United States Patent 7,888,497 (BIOINFORMATICALLY DETECTABLE GROUP OF NOVEL REGULATORY OLIGONUCLEOTIDES AND USES THEREOF) - sequence listing, part 112

SEQ ID NO: 4741031 - DNA, 17 bp, Homo sapiens
atcacaccactgtactc

SEQ ID NO: 4741032 - DNA, 16 bp, Homo sapiens
atcacagtcatcttta

SEQ ID NO: 4741033 - DNA, 16 bp, Homo sapiens
atcacattaaagttaa

SEQ ID NO: 4741034 - DNA, 23 bp, Homo sapiens
atcacccgctaagagggagggag

SEQ ID NO: 4741035 - DNA, 20 bp, Homo sapiens
atcaccgtgggctccctgac

SEQ ID NO: 4741036 - DNA, 22 bp, Homo sapiens
atcaccgtgggctccctgactg

SEQ ID NO: 4741037 - DNA, 14 bp, Homo sapiens
atcacctcccacca

SEQ ID NO: 4741038 - DNA, 13 bp, Homo sapiens
atcaccttccaaa

SEQ ID NO: 4741039 - DNA, 15 bp, Homo sapiens
atcacgccactgcac

SEQ ID NO: 4741040 - DNA, 17 bp, Homo sapiens
atcacgccactgcacta

SEQ ID NO: 4741041 - DNA, 19 bp, Homo sapiens
atcacggctcactgcagcc

SEQ ID NO: 4741042 - DNA, 22 bp, Homo sapiens
atcacggctcactgcagcctca

SEQ ID NO: 4741043 - DNA, 15 bp, Homo sapiens
atcacgtctgacaaa

SEQ ID NO: 4741044 - DNA, 21 bp, Homo sapiens
atcacgtctgacaaatgtgta

SEQ ID NO: 4741045 - DNA, 12 bp, Homo sapiens
atcactcccctc

SEQ ID NO: 4741046 - DNA, 14 bp, Homo sapiens
atcactcccctcca

SEQ ID NO: 4741047 - DNA, 17 bp, Homo sapiens
atcactgagccatcatt

SEQ ID NO: 4741048 - DNA, 23 bp, Homo sapiens
atcactgagccatcatttcctgg

SEQ ID NO: 4741049 - DNA, 18 bp, Homo sapiens
atcacttctgagaactca

SEQ ID NO: 4741050 - DNA, 21 bp, Homo sapiens
atcagaagtatggaattttct

SEQ ID NO: 4741051 - DNA, 16 bp, Homo sapiens
atcagactaagccagc

SEQ ID NO: 4741052 - DNA, 15 bp, Homo sapiens
atcagctaccattca

SEQ ID NO: 4741053 - DNA, 18 bp, Homo sapiens
atcagctccactttcagt

SEQ ID NO: 4741054 - DNA, 15 bp, Homo sapiens
atcagctccttcctg

SEQ ID NO: 4741055 - DNA, 22 bp, Homo sapiens
atcaggagaaaaagcctccagt

SEQ ID NO: 4741056 - DNA, 17 bp, Homo sapiens
atcaggagttccagtgc

SEQ ID NO: 4741057 - DNA, 13 bp, Homo sapiens
atcaggccaggcc

SEQ ID NO: 4741058 - DNA, 14 bp, Homo sapiens
atcaggccaggccc

SEQ ID NO: 4741059 - DNA, 15 bp, Homo sapiens
atcaggccaggccct

SEQ ID NO: 4741060 - DNA, 18 bp, Homo sapiens
atcaggccaggccctctg

SEQ ID NO: 4741061 - DNA, 20 bp, Homo sapiens
atcaggccaggccctctgcc

SEQ ID NO: 4741062 - DNA, 15 bp, Homo sapiens
atcaggtgctgccat

SEQ ID NO: 4741063 - DNA, 19 bp, Homo sapiens
atcaggtgctgccatccag

SEQ ID NO: 4741064 - DNA, 18 bp, Homo sapiens
atcagtagccagcatctg

SEQ ID NO: 4741065 - DNA, 15 bp, Homo sapiens
atcagtatatttggt

SEQ ID NO: 4741066 - DNA, 10 bp, Homo sapiens
atcagtgcca

SEQ ID NO: 4741067 - DNA, 13 bp, Homo sapiens
atcagtgtgaatg

SEQ ID NO: 4741068 - DNA, 13 bp, Homo sapiens
atcagtgtgcccc

SEQ ID NO: 4741069 - DNA, 15 bp, Homo sapiens
atcagtgtgcccccc

SEQ ID NO: 4741070 - DNA, 15 bp, Homo sapiens
atcagttagagctga

SEQ ID NO: 4741071 - DNA, 13 bp, Homo sapiens
atcatacaaatac

SEQ ID NO: 4741072 - DNA, 23 bp, Homo sapiens
atcatacagatcaggcagtgttt

SEQ ID NO: 4741073 - DNA, 14 bp, Homo sapiens
atcatataaacatt

SEQ ID NO: 4741074 - DNA, 17 bp, Homo sapiens
atcatataaacatttta

SEQ ID NO: 4741075 - DNA, 13 bp, Homo sapiens
atcatcaaggcac

SEQ ID NO: 4741076 - DNA, 18 bp, Homo sapiens
atcatcagtggagccatg

SEQ ID NO: 4741077 - DNA, 15 bp, Homo sapiens
atcatccctccctgc

SEQ ID NO: 4741078 - DNA, 16 bp, Homo sapiens
atcatccctccctgcc

SEQ ID NO: 4741079 - DNA, 17 bp, Homo sapiens
atcatccctccctgcct

SEQ ID NO: 4741080 - DNA, 20 bp, Homo sapiens
atcatctcctgccttcctcc

SEQ ID NO: 4741081 - DNA, 22 bp, Homo sapiens
atcatctttgctgaatgtcatt

SEQ ID NO: 4741082 - DNA, 18 bp, Homo sapiens
atcatggtgtaataagac

SEQ ID NO: 4741083 - DNA, 21 bp, Homo sapiens
atcatggtgtaataagacata

SEQ ID NO: 4741084 - DNA, 19 bp, Homo sapiens
atcatttcctgggagaaag

SEQ ID NO: 4741085 - DNA, 23 bp, Homo sapiens
atcatttcctgggagaaagacca

SEQ ID NO: 4741086 - DNA, 16 bp, Homo sapiens
atcatttgtgaagaat

SEQ ID NO: 4741087 - DNA, 18 bp, Homo sapiens
atcatttgtgaagaatta

SEQ ID NO: 4741088 - DNA, 20 bp, Homo sapiens
atccaaatgcattcatgttt

SEQ ID NO: 4741089 - DNA, 18 bp, Homo sapiens
atccaaatgctgtgcaaa

SEQ ID NO: 4741090 - DNA, 19 bp, Homo sapiens
atccaaatgctgtgcaaac

SEQ ID NO: 4741091 - DNA, 20 bp, Homo sapiens
atccaaatgctgtgcaaaca

SEQ ID NO: 4741092 - DNA, 22 bp, Homo sapiens
atccaaatttttttttaaagca

SEQ ID NO: 4741093 - DNA, 21 bp, Homo sapiens
atccaaggtggggtggaagct

SEQ ID NO: 4741094 - DNA, 14 bp, Homo sapiens
atccaatactgccc

SEQ ID NO: 4741095 - DNA, 14 bp, Homo sapiens
atccaatattgtaa

SEQ ID NO: 4741096 - DNA, 15 bp, Homo sapiens
atccaatattgtaat

SEQ ID NO: 4741097 - DNA, 14 bp, Homo sapiens
atccaatgtcgctg

SEQ ID NO: 4741098 - DNA, 16 bp, Homo sapiens
atccaattcatctttt

SEQ ID NO: 4741099 - DNA, 20 bp, Homo sapiens
atccacatctttactcaggc

SEQ ID NO: 4741100 - DNA, 15 bp, Homo sapiens
atccacccacctcag

SEQ ID NO: 4741101 - DNA, 10 bp, Homo sapiens
atccacctcc

SEQ ID NO: 4741102 - DNA, 16 bp, Homo sapiens
atccactcccaggcag

SEQ ID NO: 4741103 - DNA, 15 bp, Homo sapiens
atccaggttcagctt

SEQ ID NO: 4741104 - DNA, 14 bp, Homo sapiens
atccagtagggaaa

SEQ ID NO: 4741105 - DNA, 16 bp, Homo sapiens
atccagtagggaaaat

SEQ ID NO: 4741106 - DNA, 14 bp, Homo sapiens
atccagtattatat

SEQ ID NO: 4741107 - DNA, 19 bp, Homo sapiens
atccagtgttacaatcagt

SEQ ID NO: 4741108 - DNA, 23 bp, Homo sapiens
atccatttttaaggctgtgtgaa

SEQ ID NO: 4741109 - DNA, 19 bp, Homo sapiens
atcccaccttgccaaagca

SEQ ID NO: 4741110 - DNA, 13 bp, Homo sapiens
atcccagccttgg

SEQ ID NO: 4741111 - DNA, 15 bp, Homo sapiens
atcccagccttggca

SEQ ID NO: 4741112 - DNA, 17 bp, Homo sapiens
atcccatgagcctcagc

SEQ ID NO: 4741113 - DNA, 19 bp, Homo sapiens
atcccgagcacctccacat

SEQ ID NO: 4741114 - DNA, 16 bp, Homo sapiens
atccctcaattgaatg

SEQ ID NO: 4741115 - DNA, 13 bp, Homo sapiens
atccctcatctgt

SEQ ID NO: 4741116 - DNA, 23 bp, Homo sapiens
atccctctacagagcttccctga

SEQ ID NO: 4741117 - DNA, 14 bp, Homo sapiens
atccctctctggat

SEQ ID NO: 4741118 - DNA, 16 bp, Homo sapiens
atccctctctggattg

SEQ ID NO: 4741119 - DNA, 19 bp, Homo sapiens
atcccttggacattttatg

SEQ ID NO: 4741120 - DNA, 22 bp, Homo sapiens
atccctttttcataaattattt

SEQ ID NO: 4741121 - DNA, 23 bp, Homo sapiens
atccgacttgaattttcccactg

SEQ ID NO: 4741122 - DNA, 13 bp, Homo sapiens
atcctaatgaatg

SEQ ID NO: 4741123 - DNA, 14 bp, Homo sapiens
atcctacaagacac

SEQ ID NO: 4741124 - DNA, 15 bp, Homo sapiens
atcctagttccacca

SEQ ID NO: 4741125 - DNA, 19 bp, Homo sapiens
atcctagttccaccatcaa

SEQ ID NO: 4741126 - DNA, 15 bp, Homo sapiens
atcctcaaacactgc

SEQ ID NO: 4741127 - DNA, 21 bp, Homo sapiens
atcctcaaacactgcaggcat

SEQ ID NO: 4741128 - DNA, 15 bp, Homo sapiens
atcctcaatccagct

SEQ ID NO: 4741129 - DNA, 22 bp, Homo sapiens
atcctccaggtgcacaagctcc

SEQ ID NO: 4741130 - DNA, 22 bp, Homo sapiens
atcctccatgggggctcagcca

SEQ ID NO: 4741131 - DNA, 15 bp, Homo sapiens
atcctccatttttgt

SEQ ID NO: 4741132 - DNA, 15 bp, Homo sapiens
atcctcccacctcag

SEQ ID NO: 4741133 - DNA, 18 bp, Homo sapiens
atcctcccacctcagcct

SEQ ID NO: 4741134 - DNA, 17 bp, Homo sapiens
atcctctgtacagagcc

SEQ ID NO: 4741135 - DNA, 18 bp, Homo sapiens
atcctctgtacagagccc

SEQ ID NO: 4741136 - DNA, 13 bp, Homo sapiens
atcctgctaagtt

SEQ ID NO: 4741137 - DNA, 19 bp, Homo sapiens
atcctggaggggtgttgta

SEQ ID NO: 4741138 - DNA, 20 bp, Homo sapiens
atcctggaggggtgttgtat

SEQ ID NO: 4741139 - DNA, 17 bp, Homo sapiens
atcctggcacccggccc

SEQ ID NO: 4741140 - DNA, 12 bp, Homo sapiens
atcctggcccat

SEQ ID NO: 4741141 - DNA, 16 bp, Homo sapiens
atcctggcccatcagt

SEQ ID NO: 4741142 - DNA, 21 bp, Homo sapiens
atcctgtaccaaatctgacat

SEQ ID NO: 4741143 - DNA, 16 bp, Homo sapiens
atcctgtgaagtaagg

SEQ ID NO: 4741144 - DNA, 16 bp, Homo sapiens
atcctgttaacactgt

SEQ ID NO: 4741145 - DNA, 15 bp, Homo sapiens
atccttccacctcag

SEQ ID NO: 4741146 - DNA, 16 bp, Homo sapiens
atccttgagtcaaaaa

SEQ ID NO: 4741147 - DNA, 13 bp, Homo sapiens
atcgaaataacaa

SEQ ID NO: 4741148 - DNA, 17 bp, Homo sapiens
atcgaaataacaatgtt

SEQ ID NO: 4741149 - DNA, 19 bp, Homo sapiens
atcgaaataacaatgttaa

SEQ ID NO: 4741150 - DNA, 15 bp, Homo sapiens
atcgccttatgagaa

SEQ ID NO: 4741151 - DNA, 16 bp, Homo sapiens
atcgtgatcactgagc

SEQ ID NO: 4741152 - DNA, 15 bp, Homo sapiens
atctaaactgccccc

SEQ ID NO: 4741153 - DNA, 20 bp, Homo sapiens
atctaatatgtaacaagcca

SEQ ID NO: 4741154 - DNA, 23 bp, Homo sapiens
atctaatatgtaacaagccaccc

SEQ ID NO: 4741155 - DNA, 21 bp, Homo sapiens
atctaattcttatttttaatt

SEQ ID NO: 4741156 - DNA, 19 bp, Homo sapiens
atctacttctgtaattgtg

SEQ ID NO: 4741157 - DNA, 20 bp, Homo sapiens
atctagagcttgatgccagt

SEQ ID NO: 4741158 - DNA, 16 bp, Homo sapiens
atctagcagtaaaaga

SEQ ID NO: 4741159 - DNA, 17 bp, Homo sapiens
atctaggaagactttgg

SEQ ID NO: 4741160 - DNA, 19 bp, Homo sapiens
atctaggaagactttggaa

SEQ ID NO: 4741161 - DNA, 13 bp, Homo sapiens
atctatgactgtg

SEQ ID NO: 4741162 - DNA, 21 bp, Homo sapiens
atctatttgtagattaggatt

SEQ ID NO: 4741163 - DNA, 23 bp, Homo sapiens
atctatttgtagattaggattaa

SEQ ID NO: 4741164 - DNA, 22 bp, Homo sapiens
atctattttgagttaatttttg

SEQ ID NO: 4741165 - DNA, 14 bp, Homo sapiens
atctcaattcttcc

SEQ ID NO: 4741166 - DNA, 22 bp, Homo sapiens
atctcacaaaacatattttaca

SEQ ID NO: 4741167 - DNA, 16 bp, Homo sapiens
atctcagtcatgcata

SEQ ID NO: 4741168 - DNA, 19 bp, Homo sapiens
atctcattggacccttcca

SEQ ID NO: 4741169 - DNA, 20 bp, Homo sapiens
atctcccagataatgtgaaa

SEQ ID NO: 4741170 - DNA, 17 bp, Homo sapiens
atctcccccagccccat

SEQ ID NO: 4741171 - DNA, 17 bp, Homo sapiens
atctcctgccttcctcc

SEQ ID NO: 4741172 - DNA, 14 bp, Homo sapiens
atctcggctcactg

SEQ ID NO: 4741173 - DNA, 21 bp, Homo sapiens
atctctaggatgtcgtctttg

SEQ ID NO: 4741174 - DNA, 15 bp, Homo sapiens
atctctcttcttttc

SEQ ID NO: 4741175 - DNA, 14 bp, Homo sapiens
atctctgactaaaa

SEQ ID NO: 4741176 - DNA, 17 bp, Homo sapiens
atctctgctttggaaat

SEQ ID NO: 4741177 - DNA, 19 bp, Homo sapiens
atctcttagctcccctcca

SEQ ID NO: 4741178 - DNA, 19 bp, Homo sapiens
atctcttgtgcttttttga

SEQ ID NO: 4741179 - DNA, 22 bp, Homo sapiens
atctcttgtgcttttttgattt

SEQ ID NO: 4741180 - DNA, 17 bp, Homo sapiens
atctgaaaatacatttc

SEQ ID NO: 4741181 - DNA, 16 bp, Homo sapiens
atctgaagaaagttat

SEQ ID NO: 4741182 - DNA, 12 bp, Homo sapiens
atctgacatatt

SEQ ID NO: 4741183 - DNA, 20 bp, Homo sapiens
atctgacatattatgcctga

SEQ ID NO: 4741184 - DNA, 18 bp, Homo sapiens
atctgatgcaagcaagaa

SEQ ID NO: 4741185 - DNA, 22 bp, Homo sapiens
atctgcaatgtttttgtgtaga

SEQ ID NO: 4741186 - DNA, 22 bp, Homo sapiens
atctgcatgtaaaatcttcagc

SEQ ID NO: 4741187 - DNA, 12 bp, Homo sapiens
atctgcccagga

SEQ ID NO: 4741188 - DNA, 14 bp, Homo sapiens
atctgcccctccct

SEQ ID NO: 4741189 - DNA, 17 bp, Homo sapiens
atctgcgtgacaataaa

SEQ ID NO: 4741190 - DNA, 13 bp, Homo sapiens
atctgctctcctt

SEQ ID NO: 4741191 - DNA, 15 bp, Homo sapiens
atctggagagctaga

SEQ ID NO: 4741192 - DNA, 22 bp, Homo sapiens
atctggagagctagaacctgga

SEQ ID NO: 4741193 - DNA, 22 bp, Homo sapiens
atctgggctcctaaccttcctg

SEQ ID NO: 4741194 - DNA, 17 bp, Homo sapiens
atctgggttcactgcaa

SEQ ID NO: 4741195 - DNA, 17 bp, Homo sapiens
atctgtgaaaggaaaga

SEQ ID NO: 4741196 - DNA, 19 bp, Homo sapiens
atctgtgggtctccatcct

SEQ ID NO: 4741197 - DNA, 13 bp, Homo sapiens
atctgttgcaaac

SEQ ID NO: 4741198 - DNA, 18 bp, Homo sapiens
atctgttgcaaactcagc

SEQ ID NO: 4741199 - DNA, 19 bp, Homo sapiens
atcttaaaccttaagatac

SEQ ID NO: 4741200 - DNA, 15 bp, Homo sapiens
atcttataatttaaa

SEQ ID NO: 4741201 - DNA, 22 bp, Homo sapiens
atcttataatttaaaatatgct

SEQ ID NO: 4741202 - DNA, 13 bp, Homo sapiens
atcttcacctcag

SEQ ID NO: 4741203 - DNA, 14 bp, Homo sapiens
atcttcacctcaga

SEQ ID NO: 4741204 - DNA, 19 bp, Homo sapiens
atcttcagctggtggatgg

SEQ ID NO: 4741205 - DNA, 18 bp, Homo sapiens
atcttccaggtggggtga

SEQ ID NO: 4741206 - DNA, 13 bp, Homo sapiens
atcttgctctgct

SEQ ID NO: 4741207 - DNA, 14 bp, Homo sapiens
atcttgctctgctg

SEQ ID NO: 4741208 - DNA, 17 bp, Homo sapiens
atcttgctctgctgaca

SEQ ID NO: 4741209 - DNA, 14 bp, Homo sapiens
atctttctgttact

SEQ ID NO: 4741210 - DNA, 18 bp, Homo sapiens
atctttcttgatcaacat

SEQ ID NO: 4741211 - DNA, 14 bp, Homo sapiens
atctttgattctcc

SEQ ID NO: 4741212 - DNA, 20 bp, Homo sapiens
atctttgattctccttcagc

SEQ ID NO: 4741213 - DNA, 17 bp, Homo sapiens
atctttgcagacaggca

SEQ ID NO: 4741214 - DNA, 18 bp, Homo sapiens
atctttgcagacaggcaa

SEQ ID NO: 4741215 - DNA, 16 bp, Homo sapiens
atctttgccaacatgg

SEQ ID NO: 4741216 - DNA, 16 bp, Homo sapiens
atctttgccaccctca

SEQ ID NO: 4741217 - DNA, 22 bp, Homo sapiens
atctttggacagaagcagctct

SEQ ID NO: 4741218 - DNA, 13 bp, Homo sapiens
atcttttcacaaa

SEQ ID NO: 4741219 - DNA, 14 bp, Homo sapiens
atcttttcacaaat

SEQ ID NO: 4741220 - DNA, 23 bp, Homo sapiens
atcttttcttgcctctgtcccct

SEQ ID NO: 4741221 - DNA, 13 bp, Homo sapiens
atctttttcactg

SEQ ID NO: 4741222 - DNA, 11 bp, Homo sapiens
atgaaaacatt

SEQ ID NO: 4741223 - DNA, 20 bp, Homo sapiens
atgaaaacattgatgaatga

SEQ ID NO: 4741224 - DNA, 12 bp, Homo sapiens
atgaaaacctgc

SEQ ID NO: 4741225 - DNA, 16 bp, Homo sapiens
atgaaaagtatattga

SEQ ID NO: 4741226 - DNA, 12 bp, Homo sapiens
atgaaaatggaa

SEQ ID NO: 4741227 - DNA, 13 bp, Homo sapiens
atgaaaatgtctt

SEQ ID NO: 4741228 - DNA, 16 bp, Homo sapiens
atgaaaccgtccctga

SEQ ID NO: 4741229 - DNA, 15 bp, Homo sapiens
atgaaagggcccaga

SEQ ID NO: 4741230 - DNA, 16 bp, Homo sapiens
atgaaataaaatatat

SEQ ID NO: 4741231 - DNA, 18 bp, Homo sapiens
atgaaatgcatatttgca

SEQ ID NO: 4741232 - DNA, 16 bp, Homo sapiens
atgaacacatggcaga

SEQ ID NO: 4741233 - DNA, 13 bp, Homo sapiens
atgaaccacatct

SEQ ID NO: 4741234 - DNA, 13 bp, Homo sapiens
atgaacctggagg

SEQ ID NO: 4741235 - DNA, 18 bp, Homo sapiens
atgaacttgtaaaggaat

SEQ ID NO: 4741236 - DNA, 14 bp, Homo sapiens
atgaagacagaggc

SEQ ID NO: 4741237 - DNA, 20 bp, Homo sapiens
atgaagacagaggcagagat

SEQ ID NO: 4741238 - DNA, 16 bp, Homo sapiens
atgaaggatccatctt

SEQ ID NO: 4741239 - DNA, 22 bp, Homo sapiens
atgaaggatccatctttgtata

SEQ ID NO: 4741240 - DNA, 18 bp, Homo sapiens
atgaagttgattcatatt

SEQ ID NO: 4741241 - DNA, 20 bp, Homo sapiens
atgaagttgattcatattgc

SEQ ID NO: 4741242 - DNA, 12 bp, Homo sapiens
atgaataaaata

SEQ ID NO: 4741243 - DNA, 14 bp, Homo sapiens
atgaataaaataat

SEQ ID NO: 4741244 - DNA, 21 bp, Homo sapiens
atgaatactgtattttgtatt

SEQ ID NO: 4741245 - DNA, 14 bp, Homo sapiens
atgaatgaatgaat

SEQ ID NO: 4741246 - DNA, 14 bp, Homo sapiens
atgacagaggcaag

SEQ ID NO: 4741247 - DNA, 23 bp, Homo sapiens
atgacagatatatttaagcctta

SEQ ID NO: 4741248 - DNA, 17 bp, Homo sapiens
atgacagtgttccccga

SEQ ID NO: 4741249 - DNA, 18 bp, Homo sapiens
atgacattcatgcctggc

SEQ ID NO: 4741250 - DNA, 18 bp, Homo sapiens
atgacatttatttttcat

SEQ ID NO: 4741251 - DNA, 14 bp, Homo sapiens
atgacattttgcca

SEQ ID NO: 4741252 - DNA, 14 bp, Homo sapiens
atgacccaggctgg

SEQ ID NO: 4741253 - DNA, 18 bp, Homo sapiens
atgacctacagtgctgtg

SEQ ID NO: 4741254 - DNA, 18 bp, Homo sapiens
atgactgagtctggcaaa

SEQ ID NO: 4741255 - DNA, 23 bp, Homo sapiens
atgactgagtctggcaaacatgt

SEQ ID NO: 4741256 - DNA, 15 bp, Homo sapiens
atgactggttgttca

SEQ ID NO: 4741257 - DNA, 22 bp, Homo sapiens
atgagaaaggttgaagcaccaa

SEQ ID NO: 4741258 - DNA, 23 bp, Homo sapiens
atgagaagtactttgtgctgatc

SEQ ID NO: 4741259 - DNA, 22 bp, Homo sapiens
atgagaagttgatatagaacag

SEQ ID NO: 4741260 - DNA, 21 bp, Homo sapiens
atgagaatttgagtgctctga

SEQ ID NO: 4741261 - DNA, 19 bp, Homo sapiens
atgagagagagactgtgtg

SEQ ID NO: 4741262 - DNA, 16 bp, Homo sapiens
atgagagcccagaggt

SEQ ID NO: 4741263 - DNA, 20 bp, Homo sapiens
atgagagcccagaggtaaca

SEQ ID NO: 4741264 - DNA, 22 bp, Homo sapiens
atgagagcccagaggtaacaga

SEQ ID NO: 4741265 - DNA, 16 bp, Homo sapiens
atgagcatcaggccag

SEQ ID NO: 4741266 - DNA, 17 bp, Homo sapiens
atgagcatcaggccagg

SEQ ID NO: 4741267 - DNA, 20 bp, Homo sapiens
atgagcatcaggccaggccc

SEQ ID NO: 4741268 - DNA, 15 bp, Homo sapiens
atgagcatcccagga

SEQ ID NO: 4741269 - DNA, 15 bp, Homo sapiens
atgagcctcagcatc

SEQ ID NO: 4741270 - DNA, 19 bp, Homo sapiens
atgagcctcagcatcctgg

SEQ ID NO: 4741271 - DNA, 20 bp, Homo sapiens
atgaggccctccacacctgc

SEQ ID NO: 4741272 - DNA, 16 bp, Homo sapiens
atgaggtcagagcctg

SEQ ID NO: 4741273 - DNA, 22 bp, Homo sapiens
atgaggtcagagcctgcagtta

SEQ ID NO: 4741274 - DNA, 16 bp, Homo sapiens
atgagtgcgtgctcag

SEQ ID NO: 4741275 - DNA, 17 bp, Homo sapiens
atgagtgcgtgctcagt

SEQ ID NO: 4741276 - DNA, 22 bp, Homo sapiens
atgagtgcgtggtgcgagtgcg

SEQ ID NO: 4741277 - DNA, 14 bp, Homo sapiens
atgatcaaattttg

SEQ ID NO: 4741278 - DNA, 13 bp, Homo sapiens
atgatcagttttt

SEQ ID NO: 4741279 - DNA, 19 bp, Homo sapiens
atgatctttgcagacaggc

SEQ ID NO: 4741280 - DNA, 18 bp, Homo sapiens
atgatgaaatgaggtcag

SEQ ID NO: 4741281 - DNA, 19 bp, Homo sapiens
atgatgaaggtaattaaag

SEQ ID NO: 4741282 - DNA, 20 bp, Homo sapiens
atgatgcatggagtgtttga

SEQ ID NO: 4741283 - DNA, 22 bp, Homo sapiens
atgatgccacaccaagctgtgc

SEQ ID NO: 4741284 - DNA, 24 bp, Homo sapiens
atgatgccacaccaagctgtgcca

SEQ ID NO: 4741285 - DNA, 13 bp, Homo sapiens
atgatggaaagga

SEQ ID NO: 4741286 - DNA, 14 bp, Homo sapiens
atgatggaaaggaa

SEQ ID NO: 4741287 - DNA, 14 bp, Homo sapiens
atgatgtgcctggg

SEQ ID NO: 4741288 - DNA, 20 bp, Homo sapiens
atgattagttaaaaaaagaa

SEQ ID NO: 4741289 - DNA, 20 bp, Homo sapiens
atgattcactatttaaacta

SEQ ID NO: 4741290 - DNA, 16 bp, Homo sapiens
atgattcttccagata

SEQ ID NO: 4741291 - DNA, 17 bp, Homo sapiens
atgatttcagctcactg

SEQ ID NO: 4741292 - DNA, 19 bp, Homo sapiens
atgatttcagctcactgca

SEQ ID NO: 4741293 - DNA, 17 bp, Homo sapiens
atgattttgatgcacaa

SEQ ID NO: 4741294 - DNA, 18 bp, Homo sapiens
atgatttttgtgtatcca

SEQ ID NO: 4741295 - DNA, 22 bp, Homo sapiens
atgcaagcaaagtatcaaagaa

SEQ ID NO: 4741296 - DNA, 22 bp, Homo sapiens
atgcaagtgggagatgaaaacc

SEQ ID NO: 4741297 - DNA, 19 bp, Homo sapiens
atgcacagttgccacattt

SEQ ID NO: 4741298 - DNA, 14 bp, Homo sapiens
atgcacatccctgg

SEQ ID NO: 4741299 - DNA, 14 bp, Homo sapiens
atgcaccattagaa

SEQ ID NO: 4741300 - DNA, 22 bp, Homo sapiens
atgcactgttccccctgtgcag

SEQ ID NO: 4741301 - DNA, 17 bp, Homo sapiens
atgcagcatctaagtaa

SEQ ID NO: 4741302 - DNA, 14 bp, Homo sapiens
atgcaggtctccat

SEQ ID NO: 4741303 - DNA, 22 bp, Homo sapiens
atgcaggtttgaccaggaaagc

SEQ ID NO: 4741304 - DNA, 18 bp, Homo sapiens
atgcagtgatatggcaga

SEQ ID NO: 4741305 - DNA, 21 bp, Homo sapiens
atgcagtgatatggcagaaga

SEQ ID NO: 4741306 - DNA, 15 bp, Homo sapiens
atgcatataatgaat

SEQ ID NO: 4741307 - DNA, 18 bp, Homo sapiens
atgcatataatgaataaa

SEQ ID NO: 4741308 - DNA, 21 bp, Homo sapiens
atgcatatttgcaaagtgtat

SEQ ID NO: 4741309 - DNA, 16 bp, Homo sapiens
atgcatggaaattccc

SEQ ID NO: 4741310 - DNA, 19 bp, Homo sapiens
atgcatgttttccagctcc

SEQ ID NO: 4741311 - DNA, 20 bp, Homo sapiens
atgcatgttttccagctcct

SEQ ID NO: 4741312 - DNA, 22 bp, Homo sapiens
atgcatttaaagtattctccat

SEQ ID NO: 4741313 - DNA, 16 bp, Homo sapiens
atgcattttcttgtat

SEQ ID NO: 4741314 - DNA, 18 bp, Homo sapiens
atgcattttcttgtatga

SEQ ID NO: 4741315 - DNA, 17 bp, Homo sapiens
atgccaagcactgtgct

SEQ ID NO: 4741316 - DNA, 15 bp, Homo sapiens
atgccatcatctcct

SEQ ID NO: 4741317 - DNA, 21 bp, Homo sapiens
atgccatcctcaaacactgca

SEQ ID NO: 4741318 - DNA, 23 bp, Homo sapiens
atgccatcctcaaacactgcagg

SEQ ID NO: 4741319 - DNA, 11 bp, Homo sapiens
atgcccagccc

SEQ ID NO: 4741320 - DNA, 12 bp, Homo sapiens
atgcccagcccc

SEQ ID NO: 4741321 - DNA, 15 bp, Homo sapiens
atgcccagccccttc

SEQ ID NO: 4741322 - DNA, 16 bp, Homo sapiens
atgcccagccccttct

SEQ ID NO: 4741323 - DNA, 17 bp, Homo sapiens
atgcccagccccttctg

SEQ ID NO: 4741324 - DNA, 15 bp, Homo sapiens
atgccccctcgtgcc

SEQ ID NO: 4741325 - DNA, 17 bp, Homo sapiens
atgccccctcgtgccag

SEQ ID NO: 4741326 - DNA, 18 bp, Homo sapiens
atgccccgtccccctctg

SEQ ID NO: 4741327 - DNA, 15 bp, Homo sapiens
atgcccttcctttct

SEQ ID NO: 4741328 - DNA, 16 bp, Homo sapiens
atgcctaccttgtgag

SEQ ID NO: 4741329 - DNA, 21 bp, Homo sapiens
atgcctatggtggatccaaac

SEQ ID NO: 4741330 - DNA, 19 bp, Homo sapiens
atgcctggatggggctgca

SEQ ID NO: 4741331 - DNA, 23 bp, Homo sapiens
atgcctggatggggctgcaccgg

SEQ ID NO: 4741332 - DNA, 13 bp, Homo sapiens
atgcctggcttcg

SEQ ID NO: 4741333 - DNA, 11 bp, Homo sapiens
atgcctggtgg

SEQ ID NO: 4741334 - DNA, 19 bp, Homo sapiens
atgcctggtggcagctgcg

SEQ ID NO: 4741335 - DNA, 12 bp, Homo sapiens
atgcctttgaga

SEQ ID NO: 4741336 - DNA, 19 bp, Homo sapiens
atgcctttgagacagtttc

SEQ ID NO: 4741337 - DNA, 16 bp, Homo sapiens
atgcgtgtgtgtgtgt

SEQ ID NO: 4741338 - DNA, 18 bp, Homo sapiens
atgctacaggatttgaaa

SEQ ID NO: 4741339 - DNA, 16 bp, Homo sapiens
atgctcattgctttct

SEQ ID NO: 4741340 - DNA, 21 bp, Homo sapiens
atgctctcatatatattttaa

SEQ ID NO: 4741341 - DNA, 12 bp, Homo sapiens
atgctctgatta

SEQ ID NO: 4741342 - DNA, 19 bp, Homo sapiens
atgctgaagccaaagccaa

SEQ ID NO: 4741343 - DNA, 17 bp, Homo sapiens
atgctgagagctgggct

SEQ ID NO: 4741344 - DNA, 14 bp, Homo sapiens
atgctgatgtcctc

SEQ ID NO: 4741345 - DNA, 20 bp, Homo sapiens
atgctgcagatttgggctgg

SEQ ID NO: 4741346 - DNA, 18 bp, Homo sapiens
atgctggctgttggctgg

SEQ ID NO: 4741347 - DNA, 15 bp, Homo sapiens
atgctgggctgggtg

SEQ ID NO: 4741348 - DNA, 14 bp, Homo sapiens
atgctgtgtgactc

SEQ ID NO: 4741349 - DNA, 15 bp, Homo sapiens
atgcttagaggggtg

SEQ ID NO: 4741350 - DNA, 22 bp, Homo sapiens
atgcttagaggggtgaaaatta

SEQ ID NO: 4741351 - DNA, 22 bp, Homo sapiens
atgcttatgcttgtgtatatgt

SEQ ID NO: 4741352 - DNA, 17 bp, Homo sapiens
atgcttccattaacaaa

SEQ ID NO: 4741353 - DNA, 17 bp, Homo sapiens
atgcttcttcagagact

SEQ ID NO: 4741354 - DNA, 13 bp, Homo sapiens
atgcttggttttc

SEQ ID NO: 4741355 - DNA, 18 bp, Homo sapiens
atgcttgtgtatatgtat

SEQ ID NO: 4741356 - DNA, 22 bp, Homo sapiens
atgcttttatagctgcttggat

SEQ ID NO: 4741357 - DNA, 20 bp, Homo sapiens
atggaaacactgattttgta

SEQ ID NO: 4741358 - DNA, 17 bp, Homo sapiens
atggaaagaaatatgat

SEQ ID NO: 4741359 - DNA, 20 bp, Homo sapiens
atggaaatgggcagagcaga

SEQ ID NO: 4741360 - DNA, 13 bp, Homo sapiens
atggaacctcctt

SEQ ID NO: 4741361 - DNA, 15 bp, Homo sapiens
atggaattggacata

SEQ ID NO: 4741362 - DNA, 20 bp, Homo sapiens
atggacatcgatatgaaaaa

SEQ ID NO: 4741363 - DNA, 20 bp, Homo sapiens
atggaccggagagtgggggt

SEQ ID NO: 4741364 - DNA, 15 bp, Homo sapiens
atggacggtgctcca

SEQ ID NO: 4741365 - DNA, 19 bp, Homo sapiens
atggactaacttgtctttg

SEQ ID NO: 4741366 - DNA, 21 bp, Homo sapiens
atggactatgcacacttttaa

SEQ ID NO: 4741367 - DNA, 12 bp, Homo sapiens
atggactttgtt

SEQ ID NO: 4741368 - DNA, 20 bp, Homo sapiens
atggagagctagaacccggc

SEQ ID NO: 4741369 - DNA, 13 bp, Homo sapiens
atggagagctgga

SEQ ID NO: 4741370 - DNA, 22 bp, Homo sapiens
atggagctcagagagggcaggc

SEQ ID NO: 4741371 - DNA, 15 bp, Homo sapiens
atggaggagacagga

SEQ ID NO: 4741372 - DNA, 22 bp, Homo sapiens
atggaggagacaggaagcctca

SEQ ID NO: 4741373 - DNA, 14 bp, Homo sapiens
atggagggtttagt

SEQ ID NO: 4741374 - DNA, 17 bp, Homo sapiens
atggagtgagacccagg

SEQ ID NO: 4741375 - DNA, 19 bp, Homo sapiens
atggatacatatttcagtt

SEQ ID NO: 4741376 - DNA, 17 bp, Homo sapiens
atggcaggatggcctgg

SEQ ID NO: 4741377 - DNA, 17 bp, Homo sapiens
atggcagggggtggaat

SEQ ID NO: 4741378 - DNA, 22 bp, Homo sapiens
atggcatccctttttcataaat

SEQ ID NO: 4741379 - DNA, 15 bp, Homo sapiens
atggcgtcctgccct

SEQ ID NO: 4741380 - DNA, 18 bp, Homo sapiens
atggctcactatggtgcc

SEQ ID NO: 4741381 - DNA, 19 bp, Homo sapiens
atggctcactatggtgcca

SEQ ID NO: 4741382 - DNA, 19 bp, Homo sapiens
atggcttatccagctggtg

SEQ ID NO: 4741383 - DNA, 22 bp, Homo sapiens
atggcttttcccaacccccagc

SEQ ID NO: 4741384 - DNA, 22 bp, Homo sapiens
atggctttttttgcctaccatt

SEQ ID NO: 4741385 - DNA, 12 bp, Homo sapiens
atgggacctgat

SEQ ID NO: 4741386 - DNA, 23 bp, Homo sapiens
atgggaggctcacccccttctcc

SEQ ID NO: 4741387 - DNA, 18 bp, Homo sapiens
atgggatggtggagggcc

SEQ ID NO: 4741388 - DNA, 18 bp, Homo sapiens
atgggcaacccccagcct

SEQ ID NO: 4741389 - DNA, 21 bp, Homo sapiens
atgggcaacccccagcctgct

SEQ ID NO: 4741390 - DNA, 22 bp, Homo sapiens
atgggcactgctgggtggccca

SEQ ID NO: 4741391 - DNA, 23 bp, Homo sapiens
atgggcactgctgggtggcccat

SEQ ID NO: 4741392 - DNA, 14 bp, Homo sapiens
atggggaggaggag

SEQ ID NO: 4741393 - DNA, 12 bp, Homo sapiens
atggggatgcag

SEQ ID NO: 4741394 - DNA, 13 bp, Homo sapiens
atggggccctgcc

SEQ ID NO: 4741395 - DNA, 12 bp, Homo sapiens
atggggctgcac

SEQ ID NO: 4741396 - DNA, 18 bp, Homo sapiens
atgggggaaatggtgcct

SEQ ID NO: 4741397 - DNA, 18 bp, Homo sapiens
atgggtcgggagagggga

SEQ ID NO: 4741398 - DNA, 15 bp, Homo sapiens
atgggtgcttggagg

SEQ ID NO: 4741399 - DNA, 23 bp, Homo sapiens
atgggtgcttggaggaaggaaac

SEQ ID NO: 4741400 - DNA, 19 bp, Homo sapiens
atgggtttcttccagcaga

SEQ ID NO: 4741401 - DNA, 20 bp, Homo sapiens
atggtacttaaacatttttg

SEQ ID NO: 4741402 - DNA, 20 bp, Homo sapiens
atggtagccagttgaattta

SEQ ID NO: 4741403 - DNA, 16 bp, Homo sapiens
atggtcccacctgtgc

SEQ ID NO: 4741404 - DNA, 21 bp, Homo sapiens
atggtgctgcagatttgatat

SEQ ID NO: 4741405 - DNA, 13 bp, Homo sapiens
atggtggagggcc

SEQ ID NO: 4741406 - DNA, 14 bp, Homo sapiens
atggtggagggcca

SEQ ID NO: 4741407 - DNA, 12 bp, Homo sapiens
atggtgtaataa

SEQ ID NO: 4741408 - DNA, 14 bp, Homo sapiens
atggtgtaataaga

SEQ ID NO: 4741409 - DNA, 15 bp, Homo sapiens
atggttccaatgaaa

SEQ ID NO: 4741410 - DNA, 14 bp, Homo sapiens
atgtaaaaataacc

SEQ ID NO: 4741411 - DNA, 23 bp, Homo sapiens
atgtaaaaatacactaatgagta

SEQ ID NO: 4741412 - DNA, 17 bp, Homo sapiens
atgtaaaagactttttt

SEQ ID NO: 4741413 - DNA, 13 bp, Homo sapiens
atgtaaaatcttc

SEQ ID NO: 4741414 - DNA, 18 bp, Homo sapiens
atgtaaacataccaacat

SEQ ID NO: 4741415 - DNA, 12 bp, Homo sapiens
atgtaaacattt

SEQ ID NO: 4741416 - DNA, 23 bp, Homo sapiens
atgtaaagccaaaaccatcttct

SEQ ID NO: 4741417 - DNA, 21 bp, Homo sapiens
atgtaaaggtatattgtgaac

SEQ ID NO: 4741418 - DNA, 14 bp, Homo sapiens
atgtaaatagattt

SEQ ID NO: 4741419 - DNA, 21 bp, Homo sapiens
atgtaataactgcatgtgtct

SEQ ID NO: 4741420 - DNA, 19 bp, Homo sapiens
atgtaatcttgaattgtaa

SEQ ID NO: 4741421 - DNA, 21 bp, Homo sapiens
atgtaatgcttatgtgttgca

SEQ ID NO: 4741422 - DNA, 15 bp, Homo sapiens
atgtaattggaatct

SEQ ID NO: 4741423 - DNA, 16 bp, Homo sapiens
atgtacaaggtatgta

SEQ ID NO: 4741424 - DNA, 17 bp, Homo sapiens
atgtacaaggtatgtac

SEQ ID NO: 4741425 - DNA, 18 bp, Homo sapiens
atgtacagtctcaatttt

SEQ ID NO: 4741426 - DNA, 21 bp, Homo sapiens
atgtacagtctcaattttgta

SEQ ID NO: 4741427 - DNA, 22 bp, Homo sapiens
atgtacagtctcaattttgtat

SEQ ID NO: 4741428 - DNA, 16 bp, Homo sapiens
atgtactctactgata

SEQ ID NO: 4741429 - DNA, 20 bp, Homo sapiens
atgtactggagagtggcaaa

SEQ ID NO: 4741430 - DNA, 14 bp, Homo sapiens
atgtagaaattctt

SEQ ID NO: 4741431 - DNA, 16 bp, Homo sapiens
atgtagatgatatgtt

SEQ ID NO: 4741432 - DNA, 14 bp, Homo sapiens
atgtaggaagtagg

SEQ ID NO: 4741433 - DNA, 21 bp, Homo sapiens
atgtagttgtcacactaaaat

SEQ ID NO: 4741434 - DNA, 23 bp, Homo sapiens
atgtagttgtcacactaaaattt

SEQ ID NO: 4741435 - DNA, 21 bp, Homo sapiens
atgtataaattaatacagagt

SEQ ID NO: 4741436 - DNA, 14 bp, Homo sapiens
atgtatatcttcta

SEQ ID NO: 4741437 - DNA, 20 bp, Homo sapiens
atgtatatcttctacatgca

SEQ ID NO: 4741438 - DNA, 22 bp, Homo sapiens
atgtatattaaaaaagagacat

SEQ ID NO: 4741439 - DNA, 15 bp, Homo sapiens
atgtatatttgcata

SEQ ID NO: 4741440 - DNA, 18 bp, Homo sapiens
atgtatatttgcatattt

SEQ ID NO: 4741441 - DNA, 14 bp, Homo sapiens
atgtatcacattga

SEQ ID NO: 4741442 - DNA, 19 bp, Homo sapiens
atgtatgaggaatttctgt

SEQ ID NO: 4741443 - DNA, 19 bp, Homo sapiens
atgtattttggttgctgat

SEQ ID NO: 4741444 - DNA, 15 bp, Homo sapiens
atgtcacaggcaggt

SEQ ID NO: 4741445 - DNA, 16 bp, Homo sapiens
atgtcacaggcaggtc

SEQ ID NO: 4741446 - DNA, 17 bp, Homo sapiens
atgtcacaggcaggtcc

SEQ ID NO: 4741447 - DNA, 17 bp, Homo sapiens
atgtcagttgttattta

SEQ ID NO: 4741448 - DNA, 16 bp, Homo sapiens
atgtccaagaagccca

SEQ ID NO: 4741449 - DNA, 17 bp, Homo sapiens
atgtccaagaagcccag

SEQ ID NO: 4741450 - DNA, 21 bp, Homo sapiens
atgtccatagccataattcca

SEQ ID NO: 4741451 - DNA, 19 bp, Homo sapiens
atgtccctatttatgattt

SEQ ID NO: 4741452 - DNA, 16 bp, Homo sapiens
atgtcctcctctgtga

SEQ ID NO: 4741453 - DNA, 18 bp, Homo sapiens
atgtcctcctctgtgaaa

SEQ ID NO: 4741454 - DNA, 23 bp, Homo sapiens
atgtctctgtgagactcgagaac

SEQ ID NO: 4741455 - DNA, 13 bp, Homo sapiens
atgtctctgtgtg

SEQ ID NO: 4741456 - DNA, 11 bp, Homo sapiens
atgtcttgtgt

SEQ ID NO: 4741457 - DNA, 15 bp, Homo sapiens
atgtctttttattaa

SEQ ID NO: 4741458 - DNA, 12 bp, Homo sapiens
atgtgaaacctt

SEQ ID NO: 4741459 - DNA, 21 bp, Homo sapiens
atgtgaaaccttttttaagat

SEQ ID NO: 4741460 - DNA, 11 bp, Homo sapiens
atgtgaagaaa

SEQ ID NO: 4741461 - DNA, 17 bp, Homo sapiens
atgtgaagaaaaagacc

SEQ ID NO: 4741462 - DNA, 22 bp, Homo sapiens
atgtgaggggtagtgggatggt

SEQ ID NO: 4741463 - DNA, 15 bp, Homo sapiens
atgtgatcatctttg

SEQ ID NO: 4741464 - DNA, 16 bp, Homo sapiens
atgtgcaactcttgta

SEQ ID NO: 4741465 - DNA, 13 bp, Homo sapiens
atgtgcaatagaa

SEQ ID NO: 4741466 - DNA, 14 bp, Homo sapiens
atgtgcatctggtg

SEQ ID NO: 4741467 - DNA, 20 bp, Homo sapiens
atgtgccaattttgtcacag

SEQ ID NO: 4741468 - DNA, 20 bp, Homo sapiens
atgtggcctttgaattctgt

SEQ ID NO: 4741469 - DNA, 20 bp, Homo sapiens
atgtgggaattaagcaaaat

SEQ ID NO: 4741470 - DNA, 20 bp, Homo sapiens
atgtgggtcttatgcttcca

SEQ ID NO: 4741471 - DNA, 23 bp, Homo sapiens
atgtgggtcttatgcttccatta

SEQ ID NO: 4741472 - DNA, 21 bp, Homo sapiens
atgtgtataattttaaagtaa

SEQ ID NO: 4741473 - DNA, 22 bp, Homo sapiens
atgtgtataattttaaagtaat

SEQ ID NO: 4741474 - DNA, 19 bp, Homo sapiens
atgtgtatgagaagtactt

SEQ ID NO: 4741475 - DNA, 20 bp, Homo sapiens
atgtgtcaatgtaaagccaa

SEQ ID NO: 4741476 - DNA, 16 bp, Homo sapiens
atgtgtcccagtgaac

SEQ ID NO: 4741477 - DNA, 18 bp, Homo sapiens
atgtgtcccagtgaacag

SEQ ID NO: 4741478 - DNA, 13 bp, Homo sapiens
atgtgtctgcaac

SEQ ID NO: 4741479 - DNA, 22 bp, Homo sapiens
atgtgtgtccacgactgtctcc

SEQ ID NO: 4741480 - DNA, 17 bp, Homo sapiens
atgtgtgttgatactgt

SEQ ID NO: 4741481 - DNA, 19 bp, Homo sapiens
atgtgtgttgatactgttg

SEQ ID NO: 4741482 - DNA, 18 bp, Homo sapiens
atgtgttgcataaacaat

SEQ ID NO: 4741483 - DNA, 13 bp, Homo sapiens
atgttaaggaaac

SEQ ID NO: 4741484 - DNA, 13 bp, Homo sapiens
atgttaatatttt

SEQ ID NO: 4741485 - DNA, 13 bp, Homo sapiens
atgttactgagat

SEQ ID NO: 4741486 - DNA, 14 bp, Homo sapiens
atgttacttaaaca

SEQ ID NO: 4741487 - DNA, 23 bp, Homo sapiens
atgttagaggatccctctctgga

SEQ ID NO: 4741488 - DNA, 14 bp, Homo sapiens
atgttagtatttta

SEQ ID NO: 4741489 - DNA, 19 bp, Homo sapiens
atgttagtattttaatcct

SEQ ID NO: 4741490 - DNA, 21 bp, Homo sapiens
atgttcagacatttatgtgtt

SEQ ID NO: 4741491 - DNA, 19 bp, Homo sapiens
atgttctatttaacaactg

SEQ ID NO: 4741492 - DNA, 22 bp, Homo sapiens
atgttctatttcagtgccaata

SEQ ID NO: 4741493 - DNA, 18 bp, Homo sapiens
atgttctctgaggacact

SEQ ID NO: 4741494 - DNA, 13 bp, Homo sapiens
atgttctgtccct

SEQ ID NO: 4741495 - DNA, 14 bp, Homo sapiens
atgttctgtccctt

SEQ ID NO: 4741496 - DNA, 12 bp, Homo sapiens
atgttgcccagg

SEQ ID NO: 4741497 - DNA, 15 bp, Homo sapiens
atgttgcccaggcag

SEQ ID NO: 4741498 - DNA, 16 bp, Homo sapiens
atgttgcccaggcagg

SEQ ID NO: 4741499 - DNA, 17 bp, Homo sapiens
atgttgcccaggcaggt

SEQ ID NO: 4741500 - DNA, 12 bp, Homo sapiens
atgttggtgcaa

SEQ ID NO: 4741501 - DNA, 22 bp, Homo sapiens
atgttgtttataataaaaatat

SEQ ID NO: 4741502 - DNA, 20 bp, Homo sapiens
atgtttaaaatttcttagaa

SEQ ID NO: 4741503 - DNA, 12 bp, Homo sapiens
atgtttctggat

SEQ ID NO: 4741504 - DNA, 23 bp, Homo sapiens
atgtttgggagactgctgagtca

SEQ ID NO: 4741505 - DNA, 16 bp, Homo sapiens
atgttttaaaagtttg

SEQ ID NO: 4741506 - DNA, 16 bp, Homo sapiens
atgttttataattcat

SEQ ID NO: 4741507 - DNA, 15 bp, Homo sapiens
atgttttcaaatgtt

SEQ ID NO: 4741508 - DNA, 19 bp, Homo sapiens
atgttttccagctcctcat

SEQ ID NO: 4741509 - DNA, 21 bp, Homo sapiens
atgttttctgaaaatataacc

SEQ ID NO: 4741510 - DNA, 17 bp, Homo sapiens
atgtttttgtgtatttg

SEQ ID NO: 4741511 - DNA, 16 bp, Homo sapiens
atgttttttttcagca

SEQ ID NO: 4741512 - DNA, 13 bp, Homo sapiens
attaaaaaagaga

SEQ ID NO: 4741513 - DNA, 13 bp, Homo sapiens
attaaaagcaggc

SEQ ID NO: 4741514 - DNA, 17 bp, Homo sapiens
attaaaatatttcaggt

SEQ ID NO: 4741515 - DNA, 14 bp, Homo sapiens
attaaacattttca

SEQ ID NO: 4741516 - DNA, 14 bp, Homo sapiens
attaaaccaattat

SEQ ID NO: 4741517 - DNA, 22 bp, Homo sapiens
attaaagacaggagacaaaaga

SEQ ID NO: 4741518 - DNA, 17 bp, Homo sapiens
attaaatcagttctcaa

SEQ ID NO: 4741519 - DNA, 19 bp, Homo sapiens
attaaatgcccagcccctt

SEQ ID NO: 4741520 - DNA, 17 bp, Homo sapiens
attaacactaattatca

SEQ ID NO: 4741521 - DNA, 18 bp, Homo sapiens
attaacactcatttccaa

SEQ ID NO: 4741522 - DNA, 16 bp, Homo sapiens
attaactctggacctc

SEQ ID NO: 4741523 - DNA, 23 bp, Homo sapiens
attaactctggacctctcttgtg

SEQ ID NO: 4741524 - DNA, 13 bp, Homo sapiens
attaagaaacaat

SEQ ID NO: 4741525 - DNA, 13 bp, Homo sapiens
attaagttacaat

SEQ ID NO: 4741526 - DNA, 14 bp, Homo sapiens
attaagttgttaat

SEQ ID NO: 4741527 - DNA, 14 bp, Homo sapiens
attaatttgtgaat

SEQ ID NO: 4741528 - DNA, 22 bp, Homo sapiens
attacaaaatgacattttgcca

SEQ ID NO: 4741529 - DNA, 15 bp, Homo sapiens
attacaaagttaaaa

SEQ ID NO: 4741530 - DNA, 24 bp, Homo sapiens
attacaaagttaaaattgttatca

SEQ ID NO: 4741531 - DNA, 12 bp, Homo sapiens
attacacagtca

SEQ ID NO: 4741532 - DNA, 19 bp, Homo sapiens
attacaggctcctgccacc

SEQ ID NO: 4741533 - DNA, 20 bp, Homo sapiens
attaccaccacctgctcact

SEQ ID NO: 4741534 - DNA, 12 bp, Homo sapiens
attacctcctga

SEQ ID NO: 4741535 - DNA, 15 bp, Homo sapiens
attacctcttgccct

SEQ ID NO: 4741536 - DNA, 19 bp, Homo sapiens
attacctgtggatatttgt

SEQ ID NO: 4741537 - DNA, 22 bp, Homo sapiens
attaccttattggatatttgat

SEQ ID NO: 4741538 - DNA, 23 bp, Homo sapiens
attactgtttgtcttctccccag

SEQ ID NO: 4741539 - DNA, 21 bp, Homo sapiens
attactgtttgttctcttatt

SEQ ID NO: 4741540 - DNA, 12 bp, Homo sapiens
attacttttaaa

SEQ ID NO: 4741541 - DNA, 20 bp, Homo sapiens
attagagattacctcctgag

SEQ ID NO: 4741542 - DNA, 13 bp, Homo sapiens
attagagcaggcg

SEQ ID NO: 4741543 - DNA, 21 bp, Homo sapiens
attagataatcttttacattg

SEQ ID NO: 4741544 - DNA, 23 bp, Homo sapiens
attagatttctcatttgccaata

SEQ ID NO: 4741545 - DNA, 14 bp, Homo sapiens
attagccaggatca

SEQ ID NO: 4741546 - DNA, 22 bp, Homo sapiens
attagccaggatcatggtgtaa

SEQ ID NO: 4741547 - DNA, 19 bp, Homo sapiens
attaggaatcattctgtaa

SEQ ID NO: 4741548 - DNA, 17 bp, Homo sapiens
attagtaacatgtgtta

SEQ ID NO: 4741549 - DNA, 22 bp, Homo sapiens
attagtgattccatcaaagaga

SEQ ID NO: 4741550 - DNA, 14 bp, Homo sapiens
attataaaatattg

SEQ ID NO: 4741551 - DNA, 18 bp, Homo sapiens
attataacttattagcag

SEQ ID NO: 4741552 - DNA, 12 bp, Homo sapiens
attataatttta

SEQ ID NO: 4741553 - DNA, 16 bp, Homo sapiens
attatattcattcttt

SEQ ID NO: 4741554 - DNA, 22 bp, Homo sapiens
attatggacatcgatatgaaaa

SEQ ID NO: 4741555 - DNA, 19 bp, Homo sapiens
attatggcctttttaagta

SEQ ID NO: 4741556 - DNA, 14 bp, Homo sapiens
attatgtaaaagaa

SEQ ID NO: 4741557 - DNA, 16 bp, Homo sapiens
attattcagtgaattt

SEQ ID NO: 4741558 - DNA, 20 bp, Homo sapiens
attattcagtgaatttgtcc

SEQ ID NO: 4741559 - DNA, 15 bp, Homo sapiens
attatttaaagcaca

SEQ ID NO: 4741560 - DNA, 21 bp, Homo sapiens
attatttaataacattacctt

SEQ ID NO: 4741561 - DNA, 16 bp, Homo sapiens
attatttaatttgtat

SEQ ID NO: 4741562 - DNA, 19 bp, Homo sapiens
attatttctgtatttggct

SEQ ID NO: 4741563 - DNA, 17 bp, Homo sapiens
attatttgataacattt

SEQ ID NO: 4741564 - DNA, 18 bp, Homo sapiens
attatttgattatttaag

SEQ ID NO: 4741565 - DNA, 19 bp, Homo sapiens
attatttgattatttaaga

SEQ ID NO: 4741566 - DNA, 14 bp, Homo sapiens
attattttgttact

SEQ ID NO: 4741567 - DNA, 17 bp, Homo sapiens
attattttgttactgtc

SEQ ID NO: 4741568 - DNA, 16 bp, Homo sapiens
attcaaaggtatccaa

SEQ ID NO: 4741569 - DNA, 16 bp, Homo sapiens
attcacccccaaacag

SEQ ID NO: 4741570 - DNA, 23 bp, Homo sapiens
attcacctctctcactgactatt

SEQ ID NO: 4741571 - DNA, 14 bp, Homo sapiens
attcaccttttctt

SEQ ID NO: 4741572 - DNA, 20 bp, Homo sapiens
attcaccttttcttcaaaat

SEQ ID NO: 4741573 - DNA, 14 bp, Homo sapiens
attcactattggct

SEQ ID NO: 4741574 - DNA, 21 bp, Homo sapiens
attcactcatacatctggccg

SEQ ID NO: 4741575 - DNA, 14 bp, Homo sapiens
attcactttcattt

SEQ ID NO: 4741576 - DNA, 17 bp, Homo sapiens
attcagacagctgcctg

SEQ ID NO: 4741577 - DNA, 18 bp, Homo sapiens
attcagacagctgcctgg

SEQ ID NO: 4741578 - DNA, 12 bp, Homo sapiens
attcagatgtat

SEQ ID NO: 4741579 - DNA, 19 bp, Homo sapiens
attcaggaaaagcctctgt

SEQ ID NO: 4741580 - DNA, 17 bp, Homo sapiens
attcaggaagataaaaa

SEQ ID NO: 4741581 - DNA, 23 bp, Homo sapiens
attcaggaagctcagggcctggc

SEQ ID NO: 4741582 - DNA, 18 bp, Homo sapiens
attcaggacttgaaagaa

SEQ ID NO: 4741583 - DNA, 13 bp, Homo sapiens
attcagtgaattt

SEQ ID NO: 4741584 - DNA, 18 bp, Homo sapiens
attcagtgaatttgtcca

SEQ ID NO: 4741585 - DNA, 17 bp, Homo sapiens
attcataaagagaaaat

SEQ ID NO: 4741586 - DNA, 16 bp, Homo sapiens
attcatattgcatcat

SEQ ID NO: 4741587 - DNA, 14 bp, Homo sapiens
attcatcaaataaa

SEQ ID NO: 4741588 - DNA, 20 bp, Homo sapiens
attcatcaaataaaccttgt

SEQ ID NO: 4741589 - DNA, 18 bp, Homo sapiens
attcatccaggactgaga

SEQ ID NO: 4741590 - DNA, 21 bp, Homo sapiens
attcatgtttaacgtttctca

SEQ ID NO: 4741591 - DNA, 21 bp, Homo sapiens
attcatgttttgagacataaa

SEQ ID NO: 4741592 - DNA, 13 bp, Homo sapiens
attccaaagagtg

SEQ ID NO: 4741593 - DNA, 22 bp, Homo sapiens
attccacttgttcattctgtga

SEQ ID NO: 4741594 - DNA, 20 bp, Homo sapiens
attccagatctgcagtcact

SEQ ID NO: 4741595 - DNA, 11 bp, Homo sapiens
attccatcctt

SEQ ID NO: 4741596 - DNA, 16 bp, Homo sapiens
attccattctggattt

SEQ ID NO: 4741597 - DNA, 20 bp, Homo sapiens
attccccagattgcaacagg

SEQ ID NO: 4741598 - DNA, 20 bp, Homo sapiens
attccccggggcgtttcttt

SEQ ID NO: 4741599 - DNA, 17 bp, Homo sapiens
attccctagaaacttcc

SEQ ID NO: 4741600 - DNA, 16 bp, Homo sapiens
attcccttcatctgga

SEQ ID NO: 4741601 - DNA, 16 bp, Homo sapiens
attccgtattacattt

SEQ ID NO: 4741602 - DNA, 14 bp, Homo sapiens
attcctacttgcag

SEQ ID NO: 4741603 - DNA, 20 bp, Homo sapiens
attcctctactaacaatcag

SEQ ID NO: 4741604 - DNA, 17 bp, Homo sapiens
attcctgggaaatattc

SEQ ID NO: 4741605 - DNA, 20 bp, Homo sapiens
attccttctttgataatgtt

SEQ ID NO: 4741606 - DNA, 22 bp, Homo sapiens
attccttctttgataatgttaa

SEQ ID NO: 4741607 - DNA, 15 bp, Homo sapiens
attctaaacagatgt

SEQ ID NO: 4741608 - DNA, 20 bp, Homo sapiens
attctaaacagatgtccctg

SEQ ID NO: 4741609 - DNA, 18 bp, Homo sapiens
attctaagactaatgctc

SEQ ID NO: 4741610 - DNA, 21 bp, Homo sapiens
attctaattgtcagtgatttt

SEQ ID NO: 4741611 - DNA, 15 bp, Homo sapiens
attctagctttgagc

SEQ ID NO: 4741612 - DNA, 15 bp, Homo sapiens
attctatgttaatat

SEQ ID NO: 4741613 - DNA, 22 bp, Homo sapiens
attctcacctaaaccctctgtg

SEQ ID NO: 4741614 - DNA, 17 bp, Homo sapiens
attctcagccacaacca

SEQ ID NO: 4741615 - DNA, 17 bp, Homo sapiens
attctcatttgtcacac

SEQ ID NO: 4741616 - DNA, 20 bp, Homo sapiens
attctccacctgccagggac

SEQ ID NO: 4741617 - DNA, 21 bp, Homo sapiens
attctccacctgccagggaca

SEQ ID NO: 4741618 - DNA, 13 bp, Homo sapiens
attctcctgcctc

SEQ ID NO: 4741619 - DNA, 14 bp, Homo sapiens
attctcctgcctca

SEQ ID NO: 4741620 - DNA, 14 bp, Homo sapiens
attctccttcagcc

SEQ ID NO: 4741621 - DNA, 16 bp, Homo sapiens
attctccttcagccct

SEQ ID NO: 4741622 - DNA, 18 bp, Homo sapiens
attctccttcagccctca

SEQ ID NO: 4741623 - DNA, 22 bp, Homo sapiens
attctccttcagccctcacccc

SEQ ID NO: 4741624 - DNA, 17 bp, Homo sapiens
attctctctaacataac

SEQ ID NO: 4741625 - DNA, 21 bp, Homo sapiens
attctctctcactcacatttt

SEQ ID NO: 4741626 - DNA, 11 bp, Homo sapiens
attctctgagc

SEQ ID NO: 4741627 - DNA, 18 bp, Homo sapiens
attctctgagctgtgcag

SEQ ID NO: 4741628 - DNA, 12 bp, Homo sapiens
attctctgtctc

SEQ ID NO: 4741629 - DNA, 13 bp, Homo sapiens
attctctgtctca

SEQ ID NO: 4741630 - DNA, 16 bp, Homo sapiens
attctctgtctcatcc

SEQ ID NO: 4741631 - DNA, 15 bp, Homo sapiens
attctgaaggagccc

SEQ ID NO: 4741632 - DNA, 16 bp, Homo sapiens
attctgaaggagcccc

SEQ ID NO: 4741633 - DNA, 14 bp, Homo sapiens
attctgcctgccca

SEQ ID NO: 4741634 - DNA, 15 bp, Homo sapiens
attctgcctgcccag

SEQ ID NO: 4741635 - DNA, 17 bp, Homo sapiens
attctgcctgcccaggc

SEQ ID NO: 4741636 - DNA, 18 bp, Homo sapiens
attctgcctgcccaggcc

SEQ ID NO: 4741637 - DNA, 18 bp, Homo sapiens
attctgctcacatatctg

SEQ ID NO: 4741638 - DNA, 21 bp, Homo sapiens
attctggattttgtcaagcag

SEQ ID NO: 4741639 - DNA, 21 bp, Homo sapiens
attctgtctttcaaaaggtaa

SEQ ID NO: 4741640 - DNA, 13 bp, Homo sapiens
attcttactaaaa

SEQ ID NO: 4741641 - DNA, 21 bp, Homo sapiens
attcttccttttattaaaacc

SEQ ID NO: 4741642 - DNA, 19 bp, Homo sapiens
attcttctgcttcagcctc

SEQ ID NO: 4741643 - DNA, 17 bp, Homo sapiens
attcttggttggctggc

SEQ ID NO: 4741644 - DNA, 20 bp, Homo sapiens
attcttggttggctggcctt

SEQ ID NO: 4741645 - DNA, 21 bp, Homo sapiens
attcttgttgctgtacaaaag

SEQ ID NO: 4741646 - DNA, 19 bp, Homo sapiens
attctttaatgattcctat

SEQ ID NO: 4741647 - DNA, 22 bp, Homo sapiens
attctttcctgaggctgggctc

SEQ ID NO: 4741648 - DNA, 20 bp, Homo sapiens
attcttttccagaaagaaaa

SEQ ID NO: 4741649 - DNA, 15 bp, Homo sapiens
attgaaaaattatca

SEQ ID NO: 4741650 - DNA, 19 bp, Homo sapiens
attgaaagaacttaagtct

SEQ ID NO: 4741651 - DNA, 22 bp, Homo sapiens
attgaaagtttttaatatttat

SEQ ID NO: 4741652 - DNA, 10 bp, Homo sapiens
attgaagaat

SEQ ID NO: 4741653 - DNA, 16 bp, Homo sapiens
attgaagaatgttaga

SEQ ID NO: 4741654 - DNA, 18 bp, Homo sapiens
attgaagggtctgtttaa

SEQ ID NO: 4741655 - DNA, 13 bp, Homo sapiens
attgaatgctgcc

SEQ ID NO: 4741656 - DNA, 15 bp, Homo sapiens
attgaattattttgt

SEQ ID NO: 4741657 - DNA, 20 bp, Homo sapiens
attgaattattttgttactg

SEQ ID NO: 4741658 - DNA, 22 bp, Homo sapiens
attgaattcttggttgaggaaa

SEQ ID NO: 4741659 - DNA, 16 bp, Homo sapiens
attgacaccaaaatga

SEQ ID NO: 4741660 - DNA, 17 bp, Homo sapiens
attgacaccaaaatgaa

SEQ ID NO: 4741661 - DNA, 23 bp, Homo sapiens
attgataagagggcacacactgt

SEQ ID NO: 4741662 - DNA, 15 bp, Homo sapiens
attgatttctgcctt

SEQ ID NO: 4741663 - DNA, 21 bp, Homo sapiens
attgatttctgccttccttgc

SEQ ID NO: 4741664 - DNA, 12 bp, Homo sapiens
attgatttgacc

SEQ ID NO: 4741665 - DNA, 12 bp, Homo sapiens
attgattttgaa

SEQ ID NO: 4741666 - DNA, 15 bp, Homo sapiens
attgcaacaggctgg

SEQ ID NO: 4741667 - DNA, 23 bp, Homo sapiens
attgcagtctaaaacttcaaaaa

SEQ ID NO: 4741668 - DNA, 15 bp, Homo sapiens
attgcagtgcggctc

SEQ ID NO: 4741669 - DNA, 16 bp, Homo sapiens
attgcatatatacata

SEQ ID NO: 4741670 - DNA, 23 bp, Homo sapiens
attgcatctcccagataatgtga

SEQ ID NO: 4741671 - DNA, 15 bp, Homo sapiens
attgcattataaaat

SEQ ID NO: 4741672 - DNA, 22 bp, Homo sapiens
attgccaagctcaggaccaggc

SEQ ID NO: 4741673 - DNA, 17 bp, Homo sapiens
attgcccacgctggagt

SEQ ID NO: 4741674 - DNA, 15 bp, Homo sapiens
attgcgagagatgtg

SEQ ID NO: 4741675 - DNA, 19 bp, Homo sapiens
attgcgagagatgtgtgtt

SEQ ID NO: 4741676 - DNA, 20 bp, Homo sapiens
attgcgagagatgtgtgttg

SEQ ID NO: 4741677 - DNA, 18 bp, Homo sapiens
attgcggacagccacggc

SEQ ID NO: 4741678 - DNA, 15 bp, Homo sapiens
attgctactgtccta

SEQ ID NO: 4741679 - DNA, 14 bp, Homo sapiens
attgctagtagata

SEQ ID NO: 4741680 - DNA, 15 bp, Homo sapiens
attggaactggaggc

SEQ ID NO: 4741681 - DNA, 16 bp, Homo sapiens
attggataaagcagct

SEQ ID NO: 4741682 - DNA, 11 bp, Homo sapiens
attggatattt

SEQ ID NO: 4741683 - DNA, 17 bp, Homo sapiens
attggattatttaataa

SEQ ID NO: 4741684 - DNA, 22 bp, Homo sapiens
attggattatttaataacatta

SEQ ID NO: 4741685 - DNA, 23 bp, Homo sapiens
attggcctggcaaaataaaacat

SEQ ID NO: 4741686 - DNA, 18 bp, Homo sapiens
attggctatttaaaactt

SEQ ID NO: 4741687 - DNA, 17 bp, Homo sapiens
attggctcacactgaga

SEQ ID NO: 4741688 - DNA, 17 bp, Homo sapiens
attggctgggagtggtg

SEQ ID NO: 4741689 - DNA, 17 bp, Homo sapiens
attgggttatgaatatt

SEQ ID NO: 4741690 - DNA, 18 bp, Homo sapiens
attggtaattaaaagact

SEQ ID NO: 4741691 - DNA, 18 bp, Homo sapiens
attggtcatttagagttt

SEQ ID NO: 4741692 - DNA, 14 bp, Homo sapiens
attggtctcctctc

SEQ ID NO: 4741693 - DNA, 17 bp, Homo sapiens
attggtctcctctcagc

SEQ ID NO: 4741694 - DNA, 18 bp, Homo sapiens
attggtcttaatgttgaa

SEQ ID NO: 4741695 - DNA, 23 bp, Homo sapiens
attgtaaaaaaaaatgcctttga

SEQ ID NO: 4741696 - DNA, 16 bp, Homo sapiens
attgtaaaaataatca

SEQ ID NO: 4741697 - DNA, 20 bp, Homo sapiens
attgtaaaattatttcatga

SEQ ID NO: 4741698 - DNA, 16 bp, Homo sapiens
attgtaaatctgaaga

SEQ ID NO: 4741699 - DNA, 15 bp, Homo sapiens
attgtaactgttctt

SEQ ID NO: 4741700 - DNA, 19 bp, Homo sapiens
attgtacacaccttatatt

SEQ ID NO: 4741701 - DNA, 21 bp, Homo sapiens
attgtacagtttttattgctt

SEQ ID NO: 4741702 - DNA, 16 bp, Homo sapiens
attgtagtcctgtaat

SEQ ID NO: 4741703 - DNA, 14 bp, Homo sapiens
attgtattacaaat

SEQ ID NO: 4741704 - DNA, 15 bp, Homo sapiens
attgtcatcaggaga

SEQ ID NO: 4741705 - DNA, 20 bp, Homo sapiens
attgtccccgacccttgccg

SEQ ID NO: 4741706 - DNA, 18 bp, Homo sapiens
attgtctctaaattgtgg

SEQ ID NO: 4741707 - DNA, 22 bp, Homo sapiens
attgtgaaccctagctgtgtca

SEQ ID NO: 4741708 - DNA, 16 bp, Homo sapiens
attgtgatttcccgtg

SEQ ID NO: 4741709 - DNA, 12 bp, Homo sapiens
attgtggctccc

SEQ ID NO: 4741710 - DNA, 20 bp, Homo sapiens
attgtgggtctatttctagt

SEQ ID NO: 4741711 - DNA, 18 bp, Homo sapiens
attgtgtctcttggtcct

SEQ ID NO: 4741712 - DNA, 23 bp, Homo sapiens
attgtgtctcttggtcctgctgc

SEQ ID NO: 4741713 - DNA, 19 bp, Homo sapiens
attgtgtggattctttaaa

SEQ ID NO: 4741714 - DNA, 17 bp, Homo sapiens
attgttctgggtgattt

SEQ ID NO: 4741715 - DNA, 18 bp, Homo sapiens
attgttctgggtgatttc

SEQ ID NO: 4741716 - DNA, 16 bp, Homo sapiens
attgttgtttctttct

SEQ ID NO: 4741717 - DNA, 19 bp, Homo sapiens
attgttgtttctttctagt

SEQ ID NO: 4741718 - DNA, 20 bp, Homo sapiens
attgttgtttctttctagtg

SEQ ID NO: 4741719 - DNA, 15 bp, Homo sapiens
atttaaaaatatatt

SEQ ID NO: 4741720 - DNA, 18 bp, Homo sapiens
atttaaaacaacttgttt

SEQ ID NO: 4741721 - DNA, 13 bp, Homo sapiens
atttaaaactgtt

SEQ ID NO: 4741722 - DNA, 11 bp, Homo sapiens
atttaaaactt

SEQ ID NO: 4741723 - DNA, 14 bp, Homo sapiens
atttaaaagacaaa

SEQ ID NO: 4741724 - DNA, 19 bp, Homo sapiens
atttaaaagacaaacacct

SEQ ID NO: 4741725 - DNA, 13 bp, Homo sapiens
atttaaagcacat

SEQ ID NO: 4741726 - DNA, 18 bp, Homo sapiens
atttaaatgtacttatat

SEQ ID NO: 4741727 - DNA, 16 bp, Homo sapiens
atttaaccataaatca

SEQ ID NO: 4741728 - DNA, 13 bp, Homo sapiens
atttaacctattt

SEQ ID NO: 4741729 - DNA, 22 bp, Homo sapiens
atttaacctatttccacattct

SEQ ID NO: 4741730 - DNA, 12 bp, Homo sapiens
atttaagcatga

SEQ ID NO: 4741731 - DNA, 15 bp, Homo sapiens
atttaagcattcaaa

SEQ ID NO: 4741732 - DNA, 21 bp, Homo sapiens
atttaagtgcgtgtgtagagt

SEQ ID NO: 4741733 - DNA, 22 bp, Homo sapiens
atttaagtgcgtgtgtagagtt

SEQ ID NO: 4741734 - DNA, 12 bp, Homo sapiens
atttaataacat

SEQ ID NO: 4741735 - DNA, 18 bp, Homo sapiens
atttaataacattacctt

SEQ ID NO: 4741736 - DNA, 19 bp, Homo sapiens
atttaataacattacctta

SEQ ID NO: 4741737 - DNA, 23 bp, Homo sapiens
atttaataacattaccttactgt

SEQ ID NO: 4741738 - DNA, 19 bp, Homo sapiens
atttaataatgtatgtaca

SEQ ID NO: 4741739 - DNA, 15 bp, Homo sapiens
atttaatccattttt

SEQ ID NO: 4741740 - DNA, 16 bp, Homo sapiens
atttaatccattttta

SEQ ID NO: 4741741 - DNA, 16 bp, Homo sapiens
atttaatgtagccatg

SEQ ID NO: 4741742 - DNA, 14 bp, Homo sapiens
atttaattacctta

SEQ ID NO: 4741743 - DNA, 13 bp, Homo sapiens
atttaatttgtat

SEQ ID NO: 4741744 - DNA, 22 bp, Homo sapiens
atttaatttgtatgctaaatga

SEQ ID NO: 4741745 - DNA, 19 bp, Homo sapiens
atttacaaaaatataaaat

SEQ ID NO: 4741746 - DNA, 20 bp, Homo sapiens
atttacaaaaatataaaata

SEQ ID NO: 4741747 - DNA, 12 bp, Homo sapiens
atttacactggt

SEQ ID NO: 4741748 - DNA, 14 bp, Homo sapiens
atttacactggtct

SEQ ID NO: 4741749 - DNA, 19 bp, Homo sapiens
atttacactggtctaatgt

SEQ ID NO: 4741750 - DNA, 18 bp, Homo sapiens
atttacatttatctatta

SEQ ID NO: 4741751 - DNA, 19 bp, Homo sapiens
atttacccttcttttctga

SEQ ID NO: 4741752 - DNA, 13 bp, Homo sapiens
atttaccttttaa

SEQ ID NO: 4741753 - DNA, 18 bp, Homo sapiens
atttagagtcaatttgct

SEQ ID NO: 4741754 - DNA, 15 bp, Homo sapiens
atttagcaatgctgt

SEQ ID NO: 4741755 - DNA, 19 bp, Homo sapiens
atttagcaatgctgtgaat

SEQ ID NO: 4741756 - DNA, 15 bp, Homo sapiens
atttaggagaagttg

SEQ ID NO: 4741757 - DNA, 17 bp, Homo sapiens
atttaggttttctctgt

SEQ ID NO: 4741758 - DNA, 12 bp, Homo sapiens
atttagtcctgt

SEQ ID NO: 4741759 - DNA, 14 bp, Homo sapiens
atttagtcctgtac

SEQ ID NO: 4741760 - DNA, 14 bp, Homo sapiens
atttagttgtggaa

SEQ ID NO: 4741761 - DNA, 14 bp, Homo sapiens
atttataaagcaaa

SEQ ID NO: 4741762 - DNA, 14 bp, Homo sapiens
atttataacaaata

SEQ ID NO: 4741763 - DNA, 13 bp, Homo sapiens
atttatacctttg

SEQ ID NO: 4741764 - DNA, 21 bp, Homo sapiens
atttatctattaaaattgcca

SEQ ID NO: 4741765 - DNA, 15 bp, Homo sapiens
atttatgatttaata

SEQ ID NO: 4741766 - DNA, 16 bp, Homo sapiens
atttatgatttaataa

SEQ ID NO: 4741767 - DNA, 17 bp, Homo sapiens
atttatgatttaataaa

SEQ ID NO: 4741768 - DNA, 13 bp, Homo sapiens
atttatgatttca

SEQ ID NO: 4741769 - DNA, 15 bp, Homo sapiens
atttatggttgttaa

SEQ ID NO: 4741770 - DNA, 12 bp, Homo sapiens
atttatgtatct

SEQ ID NO: 4741771 - DNA, 18 bp, Homo sapiens
atttattaatttgaaacc

SEQ ID NO: 4741772 - DNA, 19 bp, Homo sapiens
atttattaatttgaaacca

SEQ ID NO: 4741773 - DNA, 14 bp, Homo sapiens
atttattcattagt

SEQ ID NO: 4741774 - DNA, 15 bp, Homo sapiens
atttattgaaatgat

SEQ ID NO: 4741775 - DNA, 22 bp, Homo sapiens
atttcacagtgcccaagagtgg

SEQ ID NO: 4741776 - DNA, 15 bp, Homo sapiens
atttcacccctccct

SEQ ID NO: 4741777 - DNA, 20 bp, Homo sapiens
atttcacccctccctttctc

SEQ ID NO: 4741778 - DNA, 15 bp, Homo sapiens
atttcagatttgtga

SEQ ID NO: 4741779 - DNA, 16 bp, Homo sapiens
atttcagcagctgcag

SEQ ID NO: 4741780 - DNA, 15 bp, Homo sapiens
atttcaggagcagcc

SEQ ID NO: 4741781 - DNA, 17 bp, Homo sapiens
atttcagtcaattctga

SEQ ID NO: 4741782 - DNA, 18 bp, Homo sapiens
atttcagtcaattctgat

SEQ ID NO: 4741783 - DNA, 20 bp, Homo sapiens
atttcagtcaattctgatgt

SEQ ID NO: 4741784 - DNA, 14 bp, Homo sapiens
atttcagtgccaat

SEQ ID NO: 4741785 - DNA, 11 bp, Homo sapiens
atttcatctgc

SEQ ID NO: 4741786 - DNA, 16 bp, Homo sapiens
atttcatctgctctcc

SEQ ID NO: 4741787 - DNA, 17 bp, Homo sapiens
atttcatttgtaacttt

SEQ ID NO: 4741788 - DNA, 22 bp, Homo sapiens
atttcattttttatgtattgtt

SEQ ID NO: 4741789 - DNA, 15 bp, Homo sapiens
atttccaagagctga

SEQ ID NO: 4741790 - DNA, 14 bp, Homo sapiens
atttccagccaggg

SEQ ID NO: 4741791 - DNA, 17 bp, Homo sapiens
atttccagccagggctg

SEQ ID NO: 4741792 - DNA, 15 bp, Homo sapiens
atttcccgtggcccc

SEQ ID NO: 4741793 - DNA, 16 bp, Homo sapiens
atttcccgtggcccca

SEQ ID NO: 4741794 - DNA, 20 bp, Homo sapiens
atttcccgtggccccagcct

SEQ ID NO: 4741795 - DNA, 18 bp, Homo sapiens
atttcctctgagctgtta

SEQ ID NO: 4741796 - DNA, 17 bp, Homo sapiens
atttcgtgtaatattct

SEQ ID NO: 4741797 - DNA, 17 bp, Homo sapiens
atttctacagagaaaat

SEQ ID NO: 4741798 - DNA, 22 bp, Homo sapiens
atttctatgtatgtgccaattt

SEQ ID NO: 4741799 - DNA, 12 bp, Homo sapiens
atttctccccag

SEQ ID NO: 4741800 - DNA, 20 bp, Homo sapiens
atttctcctccatgggagaa

SEQ ID NO: 4741801 - DNA, 17 bp, Homo sapiens
atttctgtatttggcta

SEQ ID NO: 4741802 - DNA, 21 bp, Homo sapiens
atttctttaatctgttgtttg

SEQ ID NO: 4741803 - DNA, 22 bp, Homo sapiens
atttctttaatctgttgtttga

SEQ ID NO: 4741804 - DNA, 15 bp, Homo sapiens
atttctttataaaat

SEQ ID NO: 4741805 - DNA, 23 bp, Homo sapiens
atttgaaggtagaatgttttcaa

SEQ ID NO: 4741806 - DNA, 15 bp, Homo sapiens
atttgagcagggctc

SEQ ID NO: 4741807 - DNA, 17 bp, Homo sapiens
atttgagcagggctcag

SEQ ID NO: 4741808 - DNA, 19 bp, Homo sapiens
atttgatatttgcattgag

SEQ ID NO: 4741809 - DNA, 21 bp, Homo sapiens
atttgcaatatggatttctta

SEQ ID NO: 4741810 - DNA, 12 bp, Homo sapiens
atttgcagaggc

SEQ ID NO: 4741811 - DNA, 22 bp, Homo sapiens
atttgcatatttttctaaagaa

SEQ ID NO: 4741812 - DNA, 19 bp, Homo sapiens
atttgcattgaggaaatat

SEQ ID NO: 4741813 - DNA, 15 bp, Homo sapiens
atttgccaataataa

SEQ ID NO: 4741814 - DNA, 16 bp, Homo sapiens
atttgccaataataat

SEQ ID NO: 4741815 - DNA, 19 bp, Homo sapiens
atttgccatgggcttcact

SEQ ID NO: 4741816 - DNA, 15 bp, Homo sapiens
atttggaaagtgtgt

SEQ ID NO: 4741817 - DNA, 21 bp, Homo sapiens
atttggagatgtctctgtgtg

SEQ ID NO: 4741818 - DNA, 21 bp, Homo sapiens
atttggagtgttccccttcca

SEQ ID NO: 4741819 - DNA, 19 bp, Homo sapiens
atttggcaatgccatcatc

SEQ ID NO: 4741820 - DNA, 17 bp, Homo sapiens
atttgggggggaataag

SEQ ID NO: 4741821 - DNA, 14 bp, Homo sapiens
atttggtattacac

SEQ ID NO: 4741822 - DNA, 18 bp, Homo sapiens
atttggtcagaatgcagt

SEQ ID NO: 4741823 - DNA, 14 bp, Homo sapiens
atttggtttctaga

SEQ ID NO: 4741824 - DNA, 16 bp, Homo sapiens
atttggtttctagatc

SEQ ID NO: 4741825 - DNA, 20 bp, Homo sapiens
atttggtttctagatcactg

SEQ ID NO: 4741826 - DNA, 22 bp, Homo sapiens
atttggtttggccatctctgga

SEQ ID NO: 4741827 - DNA, 13 bp, Homo sapiens
atttgtagattag

SEQ ID NO: 4741828 - DNA, 14 bp, Homo sapiens
atttgtatgctaaa

SEQ ID NO: 4741829 - DNA, 15 bp, Homo sapiens
atttgtatgctaaat

SEQ ID NO: 4741830 - DNA, 17 bp, Homo sapiens
atttgtatgctaaatga

SEQ ID NO: 4741831 - DNA, 21 bp, Homo sapiens
atttgtattaaaattgtaagc

SEQ ID NO: 4741832 - DNA, 14 bp, Homo sapiens
atttgtattgtaca

SEQ ID NO: 4741833 - DNA, 16 bp, Homo sapiens
atttgtgaaaatgtaa

SEQ ID NO: 4741834 - DNA, 13 bp, Homo sapiens
atttgtgaatttg

SEQ ID NO: 4741835 - DNA, 17 bp, Homo sapiens
atttgttattttgcaac

SEQ ID NO: 4741836 - DNA, 13 bp, Homo sapiens
atttgttggtaac

SEQ ID NO: 4741837 - DNA, 22 bp, Homo sapiens
atttgttggtaactaatgttat

SEQ ID NO: 4741838 - DNA, 23 bp, Homo sapiens
atttgttggtaactaatgttatt

SEQ ID NO: 4741839 - DNA, 14 bp, Homo sapiens
attttaaagtaatt

SEQ ID NO: 4741840 - DNA, 19 bp, Homo sapiens
attttaaagtaatttctaa

SEQ ID NO: 4741841 - DNA, 15 bp, Homo sapiens
attttaatgggtttc

SEQ ID NO: 4741842 - DNA, 17 bp, Homo sapiens
attttacctagctaatt

SEQ ID NO: 4741843 - DNA, 22 bp, Homo sapiens
attttacctagctaattattta

SEQ ID NO: 4741844 - DNA, 17 bp, Homo sapiens
attttagaaattataat

SEQ ID NO: 4741845 - DNA, 12 bp, Homo sapiens
attttagacttt

SEQ ID NO: 4741846 - DNA, 22 bp, Homo sapiens
attttagttttgtgcttagtta

SEQ ID NO: 4741847 - DNA, 20 bp, Homo sapiens
attttatctacccagtcatg

SEQ ID NO: 4741848 - DNA, 22 bp, Homo sapiens
attttatctacccagtcatgta

SEQ ID NO: 4741849 - DNA, 19 bp, Homo sapiens
attttatgatcttttcagt

SEQ ID NO: 4741850 - DNA, 20 bp, Homo sapiens
attttatgccttttatttct

SEQ ID NO: 4741851 - DNA, 17 bp, Homo sapiens
attttatggcactattt

SEQ ID NO: 4741852 - DNA, 13 bp, Homo sapiens
attttatttatat

SEQ ID NO: 4741853 - DNA, 22 bp, Homo sapiens
attttcagcatcaaacatgaaa

SEQ ID NO: 4741854 - DNA, 21 bp, Homo sapiens
attttcataagtatttcaaat

SEQ ID NO: 4741855 - DNA, 16 bp, Homo sapiens
attttcatgcacagta

SEQ ID NO: 4741856 - DNA, 15 bp, Homo sapiens
attttccataagcta

SEQ ID NO: 4741857 - DNA, 16 bp, Homo sapiens
attttcctcctttcct

SEQ ID NO: 4741858 - DNA, 14 bp, Homo sapiens
attttcctgtgaca

SEQ ID NO: 4741859 - DNA, 15 bp, Homo sapiens
attttctaaagactt

SEQ ID NO: 4741860 - DNA, 14 bp, Homo sapiens
attttctataattt

SEQ ID NO: 4741861 - DNA, 15 bp, Homo sapiens
attttctataattta

SEQ ID NO: 4741862 - DNA, 19 bp, Homo sapiens
attttctataatttaaata

SEQ ID NO: 4741863 - DNA, 20 bp, Homo sapiens
attttctccaaataaaaatt

SEQ ID NO: 4741864 - DNA, 20 bp, Homo sapiens
attttctgccaggctcaaca

SEQ ID NO: 4741865 - DNA, 19 bp, Homo sapiens
attttcttgtcaatggaag

SEQ ID NO: 4741866 - DNA, 20 bp, Homo sapiens
attttgaacctgatgaaaat

SEQ ID NO: 4741867 - DNA, 21 bp, Homo sapiens
attttgaattagattatttct

SEQ ID NO: 4741868 - DNA, 19 bp, Homo sapiens
attttgagggtgtaaccag

SEQ ID NO: 4741869 - DNA, 21 bp, Homo sapiens
attttgagttaatttttgtat

SEQ ID NO: 4741870 - DNA, 19 bp, Homo sapiens
attttgcatatatgttctt

SEQ ID NO: 4741871 - DNA, 18 bp, Homo sapiens
attttgccagtgggaact

SEQ ID NO: 4741872 - DNA, 22 bp, Homo sapiens
attttggggtacccactgctct

SEQ ID NO: 4741873 - DNA, 20 bp, Homo sapiens
attttggttgctgatgttta

SEQ ID NO: 4741874 - DNA, 21 bp, Homo sapiens
attttgtaattattgtgattt

SEQ ID NO: 4741875 - DNA, 21 bp, Homo sapiens
attttgtcacagctcttgttt

SEQ ID NO: 4741876 - DNA, 14 bp, Homo sapiens
attttgtgttgtac

SEQ ID NO: 4741877 - DNA, 21 bp, Homo sapiens
attttgtgttgtacaattaag

SEQ ID NO: 4741878 - DNA, 15 bp, Homo sapiens
attttgttactgtct

SEQ ID NO: 4741879 - DNA, 22 bp, Homo sapiens
attttgttactgtctgtagtgt

SEQ ID NO: 4741880 - DNA, 14 bp, Homo sapiens
attttgtttcaatc

SEQ ID NO: 4741881 - DNA, 17 bp, Homo sapiens
attttgtttcaatctct

SEQ ID NO: 4741882 - DNA, 19 bp, Homo sapiens
attttgtttcaatctctga

SEQ ID NO: 4741883 - DNA, 23 bp, Homo sapiens
atttttaaaggacaaacagtgaa

SEQ ID NO: 4741884 - DNA, 23 bp, Homo sapiens
atttttaagtcaacactatatat

SEQ ID NO: 4741885 - DNA, 16 bp, Homo sapiens
atttttacaaaactgc

SEQ ID NO: 4741886 - DNA, 22 bp, Homo sapiens
atttttatattgtttttgtatt

SEQ ID NO: 4741887 - DNA, 16 bp, Homo sapiens
atttttctttaactgc

SEQ ID NO: 4741888 - DNA, 18 bp, Homo sapiens
atttttgaaaatcctgaa

SEQ ID NO: 4741889 - DNA, 21 bp, Homo sapiens
atttttgaaaatcctgaataa

SEQ ID NO: 4741890 - DNA, 15 bp, Homo sapiens
atttttgaatgtgat

SEQ ID NO: 4741891 - DNA, 17 bp, Homo sapiens
atttttgaatgtgattt

SEQ ID NO: 4741892 - DNA, 19 bp, Homo sapiens
atttttgtagagccagggt

SEQ ID NO: 4741893 - DNA, 14 bp, Homo sapiens
atttttgtcttgtg

SEQ ID NO: 4741894 - DNA, 16 bp, Homo sapiens
atttttgtgtatccag

SEQ ID NO: 4741895 - DNA, 14 bp, Homo sapiens
attttttttcaaaa

SEQ ID NO: 4741896 - DNA, 15 bp, Homo sapiens
attttttttcaaaaa

SEQ ID NO: 4741897 - DNA, 14 bp, Homo sapiens
caaaaatagttaaa

SEQ ID NO: 4741898 - DNA, 23 bp, Homo sapiens
caaaaatataaaatatgaagaca

SEQ ID NO: 4741899 - DNA, 22 bp, Homo sapiens
caaaaatttctgtaaaacaggt

SEQ ID NO: 4741900 - DNA, 16 bp, Homo sapiens
caaaacatattttaca

SEQ ID NO: 4741901 - DNA, 18 bp, Homo sapiens
caaaacatattttacatc

SEQ ID NO: 4741902 - DNA, 21 bp, Homo sapiens
caaaactctcctctgctgctg

SEQ ID NO: 4741903 - DNA, 22 bp, Homo sapiens
caaaactctcctctgctgctgg

SEQ ID NO: 4741904 - DNA, 19 bp, Homo sapiens
caaaagcccattcattcca

SEQ ID NO: 4741905 - DNA, 15 bp, Homo sapiens
caaaagtctgaggca

SEQ ID NO: 4741906 - DNA, 19 bp, Homo sapiens
caaaatcaagcaagcctct

SEQ ID NO: 4741907 - DNA, 17 bp, Homo sapiens
caaaatgttctatttaa

SEQ ID NO: 4741908 - DNA, 13 bp, Homo sapiens
caaacagtgaatt

SEQ ID NO: 4741909 - DNA, 13 bp, Homo sapiens
caaacatgaaaac

SEQ ID NO: 4741910 - DNA, 15 bp, Homo sapiens
caaacatgaaaacat

SEQ ID NO: 4741911 - DNA, 16 bp, Homo sapiens
caaacatgaaaacatt

SEQ ID NO: 4741912 - DNA, 20 bp, Homo sapiens
caaacatgtggttaatgcca

SEQ ID NO: 4741913 - DNA, 17 bp, Homo sapiens
caaaccaaccatttcta

SEQ ID NO: 4741914 - DNA, 20 bp, Homo sapiens
caaaccactttttgcagctt

SEQ ID NO: 4741915 - DNA, 13 bp, Homo sapiens
caaacctgcctgg

SEQ ID NO: 4741916 - DNA, 15 bp, Homo sapiens
caaacctgcctgggt

SEQ ID NO: 4741917 - DNA, 16 bp, Homo sapiens
caaacctgcctgggtt

SEQ ID NO: 4741918 - DNA, 19 bp, Homo sapiens
caaactagggccaagccca

SEQ ID NO: 4741919 - DNA, 17 bp, Homo sapiens
caaactcttgacctcag

SEQ ID NO: 4741920 - DNA, 20 bp, Homo sapiens
caaactcttgacctcaggtg

SEQ ID NO: 4741921 - DNA, 21 bp, Homo sapiens
caaactcttgacctcaggtga

SEQ ID NO: 4741922 - DNA, 22 bp, Homo sapiens
caaacttcattttttaaaaaat

SEQ ID NO: 4741923 - DNA, 14 bp, Homo sapiens
caaagaaaatgaaa

SEQ ID NO: 4741924 - DNA, 12 bp, Homo sapiens
caaagaaatttc

SEQ ID NO: 4741925 - DNA, 18 bp, Homo sapiens
caaagaaatttccactca

SEQ ID NO: 4741926 - DNA, 19 bp, Homo sapiens
caaagaaatttccactcag

SEQ ID NO: 4741927 - DNA, 19 bp, Homo sapiens
caaagaaggaaaaggcagg

SEQ ID NO: 4741928 - DNA, 13 bp, Homo sapiens
caaagcaaggaaa

SEQ ID NO: 4741929 - DNA, 15 bp, Homo sapiens
caaagcagggtctgg

SEQ ID NO: 4741930 - DNA, 22 bp, Homo sapiens
caaagccagcgtcctcctctgt

SEQ ID NO: 4741931 - DNA, 17 bp, Homo sapiens
caaagcccaaagtggta

SEQ ID NO: 4741932 - DNA, 19 bp, Homo sapiens
caaagcccaaagtggtata

SEQ ID NO: 4741933 - DNA, 16 bp, Homo sapiens
caaagctaggcctggc

SEQ ID NO: 4741934 - DNA, 19 bp, Homo sapiens
caaagctaggcctggccag

SEQ ID NO: 4741935 - DNA, 14 bp, Homo sapiens
caaagcttaaaaag

SEQ ID NO: 4741936 - DNA, 15 bp, Homo sapiens
caaagcttaaaaaga

SEQ ID NO: 4741937 - DNA, 20 bp, Homo sapiens
caaaggagataaatctagta

SEQ ID NO: 4741938 - DNA, 20 bp, Homo sapiens
caaaggaggacaagaccctc

SEQ ID NO: 4741939 - DNA, 21 bp, Homo sapiens
caaaggccatggagagctgga

SEQ ID NO: 4741940 - DNA, 13 bp, Homo sapiens
caaaggctgggac

SEQ ID NO: 4741941 - DNA, 23 bp, Homo sapiens
caaagggcatgggtcgggagagg

SEQ ID NO: 4741942 - DNA, 19 bp, Homo sapiens
caaagggtatcaggtgctg

SEQ ID NO: 4741943 - DNA, 20 bp, Homo sapiens
caaagggtatcaggtgctgc

SEQ ID NO: 4741944 - DNA, 22 bp, Homo sapiens
caaagtcatgcaaaggctggga

SEQ ID NO: 4741945 - DNA, 17 bp, Homo sapiens
caaagtcattaaagaca

SEQ ID NO: 4741946 - DNA, 13 bp, Homo sapiens
caaagtgctggga

SEQ ID NO: 4741947 - DNA, 19 bp, Homo sapiens
caaagtgctgggattacaa

SEQ ID NO: 4741948 - DNA, 23 bp, Homo sapiens
caaagtgctgggattacaagcgt

SEQ ID NO: 4741949 - DNA, 18 bp, Homo sapiens
caaagttaaaagtaaaat

SEQ ID NO: 4741950 - DNA, 14 bp, Homo sapiens
caaagttaaatgta

SEQ ID NO: 4741951 - DNA, 15 bp, Homo sapiens
caaagttaaatgtat

SEQ ID NO: 4741952 - DNA, 21 bp, Homo sapiens
caaagttccagttttgttttg

SEQ ID NO: 4741953 - DNA, 14 bp, Homo sapiens
caaagtttgtggta

SEQ ID NO: 4741954 - DNA, 14 bp, Homo sapiens
caaagttttgaaaa

SEQ ID NO: 4741955 - DNA, 17 bp, Homo sapiens
caaagttttgaaaagct

SEQ ID NO: 4741956 - DNA, 19 bp, Homo sapiens
caaagttttgaaaagctat

SEQ ID NO: 4741957 - DNA, 10 bp, Homo sapiens
caaataaaat

SEQ ID NO: 4741958 - DNA, 16 bp, Homo sapiens
caaataatgtctctgt

SEQ ID NO: 4741959 - DNA, 15 bp, Homo sapiens
caaatatcatataaa

SEQ ID NO: 4741960 - DNA, 15 bp, Homo sapiens
caaatcaaagcagat

SEQ ID NO: 4741961 - DNA, 15 bp, Homo sapiens
caaatcactgaactt

SEQ ID NO: 4741962 - DNA, 16 bp, Homo sapiens
caaatctgacatatta

SEQ ID NO: 4741963 - DNA, 21 bp, Homo sapiens
caaatgctgtgcaaacagtgt

SEQ ID NO: 4741964 - DNA, 22 bp, Homo sapiens
caaatgctgtgcaaacagtgta

SEQ ID NO: 4741965 - DNA, 22 bp, Homo sapiens
caaatggaaatgggcagagcag

SEQ ID NO: 4741966 - DNA, 17 bp, Homo sapiens
caaatgtaaacattttc

SEQ ID NO: 4741967 - DNA, 18 bp, Homo sapiens
caaatgtttaaacatttt

SEQ ID NO: 4741968 - DNA, 17 bp, Homo sapiens
caaattcaatgattctt

SEQ ID NO: 4741969 - DNA, 20 bp, Homo sapiens
caaattcctgttagccaggt

SEQ ID NO: 4741970 - DNA, 21 bp, Homo sapiens
caaattggagcttcatggcag

SEQ ID NO: 4741971 - DNA, 16 bp, Homo sapiens
caaatttacatttatc

SEQ ID NO: 4741972 - DNA, 20 bp, Homo sapiens
caaattttgagcaaagaaac

SEQ ID NO: 4741973 - DNA, 12 bp, Homo sapiens
caacaaacactg

SEQ ID NO: 4741974 - DNA, 15 bp, Homo sapiens
caacaaagaaacaaa

SEQ ID NO: 4741975 - DNA, 18 bp, Homo sapiens
caacaatactacctcact

SEQ ID NO: 4741976 - DNA, 18 bp, Homo sapiens
caacaatttctactttga

SEQ ID NO: 4741977 - DNA, 13 bp, Homo sapiens
caacacatttttg

SEQ ID NO: 4741978 - DNA, 18 bp, Homo sapiens
caacactcattgacctga

SEQ ID NO: 4741979 - DNA, 20 bp, Homo sapiens
caacagagactgaatagata

SEQ ID NO: 4741980 - DNA, 17 bp, Homo sapiens
caacagcaaacaggtgc

SEQ ID NO: 4741981 - DNA, 24 bp, Homo sapiens
caacaggctgggcttcagtggcag

SEQ ID NO: 4741982 - DNA, 20 bp, Homo sapiens
caacagtgttaggcctggca

SEQ ID NO: 4741983 - DNA, 19 bp, Homo sapiens
caacatactcccatctgtg

SEQ ID NO: 4741984 - DNA, 20 bp, Homo sapiens
caacatactcccatctgtga

SEQ ID NO: 4741985 - DNA, 13 bp, Homo sapiens
caacatcttttct

SEQ ID NO: 4741986 - DNA, 12 bp, Homo sapiens
caacatggtcct

SEQ ID NO: 4741987 - DNA, 19 bp, Homo sapiens
caacatgtataatattttt

SEQ ID NO: 4741988 - DNA, 19 bp, Homo sapiens
caacatgtatgtggataca

SEQ ID NO: 4741989 - DNA, 21 bp, Homo sapiens
caacattacagggaatgcctg

SEQ ID NO: 4741990 - DNA, 18 bp, Homo sapiens
caacattgttcattcttg

SEQ ID NO: 4741991 - DNA, 13 bp, Homo sapiens
caaccatttctag

SEQ ID NO: 4741992 - DNA, 11 bp, Homo sapiens
caacccagccg

SEQ ID NO: 4741993 - DNA, 16 bp, Homo sapiens
caacccagccgctgcc

SEQ ID NO: 4741994 - DNA, 17 bp, Homo sapiens
caacccagccgctgccc

SEQ ID NO: 4741995 - DNA, 16 bp, Homo sapiens
caacccccagccccca

SEQ ID NO: 4741996 - DNA, 16 bp, Homo sapiens
caacccccagcctgct

SEQ ID NO: 4741997 - DNA, 15 bp, Homo sapiens
caaccccccagcact

SEQ ID NO: 4741998 - DNA, 18 bp, Homo sapiens
caaccccccagcactgag

SEQ ID NO: 4741999 - DNA, 19 bp, Homo sapiens
caaccccccagcactgagg

SEQ ID NO: 4742000 - DNA, 20 bp, Homo sapiens
caaccccccagcactgagga

SEQ ID NO: 4742001 - DNA, 22 bp, Homo sapiens
caaccccttcgctcctgtgtct

SEQ ID NO: 4742002 - DNA, 12 bp, Homo sapiens
caaccctcatca

SEQ ID NO: 4742003 - DNA, 17 bp, Homo sapiens
caacctgattgtgtctc

SEQ ID NO: 4742004 - DNA, 19 bp, Homo sapiens
caacctgattgtgtctctt

SEQ ID NO: 4742005 - DNA, 20 bp, Homo sapiens
caacctgttctgctttcctc

SEQ ID NO: 4742006 - DNA, 19 bp, Homo sapiens
caactatgatttggaaaat

SEQ ID NO: 4742007 - DNA, 17 bp, Homo sapiens
caactcaccccagcccc

SEQ ID NO: 4742008 - DNA, 18 bp, Homo sapiens
caactcaccccagcccca

SEQ ID NO: 4742009 - DNA, 21 bp, Homo sapiens
caactccctgccccccagccc

SEQ ID NO: 4742010 - DNA, 19 bp, Homo sapiens
caactcctagggccactga

SEQ ID NO: 4742011 - DNA, 20 bp, Homo sapiens
caactcgccctgtttggcat

SEQ ID NO: 4742012 - DNA, 22 bp, Homo sapiens
caactctgaagagtatttgaaa

SEQ ID NO: 4742013 - DNA, 14 bp, Homo sapiens
caactcttgtattg

SEQ ID NO: 4742014 - DNA, 15 bp, Homo sapiens
caactctttgagaaa

SEQ ID NO: 4742015 - DNA, 16 bp, Homo sapiens
caactgaatacttgaa

SEQ ID NO: 4742016 - DNA, 15 bp, Homo sapiens
caactgatcatattt

SEQ ID NO: 4742017 - DNA, 18 bp, Homo sapiens
caacttagatctccagga

SEQ ID NO: 4742018 - DNA, 12 bp, Homo sapiens
caacttgggaac

SEQ ID NO: 4742019 - DNA, 12 bp, Homo sapiens
caacttgtgaac

SEQ ID NO: 4742020 - DNA, 15 bp, Homo sapiens
caactttcatttgaa

SEQ ID NO: 4742021 - DNA, 15 bp, Homo sapiens
caagaaaacaggcac

SEQ ID NO: 4742022 - DNA, 17 bp, Homo sapiens
caagaaaacaggcactg

SEQ ID NO: 4742023 - DNA, 21 bp, Homo sapiens
caagaaaacaggcactgccct

SEQ ID NO: 4742024 - DNA, 13 bp, Homo sapiens
caagaagcccagg

SEQ ID NO: 4742025 - DNA, 14 bp, Homo sapiens
caagaagcccagga

SEQ ID NO: 4742026 - DNA, 12 bp, Homo sapiens
caagaccctctc

SEQ ID NO: 4742027 - DNA, 17 bp, Homo sapiens
caagaccctctcaggct

SEQ ID NO: 4742028 - DNA, 23 bp, Homo sapiens
caagaccctctcaggctgtccca

SEQ ID NO: 4742029 - DNA, 17 bp, Homo sapiens
caagaccttctccttca

SEQ ID NO: 4742030 - DNA, 18 bp, Homo sapiens
caagaccttctccttcac

SEQ ID NO: 4742031 - DNA, 21 bp, Homo sapiens
caagaccttctccttcacctt

SEQ ID NO: 4742032 - DNA, 13 bp, Homo sapiens
caagacgctgtgc

SEQ ID NO: 4742033 - DNA, 20 bp, Homo sapiens
caagacgctgtgctgccctg

SEQ ID NO: 4742034 - DNA, 21 bp, Homo sapiens
caagacgctgtgctgccctgc

SEQ ID NO: 4742035 - DNA, 17 bp, Homo sapiens
caagagatagagaccat

SEQ ID NO: 4742036 - DNA, 14 bp, Homo sapiens
caagagcacacttg

SEQ ID NO: 4742037 - DNA, 16 bp, Homo sapiens
caagagcacacttggc

SEQ ID NO: 4742038 - DNA, 20 bp, Homo sapiens
caagagccatgtagaagctg

SEQ ID NO: 4742039 - DNA, 21 bp, Homo sapiens
caagagccatgtagaagctgc

SEQ ID NO: 4742040 - DNA, 12 bp, Homo sapiens
caagagctgagg

SEQ ID NO: 4742041 - DNA, 14 bp, Homo sapiens
caagaggcaaagga

SEQ ID NO: 4742042 - DNA, 12 bp, Homo sapiens
caagagggtctg

SEQ ID NO: 4742043 - DNA, 21 bp, Homo sapiens
caagatattttaaaatctgtc

SEQ ID NO: 4742044 - DNA, 19 bp, Homo sapiens
caagatccaaatgctgtgc

SEQ ID NO: 4742045 - DNA, 12 bp, Homo sapiens
caagatttcaga

SEQ ID NO: 4742046 - DNA, 18 bp, Homo sapiens
caagcaacaagctatttt

SEQ ID NO: 4742047 - DNA, 13 bp, Homo sapiens
caagcaagaaaca

SEQ ID NO: 4742048 - DNA, 18 bp, Homo sapiens
caagcaagaaacactggg

SEQ ID NO: 4742049 - DNA, 12 bp, Homo sapiens
caagcaagctcc

SEQ ID NO: 4742050 - DNA, 16 bp, Homo sapiens
caagcacctcctgcct

SEQ ID NO: 4742051 - DNA, 13 bp, Homo sapiens
caagcactgtgct

SEQ ID NO: 4742052 - DNA, 15 bp, Homo sapiens
caagcgattcttctg

SEQ ID NO: 4742053 - DNA, 16 bp, Homo sapiens
caagcgcttctttctg

SEQ ID NO: 4742054 - DNA, 17 bp, Homo sapiens
caagcgtgagccactgc

SEQ ID NO: 4742055 - DNA, 16 bp, Homo sapiens
caagctagaacctgga

SEQ ID NO: 4742056 - DNA, 17 bp, Homo sapiens
caagctagaacctggag

SEQ ID NO: 4742057 - DNA, 15 bp, Homo sapiens
caagctatcctggct

SEQ ID NO: 4742058 - DNA, 22 bp, Homo sapiens
caagctcccaagggatggtgcc

SEQ ID NO: 4742059 - DNA, 13 bp, Homo sapiens
caagctctgctcc

SEQ ID NO: 4742060 - DNA, 15 bp, Homo sapiens
caagctctgctcctc

SEQ ID NO: 4742061 - DNA, 19 bp, Homo sapiens
caagctggtcccactcagt

SEQ ID NO: 4742062 - DNA, 22 bp, Homo sapiens
caagctggtcccactcagtcca

SEQ ID NO: 4742063 - DNA, 14 bp, Homo sapiens
caagctgtgccacc

SEQ ID NO: 4742064 - DNA, 18 bp, Homo sapiens
caagctgtgccaccctgg

SEQ ID NO: 4742065 - DNA, 20 bp, Homo sapiens
caagctgtgccaccctgggc

SEQ ID NO: 4742066 - DNA, 17 bp, Homo sapiens
caaggaaaccacagctg

SEQ ID NO: 4742067 - DNA, 21 bp, Homo sapiens
caaggaaaccacagctgctgg

SEQ ID NO: 4742068 - DNA, 16 bp, Homo sapiens
caaggaagtctgtgtc

SEQ ID NO: 4742069 - DNA, 16 bp, Homo sapiens
caaggactagggtcct

SEQ ID NO: 4742070 - DNA, 18 bp, Homo sapiens
caaggactagggtcctgg

SEQ ID NO: 4742071 - DNA, 22 bp, Homo sapiens
caaggactggtaaaatacatat

SEQ ID NO: 4742072 - DNA, 19 bp, Homo sapiens
caaggcacctgcaggttgg

SEQ ID NO: 4742073 - DNA, 13 bp, Homo sapiens
caaggcactgcct

SEQ ID NO: 4742074 - DNA, 15 bp, Homo sapiens
caaggcactgcctga

SEQ ID NO: 4742075 - DNA, 13 bp, Homo sapiens
caaggcctcccac

SEQ ID NO: 4742076 - DNA, 14 bp, Homo sapiens
caaggcctcccaca

SEQ ID NO: 4742077 - DNA, 18 bp, Homo sapiens
caaggcctcccacagtga

SEQ ID NO: 4742078 - DNA, 21 bp, Homo sapiens
caaggggaatgtttgcctctg

SEQ ID NO: 4742079 - DNA, 23 bp, Homo sapiens
caaggggaatgtttgcctctgcc

SEQ ID NO: 4742080 - DNA, 13 bp, Homo sapiens
caaggggtggccg

SEQ ID NO: 4742081 - DNA, 19 bp, Homo sapiens
caaggggtggccgtcctga

SEQ ID NO: 4742082 - DNA, 23 bp, Homo sapiens
caaggggtggccgtcctgagggg

SEQ ID NO: 4742083 - DNA, 13 bp, Homo sapiens
caaggtttataaa

SEQ ID NO: 4742084 - DNA, 15 bp, Homo sapiens
caaggtttataaagc

SEQ ID NO: 4742085 - DNA, 16 bp, Homo sapiens
caaggtttataaagca

SEQ ID NO: 4742086 - DNA, 18 bp, Homo sapiens
caaggtttataaagcaga

SEQ ID NO: 4742087 - DNA, 19 bp, Homo sapiens
caaggtttataaagcagat

SEQ ID NO: 4742088 - DNA, 17 bp, Homo sapiens
caagtccacagtggaac

SEQ ID NO: 4742089 - DNA, 14 bp, Homo sapiens
caagtcctcttttc

SEQ ID NO: 4742090 - DNA, 14 bp, Homo sapiens
caagtgagagctgg

SEQ ID NO: 4742091 - DNA, 17 bp, Homo sapiens
caagtgagagctgggtg

SEQ ID NO: 4742092 - DNA, 21 bp, Homo sapiens
caagtgatccttccacctcag

SEQ ID NO: 4742093 - DNA, 22 bp, Homo sapiens
caagtgattctcatgcctcagc

SEQ ID NO: 4742094 - DNA, 22 bp, Homo sapiens
caagttaaggtatctggtatct

SEQ ID NO: 4742095 - DNA, 15 bp, Homo sapiens
caagttccagtgcag

SEQ ID NO: 4742096 - DNA, 20 bp, Homo sapiens
caataaagtgacaaaagctc

SEQ ID NO: 4742097 - DNA, 12 bp, Homo sapiens
caataagccttg

SEQ ID NO: 4742098 - DNA, 18 bp, Homo sapiens
caataataatacctccct

SEQ ID NO: 4742099 - DNA, 19 bp, Homo sapiens
caatacccaaatcctctcc

SEQ ID NO: 4742100 - DNA, 22 bp, Homo sapiens
caatacccaaatcctctccagc

SEQ ID NO: 4742101 - DNA, 13 bp, Homo sapiens
caatactcccttt

SEQ ID NO: 4742102 - DNA, 15 bp, Homo sapiens
caatagggttaaatg

SEQ ID NO: 4742103 - DNA, 15 bp, Homo sapiens
caatataagaaggaa

SEQ ID NO: 4742104 - DNA, 16 bp, Homo sapiens
caatatggatttctta

SEQ ID NO: 4742105 - DNA, 12 bp, Homo sapiens
caatattgtaat

SEQ ID NO: 4742106 - DNA, 17 bp, Homo sapiens
caatattgtacagtttt

SEQ ID NO: 4742107 - DNA, 18 bp, Homo sapiens
caatattgtacagttttt

SEQ ID NO: 4742108 - DNA, 13 bp, Homo sapiens
caatattttccat

SEQ ID NO: 4742109 - DNA, 17 bp, Homo sapiens
caatatttttattttta

SEQ ID NO: 4742110 - DNA, 18 bp, Homo sapiens
caatcaaaatcacctccc

SEQ ID NO: 4742111 - DNA, 18 bp, Homo sapiens
caatcagctccttcctgg

SEQ ID NO: 4742112 - DNA, 15 bp, Homo sapiens
caatcagtgtgaatg

SEQ ID NO: 4742113 - DNA, 16 bp, Homo sapiens
caatccaaatgcattc

SEQ ID NO: 4742114 - DNA, 17 bp, Homo sapiens
caatccaaatgcattca

SEQ ID NO: 4742115 - DNA, 11 bp, Homo sapiens
caatccctcaa

SEQ ID NO: 4742116 - DNA, 12 bp, Homo sapiens
caatccctcaaa

SEQ ID NO: 4742117 - DNA, 20 bp, Homo sapiens
caatcctatgtttttgttca

SEQ ID NO: 4742118 - DNA, 22 bp, Homo sapiens
caatctattaatagctgcctta

SEQ ID NO: 4742119 - DNA, 11 bp, Homo sapiens
caatctctgac

SEQ ID NO: 4742120 - DNA, 15 bp, Homo sapiens
caatgaaaaaatgta

SEQ ID NO: 4742121 - DNA, 15 bp, Homo sapiens
caatgactcaaagtc

SEQ ID NO: 4742122 - DNA, 13 bp, Homo sapiens
caatgagagcata

SEQ ID NO: 4742123 - DNA, 14 bp, Homo sapiens
caatgcactttgtt

SEQ ID NO: 4742124 - DNA, 22 bp, Homo sapiens
caatgcactttgttctggctct

SEQ ID NO: 4742125 - DNA, 13 bp, Homo sapiens
caatgccatcatc

SEQ ID NO: 4742126 - DNA, 16 bp, Homo sapiens
caatgccatcctcaaa

SEQ ID NO: 4742127 - DNA, 12 bp, Homo sapiens
caatgcgtggca

SEQ ID NO: 4742128 - DNA, 17 bp, Homo sapiens
caatgctgcctgggagc

SEQ ID NO: 4742129 - DNA, 22 bp, Homo sapiens
caatgctgcctgggagccaggg

SEQ ID NO: 4742130 - DNA, 22 bp, Homo sapiens
caatgctggctgttggctgggg

SEQ ID NO: 4742131 - DNA, 13 bp, Homo sapiens
caatgctgtgaat

SEQ ID NO: 4742132 - DNA, 17 bp, Homo sapiens
caatggaacctcctttc

SEQ ID NO: 4742133 - DNA, 14 bp, Homo sapiens
caatggaccggaga

SEQ ID NO: 4742134 - DNA, 15 bp, Homo sapiens
caatggcagccttgg

SEQ ID NO: 4742135 - DNA, 17 bp, Homo sapiens
caatgggggagggaggg

SEQ ID NO: 4742136 - DNA, 22 bp, Homo sapiens
caatggtgttcaccatcggcag

SEQ ID NO: 4742137 - DNA, 19 bp, Homo sapiens
caatggtttgcaaggaagc

SEQ ID NO: 4742138 - DNA, 11 bp, Homo sapiens
caatgtaaaaa

SEQ ID NO: 4742139 - DNA, 20 bp, Homo sapiens
caatgtgtggctgaagactt

SEQ ID NO: 4742140 - DNA, 11 bp, Homo sapiens
caatgttaagg

SEQ ID NO: 4742141 - DNA, 24 bp, Homo sapiens
caatgttaaggaaactcttatctc

SEQ ID NO: 4742142 - DNA, 20 bp, Homo sapiens
caatgtttttgtgtagagtg

SEQ ID NO: 4742143 - DNA, 15 bp, Homo sapiens
caattaagttacaat

SEQ ID NO: 4742144 - DNA, 23 bp, Homo sapiens
caattaagttacaattacatctc

SEQ ID NO: 4742145 - DNA, 15 bp, Homo sapiens
caattacatctctaa

SEQ ID NO: 4742146 - DNA, 21 bp, Homo sapiens
caattataacttattagcagt

SEQ ID NO: 4742147 - DNA, 17 bp, Homo sapiens
caattctcctgcctcag

SEQ ID NO: 4742148 - DNA, 18 bp, Homo sapiens
caattcttacaaacatgt

SEQ ID NO: 4742149 - DNA, 22 bp, Homo sapiens
caattcttccctatctttgcca

SEQ ID NO: 4742150 - DNA, 14 bp, Homo sapiens
caattgcatctccc

SEQ ID NO: 4742151 - DNA, 22 bp, Homo sapiens
caatttactttttaaacagtgt

SEQ ID NO: 4742152 - DNA, 20 bp, Homo sapiens
caatttctactttgaagtca

SEQ ID NO: 4742153 - DNA, 21 bp, Homo sapiens
caatttctactttgaagtcat

SEQ ID NO: 4742154 - DNA, 15 bp, Homo sapiens
caatttctccccagg

SEQ ID NO: 4742155 - DNA, 21 bp, Homo sapiens
caatttggatttaaaagcctg

SEQ ID NO: 4742156 - DNA, 14 bp, Homo sapiens
caattttttaaacc

SEQ ID NO: 4742157 - DNA, 16 bp, Homo sapiens
cacaaaagctgtgtct

SEQ ID NO: 4742158 - DNA, 22 bp, Homo sapiens
cacaaaatatattttgtttaca

SEQ ID NO: 4742159 - DNA, 13 bp, Homo sapiens
cacaaacctgcct

SEQ ID NO: 4742160 - DNA, 13 bp, Homo sapiens
cacaaataggtat

SEQ ID NO: 4742161 - DNA, 20 bp, Homo sapiens
cacaaatgtgtcccagtgaa

SEQ ID NO: 4742162 - DNA, 19 bp, Homo sapiens
cacaactagttaaaagcct

SEQ ID NO: 4742163 - DNA, 20 bp, Homo sapiens
cacaacttgtttttggtttt

SEQ ID NO: 4742164 - DNA, 14 bp, Homo sapiens
cacaagacccttgt

SEQ ID NO: 4742165 - DNA, 20 bp, Homo sapiens
cacaagccaaggaagtctgt

SEQ ID NO: 4742166 - DNA, 15 bp, Homo sapiens
cacaagctccaagct

SEQ ID NO: 4742167 - DNA, 17 bp, Homo sapiens
cacaagctccaagctcc

SEQ ID NO: 4742168 - DNA, 23 bp, Homo sapiens
cacaataaaaccaagcctctgga

SEQ ID NO: 4742169 - DNA, 23 bp, Homo sapiens
cacaatctcggctcactgcatcc

SEQ ID NO: 4742170 - DNA, 17 bp, Homo sapiens
cacaatggagtgtgtaa

SEQ ID NO: 4742171 - DNA, 20 bp, Homo sapiens
cacaatgttgcactgaaaac

SEQ ID NO: 4742172 - DNA, 13 bp, Homo sapiens
cacacacacatac

SEQ ID NO: 4742173 - DNA, 15 bp, Homo sapiens
cacacacaggagcat

SEQ ID NO: 4742174 - DNA, 14 bp, Homo sapiens
cacacaccagagcc

SEQ ID NO: 4742175 - DNA, 15 bp, Homo sapiens
cacacaccagagccc

SEQ ID NO: 4742176 - DNA, 17 bp, Homo sapiens
cacacacgcgtgcacac

SEQ ID NO: 4742177 - DNA, 14 bp, Homo sapiens
cacacactttggct

SEQ ID NO: 4742178 - DNA, 18 bp, Homo sapiens
cacacagatttgagctca

SEQ ID NO: 4742179 - DNA, 13 bp, Homo sapiens
cacacagctctgt

SEQ ID NO: 4742180 - DNA, 15 bp, Homo sapiens
cacacagctctgtcc

SEQ ID NO: 4742181 - DNA, 23 bp, Homo sapiens
cacacagtgagtcgaggacaggg

SEQ ID NO: 4742182 - DNA, 12 bp, Homo sapiens
cacacatacaca

SEQ ID NO: 4742183 - DNA, 17 bp, Homo sapiens
cacaccaagctgtgcca

SEQ ID NO: 4742184 - DNA, 18 bp, Homo sapiens
cacaccaagctgtgccac

SEQ ID NO: 4742185 - DNA, 15 bp, Homo sapiens
cacaccagagcccac

SEQ ID NO: 4742186 - DNA, 21 bp, Homo sapiens
cacaccagagcccaccttggc

SEQ ID NO: 4742187 - DNA, 15 bp, Homo sapiens
cacaccccaacatgc

SEQ ID NO: 4742188 - DNA, 13 bp, Homo sapiens
cacacctctggct

SEQ ID NO: 4742189 - DNA, 15 bp, Homo sapiens
cacacctctggctgt

SEQ ID NO: 4742190 - DNA, 17 bp, Homo sapiens
cacacctttattcagaa

SEQ ID NO: 4742191 - DNA, 18 bp, Homo sapiens
cacacctttattcagaac

SEQ ID NO: 4742192 - DNA, 23 bp, Homo sapiens
cacactgaaaaggaaaatgggaa

SEQ ID NO: 4742193 - DNA, 19 bp, Homo sapiens
cacactgggacttgcaaaa

SEQ ID NO: 4742194 - DNA, 21 bp, Homo sapiens
cacacttggcccaagtggcag

SEQ ID NO: 4742195 - DNA, 16 bp, Homo sapiens
cacagaaaccaatttt

SEQ ID NO: 4742196 - DNA, 22 bp, Homo sapiens
cacagacactaacgaaatatca

SEQ ID NO: 4742197 - DNA, 13 bp, Homo sapiens
cacagaccctgcc

SEQ ID NO: 4742198 - DNA, 16 bp, Homo sapiens
cacagaccctgccctg

SEQ ID NO: 4742199 - DNA, 14 bp, Homo sapiens
cacagacctgctct

SEQ ID NO: 4742200 - DNA, 19 bp, Homo sapiens
cacagacctgctctggaca

SEQ ID NO: 4742201 - DNA, 22 bp, Homo sapiens
cacagacctgctctggacactt

SEQ ID NO: 4742202 - DNA, 23 bp, Homo sapiens
cacagatgggtgcttggaggaag

SEQ ID NO: 4742203 - DNA, 16 bp, Homo sapiens
cacagcaaggaggctg

SEQ ID NO: 4742204 - DNA, 21 bp, Homo sapiens
cacagcaaggaggctggctgg

SEQ ID NO: 4742205 - DNA, 23 bp, Homo sapiens
cacagcaaggaggctggctgggg

SEQ ID NO: 4742206 - DNA, 15 bp, Homo sapiens
cacagcaaggcacct

SEQ ID NO: 4742207 - DNA, 19 bp, Homo sapiens
cacagcaaggcacctgcag

SEQ ID NO: 4742208 - DNA, 20 bp, Homo sapiens
cacagcacgggggccaagga

SEQ ID NO: 4742209 - DNA, 14 bp, Homo sapiens
cacagccaaggact

SEQ ID NO: 4742210 - DNA, 13 bp, Homo sapiens
cacagccatccca

SEQ ID NO: 4742211 - DNA, 19 bp, Homo sapiens
cacagcccaaagaaggaaa

SEQ ID NO: 4742212 - DNA, 17 bp, Homo sapiens
cacagcccacgtcctgt

SEQ ID NO: 4742213 - DNA, 18 bp, Homo sapiens
cacagcccacgtcctgtc

SEQ ID NO: 4742214 - DNA, 12 bp, Homo sapiens
cacagccctccc

SEQ ID NO: 4742215 - DNA, 20 bp, Homo sapiens
cacagccctcccgccccttc

SEQ ID NO: 4742216 - DNA, 23 bp, Homo sapiens
cacagcctcccctgccagggcag

SEQ ID NO: 4742217 - DNA, 19 bp, Homo sapiens
cacagcgctggccgggacc

SEQ ID NO: 4742218 - DNA, 16 bp, Homo sapiens
cacagctctgtcctgg

SEQ ID NO: 4742219 - DNA, 18 bp, Homo sapiens
cacagctctgtcctggga

SEQ ID NO: 4742220 - DNA, 14 bp, Homo sapiens
cacagctcttctcc

SEQ ID NO: 4742221 - DNA, 21 bp, Homo sapiens
cacagcttcatttcctgtgtc

SEQ ID NO: 4742222 - DNA, 15 bp, Homo sapiens
cacaggagcatttgg

SEQ ID NO: 4742223 - DNA, 14 bp, Homo sapiens
cacaggagggaggg

SEQ ID NO: 4742224 - DNA, 11 bp, Homo sapiens
cacaggcaggt

SEQ ID NO: 4742225 - DNA, 19 bp, Homo sapiens
cacaggcaggtccagggtt

SEQ ID NO: 4742226 - DNA, 17 bp, Homo sapiens
cacaggcccggctccag

SEQ ID NO: 4742227 - DNA, 20 bp, Homo sapiens
cacaggcctgagatttcatc

SEQ ID NO: 4742228 - DNA, 15 bp, Homo sapiens
cacagggatccgact

SEQ ID NO: 4742229 - DNA, 23 bp, Homo sapiens
cacaggtatgaccttctaggaag

SEQ ID NO: 4742230 - DNA, 16 bp, Homo sapiens
cacagtattacttctg

SEQ ID NO: 4742231 - DNA, 19 bp, Homo sapiens
cacagtattacttctgcta

SEQ ID NO: 4742232 - DNA, 21 bp, Homo sapiens
cacagtattacttctgctaca

SEQ ID NO: 4742233 - DNA, 15 bp, Homo sapiens
cacagtccttaccag

SEQ ID NO: 4742234 - DNA, 21 bp, Homo sapiens
cacagtccttaccagcagagc

SEQ ID NO: 4742235 - DNA, 20 bp, Homo sapiens
cacagtgactcgggctcctg

SEQ ID NO: 4742236 - DNA, 22 bp, Homo sapiens
cacagtgactcgggctcctgtg

SEQ ID NO: 4742237 - DNA, 23 bp, Homo sapiens
cacagtgactcgggctcctgtgc

SEQ ID NO: 4742238 - DNA, 18 bp, Homo sapiens
cacagtgagtcgaggaca

SEQ ID NO: 4742239 - DNA, 14 bp, Homo sapiens
cacagtgtctgggc

SEQ ID NO: 4742240 - DNA, 16 bp, Homo sapiens
cacagtgtctgggctg

SEQ ID NO: 4742241 - DNA, 17 bp, Homo sapiens
cacagttcaattctcat

SEQ ID NO: 4742242 - DNA, 21 bp, Homo sapiens
cacatacagagctctctgagg

SEQ ID NO: 4742243 - DNA, 12 bp, Homo sapiens
cacatatctgtc

SEQ ID NO: 4742244 - DNA, 21 bp, Homo sapiens
cacatattaagaatagtctct

SEQ ID NO: 4742245 - DNA, 20 bp, Homo sapiens
cacatcacaagactatgcca

SEQ ID NO: 4742246 - DNA, 22 bp, Homo sapiens
cacatcctccacgttctgctca

SEQ ID NO: 4742247 - DNA, 13 bp, Homo sapiens
cacatcttgctct

SEQ ID NO: 4742248 - DNA, 16 bp, Homo sapiens
cacatcttgctctgct

SEQ ID NO: 4742249 - DNA, 18 bp, Homo sapiens
cacatcttgctctgctga

SEQ ID NO: 4742250 - DNA, 22 bp, Homo sapiens
cacatcttgctctgctgacaga

SEQ ID NO: 4742251 - DNA, 23 bp, Homo sapiens
cacatcttgctctgctgacagac

SEQ ID NO: 4742252 - DNA, 15 bp, Homo sapiens
cacatctttttcact

SEQ ID NO: 4742253 - DNA, 16 bp, Homo sapiens
cacatgtccaagaagc

SEQ ID NO: 4742254 - DNA, 18 bp, Homo sapiens
cacatgtccaagaagccc

SEQ ID NO: 4742255 - DNA, 19 bp, Homo sapiens
cacatgtccaagaagccca

SEQ ID NO: 4742256 - DNA, 21 bp, Homo sapiens
cacatgtccaagaagcccagg

SEQ ID NO: 4742257 - DNA, 23 bp, Homo sapiens
cacatgtccaagaagcccaggaa

SEQ ID NO: 4742258 - DNA, 15 bp, Homo sapiens
cacatgtgcacatgc

SEQ ID NO: 4742259 - DNA, 18 bp, Homo sapiens
cacattccttgcctgcac

SEQ ID NO: 4742260 - DNA, 17 bp, Homo sapiens
cacattgccccatgaga

SEQ ID NO: 4742261 - DNA, 16 bp, Homo sapiens
cacatttaagagacag

SEQ ID NO: 4742262 - DNA, 12 bp, Homo sapiens
cacatttacata

SEQ ID NO: 4742263 - DNA, 23 bp, Homo sapiens
caccaacatactcccatctgtga

SEQ ID NO: 4742264 - DNA, 14 bp, Homo sapiens
caccaacgtctgtg

SEQ ID NO: 4742265 - DNA, 13 bp, Homo sapiens
caccaagcccagt

SEQ ID NO: 4742266 - DNA, 13 bp, Homo sapiens
caccaagctcaaa

SEQ ID NO: 4742267 - DNA, 15 bp, Homo sapiens
caccaagctgtgcca

SEQ ID NO: 4742268 - DNA, 20 bp, Homo sapiens
caccaagctgtgccaccctg

SEQ ID NO: 4742269 - DNA, 22 bp, Homo sapiens
caccaagctgtgccaccctggg

SEQ ID NO: 4742270 - DNA, 23 bp, Homo sapiens
caccaagttggaacatccttgga

SEQ ID NO: 4742271 - DNA, 14 bp, Homo sapiens
caccaataaatgtt

SEQ ID NO: 4742272 - DNA, 13 bp, Homo sapiens
caccacacccagc

SEQ ID NO: 4742273 - DNA, 22 bp, Homo sapiens
caccacagcttatggcatctca

SEQ ID NO: 4742274 - DNA, 18 bp, Homo sapiens
caccacatgtgcacatgc

SEQ ID NO: 4742275 - DNA, 14 bp, Homo sapiens
caccacccagagca

SEQ ID NO: 4742276 - DNA, 20 bp, Homo sapiens
caccaccccccactctgtgc

SEQ ID NO: 4742277 - DNA, 12 bp, Homo sapiens
caccacctgctc

SEQ ID NO: 4742278 - DNA, 17 bp, Homo sapiens
caccacctgctcactgg

SEQ ID NO: 4742279 - DNA, 14 bp, Homo sapiens
caccacgcccggct

SEQ ID NO: 4742280 - DNA, 18 bp, Homo sapiens
caccacgtggggccatgc

SEQ ID NO: 4742281 - DNA, 12 bp, Homo sapiens
caccagagcaga

SEQ ID NO: 4742282 - DNA, 16 bp, Homo sapiens
caccagagcagatgca

SEQ ID NO: 4742283 - DNA, 18 bp, Homo sapiens
caccagagcagatgcaga

SEQ ID NO: 4742284 - DNA, 20 bp, Homo sapiens
caccagagcagatgcagaga

SEQ ID NO: 4742285 - DNA, 18 bp, Homo sapiens
caccagccccagtgccca

SEQ ID NO: 4742286 - DNA, 19 bp, Homo sapiens
caccagcccttagcaggga

SEQ ID NO: 4742287 - DNA, 21 bp, Homo sapiens
caccagggaaggggacaagga

SEQ ID NO: 4742288 - DNA, 22 bp, Homo sapiens
caccagggttgaccccagagga

SEQ ID NO: 4742289 - DNA, 23 bp, Homo sapiens
caccagggttgaccccagaggat

SEQ ID NO: 4742290 - DNA, 16 bp, Homo sapiens
caccaggtagaacaca

SEQ ID NO: 4742291 - DNA, 18 bp, Homo sapiens
caccagttcctttcaatg

SEQ ID NO: 4742292 - DNA, 14 bp, Homo sapiens
caccatcaagccac

SEQ ID NO: 4742293 - DNA, 15 bp, Homo sapiens
caccatcaagccacc

SEQ ID NO: 4742294 - DNA, 17 bp, Homo sapiens
caccatcaagccaccaa

SEQ ID NO: 4742295 - DNA, 17 bp, Homo sapiens
caccatcatgtctggct

SEQ ID NO: 4742296 - DNA, 20 bp, Homo sapiens
caccatgttggccaggctgc

SEQ ID NO: 4742297 - DNA, 13 bp, Homo sapiens
cacccaagggcct

SEQ ID NO: 4742298 - DNA, 14 bp, Homo sapiens
cacccaagggcctg

SEQ ID NO: 4742299 - DNA, 23 bp, Homo sapiens
cacccaagggcctggcctgagct

SEQ ID NO: 4742300 - DNA, 22 bp, Homo sapiens
cacccaccatcatgtctggcta

SEQ ID NO: 4742301 - DNA, 16 bp, Homo sapiens
cacccacctcagcctc

SEQ ID NO: 4742302 - DNA, 16 bp, Homo sapiens
cacccacttctgcact

SEQ ID NO: 4742303 - DNA, 21 bp, Homo sapiens
cacccagatgggggaaagcac

SEQ ID NO: 4742304 - DNA, 20 bp, Homo sapiens
cacccagccccaaggggtgg

SEQ ID NO: 4742305 - DNA, 21 bp, Homo sapiens
caccccacccacttctgcact

SEQ ID NO: 4742306 - DNA, 12 bp, Homo sapiens
caccccagcccc

SEQ ID NO: 4742307 - DNA, 13 bp, Homo sapiens
caccccaggactc

SEQ ID NO: 4742308 - DNA, 13 bp, Homo sapiens
caccccagggcag

SEQ ID NO: 4742309 - DNA, 18 bp, Homo sapiens
caccccagggcagccagg

SEQ ID NO: 4742310 - DNA, 22 bp, Homo sapiens
cacccccacccaagggcctggc

SEQ ID NO: 4742311 - DNA, 16 bp, Homo sapiens
caccccccactctgtg

SEQ ID NO: 4742312 - DNA, 15 bp, Homo sapiens
caccccccttctgaa

SEQ ID NO: 4742313 - DNA, 16 bp, Homo sapiens
caccccctccccgccc

SEQ ID NO: 4742314 - DNA, 14 bp, Homo sapiens
caccccctcctgct

SEQ ID NO: 4742315 - DNA, 17 bp, Homo sapiens
caccccggccacctgcg

SEQ ID NO: 4742316 - DNA, 15 bp, Homo sapiens
cacccctccctttct

SEQ ID NO: 4742317 - DNA, 17 bp, Homo sapiens
cacccctggttctcatc

SEQ ID NO: 4742318 - DNA, 17 bp, Homo sapiens
cacccggcccctgctgg

SEQ ID NO: 4742319 - DNA, 13 bp, Homo sapiens
cacccgggctcag

SEQ ID NO: 4742320 - DNA, 19 bp, Homo sapiens
caccctcaccgcggctgga

SEQ ID NO: 4742321 - DNA, 14 bp, Homo sapiens
caccctcatgctgt

SEQ ID NO: 4742322 - DNA, 13 bp, Homo sapiens
caccctcccctcc

SEQ ID NO: 4742323 - DNA, 21 bp, Homo sapiens
caccctgggctctgtgggctg

SEQ ID NO: 4742324 - DNA, 15 bp, Homo sapiens
caccctggggagaaa

SEQ ID NO: 4742325 - DNA, 12 bp, Homo sapiens
caccctgtgatg

SEQ ID NO: 4742326 - DNA, 15 bp, Homo sapiens
caccgcagacaggac

SEQ ID NO: 4742327 - DNA, 14 bp, Homo sapiens
caccgcatgccccc

SEQ ID NO: 4742328 - DNA, 15 bp, Homo sapiens
caccgcatgccccct

SEQ ID NO: 4742329 - DNA, 16 bp, Homo sapiens
caccgcatgccccctc

SEQ ID NO: 4742330 - DNA, 12 bp, Homo sapiens
caccgccagctt

SEQ ID NO: 4742331 - DNA, 22 bp, Homo sapiens
caccgccatggcttccaaggtg

SEQ ID NO: 4742332 - DNA, 23 bp, Homo sapiens
caccgccatggcttccaaggtgg

SEQ ID NO: 4742333 - DNA, 14 bp, Homo sapiens
caccggctggcctg

SEQ ID NO: 4742334 - DNA, 15 bp, Homo sapiens
caccgggcactcaga

SEQ ID NO: 4742335 - DNA, 18 bp, Homo sapiens
caccgtagggcctgactc

SEQ ID NO: 4742336 - DNA, 23 bp, Homo sapiens
caccgtagggcctgactccttct

SEQ ID NO: 4742337 - DNA, 15 bp, Homo sapiens
caccgtgcctggcca

SEQ ID NO: 4742338 - DNA, 18 bp, Homo sapiens
caccgtgggctccctgac

SEQ ID NO: 4742339 - DNA, 19 bp, Homo sapiens
cacctaaaccctctgtgaa

SEQ ID NO: 4742340 - DNA, 21 bp, Homo sapiens
cacctaaaccctctgtgaaat

SEQ ID NO: 4742341 - DNA, 13 bp, Homo sapiens
cacctacagtgta

SEQ ID NO: 4742342 - DNA, 15 bp, Homo sapiens
cacctagtggctgtc

SEQ ID NO: 4742343 - DNA, 21 bp, Homo sapiens
cacctagtggctgtccagtgc

SEQ ID NO: 4742344 - DNA, 18 bp, Homo sapiens
cacctcaatatttactat

SEQ ID NO: 4742345 - DNA, 13 bp, Homo sapiens
cacctcagcctcc

SEQ ID NO: 4742346 - DNA, 21 bp, Homo sapiens
cacctcccccatctcttctgg

SEQ ID NO: 4742347 - DNA, 22 bp, Homo sapiens
cacctcctgtgttgtgctggga

SEQ ID NO: 4742348 - DNA, 17 bp, Homo sapiens
cacctctctcactcctt

SEQ ID NO: 4742349 - DNA, 20 bp, Homo sapiens
cacctctgggccaggttgga

SEQ ID NO: 4742350 - DNA, 20 bp, Homo sapiens
cacctgaaattaatttgtga

SEQ ID NO: 4742351 - DNA, 14 bp, Homo sapiens
cacctgaagactca

SEQ ID NO: 4742352 - DNA, 23 bp, Homo sapiens
cacctgcaggttgggccatactg

SEQ ID NO: 4742353 - DNA, 13 bp, Homo sapiens
cacctgccaggga

SEQ ID NO: 4742354 - DNA, 17 bp, Homo sapiens
cacctgcggtgctatct

SEQ ID NO: 4742355 - DNA, 23 bp, Homo sapiens
cacctgcggtgctatctccccca

SEQ ID NO: 4742356 - DNA, 11 bp, Homo sapiens
cacctggaccc

SEQ ID NO: 4742357 - DNA, 19 bp, Homo sapiens
cacctggacccctgcattg

SEQ ID NO: 4742358 - DNA, 14 bp, Homo sapiens
cacctggcctctgc

SEQ ID NO: 4742359 - DNA, 20 bp, Homo sapiens
cacctggcctctgcactccc

SEQ ID NO: 4742360 - DNA, 16 bp, Homo sapiens
caccttccaaacaaaa

SEQ ID NO: 4742361 - DNA, 19 bp, Homo sapiens
caccttccaaacaaaagca

SEQ ID NO: 4742362 - DNA, 22 bp, Homo sapiens
caccttctgacgcagcctgaga

SEQ ID NO: 4742363 - DNA, 15 bp, Homo sapiens
caccttgacagggca

SEQ ID NO: 4742364 - DNA, 18 bp, Homo sapiens
caccttgacagggcacac

SEQ ID NO: 4742365 - DNA, 13 bp, Homo sapiens
caccttggctgca

SEQ ID NO: 4742366 - DNA, 16 bp, Homo sapiens
caccttggctgcaggg

SEQ ID NO: 4742367 - DNA, 17 bp, Homo sapiens
cacctttgtttctcccc

SEQ ID NO: 4742368 - DNA, 19 bp, Homo sapiens
cacctttgtttctccccca

SEQ ID NO: 4742369 - DNA, 17 bp, Homo sapiens
caccttttttaaggaaa

SEQ ID NO: 4742370 - DNA, 19 bp, Homo sapiens
cacgcacacacacatacag

SEQ ID NO: 4742371 - DNA, 20 bp, Homo sapiens
cacgcacacacacatacaga

SEQ ID NO: 4742372 - DNA, 15 bp, Homo sapiens
cacgcacgcacacac

SEQ ID NO: 4742373 - DNA, 17 bp, Homo sapiens
cacgcacgcacacacac

SEQ ID NO: 4742374 - DNA, 16 bp, Homo sapiens
cacgcagctggcagag

SEQ ID NO: 4742375 - DNA, 15 bp, Homo sapiens
cacgcgcgcacacac

SEQ ID NO: 4742376 - DNA, 19 bp, Homo sapiens
cacgcggccacctcaccct

SEQ ID NO: 4742377 - DNA, 16 bp, Homo sapiens
cacgcgtgcacacacc

SEQ ID NO: 4742378 - DNA, 23 bp, Homo sapiens
cacgcgtgcacacaccagagccc

SEQ ID NO: 4742379 - DNA, 20 bp, Homo sapiens
cacgctggaccttgaactgg

SEQ ID NO: 4742380 - DNA, 17 bp, Homo sapiens
cacgctggagtgcagtg

SEQ ID NO: 4742381 - DNA, 20 bp, Homo sapiens
cacgctggagtgcagtgagc

SEQ ID NO: 4742382 - DNA, 21 bp, Homo sapiens
cacgctggagtgcagtgagcc

SEQ ID NO: 4742383 - DNA, 21 bp, Homo sapiens
cacggagccactcctctgact

SEQ ID NO: 4742384 - DNA, 23 bp, Homo sapiens
cacggagccactcctctgactca

SEQ ID NO: 4742385 - DNA, 13 bp, Homo sapiens
cacggctgctgag

SEQ ID NO: 4742386 - DNA, 15 bp, Homo sapiens
cacgggggcagctga

SEQ ID NO: 4742387 - DNA, 22 bp, Homo sapiens
cacgtccacgcggccacctcac

SEQ ID NO: 4742388 - DNA, 16 bp, Homo sapiens
cacgtcctgtcagtgc

SEQ ID NO: 4742389 - DNA, 23 bp, Homo sapiens
cacgtcctgtcagtgccgccgcc

SEQ ID NO: 4742390 - DNA, 14 bp, Homo sapiens
cacgtctgacaaat

SEQ ID NO: 4742391 - DNA, 18 bp, Homo sapiens
cacgtgtgtttttctatt

SEQ ID NO: 4742392 - DNA, 13 bp, Homo sapiens
cactaaacaaaga

SEQ ID NO: 4742393 - DNA, 11 bp, Homo sapiens
cactaactaga

SEQ ID NO: 4742394 - DNA, 18 bp, Homo sapiens
cactaattctgcatctgg

SEQ ID NO: 4742395 - DNA, 15 bp, Homo sapiens
cactaccgtggacca

SEQ ID NO: 4742396 - DNA, 14 bp, Homo sapiens
cactactacatctg

SEQ ID NO: 4742397 - DNA, 14 bp, Homo sapiens
cactagacatgtca

SEQ ID NO: 4742398 - DNA, 15 bp, Homo sapiens
cactagaggccaggg

SEQ ID NO: 4742399 - DNA, 14 bp, Homo sapiens
cactatagcctagg

SEQ ID NO: 4742400 - DNA, 21 bp, Homo sapiens
cactatagcctaggtgacaga

SEQ ID NO: 4742401 - DNA, 16 bp, Homo sapiens
cactatgttgcccagg

SEQ ID NO: 4742402 - DNA, 22 bp, Homo sapiens
cactattggctgggagtggtgg

SEQ ID NO: 4742403 - DNA, 13 bp, Homo sapiens
cactatttaaact

SEQ ID NO: 4742404 - DNA, 20 bp, Homo sapiens
cactcaagaagcaggctaca

SEQ ID NO: 4742405 - DNA, 20 bp, Homo sapiens
cactcacatttattctgctc

SEQ ID NO: 4742406 - DNA, 17 bp, Homo sapiens
cactcagaagacactga

SEQ ID NO: 4742407 - DNA, 19 bp, Homo sapiens
cactcagaagacactgatg

SEQ ID NO: 4742408 - DNA, 16 bp, Homo sapiens
cactcaggtctgtttt

SEQ ID NO: 4742409 - DNA, 16 bp, Homo sapiens
cactcagtccatagca

SEQ ID NO: 4742410 - DNA, 15 bp, Homo sapiens
cactcagttctgctc

SEQ ID NO: 4742411 - DNA, 18 bp, Homo sapiens
cactcattgacctgaggc

SEQ ID NO: 4742412 - DNA, 22 bp, Homo sapiens
cactccacgcagctggcagaga

SEQ ID NO: 4742413 - DNA, 14 bp, Homo sapiens
cactcccacttccc

SEQ ID NO: 4742414 - DNA, 15 bp, Homo sapiens
cactcccaggcagcc

SEQ ID NO: 4742415 - DNA, 16 bp, Homo sapiens
cactccctgcaacctg

SEQ ID NO: 4742416 - DNA, 20 bp, Homo sapiens
cactcccttgggctccctgt

SEQ ID NO: 4742417 - DNA, 18 bp, Homo sapiens
cactcctacacctaactc

SEQ ID NO: 4742418 - DNA, 12 bp, Homo sapiens
cactcctctgac

SEQ ID NO: 4742419 - DNA, 20 bp, Homo sapiens
cactctcccccaccccctcc

SEQ ID NO: 4742420 - DNA, 12 bp, Homo sapiens
cactctggcagc

SEQ ID NO: 4742421 - DNA, 15 bp, Homo sapiens
cactctggcagctca

SEQ ID NO: 4742422 - DNA, 19 bp, Homo sapiens
cactctggcagctcagaga

SEQ ID NO: 4742423 - DNA, 21 bp, Homo sapiens
cactctggcagctcagagagg

SEQ ID NO: 4742424 - DNA, 12 bp, Homo sapiens
cactctgtgccc

SEQ ID NO: 4742425 - DNA, 16 bp, Homo sapiens
cactctgtgcccatgg

SEQ ID NO: 4742426 - DNA, 21 bp, Homo sapiens
cactctgtgcccatgggcact

SEQ ID NO: 4742427 - DNA, 22 bp, Homo sapiens
cactcttattgcccacgctgga

SEQ ID NO: 4742428 - DNA, 13 bp, Homo sapiens
cactgacactggt

SEQ ID NO: 4742429 - DNA, 13 bp, Homo sapiens
cactgactattac

SEQ ID NO: 4742430 - DNA, 19 bp, Homo sapiens
cactgagaatgtaagaact

SEQ ID NO: 4742431 - DNA, 21 bp, Homo sapiens
cactgagaatgtaagaactac

SEQ ID NO: 4742432 - DNA, 14 bp, Homo sapiens
cactgagacagccc

SEQ ID NO: 4742433 - DNA, 22 bp, Homo sapiens
cactgagacagcccgggctctg

SEQ ID NO: 4742434 - DNA, 15 bp, Homo sapiens
cactgagctgtcatg

SEQ ID NO: 4742435 - DNA, 15 bp, Homo sapiens
cactgagggtcactc

SEQ ID NO: 4742436 - DNA, 21 bp, Homo sapiens
cactgatctgctagtgctgta

SEQ ID NO: 4742437 - DNA, 23 bp, Homo sapiens
cactgcaacctccgcctcttggg

SEQ ID NO: 4742438 - DNA, 23 bp, Homo sapiens
cactgcaaccttcgccacctggg

SEQ ID NO: 4742439 - DNA, 22 bp, Homo sapiens
cactgcaacttgtgaactccat

SEQ ID NO: 4742440 - DNA, 23 bp, Homo sapiens
cactgcacagaagacagcagcaa

SEQ ID NO: 4742441 - DNA, 13 bp, Homo sapiens
cactgcaccccct

SEQ ID NO: 4742442 - DNA, 16 bp, Homo sapiens
cactgcaccccctcct

SEQ ID NO: 4742443 - DNA, 20 bp, Homo sapiens
cactgcaccccctcctgctg

SEQ ID NO: 4742444 - DNA, 15 bp, Homo sapiens
cactgcaccgggcca

SEQ ID NO: 4742445 - DNA, 13 bp, Homo sapiens
cactgcagcctca

SEQ ID NO: 4742446 - DNA, 19 bp, Homo sapiens
cactgcagcctcaacctcc

SEQ ID NO: 4742447 - DNA, 20 bp, Homo sapiens
cactgcagcctcaacctcct

SEQ ID NO: 4742448 - DNA, 23 bp, Homo sapiens
cactgcagcctcaacctcctggg

SEQ ID NO: 4742449 - DNA, 19 bp, Homo sapiens
cactgcggggcttggctga

SEQ ID NO: 4742450 - DNA, 14 bp, Homo sapiens
cactgctgggtggc

SEQ ID NO: 4742451 - DNA, 17 bp, Homo sapiens
cactgctgggtggccca

SEQ ID NO: 4742452 - DNA, 22 bp, Homo sapiens
cactgctgggtggcccatcccc

SEQ ID NO: 4742453 - DNA, 18 bp, Homo sapiens
cactgcttccagtgaggc

SEQ ID NO: 4742454 - DNA, 20 bp, Homo sapiens
cactgcttccagtgaggctc

SEQ ID NO: 4742455 - DNA, 14 bp, Homo sapiens
cactgcttgaggaa

SEQ ID NO: 4742456 - DNA, 15 bp, Homo sapiens
cactgcttgaggaaa

SEQ ID NO: 4742457 - DNA, 16 bp, Homo sapiens
cactggctgcctccac

SEQ ID NO: 4742458 - DNA, 18 bp, Homo sapiens
cactggctgcctccactc

SEQ ID NO: 4742459 - DNA, 21 bp, Homo sapiens
cactggctgcctccactccca

SEQ ID NO: 4742460 - DNA, 22 bp, Homo sapiens
cactggctgcctccactcccac

SEQ ID NO: 4742461 - DNA, 23 bp, Homo sapiens
cactggctgcctccactcccact

SEQ ID NO: 4742462 - DNA, 13 bp, Homo sapiens
cactgggcttcta

SEQ ID NO: 4742463 - DNA, 17 bp, Homo sapiens
cactggtattcctgcct

SEQ ID NO: 4742464 - DNA, 15 bp, Homo sapiens
cactgtataaatagg

SEQ ID NO: 4742465 - DNA, 16 bp, Homo sapiens
cactgtataaatagga

SEQ ID NO: 4742466 - DNA, 18 bp, Homo sapiens
cactgtataaataggaga

SEQ ID NO: 4742467 - DNA, 19 bp, Homo sapiens
cactgtataaataggagag

SEQ ID NO: 4742468 - DNA, 21 bp, Homo sapiens
cactgtataaataggagagga

SEQ ID NO: 4742469 - DNA, 13 bp, Homo sapiens
cactgtccaccac

SEQ ID NO: 4742470 - DNA, 12 bp, Homo sapiens
cactgtcctgct

SEQ ID NO: 4742471 - DNA, 15 bp, Homo sapiens
cactgtcctgctcca

SEQ ID NO: 4742472 - DNA, 16 bp, Homo sapiens
cactgtcctgctccac

SEQ ID NO: 4742473 - DNA, 21 bp, Homo sapiens
cactgtcctgctccacagtgt

SEQ ID NO: 4742474 - DNA, 14 bp, Homo sapiens
cactgtcttcttca

SEQ ID NO: 4742475 - DNA, 16 bp, Homo sapiens
cactgtgatgttggga

SEQ ID NO: 4742476 - DNA, 18 bp, Homo sapiens
cactgtgccatgtgccag

SEQ ID NO: 4742477 - DNA, 15 bp, Homo sapiens
cactgtgctcagggc

SEQ ID NO: 4742478 - DNA, 13 bp, Homo sapiens
cactgtgctgagt

SEQ ID NO: 4742479 - DNA, 15 bp, Homo sapiens
cactgtgctgagtct

SEQ ID NO: 4742480 - DNA, 22 bp, Homo sapiens
cactgtgctgagtctgaaggct

SEQ ID NO: 4742481 - DNA, 16 bp, Homo sapiens
cactgtggaagtccct

SEQ ID NO: 4742482 - DNA, 18 bp, Homo sapiens
cactgtggaagtccctca

SEQ ID NO: 4742483 - DNA, 17 bp, Homo sapiens
cactgttccccctgtgc

SEQ ID NO: 4742484 - DNA, 13 bp, Homo sapiens
cactgttctctgc

SEQ ID NO: 4742485 - DNA, 16 bp, Homo sapiens
cactgttctctgccct

SEQ ID NO: 4742486 - DNA, 15 bp, Homo sapiens
cactgttgcccaggc

SEQ ID NO: 4742487 - DNA, 19 bp, Homo sapiens
cactgttgcccaggctggc

SEQ ID NO: 4742488 - DNA, 23 bp, Homo sapiens
cacttaggaacgtaatcgtgtcc

SEQ ID NO: 4742489 - DNA, 17 bp, Homo sapiens
cacttattgaatatatg

SEQ ID NO: 4742490 - DNA, 23 bp, Homo sapiens
cacttcccaggtaagcaggagga

SEQ ID NO: 4742491 - DNA, 12 bp, Homo sapiens
cacttcccctcc

SEQ ID NO: 4742492 - DNA, 13 bp, Homo sapiens
cacttcccctcct

SEQ ID NO: 4742493 - DNA, 13 bp, Homo sapiens
cacttccctgggc

SEQ ID NO: 4742494 - DNA, 12 bp, Homo sapiens
cacttctattta

SEQ ID NO: 4742495 - DNA, 15 bp, Homo sapiens
cacttctcaggaaat

SEQ ID NO: 4742496 - DNA, 11 bp, Homo sapiens
cacttctgcac

SEQ ID NO: 4742497 - DNA, 18 bp, Homo sapiens
cacttctgggtggggcag

SEQ ID NO: 4742498 - DNA, 18 bp, Homo sapiens
cacttgaggtcaggagtt

SEQ ID NO: 4742499 - DNA, 19 bp, Homo sapiens
cacttgatgtgatgtggca

SEQ ID NO: 4742500 - DNA, 20 bp, Homo sapiens
cacttggatttcatttgtaa

SEQ ID NO: 4742501 - DNA, 17 bp, Homo sapiens
cacttggcatcagctgg

SEQ ID NO: 4742502 - DNA, 19 bp, Homo sapiens
cacttggcatcagctggcg

SEQ ID NO: 4742503 - DNA, 22 bp, Homo sapiens
cacttggcccaagtggcagagc

SEQ ID NO: 4742504 - DNA, 18 bp, Homo sapiens
cacttgtgccaacactca

SEQ ID NO: 4742505 - DNA, 24 bp, Homo sapiens
cacttgtgccaacactcaagaagc

SEQ ID NO: 4742506 - DNA, 17 bp, Homo sapiens
cactttcagtgaaagca

SEQ ID NO: 4742507 - DNA, 19 bp, Homo sapiens
cactttcagtgaaagcatc

SEQ ID NO: 4742508 - DNA, 12 bp, Homo sapiens
cactttggggtt

SEQ ID NO: 4742509 - DNA, 16 bp, Homo sapiens
cactttgttctggctc

SEQ ID NO: 4742510 - DNA, 17 bp, Homo sapiens
cagaaacctgggagaga

SEQ ID NO: 4742511 - DNA, 13 bp, Homo sapiens
cagaaatgctctg

SEQ ID NO: 4742512 - DNA, 16 bp, Homo sapiens
cagaaattcaatttgg

SEQ ID NO: 4742513 - DNA, 20 bp, Homo sapiens
cagaaattcaatttggattt

SEQ ID NO: 4742514 - DNA, 19 bp, Homo sapiens
cagaacacggcagctgctg

SEQ ID NO: 4742515 - DNA, 19 bp, Homo sapiens
cagaacagcttcaggttat

SEQ ID NO: 4742516 - DNA, 24 bp, Homo sapiens
cagaacaggtgttggtgacaattg

SEQ ID NO: 4742517 - DNA, 13 bp, Homo sapiens
cagaacctggagg

SEQ ID NO: 4742518 - DNA, 20 bp, Homo sapiens
cagaacctggagggctagaa

SEQ ID NO: 4742519 - DNA, 14 bp, Homo sapiens
cagaactctttcaa

SEQ ID NO: 4742520 - DNA, 15 bp, Homo sapiens
cagaactctttcaaa

SEQ ID NO: 4742521 - DNA, 15 bp, Homo sapiens
cagaagaaggcagca

SEQ ID NO: 4742522 - DNA, 14 bp, Homo sapiens
cagaagacaccaga

SEQ ID NO: 4742523 - DNA, 19 bp, Homo sapiens
cagaagacaccagagcaga

SEQ ID NO: 4742524 - DNA, 20 bp, Homo sapiens
cagaagacaccagagcagat

SEQ ID NO: 4742525 - DNA, 13 bp, Homo sapiens
cagaagcagctct

SEQ ID NO: 4742526 - DNA, 17 bp, Homo sapiens
cagaagggggagaccaa

SEQ ID NO: 4742527 - DNA, 20 bp, Homo sapiens
cagaagtcacacattacaaa

SEQ ID NO: 4742528 - DNA, 14 bp, Homo sapiens
cagaatactggtct

SEQ ID NO: 4742529 - DNA, 15 bp, Homo sapiens
cagaatctcgctctg

SEQ ID NO: 4742530 - DNA, 20 bp, Homo sapiens
cagaatgcagttgttgtaca

SEQ ID NO: 4742531 - DNA, 21 bp, Homo sapiens
cagacacatgtccaagaagcc

SEQ ID NO: 4742532 - DNA, 19 bp, Homo sapiens
cagacaccttgacagggca

SEQ ID NO: 4742533 - DNA, 22 bp, Homo sapiens
cagacaccttgacagggcacac

SEQ ID NO: 4742534 - DNA, 17 bp, Homo sapiens
cagacagctgcctggga

SEQ ID NO: 4742535 - DNA, 17 bp, Homo sapiens
cagacaggaccagggat

SEQ ID NO: 4742536 - DNA, 16 bp, Homo sapiens
cagacattatgtaaaa

SEQ ID NO: 4742537 - DNA, 21 bp, Homo sapiens
cagacattatgtaaaagaaag

SEQ ID NO: 4742538 - DNA, 13 bp, Homo sapiens
cagacatttatgt

SEQ ID NO: 4742539 - DNA, 14 bp, Homo sapiens
cagacccggctgcg

SEQ ID NO: 4742540 - DNA, 12 bp, Homo sapiens
cagaccctgccc

SEQ ID NO: 4742541 - DNA, 15 bp, Homo sapiens
cagaccctgccctgt

SEQ ID NO: 4742542 - DNA, 14 bp, Homo sapiens
cagactaagccagc

SEQ ID NO: 4742543 - DNA, 21 bp, Homo sapiens
cagactctacagaggccatgg

SEQ ID NO: 4742544 - DNA, 23 bp, Homo sapiens
cagactctacagaggccatgggc

SEQ ID NO: 4742545 - DNA, 13 bp, Homo sapiens
cagactggaagca

SEQ ID NO: 4742546 - DNA, 20 bp, Homo sapiens
cagactggaagcacagcttc

SEQ ID NO: 4742547 - DNA, 22 bp, Homo sapiens
cagactgtgtaaaaagagagct

SEQ ID NO: 4742548 - DNA, 22 bp, Homo sapiens
cagagacactgttgataaaaac

SEQ ID NO: 4742549 - DNA, 17 bp, Homo sapiens
cagagacatcagccctt

SEQ ID NO: 4742550 - DNA, 20 bp, Homo sapiens
cagagaccatccctgaaggc

SEQ ID NO: 4742551 - DNA, 14 bp, Homo sapiens
cagagaccttctga

SEQ ID NO: 4742552 - DNA, 15 bp, Homo sapiens
cagagagccattttg

SEQ ID NO: 4742553 - DNA, 23 bp, Homo sapiens
cagagagccattttgtgaatgga

SEQ ID NO: 4742554 - DNA, 13 bp, Homo sapiens
cagagaggacaaa

SEQ ID NO: 4742555 - DNA, 16 bp, Homo sapiens
cagagaggacaaaata

SEQ ID NO: 4742556 - DNA, 21 bp, Homo sapiens
cagagaggacaaaataaagtg

SEQ ID NO: 4742557 - DNA, 13 bp, Homo sapiens
cagagagggcagg

SEQ ID NO: 4742558 - DNA, 15 bp, Homo sapiens
cagagagggcaggca

SEQ ID NO: 4742559 - DNA, 18 bp, Homo sapiens
cagagagggcaggcatga

SEQ ID NO: 4742560 - DNA, 13 bp, Homo sapiens
cagagagggtggg

SEQ ID NO: 4742561 - DNA, 20 bp, Homo sapiens
cagagagggtgggagtgggc

SEQ ID NO: 4742562 - DNA, 22 bp, Homo sapiens
cagagagggtggtgacctctgc

SEQ ID NO: 4742563 - DNA, 16 bp, Homo sapiens
cagagataaagacctt

SEQ ID NO: 4742564 - DNA, 17 bp, Homo sapiens
cagagatcctacttctc

SEQ ID NO: 4742565 - DNA, 21 bp, Homo sapiens
cagagattggaatgggcagct

SEQ ID NO: 4742566 - DNA, 13 bp, Homo sapiens
cagagcaccctct

SEQ ID NO: 4742567 - DNA, 21 bp, Homo sapiens
cagagcaccttagacagtccc

SEQ ID NO: 4742568 - DNA, 23 bp, Homo sapiens
cagagcaccttagacagtccctg

SEQ ID NO: 4742569 - DNA, 13 bp, Homo sapiens
cagagcagatgca

SEQ ID NO: 4742570 - DNA, 19 bp, Homo sapiens
cagagcagatgcagagagc

SEQ ID NO: 4742571 - DNA, 21 bp, Homo sapiens
cagagcagatgcagagagcca

SEQ ID NO: 4742572 - DNA, 17 bp, Homo sapiens
cagagcccacgccccca

SEQ ID NO: 4742573 - DNA, 19 bp, Homo sapiens
cagagccgtggtcctttgg

SEQ ID NO: 4742574 - DNA, 21 bp, Homo sapiens
cagagctctgacccacagcct

SEQ ID NO: 4742575 - DNA, 19 bp, Homo sapiens
cagagctgacacaggatga

SEQ ID NO: 4742576 - DNA, 14 bp, Homo sapiens
cagagctgcacagg

SEQ ID NO: 4742577 - DNA, 14 bp, Homo sapiens
cagagctgcttctg

SEQ ID NO: 4742578 - DNA, 15 bp, Homo sapiens
cagagcttggactgg

SEQ ID NO: 4742579 - DNA, 16 bp, Homo sapiens
cagagcttggactgga

SEQ ID NO: 4742580 - DNA, 19 bp, Homo sapiens
cagaggaaggggccagagg

SEQ ID NO: 4742581 - DNA, 20 bp, Homo sapiens
cagaggaaggggccagaggc

SEQ ID NO: 4742582 - DNA, 21 bp, Homo sapiens
cagaggagtacaggtgaagca

SEQ ID NO: 4742583 - DNA, 22 bp, Homo sapiens
cagaggcagccccattctgcct

SEQ ID NO: 4742584 - DNA, 20 bp, Homo sapiens
cagaggccatgggcctcctg

SEQ ID NO: 4742585 - DNA, 22 bp, Homo sapiens
cagagggagtgacagaggcagc

SEQ ID NO: 4742586 - DNA, 19 bp, Homo sapiens
cagagggcctgcaagggag

SEQ ID NO: 4742587 - DNA, 16 bp, Homo sapiens
cagaggggcaggccct

SEQ ID NO: 4742588 - DNA, 20 bp, Homo sapiens
cagaggggcctgccacctgg

SEQ ID NO: 4742589 - DNA, 16 bp, Homo sapiens
cagagggggtggcctc

SEQ ID NO: 4742590 - DNA, 17 bp, Homo sapiens
cagaggtaacagaacag

SEQ ID NO: 4742591 - DNA, 20 bp, Homo sapiens
cagaggtaacagaacagctt

SEQ ID NO: 4742592 - DNA, 19 bp, Homo sapiens
cagagtacgttaaaagcaa

SEQ ID NO: 4742593 - DNA, 20 bp, Homo sapiens
cagagtatggagctcagaga

SEQ ID NO: 4742594 - DNA, 19 bp, Homo sapiens
cagagtctcactgttgccc

SEQ ID NO: 4742595 - DNA, 23 bp, Homo sapiens
cagagtctcactgttgcccaggc

SEQ ID NO: 4742596 - DNA, 16 bp, Homo sapiens
cagagtgagactctgt

SEQ ID NO: 4742597 - DNA, 17 bp, Homo sapiens
cagagtgagactctgtc

SEQ ID NO: 4742598 - DNA, 18 bp, Homo sapiens
cagagtgagactctgtct

SEQ ID NO: 4742599 - DNA, 24 bp, Homo sapiens
cagagttccccatgcagacatgag

SEQ ID NO: 4742600 - DNA, 12 bp, Homo sapiens
cagagttctttg

SEQ ID NO: 4742601 - DNA, 14 bp, Homo sapiens
cagagttctttgca

SEQ ID NO: 4742602 - DNA, 16 bp, Homo sapiens
cagagttctttgcaag

SEQ ID NO: 4742603 - DNA, 15 bp, Homo sapiens
cagataatccctgta

SEQ ID NO: 4742604 - DNA, 14 bp, Homo sapiens
cagataatgtgaaa

SEQ ID NO: 4742605 - DNA, 16 bp, Homo sapiens
cagataatgtgaaaat

SEQ ID NO: 4742606 - DNA, 22 bp, Homo sapiens
cagatataaaagactgaccaat

SEQ ID NO: 4742607 - DNA, 23 bp, Homo sapiens
cagatatatttaagccttataaa

SEQ ID NO: 4742608 - DNA, 14 bp, Homo sapiens
cagatcacagtgtc

SEQ ID NO: 4742609 - DNA, 19 bp, Homo sapiens
cagatcaggcagtgtttaa

SEQ ID NO: 4742610 - DNA, 13 bp, Homo sapiens
cagatgcaccagc

SEQ ID NO: 4742611 - DNA, 17 bp, Homo sapiens
cagatgcaccagccctt

SEQ ID NO: 4742612 - DNA, 22 bp, Homo sapiens
cagatgcaccagcccttagcag

SEQ ID NO: 4742613 - DNA, 19 bp, Homo sapiens
cagatgctcattgctttct

SEQ ID NO: 4742614 - DNA, 14 bp, Homo sapiens
cagatgctgtgtaa

SEQ ID NO: 4742615 - DNA, 18 bp, Homo sapiens
cagatgtcgctgggtcct

SEQ ID NO: 4742616 - DNA, 19 bp, Homo sapiens
cagattcacactgtctggt

SEQ ID NO: 4742617 - DNA, 14 bp, Homo sapiens
cagattctttcctg

SEQ ID NO: 4742618 - DNA, 20 bp, Homo sapiens
cagattctttcctgaggctg

SEQ ID NO: 4742619 - DNA, 22 bp, Homo sapiens
cagattctttcctgaggctggg

SEQ ID NO: 4742620 - DNA, 17 bp, Homo sapiens
cagattgcaacaggctg

SEQ ID NO: 4742621 - DNA, 17 bp, Homo sapiens
cagattggctcacactg

SEQ ID NO: 4742622 - DNA, 18 bp, Homo sapiens
cagattggctcacactga

SEQ ID NO: 4742623 - DNA, 22 bp, Homo sapiens
cagattggctcacactgagaat

SEQ ID NO: 4742624 - DNA, 21 bp, Homo sapiens
cagatttgatatttgcattga

SEQ ID NO: 4742625 - DNA, 14 bp, Homo sapiens
cagatttgggctgg

SEQ ID NO: 4742626 - DNA, 18 bp, Homo sapiens
cagatttgggctggaaca

SEQ ID NO: 4742627 - DNA, 14 bp, Homo sapiens
cagcaaacaggtgc

SEQ ID NO: 4742628 - DNA, 22 bp, Homo sapiens
cagcaagaagatcctaaaacaa

SEQ ID NO: 4742629 - DNA, 15 bp, Homo sapiens
cagcaaggcacctgc

SEQ ID NO: 4742630 - DNA, 14 bp, Homo sapiens
cagcaagtgagagc

SEQ ID NO: 4742631 - DNA, 16 bp, Homo sapiens
cagcaagtgagagctg

SEQ ID NO: 4742632 - DNA, 13 bp, Homo sapiens
cagcacagcaagg

SEQ ID NO: 4742633 - DNA, 17 bp, Homo sapiens
cagcaccggaccagcct

SEQ ID NO: 4742634 - DNA, 18 bp, Homo sapiens
cagcaccggaccagcctg

SEQ ID NO: 4742635 - DNA, 20 bp, Homo sapiens
cagcaccggaccagcctggc

SEQ ID NO: 4742636 - DNA, 17 bp, Homo sapiens
cagcactcctcggcagg

SEQ ID NO: 4742637 - DNA, 13 bp, Homo sapiens
cagcactgaggaa

SEQ ID NO: 4742638 - DNA, 17 bp, Homo sapiens
cagcactgaggaagaac

SEQ ID NO: 4742639 - DNA, 18 bp, Homo sapiens
cagcactgcttgaggaaa

SEQ ID NO: 4742640 - DNA, 17 bp, Homo sapiens
cagcagggctgctgtga

SEQ ID NO: 4742641 - DNA, 18 bp, Homo sapiens
cagcagggctgctgtgaa

SEQ ID NO: 4742642 - DNA, 19 bp, Homo sapiens
cagcaggtgctgctaccct

SEQ ID NO: 4742643 - DNA, 20 bp, Homo sapiens
cagcagtgtgaggccagggc

SEQ ID NO: 4742644 - DNA, 18 bp, Homo sapiens
cagcatattcaggaagct

SEQ ID NO: 4742645 - DNA, 19 bp, Homo sapiens
cagcatattcaggaagctc

SEQ ID NO: 4742646 - DNA, 19 bp, Homo sapiens
cagcatcaaacatgaaaac

SEQ ID NO: 4742647 - DNA, 20 bp, Homo sapiens
cagcatcaaacatgaaaaca

SEQ ID NO: 4742648 - DNA, 16 bp, Homo sapiens
cagcatcattaaagga

SEQ ID NO: 4742649 - DNA, 18 bp, Homo sapiens
cagcatcccttgaccagg

SEQ ID NO: 4742650 - DNA, 23 bp, Homo sapiens
cagcatcccttgaccaggcctgg

SEQ ID NO: 4742651 - DNA, 15 bp, Homo sapiens
cagcatcctggcacc

SEQ ID NO: 4742652 - DNA, 15 bp, Homo sapiens
cagcattctcagcca

SEQ ID NO: 4742653 - DNA, 18 bp, Homo sapiens
cagcattttactgattca

SEQ ID NO: 4742654 - DNA, 21 bp, Homo sapiens
cagccacagtgttatgctctg

SEQ ID NO: 4742655 - DNA, 11 bp, Homo sapiens
cagccacatat

SEQ ID NO: 4742656 - DNA, 20 bp, Homo sapiens
cagccaccctcaccgcggct

SEQ ID NO: 4742657 - DNA, 17 bp, Homo sapiens
cagccacggccaggcca

SEQ ID NO: 4742658 - DNA, 22 bp, Homo sapiens
cagccactggaggggtcatcct

SEQ ID NO: 4742659 - DNA, 13 bp, Homo sapiens
cagccaggccaca

SEQ ID NO: 4742660 - DNA, 15 bp, Homo sapiens
cagccagggagagcc

SEQ ID NO: 4742661 - DNA, 19 bp, Homo sapiens
cagccagggagagcccagg

SEQ ID NO: 4742662 - DNA, 20 bp, Homo sapiens
cagccattggctatttaaaa

SEQ ID NO: 4742663 - DNA, 20 bp, Homo sapiens
cagcccacgtcctgtcagtg

SEQ ID NO: 4742664 - DNA, 13 bp, Homo sapiens
cagccccaagggg

SEQ ID NO: 4742665 - DNA, 14 bp, Homo sapiens
cagccccaaggggt

SEQ ID NO: 4742666 - DNA, 15 bp, Homo sapiens
cagccccaaggggtg

SEQ ID NO: 4742667 - DNA, 16 bp, Homo sapiens
cagccccaaggggtgg

SEQ ID NO: 4742668 - DNA, 20 bp, Homo sapiens
cagccccaaggggtggccgt

SEQ ID NO: 4742669 - DNA, 13 bp, Homo sapiens
cagccccacagcc

SEQ ID NO: 4742670 - DNA, 20 bp, Homo sapiens
cagccccaccccagggcagc

SEQ ID NO: 4742671 - DNA, 21 bp, Homo sapiens
cagccccaccccagggcagcc

SEQ ID NO: 4742672 - DNA, 14 bp, Homo sapiens
cagccccagtgccc

SEQ ID NO: 4742673 - DNA, 18 bp, Homo sapiens
cagccccagtgcccacag

SEQ ID NO: 4742674 - DNA, 11 bp, Homo sapiens
cagccccatcc

SEQ ID NO: 4742675 - DNA, 13 bp, Homo sapiens
cagccccatcctc

SEQ ID NO: 4742676 - DNA, 22 bp, Homo sapiens
cagccccatcctctgtacagag

SEQ ID NO: 4742677 - DNA, 14 bp, Homo sapiens
cagccccattctgc

SEQ ID NO: 4742678 - DNA, 17 bp, Homo sapiens
cagccccattctgcctg

SEQ ID NO: 4742679 - DNA, 18 bp, Homo sapiens
cagccccattctgcctgc

SEQ ID NO: 4742680 - DNA, 14 bp, Homo sapiens
cagcccctgatcct

SEQ ID NO: 4742681 - DNA, 19 bp, Homo sapiens
cagcccctgatcctgtgaa

SEQ ID NO: 4742682 - DNA, 23 bp, Homo sapiens
cagcccctgctggctggtgcctg

SEQ ID NO: 4742683 - DNA, 12 bp, Homo sapiens
cagcccctggat

SEQ ID NO: 4742684 - DNA, 17 bp, Homo sapiens
cagcccctggatgcagc

SEQ ID NO: 4742685 - DNA, 19 bp, Homo sapiens
cagcccctggatgcagcct

SEQ ID NO: 4742686 - DNA, 18 bp, Homo sapiens
cagcccgggctctgcctc

SEQ ID NO: 4742687 - DNA, 17 bp, Homo sapiens
cagccctactctgtgta

SEQ ID NO: 4742688 - DNA, 14 bp, Homo sapiens
cagccctcacccct

SEQ ID NO: 4742689 - DNA, 15 bp, Homo sapiens
cagccctcacccctg

SEQ ID NO: 4742690 - DNA, 13 bp, Homo sapiens
cagccctcatccc

SEQ ID NO: 4742691 - DNA, 14 bp, Homo sapiens
cagccctggagtca

SEQ ID NO: 4742692 - DNA, 15 bp, Homo sapiens
cagccctggctgaag

SEQ ID NO: 4742693 - DNA, 16 bp, Homo sapiens
cagcccttagcaggga

SEQ ID NO: 4742694 - DNA, 15 bp, Homo sapiens
cagccgctgcccggc

SEQ ID NO: 4742695 - DNA, 16 bp, Homo sapiens
cagccgctgcccggcg

SEQ ID NO: 4742696 - DNA, 19 bp, Homo sapiens
cagccggtacctgggaagg

SEQ ID NO: 4742697 - DNA, 14 bp, Homo sapiens
cagccgtgggcccg

SEQ ID NO: 4742698 - DNA, 19 bp, Homo sapiens
cagcctcaacctcctgggc

SEQ ID NO: 4742699 - DNA, 20 bp, Homo sapiens
cagcctcaacctcctgggct

SEQ ID NO: 4742700 - DNA, 21 bp, Homo sapiens
cagcctcaacctcctgggcta

SEQ ID NO: 4742701 - DNA, 15 bp, Homo sapiens
cagcctcacagtcct

SEQ ID NO: 4742702 - DNA, 12 bp, Homo sapiens
cagcctcagaga

SEQ ID NO: 4742703 - DNA, 20 bp, Homo sapiens
cagcctcccaaagtgctggg

SEQ ID NO: 4742704 - DNA, 21 bp, Homo sapiens
cagcctcccaaagtgctggga

SEQ ID NO: 4742705 - DNA, 23 bp, Homo sapiens
cagcctccccctgtcccctctat

SEQ ID NO: 4742706 - DNA, 16 bp, Homo sapiens
cagcctcccctgccag

SEQ ID NO: 4742707 - DNA, 19 bp, Homo sapiens
cagcctcccctgccagggc

SEQ ID NO: 4742708 - DNA, 21 bp, Homo sapiens
cagcctcccgaatagctggga

SEQ ID NO: 4742709 - DNA, 23 bp, Homo sapiens
cagcctcccgaatagctgggact

SEQ ID NO: 4742710 - DNA, 12 bp, Homo sapiens
cagcctcctctg

SEQ ID NO: 4742711 - DNA, 17 bp, Homo sapiens
cagcctgacaacagcct

SEQ ID NO: 4742712 - DNA, 23 bp, Homo sapiens
cagccttgaccattctccacctg

SEQ ID NO: 4742713 - DNA, 14 bp, Homo sapiens
cagcctttgggaaa

SEQ ID NO: 4742714 - DNA, 16 bp, Homo sapiens
cagcgagccctggtgg

SEQ ID NO: 4742715 - DNA, 16 bp, Homo sapiens
cagcgaggaggctcca

SEQ ID NO: 4742716 - DNA, 21 bp, Homo sapiens
cagcggggacagctccttctg

SEQ ID NO: 4742717 - DNA, 15 bp, Homo sapiens
cagcgtcctcctctg

SEQ ID NO: 4742718 - DNA, 16 bp, Homo sapiens
cagcgtcctcctctgt

SEQ ID NO: 4742719 - DNA, 12 bp, Homo sapiens
cagctaaagcaa

SEQ ID NO: 4742720 - DNA, 15 bp, Homo sapiens
cagctaacacacagc

SEQ ID NO: 4742721 - DNA, 20 bp, Homo sapiens
cagctaacacacagctccca

SEQ ID NO: 4742722 - DNA, 16 bp, Homo sapiens
cagctaatgggacact

SEQ ID NO: 4742723 - DNA, 14 bp, Homo sapiens
cagctactttccat

SEQ ID NO: 4742724 - DNA, 20 bp, Homo sapiens
cagctactttccatttggta

SEQ ID NO: 4742725 - DNA, 20 bp, Homo sapiens
cagctataacagtagggatg

SEQ ID NO: 4742726 - DNA, 21 bp, Homo sapiens
cagctatgttatattgaaaaa

SEQ ID NO: 4742727 - DNA, 13 bp, Homo sapiens
cagctatttttat

SEQ ID NO: 4742728 - DNA, 15 bp, Homo sapiens
cagctcaccagcccc

SEQ ID NO: 4742729 - DNA, 12 bp, Homo sapiens
cagctcactgca

SEQ ID NO: 4742730 - DNA, 14 bp, Homo sapiens
cagctcactgcaac

SEQ ID NO: 4742731 - DNA, 19 bp, Homo sapiens
cagctcagagagggtggga

SEQ ID NO: 4742732 - DNA, 14 bp, Homo sapiens
cagctccagctcac

SEQ ID NO: 4742733 - DNA, 20 bp, Homo sapiens
cagctccagctcaccagccc

SEQ ID NO: 4742734 - DNA, 14 bp, Homo sapiens
cagctccttcctgg

SEQ ID NO: 4742735 - DNA, 10 bp, Homo sapiens
cagctctggt

SEQ ID NO: 4742736 - DNA, 21 bp, Homo sapiens
cagctctggtccatagagagc

SEQ ID NO: 4742737 - DNA, 23 bp, Homo sapiens
cagctctgtcctgggagtgagct

SEQ ID NO: 4742738 - DNA, 16 bp, Homo sapiens
cagctcttctccaggc

SEQ ID NO: 4742739 - DNA, 23 bp, Homo sapiens
cagctcttctccaggctgtatcc

SEQ ID NO: 4742740 - DNA, 11 bp, Homo sapiens
cagctcttgtt

SEQ ID NO: 4742741 - DNA, 16 bp, Homo sapiens
cagctgacagtcctct

SEQ ID NO: 4742742 - DNA, 21 bp, Homo sapiens
cagctgacagtcctctccacc

SEQ ID NO: 4742743 - DNA, 14 bp, Homo sapiens
cagctgaccccctc

SEQ ID NO: 4742744 - DNA, 15 bp, Homo sapiens
cagctgaccccctcc

SEQ ID NO: 4742745 - DNA, 18 bp, Homo sapiens
cagctgaccccctccccc

SEQ ID NO: 4742746 - DNA, 23 bp, Homo sapiens
cagctgatacaaattgcagactg

SEQ ID NO: 4742747 - DNA, 18 bp, Homo sapiens
cagctgcctgggatccct

SEQ ID NO: 4742748 - DNA, 19 bp, Homo sapiens
cagctgcggtccacccagg

SEQ ID NO: 4742749 - DNA, 23 bp, Homo sapiens
cagctgcggtccacccaggagcc

SEQ ID NO: 4742750 - DNA, 18 bp, Homo sapiens
cagctgctggagactcct

SEQ ID NO: 4742751 - DNA, 19 bp, Homo sapiens
cagctgctggagactccta

SEQ ID NO: 4742752 - DNA, 15 bp, Homo sapiens
cagctggattgggtt

SEQ ID NO: 4742753 - DNA, 18 bp, Homo sapiens
cagctgggtggcactgcc

SEQ ID NO: 4742754 - DNA, 20 bp, Homo sapiens
cagctgggtggcactgccat

SEQ ID NO: 4742755 - DNA, 16 bp, Homo sapiens
cagctgggttggaaaa

SEQ ID NO: 4742756 - DNA, 17 bp, Homo sapiens
cagctgggttggaaaac

SEQ ID NO: 4742757 - DNA, 14 bp, Homo sapiens
cagctggtggatgg

SEQ ID NO: 4742758 - DNA, 18 bp, Homo sapiens
cagctggtggatggtgac

SEQ ID NO: 4742759 - DNA, 19 bp, Homo sapiens
cagctggtggtatctgagt

SEQ ID NO: 4742760 - DNA, 19 bp, Homo sapiens
cagctgtgctctggacagg

SEQ ID NO: 4742761 - DNA, 20 bp, Homo sapiens
cagctgttctgtcccttgga

SEQ ID NO: 4742762 - DNA, 21 bp, Homo sapiens
cagctgtttatgcatagataa

SEQ ID NO: 4742763 - DNA, 21 bp, Homo sapiens
cagcttcatttcctgtgtctt

SEQ ID NO: 4742764 - DNA, 11 bp, Homo sapiens
cagcttctgcc

SEQ ID NO: 4742765 - DNA, 13 bp, Homo sapiens
cagcttctgccac

SEQ ID NO: 4742766 - DNA, 15 bp, Homo sapiens
cagcttctgccactt

SEQ ID NO: 4742767 - DNA, 18 bp, Homo sapiens
cagcttctgccacttccc

SEQ ID NO: 4742768 - DNA, 14 bp, Homo sapiens
cagcttctgctggg

SEQ ID NO: 4742769 - DNA, 21 bp, Homo sapiens
cagcttgagggttgggctggt

SEQ ID NO: 4742770 - DNA, 12 bp, Homo sapiens
cagcttgagttt

SEQ ID NO: 4742771 - DNA, 18 bp, Homo sapiens
cagcttgtaaatagctca

SEQ ID NO: 4742772 - DNA, 20 bp, Homo sapiens
cagcttgtaaatagctcagg

SEQ ID NO: 4742773 - DNA, 22 bp, Homo sapiens
cagcttgtaaatagctcaggtg

SEQ ID NO: 4742774 - DNA, 20 bp, Homo sapiens
cagcttttcccaaaagccca

SEQ ID NO: 4742775 - DNA, 13 bp, Homo sapiens
caggaaaaagaac

SEQ ID NO: 4742776 - DNA, 15 bp, Homo sapiens
caggaaaagctgctg

SEQ ID NO: 4742777 - DNA, 19 bp, Homo sapiens
caggaaacatatttaagaa

SEQ ID NO: 4742778 - DNA, 15 bp, Homo sapiens
caggaaaggaatcat

SEQ ID NO: 4742779 - DNA, 17 bp, Homo sapiens
caggaaaggctccagga

SEQ ID NO: 4742780 - DNA, 20 bp, Homo sapiens
caggaaaggctccaggagca

SEQ ID NO: 4742781 - DNA, 21 bp, Homo sapiens
caggaaccgaacatatcattt

SEQ ID NO: 4742782 - DNA, 13 bp, Homo sapiens
caggaagaaggtg

SEQ ID NO: 4742783 - DNA, 17 bp, Homo sapiens
caggaagctcagggcct

SEQ ID NO: 4742784 - DNA, 18 bp, Homo sapiens
caggaagctcagggcctg

SEQ ID NO: 4742785 - DNA, 19 bp, Homo sapiens
caggaagctcagggcctgg

SEQ ID NO: 4742786 - DNA, 19 bp, Homo sapiens
caggaaggagctgcctgga

SEQ ID NO: 4742787 - DNA, 19 bp, Homo sapiens
caggaaggctgagaggaga

SEQ ID NO: 4742788 - DNA, 17 bp, Homo sapiens
caggacatgctgaagcc

SEQ ID NO: 4742789 - DNA, 16 bp, Homo sapiens
caggaccaagggcaga

SEQ ID NO: 4742790 - DNA, 21 bp, Homo sapiens
caggaccagggatttccatga

SEQ ID NO: 4742791 - DNA, 21 bp, Homo sapiens
caggacctaggatatcttctc

SEQ ID NO: 4742792 - DNA, 16 bp, Homo sapiens
caggacggggccggcc

SEQ ID NO: 4742793 - DNA, 23 bp, Homo sapiens
caggacggggccggccaggtggg

SEQ ID NO: 4742794 - DNA, 17 bp, Homo sapiens
caggactcagctcccca

SEQ ID NO: 4742795 - DNA, 21 bp, Homo sapiens
caggactcagctccccagagt

SEQ ID NO: 4742796 - DNA, 15 bp, Homo sapiens
caggactctgcagcc

SEQ ID NO: 4742797 - DNA, 16 bp, Homo sapiens
caggactctgcagcct

SEQ ID NO: 4742798 - DNA, 17 bp, Homo sapiens
caggactctgcagcctc

SEQ ID NO: 4742799 - DNA, 19 bp, Homo sapiens
caggactctgcagcctcag

SEQ ID NO: 4742800 - DNA, 21 bp, Homo sapiens
caggactctgcagcctcagag

SEQ ID NO: 4742801 - DNA, 12 bp, Homo sapiens
caggactgggcc

SEQ ID NO: 4742802 - DNA, 21 bp, Homo sapiens
caggagaaggccaattcctat

SEQ ID NO: 4742803 - DNA, 13 bp, Homo sapiens
caggagacaaaag

SEQ ID NO: 4742804 - DNA, 19 bp, Homo sapiens
caggagcagccacattcct

SEQ ID NO: 4742805 - DNA, 15 bp, Homo sapiens
caggagcagcctcag

SEQ ID NO: 4742806 - DNA, 20 bp, Homo sapiens
caggagcagcctcagaacaa

SEQ ID NO: 4742807 - DNA, 23 bp, Homo sapiens
caggagcagcctcagaacaaagt

SEQ ID NO: 4742808 - DNA, 18 bp, Homo sapiens
caggagccccgaggcctt

SEQ ID NO: 4742809 - DNA, 20 bp, Homo sapiens
caggaggcagaggttgcagt

SEQ ID NO: 4742810 - DNA, 12 bp, Homo sapiens
caggaggccagc

SEQ ID NO: 4742811 - DNA, 16 bp, Homo sapiens
caggaggccagccttg

SEQ ID NO: 4742812 - DNA, 15 bp, Homo sapiens
caggagggaggggga

SEQ ID NO: 4742813 - DNA, 12 bp, Homo sapiens
caggagggcagt

SEQ ID NO: 4742814 - DNA, 18 bp, Homo sapiens
caggagggctaattagaa

SEQ ID NO: 4742815 - DNA, 20 bp, Homo sapiens
caggaggggaaaaaattaac

SEQ ID NO: 4742816 - DNA, 12 bp, Homo sapiens
caggagtgagca

SEQ ID NO: 4742817 - DNA, 19 bp, Homo sapiens
caggattgcgagagatgtg

SEQ ID NO: 4742818 - DNA, 21 bp, Homo sapiens
caggattgcgagagatgtgtg

SEQ ID NO: 4742819 - DNA, 12 bp, Homo sapiens
caggatttataa

SEQ ID NO: 4742820 - DNA, 17 bp, Homo sapiens
caggatttataaagcaa

SEQ ID NO: 4742821 - DNA, 17 bp, Homo sapiens
caggcaaagaaaatgaa

SEQ ID NO: 4742822 - DNA, 22 bp, Homo sapiens
caggcaacgcacaaaacagaaa

SEQ ID NO: 4742823 - DNA, 14 bp, Homo sapiens
caggcaatgctggc

SEQ ID NO: 4742824 - DNA, 15 bp, Homo sapiens
caggcaatgctggct

SEQ ID NO: 4742825 - DNA, 17 bp, Homo sapiens
caggcaatgctggctgt

SEQ ID NO: 4742826 - DNA, 20 bp, Homo sapiens
caggcaatgctggctgttgg

SEQ ID NO: 4742827 - DNA, 21 bp, Homo sapiens
caggcaatgctggctgttggc

SEQ ID NO: 4742828 - DNA, 23 bp, Homo sapiens
caggcacccaccatcatgtctgg

SEQ ID NO: 4742829 - DNA, 13 bp, Homo sapiens
caggcactgccct

SEQ ID NO: 4742830 - DNA, 15 bp, Homo sapiens
caggcactgccctgg

SEQ ID NO: 4742831 - DNA, 18 bp, Homo sapiens
caggcagatacaggaaaa

SEQ ID NO: 4742832 - DNA, 20 bp, Homo sapiens
caggcaggaaggctgagagg

SEQ ID NO: 4742833 - DNA, 14 bp, Homo sapiens
caggcaggtccagg

SEQ ID NO: 4742834 - DNA, 12 bp, Homo sapiens
caggcaggtctt

SEQ ID NO: 4742835 - DNA, 22 bp, Homo sapiens
caggcaggtcttgaactcctgg

SEQ ID NO: 4742836 - DNA, 19 bp, Homo sapiens
caggcatggctggtgcctg

SEQ ID NO: 4742837 - DNA, 15 bp, Homo sapiens
caggcatgttctctg

SEQ ID NO: 4742838 - DNA, 20 bp, Homo sapiens
caggcatgttctctgaggac

SEQ ID NO: 4742839 - DNA, 13 bp, Homo sapiens
caggcattcccca

SEQ ID NO: 4742840 - DNA, 15 bp, Homo sapiens
caggcattccccagg

SEQ ID NO: 4742841 - DNA, 16 bp, Homo sapiens
caggcattccccagga

SEQ ID NO: 4742842 - DNA, 18 bp, Homo sapiens
caggcattccccaggagg

SEQ ID NO: 4742843 - DNA, 15 bp, Homo sapiens
caggcattggatatt

SEQ ID NO: 4742844 - DNA, 16 bp, Homo sapiens
caggccacaaatgtgt

SEQ ID NO: 4742845 - DNA, 15 bp, Homo sapiens
caggccagagggagt

SEQ ID NO: 4742846 - DNA, 21 bp, Homo sapiens
caggccagagggagtgacaga

SEQ ID NO: 4742847 - DNA, 21 bp, Homo sapiens
caggccaggaccaagggcaga

SEQ ID NO: 4742848 - DNA, 15 bp, Homo sapiens
caggccaggactctg

SEQ ID NO: 4742849 - DNA, 13 bp, Homo sapiens
caggccaggccct

SEQ ID NO: 4742850 - DNA, 16 bp, Homo sapiens
caggccaggccctctg

SEQ ID NO: 4742851 - DNA, 19 bp, Homo sapiens
caggccatcttccaggtgg

SEQ ID NO: 4742852 - DNA, 16 bp, Homo sapiens
caggcccctctcctcc

SEQ ID NO: 4742853 - DNA, 18 bp, Homo sapiens
caggcccctctcctccgt

SEQ ID NO: 4742854 - DNA, 13 bp, Homo sapiens
caggcccctgcca

SEQ ID NO: 4742855 - DNA, 19 bp, Homo sapiens
caggcccctgccaccctgg

SEQ ID NO: 4742856 - DNA, 20 bp, Homo sapiens
caggcccctgccaccctggg

SEQ ID NO: 4742857 - DNA, 15 bp, Homo sapiens
caggcccggctccag

SEQ ID NO: 4742858 - DNA, 17 bp, Homo sapiens
caggcccggctccaggc

SEQ ID NO: 4742859 - DNA, 18 bp, Homo sapiens
caggcccggctccaggct

SEQ ID NO: 4742860 - DNA, 20 bp, Homo sapiens
caggcccggctccaggctcc

SEQ ID NO: 4742861 - DNA, 14 bp, Homo sapiens
caggccctctgccc

SEQ ID NO: 4742862 - DNA, 15 bp, Homo sapiens
caggccctctgccca

SEQ ID NO: 4742863 - DNA, 11 bp, Homo sapiens
caggccctgca

SEQ ID NO: 4742864 - DNA, 12 bp, Homo sapiens
caggccctgcac

SEQ ID NO: 4742865 - DNA, 14 bp, Homo sapiens
caggccctgcactg

SEQ ID NO: 4742866 - DNA, 15 bp, Homo sapiens
caggccctgcactgt

SEQ ID NO: 4742867 - DNA, 16 bp, Homo sapiens
caggccctgcactgtc

SEQ ID NO: 4742868 - DNA, 18 bp, Homo sapiens
caggccctgcactgtcct

SEQ ID NO: 4742869 - DNA, 19 bp, Homo sapiens
caggccctgcactgtcctg

SEQ ID NO: 4742870 - DNA, 16 bp, Homo sapiens
caggcctgagatttca

SEQ ID NO: 4742871 - DNA, 19 bp, Homo sapiens
caggcctgagatttcatct

SEQ ID NO: 4742872 - DNA, 19 bp, Homo sapiens
caggcgttcagctcactgt

SEQ ID NO: 4742873 - DNA, 22 bp, Homo sapiens
caggcgttcagctcactgttct

SEQ ID NO: 4742874 - DNA, 19 bp, Homo sapiens
caggctaaggcgtggagct

SEQ ID NO: 4742875 - DNA, 20 bp, Homo sapiens
caggctacactgacactggt

SEQ ID NO: 4742876 - DNA, 13 bp, Homo sapiens
caggctcctgcca

SEQ ID NO: 4742877 - DNA, 15 bp, Homo sapiens
caggctcctgccacc

SEQ ID NO: 4742878 - DNA, 16 bp, Homo sapiens
caggctcctgccacca

SEQ ID NO: 4742879 - DNA, 20 bp, Homo sapiens
caggctcctttagcgcccag

SEQ ID NO: 4742880 - DNA, 12 bp, Homo sapiens
caggctgagcct

SEQ ID NO: 4742881 - DNA, 16 bp, Homo sapiens
caggctgagcctcagt

SEQ ID NO: 4742882 - DNA, 21 bp, Homo sapiens
caggctgagcctcagtctccc

SEQ ID NO: 4742883 - DNA, 23 bp, Homo sapiens
caggctgctcttgaactcctgac

SEQ ID NO: 4742884 - DNA, 12 bp, Homo sapiens
caggctggccag

SEQ ID NO: 4742885 - DNA, 15 bp, Homo sapiens
caggctggccagccc

SEQ ID NO: 4742886 - DNA, 21 bp, Homo sapiens
caggctggccagccccacagc

SEQ ID NO: 4742887 - DNA, 15 bp, Homo sapiens
caggctggccctgcc

SEQ ID NO: 4742888 - DNA, 17 bp, Homo sapiens
caggctggccctgccct

SEQ ID NO: 4742889 - DNA, 15 bp, Homo sapiens
caggctggcgtgcag

SEQ ID NO: 4742890 - DNA, 17 bp, Homo sapiens
caggctggcgtgcagtg

SEQ ID NO: 4742891 - DNA, 18 bp, Homo sapiens
caggctggcgtgcagtgg

SEQ ID NO: 4742892 - DNA, 18 bp, Homo sapiens
caggctgggagagccttc

SEQ ID NO: 4742893 - DNA, 20 bp, Homo sapiens
caggctgggagagccttcca

SEQ ID NO: 4742894 - DNA, 23 bp, Homo sapiens
caggctgggagagccttccaggg

SEQ ID NO: 4742895 - DNA, 17 bp, Homo sapiens
caggctgggcttcagtg

SEQ ID NO: 4742896 - DNA, 23 bp, Homo sapiens
caggctgggcttcagtggcagct

SEQ ID NO: 4742897 - DNA, 12 bp, Homo sapiens
caggctggtctc

SEQ ID NO: 4742898 - DNA, 19 bp, Homo sapiens
caggctggtctcaaactct

SEQ ID NO: 4742899 - DNA, 22 bp, Homo sapiens
caggctggtctcgaactcctga

SEQ ID NO: 4742900 - DNA, 16 bp, Homo sapiens
caggctgtcccaagct

SEQ ID NO: 4742901 - DNA, 17 bp, Homo sapiens
caggcttagtcactgag

SEQ ID NO: 4742902 - DNA, 17 bp, Homo sapiens
cagggaacatatttaag

SEQ ID NO: 4742903 - DNA, 18 bp, Homo sapiens
cagggaacatggggagga

SEQ ID NO: 4742904 - DNA, 23 bp, Homo sapiens
cagggaatgcctgagtgcctggc

SEQ ID NO: 4742905 - DNA, 15 bp, Homo sapiens
cagggaatggagaat

SEQ ID NO: 4742906 - DNA, 13 bp, Homo sapiens
cagggaccacagc

SEQ ID NO: 4742907 - DNA, 14 bp, Homo sapiens
cagggaccacagca

SEQ ID NO: 4742908 - DNA, 15 bp, Homo sapiens
cagggacttctgcgg

SEQ ID NO: 4742909 - DNA, 13 bp, Homo sapiens
cagggagagccca

SEQ ID NO: 4742910 - DNA, 16 bp, Homo sapiens
cagggagagcccagga

SEQ ID NO: 4742911 - DNA, 15 bp, Homo sapiens
cagggagcatggctg

SEQ ID NO: 4742912 - DNA, 14 bp, Homo sapiens
cagggagggcctgg

SEQ ID NO: 4742913 - DNA, 12 bp, Homo sapiens
cagggatgagca

SEQ ID NO: 4742914 - DNA, 16 bp, Homo sapiens
cagggatgagcatgga

SEQ ID NO: 4742915 - DNA, 22 bp, Homo sapiens
cagggatgagcatggagctggc

SEQ ID NO: 4742916 - DNA, 18 bp, Homo sapiens
cagggcagccagggagag

SEQ ID NO: 4742917 - DNA, 17 bp, Homo sapiens
cagggcaggaaggggaa

SEQ ID NO: 4742918 - DNA, 20 bp, Homo sapiens
cagggccccaggcattgcca

SEQ ID NO: 4742919 - DNA, 16 bp, Homo sapiens
cagggcctcacacggt

SEQ ID NO: 4742920 - DNA, 12 bp, Homo sapiens
cagggcctggaa

SEQ ID NO: 4742921 - DNA, 19 bp, Homo sapiens
cagggcctggctcaggtgg

SEQ ID NO: 4742922 - DNA, 14 bp, Homo sapiens
cagggctaccctga

SEQ ID NO: 4742923 - DNA, 13 bp, Homo sapiens
cagggctcctggg

SEQ ID NO: 4742924 - DNA, 15 bp, Homo sapiens
cagggctctgaccag

SEQ ID NO: 4742925 - DNA, 21 bp, Homo sapiens
cagggctggactgaggcctga

SEQ ID NO: 4742926 - DNA, 13 bp, Homo sapiens
caggggcaggcac

SEQ ID NO: 4742927 - DNA, 12 bp, Homo sapiens
caggggctgccc

SEQ ID NO: 4742928 - DNA, 13 bp, Homo sapiens
caggggctgcccg

SEQ ID NO: 4742929 - DNA, 16 bp, Homo sapiens
caggggctgcccgctc

SEQ ID NO: 4742930 - DNA, 20 bp, Homo sapiens
caggggctgcccgctcccag

SEQ ID NO: 4742931 - DNA, 14 bp, Homo sapiens
caggggtgggacac

SEQ ID NO: 4742932 - DNA, 17 bp, Homo sapiens
cagggtcagtgtatcta

SEQ ID NO: 4742933 - DNA, 12 bp, Homo sapiens
cagggtccctgg

SEQ ID NO: 4742934 - DNA, 18 bp, Homo sapiens
cagggtccctggtggcag

SEQ ID NO: 4742935 - DNA, 19 bp, Homo sapiens
cagggtccctggtggcagc

SEQ ID NO: 4742936 - DNA, 21 bp, Homo sapiens
cagggtctcactatgttgccc

SEQ ID NO: 4742937 - DNA, 15 bp, Homo sapiens
cagggtctcactctg

SEQ ID NO: 4742938 - DNA, 17 bp, Homo sapiens
cagggtctctgctgccg

SEQ ID NO: 4742939 - DNA, 19 bp, Homo sapiens
cagggtctctgctgccgcc

SEQ ID NO: 4742940 - DNA, 15 bp, Homo sapiens
cagggtctgggcagg

SEQ ID NO: 4742941 - DNA, 16 bp, Homo sapiens
cagggtctgggcagga

SEQ ID NO: 4742942 - DNA, 19 bp, Homo sapiens
cagggtgagagtctgggtc

SEQ ID NO: 4742943 - DNA, 13 bp, Homo sapiens
cagggtgctgtgg

SEQ ID NO: 4742944 - DNA, 20 bp, Homo sapiens
cagggttgaccccagaggat

SEQ ID NO: 4742945 - DNA, 16 bp, Homo sapiens
cagggttttgccatgt

SEQ ID NO: 4742946 - DNA, 16 bp, Homo sapiens
caggtaacaggcagat

SEQ ID NO: 4742947 - DNA, 19 bp, Homo sapiens
caggtaatcgacctgcctc

SEQ ID NO: 4742948 - DNA, 20 bp, Homo sapiens
caggtaatcgacctgcctcg

SEQ ID NO: 4742949 - DNA, 20 bp, Homo sapiens
caggtatgaccttctaggaa

SEQ ID NO: 4742950 - DNA, 15 bp, Homo sapiens
caggtcgttcttatc

SEQ ID NO: 4742951 - DNA, 20 bp, Homo sapiens
caggtgaagcaccaagctca

SEQ ID NO: 4742952 - DNA, 16 bp, Homo sapiens
caggtgacatgtgaaa

SEQ ID NO: 4742953 - DNA, 23 bp, Homo sapiens
caggtgaccaaaatccccttctc

SEQ ID NO: 4742954 - DNA, 20 bp, Homo sapiens
caggtgagcccatggccctc

SEQ ID NO: 4742955 - DNA, 16 bp, Homo sapiens
caggtgatccacccac

SEQ ID NO: 4742956 - DNA, 20 bp, Homo sapiens
caggtgcacaagctccaagc

SEQ ID NO: 4742957 - DNA, 20 bp, Homo sapiens
caggtgcagcccccactgcc

SEQ ID NO: 4742958 - DNA, 16 bp, Homo sapiens
caggtgctgctaccct

SEQ ID NO: 4742959 - DNA, 19 bp, Homo sapiens
caggtgctgctaccctccc

SEQ ID NO: 4742960 - DNA, 21 bp, Homo sapiens
caggtgctgctaccctccctg

SEQ ID NO: 4742961 - DNA, 23 bp, Homo sapiens
caggtgctgctaccctccctgct

SEQ ID NO: 4742962 - DNA, 16 bp, Homo sapiens
caggtgggcttcccag

SEQ ID NO: 4742963 - DNA, 22 bp, Homo sapiens
caggtggggagactgggctgag

SEQ ID NO: 4742964 - DNA, 13 bp, Homo sapiens
caggtggggcagc

SEQ ID NO: 4742965 - DNA, 19 bp, Homo sapiens
caggtggggtcactctggc

SEQ ID NO: 4742966 - DNA, 21 bp, Homo sapiens
caggtggggtcactctggcag

SEQ ID NO: 4742967 - DNA, 22 bp, Homo sapiens
caggtggggtcactctggcagc

SEQ ID NO: 4742968 - DNA, 22 bp, Homo sapiens
caggtggggtgaggcagtgggt

SEQ ID NO: 4742969 - DNA, 16 bp, Homo sapiens
caggtgtgaaccacca

SEQ ID NO: 4742970 - DNA, 22 bp, Homo sapiens
caggtgtgaaccaccacaccca

SEQ ID NO: 4742971 - DNA, 18 bp, Homo sapiens
caggtgtgagccaccacg

SEQ ID NO: 4742972 - DNA, 21 bp, Homo sapiens
caggtgtgagtcaccaagccc

SEQ ID NO: 4742973 - DNA, 23 bp, Homo sapiens
caggtgtgagtcaccaagcccag

SEQ ID NO: 4742974 - DNA, 18 bp, Homo sapiens
caggtgtgccgacagaag

SEQ ID NO: 4742975 - DNA, 23 bp, Homo sapiens
caggttagaacctagaagggcta

SEQ ID NO: 4742976 - DNA, 13 bp, Homo sapiens
caggttcagcttg

SEQ ID NO: 4742977 - DNA, 13 bp, Homo sapiens
caggttgggccat

SEQ ID NO: 4742978 - DNA, 22 bp, Homo sapiens
caggttgggccatactggcctc

SEQ ID NO: 4742979 - DNA, 23 bp, Homo sapiens
caggtttttggtctgacccactg

SEQ ID NO: 4742980 - DNA, 18 bp, Homo sapiens
cagtaagtataacaaact

SEQ ID NO: 4742981 - DNA, 23 bp, Homo sapiens
cagtaagtataacaaactatgta

SEQ ID NO: 4742982 - DNA, 23 bp, Homo sapiens
cagtaccttcaaactagggccaa

SEQ ID NO: 4742983 - DNA, 14 bp, Homo sapiens
cagtactcaaattc

SEQ ID NO: 4742984 - DNA, 21 bp, Homo sapiens
cagtaggagcccagctctgaa

SEQ ID NO: 4742985 - DNA, 18 bp, Homo sapiens
cagtaggcttttaccatt

SEQ ID NO: 4742986 - DNA, 13 bp, Homo sapiens
cagtatatttggt

SEQ ID NO: 4742987 - DNA, 23 bp, Homo sapiens
cagtatgggttagggaaaacatt

SEQ ID NO: 4742988 - DNA, 19 bp, Homo sapiens
cagtattacttctgctaca

SEQ ID NO: 4742989 - DNA, 17 bp, Homo sapiens
cagtcaaatttacattt

SEQ ID NO: 4742990 - DNA, 15 bp, Homo sapiens
cagtcaacaagcctg

SEQ ID NO: 4742991 - DNA, 14 bp, Homo sapiens
cagtcaacctgggc

SEQ ID NO: 4742992 - DNA, 22 bp, Homo sapiens
cagtcaacctgggcaaagccta

SEQ ID NO: 4742993 - DNA, 12 bp, Homo sapiens
cagtcaccccag

SEQ ID NO: 4742994 - DNA, 16 bp, Homo sapiens
cagtcaccccggccac

SEQ ID NO: 4742995 - DNA, 21 bp, Homo sapiens
cagtcaggaaaggaatcattt

SEQ ID NO: 4742996 - DNA, 14 bp, Homo sapiens
cagtcatgcataaa

SEQ ID NO: 4742997 - DNA, 17 bp, Homo sapiens
cagtcatgcataaatat

SEQ ID NO: 4742998 - DNA, 19 bp, Homo sapiens
cagtcattatgttaatatt

SEQ ID NO: 4742999 - DNA, 13 bp, Homo sapiens
cagtccagcctgg

SEQ ID NO: 4743000 - DNA, 16 bp, Homo sapiens
cagtccagcctggaga

SEQ ID NO: 4743001 - DNA, 17 bp, Homo sapiens
cagtccctgccaatgga

SEQ ID NO: 4743002 - DNA, 13 bp, Homo sapiens
cagtcctcccatc

SEQ ID NO: 4743003 - DNA, 20 bp, Homo sapiens
cagtccttaccagcagagca

SEQ ID NO: 4743004 - DNA, 21 bp, Homo sapiens
cagtccttaccagcagagcac

SEQ ID NO: 4743005 - DNA, 16 bp, Homo sapiens
cagtcgatagagctgt

SEQ ID NO: 4743006 - DNA, 19 bp, Homo sapiens
cagtcgcgagcacatgttc

SEQ ID NO: 4743007 - DNA, 17 bp, Homo sapiens
cagtcgcgctgcctgtg

SEQ ID NO: 4743008 - DNA, 18 bp, Homo sapiens
cagtcgcgctgcctgtgt

SEQ ID NO: 4743009 - DNA, 13 bp, Homo sapiens
cagtctcaatttt

SEQ ID NO: 4743010 - DNA, 12 bp, Homo sapiens
cagtctctgagc

SEQ ID NO: 4743011 - DNA, 21 bp, Homo sapiens
cagtctgattcccaagctctg

SEQ ID NO: 4743012 - DNA, 17 bp, Homo sapiens
cagtcttgtattaagtt

SEQ ID NO: 4743013 - DNA, 17 bp, Homo sapiens
cagtctttgatcatcat

SEQ ID NO: 4743014 - DNA, 18 bp, Homo sapiens
cagtgaatgattcagtgt

SEQ ID NO: 4743015 - DNA, 20 bp, Homo sapiens
cagtgaatgattcagtgtta

SEQ ID NO: 4743016 - DNA, 15 bp, Homo sapiens
cagtgaatttaagca

SEQ ID NO: 4743017 - DNA, 11 bp, Homo sapiens
cagtgaatttg

SEQ ID NO: 4743018 - DNA, 21 bp, Homo sapiens
cagtgactcgggctcctgtgc

SEQ ID NO: 4743019 - DNA, 18 bp, Homo sapiens
cagtgagtcgaggacagg

SEQ ID NO: 4743020 - DNA, 20 bp, Homo sapiens
cagtgagtcgaggacaggga

SEQ ID NO: 4743021 - DNA, 22 bp, Homo sapiens
cagtgagtcgaggacagggagg

SEQ ID NO: 4743022 - DNA, 23 bp, Homo sapiens
cagtgagtcgaggacagggaggt

SEQ ID NO: 4743023 - DNA, 23 bp, Homo sapiens
cagtgatatggcagaagacacca

SEQ ID NO: 4743024 - DNA, 19 bp, Homo sapiens
cagtgatttacatgctgat

SEQ ID NO: 4743025 - DNA, 19 bp, Homo sapiens
cagtgcactaattctgcat

SEQ ID NO: 4743026 - DNA, 12 bp, Homo sapiens
cagtgcaggcac

SEQ ID NO: 4743027 - DNA, 19 bp, Homo sapiens
cagtgccagcccctgctgg

SEQ ID NO: 4743028 - DNA, 23 bp, Homo sapiens
cagtgccagcccctgctggctgg

SEQ ID NO: 4743029 - DNA, 15 bp, Homo sapiens
cagtgcccacaggat

SEQ ID NO: 4743030 - DNA, 22 bp, Homo sapiens
cagtgcccacaggatcagtctg

SEQ ID NO: 4743031 - DNA, 18 bp, Homo sapiens
cagtgcccattcctcacc

SEQ ID NO: 4743032 - DNA, 19 bp, Homo sapiens
cagtgcccattcctcacct

SEQ ID NO: 4743033 - DNA, 14 bp, Homo sapiens
cagtgcccctagct

SEQ ID NO: 4743034 - DNA, 18 bp, Homo sapiens
cagtgccgccgcctcgcc

SEQ ID NO: 4743035 - DNA, 22 bp, Homo sapiens
cagtgccgccgcctcgcccacc

SEQ ID NO: 4743036 - DNA, 23 bp, Homo sapiens
cagtgccgccgcctcgcccaccg

SEQ ID NO: 4743037 - DNA, 14 bp, Homo sapiens
cagtgctccctcac

SEQ ID NO: 4743038 - DNA, 14 bp, Homo sapiens
cagtgctgctgaac

SEQ ID NO: 4743039 - DNA, 15 bp, Homo sapiens
cagtgcttgccacag

SEQ ID NO: 4743040 - DNA, 16 bp, Homo sapiens
cagtggaaccagccca

SEQ ID NO: 4743041 - DNA, 14 bp, Homo sapiens
cagtggagagggct

SEQ ID NO: 4743042 - DNA, 13 bp, Homo sapiens
cagtggcagctgc

SEQ ID NO: 4743043 - DNA, 18 bp, Homo sapiens
cagtgggaaaaatgtagg

SEQ ID NO: 4743044 - DNA, 17 bp, Homo sapiens
cagtgggagctgcctgt

SEQ ID NO: 4743045 - DNA, 18 bp, Homo sapiens
cagtgggagctgcctgtt

SEQ ID NO: 4743046 - DNA, 14 bp, Homo sapiens
cagtgggtcccact

SEQ ID NO: 4743047 - DNA, 18 bp, Homo sapiens
cagtgggtcccacttccc

SEQ ID NO: 4743048 - DNA, 16 bp, Homo sapiens
cagtggtaagaatagt

SEQ ID NO: 4743049 - DNA, 21 bp, Homo sapiens
cagtggtatgatcacggctca

SEQ ID NO: 4743050 - DNA, 20 bp, Homo sapiens
cagtggtgcgatctgggttc

SEQ ID NO: 4743051 - DNA, 17 bp, Homo sapiens
cagtgtacagtcttgta

SEQ ID NO: 4743052 - DNA, 19 bp, Homo sapiens
cagtgtacccccgcccagg

SEQ ID NO: 4743053 - DNA, 20 bp, Homo sapiens
cagtgtacccccgcccaggc

SEQ ID NO: 4743054 - DNA, 21 bp, Homo sapiens
cagtgtacccccgcccaggct

SEQ ID NO: 4743055 - DNA, 18 bp, Homo sapiens
cagtgtctgggctgactg

SEQ ID NO: 4743056 - DNA, 15 bp, Homo sapiens
cagtgtcttcctgtg

SEQ ID NO: 4743057 - DNA, 17 bp, Homo sapiens
cagtgtgaggccagggc

SEQ ID NO: 4743058 - DNA, 13 bp, Homo sapiens
cagtgtgcccccc

SEQ ID NO: 4743059 - DNA, 15 bp, Homo sapiens
cagtgtgccccccat

SEQ ID NO: 4743060 - DNA, 19 bp, Homo sapiens
cagtgtgccccccatcctg

SEQ ID NO: 4743061 - DNA, 22 bp, Homo sapiens
cagtgtgccccccatcctggcc

SEQ ID NO: 4743062 - DNA, 23 bp, Homo sapiens
cagtgtgccccccatcctggccc

SEQ ID NO: 4743063 - DNA, 15 bp, Homo sapiens
cagtgtgttgacttc

SEQ ID NO: 4743064 - DNA, 19 bp, Homo sapiens
cagtgttaaatgtgatgaa

SEQ ID NO: 4743065 - DNA, 19 bp, Homo sapiens
cagtgttaggcctggcaca

SEQ ID NO: 4743066 - DNA, 20 bp, Homo sapiens
cagtgttaggcctggcacag

SEQ ID NO: 4743067 - DNA, 21 bp, Homo sapiens
cagtgttaggcctggcacagt

SEQ ID NO: 4743068 - DNA, 15 bp, Homo sapiens
cagtgtttatgacga

SEQ ID NO: 4743069 - DNA, 18 bp, Homo sapiens
cagttcataaatttgttg

SEQ ID NO: 4743070 - DNA, 12 bp, Homo sapiens
cagttccctccc

SEQ ID NO: 4743071 - DNA, 12 bp, Homo sapiens
cagttccttgca

SEQ ID NO: 4743072 - DNA, 22 bp, Homo sapiens
cagttcctttagaaagcagtta

SEQ ID NO: 4743073 - DNA, 14 bp, Homo sapiens
cagttctgtgtaca

SEQ ID NO: 4743074 - DNA, 14 bp, Homo sapiens
cagttctttctttt

SEQ ID NO: 4743075 - DNA, 21 bp, Homo sapiens
cagttgaatttatggaatcta

SEQ ID NO: 4743076 - DNA, 23 bp, Homo sapiens
cagttgccagtcaccccggccac

SEQ ID NO: 4743077 - DNA, 16 bp, Homo sapiens
cagttgggtggatgcc

SEQ ID NO: 4743078 - DNA, 18 bp, Homo sapiens
cagttgggtggatgcctg

SEQ ID NO: 4743079 - DNA, 19 bp, Homo sapiens
cagttgggtggatgcctgg

SEQ ID NO: 4743080 - DNA, 20 bp, Homo sapiens
cagttggtcccccttccatg

SEQ ID NO: 4743081 - DNA, 20 bp, Homo sapiens
cagtttaacctgatgcagtc

SEQ ID NO: 4743082 - DNA, 12 bp, Homo sapiens
cagttttaactg

SEQ ID NO: 4743083 - DNA, 13 bp, Homo sapiens
cagttttaactgt

SEQ ID NO: 4743084 - DNA, 15 bp, Homo sapiens
cagttttaactgtgg

SEQ ID NO: 4743085 - DNA, 17 bp, Homo sapiens
cagtttttctgtatttt

SEQ ID NO: 4743086 - DNA, 18 bp, Homo sapiens
cagtttttctgtatttta

SEQ ID NO: 4743087 - DNA, 22 bp, Homo sapiens
cataaaactcatgactgagtct

SEQ ID NO: 4743088 - DNA, 14 bp, Homo sapiens
cataaagagaaaat

SEQ ID NO: 4743089 - DNA, 22 bp, Homo sapiens
cataaagtaaatacatgcatat

SEQ ID NO: 4743090 - DNA, 17 bp, Homo sapiens
cataacaattcctctac

SEQ ID NO: 4743091 - DNA, 16 bp, Homo sapiens
cataacgtttttcctt

SEQ ID NO: 4743092 - DNA, 13 bp, Homo sapiens
cataactagaact

SEQ ID NO: 4743093 - DNA, 13 bp, Homo sapiens
cataagctatttt

SEQ ID NO: 4743094 - DNA, 14 bp, Homo sapiens
cataagtgacacca

SEQ ID NO: 4743095 - DNA, 18 bp, Homo sapiens
cataagtgacagtttaac

SEQ ID NO: 4743096 - DNA, 14 bp, Homo sapiens
cataataaatcaca

SEQ ID NO: 4743097 - DNA, 16 bp, Homo sapiens
cataataaatcacaca

SEQ ID NO: 4743098 - DNA, 21 bp, Homo sapiens
cataatgtttctggatttcat

SEQ ID NO: 4743099 - DNA, 14 bp, Homo sapiens
cataatttaaaaat

SEQ ID NO: 4743100 - DNA, 18 bp, Homo sapiens
cataattttgtgttgtac

SEQ ID NO: 4743101 - DNA, 14 bp, Homo sapiens
catacataaaagaa

SEQ ID NO: 4743102 - DNA, 18 bp, Homo sapiens
catacataaaagaaataa

SEQ ID NO: 4743103 - DNA, 16 bp, Homo sapiens
catacatccctcagtt

SEQ ID NO: 4743104 - DNA, 14 bp, Homo sapiens
cataccaatgaaaa

SEQ ID NO: 4743105 - DNA, 23 bp, Homo sapiens
catactccatcagttagagctga

SEQ ID NO: 4743106 - DNA, 20 bp, Homo sapiens
catactggcctcgcctggcc

SEQ ID NO: 4743107 - DNA, 22 bp, Homo sapiens
catactggcctcgcctggcctg

SEQ ID NO: 4743108 - DNA, 17 bp, Homo sapiens
catactgtgctggagcc

SEQ ID NO: 4743109 - DNA, 13 bp, Homo sapiens
catacttgttctg

SEQ ID NO: 4743110 - DNA, 14 bp, Homo sapiens
catacttgttctgt

SEQ ID NO: 4743111 - DNA, 21 bp, Homo sapiens
catagagagcaagacgctgtg

SEQ ID NO: 4743112 - DNA, 17 bp, Homo sapiens
catagagatatttaaaa

SEQ ID NO: 4743113 - DNA, 22 bp, Homo sapiens
catagcagagaatgaaagggcc

SEQ ID NO: 4743114 - DNA, 19 bp, Homo sapiens
catagccctcaccctgggg

SEQ ID NO: 4743115 - DNA, 18 bp, Homo sapiens
catagcgggggcctaaaa

SEQ ID NO: 4743116 - DNA, 17 bp, Homo sapiens
catagctacatcagttt

SEQ ID NO: 4743117 - DNA, 19 bp, Homo sapiens
catagctacatcagtttga

SEQ ID NO: 4743118 - DNA, 19 bp, Homo sapiens
cataggaggggtctggaca

SEQ ID NO: 4743119 - DNA, 15 bp, Homo sapiens
catagtatggtggct

SEQ ID NO: 4743120 - DNA, 22 bp, Homo sapiens
catagtggcttaaaacaacact

SEQ ID NO: 4743121 - DNA, 21 bp, Homo sapiens
catagttgaaaaaagaagttt

SEQ ID NO: 4743122 - DNA, 18 bp, Homo sapiens
catataaatatatttaac

SEQ ID NO: 4743123 - DNA, 18 bp, Homo sapiens
catataagacaaatattc

SEQ ID NO: 4743124 - DNA, 18 bp, Homo sapiens
catatagtcaatgtaaaa

SEQ ID NO: 4743125 - DNA, 22 bp, Homo sapiens
catatatatgttttaagaggca

SEQ ID NO: 4743126 - DNA, 13 bp, Homo sapiens
catatatgttctt

SEQ ID NO: 4743127 - DNA, 14 bp, Homo sapiens
catatatgttcttc

SEQ ID NO: 4743128 - DNA, 15 bp, Homo sapiens
catatcatttgtgaa

SEQ ID NO: 4743129 - DNA, 20 bp, Homo sapiens
catatctctagtccctgtgt

SEQ ID NO: 4743130 - DNA, 21 bp, Homo sapiens
catatgacattcatgcctggc

SEQ ID NO: 4743131 - DNA, 18 bp, Homo sapiens
catatgcatgcccttcct

SEQ ID NO: 4743132 - DNA, 17 bp, Homo sapiens
catattataaaggataa

SEQ ID NO: 4743133 - DNA, 21 bp, Homo sapiens
catattataaaggataaagaa

SEQ ID NO: 4743134 - DNA, 15 bp, Homo sapiens
catattcaggaagct

SEQ ID NO: 4743135 - DNA, 18 bp, Homo sapiens
catattctgttggccagt

SEQ ID NO: 4743136 - DNA, 20 bp, Homo sapiens
catattggatctgcttgctg

SEQ ID NO: 4743137 - DNA, 11 bp, Homo sapiens
catatttaagg

SEQ ID NO: 4743138 - DNA, 14 bp, Homo sapiens
catattttgccact

SEQ ID NO: 4743139 - DNA, 16 bp, Homo sapiens
catatttttctaaaga

SEQ ID NO: 4743140 - DNA, 16 bp, Homo sapiens
catcaaaaagaaaaat

SEQ ID NO: 4743141 - DNA, 17 bp, Homo sapiens
catcaaacatgaaaaca

SEQ ID NO: 4743142 - DNA, 18 bp, Homo sapiens
catcaaacatgaaaacat

SEQ ID NO: 4743143 - DNA, 16 bp, Homo sapiens
catcaaataaaccttg

SEQ ID NO: 4743144 - DNA, 17 bp, Homo sapiens
catcaaataaaccttgt

SEQ ID NO: 4743145 - DNA, 15 bp, Homo sapiens
catcaaatggaagac

SEQ ID NO: 4743146 - DNA, 17 bp, Homo sapiens
catcaaatggaagacac

SEQ ID NO: 4743147 - DNA, 18 bp, Homo sapiens
catcaaggcactgcctga

SEQ ID NO: 4743148 - DNA, 17 bp, Homo sapiens
catcacagctaacaatt

SEQ ID NO: 4743149 - DNA, 20 bp, Homo sapiens
catcaccaacgtctgtgcca

SEQ ID NO: 4743150 - DNA, 19 bp, Homo sapiens
catcacgttagctgtccca

SEQ ID NO: 4743151 - DNA, 16 bp, Homo sapiens
catcactggctctcta

SEQ ID NO: 4743152 - DNA, 13 bp, Homo sapiens
catcagaactgaa

SEQ ID NO: 4743153 - DNA, 15 bp, Homo sapiens
catcaggactcttgt

SEQ ID NO: 4743154 - DNA, 22 bp, Homo sapiens
catcaggagaaaaagcctccag

SEQ ID NO: 4743155 - DNA, 19 bp, Homo sapiens
catcaggagttccagtgct

SEQ ID NO: 4743156 - DNA, 13 bp, Homo sapiens
catcaggccaggc

SEQ ID NO: 4743157 - DNA, 14 bp, Homo sapiens
catcaggccaggcc

SEQ ID NO: 4743158 - DNA, 16 bp, Homo sapiens
catcaggccaggccct

SEQ ID NO: 4743159 - DNA, 20 bp, Homo sapiens
catcaggccaggccctctgc

SEQ ID NO: 4743160 - DNA, 21 bp, Homo sapiens
catcaggccaggccctctgcc

SEQ ID NO: 4743161 - DNA, 18 bp, Homo sapiens
catcagtgccagcccctg

SEQ ID NO: 4743162 - DNA, 24 bp, Homo sapiens
catcagtgtacccccgcccaggct

SEQ ID NO: 4743163 - DNA, 15 bp, Homo sapiens
catcagttagagctg

SEQ ID NO: 4743164 - DNA, 16 bp, Homo sapiens
catcagttagagctga

SEQ ID NO: 4743165 - DNA, 20 bp, Homo sapiens
catcagttagagctgacaca

SEQ ID NO: 4743166 - DNA, 19 bp, Homo sapiens
catcatcaaggcactgcct

SEQ ID NO: 4743167 - DNA, 17 bp, Homo sapiens
catcatcagtggagcca

SEQ ID NO: 4743168 - DNA, 13 bp, Homo sapiens
catcatccctccc

SEQ ID NO: 4743169 - DNA, 14 bp, Homo sapiens
catcatgtctggct

SEQ ID NO: 4743170 - DNA, 23 bp, Homo sapiens
catcattaaaggaaacgtggcag

SEQ ID NO: 4743171 - DNA, 22 bp, Homo sapiens
catcattctctgtctcatccat

SEQ ID NO: 4743172 - DNA, 18 bp, Homo sapiens
catcattggataaatttg

SEQ ID NO: 4743173 - DNA, 16 bp, Homo sapiens
catcattgtattaacg

SEQ ID NO: 4743174 - DNA, 17 bp, Homo sapiens
catcattgtattaacgc

SEQ ID NO: 4743175 - DNA, 23 bp, Homo sapiens
catccactgtgccatgtgccagg

SEQ ID NO: 4743176 - DNA, 17 bp, Homo sapiens
catccaggttcagcttg

SEQ ID NO: 4743177 - DNA, 18 bp, Homo sapiens
catccatgttccgagaag

SEQ ID NO: 4743178 - DNA, 11 bp, Homo sapiens
catcccagccc

SEQ ID NO: 4743179 - DNA, 13 bp, Homo sapiens
catcccagcccca

SEQ ID NO: 4743180 - DNA, 14 bp, Homo sapiens
catcccagccccaa

SEQ ID NO: 4743181 - DNA, 14 bp, Homo sapiens
catcccagccttgg

SEQ ID NO: 4743182 - DNA, 14 bp, Homo sapiens
catcccccctcacc

SEQ ID NO: 4743183 - DNA, 21 bp, Homo sapiens
catccctcagtttcttaaaat

SEQ ID NO: 4743184 - DNA, 11 bp, Homo sapiens
catccctgaag

SEQ ID NO: 4743185 - DNA, 17 bp, Homo sapiens
catccctgaaggccccg

SEQ ID NO: 4743186 - DNA, 18 bp, Homo sapiens
catccctgaaggccccgc

SEQ ID NO: 4743187 - DNA, 21 bp, Homo sapiens
catccctgaaggccccgccca

SEQ ID NO: 4743188 - DNA, 23 bp, Homo sapiens
catcccttgaccaggcctgggcc

SEQ ID NO: 4743189 - DNA, 17 bp, Homo sapiens
catcctacaagacacag

SEQ ID NO: 4743190 - DNA, 19 bp, Homo sapiens
catcctacaagacacagtg

SEQ ID NO: 4743191 - DNA, 16 bp, Homo sapiens
catcctcaaacactgc

SEQ ID NO: 4743192 - DNA, 18 bp, Homo sapiens
catcctcaaacactgcag

SEQ ID NO: 4743193 - DNA, 18 bp, Homo sapiens
catcctcatacccacccc

SEQ ID NO: 4743194 - DNA, 21 bp, Homo sapiens
catcctccacgttctgctcat

SEQ ID NO: 4743195 - DNA, 15 bp, Homo sapiens
catcctctgtacaga

SEQ ID NO: 4743196 - DNA, 18 bp, Homo sapiens
catcctctgtacagagcc

SEQ ID NO: 4743197 - DNA, 21 bp, Homo sapiens
catcctggaggggtgttgtat

SEQ ID NO: 4743198 - DNA, 22 bp, Homo sapiens
catcctggcacccggcccctgc

SEQ ID NO: 4743199 - DNA, 11 bp, Homo sapiens
catcctggccc

SEQ ID NO: 4743200 - DNA, 15 bp, Homo sapiens
catcctggcccatca

SEQ ID NO: 4743201 - DNA, 16 bp, Homo sapiens
catcctggcccatcag

SEQ ID NO: 4743202 - DNA, 14 bp, Homo sapiens
catccttgagtcaa

SEQ ID NO: 4743203 - DNA, 13 bp, Homo sapiens
catcgatatgaaa

SEQ ID NO: 4743204 - DNA, 19 bp, Homo sapiens
catctaaattgatcattca

SEQ ID NO: 4743205 - DNA, 14 bp, Homo sapiens
catctaattcttat

SEQ ID NO: 4743206 - DNA, 13 bp, Homo sapiens
catctatgtcata

SEQ ID NO: 4743207 - DNA, 21 bp, Homo sapiens
catctccagtatcctgctggt

SEQ ID NO: 4743208 - DNA, 22 bp, Homo sapiens
catctcccagataatgtgaaaa

SEQ ID NO: 4743209 - DNA, 16 bp, Homo sapiens
catctcttagctcccc

SEQ ID NO: 4743210 - DNA, 19 bp, Homo sapiens
catctcttagctcccctcc

SEQ ID NO: 4743211 - DNA, 16 bp, Homo sapiens
catctgaatctccttg

SEQ ID NO: 4743212 - DNA, 17 bp, Homo sapiens
catctgaatctccttgt

SEQ ID NO: 4743213 - DNA, 18 bp, Homo sapiens
catctgaatctccttgtt

SEQ ID NO: 4743214 - DNA, 17 bp, Homo sapiens
catctgataatttcaca

SEQ ID NO: 4743215 - DNA, 14 bp, Homo sapiens
catctgcccaggac

SEQ ID NO: 4743216 - DNA, 18 bp, Homo sapiens
catctgcgtgacaataaa

SEQ ID NO: 4743217 - DNA, 22 bp, Homo sapiens
catctgcgtgacaataaaacat

SEQ ID NO: 4743218 - DNA, 18 bp, Homo sapiens
catctgctactgtgtcag

SEQ ID NO: 4743219 - DNA, 13 bp, Homo sapiens
catctgctctcct

SEQ ID NO: 4743220 - DNA, 20 bp, Homo sapiens
catctgctctccttcctgga

SEQ ID NO: 4743221 - DNA, 18 bp, Homo sapiens
catctggtgtaggaagtt

SEQ ID NO: 4743222 - DNA, 20 bp, Homo sapiens
catctgtccctccgggacct

SEQ ID NO: 4743223 - DNA, 14 bp, Homo sapiens
catctgtgtcttgt

SEQ ID NO: 4743224 - DNA, 14 bp, Homo sapiens
catcttcttcacca

SEQ ID NO: 4743225 - DNA, 13 bp, Homo sapiens
catcttgctctgc

SEQ ID NO: 4743226 - DNA, 19 bp, Homo sapiens
catctttcctgatggcagg

SEQ ID NO: 4743227 - DNA, 21 bp, Homo sapiens
catctttcctgatggcaggat

SEQ ID NO: 4743228 - DNA, 16 bp, Homo sapiens
catcttttcttgcctc

SEQ ID NO: 4743229 - DNA, 15 bp, Homo sapiens
catgaaaacattgat

SEQ ID NO: 4743230 - DNA, 15 bp, Homo sapiens
catgaaaatgcaaca

SEQ ID NO: 4743231 - DNA, 19 bp, Homo sapiens
catgaagtcgttgtgaggg

SEQ ID NO: 4743232 - DNA, 20 bp, Homo sapiens
catgaagtttccttggctgg

SEQ ID NO: 4743233 - DNA, 23 bp, Homo sapiens
catgaagtttccttggctggtgc

SEQ ID NO: 4743234 - DNA, 19 bp, Homo sapiens
catgacccaggctgggcaa

SEQ ID NO: 4743235 - DNA, 11 bp, Homo sapiens
catgacccagt

SEQ ID NO: 4743236 - DNA, 23 bp, Homo sapiens
catgactgagtctggcaaacatg

SEQ ID NO: 4743237 - DNA, 16 bp, Homo sapiens
catgagaagccataca

SEQ ID NO: 4743238 - DNA, 16 bp, Homo sapiens
catgagcatcaggcca

SEQ ID NO: 4743239 - DNA, 21 bp, Homo sapiens
catgagcatcaggccaggccc

SEQ ID NO: 4743240 - DNA, 12 bp, Homo sapiens
catgagcctcag

SEQ ID NO: 4743241 - DNA, 17 bp, Homo sapiens
catgagcctcagcatcc

SEQ ID NO: 4743242 - DNA, 13 bp, Homo sapiens
catgagtcccctg

SEQ ID NO: 4743243 - DNA, 20 bp, Homo sapiens
catgagtggccttaataaat

SEQ ID NO: 4743244 - DNA, 14 bp, Homo sapiens
catgagttattcat

SEQ ID NO: 4743245 - DNA, 18 bp, Homo sapiens
catgagttattcataaag

SEQ ID NO: 4743246 - DNA, 21 bp, Homo sapiens
catgatgaaactgtcataatg

SEQ ID NO: 4743247 - DNA, 14 bp, Homo sapiens
catgcagcatctaa

SEQ ID NO: 4743248 - DNA, 13 bp, Homo sapiens
catgcaggtctcc

SEQ ID NO: 4743249 - DNA, 17 bp, Homo sapiens
catgcaggtctccatga

SEQ ID NO: 4743250 - DNA, 21 bp, Homo sapiens
catgcaggtctccatgaagaa

SEQ ID NO: 4743251 - DNA, 15 bp, Homo sapiens
catgcataaatatgc

SEQ ID NO: 4743252 - DNA, 14 bp, Homo sapiens
catgcatataatga

SEQ ID NO: 4743253 - DNA, 18 bp, Homo sapiens
catgcatataatgaataa

SEQ ID NO: 4743254 - DNA, 20 bp, Homo sapiens
catgcatataatgaataaat

SEQ ID NO: 4743255 - DNA, 21 bp, Homo sapiens
catgcatataatgaataaatc

SEQ ID NO: 4743256 - DNA, 15 bp, Homo sapiens
catgcatggaaattc

SEQ ID NO: 4743257 - DNA, 13 bp, Homo sapiens
catgcattttctt

SEQ ID NO: 4743258 - DNA, 16 bp, Homo sapiens
catgcattttcttgta

SEQ ID NO: 4743259 - DNA, 18 bp, Homo sapiens
catgccaagcactgtgct

SEQ ID NO: 4743260 - DNA, 16 bp, Homo sapiens
catgcccttcctttct

SEQ ID NO: 4743261 - DNA, 13 bp, Homo sapiens
catgcctgcacct

SEQ ID NO: 4743262 - DNA, 13 bp, Homo sapiens
catgcctggatgg

SEQ ID NO: 4743263 - DNA, 18 bp, Homo sapiens
catgcctggatggggctg

SEQ ID NO: 4743264 - DNA, 20 bp, Homo sapiens
catgctctccaaaccacttt

SEQ ID NO: 4743265 - DNA, 16 bp, Homo sapiens
catgctcttagaaaat

SEQ ID NO: 4743266 - DNA, 15 bp, Homo sapiens
catgctgaagccaaa

SEQ ID NO: 4743267 - DNA, 16 bp, Homo sapiens
catgctgaagccaaag

SEQ ID NO: 4743268 - DNA, 19 bp, Homo sapiens
catgctgaaggctgaaaga

SEQ ID NO: 4743269 - DNA, 13 bp, Homo sapiens
catgctgccctgt

SEQ ID NO: 4743270 - DNA, 17 bp, Homo sapiens
catgctgtgtgactcaa

SEQ ID NO: 4743271 - DNA, 14 bp, Homo sapiens
catgcttggttttc

SEQ ID NO: 4743272 - DNA, 15 bp, Homo sapiens
catggacaatggacc

SEQ ID NO: 4743273 - DNA, 20 bp, Homo sapiens
catggacaatggaccggaga

SEQ ID NO: 4743274 - DNA, 20 bp, Homo sapiens
catggagagctggagcctgg

SEQ ID NO: 4743275 - DNA, 14 bp, Homo sapiens
catggaggagacag

SEQ ID NO: 4743276 - DNA, 14 bp, Homo sapiens
catggagtgtttga

SEQ ID NO: 4743277 - DNA, 15 bp, Homo sapiens
catggagtgtttgac

SEQ ID NO: 4743278 - DNA, 14 bp, Homo sapiens
catggatacatatt

SEQ ID NO: 4743279 - DNA, 17 bp, Homo sapiens
catggattccaaagcat

SEQ ID NO: 4743280 - DNA, 22 bp, Homo sapiens
catggattccaaagcattttca

SEQ ID NO: 4743281 - DNA, 13 bp, Homo sapiens
catggatttggtt

SEQ ID NO: 4743282 - DNA, 18 bp, Homo sapiens
catggcatcacctccacc

SEQ ID NO: 4743283 - DNA, 16 bp, Homo sapiens
catggccctgccatgc

SEQ ID NO: 4743284 - DNA, 20 bp, Homo sapiens
catggccctgctgcccctcc

SEQ ID NO: 4743285 - DNA, 14 bp, Homo sapiens
catggctgtgagga

SEQ ID NO: 4743286 - DNA, 13 bp, Homo sapiens
catgggcactgct

SEQ ID NO: 4743287 - DNA, 15 bp, Homo sapiens
catgggcactgctgg

SEQ ID NO: 4743288 - DNA, 17 bp, Homo sapiens
catgggcactgctgggt

SEQ ID NO: 4743289 - DNA, 15 bp, Homo sapiens
catgggcagagccca

SEQ ID NO: 4743290 - DNA, 17 bp, Homo sapiens
catgggcagagcccaag

SEQ ID NO: 4743291 - DNA, 17 bp, Homo sapiens
catgggcccaggaatgc

SEQ ID NO: 4743292 - DNA, 15 bp, Homo sapiens
catgggcctcctgtg

SEQ ID NO: 4743293 - DNA, 12 bp, Homo sapiens
catgggcttcac

SEQ ID NO: 4743294 - DNA, 14 bp, Homo sapiens
catgggcttcactg

SEQ ID NO: 4743295 - DNA, 15 bp, Homo sapiens
catgggcttcactgt

SEQ ID NO: 4743296 - DNA, 21 bp, Homo sapiens
catgggcttcactgtataaat

SEQ ID NO: 4743297 - DNA, 17 bp, Homo sapiens
catgggggagggggcag

SEQ ID NO: 4743298 - DNA, 18 bp, Homo sapiens
catgggggctcagccagg

SEQ ID NO: 4743299 - DNA, 15 bp, Homo sapiens
catgggtcgggagag

SEQ ID NO: 4743300 - DNA, 18 bp, Homo sapiens
catgggtcgggagagggg

SEQ ID NO: 4743301 - DNA, 20 bp, Homo sapiens
catgggtcgggagaggggac

SEQ ID NO: 4743302 - DNA, 19 bp, Homo sapiens
catggtcagccctagggtg

SEQ ID NO: 4743303 - DNA, 22 bp, Homo sapiens
catggtctgtcctgacagcact

SEQ ID NO: 4743304 - DNA, 12 bp, Homo sapiens
catggtgtctgg

SEQ ID NO: 4743305 - DNA, 21 bp, Homo sapiens
catggttccaattttttttaa

SEQ ID NO: 4743306 - DNA, 17 bp, Homo sapiens
catgtaaaatcttcagc

SEQ ID NO: 4743307 - DNA, 21 bp, Homo sapiens
catgtaaaatcttcagctggt

SEQ ID NO: 4743308 - DNA, 22 bp, Homo sapiens
catgtacctaatccaaatatca

SEQ ID NO: 4743309 - DNA, 20 bp, Homo sapiens
catgtagaaaatttgttatt

SEQ ID NO: 4743310 - DNA, 15 bp, Homo sapiens
catgtataatatttt

SEQ ID NO: 4743311 - DNA, 15 bp, Homo sapiens
catgtatagctagct

SEQ ID NO: 4743312 - DNA, 16 bp, Homo sapiens
catgtatcctttcaca

SEQ ID NO: 4743313 - DNA, 16 bp, Homo sapiens
catgtccaagaagccc

SEQ ID NO: 4743314 - DNA, 19 bp, Homo sapiens
catgtccaagaagcccagg

SEQ ID NO: 4743315 - DNA, 19 bp, Homo sapiens
catgtcttttcttgcatga

SEQ ID NO: 4743316 - DNA, 21 bp, Homo sapiens
catgtcttttcttgcatgagg

SEQ ID NO: 4743317 - DNA, 22 bp, Homo sapiens
catgtgaaaccttttttaagat

SEQ ID NO: 4743318 - DNA, 17 bp, Homo sapiens
catgtgattatggacat

SEQ ID NO: 4743319 - DNA, 15 bp, Homo sapiens
catgtgcaactcttg

SEQ ID NO: 4743320 - DNA, 18 bp, Homo sapiens
catgtgcaactcttgtat

SEQ ID NO: 4743321 - DNA, 19 bp, Homo sapiens
catgtgcaactcttgtatt

SEQ ID NO: 4743322 - DNA, 14 bp, Homo sapiens
catgtgcacatgca

SEQ ID NO: 4743323 - DNA, 21 bp, Homo sapiens
catgtgccaggtttttggtct

SEQ ID NO: 4743324 - DNA, 17 bp, Homo sapiens
catgtgggttgtgatat

SEQ ID NO: 4743325 - DNA, 17 bp, Homo sapiens
catgtggttaatgccat

SEQ ID NO: 4743326 - DNA, 22 bp, Homo sapiens
catgtgtatgagaagtactttg

SEQ ID NO: 4743327 - DNA, 20 bp, Homo sapiens
catgtgtgctcttcttcttt

SEQ ID NO: 4743328 - DNA, 16 bp, Homo sapiens
catgttagtcaaggac

SEQ ID NO: 4743329 - DNA, 23 bp, Homo sapiens
catgttcacgttgttcacatccc

SEQ ID NO: 4743330 - DNA, 21 bp, Homo sapiens
catgttcctggacaccaccca

SEQ ID NO: 4743331 - DNA, 12 bp, Homo sapiens
catgttggccag

SEQ ID NO: 4743332 - DNA, 15 bp, Homo sapiens
catgttggccaggct

SEQ ID NO: 4743333 - DNA, 19 bp, Homo sapiens
catgttggccaggctggtc

SEQ ID NO: 4743334 - DNA, 12 bp, Homo sapiens
cattaaagccat

SEQ ID NO: 4743335 - DNA, 22 bp, Homo sapiens
cattaaagttaaactgtatttt

SEQ ID NO: 4743336 - DNA, 19 bp, Homo sapiens
cattaattcaatgaaatgg

SEQ ID NO: 4743337 - DNA, 12 bp, Homo sapiens
cattagagcagg

SEQ ID NO: 4743338 - DNA, 13 bp, Homo sapiens
cattagagcaggc

SEQ ID NO: 4743339 - DNA, 21 bp, Homo sapiens
cattagattatcaaaaagtat

SEQ ID NO: 4743340 - DNA, 17 bp, Homo sapiens
cattagcataattttgt

SEQ ID NO: 4743341 - DNA, 12 bp, Homo sapiens
cattagttttaa

SEQ ID NO: 4743342 - DNA, 17 bp, Homo sapiens
cattagttttaaaaagg

SEQ ID NO: 4743343 - DNA, 14 bp, Homo sapiens
cattagttttgaag

SEQ ID NO: 4743344 - DNA, 23 bp, Homo sapiens
cattatgatgtgggtcaaggaat

SEQ ID NO: 4743345 - DNA, 14 bp, Homo sapiens
cattatgttaatat

SEQ ID NO: 4743346 - DNA, 15 bp, Homo sapiens
cattatttaatttgt

SEQ ID NO: 4743347 - DNA, 17 bp, Homo sapiens
cattatttgataacatt

SEQ ID NO: 4743348 - DNA, 21 bp, Homo sapiens
cattatttgataacattttgt

SEQ ID NO: 4743349 - DNA, 14 bp, Homo sapiens
cattcataatttta

SEQ ID NO: 4743350 - DNA, 22 bp, Homo sapiens
cattcatccaggactgagatgc

SEQ ID NO: 4743351 - DNA, 16 bp, Homo sapiens
cattcattccattctg

SEQ ID NO: 4743352 - DNA, 18 bp, Homo sapiens
cattccccaggaggccag

SEQ ID NO: 4743353 - DNA, 15 bp, Homo sapiens
cattccttcccagag

SEQ ID NO: 4743354 - DNA, 15 bp, Homo sapiens
cattccttctttgat

SEQ ID NO: 4743355 - DNA, 23 bp, Homo sapiens
cattccttctttgataatgttaa

SEQ ID NO: 4743356 - DNA, 13 bp, Homo sapiens
cattccttgcctg

SEQ ID NO: 4743357 - DNA, 23 bp, Homo sapiens
cattctcacctaaaccctctgtg

SEQ ID NO: 4743358 - DNA, 14 bp, Homo sapiens
cattctccacctgc

SEQ ID NO: 4743359 - DNA, 19 bp, Homo sapiens
cattctctgtctcatccat

SEQ ID NO: 4743360 - DNA, 16 bp, Homo sapiens
cattctgaaggagccc

SEQ ID NO: 4743361 - DNA, 12 bp, Homo sapiens
cattctgcctgc

SEQ ID NO: 4743362 - DNA, 11 bp, Homo sapiens
cattctgtgac

SEQ ID NO: 4743363 - DNA, 18 bp, Homo sapiens
cattcttactaaaaagta

SEQ ID NO: 4743364 - DNA, 16 bp, Homo sapiens
cattcttggttggctg

SEQ ID NO: 4743365 - DNA, 19 bp, Homo sapiens
cattgaatctgtatggcta

SEQ ID NO: 4743366 - DNA, 17 bp, Homo sapiens
cattgacctgaggccct

SEQ ID NO: 4743367 - DNA, 21 bp, Homo sapiens
cattgaggaaatattaatttt

SEQ ID NO: 4743368 - DNA, 14 bp, Homo sapiens
cattgcaatagaaa

SEQ ID NO: 4743369 - DNA, 17 bp, Homo sapiens
cattgcactccagcctg

SEQ ID NO: 4743370 - DNA, 19 bp, Homo sapiens
cattgcctcttttcacatt

SEQ ID NO: 4743371 - DNA, 15 bp, Homo sapiens
cattgcggacagcca

SEQ ID NO: 4743372 - DNA, 17 bp, Homo sapiens
cattgcggacagccacg

SEQ ID NO: 4743373 - DNA, 22 bp, Homo sapiens
cattgctgtgaattagctcact

SEQ ID NO: 4743374 - DNA, 15 bp, Homo sapiens
cattggaactggagg

SEQ ID NO: 4743375 - DNA, 16 bp, Homo sapiens
cattggaactggaggc

SEQ ID NO: 4743376 - DNA, 18 bp, Homo sapiens
cattggatattttttact

SEQ ID NO: 4743377 - DNA, 24 bp, Homo sapiens
cattggcagcaggtgctgctaccc

SEQ ID NO: 4743378 - DNA, 23 bp, Homo sapiens
cattggggtagttgtgtttcaac

SEQ ID NO: 4743379 - DNA, 19 bp, Homo sapiens
cattgtaaatctgaagaaa

SEQ ID NO: 4743380 - DNA, 20 bp, Homo sapiens
cattgtaaatctgaagaaag

SEQ ID NO: 4743381 - DNA, 20 bp, Homo sapiens
cattgtaacctcgtgtctag

SEQ ID NO: 4743382 - DNA, 16 bp, Homo sapiens
cattgtcaaaattaat

SEQ ID NO: 4743383 - DNA, 21 bp, Homo sapiens
cattgtccaatcctatgtttt

SEQ ID NO: 4743384 - DNA, 13 bp, Homo sapiens
cattgtgggaagg

SEQ ID NO: 4743385 - DNA, 15 bp, Homo sapiens
cattgtgggaagggg

SEQ ID NO: 4743386 - DNA, 18 bp, Homo sapiens
cattgtgtcctgcttata

SEQ ID NO: 4743387 - DNA, 22 bp, Homo sapiens
cattgtttcccatcactgtatc

SEQ ID NO: 4743388 - DNA, 17 bp, Homo sapiens
cattgtttcgtaacaca

SEQ ID NO: 4743389 - DNA, 19 bp, Homo sapiens
catttaaagttgtataaaa

SEQ ID NO: 4743390 - DNA, 17 bp, Homo sapiens
catttaaatacagtctt

SEQ ID NO: 4743391 - DNA, 12 bp, Homo sapiens
catttactgtgg

SEQ ID NO: 4743392 - DNA, 13 bp, Homo sapiens
catttactgtggc

SEQ ID NO: 4743393 - DNA, 16 bp, Homo sapiens
catttaggagaagttg

SEQ ID NO: 4743394 - DNA, 18 bp, Homo sapiens
catttaggagaagttggt

SEQ ID NO: 4743395 - DNA, 16 bp, Homo sapiens
catttatacctttgaa

SEQ ID NO: 4743396 - DNA, 19 bp, Homo sapiens
catttatacctttgaaata

SEQ ID NO: 4743397 - DNA, 15 bp, Homo sapiens
catttatctattaaa

SEQ ID NO: 4743398 - DNA, 17 bp, Homo sapiens
catttatctattaaaat

SEQ ID NO: 4743399 - DNA, 21 bp, Homo sapiens
catttatctattaaaattgcc

SEQ ID NO: 4743400 - DNA, 23 bp, Homo sapiens
catttatctattaaaattgccat

SEQ ID NO: 4743401 - DNA, 12 bp, Homo sapiens
catttatgtgtt

SEQ ID NO: 4743402 - DNA, 14 bp, Homo sapiens
catttattctgctc

SEQ ID NO: 4743403 - DNA, 16 bp, Homo sapiens
catttattctgctcac

SEQ ID NO: 4743404 - DNA, 17 bp, Homo sapiens
catttcaagatccaaat

SEQ ID NO: 4743405 - DNA, 18 bp, Homo sapiens
catttcaagatccaaatg

SEQ ID NO: 4743406 - DNA, 19 bp, Homo sapiens
catttcacccctccctttc

SEQ ID NO: 4743407 - DNA, 16 bp, Homo sapiens
catttcaggagcagcc

SEQ ID NO: 4743408 - DNA, 22 bp, Homo sapiens
catttcctctgagctgttatct

SEQ ID NO: 4743409 - DNA, 21 bp, Homo sapiens
catttctcttcagtgtgttga

SEQ ID NO: 4743410 - DNA, 23 bp, Homo sapiens
catttgaaagtgggtttcaattt

SEQ ID NO: 4743411 - DNA, 14 bp, Homo sapiens
catttgagcagggc

SEQ ID NO: 4743412 - DNA, 16 bp, Homo sapiens
catttgagcagggctc

SEQ ID NO: 4743413 - DNA, 18 bp, Homo sapiens
catttgagcagggctcag

SEQ ID NO: 4743414 - DNA, 20 bp, Homo sapiens
catttgatttcgatgtacag

SEQ ID NO: 4743415 - DNA, 22 bp, Homo sapiens
catttgcaagggaaaagtctct

SEQ ID NO: 4743416 - DNA, 21 bp, Homo sapiens
catttgcaatatggatttctt

SEQ ID NO: 4743417 - DNA, 21 bp, Homo sapiens
catttgcgttccatgatgctg

SEQ ID NO: 4743418 - DNA, 23 bp, Homo sapiens
catttggcaggaagatgtatgct

SEQ ID NO: 4743419 - DNA, 13 bp, Homo sapiens
catttgtaacttt

SEQ ID NO: 4743420 - DNA, 23 bp, Homo sapiens
catttgtattgtacataaaattt

SEQ ID NO: 4743421 - DNA, 14 bp, Homo sapiens
catttgtgaagaat

SEQ ID NO: 4743422 - DNA, 14 bp, Homo sapiens
cattttaaaggata

SEQ ID NO: 4743423 - DNA, 20 bp, Homo sapiens
cattttcagcatcaaacatg

SEQ ID NO: 4743424 - DNA, 12 bp, Homo sapiens
cattttctcagt

SEQ ID NO: 4743425 - DNA, 13 bp, Homo sapiens
cattttcttgtat

SEQ ID NO: 4743426 - DNA, 12 bp, Homo sapiens
cattttcttgtc

SEQ ID NO: 4743427 - DNA, 22 bp, Homo sapiens
cattttcttgtcaatggaagaa

SEQ ID NO: 4743428 - DNA, 14 bp, Homo sapiens
cattttgaatgtga

SEQ ID NO: 4743429 - DNA, 21 bp, Homo sapiens
cattttggggtacccactgct

SEQ ID NO: 4743430 - DNA, 18 bp, Homo sapiens
cattttgtgaatggattg

SEQ ID NO: 4743431 - DNA, 21 bp, Homo sapiens
catttttaaaggacaaacagt

SEQ ID NO: 4743432 - DNA, 22 bp, Homo sapiens
catttttaaaggacaaacagtg

SEQ ID NO: 4743433 - DNA, 19 bp, Homo sapiens
catttttaactactgtatt

SEQ ID NO: 4743434 - DNA, 17 bp, Homo sapiens
catttttagtagagaca

SEQ ID NO: 4743435 - DNA, 18 bp, Homo sapiens
catttttagtagagacag

SEQ ID NO: 4743436 - DNA, 20 bp, Homo sapiens
catttttagtagagacaggg

SEQ ID NO: 4743437 - DNA, 18 bp, Homo sapiens
catttttcagatataaaa

SEQ ID NO: 4743438 - DNA, 16 bp, Homo sapiens
cattttttaaaaaatc

SEQ ID NO: 4743439 - DNA, 17 bp, Homo sapiens
catttttttccaggctg

SEQ ID NO: 4743440 - DNA, 19 bp, Homo sapiens
ccaaaaggtttaagaaata

SEQ ID NO: 4743441 - DNA, 23 bp, Homo sapiens
ccaaaaggtttaagaaatagaat

SEQ ID NO: 4743442 - DNA, 13 bp, Homo sapiens
ccaaacagtgaca

SEQ ID NO: 4743443 - DNA, 16 bp, Homo sapiens
ccaaagcagggtctgg

SEQ ID NO: 4743444 - DNA, 19 bp, Homo sapiens
ccaaagccaaagctaggcc

SEQ ID NO: 4743445 - DNA, 16 bp, Homo sapiens
ccaaagctttcatgta

SEQ ID NO: 4743446 - DNA, 14 bp, Homo sapiens
ccaaagtgctggga

SEQ ID NO: 4743447 - DNA, 19 bp, Homo sapiens
ccaaagtgctgggattaca

SEQ ID NO: 4743448 - DNA, 19 bp, Homo sapiens
ccaaagtggtatagaaatg

SEQ ID NO: 4743449 - DNA, 16 bp, Homo sapiens
ccaaagttaaatgtat

SEQ ID NO: 4743450 - DNA, 14 bp, Homo sapiens
ccaaataaaaataa

SEQ ID NO: 4743451 - DNA, 14 bp, Homo sapiens
ccaaataaaaatta

SEQ ID NO: 4743452 - DNA, 18 bp, Homo sapiens
ccaaatcctctccagcta

SEQ ID NO: 4743453 - DNA, 18 bp, Homo sapiens
ccaaatctgacatattat

SEQ ID NO: 4743454 - DNA, 20 bp, Homo sapiens
ccaaatgtgtataattttaa

SEQ ID NO: 4743455 - DNA, 21 bp, Homo sapiens
ccaaatgtgtataattttaaa

SEQ ID NO: 4743456 - DNA, 17 bp, Homo sapiens
ccaacatactcccatct

SEQ ID NO: 4743457 - DNA, 19 bp, Homo sapiens
ccaacatactcccatctgt

SEQ ID NO: 4743458 - DNA, 16 bp, Homo sapiens
ccaacatggtcctagc

SEQ ID NO: 4743459 - DNA, 13 bp, Homo sapiens
ccaacccagccgc

SEQ ID NO: 4743460 - DNA, 21 bp, Homo sapiens
ccaacccccagcacccgggct

SEQ ID NO: 4743461 - DNA, 21 bp, Homo sapiens
ccaaccccccagcactgagga

SEQ ID NO: 4743462 - DNA, 13 bp, Homo sapiens
ccaaccctcatca

SEQ ID NO: 4743463 - DNA, 23 bp, Homo sapiens
ccaaccttagatgttctaagtct

SEQ ID NO: 4743464 - DNA, 15 bp, Homo sapiens
ccaacgtctgtgcca

SEQ ID NO: 4743465 - DNA, 13 bp, Homo sapiens
ccaactcacccca

SEQ ID NO: 4743466 - DNA, 14 bp, Homo sapiens
ccaactcaccccag

SEQ ID NO: 4743467 - DNA, 18 bp, Homo sapiens
ccaactcaccccagcccc

SEQ ID NO: 4743468 - DNA, 21 bp, Homo sapiens
ccaactcaccccagccccaaa

SEQ ID NO: 4743469 - DNA, 15 bp, Homo sapiens
ccaactgaccacctt

SEQ ID NO: 4743470 - DNA, 14 bp, Homo sapiens
ccaagaagcccagg

SEQ ID NO: 4743471 - DNA, 19 bp, Homo sapiens
ccaagaagcccaggaaagg

SEQ ID NO: 4743472 - DNA, 13 bp, Homo sapiens
ccaagaagggcta

SEQ ID NO: 4743473 - DNA, 24 bp, Homo sapiens
ccaagagactccttgagagaccag

SEQ ID NO: 4743474 - DNA, 15 bp, Homo sapiens
ccaagagcttccaga

SEQ ID NO: 4743475 - DNA, 21 bp, Homo sapiens
ccaagagcttccagagctctg

SEQ ID NO: 4743476 - DNA, 16 bp, Homo sapiens
ccaagagtctgatgat

SEQ ID NO: 4743477 - DNA, 18 bp, Homo sapiens
ccaagcaggaaatgaaaa

SEQ ID NO: 4743478 - DNA, 12 bp, Homo sapiens
ccaagcctctgg

SEQ ID NO: 4743479 - DNA, 16 bp, Homo sapiens
ccaagctatcctggct

SEQ ID NO: 4743480 - DNA, 17 bp, Homo sapiens
ccaagctcaaagcgtgg

SEQ ID NO: 4743481 - DNA, 12 bp, Homo sapiens
ccaagctctgct

SEQ ID NO: 4743482 - DNA, 13 bp, Homo sapiens
ccaagctctgctc

SEQ ID NO: 4743483 - DNA, 15 bp, Homo sapiens
ccaagctctgctcct

SEQ ID NO: 4743484 - DNA, 16 bp, Homo sapiens
ccaagctctgctcctc

SEQ ID NO: 4743485 - DNA, 17 bp, Homo sapiens
ccaagctctgctcctct

SEQ ID NO: 4743486 - DNA, 15 bp, Homo sapiens
ccaagctgtgccacc

SEQ ID NO: 4743487 - DNA, 23 bp, Homo sapiens
ccaaggaaaccacagctgctgga

SEQ ID NO: 4743488 - DNA, 19 bp, Homo sapiens
ccaagggcctggcctgagc

SEQ ID NO: 4743489 - DNA, 18 bp, Homo sapiens
ccaaggtttataaagcag

SEQ ID NO: 4743490 - DNA, 18 bp, Homo sapiens
ccaagtggcagagcttgg

SEQ ID NO: 4743491 - DNA, 19 bp, Homo sapiens
ccaagtggcagagcttgga

SEQ ID NO: 4743492 - DNA, 22 bp, Homo sapiens
ccaataaatgtttgttatttac

SEQ ID NO: 4743493 - DNA, 14 bp, Homo sapiens
ccaataattttcct

SEQ ID NO: 4743494 - DNA, 22 bp, Homo sapiens
ccaatagttgttgattggcagg

SEQ ID NO: 4743495 - DNA, 14 bp, Homo sapiens
ccaatattgtacag

SEQ ID NO: 4743496 - DNA, 18 bp, Homo sapiens
ccaatattgtacagtttt

SEQ ID NO: 4743497 - DNA, 21 bp, Homo sapiens
ccaatctattctcaaagttaa

SEQ ID NO: 4743498 - DNA, 17 bp, Homo sapiens
ccaatggaacctccttt

SEQ ID NO: 4743499 - DNA, 12 bp, Homo sapiens
ccaatgtcttga

SEQ ID NO: 4743500 - DNA, 14 bp, Homo sapiens
ccaattccttgtag

SEQ ID NO: 4743501 - DNA, 11 bp, Homo sapiens
ccaattcttac

SEQ ID NO: 4743502 - DNA, 23 bp, Homo sapiens
ccacaaaataaccaatcctggac

SEQ ID NO: 4743503 - DNA, 16 bp, Homo sapiens
ccacaagacccttgtg

SEQ ID NO: 4743504 - DNA, 13 bp, Homo sapiens
ccacaccaagctg

SEQ ID NO: 4743505 - DNA, 15 bp, Homo sapiens
ccacacccagcccac

SEQ ID NO: 4743506 - DNA, 22 bp, Homo sapiens
ccacacccagcccacttctgcc

SEQ ID NO: 4743507 - DNA, 22 bp, Homo sapiens
ccacagagaaagtacttctcca

SEQ ID NO: 4743508 - DNA, 20 bp, Homo sapiens
ccacagccatcccagccttg

SEQ ID NO: 4743509 - DNA, 16 bp, Homo sapiens
ccacagcctcccctgc

SEQ ID NO: 4743510 - DNA, 16 bp, Homo sapiens
ccacagctgctggaga

SEQ ID NO: 4743511 - DNA, 21 bp, Homo sapiens
ccacagtgttggcgagaggag

SEQ ID NO: 4743512 - DNA, 13 bp, Homo sapiens
ccacataagtcca

SEQ ID NO: 4743513 - DNA, 14 bp, Homo sapiens
ccacatcttgctct

SEQ ID NO: 4743514 - DNA, 19 bp, Homo sapiens
ccacatcttgctctgctga

SEQ ID NO: 4743515 - DNA, 22 bp, Homo sapiens
ccacatcttgctctgctgacag

SEQ ID NO: 4743516 - DNA, 23 bp, Homo sapiens
ccacatcttgctctgctgacaga

SEQ ID NO: 4743517 - DNA, 16 bp, Homo sapiens
ccacatgtgcacatgc

SEQ ID NO: 4743518 - DNA, 16 bp, Homo sapiens
ccacattgaagaatgt

SEQ ID NO: 4743519 - DNA, 17 bp, Homo sapiens
ccaccaagagggacgcc

SEQ ID NO: 4743520 - DNA, 23 bp, Homo sapiens
ccaccacagcttatggcatctca

SEQ ID NO: 4743521 - DNA, 15 bp, Homo sapiens
ccaccaccagaaagc

SEQ ID NO: 4743522 - DNA, 20 bp, Homo sapiens
ccaccaccccccactctgtg

SEQ ID NO: 4743523 - DNA, 24 bp, Homo sapiens
ccaccaccccccactctgtgcctg

SEQ ID NO: 4743524 - DNA, 13 bp, Homo sapiens
ccaccaccctgag

SEQ ID NO: 4743525 - DNA, 14 bp, Homo sapiens
ccaccatcaagcca

SEQ ID NO: 4743526 - DNA, 15 bp, Homo sapiens
ccaccatcaagccac

SEQ ID NO: 4743527 - DNA, 16 bp, Homo sapiens
ccaccatcaagccacc

SEQ ID NO: 4743528 - DNA, 18 bp, Homo sapiens
ccaccatcatgtctggct

SEQ ID NO: 4743529 - DNA, 19 bp, Homo sapiens
ccaccatcatgtctggcta

SEQ ID NO: 4743530 - DNA, 16 bp, Homo sapiens
ccacccaagggcctgg

SEQ ID NO: 4743531 - DNA, 17 bp, Homo sapiens
ccacccaagggcctggc

SEQ ID NO: 4743532 - DNA, 19 bp, Homo sapiens
ccacccaagggcctggcct

SEQ ID NO: 4743533 - DNA, 20 bp, Homo sapiens
ccacccaagggcctggcctg

SEQ ID NO: 4743534 - DNA, 22 bp, Homo sapiens
ccacccaagggcctggcctgag

SEQ ID NO: 4743535 - DNA, 13 bp, Homo sapiens
ccacccacctcag

SEQ ID NO: 4743536 - DNA, 14 bp, Homo sapiens
ccacccaggagccc

SEQ ID NO: 4743537 - DNA, 23 bp, Homo sapiens
ccacccaggagccccgaggcctt

SEQ ID NO: 4743538 - DNA, 15 bp, Homo sapiens
ccaccccacacacgc

SEQ ID NO: 4743539 - DNA, 14 bp, Homo sapiens
ccacccccacacct

SEQ ID NO: 4743540 - DNA, 18 bp, Homo sapiens
ccaccccccactctgtgc

SEQ ID NO: 4743541 - DNA, 15 bp, Homo sapiens
ccacccctcatcagg

SEQ ID NO: 4743542 - DNA, 16 bp, Homo sapiens
ccacccctcatcagga

SEQ ID NO: 4743543 - DNA, 14 bp, Homo sapiens
ccaccctcctttca

SEQ ID NO: 4743544 - DNA, 15 bp, Homo sapiens
ccaccctgggctctg

SEQ ID NO: 4743545 - DNA, 17 bp, Homo sapiens
ccaccctgggctctgtg

SEQ ID NO: 4743546 - DNA, 20 bp, Homo sapiens
ccaccctgggctctgtgggc

SEQ ID NO: 4743547 - DNA, 17 bp, Homo sapiens
ccaccgcagacaggacc

SEQ ID NO: 4743548 - DNA, 16 bp, Homo sapiens
ccaccgcatgccccct

SEQ ID NO: 4743549 - DNA, 16 bp, Homo sapiens
ccacctagtggctgtc

SEQ ID NO: 4743550 - DNA, 19 bp, Homo sapiens
ccacctagtggctgtccag

SEQ ID NO: 4743551 - DNA, 20 bp, Homo sapiens
ccacctagtggctgtccagt

SEQ ID NO: 4743552 - DNA, 16 bp, Homo sapiens
ccacctccttccagca

SEQ ID NO: 4743553 - DNA, 20 bp, Homo sapiens
ccacctccttccagcactga

SEQ ID NO: 4743554 - DNA, 19 bp, Homo sapiens
ccacctctctcactccttg

SEQ ID NO: 4743555 - DNA, 20 bp, Homo sapiens
ccacctctctcactccttga

SEQ ID NO: 4743556 - DNA, 14 bp, Homo sapiens
ccacctgccaggga

SEQ ID NO: 4743557 - DNA, 16 bp, Homo sapiens
ccacctgccagggaca

SEQ ID NO: 4743558 - DNA, 21 bp, Homo sapiens
ccacctggacccctgcattgg

SEQ ID NO: 4743559 - DNA, 13 bp, Homo sapiens
ccacctggcctct

SEQ ID NO: 4743560 - DNA, 14 bp, Homo sapiens
ccacctggcctctg

SEQ ID NO: 4743561 - DNA, 17 bp, Homo sapiens
ccacctggcctctgcac

SEQ ID NO: 4743562 - DNA, 20 bp, Homo sapiens
ccacctggcctctgcactcc

SEQ ID NO: 4743563 - DNA, 16 bp, Homo sapiens
ccacctgtgcgagacc

SEQ ID NO: 4743564 - DNA, 14 bp, Homo sapiens
ccaccttgcgggga

SEQ ID NO: 4743565 - DNA, 12 bp, Homo sapiens
ccaccttggctg

SEQ ID NO: 4743566 - DNA, 14 bp, Homo sapiens
ccaccttggctgca

SEQ ID NO: 4743567 - DNA, 15 bp, Homo sapiens
ccacgactgtctcca

SEQ ID NO: 4743568 - DNA, 18 bp, Homo sapiens
ccacgcccccactggtga

SEQ ID NO: 4743569 - DNA, 19 bp, Homo sapiens
ccacgcccccactggtgac

SEQ ID NO: 4743570 - DNA, 13 bp, Homo sapiens
ccacgcccggcta

SEQ ID NO: 4743571 - DNA, 18 bp, Homo sapiens
ccacgcggccacctcacc

SEQ ID NO: 4743572 - DNA, 18 bp, Homo sapiens
ccacgctggagtgcagtg

SEQ ID NO: 4743573 - DNA, 12 bp, Homo sapiens
ccacggagccac

SEQ ID NO: 4743574 - DNA, 20 bp, Homo sapiens
ccacggagccactcctctga

SEQ ID NO: 4743575 - DNA, 16 bp, Homo sapiens
ccacgtcctgtcagtg

SEQ ID NO: 4743576 - DNA, 13 bp, Homo sapiens
ccacgtggggcca

SEQ ID NO: 4743577 - DNA, 23 bp, Homo sapiens
ccacgtggggccatgctgagagc

SEQ ID NO: 4743578 - DNA, 22 bp, Homo sapiens
ccactacggaatagttggctag

SEQ ID NO: 4743579 - DNA, 17 bp, Homo sapiens
ccactagacccactgga

SEQ ID NO: 4743580 - DNA, 21 bp, Homo sapiens
ccactatgagctttcagactc

SEQ ID NO: 4743581 - DNA, 16 bp, Homo sapiens
ccactcaggtctgttt

SEQ ID NO: 4743582 - DNA, 23 bp, Homo sapiens
ccactcccacttccctgacactg

SEQ ID NO: 4743583 - DNA, 14 bp, Homo sapiens
ccactcccaggcag

SEQ ID NO: 4743584 - DNA, 12 bp, Homo sapiens
ccactcctctga

SEQ ID NO: 4743585 - DNA, 13 bp, Homo sapiens
ccactcctctgac

SEQ ID NO: 4743586 - DNA, 20 bp, Homo sapiens
ccactcctctgactcagggc

SEQ ID NO: 4743587 - DNA, 14 bp, Homo sapiens
ccactccttccttt

SEQ ID NO: 4743588 - DNA, 19 bp, Homo sapiens
ccactgcaccccctcctgc

SEQ ID NO: 4743589 - DNA, 23 bp, Homo sapiens
ccactgcaccccctcctgctgca

SEQ ID NO: 4743590 - DNA, 17 bp, Homo sapiens
ccactgcaccgggccac

SEQ ID NO: 4743591 - DNA, 14 bp, Homo sapiens
ccactgcctttgac

SEQ ID NO: 4743592 - DNA, 20 bp, Homo sapiens
ccactgcttttggtctgtgt

SEQ ID NO: 4743593 - DNA, 15 bp, Homo sapiens
ccactgtgccatgtg

SEQ ID NO: 4743594 - DNA, 23 bp, Homo sapiens
ccactgtggaagtccctcagagg

SEQ ID NO: 4743595 - DNA, 23 bp, Homo sapiens
ccactgttgggtgggtgggccct

SEQ ID NO: 4743596 - DNA, 14 bp, Homo sapiens
ccacttcccaggta

SEQ ID NO: 4743597 - DNA, 23 bp, Homo sapiens
ccacttcccaggtaagcaggagg

SEQ ID NO: 4743598 - DNA, 15 bp, Homo sapiens
ccacttccctgacac

SEQ ID NO: 4743599 - DNA, 17 bp, Homo sapiens
ccacttccctgacactg

SEQ ID NO: 4743600 - DNA, 14 bp, Homo sapiens
ccacttccctgggc

SEQ ID NO: 4743601 - DNA, 19 bp, Homo sapiens
ccacttgttcattctgtga

SEQ ID NO: 4743602 - DNA, 13 bp, Homo sapiens
ccactttctttct

SEQ ID NO: 4743603 - DNA, 18 bp, Homo sapiens
ccagaaacctgggagaga

SEQ ID NO: 4743604 - DNA, 15 bp, Homo sapiens
ccagaaagaaaatga

SEQ ID NO: 4743605 - DNA, 19 bp, Homo sapiens
ccagacaccttgacagggc

SEQ ID NO: 4743606 - DNA, 14 bp, Homo sapiens
ccagacccggctgc

SEQ ID NO: 4743607 - DNA, 15 bp, Homo sapiens
ccagaccttctagga

SEQ ID NO: 4743608 - DNA, 15 bp, Homo sapiens
ccagagaaaattaat

SEQ ID NO: 4743609 - DNA, 15 bp, Homo sapiens
ccagagcagatgcag

SEQ ID NO: 4743610 - DNA, 17 bp, Homo sapiens
ccagagcagatgcagag

SEQ ID NO: 4743611 - DNA, 22 bp, Homo sapiens
ccagagcagatgcagagagcca

SEQ ID NO: 4743612 - DNA, 14 bp, Homo sapiens
ccagagcccacctt

SEQ ID NO: 4743613 - DNA, 14 bp, Homo sapiens
ccagagctctgacc

SEQ ID NO: 4743614 - DNA, 22 bp, Homo sapiens
ccagagctctgacccacagcct

SEQ ID NO: 4743615 - DNA, 15 bp, Homo sapiens
ccagagctgcacagg

SEQ ID NO: 4743616 - DNA, 22 bp, Homo sapiens
ccagaggaaggggccagaggct

SEQ ID NO: 4743617 - DNA, 22 bp, Homo sapiens
ccagaggagggcagcagaaggg

SEQ ID NO: 4743618 - DNA, 16 bp, Homo sapiens
ccagagggagtgacag

SEQ ID NO: 4743619 - DNA, 17 bp, Homo sapiens
ccagagggagtgacaga

SEQ ID NO: 4743620 - DNA, 18 bp, Homo sapiens
ccagagggagtgacagag

SEQ ID NO: 4743621 - DNA, 16 bp, Homo sapiens
ccagagggcctgcaag

SEQ ID NO: 4743622 - DNA, 18 bp, Homo sapiens
ccagagggcctgcaaggg

SEQ ID NO: 4743623 - DNA, 15 bp, Homo sapiens
ccagaggggcctgcc

SEQ ID NO: 4743624 - DNA, 17 bp, Homo sapiens
ccagaggggcctgccac

SEQ ID NO: 4743625 - DNA, 17 bp, Homo sapiens
ccagaggtaacagaaca

SEQ ID NO: 4743626 - DNA, 18 bp, Homo sapiens
ccagaggtaacagaacag

SEQ ID NO: 4743627 - DNA, 21 bp, Homo sapiens
ccagaggtaacagaacagctt

SEQ ID NO: 4743628 - DNA, 22 bp, Homo sapiens
ccagaggtaacagaacagcttc

SEQ ID NO: 4743629 - DNA, 19 bp, Homo sapiens
ccagatcggatctgttgca

SEQ ID NO: 4743630 - DNA, 22 bp, Homo sapiens
ccagatcggatctgttgcaaac

SEQ ID NO: 4743631 - DNA, 18 bp, Homo sapiens
ccagatgcacatccctgg

SEQ ID NO: 4743632 - DNA, 15 bp, Homo sapiens
ccagatgcaccagcc

SEQ ID NO: 4743633 - DNA, 17 bp, Homo sapiens
ccagatgcaccagccct

SEQ ID NO: 4743634 - DNA, 20 bp, Homo sapiens
ccagatgggggaaagcacag

SEQ ID NO: 4743635 - DNA, 18 bp, Homo sapiens
ccagatgtcgctgggtcc

SEQ ID NO: 4743636 - DNA, 22 bp, Homo sapiens
ccagattctttcctgaggctgg

SEQ ID NO: 4743637 - DNA, 18 bp, Homo sapiens
ccagattgcaacaggctg

SEQ ID NO: 4743638 - DNA, 22 bp, Homo sapiens
ccagattgcaacaggctgggct

SEQ ID NO: 4743639 - DNA, 16 bp, Homo sapiens
ccagattggctcacac

SEQ ID NO: 4743640 - DNA, 22 bp, Homo sapiens
ccagattggctcacactgagaa

SEQ ID NO: 4743641 - DNA, 15 bp, Homo sapiens
ccagcaaaaggttgt

SEQ ID NO: 4743642 - DNA, 20 bp, Homo sapiens
ccagcaagtgagagctgggt

SEQ ID NO: 4743643 - DNA, 19 bp, Homo sapiens
ccagcaattctcctgcctc

SEQ ID NO: 4743644 - DNA, 14 bp, Homo sapiens
ccagcacccgggct

SEQ ID NO: 4743645 - DNA, 20 bp, Homo sapiens
ccagcacccgggctcaggga

SEQ ID NO: 4743646 - DNA, 22 bp, Homo sapiens
ccagcaccggccccatttaccc

SEQ ID NO: 4743647 - DNA, 12 bp, Homo sapiens
ccagcactgagg

SEQ ID NO: 4743648 - DNA, 17 bp, Homo sapiens
ccagcactgaggaagaa

SEQ ID NO: 4743649 - DNA, 22 bp, Homo sapiens
ccagcactgcttgaggaaaaca

SEQ ID NO: 4743650 - DNA, 14 bp, Homo sapiens
ccagcagagcacct

SEQ ID NO: 4743651 - DNA, 19 bp, Homo sapiens
ccagcagagcaccttagac

SEQ ID NO: 4743652 - DNA, 14 bp, Homo sapiens
ccagcagtggcttg

SEQ ID NO: 4743653 - DNA, 19 bp, Homo sapiens
ccagcatatatagtattta

SEQ ID NO: 4743654 - DNA, 15 bp, Homo sapiens
ccagcattctcagcc

SEQ ID NO: 4743655 - DNA, 16 bp, Homo sapiens
ccagcattctcagcca

SEQ ID NO: 4743656 - DNA, 18 bp, Homo sapiens
ccagcattctcagccaca

SEQ ID NO: 4743657 - DNA, 18 bp, Homo sapiens
ccagcattttactgattc

SEQ ID NO: 4743658 - DNA, 15 bp, Homo sapiens
ccagccagggctgct

SEQ ID NO: 4743659 - DNA, 16 bp, Homo sapiens
ccagccccaaggggtg

SEQ ID NO: 4743660 - DNA, 15 bp, Homo sapiens
ccagccccacagccc

SEQ ID NO: 4743661 - DNA, 15 bp, Homo sapiens
ccagccccagtgccc

SEQ ID NO: 4743662 - DNA, 14 bp, Homo sapiens
ccagcccctgctgg

SEQ ID NO: 4743663 - DNA, 18 bp, Homo sapiens
ccagcccctgctggctgg

SEQ ID NO: 4743664 - DNA, 23 bp, Homo sapiens
ccagcccctgctggctggtgcct

SEQ ID NO: 4743665 - DNA, 13 bp, Homo sapiens
ccagcccctggat

SEQ ID NO: 4743666 - DNA, 17 bp, Homo sapiens
ccagccccttctgaccc

SEQ ID NO: 4743667 - DNA, 23 bp, Homo sapiens
ccagccccttctgacccatgctg

SEQ ID NO: 4743668 - DNA, 13 bp, Homo sapiens
ccagccctcatcc

SEQ ID NO: 4743669 - DNA, 17 bp, Homo sapiens
ccagccctggctgaagg

SEQ ID NO: 4743670 - DNA, 18 bp, Homo sapiens
ccagccctggctgaagga

SEQ ID NO: 4743671 - DNA, 16 bp, Homo sapiens
ccagccgctgcccggc

SEQ ID NO: 4743672 - DNA, 14 bp, Homo sapiens
ccagcctcagctct

SEQ ID NO: 4743673 - DNA, 15 bp, Homo sapiens
ccagcctctagggac

SEQ ID NO: 4743674 - DNA, 17 bp, Homo sapiens
ccagcctctagggaccc

SEQ ID NO: 4743675 - DNA, 22 bp, Homo sapiens
ccagcctgacaacagcctgaga

SEQ ID NO: 4743676 - DNA, 12 bp, Homo sapiens
ccagcctggccc

SEQ ID NO: 4743677 - DNA, 15 bp, Homo sapiens
ccagcctggcccagc

SEQ ID NO: 4743678 - DNA, 18 bp, Homo sapiens
ccagcctggcccagctcc

SEQ ID NO: 4743679 - DNA, 19 bp, Homo sapiens
ccagcctggcccagctccc

SEQ ID NO: 4743680 - DNA, 20 bp, Homo sapiens
ccagcctggcccagctcccc

SEQ ID NO: 4743681 - DNA, 13 bp, Homo sapiens
ccagcgagccctg

SEQ ID NO: 4743682 - DNA, 15 bp, Homo sapiens
ccagctcaccagccc

SEQ ID NO: 4743683 - DNA, 16 bp, Homo sapiens
ccagctcaccagcccc

SEQ ID NO: 4743684 - DNA, 15 bp, Homo sapiens
ccagctcccccggga

SEQ ID NO: 4743685 - DNA, 15 bp, Homo sapiens
ccagctctgaaacca

SEQ ID NO: 4743686 - DNA, 20 bp, Homo sapiens
ccagctctgaaaccagtgtt

SEQ ID NO: 4743687 - DNA, 21 bp, Homo sapiens
ccagctctgaaaccagtgtta

SEQ ID NO: 4743688 - DNA, 12 bp, Homo sapiens
ccagctctggtc

SEQ ID NO: 4743689 - DNA, 13 bp, Homo sapiens
ccagctctggtcc

SEQ ID NO: 4743690 - DNA, 14 bp, Homo sapiens
ccagctctggtcca

SEQ ID NO: 4743691 - DNA, 21 bp, Homo sapiens
ccagctgacagtcctctccac

SEQ ID NO: 4743692 - DNA, 21 bp, Homo sapiens
ccagctgtgctctggacaggc

SEQ ID NO: 4743693 - DNA, 14 bp, Homo sapiens
ccaggaaaaagaac

SEQ ID NO: 4743694 - DNA, 14 bp, Homo sapiens
ccaggaaaggctcc

SEQ ID NO: 4743695 - DNA, 17 bp, Homo sapiens
ccaggaaaggctccagg

SEQ ID NO: 4743696 - DNA, 18 bp, Homo sapiens
ccaggaaaggctccagga

SEQ ID NO: 4743697 - DNA, 20 bp, Homo sapiens
ccaggaaaggctccaggagc

SEQ ID NO: 4743698 - DNA, 21 bp, Homo sapiens
ccaggaaaggctccaggagca

SEQ ID NO: 4743699 - DNA, 13 bp, Homo sapiens
ccaggaagatcca

SEQ ID NO: 4743700 - DNA, 19 bp, Homo sapiens
ccaggaccaagggcagagg

SEQ ID NO: 4743701 - DNA, 16 bp, Homo sapiens
ccaggacggggccggc

SEQ ID NO: 4743702 - DNA, 20 bp, Homo sapiens
ccaggacggggccggccagg

SEQ ID NO: 4743703 - DNA, 23 bp, Homo sapiens
ccaggacggggccggccaggtgg

SEQ ID NO: 4743704 - DNA, 16 bp, Homo sapiens
ccaggactctgcagcc

SEQ ID NO: 4743705 - DNA, 21 bp, Homo sapiens
ccaggactctgcagcctcaga

SEQ ID NO: 4743706 - DNA, 13 bp, Homo sapiens
ccaggactgggcc

SEQ ID NO: 4743707 - DNA, 14 bp, Homo sapiens
ccaggactgggcca

SEQ ID NO: 4743708 - DNA, 20 bp, Homo sapiens
ccaggagaaggccaattcct

SEQ ID NO: 4743709 - DNA, 12 bp, Homo sapiens
ccaggagcagcc

SEQ ID NO: 4743710 - DNA, 14 bp, Homo sapiens
ccaggagcagccac

SEQ ID NO: 4743711 - DNA, 18 bp, Homo sapiens
ccaggagcatccacctcc

SEQ ID NO: 4743712 - DNA, 23 bp, Homo sapiens
ccaggagcatccacctccttctc

SEQ ID NO: 4743713 - DNA, 16 bp, Homo sapiens
ccaggagccccgaggc

SEQ ID NO: 4743714 - DNA, 19 bp, Homo sapiens
ccaggagccggacacttct

SEQ ID NO: 4743715 - DNA, 21 bp, Homo sapiens
ccaggagccggacacttctca

SEQ ID NO: 4743716 - DNA, 22 bp, Homo sapiens
ccaggagccggacacttctcag

SEQ ID NO: 4743717 - DNA, 12 bp, Homo sapiens
ccaggaggccag

SEQ ID NO: 4743718 - DNA, 15 bp, Homo sapiens
ccaggatcatggtgt

SEQ ID NO: 4743719 - DNA, 14 bp, Homo sapiens
ccaggatttataaa

SEQ ID NO: 4743720 - DNA, 15 bp, Homo sapiens
ccaggatttataaag

SEQ ID NO: 4743721 - DNA, 18 bp, Homo sapiens
ccaggatttataaagcaa

SEQ ID NO: 4743722 - DNA, 18 bp, Homo sapiens
ccaggcaggctaaggcgt

SEQ ID NO: 4743723 - DNA, 14 bp, Homo sapiens
ccaggcattcccca

SEQ ID NO: 4743724 - DNA, 24 bp, Homo sapiens
ccaggcattccccaggaggccagc

SEQ ID NO: 4743725 - DNA, 21 bp, Homo sapiens
ccaggccacaagacccttgtg

SEQ ID NO: 4743726 - DNA, 14 bp, Homo sapiens
ccaggccagaggga

SEQ ID NO: 4743727 - DNA, 18 bp, Homo sapiens
ccaggccaggactctgca

SEQ ID NO: 4743728 - DNA, 21 bp, Homo sapiens
ccaggccaggactctgcagcc

SEQ ID NO: 4743729 - DNA, 16 bp, Homo sapiens
ccaggccatcttccag

SEQ ID NO: 4743730 - DNA, 14 bp, Homo sapiens
ccaggcccctgcca

SEQ ID NO: 4743731 - DNA, 23 bp, Homo sapiens
ccaggcccctgccaccctgggga

SEQ ID NO: 4743732 - DNA, 15 bp, Homo sapiens
ccaggccctctgccc

SEQ ID NO: 4743733 - DNA, 16 bp, Homo sapiens
ccaggccctctgccca

SEQ ID NO: 4743734 - DNA, 20 bp, Homo sapiens
ccaggccctctgcccactcc

SEQ ID NO: 4743735 - DNA, 21 bp, Homo sapiens
ccaggccctctgcccactccc

SEQ ID NO: 4743736 - DNA, 17 bp, Homo sapiens
ccaggcctgggccagag

SEQ ID NO: 4743737 - DNA, 20 bp, Homo sapiens
ccaggctcctttagcgccca

SEQ ID NO: 4743738 - DNA, 13 bp, Homo sapiens
ccaggctgagcct

SEQ ID NO: 4743739 - DNA, 19 bp, Homo sapiens
ccaggctgagcctcagtct

SEQ ID NO: 4743740 - DNA, 22 bp, Homo sapiens
ccaggctgagcctcagtctccc

SEQ ID NO: 4743741 - DNA, 15 bp, Homo sapiens
ccaggctggccagcc

SEQ ID NO: 4743742 - DNA, 20 bp, Homo sapiens
ccaggctggccagccccaca

SEQ ID NO: 4743743 - DNA, 22 bp, Homo sapiens
ccaggctggccagccccacagc

SEQ ID NO: 4743744 - DNA, 12 bp, Homo sapiens
ccaggctggcgt

SEQ ID NO: 4743745 - DNA, 16 bp, Homo sapiens
ccaggctggcgtgcag

SEQ ID NO: 4743746 - DNA, 18 bp, Homo sapiens
ccaggctggcgtgcagtg

SEQ ID NO: 4743747 - DNA, 17 bp, Homo sapiens
ccaggctgggagagcct

SEQ ID NO: 4743748 - DNA, 18 bp, Homo sapiens
ccaggctgggagagcctt

SEQ ID NO: 4743749 - DNA, 21 bp, Homo sapiens
ccaggctgggagagccttcca

SEQ ID NO: 4743750 - DNA, 15 bp, Homo sapiens
ccagggacagagggg

SEQ ID NO: 4743751 - DNA, 15 bp, Homo sapiens
ccagggagagcccag

SEQ ID NO: 4743752 - DNA, 19 bp, Homo sapiens
ccagggagagcccaggagc

SEQ ID NO: 4743753 - DNA, 20 bp, Homo sapiens
ccagggcagccagggagagc

SEQ ID NO: 4743754 - DNA, 14 bp, Homo sapiens
ccagggcctaggac

SEQ ID NO: 4743755 - DNA, 16 bp, Homo sapiens
ccagggcctggaagac

SEQ ID NO: 4743756 - DNA, 21 bp, Homo sapiens
ccagggcctggaagacagaga

SEQ ID NO: 4743757 - DNA, 16 bp, Homo sapiens
ccagggctctgaccag

SEQ ID NO: 4743758 - DNA, 21 bp, Homo sapiens
ccagggctggaatgatttcag

SEQ ID NO: 4743759 - DNA, 13 bp, Homo sapiens
ccagggctggact

SEQ ID NO: 4743760 - DNA, 18 bp, Homo sapiens
ccagggctggactgaggc

SEQ ID NO: 4743761 - DNA, 15 bp, Homo sapiens
ccaggggcaggcaca

SEQ ID NO: 4743762 - DNA, 19 bp, Homo sapiens
ccaggggtgggacaccctg

SEQ ID NO: 4743763 - DNA, 16 bp, Homo sapiens
ccagggttgaccccag

SEQ ID NO: 4743764 - DNA, 20 bp, Homo sapiens
ccaggtgcacaagctccaag

SEQ ID NO: 4743765 - DNA, 22 bp, Homo sapiens
ccaggtgctacacccttttcca

SEQ ID NO: 4743766 - DNA, 20 bp, Homo sapiens
ccaggtgggcgggcagcaca

SEQ ID NO: 4743767 - DNA, 20 bp, Homo sapiens
ccaggtggggtgaggcagtg

SEQ ID NO: 4743768 - DNA, 23 bp, Homo sapiens
ccaggtggggtgaggcagtgggt

SEQ ID NO: 4743769 - DNA, 14 bp, Homo sapiens
ccaggttggaaaag

SEQ ID NO: 4743770 - DNA, 17 bp, Homo sapiens
ccaggtttttggtctga

SEQ ID NO: 4743771 - DNA, 19 bp, Homo sapiens
ccagtcaccccggccacct

SEQ ID NO: 4743772 - DNA, 20 bp, Homo sapiens
ccagtcaccccggccacctg

SEQ ID NO: 4743773 - DNA, 21 bp, Homo sapiens
ccagtcaccccggccacctgc

SEQ ID NO: 4743774 - DNA, 15 bp, Homo sapiens
ccagtcgcgctgcct

SEQ ID NO: 4743775 - DNA, 18 bp, Homo sapiens
ccagtcgcgctgcctgtg

SEQ ID NO: 4743776 - DNA, 18 bp, Homo sapiens
ccagtctggaatgcagtg

SEQ ID NO: 4743777 - DNA, 13 bp, Homo sapiens
ccagtgagatgca

SEQ ID NO: 4743778 - DNA, 17 bp, Homo sapiens
ccagtgagatgcattct

SEQ ID NO: 4743779 - DNA, 21 bp, Homo sapiens
ccagtgagatgcattcttggt

SEQ ID NO: 4743780 - DNA, 19 bp, Homo sapiens
ccagtgaggctctgccctt

SEQ ID NO: 4743781 - DNA, 16 bp, Homo sapiens
ccagtgtcttcctgtg

SEQ ID NO: 4743782 - DNA, 14 bp, Homo sapiens
ccagtgtgacaagg

SEQ ID NO: 4743783 - DNA, 20 bp, Homo sapiens
ccagtgttagggaagggcct

SEQ ID NO: 4743784 - DNA, 15 bp, Homo sapiens
ccagttccctccctc

SEQ ID NO: 4743785 - DNA, 22 bp, Homo sapiens
ccagttcctttcaatggtttgc

SEQ ID NO: 4743786 - DNA, 18 bp, Homo sapiens
ccagttgcactcaggtga

SEQ ID NO: 4743787 - DNA, 13 bp, Homo sapiens
ccagttggtcccc

SEQ ID NO: 4743788 - DNA, 17 bp, Homo sapiens
ccagtttaacctgatgc

SEQ ID NO: 4743789 - DNA, 18 bp, Homo sapiens
ccagtttaacctgatgca

SEQ ID NO: 4743790 - DNA, 17 bp, Homo sapiens
ccataaccgctgattct

SEQ ID NO: 4743791 - DNA, 12 bp, Homo sapiens
ccatactaatta

SEQ ID NO: 4743792 - DNA, 13 bp, Homo sapiens
ccatactggcctc

SEQ ID NO: 4743793 - DNA, 17 bp, Homo sapiens
ccatactggcctcgcct

SEQ ID NO: 4743794 - DNA, 18 bp, Homo sapiens
ccatactggcctcgcctg

SEQ ID NO: 4743795 - DNA, 20 bp, Homo sapiens
ccatactggcctcgcctggc

SEQ ID NO: 4743796 - DNA, 21 bp, Homo sapiens
ccatactggcctcgcctggcc

SEQ ID NO: 4743797 - DNA, 13 bp, Homo sapiens
ccataggcccagt

SEQ ID NO: 4743798 - DNA, 12 bp, Homo sapiens
ccatcacccgct

SEQ ID NO: 4743799 - DNA, 20 bp, Homo sapiens
ccatcagaaacaccctcaca

SEQ ID NO: 4743800 - DNA, 22 bp, Homo sapiens
ccatcagaaacaccctcacact

SEQ ID NO: 4743801 - DNA, 23 bp, Homo sapiens
ccatcagaaacaccctcacactg

SEQ ID NO: 4743802 - DNA, 15 bp, Homo sapiens
ccatcagtgccagcc

SEQ ID NO: 4743803 - DNA, 19 bp, Homo sapiens
ccatcagtgccagcccctg

SEQ ID NO: 4743804 - DNA, 22 bp, Homo sapiens
ccatcagtgtacccccgcccag

SEQ ID NO: 4743805 - DNA, 23 bp, Homo sapiens
ccatcagtgtacccccgcccagg

SEQ ID NO: 4743806 - DNA, 13 bp, Homo sapiens
ccatcatctcctg

SEQ ID NO: 4743807 - DNA, 14 bp, Homo sapiens
ccatcatgtctggc

SEQ ID NO: 4743808 - DNA, 15 bp, Homo sapiens
ccatcccagccccaa

SEQ ID NO: 4743809 - DNA, 20 bp, Homo sapiens
ccatcccccctcaccagggg

SEQ ID NO: 4743810 - DNA, 22 bp, Homo sapiens
ccatcccccctcaccaggggca

SEQ ID NO: 4743811 - DNA, 16 bp, Homo sapiens
ccatcccctagaaatc

SEQ ID NO: 4743812 - DNA, 14 bp, Homo sapiens
ccatccctgaaggc

SEQ ID NO: 4743813 - DNA, 20 bp, Homo sapiens
ccatccctgaaggccccgcc

SEQ ID NO: 4743814 - DNA, 21 bp, Homo sapiens
ccatcctctgtacagagccca

SEQ ID NO: 4743815 - DNA, 16 bp, Homo sapiens
ccatcctggcccatca

SEQ ID NO: 4743816 - DNA, 16 bp, Homo sapiens
ccatctaaactgcccc

SEQ ID NO: 4743817 - DNA, 15 bp, Homo sapiens
ccatctcacacatga

SEQ ID NO: 4743818 - DNA, 22 bp, Homo sapiens
ccatctctggatgcctgattgc

SEQ ID NO: 4743819 - DNA, 12 bp, Homo sapiens
ccatctgcccag

SEQ ID NO: 4743820 - DNA, 14 bp, Homo sapiens
ccatcttccaggtg

SEQ ID NO: 4743821 - DNA, 15 bp, Homo sapiens
ccatcttccaggtgg

SEQ ID NO: 4743822 - DNA, 14 bp, Homo sapiens
ccatctttgtatat

SEQ ID NO: 4743823 - DNA, 18 bp, Homo sapiens
ccatgagcctcagcatcc

SEQ ID NO: 4743824 - DNA, 19 bp, Homo sapiens
ccatgagcctcagcatcct

SEQ ID NO: 4743825 - DNA, 13 bp, Homo sapiens
ccatgagtcccct

SEQ ID NO: 4743826 - DNA, 16 bp, Homo sapiens
ccatgagtcccctgtt

SEQ ID NO: 4743827 - DNA, 17 bp, Homo sapiens
ccatgatgcatggagtg

SEQ ID NO: 4743828 - DNA, 19 bp, Homo sapiens
ccatgctgagagctgggct

SEQ ID NO: 4743829 - DNA, 14 bp, Homo sapiens
ccatgctgccctgt

SEQ ID NO: 4743830 - DNA, 13 bp, Homo sapiens
ccatggactttgt

SEQ ID NO: 4743831 - DNA, 15 bp, Homo sapiens
ccatggccctcccag

SEQ ID NO: 4743832 - DNA, 16 bp, Homo sapiens
ccatgggcactgctgg

SEQ ID NO: 4743833 - DNA, 17 bp, Homo sapiens
ccatgggcactgctggg

SEQ ID NO: 4743834 - DNA, 16 bp, Homo sapiens
ccatgggcagagccca

SEQ ID NO: 4743835 - DNA, 13 bp, Homo sapiens
ccatgggcttcac

SEQ ID NO: 4743836 - DNA, 16 bp, Homo sapiens
ccatgggcttcactgt

SEQ ID NO: 4743837 - DNA, 19 bp, Homo sapiens
ccatgggcttcactgtata

SEQ ID NO: 4743838 - DNA, 13 bp, Homo sapiens
ccatgtgccaggt

SEQ ID NO: 4743839 - DNA, 23 bp, Homo sapiens
ccatgttctatttcagtgccaat

SEQ ID NO: 4743840 - DNA, 16 bp, Homo sapiens
ccatgttggccaggct

SEQ ID NO: 4743841 - DNA, 21 bp, Homo sapiens
ccatgttggccaggctggtct

SEQ ID NO: 4743842 - DNA, 14 bp, Homo sapiens
ccattaactgcttt

SEQ ID NO: 4743843 - DNA, 18 bp, Homo sapiens
ccattcattccattctgg

SEQ ID NO: 4743844 - DNA, 22 bp, Homo sapiens
ccattcctcaccttttcccggg

SEQ ID NO: 4743845 - DNA, 13 bp, Homo sapiens
ccattccttccca

SEQ ID NO: 4743846 - DNA, 19 bp, Homo sapiens
ccattctccacctgccagg

SEQ ID NO: 4743847 - DNA, 20 bp, Homo sapiens
ccattctccacctgccaggg

SEQ ID NO: 4743848 - DNA, 19 bp, Homo sapiens
ccattctggaagtgacttt

SEQ ID NO: 4743849 - DNA, 13 bp, Homo sapiens
ccattgaattctt

SEQ ID NO: 4743850 - DNA, 19 bp, Homo sapiens
ccattgcactccagcctgg

SEQ ID NO: 4743851 - DNA, 19 bp, Homo sapiens
ccattggctatttaaaact

SEQ ID NO: 4743852 - DNA, 19 bp, Homo sapiens
ccattgtccaatcctatgt

SEQ ID NO: 4743853 - DNA, 21 bp, Homo sapiens
ccatttgatttcgatgtacag

SEQ ID NO: 4743854 - DNA, 19 bp, Homo sapiens
ccattttattaaacatttt

SEQ ID NO: 4743855 - DNA, 20 bp, Homo sapiens
ccattttattaaacattttc

SEQ ID NO: 4743856 - DNA, 14 bp, Homo sapiens
ccattttgtgaatg

SEQ ID NO: 4743857 - DNA, 18 bp, Homo sapiens
ccattttgttattgacta

SEQ ID NO: 4743858 - DNA, 18 bp, Homo sapiens
cccaaatggaaatgggca

SEQ ID NO: 4743859 - DNA, 22 bp, Homo sapiens
cccaaatggaaatgggcagagc

SEQ ID NO: 4743860 - DNA, 12 bp, Homo sapiens
cccaacaccaaa

SEQ ID NO: 4743861 - DNA, 15 bp, Homo sapiens
cccaactcaccccag

SEQ ID NO: 4743862 - DNA, 13 bp, Homo sapiens
cccaagctctgct

SEQ ID NO: 4743863 - DNA, 17 bp, Homo sapiens
cccaagggcctggcctg

SEQ ID NO: 4743864 - DNA, 23 bp, Homo sapiens
cccaagggcctggcctgagctgg

SEQ ID NO: 4743865 - DNA, 16 bp, Homo sapiens
cccaagtttctaaggg

SEQ ID NO: 4743866 - DNA, 19 bp, Homo sapiens
cccaatccctcaaaccttg

SEQ ID NO: 4743867 - DNA, 23 bp, Homo sapiens
cccaatgcactttgttctggctc

SEQ ID NO: 4743868 - DNA, 15 bp, Homo sapiens
cccaatgctgatgtc

SEQ ID NO: 4743869 - DNA, 15 bp, Homo sapiens
cccacagcccacgtc

SEQ ID NO: 4743870 - DNA, 22 bp, Homo sapiens
cccacagcccacgtcctgtcag

SEQ ID NO: 4743871 - DNA, 13 bp, Homo sapiens
cccacagcgctgg

SEQ ID NO: 4743872 - DNA, 20 bp, Homo sapiens
cccacaggacatttctctaa

SEQ ID NO: 4743873 - DNA, 20 bp, Homo sapiens
cccacagtggagagggctac

SEQ ID NO: 4743874 - DNA, 18 bp, Homo sapiens
cccaccatcatgtctggc

SEQ ID NO: 4743875 - DNA, 15 bp, Homo sapiens
cccaccgcagacagg

SEQ ID NO: 4743876 - DNA, 19 bp, Homo sapiens
cccaccgcagacaggacca

SEQ ID NO: 4743877 - DNA, 14 bp, Homo sapiens
cccaccgcatgccc

SEQ ID NO: 4743878 - DNA, 20 bp, Homo sapiens
cccaccgcatgccccctcgt

SEQ ID NO: 4743879 - DNA, 22 bp, Homo sapiens
cccaccgcatgccccctcgtgc

SEQ ID NO: 4743880 - DNA, 21 bp, Homo sapiens
cccacctcagcctcccaaagt

SEQ ID NO: 4743881 - DNA, 13 bp, Homo sapiens
cccacctctctca

SEQ ID NO: 4743882 - DNA, 17 bp, Homo sapiens
cccacctctctcactcc

SEQ ID NO: 4743883 - DNA, 19 bp, Homo sapiens
cccacctctctcactcctt

SEQ ID NO: 4743884 - DNA, 22 bp, Homo sapiens
cccacctctctcactccttgaa

SEQ ID NO: 4743885 - DNA, 19 bp, Homo sapiens
cccacctggcctctgcact

SEQ ID NO: 4743886 - DNA, 21 bp, Homo sapiens
cccacctggcctctgcactcc

SEQ ID NO: 4743887 - DNA, 15 bp, Homo sapiens
cccaccttggctgca

SEQ ID NO: 4743888 - DNA, 14 bp, Homo sapiens
cccacgctggagtg

SEQ ID NO: 4743889 - DNA, 13 bp, Homo sapiens
cccacgtcctgtc

SEQ ID NO: 4743890 - DNA, 18 bp, Homo sapiens
cccactagacccactgga

SEQ ID NO: 4743891 - DNA, 17 bp, Homo sapiens
cccactcattccttctc

SEQ ID NO: 4743892 - DNA, 12 bp, Homo sapiens
cccactctgtgc

SEQ ID NO: 4743893 - DNA, 14 bp, Homo sapiens
cccactgaaatgga

SEQ ID NO: 4743894 - DNA, 17 bp, Homo sapiens
cccactgcaccccctcc

SEQ ID NO: 4743895 - DNA, 22 bp, Homo sapiens
cccactgcaccccctcctgctg

SEQ ID NO: 4743896 - DNA, 19 bp, Homo sapiens
cccactgcttttggtctgt

SEQ ID NO: 4743897 - DNA, 23 bp, Homo sapiens
cccacttcccctcctacccctcc

SEQ ID NO: 4743898 - DNA, 12 bp, Homo sapiens
cccacttccctg

SEQ ID NO: 4743899 - DNA, 16 bp, Homo sapiens
cccacttccctgacac

SEQ ID NO: 4743900 - DNA, 17 bp, Homo sapiens
cccacttccctgacact

SEQ ID NO: 4743901 - DNA, 12 bp, Homo sapiens
cccacttctgcc

SEQ ID NO: 4743902 - DNA, 21 bp, Homo sapiens
cccagaacacggcagctgctg

SEQ ID NO: 4743903 - DNA, 16 bp, Homo sapiens
cccagagctgcacagg

SEQ ID NO: 4743904 - DNA, 21 bp, Homo sapiens
cccagaggaaggggccagagg

SEQ ID NO: 4743905 - DNA, 24 bp, Homo sapiens
cccagaggaaggggccagaggctc

SEQ ID NO: 4743906 - DNA, 20 bp, Homo sapiens
cccagagggcctgcaaggga

SEQ ID NO: 4743907 - DNA, 17 bp, Homo sapiens
cccagaggggcctgcca

SEQ ID NO: 4743908 - DNA, 18 bp, Homo sapiens
cccagaggggcctgccac

SEQ ID NO: 4743909 - DNA, 13 bp, Homo sapiens
cccagaggtaaca

SEQ ID NO: 4743910 - DNA, 20 bp, Homo sapiens
cccagaggtaacagaacagc

SEQ ID NO: 4743911 - DNA, 22 bp, Homo sapiens
cccagaggtaacagaacagctt

SEQ ID NO: 4743912 - DNA, 20 bp, Homo sapiens
cccagattgcaacaggctgg

SEQ ID NO: 4743913 - DNA, 21 bp, Homo sapiens
cccagattggctcacactgag

SEQ ID NO: 4743914 - DNA, 16 bp, Homo sapiens
cccagattttatttat

SEQ ID NO: 4743915 - DNA, 17 bp, Homo sapiens
cccagattttatttata

SEQ ID NO: 4743916 - DNA, 18 bp, Homo sapiens
cccagcaagtgagagctg

SEQ ID NO: 4743917 - DNA, 22 bp, Homo sapiens
cccagcacccgggctcagggac

SEQ ID NO: 4743918 - DNA, 13 bp, Homo sapiens
cccagcactgagg

SEQ ID NO: 4743919 - DNA, 23 bp, Homo sapiens
cccagccacagtgttatgctctg

SEQ ID NO: 4743920 - DNA, 17 bp, Homo sapiens
cccagcccacttctgcc

SEQ ID NO: 4743921 - DNA, 19 bp, Homo sapiens
cccagcccacttctgccat

SEQ ID NO: 4743922 - DNA, 21 bp, Homo sapiens
cccagccccaaaactctcctc

SEQ ID NO: 4743923 - DNA, 23 bp, Homo sapiens
cccagccccaaaactctcctctg

SEQ ID NO: 4743924 - DNA, 19 bp, Homo sapiens
cccagccccaaggggtggc

SEQ ID NO: 4743925 - DNA, 16 bp, Homo sapiens
cccagccctcatcccg

SEQ ID NO: 4743926 - DNA, 13 bp, Homo sapiens
cccagcctggccc

SEQ ID NO: 4743927 - DNA, 14 bp, Homo sapiens
cccagcctggccca

SEQ ID NO: 4743928 - DNA, 16 bp, Homo sapiens
cccagcctggcccagc

SEQ ID NO: 4743929 - DNA, 18 bp, Homo sapiens
cccagcctggcccagctc

SEQ ID NO: 4743930 - DNA, 15 bp, Homo sapiens
cccagcgagccctgg

SEQ ID NO: 4743931 - DNA, 19 bp, Homo sapiens
cccagcgagccctggtggc

SEQ ID NO: 4743932 - DNA, 16 bp, Homo sapiens
cccagctcccccggga

SEQ ID NO: 4743933 - DNA, 12 bp, Homo sapiens
cccagctctgaa

SEQ ID NO: 4743934 - DNA, 22 bp, Homo sapiens
cccagctctgaaaccagtgtta

SEQ ID NO: 4743935 - DNA, 13 bp, Homo sapiens
cccagctctggtc

SEQ ID NO: 4743936 - DNA, 15 bp, Homo sapiens
cccagctctggtcca

SEQ ID NO: 4743937 - DNA, 21 bp, Homo sapiens
cccagctgtgctctggacagg

SEQ ID NO: 4743938 - DNA, 18 bp, Homo sapiens
cccaggaaaggctccagg

SEQ ID NO: 4743939 - DNA, 21 bp, Homo sapiens
cccaggaaaggctccaggagc

SEQ ID NO: 4743940 - DNA, 23 bp, Homo sapiens
cccaggaaaggctccaggagcag

SEQ ID NO: 4743941 - DNA, 19 bp, Homo sapiens
cccaggacggggccggcca

SEQ ID NO: 4743942 - DNA, 15 bp, Homo sapiens
cccaggactgggcca

SEQ ID NO: 4743943 - DNA, 18 bp, Homo sapiens
cccaggagccccgaggcc

SEQ ID NO: 4743944 - DNA, 21 bp, Homo sapiens
cccaggagccccgaggccttc

SEQ ID NO: 4743945 - DNA, 15 bp, Homo sapiens
cccaggaggccagcc

SEQ ID NO: 4743946 - DNA, 22 bp, Homo sapiens
cccaggaggccagccttgacca

SEQ ID NO: 4743947 - DNA, 11 bp, Homo sapiens
cccaggcaggt

SEQ ID NO: 4743948 - DNA, 17 bp, Homo sapiens
cccaggcaggtcttgaa

SEQ ID NO: 4743949 - DNA, 23 bp, Homo sapiens
cccaggcattccccaggaggcca

SEQ ID NO: 4743950 - DNA, 14 bp, Homo sapiens
cccaggccaggact

SEQ ID NO: 4743951 - DNA, 15 bp, Homo sapiens
cccaggccaggactc

SEQ ID NO: 4743952 - DNA, 20 bp, Homo sapiens
cccaggccaggactctgcag

SEQ ID NO: 4743953 - DNA, 21 bp, Homo sapiens
cccaggccaggactctgcagc

SEQ ID NO: 4743954 - DNA, 22 bp, Homo sapiens
cccaggccaggactctgcagcc

SEQ ID NO: 4743955 - DNA, 23 bp, Homo sapiens
cccaggccaggactctgcagcct

SEQ ID NO: 4743956 - DNA, 18 bp, Homo sapiens
cccaggccatcttccagg

SEQ ID NO: 4743957 - DNA, 11 bp, Homo sapiens
cccaggcccct

SEQ ID NO: 4743958 - DNA, 18 bp, Homo sapiens
cccaggcccctgccaccc

SEQ ID NO: 4743959 - DNA, 15 bp, Homo sapiens
cccaggctgagcctc

SEQ ID NO: 4743960 - DNA, 17 bp, Homo sapiens
cccaggctgagcctcag

SEQ ID NO: 4743961 - DNA, 18 bp, Homo sapiens
cccaggctgagcctcagt

SEQ ID NO: 4743962 - DNA, 16 bp, Homo sapiens
cccaggctggccagcc

SEQ ID NO: 4743963 - DNA, 22 bp, Homo sapiens
cccaggctggccagccccacag

SEQ ID NO: 4743964 - DNA, 23 bp, Homo sapiens
cccaggctggccagccccacagc

SEQ ID NO: 4743965 - DNA, 13 bp, Homo sapiens
cccaggctggcgt

SEQ ID NO: 4743966 - DNA, 19 bp, Homo sapiens
cccaggctgggcaaggagg

SEQ ID NO: 4743967 - DNA, 18 bp, Homo sapiens
cccagggcagccagggag

SEQ ID NO: 4743968 - DNA, 17 bp, Homo sapiens
cccaggtaagcaggagg

SEQ ID NO: 4743969 - DNA, 19 bp, Homo sapiens
cccaggtaagcaggaggag

SEQ ID NO: 4743970 - DNA, 13 bp, Homo sapiens
cccaggtttctgg

SEQ ID NO: 4743971 - DNA, 22 bp, Homo sapiens
cccagtaattattttcttcctt

SEQ ID NO: 4743972 - DNA, 15 bp, Homo sapiens
cccagtgcccacagg

SEQ ID NO: 4743973 - DNA, 15 bp, Homo sapiens
cccagtggctgctgc

SEQ ID NO: 4743974 - DNA, 17 bp, Homo sapiens
cccagtggctgctgccc

SEQ ID NO: 4743975 - DNA, 18 bp, Homo sapiens
cccagtggctgctgccca

SEQ ID NO: 4743976 - DNA, 15 bp, Homo sapiens
cccagtgtcttcctg

SEQ ID NO: 4743977 - DNA, 20 bp, Homo sapiens
cccagtgtcttcctgtgggg

SEQ ID NO: 4743978 - DNA, 13 bp, Homo sapiens
cccagttgtattt

SEQ ID NO: 4743979 - DNA, 19 bp, Homo sapiens
cccatcagtgccagcccct

SEQ ID NO: 4743980 - DNA, 13 bp, Homo sapiens
cccatcagtgtac

SEQ ID NO: 4743981 - DNA, 21 bp, Homo sapiens
cccatcagtgtacccccgccc

SEQ ID NO: 4743982 - DNA, 15 bp, Homo sapiens
cccatcccccctcac

SEQ ID NO: 4743983 - DNA, 22 bp, Homo sapiens
cccatcccccctcaccaggggc

SEQ ID NO: 4743984 - DNA, 14 bp, Homo sapiens
cccatcctctgtac

SEQ ID NO: 4743985 - DNA, 19 bp, Homo sapiens
cccatcctctgtacagagc

SEQ ID NO: 4743986 - DNA, 22 bp, Homo sapiens
cccatcctctgtacagagccca

SEQ ID NO: 4743987 - DNA, 18 bp, Homo sapiens
cccatctcacacatgagc

SEQ ID NO: 4743988 - DNA, 15 bp, Homo sapiens
cccatctgcccagga

SEQ ID NO: 4743989 - DNA, 12 bp, Homo sapiens
cccatctgtgaa

SEQ ID NO: 4743990 - DNA, 17 bp, Homo sapiens
cccatgacccaggctgg

SEQ ID NO: 4743991 - DNA, 18 bp, Homo sapiens
cccatgacccaggctggg

SEQ ID NO: 4743992 - DNA, 19 bp, Homo sapiens
cccatgacccaggctgggc

SEQ ID NO: 4743993 - DNA, 12 bp, Homo sapiens
cccatgctgccc

SEQ ID NO: 4743994 - DNA, 14 bp, Homo sapiens
cccatgctgccctg

SEQ ID NO: 4743995 - DNA, 22 bp, Homo sapiens
cccatggaggagacaggaagcc

SEQ ID NO: 4743996 - DNA, 17 bp, Homo sapiens
cccatggccctcccagt

SEQ ID NO: 4743997 - DNA, 15 bp, Homo sapiens
cccatgggcactgct

SEQ ID NO: 4743998 - DNA, 15 bp, Homo sapiens
cccatgttctgtccc

SEQ ID NO: 4743999 - DNA, 21 bp, Homo sapiens
cccatgttctgtcccttgccc

SEQ ID NO: 4744000 - DNA, 13 bp, Homo sapiens
cccattctgcctg

SEQ ID NO: 4744001 - DNA, 15 bp, Homo sapiens
cccattctgcctgcc

SEQ ID NO: 4744002 - DNA, 23 bp, Homo sapiens
cccattctgcctgcccaggcccc

SEQ ID NO: 4744003 - DNA, 21 bp, Homo sapiens
ccccaaaactctcctctgctg

SEQ ID NO: 4744004 - DNA, 15 bp, Homo sapiens
ccccaattccttgta

SEQ ID NO: 4744005 - DNA, 11 bp, Homo sapiens
ccccacagccc

SEQ ID NO: 4744006 - DNA, 12 bp, Homo sapiens
ccccacagccca

SEQ ID NO: 4744007 - DNA, 15 bp, Homo sapiens
ccccacagcccacgt

SEQ ID NO: 4744008 - DNA, 21 bp, Homo sapiens
ccccacccaagggcctggcct

SEQ ID NO: 4744009 - DNA, 13 bp, Homo sapiens
ccccacccacttc

SEQ ID NO: 4744010 - DNA, 16 bp, Homo sapiens
ccccaccccagggcag

SEQ ID NO: 4744011 - DNA, 12 bp, Homo sapiens
ccccacccctca

SEQ ID NO: 4744012 - DNA, 15 bp, Homo sapiens
ccccaccccttgctc

SEQ ID NO: 4744013 - DNA, 13 bp, Homo sapiens
ccccactctgtgc

SEQ ID NO: 4744014 - DNA, 13 bp, Homo sapiens
ccccactggtgac

SEQ ID NO: 4744015 - DNA, 20 bp, Homo sapiens
ccccagattgcaacaggctg

SEQ ID NO: 4744016 - DNA, 21 bp, Homo sapiens
ccccagcaagtgagagctggg

SEQ ID NO: 4744017 - DNA, 14 bp, Homo sapiens
ccccagcccccacc

SEQ ID NO: 4744018 - DNA, 14 bp, Homo sapiens
ccccaggactgggc

SEQ ID NO: 4744019 - DNA, 14 bp, Homo sapiens
ccccaggaggccag

SEQ ID NO: 4744020 - DNA, 15 bp, Homo sapiens
ccccaggaggccagc

SEQ ID NO: 4744021 - DNA, 21 bp, Homo sapiens
ccccaggaggccagccttgac

SEQ ID NO: 4744022 - DNA, 15 bp, Homo sapiens
ccccagggcagccag

SEQ ID NO: 4744023 - DNA, 22 bp, Homo sapiens
ccccagggcagccagggagagc

SEQ ID NO: 4744024 - DNA, 20 bp, Homo sapiens
ccccagtgcccacaggatca

SEQ ID NO: 4744025 - DNA, 17 bp, Homo sapiens
ccccatcctctgtacag

SEQ ID NO: 4744026 - DNA, 22 bp, Homo sapiens
ccccatcctctgtacagagccc

SEQ ID NO: 4744027 - DNA, 13 bp, Homo sapiens
ccccatcctggcc

SEQ ID NO: 4744028 - DNA, 15 bp, Homo sapiens
ccccatcctggccca

SEQ ID NO: 4744029 - DNA, 17 bp, Homo sapiens
ccccatctgcccaggac

SEQ ID NO: 4744030 - DNA, 23 bp, Homo sapiens
ccccattcctgggaaatattccc

SEQ ID NO: 4744031 - DNA, 13 bp, Homo sapiens
ccccattctgcct

SEQ ID NO: 4744032 - DNA, 13 bp, Homo sapiens
cccccaatccatg

SEQ ID NO: 4744033 - DNA, 13 bp, Homo sapiens
cccccacccaagg

SEQ ID NO: 4744034 - DNA, 13 bp, Homo sapiens
cccccacccactt

SEQ ID NO: 4744035 - DNA, 21 bp, Homo sapiens
cccccacgggacgcggcaggc

SEQ ID NO: 4744036 - DNA, 17 bp, Homo sapiens
cccccactgcctttgac

SEQ ID NO: 4744037 - DNA, 15 bp, Homo sapiens
cccccactggtgaca

SEQ ID NO: 4744038 - DNA, 15 bp, Homo sapiens
cccccagcactgagg

SEQ ID NO: 4744039 - DNA, 17 bp, Homo sapiens
cccccagcactgaggaa

SEQ ID NO: 4744040 - DNA, 12 bp, Homo sapiens
cccccagcccca

SEQ ID NO: 4744041 - DNA, 17 bp, Homo sapiens
cccccagcccctccatg

SEQ ID NO: 4744042 - DNA, 12 bp, Homo sapiens
cccccaggactg

SEQ ID NO: 4744043 - DNA, 13 bp, Homo sapiens
ccccccactctgt

SEQ ID NO: 4744044 - DNA, 13 bp, Homo sapiens
ccccccagcactg

SEQ ID NO: 4744045 - DNA, 12 bp, Homo sapiens
ccccccttctga

SEQ ID NO: 4744046 - DNA, 13 bp, Homo sapiens
cccccgcccaggc

SEQ ID NO: 4744047 - DNA, 18 bp, Homo sapiens
cccccgggaggggcccgc

SEQ ID NO: 4744048 - DNA, 22 bp, Homo sapiens
cccccgggaggggcccgcttgc

SEQ ID NO: 4744049 - DNA, 13 bp, Homo sapiens
ccccctcctgctg

SEQ ID NO: 4744050 - DNA, 15 bp, Homo sapiens
ccccctcctgctgca

SEQ ID NO: 4744051 - DNA, 16 bp, Homo sapiens
ccccctctgccctgcg

SEQ ID NO: 4744052 - DNA, 21 bp, Homo sapiens
ccccctctggctccagctggc

SEQ ID NO: 4744053 - DNA, 19 bp, Homo sapiens
ccccctgacaacactcatt

SEQ ID NO: 4744054 - DNA, 19 bp, Homo sapiens
ccccctgcaaagcccagct

SEQ ID NO: 4744055 - DNA, 21 bp, Homo sapiens
ccccctgcaaagcccagcttg

SEQ ID NO: 4744056 - DNA, 17 bp, Homo sapiens
ccccctggcctccccca

SEQ ID NO: 4744057 - DNA, 12 bp, Homo sapiens
ccccctgtgcag

SEQ ID NO: 4744058 - DNA, 23 bp, Homo sapiens
ccccgaggccttctctgaaggac

SEQ ID NO: 4744059 - DNA, 20 bp, Homo sapiens
ccccgagggatgatgccaca

SEQ ID NO: 4744060 - DNA, 19 bp, Homo sapiens
ccccgcaggcctgccttct

SEQ ID NO: 4744061 - DNA, 13 bp, Homo sapiens
ccccggccacctg

SEQ ID NO: 4744062 - DNA, 18 bp, Homo sapiens
ccccggccacctgcggtg

SEQ ID NO: 4744063 - DNA, 16 bp, Homo sapiens
cccctcagacagcccc

SEQ ID NO: 4744064 - DNA, 18 bp, Homo sapiens
cccctcagggtccctggt

SEQ ID NO: 4744065 - DNA, 20 bp, Homo sapiens
cccctcagggtccctggtgg

SEQ ID NO: 4744066 - DNA, 20 bp, Homo sapiens
cccctcatagccctcaccct

SEQ ID NO: 4744067 - DNA, 12 bp, Homo sapiens
cccctcccagct

SEQ ID NO: 4744068 - DNA, 13 bp, Homo sapiens
cccctcccagctg

SEQ ID NO: 4744069 - DNA, 15 bp, Homo sapiens
cccctcctccactct

SEQ ID NO: 4744070 - DNA, 23 bp, Homo sapiens
cccctcctctcccctaccactgt

SEQ ID NO: 4744071 - DNA, 15 bp, Homo sapiens
cccctcctctctgcc

SEQ ID NO: 4744072 - DNA, 12 bp, Homo sapiens
cccctcctgctg

SEQ ID NO: 4744073 - DNA, 14 bp, Homo sapiens
cccctcctgctgca

SEQ ID NO: 4744074 - DNA, 22 bp, Homo sapiens
cccctcctgctgcagaggggca

SEQ ID NO: 4744075 - DNA, 15 bp, Homo sapiens
cccctcgtgccagtc

SEQ ID NO: 4744076 - DNA, 13 bp, Homo sapiens
cccctctgccctg

SEQ ID NO: 4744077 - DNA, 15 bp, Homo sapiens
cccctctgccctgcg

SEQ ID NO: 4744078 - DNA, 18 bp, Homo sapiens
cccctctggctccagctg

SEQ ID NO: 4744079 - DNA, 22 bp, Homo sapiens
cccctctgtccaggcactgaga

SEQ ID NO: 4744080 - DNA, 15 bp, Homo sapiens
cccctgcaaagccca

SEQ ID NO: 4744081 - DNA, 18 bp, Homo sapiens
cccctgcaggaaggagct

SEQ ID NO: 4744082 - DNA, 19 bp, Homo sapiens
cccctgcaggaaggagctg

SEQ ID NO: 4744083 - DNA, 20 bp, Homo sapiens
cccctgcaggaaggagctgc

SEQ ID NO: 4744084 - DNA, 21 bp, Homo sapiens
cccctgcattggaactggagg

SEQ ID NO: 4744085 - DNA, 16 bp, Homo sapiens
cccctgccaccctggg

SEQ ID NO: 4744086 - DNA, 15 bp, Homo sapiens
cccctgccacctcct

SEQ ID NO: 4744087 - DNA, 23 bp, Homo sapiens
cccctgccagggcagggccccag

SEQ ID NO: 4744088 - DNA, 23 bp, Homo sapiens
cccctgcccccaggactgggcca

SEQ ID NO: 4744089 - DNA, 18 bp, Homo sapiens
cccctgccccctgcagga

SEQ ID NO: 4744090 - DNA, 19 bp, Homo sapiens
cccctgcccggctgcggaa

SEQ ID NO: 4744091 - DNA, 17 bp, Homo sapiens
cccctgctgggtgtggc

SEQ ID NO: 4744092 - DNA, 18 bp, Homo sapiens
cccctggatgcagcctca

SEQ ID NO: 4744093 - DNA, 19 bp, Homo sapiens
cccctgtgcagccgctgag

SEQ ID NO: 4744094 - DNA, 14 bp, Homo sapiens
ccccttccactgag

SEQ ID NO: 4744095 - DNA, 22 bp, Homo sapiens
ccccttcctaattccacagctg

SEQ ID NO: 4744096 - DNA, 19 bp, Homo sapiens
ccccttcgctcctgtgtct

SEQ ID NO: 4744097 - DNA, 15 bp, Homo sapiens
ccccttctcatcact

SEQ ID NO: 4744098 - DNA, 13 bp, Homo sapiens
ccccttctgaccc

SEQ ID NO: 4744099 - DNA, 14 bp, Homo sapiens
ccccttctgaccca

SEQ ID NO: 4744100 - DNA, 16 bp, Homo sapiens
ccccttctgacccatg

SEQ ID NO: 4744101 - DNA, 17 bp, Homo sapiens
ccccttctgacccatgc

SEQ ID NO: 4744102 - DNA, 19 bp, Homo sapiens
ccccttttcagcttctgct

SEQ ID NO: 4744103 - DNA, 22 bp, Homo sapiens
cccgaacgctctgcaccttctg

SEQ ID NO: 4744104 - DNA, 20 bp, Homo sapiens
cccgaatacaaacacctgga

SEQ ID NO: 4744105 - DNA, 15 bp, Homo sapiens
cccgagcctggctcc

SEQ ID NO: 4744106 - DNA, 20 bp, Homo sapiens
cccgaggccttctctgaagg

SEQ ID NO: 4744107 - DNA, 14 bp, Homo sapiens
cccgagtagctggg

SEQ ID NO: 4744108 - DNA, 21 bp, Homo sapiens
cccgagtagctgggactacag

SEQ ID NO: 4744109 - DNA, 22 bp, Homo sapiens
cccgagtagctgggactacagg

SEQ ID NO: 4744110 - DNA, 19 bp, Homo sapiens
cccgagtttggtccctggg

SEQ ID NO: 4744111 - DNA, 11 bp, Homo sapiens
cccgcttgcct

SEQ ID NO: 4744112 - DNA, 17 bp, Homo sapiens
cccgcttgcctcggctc

SEQ ID NO: 4744113 - DNA, 21 bp, Homo sapiens
cccgcttgcctcggctcctgc

SEQ ID NO: 4744114 - DNA, 22 bp, Homo sapiens
cccgcttgcctcggctcctgct

SEQ ID NO: 4744115 - DNA, 15 bp, Homo sapiens
cccggcgccctctgt

SEQ ID NO: 4744116 - DNA, 14 bp, Homo sapiens
cccggctccaggct

SEQ ID NO: 4744117 - DNA, 13 bp, Homo sapiens
cccggctgccctt

SEQ ID NO: 4744118 - DNA, 13 bp, Homo sapiens
cccgggaggggcc

SEQ ID NO: 4744119 - DNA, 18 bp, Homo sapiens
cccgggaggggcccgctt

SEQ ID NO: 4744120 - DNA, 20 bp, Homo sapiens
cccgtggccccagcctggcc

SEQ ID NO: 4744121 - DNA, 23 bp, Homo sapiens
cccgtggccccagcctggcccag

SEQ ID NO: 4744122 - DNA, 16 bp, Homo sapiens
cccgttgtctccctgg

SEQ ID NO: 4744123 - DNA, 22 bp, Homo sapiens
cccgttgtctccctggccctca

SEQ ID NO: 4744124 - DNA, 18 bp, Homo sapiens
ccctaaggcatgtgtgaa

SEQ ID NO: 4744125 - DNA, 17 bp, Homo sapiens
ccctaatgcgcaggctg

SEQ ID NO: 4744126 - DNA, 14 bp, Homo sapiens
ccctatctttgcca

SEQ ID NO: 4744127 - DNA, 16 bp, Homo sapiens
ccctatctttgccacc

SEQ ID NO: 4744128 - DNA, 19 bp, Homo sapiens
ccctatctttgccaccctc

SEQ ID NO: 4744129 - DNA, 21 bp, Homo sapiens
ccctatctttgccaccctcat

SEQ ID NO: 4744130 - DNA, 17 bp, Homo sapiens
ccctattggtaaagaat

SEQ ID NO: 4744131 - DNA, 16 bp, Homo sapiens
ccctcaaggcctccca

SEQ ID NO: 4744132 - DNA, 20 bp, Homo sapiens
ccctcaaggcctcccacagt

SEQ ID NO: 4744133 - DNA, 19 bp, Homo sapiens
ccctcaattccccctggcc

SEQ ID NO: 4744134 - DNA, 13 bp, Homo sapiens
ccctcacccctgg

SEQ ID NO: 4744135 - DNA, 20 bp, Homo sapiens
ccctcacccctggttctcat

SEQ ID NO: 4744136 - DNA, 22 bp, Homo sapiens
ccctcacccctggttctcatct

SEQ ID NO: 4744137 - DNA, 17 bp, Homo sapiens
ccctcagggtccctggt

SEQ ID NO: 4744138 - DNA, 13 bp, Homo sapiens
ccctcatagccct

SEQ ID NO: 4744139 - DNA, 15 bp, Homo sapiens
ccctcatagccctca

SEQ ID NO: 4744140 - DNA, 17 bp, Homo sapiens
ccctcatcccgagcacc

SEQ ID NO: 4744141 - DNA, 14 bp, Homo sapiens
ccctcatctgtccc

SEQ ID NO: 4744142 - DNA, 16 bp, Homo sapiens
ccctcatttcaggagc

SEQ ID NO: 4744143 - DNA, 21 bp, Homo sapiens
ccctccaagaccttctccttc

SEQ ID NO: 4744144 - DNA, 17 bp, Homo sapiens
ccctccacacctgcggc

SEQ ID NO: 4744145 - DNA, 19 bp, Homo sapiens
ccctccatctaaactgccc

SEQ ID NO: 4744146 - DNA, 13 bp, Homo sapiens
ccctcccagcagt

SEQ ID NO: 4744147 - DNA, 12 bp, Homo sapiens
ccctcccagctg

SEQ ID NO: 4744148 - DNA, 14 bp, Homo sapiens
ccctcccgcccctt

SEQ ID NO: 4744149 - DNA, 12 bp, Homo sapiens
ccctccctgctg

SEQ ID NO: 4744150 - DNA, 13 bp, Homo sapiens
ccctccctttctc

SEQ ID NO: 4744151 - DNA, 14 bp, Homo sapiens
ccctccctttctcc

SEQ ID NO: 4744152 - DNA, 14 bp, Homo sapiens
ccctcctccactct

SEQ ID NO: 4744153 - DNA, 20 bp, Homo sapiens
ccctcctccctttttccttg

SEQ ID NO: 4744154 - DNA, 14 bp, Homo sapiens
ccctcctctctgcc

SEQ ID NO: 4744155 - DNA, 22 bp, Homo sapiens
ccctcgaggcggatctttggac

SEQ ID NO: 4744156 - DNA, 23 bp, Homo sapiens
ccctcgaggcggatctttggaca

SEQ ID NO: 4744157 - DNA, 15 bp, Homo sapiens
ccctcgcccatcagt

SEQ ID NO: 4744158 - DNA, 13 bp, Homo sapiens
ccctcgtgccagt

SEQ ID NO: 4744159 - DNA, 14 bp, Homo sapiens
ccctcgtgccagtc

SEQ ID NO: 4744160 - DNA, 23 bp, Homo sapiens
ccctcgtgccagtcgcgctgcct

SEQ ID NO: 4744161 - DNA, 15 bp, Homo sapiens
ccctcgtttgatagt

SEQ ID NO: 4744162 - DNA, 18 bp, Homo sapiens
ccctctacagagcttccc

SEQ ID NO: 4744163 - DNA, 18 bp, Homo sapiens
ccctctcaggctgtccca

SEQ ID NO: 4744164 - DNA, 19 bp, Homo sapiens
ccctctccgcacacctctg

SEQ ID NO: 4744165 - DNA, 11 bp, Homo sapiens
ccctctgccca

SEQ ID NO: 4744166 - DNA, 17 bp, Homo sapiens
ccctctggctccagctg

SEQ ID NO: 4744167 - DNA, 13 bp, Homo sapiens
ccctgaaggcccc

SEQ ID NO: 4744168 - DNA, 20 bp, Homo sapiens
ccctgaaggccccgcccagg

SEQ ID NO: 4744169 - DNA, 14 bp, Homo sapiens
ccctgacaacactc

SEQ ID NO: 4744170 - DNA, 13 bp, Homo sapiens
ccctgagctgagg

SEQ ID NO: 4744171 - DNA, 19 bp, Homo sapiens
ccctgagctgaggcagcag

SEQ ID NO: 4744172 - DNA, 21 bp, Homo sapiens
ccctgagctgaggcagcagtg

SEQ ID NO: 4744173 - DNA, 21 bp, Homo sapiens
ccctgagttgcaccattcttt

SEQ ID NO: 4744174 - DNA, 19 bp, Homo sapiens
ccctgataacaacctggag

SEQ ID NO: 4744175 - DNA, 18 bp, Homo sapiens
ccctgatttgctgggcag

SEQ ID NO: 4744176 - DNA, 18 bp, Homo sapiens
ccctgcaaaaggactctc

SEQ ID NO: 4744177 - DNA, 16 bp, Homo sapiens
ccctgcaaagcccagc

SEQ ID NO: 4744178 - DNA, 16 bp, Homo sapiens
ccctgcactgtcctgc

SEQ ID NO: 4744179 - DNA, 23 bp, Homo sapiens
ccctgcactgtcctgctccacag

SEQ ID NO: 4744180 - DNA, 19 bp, Homo sapiens
ccctgcacttgcagactct

SEQ ID NO: 4744181 - DNA, 15 bp, Homo sapiens
ccctgcaggaaggag

SEQ ID NO: 4744182 - DNA, 22 bp, Homo sapiens
ccctgcaggaaggagctgcctg

SEQ ID NO: 4744183 - DNA, 23 bp, Homo sapiens
ccctgcaggaaggagctgcctgg

SEQ ID NO: 4744184 - DNA, 12 bp, Homo sapiens
ccctgccaccct

SEQ ID NO: 4744185 - DNA, 14 bp, Homo sapiens
ccctgccaccctgg

SEQ ID NO: 4744186 - DNA, 15 bp, Homo sapiens
ccctgccaccctggg

SEQ ID NO: 4744187 - DNA, 18 bp, Homo sapiens
ccctgccaccctggggag

SEQ ID NO: 4744188 - DNA, 20 bp, Homo sapiens
ccctgccacctcctgcctca

SEQ ID NO: 4744189 - DNA, 12 bp, Homo sapiens
ccctgccagggc

SEQ ID NO: 4744190 - DNA, 14 bp, Homo sapiens
ccctgccagggcag

SEQ ID NO: 4744191 - DNA, 18 bp, Homo sapiens
ccctgcccacctggcctc

SEQ ID NO: 4744192 - DNA, 20 bp, Homo sapiens
ccctgcccacctggcctctg

SEQ ID NO: 4744193 - DNA, 23 bp, Homo sapiens
ccctgcccccaggactgggccac

SEQ ID NO: 4744194 - DNA, 14 bp, Homo sapiens
ccctgccccccagc

SEQ ID NO: 4744195 - DNA, 16 bp, Homo sapiens
ccctgccccctgcagg

SEQ ID NO: 4744196 - DNA, 19 bp, Homo sapiens
ccctgccccgcaggcctgc

SEQ ID NO: 4744197 - DNA, 12 bp, Homo sapiens
ccctgccctggt

SEQ ID NO: 4744198 - DNA, 22 bp, Homo sapiens
ccctgccctggtttcctgccct

SEQ ID NO: 4744199 - DNA, 12 bp, Homo sapiens
ccctgccctgtg

SEQ ID NO: 4744200 - DNA, 14 bp, Homo sapiens
ccctgccctgtggg

SEQ ID NO: 4744201 - DNA, 16 bp, Homo sapiens
ccctgcctcctttgtg

SEQ ID NO: 4744202 - DNA, 23 bp, Homo sapiens
ccctgcctcctttgtgaggaagc

SEQ ID NO: 4744203 - DNA, 14 bp, Homo sapiens
ccctgcctgctgca

SEQ ID NO: 4744204 - DNA, 22 bp, Homo sapiens
ccctgctctccgaccagacacc

SEQ ID NO: 4744205 - DNA, 16 bp, Homo sapiens
ccctgctgctgcctgc

SEQ ID NO: 4744206 - DNA, 13 bp, Homo sapiens
ccctgctggttca

SEQ ID NO: 4744207 - DNA, 19 bp, Homo sapiens
ccctgctggttcagggttg

SEQ ID NO: 4744208 - DNA, 12 bp, Homo sapiens
ccctgctgtccc

SEQ ID NO: 4744209 - DNA, 17 bp, Homo sapiens
ccctgctgtcccctctt

SEQ ID NO: 4744210 - DNA, 19 bp, Homo sapiens
ccctgctgtcccctcttgc

SEQ ID NO: 4744211 - DNA, 21 bp, Homo sapiens
ccctgcttcaatacccaaatc

SEQ ID NO: 4744212 - DNA, 17 bp, Homo sapiens
ccctggatgcagcctca

SEQ ID NO: 4744213 - DNA, 13 bp, Homo sapiens
ccctggccctcaa

SEQ ID NO: 4744214 - DNA, 22 bp, Homo sapiens
ccctggccctcaaggcctccca

SEQ ID NO: 4744215 - DNA, 23 bp, Homo sapiens
ccctggccctcaaggcctcccac

SEQ ID NO: 4744216 - DNA, 19 bp, Homo sapiens
ccctggctgaaggactgtg

SEQ ID NO: 4744217 - DNA, 17 bp, Homo sapiens
ccctggggacagcaagg

SEQ ID NO: 4744218 - DNA, 16 bp, Homo sapiens
ccctggtggcagctca

SEQ ID NO: 4744219 - DNA, 17 bp, Homo sapiens
ccctggtggcagctcac

SEQ ID NO: 4744220 - DNA, 14 bp, Homo sapiens
ccctggtggcagtg

SEQ ID NO: 4744221 - DNA, 20 bp, Homo sapiens
ccctggtggccctctcccct

SEQ ID NO: 4744222 - DNA, 14 bp, Homo sapiens
ccctggttctcatc

SEQ ID NO: 4744223 - DNA, 15 bp, Homo sapiens
ccctggttctcatct

SEQ ID NO: 4744224 - DNA, 19 bp, Homo sapiens
ccctggtttcctgccctgg

SEQ ID NO: 4744225 - DNA, 23 bp, Homo sapiens
ccctggtttcctgccctgggagg

SEQ ID NO: 4744226 - DNA, 15 bp, Homo sapiens
ccctgtgatggggcc

SEQ ID NO: 4744227 - DNA, 17 bp, Homo sapiens
ccctgtgatggggccct

SEQ ID NO: 4744228 - DNA, 20 bp, Homo sapiens
ccctgtgatggggccctgcc

SEQ ID NO: 4744229 - DNA, 21 bp, Homo sapiens
ccctgtgatggggccctgcct

SEQ ID NO: 4744230 - DNA, 22 bp, Homo sapiens
ccctgtgcagccgctgagcgag

SEQ ID NO: 4744231 - DNA, 16 bp, Homo sapiens
ccctgtgggcccccaa

SEQ ID NO: 4744232 - DNA, 17 bp, Homo sapiens
ccctgtgttctgcacat

SEQ ID NO: 4744233 - DNA, 15 bp, Homo sapiens
ccctgtttgtttctg

SEQ ID NO: 4744234 - DNA, 19 bp, Homo sapiens
ccctgtttgtttctgaaag

SEQ ID NO: 4744235 - DNA, 14 bp, Homo sapiens
cccttacacttact

SEQ ID NO: 4744236 - DNA, 14 bp, Homo sapiens
cccttagcagggaa

SEQ ID NO: 4744237 - DNA, 22 bp, Homo sapiens
cccttagcccccacccacttcc

SEQ ID NO: 4744238 - DNA, 14 bp, Homo sapiens
cccttcccacagga

SEQ ID NO: 4744239 - DNA, 23 bp, Homo sapiens
cccttcccacaggacatttctct

SEQ ID NO: 4744240 - DNA, 12 bp, Homo sapiens
cccttcccacct

SEQ ID NO: 4744241 - DNA, 21 bp, Homo sapiens
cccttcccatgacccaggctg

SEQ ID NO: 4744242 - DNA, 13 bp, Homo sapiens
cccttcctaattc

SEQ ID NO: 4744243 - DNA, 20 bp, Homo sapiens
cccttcctaattccacagct

SEQ ID NO: 4744244 - DNA, 21 bp, Homo sapiens
cccttcctaattccacagctg

SEQ ID NO: 4744245 - DNA, 13 bp, Homo sapiens
cccttcgctcctg

SEQ ID NO: 4744246 - DNA, 14 bp, Homo sapiens
cccttcgctcctgt

SEQ ID NO: 4744247 - DNA, 15 bp, Homo sapiens
cccttcgctcctgtg

SEQ ID NO: 4744248 - DNA, 23 bp, Homo sapiens
cccttctccatccacatgggagc

SEQ ID NO: 4744249 - DNA, 21 bp, Homo sapiens
cccttctctccagcccctgga

SEQ ID NO: 4744250 - DNA, 11 bp, Homo sapiens
cccttcttttt

SEQ ID NO: 4744251 - DNA, 17 bp, Homo sapiens
cccttgcccccctggcc

SEQ ID NO: 4744252 - DNA, 17 bp, Homo sapiens
cccttgccgtctacctg

SEQ ID NO: 4744253 - DNA, 22 bp, Homo sapiens
cccttgccgtctacctgagggg

SEQ ID NO: 4744254 - DNA, 14 bp, Homo sapiens
cccttggaaagaaa

SEQ ID NO: 4744255 - DNA, 14 bp, Homo sapiens
cccttggacatttt

SEQ ID NO: 4744256 - DNA, 23 bp, Homo sapiens
cccttgggggtcctcctccaggg

SEQ ID NO: 4744257 - DNA, 22 bp, Homo sapiens
cccttggttaggcattgtggga

SEQ ID NO: 4744258 - DNA, 23 bp, Homo sapiens
cccttggttaggcattgtgggaa

SEQ ID NO: 4744259 - DNA, 23 bp, Homo sapiens
cccttttttggctgctgaaggct

SEQ ID NO: 4744260 - DNA, 20 bp, Homo sapiens
ccgaacatatcatttgtgaa

SEQ ID NO: 4744261 - DNA, 21 bp, Homo sapiens
ccgaacatatcatttgtgaag

SEQ ID NO: 4744262 - DNA, 14 bp, Homo sapiens
ccgaacgctctgca

SEQ ID NO: 4744263 - DNA, 23 bp, Homo sapiens
ccgacttgaattttcccactgca

SEQ ID NO: 4744264 - DNA, 16 bp, Homo sapiens
ccgagcctggctccaa

SEQ ID NO: 4744265 - DNA, 17 bp, Homo sapiens
ccgaggccttctctgaa

SEQ ID NO: 4744266 - DNA, 16 bp, Homo sapiens
ccgagggatgatgcca

SEQ ID NO: 4744267 - DNA, 18 bp, Homo sapiens
ccgagggatgatgccaca

SEQ ID NO: 4744268 - DNA, 19 bp, Homo sapiens
ccgagggatgatgccacac

SEQ ID NO: 4744269 - DNA, 20 bp, Homo sapiens
ccgagggatgatgccacacc

SEQ ID NO: 4744270 - DNA, 14 bp, Homo sapiens
ccgagtagctggga

SEQ ID NO: 4744271 - DNA, 14 bp, Homo sapiens
ccgagtctgtcctg

SEQ ID NO: 4744272 - DNA, 21 bp, Homo sapiens
ccgatgtgggtccctctcttg

SEQ ID NO: 4744273 - DNA, 16 bp, Homo sapiens
ccgcagacaggaccag

SEQ ID NO: 4744274 - DNA, 23 bp, Homo sapiens
ccgcaggatttgggctcttggaa

SEQ ID NO: 4744275 - DNA, 21 bp, Homo sapiens
ccgcaggcctgccttctcagg

SEQ ID NO: 4744276 - DNA, 22 bp, Homo sapiens
ccgcaggcctgccttctcaggg

SEQ ID NO: 4744277 - DNA, 19 bp, Homo sapiens
ccgcatgccccctcgtgcc

SEQ ID NO: 4744278 - DNA, 14 bp, Homo sapiens
ccgcccaggctggc

SEQ ID NO: 4744279 - DNA, 16 bp, Homo sapiens
ccgcccaggctggcca

SEQ ID NO: 4744280 - DNA, 18 bp, Homo sapiens
ccgcccaggctggccagc

SEQ ID NO: 4744281 - DNA, 19 bp, Homo sapiens
ccgccccttccccgaggga

SEQ ID NO: 4744282 - DNA, 15 bp, Homo sapiens
ccgcctcgcccaccg

SEQ ID NO: 4744283 - DNA, 17 bp, Homo sapiens
ccgcctcgcccaccgca

SEQ ID NO: 4744284 - DNA, 19 bp, Homo sapiens
ccgcctcgcccaccgcatg

SEQ ID NO: 4744285 - DNA, 21 bp, Homo sapiens
ccgcctcgcccaccgcatgcc

SEQ ID NO: 4744286 - DNA, 15 bp, Homo sapiens
ccgcggctggatggg

SEQ ID NO: 4744287 - DNA, 14 bp, Homo sapiens
ccgctcccagtgtc

SEQ ID NO: 4744288 - DNA, 20 bp, Homo sapiens
ccgctgcccggcgccctctg

SEQ ID NO: 4744289 - DNA, 11 bp, Homo sapiens
ccgctggggcc

SEQ ID NO: 4744290 - DNA, 20 bp, Homo sapiens
ccgcttgcctcggctcctgc

SEQ ID NO: 4744291 - DNA, 17 bp, Homo sapiens
ccgcttggagcagaggg

SEQ ID NO: 4744292 - DNA, 18 bp, Homo sapiens
ccgcttggagcagagggg

SEQ ID NO: 4744293 - DNA, 20 bp, Homo sapiens
ccggacacttctcaggaaat

SEQ ID NO: 4744294 - DNA, 13 bp, Homo sapiens
ccggaccagcctg

SEQ ID NO: 4744295 - DNA, 16 bp, Homo sapiens
ccggaccagcctggcc

SEQ ID NO: 4744296 - DNA, 14 bp, Homo sapiens
ccggagagtggggg

SEQ ID NO: 4744297 - DNA, 19 bp, Homo sapiens
ccggagggaaactgtgaat

SEQ ID NO: 4744298 - DNA, 19 bp, Homo sapiens
ccggcgccctctgtcctga

SEQ ID NO: 4744299 - DNA, 12 bp, Homo sapiens
ccggctccaggc

SEQ ID NO: 4744300 - DNA, 18 bp, Homo sapiens
ccggctggcctggcccct

SEQ ID NO: 4744301 - DNA, 18 bp, Homo sapiens
ccgggaccccgagcctgg

SEQ ID NO: 4744302 - DNA, 20 bp, Homo sapiens
ccgggcactcagaagacact

SEQ ID NO: 4744303 - DNA, 15 bp, Homo sapiens
ccgggccctgggccc

SEQ ID NO: 4744304 - DNA, 21 bp, Homo sapiens
ccgggctcagggaccacagca

SEQ ID NO: 4744305 - DNA, 14 bp, Homo sapiens
ccgggctctgcctc

SEQ ID NO: 4744306 - DNA, 22 bp, Homo sapiens
ccgggctctgcctcccatcacc

SEQ ID NO: 4744307 - DNA, 23 bp, Homo sapiens
ccggggaggagagagcagcttct

SEQ ID NO: 4744308 - DNA, 14 bp, Homo sapiens
ccgtaatttaactt

SEQ ID NO: 4744309 - DNA, 18 bp, Homo sapiens
ccgtatgaagacagaggc

SEQ ID NO: 4744310 - DNA, 14 bp, Homo sapiens
ccgtccccctctgg

SEQ ID NO: 4744311 - DNA, 12 bp, Homo sapiens
ccgtcctgaggg

SEQ ID NO: 4744312 - DNA, 16 bp, Homo sapiens
ccgtcctgagggggaa

SEQ ID NO: 4744313 - DNA, 20 bp, Homo sapiens
ccgtcctgagggggaagtga

SEQ ID NO: 4744314 - DNA, 15 bp, Homo sapiens
ccgtggaccacctag

SEQ ID NO: 4744315 - DNA, 21 bp, Homo sapiens
ccgtggccccagcctggccca

SEQ ID NO: 4744316 - DNA, 22 bp, Homo sapiens
ccgtggccccagcctggcccag

SEQ ID NO: 4744317 - DNA, 14 bp, Homo sapiens
ccgtggtcctttgg

SEQ ID NO: 4744318 - DNA, 18 bp, Homo sapiens
ccgttgtctccctggccc

SEQ ID NO: 4744319 - DNA, 19 bp, Homo sapiens
ccgttgtctccctggccct

SEQ ID NO: 4744320 - DNA, 20 bp, Homo sapiens
ccgttgtctccctggccctc

SEQ ID NO: 4744321 - DNA, 23 bp, Homo sapiens
ccgtttcctttcatttactgtgg

SEQ ID NO: 4744322 - DNA, 15 bp, Homo sapiens
cctaaaattcagtgg

SEQ ID NO: 4744323 - DNA, 14 bp, Homo sapiens
cctaaaatttgccc

SEQ ID NO: 4744324 - DNA, 14 bp, Homo sapiens
cctaaaccctctgt

SEQ ID NO: 4744325 - DNA, 15 bp, Homo sapiens
cctaaaccctctgtg

SEQ ID NO: 4744326 - DNA, 15 bp, Homo sapiens
cctaaattatttact

SEQ ID NO: 4744327 - DNA, 17 bp, Homo sapiens
cctaattccacagctgc

SEQ ID NO: 4744328 - DNA, 24 bp, Homo sapiens
cctaattgtatgttagaataattt

SEQ ID NO: 4744329 - DNA, 18 bp, Homo sapiens
cctacaggagtgagcact

SEQ ID NO: 4744330 - DNA, 20 bp, Homo sapiens
cctacagtgtacagtcttgt

SEQ ID NO: 4744331 - DNA, 20 bp, Homo sapiens
cctacagttttaactgtgga

SEQ ID NO: 4744332 - DNA, 13 bp, Homo sapiens
cctaccactgtct

SEQ ID NO: 4744333 - DNA, 17 bp, Homo sapiens
cctaccccaattccttg

SEQ ID NO: 4744334 - DNA, 19 bp, Homo sapiens
cctaccccaattccttgta

SEQ ID NO: 4744335 - DNA, 12 bp, Homo sapiens
cctacttctcca

SEQ ID NO: 4744336 - DNA, 14 bp, Homo sapiens
cctacttctccagc

SEQ ID NO: 4744337 - DNA, 13 bp, Homo sapiens
cctagaagggcta

SEQ ID NO: 4744338 - DNA, 23 bp, Homo sapiens
cctagaggtactttccacttgat

SEQ ID NO: 4744339 - DNA, 21 bp, Homo sapiens
cctagccccttagcccccacc

SEQ ID NO: 4744340 - DNA, 16 bp, Homo sapiens
cctagctgtgtgaata

SEQ ID NO: 4744341 - DNA, 22 bp, Homo sapiens
cctaggcaggacatgctgaagc

SEQ ID NO: 4744342 - DNA, 23 bp, Homo sapiens
cctagggaagggtggtggagcca

SEQ ID NO: 4744343 - DNA, 13 bp, Homo sapiens
cctaggtgacaga

SEQ ID NO: 4744344 - DNA, 23 bp, Homo sapiens
cctagtctgtgtggcaaattaaa

SEQ ID NO: 4744345 - DNA, 22 bp, Homo sapiens
cctagtgaaggcttctctctgt

SEQ ID NO: 4744346 - DNA, 16 bp, Homo sapiens
cctagtggctgtccag

SEQ ID NO: 4744347 - DNA, 21 bp, Homo sapiens
cctagttccaccatcaagcca

SEQ ID NO: 4744348 - DNA, 15 bp, Homo sapiens
cctatattggctaaa

SEQ ID NO: 4744349 - DNA, 16 bp, Homo sapiens
cctatctgacttcata

SEQ ID NO: 4744350 - DNA, 13 bp, Homo sapiens
cctatctttgcca

SEQ ID NO: 4744351 - DNA, 15 bp, Homo sapiens
cctcaaacactgcag

SEQ ID NO: 4744352 - DNA, 15 bp, Homo sapiens
cctcaacctcctggg

SEQ ID NO: 4744353 - DNA, 15 bp, Homo sapiens
cctcaaggcctccca

SEQ ID NO: 4744354 - DNA, 16 bp, Homo sapiens
cctcaaggcctcccac

SEQ ID NO: 4744355 - DNA, 16 bp, Homo sapiens
cctcaagttccagtgc

SEQ ID NO: 4744356 - DNA, 17 bp, Homo sapiens
cctcaagttccagtgca

SEQ ID NO: 4744357 - DNA, 18 bp, Homo sapiens
cctcaagttccagtgcag

SEQ ID NO: 4744358 - DNA, 18 bp, Homo sapiens
cctcaataagccttgtcg

SEQ ID NO: 4744359 - DNA, 13 bp, Homo sapiens
cctcacactggga

SEQ ID NO: 4744360 - DNA, 15 bp, Homo sapiens
cctcacactgggact

SEQ ID NO: 4744361 - DNA, 23 bp, Homo sapiens
cctcacagtccttaccagcagag

SEQ ID NO: 4744362 - DNA, 15 bp, Homo sapiens
cctcacccctggttc

SEQ ID NO: 4744363 - DNA, 20 bp, Homo sapiens
cctcacccctggttctcatc

SEQ ID NO: 4744364 - DNA, 22 bp, Homo sapiens
cctcacccctggttctcatctt

SEQ ID NO: 4744365 - DNA, 14 bp, Homo sapiens
cctcaccctggggc

SEQ ID NO: 4744366 - DNA, 22 bp, Homo sapiens
cctcactactacatctgtgatg

SEQ ID NO: 4744367 - DNA, 21 bp, Homo sapiens
cctcactatcccggctgccct

SEQ ID NO: 4744368 - DNA, 21 bp, Homo sapiens
cctcactgggactttgtaaac

SEQ ID NO: 4744369 - DNA, 21 bp, Homo sapiens
cctcagaacaaagtgagacag

SEQ ID NO: 4744370 - DNA, 23 bp, Homo sapiens
cctcagaacaaagtgagacagtc

SEQ ID NO: 4744371 - DNA, 16 bp, Homo sapiens
cctcagacagccccct

SEQ ID NO: 4744372 - DNA, 20 bp, Homo sapiens
cctcagagacatcagccctt

SEQ ID NO: 4744373 - DNA, 17 bp, Homo sapiens
cctcagcatcctggcac

SEQ ID NO: 4744374 - DNA, 11 bp, Homo sapiens
cctcagcctcc

SEQ ID NO: 4744375 - DNA, 22 bp, Homo sapiens
cctcagcctcccaaagtgctgg

SEQ ID NO: 4744376 - DNA, 22 bp, Homo sapiens
cctcagcctcccgaatagctgg

SEQ ID NO: 4744377 - DNA, 13 bp, Homo sapiens
cctcagcctcctg

SEQ ID NO: 4744378 - DNA, 17 bp, Homo sapiens
cctcagctctcagttgc

SEQ ID NO: 4744379 - DNA, 15 bp, Homo sapiens
cctcagggtccctgg

SEQ ID NO: 4744380 - DNA, 22 bp, Homo sapiens
cctcagggtccctggtggcagc

SEQ ID NO: 4744381 - DNA, 21 bp, Homo sapiens
cctcaggtaatcgacctgcct

SEQ ID NO: 4744382 - DNA, 17 bp, Homo sapiens
cctcaggtgatccaccc

SEQ ID NO: 4744383 - DNA, 14 bp, Homo sapiens
cctcagtctccctc

SEQ ID NO: 4744384 - DNA, 22 bp, Homo sapiens
cctcatagccctcaccctgggg

SEQ ID NO: 4744385 - DNA, 22 bp, Homo sapiens
cctcatagtatggtggctgggt

SEQ ID NO: 4744386 - DNA, 14 bp, Homo sapiens
cctcatcaccaacg

SEQ ID NO: 4744387 - DNA, 23 bp, Homo sapiens
cctcatcaggagttccagtgctg

SEQ ID NO: 4744388 - DNA, 15 bp, Homo sapiens
cctcatccagggctc

SEQ ID NO: 4744389 - DNA, 13 bp, Homo sapiens
cctcatcctcata

SEQ ID NO: 4744390 - DNA, 17 bp, Homo sapiens
cctcatcttcttcacca

SEQ ID NO: 4744391 - DNA, 19 bp, Homo sapiens
cctcatggtgcatataaat

SEQ ID NO: 4744392 - DNA, 23 bp, Homo sapiens
cctcatttttgaatacaggcata

SEQ ID NO: 4744393 - DNA, 19 bp, Homo sapiens
cctccaacctggggggcag

SEQ ID NO: 4744394 - DNA, 17 bp, Homo sapiens
cctccaagaccttctcc

SEQ ID NO: 4744395 - DNA, 19 bp, Homo sapiens
cctccaagaccttctcctt

SEQ ID NO: 4744396 - DNA, 14 bp, Homo sapiens
cctccaagtcaggt

SEQ ID NO: 4744397 - DNA, 18 bp, Homo sapiens
cctccaagtccacagtgg

SEQ ID NO: 4744398 - DNA, 17 bp, Homo sapiens
cctccacacctgcggcc

SEQ ID NO: 4744399 - DNA, 14 bp, Homo sapiens
cctccacatcctcc

SEQ ID NO: 4744400 - DNA, 15 bp, Homo sapiens
cctccacatcctcca

SEQ ID NO: 4744401 - DNA, 16 bp, Homo sapiens
cctccacatcctccac

SEQ ID NO: 4744402 - DNA, 14 bp, Homo sapiens
cctccacccacagt

SEQ ID NO: 4744403 - DNA, 18 bp, Homo sapiens
cctccacgttctgctcat

SEQ ID NO: 4744404 - DNA, 21 bp, Homo sapiens
cctccacgttctgctcatcat

SEQ ID NO: 4744405 - DNA, 14 bp, Homo sapiens
cctccactcccact

SEQ ID NO: 4744406 - DNA, 15 bp, Homo sapiens
cctccactcccactt

SEQ ID NO: 4744407 - DNA, 14 bp, Homo sapiens
cctccactctcccc

SEQ ID NO: 4744408 - DNA, 17 bp, Homo sapiens
cctccagggctggactg

SEQ ID NO: 4744409 - DNA, 20 bp, Homo sapiens
cctccagggctggactgagg

SEQ ID NO: 4744410 - DNA, 22 bp, Homo sapiens
cctccagggctggactgaggcc

SEQ ID NO: 4744411 - DNA, 23 bp, Homo sapiens
cctccagggctggactgaggcct

SEQ ID NO: 4744412 - DNA, 12 bp, Homo sapiens
cctccaggtgca

SEQ ID NO: 4744413 - DNA, 19 bp, Homo sapiens
cctccatgggggctcagcc

SEQ ID NO: 4744414 - DNA, 21 bp, Homo sapiens
cctccatgggggctcagccag

SEQ ID NO: 4744415 - DNA, 22 bp, Homo sapiens
cctccatgggggctcagccagg

SEQ ID NO: 4744416 - DNA, 12 bp, Homo sapiens
cctccatgtggg

SEQ ID NO: 4744417 - DNA, 23 bp, Homo sapiens
cctccatgtgggctagttgggct

SEQ ID NO: 4744418 - DNA, 15 bp, Homo sapiens
cctcccaactcaccc

SEQ ID NO: 4744419 - DNA, 23 bp, Homo sapiens
cctcccaactcaccccagcccca

SEQ ID NO: 4744420 - DNA, 13 bp, Homo sapiens
cctcccacagtga

SEQ ID NO: 4744421 - DNA, 23 bp, Homo sapiens
cctcccacagtgactcgggctcc

SEQ ID NO: 4744422 - DNA, 16 bp, Homo sapiens
cctcccagctgacagt

SEQ ID NO: 4744423 - DNA, 19 bp, Homo sapiens
cctcccagctgacagtcct

SEQ ID NO: 4744424 - DNA, 17 bp, Homo sapiens
cctcccatcacccgcta

SEQ ID NO: 4744425 - DNA, 19 bp, Homo sapiens
cctccccccaatccctcaa

SEQ ID NO: 4744426 - DNA, 14 bp, Homo sapiens
cctccccctgtccc

SEQ ID NO: 4744427 - DNA, 16 bp, Homo sapiens
cctccccgcccttttt

SEQ ID NO: 4744428 - DNA, 13 bp, Homo sapiens
cctcccctcccgt

SEQ ID NO: 4744429 - DNA, 18 bp, Homo sapiens
cctcccctgccagggcag

SEQ ID NO: 4744430 - DNA, 13 bp, Homo sapiens
cctcccctgggga

SEQ ID NO: 4744431 - DNA, 14 bp, Homo sapiens
cctcccctggggac

SEQ ID NO: 4744432 - DNA, 23 bp, Homo sapiens
cctcccctggggacagcaagggc

SEQ ID NO: 4744433 - DNA, 19 bp, Homo sapiens
cctcccgaatagctgggac

SEQ ID NO: 4744434 - DNA, 17 bp, Homo sapiens
cctcccgagtagctggg

SEQ ID NO: 4744435 - DNA, 19 bp, Homo sapiens
cctcccgagtagctgggac

SEQ ID NO: 4744436 - DNA, 15 bp, Homo sapiens
cctccctgctgtccc

SEQ ID NO: 4744437 - DNA, 16 bp, Homo sapiens
cctccctttttccttg

SEQ ID NO: 4744438 - DNA, 19 bp, Homo sapiens
cctccctttttccttgtcc

SEQ ID NO: 4744439 - DNA, 16 bp, Homo sapiens
cctccgcctcccgggt

SEQ ID NO: 4744440 - DNA, 18 bp, Homo sapiens
cctccgggacctggtgct

SEQ ID NO: 4744441 - DNA, 17 bp, Homo sapiens
cctcctacccctcccag

SEQ ID NO: 4744442 - DNA, 13 bp, Homo sapiens
cctcctccaggga

SEQ ID NO: 4744443 - DNA, 17 bp, Homo sapiens
cctcctccctttttcct

SEQ ID NO: 4744444 - DNA, 22 bp, Homo sapiens
cctcctccctttttccttgtcc

SEQ ID NO: 4744445 - DNA, 16 bp, Homo sapiens
cctcctctctgcccta

SEQ ID NO: 4744446 - DNA, 17 bp, Homo sapiens
cctcctgctgcagaggg

SEQ ID NO: 4744447 - DNA, 12 bp, Homo sapiens
cctcctggccag

SEQ ID NO: 4744448 - DNA, 21 bp, Homo sapiens
cctcctgggccctctctgctc

SEQ ID NO: 4744449 - DNA, 15 bp, Homo sapiens
cctcctgtgtgtgcg

SEQ ID NO: 4744450 - DNA, 15 bp, Homo sapiens
cctccttctctgtct

SEQ ID NO: 4744451 - DNA, 17 bp, Homo sapiens
cctccttctctgtctca

SEQ ID NO: 4744452 - DNA, 21 bp, Homo sapiens
cctcctttctcttctctgttc

SEQ ID NO: 4744453 - DNA, 20 bp, Homo sapiens
cctcctttgtgaggaagccg

SEQ ID NO: 4744454 - DNA, 15 bp, Homo sapiens
cctcgaactggctgc

SEQ ID NO: 4744455 - DNA, 15 bp, Homo sapiens
cctcgatgtcctcct

SEQ ID NO: 4744456 - DNA, 17 bp, Homo sapiens
cctcgatgtcctcctct

SEQ ID NO: 4744457 - DNA, 23 bp, Homo sapiens
cctcgatgtcctcctctgtgaaa

SEQ ID NO: 4744458 - DNA, 13 bp, Homo sapiens
cctcgcccaccgc

SEQ ID NO: 4744459 - DNA, 20 bp, Homo sapiens
cctcgcccatcagtgccagc

SEQ ID NO: 4744460 - DNA, 18 bp, Homo sapiens
cctcgcctggcctgaggt

SEQ ID NO: 4744461 - DNA, 20 bp, Homo sapiens
cctcggacttagctgggaga

SEQ ID NO: 4744462 - DNA, 14 bp, Homo sapiens
cctcggctcctgct

SEQ ID NO: 4744463 - DNA, 15 bp, Homo sapiens
cctcggctcctgctg

SEQ ID NO: 4744464 - DNA, 16 bp, Homo sapiens
cctcggctcctgctgc

SEQ ID NO: 4744465 - DNA, 13 bp, Homo sapiens
cctcgtgccagtc

SEQ ID NO: 4744466 - DNA, 14 bp, Homo sapiens
cctcgtgccagtcg

SEQ ID NO: 4744467 - DNA, 24 bp, Homo sapiens
cctctacagagcttccctgactca

SEQ ID NO: 4744468 - DNA, 18 bp, Homo sapiens
cctctagggacccctcct

SEQ ID NO: 4744469 - DNA, 14 bp, Homo sapiens
cctctatttcttta

SEQ ID NO: 4744470 - DNA, 22 bp, Homo sapiens
cctctcagagctacttgggcca

SEQ ID NO: 4744471 - DNA, 16 bp, Homo sapiens
cctctcaggctgtccc

SEQ ID NO: 4744472 - DNA, 18 bp, Homo sapiens
cctctcaggtgaccaaaa

SEQ ID NO: 4744473 - DNA, 20 bp, Homo sapiens
cctctccccagcaagtgaga

SEQ ID NO: 4744474 - DNA, 23 bp, Homo sapiens
cctctcccctaccactgtcttct

SEQ ID NO: 4744475 - DNA, 13 bp, Homo sapiens
cctctcccctgcc

SEQ ID NO: 4744476 - DNA, 22 bp, Homo sapiens
cctctcccctgccccctgcagg

SEQ ID NO: 4744477 - DNA, 17 bp, Homo sapiens
cctctccctcctggcca

SEQ ID NO: 4744478 - DNA, 18 bp, Homo sapiens
cctctccctcctggccag

SEQ ID NO: 4744479 - DNA, 22 bp, Homo sapiens
cctctccgcacacctctggctg

SEQ ID NO: 4744480 - DNA, 21 bp, Homo sapiens
cctctccttgtggcctgggcc

SEQ ID NO: 4744481 - DNA, 12 bp, Homo sapiens
cctctctcactc

SEQ ID NO: 4744482 - DNA, 17 bp, Homo sapiens
cctctctcactccttga

SEQ ID NO: 4744483 - DNA, 16 bp, Homo sapiens
cctctcttataattcc

SEQ ID NO: 4744484 - DNA, 22 bp, Homo sapiens
cctctcttgtgagccatagaga

SEQ ID NO: 4744485 - DNA, 18 bp, Homo sapiens
cctctgacacacagctct

SEQ ID NO: 4744486 - DNA, 17 bp, Homo sapiens
cctctgactcagggctc

SEQ ID NO: 4744487 - DNA, 22 bp, Homo sapiens
cctctgactcagggctcctggg

SEQ ID NO: 4744488 - DNA, 12 bp, Homo sapiens
cctctgagcctt

SEQ ID NO: 4744489 - DNA, 15 bp, Homo sapiens
cctctgcactcccct

SEQ ID NO: 4744490 - DNA, 21 bp, Homo sapiens
cctctgcactcccctgctggg

SEQ ID NO: 4744491 - DNA, 19 bp, Homo sapiens
cctctgcccactccctgca

SEQ ID NO: 4744492 - DNA, 14 bp, Homo sapiens
cctctgccctgcgg

SEQ ID NO: 4744493 - DNA, 11 bp, Homo sapiens
cctctgcctga

SEQ ID NO: 4744494 - DNA, 20 bp, Homo sapiens
cctctgcctgaagtcacaca

SEQ ID NO: 4744495 - DNA, 14 bp, Homo sapiens
cctctgctgctggc

SEQ ID NO: 4744496 - DNA, 17 bp, Homo sapiens
cctctggctccagctgg

SEQ ID NO: 4744497 - DNA, 18 bp, Homo sapiens
cctctgtacagagcccac

SEQ ID NO: 4744498 - DNA, 14 bp, Homo sapiens
cctctgtccccttc

SEQ ID NO: 4744499 - DNA, 18 bp, Homo sapiens
cctctgtccccttctctc

SEQ ID NO: 4744500 - DNA, 16 bp, Homo sapiens
cctctgtcctgacttc

SEQ ID NO: 4744501 - DNA, 18 bp, Homo sapiens
cctctgtgaaatttgtaa

SEQ ID NO: 4744502 - DNA, 21 bp, Homo sapiens
cctctgtgaccaatgtcttga

SEQ ID NO: 4744503 - DNA, 18 bp, Homo sapiens
cctctgtgtcactggctg

SEQ ID NO: 4744504 - DNA, 19 bp, Homo sapiens
cctctgtgtcactggctgc

SEQ ID NO: 4744505 - DNA, 21 bp, Homo sapiens
cctctgtgtcactggctgcct

SEQ ID NO: 4744506 - DNA, 23 bp, Homo sapiens
cctctgtgtcactggctgcctcc

SEQ ID NO: 4744507 - DNA, 21 bp, Homo sapiens
cctctgtttgacaaacctcta

SEQ ID NO: 4744508 - DNA, 16 bp, Homo sapiens
cctcttcagaggccct

SEQ ID NO: 4744509 - DNA, 13 bp, Homo sapiens
cctcttctgggag

SEQ ID NO: 4744510 - DNA, 21 bp, Homo sapiens
cctcttctgggagggcagcag

SEQ ID NO: 4744511 - DNA, 12 bp, Homo sapiens
cctcttgcccca

SEQ ID NO: 4744512 - DNA, 22 bp, Homo sapiens
cctcttgccccaacccccagca

SEQ ID NO: 4744513 - DNA, 22 bp, Homo sapiens
cctcttttcacattttttttct

SEQ ID NO: 4744514 - DNA, 14 bp, Homo sapiens
cctgaactctgcaa

SEQ ID NO: 4744515 - DNA, 13 bp, Homo sapiens
cctgaagacccca

SEQ ID NO: 4744516 - DNA, 14 bp, Homo sapiens
cctgaagaccccag

SEQ ID NO: 4744517 - DNA, 15 bp, Homo sapiens
cctgaagaccccaga

SEQ ID NO: 4744518 - DNA, 13 bp, Homo sapiens
cctgaagagcatt

SEQ ID NO: 4744519 - DNA, 20 bp, Homo sapiens
cctgaaggccccgcccaggc

SEQ ID NO: 4744520 - DNA, 15 bp, Homo sapiens
cctgaagtcacacag

SEQ ID NO: 4744521 - DNA, 17 bp, Homo sapiens
cctgaagtcacacagtg

SEQ ID NO: 4744522 - DNA, 20 bp, Homo sapiens
cctgaagtcacacagtgagt

SEQ ID NO: 4744523 - DNA, 12 bp, Homo sapiens
cctgacaacact

SEQ ID NO: 4744524 - DNA, 15 bp, Homo sapiens
cctgacaacagcctg

SEQ ID NO: 4744525 - DNA, 18 bp, Homo sapiens
cctgacaacagcctgaga

SEQ ID NO: 4744526 - DNA, 20 bp, Homo sapiens
cctgacaacagcctgagaaa

SEQ ID NO: 4744527 - DNA, 13 bp, Homo sapiens
cctgactcattct

SEQ ID NO: 4744528 - DNA, 14 bp, Homo sapiens
cctgactccttctg

SEQ ID NO: 4744529 - DNA, 20 bp, Homo sapiens
cctgacttcaggggctgccc

SEQ ID NO: 4744530 - DNA, 21 bp, Homo sapiens
cctgacttcaggggctgcccg

SEQ ID NO: 4744531 - DNA, 12 bp, Homo sapiens
cctgagaatgac

SEQ ID NO: 4744532 - DNA, 17 bp, Homo sapiens
cctgagatttcatctgc

SEQ ID NO: 4744533 - DNA, 18 bp, Homo sapiens
cctgagatttcatctgct

SEQ ID NO: 4744534 - DNA, 15 bp, Homo sapiens
cctgagcccctcaga

SEQ ID NO: 4744535 - DNA, 21 bp, Homo sapiens
cctgagcgctcctgccgcaga

SEQ ID NO: 4744536 - DNA, 18 bp, Homo sapiens
cctgagctagaagctgga

SEQ ID NO: 4744537 - DNA, 15 bp, Homo sapiens
cctgagctgggatga

SEQ ID NO: 4744538 - DNA, 12 bp, Homo sapiens
cctgaggcccag

SEQ ID NO: 4744539 - DNA, 14 bp, Homo sapiens
cctgaggcccagag

SEQ ID NO: 4744540 - DNA, 17 bp, Homo sapiens
cctgaggcccagagggc

SEQ ID NO: 4744541 - DNA, 18 bp, Homo sapiens
cctgaggcccagagggcc

SEQ ID NO: 4744542 - DNA, 16 bp, Homo sapiens
cctgaggcccttctct

SEQ ID NO: 4744543 - DNA, 23 bp, Homo sapiens
cctgaggcccttctctccagccc

SEQ ID NO: 4744544 - DNA, 21 bp, Homo sapiens
cctgaggctgggctcccttcc

SEQ ID NO: 4744545 - DNA, 15 bp, Homo sapiens
cctgagggggaagtg

SEQ ID NO: 4744546 - DNA, 16 bp, Homo sapiens
cctgagggggaagtga

SEQ ID NO: 4744547 - DNA, 16 bp, Homo sapiens
cctgaggtctcgctga

SEQ ID NO: 4744548 - DNA, 15 bp, Homo sapiens
cctgagtgcctggcc

SEQ ID NO: 4744549 - DNA, 17 bp, Homo sapiens
cctgataacaacctgga

SEQ ID NO: 4744550 - DNA, 13 bp, Homo sapiens
cctgatgaaaata

SEQ ID NO: 4744551 - DNA, 13 bp, Homo sapiens
cctgatgattttt

SEQ ID NO: 4744552 - DNA, 17 bp, Homo sapiens
cctgattgccaagctca

SEQ ID NO: 4744553 - DNA, 15 bp, Homo sapiens
cctgattgtgtctct

SEQ ID NO: 4744554 - DNA, 17 bp, Homo sapiens
cctgcaaaaggactctc

SEQ ID NO: 4744555 - DNA, 15 bp, Homo sapiens
cctgcaaagcccagc

SEQ ID NO: 4744556 - DNA, 16 bp, Homo sapiens
cctgcaaagcccagct

SEQ ID NO: 4744557 - DNA, 17 bp, Homo sapiens
cctgcaaagcccagctt

SEQ ID NO: 4744558 - DNA, 15 bp, Homo sapiens
cctgcactgtcctgc

SEQ ID NO: 4744559 - DNA, 16 bp, Homo sapiens
cctgcactgtcctgct

SEQ ID NO: 4744560 - DNA, 17 bp, Homo sapiens
cctgcactgtcctgctc

SEQ ID NO: 4744561 - DNA, 17 bp, Homo sapiens
cctgcacttgcagactc

SEQ ID NO: 4744562 - DNA, 22 bp, Homo sapiens
cctgcacttgcagactctacag

SEQ ID NO: 4744563 - DNA, 13 bp, Homo sapiens
cctgcaggaagga

SEQ ID NO: 4744564 - DNA, 19 bp, Homo sapiens
cctgcaggaaggagctgcc

SEQ ID NO: 4744565 - DNA, 12 bp, Homo sapiens
cctgcaggcagc

SEQ ID NO: 4744566 - DNA, 13 bp, Homo sapiens
cctgcaggcagcc

SEQ ID NO: 4744567 - DNA, 18 bp, Homo sapiens
cctgcaggcagccaggcc

SEQ ID NO: 4744568 - DNA, 19 bp, Homo sapiens
cctgcaggcagccaggcca

SEQ ID NO: 4744569 - DNA, 20 bp, Homo sapiens
cctgcaggcagccaggccac

SEQ ID NO: 4744570 - DNA, 21 bp, Homo sapiens
cctgcaggcagccaggccaca

SEQ ID NO: 4744571 - DNA, 23 bp, Homo sapiens
cctgcaggcagccaggccacaag

SEQ ID NO: 4744572 - DNA, 16 bp, Homo sapiens
cctgcattggaactgg

SEQ ID NO: 4744573 - DNA, 23 bp, Homo sapiens
cctgcattggaactggaggcagg

SEQ ID NO: 4744574 - DNA, 19 bp, Homo sapiens
cctgccaatggactaactt

SEQ ID NO: 4744575 - DNA, 12 bp, Homo sapiens
cctgccaccctg

SEQ ID NO: 4744576 - DNA, 16 bp, Homo sapiens
cctgccacctcctgcc

SEQ ID NO: 4744577 - DNA, 15 bp, Homo sapiens
cctgccacctggacc

SEQ ID NO: 4744578 - DNA, 22 bp, Homo sapiens
cctgccacctggacccctgcat

SEQ ID NO: 4744579 - DNA, 17 bp, Homo sapiens
cctgccagggcagggcc

SEQ ID NO: 4744580 - DNA, 13 bp, Homo sapiens
cctgcccaggccc

SEQ ID NO: 4744581 - DNA, 15 bp, Homo sapiens
cctgcccaggcccct

SEQ ID NO: 4744582 - DNA, 16 bp, Homo sapiens
cctgcccagttgcact

SEQ ID NO: 4744583 - DNA, 16 bp, Homo sapiens
cctgcccccaggactg

SEQ ID NO: 4744584 - DNA, 18 bp, Homo sapiens
cctgcccccaggactggg

SEQ ID NO: 4744585 - DNA, 20 bp, Homo sapiens
cctgccccctgcaggaagga

SEQ ID NO: 4744586 - DNA, 18 bp, Homo sapiens
cctgccccgcaggcctgc

SEQ ID NO: 4744587 - DNA, 21 bp, Homo sapiens
cctgccccgcaggcctgcctt

SEQ ID NO: 4744588 - DNA, 18 bp, Homo sapiens
cctgcccctcctctctgc

SEQ ID NO: 4744589 - DNA, 19 bp, Homo sapiens
cctgcccctcctctctgcc

SEQ ID NO: 4744590 - DNA, 21 bp, Homo sapiens
cctgcccctcctctctgccct

SEQ ID NO: 4744591 - DNA, 22 bp, Homo sapiens
cctgcccctcctctctgcccta

SEQ ID NO: 4744592 - DNA, 14 bp, Homo sapiens
cctgccctgggagg

SEQ ID NO: 4744593 - DNA, 22 bp, Homo sapiens
cctgccctgggaggcagtgatg

SEQ ID NO: 4744594 - DNA, 14 bp, Homo sapiens
cctgccctggtttc

SEQ ID NO: 4744595 - DNA, 20 bp, Homo sapiens
cctgccctggtttcctgccc

SEQ ID NO: 4744596 - DNA, 21 bp, Homo sapiens
cctgccctggtttcctgccct

SEQ ID NO: 4744597 - DNA, 22 bp, Homo sapiens
cctgccctggtttcctgccctg

SEQ ID NO: 4744598 - DNA, 23 bp, Homo sapiens
cctgccctggtttcctgccctgg

SEQ ID NO: 4744599 - DNA, 19 bp, Homo sapiens
cctgcccttgctccagcct

SEQ ID NO: 4744600 - DNA, 14 bp, Homo sapiens
cctgccgcagagct

SEQ ID NO: 4744601 - DNA, 15 bp, Homo sapiens
cctgccgcagagctg

SEQ ID NO: 4744602 - DNA, 16 bp, Homo sapiens
cctgccgcagagctgg

SEQ ID NO: 4744603 - DNA, 13 bp, Homo sapiens
cctgcctcagcct

SEQ ID NO: 4744604 - DNA, 15 bp, Homo sapiens
cctgcctcagcctcc

SEQ ID NO: 4744605 - DNA, 16 bp, Homo sapiens
cctgcctcagcctccc

SEQ ID NO: 4744606 - DNA, 21 bp, Homo sapiens
cctgcctccagggctggactg

SEQ ID NO: 4744607 - DNA, 15 bp, Homo sapiens
cctgcctcctttgtg

SEQ ID NO: 4744608 - DNA, 19 bp, Homo sapiens
cctgcctcctttgtgagga

SEQ ID NO: 4744609 - DNA, 23 bp, Homo sapiens
cctgcctcctttgtgaggaagcc

SEQ ID NO: 4744610 - DNA, 19 bp, Homo sapiens
cctgcctcgaactggctgc

SEQ ID NO: 4744611 - DNA, 14 bp, Homo sapiens
cctgccttcctcct

SEQ ID NO: 4744612 - DNA, 22 bp, Homo sapiens
cctgccttcctcctgggccctc

SEQ ID NO: 4744613 - DNA, 18 bp, Homo sapiens
cctgcgggtcacaggagg

SEQ ID NO: 4744614 - DNA, 21 bp, Homo sapiens
cctgctaattccccagattgc

SEQ ID NO: 4744615 - DNA, 14 bp, Homo sapiens
cctgctcacatctg

SEQ ID NO: 4744616 - DNA, 18 bp, Homo sapiens
cctgctgcaccaacccag

SEQ ID NO: 4744617 - DNA, 20 bp, Homo sapiens
cctgctgcaccaacccagcc

SEQ ID NO: 4744618 - DNA, 14 bp, Homo sapiens
cctgctgcagaggg

SEQ ID NO: 4744619 - DNA, 18 bp, Homo sapiens
cctgctgcagaggggcag

SEQ ID NO: 4744620 - DNA, 16 bp, Homo sapiens
cctgctgcagttgcca

SEQ ID NO: 4744621 - DNA, 19 bp, Homo sapiens
cctgctgcccctccctgcc

SEQ ID NO: 4744622 - DNA, 15 bp, Homo sapiens
cctgctgctgcctgc

SEQ ID NO: 4744623 - DNA, 19 bp, Homo sapiens
cctgctggctggtgcctga

SEQ ID NO: 4744624 - DNA, 12 bp, Homo sapiens
cctgctgggtgt

SEQ ID NO: 4744625 - DNA, 19 bp, Homo sapiens
cctgctggttcagggttgg

SEQ ID NO: 4744626 - DNA, 23 bp, Homo sapiens
cctggaaccaggcttgcctggga

SEQ ID NO: 4744627 - DNA, 14 bp, Homo sapiens
cctggaagacagag

SEQ ID NO: 4744628 - DNA, 15 bp, Homo sapiens
cctggaagacagaga

SEQ ID NO: 4744629 - DNA, 20 bp, Homo sapiens
cctggaaggacatccatgtt

SEQ ID NO: 4744630 - DNA, 13 bp, Homo sapiens
cctggaagggcta

SEQ ID NO: 4744631 - DNA, 24 bp, Homo sapiens
cctggaagggctagaacctgtaga

SEQ ID NO: 4744632 - DNA, 21 bp, Homo sapiens
cctggacatgaagattctttc

SEQ ID NO: 4744633 - DNA, 15 bp, Homo sapiens
cctggacccctgcat

SEQ ID NO: 4744634 - DNA, 18 bp, Homo sapiens
cctggagactgcccagct

SEQ ID NO: 4744635 - DNA, 14 bp, Homo sapiens
cctggagagccaga

SEQ ID NO: 4744636 - DNA, 19 bp, Homo sapiens
cctggagagctagaaccta

SEQ ID NO: 4744637 - DNA, 22 bp, Homo sapiens
cctggagagctagaacctggag

SEQ ID NO: 4744638 - DNA, 21 bp, Homo sapiens
cctggagggaatgaacctgga

SEQ ID NO: 4744639 - DNA, 19 bp, Homo sapiens
cctggagggctagaaccta

SEQ ID NO: 4744640 - DNA, 21 bp, Homo sapiens
cctggagggctagaacctgga

SEQ ID NO: 4744641 - DNA, 22 bp, Homo sapiens
cctggagggctagaacctggag

SEQ ID NO: 4744642 - DNA, 17 bp, Homo sapiens
cctggatggggctgcac

SEQ ID NO: 4744643 - DNA, 23 bp, Homo sapiens
cctggcaagctagaacctggagg

SEQ ID NO: 4744644 - DNA, 21 bp, Homo sapiens
cctggcacagtgtctgggctg

SEQ ID NO: 4744645 - DNA, 22 bp, Homo sapiens
cctggcacccggcccctgctgg

SEQ ID NO: 4744646 - DNA, 17 bp, Homo sapiens
cctggcccatcagtgta

SEQ ID NO: 4744647 - DNA, 20 bp, Homo sapiens
cctggcccatcagtgtaccc

SEQ ID NO: 4744648 - DNA, 16 bp, Homo sapiens
cctggccccagcccta

SEQ ID NO: 4744649 - DNA, 21 bp, Homo sapiens
cctggcccctcagggtccctg

SEQ ID NO: 4744650 - DNA, 23 bp, Homo sapiens
cctggccctcaaggcctcccaca

SEQ ID NO: 4744651 - DNA, 14 bp, Homo sapiens
cctggcctctgcac

SEQ ID NO: 4744652 - DNA, 16 bp, Homo sapiens
cctggcctctgcactc

SEQ ID NO: 4744653 - DNA, 22 bp, Homo sapiens
cctggcctctgcactcccctgc

SEQ ID NO: 4744654 - DNA, 20 bp, Homo sapiens
cctggcctgagctgggatga

SEQ ID NO: 4744655 - DNA, 13 bp, Homo sapiens
cctggcgtcctct

SEQ ID NO: 4744656 - DNA, 19 bp, Homo sapiens
cctggctgaaggactgtga

SEQ ID NO: 4744657 - DNA, 20 bp, Homo sapiens
cctggctgaaggactgtgac

SEQ ID NO: 4744658 - DNA, 22 bp, Homo sapiens
cctgggagagacttggatgagg

SEQ ID NO: 4744659 - DNA, 16 bp, Homo sapiens
cctgggatccctcatc

SEQ ID NO: 4744660 - DNA, 14 bp, Homo sapiens
cctgggccctctct

SEQ ID NO: 4744661 - DNA, 18 bp, Homo sapiens
cctgggccctctctgctc

SEQ ID NO: 4744662 - DNA, 14 bp, Homo sapiens
cctgggctctgtgg

SEQ ID NO: 4744663 - DNA, 15 bp, Homo sapiens
cctgggctctgtggg

SEQ ID NO: 4744664 - DNA, 22 bp, Homo sapiens
cctgggctctgtgggctgcact

SEQ ID NO: 4744665 - DNA, 20 bp, Homo sapiens
cctgggctggcactgctggg

SEQ ID NO: 4744666 - DNA, 18 bp, Homo sapiens
cctggggaacctgacccc

SEQ ID NO: 4744667 - DNA, 15 bp, Homo sapiens
cctggggagaaagta

SEQ ID NO: 4744668 - DNA, 14 bp, Homo sapiens
cctggggctgctgg

SEQ ID NO: 4744669 - DNA, 14 bp, Homo sapiens
cctgggggtgccag

SEQ ID NO: 4744670 - DNA, 19 bp, Homo sapiens
cctgggttttgtattctct

SEQ ID NO: 4744671 - DNA, 21 bp, Homo sapiens
cctggtacaaacgtatggaat

SEQ ID NO: 4744672 - DNA, 15 bp, Homo sapiens
cctggtgctgcctct

SEQ ID NO: 4744673 - DNA, 12 bp, Homo sapiens
cctggtggcagc

SEQ ID NO: 4744674 - DNA, 14 bp, Homo sapiens
cctggtggcagctc

SEQ ID NO: 4744675 - DNA, 17 bp, Homo sapiens
cctggtggcagctcacc

SEQ ID NO: 4744676 - DNA, 19 bp, Homo sapiens
cctggtggcagctcacctc

SEQ ID NO: 4744677 - DNA, 22 bp, Homo sapiens
cctggtggcagctcacctctcc

SEQ ID NO: 4744678 - DNA, 14 bp, Homo sapiens
cctggttctcatct

SEQ ID NO: 4744679 - DNA, 21 bp, Homo sapiens
cctggttctgatgatgtgcct

SEQ ID NO: 4744680 - DNA, 15 bp, Homo sapiens
cctggtttcctgccc

SEQ ID NO: 4744681 - DNA, 16 bp, Homo sapiens
cctggtttcctgccct

SEQ ID NO: 4744682 - DNA, 19 bp, Homo sapiens
cctggtttcctgccctggg

SEQ ID NO: 4744683 - DNA, 21 bp, Homo sapiens
cctggtttcctgccctgggag

SEQ ID NO: 4744684 - DNA, 13 bp, Homo sapiens
cctgtcagtgccg

SEQ ID NO: 4744685 - DNA, 19 bp, Homo sapiens
cctgtcagtgccgccgcct

SEQ ID NO: 4744686 - DNA, 12 bp, Homo sapiens
cctgtccccctg

SEQ ID NO: 4744687 - DNA, 13 bp, Homo sapiens
cctgtccccctga

SEQ ID NO: 4744688 - DNA, 16 bp, Homo sapiens
cctgtccccctgacaa

SEQ ID NO: 4744689 - DNA, 20 bp, Homo sapiens
cctgtgatggggccctgcct

SEQ ID NO: 4744690 - DNA, 21 bp, Homo sapiens
cctgtgatggggccctgcctc

SEQ ID NO: 4744691 - DNA, 22 bp, Homo sapiens
cctgtgatggggccctgcctcc

SEQ ID NO: 4744692 - DNA, 12 bp, Homo sapiens
cctgtgatgtcc

SEQ ID NO: 4744693 - DNA, 18 bp, Homo sapiens
cctgtgcagccgctgagc

SEQ ID NO: 4744694 - DNA, 20 bp, Homo sapiens
cctgtgcagccgctgagcga

SEQ ID NO: 4744695 - DNA, 21 bp, Homo sapiens
cctgtgcagccgctgagcgag

SEQ ID NO: 4744696 - DNA, 17 bp, Homo sapiens
cctgtgtcttgcaatgg

SEQ ID NO: 4744697 - DNA, 16 bp, Homo sapiens
cctgtgtgatacaaga

SEQ ID NO: 4744698 - DNA, 21 bp, Homo sapiens
cctgttaacactgtaatatct

SEQ ID NO: 4744699 - DNA, 13 bp, Homo sapiens
cctgttctgtgac

SEQ ID NO: 4744700 - DNA, 20 bp, Homo sapiens
cctgttttagaaggttctct

SEQ ID NO: 4744701 - DNA, 22 bp, Homo sapiens
ccttaaagtcagtaacttaccc

SEQ ID NO: 4744702 - DNA, 21 bp, Homo sapiens
ccttacagtaggagcccagct

SEQ ID NO: 4744703 - DNA, 13 bp, Homo sapiens
ccttaccagcaga

SEQ ID NO: 4744704 - DNA, 17 bp, Homo sapiens
ccttaccagcagagcac

SEQ ID NO: 4744705 - DNA, 16 bp, Homo sapiens
ccttagacagtccctg

SEQ ID NO: 4744706 - DNA, 19 bp, Homo sapiens
ccttagacagtccctgcca

SEQ ID NO: 4744707 - DNA, 21 bp, Homo sapiens
ccttagacagtccctgccaat

SEQ ID NO: 4744708 - DNA, 20 bp, Homo sapiens
ccttagcagggaaacagcta

SEQ ID NO: 4744709 - DNA, 23 bp, Homo sapiens
ccttagcagggaaggctggtctc

SEQ ID NO: 4744710 - DNA, 18 bp, Homo sapiens
ccttagcccccacccact

SEQ ID NO: 4744711 - DNA, 13 bp, Homo sapiens
ccttatcaaagga

SEQ ID NO: 4744712 - DNA, 14 bp, Homo sapiens
ccttatcaaaggac

SEQ ID NO: 4744713 - DNA, 21 bp, Homo sapiens
ccttcaaaatgttctatttaa

SEQ ID NO: 4744714 - DNA, 20 bp, Homo sapiens
ccttcacctttgtccccacc

SEQ ID NO: 4744715 - DNA, 21 bp, Homo sapiens
ccttcacctttgtccccaccg

SEQ ID NO: 4744716 - DNA, 14 bp, Homo sapiens
ccttcacttaggaa

SEQ ID NO: 4744717 - DNA, 13 bp, Homo sapiens
ccttcagccctca

SEQ ID NO: 4744718 - DNA, 15 bp, Homo sapiens
ccttcagccctcacc

SEQ ID NO: 4744719 - DNA, 13 bp, Homo sapiens
ccttcatctggaa

SEQ ID NO: 4744720 - DNA, 14 bp, Homo sapiens
ccttcatctggaac

SEQ ID NO: 4744721 - DNA, 17 bp, Homo sapiens
ccttcatgacagcctcc

SEQ ID NO: 4744722 - DNA, 13 bp, Homo sapiens
ccttccacctcag

SEQ ID NO: 4744723 - DNA, 19 bp, Homo sapiens
ccttccacgtgtatgcaag

SEQ ID NO: 4744724 - DNA, 17 bp, Homo sapiens
ccttccactgagggcag

SEQ ID NO: 4744725 - DNA, 22 bp, Homo sapiens
ccttccaggggtgggacaccct

SEQ ID NO: 4744726 - DNA, 17 bp, Homo sapiens
ccttccatggactttgt

SEQ ID NO: 4744727 - DNA, 19 bp, Homo sapiens
ccttcccacctctctcact

SEQ ID NO: 4744728 - DNA, 12 bp, Homo sapiens
ccttcccagagg

SEQ ID NO: 4744729 - DNA, 17 bp, Homo sapiens
ccttcccagaggggcct

SEQ ID NO: 4744730 - DNA, 19 bp, Homo sapiens
ccttcccagaggggcctgc

SEQ ID NO: 4744731 - DNA, 20 bp, Homo sapiens
ccttcccagaggggcctgcc

SEQ ID NO: 4744732 - DNA, 23 bp, Homo sapiens
ccttcccatgacccaggctgggc

SEQ ID NO: 4744733 - DNA, 20 bp, Homo sapiens
ccttcctaattccacagctg

SEQ ID NO: 4744734 - DNA, 21 bp, Homo sapiens
ccttcctaattccacagctgc

SEQ ID NO: 4744735 - DNA, 13 bp, Homo sapiens
ccttcctcctggg

SEQ ID NO: 4744736 - DNA, 16 bp, Homo sapiens
ccttcctctgagcctt

SEQ ID NO: 4744737 - DNA, 20 bp, Homo sapiens
ccttcctctgagccttggga

SEQ ID NO: 4744738 - DNA, 14 bp, Homo sapiens
ccttccttgctaat

SEQ ID NO: 4744739 - DNA, 21 bp, Homo sapiens
ccttctcatcactcccctcca

SEQ ID NO: 4744740 - DNA, 14 bp, Homo sapiens
ccttctcccccccg

SEQ ID NO: 4744741 - DNA, 23 bp, Homo sapiens
ccttctcccccccggggctgggt

SEQ ID NO: 4744742 - DNA, 15 bp, Homo sapiens
ccttctctccagccc

SEQ ID NO: 4744743 - DNA, 16 bp, Homo sapiens
ccttctctccagcccc

SEQ ID NO: 4744744 - DNA, 20 bp, Homo sapiens
ccttctctccagcccctgga

SEQ ID NO: 4744745 - DNA, 21 bp, Homo sapiens
ccttctctccagcccctggat

SEQ ID NO: 4744746 - DNA, 23 bp, Homo sapiens
ccttctctccagcccctggatgc

SEQ ID NO: 4744747 - DNA, 19 bp, Homo sapiens
ccttctgaatgaagccttc

SEQ ID NO: 4744748 - DNA, 22 bp, Homo sapiens
ccttctgacccatgctgccctg

SEQ ID NO: 4744749 - DNA, 16 bp, Homo sapiens
ccttctgccagttccc

SEQ ID NO: 4744750 - DNA, 20 bp, Homo sapiens
ccttctttgataatgttaaa

SEQ ID NO: 4744751 - DNA, 21 bp, Homo sapiens
ccttctttgataatgttaaat

SEQ ID NO: 4744752 - DNA, 15 bp, Homo sapiens
ccttgaaaacactgt

SEQ ID NO: 4744753 - DNA, 19 bp, Homo sapiens
ccttgaaaacactgttctc

SEQ ID NO: 4744754 - DNA, 22 bp, Homo sapiens
ccttgaaaacactgttctctgc

SEQ ID NO: 4744755 - DNA, 14 bp, Homo sapiens
ccttgaactgggta

SEQ ID NO: 4744756 - DNA, 16 bp, Homo sapiens
ccttgaactgggtact

SEQ ID NO: 4744757 - DNA, 17 bp, Homo sapiens
ccttgaagtgactgttg

SEQ ID NO: 4744758 - DNA, 14 bp, Homo sapiens
ccttgacaaacttc

SEQ ID NO: 4744759 - DNA, 18 bp, Homo sapiens
ccttgacagggcacaccg

SEQ ID NO: 4744760 - DNA, 15 bp, Homo sapiens
ccttgaccaggcctg

SEQ ID NO: 4744761 - DNA, 20 bp, Homo sapiens
ccttgaccattctccacctg

SEQ ID NO: 4744762 - DNA, 16 bp, Homo sapiens
ccttgagagaccaggc

SEQ ID NO: 4744763 - DNA, 21 bp, Homo sapiens
ccttgagagaccaggcaaagc

SEQ ID NO: 4744764 - DNA, 13 bp, Homo sapiens
ccttgaggagaag

SEQ ID NO: 4744765 - DNA, 19 bp, Homo sapiens
ccttgccaaagcacttaca

SEQ ID NO: 4744766 - DNA, 15 bp, Homo sapiens
ccttgccctttccat

SEQ ID NO: 4744767 - DNA, 17 bp, Homo sapiens
ccttgccgtctacctga

SEQ ID NO: 4744768 - DNA, 14 bp, Homo sapiens
ccttgctccagcct

SEQ ID NO: 4744769 - DNA, 22 bp, Homo sapiens
ccttgctttacaaaccaaccat

SEQ ID NO: 4744770 - DNA, 22 bp, Homo sapiens
ccttggaagttgcatggcatca

SEQ ID NO: 4744771 - DNA, 16 bp, Homo sapiens
ccttggacattttatg

SEQ ID NO: 4744772 - DNA, 15 bp, Homo sapiens
ccttggattgtcccc

SEQ ID NO: 4744773 - DNA, 19 bp, Homo sapiens
ccttggattgtccccgacc

SEQ ID NO: 4744774 - DNA, 18 bp, Homo sapiens
ccttggcatctagagctt

SEQ ID NO: 4744775 - DNA, 17 bp, Homo sapiens
ccttgggccctttgagt

SEQ ID NO: 4744776 - DNA, 11 bp, Homo sapiens
ccttgggggtc

SEQ ID NO: 4744777 - DNA, 22 bp, Homo sapiens
ccttgggggtcctcctccaggg

SEQ ID NO: 4744778 - DNA, 22 bp, Homo sapiens
ccttggttaggcattgtgggaa

SEQ ID NO: 4744779 - DNA, 16 bp, Homo sapiens
ccttgtccccacactc

SEQ ID NO: 4744780 - DNA, 17 bp, Homo sapiens
ccttgtccccacactcc

SEQ ID NO: 4744781 - DNA, 15 bp, Homo sapiens
ccttgtgagggagag

SEQ ID NO: 4744782 - DNA, 22 bp, Homo sapiens
ccttgtggcctgggcctcctca

SEQ ID NO: 4744783 - DNA, 16 bp, Homo sapiens
ccttgtggtcccaccc

SEQ ID NO: 4744784 - DNA, 18 bp, Homo sapiens
ccttgttttctctgtgtg

SEQ ID NO: 4744785 - DNA, 22 bp, Homo sapiens
cctttaaagagagtttgccact

SEQ ID NO: 4744786 - DNA, 19 bp, Homo sapiens
cctttcatttactgtggct

SEQ ID NO: 4744787 - DNA, 15 bp, Homo sapiens
cctttcctatttccc

SEQ ID NO: 4744788 - DNA, 19 bp, Homo sapiens
cctttcctatttccccaaa

SEQ ID NO: 4744789 - DNA, 20 bp, Homo sapiens
cctttctcccctgcccccag

SEQ ID NO: 4744790 - DNA, 15 bp, Homo sapiens
cctttgacctgcctc

SEQ ID NO: 4744791 - DNA, 21 bp, Homo sapiens
cctttgacctgcctcccttca

SEQ ID NO: 4744792 - DNA, 18 bp, Homo sapiens
cctttgacgccatcccag

SEQ ID NO: 4744793 - DNA, 19 bp, Homo sapiens
cctttgagtgcagtcctga

SEQ ID NO: 4744794 - DNA, 23 bp, Homo sapiens
cctttgtccccaccgcagacagg

SEQ ID NO: 4744795 - DNA, 14 bp, Homo sapiens
cctttgtgaggaag

SEQ ID NO: 4744796 - DNA, 21 bp, Homo sapiens
ccttttcagcttctgctgggc

SEQ ID NO: 4744797 - DNA, 12 bp, Homo sapiens
ccttttccatgc

SEQ ID NO: 4744798 - DNA, 16 bp, Homo sapiens
ccttttcccggggagg

SEQ ID NO: 4744799 - DNA, 21 bp, Homo sapiens
ccttttcccggggaggagaga

SEQ ID NO: 4744800 - DNA, 22 bp, Homo sapiens
ccttttctagcccgaatacaaa

SEQ ID NO: 4744801 - DNA, 13 bp, Homo sapiens
cctttttattcat

SEQ ID NO: 4744802 - DNA, 17 bp, Homo sapiens
cctttttccttgtcccc

SEQ ID NO: 4744803 - DNA, 18 bp, Homo sapiens
ccttttttaagatttttc

SEQ ID NO: 4744804 - DNA, 19 bp, Homo sapiens
ccttttttaagatttttct

SEQ ID NO: 4744805 - DNA, 21 bp, Homo sapiens
ccttttttaagatttttctca

SEQ ID NO: 4744806 - DNA, 18 bp, Homo sapiens
ccttttttggctgctgaa

SEQ ID NO: 4744807 - DNA, 22 bp, Homo sapiens
ccttttttggctgctgaaggct

SEQ ID NO: 4744808 - DNA, 11 bp, Homo sapiens
cgaaataacaa

SEQ ID NO: 4744809 - DNA, 17 bp, Homo sapiens
cgaaataacaatgttaa

SEQ ID NO: 4744810 - DNA, 15 bp, Homo sapiens
cgaaatttcattttc

SEQ ID NO: 4744811 - DNA, 20 bp, Homo sapiens
cgaaatttcattttccttca

SEQ ID NO: 4744812 - DNA, 20 bp, Homo sapiens
cgaacatatcatttgtgaag

SEQ ID NO: 4744813 - DNA, 22 bp, Homo sapiens
cgaacatatcatttgtgaagaa

SEQ ID NO: 4744814 - DNA, 14 bp, Homo sapiens
cgaactcctgacct

SEQ ID NO: 4744815 - DNA, 12 bp, Homo sapiens
cgaactggctgc

SEQ ID NO: 4744816 - DNA, 13 bp, Homo sapiens
cgaatagctggga

SEQ ID NO: 4744817 - DNA, 22 bp, Homo sapiens
cgaatctctttttgctttcgaa

SEQ ID NO: 4744818 - DNA, 15 bp, Homo sapiens
cgaatgtaattggaa

SEQ ID NO: 4744819 - DNA, 23 bp, Homo sapiens
cgaccagacaccttgacagggca

SEQ ID NO: 4744820 - DNA, 14 bp, Homo sapiens
cgaccccatctgcc

SEQ ID NO: 4744821 - DNA, 18 bp, Homo sapiens
cgaccccatctgcccagg

SEQ ID NO: 4744822 - DNA, 19 bp, Homo sapiens
cgacccttgccgtctacct

SEQ ID NO: 4744823 - DNA, 19 bp, Homo sapiens
cgacttgaattttcccact

SEQ ID NO: 4744824 - DNA, 22 bp, Homo sapiens
cgacttgaattttcccactgca

SEQ ID NO: 4744825 - DNA, 17 bp, Homo sapiens
cgagaactttcattttt

SEQ ID NO: 4744826 - DNA, 16 bp, Homo sapiens
cgagagatcaaagatg

SEQ ID NO: 4744827 - DNA, 12 bp, Homo sapiens
cgagagatgtgt

SEQ ID NO: 4744828 - DNA, 17 bp, Homo sapiens
cgagatcacgccactgc

SEQ ID NO: 4744829 - DNA, 20 bp, Homo sapiens
cgagatcacgccactgcact

SEQ ID NO: 4744830 - DNA, 13 bp, Homo sapiens
cgagcatgcctgg

SEQ ID NO: 4744831 - DNA, 14 bp, Homo sapiens
cgagcatgcctgga

SEQ ID NO: 4744832 - DNA, 16 bp, Homo sapiens
cgagcatgcctggatg

SEQ ID NO: 4744833 - DNA, 17 bp, Homo sapiens
cgagcatgcctggatgg

SEQ ID NO: 4744834 - DNA, 19 bp, Homo sapiens
cgagccctggtggcagtgg

SEQ ID NO: 4744835 - DNA, 19 bp, Homo sapiens
cgaggaggctccagagggc

SEQ ID NO: 4744836 - DNA, 20 bp, Homo sapiens
cgaggaggctccagagggca

SEQ ID NO: 4744837 - DNA, 19 bp, Homo sapiens
cgaggccttctctgaagga

SEQ ID NO: 4744838 - DNA, 13 bp, Homo sapiens
cgagtagctggga

SEQ ID NO: 4744839 - DNA, 20 bp, Homo sapiens
cgatgtcctcctctgtgaaa

SEQ ID NO: 4744840 - DNA, 19 bp, Homo sapiens
cgatgtgggtccctctctt

SEQ ID NO: 4744841 - DNA, 21 bp, Homo sapiens
cgatgtgggtccctctcttga

SEQ ID NO: 4744842 - DNA, 12 bp, Homo sapiens
cgcaaagggcat

SEQ ID NO: 4744843 - DNA, 22 bp, Homo sapiens
cgcacaatagtaacctgggtaa

SEQ ID NO: 4744844 - DNA, 17 bp, Homo sapiens
cgcacacacacatacag

SEQ ID NO: 4744845 - DNA, 20 bp, Homo sapiens
cgcacccagagaaaattaat

SEQ ID NO: 4744846 - DNA, 16 bp, Homo sapiens
cgcaccctcccctccc

SEQ ID NO: 4744847 - DNA, 20 bp, Homo sapiens
cgcactcagccgtgggcccg

SEQ ID NO: 4744848 - DNA, 15 bp, Homo sapiens
cgcagacaggaccag

SEQ ID NO: 4744849 - DNA, 16 bp, Homo sapiens
cgcagacaggaccagg

SEQ ID NO: 4744850 - DNA, 13 bp, Homo sapiens
cgcagcctgagaa

SEQ ID NO: 4744851 - DNA, 14 bp, Homo sapiens
cgcagctggcagag

SEQ ID NO: 4744852 - DNA, 10 bp, Homo sapiens
cgcaggcccc

SEQ ID NO: 4744853 - DNA, 17 bp, Homo sapiens
cgcaggcccctctcctc

SEQ ID NO: 4744854 - DNA, 20 bp, Homo sapiens
cgcaggcctgccttctcagg

SEQ ID NO: 4744855 - DNA, 13 bp, Homo sapiens
cgcaggctggccc

SEQ ID NO: 4744856 - DNA, 15 bp, Homo sapiens
cgcaggctggccctg

SEQ ID NO: 4744857 - DNA, 16 bp, Homo sapiens
cgcatgccccctcgtg

SEQ ID NO: 4744858 - DNA, 14 bp, Homo sapiens
cgccatcccagccc

SEQ ID NO: 4744859 - DNA, 17 bp, Homo sapiens
cgccatcccagccccaa

SEQ ID NO: 4744860 - DNA, 18 bp, Homo sapiens
cgcccaactaatttttgt

SEQ ID NO: 4744861 - DNA, 16 bp, Homo sapiens
cgcccaccgcatgccc

SEQ ID NO: 4744862 - DNA, 19 bp, Homo sapiens
cgcccaggctggagtgcaa

SEQ ID NO: 4744863 - DNA, 20 bp, Homo sapiens
cgcccaggctggagtgcaat

SEQ ID NO: 4744864 - DNA, 15 bp, Homo sapiens
cgcccaggctggcca

SEQ ID NO: 4744865 - DNA, 16 bp, Homo sapiens
cgcccaggctggccag

SEQ ID NO: 4744866 - DNA, 19 bp, Homo sapiens
cgcccaggctggccagccc

SEQ ID NO: 4744867 - DNA, 22 bp, Homo sapiens
cgcccaggctggccagccccac

SEQ ID NO: 4744868 - DNA, 22 bp, Homo sapiens
cgcccaggcttagtcactgaga

SEQ ID NO: 4744869 - DNA, 19 bp, Homo sapiens
cgcccagtctggaatgcag

SEQ ID NO: 4744870 - DNA, 21 bp, Homo sapiens
cgcccatcagtgccagcccct

SEQ ID NO: 4744871 - DNA, 14 bp, Homo sapiens
cgccctctgtcctg

SEQ ID NO: 4744872 - DNA, 16 bp, Homo sapiens
cgccctctgtcctgac

SEQ ID NO: 4744873 - DNA, 14 bp, Homo sapiens
cgcctacaggagtg

SEQ ID NO: 4744874 - DNA, 15 bp, Homo sapiens
cgcctcgcccaccgc

SEQ ID NO: 4744875 - DNA, 19 bp, Homo sapiens
cgcctcgcccaccgcatgc

SEQ ID NO: 4744876 - DNA, 12 bp, Homo sapiens
cgcctggcctga

SEQ ID NO: 4744877 - DNA, 21 bp, Homo sapiens
cgccttctcccccccggggct

SEQ ID NO: 4744878 - DNA, 19 bp, Homo sapiens
cgcgccaaataatgtctct

SEQ ID NO: 4744879 - DNA, 21 bp, Homo sapiens
cgcgccaaataatgtctctgt

SEQ ID NO: 4744880 - DNA, 19 bp, Homo sapiens
cgcgccttctcccccccgg

SEQ ID NO: 4744881 - DNA, 23 bp, Homo sapiens
cgcgccttctcccccccggggct

SEQ ID NO: 4744882 - DNA, 19 bp, Homo sapiens
cgcggctggatgggggctc

SEQ ID NO: 4744883 - DNA, 16 bp, Homo sapiens
cgcggggaggccggcg

SEQ ID NO: 4744884 - DNA, 16 bp, Homo sapiens
cgcgtgcacacaccag

SEQ ID NO: 4744885 - DNA, 15 bp, Homo sapiens
cgctaagagggaggg

SEQ ID NO: 4744886 - DNA, 21 bp, Homo sapiens
cgctaagagggagggagggct

SEQ ID NO: 4744887 - DNA, 22 bp, Homo sapiens
cgctaagagggagggagggctc

SEQ ID NO: 4744888 - DNA, 16 bp, Homo sapiens
cgctacccgggaaggg

SEQ ID NO: 4744889 - DNA, 17 bp, Homo sapiens
cgctacccgggaagggg

SEQ ID NO: 4744890 - DNA, 14 bp, Homo sapiens
cgctcccagtgtct

SEQ ID NO: 4744891 - DNA, 21 bp, Homo sapiens
cgctcccagtgtcttcctgtg

SEQ ID NO: 4744892 - DNA, 18 bp, Homo sapiens
cgctcctgccgcagagct

SEQ ID NO: 4744893 - DNA, 14 bp, Homo sapiens
cgctgattctcagg

SEQ ID NO: 4744894 - DNA, 15 bp, Homo sapiens
cgctgccagctctgt

SEQ ID NO: 4744895 - DNA, 19 bp, Homo sapiens
cgctggaccttgaactggg

SEQ ID NO: 4744896 - DNA, 23 bp, Homo sapiens
cgctggaccttgaactgggtact

SEQ ID NO: 4744897 - DNA, 20 bp, Homo sapiens
cgctggactctcagtctctg

SEQ ID NO: 4744898 - DNA, 15 bp, Homo sapiens
cgctgtgctgccctg

SEQ ID NO: 4744899 - DNA, 13 bp, Homo sapiens
cgcttgcctcggc

SEQ ID NO: 4744900 - DNA, 14 bp, Homo sapiens
cgcttgcctcggct

SEQ ID NO: 4744901 - DNA, 22 bp, Homo sapiens
cgcttgcctcggctcctgctgc

SEQ ID NO: 4744902 - DNA, 14 bp, Homo sapiens
cgctttctacccag

SEQ ID NO: 4744903 - DNA, 12 bp, Homo sapiens
cggaaagaagag

SEQ ID NO: 4744904 - DNA, 16 bp, Homo sapiens
cggacacttctcagga

SEQ ID NO: 4744905 - DNA, 15 bp, Homo sapiens
cggacagccacggcc

SEQ ID NO: 4744906 - DNA, 21 bp, Homo sapiens
cggacagccacggccaggcca

SEQ ID NO: 4744907 - DNA, 12 bp, Homo sapiens
cggaccagcctg

SEQ ID NO: 4744908 - DNA, 13 bp, Homo sapiens
cggaccagcctgg

SEQ ID NO: 4744909 - DNA, 21 bp, Homo sapiens
cggagccactcctctgactca

SEQ ID NO: 4744910 - DNA, 21 bp, Homo sapiens
cggagtcccaccttggctgca

SEQ ID NO: 4744911 - DNA, 22 bp, Homo sapiens
cggagtcccaccttggctgcag

SEQ ID NO: 4744912 - DNA, 20 bp, Homo sapiens
cggataggcaggaacataca

SEQ ID NO: 4744913 - DNA, 21 bp, Homo sapiens
cggataggcaggaacatacag

SEQ ID NO: 4744914 - DNA, 16 bp, Homo sapiens
cggatctttggacaga

SEQ ID NO: 4744915 - DNA, 17 bp, Homo sapiens
cggatgacagccaccct

SEQ ID NO: 4744916 - DNA, 15 bp, Homo sapiens
cggatttggggtgga

SEQ ID NO: 4744917 - DNA, 10 bp, Homo sapiens
cggcactgca

SEQ ID NO: 4744918 - DNA, 13 bp, Homo sapiens
cggccacctcacc

SEQ ID NO: 4744919 - DNA, 16 bp, Homo sapiens
cggccacctcaccctc

SEQ ID NO: 4744920 - DNA, 16 bp, Homo sapiens
cggccacctgcggtgc

SEQ ID NO: 4744921 - DNA, 20 bp, Homo sapiens
cggccagccctcccagcagt

SEQ ID NO: 4744922 - DNA, 13 bp, Homo sapiens
cggccaggtgggc

SEQ ID NO: 4744923 - DNA, 17 bp, Homo sapiens
cggcccaatccaaggtg

SEQ ID NO: 4744924 - DNA, 18 bp, Homo sapiens
cggctcactgcagcctca

SEQ ID NO: 4744925 - DNA, 12 bp, Homo sapiens
cggctcctgctg

SEQ ID NO: 4744926 - DNA, 13 bp, Homo sapiens
cggctcctgctgc

SEQ ID NO: 4744927 - DNA, 13 bp, Homo sapiens
cggctggatgggg

SEQ ID NO: 4744928 - DNA, 17 bp, Homo sapiens
cggctgtttactgcttt

SEQ ID NO: 4744929 - DNA, 19 bp, Homo sapiens
cgggaagggggctgggaca

SEQ ID NO: 4744930 - DNA, 22 bp, Homo sapiens
cgggaccagaaacctgggagag

SEQ ID NO: 4744931 - DNA, 23 bp, Homo sapiens
cgggaccagaaacctgggagaga

SEQ ID NO: 4744932 - DNA, 16 bp, Homo sapiens
cgggacgcggcaggct

SEQ ID NO: 4744933 - DNA, 13 bp, Homo sapiens
cgggagaggggac

SEQ ID NO: 4744934 - DNA, 21 bp, Homo sapiens
cgggagcctgatcacctgccc

SEQ ID NO: 4744935 - DNA, 21 bp, Homo sapiens
cgggaggatgttctgggacac

SEQ ID NO: 4744936 - DNA, 20 bp, Homo sapiens
cgggaggcagaggttgcagt

SEQ ID NO: 4744937 - DNA, 22 bp, Homo sapiens
cgggcactcagaagacactgat

SEQ ID NO: 4744938 - DNA, 12 bp, Homo sapiens
cgggcattttga

SEQ ID NO: 4744939 - DNA, 14 bp, Homo sapiens
cgggctcctgtgcc

SEQ ID NO: 4744940 - DNA, 19 bp, Homo sapiens
cgggctcgaagaaaataat

SEQ ID NO: 4744941 - DNA, 14 bp, Homo sapiens
cggggacagctcct

SEQ ID NO: 4744942 - DNA, 22 bp, Homo sapiens
cggggacagctccttctgtcct

SEQ ID NO: 4744943 - DNA, 20 bp, Homo sapiens
cggggaggccggcgcagcgc

SEQ ID NO: 4744944 - DNA, 13 bp, Homo sapiens
cgggggcagctga

SEQ ID NO: 4744945 - DNA, 11 bp, Homo sapiens
cgggtcacagg

SEQ ID NO: 4744946 - DNA, 13 bp, Homo sapiens
cgggtctgcctct

SEQ ID NO: 4744947 - DNA, 20 bp, Homo sapiens
cggtaaaacaccggagacta

SEQ ID NO: 4744948 - DNA, 17 bp, Homo sapiens
cggtgagctacaaatgc

SEQ ID NO: 4744949 - DNA, 21 bp, Homo sapiens
cggtgctatctcccccagccc

SEQ ID NO: 4744950 - DNA, 22 bp, Homo sapiens
cggtgctatctcccccagcccc

SEQ ID NO: 4744951 - DNA, 23 bp, Homo sapiens
cggtgctatctcccccagcccca

SEQ ID NO: 4744952 - DNA, 14 bp, Homo sapiens
cggtgctccaggca

SEQ ID NO: 4744953 - DNA, 15 bp, Homo sapiens
cggtgctccaggcag

SEQ ID NO: 4744954 - DNA, 16 bp, Homo sapiens
cggtgctccaggcagg

SEQ ID NO: 4744955 - DNA, 10 bp, Homo sapiens
cggtgggggt

SEQ ID NO: 4744956 - DNA, 11 bp, Homo sapiens
cggtgggggta

SEQ ID NO: 4744957 - DNA, 17 bp, Homo sapiens
cggtggtaccaggtctc

SEQ ID NO: 4744958 - DNA, 15 bp, Homo sapiens
cggtgtgcaccaggg

SEQ ID NO: 4744959 - DNA, 20 bp, Homo sapiens
cgtaaagccttgttttctct

SEQ ID NO: 4744960 - DNA, 16 bp, Homo sapiens
cgtaaagctagaaatg

SEQ ID NO: 4744961 - DNA, 12 bp, Homo sapiens
cgtaaatgtttt

SEQ ID NO: 4744962 - DNA, 15 bp, Homo sapiens
cgtagggcctgactc

SEQ ID NO: 4744963 - DNA, 16 bp, Homo sapiens
cgtcataactagaact

SEQ ID NO: 4744964 - DNA, 23 bp, Homo sapiens
cgtccatcacgttagctgtccca

SEQ ID NO: 4744965 - DNA, 14 bp, Homo sapiens
cgtccccctctggc

SEQ ID NO: 4744966 - DNA, 22 bp, Homo sapiens
cgtccccctctggctccagctg

SEQ ID NO: 4744967 - DNA, 14 bp, Homo sapiens
cgtcctcctctgtg

SEQ ID NO: 4744968 - DNA, 15 bp, Homo sapiens
cgtcctcctctgtga

SEQ ID NO: 4744969 - DNA, 20 bp, Homo sapiens
cgtcctctccctcctggcca

SEQ ID NO: 4744970 - DNA, 20 bp, Homo sapiens
cgtctgacaggcaatgctgg

SEQ ID NO: 4744971 - DNA, 23 bp, Homo sapiens
cgtgacaacacaaatttgggagg

SEQ ID NO: 4744972 - DNA, 14 bp, Homo sapiens
cgtgacaacacttg

SEQ ID NO: 4744973 - DNA, 15 bp, Homo sapiens
cgtgagccactgcac

SEQ ID NO: 4744974 - DNA, 20 bp, Homo sapiens
cgtgagccactgcaccgggc

SEQ ID NO: 4744975 - DNA, 16 bp, Homo sapiens
cgtgatcactgagcca

SEQ ID NO: 4744976 - DNA, 17 bp, Homo sapiens
cgtgatcactgagccat

SEQ ID NO: 4744977 - DNA, 14 bp, Homo sapiens
cgtgcacacaccag

SEQ ID NO: 4744978 - DNA, 16 bp, Homo sapiens
cgtgcacacaccagag

SEQ ID NO: 4744979 - DNA, 19 bp, Homo sapiens
cgtgcacacaccagagccc

SEQ ID NO: 4744980 - DNA, 20 bp, Homo sapiens
cgtgcacacaccagagccca

SEQ ID NO: 4744981 - DNA, 22 bp, Homo sapiens
cgtgcacacaccagagcccacc

SEQ ID NO: 4744982 - DNA, 16 bp, Homo sapiens
cgtgcctggccacgcc

SEQ ID NO: 4744983 - DNA, 14 bp, Homo sapiens
cgtgcgtctgtgtg

SEQ ID NO: 4744984 - DNA, 20 bp, Homo sapiens
cgtggaacgtttttcctgtt

SEQ ID NO: 4744985 - DNA, 15 bp, Homo sapiens
cgtggagctgcctga

SEQ ID NO: 4744986 - DNA, 11 bp, Homo sapiens
cgtggcaggac

SEQ ID NO: 4744987 - DNA, 18 bp, Homo sapiens
cgtggccccagcctggcc

SEQ ID NO: 4744988 - DNA, 21 bp, Homo sapiens
cgtggccccagcctggcccag

SEQ ID NO: 4744989 - DNA, 13 bp, Homo sapiens
cgtgggctccctg

SEQ ID NO: 4744990 - DNA, 12 bp, Homo sapiens
cgtgtgtagagt

SEQ ID NO: 4744991 - DNA, 14 bp, Homo sapiens
cgtgtgtctgtgtt

SEQ ID NO: 4744992 - DNA, 17 bp, Homo sapiens
cgtgtgtttttctatta

SEQ ID NO: 4744993 - DNA, 18 bp, Homo sapiens
cgtgtgtttttctattaa

SEQ ID NO: 4744994 - DNA, 21 bp, Homo sapiens
cgtgtgtttttctattaaaag

SEQ ID NO: 4744995 - DNA, 14 bp, Homo sapiens
cgttaccaggcagg

SEQ ID NO: 4744996 - DNA, 17 bp, Homo sapiens
cgttgtctccctggccc

SEQ ID NO: 4744997 - DNA, 11 bp, Homo sapiens
cgttgtgaggg

SEQ ID NO: 4744998 - DNA, 15 bp, Homo sapiens
ctaaaaagtataaaa

SEQ ID NO: 4744999 - DNA, 16 bp, Homo sapiens
ctaaaaagtataaaat

SEQ ID NO: 4745000 - DNA, 22 bp, Homo sapiens
ctaaaaatacttaaatttggtt

SEQ ID NO: 4745001 - DNA, 15 bp, Homo sapiens
ctaaaacctgagcta

SEQ ID NO: 4745002 - DNA, 21 bp, Homo sapiens
ctaaaagcatggccctgctgc

SEQ ID NO: 4745003 - DNA, 23 bp, Homo sapiens
ctaaaagcatggccctgctgccc

SEQ ID NO: 4745004 - DNA, 17 bp, Homo sapiens
ctaaacaagaaccattt

SEQ ID NO: 4745005 - DNA, 18 bp, Homo sapiens
ctaaaccatggcacttga

SEQ ID NO: 4745006 - DNA, 16 bp, Homo sapiens
ctaaaccctctgtgaa

SEQ ID NO: 4745007 - DNA, 17 bp, Homo sapiens
ctaaaccctctgtgaaa

SEQ ID NO: 4745008 - DNA, 22 bp, Homo sapiens
ctaaactgccccctctgccctg

SEQ ID NO: 4745009 - DNA, 21 bp, Homo sapiens
ctaaagaaggtttcagaaaga

SEQ ID NO: 4745010 - DNA, 23 bp, Homo sapiens
ctaaatattggtttgttattctt

SEQ ID NO: 4745011 - DNA, 13 bp, Homo sapiens
ctaaatttaatta

SEQ ID NO: 4745012 - DNA, 15 bp, Homo sapiens
ctaaatttttaactg

SEQ ID NO: 4745013 - DNA, 17 bp, Homo sapiens
ctaaccacgctggacct

SEQ ID NO: 4745014 - DNA, 17 bp, Homo sapiens
ctaactcatactgtgct

SEQ ID NO: 4745015 - DNA, 16 bp, Homo sapiens
ctaagaagctgcaata

SEQ ID NO: 4745016 - DNA, 19 bp, Homo sapiens
ctaagaagctgcaataaag

SEQ ID NO: 4745017 - DNA, 18 bp, Homo sapiens
ctaagactgctgctgaat

SEQ ID NO: 4745018 - DNA, 13 bp, Homo sapiens
ctaagagggaggg

SEQ ID NO: 4745019 - DNA, 20 bp, Homo sapiens
ctaagcacgggccatatgaa

SEQ ID NO: 4745020 - DNA, 20 bp, Homo sapiens
ctaagcggctgtttactgct

SEQ ID NO: 4745021 - DNA, 21 bp, Homo sapiens
ctaagcggctgtttactgctt

SEQ ID NO: 4745022 - DNA, 21 bp, Homo sapiens
ctaagcttcactgtaaaataa

SEQ ID NO: 4745023 - DNA, 23 bp, Homo sapiens
ctaaggccatggcatcccttttt

SEQ ID NO: 4745024 - DNA, 16 bp, Homo sapiens
ctaaggcgtggagctg

SEQ ID NO: 4745025 - DNA, 20 bp, Homo sapiens
ctaaggcgtggagctgcctg

SEQ ID NO: 4745026 - DNA, 22 bp, Homo sapiens
ctaaggcgtggagctgcctgat

SEQ ID NO: 4745027 - DNA, 20 bp, Homo sapiens
ctaagtgatcctcccacctc

SEQ ID NO: 4745028 - DNA, 23 bp, Homo sapiens
ctaagtgatcctcccacctcagc

SEQ ID NO: 4745029 - DNA, 21 bp, Homo sapiens
ctaataaaatttaaaagtctt

SEQ ID NO: 4745030 - DNA, 18 bp, Homo sapiens
ctaatatgtaacaagcca

SEQ ID NO: 4745031 - DNA, 16 bp, Homo sapiens
ctaatcctctttttct

SEQ ID NO: 4745032 - DNA, 16 bp, Homo sapiens
ctaatgcgcaggctgg

SEQ ID NO: 4745033 - DNA, 20 bp, Homo sapiens
ctaatgcgcaggctggccct

SEQ ID NO: 4745034 - DNA, 23 bp, Homo sapiens
ctaatgctgcagatttgggctgg

SEQ ID NO: 4745035 - DNA, 15 bp, Homo sapiens
ctaatgcttgattta

SEQ ID NO: 4745036 - DNA, 17 bp, Homo sapiens
ctaattatcacgtctga

SEQ ID NO: 4745037 - DNA, 14 bp, Homo sapiens
ctaattatttaatt

SEQ ID NO: 4745038 - DNA, 14 bp, Homo sapiens
ctaattccacagct

SEQ ID NO: 4745039 - DNA, 23 bp, Homo sapiens
ctaattcttatttttaatttttc

SEQ ID NO: 4745040 - DNA, 20 bp, Homo sapiens
ctaattgtatgttagaataa

SEQ ID NO: 4745041 - DNA, 11 bp, Homo sapiens
ctaatttaaca

SEQ ID NO: 4745042 - DNA, 21 bp, Homo sapiens
ctaatttctgtgtctaaattt

SEQ ID NO: 4745043 - DNA, 17 bp, Homo sapiens
ctacaaacaaaatttct

SEQ ID NO: 4745044 - DNA, 23 bp, Homo sapiens
ctacaaaggaggacaagaccctc

SEQ ID NO: 4745045 - DNA, 24 bp, Homo sapiens
ctacaaaggaggacaagaccctct

SEQ ID NO: 4745046 - DNA, 15 bp, Homo sapiens
ctacacagctgtttc

SEQ ID NO: 4745047 - DNA, 13 bp, Homo sapiens
ctacacctaactc

SEQ ID NO: 4745048 - DNA, 14 bp, Homo sapiens
ctacacctaactca

SEQ ID NO: 4745049 - DNA, 23 bp, Homo sapiens
ctacacgagatacagaattttat

SEQ ID NO: 4745050 - DNA, 14 bp, Homo sapiens
ctacactgtgctga

SEQ ID NO: 4745051 - DNA, 11 bp, Homo sapiens
ctacagagaaa

SEQ ID NO: 4745052 - DNA, 12 bp, Homo sapiens
ctacagagaaaa

SEQ ID NO: 4745053 - DNA, 17 bp, Homo sapiens
ctacagagaaaatgaat

SEQ ID NO: 4745054 - DNA, 18 bp, Homo sapiens
ctacagaggccatgggcc

SEQ ID NO: 4745055 - DNA, 22 bp, Homo sapiens
ctacagctttgggtcattttta

SEQ ID NO: 4745056 - DNA, 14 bp, Homo sapiens
ctacaggagtgagc

SEQ ID NO: 4745057 - DNA, 13 bp, Homo sapiens
ctacagtcctccc

SEQ ID NO: 4745058 - DNA, 17 bp, Homo sapiens
ctacagtcctcccatct

SEQ ID NO: 4745059 - DNA, 14 bp, Homo sapiens
ctacagtgtacagt

SEQ ID NO: 4745060 - DNA, 16 bp, Homo sapiens
ctacagtgtacagtct

SEQ ID NO: 4745061 - DNA, 20 bp, Homo sapiens
ctacagtgtacagtcttgta

SEQ ID NO: 4745062 - DNA, 19 bp, Homo sapiens
ctaccaagctatcctggct

SEQ ID NO: 4745063 - DNA, 16 bp, Homo sapiens
ctaccataagtgacac

SEQ ID NO: 4745064 - DNA, 13 bp, Homo sapiens
ctacccaccctcc

SEQ ID NO: 4745065 - DNA, 22 bp, Homo sapiens
ctacccaccctcctttcaccac

SEQ ID NO: 4745066 - DNA, 17 bp, Homo sapiens
ctacccagcgagccctg

SEQ ID NO: 4745067 - DNA, 12 bp, Homo sapiens
ctacccaggtgc

SEQ ID NO: 4745068 - DNA, 13 bp, Homo sapiens
ctacccaggtgct

SEQ ID NO: 4745069 - DNA, 13 bp, Homo sapiens
ctacccctcccag

SEQ ID NO: 4745070 - DNA, 16 bp, Homo sapiens
ctacccctcccagctg

SEQ ID NO: 4745071 - DNA, 18 bp, Homo sapiens
ctacccctcccagctgac

SEQ ID NO: 4745072 - DNA, 16 bp, Homo sapiens
ctaccctccctgctgt

SEQ ID NO: 4745073 - DNA, 16 bp, Homo sapiens
ctacctgaggggcctc

SEQ ID NO: 4745074 - DNA, 16 bp, Homo sapiens
ctacctgtcctccgtg

SEQ ID NO: 4745075 - DNA, 17 bp, Homo sapiens
ctacgttaccaggcagg

SEQ ID NO: 4745076 - DNA, 13 bp, Homo sapiens
ctactacatctgt

SEQ ID NO: 4745077 - DNA, 18 bp, Homo sapiens
ctactacccccacagacc

SEQ ID NO: 4745078 - DNA, 22 bp, Homo sapiens
ctactgcttcctctgaatatta

SEQ ID NO: 4745079 - DNA, 16 bp, Homo sapiens
ctacttctctgagtca

SEQ ID NO: 4745080 - DNA, 21 bp, Homo sapiens
ctacttctctgagtcagctga

SEQ ID NO: 4745081 - DNA, 17 bp, Homo sapiens
ctacttctgtaattgtg

SEQ ID NO: 4745082 - DNA, 23 bp, Homo sapiens
ctacttgatatttccttcaccac

SEQ ID NO: 4745083 - DNA, 18 bp, Homo sapiens
ctacttgcagtacatcaa

SEQ ID NO: 4745084 - DNA, 17 bp, Homo sapiens
ctactttccatttggta

SEQ ID NO: 4745085 - DNA, 22 bp, Homo sapiens
ctacttttgcttttttatttac

SEQ ID NO: 4745086 - DNA, 23 bp, Homo sapiens
ctagaaatgatccccagctgttt

SEQ ID NO: 4745087 - DNA, 20 bp, Homo sapiens
ctagaatatcctacttctcc

SEQ ID NO: 4745088 - DNA, 18 bp, Homo sapiens
ctagcacagttccttgca

SEQ ID NO: 4745089 - DNA, 15 bp, Homo sapiens
ctagcagtaaaagat

SEQ ID NO: 4745090 - DNA, 17 bp, Homo sapiens
ctagcagtaaaagataa

SEQ ID NO: 4745091 - DNA, 22 bp, Homo sapiens
ctagcggagttccagcaaacaa

SEQ ID NO: 4745092 - DNA, 10 bp, Homo sapiens
ctagctcccc

SEQ ID NO: 4745093 - DNA, 13 bp, Homo sapiens
ctagctcccctcc

SEQ ID NO: 4745094 - DNA, 15 bp, Homo sapiens
ctagctcccctcctc

SEQ ID NO: 4745095 - DNA, 19 bp, Homo sapiens
ctagctcccctcctctccc

SEQ ID NO: 4745096 - DNA, 21 bp, Homo sapiens
ctagctcccctcctctcccct

SEQ ID NO: 4745097 - DNA, 23 bp, Homo sapiens
ctagctcccctcctctcccctac

SEQ ID NO: 4745098 - DNA, 23 bp, Homo sapiens
ctagctgtgtgaatacctgctca

SEQ ID NO: 4745099 - DNA, 20 bp, Homo sapiens
ctagcttagagcctccctca

SEQ ID NO: 4745100 - DNA, 15 bp, Homo sapiens
ctaggaagactttgg

SEQ ID NO: 4745101 - DNA, 17 bp, Homo sapiens
ctaggaagactttggaa

SEQ ID NO: 4745102 - DNA, 21 bp, Homo sapiens
ctaggaagactttggaaagag

SEQ ID NO: 4745103 - DNA, 15 bp, Homo sapiens
ctaggatatcttctc

SEQ ID NO: 4745104 - DNA, 17 bp, Homo sapiens
ctaggatatcttctcca

SEQ ID NO: 4745105 - DNA, 16 bp, Homo sapiens
ctaggcaggacctgtg

SEQ ID NO: 4745106 - DNA, 13 bp, Homo sapiens
ctaggcctggcca

SEQ ID NO: 4745107 - DNA, 13 bp, Homo sapiens
ctaggctggggaa

SEQ ID NO: 4745108 - DNA, 14 bp, Homo sapiens
ctagggaagggtgg

SEQ ID NO: 4745109 - DNA, 20 bp, Homo sapiens
ctagggacccctcctccctt

SEQ ID NO: 4745110 - DNA, 14 bp, Homo sapiens
ctagggctagtctt

SEQ ID NO: 4745111 - DNA, 13 bp, Homo sapiens
ctagggtcctggg

SEQ ID NO: 4745112 - DNA, 14 bp, Homo sapiens
ctagggtcctgggg

SEQ ID NO: 4745113 - DNA, 15 bp, Homo sapiens
ctagggtcctgggga

SEQ ID NO: 4745114 - DNA, 24 bp, Homo sapiens
ctaggtgacagagtgagactctgt

SEQ ID NO: 4745115 - DNA, 15 bp, Homo sapiens
ctagtcccttccaca

SEQ ID NO: 4745116 - DNA, 20 bp, Homo sapiens
ctagtcccttccacaccccc

SEQ ID NO: 4745117 - DNA, 23 bp, Homo sapiens
ctagtctgtgtggcaaattaaac

SEQ ID NO: 4745118 - DNA, 21 bp, Homo sapiens
ctagtgctgtaatattgtaaa

SEQ ID NO: 4745119 - DNA, 15 bp, Homo sapiens
ctagtggctgtccag

SEQ ID NO: 4745120 - DNA, 16 bp, Homo sapiens
ctagtggctgtccagt

SEQ ID NO: 4745121 - DNA, 18 bp, Homo sapiens
ctagtggctgtccagtgc

SEQ ID NO: 4745122 - DNA, 20 bp, Homo sapiens
ctagtggtctttgtaagagt

SEQ ID NO: 4745123 - DNA, 19 bp, Homo sapiens
ctagtgtggtgtttcctgg

SEQ ID NO: 4745124 - DNA, 21 bp, Homo sapiens
ctagtgtggtgtttcctggca

SEQ ID NO: 4745125 - DNA, 23 bp, Homo sapiens
ctagttatacttatttgtatatg

SEQ ID NO: 4745126 - DNA, 22 bp, Homo sapiens
ctagttattacccagagttttt

SEQ ID NO: 4745127 - DNA, 13 bp, Homo sapiens
ctataactttttt

SEQ ID NO: 4745128 - DNA, 20 bp, Homo sapiens
ctatcaaaagaaatagaaaa

SEQ ID NO: 4745129 - DNA, 21 bp, Homo sapiens
ctatcagtgtgccccccatcc

SEQ ID NO: 4745130 - DNA, 15 bp, Homo sapiens
ctatcccggctgccc

SEQ ID NO: 4745131 - DNA, 18 bp, Homo sapiens
ctatcctgttaacactgt

SEQ ID NO: 4745132 - DNA, 22 bp, Homo sapiens
ctatcctgttaacactgtaata

SEQ ID NO: 4745133 - DNA, 23 bp, Homo sapiens
ctatcctgttaacactgtaatat

SEQ ID NO: 4745134 - DNA, 14 bp, Homo sapiens
ctatctcccccagc

SEQ ID NO: 4745135 - DNA, 12 bp, Homo sapiens
ctatctgtattc

SEQ ID NO: 4745136 - DNA, 17 bp, Homo sapiens
ctatctgtattcccaaa

SEQ ID NO: 4745137 - DNA, 18 bp, Homo sapiens
ctatctttgccaccctca

SEQ ID NO: 4745138 - DNA, 21 bp, Homo sapiens
ctatctttgccaccctcatgc

SEQ ID NO: 4745139 - DNA, 14 bp, Homo sapiens
ctatgataaattat

SEQ ID NO: 4745140 - DNA, 21 bp, Homo sapiens
ctatgatgaaggtaattaaag

SEQ ID NO: 4745141 - DNA, 22 bp, Homo sapiens
ctatggacggtgctccaggcag

SEQ ID NO: 4745142 - DNA, 23 bp, Homo sapiens
ctatgggactcaatgcactgaca

SEQ ID NO: 4745143 - DNA, 14 bp, Homo sapiens
ctatggtgccaatg

SEQ ID NO: 4745144 - DNA, 21 bp, Homo sapiens
ctatgttaatattttaggtgt

SEQ ID NO: 4745145 - DNA, 14 bp, Homo sapiens
ctatgttgcccagg

SEQ ID NO: 4745146 - DNA, 15 bp, Homo sapiens
ctatgttgcccaggc

SEQ ID NO: 4745147 - DNA, 16 bp, Homo sapiens
ctatgttgcccaggca

SEQ ID NO: 4745148 - DNA, 17 bp, Homo sapiens
ctatgttgcccaggcag

SEQ ID NO: 4745149 - DNA, 15 bp, Homo sapiens
ctattaaaagactca

SEQ ID NO: 4745150 - DNA, 16 bp, Homo sapiens
ctattaaaagactcat

SEQ ID NO: 4745151 - DNA, 17 bp, Homo sapiens
ctattaaaagactcatc

SEQ ID NO: 4745152 - DNA, 22 bp, Homo sapiens
ctattagccaggatcatggtgt

SEQ ID NO: 4745153 - DNA, 9 bp, Homo sapiens
ctatttaac

SEQ ID NO: 4745154 - DNA, 22 bp, Homo sapiens
ctatttatgtgatccttttgga

SEQ ID NO: 4745155 - DNA, 12 bp, Homo sapiens
ctatttatttat

SEQ ID NO: 4745156 - DNA, 12 bp, Homo sapiens
ctatttctagtt

SEQ ID NO: 4745157 - DNA, 14 bp, Homo sapiens
ctatttgcagaggc

SEQ ID NO: 4745158 - DNA, 12 bp, Homo sapiens
ctattttcacaa

SEQ ID NO: 4745159 - DNA, 17 bp, Homo sapiens
ctattttgagttaattt

SEQ ID NO: 4745160 - DNA, 13 bp, Homo sapiens
ctcaaacactgca

SEQ ID NO: 4745161 - DNA, 14 bp, Homo sapiens
ctcaaacactgcag

SEQ ID NO: 4745162 - DNA, 19 bp, Homo sapiens
ctcaaaccaaatcactgaa

SEQ ID NO: 4745163 - DNA, 19 bp, Homo sapiens
ctcaaaccttgaggagaag

SEQ ID NO: 4745164 - DNA, 15 bp, Homo sapiens
ctcaaagaaatcctc

SEQ ID NO: 4745165 - DNA, 12 bp, Homo sapiens
ctcaaagttttg

SEQ ID NO: 4745166 - DNA, 13 bp, Homo sapiens
ctcaagcaggttt

SEQ ID NO: 4745167 - DNA, 15 bp, Homo sapiens
ctcaaggcctcccac

SEQ ID NO: 4745168 - DNA, 16 bp, Homo sapiens
ctcaaggcctcccaca

SEQ ID NO: 4745169 - DNA, 20 bp, Homo sapiens
ctcaaggggccatcctgtcc

SEQ ID NO: 4745170 - DNA, 21 bp, Homo sapiens
ctcaagtcctcttttctgaga

SEQ ID NO: 4745171 - DNA, 18 bp, Homo sapiens
ctcaagtgattctcctgc

SEQ ID NO: 4745172 - DNA, 19 bp, Homo sapiens
ctcaagtgattctcctgcc

SEQ ID NO: 4745173 - DNA, 21 bp, Homo sapiens
ctcaagtgattctcctgcctc

SEQ ID NO: 4745174 - DNA, 20 bp, Homo sapiens
ctcaagtgttcacaacctgg

SEQ ID NO: 4745175 - DNA, 17 bp, Homo sapiens
ctcaagttccagtgcag

SEQ ID NO: 4745176 - DNA, 13 bp, Homo sapiens
ctcaatattttcc

SEQ ID NO: 4745177 - DNA, 19 bp, Homo sapiens
ctcaatattttccatgaaa

SEQ ID NO: 4745178 - DNA, 15 bp, Homo sapiens
ctcaatccctgagga

SEQ ID NO: 4745179 - DNA, 13 bp, Homo sapiens
ctcaatgcactga

SEQ ID NO: 4745180 - DNA, 19 bp, Homo sapiens
ctcaattccccctggccac

SEQ ID NO: 4745181 - DNA, 11 bp, Homo sapiens
ctcaattctgt

SEQ ID NO: 4745182 - DNA, 12 bp, Homo sapiens
ctcaattctgtc

SEQ ID NO: 4745183 - DNA, 19 bp, Homo sapiens
ctcaattcttccctatctt

SEQ ID NO: 4745184 - DNA, 15 bp, Homo sapiens
ctcaatttctcccca

SEQ ID NO: 4745185 - DNA, 15 bp, Homo sapiens
ctcaattttgtattt

SEQ ID NO: 4745186 - DNA, 24 bp, Homo sapiens
ctcacacatgagcatcaggccagg

SEQ ID NO: 4745187 - DNA, 12 bp, Homo sapiens
ctcacactgaga

SEQ ID NO: 4745188 - DNA, 19 bp, Homo sapiens
ctcacagtccttaccagca

SEQ ID NO: 4745189 - DNA, 17 bp, Homo sapiens
ctcacatctttttcact

SEQ ID NO: 4745190 - DNA, 22 bp, Homo sapiens
ctcacatgtcagtaccttcaaa

SEQ ID NO: 4745191 - DNA, 13 bp, Homo sapiens
ctcacatttatat

SEQ ID NO: 4745192 - DNA, 22 bp, Homo sapiens
ctcacatttattctgctcacat

SEQ ID NO: 4745193 - DNA, 17 bp, Homo sapiens
ctcaccacgtggggcca

SEQ ID NO: 4745194 - DNA, 15 bp, Homo sapiens
ctcaccagccccagt

SEQ ID NO: 4745195 - DNA, 12 bp, Homo sapiens
ctcaccccagcc

SEQ ID NO: 4745196 - DNA, 13 bp, Homo sapiens
ctcaccccagccc

SEQ ID NO: 4745197 - DNA, 14 bp, Homo sapiens
ctcaccccagcccc

SEQ ID NO: 4745198 - DNA, 17 bp, Homo sapiens
ctcacccccttctccat

SEQ ID NO: 4745199 - DNA, 18 bp, Homo sapiens
ctcacctaaaccctctgt

SEQ ID NO: 4745200 - DNA, 20 bp, Homo sapiens
ctcacctaaaccctctgtga

SEQ ID NO: 4745201 - DNA, 21 bp, Homo sapiens
ctcacctaaaccctctgtgaa

SEQ ID NO: 4745202 - DNA, 16 bp, Homo sapiens
ctcacctcccccatct

SEQ ID NO: 4745203 - DNA, 14 bp, Homo sapiens
ctcacgtcaaatgc

SEQ ID NO: 4745204 - DNA, 20 bp, Homo sapiens
ctcactatcccggctgccct

SEQ ID NO: 4745205 - DNA, 15 bp, Homo sapiens
ctcactatggtgcca

SEQ ID NO: 4745206 - DNA, 23 bp, Homo sapiens
ctcactatgttgcccaggcaggt

SEQ ID NO: 4745207 - DNA, 13 bp, Homo sapiens
ctcactcacattt

SEQ ID NO: 4745208 - DNA, 11 bp, Homo sapiens
ctcactctgtc

SEQ ID NO: 4745209 - DNA, 22 bp, Homo sapiens
ctcactctgtcgcccagtctgg

SEQ ID NO: 4745210 - DNA, 15 bp, Homo sapiens
ctcactgcagcctca

SEQ ID NO: 4745211 - DNA, 18 bp, Homo sapiens
ctcactgttgcccaggct

SEQ ID NO: 4745212 - DNA, 21 bp, Homo sapiens
ctcactgttgcccaggctggc

SEQ ID NO: 4745213 - DNA, 15 bp, Homo sapiens
ctcagaagacactga

SEQ ID NO: 4745214 - DNA, 22 bp, Homo sapiens
ctcagactctttttgtacctgg

SEQ ID NO: 4745215 - DNA, 22 bp, Homo sapiens
ctcagagacactgttgataaaa

SEQ ID NO: 4745216 - DNA, 15 bp, Homo sapiens
ctcagagaggacaaa

SEQ ID NO: 4745217 - DNA, 23 bp, Homo sapiens
ctcagagagggcaggcatgaagt

SEQ ID NO: 4745218 - DNA, 18 bp, Homo sapiens
ctcagagagggtgggagt

SEQ ID NO: 4745219 - DNA, 23 bp, Homo sapiens
ctcagagagggtgggagtgggcc

SEQ ID NO: 4745220 - DNA, 18 bp, Homo sapiens
ctcagagctacttgggcc

SEQ ID NO: 4745221 - DNA, 19 bp, Homo sapiens
ctcagagctacttgggcca

SEQ ID NO: 4745222 - DNA, 16 bp, Homo sapiens
ctcagagtatggagct

SEQ ID NO: 4745223 - DNA, 21 bp, Homo sapiens
ctcagatatcatactgatttt

SEQ ID NO: 4745224 - DNA, 18 bp, Homo sapiens
ctcagcatcctggcaccc

SEQ ID NO: 4745225 - DNA, 18 bp, Homo sapiens
ctcagccaggtgctgtga

SEQ ID NO: 4745226 - DNA, 19 bp, Homo sapiens
ctcagccccaccccagggc

SEQ ID NO: 4745227 - DNA, 22 bp, Homo sapiens
ctcagccccaccccagggcagc

SEQ ID NO: 4745228 - DNA, 15 bp, Homo sapiens
ctcagccgtgggccc

SEQ ID NO: 4745229 - DNA, 13 bp, Homo sapiens
ctcagcctcccaa

SEQ ID NO: 4745230 - DNA, 14 bp, Homo sapiens
ctcagcctcccaaa

SEQ ID NO: 4745231 - DNA, 21 bp, Homo sapiens
ctcagcctcccaaagtgctgg

SEQ ID NO: 4745232 - DNA, 22 bp, Homo sapiens
ctcagcctcccgaatagctggg

SEQ ID NO: 4745233 - DNA, 12 bp, Homo sapiens
ctcagcctcctg

SEQ ID NO: 4745234 - DNA, 16 bp, Homo sapiens
ctcagcggggacagct

SEQ ID NO: 4745235 - DNA, 18 bp, Homo sapiens
ctcagcggggacagctcc

SEQ ID NO: 4745236 - DNA, 19 bp, Homo sapiens
ctcagctccccagagtcct

SEQ ID NO: 4745237 - DNA, 21 bp, Homo sapiens
ctcaggaaatggcttttccca

SEQ ID NO: 4745238 - DNA, 20 bp, Homo sapiens
ctcaggaccaaagctttcat

SEQ ID NO: 4745239 - DNA, 21 bp, Homo sapiens
ctcaggaccaaagctttcatg

SEQ ID NO: 4745240 - DNA, 22 bp, Homo sapiens
ctcaggaccaaagctttcatgt

SEQ ID NO: 4745241 - DNA, 15 bp, Homo sapiens
ctcaggaccaggcaa

SEQ ID NO: 4745242 - DNA, 17 bp, Homo sapiens
ctcaggccaagcccaat

SEQ ID NO: 4745243 - DNA, 13 bp, Homo sapiens
ctcaggctgtccc

SEQ ID NO: 4745244 - DNA, 13 bp, Homo sapiens
ctcagggaaagca

SEQ ID NO: 4745245 - DNA, 12 bp, Homo sapiens
ctcagggaccac

SEQ ID NO: 4745246 - DNA, 15 bp, Homo sapiens
ctcagggaccacagc

SEQ ID NO: 4745247 - DNA, 14 bp, Homo sapiens
ctcagggcctggct

SEQ ID NO: 4745248 - DNA, 22 bp, Homo sapiens
ctcagggctaaacgggcattgc

SEQ ID NO: 4745249 - DNA, 15 bp, Homo sapiens
ctcagggctcctggg

SEQ ID NO: 4745250 - DNA, 14 bp, Homo sapiens
ctcagggtccctgg

SEQ ID NO: 4745251 - DNA, 20 bp, Homo sapiens
ctcagggtccctggtggcag

SEQ ID NO: 4745252 - DNA, 21 bp, Homo sapiens
ctcagggtccctggtggcagc

SEQ ID NO: 4745253 - DNA, 22 bp, Homo sapiens
ctcagggtccctggtggcagct

SEQ ID NO: 4745254 - DNA, 14 bp, Homo sapiens
ctcagggtctctgc

SEQ ID NO: 4745255 - DNA, 18 bp, Homo sapiens
ctcagggtctctgctgcc

SEQ ID NO: 4745256 - DNA, 19 bp, Homo sapiens
ctcagggtctctgctgccg

SEQ ID NO: 4745257 - DNA, 20 bp, Homo sapiens
ctcaggtaatcgacctgcct

SEQ ID NO: 4745258 - DNA, 13 bp, Homo sapiens
ctcaggtgaccaa

SEQ ID NO: 4745259 - DNA, 18 bp, Homo sapiens
ctcaggtgatccacccac

SEQ ID NO: 4745260 - DNA, 22 bp, Homo sapiens
ctcaggtgatccacccacctca

SEQ ID NO: 4745261 - DNA, 23 bp, Homo sapiens
ctcaggtgtccctgcacttgcag

SEQ ID NO: 4745262 - DNA, 19 bp, Homo sapiens
ctcagtaagacgacaagga

SEQ ID NO: 4745263 - DNA, 14 bp, Homo sapiens
ctcagtcatgcata

SEQ ID NO: 4745264 - DNA, 22 bp, Homo sapiens
ctcagtcatgcataaatatgca

SEQ ID NO: 4745265 - DNA, 17 bp, Homo sapiens
ctcagtccatagcagag

SEQ ID NO: 4745266 - DNA, 15 bp, Homo sapiens
ctcagtctccctccc

SEQ ID NO: 4745267 - DNA, 17 bp, Homo sapiens
ctcagtctccctccctt

SEQ ID NO: 4745268 - DNA, 13 bp, Homo sapiens
ctcagtctctgag

SEQ ID NO: 4745269 - DNA, 14 bp, Homo sapiens
ctcagtctctgagc

SEQ ID NO: 4745270 - DNA, 20 bp, Homo sapiens
ctcatagccctcaccctggg

SEQ ID NO: 4745271 - DNA, 19 bp, Homo sapiens
ctcatagtatggtggctgg

SEQ ID NO: 4745272 - DNA, 22 bp, Homo sapiens
ctcatcaccaacgtctgtgcca

SEQ ID NO: 4745273 - DNA, 15 bp, Homo sapiens
ctcatcagaactgaa

SEQ ID NO: 4745274 - DNA, 23 bp, Homo sapiens
ctcatcaggagttccagtgctgc

SEQ ID NO: 4745275 - DNA, 15 bp, Homo sapiens
ctcatcattctctgt

SEQ ID NO: 4745276 - DNA, 23 bp, Homo sapiens
ctcatcattctctgtctcatcca

SEQ ID NO: 4745277 - DNA, 19 bp, Homo sapiens
ctcatccatcatcatgtgt

SEQ ID NO: 4745278 - DNA, 15 bp, Homo sapiens
ctcatcctcataccc

SEQ ID NO: 4745279 - DNA, 17 bp, Homo sapiens
ctcatctgtccctccgg

SEQ ID NO: 4745280 - DNA, 17 bp, Homo sapiens
ctcatcttcttcaccat

SEQ ID NO: 4745281 - DNA, 12 bp, Homo sapiens
ctcatctttctt

SEQ ID NO: 4745282 - DNA, 15 bp, Homo sapiens
ctcatctttcttgat

SEQ ID NO: 4745283 - DNA, 16 bp, Homo sapiens
ctcatgcctcagcctc

SEQ ID NO: 4745284 - DNA, 21 bp, Homo sapiens
ctcatgcctgtaatcccagca

SEQ ID NO: 4745285 - DNA, 20 bp, Homo sapiens
ctcatggatttggttatgat

SEQ ID NO: 4745286 - DNA, 20 bp, Homo sapiens
ctcatggtgcatataaatat

SEQ ID NO: 4745287 - DNA, 17 bp, Homo sapiens
ctcatgtcatttctcat

SEQ ID NO: 4745288 - DNA, 13 bp, Homo sapiens
ctcattcttctgt

SEQ ID NO: 4745289 - DNA, 13 bp, Homo sapiens
ctcattgacctga

SEQ ID NO: 4745290 - DNA, 16 bp, Homo sapiens
ctcattgacctgaggc

SEQ ID NO: 4745291 - DNA, 19 bp, Homo sapiens
ctcattgacctgaggccct

SEQ ID NO: 4745292 - DNA, 13 bp, Homo sapiens
ctcattggaccct

SEQ ID NO: 4745293 - DNA, 17 bp, Homo sapiens
ctcattggacccttcca

SEQ ID NO: 4745294 - DNA, 18 bp, Homo sapiens
ctcattggacccttccat

SEQ ID NO: 4745295 - DNA, 14 bp, Homo sapiens
ctcatttcacccct

SEQ ID NO: 4745296 - DNA, 19 bp, Homo sapiens
ctcatttcacccctccctt

SEQ ID NO: 4745297 - DNA, 16 bp, Homo sapiens
ctcatttcaggagcag

SEQ ID NO: 4745298 - DNA, 13 bp, Homo sapiens
ctccaaatttaac

SEQ ID NO: 4745299 - DNA, 15 bp, Homo sapiens
ctccaaccccccagc

SEQ ID NO: 4745300 - DNA, 18 bp, Homo sapiens
ctccaaccccccagcact

SEQ ID NO: 4745301 - DNA, 19 bp, Homo sapiens
ctccaaccccccagcactg

SEQ ID NO: 4745302 - DNA, 23 bp, Homo sapiens
ctccaaccccccagcactgagga

SEQ ID NO: 4745303 - DNA, 13 bp, Homo sapiens
ctccaagctccca

SEQ ID NO: 4745304 - DNA, 16 bp, Homo sapiens
ctccaagctcccaggc

SEQ ID NO: 4745305 - DNA, 17 bp, Homo sapiens
ctccaaggtttataaag

SEQ ID NO: 4745306 - DNA, 19 bp, Homo sapiens
ctccaaggtttataaagca

SEQ ID NO: 4745307 - DNA, 20 bp, Homo sapiens
ctccaaggtttataaagcag

SEQ ID NO: 4745308 - DNA, 21 bp, Homo sapiens
ctccaaggtttataaagcaga

SEQ ID NO: 4745309 - DNA, 23 bp, Homo sapiens
ctccaagtcaggtggggtggagt

SEQ ID NO: 4745310 - DNA, 13 bp, Homo sapiens
ctccacatcctcc

SEQ ID NO: 4745311 - DNA, 15 bp, Homo sapiens
ctccacatcctccac

SEQ ID NO: 4745312 - DNA, 13 bp, Homo sapiens
ctccaccctgctc

SEQ ID NO: 4745313 - DNA, 16 bp, Homo sapiens
ctccaccgccatggct

SEQ ID NO: 4745314 - DNA, 20 bp, Homo sapiens
ctccacctagtggctgtcca

SEQ ID NO: 4745315 - DNA, 11 bp, Homo sapiens
ctccagacaca

SEQ ID NO: 4745316 - DNA, 17 bp, Homo sapiens
ctccagacacatgtcca

SEQ ID NO: 4745317 - DNA, 20 bp, Homo sapiens
ctccagagggcactctgctt

SEQ ID NO: 4745318 - DNA, 19 bp, Homo sapiens
ctccagcattctcagccac

SEQ ID NO: 4745319 - DNA, 20 bp, Homo sapiens
ctccagcattctcagccaca

SEQ ID NO: 4745320 - DNA, 22 bp, Homo sapiens
ctccagcattctcagccacaac

SEQ ID NO: 4745321 - DNA, 17 bp, Homo sapiens
ctccagcccctggatgc

SEQ ID NO: 4745322 - DNA, 11 bp, Homo sapiens
ctccagcctga

SEQ ID NO: 4745323 - DNA, 20 bp, Homo sapiens
ctccagcctgacaacagcct

SEQ ID NO: 4745324 - DNA, 21 bp, Homo sapiens
ctccagcctgacaacagcctg

SEQ ID NO: 4745325 - DNA, 22 bp, Homo sapiens
ctccagcctgacaacagcctga

SEQ ID NO: 4745326 - DNA, 16 bp, Homo sapiens
ctccagctcaccagcc

SEQ ID NO: 4745327 - DNA, 22 bp, Homo sapiens
ctccagctggccgggagcctga

SEQ ID NO: 4745328 - DNA, 19 bp, Homo sapiens
ctccagctgggttggaaaa

SEQ ID NO: 4745329 - DNA, 14 bp, Homo sapiens
ctccaggagcagcc

SEQ ID NO: 4745330 - DNA, 17 bp, Homo sapiens
ctccaggatttataaag

SEQ ID NO: 4745331 - DNA, 13 bp, Homo sapiens
ctccaggcaggct

SEQ ID NO: 4745332 - DNA, 11 bp, Homo sapiens
ctccaggctcc

SEQ ID NO: 4745333 - DNA, 15 bp, Homo sapiens
ctccaggctccttta

SEQ ID NO: 4745334 - DNA, 23 bp, Homo sapiens
ctccaggctgtatcccatgagcc

SEQ ID NO: 4745335 - DNA, 14 bp, Homo sapiens
ctccagggacagca

SEQ ID NO: 4745336 - DNA, 17 bp, Homo sapiens
ctccagggctggactga

SEQ ID NO: 4745337 - DNA, 19 bp, Homo sapiens
ctccaggtgcacaagctcc

SEQ ID NO: 4745338 - DNA, 20 bp, Homo sapiens
ctccatccacatgggagccg

SEQ ID NO: 4745339 - DNA, 16 bp, Homo sapiens
ctccatccctgaaatt

SEQ ID NO: 4745340 - DNA, 14 bp, Homo sapiens
ctccatcctccatg

SEQ ID NO: 4745341 - DNA, 20 bp, Homo sapiens
ctccatgggggctcagccag

SEQ ID NO: 4745342 - DNA, 13 bp, Homo sapiens
ctccatgtgggct

SEQ ID NO: 4745343 - DNA, 24 bp, Homo sapiens
ctccattcccgtggaacgtttttc

SEQ ID NO: 4745344 - DNA, 14 bp, Homo sapiens
ctccattttcttgt

SEQ ID NO: 4745345 - DNA, 13 bp, Homo sapiens
ctccatttttgtt

SEQ ID NO: 4745346 - DNA, 17 bp, Homo sapiens
ctcccaaagtgctggga

SEQ ID NO: 4745347 - DNA, 17 bp, Homo sapiens
ctcccaactcaccccag

SEQ ID NO: 4745348 - DNA, 11 bp, Homo sapiens
ctcccacagtg

SEQ ID NO: 4745349 - DNA, 12 bp, Homo sapiens
ctcccacagtga

SEQ ID NO: 4745350 - DNA, 18 bp, Homo sapiens
ctcccaccataatccctg

SEQ ID NO: 4745351 - DNA, 17 bp, Homo sapiens
ctcccacctcagcctcc

SEQ ID NO: 4745352 - DNA, 20 bp, Homo sapiens
ctcccactgcaacttgtgaa

SEQ ID NO: 4745353 - DNA, 19 bp, Homo sapiens
ctcccacttccctgacact

SEQ ID NO: 4745354 - DNA, 15 bp, Homo sapiens
ctcccaggcattccc

SEQ ID NO: 4745355 - DNA, 16 bp, Homo sapiens
ctcccagtacctcctg

SEQ ID NO: 4745356 - DNA, 19 bp, Homo sapiens
ctcccagtgtcttcctgtg

SEQ ID NO: 4745357 - DNA, 17 bp, Homo sapiens
ctcccataaccgctgat

SEQ ID NO: 4745358 - DNA, 18 bp, Homo sapiens
ctcccatctcacacatga

SEQ ID NO: 4745359 - DNA, 22 bp, Homo sapiens
ctcccatgactgcccagctctg

SEQ ID NO: 4745360 - DNA, 20 bp, Homo sapiens
ctccccaactgaccaccttt

SEQ ID NO: 4745361 - DNA, 20 bp, Homo sapiens
ctccccagagttccccatgc

SEQ ID NO: 4745362 - DNA, 22 bp, Homo sapiens
ctccccagcaagtgagagctgg

SEQ ID NO: 4745363 - DNA, 23 bp, Homo sapiens
ctccccagcaagtgagagctggg

SEQ ID NO: 4745364 - DNA, 17 bp, Homo sapiens
ctcccccgggaggggcc

SEQ ID NO: 4745365 - DNA, 18 bp, Homo sapiens
ctcccccgggaggggccc

SEQ ID NO: 4745366 - DNA, 21 bp, Homo sapiens
ctcccccgggaggggcccgct

SEQ ID NO: 4745367 - DNA, 16 bp, Homo sapiens
ctcccctgccagggca

SEQ ID NO: 4745368 - DNA, 21 bp, Homo sapiens
ctcccctgccagggcagggcc

SEQ ID NO: 4745369 - DNA, 15 bp, Homo sapiens
ctcccctgcccccag

SEQ ID NO: 4745370 - DNA, 19 bp, Homo sapiens
ctcccctgcccccaggact

SEQ ID NO: 4745371 - DNA, 21 bp, Homo sapiens
ctcccctgcccccaggactgg

SEQ ID NO: 4745372 - DNA, 15 bp, Homo sapiens
ctcccctgccccctg

SEQ ID NO: 4745373 - DNA, 20 bp, Homo sapiens
ctcccctgccccctgcagga

SEQ ID NO: 4745374 - DNA, 21 bp, Homo sapiens
ctcccctgctgggtgtggcgc

SEQ ID NO: 4745375 - DNA, 15 bp, Homo sapiens
ctcccgagtagctgg

SEQ ID NO: 4745376 - DNA, 17 bp, Homo sapiens
ctcccgagtagctggga

SEQ ID NO: 4745377 - DNA, 19 bp, Homo sapiens
ctcccgagtagctgggact

SEQ ID NO: 4745378 - DNA, 13 bp, Homo sapiens
ctcccgtcactcc

SEQ ID NO: 4745379 - DNA, 17 bp, Homo sapiens
ctccctcaattccccct

SEQ ID NO: 4745380 - DNA, 12 bp, Homo sapiens
ctccctcctggc

SEQ ID NO: 4745381 - DNA, 14 bp, Homo sapiens
ctccctcctggcca

SEQ ID NO: 4745382 - DNA, 23 bp, Homo sapiens
ctccctgccccccagccctcctt

SEQ ID NO: 4745383 - DNA, 18 bp, Homo sapiens
ctccctgctgtcccctct

SEQ ID NO: 4745384 - DNA, 18 bp, Homo sapiens
ctccctgggggcggccag

SEQ ID NO: 4745385 - DNA, 19 bp, Homo sapiens
ctcccttcatgcatggaaa

SEQ ID NO: 4745386 - DNA, 23 bp, Homo sapiens
ctcccttcccacctctctcactc

SEQ ID NO: 4745387 - DNA, 18 bp, Homo sapiens
ctcccttgggctccctgt

SEQ ID NO: 4745388 - DNA, 19 bp, Homo sapiens
ctcccttggggcctatgca

SEQ ID NO: 4745389 - DNA, 21 bp, Homo sapiens
ctccctttttccttgtcccca

SEQ ID NO: 4745390 - DNA, 23 bp, Homo sapiens
ctccctttttccttgtccccaca

SEQ ID NO: 4745391 - DNA, 15 bp, Homo sapiens
ctccgcctcccgggt

SEQ ID NO: 4745392 - DNA, 23 bp, Homo sapiens
ctccgctttctacccagcgagcc

SEQ ID NO: 4745393 - DNA, 13 bp, Homo sapiens
ctccgtggcacat

SEQ ID NO: 4745394 - DNA, 20 bp, Homo sapiens
ctcctactgcttcctctgaa

SEQ ID NO: 4745395 - DNA, 13 bp, Homo sapiens
ctcctccagggac

SEQ ID NO: 4745396 - DNA, 14 bp, Homo sapiens
ctcctccagggaca

SEQ ID NO: 4745397 - DNA, 15 bp, Homo sapiens
ctcctccatgggaga

SEQ ID NO: 4745398 - DNA, 15 bp, Homo sapiens
ctcctccccggagcc

SEQ ID NO: 4745399 - DNA, 22 bp, Homo sapiens
ctcctctccccagcaagtgaga

SEQ ID NO: 4745400 - DNA, 18 bp, Homo sapiens
ctcctctcccctaccact

SEQ ID NO: 4745401 - DNA, 20 bp, Homo sapiens
ctcctctgactcagggctcc

SEQ ID NO: 4745402 - DNA, 14 bp, Homo sapiens
ctcctctgctgctg

SEQ ID NO: 4745403 - DNA, 16 bp, Homo sapiens
ctcctctgctgctggc

SEQ ID NO: 4745404 - DNA, 18 bp, Homo sapiens
ctcctctgctgctggctg

SEQ ID NO: 4745405 - DNA, 13 bp, Homo sapiens
ctcctctgtgacc

SEQ ID NO: 4745406 - DNA, 20 bp, Homo sapiens
ctcctgagaaaaaaggttcc

SEQ ID NO: 4745407 - DNA, 18 bp, Homo sapiens
ctcctgcaggcagccagg

SEQ ID NO: 4745408 - DNA, 13 bp, Homo sapiens
ctcctgcctcagc

SEQ ID NO: 4745409 - DNA, 18 bp, Homo sapiens
ctcctgcctcgaactggc

SEQ ID NO: 4745410 - DNA, 14 bp, Homo sapiens
ctcctgctgcacca

SEQ ID NO: 4745411 - DNA, 18 bp, Homo sapiens
ctcctgctgcaccaaccc

SEQ ID NO: 4745412 - DNA, 12 bp, Homo sapiens
ctcctggccaga

SEQ ID NO: 4745413 - DNA, 19 bp, Homo sapiens
ctcctggcctcaagtgatt

SEQ ID NO: 4745414 - DNA, 19 bp, Homo sapiens
ctcctgggcccaagtgatc

SEQ ID NO: 4745415 - DNA, 12 bp, Homo sapiens
ctcctgggccct

SEQ ID NO: 4745416 - DNA, 20 bp, Homo sapiens
ctcctgggccctctctgctc

SEQ ID NO: 4745417 - DNA, 13 bp, Homo sapiens
ctcctgtgccctt

SEQ ID NO: 4745418 - DNA, 15 bp, Homo sapiens
ctcctgtgtcttgca

SEQ ID NO: 4745419 - DNA, 17 bp, Homo sapiens
ctccttaacactgagct

SEQ ID NO: 4745420 - DNA, 17 bp, Homo sapiens
ctccttagaagtggaag

SEQ ID NO: 4745421 - DNA, 16 bp, Homo sapiens
ctccttcacagatggg

SEQ ID NO: 4745422 - DNA, 19 bp, Homo sapiens
ctccttcacagatgggtgc

SEQ ID NO: 4745423 - DNA, 14 bp, Homo sapiens
ctccttcacctttg

SEQ ID NO: 4745424 - DNA, 19 bp, Homo sapiens
ctccttcatgacagcctcc

SEQ ID NO: 4745425 - DNA, 14 bp, Homo sapiens
ctccttcctggaga

SEQ ID NO: 4745426 - DNA, 20 bp, Homo sapiens
ctccttctgtcctactctgt

SEQ ID NO: 4745427 - DNA, 13 bp, Homo sapiens
ctccttgggccct

SEQ ID NO: 4745428 - DNA, 17 bp, Homo sapiens
ctccttgggccctttga

SEQ ID NO: 4745429 - DNA, 18 bp, Homo sapiens
ctccttgggccctttgag

SEQ ID NO: 4745430 - DNA, 16 bp, Homo sapiens
ctccttgtggcctggg

SEQ ID NO: 4745431 - DNA, 16 bp, Homo sapiens
ctcctttagcgcccag

SEQ ID NO: 4745432 - DNA, 17 bp, Homo sapiens
ctcctttagcgcccagt

SEQ ID NO: 4745433 - DNA, 15 bp, Homo sapiens
ctcctttcaccacat

SEQ ID NO: 4745434 - DNA, 16 bp, Homo sapiens
ctcgaactggctgcaa

SEQ ID NO: 4745435 - DNA, 20 bp, Homo sapiens
ctcgaatgtaattggaatct

SEQ ID NO: 4745436 - DNA, 19 bp, Homo sapiens
ctcgagaactttcattttt

SEQ ID NO: 4745437 - DNA, 17 bp, Homo sapiens
ctcgaggtttctcaaag

SEQ ID NO: 4745438 - DNA, 18 bp, Homo sapiens
ctcgatgtcctcctctgt

SEQ ID NO: 4745439 - DNA, 20 bp, Homo sapiens
ctcgatgtcctcctctgtga

SEQ ID NO: 4745440 - DNA, 18 bp, Homo sapiens
ctcgcccaccgcatgccc

SEQ ID NO: 4745441 - DNA, 15 bp, Homo sapiens
ctcgcccatcagtgc

SEQ ID NO: 4745442 - DNA, 15 bp, Homo sapiens
ctcgccttcatctcc

SEQ ID NO: 4745443 - DNA, 23 bp, Homo sapiens
ctcgctctgtcgcccaggctgga

SEQ ID NO: 4745444 - DNA, 19 bp, Homo sapiens
ctcgctgatgctgggctgg

SEQ ID NO: 4745445 - DNA, 20 bp, Homo sapiens
ctcgctgatgctgggctggg

SEQ ID NO: 4745446 - DNA, 15 bp, Homo sapiens
ctcgctggactctca

SEQ ID NO: 4745447 - DNA, 16 bp, Homo sapiens
ctcgctggactctcag

SEQ ID NO: 4745448 - DNA, 15 bp, Homo sapiens
ctcggctcctgctgc

SEQ ID NO: 4745449 - DNA, 20 bp, Homo sapiens
ctcgggattagtacacactt

SEQ ID NO: 4745450 - DNA, 12 bp, Homo sapiens
ctcgggcccagg

SEQ ID NO: 4745451 - DNA, 16 bp, Homo sapiens
ctcgggcccaggccat

SEQ ID NO: 4745452 - DNA, 24 bp, Homo sapiens
ctcgggcccaggccatcttccagg

SEQ ID NO: 4745453 - DNA, 17 bp, Homo sapiens
ctcgggctcctgtgccc

SEQ ID NO: 4745454 - DNA, 24 bp, Homo sapiens
ctcgtgccagtcgcgctgcctgtg

SEQ ID NO: 4745455 - DNA, 17 bp, Homo sapiens
ctcgtggtaggactgta

SEQ ID NO: 4745456 - DNA, 15 bp, Homo sapiens
ctctaaaattataaa

SEQ ID NO: 4745457 - DNA, 16 bp, Homo sapiens
ctctaaaccatggcac

SEQ ID NO: 4745458 - DNA, 13 bp, Homo sapiens
ctctacagaggcc

SEQ ID NO: 4745459 - DNA, 14 bp, Homo sapiens
ctctacagaggcca

SEQ ID NO: 4745460 - DNA, 15 bp, Homo sapiens
ctctaggctggggaa

SEQ ID NO: 4745461 - DNA, 16 bp, Homo sapiens
ctctagggacccctcc

SEQ ID NO: 4745462 - DNA, 13 bp, Homo sapiens
ctctagtccctgt

SEQ ID NO: 4745463 - DNA, 17 bp, Homo sapiens
ctctagtgcggtttact

SEQ ID NO: 4745464 - DNA, 22 bp, Homo sapiens
ctctatgggcagatctacccct

SEQ ID NO: 4745465 - DNA, 15 bp, Homo sapiens
ctctcactccttgaa

SEQ ID NO: 4745466 - DNA, 20 bp, Homo sapiens
ctctcagagctacttgggcc

SEQ ID NO: 4745467 - DNA, 21 bp, Homo sapiens
ctctcagagctacttgggcca

SEQ ID NO: 4745468 - DNA, 22 bp, Homo sapiens
ctctcaggctgtcccaagctcc

SEQ ID NO: 4745469 - DNA, 14 bp, Homo sapiens
ctctcagtctctga

SEQ ID NO: 4745470 - DNA, 16 bp, Homo sapiens
ctctcagtctctgagc

SEQ ID NO: 4745471 - DNA, 17 bp, Homo sapiens
ctctcagtctctgagca

SEQ ID NO: 4745472 - DNA, 17 bp, Homo sapiens
ctctcatctcttagctc

SEQ ID NO: 4745473 - DNA, 16 bp, Homo sapiens
ctctccaaaccacttt

SEQ ID NO: 4745474 - DNA, 17 bp, Homo sapiens
ctctccacctagtggct

SEQ ID NO: 4745475 - DNA, 23 bp, Homo sapiens
ctctccacctagtggctgtccag

SEQ ID NO: 4745476 - DNA, 15 bp, Homo sapiens
ctctccagcccctgg

SEQ ID NO: 4745477 - DNA, 17 bp, Homo sapiens
ctctccagcccctggat

SEQ ID NO: 4745478 - DNA, 13 bp, Homo sapiens
ctctccccagcaa

SEQ ID NO: 4745479 - DNA, 13 bp, Homo sapiens
ctctcccccaccc

SEQ ID NO: 4745480 - DNA, 19 bp, Homo sapiens
ctctcccctgccccctgca

SEQ ID NO: 4745481 - DNA, 13 bp, Homo sapiens
ctctccctcctgg

SEQ ID NO: 4745482 - DNA, 20 bp, Homo sapiens
ctctccgcacacctctggct

SEQ ID NO: 4745483 - DNA, 13 bp, Homo sapiens
ctctcctccgtgg

SEQ ID NO: 4745484 - DNA, 12 bp, Homo sapiens
ctctcctctgct

SEQ ID NO: 4745485 - DNA, 14 bp, Homo sapiens
ctctcctctgctgc

SEQ ID NO: 4745486 - DNA, 22 bp, Homo sapiens
ctctccttcatgacagcctcca

SEQ ID NO: 4745487 - DNA, 12 bp, Homo sapiens
ctctctaacata

SEQ ID NO: 4745488 - DNA, 17 bp, Homo sapiens
ctctctaattccacttg

SEQ ID NO: 4745489 - DNA, 13 bp, Homo sapiens
ctctctgccctaa

SEQ ID NO: 4745490 - DNA, 21 bp, Homo sapiens
ctctctgccctaatgcgcagg

SEQ ID NO: 4745491 - DNA, 22 bp, Homo sapiens
ctctcttagttcttaccttttg

SEQ ID NO: 4745492 - DNA, 18 bp, Homo sapiens
ctctcttgaccctgtcac

SEQ ID NO: 4745493 - DNA, 15 bp, Homo sapiens
ctctgacacacagct

SEQ ID NO: 4745494 - DNA, 16 bp, Homo sapiens
ctctgacccacagcct

SEQ ID NO: 4745495 - DNA, 11 bp, Homo sapiens
ctctgagctgt

SEQ ID NO: 4745496 - DNA, 13 bp, Homo sapiens
ctctgagctgtca

SEQ ID NO: 4745497 - DNA, 19 bp, Homo sapiens
ctctgagctgtcaacgaga

SEQ ID NO: 4745498 - DNA, 16 bp, Homo sapiens
ctctgagctgtgcagg

SEQ ID NO: 4745499 - DNA, 16 bp, Homo sapiens
ctctgaggacactaac

SEQ ID NO: 4745500 - DNA, 22 bp, Homo sapiens
ctctgaggcccgatctccactg

SEQ ID NO: 4745501 - DNA, 22 bp, Homo sapiens
ctctgagggtgatggggctgag

SEQ ID NO: 4745502 - DNA, 23 bp, Homo sapiens
ctctgagtcagctgaccccctcc

SEQ ID NO: 4745503 - DNA, 22 bp, Homo sapiens
ctctgatccctctacagagctt

SEQ ID NO: 4745504 - DNA, 14 bp, Homo sapiens
ctctgcaactgaat

SEQ ID NO: 4745505 - DNA, 16 bp, Homo sapiens
ctctgcactcccctgc

SEQ ID NO: 4745506 - DNA, 17 bp, Homo sapiens
ctctgcactcccctgct

SEQ ID NO: 4745507 - DNA, 20 bp, Homo sapiens
ctctgcactcccctgctggg

SEQ ID NO: 4745508 - DNA, 12 bp, Homo sapiens
ctctgcagcctc

SEQ ID NO: 4745509 - DNA, 16 bp, Homo sapiens
ctctgcagcctcagag

SEQ ID NO: 4745510 - DNA, 14 bp, Homo sapiens
ctctgccctccaag

SEQ ID NO: 4745511 - DNA, 16 bp, Homo sapiens
ctctgccctccaagac

SEQ ID NO: 4745512 - DNA, 17 bp, Homo sapiens
ctctgcctcccatcacc

SEQ ID NO: 4745513 - DNA, 21 bp, Homo sapiens
ctctgcctcccatcacccgct

SEQ ID NO: 4745514 - DNA, 13 bp, Homo sapiens
ctctgctcctctc

SEQ ID NO: 4745515 - DNA, 20 bp, Homo sapiens
ctctgctcctctccccagca

SEQ ID NO: 4745516 - DNA, 16 bp, Homo sapiens
ctctgctgaatgtaaa

SEQ ID NO: 4745517 - DNA, 14 bp, Homo sapiens
ctctgctgacagac

SEQ ID NO: 4745518 - DNA, 18 bp, Homo sapiens
ctctgctgacagacacag

SEQ ID NO: 4745519 - DNA, 19 bp, Homo sapiens
ctctgctgacagacacagg

SEQ ID NO: 4745520 - DNA, 14 bp, Homo sapiens
ctctggacaggcat

SEQ ID NO: 4745521 - DNA, 18 bp, Homo sapiens
ctctggacctctcttgtg

SEQ ID NO: 4745522 - DNA, 23 bp, Homo sapiens
ctctggcagctcagagagggtgg

SEQ ID NO: 4745523 - DNA, 21 bp, Homo sapiens
ctctgggtttacaacaaacac

SEQ ID NO: 4745524 - DNA, 22 bp, Homo sapiens
ctctgtatcaggacccagagga

SEQ ID NO: 4745525 - DNA, 14 bp, Homo sapiens
ctctgtccaggcac

SEQ ID NO: 4745526 - DNA, 19 bp, Homo sapiens
ctctgtccaggcactgaga

SEQ ID NO: 4745527 - DNA, 22 bp, Homo sapiens
ctctgtcccacttggcatcagc

SEQ ID NO: 4745528 - DNA, 21 bp, Homo sapiens
ctctgtccccttctctcatct

SEQ ID NO: 4745529 - DNA, 11 bp, Homo sapiens
ctctgtcctga

SEQ ID NO: 4745530 - DNA, 18 bp, Homo sapiens
ctctgtcgcccaggctgg

SEQ ID NO: 4745531 - DNA, 19 bp, Homo sapiens
ctctgtcgcccagtctgga

SEQ ID NO: 4745532 - DNA, 23 bp, Homo sapiens
ctctgtctcatgtgtgctcttct

SEQ ID NO: 4745533 - DNA, 13 bp, Homo sapiens
ctctgtgagactc

SEQ ID NO: 4745534 - DNA, 18 bp, Homo sapiens
ctctgtgagactcgagaa

SEQ ID NO: 4745535 - DNA, 20 bp, Homo sapiens
ctctgtgcacttatttatga

SEQ ID NO: 4745536 - DNA, 20 bp, Homo sapiens
ctctgtgcccatgggcactg

SEQ ID NO: 4745537 - DNA, 23 bp, Homo sapiens
ctctgtgcccatgggcactgctg

SEQ ID NO: 4745538 - DNA, 23 bp, Homo sapiens
ctctgtgggctgcactctgtgcc

SEQ ID NO: 4745539 - DNA, 17 bp, Homo sapiens
ctctgtgtaatagaata

SEQ ID NO: 4745540 - DNA, 22 bp, Homo sapiens
ctctgtgtaatagaataaaggc

SEQ ID NO: 4745541 - DNA, 13 bp, Homo sapiens
ctctgtttgcttg

SEQ ID NO: 4745542 - DNA, 18 bp, Homo sapiens
ctcttagctcccctccaa

SEQ ID NO: 4745543 - DNA, 19 bp, Homo sapiens
ctcttagctcccctccaac

SEQ ID NO: 4745544 - DNA, 23 bp, Homo sapiens
ctcttatctcagtcatgcataaa

SEQ ID NO: 4745545 - DNA, 14 bp, Homo sapiens
ctcttatgggctgg

SEQ ID NO: 4745546 - DNA, 19 bp, Homo sapiens
ctcttattgcccacgctgg

SEQ ID NO: 4745547 - DNA, 13 bp, Homo sapiens
ctcttcagaggcc

SEQ ID NO: 4745548 - DNA, 14 bp, Homo sapiens
ctcttccaggctgg

SEQ ID NO: 4745549 - DNA, 21 bp, Homo sapiens
ctcttccaggctgggagagcc

SEQ ID NO: 4745550 - DNA, 23 bp, Homo sapiens
ctcttccaggctgggagagcctt

SEQ ID NO: 4745551 - DNA, 12 bp, Homo sapiens
ctcttcccctct

SEQ ID NO: 4745552 - DNA, 14 bp, Homo sapiens
ctcttcccctctca

SEQ ID NO: 4745553 - DNA, 23 bp, Homo sapiens
ctcttctactacccccacagacc

SEQ ID NO: 4745554 - DNA, 12 bp, Homo sapiens
ctcttctcattt

SEQ ID NO: 4745555 - DNA, 15 bp, Homo sapiens
ctcttctcatttcac

SEQ ID NO: 4745556 - DNA, 12 bp, Homo sapiens
ctcttctccagg

SEQ ID NO: 4745557 - DNA, 15 bp, Homo sapiens
ctcttctccaggctg

SEQ ID NO: 4745558 - DNA, 13 bp, Homo sapiens
ctcttctccccag

SEQ ID NO: 4745559 - DNA, 22 bp, Homo sapiens
ctcttctgggagggcagcaggg

SEQ ID NO: 4745560 - DNA, 13 bp, Homo sapiens
ctcttgacctcag

SEQ ID NO: 4745561 - DNA, 12 bp, Homo sapiens
ctcttgccccaa

SEQ ID NO: 4745562 - DNA, 20 bp, Homo sapiens
ctcttgccccaacccccagc

SEQ ID NO: 4745563 - DNA, 22 bp, Homo sapiens
ctcttgccccaacccccagcac

SEQ ID NO: 4745564 - DNA, 16 bp, Homo sapiens
ctcttggtcctgctgc

SEQ ID NO: 4745565 - DNA, 23 bp, Homo sapiens
ctcttgtgaatattgtggctccc

SEQ ID NO: 4745566 - DNA, 20 bp, Homo sapiens
ctctttaatgtcacaggcag

SEQ ID NO: 4745567 - DNA, 17 bp, Homo sapiens
ctgaaaacactgtgcac

SEQ ID NO: 4745568 - DNA, 23 bp, Homo sapiens
ctgaaagggacgctacccgggaa

SEQ ID NO: 4745569 - DNA, 16 bp, Homo sapiens
ctgaaattattttctc

SEQ ID NO: 4745570 - DNA, 23 bp, Homo sapiens
ctgaactttcattggatttttgt

SEQ ID NO: 4745571 - DNA, 14 bp, Homo sapiens
ctgaactttgctga

SEQ ID NO: 4745572 - DNA, 20 bp, Homo sapiens
ctgaagaaatctttccagtt

SEQ ID NO: 4745573 - DNA, 12 bp, Homo sapiens
ctgaagagcatt

SEQ ID NO: 4745574 - DNA, 16 bp, Homo sapiens
ctgaagagtatttgaa

SEQ ID NO: 4745575 - DNA, 13 bp, Homo sapiens
ctgaaggactgtg

SEQ ID NO: 4745576 - DNA, 21 bp, Homo sapiens
ctgaaggactgtgacaggcag

SEQ ID NO: 4745577 - DNA, 22 bp, Homo sapiens
ctgaaggactgtgacaggcagc

SEQ ID NO: 4745578 - DNA, 17 bp, Homo sapiens
ctgaaggccccgcccag

SEQ ID NO: 4745579 - DNA, 21 bp, Homo sapiens
ctgaaggccccgcccaggctt

SEQ ID NO: 4745580 - DNA, 15 bp, Homo sapiens
ctgaagtcacacagt

SEQ ID NO: 4745581 - DNA, 21 bp, Homo sapiens
ctgaagtcacacagtgagtcg

SEQ ID NO: 4745582 - DNA, 13 bp, Homo sapiens
ctgaagtcttgca

SEQ ID NO: 4745583 - DNA, 14 bp, Homo sapiens
ctgaatacttgaag

SEQ ID NO: 4745584 - DNA, 19 bp, Homo sapiens
ctgaatacttgaagtagga

SEQ ID NO: 4745585 - DNA, 13 bp, Homo sapiens
ctgaatgtaaaag

SEQ ID NO: 4745586 - DNA, 16 bp, Homo sapiens
ctgaatgtaaaagaaa

SEQ ID NO: 4745587 - DNA, 17 bp, Homo sapiens
ctgaatgtaaaagaaaa

SEQ ID NO: 4745588 - DNA, 23 bp, Homo sapiens
ctgaatgtcattatttgataaca

SEQ ID NO: 4745589 - DNA, 23 bp, Homo sapiens
ctgacaacactcattgacctgag

SEQ ID NO: 4745590 - DNA, 16 bp, Homo sapiens
ctgacaacagcctgag

SEQ ID NO: 4745591 - DNA, 18 bp, Homo sapiens
ctgacaacagcctgagaa

SEQ ID NO: 4745592 - DNA, 22 bp, Homo sapiens
ctgacaatggtgttatttgaaa

SEQ ID NO: 4745593 - DNA, 16 bp, Homo sapiens
ctgacacacagctctg

SEQ ID NO: 4745594 - DNA, 20 bp, Homo sapiens
ctgacacacagctctgtcct

SEQ ID NO: 4745595 - DNA, 13 bp, Homo sapiens
ctgacactgcggg

SEQ ID NO: 4745596 - DNA, 12 bp, Homo sapiens
ctgacagacaca

SEQ ID NO: 4745597 - DNA, 16 bp, Homo sapiens
ctgacagacacaggcc

SEQ ID NO: 4745598 - DNA, 11 bp, Homo sapiens
ctgacaggcaa

SEQ ID NO: 4745599 - DNA, 16 bp, Homo sapiens
ctgacaggcaatgctg

SEQ ID NO: 4745600 - DNA, 21 bp, Homo sapiens
ctgacaggcaatgctggctgt

SEQ ID NO: 4745601 - DNA, 19 bp, Homo sapiens
ctgaccaatattgtacagt

SEQ ID NO: 4745602 - DNA, 21 bp, Homo sapiens
ctgaccaatattgtacagttt

SEQ ID NO: 4745603 - DNA, 19 bp, Homo sapiens
ctgacccatgctgccctgt

SEQ ID NO: 4745604 - DNA, 20 bp, Homo sapiens
ctgacccatgctgccctgtg

SEQ ID NO: 4745605 - DNA, 21 bp, Homo sapiens
ctgacccatgctgccctgtga

SEQ ID NO: 4745606 - DNA, 22 bp, Homo sapiens
ctgacccatgctgccctgtgag

SEQ ID NO: 4745607 - DNA, 17 bp, Homo sapiens
ctgacccctcatagccc

SEQ ID NO: 4745608 - DNA, 13 bp, Homo sapiens
ctgacgcagcctg

SEQ ID NO: 4745609 - DNA, 16 bp, Homo sapiens
ctgacgcagcctgaga

SEQ ID NO: 4745610 - DNA, 22 bp, Homo sapiens
ctgactaaaaatacttaaattt

SEQ ID NO: 4745611 - DNA, 16 bp, Homo sapiens
ctgactcagggctcct

SEQ ID NO: 4745612 - DNA, 22 bp, Homo sapiens
ctgacttcaggggctgcccgct

SEQ ID NO: 4745613 - DNA, 22 bp, Homo sapiens
ctgagaacactgtgaaaacatt

SEQ ID NO: 4745614 - DNA, 19 bp, Homo sapiens
ctgagaatgacctgccctg

SEQ ID NO: 4745615 - DNA, 19 bp, Homo sapiens
ctgagaatgtaagaactac

SEQ ID NO: 4745616 - DNA, 15 bp, Homo sapiens
ctgagacagcccggg

SEQ ID NO: 4745617 - DNA, 19 bp, Homo sapiens
ctgagacagcccgggctct

SEQ ID NO: 4745618 - DNA, 21 bp, Homo sapiens
ctgagactctcttaggagcag

SEQ ID NO: 4745619 - DNA, 14 bp, Homo sapiens
ctgagagctgggct

SEQ ID NO: 4745620 - DNA, 17 bp, Homo sapiens
ctgagagctgggctttc

SEQ ID NO: 4745621 - DNA, 21 bp, Homo sapiens
ctgagaggacttttctttgtg

SEQ ID NO: 4745622 - DNA, 22 bp, Homo sapiens
ctgagaggacttttctttgtgg

SEQ ID NO: 4745623 - DNA, 18 bp, Homo sapiens
ctgagatgcaaatgtcac

SEQ ID NO: 4745624 - DNA, 14 bp, Homo sapiens
ctgagatttcatct

SEQ ID NO: 4745625 - DNA, 23 bp, Homo sapiens
ctgagcaagagagagagagaatg

SEQ ID NO: 4745626 - DNA, 19 bp, Homo sapiens
ctgagcagaatactggtct

SEQ ID NO: 4745627 - DNA, 14 bp, Homo sapiens
ctgagccacactga

SEQ ID NO: 4745628 - DNA, 17 bp, Homo sapiens
ctgagccatcatttcct

SEQ ID NO: 4745629 - DNA, 14 bp, Homo sapiens
ctgagcgctcctgc

SEQ ID NO: 4745630 - DNA, 13 bp, Homo sapiens
ctgagctgaggca

SEQ ID NO: 4745631 - DNA, 18 bp, Homo sapiens
ctgagctgaggcagcagt

SEQ ID NO: 4745632 - DNA, 17 bp, Homo sapiens
ctgagctgttatcttgt

SEQ ID NO: 4745633 - DNA, 22 bp, Homo sapiens
ctgagcttgcagagatgaggcc

SEQ ID NO: 4745634 - DNA, 23 bp, Homo sapiens
ctgaggaagaacggggctcttct

SEQ ID NO: 4745635 - DNA, 21 bp, Homo sapiens
ctgaggaatccagacccggct

SEQ ID NO: 4745636 - DNA, 22 bp, Homo sapiens
ctgaggatattcagatgtatgt

SEQ ID NO: 4745637 - DNA, 22 bp, Homo sapiens
ctgaggcaagccatggagtgag

SEQ ID NO: 4745638 - DNA, 15 bp, Homo sapiens
ctgaggcccttctct

SEQ ID NO: 4745639 - DNA, 19 bp, Homo sapiens
ctgaggcccttctctccag

SEQ ID NO: 4745640 - DNA, 22 bp, Homo sapiens
ctgaggcccttctctccagccc

SEQ ID NO: 4745641 - DNA, 18 bp, Homo sapiens
ctgaggcctgagcgctcc

SEQ ID NO: 4745642 - DNA, 16 bp, Homo sapiens
ctgaggctgggctccc

SEQ ID NO: 4745643 - DNA, 22 bp, Homo sapiens
ctgaggctgggctcccttccca

SEQ ID NO: 4745644 - DNA, 13 bp, Homo sapiens
ctgagggagcctg

SEQ ID NO: 4745645 - DNA, 16 bp, Homo sapiens
ctgagggcagtcgata

SEQ ID NO: 4745646 - DNA, 22 bp, Homo sapiens
ctgagggggaagtgagaagggc

SEQ ID NO: 4745647 - DNA, 17 bp, Homo sapiens
ctgagtcagctgacccc

SEQ ID NO: 4745648 - DNA, 18 bp, Homo sapiens
ctgagtctgaaggctggg

SEQ ID NO: 4745649 - DNA, 21 bp, Homo sapiens
ctgagtctggcaaacatgtgc

SEQ ID NO: 4745650 - DNA, 22 bp, Homo sapiens
ctgagtctggcaaacatgtgca

SEQ ID NO: 4745651 - DNA, 23 bp, Homo sapiens
ctgataaaaccatgtagaaaatt

SEQ ID NO: 4745652 - DNA, 17 bp, Homo sapiens
ctgataacaacctggag

SEQ ID NO: 4745653 - DNA, 18 bp, Homo sapiens
ctgataacaacctggaga

SEQ ID NO: 4745654 - DNA, 13 bp, Homo sapiens
ctgatacgtgtat

SEQ ID NO: 4745655 - DNA, 20 bp, Homo sapiens
ctgatactttgacagtgttt

SEQ ID NO: 4745656 - DNA, 15 bp, Homo sapiens
ctgatcacctgccct

SEQ ID NO: 4745657 - DNA, 13 bp, Homo sapiens
ctgatccctctac

SEQ ID NO: 4745658 - DNA, 20 bp, Homo sapiens
ctgatcctagttccaccatc

SEQ ID NO: 4745659 - DNA, 18 bp, Homo sapiens
ctgatgaaaataaagaat

SEQ ID NO: 4745660 - DNA, 13 bp, Homo sapiens
ctgatgacctggg

SEQ ID NO: 4745661 - DNA, 17 bp, Homo sapiens
ctgatgctgggctgggt

SEQ ID NO: 4745662 - DNA, 18 bp, Homo sapiens
ctgatgctgggctgggtg

SEQ ID NO: 4745663 - DNA, 19 bp, Homo sapiens
ctgatgcttcttcagagac

SEQ ID NO: 4745664 - DNA, 20 bp, Homo sapiens
ctgatgcttcttcagagact

SEQ ID NO: 4745665 - DNA, 15 bp, Homo sapiens
ctgatggagagtgag

SEQ ID NO: 4745666 - DNA, 16 bp, Homo sapiens
ctgatggcaggatggc

SEQ ID NO: 4745667 - DNA, 17 bp, Homo sapiens
ctgatggcaggatggcc

SEQ ID NO: 4745668 - DNA, 18 bp, Homo sapiens
ctgatgggcaacccccag

SEQ ID NO: 4745669 - DNA, 15 bp, Homo sapiens
ctgatgtcctcacca

SEQ ID NO: 4745670 - DNA, 16 bp, Homo sapiens
ctgatgttactgagat

SEQ ID NO: 4745671 - DNA, 20 bp, Homo sapiens
ctgatgttactgagatgttt

SEQ ID NO: 4745672 - DNA, 15 bp, Homo sapiens
ctgatgtttataaac

SEQ ID NO: 4745673 - DNA, 18 bp, Homo sapiens
ctgatgtttataaactga

SEQ ID NO: 4745674 - DNA, 21 bp, Homo sapiens
ctgatgtttataaactgagag

SEQ ID NO: 4745675 - DNA, 17 bp, Homo sapiens
ctgattgtgtctcttgg

SEQ ID NO: 4745676 - DNA, 13 bp, Homo sapiens
ctgatttagaaaa

SEQ ID NO: 4745677 - DNA, 17 bp, Homo sapiens
ctgcaaaaggactctca

SEQ ID NO: 4745678 - DNA, 15 bp, Homo sapiens
ctgcaaagcccagct

SEQ ID NO: 4745679 - DNA, 22 bp, Homo sapiens
ctgcaacctccgcctcttgggt

SEQ ID NO: 4745680 - DNA, 14 bp, Homo sapiens
ctgcaacctgattg

SEQ ID NO: 4745681 - DNA, 21 bp, Homo sapiens
ctgcaacctgattgtgtctct

SEQ ID NO: 4745682 - DNA, 18 bp, Homo sapiens
ctgcaacttgtaaatgtg

SEQ ID NO: 4745683 - DNA, 12 bp, Homo sapiens
ctgcaagggagt

SEQ ID NO: 4745684 - DNA, 16 bp, Homo sapiens
ctgcacaaactcacca

SEQ ID NO: 4745685 - DNA, 15 bp, Homo sapiens
ctgcacaataaaacc

SEQ ID NO: 4745686 - DNA, 23 bp, Homo sapiens
ctgcacagggtttggcccaagtt

SEQ ID NO: 4745687 - DNA, 13 bp, Homo sapiens
ctgcaccccctcc

SEQ ID NO: 4745688 - DNA, 16 bp, Homo sapiens
ctgcaccccctcctgc

SEQ ID NO: 4745689 - DNA, 18 bp, Homo sapiens
ctgcaccccctcctgctg

SEQ ID NO: 4745690 - DNA, 15 bp, Homo sapiens
ctgcaccggctggcc

SEQ ID NO: 4745691 - DNA, 18 bp, Homo sapiens
ctgcaccggctggcctgg

SEQ ID NO: 4745692 - DNA, 13 bp, Homo sapiens
ctgcaccttctga

SEQ ID NO: 4745693 - DNA, 14 bp, Homo sapiens
ctgcaccttctgac

SEQ ID NO: 4745694 - DNA, 16 bp, Homo sapiens
ctgcactatagcctag

SEQ ID NO: 4745695 - DNA, 23 bp, Homo sapiens
ctgcactatagcctaggtgacag

SEQ ID NO: 4745696 - DNA, 15 bp, Homo sapiens
ctgcactcccctgct

SEQ ID NO: 4745697 - DNA, 19 bp, Homo sapiens
ctgcactgtcctgctccac

SEQ ID NO: 4745698 - DNA, 20 bp, Homo sapiens
ctgcactgtcctgctccaca

SEQ ID NO: 4745699 - DNA, 23 bp, Homo sapiens
ctgcactgtcctgctccacagtg

SEQ ID NO: 4745700 - DNA, 18 bp, Homo sapiens
ctgcacttgcagactcta

SEQ ID NO: 4745701 - DNA, 23 bp, Homo sapiens
ctgcacttgcggttccggcatgg

SEQ ID NO: 4745702 - DNA, 13 bp, Homo sapiens
ctgcagaggggca

SEQ ID NO: 4745703 - DNA, 19 bp, Homo sapiens
ctgcagaggggcaggccct

SEQ ID NO: 4745704 - DNA, 21 bp, Homo sapiens
ctgcagaggggcaggccctgc

SEQ ID NO: 4745705 - DNA, 14 bp, Homo sapiens
ctgcagatttgata

SEQ ID NO: 4745706 - DNA, 19 bp, Homo sapiens
ctgcagatttgggctggaa

SEQ ID NO: 4745707 - DNA, 14 bp, Homo sapiens
ctgcagcagggcag

SEQ ID NO: 4745708 - DNA, 11 bp, Homo sapiens
ctgcagcctca

SEQ ID NO: 4745709 - DNA, 20 bp, Homo sapiens
ctgcagcctcaacctcctgg

SEQ ID NO: 4745710 - DNA, 24 bp, Homo sapiens
ctgcagcctcaacctcctgggcta

SEQ ID NO: 4745711 - DNA, 13 bp, Homo sapiens
ctgcagcctcaga

SEQ ID NO: 4745712 - DNA, 15 bp, Homo sapiens
ctgcagcgcgcacac

SEQ ID NO: 4745713 - DNA, 22 bp, Homo sapiens
ctgcaggaaggagctgcctgga

SEQ ID NO: 4745714 - DNA, 14 bp, Homo sapiens
ctgcaggcagccag

SEQ ID NO: 4745715 - DNA, 15 bp, Homo sapiens
ctgcaggcagccagg

SEQ ID NO: 4745716 - DNA, 17 bp, Homo sapiens
ctgcaggcatcacagct

SEQ ID NO: 4745717 - DNA, 19 bp, Homo sapiens
ctgcagttgccagtcaccc

SEQ ID NO: 4745718 - DNA, 15 bp, Homo sapiens
ctgcataatgtttct

SEQ ID NO: 4745719 - DNA, 19 bp, Homo sapiens
ctgcatcctccgcctcccg

SEQ ID NO: 4745720 - DNA, 15 bp, Homo sapiens
ctgcattggaactgg

SEQ ID NO: 4745721 - DNA, 16 bp, Homo sapiens
ctgcattggaactgga

SEQ ID NO: 4745722 - DNA, 19 bp, Homo sapiens
ctgcattggaactggaggc

SEQ ID NO: 4745723 - DNA, 21 bp, Homo sapiens
ctgcattggaactggaggcag

SEQ ID NO: 4745724 - DNA, 23 bp, Homo sapiens
ctgcattggaactggaggcaggg

SEQ ID NO: 4745725 - DNA, 23 bp, Homo sapiens
ctgccacagcctcccctgccagg

SEQ ID NO: 4745726 - DNA, 12 bp, Homo sapiens
ctgccaccctgg

SEQ ID NO: 4745727 - DNA, 14 bp, Homo sapiens
ctgccaccctgggg

SEQ ID NO: 4745728 - DNA, 14 bp, Homo sapiens
ctgccacctcctgc

SEQ ID NO: 4745729 - DNA, 16 bp, Homo sapiens
ctgccacctcctgcct

SEQ ID NO: 4745730 - DNA, 19 bp, Homo sapiens
ctgccacctcctgcctcag

SEQ ID NO: 4745731 - DNA, 13 bp, Homo sapiens
ctgccacctggac

SEQ ID NO: 4745732 - DNA, 20 bp, Homo sapiens
ctgccacctggacccctgca

SEQ ID NO: 4745733 - DNA, 21 bp, Homo sapiens
ctgccacctggacccctgcat

SEQ ID NO: 4745734 - DNA, 12 bp, Homo sapiens
ctgccagggcag

SEQ ID NO: 4745735 - DNA, 13 bp, Homo sapiens
ctgccagggcagg

SEQ ID NO: 4745736 - DNA, 21 bp, Homo sapiens
ctgccatccaggttcagcttg

SEQ ID NO: 4745737 - DNA, 13 bp, Homo sapiens
ctgcccaaattat

SEQ ID NO: 4745738 - DNA, 18 bp, Homo sapiens
ctgcccaaattatgtgaa

SEQ ID NO: 4745739 - DNA, 21 bp, Homo sapiens
ctgcccaattttgcagggagc

SEQ ID NO: 4745740 - DNA, 20 bp, Homo sapiens
ctgcccacctccttccagca

SEQ ID NO: 4745741 - DNA, 19 bp, Homo sapiens
ctgcccacctggcctctgc

SEQ ID NO: 4745742 - DNA, 15 bp, Homo sapiens
ctgcccactccctgc

SEQ ID NO: 4745743 - DNA, 12 bp, Homo sapiens
ctgcccagctct

SEQ ID NO: 4745744 - DNA, 20 bp, Homo sapiens
ctgcccaggacggggccggc

SEQ ID NO: 4745745 - DNA, 14 bp, Homo sapiens
ctgcccaggcccct

SEQ ID NO: 4745746 - DNA, 16 bp, Homo sapiens
ctgcccaggcccctgc

SEQ ID NO: 4745747 - DNA, 13 bp, Homo sapiens
ctgcccccaggac

SEQ ID NO: 4745748 - DNA, 15 bp, Homo sapiens
ctgcccccaggactg

SEQ ID NO: 4745749 - DNA, 18 bp, Homo sapiens
ctgcccccaggactgggc

SEQ ID NO: 4745750 - DNA, 13 bp, Homo sapiens
ctgccccccagcc

SEQ ID NO: 4745751 - DNA, 15 bp, Homo sapiens
ctgccccctctgccc

SEQ ID NO: 4745752 - DNA, 16 bp, Homo sapiens
ctgccccctctgccct

SEQ ID NO: 4745753 - DNA, 17 bp, Homo sapiens
ctgccccctctgccctg

SEQ ID NO: 4745754 - DNA, 16 bp, Homo sapiens
ctgccccctgcaggaa

SEQ ID NO: 4745755 - DNA, 15 bp, Homo sapiens
ctgcccctccctgct

SEQ ID NO: 4745756 - DNA, 21 bp, Homo sapiens
ctgcccctcctctctgcccta

SEQ ID NO: 4745757 - DNA, 17 bp, Homo sapiens
ctgcccgctcccagtgt

SEQ ID NO: 4745758 - DNA, 16 bp, Homo sapiens
ctgcccggcgccctct

SEQ ID NO: 4745759 - DNA, 17 bp, Homo sapiens
ctgcccggcgccctctg

SEQ ID NO: 4745760 - DNA, 22 bp, Homo sapiens
ctgcccggcgccctctgtcctg

SEQ ID NO: 4745761 - DNA, 21 bp, Homo sapiens
ctgccctaatgcgcaggctgg

SEQ ID NO: 4745762 - DNA, 13 bp, Homo sapiens
ctgccctgcccac

SEQ ID NO: 4745763 - DNA, 16 bp, Homo sapiens
ctgccctgcccacctg

SEQ ID NO: 4745764 - DNA, 21 bp, Homo sapiens
ctgccctgcccacctggcctc

SEQ ID NO: 4745765 - DNA, 20 bp, Homo sapiens
ctgccctgcgggtcacagga

SEQ ID NO: 4745766 - DNA, 11 bp, Homo sapiens
ctgccctggga

SEQ ID NO: 4745767 - DNA, 15 bp, Homo sapiens
ctgccctgggaggca

SEQ ID NO: 4745768 - DNA, 17 bp, Homo sapiens
ctgccctggtggccctc

SEQ ID NO: 4745769 - DNA, 17 bp, Homo sapiens
ctgccctggtttcctgc

SEQ ID NO: 4745770 - DNA, 12 bp, Homo sapiens
ctgccctgtgag

SEQ ID NO: 4745771 - DNA, 24 bp, Homo sapiens
ctgccctgtgagtactacagtcct

SEQ ID NO: 4745772 - DNA, 11 bp, Homo sapiens
ctgccctgtgg

SEQ ID NO: 4745773 - DNA, 19 bp, Homo sapiens
ctgcccttgctccagcctg

SEQ ID NO: 4745774 - DNA, 22 bp, Homo sapiens
ctgcccttgctccagcctgaca

SEQ ID NO: 4745775 - DNA, 21 bp, Homo sapiens
ctgccctttctgggcaccggg

SEQ ID NO: 4745776 - DNA, 14 bp, Homo sapiens
ctgccgcagagctg

SEQ ID NO: 4745777 - DNA, 15 bp, Homo sapiens
ctgccgcagagctgg

SEQ ID NO: 4745778 - DNA, 13 bp, Homo sapiens
ctgcctcagcctc

SEQ ID NO: 4745779 - DNA, 17 bp, Homo sapiens
ctgcctcagcctcccga

SEQ ID NO: 4745780 - DNA, 17 bp, Homo sapiens
ctgcctccactcccact

SEQ ID NO: 4745781 - DNA, 22 bp, Homo sapiens
ctgcctccagggctggactgag

SEQ ID NO: 4745782 - DNA, 21 bp, Homo sapiens
ctgcctcccttcatgcatgga

SEQ ID NO: 4745783 - DNA, 23 bp, Homo sapiens
ctgcctcccttcatgcatggaaa

SEQ ID NO: 4745784 - DNA, 14 bp, Homo sapiens
ctgcctcgaactgg

SEQ ID NO: 4745785 - DNA, 19 bp, Homo sapiens
ctgcctcgaactggctgca

SEQ ID NO: 4745786 - DNA, 22 bp, Homo sapiens
ctgcctcttctgggagggcagc

SEQ ID NO: 4745787 - DNA, 15 bp, Homo sapiens
ctgcctgaagtcaca

SEQ ID NO: 4745788 - DNA, 16 bp, Homo sapiens
ctgcctgaagtcacac

SEQ ID NO: 4745789 - DNA, 19 bp, Homo sapiens
ctgcctgaagtcacacagt

SEQ ID NO: 4745790 - DNA, 16 bp, Homo sapiens
ctgcctgatggacctg

SEQ ID NO: 4745791 - DNA, 13 bp, Homo sapiens
ctgcctgcccagg

SEQ ID NO: 4745792 - DNA, 15 bp, Homo sapiens
ctgcctgcccaggcc

SEQ ID NO: 4745793 - DNA, 16 bp, Homo sapiens
ctgcctgcccaggccc

SEQ ID NO: 4745794 - DNA, 11 bp, Homo sapiens
ctgcctggacc

SEQ ID NO: 4745795 - DNA, 12 bp, Homo sapiens
ctgcctggaccc

SEQ ID NO: 4745796 - DNA, 22 bp, Homo sapiens
ctgcctggacttggcccctgcc

SEQ ID NO: 4745797 - DNA, 14 bp, Homo sapiens
ctgcctgttcagct

SEQ ID NO: 4745798 - DNA, 15 bp, Homo sapiens
ctgcctgttcagctc

SEQ ID NO: 4745799 - DNA, 18 bp, Homo sapiens
ctgcctgttcagctccag

SEQ ID NO: 4745800 - DNA, 20 bp, Homo sapiens
ctgccttaaagtcagtaact

SEQ ID NO: 4745801 - DNA, 16 bp, Homo sapiens
ctgccttcctcctggg

SEQ ID NO: 4745802 - DNA, 14 bp, Homo sapiens
ctgccttctcaggg

SEQ ID NO: 4745803 - DNA, 21 bp, Homo sapiens
ctgccttgaaatacctgtttc

SEQ ID NO: 4745804 - DNA, 23 bp, Homo sapiens
ctgccttgaaatacctgtttctt

SEQ ID NO: 4745805 - DNA, 15 bp, Homo sapiens
ctgcggggcttggct

SEQ ID NO: 4745806 - DNA, 15 bp, Homo sapiens
ctgcgggtcacagga

SEQ ID NO: 4745807 - DNA, 15 bp, Homo sapiens
ctgcggtccacccag

SEQ ID NO: 4745808 - DNA, 18 bp, Homo sapiens
ctgcggtgctatctcccc

SEQ ID NO: 4745809 - DNA, 22 bp, Homo sapiens
ctgcggtgctatctcccccagc

SEQ ID NO: 4745810 - DNA, 16 bp, Homo sapiens
ctgcgtgtgtctgtgt

SEQ ID NO: 4745811 - DNA, 18 bp, Homo sapiens
ctgctaaatttttgttgg

SEQ ID NO: 4745812 - DNA, 19 bp, Homo sapiens
ctgctaccctccctgctgt

SEQ ID NO: 4745813 - DNA, 17 bp, Homo sapiens
ctgctagtgctgtaata

SEQ ID NO: 4745814 - DNA, 22 bp, Homo sapiens
ctgctcacatctgaatctcctt

SEQ ID NO: 4745815 - DNA, 18 bp, Homo sapiens
ctgctcatcattctctgt

SEQ ID NO: 4745816 - DNA, 13 bp, Homo sapiens
ctgctccaaattt

SEQ ID NO: 4745817 - DNA, 19 bp, Homo sapiens
ctgctccacagccatccca

SEQ ID NO: 4745818 - DNA, 16 bp, Homo sapiens
ctgctccacagtgttg

SEQ ID NO: 4745819 - DNA, 13 bp, Homo sapiens
ctgctcgggccca

SEQ ID NO: 4745820 - DNA, 19 bp, Homo sapiens
ctgctcgggcccaggccat

SEQ ID NO: 4745821 - DNA, 13 bp, Homo sapiens
ctgctctccttcc

SEQ ID NO: 4745822 - DNA, 19 bp, Homo sapiens
ctgctctccttcctggagc

SEQ ID NO: 4745823 - DNA, 20 bp, Homo sapiens
ctgctctgcgtgtcacctgt

SEQ ID NO: 4745824 - DNA, 21 bp, Homo sapiens
ctgctctgcgtgtcacctgtg

SEQ ID NO: 4745825 - DNA, 22 bp, Homo sapiens
ctgctctgcgtgtcacctgtgc

SEQ ID NO: 4745826 - DNA, 19 bp, Homo sapiens
ctgctcttgaactcctgac

SEQ ID NO: 4745827 - DNA, 19 bp, Homo sapiens
ctgctgaatttataaaaat

SEQ ID NO: 4745828 - DNA, 15 bp, Homo sapiens
ctgctgacagacaca

SEQ ID NO: 4745829 - DNA, 21 bp, Homo sapiens
ctgctgacagacacaggcccg

SEQ ID NO: 4745830 - DNA, 15 bp, Homo sapiens
ctgctgacagtgttg

SEQ ID NO: 4745831 - DNA, 19 bp, Homo sapiens
ctgctgagtcccaggctga

SEQ ID NO: 4745832 - DNA, 20 bp, Homo sapiens
ctgctgcaccaacccagccg

SEQ ID NO: 4745833 - DNA, 16 bp, Homo sapiens
ctgctgcagaggggca

SEQ ID NO: 4745834 - DNA, 10 bp, Homo sapiens
ctgctgcagt

SEQ ID NO: 4745835 - DNA, 15 bp, Homo sapiens
ctgctgcagttgcca

SEQ ID NO: 4745836 - DNA, 12 bp, Homo sapiens
ctgctgcccagg

SEQ ID NO: 4745837 - DNA, 19 bp, Homo sapiens
ctgctgccgccccacccag

SEQ ID NO: 4745838 - DNA, 20 bp, Homo sapiens
ctgctgccgccccacccaga

SEQ ID NO: 4745839 - DNA, 12 bp, Homo sapiens
ctgctgctggct

SEQ ID NO: 4745840 - DNA, 14 bp, Homo sapiens
ctgctgctggctgg

SEQ ID NO: 4745841 - DNA, 15 bp, Homo sapiens
ctgctgctggctggt

SEQ ID NO: 4745842 - DNA, 21 bp, Homo sapiens
ctgctggctggtgcctgagcc

SEQ ID NO: 4745843 - DNA, 14 bp, Homo sapiens
ctgctgggctgggg

SEQ ID NO: 4745844 - DNA, 11 bp, Homo sapiens
ctgctgggtgg

SEQ ID NO: 4745845 - DNA, 12 bp, Homo sapiens
ctgctgggtggc

SEQ ID NO: 4745846 - DNA, 14 bp, Homo sapiens
ctgctgggtggccc

SEQ ID NO: 4745847 - DNA, 15 bp, Homo sapiens
ctgctgggtggccca

SEQ ID NO: 4745848 - DNA, 17 bp, Homo sapiens
ctgctgggtggcccatc

SEQ ID NO: 4745849 - DNA, 15 bp, Homo sapiens
ctgctgggtgtggcg

SEQ ID NO: 4745850 - DNA, 13 bp, Homo sapiens
ctgctggttcagg

SEQ ID NO: 4745851 - DNA, 15 bp, Homo sapiens
ctgctggttcagggt

SEQ ID NO: 4745852 - DNA, 23 bp, Homo sapiens
ctgctggttcagggttggcccct

SEQ ID NO: 4745853 - DNA, 14 bp, Homo sapiens
ctgctgtcccctct

SEQ ID NO: 4745854 - DNA, 23 bp, Homo sapiens
ctgctgtgaatttgtgtaaggat

SEQ ID NO: 4745855 - DNA, 13 bp, Homo sapiens
ctgctgtggaaag

SEQ ID NO: 4745856 - DNA, 15 bp, Homo sapiens
ctgctgtggaaagga

SEQ ID NO: 4745857 - DNA, 23 bp, Homo sapiens
ctgcttactcatgtccctattta

SEQ ID NO: 4745858 - DNA, 21 bp, Homo sapiens
ctgcttcaatacccaaatcct

SEQ ID NO: 4745859 - DNA, 14 bp, Homo sapiens
ctgcttcagcctcc

SEQ ID NO: 4745860 - DNA, 16 bp, Homo sapiens
ctgcttcagcctcccg

SEQ ID NO: 4745861 - DNA, 23 bp, Homo sapiens
ctgcttcagcctcccgagtagct

SEQ ID NO: 4745862 - DNA, 18 bp, Homo sapiens
ctgcttccagtgaggctc

SEQ ID NO: 4745863 - DNA, 19 bp, Homo sapiens
ctgcttccagtgaggctct

SEQ ID NO: 4745864 - DNA, 21 bp, Homo sapiens
ctgcttccagtgaggctctgc

SEQ ID NO: 4745865 - DNA, 12 bp, Homo sapiens
ctggaaagcaaa

SEQ ID NO: 4745866 - DNA, 20 bp, Homo sapiens
ctggaacatcatcaaggcac

SEQ ID NO: 4745867 - DNA, 20 bp, Homo sapiens
ctggaaccacattgaagaat

SEQ ID NO: 4745868 - DNA, 15 bp, Homo sapiens
ctggaaccatcagaa

SEQ ID NO: 4745869 - DNA, 18 bp, Homo sapiens
ctggaagtgactttggct

SEQ ID NO: 4745870 - DNA, 18 bp, Homo sapiens
ctggaagtggctctgggg

SEQ ID NO: 4745871 - DNA, 15 bp, Homo sapiens
ctggacaccacccag

SEQ ID NO: 4745872 - DNA, 15 bp, Homo sapiens
ctggacccctgcatt

SEQ ID NO: 4745873 - DNA, 18 bp, Homo sapiens
ctggacccctgcattgga

SEQ ID NO: 4745874 - DNA, 22 bp, Homo sapiens
ctggacctgcctgctgcagtca

SEQ ID NO: 4745875 - DNA, 16 bp, Homo sapiens
ctggaccttgaactgg

SEQ ID NO: 4745876 - DNA, 21 bp, Homo sapiens
ctggaccttgaactgggtact

SEQ ID NO: 4745877 - DNA, 16 bp, Homo sapiens
ctggactcacctcccc

SEQ ID NO: 4745878 - DNA, 21 bp, Homo sapiens
ctggactctcagtctctgagc

SEQ ID NO: 4745879 - DNA, 23 bp, Homo sapiens
ctggactctcagtctctgagcag

SEQ ID NO: 4745880 - DNA, 15 bp, Homo sapiens
ctggactgctgctgt

SEQ ID NO: 4745881 - DNA, 15 bp, Homo sapiens
ctggacttatttaaa

SEQ ID NO: 4745882 - DNA, 17 bp, Homo sapiens
ctggacttggcccctgc

SEQ ID NO: 4745883 - DNA, 19 bp, Homo sapiens
ctggagaactagaacctgg

SEQ ID NO: 4745884 - DNA, 22 bp, Homo sapiens
ctggagaactagaacctggagg

SEQ ID NO: 4745885 - DNA, 23 bp, Homo sapiens
ctggagaactagaacctggaggg

SEQ ID NO: 4745886 - DNA, 22 bp, Homo sapiens
ctggagagccagaacctggagg

SEQ ID NO: 4745887 - DNA, 13 bp, Homo sapiens
ctggagagctaga

SEQ ID NO: 4745888 - DNA, 22 bp, Homo sapiens
ctggagagctagaacctggagg

SEQ ID NO: 4745889 - DNA, 23 bp, Homo sapiens
ctggagagctagaacctggaggg

SEQ ID NO: 4745890 - DNA, 15 bp, Homo sapiens
ctggagccactaact

SEQ ID NO: 4745891 - DNA, 16 bp, Homo sapiens
ctggagcccagaggag

SEQ ID NO: 4745892 - DNA, 15 bp, Homo sapiens
ctggagcctggtgcc

SEQ ID NO: 4745893 - DNA, 17 bp, Homo sapiens
ctggagcctggtgccct

SEQ ID NO: 4745894 - DNA, 12 bp, Homo sapiens
ctggaggagccc

SEQ ID NO: 4745895 - DNA, 15 bp, Homo sapiens
ctggaggagcccagg

SEQ ID NO: 4745896 - DNA, 15 bp, Homo sapiens
ctggaggcagggaac

SEQ ID NO: 4745897 - DNA, 22 bp, Homo sapiens
ctggagggaatgaacctggagg

SEQ ID NO: 4745898 - DNA, 23 bp, Homo sapiens
ctggagggaatgaacctggaggg

SEQ ID NO: 4745899 - DNA, 19 bp, Homo sapiens
ctggagggctagaacctgg

SEQ ID NO: 4745900 - DNA, 21 bp, Homo sapiens
ctggagggctagaacctggag

SEQ ID NO: 4745901 - DNA, 22 bp, Homo sapiens
ctggagggctagaacctggaga

SEQ ID NO: 4745902 - DNA, 22 bp, Homo sapiens
ctggagggctagaacctggcag

SEQ ID NO: 4745903 - DNA, 22 bp, Homo sapiens
ctggagggctagaatctggaga

SEQ ID NO: 4745904 - DNA, 22 bp, Homo sapiens
ctggagggctggaatctggaga

SEQ ID NO: 4745905 - DNA, 17 bp, Homo sapiens
ctggagtgcagtgagcc

SEQ ID NO: 4745906 - DNA, 20 bp, Homo sapiens
ctggatctccattctctcag

SEQ ID NO: 4745907 - DNA, 12 bp, Homo sapiens
ctggatgggggc

SEQ ID NO: 4745908 - DNA, 16 bp, Homo sapiens
ctggatgggggctctg

SEQ ID NO: 4745909 - DNA, 13 bp, Homo sapiens
ctggattcccagg

SEQ ID NO: 4745910 - DNA, 15 bp, Homo sapiens
ctggattttgaatta

SEQ ID NO: 4745911 - DNA, 13 bp, Homo sapiens
ctggattttgtca

SEQ ID NO: 4745912 - DNA, 17 bp, Homo sapiens
ctggcaaggacacagat

SEQ ID NO: 4745913 - DNA, 21 bp, Homo sapiens
ctggcacacagtaggtgctca

SEQ ID NO: 4745914 - DNA, 14 bp, Homo sapiens
ctggcacagtgtct

SEQ ID NO: 4745915 - DNA, 19 bp, Homo sapiens
ctggcacagtgtctgggct

SEQ ID NO: 4745916 - DNA, 20 bp, Homo sapiens
ctggcacagtgtctgggctg

SEQ ID NO: 4745917 - DNA, 16 bp, Homo sapiens
ctggcacccggcccct

SEQ ID NO: 4745918 - DNA, 17 bp, Homo sapiens
ctggcacccggcccctg

SEQ ID NO: 4745919 - DNA, 14 bp, Homo sapiens
ctggcagagagcac

SEQ ID NO: 4745920 - DNA, 14 bp, Homo sapiens
ctggcagctcagag

SEQ ID NO: 4745921 - DNA, 19 bp, Homo sapiens
ctggccaccaccccccact

SEQ ID NO: 4745922 - DNA, 21 bp, Homo sapiens
ctggccaccaccccccactct

SEQ ID NO: 4745923 - DNA, 17 bp, Homo sapiens
ctggccagatgcaccag

SEQ ID NO: 4745924 - DNA, 20 bp, Homo sapiens
ctggccagatgcaccagccc

SEQ ID NO: 4745925 - DNA, 22 bp, Homo sapiens
ctggccagatgcaccagccctt

SEQ ID NO: 4745926 - DNA, 22 bp, Homo sapiens
ctggccagatgtcgctgggtcc

SEQ ID NO: 4745927 - DNA, 14 bp, Homo sapiens
ctggccagccccac

SEQ ID NO: 4745928 - DNA, 17 bp, Homo sapiens
ctggccagccccacagc

SEQ ID NO: 4745929 - DNA, 16 bp, Homo sapiens
ctggccagggcctgga

SEQ ID NO: 4745930 - DNA, 22 bp, Homo sapiens
ctggccatgtggccctccagtg

SEQ ID NO: 4745931 - DNA, 16 bp, Homo sapiens
ctggcccaccccaccc

SEQ ID NO: 4745932 - DNA, 17 bp, Homo sapiens
ctggccccatggtcagc

SEQ ID NO: 4745933 - DNA, 20 bp, Homo sapiens
ctggcccctcagggtccctg

SEQ ID NO: 4745934 - DNA, 18 bp, Homo sapiens
ctggccctcaaggcctcc

SEQ ID NO: 4745935 - DNA, 24 bp, Homo sapiens
ctggccctcaaggcctcccacagt

SEQ ID NO: 4745936 - DNA, 11 bp, Homo sapiens
ctggccctgcc

SEQ ID NO: 4745937 - DNA, 13 bp, Homo sapiens
ctggccctgccct

SEQ ID NO: 4745938 - DNA, 17 bp, Homo sapiens
ctggcctagtcccttcc

SEQ ID NO: 4745939 - DNA, 18 bp, Homo sapiens
ctggcctctgcactcccc

SEQ ID NO: 4745940 - DNA, 13 bp, Homo sapiens
ctggcctgagctg

SEQ ID NO: 4745941 - DNA, 15 bp, Homo sapiens
ctggcctgagctggg

SEQ ID NO: 4745942 - DNA, 16 bp, Homo sapiens
ctggcctgagctggga

SEQ ID NO: 4745943 - DNA, 18 bp, Homo sapiens
ctggcctgagctgggatg

SEQ ID NO: 4745944 - DNA, 14 bp, Homo sapiens
ctggcctgtgtcta

SEQ ID NO: 4745945 - DNA, 12 bp, Homo sapiens
ctggcgtcctct

SEQ ID NO: 4745946 - DNA, 13 bp, Homo sapiens
ctggctccagctg

SEQ ID NO: 4745947 - DNA, 13 bp, Homo sapiens
ctggctcttccag

SEQ ID NO: 4745948 - DNA, 21 bp, Homo sapiens
ctggctcttccaggctgggag

SEQ ID NO: 4745949 - DNA, 16 bp, Homo sapiens
ctggctgaaggactgt

SEQ ID NO: 4745950 - DNA, 17 bp, Homo sapiens
ctggctgaaggactgtg

SEQ ID NO: 4745951 - DNA, 15 bp, Homo sapiens
ctggctgcctccact

SEQ ID NO: 4745952 - DNA, 16 bp, Homo sapiens
ctggctgcctccactc

SEQ ID NO: 4745953 - DNA, 20 bp, Homo sapiens
ctggctgcctccactcccac

SEQ ID NO: 4745954 - DNA, 13 bp, Homo sapiens
ctggctggggcct

SEQ ID NO: 4745955 - DNA, 22 bp, Homo sapiens
ctggctggggcctatcagtgtg

SEQ ID NO: 4745956 - DNA, 15 bp, Homo sapiens
ctggctggtgcctga

SEQ ID NO: 4745957 - DNA, 13 bp, Homo sapiens
ctggctgtgacaa

SEQ ID NO: 4745958 - DNA, 18 bp, Homo sapiens
ctggctgttggctggggg

SEQ ID NO: 4745959 - DNA, 17 bp, Homo sapiens
ctgggaactcacctggg

SEQ ID NO: 4745960 - DNA, 20 bp, Homo sapiens
ctgggaactcacctggggct

SEQ ID NO: 4745961 - DNA, 16 bp, Homo sapiens
ctgggaccacgtgaga

SEQ ID NO: 4745962 - DNA, 17 bp, Homo sapiens
ctgggactacaggcacc

SEQ ID NO: 4745963 - DNA, 15 bp, Homo sapiens
ctgggactcattcac

SEQ ID NO: 4745964 - DNA, 21 bp, Homo sapiens
ctgggagagacttggatgagg

SEQ ID NO: 4745965 - DNA, 19 bp, Homo sapiens
ctgggagagccttccaggg

SEQ ID NO: 4745966 - DNA, 20 bp, Homo sapiens
ctgggagagccttccagggg

SEQ ID NO: 4745967 - DNA, 14 bp, Homo sapiens
ctgggaggcagtga

SEQ ID NO: 4745968 - DNA, 16 bp, Homo sapiens
ctgggaggcagtgatg

SEQ ID NO: 4745969 - DNA, 20 bp, Homo sapiens
ctgggagggcagcagggcta

SEQ ID NO: 4745970 - DNA, 12 bp, Homo sapiens
ctgggagtgagc

SEQ ID NO: 4745971 - DNA, 16 bp, Homo sapiens
ctgggagtgagctggt

SEQ ID NO: 4745972 - DNA, 23 bp, Homo sapiens
ctgggagttgatcgcctttccca

SEQ ID NO: 4745973 - DNA, 18 bp, Homo sapiens
ctgggatgattggagggg

SEQ ID NO: 4745974 - DNA, 21 bp, Homo sapiens
ctgggattacaagcgtgagcc

SEQ ID NO: 4745975 - DNA, 18 bp, Homo sapiens
ctgggattacaggcgtga

SEQ ID NO: 4745976 - DNA, 20 bp, Homo sapiens
ctgggattacaggctcctgc

SEQ ID NO: 4745977 - DNA, 21 bp, Homo sapiens
ctgggattacaggctcctgcc

SEQ ID NO: 4745978 - DNA, 20 bp, Homo sapiens
ctgggcaccggggcctcgga

SEQ ID NO: 4745979 - DNA, 17 bp, Homo sapiens
ctgggcaggactcagct

SEQ ID NO: 4745980 - DNA, 18 bp, Homo sapiens
ctgggccacttctgggtg

SEQ ID NO: 4745981 - DNA, 13 bp, Homo sapiens
ctgggccagagta

SEQ ID NO: 4745982 - DNA, 13 bp, Homo sapiens
ctgggccctctct

SEQ ID NO: 4745983 - DNA, 22 bp, Homo sapiens
ctgggctcccttcccacctctc

SEQ ID NO: 4745984 - DNA, 16 bp, Homo sapiens
ctgggctctgtgggct

SEQ ID NO: 4745985 - DNA, 18 bp, Homo sapiens
ctgggctctgtgggctgc

SEQ ID NO: 4745986 - DNA, 15 bp, Homo sapiens
ctgggcttcagtggc

SEQ ID NO: 4745987 - DNA, 16 bp, Homo sapiens
ctggggaacctgaccc

SEQ ID NO: 4745988 - DNA, 12 bp, Homo sapiens
ctggggctgctg

SEQ ID NO: 4745989 - DNA, 15 bp, Homo sapiens
ctgggggcggccagc

SEQ ID NO: 4745990 - DNA, 18 bp, Homo sapiens
ctgggggctcctcaccac

SEQ ID NO: 4745991 - DNA, 16 bp, Homo sapiens
ctggggggcagtggtg

SEQ ID NO: 4745992 - DNA, 17 bp, Homo sapiens
ctgggtaagagcacagg

SEQ ID NO: 4745993 - DNA, 16 bp, Homo sapiens
ctgggtccaggcctgg

SEQ ID NO: 4745994 - DNA, 23 bp, Homo sapiens
ctgggtggacatggcccctgtga

SEQ ID NO: 4745995 - DNA, 14 bp, Homo sapiens
ctgggtggcactgc

SEQ ID NO: 4745996 - DNA, 20 bp, Homo sapiens
ctgggtggcactgccatgca

SEQ ID NO: 4745997 - DNA, 15 bp, Homo sapiens
ctgggtggcccatcc

SEQ ID NO: 4745998 - DNA, 16 bp, Homo sapiens
ctgggtggcccatccc

SEQ ID NO: 4745999 - DNA, 20 bp, Homo sapiens
ctgggtggcccatcccccct

SEQ ID NO: 4746000 - DNA, 14 bp, Homo sapiens
ctgggtgtggcgca

SEQ ID NO: 4746001 - DNA, 15 bp, Homo sapiens
ctgggtgtggcgcag

SEQ ID NO: 4746002 - DNA, 18 bp, Homo sapiens
ctgggttcactgcaacct

SEQ ID NO: 4746003 - DNA, 23 bp, Homo sapiens
ctgggttccttcctctgagcctt

SEQ ID NO: 4746004 - DNA, 17 bp, Homo sapiens
ctgggttctacccaggt

SEQ ID NO: 4746005 - DNA, 19 bp, Homo sapiens
ctgggttctacccaggtgc

SEQ ID NO: 4746006 - DNA, 13 bp, Homo sapiens
ctgggttggaaaa

SEQ ID NO: 4746007 - DNA, 18 bp, Homo sapiens
ctgggttggaaaacagta

SEQ ID NO: 4746008 - DNA, 18 bp, Homo sapiens
ctgggttggcgcaccctc

SEQ ID NO: 4746009 - DNA, 22 bp, Homo sapiens
ctgggtttaaggggagaggaaa

SEQ ID NO: 4746010 - DNA, 15 bp, Homo sapiens
ctggtatactatcat

SEQ ID NO: 4746011 - DNA, 19 bp, Homo sapiens
ctggtatctaattctttaa

SEQ ID NO: 4746012 - DNA, 21 bp, Homo sapiens
ctggtctcgaactcctgacct

SEQ ID NO: 4746013 - DNA, 18 bp, Homo sapiens
ctggtctctaggctgggg

SEQ ID NO: 4746014 - DNA, 21 bp, Homo sapiens
ctggtgactttcctctttggt

SEQ ID NO: 4746015 - DNA, 20 bp, Homo sapiens
ctggtgccctaacctctgag

SEQ ID NO: 4746016 - DNA, 21 bp, Homo sapiens
ctggtgcctgaagaccccaga

SEQ ID NO: 4746017 - DNA, 16 bp, Homo sapiens
ctggtgcttagttttt

SEQ ID NO: 4746018 - DNA, 21 bp, Homo sapiens
ctggtggcagctcacctctcc

SEQ ID NO: 4746019 - DNA, 23 bp, Homo sapiens
ctggtggcagctcacctctccct

SEQ ID NO: 4746020 - DNA, 14 bp, Homo sapiens
ctggtggcagctgc

SEQ ID NO: 4746021 - DNA, 15 bp, Homo sapiens
ctggtggcagctgcg

SEQ ID NO: 4746022 - DNA, 19 bp, Homo sapiens
ctggtggcagtgggagctg

SEQ ID NO: 4746023 - DNA, 17 bp, Homo sapiens
ctggtggccctctcccc

SEQ ID NO: 4746024 - DNA, 18 bp, Homo sapiens
ctggtggccctctcccct

SEQ ID NO: 4746025 - DNA, 20 bp, Homo sapiens
ctggtggccctctcccctgc

SEQ ID NO: 4746026 - DNA, 20 bp, Homo sapiens
ctggtgtaggaagttttttc

SEQ ID NO: 4746027 - DNA, 21 bp, Homo sapiens
ctggttaaccttgaagtgact

SEQ ID NO: 4746028 - DNA, 22 bp, Homo sapiens
ctggttaaccttgaagtgactg

SEQ ID NO: 4746029 - DNA, 20 bp, Homo sapiens
ctggttaacttgtttggcct

SEQ ID NO: 4746030 - DNA, 16 bp, Homo sapiens
ctggttataagcagca

SEQ ID NO: 4746031 - DNA, 20 bp, Homo sapiens
ctggttcagggttggcccct

SEQ ID NO: 4746032 - DNA, 23 bp, Homo sapiens
ctggttcggatttggggtggatt

SEQ ID NO: 4746033 - DNA, 14 bp, Homo sapiens
ctggttctcatctt

SEQ ID NO: 4746034 - DNA, 14 bp, Homo sapiens
ctggtttcctgccc

SEQ ID NO: 4746035 - DNA, 21 bp, Homo sapiens
ctgtaacatatctgtaaatag

SEQ ID NO: 4746036 - DNA, 15 bp, Homo sapiens
ctgtaacgattgaca

SEQ ID NO: 4746037 - DNA, 21 bp, Homo sapiens
ctgtaaggatccggaaagaag

SEQ ID NO: 4746038 - DNA, 14 bp, Homo sapiens
ctgtaatattgtaa

SEQ ID NO: 4746039 - DNA, 15 bp, Homo sapiens
ctgtaatattgtaaa

SEQ ID NO: 4746040 - DNA, 17 bp, Homo sapiens
ctgtaatattgtaaata

SEQ ID NO: 4746041 - DNA, 19 bp, Homo sapiens
ctgtaatcccagcacttgg

SEQ ID NO: 4746042 - DNA, 21 bp, Homo sapiens
ctgtaatgaaccgctgaatat

SEQ ID NO: 4746043 - DNA, 12 bp, Homo sapiens
ctgtaattgtgt

SEQ ID NO: 4746044 - DNA, 13 bp, Homo sapiens
ctgtacagagccc

SEQ ID NO: 4746045 - DNA, 14 bp, Homo sapiens
ctgtacagagccca

SEQ ID NO: 4746046 - DNA, 18 bp, Homo sapiens
ctgtacagagcccacgcc

SEQ ID NO: 4746047 - DNA, 16 bp, Homo sapiens
ctgtaccaaatctgac

SEQ ID NO: 4746048 - DNA, 17 bp, Homo sapiens
ctgtaccaaatctgaca

SEQ ID NO: 4746049 - DNA, 20 bp, Homo sapiens
ctgtaccaaatctgacatat

SEQ ID NO: 4746050 - DNA, 16 bp, Homo sapiens
ctgtacgtctgacagg

SEQ ID NO: 4746051 - DNA, 18 bp, Homo sapiens
ctgtacgtctgacaggca

SEQ ID NO: 4746052 - DNA, 19 bp, Homo sapiens
ctgtagaaaagggaactga

SEQ ID NO: 4746053 - DNA, 21 bp, Homo sapiens
ctgtagagctagaacatggag

SEQ ID NO: 4746054 - DNA, 21 bp, Homo sapiens
ctgtagggaaaaaaatgcttc

SEQ ID NO: 4746055 - DNA, 19 bp, Homo sapiens
ctgtataaataggagagga

SEQ ID NO: 4746056 - DNA, 19 bp, Homo sapiens
ctgtatccactttcagaat

SEQ ID NO: 4746057 - DNA, 18 bp, Homo sapiens
ctgtatcccatgagcctc

SEQ ID NO: 4746058 - DNA, 22 bp, Homo sapiens
ctgtatcccatgagcctcagca

SEQ ID NO: 4746059 - DNA, 17 bp, Homo sapiens
ctgtatggaaacactga

SEQ ID NO: 4746060 - DNA, 19 bp, Homo sapiens
ctgtatggaaacactgatt

SEQ ID NO: 4746061 - DNA, 20 bp, Homo sapiens
ctgtatgtctcgtggtagga

SEQ ID NO: 4746062 - DNA, 19 bp, Homo sapiens
ctgtattagtcacagagat

SEQ ID NO: 4746063 - DNA, 18 bp, Homo sapiens
ctgtcaagaggcaaagga

SEQ ID NO: 4746064 - DNA, 16 bp, Homo sapiens
ctgtcaatgagagcat

SEQ ID NO: 4746065 - DNA, 22 bp, Homo sapiens
ctgtcaggattgcgagagatgt

SEQ ID NO: 4746066 - DNA, 24 bp, Homo sapiens
ctgtcaggattgcgagagatgtgt

SEQ ID NO: 4746067 - DNA, 17 bp, Homo sapiens
ctgtcagtgccgccgcc

SEQ ID NO: 4746068 - DNA, 22 bp, Homo sapiens
ctgtcagtgccgccgcctcgcc

SEQ ID NO: 4746069 - DNA, 14 bp, Homo sapiens
ctgtcatttgagca

SEQ ID NO: 4746070 - DNA, 21 bp, Homo sapiens
ctgtcatttgagcagggctca

SEQ ID NO: 4746071 - DNA, 16 bp, Homo sapiens
ctgtcattttttttct

SEQ ID NO: 4746072 - DNA, 14 bp, Homo sapiens
ctgtcccaagctcc

SEQ ID NO: 4746073 - DNA, 12 bp, Homo sapiens
ctgtcccctctt

SEQ ID NO: 4746074 - DNA, 15 bp, Homo sapiens
ctgtcccctcttgcc

SEQ ID NO: 4746075 - DNA, 16 bp, Homo sapiens
ctgtccccttctctca

SEQ ID NO: 4746076 - DNA, 20 bp, Homo sapiens
ctgtccccttctctcatctc

SEQ ID NO: 4746077 - DNA, 21 bp, Homo sapiens
ctgtccccttctctcatctct

SEQ ID NO: 4746078 - DNA, 12 bp, Homo sapiens
ctgtccctccgg

SEQ ID NO: 4746079 - DNA, 18 bp, Homo sapiens
ctgtcccttgcccccctg

SEQ ID NO: 4746080 - DNA, 21 bp, Homo sapiens
ctgtcccttgcccccctggcc

SEQ ID NO: 4746081 - DNA, 15 bp, Homo sapiens
ctgtccgagacagcc

SEQ ID NO: 4746082 - DNA, 14 bp, Homo sapiens
ctgtcctacccacc

SEQ ID NO: 4746083 - DNA, 20 bp, Homo sapiens
ctgtcctactctgtgtcagg

SEQ ID NO: 4746084 - DNA, 21 bp, Homo sapiens
ctgtcctccgtgaaaatatgt

SEQ ID NO: 4746085 - DNA, 16 bp, Homo sapiens
ctgtcctgctccacag

SEQ ID NO: 4746086 - DNA, 19 bp, Homo sapiens
ctgtcctgctccacagtgt

SEQ ID NO: 4746087 - DNA, 21 bp, Homo sapiens
ctgtcctgggagtgagctggt

SEQ ID NO: 4746088 - DNA, 16 bp, Homo sapiens
ctgtcgcccagtctgg

SEQ ID NO: 4746089 - DNA, 12 bp, Homo sapiens
ctgtctcatcca

SEQ ID NO: 4746090 - DNA, 20 bp, Homo sapiens
ctgtctcatccatcatcatg

SEQ ID NO: 4746091 - DNA, 20 bp, Homo sapiens
ctgtctccttaacactgagc

SEQ ID NO: 4746092 - DNA, 18 bp, Homo sapiens
ctgtctttcaaaaggtaa

SEQ ID NO: 4746093 - DNA, 15 bp, Homo sapiens
ctgtgaaactgggat

SEQ ID NO: 4746094 - DNA, 22 bp, Homo sapiens
ctgtgaaaggaaagagggaggt

SEQ ID NO: 4746095 - DNA, 15 bp, Homo sapiens
ctgtgaataaaaaga

SEQ ID NO: 4746096 - DNA, 13 bp, Homo sapiens
ctgtgaatgcttc

SEQ ID NO: 4746097 - DNA, 14 bp, Homo sapiens
ctgtgaatgcttct

SEQ ID NO: 4746098 - DNA, 18 bp, Homo sapiens
ctgtgacaggcagcagag

SEQ ID NO: 4746099 - DNA, 17 bp, Homo sapiens
ctgtgaccaatgtcttg

SEQ ID NO: 4746100 - DNA, 13 bp, Homo sapiens
ctgtgaccatccc

SEQ ID NO: 4746101 - DNA, 18 bp, Homo sapiens
ctgtgagactcgagaact

SEQ ID NO: 4746102 - DNA, 21 bp, Homo sapiens
ctgtgagagaataatttctgt

SEQ ID NO: 4746103 - DNA, 20 bp, Homo sapiens
ctgtgagtactacagtcctc

SEQ ID NO: 4746104 - DNA, 13 bp, Homo sapiens
ctgtgagtgagtg

SEQ ID NO: 4746105 - DNA, 17 bp, Homo sapiens
ctgtgatggggccctgc

SEQ ID NO: 4746106 - DNA, 18 bp, Homo sapiens
ctgtgatggggccctgcc

SEQ ID NO: 4746107 - DNA, 21 bp, Homo sapiens
ctgtgatggggccctgcctcc

SEQ ID NO: 4746108 - DNA, 15 bp, Homo sapiens
ctgtgatgtcccagt

SEQ ID NO: 4746109 - DNA, 21 bp, Homo sapiens
ctgtgatgttgggaagctatt

SEQ ID NO: 4746110 - DNA, 16 bp, Homo sapiens
ctgtgcaaacagtgta

SEQ ID NO: 4746111 - DNA, 22 bp, Homo sapiens
ctgtgcaaacagtgtaagctta

SEQ ID NO: 4746112 - DNA, 19 bp, Homo sapiens
ctgtgcacatctgtgtctt

SEQ ID NO: 4746113 - DNA, 12 bp, Homo sapiens
ctgtgcacgcag

SEQ ID NO: 4746114 - DNA, 17 bp, Homo sapiens
ctgtgcagataaacaga

SEQ ID NO: 4746115 - DNA, 21 bp, Homo sapiens
ctgtgcagccgctgagcgagg

SEQ ID NO: 4746116 - DNA, 11 bp, Homo sapiens
ctgtgccaccc

SEQ ID NO: 4746117 - DNA, 22 bp, Homo sapiens
ctgtgccaccctgggctctgtg

SEQ ID NO: 4746118 - DNA, 23 bp, Homo sapiens
ctgtgccaccctgggctctgtgg

SEQ ID NO: 4746119 - DNA, 16 bp, Homo sapiens
ctgtgccatgtgccag

SEQ ID NO: 4746120 - DNA, 18 bp, Homo sapiens
ctgtgcccatgggcactg

SEQ ID NO: 4746121 - DNA, 21 bp, Homo sapiens
ctgtgcccatgggcactgctg

SEQ ID NO: 4746122 - DNA, 17 bp, Homo sapiens
ctgtgcccttattcagg

SEQ ID NO: 4746123 - DNA, 19 bp, Homo sapiens
ctgtgcctgaccttgagga

SEQ ID NO: 4746124 - DNA, 10 bp, Homo sapiens
ctgtgcctgg

SEQ ID NO: 4746125 - DNA, 19 bp, Homo sapiens
ctgtgctgagtctgaaggc

SEQ ID NO: 4746126 - DNA, 20 bp, Homo sapiens
ctgtgctgagtctgaaggct

SEQ ID NO: 4746127 - DNA, 13 bp, Homo sapiens
ctgtgctgccctg

SEQ ID NO: 4746128 - DNA, 14 bp, Homo sapiens
ctgtgctgccctgc

SEQ ID NO: 4746129 - DNA, 17 bp, Homo sapiens
ctgtgctgccctgccca

SEQ ID NO: 4746130 - DNA, 15 bp, Homo sapiens
ctgtgctggagccac

SEQ ID NO: 4746131 - DNA, 16 bp, Homo sapiens
ctgtgctggagccact

SEQ ID NO: 4746132 - DNA, 21 bp, Homo sapiens
ctgtgctggagccactaacta

SEQ ID NO: 4746133 - DNA, 17 bp, Homo sapiens
ctgtgcttcgggccctt

SEQ ID NO: 4746134 - DNA, 19 bp, Homo sapiens
ctgtgcttcgggcccttcc

SEQ ID NO: 4746135 - DNA, 21 bp, Homo sapiens
ctgtgcttcgggcccttccca

SEQ ID NO: 4746136 - DNA, 15 bp, Homo sapiens
ctgtggaagtccctc

SEQ ID NO: 4746137 - DNA, 21 bp, Homo sapiens
ctgtggaggaaggattgtaaa

SEQ ID NO: 4746138 - DNA, 22 bp, Homo sapiens
ctgtggaggaaggattgtaaaa

SEQ ID NO: 4746139 - DNA, 23 bp, Homo sapiens
ctgtggaggaaggattgtaaaaa

SEQ ID NO: 4746140 - DNA, 21 bp, Homo sapiens
ctgtggattcagcttctgttg

SEQ ID NO: 4746141 - DNA, 15 bp, Homo sapiens
ctgtgggattctgat

SEQ ID NO: 4746142 - DNA, 16 bp, Homo sapiens
ctgtgggattctgatt

SEQ ID NO: 4746143 - DNA, 22 bp, Homo sapiens
ctgtgggcgtgagacctgcccc

SEQ ID NO: 4746144 - DNA, 23 bp, Homo sapiens
ctgtgggcgtgagacctgcccct

SEQ ID NO: 4746145 - DNA, 21 bp, Homo sapiens
ctgtgggctgcactctgtgcc

SEQ ID NO: 4746146 - DNA, 17 bp, Homo sapiens
ctgtgggtctccatcct

SEQ ID NO: 4746147 - DNA, 14 bp, Homo sapiens
ctgtggtgtgtccc

SEQ ID NO: 4746148 - DNA, 16 bp, Homo sapiens
ctgtgtaaaaagagag

SEQ ID NO: 4746149 - DNA, 13 bp, Homo sapiens
ctgtgtaagaaaa

SEQ ID NO: 4746150 - DNA, 23 bp, Homo sapiens
ctgtgtacattttaaaggataat

SEQ ID NO: 4746151 - DNA, 14 bp, Homo sapiens
ctgtgtcactggct

SEQ ID NO: 4746152 - DNA, 18 bp, Homo sapiens
ctgtgtcactggctgcct

SEQ ID NO: 4746153 - DNA, 23 bp, Homo sapiens
ctgtgtcagggaacatatttaag

SEQ ID NO: 4746154 - DNA, 12 bp, Homo sapiens
ctgtgtctctgt

SEQ ID NO: 4746155 - DNA, 18 bp, Homo sapiens
ctgtgtgaatacctgctc

SEQ ID NO: 4746156 - DNA, 17 bp, Homo sapiens
ctgtgtgaatttttcta

SEQ ID NO: 4746157 - DNA, 17 bp, Homo sapiens
ctgtgtgcgagtctgag

SEQ ID NO: 4746158 - DNA, 15 bp, Homo sapiens
ctgtgtgtgcctgtg

SEQ ID NO: 4746159 - DNA, 20 bp, Homo sapiens
ctgtgtttaatagtatatct

SEQ ID NO: 4746160 - DNA, 16 bp, Homo sapiens
ctgtgttttgaaagaa

SEQ ID NO: 4746161 - DNA, 17 bp, Homo sapiens
ctgtgttttgaaagaat

SEQ ID NO: 4746162 - DNA, 22 bp, Homo sapiens
ctgtgttttgaaagaatagaac

SEQ ID NO: 4746163 - DNA, 20 bp, Homo sapiens
ctgttaacactgtaatatct

SEQ ID NO: 4746164 - DNA, 13 bp, Homo sapiens
ctgttaactgtta

SEQ ID NO: 4746165 - DNA, 16 bp, Homo sapiens
ctgttcagctccagct

SEQ ID NO: 4746166 - DNA, 22 bp, Homo sapiens
ctgttcagctccagctcaccag

SEQ ID NO: 4746167 - DNA, 12 bp, Homo sapiens
ctgttccccctg

SEQ ID NO: 4746168 - DNA, 17 bp, Homo sapiens
ctgttccccctgtgcag

SEQ ID NO: 4746169 - DNA, 17 bp, Homo sapiens
ctgttctacttgatatt

SEQ ID NO: 4746170 - DNA, 20 bp, Homo sapiens
ctgttctctgccctccaaga

SEQ ID NO: 4746171 - DNA, 12 bp, Homo sapiens
ctgttctgtgac

SEQ ID NO: 4746172 - DNA, 18 bp, Homo sapiens
ctgttgaagattaacact

SEQ ID NO: 4746173 - DNA, 17 bp, Homo sapiens
ctgttgaatttcccaca

SEQ ID NO: 4746174 - DNA, 15 bp, Homo sapiens
ctgttgataaaaact

SEQ ID NO: 4746175 - DNA, 18 bp, Homo sapiens
ctgttgcacgtgtgtttt

SEQ ID NO: 4746176 - DNA, 18 bp, Homo sapiens
ctgttgcccaggctggcg

SEQ ID NO: 4746177 - DNA, 15 bp, Homo sapiens
ctgttgctgcctcat

SEQ ID NO: 4746178 - DNA, 16 bp, Homo sapiens
ctgttgctgcctcatg

SEQ ID NO: 4746179 - DNA, 20 bp, Homo sapiens
ctgttgggtgggtgggccct

SEQ ID NO: 4746180 - DNA, 22 bp, Homo sapiens
ctgttgggtgggtgggccctgc

SEQ ID NO: 4746181 - DNA, 15 bp, Homo sapiens
ctgttgtacatttat

SEQ ID NO: 4746182 - DNA, 19 bp, Homo sapiens
ctgttgtacatttatgatt

SEQ ID NO: 4746183 - DNA, 22 bp, Homo sapiens
ctgttgtacatttatgatttaa

SEQ ID NO: 4746184 - DNA, 18 bp, Homo sapiens
ctgttgttccaaatgtgt

SEQ ID NO: 4746185 - DNA, 15 bp, Homo sapiens
ctgtttactgctttt

SEQ ID NO: 4746186 - DNA, 15 bp, Homo sapiens
ctgtttcccagcagt

SEQ ID NO: 4746187 - DNA, 22 bp, Homo sapiens
cttaaaaattaaattctctcta

SEQ ID NO: 4746188 - DNA, 20 bp, Homo sapiens
cttaaaaggtataattaaac

SEQ ID NO: 4746189 - DNA, 14 bp, Homo sapiens
cttaaacaaatgta

SEQ ID NO: 4746190 - DNA, 20 bp, Homo sapiens
cttaaacataataaatcaca

SEQ ID NO: 4746191 - DNA, 17 bp, Homo sapiens
cttaagagatgcctcat

SEQ ID NO: 4746192 - DNA, 17 bp, Homo sapiens
cttaatcttttcacaaa

SEQ ID NO: 4746193 - DNA, 19 bp, Homo sapiens
cttaatcttttcacaaata

SEQ ID NO: 4746194 - DNA, 13 bp, Homo sapiens
cttaatgttgaat

SEQ ID NO: 4746195 - DNA, 16 bp, Homo sapiens
cttaatgttgaatgta

SEQ ID NO: 4746196 - DNA, 10 bp, Homo sapiens
cttaattatt

SEQ ID NO: 4746197 - DNA, 14 bp, Homo sapiens
cttacaatgtaaac

SEQ ID NO: 4746198 - DNA, 17 bp, Homo sapiens
cttacacttactgttgt

SEQ ID NO: 4746199 - DNA, 17 bp, Homo sapiens
cttacatatctgacttc

SEQ ID NO: 4746200 - DNA, 18 bp, Homo sapiens
cttaccagggtctttgca

SEQ ID NO: 4746201 - DNA, 23 bp, Homo sapiens
cttacgaatacttttgccctttg

SEQ ID NO: 4746202 - DNA, 15 bp, Homo sapiens
cttactaaaaagtat

SEQ ID NO: 4746203 - DNA, 22 bp, Homo sapiens
cttactcattaattcaatgaaa

SEQ ID NO: 4746204 - DNA, 16 bp, Homo sapiens
cttactgtggaggaag

SEQ ID NO: 4746205 - DNA, 19 bp, Homo sapiens
cttactgtggaggaaggat

SEQ ID NO: 4746206 - DNA, 13 bp, Homo sapiens
cttactttgtgca

SEQ ID NO: 4746207 - DNA, 14 bp, Homo sapiens
cttactttgtgcaa

SEQ ID NO: 4746208 - DNA, 23 bp, Homo sapiens
cttactttttttggaagttattt

SEQ ID NO: 4746209 - DNA, 15 bp, Homo sapiens
cttagacagtccctg

SEQ ID NO: 4746210 - DNA, 16 bp, Homo sapiens
cttagacagtccctgc

SEQ ID NO: 4746211 - DNA, 19 bp, Homo sapiens
cttagagcagtttctgtcc

SEQ ID NO: 4746212 - DNA, 16 bp, Homo sapiens
cttagagcctccctca

SEQ ID NO: 4746213 - DNA, 18 bp, Homo sapiens
cttagatgttctaagtct

SEQ ID NO: 4746214 - DNA, 18 bp, Homo sapiens
cttagcagggaaacagct

SEQ ID NO: 4746215 - DNA, 21 bp, Homo sapiens
cttagcagggaaacagctaat

SEQ ID NO: 4746216 - DNA, 13 bp, Homo sapiens
cttagcccccacc

SEQ ID NO: 4746217 - DNA, 18 bp, Homo sapiens
cttagcccccacccactt

SEQ ID NO: 4746218 - DNA, 14 bp, Homo sapiens
cttagctcccctcc

SEQ ID NO: 4746219 - DNA, 13 bp, Homo sapiens
cttagctgggaga

SEQ ID NO: 4746220 - DNA, 18 bp, Homo sapiens
cttagctttgctctgcca

SEQ ID NO: 4746221 - DNA, 21 bp, Homo sapiens
cttagtcactgagacagcccg

SEQ ID NO: 4746222 - DNA, 16 bp, Homo sapiens
cttataaaccaatctt

SEQ ID NO: 4746223 - DNA, 16 bp, Homo sapiens
cttatacttttctcaa

SEQ ID NO: 4746224 - DNA, 22 bp, Homo sapiens
cttatatatatattgattattt

SEQ ID NO: 4746225 - DNA, 23 bp, Homo sapiens
cttatatatatattgattatttg

SEQ ID NO: 4746226 - DNA, 19 bp, Homo sapiens
cttatctcagtcatgcata

SEQ ID NO: 4746227 - DNA, 18 bp, Homo sapiens
cttatctgccatgtccat

SEQ ID NO: 4746228 - DNA, 20 bp, Homo sapiens
cttatgagaacatggtgtgt

SEQ ID NO: 4746229 - DNA, 23 bp, Homo sapiens
cttatgagaacatggtgtgtgtc

SEQ ID NO: 4746230 - DNA, 14 bp, Homo sapiens
cttatggcatctca

SEQ ID NO: 4746231 - DNA, 14 bp, Homo sapiens
cttatgggctgggt

SEQ ID NO: 4746232 - DNA, 22 bp, Homo sapiens
cttatgggctgggttctaccca

SEQ ID NO: 4746233 - DNA, 14 bp, Homo sapiens
cttatgtgttgcat

SEQ ID NO: 4746234 - DNA, 11 bp, Homo sapiens
cttattagcag

SEQ ID NO: 4746235 - DNA, 13 bp, Homo sapiens
cttattcactttt

SEQ ID NO: 4746236 - DNA, 16 bp, Homo sapiens
cttattcagttcttac

SEQ ID NO: 4746237 - DNA, 17 bp, Homo sapiens
cttattcagttcttaca

SEQ ID NO: 4746238 - DNA, 18 bp, Homo sapiens
cttattgagcgtgattct

SEQ ID NO: 4746239 - DNA, 16 bp, Homo sapiens
cttattggatatttga

SEQ ID NO: 4746240 - DNA, 21 bp, Homo sapiens
cttattggatatttgatattt

SEQ ID NO: 4746241 - DNA, 21 bp, Homo sapiens
cttatttatattcatcaaata

SEQ ID NO: 4746242 - DNA, 16 bp, Homo sapiens
cttatttgtatatggt

SEQ ID NO: 4746243 - DNA, 22 bp, Homo sapiens
cttcaacattaaggcagtatga

SEQ ID NO: 4746244 - DNA, 17 bp, Homo sapiens
cttcaagaccttcacca

SEQ ID NO: 4746245 - DNA, 18 bp, Homo sapiens
cttcaagtgagtggcatg

SEQ ID NO: 4746246 - DNA, 15 bp, Homo sapiens
cttcaatgatcaaat

SEQ ID NO: 4746247 - DNA, 13 bp, Homo sapiens
cttcacctcagag

SEQ ID NO: 4746248 - DNA, 20 bp, Homo sapiens
cttcacctttgtccccaccg

SEQ ID NO: 4746249 - DNA, 21 bp, Homo sapiens
cttcacctttgtccccaccgc

SEQ ID NO: 4746250 - DNA, 15 bp, Homo sapiens
cttcactgtaaaata

SEQ ID NO: 4746251 - DNA, 21 bp, Homo sapiens
cttcagagactcctgcaggca

SEQ ID NO: 4746252 - DNA, 22 bp, Homo sapiens
cttcagagactcctgcaggcag

SEQ ID NO: 4746253 - DNA, 18 bp, Homo sapiens
cttcagagctgacacagg

SEQ ID NO: 4746254 - DNA, 23 bp, Homo sapiens
cttcagaggccctcgctgccagc

SEQ ID NO: 4746255 - DNA, 16 bp, Homo sapiens
cttcagccctcacccc

SEQ ID NO: 4746256 - DNA, 13 bp, Homo sapiens
cttcagctggtgg

SEQ ID NO: 4746257 - DNA, 14 bp, Homo sapiens
cttcagctggtgga

SEQ ID NO: 4746258 - DNA, 14 bp, Homo sapiens
cttcaggggctgcc

SEQ ID NO: 4746259 - DNA, 16 bp, Homo sapiens
cttcaggggctgcccg

SEQ ID NO: 4746260 - DNA, 20 bp, Homo sapiens
cttcaggggctgcccgctcc

SEQ ID NO: 4746261 - DNA, 23 bp, Homo sapiens
cttcaggggctgcccgctcccag

SEQ ID NO: 4746262 - DNA, 20 bp, Homo sapiens
cttcaggttatcgaaataac

SEQ ID NO: 4746263 - DNA, 22 bp, Homo sapiens
cttcaggttatcgaaataacaa

SEQ ID NO: 4746264 - DNA, 18 bp, Homo sapiens
cttcaggttggtttaatc

SEQ ID NO: 4746265 - DNA, 18 bp, Homo sapiens
cttcagtggcagctgctt

SEQ ID NO: 4746266 - DNA, 11 bp, Homo sapiens
cttcatctgga

SEQ ID NO: 4746267 - DNA, 12 bp, Homo sapiens
cttcatctggaa

SEQ ID NO: 4746268 - DNA, 13 bp, Homo sapiens
cttcatgcatgga

SEQ ID NO: 4746269 - DNA, 23 bp, Homo sapiens
cttccaaaccccactttctccct

SEQ ID NO: 4746270 - DNA, 14 bp, Homo sapiens
cttccaaataaata

SEQ ID NO: 4746271 - DNA, 15 bp, Homo sapiens
cttccaaataaataa

SEQ ID NO: 4746272 - DNA, 20 bp, Homo sapiens
cttccaaatcccctaagcag

SEQ ID NO: 4746273 - DNA, 15 bp, Homo sapiens
cttccaaggtggtct

SEQ ID NO: 4746274 - DNA, 16 bp, Homo sapiens
cttccaaggtggtctg

SEQ ID NO: 4746275 - DNA, 14 bp, Homo sapiens
cttccactgagggc

SEQ ID NO: 4746276 - DNA, 16 bp, Homo sapiens
cttccaggctgggaga

SEQ ID NO: 4746277 - DNA, 14 bp, Homo sapiens
cttccagtgaggct

SEQ ID NO: 4746278 - DNA, 18 bp, Homo sapiens
cttccatctttcctgatg

SEQ ID NO: 4746279 - DNA, 22 bp, Homo sapiens
cttccatctttcctgatggcag

SEQ ID NO: 4746280 - DNA, 18 bp, Homo sapiens
cttccattaacaaatgct

SEQ ID NO: 4746281 - DNA, 11 bp, Homo sapiens
cttcccacctc

SEQ ID NO: 4746282 - DNA, 19 bp, Homo sapiens
cttcccaggagtggaggag

SEQ ID NO: 4746283 - DNA, 23 bp, Homo sapiens
cttcccagtataagatttttgaa

SEQ ID NO: 4746284 - DNA, 16 bp, Homo sapiens
cttccccatacaaata

SEQ ID NO: 4746285 - DNA, 22 bp, Homo sapiens
cttcccctcctacccctcccag

SEQ ID NO: 4746286 - DNA, 16 bp, Homo sapiens
cttccctaaaatcagg

SEQ ID NO: 4746287 - DNA, 23 bp, Homo sapiens
cttccctatctttgccaccctca

SEQ ID NO: 4746288 - DNA, 13 bp, Homo sapiens
cttccctgactca

SEQ ID NO: 4746289 - DNA, 17 bp, Homo sapiens
cttcctaattccacagc

SEQ ID NO: 4746290 - DNA, 14 bp, Homo sapiens
cttcctcctgggcc

SEQ ID NO: 4746291 - DNA, 18 bp, Homo sapiens
cttcctctatcttccaaa

SEQ ID NO: 4746292 - DNA, 15 bp, Homo sapiens
cttcctctgagcctt

SEQ ID NO: 4746293 - DNA, 16 bp, Homo sapiens
cttcctgttctgtgac

SEQ ID NO: 4746294 - DNA, 17 bp, Homo sapiens
cttcctgttctgtgact

SEQ ID NO: 4746295 - DNA, 19 bp, Homo sapiens
cttccttgctaatgcacca

SEQ ID NO: 4746296 - DNA, 13 bp, Homo sapiens
cttcctttcagaa

SEQ ID NO: 4746297 - DNA, 17 bp, Homo sapiens
cttcgctcctgtgtctt

SEQ ID NO: 4746298 - DNA, 23 bp, Homo sapiens
cttcgtgggatctgcccctccct

SEQ ID NO: 4746299 - DNA, 22 bp, Homo sapiens
cttctaatcataacatagttga

SEQ ID NO: 4746300 - DNA, 13 bp, Homo sapiens
cttctagaaccag

SEQ ID NO: 4746301 - DNA, 17 bp, Homo sapiens
cttctagaaccaggcaa

SEQ ID NO: 4746302 - DNA, 20 bp, Homo sapiens
cttctaggtggcaaggctgt

SEQ ID NO: 4746303 - DNA, 17 bp, Homo sapiens
cttctatgaaagactca

SEQ ID NO: 4746304 - DNA, 11 bp, Homo sapiens
cttctatttaa

SEQ ID NO: 4746305 - DNA, 16 bp, Homo sapiens
cttctatttaatgctt

SEQ ID NO: 4746306 - DNA, 22 bp, Homo sapiens
cttctcatttcacccctccctt

SEQ ID NO: 4746307 - DNA, 18 bp, Homo sapiens
cttctccaccctgctctc

SEQ ID NO: 4746308 - DNA, 15 bp, Homo sapiens
cttctccagcctaga

SEQ ID NO: 4746309 - DNA, 12 bp, Homo sapiens
cttctccaggct

SEQ ID NO: 4746310 - DNA, 14 bp, Homo sapiens
cttctccaggctgt

SEQ ID NO: 4746311 - DNA, 19 bp, Homo sapiens
cttctccagggtccacagg

SEQ ID NO: 4746312 - DNA, 16 bp, Homo sapiens
cttctccccagagttc

SEQ ID NO: 4746313 - DNA, 19 bp, Homo sapiens
cttctcctgtgatgtccca

SEQ ID NO: 4746314 - DNA, 20 bp, Homo sapiens
cttctcctgtgatgtcccag

SEQ ID NO: 4746315 - DNA, 19 bp, Homo sapiens
cttctccttcacctttgtc

SEQ ID NO: 4746316 - DNA, 15 bp, Homo sapiens
cttctctccagcccc

SEQ ID NO: 4746317 - DNA, 13 bp, Homo sapiens
cttctctgaagga

SEQ ID NO: 4746318 - DNA, 13 bp, Homo sapiens
cttctctgtctca

SEQ ID NO: 4746319 - DNA, 21 bp, Homo sapiens
cttctctgttccattgaatct

SEQ ID NO: 4746320 - DNA, 15 bp, Homo sapiens
cttctgaatgaagcc

SEQ ID NO: 4746321 - DNA, 16 bp, Homo sapiens
cttctgacccatgctg

SEQ ID NO: 4746322 - DNA, 21 bp, Homo sapiens
cttctgacccatgctgccctg

SEQ ID NO: 4746323 - DNA, 14 bp, Homo sapiens
cttctgatttagca

SEQ ID NO: 4746324 - DNA, 23 bp, Homo sapiens
cttctgatttagcaatgctgtga

SEQ ID NO: 4746325 - DNA, 14 bp, Homo sapiens
cttctgccacttcc

SEQ ID NO: 4746326 - DNA, 17 bp, Homo sapiens
cttctgccacttcccag

SEQ ID NO: 4746327 - DNA, 18 bp, Homo sapiens
cttctgccacttcccagg

SEQ ID NO: 4746328 - DNA, 13 bp, Homo sapiens
cttctgctgggct

SEQ ID NO: 4746329 - DNA, 17 bp, Homo sapiens
cttctgctgggctgggg

SEQ ID NO: 4746330 - DNA, 19 bp, Homo sapiens
cttctgctgggctggggcc

SEQ ID NO: 4746331 - DNA, 13 bp, Homo sapiens
cttctgcttcagc

SEQ ID NO: 4746332 - DNA, 16 bp, Homo sapiens
cttctgcttcagcctc

SEQ ID NO: 4746333 - DNA, 23 bp, Homo sapiens
cttctgggagggcagcagggcta

SEQ ID NO: 4746334 - DNA, 17 bp, Homo sapiens
cttctgggttccttcct

SEQ ID NO: 4746335 - DNA, 23 bp, Homo sapiens
cttctgggttccttcctctgagc

SEQ ID NO: 4746336 - DNA, 16 bp, Homo sapiens
cttctgtcctactctg

SEQ ID NO: 4746337 - DNA, 18 bp, Homo sapiens
cttctgtcctactctgtg

SEQ ID NO: 4746338 - DNA, 15 bp, Homo sapiens
cttctgttgctgcct

SEQ ID NO: 4746339 - DNA, 17 bp, Homo sapiens
cttcttaatcttttcac

SEQ ID NO: 4746340 - DNA, 20 bp, Homo sapiens
cttcttaatcttttcacaaa

SEQ ID NO: 4746341 - DNA, 14 bp, Homo sapiens
cttcttcagagact

SEQ ID NO: 4746342 - DNA, 18 bp, Homo sapiens
cttcttcagagactcctg

SEQ ID NO: 4746343 - DNA, 20 bp, Homo sapiens
cttcttcagagactcctgca

SEQ ID NO: 4746344 - DNA, 21 bp, Homo sapiens
cttcttcagagactcctgcag

SEQ ID NO: 4746345 - DNA, 14 bp, Homo sapiens
cttcttcagagctg

SEQ ID NO: 4746346 - DNA, 19 bp, Homo sapiens
cttcttctcctaggattcc

SEQ ID NO: 4746347 - DNA, 18 bp, Homo sapiens
cttctttccatcccctag

SEQ ID NO: 4746348 - DNA, 15 bp, Homo sapiens
cttctttctgactct

SEQ ID NO: 4746349 - DNA, 17 bp, Homo sapiens
cttctttcttgctttga

SEQ ID NO: 4746350 - DNA, 16 bp, Homo sapiens
cttcttttctcttcta

SEQ ID NO: 4746351 - DNA, 16 bp, Homo sapiens
cttgaaaaaaaacagt

SEQ ID NO: 4746352 - DNA, 16 bp, Homo sapiens
cttgaacatacttggt

SEQ ID NO: 4746353 - DNA, 18 bp, Homo sapiens
cttgaactcctgacctca

SEQ ID NO: 4746354 - DNA, 14 bp, Homo sapiens
cttgaactcctggc

SEQ ID NO: 4746355 - DNA, 19 bp, Homo sapiens
cttgaactcctggcctcaa

SEQ ID NO: 4746356 - DNA, 16 bp, Homo sapiens
cttgaactgggtactt

SEQ ID NO: 4746357 - DNA, 18 bp, Homo sapiens
cttgaactgggtacttgt

SEQ ID NO: 4746358 - DNA, 19 bp, Homo sapiens
cttgaattttcccactgca

SEQ ID NO: 4746359 - DNA, 20 bp, Homo sapiens
cttgaattttcccactgcac

SEQ ID NO: 4746360 - DNA, 13 bp, Homo sapiens
cttgacagggcac

SEQ ID NO: 4746361 - DNA, 15 bp, Homo sapiens
cttgacagggcacac

SEQ ID NO: 4746362 - DNA, 17 bp, Homo sapiens
cttgaccattctccacc

SEQ ID NO: 4746363 - DNA, 22 bp, Homo sapiens
cttgaccattctccacctgcca

SEQ ID NO: 4746364 - DNA, 15 bp, Homo sapiens
cttgagggttgggct

SEQ ID NO: 4746365 - DNA, 19 bp, Homo sapiens
cttgagggttgggctggtg

SEQ ID NO: 4746366 - DNA, 14 bp, Homo sapiens
cttgatatttcctt

SEQ ID NO: 4746367 - DNA, 20 bp, Homo sapiens
cttgatgtgatgtggcagga

SEQ ID NO: 4746368 - DNA, 15 bp, Homo sapiens
cttgcaaaaagggtc

SEQ ID NO: 4746369 - DNA, 16 bp, Homo sapiens
cttgcaatggcagcct

SEQ ID NO: 4746370 - DNA, 12 bp, Homo sapiens
cttgcagaagct

SEQ ID NO: 4746371 - DNA, 13 bp, Homo sapiens
cttgcagaagctg

SEQ ID NO: 4746372 - DNA, 13 bp, Homo sapiens
cttgcagcaggat

SEQ ID NO: 4746373 - DNA, 13 bp, Homo sapiens
cttgcatgaggct

SEQ ID NO: 4746374 - DNA, 17 bp, Homo sapiens
cttgcatgaggctagtg

SEQ ID NO: 4746375 - DNA, 17 bp, Homo sapiens
cttgccaaatataaata

SEQ ID NO: 4746376 - DNA, 22 bp, Homo sapiens
cttgcccatcgggaccagaaac

SEQ ID NO: 4746377 - DNA, 17 bp, Homo sapiens
cttgccccaacccccag

SEQ ID NO: 4746378 - DNA, 18 bp, Homo sapiens
cttgccccaacccccagc

SEQ ID NO: 4746379 - DNA, 21 bp, Homo sapiens
cttgcccccctggcctccccc

SEQ ID NO: 4746380 - DNA, 15 bp, Homo sapiens
cttgcctcggctcct

SEQ ID NO: 4746381 - DNA, 21 bp, Homo sapiens
cttgcctcggctcctgctgca

SEQ ID NO: 4746382 - DNA, 23 bp, Homo sapiens
cttgcctctgtccccttctctca

SEQ ID NO: 4746383 - DNA, 20 bp, Homo sapiens
cttgccttattagagtgtct

SEQ ID NO: 4746384 - DNA, 14 bp, Homo sapiens
cttgctccagcctg

SEQ ID NO: 4746385 - DNA, 18 bp, Homo sapiens
cttgctccagcctgacaa

SEQ ID NO: 4746386 - DNA, 16 bp, Homo sapiens
cttgctctgctgacag

SEQ ID NO: 4746387 - DNA, 20 bp, Homo sapiens
cttgcttgattgtatggtgg

SEQ ID NO: 4746388 - DNA, 20 bp, Homo sapiens
cttggaagctccgctttcta

SEQ ID NO: 4746389 - DNA, 12 bp, Homo sapiens
cttggatgagga

SEQ ID NO: 4746390 - DNA, 13 bp, Homo sapiens
cttggattgtccc

SEQ ID NO: 4746391 - DNA, 17 bp, Homo sapiens
cttggcatcagctggcg

SEQ ID NO: 4746392 - DNA, 14 bp, Homo sapiens
cttggctgcaggga

SEQ ID NO: 4746393 - DNA, 13 bp, Homo sapiens
cttgggctccctg

SEQ ID NO: 4746394 - DNA, 21 bp, Homo sapiens
cttgggctccctgtaacctct

SEQ ID NO: 4746395 - DNA, 15 bp, Homo sapiens
cttggggcctatgca

SEQ ID NO: 4746396 - DNA, 17 bp, Homo sapiens
cttgggtcccagggaag

SEQ ID NO: 4746397 - DNA, 15 bp, Homo sapiens
cttggtcctgctgca

SEQ ID NO: 4746398 - DNA, 18 bp, Homo sapiens
cttggtcctgctgcagtt

SEQ ID NO: 4746399 - DNA, 20 bp, Homo sapiens
cttggtcctgctgcagttgc

SEQ ID NO: 4746400 - DNA, 13 bp, Homo sapiens
cttggttccccca

SEQ ID NO: 4746401 - DNA, 15 bp, Homo sapiens
cttggttggctggcc

SEQ ID NO: 4746402 - DNA, 21 bp, Homo sapiens
cttgtaaatagctcaggtgtc

SEQ ID NO: 4746403 - DNA, 14 bp, Homo sapiens
cttgtaatatttct

SEQ ID NO: 4746404 - DNA, 15 bp, Homo sapiens
cttgtaatatttctt

SEQ ID NO: 4746405 - DNA, 18 bp, Homo sapiens
cttgtattgctccatttt

SEQ ID NO: 4746406 - DNA, 18 bp, Homo sapiens
cttgtcaatactgagcca

SEQ ID NO: 4746407 - DNA, 13 bp, Homo sapiens
cttgtctttggac

SEQ ID NO: 4746408 - DNA, 18 bp, Homo sapiens
cttgtctttggaccctga

SEQ ID NO: 4746409 - DNA, 19 bp, Homo sapiens
cttgtctttggaccctgag

SEQ ID NO: 4746410 - DNA, 14 bp, Homo sapiens
cttgtgaactccat

SEQ ID NO: 4746411 - DNA, 23 bp, Homo sapiens
cttgtgaatattgtggctccctg

SEQ ID NO: 4746412 - DNA, 22 bp, Homo sapiens
cttgtgcttttttgattttgct

SEQ ID NO: 4746413 - DNA, 14 bp, Homo sapiens
cttgtggacacagc

SEQ ID NO: 4746414 - DNA, 18 bp, Homo sapiens
cttgtggacacagctctt

SEQ ID NO: 4746415 - DNA, 15 bp, Homo sapiens
cttgtggtcccaccc

SEQ ID NO: 4746416 - DNA, 15 bp, Homo sapiens
cttgtgttctgagta

SEQ ID NO: 4746417 - DNA, 16 bp, Homo sapiens
cttgttagatttttaa

SEQ ID NO: 4746418 - DNA, 15 bp, Homo sapiens
cttgttattaccaaa

SEQ ID NO: 4746419 - DNA, 21 bp, Homo sapiens
cttgttggatttttgtcttgt

SEQ ID NO: 4746420 - DNA, 23 bp, Homo sapiens
cttgttggatttttgtcttgtgt

SEQ ID NO: 4746421 - DNA, 13 bp, Homo sapiens
cttgtttctttct

SEQ ID NO: 4746422 - DNA, 12 bp, Homo sapiens
cttgtttttgag

SEQ ID NO: 4746423 - DNA, 17 bp, Homo sapiens
ctttaaaaaaatttaag

SEQ ID NO: 4746424 - DNA, 15 bp, Homo sapiens
ctttaaaaggattaa

SEQ ID NO: 4746425 - DNA, 15 bp, Homo sapiens
ctttaaagagagttt

SEQ ID NO: 4746426 - DNA, 19 bp, Homo sapiens
ctttaacaggttttcttct

SEQ ID NO: 4746427 - DNA, 15 bp, Homo sapiens
ctttaaccctcactg

SEQ ID NO: 4746428 - DNA, 17 bp, Homo sapiens
ctttaagtgcacaacat

SEQ ID NO: 4746429 - DNA, 12 bp, Homo sapiens
ctttaatataaa

SEQ ID NO: 4746430 - DNA, 22 bp, Homo sapiens
ctttaatctgttgtttgaagaa

SEQ ID NO: 4746431 - DNA, 17 bp, Homo sapiens
ctttaatgtcacaggca

SEQ ID NO: 4746432 - DNA, 17 bp, Homo sapiens
ctttacttcccagtata

SEQ ID NO: 4746433 - DNA, 20 bp, Homo sapiens
ctttagaattctaattgtca

SEQ ID NO: 4746434 - DNA, 14 bp, Homo sapiens
ctttagcagggaag

SEQ ID NO: 4746435 - DNA, 14 bp, Homo sapiens
ctttaggatgtaaa

SEQ ID NO: 4746436 - DNA, 21 bp, Homo sapiens
ctttattagattttcctcctt

SEQ ID NO: 4746437 - DNA, 21 bp, Homo sapiens
ctttattcaccttttcttcaa

SEQ ID NO: 4746438 - DNA, 20 bp, Homo sapiens
ctttcaatggtttgcaagga

SEQ ID NO: 4746439 - DNA, 20 bp, Homo sapiens
ctttcactaaaacacacagg

SEQ ID NO: 4746440 - DNA, 16 bp, Homo sapiens
ctttcatttactgtgg

SEQ ID NO: 4746441 - DNA, 17 bp, Homo sapiens
ctttcatttgaaagtgg

SEQ ID NO: 4746442 - DNA, 19 bp, Homo sapiens
ctttcatttttttccaggc

SEQ ID NO: 4746443 - DNA, 22 bp, Homo sapiens
ctttcatttttttccaggctgg

SEQ ID NO: 4746444 - DNA, 21 bp, Homo sapiens
ctttccaaaggccatggagag

SEQ ID NO: 4746445 - DNA, 13 bp, Homo sapiens
ctttcctgaggct

SEQ ID NO: 4746446 - DNA, 16 bp, Homo sapiens
ctttcctgaggctggg

SEQ ID NO: 4746447 - DNA, 20 bp, Homo sapiens
ctttcctgaggctgggctcc

SEQ ID NO: 4746448 - DNA, 22 bp, Homo sapiens
ctttcctgaggctgggctccct

SEQ ID NO: 4746449 - DNA, 19 bp, Homo sapiens
ctttccttgttccccatca

SEQ ID NO: 4746450 - DNA, 13 bp, Homo sapiens
ctttctaatagag

SEQ ID NO: 4746451 - DNA, 16 bp, Homo sapiens
ctttctacccagcgag

SEQ ID NO: 4746452 - DNA, 14 bp, Homo sapiens
ctttctactttgtt

SEQ ID NO: 4746453 - DNA, 16 bp, Homo sapiens
ctttctagtggtcttt

SEQ ID NO: 4746454 - DNA, 20 bp, Homo sapiens
ctttctagtggtctttgtaa

SEQ ID NO: 4746455 - DNA, 14 bp, Homo sapiens
ctttctcccctgcc

SEQ ID NO: 4746456 - DNA, 19 bp, Homo sapiens
ctttctcctgtttatgggt

SEQ ID NO: 4746457 - DNA, 15 bp, Homo sapiens
ctttctgactctaaa

SEQ ID NO: 4746458 - DNA, 22 bp, Homo sapiens
ctttcttgatcaacatcttttc

SEQ ID NO: 4746459 - DNA, 17 bp, Homo sapiens
ctttcttggtgcattcg

SEQ ID NO: 4746460 - DNA, 15 bp, Homo sapiens
ctttctttgctgctg

SEQ ID NO: 4746461 - DNA, 16 bp, Homo sapiens
ctttctttgctgctgt

SEQ ID NO: 4746462 - DNA, 21 bp, Homo sapiens
ctttctttgctgctgtggaaa

SEQ ID NO: 4746463 - DNA, 16 bp, Homo sapiens
ctttgaagtcatacca

SEQ ID NO: 4746464 - DNA, 18 bp, Homo sapiens
ctttgacctgcctccctt

SEQ ID NO: 4746465 - DNA, 18 bp, Homo sapiens
ctttgacgccatcccagc

SEQ ID NO: 4746466 - DNA, 19 bp, Homo sapiens
ctttgacgccatcccagcc

SEQ ID NO: 4746467 - DNA, 15 bp, Homo sapiens
ctttgagacagtttc

SEQ ID NO: 4746468 - DNA, 16 bp, Homo sapiens
ctttgagacagtttct

SEQ ID NO: 4746469 - DNA, 17 bp, Homo sapiens
ctttgagacagtttctt

SEQ ID NO: 4746470 - DNA, 21 bp, Homo sapiens
ctttgataatgttaaatttgt

SEQ ID NO: 4746471 - DNA, 16 bp, Homo sapiens
ctttgattctccttca

SEQ ID NO: 4746472 - DNA, 14 bp, Homo sapiens
ctttgcagacaggc

SEQ ID NO: 4746473 - DNA, 15 bp, Homo sapiens
ctttgcagacaggca

SEQ ID NO: 4746474 - DNA, 23 bp, Homo sapiens
ctttgcatattataaaggataaa

SEQ ID NO: 4746475 - DNA, 15 bp, Homo sapiens
ctttgccaacatggt

SEQ ID NO: 4746476 - DNA, 21 bp, Homo sapiens
ctttgccaccctcatgctgtg

SEQ ID NO: 4746477 - DNA, 16 bp, Homo sapiens
ctttgctttgcccagc

SEQ ID NO: 4746478 - DNA, 18 bp, Homo sapiens
ctttggaccctgaggccc

SEQ ID NO: 4746479 - DNA, 16 bp, Homo sapiens
ctttggctgcatgcga

SEQ ID NO: 4746480 - DNA, 13 bp, Homo sapiens
ctttgggacattc

SEQ ID NO: 4746481 - DNA, 20 bp, Homo sapiens
ctttggtctacactgtgctg

SEQ ID NO: 4746482 - DNA, 18 bp, Homo sapiens
ctttgtccccaccgcaga

SEQ ID NO: 4746483 - DNA, 19 bp, Homo sapiens
ctttgtgaggaagccgctg

SEQ ID NO: 4746484 - DNA, 11 bp, Homo sapiens
ctttgtgctga

SEQ ID NO: 4746485 - DNA, 16 bp, Homo sapiens
ctttgttctggctctt

SEQ ID NO: 4746486 - DNA, 12 bp, Homo sapiens
ctttgtttattt

SEQ ID NO: 4746487 - DNA, 14 bp, Homo sapiens
cttttaaaaatgta

SEQ ID NO: 4746488 - DNA, 18 bp, Homo sapiens
cttttaaagaatttcttt

SEQ ID NO: 4746489 - DNA, 13 bp, Homo sapiens
cttttaagacatt

SEQ ID NO: 4746490 - DNA, 16 bp, Homo sapiens
cttttaagacattttc

SEQ ID NO: 4746491 - DNA, 15 bp, Homo sapiens
cttttacatacagtg

SEQ ID NO: 4746492 - DNA, 19 bp, Homo sapiens
cttttatttagcaccaggg

SEQ ID NO: 4746493 - DNA, 15 bp, Homo sapiens
cttttcaaaacattt

SEQ ID NO: 4746494 - DNA, 13 bp, Homo sapiens
cttttcacaaata

SEQ ID NO: 4746495 - DNA, 14 bp, Homo sapiens
cttttcacaaataa

SEQ ID NO: 4746496 - DNA, 14 bp, Homo sapiens
cttttcagcttctg

SEQ ID NO: 4746497 - DNA, 23 bp, Homo sapiens
cttttcagcttctgctgggctgg

SEQ ID NO: 4746498 - DNA, 22 bp, Homo sapiens
cttttcataacctagccttaga

SEQ ID NO: 4746499 - DNA, 11 bp, Homo sapiens
cttttccagaa

SEQ ID NO: 4746500 - DNA, 23 bp, Homo sapiens
cttttcccaacccccagccccca

SEQ ID NO: 4746501 - DNA, 21 bp, Homo sapiens
cttttctagcccgaatacaaa

SEQ ID NO: 4746502 - DNA, 22 bp, Homo sapiens
cttttctggaagggcagcatat

SEQ ID NO: 4746503 - DNA, 23 bp, Homo sapiens
cttttcttgcatgaggctagtgt

SEQ ID NO: 4746504 - DNA, 22 bp, Homo sapiens
cttttgaagaacaaaaggcttt

SEQ ID NO: 4746505 - DNA, 13 bp, Homo sapiens
cttttggagtcag

SEQ ID NO: 4746506 - DNA, 23 bp, Homo sapiens
cttttggcaatgactcaaagtct

SEQ ID NO: 4746507 - DNA, 16 bp, Homo sapiens
cttttggtctgtgtga

SEQ ID NO: 4746508 - DNA, 17 bp, Homo sapiens
cttttgtctatgggact

SEQ ID NO: 4746509 - DNA, 23 bp, Homo sapiens
ctttttaaccaagttgtttattc

SEQ ID NO: 4746510 - DNA, 16 bp, Homo sapiens
ctttttaattgttgtt

SEQ ID NO: 4746511 - DNA, 22 bp, Homo sapiens
ctttttaattgttgtttctttc

SEQ ID NO: 4746512 - DNA, 23 bp, Homo sapiens
ctttttaattgttgtttctttct

SEQ ID NO: 4746513 - DNA, 13 bp, Homo sapiens
ctttttattaaaa

SEQ ID NO: 4746514 - DNA, 18 bp, Homo sapiens
ctttttcataaattattt

SEQ ID NO: 4746515 - DNA, 22 bp, Homo sapiens
ctttttctcactatctgaaaat

SEQ ID NO: 4746516 - DNA, 13 bp, Homo sapiens
ctttttgcagctt

SEQ ID NO: 4746517 - DNA, 14 bp, Homo sapiens
ctttttgcagcttt

SEQ ID NO: 4746518 - DNA, 15 bp, Homo sapiens
cttttttcactacat

SEQ ID NO: 4746519 - DNA, 14 bp, Homo sapiens
cttttttggctgct

SEQ ID NO: 4746520 - DNA, 19 bp, Homo sapiens
ctttttttggaagttattt

SEQ ID NO: 4746521 - DNA, 14 bp, Homo sapiens
cttttttttaagtt

SEQ ID NO: 4746522 - DNA, 21 bp, Homo sapiens
cttttttttttttgagacaga

SEQ ID NO: 4746523 - DNA, 21 bp, Homo sapiens
ctttttttttttttttaaaga

SEQ ID NO: 4746524 - DNA, 13 bp, Homo sapiens
gaaaaaaattatt

SEQ ID NO: 4746525 - DNA, 13 bp, Homo sapiens
gaaaaaattgaaa

SEQ ID NO: 4746526 - DNA, 23 bp, Homo sapiens
gaaaaagaacttccccatacaaa

SEQ ID NO: 4746527 - DNA, 14 bp, Homo sapiens
gaaaaaggtgatta

SEQ ID NO: 4746528 - DNA, 17 bp, Homo sapiens
gaaaaatttgaagtatt

SEQ ID NO: 4746529 - DNA, 22 bp, Homo sapiens
gaaaacaataacgataaaagac

SEQ ID NO: 4746530 - DNA, 14 bp, Homo sapiens
gaaaacactgtgca

SEQ ID NO: 4746531 - DNA, 21 bp, Homo sapiens
gaaaacactgtgcacatctgt

SEQ ID NO: 4746532 - DNA, 22 bp, Homo sapiens
gaaaacactgttctctgccctc

SEQ ID NO: 4746533 - DNA, 24 bp, Homo sapiens
gaaaacactgttctctgccctcca

SEQ ID NO: 4746534 - DNA, 19 bp, Homo sapiens
gaaaacagagtatttctgg

SEQ ID NO: 4746535 - DNA, 18 bp, Homo sapiens
gaaaacaggcactgccct

SEQ ID NO: 4746536 - DNA, 16 bp, Homo sapiens
gaaaacatcctgactt

SEQ ID NO: 4746537 - DNA, 16 bp, Homo sapiens
gaaaactgcacaataa

SEQ ID NO: 4746538 - DNA, 15 bp, Homo sapiens
gaaaagcctctgtgt

SEQ ID NO: 4746539 - DNA, 11 bp, Homo sapiens
gaaaagctatt

SEQ ID NO: 4746540 - DNA, 19 bp, Homo sapiens
gaaaaggaggccattctga

SEQ ID NO: 4746541 - DNA, 22 bp, Homo sapiens
gaaaagtcaagggtagggtggg

SEQ ID NO: 4746542 - DNA, 16 bp, Homo sapiens
gaaaatataaccagcc

SEQ ID NO: 4746543 - DNA, 15 bp, Homo sapiens
gaaaatatacatttg

SEQ ID NO: 4746544 - DNA, 21 bp, Homo sapiens
gaaaatatctcttgtgctttt

SEQ ID NO: 4746545 - DNA, 18 bp, Homo sapiens
gaaaatcttataatttaa

SEQ ID NO: 4746546 - DNA, 20 bp, Homo sapiens
gaaaatcttataatttaaaa

SEQ ID NO: 4746547 - DNA, 13 bp, Homo sapiens
gaaaatgaaagct

SEQ ID NO: 4746548 - DNA, 23 bp, Homo sapiens
gaaaatgaatttgggatactaaa

SEQ ID NO: 4746549 - DNA, 20 bp, Homo sapiens
gaaaatgcaacaacatgtat

SEQ ID NO: 4746550 - DNA, 17 bp, Homo sapiens
gaaaatgtctgtaataa

SEQ ID NO: 4746551 - DNA, 12 bp, Homo sapiens
gaaaatgtgtgt

SEQ ID NO: 4746552 - DNA, 13 bp, Homo sapiens
gaaaattcactat

SEQ ID NO: 4746553 - DNA, 17 bp, Homo sapiens
gaaaatttgttattttg

SEQ ID NO: 4746554 - DNA, 21 bp, Homo sapiens
gaaaatttgttattttgcaac

SEQ ID NO: 4746555 - DNA, 18 bp, Homo sapiens
gaaacaccctcacactgg

SEQ ID NO: 4746556 - DNA, 22 bp, Homo sapiens
gaaacaccctcacactgggact

SEQ ID NO: 4746557 - DNA, 14 bp, Homo sapiens
gaaaccacagctgc

SEQ ID NO: 4746558 - DNA, 18 bp, Homo sapiens
gaaaccacagctgctgga

SEQ ID NO: 4746559 - DNA, 14 bp, Homo sapiens
gaaacccagctctg

SEQ ID NO: 4746560 - DNA, 19 bp, Homo sapiens
gaaaccttttttaagattt

SEQ ID NO: 4746561 - DNA, 22 bp, Homo sapiens
gaaaccttttttaagatttttc

SEQ ID NO: 4746562 - DNA, 20 bp, Homo sapiens
gaaactccaccttgcgggga

SEQ ID NO: 4746563 - DNA, 13 bp, Homo sapiens
gaaactccatctc

SEQ ID NO: 4746564 - DNA, 14 bp, Homo sapiens
gaaactcttatctc

SEQ ID NO: 4746565 - DNA, 20 bp, Homo sapiens
gaaactcttatctcagtcat

SEQ ID NO: 4746566 - DNA, 21 bp, Homo sapiens
gaaactgtcggtttgctttga

SEQ ID NO: 4746567 - DNA, 13 bp, Homo sapiens
gaaagaaaatgaa

SEQ ID NO: 4746568 - DNA, 16 bp, Homo sapiens
gaaagacagagctggg

SEQ ID NO: 4746569 - DNA, 14 bp, Homo sapiens
gaaagagaaggtgg

SEQ ID NO: 4746570 - DNA, 16 bp, Homo sapiens
gaaagagatacagagg

SEQ ID NO: 4746571 - DNA, 20 bp, Homo sapiens
gaaagagattagaacattta

SEQ ID NO: 4746572 - DNA, 13 bp, Homo sapiens
gaaagattttata

SEQ ID NO: 4746573 - DNA, 18 bp, Homo sapiens
gaaagcttcagtgctgcc

SEQ ID NO: 4746574 - DNA, 11 bp, Homo sapiens
gaaaggaaaga

SEQ ID NO: 4746575 - DNA, 13 bp, Homo sapiens
gaaaggctccagg

SEQ ID NO: 4746576 - DNA, 18 bp, Homo sapiens
gaaaggctccaggagcag

SEQ ID NO: 4746577 - DNA, 19 bp, Homo sapiens
gaaaggctccaggagcagc

SEQ ID NO: 4746578 - DNA, 20 bp, Homo sapiens
gaaagggacgctacccggga

SEQ ID NO: 4746579 - DNA, 19 bp, Homo sapiens
gaaagggacttggaagctc

SEQ ID NO: 4746580 - DNA, 13 bp, Homo sapiens
gaaagggcccaga

SEQ ID NO: 4746581 - DNA, 16 bp, Homo sapiens
gaaagggcccagagag

SEQ ID NO: 4746582 - DNA, 19 bp, Homo sapiens
gaaagtaagaaaacaatat

SEQ ID NO: 4746583 - DNA, 21 bp, Homo sapiens
gaaagtacttctccaccctgc

SEQ ID NO: 4746584 - DNA, 22 bp, Homo sapiens
gaaagtacttctccaccctgct

SEQ ID NO: 4746585 - DNA, 15 bp, Homo sapiens
gaaagttttgttctg

SEQ ID NO: 4746586 - DNA, 13 bp, Homo sapiens
gaaataaaagctt

SEQ ID NO: 4746587 - DNA, 15 bp, Homo sapiens
gaaataacaatgtta

SEQ ID NO: 4746588 - DNA, 18 bp, Homo sapiens
gaaataacaatgttaagg

SEQ ID NO: 4746589 - DNA, 20 bp, Homo sapiens
gaaataacaatgttaaggaa

SEQ ID NO: 4746590 - DNA, 20 bp, Homo sapiens
gaaatagctccgtggagcag

SEQ ID NO: 4746591 - DNA, 23 bp, Homo sapiens
gaaatatcaaagtcattaaagac

SEQ ID NO: 4746592 - DNA, 11 bp, Homo sapiens
gaaatattaaa

SEQ ID NO: 4746593 - DNA, 17 bp, Homo sapiens
gaaatcgccttatgaga

SEQ ID NO: 4746594 - DNA, 19 bp, Homo sapiens
gaaatcgccttatgagaac

SEQ ID NO: 4746595 - DNA, 11 bp, Homo sapiens
gaaatgagctc

SEQ ID NO: 4746596 - DNA, 23 bp, Homo sapiens
gaaatgctggtttttcagttttc

SEQ ID NO: 4746597 - DNA, 18 bp, Homo sapiens
gaaatggattggtaagat

SEQ ID NO: 4746598 - DNA, 15 bp, Homo sapiens
gaaatgggcagagca

SEQ ID NO: 4746599 - DNA, 17 bp, Homo sapiens
gaaatgggcagagcaga

SEQ ID NO: 4746600 - DNA, 19 bp, Homo sapiens
gaaatgtagatgatatgtt

SEQ ID NO: 4746601 - DNA, 15 bp, Homo sapiens
gaaattaatttgtga

SEQ ID NO: 4746602 - DNA, 17 bp, Homo sapiens
gaaattaatttgtgaat

SEQ ID NO: 4746603 - DNA, 19 bp, Homo sapiens
gaaattaatttgtgaattt

SEQ ID NO: 4746604 - DNA, 22 bp, Homo sapiens
gaaattaatttgtgaatttgca

SEQ ID NO: 4746605 - DNA, 21 bp, Homo sapiens
gaaattcccttcatctggaac

SEQ ID NO: 4746606 - DNA, 16 bp, Homo sapiens
gaaattgtattacaaa

SEQ ID NO: 4746607 - DNA, 18 bp, Homo sapiens
gaaattgtattacaaatc

SEQ ID NO: 4746608 - DNA, 16 bp, Homo sapiens
gaaatttcattttcct

SEQ ID NO: 4746609 - DNA, 13 bp, Homo sapiens
gaacaagcttcag

SEQ ID NO: 4746610 - DNA, 14 bp, Homo sapiens
gaacaatcacaaaa

SEQ ID NO: 4746611 - DNA, 20 bp, Homo sapiens
gaacacacccatcatctgac

SEQ ID NO: 4746612 - DNA, 17 bp, Homo sapiens
gaacactccttcacaga

SEQ ID NO: 4746613 - DNA, 19 bp, Homo sapiens
gaacagactggaagcacag

SEQ ID NO: 4746614 - DNA, 17 bp, Homo sapiens
gaacagataatccctgt

SEQ ID NO: 4746615 - DNA, 21 bp, Homo sapiens
gaacagattcacactgtctgg

SEQ ID NO: 4746616 - DNA, 15 bp, Homo sapiens
gaacagcttcaggtt

SEQ ID NO: 4746617 - DNA, 18 bp, Homo sapiens
gaacagtgcttgccacag

SEQ ID NO: 4746618 - DNA, 18 bp, Homo sapiens
gaacagtgtttgattttt

SEQ ID NO: 4746619 - DNA, 20 bp, Homo sapiens
gaacagtgtttgatttttat

SEQ ID NO: 4746620 - DNA, 12 bp, Homo sapiens
gaacatacagac

SEQ ID NO: 4746621 - DNA, 15 bp, Homo sapiens
gaacatacagacaca

SEQ ID NO: 4746622 - DNA, 17 bp, Homo sapiens
gaacatctgtcctgtga

SEQ ID NO: 4746623 - DNA, 15 bp, Homo sapiens
gaacatggggaggag

SEQ ID NO: 4746624 - DNA, 18 bp, Homo sapiens
gaacatggtgtgtgtctc

SEQ ID NO: 4746625 - DNA, 19 bp, Homo sapiens
gaacatggtgtgtgtctct

SEQ ID NO: 4746626 - DNA, 22 bp, Homo sapiens
gaacatggtgtgtgtctctgac

SEQ ID NO: 4746627 - DNA, 13 bp, Homo sapiens
gaacattgcaata

SEQ ID NO: 4746628 - DNA, 15 bp, Homo sapiens
gaacattgcaataga

SEQ ID NO: 4746629 - DNA, 20 bp, Homo sapiens
gaacatttaataatgtatgt

SEQ ID NO: 4746630 - DNA, 20 bp, Homo sapiens
gaacccaaagagacagctct

SEQ ID NO: 4746631 - DNA, 17 bp, Homo sapiens
gaaccctagctgtgtca

SEQ ID NO: 4746632 - DNA, 22 bp, Homo sapiens
gaaccgaacatatcatttgtga

SEQ ID NO: 4746633 - DNA, 19 bp, Homo sapiens
gaacctacagttttaactg

SEQ ID NO: 4746634 - DNA, 14 bp, Homo sapiens
gaacctagaagggc

SEQ ID NO: 4746635 - DNA, 11 bp, Homo sapiens
gaacctgaccc

SEQ ID NO: 4746636 - DNA, 12 bp, Homo sapiens
gaacctgacccc

SEQ ID NO: 4746637 - DNA, 15 bp, Homo sapiens
gaacctgatgaaaat

SEQ ID NO: 4746638 - DNA, 15 bp, Homo sapiens
gaacctggagagcta

SEQ ID NO: 4746639 - DNA, 12 bp, Homo sapiens
gaacgtgtatgt

SEQ ID NO: 4746640 - DNA, 14 bp, Homo sapiens
gaactaatttctgt

SEQ ID NO: 4746641 - DNA, 24 bp, Homo sapiens
gaactacgtgacctctgcaagaca

SEQ ID NO: 4746642 - DNA, 21 bp, Homo sapiens
gaactcacctggggctgctgg

SEQ ID NO: 4746643 - DNA, 22 bp, Homo sapiens
gaactcatccctaatgctgcag

SEQ ID NO: 4746644 - DNA, 15 bp, Homo sapiens
gaactcctaaatcaa

SEQ ID NO: 4746645 - DNA, 14 bp, Homo sapiens
gaactcctgacctc

SEQ ID NO: 4746646 - DNA, 16 bp, Homo sapiens
gaactggaggcaggga

SEQ ID NO: 4746647 - DNA, 22 bp, Homo sapiens
gaactgggtacttgtggacaca

SEQ ID NO: 4746648 - DNA, 14 bp, Homo sapiens
gaactgttggttat

SEQ ID NO: 4746649 - DNA, 22 bp, Homo sapiens
gaacttgtaaaggaatttaaaa

SEQ ID NO: 4746650 - DNA, 15 bp, Homo sapiens
gaagaaagtggaaaa

SEQ ID NO: 4746651 - DNA, 16 bp, Homo sapiens
gaagaaatctttccag

SEQ ID NO: 4746652 - DNA, 15 bp, Homo sapiens
gaagaacaaaaggct

SEQ ID NO: 4746653 - DNA, 15 bp, Homo sapiens
gaagacaccagagca

SEQ ID NO: 4746654 - DNA, 18 bp, Homo sapiens
gaagacaccagagcagat

SEQ ID NO: 4746655 - DNA, 23 bp, Homo sapiens
gaagacaccagagcagatgcaga

SEQ ID NO: 4746656 - DNA, 16 bp, Homo sapiens
gaagacactgatgggc

SEQ ID NO: 4746657 - DNA, 21 bp, Homo sapiens
gaagacagagacctcctgcct

SEQ ID NO: 4746658 - DNA, 13 bp, Homo sapiens
gaagacagaggca

SEQ ID NO: 4746659 - DNA, 20 bp, Homo sapiens
gaagacagcagcaagtgtgc

SEQ ID NO: 4746660 - DNA, 20 bp, Homo sapiens
gaagacccattccttcccag

SEQ ID NO: 4746661 - DNA, 22 bp, Homo sapiens
gaagacctggcaaggacacaga

SEQ ID NO: 4746662 - DNA, 21 bp, Homo sapiens
gaagactcattcttctgtacg

SEQ ID NO: 4746663 - DNA, 21 bp, Homo sapiens
gaagagagtccatatttcaat

SEQ ID NO: 4746664 - DNA, 20 bp, Homo sapiens
gaagatcccaacatggtcct

SEQ ID NO: 4746665 - DNA, 13 bp, Homo sapiens
gaagatcctaccc

SEQ ID NO: 4746666 - DNA, 22 bp, Homo sapiens
gaagatgcaggtttgaccagga

SEQ ID NO: 4746667 - DNA, 12 bp, Homo sapiens
gaagcagctctt

SEQ ID NO: 4746668 - DNA, 14 bp, Homo sapiens
gaagcaggctacac

SEQ ID NO: 4746669 - DNA, 22 bp, Homo sapiens
gaagcattccttctttgataat

SEQ ID NO: 4746670 - DNA, 18 bp, Homo sapiens
gaagccacaggcctgaga

SEQ ID NO: 4746671 - DNA, 21 bp, Homo sapiens
gaagcccaggaaaggctccag

SEQ ID NO: 4746672 - DNA, 16 bp, Homo sapiens
gaagccttctgacctg

SEQ ID NO: 4746673 - DNA, 17 bp, Homo sapiens
gaagccttctgacctgg

SEQ ID NO: 4746674 - DNA, 13 bp, Homo sapiens
gaagcctttggga

SEQ ID NO: 4746675 - DNA, 15 bp, Homo sapiens
gaagctagctcccct

SEQ ID NO: 4746676 - DNA, 19 bp, Homo sapiens
gaagctagctcccctcctc

SEQ ID NO: 4746677 - DNA, 20 bp, Homo sapiens
gaagctatttcctttgcgca

SEQ ID NO: 4746678 - DNA, 18 bp, Homo sapiens
gaagctcagggcctggct

SEQ ID NO: 4746679 - DNA, 21 bp, Homo sapiens
gaagctcagggcctggctcag

SEQ ID NO: 4746680 - DNA, 13 bp, Homo sapiens
gaagctgcaataa

SEQ ID NO: 4746681 - DNA, 21 bp, Homo sapiens
gaagctgttgtacatttatga

SEQ ID NO: 4746682 - DNA, 22 bp, Homo sapiens
gaagcttctaaatggtgctgca

SEQ ID NO: 4746683 - DNA, 13 bp, Homo sapiens
gaagcttctaatt

SEQ ID NO: 4746684 - DNA, 18 bp, Homo sapiens
gaagcttggggaagaccc

SEQ ID NO: 4746685 - DNA, 14 bp, Homo sapiens
gaaggaaacccagc

SEQ ID NO: 4746686 - DNA, 19 bp, Homo sapiens
gaaggaaacccagctctgg

SEQ ID NO: 4746687 - DNA, 22 bp, Homo sapiens
gaaggaaacccagctctggtcc

SEQ ID NO: 4746688 - DNA, 19 bp, Homo sapiens
gaaggactgtgacaggcag

SEQ ID NO: 4746689 - DNA, 23 bp, Homo sapiens
gaaggactgtgacaggcagcaga

SEQ ID NO: 4746690 - DNA, 22 bp, Homo sapiens
gaaggagccccattcctgggaa

SEQ ID NO: 4746691 - DNA, 18 bp, Homo sapiens
gaaggagctgcctggacc

SEQ ID NO: 4746692 - DNA, 13 bp, Homo sapiens
gaaggattgtaaa

SEQ ID NO: 4746693 - DNA, 14 bp, Homo sapiens
gaaggattgtaaaa

SEQ ID NO: 4746694 - DNA, 13 bp, Homo sapiens
gaaggcaatgcca

SEQ ID NO: 4746695 - DNA, 20 bp, Homo sapiens
gaaggcagggagggcctggg

SEQ ID NO: 4746696 - DNA, 16 bp, Homo sapiens
gaaggccccgcccagg

SEQ ID NO: 4746697 - DNA, 18 bp, Homo sapiens
gaaggccccgcccaggct

SEQ ID NO: 4746698 - DNA, 17 bp, Homo sapiens
gaaggctcgagcatgcc

SEQ ID NO: 4746699 - DNA, 21 bp, Homo sapiens
gaaggctcgagcatgcctgga

SEQ ID NO: 4746700 - DNA, 21 bp, Homo sapiens
gaaggctcttctccccagagt

SEQ ID NO: 4746701 - DNA, 15 bp, Homo sapiens
gaaggctgggttctg

SEQ ID NO: 4746702 - DNA, 16 bp, Homo sapiens
gaaggcttctctctgt

SEQ ID NO: 4746703 - DNA, 20 bp, Homo sapiens
gaagggctagaacctggagg

SEQ ID NO: 4746704 - DNA, 21 bp, Homo sapiens
gaagggcttggactcaagcaa

SEQ ID NO: 4746705 - DNA, 16 bp, Homo sapiens
gaagggggctgggaca

SEQ ID NO: 4746706 - DNA, 16 bp, Homo sapiens
gaagggtctgtttaaa

SEQ ID NO: 4746707 - DNA, 13 bp, Homo sapiens
gaaggtaattaaa

SEQ ID NO: 4746708 - DNA, 16 bp, Homo sapiens
gaaggtagaatgtttt

SEQ ID NO: 4746709 - DNA, 20 bp, Homo sapiens
gaaggtagaatgttttcaaa

SEQ ID NO: 4746710 - DNA, 23 bp, Homo sapiens
gaaggtggtgggggtgcagatga

SEQ ID NO: 4746711 - DNA, 14 bp, Homo sapiens
gaagtactttgtgc

SEQ ID NO: 4746712 - DNA, 22 bp, Homo sapiens
gaagtattagacttctaaataa

SEQ ID NO: 4746713 - DNA, 15 bp, Homo sapiens
gaagtcaaagcaagg

SEQ ID NO: 4746714 - DNA, 16 bp, Homo sapiens
gaagtcaaagcaagga

SEQ ID NO: 4746715 - DNA, 12 bp, Homo sapiens
gaagtccctcag

SEQ ID NO: 4746716 - DNA, 14 bp, Homo sapiens
gaagtccctcagag

SEQ ID NO: 4746717 - DNA, 16 bp, Homo sapiens
gaagtccctcagaggc

SEQ ID NO: 4746718 - DNA, 18 bp, Homo sapiens
gaagtccctcagaggcct

SEQ ID NO: 4746719 - DNA, 15 bp, Homo sapiens
gaagtgactgttgta

SEQ ID NO: 4746720 - DNA, 13 bp, Homo sapiens
gaagtgactttgg

SEQ ID NO: 4746721 - DNA, 20 bp, Homo sapiens
gaagtgactttggctgcatg

SEQ ID NO: 4746722 - DNA, 22 bp, Homo sapiens
gaagtgcggggtaggggaagaa

SEQ ID NO: 4746723 - DNA, 22 bp, Homo sapiens
gaagtggggaccccacccctca

SEQ ID NO: 4746724 - DNA, 19 bp, Homo sapiens
gaagttgattcatattgca

SEQ ID NO: 4746725 - DNA, 21 bp, Homo sapiens
gaagttggtcttactttgtgc

SEQ ID NO: 4746726 - DNA, 17 bp, Homo sapiens
gaataagattatatgga

SEQ ID NO: 4746727 - DNA, 17 bp, Homo sapiens
gaatacaaacacctgga

SEQ ID NO: 4746728 - DNA, 13 bp, Homo sapiens
gaatacctgtccc

SEQ ID NO: 4746729 - DNA, 19 bp, Homo sapiens
gaatactcagggaaagcat

SEQ ID NO: 4746730 - DNA, 19 bp, Homo sapiens
gaatacttttgccctttga

SEQ ID NO: 4746731 - DNA, 12 bp, Homo sapiens
gaatagatttta

SEQ ID NO: 4746732 - DNA, 16 bp, Homo sapiens
gaatagtctctgggtt

SEQ ID NO: 4746733 - DNA, 13 bp, Homo sapiens
gaatataaacact

SEQ ID NO: 4746734 - DNA, 23 bp, Homo sapiens
gaatattaagaaacaatttaaat

SEQ ID NO: 4746735 - DNA, 19 bp, Homo sapiens
gaatattgtggctccctgg

SEQ ID NO: 4746736 - DNA, 23 bp, Homo sapiens
gaatattttgttttgtgcagaga

SEQ ID NO: 4746737 - DNA, 20 bp, Homo sapiens
gaatccagacccggctgcgt

SEQ ID NO: 4746738 - DNA, 14 bp, Homo sapiens
gaatctccttgttg

SEQ ID NO: 4746739 - DNA, 18 bp, Homo sapiens
gaatctctttttgctttc

SEQ ID NO: 4746740 - DNA, 17 bp, Homo sapiens
gaatcttcacctcagag

SEQ ID NO: 4746741 - DNA, 14 bp, Homo sapiens
gaatgaaagggccc

SEQ ID NO: 4746742 - DNA, 18 bp, Homo sapiens
gaatgaaccacatcttgc

SEQ ID NO: 4746743 - DNA, 15 bp, Homo sapiens
gaatgaggaacaatc

SEQ ID NO: 4746744 - DNA, 11 bp, Homo sapiens
gaatgcagtgg

SEQ ID NO: 4746745 - DNA, 14 bp, Homo sapiens
gaatgcataaaatg

SEQ ID NO: 4746746 - DNA, 18 bp, Homo sapiens
gaatgcttataggtggcc

SEQ ID NO: 4746747 - DNA, 16 bp, Homo sapiens
gaatgtaaaagaaaat

SEQ ID NO: 4746748 - DNA, 16 bp, Homo sapiens
gaatgtaattggaatc

SEQ ID NO: 4746749 - DNA, 23 bp, Homo sapiens
gaatgttagagtaatgaaatgga

SEQ ID NO: 4746750 - DNA, 18 bp, Homo sapiens
gaattaagttagggaatg

SEQ ID NO: 4746751 - DNA, 21 bp, Homo sapiens
gaattataactgtaaagatgt

SEQ ID NO: 4746752 - DNA, 18 bp, Homo sapiens
gaattattcagtgaattt

SEQ ID NO: 4746753 - DNA, 21 bp, Homo sapiens
gaattattcagtgaatttgtc

SEQ ID NO: 4746754 - DNA, 15 bp, Homo sapiens
gaattattttgttac

SEQ ID NO: 4746755 - DNA, 22 bp, Homo sapiens
gaatttaagcatgagtggcctt

SEQ ID NO: 4746756 - DNA, 18 bp, Homo sapiens
gaatttccttactcttga

SEQ ID NO: 4746757 - DNA, 21 bp, Homo sapiens
gaatttgtccattgtaaatct

SEQ ID NO: 4746758 - DNA, 14 bp, Homo sapiens
gaattttcccactg

SEQ ID NO: 4746759 - DNA, 14 bp, Homo sapiens
gaatttttattatt

SEQ ID NO: 4746760 - DNA, 13 bp, Homo sapiens
gacaaaataaagt

SEQ ID NO: 4746761 - DNA, 14 bp, Homo sapiens
gacaaaataaagtg

SEQ ID NO: 4746762 - DNA, 14 bp, Homo sapiens
gacaaacagtgaat

SEQ ID NO: 4746763 - DNA, 15 bp, Homo sapiens
gacaaatcaaagcag

SEQ ID NO: 4746764 - DNA, 23 bp, Homo sapiens
gacaacactcattgacctgaggc

SEQ ID NO: 4746765 - DNA, 16 bp, Homo sapiens
gacaacagcctgagaa

SEQ ID NO: 4746766 - DNA, 17 bp, Homo sapiens
gacaacagcctgagaaa

SEQ ID NO: 4746767 - DNA, 18 bp, Homo sapiens
gacaacagcctgagaaat

SEQ ID NO: 4746768 - DNA, 21 bp, Homo sapiens
gacaaggattgctactgtcct

SEQ ID NO: 4746769 - DNA, 14 bp, Homo sapiens
gacaataaaacatt

SEQ ID NO: 4746770 - DNA, 20 bp, Homo sapiens
gacaatactccctttaaaga

SEQ ID NO: 4746771 - DNA, 21 bp, Homo sapiens
gacaatactccctttaaagag

SEQ ID NO: 4746772 - DNA, 17 bp, Homo sapiens
gacaattcagtgactta

SEQ ID NO: 4746773 - DNA, 20 bp, Homo sapiens
gacacaaacctgcctgggtt

SEQ ID NO: 4746774 - DNA, 13 bp, Homo sapiens
gacacacagctct

SEQ ID NO: 4746775 - DNA, 15 bp, Homo sapiens
gacacacagctctgt

SEQ ID NO: 4746776 - DNA, 18 bp, Homo sapiens
gacacacagctctgtcct

SEQ ID NO: 4746777 - DNA, 21 bp, Homo sapiens
gacacacagctctgtcctggg

SEQ ID NO: 4746778 - DNA, 15 bp, Homo sapiens
gacacagatgaaaca

SEQ ID NO: 4746779 - DNA, 19 bp, Homo sapiens
gacacagctcttctccagg

SEQ ID NO: 4746780 - DNA, 20 bp, Homo sapiens
gacacagctcttctccaggc

SEQ ID NO: 4746781 - DNA, 21 bp, Homo sapiens
gacacagctcttctccaggct

SEQ ID NO: 4746782 - DNA, 22 bp, Homo sapiens
gacacagctcttctccaggctg

SEQ ID NO: 4746783 - DNA, 12 bp, Homo sapiens
gacacaggcccg

SEQ ID NO: 4746784 - DNA, 15 bp, Homo sapiens
gacacaggcccggct

SEQ ID NO: 4746785 - DNA, 17 bp, Homo sapiens
gacacagtgaccatact

SEQ ID NO: 4746786 - DNA, 15 bp, Homo sapiens
gacaccacccagagc

SEQ ID NO: 4746787 - DNA, 14 bp, Homo sapiens
gacaccagagcaga

SEQ ID NO: 4746788 - DNA, 22 bp, Homo sapiens
gacaccagagcagatgcagaga

SEQ ID NO: 4746789 - DNA, 17 bp, Homo sapiens
gacaccttgacagggca

SEQ ID NO: 4746790 - DNA, 17 bp, Homo sapiens
gacactaaccacgctgg

SEQ ID NO: 4746791 - DNA, 21 bp, Homo sapiens
gacactaaccacgctggacct

SEQ ID NO: 4746792 - DNA, 21 bp, Homo sapiens
gacactcccttgggctccctg

SEQ ID NO: 4746793 - DNA, 13 bp, Homo sapiens
gacactgatgggc

SEQ ID NO: 4746794 - DNA, 16 bp, Homo sapiens
gacactgcggggcttg

SEQ ID NO: 4746795 - DNA, 22 bp, Homo sapiens
gacactgcggggcttggctgag

SEQ ID NO: 4746796 - DNA, 12 bp, Homo sapiens
gacacttctcag

SEQ ID NO: 4746797 - DNA, 15 bp, Homo sapiens
gacagaacactgtct

SEQ ID NO: 4746798 - DNA, 12 bp, Homo sapiens
gacagacacagg

SEQ ID NO: 4746799 - DNA, 11 bp, Homo sapiens
gacagaggcag

SEQ ID NO: 4746800 - DNA, 16 bp, Homo sapiens
gacagaggcagcccca

SEQ ID NO: 4746801 - DNA, 17 bp, Homo sapiens
gacagaggcagccccat

SEQ ID NO: 4746802 - DNA, 23 bp, Homo sapiens
gacagaggcagccccattctgcc

SEQ ID NO: 4746803 - DNA, 18 bp, Homo sapiens
gacagagggggtggcctc

SEQ ID NO: 4746804 - DNA, 21 bp, Homo sapiens
gacagagggggtggcctccca

SEQ ID NO: 4746805 - DNA, 19 bp, Homo sapiens
gacagagtgagactctgtc

SEQ ID NO: 4746806 - DNA, 16 bp, Homo sapiens
gacagatcctccattt

SEQ ID NO: 4746807 - DNA, 19 bp, Homo sapiens
gacagatcctccatttttg

SEQ ID NO: 4746808 - DNA, 19 bp, Homo sapiens
gacagatctctgctttgga

SEQ ID NO: 4746809 - DNA, 23 bp, Homo sapiens
gacagatctctgctttggaaatc

SEQ ID NO: 4746810 - DNA, 18 bp, Homo sapiens
gacagccacggccaggcc

SEQ ID NO: 4746811 - DNA, 21 bp, Homo sapiens
gacagccacggccaggccaga

SEQ ID NO: 4746812 - DNA, 14 bp, Homo sapiens
gacagccccctgcc

SEQ ID NO: 4746813 - DNA, 17 bp, Homo sapiens
gacagccccctgccccg

SEQ ID NO: 4746814 - DNA, 16 bp, Homo sapiens
gacagcccgggctctg

SEQ ID NO: 4746815 - DNA, 22 bp, Homo sapiens
gacagcccgggctctgcctccc

SEQ ID NO: 4746816 - DNA, 13 bp, Homo sapiens
gacagccctccat

SEQ ID NO: 4746817 - DNA, 18 bp, Homo sapiens
gacagcctccccctgtcc

SEQ ID NO: 4746818 - DNA, 11 bp, Homo sapiens
gacagctcctt

SEQ ID NO: 4746819 - DNA, 13 bp, Homo sapiens
gacagctccttct

SEQ ID NO: 4746820 - DNA, 21 bp, Homo sapiens
gacagctgcctgggatccctc

SEQ ID NO: 4746821 - DNA, 14 bp, Homo sapiens
gacaggacctagga

SEQ ID NO: 4746822 - DNA, 13 bp, Homo sapiens
gacaggcaagcac

SEQ ID NO: 4746823 - DNA, 17 bp, Homo sapiens
gacaggcaatgctggct

SEQ ID NO: 4746824 - DNA, 18 bp, Homo sapiens
gacaggcatgttctctga

SEQ ID NO: 4746825 - DNA, 19 bp, Homo sapiens
gacaggcatgttctctgag

SEQ ID NO: 4746826 - DNA, 21 bp, Homo sapiens
gacaggcatgttctctgagga

SEQ ID NO: 4746827 - DNA, 22 bp, Homo sapiens
gacaggcatgttctctgaggac

SEQ ID NO: 4746828 - DNA, 23 bp, Homo sapiens
gacagggcacaccgggcactcag

SEQ ID NO: 4746829 - DNA, 16 bp, Homo sapiens
gacaggtgtgccgaca

SEQ ID NO: 4746830 - DNA, 12 bp, Homo sapiens
gacagtccctgc

SEQ ID NO: 4746831 - DNA, 16 bp, Homo sapiens
gacagtccctgccaat

SEQ ID NO: 4746832 - DNA, 15 bp, Homo sapiens
gacagtcctctccac

SEQ ID NO: 4746833 - DNA, 17 bp, Homo sapiens
gacagtcctctccacct

SEQ ID NO: 4746834 - DNA, 24 bp, Homo sapiens
gacagtcctctccacctagtggct

SEQ ID NO: 4746835 - DNA, 12 bp, Homo sapiens
gacagtttctta

SEQ ID NO: 4746836 - DNA, 17 bp, Homo sapiens
gacatcgatatgaaaaa

SEQ ID NO: 4746837 - DNA, 19 bp, Homo sapiens
gacatgagtgcgtgctcag

SEQ ID NO: 4746838 - DNA, 18 bp, Homo sapiens
gacatgctgaagccaaag

SEQ ID NO: 4746839 - DNA, 14 bp, Homo sapiens
gacatgggaaaggg

SEQ ID NO: 4746840 - DNA, 12 bp, Homo sapiens
gacatgtgaaac

SEQ ID NO: 4746841 - DNA, 15 bp, Homo sapiens
gacatgtgaaacctt

SEQ ID NO: 4746842 - DNA, 18 bp, Homo sapiens
gacattatgtaaaagaaa

SEQ ID NO: 4746843 - DNA, 22 bp, Homo sapiens
gacattatgtaaaagaaaggtt

SEQ ID NO: 4746844 - DNA, 19 bp, Homo sapiens
gacattctgtctttcaaaa

SEQ ID NO: 4746845 - DNA, 19 bp, Homo sapiens
gacattgttggccaaagcc

SEQ ID NO: 4746846 - DNA, 15 bp, Homo sapiens
gacattttgccaaaa

SEQ ID NO: 4746847 - DNA, 13 bp, Homo sapiens
gaccaaaatcccc

SEQ ID NO: 4746848 - DNA, 19 bp, Homo sapiens
gaccaatattgtacagttt

SEQ ID NO: 4746849 - DNA, 21 bp, Homo sapiens
gaccaatattgtacagttttt

SEQ ID NO: 4746850 - DNA, 11 bp, Homo sapiens
gaccacagcaa

SEQ ID NO: 4746851 - DNA, 20 bp, Homo sapiens
gaccagaaacctgggagaga

SEQ ID NO: 4746852 - DNA, 20 bp, Homo sapiens
gaccagggatttccatgatg

SEQ ID NO: 4746853 - DNA, 20 bp, Homo sapiens
gaccatccctgaaggccccg

SEQ ID NO: 4746854 - DNA, 19 bp, Homo sapiens
gaccattctccacctgcca

SEQ ID NO: 4746855 - DNA, 15 bp, Homo sapiens
gacccacagcctcca

SEQ ID NO: 4746856 - DNA, 12 bp, Homo sapiens
gacccactgctt

SEQ ID NO: 4746857 - DNA, 16 bp, Homo sapiens
gacccagccctcatcc

SEQ ID NO: 4746858 - DNA, 17 bp, Homo sapiens
gacccagccctcatccc

SEQ ID NO: 4746859 - DNA, 13 bp, Homo sapiens
gacccatgctgcc

SEQ ID NO: 4746860 - DNA, 17 bp, Homo sapiens
gacccatgctgccctgt

SEQ ID NO: 4746861 - DNA, 18 bp, Homo sapiens
gacccatgctgccctgtg

SEQ ID NO: 4746862 - DNA, 19 bp, Homo sapiens
gacccatgctgccctgtga

SEQ ID NO: 4746863 - DNA, 14 bp, Homo sapiens
gacccattccttcc

SEQ ID NO: 4746864 - DNA, 16 bp, Homo sapiens
gacccattccttccca

SEQ ID NO: 4746865 - DNA, 14 bp, Homo sapiens
gaccccacccctca

SEQ ID NO: 4746866 - DNA, 12 bp, Homo sapiens
gaccccagagga

SEQ ID NO: 4746867 - DNA, 16 bp, Homo sapiens
gaccccatctgcccag

SEQ ID NO: 4746868 - DNA, 17 bp, Homo sapiens
gaccccatctgcccagg

SEQ ID NO: 4746869 - DNA, 23 bp, Homo sapiens
gacccctcatagccctcaccctg

SEQ ID NO: 4746870 - DNA, 13 bp, Homo sapiens
gacccctccatgt

SEQ ID NO: 4746871 - DNA, 18 bp, Homo sapiens
gacccctccatgtgggct

SEQ ID NO: 4746872 - DNA, 21 bp, Homo sapiens
gacccctccatgtgggctagt

SEQ ID NO: 4746873 - DNA, 12 bp, Homo sapiens
gacccctcctcc

SEQ ID NO: 4746874 - DNA, 14 bp, Homo sapiens
gacccctcctccct

SEQ ID NO: 4746875 - DNA, 17 bp, Homo sapiens
gaccccttttcagcttc

SEQ ID NO: 4746876 - DNA, 19 bp, Homo sapiens
gaccctgaggcccagaggg

SEQ ID NO: 4746877 - DNA, 13 bp, Homo sapiens
gaccctgccctgt

SEQ ID NO: 4746878 - DNA, 17 bp, Homo sapiens
gaccctgccctgtgggc

SEQ ID NO: 4746879 - DNA, 20 bp, Homo sapiens
gaccctgccctgtgggcccc

SEQ ID NO: 4746880 - DNA, 17 bp, Homo sapiens
gaccctgctcacaggca

SEQ ID NO: 4746881 - DNA, 18 bp, Homo sapiens
gaccctgctcacaggcag

SEQ ID NO: 4746882 - DNA, 20 bp, Homo sapiens
gacccttgccgtctacctga

SEQ ID NO: 4746883 - DNA, 15 bp, Homo sapiens
gacccttgtggtccc

SEQ ID NO: 4746884 - DNA, 21 bp, Homo sapiens
gacccttgtggtcccacccca

SEQ ID NO: 4746885 - DNA, 19 bp, Homo sapiens
gacctaaaatttgccctcc

SEQ ID NO: 4746886 - DNA, 18 bp, Homo sapiens
gacctaggatatcttctc

SEQ ID NO: 4746887 - DNA, 20 bp, Homo sapiens
gacctcaggtgatccaccca

SEQ ID NO: 4746888 - DNA, 22 bp, Homo sapiens
gacctgaactctgcaactgaat

SEQ ID NO: 4746889 - DNA, 23 bp, Homo sapiens
gacctgatttctgagcatttaat

SEQ ID NO: 4746890 - DNA, 22 bp, Homo sapiens
gacctgcctcccttcatgcatg

SEQ ID NO: 4746891 - DNA, 17 bp, Homo sapiens
gacctggcaaggacaca

SEQ ID NO: 4746892 - DNA, 23 bp, Homo sapiens
gacctgggctggcactgctgggg

SEQ ID NO: 4746893 - DNA, 19 bp, Homo sapiens
gacctgtggccaagttctt

SEQ ID NO: 4746894 - DNA, 15 bp, Homo sapiens
gaccttctaggaagc

SEQ ID NO: 4746895 - DNA, 16 bp, Homo sapiens
gaccttctccttcacc

SEQ ID NO: 4746896 - DNA, 13 bp, Homo sapiens
gacgcagcctgag

SEQ ID NO: 4746897 - DNA, 13 bp, Homo sapiens
gacgcaggcccct

SEQ ID NO: 4746898 - DNA, 15 bp, Homo sapiens
gacgcaggcccctct

SEQ ID NO: 4746899 - DNA, 13 bp, Homo sapiens
gacgccacccagc

SEQ ID NO: 4746900 - DNA, 21 bp, Homo sapiens
gacgcctgggggtgccaggac

SEQ ID NO: 4746901 - DNA, 19 bp, Homo sapiens
gacgctacccgggaagggg

SEQ ID NO: 4746902 - DNA, 23 bp, Homo sapiens
gacgctacccgggaagggggctg

SEQ ID NO: 4746903 - DNA, 18 bp, Homo sapiens
gacgctgtgctgccctgc

SEQ ID NO: 4746904 - DNA, 21 bp, Homo sapiens
gacgctgtgctgccctgccca

SEQ ID NO: 4746905 - DNA, 13 bp, Homo sapiens
gacggagtcccac

SEQ ID NO: 4746906 - DNA, 23 bp, Homo sapiens
gacggagtcccaccttggctgca

SEQ ID NO: 4746907 - DNA, 17 bp, Homo sapiens
gacggtgctccaggcag

SEQ ID NO: 4746908 - DNA, 22 bp, Homo sapiens
gacgtgattcaattcaacactc

SEQ ID NO: 4746909 - DNA, 21 bp, Homo sapiens
gactaattcctgccctgccca

SEQ ID NO: 4746910 - DNA, 12 bp, Homo sapiens
gactacaggcac

SEQ ID NO: 4746911 - DNA, 18 bp, Homo sapiens
gactacaggcacccacca

SEQ ID NO: 4746912 - DNA, 20 bp, Homo sapiens
gactacttgggagcaccgcc

SEQ ID NO: 4746913 - DNA, 15 bp, Homo sapiens
gactagaacctggag

SEQ ID NO: 4746914 - DNA, 18 bp, Homo sapiens
gactagggtcctggggaa

SEQ ID NO: 4746915 - DNA, 18 bp, Homo sapiens
gactatattgtacacacc

SEQ ID NO: 4746916 - DNA, 22 bp, Homo sapiens
gactcaaaacccatctgggctc

SEQ ID NO: 4746917 - DNA, 17 bp, Homo sapiens
gactcaaagaatataat

SEQ ID NO: 4746918 - DNA, 14 bp, Homo sapiens
gactcaatgcactg

SEQ ID NO: 4746919 - DNA, 22 bp, Homo sapiens
gactcacctcccccatctcttc

SEQ ID NO: 4746920 - DNA, 14 bp, Homo sapiens
gactcagctcccca

SEQ ID NO: 4746921 - DNA, 16 bp, Homo sapiens
gactcagggctcctgg

SEQ ID NO: 4746922 - DNA, 11 bp, Homo sapiens
gactcattcac

SEQ ID NO: 4746923 - DNA, 13 bp, Homo sapiens
gactcattctgaa

SEQ ID NO: 4746924 - DNA, 19 bp, Homo sapiens
gactcctgcaggcagccag

SEQ ID NO: 4746925 - DNA, 20 bp, Homo sapiens
gactcctgcaggcagccagg

SEQ ID NO: 4746926 - DNA, 21 bp, Homo sapiens
gactcctgcaggcagccaggc

SEQ ID NO: 4746927 - DNA, 22 bp, Homo sapiens
gactccttgagagaccaggcaa

SEQ ID NO: 4746928 - DNA, 19 bp, Homo sapiens
gactcgagaactttcattt

SEQ ID NO: 4746929 - DNA, 16 bp, Homo sapiens
gactcgggctcctgtg

SEQ ID NO: 4746930 - DNA, 18 bp, Homo sapiens
gactcgggctcctgtgcc

SEQ ID NO: 4746931 - DNA, 21 bp, Homo sapiens
gactctacagaggccatgggc

SEQ ID NO: 4746932 - DNA, 18 bp, Homo sapiens
gactctcagtctctgagc

SEQ ID NO: 4746933 - DNA, 18 bp, Homo sapiens
gactctgcagcctcagag

SEQ ID NO: 4746934 - DNA, 22 bp, Homo sapiens
gactgaccaatattgtacagtt

SEQ ID NO: 4746935 - DNA, 21 bp, Homo sapiens
gactgaggcctgagcgctcct

SEQ ID NO: 4746936 - DNA, 14 bp, Homo sapiens
gactgatttcagag

SEQ ID NO: 4746937 - DNA, 16 bp, Homo sapiens
gactggaagcacagct

SEQ ID NO: 4746938 - DNA, 18 bp, Homo sapiens
gactggaagcacagcttc

SEQ ID NO: 4746939 - DNA, 17 bp, Homo sapiens
gactgggccctgcctct

SEQ ID NO: 4746940 - DNA, 18 bp, Homo sapiens
gactgtaacgattgacac

SEQ ID NO: 4746941 - DNA, 19 bp, Homo sapiens
gactgtgacaggcagcaga

SEQ ID NO: 4746942 - DNA, 22 bp, Homo sapiens
gactgtgtatagtgccaccaca

SEQ ID NO: 4746943 - DNA, 12 bp, Homo sapiens
gactgtgtttaa

SEQ ID NO: 4746944 - DNA, 14 bp, Homo sapiens
gacttaacttttta

SEQ ID NO: 4746945 - DNA, 19 bp, Homo sapiens
gacttaagtgtgcaaaata

SEQ ID NO: 4746946 - DNA, 15 bp, Homo sapiens
gacttagctgggaga

SEQ ID NO: 4746947 - DNA, 20 bp, Homo sapiens
gacttcagaacagtgtttga

SEQ ID NO: 4746948 - DNA, 21 bp, Homo sapiens
gacttcagaacagtgtttgat

SEQ ID NO: 4746949 - DNA, 14 bp, Homo sapiens
gacttggaagctcc

SEQ ID NO: 4746950 - DNA, 15 bp, Homo sapiens
gacttggaagctccg

SEQ ID NO: 4746951 - DNA, 13 bp, Homo sapiens
gacttggatgagg

SEQ ID NO: 4746952 - DNA, 14 bp, Homo sapiens
gacttggggcctct

SEQ ID NO: 4746953 - DNA, 22 bp, Homo sapiens
gacttgtatagcatgaaataaa

SEQ ID NO: 4746954 - DNA, 17 bp, Homo sapiens
gactttaaaaggattaa

SEQ ID NO: 4746955 - DNA, 14 bp, Homo sapiens
gactttggaaagag

SEQ ID NO: 4746956 - DNA, 16 bp, Homo sapiens
gactttggctgcatgc

SEQ ID NO: 4746957 - DNA, 19 bp, Homo sapiens
gactttggctgcatgcgag

SEQ ID NO: 4746958 - DNA, 20 bp, Homo sapiens
gacttttccaaccctcatca

SEQ ID NO: 4746959 - DNA, 13 bp, Homo sapiens
gacttttgaagaa

SEQ ID NO: 4746960 - DNA, 16 bp, Homo sapiens
gagaaagaggaagctt

SEQ ID NO: 4746961 - DNA, 21 bp, Homo sapiens
gagaacccaaagagacagctc

SEQ ID NO: 4746962 - DNA, 15 bp, Homo sapiens
gagaactttcatttt

SEQ ID NO: 4746963 - DNA, 17 bp, Homo sapiens
gagaactttcatttttt

SEQ ID NO: 4746964 - DNA, 18 bp, Homo sapiens
gagaagggctcagagagg

SEQ ID NO: 4746965 - DNA, 20 bp, Homo sapiens
gagaagggctcagagaggac

SEQ ID NO: 4746966 - DNA, 23 bp, Homo sapiens
gagaagggctcagagaggacaaa

SEQ ID NO: 4746967 - DNA, 23 bp, Homo sapiens
gagaaggtgggttttcatcaaga

SEQ ID NO: 4746968 - DNA, 22 bp, Homo sapiens
gagaagtggggaccccacccct

SEQ ID NO: 4746969 - DNA, 15 bp, Homo sapiens
gagaatgtaagaact

SEQ ID NO: 4746970 - DNA, 20 bp, Homo sapiens
gagacacaacaactcctagg

SEQ ID NO: 4746971 - DNA, 16 bp, Homo sapiens
gagacactgttgataa

SEQ ID NO: 4746972 - DNA, 19 bp, Homo sapiens
gagacagagttttcactct

SEQ ID NO: 4746973 - DNA, 21 bp, Homo sapiens
gagacagcccgggctctgcct

SEQ ID NO: 4746974 - DNA, 23 bp, Homo sapiens
gagacagcccgggctctgcctcc

SEQ ID NO: 4746975 - DNA, 21 bp, Homo sapiens
gagacagtttcttagcttttt

SEQ ID NO: 4746976 - DNA, 22 bp, Homo sapiens
gagacagtttcttagcttttta

SEQ ID NO: 4746977 - DNA, 18 bp, Homo sapiens
gagacataaatgttcact

SEQ ID NO: 4746978 - DNA, 17 bp, Homo sapiens
gagacattctgtctttc

SEQ ID NO: 4746979 - DNA, 12 bp, Homo sapiens
gagaccatccct

SEQ ID NO: 4746980 - DNA, 13 bp, Homo sapiens
gagacccaggagc

SEQ ID NO: 4746981 - DNA, 12 bp, Homo sapiens
gagacctgcccc

SEQ ID NO: 4746982 - DNA, 18 bp, Homo sapiens
gagactatgcgtttttat

SEQ ID NO: 4746983 - DNA, 13 bp, Homo sapiens
gagactcctgcag

SEQ ID NO: 4746984 - DNA, 17 bp, Homo sapiens
gagactcctgcaggcag

SEQ ID NO: 4746985 - DNA, 18 bp, Homo sapiens
gagactcctgcaggcagc

SEQ ID NO: 4746986 - DNA, 19 bp, Homo sapiens
gagactcctgcaggcagcc

SEQ ID NO: 4746987 - DNA, 21 bp, Homo sapiens
gagactcctgcaggcagccag

SEQ ID NO: 4746988 - DNA, 15 bp, Homo sapiens
gagactgcccagcta

SEQ ID NO: 4746989 - DNA, 14 bp, Homo sapiens
gagactgggctgag

SEQ ID NO: 4746990 - DNA, 21 bp, Homo sapiens
gagactgggctgagggagcct

SEQ ID NO: 4746991 - DNA, 18 bp, Homo sapiens
gagacttggatgaggagt

SEQ ID NO: 4746992 - DNA, 14 bp, Homo sapiens
gagagaaaaacaaa

SEQ ID NO: 4746993 - DNA, 14 bp, Homo sapiens
gagagaccaggcaa

SEQ ID NO: 4746994 - DNA, 16 bp, Homo sapiens
gagagacttggatgag

SEQ ID NO: 4746995 - DNA, 21 bp, Homo sapiens
gagagagttgttttaataact

SEQ ID NO: 4746996 - DNA, 15 bp, Homo sapiens
gagagatcaaagatg

SEQ ID NO: 4746997 - DNA, 13 bp, Homo sapiens
gagagatgtgtgt

SEQ ID NO: 4746998 - DNA, 14 bp, Homo sapiens
gagagatgtgtgtt

SEQ ID NO: 4746999 - DNA, 16 bp, Homo sapiens
gagagcagcttctgcc

SEQ ID NO: 4747000 - DNA, 19 bp, Homo sapiens
gagagcagcttctgccact

SEQ ID NO: 4747001 - DNA, 12 bp, Homo sapiens
gagagcataatt

SEQ ID NO: 4747002 - DNA, 13 bp, Homo sapiens
gagagcatgtgag

SEQ ID NO: 4747003 - DNA, 16 bp, Homo sapiens
gagagccaccaagagg

SEQ ID NO: 4747004 - DNA, 16 bp, Homo sapiens
gagagccatacataaa

SEQ ID NO: 4747005 - DNA, 14 bp, Homo sapiens
gagagcccagaggt

SEQ ID NO: 4747006 - DNA, 21 bp, Homo sapiens
gagagcccagaggtaacagaa

SEQ ID NO: 4747007 - DNA, 15 bp, Homo sapiens
gagagccttccaggg

SEQ ID NO: 4747008 - DNA, 20 bp, Homo sapiens
gagagctagaacccggcagg

SEQ ID NO: 4747009 - DNA, 16 bp, Homo sapiens
gagagctggagcctgg

SEQ ID NO: 4747010 - DNA, 21 bp, Homo sapiens
gagagctggagcctggtgccc

SEQ ID NO: 4747011 - DNA, 20 bp, Homo sapiens
gagagctgggctttcctctg

SEQ ID NO: 4747012 - DNA, 13 bp, Homo sapiens
gagagctgggtgt

SEQ ID NO: 4747013 - DNA, 20 bp, Homo sapiens
gagagctgggtgtcaagagg

SEQ ID NO: 4747014 - DNA, 16 bp, Homo sapiens
gagagcttaatgataa

SEQ ID NO: 4747015 - DNA, 20 bp, Homo sapiens
gagaggacaaaataaagtgt

SEQ ID NO: 4747016 - DNA, 18 bp, Homo sapiens
gagaggatgagagcccag

SEQ ID NO: 4747017 - DNA, 19 bp, Homo sapiens
gagaggggaacagactgga

SEQ ID NO: 4747018 - DNA, 15 bp, Homo sapiens
gagaggggacgcagg

SEQ ID NO: 4747019 - DNA, 16 bp, Homo sapiens
gagagggtgggagtgg

SEQ ID NO: 4747020 - DNA, 12 bp, Homo sapiens
gagagtgggggt

SEQ ID NO: 4747021 - DNA, 17 bp, Homo sapiens
gagagtttactgatgaa

SEQ ID NO: 4747022 - DNA, 23 bp, Homo sapiens
gagatcaaccccttcgctcctgt

SEQ ID NO: 4747023 - DNA, 21 bp, Homo sapiens
gagatcgtgccattgcactcc

SEQ ID NO: 4747024 - DNA, 23 bp, Homo sapiens
gagatgcattcttggttggctgg

SEQ ID NO: 4747025 - DNA, 18 bp, Homo sapiens
gagatgtgtgttgatact

SEQ ID NO: 4747026 - DNA, 21 bp, Homo sapiens
gagatgtgtgttgatactgtt

SEQ ID NO: 4747027 - DNA, 23 bp, Homo sapiens
gagatgtgtgttgatactgttgc

SEQ ID NO: 4747028 - DNA, 15 bp, Homo sapiens
gagattacctcctga

SEQ ID NO: 4747029 - DNA, 17 bp, Homo sapiens
gagattagaacatttaa

SEQ ID NO: 4747030 - DNA, 11 bp, Homo sapiens
gagatttttaa

SEQ ID NO: 4747031 - DNA, 13 bp, Homo sapiens
gagcaaaggctga

SEQ ID NO: 4747032 - DNA, 18 bp, Homo sapiens
gagcaagacgctgtgctg

SEQ ID NO: 4747033 - DNA, 13 bp, Homo sapiens
gagcacagccctc

SEQ ID NO: 4747034 - DNA, 14 bp, Homo sapiens
gagcacagccctcc

SEQ ID NO: 4747035 - DNA, 19 bp, Homo sapiens
gagcacctccacatcctcc

SEQ ID NO: 4747036 - DNA, 17 bp, Homo sapiens
gagcaccttagacagtc

SEQ ID NO: 4747037 - DNA, 14 bp, Homo sapiens
gagcacttgctgta

SEQ ID NO: 4747038 - DNA, 21 bp, Homo sapiens
gagcagagaccatccctgaag

SEQ ID NO: 4747039 - DNA, 15 bp, Homo sapiens
gagcagaggggctga

SEQ ID NO: 4747040 - DNA, 18 bp, Homo sapiens
gagcagatgcagagagcc

SEQ ID NO: 4747041 - DNA, 19 bp, Homo sapiens
gagcagatgcagagagcca

SEQ ID NO: 4747042 - DNA, 16 bp, Homo sapiens
gagcagccctggagtc

SEQ ID NO: 4747043 - DNA, 17 bp, Homo sapiens
gagcagcctcagaacaa

SEQ ID NO: 4747044 - DNA, 21 bp, Homo sapiens
gagcagtgaatgattcagtgt

SEQ ID NO: 4747045 - DNA, 17 bp, Homo sapiens
gagcagtgcaggcacag

SEQ ID NO: 4747046 - DNA, 21 bp, Homo sapiens
gagcataataaatggatgagg

SEQ ID NO: 4747047 - DNA, 17 bp, Homo sapiens
gagcatccacctccttc

SEQ ID NO: 4747048 - DNA, 13 bp, Homo sapiens
gagcatgcctgga

SEQ ID NO: 4747049 - DNA, 22 bp, Homo sapiens
gagcatgcctggatggggctgc

SEQ ID NO: 4747050 - DNA, 14 bp, Homo sapiens
gagcatggctgtga

SEQ ID NO: 4747051 - DNA, 19 bp, Homo sapiens
gagcatggctgtgaggatg

SEQ ID NO: 4747052 - DNA, 21 bp, Homo sapiens
gagcattagatttctcatttg

SEQ ID NO: 4747053 - DNA, 21 bp, Homo sapiens
gagccagaacctggagggcta

SEQ ID NO: 4747054 - DNA, 14 bp, Homo sapiens
gagccagggtctca

SEQ ID NO: 4747055 - DNA, 18 bp, Homo sapiens
gagccagtaaacagagga

SEQ ID NO: 4747056 - DNA, 21 bp, Homo sapiens
gagccatgtagaagctgcatc

SEQ ID NO: 4747057 - DNA, 14 bp, Homo sapiens
gagccattttgtga

SEQ ID NO: 4747058 - DNA, 15 bp, Homo sapiens
gagcccaccttggct

SEQ ID NO: 4747059 - DNA, 14 bp, Homo sapiens
gagcccagaggagg

SEQ ID NO: 4747060 - DNA, 12 bp, Homo sapiens
gagcccagctct

SEQ ID NO: 4747061 - DNA, 21 bp, Homo sapiens
gagcccagctctgaaaccagt

SEQ ID NO: 4747062 - DNA, 13 bp, Homo sapiens
gagcccaggccag

SEQ ID NO: 4747063 - DNA, 17 bp, Homo sapiens
gagcccaggccaggact

SEQ ID NO: 4747064 - DNA, 21 bp, Homo sapiens
gagcccaggccaggactctgc

SEQ ID NO: 4747065 - DNA, 22 bp, Homo sapiens
gagcccaggccaggactctgca

SEQ ID NO: 4747066 - DNA, 18 bp, Homo sapiens
gagccccattcctgggaa

SEQ ID NO: 4747067 - DNA, 17 bp, Homo sapiens
gagccccgaggccttct

SEQ ID NO: 4747068 - DNA, 14 bp, Homo sapiens
gagcctcagcatcc

SEQ ID NO: 4747069 - DNA, 15 bp, Homo sapiens
gagcctcagcatcct

SEQ ID NO: 4747070 - DNA, 19 bp, Homo sapiens
gagcctcagcatcctggca

SEQ ID NO: 4747071 - DNA, 10 bp, Homo sapiens
gagcctgagg

SEQ ID NO: 4747072 - DNA, 15 bp, Homo sapiens
gagcctgagggatct

SEQ ID NO: 4747073 - DNA, 12 bp, Homo sapiens
gagcctgcagtt

SEQ ID NO: 4747074 - DNA, 16 bp, Homo sapiens
gagcctgggggctcct

SEQ ID NO: 4747075 - DNA, 17 bp, Homo sapiens
gagcctgggggctcctc

SEQ ID NO: 4747076 - DNA, 12 bp, Homo sapiens
gagcctggtgcc

SEQ ID NO: 4747077 - DNA, 16 bp, Homo sapiens
gagccttccaggggtg

SEQ ID NO: 4747078 - DNA, 20 bp, Homo sapiens
gagccttccaggggtgggac

SEQ ID NO: 4747079 - DNA, 21 bp, Homo sapiens
gagcgcccactagacccactg

SEQ ID NO: 4747080 - DNA, 14 bp, Homo sapiens
gagcgtgcgtctgt

SEQ ID NO: 4747081 - DNA, 22 bp, Homo sapiens
gagcgtgcgtctgtgtgtgcct

SEQ ID NO: 4747082 - DNA, 14 bp, Homo sapiens
gagctacaaatgca

SEQ ID NO: 4747083 - DNA, 22 bp, Homo sapiens
gagctagaacctagaagggcta

SEQ ID NO: 4747084 - DNA, 15 bp, Homo sapiens
gagctagaagctgga

SEQ ID NO: 4747085 - DNA, 20 bp, Homo sapiens
gagctcagagagggcaggca

SEQ ID NO: 4747086 - DNA, 21 bp, Homo sapiens
gagctcagagagggcaggcat

SEQ ID NO: 4747087 - DNA, 17 bp, Homo sapiens
gagctcaggacactaat

SEQ ID NO: 4747088 - DNA, 15 bp, Homo sapiens
gagctcccctcccca

SEQ ID NO: 4747089 - DNA, 19 bp, Homo sapiens
gagctcccctccccaactg

SEQ ID NO: 4747090 - DNA, 17 bp, Homo sapiens
gagctgacacaggatga

SEQ ID NO: 4747091 - DNA, 23 bp, Homo sapiens
gagctgcacagggtttggcccaa

SEQ ID NO: 4747092 - DNA, 12 bp, Homo sapiens
gagctgcctgga

SEQ ID NO: 4747093 - DNA, 16 bp, Homo sapiens
gagctgcctggacccg

SEQ ID NO: 4747094 - DNA, 19 bp, Homo sapiens
gagctgcctgttcagctcc

SEQ ID NO: 4747095 - DNA, 12 bp, Homo sapiens
gagctggagcct

SEQ ID NO: 4747096 - DNA, 15 bp, Homo sapiens
gagctggagcctggt

SEQ ID NO: 4747097 - DNA, 17 bp, Homo sapiens
gagctggccgtgggcct

SEQ ID NO: 4747098 - DNA, 13 bp, Homo sapiens
gagctgggcagct

SEQ ID NO: 4747099 - DNA, 13 bp, Homo sapiens
gagctgttatctt

SEQ ID NO: 4747100 - DNA, 19 bp, Homo sapiens
gagcttcatggcagaaggc

SEQ ID NO: 4747101 - DNA, 20 bp, Homo sapiens
gagcttccagagctctgacc

SEQ ID NO: 4747102 - DNA, 21 bp, Homo sapiens
gagcttctgttgctgcctcat

SEQ ID NO: 4747103 - DNA, 17 bp, Homo sapiens
gaggaagccgctggggc

SEQ ID NO: 4747104 - DNA, 18 bp, Homo sapiens
gaggaagccgctggggcc

SEQ ID NO: 4747105 - DNA, 19 bp, Homo sapiens
gaggaaggaaacccagctc

SEQ ID NO: 4747106 - DNA, 15 bp, Homo sapiens
gaggaaggattgtaa

SEQ ID NO: 4747107 - DNA, 16 bp, Homo sapiens
gaggaaggattgtaaa

SEQ ID NO: 4747108 - DNA, 19 bp, Homo sapiens
gaggaaggggccagaggct

SEQ ID NO: 4747109 - DNA, 15 bp, Homo sapiens
gaggaatccagaccc

SEQ ID NO: 4747110 - DNA, 14 bp, Homo sapiens
gaggaatttataac

SEQ ID NO: 4747111 - DNA, 13 bp, Homo sapiens
gaggacaaaataa

SEQ ID NO: 4747112 - DNA, 16 bp, Homo sapiens
gaggacaaaataaagt

SEQ ID NO: 4747113 - DNA, 22 bp, Homo sapiens
gaggacaaaataaagtgtgtgt

SEQ ID NO: 4747114 - DNA, 21 bp, Homo sapiens
gaggacaagaccctctcaggc

SEQ ID NO: 4747115 - DNA, 13 bp, Homo sapiens
gaggacagggagg

SEQ ID NO: 4747116 - DNA, 16 bp, Homo sapiens
gaggactagaacctgg

SEQ ID NO: 4747117 - DNA, 18 bp, Homo sapiens
gaggactagaacctggag

SEQ ID NO: 4747118 - DNA, 16 bp, Homo sapiens
gaggacttttctttgt

SEQ ID NO: 4747119 - DNA, 20 bp, Homo sapiens
gaggacttttctttgtggct

SEQ ID NO: 4747120 - DNA, 15 bp, Homo sapiens
gaggagcagtgcagg

SEQ ID NO: 4747121 - DNA, 13 bp, Homo sapiens
gaggagcccaggc

SEQ ID NO: 4747122 - DNA, 20 bp, Homo sapiens
gaggagcccaggccaggact

SEQ ID NO: 4747123 - DNA, 20 bp, Homo sapiens
gaggagggtcggtgccttca

SEQ ID NO: 4747124 - DNA, 15 bp, Homo sapiens
gaggagtacaggtga

SEQ ID NO: 4747125 - DNA, 14 bp, Homo sapiens
gaggagtcttgtgt

SEQ ID NO: 4747126 - DNA, 22 bp, Homo sapiens
gaggagtggttgggctgtgcct

SEQ ID NO: 4747127 - DNA, 15 bp, Homo sapiens
gaggatgagagccca

SEQ ID NO: 4747128 - DNA, 20 bp, Homo sapiens
gaggatgagagcccagaggt

SEQ ID NO: 4747129 - DNA, 18 bp, Homo sapiens
gaggatttgatttctgcc

SEQ ID NO: 4747130 - DNA, 19 bp, Homo sapiens
gaggcagccccattctgcc

SEQ ID NO: 4747131 - DNA, 20 bp, Homo sapiens
gaggcagccccattctgcct

SEQ ID NO: 4747132 - DNA, 9 bp, Homo sapiens
gaggcaggg

SEQ ID NO: 4747133 - DNA, 18 bp, Homo sapiens
gaggcagggtctcactct

SEQ ID NO: 4747134 - DNA, 14 bp, Homo sapiens
gaggcagtgggtcc

SEQ ID NO: 4747135 - DNA, 17 bp, Homo sapiens
gaggcatcgcaatgtaa

SEQ ID NO: 4747136 - DNA, 13 bp, Homo sapiens
gaggccagggcag

SEQ ID NO: 4747137 - DNA, 14 bp, Homo sapiens
gaggccatgggcct

SEQ ID NO: 4747138 - DNA, 21 bp, Homo sapiens
gaggccatgggcctcctgtgt

SEQ ID NO: 4747139 - DNA, 11 bp, Homo sapiens
gaggcccagag

SEQ ID NO: 4747140 - DNA, 20 bp, Homo sapiens
gaggccccttctaggtggca

SEQ ID NO: 4747141 - DNA, 12 bp, Homo sapiens
gaggccctccac

SEQ ID NO: 4747142 - DNA, 17 bp, Homo sapiens
gaggccctccacacctg

SEQ ID NO: 4747143 - DNA, 18 bp, Homo sapiens
gaggccctccacacctgc

SEQ ID NO: 4747144 - DNA, 22 bp, Homo sapiens
gaggccctccacacctgcggcc

SEQ ID NO: 4747145 - DNA, 22 bp, Homo sapiens
gaggcccttctctccagcccct

SEQ ID NO: 4747146 - DNA, 23 bp, Homo sapiens
gaggcccttctctccagcccctg

SEQ ID NO: 4747147 - DNA, 14 bp, Homo sapiens
gaggccttctctga

SEQ ID NO: 4747148 - DNA, 19 bp, Homo sapiens
gaggccttctctgaaggac

SEQ ID NO: 4747149 - DNA, 14 bp, Homo sapiens
gaggctccagaggg

SEQ ID NO: 4747150 - DNA, 13 bp, Homo sapiens
gaggctggctggg

SEQ ID NO: 4747151 - DNA, 13 bp, Homo sapiens
gagggaagccagg

SEQ ID NO: 4747152 - DNA, 16 bp, Homo sapiens
gagggacgcctggggg

SEQ ID NO: 4747153 - DNA, 15 bp, Homo sapiens
gagggagggagggct

SEQ ID NO: 4747154 - DNA, 15 bp, Homo sapiens
gagggagggctccag

SEQ ID NO: 4747155 - DNA, 16 bp, Homo sapiens
gagggagggctccaga

SEQ ID NO: 4747156 - DNA, 20 bp, Homo sapiens
gagggagggctccagacaca

SEQ ID NO: 4747157 - DNA, 17 bp, Homo sapiens
gagggatgatgccacac

SEQ ID NO: 4747158 - DNA, 20 bp, Homo sapiens
gagggcacattccttgcctg

SEQ ID NO: 4747159 - DNA, 23 bp, Homo sapiens
gagggcacattccttgcctgcac

SEQ ID NO: 4747160 - DNA, 19 bp, Homo sapiens
gagggcagcagaagggggt

SEQ ID NO: 4747161 - DNA, 21 bp, Homo sapiens
gagggcagcagaagggggtgg

SEQ ID NO: 4747162 - DNA, 12 bp, Homo sapiens
gagggcagcagg

SEQ ID NO: 4747163 - DNA, 14 bp, Homo sapiens
gagggcagcagggc

SEQ ID NO: 4747164 - DNA, 16 bp, Homo sapiens
gagggcagcagggcta

SEQ ID NO: 4747165 - DNA, 16 bp, Homo sapiens
gagggctagaacctgg

SEQ ID NO: 4747166 - DNA, 18 bp, Homo sapiens
gagggctagaacctggag

SEQ ID NO: 4747167 - DNA, 18 bp, Homo sapiens
gagggctagaatctggag

SEQ ID NO: 4747168 - DNA, 18 bp, Homo sapiens
gagggctggaatctggag

SEQ ID NO: 4747169 - DNA, 20 bp, Homo sapiens
gagggctggaatctggagag

SEQ ID NO: 4747170 - DNA, 19 bp, Homo sapiens
gaggggacgcaggcccctc

SEQ ID NO: 4747171 - DNA, 17 bp, Homo sapiens
gaggggcaggccctgca

SEQ ID NO: 4747172 - DNA, 23 bp, Homo sapiens
gaggggcaggccctgcactgtcc

SEQ ID NO: 4747173 - DNA, 17 bp, Homo sapiens
gaggggcccgcttgcct

SEQ ID NO: 4747174 - DNA, 15 bp, Homo sapiens
gaggggcctgccacc

SEQ ID NO: 4747175 - DNA, 17 bp, Homo sapiens
gaggggcctgccacctg

SEQ ID NO: 4747176 - DNA, 22 bp, Homo sapiens
gaggggcctgccacctggaccc

SEQ ID NO: 4747177 - DNA, 16 bp, Homo sapiens
gagggggaagtgagaa

SEQ ID NO: 4747178 - DNA, 19 bp, Homo sapiens
gagggggaagtgagaaggg

SEQ ID NO: 4747179 - DNA, 15 bp, Homo sapiens
gaggggggaggtggg

SEQ ID NO: 4747180 - DNA, 15 bp, Homo sapiens
gagggggtggcctcc

SEQ ID NO: 4747181 - DNA, 17 bp, Homo sapiens
gagggggtggcctccca

SEQ ID NO: 4747182 - DNA, 13 bp, Homo sapiens
gaggggtagtggg

SEQ ID NO: 4747183 - DNA, 15 bp, Homo sapiens
gagggtcggtgcctt

SEQ ID NO: 4747184 - DNA, 18 bp, Homo sapiens
gagggtgatggggctgag

SEQ ID NO: 4747185 - DNA, 15 bp, Homo sapiens
gagggtgggagtggg

SEQ ID NO: 4747186 - DNA, 22 bp, Homo sapiens
gagggtgtcccaaaaagaaagg

SEQ ID NO: 4747187 - DNA, 21 bp, Homo sapiens
gaggtaaggaatacctgtccc

SEQ ID NO: 4747188 - DNA, 18 bp, Homo sapiens
gaggtccacaacacacag

SEQ ID NO: 4747189 - DNA, 17 bp, Homo sapiens
gaggtccagccctggct

SEQ ID NO: 4747190 - DNA, 17 bp, Homo sapiens
gaggtctcgctgatgct

SEQ ID NO: 4747191 - DNA, 22 bp, Homo sapiens
gaggtctcgctgatgctgggct

SEQ ID NO: 4747192 - DNA, 23 bp, Homo sapiens
gaggtgaccccaggtttctatgt

SEQ ID NO: 4747193 - DNA, 17 bp, Homo sapiens
gaggtgggatcctccag

SEQ ID NO: 4747194 - DNA, 22 bp, Homo sapiens
gaggtgggatcctccaggtgca

SEQ ID NO: 4747195 - DNA, 19 bp, Homo sapiens
gaggtttcacttgcacatc

SEQ ID NO: 4747196 - DNA, 21 bp, Homo sapiens
gagtactacagtcctcccatc

SEQ ID NO: 4747197 - DNA, 12 bp, Homo sapiens
gagtagctggga

SEQ ID NO: 4747198 - DNA, 19 bp, Homo sapiens
gagtagctgggactacagg

SEQ ID NO: 4747199 - DNA, 13 bp, Homo sapiens
gagtaggaagact

SEQ ID NO: 4747200 - DNA, 17 bp, Homo sapiens
gagtaggaagactttgg

SEQ ID NO: 4747201 - DNA, 18 bp, Homo sapiens
gagtaggaagactttgga

SEQ ID NO: 4747202 - DNA, 19 bp, Homo sapiens
gagtaggaagactttggaa

SEQ ID NO: 4747203 - DNA, 12 bp, Homo sapiens
gagtatttctgg

SEQ ID NO: 4747204 - DNA, 13 bp, Homo sapiens
gagtcaccaagcc

SEQ ID NO: 4747205 - DNA, 17 bp, Homo sapiens
gagtcaccaagcccagt

SEQ ID NO: 4747206 - DNA, 20 bp, Homo sapiens
gagtcagctgaccccctccc

SEQ ID NO: 4747207 - DNA, 12 bp, Homo sapiens
gagtcccacctt

SEQ ID NO: 4747208 - DNA, 14 bp, Homo sapiens
gagtcgaggacagg

SEQ ID NO: 4747209 - DNA, 17 bp, Homo sapiens
gagtcgaggacagggag

SEQ ID NO: 4747210 - DNA, 21 bp, Homo sapiens
gagtctcactgttgcccaggc

SEQ ID NO: 4747211 - DNA, 23 bp, Homo sapiens
gagtctcactgttgcccaggctg

SEQ ID NO: 4747212 - DNA, 23 bp, Homo sapiens
gagtctcgctattgtcaccaggg

SEQ ID NO: 4747213 - DNA, 12 bp, Homo sapiens
gagtctgaaggc

SEQ ID NO: 4747214 - DNA, 21 bp, Homo sapiens
gagtctgtcctggaaccaggc

SEQ ID NO: 4747215 - DNA, 14 bp, Homo sapiens
gagtgacagaggca

SEQ ID NO: 4747216 - DNA, 23 bp, Homo sapiens
gagtgagacccagccctcatccc

SEQ ID NO: 4747217 - DNA, 14 bp, Homo sapiens
gagtgagacccagg

SEQ ID NO: 4747218 - DNA, 18 bp, Homo sapiens
gagtgagactctgtctca

SEQ ID NO: 4747219 - DNA, 24 bp, Homo sapiens
gagtgagcactaaggtgtgctctg

SEQ ID NO: 4747220 - DNA, 11 bp, Homo sapiens
gagtgcagtga

SEQ ID NO: 4747221 - DNA, 17 bp, Homo sapiens
gagtggaggaggcctgg

SEQ ID NO: 4747222 - DNA, 14 bp, Homo sapiens
gagtggagttgaaa

SEQ ID NO: 4747223 - DNA, 13 bp, Homo sapiens
gagtgtagaagca

SEQ ID NO: 4747224 - DNA, 16 bp, Homo sapiens
gagtgtagaagcattc

SEQ ID NO: 4747225 - DNA, 13 bp, Homo sapiens
gagtgtctttcca

SEQ ID NO: 4747226 - DNA, 19 bp, Homo sapiens
gagtgtctttccacggagc

SEQ ID NO: 4747227 - DNA, 13 bp, Homo sapiens
gagttaagaagct

SEQ ID NO: 4747228 - DNA, 20 bp, Homo sapiens
gagttattcataaagagaaa

SEQ ID NO: 4747229 - DNA, 20 bp, Homo sapiens
gagttcataccctgttacca

SEQ ID NO: 4747230 - DNA, 20 bp, Homo sapiens
gagttgcaccattctttctt

SEQ ID NO: 4747231 - DNA, 15 bp, Homo sapiens
gagttgttgccctgg

SEQ ID NO: 4747232 - DNA, 16 bp, Homo sapiens
gagtttaaattgtaat

SEQ ID NO: 4747233 - DNA, 17 bp, Homo sapiens
gagtttgatgaggccct

SEQ ID NO: 4747234 - DNA, 23 bp, Homo sapiens
gagttttcttatatatatattga

SEQ ID NO: 4747235 - DNA, 16 bp, Homo sapiens
gataacaacctggaga

SEQ ID NO: 4747236 - DNA, 13 bp, Homo sapiens
gataacagcactg

SEQ ID NO: 4747237 - DNA, 17 bp, Homo sapiens
gataagaccaccacctc

SEQ ID NO: 4747238 - DNA, 16 bp, Homo sapiens
gataataaattgattt

SEQ ID NO: 4747239 - DNA, 19 bp, Homo sapiens
gataatggtgaacatttta

SEQ ID NO: 4747240 - DNA, 14 bp, Homo sapiens
gataatgttaaatt

SEQ ID NO: 4747241 - DNA, 19 bp, Homo sapiens
gataatgttaaatttgtaa

SEQ ID NO: 4747242 - DNA, 21 bp, Homo sapiens
gataatgttaaatttgtaagt

SEQ ID NO: 4747243 - DNA, 18 bp, Homo sapiens
gataattttttaattatt

SEQ ID NO: 4747244 - DNA, 22 bp, Homo sapiens
gatacagggtgctccttgtcaa

SEQ ID NO: 4747245 - DNA, 17 bp, Homo sapiens
gatacagtcaacaagcc

SEQ ID NO: 4747246 - DNA, 15 bp, Homo sapiens
gataccagcgaggag

SEQ ID NO: 4747247 - DNA, 13 bp, Homo sapiens
gatactgttgcac

SEQ ID NO: 4747248 - DNA, 17 bp, Homo sapiens
gatactgttgcacgtgt

SEQ ID NO: 4747249 - DNA, 21 bp, Homo sapiens
gatagcacagaccctgccctg

SEQ ID NO: 4747250 - DNA, 19 bp, Homo sapiens
gataggcaggaacatacag

SEQ ID NO: 4747251 - DNA, 17 bp, Homo sapiens
gatagtgcttcttgtaa

SEQ ID NO: 4747252 - DNA, 19 bp, Homo sapiens
gatataactattgcccagg

SEQ ID NO: 4747253 - DNA, 19 bp, Homo sapiens
gatatataggctattttct

SEQ ID NO: 4747254 - DNA, 21 bp, Homo sapiens
gatatataggctattttctaa

SEQ ID NO: 4747255 - DNA, 15 bp, Homo sapiens
gatatatttaagcct

SEQ ID NO: 4747256 - DNA, 15 bp, Homo sapiens
gatatctatgactgt

SEQ ID NO: 4747257 - DNA, 15 bp, Homo sapiens
gatatgaaagctgat

SEQ ID NO: 4747258 - DNA, 17 bp, Homo sapiens
gatatggcagaagacac

SEQ ID NO: 4747259 - DNA, 21 bp, Homo sapiens
gatatgtgtaaatgttatgac

SEQ ID NO: 4747260 - DNA, 16 bp, Homo sapiens
gatattgaccatgtga

SEQ ID NO: 4747261 - DNA, 15 bp, Homo sapiens
gatatttatgtatct

SEQ ID NO: 4747262 - DNA, 22 bp, Homo sapiens
gatatttccctcccctggggac

SEQ ID NO: 4747263 - DNA, 22 bp, Homo sapiens
gatcaaattttgagcaaagaaa

SEQ ID NO: 4747264 - DNA, 20 bp, Homo sapiens
gatcaacatcttttcttgcc

SEQ ID NO: 4747265 - DNA, 22 bp, Homo sapiens
gatcaaccccttcgctcctgtg

SEQ ID NO: 4747266 - DNA, 15 bp, Homo sapiens
gatcacggctcactg

SEQ ID NO: 4747267 - DNA, 18 bp, Homo sapiens
gatcacggctcactgcag

SEQ ID NO: 4747268 - DNA, 20 bp, Homo sapiens
gatcactgagccatcatttc

SEQ ID NO: 4747269 - DNA, 16 bp, Homo sapiens
gatcatccactgtgcc

SEQ ID NO: 4747270 - DNA, 15 bp, Homo sapiens
gatcatggtgtaata

SEQ ID NO: 4747271 - DNA, 23 bp, Homo sapiens
gatcatggtgtaataagacataa

SEQ ID NO: 4747272 - DNA, 15 bp, Homo sapiens
gatccaaatgctgtg

SEQ ID NO: 4747273 - DNA, 12 bp, Homo sapiens
gatccaagctgg

SEQ ID NO: 4747274 - DNA, 17 bp, Homo sapiens
gatccaagctggtccca

SEQ ID NO: 4747275 - DNA, 22 bp, Homo sapiens
gatccacccacctcagcctccc

SEQ ID NO: 4747276 - DNA, 23 bp, Homo sapiens
gatccctctacagagcttccctg

SEQ ID NO: 4747277 - DNA, 23 bp, Homo sapiens
gatccgacttgaattttcccact

SEQ ID NO: 4747278 - DNA, 23 bp, Homo sapiens
gatcctaatgaatgcataaaatg

SEQ ID NO: 4747279 - DNA, 15 bp, Homo sapiens
gatcctccatttttg

SEQ ID NO: 4747280 - DNA, 12 bp, Homo sapiens
gatcctgtgaag

SEQ ID NO: 4747281 - DNA, 20 bp, Homo sapiens
gatctacttctgtaattgtg

SEQ ID NO: 4747282 - DNA, 18 bp, Homo sapiens
gatctagaataatcttgc

SEQ ID NO: 4747283 - DNA, 13 bp, Homo sapiens
gatctaggaagac

SEQ ID NO: 4747284 - DNA, 20 bp, Homo sapiens
gatctaggaagactttggaa

SEQ ID NO: 4747285 - DNA, 20 bp, Homo sapiens
gatctccactgttgggtggg

SEQ ID NO: 4747286 - DNA, 17 bp, Homo sapiens
gatctgatgcaagcaag

SEQ ID NO: 4747287 - DNA, 13 bp, Homo sapiens
gatctgcccctcc

SEQ ID NO: 4747288 - DNA, 20 bp, Homo sapiens
gatctgggttcactgcaacc

SEQ ID NO: 4747289 - DNA, 23 bp, Homo sapiens
gatgaaaagtatattgataacct

SEQ ID NO: 4747290 - DNA, 16 bp, Homo sapiens
gatgaaaataaagaat

SEQ ID NO: 4747291 - DNA, 19 bp, Homo sapiens
gatgaaatcttacagctgg

SEQ ID NO: 4747292 - DNA, 20 bp, Homo sapiens
gatgaaatcttacagctggg

SEQ ID NO: 4747293 - DNA, 16 bp, Homo sapiens
gatgaaatgtaaatac

SEQ ID NO: 4747294 - DNA, 17 bp, Homo sapiens
gatgagagcccagaggt

SEQ ID NO: 4747295 - DNA, 23 bp, Homo sapiens
gatgagggttcatcatccctccc

SEQ ID NO: 4747296 - DNA, 15 bp, Homo sapiens
gatgatctaggaaga

SEQ ID NO: 4747297 - DNA, 14 bp, Homo sapiens
gatgatctttgcag

SEQ ID NO: 4747298 - DNA, 20 bp, Homo sapiens
gatgatctttgcagacaggc

SEQ ID NO: 4747299 - DNA, 21 bp, Homo sapiens
gatgatgaaatgaggtcagag

SEQ ID NO: 4747300 - DNA, 15 bp, Homo sapiens
gatgatgtgcctggg

SEQ ID NO: 4747301 - DNA, 14 bp, Homo sapiens
gatgcaccagccct

SEQ ID NO: 4747302 - DNA, 19 bp, Homo sapiens
gatgcagcctcacagtcct

SEQ ID NO: 4747303 - DNA, 21 bp, Homo sapiens
gatgccccgtccccctctggc

SEQ ID NO: 4747304 - DNA, 14 bp, Homo sapiens
gatgcctggtggca

SEQ ID NO: 4747305 - DNA, 16 bp, Homo sapiens
gatgcctggtggcagc

SEQ ID NO: 4747306 - DNA, 21 bp, Homo sapiens
gatgctccttgggccctttga

SEQ ID NO: 4747307 - DNA, 12 bp, Homo sapiens
gatgctgggctg

SEQ ID NO: 4747308 - DNA, 15 bp, Homo sapiens
gatgctgggctgggt

SEQ ID NO: 4747309 - DNA, 20 bp, Homo sapiens
gatgctggtcatgtgtttga

SEQ ID NO: 4747310 - DNA, 17 bp, Homo sapiens
gatgcttcttcagagac

SEQ ID NO: 4747311 - DNA, 15 bp, Homo sapiens
gatggcaggatggcc

SEQ ID NO: 4747312 - DNA, 17 bp, Homo sapiens
gatggcaggatggcctg

SEQ ID NO: 4747313 - DNA, 18 bp, Homo sapiens
gatggcaggatggcctgg

SEQ ID NO: 4747314 - DNA, 21 bp, Homo sapiens
gatggcctggccagggcctgg

SEQ ID NO: 4747315 - DNA, 23 bp, Homo sapiens
gatggggctgcaccggctggcct

SEQ ID NO: 4747316 - DNA, 17 bp, Homo sapiens
gatgggggaaagcacag

SEQ ID NO: 4747317 - DNA, 16 bp, Homo sapiens
gatgggggctctgcac

SEQ ID NO: 4747318 - DNA, 16 bp, Homo sapiens
gatggtgacattgaaa

SEQ ID NO: 4747319 - DNA, 17 bp, Homo sapiens
gatggtgacattgaaac

SEQ ID NO: 4747320 - DNA, 17 bp, Homo sapiens
gatggtgacttttgaag

SEQ ID NO: 4747321 - DNA, 15 bp, Homo sapiens
gatggtggagggcca

SEQ ID NO: 4747322 - DNA, 20 bp, Homo sapiens
gatgtcctcctctgtgaaac

SEQ ID NO: 4747323 - DNA, 19 bp, Homo sapiens
gatgtcgctgggtcctctg

SEQ ID NO: 4747324 - DNA, 21 bp, Homo sapiens
gatgtcgctgggtcctctgca

SEQ ID NO: 4747325 - DNA, 22 bp, Homo sapiens
gatgtcgctgggtcctctgcag

SEQ ID NO: 4747326 - DNA, 18 bp, Homo sapiens
gatgtgagggcaccacca

SEQ ID NO: 4747327 - DNA, 20 bp, Homo sapiens
gatgtgggggaagacctggc

SEQ ID NO: 4747328 - DNA, 17 bp, Homo sapiens
gatgtgggtcaaggaat

SEQ ID NO: 4747329 - DNA, 21 bp, Homo sapiens
gatgtgtgttgatactgttgc

SEQ ID NO: 4747330 - DNA, 14 bp, Homo sapiens
gatgttctgggaca

SEQ ID NO: 4747331 - DNA, 16 bp, Homo sapiens
gatgttctgggacaca

SEQ ID NO: 4747332 - DNA, 14 bp, Homo sapiens
gatgttttccatga

SEQ ID NO: 4747333 - DNA, 21 bp, Homo sapiens
gattaatttgtgaaaatgtaa

SEQ ID NO: 4747334 - DNA, 20 bp, Homo sapiens
gattacaggcgtgagccacc

SEQ ID NO: 4747335 - DNA, 17 bp, Homo sapiens
gattacaggctcctgcc

SEQ ID NO: 4747336 - DNA, 20 bp, Homo sapiens
gattacaggtgtgagccacc

SEQ ID NO: 4747337 - DNA, 17 bp, Homo sapiens
gattacctcctgagaaa

SEQ ID NO: 4747338 - DNA, 22 bp, Homo sapiens
gattagaaattacctgtggata

SEQ ID NO: 4747339 - DNA, 20 bp, Homo sapiens
gattaggaatcattctgtaa

SEQ ID NO: 4747340 - DNA, 12 bp, Homo sapiens
gattaggattaa

SEQ ID NO: 4747341 - DNA, 19 bp, Homo sapiens
gattatgtagcaaaataca

SEQ ID NO: 4747342 - DNA, 12 bp, Homo sapiens
gattatttaata

SEQ ID NO: 4747343 - DNA, 15 bp, Homo sapiens
gattatttaataaca

SEQ ID NO: 4747344 - DNA, 16 bp, Homo sapiens
gattatttaataacat

SEQ ID NO: 4747345 - DNA, 18 bp, Homo sapiens
gattatttaataacatta

SEQ ID NO: 4747346 - DNA, 23 bp, Homo sapiens
gattatttaataacattacctta

SEQ ID NO: 4747347 - DNA, 16 bp, Homo sapiens
gattatttctgtattt

SEQ ID NO: 4747348 - DNA, 12 bp, Homo sapiens
gattcacactgt

SEQ ID NO: 4747349 - DNA, 14 bp, Homo sapiens
gattcagacagctg

SEQ ID NO: 4747350 - DNA, 17 bp, Homo sapiens
gattcagacagctgcct

SEQ ID NO: 4747351 - DNA, 18 bp, Homo sapiens
gattcagacagctgcctg

SEQ ID NO: 4747352 - DNA, 19 bp, Homo sapiens
gattcagacagctgcctgg

SEQ ID NO: 4747353 - DNA, 20 bp, Homo sapiens
gattcagtgttaaatgtgat

SEQ ID NO: 4747354 - DNA, 12 bp, Homo sapiens
gattcatattta

SEQ ID NO: 4747355 - DNA, 18 bp, Homo sapiens
gattccaaagcattttca

SEQ ID NO: 4747356 - DNA, 15 bp, Homo sapiens
gattcccaagctctg

SEQ ID NO: 4747357 - DNA, 19 bp, Homo sapiens
gattcccaagctctgctcc

SEQ ID NO: 4747358 - DNA, 20 bp, Homo sapiens
gattcccaagctctgctcct

SEQ ID NO: 4747359 - DNA, 21 bp, Homo sapiens
gattcccaagctctgctcctc

SEQ ID NO: 4747360 - DNA, 22 bp, Homo sapiens
gattcccaagctctgctcctct

SEQ ID NO: 4747361 - DNA, 22 bp, Homo sapiens
gattctaaacagatgtccctga

SEQ ID NO: 4747362 - DNA, 21 bp, Homo sapiens
gattctcagggtctctgctgc

SEQ ID NO: 4747363 - DNA, 14 bp, Homo sapiens
gattctcctgcctc

SEQ ID NO: 4747364 - DNA, 12 bp, Homo sapiens
gattctccttca

SEQ ID NO: 4747365 - DNA, 15 bp, Homo sapiens
gattcttctgcttca

SEQ ID NO: 4747366 - DNA, 20 bp, Homo sapiens
gattcttctgcttcagcctc

SEQ ID NO: 4747367 - DNA, 22 bp, Homo sapiens
gattctttcctgaggctgggct

SEQ ID NO: 4747368 - DNA, 15 bp, Homo sapiens
gattgcaacaggctg

SEQ ID NO: 4747369 - DNA, 17 bp, Homo sapiens
gattgcaacaggctggg

SEQ ID NO: 4747370 - DNA, 20 bp, Homo sapiens
gattgcgagagatgtgtgtt

SEQ ID NO: 4747371 - DNA, 22 bp, Homo sapiens
gattgcgagagatgtgtgttga

SEQ ID NO: 4747372 - DNA, 22 bp, Homo sapiens
gattggagatagggaaagaaag

SEQ ID NO: 4747373 - DNA, 22 bp, Homo sapiens
gattggattatttaataacatt

SEQ ID NO: 4747374 - DNA, 18 bp, Homo sapiens
gattgggttatgaatatt

SEQ ID NO: 4747375 - DNA, 18 bp, Homo sapiens
gattggttttattttatg

SEQ ID NO: 4747376 - DNA, 14 bp, Homo sapiens
gattgtaaaaataa

SEQ ID NO: 4747377 - DNA, 15 bp, Homo sapiens
gattgtccccgaccc

SEQ ID NO: 4747378 - DNA, 18 bp, Homo sapiens
gattgtgcctaatgtgtt

SEQ ID NO: 4747379 - DNA, 13 bp, Homo sapiens
gatttaataaaat

SEQ ID NO: 4747380 - DNA, 22 bp, Homo sapiens
gatttaataaaataattctaaa

SEQ ID NO: 4747381 - DNA, 15 bp, Homo sapiens
gatttaatccatttt

SEQ ID NO: 4747382 - DNA, 20 bp, Homo sapiens
gatttagcaatgctgtgaat

SEQ ID NO: 4747383 - DNA, 22 bp, Homo sapiens
gatttcaacatggatacatatt

SEQ ID NO: 4747384 - DNA, 12 bp, Homo sapiens
gatttcatctgc

SEQ ID NO: 4747385 - DNA, 15 bp, Homo sapiens
gatttcatctgctct

SEQ ID NO: 4747386 - DNA, 20 bp, Homo sapiens
gatttcatctgctctccttc

SEQ ID NO: 4747387 - DNA, 21 bp, Homo sapiens
gatttcatctgctctccttcc

SEQ ID NO: 4747388 - DNA, 19 bp, Homo sapiens
gatttccagccagggctgc

SEQ ID NO: 4747389 - DNA, 16 bp, Homo sapiens
gatttcccgtggcccc

SEQ ID NO: 4747390 - DNA, 18 bp, Homo sapiens
gatttctagaatggtttt

SEQ ID NO: 4747391 - DNA, 16 bp, Homo sapiens
gatttgatatttgcat

SEQ ID NO: 4747392 - DNA, 17 bp, Homo sapiens
gatttgatatttgcatt

SEQ ID NO: 4747393 - DNA, 23 bp, Homo sapiens
gatttgggctggaacagattcac

SEQ ID NO: 4747394 - DNA, 13 bp, Homo sapiens
gatttggggtgga

SEQ ID NO: 4747395 - DNA, 23 bp, Homo sapiens
gatttggtcagaatgcagttgtt

SEQ ID NO: 4747396 - DNA, 17 bp, Homo sapiens
gatttgtaacattagtt

SEQ ID NO: 4747397 - DNA, 20 bp, Homo sapiens
gatttgtctttggtgaacat

SEQ ID NO: 4747398 - DNA, 18 bp, Homo sapiens
gatttgttatggttacat

SEQ ID NO: 4747399 - DNA, 19 bp, Homo sapiens
gattttaaaagttttgttc

SEQ ID NO: 4747400 - DNA, 15 bp, Homo sapiens
gattttatctgtgga

SEQ ID NO: 4747401 - DNA, 19 bp, Homo sapiens
gattttatttatatcttta

SEQ ID NO: 4747402 - DNA, 14 bp, Homo sapiens
gattttgaattaga

SEQ ID NO: 4747403 - DNA, 22 bp, Homo sapiens
gattttggttttgttcccctcc

SEQ ID NO: 4747404 - DNA, 15 bp, Homo sapiens
gatttttctttaact

SEQ ID NO: 4747405 - DNA, 14 bp, Homo sapiens
gcaaaaatagttaa

SEQ ID NO: 4747406 - DNA, 21 bp, Homo sapiens
gcaaaagtacaagggctgaga

SEQ ID NO: 4747407 - DNA, 22 bp, Homo sapiens
gcaaactttaacaggttttctt

SEQ ID NO: 4747408 - DNA, 12 bp, Homo sapiens
gcaaagaaaatg

SEQ ID NO: 4747409 - DNA, 22 bp, Homo sapiens
gcaaagtatcaaagaaaaacaa

SEQ ID NO: 4747410 - DNA, 23 bp, Homo sapiens
gcaaagtcatgcaaaggctggga

SEQ ID NO: 4747411 - DNA, 14 bp, Homo sapiens
gcaaatgcccaagg

SEQ ID NO: 4747412 - DNA, 11 bp, Homo sapiens
gcaaatgccct

SEQ ID NO: 4747413 - DNA, 18 bp, Homo sapiens
gcaaattaaacaatataa

SEQ ID NO: 4747414 - DNA, 14 bp, Homo sapiens
gcaacaagctattt

SEQ ID NO: 4747415 - DNA, 15 bp, Homo sapiens
gcaacaggctgggct

SEQ ID NO: 4747416 - DNA, 16 bp, Homo sapiens
gcaacaggctgggctt

SEQ ID NO: 4747417 - DNA, 18 bp, Homo sapiens
gcaacctccgcctcttgg

SEQ ID NO: 4747418 - DNA, 22 bp, Homo sapiens
gcaactatcagactaagccagc

SEQ ID NO: 4747419 - DNA, 23 bp, Homo sapiens
gcaactatcagactaagccagca

SEQ ID NO: 4747420 - DNA, 16 bp, Homo sapiens
gcaacttgtgaactcc

SEQ ID NO: 4747421 - DNA, 18 bp, Homo sapiens
gcaagcaagaaacactgg

SEQ ID NO: 4747422 - DNA, 17 bp, Homo sapiens
gcaagccatggagtgag

SEQ ID NO: 4747423 - DNA, 21 bp, Homo sapiens
gcaaggacacagatgaaacac

SEQ ID NO: 4747424 - DNA, 14 bp, Homo sapiens
gcaaggaggctggc

SEQ ID NO: 4747425 - DNA, 16 bp, Homo sapiens
gcaaggaggctggctg

SEQ ID NO: 4747426 - DNA, 19 bp, Homo sapiens
gcaaggaggctggctgggg

SEQ ID NO: 4747427 - DNA, 14 bp, Homo sapiens
gcaaggcacctgca

SEQ ID NO: 4747428 - DNA, 22 bp, Homo sapiens
gcaatgctggctgttggctggg

SEQ ID NO: 4747429 - DNA, 14 bp, Homo sapiens
gcaatggcagcctt

SEQ ID NO: 4747430 - DNA, 15 bp, Homo sapiens
gcaattctcctgcct

SEQ ID NO: 4747431 - DNA, 18 bp, Homo sapiens
gcaattctcctgcctcag

SEQ ID NO: 4747432 - DNA, 19 bp, Homo sapiens
gcaattctcctgcctcagc

SEQ ID NO: 4747433 - DNA, 20 bp, Homo sapiens
gcaattctcctgcctcagcc

SEQ ID NO: 4747434 - DNA, 18 bp, Homo sapiens
gcacaaactcaccatctg

SEQ ID NO: 4747435 - DNA, 15 bp, Homo sapiens
gcacaagctccaagc

SEQ ID NO: 4747436 - DNA, 23 bp, Homo sapiens
gcacaagctccaagctcccaggc

SEQ ID NO: 4747437 - DNA, 20 bp, Homo sapiens
gcacaataaaaccaagcctc

SEQ ID NO: 4747438 - DNA, 22 bp, Homo sapiens
gcacaataaaaccaagcctctg

SEQ ID NO: 4747439 - DNA, 23 bp, Homo sapiens
gcacaataaaaccaagcctctgg

SEQ ID NO: 4747440 - DNA, 23 bp, Homo sapiens
gcacacacacacacacatacaca

SEQ ID NO: 4747441 - DNA, 18 bp, Homo sapiens
gcacacacacatacagag

SEQ ID NO: 4747442 - DNA, 18 bp, Homo sapiens
gcacacaccagagcccac

SEQ ID NO: 4747443 - DNA, 19 bp, Homo sapiens
gcacacaccagagcccacc

SEQ ID NO: 4747444 - DNA, 18 bp, Homo sapiens
gcacacagaggggagtca

SEQ ID NO: 4747445 - DNA, 11 bp, Homo sapiens
gcacacagcac

SEQ ID NO: 4747446 - DNA, 14 bp, Homo sapiens
gcacacctctggct

SEQ ID NO: 4747447 - DNA, 21 bp, Homo sapiens
gcacagaccctgccctgtggg

SEQ ID NO: 4747448 - DNA, 15 bp, Homo sapiens
gcacagatgcccacg

SEQ ID NO: 4747449 - DNA, 19 bp, Homo sapiens
gcacagcaaggaggctggc

SEQ ID NO: 4747450 - DNA, 15 bp, Homo sapiens
gcacagccaaggact

SEQ ID NO: 4747451 - DNA, 12 bp, Homo sapiens
gcacagccctcc

SEQ ID NO: 4747452 - DNA, 16 bp, Homo sapiens
gcacagccctcccgcc

SEQ ID NO: 4747453 - DNA, 13 bp, Homo sapiens
gcacatccctgga

SEQ ID NO: 4747454 - DNA, 19 bp, Homo sapiens
gcacatctaaattgatcat

SEQ ID NO: 4747455 - DNA, 23 bp, Homo sapiens
gcacatctaaattgatcattcat

SEQ ID NO: 4747456 - DNA, 23 bp, Homo sapiens
gcacatttaagagacagtcaccc

SEQ ID NO: 4747457 - DNA, 15 bp, Homo sapiens
gcaccaacccagccg

SEQ ID NO: 4747458 - DNA, 18 bp, Homo sapiens
gcaccaacccagccgctg

SEQ ID NO: 4747459 - DNA, 20 bp, Homo sapiens
gcacccagccccaaggggtg

SEQ ID NO: 4747460 - DNA, 21 bp, Homo sapiens
gcacccagcctctagggaccc

SEQ ID NO: 4747461 - DNA, 17 bp, Homo sapiens
gcaccccctcctgctgc

SEQ ID NO: 4747462 - DNA, 15 bp, Homo sapiens
gcacccggcccctgc

SEQ ID NO: 4747463 - DNA, 16 bp, Homo sapiens
gcacccgggctcaggg

SEQ ID NO: 4747464 - DNA, 21 bp, Homo sapiens
gcacccgggctcagggaccac

SEQ ID NO: 4747465 - DNA, 15 bp, Homo sapiens
gcaccctcccctccc

SEQ ID NO: 4747466 - DNA, 14 bp, Homo sapiens
gcaccggaccagcc

SEQ ID NO: 4747467 - DNA, 17 bp, Homo sapiens
gcaccggctggcctggc

SEQ ID NO: 4747468 - DNA, 21 bp, Homo sapiens
gcaccggctggcctggcccct

SEQ ID NO: 4747469 - DNA, 19 bp, Homo sapiens
gcacctacagtgtacagtc

SEQ ID NO: 4747470 - DNA, 18 bp, Homo sapiens
gcacctaccaccacgccc

SEQ ID NO: 4747471 - DNA, 21 bp, Homo sapiens
gcacctaccaccacgcccggc

SEQ ID NO: 4747472 - DNA, 15 bp, Homo sapiens
gcacctcctgcctcg

SEQ ID NO: 4747473 - DNA, 22 bp, Homo sapiens
gcacctgaaattaatttgtgaa

SEQ ID NO: 4747474 - DNA, 20 bp, Homo sapiens
gcacctgcaggttgggccat

SEQ ID NO: 4747475 - DNA, 17 bp, Homo sapiens
gcaccttagacagtccc

SEQ ID NO: 4747476 - DNA, 18 bp, Homo sapiens
gcaccttagacagtccct

SEQ ID NO: 4747477 - DNA, 20 bp, Homo sapiens
gcaccttctgacgcagcctg

SEQ ID NO: 4747478 - DNA, 23 bp, Homo sapiens
gcaccttctgacgcagcctgaga

SEQ ID NO: 4747479 - DNA, 16 bp, Homo sapiens
gcacgtgtgtttttct

SEQ ID NO: 4747480 - DNA, 18 bp, Homo sapiens
gcactaaggtgtgctctg

SEQ ID NO: 4747481 - DNA, 20 bp, Homo sapiens
gcactaaggtgtgctctgat

SEQ ID NO: 4747482 - DNA, 17 bp, Homo sapiens
gcactactcagttatta

SEQ ID NO: 4747483 - DNA, 13 bp, Homo sapiens
gcactcagaagac

SEQ ID NO: 4747484 - DNA, 16 bp, Homo sapiens
gcactcagaagacact

SEQ ID NO: 4747485 - DNA, 20 bp, Homo sapiens
gcactcagaagacactgatg

SEQ ID NO: 4747486 - DNA, 12 bp, Homo sapiens
gcactcccctgc

SEQ ID NO: 4747487 - DNA, 14 bp, Homo sapiens
gcactcccctgctg

SEQ ID NO: 4747488 - DNA, 21 bp, Homo sapiens
gcactctcgcacacacagtga

SEQ ID NO: 4747489 - DNA, 15 bp, Homo sapiens
gcactgactggaagg

SEQ ID NO: 4747490 - DNA, 21 bp, Homo sapiens
gcactgagataccagcgagga

SEQ ID NO: 4747491 - DNA, 13 bp, Homo sapiens
gcactgaggaaga

SEQ ID NO: 4747492 - DNA, 16 bp, Homo sapiens
gcactgcacactcagt

SEQ ID NO: 4747493 - DNA, 19 bp, Homo sapiens
gcactgccctggtggccct

SEQ ID NO: 4747494 - DNA, 11 bp, Homo sapiens
gcactgcctga

SEQ ID NO: 4747495 - DNA, 18 bp, Homo sapiens
gcactgcctgatggacct

SEQ ID NO: 4747496 - DNA, 14 bp, Homo sapiens
gcactgctgggtgg

SEQ ID NO: 4747497 - DNA, 21 bp, Homo sapiens
gcactgctgggtggcccatcc

SEQ ID NO: 4747498 - DNA, 12 bp, Homo sapiens
gcactgcttcca

SEQ ID NO: 4747499 - DNA, 14 bp, Homo sapiens
gcactgcttccagt

SEQ ID NO: 4747500 - DNA, 22 bp, Homo sapiens
gcactgcttccagtgaggctct

SEQ ID NO: 4747501 - DNA, 12 bp, Homo sapiens
gcactgtcctgc

SEQ ID NO: 4747502 - DNA, 14 bp, Homo sapiens
gcactgtgctcagg

SEQ ID NO: 4747503 - DNA, 18 bp, Homo sapiens
gcactgttccccctgtgc

SEQ ID NO: 4747504 - DNA, 20 bp, Homo sapiens
gcactgttccccctgtgcag

SEQ ID NO: 4747505 - DNA, 17 bp, Homo sapiens
gcacttacaccagtttg

SEQ ID NO: 4747506 - DNA, 17 bp, Homo sapiens
gcacttattgaatatat

SEQ ID NO: 4747507 - DNA, 18 bp, Homo sapiens
gcacttattgaatatatg

SEQ ID NO: 4747508 - DNA, 14 bp, Homo sapiens
gcacttgcagactc

SEQ ID NO: 4747509 - DNA, 16 bp, Homo sapiens
gcacttgcagactcta

SEQ ID NO: 4747510 - DNA, 15 bp, Homo sapiens
gcagaagacaccaga

SEQ ID NO: 4747511 - DNA, 16 bp, Homo sapiens
gcagaagacaccagag

SEQ ID NO: 4747512 - DNA, 20 bp, Homo sapiens
gcagaagacaccagagcaga

SEQ ID NO: 4747513 - DNA, 15 bp, Homo sapiens
gcagaatactggtct

SEQ ID NO: 4747514 - DNA, 13 bp, Homo sapiens
gcagacaggacca

SEQ ID NO: 4747515 - DNA, 15 bp, Homo sapiens
gcagacaggaccagg

SEQ ID NO: 4747516 - DNA, 18 bp, Homo sapiens
gcagacaggaccagggat

SEQ ID NO: 4747517 - DNA, 13 bp, Homo sapiens
gcagacaggcaag

SEQ ID NO: 4747518 - DNA, 19 bp, Homo sapiens
gcagacaggcaagcacctc

SEQ ID NO: 4747519 - DNA, 17 bp, Homo sapiens
gcagactctacagaggc

SEQ ID NO: 4747520 - DNA, 19 bp, Homo sapiens
gcagactctacagaggcca

SEQ ID NO: 4747521 - DNA, 20 bp, Homo sapiens
gcagagaatgaaagggccca

SEQ ID NO: 4747522 - DNA, 15 bp, Homo sapiens
gcagagagccatttt

SEQ ID NO: 4747523 - DNA, 19 bp, Homo sapiens
gcagagagccattttgtga

SEQ ID NO: 4747524 - DNA, 21 bp, Homo sapiens
gcagagagccattttgtgaat

SEQ ID NO: 4747525 - DNA, 23 bp, Homo sapiens
gcagagattggaatgggcagctc

SEQ ID NO: 4747526 - DNA, 24 bp, Homo sapiens
gcagagcaccttagacagtccctg

SEQ ID NO: 4747527 - DNA, 14 bp, Homo sapiens
gcagagcagagacc

SEQ ID NO: 4747528 - DNA, 13 bp, Homo sapiens
gcagaggggcagg

SEQ ID NO: 4747529 - DNA, 22 bp, Homo sapiens
gcagataaacagaaatgctctg

SEQ ID NO: 4747530 - DNA, 19 bp, Homo sapiens
gcagatgaggttgctagag

SEQ ID NO: 4747531 - DNA, 17 bp, Homo sapiens
gcagatttctgccttga

SEQ ID NO: 4747532 - DNA, 15 bp, Homo sapiens
gcagcagaagggggt

SEQ ID NO: 4747533 - DNA, 19 bp, Homo sapiens
gcagcagtgtgaggccagg

SEQ ID NO: 4747534 - DNA, 18 bp, Homo sapiens
gcagcatattcaggaagc

SEQ ID NO: 4747535 - DNA, 19 bp, Homo sapiens
gcagcatattcaggaagct

SEQ ID NO: 4747536 - DNA, 16 bp, Homo sapiens
gcagccacattcctga

SEQ ID NO: 4747537 - DNA, 13 bp, Homo sapiens
gcagccaggccac

SEQ ID NO: 4747538 - DNA, 14 bp, Homo sapiens
gcagccagggagag

SEQ ID NO: 4747539 - DNA, 21 bp, Homo sapiens
gcagccagggagagcccagga

SEQ ID NO: 4747540 - DNA, 18 bp, Homo sapiens
gcagccccattctgcctg

SEQ ID NO: 4747541 - DNA, 17 bp, Homo sapiens
gcagccgctgagcgagg

SEQ ID NO: 4747542 - DNA, 20 bp, Homo sapiens
gcagcctcaacctcctgggc

SEQ ID NO: 4747543 - DNA, 15 bp, Homo sapiens
gcagcctcagagaca

SEQ ID NO: 4747544 - DNA, 23 bp, Homo sapiens
gcagcctcagagacatcagccct

SEQ ID NO: 4747545 - DNA, 12 bp, Homo sapiens
gcagcctgagaa

SEQ ID NO: 4747546 - DNA, 13 bp, Homo sapiens
gcagcctgagaat

SEQ ID NO: 4747547 - DNA, 14 bp, Homo sapiens
gcagctcatctctg

SEQ ID NO: 4747548 - DNA, 19 bp, Homo sapiens
gcagctgcggtccacccag

SEQ ID NO: 4747549 - DNA, 22 bp, Homo sapiens
gcagctgcggtccacccaggag

SEQ ID NO: 4747550 - DNA, 13 bp, Homo sapiens
gcagctgcttttg

SEQ ID NO: 4747551 - DNA, 20 bp, Homo sapiens
gcagctgcttttgtctatgg

SEQ ID NO: 4747552 - DNA, 19 bp, Homo sapiens
gcagctggaagtggctctg

SEQ ID NO: 4747553 - DNA, 23 bp, Homo sapiens
gcaggaaatgaaaatgtcttgtg

SEQ ID NO: 4747554 - DNA, 14 bp, Homo sapiens
gcaggaacatacag

SEQ ID NO: 4747555 - DNA, 17 bp, Homo sapiens
gcaggaaggagctgcct

SEQ ID NO: 4747556 - DNA, 18 bp, Homo sapiens
gcaggaaggagctgcctg

SEQ ID NO: 4747557 - DNA, 21 bp, Homo sapiens
gcaggaaggagctgcctggac

SEQ ID NO: 4747558 - DNA, 20 bp, Homo sapiens
gcaggaaggctgagaggaga

SEQ ID NO: 4747559 - DNA, 20 bp, Homo sapiens
gcaggacctagctgttgtaa

SEQ ID NO: 4747560 - DNA, 19 bp, Homo sapiens
gcaggactcagctccccag

SEQ ID NO: 4747561 - DNA, 13 bp, Homo sapiens
gcaggaggaggtg

SEQ ID NO: 4747562 - DNA, 14 bp, Homo sapiens
gcaggaggaggtgc

SEQ ID NO: 4747563 - DNA, 14 bp, Homo sapiens
gcaggagggcagtg

SEQ ID NO: 4747564 - DNA, 18 bp, Homo sapiens
gcaggcacagcacaggga

SEQ ID NO: 4747565 - DNA, 12 bp, Homo sapiens
gcaggcagccag

SEQ ID NO: 4747566 - DNA, 13 bp, Homo sapiens
gcaggcagccagg

SEQ ID NO: 4747567 - DNA, 14 bp, Homo sapiens
gcaggcagccaggc

SEQ ID NO: 4747568 - DNA, 20 bp, Homo sapiens
gcaggcatggctggtgcctg

SEQ ID NO: 4747569 - DNA, 21 bp, Homo sapiens
gcaggcatggctggtgcctga

SEQ ID NO: 4747570 - DNA, 15 bp, Homo sapiens
gcaggcccctctcct

SEQ ID NO: 4747571 - DNA, 21 bp, Homo sapiens
gcaggcccctctcctccgtgg

SEQ ID NO: 4747572 - DNA, 12 bp, Homo sapiens
gcaggccctgca

SEQ ID NO: 4747573 - DNA, 20 bp, Homo sapiens
gcaggccctgcactgtcctg

SEQ ID NO: 4747574 - DNA, 13 bp, Homo sapiens
gcaggcctgcctt

SEQ ID NO: 4747575 - DNA, 21 bp, Homo sapiens
gcaggctaaggcgtggagctg

SEQ ID NO: 4747576 - DNA, 22 bp, Homo sapiens
gcaggctaaggcgtggagctgc

SEQ ID NO: 4747577 - DNA, 20 bp, Homo sapiens
gcaggctacactgacactgg

SEQ ID NO: 4747578 - DNA, 18 bp, Homo sapiens
gcaggctggccctgccct

SEQ ID NO: 4747579 - DNA, 17 bp, Homo sapiens
gcagggaacatggggag

SEQ ID NO: 4747580 - DNA, 18 bp, Homo sapiens
gcagggaacatggggagg

SEQ ID NO: 4747581 - DNA, 10 bp, Homo sapiens
gcagggaggg

SEQ ID NO: 4747582 - DNA, 14 bp, Homo sapiens
gcagggagggcctg

SEQ ID NO: 4747583 - DNA, 18 bp, Homo sapiens
gcagggcaggaaggggaa

SEQ ID NO: 4747584 - DNA, 16 bp, Homo sapiens
gcagggcctcacacgg

SEQ ID NO: 4747585 - DNA, 20 bp, Homo sapiens
gcagggctaccctgagctga

SEQ ID NO: 4747586 - DNA, 21 bp, Homo sapiens
gcagggctaccctgagctgag

SEQ ID NO: 4747587 - DNA, 22 bp, Homo sapiens
gcagggctaccctgagctgagg

SEQ ID NO: 4747588 - DNA, 18 bp, Homo sapiens
gcagggtctcactctgtc

SEQ ID NO: 4747589 - DNA, 20 bp, Homo sapiens
gcaggtgctgctaccctccc

SEQ ID NO: 4747590 - DNA, 21 bp, Homo sapiens
gcaggtgctgctaccctccct

SEQ ID NO: 4747591 - DNA, 17 bp, Homo sapiens
gcaggtttgaccaggaa

SEQ ID NO: 4747592 - DNA, 19 bp, Homo sapiens
gcaggtttgaccaggaaag

SEQ ID NO: 4747593 - DNA, 20 bp, Homo sapiens
gcagtaaaagataaatttgt

SEQ ID NO: 4747594 - DNA, 19 bp, Homo sapiens
gcagtcctgatcagagccg

SEQ ID NO: 4747595 - DNA, 22 bp, Homo sapiens
gcagtgatatggcagaagacac

SEQ ID NO: 4747596 - DNA, 14 bp, Homo sapiens
gcagtgggagctgc

SEQ ID NO: 4747597 - DNA, 18 bp, Homo sapiens
gcagtggtgcgatctggg

SEQ ID NO: 4747598 - DNA, 22 bp, Homo sapiens
gcagtggtgcgatctgggttca

SEQ ID NO: 4747599 - DNA, 15 bp, Homo sapiens
gcagtgtgaggccag

SEQ ID NO: 4747600 - DNA, 13 bp, Homo sapiens
gcagtgtttgtat

SEQ ID NO: 4747601 - DNA, 14 bp, Homo sapiens
gcagtttttctgta

SEQ ID NO: 4747602 - DNA, 13 bp, Homo sapiens
gcataaagtaaat

SEQ ID NO: 4747603 - DNA, 15 bp, Homo sapiens
gcatatatgttcttc

SEQ ID NO: 4747604 - DNA, 19 bp, Homo sapiens
gcatatctctagtccctgt

SEQ ID NO: 4747605 - DNA, 22 bp, Homo sapiens
gcatatctctagtccctgtgtt

SEQ ID NO: 4747606 - DNA, 23 bp, Homo sapiens
gcatattataaaggataaagaag

SEQ ID NO: 4747607 - DNA, 18 bp, Homo sapiens
gcatatttttctaaagaa

SEQ ID NO: 4747608 - DNA, 14 bp, Homo sapiens
gcatcaaacatgaa

SEQ ID NO: 4747609 - DNA, 16 bp, Homo sapiens
gcatcaaacatgaaaa

SEQ ID NO: 4747610 - DNA, 20 bp, Homo sapiens
gcatcaaacatgaaaacatt

SEQ ID NO: 4747611 - DNA, 15 bp, Homo sapiens
gcatcacctccacca

SEQ ID NO: 4747612 - DNA, 12 bp, Homo sapiens
gcatcaggccag

SEQ ID NO: 4747613 - DNA, 18 bp, Homo sapiens
gcatcccttgaccaggcc

SEQ ID NO: 4747614 - DNA, 22 bp, Homo sapiens
gcatcccttgaccaggcctggg

SEQ ID NO: 4747615 - DNA, 20 bp, Homo sapiens
gcatctagcatgtcgtcaaa

SEQ ID NO: 4747616 - DNA, 22 bp, Homo sapiens
gcatctccagcattctcagcca

SEQ ID NO: 4747617 - DNA, 15 bp, Homo sapiens
gcatgaaataaaata

SEQ ID NO: 4747618 - DNA, 17 bp, Homo sapiens
gcatgacccagtgaaga

SEQ ID NO: 4747619 - DNA, 11 bp, Homo sapiens
gcatgagtggc

SEQ ID NO: 4747620 - DNA, 19 bp, Homo sapiens
gcatgatgaaactgtcata

SEQ ID NO: 4747621 - DNA, 17 bp, Homo sapiens
gcatgcactgttccccc

SEQ ID NO: 4747622 - DNA, 21 bp, Homo sapiens
gcatgcactgttccccctgtg

SEQ ID NO: 4747623 - DNA, 15 bp, Homo sapiens
gcatgcctggatggg

SEQ ID NO: 4747624 - DNA, 21 bp, Homo sapiens
gcatggccctgctgcccctcc

SEQ ID NO: 4747625 - DNA, 15 bp, Homo sapiens
gcatggctgtgagga

SEQ ID NO: 4747626 - DNA, 17 bp, Homo sapiens
gcatgggtcgggagagg

SEQ ID NO: 4747627 - DNA, 19 bp, Homo sapiens
gcatgggtcgggagagggg

SEQ ID NO: 4747628 - DNA, 19 bp, Homo sapiens
gcatgtaaaatcttcagct

SEQ ID NO: 4747629 - DNA, 20 bp, Homo sapiens
gcatgtaaaatcttcagctg

SEQ ID NO: 4747630 - DNA, 19 bp, Homo sapiens
gcatgttttccagctcctc

SEQ ID NO: 4747631 - DNA, 23 bp, Homo sapiens
gcattcatgttttaaaagtttgt

SEQ ID NO: 4747632 - DNA, 16 bp, Homo sapiens
gcattccccaggaggc

SEQ ID NO: 4747633 - DNA, 22 bp, Homo sapiens
gcattccccaggaggccagcct

SEQ ID NO: 4747634 - DNA, 15 bp, Homo sapiens
gcattcttattcatc

SEQ ID NO: 4747635 - DNA, 14 bp, Homo sapiens
gcattgccaagggc

SEQ ID NO: 4747636 - DNA, 20 bp, Homo sapiens
gcattggcagcaggtgctgc

SEQ ID NO: 4747637 - DNA, 21 bp, Homo sapiens
gcattggcagcaggtgctgct

SEQ ID NO: 4747638 - DNA, 16 bp, Homo sapiens
gcattgtgggaagggg

SEQ ID NO: 4747639 - DNA, 18 bp, Homo sapiens
gcattgtgggaaggggag

SEQ ID NO: 4747640 - DNA, 16 bp, Homo sapiens
gcattgttgatgctca

SEQ ID NO: 4747641 - DNA, 13 bp, Homo sapiens
gcatttaaaaaaa

SEQ ID NO: 4747642 - DNA, 19 bp, Homo sapiens
gcatttaatgtagccatgg

SEQ ID NO: 4747643 - DNA, 18 bp, Homo sapiens
gcatttactttgtgttca

SEQ ID NO: 4747644 - DNA, 17 bp, Homo sapiens
gcatttatttgtgatga

SEQ ID NO: 4747645 - DNA, 19 bp, Homo sapiens
gcatttcacaaaacagcct

SEQ ID NO: 4747646 - DNA, 12 bp, Homo sapiens
gcattttgaatg

SEQ ID NO: 4747647 - DNA, 13 bp, Homo sapiens
gccaaagccaaag

SEQ ID NO: 4747648 - DNA, 16 bp, Homo sapiens
gccaaagttaaatgta

SEQ ID NO: 4747649 - DNA, 16 bp, Homo sapiens
gccaaataatgtctct

SEQ ID NO: 4747650 - DNA, 18 bp, Homo sapiens
gccaaataatgtctctgt

SEQ ID NO: 4747651 - DNA, 20 bp, Homo sapiens
gccaacactcaagaagcagg

SEQ ID NO: 4747652 - DNA, 21 bp, Homo sapiens
gccaacagtgttaggcctggc

SEQ ID NO: 4747653 - DNA, 22 bp, Homo sapiens
gccaacagtgttaggcctggca

SEQ ID NO: 4747654 - DNA, 19 bp, Homo sapiens
gccaacttcttcagagctg

SEQ ID NO: 4747655 - DNA, 20 bp, Homo sapiens
gccaacttcttcagagctga

SEQ ID NO: 4747656 - DNA, 18 bp, Homo sapiens
gccaagcactgtgctcag

SEQ ID NO: 4747657 - DNA, 23 bp, Homo sapiens
gccaagcactgtgctcagggcta

SEQ ID NO: 4747658 - DNA, 22 bp, Homo sapiens
gccaagcatttaatgtagccat

SEQ ID NO: 4747659 - DNA, 16 bp, Homo sapiens
gccaagggctttgttt

SEQ ID NO: 4747660 - DNA, 17 bp, Homo sapiens
gccaatctattctcaaa

SEQ ID NO: 4747661 - DNA, 13 bp, Homo sapiens
gccaatggaacct

SEQ ID NO: 4747662 - DNA, 19 bp, Homo sapiens
gccaatggaacctcctttc

SEQ ID NO: 4747663 - DNA, 20 bp, Homo sapiens
gccaatggaacctcctttct

SEQ ID NO: 4747664 - DNA, 15 bp, Homo sapiens
gccacaaatgtgtcc

SEQ ID NO: 4747665 - DNA, 19 bp, Homo sapiens
gccacaccaagctgtgcca

SEQ ID NO: 4747666 - DNA, 21 bp, Homo sapiens
gccacaccaagctgtgccacc

SEQ ID NO: 4747667 - DNA, 13 bp, Homo sapiens
gccacaggcctga

SEQ ID NO: 4747668 - DNA, 23 bp, Homo sapiens
gccacaggcctgagatttcatct

SEQ ID NO: 4747669 - DNA, 15 bp, Homo sapiens
gccacatgggaggct

SEQ ID NO: 4747670 - DNA, 21 bp, Homo sapiens
gccaccaacatactcccatct

SEQ ID NO: 4747671 - DNA, 15 bp, Homo sapiens
gccaccctcatgctg

SEQ ID NO: 4747672 - DNA, 14 bp, Homo sapiens
gccaccctgggctc

SEQ ID NO: 4747673 - DNA, 19 bp, Homo sapiens
gccaccctgggctctgtgg

SEQ ID NO: 4747674 - DNA, 20 bp, Homo sapiens
gccaccgtagggcctgactc

SEQ ID NO: 4747675 - DNA, 17 bp, Homo sapiens
gccaccgtgcctggcca

SEQ ID NO: 4747676 - DNA, 22 bp, Homo sapiens
gccaccgtgcctggccacgccc

SEQ ID NO: 4747677 - DNA, 20 bp, Homo sapiens
gccacctcaccctctccgca

SEQ ID NO: 4747678 - DNA, 14 bp, Homo sapiens
gccacctgcggtgc

SEQ ID NO: 4747679 - DNA, 14 bp, Homo sapiens
gccacctggacccc

SEQ ID NO: 4747680 - DNA, 16 bp, Homo sapiens
gccacggccaggccag

SEQ ID NO: 4747681 - DNA, 23 bp, Homo sapiens
gccactaactagagcagccctgg

SEQ ID NO: 4747682 - DNA, 22 bp, Homo sapiens
gccactcccctaaactccagga

SEQ ID NO: 4747683 - DNA, 14 bp, Homo sapiens
gccactcctctgac

SEQ ID NO: 4747684 - DNA, 14 bp, Homo sapiens
gccactctccccat

SEQ ID NO: 4747685 - DNA, 17 bp, Homo sapiens
gccactgcaccgggcca

SEQ ID NO: 4747686 - DNA, 16 bp, Homo sapiens
gccactgttgttttgg

SEQ ID NO: 4747687 - DNA, 18 bp, Homo sapiens
gccacttaaaatgttcac

SEQ ID NO: 4747688 - DNA, 14 bp, Homo sapiens
gccacttctgggtg

SEQ ID NO: 4747689 - DNA, 22 bp, Homo sapiens
gccagaggctcgttgactggct

SEQ ID NO: 4747690 - DNA, 19 bp, Homo sapiens
gccagagggagtgacagag

SEQ ID NO: 4747691 - DNA, 20 bp, Homo sapiens
gccagagggagtgacagagg

SEQ ID NO: 4747692 - DNA, 22 bp, Homo sapiens
gccagatgcacatccctggaag

SEQ ID NO: 4747693 - DNA, 17 bp, Homo sapiens
gccagccccacagccca

SEQ ID NO: 4747694 - DNA, 22 bp, Homo sapiens
gccagcgtcctcctctgtgacc

SEQ ID NO: 4747695 - DNA, 15 bp, Homo sapiens
gccagctctgtatca

SEQ ID NO: 4747696 - DNA, 16 bp, Homo sapiens
gccaggactctgcagc

SEQ ID NO: 4747697 - DNA, 17 bp, Homo sapiens
gccaggactctgcagcc

SEQ ID NO: 4747698 - DNA, 20 bp, Homo sapiens
gccaggactctgcagcctca

SEQ ID NO: 4747699 - DNA, 21 bp, Homo sapiens
gccaggactctgcagcctcag

SEQ ID NO: 4747700 - DNA, 22 bp, Homo sapiens
gccaggatcatggtgtaataag

SEQ ID NO: 4747701 - DNA, 13 bp, Homo sapiens
gccaggccacaag

SEQ ID NO: 4747702 - DNA, 23 bp, Homo sapiens
gccaggccacaagacccttgtgg

SEQ ID NO: 4747703 - DNA, 12 bp, Homo sapiens
gccaggccagag

SEQ ID NO: 4747704 - DNA, 13 bp, Homo sapiens
gccaggccctctg

SEQ ID NO: 4747705 - DNA, 14 bp, Homo sapiens
gccaggccctctgc

SEQ ID NO: 4747706 - DNA, 13 bp, Homo sapiens
gccaggctggtct

SEQ ID NO: 4747707 - DNA, 13 bp, Homo sapiens
gccagggagagcc

SEQ ID NO: 4747708 - DNA, 15 bp, Homo sapiens
gccagggagagccca

SEQ ID NO: 4747709 - DNA, 22 bp, Homo sapiens
gccagggagagcccaggagctc

SEQ ID NO: 4747710 - DNA, 14 bp, Homo sapiens
gccagggcagggcc

SEQ ID NO: 4747711 - DNA, 15 bp, Homo sapiens
gccaggttggaaaag

SEQ ID NO: 4747712 - DNA, 20 bp, Homo sapiens
gccagtcaccccggccacct

SEQ ID NO: 4747713 - DNA, 14 bp, Homo sapiens
gccagtcgcgctgc

SEQ ID NO: 4747714 - DNA, 19 bp, Homo sapiens
gccagtcgcgctgcctgtg

SEQ ID NO: 4747715 - DNA, 19 bp, Homo sapiens
gccagtgatgctaaaggtt

SEQ ID NO: 4747716 - DNA, 18 bp, Homo sapiens
gccagttgaatttatgga

SEQ ID NO: 4747717 - DNA, 13 bp, Homo sapiens
gccagttggtccc

SEQ ID NO: 4747718 - DNA, 16 bp, Homo sapiens
gccagttggtccccct

SEQ ID NO: 4747719 - DNA, 23 bp, Homo sapiens
gccagttggtcccccttccatgg

SEQ ID NO: 4747720 - DNA, 13 bp, Homo sapiens
gccatactggcct

SEQ ID NO: 4747721 - DNA, 20 bp, Homo sapiens
gccatactggcctcgcctgg

SEQ ID NO: 4747722 - DNA, 22 bp, Homo sapiens
gccatactggcctcgcctggcc

SEQ ID NO: 4747723 - DNA, 15 bp, Homo sapiens
gccatacttgttctg

SEQ ID NO: 4747724 - DNA, 23 bp, Homo sapiens
gccatcatctcctgccttcctcc

SEQ ID NO: 4747725 - DNA, 13 bp, Homo sapiens
gccatcccagccc

SEQ ID NO: 4747726 - DNA, 15 bp, Homo sapiens
gccatctctggatgc

SEQ ID NO: 4747727 - DNA, 21 bp, Homo sapiens
gccatctgcgtgacaataaaa

SEQ ID NO: 4747728 - DNA, 19 bp, Homo sapiens
gccatcttaaaaagcgggt

SEQ ID NO: 4747729 - DNA, 18 bp, Homo sapiens
gccatggagagctggagc

SEQ ID NO: 4747730 - DNA, 12 bp, Homo sapiens
gccatgggacca

SEQ ID NO: 4747731 - DNA, 17 bp, Homo sapiens
gccatgggaccaaacct

SEQ ID NO: 4747732 - DNA, 23 bp, Homo sapiens
gccatgtgcaggtggattccatg

SEQ ID NO: 4747733 - DNA, 20 bp, Homo sapiens
gccatgttggccaggctggt

SEQ ID NO: 4747734 - DNA, 20 bp, Homo sapiens
gccattggctatttaaaact

SEQ ID NO: 4747735 - DNA, 18 bp, Homo sapiens
gccattgtgtatgatttt

SEQ ID NO: 4747736 - DNA, 20 bp, Homo sapiens
gccattttattaaacatttt

SEQ ID NO: 4747737 - DNA, 13 bp, Homo sapiens
gccattttgtgaa

SEQ ID NO: 4747738 - DNA, 14 bp, Homo sapiens
gccattttgtgaat

SEQ ID NO: 4747739 - DNA, 13 bp, Homo sapiens
gcccaagagtggg

SEQ ID NO: 4747740 - DNA, 21 bp, Homo sapiens
gcccaatgcactttgttctgg

SEQ ID NO: 4747741 - DNA, 16 bp, Homo sapiens
gcccaccgcatgcccc

SEQ ID NO: 4747742 - DNA, 19 bp, Homo sapiens
gcccaccgcatgccccctc

SEQ ID NO: 4747743 - DNA, 20 bp, Homo sapiens
gcccaccgcatgccccctcg

SEQ ID NO: 4747744 - DNA, 21 bp, Homo sapiens
gcccacctccttccagcactg

SEQ ID NO: 4747745 - DNA, 15 bp, Homo sapiens
gcccacctggcctct

SEQ ID NO: 4747746 - DNA, 17 bp, Homo sapiens
gcccacctggcctctgc

SEQ ID NO: 4747747 - DNA, 20 bp, Homo sapiens
gcccacctggcctctgcact

SEQ ID NO: 4747748 - DNA, 24 bp, Homo sapiens
gcccacctggcctctgcactcccc

SEQ ID NO: 4747749 - DNA, 13 bp, Homo sapiens
gcccaccttggct

SEQ ID NO: 4747750 - DNA, 18 bp, Homo sapiens
gcccaccttggctcaagt

SEQ ID NO: 4747751 - DNA, 21 bp, Homo sapiens
gcccacgctggagtgcagtga

SEQ ID NO: 4747752 - DNA, 23 bp, Homo sapiens
gcccacgctggagtgcagtgagc

SEQ ID NO: 4747753 - DNA, 23 bp, Homo sapiens
gcccacgtcctgtcagtgccgcc

SEQ ID NO: 4747754 - DNA, 16 bp, Homo sapiens
gcccactcattccttc

SEQ ID NO: 4747755 - DNA, 13 bp, Homo sapiens
gcccactccctgc

SEQ ID NO: 4747756 - DNA, 16 bp, Homo sapiens
gcccagaggagggcag

SEQ ID NO: 4747757 - DNA, 15 bp, Homo sapiens
gcccagagggcctgc

SEQ ID NO: 4747758 - DNA, 22 bp, Homo sapiens
gcccagagggcctgcaagggag

SEQ ID NO: 4747759 - DNA, 21 bp, Homo sapiens
gcccagcactgcttgaggaaa

SEQ ID NO: 4747760 - DNA, 9 bp, Homo sapiens
gcccagccc

SEQ ID NO: 4747761 - DNA, 11 bp, Homo sapiens
gcccagcccct

SEQ ID NO: 4747762 - DNA, 12 bp, Homo sapiens
gcccagcccctt

SEQ ID NO: 4747763 - DNA, 16 bp, Homo sapiens
gcccagccccttctga

SEQ ID NO: 4747764 - DNA, 12 bp, Homo sapiens
gcccagctcccc

SEQ ID NO: 4747765 - DNA, 16 bp, Homo sapiens
gcccagctcccccggg

SEQ ID NO: 4747766 - DNA, 13 bp, Homo sapiens
gcccagctctgag

SEQ ID NO: 4747767 - DNA, 16 bp, Homo sapiens
gcccaggaaaggctcc

SEQ ID NO: 4747768 - DNA, 18 bp, Homo sapiens
gcccaggaaaggctccag

SEQ ID NO: 4747769 - DNA, 19 bp, Homo sapiens
gcccaggaaaggctccagg

SEQ ID NO: 4747770 - DNA, 20 bp, Homo sapiens
gcccaggaaaggctccagga

SEQ ID NO: 4747771 - DNA, 21 bp, Homo sapiens
gcccaggaaaggctccaggag

SEQ ID NO: 4747772 - DNA, 22 bp, Homo sapiens
gcccaggaaaggctccaggagc

SEQ ID NO: 4747773 - DNA, 13 bp, Homo sapiens
gcccaggacccca

SEQ ID NO: 4747774 - DNA, 19 bp, Homo sapiens
gcccaggacggggccggcc

SEQ ID NO: 4747775 - DNA, 11 bp, Homo sapiens
gcccaggagct

SEQ ID NO: 4747776 - DNA, 20 bp, Homo sapiens
gcccaggagctcccctcccc

SEQ ID NO: 4747777 - DNA, 13 bp, Homo sapiens
gcccaggcaggtc

SEQ ID NO: 4747778 - DNA, 14 bp, Homo sapiens
gcccaggcaggtct

SEQ ID NO: 4747779 - DNA, 16 bp, Homo sapiens
gcccaggcaggtcttg

SEQ ID NO: 4747780 - DNA, 23 bp, Homo sapiens
gcccaggccaggactctgcagcc

SEQ ID NO: 4747781 - DNA, 19 bp, Homo sapiens
gcccaggccatcttccagg

SEQ ID NO: 4747782 - DNA, 21 bp, Homo sapiens
gcccaggcccctgccaccctg

SEQ ID NO: 4747783 - DNA, 23 bp, Homo sapiens
gcccaggcccctgccaccctggg

SEQ ID NO: 4747784 - DNA, 11 bp, Homo sapiens
gcccaggctgg

SEQ ID NO: 4747785 - DNA, 13 bp, Homo sapiens
gcccaggctggcc

SEQ ID NO: 4747786 - DNA, 15 bp, Homo sapiens
gcccaggctggccag

SEQ ID NO: 4747787 - DNA, 17 bp, Homo sapiens
gcccaggctggccagcc

SEQ ID NO: 4747788 - DNA, 23 bp, Homo sapiens
gcccaggctggccagccccacag

SEQ ID NO: 4747789 - DNA, 20 bp, Homo sapiens
gcccaggctggcgtgcagtg

SEQ ID NO: 4747790 - DNA, 23 bp, Homo sapiens
gcccaggcttagtcactgagaca

SEQ ID NO: 4747791 - DNA, 17 bp, Homo sapiens
gcccaggtttctggtct

SEQ ID NO: 4747792 - DNA, 19 bp, Homo sapiens
gcccagtctggaatgcagt

SEQ ID NO: 4747793 - DNA, 22 bp, Homo sapiens
gcccagtctggaatgcagtggt

SEQ ID NO: 4747794 - DNA, 21 bp, Homo sapiens
gcccatcagtgtacccccgcc

SEQ ID NO: 4747795 - DNA, 19 bp, Homo sapiens
gcccatcgggaccagaaac

SEQ ID NO: 4747796 - DNA, 22 bp, Homo sapiens
gcccatcttccctggcgtcctc

SEQ ID NO: 4747797 - DNA, 13 bp, Homo sapiens
gcccatggaggag

SEQ ID NO: 4747798 - DNA, 22 bp, Homo sapiens
gcccatggaggagacaggaagc

SEQ ID NO: 4747799 - DNA, 15 bp, Homo sapiens
gcccatgggcactgc

SEQ ID NO: 4747800 - DNA, 21 bp, Homo sapiens
gcccatgggcactgctgggtg

SEQ ID NO: 4747801 - DNA, 16 bp, Homo sapiens
gcccattcattccatt

SEQ ID NO: 4747802 - DNA, 17 bp, Homo sapiens
gccccaacccccagcac

SEQ ID NO: 4747803 - DNA, 19 bp, Homo sapiens
gccccaacccccagcaccc

SEQ ID NO: 4747804 - DNA, 18 bp, Homo sapiens
gccccacagcccacgtcc

SEQ ID NO: 4747805 - DNA, 12 bp, Homo sapiens
gccccacccaga

SEQ ID NO: 4747806 - DNA, 17 bp, Homo sapiens
gccccaccccagggcag

SEQ ID NO: 4747807 - DNA, 12 bp, Homo sapiens
gccccagcctgg

SEQ ID NO: 4747808 - DNA, 19 bp, Homo sapiens
gccccagcctggcccagct

SEQ ID NO: 4747809 - DNA, 17 bp, Homo sapiens
gccccagtgcccacagg

SEQ ID NO: 4747810 - DNA, 19 bp, Homo sapiens
gccccatcaggactcttgt

SEQ ID NO: 4747811 - DNA, 14 bp, Homo sapiens
gccccatcagtgct

SEQ ID NO: 4747812 - DNA, 23 bp, Homo sapiens
gccccatccaccgccagcttccc

SEQ ID NO: 4747813 - DNA, 13 bp, Homo sapiens
gccccatgagaca

SEQ ID NO: 4747814 - DNA, 13 bp, Homo sapiens
gcccccaggactg

SEQ ID NO: 4747815 - DNA, 14 bp, Homo sapiens
gcccccaggactgg

SEQ ID NO: 4747816 - DNA, 16 bp, Homo sapiens
gcccccaggactgggc

SEQ ID NO: 4747817 - DNA, 20 bp, Homo sapiens
gccccccatcctggcccatc

SEQ ID NO: 4747818 - DNA, 12 bp, Homo sapiens
gcccccctggcc

SEQ ID NO: 4747819 - DNA, 16 bp, Homo sapiens
gccccctctgccctgc

SEQ ID NO: 4747820 - DNA, 11 bp, Homo sapiens
gccccctgcag

SEQ ID NO: 4747821 - DNA, 21 bp, Homo sapiens
gccccctgcaggaaggagctg

SEQ ID NO: 4747822 - DNA, 23 bp, Homo sapiens
gccccctgcaggaaggagctgcc

SEQ ID NO: 4747823 - DNA, 15 bp, Homo sapiens
gccccgaggccttct

SEQ ID NO: 4747824 - DNA, 18 bp, Homo sapiens
gccccgaggccttctctg

SEQ ID NO: 4747825 - DNA, 21 bp, Homo sapiens
gccccgtccccctctggctcc

SEQ ID NO: 4747826 - DNA, 22 bp, Homo sapiens
gcccctagcttagagcctccct

SEQ ID NO: 4747827 - DNA, 18 bp, Homo sapiens
gcccctcagggtccctgg

SEQ ID NO: 4747828 - DNA, 18 bp, Homo sapiens
gcccctcccacagcgctg

SEQ ID NO: 4747829 - DNA, 19 bp, Homo sapiens
gcccctcctctctgcccta

SEQ ID NO: 4747830 - DNA, 11 bp, Homo sapiens
gcccctctcct

SEQ ID NO: 4747831 - DNA, 14 bp, Homo sapiens
gcccctctcctccg

SEQ ID NO: 4747832 - DNA, 13 bp, Homo sapiens
gcccctgccaccc

SEQ ID NO: 4747833 - DNA, 13 bp, Homo sapiens
gcccctgcccggc

SEQ ID NO: 4747834 - DNA, 14 bp, Homo sapiens
gcccctgcccggct

SEQ ID NO: 4747835 - DNA, 15 bp, Homo sapiens
gcccctgcccggctg

SEQ ID NO: 4747836 - DNA, 21 bp, Homo sapiens
gcccctgctggttcagggttg

SEQ ID NO: 4747837 - DNA, 18 bp, Homo sapiens
gcccctggatgcagcctc

SEQ ID NO: 4747838 - DNA, 18 bp, Homo sapiens
gcccgcttgcctcggctc

SEQ ID NO: 4747839 - DNA, 18 bp, Homo sapiens
gcccggcgccctctgtcc

SEQ ID NO: 4747840 - DNA, 13 bp, Homo sapiens
gcccggctccagg

SEQ ID NO: 4747841 - DNA, 13 bp, Homo sapiens
gcccgggctctgc

SEQ ID NO: 4747842 - DNA, 14 bp, Homo sapiens
gcccgggctctgcc

SEQ ID NO: 4747843 - DNA, 15 bp, Homo sapiens
gcccgggctctgcct

SEQ ID NO: 4747844 - DNA, 18 bp, Homo sapiens
gcccgggctctgcctccc

SEQ ID NO: 4747845 - DNA, 16 bp, Homo sapiens
gcccgttgtctccctg

SEQ ID NO: 4747846 - DNA, 19 bp, Homo sapiens
gcccgttgtctccctggcc

SEQ ID NO: 4747847 - DNA, 21 bp, Homo sapiens
gcccgttgtctccctggccct

SEQ ID NO: 4747848 - DNA, 22 bp, Homo sapiens
gcccgttgtctccctggccctc

SEQ ID NO: 4747849 - DNA, 19 bp, Homo sapiens
gccctaatgcgcaggctgg

SEQ ID NO: 4747850 - DNA, 16 bp, Homo sapiens
gccctcaaggcctccc

SEQ ID NO: 4747851 - DNA, 16 bp, Homo sapiens
gccctcaccctggggc

SEQ ID NO: 4747852 - DNA, 15 bp, Homo sapiens
gccctccacacctgc

SEQ ID NO: 4747853 - DNA, 18 bp, Homo sapiens
gccctccacacctgcggc

SEQ ID NO: 4747854 - DNA, 12 bp, Homo sapiens
gccctcccagca

SEQ ID NO: 4747855 - DNA, 17 bp, Homo sapiens
gccctccttaccactgt

SEQ ID NO: 4747856 - DNA, 17 bp, Homo sapiens
gccctcgctgccagctc

SEQ ID NO: 4747857 - DNA, 16 bp, Homo sapiens
gccctctcccctgccc

SEQ ID NO: 4747858 - DNA, 23 bp, Homo sapiens
gccctctcccctgccccctgcag

SEQ ID NO: 4747859 - DNA, 16 bp, Homo sapiens
gccctctgcccactcc

SEQ ID NO: 4747860 - DNA, 18 bp, Homo sapiens
gccctctgcccactccct

SEQ ID NO: 4747861 - DNA, 19 bp, Homo sapiens
gccctctgcccactccctg

SEQ ID NO: 4747862 - DNA, 21 bp, Homo sapiens
gccctgattaaaaaatctccc

SEQ ID NO: 4747863 - DNA, 18 bp, Homo sapiens
gccctgcaaaaggactct

SEQ ID NO: 4747864 - DNA, 16 bp, Homo sapiens
gccctgcactgtcctg

SEQ ID NO: 4747865 - DNA, 21 bp, Homo sapiens
gccctgcactgtcctgctcca

SEQ ID NO: 4747866 - DNA, 20 bp, Homo sapiens
gccctgcccacctggcctct

SEQ ID NO: 4747867 - DNA, 22 bp, Homo sapiens
gccctgcctcctttgtgaggaa

SEQ ID NO: 4747868 - DNA, 21 bp, Homo sapiens
gccctgctgagtcccaggctg

SEQ ID NO: 4747869 - DNA, 22 bp, Homo sapiens
gccctgctgagtcccaggctga

SEQ ID NO: 4747870 - DNA, 21 bp, Homo sapiens
gccctgctgcccctccctgcc

SEQ ID NO: 4747871 - DNA, 19 bp, Homo sapiens
gccctggagtcatgccaag

SEQ ID NO: 4747872 - DNA, 16 bp, Homo sapiens
gccctggctgaaggac

SEQ ID NO: 4747873 - DNA, 21 bp, Homo sapiens
gccctggctgaaggactgtga

SEQ ID NO: 4747874 - DNA, 18 bp, Homo sapiens
gccctggtggcagtggga

SEQ ID NO: 4747875 - DNA, 18 bp, Homo sapiens
gccctggtggccctctcc

SEQ ID NO: 4747876 - DNA, 17 bp, Homo sapiens
gccctggtttcctgccc

SEQ ID NO: 4747877 - DNA, 19 bp, Homo sapiens
gccctggtttcctgccctg

SEQ ID NO: 4747878 - DNA, 20 bp, Homo sapiens
gccctggtttcctgccctgg

SEQ ID NO: 4747879 - DNA, 16 bp, Homo sapiens
gccctggtttgttttc

SEQ ID NO: 4747880 - DNA, 14 bp, Homo sapiens
gccctgtttggcat

SEQ ID NO: 4747881 - DNA, 16 bp, Homo sapiens
gcccttctctccagcc

SEQ ID NO: 4747882 - DNA, 19 bp, Homo sapiens
gcccttctctccagcccct

SEQ ID NO: 4747883 - DNA, 17 bp, Homo sapiens
gcccttgctccagcctg

SEQ ID NO: 4747884 - DNA, 22 bp, Homo sapiens
gcccttgctccagcctgacaac

SEQ ID NO: 4747885 - DNA, 20 bp, Homo sapiens
gcccttgggggtcctcctcc

SEQ ID NO: 4747886 - DNA, 22 bp, Homo sapiens
gcccttgggggtcctcctccag

SEQ ID NO: 4747887 - DNA, 11 bp, Homo sapiens
gccctttccat

SEQ ID NO: 4747888 - DNA, 22 bp, Homo sapiens
gccgagatcacaccactgtact

SEQ ID NO: 4747889 - DNA, 16 bp, Homo sapiens
gccgagatcacgccac

SEQ ID NO: 4747890 - DNA, 21 bp, Homo sapiens
gccgagatcacgccactgcac

SEQ ID NO: 4747891 - DNA, 15 bp, Homo sapiens
gccgccccacccaga

SEQ ID NO: 4747892 - DNA, 16 bp, Homo sapiens
gccgccgcctcgccca

SEQ ID NO: 4747893 - DNA, 16 bp, Homo sapiens
gccgcctcgcccaccg

SEQ ID NO: 4747894 - DNA, 17 bp, Homo sapiens
gccgctgagcgaggaga

SEQ ID NO: 4747895 - DNA, 14 bp, Homo sapiens
gccgtaatttaact

SEQ ID NO: 4747896 - DNA, 23 bp, Homo sapiens
gccgtcctaacctcgggcctgct

SEQ ID NO: 4747897 - DNA, 16 bp, Homo sapiens
gccgtctacctgaggg

SEQ ID NO: 4747898 - DNA, 16 bp, Homo sapiens
gccgtggtcctttggg

SEQ ID NO: 4747899 - DNA, 19 bp, Homo sapiens
gccgttgatgttggctggg

SEQ ID NO: 4747900 - DNA, 16 bp, Homo sapiens
gcctacaggagtgagc

SEQ ID NO: 4747901 - DNA, 12 bp, Homo sapiens
gcctaccttgtg

SEQ ID NO: 4747902 - DNA, 13 bp, Homo sapiens
gcctatcagtgtg

SEQ ID NO: 4747903 - DNA, 18 bp, Homo sapiens
gcctatcagtgtgccccc

SEQ ID NO: 4747904 - DNA, 14 bp, Homo sapiens
gcctcaacctcctg

SEQ ID NO: 4747905 - DNA, 19 bp, Homo sapiens
gcctcaagtgattctcctg

SEQ ID NO: 4747906 - DNA, 17 bp, Homo sapiens
gcctcaataagccttgt

SEQ ID NO: 4747907 - DNA, 18 bp, Homo sapiens
gcctcaataagccttgtc

SEQ ID NO: 4747908 - DNA, 22 bp, Homo sapiens
gcctcagcctcccaaagtgctg

SEQ ID NO: 4747909 - DNA, 23 bp, Homo sapiens
gcctcagcctcccaaagtgctgg

SEQ ID NO: 4747910 - DNA, 22 bp, Homo sapiens
gcctcagtaagtatctggagga

SEQ ID NO: 4747911 - DNA, 12 bp, Homo sapiens
gcctcagtgcca

SEQ ID NO: 4747912 - DNA, 14 bp, Homo sapiens
gcctcagtgccact

SEQ ID NO: 4747913 - DNA, 13 bp, Homo sapiens
gcctcatgctctg

SEQ ID NO: 4747914 - DNA, 14 bp, Homo sapiens
gcctcatgctctga

SEQ ID NO: 4747915 - DNA, 16 bp, Homo sapiens
gcctccaagtcaggtg

SEQ ID NO: 4747916 - DNA, 19 bp, Homo sapiens
gcctccaagtcaggtgggg

SEQ ID NO: 4747917 - DNA, 22 bp, Homo sapiens
gcctccacccacagtggagagg

SEQ ID NO: 4747918 - DNA, 18 bp, Homo sapiens
gcctccactcccacttcc

SEQ ID NO: 4747919 - DNA, 14 bp, Homo sapiens
gcctccagggctgg

SEQ ID NO: 4747920 - DNA, 19 bp, Homo sapiens
gcctcccaaagtgctggga

SEQ ID NO: 4747921 - DNA, 13 bp, Homo sapiens
gcctcccaactca

SEQ ID NO: 4747922 - DNA, 22 bp, Homo sapiens
gcctcccaactcaccccagccc

SEQ ID NO: 4747923 - DNA, 13 bp, Homo sapiens
gcctcccacagtg

SEQ ID NO: 4747924 - DNA, 23 bp, Homo sapiens
gcctcccacagtgactcgggctc

SEQ ID NO: 4747925 - DNA, 14 bp, Homo sapiens
gcctcccatcaccc

SEQ ID NO: 4747926 - DNA, 17 bp, Homo sapiens
gcctcccatcacccgct

SEQ ID NO: 4747927 - DNA, 15 bp, Homo sapiens
gcctcccgagtagct

SEQ ID NO: 4747928 - DNA, 18 bp, Homo sapiens
gcctcccgagtagctggg

SEQ ID NO: 4747929 - DNA, 20 bp, Homo sapiens
gcctcccgagtagctgggac

SEQ ID NO: 4747930 - DNA, 21 bp, Homo sapiens
gcctcccgagtagctgggact

SEQ ID NO: 4747931 - DNA, 23 bp, Homo sapiens
gcctcccttcatgcatggaaatt

SEQ ID NO: 4747932 - DNA, 19 bp, Homo sapiens
gcctcctgagtagctggga

SEQ ID NO: 4747933 - DNA, 19 bp, Homo sapiens
gcctcctttgtgaggaagc

SEQ ID NO: 4747934 - DNA, 13 bp, Homo sapiens
gcctcgcctggcc

SEQ ID NO: 4747935 - DNA, 14 bp, Homo sapiens
gcctcgcctggcct

SEQ ID NO: 4747936 - DNA, 15 bp, Homo sapiens
gcctcgcctggcctg

SEQ ID NO: 4747937 - DNA, 13 bp, Homo sapiens
gcctcggacttag

SEQ ID NO: 4747938 - DNA, 18 bp, Homo sapiens
gcctctagggacccctcc

SEQ ID NO: 4747939 - DNA, 19 bp, Homo sapiens
gcctctagggacccctcct

SEQ ID NO: 4747940 - DNA, 23 bp, Homo sapiens
gcctctagggacccctcctccct

SEQ ID NO: 4747941 - DNA, 16 bp, Homo sapiens
gcctctgacacacagc

SEQ ID NO: 4747942 - DNA, 19 bp, Homo sapiens
gcctctgacacacagctct

SEQ ID NO: 4747943 - DNA, 16 bp, Homo sapiens
gcctctgcactcccct

SEQ ID NO: 4747944 - DNA, 18 bp, Homo sapiens
gcctctgcactcccctgc

SEQ ID NO: 4747945 - DNA, 18 bp, Homo sapiens
gcctctgtccccttctct

SEQ ID NO: 4747946 - DNA, 21 bp, Homo sapiens
gcctctgtccccttctctcat

SEQ ID NO: 4747947 - DNA, 12 bp, Homo sapiens
gcctctgtgtca

SEQ ID NO: 4747948 - DNA, 19 bp, Homo sapiens
gcctctgtgtcactggctg

SEQ ID NO: 4747949 - DNA, 20 bp, Homo sapiens
gcctctgtgtcactggctgc

SEQ ID NO: 4747950 - DNA, 14 bp, Homo sapiens
gcctcttctgggag

SEQ ID NO: 4747951 - DNA, 15 bp, Homo sapiens
gcctcttctgggagg

SEQ ID NO: 4747952 - DNA, 16 bp, Homo sapiens
gcctcttttcacattt

SEQ ID NO: 4747953 - DNA, 16 bp, Homo sapiens
gcctgaagtcacacag

SEQ ID NO: 4747954 - DNA, 22 bp, Homo sapiens
gcctgaagtcacacagtgagtc

SEQ ID NO: 4747955 - DNA, 17 bp, Homo sapiens
gcctgacaacagcctga

SEQ ID NO: 4747956 - DNA, 22 bp, Homo sapiens
gcctgacatttggagtgttccc

SEQ ID NO: 4747957 - DNA, 18 bp, Homo sapiens
gcctgagatttcatctgc

SEQ ID NO: 4747958 - DNA, 14 bp, Homo sapiens
gcctgagcccctca

SEQ ID NO: 4747959 - DNA, 13 bp, Homo sapiens
gcctgccacctgg

SEQ ID NO: 4747960 - DNA, 15 bp, Homo sapiens
gcctgccacctggac

SEQ ID NO: 4747961 - DNA, 17 bp, Homo sapiens
gcctgccacctggaccc

SEQ ID NO: 4747962 - DNA, 18 bp, Homo sapiens
gcctgccacctggacccc

SEQ ID NO: 4747963 - DNA, 11 bp, Homo sapiens
gcctgcccagg

SEQ ID NO: 4747964 - DNA, 12 bp, Homo sapiens
gcctgcccaggc

SEQ ID NO: 4747965 - DNA, 18 bp, Homo sapiens
gcctgcccaggcccctgc

SEQ ID NO: 4747966 - DNA, 22 bp, Homo sapiens
gcctgcccaggcccctgccacc

SEQ ID NO: 4747967 - DNA, 15 bp, Homo sapiens
gcctgcgtgtgtctg

SEQ ID NO: 4747968 - DNA, 22 bp, Homo sapiens
gcctgcttaaaaggtataatta

SEQ ID NO: 4747969 - DNA, 13 bp, Homo sapiens
gcctggaagacag

SEQ ID NO: 4747970 - DNA, 22 bp, Homo sapiens
gcctggaagacagagacctcct

SEQ ID NO: 4747971 - DNA, 15 bp, Homo sapiens
gcctggatggggctg

SEQ ID NO: 4747972 - DNA, 13 bp, Homo sapiens
gcctggccacgcc

SEQ ID NO: 4747973 - DNA, 15 bp, Homo sapiens
gcctggccagatgca

SEQ ID NO: 4747974 - DNA, 16 bp, Homo sapiens
gcctggccagatgcac

SEQ ID NO: 4747975 - DNA, 14 bp, Homo sapiens
gcctggccatgtgg

SEQ ID NO: 4747976 - DNA, 12 bp, Homo sapiens
gcctggcccagc

SEQ ID NO: 4747977 - DNA, 14 bp, Homo sapiens
gcctggcccctcag

SEQ ID NO: 4747978 - DNA, 15 bp, Homo sapiens
gcctggcccctcagg

SEQ ID NO: 4747979 - DNA, 13 bp, Homo sapiens
gcctggcctgagc

SEQ ID NO: 4747980 - DNA, 18 bp, Homo sapiens
gcctggcctgagctggga

SEQ ID NO: 4747981 - DNA, 13 bp, Homo sapiens
gcctgggccagag

SEQ ID NO: 4747982 - DNA, 21 bp, Homo sapiens
gcctgggggtgccaggaccag

SEQ ID NO: 4747983 - DNA, 13 bp, Homo sapiens
gcctgggtgacag

SEQ ID NO: 4747984 - DNA, 20 bp, Homo sapiens
gcctgggtgacagagtgaga

SEQ ID NO: 4747985 - DNA, 14 bp, Homo sapiens
gcctggtggcagct

SEQ ID NO: 4747986 - DNA, 17 bp, Homo sapiens
gcctggtggcagctgcg

SEQ ID NO: 4747987 - DNA, 19 bp, Homo sapiens
gcctggtggcagctgcggt

SEQ ID NO: 4747988 - DNA, 14 bp, Homo sapiens
gcctgtcaagaggc

SEQ ID NO: 4747989 - DNA, 16 bp, Homo sapiens
gcctgttcagctccag

SEQ ID NO: 4747990 - DNA, 19 bp, Homo sapiens
gcctgttcagctccagctc

SEQ ID NO: 4747991 - DNA, 20 bp, Homo sapiens
gccttagaagtcacacagta

SEQ ID NO: 4747992 - DNA, 18 bp, Homo sapiens
gccttatgagaacatggt

SEQ ID NO: 4747993 - DNA, 22 bp, Homo sapiens
gccttcaagaaaacaggcactg

SEQ ID NO: 4747994 - DNA, 13 bp, Homo sapiens
gccttcagggagt

SEQ ID NO: 4747995 - DNA, 15 bp, Homo sapiens
gccttccaggggtgg

SEQ ID NO: 4747996 - DNA, 16 bp, Homo sapiens
gccttccaggggtggg

SEQ ID NO: 4747997 - DNA, 21 bp, Homo sapiens
gccttccaggggtgggacacc

SEQ ID NO: 4747998 - DNA, 13 bp, Homo sapiens
gccttcctcctgg

SEQ ID NO: 4747999 - DNA, 16 bp, Homo sapiens
gccttcttgccagcca

SEQ ID NO: 4748000 - DNA, 17 bp, Homo sapiens
gccttgaccattctcca

SEQ ID NO: 4748001 - DNA, 19 bp, Homo sapiens
gccttgaccattctccacc

SEQ ID NO: 4748002 - DNA, 20 bp, Homo sapiens
gccttgaccattctccacct

SEQ ID NO: 4748003 - DNA, 22 bp, Homo sapiens
gccttggggcatgacccagtga

SEQ ID NO: 4748004 - DNA, 19 bp, Homo sapiens
gccttgggtttctgtgcag

SEQ ID NO: 4748005 - DNA, 15 bp, Homo sapiens
gccttgtttaatggt

SEQ ID NO: 4748006 - DNA, 19 bp, Homo sapiens
gcctttgagacagtttctt

SEQ ID NO: 4748007 - DNA, 20 bp, Homo sapiens
gcctttgagacagtttctta

SEQ ID NO: 4748008 - DNA, 15 bp, Homo sapiens
gcgaccccatctgcc

SEQ ID NO: 4748009 - DNA, 20 bp, Homo sapiens
gcgacgcacctcgagggtgt

SEQ ID NO: 4748010 - DNA, 22 bp, Homo sapiens
gcgagaccccctgtcctgtgct

SEQ ID NO: 4748011 - DNA, 13 bp, Homo sapiens
gcgagagatgtgt

SEQ ID NO: 4748012 - DNA, 22 bp, Homo sapiens
gcgagagatgtgtgttgatact

SEQ ID NO: 4748013 - DNA, 15 bp, Homo sapiens
gcgagccctggtggc

SEQ ID NO: 4748014 - DNA, 17 bp, Homo sapiens
gcgaggaggctccagag

SEQ ID NO: 4748015 - DNA, 22 bp, Homo sapiens
gcgatctgggttcactgcaacc

SEQ ID NO: 4748016 - DNA, 13 bp, Homo sapiens
gcgattcttctgc

SEQ ID NO: 4748017 - DNA, 15 bp, Homo sapiens
gcgcaccctcccctc

SEQ ID NO: 4748018 - DNA, 17 bp, Homo sapiens
gcgcaccctcccctccc

SEQ ID NO: 4748019 - DNA, 20 bp, Homo sapiens
gcgcagcatattcaggaagc

SEQ ID NO: 4748020 - DNA, 16 bp, Homo sapiens
gcgcaggctggccctg

SEQ ID NO: 4748021 - DNA, 19 bp, Homo sapiens
gcgcaggctggccctgccc

SEQ ID NO: 4748022 - DNA, 20 bp, Homo sapiens
gcgcaggctggccctgccct

SEQ ID NO: 4748023 - DNA, 22 bp, Homo sapiens
gcgcaggctggccctgccctgg

SEQ ID NO: 4748024 - DNA, 15 bp, Homo sapiens
gcgcctacaggagtg

SEQ ID NO: 4748025 - DNA, 21 bp, Homo sapiens
gcgcggggaggccggcgcagc

SEQ ID NO: 4748026 - DNA, 23 bp, Homo sapiens
gcgctgcagcagggcaggaaggg

SEQ ID NO: 4748027 - DNA, 11 bp, Homo sapiens
gcggacagcca

SEQ ID NO: 4748028 - DNA, 23 bp, Homo sapiens
gcggacagccacggccaggccag

SEQ ID NO: 4748029 - DNA, 13 bp, Homo sapiens
gcggctggatggg

SEQ ID NO: 4748030 - DNA, 20 bp, Homo sapiens
gcggctggatgggggctctg

SEQ ID NO: 4748031 - DNA, 22 bp, Homo sapiens
gcggctggatgggggctctgca

SEQ ID NO: 4748032 - DNA, 23 bp, Homo sapiens
gcggctggatgggggctctgcac

SEQ ID NO: 4748033 - DNA, 21 bp, Homo sapiens
gcgggaggatgttctgggaca

SEQ ID NO: 4748034 - DNA, 15 bp, Homo sapiens
gcggggacagctcct

SEQ ID NO: 4748035 - DNA, 13 bp, Homo sapiens
gcgggtcacagga

SEQ ID NO: 4748036 - DNA, 15 bp, Homo sapiens
gcgggtcacaggagg

SEQ ID NO: 4748037 - DNA, 19 bp, Homo sapiens
gcgggtggatcacaaggtc

SEQ ID NO: 4748038 - DNA, 15 bp, Homo sapiens
gcgtcctctccctcc

SEQ ID NO: 4748039 - DNA, 20 bp, Homo sapiens
gcgtcctctccctcctggcc

SEQ ID NO: 4748040 - DNA, 15 bp, Homo sapiens
gcgtgagacctgccc

SEQ ID NO: 4748041 - DNA, 16 bp, Homo sapiens
gcgtgagacctgcccc

SEQ ID NO: 4748042 - DNA, 15 bp, Homo sapiens
gcgtgagccactgca

SEQ ID NO: 4748043 - DNA, 18 bp, Homo sapiens
gcgtgagccactgcaccg

SEQ ID NO: 4748044 - DNA, 13 bp, Homo sapiens
gcgtgattctgtt

SEQ ID NO: 4748045 - DNA, 15 bp, Homo sapiens
gcgtgtgtagagtta

SEQ ID NO: 4748046 - DNA, 17 bp, Homo sapiens
gcgttccatgatgctgg

SEQ ID NO: 4748047 - DNA, 11 bp, Homo sapiens
gctaacattta

SEQ ID NO: 4748048 - DNA, 21 bp, Homo sapiens
gctaagagggagggagggctc

SEQ ID NO: 4748049 - DNA, 23 bp, Homo sapiens
gctaagagggagggagggctcca

SEQ ID NO: 4748050 - DNA, 17 bp, Homo sapiens
gctaaggcgtggagctg

SEQ ID NO: 4748051 - DNA, 22 bp, Homo sapiens
gctaaggcgtggagctgcctga

SEQ ID NO: 4748052 - DNA, 16 bp, Homo sapiens
gctaccctccctgctg

SEQ ID NO: 4748053 - DNA, 17 bp, Homo sapiens
gctaccctccctgctgt

SEQ ID NO: 4748054 - DNA, 16 bp, Homo sapiens
gctaccctgagctgag

SEQ ID NO: 4748055 - DNA, 20 bp, Homo sapiens
gctaccctgagctgaggcag

SEQ ID NO: 4748056 - DNA, 15 bp, Homo sapiens
gctacttaacttggt

SEQ ID NO: 4748057 - DNA, 18 bp, Homo sapiens
gctacttgggccatagct

SEQ ID NO: 4748058 - DNA, 14 bp, Homo sapiens
gctactttccattt

SEQ ID NO: 4748059 - DNA, 15 bp, Homo sapiens
gctagaacctggaga

SEQ ID NO: 4748060 - DNA, 22 bp, Homo sapiens
gctaggaaatccagggtggtgg

SEQ ID NO: 4748061 - DNA, 21 bp, Homo sapiens
gctaggaacactccttcacag

SEQ ID NO: 4748062 - DNA, 20 bp, Homo sapiens
gctaggacccctccatgtgg

SEQ ID NO: 4748063 - DNA, 22 bp, Homo sapiens
gctaggacccctccatgtgggc

SEQ ID NO: 4748064 - DNA, 15 bp, Homo sapiens
gctaggcctggccag

SEQ ID NO: 4748065 - DNA, 16 bp, Homo sapiens
gctaggcctggccaga

SEQ ID NO: 4748066 - DNA, 17 bp, Homo sapiens
gctaggcctggccagat

SEQ ID NO: 4748067 - DNA, 22 bp, Homo sapiens
gctagtgtggtgtttcctggca

SEQ ID NO: 4748068 - DNA, 16 bp, Homo sapiens
gctatcaaaagaaata

SEQ ID NO: 4748069 - DNA, 12 bp, Homo sapiens
gctatccaccaa

SEQ ID NO: 4748070 - DNA, 22 bp, Homo sapiens
gctatctcccccagccccatcc

SEQ ID NO: 4748071 - DNA, 21 bp, Homo sapiens
gctattagccaggatcatggt

SEQ ID NO: 4748072 - DNA, 16 bp, Homo sapiens
gctattgtcaccaggg

SEQ ID NO: 4748073 - DNA, 21 bp, Homo sapiens
gctattgtcaccagggctgga

SEQ ID NO: 4748074 - DNA, 15 bp, Homo sapiens
gctatttaattcttt

SEQ ID NO: 4748075 - DNA, 22 bp, Homo sapiens
gctatttttatttgtttgtgca

SEQ ID NO: 4748076 - DNA, 16 bp, Homo sapiens
gctcaatccctgagga

SEQ ID NO: 4748077 - DNA, 13 bp, Homo sapiens
gctcaccagcccc

SEQ ID NO: 4748078 - DNA, 18 bp, Homo sapiens
gctcaccagccccagtgc

SEQ ID NO: 4748079 - DNA, 16 bp, Homo sapiens
gctcacccccttctcc

SEQ ID NO: 4748080 - DNA, 11 bp, Homo sapiens
gctcactgcag

SEQ ID NO: 4748081 - DNA, 18 bp, Homo sapiens
gctcagagagggcaggca

SEQ ID NO: 4748082 - DNA, 20 bp, Homo sapiens
gctcagccccaccccagggc

SEQ ID NO: 4748083 - DNA, 15 bp, Homo sapiens
gctcagcggggacag

SEQ ID NO: 4748084 - DNA, 20 bp, Homo sapiens
gctcagcggggacagctcct

SEQ ID NO: 4748085 - DNA, 21 bp, Homo sapiens
gctcagcggggacagctcctt

SEQ ID NO: 4748086 - DNA, 16 bp, Homo sapiens
gctcagggcctggctc

SEQ ID NO: 4748087 - DNA, 18 bp, Homo sapiens
gctcagggcctggctcag

SEQ ID NO: 4748088 - DNA, 21 bp, Homo sapiens
gctcaggtggggtcactctgg

SEQ ID NO: 4748089 - DNA, 22 bp, Homo sapiens
gctcaggtggggtcactctggc

SEQ ID NO: 4748090 - DNA, 23 bp, Homo sapiens
gctcaggtggggtcactctggca

SEQ ID NO: 4748091 - DNA, 20 bp, Homo sapiens
gctcatcattctctgtctca

SEQ ID NO: 4748092 - DNA, 17 bp, Homo sapiens
gctccaaaccctcgagg

SEQ ID NO: 4748093 - DNA, 16 bp, Homo sapiens
gctccaagctcccagg

SEQ ID NO: 4748094 - DNA, 17 bp, Homo sapiens
gctccaagctcccaggc

SEQ ID NO: 4748095 - DNA, 23 bp, Homo sapiens
gctccagacacatgtccaagaag

SEQ ID NO: 4748096 - DNA, 13 bp, Homo sapiens
gctccagcctgac

SEQ ID NO: 4748097 - DNA, 22 bp, Homo sapiens
gctccagcctgacaacagcctg

SEQ ID NO: 4748098 - DNA, 17 bp, Homo sapiens
gctccagctcaccagcc

SEQ ID NO: 4748099 - DNA, 21 bp, Homo sapiens
gctccagctcaccagccccag

SEQ ID NO: 4748100 - DNA, 14 bp, Homo sapiens
gctccaggagcagc

SEQ ID NO: 4748101 - DNA, 15 bp, Homo sapiens
gctccaggagcagcc

SEQ ID NO: 4748102 - DNA, 18 bp, Homo sapiens
gctccaggagcagccaca

SEQ ID NO: 4748103 - DNA, 11 bp, Homo sapiens
gctcccaaggg

SEQ ID NO: 4748104 - DNA, 20 bp, Homo sapiens
gctcccaggcattccccagg

SEQ ID NO: 4748105 - DNA, 18 bp, Homo sapiens
gctcccagtgtcttcctg

SEQ ID NO: 4748106 - DNA, 20 bp, Homo sapiens
gctcccagtgtcttcctgtg

SEQ ID NO: 4748107 - DNA, 12 bp, Homo sapiens
gctcccctccaa

SEQ ID NO: 4748108 - DNA, 18 bp, Homo sapiens
gctcccttccacctgtca

SEQ ID NO: 4748109 - DNA, 19 bp, Homo sapiens
gctcccttcccacctctct

SEQ ID NO: 4748110 - DNA, 20 bp, Homo sapiens
gctcccttcccacctctctc

SEQ ID NO: 4748111 - DNA, 21 bp, Homo sapiens
gctccgctttctacccagcga

SEQ ID NO: 4748112 - DNA, 23 bp, Homo sapiens
gctccgctttctacccagcgagc

SEQ ID NO: 4748113 - DNA, 24 bp, Homo sapiens
gctccgctttctacccagcgagcc

SEQ ID NO: 4748114 - DNA, 18 bp, Homo sapiens
gctcctcatccagggctc

SEQ ID NO: 4748115 - DNA, 18 bp, Homo sapiens
gctcctgccaccacgccc

SEQ ID NO: 4748116 - DNA, 21 bp, Homo sapiens
gctcctgccaccacgcccggc

SEQ ID NO: 4748117 - DNA, 17 bp, Homo sapiens
gctcctgccgcagagct

SEQ ID NO: 4748118 - DNA, 19 bp, Homo sapiens
gctcctgccgcagagctgg

SEQ ID NO: 4748119 - DNA, 13 bp, Homo sapiens
gctccttctgtcc

SEQ ID NO: 4748120 - DNA, 20 bp, Homo sapiens
gctccttgtcaatactgagc

SEQ ID NO: 4748121 - DNA, 22 bp, Homo sapiens
gctccttgtcaatactgagcca

SEQ ID NO: 4748122 - DNA, 16 bp, Homo sapiens
gctcgagcatgcctgg

SEQ ID NO: 4748123 - DNA, 12 bp, Homo sapiens
gctcgggcccag

SEQ ID NO: 4748124 - DNA, 14 bp, Homo sapiens
gctcgggcccaggc

SEQ ID NO: 4748125 - DNA, 15 bp, Homo sapiens
gctctacacaacatg

SEQ ID NO: 4748126 - DNA, 19 bp, Homo sapiens
gctctaggtacgatgacag

SEQ ID NO: 4748127 - DNA, 12 bp, Homo sapiens
gctctatctgca

SEQ ID NO: 4748128 - DNA, 18 bp, Homo sapiens
gctctatgggcagatcta

SEQ ID NO: 4748129 - DNA, 19 bp, Homo sapiens
gctctcaacccaggagcat

SEQ ID NO: 4748130 - DNA, 22 bp, Homo sapiens
gctctccttcctggagcccaga

SEQ ID NO: 4748131 - DNA, 20 bp, Homo sapiens
gctctctaattccacttgtt

SEQ ID NO: 4748132 - DNA, 15 bp, Homo sapiens
gctctgacccacagc

SEQ ID NO: 4748133 - DNA, 17 bp, Homo sapiens
gctctgacccacagcct

SEQ ID NO: 4748134 - DNA, 13 bp, Homo sapiens
gctctgagctgtc

SEQ ID NO: 4748135 - DNA, 16 bp, Homo sapiens
gctctgcaccttctga

SEQ ID NO: 4748136 - DNA, 11 bp, Homo sapiens
gctctgccctt

SEQ ID NO: 4748137 - DNA, 13 bp, Homo sapiens
gctctgcctccca

SEQ ID NO: 4748138 - DNA, 15 bp, Homo sapiens
gctctgcctcccatc

SEQ ID NO: 4748139 - DNA, 22 bp, Homo sapiens
gctctgcgtgtcacctgtgctt

SEQ ID NO: 4748140 - DNA, 13 bp, Homo sapiens
gctctgctgacag

SEQ ID NO: 4748141 - DNA, 20 bp, Homo sapiens
gctctgctgacagacacagg

SEQ ID NO: 4748142 - DNA, 15 bp, Homo sapiens
gctctggacaggcat

SEQ ID NO: 4748143 - DNA, 22 bp, Homo sapiens
gctctggacaggcatgttctct

SEQ ID NO: 4748144 - DNA, 15 bp, Homo sapiens
gctctggtccataga

SEQ ID NO: 4748145 - DNA, 16 bp, Homo sapiens
gctctgtcctgggagt

SEQ ID NO: 4748146 - DNA, 19 bp, Homo sapiens
gctctgtcgcccaggctgg

SEQ ID NO: 4748147 - DNA, 23 bp, Homo sapiens
gctctgtcgcccaggctggagtg

SEQ ID NO: 4748148 - DNA, 17 bp, Homo sapiens
gctcttcataattctaa

SEQ ID NO: 4748149 - DNA, 15 bp, Homo sapiens
gctcttccaggctgg

SEQ ID NO: 4748150 - DNA, 18 bp, Homo sapiens
gctcttccaggctgggag

SEQ ID NO: 4748151 - DNA, 12 bp, Homo sapiens
gctcttctccag

SEQ ID NO: 4748152 - DNA, 14 bp, Homo sapiens
gctcttcttctttc

SEQ ID NO: 4748153 - DNA, 22 bp, Homo sapiens
gctcttgtgaatattgtggctc

SEQ ID NO: 4748154 - DNA, 13 bp, Homo sapiens
gctgaaggactgt

SEQ ID NO: 4748155 - DNA, 21 bp, Homo sapiens
gctgaaggactgtgacaggca

SEQ ID NO: 4748156 - DNA, 20 bp, Homo sapiens
gctgaaggctcgagcatgcc

SEQ ID NO: 4748157 - DNA, 15 bp, Homo sapiens
gctgaataaagggaa

SEQ ID NO: 4748158 - DNA, 19 bp, Homo sapiens
gctgaatttataaaaatta

SEQ ID NO: 4748159 - DNA, 21 bp, Homo sapiens
gctgacacaaacctgcctggg

SEQ ID NO: 4748160 - DNA, 15 bp, Homo sapiens
gctgacagacacagg

SEQ ID NO: 4748161 - DNA, 12 bp, Homo sapiens
gctgaccagaca

SEQ ID NO: 4748162 - DNA, 16 bp, Homo sapiens
gctgaccccctccccc

SEQ ID NO: 4748163 - DNA, 18 bp, Homo sapiens
gctgaccccctcccccca

SEQ ID NO: 4748164 - DNA, 21 bp, Homo sapiens
gctgaccccctccccccaatc

SEQ ID NO: 4748165 - DNA, 20 bp, Homo sapiens
gctgactttaaaaggattaa

SEQ ID NO: 4748166 - DNA, 14 bp, Homo sapiens
gctgagagctgggc

SEQ ID NO: 4748167 - DNA, 16 bp, Homo sapiens
gctgagaggagagaga

SEQ ID NO: 4748168 - DNA, 21 bp, Homo sapiens
gctgaggttgcgccactacac

SEQ ID NO: 4748169 - DNA, 15 bp, Homo sapiens
gctgagtctgaaggc

SEQ ID NO: 4748170 - DNA, 16 bp, Homo sapiens
gctgatagctaagtga

SEQ ID NO: 4748171 - DNA, 15 bp, Homo sapiens
gctgatgctgggctg

SEQ ID NO: 4748172 - DNA, 19 bp, Homo sapiens
gctgatgctgggctgggtg

SEQ ID NO: 4748173 - DNA, 20 bp, Homo sapiens
gctgatgctgggctgggtgc

SEQ ID NO: 4748174 - DNA, 20 bp, Homo sapiens
gctgattctcagggtctctg

SEQ ID NO: 4748175 - DNA, 21 bp, Homo sapiens
gctgattctcagggtctctgc

SEQ ID NO: 4748176 - DNA, 16 bp, Homo sapiens
gctgcaccaacccagc

SEQ ID NO: 4748177 - DNA, 18 bp, Homo sapiens
gctgcaccaacccagccg

SEQ ID NO: 4748178 - DNA, 20 bp, Homo sapiens
gctgcaccaacccagccgct

SEQ ID NO: 4748179 - DNA, 14 bp, Homo sapiens
gctgcaccggctgg

SEQ ID NO: 4748180 - DNA, 17 bp, Homo sapiens
gctgcaccggctggcct

SEQ ID NO: 4748181 - DNA, 18 bp, Homo sapiens
gctgcaccggctggcctg

SEQ ID NO: 4748182 - DNA, 19 bp, Homo sapiens
gctgcaccggctggcctgg

SEQ ID NO: 4748183 - DNA, 16 bp, Homo sapiens
gctgcactctgtgccc

SEQ ID NO: 4748184 - DNA, 17 bp, Homo sapiens
gctgcactctgtgccca

SEQ ID NO: 4748185 - DNA, 22 bp, Homo sapiens
gctgcactctgtgcccatgggc

SEQ ID NO: 4748186 - DNA, 13 bp, Homo sapiens
gctgcagttgcca

SEQ ID NO: 4748187 - DNA, 21 bp, Homo sapiens
gctgcagttgccagtcacccc

SEQ ID NO: 4748188 - DNA, 13 bp, Homo sapiens
gctgccatccagg

SEQ ID NO: 4748189 - DNA, 17 bp, Homo sapiens
gctgccatccaggttca

SEQ ID NO: 4748190 - DNA, 14 bp, Homo sapiens
gctgcccctccctg

SEQ ID NO: 4748191 - DNA, 15 bp, Homo sapiens
gctgcccctccctgc

SEQ ID NO: 4748192 - DNA, 12 bp, Homo sapiens
gctgcccgctcc

SEQ ID NO: 4748193 - DNA, 13 bp, Homo sapiens
gctgcccgctccc

SEQ ID NO: 4748194 - DNA, 12 bp, Homo sapiens
gctgccctgccc

SEQ ID NO: 4748195 - DNA, 13 bp, Homo sapiens
gctgccctgccca

SEQ ID NO: 4748196 - DNA, 20 bp, Homo sapiens
gctgcctccactcccacttc

SEQ ID NO: 4748197 - DNA, 12 bp, Homo sapiens
gctgcctggacc

SEQ ID NO: 4748198 - DNA, 14 bp, Homo sapiens
gctgcctggacccg

SEQ ID NO: 4748199 - DNA, 17 bp, Homo sapiens
gctgcctgggagccagg

SEQ ID NO: 4748200 - DNA, 13 bp, Homo sapiens
gctgcctgggatc

SEQ ID NO: 4748201 - DNA, 16 bp, Homo sapiens
gctgcctgggatccct

SEQ ID NO: 4748202 - DNA, 18 bp, Homo sapiens
gctgcctgggatccctca

SEQ ID NO: 4748203 - DNA, 20 bp, Homo sapiens
gctgcctgggatccctcatc

SEQ ID NO: 4748204 - DNA, 21 bp, Homo sapiens
gctgcctgggatccctcatcc

SEQ ID NO: 4748205 - DNA, 13 bp, Homo sapiens
gctgcctgttcag

SEQ ID NO: 4748206 - DNA, 15 bp, Homo sapiens
gctgcggtccaccca

SEQ ID NO: 4748207 - DNA, 18 bp, Homo sapiens
gctgctaccctccctgct

SEQ ID NO: 4748208 - DNA, 19 bp, Homo sapiens
gctgctaccctccctgctg

SEQ ID NO: 4748209 - DNA, 20 bp, Homo sapiens
gctgctaccctccctgctgt

SEQ ID NO: 4748210 - DNA, 12 bp, Homo sapiens
gctgctgcctgc

SEQ ID NO: 4748211 - DNA, 13 bp, Homo sapiens
gctgctggagact

SEQ ID NO: 4748212 - DNA, 19 bp, Homo sapiens
gctggaagtggctctgggg

SEQ ID NO: 4748213 - DNA, 15 bp, Homo sapiens
gctggaccttgaact

SEQ ID NO: 4748214 - DNA, 21 bp, Homo sapiens
gctggaccttgaactgggtac

SEQ ID NO: 4748215 - DNA, 13 bp, Homo sapiens
gctggactgaggc

SEQ ID NO: 4748216 - DNA, 14 bp, Homo sapiens
gctggactgaggcc

SEQ ID NO: 4748217 - DNA, 16 bp, Homo sapiens
gctggactgaggcctg

SEQ ID NO: 4748218 - DNA, 15 bp, Homo sapiens
gctggactgctgctg

SEQ ID NO: 4748219 - DNA, 18 bp, Homo sapiens
gctggagactcctaggca

SEQ ID NO: 4748220 - DNA, 21 bp, Homo sapiens
gctggagactcctaggcagga

SEQ ID NO: 4748221 - DNA, 20 bp, Homo sapiens
gctggaggagcccaggccag

SEQ ID NO: 4748222 - DNA, 17 bp, Homo sapiens
gctggagtgcagtgagc

SEQ ID NO: 4748223 - DNA, 22 bp, Homo sapiens
gctggagtgcagtgagccgaga

SEQ ID NO: 4748224 - DNA, 17 bp, Homo sapiens
gctggatgggggctctg

SEQ ID NO: 4748225 - DNA, 19 bp, Homo sapiens
gctggatgggggctctgca

SEQ ID NO: 4748226 - DNA, 17 bp, Homo sapiens
gctggcactgctggggg

SEQ ID NO: 4748227 - DNA, 20 bp, Homo sapiens
gctggcagagagcacagtga

SEQ ID NO: 4748228 - DNA, 14 bp, Homo sapiens
gctggccagcccca

SEQ ID NO: 4748229 - DNA, 19 bp, Homo sapiens
gctggccagccccacagcc

SEQ ID NO: 4748230 - DNA, 22 bp, Homo sapiens
gctggccagccccacagcccac

SEQ ID NO: 4748231 - DNA, 13 bp, Homo sapiens
gctggccctgccc

SEQ ID NO: 4748232 - DNA, 15 bp, Homo sapiens
gctggccctgccctg

SEQ ID NO: 4748233 - DNA, 13 bp, Homo sapiens
gctggccgggacc

SEQ ID NO: 4748234 - DNA, 14 bp, Homo sapiens
gctggcctggcccc

SEQ ID NO: 4748235 - DNA, 18 bp, Homo sapiens
gctggcctggcccctcag

SEQ ID NO: 4748236 - DNA, 19 bp, Homo sapiens
gctggcctggcccctcagg

SEQ ID NO: 4748237 - DNA, 16 bp, Homo sapiens
gctggctggtgcctga

SEQ ID NO: 4748238 - DNA, 14 bp, Homo sapiens
gctggctgtgacaa

SEQ ID NO: 4748239 - DNA, 20 bp, Homo sapiens
gctggctgttggctgggggc

SEQ ID NO: 4748240 - DNA, 17 bp, Homo sapiens
gctgggaaccagggagg

SEQ ID NO: 4748241 - DNA, 18 bp, Homo sapiens
gctgggaactcacctggg

SEQ ID NO: 4748242 - DNA, 18 bp, Homo sapiens
gctgggactacaggcacc

SEQ ID NO: 4748243 - DNA, 22 bp, Homo sapiens
gctgggagagccttccaggggt

SEQ ID NO: 4748244 - DNA, 20 bp, Homo sapiens
gctgggattacaggctcctg

SEQ ID NO: 4748245 - DNA, 17 bp, Homo sapiens
gctgggattacaggtgt

SEQ ID NO: 4748246 - DNA, 12 bp, Homo sapiens
gctgggctgggt

SEQ ID NO: 4748247 - DNA, 17 bp, Homo sapiens
gctgggcttcagtggca

SEQ ID NO: 4748248 - DNA, 20 bp, Homo sapiens
gctggggaagtcctctgggt

SEQ ID NO: 4748249 - DNA, 20 bp, Homo sapiens
gctggggcctatcagtgtgc

SEQ ID NO: 4748250 - DNA, 15 bp, Homo sapiens
gctgggggcctcagt

SEQ ID NO: 4748251 - DNA, 21 bp, Homo sapiens
gctgggtgcgaccccatctgc

SEQ ID NO: 4748252 - DNA, 23 bp, Homo sapiens
gctgggtgcgaccccatctgccc

SEQ ID NO: 4748253 - DNA, 17 bp, Homo sapiens
gctgggtggcactgcca

SEQ ID NO: 4748254 - DNA, 13 bp, Homo sapiens
gctgggtggccca

SEQ ID NO: 4748255 - DNA, 20 bp, Homo sapiens
gctgggtggcccatcccccc

SEQ ID NO: 4748256 - DNA, 22 bp, Homo sapiens
gctgggtggcccatcccccctc

SEQ ID NO: 4748257 - DNA, 15 bp, Homo sapiens
gctgggttctaccca

SEQ ID NO: 4748258 - DNA, 17 bp, Homo sapiens
gctgggttctacccagg

SEQ ID NO: 4748259 - DNA, 20 bp, Homo sapiens
gctgggttctacccaggtgc

SEQ ID NO: 4748260 - DNA, 14 bp, Homo sapiens
gctgggttggaggg

SEQ ID NO: 4748261 - DNA, 21 bp, Homo sapiens
gctgggttggagggtgtccca

SEQ ID NO: 4748262 - DNA, 21 bp, Homo sapiens
gctgggttggcgcaccctccc

SEQ ID NO: 4748263 - DNA, 23 bp, Homo sapiens
gctggtctcgaactcctgacctt

SEQ ID NO: 4748264 - DNA, 15 bp, Homo sapiens
gctggtgcctgagcc

SEQ ID NO: 4748265 - DNA, 17 bp, Homo sapiens
gctggtggatggtgact

SEQ ID NO: 4748266 - DNA, 21 bp, Homo sapiens
gctggttagaggttccctttg

SEQ ID NO: 4748267 - DNA, 14 bp, Homo sapiens
gctggtttttcagt

SEQ ID NO: 4748268 - DNA, 18 bp, Homo sapiens
gctgtcaggattgcgaga

SEQ ID NO: 4748269 - DNA, 13 bp, Homo sapiens
gctgtcatctcag

SEQ ID NO: 4748270 - DNA, 12 bp, Homo sapiens
gctgtccagtgc

SEQ ID NO: 4748271 - DNA, 23 bp, Homo sapiens
gctgtccagtgcccattcctcac

SEQ ID NO: 4748272 - DNA, 19 bp, Homo sapiens
gctgtcccaagctcccaag

SEQ ID NO: 4748273 - DNA, 19 bp, Homo sapiens
gctgtcccctcttgcccca

SEQ ID NO: 4748274 - DNA, 18 bp, Homo sapiens
gctgtgaataaaaagaaa

SEQ ID NO: 4748275 - DNA, 20 bp, Homo sapiens
gctgtgaatttgtgtaagga

SEQ ID NO: 4748276 - DNA, 17 bp, Homo sapiens
gctgtgccaccctgggc

SEQ ID NO: 4748277 - DNA, 18 bp, Homo sapiens
gctgtgccaccctgggct

SEQ ID NO: 4748278 - DNA, 11 bp, Homo sapiens
gctgtgcctgg

SEQ ID NO: 4748279 - DNA, 13 bp, Homo sapiens
gctgtgcctgggc

SEQ ID NO: 4748280 - DNA, 13 bp, Homo sapiens
gctgtgctctgga

SEQ ID NO: 4748281 - DNA, 21 bp, Homo sapiens
gctgtgggcgtgagacctgcc

SEQ ID NO: 4748282 - DNA, 18 bp, Homo sapiens
gctgtgtgaatacctgct

SEQ ID NO: 4748283 - DNA, 17 bp, Homo sapiens
gctgtgtgaatttttct

SEQ ID NO: 4748284 - DNA, 13 bp, Homo sapiens
gctgttatcttgt

SEQ ID NO: 4748285 - DNA, 13 bp, Homo sapiens
gctgttggctggg

SEQ ID NO: 4748286 - DNA, 14 bp, Homo sapiens
gctgttggctgggg

SEQ ID NO: 4748287 - DNA, 15 bp, Homo sapiens
gctgttggctggggg

SEQ ID NO: 4748288 - DNA, 16 bp, Homo sapiens
gctgttggctgggggc

SEQ ID NO: 4748289 - DNA, 12 bp, Homo sapiens
gctgttgtacat

SEQ ID NO: 4748290 - DNA, 14 bp, Homo sapiens
gctgttgtacattt

SEQ ID NO: 4748291 - DNA, 19 bp, Homo sapiens
gcttaccagggtctttgca

SEQ ID NO: 4748292 - DNA, 18 bp, Homo sapiens
gcttagctttgctctgcc

SEQ ID NO: 4748293 - DNA, 19 bp, Homo sapiens
gcttagtcactgagacagc

SEQ ID NO: 4748294 - DNA, 15 bp, Homo sapiens
gcttataggtggcct

SEQ ID NO: 4748295 - DNA, 20 bp, Homo sapiens
gcttatgtgttgcataaaca

SEQ ID NO: 4748296 - DNA, 22 bp, Homo sapiens
gcttcaatacccaaatcctctc

SEQ ID NO: 4748297 - DNA, 12 bp, Homo sapiens
gcttcaggttat

SEQ ID NO: 4748298 - DNA, 17 bp, Homo sapiens
gcttcaggttatcgaaa

SEQ ID NO: 4748299 - DNA, 16 bp, Homo sapiens
gcttcagtggcagctg

SEQ ID NO: 4748300 - DNA, 17 bp, Homo sapiens
gcttcagtggcagctgc

SEQ ID NO: 4748301 - DNA, 19 bp, Homo sapiens
gcttcagtggcagctgctt

SEQ ID NO: 4748302 - DNA, 18 bp, Homo sapiens
gcttccaaggtggtctgc

SEQ ID NO: 4748303 - DNA, 15 bp, Homo sapiens
gcttccagagctctg

SEQ ID NO: 4748304 - DNA, 16 bp, Homo sapiens
gcttccagagctctga

SEQ ID NO: 4748305 - DNA, 18 bp, Homo sapiens
gcttccagagctctgacc

SEQ ID NO: 4748306 - DNA, 23 bp, Homo sapiens
gcttccagtgaggctctgccctt

SEQ ID NO: 4748307 - DNA, 21 bp, Homo sapiens
gcttcccagtggctgctgccc

SEQ ID NO: 4748308 - DNA, 18 bp, Homo sapiens
gcttcgggcccttcccac

SEQ ID NO: 4748309 - DNA, 20 bp, Homo sapiens
gcttcgggcccttcccacag

SEQ ID NO: 4748310 - DNA, 16 bp, Homo sapiens
gcttctatgaaagact

SEQ ID NO: 4748311 - DNA, 14 bp, Homo sapiens
gcttctctctgtgg

SEQ ID NO: 4748312 - DNA, 14 bp, Homo sapiens
gcttctgccacttc

SEQ ID NO: 4748313 - DNA, 19 bp, Homo sapiens
gcttctgccacttcccagg

SEQ ID NO: 4748314 - DNA, 21 bp, Homo sapiens
gcttctgccacttcccaggta

SEQ ID NO: 4748315 - DNA, 22 bp, Homo sapiens
gcttctgctgggctggggcctg

SEQ ID NO: 4748316 - DNA, 16 bp, Homo sapiens
gcttctgttgctgcct

SEQ ID NO: 4748317 - DNA, 17 bp, Homo sapiens
gcttctgttgctgcctc

SEQ ID NO: 4748318 - DNA, 19 bp, Homo sapiens
gcttctgttgctgcctcat

SEQ ID NO: 4748319 - DNA, 23 bp, Homo sapiens
gcttcttaatcttttcacaaata

SEQ ID NO: 4748320 - DNA, 15 bp, Homo sapiens
gcttcttcagagact

SEQ ID NO: 4748321 - DNA, 23 bp, Homo sapiens
gcttcttcagagactcctgcagg

SEQ ID NO: 4748322 - DNA, 22 bp, Homo sapiens
gcttgagggttgggctggtgtc

SEQ ID NO: 4748323 - DNA, 14 bp, Homo sapiens
gcttgcctcggctc

SEQ ID NO: 4748324 - DNA, 19 bp, Homo sapiens
gcttgcctcggctcctgct

SEQ ID NO: 4748325 - DNA, 20 bp, Homo sapiens
gcttgcctcggctcctgctg

SEQ ID NO: 4748326 - DNA, 21 bp, Homo sapiens
gcttgcctcggctcctgctgc

SEQ ID NO: 4748327 - DNA, 20 bp, Homo sapiens
gcttgctttcttctcctgtg

SEQ ID NO: 4748328 - DNA, 14 bp, Homo sapiens
gcttggagcagagg

SEQ ID NO: 4748329 - DNA, 19 bp, Homo sapiens
gcttggttttcttttttct

SEQ ID NO: 4748330 - DNA, 20 bp, Homo sapiens
gcttgtaaatagctcaggtg

SEQ ID NO: 4748331 - DNA, 23 bp, Homo sapiens
gctttataccccatttgatttcg

SEQ ID NO: 4748332 - DNA, 15 bp, Homo sapiens
gctttcatgtaaact

SEQ ID NO: 4748333 - DNA, 20 bp, Homo sapiens
gctttcatgtaaactgtgca

SEQ ID NO: 4748334 - DNA, 16 bp, Homo sapiens
gctttcctcttcctga

SEQ ID NO: 4748335 - DNA, 22 bp, Homo sapiens
gctttctacccagcgagccctg

SEQ ID NO: 4748336 - DNA, 15 bp, Homo sapiens
gctttcttctcctgt

SEQ ID NO: 4748337 - DNA, 12 bp, Homo sapiens
gctttgcccagc

SEQ ID NO: 4748338 - DNA, 12 bp, Homo sapiens
gctttgctctgc

SEQ ID NO: 4748339 - DNA, 14 bp, Homo sapiens
gctttgttttgcac

SEQ ID NO: 4748340 - DNA, 23 bp, Homo sapiens
gctttgttttgcacactttgcca

SEQ ID NO: 4748341 - DNA, 17 bp, Homo sapiens
gcttttaccattagcat

SEQ ID NO: 4748342 - DNA, 18 bp, Homo sapiens
gcttttacgtagtaaaag

SEQ ID NO: 4748343 - DNA, 21 bp, Homo sapiens
gcttttacgtagtaaaagtca

SEQ ID NO: 4748344 - DNA, 19 bp, Homo sapiens
gcttttccaggaagatcca

SEQ ID NO: 4748345 - DNA, 15 bp, Homo sapiens
gcttttggtctgtgt

SEQ ID NO: 4748346 - DNA, 18 bp, Homo sapiens
gcttttgtctatgggact

SEQ ID NO: 4748347 - DNA, 13 bp, Homo sapiens
ggaaaaatttgaa

SEQ ID NO: 4748348 - DNA, 15 bp, Homo sapiens
ggaaaacattccatc

SEQ ID NO: 4748349 - DNA, 18 bp, Homo sapiens
ggaaaagctgctgacagt

SEQ ID NO: 4748350 - DNA, 18 bp, Homo sapiens
ggaaacatatttaagaaa

SEQ ID NO: 4748351 - DNA, 15 bp, Homo sapiens
ggaaaccacagctgc

SEQ ID NO: 4748352 - DNA, 15 bp, Homo sapiens
ggaaacccagctctg

SEQ ID NO: 4748353 - DNA, 16 bp, Homo sapiens
ggaaactgtgaatgct

SEQ ID NO: 4748354 - DNA, 15 bp, Homo sapiens
ggaaagaaagttgca

SEQ ID NO: 4748355 - DNA, 20 bp, Homo sapiens
ggaaagacttttccaaccct

SEQ ID NO: 4748356 - DNA, 16 bp, Homo sapiens
ggaaagcacaggtggg

SEQ ID NO: 4748357 - DNA, 13 bp, Homo sapiens
ggaaaggctccag

SEQ ID NO: 4748358 - DNA, 20 bp, Homo sapiens
ggaaaggctccaggagcagc

SEQ ID NO: 4748359 - DNA, 22 bp, Homo sapiens
ggaaaggctccaggagcagcca

SEQ ID NO: 4748360 - DNA, 14 bp, Homo sapiens
ggaaagtttctttg

SEQ ID NO: 4748361 - DNA, 17 bp, Homo sapiens
ggaaagtttctttgaaa

SEQ ID NO: 4748362 - DNA, 18 bp, Homo sapiens
ggaacaatcacaaaagct

SEQ ID NO: 4748363 - DNA, 20 bp, Homo sapiens
ggaacagactggaagcacag

SEQ ID NO: 4748364 - DNA, 18 bp, Homo sapiens
ggaacatacagacacatt

SEQ ID NO: 4748365 - DNA, 23 bp, Homo sapiens
ggaacatcatcaaggcactgcct

SEQ ID NO: 4748366 - DNA, 17 bp, Homo sapiens
ggaactcacctggggct

SEQ ID NO: 4748367 - DNA, 11 bp, Homo sapiens
ggaactggagg

SEQ ID NO: 4748368 - DNA, 12 bp, Homo sapiens
ggaactggaggc

SEQ ID NO: 4748369 - DNA, 16 bp, Homo sapiens
ggaagaaagagaagga

SEQ ID NO: 4748370 - DNA, 21 bp, Homo sapiens
ggaagaacggggctcttctca

SEQ ID NO: 4748371 - DNA, 17 bp, Homo sapiens
ggaagacccattccttc

SEQ ID NO: 4748372 - DNA, 13 bp, Homo sapiens
ggaagactttgga

SEQ ID NO: 4748373 - DNA, 18 bp, Homo sapiens
ggaagactttggaaagag

SEQ ID NO: 4748374 - DNA, 14 bp, Homo sapiens
ggaagagcacagcc

SEQ ID NO: 4748375 - DNA, 16 bp, Homo sapiens
ggaagagcacagccct

SEQ ID NO: 4748376 - DNA, 18 bp, Homo sapiens
ggaagagcacagccctcc

SEQ ID NO: 4748377 - DNA, 20 bp, Homo sapiens
ggaagctagctcccctcctc

SEQ ID NO: 4748378 - DNA, 21 bp, Homo sapiens
ggaagctcagggcctggctca

SEQ ID NO: 4748379 - DNA, 11 bp, Homo sapiens
ggaagctccgc

SEQ ID NO: 4748380 - DNA, 19 bp, Homo sapiens
ggaaggagctgcctggacc

SEQ ID NO: 4748381 - DNA, 23 bp, Homo sapiens
ggaaggattgtaaaaaaaaatgc

SEQ ID NO: 4748382 - DNA, 21 bp, Homo sapiens
ggaaggctcttctccccagag

SEQ ID NO: 4748383 - DNA, 15 bp, Homo sapiens
ggaaggggccagagg

SEQ ID NO: 4748384 - DNA, 13 bp, Homo sapiens
ggaagtcaaagca

SEQ ID NO: 4748385 - DNA, 17 bp, Homo sapiens
ggaagttatttatttta

SEQ ID NO: 4748386 - DNA, 19 bp, Homo sapiens
ggaatacctgtccccctga

SEQ ID NO: 4748387 - DNA, 13 bp, Homo sapiens
ggaatagtttttt

SEQ ID NO: 4748388 - DNA, 17 bp, Homo sapiens
ggaatcttcacctcaga

SEQ ID NO: 4748389 - DNA, 19 bp, Homo sapiens
ggaatgcctgagtgcctgg

SEQ ID NO: 4748390 - DNA, 19 bp, Homo sapiens
ggacaaggactagggtcct

SEQ ID NO: 4748391 - DNA, 22 bp, Homo sapiens
ggacaaggatgatctaggaaga

SEQ ID NO: 4748392 - DNA, 11 bp, Homo sapiens
ggacaccaccc

SEQ ID NO: 4748393 - DNA, 17 bp, Homo sapiens
ggacactaaccacgctg

SEQ ID NO: 4748394 - DNA, 14 bp, Homo sapiens
ggacacttctcagg

SEQ ID NO: 4748395 - DNA, 16 bp, Homo sapiens
ggacagaagcagctct

SEQ ID NO: 4748396 - DNA, 20 bp, Homo sapiens
ggacagagggggtggcctcc

SEQ ID NO: 4748397 - DNA, 20 bp, Homo sapiens
ggacagccacggccaggcca

SEQ ID NO: 4748398 - DNA, 20 bp, Homo sapiens
ggacagctccttctgtccta

SEQ ID NO: 4748399 - DNA, 22 bp, Homo sapiens
ggacagggatgagcatggagct

SEQ ID NO: 4748400 - DNA, 20 bp, Homo sapiens
ggacaggtgtgccgacagaa

SEQ ID NO: 4748401 - DNA, 14 bp, Homo sapiens
ggacatggacaagg

SEQ ID NO: 4748402 - DNA, 18 bp, Homo sapiens
ggacatggcccctgtgag

SEQ ID NO: 4748403 - DNA, 16 bp, Homo sapiens
ggacatggtctgtcct

SEQ ID NO: 4748404 - DNA, 15 bp, Homo sapiens
ggacattttatgtct

SEQ ID NO: 4748405 - DNA, 16 bp, Homo sapiens
ggaccagcctggccca

SEQ ID NO: 4748406 - DNA, 22 bp, Homo sapiens
ggaccagcctggcccaccccac

SEQ ID NO: 4748407 - DNA, 15 bp, Homo sapiens
ggaccagcttttccc

SEQ ID NO: 4748408 - DNA, 22 bp, Homo sapiens
ggaccagcttttcccaaaagcc

SEQ ID NO: 4748409 - DNA, 23 bp, Homo sapiens
ggaccaggcaatgtgactttgca

SEQ ID NO: 4748410 - DNA, 21 bp, Homo sapiens
ggacccagaggaaggggccag

SEQ ID NO: 4748411 - DNA, 13 bp, Homo sapiens
ggaccccacccct

SEQ ID NO: 4748412 - DNA, 16 bp, Homo sapiens
ggacccctcctccctt

SEQ ID NO: 4748413 - DNA, 11 bp, Homo sapiens
ggacccctgca

SEQ ID NO: 4748414 - DNA, 17 bp, Homo sapiens
ggacccgccggatgaca

SEQ ID NO: 4748415 - DNA, 18 bp, Homo sapiens
ggaccggagagtgggggt

SEQ ID NO: 4748416 - DNA, 18 bp, Homo sapiens
ggaccttgaactgggtac

SEQ ID NO: 4748417 - DNA, 17 bp, Homo sapiens
ggacgcccaggacccca

SEQ ID NO: 4748418 - DNA, 16 bp, Homo sapiens
ggacggggccggccag

SEQ ID NO: 4748419 - DNA, 17 bp, Homo sapiens
ggacggtgctccaggca

SEQ ID NO: 4748420 - DNA, 17 bp, Homo sapiens
ggactagaacctggagg

SEQ ID NO: 4748421 - DNA, 16 bp, Homo sapiens
ggactagggtcctggg

SEQ ID NO: 4748422 - DNA, 16 bp, Homo sapiens
ggactcaatgcactga

SEQ ID NO: 4748423 - DNA, 17 bp, Homo sapiens
ggactcagctccccaga

SEQ ID NO: 4748424 - DNA, 18 bp, Homo sapiens
ggactctcagtctctgag

SEQ ID NO: 4748425 - DNA, 14 bp, Homo sapiens
ggactgaggcctga

SEQ ID NO: 4748426 - DNA, 20 bp, Homo sapiens
ggactgtgacaggcagcaga

SEQ ID NO: 4748427 - DNA, 17 bp, Homo sapiens
ggacttagctgggagaa

SEQ ID NO: 4748428 - DNA, 15 bp, Homo sapiens
ggacttggaagctcc

SEQ ID NO: 4748429 - DNA, 22 bp, Homo sapiens
ggagaaagaccatgcatttaaa

SEQ ID NO: 4748430 - DNA, 18 bp, Homo sapiens
ggagaactagaacctgga

SEQ ID NO: 4748431 - DNA, 22 bp, Homo sapiens
ggagaactagaacctggagggc

SEQ ID NO: 4748432 - DNA, 20 bp, Homo sapiens
ggagaagccacaggcctgag

SEQ ID NO: 4748433 - DNA, 21 bp, Homo sapiens
ggagaagtggggaccccaccc

SEQ ID NO: 4748434 - DNA, 16 bp, Homo sapiens
ggagactcctaggcag

SEQ ID NO: 4748435 - DNA, 23 bp, Homo sapiens
ggagagaactgagcatctccagc

SEQ ID NO: 4748436 - DNA, 19 bp, Homo sapiens
ggagagacttggatgagga

SEQ ID NO: 4748437 - DNA, 14 bp, Homo sapiens
ggagagagactcca

SEQ ID NO: 4748438 - DNA, 21 bp, Homo sapiens
ggagagccatacataaaagaa

SEQ ID NO: 4748439 - DNA, 21 bp, Homo sapiens
ggagagctagaacctggaggg

SEQ ID NO: 4748440 - DNA, 13 bp, Homo sapiens
ggagagctggagc

SEQ ID NO: 4748441 - DNA, 17 bp, Homo sapiens
ggagagctggagcctgg

SEQ ID NO: 4748442 - DNA, 20 bp, Homo sapiens
ggagaggatgagagcccaga

SEQ ID NO: 4748443 - DNA, 21 bp, Homo sapiens
ggagaggatgagagcccagag

SEQ ID NO: 4748444 - DNA, 14 bp, Homo sapiens
ggagaggggacgca

SEQ ID NO: 4748445 - DNA, 16 bp, Homo sapiens
ggagaggggacgcagg

SEQ ID NO: 4748446 - DNA, 13 bp, Homo sapiens
ggagagtgggggt

SEQ ID NO: 4748447 - DNA, 13 bp, Homo sapiens
ggagatgaaaacc

SEQ ID NO: 4748448 - DNA, 22 bp, Homo sapiens
ggagcatccacctccttctctg

SEQ ID NO: 4748449 - DNA, 18 bp, Homo sapiens
ggagccactaactagagc

SEQ ID NO: 4748450 - DNA, 18 bp, Homo sapiens
ggagccagtaaacagagg

SEQ ID NO: 4748451 - DNA, 15 bp, Homo sapiens
ggagcccaggccagg

SEQ ID NO: 4748452 - DNA, 16 bp, Homo sapiens
ggagccccattcctgg

SEQ ID NO: 4748453 - DNA, 22 bp, Homo sapiens
ggagccccgaggccttctctga

SEQ ID NO: 4748454 - DNA, 14 bp, Homo sapiens
ggagctcagagagg

SEQ ID NO: 4748455 - DNA, 17 bp, Homo sapiens
ggagctcagagagggca

SEQ ID NO: 4748456 - DNA, 11 bp, Homo sapiens
ggagctgcctg

SEQ ID NO: 4748457 - DNA, 16 bp, Homo sapiens
ggagctgcctggaccc

SEQ ID NO: 4748458 - DNA, 12 bp, Homo sapiens
ggagctgcctgt

SEQ ID NO: 4748459 - DNA, 22 bp, Homo sapiens
ggagctgcctgttcagctccag

SEQ ID NO: 4748460 - DNA, 20 bp, Homo sapiens
ggagcttcatggcagaaggc

SEQ ID NO: 4748461 - DNA, 20 bp, Homo sapiens
ggaggaaggaaacccagctc

SEQ ID NO: 4748462 - DNA, 11 bp, Homo sapiens
ggaggaaggat

SEQ ID NO: 4748463 - DNA, 16 bp, Homo sapiens
ggaggactagaacctg

SEQ ID NO: 4748464 - DNA, 21 bp, Homo sapiens
ggaggactagaacctggaggg

SEQ ID NO: 4748465 - DNA, 22 bp, Homo sapiens
ggaggactagaacctggagggc

SEQ ID NO: 4748466 - DNA, 14 bp, Homo sapiens
ggaggagacaggaa

SEQ ID NO: 4748467 - DNA, 12 bp, Homo sapiens
ggaggagcccag

SEQ ID NO: 4748468 - DNA, 20 bp, Homo sapiens
ggaggagcccaggccaggac

SEQ ID NO: 4748469 - DNA, 22 bp, Homo sapiens
ggaggaggcctgggggcaggga

SEQ ID NO: 4748470 - DNA, 17 bp, Homo sapiens
ggaggcacttcctcccc

SEQ ID NO: 4748471 - DNA, 16 bp, Homo sapiens
ggaggccgagtctgtc

SEQ ID NO: 4748472 - DNA, 18 bp, Homo sapiens
ggaggccgagtctgtcct

SEQ ID NO: 4748473 - DNA, 23 bp, Homo sapiens
ggaggccgtatgaagacagaggc

SEQ ID NO: 4748474 - DNA, 16 bp, Homo sapiens
ggaggctccagagggc

SEQ ID NO: 4748475 - DNA, 16 bp, Homo sapiens
ggaggctggctggggc

SEQ ID NO: 4748476 - DNA, 17 bp, Homo sapiens
ggagggaaactgtgaat

SEQ ID NO: 4748477 - DNA, 21 bp, Homo sapiens
ggagggaaactgtgaatgctt

SEQ ID NO: 4748478 - DNA, 13 bp, Homo sapiens
ggagggagggctc

SEQ ID NO: 4748479 - DNA, 16 bp, Homo sapiens
ggagggctagaacctg

SEQ ID NO: 4748480 - DNA, 15 bp, Homo sapiens
ggagggctccagaca

SEQ ID NO: 4748481 - DNA, 14 bp, Homo sapiens
ggagggctggaatc

SEQ ID NO: 4748482 - DNA, 22 bp, Homo sapiens
ggaggggcccgcttgcctcggc

SEQ ID NO: 4748483 - DNA, 18 bp, Homo sapiens
ggaggtaaaggatgaggg

SEQ ID NO: 4748484 - DNA, 23 bp, Homo sapiens
ggaggtgggatcctccaggtgca

SEQ ID NO: 4748485 - DNA, 15 bp, Homo sapiens
ggagtcaagtgtgga

SEQ ID NO: 4748486 - DNA, 21 bp, Homo sapiens
ggagtcccaccttggctgcag

SEQ ID NO: 4748487 - DNA, 23 bp, Homo sapiens
ggagtcccaccttggctgcaggg

SEQ ID NO: 4748488 - DNA, 13 bp, Homo sapiens
ggagtcccagagc

SEQ ID NO: 4748489 - DNA, 16 bp, Homo sapiens
ggagtctgactgtgcc

SEQ ID NO: 4748490 - DNA, 17 bp, Homo sapiens
ggagtgacagaggcagc

SEQ ID NO: 4748491 - DNA, 18 bp, Homo sapiens
ggagtgacagaggcagcc

SEQ ID NO: 4748492 - DNA, 21 bp, Homo sapiens
ggagtgacagaggcagcccca

SEQ ID NO: 4748493 - DNA, 14 bp, Homo sapiens
ggagtgagctggtt

SEQ ID NO: 4748494 - DNA, 21 bp, Homo sapiens
ggagtgagttgatagcacaga

SEQ ID NO: 4748495 - DNA, 15 bp, Homo sapiens
ggagtgcagtgagcc

SEQ ID NO: 4748496 - DNA, 12 bp, Homo sapiens
ggagtgttcccc

SEQ ID NO: 4748497 - DNA, 20 bp, Homo sapiens
ggagtgttccccttccactg

SEQ ID NO: 4748498 - DNA, 12 bp, Homo sapiens
ggagtgtttgac

SEQ ID NO: 4748499 - DNA, 14 bp, Homo sapiens
ggagttccagtgct

SEQ ID NO: 4748500 - DNA, 21 bp, Homo sapiens
ggagttggaagtgtgtgatct

SEQ ID NO: 4748501 - DNA, 19 bp, Homo sapiens
ggatatttgatatttggtt

SEQ ID NO: 4748502 - DNA, 21 bp, Homo sapiens
ggatcatggtgtaataagaca

SEQ ID NO: 4748503 - DNA, 14 bp, Homo sapiens
ggatccacacctgg

SEQ ID NO: 4748504 - DNA, 15 bp, Homo sapiens
ggatccatctttgta

SEQ ID NO: 4748505 - DNA, 13 bp, Homo sapiens
ggatccctcatct

SEQ ID NO: 4748506 - DNA, 22 bp, Homo sapiens
ggatccctcatctgtccctccg

SEQ ID NO: 4748507 - DNA, 15 bp, Homo sapiens
ggatcctccaggtgc

SEQ ID NO: 4748508 - DNA, 17 bp, Homo sapiens
ggatctcattggaccct

SEQ ID NO: 4748509 - DNA, 24 bp, Homo sapiens
ggatctcattggacccttccatgg

SEQ ID NO: 4748510 - DNA, 22 bp, Homo sapiens
ggatgagaaaggttgaagcacc

SEQ ID NO: 4748511 - DNA, 23 bp, Homo sapiens
ggatgagaatttgagtgctctga

SEQ ID NO: 4748512 - DNA, 14 bp, Homo sapiens
ggatgagagcccag

SEQ ID NO: 4748513 - DNA, 20 bp, Homo sapiens
ggatgagagcccagaggtaa

SEQ ID NO: 4748514 - DNA, 16 bp, Homo sapiens
ggatgatctaggaaga

SEQ ID NO: 4748515 - DNA, 14 bp, Homo sapiens
ggatgatgccacac

SEQ ID NO: 4748516 - DNA, 13 bp, Homo sapiens
ggatgcagcatta

SEQ ID NO: 4748517 - DNA, 17 bp, Homo sapiens
ggatgccccgtccccct

SEQ ID NO: 4748518 - DNA, 18 bp, Homo sapiens
ggatgcctggtggcagct

SEQ ID NO: 4748519 - DNA, 16 bp, Homo sapiens
ggatggcctggccagg

SEQ ID NO: 4748520 - DNA, 16 bp, Homo sapiens
ggatggggctgcaccg

SEQ ID NO: 4748521 - DNA, 13 bp, Homo sapiens
ggatggtgacttt

SEQ ID NO: 4748522 - DNA, 13 bp, Homo sapiens
ggatgttctggga

SEQ ID NO: 4748523 - DNA, 23 bp, Homo sapiens
ggatgtttctgtcacatcagctc

SEQ ID NO: 4748524 - DNA, 19 bp, Homo sapiens
ggattacaagcgtgagcca

SEQ ID NO: 4748525 - DNA, 19 bp, Homo sapiens
ggattatttaataacatta

SEQ ID NO: 4748526 - DNA, 22 bp, Homo sapiens
ggattatttaataacattacct

SEQ ID NO: 4748527 - DNA, 23 bp, Homo sapiens
ggattctaaacagatgtccctga

SEQ ID NO: 4748528 - DNA, 17 bp, Homo sapiens
ggattctgatttgtatt

SEQ ID NO: 4748529 - DNA, 23 bp, Homo sapiens
ggattctgatttgtattaaaatt

SEQ ID NO: 4748530 - DNA, 12 bp, Homo sapiens
ggattctttaaa

SEQ ID NO: 4748531 - DNA, 18 bp, Homo sapiens
ggattgcgagagatgtgt

SEQ ID NO: 4748532 - DNA, 16 bp, Homo sapiens
ggattggattatttaa

SEQ ID NO: 4748533 - DNA, 13 bp, Homo sapiens
ggattgtccccga

SEQ ID NO: 4748534 - DNA, 15 bp, Homo sapiens
ggattgttcctgtca

SEQ ID NO: 4748535 - DNA, 11 bp, Homo sapiens
ggatttcattt

SEQ ID NO: 4748536 - DNA, 14 bp, Homo sapiens
ggcaaaataaaaca

SEQ ID NO: 4748537 - DNA, 21 bp, Homo sapiens
ggcaacagaaaacaattgttc

SEQ ID NO: 4748538 - DNA, 19 bp, Homo sapiens
ggcaagcaagagctcttgt

SEQ ID NO: 4748539 - DNA, 17 bp, Homo sapiens
ggcaagcacctcctgcc

SEQ ID NO: 4748540 - DNA, 18 bp, Homo sapiens
ggcaagctagaacctgga

SEQ ID NO: 4748541 - DNA, 13 bp, Homo sapiens
ggcaaggctgtgc

SEQ ID NO: 4748542 - DNA, 18 bp, Homo sapiens
ggcaatctattaatagct

SEQ ID NO: 4748543 - DNA, 23 bp, Homo sapiens
ggcaatgctggctgttggctggg

SEQ ID NO: 4748544 - DNA, 22 bp, Homo sapiens
ggcacaatctcggctcactgca

SEQ ID NO: 4748545 - DNA, 17 bp, Homo sapiens
ggcacagtatgtcccat

SEQ ID NO: 4748546 - DNA, 17 bp, Homo sapiens
ggcacccggcccctgct

SEQ ID NO: 4748547 - DNA, 20 bp, Homo sapiens
ggcacccggcccctgctggt

SEQ ID NO: 4748548 - DNA, 21 bp, Homo sapiens
ggcacctacactcacctgcac

SEQ ID NO: 4748549 - DNA, 16 bp, Homo sapiens
ggcacctgaaattaat

SEQ ID NO: 4748550 - DNA, 19 bp, Homo sapiens
ggcactcagaagacactga

SEQ ID NO: 4748551 - DNA, 20 bp, Homo sapiens
ggcactcagaagacactgat

SEQ ID NO: 4748552 - DNA, 11 bp, Homo sapiens
ggcactgcatg

SEQ ID NO: 4748553 - DNA, 12 bp, Homo sapiens
ggcactgccctg

SEQ ID NO: 4748554 - DNA, 14 bp, Homo sapiens
ggcactgccctggt

SEQ ID NO: 4748555 - DNA, 24 bp, Homo sapiens
ggcactgccctggtggccctctcc

SEQ ID NO: 4748556 - DNA, 12 bp, Homo sapiens
ggcactgctggg

SEQ ID NO: 4748557 - DNA, 16 bp, Homo sapiens
ggcactgctgggtggc

SEQ ID NO: 4748558 - DNA, 22 bp, Homo sapiens
ggcactgcttccagtgaggctc

SEQ ID NO: 4748559 - DNA, 13 bp, Homo sapiens
ggcacttcctccc

SEQ ID NO: 4748560 - DNA, 18 bp, Homo sapiens
ggcagaagacaccagagc

SEQ ID NO: 4748561 - DNA, 19 bp, Homo sapiens
ggcagaagacaccagagca

SEQ ID NO: 4748562 - DNA, 23 bp, Homo sapiens
ggcagagattggaatgggcagct

SEQ ID NO: 4748563 - DNA, 10 bp, Homo sapiens
ggcagagcag

SEQ ID NO: 4748564 - DNA, 15 bp, Homo sapiens
ggcagagcagagacc

SEQ ID NO: 4748565 - DNA, 16 bp, Homo sapiens
ggcagagcagagacca

SEQ ID NO: 4748566 - DNA, 12 bp, Homo sapiens
ggcagagcccaa

SEQ ID NO: 4748567 - DNA, 18 bp, Homo sapiens
ggcagcagaagggggtgg

SEQ ID NO: 4748568 - DNA, 21 bp, Homo sapiens
ggcagcagggctaccctgagc

SEQ ID NO: 4748569 - DNA, 15 bp, Homo sapiens
ggcagccaggccaca

SEQ ID NO: 4748570 - DNA, 17 bp, Homo sapiens
ggcagccaggccacaag

SEQ ID NO: 4748571 - DNA, 17 bp, Homo sapiens
ggcagccagggagagcc

SEQ ID NO: 4748572 - DNA, 18 bp, Homo sapiens
ggcagccagggagagccc

SEQ ID NO: 4748573 - DNA, 23 bp, Homo sapiens
ggcagccccattctgcctgccca

SEQ ID NO: 4748574 - DNA, 21 bp, Homo sapiens
ggcagctcagagagggtggga

SEQ ID NO: 4748575 - DNA, 24 bp, Homo sapiens
ggcagctgcggtccacccaggagc

SEQ ID NO: 4748576 - DNA, 16 bp, Homo sapiens
ggcaggagggcagtgg

SEQ ID NO: 4748577 - DNA, 15 bp, Homo sapiens
ggcaggatggcctgg

SEQ ID NO: 4748578 - DNA, 16 bp, Homo sapiens
ggcaggatggcctggc

SEQ ID NO: 4748579 - DNA, 13 bp, Homo sapiens
ggcaggcacagca

SEQ ID NO: 4748580 - DNA, 16 bp, Homo sapiens
ggcaggcacagcacag

SEQ ID NO: 4748581 - DNA, 20 bp, Homo sapiens
ggcaggcatggctggtgcct

SEQ ID NO: 4748582 - DNA, 15 bp, Homo sapiens
ggcaggccctgcact

SEQ ID NO: 4748583 - DNA, 21 bp, Homo sapiens
ggcaggctaaggcgtggagct

SEQ ID NO: 4748584 - DNA, 19 bp, Homo sapiens
ggcaggctagaacctggca

SEQ ID NO: 4748585 - DNA, 20 bp, Homo sapiens
ggcagggaacatggggagga

SEQ ID NO: 4748586 - DNA, 18 bp, Homo sapiens
ggcagggagggcctgggc

SEQ ID NO: 4748587 - DNA, 16 bp, Homo sapiens
ggcagggccccaggca

SEQ ID NO: 4748588 - DNA, 19 bp, Homo sapiens
ggcagggtctcactctgtc

SEQ ID NO: 4748589 - DNA, 22 bp, Homo sapiens
ggcagtcattcagcaccagagc

SEQ ID NO: 4748590 - DNA, 19 bp, Homo sapiens
ggcagtcgatagagctgta

SEQ ID NO: 4748591 - DNA, 16 bp, Homo sapiens
ggcagtgccagggcag

SEQ ID NO: 4748592 - DNA, 13 bp, Homo sapiens
ggcagtgggaaaa

SEQ ID NO: 4748593 - DNA, 17 bp, Homo sapiens
ggcagtgggagctgcct

SEQ ID NO: 4748594 - DNA, 20 bp, Homo sapiens
ggcagtgggtcccacttccc

SEQ ID NO: 4748595 - DNA, 16 bp, Homo sapiens
ggcagtgtttaaaatg

SEQ ID NO: 4748596 - DNA, 15 bp, Homo sapiens
ggcagtttttctgta

SEQ ID NO: 4748597 - DNA, 16 bp, Homo sapiens
ggcagtttttctgtat

SEQ ID NO: 4748598 - DNA, 12 bp, Homo sapiens
ggcataaagtaa

SEQ ID NO: 4748599 - DNA, 20 bp, Homo sapiens
ggcatatattaaaagcaggc

SEQ ID NO: 4748600 - DNA, 20 bp, Homo sapiens
ggcatcgcaatgtaagactc

SEQ ID NO: 4748601 - DNA, 21 bp, Homo sapiens
ggcatctagagcttgatgcca

SEQ ID NO: 4748602 - DNA, 22 bp, Homo sapiens
ggcatctagagcttgatgccag

SEQ ID NO: 4748603 - DNA, 22 bp, Homo sapiens
ggcatgaagtttccttggctgg

SEQ ID NO: 4748604 - DNA, 17 bp, Homo sapiens
ggcatggctggtgcctg

SEQ ID NO: 4748605 - DNA, 20 bp, Homo sapiens
ggcatgggtcgggagagggg

SEQ ID NO: 4748606 - DNA, 18 bp, Homo sapiens
ggcatgtgggttgtgata

SEQ ID NO: 4748607 - DNA, 19 bp, Homo sapiens
ggcatgtgggttgtgatat

SEQ ID NO: 4748608 - DNA, 15 bp, Homo sapiens
ggcattccccaggag

SEQ ID NO: 4748609 - DNA, 16 bp, Homo sapiens
ggcattccccaggagg

SEQ ID NO: 4748610 - DNA, 17 bp, Homo sapiens
ggcattccccaggaggc

SEQ ID NO: 4748611 - DNA, 19 bp, Homo sapiens
ggcattccccaggaggcca

SEQ ID NO: 4748612 - DNA, 18 bp, Homo sapiens
ggcattggcagcaggtgc

SEQ ID NO: 4748613 - DNA, 15 bp, Homo sapiens
ggccaaagccaaagc

SEQ ID NO: 4748614 - DNA, 17 bp, Homo sapiens
ggccaacatggcgaaac

SEQ ID NO: 4748615 - DNA, 16 bp, Homo sapiens
ggccacaagacccttg

SEQ ID NO: 4748616 - DNA, 18 bp, Homo sapiens
ggccacatgggaggctca

SEQ ID NO: 4748617 - DNA, 13 bp, Homo sapiens
ggccacctcaccc

SEQ ID NO: 4748618 - DNA, 16 bp, Homo sapiens
ggccacctgcggtgct

SEQ ID NO: 4748619 - DNA, 14 bp, Homo sapiens
ggccactgaagata

SEQ ID NO: 4748620 - DNA, 21 bp, Homo sapiens
ggccacttctgggtggggcag

SEQ ID NO: 4748621 - DNA, 19 bp, Homo sapiens
ggccagagggagtgacaga

SEQ ID NO: 4748622 - DNA, 22 bp, Homo sapiens
ggccagagggagtgacagaggc

SEQ ID NO: 4748623 - DNA, 19 bp, Homo sapiens
ggccagagtattggtctcc

SEQ ID NO: 4748624 - DNA, 16 bp, Homo sapiens
ggccagatgcaccagc

SEQ ID NO: 4748625 - DNA, 21 bp, Homo sapiens
ggccagatgtcgctgggtcct

SEQ ID NO: 4748626 - DNA, 13 bp, Homo sapiens
ggccagccccaca

SEQ ID NO: 4748627 - DNA, 15 bp, Homo sapiens
ggccagccccacagc

SEQ ID NO: 4748628 - DNA, 19 bp, Homo sapiens
ggccagccccacagcccac

SEQ ID NO: 4748629 - DNA, 18 bp, Homo sapiens
ggccagccctcccagcag

SEQ ID NO: 4748630 - DNA, 19 bp, Homo sapiens
ggccaggaccaagggcaga

SEQ ID NO: 4748631 - DNA, 21 bp, Homo sapiens
ggccaggaccaagggcagagg

SEQ ID NO: 4748632 - DNA, 14 bp, Homo sapiens
ggccaggactctgc

SEQ ID NO: 4748633 - DNA, 16 bp, Homo sapiens
ggccaggactctgcag

SEQ ID NO: 4748634 - DNA, 20 bp, Homo sapiens
ggccaggactctgcagcctc

SEQ ID NO: 4748635 - DNA, 16 bp, Homo sapiens
ggccaggccagaggga

SEQ ID NO: 4748636 - DNA, 18 bp, Homo sapiens
ggccaggccctctgccca

SEQ ID NO: 4748637 - DNA, 11 bp, Homo sapiens
ggccaggctgc

SEQ ID NO: 4748638 - DNA, 12 bp, Homo sapiens
ggccaggctggt

SEQ ID NO: 4748639 - DNA, 12 bp, Homo sapiens
ggccagggcctg

SEQ ID NO: 4748640 - DNA, 23 bp, Homo sapiens
ggccaggtgggcgggcagcacag

SEQ ID NO: 4748641 - DNA, 16 bp, Homo sapiens
ggccagtgtgacaagg

SEQ ID NO: 4748642 - DNA, 15 bp, Homo sapiens
ggccatactggcctc

SEQ ID NO: 4748643 - DNA, 19 bp, Homo sapiens
ggccatctctggatgcctg

SEQ ID NO: 4748644 - DNA, 19 bp, Homo sapiens
ggccatcttccaggtgggg

SEQ ID NO: 4748645 - DNA, 14 bp, Homo sapiens
ggccattaggaaac

SEQ ID NO: 4748646 - DNA, 17 bp, Homo sapiens
ggccattaggaaactgt

SEQ ID NO: 4748647 - DNA, 19 bp, Homo sapiens
ggcccaccccacccacttc

SEQ ID NO: 4748648 - DNA, 12 bp, Homo sapiens
ggcccagagagg

SEQ ID NO: 4748649 - DNA, 20 bp, Homo sapiens
ggcccagagggcctgcaagg

SEQ ID NO: 4748650 - DNA, 13 bp, Homo sapiens
ggcccaggccatc

SEQ ID NO: 4748651 - DNA, 13 bp, Homo sapiens
ggcccatcccccc

SEQ ID NO: 4748652 - DNA, 14 bp, Homo sapiens
ggccccagcctggc

SEQ ID NO: 4748653 - DNA, 18 bp, Homo sapiens
ggccccagcctggcccag

SEQ ID NO: 4748654 - DNA, 21 bp, Homo sapiens
ggccccagcctggcccagctc

SEQ ID NO: 4748655 - DNA, 23 bp, Homo sapiens
ggccccagcctggcccagctccc

SEQ ID NO: 4748656 - DNA, 22 bp, Homo sapiens
ggccccaggcattgccaagggc

SEQ ID NO: 4748657 - DNA, 19 bp, Homo sapiens
ggcccctcagggtccctgg

SEQ ID NO: 4748658 - DNA, 20 bp, Homo sapiens
ggcccctcagggtccctggt

SEQ ID NO: 4748659 - DNA, 12 bp, Homo sapiens
ggcccctctcct

SEQ ID NO: 4748660 - DNA, 22 bp, Homo sapiens
ggcccctctcctccgtggcaca

SEQ ID NO: 4748661 - DNA, 23 bp, Homo sapiens
ggcccctctcctccgtggcacat

SEQ ID NO: 4748662 - DNA, 13 bp, Homo sapiens
ggcccctgtgagt

SEQ ID NO: 4748663 - DNA, 13 bp, Homo sapiens
ggcccgcttgcct

SEQ ID NO: 4748664 - DNA, 23 bp, Homo sapiens
ggcccgcttgcctcggctcctgc

SEQ ID NO: 4748665 - DNA, 13 bp, Homo sapiens
ggcccggctccag

SEQ ID NO: 4748666 - DNA, 17 bp, Homo sapiens
ggcccgttgtctccctg

SEQ ID NO: 4748667 - DNA, 18 bp, Homo sapiens
ggcccgttgtctccctgg

SEQ ID NO: 4748668 - DNA, 16 bp, Homo sapiens
ggccctcaaggcctcc

SEQ ID NO: 4748669 - DNA, 18 bp, Homo sapiens
ggccctcaaggcctccca

SEQ ID NO: 4748670 - DNA, 23 bp, Homo sapiens
ggccctcaaggcctcccacagtg

SEQ ID NO: 4748671 - DNA, 15 bp, Homo sapiens
ggccctcgctgccag

SEQ ID NO: 4748672 - DNA, 16 bp, Homo sapiens
ggccctctcccctgcc

SEQ ID NO: 4748673 - DNA, 13 bp, Homo sapiens
ggccctctgccca

SEQ ID NO: 4748674 - DNA, 16 bp, Homo sapiens
ggccctctgcccactc

SEQ ID NO: 4748675 - DNA, 20 bp, Homo sapiens
ggccctctgcccactccctg

SEQ ID NO: 4748676 - DNA, 19 bp, Homo sapiens
ggccctgcaaaaggactct

SEQ ID NO: 4748677 - DNA, 17 bp, Homo sapiens
ggccctgcactgtcctg

SEQ ID NO: 4748678 - DNA, 19 bp, Homo sapiens
ggccctgcactgtcctgct

SEQ ID NO: 4748679 - DNA, 23 bp, Homo sapiens
ggccctgcactgtcctgctccac

SEQ ID NO: 4748680 - DNA, 11 bp, Homo sapiens
ggccctgccct

SEQ ID NO: 4748681 - DNA, 14 bp, Homo sapiens
ggccctgcctcctt

SEQ ID NO: 4748682 - DNA, 15 bp, Homo sapiens
ggccctgcctccttt

SEQ ID NO: 4748683 - DNA, 13 bp, Homo sapiens
ggccctgcctctg

SEQ ID NO: 4748684 - DNA, 16 bp, Homo sapiens
ggccctgctgcccctc

SEQ ID NO: 4748685 - DNA, 19 bp, Homo sapiens
ggcccttcccacaggacat

SEQ ID NO: 4748686 - DNA, 16 bp, Homo sapiens
ggcccttctctccagc

SEQ ID NO: 4748687 - DNA, 17 bp, Homo sapiens
ggcccttctctccagcc

SEQ ID NO: 4748688 - DNA, 19 bp, Homo sapiens
ggcccttctctccagcccc

SEQ ID NO: 4748689 - DNA, 20 bp, Homo sapiens
ggcccttctctccagcccct

SEQ ID NO: 4748690 - DNA, 21 bp, Homo sapiens
ggccgatgtgggtccctctct

SEQ ID NO: 4748691 - DNA, 22 bp, Homo sapiens
ggccgcgccaaataatgtctct

SEQ ID NO: 4748692 - DNA, 23 bp, Homo sapiens
ggccgggaccccgagcctggctc

SEQ ID NO: 4748693 - DNA, 20 bp, Homo sapiens
ggccgtatgaagacagaggc

SEQ ID NO: 4748694 - DNA, 15 bp, Homo sapiens
ggccgtcctgagggg

SEQ ID NO: 4748695 - DNA, 21 bp, Homo sapiens
ggccgttgatgttggctggga

SEQ ID NO: 4748696 - DNA, 15 bp, Homo sapiens
ggcctaccttgtgag

SEQ ID NO: 4748697 - DNA, 20 bp, Homo sapiens
ggcctatcagtgtgcccccc

SEQ ID NO: 4748698 - DNA, 19 bp, Homo sapiens
ggcctcccaactcacccca

SEQ ID NO: 4748699 - DNA, 13 bp, Homo sapiens
ggcctcccacagt

SEQ ID NO: 4748700 - DNA, 11 bp, Homo sapiens
ggcctccccca

SEQ ID NO: 4748701 - DNA, 14 bp, Homo sapiens
ggcctcctgtgtgt

SEQ ID NO: 4748702 - DNA, 17 bp, Homo sapiens
ggcctcgcctggcctga

SEQ ID NO: 4748703 - DNA, 20 bp, Homo sapiens
ggcctcggacttagctggga

SEQ ID NO: 4748704 - DNA, 13 bp, Homo sapiens
ggcctctgcactc

SEQ ID NO: 4748705 - DNA, 15 bp, Homo sapiens
ggcctctgcactccc

SEQ ID NO: 4748706 - DNA, 20 bp, Homo sapiens
ggcctgagatttcatctgct

SEQ ID NO: 4748707 - DNA, 18 bp, Homo sapiens
ggcctgagcgctcctgcc

SEQ ID NO: 4748708 - DNA, 19 bp, Homo sapiens
ggcctgccacctggacccc

SEQ ID NO: 4748709 - DNA, 19 bp, Homo sapiens
ggcctgcctccagggctgg

SEQ ID NO: 4748710 - DNA, 18 bp, Homo sapiens
ggcctgccttctcaggga

SEQ ID NO: 4748711 - DNA, 12 bp, Homo sapiens
ggcctggcacag

SEQ ID NO: 4748712 - DNA, 12 bp, Homo sapiens
ggcctggccaga

SEQ ID NO: 4748713 - DNA, 22 bp, Homo sapiens
ggcctggccagggcctggaaga

SEQ ID NO: 4748714 - DNA, 15 bp, Homo sapiens
ggcctggcctgagct

SEQ ID NO: 4748715 - DNA, 16 bp, Homo sapiens
ggcctggcctgagctg

SEQ ID NO: 4748716 - DNA, 13 bp, Homo sapiens
ggccttggcaggc

SEQ ID NO: 4748717 - DNA, 23 bp, Homo sapiens
ggcgcagcatattcaggaagctc

SEQ ID NO: 4748718 - DNA, 24 bp, Homo sapiens
ggcgcagcatattcaggaagctca

SEQ ID NO: 4748719 - DNA, 14 bp, Homo sapiens
ggcgccctctgtcc

SEQ ID NO: 4748720 - DNA, 17 bp, Homo sapiens
ggcgccctctgtcctga

SEQ ID NO: 4748721 - DNA, 22 bp, Homo sapiens
ggcgggtgcctgtaatcccagc

SEQ ID NO: 4748722 - DNA, 17 bp, Homo sapiens
ggcgtcctctccctcct

SEQ ID NO: 4748723 - DNA, 22 bp, Homo sapiens
ggcgtcctctccctcctggcca

SEQ ID NO: 4748724 - DNA, 23 bp, Homo sapiens
ggcgtcctctccctcctggccag

SEQ ID NO: 4748725 - DNA, 14 bp, Homo sapiens
ggcgtgagacctgc

SEQ ID NO: 4748726 - DNA, 19 bp, Homo sapiens
ggctaacatttaggagaag

SEQ ID NO: 4748727 - DNA, 19 bp, Homo sapiens
ggctaccctgagctgaggc

SEQ ID NO: 4748728 - DNA, 21 bp, Homo sapiens
ggctagaacctagaagggcta

SEQ ID NO: 4748729 - DNA, 14 bp, Homo sapiens
ggctagaacctggc

SEQ ID NO: 4748730 - DNA, 15 bp, Homo sapiens
ggctagaactggaga

SEQ ID NO: 4748731 - DNA, 13 bp, Homo sapiens
ggctagaatctgg

SEQ ID NO: 4748732 - DNA, 22 bp, Homo sapiens
ggctagaatctggagagctaga

SEQ ID NO: 4748733 - DNA, 22 bp, Homo sapiens
ggctaggacccctccatgtggg

SEQ ID NO: 4748734 - DNA, 18 bp, Homo sapiens
ggctattttctaaagact

SEQ ID NO: 4748735 - DNA, 21 bp, Homo sapiens
ggctcaagtcctcttttctga

SEQ ID NO: 4748736 - DNA, 17 bp, Homo sapiens
ggctcacccccttctcc

SEQ ID NO: 4748737 - DNA, 17 bp, Homo sapiens
ggctcactatggtgcca

SEQ ID NO: 4748738 - DNA, 18 bp, Homo sapiens
ggctcactatggtgccaa

SEQ ID NO: 4748739 - DNA, 19 bp, Homo sapiens
ggctcactatggtgccaat

SEQ ID NO: 4748740 - DNA, 14 bp, Homo sapiens
ggctcactgcagcc

SEQ ID NO: 4748741 - DNA, 16 bp, Homo sapiens
ggctcactgcagcctc

SEQ ID NO: 4748742 - DNA, 23 bp, Homo sapiens
ggctcagccaggtgctgtgacac

SEQ ID NO: 4748743 - DNA, 22 bp, Homo sapiens
ggctcagccccaccccagggca

SEQ ID NO: 4748744 - DNA, 19 bp, Homo sapiens
ggctcagcggggacagctc

SEQ ID NO: 4748745 - DNA, 20 bp, Homo sapiens
ggctcaggtggggtcactct

SEQ ID NO: 4748746 - DNA, 18 bp, Homo sapiens
ggctccacacctccaatg

SEQ ID NO: 4748747 - DNA, 12 bp, Homo sapiens
ggctccagctgg

SEQ ID NO: 4748748 - DNA, 14 bp, Homo sapiens
ggctccaggctcct

SEQ ID NO: 4748749 - DNA, 13 bp, Homo sapiens
ggctcccttccca

SEQ ID NO: 4748750 - DNA, 18 bp, Homo sapiens
ggctcccttcccacctct

SEQ ID NO: 4748751 - DNA, 12 bp, Homo sapiens
ggctcctgctgc

SEQ ID NO: 4748752 - DNA, 15 bp, Homo sapiens
ggctcctgctgcacc

SEQ ID NO: 4748753 - DNA, 21 bp, Homo sapiens
ggctcctgctgcaccaaccca

SEQ ID NO: 4748754 - DNA, 13 bp, Homo sapiens
ggctcctgtgccc

SEQ ID NO: 4748755 - DNA, 14 bp, Homo sapiens
ggctcctgttttgc

SEQ ID NO: 4748756 - DNA, 17 bp, Homo sapiens
ggctctgagacacaccc

SEQ ID NO: 4748757 - DNA, 14 bp, Homo sapiens
ggctctgcccttgg

SEQ ID NO: 4748758 - DNA, 15 bp, Homo sapiens
ggctctgcccttggt

SEQ ID NO: 4748759 - DNA, 12 bp, Homo sapiens
ggctctgtgggc

SEQ ID NO: 4748760 - DNA, 14 bp, Homo sapiens
ggctctgtgggctg

SEQ ID NO: 4748761 - DNA, 12 bp, Homo sapiens
ggctcttccagg

SEQ ID NO: 4748762 - DNA, 20 bp, Homo sapiens
ggctcttccaggctgggaga

SEQ ID NO: 4748763 - DNA, 23 bp, Homo sapiens
ggctcttccaggctgggagagcc

SEQ ID NO: 4748764 - DNA, 13 bp, Homo sapiens
ggctcttctcatt

SEQ ID NO: 4748765 - DNA, 16 bp, Homo sapiens
ggctcttctccccaga

SEQ ID NO: 4748766 - DNA, 13 bp, Homo sapiens
ggctgaaggactg

SEQ ID NO: 4748767 - DNA, 22 bp, Homo sapiens
ggctgacagacagccctccatc

SEQ ID NO: 4748768 - DNA, 15 bp, Homo sapiens
ggctgagagagtggc

SEQ ID NO: 4748769 - DNA, 15 bp, Homo sapiens
ggctgagggagcctg

SEQ ID NO: 4748770 - DNA, 18 bp, Homo sapiens
ggctgcaaagggtatcag

SEQ ID NO: 4748771 - DNA, 18 bp, Homo sapiens
ggctgcactctgtgccca

SEQ ID NO: 4748772 - DNA, 21 bp, Homo sapiens
ggctgcactctgtgcccatgg

SEQ ID NO: 4748773 - DNA, 17 bp, Homo sapiens
ggctgcccgctcccagt

SEQ ID NO: 4748774 - DNA, 11 bp, Homo sapiens
ggctgcccttt

SEQ ID NO: 4748775 - DNA, 12 bp, Homo sapiens
ggctgcctccac

SEQ ID NO: 4748776 - DNA, 13 bp, Homo sapiens
ggctgctgaaggc

SEQ ID NO: 4748777 - DNA, 14 bp, Homo sapiens
ggctggactgaggc

SEQ ID NO: 4748778 - DNA, 14 bp, Homo sapiens
ggctggccagcccc

SEQ ID NO: 4748779 - DNA, 15 bp, Homo sapiens
ggctggccagcccca

SEQ ID NO: 4748780 - DNA, 18 bp, Homo sapiens
ggctggccagccccacag

SEQ ID NO: 4748781 - DNA, 20 bp, Homo sapiens
ggctggccagccccacagcc

SEQ ID NO: 4748782 - DNA, 13 bp, Homo sapiens
ggctggcctggcc

SEQ ID NO: 4748783 - DNA, 20 bp, Homo sapiens
ggctggcgtgcagtggtgcg

SEQ ID NO: 4748784 - DNA, 12 bp, Homo sapiens
ggctggctgggg

SEQ ID NO: 4748785 - DNA, 18 bp, Homo sapiens
ggctgggaaccagggagg

SEQ ID NO: 4748786 - DNA, 19 bp, Homo sapiens
ggctgggaactcacctggg

SEQ ID NO: 4748787 - DNA, 14 bp, Homo sapiens
ggctgggagagcct

SEQ ID NO: 4748788 - DNA, 15 bp, Homo sapiens
ggctgggagagcctt

SEQ ID NO: 4748789 - DNA, 16 bp, Homo sapiens
ggctgggagagccttc

SEQ ID NO: 4748790 - DNA, 19 bp, Homo sapiens
ggctgggagagccttccag

SEQ ID NO: 4748791 - DNA, 23 bp, Homo sapiens
ggctgggagagccttccaggggt

SEQ ID NO: 4748792 - DNA, 17 bp, Homo sapiens
ggctgggcttcagtggc

SEQ ID NO: 4748793 - DNA, 17 bp, Homo sapiens
ggctggggaagtcctct

SEQ ID NO: 4748794 - DNA, 22 bp, Homo sapiens
ggctggggcctatcagtgtgcc

SEQ ID NO: 4748795 - DNA, 16 bp, Homo sapiens
ggctgggttggcgcac

SEQ ID NO: 4748796 - DNA, 19 bp, Homo sapiens
ggctgggttggcgcaccct

SEQ ID NO: 4748797 - DNA, 20 bp, Homo sapiens
ggctgggttggcgcaccctc

SEQ ID NO: 4748798 - DNA, 23 bp, Homo sapiens
ggctggtgcctgaagaccccaga

SEQ ID NO: 4748799 - DNA, 23 bp, Homo sapiens
ggctggttcggatttggggtgga

SEQ ID NO: 4748800 - DNA, 19 bp, Homo sapiens
ggctgtatcccatgagcct

SEQ ID NO: 4748801 - DNA, 23 bp, Homo sapiens
ggctgtatcccatgagcctcagc

SEQ ID NO: 4748802 - DNA, 16 bp, Homo sapiens
ggctgtccagtgccca

SEQ ID NO: 4748803 - DNA, 23 bp, Homo sapiens
ggctgtcccaagctcccaagagc

SEQ ID NO: 4748804 - DNA, 16 bp, Homo sapiens
ggctgttggctggggg

SEQ ID NO: 4748805 - DNA, 21 bp, Homo sapiens
ggctgtttactgcttttcatt

SEQ ID NO: 4748806 - DNA, 21 bp, Homo sapiens
ggcttaattattgatgttttc

SEQ ID NO: 4748807 - DNA, 16 bp, Homo sapiens
ggcttatccagctggt

SEQ ID NO: 4748808 - DNA, 18 bp, Homo sapiens
ggcttcagtggcagctgc

SEQ ID NO: 4748809 - DNA, 21 bp, Homo sapiens
ggcttcccagtggctgctgcc

SEQ ID NO: 4748810 - DNA, 22 bp, Homo sapiens
ggcttcccagtggctgctgccc

SEQ ID NO: 4748811 - DNA, 16 bp, Homo sapiens
ggcttcctcatagtat

SEQ ID NO: 4748812 - DNA, 15 bp, Homo sapiens
ggcttctttctccct

SEQ ID NO: 4748813 - DNA, 11 bp, Homo sapiens
ggcttgctgcc

SEQ ID NO: 4748814 - DNA, 17 bp, Homo sapiens
gggaaaattatttgcat

SEQ ID NO: 4748815 - DNA, 14 bp, Homo sapiens
gggaaactgtgaat

SEQ ID NO: 4748816 - DNA, 16 bp, Homo sapiens
gggaacatatttaagg

SEQ ID NO: 4748817 - DNA, 14 bp, Homo sapiens
gggaacatggggag

SEQ ID NO: 4748818 - DNA, 23 bp, Homo sapiens
gggaactcacctggggctgctgg

SEQ ID NO: 4748819 - DNA, 22 bp, Homo sapiens
gggaagacccattccttcccag

SEQ ID NO: 4748820 - DNA, 15 bp, Homo sapiens
gggaagagcacagcc

SEQ ID NO: 4748821 - DNA, 22 bp, Homo sapiens
gggaagagcacagccctcccgc

SEQ ID NO: 4748822 - DNA, 17 bp, Homo sapiens
gggaatgcctgagtgcc

SEQ ID NO: 4748823 - DNA, 16 bp, Homo sapiens
gggaatggcacagccc

SEQ ID NO: 4748824 - DNA, 21 bp, Homo sapiens
gggaatgtttgcctctgcctc

SEQ ID NO: 4748825 - DNA, 17 bp, Homo sapiens
gggaattttgtttttag

SEQ ID NO: 4748826 - DNA, 23 bp, Homo sapiens
gggacaaggactagggtcctggg

SEQ ID NO: 4748827 - DNA, 14 bp, Homo sapiens
gggacaccctgtga

SEQ ID NO: 4748828 - DNA, 21 bp, Homo sapiens
gggacagctccttctgtccta

SEQ ID NO: 4748829 - DNA, 23 bp, Homo sapiens
gggaccacagcaaggcacctgca

SEQ ID NO: 4748830 - DNA, 23 bp, Homo sapiens
gggaccccacccctcatcaggag

SEQ ID NO: 4748831 - DNA, 20 bp, Homo sapiens
gggaccccgagcctggctcc

SEQ ID NO: 4748832 - DNA, 21 bp, Homo sapiens
gggacctgatggagagtgaga

SEQ ID NO: 4748833 - DNA, 18 bp, Homo sapiens
gggacgcaggcccctctc

SEQ ID NO: 4748834 - DNA, 21 bp, Homo sapiens
gggacgcctgggggtgccagg

SEQ ID NO: 4748835 - DNA, 20 bp, Homo sapiens
gggagactgggctgagggag

SEQ ID NO: 4748836 - DNA, 20 bp, Homo sapiens
gggagagacttggatgagga

SEQ ID NO: 4748837 - DNA, 22 bp, Homo sapiens
gggagagacttggatgaggagt

SEQ ID NO: 4748838 - DNA, 15 bp, Homo sapiens
gggagagccttccag

SEQ ID NO: 4748839 - DNA, 19 bp, Homo sapiens
gggagagccttccaggggt

SEQ ID NO: 4748840 - DNA, 19 bp, Homo sapiens
gggagaggggacgcaggcc

SEQ ID NO: 4748841 - DNA, 16 bp, Homo sapiens
gggagcatggctgtga

SEQ ID NO: 4748842 - DNA, 22 bp, Homo sapiens
gggagctgcctgttcagctcca

SEQ ID NO: 4748843 - DNA, 22 bp, Homo sapiens
gggaggatgttctgggacacag

SEQ ID NO: 4748844 - DNA, 21 bp, Homo sapiens
gggaggccggcgcagcgcaga

SEQ ID NO: 4748845 - DNA, 15 bp, Homo sapiens
gggagggagggctcc

SEQ ID NO: 4748846 - DNA, 13 bp, Homo sapiens
gggagggcagcag

SEQ ID NO: 4748847 - DNA, 13 bp, Homo sapiens
gggaggggcccgc

SEQ ID NO: 4748848 - DNA, 18 bp, Homo sapiens
gggagtgacagaggcagc

SEQ ID NO: 4748849 - DNA, 15 bp, Homo sapiens
gggatacatgctctt

SEQ ID NO: 4748850 - DNA, 15 bp, Homo sapiens
gggatcctccaggtg

SEQ ID NO: 4748851 - DNA, 11 bp, Homo sapiens
gggatgaaaga

SEQ ID NO: 4748852 - DNA, 15 bp, Homo sapiens
gggatgggacctgat

SEQ ID NO: 4748853 - DNA, 20 bp, Homo sapiens
gggatgggacctgatgacct

SEQ ID NO: 4748854 - DNA, 13 bp, Homo sapiens
gggatggtgccct

SEQ ID NO: 4748855 - DNA, 16 bp, Homo sapiens
gggattacaggctcct

SEQ ID NO: 4748856 - DNA, 12 bp, Homo sapiens
gggattacaggt

SEQ ID NO: 4748857 - DNA, 15 bp, Homo sapiens
gggatttccatgatg

SEQ ID NO: 4748858 - DNA, 16 bp, Homo sapiens
gggcaacccccagcct

SEQ ID NO: 4748859 - DNA, 18 bp, Homo sapiens
gggcaacccccagcctgc

SEQ ID NO: 4748860 - DNA, 23 bp, Homo sapiens
gggcacaccgggcactcagaaga

SEQ ID NO: 4748861 - DNA, 14 bp, Homo sapiens
gggcaccggggcct

SEQ ID NO: 4748862 - DNA, 19 bp, Homo sapiens
gggcactcagaagacactg

SEQ ID NO: 4748863 - DNA, 20 bp, Homo sapiens
gggcactcagaagacactga

SEQ ID NO: 4748864 - DNA, 19 bp, Homo sapiens
gggcagacattatgtaaaa

SEQ ID NO: 4748865 - DNA, 20 bp, Homo sapiens
gggcagaccctgagcagaat

SEQ ID NO: 4748866 - DNA, 11 bp, Homo sapiens
gggcagagcag

SEQ ID NO: 4748867 - DNA, 14 bp, Homo sapiens
gggcagccagggag

SEQ ID NO: 4748868 - DNA, 22 bp, Homo sapiens
gggcagccagggagagcccagg

SEQ ID NO: 4748869 - DNA, 12 bp, Homo sapiens
gggcagccctcc

SEQ ID NO: 4748870 - DNA, 14 bp, Homo sapiens
gggcagccctcctt

SEQ ID NO: 4748871 - DNA, 15 bp, Homo sapiens
gggcaggcacagcac

SEQ ID NO: 4748872 - DNA, 17 bp, Homo sapiens
gggcaggccctgcactg

SEQ ID NO: 4748873 - DNA, 19 bp, Homo sapiens
gggcaggccctgcactgtc

SEQ ID NO: 4748874 - DNA, 21 bp, Homo sapiens
gggcaggccctgcactgtcct

SEQ ID NO: 4748875 - DNA, 18 bp, Homo sapiens
gggcagtgggtcccagat

SEQ ID NO: 4748876 - DNA, 14 bp, Homo sapiens
gggcataaagtaaa

SEQ ID NO: 4748877 - DNA, 16 bp, Homo sapiens
gggccacagagaaagt

SEQ ID NO: 4748878 - DNA, 19 bp, Homo sapiens
gggccacatgggaggctca

SEQ ID NO: 4748879 - DNA, 20 bp, Homo sapiens
gggccagagtattggtctcc

SEQ ID NO: 4748880 - DNA, 22 bp, Homo sapiens
gggccagttggtcccccttcca

SEQ ID NO: 4748881 - DNA, 15 bp, Homo sapiens
gggccatactggcct

SEQ ID NO: 4748882 - DNA, 22 bp, Homo sapiens
gggccatactggcctcgcctgg

SEQ ID NO: 4748883 - DNA, 15 bp, Homo sapiens
gggccatagctcctg

SEQ ID NO: 4748884 - DNA, 17 bp, Homo sapiens
gggccatcctgtcccac

SEQ ID NO: 4748885 - DNA, 20 bp, Homo sapiens
gggccatgctgagagctggg

SEQ ID NO: 4748886 - DNA, 17 bp, Homo sapiens
gggcccagagagggtgg

SEQ ID NO: 4748887 - DNA, 14 bp, Homo sapiens
gggcccatggagga

SEQ ID NO: 4748888 - DNA, 21 bp, Homo sapiens
gggcccatggaggagacagga

SEQ ID NO: 4748889 - DNA, 13 bp, Homo sapiens
gggcccgcttgcc

SEQ ID NO: 4748890 - DNA, 23 bp, Homo sapiens
gggcccgcttgcctcggctcctg

SEQ ID NO: 4748891 - DNA, 16 bp, Homo sapiens
gggcccgttgtctccc

SEQ ID NO: 4748892 - DNA, 18 bp, Homo sapiens
gggcccgttgtctccctg

SEQ ID NO: 4748893 - DNA, 17 bp, Homo sapiens
gggccctttgagtgcag

SEQ ID NO: 4748894 - DNA, 22 bp, Homo sapiens
gggcctatcagtgtgcccccca

SEQ ID NO: 4748895 - DNA, 22 bp, Homo sapiens
gggcctcggacttagctgggag

SEQ ID NO: 4748896 - DNA, 11 bp, Homo sapiens
gggcctgccac

SEQ ID NO: 4748897 - DNA, 16 bp, Homo sapiens
gggcctgccacctgga

SEQ ID NO: 4748898 - DNA, 13 bp, Homo sapiens
gggcctggcctga

SEQ ID NO: 4748899 - DNA, 19 bp, Homo sapiens
gggcgtgagacctgcccct

SEQ ID NO: 4748900 - DNA, 16 bp, Homo sapiens
gggctacaaaggagga

SEQ ID NO: 4748901 - DNA, 22 bp, Homo sapiens
gggctaccctgagctgaggcag

SEQ ID NO: 4748902 - DNA, 12 bp, Homo sapiens
gggctagaatct

SEQ ID NO: 4748903 - DNA, 16 bp, Homo sapiens
gggctcagagaggaca

SEQ ID NO: 4748904 - DNA, 17 bp, Homo sapiens
gggctcagagaggacaa

SEQ ID NO: 4748905 - DNA, 22 bp, Homo sapiens
gggctcagagaggacaaaataa

SEQ ID NO: 4748906 - DNA, 17 bp, Homo sapiens
gggctcagggaccacag

SEQ ID NO: 4748907 - DNA, 14 bp, Homo sapiens
gggctccctgactg

SEQ ID NO: 4748908 - DNA, 21 bp, Homo sapiens
gggctccctgtaacctcttca

SEQ ID NO: 4748909 - DNA, 14 bp, Homo sapiens
gggctcccttccca

SEQ ID NO: 4748910 - DNA, 17 bp, Homo sapiens
gggctctgcctcccatc

SEQ ID NO: 4748911 - DNA, 16 bp, Homo sapiens
gggctctgtgggctgc

SEQ ID NO: 4748912 - DNA, 19 bp, Homo sapiens
gggctgcactctgtgccca

SEQ ID NO: 4748913 - DNA, 20 bp, Homo sapiens
gggctgcactctgtgcccat

SEQ ID NO: 4748914 - DNA, 15 bp, Homo sapiens
gggctgcccgctccc

SEQ ID NO: 4748915 - DNA, 18 bp, Homo sapiens
gggctgcccgctcccagt

SEQ ID NO: 4748916 - DNA, 19 bp, Homo sapiens
gggctgcccgctcccagtg

SEQ ID NO: 4748917 - DNA, 12 bp, Homo sapiens
gggctgctgtga

SEQ ID NO: 4748918 - DNA, 15 bp, Homo sapiens
gggctggactgaggc

SEQ ID NO: 4748919 - DNA, 17 bp, Homo sapiens
gggctggaggagcccag

SEQ ID NO: 4748920 - DNA, 23 bp, Homo sapiens
gggctggaggagcccaggccagg

SEQ ID NO: 4748921 - DNA, 22 bp, Homo sapiens
gggctgggttctacccaggtgc

SEQ ID NO: 4748922 - DNA, 14 bp, Homo sapiens
gggcttagagcagt

SEQ ID NO: 4748923 - DNA, 24 bp, Homo sapiens
gggcttagagcagtttctgtcctg

SEQ ID NO: 4748924 - DNA, 16 bp, Homo sapiens
gggcttcactgtataa

SEQ ID NO: 4748925 - DNA, 14 bp, Homo sapiens
gggcttcagtggca

SEQ ID NO: 4748926 - DNA, 18 bp, Homo sapiens
gggcttcagtggcagctg

SEQ ID NO: 4748927 - DNA, 22 bp, Homo sapiens
gggcttcccagtggctgctgcc

SEQ ID NO: 4748928 - DNA, 14 bp, Homo sapiens
gggcttttttcttt

SEQ ID NO: 4748929 - DNA, 18 bp, Homo sapiens
ggggaagagcacagccct

SEQ ID NO: 4748930 - DNA, 15 bp, Homo sapiens
ggggaattcatctct

SEQ ID NO: 4748931 - DNA, 20 bp, Homo sapiens
ggggacagctccttctgtcc

SEQ ID NO: 4748932 - DNA, 13 bp, Homo sapiens
ggggacgcaggcc

SEQ ID NO: 4748933 - DNA, 14 bp, Homo sapiens
ggggacgcaggccc

SEQ ID NO: 4748934 - DNA, 16 bp, Homo sapiens
ggggacgcaggcccct

SEQ ID NO: 4748935 - DNA, 21 bp, Homo sapiens
ggggacgcaggcccctctcct

SEQ ID NO: 4748936 - DNA, 22 bp, Homo sapiens
ggggacgcaggcccctctcctc

SEQ ID NO: 4748937 - DNA, 18 bp, Homo sapiens
ggggagactgggctgagg

SEQ ID NO: 4748938 - DNA, 11 bp, Homo sapiens
ggggagagaag

SEQ ID NO: 4748939 - DNA, 13 bp, Homo sapiens
ggggaggaggagg

SEQ ID NO: 4748940 - DNA, 13 bp, Homo sapiens
ggggcaggcacag

SEQ ID NO: 4748941 - DNA, 17 bp, Homo sapiens
ggggcaggcacagcaca

SEQ ID NO: 4748942 - DNA, 15 bp, Homo sapiens
ggggcaggccctgca

SEQ ID NO: 4748943 - DNA, 16 bp, Homo sapiens
ggggcaggccctgcac

SEQ ID NO: 4748944 - DNA, 18 bp, Homo sapiens
ggggcaggccctgcactg

SEQ ID NO: 4748945 - DNA, 20 bp, Homo sapiens
ggggcatgacccagtgaaga

SEQ ID NO: 4748946 - DNA, 20 bp, Homo sapiens
ggggcccgcttgcctcggct

SEQ ID NO: 4748947 - DNA, 21 bp, Homo sapiens
ggggcccgcttgcctcggctc

SEQ ID NO: 4748948 - DNA, 19 bp, Homo sapiens
ggggcctatcagtgtgccc

SEQ ID NO: 4748949 - DNA, 14 bp, Homo sapiens
ggggctaatttaac

SEQ ID NO: 4748950 - DNA, 21 bp, Homo sapiens
ggggctgcaccggctggcctg

SEQ ID NO: 4748951 - DNA, 15 bp, Homo sapiens
ggggctgcccgctcc

SEQ ID NO: 4748952 - DNA, 13 bp, Homo sapiens
ggggctggaggag

SEQ ID NO: 4748953 - DNA, 22 bp, Homo sapiens
ggggctgggttggcgcaccctc

SEQ ID NO: 4748954 - DNA, 17 bp, Homo sapiens
gggggaagagcacagcc

SEQ ID NO: 4748955 - DNA, 19 bp, Homo sapiens
gggggaagagcacagccct

SEQ ID NO: 4748956 - DNA, 16 bp, Homo sapiens
gggggctggaggagcc

SEQ ID NO: 4748957 - DNA, 16 bp, Homo sapiens
gggggtcctcctccag

SEQ ID NO: 4748958 - DNA, 21 bp, Homo sapiens
ggggtaaagggcgcaaagggc

SEQ ID NO: 4748959 - DNA, 13 bp, Homo sapiens
ggggtagggggct

SEQ ID NO: 4748960 - DNA, 21 bp, Homo sapiens
ggggtcactctggcagctcag

SEQ ID NO: 4748961 - DNA, 16 bp, Homo sapiens
ggggtcatccttgccc

SEQ ID NO: 4748962 - DNA, 16 bp, Homo sapiens
ggggtggagtcccaga

SEQ ID NO: 4748963 - DNA, 17 bp, Homo sapiens
ggggtggagtcccagag

SEQ ID NO: 4748964 - DNA, 17 bp, Homo sapiens
ggggtggccgtcctgag

SEQ ID NO: 4748965 - DNA, 13 bp, Homo sapiens
ggggttgaagaaa

SEQ ID NO: 4748966 - DNA, 23 bp, Homo sapiens
gggtaaagggcgcaaagggcatg

SEQ ID NO: 4748967 - DNA, 13 bp, Homo sapiens
gggtacccactgc

SEQ ID NO: 4748968 - DNA, 18 bp, Homo sapiens
gggtacccactgctctgg

SEQ ID NO: 4748969 - DNA, 19 bp, Homo sapiens
gggtacttgtggacacagc

SEQ ID NO: 4748970 - DNA, 23 bp, Homo sapiens
gggtacttgtggacacagctctt

SEQ ID NO: 4748971 - DNA, 22 bp, Homo sapiens
gggtcactccaaggatcagaag

SEQ ID NO: 4748972 - DNA, 13 bp, Homo sapiens
gggtcatttttaa

SEQ ID NO: 4748973 - DNA, 15 bp, Homo sapiens
gggtcgggagagggg

SEQ ID NO: 4748974 - DNA, 14 bp, Homo sapiens
gggtctcactctgt

SEQ ID NO: 4748975 - DNA, 18 bp, Homo sapiens
gggtctctgctgccgccc

SEQ ID NO: 4748976 - DNA, 15 bp, Homo sapiens
gggtgatttctagaa

SEQ ID NO: 4748977 - DNA, 12 bp, Homo sapiens
gggtggaagctt

SEQ ID NO: 4748978 - DNA, 19 bp, Homo sapiens
gggtggcccatcccccctc

SEQ ID NO: 4748979 - DNA, 14 bp, Homo sapiens
gggtggccgtcctg

SEQ ID NO: 4748980 - DNA, 16 bp, Homo sapiens
gggtggccgtcctgag

SEQ ID NO: 4748981 - DNA, 19 bp, Homo sapiens
gggtggccgtcctgagggg

SEQ ID NO: 4748982 - DNA, 14 bp, Homo sapiens
gggtggcctcccaa

SEQ ID NO: 4748983 - DNA, 19 bp, Homo sapiens
gggtgggacaccctgtgat

SEQ ID NO: 4748984 - DNA, 15 bp, Homo sapiens
gggtggtggtgatag

SEQ ID NO: 4748985 - DNA, 22 bp, Homo sapiens
gggttcaagcgattcttctgct

SEQ ID NO: 4748986 - DNA, 23 bp, Homo sapiens
gggttcaagcgattcttctgctt

SEQ ID NO: 4748987 - DNA, 16 bp, Homo sapiens
gggttcatcatccctc

SEQ ID NO: 4748988 - DNA, 16 bp, Homo sapiens
gggttggcccctgccc

SEQ ID NO: 4748989 - DNA, 20 bp, Homo sapiens
gggttggcgcaccctcccct

SEQ ID NO: 4748990 - DNA, 15 bp, Homo sapiens
gggtttattcactga

SEQ ID NO: 4748991 - DNA, 20 bp, Homo sapiens
gggtttcaccatgttggcca

SEQ ID NO: 4748992 - DNA, 19 bp, Homo sapiens
ggtaagaatagtagatgtg

SEQ ID NO: 4748993 - DNA, 20 bp, Homo sapiens
ggtaccaggtctcctccacc

SEQ ID NO: 4748994 - DNA, 20 bp, Homo sapiens
ggtacttgtggacacagctc

SEQ ID NO: 4748995 - DNA, 20 bp, Homo sapiens
ggtagaaagagatacagagg

SEQ ID NO: 4748996 - DNA, 23 bp, Homo sapiens
ggtagaatgttttcaaatgttct

SEQ ID NO: 4748997 - DNA, 13 bp, Homo sapiens
ggtagggggctgg

SEQ ID NO: 4748998 - DNA, 11 bp, Homo sapiens
ggtagggtggg

SEQ ID NO: 4748999 - DNA, 18 bp, Homo sapiens
ggtatatatccgcctggc

SEQ ID NO: 4749000 - DNA, 19 bp, Homo sapiens
ggtatcaggtgctgccatc

SEQ ID NO: 4749001 - DNA, 16 bp, Homo sapiens
ggtcactctggcagct

SEQ ID NO: 4749002 - DNA, 20 bp, Homo sapiens
ggtcactctggcagctcaga

SEQ ID NO: 4749003 - DNA, 22 bp, Homo sapiens
ggtcactctggcagctcagaga

SEQ ID NO: 4749004 - DNA, 13 bp, Homo sapiens
ggtcagagcctgc

SEQ ID NO: 4749005 - DNA, 14 bp, Homo sapiens
ggtcagagcctgca

SEQ ID NO: 4749006 - DNA, 16 bp, Homo sapiens
ggtcagagcctgcagt

SEQ ID NO: 4749007 - DNA, 16 bp, Homo sapiens
ggtcatagcagtgctt

SEQ ID NO: 4749008 - DNA, 14 bp, Homo sapiens
ggtcatccttgccc

SEQ ID NO: 4749009 - DNA, 13 bp, Homo sapiens
ggtccaagtggct

SEQ ID NO: 4749010 - DNA, 12 bp, Homo sapiens
ggtccacccagg

SEQ ID NO: 4749011 - DNA, 13 bp, Homo sapiens
ggtccacccagga

SEQ ID NO: 4749012 - DNA, 19 bp, Homo sapiens
ggtccacccaggagccccg

SEQ ID NO: 4749013 - DNA, 20 bp, Homo sapiens
ggtccacccaggagccccga

SEQ ID NO: 4749014 - DNA, 11 bp, Homo sapiens
ggtccaggaga

SEQ ID NO: 4749015 - DNA, 14 bp, Homo sapiens
ggtccatgggcaga

SEQ ID NO: 4749016 - DNA, 16 bp, Homo sapiens
ggtccatgggcagagc

SEQ ID NO: 4749017 - DNA, 16 bp, Homo sapiens
ggtcccaccccacaca

SEQ ID NO: 4749018 - DNA, 17 bp, Homo sapiens
ggtcccaccccacacac

SEQ ID NO: 4749019 - DNA, 17 bp, Homo sapiens
ggtcccacttcccctcc

SEQ ID NO: 4749020 - DNA, 12 bp, Homo sapiens
ggtccctctctt

SEQ ID NO: 4749021 - DNA, 13 bp, Homo sapiens
ggtccctctcttg

SEQ ID NO: 4749022 - DNA, 14 bp, Homo sapiens
ggtcctcctccagg

SEQ ID NO: 4749023 - DNA, 19 bp, Homo sapiens
ggtcctcctccagggacag

SEQ ID NO: 4749024 - DNA, 15 bp, Homo sapiens
ggtcggtgccttcaa

SEQ ID NO: 4749025 - DNA, 13 bp, Homo sapiens
ggtctaatgtttg

SEQ ID NO: 4749026 - DNA, 12 bp, Homo sapiens
ggtctatttcta

SEQ ID NO: 4749027 - DNA, 21 bp, Homo sapiens
ggtctcactatgttgcccagg

SEQ ID NO: 4749028 - DNA, 12 bp, Homo sapiens
ggtctcactctg

SEQ ID NO: 4749029 - DNA, 19 bp, Homo sapiens
ggtctcgaactcctgacct

SEQ ID NO: 4749030 - DNA, 17 bp, Homo sapiens
ggtctctaggctgggga

SEQ ID NO: 4749031 - DNA, 19 bp, Homo sapiens
ggtctgaggaatccagacc

SEQ ID NO: 4749032 - DNA, 17 bp, Homo sapiens
ggtctgctcgggcccag

SEQ ID NO: 4749033 - DNA, 19 bp, Homo sapiens
ggtctgctcgggcccaggc

SEQ ID NO: 4749034 - DNA, 21 bp, Homo sapiens
ggtgacctctgcctgaagtca

SEQ ID NO: 4749035 - DNA, 16 bp, Homo sapiens
ggtgagaggggaacag

SEQ ID NO: 4749036 - DNA, 18 bp, Homo sapiens
ggtgatccacccacctca

SEQ ID NO: 4749037 - DNA, 23 bp, Homo sapiens
ggtgatccacccacctcagcctc

SEQ ID NO: 4749038 - DNA, 20 bp, Homo sapiens
ggtgcaatgggggagggagg

SEQ ID NO: 4749039 - DNA, 16 bp, Homo sapiens
ggtgcacaagctccaa

SEQ ID NO: 4749040 - DNA, 22 bp, Homo sapiens
ggtgccaatggaacctcctttc

SEQ ID NO: 4749041 - DNA, 18 bp, Homo sapiens
ggtgccacaaataaaatg

SEQ ID NO: 4749042 - DNA, 13 bp, Homo sapiens
ggtgcctgagccc

SEQ ID NO: 4749043 - DNA, 22 bp, Homo sapiens
ggtgctacacccttttccagct

SEQ ID NO: 4749044 - DNA, 16 bp, Homo sapiens
ggtgctatctccccca

SEQ ID NO: 4749045 - DNA, 20 bp, Homo sapiens
ggtgctatctcccccagccc

SEQ ID NO: 4749046 - DNA, 23 bp, Homo sapiens
ggtgctatctcccccagccccat

SEQ ID NO: 4749047 - DNA, 15 bp, Homo sapiens
ggtgctccaggcagg

SEQ ID NO: 4749048 - DNA, 23 bp, Homo sapiens
ggtgctgcagatttgatatttgc

SEQ ID NO: 4749049 - DNA, 13 bp, Homo sapiens
ggtgctgctaccc

SEQ ID NO: 4749050 - DNA, 16 bp, Homo sapiens
ggtgctgctaccctcc

SEQ ID NO: 4749051 - DNA, 17 bp, Homo sapiens
ggtgctgctaccctccc

SEQ ID NO: 4749052 - DNA, 19 bp, Homo sapiens
ggtgctgctaccctccctg

SEQ ID NO: 4749053 - DNA, 20 bp, Homo sapiens
ggtgctgctaccctccctgc

SEQ ID NO: 4749054 - DNA, 23 bp, Homo sapiens
ggtgctgctaccctccctgctgt

SEQ ID NO: 4749055 - DNA, 11 bp, Homo sapiens
ggtggcagctg

SEQ ID NO: 4749056 - DNA, 12 bp, Homo sapiens
ggtggcagctgc

SEQ ID NO: 4749057 - DNA, 13 bp, Homo sapiens
ggtggcagctgcg

SEQ ID NO: 4749058 - DNA, 23 bp, Homo sapiens
ggtggcagctgcggtccacccag

SEQ ID NO: 4749059 - DNA, 21 bp, Homo sapiens
ggtggccctctcccctgcccc

SEQ ID NO: 4749060 - DNA, 22 bp, Homo sapiens
ggtggccctctcccctgccccc

SEQ ID NO: 4749061 - DNA, 15 bp, Homo sapiens
ggtggccgtcctgag

SEQ ID NO: 4749062 - DNA, 13 bp, Homo sapiens
ggtggcctcccaa

SEQ ID NO: 4749063 - DNA, 22 bp, Homo sapiens
ggtggcctcccaactcacccca

SEQ ID NO: 4749064 - DNA, 23 bp, Homo sapiens
ggtggcctcccaactcaccccag

SEQ ID NO: 4749065 - DNA, 17 bp, Homo sapiens
ggtgggacaccctgtga

SEQ ID NO: 4749066 - DNA, 14 bp, Homo sapiens
ggtgggatcctcca

SEQ ID NO: 4749067 - DNA, 11 bp, Homo sapiens
ggtgggccctg

SEQ ID NO: 4749068 - DNA, 13 bp, Homo sapiens
ggtggggcagctt

SEQ ID NO: 4749069 - DNA, 20 bp, Homo sapiens
ggtggggcccatggaggaga

SEQ ID NO: 4749070 - DNA, 11 bp, Homo sapiens
ggtggggtgga

SEQ ID NO: 4749071 - DNA, 20 bp, Homo sapiens
ggtgggtccatgggcagagc

SEQ ID NO: 4749072 - DNA, 15 bp, Homo sapiens
ggtggtaccaggtct

SEQ ID NO: 4749073 - DNA, 13 bp, Homo sapiens
ggtggtctgctcg

SEQ ID NO: 4749074 - DNA, 19 bp, Homo sapiens
ggtggtctgctcgggccca

SEQ ID NO: 4749075 - DNA, 14 bp, Homo sapiens
ggtggtgacctctg

SEQ ID NO: 4749076 - DNA, 15 bp, Homo sapiens
ggtggtgacctctgc

SEQ ID NO: 4749077 - DNA, 13 bp, Homo sapiens
ggtggtgttttta

SEQ ID NO: 4749078 - DNA, 14 bp, Homo sapiens
ggtgtaataagaca

SEQ ID NO: 4749079 - DNA, 16 bp, Homo sapiens
ggtgtatggttctgtg

SEQ ID NO: 4749080 - DNA, 19 bp, Homo sapiens
ggtgtcaagagggtctgag

SEQ ID NO: 4749081 - DNA, 16 bp, Homo sapiens
ggtgtgcaccagggtt

SEQ ID NO: 4749082 - DNA, 17 bp, Homo sapiens
ggtgtgcaccagggttg

SEQ ID NO: 4749083 - DNA, 14 bp, Homo sapiens
ggtgtgtgttcacc

SEQ ID NO: 4749084 - DNA, 17 bp, Homo sapiens
ggtgtttcctggcactg

SEQ ID NO: 4749085 - DNA, 19 bp, Homo sapiens
ggtgtttcctggcactgct

SEQ ID NO: 4749086 - DNA, 22 bp, Homo sapiens
ggttaccaaaaatatccctttt

SEQ ID NO: 4749087 - DNA, 17 bp, Homo sapiens
ggttatcgaaataacaa

SEQ ID NO: 4749088 - DNA, 15 bp, Homo sapiens
ggttatctgtcccag

SEQ ID NO: 4749089 - DNA, 22 bp, Homo sapiens
ggttcaagcgattcttctgctt

SEQ ID NO: 4749090 - DNA, 23 bp, Homo sapiens
ggttcagctactttccatttggt

SEQ ID NO: 4749091 - DNA, 21 bp, Homo sapiens
ggttcagggttggcccctgcc

SEQ ID NO: 4749092 - DNA, 18 bp, Homo sapiens
ggttcatcatccctccct

SEQ ID NO: 4749093 - DNA, 14 bp, Homo sapiens
ggttgaagcaccaa

SEQ ID NO: 4749094 - DNA, 21 bp, Homo sapiens
ggttggaagctagctcccctc

SEQ ID NO: 4749095 - DNA, 21 bp, Homo sapiens
ggttggcccctgcccggctgc

SEQ ID NO: 4749096 - DNA, 14 bp, Homo sapiens
ggttgggctggtgt

SEQ ID NO: 4749097 - DNA, 12 bp, Homo sapiens
ggttgtgatatt

SEQ ID NO: 4749098 - DNA, 15 bp, Homo sapiens
ggtttatttcccagt

SEQ ID NO: 4749099 - DNA, 23 bp, Homo sapiens
ggtttcagttctgtgtacatttt

SEQ ID NO: 4749100 - DNA, 21 bp, Homo sapiens
ggtttcccttgccctttccat

SEQ ID NO: 4749101 - DNA, 13 bp, Homo sapiens
ggtttcctgccct

SEQ ID NO: 4749102 - DNA, 18 bp, Homo sapiens
ggtttctagatcactgtg

SEQ ID NO: 4749103 - DNA, 20 bp, Homo sapiens
ggttttattttgtaattatt

SEQ ID NO: 4749104 - DNA, 23 bp, Homo sapiens
ggttttgccatgttggccaggct

SEQ ID NO: 4749105 - DNA, 19 bp, Homo sapiens
ggttttgtattctctgagc

SEQ ID NO: 4749106 - DNA, 19 bp, Homo sapiens
ggttttgttcccctcctcc

SEQ ID NO: 4749107 - DNA, 16 bp, Homo sapiens
ggtttttaaaacccag

SEQ ID NO: 4749108 - DNA, 19 bp, Homo sapiens
gtaaaaaaaaatgcctttg

SEQ ID NO: 4749109 - DNA, 23 bp, Homo sapiens
gtaaaaaaaaatgcctttgagac

SEQ ID NO: 4749110 - DNA, 14 bp, Homo sapiens
gtaaaaatttaatt

SEQ ID NO: 4749111 - DNA, 15 bp, Homo sapiens
gtaaaagactttttt

SEQ ID NO: 4749112 - DNA, 22 bp, Homo sapiens
gtaaacccctttagtggcttca

SEQ ID NO: 4749113 - DNA, 21 bp, Homo sapiens
gtaaagatgtttatttcaggc

SEQ ID NO: 4749114 - DNA, 15 bp, Homo sapiens
gtaaagctagaaatg

SEQ ID NO: 4749115 - DNA, 22 bp, Homo sapiens
gtaaagggcgcaaagggcatgg

SEQ ID NO: 4749116 - DNA, 16 bp, Homo sapiens
gtaaatacatgcatat

SEQ ID NO: 4749117 - DNA, 14 bp, Homo sapiens
gtaaatactggact

SEQ ID NO: 4749118 - DNA, 23 bp, Homo sapiens
gtaaatactggactcaggaactt

SEQ ID NO: 4749119 - DNA, 16 bp, Homo sapiens
gtaaatatgtgaagaa

SEQ ID NO: 4749120 - DNA, 22 bp, Homo sapiens
gtaaatggcttatccagctggt

SEQ ID NO: 4749121 - DNA, 22 bp, Homo sapiens
gtaaatggtatgatcaataaag

SEQ ID NO: 4749122 - DNA, 22 bp, Homo sapiens
gtaacagaacagcttcaggtta

SEQ ID NO: 4749123 - DNA, 12 bp, Homo sapiens
gtaacaggcaga

SEQ ID NO: 4749124 - DNA, 18 bp, Homo sapiens
gtaacctcttcagaggcc

SEQ ID NO: 4749125 - DNA, 23 bp, Homo sapiens
gtaacgattgacaccaaaatgaa

SEQ ID NO: 4749126 - DNA, 13 bp, Homo sapiens
gtaactgttcttg

SEQ ID NO: 4749127 - DNA, 22 bp, Homo sapiens
gtaactgtttagatgaatgtca

SEQ ID NO: 4749128 - DNA, 20 bp, Homo sapiens
gtaagaaaacaaactaaatg

SEQ ID NO: 4749129 - DNA, 18 bp, Homo sapiens
gtaagagtgtagaagcat

SEQ ID NO: 4749130 - DNA, 18 bp, Homo sapiens
gtaagcagagttctttgc

SEQ ID NO: 4749131 - DNA, 20 bp, Homo sapiens
gtaaggaatacctgtccccc

SEQ ID NO: 4749132 - DNA, 21 bp, Homo sapiens
gtaaggaatacctgtccccct

SEQ ID NO: 4749133 - DNA, 20 bp, Homo sapiens
gtaagtagcaaccctgtgat

SEQ ID NO: 4749134 - DNA, 14 bp, Homo sapiens
gtaataagacataa

SEQ ID NO: 4749135 - DNA, 17 bp, Homo sapiens
gtaatacttccagaagt

SEQ ID NO: 4749136 - DNA, 20 bp, Homo sapiens
gtaataggcgtaactaattt

SEQ ID NO: 4749137 - DNA, 12 bp, Homo sapiens
gtaatatcttta

SEQ ID NO: 4749138 - DNA, 19 bp, Homo sapiens
gtaatatttcttcaagtga

SEQ ID NO: 4749139 - DNA, 15 bp, Homo sapiens
gtaatcccagcactt

SEQ ID NO: 4749140 - DNA, 15 bp, Homo sapiens
gtaatcgtgtcccct

SEQ ID NO: 4749141 - DNA, 16 bp, Homo sapiens
gtaatctgatggcttc

SEQ ID NO: 4749142 - DNA, 17 bp, Homo sapiens
gtaattaaagtagatta

SEQ ID NO: 4749143 - DNA, 23 bp, Homo sapiens
gtaattattgtgatttcccgtgg

SEQ ID NO: 4749144 - DNA, 17 bp, Homo sapiens
gtaattggaatcttcac

SEQ ID NO: 4749145 - DNA, 21 bp, Homo sapiens
gtaattggaatcttcacctca

SEQ ID NO: 4749146 - DNA, 22 bp, Homo sapiens
gtacaacctgttctgctttcct

SEQ ID NO: 4749147 - DNA, 16 bp, Homo sapiens
gtacacacacatacac

SEQ ID NO: 4749148 - DNA, 12 bp, Homo sapiens
gtacagagccca

SEQ ID NO: 4749149 - DNA, 18 bp, Homo sapiens
gtacagagcccacgcccc

SEQ ID NO: 4749150 - DNA, 16 bp, Homo sapiens
gtacagtcttgtatta

SEQ ID NO: 4749151 - DNA, 15 bp, Homo sapiens
gtacagttcataaat

SEQ ID NO: 4749152 - DNA, 17 bp, Homo sapiens
gtacagttcataaattt

SEQ ID NO: 4749153 - DNA, 13 bp, Homo sapiens
gtacatgtgaggc

SEQ ID NO: 4749154 - DNA, 18 bp, Homo sapiens
gtacatttatgatttaat

SEQ ID NO: 4749155 - DNA, 15 bp, Homo sapiens
gtaccaaatctgaca

SEQ ID NO: 4749156 - DNA, 17 bp, Homo sapiens
gtaccaaatctgacata

SEQ ID NO: 4749157 - DNA, 18 bp, Homo sapiens
gtaccacagtttcttctg

SEQ ID NO: 4749158 - DNA, 12 bp, Homo sapiens
gtaccagccact

SEQ ID NO: 4749159 - DNA, 12 bp, Homo sapiens
gtacccactgct

SEQ ID NO: 4749160 - DNA, 13 bp, Homo sapiens
gtacccccgccca

SEQ ID NO: 4749161 - DNA, 20 bp, Homo sapiens
gtacccccgcccaggctggc

SEQ ID NO: 4749162 - DNA, 23 bp, Homo sapiens
gtacccccgcccaggctggccag

SEQ ID NO: 4749163 - DNA, 17 bp, Homo sapiens
gtacctgcccccaatcc

SEQ ID NO: 4749164 - DNA, 17 bp, Homo sapiens
gtacctggtgacccctt

SEQ ID NO: 4749165 - DNA, 14 bp, Homo sapiens
gtacgtctgacagg

SEQ ID NO: 4749166 - DNA, 15 bp, Homo sapiens
gtacgtctgacaggc

SEQ ID NO: 4749167 - DNA, 14 bp, Homo sapiens
gtactaaggagaat

SEQ ID NO: 4749168 - DNA, 17 bp, Homo sapiens
gtactacagtcctccca

SEQ ID NO: 4749169 - DNA, 15 bp, Homo sapiens
gtactacattttctt

SEQ ID NO: 4749170 - DNA, 14 bp, Homo sapiens
gtactcaaattcaa

SEQ ID NO: 4749171 - DNA, 12 bp, Homo sapiens
gtactctgtgtg

SEQ ID NO: 4749172 - DNA, 21 bp, Homo sapiens
gtactgtatggaaacactgat

SEQ ID NO: 4749173 - DNA, 16 bp, Homo sapiens
gtacttctccaccctg

SEQ ID NO: 4749174 - DNA, 21 bp, Homo sapiens
gtacttctccaccctgctctc

SEQ ID NO: 4749175 - DNA, 21 bp, Homo sapiens
gtacttgtggacacagctctt

SEQ ID NO: 4749176 - DNA, 20 bp, Homo sapiens
gtactttttgttccagagct

SEQ ID NO: 4749177 - DNA, 19 bp, Homo sapiens
gtagaaaaataaagatgcc

SEQ ID NO: 4749178 - DNA, 21 bp, Homo sapiens
gtagaagcattccttctttga

SEQ ID NO: 4749179 - DNA, 22 bp, Homo sapiens
gtagaagcattccttctttgat

SEQ ID NO: 4749180 - DNA, 12 bp, Homo sapiens
gtagagacaggg

SEQ ID NO: 4749181 - DNA, 14 bp, Homo sapiens
gtagagttaagaag

SEQ ID NO: 4749182 - DNA, 15 bp, Homo sapiens
gtagattaggattaa

SEQ ID NO: 4749183 - DNA, 16 bp, Homo sapiens
gtagcaaccctgtgat

SEQ ID NO: 4749184 - DNA, 14 bp, Homo sapiens
gtagccatgggacc

SEQ ID NO: 4749185 - DNA, 12 bp, Homo sapiens
gtagcctctctt

SEQ ID NO: 4749186 - DNA, 12 bp, Homo sapiens
gtagctgggact

SEQ ID NO: 4749187 - DNA, 15 bp, Homo sapiens
gtaggaagactttgg

SEQ ID NO: 4749188 - DNA, 18 bp, Homo sapiens
gtaggagcccagctctga

SEQ ID NO: 4749189 - DNA, 21 bp, Homo sapiens
gtagggcgggaggatgttctg

SEQ ID NO: 4749190 - DNA, 22 bp, Homo sapiens
gtagggcgggaggatgttctgg

SEQ ID NO: 4749191 - DNA, 17 bp, Homo sapiens
gtagggggctggaggag

SEQ ID NO: 4749192 - DNA, 19 bp, Homo sapiens
gtagggggctggaggagcc

SEQ ID NO: 4749193 - DNA, 20 bp, Homo sapiens
gtagggggctggaggagccc

SEQ ID NO: 4749194 - DNA, 19 bp, Homo sapiens
gtagtaaaagtcataaatg

SEQ ID NO: 4749195 - DNA, 19 bp, Homo sapiens
gtagtaaattttgtgatga

SEQ ID NO: 4749196 - DNA, 13 bp, Homo sapiens
gtataaataggag

SEQ ID NO: 4749197 - DNA, 15 bp, Homo sapiens
gtataagtggtgtgt

SEQ ID NO: 4749198 - DNA, 14 bp, Homo sapiens
gtataattaaactt

SEQ ID NO: 4749199 - DNA, 16 bp, Homo sapiens
gtataatttagtccct

SEQ ID NO: 4749200 - DNA, 18 bp, Homo sapiens
gtatacaacatgatttta

SEQ ID NO: 4749201 - DNA, 22 bp, Homo sapiens
gtatagaaatgctggtttttca

SEQ ID NO: 4749202 - DNA, 20 bp, Homo sapiens
gtatagcatgaaataaaata

SEQ ID NO: 4749203 - DNA, 14 bp, Homo sapiens
gtatatgaaaacaa

SEQ ID NO: 4749204 - DNA, 15 bp, Homo sapiens
gtatatgaaaacaag

SEQ ID NO: 4749205 - DNA, 22 bp, Homo sapiens
gtatatgaaaacaagttccaaa

SEQ ID NO: 4749206 - DNA, 18 bp, Homo sapiens
gtatatgtataaattaat

SEQ ID NO: 4749207 - DNA, 23 bp, Homo sapiens
gtatattcaggacttgaaagaaa

SEQ ID NO: 4749208 - DNA, 18 bp, Homo sapiens
gtatatttggtttctaga

SEQ ID NO: 4749209 - DNA, 22 bp, Homo sapiens
gtatatttgtatttaaatgaaa

SEQ ID NO: 4749210 - DNA, 23 bp, Homo sapiens
gtatatttttatattgtttttgt

SEQ ID NO: 4749211 - DNA, 17 bp, Homo sapiens
gtatcaaagaaaaacaa

SEQ ID NO: 4749212 - DNA, 14 bp, Homo sapiens
gtatcaggacccag

SEQ ID NO: 4749213 - DNA, 16 bp, Homo sapiens
gtatcaggtgctgcca

SEQ ID NO: 4749214 - DNA, 22 bp, Homo sapiens
gtatcaggtgctgccatccagg

SEQ ID NO: 4749215 - DNA, 13 bp, Homo sapiens
gtatcctgctggt

SEQ ID NO: 4749216 - DNA, 14 bp, Homo sapiens
gtatcttcatgtat

SEQ ID NO: 4749217 - DNA, 15 bp, Homo sapiens
gtatgatagtgacta

SEQ ID NO: 4749218 - DNA, 22 bp, Homo sapiens
gtatgcaagtgggagatgaaaa

SEQ ID NO: 4749219 - DNA, 15 bp, Homo sapiens
gtatgcgtgtgtgtg

SEQ ID NO: 4749220 - DNA, 15 bp, Homo sapiens
gtatggagctcagag

SEQ ID NO: 4749221 - DNA, 21 bp, Homo sapiens
gtatgggttagggaaaacatt

SEQ ID NO: 4749222 - DNA, 15 bp, Homo sapiens
gtatggtggctgggt

SEQ ID NO: 4749223 - DNA, 16 bp, Homo sapiens
gtatggtggctgggtt

SEQ ID NO: 4749224 - DNA, 20 bp, Homo sapiens
gtatgtacagttcataaatt

SEQ ID NO: 4749225 - DNA, 15 bp, Homo sapiens
gtatgtgccaatttt

SEQ ID NO: 4749226 - DNA, 21 bp, Homo sapiens
gtatgtggatacagtcattat

SEQ ID NO: 4749227 - DNA, 23 bp, Homo sapiens
gtatgtttttgtgtatttgttaa

SEQ ID NO: 4749228 - DNA, 14 bp, Homo sapiens
gtattaacgcaaat

SEQ ID NO: 4749229 - DNA, 12 bp, Homo sapiens
gtattacatttt

SEQ ID NO: 4749230 - DNA, 13 bp, Homo sapiens
gtattacttctgc

SEQ ID NO: 4749231 - DNA, 14 bp, Homo sapiens
gtattcctgcctcc

SEQ ID NO: 4749232 - DNA, 15 bp, Homo sapiens
gtattgtttacatta

SEQ ID NO: 4749233 - DNA, 14 bp, Homo sapiens
gtatttaactctgt

SEQ ID NO: 4749234 - DNA, 21 bp, Homo sapiens
gtatttaatgatttttgtgta

SEQ ID NO: 4749235 - DNA, 22 bp, Homo sapiens
gtatttaatgatttttgtgtat

SEQ ID NO: 4749236 - DNA, 11 bp, Homo sapiens
gtatttattca

SEQ ID NO: 4749237 - DNA, 16 bp, Homo sapiens
gtattttaatcctgta

SEQ ID NO: 4749238 - DNA, 24 bp, Homo sapiens
gtattttaatcctgtaccaaatct

SEQ ID NO: 4749239 - DNA, 22 bp, Homo sapiens
gtattttatctttgattctcct

SEQ ID NO: 4749240 - DNA, 23 bp, Homo sapiens
gtattttatctttgattctcctt

SEQ ID NO: 4749241 - DNA, 17 bp, Homo sapiens
gtatttttccaatcaca

SEQ ID NO: 4749242 - DNA, 19 bp, Homo sapiens
gtatttttccaatcacagt

SEQ ID NO: 4749243 - DNA, 14 bp, Homo sapiens
gtcaaacgtgaaaa

SEQ ID NO: 4749244 - DNA, 21 bp, Homo sapiens
gtcaacactatatattttatg

SEQ ID NO: 4749245 - DNA, 19 bp, Homo sapiens
gtcaacctgggcaaagcct

SEQ ID NO: 4749246 - DNA, 21 bp, Homo sapiens
gtcaacgagacgtttcctacc

SEQ ID NO: 4749247 - DNA, 15 bp, Homo sapiens
gtcaatactgagcca

SEQ ID NO: 4749248 - DNA, 20 bp, Homo sapiens
gtcaattctgatgttactga

SEQ ID NO: 4749249 - DNA, 21 bp, Homo sapiens
gtcacacagtattacttctgc

SEQ ID NO: 4749250 - DNA, 15 bp, Homo sapiens
gtcacagctcttgtt

SEQ ID NO: 4749251 - DNA, 12 bp, Homo sapiens
gtcacaggcagg

SEQ ID NO: 4749252 - DNA, 23 bp, Homo sapiens
gtcaccatcttaagagatgcctc

SEQ ID NO: 4749253 - DNA, 13 bp, Homo sapiens
gtcaccccggcca

SEQ ID NO: 4749254 - DNA, 22 bp, Homo sapiens
gtcacgtggaggagcagtgcag

SEQ ID NO: 4749255 - DNA, 16 bp, Homo sapiens
gtcactccaaggatca

SEQ ID NO: 4749256 - DNA, 16 bp, Homo sapiens
gtcactctggcagctc

SEQ ID NO: 4749257 - DNA, 19 bp, Homo sapiens
gtcactctggcagctcaga

SEQ ID NO: 4749258 - DNA, 14 bp, Homo sapiens
gtcactgagacagc

SEQ ID NO: 4749259 - DNA, 15 bp, Homo sapiens
gtcactgagacagcc

SEQ ID NO: 4749260 - DNA, 17 bp, Homo sapiens
gtcactgagacagcccg

SEQ ID NO: 4749261 - DNA, 18 bp, Homo sapiens
gtcactgagacagcccgg

SEQ ID NO: 4749262 - DNA, 18 bp, Homo sapiens
gtcagacgcctgaggaac

SEQ ID NO: 4749263 - DNA, 16 bp, Homo sapiens
gtcagagcctgcagtt

SEQ ID NO: 4749264 - DNA, 13 bp, Homo sapiens
gtcagccctaggg

SEQ ID NO: 4749265 - DNA, 17 bp, Homo sapiens
gtcaggtggggcagctt

SEQ ID NO: 4749266 - DNA, 22 bp, Homo sapiens
gtcagtaccttcaaactagggc

SEQ ID NO: 4749267 - DNA, 17 bp, Homo sapiens
gtcagtgccgccgcctc

SEQ ID NO: 4749268 - DNA, 24 bp, Homo sapiens
gtcagtgtccaaagcagggtctgg

SEQ ID NO: 4749269 - DNA, 16 bp, Homo sapiens
gtcataccaatgaaaa

SEQ ID NO: 4749270 - DNA, 21 bp, Homo sapiens
gtcatattttgccactgcctt

SEQ ID NO: 4749271 - DNA, 13 bp, Homo sapiens
gtcatgcataaat

SEQ ID NO: 4749272 - DNA, 19 bp, Homo sapiens
gtcatgtgcatctggtgta

SEQ ID NO: 4749273 - DNA, 17 bp, Homo sapiens
gtcattatgttaatatt

SEQ ID NO: 4749274 - DNA, 16 bp, Homo sapiens
gtcattatttaaagca

SEQ ID NO: 4749275 - DNA, 18 bp, Homo sapiens
gtcattgtaacctcgtgt

SEQ ID NO: 4749276 - DNA, 21 bp, Homo sapiens
gtcatttgagcagggctcagc

SEQ ID NO: 4749277 - DNA, 22 bp, Homo sapiens
gtcatttgagcagggctcagcg

SEQ ID NO: 4749278 - DNA, 17 bp, Homo sapiens
gtccaaagcagggtctg

SEQ ID NO: 4749279 - DNA, 20 bp, Homo sapiens
gtccaagaagcccaggaaag

SEQ ID NO: 4749280 - DNA, 12 bp, Homo sapiens
gtccaatcctat

SEQ ID NO: 4749281 - DNA, 20 bp, Homo sapiens
gtccacaaaataaccaatcc

SEQ ID NO: 4749282 - DNA, 19 bp, Homo sapiens
gtccacagtggaaccagcc

SEQ ID NO: 4749283 - DNA, 21 bp, Homo sapiens
gtccacagtggaaccagccca

SEQ ID NO: 4749284 - DNA, 23 bp, Homo sapiens
gtccacccaggagccccgaggcc

SEQ ID NO: 4749285 - DNA, 16 bp, Homo sapiens
gtccacgactgtctcc

SEQ ID NO: 4749286 - DNA, 20 bp, Homo sapiens
gtccacgcggccacctcacc

SEQ ID NO: 4749287 - DNA, 15 bp, Homo sapiens
gtccaggcactgaga

SEQ ID NO: 4749288 - DNA, 14 bp, Homo sapiens
gtccagtgcccatt

SEQ ID NO: 4749289 - DNA, 14 bp, Homo sapiens
gtccatagagagca

SEQ ID NO: 4749290 - DNA, 23 bp, Homo sapiens
gtccatgggcagagcccaaggga

SEQ ID NO: 4749291 - DNA, 12 bp, Homo sapiens
gtccattgtaaa

SEQ ID NO: 4749292 - DNA, 21 bp, Homo sapiens
gtccattgtaaatctgaagaa

SEQ ID NO: 4749293 - DNA, 22 bp, Homo sapiens
gtccattgtaaatctgaagaaa

SEQ ID NO: 4749294 - DNA, 21 bp, Homo sapiens
gtccattgtccaatcctatgt

SEQ ID NO: 4749295 - DNA, 21 bp, Homo sapiens
gtcccaccccacacacgccag

SEQ ID NO: 4749296 - DNA, 14 bp, Homo sapiens
gtcccaccttggct

SEQ ID NO: 4749297 - DNA, 20 bp, Homo sapiens
gtcccaccttggctgcaggg

SEQ ID NO: 4749298 - DNA, 10 bp, Homo sapiens
gtcccagagc

SEQ ID NO: 4749299 - DNA, 17 bp, Homo sapiens
gtcccagattggctcac

SEQ ID NO: 4749300 - DNA, 18 bp, Homo sapiens
gtcccaggctgagcctca

SEQ ID NO: 4749301 - DNA, 21 bp, Homo sapiens
gtcccaggctgagcctcagtc

SEQ ID NO: 4749302 - DNA, 14 bp, Homo sapiens
gtccccctctggct

SEQ ID NO: 4749303 - DNA, 13 bp, Homo sapiens
gtccccctctgtc

SEQ ID NO: 4749304 - DNA, 19 bp, Homo sapiens
gtccccctctgtccaggca

SEQ ID NO: 4749305 - DNA, 21 bp, Homo sapiens
gtccccctctgtccaggcact

SEQ ID NO: 4749306 - DNA, 13 bp, Homo sapiens
gtccccctgacaa

SEQ ID NO: 4749307 - DNA, 14 bp, Homo sapiens
gtcccccttccatg

SEQ ID NO: 4749308 - DNA, 21 bp, Homo sapiens
gtcccctcttgccccaacccc

SEQ ID NO: 4749309 - DNA, 23 bp, Homo sapiens
gtcccctcttgccccaaccccca

SEQ ID NO: 4749310 - DNA, 11 bp, Homo sapiens
gtccccttctc

SEQ ID NO: 4749311 - DNA, 13 bp, Homo sapiens
gtccccttctctc

SEQ ID NO: 4749312 - DNA, 14 bp, Homo sapiens
gtccccttctctca

SEQ ID NO: 4749313 - DNA, 11 bp, Homo sapiens
gtccctctctt

SEQ ID NO: 4749314 - DNA, 16 bp, Homo sapiens
gtccctgcacttgcag

SEQ ID NO: 4749315 - DNA, 14 bp, Homo sapiens
gtccctgccaatgg

SEQ ID NO: 4749316 - DNA, 21 bp, Homo sapiens
gtcccttgcccccctggcctc

SEQ ID NO: 4749317 - DNA, 21 bp, Homo sapiens
gtccgaaagggacttggaagc

SEQ ID NO: 4749318 - DNA, 22 bp, Homo sapiens
gtccgaaagggacttggaagct

SEQ ID NO: 4749319 - DNA, 15 bp, Homo sapiens
gtcctactctgtgtc

SEQ ID NO: 4749320 - DNA, 23 bp, Homo sapiens
gtcctactctgtgtcaggtgggg

SEQ ID NO: 4749321 - DNA, 13 bp, Homo sapiens
gtcctcccatctc

SEQ ID NO: 4749322 - DNA, 14 bp, Homo sapiens
gtcctcccatctca

SEQ ID NO: 4749323 - DNA, 14 bp, Homo sapiens
gtcctcctccaggg

SEQ ID NO: 4749324 - DNA, 20 bp, Homo sapiens
gtcctcctccagggacagca

SEQ ID NO: 4749325 - DNA, 14 bp, Homo sapiens
gtcctcctctgtga

SEQ ID NO: 4749326 - DNA, 15 bp, Homo sapiens
gtcctcctctgtgaa

SEQ ID NO: 4749327 - DNA, 16 bp, Homo sapiens
gtcctctccctcctgg

SEQ ID NO: 4749328 - DNA, 17 bp, Homo sapiens
gtcctgacagcactcct

SEQ ID NO: 4749329 - DNA, 23 bp, Homo sapiens
gtcctgacttcaggggctgcccg

SEQ ID NO: 4749330 - DNA, 13 bp, Homo sapiens
gtcctgaggggga

SEQ ID NO: 4749331 - DNA, 18 bp, Homo sapiens
gtcctgagggggaagtga

SEQ ID NO: 4749332 - DNA, 15 bp, Homo sapiens
gtcctgatcagagcc

SEQ ID NO: 4749333 - DNA, 17 bp, Homo sapiens
gtcctgatgatttttat

SEQ ID NO: 4749334 - DNA, 22 bp, Homo sapiens
gtcctgcccttgctccagcctg

SEQ ID NO: 4749335 - DNA, 14 bp, Homo sapiens
gtcctgctccacag

SEQ ID NO: 4749336 - DNA, 16 bp, Homo sapiens
gtcctgctccacagtg

SEQ ID NO: 4749337 - DNA, 17 bp, Homo sapiens
gtcctgctccacagtgt

SEQ ID NO: 4749338 - DNA, 19 bp, Homo sapiens
gtcctgctccacagtgttg

SEQ ID NO: 4749339 - DNA, 13 bp, Homo sapiens
gtcctgctgcagt

SEQ ID NO: 4749340 - DNA, 16 bp, Homo sapiens
gtcctgctgcagttgc

SEQ ID NO: 4749341 - DNA, 16 bp, Homo sapiens
gtcctgggagtgagct

SEQ ID NO: 4749342 - DNA, 19 bp, Homo sapiens
gtcctggggaacctgaccc

SEQ ID NO: 4749343 - DNA, 17 bp, Homo sapiens
gtccttaccagcagagc

SEQ ID NO: 4749344 - DNA, 21 bp, Homo sapiens
gtccttaccagcagagcacct

SEQ ID NO: 4749345 - DNA, 16 bp, Homo sapiens
gtcgaatttttattat

SEQ ID NO: 4749346 - DNA, 14 bp, Homo sapiens
gtcgaggacaggga

SEQ ID NO: 4749347 - DNA, 14 bp, Homo sapiens
gtcgcccaggctgg

SEQ ID NO: 4749348 - DNA, 13 bp, Homo sapiens
gtcgcccagtctg

SEQ ID NO: 4749349 - DNA, 13 bp, Homo sapiens
gtcgcgctgcctg

SEQ ID NO: 4749350 - DNA, 18 bp, Homo sapiens
gtcgcgctgcctgtgtgg

SEQ ID NO: 4749351 - DNA, 18 bp, Homo sapiens
gtcgtcaaagctgaaatg

SEQ ID NO: 4749352 - DNA, 14 bp, Homo sapiens
gtcgttcaattcat

SEQ ID NO: 4749353 - DNA, 15 bp, Homo sapiens
gtctacactgtgctg

SEQ ID NO: 4749354 - DNA, 13 bp, Homo sapiens
gtctacctgaggg

SEQ ID NO: 4749355 - DNA, 16 bp, Homo sapiens
gtctacctgaggggcc

SEQ ID NO: 4749356 - DNA, 22 bp, Homo sapiens
gtctatgggactcaatgcactg

SEQ ID NO: 4749357 - DNA, 14 bp, Homo sapiens
gtctatttctagtt

SEQ ID NO: 4749358 - DNA, 18 bp, Homo sapiens
gtctcaattttgtattta

SEQ ID NO: 4749359 - DNA, 19 bp, Homo sapiens
gtctcaattttgtatttaa

SEQ ID NO: 4749360 - DNA, 15 bp, Homo sapiens
gtctcactctgtcgc

SEQ ID NO: 4749361 - DNA, 20 bp, Homo sapiens
gtctcactgttgcccaggct

SEQ ID NO: 4749362 - DNA, 23 bp, Homo sapiens
gtctcactgttgcccaggctggc

SEQ ID NO: 4749363 - DNA, 18 bp, Homo sapiens
gtctcagatatcatactg

SEQ ID NO: 4749364 - DNA, 16 bp, Homo sapiens
gtctccaaccccccag

SEQ ID NO: 4749365 - DNA, 17 bp, Homo sapiens
gtctccaaccccccagc

SEQ ID NO: 4749366 - DNA, 14 bp, Homo sapiens
gtctccatggccct

SEQ ID NO: 4749367 - DNA, 12 bp, Homo sapiens
gtctccctggcc

SEQ ID NO: 4749368 - DNA, 13 bp, Homo sapiens
gtctccctggccc

SEQ ID NO: 4749369 - DNA, 16 bp, Homo sapiens
gtctccctggccctca

SEQ ID NO: 4749370 - DNA, 21 bp, Homo sapiens
gtctcctccaccgccatggct

SEQ ID NO: 4749371 - DNA, 15 bp, Homo sapiens
gtctcgaatgtaatt

SEQ ID NO: 4749372 - DNA, 16 bp, Homo sapiens
gtctcgaatgtaattg

SEQ ID NO: 4749373 - DNA, 19 bp, Homo sapiens
gtctcgctgatgctgggct

SEQ ID NO: 4749374 - DNA, 22 bp, Homo sapiens
gtctctaagtgtaaaagtagta

SEQ ID NO: 4749375 - DNA, 15 bp, Homo sapiens
gtctctgaacatcct

SEQ ID NO: 4749376 - DNA, 13 bp, Homo sapiens
gtctctgctgccg

SEQ ID NO: 4749377 - DNA, 14 bp, Homo sapiens
gtctctgctgccgc

SEQ ID NO: 4749378 - DNA, 13 bp, Homo sapiens
gtctcttcccctc

SEQ ID NO: 4749379 - DNA, 13 bp, Homo sapiens
gtctcttggtcct

SEQ ID NO: 4749380 - DNA, 18 bp, Homo sapiens
gtctcttggtcctgctgc

SEQ ID NO: 4749381 - DNA, 20 bp, Homo sapiens
gtctctttaatgtcacaggc

SEQ ID NO: 4749382 - DNA, 15 bp, Homo sapiens
gtctgacaaatgtgt

SEQ ID NO: 4749383 - DNA, 21 bp, Homo sapiens
gtctgacaggcaatgctggct

SEQ ID NO: 4749384 - DNA, 15 bp, Homo sapiens
gtctgacccactgct

SEQ ID NO: 4749385 - DNA, 19 bp, Homo sapiens
gtctgactgtgcccaagtg

SEQ ID NO: 4749386 - DNA, 22 bp, Homo sapiens
gtctgaggggcaactgagtctg

SEQ ID NO: 4749387 - DNA, 17 bp, Homo sapiens
gtctgattcccaagctc

SEQ ID NO: 4749388 - DNA, 11 bp, Homo sapiens
gtctgcctctt

SEQ ID NO: 4749389 - DNA, 19 bp, Homo sapiens
gtctgctcgggcccaggcc

SEQ ID NO: 4749390 - DNA, 21 bp, Homo sapiens
gtctgctcgggcccaggccat

SEQ ID NO: 4749391 - DNA, 18 bp, Homo sapiens
gtctggaatgcagtggta

SEQ ID NO: 4749392 - DNA, 15 bp, Homo sapiens
gtctggcttcacaga

SEQ ID NO: 4749393 - DNA, 14 bp, Homo sapiens
gtctgtagtgtttt

SEQ ID NO: 4749394 - DNA, 13 bp, Homo sapiens
gtcttaatgttga

SEQ ID NO: 4749395 - DNA, 15 bp, Homo sapiens
gtcttaatgttgaat

SEQ ID NO: 4749396 - DNA, 13 bp, Homo sapiens
gtcttactttgtg

SEQ ID NO: 4749397 - DNA, 15 bp, Homo sapiens
gtcttccatttgcaa

SEQ ID NO: 4749398 - DNA, 12 bp, Homo sapiens
gtcttcctgtgg

SEQ ID NO: 4749399 - DNA, 17 bp, Homo sapiens
gtcttctatttatttat

SEQ ID NO: 4749400 - DNA, 14 bp, Homo sapiens
gtcttcttcagggt

SEQ ID NO: 4749401 - DNA, 20 bp, Homo sapiens
gtcttgaactcctggcctca

SEQ ID NO: 4749402 - DNA, 21 bp, Homo sapiens
gtcttgacctgaactctgcaa

SEQ ID NO: 4749403 - DNA, 18 bp, Homo sapiens
gtcttgcaatggcagcct

SEQ ID NO: 4749404 - DNA, 15 bp, Homo sapiens
gtcttggatatatag

SEQ ID NO: 4749405 - DNA, 19 bp, Homo sapiens
gtctttattagattttcct

SEQ ID NO: 4749406 - DNA, 12 bp, Homo sapiens
gtctttctttgc

SEQ ID NO: 4749407 - DNA, 13 bp, Homo sapiens
gtctttctttgct

SEQ ID NO: 4749408 - DNA, 19 bp, Homo sapiens
gtctttctttgctgctgtg

SEQ ID NO: 4749409 - DNA, 14 bp, Homo sapiens
gtctttggaccctg

SEQ ID NO: 4749410 - DNA, 14 bp, Homo sapiens
gtctttgtaagagt

SEQ ID NO: 4749411 - DNA, 21 bp, Homo sapiens
gtctttgtaagagtgtagaag

SEQ ID NO: 4749412 - DNA, 24 bp, Homo sapiens
gtcttttcttgcatgaggctagtg

SEQ ID NO: 4749413 - DNA, 20 bp, Homo sapiens
gtgaaaagagaggatatgtt

SEQ ID NO: 4749414 - DNA, 17 bp, Homo sapiens
gtgaaaatggtccagga

SEQ ID NO: 4749415 - DNA, 19 bp, Homo sapiens
gtgaaagaaaataacaata

SEQ ID NO: 4749416 - DNA, 19 bp, Homo sapiens
gtgaaaggaaagagggagg

SEQ ID NO: 4749417 - DNA, 22 bp, Homo sapiens
gtgaaataccaacctgaagaca

SEQ ID NO: 4749418 - DNA, 22 bp, Homo sapiens
gtgaaccaccacacccagccca

SEQ ID NO: 4749419 - DNA, 23 bp, Homo sapiens
gtgaaccaccacacccagcccac

SEQ ID NO: 4749420 - DNA, 15 bp, Homo sapiens
gtgaactccatcatt

SEQ ID NO: 4749421 - DNA, 20 bp, Homo sapiens
gtgaagaaaaagacctgcat

SEQ ID NO: 4749422 - DNA, 18 bp, Homo sapiens
gtgaagcaccaagctcaa

SEQ ID NO: 4749423 - DNA, 14 bp, Homo sapiens
gtgaaggcttctct

SEQ ID NO: 4749424 - DNA, 17 bp, Homo sapiens
gtgaaggcttctctctg

SEQ ID NO: 4749425 - DNA, 22 bp, Homo sapiens
gtgaataaaaagaaagatttta

SEQ ID NO: 4749426 - DNA, 18 bp, Homo sapiens
gtgaatgcttctgattta

SEQ ID NO: 4749427 - DNA, 17 bp, Homo sapiens
gtgaatttaagcatgag

SEQ ID NO: 4749428 - DNA, 15 bp, Homo sapiens
gtgacaccaataaat

SEQ ID NO: 4749429 - DNA, 23 bp, Homo sapiens
gtgacaccccccttctgaatgaa

SEQ ID NO: 4749430 - DNA, 12 bp, Homo sapiens
gtgacagaggca

SEQ ID NO: 4749431 - DNA, 14 bp, Homo sapiens
gtgacaggaaagat

SEQ ID NO: 4749432 - DNA, 14 bp, Homo sapiens
gtgacaggcagcag

SEQ ID NO: 4749433 - DNA, 15 bp, Homo sapiens
gtgacaggcagcaga

SEQ ID NO: 4749434 - DNA, 14 bp, Homo sapiens
gtgacatgtctttt

SEQ ID NO: 4749435 - DNA, 18 bp, Homo sapiens
gtgacatgtgaaaccttt

SEQ ID NO: 4749436 - DNA, 22 bp, Homo sapiens
gtgacatgtgaaacctttttta

SEQ ID NO: 4749437 - DNA, 12 bp, Homo sapiens
gtgacattgaaa

SEQ ID NO: 4749438 - DNA, 21 bp, Homo sapiens
gtgacatttatttttctcatg

SEQ ID NO: 4749439 - DNA, 22 bp, Homo sapiens
gtgaccccttttcagcttctgc

SEQ ID NO: 4749440 - DNA, 17 bp, Homo sapiens
gtgactcgggctcctgt

SEQ ID NO: 4749441 - DNA, 20 bp, Homo sapiens
gtgactcgggctcctgtgcc

SEQ ID NO: 4749442 - DNA, 20 bp, Homo sapiens
gtgactttggctgcatgcga

SEQ ID NO: 4749443 - DNA, 14 bp, Homo sapiens
gtgacttttgaaga

SEQ ID NO: 4749444 - DNA, 13 bp, Homo sapiens
gtgagaagggctc

SEQ ID NO: 4749445 - DNA, 22 bp, Homo sapiens
gtgagacactgcacagaagaca

SEQ ID NO: 4749446 - DNA, 13 bp, Homo sapiens
gtgagacctgccc

SEQ ID NO: 4749447 - DNA, 17 bp, Homo sapiens
gtgagactccacctcaa

SEQ ID NO: 4749448 - DNA, 17 bp, Homo sapiens
gtgagactcgagaactt

SEQ ID NO: 4749449 - DNA, 22 bp, Homo sapiens
gtgagactcgagaactttcatt

SEQ ID NO: 4749450 - DNA, 16 bp, Homo sapiens
gtgagactctgtctca

SEQ ID NO: 4749451 - DNA, 12 bp, Homo sapiens
gtgagagctggg

SEQ ID NO: 4749452 - DNA, 16 bp, Homo sapiens
gtgagaggggaacaga

SEQ ID NO: 4749453 - DNA, 16 bp, Homo sapiens
gtgagagtctgggtcc

SEQ ID NO: 4749454 - DNA, 16 bp, Homo sapiens
gtgagccaccacgccc

SEQ ID NO: 4749455 - DNA, 17 bp, Homo sapiens
gtgagcccatggccctc

SEQ ID NO: 4749456 - DNA, 11 bp, Homo sapiens
gtgaggaagcc

SEQ ID NO: 4749457 - DNA, 13 bp, Homo sapiens
gtgaggctctgcc

SEQ ID NO: 4749458 - DNA, 14 bp, Homo sapiens
gtgaggctctgccc

SEQ ID NO: 4749459 - DNA, 21 bp, Homo sapiens
gtgagtactacagtcctccca

SEQ ID NO: 4749460 - DNA, 20 bp, Homo sapiens
gtgagttcagcctttaagat

SEQ ID NO: 4749461 - DNA, 22 bp, Homo sapiens
gtgatatggtactaaggagaat

SEQ ID NO: 4749462 - DNA, 20 bp, Homo sapiens
gtgatccacccacctcagcc

SEQ ID NO: 4749463 - DNA, 24 bp, Homo sapiens
gtgatccacccacctcagcctccc

SEQ ID NO: 4749464 - DNA, 14 bp, Homo sapiens
gtgatcctcccacc

SEQ ID NO: 4749465 - DNA, 18 bp, Homo sapiens
gtgatcctcccacctcag

SEQ ID NO: 4749466 - DNA, 20 bp, Homo sapiens
gtgatcctcccacctcagcc

SEQ ID NO: 4749467 - DNA, 22 bp, Homo sapiens
gtgatcctcccacctcagcctc

SEQ ID NO: 4749468 - DNA, 23 bp, Homo sapiens
gtgatcctcccacctcagcctcc

SEQ ID NO: 4749469 - DNA, 12 bp, Homo sapiens
gtgatgcggcag

SEQ ID NO: 4749470 - DNA, 13 bp, Homo sapiens
gtgatgcggcaga

SEQ ID NO: 4749471 - DNA, 14 bp, Homo sapiens
gtgatggggccctg

SEQ ID NO: 4749472 - DNA, 16 bp, Homo sapiens
gtgatggggccctgcc

SEQ ID NO: 4749473 - DNA, 18 bp, Homo sapiens
gtgatggggccctgcctc

SEQ ID NO: 4749474 - DNA, 14 bp, Homo sapiens
gtgatgtcatctgt

SEQ ID NO: 4749475 - DNA, 22 bp, Homo sapiens
gtgattcaattcaacactccct

SEQ ID NO: 4749476 - DNA, 22 bp, Homo sapiens
gtgattctcctgcctcagcctc

SEQ ID NO: 4749477 - DNA, 15 bp, Homo sapiens
gtgatttacatgctg

SEQ ID NO: 4749478 - DNA, 16 bp, Homo sapiens
gtgattttgctgtaga

SEQ ID NO: 4749479 - DNA, 21 bp, Homo sapiens
gtgcaaaaagctgagtatggt

SEQ ID NO: 4749480 - DNA, 13 bp, Homo sapiens
gtgcaaacagtgt

SEQ ID NO: 4749481 - DNA, 14 bp, Homo sapiens
gtgcaactcttgta

SEQ ID NO: 4749482 - DNA, 18 bp, Homo sapiens
gtgcaactcttgtattgc

SEQ ID NO: 4749483 - DNA, 13 bp, Homo sapiens
gtgcacaagctcc

SEQ ID NO: 4749484 - DNA, 21 bp, Homo sapiens
gtgcacaagctccaagctccc

SEQ ID NO: 4749485 - DNA, 19 bp, Homo sapiens
gtgcagcccccactgcctt

SEQ ID NO: 4749486 - DNA, 17 bp, Homo sapiens
gtgcagccgctgagcga

SEQ ID NO: 4749487 - DNA, 18 bp, Homo sapiens
gtgcagccgctgagcgag

SEQ ID NO: 4749488 - DNA, 15 bp, Homo sapiens
gtgcaggtggggaga

SEQ ID NO: 4749489 - DNA, 16 bp, Homo sapiens
gtgcagtcctgatcag

SEQ ID NO: 4749490 - DNA, 23 bp, Homo sapiens
gtgcagtggtgcgatctgggttc

SEQ ID NO: 4749491 - DNA, 14 bp, Homo sapiens
gtgcatctggtgta

SEQ ID NO: 4749492 - DNA, 22 bp, Homo sapiens
gtgccaacactcaagaagcagg

SEQ ID NO: 4749493 - DNA, 11 bp, Homo sapiens
gtgccaccctg

SEQ ID NO: 4749494 - DNA, 13 bp, Homo sapiens
gtgccagcccctg

SEQ ID NO: 4749495 - DNA, 15 bp, Homo sapiens
gtgccagcccctgct

SEQ ID NO: 4749496 - DNA, 19 bp, Homo sapiens
gtgccagcccctgctggct

SEQ ID NO: 4749497 - DNA, 20 bp, Homo sapiens
gtgccaggtttttggtctga

SEQ ID NO: 4749498 - DNA, 15 bp, Homo sapiens
gtgccagtcgcgctg

SEQ ID NO: 4749499 - DNA, 19 bp, Homo sapiens
gtgccagtcgcgctgcctg

SEQ ID NO: 4749500 - DNA, 21 bp, Homo sapiens
gtgccagtcgcgctgcctgtg

SEQ ID NO: 4749501 - DNA, 14 bp, Homo sapiens
gtgcccatgggcac

SEQ ID NO: 4749502 - DNA, 21 bp, Homo sapiens
gtgcccatgggcactgctggg

SEQ ID NO: 4749503 - DNA, 22 bp, Homo sapiens
gtgccccccatcctggcccatc

SEQ ID NO: 4749504 - DNA, 18 bp, Homo sapiens
gtgccgccgcctcgccca

SEQ ID NO: 4749505 - DNA, 20 bp, Homo sapiens
gtgccgccgcctcgcccacc

SEQ ID NO: 4749506 - DNA, 15 bp, Homo sapiens
gtgcctaatgtgttt

SEQ ID NO: 4749507 - DNA, 21 bp, Homo sapiens
gtgcctgattcggctgtctca

SEQ ID NO: 4749508 - DNA, 22 bp, Homo sapiens
gtgcctgattcggctgtctcag

SEQ ID NO: 4749509 - DNA, 16 bp, Homo sapiens
gtgcctggccacgccc

SEQ ID NO: 4749510 - DNA, 22 bp, Homo sapiens
gtgccttcaagaaaacaggcac

SEQ ID NO: 4749511 - DNA, 20 bp, Homo sapiens
gtgcgaccccatctgcccag

SEQ ID NO: 4749512 - DNA, 14 bp, Homo sapiens
gtgcgcctacagga

SEQ ID NO: 4749513 - DNA, 13 bp, Homo sapiens
gtgcgtggtgcga

SEQ ID NO: 4749514 - DNA, 17 bp, Homo sapiens
gtgcgtgtgtagagtta

SEQ ID NO: 4749515 - DNA, 15 bp, Homo sapiens
gtgctatctccccca

SEQ ID NO: 4749516 - DNA, 18 bp, Homo sapiens
gtgctatctcccccagcc

SEQ ID NO: 4749517 - DNA, 19 bp, Homo sapiens
gtgctatctcccccagccc

SEQ ID NO: 4749518 - DNA, 13 bp, Homo sapiens
gtgctcagggcta

SEQ ID NO: 4749519 - DNA, 16 bp, Homo sapiens
gtgctctgatcatcca

SEQ ID NO: 4749520 - DNA, 16 bp, Homo sapiens
gtgctctggacaggca

SEQ ID NO: 4749521 - DNA, 16 bp, Homo sapiens
gtgctgagtctgaagg

SEQ ID NO: 4749522 - DNA, 15 bp, Homo sapiens
gtgctgcagatttga

SEQ ID NO: 4749523 - DNA, 22 bp, Homo sapiens
gtgctgcagatttgatatttgc

SEQ ID NO: 4749524 - DNA, 14 bp, Homo sapiens
gtgctgcatgcgat

SEQ ID NO: 4749525 - DNA, 15 bp, Homo sapiens
gtgctgccatccagg

SEQ ID NO: 4749526 - DNA, 19 bp, Homo sapiens
gtgctgccatccaggttca

SEQ ID NO: 4749527 - DNA, 11 bp, Homo sapiens
gtgctgccctg

SEQ ID NO: 4749528 - DNA, 13 bp, Homo sapiens
gtgctgccctgcc

SEQ ID NO: 4749529 - DNA, 15 bp, Homo sapiens
gtgctgccctgccca

SEQ ID NO: 4749530 - DNA, 12 bp, Homo sapiens
gtgctgcctcta

SEQ ID NO: 4749531 - DNA, 22 bp, Homo sapiens
gtgctgctaccctccctgctgt

SEQ ID NO: 4749532 - DNA, 20 bp, Homo sapiens
gtgcttgttatgtctagaaa

SEQ ID NO: 4749533 - DNA, 15 bp, Homo sapiens
gtggacacagctctt

SEQ ID NO: 4749534 - DNA, 17 bp, Homo sapiens
gtggacacagctcttct

SEQ ID NO: 4749535 - DNA, 22 bp, Homo sapiens
gtggagaagccacaggcctgag

SEQ ID NO: 4749536 - DNA, 15 bp, Homo sapiens
gtggaggaaggattg

SEQ ID NO: 4749537 - DNA, 12 bp, Homo sapiens
gtggaggagcag

SEQ ID NO: 4749538 - DNA, 20 bp, Homo sapiens
gtggaggagctcaggacact

SEQ ID NO: 4749539 - DNA, 15 bp, Homo sapiens
gtggaggaggcctgg

SEQ ID NO: 4749540 - DNA, 21 bp, Homo sapiens
gtggaggccgagtctgtcctg

SEQ ID NO: 4749541 - DNA, 15 bp, Homo sapiens
gtggagtcccagagc

SEQ ID NO: 4749542 - DNA, 14 bp, Homo sapiens
gtggatattgttac

SEQ ID NO: 4749543 - DNA, 23 bp, Homo sapiens
gtggatcacaaagtggaacgaaa

SEQ ID NO: 4749544 - DNA, 18 bp, Homo sapiens
gtggatgcctggtggcag

SEQ ID NO: 4749545 - DNA, 20 bp, Homo sapiens
gtggatgcctggtggcagct

SEQ ID NO: 4749546 - DNA, 21 bp, Homo sapiens
gtggatggaaggggctgacag

SEQ ID NO: 4749547 - DNA, 20 bp, Homo sapiens
gtggcagctcacctctccct

SEQ ID NO: 4749548 - DNA, 13 bp, Homo sapiens
gtggcaggagggc

SEQ ID NO: 4749549 - DNA, 17 bp, Homo sapiens
gtggcagtgggagctgc

SEQ ID NO: 4749550 - DNA, 21 bp, Homo sapiens
gtggcagtgggagctgcctgt

SEQ ID NO: 4749551 - DNA, 16 bp, Homo sapiens
gtggcattggcagcag

SEQ ID NO: 4749552 - DNA, 18 bp, Homo sapiens
gtggcattggcagcaggt

SEQ ID NO: 4749553 - DNA, 14 bp, Homo sapiens
gtggccaagttctt

SEQ ID NO: 4749554 - DNA, 20 bp, Homo sapiens
gtggcccatcccccctcacc

SEQ ID NO: 4749555 - DNA, 12 bp, Homo sapiens
gtggccccagcc

SEQ ID NO: 4749556 - DNA, 15 bp, Homo sapiens
gtggccctctcccct

SEQ ID NO: 4749557 - DNA, 18 bp, Homo sapiens
gtggccctctcccctgcc

SEQ ID NO: 4749558 - DNA, 17 bp, Homo sapiens
gtggccgtcctgagggg

SEQ ID NO: 4749559 - DNA, 16 bp, Homo sapiens
gtggctgctgcccagg

SEQ ID NO: 4749560 - DNA, 22 bp, Homo sapiens
gtggctggaaccacattgaaga

SEQ ID NO: 4749561 - DNA, 16 bp, Homo sapiens
gtggctgtgacatcta

SEQ ID NO: 4749562 - DNA, 21 bp, Homo sapiens
gtggcttcattagagcaggcg

SEQ ID NO: 4749563 - DNA, 15 bp, Homo sapiens
gtgggacaccctgtg

SEQ ID NO: 4749564 - DNA, 22 bp, Homo sapiens
gtgggacaccctgtgatggggc

SEQ ID NO: 4749565 - DNA, 14 bp, Homo sapiens
gtgggagctgcctg

SEQ ID NO: 4749566 - DNA, 15 bp, Homo sapiens
gtgggagctgcctgt

SEQ ID NO: 4749567 - DNA, 18 bp, Homo sapiens
gtgggagctgcctgttca

SEQ ID NO: 4749568 - DNA, 13 bp, Homo sapiens
gtgggagtgggcc

SEQ ID NO: 4749569 - DNA, 15 bp, Homo sapiens
gtgggatcctccagg

SEQ ID NO: 4749570 - DNA, 17 bp, Homo sapiens
gtgggcccaatgcactt

SEQ ID NO: 4749571 - DNA, 18 bp, Homo sapiens
gtgggcgggcagcacagc

SEQ ID NO: 4749572 - DNA, 15 bp, Homo sapiens
gtgggctagttgggc

SEQ ID NO: 4749573 - DNA, 19 bp, Homo sapiens
gtgggctgcactctgtgcc

SEQ ID NO: 4749574 - DNA, 20 bp, Homo sapiens
gtggggcccatggaggagac

SEQ ID NO: 4749575 - DNA, 21 bp, Homo sapiens
gtggggtcactctggcagctc

SEQ ID NO: 4749576 - DNA, 18 bp, Homo sapiens
gtgggtccatgggcagag

SEQ ID NO: 4749577 - DNA, 20 bp, Homo sapiens
gtgggtcccacttcccctcc

SEQ ID NO: 4749578 - DNA, 21 bp, Homo sapiens
gtgggtcccacttcccctcct

SEQ ID NO: 4749579 - DNA, 21 bp, Homo sapiens
gtgggttttcatcaagactgg

SEQ ID NO: 4749580 - DNA, 14 bp, Homo sapiens
gtggtatagaaatg

SEQ ID NO: 4749581 - DNA, 19 bp, Homo sapiens
gtggtatgatcacggctca

SEQ ID NO: 4749582 - DNA, 17 bp, Homo sapiens
gtggtcccaccccacac

SEQ ID NO: 4749583 - DNA, 18 bp, Homo sapiens
gtggtctgctcgggccca

SEQ ID NO: 4749584 - DNA, 14 bp, Homo sapiens
gtggtgacctctgc

SEQ ID NO: 4749585 - DNA, 17 bp, Homo sapiens
gtggtgacctctgcctg

SEQ ID NO: 4749586 - DNA, 12 bp, Homo sapiens
gtggtggagcca

SEQ ID NO: 4749587 - DNA, 14 bp, Homo sapiens
gtggtggagccagt

SEQ ID NO: 4749588 - DNA, 22 bp, Homo sapiens
gtggtgtggagaagccacaggc

SEQ ID NO: 4749589 - DNA, 23 bp, Homo sapiens
gtggtgtgtccccctctgtccag

SEQ ID NO: 4749590 - DNA, 19 bp, Homo sapiens
gtggtgtttcctggcactg

SEQ ID NO: 4749591 - DNA, 14 bp, Homo sapiens
gtgtaataagacat

SEQ ID NO: 4749592 - DNA, 14 bp, Homo sapiens
gtgtactctgtgtg

SEQ ID NO: 4749593 - DNA, 23 bp, Homo sapiens
gtgtagaagcattccttctttga

SEQ ID NO: 4749594 - DNA, 20 bp, Homo sapiens
gtgtagagttaagaagctgt

SEQ ID NO: 4749595 - DNA, 20 bp, Homo sapiens
gtgtatatgtataaattaat

SEQ ID NO: 4749596 - DNA, 21 bp, Homo sapiens
gtgtatgagaagtactttgtg

SEQ ID NO: 4749597 - DNA, 17 bp, Homo sapiens
gtgtcactggctgcctc

SEQ ID NO: 4749598 - DNA, 13 bp, Homo sapiens
gtgtcccagtgaa

SEQ ID NO: 4749599 - DNA, 14 bp, Homo sapiens
gtgtccccctctgt

SEQ ID NO: 4749600 - DNA, 18 bp, Homo sapiens
gtgtccccctctgtccag

SEQ ID NO: 4749601 - DNA, 14 bp, Homo sapiens
gtgtccctaatgtg

SEQ ID NO: 4749602 - DNA, 13 bp, Homo sapiens
gtgtccctgcact

SEQ ID NO: 4749603 - DNA, 13 bp, Homo sapiens
gtgtctccaaccc

SEQ ID NO: 4749604 - DNA, 13 bp, Homo sapiens
gtgtctctgtata

SEQ ID NO: 4749605 - DNA, 14 bp, Homo sapiens
gtgtctgcaacatg

SEQ ID NO: 4749606 - DNA, 12 bp, Homo sapiens
gtgtcttcctgt

SEQ ID NO: 4749607 - DNA, 18 bp, Homo sapiens
gtgtcttgcaatggcagc

SEQ ID NO: 4749608 - DNA, 18 bp, Homo sapiens
gtgtcttttttcactaca

SEQ ID NO: 4749609 - DNA, 15 bp, Homo sapiens
gtgtgaggccagggc

SEQ ID NO: 4749610 - DNA, 20 bp, Homo sapiens
gtgtgagtcaccaagcccag

SEQ ID NO: 4749611 - DNA, 18 bp, Homo sapiens
gtgtgatctcttcagggt

SEQ ID NO: 4749612 - DNA, 16 bp, Homo sapiens
gtgtgcaccagggttg

SEQ ID NO: 4749613 - DNA, 17 bp, Homo sapiens
gtgtgccccccatcctg

SEQ ID NO: 4749614 - DNA, 20 bp, Homo sapiens
gtgtgccccccatcctggcc

SEQ ID NO: 4749615 - DNA, 14 bp, Homo sapiens
gtgtgcctgtgtgc

SEQ ID NO: 4749616 - DNA, 12 bp, Homo sapiens
gtgtgctctgat

SEQ ID NO: 4749617 - DNA, 22 bp, Homo sapiens
gtgtggagaagccacaggcctg

SEQ ID NO: 4749618 - DNA, 23 bp, Homo sapiens
gtgtggagaagccacaggcctga

SEQ ID NO: 4749619 - DNA, 20 bp, Homo sapiens
gtgtgtagagttaagaagct

SEQ ID NO: 4749620 - DNA, 17 bp, Homo sapiens
gtgtgtccccctctgtc

SEQ ID NO: 4749621 - DNA, 11 bp, Homo sapiens
gtgtgtctgtg

SEQ ID NO: 4749622 - DNA, 20 bp, Homo sapiens
gtgtgtgaaaatgtgtgtgt

SEQ ID NO: 4749623 - DNA, 22 bp, Homo sapiens
gtgtgttcaccttcaaaatgtt

SEQ ID NO: 4749624 - DNA, 20 bp, Homo sapiens
gtgtgttgatactgttgcac

SEQ ID NO: 4749625 - DNA, 15 bp, Homo sapiens
gtgtgtttctgatct

SEQ ID NO: 4749626 - DNA, 16 bp, Homo sapiens
gtgttacctgaaaaca

SEQ ID NO: 4749627 - DNA, 15 bp, Homo sapiens
gtgttaggcctggca

SEQ ID NO: 4749628 - DNA, 18 bp, Homo sapiens
gtgttaggcctggcacag

SEQ ID NO: 4749629 - DNA, 21 bp, Homo sapiens
gtgttaggcctggcacagtgt

SEQ ID NO: 4749630 - DNA, 23 bp, Homo sapiens
gtgttccccttccactgagggca

SEQ ID NO: 4749631 - DNA, 17 bp, Homo sapiens
gtgttgacgtaagctct

SEQ ID NO: 4749632 - DNA, 14 bp, Homo sapiens
gtgttgatactgtt

SEQ ID NO: 4749633 - DNA, 16 bp, Homo sapiens
gtgtttctttagtttt

SEQ ID NO: 4749634 - DNA, 22 bp, Homo sapiens
gtgtttgtataccatgatgcat

SEQ ID NO: 4749635 - DNA, 20 bp, Homo sapiens
gtgttttgaaagaatagaac

SEQ ID NO: 4749636 - DNA, 15 bp, Homo sapiens
gtgtttttaactcaa

SEQ ID NO: 4749637 - DNA, 14 bp, Homo sapiens
gtgtttttctatta

SEQ ID NO: 4749638 - DNA, 18 bp, Homo sapiens
gtgtttttctattaaaag

SEQ ID NO: 4749639 - DNA, 19 bp, Homo sapiens
gtgtttttctattaaaaga

SEQ ID NO: 4749640 - DNA, 14 bp, Homo sapiens
gttaaatttgtaag

SEQ ID NO: 4749641 - DNA, 18 bp, Homo sapiens
gttaaatttgtaagtttc

SEQ ID NO: 4749642 - DNA, 18 bp, Homo sapiens
gttaacaataaagtgaca

SEQ ID NO: 4749643 - DNA, 19 bp, Homo sapiens
gttaacaataaagtgacaa

SEQ ID NO: 4749644 - DNA, 16 bp, Homo sapiens
gttaacactgtaatat

SEQ ID NO: 4749645 - DNA, 23 bp, Homo sapiens
gttaacagcgtgtcaactttcat

SEQ ID NO: 4749646 - DNA, 18 bp, Homo sapiens
gttaactatgacagatat

SEQ ID NO: 4749647 - DNA, 22 bp, Homo sapiens
gttaactatgacagatatattt

SEQ ID NO: 4749648 - DNA, 15 bp, Homo sapiens
gttaagaagctgttg

SEQ ID NO: 4749649 - DNA, 17 bp, Homo sapiens
gttaagaagctgttgta

SEQ ID NO: 4749650 - DNA, 12 bp, Homo sapiens
gttaaggaaact

SEQ ID NO: 4749651 - DNA, 21 bp, Homo sapiens
gttaaggaaactcttatctca

SEQ ID NO: 4749652 - DNA, 22 bp, Homo sapiens
gttaagttgatggtgatgaaat

SEQ ID NO: 4749653 - DNA, 19 bp, Homo sapiens
gttaattgtatttatgtat

SEQ ID NO: 4749654 - DNA, 16 bp, Homo sapiens
gttaattttcctcatt

SEQ ID NO: 4749655 - DNA, 17 bp, Homo sapiens
gttacacatttttcaga

SEQ ID NO: 4749656 - DNA, 22 bp, Homo sapiens
gttacataatcagtatatttgg

SEQ ID NO: 4749657 - DNA, 19 bp, Homo sapiens
gttactggcacctgaaatt

SEQ ID NO: 4749658 - DNA, 21 bp, Homo sapiens
gttactggcacctgaaattaa

SEQ ID NO: 4749659 - DNA, 15 bp, Homo sapiens
gttacttaaacatca

SEQ ID NO: 4749660 - DNA, 19 bp, Homo sapiens
gttagaggttccctttgac

SEQ ID NO: 4749661 - DNA, 18 bp, Homo sapiens
gttaggaaaaaattgaaa

SEQ ID NO: 4749662 - DNA, 20 bp, Homo sapiens
gttaggcattgtgggaaggg

SEQ ID NO: 4749663 - DNA, 13 bp, Homo sapiens
gttaggcctggca

SEQ ID NO: 4749664 - DNA, 15 bp, Homo sapiens
gttaggcctggcaca

SEQ ID NO: 4749665 - DNA, 16 bp, Homo sapiens
gttaggcctggcacag

SEQ ID NO: 4749666 - DNA, 21 bp, Homo sapiens
gttagggtgtgtgttcacctt

SEQ ID NO: 4749667 - DNA, 22 bp, Homo sapiens
gttagtttctccaagcaggaca

SEQ ID NO: 4749668 - DNA, 14 bp, Homo sapiens
gttataaagataca

SEQ ID NO: 4749669 - DNA, 15 bp, Homo sapiens
gttataaagatacag

SEQ ID NO: 4749670 - DNA, 17 bp, Homo sapiens
gttatcaaaatagtcta

SEQ ID NO: 4749671 - DNA, 20 bp, Homo sapiens
gttatcaccgtgggctccct

SEQ ID NO: 4749672 - DNA, 22 bp, Homo sapiens
gttatcaccgtgggctccctga

SEQ ID NO: 4749673 - DNA, 17 bp, Homo sapiens
gttatcgaaataacaat

SEQ ID NO: 4749674 - DNA, 21 bp, Homo sapiens
gttatcgaaataacaatgtta

SEQ ID NO: 4749675 - DNA, 23 bp, Homo sapiens
gttatcgaaataacaatgttaag

SEQ ID NO: 4749676 - DNA, 23 bp, Homo sapiens
gttatgaatatttacgtttttgt

SEQ ID NO: 4749677 - DNA, 19 bp, Homo sapiens
gttatgcggtctagggaat

SEQ ID NO: 4749678 - DNA, 18 bp, Homo sapiens
gttattaccaaaacagga

SEQ ID NO: 4749679 - DNA, 20 bp, Homo sapiens
gttattatatttacaaatgg

SEQ ID NO: 4749680 - DNA, 14 bp, Homo sapiens
gttattcataaaga

SEQ ID NO: 4749681 - DNA, 22 bp, Homo sapiens
gttattcttttccagaaagaaa

SEQ ID NO: 4749682 - DNA, 23 bp, Homo sapiens
gttatttaatcacagtcatcttt

SEQ ID NO: 4749683 - DNA, 14 bp, Homo sapiens
gttatttacactgg

SEQ ID NO: 4749684 - DNA, 16 bp, Homo sapiens
gttatttacactggtc

SEQ ID NO: 4749685 - DNA, 17 bp, Homo sapiens
gttatttacactggtct

SEQ ID NO: 4749686 - DNA, 19 bp, Homo sapiens
gttcaagcgattcttctgc

SEQ ID NO: 4749687 - DNA, 23 bp, Homo sapiens
gttcaatctggattcatatttaa

SEQ ID NO: 4749688 - DNA, 20 bp, Homo sapiens
gttcacttttgacaaaggca

SEQ ID NO: 4749689 - DNA, 21 bp, Homo sapiens
gttcagctactttccatttgg

SEQ ID NO: 4749690 - DNA, 14 bp, Homo sapiens
gttcaggctctgag

SEQ ID NO: 4749691 - DNA, 19 bp, Homo sapiens
gttcaggctctgagacaca

SEQ ID NO: 4749692 - DNA, 22 bp, Homo sapiens
gttcatcatccctccctgccta

SEQ ID NO: 4749693 - DNA, 20 bp, Homo sapiens
gttcatgggggagggggcag

SEQ ID NO: 4749694 - DNA, 13 bp, Homo sapiens
gttcattctgtga

SEQ ID NO: 4749695 - DNA, 14 bp, Homo sapiens
gttccaatgaaata

SEQ ID NO: 4749696 - DNA, 17 bp, Homo sapiens
gttccagagctgcttct

SEQ ID NO: 4749697 - DNA, 21 bp, Homo sapiens
gttccagcaattctcctgcct

SEQ ID NO: 4749698 - DNA, 19 bp, Homo sapiens
gttccagtgcagagatcct

SEQ ID NO: 4749699 - DNA, 18 bp, Homo sapiens
gttcccactgaaatggac

SEQ ID NO: 4749700 - DNA, 18 bp, Homo sapiens
gttccctttatttcacat

SEQ ID NO: 4749701 - DNA, 20 bp, Homo sapiens
gttccctttgacgccatccc

SEQ ID NO: 4749702 - DNA, 22 bp, Homo sapiens
gttccctttgacgccatcccag

SEQ ID NO: 4749703 - DNA, 22 bp, Homo sapiens
gttcctggacaccacccagagc

SEQ ID NO: 4749704 - DNA, 23 bp, Homo sapiens
gttcctggacaccacccagagca

SEQ ID NO: 4749705 - DNA, 18 bp, Homo sapiens
gttccttcctctgagcct

SEQ ID NO: 4749706 - DNA, 20 bp, Homo sapiens
gttctaatactttgtttatt

SEQ ID NO: 4749707 - DNA, 23 bp, Homo sapiens
gttctatttaacaactgggtcat

SEQ ID NO: 4749708 - DNA, 18 bp, Homo sapiens
gttctcaataaaacagaa

SEQ ID NO: 4749709 - DNA, 15 bp, Homo sapiens
gttctcaatttcatt

SEQ ID NO: 4749710 - DNA, 12 bp, Homo sapiens
gttctctgagga

SEQ ID NO: 4749711 - DNA, 15 bp, Homo sapiens
gttctgcacacagca

SEQ ID NO: 4749712 - DNA, 16 bp, Homo sapiens
gttctgcacacagcac

SEQ ID NO: 4749713 - DNA, 23 bp, Homo sapiens
gttctgcccaaattatgtgaaat

SEQ ID NO: 4749714 - DNA, 18 bp, Homo sapiens
gttctgctcatcattctc

SEQ ID NO: 4749715 - DNA, 16 bp, Homo sapiens
gttctggctcttccag

SEQ ID NO: 4749716 - DNA, 15 bp, Homo sapiens
gttctgggacacagt

SEQ ID NO: 4749717 - DNA, 21 bp, Homo sapiens
gttctgtatattttgttacct

SEQ ID NO: 4749718 - DNA, 18 bp, Homo sapiens
gttctgtcccttgccccc

SEQ ID NO: 4749719 - DNA, 21 bp, Homo sapiens
gttcttataagaagaagagag

SEQ ID NO: 4749720 - DNA, 16 bp, Homo sapiens
gttcttcataagctga

SEQ ID NO: 4749721 - DNA, 14 bp, Homo sapiens
gttcttcatctaag

SEQ ID NO: 4749722 - DNA, 17 bp, Homo sapiens
gttcttttatagactga

SEQ ID NO: 4749723 - DNA, 14 bp, Homo sapiens
gttgaccccagagg

SEQ ID NO: 4749724 - DNA, 19 bp, Homo sapiens
gttgacttgacagaacact

SEQ ID NO: 4749725 - DNA, 20 bp, Homo sapiens
gttgacttgacagaacactg

SEQ ID NO: 4749726 - DNA, 18 bp, Homo sapiens
gttgactttagggactca

SEQ ID NO: 4749727 - DNA, 22 bp, Homo sapiens
gttgaggtccagccctggctga

SEQ ID NO: 4749728 - DNA, 12 bp, Homo sapiens
gttgatactgtt

SEQ ID NO: 4749729 - DNA, 13 bp, Homo sapiens
gttgatactgttg

SEQ ID NO: 4749730 - DNA, 14 bp, Homo sapiens
gttgatactgttgc

SEQ ID NO: 4749731 - DNA, 15 bp, Homo sapiens
gttgatactgttgca

SEQ ID NO: 4749732 - DNA, 16 bp, Homo sapiens
gttgatactgttgcac

SEQ ID NO: 4749733 - DNA, 18 bp, Homo sapiens
gttgatactgttgcacgt

SEQ ID NO: 4749734 - DNA, 19 bp, Homo sapiens
gttgatactgttgcacgtg

SEQ ID NO: 4749735 - DNA, 21 bp, Homo sapiens
gttgatactgttgcacgtgtg

SEQ ID NO: 4749736 - DNA, 23 bp, Homo sapiens
gttgatagcacagaccctgccct

SEQ ID NO: 4749737 - DNA, 17 bp, Homo sapiens
gttgatgttggctggga

SEQ ID NO: 4749738 - DNA, 22 bp, Homo sapiens
gttgcaatagaacagagaaaga

SEQ ID NO: 4749739 - DNA, 19 bp, Homo sapiens
gttgcacgtgtgtttttct

SEQ ID NO: 4749740 - DNA, 23 bp, Homo sapiens
gttgcacgtgtgtttttctatta

SEQ ID NO: 4749741 - DNA, 14 bp, Homo sapiens
gttgccagtcaccc

SEQ ID NO: 4749742 - DNA, 17 bp, Homo sapiens
gttgccagtcaccccgg

SEQ ID NO: 4749743 - DNA, 12 bp, Homo sapiens
gttgcccaggca

SEQ ID NO: 4749744 - DNA, 17 bp, Homo sapiens
gttgcccaggcaggtct

SEQ ID NO: 4749745 - DNA, 18 bp, Homo sapiens
gttgcccaggcaggtctt

SEQ ID NO: 4749746 - DNA, 23 bp, Homo sapiens
gttgcccaggcaggtcttgaact

SEQ ID NO: 4749747 - DNA, 14 bp, Homo sapiens
gttgcccaggctgg

SEQ ID NO: 4749748 - DNA, 16 bp, Homo sapiens
gttgcccaggctggcg

SEQ ID NO: 4749749 - DNA, 21 bp, Homo sapiens
gttgcccaggctggcgtgcag

SEQ ID NO: 4749750 - DNA, 18 bp, Homo sapiens
gttgctgatgtttataaa

SEQ ID NO: 4749751 - DNA, 13 bp, Homo sapiens
gttggaagaaata

SEQ ID NO: 4749752 - DNA, 17 bp, Homo sapiens
gttggaatggatttttc

SEQ ID NO: 4749753 - DNA, 22 bp, Homo sapiens
gttggaatggatttttctttaa

SEQ ID NO: 4749754 - DNA, 19 bp, Homo sapiens
gttggagagctagaacctg

SEQ ID NO: 4749755 - DNA, 22 bp, Homo sapiens
gttggagagctagaacctggag

SEQ ID NO: 4749756 - DNA, 23 bp, Homo sapiens
gttggaggtttcacttgcacatc

SEQ ID NO: 4749757 - DNA, 14 bp, Homo sapiens
gttggatttttgtc

SEQ ID NO: 4749758 - DNA, 13 bp, Homo sapiens
gttggccaggctg

SEQ ID NO: 4749759 - DNA, 14 bp, Homo sapiens
gttggccaggctgc

SEQ ID NO: 4749760 - DNA, 15 bp, Homo sapiens
gttggccaggctggt

SEQ ID NO: 4749761 - DNA, 14 bp, Homo sapiens
gttggcccctgccc

SEQ ID NO: 4749762 - DNA, 13 bp, Homo sapiens
gttgggctggtgt

SEQ ID NO: 4749763 - DNA, 15 bp, Homo sapiens
gttgggctggtgtca

SEQ ID NO: 4749764 - DNA, 13 bp, Homo sapiens
gttgggctgtgcc

SEQ ID NO: 4749765 - DNA, 13 bp, Homo sapiens
gttgggtggatgc

SEQ ID NO: 4749766 - DNA, 16 bp, Homo sapiens
gttgtaaacaggaagc

SEQ ID NO: 4749767 - DNA, 14 bp, Homo sapiens
gttgtaattgcatt

SEQ ID NO: 4749768 - DNA, 15 bp, Homo sapiens
gttgtcctatgggag

SEQ ID NO: 4749769 - DNA, 16 bp, Homo sapiens
gttgtttataataaaa

SEQ ID NO: 4749770 - DNA, 11 bp, Homo sapiens
gttgtttcttt

SEQ ID NO: 4749771 - DNA, 20 bp, Homo sapiens
gtttacaaaaatttctgtaa

SEQ ID NO: 4749772 - DNA, 18 bp, Homo sapiens
gtttagatgaatgtcagt

SEQ ID NO: 4749773 - DNA, 17 bp, Homo sapiens
gtttaggattacttaga

SEQ ID NO: 4749774 - DNA, 14 bp, Homo sapiens
gtttataaagcaga

SEQ ID NO: 4749775 - DNA, 13 bp, Homo sapiens
gtttataataaaa

SEQ ID NO: 4749776 - DNA, 22 bp, Homo sapiens
gtttcaattgcatctcccagat

SEQ ID NO: 4749777 - DNA, 14 bp, Homo sapiens
gtttcaatttactt

SEQ ID NO: 4749778 - DNA, 16 bp, Homo sapiens
gtttcacttgcacatc

SEQ ID NO: 4749779 - DNA, 20 bp, Homo sapiens
gtttcaggtgacatgtgaaa

SEQ ID NO: 4749780 - DNA, 16 bp, Homo sapiens
gtttcagttctgtgta

SEQ ID NO: 4749781 - DNA, 13 bp, Homo sapiens
gtttcccactctg

SEQ ID NO: 4749782 - DNA, 17 bp, Homo sapiens
gtttcctgccctgggag

SEQ ID NO: 4749783 - DNA, 16 bp, Homo sapiens
gtttcctggcactgct

SEQ ID NO: 4749784 - DNA, 23 bp, Homo sapiens
gtttcctttcatttactgtggct

SEQ ID NO: 4749785 - DNA, 19 bp, Homo sapiens
gtttctatgtgtagggcgg

SEQ ID NO: 4749786 - DNA, 14 bp, Homo sapiens
gtttctcaaagaaa

SEQ ID NO: 4749787 - DNA, 17 bp, Homo sapiens
gtttctcccccatgttc

SEQ ID NO: 4749788 - DNA, 16 bp, Homo sapiens
gtttctgtcctgctgg

SEQ ID NO: 4749789 - DNA, 15 bp, Homo sapiens
gtttcttctgtaaat

SEQ ID NO: 4749790 - DNA, 11 bp, Homo sapiens
gtttcttgctt

SEQ ID NO: 4749791 - DNA, 19 bp, Homo sapiens
gtttgaagaaccgcatttt

SEQ ID NO: 4749792 - DNA, 15 bp, Homo sapiens
gtttgaccaggaaag

SEQ ID NO: 4749793 - DNA, 14 bp, Homo sapiens
gtttgactgtgcta

SEQ ID NO: 4749794 - DNA, 15 bp, Homo sapiens
gtttgatgaggccct

SEQ ID NO: 4749795 - DNA, 21 bp, Homo sapiens
gtttgattcagacagctgcct

SEQ ID NO: 4749796 - DNA, 22 bp, Homo sapiens
gtttgcaaggaagccacagctg

SEQ ID NO: 4749797 - DNA, 16 bp, Homo sapiens
gtttgcctctgcctct

SEQ ID NO: 4749798 - DNA, 18 bp, Homo sapiens
gtttgctaaatactgtag

SEQ ID NO: 4749799 - DNA, 21 bp, Homo sapiens
gtttgggggttaccaaaaata

SEQ ID NO: 4749800 - DNA, 20 bp, Homo sapiens
gtttgggtcttttatacatg

SEQ ID NO: 4749801 - DNA, 22 bp, Homo sapiens
gtttgtagtgccactgttgttt

SEQ ID NO: 4749802 - DNA, 16 bp, Homo sapiens
gtttgtggtaatttgt

SEQ ID NO: 4749803 - DNA, 15 bp, Homo sapiens
gttttaactgtggat

SEQ ID NO: 4749804 - DNA, 16 bp, Homo sapiens
gttttaagaggcaggg

SEQ ID NO: 4749805 - DNA, 21 bp, Homo sapiens
gttttactcctttttattcat

SEQ ID NO: 4749806 - DNA, 16 bp, Homo sapiens
gttttatgcatgtaat

SEQ ID NO: 4749807 - DNA, 19 bp, Homo sapiens
gttttccatgagtcccctg

SEQ ID NO: 4749808 - DNA, 15 bp, Homo sapiens
gttttgaaaagctat

SEQ ID NO: 4749809 - DNA, 22 bp, Homo sapiens
gttttgcacagccaaatttaaa

SEQ ID NO: 4749810 - DNA, 20 bp, Homo sapiens
gttttgttcccctcctccac

SEQ ID NO: 4749811 - DNA, 22 bp, Homo sapiens
gttttgttcccctcctccactc

SEQ ID NO: 4749812 - DNA, 13 bp, Homo sapiens
gttttgttctgta

SEQ ID NO: 4749813 - DNA, 18 bp, Homo sapiens
gttttgttctgtatattt

SEQ ID NO: 4749814 - DNA, 19 bp, Homo sapiens
gtttttaactcaatatttt

SEQ ID NO: 4749815 - DNA, 12 bp, Homo sapiens
gtttttcagttt

SEQ ID NO: 4749816 - DNA, 19 bp, Homo sapiens
gtttttcctgttcttaaga

SEQ ID NO: 4749817 - DNA, 12 bp, Homo sapiens
gtttttctatta

SEQ ID NO: 4749818 - DNA, 22 bp, Homo sapiens
gtttttctattaaaagactcat

SEQ ID NO: 4749819 - DNA, 15 bp, Homo sapiens
gtttttgttcaaagc

SEQ ID NO: 4749820 - DNA, 13 bp, Homo sapiens
gtttttgttgagt

SEQ ID NO: 4749821 - DNA, 12 bp, Homo sapiens
taaaaaaattta

SEQ ID NO: 4749822 - DNA, 20 bp, Homo sapiens
taaaaacctgaactttcatt

SEQ ID NO: 4749823 - DNA, 20 bp, Homo sapiens
taaaaactcaggcaaagaaa

SEQ ID NO: 4749824 - DNA, 16 bp, Homo sapiens
taaaaagaaagatttt

SEQ ID NO: 4749825 - DNA, 20 bp, Homo sapiens
taaaaaggaatccactccca

SEQ ID NO: 4749826 - DNA, 21 bp, Homo sapiens
taaaaagggcagccctcctta

SEQ ID NO: 4749827 - DNA, 16 bp, Homo sapiens
taaaaataaccttgca

SEQ ID NO: 4749828 - DNA, 14 bp, Homo sapiens
taaaaataatcagt

SEQ ID NO: 4749829 - DNA, 14 bp, Homo sapiens
taaaaatcaatgga

SEQ ID NO: 4749830 - DNA, 22 bp, Homo sapiens
taaaaatgtagaaattcttcat

SEQ ID NO: 4749831 - DNA, 23 bp, Homo sapiens
taaaaatgtagaaattcttcatg

SEQ ID NO: 4749832 - DNA, 12 bp, Homo sapiens
taaaacattaat

SEQ ID NO: 4749833 - DNA, 20 bp, Homo sapiens
taaaagataaatttgttgaa

SEQ ID NO: 4749834 - DNA, 17 bp, Homo sapiens
taaaagcaggcttctat

SEQ ID NO: 4749835 - DNA, 13 bp, Homo sapiens
taaaaggattaat

SEQ ID NO: 4749836 - DNA, 17 bp, Homo sapiens
taaaagtaaaattgttt

SEQ ID NO: 4749837 - DNA, 14 bp, Homo sapiens
taaaagtagtaaat

SEQ ID NO: 4749838 - DNA, 17 bp, Homo sapiens
taaaagttgcattttaa

SEQ ID NO: 4749839 - DNA, 17 bp, Homo sapiens
taaaagtttgtccttta

SEQ ID NO: 4749840 - DNA, 20 bp, Homo sapiens
taaaagtttgtcctttaact

SEQ ID NO: 4749841 - DNA, 15 bp, Homo sapiens
taaaataattctaaa

SEQ ID NO: 4749842 - DNA, 16 bp, Homo sapiens
taaaataattctaaag

SEQ ID NO: 4749843 - DNA, 17 bp, Homo sapiens
taaaataattctaaagg

SEQ ID NO: 4749844 - DNA, 13 bp, Homo sapiens
taaaatattactg

SEQ ID NO: 4749845 - DNA, 13 bp, Homo sapiens
taaaatattttag

SEQ ID NO: 4749846 - DNA, 15 bp, Homo sapiens
taaaatcattgtcaa

SEQ ID NO: 4749847 - DNA, 18 bp, Homo sapiens
taaaatgagctacttctt

SEQ ID NO: 4749848 - DNA, 20 bp, Homo sapiens
taaaatgagctacttcttat

SEQ ID NO: 4749849 - DNA, 15 bp, Homo sapiens
taaaatggatttaat

SEQ ID NO: 4749850 - DNA, 22 bp, Homo sapiens
taaaattcgttgaaacgatttc

SEQ ID NO: 4749851 - DNA, 16 bp, Homo sapiens
taaaattgttatcaaa

SEQ ID NO: 4749852 - DNA, 16 bp, Homo sapiens
taaaatttcttagaaa

SEQ ID NO: 4749853 - DNA, 18 bp, Homo sapiens
taaaatttcttagaaaac

SEQ ID NO: 4749854 - DNA, 12 bp, Homo sapiens
taaacaaatgta

SEQ ID NO: 4749855 - DNA, 19 bp, Homo sapiens
taaacaagaaccatttgca

SEQ ID NO: 4749856 - DNA, 14 bp, Homo sapiens
taaacagaaatgct

SEQ ID NO: 4749857 - DNA, 22 bp, Homo sapiens
taaacataataaatcacacatt

SEQ ID NO: 4749858 - DNA, 23 bp, Homo sapiens
taaacataataaatcacacattc

SEQ ID NO: 4749859 - DNA, 15 bp, Homo sapiens
taaacattttattta

SEQ ID NO: 4749860 - DNA, 20 bp, Homo sapiens
taaaccactaatgcttgcca

SEQ ID NO: 4749861 - DNA, 19 bp, Homo sapiens
taaacccagtagtggtgac

SEQ ID NO: 4749862 - DNA, 14 bp, Homo sapiens
taaaccctctgtga

SEQ ID NO: 4749863 - DNA, 15 bp, Homo sapiens
taaaccctctgtgaa

SEQ ID NO: 4749864 - DNA, 18 bp, Homo sapiens
taaaccttgtttctttct

SEQ ID NO: 4749865 - DNA, 13 bp, Homo sapiens
taaactaaatgtg

SEQ ID NO: 4749866 - DNA, 14 bp, Homo sapiens
taaactaaatgtgc

SEQ ID NO: 4749867 - DNA, 20 bp, Homo sapiens
taaactatgataaattatga

SEQ ID NO: 4749868 - DNA, 19 bp, Homo sapiens
taaactccaggatttataa

SEQ ID NO: 4749869 - DNA, 20 bp, Homo sapiens
taaactggtattttatcttt

SEQ ID NO: 4749870 - DNA, 16 bp, Homo sapiens
taaactgtattttatg

SEQ ID NO: 4749871 - DNA, 12 bp, Homo sapiens
taaactgtgcac

SEQ ID NO: 4749872 - DNA, 21 bp, Homo sapiens
taaactttcaatatctttatt

SEQ ID NO: 4749873 - DNA, 22 bp, Homo sapiens
taaagaaaagttttgtaaattt

SEQ ID NO: 4749874 - DNA, 14 bp, Homo sapiens
taaagaaggtttca

SEQ ID NO: 4749875 - DNA, 14 bp, Homo sapiens
taaagaatttcttt

SEQ ID NO: 4749876 - DNA, 20 bp, Homo sapiens
taaagagcatctgattcttg

SEQ ID NO: 4749877 - DNA, 23 bp, Homo sapiens
taaagatacagaactctttcaaa

SEQ ID NO: 4749878 - DNA, 12 bp, Homo sapiens
taaagcagatta

SEQ ID NO: 4749879 - DNA, 20 bp, Homo sapiens
taaagcagtttattataatg

SEQ ID NO: 4749880 - DNA, 17 bp, Homo sapiens
taaagccttgttttctc

SEQ ID NO: 4749881 - DNA, 20 bp, Homo sapiens
taaaggaacatggtttgtca

SEQ ID NO: 4749882 - DNA, 19 bp, Homo sapiens
taaaggacaaacagtgaat

SEQ ID NO: 4749883 - DNA, 23 bp, Homo sapiens
taaaggataatggtgaacatttt

SEQ ID NO: 4749884 - DNA, 18 bp, Homo sapiens
taaaggggtctgaaattt

SEQ ID NO: 4749885 - DNA, 14 bp, Homo sapiens
taaagtgaattgtt

SEQ ID NO: 4749886 - DNA, 22 bp, Homo sapiens
taaagtgcacacctttattcag

SEQ ID NO: 4749887 - DNA, 17 bp, Homo sapiens
taaagtgtgtgtgcagg

SEQ ID NO: 4749888 - DNA, 23 bp, Homo sapiens
taaagttctgtactcaaatgtag

SEQ ID NO: 4749889 - DNA, 18 bp, Homo sapiens
taaagttgtataaaaaca

SEQ ID NO: 4749890 - DNA, 17 bp, Homo sapiens
taaataaaaataatcct

SEQ ID NO: 4749891 - DNA, 13 bp, Homo sapiens
taaataacttttt

SEQ ID NO: 4749892 - DNA, 17 bp, Homo sapiens
taaatacagtcttccat

SEQ ID NO: 4749893 - DNA, 23 bp, Homo sapiens
taaatacagtcttccatttgcaa

SEQ ID NO: 4749894 - DNA, 15 bp, Homo sapiens
taaatacatgcatat

SEQ ID NO: 4749895 - DNA, 17 bp, Homo sapiens
taaatactggactcagg

SEQ ID NO: 4749896 - DNA, 18 bp, Homo sapiens
taaatactggactcagga

SEQ ID NO: 4749897 - DNA, 16 bp, Homo sapiens
taaataggagaggatg

SEQ ID NO: 4749898 - DNA, 21 bp, Homo sapiens
taaatatagttgtctttcttt

SEQ ID NO: 4749899 - DNA, 22 bp, Homo sapiens
taaatatagttgtctttctttg

SEQ ID NO: 4749900 - DNA, 18 bp, Homo sapiens
taaatatatgctaagtct

SEQ ID NO: 4749901 - DNA, 14 bp, Homo sapiens
taaatatgtgaaga

SEQ ID NO: 4749902 - DNA, 15 bp, Homo sapiens
taaatcacacatgct

SEQ ID NO: 4749903 - DNA, 16 bp, Homo sapiens
taaatcagttctcaat

SEQ ID NO: 4749904 - DNA, 13 bp, Homo sapiens
taaatcccctcac

SEQ ID NO: 4749905 - DNA, 18 bp, Homo sapiens
taaatctagtatacattg

SEQ ID NO: 4749906 - DNA, 21 bp, Homo sapiens
taaatctagtatacattgtct

SEQ ID NO: 4749907 - DNA, 18 bp, Homo sapiens
taaatggtgctgcagatt

SEQ ID NO: 4749908 - DNA, 19 bp, Homo sapiens
taaatgtgcaatagaaggt

SEQ ID NO: 4749909 - DNA, 13 bp, Homo sapiens
taaatgttatgac

SEQ ID NO: 4749910 - DNA, 15 bp, Homo sapiens
taaatgttatgactc

SEQ ID NO: 4749911 - DNA, 20 bp, Homo sapiens
taaatgttatgactccttga

SEQ ID NO: 4749912 - DNA, 20 bp, Homo sapiens
taaatgtttgttatttacac

SEQ ID NO: 4749913 - DNA, 23 bp, Homo sapiens
taaattatttgattatttaagac

SEQ ID NO: 4749914 - DNA, 14 bp, Homo sapiens
taaattctctctaa

SEQ ID NO: 4749915 - DNA, 17 bp, Homo sapiens
taaattgatttgttatg

SEQ ID NO: 4749916 - DNA, 13 bp, Homo sapiens
taaattgttgtaa

SEQ ID NO: 4749917 - DNA, 13 bp, Homo sapiens
taaatttaagcat

SEQ ID NO: 4749918 - DNA, 21 bp, Homo sapiens
taaatttggtttgttaattct

SEQ ID NO: 4749919 - DNA, 12 bp, Homo sapiens
taaatttgtaag

SEQ ID NO: 4749920 - DNA, 15 bp, Homo sapiens
taaatttgtaagttt

SEQ ID NO: 4749921 - DNA, 16 bp, Homo sapiens
taaatttgtaagtttc

SEQ ID NO: 4749922 - DNA, 23 bp, Homo sapiens
taaatttgtaagtttcaggtgac

SEQ ID NO: 4749923 - DNA, 15 bp, Homo sapiens
taaatttgttgtcat

SEQ ID NO: 4749924 - DNA, 18 bp, Homo sapiens
taaatttgttgtcatgtg

SEQ ID NO: 4749925 - DNA, 15 bp, Homo sapiens
taacaatgttaagga

SEQ ID NO: 4749926 - DNA, 21 bp, Homo sapiens
taacaatgttaaggaaactct

SEQ ID NO: 4749927 - DNA, 17 bp, Homo sapiens
taacactgtaatatctt

SEQ ID NO: 4749928 - DNA, 21 bp, Homo sapiens
taacagaacagcttcaggtta

SEQ ID NO: 4749929 - DNA, 20 bp, Homo sapiens
taacagcgtgtcaactttca

SEQ ID NO: 4749930 - DNA, 19 bp, Homo sapiens
taacaggcagatacaggaa

SEQ ID NO: 4749931 - DNA, 15 bp, Homo sapiens
taacagtaacgcagg

SEQ ID NO: 4749932 - DNA, 12 bp, Homo sapiens
taacagttttag

SEQ ID NO: 4749933 - DNA, 21 bp, Homo sapiens
taacataaaatccaatattgt

SEQ ID NO: 4749934 - DNA, 19 bp, Homo sapiens
taacatttaggagaagttg

SEQ ID NO: 4749935 - DNA, 11 bp, Homo sapiens
taacattttgt

SEQ ID NO: 4749936 - DNA, 16 bp, Homo sapiens
taacccagattttatt

SEQ ID NO: 4749937 - DNA, 12 bp, Homo sapiens
taaccctcactg

SEQ ID NO: 4749938 - DNA, 14 bp, Homo sapiens
taacctcatcttct

SEQ ID NO: 4749939 - DNA, 16 bp, Homo sapiens
taacctcgggcctgct

SEQ ID NO: 4749940 - DNA, 17 bp, Homo sapiens
taacctcttcagaggcc

SEQ ID NO: 4749941 - DNA, 18 bp, Homo sapiens
taacgtttttcctttaaa

SEQ ID NO: 4749942 - DNA, 15 bp, Homo sapiens
taactaatgttattt

SEQ ID NO: 4749943 - DNA, 17 bp, Homo sapiens
taactagaactgaattt

SEQ ID NO: 4749944 - DNA, 14 bp, Homo sapiens
taactatgacagat

SEQ ID NO: 4749945 - DNA, 16 bp, Homo sapiens
taactatgttgataaa

SEQ ID NO: 4749946 - DNA, 22 bp, Homo sapiens
taactcaatattttccatgaaa

SEQ ID NO: 4749947 - DNA, 23 bp, Homo sapiens
taactcatactgtgctggagcca

SEQ ID NO: 4749948 - DNA, 16 bp, Homo sapiens
taactctggattttga

SEQ ID NO: 4749949 - DNA, 20 bp, Homo sapiens
taactctggattttgaatta

SEQ ID NO: 4749950 - DNA, 13 bp, Homo sapiens
taactgctgattt

SEQ ID NO: 4749951 - DNA, 15 bp, Homo sapiens
taactgtaaagatgt

SEQ ID NO: 4749952 - DNA, 23 bp, Homo sapiens
taactgtaaagatgtttatttca

SEQ ID NO: 4749953 - DNA, 22 bp, Homo sapiens
taactgttaactatgacagata

SEQ ID NO: 4749954 - DNA, 14 bp, Homo sapiens
taacttattagcag

SEQ ID NO: 4749955 - DNA, 15 bp, Homo sapiens
taacttccaaataaa

SEQ ID NO: 4749956 - DNA, 16 bp, Homo sapiens
taacttgtctttggac

SEQ ID NO: 4749957 - DNA, 16 bp, Homo sapiens
taagaagctgcaataa

SEQ ID NO: 4749958 - DNA, 17 bp, Homo sapiens
taagaagctgcaataaa

SEQ ID NO: 4749959 - DNA, 15 bp, Homo sapiens
taagaagctgttgta

SEQ ID NO: 4749960 - DNA, 19 bp, Homo sapiens
taagaagctgttgtacatt

SEQ ID NO: 4749961 - DNA, 21 bp, Homo sapiens
taagaagctgttgtacattta

SEQ ID NO: 4749962 - DNA, 12 bp, Homo sapiens
taagacataacg

SEQ ID NO: 4749963 - DNA, 16 bp, Homo sapiens
taagacataacgtttt

SEQ ID NO: 4749964 - DNA, 17 bp, Homo sapiens
taagacataacgttttt

SEQ ID NO: 4749965 - DNA, 20 bp, Homo sapiens
taagacataacgtttttcct

SEQ ID NO: 4749966 - DNA, 22 bp, Homo sapiens
taagacataacgtttttccttt

SEQ ID NO: 4749967 - DNA, 13 bp, Homo sapiens
taagagacagtca

SEQ ID NO: 4749968 - DNA, 21 bp, Homo sapiens
taagagcacaggttagggcat

SEQ ID NO: 4749969 - DNA, 23 bp, Homo sapiens
taagagggagggagggctccaga

SEQ ID NO: 4749970 - DNA, 20 bp, Homo sapiens
taagagggcacacactgtgt

SEQ ID NO: 4749971 - DNA, 21 bp, Homo sapiens
taagagtagaaactgcaggga

SEQ ID NO: 4749972 - DNA, 12 bp, Homo sapiens
taagagtgtaga

SEQ ID NO: 4749973 - DNA, 19 bp, Homo sapiens
taagatgtcttgaaaacat

SEQ ID NO: 4749974 - DNA, 15 bp, Homo sapiens
taagatttttctcaa

SEQ ID NO: 4749975 - DNA, 21 bp, Homo sapiens
taagatttttctcaaagtttt

SEQ ID NO: 4749976 - DNA, 18 bp, Homo sapiens
taagcagagttctttgca

SEQ ID NO: 4749977 - DNA, 15 bp, Homo sapiens
taagcaggaggaggt

SEQ ID NO: 4749978 - DNA, 23 bp, Homo sapiens
taagcaggaggaggtgccaacag

SEQ ID NO: 4749979 - DNA, 19 bp, Homo sapiens
taagccacttaaaatgttc

SEQ ID NO: 4749980 - DNA, 18 bp, Homo sapiens
taagcctcaaatttgaac

SEQ ID NO: 4749981 - DNA, 20 bp, Homo sapiens
taagccttataaaccaatct

SEQ ID NO: 4749982 - DNA, 16 bp, Homo sapiens
taagctctgagctgtc

SEQ ID NO: 4749983 - DNA, 19 bp, Homo sapiens
taagcttagattttctgta

SEQ ID NO: 4749984 - DNA, 16 bp, Homo sapiens
taaggaaccctggaaa

SEQ ID NO: 4749985 - DNA, 22 bp, Homo sapiens
taagggaggcacttcctcccct

SEQ ID NO: 4749986 - DNA, 17 bp, Homo sapiens
taagggtatctggtgac

SEQ ID NO: 4749987 - DNA, 19 bp, Homo sapiens
taaggtgaaggtgaatcta

SEQ ID NO: 4749988 - DNA, 20 bp, Homo sapiens
taagtagcaaccctgtgata

SEQ ID NO: 4749989 - DNA, 14 bp, Homo sapiens
taagtataacaaac

SEQ ID NO: 4749990 - DNA, 17 bp, Homo sapiens
taagtatcttcatgtat

SEQ ID NO: 4749991 - DNA, 15 bp, Homo sapiens
taagtcaacctgcct

SEQ ID NO: 4749992 - DNA, 20 bp, Homo sapiens
taagtcctacttttaaagaa

SEQ ID NO: 4749993 - DNA, 20 bp, Homo sapiens
taagtcttatcaagcagcca

SEQ ID NO: 4749994 - DNA, 17 bp, Homo sapiens
taagtgagtttttaatg

SEQ ID NO: 4749995 - DNA, 14 bp, Homo sapiens
taagtgcacaacat

SEQ ID NO: 4749996 - DNA, 22 bp, Homo sapiens
taagtgcacaacattacaggga

SEQ ID NO: 4749997 - DNA, 18 bp, Homo sapiens
taagtgcgtgtgtagagt

SEQ ID NO: 4749998 - DNA, 14 bp, Homo sapiens
taagttcacttttt

SEQ ID NO: 4749999 - DNA, 17 bp, Homo sapiens
taagtttcaggtgacat

SEQ ID NO: 4750000 - DNA, 19 bp, Homo sapiens
taagtttcaggtgacatgt

SEQ ID NO: 4750001 - DNA, 17 bp, Homo sapiens
taagttttatttaactt

SEQ ID NO: 4750002 - DNA, 17 bp, Homo sapiens
taataaaagtacatgtt

SEQ ID NO: 4750003 - DNA, 12 bp, Homo sapiens
taataacattac

SEQ ID NO: 4750004 - DNA, 21 bp, Homo sapiens
taataacattaccttactgtg

SEQ ID NO: 4750005 - DNA, 14 bp, Homo sapiens
taataagacataac

SEQ ID NO: 4750006 - DNA, 20 bp, Homo sapiens
taatacagagtacgttaaaa

SEQ ID NO: 4750007 - DNA, 22 bp, Homo sapiens
taatagataaaaacctgaactt

SEQ ID NO: 4750008 - DNA, 18 bp, Homo sapiens
taatataagaagctttca

SEQ ID NO: 4750009 - DNA, 23 bp, Homo sapiens
taatatagtaggggttgaagaaa

SEQ ID NO: 4750010 - DNA, 12 bp, Homo sapiens
taatatctttaa

SEQ ID NO: 4750011 - DNA, 16 bp, Homo sapiens
taatatctttaaatga

SEQ ID NO: 4750012 - DNA, 18 bp, Homo sapiens
taatattcattggttaac

SEQ ID NO: 4750013 - DNA, 14 bp, Homo sapiens
taatattgtaaata

SEQ ID NO: 4750014 - DNA, 21 bp, Homo sapiens
taatattgtaaatactggact

SEQ ID NO: 4750015 - DNA, 16 bp, Homo sapiens
taatattgtggtgcca

SEQ ID NO: 4750016 - DNA, 13 bp, Homo sapiens
taatatttattga

SEQ ID NO: 4750017 - DNA, 18 bp, Homo sapiens
taatatttattgaattat

SEQ ID NO: 4750018 - DNA, 22 bp, Homo sapiens
taatcagttactggtatctgtc

SEQ ID NO: 4750019 - DNA, 22 bp, Homo sapiens
taatcataacatagttgaaaaa

SEQ ID NO: 4750020 - DNA, 22 bp, Homo sapiens
taatccacatctttactcaggc

SEQ ID NO: 4750021 - DNA, 18 bp, Homo sapiens
taatcttttcacaaataa

SEQ ID NO: 4750022 - DNA, 13 bp, Homo sapiens
taatgaaatggag

SEQ ID NO: 4750023 - DNA, 15 bp, Homo sapiens
taatgaaatggagga

SEQ ID NO: 4750024 - DNA, 17 bp, Homo sapiens
taatgaagaaagtggaa

SEQ ID NO: 4750025 - DNA, 14 bp, Homo sapiens
taatgagtatttgg

SEQ ID NO: 4750026 - DNA, 15 bp, Homo sapiens
taatgagtatttggt

SEQ ID NO: 4750027 - DNA, 16 bp, Homo sapiens
taatgagtatttggta

SEQ ID NO: 4750028 - DNA, 13 bp, Homo sapiens
taatgatttttgt

SEQ ID NO: 4750029 - DNA, 17 bp, Homo sapiens
taatgatttttgtgtat

SEQ ID NO: 4750030 - DNA, 22 bp, Homo sapiens
taatgcgcaggctggccctgcc

SEQ ID NO: 4750031 - DNA, 15 bp, Homo sapiens
taatgcttgatttag

SEQ ID NO: 4750032 - DNA, 18 bp, Homo sapiens
taatgggcttagagcagt

SEQ ID NO: 4750033 - DNA, 15 bp, Homo sapiens
taatggggcggtgag

SEQ ID NO: 4750034 - DNA, 16 bp, Homo sapiens
taatggtagttttaca

SEQ ID NO: 4750035 - DNA, 15 bp, Homo sapiens
taatggtttgaatat

SEQ ID NO: 4750036 - DNA, 16 bp, Homo sapiens
taatgtagccatggga

SEQ ID NO: 4750037 - DNA, 16 bp, Homo sapiens
taatgtcacaggcagg

SEQ ID NO: 4750038 - DNA, 17 bp, Homo sapiens
taatgtcacaggcaggt

SEQ ID NO: 4750039 - DNA, 17 bp, Homo sapiens
taatgttaaatttgtaa

SEQ ID NO: 4750040 - DNA, 11 bp, Homo sapiens
taatgttgaat

SEQ ID NO: 4750041 - DNA, 20 bp, Homo sapiens
taatgtttaaaatttcttag

SEQ ID NO: 4750042 - DNA, 13 bp, Homo sapiens
taattaaaagact

SEQ ID NO: 4750043 - DNA, 22 bp, Homo sapiens
taattatctcctaattgtatgt

SEQ ID NO: 4750044 - DNA, 16 bp, Homo sapiens
taattattgatgtttt

SEQ ID NO: 4750045 - DNA, 16 bp, Homo sapiens
taattatttaaatgta

SEQ ID NO: 4750046 - DNA, 18 bp, Homo sapiens
taattatttaaatgtact

SEQ ID NO: 4750047 - DNA, 14 bp, Homo sapiens
taattcaatgaaat

SEQ ID NO: 4750048 - DNA, 15 bp, Homo sapiens
taattcaatgaaatg

SEQ ID NO: 4750049 - DNA, 22 bp, Homo sapiens
taattccgtaggttattttcag

SEQ ID NO: 4750050 - DNA, 15 bp, Homo sapiens
taattctattgaaag

SEQ ID NO: 4750051 - DNA, 21 bp, Homo sapiens
taattcttagtggaagacaat

SEQ ID NO: 4750052 - DNA, 11 bp, Homo sapiens
taattctttaa

SEQ ID NO: 4750053 - DNA, 12 bp, Homo sapiens
taattctttaat

SEQ ID NO: 4750054 - DNA, 14 bp, Homo sapiens
taattctttaatga

SEQ ID NO: 4750055 - DNA, 18 bp, Homo sapiens
taattctttctattttca

SEQ ID NO: 4750056 - DNA, 21 bp, Homo sapiens
taattctttctattttcacaa

SEQ ID NO: 4750057 - DNA, 15 bp, Homo sapiens
taattgtcagtgatt

SEQ ID NO: 4750058 - DNA, 15 bp, Homo sapiens
taattgttgtttctt

SEQ ID NO: 4750059 - DNA, 21 bp, Homo sapiens
taatttacaaaaatataaaat

SEQ ID NO: 4750060 - DNA, 22 bp, Homo sapiens
taatttctgtgtctaaatttct

SEQ ID NO: 4750061 - DNA, 20 bp, Homo sapiens
taatttgaaggtagaatgtt

SEQ ID NO: 4750062 - DNA, 16 bp, Homo sapiens
taatttgtatgctaaa

SEQ ID NO: 4750063 - DNA, 21 bp, Homo sapiens
taatttgtatgctaaatgagg

SEQ ID NO: 4750064 - DNA, 22 bp, Homo sapiens
taatttgtatgctaaatgagga

SEQ ID NO: 4750065 - DNA, 15 bp, Homo sapiens
taatttgtgaatttg

SEQ ID NO: 4750066 - DNA, 18 bp, Homo sapiens
taatttgtgaatttgcaa

SEQ ID NO: 4750067 - DNA, 20 bp, Homo sapiens
taatttgtgaatttgcaaca

SEQ ID NO: 4750068 - DNA, 16 bp, Homo sapiens
taattttaaagtaatt

SEQ ID NO: 4750069 - DNA, 21 bp, Homo sapiens
taattttaaagtaatttctaa

SEQ ID NO: 4750070 - DNA, 20 bp, Homo sapiens
taattttccataagctattt

SEQ ID NO: 4750071 - DNA, 17 bp, Homo sapiens
taattttcctaataaag

SEQ ID NO: 4750072 - DNA, 16 bp, Homo sapiens
taattttcctcatttt

SEQ ID NO: 4750073 - DNA, 13 bp, Homo sapiens
taattttggataa

SEQ ID NO: 4750074 - DNA, 14 bp, Homo sapiens
taattttggataat

SEQ ID NO: 4750075 - DNA, 18 bp, Homo sapiens
taattttgtgttgtacaa

SEQ ID NO: 4750076 - DNA, 22 bp, Homo sapiens
taattttgtgttgtacaattaa

SEQ ID NO: 4750077 - DNA, 18 bp, Homo sapiens
taatttttgtactttgct

SEQ ID NO: 4750078 - DNA, 17 bp, Homo sapiens
taattttttaagaggaa

SEQ ID NO: 4750079 - DNA, 19 bp, Homo sapiens
taattttttaattatttaa

SEQ ID NO: 4750080 - DNA, 16 bp, Homo sapiens
taatttttttaaattt

SEQ ID NO: 4750081 - DNA, 14 bp, Homo sapiens
tacaaaaatataaa

SEQ ID NO: 4750082 - DNA, 22 bp, Homo sapiens
tacaaaaatttgccaggcgtgg

SEQ ID NO: 4750083 - DNA, 16 bp, Homo sapiens
tacaaaagattgtcat

SEQ ID NO: 4750084 - DNA, 17 bp, Homo sapiens
tacaaacacctggactt

SEQ ID NO: 4750085 - DNA, 23 bp, Homo sapiens
tacaaacatggaaaacagagtat

SEQ ID NO: 4750086 - DNA, 12 bp, Homo sapiens
tacaaatgtgat

SEQ ID NO: 4750087 - DNA, 13 bp, Homo sapiens
tacaaatgtgata

SEQ ID NO: 4750088 - DNA, 19 bp, Homo sapiens
tacaacaaacactgtgatg

SEQ ID NO: 4750089 - DNA, 14 bp, Homo sapiens
tacaaccaggtctt

SEQ ID NO: 4750090 - DNA, 18 bp, Homo sapiens
tacaagggcataaagtaa

SEQ ID NO: 4750091 - DNA, 14 bp, Homo sapiens
tacaaggtatgtac

SEQ ID NO: 4750092 - DNA, 16 bp, Homo sapiens
tacacaacatgtatgt

SEQ ID NO: 4750093 - DNA, 11 bp, Homo sapiens
tacacacacac

SEQ ID NO: 4750094 - DNA, 18 bp, Homo sapiens
tacacaccttatatttac

SEQ ID NO: 4750095 - DNA, 19 bp, Homo sapiens
tacacagtcaaatttacat

SEQ ID NO: 4750096 - DNA, 16 bp, Homo sapiens
tacacatgtatccttt

SEQ ID NO: 4750097 - DNA, 21 bp, Homo sapiens
tacacatttttcagatataaa

SEQ ID NO: 4750098 - DNA, 16 bp, Homo sapiens
tacactggtctaatgt

SEQ ID NO: 4750099 - DNA, 23 bp, Homo sapiens
tacactgtgctgagtctgaaggc

SEQ ID NO: 4750100 - DNA, 19 bp, Homo sapiens
tacacttactgttgtccta

SEQ ID NO: 4750101 - DNA, 21 bp, Homo sapiens
tacacttactgttgtcctatg

SEQ ID NO: 4750102 - DNA, 13 bp, Homo sapiens
tacacttggattt

SEQ ID NO: 4750103 - DNA, 19 bp, Homo sapiens
tacactttcattactttta

SEQ ID NO: 4750104 - DNA, 15 bp, Homo sapiens
tacagaaaatatggt

SEQ ID NO: 4750105 - DNA, 14 bp, Homo sapiens
tacagaataaaaga

SEQ ID NO: 4750106 - DNA, 13 bp, Homo sapiens
tacagaattttat

SEQ ID NO: 4750107 - DNA, 19 bp, Homo sapiens
tacagagaaaatgaatttg

SEQ ID NO: 4750108 - DNA, 23 bp, Homo sapiens
tacagagcccacgcccccactgg

SEQ ID NO: 4750109 - DNA, 15 bp, Homo sapiens
tacagagcttccctg

SEQ ID NO: 4750110 - DNA, 16 bp, Homo sapiens
tacagagcttccctga

SEQ ID NO: 4750111 - DNA, 18 bp, Homo sapiens
tacagaggccatgggcct

SEQ ID NO: 4750112 - DNA, 22 bp, Homo sapiens
tacagatcaggcagtgtttaaa

SEQ ID NO: 4750113 - DNA, 20 bp, Homo sapiens
tacagatccccaagcctggc

SEQ ID NO: 4750114 - DNA, 21 bp, Homo sapiens
tacagctgggtggcactgcca

SEQ ID NO: 4750115 - DNA, 15 bp, Homo sapiens
tacagctttgggtca

SEQ ID NO: 4750116 - DNA, 19 bp, Homo sapiens
tacaggaaaagctgctgac

SEQ ID NO: 4750117 - DNA, 14 bp, Homo sapiens
tacaggatttgaaa

SEQ ID NO: 4750118 - DNA, 14 bp, Homo sapiens
tacaggctcctgcc

SEQ ID NO: 4750119 - DNA, 17 bp, Homo sapiens
tacaggctcctgccacc

SEQ ID NO: 4750120 - DNA, 16 bp, Homo sapiens
tacagggaatgcctga

SEQ ID NO: 4750121 - DNA, 13 bp, Homo sapiens
tacagtaggagcc

SEQ ID NO: 4750122 - DNA, 18 bp, Homo sapiens
tacagtaggagcccagct

SEQ ID NO: 4750123 - DNA, 20 bp, Homo sapiens
tacagtaggagcccagctct

SEQ ID NO: 4750124 - DNA, 13 bp, Homo sapiens
tacagtattgaaa

SEQ ID NO: 4750125 - DNA, 15 bp, Homo sapiens
tacagtctcaatttt

SEQ ID NO: 4750126 - DNA, 17 bp, Homo sapiens
tacagtctcaattttgt

SEQ ID NO: 4750127 - DNA, 22 bp, Homo sapiens
tacagtcttccatttgcaaggg

SEQ ID NO: 4750128 - DNA, 17 bp, Homo sapiens
tacagtcttgcagcagg

SEQ ID NO: 4750129 - DNA, 12 bp, Homo sapiens
tacagtcttgta

SEQ ID NO: 4750130 - DNA, 13 bp, Homo sapiens
tacagtcttgtat

SEQ ID NO: 4750131 - DNA, 15 bp, Homo sapiens
tacagtgtacagtct

SEQ ID NO: 4750132 - DNA, 22 bp, Homo sapiens
tacagtgtacagtcttgtatta

SEQ ID NO: 4750133 - DNA, 17 bp, Homo sapiens
tacagttcataaatttg

SEQ ID NO: 4750134 - DNA, 23 bp, Homo sapiens
tacagttcggtgagctacaaatg

SEQ ID NO: 4750135 - DNA, 14 bp, Homo sapiens
tacagttttaactg

SEQ ID NO: 4750136 - DNA, 19 bp, Homo sapiens
tacagttttaactgtggat

SEQ ID NO: 4750137 - DNA, 15 bp, Homo sapiens
tacataaaattttct

SEQ ID NO: 4750138 - DNA, 19 bp, Homo sapiens
tacataatcagtatatttg

SEQ ID NO: 4750139 - DNA, 14 bp, Homo sapiens
tacatatttcagtt

SEQ ID NO: 4750140 - DNA, 14 bp, Homo sapiens
tacatcagtttgat

SEQ ID NO: 4750141 - DNA, 20 bp, Homo sapiens
tacatctctaattttggata

SEQ ID NO: 4750142 - DNA, 21 bp, Homo sapiens
tacatgacatttatttttcat

SEQ ID NO: 4750143 - DNA, 14 bp, Homo sapiens
tacatgcatataat

SEQ ID NO: 4750144 - DNA, 15 bp, Homo sapiens
tacatgctcttagaa

SEQ ID NO: 4750145 - DNA, 19 bp, Homo sapiens
tacattgtgtcctgcttat

SEQ ID NO: 4750146 - DNA, 22 bp, Homo sapiens
tacattgtgtcctgcttatact

SEQ ID NO: 4750147 - DNA, 19 bp, Homo sapiens
tacatttagcccctctctt

SEQ ID NO: 4750148 - DNA, 19 bp, Homo sapiens
tacatttatctattaaaat

SEQ ID NO: 4750149 - DNA, 16 bp, Homo sapiens
tacatttatgatttaa

SEQ ID NO: 4750150 - DNA, 17 bp, Homo sapiens
tacatttatgatttaat

SEQ ID NO: 4750151 - DNA, 19 bp, Homo sapiens
tacatttatgatttaataa

SEQ ID NO: 4750152 - DNA, 20 bp, Homo sapiens
tacatttatgatttaataaa

SEQ ID NO: 4750153 - DNA, 23 bp, Homo sapiens
tacattttaaaggataatggtga

SEQ ID NO: 4750154 - DNA, 19 bp, Homo sapiens
taccaagcgcttctttctg

SEQ ID NO: 4750155 - DNA, 17 bp, Homo sapiens
taccaatgaaaaaatgt

SEQ ID NO: 4750156 - DNA, 18 bp, Homo sapiens
taccacagtttcttctgt

SEQ ID NO: 4750157 - DNA, 14 bp, Homo sapiens
taccacccccacac

SEQ ID NO: 4750158 - DNA, 23 bp, Homo sapiens
taccactgtggaagtccctcaga

SEQ ID NO: 4750159 - DNA, 14 bp, Homo sapiens
taccagcagagcac

SEQ ID NO: 4750160 - DNA, 14 bp, Homo sapiens
taccagccactgga

SEQ ID NO: 4750161 - DNA, 20 bp, Homo sapiens
taccagcgaggaggctccag

SEQ ID NO: 4750162 - DNA, 14 bp, Homo sapiens
taccaggtctcctc

SEQ ID NO: 4750163 - DNA, 22 bp, Homo sapiens
taccaggtctcctccaccgcca

SEQ ID NO: 4750164 - DNA, 19 bp, Homo sapiens
taccagtgggcatgtatta

SEQ ID NO: 4750165 - DNA, 11 bp, Homo sapiens
tacccactgct

SEQ ID NO: 4750166 - DNA, 14 bp, Homo sapiens
tacccactgctctg

SEQ ID NO: 4750167 - DNA, 15 bp, Homo sapiens
tacccactgctctgg

SEQ ID NO: 4750168 - DNA, 17 bp, Homo sapiens
tacccccgcccaggctg

SEQ ID NO: 4750169 - DNA, 20 bp, Homo sapiens
tacccccgcccaggctggcc

SEQ ID NO: 4750170 - DNA, 15 bp, Homo sapiens
taccccctgcaaagc

SEQ ID NO: 4750171 - DNA, 10 bp, Homo sapiens
tacccctccc

SEQ ID NO: 4750172 - DNA, 13 bp, Homo sapiens
tacccctcccagc

SEQ ID NO: 4750173 - DNA, 15 bp, Homo sapiens
tacccctcccagctg

SEQ ID NO: 4750174 - DNA, 16 bp, Homo sapiens
tacccctcccagctga

SEQ ID NO: 4750175 - DNA, 20 bp, Homo sapiens
tacccgggaagggggctggg

SEQ ID NO: 4750176 - DNA, 15 bp, Homo sapiens
taccctccctgctgt

SEQ ID NO: 4750177 - DNA, 23 bp, Homo sapiens
taccctccctgctgtcccctctt

SEQ ID NO: 4750178 - DNA, 16 bp, Homo sapiens
taccctgagctgaggc

SEQ ID NO: 4750179 - DNA, 17 bp, Homo sapiens
taccctgagctgaggca

SEQ ID NO: 4750180 - DNA, 18 bp, Homo sapiens
taccctgagctgaggcag

SEQ ID NO: 4750181 - DNA, 19 bp, Homo sapiens
tacccttggaaagaaatgt

SEQ ID NO: 4750182 - DNA, 16 bp, Homo sapiens
tacctataatcctcat

SEQ ID NO: 4750183 - DNA, 14 bp, Homo sapiens
tacctcctgtctct

SEQ ID NO: 4750184 - DNA, 23 bp, Homo sapiens
tacctctccagcctcagctctca

SEQ ID NO: 4750185 - DNA, 21 bp, Homo sapiens
tacctgaaaacactgtgcaca

SEQ ID NO: 4750186 - DNA, 13 bp, Homo sapiens
tacctgaggggcc

SEQ ID NO: 4750187 - DNA, 15 bp, Homo sapiens
tacctgaggggcctc

SEQ ID NO: 4750188 - DNA, 13 bp, Homo sapiens
tacctgtccccct

SEQ ID NO: 4750189 - DNA, 12 bp, Homo sapiens
tacctgtggata

SEQ ID NO: 4750190 - DNA, 12 bp, Homo sapiens
taccttactgtg

SEQ ID NO: 4750191 - DNA, 22 bp, Homo sapiens
taccttattgagcgtgattctg

SEQ ID NO: 4750192 - DNA, 14 bp, Homo sapiens
taccttctccctca

SEQ ID NO: 4750193 - DNA, 13 bp, Homo sapiens
taccttggttccc

SEQ ID NO: 4750194 - DNA, 22 bp, Homo sapiens
taccttggttcccccactgatc

SEQ ID NO: 4750195 - DNA, 19 bp, Homo sapiens
tacctttgaaatattaaaa

SEQ ID NO: 4750196 - DNA, 13 bp, Homo sapiens
taccttttaagac

SEQ ID NO: 4750197 - DNA, 22 bp, Homo sapiens
tacgcagcgtgctttaaaaaat

SEQ ID NO: 4750198 - DNA, 13 bp, Homo sapiens
tacggtgggggta

SEQ ID NO: 4750199 - DNA, 13 bp, Homo sapiens
tacgtatgagacg

SEQ ID NO: 4750200 - DNA, 14 bp, Homo sapiens
tacgtctgacaggc

SEQ ID NO: 4750201 - DNA, 15 bp, Homo sapiens
tacgtctgacaggca

SEQ ID NO: 4750202 - DNA, 16 bp, Homo sapiens
tacgtctgacaggcaa

SEQ ID NO: 4750203 - DNA, 20 bp, Homo sapiens
tacgtgacctctgcaagaca

SEQ ID NO: 4750204 - DNA, 13 bp, Homo sapiens
tacgtttttgtaa

SEQ ID NO: 4750205 - DNA, 15 bp, Homo sapiens
tactaaaaagtataa

SEQ ID NO: 4750206 - DNA, 17 bp, Homo sapiens
tactaaagcaaagcaaa

SEQ ID NO: 4750207 - DNA, 18 bp, Homo sapiens
tactaaagtagtttaagt

SEQ ID NO: 4750208 - DNA, 22 bp, Homo sapiens
tactaataaaatttaaaagtct

SEQ ID NO: 4750209 - DNA, 20 bp, Homo sapiens
tactacagtcctcccatctc

SEQ ID NO: 4750210 - DNA, 21 bp, Homo sapiens
tactacccccacagacctgct

SEQ ID NO: 4750211 - DNA, 21 bp, Homo sapiens
tactagggatccctcatctgt

SEQ ID NO: 4750212 - DNA, 20 bp, Homo sapiens
tactatcatgtcaaacgtga

SEQ ID NO: 4750213 - DNA, 15 bp, Homo sapiens
tactattcatgtttt

SEQ ID NO: 4750214 - DNA, 17 bp, Homo sapiens
tactcaaattcaatgat

SEQ ID NO: 4750215 - DNA, 18 bp, Homo sapiens
tactcaaattcaatgatt

SEQ ID NO: 4750216 - DNA, 23 bp, Homo sapiens
tactcaaccctctcaggtgacca

SEQ ID NO: 4750217 - DNA, 19 bp, Homo sapiens
tactcaagcaggtttcttg

SEQ ID NO: 4750218 - DNA, 21 bp, Homo sapiens
tactcagggaaagcatttaaa

SEQ ID NO: 4750219 - DNA, 20 bp, Homo sapiens
tactcattaattcaatgaaa

SEQ ID NO: 4750220 - DNA, 19 bp, Homo sapiens
tactccaaggtttataaag

SEQ ID NO: 4750221 - DNA, 15 bp, Homo sapiens
tactccctttaaaga

SEQ ID NO: 4750222 - DNA, 13 bp, Homo sapiens
tactcctgggtca

SEQ ID NO: 4750223 - DNA, 19 bp, Homo sapiens
tactctgtgtaatagaata

SEQ ID NO: 4750224 - DNA, 11 bp, Homo sapiens
tactctgtgtg

SEQ ID NO: 4750225 - DNA, 14 bp, Homo sapiens
tactgaaaaagcaa

SEQ ID NO: 4750226 - DNA, 22 bp, Homo sapiens
tactgaagaaatctttccagtt

SEQ ID NO: 4750227 - DNA, 13 bp, Homo sapiens
tactgaatattaa

SEQ ID NO: 4750228 - DNA, 16 bp, Homo sapiens
tactgatcttaccttt

SEQ ID NO: 4750229 - DNA, 16 bp, Homo sapiens
tactgatttttaagtc

SEQ ID NO: 4750230 - DNA, 22 bp, Homo sapiens
tactggcacctgaaattaattt

SEQ ID NO: 4750231 - DNA, 14 bp, Homo sapiens
tactggcctcgcct

SEQ ID NO: 4750232 - DNA, 17 bp, Homo sapiens
tactggtatctgtcact

SEQ ID NO: 4750233 - DNA, 17 bp, Homo sapiens
tactgtatggaaacact

SEQ ID NO: 4750234 - DNA, 18 bp, Homo sapiens
tactgtgctggagccact

SEQ ID NO: 4750235 - DNA, 12 bp, Homo sapiens
tactgtggagga

SEQ ID NO: 4750236 - DNA, 23 bp, Homo sapiens
tactgttgcacgtgtgtttttct

SEQ ID NO: 4750237 - DNA, 12 bp, Homo sapiens
tactgtttgtct

SEQ ID NO: 4750238 - DNA, 19 bp, Homo sapiens
tactgtttgtcttctcccc

SEQ ID NO: 4750239 - DNA, 20 bp, Homo sapiens
tactgtttgtcttctcccca

SEQ ID NO: 4750240 - DNA, 18 bp, Homo sapiens
tacttatttgtatatggt

SEQ ID NO: 4750241 - DNA, 15 bp, Homo sapiens
tacttccccttccta

SEQ ID NO: 4750242 - DNA, 15 bp, Homo sapiens
tacttctgctacata

SEQ ID NO: 4750243 - DNA, 20 bp, Homo sapiens
tacttctgtaattgtgtgga

SEQ ID NO: 4750244 - DNA, 22 bp, Homo sapiens
tacttctgtaattgtgtggatt

SEQ ID NO: 4750245 - DNA, 15 bp, Homo sapiens
tacttcttattcact

SEQ ID NO: 4750246 - DNA, 16 bp, Homo sapiens
tacttgatatttcctt

SEQ ID NO: 4750247 - DNA, 18 bp, Homo sapiens
tacttgatatttccttca

SEQ ID NO: 4750248 - DNA, 14 bp, Homo sapiens
tacttgtggacaca

SEQ ID NO: 4750249 - DNA, 18 bp, Homo sapiens
tacttgtggacacagctc

SEQ ID NO: 4750250 - DNA, 15 bp, Homo sapiens
tacttgttctgtatt

SEQ ID NO: 4750251 - DNA, 17 bp, Homo sapiens
tactttagaagcctgca

SEQ ID NO: 4750252 - DNA, 21 bp, Homo sapiens
tactttagaagcctgcataat

SEQ ID NO: 4750253 - DNA, 17 bp, Homo sapiens
tactttcccattgtaac

SEQ ID NO: 4750254 - DNA, 17 bp, Homo sapiens
tactttcgaaatttcat

SEQ ID NO: 4750255 - DNA, 15 bp, Homo sapiens
tacttttaaaaatgt

SEQ ID NO: 4750256 - DNA, 19 bp, Homo sapiens
tacttttaaaaatgtagaa

SEQ ID NO: 4750257 - DNA, 22 bp, Homo sapiens
tacttttaaagaatttctttat

SEQ ID NO: 4750258 - DNA, 13 bp, Homo sapiens
tactttttaaaca

SEQ ID NO: 4750259 - DNA, 19 bp, Homo sapiens
tactttttgttccagagct

SEQ ID NO: 4750260 - DNA, 20 bp, Homo sapiens
tactttttttggaagttatt

SEQ ID NO: 4750261 - DNA, 17 bp, Homo sapiens
tagaaactactaatttt

SEQ ID NO: 4750262 - DNA, 15 bp, Homo sapiens
tagaaagaagatgaa

SEQ ID NO: 4750263 - DNA, 18 bp, Homo sapiens
tagaaagtaagaaaacaa

SEQ ID NO: 4750264 - DNA, 18 bp, Homo sapiens
tagaaattacctgtggat

SEQ ID NO: 4750265 - DNA, 13 bp, Homo sapiens
tagaaattcttca

SEQ ID NO: 4750266 - DNA, 23 bp, Homo sapiens
tagaacagagaaagaggaagctt

SEQ ID NO: 4750267 - DNA, 13 bp, Homo sapiens
tagaacctagaag

SEQ ID NO: 4750268 - DNA, 16 bp, Homo sapiens
tagaacctagaagggc

SEQ ID NO: 4750269 - DNA, 17 bp, Homo sapiens
tagaacctagaagggct

SEQ ID NO: 4750270 - DNA, 23 bp, Homo sapiens
tagaacctagaagggctagaacc

SEQ ID NO: 4750271 - DNA, 22 bp, Homo sapiens
tagaacctggagggctagaacc

SEQ ID NO: 4750272 - DNA, 17 bp, Homo sapiens
tagaacctggagggctg

SEQ ID NO: 4750273 - DNA, 17 bp, Homo sapiens
tagaactgaattttgtc

SEQ ID NO: 4750274 - DNA, 22 bp, Homo sapiens
tagaacttggatgtacctgccc

SEQ ID NO: 4750275 - DNA, 23 bp, Homo sapiens
tagaagatattagtcttggggca

SEQ ID NO: 4750276 - DNA, 16 bp, Homo sapiens
tagaagatcctacccc

SEQ ID NO: 4750277 - DNA, 20 bp, Homo sapiens
tagaagcattccttctttga

SEQ ID NO: 4750278 - DNA, 21 bp, Homo sapiens
tagaagtaaggattataaaca

SEQ ID NO: 4750279 - DNA, 21 bp, Homo sapiens
tagaataattttattagaata

SEQ ID NO: 4750280 - DNA, 16 bp, Homo sapiens
tagaatacattgtact

SEQ ID NO: 4750281 - DNA, 16 bp, Homo sapiens
tagaatatcctacttc

SEQ ID NO: 4750282 - DNA, 18 bp, Homo sapiens
tagaatgttttcaaatgt

SEQ ID NO: 4750283 - DNA, 22 bp, Homo sapiens
tagaattataactgtaaagatg

SEQ ID NO: 4750284 - DNA, 17 bp, Homo sapiens
tagacagtccctgccaa

SEQ ID NO: 4750285 - DNA, 17 bp, Homo sapiens
tagacatgtcatggtcc

SEQ ID NO: 4750286 - DNA, 16 bp, Homo sapiens
tagagaagtaagcaga

SEQ ID NO: 4750287 - DNA, 16 bp, Homo sapiens
tagagatatttaaaag

SEQ ID NO: 4750288 - DNA, 18 bp, Homo sapiens
tagagattacctcctgag

SEQ ID NO: 4750289 - DNA, 14 bp, Homo sapiens
tagagcagccctgg

SEQ ID NO: 4750290 - DNA, 20 bp, Homo sapiens
tagagcaggcgttcagctca

SEQ ID NO: 4750291 - DNA, 22 bp, Homo sapiens
tagagcaggcgttcagctcact

SEQ ID NO: 4750292 - DNA, 22 bp, Homo sapiens
tagagcagtttctgtcctgctg

SEQ ID NO: 4750293 - DNA, 14 bp, Homo sapiens
tagagcctgaggga

SEQ ID NO: 4750294 - DNA, 23 bp, Homo sapiens
tagagctgacacaaacctgcctg

SEQ ID NO: 4750295 - DNA, 21 bp, Homo sapiens
tagagcttgtaataaatactg

SEQ ID NO: 4750296 - DNA, 20 bp, Homo sapiens
tagaggatccctctctggat

SEQ ID NO: 4750297 - DNA, 14 bp, Homo sapiens
tagagtaatgaaat

SEQ ID NO: 4750298 - DNA, 15 bp, Homo sapiens
tagagtcaatttgct

SEQ ID NO: 4750299 - DNA, 15 bp, Homo sapiens
tagagtgtctttcca

SEQ ID NO: 4750300 - DNA, 17 bp, Homo sapiens
tagagttaagaagctgt

SEQ ID NO: 4750301 - DNA, 19 bp, Homo sapiens
tagagttaagaagctgttg

SEQ ID NO: 4750302 - DNA, 23 bp, Homo sapiens
tagagttaagaagctgttgtaca

SEQ ID NO: 4750303 - DNA, 17 bp, Homo sapiens
tagataatcttttacat

SEQ ID NO: 4750304 - DNA, 20 bp, Homo sapiens
tagatgaatgtcagttgtta

SEQ ID NO: 4750305 - DNA, 24 bp, Homo sapiens
tagattcaagttgtgtctgaaaat

SEQ ID NO: 4750306 - DNA, 11 bp, Homo sapiens
tagatttatgg

SEQ ID NO: 4750307 - DNA, 18 bp, Homo sapiens
tagattttagcatgatga

SEQ ID NO: 4750308 - DNA, 22 bp, Homo sapiens
tagcaaaaatagttaaaatgct

SEQ ID NO: 4750309 - DNA, 16 bp, Homo sapiens
tagcaaccctgtgata

SEQ ID NO: 4750310 - DNA, 14 bp, Homo sapiens
tagcacagaccctg

SEQ ID NO: 4750311 - DNA, 19 bp, Homo sapiens
tagcacagaccctgccctg

SEQ ID NO: 4750312 - DNA, 14 bp, Homo sapiens
tagcaccagggaag

SEQ ID NO: 4750313 - DNA, 21 bp, Homo sapiens
tagcagggaaaatatatatct

SEQ ID NO: 4750314 - DNA, 20 bp, Homo sapiens
tagcataattttgtgttgta

SEQ ID NO: 4750315 - DNA, 21 bp, Homo sapiens
tagcatgtcgtcaaagctgaa

SEQ ID NO: 4750316 - DNA, 13 bp, Homo sapiens
tagccaggatcat

SEQ ID NO: 4750317 - DNA, 20 bp, Homo sapiens
tagccaggatcatggtgtaa

SEQ ID NO: 4750318 - DNA, 22 bp, Homo sapiens
tagccaggatcatggtgtaata

SEQ ID NO: 4750319 - DNA, 18 bp, Homo sapiens
tagcccccacccacttcc

SEQ ID NO: 4750320 - DNA, 18 bp, Homo sapiens
tagccctcaccctggggc

SEQ ID NO: 4750321 - DNA, 21 bp, Homo sapiens
tagcctaaggctcctgttttg

SEQ ID NO: 4750322 - DNA, 14 bp, Homo sapiens
tagcgtatacattt

SEQ ID NO: 4750323 - DNA, 17 bp, Homo sapiens
tagctagctatttctat

SEQ ID NO: 4750324 - DNA, 11 bp, Homo sapiens
tagctatttaa

SEQ ID NO: 4750325 - DNA, 16 bp, Homo sapiens
tagctatttaatacta

SEQ ID NO: 4750326 - DNA, 20 bp, Homo sapiens
tagctcaggtgtccctgcac

SEQ ID NO: 4750327 - DNA, 20 bp, Homo sapiens
tagctcccctcctctcccct

SEQ ID NO: 4750328 - DNA, 14 bp, Homo sapiens
tagctctacacaac

SEQ ID NO: 4750329 - DNA, 18 bp, Homo sapiens
tagctctacacaacatgt

SEQ ID NO: 4750330 - DNA, 11 bp, Homo sapiens
tagctgggact

SEQ ID NO: 4750331 - DNA, 15 bp, Homo sapiens
tagctgggactacag

SEQ ID NO: 4750332 - DNA, 15 bp, Homo sapiens
tagcttggaaactgg

SEQ ID NO: 4750333 - DNA, 16 bp, Homo sapiens
tagctttgctctgcca

SEQ ID NO: 4750334 - DNA, 14 bp, Homo sapiens
taggaaatttaaga

SEQ ID NO: 4750335 - DNA, 14 bp, Homo sapiens
taggaagactttgg

SEQ ID NO: 4750336 - DNA, 15 bp, Homo sapiens
taggaagactttgga

SEQ ID NO: 4750337 - DNA, 12 bp, Homo sapiens
taggaatcagca

SEQ ID NO: 4750338 - DNA, 20 bp, Homo sapiens
taggagaagtcttctattta

SEQ ID NO: 4750339 - DNA, 18 bp, Homo sapiens
taggagaggatgagagcc

SEQ ID NO: 4750340 - DNA, 19 bp, Homo sapiens
taggcaggaacatacagac

SEQ ID NO: 4750341 - DNA, 17 bp, Homo sapiens
taggcaggacatgctga

SEQ ID NO: 4750342 - DNA, 14 bp, Homo sapiens
tagggaagtaacag

SEQ ID NO: 4750343 - DNA, 21 bp, Homo sapiens
taggggagccacatttacata

SEQ ID NO: 4750344 - DNA, 13 bp, Homo sapiens
tagggtcctgggg

SEQ ID NO: 4750345 - DNA, 20 bp, Homo sapiens
tagggtccttgaaacagaaa

SEQ ID NO: 4750346 - DNA, 15 bp, Homo sapiens
tagggttaaatggta

SEQ ID NO: 4750347 - DNA, 23 bp, Homo sapiens
taggtagccttgtgttctgagta

SEQ ID NO: 4750348 - DNA, 20 bp, Homo sapiens
taggtataagtggtgtgtgt

SEQ ID NO: 4750349 - DNA, 23 bp, Homo sapiens
taggtgacagagtgagactctgt

SEQ ID NO: 4750350 - DNA, 17 bp, Homo sapiens
tagtaaaagtcataaat

SEQ ID NO: 4750351 - DNA, 16 bp, Homo sapiens
tagtaaatatgtgaag

SEQ ID NO: 4750352 - DNA, 17 bp, Homo sapiens
tagtaaatatgtgaaga

SEQ ID NO: 4750353 - DNA, 23 bp, Homo sapiens
tagtaaattttgtgatgaataaa

SEQ ID NO: 4750354 - DNA, 14 bp, Homo sapiens
tagtagaacaatgt

SEQ ID NO: 4750355 - DNA, 23 bp, Homo sapiens
tagtagccaaagttaaatgtatc

SEQ ID NO: 4750356 - DNA, 17 bp, Homo sapiens
tagtaggggttgaagaa

SEQ ID NO: 4750357 - DNA, 13 bp, Homo sapiens
tagtatgaaaatg

SEQ ID NO: 4750358 - DNA, 16 bp, Homo sapiens
tagtatggtggctggg

SEQ ID NO: 4750359 - DNA, 16 bp, Homo sapiens
tagtcaaggactggta

SEQ ID NO: 4750360 - DNA, 15 bp, Homo sapiens
tagtcacctctgggc

SEQ ID NO: 4750361 - DNA, 18 bp, Homo sapiens
tagtctctgggtttacaa

SEQ ID NO: 4750362 - DNA, 15 bp, Homo sapiens
tagtgatcacagcag

SEQ ID NO: 4750363 - DNA, 20 bp, Homo sapiens
tagtgatcacagcagcttct

SEQ ID NO: 4750364 - DNA, 17 bp, Homo sapiens
tagtgatctattttgag

SEQ ID NO: 4750365 - DNA, 13 bp, Homo sapiens
tagtgccaccaca

SEQ ID NO: 4750366 - DNA, 15 bp, Homo sapiens
tagtggatggaaggg

SEQ ID NO: 4750367 - DNA, 18 bp, Homo sapiens
tagtggatggaaggggct

SEQ ID NO: 4750368 - DNA, 13 bp, Homo sapiens
tagtggtctttgt

SEQ ID NO: 4750369 - DNA, 14 bp, Homo sapiens
tagtggtctttgta

SEQ ID NO: 4750370 - DNA, 15 bp, Homo sapiens
tagtgtagtgttaaa

SEQ ID NO: 4750371 - DNA, 14 bp, Homo sapiens
tagttaaaatgctg

SEQ ID NO: 4750372 - DNA, 19 bp, Homo sapiens
tagttgaaaaaagaagttt

SEQ ID NO: 4750373 - DNA, 17 bp, Homo sapiens
tagttgcaatagaacag

SEQ ID NO: 4750374 - DNA, 21 bp, Homo sapiens
tagttgtctttctttgctgct

SEQ ID NO: 4750375 - DNA, 22 bp, Homo sapiens
tagttgtttgattcagacagct

SEQ ID NO: 4750376 - DNA, 21 bp, Homo sapiens
tagtttgattattcagtgtca

SEQ ID NO: 4750377 - DNA, 10 bp, Homo sapiens
tagtttttgt

SEQ ID NO: 4750378 - DNA, 21 bp, Homo sapiens
tagtttttttttaatctaaat

SEQ ID NO: 4750379 - DNA, 20 bp, Homo sapiens
tataaaaacatgagttattc

SEQ ID NO: 4750380 - DNA, 21 bp, Homo sapiens
tataaaatatgaagacataaa

SEQ ID NO: 4750381 - DNA, 17 bp, Homo sapiens
tataaaatattgttaat

SEQ ID NO: 4750382 - DNA, 15 bp, Homo sapiens
tataaaccaatctta

SEQ ID NO: 4750383 - DNA, 17 bp, Homo sapiens
tataaaccaatcttaaa

SEQ ID NO: 4750384 - DNA, 20 bp, Homo sapiens
tataaaccaatcttaaacat

SEQ ID NO: 4750385 - DNA, 19 bp, Homo sapiens
tataaacctctaatttatt

SEQ ID NO: 4750386 - DNA, 12 bp, Homo sapiens
tataaagattaa

SEQ ID NO: 4750387 - DNA, 16 bp, Homo sapiens
tataaagattaacact

SEQ ID NO: 4750388 - DNA, 19 bp, Homo sapiens
tataaagtggaagtatgta

SEQ ID NO: 4750389 - DNA, 13 bp, Homo sapiens
tataaataggaga

SEQ ID NO: 4750390 - DNA, 15 bp, Homo sapiens
tataaatatcctgct

SEQ ID NO: 4750391 - DNA, 21 bp, Homo sapiens
tataaattttttttgtttcat

SEQ ID NO: 4750392 - DNA, 15 bp, Homo sapiens
tataacaaactatgt

SEQ ID NO: 4750393 - DNA, 16 bp, Homo sapiens
tataacagtgtttaaa

SEQ ID NO: 4750394 - DNA, 19 bp, Homo sapiens
tataactatgttgataaaa

SEQ ID NO: 4750395 - DNA, 16 bp, Homo sapiens
tataacttattagcag

SEQ ID NO: 4750396 - DNA, 20 bp, Homo sapiens
tataagaagctttcagtatt

SEQ ID NO: 4750397 - DNA, 15 bp, Homo sapiens
tataagatttttgaa

SEQ ID NO: 4750398 - DNA, 14 bp, Homo sapiens
tatacactgtaatg

SEQ ID NO: 4750399 - DNA, 22 bp, Homo sapiens
tatacacttggagtttgcattc

SEQ ID NO: 4750400 - DNA, 16 bp, Homo sapiens
tataccccatttgatt

SEQ ID NO: 4750401 - DNA, 17 bp, Homo sapiens
tataccccctgcaaagc

SEQ ID NO: 4750402 - DNA, 13 bp, Homo sapiens
tatacctttgaaa

SEQ ID NO: 4750403 - DNA, 14 bp, Homo sapiens
tatacctttgaaat

SEQ ID NO: 4750404 - DNA, 20 bp, Homo sapiens
tatacgcagcgtgctttaaa

SEQ ID NO: 4750405 - DNA, 17 bp, Homo sapiens
tatactatttatataca

SEQ ID NO: 4750406 - DNA, 21 bp, Homo sapiens
tatagcctaagcggctgttta

SEQ ID NO: 4750407 - DNA, 19 bp, Homo sapiens
tatagctagctatttctat

SEQ ID NO: 4750408 - DNA, 21 bp, Homo sapiens
tatagtaggggttgaagaaaa

SEQ ID NO: 4750409 - DNA, 22 bp, Homo sapiens
tatagtatttaattgtttcaaa

SEQ ID NO: 4750410 - DNA, 16 bp, Homo sapiens
tatagtcaatgtaaaa

SEQ ID NO: 4750411 - DNA, 20 bp, Homo sapiens
tatatacttgttgtttaatg

SEQ ID NO: 4750412 - DNA, 17 bp, Homo sapiens
tatatattttaaaaaca

SEQ ID NO: 4750413 - DNA, 14 bp, Homo sapiens
tatatattttaatt

SEQ ID NO: 4750414 - DNA, 13 bp, Homo sapiens
tatatattttatg

SEQ ID NO: 4750415 - DNA, 21 bp, Homo sapiens
tatatgcacttataattttcc

SEQ ID NO: 4750416 - DNA, 12 bp, Homo sapiens
tatatggacttt

SEQ ID NO: 4750417 - DNA, 21 bp, Homo sapiens
tatatgggcttttacctgtgc

SEQ ID NO: 4750418 - DNA, 19 bp, Homo sapiens
tatatgttttaagaggcag

SEQ ID NO: 4750419 - DNA, 16 bp, Homo sapiens
tatattaaaagcaggc

SEQ ID NO: 4750420 - DNA, 23 bp, Homo sapiens
tatattacttgcctatctgactt

SEQ ID NO: 4750421 - DNA, 14 bp, Homo sapiens
tatattcatcaaat

SEQ ID NO: 4750422 - DNA, 20 bp, Homo sapiens
tatattcattctttttgaaa

SEQ ID NO: 4750423 - DNA, 18 bp, Homo sapiens
tatattcttatgttatca

SEQ ID NO: 4750424 - DNA, 17 bp, Homo sapiens
tatattgattatttgtt

SEQ ID NO: 4750425 - DNA, 18 bp, Homo sapiens
tatattgttttgtctcct

SEQ ID NO: 4750426 - DNA, 16 bp, Homo sapiens
tatatttctacagaga

SEQ ID NO: 4750427 - DNA, 22 bp, Homo sapiens
tatatttggtttctagatcact

SEQ ID NO: 4750428 - DNA, 14 bp, Homo sapiens
tatattttaatttg

SEQ ID NO: 4750429 - DNA, 14 bp, Homo sapiens
tatattttgctgtt

SEQ ID NO: 4750430 - DNA, 11 bp, Homo sapiens
tatattttgtt

SEQ ID NO: 4750431 - DNA, 15 bp, Homo sapiens
tatattttgttacct

SEQ ID NO: 4750432 - DNA, 15 bp, Homo sapiens
tatcaagcagccaag

SEQ ID NO: 4750433 - DNA, 20 bp, Homo sapiens
tatcaagtactacattttct

SEQ ID NO: 4750434 - DNA, 19 bp, Homo sapiens
tatcaccgtgggctccctg

SEQ ID NO: 4750435 - DNA, 22 bp, Homo sapiens
tatcacgtctgacaaatgtgta

SEQ ID NO: 4750436 - DNA, 17 bp, Homo sapiens
tatcagactaagccagc

SEQ ID NO: 4750437 - DNA, 14 bp, Homo sapiens
tatcagatgctcat

SEQ ID NO: 4750438 - DNA, 20 bp, Homo sapiens
tatcaggacccagaggaagg

SEQ ID NO: 4750439 - DNA, 19 bp, Homo sapiens
tatcaggtgctgccatcca

SEQ ID NO: 4750440 - DNA, 20 bp, Homo sapiens
tatcaggtgctgccatccag

SEQ ID NO: 4750441 - DNA, 20 bp, Homo sapiens
tatcatataaacattttatt

SEQ ID NO: 4750442 - DNA, 16 bp, Homo sapiens
tatcatgtcaaacgtg

SEQ ID NO: 4750443 - DNA, 13 bp, Homo sapiens
tatcatttgtgaa

SEQ ID NO: 4750444 - DNA, 15 bp, Homo sapiens
tatcatttgtgaaga

SEQ ID NO: 4750445 - DNA, 17 bp, Homo sapiens
tatcatttgtgaagaat

SEQ ID NO: 4750446 - DNA, 23 bp, Homo sapiens
tatccaccaaaagggctccctga

SEQ ID NO: 4750447 - DNA, 20 bp, Homo sapiens
tatccattctacctgtcctc

SEQ ID NO: 4750448 - DNA, 19 bp, Homo sapiens
tatcccattctccctctca

SEQ ID NO: 4750449 - DNA, 17 bp, Homo sapiens
tatcccttggacatttt

SEQ ID NO: 4750450 - DNA, 15 bp, Homo sapiens
tatcgaaataacaat

SEQ ID NO: 4750451 - DNA, 16 bp, Homo sapiens
tatcgaaataacaatg

SEQ ID NO: 4750452 - DNA, 18 bp, Homo sapiens
tatcgaaataacaatgtt

SEQ ID NO: 4750453 - DNA, 14 bp, Homo sapiens
tatctaattcttta

SEQ ID NO: 4750454 - DNA, 14 bp, Homo sapiens
tatctaatttgtgc

SEQ ID NO: 4750455 - DNA, 21 bp, Homo sapiens
tatctacccagtcatgtactg

SEQ ID NO: 4750456 - DNA, 19 bp, Homo sapiens
tatctagcagtaaaagata

SEQ ID NO: 4750457 - DNA, 22 bp, Homo sapiens
tatctcagtcatgcataaatat

SEQ ID NO: 4750458 - DNA, 13 bp, Homo sapiens
tatctcccccagc

SEQ ID NO: 4750459 - DNA, 14 bp, Homo sapiens
tatctcccccagcc

SEQ ID NO: 4750460 - DNA, 16 bp, Homo sapiens
tatctcccccagcccc

SEQ ID NO: 4750461 - DNA, 18 bp, Homo sapiens
tatctcccccagccccat

SEQ ID NO: 4750462 - DNA, 22 bp, Homo sapiens
tatctgcatgtaaaatcttcag

SEQ ID NO: 4750463 - DNA, 16 bp, Homo sapiens
tatctgccatgtccat

SEQ ID NO: 4750464 - DNA, 21 bp, Homo sapiens
tatctgtcatttgagcagggc

SEQ ID NO: 4750465 - DNA, 22 bp, Homo sapiens
tatcttataaagtggaagtatg

SEQ ID NO: 4750466 - DNA, 13 bp, Homo sapiens
tatcttgtgtatg

SEQ ID NO: 4750467 - DNA, 14 bp, Homo sapiens
tatctttgccaccc

SEQ ID NO: 4750468 - DNA, 22 bp, Homo sapiens
tatctttgccaccctcatgctg

SEQ ID NO: 4750469 - DNA, 13 bp, Homo sapiens
tatcttttgacct

SEQ ID NO: 4750470 - DNA, 15 bp, Homo sapiens
tatgaagaagagagt

SEQ ID NO: 4750471 - DNA, 23 bp, Homo sapiens
tatgaagacagaggcagagattg

SEQ ID NO: 4750472 - DNA, 21 bp, Homo sapiens
tatgagaagtactttgtgctg

SEQ ID NO: 4750473 - DNA, 13 bp, Homo sapiens
tatgataatatat

SEQ ID NO: 4750474 - DNA, 14 bp, Homo sapiens
tatgatcacggctc

SEQ ID NO: 4750475 - DNA, 21 bp, Homo sapiens
tatgatcacggctcactgcag

SEQ ID NO: 4750476 - DNA, 23 bp, Homo sapiens
tatgatcacggctcactgcagcc

SEQ ID NO: 4750477 - DNA, 15 bp, Homo sapiens
tatgatctatttgta

SEQ ID NO: 4750478 - DNA, 16 bp, Homo sapiens
tatgatctatttgtag

SEQ ID NO: 4750479 - DNA, 17 bp, Homo sapiens
tatgatctatttgtaga

SEQ ID NO: 4750480 - DNA, 15 bp, Homo sapiens
tatgcacgaccttgg

SEQ ID NO: 4750481 - DNA, 22 bp, Homo sapiens
tatgcagtgatatggcagaaga

SEQ ID NO: 4750482 - DNA, 22 bp, Homo sapiens
tatgcatggtgtagatgccctg

SEQ ID NO: 4750483 - DNA, 17 bp, Homo sapiens
tatgcttccattaacaa

SEQ ID NO: 4750484 - DNA, 15 bp, Homo sapiens
tatggaatgcttctt

SEQ ID NO: 4750485 - DNA, 18 bp, Homo sapiens
tatggagctcagagaggg

SEQ ID NO: 4750486 - DNA, 15 bp, Homo sapiens
tatggatatgtgtaa

SEQ ID NO: 4750487 - DNA, 15 bp, Homo sapiens
tatggcactattttt

SEQ ID NO: 4750488 - DNA, 13 bp, Homo sapiens
tatggcagtgtct

SEQ ID NO: 4750489 - DNA, 23 bp, Homo sapiens
tatggcatctcattgaggacaaa

SEQ ID NO: 4750490 - DNA, 21 bp, Homo sapiens
tatggctagaatatcctactt

SEQ ID NO: 4750491 - DNA, 21 bp, Homo sapiens
tatggtatttattttttcttt

SEQ ID NO: 4750492 - DNA, 13 bp, Homo sapiens
tatggtgccaatg

SEQ ID NO: 4750493 - DNA, 15 bp, Homo sapiens
tatggtgccaatgga

SEQ ID NO: 4750494 - DNA, 19 bp, Homo sapiens
tatggtgccaatggaacct

SEQ ID NO: 4750495 - DNA, 17 bp, Homo sapiens
tatggtggatccaaact

SEQ ID NO: 4750496 - DNA, 11 bp, Homo sapiens
tatgtaacatg

SEQ ID NO: 4750497 - DNA, 16 bp, Homo sapiens
tatgtaatgcttatgt

SEQ ID NO: 4750498 - DNA, 20 bp, Homo sapiens
tatgtaatgcttatgtgttg

SEQ ID NO: 4750499 - DNA, 18 bp, Homo sapiens
tatgtacagttcataaat

SEQ ID NO: 4750500 - DNA, 19 bp, Homo sapiens
tatgtagcagggaaaatat

SEQ ID NO: 4750501 - DNA, 18 bp, Homo sapiens
tatgtagtatctatatga

SEQ ID NO: 4750502 - DNA, 18 bp, Homo sapiens
tatgtatattaaaaaaga

SEQ ID NO: 4750503 - DNA, 13 bp, Homo sapiens
tatgtgaagaaaa

SEQ ID NO: 4750504 - DNA, 20 bp, Homo sapiens
tatgtgcacatctgttttgt

SEQ ID NO: 4750505 - DNA, 15 bp, Homo sapiens
tatgtggatacagtc

SEQ ID NO: 4750506 - DNA, 21 bp, Homo sapiens
tatgtgggtcttatgcttcca

SEQ ID NO: 4750507 - DNA, 16 bp, Homo sapiens
tatgtgtggtttcagt

SEQ ID NO: 4750508 - DNA, 14 bp, Homo sapiens
tatgttaatatttt

SEQ ID NO: 4750509 - DNA, 12 bp, Homo sapiens
tatgttacttaa

SEQ ID NO: 4750510 - DNA, 20 bp, Homo sapiens
tatgttacttaaacatcatt

SEQ ID NO: 4750511 - DNA, 21 bp, Homo sapiens
tatgttatcaccttccaaaca

SEQ ID NO: 4750512 - DNA, 14 bp, Homo sapiens
tatgttcacaccta

SEQ ID NO: 4750513 - DNA, 14 bp, Homo sapiens
tatgttgataaaag

SEQ ID NO: 4750514 - DNA, 15 bp, Homo sapiens
tatgtttttgttcaa

SEQ ID NO: 4750515 - DNA, 16 bp, Homo sapiens
tatgtttttgttcaaa

SEQ ID NO: 4750516 - DNA, 12 bp, Homo sapiens
tattaaaagact

SEQ ID NO: 4750517 - DNA, 15 bp, Homo sapiens
tattaaaagactcat

SEQ ID NO: 4750518 - DNA, 17 bp, Homo sapiens
tattaaaattgccattt

SEQ ID NO: 4750519 - DNA, 14 bp, Homo sapiens
tattaaaattgtaa

SEQ ID NO: 4750520 - DNA, 17 bp, Homo sapiens
tattaaatgcccagccc

SEQ ID NO: 4750521 - DNA, 20 bp, Homo sapiens
tattaaattgtgtacacttt

SEQ ID NO: 4750522 - DNA, 22 bp, Homo sapiens
tattaatttgaaaccaggacat

SEQ ID NO: 4750523 - DNA, 18 bp, Homo sapiens
tattactaatgatgcttt

SEQ ID NO: 4750524 - DNA, 16 bp, Homo sapiens
tattactgtttgttct

SEQ ID NO: 4750525 - DNA, 14 bp, Homo sapiens
tattagacttctaa

SEQ ID NO: 4750526 - DNA, 16 bp, Homo sapiens
tattagacttctaaat

SEQ ID NO: 4750527 - DNA, 18 bp, Homo sapiens
tattagccagtcattgta

SEQ ID NO: 4750528 - DNA, 23 bp, Homo sapiens
tattatattcattctttttgaaa

SEQ ID NO: 4750529 - DNA, 13 bp, Homo sapiens
tattattactgtt

SEQ ID NO: 4750530 - DNA, 14 bp, Homo sapiens
tattattactgttt

SEQ ID NO: 4750531 - DNA, 18 bp, Homo sapiens
tattcaagaaagatatct

SEQ ID NO: 4750532 - DNA, 20 bp, Homo sapiens
tattcaccttttcttcaaaa

SEQ ID NO: 4750533 - DNA, 15 bp, Homo sapiens
tattcagatgtatgt

SEQ ID NO: 4750534 - DNA, 20 bp, Homo sapiens
tattcaggacttgaaagaaa

SEQ ID NO: 4750535 - DNA, 14 bp, Homo sapiens
tattcagtgaattt

SEQ ID NO: 4750536 - DNA, 15 bp, Homo sapiens
tattcagtgtcactg

SEQ ID NO: 4750537 - DNA, 16 bp, Homo sapiens
tattcagttcttacac

SEQ ID NO: 4750538 - DNA, 18 bp, Homo sapiens
tattcataaagagaaaat

SEQ ID NO: 4750539 - DNA, 23 bp, Homo sapiens
tattcatcaaataaaccttgttt

SEQ ID NO: 4750540 - DNA, 15 bp, Homo sapiens
tattctcaaagttaa

SEQ ID NO: 4750541 - DNA, 16 bp, Homo sapiens
tattctcaaagttaaa

SEQ ID NO: 4750542 - DNA, 15 bp, Homo sapiens
tattctcgaatcacc

SEQ ID NO: 4750543 - DNA, 12 bp, Homo sapiens
tattctctgagc

SEQ ID NO: 4750544 - DNA, 14 bp, Homo sapiens
tattctctgatgtt

SEQ ID NO: 4750545 - DNA, 20 bp, Homo sapiens
tattctggatgtataaaaat

SEQ ID NO: 4750546 - DNA, 22 bp, Homo sapiens
tattcttggtactgttgctttg

SEQ ID NO: 4750547 - DNA, 16 bp, Homo sapiens
tattgaaatgatttca

SEQ ID NO: 4750548 - DNA, 16 bp, Homo sapiens
tattgaattattttgt

SEQ ID NO: 4750549 - DNA, 21 bp, Homo sapiens
tattgaattattttgttactg

SEQ ID NO: 4750550 - DNA, 22 bp, Homo sapiens
tattgaattattttgttactgt

SEQ ID NO: 4750551 - DNA, 18 bp, Homo sapiens
tattgagcgtgattctgt

SEQ ID NO: 4750552 - DNA, 18 bp, Homo sapiens
tattgataacagcactga

SEQ ID NO: 4750553 - DNA, 14 bp, Homo sapiens
tattgcccacgctg

SEQ ID NO: 4750554 - DNA, 11 bp, Homo sapiens
tattgctgggg

SEQ ID NO: 4750555 - DNA, 17 bp, Homo sapiens
tattggatatttgatat

SEQ ID NO: 4750556 - DNA, 16 bp, Homo sapiens
tattgggtttggtcac

SEQ ID NO: 4750557 - DNA, 12 bp, Homo sapiens
tattgtacagtt

SEQ ID NO: 4750558 - DNA, 15 bp, Homo sapiens
tattgtacagttttt

SEQ ID NO: 4750559 - DNA, 14 bp, Homo sapiens
tattgtacataaaa

SEQ ID NO: 4750560 - DNA, 15 bp, Homo sapiens
tattgtacataaaat

SEQ ID NO: 4750561 - DNA, 17 bp, Homo sapiens
tattgtgctcagagaca

SEQ ID NO: 4750562 - DNA, 14 bp, Homo sapiens
tattgtggctccct

SEQ ID NO: 4750563 - DNA, 13 bp, Homo sapiens
tattgtttacatt

SEQ ID NO: 4750564 - DNA, 13 bp, Homo sapiens
tatttaaaacttg

SEQ ID NO: 4750565 - DNA, 13 bp, Homo sapiens
tatttaaaagaca

SEQ ID NO: 4750566 - DNA, 17 bp, Homo sapiens
tatttaaaagacaaaca

SEQ ID NO: 4750567 - DNA, 14 bp, Homo sapiens
tatttaaagcacat

SEQ ID NO: 4750568 - DNA, 20 bp, Homo sapiens
tatttaactctgtaagaaac

SEQ ID NO: 4750569 - DNA, 19 bp, Homo sapiens
tatttaacttaacccagat

SEQ ID NO: 4750570 - DNA, 12 bp, Homo sapiens
tatttaagcctt

SEQ ID NO: 4750571 - DNA, 17 bp, Homo sapiens
tatttaagccttataaa

SEQ ID NO: 4750572 - DNA, 10 bp, Homo sapiens
tatttaataa

SEQ ID NO: 4750573 - DNA, 14 bp, Homo sapiens
tatttaataacatt

SEQ ID NO: 4750574 - DNA, 23 bp, Homo sapiens
tatttaatcacagtcatctttaa

SEQ ID NO: 4750575 - DNA, 17 bp, Homo sapiens
tatttaatttgtatgct

SEQ ID NO: 4750576 - DNA, 23 bp, Homo sapiens
tatttaatttttttgagacagag

SEQ ID NO: 4750577 - DNA, 20 bp, Homo sapiens
tatttagcaccagggaaggg

SEQ ID NO: 4750578 - DNA, 17 bp, Homo sapiens
tatttagcgcacccaga

SEQ ID NO: 4750579 - DNA, 22 bp, Homo sapiens
tatttatattcatcaaataaac

SEQ ID NO: 4750580 - DNA, 17 bp, Homo sapiens
tatttatgatttcaaca

SEQ ID NO: 4750581 - DNA, 22 bp, Homo sapiens
tatttattaaatgcccagcccc

SEQ ID NO: 4750582 - DNA, 15 bp, Homo sapiens
tatttattaatttga

SEQ ID NO: 4750583 - DNA, 20 bp, Homo sapiens
tatttattgaaatgatttca

SEQ ID NO: 4750584 - DNA, 17 bp, Homo sapiens
tatttcaccatttaatt

SEQ ID NO: 4750585 - DNA, 20 bp, Homo sapiens
tatttccctcccctggggac

SEQ ID NO: 4750586 - DNA, 22 bp, Homo sapiens
tatttcctttgcgcaaacttta

SEQ ID NO: 4750587 - DNA, 13 bp, Homo sapiens
tatttgataacat

SEQ ID NO: 4750588 - DNA, 13 bp, Homo sapiens
tatttgattattt

SEQ ID NO: 4750589 - DNA, 14 bp, Homo sapiens
tatttgattattta

SEQ ID NO: 4750590 - DNA, 21 bp, Homo sapiens
tatttgcataacaattcctct

SEQ ID NO: 4750591 - DNA, 16 bp, Homo sapiens
tatttgccatgggctt

SEQ ID NO: 4750592 - DNA, 15 bp, Homo sapiens
tatttgctgttaact

SEQ ID NO: 4750593 - DNA, 21 bp, Homo sapiens
tatttggtttggccatctctg

SEQ ID NO: 4750594 - DNA, 18 bp, Homo sapiens
tatttgtataaaagtgtg

SEQ ID NO: 4750595 - DNA, 22 bp, Homo sapiens
tatttgtataaaagtgtgaaat

SEQ ID NO: 4750596 - DNA, 23 bp, Homo sapiens
tatttgtcggggaagatgaaacc

SEQ ID NO: 4750597 - DNA, 18 bp, Homo sapiens
tatttgtgatgacaactg

SEQ ID NO: 4750598 - DNA, 18 bp, Homo sapiens
tattttaaaatctgtcac

SEQ ID NO: 4750599 - DNA, 22 bp, Homo sapiens
tattttaaaggggtctgaaatt

SEQ ID NO: 4750600 - DNA, 14 bp, Homo sapiens
tattttcaccattt

SEQ ID NO: 4750601 - DNA, 17 bp, Homo sapiens
tattttgttactgtctg

SEQ ID NO: 4750602 - DNA, 18 bp, Homo sapiens
tattttgttactgtctgt

SEQ ID NO: 4750603 - DNA, 14 bp, Homo sapiens
tattttgtttcaat

SEQ ID NO: 4750604 - DNA, 19 bp, Homo sapiens
tatttttaactctggattt

SEQ ID NO: 4750605 - DNA, 23 bp, Homo sapiens
tatttttaactctggattttgaa

SEQ ID NO: 4750606 - DNA, 22 bp, Homo sapiens
tatttttatatacgtttatata

SEQ ID NO: 4750607 - DNA, 13 bp, Homo sapiens
tatttttatttgt

SEQ ID NO: 4750608 - DNA, 14 bp, Homo sapiens
tatttttgtttaca

SEQ ID NO: 4750609 - DNA, 19 bp, Homo sapiens
tattttttgaactttgtag

SEQ ID NO: 4750610 - DNA, 21 bp, Homo sapiens
tattttttgaactttgtagga

SEQ ID NO: 4750611 - DNA, 14 bp, Homo sapiens
tcaaaaatgctgtt

SEQ ID NO: 4750612 - DNA, 19 bp, Homo sapiens
tcaaaacccatctgggctc

SEQ ID NO: 4750613 - DNA, 12 bp, Homo sapiens
tcaaaactggtt

SEQ ID NO: 4750614 - DNA, 12 bp, Homo sapiens
tcaaacactgca

SEQ ID NO: 4750615 - DNA, 14 bp, Homo sapiens
tcaaacactgcagg

SEQ ID NO: 4750616 - DNA, 17 bp, Homo sapiens
tcaaacatgaaaacatt

SEQ ID NO: 4750617 - DNA, 17 bp, Homo sapiens
tcaaaccttgaggagaa

SEQ ID NO: 4750618 - DNA, 22 bp, Homo sapiens
tcaaactcttgacctcaggtga

SEQ ID NO: 4750619 - DNA, 22 bp, Homo sapiens
tcaaagaaaaacaatgaaattg

SEQ ID NO: 4750620 - DNA, 20 bp, Homo sapiens
tcaaagcaaggaaactatgt

SEQ ID NO: 4750621 - DNA, 16 bp, Homo sapiens
tcaaagcttaaaaaga

SEQ ID NO: 4750622 - DNA, 20 bp, Homo sapiens
tcaaagtagaaactactaat

SEQ ID NO: 4750623 - DNA, 23 bp, Homo sapiens
tcaaataaaccttgtttctttct

SEQ ID NO: 4750624 - DNA, 13 bp, Homo sapiens
tcaacaagcctga

SEQ ID NO: 4750625 - DNA, 23 bp, Homo sapiens
tcaacccaggagcatccacctcc

SEQ ID NO: 4750626 - DNA, 19 bp, Homo sapiens
tcaaccccttcgctcctgt

SEQ ID NO: 4750627 - DNA, 18 bp, Homo sapiens
tcaaccctctcaggtgac

SEQ ID NO: 4750628 - DNA, 14 bp, Homo sapiens
tcaacctcctgggc

SEQ ID NO: 4750629 - DNA, 13 bp, Homo sapiens
tcaacctgcctga

SEQ ID NO: 4750630 - DNA, 18 bp, Homo sapiens
tcaacctgggcaaagcct

SEQ ID NO: 4750631 - DNA, 22 bp, Homo sapiens
tcaactccctgccccccagccc

SEQ ID NO: 4750632 - DNA, 16 bp, Homo sapiens
tcaactggttgtatat

SEQ ID NO: 4750633 - DNA, 16 bp, Homo sapiens
tcaactttcatttgaa

SEQ ID NO: 4750634 - DNA, 22 bp, Homo sapiens
tcaagaaaacaggcactgccct

SEQ ID NO: 4750635 - DNA, 23 bp, Homo sapiens
tcaagaaatgctcgtcatacagt

SEQ ID NO: 4750636 - DNA, 18 bp, Homo sapiens
tcaagaggcaaaggaatc

SEQ ID NO: 4750637 - DNA, 17 bp, Homo sapiens
tcaagagggtctgagga

SEQ ID NO: 4750638 - DNA, 13 bp, Homo sapiens
tcaagatccaaat

SEQ ID NO: 4750639 - DNA, 18 bp, Homo sapiens
tcaagcaggtttcttgct

SEQ ID NO: 4750640 - DNA, 12 bp, Homo sapiens
tcaagccaccaa

SEQ ID NO: 4750641 - DNA, 16 bp, Homo sapiens
tcaagcgattcttctg

SEQ ID NO: 4750642 - DNA, 17 bp, Homo sapiens
tcaagcgattcttctgc

SEQ ID NO: 4750643 - DNA, 12 bp, Homo sapiens
tcaaggactggt

SEQ ID NO: 4750644 - DNA, 14 bp, Homo sapiens
tcaaggagaggagg

SEQ ID NO: 4750645 - DNA, 14 bp, Homo sapiens
tcaaggcactgcct

SEQ ID NO: 4750646 - DNA, 15 bp, Homo sapiens
tcaaggcactgcctg

SEQ ID NO: 4750647 - DNA, 15 bp, Homo sapiens
tcaaggcctcccaca

SEQ ID NO: 4750648 - DNA, 18 bp, Homo sapiens
tcaaggcctcccacagtg

SEQ ID NO: 4750649 - DNA, 18 bp, Homo sapiens
tcaagtgagtggcatgtg

SEQ ID NO: 4750650 - DNA, 22 bp, Homo sapiens
tcaagtgattctcatgcctcag

SEQ ID NO: 4750651 - DNA, 16 bp, Homo sapiens
tcaagtgattctcctg

SEQ ID NO: 4750652 - DNA, 19 bp, Homo sapiens
tcaagttccagtgcagaga

SEQ ID NO: 4750653 - DNA, 14 bp, Homo sapiens
tcaatctctgacta

SEQ ID NO: 4750654 - DNA, 19 bp, Homo sapiens
tcaatctggattcatattt

SEQ ID NO: 4750655 - DNA, 22 bp, Homo sapiens
tcaatgaaatggattggtaaga

SEQ ID NO: 4750656 - DNA, 14 bp, Homo sapiens
tcaatgattcttcc

SEQ ID NO: 4750657 - DNA, 18 bp, Homo sapiens
tcaatggaagaaaccctt

SEQ ID NO: 4750658 - DNA, 23 bp, Homo sapiens
tcaattacttattttaggaaatt

SEQ ID NO: 4750659 - DNA, 22 bp, Homo sapiens
tcaattccccctggccaccacc

SEQ ID NO: 4750660 - DNA, 21 bp, Homo sapiens
tcaattctgatgttactgaga

SEQ ID NO: 4750661 - DNA, 17 bp, Homo sapiens
tcaattcttccctatct

SEQ ID NO: 4750662 - DNA, 23 bp, Homo sapiens
tcaattcttccctatctttgcca

SEQ ID NO: 4750663 - DNA, 17 bp, Homo sapiens
tcaattgcatctcccag

SEQ ID NO: 4750664 - DNA, 22 bp, Homo sapiens
tcaattgcatctcccagataat

SEQ ID NO: 4750665 - DNA, 19 bp, Homo sapiens
tcaatttactttttaaaca

SEQ ID NO: 4750666 - DNA, 22 bp, Homo sapiens
tcaatttactttttaaacagtg

SEQ ID NO: 4750667 - DNA, 23 bp, Homo sapiens
tcaatttactttttaaacagtgt

SEQ ID NO: 4750668 - DNA, 20 bp, Homo sapiens
tcaattttgtatttaatgat

SEQ ID NO: 4750669 - DNA, 16 bp, Homo sapiens
tcacaaaacagccttt

SEQ ID NO: 4750670 - DNA, 21 bp, Homo sapiens
tcacaaaacatattttacatc

SEQ ID NO: 4750671 - DNA, 20 bp, Homo sapiens
tcacaaaagctgtgtctctg

SEQ ID NO: 4750672 - DNA, 17 bp, Homo sapiens
tcacaaagtggaacgaa

SEQ ID NO: 4750673 - DNA, 11 bp, Homo sapiens
tcacaaataaa

SEQ ID NO: 4750674 - DNA, 13 bp, Homo sapiens
tcacacagtgagt

SEQ ID NO: 4750675 - DNA, 23 bp, Homo sapiens
tcacacagtgagtcgaggacagg

SEQ ID NO: 4750676 - DNA, 23 bp, Homo sapiens
tcacacatgagcatcaggccagg

SEQ ID NO: 4750677 - DNA, 15 bp, Homo sapiens
tcacaccactgtact

SEQ ID NO: 4750678 - DNA, 19 bp, Homo sapiens
tcacactgagaatgtaaga

SEQ ID NO: 4750679 - DNA, 20 bp, Homo sapiens
tcacactgagaatgtaagaa

SEQ ID NO: 4750680 - DNA, 15 bp, Homo sapiens
tcacagatgctgtgt

SEQ ID NO: 4750681 - DNA, 21 bp, Homo sapiens
tcacagatgtgtgattcacag

SEQ ID NO: 4750682 - DNA, 15 bp, Homo sapiens
tcacagcagcttcta

SEQ ID NO: 4750683 - DNA, 16 bp, Homo sapiens
tcacagccacttggga

SEQ ID NO: 4750684 - DNA, 16 bp, Homo sapiens
tcacaggcaggtccag

SEQ ID NO: 4750685 - DNA, 19 bp, Homo sapiens
tcacaggcaggtccagggt

SEQ ID NO: 4750686 - DNA, 17 bp, Homo sapiens
tcacagtaatgcaagca

SEQ ID NO: 4750687 - DNA, 20 bp, Homo sapiens
tcacagtaatgcaagcaaag

SEQ ID NO: 4750688 - DNA, 22 bp, Homo sapiens
tcacagtccttaccagcagagc

SEQ ID NO: 4750689 - DNA, 23 bp, Homo sapiens
tcacagtccttaccagcagagca

SEQ ID NO: 4750690 - DNA, 15 bp, Homo sapiens
tcacagtgcccaaga

SEQ ID NO: 4750691 - DNA, 16 bp, Homo sapiens
tcacagtgttatgtag

SEQ ID NO: 4750692 - DNA, 21 bp, Homo sapiens
tcacatgtcagtaccttcaaa

SEQ ID NO: 4750693 - DNA, 18 bp, Homo sapiens
tcacatttattctgctca

SEQ ID NO: 4750694 - DNA, 21 bp, Homo sapiens
tcacatttcaagatccaaatg

SEQ ID NO: 4750695 - DNA, 17 bp, Homo sapiens
tcaccaacgtctgtgcc

SEQ ID NO: 4750696 - DNA, 13 bp, Homo sapiens
tcaccaagcccag

SEQ ID NO: 4750697 - DNA, 18 bp, Homo sapiens
tcaccacctcatgtcatt

SEQ ID NO: 4750698 - DNA, 21 bp, Homo sapiens
tcaccacctcatgtcatttct

SEQ ID NO: 4750699 - DNA, 15 bp, Homo sapiens
tcaccaggggcaggc

SEQ ID NO: 4750700 - DNA, 19 bp, Homo sapiens
tcaccaggggcaggcacag

SEQ ID NO: 4750701 - DNA, 13 bp, Homo sapiens
tcacccccttctc

SEQ ID NO: 4750702 - DNA, 18 bp, Homo sapiens
tcacccccttctccatcc

SEQ ID NO: 4750703 - DNA, 18 bp, Homo sapiens
tcaccccggccacctgcg

SEQ ID NO: 4750704 - DNA, 17 bp, Homo sapiens
tcacccctccctttctc

SEQ ID NO: 4750705 - DNA, 15 bp, Homo sapiens
tcacccctggttctc

SEQ ID NO: 4750706 - DNA, 14 bp, Homo sapiens
tcaccgcggctgga

SEQ ID NO: 4750707 - DNA, 17 bp, Homo sapiens
tcaccgcggctggatgg

SEQ ID NO: 4750708 - DNA, 20 bp, Homo sapiens
tcacctaaaccctctgtgaa

SEQ ID NO: 4750709 - DNA, 21 bp, Homo sapiens
tcacctaaaccctctgtgaaa

SEQ ID NO: 4750710 - DNA, 22 bp, Homo sapiens
tcacctaaaccctctgtgaaat

SEQ ID NO: 4750711 - DNA, 12 bp, Homo sapiens
tcacctcagagt

SEQ ID NO: 4750712 - DNA, 13 bp, Homo sapiens
tcacctcagagtg

SEQ ID NO: 4750713 - DNA, 15 bp, Homo sapiens
tcacctcccccatct

SEQ ID NO: 4750714 - DNA, 16 bp, Homo sapiens
tcacctggggctgctg

SEQ ID NO: 4750715 - DNA, 22 bp, Homo sapiens
tcacctggggctgctggcctga

SEQ ID NO: 4750716 - DNA, 14 bp, Homo sapiens
tcacctgtgcttcg

SEQ ID NO: 4750717 - DNA, 20 bp, Homo sapiens
tcacctgtgcttcgggccct

SEQ ID NO: 4750718 - DNA, 22 bp, Homo sapiens
tcaccttcaaaatgttctattt

SEQ ID NO: 4750719 - DNA, 13 bp, Homo sapiens
tcaccttccaaac

SEQ ID NO: 4750720 - DNA, 17 bp, Homo sapiens
tcacctttgtccccacc

SEQ ID NO: 4750721 - DNA, 14 bp, Homo sapiens
tcacgccactgcac

SEQ ID NO: 4750722 - DNA, 15 bp, Homo sapiens
tcacggctcactgca

SEQ ID NO: 4750723 - DNA, 17 bp, Homo sapiens
tcacgtccatcactggc

SEQ ID NO: 4750724 - DNA, 20 bp, Homo sapiens
tcacgtctgacaaatgtgta

SEQ ID NO: 4750725 - DNA, 18 bp, Homo sapiens
tcactatgttgcccaggc

SEQ ID NO: 4750726 - DNA, 13 bp, Homo sapiens
tcactcacatttt

SEQ ID NO: 4750727 - DNA, 19 bp, Homo sapiens
tcactccacgcagctggca

SEQ ID NO: 4750728 - DNA, 15 bp, Homo sapiens
tcactctggcagctc

SEQ ID NO: 4750729 - DNA, 22 bp, Homo sapiens
tcactctggcagctcagagagg

SEQ ID NO: 4750730 - DNA, 19 bp, Homo sapiens
tcactctgtcgcccagtct

SEQ ID NO: 4750731 - DNA, 22 bp, Homo sapiens
tcactctgtcgcccagtctgga

SEQ ID NO: 4750732 - DNA, 20 bp, Homo sapiens
tcactcttattgcccacgct

SEQ ID NO: 4750733 - DNA, 13 bp, Homo sapiens
tcactgagacagc

SEQ ID NO: 4750734 - DNA, 18 bp, Homo sapiens
tcactgagccatcatttc

SEQ ID NO: 4750735 - DNA, 13 bp, Homo sapiens
tcactgcatcctc

SEQ ID NO: 4750736 - DNA, 18 bp, Homo sapiens
tcactgcatcctccgcct

SEQ ID NO: 4750737 - DNA, 14 bp, Homo sapiens
tcactggaactcag

SEQ ID NO: 4750738 - DNA, 22 bp, Homo sapiens
tcactggcgacacgtagcagct

SEQ ID NO: 4750739 - DNA, 15 bp, Homo sapiens
tcactggctgcctcc

SEQ ID NO: 4750740 - DNA, 17 bp, Homo sapiens
tcactggctgcctccac

SEQ ID NO: 4750741 - DNA, 21 bp, Homo sapiens
tcactggctgcctccactccc

SEQ ID NO: 4750742 - DNA, 16 bp, Homo sapiens
tcactgggactttgta

SEQ ID NO: 4750743 - DNA, 22 bp, Homo sapiens
tcactgttctattcatctcaag

SEQ ID NO: 4750744 - DNA, 16 bp, Homo sapiens
tcactgttgcccaggc

SEQ ID NO: 4750745 - DNA, 23 bp, Homo sapiens
tcactgttgcccaggctggcgtg

SEQ ID NO: 4750746 - DNA, 11 bp, Homo sapiens
tcacttgctgg

SEQ ID NO: 4750747 - DNA, 18 bp, Homo sapiens
tcacttgctggctgtgaa

SEQ ID NO: 4750748 - DNA, 22 bp, Homo sapiens
tcactttggggttcggcctgtg

SEQ ID NO: 4750749 - DNA, 16 bp, Homo sapiens
tcactttttttgttct

SEQ ID NO: 4750750 - DNA, 22 bp, Homo sapiens
tcagaacagtgtttgattttta

SEQ ID NO: 4750751 - DNA, 13 bp, Homo sapiens
tcagaagacactg

SEQ ID NO: 4750752 - DNA, 14 bp, Homo sapiens
tcagaagacactga

SEQ ID NO: 4750753 - DNA, 14 bp, Homo sapiens
tcagaagcctttgg

SEQ ID NO: 4750754 - DNA, 12 bp, Homo sapiens
tcagaagtgatt

SEQ ID NO: 4750755 - DNA, 17 bp, Homo sapiens
tcagaagtgatttagtt

SEQ ID NO: 4750756 - DNA, 23 bp, Homo sapiens
tcagaagtgatttagttgtggaa

SEQ ID NO: 4750757 - DNA, 16 bp, Homo sapiens
tcagaatatattcact

SEQ ID NO: 4750758 - DNA, 18 bp, Homo sapiens
tcagaatatattcacttt

SEQ ID NO: 4750759 - DNA, 17 bp, Homo sapiens
tcagaatcacttctgag

SEQ ID NO: 4750760 - DNA, 19 bp, Homo sapiens
tcagaatcacttctgagaa

SEQ ID NO: 4750761 - DNA, 14 bp, Homo sapiens
tcagacagccccct

SEQ ID NO: 4750762 - DNA, 14 bp, Homo sapiens
tcagacagctgcct

SEQ ID NO: 4750763 - DNA, 18 bp, Homo sapiens
tcagacagctgcctggga

SEQ ID NO: 4750764 - DNA, 14 bp, Homo sapiens
tcagacatttatgt

SEQ ID NO: 4750765 - DNA, 17 bp, Homo sapiens
tcagactccagctgtga

SEQ ID NO: 4750766 - DNA, 20 bp, Homo sapiens
tcagagactcctgcaggcag

SEQ ID NO: 4750767 - DNA, 23 bp, Homo sapiens
tcagagactcctgcaggcagcca

SEQ ID NO: 4750768 - DNA, 15 bp, Homo sapiens
tcagagaggacaaaa

SEQ ID NO: 4750769 - DNA, 21 bp, Homo sapiens
tcagagaggacaaaataaagt

SEQ ID NO: 4750770 - DNA, 13 bp, Homo sapiens
tcagagcctgcag

SEQ ID NO: 4750771 - DNA, 14 bp, Homo sapiens
tcagagcctgcagt

SEQ ID NO: 4750772 - DNA, 15 bp, Homo sapiens
tcagagcctgcagtt

SEQ ID NO: 4750773 - DNA, 18 bp, Homo sapiens
tcagagcctgcagttatt

SEQ ID NO: 4750774 - DNA, 16 bp, Homo sapiens
tcagagctacttgggc

SEQ ID NO: 4750775 - DNA, 18 bp, Homo sapiens
tcagagctgacacaggat

SEQ ID NO: 4750776 - DNA, 18 bp, Homo sapiens
tcagaggccctcgctgcc

SEQ ID NO: 4750777 - DNA, 15 bp, Homo sapiens
tcagagtatggagct

SEQ ID NO: 4750778 - DNA, 13 bp, Homo sapiens
tcagagtggagtt

SEQ ID NO: 4750779 - DNA, 15 bp, Homo sapiens
tcagatatcatactg

SEQ ID NO: 4750780 - DNA, 22 bp, Homo sapiens
tcagatatcatactgattttta

SEQ ID NO: 4750781 - DNA, 22 bp, Homo sapiens
tcagatgctcattgctttctaa

SEQ ID NO: 4750782 - DNA, 24 bp, Homo sapiens
tcagatgtgttgacgtaagctcta

SEQ ID NO: 4750783 - DNA, 20 bp, Homo sapiens
tcagcatcaaacatgaaaac

SEQ ID NO: 4750784 - DNA, 16 bp, Homo sapiens
tcagcatcattaaagg

SEQ ID NO: 4750785 - DNA, 18 bp, Homo sapiens
tcagcatcctggcacccg

SEQ ID NO: 4750786 - DNA, 17 bp, Homo sapiens
tcagccagccccatcag

SEQ ID NO: 4750787 - DNA, 15 bp, Homo sapiens
tcagccccaccccag

SEQ ID NO: 4750788 - DNA, 19 bp, Homo sapiens
tcagccctagggtggagag

SEQ ID NO: 4750789 - DNA, 12 bp, Homo sapiens
tcagcctcccaa

SEQ ID NO: 4750790 - DNA, 19 bp, Homo sapiens
tcagcctcccaaagtgctg

SEQ ID NO: 4750791 - DNA, 21 bp, Homo sapiens
tcagcctcccgaatagctggg

SEQ ID NO: 4750792 - DNA, 20 bp, Homo sapiens
tcagcgctgtcaggattgcg

SEQ ID NO: 4750793 - DNA, 21 bp, Homo sapiens
tcagcgctgtcaggattgcga

SEQ ID NO: 4750794 - DNA, 15 bp, Homo sapiens
tcagcggggacagct

SEQ ID NO: 4750795 - DNA, 16 bp, Homo sapiens
tcagcggggacagctc

SEQ ID NO: 4750796 - DNA, 19 bp, Homo sapiens
tcagcggggacagctcctt

SEQ ID NO: 4750797 - DNA, 16 bp, Homo sapiens
tcagctcactgcaacc

SEQ ID NO: 4750798 - DNA, 21 bp, Homo sapiens
tcagctccagctcaccagccc

SEQ ID NO: 4750799 - DNA, 22 bp, Homo sapiens
tcagctcttctgacttaagtgt

SEQ ID NO: 4750800 - DNA, 20 bp, Homo sapiens
tcagctgaccccctcccccc

SEQ ID NO: 4750801 - DNA, 11 bp, Homo sapiens
tcagctggtgg

SEQ ID NO: 4750802 - DNA, 19 bp, Homo sapiens
tcagctggtggatggtgac

SEQ ID NO: 4750803 - DNA, 22 bp, Homo sapiens
tcagctggtggatggtgacttt

SEQ ID NO: 4750804 - DNA, 23 bp, Homo sapiens
tcagctggtggatggtgactttt

SEQ ID NO: 4750805 - DNA, 15 bp, Homo sapiens
tcagcttctgctggg

SEQ ID NO: 4750806 - DNA, 19 bp, Homo sapiens
tcagcttctgctgggctgg

SEQ ID NO: 4750807 - DNA, 20 bp, Homo sapiens
tcaggaaacatatttaagaa

SEQ ID NO: 4750808 - DNA, 16 bp, Homo sapiens
tcaggaaagagattag

SEQ ID NO: 4750809 - DNA, 23 bp, Homo sapiens
tcaggaaagagattagaacattt

SEQ ID NO: 4750810 - DNA, 13 bp, Homo sapiens
tcaggaagctcag

SEQ ID NO: 4750811 - DNA, 16 bp, Homo sapiens
tcaggaattcttggag

SEQ ID NO: 4750812 - DNA, 19 bp, Homo sapiens
tcaggacccagaggaaggg

SEQ ID NO: 4750813 - DNA, 10 bp, Homo sapiens
tcaggagcag

SEQ ID NO: 4750814 - DNA, 22 bp, Homo sapiens
tcaggagcagcctcagaacaaa

SEQ ID NO: 4750815 - DNA, 21 bp, Homo sapiens
tcaggattgcgagagatgtgt

SEQ ID NO: 4750816 - DNA, 22 bp, Homo sapiens
tcaggattgcgagagatgtgtg

SEQ ID NO: 4750817 - DNA, 23 bp, Homo sapiens
tcaggattgcgagagatgtgtgt

SEQ ID NO: 4750818 - DNA, 16 bp, Homo sapiens
tcaggcaaagaaaatg

SEQ ID NO: 4750819 - DNA, 15 bp, Homo sapiens
tcaggcagtgtttaa

SEQ ID NO: 4750820 - DNA, 16 bp, Homo sapiens
tcaggccaggccctct

SEQ ID NO: 4750821 - DNA, 21 bp, Homo sapiens
tcaggccatcatcagtggagc

SEQ ID NO: 4750822 - DNA, 13 bp, Homo sapiens
tcaggctgtccca

SEQ ID NO: 4750823 - DNA, 24 bp, Homo sapiens
tcaggctgtcccaagctcccaaga

SEQ ID NO: 4750824 - DNA, 14 bp, Homo sapiens
tcagggcctggctc

SEQ ID NO: 4750825 - DNA, 14 bp, Homo sapiens
tcagggctcctggg

SEQ ID NO: 4750826 - DNA, 20 bp, Homo sapiens
tcaggggctgcccgctccca

SEQ ID NO: 4750827 - DNA, 19 bp, Homo sapiens
tcagggttggcccctgccc

SEQ ID NO: 4750828 - DNA, 15 bp, Homo sapiens
tcaggtaacaggcag

SEQ ID NO: 4750829 - DNA, 16 bp, Homo sapiens
tcaggtaacaggcaga

SEQ ID NO: 4750830 - DNA, 18 bp, Homo sapiens
tcaggtaatcgacctgcc

SEQ ID NO: 4750831 - DNA, 22 bp, Homo sapiens
tcaggtgaccaaaatccccttc

SEQ ID NO: 4750832 - DNA, 16 bp, Homo sapiens
tcaggtgatccaccca

SEQ ID NO: 4750833 - DNA, 20 bp, Homo sapiens
tcaggtgctgccatccaggt

SEQ ID NO: 4750834 - DNA, 15 bp, Homo sapiens
tcaggtggggcagct

SEQ ID NO: 4750835 - DNA, 20 bp, Homo sapiens
tcaggtggggcagcttgagg

SEQ ID NO: 4750836 - DNA, 21 bp, Homo sapiens
tcaggtggggcagcttgaggg

SEQ ID NO: 4750837 - DNA, 17 bp, Homo sapiens
tcaggtggggtcactct

SEQ ID NO: 4750838 - DNA, 21 bp, Homo sapiens
tcaggtggggtcactctggca

SEQ ID NO: 4750839 - DNA, 22 bp, Homo sapiens
tcaggtggggtggagtcccaga

SEQ ID NO: 4750840 - DNA, 21 bp, Homo sapiens
tcaggttatcgaaataacaat

SEQ ID NO: 4750841 - DNA, 23 bp, Homo sapiens
tcaggttatcgaaataacaatgt

SEQ ID NO: 4750842 - DNA, 22 bp, Homo sapiens
tcagtaagacgacaaggaaagg

SEQ ID NO: 4750843 - DNA, 22 bp, Homo sapiens
tcagtaagtagcaaccctgtga

SEQ ID NO: 4750844 - DNA, 16 bp, Homo sapiens
tcagtaagtataacaa

SEQ ID NO: 4750845 - DNA, 17 bp, Homo sapiens
tcagtaagtataacaaa

SEQ ID NO: 4750846 - DNA, 18 bp, Homo sapiens
tcagtattttccctgcta

SEQ ID NO: 4750847 - DNA, 14 bp, Homo sapiens
tcagtcatgcataa

SEQ ID NO: 4750848 - DNA, 15 bp, Homo sapiens
tcagtccatagcaga

SEQ ID NO: 4750849 - DNA, 15 bp, Homo sapiens
tcagtctctgagcag

SEQ ID NO: 4750850 - DNA, 22 bp, Homo sapiens
tcagtctgattcccaagctctg

SEQ ID NO: 4750851 - DNA, 23 bp, Homo sapiens
tcagtctgattcccaagctctgc

SEQ ID NO: 4750852 - DNA, 16 bp, Homo sapiens
tcagtgccgccgcctc

SEQ ID NO: 4750853 - DNA, 20 bp, Homo sapiens
tcagtgccgccgcctcgccc

SEQ ID NO: 4750854 - DNA, 19 bp, Homo sapiens
tcagtgctgctgaactaat

SEQ ID NO: 4750855 - DNA, 12 bp, Homo sapiens
tcagtggagcca

SEQ ID NO: 4750856 - DNA, 14 bp, Homo sapiens
tcagtggcagctgc

SEQ ID NO: 4750857 - DNA, 17 bp, Homo sapiens
tcagtgtacccccgccc

SEQ ID NO: 4750858 - DNA, 22 bp, Homo sapiens
tcagtgtacccccgcccaggct

SEQ ID NO: 4750859 - DNA, 12 bp, Homo sapiens
tcagtgtatcta

SEQ ID NO: 4750860 - DNA, 12 bp, Homo sapiens
tcagtgtgaatg

SEQ ID NO: 4750861 - DNA, 14 bp, Homo sapiens
tcagtgtgcccccc

SEQ ID NO: 4750862 - DNA, 19 bp, Homo sapiens
tcagtgtgccccccatcct

SEQ ID NO: 4750863 - DNA, 15 bp, Homo sapiens
tcagtgttaaatgtg

SEQ ID NO: 4750864 - DNA, 17 bp, Homo sapiens
tcagttatattttgctg

SEQ ID NO: 4750865 - DNA, 13 bp, Homo sapiens
tcagttctgtgta

SEQ ID NO: 4750866 - DNA, 20 bp, Homo sapiens
tcagttctgtgtacatttta

SEQ ID NO: 4750867 - DNA, 12 bp, Homo sapiens
tcagttgcagcc

SEQ ID NO: 4750868 - DNA, 21 bp, Homo sapiens
tcagtttcttaaaatgtccta

SEQ ID NO: 4750869 - DNA, 19 bp, Homo sapiens
tcataaatttgttgtcatg

SEQ ID NO: 4750870 - DNA, 24 bp, Homo sapiens
tcataaatttgttgtcatgtgtat

SEQ ID NO: 4750871 - DNA, 15 bp, Homo sapiens
tcataactagaactg

SEQ ID NO: 4750872 - DNA, 20 bp, Homo sapiens
tcatacaaatactatccaaa

SEQ ID NO: 4750873 - DNA, 13 bp, Homo sapiens
tcatacccacccc

SEQ ID NO: 4750874 - DNA, 16 bp, Homo sapiens
tcatactgaaattatt

SEQ ID NO: 4750875 - DNA, 15 bp, Homo sapiens
tcatagtatggtggc

SEQ ID NO: 4750876 - DNA, 12 bp, Homo sapiens
tcatataagaca

SEQ ID NO: 4750877 - DNA, 20 bp, Homo sapiens
tcatatgacattcatgcctg

SEQ ID NO: 4750878 - DNA, 15 bp, Homo sapiens
tcatattgcatcata

SEQ ID NO: 4750879 - DNA, 15 bp, Homo sapiens
tcatattttgccact

SEQ ID NO: 4750880 - DNA, 13 bp, Homo sapiens
tcatcaaaaagaa

SEQ ID NO: 4750881 - DNA, 17 bp, Homo sapiens
tcatcaaaaagaaaaat

SEQ ID NO: 4750882 - DNA, 24 bp, Homo sapiens
tcatcaaaaagaaaaatcaaagta

SEQ ID NO: 4750883 - DNA, 17 bp, Homo sapiens
tcatcaaataaaccttg

SEQ ID NO: 4750884 - DNA, 22 bp, Homo sapiens
tcatcaaataaaccttgtttct

SEQ ID NO: 4750885 - DNA, 11 bp, Homo sapiens
tcatcaagact

SEQ ID NO: 4750886 - DNA, 19 bp, Homo sapiens
tcatcaagactggaaggtg

SEQ ID NO: 4750887 - DNA, 16 bp, Homo sapiens
tcatcaaggcactgcc

SEQ ID NO: 4750888 - DNA, 19 bp, Homo sapiens
tcatcaaggcactgcctga

SEQ ID NO: 4750889 - DNA, 16 bp, Homo sapiens
tcatcactcccctcca

SEQ ID NO: 4750890 - DNA, 15 bp, Homo sapiens
tcatcagtggagcca

SEQ ID NO: 4750891 - DNA, 13 bp, Homo sapiens
tcatcatccctcc

SEQ ID NO: 4750892 - DNA, 15 bp, Homo sapiens
tcatcatgtagaata

SEQ ID NO: 4750893 - DNA, 18 bp, Homo sapiens
tcatcattctctgtctca

SEQ ID NO: 4750894 - DNA, 19 bp, Homo sapiens
tcatcattctctgtctcat

SEQ ID NO: 4750895 - DNA, 14 bp, Homo sapiens
tcatccaggactga

SEQ ID NO: 4750896 - DNA, 16 bp, Homo sapiens
tcatccaggactgaga

SEQ ID NO: 4750897 - DNA, 14 bp, Homo sapiens
tcatccagggctct

SEQ ID NO: 4750898 - DNA, 12 bp, Homo sapiens
tcatccatcatc

SEQ ID NO: 4750899 - DNA, 16 bp, Homo sapiens
tcatccatcatcatgt

SEQ ID NO: 4750900 - DNA, 18 bp, Homo sapiens
tcatccctaatgctgcag

SEQ ID NO: 4750901 - DNA, 20 bp, Homo sapiens
tcatccttgcccatcgggac

SEQ ID NO: 4750902 - DNA, 21 bp, Homo sapiens
tcatctcctgccttcctcctg

SEQ ID NO: 4750903 - DNA, 19 bp, Homo sapiens
tcatctcttagctcccctc

SEQ ID NO: 4750904 - DNA, 21 bp, Homo sapiens
tcatctcttagctcccctcca

SEQ ID NO: 4750905 - DNA, 18 bp, Homo sapiens
tcatctgtccctccggga

SEQ ID NO: 4750906 - DNA, 13 bp, Homo sapiens
tcatctttcttga

SEQ ID NO: 4750907 - DNA, 14 bp, Homo sapiens
tcatgacagcctcc

SEQ ID NO: 4750908 - DNA, 22 bp, Homo sapiens
tcatgattcacccccaaacagt

SEQ ID NO: 4750909 - DNA, 15 bp, Homo sapiens
tcatgcatggaaatt

SEQ ID NO: 4750910 - DNA, 16 bp, Homo sapiens
tcatgccaagcattta

SEQ ID NO: 4750911 - DNA, 14 bp, Homo sapiens
tcatgcctgtaatc

SEQ ID NO: 4750912 - DNA, 16 bp, Homo sapiens
tcatgctctcatatat

SEQ ID NO: 4750913 - DNA, 21 bp, Homo sapiens
tcatgctggcctgtgtgatac

SEQ ID NO: 4750914 - DNA, 14 bp, Homo sapiens
tcatggatttggtt

SEQ ID NO: 4750915 - DNA, 16 bp, Homo sapiens
tcatggtgcatataaa

SEQ ID NO: 4750916 - DNA, 13 bp, Homo sapiens
tcatggtgtaata

SEQ ID NO: 4750917 - DNA, 15 bp, Homo sapiens
tcatggtgtaataag

SEQ ID NO: 4750918 - DNA, 17 bp, Homo sapiens
tcatggtgtaataagac

SEQ ID NO: 4750919 - DNA, 18 bp, Homo sapiens
tcatggtgtaataagaca

SEQ ID NO: 4750920 - DNA, 22 bp, Homo sapiens
tcatggtgtaataagacataac

SEQ ID NO: 4750921 - DNA, 13 bp, Homo sapiens
tcatgtaaactgt

SEQ ID NO: 4750922 - DNA, 14 bp, Homo sapiens
tcatgtaaactgtg

SEQ ID NO: 4750923 - DNA, 18 bp, Homo sapiens
tcatgtgcatctggtgta

SEQ ID NO: 4750924 - DNA, 12 bp, Homo sapiens
tcatgtgtatga

SEQ ID NO: 4750925 - DNA, 12 bp, Homo sapiens
tcatgtgtgtcc

SEQ ID NO: 4750926 - DNA, 20 bp, Homo sapiens
tcatgtttaacgtttctcat

SEQ ID NO: 4750927 - DNA, 23 bp, Homo sapiens
tcatgttttgagacataaatgtt

SEQ ID NO: 4750928 - DNA, 16 bp, Homo sapiens
tcattaaaatccagta

SEQ ID NO: 4750929 - DNA, 20 bp, Homo sapiens
tcattacttttaaaaatgta

SEQ ID NO: 4750930 - DNA, 12 bp, Homo sapiens
tcattagagcag

SEQ ID NO: 4750931 - DNA, 18 bp, Homo sapiens
tcattatttgataacatt

SEQ ID NO: 4750932 - DNA, 22 bp, Homo sapiens
tcattatttgataacattttgt

SEQ ID NO: 4750933 - DNA, 20 bp, Homo sapiens
tcattcatccaggactgaga

SEQ ID NO: 4750934 - DNA, 12 bp, Homo sapiens
tcattctgtgac

SEQ ID NO: 4750935 - DNA, 18 bp, Homo sapiens
tcattctgtgaccctagt

SEQ ID NO: 4750936 - DNA, 21 bp, Homo sapiens
tcattctttttgaaatgtcaa

SEQ ID NO: 4750937 - DNA, 12 bp, Homo sapiens
tcattgacctga

SEQ ID NO: 4750938 - DNA, 14 bp, Homo sapiens
tcattgacctgagg

SEQ ID NO: 4750939 - DNA, 15 bp, Homo sapiens
tcattgacctgaggc

SEQ ID NO: 4750940 - DNA, 19 bp, Homo sapiens
tcattgaggacaaagaaaa

SEQ ID NO: 4750941 - DNA, 19 bp, Homo sapiens
tcattgctagtagatagaa

SEQ ID NO: 4750942 - DNA, 18 bp, Homo sapiens
tcattggttaacaataaa

SEQ ID NO: 4750943 - DNA, 20 bp, Homo sapiens
tcatttactgtggcttctta

SEQ ID NO: 4750944 - DNA, 15 bp, Homo sapiens
tcatttcacccctcc

SEQ ID NO: 4750945 - DNA, 16 bp, Homo sapiens
tcatttcacccctccc

SEQ ID NO: 4750946 - DNA, 21 bp, Homo sapiens
tcatttcacccctccctttct

SEQ ID NO: 4750947 - DNA, 23 bp, Homo sapiens
tcatttcacccctccctttctcc

SEQ ID NO: 4750948 - DNA, 15 bp, Homo sapiens
tcatttcaggagcag

SEQ ID NO: 4750949 - DNA, 24 bp, Homo sapiens
tcatttcctctgagctgttatctt

SEQ ID NO: 4750950 - DNA, 13 bp, Homo sapiens
tcatttcctgtgt

SEQ ID NO: 4750951 - DNA, 13 bp, Homo sapiens
tcatttgaaagtg

SEQ ID NO: 4750952 - DNA, 19 bp, Homo sapiens
tcatttttagtagagacag

SEQ ID NO: 4750953 - DNA, 22 bp, Homo sapiens
tccaaacaaaagcacttacttt

SEQ ID NO: 4750954 - DNA, 12 bp, Homo sapiens
tccaaaccactt

SEQ ID NO: 4750955 - DNA, 22 bp, Homo sapiens
tccaaaccactttttgcagctt

SEQ ID NO: 4750956 - DNA, 16 bp, Homo sapiens
tccaaataaaaattag

SEQ ID NO: 4750957 - DNA, 18 bp, Homo sapiens
tccaaatgcattcatgtt

SEQ ID NO: 4750958 - DNA, 17 bp, Homo sapiens
tccaaatgctgtgcaaa

SEQ ID NO: 4750959 - DNA, 18 bp, Homo sapiens
tccaaatgctgtgcaaac

SEQ ID NO: 4750960 - DNA, 22 bp, Homo sapiens
tccaaatgctgtgcaaacagtg

SEQ ID NO: 4750961 - DNA, 19 bp, Homo sapiens
tccaaatttaaccataaat

SEQ ID NO: 4750962 - DNA, 21 bp, Homo sapiens
tccaaatttaaccataaatca

SEQ ID NO: 4750963 - DNA, 21 bp, Homo sapiens
tccaaatttttttttaaagca

SEQ ID NO: 4750964 - DNA, 17 bp, Homo sapiens
tccaaccccccagcact

SEQ ID NO: 4750965 - DNA, 19 bp, Homo sapiens
tccaagaagcccaggaaag

SEQ ID NO: 4750966 - DNA, 20 bp, Homo sapiens
tccaagaagcccaggaaagg

SEQ ID NO: 4750967 - DNA, 19 bp, Homo sapiens
tccaagaccttctccttca

SEQ ID NO: 4750968 - DNA, 22 bp, Homo sapiens
tccaagcaggacatggacaagg

SEQ ID NO: 4750969 - DNA, 12 bp, Homo sapiens
tccaagctccca

SEQ ID NO: 4750970 - DNA, 15 bp, Homo sapiens
tccaagctcccaggc

SEQ ID NO: 4750971 - DNA, 20 bp, Homo sapiens
tccaagctggtcccactcag

SEQ ID NO: 4750972 - DNA, 19 bp, Homo sapiens
tccaataattttcctgtga

SEQ ID NO: 4750973 - DNA, 21 bp, Homo sapiens
tccaataattttcctgtgaca

SEQ ID NO: 4750974 - DNA, 11 bp, Homo sapiens
tccaatactgc

SEQ ID NO: 4750975 - DNA, 17 bp, Homo sapiens
tccaatactgcccaagg

SEQ ID NO: 4750976 - DNA, 11 bp, Homo sapiens
tccaatgaaat

SEQ ID NO: 4750977 - DNA, 18 bp, Homo sapiens
tccacaactcagtttcat

SEQ ID NO: 4750978 - DNA, 15 bp, Homo sapiens
tccacacccccaccc

SEQ ID NO: 4750979 - DNA, 13 bp, Homo sapiens
tccacacctgcgg

SEQ ID NO: 4750980 - DNA, 14 bp, Homo sapiens
tccacagccatccc

SEQ ID NO: 4750981 - DNA, 22 bp, Homo sapiens
tccacagcttttacgtagtaaa

SEQ ID NO: 4750982 - DNA, 14 bp, Homo sapiens
tccacagtgactcc

SEQ ID NO: 4750983 - DNA, 12 bp, Homo sapiens
tccacatcctcc

SEQ ID NO: 4750984 - DNA, 19 bp, Homo sapiens
tccacattctctctcactc

SEQ ID NO: 4750985 - DNA, 12 bp, Homo sapiens
tccacccacagt

SEQ ID NO: 4750986 - DNA, 13 bp, Homo sapiens
tccacccacctca

SEQ ID NO: 4750987 - DNA, 17 bp, Homo sapiens
tccacccaggagccccg

SEQ ID NO: 4750988 - DNA, 12 bp, Homo sapiens
tccaccctgctc

SEQ ID NO: 4750989 - DNA, 13 bp, Homo sapiens
tccaccctgctct

SEQ ID NO: 4750990 - DNA, 13 bp, Homo sapiens
tccacctccttct

SEQ ID NO: 4750991 - DNA, 16 bp, Homo sapiens
tccacctccttctctg

SEQ ID NO: 4750992 - DNA, 21 bp, Homo sapiens
tccacctgccagggacagagg

SEQ ID NO: 4750993 - DNA, 17 bp, Homo sapiens
tccacgactgtctccat

SEQ ID NO: 4750994 - DNA, 22 bp, Homo sapiens
tccacgagctgtttactaggga

SEQ ID NO: 4750995 - DNA, 19 bp, Homo sapiens
tccacgcagctggcagaga

SEQ ID NO: 4750996 - DNA, 16 bp, Homo sapiens
tccacgcggccacctc

SEQ ID NO: 4750997 - DNA, 22 bp, Homo sapiens
tccacggagccactcctctgac

SEQ ID NO: 4750998 - DNA, 19 bp, Homo sapiens
tccacgttctgctcatcat

SEQ ID NO: 4750999 - DNA, 17 bp, Homo sapiens
tccactcaggtctgttt

SEQ ID NO: 4751000 - DNA, 15 bp, Homo sapiens
tccactgagggcagt

SEQ ID NO: 4751001 - DNA, 23 bp, Homo sapiens
tccactgttgggtgggtgggccc

SEQ ID NO: 4751002 - DNA, 21 bp, Homo sapiens
tccacttgttcattctgtgac

SEQ ID NO: 4751003 - DNA, 18 bp, Homo sapiens
tccagaagtattgtttac

SEQ ID NO: 4751004 - DNA, 20 bp, Homo sapiens
tccagaagtattgtttacat

SEQ ID NO: 4751005 - DNA, 13 bp, Homo sapiens
tccagacacatgt

SEQ ID NO: 4751006 - DNA, 14 bp, Homo sapiens
tccagagactggga

SEQ ID NO: 4751007 - DNA, 15 bp, Homo sapiens
tccagatagtgtagc

SEQ ID NO: 4751008 - DNA, 18 bp, Homo sapiens
tccagatctgcagtcact

SEQ ID NO: 4751009 - DNA, 22 bp, Homo sapiens
tccagcattctcagccacaacc

SEQ ID NO: 4751010 - DNA, 15 bp, Homo sapiens
tccagccagggctgc

SEQ ID NO: 4751011 - DNA, 14 bp, Homo sapiens
tccagcccctggat

SEQ ID NO: 4751012 - DNA, 15 bp, Homo sapiens
tccagcccctggatg

SEQ ID NO: 4751013 - DNA, 17 bp, Homo sapiens
tccagccctggctgaag

SEQ ID NO: 4751014 - DNA, 12 bp, Homo sapiens
tccagcctagag

SEQ ID NO: 4751015 - DNA, 23 bp, Homo sapiens
tccagcctgacaacagcctgaga

SEQ ID NO: 4751016 - DNA, 15 bp, Homo sapiens
tccagctcaccagcc

SEQ ID NO: 4751017 - DNA, 14 bp, Homo sapiens
tccaggaagatcca

SEQ ID NO: 4751018 - DNA, 16 bp, Homo sapiens
tccaggagaaggccaa

SEQ ID NO: 4751019 - DNA, 14 bp, Homo sapiens
tccaggagcagcca

SEQ ID NO: 4751020 - DNA, 19 bp, Homo sapiens
tccaggagggctaattaga

SEQ ID NO: 4751021 - DNA, 20 bp, Homo sapiens
tccaggatttataaagcaaa

SEQ ID NO: 4751022 - DNA, 17 bp, Homo sapiens
tccaggctgggagagcc

SEQ ID NO: 4751023 - DNA, 18 bp, Homo sapiens
tccaggctgggagagcct

SEQ ID NO: 4751024 - DNA, 20 bp, Homo sapiens
tccaggctgggagagccttc

SEQ ID NO: 4751025 - DNA, 13 bp, Homo sapiens
tccagggctctga

SEQ ID NO: 4751026 - DNA, 11 bp, Homo sapiens
tccagggtggt

SEQ ID NO: 4751027 - DNA, 16 bp, Homo sapiens
tccaggttcagcttgt

SEQ ID NO: 4751028 - DNA, 21 bp, Homo sapiens
tccagtcattatgttaatatt

SEQ ID NO: 4751029 - DNA, 17 bp, Homo sapiens
tccagtgaggctctgcc

SEQ ID NO: 4751030 - DNA, 18 bp, Homo sapiens
tccagtgaggctctgccc

SEQ ID NO: 4751031 - DNA, 20 bp, Homo sapiens
tccagtgaggctctgccctt

SEQ ID NO: 4751032 - DNA, 21 bp, Homo sapiens
tccagttaaaaaaaattttaa

SEQ ID NO: 4751033 - DNA, 17 bp, Homo sapiens
tccagtttgtcttggat

SEQ ID NO: 4751034 - DNA, 13 bp, Homo sapiens
tccataagctatt

SEQ ID NO: 4751035 - DNA, 15 bp, Homo sapiens
tccatagagagcaag

SEQ ID NO: 4751036 - DNA, 21 bp, Homo sapiens
tccatatttaacctatttcca

SEQ ID NO: 4751037 - DNA, 13 bp, Homo sapiens
tccatcatcatgt

SEQ ID NO: 4751038 - DNA, 15 bp, Homo sapiens
tccatccacatggga

SEQ ID NO: 4751039 - DNA, 15 bp, Homo sapiens
tccatcctcccagga

SEQ ID NO: 4751040 - DNA, 16 bp, Homo sapiens
tccatctaaactgccc

SEQ ID NO: 4751041 - DNA, 15 bp, Homo sapiens
tccatctttgtatat

SEQ ID NO: 4751042 - DNA, 15 bp, Homo sapiens
tccatgaaaatgcaa

SEQ ID NO: 4751043 - DNA, 17 bp, Homo sapiens
tccatgagtcccctgtt

SEQ ID NO: 4751044 - DNA, 21 bp, Homo sapiens
tccatgcaccctcatacacag

SEQ ID NO: 4751045 - DNA, 14 bp, Homo sapiens
tccatggactttgt

SEQ ID NO: 4751046 - DNA, 15 bp, Homo sapiens
tccatggactttgtt

SEQ ID NO: 4751047 - DNA, 14 bp, Homo sapiens
tccatggccctgcc

SEQ ID NO: 4751048 - DNA, 18 bp, Homo sapiens
tccatgggattttatctg

SEQ ID NO: 4751049 - DNA, 23 bp, Homo sapiens
tccatgggcagagcccaagggaa

SEQ ID NO: 4751050 - DNA, 20 bp, Homo sapiens
tccatgggggctcagccagg

SEQ ID NO: 4751051 - DNA, 14 bp, Homo sapiens
tccattaacaaatg

SEQ ID NO: 4751052 - DNA, 23 bp, Homo sapiens
tccattatgactgttgttcttat

SEQ ID NO: 4751053 - DNA, 18 bp, Homo sapiens
tccattattcaagaaaga

SEQ ID NO: 4751054 - DNA, 16 bp, Homo sapiens
tccattggatctcatt

SEQ ID NO: 4751055 - DNA, 15 bp, Homo sapiens
tccatttgcaaggga

SEQ ID NO: 4751056 - DNA, 14 bp, Homo sapiens
tccattttcttgtc

SEQ ID NO: 4751057 - DNA, 13 bp, Homo sapiens
tcccaaagtgctg

SEQ ID NO: 4751058 - DNA, 14 bp, Homo sapiens
tcccaaagtgctgg

SEQ ID NO: 4751059 - DNA, 13 bp, Homo sapiens
tcccaactcaccc

SEQ ID NO: 4751060 - DNA, 19 bp, Homo sapiens
tcccaactcaccccagccc

SEQ ID NO: 4751061 - DNA, 15 bp, Homo sapiens
tcccaagctcccaag

SEQ ID NO: 4751062 - DNA, 18 bp, Homo sapiens
tcccaagctcccaagagc

SEQ ID NO: 4751063 - DNA, 17 bp, Homo sapiens
tcccacaggacatttct

SEQ ID NO: 4751064 - DNA, 18 bp, Homo sapiens
tcccacaggacatttctc

SEQ ID NO: 4751065 - DNA, 11 bp, Homo sapiens
tcccaccccac

SEQ ID NO: 4751066 - DNA, 14 bp, Homo sapiens
tcccaccccacaca

SEQ ID NO: 4751067 - DNA, 15 bp, Homo sapiens
tcccaccccacacac

SEQ ID NO: 4751068 - DNA, 15 bp, Homo sapiens
tcccacctcagcctc

SEQ ID NO: 4751069 - DNA, 17 bp, Homo sapiens
tcccacctctctcactc

SEQ ID NO: 4751070 - DNA, 20 bp, Homo sapiens
tcccacctctctcactcctt

SEQ ID NO: 4751071 - DNA, 12 bp, Homo sapiens
tcccacctgtgc

SEQ ID NO: 4751072 - DNA, 13 bp, Homo sapiens
tcccaccttggct

SEQ ID NO: 4751073 - DNA, 13 bp, Homo sapiens
tcccactgcaccc

SEQ ID NO: 4751074 - DNA, 15 bp, Homo sapiens
tcccacttcccctcc

SEQ ID NO: 4751075 - DNA, 22 bp, Homo sapiens
tcccagaggggcctgccacctg

SEQ ID NO: 4751076 - DNA, 17 bp, Homo sapiens
tcccagatcggatctgt

SEQ ID NO: 4751077 - DNA, 18 bp, Homo sapiens
tcccagattggctcacac

SEQ ID NO: 4751078 - DNA, 20 bp, Homo sapiens
tcccagattggctcacactg

SEQ ID NO: 4751079 - DNA, 17 bp, Homo sapiens
tcccagcagtggcttgc

SEQ ID NO: 4751080 - DNA, 13 bp, Homo sapiens
tcccagccttggc

SEQ ID NO: 4751081 - DNA, 16 bp, Homo sapiens
tcccagctgacagtcc

SEQ ID NO: 4751082 - DNA, 18 bp, Homo sapiens
tcccagctgacagtcctc

SEQ ID NO: 4751083 - DNA, 22 bp, Homo sapiens
tcccagctgacagtcctctcca

SEQ ID NO: 4751084 - DNA, 24 bp, Homo sapiens
tcccagctgacagtcctctccacc

SEQ ID NO: 4751085 - DNA, 22 bp, Homo sapiens
tcccagctgtgctctggacagg

SEQ ID NO: 4751086 - DNA, 23 bp, Homo sapiens
tcccaggaaccgaacatatcatt

SEQ ID NO: 4751087 - DNA, 22 bp, Homo sapiens
tcccaggagtggaggaggcctg

SEQ ID NO: 4751088 - DNA, 16 bp, Homo sapiens
tcccaggatgagcatc

SEQ ID NO: 4751089 - DNA, 22 bp, Homo sapiens
tcccaggatgagcatcccagga

SEQ ID NO: 4751090 - DNA, 17 bp, Homo sapiens
tcccaggcattccccag

SEQ ID NO: 4751091 - DNA, 19 bp, Homo sapiens
tcccaggcattccccagga

SEQ ID NO: 4751092 - DNA, 23 bp, Homo sapiens
tcccaggcattccccaggaggcc

SEQ ID NO: 4751093 - DNA, 24 bp, Homo sapiens
tcccaggcattccccaggaggcca

SEQ ID NO: 4751094 - DNA, 18 bp, Homo sapiens
tcccaggtaagcaggagg

SEQ ID NO: 4751095 - DNA, 17 bp, Homo sapiens
tcccagtacctcctgtc

SEQ ID NO: 4751096 - DNA, 21 bp, Homo sapiens
tcccagtaggcttttaccatt

SEQ ID NO: 4751097 - DNA, 15 bp, Homo sapiens
tcccagtggctgctg

SEQ ID NO: 4751098 - DNA, 18 bp, Homo sapiens
tcccagtggctgctgccc

SEQ ID NO: 4751099 - DNA, 19 bp, Homo sapiens
tcccagtgtcttcctgtgg

SEQ ID NO: 4751100 - DNA, 22 bp, Homo sapiens
tcccataaccgctgattctcag

SEQ ID NO: 4751101 - DNA, 13 bp, Homo sapiens
tcccatctcacac

SEQ ID NO: 4751102 - DNA, 20 bp, Homo sapiens
tcccatctcacacatgagca

SEQ ID NO: 4751103 - DNA, 15 bp, Homo sapiens
tcccatgacccaggc

SEQ ID NO: 4751104 - DNA, 20 bp, Homo sapiens
tcccatgacccaggctgggc

SEQ ID NO: 4751105 - DNA, 21 bp, Homo sapiens
tcccatgactgcccagctctg

SEQ ID NO: 4751106 - DNA, 15 bp, Homo sapiens
tcccatgagcctcag

SEQ ID NO: 4751107 - DNA, 18 bp, Homo sapiens
tcccatgagcctcagcat

SEQ ID NO: 4751108 - DNA, 19 bp, Homo sapiens
tcccatgagcctcagcatc

SEQ ID NO: 4751109 - DNA, 20 bp, Homo sapiens
tcccatgagcctcagcatcc

SEQ ID NO: 4751110 - DNA, 15 bp, Homo sapiens
tccccaagcctggca

SEQ ID NO: 4751111 - DNA, 15 bp, Homo sapiens
tccccaccgcagaca

SEQ ID NO: 4751112 - DNA, 18 bp, Homo sapiens
tccccaccgcagacagga

SEQ ID NO: 4751113 - DNA, 24 bp, Homo sapiens
tccccaccgcagacaggaccaggg

SEQ ID NO: 4751114 - DNA, 17 bp, Homo sapiens
tccccagagttccccat

SEQ ID NO: 4751115 - DNA, 18 bp, Homo sapiens
tccccagagttccccatg

SEQ ID NO: 4751116 - DNA, 19 bp, Homo sapiens
tccccagatatttatgtat

SEQ ID NO: 4751117 - DNA, 19 bp, Homo sapiens
tccccagattgcaacaggc

SEQ ID NO: 4751118 - DNA, 14 bp, Homo sapiens
tccccagctgttta

SEQ ID NO: 4751119 - DNA, 15 bp, Homo sapiens
tccccagctgtttat

SEQ ID NO: 4751120 - DNA, 14 bp, Homo sapiens
tccccaggaggcca

SEQ ID NO: 4751121 - DNA, 20 bp, Homo sapiens
tccccaggaggccagccttg

SEQ ID NO: 4751122 - DNA, 11 bp, Homo sapiens
tcccccagccc

SEQ ID NO: 4751123 - DNA, 17 bp, Homo sapiens
tcccccagccccatcct

SEQ ID NO: 4751124 - DNA, 20 bp, Homo sapiens
tcccccagccccatcctctg

SEQ ID NO: 4751125 - DNA, 21 bp, Homo sapiens
tcccccagccccatcctctgt

SEQ ID NO: 4751126 - DNA, 16 bp, Homo sapiens
tcccccatgttctgtc

SEQ ID NO: 4751127 - DNA, 17 bp, Homo sapiens
tccccccaatccctcaa

SEQ ID NO: 4751128 - DNA, 18 bp, Homo sapiens
tcccccccggggctgggt

SEQ ID NO: 4751129 - DNA, 13 bp, Homo sapiens
tccccctctggct

SEQ ID NO: 4751130 - DNA, 21 bp, Homo sapiens
tccccctggccaccacccccc

SEQ ID NO: 4751131 - DNA, 21 bp, Homo sapiens
tccccgagggatgatgccaca

SEQ ID NO: 4751132 - DNA, 20 bp, Homo sapiens
tcccctaagcagaccactga

SEQ ID NO: 4751133 - DNA, 19 bp, Homo sapiens
tcccctcactgatggacaa

SEQ ID NO: 4751134 - DNA, 12 bp, Homo sapiens
tcccctccaacc

SEQ ID NO: 4751135 - DNA, 14 bp, Homo sapiens
tcccctccccaact

SEQ ID NO: 4751136 - DNA, 19 bp, Homo sapiens
tcccctcctacccctccca

SEQ ID NO: 4751137 - DNA, 20 bp, Homo sapiens
tcccctcctacccctcccag

SEQ ID NO: 4751138 - DNA, 12 bp, Homo sapiens
tcccctcctcca

SEQ ID NO: 4751139 - DNA, 14 bp, Homo sapiens
tcccctcctccact

SEQ ID NO: 4751140 - DNA, 16 bp, Homo sapiens
tcccctcctccactct

SEQ ID NO: 4751141 - DNA, 16 bp, Homo sapiens
tcccctcctctcccct

SEQ ID NO: 4751142 - DNA, 18 bp, Homo sapiens
tcccctcctctcccctac

SEQ ID NO: 4751143 - DNA, 17 bp, Homo sapiens
tcccctcgcccatcagt

SEQ ID NO: 4751144 - DNA, 15 bp, Homo sapiens
tcccctgccagggca

SEQ ID NO: 4751145 - DNA, 20 bp, Homo sapiens
tcccctgccagggcagggcc

SEQ ID NO: 4751146 - DNA, 16 bp, Homo sapiens
tcccctgcccccagga

SEQ ID NO: 4751147 - DNA, 19 bp, Homo sapiens
tcccctgcccccaggactg

SEQ ID NO: 4751148 - DNA, 20 bp, Homo sapiens
tcccctgcccccaggactgg

SEQ ID NO: 4751149 - DNA, 17 bp, Homo sapiens
tcccctgccccctgcag

SEQ ID NO: 4751150 - DNA, 20 bp, Homo sapiens
tcccctgctgggtgtggcgc

SEQ ID NO: 4751151 - DNA, 21 bp, Homo sapiens
tcccctgtttgtttctgaaag

SEQ ID NO: 4751152 - DNA, 18 bp, Homo sapiens
tccccttccactgagggc

SEQ ID NO: 4751153 - DNA, 21 bp, Homo sapiens
tccccttcctaattccacagc

SEQ ID NO: 4751154 - DNA, 22 bp, Homo sapiens
tccccttcctaattccacagct

SEQ ID NO: 4751155 - DNA, 13 bp, Homo sapiens
tccccttctctca

SEQ ID NO: 4751156 - DNA, 18 bp, Homo sapiens
tccccttctctcatctct

SEQ ID NO: 4751157 - DNA, 16 bp, Homo sapiens
tcccgaatagctggga

SEQ ID NO: 4751158 - DNA, 20 bp, Homo sapiens
tcccgagtagctgagattat

SEQ ID NO: 4751159 - DNA, 16 bp, Homo sapiens
tcccggcctgtaacat

SEQ ID NO: 4751160 - DNA, 12 bp, Homo sapiens
tcccgtggcccc

SEQ ID NO: 4751161 - DNA, 13 bp, Homo sapiens
tcccgtggcccca

SEQ ID NO: 4751162 - DNA, 16 bp, Homo sapiens
tcccgtggccccagcc

SEQ ID NO: 4751163 - DNA, 17 bp, Homo sapiens
tcccgtggccccagcct

SEQ ID NO: 4751164 - DNA, 18 bp, Homo sapiens
tcccgtggccccagcctg

SEQ ID NO: 4751165 - DNA, 23 bp, Homo sapiens
tcccgtttagagttatttaggct

SEQ ID NO: 4751166 - DNA, 14 bp, Homo sapiens
tccctaatgtgttt

SEQ ID NO: 4751167 - DNA, 14 bp, Homo sapiens
tccctatttatgat

SEQ ID NO: 4751168 - DNA, 20 bp, Homo sapiens
tccctcaaagaaatcctcca

SEQ ID NO: 4751169 - DNA, 15 bp, Homo sapiens
tccctcatttcagga

SEQ ID NO: 4751170 - DNA, 13 bp, Homo sapiens
tccctcccttggg

SEQ ID NO: 4751171 - DNA, 14 bp, Homo sapiens
tccctcctggccag

SEQ ID NO: 4751172 - DNA, 21 bp, Homo sapiens
tccctctacagagcttccctg

SEQ ID NO: 4751173 - DNA, 17 bp, Homo sapiens
tccctgaaggccccgcc

SEQ ID NO: 4751174 - DNA, 21 bp, Homo sapiens
tccctgaaggccccgcccagg

SEQ ID NO: 4751175 - DNA, 16 bp, Homo sapiens
tccctgaagtcttgca

SEQ ID NO: 4751176 - DNA, 21 bp, Homo sapiens
tccctgagttgcaccattctt

SEQ ID NO: 4751177 - DNA, 15 bp, Homo sapiens
tccctgcctaaggaa

SEQ ID NO: 4751178 - DNA, 14 bp, Homo sapiens
tccctgcctccacc

SEQ ID NO: 4751179 - DNA, 19 bp, Homo sapiens
tccctgcctccacccacag

SEQ ID NO: 4751180 - DNA, 23 bp, Homo sapiens
tccctgctaggggttttaggtct

SEQ ID NO: 4751181 - DNA, 16 bp, Homo sapiens
tccctggcgtcctctc

SEQ ID NO: 4751182 - DNA, 17 bp, Homo sapiens
tccctgggggcggccag

SEQ ID NO: 4751183 - DNA, 20 bp, Homo sapiens
tccctggtggcagctcacct

SEQ ID NO: 4751184 - DNA, 18 bp, Homo sapiens
tccctgtaacctcttcag

SEQ ID NO: 4751185 - DNA, 22 bp, Homo sapiens
tccctgtaacctcttcagaggc

SEQ ID NO: 4751186 - DNA, 22 bp, Homo sapiens
tcccttaaacaaaaattaaaat

SEQ ID NO: 4751187 - DNA, 14 bp, Homo sapiens
tcccttacctcaaa

SEQ ID NO: 4751188 - DNA, 21 bp, Homo sapiens
tcccttcatctggaaccatca

SEQ ID NO: 4751189 - DNA, 16 bp, Homo sapiens
tcccttcccacctctc

SEQ ID NO: 4751190 - DNA, 17 bp, Homo sapiens
tcccttgaccaggcctg

SEQ ID NO: 4751191 - DNA, 16 bp, Homo sapiens
tccctttgacgccatc

SEQ ID NO: 4751192 - DNA, 20 bp, Homo sapiens
tcccttttttggctgctgaa

SEQ ID NO: 4751193 - DNA, 22 bp, Homo sapiens
tcccttttttggctgctgaagg

SEQ ID NO: 4751194 - DNA, 13 bp, Homo sapiens
tccgaccagacac

SEQ ID NO: 4751195 - DNA, 22 bp, Homo sapiens
tccgacttgaattttcccactg

SEQ ID NO: 4751196 - DNA, 19 bp, Homo sapiens
tccgcacacctctggctgt

SEQ ID NO: 4751197 - DNA, 14 bp, Homo sapiens
tccgcctcttgggt

SEQ ID NO: 4751198 - DNA, 18 bp, Homo sapiens
tccgctttctacccagcg

SEQ ID NO: 4751199 - DNA, 21 bp, Homo sapiens
tccgctttctacccagcgagc

SEQ ID NO: 4751200 - DNA, 22 bp, Homo sapiens
tccgtgaaaatatgtttggaat

SEQ ID NO: 4751201 - DNA, 18 bp, Homo sapiens
tcctaataaagttctgta

SEQ ID NO: 4751202 - DNA, 16 bp, Homo sapiens
tcctacacctaactca

SEQ ID NO: 4751203 - DNA, 14 bp, Homo sapiens
tcctacccctccca

SEQ ID NO: 4751204 - DNA, 16 bp, Homo sapiens
tcctacccctcccagc

SEQ ID NO: 4751205 - DNA, 17 bp, Homo sapiens
tcctagttccaccatca

SEQ ID NO: 4751206 - DNA, 17 bp, Homo sapiens
tcctatgtatatcttct

SEQ ID NO: 4751207 - DNA, 11 bp, Homo sapiens
tcctatttaag

SEQ ID NO: 4751208 - DNA, 16 bp, Homo sapiens
tcctcaaacactgcag

SEQ ID NO: 4751209 - DNA, 14 bp, Homo sapiens
tcctcaaggggcca

SEQ ID NO: 4751210 - DNA, 13 bp, Homo sapiens
tcctcaatccagc

SEQ ID NO: 4751211 - DNA, 15 bp, Homo sapiens
tcctcacgtccatca

SEQ ID NO: 4751212 - DNA, 18 bp, Homo sapiens
tcctcatacccaccccca

SEQ ID NO: 4751213 - DNA, 22 bp, Homo sapiens
tcctcatacccacccccaccca

SEQ ID NO: 4751214 - DNA, 23 bp, Homo sapiens
tcctccaatcaaaatcacctccc

SEQ ID NO: 4751215 - DNA, 22 bp, Homo sapiens
tcctccacgttctgctcatcat

SEQ ID NO: 4751216 - DNA, 23 bp, Homo sapiens
tcctccactctcccccaccccct

SEQ ID NO: 4751217 - DNA, 16 bp, Homo sapiens
tcctccagggacagca

SEQ ID NO: 4751218 - DNA, 12 bp, Homo sapiens
tcctccaggtgc

SEQ ID NO: 4751219 - DNA, 12 bp, Homo sapiens
tcctccatggga

SEQ ID NO: 4751220 - DNA, 13 bp, Homo sapiens
tcctcccacctca

SEQ ID NO: 4751221 - DNA, 14 bp, Homo sapiens
tcctcccacctcag

SEQ ID NO: 4751222 - DNA, 17 bp, Homo sapiens
tcctccctttttccttg

SEQ ID NO: 4751223 - DNA, 19 bp, Homo sapiens
tcctccctttttccttgtc

SEQ ID NO: 4751224 - DNA, 15 bp, Homo sapiens
tcctccgtgaaaata

SEQ ID NO: 4751225 - DNA, 13 bp, Homo sapiens
tcctccgtggcac

SEQ ID NO: 4751226 - DNA, 14 bp, Homo sapiens
tcctccgtggcaca

SEQ ID NO: 4751227 - DNA, 13 bp, Homo sapiens
tcctcctccaggg

SEQ ID NO: 4751228 - DNA, 16 bp, Homo sapiens
tcctcctccagggaca

SEQ ID NO: 4751229 - DNA, 13 bp, Homo sapiens
tcctcctctgtga

SEQ ID NO: 4751230 - DNA, 20 bp, Homo sapiens
tcctcctgggccctctctgc

SEQ ID NO: 4751231 - DNA, 21 bp, Homo sapiens
tcctccttaaaacagagaagg

SEQ ID NO: 4751232 - DNA, 19 bp, Homo sapiens
tcctcctttcctatttccc

SEQ ID NO: 4751233 - DNA, 18 bp, Homo sapiens
tcctctactaacaatcag

SEQ ID NO: 4751234 - DNA, 14 bp, Homo sapiens
tcctctatcttcca

SEQ ID NO: 4751235 - DNA, 13 bp, Homo sapiens
tcctctatttctt

SEQ ID NO: 4751236 - DNA, 17 bp, Homo sapiens
tcctctccacctagtgg

SEQ ID NO: 4751237 - DNA, 17 bp, Homo sapiens
tcctctccctcctggcc

SEQ ID NO: 4751238 - DNA, 18 bp, Homo sapiens
tcctctccctcctggcca

SEQ ID NO: 4751239 - DNA, 14 bp, Homo sapiens
tcctctctgcccta

SEQ ID NO: 4751240 - DNA, 15 bp, Homo sapiens
tcctctgactcaggg

SEQ ID NO: 4751241 - DNA, 17 bp, Homo sapiens
tcctctgagccttggga

SEQ ID NO: 4751242 - DNA, 16 bp, Homo sapiens
tcctctgagctgttat

SEQ ID NO: 4751243 - DNA, 14 bp, Homo sapiens
tcctctgctgctgg

SEQ ID NO: 4751244 - DNA, 15 bp, Homo sapiens
tcctctgctgctggc

SEQ ID NO: 4751245 - DNA, 21 bp, Homo sapiens
tcctcttcctgaattttattt

SEQ ID NO: 4751246 - DNA, 21 bp, Homo sapiens
tcctctttggtctacactgtg

SEQ ID NO: 4751247 - DNA, 15 bp, Homo sapiens
tcctgaataaaccag

SEQ ID NO: 4751248 - DNA, 17 bp, Homo sapiens
tcctgaataaaccagta

SEQ ID NO: 4751249 - DNA, 21 bp, Homo sapiens
tcctgaattttattttttggg

SEQ ID NO: 4751250 - DNA, 21 bp, Homo sapiens
tcctgacttcaggggctgccc

SEQ ID NO: 4751251 - DNA, 22 bp, Homo sapiens
tcctgacttcaggggctgcccg

SEQ ID NO: 4751252 - DNA, 17 bp, Homo sapiens
tcctgaggctgggctcc

SEQ ID NO: 4751253 - DNA, 19 bp, Homo sapiens
tcctgaggctgggctccct

SEQ ID NO: 4751254 - DNA, 17 bp, Homo sapiens
tcctgatgatttttatt

SEQ ID NO: 4751255 - DNA, 21 bp, Homo sapiens
tcctgatggcaggatggcctg

SEQ ID NO: 4751256 - DNA, 16 bp, Homo sapiens
tcctgcaggcagccag

SEQ ID NO: 4751257 - DNA, 22 bp, Homo sapiens
tcctgcaggcagccaggccaca

SEQ ID NO: 4751258 - DNA, 11 bp, Homo sapiens
tcctgccctgg

SEQ ID NO: 4751259 - DNA, 15 bp, Homo sapiens
tcctgccctgggagg

SEQ ID NO: 4751260 - DNA, 21 bp, Homo sapiens
tcctgccctgggaggcagtga

SEQ ID NO: 4751261 - DNA, 13 bp, Homo sapiens
tcctgcctcagcc

SEQ ID NO: 4751262 - DNA, 14 bp, Homo sapiens
tcctgcctcagcct

SEQ ID NO: 4751263 - DNA, 19 bp, Homo sapiens
tcctgccttcctcctgggc

SEQ ID NO: 4751264 - DNA, 18 bp, Homo sapiens
tcctgctaagttaatgtt

SEQ ID NO: 4751265 - DNA, 13 bp, Homo sapiens
tcctgctcacatc

SEQ ID NO: 4751266 - DNA, 13 bp, Homo sapiens
tcctgctccacag

SEQ ID NO: 4751267 - DNA, 14 bp, Homo sapiens
tcctgctccacagc

SEQ ID NO: 4751268 - DNA, 21 bp, Homo sapiens
tcctgctgcaccaacccagcc

SEQ ID NO: 4751269 - DNA, 22 bp, Homo sapiens
tcctggaaccaggcttgcctgg

SEQ ID NO: 4751270 - DNA, 20 bp, Homo sapiens
tcctggacaccacccagagc

SEQ ID NO: 4751271 - DNA, 22 bp, Homo sapiens
tcctggacatgaagattctttc

SEQ ID NO: 4751272 - DNA, 22 bp, Homo sapiens
tcctggagcccagaggagggca

SEQ ID NO: 4751273 - DNA, 16 bp, Homo sapiens
tcctggcacccggccc

SEQ ID NO: 4751274 - DNA, 10 bp, Homo sapiens
tcctggccag

SEQ ID NO: 4751275 - DNA, 15 bp, Homo sapiens
tcctggccagatgtc

SEQ ID NO: 4751276 - DNA, 16 bp, Homo sapiens
tcctggccagatgtcg

SEQ ID NO: 4751277 - DNA, 21 bp, Homo sapiens
tcctggccagatgtcgctggg

SEQ ID NO: 4751278 - DNA, 21 bp, Homo sapiens
tcctgggaaatattccctaga

SEQ ID NO: 4751279 - DNA, 17 bp, Homo sapiens
tcctgggagtgagctgg

SEQ ID NO: 4751280 - DNA, 21 bp, Homo sapiens
tcctgggccctctctgctctg

SEQ ID NO: 4751281 - DNA, 17 bp, Homo sapiens
tcctgggttttgtattc

SEQ ID NO: 4751282 - DNA, 21 bp, Homo sapiens
tcctgggttttgtattctctg

SEQ ID NO: 4751283 - DNA, 15 bp, Homo sapiens
tcctgtaccaaatct

SEQ ID NO: 4751284 - DNA, 12 bp, Homo sapiens
tcctgtcagtgc

SEQ ID NO: 4751285 - DNA, 16 bp, Homo sapiens
tcctgtcccaccatgc

SEQ ID NO: 4751286 - DNA, 23 bp, Homo sapiens
tcctgtgggggaagagcacagcc

SEQ ID NO: 4751287 - DNA, 14 bp, Homo sapiens
tcctgtgtgtgcgc

SEQ ID NO: 4751288 - DNA, 12 bp, Homo sapiens
tcctgttctgtg

SEQ ID NO: 4751289 - DNA, 19 bp, Homo sapiens
tcctgttcttaagacgtga

SEQ ID NO: 4751290 - DNA, 21 bp, Homo sapiens
tcctgttttgcacagccaaat

SEQ ID NO: 4751291 - DNA, 14 bp, Homo sapiens
tccttacaatgtaa

SEQ ID NO: 4751292 - DNA, 16 bp, Homo sapiens
tccttaccagcagagc

SEQ ID NO: 4751293 - DNA, 14 bp, Homo sapiens
tccttagaagtgga

SEQ ID NO: 4751294 - DNA, 19 bp, Homo sapiens
tccttcacagatgggtgct

SEQ ID NO: 4751295 - DNA, 21 bp, Homo sapiens
tccttcacctttgtccccacc

SEQ ID NO: 4751296 - DNA, 14 bp, Homo sapiens
tccttcagccctca

SEQ ID NO: 4751297 - DNA, 19 bp, Homo sapiens
tccttcagccctcacccct

SEQ ID NO: 4751298 - DNA, 21 bp, Homo sapiens
tccttcagccctcacccctgg

SEQ ID NO: 4751299 - DNA, 14 bp, Homo sapiens
tccttccacctcag

SEQ ID NO: 4751300 - DNA, 15 bp, Homo sapiens
tccttccagaagagt

SEQ ID NO: 4751301 - DNA, 12 bp, Homo sapiens
tccttcccagag

SEQ ID NO: 4751302 - DNA, 22 bp, Homo sapiens
tccttcccagaggggcctgcca

SEQ ID NO: 4751303 - DNA, 16 bp, Homo sapiens
tccttcctctgagcct

SEQ ID NO: 4751304 - DNA, 17 bp, Homo sapiens
tccttcctctgagcctt

SEQ ID NO: 4751305 - DNA, 22 bp, Homo sapiens
tccttgacaccttactttccca

SEQ ID NO: 4751306 - DNA, 20 bp, Homo sapiens
tccttgcccatcgggaccag

SEQ ID NO: 4751307 - DNA, 15 bp, Homo sapiens
tccttggctggtgca

SEQ ID NO: 4751308 - DNA, 16 bp, Homo sapiens
tccttgtccccacact

SEQ ID NO: 4751309 - DNA, 18 bp, Homo sapiens
tccttgtccccacactcc

SEQ ID NO: 4751310 - DNA, 18 bp, Homo sapiens
tccttgtggcctgggcct

SEQ ID NO: 4751311 - DNA, 19 bp, Homo sapiens
tccttgtggcctgggcctc

SEQ ID NO: 4751312 - DNA, 22 bp, Homo sapiens
tcctttaaaaaaatttaagtgc

SEQ ID NO: 4751313 - DNA, 18 bp, Homo sapiens
tcctttactgaatgtaag

SEQ ID NO: 4751314 - DNA, 15 bp, Homo sapiens
tcctttagcgcccag

SEQ ID NO: 4751315 - DNA, 22 bp, Homo sapiens
tcctttagcgcccagttgggtg

SEQ ID NO: 4751316 - DNA, 19 bp, Homo sapiens
tcctttcaatggtttgcaa

SEQ ID NO: 4751317 - DNA, 16 bp, Homo sapiens
tcctttcatttactgt

SEQ ID NO: 4751318 - DNA, 15 bp, Homo sapiens
tcctttctatatcct

SEQ ID NO: 4751319 - DNA, 24 bp, Homo sapiens
tcctttgatggctttttttgccta

SEQ ID NO: 4751320 - DNA, 17 bp, Homo sapiens
tcctttgcgcaaacttt

SEQ ID NO: 4751321 - DNA, 22 bp, Homo sapiens
tcctttgtgaggaagccgctgg

SEQ ID NO: 4751322 - DNA, 14 bp, Homo sapiens
tccttttggagtca

SEQ ID NO: 4751323 - DNA, 23 bp, Homo sapiens
tccttttggagtcagacagatgt

SEQ ID NO: 4751324 - DNA, 18 bp, Homo sapiens
tcgaaataacaatgttaa

SEQ ID NO: 4751325 - DNA, 14 bp, Homo sapiens
tcgaaatttcattt

SEQ ID NO: 4751326 - DNA, 21 bp, Homo sapiens
tcgaagaaaataattctctat

SEQ ID NO: 4751327 - DNA, 15 bp, Homo sapiens
tcgaatttttattat

SEQ ID NO: 4751328 - DNA, 15 bp, Homo sapiens
tcgagaactttcatt

SEQ ID NO: 4751329 - DNA, 22 bp, Homo sapiens
tcgagaactttcatttttttcc

SEQ ID NO: 4751330 - DNA, 16 bp, Homo sapiens
tcgagcatgcctggat

SEQ ID NO: 4751331 - DNA, 18 bp, Homo sapiens
tcgagcatgcctggatgg

SEQ ID NO: 4751332 - DNA, 16 bp, Homo sapiens
tcgatgtcctcctctg

SEQ ID NO: 4751333 - DNA, 18 bp, Homo sapiens
tcgatgtcctcctctgtg

SEQ ID NO: 4751334 - DNA, 17 bp, Homo sapiens
tcgcaatgtaagactcg

SEQ ID NO: 4751335 - DNA, 13 bp, Homo sapiens
tcgcacacacagt

SEQ ID NO: 4751336 - DNA, 14 bp, Homo sapiens
tcgcccagtctgga

SEQ ID NO: 4751337 - DNA, 19 bp, Homo sapiens
tcgcccagtctggaatgca

SEQ ID NO: 4751338 - DNA, 13 bp, Homo sapiens
tcgctcctgtgtc

SEQ ID NO: 4751339 - DNA, 19 bp, Homo sapiens
tcgctgccagctctgtatc

SEQ ID NO: 4751340 - DNA, 23 bp, Homo sapiens
tcgctggactctcagtctctgag

SEQ ID NO: 4751341 - DNA, 13 bp, Homo sapiens
tcggcctgtgtcc

SEQ ID NO: 4751342 - DNA, 11 bp, Homo sapiens
tcggctcctgc

SEQ ID NO: 4751343 - DNA, 13 bp, Homo sapiens
tcggctcctgctg

SEQ ID NO: 4751344 - DNA, 17 bp, Homo sapiens
tcggctcctgctgcacc

SEQ ID NO: 4751345 - DNA, 18 bp, Homo sapiens
tcggctcctgctgcacca

SEQ ID NO: 4751346 - DNA, 12 bp, Homo sapiens
tcgggaccagaa

SEQ ID NO: 4751347 - DNA, 14 bp, Homo sapiens
tcgggctcctgtgc

SEQ ID NO: 4751348 - DNA, 20 bp, Homo sapiens
tcgtccctcctccccggagc

SEQ ID NO: 4751349 - DNA, 16 bp, Homo sapiens
tcgtcttaactcacca

SEQ ID NO: 4751350 - DNA, 17 bp, Homo sapiens
tcgtgatcactgagcca

SEQ ID NO: 4751351 - DNA, 23 bp, Homo sapiens
tcgtgccagtcgcgctgcctgtg

SEQ ID NO: 4751352 - DNA, 21 bp, Homo sapiens
tcgtgtctagtagaacaatgt

SEQ ID NO: 4751353 - DNA, 12 bp, Homo sapiens
tcgttgtgaggg

SEQ ID NO: 4751354 - DNA, 23 bp, Homo sapiens
tcgtttgatagtgcttcttgtaa

SEQ ID NO: 4751355 - DNA, 22 bp, Homo sapiens
tctaaacaagaaccatttgcaa

SEQ ID NO: 4751356 - DNA, 13 bp, Homo sapiens
tctaaactgcccc

SEQ ID NO: 4751357 - DNA, 12 bp, Homo sapiens
tctaaagagcat

SEQ ID NO: 4751358 - DNA, 22 bp, Homo sapiens
tctaaatatcccttggacattt

SEQ ID NO: 4751359 - DNA, 16 bp, Homo sapiens
tctaagaagctgcaat

SEQ ID NO: 4751360 - DNA, 18 bp, Homo sapiens
tctaagaagctgcaataa

SEQ ID NO: 4751361 - DNA, 19 bp, Homo sapiens
tctaagtcaatccaagagt

SEQ ID NO: 4751362 - DNA, 13 bp, Homo sapiens
tctaagtctttcc

SEQ ID NO: 4751363 - DNA, 18 bp, Homo sapiens
tctaatattcacatgttc

SEQ ID NO: 4751364 - DNA, 20 bp, Homo sapiens
tctaatattcacatgttcta

SEQ ID NO: 4751365 - DNA, 17 bp, Homo sapiens
tctaatgacattcaata

SEQ ID NO: 4751366 - DNA, 18 bp, Homo sapiens
tctaatgacattcaataa

SEQ ID NO: 4751367 - DNA, 19 bp, Homo sapiens
tctaatgacattcaataaa

SEQ ID NO: 4751368 - DNA, 17 bp, Homo sapiens
tctaatgcttgatttag

SEQ ID NO: 4751369 - DNA, 14 bp, Homo sapiens
tctaatgtttgtga

SEQ ID NO: 4751370 - DNA, 16 bp, Homo sapiens
tctaattttggataat

SEQ ID NO: 4751371 - DNA, 21 bp, Homo sapiens
tctacactgtgctgagtctga

SEQ ID NO: 4751372 - DNA, 14 bp, Homo sapiens
tctacagagaaaat

SEQ ID NO: 4751373 - DNA, 17 bp, Homo sapiens
tctacagagcttccctg

SEQ ID NO: 4751374 - DNA, 15 bp, Homo sapiens
tctaccccttactta

SEQ ID NO: 4751375 - DNA, 20 bp, Homo sapiens
tctacttgatatttccttca

SEQ ID NO: 4751376 - DNA, 12 bp, Homo sapiens
tctactttgaag

SEQ ID NO: 4751377 - DNA, 13 bp, Homo sapiens
tctagaaatacac

SEQ ID NO: 4751378 - DNA, 17 bp, Homo sapiens
tctagagcttgatgcca

SEQ ID NO: 4751379 - DNA, 14 bp, Homo sapiens
tctagatcactgtg

SEQ ID NO: 4751380 - DNA, 15 bp, Homo sapiens
tctagatcactgtgc

SEQ ID NO: 4751381 - DNA, 19 bp, Homo sapiens
tctagcagtaaaagataaa

SEQ ID NO: 4751382 - DNA, 15 bp, Homo sapiens
tctaggaagactttg

SEQ ID NO: 4751383 - DNA, 16 bp, Homo sapiens
tctaggaagactttgg

SEQ ID NO: 4751384 - DNA, 15 bp, Homo sapiens
tctagggacccctcc

SEQ ID NO: 4751385 - DNA, 18 bp, Homo sapiens
tctagggacccctcctcc

SEQ ID NO: 4751386 - DNA, 21 bp, Homo sapiens
tctaggtacgatgacagtgtt

SEQ ID NO: 4751387 - DNA, 21 bp, Homo sapiens
tctaggtcttggttagagaag

SEQ ID NO: 4751388 - DNA, 17 bp, Homo sapiens
tctaggtggcaaggctg

SEQ ID NO: 4751389 - DNA, 16 bp, Homo sapiens
tctagtagaacaatgt

SEQ ID NO: 4751390 - DNA, 18 bp, Homo sapiens
tctagtggtctttgtaag

SEQ ID NO: 4751391 - DNA, 22 bp, Homo sapiens
tctagtggtctttgtaagagtg

SEQ ID NO: 4751392 - DNA, 23 bp, Homo sapiens
tctagtggtctttgtaagagtgt

SEQ ID NO: 4751393 - DNA, 21 bp, Homo sapiens
tctatctgcaatgtttttgtg

SEQ ID NO: 4751394 - DNA, 23 bp, Homo sapiens
tctatctgcaatgtttttgtgta

SEQ ID NO: 4751395 - DNA, 13 bp, Homo sapiens
tctatcttccaaa

SEQ ID NO: 4751396 - DNA, 19 bp, Homo sapiens
tctatgactgtgtttaata

SEQ ID NO: 4751397 - DNA, 22 bp, Homo sapiens
tctatgatgaaggtaattaaag

SEQ ID NO: 4751398 - DNA, 12 bp, Homo sapiens
tctatgtatgtg

SEQ ID NO: 4751399 - DNA, 14 bp, Homo sapiens
tctatgttaatatt

SEQ ID NO: 4751400 - DNA, 16 bp, Homo sapiens
tctatgttaatatttt

SEQ ID NO: 4751401 - DNA, 17 bp, Homo sapiens
tctattaaaagactcat

SEQ ID NO: 4751402 - DNA, 19 bp, Homo sapiens
tctattaaaattgccattt

SEQ ID NO: 4751403 - DNA, 23 bp, Homo sapiens
tctattctcaaagttaaaagtaa

SEQ ID NO: 4751404 - DNA, 15 bp, Homo sapiens
tctattgaaagtttt

SEQ ID NO: 4751405 - DNA, 16 bp, Homo sapiens
tctatttctcctccat

SEQ ID NO: 4751406 - DNA, 20 bp, Homo sapiens
tctatttctcctccatggga

SEQ ID NO: 4751407 - DNA, 20 bp, Homo sapiens
tctatttttgtttacaaaca

SEQ ID NO: 4751408 - DNA, 13 bp, Homo sapiens
tctcaaactcttg

SEQ ID NO: 4751409 - DNA, 21 bp, Homo sapiens
tctcaaagaaatttccactca

SEQ ID NO: 4751410 - DNA, 21 bp, Homo sapiens
tctcacacatgagcatcaggc

SEQ ID NO: 4751411 - DNA, 22 bp, Homo sapiens
tctcacctaaaccctctgtgaa

SEQ ID NO: 4751412 - DNA, 13 bp, Homo sapiens
tctcactccttga

SEQ ID NO: 4751413 - DNA, 16 bp, Homo sapiens
tctcactctgtcgccc

SEQ ID NO: 4751414 - DNA, 14 bp, Homo sapiens
tctcactgttgccc

SEQ ID NO: 4751415 - DNA, 15 bp, Homo sapiens
tctcactgttgccca

SEQ ID NO: 4751416 - DNA, 20 bp, Homo sapiens
tctcagagctacttgggcca

SEQ ID NO: 4751417 - DNA, 21 bp, Homo sapiens
tctcagagctacttgggccat

SEQ ID NO: 4751418 - DNA, 18 bp, Homo sapiens
tctcaggccaagcccaat

SEQ ID NO: 4751419 - DNA, 13 bp, Homo sapiens
tctcaggctgtcc

SEQ ID NO: 4751420 - DNA, 23 bp, Homo sapiens
tctcaggctgtcccaagctccca

SEQ ID NO: 4751421 - DNA, 15 bp, Homo sapiens
tctcagggtctctgc

SEQ ID NO: 4751422 - DNA, 18 bp, Homo sapiens
tctcagggtctctgctgc

SEQ ID NO: 4751423 - DNA, 14 bp, Homo sapiens
tctcagtcatgcat

SEQ ID NO: 4751424 - DNA, 19 bp, Homo sapiens
tctcagtcatgcataaata

SEQ ID NO: 4751425 - DNA, 23 bp, Homo sapiens
tctcagtcatgcataaatatgca

SEQ ID NO: 4751426 - DNA, 15 bp, Homo sapiens
tctcagtctctgagc

SEQ ID NO: 4751427 - DNA, 18 bp, Homo sapiens
tctcagtctctgagcagt

SEQ ID NO: 4751428 - DNA, 11 bp, Homo sapiens
tctcagtgtgc

SEQ ID NO: 4751429 - DNA, 14 bp, Homo sapiens
tctcagttgcagcc

SEQ ID NO: 4751430 - DNA, 18 bp, Homo sapiens
tctcatatatattttaaa

SEQ ID NO: 4751431 - DNA, 14 bp, Homo sapiens
tctcatccatcatc

SEQ ID NO: 4751432 - DNA, 13 bp, Homo sapiens
tctcatctttctt

SEQ ID NO: 4751433 - DNA, 18 bp, Homo sapiens
tctcatgaatctgcaatg

SEQ ID NO: 4751434 - DNA, 19 bp, Homo sapiens
tctcatgcctcagcctcct

SEQ ID NO: 4751435 - DNA, 20 bp, Homo sapiens
tctcatgcctcagcctcctg

SEQ ID NO: 4751436 - DNA, 21 bp, Homo sapiens
tctcatgtgtgctcttcttct

SEQ ID NO: 4751437 - DNA, 16 bp, Homo sapiens
tctcattgaggacaaa

SEQ ID NO: 4751438 - DNA, 19 bp, Homo sapiens
tctcattggacccttccat

SEQ ID NO: 4751439 - DNA, 16 bp, Homo sapiens
tctcatttcacccctc

SEQ ID NO: 4751440 - DNA, 14 bp, Homo sapiens
tctccaaaccactt

SEQ ID NO: 4751441 - DNA, 14 bp, Homo sapiens
tctccaccctgctc

SEQ ID NO: 4751442 - DNA, 17 bp, Homo sapiens
tctccaccctgctctcc

SEQ ID NO: 4751443 - DNA, 22 bp, Homo sapiens
tctccacctagtggctgtccag

SEQ ID NO: 4751444 - DNA, 15 bp, Homo sapiens
tctccagcattctca

SEQ ID NO: 4751445 - DNA, 18 bp, Homo sapiens
tctccagcccctggatgc

SEQ ID NO: 4751446 - DNA, 11 bp, Homo sapiens
tctccaggctg

SEQ ID NO: 4751447 - DNA, 12 bp, Homo sapiens
tctccatgaaga

SEQ ID NO: 4751448 - DNA, 14 bp, Homo sapiens
tctccatggccctg

SEQ ID NO: 4751449 - DNA, 15 bp, Homo sapiens
tctccatggccctgc

SEQ ID NO: 4751450 - DNA, 17 bp, Homo sapiens
tctccatggccctgcca

SEQ ID NO: 4751451 - DNA, 18 bp, Homo sapiens
tctcccaaagtgctggga

SEQ ID NO: 4751452 - DNA, 20 bp, Homo sapiens
tctccccagggttcagtcct

SEQ ID NO: 4751453 - DNA, 12 bp, Homo sapiens
tctcccccagcc

SEQ ID NO: 4751454 - DNA, 18 bp, Homo sapiens
tctcccccagccccatcc

SEQ ID NO: 4751455 - DNA, 20 bp, Homo sapiens
tctcccccagccccatcctc

SEQ ID NO: 4751456 - DNA, 20 bp, Homo sapiens
tctcccccccggggctgggt

SEQ ID NO: 4751457 - DNA, 16 bp, Homo sapiens
tctcccctgcccccag

SEQ ID NO: 4751458 - DNA, 20 bp, Homo sapiens
tctcccctgcccccaggact

SEQ ID NO: 4751459 - DNA, 12 bp, Homo sapiens
tctccctcctgg

SEQ ID NO: 4751460 - DNA, 17 bp, Homo sapiens
tctccctcctggccaga

SEQ ID NO: 4751461 - DNA, 16 bp, Homo sapiens
tctccgcacacctctg

SEQ ID NO: 4751462 - DNA, 22 bp, Homo sapiens
tctccgcacacctctggctgtc

SEQ ID NO: 4751463 - DNA, 15 bp, Homo sapiens
tctcctaaattgttg

SEQ ID NO: 4751464 - DNA, 17 bp, Homo sapiens
tctcctctccatctcta

SEQ ID NO: 4751465 - DNA, 19 bp, Homo sapiens
tctcctgcctcagcctccc

SEQ ID NO: 4751466 - DNA, 22 bp, Homo sapiens
tctcctgcctcagcctcccaaa

SEQ ID NO: 4751467 - DNA, 20 bp, Homo sapiens
tctcctgccttcctcctggg

SEQ ID NO: 4751468 - DNA, 17 bp, Homo sapiens
tctcctgtgatgtccca

SEQ ID NO: 4751469 - DNA, 18 bp, Homo sapiens
tctccttcacctttgtcc

SEQ ID NO: 4751470 - DNA, 19 bp, Homo sapiens
tctccttcagccctcaccc

SEQ ID NO: 4751471 - DNA, 19 bp, Homo sapiens
tctcgctgatgctgggctg

SEQ ID NO: 4751472 - DNA, 15 bp, Homo sapiens
tctcggctcactgca

SEQ ID NO: 4751473 - DNA, 21 bp, Homo sapiens
tctcgtggtaggactgtagaa

SEQ ID NO: 4751474 - DNA, 12 bp, Homo sapiens
tctctactgaaa

SEQ ID NO: 4751475 - DNA, 22 bp, Homo sapiens
tctctcatctcttagctcccct

SEQ ID NO: 4751476 - DNA, 23 bp, Homo sapiens
tctctcatctcttagctcccctc

SEQ ID NO: 4751477 - DNA, 17 bp, Homo sapiens
tctctccagcccctgga

SEQ ID NO: 4751478 - DNA, 18 bp, Homo sapiens
tctctccagcccctggat

SEQ ID NO: 4751479 - DNA, 16 bp, Homo sapiens
tctctctaacataaca

SEQ ID NO: 4751480 - DNA, 21 bp, Homo sapiens
tctctgacaatgcgtggcaca

SEQ ID NO: 4751481 - DNA, 14 bp, Homo sapiens
tctctgaggacact

SEQ ID NO: 4751482 - DNA, 22 bp, Homo sapiens
tctctgccccttaaatcacaca

SEQ ID NO: 4751483 - DNA, 17 bp, Homo sapiens
tctctgccctccaagac

SEQ ID NO: 4751484 - DNA, 11 bp, Homo sapiens
tctctgctgcc

SEQ ID NO: 4751485 - DNA, 13 bp, Homo sapiens
tctctgctgccgc

SEQ ID NO: 4751486 - DNA, 22 bp, Homo sapiens
tctctgtgagactcgagaactt

SEQ ID NO: 4751487 - DNA, 19 bp, Homo sapiens
tctcttagctcccctccaa

SEQ ID NO: 4751488 - DNA, 19 bp, Homo sapiens
tctcttctgggttccttcc

SEQ ID NO: 4751489 - DNA, 21 bp, Homo sapiens
tctcttctgggttccttcctc

SEQ ID NO: 4751490 - DNA, 17 bp, Homo sapiens
tctcttggtcctgctgc

SEQ ID NO: 4751491 - DNA, 21 bp, Homo sapiens
tctctttaatgtcacaggcag

SEQ ID NO: 4751492 - DNA, 16 bp, Homo sapiens
tctcttttcaaaacat

SEQ ID NO: 4751493 - DNA, 18 bp, Homo sapiens
tctgaaaatataaccagc

SEQ ID NO: 4751494 - DNA, 13 bp, Homo sapiens
tctgaaagggacg

SEQ ID NO: 4751495 - DNA, 15 bp, Homo sapiens
tctgaagagtatttg

SEQ ID NO: 4751496 - DNA, 21 bp, Homo sapiens
tctgaatattaagaaacaatt

SEQ ID NO: 4751497 - DNA, 16 bp, Homo sapiens
tctgaatctccttgtt

SEQ ID NO: 4751498 - DNA, 23 bp, Homo sapiens
tctgaatgaagccttctgacctg

SEQ ID NO: 4751499 - DNA, 16 bp, Homo sapiens
tctgacacacagctct

SEQ ID NO: 4751500 - DNA, 17 bp, Homo sapiens
tctgacacacagctctg

SEQ ID NO: 4751501 - DNA, 22 bp, Homo sapiens
tctgacaggcaatgctggctgt

SEQ ID NO: 4751502 - DNA, 21 bp, Homo sapiens
tctgacccacagcctccaagt

SEQ ID NO: 4751503 - DNA, 13 bp, Homo sapiens
tctgacccactgc

SEQ ID NO: 4751504 - DNA, 20 bp, Homo sapiens
tctgacgcagcctgagaatg

SEQ ID NO: 4751505 - DNA, 14 bp, Homo sapiens
tctgactcagggct

SEQ ID NO: 4751506 - DNA, 17 bp, Homo sapiens
tctgactctaaaatatg

SEQ ID NO: 4751507 - DNA, 22 bp, Homo sapiens
tctgagactctcttaggagcag

SEQ ID NO: 4751508 - DNA, 22 bp, Homo sapiens
tctgagcattagatttctcatt

SEQ ID NO: 4751509 - DNA, 14 bp, Homo sapiens
tctgagctgttatc

SEQ ID NO: 4751510 - DNA, 20 bp, Homo sapiens
tctgagctgttatcttgtgt

SEQ ID NO: 4751511 - DNA, 22 bp, Homo sapiens
tctgagctgttatcttgtgtat

SEQ ID NO: 4751512 - DNA, 20 bp, Homo sapiens
tctgaggacactaaccacgc

SEQ ID NO: 4751513 - DNA, 23 bp, Homo sapiens
tctgaggcacctgcatatctcta

SEQ ID NO: 4751514 - DNA, 14 bp, Homo sapiens
tctgataatgtatt

SEQ ID NO: 4751515 - DNA, 16 bp, Homo sapiens
tctgatgcaagcaaga

SEQ ID NO: 4751516 - DNA, 21 bp, Homo sapiens
tctgatgcaagcaagaaacac

SEQ ID NO: 4751517 - DNA, 15 bp, Homo sapiens
tctgatggcttctcc

SEQ ID NO: 4751518 - DNA, 18 bp, Homo sapiens
tctgattcccaagctctg

SEQ ID NO: 4751519 - DNA, 19 bp, Homo sapiens
tctgatttagcaatgctgt

SEQ ID NO: 4751520 - DNA, 21 bp, Homo sapiens
tctgatttagcaatgctgtga

SEQ ID NO: 4751521 - DNA, 13 bp, Homo sapiens
tctgcaacatgga

SEQ ID NO: 4751522 - DNA, 19 bp, Homo sapiens
tctgcaacatggattccaa

SEQ ID NO: 4751523 - DNA, 22 bp, Homo sapiens
tctgcaacatggattccaaagc

SEQ ID NO: 4751524 - DNA, 18 bp, Homo sapiens
tctgcaatgtttttgtgt

SEQ ID NO: 4751525 - DNA, 14 bp, Homo sapiens
tctgcaccttctga

SEQ ID NO: 4751526 - DNA, 13 bp, Homo sapiens
tctgcactcccct

SEQ ID NO: 4751527 - DNA, 15 bp, Homo sapiens
tctgcactcccctgc

SEQ ID NO: 4751528 - DNA, 17 bp, Homo sapiens
tctgcactcccctgctg

SEQ ID NO: 4751529 - DNA, 23 bp, Homo sapiens
tctgcacttgcggttccggcatg

SEQ ID NO: 4751530 - DNA, 22 bp, Homo sapiens
tctgcagtgtggcaagcaagag

SEQ ID NO: 4751531 - DNA, 22 bp, Homo sapiens
tctgcatgtaaaatcttcagct

SEQ ID NO: 4751532 - DNA, 16 bp, Homo sapiens
tctgccacttcccagg

SEQ ID NO: 4751533 - DNA, 14 bp, Homo sapiens
tctgccatgtccat

SEQ ID NO: 4751534 - DNA, 13 bp, Homo sapiens
tctgcccactccc

SEQ ID NO: 4751535 - DNA, 18 bp, Homo sapiens
tctgcccactccctgcaa

SEQ ID NO: 4751536 - DNA, 21 bp, Homo sapiens
tctgcccactccctgcaacct

SEQ ID NO: 4751537 - DNA, 23 bp, Homo sapiens
tctgcccactccctgcaacctga

SEQ ID NO: 4751538 - DNA, 16 bp, Homo sapiens
tctgcccagggatttg

SEQ ID NO: 4751539 - DNA, 18 bp, Homo sapiens
tctgcccctccctgcttc

SEQ ID NO: 4751540 - DNA, 22 bp, Homo sapiens
tctgccctgcgggtcacaggag

SEQ ID NO: 4751541 - DNA, 20 bp, Homo sapiens
tctgcctcccatcacccgct

SEQ ID NO: 4751542 - DNA, 21 bp, Homo sapiens
tctgcctcccatcacccgcta

SEQ ID NO: 4751543 - DNA, 18 bp, Homo sapiens
tctgcctctgacacacag

SEQ ID NO: 4751544 - DNA, 21 bp, Homo sapiens
tctgcctctgacacacagctc

SEQ ID NO: 4751545 - DNA, 22 bp, Homo sapiens
tctgcctctgacacacagctct

SEQ ID NO: 4751546 - DNA, 14 bp, Homo sapiens
tctgcctcttctgg

SEQ ID NO: 4751547 - DNA, 17 bp, Homo sapiens
tctgcctcttctgggag

SEQ ID NO: 4751548 - DNA, 20 bp, Homo sapiens
tctgcctgaagtcacacagt

SEQ ID NO: 4751549 - DNA, 16 bp, Homo sapiens
tctgcctgcccaggcc

SEQ ID NO: 4751550 - DNA, 15 bp, Homo sapiens
tctgccttccttgct

SEQ ID NO: 4751551 - DNA, 23 bp, Homo sapiens
tctgcggggcctgaggcaagcca

SEQ ID NO: 4751552 - DNA, 16 bp, Homo sapiens
tctgcgtgacaataaa

SEQ ID NO: 4751553 - DNA, 15 bp, Homo sapiens
tctgcgtgtcacctg

SEQ ID NO: 4751554 - DNA, 19 bp, Homo sapiens
tctgcgtgtcacctgtgct

SEQ ID NO: 4751555 - DNA, 16 bp, Homo sapiens
tctgctcacatatctg

SEQ ID NO: 4751556 - DNA, 19 bp, Homo sapiens
tctgctcacatatctgtca

SEQ ID NO: 4751557 - DNA, 20 bp, Homo sapiens
tctgctcacatatctgtcat

SEQ ID NO: 4751558 - DNA, 18 bp, Homo sapiens
tctgctcatcattctctg

SEQ ID NO: 4751559 - DNA, 17 bp, Homo sapiens
tctgctcgggcccaggc

SEQ ID NO: 4751560 - DNA, 22 bp, Homo sapiens
tctgctcgggcccaggccatct

SEQ ID NO: 4751561 - DNA, 23 bp, Homo sapiens
tctgctctaagaagctgcaataa

SEQ ID NO: 4751562 - DNA, 12 bp, Homo sapiens
tctgctctcctt

SEQ ID NO: 4751563 - DNA, 13 bp, Homo sapiens
tctgctctccttc

SEQ ID NO: 4751564 - DNA, 15 bp, Homo sapiens
tctgctctccttcct

SEQ ID NO: 4751565 - DNA, 21 bp, Homo sapiens
tctgctgccgccccacccaga

SEQ ID NO: 4751566 - DNA, 22 bp, Homo sapiens
tctgctgccgccccacccagat

SEQ ID NO: 4751567 - DNA, 14 bp, Homo sapiens
tctgctgctggctg

SEQ ID NO: 4751568 - DNA, 15 bp, Homo sapiens
tctgctgctggctgg

SEQ ID NO: 4751569 - DNA, 13 bp, Homo sapiens
tctgctgggctgg

SEQ ID NO: 4751570 - DNA, 16 bp, Homo sapiens
tctgcttaaaaactca

SEQ ID NO: 4751571 - DNA, 24 bp, Homo sapiens
tctgcttcatttcctctgagctgt

SEQ ID NO: 4751572 - DNA, 18 bp, Homo sapiens
tctgctttcctcttcctg

SEQ ID NO: 4751573 - DNA, 18 bp, Homo sapiens
tctggaagtgactttggc

SEQ ID NO: 4751574 - DNA, 14 bp, Homo sapiens
tctggacactgcca

SEQ ID NO: 4751575 - DNA, 22 bp, Homo sapiens
tctggatgcctgattgccaagc

SEQ ID NO: 4751576 - DNA, 15 bp, Homo sapiens
tctggattcatattt

SEQ ID NO: 4751577 - DNA, 14 bp, Homo sapiens
tctggattcccagg

SEQ ID NO: 4751578 - DNA, 22 bp, Homo sapiens
tctggattcccaggatgagcat

SEQ ID NO: 4751579 - DNA, 17 bp, Homo sapiens
tctggcagctcagagag

SEQ ID NO: 4751580 - DNA, 18 bp, Homo sapiens
tctggcctagtcccttcc

SEQ ID NO: 4751581 - DNA, 15 bp, Homo sapiens
tctggctttgttctt

SEQ ID NO: 4751582 - DNA, 21 bp, Homo sapiens
tctggctttgttcttgtcatc

SEQ ID NO: 4751583 - DNA, 12 bp, Homo sapiens
tctgggacacag

SEQ ID NO: 4751584 - DNA, 21 bp, Homo sapiens
tctgggagggcagcagggcta

SEQ ID NO: 4751585 - DNA, 13 bp, Homo sapiens
tctgggcagacat

SEQ ID NO: 4751586 - DNA, 16 bp, Homo sapiens
tctgggcagacattat

SEQ ID NO: 4751587 - DNA, 17 bp, Homo sapiens
tctgggtgatttctaga

SEQ ID NO: 4751588 - DNA, 16 bp, Homo sapiens
tctggtgactttcctc

SEQ ID NO: 4751589 - DNA, 23 bp, Homo sapiens
tctggtgactttcctctttggtc

SEQ ID NO: 4751590 - DNA, 22 bp, Homo sapiens
tctgtaaatccagtgttacaat

SEQ ID NO: 4751591 - DNA, 12 bp, Homo sapiens
tctgtaataata

SEQ ID NO: 4751592 - DNA, 14 bp, Homo sapiens
tctgtacagagccc

SEQ ID NO: 4751593 - DNA, 17 bp, Homo sapiens
tctgtacgtctgacagg

SEQ ID NO: 4751594 - DNA, 20 bp, Homo sapiens
tctgtatatagctctacaca

SEQ ID NO: 4751595 - DNA, 23 bp, Homo sapiens
tctgtcatttgagcagggctcag

SEQ ID NO: 4751596 - DNA, 20 bp, Homo sapiens
tctgtccccttctctcatct

SEQ ID NO: 4751597 - DNA, 21 bp, Homo sapiens
tctgtccccttctctcatctc

SEQ ID NO: 4751598 - DNA, 22 bp, Homo sapiens
tctgtccccttctctcatctct

SEQ ID NO: 4751599 - DNA, 14 bp, Homo sapiens
tctgtcctactctg

SEQ ID NO: 4751600 - DNA, 20 bp, Homo sapiens
tctgtcctactctgtgtcag

SEQ ID NO: 4751601 - DNA, 12 bp, Homo sapiens
tctgtcctgctg

SEQ ID NO: 4751602 - DNA, 13 bp, Homo sapiens
tctgtcctggaac

SEQ ID NO: 4751603 - DNA, 14 bp, Homo sapiens
tctgtcgcccagtc

SEQ ID NO: 4751604 - DNA, 19 bp, Homo sapiens
tctgtgaccaatgtcttga

SEQ ID NO: 4751605 - DNA, 23 bp, Homo sapiens
tctgtgatgactggttgttcaaa

SEQ ID NO: 4751606 - DNA, 15 bp, Homo sapiens
tctgtgcccatgggc

SEQ ID NO: 4751607 - DNA, 23 bp, Homo sapiens
tctgtgggatgggatggtggagg

SEQ ID NO: 4751608 - DNA, 16 bp, Homo sapiens
tctgtgggctgcactc

SEQ ID NO: 4751609 - DNA, 17 bp, Homo sapiens
tctgtgtaatagaataa

SEQ ID NO: 4751610 - DNA, 23 bp, Homo sapiens
tctgtgtcactggctgcctccac

SEQ ID NO: 4751611 - DNA, 19 bp, Homo sapiens
tctgtgtggcaaattaaac

SEQ ID NO: 4751612 - DNA, 15 bp, Homo sapiens
tctgtgtgtgtatga

SEQ ID NO: 4751613 - DNA, 17 bp, Homo sapiens
tctgtgttgagcgtgcg

SEQ ID NO: 4751614 - DNA, 18 bp, Homo sapiens
tctgttctgcacacagca

SEQ ID NO: 4751615 - DNA, 10 bp, Homo sapiens
tctgttgaag

SEQ ID NO: 4751616 - DNA, 12 bp, Homo sapiens
tctgttgcaaac

SEQ ID NO: 4751617 - DNA, 19 bp, Homo sapiens
tctgttggccagtgtgaca

SEQ ID NO: 4751618 - DNA, 15 bp, Homo sapiens
tctgttgtttgaaga

SEQ ID NO: 4751619 - DNA, 20 bp, Homo sapiens
tctgtttttttttttttaac

SEQ ID NO: 4751620 - DNA, 17 bp, Homo sapiens
tcttaatcttttcacaa

SEQ ID NO: 4751621 - DNA, 21 bp, Homo sapiens
tcttaatcttttcacaaataa

SEQ ID NO: 4751622 - DNA, 14 bp, Homo sapiens
tcttaatgttgaat

SEQ ID NO: 4751623 - DNA, 20 bp, Homo sapiens
tggactcacctcccccatct

SEQ ID NO: 4751624 - DNA, 15 bp, Homo sapiens
tggactctcagtctc

SEQ ID NO: 4751625 - DNA, 11 bp, Homo sapiens
tggactgaggc

SEQ ID NO: 4751626 - DNA, 14 bp, Homo sapiens
tggactgaggcctg

SEQ ID NO: 4751627 - DNA, 15 bp, Homo sapiens
tggactttcttgcaa

SEQ ID NO: 4751628 - DNA, 22 bp, Homo sapiens
tggagaaaatgggtttattcac

SEQ ID NO: 4751629 - DNA, 21 bp, Homo sapiens
tggagaactagaacctggagg

SEQ ID NO: 4751630 - DNA, 21 bp, Homo sapiens
tggagaagctccctgaagtaa

SEQ ID NO: 4751631 - DNA, 18 bp, Homo sapiens
tggagactcctaggcagg

SEQ ID NO: 4751632 - DNA, 19 bp, Homo sapiens
tggagactcctaggcagga

SEQ ID NO: 4751633 - DNA, 20 bp, Homo sapiens
tggagagccagaacctggag

SEQ ID NO: 4751634 - DNA, 19 bp, Homo sapiens
tggagagctagaacctgga

SEQ ID NO: 4751635 - DNA, 22 bp, Homo sapiens
tggagagctagaacctggagag

SEQ ID NO: 4751636 - DNA, 18 bp, Homo sapiens
tggagaggatttgatttc

SEQ ID NO: 4751637 - DNA, 24 bp, Homo sapiens
tggagagggctacaaaggaggaca

SEQ ID NO: 4751638 - DNA, 16 bp, Homo sapiens
tggagatagggaaaga

SEQ ID NO: 4751639 - DNA, 15 bp, Homo sapiens
tggagcccagaggag

SEQ ID NO: 4751640 - DNA, 21 bp, Homo sapiens
tggagcttcatggcagaaggc

SEQ ID NO: 4751641 - DNA, 20 bp, Homo sapiens
tggaggaaggaaacccagct

SEQ ID NO: 4751642 - DNA, 19 bp, Homo sapiens
tggaggactagaacctgga

SEQ ID NO: 4751643 - DNA, 14 bp, Homo sapiens
tggaggagcaaagg

SEQ ID NO: 4751644 - DNA, 20 bp, Homo sapiens
tggaggagcaaaggctgaga

SEQ ID NO: 4751645 - DNA, 21 bp, Homo sapiens
tggaggagcagtgcaggcaca

SEQ ID NO: 4751646 - DNA, 20 bp, Homo sapiens
tggagggctagaacctggag

SEQ ID NO: 4751647 - DNA, 22 bp, Homo sapiens
tggagggctagaacctggagaa

SEQ ID NO: 4751648 - DNA, 21 bp, Homo sapiens
tggagggctagaactggagag

SEQ ID NO: 4751649 - DNA, 22 bp, Homo sapiens
tggagggctagaatctggagag

SEQ ID NO: 4751650 - DNA, 16 bp, Homo sapiens
tggaggggtgttgtat

SEQ ID NO: 4751651 - DNA, 15 bp, Homo sapiens
tggagtcatgccaag

SEQ ID NO: 4751652 - DNA, 13 bp, Homo sapiens
tggagtcccagag

SEQ ID NO: 4751653 - DNA, 16 bp, Homo sapiens
tggagtcccagagctg

SEQ ID NO: 4751654 - DNA, 12 bp, Homo sapiens
tggagtgtgtaa

SEQ ID NO: 4751655 - DNA, 22 bp, Homo sapiens
tggagtgttccccttccactga

SEQ ID NO: 4751656 - DNA, 21 bp, Homo sapiens
tggataaatttgaactccatg

SEQ ID NO: 4751657 - DNA, 19 bp, Homo sapiens
tggatatttgatatttggt

SEQ ID NO: 4751658 - DNA, 15 bp, Homo sapiens
tggatcacaaagtgg

SEQ ID NO: 4751659 - DNA, 15 bp, Homo sapiens
tggatgattcttcca

SEQ ID NO: 4751660 - DNA, 21 bp, Homo sapiens
tggatgcagcctcacagtcct

SEQ ID NO: 4751661 - DNA, 22 bp, Homo sapiens
tggatgcagcctcacagtcctt

SEQ ID NO: 4751662 - DNA, 13 bp, Homo sapiens
tggatgcctgatt

SEQ ID NO: 4751663 - DNA, 14 bp, Homo sapiens
tggatgcctggtgg

SEQ ID NO: 4751664 - DNA, 15 bp, Homo sapiens
tggatgcctggtggc

SEQ ID NO: 4751665 - DNA, 20 bp, Homo sapiens
tggatgcctggtggcagctg

SEQ ID NO: 4751666 - DNA, 21 bp, Homo sapiens
tggatgcctggtggcagctgc

SEQ ID NO: 4751667 - DNA, 15 bp, Homo sapiens
tggatgggggctctg

SEQ ID NO: 4751668 - DNA, 16 bp, Homo sapiens
tggatgggggctctgc

SEQ ID NO: 4751669 - DNA, 12 bp, Homo sapiens
tggatggtgact

SEQ ID NO: 4751670 - DNA, 14 bp, Homo sapiens
tggatggtgacttt

SEQ ID NO: 4751671 - DNA, 15 bp, Homo sapiens
tggattatttaataa

SEQ ID NO: 4751672 - DNA, 20 bp, Homo sapiens
tggattggagatagggaaag

SEQ ID NO: 4751673 - DNA, 17 bp, Homo sapiens
tggattggattatttaa

SEQ ID NO: 4751674 - DNA, 20 bp, Homo sapiens
tggatttaaaagcctgctca

SEQ ID NO: 4751675 - DNA, 18 bp, Homo sapiens
tggatttaatccattttt

SEQ ID NO: 4751676 - DNA, 16 bp, Homo sapiens
tggatttcttagagat

SEQ ID NO: 4751677 - DNA, 13 bp, Homo sapiens
tggatttttgtta

SEQ ID NO: 4751678 - DNA, 17 bp, Homo sapiens
tggcaaacatgtgcaac

SEQ ID NO: 4751679 - DNA, 13 bp, Homo sapiens
tggcaaattaaac

SEQ ID NO: 4751680 - DNA, 20 bp, Homo sapiens
tggcaacagaaaacaattgt

SEQ ID NO: 4751681 - DNA, 16 bp, Homo sapiens
tggcaaggctgtgctc

SEQ ID NO: 4751682 - DNA, 23 bp, Homo sapiens
tggcaaggctgtgctccctggtt

SEQ ID NO: 4751683 - DNA, 19 bp, Homo sapiens
tggcaatgactcaaagtct

SEQ ID NO: 4751684 - DNA, 19 bp, Homo sapiens
tggcaatgccatcatctcc

SEQ ID NO: 4751685 - DNA, 15 bp, Homo sapiens
tggcacccggcccct

SEQ ID NO: 4751686 - DNA, 18 bp, Homo sapiens
tggcacccggcccctgct

SEQ ID NO: 4751687 - DNA, 19 bp, Homo sapiens
tggcacccggcccctgctg

SEQ ID NO: 4751688 - DNA, 21 bp, Homo sapiens
tggcacccggcccctgctggt

SEQ ID NO: 4751689 - DNA, 13 bp, Homo sapiens
tggcactgccatg

SEQ ID NO: 4751690 - DNA, 16 bp, Homo sapiens
tggcactgcttccagt

SEQ ID NO: 4751691 - DNA, 18 bp, Homo sapiens
tggcactgcttccagtga

SEQ ID NO: 4751692 - DNA, 22 bp, Homo sapiens
tggcactgcttccagtgaggct

SEQ ID NO: 4751693 - DNA, 14 bp, Homo sapiens
tggcagaagacacc

SEQ ID NO: 4751694 - DNA, 20 bp, Homo sapiens
tggcagcaggtgctgctacc

SEQ ID NO: 4751695 - DNA, 15 bp, Homo sapiens
tggcagctcacctct

SEQ ID NO: 4751696 - DNA, 19 bp, Homo sapiens
tggcagctcacctctccct

SEQ ID NO: 4751697 - DNA, 22 bp, Homo sapiens
tggcagctcacctctcccttgg

SEQ ID NO: 4751698 - DNA, 17 bp, Homo sapiens
tggcagctgcggtccac

SEQ ID NO: 4751699 - DNA, 22 bp, Homo sapiens
tggcagctgcggtccacccagg

SEQ ID NO: 4751700 - DNA, 11 bp, Homo sapiens
tggcaggactt

SEQ ID NO: 4751701 - DNA, 15 bp, Homo sapiens
tggcaggagggcagt

SEQ ID NO: 4751702 - DNA, 18 bp, Homo sapiens
tggcaggatggcctggcc

SEQ ID NO: 4751703 - DNA, 19 bp, Homo sapiens
tggcagtgggaaaaatgta

SEQ ID NO: 4751704 - DNA, 18 bp, Homo sapiens
tggcatctaattcttatt

SEQ ID NO: 4751705 - DNA, 14 bp, Homo sapiens
tggcatggccacca

SEQ ID NO: 4751706 - DNA, 21 bp, Homo sapiens
tggcattggcagcaggtgctg

SEQ ID NO: 4751707 - DNA, 15 bp, Homo sapiens
tggccagatgcacca

SEQ ID NO: 4751708 - DNA, 17 bp, Homo sapiens
tggccagatgcaccagc

SEQ ID NO: 4751709 - DNA, 21 bp, Homo sapiens
tggccagatgcaccagccctt

SEQ ID NO: 4751710 - DNA, 17 bp, Homo sapiens
tggccagatgtcgctgg

SEQ ID NO: 4751711 - DNA, 17 bp, Homo sapiens
tggccaggctgctcttg

SEQ ID NO: 4751712 - DNA, 15 bp, Homo sapiens
tggccaggctggtct

SEQ ID NO: 4751713 - DNA, 17 bp, Homo sapiens
tggccaggctggtctca

SEQ ID NO: 4751714 - DNA, 16 bp, Homo sapiens
tggccatctctggatg

SEQ ID NO: 4751715 - DNA, 16 bp, Homo sapiens
tggccatcttaaaaag

SEQ ID NO: 4751716 - DNA, 17 bp, Homo sapiens
tggccattctattgtgg

SEQ ID NO: 4751717 - DNA, 19 bp, Homo sapiens
tggcccaccccacccactt

SEQ ID NO: 4751718 - DNA, 12 bp, Homo sapiens
tggcccatcagt

SEQ ID NO: 4751719 - DNA, 22 bp, Homo sapiens
tggcccatcagtgtacccccgc

SEQ ID NO: 4751720 - DNA, 23 bp, Homo sapiens
tggcccatcagtgtacccccgcc

SEQ ID NO: 4751721 - DNA, 17 bp, Homo sapiens
tggcccatcccccctca

SEQ ID NO: 4751722 - DNA, 13 bp, Homo sapiens
tggccccagcctg

SEQ ID NO: 4751723 - DNA, 16 bp, Homo sapiens
tggccccagcctggcc

SEQ ID NO: 4751724 - DNA, 22 bp, Homo sapiens
tggccccagcctggcccagctc

SEQ ID NO: 4751725 - DNA, 21 bp, Homo sapiens
tggcccctcagggtccctggt

SEQ ID NO: 4751726 - DNA, 14 bp, Homo sapiens
tggcccctgcccgg

SEQ ID NO: 4751727 - DNA, 18 bp, Homo sapiens
tggccctcaaggcctccc

SEQ ID NO: 4751728 - DNA, 23 bp, Homo sapiens
tggccctcaaggcctcccacagt

SEQ ID NO: 4751729 - DNA, 17 bp, Homo sapiens
tggccctctcccctgcc

SEQ ID NO: 4751730 - DNA, 19 bp, Homo sapiens
tggccctctcccctgcccc

SEQ ID NO: 4751731 - DNA, 12 bp, Homo sapiens
tggccctgccct

SEQ ID NO: 4751732 - DNA, 21 bp, Homo sapiens
tggccgcgccaaataatgtct

SEQ ID NO: 4751733 - DNA, 15 bp, Homo sapiens
tggccgggaccccga

SEQ ID NO: 4751734 - DNA, 19 bp, Homo sapiens
tggccgttgatgttggctg

SEQ ID NO: 4751735 - DNA, 22 bp, Homo sapiens
tggcctcattactttaccaccc

SEQ ID NO: 4751736 - DNA, 11 bp, Homo sapiens
tggcctcccaa

SEQ ID NO: 4751737 - DNA, 20 bp, Homo sapiens
tggcctcccaactcacccca

SEQ ID NO: 4751738 - DNA, 15 bp, Homo sapiens
tggcctcccccactt

SEQ ID NO: 4751739 - DNA, 16 bp, Homo sapiens
tggcctcgcctggcct

SEQ ID NO: 4751740 - DNA, 14 bp, Homo sapiens
tggcctctgcactc

SEQ ID NO: 4751741 - DNA, 15 bp, Homo sapiens
tggcctctgcactcc

SEQ ID NO: 4751742 - DNA, 18 bp, Homo sapiens
tggcctctgcactcccct

SEQ ID NO: 4751743 - DNA, 12 bp, Homo sapiens
tggcctggcccc

SEQ ID NO: 4751744 - DNA, 18 bp, Homo sapiens
tggcctggcccctcaggg

SEQ ID NO: 4751745 - DNA, 23 bp, Homo sapiens
tggcctgttttagaaggttctct

SEQ ID NO: 4751746 - DNA, 15 bp, Homo sapiens
tggcctttacagaaa

SEQ ID NO: 4751747 - DNA, 17 bp, Homo sapiens
tggcgagaggaggggcc

SEQ ID NO: 4751748 - DNA, 22 bp, Homo sapiens
tggcgtgcagtggtgcgatctg

SEQ ID NO: 4751749 - DNA, 16 bp, Homo sapiens
tggctatcaaaagaaa

SEQ ID NO: 4751750 - DNA, 22 bp, Homo sapiens
tggctattagagatcaacccct

SEQ ID NO: 4751751 - DNA, 16 bp, Homo sapiens
tggctcacactgagaa

SEQ ID NO: 4751752 - DNA, 18 bp, Homo sapiens
tggctcactatggtgcca

SEQ ID NO: 4751753 - DNA, 16 bp, Homo sapiens
tggctccaaaccctcg

SEQ ID NO: 4751754 - DNA, 20 bp, Homo sapiens
tggctccaaaccctcgaggc

SEQ ID NO: 4751755 - DNA, 21 bp, Homo sapiens
tggctccctgggggcggccag

SEQ ID NO: 4751756 - DNA, 15 bp, Homo sapiens
tggctcttccaggct

SEQ ID NO: 4751757 - DNA, 16 bp, Homo sapiens
tggctcttccaggctg

SEQ ID NO: 4751758 - DNA, 20 bp, Homo sapiens
tggctcttccaggctgggag

SEQ ID NO: 4751759 - DNA, 20 bp, Homo sapiens
tggctgaagacttttgttat

SEQ ID NO: 4751760 - DNA, 13 bp, Homo sapiens
tggctgaaggact

SEQ ID NO: 4751761 - DNA, 14 bp, Homo sapiens
tggctgaaggactg

SEQ ID NO: 4751762 - DNA, 15 bp, Homo sapiens
tggctgaaggactgt

SEQ ID NO: 4751763 - DNA, 13 bp, Homo sapiens
tggctgcagggag

SEQ ID NO: 4751764 - DNA, 18 bp, Homo sapiens
tggctgcctccactccca

SEQ ID NO: 4751765 - DNA, 20 bp, Homo sapiens
tggctgcctccactcccact

SEQ ID NO: 4751766 - DNA, 11 bp, Homo sapiens
tggctgctgaa

SEQ ID NO: 4751767 - DNA, 16 bp, Homo sapiens
tggctgctgaaggctc

SEQ ID NO: 4751768 - DNA, 15 bp, Homo sapiens
tggctgggaactcac

SEQ ID NO: 4751769 - DNA, 14 bp, Homo sapiens
tggctgggggcctc

SEQ ID NO: 4751770 - DNA, 14 bp, Homo sapiens
tggctggtgcctga

SEQ ID NO: 4751771 - DNA, 15 bp, Homo sapiens
tggctggtgcctgaa

SEQ ID NO: 4751772 - DNA, 22 bp, Homo sapiens
tggctggttagaggttcccttt

SEQ ID NO: 4751773 - DNA, 12 bp, Homo sapiens
tggctgtccagt

SEQ ID NO: 4751774 - DNA, 12 bp, Homo sapiens
tggctgtgacaa

SEQ ID NO: 4751775 - DNA, 13 bp, Homo sapiens
tggctgttggctg

SEQ ID NO: 4751776 - DNA, 15 bp, Homo sapiens
tggctgttggctggg

SEQ ID NO: 4751777 - DNA, 16 bp, Homo sapiens
tggctttgttcttgtc

SEQ ID NO: 4751778 - DNA, 17 bp, Homo sapiens
tgggaaaaatgtaggag

SEQ ID NO: 4751779 - DNA, 16 bp, Homo sapiens
tgggaaaggggaagtt

SEQ ID NO: 4751780 - DNA, 14 bp, Homo sapiens
tgggacaccctgtg

SEQ ID NO: 4751781 - DNA, 18 bp, Homo sapiens
tgggacggctgagctggg

SEQ ID NO: 4751782 - DNA, 14 bp, Homo sapiens
tgggactacaggca

SEQ ID NO: 4751783 - DNA, 20 bp, Homo sapiens
tgggactcaatgcactgaca

SEQ ID NO: 4751784 - DNA, 22 bp, Homo sapiens
tgggagaaagaccatgcattta

SEQ ID NO: 4751785 - DNA, 18 bp, Homo sapiens
tgggagactgctgagtca

SEQ ID NO: 4751786 - DNA, 20 bp, Homo sapiens
tgggagagacttggatgagg

SEQ ID NO: 4751787 - DNA, 23 bp, Homo sapiens
tgggagagacttggatgaggagt

SEQ ID NO: 4751788 - DNA, 16 bp, Homo sapiens
tgggagagccttccag

SEQ ID NO: 4751789 - DNA, 15 bp, Homo sapiens
tgggagatgaaaacc

SEQ ID NO: 4751790 - DNA, 23 bp, Homo sapiens
tgggagatgaaaacctgcatttt

SEQ ID NO: 4751791 - DNA, 23 bp, Homo sapiens
tgggagccgggtctgcctcttct

SEQ ID NO: 4751792 - DNA, 13 bp, Homo sapiens
tgggagctgcctg

SEQ ID NO: 4751793 - DNA, 13 bp, Homo sapiens
tgggaggctcacc

SEQ ID NO: 4751794 - DNA, 22 bp, Homo sapiens
tgggaggctcacccccttctcc

SEQ ID NO: 4751795 - DNA, 14 bp, Homo sapiens
tgggagggcagcag

SEQ ID NO: 4751796 - DNA, 18 bp, Homo sapiens
tgggagggcagcagggct

SEQ ID NO: 4751797 - DNA, 14 bp, Homo sapiens
tgggagtacaaaag

SEQ ID NO: 4751798 - DNA, 14 bp, Homo sapiens
tgggagtgggccca

SEQ ID NO: 4751799 - DNA, 22 bp, Homo sapiens
tgggagttgatcgcctttccca

SEQ ID NO: 4751800 - DNA, 13 bp, Homo sapiens
tgggatctgcccc

SEQ ID NO: 4751801 - DNA, 18 bp, Homo sapiens
tgggatctgcccctccct

SEQ ID NO: 4751802 - DNA, 19 bp, Homo sapiens
tgggatctgcccctccctg

SEQ ID NO: 4751803 - DNA, 17 bp, Homo sapiens
tgggatggtggagggcc

SEQ ID NO: 4751804 - DNA, 14 bp, Homo sapiens
tgggatgtttctgt

SEQ ID NO: 4751805 - DNA, 16 bp, Homo sapiens
tgggattacaggtgtg

SEQ ID NO: 4751806 - DNA, 17 bp, Homo sapiens
tgggattacaggtgtga

SEQ ID NO: 4751807 - DNA, 15 bp, Homo sapiens
tgggattgtgttaaa

SEQ ID NO: 4751808 - DNA, 15 bp, Homo sapiens
tgggcaactggctga

SEQ ID NO: 4751809 - DNA, 23 bp, Homo sapiens
tgggcactgctgggtggcccatc

SEQ ID NO: 4751810 - DNA, 23 bp, Homo sapiens
tgggcagagcagagaccatccct

SEQ ID NO: 4751811 - DNA, 15 bp, Homo sapiens
tgggcagatctaccc

SEQ ID NO: 4751812 - DNA, 21 bp, Homo sapiens
tgggcagatctaccccttact

SEQ ID NO: 4751813 - DNA, 17 bp, Homo sapiens
tgggcaggactcagctc

SEQ ID NO: 4751814 - DNA, 18 bp, Homo sapiens
tgggcaggactcagctcc

SEQ ID NO: 4751815 - DNA, 23 bp, Homo sapiens
tgggcaggactcagctccccaga

SEQ ID NO: 4751816 - DNA, 22 bp, Homo sapiens
tgggccacttctgggtggggca

SEQ ID NO: 4751817 - DNA, 15 bp, Homo sapiens
tgggccatactggcc

SEQ ID NO: 4751818 - DNA, 20 bp, Homo sapiens
tgggcccaatgcactttgtt

SEQ ID NO: 4751819 - DNA, 21 bp, Homo sapiens
tgggcccccaaatggaaatgg

SEQ ID NO: 4751820 - DNA, 18 bp, Homo sapiens
tgggccctctctgctctg

SEQ ID NO: 4751821 - DNA, 14 bp, Homo sapiens
tgggcctcctgtgt

SEQ ID NO: 4751822 - DNA, 16 bp, Homo sapiens
tgggcctcctgtgtgt

SEQ ID NO: 4751823 - DNA, 22 bp, Homo sapiens
tgggcctcctgtgtgtgcgcct

SEQ ID NO: 4751824 - DNA, 18 bp, Homo sapiens
tgggccttcagggagtga

SEQ ID NO: 4751825 - DNA, 19 bp, Homo sapiens
tgggcgggcagcacagcaa

SEQ ID NO: 4751826 - DNA, 22 bp, Homo sapiens
tgggctaagtgatcctcccacc

SEQ ID NO: 4751827 - DNA, 14 bp, Homo sapiens
tgggctcccttccc

SEQ ID NO: 4751828 - DNA, 16 bp, Homo sapiens
tgggctgagggagcct

SEQ ID NO: 4751829 - DNA, 17 bp, Homo sapiens
tgggctgcactctgtgc

SEQ ID NO: 4751830 - DNA, 18 bp, Homo sapiens
tgggctgcactctgtgcc

SEQ ID NO: 4751831 - DNA, 21 bp, Homo sapiens
tgggctgcactctgtgcccat

SEQ ID NO: 4751832 - DNA, 17 bp, Homo sapiens
tgggctggtgtcacctg

SEQ ID NO: 4751833 - DNA, 21 bp, Homo sapiens
tgggcttcagtggcagctgct

SEQ ID NO: 4751834 - DNA, 24 bp, Homo sapiens
tggggaagacccattccttcccag

SEQ ID NO: 4751835 - DNA, 15 bp, Homo sapiens
tggggaggggctgtg

SEQ ID NO: 4751836 - DNA, 15 bp, Homo sapiens
tggggatgagaaagg

SEQ ID NO: 4751837 - DNA, 20 bp, Homo sapiens
tggggccagttggtccccct

SEQ ID NO: 4751838 - DNA, 21 bp, Homo sapiens
tggggccagttggtccccctt

SEQ ID NO: 4751839 - DNA, 14 bp, Homo sapiens
tggggccctgcctc

SEQ ID NO: 4751840 - DNA, 20 bp, Homo sapiens
tggggcctatcagtgtgccc

SEQ ID NO: 4751841 - DNA, 22 bp, Homo sapiens
tggggcctatcagtgtgccccc

SEQ ID NO: 4751842 - DNA, 18 bp, Homo sapiens
tgggggaagagcacagcc

SEQ ID NO: 4751843 - DNA, 21 bp, Homo sapiens
tgggggaagagcacagccctc

SEQ ID NO: 4751844 - DNA, 14 bp, Homo sapiens
tgggggctcagcca

SEQ ID NO: 4751845 - DNA, 16 bp, Homo sapiens
tgggggctcagccagg

SEQ ID NO: 4751846 - DNA, 14 bp, Homo sapiens
tgggggctctgcac

SEQ ID NO: 4751847 - DNA, 21 bp, Homo sapiens
tggggtaccaagagactcctt

SEQ ID NO: 4751848 - DNA, 22 bp, Homo sapiens
tggggtaccagccactggaggg

SEQ ID NO: 4751849 - DNA, 15 bp, Homo sapiens
tggggtacccactgc

SEQ ID NO: 4751850 - DNA, 17 bp, Homo sapiens
tggggtacccactgctc

SEQ ID NO: 4751851 - DNA, 15 bp, Homo sapiens
tggggttcggcctgt

SEQ ID NO: 4751852 - DNA, 17 bp, Homo sapiens
tggggttcggcctgtgt

SEQ ID NO: 4751853 - DNA, 21 bp, Homo sapiens
tgggtagaaagagatacagag

SEQ ID NO: 4751854 - DNA, 13 bp, Homo sapiens
tgggtcaaggaat

SEQ ID NO: 4751855 - DNA, 14 bp, Homo sapiens
tgggtccaagtggc

SEQ ID NO: 4751856 - DNA, 19 bp, Homo sapiens
tgggtcccacttcccctcc

SEQ ID NO: 4751857 - DNA, 19 bp, Homo sapiens
tgggtcgggagaggggacg

SEQ ID NO: 4751858 - DNA, 14 bp, Homo sapiens
tgggtcttatgctt

SEQ ID NO: 4751859 - DNA, 19 bp, Homo sapiens
tgggtgcgaccccatctgc

SEQ ID NO: 4751860 - DNA, 23 bp, Homo sapiens
tgggtggatgcctggtggcagct

SEQ ID NO: 4751861 - DNA, 15 bp, Homo sapiens
tgggtggcactgcca

SEQ ID NO: 4751862 - DNA, 13 bp, Homo sapiens
tgggtgggccctg

SEQ ID NO: 4751863 - DNA, 21 bp, Homo sapiens
tgggtgtcaagagggtctgag

SEQ ID NO: 4751864 - DNA, 16 bp, Homo sapiens
tgggttagggaaaaca

SEQ ID NO: 4751865 - DNA, 19 bp, Homo sapiens
tgggttagggaaaacattc

SEQ ID NO: 4751866 - DNA, 17 bp, Homo sapiens
tgggttggaaaacagta

SEQ ID NO: 4751867 - DNA, 17 bp, Homo sapiens
tgggttggcgcaccctc

SEQ ID NO: 4751868 - DNA, 16 bp, Homo sapiens
tgggtttacaacaaac

SEQ ID NO: 4751869 - DNA, 23 bp, Homo sapiens
tgggtttcccttgccctttccat

SEQ ID NO: 4751870 - DNA, 16 bp, Homo sapiens
tggtactaaggagaat

SEQ ID NO: 4751871 - DNA, 18 bp, Homo sapiens
tggtaggactgtagaaaa

SEQ ID NO: 4751872 - DNA, 14 bp, Homo sapiens
tggtatagaaatgc

SEQ ID NO: 4751873 - DNA, 16 bp, Homo sapiens
tggtatagaaatgctg

SEQ ID NO: 4751874 - DNA, 22 bp, Homo sapiens
tggtatagaaatgctggttttt

SEQ ID NO: 4751875 - DNA, 20 bp, Homo sapiens
tggtatctaattctttaatg

SEQ ID NO: 4751876 - DNA, 18 bp, Homo sapiens
tggtatgatcacggctca

SEQ ID NO: 4751877 - DNA, 19 bp, Homo sapiens
tggtatgttgggataagga

SEQ ID NO: 4751878 - DNA, 16 bp, Homo sapiens
tggtattcctgcctcc

SEQ ID NO: 4751879 - DNA, 14 bp, Homo sapiens
tggtcaacatttct

SEQ ID NO: 4751880 - DNA, 15 bp, Homo sapiens
tggtcagccctaggg

SEQ ID NO: 4751881 - DNA, 16 bp, Homo sapiens
tggtccatagagagca

SEQ ID NO: 4751882 - DNA, 13 bp, Homo sapiens
tggtcccacccca

SEQ ID NO: 4751883 - DNA, 16 bp, Homo sapiens
tggtcccaccccacac

SEQ ID NO: 4751884 - DNA, 15 bp, Homo sapiens
tggtcccccttccat

SEQ ID NO: 4751885 - DNA, 16 bp, Homo sapiens
tggtcccccttccatg

SEQ ID NO: 4751886 - DNA, 15 bp, Homo sapiens
tggtcctgctgcagt

SEQ ID NO: 4751887 - DNA, 23 bp, Homo sapiens
tggtcctgctgcagttgccagtc

SEQ ID NO: 4751888 - DNA, 14 bp, Homo sapiens
tggtctaatgtttg

SEQ ID NO: 4751889 - DNA, 15 bp, Homo sapiens
tggtctacactgtgc

SEQ ID NO: 4751890 - DNA, 19 bp, Homo sapiens
tggtctacactgtgctgag

SEQ ID NO: 4751891 - DNA, 23 bp, Homo sapiens
tggtctcaaactcttgacctcag

SEQ ID NO: 4751892 - DNA, 19 bp, Homo sapiens
tggtctcgaactcctgacc

SEQ ID NO: 4751893 - DNA, 20 bp, Homo sapiens
tggtctcgaactcctgacct

SEQ ID NO: 4751894 - DNA, 18 bp, Homo sapiens
tggtctctaggctgggga

SEQ ID NO: 4751895 - DNA, 19 bp, Homo sapiens
tggtctctaggctggggaa

SEQ ID NO: 4751896 - DNA, 18 bp, Homo sapiens
tggtctgctcgggcccag

SEQ ID NO: 4751897 - DNA, 14 bp, Homo sapiens
tggtctttgtaaga

SEQ ID NO: 4751898 - DNA, 15 bp, Homo sapiens
tggtctttgtaagag

SEQ ID NO: 4751899 - DNA, 17 bp, Homo sapiens
tggtgacctctgcctga

SEQ ID NO: 4751900 - DNA, 22 bp, Homo sapiens
tggtgacctctgcctgaagtca

SEQ ID NO: 4751901 - DNA, 14 bp, Homo sapiens
tggtgacttttgaa

SEQ ID NO: 4751902 - DNA, 17 bp, Homo sapiens
tggtgacttttgaagaa

SEQ ID NO: 4751903 - DNA, 18 bp, Homo sapiens
tggtgccacaaataaaat

SEQ ID NO: 4751904 - DNA, 16 bp, Homo sapiens
tggtgcgatctgggtt

SEQ ID NO: 4751905 - DNA, 13 bp, Homo sapiens
tggtggagggcca

SEQ ID NO: 4751906 - DNA, 23 bp, Homo sapiens
tggtggatggtgacttttgaaga

SEQ ID NO: 4751907 - DNA, 16 bp, Homo sapiens
tggtggcagctcacct

SEQ ID NO: 4751908 - DNA, 23 bp, Homo sapiens
tggtggcagctcacctctccctt

SEQ ID NO: 4751909 - DNA, 14 bp, Homo sapiens
tggtggcagctgcg

SEQ ID NO: 4751910 - DNA, 20 bp, Homo sapiens
tggtggctttttttaaaatt

SEQ ID NO: 4751911 - DNA, 15 bp, Homo sapiens
tggtgtaataagaca

SEQ ID NO: 4751912 - DNA, 19 bp, Homo sapiens
tggtgtaataagacataac

SEQ ID NO: 4751913 - DNA, 18 bp, Homo sapiens
tggtgtgatcgtctgact

SEQ ID NO: 4751914 - DNA, 15 bp, Homo sapiens
tggtgtgtgtctctg

SEQ ID NO: 4751915 - DNA, 23 bp, Homo sapiens
tggtgttccattgcctcttttca

SEQ ID NO: 4751916 - DNA, 17 bp, Homo sapiens
tggtgttggcagtgttt

SEQ ID NO: 4751917 - DNA, 15 bp, Homo sapiens
tggtgtttcctggca

SEQ ID NO: 4751918 - DNA, 20 bp, Homo sapiens
tggttcagggttggcccctg

SEQ ID NO: 4751919 - DNA, 22 bp, Homo sapiens
tggttcagggttggcccctgcc

SEQ ID NO: 4751920 - DNA, 14 bp, Homo sapiens
tggttctcatcttt

SEQ ID NO: 4751921 - DNA, 17 bp, Homo sapiens
tggttctcatctttctt

SEQ ID NO: 4751922 - DNA, 16 bp, Homo sapiens
tggttggctggccttc

SEQ ID NO: 4751923 - DNA, 14 bp, Homo sapiens
tggtttatattctt

SEQ ID NO: 4751924 - DNA, 20 bp, Homo sapiens
tggtttcaccatccttagac

SEQ ID NO: 4751925 - DNA, 20 bp, Homo sapiens
tggtttcagttctgtgtaca

SEQ ID NO: 4751926 - DNA, 12 bp, Homo sapiens
tggtttcctgcc

SEQ ID NO: 4751927 - DNA, 13 bp, Homo sapiens
tggtttcctgccc

SEQ ID NO: 4751928 - DNA, 20 bp, Homo sapiens
tggtttggccatctctggat

SEQ ID NO: 4751929 - DNA, 23 bp, Homo sapiens
tggtttggcccttctccttttga

SEQ ID NO: 4751930 - DNA, 16 bp, Homo sapiens
tggtttttcagttttc

SEQ ID NO: 4751931 - DNA, 14 bp, Homo sapiens
tggtttttgttgag

SEQ ID NO: 4751932 - DNA, 15 bp, Homo sapiens
tggtttttgttgagt

SEQ ID NO: 4751933 - DNA, 18 bp, Homo sapiens
tgtaaaaatacactaatg

SEQ ID NO: 4751934 - DNA, 23 bp, Homo sapiens
tgtaaaagaaaattttttttcaa

SEQ ID NO: 4751935 - DNA, 14 bp, Homo sapiens
tgtaaaatcttcag

SEQ ID NO: 4751936 - DNA, 15 bp, Homo sapiens
tgtaaaatcttcagc

SEQ ID NO: 4751937 - DNA, 19 bp, Homo sapiens
tgtaaacataccaacatgt

SEQ ID NO: 4751938 - DNA, 19 bp, Homo sapiens
tgtaaataaagaactagca

SEQ ID NO: 4751939 - DNA, 16 bp, Homo sapiens
tgtaaatagctcaggt

SEQ ID NO: 4751940 - DNA, 19 bp, Homo sapiens
tgtaaatccagtgttacaa

SEQ ID NO: 4751941 - DNA, 16 bp, Homo sapiens
tgtaaatctgaagaaa

SEQ ID NO: 4751942 - DNA, 14 bp, Homo sapiens
tgtaacaagccacc

SEQ ID NO: 4751943 - DNA, 17 bp, Homo sapiens
tgtaacaagccacccca

SEQ ID NO: 4751944 - DNA, 21 bp, Homo sapiens
tgtaactgtttagatgaatgt

SEQ ID NO: 4751945 - DNA, 19 bp, Homo sapiens
tgtaacttccaaataaata

SEQ ID NO: 4751946 - DNA, 13 bp, Homo sapiens
tgtaagaaaacaa

SEQ ID NO: 4751947 - DNA, 20 bp, Homo sapiens
tgtaagagtgtagaagcatt

SEQ ID NO: 4751948 - DNA, 21 bp, Homo sapiens
tgtaagcttagattttctgta

SEQ ID NO: 4751949 - DNA, 22 bp, Homo sapiens
tgtaagcttagattttctgtaa

SEQ ID NO: 4751950 - DNA, 13 bp, Homo sapiens
tgtaataaatact

SEQ ID NO: 4751951 - DNA, 20 bp, Homo sapiens
tgtaatagaataaaggcctg

SEQ ID NO: 4751952 - DNA, 18 bp, Homo sapiens
tgtaatattctctgatgt

SEQ ID NO: 4751953 - DNA, 13 bp, Homo sapiens
tgtaatattgtaa

SEQ ID NO: 4751954 - DNA, 20 bp, Homo sapiens
tgtaatattgtaaatactgg

SEQ ID NO: 4751955 - DNA, 13 bp, Homo sapiens
tgtaatcccagca

SEQ ID NO: 4751956 - DNA, 21 bp, Homo sapiens
tgtaatcttgaattgtaactg

SEQ ID NO: 4751957 - DNA, 19 bp, Homo sapiens
tgtaatgaaccgctgaata

SEQ ID NO: 4751958 - DNA, 15 bp, Homo sapiens
tgtaatgcttatgtg

SEQ ID NO: 4751959 - DNA, 11 bp, Homo sapiens
tgtacaaaagc

SEQ ID NO: 4751960 - DNA, 14 bp, Homo sapiens
tgtacaattaagtt

SEQ ID NO: 4751961 - DNA, 11 bp, Homo sapiens
tgtacagagcc

SEQ ID NO: 4751962 - DNA, 12 bp, Homo sapiens
tgtacagagccc

SEQ ID NO: 4751963 - DNA, 17 bp, Homo sapiens
tgtacagagcccacgcc

SEQ ID NO: 4751964 - DNA, 21 bp, Homo sapiens
tgtacagagcccacgccccca

SEQ ID NO: 4751965 - DNA, 22 bp, Homo sapiens
tgtacagtctcaattttgtatt

SEQ ID NO: 4751966 - DNA, 15 bp, Homo sapiens
tgtacagtcttgtat

SEQ ID NO: 4751967 - DNA, 21 bp, Homo sapiens
tgtacagtcttgtattaagtt

SEQ ID NO: 4751968 - DNA, 13 bp, Homo sapiens
tgtacataaaatt

SEQ ID NO: 4751969 - DNA, 18 bp, Homo sapiens
tgtacataaaattttcta

SEQ ID NO: 4751970 - DNA, 22 bp, Homo sapiens
tgtacataaaattttctagaaa

SEQ ID NO: 4751971 - DNA, 15 bp, Homo sapiens
tgtacattctaaaat

SEQ ID NO: 4751972 - DNA, 20 bp, Homo sapiens
tgtacattttaaaggataat

SEQ ID NO: 4751973 - DNA, 14 bp, Homo sapiens
tgtacccccgccca

SEQ ID NO: 4751974 - DNA, 17 bp, Homo sapiens
tgtacccccgcccaggc

SEQ ID NO: 4751975 - DNA, 18 bp, Homo sapiens
tgtacctaatccaaatat

SEQ ID NO: 4751976 - DNA, 21 bp, Homo sapiens
tgtacctaatccaaatatcat

SEQ ID NO: 4751977 - DNA, 18 bp, Homo sapiens
tgtacctgcccccaatcc

SEQ ID NO: 4751978 - DNA, 15 bp, Homo sapiens
tgtacgtctgacagg

SEQ ID NO: 4751979 - DNA, 16 bp, Homo sapiens
tgtacgtctgacaggc

SEQ ID NO: 4751980 - DNA, 14 bp, Homo sapiens
tgtactctgtgtgt

SEQ ID NO: 4751981 - DNA, 15 bp, Homo sapiens
tgtactttgcttctt

SEQ ID NO: 4751982 - DNA, 19 bp, Homo sapiens
tgtagaaaagggaactgaa

SEQ ID NO: 4751983 - DNA, 22 bp, Homo sapiens
tgtagaagcattccttctttga

SEQ ID NO: 4751984 - DNA, 14 bp, Homo sapiens
tgtagaatatggct

SEQ ID NO: 4751985 - DNA, 16 bp, Homo sapiens
tgtagagccagggtct

SEQ ID NO: 4751986 - DNA, 16 bp, Homo sapiens
tgtagcctctctttgt

SEQ ID NO: 4751987 - DNA, 23 bp, Homo sapiens
tgtaggggagccacatttacata

SEQ ID NO: 4751988 - DNA, 22 bp, Homo sapiens
tgtagtgaatcacgtaaagcta

SEQ ID NO: 4751989 - DNA, 22 bp, Homo sapiens
tgtagttgcaatagaacagaga

SEQ ID NO: 4751990 - DNA, 17 bp, Homo sapiens
tgtataccatgatgcat

SEQ ID NO: 4751991 - DNA, 15 bp, Homo sapiens
tgtatagtgccacca

SEQ ID NO: 4751992 - DNA, 14 bp, Homo sapiens
tgtatattttgtta

SEQ ID NO: 4751993 - DNA, 14 bp, Homo sapiens
tgtatccattctac

SEQ ID NO: 4751994 - DNA, 23 bp, Homo sapiens
tgtatcccatgagcctcagcatc

SEQ ID NO: 4751995 - DNA, 19 bp, Homo sapiens
tgtatcctttcacacattt

SEQ ID NO: 4751996 - DNA, 21 bp, Homo sapiens
tgtatgagaagtactttgtgc

SEQ ID NO: 4751997 - DNA, 23 bp, Homo sapiens
tgtatgagagggccctgcctgct

SEQ ID NO: 4751998 - DNA, 20 bp, Homo sapiens
tgtatgattttgatgcacaa

SEQ ID NO: 4751999 - DNA, 15 bp, Homo sapiens
tgtatggatatgtgt

SEQ ID NO: 4752000 - DNA, 15 bp, Homo sapiens
tgtatggttctgtgc

SEQ ID NO: 4752001 - DNA, 18 bp, Homo sapiens
tgtatgtctcgtggtagg

SEQ ID NO: 4752002 - DNA, 17 bp, Homo sapiens
tgtatgtggatacagtc

SEQ ID NO: 4752003 - DNA, 22 bp, Homo sapiens
tgtatgtggatacagtcattat

SEQ ID NO: 4752004 - DNA, 14 bp, Homo sapiens
tgtattaagccact

SEQ ID NO: 4752005 - DNA, 21 bp, Homo sapiens
tgtattaagttgttaataaaa

SEQ ID NO: 4752006 - DNA, 15 bp, Homo sapiens
tgtattagtcacaga

SEQ ID NO: 4752007 - DNA, 13 bp, Homo sapiens
tgtattctctgag

SEQ ID NO: 4752008 - DNA, 23 bp, Homo sapiens
tgtattgttttactcctttttat

SEQ ID NO: 4752009 - DNA, 23 bp, Homo sapiens
tgtatttaactctgtaagaaact

SEQ ID NO: 4752010 - DNA, 12 bp, Homo sapiens
tgtatttatgta

SEQ ID NO: 4752011 - DNA, 13 bp, Homo sapiens
tgtatttattaat

SEQ ID NO: 4752012 - DNA, 14 bp, Homo sapiens
tgtatttattaatt

SEQ ID NO: 4752013 - DNA, 20 bp, Homo sapiens
tgtatttgttaatggtttga

SEQ ID NO: 4752014 - DNA, 19 bp, Homo sapiens
tgtattttactaataaaat

SEQ ID NO: 4752015 - DNA, 15 bp, Homo sapiens
tgtcaactgacctaa

SEQ ID NO: 4752016 - DNA, 16 bp, Homo sapiens
tgtcaactttcatttg

SEQ ID NO: 4752017 - DNA, 17 bp, Homo sapiens
tgtcaatgagagcataa

SEQ ID NO: 4752018 - DNA, 13 bp, Homo sapiens
tgtcaatgtaaag

SEQ ID NO: 4752019 - DNA, 13 bp, Homo sapiens
tgtcacactaaaa

SEQ ID NO: 4752020 - DNA, 12 bp, Homo sapiens
tgtcacagctct

SEQ ID NO: 4752021 - DNA, 13 bp, Homo sapiens
tgtcacagctctt

SEQ ID NO: 4752022 - DNA, 14 bp, Homo sapiens
tgtcacagctcttg

SEQ ID NO: 4752023 - DNA, 18 bp, Homo sapiens
tgtcacagctcttgtttg

SEQ ID NO: 4752024 - DNA, 21 bp, Homo sapiens
tgtcacaggcaggtccagggt

SEQ ID NO: 4752025 - DNA, 13 bp, Homo sapiens
tgtcacctcaata

SEQ ID NO: 4752026 - DNA, 20 bp, Homo sapiens
tgtcacctcaatatttacta

SEQ ID NO: 4752027 - DNA, 17 bp, Homo sapiens
tgtcactgacctttgtt

SEQ ID NO: 4752028 - DNA, 22 bp, Homo sapiens
tgtcactggctgcctccactcc

SEQ ID NO: 4752029 - DNA, 15 bp, Homo sapiens
tgtcagcaaatgtaa

SEQ ID NO: 4752030 - DNA, 13 bp, Homo sapiens
tgtcaggattgcg

SEQ ID NO: 4752031 - DNA, 23 bp, Homo sapiens
tgtcaggattgcgagagatgtgt

SEQ ID NO: 4752032 - DNA, 20 bp, Homo sapiens
tgtcagtaccttcaaactag

SEQ ID NO: 4752033 - DNA, 16 bp, Homo sapiens
tgtcagtgattttgta

SEQ ID NO: 4752034 - DNA, 18 bp, Homo sapiens
tgtcataatggtgaatgt

SEQ ID NO: 4752035 - DNA, 16 bp, Homo sapiens
tgtcatcagtaagtat

SEQ ID NO: 4752036 - DNA, 13 bp, Homo sapiens
tgtcatctcagct

SEQ ID NO: 4752037 - DNA, 17 bp, Homo sapiens
tgtcatgtgtatgagaa

SEQ ID NO: 4752038 - DNA, 20 bp, Homo sapiens
tgtcatgtgtatgagaagta

SEQ ID NO: 4752039 - DNA, 18 bp, Homo sapiens
tgtcattatttgataaca

SEQ ID NO: 4752040 - DNA, 22 bp, Homo sapiens
tgtcatttgagcagggctcagc

SEQ ID NO: 4752041 - DNA, 19 bp, Homo sapiens
tgtccaaaccagcaaactt

SEQ ID NO: 4752042 - DNA, 12 bp, Homo sapiens
tgtccaaagcag

SEQ ID NO: 4752043 - DNA, 14 bp, Homo sapiens
tgtccaatcctatg

SEQ ID NO: 4752044 - DNA, 19 bp, Homo sapiens
tgtccacgactgtctccat

SEQ ID NO: 4752045 - DNA, 16 bp, Homo sapiens
tgtccagtgcccattc

SEQ ID NO: 4752046 - DNA, 18 bp, Homo sapiens
tgtccagtgcccattcct

SEQ ID NO: 4752047 - DNA, 14 bp, Homo sapiens
tgtccattgtaaat

SEQ ID NO: 4752048 - DNA, 21 bp, Homo sapiens
tgtccattgtaaatctgaaga

SEQ ID NO: 4752049 - DNA, 22 bp, Homo sapiens
tgtccattgtaaatctgaagaa

SEQ ID NO: 4752050 - DNA, 22 bp, Homo sapiens
tgtcccaagctcccaagagctt

SEQ ID NO: 4752051 - DNA, 18 bp, Homo sapiens
tgtcccagtttcccactc

SEQ ID NO: 4752052 - DNA, 12 bp, Homo sapiens
tgtccccacact

SEQ ID NO: 4752053 - DNA, 16 bp, Homo sapiens
tgtccccacactccta

SEQ ID NO: 4752054 - DNA, 16 bp, Homo sapiens
tgtccccgacccttgc

SEQ ID NO: 4752055 - DNA, 11 bp, Homo sapiens
tgtccccttct

SEQ ID NO: 4752056 - DNA, 20 bp, Homo sapiens
tgtccccttctctcatctct

SEQ ID NO: 4752057 - DNA, 22 bp, Homo sapiens
tgtccccttctctcatctctta

SEQ ID NO: 4752058 - DNA, 14 bp, Homo sapiens
tgtccctgcacttg

SEQ ID NO: 4752059 - DNA, 20 bp, Homo sapiens
tgtcctacccaccctccttt

SEQ ID NO: 4752060 - DNA, 12 bp, Homo sapiens
tgtcctactctg

SEQ ID NO: 4752061 - DNA, 13 bp, Homo sapiens
tgtcctcctctgt

SEQ ID NO: 4752062 - DNA, 14 bp, Homo sapiens
tgtcctcctctgtg

SEQ ID NO: 4752063 - DNA, 15 bp, Homo sapiens
tgtcctcctctgtga

SEQ ID NO: 4752064 - DNA, 22 bp, Homo sapiens
tgtcctgacagcactcctcggc

SEQ ID NO: 4752065 - DNA, 15 bp, Homo sapiens
tgtcctgctccacag

SEQ ID NO: 4752066 - DNA, 17 bp, Homo sapiens
tgtcctgctccacagtg

SEQ ID NO: 4752067 - DNA, 21 bp, Homo sapiens
tgtcgaatttttattatttgt

SEQ ID NO: 4752068 - DNA, 14 bp, Homo sapiens
tgtcgcccagtctg

SEQ ID NO: 4752069 - DNA, 15 bp, Homo sapiens
tgtcgcccagtctgg

SEQ ID NO: 4752070 - DNA, 13 bp, Homo sapiens
tgtcgctgtaaat

SEQ ID NO: 4752071 - DNA, 19 bp, Homo sapiens
tgtcggggaagatgaaacc

SEQ ID NO: 4752072 - DNA, 20 bp, Homo sapiens
tgtcgttgactttagggact

SEQ ID NO: 4752073 - DNA, 19 bp, Homo sapiens
tgtctagaaagtaagaaaa

SEQ ID NO: 4752074 - DNA, 21 bp, Homo sapiens
tgtctagaaagtaagaaaaca

SEQ ID NO: 4752075 - DNA, 23 bp, Homo sapiens
tgtctagttgtttgattcagaca

SEQ ID NO: 4752076 - DNA, 14 bp, Homo sapiens
tgtctatgctccct

SEQ ID NO: 4752077 - DNA, 15 bp, Homo sapiens
tgtctatgctccctc

SEQ ID NO: 4752078 - DNA, 20 bp, Homo sapiens
tgtctcatgtgtgctcttct

SEQ ID NO: 4752079 - DNA, 16 bp, Homo sapiens
tgtctccaacccccca

SEQ ID NO: 4752080 - DNA, 23 bp, Homo sapiens
tgtctccaaccccccagcactga

SEQ ID NO: 4752081 - DNA, 20 bp, Homo sapiens
tgtctcgtggtaggactgta

SEQ ID NO: 4752082 - DNA, 19 bp, Homo sapiens
tgtctctgtatatagctct

SEQ ID NO: 4752083 - DNA, 13 bp, Homo sapiens
tgtctctgtgaga

SEQ ID NO: 4752084 - DNA, 19 bp, Homo sapiens
tgtctggattcccaggatg

SEQ ID NO: 4752085 - DNA, 12 bp, Homo sapiens
tgtctgggctga

SEQ ID NO: 4752086 - DNA, 17 bp, Homo sapiens
tgtctggtccaggagaa

SEQ ID NO: 4752087 - DNA, 14 bp, Homo sapiens
tgtctgtagtgttt

SEQ ID NO: 4752088 - DNA, 20 bp, Homo sapiens
tgtctgtgttttgaaagaat

SEQ ID NO: 4752089 - DNA, 18 bp, Homo sapiens
tgtcttaaactaaatgtg

SEQ ID NO: 4752090 - DNA, 15 bp, Homo sapiens
tgtcttcaatgatca

SEQ ID NO: 4752091 - DNA, 13 bp, Homo sapiens
tgtcttcctgtgg

SEQ ID NO: 4752092 - DNA, 13 bp, Homo sapiens
tgtcttctttcca

SEQ ID NO: 4752093 - DNA, 22 bp, Homo sapiens
tgtcttgatgcatgcactgttc

SEQ ID NO: 4752094 - DNA, 17 bp, Homo sapiens
tgtcttgcaatggcagc

SEQ ID NO: 4752095 - DNA, 18 bp, Homo sapiens
tgtcttgcaatggcagcc

SEQ ID NO: 4752096 - DNA, 22 bp, Homo sapiens
tgtctttattagattttcctcc

SEQ ID NO: 4752097 - DNA, 14 bp, Homo sapiens
tgtctttctttgct

SEQ ID NO: 4752098 - DNA, 21 bp, Homo sapiens
tgtctttttattaaaatattt

SEQ ID NO: 4752099 - DNA, 16 bp, Homo sapiens
tgtcttttttcactac

SEQ ID NO: 4752100 - DNA, 18 bp, Homo sapiens
tgtgaaatcatcaaaaag

SEQ ID NO: 4752101 - DNA, 15 bp, Homo sapiens
tgtgaaccaccacac

SEQ ID NO: 4752102 - DNA, 23 bp, Homo sapiens
tgtgaaccaccacacccagccca

SEQ ID NO: 4752103 - DNA, 18 bp, Homo sapiens
tgtgaactccatcattca

SEQ ID NO: 4752104 - DNA, 20 bp, Homo sapiens
tgtgaagcaaactctaaaat

SEQ ID NO: 4752105 - DNA, 20 bp, Homo sapiens
tgtgaataaaaagaaagatt

SEQ ID NO: 4752106 - DNA, 18 bp, Homo sapiens
tgtgaatattgtggctcc

SEQ ID NO: 4752107 - DNA, 19 bp, Homo sapiens
tgtgaatattgtggctccc

SEQ ID NO: 4752108 - DNA, 22 bp, Homo sapiens
tgtgaatattgtggctccctgg

SEQ ID NO: 4752109 - DNA, 12 bp, Homo sapiens
tgtgaatgcttc

SEQ ID NO: 4752110 - DNA, 21 bp, Homo sapiens
tgtgacaaggattgctactgt

SEQ ID NO: 4752111 - DNA, 19 bp, Homo sapiens
tgtgacaccccccttctga

SEQ ID NO: 4752112 - DNA, 20 bp, Homo sapiens
tgtgacaccccccttctgaa

SEQ ID NO: 4752113 - DNA, 21 bp, Homo sapiens
tgtgacacttataaatatcct

SEQ ID NO: 4752114 - DNA, 16 bp, Homo sapiens
tgtgacaggaaagatt

SEQ ID NO: 4752115 - DNA, 19 bp, Homo sapiens
tgtgagactcgagaacttt

SEQ ID NO: 4752116 - DNA, 11 bp, Homo sapiens
tgtgaggaagc

SEQ ID NO: 4752117 - DNA, 13 bp, Homo sapiens
tgtgaggccaggg

SEQ ID NO: 4752118 - DNA, 17 bp, Homo sapiens
tgtgaggccagggcaga

SEQ ID NO: 4752119 - DNA, 23 bp, Homo sapiens
tgtgagtactacagtcctcccat

SEQ ID NO: 4752120 - DNA, 15 bp, Homo sapiens
tgtgatattgaccat

SEQ ID NO: 4752121 - DNA, 17 bp, Homo sapiens
tgtgatgaataaaataa

SEQ ID NO: 4752122 - DNA, 22 bp, Homo sapiens
tgtgatgatgaaatgaggtcag

SEQ ID NO: 4752123 - DNA, 21 bp, Homo sapiens
tgtgatgtcccagtttcccac

SEQ ID NO: 4752124 - DNA, 20 bp, Homo sapiens
tgtgatgttgggaagctatt

SEQ ID NO: 4752125 - DNA, 14 bp, Homo sapiens
tgtgattatggaca

SEQ ID NO: 4752126 - DNA, 23 bp, Homo sapiens
tgtgatttcccgtggccccagcc

SEQ ID NO: 4752127 - DNA, 15 bp, Homo sapiens
tgtgcaactcttgta

SEQ ID NO: 4752128 - DNA, 17 bp, Homo sapiens
tgtgcacatctgttttg

SEQ ID NO: 4752129 - DNA, 22 bp, Homo sapiens
tgtgcacatgcacgtgtgtgca

SEQ ID NO: 4752130 - DNA, 13 bp, Homo sapiens
tgtgcaccagggt

SEQ ID NO: 4752131 - DNA, 14 bp, Homo sapiens
tgtgcaccagggtt

SEQ ID NO: 4752132 - DNA, 15 bp, Homo sapiens
tgtgcatctggtgta

SEQ ID NO: 4752133 - DNA, 21 bp, Homo sapiens
tgtgccaccctgggctctgtg

SEQ ID NO: 4752134 - DNA, 16 bp, Homo sapiens
tgtgccatgtgccagg

SEQ ID NO: 4752135 - DNA, 18 bp, Homo sapiens
tgtgcccatgggcactgc

SEQ ID NO: 4752136 - DNA, 19 bp, Homo sapiens
tgtgcccatgggcactgct

SEQ ID NO: 4752137 - DNA, 21 bp, Homo sapiens
tgtgcccatgggcactgctgg

SEQ ID NO: 4752138 - DNA, 22 bp, Homo sapiens
tgtgcccatgggcactgctggg

SEQ ID NO: 4752139 - DNA, 15 bp, Homo sapiens
tgtgccccccatcct

SEQ ID NO: 4752140 - DNA, 19 bp, Homo sapiens
tgtgccccccatcctggcc

SEQ ID NO: 4752141 - DNA, 20 bp, Homo sapiens
tgtgcctgtgtgcgagtctg

SEQ ID NO: 4752142 - DNA, 14 bp, Homo sapiens
tgtgcgcctacagg

SEQ ID NO: 4752143 - DNA, 15 bp, Homo sapiens
tgtgctcagagacac

SEQ ID NO: 4752144 - DNA, 13 bp, Homo sapiens
tgtgctgccctgc

SEQ ID NO: 4752145 - DNA, 15 bp, Homo sapiens
tgtgctgccctgccc

SEQ ID NO: 4752146 - DNA, 18 bp, Homo sapiens
tgtgctgccctgcccacc

SEQ ID NO: 4752147 - DNA, 19 bp, Homo sapiens
tgtgctgccctgcccacct

SEQ ID NO: 4752148 - DNA, 18 bp, Homo sapiens
tgtgctgctcactcaaca

SEQ ID NO: 4752149 - DNA, 15 bp, Homo sapiens
tgtgctggagccact

SEQ ID NO: 4752150 - DNA, 19 bp, Homo sapiens
tgtgcttcgggcccttccc

SEQ ID NO: 4752151 - DNA, 22 bp, Homo sapiens
tgtgcttttttgattttgctga

SEQ ID NO: 4752152 - DNA, 20 bp, Homo sapiens
tgtggaaaacatcctgactt

SEQ ID NO: 4752153 - DNA, 16 bp, Homo sapiens
tgtggaagtccctcag

SEQ ID NO: 4752154 - DNA, 18 bp, Homo sapiens
tgtggacacagctcttct

SEQ ID NO: 4752155 - DNA, 23 bp, Homo sapiens
tgtggagaaattcgttgttccca

SEQ ID NO: 4752156 - DNA, 19 bp, Homo sapiens
tgtggagaagccacaggcc

SEQ ID NO: 4752157 - DNA, 20 bp, Homo sapiens
tgtggaggaaggattgtaaa

SEQ ID NO: 4752158 - DNA, 13 bp, Homo sapiens
tgtggagggcaca

SEQ ID NO: 4752159 - DNA, 20 bp, Homo sapiens
tgtggcaagcaagagctctt

SEQ ID NO: 4752160 - DNA, 23 bp, Homo sapiens
tgtggcgcagcatattcaggaag

SEQ ID NO: 4752161 - DNA, 12 bp, Homo sapiens
tgtggctccctg

SEQ ID NO: 4752162 - DNA, 22 bp, Homo sapiens
tgtggcttcttaatcttttcac

SEQ ID NO: 4752163 - DNA, 12 bp, Homo sapiens
tgtgggaagggg

SEQ ID NO: 4752164 - DNA, 22 bp, Homo sapiens
tgtgggctagttgggcttcctc

SEQ ID NO: 4752165 - DNA, 13 bp, Homo sapiens
tgtgggctgcact

SEQ ID NO: 4752166 - DNA, 21 bp, Homo sapiens
tgtgggctgcactctgtgccc

SEQ ID NO: 4752167 - DNA, 22 bp, Homo sapiens
tgtgggctgcactctgtgccca

SEQ ID NO: 4752168 - DNA, 15 bp, Homo sapiens
tgtgggttgtgatat

SEQ ID NO: 4752169 - DNA, 15 bp, Homo sapiens
tgtggtcccacccca

SEQ ID NO: 4752170 - DNA, 23 bp, Homo sapiens
tgtggtgtgtccccctctgtcca

SEQ ID NO: 4752171 - DNA, 14 bp, Homo sapiens
tgtggtgtttcctg

SEQ ID NO: 4752172 - DNA, 15 bp, Homo sapiens
tgtgtaaaaagagag

SEQ ID NO: 4752173 - DNA, 12 bp, Homo sapiens
tgtgtaagaaaa

SEQ ID NO: 4752174 - DNA, 12 bp, Homo sapiens
tgtgtactctgt

SEQ ID NO: 4752175 - DNA, 12 bp, Homo sapiens
tgtgtagggcgg

SEQ ID NO: 4752176 - DNA, 16 bp, Homo sapiens
tgtgtagggcgggagg

SEQ ID NO: 4752177 - DNA, 15 bp, Homo sapiens
tgtgtatatgtataa

SEQ ID NO: 4752178 - DNA, 23 bp, Homo sapiens
tgtgtatgagaagtactttgtgc

SEQ ID NO: 4752179 - DNA, 19 bp, Homo sapiens
tgtgtcaatgtaaagccaa

SEQ ID NO: 4752180 - DNA, 17 bp, Homo sapiens
tgtgtcactggctgcct

SEQ ID NO: 4752181 - DNA, 18 bp, Homo sapiens
tgtgtcactggctgcctc

SEQ ID NO: 4752182 - DNA, 14 bp, Homo sapiens
tgtgtcagaatctc

SEQ ID NO: 4752183 - DNA, 19 bp, Homo sapiens
tgtgtcaggtggggcagct

SEQ ID NO: 4752184 - DNA, 16 bp, Homo sapiens
tgtgtctcttggtcct

SEQ ID NO: 4752185 - DNA, 20 bp, Homo sapiens
tgtgtctcttggtcctgctg

SEQ ID NO: 4752186 - DNA, 20 bp, Homo sapiens
tgtgtctgaaaatatctctt

SEQ ID NO: 4752187 - DNA, 12 bp, Homo sapiens
tgtgtctgtgtt

SEQ ID NO: 4752188 - DNA, 15 bp, Homo sapiens
tgtgtgcttatgtat

SEQ ID NO: 4752189 - DNA, 13 bp, Homo sapiens
tgtgtggaggggg

SEQ ID NO: 4752190 - DNA, 14 bp, Homo sapiens
tgtgtggattcttt

SEQ ID NO: 4752191 - DNA, 23 bp, Homo sapiens
tgtgtggtcaacatttctcatgt

SEQ ID NO: 4752192 - DNA, 22 bp, Homo sapiens
tgtgtgtctaggcaggacctgt

SEQ ID NO: 4752193 - DNA, 17 bp, Homo sapiens
tgtgtgtgaaaatgtgt

SEQ ID NO: 4752194 - DNA, 11 bp, Homo sapiens
tgtgtgtgtac

SEQ ID NO: 4752195 - DNA, 12 bp, Homo sapiens
tgtgtgtgtact

SEQ ID NO: 4752196 - DNA, 13 bp, Homo sapiens
tgtgtgtgtgtac

SEQ ID NO: 4752197 - DNA, 14 bp, Homo sapiens
tgtgtgtgtgtact

SEQ ID NO: 4752198 - DNA, 19 bp, Homo sapiens
tgtgtgttgatactgttgc

SEQ ID NO: 4752199 - DNA, 23 bp, Homo sapiens
tgtgttacctgaaaacactgtgc

SEQ ID NO: 4752200 - DNA, 23 bp, Homo sapiens
tgtgttactaaaaaaaagatgaa

SEQ ID NO: 4752201 - DNA, 17 bp, Homo sapiens
tgtgttgatactgttgc

SEQ ID NO: 4752202 - DNA, 19 bp, Homo sapiens
tgtgttgatactgttgcac

SEQ ID NO: 4752203 - DNA, 22 bp, Homo sapiens
tgtgttgggattgagtctgtgc

SEQ ID NO: 4752204 - DNA, 14 bp, Homo sapiens
tgtgtttttctatt

SEQ ID NO: 4752205 - DNA, 15 bp, Homo sapiens
tgtgtttttctatta

SEQ ID NO: 4752206 - DNA, 17 bp, Homo sapiens
tgtgtttttctattaaa

SEQ ID NO: 4752207 - DNA, 21 bp, Homo sapiens
tgtgtttttctattaaaagac

SEQ ID NO: 4752208 - DNA, 14 bp, Homo sapiens
tgttaaaaatgtca

SEQ ID NO: 4752209 - DNA, 21 bp, Homo sapiens
tgttaaatttgtaagtttcag

SEQ ID NO: 4752210 - DNA, 16 bp, Homo sapiens
tgttaacactgtaata

SEQ ID NO: 4752211 - DNA, 21 bp, Homo sapiens
tgttaactgaagatattccaa

SEQ ID NO: 4752212 - DNA, 20 bp, Homo sapiens
tgttaaggaaactcttatct

SEQ ID NO: 4752213 - DNA, 22 bp, Homo sapiens
tgttaaggaaactcttatctca

SEQ ID NO: 4752214 - DNA, 22 bp, Homo sapiens
tgttaagttgatggtgatgaaa

SEQ ID NO: 4752215 - DNA, 19 bp, Homo sapiens
tgttaataaaagtacatgt

SEQ ID NO: 4752216 - DNA, 13 bp, Homo sapiens
tgttaatatttta

SEQ ID NO: 4752217 - DNA, 19 bp, Homo sapiens
tgttaatgatagctactgt

SEQ ID NO: 4752218 - DNA, 19 bp, Homo sapiens
tgttaatgcctataacttt

SEQ ID NO: 4752219 - DNA, 14 bp, Homo sapiens
tgttaatgtatact

SEQ ID NO: 4752220 - DNA, 23 bp, Homo sapiens
tgttacctgaaaacactgtgcac

SEQ ID NO: 4752221 - DNA, 16 bp, Homo sapiens
tgttacgtagcctaag

SEQ ID NO: 4752222 - DNA, 15 bp, Homo sapiens
tgttactgagatgtt

SEQ ID NO: 4752223 - DNA, 16 bp, Homo sapiens
tgttactgtctgtagt

SEQ ID NO: 4752224 - DNA, 18 bp, Homo sapiens
tgttacttaaacatcatt

SEQ ID NO: 4752225 - DNA, 21 bp, Homo sapiens
tgttacttaaacatcattgga

SEQ ID NO: 4752226 - DNA, 22 bp, Homo sapiens
tgttagaggatccctctctgga

SEQ ID NO: 4752227 - DNA, 15 bp, Homo sapiens
tgttagccaggtgga

SEQ ID NO: 4752228 - DNA, 18 bp, Homo sapiens
tgttagtattttaatcct

SEQ ID NO: 4752229 - DNA, 20 bp, Homo sapiens
tgttagtattttaatcctgt

SEQ ID NO: 4752230 - DNA, 15 bp, Homo sapiens
tgttatcttgtgtat

SEQ ID NO: 4752231 - DNA, 13 bp, Homo sapiens
tgttatgactcct

SEQ ID NO: 4752232 - DNA, 16 bp, Homo sapiens
tgttatttacactggt

SEQ ID NO: 4752233 - DNA, 18 bp, Homo sapiens
tgttatttacactggtct

SEQ ID NO: 4752234 - DNA, 18 bp, Homo sapiens
tgttatttattgaaatga

SEQ ID NO: 4752235 - DNA, 19 bp, Homo sapiens
tgttatttattgaaatgat

SEQ ID NO: 4752236 - DNA, 17 bp, Homo sapiens
tgttcaaacacaatgga

SEQ ID NO: 4752237 - DNA, 15 bp, Homo sapiens
tgttcagctccagct

SEQ ID NO: 4752238 - DNA, 16 bp, Homo sapiens
tgttcattctgtgacc

SEQ ID NO: 4752239 - DNA, 21 bp, Homo sapiens
tgttcattctgtgaccctagt

SEQ ID NO: 4752240 - DNA, 14 bp, Homo sapiens
tgttcattcttgtt

SEQ ID NO: 4752241 - DNA, 18 bp, Homo sapiens
tgttcccactgaaatgga

SEQ ID NO: 4752242 - DNA, 17 bp, Homo sapiens
tgttcccctcctccact

SEQ ID NO: 4752243 - DNA, 23 bp, Homo sapiens
tgttcctggacaccacccagagc

SEQ ID NO: 4752244 - DNA, 17 bp, Homo sapiens
tgttctaagtctttcca

SEQ ID NO: 4752245 - DNA, 13 bp, Homo sapiens
tgttctacttgat

SEQ ID NO: 4752246 - DNA, 16 bp, Homo sapiens
tgttctcagttttcaa

SEQ ID NO: 4752247 - DNA, 16 bp, Homo sapiens
tgttctccgtccctgc

SEQ ID NO: 4752248 - DNA, 14 bp, Homo sapiens
tgttctctgccctc

SEQ ID NO: 4752249 - DNA, 16 bp, Homo sapiens
tgttctctgccctcca

SEQ ID NO: 4752250 - DNA, 13 bp, Homo sapiens
tgttctgggacac

SEQ ID NO: 4752251 - DNA, 21 bp, Homo sapiens
tgttctgggtgatttctagaa

SEQ ID NO: 4752252 - DNA, 23 bp, Homo sapiens
tgttcttgaatttaataatctgt

SEQ ID NO: 4752253 - DNA, 16 bp, Homo sapiens
tgttcttgtcatcagt

SEQ ID NO: 4752254 - DNA, 19 bp, Homo sapiens
tgttgacttctatcctgtt

SEQ ID NO: 4752255 - DNA, 17 bp, Homo sapiens
tgttgagtctctgaaca

SEQ ID NO: 4752256 - DNA, 14 bp, Homo sapiens
tgttgatactgttg

SEQ ID NO: 4752257 - DNA, 21 bp, Homo sapiens
tgttgatactgttgcacgtgt

SEQ ID NO: 4752258 - DNA, 18 bp, Homo sapiens
tgttgcccaggcaggtct

SEQ ID NO: 4752259 - DNA, 13 bp, Homo sapiens
tgttgcccaggct

SEQ ID NO: 4752260 - DNA, 23 bp, Homo sapiens
tgttgcccaggctggcgtgcagt

SEQ ID NO: 4752261 - DNA, 14 bp, Homo sapiens
tgttggccaggctg

SEQ ID NO: 4752262 - DNA, 22 bp, Homo sapiens
tgttggctgggaactcacctgg

SEQ ID NO: 4752263 - DNA, 20 bp, Homo sapiens
tgttggggaagggcctgccc

SEQ ID NO: 4752264 - DNA, 16 bp, Homo sapiens
tgttggtaactaatgt

SEQ ID NO: 4752265 - DNA, 11 bp, Homo sapiens
tgttggtgcaa

SEQ ID NO: 4752266 - DNA, 20 bp, Homo sapiens
tgttgtacatttatgattta

SEQ ID NO: 4752267 - DNA, 23 bp, Homo sapiens
tgttgtacatttatgatttaata

SEQ ID NO: 4752268 - DNA, 13 bp, Homo sapiens
tgttgttccaaat

SEQ ID NO: 4752269 - DNA, 13 bp, Homo sapiens
tgtttaaaatttc

SEQ ID NO: 4752270 - DNA, 22 bp, Homo sapiens
tgtttacaaacatggaaaacag

SEQ ID NO: 4752271 - DNA, 19 bp, Homo sapiens
tgtttactagggatccctc

SEQ ID NO: 4752272 - DNA, 19 bp, Homo sapiens
tgtttactgcttttcatta

SEQ ID NO: 4752273 - DNA, 22 bp, Homo sapiens
tgtttatgatctatttgtagat

SEQ ID NO: 4752274 - DNA, 19 bp, Homo sapiens
tgtttatgggtttcttcca

SEQ ID NO: 4752275 - DNA, 18 bp, Homo sapiens
tgtttatgttgtttataa

SEQ ID NO: 4752276 - DNA, 14 bp, Homo sapiens
tgtttattccaaag

SEQ ID NO: 4752277 - DNA, 20 bp, Homo sapiens
tgtttattgttgctggttat

SEQ ID NO: 4752278 - DNA, 15 bp, Homo sapiens
tgtttcaatctctga

SEQ ID NO: 4752279 - DNA, 16 bp, Homo sapiens
tgtttcaattgcatct

SEQ ID NO: 4752280 - DNA, 20 bp, Homo sapiens
tgtttcagtgccatttgtta

SEQ ID NO: 4752281 - DNA, 16 bp, Homo sapiens
tgtttcctagctgtgt

SEQ ID NO: 4752282 - DNA, 20 bp, Homo sapiens
tgtttcctggcactgcttcc

SEQ ID NO: 4752283 - DNA, 23 bp, Homo sapiens
tgtttctagatagcacaggagag

SEQ ID NO: 4752284 - DNA, 13 bp, Homo sapiens
tgtttctccccca

SEQ ID NO: 4752285 - DNA, 17 bp, Homo sapiens
tgtttctggatttcata

SEQ ID NO: 4752286 - DNA, 13 bp, Homo sapiens
tgtttctttctag

SEQ ID NO: 4752287 - DNA, 12 bp, Homo sapiens
tgtttctttctg

SEQ ID NO: 4752288 - DNA, 13 bp, Homo sapiens
tgtttctttctga

SEQ ID NO: 4752289 - DNA, 22 bp, Homo sapiens
tgtttgaagaaccgcattttga

SEQ ID NO: 4752290 - DNA, 21 bp, Homo sapiens
tgtttgacaataatctcacaa

SEQ ID NO: 4752291 - DNA, 22 bp, Homo sapiens
tgtttgattcagacagctgcct

SEQ ID NO: 4752292 - DNA, 14 bp, Homo sapiens
tgtttgtgagaagc

SEQ ID NO: 4752293 - DNA, 16 bp, Homo sapiens
tgtttgtgagaagctt

SEQ ID NO: 4752294 - DNA, 15 bp, Homo sapiens
tgtttgtgctgtggt

SEQ ID NO: 4752295 - DNA, 16 bp, Homo sapiens
tgtttgtgtgtatctg

SEQ ID NO: 4752296 - DNA, 19 bp, Homo sapiens
tgttttaaaagtttgtcct

SEQ ID NO: 4752297 - DNA, 16 bp, Homo sapiens
tgttttaagaggcagg

SEQ ID NO: 4752298 - DNA, 15 bp, Homo sapiens
tgttttatctcctgt

SEQ ID NO: 4752299 - DNA, 17 bp, Homo sapiens
tgttttccagctcctca

SEQ ID NO: 4752300 - DNA, 13 bp, Homo sapiens
tgttttctctgtg

SEQ ID NO: 4752301 - DNA, 11 bp, Homo sapiens
tgtttttcatt

SEQ ID NO: 4752302 - DNA, 13 bp, Homo sapiens
tgtttttctatta

SEQ ID NO: 4752303 - DNA, 15 bp, Homo sapiens
tgtttttctattaaa

SEQ ID NO: 4752304 - DNA, 17 bp, Homo sapiens
tgtttttctattaaaag

SEQ ID NO: 4752305 - DNA, 20 bp, Homo sapiens
tgtttttctattaaaagact

SEQ ID NO: 4752306 - DNA, 16 bp, Homo sapiens
ttaaaaaaatttaagt

SEQ ID NO: 4752307 - DNA, 14 bp, Homo sapiens
ttaaaaatgttagt

SEQ ID NO: 4752308 - DNA, 15 bp, Homo sapiens
ttaaaacttgtaatt

SEQ ID NO: 4752309 - DNA, 15 bp, Homo sapiens
ttaaaagacaaacac

SEQ ID NO: 4752310 - DNA, 14 bp, Homo sapiens
ttaaaagactcatc

SEQ ID NO: 4752311 - DNA, 18 bp, Homo sapiens
ttaaaagactcatccgtc

SEQ ID NO: 4752312 - DNA, 12 bp, Homo sapiens
ttaaaagactcc

SEQ ID NO: 4752313 - DNA, 17 bp, Homo sapiens
ttaaaaggtataattaa

SEQ ID NO: 4752314 - DNA, 13 bp, Homo sapiens
ttaaaatatcttt

SEQ ID NO: 4752315 - DNA, 18 bp, Homo sapiens
ttaaaatcactgtcaata

SEQ ID NO: 4752316 - DNA, 20 bp, Homo sapiens
ttaaaatcactgtcaatatt

SEQ ID NO: 4752317 - DNA, 16 bp, Homo sapiens
ttaaaatccagtatta

SEQ ID NO: 4752318 - DNA, 18 bp, Homo sapiens
ttaaaatgcaaaataatg

SEQ ID NO: 4752319 - DNA, 13 bp, Homo sapiens
ttaaaatgttcac

SEQ ID NO: 4752320 - DNA, 18 bp, Homo sapiens
ttaaaattgccattttat

SEQ ID NO: 4752321 - DNA, 19 bp, Homo sapiens
ttaaaatttcttagaaaac

SEQ ID NO: 4752322 - DNA, 22 bp, Homo sapiens
ttaaaatttcttagaaaacaat

SEQ ID NO: 4752323 - DNA, 12 bp, Homo sapiens
ttaaacataata

SEQ ID NO: 4752324 - DNA, 13 bp, Homo sapiens
ttaaacataataa

SEQ ID NO: 4752325 - DNA, 15 bp, Homo sapiens
ttaaacgtaaatgtt

SEQ ID NO: 4752326 - DNA, 22 bp, Homo sapiens
ttaaactggtattttatctttg

SEQ ID NO: 4752327 - DNA, 13 bp, Homo sapiens
ttaaagaaaatgt

SEQ ID NO: 4752328 - DNA, 18 bp, Homo sapiens
ttaaagaaaatgtgtctg

SEQ ID NO: 4752329 - DNA, 18 bp, Homo sapiens
ttaaagacaggagacaaa

SEQ ID NO: 4752330 - DNA, 14 bp, Homo sapiens
ttaaagcaattgca

SEQ ID NO: 4752331 - DNA, 16 bp, Homo sapiens
ttaaagcacatgccag

SEQ ID NO: 4752332 - DNA, 20 bp, Homo sapiens
ttaaaggaaacgtggcagga

SEQ ID NO: 4752333 - DNA, 23 bp, Homo sapiens
ttaaaggaaacgtggcaggactt

SEQ ID NO: 4752334 - DNA, 14 bp, Homo sapiens
ttaaaggacaaaca

SEQ ID NO: 4752335 - DNA, 19 bp, Homo sapiens
ttaaagtgaatctcaaaac

SEQ ID NO: 4752336 - DNA, 13 bp, Homo sapiens
ttaaagtgaattg

SEQ ID NO: 4752337 - DNA, 20 bp, Homo sapiens
ttaaagttgtataaaaacat

SEQ ID NO: 4752338 - DNA, 13 bp, Homo sapiens
ttaaatacagtct

SEQ ID NO: 4752339 - DNA, 22 bp, Homo sapiens
ttaaatcagttctcaatttcat

SEQ ID NO: 4752340 - DNA, 14 bp, Homo sapiens
ttaaatgatgtaca

SEQ ID NO: 4752341 - DNA, 21 bp, Homo sapiens
ttaaatgatgtacaggcagat

SEQ ID NO: 4752342 - DNA, 15 bp, Homo sapiens
ttaaatgcccagccc

SEQ ID NO: 4752343 - DNA, 16 bp, Homo sapiens
ttaaatgcccagcccc

SEQ ID NO: 4752344 - DNA, 12 bp, Homo sapiens
ttaaatgtactt

SEQ ID NO: 4752345 - DNA, 20 bp, Homo sapiens
ttaaatttggtttgttaatt

SEQ ID NO: 4752346 - DNA, 14 bp, Homo sapiens
ttaacaagaacttt

SEQ ID NO: 4752347 - DNA, 19 bp, Homo sapiens
ttaacaataaagtgacaaa

SEQ ID NO: 4752348 - DNA, 21 bp, Homo sapiens
ttaacactgtaatatctttaa

SEQ ID NO: 4752349 - DNA, 18 bp, Homo sapiens
ttaacaggttttcttcta

SEQ ID NO: 4752350 - DNA, 20 bp, Homo sapiens
ttaacaggttttcttctaat

SEQ ID NO: 4752351 - DNA, 12 bp, Homo sapiens
ttaactcaatat

SEQ ID NO: 4752352 - DNA, 16 bp, Homo sapiens
ttaacttttttcttta

SEQ ID NO: 4752353 - DNA, 16 bp, Homo sapiens
ttaagaactaaaatgt

SEQ ID NO: 4752354 - DNA, 11 bp, Homo sapiens
ttaagaagctg

SEQ ID NO: 4752355 - DNA, 23 bp, Homo sapiens
ttaagaagctgttgtacatttat

SEQ ID NO: 4752356 - DNA, 17 bp, Homo sapiens
ttaagaatagtctctgg

SEQ ID NO: 4752357 - DNA, 15 bp, Homo sapiens
ttaagaggcagggtc

SEQ ID NO: 4752358 - DNA, 19 bp, Homo sapiens
ttaagagtgctaaattttt

SEQ ID NO: 4752359 - DNA, 18 bp, Homo sapiens
ttaagattgtaaaaataa

SEQ ID NO: 4752360 - DNA, 21 bp, Homo sapiens
ttaagatttttctcaaagttt

SEQ ID NO: 4752361 - DNA, 12 bp, Homo sapiens
ttaagcatgagt

SEQ ID NO: 4752362 - DNA, 17 bp, Homo sapiens
ttaagctctgagctgtc

SEQ ID NO: 4752363 - DNA, 18 bp, Homo sapiens
ttaagctctgagctgtca

SEQ ID NO: 4752364 - DNA, 14 bp, Homo sapiens
ttaaggaaactctt

SEQ ID NO: 4752365 - DNA, 23 bp, Homo sapiens
ttaaggcagtatgatatcatgct

SEQ ID NO: 4752366 - DNA, 19 bp, Homo sapiens
ttaagtctcgaatgtaatt

SEQ ID NO: 4752367 - DNA, 17 bp, Homo sapiens
ttaagtgcgtgtgtaga

SEQ ID NO: 4752368 - DNA, 20 bp, Homo sapiens
ttaataacattaccttactg

SEQ ID NO: 4752369 - DNA, 17 bp, Homo sapiens
ttaataatgtatgtaca

SEQ ID NO: 4752370 - DNA, 19 bp, Homo sapiens
ttaatcagaatatcagaat

SEQ ID NO: 4752371 - DNA, 15 bp, Homo sapiens
ttaatcctgtaccaa

SEQ ID NO: 4752372 - DNA, 21 bp, Homo sapiens
ttaatcctgtaccaaatctga

SEQ ID NO: 4752373 - DNA, 18 bp, Homo sapiens
ttaatgaagaaagtggaa

SEQ ID NO: 4752374 - DNA, 23 bp, Homo sapiens
ttaatgaagaaagtggaaaacaa

SEQ ID NO: 4752375 - DNA, 13 bp, Homo sapiens
ttaatgaagttga

SEQ ID NO: 4752376 - DNA, 22 bp, Homo sapiens
ttaatgaatcgtaatgaagttg

SEQ ID NO: 4752377 - DNA, 14 bp, Homo sapiens
ttaatgattcctat

SEQ ID NO: 4752378 - DNA, 17 bp, Homo sapiens
ttaatgcctataacttt

SEQ ID NO: 4752379 - DNA, 23 bp, Homo sapiens
ttaatgcctataactttttttca

SEQ ID NO: 4752380 - DNA, 23 bp, Homo sapiens
ttaatgggtttcccttgcccttt

SEQ ID NO: 4752381 - DNA, 18 bp, Homo sapiens
ttaatgtaatctgatggc

SEQ ID NO: 4752382 - DNA, 15 bp, Homo sapiens
ttaatgtagccatgg

SEQ ID NO: 4752383 - DNA, 22 bp, Homo sapiens
ttaatgtcaattcttgccaaat

SEQ ID NO: 4752384 - DNA, 18 bp, Homo sapiens
ttaatgtcacaggcaggt

SEQ ID NO: 4752385 - DNA, 13 bp, Homo sapiens
ttaatgttgaatg

SEQ ID NO: 4752386 - DNA, 18 bp, Homo sapiens
ttaatgttgaatgtattt

SEQ ID NO: 4752387 - DNA, 14 bp, Homo sapiens
ttaattctttctat

SEQ ID NO: 4752388 - DNA, 19 bp, Homo sapiens
ttaattgttgtttctttct

SEQ ID NO: 4752389 - DNA, 23 bp, Homo sapiens
ttaatttacaaaaatataaaata

SEQ ID NO: 4752390 - DNA, 17 bp, Homo sapiens
ttaatttgtatgctaaa

SEQ ID NO: 4752391 - DNA, 16 bp, Homo sapiens
ttaatttgtatttccc

SEQ ID NO: 4752392 - DNA, 17 bp, Homo sapiens
ttaattttcctcatttt

SEQ ID NO: 4752393 - DNA, 12 bp, Homo sapiens
ttacaaacatgt

SEQ ID NO: 4752394 - DNA, 20 bp, Homo sapiens
ttacaaaccaaccatttcta

SEQ ID NO: 4752395 - DNA, 21 bp, Homo sapiens
ttacaaagttaaaattgttat

SEQ ID NO: 4752396 - DNA, 15 bp, Homo sapiens
ttacaacaaacactg

SEQ ID NO: 4752397 - DNA, 16 bp, Homo sapiens
ttacaacaaacactgt

SEQ ID NO: 4752398 - DNA, 21 bp, Homo sapiens
ttacaagcgtgagccactgca

SEQ ID NO: 4752399 - DNA, 12 bp, Homo sapiens
ttacaattacat

SEQ ID NO: 4752400 - DNA, 18 bp, Homo sapiens
ttacactggtctaatgtt

SEQ ID NO: 4752401 - DNA, 17 bp, Homo sapiens
ttacagtaggagcccag

SEQ ID NO: 4752402 - DNA, 14 bp, Homo sapiens
ttacagttgcattt

SEQ ID NO: 4752403 - DNA, 23 bp, Homo sapiens
ttacataatcagtatatttggtt

SEQ ID NO: 4752404 - DNA, 12 bp, Homo sapiens
ttacatatctga

SEQ ID NO: 4752405 - DNA, 18 bp, Homo sapiens
ttacatcaaggcttcaaa

SEQ ID NO: 4752406 - DNA, 21 bp, Homo sapiens
ttacatctgaacaaaatgcct

SEQ ID NO: 4752407 - DNA, 13 bp, Homo sapiens
ttaccacccccac

SEQ ID NO: 4752408 - DNA, 14 bp, Homo sapiens
ttaccagcagagca

SEQ ID NO: 4752409 - DNA, 21 bp, Homo sapiens
ttaccagggtctttgcagatg

SEQ ID NO: 4752410 - DNA, 12 bp, Homo sapiens
ttaccattagca

SEQ ID NO: 4752411 - DNA, 21 bp, Homo sapiens
ttaccattatttaatttgtat

SEQ ID NO: 4752412 - DNA, 18 bp, Homo sapiens
ttacctagctaattattt

SEQ ID NO: 4752413 - DNA, 19 bp, Homo sapiens
ttacctcctgagaaaaaag

SEQ ID NO: 4752414 - DNA, 18 bp, Homo sapiens
ttacctcttgcccttggg

SEQ ID NO: 4752415 - DNA, 23 bp, Homo sapiens
ttacctcttgcccttgggtgcta

SEQ ID NO: 4752416 - DNA, 17 bp, Homo sapiens
ttacctgtgcaccagtg

SEQ ID NO: 4752417 - DNA, 12 bp, Homo sapiens
ttacctgtggat

SEQ ID NO: 4752418 - DNA, 20 bp, Homo sapiens
ttaccttattggatatttga

SEQ ID NO: 4752419 - DNA, 18 bp, Homo sapiens
ttactaaaaaaaagatga

SEQ ID NO: 4752420 - DNA, 17 bp, Homo sapiens
ttactaaaaagtataaa

SEQ ID NO: 4752421 - DNA, 16 bp, Homo sapiens
ttactagggatccctc

SEQ ID NO: 4752422 - DNA, 20 bp, Homo sapiens
ttactagggatccctcatct

SEQ ID NO: 4752423 - DNA, 23 bp, Homo sapiens
ttactagggatccctcatctgtc

SEQ ID NO: 4752424 - DNA, 19 bp, Homo sapiens
ttactatcatgtcaaacgt

SEQ ID NO: 4752425 - DNA, 21 bp, Homo sapiens
ttactatcatgtcaaacgtga

SEQ ID NO: 4752426 - DNA, 15 bp, Homo sapiens
ttactcaaccctctc

SEQ ID NO: 4752427 - DNA, 20 bp, Homo sapiens
ttactcattaattcaatgaa

SEQ ID NO: 4752428 - DNA, 21 bp, Homo sapiens
ttactcattaattcaatgaaa

SEQ ID NO: 4752429 - DNA, 23 bp, Homo sapiens
ttactcattaattcaatgaaatg

SEQ ID NO: 4752430 - DNA, 21 bp, Homo sapiens
ttactccaaggtttataaagc

SEQ ID NO: 4752431 - DNA, 18 bp, Homo sapiens
ttactcctttttattcat

SEQ ID NO: 4752432 - DNA, 20 bp, Homo sapiens
ttactgagatgttttaccat

SEQ ID NO: 4752433 - DNA, 22 bp, Homo sapiens
ttactgatagggatacatgctc

SEQ ID NO: 4752434 - DNA, 20 bp, Homo sapiens
ttactgcttttcattagcag

SEQ ID NO: 4752435 - DNA, 15 bp, Homo sapiens
ttactgtctgtagtg

SEQ ID NO: 4752436 - DNA, 17 bp, Homo sapiens
ttactgtctgtagtgtt

SEQ ID NO: 4752437 - DNA, 16 bp, Homo sapiens
ttactgtggaggaagg

SEQ ID NO: 4752438 - DNA, 20 bp, Homo sapiens
ttactgtggaggaaggattg

SEQ ID NO: 4752439 - DNA, 18 bp, Homo sapiens
ttactttagaagcctgca

SEQ ID NO: 4752440 - DNA, 20 bp, Homo sapiens
ttagaaaagcaaagggtgct

SEQ ID NO: 4752441 - DNA, 23 bp, Homo sapiens
ttagaaattacctgtggatattt

SEQ ID NO: 4752442 - DNA, 19 bp, Homo sapiens
ttagaaggaggttctaata

SEQ ID NO: 4752443 - DNA, 15 bp, Homo sapiens
ttagaataatttcat

SEQ ID NO: 4752444 - DNA, 23 bp, Homo sapiens
ttagaataattttattagaataa

SEQ ID NO: 4752445 - DNA, 11 bp, Homo sapiens
ttagacagagt

SEQ ID NO: 4752446 - DNA, 13 bp, Homo sapiens
ttagacagagtct

SEQ ID NO: 4752447 - DNA, 15 bp, Homo sapiens
ttagacagtccctgc

SEQ ID NO: 4752448 - DNA, 16 bp, Homo sapiens
ttagacagtccctgcc

SEQ ID NO: 4752449 - DNA, 18 bp, Homo sapiens
ttagacagtccctgccaa

SEQ ID NO: 4752450 - DNA, 20 bp, Homo sapiens
ttagagcagtttctgtcctg

SEQ ID NO: 4752451 - DNA, 21 bp, Homo sapiens
ttagagctgacacaaacctgc

SEQ ID NO: 4752452 - DNA, 16 bp, Homo sapiens
ttagagtgtctttcca

SEQ ID NO: 4752453 - DNA, 17 bp, Homo sapiens
ttagagtgtctttccac

SEQ ID NO: 4752454 - DNA, 13 bp, Homo sapiens
ttagataatcttt

SEQ ID NO: 4752455 - DNA, 18 bp, Homo sapiens
ttagataatcttttacat

SEQ ID NO: 4752456 - DNA, 20 bp, Homo sapiens
ttagatgttctaagtctttc

SEQ ID NO: 4752457 - DNA, 21 bp, Homo sapiens
ttagattttctgtaaatgaag

SEQ ID NO: 4752458 - DNA, 17 bp, Homo sapiens
ttagcaatgctgtgaat

SEQ ID NO: 4752459 - DNA, 22 bp, Homo sapiens
ttagcagtcgcgagcacatgtt

SEQ ID NO: 4752460 - DNA, 15 bp, Homo sapiens
ttagccaggatcatg

SEQ ID NO: 4752461 - DNA, 17 bp, Homo sapiens
ttagccaggatcatggt

SEQ ID NO: 4752462 - DNA, 14 bp, Homo sapiens
ttagcccctctctt

SEQ ID NO: 4752463 - DNA, 13 bp, Homo sapiens
ttagctcccctcc

SEQ ID NO: 4752464 - DNA, 17 bp, Homo sapiens
ttagctttttaattgtt

SEQ ID NO: 4752465 - DNA, 16 bp, Homo sapiens
ttaggaaatttaagac

SEQ ID NO: 4752466 - DNA, 20 bp, Homo sapiens
ttaggaagtgtttatgttgt

SEQ ID NO: 4752467 - DNA, 17 bp, Homo sapiens
ttaggcctggcacagtg

SEQ ID NO: 4752468 - DNA, 23 bp, Homo sapiens
ttagggactcaatttctccccag

SEQ ID NO: 4752469 - DNA, 17 bp, Homo sapiens
ttagtattttaatcctg

SEQ ID NO: 4752470 - DNA, 22 bp, Homo sapiens
ttagtattttaatcctgtacca

SEQ ID NO: 4752471 - DNA, 20 bp, Homo sapiens
ttagtcattattattacttt

SEQ ID NO: 4752472 - DNA, 19 bp, Homo sapiens
ttagtcctgtactgtatgg

SEQ ID NO: 4752473 - DNA, 22 bp, Homo sapiens
ttagtttatattaatttcggtt

SEQ ID NO: 4752474 - DNA, 18 bp, Homo sapiens
ttagtttttgtgaagttt

SEQ ID NO: 4752475 - DNA, 12 bp, Homo sapiens
ttataaaagtgt

SEQ ID NO: 4752476 - DNA, 15 bp, Homo sapiens
ttataaaatttactg

SEQ ID NO: 4752477 - DNA, 17 bp, Homo sapiens
ttataaaccaatcttaa

SEQ ID NO: 4752478 - DNA, 17 bp, Homo sapiens
ttataactgtaaagatg

SEQ ID NO: 4752479 - DNA, 17 bp, Homo sapiens
ttataacttattagcag

SEQ ID NO: 4752480 - DNA, 15 bp, Homo sapiens
ttatactatatttgt

SEQ ID NO: 4752481 - DNA, 14 bp, Homo sapiens
ttatagcttactga

SEQ ID NO: 4752482 - DNA, 19 bp, Homo sapiens
ttataggtggcctctcctt

SEQ ID NO: 4752483 - DNA, 16 bp, Homo sapiens
ttatatacttgttgtt

SEQ ID NO: 4752484 - DNA, 17 bp, Homo sapiens
ttatatttctacagaga

SEQ ID NO: 4752485 - DNA, 18 bp, Homo sapiens
ttatattttgctgtttat

SEQ ID NO: 4752486 - DNA, 13 bp, Homo sapiens
ttatcgaaataac

SEQ ID NO: 4752487 - DNA, 14 bp, Homo sapiens
ttatcgaaataaca

SEQ ID NO: 4752488 - DNA, 14 bp, Homo sapiens
ttatctacccagtc

SEQ ID NO: 4752489 - DNA, 17 bp, Homo sapiens
ttatctcctaattgtat

SEQ ID NO: 4752490 - DNA, 14 bp, Homo sapiens
ttatcttgtgtatg

SEQ ID NO: 4752491 - DNA, 22 bp, Homo sapiens
ttatcttgtgtatggatatgtg

SEQ ID NO: 4752492 - DNA, 14 bp, Homo sapiens
ttatctttgaatat

SEQ ID NO: 4752493 - DNA, 14 bp, Homo sapiens
ttatgagaacatgg

SEQ ID NO: 4752494 - DNA, 14 bp, Homo sapiens
ttatgatctatttg

SEQ ID NO: 4752495 - DNA, 13 bp, Homo sapiens
ttatgatttaata

SEQ ID NO: 4752496 - DNA, 20 bp, Homo sapiens
ttatgatttaataaaataat

SEQ ID NO: 4752497 - DNA, 19 bp, Homo sapiens
ttatgatttttaaagaaaa

SEQ ID NO: 4752498 - DNA, 21 bp, Homo sapiens
ttatgcttccattaacaaatg

SEQ ID NO: 4752499 - DNA, 22 bp, Homo sapiens
ttatggaatctaccaactgttt

SEQ ID NO: 4752500 - DNA, 22 bp, Homo sapiens
ttatggacatcgatatgaaaaa

SEQ ID NO: 4752501 - DNA, 22 bp, Homo sapiens
ttatggccaatctattctcaaa

SEQ ID NO: 4752502 - DNA, 16 bp, Homo sapiens
ttatgggtttcttcca

SEQ ID NO: 4752503 - DNA, 15 bp, Homo sapiens
ttatgtattgtttta

SEQ ID NO: 4752504 - DNA, 19 bp, Homo sapiens
ttatgttgtttataataaa

SEQ ID NO: 4752505 - DNA, 18 bp, Homo sapiens
ttatgtttgtaatctgta

SEQ ID NO: 4752506 - DNA, 18 bp, Homo sapiens
ttatgtttttcagtttaa

SEQ ID NO: 4752507 - DNA, 16 bp, Homo sapiens
ttattaaacattttca

SEQ ID NO: 4752508 - DNA, 21 bp, Homo sapiens
ttattaaatgcccagcccctt

SEQ ID NO: 4752509 - DNA, 22 bp, Homo sapiens
ttattaatgatcagctatatac

SEQ ID NO: 4752510 - DNA, 14 bp, Homo sapiens
ttattaatttgaaa

SEQ ID NO: 4752511 - DNA, 18 bp, Homo sapiens
ttattacccagagttttt

SEQ ID NO: 4752512 - DNA, 21 bp, Homo sapiens
ttattagagattacctcctga

SEQ ID NO: 4752513 - DNA, 13 bp, Homo sapiens
ttattataatggt

SEQ ID NO: 4752514 - DNA, 15 bp, Homo sapiens
ttattatatttacaa

SEQ ID NO: 4752515 - DNA, 18 bp, Homo sapiens
ttattatcactttggggt

SEQ ID NO: 4752516 - DNA, 14 bp, Homo sapiens
ttattattactgtt

SEQ ID NO: 4752517 - DNA, 11 bp, Homo sapiens
ttattcacttt

SEQ ID NO: 4752518 - DNA, 16 bp, Homo sapiens
ttattcacttttgtaa

SEQ ID NO: 4752519 - DNA, 19 bp, Homo sapiens
ttattcaggaagataaaaa

SEQ ID NO: 4752520 - DNA, 20 bp, Homo sapiens
ttattcaggaagataaaaat

SEQ ID NO: 4752521 - DNA, 14 bp, Homo sapiens
ttattcagtgtcac

SEQ ID NO: 4752522 - DNA, 21 bp, Homo sapiens
ttattcattagttttgaagat

SEQ ID NO: 4752523 - DNA, 18 bp, Homo sapiens
ttattccaaagagtgtgg

SEQ ID NO: 4752524 - DNA, 15 bp, Homo sapiens
ttattccgtattaca

SEQ ID NO: 4752525 - DNA, 11 bp, Homo sapiens
ttattctgctc

SEQ ID NO: 4752526 - DNA, 16 bp, Homo sapiens
ttattggatatttgat

SEQ ID NO: 4752527 - DNA, 12 bp, Homo sapiens
ttattgtacttg

SEQ ID NO: 4752528 - DNA, 14 bp, Homo sapiens
ttatttaagactaa

SEQ ID NO: 4752529 - DNA, 22 bp, Homo sapiens
ttatttaatcacagtcatcttt

SEQ ID NO: 4752530 - DNA, 13 bp, Homo sapiens
ttatttaatttgt

SEQ ID NO: 4752531 - DNA, 21 bp, Homo sapiens
ttatttacactggtctaatgt

SEQ ID NO: 4752532 - DNA, 15 bp, Homo sapiens
ttatttaccttttaa

SEQ ID NO: 4752533 - DNA, 16 bp, Homo sapiens
ttatttgataacattt

SEQ ID NO: 4752534 - DNA, 19 bp, Homo sapiens
ttatttgattatttaagac

SEQ ID NO: 4752535 - DNA, 15 bp, Homo sapiens
ttatttgctgttaac

SEQ ID NO: 4752536 - DNA, 15 bp, Homo sapiens
ttatttgttttcccg

SEQ ID NO: 4752537 - DNA, 18 bp, Homo sapiens
ttattttctccaaataaa

SEQ ID NO: 4752538 - DNA, 12 bp, Homo sapiens
ttattttgcaac

SEQ ID NO: 4752539 - DNA, 21 bp, Homo sapiens
ttattttgcatatatgttctt

SEQ ID NO: 4752540 - DNA, 15 bp, Homo sapiens
ttattttgtaattat

SEQ ID NO: 4752541 - DNA, 17 bp, Homo sapiens
ttattttgttactgtct

SEQ ID NO: 4752542 - DNA, 19 bp, Homo sapiens
ttattttgttactgtctgt

SEQ ID NO: 4752543 - DNA, 17 bp, Homo sapiens
ttatttttagacagagt

SEQ ID NO: 4752544 - DNA, 18 bp, Homo sapiens
ttatttttatatacgttt

SEQ ID NO: 4752545 - DNA, 14 bp, Homo sapiens
ttcaaaaatgctgt

SEQ ID NO: 4752546 - DNA, 21 bp, Homo sapiens
ttcaaagccagcgtcctcctc

SEQ ID NO: 4752547 - DNA, 22 bp, Homo sapiens
ttcaacaaagaaacaaagatgt

SEQ ID NO: 4752548 - DNA, 12 bp, Homo sapiens
ttcaacattaag

SEQ ID NO: 4752549 - DNA, 15 bp, Homo sapiens
ttcaacattaaggca

SEQ ID NO: 4752550 - DNA, 21 bp, Homo sapiens
ttcaagaaagatatctatgac

SEQ ID NO: 4752551 - DNA, 24 bp, Homo sapiens
ttcaagaaagatatctatgactgt

SEQ ID NO: 4752552 - DNA, 15 bp, Homo sapiens
ttcaagggaattaaa

SEQ ID NO: 4752553 - DNA, 16 bp, Homo sapiens
ttcaagttgtgtctga

SEQ ID NO: 4752554 - DNA, 21 bp, Homo sapiens
ttcaatacttacatatctgac

SEQ ID NO: 4752555 - DNA, 16 bp, Homo sapiens
ttcaatgattcttcct

SEQ ID NO: 4752556 - DNA, 20 bp, Homo sapiens
ttcaatttactttttaaaca

SEQ ID NO: 4752557 - DNA, 22 bp, Homo sapiens
ttcaatttactttttaaacagt

SEQ ID NO: 4752558 - DNA, 23 bp, Homo sapiens
ttcaatttactttttaaacagtg

SEQ ID NO: 4752559 - DNA, 19 bp, Homo sapiens
ttcaatttccaagagctga

SEQ ID NO: 4752560 - DNA, 16 bp, Homo sapiens
ttcacagatgctgtgt

SEQ ID NO: 4752561 - DNA, 20 bp, Homo sapiens
ttcacatctaacctcatctt

SEQ ID NO: 4752562 - DNA, 15 bp, Homo sapiens
ttcacatgttctaat

SEQ ID NO: 4752563 - DNA, 16 bp, Homo sapiens
ttcacatgttctaata

SEQ ID NO: 4752564 - DNA, 22 bp, Homo sapiens
ttcaccacatgtgcacatgcac

SEQ ID NO: 4752565 - DNA, 22 bp, Homo sapiens
ttcaccatgttggccaggctgc

SEQ ID NO: 4752566 - DNA, 24 bp, Homo sapiens
ttcaccatttggcaatgccatcat

SEQ ID NO: 4752567 - DNA, 20 bp, Homo sapiens
ttcacctttgtccccaccgc

SEQ ID NO: 4752568 - DNA, 17 bp, Homo sapiens
ttcaccttttcttcaaa

SEQ ID NO: 4752569 - DNA, 13 bp, Homo sapiens
ttcactgtataaa

SEQ ID NO: 4752570 - DNA, 15 bp, Homo sapiens
ttcactgtataaata

SEQ ID NO: 4752571 - DNA, 16 bp, Homo sapiens
ttcactgtataaatag

SEQ ID NO: 4752572 - DNA, 18 bp, Homo sapiens
ttcactgtataaatagga

SEQ ID NO: 4752573 - DNA, 22 bp, Homo sapiens
ttcactgtataaataggagagg

SEQ ID NO: 4752574 - DNA, 23 bp, Homo sapiens
ttcactgtataaataggagagga

SEQ ID NO: 4752575 - DNA, 18 bp, Homo sapiens
ttcacttgcacatcatgg

SEQ ID NO: 4752576 - DNA, 24 bp, Homo sapiens
ttcactttaaagcaattgcataat

SEQ ID NO: 4752577 - DNA, 17 bp, Homo sapiens
ttcacttttgacaaagg

SEQ ID NO: 4752578 - DNA, 15 bp, Homo sapiens
ttcagaagtgattta

SEQ ID NO: 4752579 - DNA, 17 bp, Homo sapiens
ttcagacagctgcctgg

SEQ ID NO: 4752580 - DNA, 22 bp, Homo sapiens
ttcagaggccctcgctgccagc

SEQ ID NO: 4752581 - DNA, 21 bp, Homo sapiens
ttcagatacagggtgctcctt

SEQ ID NO: 4752582 - DNA, 12 bp, Homo sapiens
ttcagatataaa

SEQ ID NO: 4752583 - DNA, 13 bp, Homo sapiens
ttcagctactttc

SEQ ID NO: 4752584 - DNA, 20 bp, Homo sapiens
ttcagcttctgctgggctgg

SEQ ID NO: 4752585 - DNA, 20 bp, Homo sapiens
ttcaggaagataaaaatcag

SEQ ID NO: 4752586 - DNA, 20 bp, Homo sapiens
ttcaggaagctcagggcctg

SEQ ID NO: 4752587 - DNA, 16 bp, Homo sapiens
ttcaggagcagcctca

SEQ ID NO: 4752588 - DNA, 20 bp, Homo sapiens
ttcaggagcagcctcagaac

SEQ ID NO: 4752589 - DNA, 15 bp, Homo sapiens
ttcaggtaacaggca

SEQ ID NO: 4752590 - DNA, 18 bp, Homo sapiens
ttcaggtcaactctgaag

SEQ ID NO: 4752591 - DNA, 23 bp, Homo sapiens
ttcaggtcaactctgaagagtat

SEQ ID NO: 4752592 - DNA, 13 bp, Homo sapiens
ttcaggtgacatg

SEQ ID NO: 4752593 - DNA, 19 bp, Homo sapiens
ttcaggtgacatgtgaaac

SEQ ID NO: 4752594 - DNA, 22 bp, Homo sapiens
ttcaggtgacatgtgaaacctt

SEQ ID NO: 4752595 - DNA, 21 bp, Homo sapiens
ttcaggttatcgaaataacaa

SEQ ID NO: 4752596 - DNA, 20 bp, Homo sapiens
ttcagtaagttatctttgaa

SEQ ID NO: 4752597 - DNA, 13 bp, Homo sapiens
ttcagtcaattct

SEQ ID NO: 4752598 - DNA, 23 bp, Homo sapiens
ttcagttattatatttacaaatg

SEQ ID NO: 4752599 - DNA, 16 bp, Homo sapiens
ttcagtttaattctgt

SEQ ID NO: 4752600 - DNA, 12 bp, Homo sapiens
ttcagttttcag

SEQ ID NO: 4752601 - DNA, 20 bp, Homo sapiens
ttcataaattatttgattat

SEQ ID NO: 4752602 - DNA, 19 bp, Homo sapiens
ttcataaatttgttgtcat

SEQ ID NO: 4752603 - DNA, 23 bp, Homo sapiens
ttcataaatttgttgtcatgtgt

SEQ ID NO: 4752604 - DNA, 15 bp, Homo sapiens
ttcataacctagcct

SEQ ID NO: 4752605 - DNA, 16 bp, Homo sapiens
ttcataagctgaacca

SEQ ID NO: 4752606 - DNA, 18 bp, Homo sapiens
ttcataccagtcagtatt

SEQ ID NO: 4752607 - DNA, 20 bp, Homo sapiens
ttcataccagtcagtattcc

SEQ ID NO: 4752608 - DNA, 16 bp, Homo sapiens
ttcatacgtaaaattt

SEQ ID NO: 4752609 - DNA, 22 bp, Homo sapiens
ttcatactgtaacattcaggaa

SEQ ID NO: 4752610 - DNA, 23 bp, Homo sapiens
ttcatatgacattcatgcctggc

SEQ ID NO: 4752611 - DNA, 23 bp, Homo sapiens
ttcatattgcatcatagtttgct

SEQ ID NO: 4752612 - DNA, 15 bp, Homo sapiens
ttcatcatccctccc

SEQ ID NO: 4752613 - DNA, 18 bp, Homo sapiens
ttcatccaggactgagat

SEQ ID NO: 4752614 - DNA, 15 bp, Homo sapiens
ttcatctgctctcct

SEQ ID NO: 4752615 - DNA, 16 bp, Homo sapiens
ttcatgacagcctcca

SEQ ID NO: 4752616 - DNA, 16 bp, Homo sapiens
ttcatgcctggcttcg

SEQ ID NO: 4752617 - DNA, 17 bp, Homo sapiens
ttcatgctctcatatat

SEQ ID NO: 4752618 - DNA, 14 bp, Homo sapiens
ttcatgtaaactgt

SEQ ID NO: 4752619 - DNA, 17 bp, Homo sapiens
ttcatgtaaactgtgca

SEQ ID NO: 4752620 - DNA, 23 bp, Homo sapiens
ttcattagcagttgctcacatgt

SEQ ID NO: 4752621 - DNA, 23 bp, Homo sapiens
ttcattggatttttgttaatttt

SEQ ID NO: 4752622 - DNA, 14 bp, Homo sapiens
ttcatttttttcca

SEQ ID NO: 4752623 - DNA, 18 bp, Homo sapiens
ttcatttttttccaggct

SEQ ID NO: 4752624 - DNA, 20 bp, Homo sapiens
ttccaaggtggtctgctcgg

SEQ ID NO: 4752625 - DNA, 17 bp, Homo sapiens
ttccacacccccacccc

SEQ ID NO: 4752626 - DNA, 24 bp, Homo sapiens
ttccacggagccactcctctgact

SEQ ID NO: 4752627 - DNA, 23 bp, Homo sapiens
ttccactaagaacacctgcattc

SEQ ID NO: 4752628 - DNA, 17 bp, Homo sapiens
ttccactcaaatgtcct

SEQ ID NO: 4752629 - DNA, 18 bp, Homo sapiens
ttccactcaggtctgttt

SEQ ID NO: 4752630 - DNA, 19 bp, Homo sapiens
ttccacttggctacacagg

SEQ ID NO: 4752631 - DNA, 16 bp, Homo sapiens
ttccagagctgcttct

SEQ ID NO: 4752632 - DNA, 13 bp, Homo sapiens
ttccagctcctca

SEQ ID NO: 4752633 - DNA, 18 bp, Homo sapiens
ttccaggaagatccagga

SEQ ID NO: 4752634 - DNA, 13 bp, Homo sapiens
ttccaggctggga

SEQ ID NO: 4752635 - DNA, 15 bp, Homo sapiens
ttccaggctgggaga

SEQ ID NO: 4752636 - DNA, 17 bp, Homo sapiens
ttccaggctgggagagc

SEQ ID NO: 4752637 - DNA, 16 bp, Homo sapiens
ttccagtgaggctctg

SEQ ID NO: 4752638 - DNA, 20 bp, Homo sapiens
ttccagtgaggctctgccct

SEQ ID NO: 4752639 - DNA, 17 bp, Homo sapiens
ttccagttttgttttga

SEQ ID NO: 4752640 - DNA, 15 bp, Homo sapiens
ttccataagctattt

SEQ ID NO: 4752641 - DNA, 21 bp, Homo sapiens
ttccatggtgtgatcgtctga

SEQ ID NO: 4752642 - DNA, 14 bp, Homo sapiens
ttccattaacaaat

SEQ ID NO: 4752643 - DNA, 13 bp, Homo sapiens
ttccattctggaa

SEQ ID NO: 4752644 - DNA, 15 bp, Homo sapiens
ttccattctggaagt

SEQ ID NO: 4752645 - DNA, 13 bp, Homo sapiens
ttccatttgcaag

SEQ ID NO: 4752646 - DNA, 13 bp, Homo sapiens
ttccatttggtat

SEQ ID NO: 4752647 - DNA, 18 bp, Homo sapiens
ttcccaacccccagcccc

SEQ ID NO: 4752648 - DNA, 15 bp, Homo sapiens
ttcccaagctctgct

SEQ ID NO: 4752649 - DNA, 18 bp, Homo sapiens
ttcccacaggacatttct

SEQ ID NO: 4752650 - DNA, 16 bp, Homo sapiens
ttcccagagaccttct

SEQ ID NO: 4752651 - DNA, 12 bp, Homo sapiens
ttcccaggtgct

SEQ ID NO: 4752652 - DNA, 14 bp, Homo sapiens
ttcccagtataaga

SEQ ID NO: 4752653 - DNA, 14 bp, Homo sapiens
ttcccagtggctgc

SEQ ID NO: 4752654 - DNA, 18 bp, Homo sapiens
ttcccagtggctgctgcc

SEQ ID NO: 4752655 - DNA, 19 bp, Homo sapiens
ttcccatgacccaggctgg

SEQ ID NO: 4752656 - DNA, 22 bp, Homo sapiens
ttcccatttcgtgtaatattct

SEQ ID NO: 4752657 - DNA, 21 bp, Homo sapiens
ttccccaggaggccagccttg

SEQ ID NO: 4752658 - DNA, 18 bp, Homo sapiens
ttccccatacaaataagc

SEQ ID NO: 4752659 - DNA, 22 bp, Homo sapiens
ttccccctggccaccacccccc

SEQ ID NO: 4752660 - DNA, 22 bp, Homo sapiens
ttccccgagggatgatgccaca

SEQ ID NO: 4752661 - DNA, 22 bp, Homo sapiens
ttccccttcctaattccacagc

SEQ ID NO: 4752662 - DNA, 15 bp, Homo sapiens
ttcccgtggccccag

SEQ ID NO: 4752663 - DNA, 16 bp, Homo sapiens
ttcccgtggccccagc

SEQ ID NO: 4752664 - DNA, 13 bp, Homo sapiens
ttccctgactcat

SEQ ID NO: 4752665 - DNA, 18 bp, Homo sapiens
ttcccttgccctttccat

SEQ ID NO: 4752666 - DNA, 20 bp, Homo sapiens
ttccctttgacgccatccca

SEQ ID NO: 4752667 - DNA, 19 bp, Homo sapiens
ttcccttttttggctgctg

SEQ ID NO: 4752668 - DNA, 20 bp, Homo sapiens
ttcccttttttggctgctga

SEQ ID NO: 4752669 - DNA, 22 bp, Homo sapiens
ttccggcatggacaatggaccg

SEQ ID NO: 4752670 - DNA, 15 bp, Homo sapiens
ttcctaataaagttc

SEQ ID NO: 4752671 - DNA, 16 bp, Homo sapiens
ttcctaataaagttct

SEQ ID NO: 4752672 - DNA, 17 bp, Homo sapiens
ttcctaattccacagct

SEQ ID NO: 4752673 - DNA, 18 bp, Homo sapiens
ttcctaattccacagctg

SEQ ID NO: 4752674 - DNA, 19 bp, Homo sapiens
ttcctacttgcagtacatc

SEQ ID NO: 4752675 - DNA, 13 bp, Homo sapiens
ttcctatacgcag

SEQ ID NO: 4752676 - DNA, 23 bp, Homo sapiens
ttcctatttgccatgggcttcac

SEQ ID NO: 4752677 - DNA, 23 bp, Homo sapiens
ttcctcattttgaattatgtgca

SEQ ID NO: 4752678 - DNA, 11 bp, Homo sapiens
ttcctcctggg

SEQ ID NO: 4752679 - DNA, 23 bp, Homo sapiens
ttcctcctgggccctctctgctc

SEQ ID NO: 4752680 - DNA, 21 bp, Homo sapiens
ttcctctgaatattaagaaac

SEQ ID NO: 4752681 - DNA, 13 bp, Homo sapiens
ttcctctgagcct

SEQ ID NO: 4752682 - DNA, 15 bp, Homo sapiens
ttcctctgagctgtt

SEQ ID NO: 4752683 - DNA, 20 bp, Homo sapiens
ttcctgaggctgggctccct

SEQ ID NO: 4752684 - DNA, 15 bp, Homo sapiens
ttcctgatgcttctt

SEQ ID NO: 4752685 - DNA, 23 bp, Homo sapiens
ttcctgatgcttcttcagagact

SEQ ID NO: 4752686 - DNA, 13 bp, Homo sapiens
ttcctgccctggg

SEQ ID NO: 4752687 - DNA, 16 bp, Homo sapiens
ttcctggagcccagag

SEQ ID NO: 4752688 - DNA, 20 bp, Homo sapiens
ttcctggcactgcttccagt

SEQ ID NO: 4752689 - DNA, 20 bp, Homo sapiens
ttcctgttcttaagacgtga

SEQ ID NO: 4752690 - DNA, 13 bp, Homo sapiens
ttccttcctctga

SEQ ID NO: 4752691 - DNA, 13 bp, Homo sapiens
ttccttctttgat

SEQ ID NO: 4752692 - DNA, 14 bp, Homo sapiens
ttccttctttgata

SEQ ID NO: 4752693 - DNA, 13 bp, Homo sapiens
ttccttgtcccca

SEQ ID NO: 4752694 - DNA, 17 bp, Homo sapiens
ttccttgtccccacact

SEQ ID NO: 4752695 - DNA, 21 bp, Homo sapiens
ttccttgtccccacactccta

SEQ ID NO: 4752696 - DNA, 16 bp, Homo sapiens
ttcctttaaaaaaatt

SEQ ID NO: 4752697 - DNA, 15 bp, Homo sapiens
ttcctttctatatcc

SEQ ID NO: 4752698 - DNA, 14 bp, Homo sapiens
ttcctttgcatatt

SEQ ID NO: 4752699 - DNA, 21 bp, Homo sapiens
ttcgatgggcccaattcttac

SEQ ID NO: 4752700 - DNA, 12 bp, Homo sapiens
ttcgatgtacag

SEQ ID NO: 4752701 - DNA, 22 bp, Homo sapiens
ttcgatgtacagtctcaatttt

SEQ ID NO: 4752702 - DNA, 23 bp, Homo sapiens
ttcgatgtacagtctcaattttg

SEQ ID NO: 4752703 - DNA, 13 bp, Homo sapiens
ttcgtaacacagc

SEQ ID NO: 4752704 - DNA, 17 bp, Homo sapiens
ttctaaaactgcctttc

SEQ ID NO: 4752705 - DNA, 22 bp, Homo sapiens
ttctaaacaagaaccatttgca

SEQ ID NO: 4752706 - DNA, 11 bp, Homo sapiens
ttctaaacaga

SEQ ID NO: 4752707 - DNA, 15 bp, Homo sapiens
ttctaaggacttttt

SEQ ID NO: 4752708 - DNA, 21 bp, Homo sapiens
ttctaagggaggcacttcctc

SEQ ID NO: 4752709 - DNA, 15 bp, Homo sapiens
ttctaagtctttcca

SEQ ID NO: 4752710 - DNA, 22 bp, Homo sapiens
ttctaatactttgtttattgta

SEQ ID NO: 4752711 - DNA, 16 bp, Homo sapiens
ttctaatagagagatt

SEQ ID NO: 4752712 - DNA, 16 bp, Homo sapiens
ttctaatattcacatg

SEQ ID NO: 4752713 - DNA, 23 bp, Homo sapiens
ttctaattgtcagtgattttgta

SEQ ID NO: 4752714 - DNA, 17 bp, Homo sapiens
ttctacagtattatgta

SEQ ID NO: 4752715 - DNA, 19 bp, Homo sapiens
ttctacccagcgagccctg

SEQ ID NO: 4752716 - DNA, 20 bp, Homo sapiens
ttctacccagcgagccctgg

SEQ ID NO: 4752717 - DNA, 12 bp, Homo sapiens
ttctacctccca

SEQ ID NO: 4752718 - DNA, 16 bp, Homo sapiens
ttctacttgatatttc

SEQ ID NO: 4752719 - DNA, 18 bp, Homo sapiens
ttctagcccgaatacaaa

SEQ ID NO: 4752720 - DNA, 23 bp, Homo sapiens
ttctaggtggcaaggctgtgctc

SEQ ID NO: 4752721 - DNA, 22 bp, Homo sapiens
ttctatgtatgtgccaattttg

SEQ ID NO: 4752722 - DNA, 14 bp, Homo sapiens
ttctattaaaagac

SEQ ID NO: 4752723 - DNA, 18 bp, Homo sapiens
ttctattaaaagactcat

SEQ ID NO: 4752724 - DNA, 19 bp, Homo sapiens
ttctattaaaagactcatc

SEQ ID NO: 4752725 - DNA, 19 bp, Homo sapiens
ttctatttcagtgccaata

SEQ ID NO: 4752726 - DNA, 17 bp, Homo sapiens
ttctatttctcctccat

SEQ ID NO: 4752727 - DNA, 15 bp, Homo sapiens
ttctattttcacaat

SEQ ID NO: 4752728 - DNA, 19 bp, Homo sapiens
ttctcaaagaaatttccac

SEQ ID NO: 4752729 - DNA, 20 bp, Homo sapiens
ttctcaaagaaatttccact

SEQ ID NO: 4752730 - DNA, 20 bp, Homo sapiens
ttctcaaagttaaaagtaaa

SEQ ID NO: 4752731 - DNA, 15 bp, Homo sapiens
ttctcaaagttttga

SEQ ID NO: 4752732 - DNA, 22 bp, Homo sapiens
ttctcaaagttttgaaaagcta

SEQ ID NO: 4752733 - DNA, 21 bp, Homo sapiens
ttctcacctaaaccctctgtg

SEQ ID NO: 4752734 - DNA, 16 bp, Homo sapiens
ttctcagccacaaacc

SEQ ID NO: 4752735 - DNA, 18 bp, Homo sapiens
ttctcagctcttctgact

SEQ ID NO: 4752736 - DNA, 18 bp, Homo sapiens
ttctcaggaaatggcttt

SEQ ID NO: 4752737 - DNA, 17 bp, Homo sapiens
ttctcaggccatcatca

SEQ ID NO: 4752738 - DNA, 19 bp, Homo sapiens
ttctcagggtctctgctgc

SEQ ID NO: 4752739 - DNA, 20 bp, Homo sapiens
ttctcagggtctctgctgcc

SEQ ID NO: 4752740 - DNA, 14 bp, Homo sapiens
ttctcatgcctcag

SEQ ID NO: 4752741 - DNA, 18 bp, Homo sapiens
ttctcattaaaatccagt

SEQ ID NO: 4752742 - DNA, 15 bp, Homo sapiens
ttctcatttcacccc

SEQ ID NO: 4752743 - DNA, 19 bp, Homo sapiens
ttctcatttcacccctccc

SEQ ID NO: 4752744 - DNA, 22 bp, Homo sapiens
ttctccaaataaaaattagatg

SEQ ID NO: 4752745 - DNA, 12 bp, Homo sapiens
ttctccacctgc

SEQ ID NO: 4752746 - DNA, 20 bp, Homo sapiens
ttctccatccacatgggagc

SEQ ID NO: 4752747 - DNA, 18 bp, Homo sapiens
ttctccatggccctgcca

SEQ ID NO: 4752748 - DNA, 21 bp, Homo sapiens
ttctcccccatgttctgtccc

SEQ ID NO: 4752749 - DNA, 15 bp, Homo sapiens
ttctcccctgccccc

SEQ ID NO: 4752750 - DNA, 17 bp, Homo sapiens
ttctcccctgcccccag

SEQ ID NO: 4752751 - DNA, 19 bp, Homo sapiens
ttctcccctgcccccagga

SEQ ID NO: 4752752 - DNA, 12 bp, Homo sapiens
ttctcctgcctc

SEQ ID NO: 4752753 - DNA, 19 bp, Homo sapiens
ttctcctgtttatgggttt

SEQ ID NO: 4752754 - DNA, 15 bp, Homo sapiens
ttctctaatgcttga

SEQ ID NO: 4752755 - DNA, 12 bp, Homo sapiens
ttctctcatctc

SEQ ID NO: 4752756 - DNA, 13 bp, Homo sapiens
ttctctcatctct

SEQ ID NO: 4752757 - DNA, 13 bp, Homo sapiens
ttctctccagccc

SEQ ID NO: 4752758 - DNA, 11 bp, Homo sapiens
ttctctgccct

SEQ ID NO: 4752759 - DNA, 16 bp, Homo sapiens
ttctctgccctccaag

SEQ ID NO: 4752760 - DNA, 12 bp, Homo sapiens
ttctctgtctca

SEQ ID NO: 4752761 - DNA, 13 bp, Homo sapiens
ttctctgtctcat

SEQ ID NO: 4752762 - DNA, 15 bp, Homo sapiens
ttctcttcagtgtgt

SEQ ID NO: 4752763 - DNA, 12 bp, Homo sapiens
ttctcttctctg

SEQ ID NO: 4752764 - DNA, 19 bp, Homo sapiens
ttctgaaaattaacactgc

SEQ ID NO: 4752765 - DNA, 15 bp, Homo sapiens
ttctgaaagggacgc

SEQ ID NO: 4752766 - DNA, 16 bp, Homo sapiens
ttctgacccagggcct

SEQ ID NO: 4752767 - DNA, 16 bp, Homo sapiens
ttctgacccatgctgc

SEQ ID NO: 4752768 - DNA, 18 bp, Homo sapiens
ttctgatgatgtgcctgg

SEQ ID NO: 4752769 - DNA, 15 bp, Homo sapiens
ttctgccatattctg

SEQ ID NO: 4752770 - DNA, 15 bp, Homo sapiens
ttctgcctgcccagg

SEQ ID NO: 4752771 - DNA, 11 bp, Homo sapiens
ttctgccttcc

SEQ ID NO: 4752772 - DNA, 23 bp, Homo sapiens
ttctgctctaagaagctgcaata

SEQ ID NO: 4752773 - DNA, 20 bp, Homo sapiens
ttctgctgggctggggcctg

SEQ ID NO: 4752774 - DNA, 15 bp, Homo sapiens
ttctgcttcagcctc

SEQ ID NO: 4752775 - DNA, 16 bp, Homo sapiens
ttctgcttcagcctcc

SEQ ID NO: 4752776 - DNA, 19 bp, Homo sapiens
ttctgcttcagcctcccga

SEQ ID NO: 4752777 - DNA, 18 bp, Homo sapiens
ttctgctttcctcttcct

SEQ ID NO: 4752778 - DNA, 15 bp, Homo sapiens
ttctggaatggaatt

SEQ ID NO: 4752779 - DNA, 16 bp, Homo sapiens
ttctggctcttccagg

SEQ ID NO: 4752780 - DNA, 22 bp, Homo sapiens
ttctgggacacagttcaattct

SEQ ID NO: 4752781 - DNA, 14 bp, Homo sapiens
ttctgggctgggaa

SEQ ID NO: 4752782 - DNA, 16 bp, Homo sapiens
ttctgggtgatttcta

SEQ ID NO: 4752783 - DNA, 13 bp, Homo sapiens
ttctgtaaatgaa

SEQ ID NO: 4752784 - DNA, 13 bp, Homo sapiens
ttctgtaattgtg

SEQ ID NO: 4752785 - DNA, 11 bp, Homo sapiens
ttctgtatttt

SEQ ID NO: 4752786 - DNA, 13 bp, Homo sapiens
ttctgtcctgctg

SEQ ID NO: 4752787 - DNA, 14 bp, Homo sapiens
ttctgtgtttagct

SEQ ID NO: 4752788 - DNA, 18 bp, Homo sapiens
ttctgtgtttagctattt

SEQ ID NO: 4752789 - DNA, 13 bp, Homo sapiens
ttctgttctactt

SEQ ID NO: 4752790 - DNA, 15 bp, Homo sapiens
ttctgttgaagatta

SEQ ID NO: 4752791 - DNA, 16 bp, Homo sapiens
ttctgttgctgcctca

SEQ ID NO: 4752792 - DNA, 19 bp, Homo sapiens
ttctgtttaattttcactt

SEQ ID NO: 4752793 - DNA, 12 bp, Homo sapiens
ttcttacaagga

SEQ ID NO: 4752794 - DNA, 18 bp, Homo sapiens
ttcttactaaaaagtata

SEQ ID NO: 4752795 - DNA, 20 bp, Homo sapiens
ttcttactaaaaagtataaa

SEQ ID NO: 4752796 - DNA, 13 bp, Homo sapiens
ttcttagagatta

SEQ ID NO: 4752797 - DNA, 19 bp, Homo sapiens
ttcttagctttttaattgt

SEQ ID NO: 4752798 - DNA, 14 bp, Homo sapiens
ttcttagttgctgt

SEQ ID NO: 4752799 - DNA, 18 bp, Homo sapiens
ttcttcacacagacacta

SEQ ID NO: 4752800 - DNA, 17 bp, Homo sapiens
ttcttcccccttcacat

SEQ ID NO: 4752801 - DNA, 17 bp, Homo sapiens
ttcttcccttatccctg

SEQ ID NO: 4752802 - DNA, 21 bp, Homo sapiens
ttcttcctatttgccatgggc

SEQ ID NO: 4752803 - DNA, 21 bp, Homo sapiens
ttcttgaatttaataatctgt

SEQ ID NO: 4752804 - DNA, 21 bp, Homo sapiens
ttcttgatcaacatcttttct

SEQ ID NO: 4752805 - DNA, 22 bp, Homo sapiens
ttcttgcaagcaacaagctatt

SEQ ID NO: 4752806 - DNA, 18 bp, Homo sapiens
ttcttgcctctgtcccct

SEQ ID NO: 4752807 - DNA, 22 bp, Homo sapiens
ttctttaaccctcactgggact

SEQ ID NO: 4752808 - DNA, 19 bp, Homo sapiens
ttctttaactgccgtaatt

SEQ ID NO: 4752809 - DNA, 22 bp, Homo sapiens
ttctttctagtggtctttgtaa

SEQ ID NO: 4752810 - DNA, 17 bp, Homo sapiens
ttctttctattttcaca

SEQ ID NO: 4752811 - DNA, 17 bp, Homo sapiens
ttctttgataatgttaa

SEQ ID NO: 4752812 - DNA, 22 bp, Homo sapiens
ttctttgataatgttaaatttg

SEQ ID NO: 4752813 - DNA, 17 bp, Homo sapiens
ttcttttctcttctaca

SEQ ID NO: 4752814 - DNA, 20 bp, Homo sapiens
ttgaaaaaatagagcctgag

SEQ ID NO: 4752815 - DNA, 14 bp, Homo sapiens
ttgaaaagctatta

SEQ ID NO: 4752816 - DNA, 21 bp, Homo sapiens
ttgaaaatcttataatttaaa

SEQ ID NO: 4752817 - DNA, 12 bp, Homo sapiens
ttgaaagaactt

SEQ ID NO: 4752818 - DNA, 17 bp, Homo sapiens
ttgaaattgtattacaa

SEQ ID NO: 4752819 - DNA, 18 bp, Homo sapiens
ttgaacctgatgaaaata

SEQ ID NO: 4752820 - DNA, 16 bp, Homo sapiens
ttgaactcctggcctc

SEQ ID NO: 4752821 - DNA, 18 bp, Homo sapiens
ttgaactgggtacttgtg

SEQ ID NO: 4752822 - DNA, 13 bp, Homo sapiens
ttgaagattctat

SEQ ID NO: 4752823 - DNA, 16 bp, Homo sapiens
ttgaagtgactgttgt

SEQ ID NO: 4752824 - DNA, 18 bp, Homo sapiens
ttgaagtgactgttgtac

SEQ ID NO: 4752825 - DNA, 20 bp, Homo sapiens
ttgaagtgactgttgtacca

SEQ ID NO: 4752826 - DNA, 16 bp, Homo sapiens
ttgaatataaacacta

SEQ ID NO: 4752827 - DNA, 18 bp, Homo sapiens
ttgaatataaacactata

SEQ ID NO: 4752828 - DNA, 13 bp, Homo sapiens
ttgaatatatgat

SEQ ID NO: 4752829 - DNA, 13 bp, Homo sapiens
ttgaatcacagta

SEQ ID NO: 4752830 - DNA, 18 bp, Homo sapiens
ttgaatgtgatcatcttt

SEQ ID NO: 4752831 - DNA, 21 bp, Homo sapiens
ttgaatgtgatcatctttgct

SEQ ID NO: 4752832 - DNA, 23 bp, Homo sapiens
ttgaatgtgatcatctttgctga

SEQ ID NO: 4752833 - DNA, 21 bp, Homo sapiens
ttgaattcttggttgaggaaa

SEQ ID NO: 4752834 - DNA, 16 bp, Homo sapiens
ttgaattttcccactg

SEQ ID NO: 4752835 - DNA, 22 bp, Homo sapiens
ttgacaccagctgttctgtccc

SEQ ID NO: 4752836 - DNA, 16 bp, Homo sapiens
ttgacagaacactgtc

SEQ ID NO: 4752837 - DNA, 14 bp, Homo sapiens
ttgacagtgttttt

SEQ ID NO: 4752838 - DNA, 17 bp, Homo sapiens
ttgaccattctccacct

SEQ ID NO: 4752839 - DNA, 19 bp, Homo sapiens
ttgaccattctccacctgc

SEQ ID NO: 4752840 - DNA, 18 bp, Homo sapiens
ttgacctgaactctgcaa

SEQ ID NO: 4752841 - DNA, 22 bp, Homo sapiens
ttgacctgcctcccttcatgca

SEQ ID NO: 4752842 - DNA, 23 bp, Homo sapiens
ttgacctgcctcccttcatgcat

SEQ ID NO: 4752843 - DNA, 17 bp, Homo sapiens
ttgacgccatcccagcc

SEQ ID NO: 4752844 - DNA, 19 bp, Homo sapiens
ttgacttctatcctgttaa

SEQ ID NO: 4752845 - DNA, 20 bp, Homo sapiens
ttgacttctatcctgttaac

SEQ ID NO: 4752846 - DNA, 19 bp, Homo sapiens
ttgacttgacagaacactg

SEQ ID NO: 4752847 - DNA, 20 bp, Homo sapiens
ttgacttgacagaacactgt

SEQ ID NO: 4752848 - DNA, 10 bp, Homo sapiens
ttgagacaga

SEQ ID NO: 4752849 - DNA, 13 bp, Homo sapiens
ttgagacagtttc

SEQ ID NO: 4752850 - DNA, 22 bp, Homo sapiens
ttgagacagtttcttagctttt

SEQ ID NO: 4752851 - DNA, 17 bp, Homo sapiens
ttgagagaccaggcaaa

SEQ ID NO: 4752852 - DNA, 13 bp, Homo sapiens
ttgagcaaacatt

SEQ ID NO: 4752853 - DNA, 12 bp, Homo sapiens
ttgagcagggct

SEQ ID NO: 4752854 - DNA, 23 bp, Homo sapiens
ttgagcgtgcgtctgtgtgtgcc

SEQ ID NO: 4752855 - DNA, 15 bp, Homo sapiens
ttgagcttgcttctt

SEQ ID NO: 4752856 - DNA, 15 bp, Homo sapiens
ttgagtgctctgatc

SEQ ID NO: 4752857 - DNA, 19 bp, Homo sapiens
ttgagttttcagtggggca

SEQ ID NO: 4752858 - DNA, 18 bp, Homo sapiens
ttgagttttcttctgtga

SEQ ID NO: 4752859 - DNA, 15 bp, Homo sapiens
ttgataacagcactg

SEQ ID NO: 4752860 - DNA, 16 bp, Homo sapiens
ttgataagagggcaca

SEQ ID NO: 4752861 - DNA, 13 bp, Homo sapiens
ttgataatgttaa

SEQ ID NO: 4752862 - DNA, 21 bp, Homo sapiens
ttgataatgttaaatttgtaa

SEQ ID NO: 4752863 - DNA, 18 bp, Homo sapiens
ttgatactgttgcacgtg

SEQ ID NO: 4752864 - DNA, 18 bp, Homo sapiens
ttgatagcacagaccctg

SEQ ID NO: 4752865 - DNA, 21 bp, Homo sapiens
ttgatagcacagaccctgccc

SEQ ID NO: 4752866 - DNA, 21 bp, Homo sapiens
ttgatagtagccaaagttaaa

SEQ ID NO: 4752867 - DNA, 22 bp, Homo sapiens
ttgatatagaacagtgcttgcc

SEQ ID NO: 4752868 - DNA, 12 bp, Homo sapiens
ttgatatttggt

SEQ ID NO: 4752869 - DNA, 22 bp, Homo sapiens
ttgatcaacatcttttcttgcc

SEQ ID NO: 4752870 - DNA, 21 bp, Homo sapiens
ttgatcattcataattttatc

SEQ ID NO: 4752871 - DNA, 16 bp, Homo sapiens
ttgattatttgtttta

SEQ ID NO: 4752872 - DNA, 12 bp, Homo sapiens
ttgattcatatt

SEQ ID NO: 4752873 - DNA, 12 bp, Homo sapiens
ttgattctcctt

SEQ ID NO: 4752874 - DNA, 15 bp, Homo sapiens
ttgattttgctgact

SEQ ID NO: 4752875 - DNA, 21 bp, Homo sapiens
ttgattttgctgactttaaaa

SEQ ID NO: 4752876 - DNA, 15 bp, Homo sapiens
ttgatttttatttta

SEQ ID NO: 4752877 - DNA, 13 bp, Homo sapiens
ttgcaagggaaaa

SEQ ID NO: 4752878 - DNA, 22 bp, Homo sapiens
ttgcaagggaaaagtctcttgt

SEQ ID NO: 4752879 - DNA, 14 bp, Homo sapiens
ttgcaatggcagcc

SEQ ID NO: 4752880 - DNA, 19 bp, Homo sapiens
ttgcacaaaccaattaaac

SEQ ID NO: 4752881 - DNA, 22 bp, Homo sapiens
ttgcacgtgtgtttttctatta

SEQ ID NO: 4752882 - DNA, 16 bp, Homo sapiens
ttgcagacaggcaagc

SEQ ID NO: 4752883 - DNA, 15 bp, Homo sapiens
ttgcagtacatcaaa

SEQ ID NO: 4752884 - DNA, 18 bp, Homo sapiens
ttgcataaacaatccaaa

SEQ ID NO: 4752885 - DNA, 15 bp, Homo sapiens
ttgcatatatgttct

SEQ ID NO: 4752886 - DNA, 18 bp, Homo sapiens
ttgcatgaccacatagaa

SEQ ID NO: 4752887 - DNA, 12 bp, Homo sapiens
ttgcatgaggct

SEQ ID NO: 4752888 - DNA, 14 bp, Homo sapiens
ttgcatgaggctag

SEQ ID NO: 4752889 - DNA, 23 bp, Homo sapiens
ttgcattgaatttagtcattatt

SEQ ID NO: 4752890 - DNA, 17 bp, Homo sapiens
ttgcattgaggaaatat

SEQ ID NO: 4752891 - DNA, 13 bp, Homo sapiens
ttgccaccctcat

SEQ ID NO: 4752892 - DNA, 18 bp, Homo sapiens
ttgccagtcaccccggcc

SEQ ID NO: 4752893 - DNA, 20 bp, Homo sapiens
ttgccatgggcttcactgta

SEQ ID NO: 4752894 - DNA, 16 bp, Homo sapiens
ttgccatgttggccag

SEQ ID NO: 4752895 - DNA, 19 bp, Homo sapiens
ttgccatgttggccaggct

SEQ ID NO: 4752896 - DNA, 23 bp, Homo sapiens
ttgcccacgctggagtgcagtga

SEQ ID NO: 4752897 - DNA, 11 bp, Homo sapiens
ttgcccaggca

SEQ ID NO: 4752898 - DNA, 16 bp, Homo sapiens
ttgcccaggcaggtct

SEQ ID NO: 4752899 - DNA, 18 bp, Homo sapiens
ttgcccaggcaggtcttg

SEQ ID NO: 4752900 - DNA, 14 bp, Homo sapiens
ttgcccaggctggc

SEQ ID NO: 4752901 - DNA, 15 bp, Homo sapiens
ttgccccaaccccca

SEQ ID NO: 4752902 - DNA, 21 bp, Homo sapiens
ttgccccaacccccagcaccc

SEQ ID NO: 4752903 - DNA, 18 bp, Homo sapiens
ttgccgtctacctgaggg

SEQ ID NO: 4752904 - DNA, 17 bp, Homo sapiens
ttgcctcggctcctgct

SEQ ID NO: 4752905 - DNA, 19 bp, Homo sapiens
ttgcctcggctcctgctgc

SEQ ID NO: 4752906 - DNA, 16 bp, Homo sapiens
ttgcctctgcctctga

SEQ ID NO: 4752907 - DNA, 18 bp, Homo sapiens
ttgcctctgtccccttct

SEQ ID NO: 4752908 - DNA, 15 bp, Homo sapiens
ttgcctcttttcaca

SEQ ID NO: 4752909 - DNA, 18 bp, Homo sapiens
ttgcctgggacggctgag

SEQ ID NO: 4752910 - DNA, 16 bp, Homo sapiens
ttgccttgacaaactt

SEQ ID NO: 4752911 - DNA, 23 bp, Homo sapiens
ttgcctttagtgatcacagcagc

SEQ ID NO: 4752912 - DNA, 18 bp, Homo sapiens
ttgccttttctagcccga

SEQ ID NO: 4752913 - DNA, 12 bp, Homo sapiens
ttgcgagagatg

SEQ ID NO: 4752914 - DNA, 15 bp, Homo sapiens
ttgcgagagatgtgt

SEQ ID NO: 4752915 - DNA, 19 bp, Homo sapiens
ttgcgagagatgtgtgttg

SEQ ID NO: 4752916 - DNA, 21 bp, Homo sapiens
ttgcgtggaattgtgctgagt

SEQ ID NO: 4752917 - DNA, 20 bp, Homo sapiens
ttgctctgccaacttcttca

SEQ ID NO: 4752918 - DNA, 14 bp, Homo sapiens
ttgctgatctttgt

SEQ ID NO: 4752919 - DNA, 15 bp, Homo sapiens
ttgctgatctttgtc

SEQ ID NO: 4752920 - DNA, 16 bp, Homo sapiens
ttgctgatgtttataa

SEQ ID NO: 4752921 - DNA, 11 bp, Homo sapiens
ttgctgcctca

SEQ ID NO: 4752922 - DNA, 14 bp, Homo sapiens
ttgctgctgtggaa

SEQ ID NO: 4752923 - DNA, 20 bp, Homo sapiens
ttgctgtagaagatggcact

SEQ ID NO: 4752924 - DNA, 13 bp, Homo sapiens
ttgctgttttaat

SEQ ID NO: 4752925 - DNA, 14 bp, Homo sapiens
ttgctttgtttaag

SEQ ID NO: 4752926 - DNA, 14 bp, Homo sapiens
ttggaaaagaaatc

SEQ ID NO: 4752927 - DNA, 12 bp, Homo sapiens
ttggaaaataaa

SEQ ID NO: 4752928 - DNA, 17 bp, Homo sapiens
ttggaaagagtaggaag

SEQ ID NO: 4752929 - DNA, 18 bp, Homo sapiens
ttggaaagagtaggaaga

SEQ ID NO: 4752930 - DNA, 23 bp, Homo sapiens
ttggaaagagtaggaagactttg

SEQ ID NO: 4752931 - DNA, 16 bp, Homo sapiens
ttggaactggaggcag

SEQ ID NO: 4752932 - DNA, 21 bp, Homo sapiens
ttggaagctagctcccctcct

SEQ ID NO: 4752933 - DNA, 23 bp, Homo sapiens
ttggaagctagctcccctcctct

SEQ ID NO: 4752934 - DNA, 16 bp, Homo sapiens
ttggaagttgcatggc

SEQ ID NO: 4752935 - DNA, 22 bp, Homo sapiens
ttggaatattccactatttgca

SEQ ID NO: 4752936 - DNA, 21 bp, Homo sapiens
ttggaatcttcacctcagagt

SEQ ID NO: 4752937 - DNA, 19 bp, Homo sapiens
ttggacagaagcagctctt

SEQ ID NO: 4752938 - DNA, 18 bp, Homo sapiens
ttggaccctgaggcccag

SEQ ID NO: 4752939 - DNA, 21 bp, Homo sapiens
ttggaccctgaggcccagagg

SEQ ID NO: 4752940 - DNA, 20 bp, Homo sapiens
ttggacctcattttattaaa

SEQ ID NO: 4752941 - DNA, 14 bp, Homo sapiens
ttggagcttcatgg

SEQ ID NO: 4752942 - DNA, 12 bp, Homo sapiens
ttggaggatttg

SEQ ID NO: 4752943 - DNA, 16 bp, Homo sapiens
ttggagggtgtcccaa

SEQ ID NO: 4752944 - DNA, 13 bp, Homo sapiens
ttggatgaggagt

SEQ ID NO: 4752945 - DNA, 18 bp, Homo sapiens
ttggattatttaataaca

SEQ ID NO: 4752946 - DNA, 21 bp, Homo sapiens
ttggattatttaataacatta

SEQ ID NO: 4752947 - DNA, 19 bp, Homo sapiens
ttggatttaaaagcctgct

SEQ ID NO: 4752948 - DNA, 17 bp, Homo sapiens
ttggcaatgccatcatc

SEQ ID NO: 4752949 - DNA, 18 bp, Homo sapiens
ttggcacttattgaatat

SEQ ID NO: 4752950 - DNA, 21 bp, Homo sapiens
ttggcagcaggtgctgctacc

SEQ ID NO: 4752951 - DNA, 24 bp, Homo sapiens
ttggccaaagccaaagctaggcct

SEQ ID NO: 4752952 - DNA, 18 bp, Homo sapiens
ttggcctggcaaaataaa

SEQ ID NO: 4752953 - DNA, 19 bp, Homo sapiens
ttggcgcaccctcccctcc

SEQ ID NO: 4752954 - DNA, 22 bp, Homo sapiens
ttggctaggacccctccatgtg

SEQ ID NO: 4752955 - DNA, 17 bp, Homo sapiens
ttggctcacactgagaa

SEQ ID NO: 4752956 - DNA, 13 bp, Homo sapiens
ttggctgcaggga

SEQ ID NO: 4752957 - DNA, 17 bp, Homo sapiens
ttgggccatactggcct

SEQ ID NO: 4752958 - DNA, 19 bp, Homo sapiens
ttgggccatactggcctcg

SEQ ID NO: 4752959 - DNA, 17 bp, Homo sapiens
ttggggtacccactgct

SEQ ID NO: 4752960 - DNA, 22 bp, Homo sapiens
ttggggtacccactgctctggt

SEQ ID NO: 4752961 - DNA, 23 bp, Homo sapiens
ttgggtagaaagagatacagagg

SEQ ID NO: 4752962 - DNA, 16 bp, Homo sapiens
ttgggtggatgcctgg

SEQ ID NO: 4752963 - DNA, 17 bp, Homo sapiens
ttggtaactaatgttat

SEQ ID NO: 4752964 - DNA, 15 bp, Homo sapiens
ttggtaagagttaaa

SEQ ID NO: 4752965 - DNA, 21 bp, Homo sapiens
ttggtgaacattgcaatagaa

SEQ ID NO: 4752966 - DNA, 19 bp, Homo sapiens
ttggttaggcattgtggga

SEQ ID NO: 4752967 - DNA, 18 bp, Homo sapiens
ttggttcccccactgatc

SEQ ID NO: 4752968 - DNA, 14 bp, Homo sapiens
ttggttttgttccc

SEQ ID NO: 4752969 - DNA, 17 bp, Homo sapiens
ttggttttgttcccctc

SEQ ID NO: 4752970 - DNA, 18 bp, Homo sapiens
ttggttttgttcccctcc

SEQ ID NO: 4752971 - DNA, 22 bp, Homo sapiens
ttgtaaaaaaaaatgcctttga

SEQ ID NO: 4752972 - DNA, 20 bp, Homo sapiens
ttgtaaaacagctaaatttg

SEQ ID NO: 4752973 - DNA, 17 bp, Homo sapiens
ttgtaaatagctcaggt

SEQ ID NO: 4752974 - DNA, 16 bp, Homo sapiens
ttgtaaatgtggtaaa

SEQ ID NO: 4752975 - DNA, 21 bp, Homo sapiens
ttgtaaatgtggtaaagagtt

SEQ ID NO: 4752976 - DNA, 19 bp, Homo sapiens
ttgtaagagtgtagaagca

SEQ ID NO: 4752977 - DNA, 21 bp, Homo sapiens
ttgtaagagtgtagaagcatt

SEQ ID NO: 4752978 - DNA, 13 bp, Homo sapiens
ttgtaagtttcag

SEQ ID NO: 4752979 - DNA, 19 bp, Homo sapiens
ttgtaagtttcaggtgaca

SEQ ID NO: 4752980 - DNA, 12 bp, Homo sapiens
ttgtaatatttc

SEQ ID NO: 4752981 - DNA, 22 bp, Homo sapiens
ttgtaatatttcttcaagtgag

SEQ ID NO: 4752982 - DNA, 19 bp, Homo sapiens
ttgtacaattaagttacaa

SEQ ID NO: 4752983 - DNA, 12 bp, Homo sapiens
ttgtacagtttt

SEQ ID NO: 4752984 - DNA, 14 bp, Homo sapiens
ttgtattctctgag

SEQ ID NO: 4752985 - DNA, 15 bp, Homo sapiens
ttgtattctctgagc

SEQ ID NO: 4752986 - DNA, 15 bp, Homo sapiens
ttgtatttatttagt

SEQ ID NO: 4752987 - DNA, 16 bp, Homo sapiens
ttgtcaatactgagcc

SEQ ID NO: 4752988 - DNA, 17 bp, Homo sapiens
ttgtcacacactttggc

SEQ ID NO: 4752989 - DNA, 15 bp, Homo sapiens
ttgtcatgtgtatga

SEQ ID NO: 4752990 - DNA, 12 bp, Homo sapiens
ttgtccccacac

SEQ ID NO: 4752991 - DNA, 15 bp, Homo sapiens
ttgtccccacactcc

SEQ ID NO: 4752992 - DNA, 20 bp, Homo sapiens
ttgtccccaccgcagacagg

SEQ ID NO: 4752993 - DNA, 16 bp, Homo sapiens
ttgtcctatgggagtc

SEQ ID NO: 4752994 - DNA, 14 bp, Homo sapiens
ttgtctatgggact

SEQ ID NO: 4752995 - DNA, 15 bp, Homo sapiens
ttgtctccctggccc

SEQ ID NO: 4752996 - DNA, 15 bp, Homo sapiens
ttgtctcctaaattg

SEQ ID NO: 4752997 - DNA, 15 bp, Homo sapiens
ttgtcttctccccag

SEQ ID NO: 4752998 - DNA, 13 bp, Homo sapiens
ttgtctttctttg

SEQ ID NO: 4752999 - DNA, 15 bp, Homo sapiens
ttgtctttggaccct

SEQ ID NO: 4753000 - DNA, 22 bp, Homo sapiens
ttgtgaaggcaggggaatgtat

SEQ ID NO: 4753001 - DNA, 13 bp, Homo sapiens
ttgtgaatgtgac

SEQ ID NO: 4753002 - DNA, 18 bp, Homo sapiens
ttgtgaggaagccgctgg

SEQ ID NO: 4753003 - DNA, 23 bp, Homo sapiens
ttgtgatttcccgtggccccagc

SEQ ID NO: 4753004 - DNA, 15 bp, Homo sapiens
ttgtgcctaatgtgt

SEQ ID NO: 4753005 - DNA, 15 bp, Homo sapiens
ttgtggctccctggg

SEQ ID NO: 4753006 - DNA, 15 bp, Homo sapiens
ttgtgtatatttaag

SEQ ID NO: 4753007 - DNA, 22 bp, Homo sapiens
ttgtgtctgaaaatatctcttg

SEQ ID NO: 4753008 - DNA, 13 bp, Homo sapiens
ttgtgttgtacaa

SEQ ID NO: 4753009 - DNA, 19 bp, Homo sapiens
ttgtgtttctttagttttt

SEQ ID NO: 4753010 - DNA, 20 bp, Homo sapiens
ttgttaatgcctataacttt

SEQ ID NO: 4753011 - DNA, 15 bp, Homo sapiens
ttgttaattcttatt

SEQ ID NO: 4753012 - DNA, 16 bp, Homo sapiens
ttgttacgtagcctaa

SEQ ID NO: 4753013 - DNA, 19 bp, Homo sapiens
ttgttactgtctgtagtgt

SEQ ID NO: 4753014 - DNA, 19 bp, Homo sapiens
ttgttataacttcataaaa

SEQ ID NO: 4753015 - DNA, 20 bp, Homo sapiens
ttgttatttattgaaatgat

SEQ ID NO: 4753016 - DNA, 18 bp, Homo sapiens
ttgttcattcttgttcaa

SEQ ID NO: 4753017 - DNA, 22 bp, Homo sapiens
ttgttccaaatgtgtataattt

SEQ ID NO: 4753018 - DNA, 19 bp, Homo sapiens
ttgttccagagctgcttct

SEQ ID NO: 4753019 - DNA, 13 bp, Homo sapiens
ttgttcccctcct

SEQ ID NO: 4753020 - DNA, 14 bp, Homo sapiens
ttgttcccctcctc

SEQ ID NO: 4753021 - DNA, 15 bp, Homo sapiens
ttgttcccctcctcc

SEQ ID NO: 4753022 - DNA, 16 bp, Homo sapiens
ttgttcccctcctcca

SEQ ID NO: 4753023 - DNA, 18 bp, Homo sapiens
ttgttcccctcctccact

SEQ ID NO: 4753024 - DNA, 22 bp, Homo sapiens
ttgttctggctcttccaggctg

SEQ ID NO: 4753025 - DNA, 18 bp, Homo sapiens
ttgttctgggtgatttct

SEQ ID NO: 4753026 - DNA, 22 bp, Homo sapiens
ttgttctgggtgatttctagaa

SEQ ID NO: 4753027 - DNA, 12 bp, Homo sapiens
ttgttctgtata

SEQ ID NO: 4753028 - DNA, 19 bp, Homo sapiens
ttgttcttataagaagaag

SEQ ID NO: 4753029 - DNA, 13 bp, Homo sapiens
ttgttcttgtcat

SEQ ID NO: 4753030 - DNA, 15 bp, Homo sapiens
ttgtttataataaaa

SEQ ID NO: 4753031 - DNA, 18 bp, Homo sapiens
ttgtttataataaaaata

SEQ ID NO: 4753032 - DNA, 15 bp, Homo sapiens
ttgtttattgtaaaa

SEQ ID NO: 4753033 - DNA, 13 bp, Homo sapiens
ttgtttcaaaaaa

SEQ ID NO: 4753034 - DNA, 16 bp, Homo sapiens
ttgtttctacctccca

SEQ ID NO: 4753035 - DNA, 13 bp, Homo sapiens
ttgtttctttctg

SEQ ID NO: 4753036 - DNA, 20 bp, Homo sapiens
ttgtttggagggatcatttt

SEQ ID NO: 4753037 - DNA, 17 bp, Homo sapiens
ttgttttcccgccaagc

SEQ ID NO: 4753038 - DNA, 14 bp, Homo sapiens
ttgttttctctgtg

SEQ ID NO: 4753039 - DNA, 17 bp, Homo sapiens
tttaaaaaaatttaagt

SEQ ID NO: 4753040 - DNA, 15 bp, Homo sapiens
tttaaaaattgttat

SEQ ID NO: 4753041 - DNA, 15 bp, Homo sapiens
tttaaaactgttgga

SEQ ID NO: 4753042 - DNA, 22 bp, Homo sapiens
tttaaaactgttggaatggatt

SEQ ID NO: 4753043 - DNA, 11 bp, Homo sapiens
tttaaaacttg

SEQ ID NO: 4753044 - DNA, 14 bp, Homo sapiens
tttaaaagcctgct

SEQ ID NO: 4753045 - DNA, 18 bp, Homo sapiens
tttaaaagtttgtccttt

SEQ ID NO: 4753046 - DNA, 18 bp, Homo sapiens
tttaaaagttttgttctt

SEQ ID NO: 4753047 - DNA, 15 bp, Homo sapiens
tttaaaatctgtcac

SEQ ID NO: 4753048 - DNA, 12 bp, Homo sapiens
tttaaaatgtct

SEQ ID NO: 4753049 - DNA, 13 bp, Homo sapiens
tttaaaatttctt

SEQ ID NO: 4753050 - DNA, 11 bp, Homo sapiens
tttaaagaaaa

SEQ ID NO: 4753051 - DNA, 21 bp, Homo sapiens
tttaaagaaaagttttgtaaa

SEQ ID NO: 4753052 - DNA, 13 bp, Homo sapiens
tttaaaggacaaa

SEQ ID NO: 4753053 - DNA, 20 bp, Homo sapiens
tttaaaggataatggtgaac

SEQ ID NO: 4753054 - DNA, 15 bp, Homo sapiens
tttaaagttgtataa

SEQ ID NO: 4753055 - DNA, 19 bp, Homo sapiens
tttaaatcctgaagagcat

SEQ ID NO: 4753056 - DNA, 21 bp, Homo sapiens
tttaaatgaaagtgagacttt

SEQ ID NO: 4753057 - DNA, 22 bp, Homo sapiens
tttaaatgtacttatattaaga

SEQ ID NO: 4753058 - DNA, 19 bp, Homo sapiens
tttaaattgttataacttc

SEQ ID NO: 4753059 - DNA, 23 bp, Homo sapiens
tttaacaactatgatttggaaaa

SEQ ID NO: 4753060 - DNA, 12 bp, Homo sapiens
tttaaccctcac

SEQ ID NO: 4753061 - DNA, 12 bp, Homo sapiens
tttaactgtgga

SEQ ID NO: 4753062 - DNA, 17 bp, Homo sapiens
tttaagaactaaaatgt

SEQ ID NO: 4753063 - DNA, 14 bp, Homo sapiens
tttaagatttttct

SEQ ID NO: 4753064 - DNA, 18 bp, Homo sapiens
tttaagatttttctcaaa

SEQ ID NO: 4753065 - DNA, 21 bp, Homo sapiens
tttaagtcaacactatatatt

SEQ ID NO: 4753066 - DNA, 20 bp, Homo sapiens
tttaagtgcgtgtgtagagt

SEQ ID NO: 4753067 - DNA, 14 bp, Homo sapiens
tttaagttttattt

SEQ ID NO: 4753068 - DNA, 18 bp, Homo sapiens
tttaagttttatttaact

SEQ ID NO: 4753069 - DNA, 20 bp, Homo sapiens
tttaataacattaccttact

SEQ ID NO: 4753070 - DNA, 23 bp, Homo sapiens
tttaataacattaccttactgtg

SEQ ID NO: 4753071 - DNA, 22 bp, Homo sapiens
tttaataatgtatgtacagctg

SEQ ID NO: 4753072 - DNA, 20 bp, Homo sapiens
tttaatcctgtaccaaatct

SEQ ID NO: 4753073 - DNA, 15 bp, Homo sapiens
tttaatctaaattta

SEQ ID NO: 4753074 - DNA, 20 bp, Homo sapiens
tttaattgtccagtttgtct

SEQ ID NO: 4753075 - DNA, 21 bp, Homo sapiens
tttaattgttgtttctttcta

SEQ ID NO: 4753076 - DNA, 23 bp, Homo sapiens
tttaattgttgtttctttctagt

SEQ ID NO: 4753077 - DNA, 14 bp, Homo sapiens
tttaattttcactt

SEQ ID NO: 4753078 - DNA, 19 bp, Homo sapiens
tttaatttttttgagacag

SEQ ID NO: 4753079 - DNA, 15 bp, Homo sapiens
tttacaaaaatataa

SEQ ID NO: 4753080 - DNA, 20 bp, Homo sapiens
tttacaagggcataaagtaa

SEQ ID NO: 4753081 - DNA, 18 bp, Homo sapiens
tttaccacccccacacct

SEQ ID NO: 4753082 - DNA, 20 bp, Homo sapiens
tttaccattagcataatttt

SEQ ID NO: 4753083 - DNA, 18 bp, Homo sapiens
tttactagggatccctca

SEQ ID NO: 4753084 - DNA, 18 bp, Homo sapiens
tttactcctttttattca

SEQ ID NO: 4753085 - DNA, 14 bp, Homo sapiens
tttagaaattataa

SEQ ID NO: 4753086 - DNA, 17 bp, Homo sapiens
tttagatgaatgtcagt

SEQ ID NO: 4753087 - DNA, 18 bp, Homo sapiens
tttagcaatgctgtgaat

SEQ ID NO: 4753088 - DNA, 20 bp, Homo sapiens
tttagcgcacccagagaaaa

SEQ ID NO: 4753089 - DNA, 13 bp, Homo sapiens
tttagctatttaa

SEQ ID NO: 4753090 - DNA, 23 bp, Homo sapiens
tttagggactcaatttctcccca

SEQ ID NO: 4753091 - DNA, 19 bp, Homo sapiens
tttaggtctcttcccctct

SEQ ID NO: 4753092 - DNA, 18 bp, Homo sapiens
tttagttttatactatat

SEQ ID NO: 4753093 - DNA, 22 bp, Homo sapiens
tttataaaagtgttcattgttt

SEQ ID NO: 4753094 - DNA, 18 bp, Homo sapiens
tttataaatttaagcatt

SEQ ID NO: 4753095 - DNA, 13 bp, Homo sapiens
tttataacaaata

SEQ ID NO: 4753096 - DNA, 13 bp, Homo sapiens
tttatactatatt

SEQ ID NO: 4753097 - DNA, 19 bp, Homo sapiens
tttatagactgatttagaa

SEQ ID NO: 4753098 - DNA, 16 bp, Homo sapiens
tttatattgttttgtc

SEQ ID NO: 4753099 - DNA, 12 bp, Homo sapiens
tttatctgtgga

SEQ ID NO: 4753100 - DNA, 19 bp, Homo sapiens
tttatctttgattctcctt

SEQ ID NO: 4753101 - DNA, 19 bp, Homo sapiens
tttatgatctatttgtaga

SEQ ID NO: 4753102 - DNA, 20 bp, Homo sapiens
tttatgccttttatttctta

SEQ ID NO: 4753103 - DNA, 19 bp, Homo sapiens
tttattaaaatatttcagg

SEQ ID NO: 4753104 - DNA, 19 bp, Homo sapiens
tttattaaatgtagaaagt

SEQ ID NO: 4753105 - DNA, 12 bp, Homo sapiens
tttattaatttg

SEQ ID NO: 4753106 - DNA, 22 bp, Homo sapiens
tttattagaataatttcatact

SEQ ID NO: 4753107 - DNA, 16 bp, Homo sapiens
tttattcaccttttct

SEQ ID NO: 4753108 - DNA, 12 bp, Homo sapiens
tttatttcacat

SEQ ID NO: 4753109 - DNA, 13 bp, Homo sapiens
tttatttcacata

SEQ ID NO: 4753110 - DNA, 20 bp, Homo sapiens
tttatttgtttgtgcatttg

SEQ ID NO: 4753111 - DNA, 17 bp, Homo sapiens
tttatttttcatttagt

SEQ ID NO: 4753112 - DNA, 13 bp, Homo sapiens
tttcaaaaatgct

SEQ ID NO: 4753113 - DNA, 21 bp, Homo sapiens
tttcaaaaatgctgttaatgt

SEQ ID NO: 4753114 - DNA, 23 bp, Homo sapiens
tttcaacggaaagtgctgtctta

SEQ ID NO: 4753115 - DNA, 18 bp, Homo sapiens
tttcaattgcatctccca

SEQ ID NO: 4753116 - DNA, 20 bp, Homo sapiens
tttcaattgcatctcccaga

SEQ ID NO: 4753117 - DNA, 19 bp, Homo sapiens
tttcaatttccaagagctg

SEQ ID NO: 4753118 - DNA, 17 bp, Homo sapiens
tttcacaattattaaat

SEQ ID NO: 4753119 - DNA, 17 bp, Homo sapiens
tttcacccctccctttc

SEQ ID NO: 4753120 - DNA, 20 bp, Homo sapiens
tttcacccctccctttctcc

SEQ ID NO: 4753121 - DNA, 22 bp, Homo sapiens
tttcagagtgactacacacagt

SEQ ID NO: 4753122 - DNA, 14 bp, Homo sapiens
tttcagatataaaa

SEQ ID NO: 4753123 - DNA, 23 bp, Homo sapiens
tttcagcacctacagtgtacagt

SEQ ID NO: 4753124 - DNA, 21 bp, Homo sapiens
tttcagcatcaaacatgaaaa

SEQ ID NO: 4753125 - DNA, 22 bp, Homo sapiens
tttcagcatcaaacatgaaaac

SEQ ID NO: 4753126 - DNA, 23 bp, Homo sapiens
tttcagcatcaaacatgaaaaca

SEQ ID NO: 4753127 - DNA, 14 bp, Homo sapiens
tttcagcttctgct

SEQ ID NO: 4753128 - DNA, 19 bp, Homo sapiens
tttcagcttctgctgggct

SEQ ID NO: 4753129 - DNA, 17 bp, Homo sapiens
tttcaggagcagcctca

SEQ ID NO: 4753130 - DNA, 15 bp, Homo sapiens
tttcaggtgacatgt

SEQ ID NO: 4753131 - DNA, 20 bp, Homo sapiens
tttcaggtgacatgtgaaac

SEQ ID NO: 4753132 - DNA, 21 bp, Homo sapiens
tttcagtcaattctgatgtta

SEQ ID NO: 4753133 - DNA, 22 bp, Homo sapiens
tttcagtcaattctgatgttac

SEQ ID NO: 4753134 - DNA, 16 bp, Homo sapiens
tttcagtgctgctgaa

SEQ ID NO: 4753135 - DNA, 18 bp, Homo sapiens
tttcagttctgtgtacat

SEQ ID NO: 4753136 - DNA, 20 bp, Homo sapiens
tttcagttctttctttttct

SEQ ID NO: 4753137 - DNA, 15 bp, Homo sapiens
tttcagtttaattct

SEQ ID NO: 4753138 - DNA, 15 bp, Homo sapiens
tttcagttttcagga

SEQ ID NO: 4753139 - DNA, 18 bp, Homo sapiens
tttcataaattatttgat

SEQ ID NO: 4753140 - DNA, 19 bp, Homo sapiens
tttcataaattatttgatt

SEQ ID NO: 4753141 - DNA, 17 bp, Homo sapiens
tttcataagtatttcaa

SEQ ID NO: 4753142 - DNA, 17 bp, Homo sapiens
tttcatatattattccg

SEQ ID NO: 4753143 - DNA, 16 bp, Homo sapiens
tttcatgattagaaat

SEQ ID NO: 4753144 - DNA, 15 bp, Homo sapiens
tttcattacttttaa

SEQ ID NO: 4753145 - DNA, 23 bp, Homo sapiens
tttccacggagccactcctctga

SEQ ID NO: 4753146 - DNA, 23 bp, Homo sapiens
tttccagaaagaaaatgaatttg

SEQ ID NO: 4753147 - DNA, 18 bp, Homo sapiens
tttccaggaaaaagaact

SEQ ID NO: 4753148 - DNA, 15 bp, Homo sapiens
tttccaggctggttc

SEQ ID NO: 4753149 - DNA, 22 bp, Homo sapiens
tttccaggctggttcggatttg

SEQ ID NO: 4753150 - DNA, 19 bp, Homo sapiens
tttccatatttaacctatt

SEQ ID NO: 4753151 - DNA, 12 bp, Homo sapiens
tttcccaattca

SEQ ID NO: 4753152 - DNA, 15 bp, Homo sapiens
tttcccaattcacat

SEQ ID NO: 4753153 - DNA, 13 bp, Homo sapiens
tttcccgccaagc

SEQ ID NO: 4753154 - DNA, 17 bp, Homo sapiens
tttcctatttccccaaa

SEQ ID NO: 4753155 - DNA, 14 bp, Homo sapiens
tttcctcattttga

SEQ ID NO: 4753156 - DNA, 12 bp, Homo sapiens
tttcctctgagc

SEQ ID NO: 4753157 - DNA, 21 bp, Homo sapiens
tttcctctttggtctacactg

SEQ ID NO: 4753158 - DNA, 16 bp, Homo sapiens
tttcctgaggctgggc

SEQ ID NO: 4753159 - DNA, 13 bp, Homo sapiens
tttcctgccctgg

SEQ ID NO: 4753160 - DNA, 13 bp, Homo sapiens
tttcctgtgacac

SEQ ID NO: 4753161 - DNA, 21 bp, Homo sapiens
tttccttgtccccacactcct

SEQ ID NO: 4753162 - DNA, 22 bp, Homo sapiens
tttcctttaaaaaaatttaagt

SEQ ID NO: 4753163 - DNA, 16 bp, Homo sapiens
tttctaaaactgcctt

SEQ ID NO: 4753164 - DNA, 20 bp, Homo sapiens
tttctaaagcagtttattat

SEQ ID NO: 4753165 - DNA, 23 bp, Homo sapiens
tttctacagagaaaatgaatttg

SEQ ID NO: 4753166 - DNA, 13 bp, Homo sapiens
tttctacctccca

SEQ ID NO: 4753167 - DNA, 18 bp, Homo sapiens
tttctactttgaagtcat

SEQ ID NO: 4753168 - DNA, 16 bp, Homo sapiens
tttctagaatggtttt

SEQ ID NO: 4753169 - DNA, 19 bp, Homo sapiens
tttctagcccgaatacaaa

SEQ ID NO: 4753170 - DNA, 20 bp, Homo sapiens
tttctagtggtctttgtaag

SEQ ID NO: 4753171 - DNA, 23 bp, Homo sapiens
tttctagtggtctttgtaagagt

SEQ ID NO: 4753172 - DNA, 18 bp, Homo sapiens
tttctatgtatgtgccaa

SEQ ID NO: 4753173 - DNA, 17 bp, Homo sapiens
tttctatttctcctcca

SEQ ID NO: 4753174 - DNA, 15 bp, Homo sapiens
tttctcaaagaaatt

SEQ ID NO: 4753175 - DNA, 18 bp, Homo sapiens
tttctcatgaatctgcaa

SEQ ID NO: 4753176 - DNA, 22 bp, Homo sapiens
tttctccaaataaaaattagat

SEQ ID NO: 4753177 - DNA, 12 bp, Homo sapiens
tttctccccagg

SEQ ID NO: 4753178 - DNA, 21 bp, Homo sapiens
tttctcccccatgttctgtcc

SEQ ID NO: 4753179 - DNA, 13 bp, Homo sapiens
tttctcccctgcc

SEQ ID NO: 4753180 - DNA, 20 bp, Homo sapiens
tttctgaaaattaacactgc

SEQ ID NO: 4753181 - DNA, 13 bp, Homo sapiens
tttctgccttcct

SEQ ID NO: 4753182 - DNA, 13 bp, Homo sapiens
tttctgtgtttag

SEQ ID NO: 4753183 - DNA, 19 bp, Homo sapiens
tttctgtgtttagctattt

SEQ ID NO: 4753184 - DNA, 13 bp, Homo sapiens
tttcttagctttt

SEQ ID NO: 4753185 - DNA, 16 bp, Homo sapiens
tttcttagctttttaa

SEQ ID NO: 4753186 - DNA, 23 bp, Homo sapiens
tttcttatgtgggtcttatgctt

SEQ ID NO: 4753187 - DNA, 23 bp, Homo sapiens
tttcttctcctgtgatgtcccag

SEQ ID NO: 4753188 - DNA, 21 bp, Homo sapiens
tttcttgatcaacatcttttc

SEQ ID NO: 4753189 - DNA, 18 bp, Homo sapiens
tttcttgcctctgtcccc

SEQ ID NO: 4753190 - DNA, 15 bp, Homo sapiens
tttctttaaattttg

SEQ ID NO: 4753191 - DNA, 13 bp, Homo sapiens
tttctttaactgc

SEQ ID NO: 4753192 - DNA, 13 bp, Homo sapiens
tttctttaagttt

SEQ ID NO: 4753193 - DNA, 13 bp, Homo sapiens
tttctttctagtg

SEQ ID NO: 4753194 - DNA, 13 bp, Homo sapiens
tttctttctttct

SEQ ID NO: 4753195 - DNA, 14 bp, Homo sapiens
tttctttgctgctg

SEQ ID NO: 4753196 - DNA, 9 bp, Homo sapiens
tttcttttc

SEQ ID NO: 4753197 - DNA, 21 bp, Homo sapiens
tttcttttttttttctgttga

SEQ ID NO: 4753198 - DNA, 22 bp, Homo sapiens
tttcttttttttttctgttgaa

SEQ ID NO: 4753199 - DNA, 21 bp, Homo sapiens
tttgaaagaatagaacacagt

SEQ ID NO: 4753200 - DNA, 21 bp, Homo sapiens
tttgaaattgtattacaaatc

SEQ ID NO: 4753201 - DNA, 18 bp, Homo sapiens
tttgaacctgatgaaaat

SEQ ID NO: 4753202 - DNA, 20 bp, Homo sapiens
tttgaacctgatgaaaataa

SEQ ID NO: 4753203 - DNA, 21 bp, Homo sapiens
tttgaaggtagaatgttttca

SEQ ID NO: 4753204 - DNA, 17 bp, Homo sapiens
tttgaatataaacacta

SEQ ID NO: 4753205 - DNA, 14 bp, Homo sapiens
tttgaatatgtagt

SEQ ID NO: 4753206 - DNA, 19 bp, Homo sapiens
tttgaatgtgatcatcttt

SEQ ID NO: 4753207 - DNA, 20 bp, Homo sapiens
tttgaattagattatttctg

SEQ ID NO: 4753208 - DNA, 16 bp, Homo sapiens
tttgaattatgtgcac

SEQ ID NO: 4753209 - DNA, 14 bp, Homo sapiens
tttgaccaggaaag

SEQ ID NO: 4753210 - DNA, 12 bp, Homo sapiens
tttgactgtgct

SEQ ID NO: 4753211 - DNA, 17 bp, Homo sapiens
tttgagacagtttctta

SEQ ID NO: 4753212 - DNA, 19 bp, Homo sapiens
tttgagacagtttcttagc

SEQ ID NO: 4753213 - DNA, 16 bp, Homo sapiens
tttgagaccagcctgg

SEQ ID NO: 4753214 - DNA, 23 bp, Homo sapiens
tttgagcaaagaaacttgtgctt

SEQ ID NO: 4753215 - DNA, 20 bp, Homo sapiens
tttgaggctttcaggtttta

SEQ ID NO: 4753216 - DNA, 23 bp, Homo sapiens
tttgataacattttgtttatgtt

SEQ ID NO: 4753217 - DNA, 21 bp, Homo sapiens
tttgatacagtattgaaaaat

SEQ ID NO: 4753218 - DNA, 22 bp, Homo sapiens
tttgatacagtcaacaagcctg

SEQ ID NO: 4753219 - DNA, 15 bp, Homo sapiens
tttgattcagacagc

SEQ ID NO: 4753220 - DNA, 18 bp, Homo sapiens
tttgattcagacagctgc

SEQ ID NO: 4753221 - DNA, 13 bp, Homo sapiens
tttgattctcctt

SEQ ID NO: 4753222 - DNA, 16 bp, Homo sapiens
tttgattctccttcag

SEQ ID NO: 4753223 - DNA, 14 bp, Homo sapiens
tttgattttgctga

SEQ ID NO: 4753224 - DNA, 23 bp, Homo sapiens
tttgattttgctgactttaaaag

SEQ ID NO: 4753225 - DNA, 19 bp, Homo sapiens
tttgcaacagtaatcagag

SEQ ID NO: 4753226 - DNA, 23 bp, Homo sapiens
tttgcaagcttatttagcacatt

SEQ ID NO: 4753227 - DNA, 14 bp, Homo sapiens
tttgcaaggaagcc

SEQ ID NO: 4753228 - DNA, 20 bp, Homo sapiens
tttgcataacaattcctcta

SEQ ID NO: 4753229 - DNA, 14 bp, Homo sapiens
tttgcatatatgtt

SEQ ID NO: 4753230 - DNA, 16 bp, Homo sapiens
tttgcattcttattca

SEQ ID NO: 4753231 - DNA, 19 bp, Homo sapiens
tttgcattgaggaaatatt

SEQ ID NO: 4753232 - DNA, 14 bp, Homo sapiens
tttgccatgggctt

SEQ ID NO: 4753233 - DNA, 13 bp, Homo sapiens
tttgccctcccat

SEQ ID NO: 4753234 - DNA, 12 bp, Homo sapiens
tttgccctttga

SEQ ID NO: 4753235 - DNA, 17 bp, Homo sapiens
tttgcctaccatttcac

SEQ ID NO: 4753236 - DNA, 13 bp, Homo sapiens
tttgcctctgcct

SEQ ID NO: 4753237 - DNA, 22 bp, Homo sapiens
tttgctaactagcttggaaact

SEQ ID NO: 4753238 - DNA, 19 bp, Homo sapiens
tttgctgaaaacattacat

SEQ ID NO: 4753239 - DNA, 15 bp, Homo sapiens
tttgctttgcccagc

SEQ ID NO: 4753240 - DNA, 23 bp, Homo sapiens
tttggaatattccactatttgca

SEQ ID NO: 4753241 - DNA, 16 bp, Homo sapiens
tttggcaacagaaaac

SEQ ID NO: 4753242 - DNA, 21 bp, Homo sapiens
tttggcaggaagatgtatgct

SEQ ID NO: 4753243 - DNA, 13 bp, Homo sapiens
tttggcaggtgca

SEQ ID NO: 4753244 - DNA, 21 bp, Homo sapiens
tttggcccttctccttttgaa

SEQ ID NO: 4753245 - DNA, 21 bp, Homo sapiens
tttggtatgttgggataagga

SEQ ID NO: 4753246 - DNA, 13 bp, Homo sapiens
tttggtccctggg

SEQ ID NO: 4753247 - DNA, 22 bp, Homo sapiens
tttggtgaacattgcaatagaa

SEQ ID NO: 4753248 - DNA, 22 bp, Homo sapiens
tttgtaaagttgcctttatttg

SEQ ID NO: 4753249 - DNA, 13 bp, Homo sapiens
tttgtaacattag

SEQ ID NO: 4753250 - DNA, 22 bp, Homo sapiens
tttgtaacattagttttaaaaa

SEQ ID NO: 4753251 - DNA, 21 bp, Homo sapiens
tttgtaagagtgtagaagcat

SEQ ID NO: 4753252 - DNA, 22 bp, Homo sapiens
tttgtaagagtgtagaagcatt

SEQ ID NO: 4753253 - DNA, 21 bp, Homo sapiens
tttgtaagtttcaggtgacat

SEQ ID NO: 4753254 - DNA, 12 bp, Homo sapiens
tttgtaattatt

SEQ ID NO: 4753255 - DNA, 14 bp, Homo sapiens
tttgtaattattgt

SEQ ID NO: 4753256 - DNA, 19 bp, Homo sapiens
tttgtatttattaatttga

SEQ ID NO: 4753257 - DNA, 15 bp, Homo sapiens
tttgtcttctcccca

SEQ ID NO: 4753258 - DNA, 16 bp, Homo sapiens
tttgtcttctccccag

SEQ ID NO: 4753259 - DNA, 17 bp, Homo sapiens
tttgtgaatggattgga

SEQ ID NO: 4753260 - DNA, 21 bp, Homo sapiens
tttgtgaatttgcaacagtaa

SEQ ID NO: 4753261 - DNA, 15 bp, Homo sapiens
tttgtgttgtacaat

SEQ ID NO: 4753262 - DNA, 19 bp, Homo sapiens
tttgttaccttttacagaa

SEQ ID NO: 4753263 - DNA, 15 bp, Homo sapiens
tttgttactgtctgt

SEQ ID NO: 4753264 - DNA, 18 bp, Homo sapiens
tttgttatttacactggt

SEQ ID NO: 4753265 - DNA, 20 bp, Homo sapiens
tttgttatttacactggtct

SEQ ID NO: 4753266 - DNA, 13 bp, Homo sapiens
tttgttcccctcc

SEQ ID NO: 4753267 - DNA, 18 bp, Homo sapiens
tttgttcccctcctccac

SEQ ID NO: 4753268 - DNA, 15 bp, Homo sapiens
tttgtttacaaacat

SEQ ID NO: 4753269 - DNA, 13 bp, Homo sapiens
tttgtttcatatt

SEQ ID NO: 4753270 - DNA, 12 bp, Homo sapiens
tttgtttttcat

SEQ ID NO: 4753271 - DNA, 22 bp, Homo sapiens
ttttaaaaacactacttttgct

SEQ ID NO: 4753272 - DNA, 13 bp, Homo sapiens
ttttaaaaatgta

SEQ ID NO: 4753273 - DNA, 19 bp, Homo sapiens
ttttaaaaatgtagaaatt

SEQ ID NO: 4753274 - DNA, 19 bp, Homo sapiens
ttttaaaagttttgttctt

SEQ ID NO: 4753275 - DNA, 12 bp, Homo sapiens
ttttaaacagtg

SEQ ID NO: 4753276 - DNA, 19 bp, Homo sapiens
ttttaaacagtgtttatga

SEQ ID NO: 4753277 - DNA, 20 bp, Homo sapiens
ttttaaaccctattggtaaa

SEQ ID NO: 4753278 - DNA, 14 bp, Homo sapiens
ttttaaagaaaagt

SEQ ID NO: 4753279 - DNA, 17 bp, Homo sapiens
ttttaaagaaaatgtgt

SEQ ID NO: 4753280 - DNA, 14 bp, Homo sapiens
ttttaaagaatttc

SEQ ID NO: 4753281 - DNA, 21 bp, Homo sapiens
ttttaaagtaaccctacaaaa

SEQ ID NO: 4753282 - DNA, 23 bp, Homo sapiens
ttttaaccaagttgtttattcca

SEQ ID NO: 4753283 - DNA, 19 bp, Homo sapiens
ttttaactgcctttttgtc

SEQ ID NO: 4753284 - DNA, 21 bp, Homo sapiens
ttttaagacattttcatgctt

SEQ ID NO: 4753285 - DNA, 19 bp, Homo sapiens
ttttaagatttttctcaaa

SEQ ID NO: 4753286 - DNA, 16 bp, Homo sapiens
ttttaaggctgtgtga

SEQ ID NO: 4753287 - DNA, 21 bp, Homo sapiens
ttttaagtcaacactatatat

SEQ ID NO: 4753288 - DNA, 22 bp, Homo sapiens
ttttaagttacacatttttcag

SEQ ID NO: 4753289 - DNA, 21 bp, Homo sapiens
ttttaatcctgtaccaaatct

SEQ ID NO: 4753290 - DNA, 12 bp, Homo sapiens
ttttacaaaact

SEQ ID NO: 4753291 - DNA, 19 bp, Homo sapiens
ttttacctagctaattatt

SEQ ID NO: 4753292 - DNA, 15 bp, Homo sapiens
ttttactccttttta

SEQ ID NO: 4753293 - DNA, 22 bp, Homo sapiens
ttttagcatgatgaaactgtca

SEQ ID NO: 4753294 - DNA, 16 bp, Homo sapiens
ttttatagactgattt

SEQ ID NO: 4753295 - DNA, 21 bp, Homo sapiens
ttttatattgtttttgtattt

SEQ ID NO: 4753296 - DNA, 22 bp, Homo sapiens
ttttatctacccagtcatgtac

SEQ ID NO: 4753297 - DNA, 19 bp, Homo sapiens
ttttatgccttttatttct

SEQ ID NO: 4753298 - DNA, 20 bp, Homo sapiens
ttttatgtattgtgctttta

SEQ ID NO: 4753299 - DNA, 17 bp, Homo sapiens
ttttattaaacattttc

SEQ ID NO: 4753300 - DNA, 15 bp, Homo sapiens
ttttattagaataat

SEQ ID NO: 4753301 - DNA, 13 bp, Homo sapiens
ttttattatttgt

SEQ ID NO: 4753302 - DNA, 16 bp, Homo sapiens
ttttatttatagttaa

SEQ ID NO: 4753303 - DNA, 22 bp, Homo sapiens
ttttatttatagttaataatct

SEQ ID NO: 4753304 - DNA, 22 bp, Homo sapiens
ttttcagatataaaagactgac

SEQ ID NO: 4753305 - DNA, 21 bp, Homo sapiens
ttttcagcatcaaacatgaaa

SEQ ID NO: 4753306 - DNA, 22 bp, Homo sapiens
ttttcagcatcaaacatgaaaa

SEQ ID NO: 4753307 - DNA, 13 bp, Homo sapiens
ttttcagtgtgat

SEQ ID NO: 4753308 - DNA, 13 bp, Homo sapiens
ttttccagctcct

SEQ ID NO: 4753309 - DNA, 18 bp, Homo sapiens
ttttccatgaaaatgcaa

SEQ ID NO: 4753310 - DNA, 19 bp, Homo sapiens
ttttccatgaaaatgcaac

SEQ ID NO: 4753311 - DNA, 18 bp, Homo sapiens
ttttccatgagtcccctg

SEQ ID NO: 4753312 - DNA, 12 bp, Homo sapiens
ttttcctttaaa

SEQ ID NO: 4753313 - DNA, 21 bp, Homo sapiens
ttttcctttaaaaaaatttaa

SEQ ID NO: 4753314 - DNA, 14 bp, Homo sapiens
ttttctaaagaaat

SEQ ID NO: 4753315 - DNA, 23 bp, Homo sapiens
ttttctacatcttttatacattt

SEQ ID NO: 4753316 - DNA, 21 bp, Homo sapiens
ttttctagcccgaatacaaac

SEQ ID NO: 4753317 - DNA, 13 bp, Homo sapiens
ttttctattaaaa

SEQ ID NO: 4753318 - DNA, 15 bp, Homo sapiens
ttttctcaaagtttt

SEQ ID NO: 4753319 - DNA, 14 bp, Homo sapiens
ttttctccaaataa

SEQ ID NO: 4753320 - DNA, 20 bp, Homo sapiens
ttttctctgcatttaaaaaa

SEQ ID NO: 4753321 - DNA, 20 bp, Homo sapiens
ttttctgccaggctcaacaa

SEQ ID NO: 4753322 - DNA, 14 bp, Homo sapiens
ttttctttaactgc

SEQ ID NO: 4753323 - DNA, 15 bp, Homo sapiens
ttttgaaaagctatt

SEQ ID NO: 4753324 - DNA, 16 bp, Homo sapiens
ttttgaaaagctatta

SEQ ID NO: 4753325 - DNA, 18 bp, Homo sapiens
ttttgaactttgtaggac

SEQ ID NO: 4753326 - DNA, 21 bp, Homo sapiens
ttttgaagattctatgttaat

SEQ ID NO: 4753327 - DNA, 16 bp, Homo sapiens
ttttgacacatgtgtg

SEQ ID NO: 4753328 - DNA, 17 bp, Homo sapiens
ttttgcacagccaaatt

SEQ ID NO: 4753329 - DNA, 13 bp, Homo sapiens
ttttgctgtagaa

SEQ ID NO: 4753330 - DNA, 16 bp, Homo sapiens
ttttgcttaacagttt

SEQ ID NO: 4753331 - DNA, 14 bp, Homo sapiens
ttttggctgctgaa

SEQ ID NO: 4753332 - DNA, 15 bp, Homo sapiens
ttttggtctgtgtga

SEQ ID NO: 4753333 - DNA, 21 bp, Homo sapiens
ttttggttagaagtaaggatt

SEQ ID NO: 4753334 - DNA, 19 bp, Homo sapiens
ttttgtagagccagggtct

SEQ ID NO: 4753335 - DNA, 21 bp, Homo sapiens
ttttgtgaagtttaattgact

SEQ ID NO: 4753336 - DNA, 22 bp, Homo sapiens
ttttgtgcttagttaaatcttt

SEQ ID NO: 4753337 - DNA, 15 bp, Homo sapiens
ttttgttctgtatat

SEQ ID NO: 4753338 - DNA, 15 bp, Homo sapiens
ttttgttgtgtatat

SEQ ID NO: 4753339 - DNA, 12 bp, Homo sapiens
ttttgtttcata

SEQ ID NO: 4753340 - DNA, 21 bp, Homo sapiens
tttttaaaaaaaactatttaa

SEQ ID NO: 4753341 - DNA, 22 bp, Homo sapiens
tttttaaagaaaatgtgtctgc

SEQ ID NO: 4753342 - DNA, 18 bp, Homo sapiens
tttttaaaggacaaacag

SEQ ID NO: 4753343 - DNA, 16 bp, Homo sapiens
tttttaactactgtat

SEQ ID NO: 4753344 - DNA, 13 bp, Homo sapiens
tttttaagatttt

SEQ ID NO: 4753345 - DNA, 20 bp, Homo sapiens
tttttaagctctgagctgtc

SEQ ID NO: 4753346 - DNA, 17 bp, Homo sapiens
tttttaagttcactttt

SEQ ID NO: 4753347 - DNA, 23 bp, Homo sapiens
tttttaatttacaaaaatataaa

SEQ ID NO: 4753348 - DNA, 22 bp, Homo sapiens
tttttagacagagtctcactgt

SEQ ID NO: 4753349 - DNA, 21 bp, Homo sapiens
tttttatatacgtttatataa

SEQ ID NO: 4753350 - DNA, 20 bp, Homo sapiens
tttttccaatcacagtgtta

SEQ ID NO: 4753351 - DNA, 11 bp, Homo sapiens
tttttccttta

SEQ ID NO: 4753352 - DNA, 11 bp, Homo sapiens
tttttctatta

SEQ ID NO: 4753353 - DNA, 21 bp, Homo sapiens
tttttcttttcggaaatctta

SEQ ID NO: 4753354 - DNA, 22 bp, Homo sapiens
tttttgcagctaaattaccata

SEQ ID NO: 4753355 - DNA, 20 bp, Homo sapiens
tttttggcgtggctgactta

SEQ ID NO: 4753356 - DNA, 21 bp, Homo sapiens
tttttggggggaatgacatgt

SEQ ID NO: 4753357 - DNA, 19 bp, Homo sapiens
tttttgtgaaaagctccat

SEQ ID NO: 4753358 - DNA, 19 bp, Homo sapiens
tttttgttgagtctctgaa

SEQ ID NO: 4753359 - DNA, 12 bp, Homo sapiens
ttttttaagatt

SEQ ID NO: 4753360 - DNA, 20 bp, Homo sapiens
ttttttatacactgtaatga

SEQ ID NO: 4753361 - DNA, 12 bp, Homo sapiens
ttttttgtttca

SEQ ID NO: 4753362 - DNA, 15 bp, Homo sapiens
aaaaattaattcttt

SEQ ID NO: 4753363 - DNA, 17 bp, Homo sapiens
aaaagatgaaaatattt

SEQ ID NO: 4753364 - DNA, 23 bp, Homo sapiens
aaaattaattctttatcacatgt

SEQ ID NO: 4753365 - DNA, 11 bp, Homo sapiens
aaacacagcaa

SEQ ID NO: 4753366 - DNA, 15 bp, Homo sapiens
aaacagtctcaggaa

SEQ ID NO: 4753367 - DNA, 12 bp, Homo sapiens
aaaccacagcag

SEQ ID NO: 4753368 - DNA, 16 bp, Homo sapiens
aaaccacagcagttga

SEQ ID NO: 4753369 - DNA, 23 bp, Homo sapiens
aaactgagatgtgaacacatcag

SEQ ID NO: 4753370 - DNA, 14 bp, Homo sapiens
aaactgccagcaac

SEQ ID NO: 4753371 - DNA, 15 bp, Homo sapiens
aaagactattcaaac

SEQ ID NO: 4753372 - DNA, 18 bp, Homo sapiens
aaagactattcaaacagt

SEQ ID NO: 4753373 - DNA, 21 bp, Homo sapiens
aaagactattcaaacagtctc

SEQ ID NO: 4753374 - DNA, 13 bp, Homo sapiens
aaagactccaaag

SEQ ID NO: 4753375 - DNA, 19 bp, Homo sapiens
aaagcattgtaaatgtgct

SEQ ID NO: 4753376 - DNA, 20 bp, Homo sapiens
aaagcattgtaaatgtgctt

SEQ ID NO: 4753377 - DNA, 17 bp, Homo sapiens
aaagcctgtgttactga

SEQ ID NO: 4753378 - DNA, 23 bp, Homo sapiens
aaagtatattcaaaaattatatt

SEQ ID NO: 4753379 - DNA, 19 bp, Homo sapiens
aaatacacactcaaatcaa

SEQ ID NO: 4753380 - DNA, 16 bp, Homo sapiens
aaatatgcaaagcact

SEQ ID NO: 4753381 - DNA, 16 bp, Homo sapiens
aaatcaaatatgcaaa

SEQ ID NO: 4753382 - DNA, 19 bp, Homo sapiens
aaatcaaatatgcaaagca

SEQ ID NO: 4753383 - DNA, 15 bp, Homo sapiens
aaatcacaaactcat

SEQ ID NO: 4753384 - DNA, 18 bp, Homo sapiens
aaatcacaaactcatcca

SEQ ID NO: 4753385 - DNA, 22 bp, Homo sapiens
aaatcacaaactcatccattaa

SEQ ID NO: 4753386 - DNA, 19 bp, Homo sapiens
aaatcatttctgcatcagc

SEQ ID NO: 4753387 - DNA, 22 bp, Homo sapiens
aaatcatttctgcatcagctgc

SEQ ID NO: 4753388 - DNA, 18 bp, Homo sapiens
aaatgtgccttcattttt

SEQ ID NO: 4753389 - DNA, 21 bp, Homo sapiens
aaattaattctttatcacatg

SEQ ID NO: 4753390 - DNA, 18 bp, Homo sapiens
aacacagcaagggtgatg

SEQ ID NO: 4753391 - DNA, 13 bp, Homo sapiens
aacagtctcagga

SEQ ID NO: 4753392 - DNA, 17 bp, Homo sapiens
aacagtctcaggaaatc

SEQ ID NO: 4753393 - DNA, 17 bp, Homo sapiens
aacataagctagaaaaa

SEQ ID NO: 4753394 - DNA, 20 bp, Homo sapiens
aacgcaggcccccaggtgcc

SEQ ID NO: 4753395 - DNA, 24 bp, Homo sapiens
aactcatttttgttttcattatct

SEQ ID NO: 4753396 - DNA, 21 bp, Homo sapiens
aactcgaatcactcatttatt

SEQ ID NO: 4753397 - DNA, 20 bp, Homo sapiens
aactgagatgtgaacacatc

SEQ ID NO: 4753398 - DNA, 23 bp, Homo sapiens
aactgagatgtgaacacatcagc

SEQ ID NO: 4753399 - DNA, 16 bp, Homo sapiens
aagaaacatttatctt

SEQ ID NO: 4753400 - DNA, 14 bp, Homo sapiens
aagaaatgtaaggg

SEQ ID NO: 4753401 - DNA, 14 bp, Homo sapiens
aagactattcaaac

SEQ ID NO: 4753402 - DNA, 19 bp, Homo sapiens
aagagctgttcacagccag

SEQ ID NO: 4753403 - DNA, 14 bp, Homo sapiens
aagcacctttagaa

SEQ ID NO: 4753404 - DNA, 13 bp, Homo sapiens
aagcattgtaaat

SEQ ID NO: 4753405 - DNA, 17 bp, Homo sapiens
aagggatggcaagatgt

SEQ ID NO: 4753406 - DNA, 21 bp, Homo sapiens
aagggtgatgggaaagcattg

SEQ ID NO: 4753407 - DNA, 16 bp, Homo sapiens
aagtaaaaccacagca

SEQ ID NO: 4753408 - DNA, 21 bp, Homo sapiens
aagtagggacttctgtcttca

SEQ ID NO: 4753409 - DNA, 17 bp, Homo sapiens
aataaaattcattccat

SEQ ID NO: 4753410 - DNA, 22 bp, Homo sapiens
aataaaattcattccatttgct

SEQ ID NO: 4753411 - DNA, 21 bp, Homo sapiens
aataaatgtgccttcattttt

SEQ ID NO: 4753412 - DNA, 23 bp, Homo sapiens
aatacatactatagattctttat

SEQ ID NO: 4753413 - DNA, 13 bp, Homo sapiens
aatactaataaaa

SEQ ID NO: 4753414 - DNA, 14 bp, Homo sapiens
aatactaataaaat

SEQ ID NO: 4753415 - DNA, 17 bp, Homo sapiens
aatatgcaaagcactga

SEQ ID NO: 4753416 - DNA, 24 bp, Homo sapiens
aatatgcaaagcactgacttctaa

SEQ ID NO: 4753417 - DNA, 15 bp, Homo sapiens
aatcaaatatgcaaa

SEQ ID NO: 4753418 - DNA, 14 bp, Homo sapiens
aatcaatactttga

SEQ ID NO: 4753419 - DNA, 16 bp, Homo sapiens
aatcacaaaagtatat

SEQ ID NO: 4753420 - DNA, 19 bp, Homo sapiens
aatcacaaactcatccatt

SEQ ID NO: 4753421 - DNA, 17 bp, Homo sapiens
aatcactcatttatttc

SEQ ID NO: 4753422 - DNA, 20 bp, Homo sapiens
aatgtaagggaaactgccag

SEQ ID NO: 4753423 - DNA, 23 bp, Homo sapiens
aattaattctttatcacatgttg

SEQ ID NO: 4753424 - DNA, 21 bp, Homo sapiens
aattcattccatttgctgatt

SEQ ID NO: 4753425 - DNA, 17 bp, Homo sapiens
aattccaatacattatt

SEQ ID NO: 4753426 - DNA, 17 bp, Homo sapiens
aattctttatcacatgt

SEQ ID NO: 4753427 - DNA, 22 bp, Homo sapiens
aatttcatacctatcatcttaa

SEQ ID NO: 4753428 - DNA, 15 bp, Homo sapiens
acaaaaacacagcaa

SEQ ID NO: 4753429 - DNA, 23 bp, Homo sapiens
acaaaagtatattcaaaaattat

SEQ ID NO: 4753430 - DNA, 17 bp, Homo sapiens
acacaaagcctgtgtta

SEQ ID NO: 4753431 - DNA, 15 bp, Homo sapiens
acacatcagcttgcc

SEQ ID NO: 4753432 - DNA, 19 bp, Homo sapiens
acacgagcaggctactgtc

SEQ ID NO: 4753433 - DNA, 21 bp, Homo sapiens
acagcagttgaaaagactcca

SEQ ID NO: 4753434 - DNA, 16 bp, Homo sapiens
acagccagactggcac

SEQ ID NO: 4753435 - DNA, 13 bp, Homo sapiens
acagtctcaggaa

SEQ ID NO: 4753436 - DNA, 16 bp, Homo sapiens
acagtctcaggaaatc

SEQ ID NO: 4753437 - DNA, 17 bp, Homo sapiens
acagtctcaggaaatca

SEQ ID NO: 4753438 - DNA, 15 bp, Homo sapiens
acagttttctgagaa

SEQ ID NO: 4753439 - DNA, 16 bp, Homo sapiens
acagttttctgagaaa

SEQ ID NO: 4753440 - DNA, 21 bp, Homo sapiens
acagttttctgagaaagacta

SEQ ID NO: 4753441 - DNA, 17 bp, Homo sapiens
acatactatagattctt

SEQ ID NO: 4753442 - DNA, 17 bp, Homo sapiens
acctttagaatattaaa

SEQ ID NO: 4753443 - DNA, 22 bp, Homo sapiens
acgcaggcccccaggtgccagt

SEQ ID NO: 4753444 - DNA, 13 bp, Homo sapiens
actaataaaatac

SEQ ID NO: 4753445 - DNA, 21 bp, Homo sapiens
actaataaaatacatactata

SEQ ID NO: 4753446 - DNA, 14 bp, Homo sapiens
actcaaatcaagaa

SEQ ID NO: 4753447 - DNA, 18 bp, Homo sapiens
actcatccattaatgtag

SEQ ID NO: 4753448 - DNA, 22 bp, Homo sapiens
actcatttatttccatattaaa

SEQ ID NO: 4753449 - DNA, 20 bp, Homo sapiens
actcattttaaaaaatggaa

SEQ ID NO: 4753450 - DNA, 15 bp, Homo sapiens
actccaaagaaatgt

SEQ ID NO: 4753451 - DNA, 16 bp, Homo sapiens
actgacttctaagtaa

SEQ ID NO: 4753452 - DNA, 22 bp, Homo sapiens
actgacttctaagtaaaaccac

SEQ ID NO: 4753453 - DNA, 19 bp, Homo sapiens
actggcacagttttctgag

SEQ ID NO: 4753454 - DNA, 20 bp, Homo sapiens
actggcacagttttctgaga

SEQ ID NO: 4753455 - DNA, 12 bp, Homo sapiens
acttccatttgg

SEQ ID NO: 4753456 - DNA, 19 bp, Homo sapiens
acttctaagtaaaaccaca

SEQ ID NO: 4753457 - DNA, 22 bp, Homo sapiens
acttctgtcttcacaacagatt

SEQ ID NO: 4753458 - DNA, 19 bp, Homo sapiens
agaaaaattagatgactga

SEQ ID NO: 4753459 - DNA, 16 bp, Homo sapiens
agaaagactattcaaa

SEQ ID NO: 4753460 - DNA, 18 bp, Homo sapiens
agaaagactattcaaaca

SEQ ID NO: 4753461 - DNA, 23 bp, Homo sapiens
agaaagactattcaaacagtctc

SEQ ID NO: 4753462 - DNA, 20 bp, Homo sapiens
agaagagctgttcacagcca

SEQ ID NO: 4753463 - DNA, 21 bp, Homo sapiens
agaagagctgttcacagccag

SEQ ID NO: 4753464 - DNA, 15 bp, Homo sapiens
agaatactaataaaa

SEQ ID NO: 4753465 - DNA, 20 bp, Homo sapiens
agactattcaaacagtctca

SEQ ID NO: 4753466 - DNA, 16 bp, Homo sapiens
agactccaaagaaatg

SEQ ID NO: 4753467 - DNA, 20 bp, Homo sapiens
agactggcacagttttctga

SEQ ID NO: 4753468 - DNA, 21 bp, Homo sapiens
agactggcacagttttctgag

SEQ ID NO: 4753469 - DNA, 23 bp, Homo sapiens
agagtaagcacctttagaatatt

SEQ ID NO: 4753470 - DNA, 19 bp, Homo sapiens
agatgatgatgatctttaa

SEQ ID NO: 4753471 - DNA, 14 bp, Homo sapiens
agcaaattccaata

SEQ ID NO: 4753472 - DNA, 23 bp, Homo sapiens
agcaacgcaggcccccaggtgcc

SEQ ID NO: 4753473 - DNA, 22 bp, Homo sapiens
agcaagggtgatgggaaagcat

SEQ ID NO: 4753474 - DNA, 13 bp, Homo sapiens
agcacctttagaa

SEQ ID NO: 4753475 - DNA, 16 bp, Homo sapiens
agcactgacttctaag

SEQ ID NO: 4753476 - DNA, 17 bp, Homo sapiens
agcactgacttctaagt

SEQ ID NO: 4753477 - DNA, 14 bp, Homo sapiens
agcaggctactgtc

SEQ ID NO: 4753478 - DNA, 22 bp, Homo sapiens
agcataccaacacgagcaggct

SEQ ID NO: 4753479 - DNA, 20 bp, Homo sapiens
agctcccctcggagaagagc

SEQ ID NO: 4753480 - DNA, 14 bp, Homo sapiens
agctgctgaaacaa

SEQ ID NO: 4753481 - DNA, 20 bp, Homo sapiens
agctgctgaaacaacaaata

SEQ ID NO: 4753482 - DNA, 15 bp, Homo sapiens
aggcagcttgaaact

SEQ ID NO: 4753483 - DNA, 17 bp, Homo sapiens
aggctactgtcagctcc

SEQ ID NO: 4753484 - DNA, 15 bp, Homo sapiens
agggaaactgccagc

SEQ ID NO: 4753485 - DNA, 19 bp, Homo sapiens
agggaaactgccagcaacg

SEQ ID NO: 4753486 - DNA, 13 bp, Homo sapiens
agggagagaagat

SEQ ID NO: 4753487 - DNA, 16 bp, Homo sapiens
agtaaaaccacagcag

SEQ ID NO: 4753488 - DNA, 22 bp, Homo sapiens
agtatgcactaatcaatacttt

SEQ ID NO: 4753489 - DNA, 13 bp, Homo sapiens
agtcatttaataa

SEQ ID NO: 4753490 - DNA, 13 bp, Homo sapiens
agtctcaggaaat

SEQ ID NO: 4753491 - DNA, 21 bp, Homo sapiens
agtgaagtatgcactaatcaa

SEQ ID NO: 4753492 - DNA, 17 bp, Homo sapiens
agtgtcttaattaaaag

SEQ ID NO: 4753493 - DNA, 18 bp, Homo sapiens
agtgtcttaattaaaaga

SEQ ID NO: 4753494 - DNA, 19 bp, Homo sapiens
agttatggctataggtgct

SEQ ID NO: 4753495 - DNA, 17 bp, Homo sapiens
agttttctgagaaagac

SEQ ID NO: 4753496 - DNA, 18 bp, Homo sapiens
ataaagcactgtttggat

SEQ ID NO: 4753497 - DNA, 19 bp, Homo sapiens
ataaatgtgccttcatttt

SEQ ID NO: 4753498 - DNA, 16 bp, Homo sapiens
ataacataagctagaa

SEQ ID NO: 4753499 - DNA, 17 bp, Homo sapiens
ataagctagaaaaatta

SEQ ID NO: 4753500 - DNA, 21 bp, Homo sapiens
ataataaaattcattccattt

SEQ ID NO: 4753501 - DNA, 20 bp, Homo sapiens
atacacactcaaatcaagaa

SEQ ID NO: 4753502 - DNA, 17 bp, Homo sapiens
atactaataaaatacat

SEQ ID NO: 4753503 - DNA, 13 bp, Homo sapiens
atactatagattc

SEQ ID NO: 4753504 - DNA, 21 bp, Homo sapiens
atactttgaacacaaagcctg

SEQ ID NO: 4753505 - DNA, 15 bp, Homo sapiens
ataggtgctacaaaa

SEQ ID NO: 4753506 - DNA, 21 bp, Homo sapiens
ataggtgctacaaaaacacag

SEQ ID NO: 4753507 - DNA, 15 bp, Homo sapiens
atatgcaaagcactg

SEQ ID NO: 4753508 - DNA, 17 bp, Homo sapiens
atattcaaaaattatat

SEQ ID NO: 4753509 - DNA, 20 bp, Homo sapiens
atattgataataaaattcat

SEQ ID NO: 4753510 - DNA, 16 bp, Homo sapiens
atcaaatatgcaaagc

SEQ ID NO: 4753511 - DNA, 19 bp, Homo sapiens
atcaatcacaaaagtatat

SEQ ID NO: 4753512 - DNA, 23 bp, Homo sapiens
atcaatcacaaaagtatattcaa

SEQ ID NO: 4753513 - DNA, 19 bp, Homo sapiens
atcaatttttcttatttca

SEQ ID NO: 4753514 - DNA, 18 bp, Homo sapiens
atcacaaactcatccatt

SEQ ID NO: 4753515 - DNA, 14 bp, Homo sapiens
atcactcatttatt

SEQ ID NO: 4753516 - DNA, 17 bp, Homo sapiens
atcagctgctgaaacaa

SEQ ID NO: 4753517 - DNA, 22 bp, Homo sapiens
atcagctgctgaaacaacaaat

SEQ ID NO: 4753518 - DNA, 19 bp, Homo sapiens
atctcaaaactgcactgtc

SEQ ID NO: 4753519 - DNA, 13 bp, Homo sapiens
atctttttctaac

SEQ ID NO: 4753520 - DNA, 16 bp, Homo sapiens
atgactgaatttctat

SEQ ID NO: 4753521 - DNA, 12 bp, Homo sapiens
atgcaaagcact

SEQ ID NO: 4753522 - DNA, 14 bp, Homo sapiens
atgcaaagcactga

SEQ ID NO: 4753523 - DNA, 15 bp, Homo sapiens
atggctataggtgct

SEQ ID NO: 4753524 - DNA, 19 bp, Homo sapiens
atggctataggtgctacaa

SEQ ID NO: 4753525 - DNA, 23 bp, Homo sapiens
atggctataggtgctacaaaaac

SEQ ID NO: 4753526 - DNA, 20 bp, Homo sapiens
atgggaaagcattgtaaatg

SEQ ID NO: 4753527 - DNA, 14 bp, Homo sapiens
atgtaagggaaact

SEQ ID NO: 4753528 - DNA, 22 bp, Homo sapiens
atgtaagggaaactgccagcaa

SEQ ID NO: 4753529 - DNA, 18 bp, Homo sapiens
atgtgggcagtgatgtca

SEQ ID NO: 4753530 - DNA, 15 bp, Homo sapiens
attaaaagaatattt

SEQ ID NO: 4753531 - DNA, 16 bp, Homo sapiens
attaaaagaatatttt

SEQ ID NO: 4753532 - DNA, 12 bp, Homo sapiens
attaaaatcaca

SEQ ID NO: 4753533 - DNA, 12 bp, Homo sapiens
attaattcttta

SEQ ID NO: 4753534 - DNA, 21 bp, Homo sapiens
attagtgaagtatgcactaat

SEQ ID NO: 4753535 - DNA, 23 bp, Homo sapiens
attatctcaaaactgcactgtca

SEQ ID NO: 4753536 - DNA, 17 bp, Homo sapiens
attattggacttccatt

SEQ ID NO: 4753537 - DNA, 22 bp, Homo sapiens
attcaaaaattatattttgaac

SEQ ID NO: 4753538 - DNA, 15 bp, Homo sapiens
attcaaacagtctca

SEQ ID NO: 4753539 - DNA, 16 bp, Homo sapiens
attcaaacagtctcag

SEQ ID NO: 4753540 - DNA, 15 bp, Homo sapiens
attctttatcacatg

SEQ ID NO: 4753541 - DNA, 13 bp, Homo sapiens
attgataataaaa

SEQ ID NO: 4753542 - DNA, 23 bp, Homo sapiens
attggacttccatttggaatcat

SEQ ID NO: 4753543 - DNA, 17 bp, Homo sapiens
attgtaaatgtgctttt

SEQ ID NO: 4753544 - DNA, 16 bp, Homo sapiens
attgtctgaaattttc

SEQ ID NO: 4753545 - DNA, 19 bp, Homo sapiens
attgtttaaaatcatttct

SEQ ID NO: 4753546 - DNA, 16 bp, Homo sapiens
atttaataaatgtgcc

SEQ ID NO: 4753547 - DNA, 11 bp, Homo sapiens
atttatctttg

SEQ ID NO: 4753548 - DNA, 14 bp, Homo sapiens
atttatttccatat

SEQ ID NO: 4753549 - DNA, 20 bp, Homo sapiens
atttatttccatattaaaat

SEQ ID NO: 4753550 - DNA, 16 bp, Homo sapiens
atttccatattaaaat

SEQ ID NO: 4753551 - DNA, 18 bp, Homo sapiens
atttgctgattgtctgaa

SEQ ID NO: 4753552 - DNA, 20 bp, Homo sapiens
atttgctgattgtctgaaat

SEQ ID NO: 4753553 - DNA, 14 bp, Homo sapiens
attttctagaatac

SEQ ID NO: 4753554 - DNA, 20 bp, Homo sapiens
attttctagaatactaataa

SEQ ID NO: 4753555 - DNA, 18 bp, Homo sapiens
atttttattaatttgtaa

SEQ ID NO: 4753556 - DNA, 14 bp, Homo sapiens
caaaactgcactgt

SEQ ID NO: 4753557 - DNA, 16 bp, Homo sapiens
caaacagtctcaggaa

SEQ ID NO: 4753558 - DNA, 14 bp, Homo sapiens
caaactcatccatt

SEQ ID NO: 4753559 - DNA, 16 bp, Homo sapiens
caaactcatccattaa

SEQ ID NO: 4753560 - DNA, 18 bp, Homo sapiens
caaatatgcaaagcactg

SEQ ID NO: 4753561 - DNA, 22 bp, Homo sapiens
caactcgaatcactcatttatt

SEQ ID NO: 4753562 - DNA, 14 bp, Homo sapiens
caagtccaagcata

SEQ ID NO: 4753563 - DNA, 21 bp, Homo sapiens
cacaaagcctgtgttactgat

SEQ ID NO: 4753564 - DNA, 19 bp, Homo sapiens
cacactcaaatcaagaaac

SEQ ID NO: 4753565 - DNA, 22 bp, Homo sapiens
cacagcagttgaaaagactcca

SEQ ID NO: 4753566 - DNA, 14 bp, Homo sapiens
cacagttttctgag

SEQ ID NO: 4753567 - DNA, 16 bp, Homo sapiens
cacagttttctgagaa

SEQ ID NO: 4753568 - DNA, 19 bp, Homo sapiens
cacagttttctgagaaaga

SEQ ID NO: 4753569 - DNA, 17 bp, Homo sapiens
cacctttagaatattaa

SEQ ID NO: 4753570 - DNA, 17 bp, Homo sapiens
cacgagcaggctactgt

SEQ ID NO: 4753571 - DNA, 22 bp, Homo sapiens
cacgagcaggctactgtcagct

SEQ ID NO: 4753572 - DNA, 13 bp, Homo sapiens
cactaatcaatac

SEQ ID NO: 4753573 - DNA, 14 bp, Homo sapiens
cactaatcaatact

SEQ ID NO: 4753574 - DNA, 21 bp, Homo sapiens
cactgacttctaagtaaaacc

SEQ ID NO: 4753575 - DNA, 17 bp, Homo sapiens
cagactggcacagtttt

SEQ ID NO: 4753576 - DNA, 23 bp, Homo sapiens
cagcaacgcaggcccccaggtgc

SEQ ID NO: 4753577 - DNA, 21 bp, Homo sapiens
cagcagttgaaaagactccaa

SEQ ID NO: 4753578 - DNA, 16 bp, Homo sapiens
cagctcccctcggaga

SEQ ID NO: 4753579 - DNA, 17 bp, Homo sapiens
cagctcccctcggagaa

SEQ ID NO: 4753580 - DNA, 19 bp, Homo sapiens
caggaaatcaaatatgcaa

SEQ ID NO: 4753581 - DNA, 14 bp, Homo sapiens
caggcccccaggtg

SEQ ID NO: 4753582 - DNA, 19 bp, Homo sapiens
caggcccccaggtgccagt

SEQ ID NO: 4753583 - DNA, 20 bp, Homo sapiens
caggcccccaggtgccagtt

SEQ ID NO: 4753584 - DNA, 19 bp, Homo sapiens
caggtgccagttatggcta

SEQ ID NO: 4753585 - DNA, 15 bp, Homo sapiens
cagtctcaggaaatc

SEQ ID NO: 4753586 - DNA, 19 bp, Homo sapiens
cagttatggctataggtgc

SEQ ID NO: 4753587 - DNA, 22 bp, Homo sapiens
cagttgaaaagactccaaagaa

SEQ ID NO: 4753588 - DNA, 23 bp, Homo sapiens
cagttgaaaagactccaaagaaa

SEQ ID NO: 4753589 - DNA, 21 bp, Homo sapiens
cataacataagctagaaaaat

SEQ ID NO: 4753590 - DNA, 15 bp, Homo sapiens
cataagctagaaaaa

SEQ ID NO: 4753591 - DNA, 17 bp, Homo sapiens
cataccaacacgagcag

SEQ ID NO: 4753592 - DNA, 15 bp, Homo sapiens
catactatagattct

SEQ ID NO: 4753593 - DNA, 12 bp, Homo sapiens
catattaaaatc

SEQ ID NO: 4753594 - DNA, 20 bp, Homo sapiens
catattgataataaaattca

SEQ ID NO: 4753595 - DNA, 13 bp, Homo sapiens
catcagctgctga

SEQ ID NO: 4753596 - DNA, 15 bp, Homo sapiens
catcagctgctgaaa

SEQ ID NO: 4753597 - DNA, 20 bp, Homo sapiens
catccattaatgtagataaa

SEQ ID NO: 4753598 - DNA, 12 bp, Homo sapiens
cattatctcaaa

SEQ ID NO: 4753599 - DNA, 19 bp, Homo sapiens
catttatttccatattaaa

SEQ ID NO: 4753600 - DNA, 21 bp, Homo sapiens
ccaacacgagcaggctactgt

SEQ ID NO: 4753601 - DNA, 22 bp, Homo sapiens
ccaagcataccaacacgagcag

SEQ ID NO: 4753602 - DNA, 17 bp, Homo sapiens
ccacagcagttgaaaag

SEQ ID NO: 4753603 - DNA, 23 bp, Homo sapiens
ccacagcagttgaaaagactcca

SEQ ID NO: 4753604 - DNA, 12 bp, Homo sapiens
ccaggtgccagt

SEQ ID NO: 4753605 - DNA, 17 bp, Homo sapiens
ccaggtgccagttatgg

SEQ ID NO: 4753606 - DNA, 23 bp, Homo sapiens
ccatattaaaatcacaaactcat

SEQ ID NO: 4753607 - DNA, 14 bp, Homo sapiens
ccccaggtgccagt

SEQ ID NO: 4753608 - DNA, 18 bp, Homo sapiens
cgagcaggctactgtcag

SEQ ID NO: 4753609 - DNA, 18 bp, Homo sapiens
cgcaggcccccaggtgcc

SEQ ID NO: 4753610 - DNA, 23 bp, Homo sapiens
cggagaagagctgttcacagcca

SEQ ID NO: 4753611 - DNA, 24 bp, Homo sapiens
cggagaagagctgttcacagccag

SEQ ID NO: 4753612 - DNA, 22 bp, Homo sapiens
cggtcgggttttattgtttaaa

SEQ ID NO: 4753613 - DNA, 14 bp, Homo sapiens
ctaactggactggt

SEQ ID NO: 4753614 - DNA, 22 bp, Homo sapiens
ctaagtaaaaccacagcagttg

SEQ ID NO: 4753615 - DNA, 14 bp, Homo sapiens
ctatagattcttta

SEQ ID NO: 4753616 - DNA, 22 bp, Homo sapiens
ctatagattctttattagtgaa

SEQ ID NO: 4753617 - DNA, 16 bp, Homo sapiens
ctattcaaacagtctc

SEQ ID NO: 4753618 - DNA, 23 bp, Homo sapiens
ctattcaaacagtctcaggaaat

SEQ ID NO: 4753619 - DNA, 17 bp, Homo sapiens
ctcaaaactgcactgtc

SEQ ID NO: 4753620 - DNA, 16 bp, Homo sapiens
ctcaacataacataag

SEQ ID NO: 4753621 - DNA, 23 bp, Homo sapiens
ctcatccattaatgtagataaag

SEQ ID NO: 4753622 - DNA, 12 bp, Homo sapiens
ctccaaagaaat

SEQ ID NO: 4753623 - DNA, 13 bp, Homo sapiens
ctccaaagaaatg

SEQ ID NO: 4753624 - DNA, 17 bp, Homo sapiens
ctcccagtcatttaata

SEQ ID NO: 4753625 - DNA, 14 bp, Homo sapiens
ctcccctcggagaa

SEQ ID NO: 4753626 - DNA, 12 bp, Homo sapiens
ctcggagaagag

SEQ ID NO: 4753627 - DNA, 13 bp, Homo sapiens
ctgaaattttcta

SEQ ID NO: 4753628 - DNA, 18 bp, Homo sapiens
ctgaatttctatggcata

SEQ ID NO: 4753629 - DNA, 13 bp, Homo sapiens
ctgacttctaagt

SEQ ID NO: 4753630 - DNA, 16 bp, Homo sapiens
ctgagatgtgaacaca

SEQ ID NO: 4753631 - DNA, 20 bp, Homo sapiens
ctgagatgtgaacacatcag

SEQ ID NO: 4753632 - DNA, 21 bp, Homo sapiens
ctgatttggccgttttgtgaa

SEQ ID NO: 4753633 - DNA, 20 bp, Homo sapiens
ctgcatcagctgctgaaaca

SEQ ID NO: 4753634 - DNA, 15 bp, Homo sapiens
ctgccagcaacgcag

SEQ ID NO: 4753635 - DNA, 15 bp, Homo sapiens
ctgttaaaagatgaa

SEQ ID NO: 4753636 - DNA, 16 bp, Homo sapiens
ctgttaaaagatgaaa

SEQ ID NO: 4753637 - DNA, 19 bp, Homo sapiens
ctgttaaaagatgaaaata

SEQ ID NO: 4753638 - DNA, 21 bp, Homo sapiens
ctgttaaaagatgaaaatatt

SEQ ID NO: 4753639 - DNA, 23 bp, Homo sapiens
ctgttaaaagatgaaaatatttg

SEQ ID NO: 4753640 - DNA, 12 bp, Homo sapiens
ctgttcacagcc

SEQ ID NO: 4753641 - DNA, 22 bp, Homo sapiens
ctgttcacagccagactggcac

SEQ ID NO: 4753642 - DNA, 14 bp, Homo sapiens
cttatttcatttct

SEQ ID NO: 4753643 - DNA, 15 bp, Homo sapiens
cttatttcatttctt

SEQ ID NO: 4753644 - DNA, 14 bp, Homo sapiens
cttccatttggaat

SEQ ID NO: 4753645 - DNA, 13 bp, Homo sapiens
cttctaagtaaaa

SEQ ID NO: 4753646 - DNA, 18 bp, Homo sapiens
cttctgtcttcacaacag

SEQ ID NO: 4753647 - DNA, 23 bp, Homo sapiens
cttgcatcaatttttcttatttc

SEQ ID NO: 4753648 - DNA, 14 bp, Homo sapiens
cttgccctgttaaa

SEQ ID NO: 4753649 - DNA, 16 bp, Homo sapiens
cttggactcattttaa

SEQ ID NO: 4753650 - DNA, 18 bp, Homo sapiens
ctttaaagggatggcaag

SEQ ID NO: 4753651 - DNA, 16 bp, Homo sapiens
ctttagaatattaaaa

SEQ ID NO: 4753652 - DNA, 19 bp, Homo sapiens
ctttagaatattaaaaatt

SEQ ID NO: 4753653 - DNA, 23 bp, Homo sapiens
gaaagactattcaaacagtctca

SEQ ID NO: 4753654 - DNA, 20 bp, Homo sapiens
gaaagaggcagcttgaaact

SEQ ID NO: 4753655 - DNA, 16 bp, Homo sapiens
gaaatcaaatatgcaa

SEQ ID NO: 4753656 - DNA, 18 bp, Homo sapiens
gaaatcaaatatgcaaag

SEQ ID NO: 4753657 - DNA, 20 bp, Homo sapiens
gaaatcaaatatgcaaagca

SEQ ID NO: 4753658 - DNA, 23 bp, Homo sapiens
gaaatcaaatatgcaaagcactg

SEQ ID NO: 4753659 - DNA, 22 bp, Homo sapiens
gaaatgtaagggaaactgccag

SEQ ID NO: 4753660 - DNA, 13 bp, Homo sapiens
gaacaactcgaat

SEQ ID NO: 4753661 - DNA, 17 bp, Homo sapiens
gaacccaagtccaagca

SEQ ID NO: 4753662 - DNA, 16 bp, Homo sapiens
gaagaaacatttatct

SEQ ID NO: 4753663 - DNA, 13 bp, Homo sapiens
gaagagctgttca

SEQ ID NO: 4753664 - DNA, 20 bp, Homo sapiens
gaagagctgttcacagccag

SEQ ID NO: 4753665 - DNA, 18 bp, Homo sapiens
gaatactaataaaataca

SEQ ID NO: 4753666 - DNA, 23 bp, Homo sapiens
gaatactaataaaatacatacta

SEQ ID NO: 4753667 - DNA, 15 bp, Homo sapiens
gaatattaaaaatta

SEQ ID NO: 4753668 - DNA, 16 bp, Homo sapiens
gaatattaaaaattaa

SEQ ID NO: 4753669 - DNA, 15 bp, Homo sapiens
gactccaaagaaatg

SEQ ID NO: 4753670 - DNA, 14 bp, Homo sapiens
gactggcacagttt

SEQ ID NO: 4753671 - DNA, 22 bp, Homo sapiens
gactggcacagttttctgagaa

SEQ ID NO: 4753672 - DNA, 18 bp, Homo sapiens
gacttctaagtaaaacca

SEQ ID NO: 4753673 - DNA, 15 bp, Homo sapiens
gagaagagctgttca

SEQ ID NO: 4753674 - DNA, 17 bp, Homo sapiens
gagctgttcacagccag

SEQ ID NO: 4753675 - DNA, 20 bp, Homo sapiens
gagctgttcacagccagact

SEQ ID NO: 4753676 - DNA, 22 bp, Homo sapiens
gagctgttcacagccagactgg

SEQ ID NO: 4753677 - DNA, 21 bp, Homo sapiens
gagtaagcacctttagaatat

SEQ ID NO: 4753678 - DNA, 13 bp, Homo sapiens
gatagcagggcat

SEQ ID NO: 4753679 - DNA, 14 bp, Homo sapiens
gatgaaaatatttg

SEQ ID NO: 4753680 - DNA, 13 bp, Homo sapiens
gatgactgaattt

SEQ ID NO: 4753681 - DNA, 16 bp, Homo sapiens
gatgggaaagcattgt

SEQ ID NO: 4753682 - DNA, 14 bp, Homo sapiens
gatgtgaacacatc

SEQ ID NO: 4753683 - DNA, 17 bp, Homo sapiens
gattgtctgaaattttc

SEQ ID NO: 4753684 - DNA, 23 bp, Homo sapiens
gcaaagcactgacttctaagtaa

SEQ ID NO: 4753685 - DNA, 14 bp, Homo sapiens
gcaaattccaatac

SEQ ID NO: 4753686 - DNA, 17 bp, Homo sapiens
gcaaattccaatacatt

SEQ ID NO: 4753687 - DNA, 12 bp, Homo sapiens
gcaagatgtggg

SEQ ID NO: 4753688 - DNA, 14 bp, Homo sapiens
gcactaatcaatac

SEQ ID NO: 4753689 - DNA, 15 bp, Homo sapiens
gcactgtcaagatga

SEQ ID NO: 4753690 - DNA, 22 bp, Homo sapiens
gcatcagctgctgaaacaacaa

SEQ ID NO: 4753691 - DNA, 23 bp, Homo sapiens
gcatcagctgctgaaacaacaaa

SEQ ID NO: 4753692 - DNA, 21 bp, Homo sapiens
gctcccctcggagaagagctg

SEQ ID NO: 4753693 - DNA, 23 bp, Homo sapiens
gctgttcacagccagactggcac

SEQ ID NO: 4753694 - DNA, 13 bp, Homo sapiens
ggaaactgccagc

SEQ ID NO: 4753695 - DNA, 16 bp, Homo sapiens
ggaaatcaaatatgca

SEQ ID NO: 4753696 - DNA, 15 bp, Homo sapiens
ggagaagagctgttc

SEQ ID NO: 4753697 - DNA, 12 bp, Homo sapiens
ggatggcaagat

SEQ ID NO: 4753698 - DNA, 17 bp, Homo sapiens
ggattagggagagaaga

SEQ ID NO: 4753699 - DNA, 23 bp, Homo sapiens
ggctataggtgctacaaaaacac

SEQ ID NO: 4753700 - DNA, 19 bp, Homo sapiens
ggtgctacaaaaacacagc

SEQ ID NO: 4753701 - DNA, 16 bp, Homo sapiens
gtaaaaccacagcagt

SEQ ID NO: 4753702 - DNA, 18 bp, Homo sapiens
gtaagggaaactgccagc

SEQ ID NO: 4753703 - DNA, 24 bp, Homo sapiens
gtatattcaaaaattatattttga

SEQ ID NO: 4753704 - DNA, 22 bp, Homo sapiens
gtcagctcccctcggagaagag

SEQ ID NO: 4753705 - DNA, 23 bp, Homo sapiens
gtcagctcccctcggagaagagc

SEQ ID NO: 4753706 - DNA, 22 bp, Homo sapiens
gtcttaattaaaagaatatttt

SEQ ID NO: 4753707 - DNA, 13 bp, Homo sapiens
gtcttcacaacag

SEQ ID NO: 4753708 - DNA, 15 bp, Homo sapiens
gtgaagtatgcacta

SEQ ID NO: 4753709 - DNA, 17 bp, Homo sapiens
gtgatgggaaagcattg

SEQ ID NO: 4753710 - DNA, 16 bp, Homo sapiens
gttttctgagaaagac

SEQ ID NO: 4753711 - DNA, 22 bp, Homo sapiens
gttttctgagaaagactattca

SEQ ID NO: 4753712 - DNA, 23 bp, Homo sapiens
gttttctgagaaagactattcaa

SEQ ID NO: 4753713 - DNA, 17 bp, Homo sapiens
gttttgtgaagaaacat

SEQ ID NO: 4753714 - DNA, 15 bp, Homo sapiens
taaaaattaattctt

SEQ ID NO: 4753715 - DNA, 13 bp, Homo sapiens
taaaaccacagca

SEQ ID NO: 4753716 - DNA, 16 bp, Homo sapiens
taaaagaatattttaa

SEQ ID NO: 4753717 - DNA, 19 bp, Homo sapiens
taaaattcattccatttgc

SEQ ID NO: 4753718 - DNA, 16 bp, Homo sapiens
taaatgtgcttttaaa

SEQ ID NO: 4753719 - DNA, 23 bp, Homo sapiens
taacataagctagaaaaattaga

SEQ ID NO: 4753720 - DNA, 16 bp, Homo sapiens
taagcacctttagaat

SEQ ID NO: 4753721 - DNA, 18 bp, Homo sapiens
taagcacctttagaatat

SEQ ID NO: 4753722 - DNA, 17 bp, Homo sapiens
taagctagaaaaattag

SEQ ID NO: 4753723 - DNA, 19 bp, Homo sapiens
taagtaaaaccacagcagt

SEQ ID NO: 4753724 - DNA, 23 bp, Homo sapiens
taatcaatactttgaacacaaag

SEQ ID NO: 4753725 - DNA, 20 bp, Homo sapiens
taattaaaagaatattttaa

SEQ ID NO: 4753726 - DNA, 20 bp, Homo sapiens
taattctttatcacatgttg

SEQ ID NO: 4753727 - DNA, 13 bp, Homo sapiens
tacaaaaacacag

SEQ ID NO: 4753728 - DNA, 17 bp, Homo sapiens
tacacactcaaatcaag

SEQ ID NO: 4753729 - DNA, 16 bp, Homo sapiens
tacatactatagattc

SEQ ID NO: 4753730 - DNA, 21 bp, Homo sapiens
tacatactatagattctttat

SEQ ID NO: 4753731 - DNA, 16 bp, Homo sapiens
tactaataaaatacat

SEQ ID NO: 4753732 - DNA, 23 bp, Homo sapiens
tactgtcagctcccctcggagaa

SEQ ID NO: 4753733 - DNA, 19 bp, Homo sapiens
tagaatactaataaaatac

SEQ ID NO: 4753734 - DNA, 21 bp, Homo sapiens
tagaatactaataaaatacat

SEQ ID NO: 4753735 - DNA, 22 bp, Homo sapiens
tagaatactaataaaatacata

SEQ ID NO: 4753736 - DNA, 23 bp, Homo sapiens
tagaatattaaaaattaattctt

SEQ ID NO: 4753737 - DNA, 20 bp, Homo sapiens
tagatgactgaatttctatg

SEQ ID NO: 4753738 - DNA, 15 bp, Homo sapiens
tagggagagaagata

SEQ ID NO: 4753739 - DNA, 18 bp, Homo sapiens
tatattcaaaaattatat

SEQ ID NO: 4753740 - DNA, 14 bp, Homo sapiens
tatcacaaatctta

SEQ ID NO: 4753741 - DNA, 22 bp, Homo sapiens
tatgagatgtagcaaattccaa

SEQ ID NO: 4753742 - DNA, 19 bp, Homo sapiens
tatggcatattgataataa

SEQ ID NO: 4753743 - DNA, 13 bp, Homo sapiens
tattaaaatcaca

SEQ ID NO: 4753744 - DNA, 20 bp, Homo sapiens
tattagtgaagtatgcacta

SEQ ID NO: 4753745 - DNA, 14 bp, Homo sapiens
tattcaaaaattat

SEQ ID NO: 4753746 - DNA, 15 bp, Homo sapiens
tattcaaaaattata

SEQ ID NO: 4753747 - DNA, 17 bp, Homo sapiens
tattcaaaaattatatt

SEQ ID NO: 4753748 - DNA, 15 bp, Homo sapiens
tattcaaacagtctc

SEQ ID NO: 4753749 - DNA, 16 bp, Homo sapiens
tattggacttccattt

SEQ ID NO: 4753750 - DNA, 19 bp, Homo sapiens
tattggacttccatttgga

SEQ ID NO: 4753751 - DNA, 17 bp, Homo sapiens
tattgtttaaaatcatt

SEQ ID NO: 4753752 - DNA, 12 bp, Homo sapiens
tatttcatttct

SEQ ID NO: 4753753 - DNA, 14 bp, Homo sapiens
tatttccatattaa

SEQ ID NO: 4753754 - DNA, 21 bp, Homo sapiens
tcaaaataccatgccatttaa

SEQ ID NO: 4753755 - DNA, 21 bp, Homo sapiens
tcaaacagtctcaggaaatca

SEQ ID NO: 4753756 - DNA, 15 bp, Homo sapiens
tcaacataacataag

SEQ ID NO: 4753757 - DNA, 22 bp, Homo sapiens
tcaatcacaaaagtatattcaa

SEQ ID NO: 4753758 - DNA, 18 bp, Homo sapiens
tcacaaaagtatattcaa

SEQ ID NO: 4753759 - DNA, 21 bp, Homo sapiens
tcacaacagattattacctta

SEQ ID NO: 4753760 - DNA, 13 bp, Homo sapiens
tcattatctcaaa

SEQ ID NO: 4753761 - DNA, 16 bp, Homo sapiens
tcatttctgcatcagc

SEQ ID NO: 4753762 - DNA, 12 bp, Homo sapiens
tccaaagaaatg

SEQ ID NO: 4753763 - DNA, 17 bp, Homo sapiens
tccaaagaaatgtaagg

SEQ ID NO: 4753764 - DNA, 19 bp, Homo sapiens
tccatttgctgattgtctg

SEQ ID NO: 4753765 - DNA, 22 bp, Homo sapiens
tcccagtcatttaataaatgtg

SEQ ID NO: 4753766 - DNA, 14 bp, Homo sapiens
tcctagtgaaagag

SEQ ID NO: 4753767 - DNA, 15 bp, Homo sapiens
tccttgcatcaattt

SEQ ID NO: 4753768 - DNA, 12 bp, Homo sapiens
tcggagaagagc

SEQ ID NO: 4753769 - DNA, 18 bp, Homo sapiens
tctagaatactaataaaa

SEQ ID NO: 4753770 - DNA, 22 bp, Homo sapiens
tctatggcatattgataataaa

SEQ ID NO: 4753771 - DNA, 21 bp, Homo sapiens
tctcaggaaatcaaatatgca

SEQ ID NO: 4753772 - DNA, 23 bp, Homo sapiens
tctcaggaaatcaaatatgcaaa

SEQ ID NO: 4753773 - DNA, 18 bp, Homo sapiens
tctgaaattttctagaat

SEQ ID NO: 4753774 - DNA, 22 bp, Homo sapiens
tctgaaattttctagaatacta

SEQ ID NO: 4753775 - DNA, 15 bp, Homo sapiens
tctgagaaagactat

SEQ ID NO: 4753776 - DNA, 21 bp, Homo sapiens
tctgagaaagactattcaaac

SEQ ID NO: 4753777 - DNA, 23 bp, Homo sapiens
tctgagaaagactattcaaacag

SEQ ID NO: 4753778 - DNA, 14 bp, Homo sapiens
tctgcatcagctgc

SEQ ID NO: 4753779 - DNA, 19 bp, Homo sapiens
tctgcatcagctgctgaaa

SEQ ID NO: 4753780 - DNA, 21 bp, Homo sapiens
tctgcatcagctgctgaaaca

SEQ ID NO: 4753781 - DNA, 15 bp, Homo sapiens
tctgtcttcacaaca

SEQ ID NO: 4753782 - DNA, 15 bp, Homo sapiens
tcttctattgtgctt

SEQ ID NO: 4753783 - DNA, 17 bp, Homo sapiens
tgaaaagactccaaaga

SEQ ID NO: 4753784 - DNA, 22 bp, Homo sapiens
tgaaaatatttgtatcacaaat

SEQ ID NO: 4753785 - DNA, 18 bp, Homo sapiens
tgaacaactcgaatcact

SEQ ID NO: 4753786 - DNA, 15 bp, Homo sapiens
tgaacacaaagcctg

SEQ ID NO: 4753787 - DNA, 14 bp, Homo sapiens
tgaagtatgcacta

SEQ ID NO: 4753788 - DNA, 23 bp, Homo sapiens
tgacttctaagtaaaaccacagc

SEQ ID NO: 4753789 - DNA, 16 bp, Homo sapiens
tgagaaagactattca

SEQ ID NO: 4753790 - DNA, 17 bp, Homo sapiens
tgagaaagactattcaa

SEQ ID NO: 4753791 - DNA, 18 bp, Homo sapiens
tgagaaagactattcaaa

SEQ ID NO: 4753792 - DNA, 24 bp, Homo sapiens
tgagatgtgaacacatcagcttgc

SEQ ID NO: 4753793 - DNA, 14 bp, Homo sapiens
tgataataaaattc

SEQ ID NO: 4753794 - DNA, 14 bp, Homo sapiens
tgatctttaaaata

SEQ ID NO: 4753795 - DNA, 17 bp, Homo sapiens
tgatctttaaaatacac

SEQ ID NO: 4753796 - DNA, 19 bp, Homo sapiens
tgatgggaaagcattgtaa

SEQ ID NO: 4753797 - DNA, 20 bp, Homo sapiens
tgcatagattccctgagcag

SEQ ID NO: 4753798 - DNA, 22 bp, Homo sapiens
tgcatcaatttttcttatttca

SEQ ID NO: 4753799 - DNA, 22 bp, Homo sapiens
tgccatttaaagcttattaaaa

SEQ ID NO: 4753800 - DNA, 19 bp, Homo sapiens
tgccctgttaaaagatgaa

SEQ ID NO: 4753801 - DNA, 14 bp, Homo sapiens
tgctacaaaaacac

SEQ ID NO: 4753802 - DNA, 15 bp, Homo sapiens
tgctacaaaaacaca

SEQ ID NO: 4753803 - DNA, 17 bp, Homo sapiens
tgctacaaaaacacagc

SEQ ID NO: 4753804 - DNA, 19 bp, Homo sapiens
tgctacaaaaacacagcaa

SEQ ID NO: 4753805 - DNA, 17 bp, Homo sapiens
tgctgaaacaacaaata

SEQ ID NO: 4753806 - DNA, 20 bp, Homo sapiens
tggaacataaaatacaatgt

SEQ ID NO: 4753807 - DNA, 20 bp, Homo sapiens
tggcacagttttctgagaaa

SEQ ID NO: 4753808 - DNA, 18 bp, Homo sapiens
tgggaaagcattgtaaat

SEQ ID NO: 4753809 - DNA, 13 bp, Homo sapiens
tggtcttatcctg

SEQ ID NO: 4753810 - DNA, 13 bp, Homo sapiens
tgtaagggaaact

SEQ ID NO: 4753811 - DNA, 17 bp, Homo sapiens
tgtacgttcttctattg

SEQ ID NO: 4753812 - DNA, 20 bp, Homo sapiens
tgtagcaaattccaatacat

SEQ ID NO: 4753813 - DNA, 21 bp, Homo sapiens
tgtcagctcccctcggagaag

SEQ ID NO: 4753814 - DNA, 22 bp, Homo sapiens
tgtctgaaattttctagaatac

SEQ ID NO: 4753815 - DNA, 14 bp, Homo sapiens
tgtcttcacaacag

SEQ ID NO: 4753816 - DNA, 21 bp, Homo sapiens
tgttaaaagatgaaaatattt

SEQ ID NO: 4753817 - DNA, 13 bp, Homo sapiens
tgtttaaaatcat

SEQ ID NO: 4753818 - DNA, 14 bp, Homo sapiens
tgtttaaaatcatt

SEQ ID NO: 4753819 - DNA, 16 bp, Homo sapiens
ttaaaaaatggaacat

SEQ ID NO: 4753820 - DNA, 13 bp, Homo sapiens
ttaaaaattaatt

SEQ ID NO: 4753821 - DNA, 14 bp, Homo sapiens
ttaatgtagataaa

SEQ ID NO: 4753822 - DNA, 14 bp, Homo sapiens
ttaccttacagaag

SEQ ID NO: 4753823 - DNA, 23 bp, Homo sapiens
ttagtgaagtatgcactaatcaa

SEQ ID NO: 4753824 - DNA, 15 bp, Homo sapiens
ttatattttgaacaa

SEQ ID NO: 4753825 - DNA, 17 bp, Homo sapiens
ttattgtttaaaatcat

SEQ ID NO: 4753826 - DNA, 18 bp, Homo sapiens
ttcaaacagtctcaggaa

SEQ ID NO: 4753827 - DNA, 14 bp, Homo sapiens
ttcattatctcaaa

SEQ ID NO: 4753828 - DNA, 13 bp, Homo sapiens
ttcattccatttg

SEQ ID NO: 4753829 - DNA, 16 bp, Homo sapiens
ttcattccatttgctg

SEQ ID NO: 4753830 - DNA, 12 bp, Homo sapiens
ttccatttgctg

SEQ ID NO: 4753831 - DNA, 20 bp, Homo sapiens
ttccttggactcattttaaa

SEQ ID NO: 4753832 - DNA, 24 bp, Homo sapiens
ttctaagtaaaaccacagcagttg

SEQ ID NO: 4753833 - DNA, 18 bp, Homo sapiens
ttctagaatactaataaa

SEQ ID NO: 4753834 - DNA, 19 bp, Homo sapiens
ttctagaatactaataaaa

SEQ ID NO: 4753835 - DNA, 15 bp, Homo sapiens
ttctgagaaagacta

SEQ ID NO: 4753836 - DNA, 18 bp, Homo sapiens
ttgaaaagactccaaaga

SEQ ID NO: 4753837 - DNA, 15 bp, Homo sapiens
ttgaacaactcgaat

SEQ ID NO: 4753838 - DNA, 18 bp, Homo sapiens
ttgcatagattccctgag

SEQ ID NO: 4753839 - DNA, 13 bp, Homo sapiens
ttgcatcaatttt

SEQ ID NO: 4753840 - DNA, 14 bp, Homo sapiens
ttgtaaatgtgctt

SEQ ID NO: 4753841 - DNA, 16 bp, Homo sapiens
ttgtatcacaaatctt

SEQ ID NO: 4753842 - DNA, 22 bp, Homo sapiens
ttgtgaagaaacatttatcttt

SEQ ID NO: 4753843 - DNA, 24 bp, Homo sapiens
tttaaagcttattaaaactcattt

SEQ ID NO: 4753844 - DNA, 13 bp, Homo sapiens
tttatttccatat

SEQ ID NO: 4753845 - DNA, 17 bp, Homo sapiens
tttctatggcatattga

SEQ ID NO: 4753846 - DNA, 13 bp, Homo sapiens
tttctgagaaaga

SEQ ID NO: 4753847 - DNA, 15 bp, Homo sapiens
tttctgagaaagact

SEQ ID NO: 4753848 - DNA, 21 bp, Homo sapiens
tttgcatagattccctgagca

SEQ ID NO: 4753849 - DNA, 15 bp, Homo sapiens
tttgctgattgtctg

SEQ ID NO: 4753850 - DNA, 15 bp, Homo sapiens
tttgtgaagaaacat

SEQ ID NO: 4753851 - DNA, 23 bp, Homo sapiens
ttttatggaggctttgcatagat

SEQ ID NO: 4753852 - DNA, 18 bp, Homo sapiens
aaaaacacagcaagggtg

SEQ ID NO: 4753853 - DNA, 22 bp, Homo sapiens
aaaaatggaacataaaatacaa

SEQ ID NO: 4753854 - DNA, 23 bp, Homo sapiens
aaaaattaattctttatcacatg

SEQ ID NO: 4753855 - DNA, 12 bp, Homo sapiens
aaaacacagcaa

SEQ ID NO: 4753856 - DNA, 13 bp, Homo sapiens
aaaactcattttt

SEQ ID NO: 4753857 - DNA, 12 bp, Homo sapiens
aaaagaatattt

SEQ ID NO: 4753858 - DNA, 13 bp, Homo sapiens
aaaagaatatttt

SEQ ID NO: 4753859 - DNA, 21 bp, Homo sapiens
aaaatcatttctgcatcagct

SEQ ID NO: 4753860 - DNA, 12 bp, Homo sapiens
aaacacagcaag

SEQ ID NO: 4753861 - DNA, 13 bp, Homo sapiens
aaacatttatctt

SEQ ID NO: 4753862 - DNA, 21 bp, Homo sapiens
aaactgagatgtgaacacatc

SEQ ID NO: 4753863 - DNA, 15 bp, Homo sapiens
aaactgccagcaacg

SEQ ID NO: 4753864 - DNA, 21 bp, Homo sapiens
aaagactccaaagaaatgtaa

SEQ ID NO: 4753865 - DNA, 13 bp, Homo sapiens
aaagatgaaaata

SEQ ID NO: 4753866 - DNA, 21 bp, Homo sapiens
aaagcactgacttctaagtaa

SEQ ID NO: 4753867 - DNA, 15 bp, Homo sapiens
aaagcattgtaaatg

SEQ ID NO: 4753868 - DNA, 17 bp, Homo sapiens
aaagcattgtaaatgtg

SEQ ID NO: 4753869 - DNA, 13 bp, Homo sapiens
aaagtatattcaa

SEQ ID NO: 4753870 - DNA, 15 bp, Homo sapiens
aaatacacactcaaa

SEQ ID NO: 4753871 - DNA, 21 bp, Homo sapiens
aaataccatgccatttaaagc

SEQ ID NO: 4753872 - DNA, 13 bp, Homo sapiens
aaatatgcaaagc

SEQ ID NO: 4753873 - DNA, 11 bp, Homo sapiens
aaatcatttct

SEQ ID NO: 4753874 - DNA, 12 bp, Homo sapiens
aaatcatttctg

SEQ ID NO: 4753875 - DNA, 21 bp, Homo sapiens
aaatcatttctgcatcagctg

SEQ ID NO: 4753876 - DNA, 23 bp, Homo sapiens
aaatcatttctgcatcagctgct

SEQ ID NO: 4753877 - DNA, 15 bp, Homo sapiens
aaatgtgcttttaaa

SEQ ID NO: 4753878 - DNA, 22 bp, Homo sapiens
aaattaattctttatcacatgt

SEQ ID NO: 4753879 - DNA, 13 bp, Homo sapiens
aaattcattccat

SEQ ID NO: 4753880 - DNA, 16 bp, Homo sapiens
aaattcattccatttg

SEQ ID NO: 4753881 - DNA, 13 bp, Homo sapiens
aaattccaataca

SEQ ID NO: 4753882 - DNA, 22 bp, Homo sapiens
aaattttctagaatactaataa

SEQ ID NO: 4753883 - DNA, 20 bp, Homo sapiens
aacacagcaagggtgatggg

SEQ ID NO: 4753884 - DNA, 12 bp, Homo sapiens
aacacatcagct

SEQ ID NO: 4753885 - DNA, 15 bp, Homo sapiens
aacacgagcaggcta

SEQ ID NO: 4753886 - DNA, 18 bp, Homo sapiens
aacccaagtccaagcata

SEQ ID NO: 4753887 - DNA, 22 bp, Homo sapiens
aacttccttggactcattttaa

SEQ ID NO: 4753888 - DNA, 15 bp, Homo sapiens
aagaaacatttatct

SEQ ID NO: 4753889 - DNA, 14 bp, Homo sapiens
aagactccaaagaa

SEQ ID NO: 4753890 - DNA, 18 bp, Homo sapiens
aagagctgttcacagcca

SEQ ID NO: 4753891 - DNA, 14 bp, Homo sapiens
aagatagcagggca

SEQ ID NO: 4753892 - DNA, 20 bp, Homo sapiens
aagcacctttagaatattaa

SEQ ID NO: 4753893 - DNA, 16 bp, Homo sapiens
aagcaggctcaacata

SEQ ID NO: 4753894 - DNA, 15 bp, Homo sapiens
aagctagaaaaatta

SEQ ID NO: 4753895 - DNA, 18 bp, Homo sapiens
aagcttattaaaactcat

SEQ ID NO: 4753896 - DNA, 22 bp, Homo sapiens
gataataaaattcattccattt

SEQ ID NO: 4753897 - DNA, 13 bp, Homo sapiens
gatctttaaaata

SEQ ID NO: 4753898 - DNA, 14 bp, Homo sapiens
gatgactgaatttc

SEQ ID NO: 4753899 - DNA, 16 bp, Homo sapiens
gatgatctttaaaata

SEQ ID NO: 4753900 - DNA, 16 bp, Homo sapiens
gcaagatgtgggcagt

SEQ ID NO: 4753901 - DNA, 14 bp, Homo sapiens
gcacagttttctga

SEQ ID NO: 4753902 - DNA, 15 bp, Homo sapiens
gcactgacttctaag

SEQ ID NO: 4753903 - DNA, 15 bp, Homo sapiens
gcagttgaaaagact

SEQ ID NO: 4753904 - DNA, 16 bp, Homo sapiens
gcagttgaaaagactc

SEQ ID NO: 4753905 - DNA, 20 bp, Homo sapiens
gcatattgataataaaattc

SEQ ID NO: 4753906 - DNA, 15 bp, Homo sapiens
gccagactggcacag

SEQ ID NO: 4753907 - DNA, 18 bp, Homo sapiens
gccagactggcacagttt

SEQ ID NO: 4753908 - DNA, 19 bp, Homo sapiens
gccagactggcacagtttt

SEQ ID NO: 4753909 - DNA, 22 bp, Homo sapiens
gccatttaaagcttattaaaac

SEQ ID NO: 4753910 - DNA, 17 bp, Homo sapiens
gccctgttaaaagatga

SEQ ID NO: 4753911 - DNA, 18 bp, Homo sapiens
gctacaaaaacacagcaa

SEQ ID NO: 4753912 - DNA, 13 bp, Homo sapiens
gctagaaaaatta

SEQ ID NO: 4753913 - DNA, 15 bp, Homo sapiens
gctcccctcggagaa

SEQ ID NO: 4753914 - DNA, 18 bp, Homo sapiens
gctcccctcggagaagag

SEQ ID NO: 4753915 - DNA, 16 bp, Homo sapiens
gctgaaacaacaaata

SEQ ID NO: 4753916 - DNA, 18 bp, Homo sapiens
gcttgccctgttaaaaga

SEQ ID NO: 4753917 - DNA, 23 bp, Homo sapiens
ggagaagagctgttcacagccag

SEQ ID NO: 4753918 - DNA, 21 bp, Homo sapiens
ggcacagttttctgagaaaga

SEQ ID NO: 4753919 - DNA, 15 bp, Homo sapiens
ggtgccagttatggc

SEQ ID NO: 4753920 - DNA, 23 bp, Homo sapiens
ggtgctacaaaaacacagcaagg

SEQ ID NO: 4753921 - DNA, 15 bp, Homo sapiens
gtaaaaccacagcag

SEQ ID NO: 4753922 - DNA, 18 bp, Homo sapiens
gtaaaaccacagcagttg

SEQ ID NO: 4753923 - DNA, 14 bp, Homo sapiens
gtagataaagcact

SEQ ID NO: 4753924 - DNA, 20 bp, Homo sapiens
gtagcaaattccaatacatt

SEQ ID NO: 4753925 - DNA, 16 bp, Homo sapiens
gtatattcaaaaatta

SEQ ID NO: 4753926 - DNA, 23 bp, Homo sapiens
gtatattcaaaaattatattttg

SEQ ID NO: 4753927 - DNA, 22 bp, Homo sapiens
gtatgcactaatcaatactttg

SEQ ID NO: 4753928 - DNA, 21 bp, Homo sapiens
gtcagctcccctcggagaaga

SEQ ID NO: 4753929 - DNA, 17 bp, Homo sapiens
gtctgaaattttctaga

SEQ ID NO: 4753930 - DNA, 13 bp, Homo sapiens
gtgaacacatcag

SEQ ID NO: 4753931 - DNA, 17 bp, Homo sapiens
gtgaagtatgcactaat

SEQ ID NO: 4753932 - DNA, 15 bp, Homo sapiens
gtgctacaaaaacac

SEQ ID NO: 4753933 - DNA, 22 bp, Homo sapiens
gtgctacaaaaacacagcaagg

SEQ ID NO: 4753934 - DNA, 14 bp, Homo sapiens
gttaaaagatgaaa

SEQ ID NO: 4753935 - DNA, 17 bp, Homo sapiens
gttcttctattgtgctt

SEQ ID NO: 4753936 - DNA, 17 bp, Homo sapiens
gttttctgagaaagact

SEQ ID NO: 4753937 - DNA, 15 bp, Homo sapiens
taaaaccacagcagt

SEQ ID NO: 4753938 - DNA, 14 bp, Homo sapiens
taaaatacatacta

SEQ ID NO: 4753939 - DNA, 23 bp, Homo sapiens
taaaatacatactatagattctt

SEQ ID NO: 4753940 - DNA, 16 bp, Homo sapiens
taaaatcacaaactca

SEQ ID NO: 4753941 - DNA, 23 bp, Homo sapiens
taaaatcacaaactcatccatta

SEQ ID NO: 4753942 - DNA, 16 bp, Homo sapiens
taaaattcattccatt

SEQ ID NO: 4753943 - DNA, 16 bp, Homo sapiens
taaatgtgccttcatt

SEQ ID NO: 4753944 - DNA, 21 bp, Homo sapiens
taacataagctagaaaaatta

SEQ ID NO: 4753945 - DNA, 21 bp, Homo sapiens
taacttccttggactcatttt

SEQ ID NO: 4753946 - DNA, 18 bp, Homo sapiens
taaggttacctttgttcc

SEQ ID NO: 4753947 - DNA, 13 bp, Homo sapiens
taagtaaaaccac

SEQ ID NO: 4753948 - DNA, 16 bp, Homo sapiens
taagtaaaaccacagc

SEQ ID NO: 4753949 - DNA, 17 bp, Homo sapiens
taagtaaaaccacagca

SEQ ID NO: 4753950 - DNA, 14 bp, Homo sapiens
taataaaatacata

SEQ ID NO: 4753951 - DNA, 16 bp, Homo sapiens
taataaaatacatact

SEQ ID NO: 4753952 - DNA, 14 bp, Homo sapiens
taataaaattcatt

SEQ ID NO: 4753953 - DNA, 19 bp, Homo sapiens
taataaaattcattccatt

SEQ ID NO: 4753954 - DNA, 20 bp, Homo sapiens
taatcaatactttgaacaca

SEQ ID NO: 4753955 - DNA, 16 bp, Homo sapiens
taatgtagataaagca

SEQ ID NO: 4753956 - DNA, 18 bp, Homo sapiens
tacaaaaacacagcaagg

SEQ ID NO: 4753957 - DNA, 18 bp, Homo sapiens
tacatactatagattctt

SEQ ID NO: 4753958 - DNA, 16 bp, Homo sapiens
taccatgccatttaaa

SEQ ID NO: 4753959 - DNA, 23 bp, Homo sapiens
tacctttgttcccaaatttcata

SEQ ID NO: 4753960 - DNA, 12 bp, Homo sapiens
tagaaaaattag

SEQ ID NO: 4753961 - DNA, 14 bp, Homo sapiens
tagataaagcactg

SEQ ID NO: 4753962 - DNA, 15 bp, Homo sapiens
tagattctttattag

SEQ ID NO: 4753963 - DNA, 18 bp, Homo sapiens
tagattctttattagtga

SEQ ID NO: 4753964 - DNA, 18 bp, Homo sapiens
tagcaaattccaatacat

SEQ ID NO: 4753965 - DNA, 20 bp, Homo sapiens
tagcaaattccaatacatta

SEQ ID NO: 4753966 - DNA, 18 bp, Homo sapiens
taggtgctacaaaaacac

SEQ ID NO: 4753967 - DNA, 21 bp, Homo sapiens
tataggtgctacaaaaacaca

SEQ ID NO: 4753968 - DNA, 16 bp, Homo sapiens
tatattcaaaaattat

SEQ ID NO: 4753969 - DNA, 21 bp, Homo sapiens
tatattttgaacaactcgaat

SEQ ID NO: 4753970 - DNA, 20 bp, Homo sapiens
tatcacaaatcttaacttga

SEQ ID NO: 4753971 - DNA, 13 bp, Homo sapiens
tatctaattttta

SEQ ID NO: 4753972 - DNA, 18 bp, Homo sapiens
tatctaatttttattaat

SEQ ID NO: 4753973 - DNA, 12 bp, Homo sapiens
tatgcaaagcac

SEQ ID NO: 4753974 - DNA, 13 bp, Homo sapiens
tatgcaaagcact

SEQ ID NO: 4753975 - DNA, 14 bp, Homo sapiens
tatgcaaagcactg

SEQ ID NO: 4753976 - DNA, 16 bp, Homo sapiens
tatggctataggtgct

SEQ ID NO: 4753977 - DNA, 17 bp, Homo sapiens
tatggctataggtgcta

SEQ ID NO: 4753978 - DNA, 16 bp, Homo sapiens
tattaaaactcatttt

SEQ ID NO: 4753979 - DNA, 16 bp, Homo sapiens
tattattcccattcta

SEQ ID NO: 4753980 - DNA, 23 bp, Homo sapiens
tattcaaacagtctcaggaaatc

SEQ ID NO: 4753981 - DNA, 17 bp, Homo sapiens
tattgataataaaattc

SEQ ID NO: 4753982 - DNA, 17 bp, Homo sapiens
tattggacttccatttg

SEQ ID NO: 4753983 - DNA, 20 bp, Homo sapiens
tattgtttaaaatcatttct

SEQ ID NO: 4753984 - DNA, 18 bp, Homo sapiens
tatttccatattaaaatc

SEQ ID NO: 4753985 - DNA, 12 bp, Homo sapiens
tattttgaacaa

SEQ ID NO: 4753986 - DNA, 20 bp, Homo sapiens
tcaaacagtctcaggaaatc

SEQ ID NO: 4753987 - DNA, 22 bp, Homo sapiens
tcaaacagtctcaggaaatcaa

SEQ ID NO: 4753988 - DNA, 16 bp, Homo sapiens
tcaaatatgcaaagca

SEQ ID NO: 4753989 - DNA, 20 bp, Homo sapiens
tcaaatcaagaaacttaagg

SEQ ID NO: 4753990 - DNA, 18 bp, Homo sapiens
tcaacataacataagcta

SEQ ID NO: 4753991 - DNA, 22 bp, Homo sapiens
tcaagatgatgatgatctttaa

SEQ ID NO: 4753992 - DNA, 18 bp, Homo sapiens
tcaatactttgaacacaa

SEQ ID NO: 4753993 - DNA, 23 bp, Homo sapiens
tcacagccagactggcacagttt

SEQ ID NO: 4753994 - DNA, 19 bp, Homo sapiens
tcactcatttatttccata

SEQ ID NO: 4753995 - DNA, 17 bp, Homo sapiens
tcagctcccctcggaga

SEQ ID NO: 4753996 - DNA, 18 bp, Homo sapiens
tcagctcccctcggagaa

SEQ ID NO: 4753997 - DNA, 21 bp, Homo sapiens
tcagctcccctcggagaagag

SEQ ID NO: 4753998 - DNA, 22 bp, Homo sapiens
tcagctcccctcggagaagagc

SEQ ID NO: 4753999 - DNA, 16 bp, Homo sapiens
tcagctgctgaaacaa

SEQ ID NO: 4754000 - DNA, 21 bp, Homo sapiens
tcaggaaatcaaatatgcaaa

SEQ ID NO: 4754001 - DNA, 20 bp, Homo sapiens
tcatatgggatactgctggt

SEQ ID NO: 4754002 - DNA, 19 bp, Homo sapiens
tcattatctcaaaactgca

SEQ ID NO: 4754003 - DNA, 20 bp, Homo sapiens
tcattatctcaaaactgcac

SEQ ID NO: 4754004 - DNA, 14 bp, Homo sapiens
tcatttatttccat

SEQ ID NO: 4754005 - DNA, 16 bp, Homo sapiens
tccattaatgtagata

SEQ ID NO: 4754006 - DNA, 13 bp, Homo sapiens
tccatttgctgat

SEQ ID NO: 4754007 - DNA, 17 bp, Homo sapiens
tccttgcatcaattttt

SEQ ID NO: 4754008 - DNA, 16 bp, Homo sapiens
tcgaatcactcattta

SEQ ID NO: 4754009 - DNA, 14 bp, Homo sapiens
tctaagtaaaacca

SEQ ID NO: 4754010 - DNA, 19 bp, Homo sapiens
tctaagtaaaaccacagca

SEQ ID NO: 4754011 - DNA, 14 bp, Homo sapiens
tctagaatactaat

SEQ ID NO: 4754012 - DNA, 14 bp, Homo sapiens
tctatctaattttt

SEQ ID NO: 4754013 - DNA, 14 bp, Homo sapiens
tctcaggaaatcaa

SEQ ID NO: 4754014 - DNA, 15 bp, Homo sapiens
tctcccagtcattta

SEQ ID NO: 4754015 - DNA, 13 bp, Homo sapiens
tctcttctttaaa

SEQ ID NO: 4754016 - DNA, 14 bp, Homo sapiens
tcttaattaaaaga

SEQ ID NO: 4754017 - DNA, 16 bp, Homo sapiens
tcttatttcatttctt

SEQ ID NO: 4754018 - DNA, 14 bp, Homo sapiens
tctttattagtgaa

SEQ ID NO: 4754019 - DNA, 15 bp, Homo sapiens
tgaaaagactccaaa

SEQ ID NO: 4754020 - DNA, 19 bp, Homo sapiens
tgaaaagactccaaagaaa

SEQ ID NO: 4754021 - DNA, 22 bp, Homo sapiens
tgaaaagactccaaagaaatgt

SEQ ID NO: 4754022 - DNA, 22 bp, Homo sapiens
tgaaacaacaaataggaattgt

SEQ ID NO: 4754023 - DNA, 13 bp, Homo sapiens
tgaaattttctag

SEQ ID NO: 4754024 - DNA, 16 bp, Homo sapiens
tgaaattttctagaat

SEQ ID NO: 4754025 - DNA, 20 bp, Homo sapiens
tgaaattttctagaatacta

SEQ ID NO: 4754026 - DNA, 20 bp, Homo sapiens
tgaacaactcgaatcactca

SEQ ID NO: 4754027 - DNA, 23 bp, Homo sapiens
tgaacaactcgaatcactcattt

SEQ ID NO: 4754028 - DNA, 14 bp, Homo sapiens
aaaaattaattctt

SEQ ID NO: 4754029 - DNA, 14 bp, Homo sapiens
aaaaattatatttt

SEQ ID NO: 4754030 - DNA, 18 bp, Homo sapiens
aaaacacagcaagggtga

SEQ ID NO: 4754031 - DNA, 12 bp, Homo sapiens
aaaaccacagca

SEQ ID NO: 4754032 - DNA, 13 bp, Homo sapiens
aaaaccacagcag

SEQ ID NO: 4754033 - DNA, 14 bp, Homo sapiens
aaaaccacagcagt

SEQ ID NO: 4754034 - DNA, 13 bp, Homo sapiens
aaaagactccaaa

SEQ ID NO: 4754035 - DNA, 20 bp, Homo sapiens
aaaagtatattcaaaaatta

SEQ ID NO: 4754036 - DNA, 22 bp, Homo sapiens
aaaagtatattcaaaaattata

SEQ ID NO: 4754037 - DNA, 14 bp, Homo sapiens
aaaatacacactca

SEQ ID NO: 4754038 - DNA, 15 bp, Homo sapiens
aaaatacatactata

SEQ ID NO: 4754039 - DNA, 10 bp, Homo sapiens
aaaatcattt

SEQ ID NO: 4754040 - DNA, 12 bp, Homo sapiens
aaaatcatttct

SEQ ID NO: 4754041 - DNA, 16 bp, Homo sapiens
aaaattaattctttat

SEQ ID NO: 4754042 - DNA, 16 bp, Homo sapiens
aaaattcattccattt

SEQ ID NO: 4754043 - DNA, 18 bp, Homo sapiens
aaaattcattccatttgc

SEQ ID NO: 4754044 - DNA, 14 bp, Homo sapiens
aaacacagcaaggg

SEQ ID NO: 4754045 - DNA, 20 bp, Homo sapiens
aaacagtctcaggaaatcaa

SEQ ID NO: 4754046 - DNA, 19 bp, Homo sapiens
aaactgccagcaacgcagg

SEQ ID NO: 4754047 - DNA, 14 bp, Homo sapiens
aaagactccaaaga

SEQ ID NO: 4754048 - DNA, 15 bp, Homo sapiens
aaagaggcagcttga

SEQ ID NO: 4754049 - DNA, 20 bp, Homo sapiens
aaagaggcagcttgaaactg

SEQ ID NO: 4754050 - DNA, 16 bp, Homo sapiens
aaagatgaaaatattt

SEQ ID NO: 4754051 - DNA, 13 bp, Homo sapiens
aaagcttattaaa

SEQ ID NO: 4754052 - DNA, 20 bp, Homo sapiens
aaagggatggcaagatgtgg

SEQ ID NO: 4754053 - DNA, 12 bp, Homo sapiens
aaatcaaatatg

SEQ ID NO: 4754054 - DNA, 14 bp, Homo sapiens
aaatcaaatatgca

SEQ ID NO: 4754055 - DNA, 18 bp, Homo sapiens
aaatcaaatatgcaaagc

SEQ ID NO: 4754056 - DNA, 14 bp, Homo sapiens
aaatcttaacttga

SEQ ID NO: 4754057 - DNA, 16 bp, Homo sapiens
aaatgtaagggaaact

SEQ ID NO: 4754058 - DNA, 13 bp, Homo sapiens
aaattaattcttt

SEQ ID NO: 4754059 - DNA, 16 bp, Homo sapiens
aaattagatgactgaa

SEQ ID NO: 4754060 - DNA, 15 bp, Homo sapiens
aaattttctagaata

SEQ ID NO: 4754061 - DNA, 15 bp, Homo sapiens
aacacagcaagggtg

SEQ ID NO: 4754062 - DNA, 14 bp, Homo sapiens
aacagtctcaggaa

SEQ ID NO: 4754063 - DNA, 14 bp, Homo sapiens
aacataaaatacaa

SEQ ID NO: 4754064 - DNA, 14 bp, Homo sapiens
aacataagctagaa

SEQ ID NO: 4754065 - DNA, 22 bp, Homo sapiens
aacataagctagaaaaattaga

SEQ ID NO: 4754066 - DNA, 14 bp, Homo sapiens
aacatttatctttg

SEQ ID NO: 4754067 - DNA, 15 bp, Homo sapiens
aacatttatctttgt

SEQ ID NO: 4754068 - DNA, 12 bp, Homo sapiens
aaccacagcagt

SEQ ID NO: 4754069 - DNA, 19 bp, Homo sapiens
aactgcactgtcaagatga

SEQ ID NO: 4754070 - DNA, 19 bp, Homo sapiens
aactggactggttcaaatg

SEQ ID NO: 4754071 - DNA, 23 bp, Homo sapiens
aacttccttggactcattttaaa

SEQ ID NO: 4754072 - DNA, 12 bp, Homo sapiens
aagaaacattta

SEQ ID NO: 4754073 - DNA, 13 bp, Homo sapiens
aagaaatgtaagg

SEQ ID NO: 4754074 - DNA, 13 bp, Homo sapiens
aagaatattttaa

SEQ ID NO: 4754075 - DNA, 16 bp, Homo sapiens
aagactccaaagaaat

SEQ ID NO: 4754076 - DNA, 22 bp, Homo sapiens
aagagtaagcacctttagaata

SEQ ID NO: 4754077 - DNA, 15 bp, Homo sapiens
aagatagcagggcat

SEQ ID NO: 4754078 - DNA, 14 bp, Homo sapiens
aagatgaaaatatt

SEQ ID NO: 4754079 - DNA, 16 bp, Homo sapiens
aagcactgacttctaa

SEQ ID NO: 4754080 - DNA, 19 bp, Homo sapiens
aagcactgacttctaagta

SEQ ID NO: 4754081 - DNA, 17 bp, Homo sapiens
aagcaggctcaacataa

SEQ ID NO: 4754082 - DNA, 18 bp, Homo sapiens
aagcattgtaaatgtgct

SEQ ID NO: 4754083 - DNA, 16 bp, Homo sapiens
aagtatgcactaatca

SEQ ID NO: 4754084 - DNA, 17 bp, Homo sapiens
aagtccaagcataccaa

SEQ ID NO: 4754085 - DNA, 13 bp, Homo sapiens
aataaaattcatt

SEQ ID NO: 4754086 - DNA, 16 bp, Homo sapiens
aataaaattcattcca

SEQ ID NO: 4754087 - DNA, 22 bp, Homo sapiens
aatacattattggacttccatt

SEQ ID NO: 4754088 - DNA, 18 bp, Homo sapiens
aatactaataaaatacat

SEQ ID NO: 4754089 - DNA, 11 bp, Homo sapiens
aatattaaaaa

SEQ ID NO: 4754090 - DNA, 23 bp, Homo sapiens
aatattaaaaattaattctttat

SEQ ID NO: 4754091 - DNA, 16 bp, Homo sapiens
aatcaaatatgcaaag

SEQ ID NO: 4754092 - DNA, 22 bp, Homo sapiens
aatcactcatttatttccatat

SEQ ID NO: 4754093 - DNA, 16 bp, Homo sapiens
aagggaaactgccagc

SEQ ID NO: 4754094 - DNA, 17 bp, Homo sapiens
aagggaaactgccagca

SEQ ID NO: 4754095 - DNA, 15 bp, Homo sapiens
aagtaaaaccacagc

SEQ ID NO: 4754096 - DNA, 18 bp, Homo sapiens
aagtatattcaaaaatta

SEQ ID NO: 4754097 - DNA, 19 bp, Homo sapiens
aagtatattcaaaaattat

SEQ ID NO: 4754098 - DNA, 18 bp, Homo sapiens
aagtatgcactaatcaat

SEQ ID NO: 4754099 - DNA, 18 bp, Homo sapiens
aataaaattcattccatt

SEQ ID NO: 4754100 - DNA, 12 bp, Homo sapiens
aataaatgtgcc

SEQ ID NO: 4754101 - DNA, 14 bp, Homo sapiens
aatacacactcaaa

SEQ ID NO: 4754102 - DNA, 15 bp, Homo sapiens
aatatgcaaagcact

SEQ ID NO: 4754103 - DNA, 15 bp, Homo sapiens
aatattaaaaattaa

SEQ ID NO: 4754104 - DNA, 20 bp, Homo sapiens
aatattaaaaattaattctt

SEQ ID NO: 4754105 - DNA, 22 bp, Homo sapiens
aatcaaatatgcaaagcactga

SEQ ID NO: 4754106 - DNA, 12 bp, Homo sapiens
aatcaatacttt

SEQ ID NO: 4754107 - DNA, 21 bp, Homo sapiens
aatcaatactttgaacacaaa

SEQ ID NO: 4754108 - DNA, 17 bp, Homo sapiens
aatcacaaaagtatatt

SEQ ID NO: 4754109 - DNA, 21 bp, Homo sapiens
aatcacaaaagtatattcaaa

SEQ ID NO: 4754110 - DNA, 20 bp, Homo sapiens
aatcactcatttatttccat

SEQ ID NO: 4754111 - DNA, 20 bp, Homo sapiens
aatcatatgggatactgctg

SEQ ID NO: 4754112 - DNA, 22 bp, Homo sapiens
aatcatttctgcatcagctgct

SEQ ID NO: 4754113 - DNA, 19 bp, Homo sapiens
aattctttatcacatgttg

SEQ ID NO: 4754114 - DNA, 19 bp, Homo sapiens
aatttctcccagtcattta

SEQ ID NO: 4754115 - DNA, 16 bp, Homo sapiens
acaaaaacacagcaag

SEQ ID NO: 4754116 - DNA, 14 bp, Homo sapiens
acacgagcaggcta

SEQ ID NO: 4754117 - DNA, 13 bp, Homo sapiens
acactcaaatcaa

SEQ ID NO: 4754118 - DNA, 15 bp, Homo sapiens
acagcagttgaaaag

SEQ ID NO: 4754119 - DNA, 18 bp, Homo sapiens
acagcagttgaaaagact

SEQ ID NO: 4754120 - DNA, 13 bp, Homo sapiens
acagccagactgg

SEQ ID NO: 4754121 - DNA, 14 bp, Homo sapiens
acagtctcaggaaa

SEQ ID NO: 4754122 - DNA, 17 bp, Homo sapiens
acagttttctgagaaag

SEQ ID NO: 4754123 - DNA, 19 bp, Homo sapiens
acagttttctgagaaagac

SEQ ID NO: 4754124 - DNA, 22 bp, Homo sapiens
acataacataagctagaaaaat

SEQ ID NO: 4754125 - DNA, 19 bp, Homo sapiens
acattattggacttccatt

SEQ ID NO: 4754126 - DNA, 19 bp, Homo sapiens
accaacacgagcaggctac

SEQ ID NO: 4754127 - DNA, 19 bp, Homo sapiens
acgagcaggctactgtcag

SEQ ID NO: 4754128 - DNA, 15 bp, Homo sapiens
actaatcaatacttt

SEQ ID NO: 4754129 - DNA, 14 bp, Homo sapiens
actattcaaacagt

SEQ ID NO: 4754130 - DNA, 12 bp, Homo sapiens
actcatccatta

SEQ ID NO: 4754131 - DNA, 14 bp, Homo sapiens
actccaaagaaatg

SEQ ID NO: 4754132 - DNA, 21 bp, Homo sapiens
actccaaagaaatgtaaggga

SEQ ID NO: 4754133 - DNA, 13 bp, Homo sapiens
actgaatttctat

SEQ ID NO: 4754134 - DNA, 19 bp, Homo sapiens
actgaatttctatggcata

SEQ ID NO: 4754135 - DNA, 17 bp, Homo sapiens
actgagatgtgaacaca

SEQ ID NO: 4754136 - DNA, 22 bp, Homo sapiens
actgagatgtgaacacatcagc

SEQ ID NO: 4754137 - DNA, 21 bp, Homo sapiens
actgtcagctcccctcggaga

SEQ ID NO: 4754138 - DNA, 13 bp, Homo sapiens
acttctaagtaaa

SEQ ID NO: 4754139 - DNA, 18 bp, Homo sapiens
acttctaagtaaaaccac

SEQ ID NO: 4754140 - DNA, 21 bp, Homo sapiens
acttctaagtaaaaccacagc

SEQ ID NO: 4754141 - DNA, 21 bp, Homo sapiens
acttctgtcttcacaacagat

SEQ ID NO: 4754142 - DNA, 17 bp, Homo sapiens
agaaacatttatctttg

SEQ ID NO: 4754143 - DNA, 13 bp, Homo sapiens
agaagagctgttc

SEQ ID NO: 4754144 - DNA, 20 bp, Homo sapiens
agaatactaataaaatacat

SEQ ID NO: 4754145 - DNA, 15 bp, Homo sapiens
agaatattaaaaatt

SEQ ID NO: 4754146 - DNA, 12 bp, Homo sapiens
agactattcaaa

SEQ ID NO: 4754147 - DNA, 18 bp, Homo sapiens
agactattcaaacagtct

SEQ ID NO: 4754148 - DNA, 12 bp, Homo sapiens
agactccaaaga

SEQ ID NO: 4754149 - DNA, 13 bp, Homo sapiens
agactccaaagaa

SEQ ID NO: 4754150 - DNA, 14 bp, Homo sapiens
agactccaaagaaa

SEQ ID NO: 4754151 - DNA, 15 bp, Homo sapiens
agactggcacagttt

SEQ ID NO: 4754152 - DNA, 18 bp, Homo sapiens
agactggcacagttttct

SEQ ID NO: 4754153 - DNA, 23 bp, Homo sapiens
agactggcacagttttctgagaa

SEQ ID NO: 4754154 - DNA, 19 bp, Homo sapiens
agagctgttcacagccaga

SEQ ID NO: 4754155 - DNA, 20 bp, Homo sapiens
agataaagcactgtttggat

SEQ ID NO: 4754156 - DNA, 18 bp, Homo sapiens
agatgactgaatttctat

SEQ ID NO: 4754157 - DNA, 17 bp, Homo sapiens
agcaggctactgtcagc

SEQ ID NO: 4754158 - DNA, 19 bp, Homo sapiens
agcaggctactgtcagctc

SEQ ID NO: 4754159 - DNA, 19 bp, Homo sapiens
agcagggcatggctgggaa

SEQ ID NO: 4754160 - DNA, 19 bp, Homo sapiens
agcataccaacacgagcag

SEQ ID NO: 4754161 - DNA, 14 bp, Homo sapiens
agccagactggcac

SEQ ID NO: 4754162 - DNA, 19 bp, Homo sapiens
agccagactggcacagttt

SEQ ID NO: 4754163 - DNA, 17 bp, Homo sapiens
agcctgtgttactgatt

SEQ ID NO: 4754164 - DNA, 17 bp, Homo sapiens
agctcccctcggagaag

SEQ ID NO: 4754165 - DNA, 19 bp, Homo sapiens
agctcccctcggagaagag

SEQ ID NO: 4754166 - DNA, 15 bp, Homo sapiens
agctgctgaaacaac

SEQ ID NO: 4754167 - DNA, 18 bp, Homo sapiens
agcttgccctgttaaaag

SEQ ID NO: 4754168 - DNA, 19 bp, Homo sapiens
agcttgccctgttaaaaga

SEQ ID NO: 4754169 - DNA, 20 bp, Homo sapiens
aggaaatcaaatatgcaaag

SEQ ID NO: 4754170 - DNA, 21 bp, Homo sapiens
aggaaatcaaatatgcaaagc

SEQ ID NO: 4754171 - DNA, 23 bp, Homo sapiens
aggaaatcaaatatgcaaagcac

SEQ ID NO: 4754172 - DNA, 16 bp, Homo sapiens
agggaaactgccagca

SEQ ID NO: 4754173 - DNA, 21 bp, Homo sapiens
agggaaactgccagcaacgca

SEQ ID NO: 4754174 - DNA, 23 bp, Homo sapiens
agggacttctgtcttcacaacag

SEQ ID NO: 4754175 - DNA, 14 bp, Homo sapiens
agggagagaagata

SEQ ID NO: 4754176 - DNA, 20 bp, Homo sapiens
agggattagggagagaagat

SEQ ID NO: 4754177 - DNA, 22 bp, Homo sapiens
agggtgatgggaaagcattgta

SEQ ID NO: 4754178 - DNA, 20 bp, Homo sapiens
aggtgctacaaaaacacagc

SEQ ID NO: 4754179 - DNA, 24 bp, Homo sapiens
aggtgctacaaaaacacagcaagg

SEQ ID NO: 4754180 - DNA, 19 bp, Homo sapiens
agtaaaaccacagcagttg

SEQ ID NO: 4754181 - DNA, 20 bp, Homo sapiens
agtaaaaccacagcagttga

SEQ ID NO: 4754182 - DNA, 20 bp, Homo sapiens
agtaagcacctttagaatat

SEQ ID NO: 4754183 - DNA, 15 bp, Homo sapiens
agtatattcaaaaat

SEQ ID NO: 4754184 - DNA, 16 bp, Homo sapiens
agtgaaagaggcagct

SEQ ID NO: 4754185 - DNA, 22 bp, Homo sapiens
agtgaaagaggcagcttgaaac

SEQ ID NO: 4754186 - DNA, 18 bp, Homo sapiens
agttgaaaagactccaaa

SEQ ID NO: 4754187 - DNA, 19 bp, Homo sapiens
agttttctgagaaagacta

SEQ ID NO: 4754188 - DNA, 23 bp, Homo sapiens
agttttctgagaaagactattca

SEQ ID NO: 4754189 - DNA, 12 bp, Homo sapiens
ataaaatacata

SEQ ID NO: 4754190 - DNA, 22 bp, Homo sapiens
tcatttatttccatattaaaat

SEQ ID NO: 4754191 - DNA, 22 bp, Homo sapiens
tcatttctgcatcagctgctga

SEQ ID NO: 4754192 - DNA, 14 bp, Homo sapiens
tccaaagaaatgta

SEQ ID NO: 4754193 - DNA, 23 bp, Homo sapiens
tccaagcataccaacacgagcag

SEQ ID NO: 4754194 - DNA, 21 bp, Homo sapiens
tccatttggaatcatatggga

SEQ ID NO: 4754195 - DNA, 16 bp, Homo sapiens
tcccaaatttcatacc

SEQ ID NO: 4754196 - DNA, 14 bp, Homo sapiens
tcccagtcatttaa

SEQ ID NO: 4754197 - DNA, 17 bp, Homo sapiens
tcccctcggagaagagc

SEQ ID NO: 4754198 - DNA, 11 bp, Homo sapiens
tccctgagcag

SEQ ID NO: 4754199 - DNA, 23 bp, Homo sapiens
tcctagtgaaagaggcagcttga

SEQ ID NO: 4754200 - DNA, 23 bp, Homo sapiens
tcgaatcactcatttatttccat

SEQ ID NO: 4754201 - DNA, 14 bp, Homo sapiens
tcggagaagagctg

SEQ ID NO: 4754202 - DNA, 22 bp, Homo sapiens
tcgggttttattgtttaaaatc

SEQ ID NO: 4754203 - DNA, 15 bp, Homo sapiens
tctaagtaaaaccac

SEQ ID NO: 4754204 - DNA, 23 bp, Homo sapiens
tctaagtaaaaccacagcagttg

SEQ ID NO: 4754205 - DNA, 15 bp, Homo sapiens
tctaatttttattaa

SEQ ID NO: 4754206 - DNA, 13 bp, Homo sapiens
tctagaatactaa

SEQ ID NO: 4754207 - DNA, 22 bp, Homo sapiens
tctagaatactaataaaataca

SEQ ID NO: 4754208 - DNA, 15 bp, Homo sapiens
tctatctaattttta

SEQ ID NO: 4754209 - DNA, 12 bp, Homo sapiens
tctcttctttaa

SEQ ID NO: 4754210 - DNA, 16 bp, Homo sapiens
tctgaaattttctaga

SEQ ID NO: 4754211 - DNA, 14 bp, Homo sapiens
tctgagaaagacta

SEQ ID NO: 4754212 - DNA, 19 bp, Homo sapiens
tctgagaaagactattcaa

SEQ ID NO: 4754213 - DNA, 23 bp, Homo sapiens
aagggaaactgccagcaacgcag

SEQ ID NO: 4754214 - DNA, 14 bp, Homo sapiens
aagggatggcaaga

SEQ ID NO: 4754215 - DNA, 19 bp, Homo sapiens
aagggtgatgggaaagcat

SEQ ID NO: 4754216 - DNA, 14 bp, Homo sapiens
aagtaaaaccacag

SEQ ID NO: 4754217 - DNA, 17 bp, Homo sapiens
aagtaaaaccacagcag

SEQ ID NO: 4754218 - DNA, 18 bp, Homo sapiens
aagtaaaaccacagcagt

SEQ ID NO: 4754219 - DNA, 22 bp, Homo sapiens
aagtatgcactaatcaatactt

SEQ ID NO: 4754220 - DNA, 21 bp, Homo sapiens
aatacattattggacttccat

SEQ ID NO: 4754221 - DNA, 18 bp, Homo sapiens
aataccatgccatttaaa

SEQ ID NO: 4754222 - DNA, 15 bp, Homo sapiens
aatactaataaaata

SEQ ID NO: 4754223 - DNA, 14 bp, Homo sapiens
aatattaaaaatta

SEQ ID NO: 4754224 - DNA, 18 bp, Homo sapiens
aatattaaaaattaattc

SEQ ID NO: 4754225 - DNA, 15 bp, Homo sapiens
aatcaagaaacttaa

SEQ ID NO: 4754226 - DNA, 13 bp, Homo sapiens
aatcaatactttg

SEQ ID NO: 4754227 - DNA, 15 bp, Homo sapiens
aatcaatactttgaa

SEQ ID NO: 4754228 - DNA, 15 bp, Homo sapiens
aatcactcatttatt

SEQ ID NO: 4754229 - DNA, 16 bp, Homo sapiens
aattagatgactgaat

SEQ ID NO: 4754230 - DNA, 13 bp, Homo sapiens
aattatattttga

SEQ ID NO: 4754231 - DNA, 23 bp, Homo sapiens
aattatattttgaacaactcgaa

SEQ ID NO: 4754232 - DNA, 13 bp, Homo sapiens
aattcattccatt

SEQ ID NO: 4754233 - DNA, 15 bp, Homo sapiens
aattcattccatttg

SEQ ID NO: 4754234 - DNA, 13 bp, Homo sapiens
aattccaatacat

SEQ ID NO: 4754235 - DNA, 12 bp, Homo sapiens
aatttctatggc

SEQ ID NO: 4754236 - DNA, 17 bp, Homo sapiens
aattttctagaatacta

SEQ ID NO: 4754237 - DNA, 21 bp, Homo sapiens
aatttttcttatttcatttct

SEQ ID NO: 4754238 - DNA, 14 bp, Homo sapiens
acaaaaacacagca

SEQ ID NO: 4754239 - DNA, 13 bp, Homo sapiens
acaaactcatcca

SEQ ID NO: 4754240 - DNA, 15 bp, Homo sapiens
acacactcaaatcaa

SEQ ID NO: 4754241 - DNA, 17 bp, Homo sapiens
acactcaaatcaagaaa

SEQ ID NO: 4754242 - DNA, 18 bp, Homo sapiens
acagcaagggtgatggga

SEQ ID NO: 4754243 - DNA, 22 bp, Homo sapiens
acagcagttgaaaagactccaa

SEQ ID NO: 4754244 - DNA, 15 bp, Homo sapiens
acagccagactggca

SEQ ID NO: 4754245 - DNA, 15 bp, Homo sapiens
acagtctcaggaaat

SEQ ID NO: 4754246 - DNA, 18 bp, Homo sapiens
acagttttctgagaaaga

SEQ ID NO: 4754247 - DNA, 18 bp, Homo sapiens
acataagctagaaaaatt

SEQ ID NO: 4754248 - DNA, 14 bp, Homo sapiens
acatttatctttgt

SEQ ID NO: 4754249 - DNA, 14 bp, Homo sapiens
accaacacgagcag

SEQ ID NO: 4754250 - DNA, 16 bp, Homo sapiens
acccaagtccaagcat

SEQ ID NO: 4754251 - DNA, 20 bp, Homo sapiens
acgagcaggctactgtcagc

SEQ ID NO: 4754252 - DNA, 19 bp, Homo sapiens
acgcaggcccccaggtgcc

SEQ ID NO: 4754253 - DNA, 15 bp, Homo sapiens
actaataaaatacat

SEQ ID NO: 4754254 - DNA, 16 bp, Homo sapiens
actaataaaatacata

SEQ ID NO: 4754255 - DNA, 16 bp, Homo sapiens
actaatcaatactttg

SEQ ID NO: 4754256 - DNA, 18 bp, Homo sapiens
actatagattctttatta

SEQ ID NO: 4754257 - DNA, 13 bp, Homo sapiens
actattcaaacag

SEQ ID NO: 4754258 - DNA, 16 bp, Homo sapiens
actattcaaacagtct

SEQ ID NO: 4754259 - DNA, 18 bp, Homo sapiens
actattcaaacagtctca

SEQ ID NO: 4754260 - DNA, 21 bp, Homo sapiens
actattcaaacagtctcagga

SEQ ID NO: 4754261 - DNA, 13 bp, Homo sapiens
actcatccattaa

SEQ ID NO: 4754262 - DNA, 16 bp, Homo sapiens
actcatttatttccat

SEQ ID NO: 4754263 - DNA, 19 bp, Homo sapiens
actcatttatttccatatt

SEQ ID NO: 4754264 - DNA, 18 bp, Homo sapiens
actccaaagaaatgtaag

SEQ ID NO: 4754265 - DNA, 12 bp, Homo sapiens
actgaatttcta

SEQ ID NO: 4754266 - DNA, 15 bp, Homo sapiens
actgacttctaagta

SEQ ID NO: 4754267 - DNA, 13 bp, Homo sapiens
actggcacagttt

SEQ ID NO: 4754268 - DNA, 22 bp, Homo sapiens
actggcacagttttctgagaaa

SEQ ID NO: 4754269 - DNA, 23 bp, Homo sapiens
actgtcagctcccctcggagaag

SEQ ID NO: 4754270 - DNA, 11 bp, Homo sapiens
acttccatttg

SEQ ID NO: 4754271 - DNA, 20 bp, Homo sapiens
acttccatttggaatcatat

SEQ ID NO: 4754272 - DNA, 22 bp, Homo sapiens
acttccatttggaatcatatgg

SEQ ID NO: 4754273 - DNA, 23 bp, Homo sapiens
agaaacttaaggttacctttgtt

SEQ ID NO: 4754274 - DNA, 20 bp, Homo sapiens
agaaagactattcaaacagt

SEQ ID NO: 4754275 - DNA, 22 bp, Homo sapiens
agaagagctgttcacagccaga

SEQ ID NO: 4754276 - DNA, 19 bp, Homo sapiens
agaatattaaaaattaatt

SEQ ID NO: 4754277 - DNA, 14 bp, Homo sapiens
agactattcaaaca

SEQ ID NO: 4754278 - DNA, 16 bp, Homo sapiens
agactattcaaacagt

SEQ ID NO: 4754279 - DNA, 21 bp, Homo sapiens
agactattcaaacagtctcag

SEQ ID NO: 4754280 - DNA, 19 bp, Homo sapiens
agactccaaagaaatgtaa

SEQ ID NO: 4754281 - DNA, 22 bp, Homo sapiens
agactccaaagaaatgtaaggg

SEQ ID NO: 4754282 - DNA, 14 bp, Homo sapiens
agactggcacagtt

SEQ ID NO: 4754283 - DNA, 21 bp, Homo sapiens
agagctgttcacagccagact

SEQ ID NO: 4754284 - DNA, 22 bp, Homo sapiens
agatgtgaacacatcagcttgc

SEQ ID NO: 4754285 - DNA, 18 bp, Homo sapiens
agcaaattccaatacatt

SEQ ID NO: 4754286 - DNA, 20 bp, Homo sapiens
agcaggctactgtcagctcc

SEQ ID NO: 4754287 - DNA, 13 bp, Homo sapiens
agcagttgaaaag

SEQ ID NO: 4754288 - DNA, 17 bp, Homo sapiens
agcattgtaaatgtgct

SEQ ID NO: 4754289 - DNA, 18 bp, Homo sapiens
agcattgtaaatgtgctt

SEQ ID NO: 4754290 - DNA, 22 bp, Homo sapiens
agctcccctcggagaagagctg

SEQ ID NO: 4754291 - DNA, 14 bp, Homo sapiens
agctgttcacagcc

SEQ ID NO: 4754292 - DNA, 19 bp, Homo sapiens
agctgttcacagccagact

SEQ ID NO: 4754293 - DNA, 19 bp, Homo sapiens
aggaaatcaaatatgcaaa

SEQ ID NO: 4754294 - DNA, 22 bp, Homo sapiens
aggaaatcaaatatgcaaagca

SEQ ID NO: 4754295 - DNA, 15 bp, Homo sapiens
aggcccccaggtgcc

SEQ ID NO: 4754296 - DNA, 14 bp, Homo sapiens
agggaaactgccag

SEQ ID NO: 4754297 - DNA, 17 bp, Homo sapiens
agggacaggataagagg

SEQ ID NO: 4754298 - DNA, 17 bp, Homo sapiens
agggcagggacaggata

SEQ ID NO: 4754299 - DNA, 21 bp, Homo sapiens
agggtgatgggaaagcattgt

SEQ ID NO: 4754300 - DNA, 18 bp, Homo sapiens
aggtgctacaaaaacaca

SEQ ID NO: 4754301 - DNA, 19 bp, Homo sapiens
aggtgctacaaaaacacag

SEQ ID NO: 4754302 - DNA, 23 bp, Homo sapiens
aggtgctacaaaaacacagcaag

SEQ ID NO: 4754303 - DNA, 15 bp, Homo sapiens
agtaaaaccacagca

SEQ ID NO: 4754304 - DNA, 17 bp, Homo sapiens
agtaaaaccacagcagt

SEQ ID NO: 4754305 - DNA, 17 bp, Homo sapiens
agtaagcacctttagaa

SEQ ID NO: 4754306 - DNA, 14 bp, Homo sapiens
agtatattcaaaaa

SEQ ID NO: 4754307 - DNA, 18 bp, Homo sapiens
agtatgcactaatcaata

SEQ ID NO: 4754308 - DNA, 23 bp, Homo sapiens
agtatgcactaatcaatactttg

SEQ ID NO: 4754309 - DNA, 16 bp, Homo sapiens
agtctcaggaaatcaa

SEQ ID NO: 4754310 - DNA, 16 bp, Homo sapiens
agtgaagtatgcacta

SEQ ID NO: 4754311 - DNA, 19 bp, Homo sapiens
agtgatgtcactagggcag

SEQ ID NO: 4754312 - DNA, 14 bp, Homo sapiens
agttgaaaagactc

SEQ ID NO: 4754313 - DNA, 20 bp, Homo sapiens
agttgaaaagactccaaaga

SEQ ID NO: 4754314 - DNA, 21 bp, Homo sapiens
agttgaaaagactccaaagaa

SEQ ID NO: 4754315 - DNA, 22 bp, Homo sapiens
agttgaaaagactccaaagaaa

SEQ ID NO: 4754316 - DNA, 13 bp, Homo sapiens
agttttctgagaa

SEQ ID NO: 4754317 - DNA, 14 bp, Homo sapiens
agttttctgagaaa

SEQ ID NO: 4754318 - DNA, 17 bp, Homo sapiens
ataaaattcattccatt

SEQ ID NO: 4754319 - DNA, 19 bp, Homo sapiens
atacatactatagattctt

SEQ ID NO: 4754320 - DNA, 12 bp, Homo sapiens
atactaataaaa

SEQ ID NO: 4754321 - DNA, 19 bp, Homo sapiens
atactaataaaatacatac

SEQ ID NO: 4754322 - DNA, 15 bp, Homo sapiens
atagattctttatta

SEQ ID NO: 4754323 - DNA, 23 bp, Homo sapiens
ataggtgctacaaaaacacagca

SEQ ID NO: 4754324 - DNA, 14 bp, Homo sapiens
atatgcaaagcact

SEQ ID NO: 4754325 - DNA, 21 bp, Homo sapiens
atattaaaaattaattcttta

SEQ ID NO: 4754326 - DNA, 22 bp, Homo sapiens
atattaaaaattaattctttat

SEQ ID NO: 4754327 - DNA, 12 bp, Homo sapiens
atattaaaatca

SEQ ID NO: 4754328 - DNA, 18 bp, Homo sapiens
atattaaaatcacaaact

SEQ ID NO: 4754329 - DNA, 14 bp, Homo sapiens
atattgataataaa

SEQ ID NO: 4754330 - DNA, 16 bp, Homo sapiens
atattgataataaaat

SEQ ID NO: 4754331 - DNA, 17 bp, Homo sapiens
atattgataataaaatt

SEQ ID NO: 4754332 - DNA, 14 bp, Homo sapiens
atcaaatatgcaaa

SEQ ID NO: 4754333 - DNA, 15 bp, Homo sapiens
atcaaatatgcaaag

SEQ ID NO: 4754334 - DNA, 17 bp, Homo sapiens
atcaaatatgcaaagca

SEQ ID NO: 4754335 - DNA, 18 bp, Homo sapiens
atcactcatttatttcca

SEQ ID NO: 4754336 - DNA, 20 bp, Homo sapiens
atcatttctgcatcagctgc

SEQ ID NO: 4754337 - DNA, 15 bp, Homo sapiens
atctcaaaactgcac

SEQ ID NO: 4754338 - DNA, 12 bp, Homo sapiens
atctttaaaata

SEQ ID NO: 4754339 - DNA, 21 bp, Homo sapiens
atgatgatctttaaaatacac

SEQ ID NO: 4754340 - DNA, 13 bp, Homo sapiens
atgcaaagcactg

SEQ ID NO: 4754341 - DNA, 15 bp, Homo sapiens
atgcaaagcactgac

SEQ ID NO: 4754342 - DNA, 21 bp, Homo sapiens
atgcactaatcaatactttga

SEQ ID NO: 4754343 - DNA, 17 bp, Homo sapiens
atgccatttaaagctta

SEQ ID NO: 4754344 - DNA, 16 bp, Homo sapiens
atggaacataaaatac

SEQ ID NO: 4754345 - DNA, 21 bp, Homo sapiens
atggcatattgataataaaat

SEQ ID NO: 4754346 - DNA, 14 bp, Homo sapiens
tgaacacatcagct

SEQ ID NO: 4754347 - DNA, 21 bp, Homo sapiens
tgaagtatgcactaatcaata

SEQ ID NO: 4754348 - DNA, 17 bp, Homo sapiens
tgactgaatttctatgg

SEQ ID NO: 4754349 - DNA, 15 bp, Homo sapiens
tgagaaagactattc

SEQ ID NO: 4754350 - DNA, 15 bp, Homo sapiens
tgagcaggattttaa

SEQ ID NO: 4754351 - DNA, 20 bp, Homo sapiens
tgagcaggattttaatcttt

SEQ ID NO: 4754352 - DNA, 18 bp, Homo sapiens
tgagtgtcttaattaaaa

SEQ ID NO: 4754353 - DNA, 22 bp, Homo sapiens
tgataataaaattcattccatt

SEQ ID NO: 4754354 - DNA, 14 bp, Homo sapiens
tgatgatctttaaa

SEQ ID NO: 4754355 - DNA, 18 bp, Homo sapiens
tgcaaagcactgacttct

SEQ ID NO: 4754356 - DNA, 20 bp, Homo sapiens
tgcaaagcactgacttctaa

SEQ ID NO: 4754357 - DNA, 22 bp, Homo sapiens
tgcaaagcactgacttctaagt

SEQ ID NO: 4754358 - DNA, 13 bp, Homo sapiens
tgcatcagctgct

SEQ ID NO: 4754359 - DNA, 22 bp, Homo sapiens
tgcatcagctgctgaaacaaca

SEQ ID NO: 4754360 - DNA, 20 bp, Homo sapiens
tgctacaaaaacacagcaag

SEQ ID NO: 4754361 - DNA, 22 bp, Homo sapiens
tggaatttctcccagtcattta

SEQ ID NO: 4754362 - DNA, 22 bp, Homo sapiens
tggcacagttttctgagaaaga

SEQ ID NO: 4754363 - DNA, 17 bp, Homo sapiens
tgggaaagcattgtaaa

SEQ ID NO: 4754364 - DNA, 13 bp, Homo sapiens
tgtctgaaatttt

SEQ ID NO: 4754365 - DNA, 14 bp, Homo sapiens
tgtcttaattaaaa

SEQ ID NO: 4754366 - DNA, 15 bp, Homo sapiens
tgtgaagaaacattt

SEQ ID NO: 4754367 - DNA, 12 bp, Homo sapiens
tgtgttactgat

SEQ ID NO: 4754368 - DNA, 16 bp, Homo sapiens
tgttcacagccagact

SEQ ID NO: 4754369 - DNA, 17 bp, Homo sapiens
tgtttaaaatcatttct

SEQ ID NO: 4754370 - DNA, 18 bp, Homo sapiens
tgtttaaaatcatttctg

SEQ ID NO: 4754371 - DNA, 15 bp, Homo sapiens
ttaaaagatgaaaat

SEQ ID NO: 4754372 - DNA, 18 bp, Homo sapiens
ttaaaatacacactcaaa

SEQ ID NO: 4754373 - DNA, 15 bp, Homo sapiens
ttaatgtagataaag

SEQ ID NO: 4754374 - DNA, 18 bp, Homo sapiens
ttaatgtagataaagcac

SEQ ID NO: 4754375 - DNA, 20 bp, Homo sapiens
ttaatgtagataaagcactg

SEQ ID NO: 4754376 - DNA, 23 bp, Homo sapiens
ttaattctttatcacatgttgtc

SEQ ID NO: 4754377 - DNA, 11 bp, Homo sapiens
ttatctcaaaa

SEQ ID NO: 4754378 - DNA, 18 bp, Homo sapiens
ttatggctataggtgcta

SEQ ID NO: 4754379 - DNA, 20 bp, Homo sapiens
ttattagtgaagtatgcact

SEQ ID NO: 4754380 - DNA, 16 bp, Homo sapiens
ttattggacttccatt

SEQ ID NO: 4754381 - DNA, 22 bp, Homo sapiens
ttatttccatattaaaatcaca

SEQ ID NO: 4754382 - DNA, 17 bp, Homo sapiens
ttcaaaaattatatttt

SEQ ID NO: 4754383 - DNA, 16 bp, Homo sapiens
ttctaagtaaaaccac

SEQ ID NO: 4754384 - DNA, 17 bp, Homo sapiens
ttctaagtaaaaccaca

SEQ ID NO: 4754385 - DNA, 19 bp, Homo sapiens
ttctaagtaaaaccacagc

SEQ ID NO: 4754386 - DNA, 21 bp, Homo sapiens
ttctaagtaaaaccacagcag

SEQ ID NO: 4754387 - DNA, 23 bp, Homo sapiens
ttctatggcatattgataataaa

SEQ ID NO: 4754388 - DNA, 18 bp, Homo sapiens
ttctattgtgctttctat

SEQ ID NO: 4754389 - DNA, 16 bp, Homo sapiens
ttctgcatcagctgct

SEQ ID NO: 4754390 - DNA, 16 bp, Homo sapiens
ttcttctattgtgctt

SEQ ID NO: 4754391 - DNA, 16 bp, Homo sapiens
ttctttatcacatgtt

SEQ ID NO: 4754392 - DNA, 22 bp, Homo sapiens
ttgaaaagactccaaagaaatg

SEQ ID NO: 4754393 - DNA, 23 bp, Homo sapiens
ttgaaaagactccaaagaaatgt

SEQ ID NO: 4754394 - DNA, 21 bp, Homo sapiens
ttgaacaactcgaatcactca

SEQ ID NO: 4754395 - DNA, 14 bp, Homo sapiens
ttgataataaaatt

SEQ ID NO: 4754396 - DNA, 18 bp, Homo sapiens
ttgataataaaattcatt

SEQ ID NO: 4754397 - DNA, 17 bp, Homo sapiens
ttgtttaaaatcatttc

SEQ ID NO: 4754398 - DNA, 14 bp, Homo sapiens
ttgttttcattatc

SEQ ID NO: 4754399 - DNA, 19 bp, Homo sapiens
tttaaaatacacactcaaa

SEQ ID NO: 4754400 - DNA, 14 bp, Homo sapiens
tttattagtgaagt

SEQ ID NO: 4754401 - DNA, 22 bp, Homo sapiens
tttattgtttaaaatcatttct

SEQ ID NO: 4754402 - DNA, 14 bp, Homo sapiens
tttctagaatacta

SEQ ID NO: 4754403 - DNA, 15 bp, Homo sapiens
tttctagaatactaa

SEQ ID NO: 4754404 - DNA, 22 bp, Homo sapiens
tttctagaatactaataaaata

SEQ ID NO: 4754405 - DNA, 18 bp, Homo sapiens
tttctcccagtcatttaa

SEQ ID NO: 4754406 - DNA, 16 bp, Homo sapiens
tttgaacaactcgaat

SEQ ID NO: 4754407 - DNA, 22 bp, Homo sapiens
tttgaacaactcgaatcactca

SEQ ID NO: 4754408 - DNA, 18 bp, Homo sapiens
ttttctgagaaagactat

SEQ ID NO: 4754409 - DNA, 18 bp, Homo sapiens
atgtagcaaattccaata

SEQ ID NO: 4754410 - DNA, 15 bp, Homo sapiens
atgtgaacacatcag

SEQ ID NO: 4754411 - DNA, 15 bp, Homo sapiens
atgttcctagtgaaa

SEQ ID NO: 4754412 - DNA, 16 bp, Homo sapiens
atgttcctagtgaaag

SEQ ID NO: 4754413 - DNA, 13 bp, Homo sapiens
attaaaatcacaa

SEQ ID NO: 4754414 - DNA, 17 bp, Homo sapiens
attaattctttatcaca

SEQ ID NO: 4754415 - DNA, 22 bp, Homo sapiens
attaattctttatcacatgttg

SEQ ID NO: 4754416 - DNA, 21 bp, Homo sapiens
attagatgactgaatttctat

SEQ ID NO: 4754417 - DNA, 16 bp, Homo sapiens
attagggagagaagat

SEQ ID NO: 4754418 - DNA, 22 bp, Homo sapiens
attatattttgaacaactcgaa

SEQ ID NO: 4754419 - DNA, 18 bp, Homo sapiens
attcaaacagtctcagga

SEQ ID NO: 4754420 - DNA, 14 bp, Homo sapiens
attccaatacatta

SEQ ID NO: 4754421 - DNA, 16 bp, Homo sapiens
attccatttgctgatt

SEQ ID NO: 4754422 - DNA, 14 bp, Homo sapiens
attgataataaaat

SEQ ID NO: 4754423 - DNA, 15 bp, Homo sapiens
attgataataaaatt

SEQ ID NO: 4754424 - DNA, 18 bp, Homo sapiens
attgataataaaattcat

SEQ ID NO: 4754425 - DNA, 13 bp, Homo sapiens
attggacttccat

SEQ ID NO: 4754426 - DNA, 14 bp, Homo sapiens
attggacttccatt

SEQ ID NO: 4754427 - DNA, 21 bp, Homo sapiens
attgtctgaaattttctagaa

SEQ ID NO: 4754428 - DNA, 22 bp, Homo sapiens
atttatttccatattaaaatca

SEQ ID NO: 4754429 - DNA, 13 bp, Homo sapiens
atttccatattaa

SEQ ID NO: 4754430 - DNA, 14 bp, Homo sapiens
atttccatattaaa

SEQ ID NO: 4754431 - DNA, 16 bp, Homo sapiens
atttctatggcatatt

SEQ ID NO: 4754432 - DNA, 19 bp, Homo sapiens
atttctatggcatattgat

SEQ ID NO: 4754433 - DNA, 15 bp, Homo sapiens
atttggaatcatatg

SEQ ID NO: 4754434 - DNA, 15 bp, Homo sapiens
atttgtatcacaaat

SEQ ID NO: 4754435 - DNA, 22 bp, Homo sapiens
attttctagaatactaataaaa

SEQ ID NO: 4754436 - DNA, 20 bp, Homo sapiens
atttttcttatttcatttct

SEQ ID NO: 4754437 - DNA, 15 bp, Homo sapiens
caaaagtatattcaa

SEQ ID NO: 4754438 - DNA, 22 bp, Homo sapiens
caaaagtatattcaaaaattat

SEQ ID NO: 4754439 - DNA, 17 bp, Homo sapiens
caaacagtctcaggaaa

SEQ ID NO: 4754440 - DNA, 13 bp, Homo sapiens
caaatatgcaaag

SEQ ID NO: 4754441 - DNA, 14 bp, Homo sapiens
caaatatgcaaagc

SEQ ID NO: 4754442 - DNA, 19 bp, Homo sapiens
caaatatgcaaagcactga

SEQ ID NO: 4754443 - DNA, 16 bp, Homo sapiens
caaattccaatacatt

SEQ ID NO: 4754444 - DNA, 18 bp, Homo sapiens
caagcaggctcaacataa

SEQ ID NO: 4754445 - DNA, 16 bp, Homo sapiens
caagcataccaacacg

SEQ ID NO: 4754446 - DNA, 21 bp, Homo sapiens
caagcataccaacacgagcag

SEQ ID NO: 4754447 - DNA, 20 bp, Homo sapiens
cacaaaagtatattcaaaaa

SEQ ID NO: 4754448 - DNA, 11 bp, Homo sapiens
cacaacagatt

SEQ ID NO: 4754449 - DNA, 19 bp, Homo sapiens
cacagcagttgaaaagact

SEQ ID NO: 4754450 - DNA, 18 bp, Homo sapiens
cacagccagactggcaca

SEQ ID NO: 4754451 - DNA, 20 bp, Homo sapiens
cacagttttctgagaaagac

SEQ ID NO: 4754452 - DNA, 13 bp, Homo sapiens
cacatcagcttgc

SEQ ID NO: 4754453 - DNA, 23 bp, Homo sapiens
cacatcagcttgccctgttaaaa

SEQ ID NO: 4754454 - DNA, 22 bp, Homo sapiens
cacctttagaatattaaaaatt

SEQ ID NO: 4754455 - DNA, 20 bp, Homo sapiens
cacgagcaggctactgtcag

SEQ ID NO: 4754456 - DNA, 20 bp, Homo sapiens
cactagggcagggacaggat

SEQ ID NO: 4754457 - DNA, 16 bp, Homo sapiens
cactcaaatcaagaaa

SEQ ID NO: 4754458 - DNA, 15 bp, Homo sapiens
cactgacttctaagt

SEQ ID NO: 4754459 - DNA, 22 bp, Homo sapiens
cagactggcacagttttctgag

SEQ ID NO: 4754460 - DNA, 22 bp, Homo sapiens
cagcaagggtgatgggaaagca

SEQ ID NO: 4754461 - DNA, 17 bp, Homo sapiens
cagcagttgaaaagact

SEQ ID NO: 4754462 - DNA, 15 bp, Homo sapiens
cagccagactggcac

SEQ ID NO: 4754463 - DNA, 20 bp, Homo sapiens
cagccagactggcacagttt

SEQ ID NO: 4754464 - DNA, 20 bp, Homo sapiens
cagctcccctcggagaagag

SEQ ID NO: 4754465 - DNA, 21 bp, Homo sapiens
cagctcccctcggagaagagc

SEQ ID NO: 4754466 - DNA, 22 bp, Homo sapiens
cagctcccctcggagaagagct

SEQ ID NO: 4754467 - DNA, 18 bp, Homo sapiens
cagcttgaaactgagatg

SEQ ID NO: 4754468 - DNA, 22 bp, Homo sapiens
caggaaatcaaatatgcaaagc

SEQ ID NO: 4754469 - DNA, 16 bp, Homo sapiens
caggattttaatcttt

SEQ ID NO: 4754470 - DNA, 11 bp, Homo sapiens
caggctactgt

SEQ ID NO: 4754471 - DNA, 17 bp, Homo sapiens
cagggcatggctgggaa

SEQ ID NO: 4754472 - DNA, 21 bp, Homo sapiens
cagttgaaaagactccaaaga

SEQ ID NO: 4754473 - DNA, 20 bp, Homo sapiens
cagttttctgagaaagacta

SEQ ID NO: 4754474 - DNA, 21 bp, Homo sapiens
catactatagattctttatta

SEQ ID NO: 4754475 - DNA, 17 bp, Homo sapiens
catattaaaatcacaaa

SEQ ID NO: 4754476 - DNA, 19 bp, Homo sapiens
catattgataataaaattc

SEQ ID NO: 4754477 - DNA, 21 bp, Homo sapiens
cattaatgtagataaagcact

SEQ ID NO: 4754478 - DNA, 19 bp, Homo sapiens
cattattggacttccattt

SEQ ID NO: 4754479 - DNA, 14 bp, Homo sapiens
catttatctttgta

SEQ ID NO: 4754480 - DNA, 21 bp, Homo sapiens
catttatttccatattaaaat

SEQ ID NO: 4754481 - DNA, 23 bp, Homo sapiens
ccaaatttcatacctatcatctt

SEQ ID NO: 4754482 - DNA, 14 bp, Homo sapiens
ccaacacgagcagg

SEQ ID NO: 4754483 - DNA, 12 bp, Homo sapiens
ccacagcagttg

SEQ ID NO: 4754484 - DNA, 18 bp, Homo sapiens
ccacagcagttgaaaaga

SEQ ID NO: 4754485 - DNA, 13 bp, Homo sapiens
ccaggtgccagtt

SEQ ID NO: 4754486 - DNA, 22 bp, Homo sapiens
ccatttaaagcttattaaaact

SEQ ID NO: 4754487 - DNA, 13 bp, Homo sapiens
cccaggtgccagt

SEQ ID NO: 4754488 - DNA, 23 bp, Homo sapiens
ctaagtaaaaccacagcagttga

SEQ ID NO: 4754489 - DNA, 20 bp, Homo sapiens
ctaatttttattaatttgta

SEQ ID NO: 4754490 - DNA, 17 bp, Homo sapiens
ctacaaaaacacagcaa

SEQ ID NO: 4754491 - DNA, 18 bp, Homo sapiens
ctacatactatggaattt

SEQ ID NO: 4754492 - DNA, 17 bp, Homo sapiens
ctagaatactaataaaa

SEQ ID NO: 4754493 - DNA, 20 bp, Homo sapiens
ctataggtgctacaaaaaca

SEQ ID NO: 4754494 - DNA, 22 bp, Homo sapiens
ctcaggaaatcaaatatgcaaa

SEQ ID NO: 4754495 - DNA, 17 bp, Homo sapiens
ctcatttatttccatat

SEQ ID NO: 4754496 - DNA, 20 bp, Homo sapiens
ctcggagaagagctgttcac

SEQ ID NO: 4754497 - DNA, 14 bp, Homo sapiens
ctgaaattttctag

SEQ ID NO: 4754498 - DNA, 16 bp, Homo sapiens
ctgacttctaagtaaa

SEQ ID NO: 4754499 - DNA, 12 bp, Homo sapiens
ctgagaaagact

SEQ ID NO: 4754500 - DNA, 20 bp, Homo sapiens
ctgagaaagactattcaaac

SEQ ID NO: 4754501 - DNA, 23 bp, Homo sapiens
ctgagaaagactattcaaacagt

SEQ ID NO: 4754502 - DNA, 18 bp, Homo sapiens
ctgatgttcctagtgaaa

SEQ ID NO: 4754503 - DNA, 17 bp, Homo sapiens
ctgattgtctgaaattt

SEQ ID NO: 4754504 - DNA, 17 bp, Homo sapiens
ctgctggtcttatcctg

SEQ ID NO: 4754505 - DNA, 18 bp, Homo sapiens
ctggcacagttttctgag

SEQ ID NO: 4754506 - DNA, 19 bp, Homo sapiens
ctggcacagttttctgaga

SEQ ID NO: 4754507 - DNA, 20 bp, Homo sapiens
ctggcacagttttctgagaa

SEQ ID NO: 4754508 - DNA, 21 bp, Homo sapiens
ctggcacagttttctgagaaa

SEQ ID NO: 4754509 - DNA, 23 bp, Homo sapiens
ctgtcagctcccctcggagaaga

SEQ ID NO: 4754510 - DNA, 13 bp, Homo sapiens
ctgtgttactgat

SEQ ID NO: 4754511 - DNA, 19 bp, Homo sapiens
ctgttcacagccagactgg

SEQ ID NO: 4754512 - DNA, 22 bp, Homo sapiens
cttctaagtaaaaccacagcag

SEQ ID NO: 4754513 - DNA, 21 bp, Homo sapiens
cttctgtcttcacaacagatt

SEQ ID NO: 4754514 - DNA, 22 bp, Homo sapiens
cttctgtcttcacaacagatta

SEQ ID NO: 4754515 - DNA, 18 bp, Homo sapiens
ctttagaatattaaaaat

SEQ ID NO: 4754516 - DNA, 14 bp, Homo sapiens
ctttattagtgaag

SEQ ID NO: 4754517 - DNA, 16 bp, Homo sapiens
gaaaagactccaaaga

SEQ ID NO: 4754518 - DNA, 17 bp, Homo sapiens
gaaaagactccaaagaa

SEQ ID NO: 4754519 - DNA, 20 bp, Homo sapiens
gaaaagactccaaagaaatg

SEQ ID NO: 4754520 - DNA, 21 bp, Homo sapiens
gaaaagactccaaagaaatgt

SEQ ID NO: 4754521 - DNA, 13 bp, Homo sapiens
gaaacatttatct

SEQ ID NO: 4754522 - DNA, 15 bp, Homo sapiens
gaaactgccagcaac

SEQ ID NO: 4754523 - DNA, 19 bp, Homo sapiens
gaaatcaaatatgcaaagc

SEQ ID NO: 4754524 - DNA, 21 bp, Homo sapiens
gaaatcaaatatgcaaagcac

SEQ ID NO: 4754525 - DNA, 14 bp, Homo sapiens
gaaattttctagaa

SEQ ID NO: 4754526 - DNA, 15 bp, Homo sapiens
gaatactaataaaat

SEQ ID NO: 4754527 - DNA, 20 bp, Homo sapiens
gaatactaataaaatacata

SEQ ID NO: 4754528 - DNA, 21 bp, Homo sapiens
gaatcactcatttatttccat

SEQ ID NO: 4754529 - DNA, 15 bp, Homo sapiens
gactattcaaacagt

SEQ ID NO: 4754530 - DNA, 16 bp, Homo sapiens
gactattcaaacagtc

SEQ ID NO: 4754531 - DNA, 16 bp, Homo sapiens
gactccaaagaaatgt

SEQ ID NO: 4754532 - DNA, 14 bp, Homo sapiens
gactgaatttctat

SEQ ID NO: 4754533 - DNA, 13 bp, Homo sapiens
gacttccatttgg

SEQ ID NO: 4754534 - DNA, 19 bp, Homo sapiens
gacttctaagtaaaaccac

SEQ ID NO: 4754535 - DNA, 23 bp, Homo sapiens
gacttctaagtaaaaccacagca

SEQ ID NO: 4754536 - DNA, 13 bp, Homo sapiens
gagaaagactatt

SEQ ID NO: 4754537 - DNA, 17 bp, Homo sapiens
gagaaagactattcaaa

SEQ ID NO: 4754538 - DNA, 19 bp, Homo sapiens
gagtgtcttaattaaaaga

SEQ ID NO: 4754539 - DNA, 14 bp, Homo sapiens
gataataaaattca

SEQ ID NO: 4754540 - DNA, 13 bp, Homo sapiens
aattaattcttta

SEQ ID NO: 4754541 - DNA, 14 bp, Homo sapiens
aattaattctttat

SEQ ID NO: 4754542 - DNA, 14 bp, Homo sapiens
aattatattttgaa

SEQ ID NO: 4754543 - DNA, 14 bp, Homo sapiens
aattcattccattt

SEQ ID NO: 4754544 - DNA, 20 bp, Homo sapiens
aatttctcccagtcatttaa

SEQ ID NO: 4754545 - DNA, 16 bp, Homo sapiens
aattttctagaatact

SEQ ID NO: 4754546 - DNA, 19 bp, Homo sapiens
aattttctagaatactaat

SEQ ID NO: 4754547 - DNA, 13 bp, Homo sapiens
acaaaaacacagc

SEQ ID NO: 4754548 - DNA, 16 bp, Homo sapiens
acaaaagtatattcaa

SEQ ID NO: 4754549 - DNA, 22 bp, Homo sapiens
acacaaagcctgtgttactgat

SEQ ID NO: 4754550 - DNA, 20 bp, Homo sapiens
acacactcaaatcaagaaac

SEQ ID NO: 4754551 - DNA, 22 bp, Homo sapiens
acacatcagcttgccctgttaa

SEQ ID NO: 4754552 - DNA, 21 bp, Homo sapiens
acacgagcaggctactgtcag

SEQ ID NO: 4754553 - DNA, 18 bp, Homo sapiens
acactcaaatcaagaaac

SEQ ID NO: 4754554 - DNA, 19 bp, Homo sapiens
acactcaaatcaagaaact

SEQ ID NO: 4754555 - DNA, 23 bp, Homo sapiens
acagcagttgaaaagactccaaa

SEQ ID NO: 4754556 - DNA, 20 bp, Homo sapiens
acagttttctgagaaagact

SEQ ID NO: 4754557 - DNA, 17 bp, Homo sapiens
acataagctagaaaaat

SEQ ID NO: 4754558 - DNA, 20 bp, Homo sapiens
acataagctagaaaaattag

SEQ ID NO: 4754559 - DNA, 20 bp, Homo sapiens
acattattggacttccattt

SEQ ID NO: 4754560 - DNA, 21 bp, Homo sapiens
acattattggacttccatttg

SEQ ID NO: 4754561 - DNA, 11 bp, Homo sapiens
accacagcagt

SEQ ID NO: 4754562 - DNA, 13 bp, Homo sapiens
acctttagaatat

SEQ ID NO: 4754563 - DNA, 12 bp, Homo sapiens
actaataaaata

SEQ ID NO: 4754564 - DNA, 14 bp, Homo sapiens
actaatcaatactt

SEQ ID NO: 4754565 - DNA, 13 bp, Homo sapiens
actgacttctaag

SEQ ID NO: 4754566 - DNA, 13 bp, Homo sapiens
actgccagcaacg

SEQ ID NO: 4754567 - DNA, 21 bp, Homo sapiens
actggcacagttttctgagaa

SEQ ID NO: 4754568 - DNA, 22 bp, Homo sapiens
actgtcagctcccctcggagaa

SEQ ID NO: 4754569 - DNA, 23 bp, Homo sapiens
acttctaagtaaaaccacagcag

SEQ ID NO: 4754570 - DNA, 19 bp, Homo sapiens
agaaagactattcaaacag

SEQ ID NO: 4754571 - DNA, 13 bp, Homo sapiens
agaagatagcagg

SEQ ID NO: 4754572 - DNA, 14 bp, Homo sapiens
agaatattaaaaat

SEQ ID NO: 4754573 - DNA, 15 bp, Homo sapiens
agactattcaaacag

SEQ ID NO: 4754574 - DNA, 18 bp, Homo sapiens
agagctgttcacagccag

SEQ ID NO: 4754575 - DNA, 21 bp, Homo sapiens
agagtaagcacctttagaata

SEQ ID NO: 4754576 - DNA, 17 bp, Homo sapiens
agatgactgaatttcta

SEQ ID NO: 4754577 - DNA, 24 bp, Homo sapiens
agatgactgaatttctatggcata

SEQ ID NO: 4754578 - DNA, 17 bp, Homo sapiens
agatgtgaacacatcag

SEQ ID NO: 4754579 - DNA, 15 bp, Homo sapiens
agattccctgagcag

SEQ ID NO: 4754580 - DNA, 14 bp, Homo sapiens
agattctttattag

SEQ ID NO: 4754581 - DNA, 14 bp, Homo sapiens
agcaacgcaggccc

SEQ ID NO: 4754582 - DNA, 16 bp, Homo sapiens
agcaagggtgatggga

SEQ ID NO: 4754583 - DNA, 20 bp, Homo sapiens
agcaagggtgatgggaaagc

SEQ ID NO: 4754584 - DNA, 23 bp, Homo sapiens
agcacctttagaatattaaaaat

SEQ ID NO: 4754585 - DNA, 19 bp, Homo sapiens
agcactgacttctaagtaa

SEQ ID NO: 4754586 - DNA, 20 bp, Homo sapiens
agcactgtttggatatgaga

SEQ ID NO: 4754587 - DNA, 16 bp, Homo sapiens
agcaggctactgtcag

SEQ ID NO: 4754588 - DNA, 16 bp, Homo sapiens
agcagttgaaaagact

SEQ ID NO: 4754589 - DNA, 21 bp, Homo sapiens
agcagttgaaaagactccaaa

SEQ ID NO: 4754590 - DNA, 23 bp, Homo sapiens
agcagttgaaaagactccaaaga

SEQ ID NO: 4754591 - DNA, 13 bp, Homo sapiens
agcataccaacac

SEQ ID NO: 4754592 - DNA, 16 bp, Homo sapiens
agctgctgaaacaaca

SEQ ID NO: 4754593 - DNA, 16 bp, Homo sapiens
agctgttcacagccag

SEQ ID NO: 4754594 - DNA, 15 bp, Homo sapiens
agcttattaaaactc

SEQ ID NO: 4754595 - DNA, 20 bp, Homo sapiens
agcttattaaaactcatttt

SEQ ID NO: 4754596 - DNA, 17 bp, Homo sapiens
agcttgaaactgagatg

SEQ ID NO: 4754597 - DNA, 16 bp, Homo sapiens
agcttgccctgttaaa

SEQ ID NO: 4754598 - DNA, 23 bp, Homo sapiens
agggaaactgccagcaacgcagg

SEQ ID NO: 4754599 - DNA, 15 bp, Homo sapiens
agggattagggagag

SEQ ID NO: 4754600 - DNA, 16 bp, Homo sapiens
aggtgctacaaaaaca

SEQ ID NO: 4754601 - DNA, 21 bp, Homo sapiens
aggtgctacaaaaacacagca

SEQ ID NO: 4754602 - DNA, 22 bp, Homo sapiens
aggtgctacaaaaacacagcaa

SEQ ID NO: 4754603 - DNA, 18 bp, Homo sapiens
agtaagcacctttagaat

SEQ ID NO: 4754604 - DNA, 18 bp, Homo sapiens
agtatattcaaaaattat

SEQ ID NO: 4754605 - DNA, 11 bp, Homo sapiens
agtccaagcat

SEQ ID NO: 4754606 - DNA, 22 bp, Homo sapiens
agtctcaggaaatcaaatatgc

SEQ ID NO: 4754607 - DNA, 23 bp, Homo sapiens
agtgaagtatgcactaatcaata

SEQ ID NO: 4754608 - DNA, 15 bp, Homo sapiens
agtgtcttaattaaa

SEQ ID NO: 4754609 - DNA, 21 bp, Homo sapiens
agtgtcttaattaaaagaata

SEQ ID NO: 4754610 - DNA, 19 bp, Homo sapiens
agttgaaaagactccaaag

SEQ ID NO: 4754611 - DNA, 12 bp, Homo sapiens
agttttctgaga

SEQ ID NO: 4754612 - DNA, 18 bp, Homo sapiens
agttttctgagaaagact

SEQ ID NO: 4754613 - DNA, 12 bp, Homo sapiens
ataaaattcatt

SEQ ID NO: 4754614 - DNA, 16 bp, Homo sapiens
ataaaattcattccat

SEQ ID NO: 4754615 - DNA, 19 bp, Homo sapiens
ataataaaattcattccat

SEQ ID NO: 4754616 - DNA, 17 bp, Homo sapiens
atacacactcaaatcaa

SEQ ID NO: 4754617 - DNA, 18 bp, Homo sapiens
atacacactcaaatcaag

SEQ ID NO: 4754618 - DNA, 13 bp, Homo sapiens
atactaataaaat

SEQ ID NO: 4754619 - DNA, 22 bp, Homo sapiens
atactaataaaatacatactat

SEQ ID NO: 4754620 - DNA, 14 bp, Homo sapiens
atagattctttatt

SEQ ID NO: 4754621 - DNA, 22 bp, Homo sapiens
atatgagatgtagcaaattcca

SEQ ID NO: 4754622 - DNA, 16 bp, Homo sapiens
atatgcaaagcactga

SEQ ID NO: 4754623 - DNA, 14 bp, Homo sapiens
atattaaaaattaa

SEQ ID NO: 4754624 - DNA, 16 bp, Homo sapiens
atattaaaaattaatt

SEQ ID NO: 4754625 - DNA, 17 bp, Homo sapiens
atattaaaaattaattc

SEQ ID NO: 4754626 - DNA, 19 bp, Homo sapiens
atattaaaaattaattctt

SEQ ID NO: 4754627 - DNA, 14 bp, Homo sapiens
atattaaaatcaca

SEQ ID NO: 4754628 - DNA, 21 bp, Homo sapiens
atattcaaaaattatattttg

SEQ ID NO: 4754629 - DNA, 15 bp, Homo sapiens
atattgataataaaa

SEQ ID NO: 4754630 - DNA, 19 bp, Homo sapiens
atattgataataaaattca

SEQ ID NO: 4754631 - DNA, 22 bp, Homo sapiens
atattgataataaaattcattc

SEQ ID NO: 4754632 - DNA, 22 bp, Homo sapiens
atatttgtatcacaaatcttaa

SEQ ID NO: 4754633 - DNA, 20 bp, Homo sapiens
atcaaatatgcaaagcactg

SEQ ID NO: 4754634 - DNA, 14 bp, Homo sapiens
atcaatttttctta

SEQ ID NO: 4754635 - DNA, 21 bp, Homo sapiens
atcacaaaagtatattcaaaa

SEQ ID NO: 4754636 - DNA, 21 bp, Homo sapiens
atcagctgctgaaacaacaaa

SEQ ID NO: 4754637 - DNA, 23 bp, Homo sapiens
atcagctgctgaaacaacaaata

SEQ ID NO: 4754638 - DNA, 16 bp, Homo sapiens
atctaatttttattaa

SEQ ID NO: 4754639 - DNA, 18 bp, Homo sapiens
atctaatttttattaatt

SEQ ID NO: 4754640 - DNA, 20 bp, Homo sapiens
atctcaaaactgcactgtca

SEQ ID NO: 4754641 - DNA, 15 bp, Homo sapiens
atctttaaaatacac

SEQ ID NO: 4754642 - DNA, 15 bp, Homo sapiens
atgactgaatttcta

SEQ ID NO: 4754643 - DNA, 16 bp, Homo sapiens
atgatctttaaaatac

SEQ ID NO: 4754644 - DNA, 18 bp, Homo sapiens
atgatgatctttaaaata

SEQ ID NO: 4754645 - DNA, 20 bp, Homo sapiens
atgcactaatcaatactttg

SEQ ID NO: 4754646 - DNA, 20 bp, Homo sapiens
atggcatattgataataaaa

SEQ ID NO: 4754647 - DNA, 14 bp, Homo sapiens
atgggaaagcattg

SEQ ID NO: 4754648 - DNA, 16 bp, Homo sapiens
atgtagataaagcact

SEQ ID NO: 4754649 - DNA, 20 bp, Homo sapiens
atgtagcaaattccaataca

SEQ ID NO: 4754650 - DNA, 14 bp, Homo sapiens
attaaaaattaatt

SEQ ID NO: 4754651 - DNA, 16 bp, Homo sapiens
attaaaatcacaaact

SEQ ID NO: 4754652 - DNA, 13 bp, Homo sapiens
attaatgtagata

SEQ ID NO: 4754653 - DNA, 15 bp, Homo sapiens
attagtgaagtatgc

SEQ ID NO: 4754654 - DNA, 13 bp, Homo sapiens
attatattttgaa

SEQ ID NO: 4754655 - DNA, 18 bp, Homo sapiens
attatctcaaaactgcac

SEQ ID NO: 4754656 - DNA, 20 bp, Homo sapiens
attcaaaaattatattttga

SEQ ID NO: 4754657 - DNA, 20 bp, Homo sapiens
attcaaacagtctcaggaaa

SEQ ID NO: 4754658 - DNA, 12 bp, Homo sapiens
attccaatacat

SEQ ID NO: 4754659 - DNA, 16 bp, Homo sapiens
attccaatacattatt

SEQ ID NO: 4754660 - DNA, 17 bp, Homo sapiens
attggacttccatttgg

SEQ ID NO: 4754661 - DNA, 14 bp, Homo sapiens
attgtgctttctat

SEQ ID NO: 4754662 - DNA, 15 bp, Homo sapiens
attgtttaaaatcat

SEQ ID NO: 4754663 - DNA, 19 bp, Homo sapiens
atttaaagcttattaaaac

SEQ ID NO: 4754664 - DNA, 12 bp, Homo sapiens
atttatttccat

SEQ ID NO: 4754665 - DNA, 15 bp, Homo sapiens
atttctatggcatat

SEQ ID NO: 4754666 - DNA, 19 bp, Homo sapiens
atttggaatcatatgggat

SEQ ID NO: 4754667 - DNA, 21 bp, Homo sapiens
atttttgttttcattatctca

SEQ ID NO: 4754668 - DNA, 14 bp, Homo sapiens
caaaaacacagcaa

SEQ ID NO: 4754669 - DNA, 17 bp, Homo sapiens
caaaactgcactgtcaa

SEQ ID NO: 4754670 - DNA, 20 bp, Homo sapiens
caaagcactgacttctaagt

SEQ ID NO: 4754671 - DNA, 22 bp, Homo sapiens
caaagcactgacttctaagtaa

SEQ ID NO: 4754672 - DNA, 16 bp, Homo sapiens
caaatatgcaaagcac

SEQ ID NO: 4754673 - DNA, 17 bp, Homo sapiens
caaatatgcaaagcact

SEQ ID NO: 4754674 - DNA, 21 bp, Homo sapiens
caaatatgcaaagcactgact

SEQ ID NO: 4754675 - DNA, 13 bp, Homo sapiens
caaattccaatac

SEQ ID NO: 4754676 - DNA, 23 bp, Homo sapiens
caacacgagcaggctactgtcag

SEQ ID NO: 4754677 - DNA, 21 bp, Homo sapiens
caatacattattggacttcca

SEQ ID NO: 4754678 - DNA, 22 bp, Homo sapiens
caatttttcttatttcatttct

SEQ ID NO: 4754679 - DNA, 17 bp, Homo sapiens
cacagccagactggcac

SEQ ID NO: 4754680 - DNA, 15 bp, Homo sapiens
cacagttttctgaga

SEQ ID NO: 4754681 - DNA, 23 bp, Homo sapiens
cacctcaaaataccatgccattt

SEQ ID NO: 4754682 - DNA, 19 bp, Homo sapiens
cacgagcaggctactgtca

SEQ ID NO: 4754683 - DNA, 22 bp, Homo sapiens
cactcatttatttccatattaa

SEQ ID NO: 4754684 - DNA, 14 bp, Homo sapiens
cactgacttctaag

SEQ ID NO: 4754685 - DNA, 14 bp, Homo sapiens
cactgtcaagatga

SEQ ID NO: 4754686 - DNA, 18 bp, Homo sapiens
cagactggcacagttttc

SEQ ID NO: 4754687 - DNA, 19 bp, Homo sapiens
cagcaagggtgatgggaaa

SEQ ID NO: 4754688 - DNA, 23 bp, Homo sapiens
cagcaagggtgatgggaaagcat

SEQ ID NO: 4754689 - DNA, 22 bp, Homo sapiens
cagcagttgaaaagactccaaa

SEQ ID NO: 4754690 - DNA, 18 bp, Homo sapiens
cagccagactggcacagt

SEQ ID NO: 4754691 - DNA, 18 bp, Homo sapiens
cagctcccctcggagaag

SEQ ID NO: 4754692 - DNA, 20 bp, Homo sapiens
cagctgctgaaacaacaaat

SEQ ID NO: 4754693 - DNA, 17 bp, Homo sapiens
caggctcaacataacat

SEQ ID NO: 4754694 - DNA, 18 bp, Homo sapiens
cagggacaggataagagg

SEQ ID NO: 4754695 - DNA, 18 bp, Homo sapiens
cagttgaaaagactccaa

SEQ ID NO: 4754696 - DNA, 14 bp, Homo sapiens
cagttttctgagaa

SEQ ID NO: 4754697 - DNA, 18 bp, Homo sapiens
catagattccctgagcag

SEQ ID NO: 4754698 - DNA, 13 bp, Homo sapiens
catattaaaatca

SEQ ID NO: 4754699 - DNA, 16 bp, Homo sapiens
catattaaaatcacaa

SEQ ID NO: 4754700 - DNA, 15 bp, Homo sapiens
catattgataataaa

SEQ ID NO: 4754701 - DNA, 16 bp, Homo sapiens
catattgataataaaa

SEQ ID NO: 4754702 - DNA, 17 bp, Homo sapiens
catattgataataaaat

SEQ ID NO: 4754703 - DNA, 18 bp, Homo sapiens
catattgataataaaatt

SEQ ID NO: 4754704 - DNA, 13 bp, Homo sapiens
cattatctcaaaa

SEQ ID NO: 4754705 - DNA, 14 bp, Homo sapiens
catttggaatcata

SEQ ID NO: 4754706 - DNA, 17 bp, Homo sapiens
ccaaagaaatgtaaggg

SEQ ID NO: 4754707 - DNA, 13 bp, Homo sapiens
ccaatacattatt

SEQ ID NO: 4754708 - DNA, 14 bp, Homo sapiens
ccagttatggctat

SEQ ID NO: 4754709 - DNA, 14 bp, Homo sapiens
ccatattaaaatca

SEQ ID NO: 4754710 - DNA, 23 bp, Homo sapiens
ccattaatgtagataaagcactg

SEQ ID NO: 4754711 - DNA, 16 bp, Homo sapiens
ccatttggaatcatat

SEQ ID NO: 4754712 - DNA, 15 bp, Homo sapiens
cccctcggagaagag

SEQ ID NO: 4754713 - DNA, 14 bp, Homo sapiens
ccctgagcaggatt

SEQ ID NO: 4754714 - DNA, 14 bp, Homo sapiens
cctcggagaagagc

SEQ ID NO: 4754715 - DNA, 20 bp, Homo sapiens
cctgttaaaagatgaaaata

SEQ ID NO: 4754716 - DNA, 21 bp, Homo sapiens
cctgttaaaagatgaaaatat

SEQ ID NO: 4754717 - DNA, 16 bp, Homo sapiens
cctttagaatattaaa

SEQ ID NO: 4754718 - DNA, 20 bp, Homo sapiens
cctttagaatattaaaaatt

SEQ ID NO: 4754719 - DNA, 14 bp, Homo sapiens
ctaagtaaaaccac

SEQ ID NO: 4754720 - DNA, 18 bp, Homo sapiens
ctaagtaaaaccacagca

SEQ ID NO: 4754721 - DNA, 20 bp, Homo sapiens
ctaagtaaaaccacagcagt

SEQ ID NO: 4754722 - DNA, 14 bp, Homo sapiens
ctaataaaatacat

SEQ ID NO: 4754723 - DNA, 15 bp, Homo sapiens
ctaataaaatacata

SEQ ID NO: 4754724 - DNA, 16 bp, Homo sapiens
ctacaaaaacacagca

SEQ ID NO: 4754725 - DNA, 20 bp, Homo sapiens
ctacaaaaacacagcaaggg

SEQ ID NO: 4754726 - DNA, 18 bp, Homo sapiens
ctagaatactaataaaat

SEQ ID NO: 4754727 - DNA, 19 bp, Homo sapiens
ctagaatactaataaaata

SEQ ID NO: 4754728 - DNA, 18 bp, Homo sapiens
ctagtgaaagaggcagct

SEQ ID NO: 4754729 - DNA, 22 bp, Homo sapiens
ctataggtgctacaaaaacaca

SEQ ID NO: 4754730 - DNA, 21 bp, Homo sapiens
ctatctaatttttattaattt

SEQ ID NO: 4754731 - DNA, 23 bp, Homo sapiens
ctatggcatattgataataaaat

SEQ ID NO: 4754732 - DNA, 18 bp, Homo sapiens
ctattcaaacagtctcag

SEQ ID NO: 4754733 - DNA, 16 bp, Homo sapiens
ctattgtgctttctat

SEQ ID NO: 4754734 - DNA, 13 bp, Homo sapiens
ctcaaaactgcac

SEQ ID NO: 4754735 - DNA, 18 bp, Homo sapiens
ctcaacataacataagct

SEQ ID NO: 4754736 - DNA, 22 bp, Homo sapiens
ctcttctttaaagggatggcaa

SEQ ID NO: 4754737 - DNA, 15 bp, Homo sapiens
ctgaaacaacaaata

SEQ ID NO: 4754738 - DNA, 19 bp, Homo sapiens
ctgagaaagactattcaaa

SEQ ID NO: 4754739 - DNA, 22 bp, Homo sapiens
ctgagaaagactattcaaacag

SEQ ID NO: 4754740 - DNA, 21 bp, Homo sapiens
ctgagatgtgaacacatcagc

SEQ ID NO: 4754741 - DNA, 20 bp, Homo sapiens
ctgatgttcctagtgaaaga

SEQ ID NO: 4754742 - DNA, 21 bp, Homo sapiens
ctgatgttcctagtgaaagag

SEQ ID NO: 4754743 - DNA, 13 bp, Homo sapiens
ctgctgaaacaac

SEQ ID NO: 4754744 - DNA, 18 bp, Homo sapiens
ctgtcttcacaacagatt

SEQ ID NO: 4754745 - DNA, 20 bp, Homo sapiens
cttccatttggaatcatatg

SEQ ID NO: 4754746 - DNA, 20 bp, Homo sapiens
cttccttggactcattttaa

SEQ ID NO: 4754747 - DNA, 22 bp, Homo sapiens
cttgccctgttaaaagatgaaa

SEQ ID NO: 4754748 - DNA, 20 bp, Homo sapiens
ctttaaagggatggcaagat

SEQ ID NO: 4754749 - DNA, 13 bp, Homo sapiens
ctttctatctaat

SEQ ID NO: 4754750 - DNA, 14 bp, Homo sapiens
ctttctatctaatt

SEQ ID NO: 4754751 - DNA, 21 bp, Homo sapiens
ctttgagtgtcttaattaaaa

SEQ ID NO: 4754752 - DNA, 20 bp, Homo sapiens
gaaaaattagatgactgaat

SEQ ID NO: 4754753 - DNA, 14 bp, Homo sapiens
gaaaagactccaaa

SEQ ID NO: 4754754 - DNA, 18 bp, Homo sapiens
gaaaagactccaaagaaa

SEQ ID NO: 4754755 - DNA, 13 bp, Homo sapiens
gaaactgccagca

SEQ ID NO: 4754756 - DNA, 14 bp, Homo sapiens
gaaagactattcaa

SEQ ID NO: 4754757 - DNA, 19 bp, Homo sapiens
gaaagactattcaaacagt

SEQ ID NO: 4754758 - DNA, 22 bp, Homo sapiens
gaaagactattcaaacagtctc

SEQ ID NO: 4754759 - DNA, 15 bp, Homo sapiens
gaaattttctagaat

SEQ ID NO: 4754760 - DNA, 16 bp, Homo sapiens
gaacccaagtccaagc

SEQ ID NO: 4754761 - DNA, 15 bp, Homo sapiens
gaagagctgttcaca

SEQ ID NO: 4754762 - DNA, 23 bp, Homo sapiens
gaagagctgttcacagccagact

SEQ ID NO: 4754763 - DNA, 14 bp, Homo sapiens
gaatactaataaaa

SEQ ID NO: 4754764 - DNA, 18 bp, Homo sapiens
gactccaaagaaatgtaa

SEQ ID NO: 4754765 - DNA, 18 bp, Homo sapiens
gactggcacagttttctg

SEQ ID NO: 4754766 - DNA, 24 bp, Homo sapiens
gacttccatttggaatcatatggg

SEQ ID NO: 4754767 - DNA, 16 bp, Homo sapiens
gacttctaagtaaaac

SEQ ID NO: 4754768 - DNA, 20 bp, Homo sapiens
gacttctgtcttcacaacag

SEQ ID NO: 4754769 - DNA, 23 bp, Homo sapiens
gacttctgtcttcacaacagatt

SEQ ID NO: 4754770 - DNA, 13 bp, Homo sapiens
gagaagagctgtt

SEQ ID NO: 4754771 - DNA, 15 bp, Homo sapiens
gagatgtagcaaatt

SEQ ID NO: 4754772 - DNA, 21 bp, Homo sapiens
gagcaggctactgtcagctcc

SEQ ID NO: 4754773 - DNA, 16 bp, Homo sapiens
gataataaaattcatt

SEQ ID NO: 4754774 - DNA, 14 bp, Homo sapiens
gatctttaaaatac

SEQ ID NO: 4754775 - DNA, 16 bp, Homo sapiens
gatgactgaatttcta

SEQ ID NO: 4754776 - DNA, 17 bp, Homo sapiens
gcacagttttctgagaa

SEQ ID NO: 4754777 - DNA, 22 bp, Homo sapiens
gcacagttttctgagaaagact

SEQ ID NO: 4754778 - DNA, 15 bp, Homo sapiens
gcaggctactgtcag

SEQ ID NO: 4754779 - DNA, 21 bp, Homo sapiens
gcagttgaaaagactccaaag

SEQ ID NO: 4754780 - DNA, 13 bp, Homo sapiens
gcatattgataat

SEQ ID NO: 4754781 - DNA, 18 bp, Homo sapiens
gcatattgataataaaat

SEQ ID NO: 4754782 - DNA, 22 bp, Homo sapiens
gccagttatggctataggtgct

SEQ ID NO: 4754783 - DNA, 16 bp, Homo sapiens
gcccccaggtgccagt

SEQ ID NO: 4754784 - DNA, 14 bp, Homo sapiens
gccctgttaaaaga

SEQ ID NO: 4754785 - DNA, 13 bp, Homo sapiens
gctataggtgcta

SEQ ID NO: 4754786 - DNA, 18 bp, Homo sapiens
gctataggtgctacaaaa

SEQ ID NO: 4754787 - DNA, 19 bp, Homo sapiens
gctataggtgctacaaaaa

SEQ ID NO: 4754788 - DNA, 15 bp, Homo sapiens
gctcaacataacata

SEQ ID NO: 4754789 - DNA, 13 bp, Homo sapiens
gctgctgaaacaa

SEQ ID NO: 4754790 - DNA, 15 bp, Homo sapiens
gctgttcacagccag

SEQ ID NO: 4754791 - DNA, 17 bp, Homo sapiens
gcttttaaaaaaaaata

SEQ ID NO: 4754792 - DNA, 17 bp, Homo sapiens
ggaaatcaaatatgcaa

SEQ ID NO: 4754793 - DNA, 23 bp, Homo sapiens
ggaatttctcccagtcatttaat

SEQ ID NO: 4754794 - DNA, 22 bp, Homo sapiens
ggactcattttaaaaaatggaa

SEQ ID NO: 4754795 - DNA, 20 bp, Homo sapiens
gggttttattgtttaaaatc

SEQ ID NO: 4754796 - DNA, 21 bp, Homo sapiens
ggtgctacaaaaacacagcaa

SEQ ID NO: 4754797 - DNA, 20 bp, Homo sapiens
gtatgcactaatcaatactt

SEQ ID NO: 4754798 - DNA, 24 bp, Homo sapiens
gtccaagcataccaacacgagcag

SEQ ID NO: 4754799 - DNA, 14 bp, Homo sapiens
gtcttaattaaaag

SEQ ID NO: 4754800 - DNA, 19 bp, Homo sapiens
gtgctttctatctaatttt

SEQ ID NO: 4754801 - DNA, 20 bp, Homo sapiens
gttaaaagatgaaaatattt

SEQ ID NO: 4754802 - DNA, 17 bp, Homo sapiens
gttgaaaagactccaaa

SEQ ID NO: 4754803 - DNA, 22 bp, Homo sapiens
gttgaaaagactccaaagaaat

SEQ ID NO: 4754804 - DNA, 15 bp, Homo sapiens
gttttctgagaaaga

SEQ ID NO: 4754805 - DNA, 16 bp, Homo sapiens
taaaaattaattcttt

SEQ ID NO: 4754806 - DNA, 13 bp, Homo sapiens
taaaagaatattt

SEQ ID NO: 4754807 - DNA, 14 bp, Homo sapiens
taaaagatgaaaat

SEQ ID NO: 4754808 - DNA, 21 bp, Homo sapiens
taaaatacacactcaaatcaa

SEQ ID NO: 4754809 - DNA, 14 bp, Homo sapiens
taaaatcacaaact

SEQ ID NO: 4754810 - DNA, 13 bp, Homo sapiens
taaaatcatttct

SEQ ID NO: 4754811 - DNA, 18 bp, Homo sapiens
taaaatcatttctgcatc

SEQ ID NO: 4754812 - DNA, 22 bp, Homo sapiens
taaaatcatttctgcatcagct

SEQ ID NO: 4754813 - DNA, 23 bp, Homo sapiens
taagagggattagggagagaaga

SEQ ID NO: 4754814 - DNA, 18 bp, Homo sapiens
taagtaaaaccacagcag

SEQ ID NO: 4754815 - DNA, 13 bp, Homo sapiens
taataaaatacat

SEQ ID NO: 4754816 - DNA, 20 bp, Homo sapiens
taataaaattcattccattt

SEQ ID NO: 4754817 - DNA, 14 bp, Homo sapiens
taatcaatactttg

SEQ ID NO: 4754818 - DNA, 16 bp, Homo sapiens
taattctttatcacat

SEQ ID NO: 4754819 - DNA, 14 bp, Homo sapiens
tacaaaaacacagc

SEQ ID NO: 4754820 - DNA, 15 bp, Homo sapiens
tacaaaaacacagca

SEQ ID NO: 4754821 - DNA, 16 bp, Homo sapiens
tacaaaaacacagcaa

SEQ ID NO: 4754822 - DNA, 17 bp, Homo sapiens
tacaaaaacacagcaag

SEQ ID NO: 4754823 - DNA, 16 bp, Homo sapiens
tacacactcaaatcaa

SEQ ID NO: 4754824 - DNA, 16 bp, Homo sapiens
taccaacacgagcagg

SEQ ID NO: 4754825 - DNA, 16 bp, Homo sapiens
tacctatcatcttaag

SEQ ID NO: 4754826 - DNA, 15 bp, Homo sapiens
tactaataaaataca

SEQ ID NO: 4754827 - DNA, 17 bp, Homo sapiens
tactaataaaatacata

SEQ ID NO: 4754828 - DNA, 17 bp, Homo sapiens
tactatagattctttat

SEQ ID NO: 4754829 - DNA, 23 bp, Homo sapiens
tactgatgttcctagtgaaagag

SEQ ID NO: 4754830 - DNA, 22 bp, Homo sapiens
tactgatttggccgttttgtga

SEQ ID NO: 4754831 - DNA, 18 bp, Homo sapiens
tagaatactaataaaata

SEQ ID NO: 4754832 - DNA, 13 bp, Homo sapiens
tagaatattaaaa

SEQ ID NO: 4754833 - DNA, 20 bp, Homo sapiens
tagaatattaaaaattaatt

SEQ ID NO: 4754834 - DNA, 22 bp, Homo sapiens
tagaatattaaaaattaattct

SEQ ID NO: 4754835 - DNA, 12 bp, Homo sapiens
tagattctttat

SEQ ID NO: 4754836 - DNA, 14 bp, Homo sapiens
tagcaaattccaat

SEQ ID NO: 4754837 - DNA, 20 bp, Homo sapiens
tagcagggcatggctgggaa

SEQ ID NO: 4754838 - DNA, 20 bp, Homo sapiens
taggtgctacaaaaacacag

SEQ ID NO: 4754839 - DNA, 22 bp, Homo sapiens
taggtgctacaaaaacacagca

SEQ ID NO: 4754840 - DNA, 23 bp, Homo sapiens
taggtgctacaaaaacacagcaa

SEQ ID NO: 4754841 - DNA, 23 bp, Homo sapiens
tatagattctttattagtgaagt

SEQ ID NO: 4754842 - DNA, 15 bp, Homo sapiens
tatattttgaacaac

SEQ ID NO: 4754843 - DNA, 13 bp, Homo sapiens
tatcacatgttgt

SEQ ID NO: 4754844 - DNA, 17 bp, Homo sapiens
tatctcaaaactgcact

SEQ ID NO: 4754845 - DNA, 17 bp, Homo sapiens
tatgcactaatcaatac

SEQ ID NO: 4754846 - DNA, 19 bp, Homo sapiens
tatggaggctttgcataga

SEQ ID NO: 4754847 - DNA, 16 bp, Homo sapiens
tattaaaaattaattc

SEQ ID NO: 4754848 - DNA, 20 bp, Homo sapiens
tattaaaaattaattcttta

SEQ ID NO: 4754849 - DNA, 21 bp, Homo sapiens
tattaaaaattaattctttat

SEQ ID NO: 4754850 - DNA, 19 bp, Homo sapiens
tattgtgctttctatctaa

SEQ ID NO: 4754851 - DNA, 15 bp, Homo sapiens
tattgtttaaaatca

SEQ ID NO: 4754852 - DNA, 23 bp, Homo sapiens
tcaaaataccatgccatttaaag

SEQ ID NO: 4754853 - DNA, 14 bp, Homo sapiens
tcaaatatgcaaag

SEQ ID NO: 4754854 - DNA, 17 bp, Homo sapiens
tcaaatatgcaaagcac

SEQ ID NO: 4754855 - DNA, 20 bp, Homo sapiens
tcacaaaagtatattcaaaa

SEQ ID NO: 4754856 - DNA, 17 bp, Homo sapiens
tcacagccagactggca

SEQ ID NO: 4754857 - DNA, 23 bp, Homo sapiens
tcaggaaatcaaatatgcaaagc

SEQ ID NO: 4754858 - DNA, 18 bp, Homo sapiens
tcatacctatcatcttaa

SEQ ID NO: 4754859 - DNA, 16 bp, Homo sapiens
tcattccatttgctga

SEQ ID NO: 4754860 - DNA, 19 bp, Homo sapiens
tcatttatttccatattaa

SEQ ID NO: 4754861 - DNA, 14 bp, Homo sapiens
tcatttctttgagt

SEQ ID NO: 4754862 - DNA, 21 bp, Homo sapiens
tccattaatgtagataaagca

SEQ ID NO: 4754863 - DNA, 16 bp, Homo sapiens
tcccctcggagaagag

SEQ ID NO: 4754864 - DNA, 16 bp, Homo sapiens
tccttggactcatttt

SEQ ID NO: 4754865 - DNA, 14 bp, Homo sapiens
tcgaatcactcatt

SEQ ID NO: 4754866 - DNA, 16 bp, Homo sapiens
tcggagaagagctgtt

SEQ ID NO: 4754867 - DNA, 20 bp, Homo sapiens
tctaagtaaaaccacagcag

SEQ ID NO: 4754868 - DNA, 21 bp, Homo sapiens
tctaagtaaaaccacagcagt

SEQ ID NO: 4754869 - DNA, 22 bp, Homo sapiens
tctaagtaaaaccacagcagtt

SEQ ID NO: 4754870 - DNA, 16 bp, Homo sapiens
tctacatactatggaa

SEQ ID NO: 4754871 - DNA, 21 bp, Homo sapiens
tctagaatactaataaaatac

SEQ ID NO: 4754872 - DNA, 21 bp, Homo sapiens
tctatggcatattgataataa

SEQ ID NO: 4754873 - DNA, 12 bp, Homo sapiens
tctattgtgctt

SEQ ID NO: 4754874 - DNA, 17 bp, Homo sapiens
tctcaaaactgcactgt

SEQ ID NO: 4754875 - DNA, 12 bp, Homo sapiens
tctcaggaaatc

SEQ ID NO: 4754876 - DNA, 20 bp, Homo sapiens
tctgagaaagactattcaaa

SEQ ID NO: 4754877 - DNA, 21 bp, Homo sapiens
tcttaattaaaagaatatttt

SEQ ID NO: 4754878 - DNA, 15 bp, Homo sapiens
tcttcacaacagatt

SEQ ID NO: 4754879 - DNA, 17 bp, Homo sapiens
tctttaaaatacacact

SEQ ID NO: 4754880 - DNA, 21 bp, Homo sapiens
tctttaaagggatggcaagat

SEQ ID NO: 4754881 - DNA, 17 bp, Homo sapiens
tgaaaatatttgtatca

SEQ ID NO: 4754882 - DNA, 18 bp, Homo sapiens
tgaaagaggcagcttgaa

SEQ ID NO: 4754883 - DNA, 18 bp, Homo sapiens
tgaaattttctagaatac

SEQ ID NO: 4754884 - DNA, 13 bp, Homo sapiens
tgactgaatttct

SEQ ID NO: 4754885 - DNA, 24 bp, Homo sapiens
tgacttctaagtaaaaccacagca

SEQ ID NO: 4754886 - DNA, 21 bp, Homo sapiens
tgagatgtagcaaattccaat

SEQ ID NO: 4754887 - DNA, 22 bp, Homo sapiens
tgagatgtagcaaattccaata

SEQ ID NO: 4754888 - DNA, 18 bp, Homo sapiens
tgagatgtgaacacatca

SEQ ID NO: 4754889 - DNA, 15 bp, Homo sapiens
tgataataaaattca

SEQ ID NO: 4754890 - DNA, 17 bp, Homo sapiens
tgataataaaattcatt

SEQ ID NO: 4754891 - DNA, 21 bp, Homo sapiens
tgataataaaattcattccat

SEQ ID NO: 4754892 - DNA, 14 bp, Homo sapiens
tgatgggaaagcat

SEQ ID NO: 4754893 - DNA, 22 bp, Homo sapiens
tgattgtctgaaattttctaga

SEQ ID NO: 4754894 - DNA, 19 bp, Homo sapiens
tgcatcagctgctgaaaca

SEQ ID NO: 4754895 - DNA, 17 bp, Homo sapiens
tgccagttatggctata

SEQ ID NO: 4754896 - DNA, 20 bp, Homo sapiens
tgccctgttaaaagatgaaa

SEQ ID NO: 4754897 - DNA, 23 bp, Homo sapiens
tgctgattgtctgaaattttcta

SEQ ID NO: 4754898 - DNA, 15 bp, Homo sapiens
tgctttctatctaat

SEQ ID NO: 4754899 - DNA, 14 bp, Homo sapiens
tggacttccatttg

SEQ ID NO: 4754900 - DNA, 18 bp, Homo sapiens
tggcacagttttctgaga

SEQ ID NO: 4754901 - DNA, 15 bp, Homo sapiens
tggctataggtgcta

SEQ ID NO: 4754902 - DNA, 19 bp, Homo sapiens
tggctataggtgctacaaa

SEQ ID NO: 4754903 - DNA, 17 bp, Homo sapiens
tgtagcaaattccaata

SEQ ID NO: 4754904 - DNA, 22 bp, Homo sapiens
tgtagcaaattccaatacatta

SEQ ID NO: 4754905 - DNA, 23 bp, Homo sapiens
tgtcagctcccctcggagaagag

SEQ ID NO: 4754906 - DNA, 12 bp, Homo sapiens
tgtcttaattaa

SEQ ID NO: 4754907 - DNA, 19 bp, Homo sapiens
tgtgaagaaacatttatct

SEQ ID NO: 4754908 - DNA, 20 bp, Homo sapiens
tgtgaagaaacatttatctt

SEQ ID NO: 4754909 - DNA, 22 bp, Homo sapiens
tgttactgatttggccgttttg

SEQ ID NO: 4754910 - DNA, 14 bp, Homo sapiens
tgttcctagtgaaa

SEQ ID NO: 4754911 - DNA, 19 bp, Homo sapiens
tgttttcattatctcaaaa

SEQ ID NO: 4754912 - DNA, 16 bp, Homo sapiens
ttaaaaattaattctt

SEQ ID NO: 4754913 - DNA, 18 bp, Homo sapiens
ttaaaaattaattcttta

SEQ ID NO: 4754914 - DNA, 19 bp, Homo sapiens
ttaaaatacacactcaaat

SEQ ID NO: 4754915 - DNA, 17 bp, Homo sapiens
ttaaaatcacaaactca

SEQ ID NO: 4754916 - DNA, 22 bp, Homo sapiens
ttaaaatcacaaactcatccat

SEQ ID NO: 4754917 - DNA, 14 bp, Homo sapiens
ttaaaatcatttct

SEQ ID NO: 4754918 - DNA, 22 bp, Homo sapiens
ttaaaatcatttctgcatcagc

SEQ ID NO: 4754919 - DNA, 20 bp, Homo sapiens
ttaaagcttattaaaactca

SEQ ID NO: 4754920 - DNA, 13 bp, Homo sapiens
ttagaatattaaa

SEQ ID NO: 4754921 - DNA, 14 bp, Homo sapiens
ttagatgactgaat

SEQ ID NO: 4754922 - DNA, 15 bp, Homo sapiens
ttagggagagaagat

SEQ ID NO: 4754923 - DNA, 14 bp, Homo sapiens
ttcattccatttgc

SEQ ID NO: 4754924 - DNA, 18 bp, Homo sapiens
ttcattccatttgctgat

SEQ ID NO: 4754925 - DNA, 12 bp, Homo sapiens
ttccatattaaa

SEQ ID NO: 4754926 - DNA, 12 bp, Homo sapiens
ttcccaaatttc

SEQ ID NO: 4754927 - DNA, 15 bp, Homo sapiens
ttctaagtaaaacca

SEQ ID NO: 4754928 - DNA, 20 bp, Homo sapiens
ttctaagtaaaaccacagca

SEQ ID NO: 4754929 - DNA, 15 bp, Homo sapiens
ttctacatactatgg

SEQ ID NO: 4754930 - DNA, 13 bp, Homo sapiens
ttctatggcatat

SEQ ID NO: 4754931 - DNA, 23 bp, Homo sapiens
ttctgcatcagctgctgaaacaa

SEQ ID NO: 4754932 - DNA, 15 bp, Homo sapiens
ttcttatttcatttc

SEQ ID NO: 4754933 - DNA, 17 bp, Homo sapiens
ttgataataaaattcat

SEQ ID NO: 4754934 - DNA, 11 bp, Homo sapiens
ttgtaaatgtg

SEQ ID NO: 4754935 - DNA, 18 bp, Homo sapiens
ttgtaaatgtgcttttaa

SEQ ID NO: 4754936 - DNA, 17 bp, Homo sapiens
ttgtacgttcttctatt

SEQ ID NO: 4754937 - DNA, 19 bp, Homo sapiens
ttgtatcacaaatcttaac

SEQ ID NO: 4754938 - DNA, 16 bp, Homo sapiens
ttgtctgaaattttct

SEQ ID NO: 4754939 - DNA, 21 bp, Homo sapiens
ttgtgaagaaacatttatctt

SEQ ID NO: 4754940 - DNA, 15 bp, Homo sapiens
ttgtgctttctatct

SEQ ID NO: 4754941 - DNA, 18 bp, Homo sapiens
ttgtttaaaatcatttct

SEQ ID NO: 4754942 - DNA, 19 bp, Homo sapiens
tttagaatattaaaaatta

SEQ ID NO: 4754943 - DNA, 21 bp, Homo sapiens
tttagaatattaaaaattaat

SEQ ID NO: 4754944 - DNA, 14 bp, Homo sapiens
tttctgcatcagct

SEQ ID NO: 4754945 - DNA, 17 bp, Homo sapiens
tttcttatttcatttct

SEQ ID NO: 4754946 - DNA, 15 bp, Homo sapiens
tttgaacaactcgaa

SEQ ID NO: 4754947 - DNA, 19 bp, Homo sapiens
tttgctgattgtctgaaat

SEQ ID NO: 4754948 - DNA, 23 bp, Homo sapiens
ttttctagaatactaataaaata

SEQ ID NO: 4754949 - DNA, 13 bp, Homo sapiens
ttttcttatttca

SEQ ID NO: 4754950 - DNA, 21 bp, Homo sapiens
ttttgtgaagaaacatttatc

SEQ ID NO: 4754951 - DNA, 12 bp, Homo sapiens
aaaaacacagca

SEQ ID NO: 4754952 - DNA, 13 bp, Homo sapiens
aaaaacacagcaa

SEQ ID NO: 4754953 - DNA, 13 bp, Homo sapiens
aaaacacagcaag

SEQ ID NO: 4754954 - DNA, 14 bp, Homo sapiens
aaaatacatactat

SEQ ID NO: 4754955 - DNA, 15 bp, Homo sapiens
aaaatcacaaactca

SEQ ID NO: 4754956 - DNA, 11 bp, Homo sapiens
aaaatcatttc

SEQ ID NO: 4754957 - DNA, 15 bp, Homo sapiens
aaaattcattccatt

SEQ ID NO: 4754958 - DNA, 15 bp, Homo sapiens
aaaccacagcagttg

SEQ ID NO: 4754959 - DNA, 15 bp, Homo sapiens
aaactgcactgtcaa

SEQ ID NO: 4754960 - DNA, 15 bp, Homo sapiens
aaagaaatgtaaggg

SEQ ID NO: 4754961 - DNA, 14 bp, Homo sapiens
aaagactattcaaa

SEQ ID NO: 4754962 - DNA, 17 bp, Homo sapiens
aaagactattcaaacag

SEQ ID NO: 4754963 - DNA, 19 bp, Homo sapiens
aaagactattcaaacagtc

SEQ ID NO: 4754964 - DNA, 23 bp, Homo sapiens
aaagactattcaaacagtctcag

SEQ ID NO: 4754965 - DNA, 15 bp, Homo sapiens
aaagactccaaagaa

SEQ ID NO: 4754966 - DNA, 17 bp, Homo sapiens
aaagatgaaaatatttg

SEQ ID NO: 4754967 - DNA, 17 bp, Homo sapiens
aaagcactgacttctaa

SEQ ID NO: 4754968 - DNA, 15 bp, Homo sapiens
aaatatgcaaagcac

SEQ ID NO: 4754969 - DNA, 17 bp, Homo sapiens
aaatatgcaaagcactg

SEQ ID NO: 4754970 - DNA, 15 bp, Homo sapiens
aaatcaaatatgcaa

SEQ ID NO: 4754971 - DNA, 22 bp, Homo sapiens
aaatgtaagggaaactgccagc

SEQ ID NO: 4754972 - DNA, 22 bp, Homo sapiens
aaatgttgttctcttctttaaa

SEQ ID NO: 4754973 - DNA, 15 bp, Homo sapiens
aaattcattccattt

SEQ ID NO: 4754974 - DNA, 19 bp, Homo sapiens
aaattttctagaatactaa

SEQ ID NO: 4754975 - DNA, 20 bp, Homo sapiens
aacaactcgaatcactcatt

SEQ ID NO: 4754976 - DNA, 16 bp, Homo sapiens
aacacatcagcttgcc

SEQ ID NO: 4754977 - DNA, 19 bp, Homo sapiens
aacagattattaccttaca

SEQ ID NO: 4754978 - DNA, 19 bp, Homo sapiens
aacagtctcaggaaatcaa

SEQ ID NO: 4754979 - DNA, 16 bp, Homo sapiens
aacataagctagaaaa

SEQ ID NO: 4754980 - DNA, 21 bp, Homo sapiens
aactcatttttgttttcatta

SEQ ID NO: 4754981 - DNA, 13 bp, Homo sapiens
aagactattcaaa

SEQ ID NO: 4754982 - DNA, 17 bp, Homo sapiens
aagactccaaagaaatg

SEQ ID NO: 4754983 - DNA, 13 bp, Homo sapiens
aagatgaaaatat

SEQ ID NO: 4754984 - DNA, 17 bp, Homo sapiens
aagcactgacttctaag

SEQ ID NO: 4754985 - DNA, 20 bp, Homo sapiens
aagcactgacttctaagtaa

SEQ ID NO: 4754986 - DNA, 19 bp, Homo sapiens
aagcattgtaaatgtgctt

SEQ ID NO: 4754987 - DNA, 22 bp, Homo sapiens
tctgagaaagactattcaaaca

SEQ ID NO: 4754988 - DNA, 18 bp, Homo sapiens
tcttaattaaaagaatat

SEQ ID NO: 4754989 - DNA, 15 bp, Homo sapiens
tcttatttcatttct

SEQ ID NO: 4754990 - DNA, 16 bp, Homo sapiens
tgaaaagactccaaag

SEQ ID NO: 4754991 - DNA, 21 bp, Homo sapiens
tgaaaatatttgtatcacaaa

SEQ ID NO: 4754992 - DNA, 22 bp, Homo sapiens
tgaaactgagatgtgaacacat

SEQ ID NO: 4754993 - DNA, 12 bp, Homo sapiens
tgaaattttcta

SEQ ID NO: 4754994 - DNA, 22 bp, Homo sapiens
tgaaattttctagaatactaat

SEQ ID NO: 4754995 - DNA, 18 bp, Homo sapiens
tgaagaaacatttatctt

SEQ ID NO: 4754996 - DNA, 12 bp, Homo sapiens
tgaatttctatg

SEQ ID NO: 4754997 - DNA, 21 bp, Homo sapiens
tgaatttctatggcatattga

SEQ ID NO: 4754998 - DNA, 15 bp, Homo sapiens
tgacttctaagtaaa

SEQ ID NO: 4754999 - DNA, 22 bp, Homo sapiens
tgacttctaagtaaaaccacag

SEQ ID NO: 4755000 - DNA, 20 bp, Homo sapiens
tgagaaagactattcaaaca

SEQ ID NO: 4755001 - DNA, 13 bp, Homo sapiens
tgagatgtgaaca

SEQ ID NO: 4755002 - DNA, 19 bp, Homo sapiens
tgagatgtgaacacatcag

SEQ ID NO: 4755003 - DNA, 16 bp, Homo sapiens
tgataataaaattcat

SEQ ID NO: 4755004 - DNA, 17 bp, Homo sapiens
tgatgatctttaaaata

SEQ ID NO: 4755005 - DNA, 22 bp, Homo sapiens
tgatttggccgttttgtgaaga

SEQ ID NO: 4755006 - DNA, 16 bp, Homo sapiens
tgcactgtcaagatga

SEQ ID NO: 4755007 - DNA, 16 bp, Homo sapiens
tgctacaaaaacacag

SEQ ID NO: 4755008 - DNA, 18 bp, Homo sapiens
tgctacaaaaacacagca

SEQ ID NO: 4755009 - DNA, 17 bp, Homo sapiens
tgcttttaaaaaaaaat

SEQ ID NO: 4755010 - DNA, 21 bp, Homo sapiens
tggaacataaaatacaatgtt

SEQ ID NO: 4755011 - DNA, 19 bp, Homo sapiens
tggcacagttttctgagaa

SEQ ID NO: 4755012 - DNA, 16 bp, Homo sapiens
tggcatattgataata

SEQ ID NO: 4755013 - DNA, 23 bp, Homo sapiens
tggctataggtgctacaaaaaca

SEQ ID NO: 4755014 - DNA, 14 bp, Homo sapiens
tgggaaagcattgt

SEQ ID NO: 4755015 - DNA, 16 bp, Homo sapiens
tgggaaagcattgtaa

SEQ ID NO: 4755016 - DNA, 21 bp, Homo sapiens
tgggaaagcattgtaaatgtg

SEQ ID NO: 4755017 - DNA, 20 bp, Homo sapiens
tgggaacccaagtccaagca

SEQ ID NO: 4755018 - DNA, 18 bp, Homo sapiens
tgtaagggaaactgccag

SEQ ID NO: 4755019 - DNA, 19 bp, Homo sapiens
tgtaagggaaactgccagc

SEQ ID NO: 4755020 - DNA, 23 bp, Homo sapiens
tgtagcaaattccaatacattat

SEQ ID NO: 4755021 - DNA, 15 bp, Homo sapiens
tgtatcacaaatctt

SEQ ID NO: 4755022 - DNA, 18 bp, Homo sapiens
tgtatcacaaatcttaac

SEQ ID NO: 4755023 - DNA, 20 bp, Homo sapiens
tgtcagctcccctcggagaa

SEQ ID NO: 4755024 - DNA, 15 bp, Homo sapiens
tgtctgaaattttct

SEQ ID NO: 4755025 - DNA, 22 bp, Homo sapiens
tgtgctttctatctaattttta

SEQ ID NO: 4755026 - DNA, 18 bp, Homo sapiens
tgttcctagtgaaagagg

SEQ ID NO: 4755027 - DNA, 21 bp, Homo sapiens
ttaaaagaatattttaacttc

SEQ ID NO: 4755028 - DNA, 22 bp, Homo sapiens
ttaaaagaatattttaacttcc

SEQ ID NO: 4755029 - DNA, 18 bp, Homo sapiens
ttaaaagatgaaaatatt

SEQ ID NO: 4755030 - DNA, 14 bp, Homo sapiens
ttagaatattaaaa

SEQ ID NO: 4755031 - DNA, 14 bp, Homo sapiens
ttagggagagaaga

SEQ ID NO: 4755032 - DNA, 17 bp, Homo sapiens
ttatggctataggtgct

SEQ ID NO: 4755033 - DNA, 12 bp, Homo sapiens
ttatttccatat

SEQ ID NO: 4755034 - DNA, 13 bp, Homo sapiens
ttatttccatatt

SEQ ID NO: 4755035 - DNA, 16 bp, Homo sapiens
ttatttccatattaaa

SEQ ID NO: 4755036 - DNA, 13 bp, Homo sapiens
ttccatattaaaa

SEQ ID NO: 4755037 - DNA, 18 bp, Homo sapiens
ttccatattaaaatcaca

SEQ ID NO: 4755038 - DNA, 13 bp, Homo sapiens
ttccatttgctga

SEQ ID NO: 4755039 - DNA, 12 bp, Homo sapiens
ttcctagtgaaa

SEQ ID NO: 4755040 - DNA, 17 bp, Homo sapiens
ttccttggactcatttt

SEQ ID NO: 4755041 - DNA, 16 bp, Homo sapiens
ttctgagaaagactat

SEQ ID NO: 4755042 - DNA, 21 bp, Homo sapiens
ttctgagaaagactattcaaa

SEQ ID NO: 4755043 - DNA, 17 bp, Homo sapiens
ttctgtcttcacaacag

SEQ ID NO: 4755044 - DNA, 16 bp, Homo sapiens
ttgaaaagactccaaa

SEQ ID NO: 4755045 - DNA, 23 bp, Homo sapiens
ttgaaactgagatgtgaacacat

SEQ ID NO: 4755046 - DNA, 13 bp, Homo sapiens
ttgccctgttaaa

SEQ ID NO: 4755047 - DNA, 14 bp, Homo sapiens
ttgtttaaaatcat

SEQ ID NO: 4755048 - DNA, 16 bp, Homo sapiens
tttaaaatcatttctg

SEQ ID NO: 4755049 - DNA, 17 bp, Homo sapiens
tttctcccagtcattta

SEQ ID NO: 4755050 - DNA, 22 bp, Homo sapiens
tttctgagaaagactattcaaa

SEQ ID NO: 4755051 - DNA, 19 bp, Homo sapiens
tttggccgttttgtgaaga

SEQ ID NO: 4755052 - DNA, 21 bp, Homo sapiens
tttggccgttttgtgaagaaa

SEQ ID NO: 4755053 - DNA, 13 bp, Homo sapiens
ttttctagaatac

SEQ ID NO: 4755054 - DNA, 15 bp, Homo sapiens
ttttctgagaaagac

SEQ ID NO: 4755055 - DNA, 15 bp, Homo sapiens
ttttgttttcattat

SEQ ID NO: 4755056 - DNA, 18 bp, Homo sapiens
ataaaattcattccattt

SEQ ID NO: 4755057 - DNA, 22 bp, Homo sapiens
ataacataagctagaaaaatta

SEQ ID NO: 4755058 - DNA, 12 bp, Homo sapiens
ataataaaattc

SEQ ID NO: 4755059 - DNA, 13 bp, Homo sapiens
ataataaaattca

SEQ ID NO: 4755060 - DNA, 14 bp, Homo sapiens
ataataaaattcat

SEQ ID NO: 4755061 - DNA, 15 bp, Homo sapiens
ataataaaattcatt

SEQ ID NO: 4755062 - DNA, 21 bp, Homo sapiens
atacatactatagattcttta

SEQ ID NO: 4755063 - DNA, 14 bp, Homo sapiens
atactaataaaata

SEQ ID NO: 4755064 - DNA, 16 bp, Homo sapiens
atactaataaaataca

SEQ ID NO: 4755065 - DNA, 17 bp, Homo sapiens
atactatagattcttta

SEQ ID NO: 4755066 - DNA, 18 bp, Homo sapiens
atactatagattctttat

SEQ ID NO: 4755067 - DNA, 17 bp, Homo sapiens
atactatggaatttctc

SEQ ID NO: 4755068 - DNA, 14 bp, Homo sapiens
ataggtgctacaaa

SEQ ID NO: 4755069 - DNA, 13 bp, Homo sapiens
atatgcaaagcac

SEQ ID NO: 4755070 - DNA, 23 bp, Homo sapiens
atatgcaaagcactgacttctaa

SEQ ID NO: 4755071 - DNA, 15 bp, Homo sapiens
atattaaaatcacaa

SEQ ID NO: 4755072 - DNA, 16 bp, Homo sapiens
atattcaaaaattata

SEQ ID NO: 4755073 - DNA, 13 bp, Homo sapiens
atattgataataa

SEQ ID NO: 4755074 - DNA, 12 bp, Homo sapiens
atattttaactt

SEQ ID NO: 4755075 - DNA, 18 bp, Homo sapiens
atcaaatatgcaaagcac

SEQ ID NO: 4755076 - DNA, 13 bp, Homo sapiens
atcaatactttga

SEQ ID NO: 4755077 - DNA, 22 bp, Homo sapiens
atcagcttgccctgttaaaaga

SEQ ID NO: 4755078 - DNA, 21 bp, Homo sapiens
atgccatttaaagcttattaa

SEQ ID NO: 4755079 - DNA, 17 bp, Homo sapiens
atggaatttctcccagt

SEQ ID NO: 4755080 - DNA, 14 bp, Homo sapiens
atggcatattgata

SEQ ID NO: 4755081 - DNA, 16 bp, Homo sapiens
atggctataggtgcta

SEQ ID NO: 4755082 - DNA, 21 bp, Homo sapiens
atggctataggtgctacaaaa

SEQ ID NO: 4755083 - DNA, 16 bp, Homo sapiens
atgtaagggaaactgc

SEQ ID NO: 4755084 - DNA, 19 bp, Homo sapiens
atgtaagggaaactgccag

SEQ ID NO: 4755085 - DNA, 20 bp, Homo sapiens
atgtaagggaaactgccagc

SEQ ID NO: 4755086 - DNA, 21 bp, Homo sapiens
atgtaagggaaactgccagca

SEQ ID NO: 4755087 - DNA, 22 bp, Homo sapiens
atgtagcaaattccaatacatt

SEQ ID NO: 4755088 - DNA, 17 bp, Homo sapiens
atgttcctagtgaaaga

SEQ ID NO: 4755089 - DNA, 18 bp, Homo sapiens
attaaaatcacaaactca

SEQ ID NO: 4755090 - DNA, 15 bp, Homo sapiens
attaatgtagataaa

SEQ ID NO: 4755091 - DNA, 15 bp, Homo sapiens
attagatgactgaat

SEQ ID NO: 4755092 - DNA, 18 bp, Homo sapiens
attagatgactgaatttc

SEQ ID NO: 4755093 - DNA, 18 bp, Homo sapiens
attagtgaagtatgcact

SEQ ID NO: 4755094 - DNA, 20 bp, Homo sapiens
attattaccttacagaagtt

SEQ ID NO: 4755095 - DNA, 18 bp, Homo sapiens
attattggacttccattt

SEQ ID NO: 4755096 - DNA, 14 bp, Homo sapiens
attcaaaaattata

SEQ ID NO: 4755097 - DNA, 18 bp, Homo sapiens
attcaaaaattatatttt

SEQ ID NO: 4755098 - DNA, 19 bp, Homo sapiens
attcaaaaattatattttg

SEQ ID NO: 4755099 - DNA, 14 bp, Homo sapiens
attcaaacagtctc

SEQ ID NO: 4755100 - DNA, 19 bp, Homo sapiens
attcaaacagtctcaggaa

SEQ ID NO: 4755101 - DNA, 22 bp, Homo sapiens
attcaaacagtctcaggaaatc

SEQ ID NO: 4755102 - DNA, 13 bp, Homo sapiens
attcattccattt

SEQ ID NO: 4755103 - DNA, 20 bp, Homo sapiens
attccaatacattattggac

SEQ ID NO: 4755104 - DNA, 15 bp, Homo sapiens
attggacttccattt

SEQ ID NO: 4755105 - DNA, 14 bp, Homo sapiens
attgtaaatgtgct

SEQ ID NO: 4755106 - DNA, 15 bp, Homo sapiens
attgtaaatgtgctt

SEQ ID NO: 4755107 - DNA, 18 bp, Homo sapiens
attgtctgaaattttcta

SEQ ID NO: 4755108 - DNA, 20 bp, Homo sapiens
atttcatacctatcatctta

SEQ ID NO: 4755109 - DNA, 12 bp, Homo sapiens
atttcatttctt

SEQ ID NO: 4755110 - DNA, 18 bp, Homo sapiens
atttccatattaaaatca

SEQ ID NO: 4755111 - DNA, 14 bp, Homo sapiens
atttggaatcatat

SEQ ID NO: 4755112 - DNA, 18 bp, Homo sapiens
attttctagaatactaat

SEQ ID NO: 4755113 - DNA, 21 bp, Homo sapiens
attttctagaatactaataaa

SEQ ID NO: 4755114 - DNA, 23 bp, Homo sapiens
attttctagaatactaataaaat

SEQ ID NO: 4755115 - DNA, 20 bp, Homo sapiens
attttgaacaactcgaatca

SEQ ID NO: 4755116 - DNA, 15 bp, Homo sapiens
atttttcttatttca

SEQ ID NO: 4755117 - DNA, 19 bp, Homo sapiens
atttttcttatttcatttc

SEQ ID NO: 4755118 - DNA, 13 bp, Homo sapiens
caaaaacacagca

SEQ ID NO: 4755119 - DNA, 15 bp, Homo sapiens
caaaaacacagcaag

SEQ ID NO: 4755120 - DNA, 17 bp, Homo sapiens
caaaaacacagcaaggg

SEQ ID NO: 4755121 - DNA, 18 bp, Homo sapiens
caaaactgcactgtcaag

SEQ ID NO: 4755122 - DNA, 15 bp, Homo sapiens
caaacagtctcagga

SEQ ID NO: 4755123 - DNA, 17 bp, Homo sapiens
caaactcatccattaat

SEQ ID NO: 4755124 - DNA, 14 bp, Homo sapiens
caaagaaatgtaag

SEQ ID NO: 4755125 - DNA, 12 bp, Homo sapiens
caaatatgcaaa

SEQ ID NO: 4755126 - DNA, 21 bp, Homo sapiens
caaatcttaacttgaaggagt

SEQ ID NO: 4755127 - DNA, 15 bp, Homo sapiens
caaattccaatacat

SEQ ID NO: 4755128 - DNA, 15 bp, Homo sapiens
caacacgagcaggct

SEQ ID NO: 4755129 - DNA, 21 bp, Homo sapiens
caagggtgatgggaaagcatt

SEQ ID NO: 4755130 - DNA, 23 bp, Homo sapiens
caagggtgatgggaaagcattgt

SEQ ID NO: 4755131 - DNA, 21 bp, Homo sapiens
cacagcagttgaaaagactcc

SEQ ID NO: 4755132 - DNA, 17 bp, Homo sapiens
cacagttttctgagaaa

SEQ ID NO: 4755133 - DNA, 21 bp, Homo sapiens
cacagttttctgagaaagact

SEQ ID NO: 4755134 - DNA, 22 bp, Homo sapiens
cacagttttctgagaaagacta

SEQ ID NO: 4755135 - DNA, 14 bp, Homo sapiens
cacctttagaatat

SEQ ID NO: 4755136 - DNA, 21 bp, Homo sapiens
cactagggcagggacaggata

SEQ ID NO: 4755137 - DNA, 16 bp, Homo sapiens
cactcatttatttcca

SEQ ID NO: 4755138 - DNA, 20 bp, Homo sapiens
cactgacttctaagtaaaac

SEQ ID NO: 4755139 - DNA, 15 bp, Homo sapiens
cactgtttggatatg

SEQ ID NO: 4755140 - DNA, 23 bp, Homo sapiens
cagactggcacagttttctgaga

SEQ ID NO: 4755141 - DNA, 20 bp, Homo sapiens
cagcagttgaaaagactcca

SEQ ID NO: 4755142 - DNA, 14 bp, Homo sapiens
cagccagactggca

SEQ ID NO: 4755143 - DNA, 21 bp, Homo sapiens
cagctgctgaaacaacaaata

SEQ ID NO: 4755144 - DNA, 21 bp, Homo sapiens
caggaaatcaaatatgcaaag

SEQ ID NO: 4755145 - DNA, 23 bp, Homo sapiens
caggaaatcaaatatgcaaagca

SEQ ID NO: 4755146 - DNA, 14 bp, Homo sapiens
caggctactgtcag

SEQ ID NO: 4755147 - DNA, 13 bp, Homo sapiens
cagttatggctat

SEQ ID NO: 4755148 - DNA, 20 bp, Homo sapiens
cagttatggctataggtgct

SEQ ID NO: 4755149 - DNA, 14 bp, Homo sapiens
cagttgaaaagact

SEQ ID NO: 4755150 - DNA, 15 bp, Homo sapiens
cagttttctgagaaa

SEQ ID NO: 4755151 - DNA, 19 bp, Homo sapiens
cagttttctgagaaagact

SEQ ID NO: 4755152 - DNA, 19 bp, Homo sapiens
cataagctagaaaaattag

SEQ ID NO: 4755153 - DNA, 17 bp, Homo sapiens
catagattccctgagca

SEQ ID NO: 4755154 - DNA, 11 bp, Homo sapiens
catattaaaat

SEQ ID NO: 4755155 - DNA, 15 bp, Homo sapiens
catattaaaatcaca

SEQ ID NO: 4755156 - DNA, 22 bp, Homo sapiens
catattgataataaaattcatt

SEQ ID NO: 4755157 - DNA, 17 bp, Homo sapiens
catcagctgctgaaaca

SEQ ID NO: 4755158 - DNA, 18 bp, Homo sapiens
catcagctgctgaaacaa

SEQ ID NO: 4755159 - DNA, 20 bp, Homo sapiens
catcagcttgccctgttaaa

SEQ ID NO: 4755160 - DNA, 12 bp, Homo sapiens
cattccatttgc

SEQ ID NO: 4755161 - DNA, 21 bp, Homo sapiens
cattgtaaatgtgcttttaaa

SEQ ID NO: 4755162 - DNA, 19 bp, Homo sapiens
catttaaagcttattaaaa

SEQ ID NO: 4755163 - DNA, 18 bp, Homo sapiens
catttatttccatattaa

SEQ ID NO: 4755164 - DNA, 20 bp, Homo sapiens
catttatttccatattaaaa

SEQ ID NO: 4755165 - DNA, 23 bp, Homo sapiens
catttctgcatcagctgctgaaa

SEQ ID NO: 4755166 - DNA, 23 bp, Homo sapiens
catttgctgattgtctgaaattt

SEQ ID NO: 4755167 - DNA, 20 bp, Homo sapiens
ccacaagcaggctcaacata

SEQ ID NO: 4755168 - DNA, 21 bp, Homo sapiens
ccagttatggctataggtgct

SEQ ID NO: 4755169 - DNA, 13 bp, Homo sapiens
ccatttaaagctt

SEQ ID NO: 4755170 - DNA, 12 bp, Homo sapiens
ccatttgctgat

SEQ ID NO: 4755171 - DNA, 13 bp, Homo sapiens
ccctcggagaaga

SEQ ID NO: 4755172 - DNA, 12 bp, Homo sapiens
cctcggagaaga

SEQ ID NO: 4755173 - DNA, 15 bp, Homo sapiens
ccttggactcatttt

SEQ ID NO: 4755174 - DNA, 15 bp, Homo sapiens
cctttagaatattaa

SEQ ID NO: 4755175 - DNA, 21 bp, Homo sapiens
cgaatcactcatttatttcca

SEQ ID NO: 4755176 - DNA, 21 bp, Homo sapiens
cgggttttattgtttaaaatc

SEQ ID NO: 4755177 - DNA, 19 bp, Homo sapiens
ctaagtaaaaccacagcag

SEQ ID NO: 4755178 - DNA, 15 bp, Homo sapiens
ctacaaaaacacagc

SEQ ID NO: 4755179 - DNA, 18 bp, Homo sapiens
ctacaaaaacacagcaag

SEQ ID NO: 4755180 - DNA, 20 bp, Homo sapiens
ctagaatactaataaaatac

SEQ ID NO: 4755181 - DNA, 19 bp, Homo sapiens
ctagtgaaagaggcagctt

SEQ ID NO: 4755182 - DNA, 15 bp, Homo sapiens
ctataggtgctacaa

SEQ ID NO: 4755183 - DNA, 21 bp, Homo sapiens
ctataggtgctacaaaaacac

SEQ ID NO: 4755184 - DNA, 18 bp, Homo sapiens
ctatctaatttttattaa

SEQ ID NO: 4755185 - DNA, 20 bp, Homo sapiens
ctattgtgctttctatctaa

SEQ ID NO: 4755186 - DNA, 23 bp, Homo sapiens
ctcaaaataccatgccatttaaa

SEQ ID NO: 4755187 - DNA, 19 bp, Homo sapiens
ctcatccattaatgtagat

SEQ ID NO: 4755188 - DNA, 22 bp, Homo sapiens
ctcatttatttccatattaaaa

SEQ ID NO: 4755189 - DNA, 13 bp, Homo sapiens
ctcggagaagagc

SEQ ID NO: 4755190 - DNA, 13 bp, Homo sapiens
ctgaatttctatg

SEQ ID NO: 4755191 - DNA, 23 bp, Homo sapiens
ctgaatttctatggcatattgat

SEQ ID NO: 4755192 - DNA, 15 bp, Homo sapiens
ctgacttctaagtaa

SEQ ID NO: 4755193 - DNA, 13 bp, Homo sapiens
ctgagaaagacta

SEQ ID NO: 4755194 - DNA, 15 bp, Homo sapiens
ctgagaaagactatt

SEQ ID NO: 4755195 - DNA, 18 bp, Homo sapiens
ctgagaaagactattcaa

SEQ ID NO: 4755196 - DNA, 16 bp, Homo sapiens
ctgagcaggattttaa

SEQ ID NO: 4755197 - DNA, 13 bp, Homo sapiens
ctgatgttcctag

SEQ ID NO: 4755198 - DNA, 20 bp, Homo sapiens
ctgatttggccgttttgtga

SEQ ID NO: 4755199 - DNA, 12 bp, Homo sapiens
ctgcactgtcaa

SEQ ID NO: 4755200 - DNA, 18 bp, Homo sapiens
ctgctgaaacaacaaata

SEQ ID NO: 4755201 - DNA, 22 bp, Homo sapiens
ctggcacagttttctgagaaag

SEQ ID NO: 4755202 - DNA, 22 bp, Homo sapiens
ctgggaacccaagtccaagcat

SEQ ID NO: 4755203 - DNA, 21 bp, Homo sapiens
ctgtcagctcccctcggagaa

SEQ ID NO: 4755204 - DNA, 20 bp, Homo sapiens
ctgttaaaagatgaaaatat

SEQ ID NO: 4755205 - DNA, 16 bp, Homo sapiens
cttaattaaaagaata

SEQ ID NO: 4755206 - DNA, 17 bp, Homo sapiens
cttaattaaaagaatat

SEQ ID NO: 4755207 - DNA, 19 bp, Homo sapiens
cttaattaaaagaatattt

SEQ ID NO: 4755208 - DNA, 20 bp, Homo sapiens
cttaattaaaagaatatttt

SEQ ID NO: 4755209 - DNA, 12 bp, Homo sapiens
cttcacaacaga

SEQ ID NO: 4755210 - DNA, 14 bp, Homo sapiens
cttcacaacagatt

SEQ ID NO: 4755211 - DNA, 19 bp, Homo sapiens
cttccttggactcatttta

SEQ ID NO: 4755212 - DNA, 17 bp, Homo sapiens
cttctaagtaaaaccac

SEQ ID NO: 4755213 - DNA, 21 bp, Homo sapiens
cttctaagtaaaaccacagca

SEQ ID NO: 4755214 - DNA, 23 bp, Homo sapiens
cttctaagtaaaaccacagcagt

SEQ ID NO: 4755215 - DNA, 13 bp, Homo sapiens
ctttagaatatta

SEQ ID NO: 4755216 - DNA, 23 bp, Homo sapiens
ctttattagtgaagtatgcacta

SEQ ID NO: 4755217 - DNA, 18 bp, Homo sapiens
ctttctatctaattttta

SEQ ID NO: 4755218 - DNA, 18 bp, Homo sapiens
gaaaatatttgtatcaca

SEQ ID NO: 4755219 - DNA, 15 bp, Homo sapiens
gaaagactattcaaa

SEQ ID NO: 4755220 - DNA, 17 bp, Homo sapiens
gaaagactattcaaaca

SEQ ID NO: 4755221 - DNA, 17 bp, Homo sapiens
gaaatcaaatatgcaaa

SEQ ID NO: 4755222 - DNA, 15 bp, Homo sapiens
gaacataaaatacaa

SEQ ID NO: 4755223 - DNA, 13 bp, Homo sapiens
gaagtatgcacta

SEQ ID NO: 4755224 - DNA, 23 bp, Homo sapiens
gaatattaaaaattaattcttta

SEQ ID NO: 4755225 - DNA, 16 bp, Homo sapiens
gaatattttaacttcc

SEQ ID NO: 4755226 - DNA, 16 bp, Homo sapiens
gaatcactcatttatt

SEQ ID NO: 4755227 - DNA, 22 bp, Homo sapiens
gactattcaaacagtctcagga

SEQ ID NO: 4755228 - DNA, 21 bp, Homo sapiens
gactcattttaaaaaatggaa

SEQ ID NO: 4755229 - DNA, 11 bp, Homo sapiens
gactccaaaga

SEQ ID NO: 4755230 - DNA, 12 bp, Homo sapiens
gactccaaagaa

SEQ ID NO: 4755231 - DNA, 15 bp, Homo sapiens
gacttccatttggaa

SEQ ID NO: 4755232 - DNA, 17 bp, Homo sapiens
gacttctaagtaaaacc

SEQ ID NO: 4755233 - DNA, 24 bp, Homo sapiens
gacttctaagtaaaaccacagcag

SEQ ID NO: 4755234 - DNA, 15 bp, Homo sapiens
gagaaagactattca

SEQ ID NO: 4755235 - DNA, 18 bp, Homo sapiens
gagaaagactattcaaac

SEQ ID NO: 4755236 - DNA, 22 bp, Homo sapiens
gagaagagctgttcacagccag

SEQ ID NO: 4755237 - DNA, 17 bp, Homo sapiens
gataataaaattcattc

SEQ ID NO: 4755238 - DNA, 16 bp, Homo sapiens
gatgtgaacacatcag

SEQ ID NO: 4755239 - DNA, 17 bp, Homo sapiens
gattagggagagaagat

SEQ ID NO: 4755240 - DNA, 14 bp, Homo sapiens
gcaagggtgatggg

SEQ ID NO: 4755241 - DNA, 18 bp, Homo sapiens
gcacagttttctgagaaa

SEQ ID NO: 4755242 - DNA, 20 bp, Homo sapiens
gcacagttttctgagaaaga

SEQ ID NO: 4755243 - DNA, 23 bp, Homo sapiens
gcacagttttctgagaaagacta

SEQ ID NO: 4755244 - DNA, 15 bp, Homo sapiens
gcacctttagaatat

SEQ ID NO: 4755245 - DNA, 17 bp, Homo sapiens
gcactaatcaatacttt

SEQ ID NO: 4755246 - DNA, 18 bp, Homo sapiens
gcactgacttctaagtaa

SEQ ID NO: 4755247 - DNA, 13 bp, Homo sapiens
gcagtgatgtcac

SEQ ID NO: 4755248 - DNA, 19 bp, Homo sapiens
gcagttgaaaagactccaa

SEQ ID NO: 4755249 - DNA, 22 bp, Homo sapiens
gcagttgaaaagactccaaaga

SEQ ID NO: 4755250 - DNA, 18 bp, Homo sapiens
gcatagattccctgagca

SEQ ID NO: 4755251 - DNA, 12 bp, Homo sapiens
gcatcagctgct

SEQ ID NO: 4755252 - DNA, 16 bp, Homo sapiens
gcattgtaaatgtgct

SEQ ID NO: 4755253 - DNA, 13 bp, Homo sapiens
gccctgttaaaag

SEQ ID NO: 4755254 - DNA, 17 bp, Homo sapiens
gctacaaaaacacagca

SEQ ID NO: 4755255 - DNA, 19 bp, Homo sapiens
gctacaaaaacacagcaag

SEQ ID NO: 4755256 - DNA, 15 bp, Homo sapiens
gctactgtcagctcc

SEQ ID NO: 4755257 - DNA, 21 bp, Homo sapiens
gctataggtgctacaaaaaca

SEQ ID NO: 4755258 - DNA, 16 bp, Homo sapiens
gctgttcacagccaga

SEQ ID NO: 4755259 - DNA, 13 bp, Homo sapiens
ggacttccatttg

SEQ ID NO: 4755260 - DNA, 14 bp, Homo sapiens
ggcatggctgggaa

SEQ ID NO: 4755261 - DNA, 20 bp, Homo sapiens
gggaacccaagtccaagcat

SEQ ID NO: 4755262 - DNA, 19 bp, Homo sapiens
ggttttattgtttaaaatc

SEQ ID NO: 4755263 - DNA, 14 bp, Homo sapiens
gtaaaaccacagca

SEQ ID NO: 4755264 - DNA, 23 bp, Homo sapiens
gtaaaaccacagcagttgaaaag

SEQ ID NO: 4755265 - DNA, 17 bp, Homo sapiens
gtaagggaaactgccag

SEQ ID NO: 4755266 - DNA, 15 bp, Homo sapiens
gtagataaagcactg

SEQ ID NO: 4755267 - DNA, 19 bp, Homo sapiens
gtcagctcccctcggagaa

SEQ ID NO: 4755268 - DNA, 23 bp, Homo sapiens
gtcgggttttattgtttaaaatc

SEQ ID NO: 4755269 - DNA, 21 bp, Homo sapiens
gtctgaaattttctagaatac

SEQ ID NO: 4755270 - DNA, 19 bp, Homo sapiens
gtcttaattaaaagaatat

SEQ ID NO: 4755271 - DNA, 21 bp, Homo sapiens
gtcttaattaaaagaatattt

SEQ ID NO: 4755272 - DNA, 15 bp, Homo sapiens
gtgaacacatcagct

SEQ ID NO: 4755273 - DNA, 20 bp, Homo sapiens
gtgctacaaaaacacagcaa

SEQ ID NO: 4755274 - DNA, 21 bp, Homo sapiens
gtgctacaaaaacacagcaag

SEQ ID NO: 4755275 - DNA, 20 bp, Homo sapiens
gtgctttctatctaattttt

SEQ ID NO: 4755276 - DNA, 22 bp, Homo sapiens
gtgtcttaattaaaagaatatt

SEQ ID NO: 4755277 - DNA, 16 bp, Homo sapiens
gttaaaagatgaaaat

SEQ ID NO: 4755278 - DNA, 23 bp, Homo sapiens
gttgaaaagactccaaagaaatg

SEQ ID NO: 4755279 - DNA, 10 bp, Homo sapiens
gtttaaaatc

SEQ ID NO: 4755280 - DNA, 16 bp, Homo sapiens
gtttaaaatcatttct

SEQ ID NO: 4755281 - DNA, 16 bp, Homo sapiens
gttttcattatctcaa

SEQ ID NO: 4755282 - DNA, 18 bp, Homo sapiens
taaaaattaattctttat

SEQ ID NO: 4755283 - DNA, 14 bp, Homo sapiens
taaaaccacagcag

SEQ ID NO: 4755284 - DNA, 23 bp, Homo sapiens
taaaagaatattttaacttcctt

SEQ ID NO: 4755285 - DNA, 21 bp, Homo sapiens
taaaatcacaaactcatccat

SEQ ID NO: 4755286 - DNA, 10 bp, Homo sapiens
taaaatcatt

SEQ ID NO: 4755287 - DNA, 15 bp, Homo sapiens
taaaattcattccat

SEQ ID NO: 4755288 - DNA, 21 bp, Homo sapiens
taagagtaagcacctttagaa

SEQ ID NO: 4755289 - DNA, 15 bp, Homo sapiens
taagtaaaaccacag

SEQ ID NO: 4755290 - DNA, 22 bp, Homo sapiens
taatcaatactttgaacacaaa

SEQ ID NO: 4755291 - DNA, 17 bp, Homo sapiens
taattctttatcacatg

SEQ ID NO: 4755292 - DNA, 12 bp, Homo sapiens
taatttttatta

SEQ ID NO: 4755293 - DNA, 19 bp, Homo sapiens
tacatactatagattcttt

SEQ ID NO: 4755294 - DNA, 15 bp, Homo sapiens
tacattattggactt

SEQ ID NO: 4755295 - DNA, 20 bp, Homo sapiens
tacattattggacttccatt

SEQ ID NO: 4755296 - DNA, 18 bp, Homo sapiens
tagaatattaaaaattaa

SEQ ID NO: 4755297 - DNA, 19 bp, Homo sapiens
tagatgactgaatttctat

SEQ ID NO: 4755298 - DNA, 14 bp, Homo sapiens
tagattctttatta

SEQ ID NO: 4755299 - DNA, 14 bp, Homo sapiens
tagggagagaagat

SEQ ID NO: 4755300 - DNA, 13 bp, Homo sapiens
tatagattcttta

SEQ ID NO: 4755301 - DNA, 14 bp, Homo sapiens
tatagattctttat

SEQ ID NO: 4755302 - DNA, 20 bp, Homo sapiens
tatagattctttattagtga

SEQ ID NO: 4755303 - DNA, 16 bp, Homo sapiens
tataggtgctacaaaa

SEQ ID NO: 4755304 - DNA, 20 bp, Homo sapiens
tataggtgctacaaaaacac

SEQ ID NO: 4755305 - DNA, 23 bp, Homo sapiens
tataggtgctacaaaaacacagc

SEQ ID NO: 4755306 - DNA, 16 bp, Homo sapiens
tatcacaaatcttaac

SEQ ID NO: 4755307 - DNA, 15 bp, Homo sapiens
tatgcaaagcactga

SEQ ID NO: 4755308 - DNA, 19 bp, Homo sapiens
tattaaaaattaattcttt

SEQ ID NO: 4755309 - DNA, 12 bp, Homo sapiens
tattaaaactca

SEQ ID NO: 4755310 - DNA, 20 bp, Homo sapiens
tattcaaaaattatattttg

SEQ ID NO: 4755311 - DNA, 14 bp, Homo sapiens
tattgataataaaa

SEQ ID NO: 4755312 - DNA, 16 bp, Homo sapiens
tattgtttaaaatcat

SEQ ID NO: 4755313 - DNA, 13 bp, Homo sapiens
tatttcatttctt

SEQ ID NO: 4755314 - DNA, 15 bp, Homo sapiens
tatttccatattaaa

SEQ ID NO: 4755315 - DNA, 22 bp, Homo sapiens
tatttccatattaaaatcacaa

SEQ ID NO: 4755316 - DNA, 13 bp, Homo sapiens
tcaaaactgcact

SEQ ID NO: 4755317 - DNA, 13 bp, Homo sapiens
tcaaacagtctca

SEQ ID NO: 4755318 - DNA, 18 bp, Homo sapiens
tcaaatatgcaaagcact

SEQ ID NO: 4755319 - DNA, 19 bp, Homo sapiens
tcaaatatgcaaagcactg

SEQ ID NO: 4755320 - DNA, 17 bp, Homo sapiens
tcaatactttgaacaca

SEQ ID NO: 4755321 - DNA, 20 bp, Homo sapiens
tcaatactttgaacacaaag

SEQ ID NO: 4755322 - DNA, 20 bp, Homo sapiens
tcaatttttcttatttcatt

SEQ ID NO: 4755323 - DNA, 23 bp, Homo sapiens
tcaatttttcttatttcatttct

SEQ ID NO: 4755324 - DNA, 14 bp, Homo sapiens
tcactcatttattt

SEQ ID NO: 4755325 - DNA, 20 bp, Homo sapiens
tcaggaaatcaaatatgcaa

SEQ ID NO: 4755326 - DNA, 22 bp, Homo sapiens
tcaggaaatcaaatatgcaaag

SEQ ID NO: 4755327 - DNA, 20 bp, Homo sapiens
tcatttatttccatattaaa

SEQ ID NO: 4755328 - DNA, 18 bp, Homo sapiens
tctctccccatatataaa

SEQ ID NO: 4755329 - DNA, 19 bp, Homo sapiens
tctctccccatatataaat

SEQ ID NO: 4755330 - DNA, 23 bp, Homo sapiens
tctctccctaccctcttctcagc

SEQ ID NO: 4755331 - DNA, 13 bp, Homo sapiens
tctctccctccac

SEQ ID NO: 4755332 - DNA, 16 bp, Homo sapiens
tctctccctccactcc

SEQ ID NO: 4755333 - DNA, 20 bp, Homo sapiens
tctctccctccactcctccc

SEQ ID NO: 4755334 - DNA, 23 bp, Homo sapiens
tctctccgccccggacagggtgg

SEQ ID NO: 4755335 - DNA, 21 bp, Homo sapiens
tctctctaagacaaatgcagt

SEQ ID NO: 4755336 - DNA, 14 bp, Homo sapiens
tctctctatatata

SEQ ID NO: 4755337 - DNA, 22 bp, Homo sapiens
tctctctcccaactgctgctta

SEQ ID NO: 4755338 - DNA, 11 bp, Homo sapiens
tctctctccct

SEQ ID NO: 4755339 - DNA, 12 bp, Homo sapiens
tctctctccctc

SEQ ID NO: 4755340 - DNA, 15 bp, Homo sapiens
tctctctccctccac

SEQ ID NO: 4755341 - DNA, 10 bp, Homo sapiens
tctctctctc

SEQ ID NO: 4755342 - DNA, 12 bp, Homo sapiens
tctctctctgtt

SEQ ID NO: 4755343 - DNA, 13 bp, Homo sapiens
tctctctctgttc

SEQ ID NO: 4755344 - DNA, 19 bp, Homo sapiens
tctctctggggccctgggc

SEQ ID NO: 4755345 - DNA, 21 bp, Homo sapiens
tctctctggggccctgggcct

SEQ ID NO: 4755346 - DNA, 15 bp, Homo sapiens
tctctctgtgtggca

SEQ ID NO: 4755347 - DNA, 16 bp, Homo sapiens
tctctctgtgtggcaa

SEQ ID NO: 4755348 - DNA, 13 bp, Homo sapiens
tctctcttggtct

SEQ ID NO: 4755349 - DNA, 16 bp, Homo sapiens
tctctcttggtctctt

SEQ ID NO: 4755350 - DNA, 15 bp, Homo sapiens
tctctgagcagtggg

SEQ ID NO: 4755351 - DNA, 14 bp, Homo sapiens
tctctggggccctg

SEQ ID NO: 4755352 - DNA, 20 bp, Homo sapiens
tctctgtgactcgcttagct

SEQ ID NO: 4755353 - DNA, 18 bp, Homo sapiens
tctctgttccaagtgtgt

SEQ ID NO: 4755354 - DNA, 17 bp, Homo sapiens
tctctgtttaccctccc

SEQ ID NO: 4755355 - DNA, 21 bp, Homo sapiens
tctctgtttaccctccctgtc

SEQ ID NO: 4755356 - DNA, 22 bp, Homo sapiens
tctcttaagacagcatgtgtta

SEQ ID NO: 4755357 - DNA, 12 bp, Homo sapiens
tctcttactgcc

SEQ ID NO: 4755358 - DNA, 19 bp, Homo sapiens
tctcttccttgctttctct

SEQ ID NO: 4755359 - DNA, 15 bp, Homo sapiens
tctcttcggtggcct

SEQ ID NO: 4755360 - DNA, 17 bp, Homo sapiens
tctcttcggtggccttg

SEQ ID NO: 4755361 - DNA, 14 bp, Homo sapiens
tctcttgattcata

SEQ ID NO: 4755362 - DNA, 16 bp, Homo sapiens
tctcttgattcataat

SEQ ID NO: 4755363 - DNA, 22 bp, Homo sapiens
tctcttgccgaggagccaggca

SEQ ID NO: 4755364 - DNA, 22 bp, Homo sapiens
tctcttgcctaagtattccttt

SEQ ID NO: 4755365 - DNA, 23 bp, Homo sapiens
tctcttgctgtttaccgcccacc

SEQ ID NO: 4755366 - DNA, 13 bp, Homo sapiens
tctcttgggaagc

SEQ ID NO: 4755367 - DNA, 16 bp, Homo sapiens
tctcttgggaagcagt

SEQ ID NO: 4755368 - DNA, 19 bp, Homo sapiens
tctctttgaaaattcttgt

SEQ ID NO: 4755369 - DNA, 23 bp, Homo sapiens
tctctttgttcttcaatgtgaaa

SEQ ID NO: 4755370 - DNA, 13 bp, Homo sapiens
tctgaaaactgtt

SEQ ID NO: 4755371 - DNA, 18 bp, Homo sapiens
tctgaaactatagaataa

SEQ ID NO: 4755372 - DNA, 14 bp, Homo sapiens
tctgaaatctacaa

SEQ ID NO: 4755373 - DNA, 22 bp, Homo sapiens
tctgaactatcagggcaagctc

SEQ ID NO: 4755374 - DNA, 21 bp, Homo sapiens
tctgaactcacagactgctgt

SEQ ID NO: 4755375 - DNA, 20 bp, Homo sapiens
tctgaaggccttgttaaaat

SEQ ID NO: 4755376 - DNA, 13 bp, Homo sapiens
tctgaagggaggg

SEQ ID NO: 4755377 - DNA, 21 bp, Homo sapiens
tctgaaggggaaaacctcagt

SEQ ID NO: 4755378 - DNA, 22 bp, Homo sapiens
tctgaaggggaaaacctcagtt

SEQ ID NO: 4755379 - DNA, 17 bp, Homo sapiens
tctgaagtcccttcctg

SEQ ID NO: 4755380 - DNA, 14 bp, Homo sapiens
tctgaagttggaca

SEQ ID NO: 4755381 - DNA, 17 bp, Homo sapiens
tctgaagtttcatttat

SEQ ID NO: 4755382 - DNA, 20 bp, Homo sapiens
tctgaatttctaaaaccctt

SEQ ID NO: 4755383 - DNA, 13 bp, Homo sapiens
tctgacaagggct

SEQ ID NO: 4755384 - DNA, 14 bp, Homo sapiens
tctgacggccctgc

SEQ ID NO: 4755385 - DNA, 22 bp, Homo sapiens
tctgagcagacagggcgtcctc

SEQ ID NO: 4755386 - DNA, 17 bp, Homo sapiens
tctgagcagttgttata

SEQ ID NO: 4755387 - DNA, 20 bp, Homo sapiens
tctgagccctgccctcactc

SEQ ID NO: 4755388 - DNA, 12 bp, Homo sapiens
tctgagctgctg

SEQ ID NO: 4755389 - DNA, 14 bp, Homo sapiens
tctgaggagtccaa

SEQ ID NO: 4755390 - DNA, 17 bp, Homo sapiens
tctgaggctgccccagg

SEQ ID NO: 4755391 - DNA, 16 bp, Homo sapiens
tctgatacatctgtca

SEQ ID NO: 4755392 - DNA, 19 bp, Homo sapiens
tctgatacatctgtcagtg

SEQ ID NO: 4755393 - DNA, 12 bp, Homo sapiens
tctgatatcagg

SEQ ID NO: 4755394 - DNA, 13 bp, Homo sapiens
tctgatatgggac

SEQ ID NO: 4755395 - DNA, 21 bp, Homo sapiens
tctgatatgggactgagcctg

SEQ ID NO: 4755396 - DNA, 13 bp, Homo sapiens
tctgatgaaatgt

SEQ ID NO: 4755397 - DNA, 15 bp, Homo sapiens
tctgatgaaatgtta

SEQ ID NO: 4755398 - DNA, 15 bp, Homo sapiens
tctgatgaggcattt

SEQ ID NO: 4755399 - DNA, 16 bp, Homo sapiens
tctgatgatgttctga

SEQ ID NO: 4755400 - DNA, 14 bp, Homo sapiens
tctgattattacaa

SEQ ID NO: 4755401 - DNA, 18 bp, Homo sapiens
tctgattggacctggccc

SEQ ID NO: 4755402 - DNA, 23 bp, Homo sapiens
tctgatttattttgtatgaaata

SEQ ID NO: 4755403 - DNA, 21 bp, Homo sapiens
tctgcaaatagaaaacaggaa

SEQ ID NO: 4755404 - DNA, 13 bp, Homo sapiens
tctgcacacataa

SEQ ID NO: 4755405 - DNA, 22 bp, Homo sapiens
tctgcacacataacacacatca

SEQ ID NO: 4755406 - DNA, 17 bp, Homo sapiens
tctgcactcctgtctct

SEQ ID NO: 4755407 - DNA, 18 bp, Homo sapiens
tctgcactcctgtctctt

SEQ ID NO: 4755408 - DNA, 23 bp, Homo sapiens
tctgcactcctgtctcttgggaa

SEQ ID NO: 4755409 - DNA, 18 bp, Homo sapiens
tctgcagcctgagctcca

SEQ ID NO: 4755410 - DNA, 21 bp, Homo sapiens
tctgcagctattcacacacac

SEQ ID NO: 4755411 - DNA, 19 bp, Homo sapiens
tctgcaggaaataggccca

SEQ ID NO: 4755412 - DNA, 23 bp, Homo sapiens
tctgcaggccacccccacctccc

SEQ ID NO: 4755413 - DNA, 15 bp, Homo sapiens
tctgcagtattctgt

SEQ ID NO: 4755414 - DNA, 17 bp, Homo sapiens
tctgcagtattctgtag

SEQ ID NO: 4755415 - DNA, 14 bp, Homo sapiens
tctgcagtcagact

SEQ ID NO: 4755416 - DNA, 21 bp, Homo sapiens
tctgcagtcctcggcagctcc

SEQ ID NO: 4755417 - DNA, 16 bp, Homo sapiens
tctgcatagacaaagg

SEQ ID NO: 4755418 - DNA, 22 bp, Homo sapiens
tctgccccctcccccgcagaca

SEQ ID NO: 4755419 - DNA, 16 bp, Homo sapiens
tctgcccctccgtccc

SEQ ID NO: 4755420 - DNA, 20 bp, Homo sapiens
tctgcccctccgtccccagg

SEQ ID NO: 4755421 - DNA, 17 bp, Homo sapiens
tctgcccctcttccctg

SEQ ID NO: 4755422 - DNA, 21 bp, Homo sapiens
tctgccccttgaccccacacg

SEQ ID NO: 4755423 - DNA, 22 bp, Homo sapiens
tctgcccgcgggtggctggagc

SEQ ID NO: 4755424 - DNA, 14 bp, Homo sapiens
tctgccgcagccct

SEQ ID NO: 4755425 - DNA, 15 bp, Homo sapiens
tctgccgcagccctg

SEQ ID NO: 4755426 - DNA, 16 bp, Homo sapiens
tctgccggtggggcca

SEQ ID NO: 4755427 - DNA, 17 bp, Homo sapiens
tctgctatgtctgtgat

SEQ ID NO: 4755428 - DNA, 16 bp, Homo sapiens
tctgctcatctacaca

SEQ ID NO: 4755429 - DNA, 13 bp, Homo sapiens
tctgctccatgca

SEQ ID NO: 4755430 - DNA, 13 bp, Homo sapiens
tctgctgcctcca

SEQ ID NO: 4755431 - DNA, 17 bp, Homo sapiens
tctgctggtcttcaatt

SEQ ID NO: 4755432 - DNA, 16 bp, Homo sapiens
tctgcttgtcattctg

SEQ ID NO: 4755433 - DNA, 17 bp, Homo sapiens
tctggaaaacctgaggc

SEQ ID NO: 4755434 - DNA, 14 bp, Homo sapiens
tctggaaagagctg

SEQ ID NO: 4755435 - DNA, 12 bp, Homo sapiens
tctggagcccct

SEQ ID NO: 4755436 - DNA, 20 bp, Homo sapiens
tctggagcccctatcctgca

SEQ ID NO: 4755437 - DNA, 23 bp, Homo sapiens
tctggagcccctatcctgcaccc

SEQ ID NO: 4755438 - DNA, 21 bp, Homo sapiens
tctggagtctgaaggagagga

SEQ ID NO: 4755439 - DNA, 14 bp, Homo sapiens
tctggattccagag

SEQ ID NO: 4755440 - DNA, 14 bp, Homo sapiens
tctggattttcaaa

SEQ ID NO: 4755441 - DNA, 20 bp, Homo sapiens
tctggattttcaaagattgt

SEQ ID NO: 4755442 - DNA, 18 bp, Homo sapiens
tctggcaatcttgccctt

SEQ ID NO: 4755443 - DNA, 20 bp, Homo sapiens
tctggcagagttgaagacag

SEQ ID NO: 4755444 - DNA, 14 bp, Homo sapiens
tctggcccagccat

SEQ ID NO: 4755445 - DNA, 17 bp, Homo sapiens
tctggcctggcctggcc

SEQ ID NO: 4755446 - DNA, 19 bp, Homo sapiens
tctggccttggttcctcca

SEQ ID NO: 4755447 - DNA, 21 bp, Homo sapiens
tctggccttggttcctccagc

SEQ ID NO: 4755448 - DNA, 12 bp, Homo sapiens
tctggctgccaa

SEQ ID NO: 4755449 - DNA, 14 bp, Homo sapiens
tctggctgtggccc

SEQ ID NO: 4755450 - DNA, 13 bp, Homo sapiens
tgaagcagaatga

SEQ ID NO: 4755451 - DNA, 12 bp, Homo sapiens
tgaagcagagtc

SEQ ID NO: 4755452 - DNA, 20 bp, Homo sapiens
tgaagcagagtcaagctgat

SEQ ID NO: 4755453 - DNA, 15 bp, Homo sapiens
tgaagccttttcctg

SEQ ID NO: 4755454 - DNA, 15 bp, Homo sapiens
tgaaggatctgtccg

SEQ ID NO: 4755455 - DNA, 15 bp, Homo sapiens
tgaaggccttgttaa

SEQ ID NO: 4755456 - DNA, 18 bp, Homo sapiens
tgaagggaggggaagaga

SEQ ID NO: 4755457 - DNA, 14 bp, Homo sapiens
tgaagggcccagga

SEQ ID NO: 4755458 - DNA, 18 bp, Homo sapiens
tgaaggggccagaccacg

SEQ ID NO: 4755459 - DNA, 15 bp, Homo sapiens
tgaaggtgccagacg

SEQ ID NO: 4755460 - DNA, 22 bp, Homo sapiens
tgaagtagtgtgagtgttagaa

SEQ ID NO: 4755461 - DNA, 21 bp, Homo sapiens
tgaagtatgcactaatcaata

SEQ ID NO: 4755462 - DNA, 19 bp, Homo sapiens
tgaagtcccttcctgtcct

SEQ ID NO: 4755463 - DNA, 21 bp, Homo sapiens
tgaagtcccttcctgtcctgc

SEQ ID NO: 4755464 - DNA, 22 bp, Homo sapiens
tgaagtctttgtacagacaaca

SEQ ID NO: 4755465 - DNA, 18 bp, Homo sapiens
tgaagtgatgatggatga

SEQ ID NO: 4755466 - DNA, 12 bp, Homo sapiens
tgaagtgcatgt

SEQ ID NO: 4755467 - DNA, 15 bp, Homo sapiens
tgaagttaagcacaa

SEQ ID NO: 4755468 - DNA, 22 bp, Homo sapiens
tgaagttaagcacaaccatgtt

SEQ ID NO: 4755469 - DNA, 18 bp, Homo sapiens
tgaagttggacagcaaaa

SEQ ID NO: 4755470 - DNA, 17 bp, Homo sapiens
tgaagttgtacaacacc

SEQ ID NO: 4755471 - DNA, 21 bp, Homo sapiens
tgaagtttcatttatgataca

SEQ ID NO: 4755472 - DNA, 15 bp, Homo sapiens
tgaataaaatgttta

SEQ ID NO: 4755473 - DNA, 22 bp, Homo sapiens
tgaataataaccacgattccaa

SEQ ID NO: 4755474 - DNA, 17 bp, Homo sapiens
tgaataatgcctttgta

SEQ ID NO: 4755475 - DNA, 21 bp, Homo sapiens
tgaataatgcctttgtaacca

SEQ ID NO: 4755476 - DNA, 12 bp, Homo sapiens
tgaatataaatg

SEQ ID NO: 4755477 - DNA, 19 bp, Homo sapiens
tgaatcagaggcagagacc

SEQ ID NO: 4755478 - DNA, 21 bp, Homo sapiens
tgaatccatcgatttgtatta

SEQ ID NO: 4755479 - DNA, 18 bp, Homo sapiens
tgaatctctaaaatgctg

SEQ ID NO: 4755480 - DNA, 15 bp, Homo sapiens
tgaatgaaatataaa

SEQ ID NO: 4755481 - DNA, 22 bp, Homo sapiens
tgaatgaaatataaactgtgag

SEQ ID NO: 4755482 - DNA, 17 bp, Homo sapiens
tgaatgcagtataaaat

SEQ ID NO: 4755483 - DNA, 19 bp, Homo sapiens
tgaatgcagtataaaatgt

SEQ ID NO: 4755484 - DNA, 16 bp, Homo sapiens
tgaatgcccaggaagt

SEQ ID NO: 4755485 - DNA, 22 bp, Homo sapiens
tgaatgctatttgtgtaactga

SEQ ID NO: 4755486 - DNA, 14 bp, Homo sapiens
tgaatgtcagtgtg

SEQ ID NO: 4755487 - DNA, 15 bp, Homo sapiens
tgaatgtcagtgtga

SEQ ID NO: 4755488 - DNA, 19 bp, Homo sapiens
tgaattagaagaaaatgga

SEQ ID NO: 4755489 - DNA, 22 bp, Homo sapiens
tgaattattgggcttaatataa

SEQ ID NO: 4755490 - DNA, 13 bp, Homo sapiens
tgaatttaccatc

SEQ ID NO: 4755491 - DNA, 20 bp, Homo sapiens
tgaatttaccatcaaacaaa

SEQ ID NO: 4755492 - DNA, 20 bp, Homo sapiens
tgaatttggggctacttata

SEQ ID NO: 4755493 - DNA, 16 bp, Homo sapiens
tgacaaagaaaatgag

SEQ ID NO: 4755494 - DNA, 15 bp, Homo sapiens
tgacaagtcacaccc

SEQ ID NO: 4755495 - DNA, 13 bp, Homo sapiens
tgacaataaattt

SEQ ID NO: 4755496 - DNA, 16 bp, Homo sapiens
tgacaataagaaacag

SEQ ID NO: 4755497 - DNA, 18 bp, Homo sapiens
tgacacaactcatccaga

SEQ ID NO: 4755498 - DNA, 20 bp, Homo sapiens
tgacacaagaggaataagaa

SEQ ID NO: 4755499 - DNA, 21 bp, Homo sapiens
tgacacaatggtagctctgaa

SEQ ID NO: 4755500 - DNA, 19 bp, Homo sapiens
tgacacattgcacacacag

SEQ ID NO: 4755501 - DNA, 16 bp, Homo sapiens
tgacaccaccactgtg

SEQ ID NO: 4755502 - DNA, 19 bp, Homo sapiens
tgacaccaccactgtgtcc

SEQ ID NO: 4755503 - DNA, 20 bp, Homo sapiens
tgacacctgccgctgcttga

SEQ ID NO: 4755504 - DNA, 11 bp, Homo sapiens
tgacactgacc

SEQ ID NO: 4755505 - DNA, 21 bp, Homo sapiens
tgacactggaagggtccggct

SEQ ID NO: 4755506 - DNA, 18 bp, Homo sapiens
tgacactgtctgctgccc

SEQ ID NO: 4755507 - DNA, 19 bp, Homo sapiens
tgacagcctccaccttgag

SEQ ID NO: 4755508 - DNA, 22 bp, Homo sapiens
tgacagcctccaccttgagcac

SEQ ID NO: 4755509 - DNA, 16 bp, Homo sapiens
tgacagcgccatgtgt

SEQ ID NO: 4755510 - DNA, 17 bp, Homo sapiens
tgacagcgccatgtgtg

SEQ ID NO: 4755511 - DNA, 18 bp, Homo sapiens
tgacagcgccatgtgtgt

SEQ ID NO: 4755512 - DNA, 13 bp, Homo sapiens
tgacagctgtcct

SEQ ID NO: 4755513 - DNA, 21 bp, Homo sapiens
tgacaggaacccatcactgtg

SEQ ID NO: 4755514 - DNA, 15 bp, Homo sapiens
tgacaggccttcctc

SEQ ID NO: 4755515 - DNA, 21 bp, Homo sapiens
tgacagtagcatactgatgag

SEQ ID NO: 4755516 - DNA, 19 bp, Homo sapiens
tgacatcagcactgccaac

SEQ ID NO: 4755517 - DNA, 13 bp, Homo sapiens
tgacatccacatg

SEQ ID NO: 4755518 - DNA, 21 bp, Homo sapiens
tgacatccacatgcacatgta

SEQ ID NO: 4755519 - DNA, 14 bp, Homo sapiens
tgacatgatcgctt

SEQ ID NO: 4755520 - DNA, 15 bp, Homo sapiens
tgacatgatcgcttt

SEQ ID NO: 4755521 - DNA, 17 bp, Homo sapiens
tgacatgcactgaccct

SEQ ID NO: 4755522 - DNA, 12 bp, Homo sapiens
tgacattccaca

SEQ ID NO: 4755523 - DNA, 15 bp, Homo sapiens
tgacattgtcagaat

SEQ ID NO: 4755524 - DNA, 16 bp, Homo sapiens
tgacattgtcagaatg

SEQ ID NO: 4755525 - DNA, 21 bp, Homo sapiens
tgacattgtcagaatgttgtg

SEQ ID NO: 4755526 - DNA, 17 bp, Homo sapiens
tgacattttgtagctag

SEQ ID NO: 4755527 - DNA, 19 bp, Homo sapiens
tgaccaagggaagtgacca

SEQ ID NO: 4755528 - DNA, 18 bp, Homo sapiens
tgaccaagtataaacttt

SEQ ID NO: 4755529 - DNA, 19 bp, Homo sapiens
tgaccaatctctgtgactc

SEQ ID NO: 4755530 - DNA, 20 bp, Homo sapiens
tgaccagcaccatctctcct

SEQ ID NO: 4755531 - DNA, 19 bp, Homo sapiens
tgaccagcataccagttct

SEQ ID NO: 4755532 - DNA, 19 bp, Homo sapiens
tgaccatgcattttaccat

SEQ ID NO: 4755533 - DNA, 19 bp, Homo sapiens
tgaccccacacgccggggc

SEQ ID NO: 4755534 - DNA, 12 bp, Homo sapiens
tgaccctcactt

SEQ ID NO: 4755535 - DNA, 22 bp, Homo sapiens
tgaccctcacttttctcatctg

SEQ ID NO: 4755536 - DNA, 17 bp, Homo sapiens
tgaccctgaaatatttt

SEQ ID NO: 4755537 - DNA, 21 bp, Homo sapiens
tgaccctgaaatattttctac

SEQ ID NO: 4755538 - DNA, 13 bp, Homo sapiens
tgaccctgtgccc

SEQ ID NO: 4755539 - DNA, 13 bp, Homo sapiens
tgaccctgtgcct

SEQ ID NO: 4755540 - DNA, 14 bp, Homo sapiens
tgaccctgtgcctg

SEQ ID NO: 4755541 - DNA, 22 bp, Homo sapiens
tgaccgaagggacggggcccgc

SEQ ID NO: 4755542 - DNA, 13 bp, Homo sapiens
tgaccgtgaggcc

SEQ ID NO: 4755543 - DNA, 20 bp, Homo sapiens
tgacctcaagtgatctgccc

SEQ ID NO: 4755544 - DNA, 15 bp, Homo sapiens
tgacctcacagtgac

SEQ ID NO: 4755545 - DNA, 18 bp, Homo sapiens
tgacctcgtgatccaccc

SEQ ID NO: 4755546 - DNA, 18 bp, Homo sapiens
tgacctgcctctcacaca

SEQ ID NO: 4755547 - DNA, 11 bp, Homo sapiens
tgaccttcctc

SEQ ID NO: 4755548 - DNA, 15 bp, Homo sapiens
tgaccttcctctggg

SEQ ID NO: 4755549 - DNA, 15 bp, Homo sapiens
tgacctttaagagaa

SEQ ID NO: 4755550 - DNA, 17 bp, Homo sapiens
tgacctttttaatccag

SEQ ID NO: 4755551 - DNA, 23 bp, Homo sapiens
tgacgacctacatctgaaatcta

SEQ ID NO: 4755552 - DNA, 20 bp, Homo sapiens
tgacgtgcacaaaccttctt

SEQ ID NO: 4755553 - DNA, 14 bp, Homo sapiens
tgactaatccttaa

SEQ ID NO: 4755554 - DNA, 15 bp, Homo sapiens
tgactccaaccattc

SEQ ID NO: 4755555 - DNA, 15 bp, Homo sapiens
tgactcctcaattcc

SEQ ID NO: 4755556 - DNA, 21 bp, Homo sapiens
tgactcgcttagctgaaacct

SEQ ID NO: 4755557 - DNA, 15 bp, Homo sapiens
tgactctggctgcca

SEQ ID NO: 4755558 - DNA, 18 bp, Homo sapiens
tgactctggctgccaaga

SEQ ID NO: 4755559 - DNA, 17 bp, Homo sapiens
tgactctttattgtctg

SEQ ID NO: 4755560 - DNA, 18 bp, Homo sapiens
tgactctttattgtctgt

SEQ ID NO: 4755561 - DNA, 19 bp, Homo sapiens
tgactgaacgatccttcaa

SEQ ID NO: 4755562 - DNA, 22 bp, Homo sapiens
tgactgaacgatccttcaaagt

SEQ ID NO: 4755563 - DNA, 17 bp, Homo sapiens
tgactgaatttctatgg

SEQ ID NO: 4755564 - DNA, 21 bp, Homo sapiens
tgactgcattttactgtacag

SEQ ID NO: 4755565 - DNA, 13 bp, Homo sapiens
tgactggaaacaa

SEQ ID NO: 4755566 - DNA, 22 bp, Homo sapiens
tgactgtcccaccgggagcctc

SEQ ID NO: 4755567 - DNA, 19 bp, Homo sapiens
tgactgttctcttactgcc

SEQ ID NO: 4755568 - DNA, 13 bp, Homo sapiens
tgacttatttgct

SEQ ID NO: 4755569 - DNA, 16 bp, Homo sapiens
tgacttcccagctggc

SEQ ID NO: 4755570 - DNA, 11 bp, Homo sapiens
tgacttctctc

SEQ ID NO: 4755571 - DNA, 11 bp, Homo sapiens
tgacttcttgt

SEQ ID NO: 4755572 - DNA, 16 bp, Homo sapiens
tctgcactcctgtctc

SEQ ID NO: 4755573 - DNA, 20 bp, Homo sapiens
tctgcagcccgatgtccctg

SEQ ID NO: 4755574 - DNA, 21 bp, Homo sapiens
tctgcagcccgatgtccctgt

SEQ ID NO: 4755575 - DNA, 22 bp, Homo sapiens
tctgcagcccgatgtccctgtc

SEQ ID NO: 4755576 - DNA, 24 bp, Homo sapiens
tctgcagcctgagctccaccctcc

SEQ ID NO: 4755577 - DNA, 16 bp, Homo sapiens
tctgcagtattctgta

SEQ ID NO: 4755578 - DNA, 22 bp, Homo sapiens
tctgcagtcctcggcagctccg

SEQ ID NO: 4755579 - DNA, 17 bp, Homo sapiens
tctgccacaagggcagt

SEQ ID NO: 4755580 - DNA, 13 bp, Homo sapiens
tctgccagggcag

SEQ ID NO: 4755581 - DNA, 16 bp, Homo sapiens
tctgccagggcagtgc

SEQ ID NO: 4755582 - DNA, 9 bp, Homo sapiens
tctgccccc

SEQ ID NO: 4755583 - DNA, 16 bp, Homo sapiens
tctgccccctcccccg

SEQ ID NO: 4755584 - DNA, 23 bp, Homo sapiens
tctgccccctcccccgcagacag

SEQ ID NO: 4755585 - DNA, 13 bp, Homo sapiens
tctgcccctcttc

SEQ ID NO: 4755586 - DNA, 19 bp, Homo sapiens
tctgccccttgaccccaca

SEQ ID NO: 4755587 - DNA, 20 bp, Homo sapiens
tctgccccttgaccccacac

SEQ ID NO: 4755588 - DNA, 17 bp, Homo sapiens
tctgcccgcgggtggct

SEQ ID NO: 4755589 - DNA, 23 bp, Homo sapiens
tctgcccgcgggtggctggagcc

SEQ ID NO: 4755590 - DNA, 23 bp, Homo sapiens
tctgccgcagccctgcagagggc

SEQ ID NO: 4755591 - DNA, 18 bp, Homo sapiens
tctgccggtcccccatgc

SEQ ID NO: 4755592 - DNA, 23 bp, Homo sapiens
tctgccggtggggccagcgctga

SEQ ID NO: 4755593 - DNA, 13 bp, Homo sapiens
tctgccttagagg

SEQ ID NO: 4755594 - DNA, 14 bp, Homo sapiens
tctgcgccccagcg

SEQ ID NO: 4755595 - DNA, 16 bp, Homo sapiens
tctgcgccccagcgac

SEQ ID NO: 4755596 - DNA, 16 bp, Homo sapiens
tctgctaatttatgaa

SEQ ID NO: 4755597 - DNA, 16 bp, Homo sapiens
tctgctatgtctgtga

SEQ ID NO: 4755598 - DNA, 20 bp, Homo sapiens
tctgctatttttaatttcct

SEQ ID NO: 4755599 - DNA, 18 bp, Homo sapiens
tctgctccatgcagatct

SEQ ID NO: 4755600 - DNA, 22 bp, Homo sapiens
tctgctgcctgcccgcacagca

SEQ ID NO: 4755601 - DNA, 16 bp, Homo sapiens
tctgctgctttccaac

SEQ ID NO: 4755602 - DNA, 15 bp, Homo sapiens
tctgctggtcttcaa

SEQ ID NO: 4755603 - DNA, 16 bp, Homo sapiens
tctgctgtacagatat

SEQ ID NO: 4755604 - DNA, 15 bp, Homo sapiens
tctgcttctctttca

SEQ ID NO: 4755605 - DNA, 14 bp, Homo sapiens
tctgctttctgata

SEQ ID NO: 4755606 - DNA, 17 bp, Homo sapiens
tctgctttctgatacat

SEQ ID NO: 4755607 - DNA, 22 bp, Homo sapiens
tctgctttggggcttatcagaa

SEQ ID NO: 4755608 - DNA, 23 bp, Homo sapiens
tctgctttggggcttatcagaac

SEQ ID NO: 4755609 - DNA, 23 bp, Homo sapiens
tctggaagagggaggggccctgt

SEQ ID NO: 4755610 - DNA, 13 bp, Homo sapiens
tctggacctgacc

SEQ ID NO: 4755611 - DNA, 15 bp, Homo sapiens
tctggacctgaccag

SEQ ID NO: 4755612 - DNA, 13 bp, Homo sapiens
tctggagccccta

SEQ ID NO: 4755613 - DNA, 22 bp, Homo sapiens
tctggaggtggggagggcctct

SEQ ID NO: 4755614 - DNA, 13 bp, Homo sapiens
tctggagtctgaa

SEQ ID NO: 4755615 - DNA, 20 bp, Homo sapiens
tctggagtctgaaggagagg

SEQ ID NO: 4755616 - DNA, 23 bp, Homo sapiens
tctggagtctgaaggagaggagt

SEQ ID NO: 4755617 - DNA, 15 bp, Homo sapiens
tctggattttcaaag

SEQ ID NO: 4755618 - DNA, 17 bp, Homo sapiens
tctggcccagccatggc

SEQ ID NO: 4755619 - DNA, 20 bp, Homo sapiens
tctggcccagccatggctgg

SEQ ID NO: 4755620 - DNA, 16 bp, Homo sapiens
tctggcctatgaccct

SEQ ID NO: 4755621 - DNA, 17 bp, Homo sapiens
tctggcctatgaccctg

SEQ ID NO: 4755622 - DNA, 21 bp, Homo sapiens
tctggcctatgaccctgtgcc

SEQ ID NO: 4755623 - DNA, 22 bp, Homo sapiens
tctggcctatgaccctgtgcct

SEQ ID NO: 4755624 - DNA, 18 bp, Homo sapiens
tctggcctggcctggccc

SEQ ID NO: 4755625 - DNA, 19 bp, Homo sapiens
tctggcctggcctggccct

SEQ ID NO: 4755626 - DNA, 20 bp, Homo sapiens
tctggcctggcctggccctg

SEQ ID NO: 4755627 - DNA, 22 bp, Homo sapiens
tctggcctggcctggccctgcc

SEQ ID NO: 4755628 - DNA, 23 bp, Homo sapiens
tctggcctggcctggccctgccc

SEQ ID NO: 4755629 - DNA, 22 bp, Homo sapiens
tctggccttggttcctccagca

SEQ ID NO: 4755630 - DNA, 15 bp, Homo sapiens
tctggctgtggcccc

SEQ ID NO: 4755631 - DNA, 15 bp, Homo sapiens
tctggcttctgcatt

SEQ ID NO: 4755632 - DNA, 16 bp, Homo sapiens
tctggcttctgcatta

SEQ ID NO: 4755633 - DNA, 22 bp, Homo sapiens
tctgggacaggcaccatgctgg

SEQ ID NO: 4755634 - DNA, 13 bp, Homo sapiens
tctgggcctgggc

SEQ ID NO: 4755635 - DNA, 20 bp, Homo sapiens
tctggggagggacacagagg

SEQ ID NO: 4755636 - DNA, 16 bp, Homo sapiens
tctggggccctgggcc

SEQ ID NO: 4755637 - DNA, 18 bp, Homo sapiens
tctggggccctgggcctc

SEQ ID NO: 4755638 - DNA, 19 bp, Homo sapiens
tctgggggactagaacaca

SEQ ID NO: 4755639 - DNA, 20 bp, Homo sapiens
tctggggtggggcttggaag

SEQ ID NO: 4755640 - DNA, 18 bp, Homo sapiens
tctgggttaacagtaaat

SEQ ID NO: 4755641 - DNA, 17 bp, Homo sapiens
tctggtattaaatgcca

SEQ ID NO: 4755642 - DNA, 22 bp, Homo sapiens
tctggtcagtgaagcccaggag

SEQ ID NO: 4755643 - DNA, 15 bp, Homo sapiens
tctggtccacacacc

SEQ ID NO: 4755644 - DNA, 16 bp, Homo sapiens
tctggtccacacacca

SEQ ID NO: 4755645 - DNA, 18 bp, Homo sapiens
tctggtccacacaccaca

SEQ ID NO: 4755646 - DNA, 17 bp, Homo sapiens
tctggtccttagtaaat

SEQ ID NO: 4755647 - DNA, 15 bp, Homo sapiens
tctggtgcgtgtggc

SEQ ID NO: 4755648 - DNA, 17 bp, Homo sapiens
tctggtgcgtgtggccc

SEQ ID NO: 4755649 - DNA, 22 bp, Homo sapiens
tctggtgcgtgtggccctgtgg

SEQ ID NO: 4755650 - DNA, 16 bp, Homo sapiens
tctggtggtttaatac

SEQ ID NO: 4755651 - DNA, 16 bp, Homo sapiens
tctggtgttctcaatg

SEQ ID NO: 4755652 - DNA, 21 bp, Homo sapiens
tctggtgttctcaatgctttt

SEQ ID NO: 4755653 - DNA, 18 bp, Homo sapiens
tctgtaaaaagcaggtga

SEQ ID NO: 4755654 - DNA, 15 bp, Homo sapiens
tctgtaaaaccaggc

SEQ ID NO: 4755655 - DNA, 22 bp, Homo sapiens
tctgtaaaatagtctcattgcc

SEQ ID NO: 4755656 - DNA, 20 bp, Homo sapiens
tctgtaattcttctcctttg

SEQ ID NO: 4755657 - DNA, 23 bp, Homo sapiens
tctgtaattcttctcctttgtca

SEQ ID NO: 4755658 - DNA, 20 bp, Homo sapiens
tctgtacgaggcttctctaa

SEQ ID NO: 4755659 - DNA, 23 bp, Homo sapiens
tctgtacttcagttctcatcttg

SEQ ID NO: 4755660 - DNA, 15 bp, Homo sapiens
tctgtagcctggtct

SEQ ID NO: 4755661 - DNA, 16 bp, Homo sapiens
tctgtataaatgtgaa

SEQ ID NO: 4755662 - DNA, 21 bp, Homo sapiens
tctgtataaatgtgaaatttt

SEQ ID NO: 4755663 - DNA, 19 bp, Homo sapiens
tctgtatatagatgtctgt

SEQ ID NO: 4755664 - DNA, 17 bp, Homo sapiens
tctgtatatcagctcta

SEQ ID NO: 4755665 - DNA, 13 bp, Homo sapiens
tctgtattgctaa

SEQ ID NO: 4755666 - DNA, 15 bp, Homo sapiens
tctgtattggcagca

SEQ ID NO: 4755667 - DNA, 21 bp, Homo sapiens
tctgtcagccagccgccctgg

SEQ ID NO: 4755668 - DNA, 19 bp, Homo sapiens
tctgtcagggccttggccc

SEQ ID NO: 4755669 - DNA, 23 bp, Homo sapiens
tctgtcagggccttggcccaggg

SEQ ID NO: 4755670 - DNA, 15 bp, Homo sapiens
tctgtcagtttgtga

SEQ ID NO: 4755671 - DNA, 17 bp, Homo sapiens
tctgtcagtttgtgaag

SEQ ID NO: 4755672 - DNA, 18 bp, Homo sapiens
tctgtcagtttgtgaagt

SEQ ID NO: 4755673 - DNA, 13 bp, Homo sapiens
tctgtcatctctc

SEQ ID NO: 4755674 - DNA, 20 bp, Homo sapiens
tctgtcattggttacaaatt

SEQ ID NO: 4755675 - DNA, 18 bp, Homo sapiens
tctgtcccagttaactgt

SEQ ID NO: 4755676 - DNA, 13 bp, Homo sapiens
tctgtcccgggta

SEQ ID NO: 4755677 - DNA, 18 bp, Homo sapiens
tctgtccctaaacatagt

SEQ ID NO: 4755678 - DNA, 19 bp, Homo sapiens
tctgtccctaaacatagtg

SEQ ID NO: 4755679 - DNA, 16 bp, Homo sapiens
tctgtccgtctgtcct

SEQ ID NO: 4755680 - DNA, 14 bp, Homo sapiens
tctgtcctttccca

SEQ ID NO: 4755681 - DNA, 18 bp, Homo sapiens
tctgtctctcttttgctc

SEQ ID NO: 4755682 - DNA, 21 bp, Homo sapiens
tctgtctctcttttgctctct

SEQ ID NO: 4755683 - DNA, 12 bp, Homo sapiens
tctttattgtct

SEQ ID NO: 4755684 - DNA, 20 bp, Homo sapiens
tctttcaacagtttcaaaat

SEQ ID NO: 4755685 - DNA, 23 bp, Homo sapiens
tctttcacccttttctgtttgct

SEQ ID NO: 4755686 - DNA, 12 bp, Homo sapiens
tctttccttcct

SEQ ID NO: 4755687 - DNA, 21 bp, Homo sapiens
tctttcctttcatcctcagca

SEQ ID NO: 4755688 - DNA, 22 bp, Homo sapiens
tctttcctttcatcctcagcaa

SEQ ID NO: 4755689 - DNA, 16 bp, Homo sapiens
tctttcggtctcctta

SEQ ID NO: 4755690 - DNA, 17 bp, Homo sapiens
tctttctccaaagttat

SEQ ID NO: 4755691 - DNA, 13 bp, Homo sapiens
tctttctctctgt

SEQ ID NO: 4755692 - DNA, 19 bp, Homo sapiens
tctttcttcaattaatgga

SEQ ID NO: 4755693 - DNA, 23 bp, Homo sapiens
tctttcttcaattaatggaaaac

SEQ ID NO: 4755694 - DNA, 13 bp, Homo sapiens
tctttctttccaa

SEQ ID NO: 4755695 - DNA, 17 bp, Homo sapiens
tctttcttttcttttta

SEQ ID NO: 4755696 - DNA, 15 bp, Homo sapiens
tctttcttttgtgca

SEQ ID NO: 4755697 - DNA, 18 bp, Homo sapiens
tctttcttttgtgcatat

SEQ ID NO: 4755698 - DNA, 15 bp, Homo sapiens
tgatcaaggtgctct

SEQ ID NO: 4755699 - DNA, 18 bp, Homo sapiens
tgatcccccaaacagcat

SEQ ID NO: 4755700 - DNA, 19 bp, Homo sapiens
tgatctatgggaaatctag

SEQ ID NO: 4755701 - DNA, 17 bp, Homo sapiens
tgatctctcgtgattga

SEQ ID NO: 4755702 - DNA, 11 bp, Homo sapiens
tgatctgtatt

SEQ ID NO: 4755703 - DNA, 23 bp, Homo sapiens
tgatctgtatttaatggttttta

SEQ ID NO: 4755704 - DNA, 15 bp, Homo sapiens
tgatgaataaaatgt

SEQ ID NO: 4755705 - DNA, 15 bp, Homo sapiens
tgatgaccaatctct

SEQ ID NO: 4755706 - DNA, 17 bp, Homo sapiens
tgatgaccaatctctgt

SEQ ID NO: 4755707 - DNA, 12 bp, Homo sapiens
tgatgaggcatt

SEQ ID NO: 4755708 - DNA, 14 bp, Homo sapiens
tgatgatggaaggg

SEQ ID NO: 4755709 - DNA, 16 bp, Homo sapiens
tgatgattcaatcatt

SEQ ID NO: 4755710 - DNA, 16 bp, Homo sapiens
tgatgatttcagaaac

SEQ ID NO: 4755711 - DNA, 14 bp, Homo sapiens
tgatgccatgagga

SEQ ID NO: 4755712 - DNA, 18 bp, Homo sapiens
tgatgcgtctacccagac

SEQ ID NO: 4755713 - DNA, 16 bp, Homo sapiens
tgatggagaaggaagg

SEQ ID NO: 4755714 - DNA, 13 bp, Homo sapiens
tgatggccaggcc

SEQ ID NO: 4755715 - DNA, 23 bp, Homo sapiens
tgatgggaaagaccctaggtgct

SEQ ID NO: 4755716 - DNA, 14 bp, Homo sapiens
tgatgggcaagggg

SEQ ID NO: 4755717 - DNA, 23 bp, Homo sapiens
tgatgggcaaggggccaggaagg

SEQ ID NO: 4755718 - DNA, 23 bp, Homo sapiens
tgatggggaagggtggatgtccc

SEQ ID NO: 4755719 - DNA, 13 bp, Homo sapiens
tgatgggtcctgc

SEQ ID NO: 4755720 - DNA, 15 bp, Homo sapiens
tgatggttgctttga

SEQ ID NO: 4755721 - DNA, 14 bp, Homo sapiens
tgatgtctgaggat

SEQ ID NO: 4755722 - DNA, 13 bp, Homo sapiens
tgatgttctgaaa

SEQ ID NO: 4755723 - DNA, 16 bp, Homo sapiens
tgatgttctgaaatgg

SEQ ID NO: 4755724 - DNA, 13 bp, Homo sapiens
tgattaaggacta

SEQ ID NO: 4755725 - DNA, 17 bp, Homo sapiens
tgattaaggactacaga

SEQ ID NO: 4755726 - DNA, 15 bp, Homo sapiens
tgattaattaaaaca

SEQ ID NO: 4755727 - DNA, 13 bp, Homo sapiens
tgattacctgaaa

SEQ ID NO: 4755728 - DNA, 16 bp, Homo sapiens
tgattagacaatgtgg

SEQ ID NO: 4755729 - DNA, 12 bp, Homo sapiens
tgattatgaaat

SEQ ID NO: 4755730 - DNA, 15 bp, Homo sapiens
tgattatgaaatgcc

SEQ ID NO: 4755731 - DNA, 14 bp, Homo sapiens
tgattattacaaca

SEQ ID NO: 4755732 - DNA, 16 bp, Homo sapiens
tgattatttatcacat

SEQ ID NO: 4755733 - DNA, 17 bp, Homo sapiens
tgattatttatcacata

SEQ ID NO: 4755734 - DNA, 13 bp, Homo sapiens
tgattcaaataac

SEQ ID NO: 4755735 - DNA, 20 bp, Homo sapiens
tgattcaacaggttttcctg

SEQ ID NO: 4755736 - DNA, 15 bp, Homo sapiens
tgattcaatgtgaat

SEQ ID NO: 4755737 - DNA, 15 bp, Homo sapiens
tgattcataatgact

SEQ ID NO: 4755738 - DNA, 14 bp, Homo sapiens
tgattctcctctcc

SEQ ID NO: 4755739 - DNA, 21 bp, Homo sapiens
tgattctttcaatccacagta

SEQ ID NO: 4755740 - DNA, 15 bp, Homo sapiens
tgattcttttcccat

SEQ ID NO: 4755741 - DNA, 23 bp, Homo sapiens
tgattgagagcagcctcttgaat

SEQ ID NO: 4755742 - DNA, 21 bp, Homo sapiens
tgattggaaaataataaaaga

SEQ ID NO: 4755743 - DNA, 22 bp, Homo sapiens
tgattggaaaataataaaagaa

SEQ ID NO: 4755744 - DNA, 21 bp, Homo sapiens
tgattggacctggcccagtgc

SEQ ID NO: 4755745 - DNA, 22 bp, Homo sapiens
tgattgtctgaaattttctaga

SEQ ID NO: 4755746 - DNA, 13 bp, Homo sapiens
tgatttaaacttc

SEQ ID NO: 4755747 - DNA, 12 bp, Homo sapiens
tgatttaacatt

SEQ ID NO: 4755748 - DNA, 13 bp, Homo sapiens
tgatttaacatta

SEQ ID NO: 4755749 - DNA, 14 bp, Homo sapiens
tgatttaagcattt

SEQ ID NO: 4755750 - DNA, 15 bp, Homo sapiens
tgatttaagcatttt

SEQ ID NO: 4755751 - DNA, 16 bp, Homo sapiens
tgatttagagatgata

SEQ ID NO: 4755752 - DNA, 15 bp, Homo sapiens
tgatttcaatgattg

SEQ ID NO: 4755753 - DNA, 18 bp, Homo sapiens
tgatttcatgattagaca

SEQ ID NO: 4755754 - DNA, 22 bp, Homo sapiens
tgatttcatgattagacaatgt

SEQ ID NO: 4755755 - DNA, 15 bp, Homo sapiens
tgatttccatccaaa

SEQ ID NO: 4755756 - DNA, 16 bp, Homo sapiens
tgatttctgaactatc

SEQ ID NO: 4755757 - DNA, 16 bp, Homo sapiens
tgatttgatatacaga

SEQ ID NO: 4755758 - DNA, 19 bp, Homo sapiens
tgatttgatatacagacct

SEQ ID NO: 4755759 - DNA, 13 bp, Homo sapiens
tgatttggggtga

SEQ ID NO: 4755760 - DNA, 15 bp, Homo sapiens
tgatttgtaaaacag

SEQ ID NO: 4755761 - DNA, 12 bp, Homo sapiens
tgcaaaaagata

SEQ ID NO: 4755762 - DNA, 14 bp, Homo sapiens
tgcaaacactgtgt

SEQ ID NO: 4755763 - DNA, 15 bp, Homo sapiens
tgcaaacactgtgta

SEQ ID NO: 4755764 - DNA, 17 bp, Homo sapiens
tgcaaagtgttgtctta

SEQ ID NO: 4755765 - DNA, 12 bp, Homo sapiens
tgcaacactgcc

SEQ ID NO: 4755766 - DNA, 19 bp, Homo sapiens
tgcaacactgccaaacatc

SEQ ID NO: 4755767 - DNA, 12 bp, Homo sapiens
tgcaacactgga

SEQ ID NO: 4755768 - DNA, 21 bp, Homo sapiens
tgcaacagactgccttatatt

SEQ ID NO: 4755769 - DNA, 15 bp, Homo sapiens
tgcaacccatgagcg

SEQ ID NO: 4755770 - DNA, 14 bp, Homo sapiens
tgcaacctctgcct

SEQ ID NO: 4755771 - DNA, 17 bp, Homo sapiens
tgcaacttgagggacga

SEQ ID NO: 4755772 - DNA, 13 bp, Homo sapiens
tgcaagaagaata

SEQ ID NO: 4755773 - DNA, 15 bp, Homo sapiens
tgcaagaagaatata

SEQ ID NO: 4755774 - DNA, 17 bp, Homo sapiens
tgcaagctccagtagct

SEQ ID NO: 4755775 - DNA, 20 bp, Homo sapiens
tgcaagctccagtagctccg

SEQ ID NO: 4755776 - DNA, 23 bp, Homo sapiens
tgcaaggacaagcaattagaagc

SEQ ID NO: 4755777 - DNA, 14 bp, Homo sapiens
tgcaaggcccacag

SEQ ID NO: 4755778 - DNA, 23 bp, Homo sapiens
tgcaagtggacgtgggctccagg

SEQ ID NO: 4755779 - DNA, 14 bp, Homo sapiens
tgcaataaaactcc

SEQ ID NO: 4755780 - DNA, 18 bp, Homo sapiens
tgcaataaggatttattc

SEQ ID NO: 4755781 - DNA, 23 bp, Homo sapiens
tgcaataaggatttattctcaga

SEQ ID NO: 4755782 - DNA, 21 bp, Homo sapiens
tgcaatatcttcgttagtaat

SEQ ID NO: 4755783 - DNA, 17 bp, Homo sapiens
tgcaatctgtccagaca

SEQ ID NO: 4755784 - DNA, 23 bp, Homo sapiens
tgcaatgtctgtccctaaacata

SEQ ID NO: 4755785 - DNA, 21 bp, Homo sapiens
tgcaatgttccgttcatctga

SEQ ID NO: 4755786 - DNA, 17 bp, Homo sapiens
tgcaattgtttaagaat

SEQ ID NO: 4755787 - DNA, 23 bp, Homo sapiens
tgcaattgtttaagaatcatgga

SEQ ID NO: 4755788 - DNA, 19 bp, Homo sapiens
tgcacaaacagaggccgcc

SEQ ID NO: 4755789 - DNA, 15 bp, Homo sapiens
tgcagatctagccag

SEQ ID NO: 4755790 - DNA, 16 bp, Homo sapiens
tgcagatctagccagg

SEQ ID NO: 4755791 - DNA, 19 bp, Homo sapiens
tgcagccaaccccatcctc

SEQ ID NO: 4755792 - DNA, 20 bp, Homo sapiens
tgcagcccagaacgggcctc

SEQ ID NO: 4755793 - DNA, 22 bp, Homo sapiens
tgcagcccagaacgggcctccc

SEQ ID NO: 4755794 - DNA, 19 bp, Homo sapiens
tgcagcccgatgtccctgt

SEQ ID NO: 4755795 - DNA, 16 bp, Homo sapiens
tgcagccgccttcctt

SEQ ID NO: 4755796 - DNA, 17 bp, Homo sapiens
tgcagccgccttccttg

SEQ ID NO: 4755797 - DNA, 12 bp, Homo sapiens
tgcagcctgagc

SEQ ID NO: 4755798 - DNA, 13 bp, Homo sapiens
tgcagcctgagct

SEQ ID NO: 4755799 - DNA, 16 bp, Homo sapiens
tgcagcctgagctcca

SEQ ID NO: 4755800 - DNA, 15 bp, Homo sapiens
tgcagcgaggtccac

SEQ ID NO: 4755801 - DNA, 18 bp, Homo sapiens
tgcagctaatttgtgaaa

SEQ ID NO: 4755802 - DNA, 21 bp, Homo sapiens
tgcagctaatttgtgaaagtg

SEQ ID NO: 4755803 - DNA, 19 bp, Homo sapiens
tgcagctattcacacacac

SEQ ID NO: 4755804 - DNA, 17 bp, Homo sapiens
tgcagctttgaggctgg

SEQ ID NO: 4755805 - DNA, 17 bp, Homo sapiens
tgcaggaaaaggctgca

SEQ ID NO: 4755806 - DNA, 12 bp, Homo sapiens
tgcaggaatcaa

SEQ ID NO: 4755807 - DNA, 15 bp, Homo sapiens
tgcaggaatcaaaaa

SEQ ID NO: 4755808 - DNA, 21 bp, Homo sapiens
tgcaggccacccccacctccc

SEQ ID NO: 4755809 - DNA, 18 bp, Homo sapiens
tgcaggcgcgcaccgccc

SEQ ID NO: 4755810 - DNA, 19 bp, Homo sapiens
tgcaggcgcgcaccgccca

SEQ ID NO: 4755811 - DNA, 23 bp, Homo sapiens
tgcaggctaaagtgattccttct

SEQ ID NO: 4755812 - DNA, 14 bp, Homo sapiens
tgcagggacagcct

SEQ ID NO: 4755813 - DNA, 15 bp, Homo sapiens
tgcagggacagttgg

SEQ ID NO: 4755814 - DNA, 17 bp, Homo sapiens
tgcagggacagttgggt

SEQ ID NO: 4755815 - DNA, 20 bp, Homo sapiens
tgcagggacagttgggtgtg

SEQ ID NO: 4755816 - DNA, 13 bp, Homo sapiens
tgcaggttttcta

SEQ ID NO: 4755817 - DNA, 14 bp, Homo sapiens
tgcaggttttctaa

SEQ ID NO: 4755818 - DNA, 13 bp, Homo sapiens
tgcagtagtgcca

SEQ ID NO: 4755819 - DNA, 14 bp, Homo sapiens
tgcagtattctgta

SEQ ID NO: 4755820 - DNA, 14 bp, Homo sapiens
tgcagtcagaagat

SEQ ID NO: 4755821 - DNA, 21 bp, Homo sapiens
tgcagtcagaagatctttctt

SEQ ID NO: 4755822 - DNA, 11 bp, Homo sapiens
tgcagtcagac

SEQ ID NO: 4755823 - DNA, 14 bp, Homo sapiens
tgcagtcagactga

SEQ ID NO: 4755824 - DNA, 15 bp, Homo sapiens
tgcagtcagactgaa

SEQ ID NO: 4755825 - DNA, 18 bp, Homo sapiens
tgcagtcctcggcagctc

SEQ ID NO: 4755826 - DNA, 20 bp, Homo sapiens
tgcagtcctcggcagctccg

SEQ ID NO: 4755827 - DNA, 15 bp, Homo sapiens
tgcagtctgtggagc

SEQ ID NO: 4755828 - DNA, 15 bp, Homo sapiens
tgcagtgtagatttt

SEQ ID NO: 4755829 - DNA, 21 bp, Homo sapiens
tgcagtgtatttaatgtttgt

SEQ ID NO: 4755830 - DNA, 13 bp, Homo sapiens
tgcataagattat

SEQ ID NO: 4755831 - DNA, 20 bp, Homo sapiens
tgcataagattatatacaaa

SEQ ID NO: 4755832 - DNA, 20 bp, Homo sapiens
tgcatacaaatctcactgta

SEQ ID NO: 4755833 - DNA, 13 bp, Homo sapiens
tgcatagacaaag

SEQ ID NO: 4755834 - DNA, 16 bp, Homo sapiens
tgcatatggcaacgtt

SEQ ID NO: 4755835 - DNA, 24 bp, Homo sapiens
tgcatatggcaacgttcatgttca

SEQ ID NO: 4755836 - DNA, 14 bp, Homo sapiens
tgcatcaagatgtg

SEQ ID NO: 4755837 - DNA, 19 bp, Homo sapiens
tgcatcaagatgtgacatg

SEQ ID NO: 4755838 - DNA, 18 bp, Homo sapiens
tgcatcaagtctccacgt

SEQ ID NO: 4755839 - DNA, 23 bp, Homo sapiens
tgcatccctccaccccagtcccc

SEQ ID NO: 4755840 - DNA, 15 bp, Homo sapiens
tgcatcctcagcccc

SEQ ID NO: 4755841 - DNA, 16 bp, Homo sapiens
tgcatcctcagcccca

SEQ ID NO: 4755842 - DNA, 19 bp, Homo sapiens
tgcatctgaaagttttgat

SEQ ID NO: 4755843 - DNA, 14 bp, Homo sapiens
tgcatctggcctat

SEQ ID NO: 4755844 - DNA, 15 bp, Homo sapiens
tgcatctggcctatg

SEQ ID NO: 4755845 - DNA, 21 bp, Homo sapiens
tgcatctggcctatgaccctg

SEQ ID NO: 4755846 - DNA, 13 bp, Homo sapiens
tgcatctggcctg

SEQ ID NO: 4755847 - DNA, 16 bp, Homo sapiens
tgcatgaatccatcga

SEQ ID NO: 4755848 - DNA, 16 bp, Homo sapiens
tgcatgagaactaaat

SEQ ID NO: 4755849 - DNA, 22 bp, Homo sapiens
tgcatgagaactaaatagattt

SEQ ID NO: 4755850 - DNA, 20 bp, Homo sapiens
tgcatgagaatgtcatttgc

SEQ ID NO: 4755851 - DNA, 14 bp, Homo sapiens
tgcatgagctccct

SEQ ID NO: 4755852 - DNA, 17 bp, Homo sapiens
tgcatgattagtgcaat

SEQ ID NO: 4755853 - DNA, 19 bp, Homo sapiens
tgcatgatttttgccctgc

SEQ ID NO: 4755854 - DNA, 20 bp, Homo sapiens
tgcatgatttttgccctgcg

SEQ ID NO: 4755855 - DNA, 13 bp, Homo sapiens
tgcatgctgtccc

SEQ ID NO: 4755856 - DNA, 16 bp, Homo sapiens
tgcatgcttagagcat

SEQ ID NO: 4755857 - DNA, 17 bp, Homo sapiens
tgcatgcttagagcatg

SEQ ID NO: 4755858 - DNA, 12 bp, Homo sapiens
tgcatggcctcc

SEQ ID NO: 4755859 - DNA, 13 bp, Homo sapiens
tgcatggcctccc

SEQ ID NO: 4755860 - DNA, 17 bp, Homo sapiens
tgcatggcctcccagcc

SEQ ID NO: 4755861 - DNA, 20 bp, Homo sapiens
tgcatggcctcccagccacc

SEQ ID NO: 4755862 - DNA, 20 bp, Homo sapiens
tgcatgtagcatataaatgt

SEQ ID NO: 4755863 - DNA, 16 bp, Homo sapiens
tgcatgtatgccatgt

SEQ ID NO: 4755864 - DNA, 15 bp, Homo sapiens
tgcatgtcacatgac

SEQ ID NO: 4755865 - DNA, 15 bp, Homo sapiens
tgcatgtcggggccc

SEQ ID NO: 4755866 - DNA, 11 bp, Homo sapiens
tgcattgtctg

SEQ ID NO: 4755867 - DNA, 16 bp, Homo sapiens
tgcatttatgcatgag

SEQ ID NO: 4755868 - DNA, 18 bp, Homo sapiens
tgcatttgagagaagcca

SEQ ID NO: 4755869 - DNA, 15 bp, Homo sapiens
tgcatttttaccttt

SEQ ID NO: 4755870 - DNA, 18 bp, Homo sapiens
tgccaaaatgtcaatttt

SEQ ID NO: 4755871 - DNA, 16 bp, Homo sapiens
tgccaactttccagac

SEQ ID NO: 4755872 - DNA, 17 bp, Homo sapiens
tgccaactttccagact

SEQ ID NO: 4755873 - DNA, 18 bp, Homo sapiens
tgccaagactctatgctc

SEQ ID NO: 4755874 - DNA, 19 bp, Homo sapiens
tgccaagactctatgctct

SEQ ID NO: 4755875 - DNA, 19 bp, Homo sapiens
tgccaaggcatccccagtg

SEQ ID NO: 4755876 - DNA, 17 bp, Homo sapiens
tgccaaggccagcccac

SEQ ID NO: 4755877 - DNA, 14 bp, Homo sapiens
tgccaattcatctc

SEQ ID NO: 4755878 - DNA, 14 bp, Homo sapiens
tgccacaatcacta

SEQ ID NO: 4755879 - DNA, 14 bp, Homo sapiens
tgccacaatgtgat

SEQ ID NO: 4755880 - DNA, 20 bp, Homo sapiens
tgccacattgcttcattaaa

SEQ ID NO: 4755881 - DNA, 14 bp, Homo sapiens
tgccaccacccacc

SEQ ID NO: 4755882 - DNA, 23 bp, Homo sapiens
tgccacccaccccaagctgctgc

SEQ ID NO: 4755883 - DNA, 15 bp, Homo sapiens
tgccatgatctgtat

SEQ ID NO: 4755884 - DNA, 15 bp, Homo sapiens
tgccatttcatgtcc

SEQ ID NO: 4755885 - DNA, 17 bp, Homo sapiens
tgccatttcctcctggg

SEQ ID NO: 4755886 - DNA, 18 bp, Homo sapiens
tgccattttgtctggctg

SEQ ID NO: 4755887 - DNA, 17 bp, Homo sapiens
tgccattttttgtctgt

SEQ ID NO: 4755888 - DNA, 17 bp, Homo sapiens
tgcccaaagatgcagcc

SEQ ID NO: 4755889 - DNA, 20 bp, Homo sapiens
tgcccaaagatgcagccggt

SEQ ID NO: 4755890 - DNA, 16 bp, Homo sapiens
tgcccaatttcacaga

SEQ ID NO: 4755891 - DNA, 17 bp, Homo sapiens
tgcccaatttcacagag

SEQ ID NO: 4755892 - DNA, 20 bp, Homo sapiens
tgcccaccacaactaacaat

SEQ ID NO: 4755893 - DNA, 11 bp, Homo sapiens
tgcccaccctg

SEQ ID NO: 4755894 - DNA, 14 bp, Homo sapiens
tgcccaccctgggc

SEQ ID NO: 4755895 - DNA, 19 bp, Homo sapiens
tgcccaccctgggcctccc

SEQ ID NO: 4755896 - DNA, 14 bp, Homo sapiens
tgcccacctgccag

SEQ ID NO: 4755897 - DNA, 15 bp, Homo sapiens
tgcccacctgccagg

SEQ ID NO: 4755898 - DNA, 17 bp, Homo sapiens
tgcccacctgccaggct

SEQ ID NO: 4755899 - DNA, 17 bp, Homo sapiens
tgcccacgtcccgggca

SEQ ID NO: 4755900 - DNA, 19 bp, Homo sapiens
tgcccacgtcccgggcact

SEQ ID NO: 4755901 - DNA, 15 bp, Homo sapiens
tgcccactctgaccg

SEQ ID NO: 4755902 - DNA, 18 bp, Homo sapiens
tgcccactctgaccgggc

SEQ ID NO: 4755903 - DNA, 21 bp, Homo sapiens
tgcccagagtatgggcactca

SEQ ID NO: 4755904 - DNA, 13 bp, Homo sapiens
tgcccagcacctc

SEQ ID NO: 4755905 - DNA, 21 bp, Homo sapiens
tgcccagcacctcctccgtgg

SEQ ID NO: 4755906 - DNA, 22 bp, Homo sapiens
tgcccagcacctcctccgtggg

SEQ ID NO: 4755907 - DNA, 15 bp, Homo sapiens
tgcccagcttggagt

SEQ ID NO: 4755908 - DNA, 19 bp, Homo sapiens
tgcccagcttggagtgcca

SEQ ID NO: 4755909 - DNA, 16 bp, Homo sapiens
tgcccagttagcccgg

SEQ ID NO: 4755910 - DNA, 19 bp, Homo sapiens
tgcccatgtgtcccctcac

SEQ ID NO: 4755911 - DNA, 16 bp, Homo sapiens
tgcccatttcacacaa

SEQ ID NO: 4755912 - DNA, 17 bp, Homo sapiens
tgcccatttcacacaac

SEQ ID NO: 4755913 - DNA, 20 bp, Homo sapiens
tgcccatttcacacaactgt

SEQ ID NO: 4755914 - DNA, 19 bp, Homo sapiens
tgccccagagaagcctcag

SEQ ID NO: 4755915 - DNA, 18 bp, Homo sapiens
tgccccaggctcaggctg

SEQ ID NO: 4755916 - DNA, 24 bp, Homo sapiens
tgccccaggctcaggctgcccagc

SEQ ID NO: 4755917 - DNA, 12 bp, Homo sapiens
tgcccccacaga

SEQ ID NO: 4755918 - DNA, 14 bp, Homo sapiens
tgcccccacagatc

SEQ ID NO: 4755919 - DNA, 17 bp, Homo sapiens
tgccccccatgccctcc

SEQ ID NO: 4755920 - DNA, 18 bp, Homo sapiens
tgccccccttcccacccc

SEQ ID NO: 4755921 - DNA, 16 bp, Homo sapiens
tgccccctcccccgca

SEQ ID NO: 4755922 - DNA, 17 bp, Homo sapiens
tgccccctcccccgcag

SEQ ID NO: 4755923 - DNA, 19 bp, Homo sapiens
tgccccctcccccgcagac

SEQ ID NO: 4755924 - DNA, 21 bp, Homo sapiens
tgccccctcccccgcagacag

SEQ ID NO: 4755925 - DNA, 22 bp, Homo sapiens
tgccccctcccccgcagacaga

SEQ ID NO: 4755926 - DNA, 19 bp, Homo sapiens
tgcccctcaactctcctcc

SEQ ID NO: 4755927 - DNA, 23 bp, Homo sapiens
tgcccctcaactctcctccagag

SEQ ID NO: 4755928 - DNA, 20 bp, Homo sapiens
tgcccctccgtccccagggt

SEQ ID NO: 4755929 - DNA, 18 bp, Homo sapiens
tgcccctgcacctgcttc

SEQ ID NO: 4755930 - DNA, 20 bp, Homo sapiens
tgcccctgcacctgcttctc

SEQ ID NO: 4755931 - DNA, 18 bp, Homo sapiens
tgcccctggcagcccctg

SEQ ID NO: 4755932 - DNA, 21 bp, Homo sapiens
tgccccttgaccccacacgcc

SEQ ID NO: 4755933 - DNA, 19 bp, Homo sapiens
tgcccgcacagcagcctgc

SEQ ID NO: 4755934 - DNA, 21 bp, Homo sapiens
tgcccgcgggtggctggagcc

SEQ ID NO: 4755935 - DNA, 24 bp, Homo sapiens
tgcccgcgggtggctggagcccca

SEQ ID NO: 4755936 - DNA, 14 bp, Homo sapiens
tgcccgtgtggcct

SEQ ID NO: 4755937 - DNA, 15 bp, Homo sapiens
tgcccgtgtggcctg

SEQ ID NO: 4755938 - DNA, 21 bp, Homo sapiens
tgcccgtgtggcctgggtcct

SEQ ID NO: 4755939 - DNA, 16 bp, Homo sapiens
tgccctcactccactc

SEQ ID NO: 4755940 - DNA, 12 bp, Homo sapiens
tgccctcggcca

SEQ ID NO: 4755941 - DNA, 15 bp, Homo sapiens
tgccctctcactgac

SEQ ID NO: 4755942 - DNA, 16 bp, Homo sapiens
tgccctctccttcctt

SEQ ID NO: 4755943 - DNA, 12 bp, Homo sapiens
tgccctgcacct

SEQ ID NO: 4755944 - DNA, 18 bp, Homo sapiens
tgccctgcaccttgggca

SEQ ID NO: 4755945 - DNA, 13 bp, Homo sapiens
tgccctgcgtccc

SEQ ID NO: 4755946 - DNA, 14 bp, Homo sapiens
tgccctggcctacc

SEQ ID NO: 4755947 - DNA, 20 bp, Homo sapiens
tgccctggcctaccacagct

SEQ ID NO: 4755948 - DNA, 15 bp, Homo sapiens
tgccctgtagctcct

SEQ ID NO: 4755949 - DNA, 16 bp, Homo sapiens
tgccctgtagctcctt

SEQ ID NO: 4755950 - DNA, 18 bp, Homo sapiens
tgcccttacctgccagga

SEQ ID NO: 4755951 - DNA, 19 bp, Homo sapiens
tgcccttacctgccaggaa

SEQ ID NO: 4755952 - DNA, 17 bp, Homo sapiens
tgccgaaacccttgact

SEQ ID NO: 4755953 - DNA, 14 bp, Homo sapiens
tgccgaggagccag

SEQ ID NO: 4755954 - DNA, 14 bp, Homo sapiens
tgccgcagccctgc

SEQ ID NO: 4755955 - DNA, 20 bp, Homo sapiens
tgccgcagccctgcagaggg

SEQ ID NO: 4755956 - DNA, 13 bp, Homo sapiens
tgccgcctcacct

SEQ ID NO: 4755957 - DNA, 18 bp, Homo sapiens
tgccgctgccgctgcacc

SEQ ID NO: 4755958 - DNA, 19 bp, Homo sapiens
tgccgctgctctcccaggt

SEQ ID NO: 4755959 - DNA, 22 bp, Homo sapiens
tgccggtcccccatgccaccac

SEQ ID NO: 4755960 - DNA, 15 bp, Homo sapiens
tgccggtggggccag

SEQ ID NO: 4755961 - DNA, 17 bp, Homo sapiens
tgcctaagtattccttt

SEQ ID NO: 4755962 - DNA, 19 bp, Homo sapiens
tgcctcatcttccttctca

SEQ ID NO: 4755963 - DNA, 19 bp, Homo sapiens
tgcctcattttgcttccca

SEQ ID NO: 4755964 - DNA, 20 bp, Homo sapiens
tgcctccaagtcatgggaga

SEQ ID NO: 4755965 - DNA, 22 bp, Homo sapiens
tgcctccaggaccttgcttcct

SEQ ID NO: 4755966 - DNA, 20 bp, Homo sapiens
tgcctccggccctgccccac

SEQ ID NO: 4755967 - DNA, 21 bp, Homo sapiens
tgcctccggccctgccccaca

SEQ ID NO: 4755968 - DNA, 18 bp, Homo sapiens
tgcctccgggcctcggcc

SEQ ID NO: 4755969 - DNA, 23 bp, Homo sapiens
tgcctccgggcctcggcctggct

SEQ ID NO: 4755970 - DNA, 19 bp, Homo sapiens
tgcctctcacacacataga

SEQ ID NO: 4755971 - DNA, 16 bp, Homo sapiens
tgcctctctcaggcca

SEQ ID NO: 4755972 - DNA, 23 bp, Homo sapiens
tgcctctctcatggcttgggctg

SEQ ID NO: 4755973 - DNA, 12 bp, Homo sapiens
tgcctctctctc

SEQ ID NO: 4755974 - DNA, 19 bp, Homo sapiens
tgcctctgatatgggactg

SEQ ID NO: 4755975 - DNA, 21 bp, Homo sapiens
tgcctctgatatgggactgag

SEQ ID NO: 4755976 - DNA, 14 bp, Homo sapiens
tgcctctgccttag

SEQ ID NO: 4755977 - DNA, 15 bp, Homo sapiens
tgcctctttaaatta

SEQ ID NO: 4755978 - DNA, 20 bp, Homo sapiens
tgcctctttaaattatgacg

SEQ ID NO: 4755979 - DNA, 16 bp, Homo sapiens
tgcctgccatgtgtga

SEQ ID NO: 4755980 - DNA, 22 bp, Homo sapiens
tgcctgccatgtgtgagtcact

SEQ ID NO: 4755981 - DNA, 18 bp, Homo sapiens
tgcctgcccgcacagcag

SEQ ID NO: 4755982 - DNA, 20 bp, Homo sapiens
tgcctgcctccggccctgcc

SEQ ID NO: 4755983 - DNA, 23 bp, Homo sapiens
tgcctgcctccggccctgcccca

SEQ ID NO: 4755984 - DNA, 15 bp, Homo sapiens
tgcctggacaaaccc

SEQ ID NO: 4755985 - DNA, 22 bp, Homo sapiens
tgcctggaggagaaggaggaac

SEQ ID NO: 4755986 - DNA, 14 bp, Homo sapiens
tgcctggcgggcag

SEQ ID NO: 4755987 - DNA, 16 bp, Homo sapiens
tgcctggcgggcagcc

SEQ ID NO: 4755988 - DNA, 17 bp, Homo sapiens
tgcctggcgggcagccc

SEQ ID NO: 4755989 - DNA, 18 bp, Homo sapiens
tgcctggcgggcagcccc

SEQ ID NO: 4755990 - DNA, 22 bp, Homo sapiens
tgcctggtcaataaaccactgt

SEQ ID NO: 4755991 - DNA, 14 bp, Homo sapiens
tgcctgtggtgagg

SEQ ID NO: 4755992 - DNA, 20 bp, Homo sapiens
tgcctgtggtgaggtcctgt

SEQ ID NO: 4755993 - DNA, 22 bp, Homo sapiens
tgcctgtggtgaggtcctgtcc

SEQ ID NO: 4755994 - DNA, 19 bp, Homo sapiens
tgcctgttaggtctgttga

SEQ ID NO: 4755995 - DNA, 19 bp, Homo sapiens
tgcctgttgatctatggga

SEQ ID NO: 4755996 - DNA, 21 bp, Homo sapiens
tgcctgttgatctatgggaaa

SEQ ID NO: 4755997 - DNA, 20 bp, Homo sapiens
tgcctgttgggccaggagcc

SEQ ID NO: 4755998 - DNA, 21 bp, Homo sapiens
tgccttaattcttacctcatt

SEQ ID NO: 4755999 - DNA, 19 bp, Homo sapiens
tgccttagaggagcccacg

SEQ ID NO: 4756000 - DNA, 12 bp, Homo sapiens
tgccttatatta

SEQ ID NO: 4756001 - DNA, 18 bp, Homo sapiens
tgccttatattattttct

SEQ ID NO: 4756002 - DNA, 24 bp, Homo sapiens
tgccttgggcgggccatttcacat

SEQ ID NO: 4756003 - DNA, 15 bp, Homo sapiens
tgcctttaggcagga

SEQ ID NO: 4756004 - DNA, 13 bp, Homo sapiens
aaaaaaacccagg

SEQ ID NO: 4756005 - DNA, 11 bp, Homo sapiens
aaaaaaacttt

SEQ ID NO: 4756006 - DNA, 13 bp, Homo sapiens
aaaaaaactttta

SEQ ID NO: 4756007 - DNA, 11 bp, Homo sapiens
aaaaaaatatg

SEQ ID NO: 4756008 - DNA, 12 bp, Homo sapiens
aaaaaaatatga

SEQ ID NO: 4756009 - DNA, 14 bp, Homo sapiens
aaaaaaatatgaga

SEQ ID NO: 4756010 - DNA, 13 bp, Homo sapiens
aaaaaaatatgtg

SEQ ID NO: 4756011 - DNA, 11 bp, Homo sapiens
aaaaaaatcaa

SEQ ID NO: 4756012 - DNA, 12 bp, Homo sapiens
aaaaaaatcaaa

SEQ ID NO: 4756013 - DNA, 12 bp, Homo sapiens
aaaaaacagaaa

SEQ ID NO: 4756014 - DNA, 11 bp, Homo sapiens
aaaaaactttt

SEQ ID NO: 4756015 - DNA, 13 bp, Homo sapiens
aaaaaagctgaat

SEQ ID NO: 4756016 - DNA, 14 bp, Homo sapiens
aaaaaatatgtgta

SEQ ID NO: 4756017 - DNA, 13 bp, Homo sapiens
aaaaaatgaatag

SEQ ID NO: 4756018 - DNA, 18 bp, Homo sapiens
aaaaactggaaacatctg

SEQ ID NO: 4756019 - DNA, 15 bp, Homo sapiens
aaaaactttccatga

SEQ ID NO: 4756020 - DNA, 20 bp, Homo sapiens
aaaaactttccatgacagta

SEQ ID NO: 4756021 - DNA, 18 bp, Homo sapiens
aaaaacttttataaatta

SEQ ID NO: 4756022 - DNA, 23 bp, Homo sapiens
aaaaacttttataaattaaatat

SEQ ID NO: 4756023 - DNA, 14 bp, Homo sapiens
aaaaagacttcaaa

SEQ ID NO: 4756024 - DNA, 18 bp, Homo sapiens
aaaaagatattgtattat

SEQ ID NO: 4756025 - DNA, 22 bp, Homo sapiens
aaaaagatggatttgacacact

SEQ ID NO: 4756026 - DNA, 17 bp, Homo sapiens
aaaaagcaactttccaa

SEQ ID NO: 4756027 - DNA, 12 bp, Homo sapiens
aaaaagccctct

SEQ ID NO: 4756028 - DNA, 20 bp, Homo sapiens
aaaaagggaaaacaaatatt

SEQ ID NO: 4756029 - DNA, 14 bp, Homo sapiens
aaaaagtcagatgt

SEQ ID NO: 4756030 - DNA, 16 bp, Homo sapiens
aaaaagtcagatgttt

SEQ ID NO: 4756031 - DNA, 14 bp, Homo sapiens
aaaaatatatgtaa

SEQ ID NO: 4756032 - DNA, 20 bp, Homo sapiens
aaaaatatgtgtacacatat

SEQ ID NO: 4756033 - DNA, 18 bp, Homo sapiens
aaaaatcaaaaaattatc

SEQ ID NO: 4756034 - DNA, 13 bp, Homo sapiens
aaaaatctgaatt

SEQ ID NO: 4756035 - DNA, 13 bp, Homo sapiens
aaaaatgatactt

SEQ ID NO: 4756036 - DNA, 13 bp, Homo sapiens
aaaaatgtatgtt

SEQ ID NO: 4756037 - DNA, 13 bp, Homo sapiens
aaaaatgttcatt

SEQ ID NO: 4756038 - DNA, 23 bp, Homo sapiens
aaaaattaattctttatcacatg

SEQ ID NO: 4756039 - DNA, 13 bp, Homo sapiens
aaaaatttgacat

SEQ ID NO: 4756040 - DNA, 14 bp, Homo sapiens
aaaacaaaatcctt

SEQ ID NO: 4756041 - DNA, 23 bp, Homo sapiens
aaaacaagagaccacttccttaa

SEQ ID NO: 4756042 - DNA, 21 bp, Homo sapiens
aaaacaccaccaaatgacaag

SEQ ID NO: 4756043 - DNA, 14 bp, Homo sapiens
aaaacataatatct

SEQ ID NO: 4756044 - DNA, 12 bp, Homo sapiens
aaaacattctat

SEQ ID NO: 4756045 - DNA, 15 bp, Homo sapiens
aaaaccagaaagagg

SEQ ID NO: 4756046 - DNA, 12 bp, Homo sapiens
aaggaaaccttt

SEQ ID NO: 4756047 - DNA, 18 bp, Homo sapiens
aaggaaaccttttcttgt

SEQ ID NO: 4756048 - DNA, 15 bp, Homo sapiens
aaggacagctcagaa

SEQ ID NO: 4756049 - DNA, 15 bp, Homo sapiens
aaggacagtgttcaa

SEQ ID NO: 4756050 - DNA, 14 bp, Homo sapiens
aaggactacagaat

SEQ ID NO: 4756051 - DNA, 16 bp, Homo sapiens
aaatttttttccagaa

SEQ ID NO: 4756052 - DNA, 23 bp, Homo sapiens
aacaaaatataaatcacagattt

SEQ ID NO: 4756053 - DNA, 21 bp, Homo sapiens
aacaaaatccttgccttcaaa

SEQ ID NO: 4756054 - DNA, 16 bp, Homo sapiens
aacaaacaacctgcca

SEQ ID NO: 4756055 - DNA, 19 bp, Homo sapiens
aacaaacgtaatttgttat

SEQ ID NO: 4756056 - DNA, 12 bp, Homo sapiens
aacaaagaaata

SEQ ID NO: 4756057 - DNA, 23 bp, Homo sapiens
aagaaggcacaggtgtaaatata

SEQ ID NO: 4756058 - DNA, 16 bp, Homo sapiens
aaatacattattgaaa

SEQ ID NO: 4756059 - DNA, 13 bp, Homo sapiens
aaatacattccag

SEQ ID NO: 4756060 - DNA, 17 bp, Homo sapiens
aaatactattggacaga

SEQ ID NO: 4756061 - DNA, 16 bp, Homo sapiens
aaatactcagcaactg

SEQ ID NO: 4756062 - DNA, 19 bp, Homo sapiens
aaatacttaactactgttt

SEQ ID NO: 4756063 - DNA, 21 bp, Homo sapiens
aaatacttgaaaacttctcat

SEQ ID NO: 4756064 - DNA, 16 bp, Homo sapiens
aaatagatttttagat

SEQ ID NO: 4756065 - DNA, 18 bp, Homo sapiens
aaatagctataaatagtg

SEQ ID NO: 4756066 - DNA, 20 bp, Homo sapiens
aaatagctataaatagtgaa

SEQ ID NO: 4756067 - DNA, 13 bp, Homo sapiens
aaatagtcatgtt

SEQ ID NO: 4756068 - DNA, 13 bp, Homo sapiens
aaaactttatttt

SEQ ID NO: 4756069 - DNA, 17 bp, Homo sapiens
aaaactttattttatat

SEQ ID NO: 4756070 - DNA, 18 bp, Homo sapiens
aaaactttattttatata

SEQ ID NO: 4756071 - DNA, 22 bp, Homo sapiens
aaaactttccatgacagtagca

SEQ ID NO: 4756072 - DNA, 23 bp, Homo sapiens
aaaactttccatgacagtagcat

SEQ ID NO: 4756073 - DNA, 13 bp, Homo sapiens
aaaacttttataa

SEQ ID NO: 4756074 - DNA, 21 bp, Homo sapiens
aaaacttttataaattaaata

SEQ ID NO: 4756075 - DNA, 18 bp, Homo sapiens
aaaagacacttttaccga

SEQ ID NO: 4756076 - DNA, 16 bp, Homo sapiens
aaaagaccatgcattc

SEQ ID NO: 4756077 - DNA, 19 bp, Homo sapiens
aaaagatattgtattatca

SEQ ID NO: 4756078 - DNA, 22 bp, Homo sapiens
aaaagatattgtattatcatat

SEQ ID NO: 4756079 - DNA, 22 bp, Homo sapiens
aaaagatccatttaaaacaagc

SEQ ID NO: 4756080 - DNA, 12 bp, Homo sapiens
aaaagcaacttt

SEQ ID NO: 4756081 - DNA, 11 bp, Homo sapiens
aaaagccagat

SEQ ID NO: 4756082 - DNA, 19 bp, Homo sapiens
aaaaggctggatgtgcttt

SEQ ID NO: 4756083 - DNA, 17 bp, Homo sapiens
aaaagggaaaaaagcaa

SEQ ID NO: 4756084 - DNA, 17 bp, Homo sapiens
aaaagtaattaaaaaga

SEQ ID NO: 4756085 - DNA, 22 bp, Homo sapiens
aaaagtatattcaaaaattata

SEQ ID NO: 4756086 - DNA, 17 bp, Homo sapiens
aaaagtgatgtgattta

SEQ ID NO: 4756087 - DNA, 17 bp, Homo sapiens
aaaagtgtttttacata

SEQ ID NO: 4756088 - DNA, 20 bp, Homo sapiens
aaaagtgtttttacatatag

SEQ ID NO: 4756089 - DNA, 16 bp, Homo sapiens
aaaagttgcacattag

SEQ ID NO: 4756090 - DNA, 17 bp, Homo sapiens
aaaataaaaacataaaa

SEQ ID NO: 4756091 - DNA, 19 bp, Homo sapiens
aaaataaaaccagaaagag

SEQ ID NO: 4756092 - DNA, 17 bp, Homo sapiens
aaaataataaaagaatc

SEQ ID NO: 4756093 - DNA, 12 bp, Homo sapiens
aaaatacagtat

SEQ ID NO: 4756094 - DNA, 15 bp, Homo sapiens
aaaatactattggac

SEQ ID NO: 4756095 - DNA, 20 bp, Homo sapiens
aaaatactattggacagaca

SEQ ID NO: 4756096 - DNA, 22 bp, Homo sapiens
aaaatactattggacagacaca

SEQ ID NO: 4756097 - DNA, 16 bp, Homo sapiens
aaaatagctataaata

SEQ ID NO: 4756098 - DNA, 17 bp, Homo sapiens
aaaatatacaaacatgt

SEQ ID NO: 4756099 - DNA, 15 bp, Homo sapiens
aaaatatatgtaata

SEQ ID NO: 4756100 - DNA, 17 bp, Homo sapiens
aaaatatatgtaatata

SEQ ID NO: 4756101 - DNA, 16 bp, Homo sapiens
aaaatatatgtttggc

SEQ ID NO: 4756102 - DNA, 19 bp, Homo sapiens
aaaatatgagattggaaaa

SEQ ID NO: 4756103 - DNA, 11 bp, Homo sapiens
aaaatattctg

SEQ ID NO: 4756104 - DNA, 18 bp, Homo sapiens
aaaatcaaatttttctgg

SEQ ID NO: 4756105 - DNA, 17 bp, Homo sapiens
aaaatcatatttacctg

SEQ ID NO: 4756106 - DNA, 21 bp, Homo sapiens
aaaatccctcttcctccaaag

SEQ ID NO: 4756107 - DNA, 18 bp, Homo sapiens
aaaatctagaagagtcta

SEQ ID NO: 4756108 - DNA, 17 bp, Homo sapiens
aaaatgaaatttaagca

SEQ ID NO: 4756109 - DNA, 16 bp, Homo sapiens
aaaatgcatacgtatt

SEQ ID NO: 4756110 - DNA, 14 bp, Homo sapiens
aaaatgctttctca

SEQ ID NO: 4756111 - DNA, 22 bp, Homo sapiens
aaaatgctttctcatgcataga

SEQ ID NO: 4756112 - DNA, 20 bp, Homo sapiens
aaaatggaagacagctctta

SEQ ID NO: 4756113 - DNA, 16 bp, Homo sapiens
aaaatggctgaagaaa

SEQ ID NO: 4756114 - DNA, 20 bp, Homo sapiens
aaaatggtgttttcatgtaa

SEQ ID NO: 4756115 - DNA, 24 bp, Homo sapiens
aaaatgtaaaaaccctgctaaatg

SEQ ID NO: 4756116 - DNA, 18 bp, Homo sapiens
aaaatgtgccgtctttgg

SEQ ID NO: 4756117 - DNA, 18 bp, Homo sapiens
aaaatgtgtgcttggaaa

SEQ ID NO: 4756118 - DNA, 14 bp, Homo sapiens
aaaatgttctgaca

SEQ ID NO: 4756119 - DNA, 13 bp, Homo sapiens
aaaatgtttattt

SEQ ID NO: 4756120 - DNA, 23 bp, Homo sapiens
aaaattaattctttatcacatgt

SEQ ID NO: 4756121 - DNA, 16 bp, Homo sapiens
aaaattaattgaaata

SEQ ID NO: 4756122 - DNA, 17 bp, Homo sapiens
aaaattatctgttctat

SEQ ID NO: 4756123 - DNA, 18 bp, Homo sapiens
aaaattatctgttctatg

SEQ ID NO: 4756124 - DNA, 19 bp, Homo sapiens
aaaattatctgttctatgg

SEQ ID NO: 4756125 - DNA, 16 bp, Homo sapiens
aaaattcattccattt

SEQ ID NO: 4756126 - DNA, 22 bp, Homo sapiens
aaaattgagttcttcctgtaat

SEQ ID NO: 4756127 - DNA, 23 bp, Homo sapiens
aaaattgagttcttcctgtaatc

SEQ ID NO: 4756128 - DNA, 15 bp, Homo sapiens
aaaattgcattttta

SEQ ID NO: 4756129 - DNA, 22 bp, Homo sapiens
aaaattgcatttttacctttca

SEQ ID NO: 4756130 - DNA, 23 bp, Homo sapiens
aaaatttatgtcattttcagatc

SEQ ID NO: 4756131 - DNA, 14 bp, Homo sapiens
aaaatttgacattg

SEQ ID NO: 4756132 - DNA, 24 bp, Homo sapiens
aaaatttgacattgtcagaatgtt

SEQ ID NO: 4756133 - DNA, 16 bp, Homo sapiens
aaaattttcttcttta

SEQ ID NO: 4756134 - DNA, 22 bp, Homo sapiens
aaacaacctgccacaatgtgat

SEQ ID NO: 4756135 - DNA, 17 bp, Homo sapiens
aaacaagagaccacttc

SEQ ID NO: 4756136 - DNA, 18 bp, Homo sapiens
aaacaaggaaggacattt

SEQ ID NO: 4756137 - DNA, 16 bp, Homo sapiens
aaacacacagactctg

SEQ ID NO: 4756138 - DNA, 21 bp, Homo sapiens
aaacacacagtgaccaaggga

SEQ ID NO: 4756139 - DNA, 22 bp, Homo sapiens
aaacacggagtttccatttgga

SEQ ID NO: 4756140 - DNA, 20 bp, Homo sapiens
aaacactcgtgtgcatgaga

SEQ ID NO: 4756141 - DNA, 22 bp, Homo sapiens
aaacactgcttaaggaaaagag

SEQ ID NO: 4756142 - DNA, 15 bp, Homo sapiens
aaacacttctcctta

SEQ ID NO: 4756143 - DNA, 16 bp, Homo sapiens
aaacacttctccttaa

SEQ ID NO: 4756144 - DNA, 21 bp, Homo sapiens
aaacactttggccacagcccc

SEQ ID NO: 4756145 - DNA, 16 bp, Homo sapiens
aaacaggaaaaaaact

SEQ ID NO: 4756146 - DNA, 20 bp, Homo sapiens
aaacagtgtggatgtaaatt

SEQ ID NO: 4756147 - DNA, 24 bp, Homo sapiens
aaacataaaatatacaaacatgtg

SEQ ID NO: 4756148 - DNA, 14 bp, Homo sapiens
aaacataatatctt

SEQ ID NO: 4756149 - DNA, 14 bp, Homo sapiens
aaacatagtggtat

SEQ ID NO: 4756150 - DNA, 20 bp, Homo sapiens
aaacatagtggtattttaac

SEQ ID NO: 4756151 - DNA, 22 bp, Homo sapiens
aaacatagtggtattttaacat

SEQ ID NO: 4756152 - DNA, 21 bp, Homo sapiens
aaacatcagtcaattgcttga

SEQ ID NO: 4756153 - DNA, 15 bp, Homo sapiens
aaacatctcatcatg

SEQ ID NO: 4756154 - DNA, 15 bp, Homo sapiens
aaacatgacactgac

SEQ ID NO: 4756155 - DNA, 15 bp, Homo sapiens
aaacatgtgaaagat

SEQ ID NO: 4756156 - DNA, 22 bp, Homo sapiens
aaacatgtggcaacctgttctt

SEQ ID NO: 4756157 - DNA, 13 bp, Homo sapiens
aaacatttatctt

SEQ ID NO: 4756158 - DNA, 17 bp, Homo sapiens
aaaccaatttgttctgt

SEQ ID NO: 4756159 - DNA, 22 bp, Homo sapiens
aaaccacaactgacacaggaaa

SEQ ID NO: 4756160 - DNA, 16 bp, Homo sapiens
aaaccaggctgcaggt

SEQ ID NO: 4756161 - DNA, 17 bp, Homo sapiens
aaaccataaaataaata

SEQ ID NO: 4756162 - DNA, 17 bp, Homo sapiens
aaaccatgaaaagtttt

SEQ ID NO: 4756163 - DNA, 19 bp, Homo sapiens
aaaccatgaaaagttttca

SEQ ID NO: 4756164 - DNA, 20 bp, Homo sapiens
aaaccatgaaaagttttcaa

SEQ ID NO: 4756165 - DNA, 13 bp, Homo sapiens
aaaccattgcttc

SEQ ID NO: 4756166 - DNA, 14 bp, Homo sapiens
aaaccattgcttca

SEQ ID NO: 4756167 - DNA, 17 bp, Homo sapiens
aaacccaaataaatgtg

SEQ ID NO: 4756168 - DNA, 14 bp, Homo sapiens
aaacccacataaac

SEQ ID NO: 4756169 - DNA, 13 bp, Homo sapiens
aaaccctgctaaa

SEQ ID NO: 4756170 - DNA, 19 bp, Homo sapiens
aaaccctgctaaatgactt

SEQ ID NO: 4756171 - DNA, 12 bp, Homo sapiens
aaaccctgcttc

SEQ ID NO: 4756172 - DNA, 14 bp, Homo sapiens
aaaccctgcttctg

SEQ ID NO: 4756173 - DNA, 20 bp, Homo sapiens
aaaccctgcttctgctgccc

SEQ ID NO: 4756174 - DNA, 14 bp, Homo sapiens
aaacccttcagtgc

SEQ ID NO: 4756175 - DNA, 14 bp, Homo sapiens
aaacccttgactgt

SEQ ID NO: 4756176 - DNA, 23 bp, Homo sapiens
acgatttctccattaaacttcta

SEQ ID NO: 4756177 - DNA, 19 bp, Homo sapiens
acgcaagaggtttcagcat

SEQ ID NO: 4756178 - DNA, 16 bp, Homo sapiens
acgcacaacatgcaca

SEQ ID NO: 4756179 - DNA, 17 bp, Homo sapiens
acgcagagccccggagc

SEQ ID NO: 4756180 - DNA, 21 bp, Homo sapiens
acgcagagccccggagcacca

SEQ ID NO: 4756181 - DNA, 23 bp, Homo sapiens
acgcagccccccacgcttctgga

SEQ ID NO: 4756182 - DNA, 11 bp, Homo sapiens
acgcccagccc

SEQ ID NO: 4756183 - DNA, 12 bp, Homo sapiens
acgcccagcccc

SEQ ID NO: 4756184 - DNA, 13 bp, Homo sapiens
acgcccagccccc

SEQ ID NO: 4756185 - DNA, 15 bp, Homo sapiens
acgcccagcccccac

SEQ ID NO: 4756186 - DNA, 17 bp, Homo sapiens
acgccgatataagccat

SEQ ID NO: 4756187 - DNA, 19 bp, Homo sapiens
acgccgatataagccatag

SEQ ID NO: 4756188 - DNA, 15 bp, Homo sapiens
acgccggggctggcc

SEQ ID NO: 4756189 - DNA, 18 bp, Homo sapiens
acgccggggctggccctg

SEQ ID NO: 4756190 - DNA, 14 bp, Homo sapiens
acgcctcctggcca

SEQ ID NO: 4756191 - DNA, 23 bp, Homo sapiens
acgcggctgctgcttctccctgg

SEQ ID NO: 4756192 - DNA, 12 bp, Homo sapiens
acgctctctgtc

SEQ ID NO: 4756193 - DNA, 15 bp, Homo sapiens
acgctctctgtctgg

SEQ ID NO: 4756194 - DNA, 20 bp, Homo sapiens
acgctctctgtctggctgta

SEQ ID NO: 4756195 - DNA, 14 bp, Homo sapiens
acgctgaatgagaa

SEQ ID NO: 4756196 - DNA, 22 bp, Homo sapiens
acgctgccgctgccgctgcacc

SEQ ID NO: 4756197 - DNA, 23 bp, Homo sapiens
acgctgccgctgccgctgcacca

SEQ ID NO: 4756198 - DNA, 15 bp, Homo sapiens
acgctggagaccctg

SEQ ID NO: 4756199 - DNA, 18 bp, Homo sapiens
acgctggagaccctgcgc

SEQ ID NO: 4756200 - DNA, 20 bp, Homo sapiens
acgcttaacctttccgctgt

SEQ ID NO: 4756201 - DNA, 19 bp, Homo sapiens
acgcttctggaggtgggga

SEQ ID NO: 4756202 - DNA, 19 bp, Homo sapiens
acgctttcatgaccactgg

SEQ ID NO: 4756203 - DNA, 17 bp, Homo sapiens
acggaagtggcctgaga

SEQ ID NO: 4756204 - DNA, 18 bp, Homo sapiens
acggacgggacagcggcc

SEQ ID NO: 4756205 - DNA, 21 bp, Homo sapiens
acggacgggacagcggcccgg

SEQ ID NO: 4756206 - DNA, 18 bp, Homo sapiens
acggaggcaggaccaggc

SEQ ID NO: 4756207 - DNA, 10 bp, Homo sapiens
acggaggctc

SEQ ID NO: 4756208 - DNA, 18 bp, Homo sapiens
acggagtttccatttgga

SEQ ID NO: 4756209 - DNA, 11 bp, Homo sapiens
acggcagcccc

SEQ ID NO: 4756210 - DNA, 14 bp, Homo sapiens
acggcagccccatc

SEQ ID NO: 4756211 - DNA, 11 bp, Homo sapiens
acggccctgca

SEQ ID NO: 4756212 - DNA, 14 bp, Homo sapiens
acggccgtccctga

SEQ ID NO: 4756213 - DNA, 13 bp, Homo sapiens
acggcgttttttt

SEQ ID NO: 4756214 - DNA, 15 bp, Homo sapiens
acggctaagaggctg

SEQ ID NO: 4756215 - DNA, 22 bp, Homo sapiens
acggcttccccatcgccttctg

SEQ ID NO: 4756216 - DNA, 14 bp, Homo sapiens
acgggacagcggcc

SEQ ID NO: 4756217 - DNA, 12 bp, Homo sapiens
acgggcctcccc

SEQ ID NO: 4756218 - DNA, 23 bp, Homo sapiens
acgggcggggctgtgcgggcgcc

SEQ ID NO: 4756219 - DNA, 13 bp, Homo sapiens
acggggcagagct

SEQ ID NO: 4756220 - DNA, 18 bp, Homo sapiens
acggggcccgccccaggc

SEQ ID NO: 4756221 - DNA, 16 bp, Homo sapiens
acgggggctgcttctc

SEQ ID NO: 4756222 - DNA, 17 bp, Homo sapiens
acgggggctgcttctcc

SEQ ID NO: 4756223 - DNA, 21 bp, Homo sapiens
acggggtcgggggaggagcac

SEQ ID NO: 4756224 - DNA, 22 bp, Homo sapiens
acgggtctgtgggactggccca

SEQ ID NO: 4756225 - DNA, 18 bp, Homo sapiens
acggtccaatccagcctt

SEQ ID NO: 4756226 - DNA, 19 bp, Homo sapiens
acgtaatttgttatatcag

SEQ ID NO: 4756227 - DNA, 23 bp, Homo sapiens
acgtaatttgttatatcagcaga

SEQ ID NO: 4756228 - DNA, 17 bp, Homo sapiens
acgtctagctatgctgt

SEQ ID NO: 4756229 - DNA, 19 bp, Homo sapiens
acgtctagctatgctgtat

SEQ ID NO: 4756230 - DNA, 18 bp, Homo sapiens
acgtctggtgttctcaat

SEQ ID NO: 4756231 - DNA, 17 bp, Homo sapiens
acgtgaagataccataa

SEQ ID NO: 4756232 - DNA, 11 bp, Homo sapiens
acgtgaccctg

SEQ ID NO: 4756233 - DNA, 14 bp, Homo sapiens
acgtgaccctgtgc

SEQ ID NO: 4756234 - DNA, 23 bp, Homo sapiens
acgtgaccctgtgccccgcctcc

SEQ ID NO: 4756235 - DNA, 19 bp, Homo sapiens
acgtgaggtttcagtagct

SEQ ID NO: 4756236 - DNA, 16 bp, Homo sapiens
acgtgcaacagactgc

SEQ ID NO: 4756237 - DNA, 20 bp, Homo sapiens
acgtgcaacagactgcctta

SEQ ID NO: 4756238 - DNA, 19 bp, Homo sapiens
acgtgcacaaaccttcttt

SEQ ID NO: 4756239 - DNA, 18 bp, Homo sapiens
acgtgctcttctgttctc

SEQ ID NO: 4756240 - DNA, 17 bp, Homo sapiens
acgtggccgctgcccac

SEQ ID NO: 4756241 - DNA, 21 bp, Homo sapiens
acgtgggagttcagctgcttc

SEQ ID NO: 4756242 - DNA, 15 bp, Homo sapiens
acgtggggtggaatt

SEQ ID NO: 4756243 - DNA, 21 bp, Homo sapiens
acgtgttattattattatatt

SEQ ID NO: 4756244 - DNA, 14 bp, Homo sapiens
acgttaattaaaca

SEQ ID NO: 4756245 - DNA, 23 bp, Homo sapiens
actaaacttggtgcttattgata

SEQ ID NO: 4756246 - DNA, 17 bp, Homo sapiens
actaaatagatttttag

SEQ ID NO: 4756247 - DNA, 14 bp, Homo sapiens
actaaatatctagt

SEQ ID NO: 4756248 - DNA, 14 bp, Homo sapiens
actaacaatgcctt

SEQ ID NO: 4756249 - DNA, 15 bp, Homo sapiens
actaacagtaactgc

SEQ ID NO: 4756250 - DNA, 14 bp, Homo sapiens
actaaccaccattt

SEQ ID NO: 4756251 - DNA, 21 bp, Homo sapiens
actaaccccaacgcacaggaa

SEQ ID NO: 4756252 - DNA, 13 bp, Homo sapiens
actaactgccatg

SEQ ID NO: 4756253 - DNA, 15 bp, Homo sapiens
actaactgccatgta

SEQ ID NO: 4756254 - DNA, 13 bp, Homo sapiens
actaacttatttt

SEQ ID NO: 4756255 - DNA, 22 bp, Homo sapiens
actaaggtacggtgagactctg

SEQ ID NO: 4756256 - DNA, 15 bp, Homo sapiens
actaataaaatacat

SEQ ID NO: 4756257 - DNA, 13 bp, Homo sapiens
actaataggtctg

SEQ ID NO: 4756258 - DNA, 15 bp, Homo sapiens
actaatcaatacttt

SEQ ID NO: 4756259 - DNA, 22 bp, Homo sapiens
accataaaataaataatctcat

SEQ ID NO: 4756260 - DNA, 15 bp, Homo sapiens
accatagcttaagaa

SEQ ID NO: 4756261 - DNA, 23 bp, Homo sapiens
accatcaaacaaatcattttgat

SEQ ID NO: 4756262 - DNA, 17 bp, Homo sapiens
accatccatccctggtg

SEQ ID NO: 4756263 - DNA, 23 bp, Homo sapiens
accatctggcctggcctggccct

SEQ ID NO: 4756264 - DNA, 18 bp, Homo sapiens
accatgaaaagttttcaa

SEQ ID NO: 4756265 - DNA, 18 bp, Homo sapiens
accatgcattttaccatc

SEQ ID NO: 4756266 - DNA, 22 bp, Homo sapiens
accatgctcaatgaaaaggtga

SEQ ID NO: 4756267 - DNA, 23 bp, Homo sapiens
accatgttggccaggcttgtctc

SEQ ID NO: 4756268 - DNA, 15 bp, Homo sapiens
accattatggctttg

SEQ ID NO: 4756269 - DNA, 16 bp, Homo sapiens
accattgcttcactac

SEQ ID NO: 4756270 - DNA, 21 bp, Homo sapiens
accattgcttcactacccatc

SEQ ID NO: 4756271 - DNA, 14 bp, Homo sapiens
accatttaatcatt

SEQ ID NO: 4756272 - DNA, 20 bp, Homo sapiens
accatttcccctgtggtttg

SEQ ID NO: 4756273 - DNA, 22 bp, Homo sapiens
accattttgctgtcccttttcc

SEQ ID NO: 4756274 - DNA, 14 bp, Homo sapiens
acccaaagcatgga

SEQ ID NO: 4756275 - DNA, 17 bp, Homo sapiens
acccaaagcatggacta

SEQ ID NO: 4756276 - DNA, 13 bp, Homo sapiens
acccaaataaatg

SEQ ID NO: 4756277 - DNA, 20 bp, Homo sapiens
acccacaccccgtctgcccc

SEQ ID NO: 4756278 - DNA, 21 bp, Homo sapiens
acccacaccccgtctgcccct

SEQ ID NO: 4756279 - DNA, 15 bp, Homo sapiens
acccaccactctcag

SEQ ID NO: 4756280 - DNA, 16 bp, Homo sapiens
acccaccactctcagg

SEQ ID NO: 4756281 - DNA, 13 bp, Homo sapiens
acccacccctgcc

SEQ ID NO: 4756282 - DNA, 17 bp, Homo sapiens
acccacccctgcccagg

SEQ ID NO: 4756283 - DNA, 14 bp, Homo sapiens
acccacctcacccc

SEQ ID NO: 4756284 - DNA, 17 bp, Homo sapiens
acccactaagtaacctc

SEQ ID NO: 4756285 - DNA, 19 bp, Homo sapiens
acccactagccctctttct

SEQ ID NO: 4756286 - DNA, 20 bp, Homo sapiens
acccactagccctctttctc

SEQ ID NO: 4756287 - DNA, 24 bp, Homo sapiens
acccactagccctctttctctctg

SEQ ID NO: 4756288 - DNA, 21 bp, Homo sapiens
acccagacgtggtgcttctca

SEQ ID NO: 4756289 - DNA, 17 bp, Homo sapiens
aggctgcagtgagccaa

SEQ ID NO: 4756290 - DNA, 18 bp, Homo sapiens
aggctgcccagcggctct

SEQ ID NO: 4756291 - DNA, 16 bp, Homo sapiens
aggctgccgctgctct

SEQ ID NO: 4756292 - DNA, 20 bp, Homo sapiens
aggctgccgctgctctccca

SEQ ID NO: 4756293 - DNA, 23 bp, Homo sapiens
aggctgccgctgctctcccaggt

SEQ ID NO: 4756294 - DNA, 16 bp, Homo sapiens
aggctgctaagtggaa

SEQ ID NO: 4756295 - DNA, 19 bp, Homo sapiens
aggctgctaagtggaagac

SEQ ID NO: 4756296 - DNA, 20 bp, Homo sapiens
aggctgctaagtggaagaca

SEQ ID NO: 4756297 - DNA, 22 bp, Homo sapiens
aggctgctaagtggaagacaga

SEQ ID NO: 4756298 - DNA, 14 bp, Homo sapiens
aggctggaccaact

SEQ ID NO: 4756299 - DNA, 16 bp, Homo sapiens
aggctggaccaactgc

SEQ ID NO: 4756300 - DNA, 18 bp, Homo sapiens
aggctggggacacaggat

SEQ ID NO: 4756301 - DNA, 21 bp, Homo sapiens
aggctggggacacaggatcct

SEQ ID NO: 4756302 - DNA, 23 bp, Homo sapiens
aggctggggacacaggatcctgg

SEQ ID NO: 4756303 - DNA, 21 bp, Homo sapiens
aggctgttctgcactgaaaag

SEQ ID NO: 4756304 - DNA, 14 bp, Homo sapiens
aggcttccagctca

SEQ ID NO: 4756305 - DNA, 18 bp, Homo sapiens
aggcttctatgtccaaca

SEQ ID NO: 4756306 - DNA, 23 bp, Homo sapiens
aggcttgtgtaatttcctgctcc

SEQ ID NO: 4756307 - DNA, 23 bp, Homo sapiens
aggctttctattggcatggattt

SEQ ID NO: 4756308 - DNA, 19 bp, Homo sapiens
agggaaacccggggaactg

SEQ ID NO: 4756309 - DNA, 21 bp, Homo sapiens
agggaaacccggggaactggt

SEQ ID NO: 4756310 - DNA, 12 bp, Homo sapiens
agggaaaccttt

SEQ ID NO: 4756311 - DNA, 15 bp, Homo sapiens
agggaaatcaattta

SEQ ID NO: 4756312 - DNA, 19 bp, Homo sapiens
agggaaatgctgttggtga

SEQ ID NO: 4756313 - DNA, 17 bp, Homo sapiens
agggaaattcacactgt

SEQ ID NO: 4756314 - DNA, 18 bp, Homo sapiens
agggaacagacctcggct

SEQ ID NO: 4756315 - DNA, 13 bp, Homo sapiens
agggaaccagagc

SEQ ID NO: 4756316 - DNA, 14 bp, Homo sapiens
agggaagcccaccc

SEQ ID NO: 4756317 - DNA, 19 bp, Homo sapiens
agggaagcccacccgcccc

SEQ ID NO: 4756318 - DNA, 13 bp, Homo sapiens
agggaccaaggag

SEQ ID NO: 4756319 - DNA, 14 bp, Homo sapiens
agggaccaaggaga

SEQ ID NO: 4756320 - DNA, 13 bp, Homo sapiens
agggaccccagat

SEQ ID NO: 4756321 - DNA, 22 bp, Homo sapiens
agggacgagcagagcgcagccc

SEQ ID NO: 4756322 - DNA, 22 bp, Homo sapiens
agggacggggcccgccccaggc

SEQ ID NO: 4756323 - DNA, 13 bp, Homo sapiens
agggactccaagc

SEQ ID NO: 4756324 - DNA, 17 bp, Homo sapiens
agggactccaagccctg

SEQ ID NO: 4756325 - DNA, 20 bp, Homo sapiens
agggactgcagctgcaccag

SEQ ID NO: 4756326 - DNA, 15 bp, Homo sapiens
agggactgcctctgc

SEQ ID NO: 4756327 - DNA, 12 bp, Homo sapiens
agggagaaggat

SEQ ID NO: 4756328 - DNA, 14 bp, Homo sapiens
aggtcaggccctgg

SEQ ID NO: 4756329 - DNA, 15 bp, Homo sapiens
aggtcaggccctgga

SEQ ID NO: 4756330 - DNA, 20 bp, Homo sapiens
aggtcccctggcccttcctt

SEQ ID NO: 4756331 - DNA, 21 bp, Homo sapiens
aggtcccctggcccttccttc

SEQ ID NO: 4756332 - DNA, 23 bp, Homo sapiens
aggtcctgcccatgtgtcccctc

SEQ ID NO: 4756333 - DNA, 13 bp, Homo sapiens
aggtcctgtcctg

SEQ ID NO: 4756334 - DNA, 15 bp, Homo sapiens
aggtcctgtcctggc

SEQ ID NO: 4756335 - DNA, 23 bp, Homo sapiens
aggtcctgtcctggctcccaggg

SEQ ID NO: 4756336 - DNA, 23 bp, Homo sapiens
aggtctcatttgatattgtgtag

SEQ ID NO: 4756337 - DNA, 16 bp, Homo sapiens
aggtctccacccctca

SEQ ID NO: 4756338 - DNA, 19 bp, Homo sapiens
aggtctccacccctcaagc

SEQ ID NO: 4756339 - DNA, 22 bp, Homo sapiens
aggtctgcacacataacacaca

SEQ ID NO: 4756340 - DNA, 17 bp, Homo sapiens
aggtctggattttcaaa

SEQ ID NO: 4756341 - DNA, 20 bp, Homo sapiens
aggtctgttgaagtgcatgt

SEQ ID NO: 4756342 - DNA, 19 bp, Homo sapiens
aggtgaacaccactttgtc

SEQ ID NO: 4756343 - DNA, 17 bp, Homo sapiens
aggtgaccagaatgagg

SEQ ID NO: 4756344 - DNA, 17 bp, Homo sapiens
aggtgatgggggcatgg

SEQ ID NO: 4756345 - DNA, 20 bp, Homo sapiens
aggtgcccagtcttgagtgg

SEQ ID NO: 4756346 - DNA, 21 bp, Homo sapiens
aggtgcccagtcttgagtggg

SEQ ID NO: 4756347 - DNA, 18 bp, Homo sapiens
aggtgcggaccggagcgg

SEQ ID NO: 4756348 - DNA, 21 bp, Homo sapiens
aggtgcggaccggagcggctg

SEQ ID NO: 4756349 - DNA, 13 bp, Homo sapiens
aggtgctcttctc

SEQ ID NO: 4756350 - DNA, 23 bp, Homo sapiens
aggtgctcttctcattttttcct

SEQ ID NO: 4756351 - DNA, 21 bp, Homo sapiens
aggtggatactggggggcagg

SEQ ID NO: 4756352 - DNA, 17 bp, Homo sapiens
aggtgggaggacagtta

SEQ ID NO: 4756353 - DNA, 11 bp, Homo sapiens
aggtggggagg

SEQ ID NO: 4756354 - DNA, 13 bp, Homo sapiens
aggtggggagggc

SEQ ID NO: 4756355 - DNA, 15 bp, Homo sapiens
aggtggggagggcct

SEQ ID NO: 4756356 - DNA, 13 bp, Homo sapiens
aggtggggtgctg

SEQ ID NO: 4756357 - DNA, 15 bp, Homo sapiens
aggtggggtgctggg

SEQ ID NO: 4756358 - DNA, 21 bp, Homo sapiens
aggtgggtcaactccaaggca

SEQ ID NO: 4756359 - DNA, 22 bp, Homo sapiens
aggtgggtcaactccaaggcaa

SEQ ID NO: 4756360 - DNA, 14 bp, Homo sapiens
aggtgggtcttgga

SEQ ID NO: 4756361 - DNA, 15 bp, Homo sapiens
aggtgggtcttggat

SEQ ID NO: 4756362 - DNA, 13 bp, Homo sapiens
aggtggtcttgga

SEQ ID NO: 4756363 - DNA, 14 bp, Homo sapiens
aggtggtcttggag

SEQ ID NO: 4756364 - DNA, 22 bp, Homo sapiens
aggtggtcttggagaggaggtg

SEQ ID NO: 4756365 - DNA, 11 bp, Homo sapiens
aggtgtaaata

SEQ ID NO: 4756366 - DNA, 17 bp, Homo sapiens
aggtgtactatggctgt

SEQ ID NO: 4756367 - DNA, 22 bp, Homo sapiens
aggttaaaagaccataagcaaa

SEQ ID NO: 4756368 - DNA, 19 bp, Homo sapiens
aggttcaagcaatcctccc

SEQ ID NO: 4756369 - DNA, 21 bp, Homo sapiens
aggttccatccaccaccttgc

SEQ ID NO: 4756370 - DNA, 14 bp, Homo sapiens
aggttctctcctgt

SEQ ID NO: 4756371 - DNA, 18 bp, Homo sapiens
aggttgctggcatttgct

SEQ ID NO: 4756372 - DNA, 13 bp, Homo sapiens
aggtttaaaacta

SEQ ID NO: 4756373 - DNA, 19 bp, Homo sapiens
aggtttaagtagatttcat

SEQ ID NO: 4756374 - DNA, 20 bp, Homo sapiens
aggtttagaatcaagtctgt

SEQ ID NO: 4756375 - DNA, 17 bp, Homo sapiens
aggtttcactgttcatg

SEQ ID NO: 4756376 - DNA, 13 bp, Homo sapiens
agtaaaattatct

SEQ ID NO: 4756377 - DNA, 15 bp, Homo sapiens
agtaaaattatctgt

SEQ ID NO: 4756378 - DNA, 19 bp, Homo sapiens
agtaaaattatctgttcta

SEQ ID NO: 4756379 - DNA, 17 bp, Homo sapiens
agtaaatctaaattaac

SEQ ID NO: 4756380 - DNA, 18 bp, Homo sapiens
agtaaatctaaattaact

SEQ ID NO: 4756381 - DNA, 15 bp, Homo sapiens
agtaaatctatctct

SEQ ID NO: 4756382 - DNA, 17 bp, Homo sapiens
agtaaatctatctctat

SEQ ID NO: 4756383 - DNA, 21 bp, Homo sapiens
agtaaatctatctctatataa

SEQ ID NO: 4756384 - DNA, 16 bp, Homo sapiens
agtaaatgtatattga

SEQ ID NO: 4756385 - DNA, 17 bp, Homo sapiens
agtaacagtatttccat

SEQ ID NO: 4756386 - DNA, 18 bp, Homo sapiens
agtaactgccattttttg

SEQ ID NO: 4756387 - DNA, 17 bp, Homo sapiens
agtaagcacctttagaa

SEQ ID NO: 4756388 - DNA, 21 bp, Homo sapiens
agtaagttctgaaaactgttt

SEQ ID NO: 4756389 - DNA, 12 bp, Homo sapiens
agtaataaaaca

SEQ ID NO: 4756390 - DNA, 15 bp, Homo sapiens
agtaatctgtataat

SEQ ID NO: 4756391 - DNA, 22 bp, Homo sapiens
agtaatctgtataatactttgt

SEQ ID NO: 4756392 - DNA, 14 bp, Homo sapiens
agtaattttcttct

SEQ ID NO: 4756393 - DNA, 17 bp, Homo sapiens
agtaattttcttctcat

SEQ ID NO: 4756394 - DNA, 17 bp, Homo sapiens
agtacaaaatagttgta

SEQ ID NO: 4756395 - DNA, 15 bp, Homo sapiens
agtacaattctttgt

SEQ ID NO: 4756396 - DNA, 23 bp, Homo sapiens
agtacaattctttgttgcttaat

SEQ ID NO: 4756397 - DNA, 21 bp, Homo sapiens
agtacataaagtaataactgt

SEQ ID NO: 4756398 - DNA, 21 bp, Homo sapiens
agtactagagatattttgtaa

SEQ ID NO: 4756399 - DNA, 22 bp, Homo sapiens
agtactcactaaaagttctcaa

SEQ ID NO: 4756400 - DNA, 19 bp, Homo sapiens
agtactggtaagattgtta

SEQ ID NO: 4756401 - DNA, 23 bp, Homo sapiens
agtactggtaagattgttattaa

SEQ ID NO: 4756402 - DNA, 14 bp, Homo sapiens
agtacttcttctgt

SEQ ID NO: 4756403 - DNA, 19 bp, Homo sapiens
agtacttcttctgtaatat

SEQ ID NO: 4756404 - DNA, 23 bp, Homo sapiens
agtacttcttctgtaatatttac

SEQ ID NO: 4756405 - DNA, 22 bp, Homo sapiens
agtactttcgttaatcttgctg

SEQ ID NO: 4756406 - DNA, 19 bp, Homo sapiens
agtactttgccatccttgc

SEQ ID NO: 4756407 - DNA, 16 bp, Homo sapiens
agtagaatctcagcac

SEQ ID NO: 4756408 - DNA, 22 bp, Homo sapiens
agtagagacgaggtttcactgt

SEQ ID NO: 4756409 - DNA, 23 bp, Homo sapiens
agtagcattttaatagtttctaa

SEQ ID NO: 4756410 - DNA, 23 bp, Homo sapiens
agtagcccacaataatgaataat

SEQ ID NO: 4756411 - DNA, 16 bp, Homo sapiens
agtagcgctatagtta

SEQ ID NO: 4756412 - DNA, 21 bp, Homo sapiens
agtagcgctatagttactgtc

SEQ ID NO: 4756413 - DNA, 16 bp, Homo sapiens
agtagctcgtgtgctt

SEQ ID NO: 4756414 - DNA, 15 bp, Homo sapiens
agtagctgataaaga

SEQ ID NO: 4756415 - DNA, 17 bp, Homo sapiens
agtagtacttcttctgt

SEQ ID NO: 4756416 - DNA, 20 bp, Homo sapiens
agtagtgtctggatcagtaa

SEQ ID NO: 4756417 - DNA, 13 bp, Homo sapiens
agatattgtatta

SEQ ID NO: 4756418 - DNA, 14 bp, Homo sapiens
agatattgtattat

SEQ ID NO: 4756419 - DNA, 18 bp, Homo sapiens
agatattgtattatcata

SEQ ID NO: 4756420 - DNA, 21 bp, Homo sapiens
agatattttgtaaaatgtatt

SEQ ID NO: 4756421 - DNA, 22 bp, Homo sapiens
agatattttgtaaaatgtatta

SEQ ID NO: 4756422 - DNA, 13 bp, Homo sapiens
agatcaggaagag

SEQ ID NO: 4756423 - DNA, 18 bp, Homo sapiens
agatcaggaagagaagga

SEQ ID NO: 4756424 - DNA, 19 bp, Homo sapiens
agatcaggaagagaaggag

SEQ ID NO: 4756425 - DNA, 17 bp, Homo sapiens
agatcatctccaaatct

SEQ ID NO: 4756426 - DNA, 18 bp, Homo sapiens
agatccattaatttaaat

SEQ ID NO: 4756427 - DNA, 15 bp, Homo sapiens
agatcccaagtcaaa

SEQ ID NO: 4756428 - DNA, 17 bp, Homo sapiens
agatcccaagtcaaaca

SEQ ID NO: 4756429 - DNA, 19 bp, Homo sapiens
agatccctcggtcagcacc

SEQ ID NO: 4756430 - DNA, 21 bp, Homo sapiens
agatcctccgcggaggcccct

SEQ ID NO: 4756431 - DNA, 22 bp, Homo sapiens
agatcctccgcggaggcccctg

SEQ ID NO: 4756432 - DNA, 23 bp, Homo sapiens
agatcctccgcggaggcccctga

SEQ ID NO: 4756433 - DNA, 19 bp, Homo sapiens
agatcctctttccccactg

SEQ ID NO: 4756434 - DNA, 16 bp, Homo sapiens
agatctagccaggcct

SEQ ID NO: 4756435 - DNA, 22 bp, Homo sapiens
agatctcagataaagtgaccag

SEQ ID NO: 4756436 - DNA, 23 bp, Homo sapiens
agatctcctgtaattttgtagta

SEQ ID NO: 4756437 - DNA, 13 bp, Homo sapiens
agatctgaagtag

SEQ ID NO: 4756438 - DNA, 14 bp, Homo sapiens
agatcttctgtggg

SEQ ID NO: 4756439 - DNA, 15 bp, Homo sapiens
agatctttcttaata

SEQ ID NO: 4756440 - DNA, 17 bp, Homo sapiens
agatctttttttaagtg

SEQ ID NO: 4756441 - DNA, 18 bp, Homo sapiens
agatgacatctgtctagg

SEQ ID NO: 4756442 - DNA, 20 bp, Homo sapiens
agatgactggaaacaaggaa

SEQ ID NO: 4756443 - DNA, 15 bp, Homo sapiens
agatgatctctccac

SEQ ID NO: 4756444 - DNA, 16 bp, Homo sapiens
agatgatttaattctt

SEQ ID NO: 4756445 - DNA, 16 bp, Homo sapiens
agatgcagctggatgg

SEQ ID NO: 4756446 - DNA, 16 bp, Homo sapiens
agatgcaggttttcta

SEQ ID NO: 4756447 - DNA, 20 bp, Homo sapiens
agatgcattttaaatgtcta

SEQ ID NO: 4756448 - DNA, 22 bp, Homo sapiens
agatgcattttaaatgtctata

SEQ ID NO: 4756449 - DNA, 12 bp, Homo sapiens
agatgccaaggg

SEQ ID NO: 4756450 - DNA, 23 bp, Homo sapiens
agatggacagttcacaccctgca

SEQ ID NO: 4756451 - DNA, 19 bp, Homo sapiens
agatggagaaacaacaaat

SEQ ID NO: 4756452 - DNA, 18 bp, Homo sapiens
agatgggttgagtttgct

SEQ ID NO: 4756453 - DNA, 15 bp, Homo sapiens
agatggtgccccctg

SEQ ID NO: 4756454 - DNA, 21 bp, Homo sapiens
agatgtccatttttacaagtt

SEQ ID NO: 4756455 - DNA, 21 bp, Homo sapiens
agatgtttagtagctgataaa

SEQ ID NO: 4756456 - DNA, 17 bp, Homo sapiens
agattaatggcactgat

SEQ ID NO: 4756457 - DNA, 13 bp, Homo sapiens
agattaatttgtg

SEQ ID NO: 4756458 - DNA, 19 bp, Homo sapiens
agattatatacaaagctgt

SEQ ID NO: 4756459 - DNA, 21 bp, Homo sapiens
agattatatacaaagctgtca

SEQ ID NO: 4756460 - DNA, 19 bp, Homo sapiens
agattatttacaagaagaa

SEQ ID NO: 4756461 - DNA, 21 bp, Homo sapiens
agattattttctatatttgga

SEQ ID NO: 4756462 - DNA, 16 bp, Homo sapiens
agattcacctgtaaaa

SEQ ID NO: 4756463 - DNA, 21 bp, Homo sapiens
agattcacctgtaaaacttta

SEQ ID NO: 4756464 - DNA, 17 bp, Homo sapiens
agattccattttggaaa

SEQ ID NO: 4756465 - DNA, 20 bp, Homo sapiens
agattcctacttaaacaaaa

SEQ ID NO: 4756466 - DNA, 15 bp, Homo sapiens
agattgttattaaat

SEQ ID NO: 4756467 - DNA, 15 bp, Homo sapiens
agatttcatccagaa

SEQ ID NO: 4756468 - DNA, 17 bp, Homo sapiens
agatttgtatttatatt

SEQ ID NO: 4756469 - DNA, 20 bp, Homo sapiens
agatttgtatttatattaga

SEQ ID NO: 4756470 - DNA, 14 bp, Homo sapiens
agattttatagtgt

SEQ ID NO: 4756471 - DNA, 15 bp, Homo sapiens
agattttatgtttaa

SEQ ID NO: 4756472 - DNA, 19 bp, Homo sapiens
agattttatgtttaaaatg

SEQ ID NO: 4756473 - DNA, 17 bp, Homo sapiens
agatttttctcatctcc

SEQ ID NO: 4756474 - DNA, 16 bp, Homo sapiens
agcaaaaaataatgac

SEQ ID NO: 4756475 - DNA, 16 bp, Homo sapiens
agcaaaaccattgctt

SEQ ID NO: 4756476 - DNA, 13 bp, Homo sapiens
accctgccctggc

SEQ ID NO: 4756477 - DNA, 14 bp, Homo sapiens
accctgcgcccctg

SEQ ID NO: 4756478 - DNA, 20 bp, Homo sapiens
accctgcgcccctgcccagc

SEQ ID NO: 4756479 - DNA, 21 bp, Homo sapiens
accctgcgcccctgcccagca

SEQ ID NO: 4756480 - DNA, 14 bp, Homo sapiens
accctgcttctgct

SEQ ID NO: 4756481 - DNA, 16 bp, Homo sapiens
accctgggtcaccttc

SEQ ID NO: 4756482 - DNA, 21 bp, Homo sapiens
accctgggtcaccttcctggg

SEQ ID NO: 4756483 - DNA, 15 bp, Homo sapiens
accctgtaaaagaca

SEQ ID NO: 4756484 - DNA, 15 bp, Homo sapiens
accctgtctgcaggc

SEQ ID NO: 4756485 - DNA, 19 bp, Homo sapiens
accctgtgccccgcctccc

SEQ ID NO: 4756486 - DNA, 21 bp, Homo sapiens
accctgtgccccgcctcccgg

SEQ ID NO: 4756487 - DNA, 16 bp, Homo sapiens
accctgtgcctgtgtt

SEQ ID NO: 4756488 - DNA, 18 bp, Homo sapiens
accctgtgcctgtgtttc

SEQ ID NO: 4756489 - DNA, 17 bp, Homo sapiens
acccttcaatgttaaat

SEQ ID NO: 4756490 - DNA, 19 bp, Homo sapiens
acccttcaatgttaaatct

SEQ ID NO: 4756491 - DNA, 13 bp, Homo sapiens
acccttccagaca

SEQ ID NO: 4756492 - DNA, 16 bp, Homo sapiens
acccttccagacatac

SEQ ID NO: 4756493 - DNA, 13 bp, Homo sapiens
acccttcccaatc

SEQ ID NO: 4756494 - DNA, 22 bp, Homo sapiens
acccttcccaatcagcactgaa

SEQ ID NO: 4756495 - DNA, 14 bp, Homo sapiens
acccttgactgtta

SEQ ID NO: 4756496 - DNA, 23 bp, Homo sapiens
accgaactcgggattacagaaac

SEQ ID NO: 4756497 - DNA, 21 bp, Homo sapiens
accgacgcccctccgggcaga

SEQ ID NO: 4756498 - DNA, 21 bp, Homo sapiens
accgcaccgggctggcctgac

SEQ ID NO: 4756499 - DNA, 13 bp, Homo sapiens
accgcagaaggaa

SEQ ID NO: 4756500 - DNA, 18 bp, Homo sapiens
accgcccaacccccacct

SEQ ID NO: 4756501 - DNA, 21 bp, Homo sapiens
accgcccaacccccacctccc

SEQ ID NO: 4756502 - DNA, 16 bp, Homo sapiens
accgcccacccacacc

SEQ ID NO: 4756503 - DNA, 17 bp, Homo sapiens
accgcccacccagcagc

SEQ ID NO: 4756504 - DNA, 14 bp, Homo sapiens
accgccccaggcac

SEQ ID NO: 4756505 - DNA, 22 bp, Homo sapiens
accgccgcggtagatcattttt

SEQ ID NO: 4756506 - DNA, 13 bp, Homo sapiens
accgcgcccctct

SEQ ID NO: 4756507 - DNA, 24 bp, Homo sapiens
accggacgctggagaccctgcgcc

SEQ ID NO: 4756508 - DNA, 15 bp, Homo sapiens
accggagcggctgag

SEQ ID NO: 4756509 - DNA, 13 bp, Homo sapiens
accggagctccag

SEQ ID NO: 4756510 - DNA, 15 bp, Homo sapiens
ataataaaagaatca

SEQ ID NO: 4756511 - DNA, 15 bp, Homo sapiens
ataataaaattcatt

SEQ ID NO: 4756512 - DNA, 19 bp, Homo sapiens
ataataaaattcattccat

SEQ ID NO: 4756513 - DNA, 12 bp, Homo sapiens
ataataaactgt

SEQ ID NO: 4756514 - DNA, 13 bp, Homo sapiens
ataataaactgtt

SEQ ID NO: 4756515 - DNA, 14 bp, Homo sapiens
ataataaactgttt

SEQ ID NO: 4756516 - DNA, 17 bp, Homo sapiens
ataataaaggttctatg

SEQ ID NO: 4756517 - DNA, 14 bp, Homo sapiens
ataataatctcagt

SEQ ID NO: 4756518 - DNA, 15 bp, Homo sapiens
ataatactttgtata

SEQ ID NO: 4756519 - DNA, 17 bp, Homo sapiens
ataatactttgtataca

SEQ ID NO: 4756520 - DNA, 14 bp, Homo sapiens
ataatataaatgaa

SEQ ID NO: 4756521 - DNA, 17 bp, Homo sapiens
ataatatcttgaagaat

SEQ ID NO: 4756522 - DNA, 23 bp, Homo sapiens
ataatatcttgaagaatattgtt

SEQ ID NO: 4756523 - DNA, 23 bp, Homo sapiens
ataatatggaaccttccctccaa

SEQ ID NO: 4756524 - DNA, 16 bp, Homo sapiens
ataatctcatccccaa

SEQ ID NO: 4756525 - DNA, 16 bp, Homo sapiens
ataatctcttcttata

SEQ ID NO: 4756526 - DNA, 12 bp, Homo sapiens
ataatgaataat

SEQ ID NO: 4756527 - DNA, 15 bp, Homo sapiens
ataatgattcaatgt

SEQ ID NO: 4756528 - DNA, 11 bp, Homo sapiens
ataatgattta

SEQ ID NO: 4756529 - DNA, 19 bp, Homo sapiens
atagttctgcaataacagt

SEQ ID NO: 4756530 - DNA, 23 bp, Homo sapiens
atagttgtaaagatattgtatct

SEQ ID NO: 4756531 - DNA, 14 bp, Homo sapiens
atataaaaaatata

SEQ ID NO: 4756532 - DNA, 21 bp, Homo sapiens
atataaaaaatatatgtaata

SEQ ID NO: 4756533 - DNA, 13 bp, Homo sapiens
atataaaaacatt

SEQ ID NO: 4756534 - DNA, 15 bp, Homo sapiens
atataaactgtgaga

SEQ ID NO: 4756535 - DNA, 16 bp, Homo sapiens
atataaacttgtgtat

SEQ ID NO: 4756536 - DNA, 10 bp, Homo sapiens
atataaatca

SEQ ID NO: 4756537 - DNA, 17 bp, Homo sapiens
atataaatcacagattt

SEQ ID NO: 4756538 - DNA, 15 bp, Homo sapiens
atataacatgaaagt

SEQ ID NO: 4756539 - DNA, 18 bp, Homo sapiens
atataacatgaaagtcaa

SEQ ID NO: 4756540 - DNA, 13 bp, Homo sapiens
atataagacaagt

SEQ ID NO: 4756541 - DNA, 14 bp, Homo sapiens
atataataaagtat

SEQ ID NO: 4756542 - DNA, 20 bp, Homo sapiens
atataataaagtattccacc

SEQ ID NO: 4756543 - DNA, 19 bp, Homo sapiens
atataataaatatatattt

SEQ ID NO: 4756544 - DNA, 15 bp, Homo sapiens
atataatatatgtca

SEQ ID NO: 4756545 - DNA, 21 bp, Homo sapiens
atataatggcctcttaaaaat

SEQ ID NO: 4756546 - DNA, 17 bp, Homo sapiens
atataatgggctgcaaa

SEQ ID NO: 4756547 - DNA, 16 bp, Homo sapiens
atatacagacctccag

SEQ ID NO: 4756548 - DNA, 13 bp, Homo sapiens
atatacagagcct

SEQ ID NO: 4756549 - DNA, 19 bp, Homo sapiens
atatacagagcctgtttta

SEQ ID NO: 4756550 - DNA, 13 bp, Homo sapiens
atatacatataca

SEQ ID NO: 4756551 - DNA, 20 bp, Homo sapiens
atatacatattcaaagtata

SEQ ID NO: 4756552 - DNA, 10 bp, Homo sapiens
atatacatta

SEQ ID NO: 4756553 - DNA, 17 bp, Homo sapiens
atatacattagacacac

SEQ ID NO: 4756554 - DNA, 22 bp, Homo sapiens
atatacattagacacacatata

SEQ ID NO: 4756555 - DNA, 17 bp, Homo sapiens
atatacattatttctgt

SEQ ID NO: 4756556 - DNA, 13 bp, Homo sapiens
atatactcattag

SEQ ID NO: 4756557 - DNA, 15 bp, Homo sapiens
atatactcattagaa

SEQ ID NO: 4756558 - DNA, 14 bp, Homo sapiens
atatactcatttgg

SEQ ID NO: 4756559 - DNA, 15 bp, Homo sapiens
atatagatgtctgtg

SEQ ID NO: 4756560 - DNA, 19 bp, Homo sapiens
atatagatgtctgtgtata

SEQ ID NO: 4756561 - DNA, 20 bp, Homo sapiens
atatagctttgcaaccttgt

SEQ ID NO: 4756562 - DNA, 15 bp, Homo sapiens
atataggaattaaga

SEQ ID NO: 4756563 - DNA, 20 bp, Homo sapiens
atataggggcaaaaatttga

SEQ ID NO: 4756564 - DNA, 15 bp, Homo sapiens
atatatatgagtgaa

SEQ ID NO: 4756565 - DNA, 20 bp, Homo sapiens
atatatgcttttttgcaata

SEQ ID NO: 4756566 - DNA, 21 bp, Homo sapiens
atatatgcttttttgcaataa

SEQ ID NO: 4756567 - DNA, 14 bp, Homo sapiens
atatatggatattt

SEQ ID NO: 4756568 - DNA, 15 bp, Homo sapiens
atatatgtatatctg

SEQ ID NO: 4756569 - DNA, 16 bp, Homo sapiens
atatatgtatatctgt

SEQ ID NO: 4756570 - DNA, 12 bp, Homo sapiens
atatatgtatgt

SEQ ID NO: 4756571 - DNA, 15 bp, Homo sapiens
atatatgtatgtaaa

SEQ ID NO: 4756572 - DNA, 15 bp, Homo sapiens
atatatttattattt

SEQ ID NO: 4756573 - DNA, 22 bp, Homo sapiens
atatatttattattttcatata

SEQ ID NO: 4756574 - DNA, 13 bp, Homo sapiens
atatattttgaaa

SEQ ID NO: 4756575 - DNA, 18 bp, Homo sapiens
atatcacctgaattatta

SEQ ID NO: 4756576 - DNA, 15 bp, Homo sapiens
atatcactcattaat

SEQ ID NO: 4756577 - DNA, 11 bp, Homo sapiens
atatcagctct

SEQ ID NO: 4756578 - DNA, 16 bp, Homo sapiens
atatcagttacagtgg

SEQ ID NO: 4756579 - DNA, 22 bp, Homo sapiens
atatcagttacagtggcagtat

SEQ ID NO: 4756580 - DNA, 20 bp, Homo sapiens
atatcatcacgtatgttata

SEQ ID NO: 4756581 - DNA, 18 bp, Homo sapiens
atatcatttcataaaaat

SEQ ID NO: 4756582 - DNA, 16 bp, Homo sapiens
atatccttactttatc

SEQ ID NO: 4756583 - DNA, 16 bp, Homo sapiens
atatctgaaaactgga

SEQ ID NO: 4756584 - DNA, 17 bp, Homo sapiens
atatctgaaaactggaa

SEQ ID NO: 4756585 - DNA, 13 bp, Homo sapiens
atatctgtgaaat

SEQ ID NO: 4756586 - DNA, 14 bp, Homo sapiens
atatctgtgtaaga

SEQ ID NO: 4756587 - DNA, 15 bp, Homo sapiens
atatcttgaagaata

SEQ ID NO: 4756588 - DNA, 16 bp, Homo sapiens
atatcttttcttctcc

SEQ ID NO: 4756589 - DNA, 16 bp, Homo sapiens
atatgaaaaatgagat

SEQ ID NO: 4756590 - DNA, 16 bp, Homo sapiens
atatgaaaactaagtt

SEQ ID NO: 4756591 - DNA, 17 bp, Homo sapiens
atatgaaagagaaaatg

SEQ ID NO: 4756592 - DNA, 18 bp, Homo sapiens
atatgaacgcacaacatg

SEQ ID NO: 4756593 - DNA, 22 bp, Homo sapiens
atatgaacgcacaacatgcaca

SEQ ID NO: 4756594 - DNA, 15 bp, Homo sapiens
atatgaagcagaatg

SEQ ID NO: 4756595 - DNA, 21 bp, Homo sapiens
atatgaagtaagttctgaaaa

SEQ ID NO: 4756596 - DNA, 15 bp, Homo sapiens
atatgacttcttgtt

SEQ ID NO: 4756597 - DNA, 22 bp, Homo sapiens
atatgagaaatataaaaataat

SEQ ID NO: 4756598 - DNA, 22 bp, Homo sapiens
atatgagattggaaaaaattag

SEQ ID NO: 4756599 - DNA, 17 bp, Homo sapiens
atatgagcatgctccct

SEQ ID NO: 4756600 - DNA, 19 bp, Homo sapiens
atatgattctcctctccca

SEQ ID NO: 4756601 - DNA, 22 bp, Homo sapiens
atatgattctcctctcccaaat

SEQ ID NO: 4756602 - DNA, 17 bp, Homo sapiens
atatgcatgtagcatat

SEQ ID NO: 4756603 - DNA, 15 bp, Homo sapiens
atatgcctatattta

SEQ ID NO: 4756604 - DNA, 17 bp, Homo sapiens
atatgcctatatttata

SEQ ID NO: 4756605 - DNA, 20 bp, Homo sapiens
atatgcttttttgcaataag

SEQ ID NO: 4756606 - DNA, 19 bp, Homo sapiens
atatggaaatcctgttact

SEQ ID NO: 4756607 - DNA, 13 bp, Homo sapiens
atatggaaccttc

SEQ ID NO: 4756608 - DNA, 16 bp, Homo sapiens
atatggaaccttccct

SEQ ID NO: 4756609 - DNA, 19 bp, Homo sapiens
atatggaaccttccctcca

SEQ ID NO: 4756610 - DNA, 23 bp, Homo sapiens
atatggatatttttaatttatga

SEQ ID NO: 4756611 - DNA, 17 bp, Homo sapiens
atatggcttgtagggtg

SEQ ID NO: 4756612 - DNA, 14 bp, Homo sapiens
atatgggactgagc

SEQ ID NO: 4756613 - DNA, 13 bp, Homo sapiens
atatgtaatatat

SEQ ID NO: 4756614 - DNA, 16 bp, Homo sapiens
atatgtaatatataca

SEQ ID NO: 4756615 - DNA, 17 bp, Homo sapiens
atatgtaatatatacat

SEQ ID NO: 4756616 - DNA, 22 bp, Homo sapiens
atatgtaatatatacatattca

SEQ ID NO: 4756617 - DNA, 16 bp, Homo sapiens
atatgtaggaaaattt

SEQ ID NO: 4756618 - DNA, 23 bp, Homo sapiens
atatgtaggaaaattttcttctt

SEQ ID NO: 4756619 - DNA, 16 bp, Homo sapiens
atatgtatatctgtgt

SEQ ID NO: 4756620 - DNA, 17 bp, Homo sapiens
atatgtatatctgtgta

SEQ ID NO: 4756621 - DNA, 19 bp, Homo sapiens
atatgtatatctgtgtaag

SEQ ID NO: 4756622 - DNA, 13 bp, Homo sapiens
atatgtatgtaaa

SEQ ID NO: 4756623 - DNA, 22 bp, Homo sapiens
atatgtatgtgtgagtgtatgt

SEQ ID NO: 4756624 - DNA, 13 bp, Homo sapiens
atatgtctttaaa

SEQ ID NO: 4756625 - DNA, 17 bp, Homo sapiens
atatgtgcttgtgtgta

SEQ ID NO: 4756626 - DNA, 15 bp, Homo sapiens
atatgtggagttcat

SEQ ID NO: 4756627 - DNA, 21 bp, Homo sapiens
atatgtggagttcatcttgaa

SEQ ID NO: 4756628 - DNA, 22 bp, Homo sapiens
atatgtgtaatatcatttcata

SEQ ID NO: 4756629 - DNA, 16 bp, Homo sapiens
atatgtgtacacatat

SEQ ID NO: 4756630 - DNA, 12 bp, Homo sapiens
atatgttgctga

SEQ ID NO: 4756631 - DNA, 19 bp, Homo sapiens
atatgtttggctgaaatta

SEQ ID NO: 4756632 - DNA, 21 bp, Homo sapiens
atatgtttggctgaaattatg

SEQ ID NO: 4756633 - DNA, 16 bp, Homo sapiens
atattaaaaattaatt

SEQ ID NO: 4756634 - DNA, 14 bp, Homo sapiens
atattaaaatcaca

SEQ ID NO: 4756635 - DNA, 15 bp, Homo sapiens
atattaagtgttgta

SEQ ID NO: 4756636 - DNA, 16 bp, Homo sapiens
atattaagtgttgtac

SEQ ID NO: 4756637 - DNA, 11 bp, Homo sapiens
atattataagt

SEQ ID NO: 4756638 - DNA, 12 bp, Homo sapiens
atattatatata

SEQ ID NO: 4756639 - DNA, 17 bp, Homo sapiens
atattatatatacatta

SEQ ID NO: 4756640 - DNA, 13 bp, Homo sapiens
atattatatcaga

SEQ ID NO: 4756641 - DNA, 16 bp, Homo sapiens
atattattttctgtaa

SEQ ID NO: 4756642 - DNA, 16 bp, Homo sapiens
atattcaaaaattata

SEQ ID NO: 4756643 - DNA, 17 bp, Homo sapiens
atattcaaaaattatat

SEQ ID NO: 4756644 - DNA, 21 bp, Homo sapiens
atattcaaagtatatacagag

SEQ ID NO: 4756645 - DNA, 22 bp, Homo sapiens
atattcaaagtatatacagagc

SEQ ID NO: 4756646 - DNA, 14 bp, Homo sapiens
atattcagagatgt

SEQ ID NO: 4756647 - DNA, 19 bp, Homo sapiens
atattcagagatgtaccat

SEQ ID NO: 4756648 - DNA, 22 bp, Homo sapiens
atattcatgaaagctgaaagaa

SEQ ID NO: 4756649 - DNA, 21 bp, Homo sapiens
atattcatgctgcctgccatg

SEQ ID NO: 4756650 - DNA, 18 bp, Homo sapiens
atattctaagaaatatct

SEQ ID NO: 4756651 - DNA, 23 bp, Homo sapiens
atattctaagaaatatctgtgaa

SEQ ID NO: 4756652 - DNA, 15 bp, Homo sapiens
agtagtgttgggtgg

SEQ ID NO: 4756653 - DNA, 19 bp, Homo sapiens
agtagtgttgggtggagga

SEQ ID NO: 4756654 - DNA, 22 bp, Homo sapiens
agtagtgttgggtggaggatgg

SEQ ID NO: 4756655 - DNA, 23 bp, Homo sapiens
agtagttgatgaccaatctctgt

SEQ ID NO: 4756656 - DNA, 14 bp, Homo sapiens
agtataaattacat

SEQ ID NO: 4756657 - DNA, 15 bp, Homo sapiens
agtataaattacatg

SEQ ID NO: 4756658 - DNA, 20 bp, Homo sapiens
agtataaattacatgcatga

SEQ ID NO: 4756659 - DNA, 17 bp, Homo sapiens
agtatagataaatccaa

SEQ ID NO: 4756660 - DNA, 17 bp, Homo sapiens
agtatataagctttttt

SEQ ID NO: 4756661 - DNA, 12 bp, Homo sapiens
agtatatatgta

SEQ ID NO: 4756662 - DNA, 14 bp, Homo sapiens
agtatatatgtaca

SEQ ID NO: 4756663 - DNA, 22 bp, Homo sapiens
agtatatctatctatatataca

SEQ ID NO: 4756664 - DNA, 22 bp, Homo sapiens
agtatccctgatttattctggt

SEQ ID NO: 4756665 - DNA, 16 bp, Homo sapiens
agtatcctggattcct

SEQ ID NO: 4756666 - DNA, 22 bp, Homo sapiens
agtatctcatcaacaaagaaat

SEQ ID NO: 4756667 - DNA, 15 bp, Homo sapiens
agtatcttaaaattg

SEQ ID NO: 4756668 - DNA, 17 bp, Homo sapiens
agtatgcaagaagaata

SEQ ID NO: 4756669 - DNA, 18 bp, Homo sapiens
agtatgcaagaagaatat

SEQ ID NO: 4756670 - DNA, 23 bp, Homo sapiens
agtatgcaagaagaatataaata

SEQ ID NO: 4756671 - DNA, 18 bp, Homo sapiens
agtatgcactaatcaata

SEQ ID NO: 4756672 - DNA, 22 bp, Homo sapiens
agtatgccccacctatctttgg

SEQ ID NO: 4756673 - DNA, 15 bp, Homo sapiens
agtatgtgtatgtac

SEQ ID NO: 4756674 - DNA, 18 bp, Homo sapiens
agtattatttagtaaaat

SEQ ID NO: 4756675 - DNA, 20 bp, Homo sapiens
agtattccttggcccagcag

SEQ ID NO: 4756676 - DNA, 22 bp, Homo sapiens
agtattgacgacctacatctga

SEQ ID NO: 4756677 - DNA, 11 bp, Homo sapiens
agtattttgag

SEQ ID NO: 4756678 - DNA, 16 bp, Homo sapiens
agtcaaacagtgtggc

SEQ ID NO: 4756679 - DNA, 15 bp, Homo sapiens
agtcaagtctacctg

SEQ ID NO: 4756680 - DNA, 13 bp, Homo sapiens
agtcaccttccag

SEQ ID NO: 4756681 - DNA, 12 bp, Homo sapiens
agtcagatgttt

SEQ ID NO: 4756682 - DNA, 16 bp, Homo sapiens
agctctaaagcagaga

SEQ ID NO: 4756683 - DNA, 16 bp, Homo sapiens
agctctgaagggaggg

SEQ ID NO: 4756684 - DNA, 21 bp, Homo sapiens
agctctgaagggaggggaaga

SEQ ID NO: 4756685 - DNA, 22 bp, Homo sapiens
agctctgaagggaggggaagag

SEQ ID NO: 4756686 - DNA, 18 bp, Homo sapiens
agctctgaatgctatttg

SEQ ID NO: 4756687 - DNA, 15 bp, Homo sapiens
agctctgagcagaca

SEQ ID NO: 4756688 - DNA, 19 bp, Homo sapiens
agctctgcataagattata

SEQ ID NO: 4756689 - DNA, 15 bp, Homo sapiens
agctctgtagcctgg

SEQ ID NO: 4756690 - DNA, 19 bp, Homo sapiens
agctctgtagcctggtctg

SEQ ID NO: 4756691 - DNA, 18 bp, Homo sapiens
agctcttggcaggagtgg

SEQ ID NO: 4756692 - DNA, 20 bp, Homo sapiens
agctgagcacccagctctgt

SEQ ID NO: 4756693 - DNA, 15 bp, Homo sapiens
agctgatacagagag

SEQ ID NO: 4756694 - DNA, 13 bp, Homo sapiens
agctgatagtgtt

SEQ ID NO: 4756695 - DNA, 23 bp, Homo sapiens
agctgatagtgtttcgttaagca

SEQ ID NO: 4756696 - DNA, 13 bp, Homo sapiens
agctgcagcttgg

SEQ ID NO: 4756697 - DNA, 17 bp, Homo sapiens
agctgcaggaatcaaaa

SEQ ID NO: 4756698 - DNA, 20 bp, Homo sapiens
agctgcaggaatcaaaaatt

SEQ ID NO: 4756699 - DNA, 22 bp, Homo sapiens
agctgcaggaatcaaaaattga

SEQ ID NO: 4756700 - DNA, 19 bp, Homo sapiens
agctgcagttagcacagag

SEQ ID NO: 4756701 - DNA, 22 bp, Homo sapiens
agctgcccaatttcacagagta

SEQ ID NO: 4756702 - DNA, 14 bp, Homo sapiens
agctgcctccgggc

SEQ ID NO: 4756703 - DNA, 15 bp, Homo sapiens
agctgcctccgggcc

SEQ ID NO: 4756704 - DNA, 17 bp, Homo sapiens
agctgcctccgggcctc

SEQ ID NO: 4756705 - DNA, 21 bp, Homo sapiens
agctgcctccgggcctcggcc

SEQ ID NO: 4756706 - DNA, 15 bp, Homo sapiens
agctgctctccttca

SEQ ID NO: 4756707 - DNA, 23 bp, Homo sapiens
agctgctctccttcactctgaca

SEQ ID NO: 4756708 - DNA, 20 bp, Homo sapiens
agctgcttgggcttcatcct

SEQ ID NO: 4756709 - DNA, 21 bp, Homo sapiens
agctgcttgggcttcatcctc

SEQ ID NO: 4756710 - DNA, 14 bp, Homo sapiens
agctgctttcttct

SEQ ID NO: 4756711 - DNA, 18 bp, Homo sapiens
agctggactgggtgggcc

SEQ ID NO: 4756712 - DNA, 19 bp, Homo sapiens
agctggagtgcagtggcat

SEQ ID NO: 4756713 - DNA, 15 bp, Homo sapiens
agctggatggggcgg

SEQ ID NO: 4756714 - DNA, 22 bp, Homo sapiens
agctggatggggcggcctgcag

SEQ ID NO: 4756715 - DNA, 23 bp, Homo sapiens
agctggatggggcggcctgcaga

SEQ ID NO: 4756716 - DNA, 15 bp, Homo sapiens
agctggcagcgcctc

SEQ ID NO: 4756717 - DNA, 21 bp, Homo sapiens
agctggctgggtcgcccctcc

SEQ ID NO: 4756718 - DNA, 22 bp, Homo sapiens
agctgggcatggtaccagccct

SEQ ID NO: 4756719 - DNA, 18 bp, Homo sapiens
agctggggggctgtcctg

SEQ ID NO: 4756720 - DNA, 13 bp, Homo sapiens
agctggtaacatc

SEQ ID NO: 4756721 - DNA, 13 bp, Homo sapiens
agctggttttctc

SEQ ID NO: 4756722 - DNA, 18 bp, Homo sapiens
agctggttttctctgatg

SEQ ID NO: 4756723 - DNA, 18 bp, Homo sapiens
agctgtaccggccactgc

SEQ ID NO: 4756724 - DNA, 19 bp, Homo sapiens
agctgtaccggccactgca

SEQ ID NO: 4756725 - DNA, 22 bp, Homo sapiens
agctgtaccggccactgcaacc

SEQ ID NO: 4756726 - DNA, 20 bp, Homo sapiens
agctgtcactcacaaaaggc

SEQ ID NO: 4756727 - DNA, 14 bp, Homo sapiens
agcttaatgactta

SEQ ID NO: 4756728 - DNA, 17 bp, Homo sapiens
agcttacctgacacaag

SEQ ID NO: 4756729 - DNA, 21 bp, Homo sapiens
atccagagagaagcaccccac

SEQ ID NO: 4756730 - DNA, 21 bp, Homo sapiens
atccagccgcaaatccatacc

SEQ ID NO: 4756731 - DNA, 23 bp, Homo sapiens
atccagcctaacttacattctta

SEQ ID NO: 4756732 - DNA, 14 bp, Homo sapiens
atccagccttcttc

SEQ ID NO: 4756733 - DNA, 15 bp, Homo sapiens
atccagtatcttgaa

SEQ ID NO: 4756734 - DNA, 16 bp, Homo sapiens
atccagtatcttgaag

SEQ ID NO: 4756735 - DNA, 22 bp, Homo sapiens
attcctcctgtctcctctgtca

SEQ ID NO: 4756736 - DNA, 23 bp, Homo sapiens
attcctcctgtctcctctgtcag

SEQ ID NO: 4756737 - DNA, 13 bp, Homo sapiens
attcctctaagat

SEQ ID NO: 4756738 - DNA, 18 bp, Homo sapiens
attcctttcctgatcact

SEQ ID NO: 4756739 - DNA, 13 bp, Homo sapiens
attcgtaagttct

SEQ ID NO: 4756740 - DNA, 16 bp, Homo sapiens
attcgtaagttctgtg

SEQ ID NO: 4756741 - DNA, 20 bp, Homo sapiens
attcgtaagttctgtgcagt

SEQ ID NO: 4756742 - DNA, 14 bp, Homo sapiens
attcgttgctccag

SEQ ID NO: 4756743 - DNA, 22 bp, Homo sapiens
attcgttgctccagtataaatt

SEQ ID NO: 4756744 - DNA, 15 bp, Homo sapiens
attctaaatgttcat

SEQ ID NO: 4756745 - DNA, 21 bp, Homo sapiens
attctaagaaatatctgtgaa

SEQ ID NO: 4756746 - DNA, 15 bp, Homo sapiens
attctaagattgtac

SEQ ID NO: 4756747 - DNA, 17 bp, Homo sapiens
attctaagattgtacat

SEQ ID NO: 4756748 - DNA, 23 bp, Homo sapiens
attctaagtgagatgtttggcaa

SEQ ID NO: 4756749 - DNA, 17 bp, Homo sapiens
attctatctactgattt

SEQ ID NO: 4756750 - DNA, 16 bp, Homo sapiens
attctatgattaaact

SEQ ID NO: 4756751 - DNA, 18 bp, Homo sapiens
attctcttcgctgtgatg

SEQ ID NO: 4756752 - DNA, 19 bp, Homo sapiens
attctgaaggggaaaacct

SEQ ID NO: 4756753 - DNA, 23 bp, Homo sapiens
attctgaaggggaaaacctcagt

SEQ ID NO: 4756754 - DNA, 21 bp, Homo sapiens
attctgattggacctggccca

SEQ ID NO: 4756755 - DNA, 18 bp, Homo sapiens
attctggggtggggcttg

SEQ ID NO: 4756756 - DNA, 20 bp, Homo sapiens
attctggggtggggcttgga

SEQ ID NO: 4756757 - DNA, 19 bp, Homo sapiens
attctgtagccaacttaaa

SEQ ID NO: 4756758 - DNA, 17 bp, Homo sapiens
attcttaccctttcttt

SEQ ID NO: 4756759 - DNA, 11 bp, Homo sapiens
attcttccttg

SEQ ID NO: 4756760 - DNA, 23 bp, Homo sapiens
attcttctcctttgtcaaatggt

SEQ ID NO: 4756761 - DNA, 22 bp, Homo sapiens
attcttgcactgtatccaagtt

SEQ ID NO: 4756762 - DNA, 21 bp, Homo sapiens
attctttcaatccacagtatt

SEQ ID NO: 4756763 - DNA, 15 bp, Homo sapiens
attcttttttcaatg

SEQ ID NO: 4756764 - DNA, 14 bp, Homo sapiens
attgaaaaaatatt

SEQ ID NO: 4756765 - DNA, 15 bp, Homo sapiens
attgaaaaaccattt

SEQ ID NO: 4756766 - DNA, 17 bp, Homo sapiens
attgaaactgtatttac

SEQ ID NO: 4756767 - DNA, 19 bp, Homo sapiens
attgaacactgcaccctcc

SEQ ID NO: 4756768 - DNA, 16 bp, Homo sapiens
attgaaccgtcaatgt

SEQ ID NO: 4756769 - DNA, 17 bp, Homo sapiens
attgaatctctaaaatg

SEQ ID NO: 4756770 - DNA, 14 bp, Homo sapiens
attgacaagtttaa

SEQ ID NO: 4756771 - DNA, 18 bp, Homo sapiens
attgacattttgtagcta

SEQ ID NO: 4756772 - DNA, 14 bp, Homo sapiens
attgagggaaaaca

SEQ ID NO: 4756773 - DNA, 22 bp, Homo sapiens
attgagggaaaacataatatct

SEQ ID NO: 4756774 - DNA, 19 bp, Homo sapiens
attgaggggaggtggccag

SEQ ID NO: 4756775 - DNA, 17 bp, Homo sapiens
attgagttcttcctgta

SEQ ID NO: 4756776 - DNA, 22 bp, Homo sapiens
attgagttggttacctattgct

SEQ ID NO: 4756777 - DNA, 13 bp, Homo sapiens
attgataataaaa

SEQ ID NO: 4756778 - DNA, 14 bp, Homo sapiens
attgataataaaat

SEQ ID NO: 4756779 - DNA, 13 bp, Homo sapiens
attgatagaataa

SEQ ID NO: 4756780 - DNA, 14 bp, Homo sapiens
attgatattctaag

SEQ ID NO: 4756781 - DNA, 16 bp, Homo sapiens
attgatattctaagaa

SEQ ID NO: 4756782 - DNA, 13 bp, Homo sapiens
attgattaaaagc

SEQ ID NO: 4756783 - DNA, 19 bp, Homo sapiens
attgcacacacagtctgtt

SEQ ID NO: 4756784 - DNA, 18 bp, Homo sapiens
attgcactgcagttattt

SEQ ID NO: 4756785 - DNA, 16 bp, Homo sapiens
attgcagcagttgcta

SEQ ID NO: 4756786 - DNA, 14 bp, Homo sapiens
attgctaaagtcag

SEQ ID NO: 4756787 - DNA, 13 bp, Homo sapiens
attgctgagatgt

SEQ ID NO: 4756788 - DNA, 14 bp, Homo sapiens
attgctgtaaataa

SEQ ID NO: 4756789 - DNA, 15 bp, Homo sapiens
attgctgtctgaaaa

SEQ ID NO: 4756790 - DNA, 23 bp, Homo sapiens
attgctgtctgaaaaagtgtttt

SEQ ID NO: 4756791 - DNA, 14 bp, Homo sapiens
attgcttgagcatg

SEQ ID NO: 4756792 - DNA, 21 bp, Homo sapiens
attgcttggactacctataaa

SEQ ID NO: 4756793 - DNA, 17 bp, Homo sapiens
attggacttccatttgg

SEQ ID NO: 4756794 - DNA, 23 bp, Homo sapiens
attggacttccatttggaatcat

SEQ ID NO: 4756795 - DNA, 22 bp, Homo sapiens
attggctgccaagagtccaagc

SEQ ID NO: 4756796 - DNA, 22 bp, Homo sapiens
attgggcccttagaatgtgaaa

SEQ ID NO: 4756797 - DNA, 15 bp, Homo sapiens
attgggcttaatata

SEQ ID NO: 4756798 - DNA, 19 bp, Homo sapiens
attggttaatgaaaaatct

SEQ ID NO: 4756799 - DNA, 21 bp, Homo sapiens
attggttaatgaaaaatctga

SEQ ID NO: 4756800 - DNA, 17 bp, Homo sapiens
attggtttctgtttgaa

SEQ ID NO: 4756801 - DNA, 23 bp, Homo sapiens
attggtttctgtttgaattttca

SEQ ID NO: 4756802 - DNA, 19 bp, Homo sapiens
attgtaaaggtgatgaatt

SEQ ID NO: 4756803 - DNA, 15 bp, Homo sapiens
attgtaatatagaaa

SEQ ID NO: 4756804 - DNA, 14 bp, Homo sapiens
attgtacagtttgt

SEQ ID NO: 4756805 - DNA, 19 bp, Homo sapiens
attgtacagtttgtttaca

SEQ ID NO: 4756806 - DNA, 17 bp, Homo sapiens
attgtacccttcttgtc

SEQ ID NO: 4756807 - DNA, 21 bp, Homo sapiens
attgtacccttcttgtctctc

SEQ ID NO: 4756808 - DNA, 20 bp, Homo sapiens
attgtagagaaaaaaaaata

SEQ ID NO: 4756809 - DNA, 21 bp, Homo sapiens
attgtagagaaaaaaaaatat

SEQ ID NO: 4756810 - DNA, 16 bp, Homo sapiens
attgtataaaacagtg

SEQ ID NO: 4756811 - DNA, 22 bp, Homo sapiens
attgtataaaacagtgtttcca

SEQ ID NO: 4756812 - DNA, 20 bp, Homo sapiens
attgtattatcatatatgct

SEQ ID NO: 4756813 - DNA, 13 bp, Homo sapiens
attgtattcctca

SEQ ID NO: 4756814 - DNA, 15 bp, Homo sapiens
attgtccacaaatgt

SEQ ID NO: 4756815 - DNA, 16 bp, Homo sapiens
attgtccacaaatgtc

SEQ ID NO: 4756816 - DNA, 15 bp, Homo sapiens
attgtccattccaat

SEQ ID NO: 4756817 - DNA, 17 bp, Homo sapiens
attgtccttgtgtatcc

SEQ ID NO: 4756818 - DNA, 21 bp, Homo sapiens
attgtctaaccaattgtgaga

SEQ ID NO: 4756819 - DNA, 21 bp, Homo sapiens
attgtctgaaattttctagaa

SEQ ID NO: 4756820 - DNA, 12 bp, Homo sapiens
attgtctgtaaa

SEQ ID NO: 4756821 - DNA, 13 bp, Homo sapiens
attgtctgtaaat

SEQ ID NO: 4756822 - DNA, 20 bp, Homo sapiens
attgtcttttgtcatgtggc

SEQ ID NO: 4756823 - DNA, 11 bp, Homo sapiens
attgtgccaaa

SEQ ID NO: 4756824 - DNA, 12 bp, Homo sapiens
attgtgccaaag

SEQ ID NO: 4756825 - DNA, 21 bp, Homo sapiens
attgtgccaaagatagcagaa

SEQ ID NO: 4756826 - DNA, 14 bp, Homo sapiens
attgtgctttctat

SEQ ID NO: 4756827 - DNA, 22 bp, Homo sapiens
attgtggctgtcaaatccatgt

SEQ ID NO: 4756828 - DNA, 13 bp, Homo sapiens
attgtgtggagaa

SEQ ID NO: 4756829 - DNA, 21 bp, Homo sapiens
attgtgtggagaagtgtgttc

SEQ ID NO: 4756830 - DNA, 21 bp, Homo sapiens
attgtgttttcttcgtggatt

SEQ ID NO: 4756831 - DNA, 16 bp, Homo sapiens
attgttagtctcttga

SEQ ID NO: 4756832 - DNA, 23 bp, Homo sapiens
attgttcagaaaagcacctcttg

SEQ ID NO: 4756833 - DNA, 21 bp, Homo sapiens
attgttcttgtaaaactgtga

SEQ ID NO: 4756834 - DNA, 22 bp, Homo sapiens
attgtttaagaatcatggattt

SEQ ID NO: 4756835 - DNA, 14 bp, Homo sapiens
attgtttaatgcaa

SEQ ID NO: 4756836 - DNA, 15 bp, Homo sapiens
attgtttaattgtag

SEQ ID NO: 4756837 - DNA, 16 bp, Homo sapiens
attgtttttatatatt

SEQ ID NO: 4756838 - DNA, 19 bp, Homo sapiens
atttaaaaaatgaatagta

SEQ ID NO: 4756839 - DNA, 15 bp, Homo sapiens
atttaaaacaagctg

SEQ ID NO: 4756840 - DNA, 17 bp, Homo sapiens
atttaaaacaagctgat

SEQ ID NO: 4756841 - DNA, 21 bp, Homo sapiens
atttaaaggaaagttctatta

SEQ ID NO: 4756842 - DNA, 13 bp, Homo sapiens
atttaaatgattt

SEQ ID NO: 4756843 - DNA, 16 bp, Homo sapiens
atttaacattcttggt

SEQ ID NO: 4756844 - DNA, 21 bp, Homo sapiens
atgctggccagcaccctctcc

SEQ ID NO: 4756845 - DNA, 22 bp, Homo sapiens
atgctggccagcaccctctcct

SEQ ID NO: 4756846 - DNA, 15 bp, Homo sapiens
atgctggccagcctg

SEQ ID NO: 4756847 - DNA, 17 bp, Homo sapiens
atgctggccagcctggg

SEQ ID NO: 4756848 - DNA, 15 bp, Homo sapiens
atgctgtccctgtgg

SEQ ID NO: 4756849 - DNA, 14 bp, Homo sapiens
atgctgttcattga

SEQ ID NO: 4756850 - DNA, 17 bp, Homo sapiens
atgctgttctcaatcat

SEQ ID NO: 4756851 - DNA, 19 bp, Homo sapiens
atgctgttctcaatcattg

SEQ ID NO: 4756852 - DNA, 17 bp, Homo sapiens
atgctgttggtgagaat

SEQ ID NO: 4756853 - DNA, 12 bp, Homo sapiens
atgcttcttgga

SEQ ID NO: 4756854 - DNA, 13 bp, Homo sapiens
atgctttctcatg

SEQ ID NO: 4756855 - DNA, 23 bp, Homo sapiens
atgctttctcatgcatagacaag

SEQ ID NO: 4756856 - DNA, 16 bp, Homo sapiens
atgctttgatcccttc

SEQ ID NO: 4756857 - DNA, 19 bp, Homo sapiens
atgctttgcagagaactca

SEQ ID NO: 4756858 - DNA, 14 bp, Homo sapiens
atgcttttttgcaa

SEQ ID NO: 4756859 - DNA, 20 bp, Homo sapiens
atggaaagggtgtggcttgg

SEQ ID NO: 4756860 - DNA, 13 bp, Homo sapiens
atggaaatcctgt

SEQ ID NO: 4756861 - DNA, 14 bp, Homo sapiens
atggaacagccctg

SEQ ID NO: 4756862 - DNA, 17 bp, Homo sapiens
atggaaccttccctcca

SEQ ID NO: 4756863 - DNA, 19 bp, Homo sapiens
atggaaccttccctccaaa

SEQ ID NO: 4756864 - DNA, 15 bp, Homo sapiens
atggaagacagctct

SEQ ID NO: 4756865 - DNA, 18 bp, Homo sapiens
atggaagacagctcttat

SEQ ID NO: 4756866 - DNA, 15 bp, Homo sapiens
atggaagagagaaag

SEQ ID NO: 4756867 - DNA, 20 bp, Homo sapiens
atggaagcggtggtcagaag

SEQ ID NO: 4756868 - DNA, 18 bp, Homo sapiens
atggacagttcacaccct

SEQ ID NO: 4756869 - DNA, 21 bp, Homo sapiens
atggacagttcacaccctgca

SEQ ID NO: 4756870 - DNA, 22 bp, Homo sapiens
atggacagttcacaccctgcaa

SEQ ID NO: 4756871 - DNA, 17 bp, Homo sapiens
atggaccaaatgtaaaa

SEQ ID NO: 4756872 - DNA, 20 bp, Homo sapiens
atggacgagtgagctaccag

SEQ ID NO: 4756873 - DNA, 19 bp, Homo sapiens
atggacgtgttatgactcc

SEQ ID NO: 4756874 - DNA, 12 bp, Homo sapiens
atggactgcaca

SEQ ID NO: 4756875 - DNA, 13 bp, Homo sapiens
atggactgcacaa

SEQ ID NO: 4756876 - DNA, 12 bp, Homo sapiens
atggacttgctt

SEQ ID NO: 4756877 - DNA, 12 bp, Homo sapiens
atggagaaggaa

SEQ ID NO: 4756878 - DNA, 15 bp, Homo sapiens
atggagaaggaaggc

SEQ ID NO: 4756879 - DNA, 20 bp, Homo sapiens
atggagaggcggcctcgtgc

SEQ ID NO: 4756880 - DNA, 21 bp, Homo sapiens
atggagcctggcacaggactg

SEQ ID NO: 4756881 - DNA, 17 bp, Homo sapiens
atggatgacaaagaaaa

SEQ ID NO: 4756882 - DNA, 20 bp, Homo sapiens
atggatgattcttttcccat

SEQ ID NO: 4756883 - DNA, 14 bp, Homo sapiens
atggattcacttct

SEQ ID NO: 4756884 - DNA, 24 bp, Homo sapiens
atggatttattttttgtaactctt

SEQ ID NO: 4756885 - DNA, 20 bp, Homo sapiens
atggcaacgttcatgttcat

SEQ ID NO: 4756886 - DNA, 14 bp, Homo sapiens
atggcatattgata

SEQ ID NO: 4756887 - DNA, 16 bp, Homo sapiens
atggcatttagcacag

SEQ ID NO: 4756888 - DNA, 13 bp, Homo sapiens
atggccccagctg

SEQ ID NO: 4756889 - DNA, 14 bp, Homo sapiens
atggccccagctgg

SEQ ID NO: 4756890 - DNA, 16 bp, Homo sapiens
atggccccagctggct

SEQ ID NO: 4756891 - DNA, 20 bp, Homo sapiens
atggccccagctggctgggt

SEQ ID NO: 4756892 - DNA, 14 bp, Homo sapiens
atggccctgtagct

SEQ ID NO: 4756893 - DNA, 17 bp, Homo sapiens
atggccctgtagctctg

SEQ ID NO: 4756894 - DNA, 14 bp, Homo sapiens
atggcctcccagcc

SEQ ID NO: 4756895 - DNA, 19 bp, Homo sapiens
atggcctcttaaaaattat

SEQ ID NO: 4756896 - DNA, 21 bp, Homo sapiens
atggcctgtccctagggctct

SEQ ID NO: 4756897 - DNA, 14 bp, Homo sapiens
atggctattaacaa

SEQ ID NO: 4756898 - DNA, 22 bp, Homo sapiens
atggctattaacaattaattgt

SEQ ID NO: 4756899 - DNA, 18 bp, Homo sapiens
atggctctgggctatatg

SEQ ID NO: 4756900 - DNA, 19 bp, Homo sapiens
atggctgaagaaacacagc

SEQ ID NO: 4756901 - DNA, 20 bp, Homo sapiens
atggctgaagaaacacagca

SEQ ID NO: 4756902 - DNA, 21 bp, Homo sapiens
atggctgaagaaacacagcat

SEQ ID NO: 4756903 - DNA, 23 bp, Homo sapiens
atggctgaagaaacacagcatgc

SEQ ID NO: 4756904 - DNA, 22 bp, Homo sapiens
atggctggatgtgcatctggcc

SEQ ID NO: 4756905 - DNA, 23 bp, Homo sapiens
atggctggatgtgcatctggcct

SEQ ID NO: 4756906 - DNA, 12 bp, Homo sapiens
atggctgtattt

SEQ ID NO: 4756907 - DNA, 21 bp, Homo sapiens
atggcttccccattgccttct

SEQ ID NO: 4756908 - DNA, 18 bp, Homo sapiens
atggcttgtagggtgagg

SEQ ID NO: 4756909 - DNA, 11 bp, Homo sapiens
atgggaccagg

SEQ ID NO: 4756910 - DNA, 20 bp, Homo sapiens
atgggagattaaaaccagag

SEQ ID NO: 4756911 - DNA, 15 bp, Homo sapiens
atgggatcctggagt

SEQ ID NO: 4756912 - DNA, 20 bp, Homo sapiens
atgggcaaggggccaggaag

SEQ ID NO: 4756913 - DNA, 23 bp, Homo sapiens
atgggcaaggggccaggaagggg

SEQ ID NO: 4756914 - DNA, 15 bp, Homo sapiens
atgggccaagccagg

SEQ ID NO: 4756915 - DNA, 15 bp, Homo sapiens
atgggctcaggatct

SEQ ID NO: 4756916 - DNA, 21 bp, Homo sapiens
atgggctgcaaaatgaagaca

SEQ ID NO: 4756917 - DNA, 17 bp, Homo sapiens
atggggcggcctgcaga

SEQ ID NO: 4756918 - DNA, 18 bp, Homo sapiens
atgggggatgggccaggg

SEQ ID NO: 4756919 - DNA, 13 bp, Homo sapiens
atgggggcctctc

SEQ ID NO: 4756920 - DNA, 16 bp, Homo sapiens
atgggtaaataaatgc

SEQ ID NO: 4756921 - DNA, 22 bp, Homo sapiens
atgggtaaataaatgctgcttt

SEQ ID NO: 4756922 - DNA, 18 bp, Homo sapiens
atgggtatcatgcttcta

SEQ ID NO: 4756923 - DNA, 13 bp, Homo sapiens
atgggtgattatg

SEQ ID NO: 4756924 - DNA, 15 bp, Homo sapiens
atgggtgattatgaa

SEQ ID NO: 4756925 - DNA, 21 bp, Homo sapiens
atgggtgattatgaaatgcca

SEQ ID NO: 4756926 - DNA, 20 bp, Homo sapiens
atggtaccagccctggggct

SEQ ID NO: 4756927 - DNA, 22 bp, Homo sapiens
atggtacctctgtctataggac

SEQ ID NO: 4756928 - DNA, 13 bp, Homo sapiens
atggtagaaaaat

SEQ ID NO: 4756929 - DNA, 15 bp, Homo sapiens
atggtagactgtgac

SEQ ID NO: 4756930 - DNA, 16 bp, Homo sapiens
atggtagactgtgaca

SEQ ID NO: 4756931 - DNA, 18 bp, Homo sapiens
atggtagctctgaaggga

SEQ ID NO: 4756932 - DNA, 13 bp, Homo sapiens
atggtatatattt

SEQ ID NO: 4756933 - DNA, 13 bp, Homo sapiens
atggtatctcttt

SEQ ID NO: 4756934 - DNA, 15 bp, Homo sapiens
atggtatgctggcca

SEQ ID NO: 4756935 - DNA, 12 bp, Homo sapiens
atggtattttcg

SEQ ID NO: 4756936 - DNA, 19 bp, Homo sapiens
atggtattttcgtgcattt

SEQ ID NO: 4756937 - DNA, 21 bp, Homo sapiens
atggtattttcgtgcatttgt

SEQ ID NO: 4756938 - DNA, 18 bp, Homo sapiens
atggtattttttgtgaat

SEQ ID NO: 4756939 - DNA, 13 bp, Homo sapiens
atggtcacagacc

SEQ ID NO: 4756940 - DNA, 15 bp, Homo sapiens
atggtcacagacccc

SEQ ID NO: 4756941 - DNA, 15 bp, Homo sapiens
atggtgatactccaa

SEQ ID NO: 4756942 - DNA, 18 bp, Homo sapiens
atggtgatactccaaggt

SEQ ID NO: 4756943 - DNA, 15 bp, Homo sapiens
atggtgggctccaga

SEQ ID NO: 4756944 - DNA, 17 bp, Homo sapiens
atggtggtttcagaaag

SEQ ID NO: 4756945 - DNA, 19 bp, Homo sapiens
atggtggtttcagaaaggg

SEQ ID NO: 4756946 - DNA, 16 bp, Homo sapiens
atggtgtcctgcatgt

SEQ ID NO: 4756947 - DNA, 17 bp, Homo sapiens
atggtgtcctgcatgta

SEQ ID NO: 4756948 - DNA, 16 bp, Homo sapiens
atggtgttttcatgta

SEQ ID NO: 4756949 - DNA, 21 bp, Homo sapiens
atggtgttttcatgtaaataa

SEQ ID NO: 4756950 - DNA, 22 bp, Homo sapiens
atggttgcaaagtgttgtctta

SEQ ID NO: 4756951 - DNA, 23 bp, Homo sapiens
atggttgcaaagtgttgtcttat

SEQ ID NO: 4756952 - DNA, 17 bp, Homo sapiens
atggttggttagtgcat

SEQ ID NO: 4756953 - DNA, 23 bp, Homo sapiens
atggttggttagtgcatgtcaca

SEQ ID NO: 4756954 - DNA, 14 bp, Homo sapiens
atgtaaaatattta

SEQ ID NO: 4756955 - DNA, 15 bp, Homo sapiens
atgtaaaatatttat

SEQ ID NO: 4756956 - DNA, 22 bp, Homo sapiens
atgtaacttaattataagctat

SEQ ID NO: 4756957 - DNA, 20 bp, Homo sapiens
atgtaatacaccaaatagct

SEQ ID NO: 4756958 - DNA, 13 bp, Homo sapiens
atgtaatatatac

SEQ ID NO: 4756959 - DNA, 19 bp, Homo sapiens
atgtaatatatacatattc

SEQ ID NO: 4756960 - DNA, 20 bp, Homo sapiens
atgtacaggctgagacacag

SEQ ID NO: 4756961 - DNA, 14 bp, Homo sapiens
atgtacccagccta

SEQ ID NO: 4756962 - DNA, 16 bp, Homo sapiens
atgtactacatttgca

SEQ ID NO: 4756963 - DNA, 20 bp, Homo sapiens
atgtagcaaattccaataca

SEQ ID NO: 4756964 - DNA, 17 bp, Homo sapiens
cgggctctctcacccag

SEQ ID NO: 4756965 - DNA, 14 bp, Homo sapiens
cggggactcagccc

SEQ ID NO: 4756966 - DNA, 14 bp, Homo sapiens
cggggcagagctga

SEQ ID NO: 4756967 - DNA, 15 bp, Homo sapiens
cggggcagagctgag

SEQ ID NO: 4756968 - DNA, 20 bp, Homo sapiens
cggggcccgccccaggcccc

SEQ ID NO: 4756969 - DNA, 15 bp, Homo sapiens
cggggcctgggtccc

SEQ ID NO: 4756970 - DNA, 23 bp, Homo sapiens
cggggctggccctgccctccccc

SEQ ID NO: 4756971 - DNA, 22 bp, Homo sapiens
cggggctgtgcgggcgcccgga

SEQ ID NO: 4756972 - DNA, 12 bp, Homo sapiens
cggggcttctgg

SEQ ID NO: 4756973 - DNA, 15 bp, Homo sapiens
cggggcttctgggcg

SEQ ID NO: 4756974 - DNA, 16 bp, Homo sapiens
cggggcttctgggcgc

SEQ ID NO: 4756975 - DNA, 16 bp, Homo sapiens
cgggggaggagcaccc

SEQ ID NO: 4756976 - DNA, 17 bp, Homo sapiens
cgggggaggagcacccc

SEQ ID NO: 4756977 - DNA, 18 bp, Homo sapiens
cgggggaggagcaccccc

SEQ ID NO: 4756978 - DNA, 19 bp, Homo sapiens
cgggggaggagcaccccca

SEQ ID NO: 4756979 - DNA, 23 bp, Homo sapiens
cgggggaggagcacccccagcct

SEQ ID NO: 4756980 - DNA, 24 bp, Homo sapiens
cgggggaggagcacccccagcctc

SEQ ID NO: 4756981 - DNA, 15 bp, Homo sapiens
cgggggcagagaggg

SEQ ID NO: 4756982 - DNA, 16 bp, Homo sapiens
cgggggcggctctggg

SEQ ID NO: 4756983 - DNA, 17 bp, Homo sapiens
cgggggctaactggccc

SEQ ID NO: 4756984 - DNA, 22 bp, Homo sapiens
cgggggtccccggacgctggct

SEQ ID NO: 4756985 - DNA, 19 bp, Homo sapiens
cggggtgcccgtgtggcct

SEQ ID NO: 4756986 - DNA, 19 bp, Homo sapiens
cggggtggagtcagggctg

SEQ ID NO: 4756987 - DNA, 16 bp, Homo sapiens
cgggtctgtgggactg

SEQ ID NO: 4756988 - DNA, 20 bp, Homo sapiens
caaatcattttgatgtatta

SEQ ID NO: 4756989 - DNA, 22 bp, Homo sapiens
caaatcattttgatgtattatt

SEQ ID NO: 4756990 - DNA, 23 bp, Homo sapiens
caaatcattttgatgtattatta

SEQ ID NO: 4756991 - DNA, 22 bp, Homo sapiens
caaatccataccccctgcccca

SEQ ID NO: 4756992 - DNA, 16 bp, Homo sapiens
caaatccatgtgtccc

SEQ ID NO: 4756993 - DNA, 14 bp, Homo sapiens
caaatgaaggaatg

SEQ ID NO: 4756994 - DNA, 15 bp, Homo sapiens
caaatgacatgcact

SEQ ID NO: 4756995 - DNA, 17 bp, Homo sapiens
caaatgacatgcactga

SEQ ID NO: 4756996 - DNA, 18 bp, Homo sapiens
caaatgacatgcactgac

SEQ ID NO: 4756997 - DNA, 19 bp, Homo sapiens
caaatgacatgcactgacc

SEQ ID NO: 4756998 - DNA, 20 bp, Homo sapiens
caaatgacatgcactgaccc

SEQ ID NO: 4756999 - DNA, 11 bp, Homo sapiens
caaatgcagtg

SEQ ID NO: 4757000 - DNA, 22 bp, Homo sapiens
caaatgcagtgtatttaatgtt

SEQ ID NO: 4757001 - DNA, 18 bp, Homo sapiens
caaatggatgtaatatag

SEQ ID NO: 4757002 - DNA, 21 bp, Homo sapiens
caaatggtattttttgtgaat

SEQ ID NO: 4757003 - DNA, 15 bp, Homo sapiens
caaatgtaaaatatt

SEQ ID NO: 4757004 - DNA, 16 bp, Homo sapiens
caaatgtaaaatattt

SEQ ID NO: 4757005 - DNA, 17 bp, Homo sapiens
caaatgtaaaatattta

SEQ ID NO: 4757006 - DNA, 18 bp, Homo sapiens
caaatgtaaaatatttat

SEQ ID NO: 4757007 - DNA, 17 bp, Homo sapiens
caaatgtacccagccta

SEQ ID NO: 4757008 - DNA, 23 bp, Homo sapiens
caaatgtccaagcatcagcaaga

SEQ ID NO: 4757009 - DNA, 15 bp, Homo sapiens
caaatgtcctcagag

SEQ ID NO: 4757010 - DNA, 18 bp, Homo sapiens
caaattcagtggacattt

SEQ ID NO: 4757011 - DNA, 15 bp, Homo sapiens
caaattccaatacat

SEQ ID NO: 4757012 - DNA, 13 bp, Homo sapiens
caaattccttccc

SEQ ID NO: 4757013 - DNA, 12 bp, Homo sapiens
caaattctgatt

SEQ ID NO: 4757014 - DNA, 19 bp, Homo sapiens
caaattctgattattacaa

SEQ ID NO: 4757015 - DNA, 16 bp, Homo sapiens
caaattcttgaataaa

SEQ ID NO: 4757016 - DNA, 22 bp, Homo sapiens
caaattcttgaataaactcccc

SEQ ID NO: 4757017 - DNA, 13 bp, Homo sapiens
caaattgctgaga

SEQ ID NO: 4757018 - DNA, 17 bp, Homo sapiens
caaattggtgtttctga

SEQ ID NO: 4757019 - DNA, 14 bp, Homo sapiens
caaatttatttcca

SEQ ID NO: 4757020 - DNA, 15 bp, Homo sapiens
caaatttttactcag

SEQ ID NO: 4757021 - DNA, 20 bp, Homo sapiens
caaatttttactcaggcttt

SEQ ID NO: 4757022 - DNA, 19 bp, Homo sapiens
caaatttttctgggaagaa

SEQ ID NO: 4757023 - DNA, 13 bp, Homo sapiens
caacaaagaaata

SEQ ID NO: 4757024 - DNA, 14 bp, Homo sapiens
caacaaagcatgct

SEQ ID NO: 4757025 - DNA, 22 bp, Homo sapiens
caacaaagcatgctcagtattg

SEQ ID NO: 4757026 - DNA, 13 bp, Homo sapiens
caacaacaaagca

SEQ ID NO: 4757027 - DNA, 22 bp, Homo sapiens
caacaacagtcagccagcttgg

SEQ ID NO: 4757028 - DNA, 18 bp, Homo sapiens
caacaatactttgtgtct

SEQ ID NO: 4757029 - DNA, 22 bp, Homo sapiens
caacaatttaggaatgctcaat

SEQ ID NO: 4757030 - DNA, 21 bp, Homo sapiens
caacacacacacacacaaaac

SEQ ID NO: 4757031 - DNA, 20 bp, Homo sapiens
caacacattgaaactgtatt

SEQ ID NO: 4757032 - DNA, 13 bp, Homo sapiens
caacacctgccgt

SEQ ID NO: 4757033 - DNA, 22 bp, Homo sapiens
caacactgccaaacatcagtca

SEQ ID NO: 4757034 - DNA, 21 bp, Homo sapiens
caacagagtggactcttccct

SEQ ID NO: 4757035 - DNA, 21 bp, Homo sapiens
caacaggctgttctgcactga

SEQ ID NO: 4757036 - DNA, 24 bp, Homo sapiens
caacaggctgttctgcactgaaaa

SEQ ID NO: 4757037 - DNA, 15 bp, Homo sapiens
caacaggttttcctg

SEQ ID NO: 4757038 - DNA, 19 bp, Homo sapiens
caacaggttttcctgaaga

SEQ ID NO: 4757039 - DNA, 19 bp, Homo sapiens
caacagtcagccagcttgg

SEQ ID NO: 4757040 - DNA, 12 bp, Homo sapiens
caacatgcacat

SEQ ID NO: 4757041 - DNA, 9 bp, Homo sapiens
caacatgtg

SEQ ID NO: 4757042 - DNA, 19 bp, Homo sapiens
caaccaggctacagttgat

SEQ ID NO: 4757043 - DNA, 14 bp, Homo sapiens
caaccattgaaggg

SEQ ID NO: 4757044 - DNA, 17 bp, Homo sapiens
caacccaggattcaaca

SEQ ID NO: 4757045 - DNA, 17 bp, Homo sapiens
caacccaggtgttgtcc

SEQ ID NO: 4757046 - DNA, 13 bp, Homo sapiens
caacccccacctc

SEQ ID NO: 4757047 - DNA, 14 bp, Homo sapiens
caacccccacctcc

SEQ ID NO: 4757048 - DNA, 13 bp, Homo sapiens
caaccctgccctg

SEQ ID NO: 4757049 - DNA, 14 bp, Homo sapiens
caaccctgccctgc

SEQ ID NO: 4757050 - DNA, 13 bp, Homo sapiens
caacccttgctga

SEQ ID NO: 4757051 - DNA, 16 bp, Homo sapiens
caaccgggaaaggcat

SEQ ID NO: 4757052 - DNA, 20 bp, Homo sapiens
caacctcccctggtcctgca

SEQ ID NO: 4757053 - DNA, 16 bp, Homo sapiens
caacctctcagatccc

SEQ ID NO: 4757054 - DNA, 20 bp, Homo sapiens
caacctctgcctcccaggtt

SEQ ID NO: 4757055 - DNA, 18 bp, Homo sapiens
caacctgaattaaagtct

SEQ ID NO: 4757056 - DNA, 16 bp, Homo sapiens
caacctggaggctgga

SEQ ID NO: 4757057 - DNA, 14 bp, Homo sapiens
caacctggtggcac

SEQ ID NO: 4757058 - DNA, 22 bp, Homo sapiens
caacctggtggcaccagatgca

SEQ ID NO: 4757059 - DNA, 13 bp, Homo sapiens
caaccttcattta

SEQ ID NO: 4757060 - DNA, 14 bp, Homo sapiens
caacgcacaggaaa

SEQ ID NO: 4757061 - DNA, 17 bp, Homo sapiens
caactaacaatgccttg

SEQ ID NO: 4757062 - DNA, 15 bp, Homo sapiens
caactaagttgtatt

SEQ ID NO: 4757063 - DNA, 18 bp, Homo sapiens
caactatttctttcatca

SEQ ID NO: 4757064 - DNA, 19 bp, Homo sapiens
caactatttctttcatcag

SEQ ID NO: 4757065 - DNA, 21 bp, Homo sapiens
caactcatccagaactgtctt

SEQ ID NO: 4757066 - DNA, 13 bp, Homo sapiens
caactccaaggca

SEQ ID NO: 4757067 - DNA, 14 bp, Homo sapiens
caactccaaggcaa

SEQ ID NO: 4757068 - DNA, 15 bp, Homo sapiens
caactccaaggcaaa

SEQ ID NO: 4757069 - DNA, 16 bp, Homo sapiens
caactccaaggcaaat

SEQ ID NO: 4757070 - DNA, 19 bp, Homo sapiens
caactccaaggcaaatgtc

SEQ ID NO: 4757071 - DNA, 18 bp, Homo sapiens
caactccaggaaaactgt

SEQ ID NO: 4757072 - DNA, 23 bp, Homo sapiens
caactccagggttaaagaaaggc

SEQ ID NO: 4757073 - DNA, 13 bp, Homo sapiens
caactctgactgt

SEQ ID NO: 4757074 - DNA, 11 bp, Homo sapiens
caactctggcc

SEQ ID NO: 4757075 - DNA, 14 bp, Homo sapiens
caactgactgactt

SEQ ID NO: 4757076 - DNA, 15 bp, Homo sapiens
caactgctaatctac

SEQ ID NO: 4757077 - DNA, 22 bp, Homo sapiens
caactgctgcttaaaatgcaag

SEQ ID NO: 4757078 - DNA, 18 bp, Homo sapiens
caactggaaggctttatt

SEQ ID NO: 4757079 - DNA, 14 bp, Homo sapiens
caactgtggataaa

SEQ ID NO: 4757080 - DNA, 23 bp, Homo sapiens
caactgtggtcccagctacaggg

SEQ ID NO: 4757081 - DNA, 19 bp, Homo sapiens
caactgttggataataact

SEQ ID NO: 4757082 - DNA, 22 bp, Homo sapiens
caactgtttttgaagaagggaa

SEQ ID NO: 4757083 - DNA, 18 bp, Homo sapiens
caacttaaacctgtgctt

SEQ ID NO: 4757084 - DNA, 21 bp, Homo sapiens
caacttaatgaagaaatacag

SEQ ID NO: 4757085 - DNA, 14 bp, Homo sapiens
caacttcagtcctg

SEQ ID NO: 4757086 - DNA, 17 bp, Homo sapiens
caacttcagtcctggga

SEQ ID NO: 4757087 - DNA, 14 bp, Homo sapiens
cgcgctctgcccct

SEQ ID NO: 4757088 - DNA, 17 bp, Homo sapiens
cgcgctctgcccctccg

SEQ ID NO: 4757089 - DNA, 15 bp, Homo sapiens
cgcggagcccccgcc

SEQ ID NO: 4757090 - DNA, 12 bp, Homo sapiens
cgcggaggcccc

SEQ ID NO: 4757091 - DNA, 23 bp, Homo sapiens
cgcgggacaggacttgtgcgccg

SEQ ID NO: 4757092 - DNA, 20 bp, Homo sapiens
cgcgggtggctggagcccca

SEQ ID NO: 4757093 - DNA, 22 bp, Homo sapiens
cgcgggtggctggagccccatc

SEQ ID NO: 4757094 - DNA, 18 bp, Homo sapiens
cgcgtcctttcctctcct

SEQ ID NO: 4757095 - DNA, 14 bp, Homo sapiens
cgcgtgcccccagc

SEQ ID NO: 4757096 - DNA, 15 bp, Homo sapiens
cgcgtgcccccagcg

SEQ ID NO: 4757097 - DNA, 16 bp, Homo sapiens
cgcgtgcccccagcgt

SEQ ID NO: 4757098 - DNA, 14 bp, Homo sapiens
cgcgtgccttcccc

SEQ ID NO: 4757099 - DNA, 22 bp, Homo sapiens
cgcgttcgcggcggtgggcgcc

SEQ ID NO: 4757100 - DNA, 22 bp, Homo sapiens
cgctagagcattctggggtggg

SEQ ID NO: 4757101 - DNA, 15 bp, Homo sapiens
cgctatccacagaac

SEQ ID NO: 4757102 - DNA, 14 bp, Homo sapiens
cgctattcccaggc

SEQ ID NO: 4757103 - DNA, 16 bp, Homo sapiens
cgctattcccaggcag

SEQ ID NO: 4757104 - DNA, 15 bp, Homo sapiens
cgctcaacctctcag

SEQ ID NO: 4757105 - DNA, 23 bp, Homo sapiens
cgctccgggtgcgtgaccggccc

SEQ ID NO: 4757106 - DNA, 13 bp, Homo sapiens
cgctcctcccagc

SEQ ID NO: 4757107 - DNA, 12 bp, Homo sapiens
ctcgggccgcct

SEQ ID NO: 4757108 - DNA, 20 bp, Homo sapiens
ctcgggccgcctcctccaga

SEQ ID NO: 4757109 - DNA, 20 bp, Homo sapiens
ctcgggcgcctgcgctcctc

SEQ ID NO: 4757110 - DNA, 17 bp, Homo sapiens
ctcgggctctctcaccc

SEQ ID NO: 4757111 - DNA, 14 bp, Homo sapiens
ctcgggtgcatttg

SEQ ID NO: 4757112 - DNA, 14 bp, Homo sapiens
ctcggtcagcaccg

SEQ ID NO: 4757113 - DNA, 22 bp, Homo sapiens
ctcgtcccgagggcgcctgggt

SEQ ID NO: 4757114 - DNA, 23 bp, Homo sapiens
ctcgtcccgagggcgcctgggtc

SEQ ID NO: 4757115 - DNA, 13 bp, Homo sapiens
ctcgtccggcctg

SEQ ID NO: 4757116 - DNA, 14 bp, Homo sapiens
ctcgtccggcctgc

SEQ ID NO: 4757117 - DNA, 20 bp, Homo sapiens
ctcgtccggcctgcagccca

SEQ ID NO: 4757118 - DNA, 13 bp, Homo sapiens
ctcgtgtgcatga

SEQ ID NO: 4757119 - DNA, 14 bp, Homo sapiens
ctcgtgtttcacag

SEQ ID NO: 4757120 - DNA, 21 bp, Homo sapiens
ctctaactgtatatttgtatg

SEQ ID NO: 4757121 - DNA, 13 bp, Homo sapiens
ctctaagaattca

SEQ ID NO: 4757122 - DNA, 16 bp, Homo sapiens
ctctaagacaaatgca

SEQ ID NO: 4757123 - DNA, 22 bp, Homo sapiens
ctctaataacctttatctaaat

SEQ ID NO: 4757124 - DNA, 13 bp, Homo sapiens
ctctactttccag

SEQ ID NO: 4757125 - DNA, 18 bp, Homo sapiens
ctctagggttgctggagc

SEQ ID NO: 4757126 - DNA, 13 bp, Homo sapiens
ctctagtgcagga

SEQ ID NO: 4757127 - DNA, 14 bp, Homo sapiens
ctctagttgacttc

SEQ ID NO: 4757128 - DNA, 19 bp, Homo sapiens
ctctagttgacttcaaatg

SEQ ID NO: 4757129 - DNA, 20 bp, Homo sapiens
ctctagttgacttcaaatgt

SEQ ID NO: 4757130 - DNA, 22 bp, Homo sapiens
ctctatataaaaaatatatgta

SEQ ID NO: 4757131 - DNA, 17 bp, Homo sapiens
ctctatctgggcctggg

SEQ ID NO: 4757132 - DNA, 21 bp, Homo sapiens
ctctcaatagcaaaagtgatg

SEQ ID NO: 4757133 - DNA, 14 bp, Homo sapiens
ctctcacacacata

SEQ ID NO: 4757134 - DNA, 18 bp, Homo sapiens
ctctcagatccctcggtc

SEQ ID NO: 4757135 - DNA, 23 bp, Homo sapiens
ctctcagatccctcggtcagcac

SEQ ID NO: 4757136 - DNA, 20 bp, Homo sapiens
ctctcaggaccaccctgcca

SEQ ID NO: 4757137 - DNA, 23 bp, Homo sapiens
ctctcaggccaaactcacctgcc

SEQ ID NO: 4757138 - DNA, 15 bp, Homo sapiens
ctctcaggccagctg

SEQ ID NO: 4757139 - DNA, 19 bp, Homo sapiens
ctctcaggccagctgcttg

SEQ ID NO: 4757140 - DNA, 16 bp, Homo sapiens
ctctcatggcttgggc

SEQ ID NO: 4757141 - DNA, 12 bp, Homo sapiens
ctctcattccca

SEQ ID NO: 4757142 - DNA, 14 bp, Homo sapiens
ctctcattcccagg

SEQ ID NO: 4757143 - DNA, 20 bp, Homo sapiens
ctctccaagcactagccttc

SEQ ID NO: 4757144 - DNA, 13 bp, Homo sapiens
ctctccacggtag

SEQ ID NO: 4757145 - DNA, 19 bp, Homo sapiens
ctctccaggattgtccaca

SEQ ID NO: 4757146 - DNA, 20 bp, Homo sapiens
ctctccctaccctcttctca

SEQ ID NO: 4757147 - DNA, 21 bp, Homo sapiens
ctctccctaccctcttctcag

SEQ ID NO: 4757148 - DNA, 12 bp, Homo sapiens
ctctccctccac

SEQ ID NO: 4757149 - DNA, 18 bp, Homo sapiens
ctctccctccactcctcc

SEQ ID NO: 4757150 - DNA, 20 bp, Homo sapiens
ctctccctccactcctccca

SEQ ID NO: 4757151 - DNA, 16 bp, Homo sapiens
ctctccgccccggaca

SEQ ID NO: 4757152 - DNA, 23 bp, Homo sapiens
ctctccggatggaatcacagcca

SEQ ID NO: 4757153 - DNA, 15 bp, Homo sapiens
ctctcctccagagtc

SEQ ID NO: 4757154 - DNA, 16 bp, Homo sapiens
ctctcctccagagtca

SEQ ID NO: 4757155 - DNA, 13 bp, Homo sapiens
ctctcctccagcc

SEQ ID NO: 4757156 - DNA, 17 bp, Homo sapiens
ctctcctccagccctgg

SEQ ID NO: 4757157 - DNA, 18 bp, Homo sapiens
ctctcctcggtggcattt

SEQ ID NO: 4757158 - DNA, 12 bp, Homo sapiens
ctctcctcgtcc

SEQ ID NO: 4757159 - DNA, 22 bp, Homo sapiens
ctctcctcgtccggcctgcagc

SEQ ID NO: 4757160 - DNA, 17 bp, Homo sapiens
ctctcctctctctccct

SEQ ID NO: 4757161 - DNA, 12 bp, Homo sapiens
ctctcctctctg

SEQ ID NO: 4757162 - DNA, 20 bp, Homo sapiens
ctctcctgggggtggcaggc

SEQ ID NO: 4757163 - DNA, 23 bp, Homo sapiens
ctctcctgggggtggcaggcaca

SEQ ID NO: 4757164 - DNA, 20 bp, Homo sapiens
ctctctaaacccaaataaat

SEQ ID NO: 4757165 - DNA, 18 bp, Homo sapiens
ctctctaagaattcagta

SEQ ID NO: 4757166 - DNA, 20 bp, Homo sapiens
ctctctaagacaaatgcagt

SEQ ID NO: 4757167 - DNA, 14 bp, Homo sapiens
ctctctagtgcagg

SEQ ID NO: 4757168 - DNA, 16 bp, Homo sapiens
ctctctatatatacat

SEQ ID NO: 4757169 - DNA, 14 bp, Homo sapiens
ctctctccctccac

SEQ ID NO: 4757170 - DNA, 12 bp, Homo sapiens
ctctctctccca

SEQ ID NO: 4757171 - DNA, 12 bp, Homo sapiens
ctctctctccct

SEQ ID NO: 4757172 - DNA, 16 bp, Homo sapiens
ctctctctccctccac

SEQ ID NO: 4757173 - DNA, 10 bp, Homo sapiens
ctctctctct

SEQ ID NO: 4757174 - DNA, 14 bp, Homo sapiens
ctctctctctctgt

SEQ ID NO: 4757175 - DNA, 15 bp, Homo sapiens
ctctctctctctgtt

SEQ ID NO: 4757176 - DNA, 11 bp, Homo sapiens
ctctctctctg

SEQ ID NO: 4757177 - DNA, 20 bp, Homo sapiens
ctctctgaactgcaacactg

SEQ ID NO: 4757178 - DNA, 22 bp, Homo sapiens
ctctctggaaggttttgcttct

SEQ ID NO: 4757179 - DNA, 22 bp, Homo sapiens
ctctctggacctgaccagactg

SEQ ID NO: 4757180 - DNA, 17 bp, Homo sapiens
ctctctggcctcccacc

SEQ ID NO: 4757181 - DNA, 19 bp, Homo sapiens
ctctctggggccctgggcc

SEQ ID NO: 4757182 - DNA, 13 bp, Homo sapiens
ctctctgtgtggc

SEQ ID NO: 4757183 - DNA, 16 bp, Homo sapiens
ctctcttaccccgtcc

SEQ ID NO: 4757184 - DNA, 19 bp, Homo sapiens
ctctcttcggtggccttga

SEQ ID NO: 4757185 - DNA, 15 bp, Homo sapiens
ctctcttttttgggg

SEQ ID NO: 4757186 - DNA, 18 bp, Homo sapiens
ctctgaactgcaacactg

SEQ ID NO: 4757187 - DNA, 15 bp, Homo sapiens
ctctgaagggagggg

SEQ ID NO: 4757188 - DNA, 15 bp, Homo sapiens
ctctgaagtcccttc

SEQ ID NO: 4757189 - DNA, 17 bp, Homo sapiens
ctctgaagttggacagc

SEQ ID NO: 4757190 - DNA, 15 bp, Homo sapiens
ctctgaatctctcaa

SEQ ID NO: 4757191 - DNA, 22 bp, Homo sapiens
ctctgaatctctcaaaatgtgc

SEQ ID NO: 4757192 - DNA, 17 bp, Homo sapiens
ctctgaatgctatttgt

SEQ ID NO: 4757193 - DNA, 19 bp, Homo sapiens
ctctgaatgctatttgtgt

SEQ ID NO: 4757194 - DNA, 20 bp, Homo sapiens
ctctgaatttgtcgggttct

SEQ ID NO: 4757195 - DNA, 19 bp, Homo sapiens
ctctgacaagggctgacct

SEQ ID NO: 4757196 - DNA, 18 bp, Homo sapiens
ctctgagactaaatgaga

SEQ ID NO: 4757197 - DNA, 22 bp, Homo sapiens
ctctgagcagacagggcgtcct

SEQ ID NO: 4757198 - DNA, 18 bp, Homo sapiens
ctctgagcagtggggagc

SEQ ID NO: 4757199 - DNA, 19 bp, Homo sapiens
ctctgaggatgatgtactt

SEQ ID NO: 4757200 - DNA, 15 bp, Homo sapiens
ctctgatatgggact

SEQ ID NO: 4757201 - DNA, 21 bp, Homo sapiens
ctctgatggcacttttgagct

SEQ ID NO: 4757202 - DNA, 12 bp, Homo sapiens
ctctgcagcctg

SEQ ID NO: 4757203 - DNA, 13 bp, Homo sapiens
ctctgcagcctga

SEQ ID NO: 4757204 - DNA, 14 bp, Homo sapiens
ctctgcagcctgag

SEQ ID NO: 4757205 - DNA, 18 bp, Homo sapiens
ctctgcagcctgagctcc

SEQ ID NO: 4757206 - DNA, 20 bp, Homo sapiens
ctctgcagtcctcggcagct

SEQ ID NO: 4757207 - DNA, 13 bp, Homo sapiens
ctctgcatgatta

SEQ ID NO: 4757208 - DNA, 14 bp, Homo sapiens
ctctgccacactct

SEQ ID NO: 4757209 - DNA, 13 bp, Homo sapiens
ctctgccagggca

SEQ ID NO: 4757210 - DNA, 15 bp, Homo sapiens
ctctgccagggcagt

SEQ ID NO: 4757211 - DNA, 21 bp, Homo sapiens
ctctgccccctcccccgcaga

SEQ ID NO: 4757212 - DNA, 13 bp, Homo sapiens
ctctgcccctccg

SEQ ID NO: 4757213 - DNA, 19 bp, Homo sapiens
ctctgcccctcttccctgg

SEQ ID NO: 4757214 - DNA, 19 bp, Homo sapiens
ctctgccggtcccccatgc

SEQ ID NO: 4757215 - DNA, 22 bp, Homo sapiens
ctctgccggtggggccagcgct

SEQ ID NO: 4757216 - DNA, 19 bp, Homo sapiens
ctctgcgacgatccccatg

SEQ ID NO: 4757217 - DNA, 13 bp, Homo sapiens
ctctgcgccccag

SEQ ID NO: 4757218 - DNA, 17 bp, Homo sapiens
ctctgctcatctacaca

SEQ ID NO: 4757219 - DNA, 16 bp, Homo sapiens
ctctgctggtcttcaa

SEQ ID NO: 4757220 - DNA, 17 bp, Homo sapiens
ctctgctggtcttcaat

SEQ ID NO: 4757221 - DNA, 15 bp, Homo sapiens
ctctggaagagggag

SEQ ID NO: 4757222 - DNA, 15 bp, Homo sapiens
ctctggcctcccacc

SEQ ID NO: 4757223 - DNA, 20 bp, Homo sapiens
ctctggccttggttcctcca

SEQ ID NO: 4757224 - DNA, 21 bp, Homo sapiens
ctctggccttggttcctccag

SEQ ID NO: 4757225 - DNA, 21 bp, Homo sapiens
ctctggggccctgggcctcag

SEQ ID NO: 4757226 - DNA, 22 bp, Homo sapiens
ctctggggctctagggttgctg

SEQ ID NO: 4757227 - DNA, 15 bp, Homo sapiens
ctctgtaacatcact

SEQ ID NO: 4757228 - DNA, 15 bp, Homo sapiens
ctctgtagcctggtc

SEQ ID NO: 4757229 - DNA, 18 bp, Homo sapiens
ctgacccttccagacata

SEQ ID NO: 4757230 - DNA, 22 bp, Homo sapiens
ctgaccttctgcggctccgggc

SEQ ID NO: 4757231 - DNA, 13 bp, Homo sapiens
ctgacggccctgc

SEQ ID NO: 4757232 - DNA, 17 bp, Homo sapiens
ctgactgttctcttact

SEQ ID NO: 4757233 - DNA, 18 bp, Homo sapiens
ctgacttcccagctggca

SEQ ID NO: 4757234 - DNA, 15 bp, Homo sapiens
ctgagaaggccccag

SEQ ID NO: 4757235 - DNA, 16 bp, Homo sapiens
ctgagaaggccccagg

SEQ ID NO: 4757236 - DNA, 20 bp, Homo sapiens
ctgagacacagcccagagac

SEQ ID NO: 4757237 - DNA, 21 bp, Homo sapiens
ctgagaccaagtctctctaag

SEQ ID NO: 4757238 - DNA, 20 bp, Homo sapiens
ctgagcacccagctctgtct

SEQ ID NO: 4757239 - DNA, 14 bp, Homo sapiens
ctgagcagacaggg

SEQ ID NO: 4757240 - DNA, 22 bp, Homo sapiens
ctgagcagacagggcgtcctct

SEQ ID NO: 4757241 - DNA, 13 bp, Homo sapiens
ctgagcagtgggg

SEQ ID NO: 4757242 - DNA, 21 bp, Homo sapiens
ctgagcagttgttatattcat

SEQ ID NO: 4757243 - DNA, 14 bp, Homo sapiens
ctgagccacagtgg

SEQ ID NO: 4757244 - DNA, 17 bp, Homo sapiens
ctgagccacagtggggc

SEQ ID NO: 4757245 - DNA, 18 bp, Homo sapiens
ctgagcccctccctcctg

SEQ ID NO: 4757246 - DNA, 13 bp, Homo sapiens
ctgagcccctcct

SEQ ID NO: 4757247 - DNA, 16 bp, Homo sapiens
ctgagcccctcctctc

SEQ ID NO: 4757248 - DNA, 19 bp, Homo sapiens
ctgagcccctcctctcctc

SEQ ID NO: 4757249 - DNA, 14 bp, Homo sapiens
ctgagccctgccct

SEQ ID NO: 4757250 - DNA, 19 bp, Homo sapiens
ctgagcctggcccatagaa

SEQ ID NO: 4757251 - DNA, 15 bp, Homo sapiens
ctgagcctgtctctc

SEQ ID NO: 4757252 - DNA, 23 bp, Homo sapiens
ctgagctaacactaaaagtcact

SEQ ID NO: 4757253 - DNA, 16 bp, Homo sapiens
ctgagctccaccctcc

SEQ ID NO: 4757254 - DNA, 17 bp, Homo sapiens
ctgagctccaccctccc

SEQ ID NO: 4757255 - DNA, 23 bp, Homo sapiens
ctgaggaaggaggggaagctgca

SEQ ID NO: 4757256 - DNA, 13 bp, Homo sapiens
ctgaggacggggc

SEQ ID NO: 4757257 - DNA, 18 bp, Homo sapiens
ctgaggacggggcagagc

SEQ ID NO: 4757258 - DNA, 19 bp, Homo sapiens
ctgaggacggggcagagct

SEQ ID NO: 4757259 - DNA, 20 bp, Homo sapiens
ctgaggacggggcagagctg

SEQ ID NO: 4757260 - DNA, 14 bp, Homo sapiens
ctgaggagtgatgg

SEQ ID NO: 4757261 - DNA, 15 bp, Homo sapiens
ctgaggagtgatggg

SEQ ID NO: 4757262 - DNA, 16 bp, Homo sapiens
ctgagggaagcccacc

SEQ ID NO: 4757263 - DNA, 20 bp, Homo sapiens
ctgagggaagcccacccgcc

SEQ ID NO: 4757264 - DNA, 18 bp, Homo sapiens
ctgagggacgagcagagc

SEQ ID NO: 4757265 - DNA, 20 bp, Homo sapiens
ctgagggacgagcagagcgc

SEQ ID NO: 4757266 - DNA, 16 bp, Homo sapiens
ctgagggcccttccca

SEQ ID NO: 4757267 - DNA, 16 bp, Homo sapiens
ctgaggttaaggggat

SEQ ID NO: 4757268 - DNA, 17 bp, Homo sapiens
ctgagtcagggcccaga

SEQ ID NO: 4757269 - DNA, 19 bp, Homo sapiens
ctgagtcagggcccagagg

SEQ ID NO: 4757270 - DNA, 18 bp, Homo sapiens
ctgagtcggctgggcagg

SEQ ID NO: 4757271 - DNA, 20 bp, Homo sapiens
ctgagtcggctgggcagggc

SEQ ID NO: 4757272 - DNA, 22 bp, Homo sapiens
ctgagtcggctgggcagggccg

SEQ ID NO: 4757273 - DNA, 14 bp, Homo sapiens
ctgagtgagggcat

SEQ ID NO: 4757274 - DNA, 16 bp, Homo sapiens
ctgagtggctcgtgtt

SEQ ID NO: 4757275 - DNA, 21 bp, Homo sapiens
ctgagttttctctttgtgggg

SEQ ID NO: 4757276 - DNA, 15 bp, Homo sapiens
ctgataaagaaacct

SEQ ID NO: 4757277 - DNA, 20 bp, Homo sapiens
ctgatacatctgtcagtgag

SEQ ID NO: 4757278 - DNA, 21 bp, Homo sapiens
ctgatacatctgtcagtgagt

SEQ ID NO: 4757279 - DNA, 17 bp, Homo sapiens
ctgatacctgcctggga

SEQ ID NO: 4757280 - DNA, 18 bp, Homo sapiens
ctgatacctgcctgggac

SEQ ID NO: 4757281 - DNA, 21 bp, Homo sapiens
ctgatacttatttataacatt

SEQ ID NO: 4757282 - DNA, 22 bp, Homo sapiens
ctgatagaagaaggactgaaga

SEQ ID NO: 4757283 - DNA, 23 bp, Homo sapiens
ctgatagtgtttcgttaagcagt

SEQ ID NO: 4757284 - DNA, 13 bp, Homo sapiens
ctgatatgggact

SEQ ID NO: 4757285 - DNA, 15 bp, Homo sapiens
ctgatcaaggtgctc

SEQ ID NO: 4757286 - DNA, 22 bp, Homo sapiens
ctgatcaaggtgctcttctcat

SEQ ID NO: 4757287 - DNA, 22 bp, Homo sapiens
ctaaggccgtgtctctgaggac

SEQ ID NO: 4757288 - DNA, 18 bp, Homo sapiens
ctaagggatccagagacc

SEQ ID NO: 4757289 - DNA, 19 bp, Homo sapiens
ctaagggatccagagacct

SEQ ID NO: 4757290 - DNA, 14 bp, Homo sapiens
ctaagtaacctcta

SEQ ID NO: 4757291 - DNA, 21 bp, Homo sapiens
ctaagtaacctctacaggcat

SEQ ID NO: 4757292 - DNA, 18 bp, Homo sapiens
ctaagtgaggatgaaaaa

SEQ ID NO: 4757293 - DNA, 14 bp, Homo sapiens
ctaagtggaagaca

SEQ ID NO: 4757294 - DNA, 16 bp, Homo sapiens
ctaagtggaagacaga

SEQ ID NO: 4757295 - DNA, 21 bp, Homo sapiens
ctaagtggaagacagagatgg

SEQ ID NO: 4757296 - DNA, 15 bp, Homo sapiens
ctaagtttctttgag

SEQ ID NO: 4757297 - DNA, 13 bp, Homo sapiens
ctaataggtctgg

SEQ ID NO: 4757298 - DNA, 14 bp, Homo sapiens
ctaataggtctgga

SEQ ID NO: 4757299 - DNA, 16 bp, Homo sapiens
ctaatatttattgctt

SEQ ID NO: 4757300 - DNA, 17 bp, Homo sapiens
ctaatatttattgcttt

SEQ ID NO: 4757301 - DNA, 18 bp, Homo sapiens
ctaatccatgtgctgctg

SEQ ID NO: 4757302 - DNA, 18 bp, Homo sapiens
ctaatccccataacttcc

SEQ ID NO: 4757303 - DNA, 16 bp, Homo sapiens
ctaatcgccctgagct

SEQ ID NO: 4757304 - DNA, 22 bp, Homo sapiens
ctaatctcatacctctgaccaa

SEQ ID NO: 4757305 - DNA, 11 bp, Homo sapiens
ctaatgaattt

SEQ ID NO: 4757306 - DNA, 14 bp, Homo sapiens
ctaatgaattttaa

SEQ ID NO: 4757307 - DNA, 22 bp, Homo sapiens
ctaatgaattttaaaagcatat

SEQ ID NO: 4757308 - DNA, 16 bp, Homo sapiens
ctaatgacaagtgact

SEQ ID NO: 4757309 - DNA, 21 bp, Homo sapiens
ctaatgtaaatattgctgtct

SEQ ID NO: 4757310 - DNA, 16 bp, Homo sapiens
ctaattaaaaagttaa

SEQ ID NO: 4757311 - DNA, 15 bp, Homo sapiens
ctaattaaactgatg

SEQ ID NO: 4757312 - DNA, 13 bp, Homo sapiens
ctaattaatttca

SEQ ID NO: 4757313 - DNA, 14 bp, Homo sapiens
ctaattaatttcag

SEQ ID NO: 4757314 - DNA, 15 bp, Homo sapiens
ctaattaatttcagt

SEQ ID NO: 4757315 - DNA, 12 bp, Homo sapiens
ctaattagtgtc

SEQ ID NO: 4757316 - DNA, 17 bp, Homo sapiens
ctaattcctgtatgtta

SEQ ID NO: 4757317 - DNA, 18 bp, Homo sapiens
ctaattcctgtatgttat

SEQ ID NO: 4757318 - DNA, 15 bp, Homo sapiens
ctaattctcttcgct

SEQ ID NO: 4757319 - DNA, 17 bp, Homo sapiens
ctaattctcttcgctgt

SEQ ID NO: 4757320 - DNA, 14 bp, Homo sapiens
ctaatttgtgaaag

SEQ ID NO: 4757321 - DNA, 23 bp, Homo sapiens
ctacaaaaaaaatcaaaaaatta

SEQ ID NO: 4757322 - DNA, 16 bp, Homo sapiens
ctacaaaatgtgtgct

SEQ ID NO: 4757323 - DNA, 10 bp, Homo sapiens
ctacaaacat

SEQ ID NO: 4757324 - DNA, 19 bp, Homo sapiens
ctacaaacttttataaatg

SEQ ID NO: 4757325 - DNA, 16 bp, Homo sapiens
ctacaacctccgcctc

SEQ ID NO: 4757326 - DNA, 20 bp, Homo sapiens
ctacacagtgggaactctga

SEQ ID NO: 4757327 - DNA, 22 bp, Homo sapiens
ctacacagtgggaactctgaca

SEQ ID NO: 4757328 - DNA, 20 bp, Homo sapiens
ctacacgtttcaacctctct

SEQ ID NO: 4757329 - DNA, 17 bp, Homo sapiens
ctacagacattaaataa

SEQ ID NO: 4757330 - DNA, 19 bp, Homo sapiens
ctacagacattaaataatc

SEQ ID NO: 4757331 - DNA, 12 bp, Homo sapiens
ctacagatcctc

SEQ ID NO: 4757332 - DNA, 16 bp, Homo sapiens
ctacagcctgcacaca

SEQ ID NO: 4757333 - DNA, 18 bp, Homo sapiens
ctacagcctgcacacacc

SEQ ID NO: 4757334 - DNA, 20 bp, Homo sapiens
ctacatatgtaggaaaattt

SEQ ID NO: 4757335 - DNA, 15 bp, Homo sapiens
ctacatctgaaatct

SEQ ID NO: 4757336 - DNA, 20 bp, Homo sapiens
ctacatctgaaatctacaac

SEQ ID NO: 4757337 - DNA, 14 bp, Homo sapiens
ctacatttgcatgc

SEQ ID NO: 4757338 - DNA, 15 bp, Homo sapiens
ctacatttgcatgcc

SEQ ID NO: 4757339 - DNA, 19 bp, Homo sapiens
ctaccaaatataaacttgt

SEQ ID NO: 4757340 - DNA, 20 bp, Homo sapiens
ctaccacagctgcctccggg

SEQ ID NO: 4757341 - DNA, 22 bp, Homo sapiens
ctaccacagctgcctccgggcc

SEQ ID NO: 4757342 - DNA, 20 bp, Homo sapiens
ctaccaccctcgctgccacc

SEQ ID NO: 4757343 - DNA, 20 bp, Homo sapiens
ctaccccagaacgcatgcag

SEQ ID NO: 4757344 - DNA, 20 bp, Homo sapiens
ctaccccaggacgcatgcag

SEQ ID NO: 4757345 - DNA, 20 bp, Homo sapiens
ctaccccaggatgcatgcag

SEQ ID NO: 4757346 - DNA, 15 bp, Homo sapiens
ctaccctttcccaaa

SEQ ID NO: 4757347 - DNA, 19 bp, Homo sapiens
ctaccctttcccaaaccct

SEQ ID NO: 4757348 - DNA, 16 bp, Homo sapiens
ctaccttatagagcac

SEQ ID NO: 4757349 - DNA, 15 bp, Homo sapiens
ctactcctccccctc

SEQ ID NO: 4757350 - DNA, 17 bp, Homo sapiens
ctactcctccccctcct

SEQ ID NO: 4757351 - DNA, 19 bp, Homo sapiens
ctactcctccccctcctcc

SEQ ID NO: 4757352 - DNA, 20 bp, Homo sapiens
ctactcctccccctcctcca

SEQ ID NO: 4757353 - DNA, 19 bp, Homo sapiens
ctactcgagttacagacaa

SEQ ID NO: 4757354 - DNA, 18 bp, Homo sapiens
ctactcttaaatatacaa

SEQ ID NO: 4757355 - DNA, 22 bp, Homo sapiens
ctactcttaaatatacaacttt

SEQ ID NO: 4757356 - DNA, 23 bp, Homo sapiens
ctactgccactcaggcagcctgt

SEQ ID NO: 4757357 - DNA, 16 bp, Homo sapiens
ctactgcctttcaaag

SEQ ID NO: 4757358 - DNA, 18 bp, Homo sapiens
ctactggcctctgtgcca

SEQ ID NO: 4757359 - DNA, 13 bp, Homo sapiens
ctacttaaacaaa

SEQ ID NO: 4757360 - DNA, 15 bp, Homo sapiens
ctacttatattctgc

SEQ ID NO: 4757361 - DNA, 18 bp, Homo sapiens
ctactttaaattgtggat

SEQ ID NO: 4757362 - DNA, 19 bp, Homo sapiens
ctactttaaattgtggatg

SEQ ID NO: 4757363 - DNA, 20 bp, Homo sapiens
ctactttaaattgtggatga

SEQ ID NO: 4757364 - DNA, 22 bp, Homo sapiens
ctactttctgtgtctatggatt

SEQ ID NO: 4757365 - DNA, 17 bp, Homo sapiens
ctagaagagtctattgt

SEQ ID NO: 4757366 - DNA, 20 bp, Homo sapiens
ctagaagagtctattgtctc

SEQ ID NO: 4757367 - DNA, 18 bp, Homo sapiens
ctagaatactaataaaat

SEQ ID NO: 4757368 - DNA, 20 bp, Homo sapiens
ctagaatactaataaaatac

SEQ ID NO: 4757369 - DNA, 14 bp, Homo sapiens
ctagaatgagaaat

SEQ ID NO: 4757370 - DNA, 16 bp, Homo sapiens
ctagaatgagaaatca

SEQ ID NO: 4757371 - DNA, 20 bp, Homo sapiens
ctagacgagcaggcttcttc

SEQ ID NO: 4757372 - DNA, 18 bp, Homo sapiens
ctagagaaattcttgtta

SEQ ID NO: 4757373 - DNA, 15 bp, Homo sapiens
ctagagatattttgt

SEQ ID NO: 4757374 - DNA, 17 bp, Homo sapiens
ctagagatattttgtaa

SEQ ID NO: 4757375 - DNA, 13 bp, Homo sapiens
ctagattaccatg

SEQ ID NO: 4757376 - DNA, 14 bp, Homo sapiens
ctagcaactgttgg

SEQ ID NO: 4757377 - DNA, 20 bp, Homo sapiens
ctagcactttgggaggctga

SEQ ID NO: 4757378 - DNA, 22 bp, Homo sapiens
ctcaatgtgctgttgattcttt

SEQ ID NO: 4757379 - DNA, 18 bp, Homo sapiens
ctcacaccgcaccgggct

SEQ ID NO: 4757380 - DNA, 21 bp, Homo sapiens
ctcacaccgcaccgggctggc

SEQ ID NO: 4757381 - DNA, 17 bp, Homo sapiens
ctcacaccggcactgtg

SEQ ID NO: 4757382 - DNA, 22 bp, Homo sapiens
ctcacaccggcactgtgcactc

SEQ ID NO: 4757383 - DNA, 19 bp, Homo sapiens
ctcacacttgggctggcac

SEQ ID NO: 4757384 - DNA, 13 bp, Homo sapiens
ctcacagcacatt

SEQ ID NO: 4757385 - DNA, 19 bp, Homo sapiens
ctcacagcacatttgttaa

SEQ ID NO: 4757386 - DNA, 13 bp, Homo sapiens
ctcacagccacca

SEQ ID NO: 4757387 - DNA, 16 bp, Homo sapiens
ctcacagccaccacct

SEQ ID NO: 4757388 - DNA, 14 bp, Homo sapiens
ctcacagtgaccct

SEQ ID NO: 4757389 - DNA, 21 bp, Homo sapiens
ctcaccccccgacctggctga

SEQ ID NO: 4757390 - DNA, 24 bp, Homo sapiens
ctcacccggcaaggggcgcgcgcc

SEQ ID NO: 4757391 - DNA, 23 bp, Homo sapiens
ctcaccctctgtccttcccccag

SEQ ID NO: 4757392 - DNA, 16 bp, Homo sapiens
ctcacctggcttccca

SEQ ID NO: 4757393 - DNA, 18 bp, Homo sapiens
ctcacctggcttcccagg

SEQ ID NO: 4757394 - DNA, 20 bp, Homo sapiens
ctcacctggcttcccaggac

SEQ ID NO: 4757395 - DNA, 19 bp, Homo sapiens
ctcaccttccctagttctt

SEQ ID NO: 4757396 - DNA, 14 bp, Homo sapiens
ctcaccttctgttt

SEQ ID NO: 4757397 - DNA, 18 bp, Homo sapiens
ctcacgagtcatccagaa

SEQ ID NO: 4757398 - DNA, 15 bp, Homo sapiens
ctcacgattccagtg

SEQ ID NO: 4757399 - DNA, 16 bp, Homo sapiens
ctcacgattccagtgc

SEQ ID NO: 4757400 - DNA, 18 bp, Homo sapiens
ctcacgattccagtgcag

SEQ ID NO: 4757401 - DNA, 20 bp, Homo sapiens
ctcacgattccagtgcagta

SEQ ID NO: 4757402 - DNA, 21 bp, Homo sapiens
ctcacgtctgtgagtctgtcc

SEQ ID NO: 4757403 - DNA, 21 bp, Homo sapiens
ctcactatggtatgctggcca

SEQ ID NO: 4757404 - DNA, 23 bp, Homo sapiens
ctcactatggtatgctggccagc

SEQ ID NO: 4757405 - DNA, 15 bp, Homo sapiens
ctcactccactcccc

SEQ ID NO: 4757406 - DNA, 18 bp, Homo sapiens
ctcactccactcccctca

SEQ ID NO: 4757407 - DNA, 18 bp, Homo sapiens
ctcactctgtcagccagc

SEQ ID NO: 4757408 - DNA, 19 bp, Homo sapiens
ctcactctgtcagccagcc

SEQ ID NO: 4757409 - DNA, 22 bp, Homo sapiens
ctcactgagaaggccccagggc

SEQ ID NO: 4757410 - DNA, 15 bp, Homo sapiens
ctcactgatatattt

SEQ ID NO: 4757411 - DNA, 12 bp, Homo sapiens
ctcactgcccgc

SEQ ID NO: 4757412 - DNA, 16 bp, Homo sapiens
ctcactgggtgtggcc

SEQ ID NO: 4757413 - DNA, 22 bp, Homo sapiens
ctcactgggtgtggcctggctt

SEQ ID NO: 4757414 - DNA, 19 bp, Homo sapiens
ctcacttgtggcagcttcc

SEQ ID NO: 4757415 - DNA, 17 bp, Homo sapiens
ctgtcctggctcccagg

SEQ ID NO: 4757416 - DNA, 14 bp, Homo sapiens
ctgtcctgtaactg

SEQ ID NO: 4757417 - DNA, 15 bp, Homo sapiens
ctgtccttccaacct

SEQ ID NO: 4757418 - DNA, 16 bp, Homo sapiens
ctgtccttccaacctg

SEQ ID NO: 4757419 - DNA, 21 bp, Homo sapiens
ctgtccttccaacctgttcac

SEQ ID NO: 4757420 - DNA, 16 bp, Homo sapiens
ctgtccttcccccagc

SEQ ID NO: 4757421 - DNA, 16 bp, Homo sapiens
ctgtcgcatttcatca

SEQ ID NO: 4757422 - DNA, 20 bp, Homo sapiens
ctgtcgccccaggccctccc

SEQ ID NO: 4757423 - DNA, 21 bp, Homo sapiens
ctgtcgggcccgcactcagga

SEQ ID NO: 4757424 - DNA, 22 bp, Homo sapiens
ctgtctaatgaaacctgtgtct

SEQ ID NO: 4757425 - DNA, 19 bp, Homo sapiens
ctgtctataggacttaatt

SEQ ID NO: 4757426 - DNA, 20 bp, Homo sapiens
ctgtctctacaaaaaaaatc

SEQ ID NO: 4757427 - DNA, 19 bp, Homo sapiens
ctgtctctcttttgctctc

SEQ ID NO: 4757428 - DNA, 17 bp, Homo sapiens
ctgtctcttgggaagca

SEQ ID NO: 4757429 - DNA, 12 bp, Homo sapiens
ctgtctgagccc

SEQ ID NO: 4757430 - DNA, 13 bp, Homo sapiens
ctgtctgagccct

SEQ ID NO: 4757431 - DNA, 17 bp, Homo sapiens
ctgtctgagccctgccc

SEQ ID NO: 4757432 - DNA, 19 bp, Homo sapiens
ctgtctgagccctgccctc

SEQ ID NO: 4757433 - DNA, 11 bp, Homo sapiens
ctgtctgcagg

SEQ ID NO: 4757434 - DNA, 19 bp, Homo sapiens
ctgtctgtcaccagctatc

SEQ ID NO: 4757435 - DNA, 22 bp, Homo sapiens
ctgtctgtcaccagctatctgt

SEQ ID NO: 4757436 - DNA, 13 bp, Homo sapiens
ctgtctgtctctc

SEQ ID NO: 4757437 - DNA, 21 bp, Homo sapiens
ctgtctgtgtgaggctccctc

SEQ ID NO: 4757438 - DNA, 21 bp, Homo sapiens
ctgtcttagtcataccatcca

SEQ ID NO: 4757439 - DNA, 22 bp, Homo sapiens
ctgtcttcaaccctgccctgca

SEQ ID NO: 4757440 - DNA, 23 bp, Homo sapiens
ctgtctttgctgtttatatatat

SEQ ID NO: 4757441 - DNA, 12 bp, Homo sapiens
ctgtgaaacagt

SEQ ID NO: 4757442 - DNA, 23 bp, Homo sapiens
ctgtgaactgccaggcagctgca

SEQ ID NO: 4757443 - DNA, 17 bp, Homo sapiens
ctgtgaataaagccaca

SEQ ID NO: 4757444 - DNA, 12 bp, Homo sapiens
ctgtgaatatgt

SEQ ID NO: 4757445 - DNA, 14 bp, Homo sapiens
ctgtgaatatgtgt

SEQ ID NO: 4757446 - DNA, 22 bp, Homo sapiens
ctgtgacccccatgtccttgga

SEQ ID NO: 4757447 - DNA, 14 bp, Homo sapiens
ctgtgagaactgtg

SEQ ID NO: 4757448 - DNA, 15 bp, Homo sapiens
ctgtgagaactgtga

SEQ ID NO: 4757449 - DNA, 17 bp, Homo sapiens
ctgtgagaactgtgaat

SEQ ID NO: 4757450 - DNA, 15 bp, Homo sapiens
ctgtgagataaatat

SEQ ID NO: 4757451 - DNA, 14 bp, Homo sapiens
ctgtgagctcccca

SEQ ID NO: 4757452 - DNA, 19 bp, Homo sapiens
ctgtgaggacagggccccc

SEQ ID NO: 4757453 - DNA, 23 bp, Homo sapiens
ctgtgaggatagagacttgcagt

SEQ ID NO: 4757454 - DNA, 15 bp, Homo sapiens
ctgtgagtctgtcct

SEQ ID NO: 4757455 - DNA, 18 bp, Homo sapiens
ctgtgagtctgtcctttc

SEQ ID NO: 4757456 - DNA, 14 bp, Homo sapiens
ctgtgataacagag

SEQ ID NO: 4757457 - DNA, 15 bp, Homo sapiens
ctgtgcatctggcct

SEQ ID NO: 4757458 - DNA, 16 bp, Homo sapiens
ctgtgcatctggcctg

SEQ ID NO: 4757459 - DNA, 23 bp, Homo sapiens
ctgtgcatctggcctgggggctg

SEQ ID NO: 4757460 - DNA, 16 bp, Homo sapiens
ctgtgcattgtggctg

SEQ ID NO: 4757461 - DNA, 13 bp, Homo sapiens
ctgtgccctctca

SEQ ID NO: 4757462 - DNA, 13 bp, Homo sapiens
ctgtgcctcagtg

SEQ ID NO: 4757463 - DNA, 12 bp, Homo sapiens
ctgtgcctgtgt

SEQ ID NO: 4757464 - DNA, 15 bp, Homo sapiens
ctgtgcctgtgtttc

SEQ ID NO: 4757465 - DNA, 16 bp, Homo sapiens
ctgtgcgttttagagt

SEQ ID NO: 4757466 - DNA, 17 bp, Homo sapiens
ctgtgctaagttgtctt

SEQ ID NO: 4757467 - DNA, 13 bp, Homo sapiens
ctgtggcccctcc

SEQ ID NO: 4757468 - DNA, 16 bp, Homo sapiens
ctgtggcccctccttc

SEQ ID NO: 4757469 - DNA, 18 bp, Homo sapiens
ctgtggcccctccttctc

SEQ ID NO: 4757470 - DNA, 13 bp, Homo sapiens
ctgtggcctgggg

SEQ ID NO: 4757471 - DNA, 22 bp, Homo sapiens
ctgtggctgatttactaacagt

SEQ ID NO: 4757472 - DNA, 23 bp, Homo sapiens
ctgtggctgatttactaacagta

SEQ ID NO: 4757473 - DNA, 22 bp, Homo sapiens
ctgtgggactggcccacccctc

SEQ ID NO: 4757474 - DNA, 17 bp, Homo sapiens
ctgtgggcagcaccctc

SEQ ID NO: 4757475 - DNA, 16 bp, Homo sapiens
ctgtggtaagagatat

SEQ ID NO: 4757476 - DNA, 22 bp, Homo sapiens
ctgtggtctgtgtgtgacacca

SEQ ID NO: 4757477 - DNA, 14 bp, Homo sapiens
ctgtggtttgttat

SEQ ID NO: 4757478 - DNA, 22 bp, Homo sapiens
ctgtgtagtagctcgtgtgctt

SEQ ID NO: 4757479 - DNA, 23 bp, Homo sapiens
ctgtgtagtagctcgtgtgctta

SEQ ID NO: 4757480 - DNA, 16 bp, Homo sapiens
ctgtgtataaaaaaga

SEQ ID NO: 4757481 - DNA, 11 bp, Homo sapiens
ctgtgtataca

SEQ ID NO: 4757482 - DNA, 14 bp, Homo sapiens
ctgtgtatacatat

SEQ ID NO: 4757483 - DNA, 16 bp, Homo sapiens
ctgtgtatacatatgt

SEQ ID NO: 4757484 - DNA, 22 bp, Homo sapiens
ctgtgtcacgtgaccctgtgcc

SEQ ID NO: 4757485 - DNA, 15 bp, Homo sapiens
ctgtgtcccagtgtc

SEQ ID NO: 4757486 - DNA, 19 bp, Homo sapiens
ctgtgtcccagtgtctggc

SEQ ID NO: 4757487 - DNA, 19 bp, Homo sapiens
ctgtgtcctaaatgcaaag

SEQ ID NO: 4757488 - DNA, 19 bp, Homo sapiens
ctgtgtctcccttcatcct

SEQ ID NO: 4757489 - DNA, 19 bp, Homo sapiens
ctgtgtctggtccacacac

SEQ ID NO: 4757490 - DNA, 16 bp, Homo sapiens
ctgtgtggggagggtg

SEQ ID NO: 4757491 - DNA, 13 bp, Homo sapiens
ctgtgtgtgaatt

SEQ ID NO: 4757492 - DNA, 13 bp, Homo sapiens
ctgtgtgtgacac

SEQ ID NO: 4757493 - DNA, 19 bp, Homo sapiens
ctccctgactccctgtggg

SEQ ID NO: 4757494 - DNA, 16 bp, Homo sapiens
ctccctgctccctgct

SEQ ID NO: 4757495 - DNA, 13 bp, Homo sapiens
ctccctgctgcca

SEQ ID NO: 4757496 - DNA, 22 bp, Homo sapiens
ctccctgctgccaggctcccac

SEQ ID NO: 4757497 - DNA, 18 bp, Homo sapiens
ctccctggccccagtgac

SEQ ID NO: 4757498 - DNA, 18 bp, Homo sapiens
ctccctggggaggacccc

SEQ ID NO: 4757499 - DNA, 22 bp, Homo sapiens
ctccctggggaggacccctgcc

SEQ ID NO: 4757500 - DNA, 13 bp, Homo sapiens
ctcccttccttat

SEQ ID NO: 4757501 - DNA, 16 bp, Homo sapiens
ctcccttctttccttc

SEQ ID NO: 4757502 - DNA, 21 bp, Homo sapiens
ctcccttggttgttccttttt

SEQ ID NO: 4757503 - DNA, 17 bp, Homo sapiens
ctccgaacgctgctcca

SEQ ID NO: 4757504 - DNA, 23 bp, Homo sapiens
ctccgagaagctctcgagggaag

SEQ ID NO: 4757505 - DNA, 13 bp, Homo sapiens
ctccgcggaggcc

SEQ ID NO: 4757506 - DNA, 18 bp, Homo sapiens
ctccgcggaggcccctga

SEQ ID NO: 4757507 - DNA, 19 bp, Homo sapiens
ctccgcggaggcccctgag

SEQ ID NO: 4757508 - DNA, 20 bp, Homo sapiens
ctccgcggaggcccctgagg

SEQ ID NO: 4757509 - DNA, 14 bp, Homo sapiens
ctccggcagaggca

SEQ ID NO: 4757510 - DNA, 23 bp, Homo sapiens
ctccggcagaggcagggccctgg

SEQ ID NO: 4757511 - DNA, 12 bp, Homo sapiens
ctccggccctgc

SEQ ID NO: 4757512 - DNA, 13 bp, Homo sapiens
ctccggccctgcc

SEQ ID NO: 4757513 - DNA, 14 bp, Homo sapiens
ctccggccctgccc

SEQ ID NO: 4757514 - DNA, 15 bp, Homo sapiens
ctccgggcagagacc

SEQ ID NO: 4757515 - DNA, 16 bp, Homo sapiens
ctccgggtgtggcctc

SEQ ID NO: 4757516 - DNA, 18 bp, Homo sapiens
ctccgggtgtggcctcag

SEQ ID NO: 4757517 - DNA, 21 bp, Homo sapiens
ctccgggtgtggcctcagccc

SEQ ID NO: 4757518 - DNA, 22 bp, Homo sapiens
ctccgggtgtggcctcagccct

SEQ ID NO: 4757519 - DNA, 20 bp, Homo sapiens
ctccgtccccagggtgcagg

SEQ ID NO: 4757520 - DNA, 18 bp, Homo sapiens
ctccgtgggcagctcctc

SEQ ID NO: 4757521 - DNA, 21 bp, Homo sapiens
ctccgtggtggcggcggcact

SEQ ID NO: 4757522 - DNA, 15 bp, Homo sapiens
ctcctaagctgccag

SEQ ID NO: 4757523 - DNA, 13 bp, Homo sapiens
ctcctagcctctc

SEQ ID NO: 4757524 - DNA, 18 bp, Homo sapiens
ctcctagcctctccgccc

SEQ ID NO: 4757525 - DNA, 20 bp, Homo sapiens
ctcctagcctctccgcccac

SEQ ID NO: 4757526 - DNA, 23 bp, Homo sapiens
ctcctagtttgacctcacagtga

SEQ ID NO: 4757527 - DNA, 23 bp, Homo sapiens
ctcctcaattccagggaaccaga

SEQ ID NO: 4757528 - DNA, 16 bp, Homo sapiens
ctcctcactgccacta

SEQ ID NO: 4757529 - DNA, 18 bp, Homo sapiens
ctcctcagatcttctgtg

SEQ ID NO: 4757530 - DNA, 12 bp, Homo sapiens
ctcctccaaatg

SEQ ID NO: 4757531 - DNA, 13 bp, Homo sapiens
ctcctccaaatgc

SEQ ID NO: 4757532 - DNA, 14 bp, Homo sapiens
ctcctccagactcg

SEQ ID NO: 4757533 - DNA, 21 bp, Homo sapiens
ctcctccagactcgagagggc

SEQ ID NO: 4757534 - DNA, 22 bp, Homo sapiens
ctcctccagactcgagagggct

SEQ ID NO: 4757535 - DNA, 19 bp, Homo sapiens
ctcctccagagcctgggcg

SEQ ID NO: 4757536 - DNA, 20 bp, Homo sapiens
ctcctccagttctgatgagg

SEQ ID NO: 4757537 - DNA, 12 bp, Homo sapiens
ctcctccattca

SEQ ID NO: 4757538 - DNA, 16 bp, Homo sapiens
ctggcagatgggggcc

SEQ ID NO: 4757539 - DNA, 22 bp, Homo sapiens
ctggcagatgggggcctctctg

SEQ ID NO: 4757540 - DNA, 12 bp, Homo sapiens
ctggcagcccct

SEQ ID NO: 4757541 - DNA, 17 bp, Homo sapiens
ctggcagcgcctcccgc

SEQ ID NO: 4757542 - DNA, 17 bp, Homo sapiens
ctggcataggactcttt

SEQ ID NO: 4757543 - DNA, 16 bp, Homo sapiens
ctggcatgggaatgaa

SEQ ID NO: 4757544 - DNA, 19 bp, Homo sapiens
ctggcatgggaatgaatgt

SEQ ID NO: 4757545 - DNA, 23 bp, Homo sapiens
ctggcattacaggtgtgagccac

SEQ ID NO: 4757546 - DNA, 21 bp, Homo sapiens
ctggccagcaccctctcctgg

SEQ ID NO: 4757547 - DNA, 14 bp, Homo sapiens
ctggccagcctggg

SEQ ID NO: 4757548 - DNA, 24 bp, Homo sapiens
ctggccagcctggggcctggcagg

SEQ ID NO: 4757549 - DNA, 15 bp, Homo sapiens
ctggcccacccctct

SEQ ID NO: 4757550 - DNA, 16 bp, Homo sapiens
ctggcccacccctctt

SEQ ID NO: 4757551 - DNA, 17 bp, Homo sapiens
ctggcccacccctcttc

SEQ ID NO: 4757552 - DNA, 19 bp, Homo sapiens
ctggcccacccctcttccc

SEQ ID NO: 4757553 - DNA, 22 bp, Homo sapiens
ctggcccacccctcttccccct

SEQ ID NO: 4757554 - DNA, 16 bp, Homo sapiens
ctggcccagccagcag

SEQ ID NO: 4757555 - DNA, 16 bp, Homo sapiens
ctggcccagccatggc

SEQ ID NO: 4757556 - DNA, 16 bp, Homo sapiens
ctggcccatagaaaca

SEQ ID NO: 4757557 - DNA, 15 bp, Homo sapiens
ctggccccaaatgtt

SEQ ID NO: 4757558 - DNA, 13 bp, Homo sapiens
ctggccccagctc

SEQ ID NO: 4757559 - DNA, 14 bp, Homo sapiens
ctggccccagctcc

SEQ ID NO: 4757560 - DNA, 22 bp, Homo sapiens
ctggccccagctcctcttcctg

SEQ ID NO: 4757561 - DNA, 13 bp, Homo sapiens
ctggccccaggcg

SEQ ID NO: 4757562 - DNA, 15 bp, Homo sapiens
ctggccccaggcgga

SEQ ID NO: 4757563 - DNA, 18 bp, Homo sapiens
ctggccccaggcggaggg

SEQ ID NO: 4757564 - DNA, 21 bp, Homo sapiens
ctggccccaggcggaggggct

SEQ ID NO: 4757565 - DNA, 13 bp, Homo sapiens
ctggccccctcgc

SEQ ID NO: 4757566 - DNA, 22 bp, Homo sapiens
ctggccccctcgcgcccctgtc

SEQ ID NO: 4757567 - DNA, 17 bp, Homo sapiens
ctggcccgggagccgca

SEQ ID NO: 4757568 - DNA, 16 bp, Homo sapiens
ctggcccggtcccagt

SEQ ID NO: 4757569 - DNA, 14 bp, Homo sapiens
ctggccctgccctc

SEQ ID NO: 4757570 - DNA, 16 bp, Homo sapiens
ctggccctgccctgag

SEQ ID NO: 4757571 - DNA, 17 bp, Homo sapiens
ctggccctgccctgagg

SEQ ID NO: 4757572 - DNA, 15 bp, Homo sapiens
ctggccgctgggaga

SEQ ID NO: 4757573 - DNA, 20 bp, Homo sapiens
ctggcctatgaccctgtgcc

SEQ ID NO: 4757574 - DNA, 21 bp, Homo sapiens
ctggcctatgaccctgtgcct

SEQ ID NO: 4757575 - DNA, 14 bp, Homo sapiens
ctggcctgacacaa

SEQ ID NO: 4757576 - DNA, 21 bp, Homo sapiens
ctggcctgagaattgagggga

SEQ ID NO: 4757577 - DNA, 14 bp, Homo sapiens
ctggcctggccctg

SEQ ID NO: 4757578 - DNA, 15 bp, Homo sapiens
ctggcctggcctggc

SEQ ID NO: 4757579 - DNA, 18 bp, Homo sapiens
ctggcctggcctggccct

SEQ ID NO: 4757580 - DNA, 13 bp, Homo sapiens
ctggccttgcctc

SEQ ID NO: 4757581 - DNA, 16 bp, Homo sapiens
ctggccttgcctccag

SEQ ID NO: 4757582 - DNA, 19 bp, Homo sapiens
ctggccttggttcctccag

SEQ ID NO: 4757583 - DNA, 15 bp, Homo sapiens
ctggcctttcctctc

SEQ ID NO: 4757584 - DNA, 14 bp, Homo sapiens
ctggcgggcagccc

SEQ ID NO: 4757585 - DNA, 14 bp, Homo sapiens
ctggcggggtctgc

SEQ ID NO: 4757586 - DNA, 15 bp, Homo sapiens
ctggctcacagccac

SEQ ID NO: 4757587 - DNA, 16 bp, Homo sapiens
ctggctcacagccacc

SEQ ID NO: 4757588 - DNA, 17 bp, Homo sapiens
ctggctcacagccacca

SEQ ID NO: 4757589 - DNA, 18 bp, Homo sapiens
ctggctcacagccaccac

SEQ ID NO: 4757590 - DNA, 13 bp, Homo sapiens
ctggctctggagc

SEQ ID NO: 4757591 - DNA, 22 bp, Homo sapiens
ctggctgagtgcgaccaccact

SEQ ID NO: 4757592 - DNA, 19 bp, Homo sapiens
ctggctgggtcgcccctcc

SEQ ID NO: 4757593 - DNA, 20 bp, Homo sapiens
ctggctgggtcgcccctcct

SEQ ID NO: 4757594 - DNA, 22 bp, Homo sapiens
ctggctgtggcccctccttctc

SEQ ID NO: 4757595 - DNA, 19 bp, Homo sapiens
ctggcttcaccgcattcca

SEQ ID NO: 4757596 - DNA, 20 bp, Homo sapiens
ctggcttcaccgcattccag

SEQ ID NO: 4757597 - DNA, 19 bp, Homo sapiens
ctggcttcccaggaccctg

SEQ ID NO: 4757598 - DNA, 14 bp, Homo sapiens
ctggcttctgggac

SEQ ID NO: 4757599 - DNA, 14 bp, Homo sapiens
ctggcttttaagcc

SEQ ID NO: 4757600 - DNA, 21 bp, Homo sapiens
ctggcttttaagccaatataa

SEQ ID NO: 4757601 - DNA, 16 bp, Homo sapiens
ctgggaaattgctcca

SEQ ID NO: 4757602 - DNA, 21 bp, Homo sapiens
ctgggaaattgctccattcct

SEQ ID NO: 4757603 - DNA, 22 bp, Homo sapiens
ctgggaatggggtgggagccac

SEQ ID NO: 4757604 - DNA, 17 bp, Homo sapiens
ctgggacagccactgga

SEQ ID NO: 4757605 - DNA, 16 bp, Homo sapiens
ctgggagaaaagccag

SEQ ID NO: 4757606 - DNA, 18 bp, Homo sapiens
ctgggagaaaagccagat

SEQ ID NO: 4757607 - DNA, 19 bp, Homo sapiens
ctgggagaaaagccagatg

SEQ ID NO: 4757608 - DNA, 21 bp, Homo sapiens
ctgggagaaaagccagatgac

SEQ ID NO: 4757609 - DNA, 20 bp, Homo sapiens
ctttttttaagtgttctgtg

SEQ ID NO: 4757610 - DNA, 23 bp, Homo sapiens
cttttttttttcgtcttccctgc

SEQ ID NO: 4757611 - DNA, 17 bp, Homo sapiens
gaaaaaaaaaagtaatt

SEQ ID NO: 4757612 - DNA, 16 bp, Homo sapiens
gaaaaaactggaaaca

SEQ ID NO: 4757613 - DNA, 16 bp, Homo sapiens
gaaaaagatattgtat

SEQ ID NO: 4757614 - DNA, 16 bp, Homo sapiens
gaaaaagccctcttca

SEQ ID NO: 4757615 - DNA, 18 bp, Homo sapiens
gaaaaagtgtttttacat

SEQ ID NO: 4757616 - DNA, 14 bp, Homo sapiens
gaaaaatcaatcat

SEQ ID NO: 4757617 - DNA, 13 bp, Homo sapiens
gaaaaatctgaat

SEQ ID NO: 4757618 - DNA, 21 bp, Homo sapiens
gaaaacaggaaaaaaactttt

SEQ ID NO: 4757619 - DNA, 12 bp, Homo sapiens
gaaaacctcagt

SEQ ID NO: 4757620 - DNA, 13 bp, Homo sapiens
gaaaacctcagtt

SEQ ID NO: 4757621 - DNA, 12 bp, Homo sapiens
gaaaactgccac

SEQ ID NO: 4757622 - DNA, 20 bp, Homo sapiens
gaaaactgccacaagcacaa

SEQ ID NO: 4757623 - DNA, 21 bp, Homo sapiens
gaaaactgccacaagcacaat

SEQ ID NO: 4757624 - DNA, 17 bp, Homo sapiens
gaaaactggaataagaa

SEQ ID NO: 4757625 - DNA, 10 bp, Homo sapiens
gaaaactgtt

SEQ ID NO: 4757626 - DNA, 11 bp, Homo sapiens
gaaaactgtta

SEQ ID NO: 4757627 - DNA, 21 bp, Homo sapiens
gaaaactgtttatggtatttt

SEQ ID NO: 4757628 - DNA, 14 bp, Homo sapiens
gaaaacttctcatt

SEQ ID NO: 4757629 - DNA, 15 bp, Homo sapiens
gaaaagaagtagtgt

SEQ ID NO: 4757630 - DNA, 21 bp, Homo sapiens
gaaaagattaaaattagtgag

SEQ ID NO: 4757631 - DNA, 23 bp, Homo sapiens
gaaaagcaaaccttaatttgaaa

SEQ ID NO: 4757632 - DNA, 17 bp, Homo sapiens
gaaaagcacctcttgaa

SEQ ID NO: 4757633 - DNA, 14 bp, Homo sapiens
gaaaagcccacata

SEQ ID NO: 4757634 - DNA, 19 bp, Homo sapiens
gaaaaggcttgagtctgga

SEQ ID NO: 4757635 - DNA, 15 bp, Homo sapiens
gaaaataataaaaga

SEQ ID NO: 4757636 - DNA, 12 bp, Homo sapiens
cttcttctgtaa

SEQ ID NO: 4757637 - DNA, 13 bp, Homo sapiens
cttcttctgtaat

SEQ ID NO: 4757638 - DNA, 14 bp, Homo sapiens
cttcttgcggcacc

SEQ ID NO: 4757639 - DNA, 18 bp, Homo sapiens
cttcttgcggcaccgccc

SEQ ID NO: 4757640 - DNA, 20 bp, Homo sapiens
cttcttgcggcaccgcccac

SEQ ID NO: 4757641 - DNA, 18 bp, Homo sapiens
cttcttgtgtttgaaaca

SEQ ID NO: 4757642 - DNA, 14 bp, Homo sapiens
cttctttccttcct

SEQ ID NO: 4757643 - DNA, 20 bp, Homo sapiens
cttcttttcctgggtgctca

SEQ ID NO: 4757644 - DNA, 24 bp, Homo sapiens
cttgaaattatatctgtggtcttc

SEQ ID NO: 4757645 - DNA, 16 bp, Homo sapiens
cttgaacattaatcca

SEQ ID NO: 4757646 - DNA, 23 bp, Homo sapiens
cttgaacattaatccacatgttt

SEQ ID NO: 4757647 - DNA, 22 bp, Homo sapiens
cttgaagaactgacttcctgaa

SEQ ID NO: 4757648 - DNA, 12 bp, Homo sapiens
cttgaagaatat

SEQ ID NO: 4757649 - DNA, 18 bp, Homo sapiens
cttgaagaatattgttaa

SEQ ID NO: 4757650 - DNA, 13 bp, Homo sapiens
cttgaatagtatt

SEQ ID NO: 4757651 - DNA, 18 bp, Homo sapiens
cttgaatgcttaaatgat

SEQ ID NO: 4757652 - DNA, 18 bp, Homo sapiens
cttgacaggcgccgcctc

SEQ ID NO: 4757653 - DNA, 19 bp, Homo sapiens
cttgacagttacttacaca

SEQ ID NO: 4757654 - DNA, 16 bp, Homo sapiens
cttgacatcaactgca

SEQ ID NO: 4757655 - DNA, 12 bp, Homo sapiens
cttgaccttcct

SEQ ID NO: 4757656 - DNA, 17 bp, Homo sapiens
cttgacgcagcccccca

SEQ ID NO: 4757657 - DNA, 15 bp, Homo sapiens
cttgacgtgtgtggt

SEQ ID NO: 4757658 - DNA, 14 bp, Homo sapiens
cttgactatttcac

SEQ ID NO: 4757659 - DNA, 16 bp, Homo sapiens
cttgactgttatctcg

SEQ ID NO: 4757660 - DNA, 22 bp, Homo sapiens
cttgagcaaggcaagaagtggg

SEQ ID NO: 4757661 - DNA, 13 bp, Homo sapiens
cttgagcatgccc

SEQ ID NO: 4757662 - DNA, 18 bp, Homo sapiens
cttgagctggttttctct

SEQ ID NO: 4757663 - DNA, 16 bp, Homo sapiens
cttgaggccaaatgag

SEQ ID NO: 4757664 - DNA, 21 bp, Homo sapiens
cttgaggttttgttcatgccc

SEQ ID NO: 4757665 - DNA, 14 bp, Homo sapiens
cttgagtggacagc

SEQ ID NO: 4757666 - DNA, 19 bp, Homo sapiens
cttgagtggacagcagctg

SEQ ID NO: 4757667 - DNA, 17 bp, Homo sapiens
cttgagtgggccccctc

SEQ ID NO: 4757668 - DNA, 19 bp, Homo sapiens
cttgagtgggccccctctc

SEQ ID NO: 4757669 - DNA, 19 bp, Homo sapiens
cttgatcatgaatcactgc

SEQ ID NO: 4757670 - DNA, 13 bp, Homo sapiens
cttgatggggtga

SEQ ID NO: 4757671 - DNA, 17 bp, Homo sapiens
cttgatggggtgagaag

SEQ ID NO: 4757672 - DNA, 18 bp, Homo sapiens
cttgatggggtgagaagt

SEQ ID NO: 4757673 - DNA, 19 bp, Homo sapiens
cttgattcataatgactta

SEQ ID NO: 4757674 - DNA, 13 bp, Homo sapiens
cttgattctaaag

SEQ ID NO: 4757675 - DNA, 16 bp, Homo sapiens
cttgattctaaagggg

SEQ ID NO: 4757676 - DNA, 14 bp, Homo sapiens
cttgatttttacat

SEQ ID NO: 4757677 - DNA, 15 bp, Homo sapiens
cttgcaagctccagt

SEQ ID NO: 4757678 - DNA, 16 bp, Homo sapiens
cttgcagtcatcagaa

SEQ ID NO: 4757679 - DNA, 20 bp, Homo sapiens
cttgcattttagctaattta

SEQ ID NO: 4757680 - DNA, 17 bp, Homo sapiens
cttgccactgccataac

SEQ ID NO: 4757681 - DNA, 19 bp, Homo sapiens
cttgccagcaacacctgcc

SEQ ID NO: 4757682 - DNA, 23 bp, Homo sapiens
cttgcctctttcctcctcatgaa

SEQ ID NO: 4757683 - DNA, 15 bp, Homo sapiens
cttgcggcaccgccc

SEQ ID NO: 4757684 - DNA, 22 bp, Homo sapiens
cttgctcctttccatcagcttt

SEQ ID NO: 4757685 - DNA, 15 bp, Homo sapiens
cttgctggaaaactg

SEQ ID NO: 4757686 - DNA, 12 bp, Homo sapiens
cttgctggagaa

SEQ ID NO: 4757687 - DNA, 15 bp, Homo sapiens
cttgctgtgacttat

SEQ ID NO: 4757688 - DNA, 14 bp, Homo sapiens
cttgcttccttctc

SEQ ID NO: 4757689 - DNA, 18 bp, Homo sapiens
cttggaacatttgggaga

SEQ ID NO: 4757690 - DNA, 20 bp, Homo sapiens
cttggactacctataaatgg

SEQ ID NO: 4757691 - DNA, 15 bp, Homo sapiens
cttggagagacacag

SEQ ID NO: 4757692 - DNA, 15 bp, Homo sapiens
cttggagcagagacg

SEQ ID NO: 4757693 - DNA, 16 bp, Homo sapiens
cttggagcagagacgg

SEQ ID NO: 4757694 - DNA, 23 bp, Homo sapiens
cttggagcagagacggcagcccc

SEQ ID NO: 4757695 - DNA, 23 bp, Homo sapiens
cttggagggatggagaggcggcc

SEQ ID NO: 4757696 - DNA, 16 bp, Homo sapiens
cttggcaccaaagatg

SEQ ID NO: 4757697 - DNA, 14 bp, Homo sapiens
cttggcattgacct

SEQ ID NO: 4757698 - DNA, 19 bp, Homo sapiens
cttggcattgaccttcatg

SEQ ID NO: 4757699 - DNA, 14 bp, Homo sapiens
cttggcccagcagc

SEQ ID NO: 4757700 - DNA, 14 bp, Homo sapiens
cttggcccctctct

SEQ ID NO: 4757701 - DNA, 17 bp, Homo sapiens
cttggcgctgcccctgg

SEQ ID NO: 4757702 - DNA, 22 bp, Homo sapiens
cttggcgctgcccctggcagcc

SEQ ID NO: 4757703 - DNA, 15 bp, Homo sapiens
cttggcgtggagcag

SEQ ID NO: 4757704 - DNA, 16 bp, Homo sapiens
cttgggagagcccctg

SEQ ID NO: 4757705 - DNA, 18 bp, Homo sapiens
cttgggagagcccctggg

SEQ ID NO: 4757706 - DNA, 17 bp, Homo sapiens
cttggggaccagagctg

SEQ ID NO: 4757707 - DNA, 21 bp, Homo sapiens
cttggggaccagagctgccac

SEQ ID NO: 4757708 - DNA, 22 bp, Homo sapiens
cttggggaccagagctgccacc

SEQ ID NO: 4757709 - DNA, 16 bp, Homo sapiens
cttgggggcagaccag

SEQ ID NO: 4757710 - DNA, 16 bp, Homo sapiens
cttggggtagagagga

SEQ ID NO: 4757711 - DNA, 13 bp, Homo sapiens
cttggtccttaaa

SEQ ID NO: 4757712 - DNA, 12 bp, Homo sapiens
cttggtctcttt

SEQ ID NO: 4757713 - DNA, 18 bp, Homo sapiens
cttggtctctttctttcc

SEQ ID NO: 4757714 - DNA, 15 bp, Homo sapiens
cttggtctgtgttct

SEQ ID NO: 4757715 - DNA, 16 bp, Homo sapiens
cttggtgactgtccca

SEQ ID NO: 4757716 - DNA, 13 bp, Homo sapiens
cttggttcctcca

SEQ ID NO: 4757717 - DNA, 16 bp, Homo sapiens
cttgtaaaactgtgac

SEQ ID NO: 4757718 - DNA, 19 bp, Homo sapiens
cttgtaaaactgtgacatt

SEQ ID NO: 4757719 - DNA, 16 bp, Homo sapiens
cttgtaccagcccagg

SEQ ID NO: 4757720 - DNA, 20 bp, Homo sapiens
cttgtacttacactgaaatc

SEQ ID NO: 4757721 - DNA, 15 bp, Homo sapiens
cttgtactttacaat

SEQ ID NO: 4757722 - DNA, 22 bp, Homo sapiens
cttgtattttcttcccatttgt

SEQ ID NO: 4757723 - DNA, 14 bp, Homo sapiens
cttgtctaaagatc

SEQ ID NO: 4757724 - DNA, 17 bp, Homo sapiens
cttgtctctctggcaat

SEQ ID NO: 4757725 - DNA, 16 bp, Homo sapiens
cttgtctgtgtatttc

SEQ ID NO: 4757726 - DNA, 14 bp, Homo sapiens
gaacgggcctcccc

SEQ ID NO: 4757727 - DNA, 15 bp, Homo sapiens
gaacgggcctccccg

SEQ ID NO: 4757728 - DNA, 22 bp, Homo sapiens
gaactaaatagatttttagatt

SEQ ID NO: 4757729 - DNA, 23 bp, Homo sapiens
gaactaagcatttttggcaacca

SEQ ID NO: 4757730 - DNA, 19 bp, Homo sapiens
gaactaatgacaagtgact

SEQ ID NO: 4757731 - DNA, 19 bp, Homo sapiens
gaactcacagactgctgtc

SEQ ID NO: 4757732 - DNA, 16 bp, Homo sapiens
gaactcagctgtctgt

SEQ ID NO: 4757733 - DNA, 21 bp, Homo sapiens
gaactcagctgtctgtggctt

SEQ ID NO: 4757734 - DNA, 17 bp, Homo sapiens
gaactcccccagaggtg

SEQ ID NO: 4757735 - DNA, 15 bp, Homo sapiens
gaactcccttctccc

SEQ ID NO: 4757736 - DNA, 21 bp, Homo sapiens
gaactcctgtgtgtggaaggc

SEQ ID NO: 4757737 - DNA, 14 bp, Homo sapiens
gaactccttggcct

SEQ ID NO: 4757738 - DNA, 20 bp, Homo sapiens
gaactctatctgggcctggg

SEQ ID NO: 4757739 - DNA, 22 bp, Homo sapiens
gaactctatctgggcctgggct

SEQ ID NO: 4757740 - DNA, 19 bp, Homo sapiens
gaactctgacaagggctga

SEQ ID NO: 4757741 - DNA, 16 bp, Homo sapiens
gaactgaagcagagtc

SEQ ID NO: 4757742 - DNA, 14 bp, Homo sapiens
gaactgcaacactg

SEQ ID NO: 4757743 - DNA, 15 bp, Homo sapiens
gaactggccccagct

SEQ ID NO: 4757744 - DNA, 14 bp, Homo sapiens
gaactgtgaatatg

SEQ ID NO: 4757745 - DNA, 18 bp, Homo sapiens
gaactgtgaatatgtgta

SEQ ID NO: 4757746 - DNA, 13 bp, Homo sapiens
gaacttggcgctg

SEQ ID NO: 4757747 - DNA, 13 bp, Homo sapiens
ggaaatcctgtta

SEQ ID NO: 4757748 - DNA, 12 bp, Homo sapiens
ggaaatttgtgt

SEQ ID NO: 4757749 - DNA, 15 bp, Homo sapiens
ggaaatttgtgtgct

SEQ ID NO: 4757750 - DNA, 15 bp, Homo sapiens
ggaacaaagacaacc

SEQ ID NO: 4757751 - DNA, 18 bp, Homo sapiens
ggaacaaattttcacaat

SEQ ID NO: 4757752 - DNA, 13 bp, Homo sapiens
ggaacagccctgc

SEQ ID NO: 4757753 - DNA, 17 bp, Homo sapiens
ggaacatttgggagact

SEQ ID NO: 4757754 - DNA, 16 bp, Homo sapiens
ggaaccatggaggagg

SEQ ID NO: 4757755 - DNA, 22 bp, Homo sapiens
ggaaccatggaggaggaagacc

SEQ ID NO: 4757756 - DNA, 18 bp, Homo sapiens
ggaacccatcactgtgtc

SEQ ID NO: 4757757 - DNA, 15 bp, Homo sapiens
ggaaccgaggactcc

SEQ ID NO: 4757758 - DNA, 12 bp, Homo sapiens
ggaaccttccct

SEQ ID NO: 4757759 - DNA, 16 bp, Homo sapiens
ggaaccttccctccaa

SEQ ID NO: 4757760 - DNA, 18 bp, Homo sapiens
ggaactcccccagaggtg

SEQ ID NO: 4757761 - DNA, 19 bp, Homo sapiens
ggaactcccccagaggtgg

SEQ ID NO: 4757762 - DNA, 13 bp, Homo sapiens
ggaactccttggc

SEQ ID NO: 4757763 - DNA, 16 bp, Homo sapiens
ggaactccttggccta

SEQ ID NO: 4757764 - DNA, 17 bp, Homo sapiens
ggaactccttggcctag

SEQ ID NO: 4757765 - DNA, 21 bp, Homo sapiens
ggaactctatctgggcctggg

SEQ ID NO: 4757766 - DNA, 13 bp, Homo sapiens
ggaactctgacaa

SEQ ID NO: 4757767 - DNA, 14 bp, Homo sapiens
ggaactctgacaag

SEQ ID NO: 4757768 - DNA, 23 bp, Homo sapiens
ggaagaacaaatatgattctcct

SEQ ID NO: 4757769 - DNA, 20 bp, Homo sapiens
ggaagaagagatcaggaaga

SEQ ID NO: 4757770 - DNA, 22 bp, Homo sapiens
ggaagaagagatcaggaagaga

SEQ ID NO: 4757771 - DNA, 11 bp, Homo sapiens
ggaagaattca

SEQ ID NO: 4757772 - DNA, 22 bp, Homo sapiens
ggaagacagagatggcagagcc

SEQ ID NO: 4757773 - DNA, 14 bp, Homo sapiens
ggaagacagctctt

SEQ ID NO: 4757774 - DNA, 14 bp, Homo sapiens
ggaagagagaggcc

SEQ ID NO: 4757775 - DNA, 15 bp, Homo sapiens
ggaagagagaggcct

SEQ ID NO: 4757776 - DNA, 17 bp, Homo sapiens
ggaagagagaggcctgg

SEQ ID NO: 4757777 - DNA, 17 bp, Homo sapiens
ggaagagctgctgtatt

SEQ ID NO: 4757778 - DNA, 18 bp, Homo sapiens
ggaagagctgctgtattt

SEQ ID NO: 4757779 - DNA, 16 bp, Homo sapiens
ggaagagggaggggcc

SEQ ID NO: 4757780 - DNA, 18 bp, Homo sapiens
ggaagagggaggggccct

SEQ ID NO: 4757781 - DNA, 18 bp, Homo sapiens
ggaagaggggcgctgccc

SEQ ID NO: 4757782 - DNA, 21 bp, Homo sapiens
ggaagaggggcgctgccccca

SEQ ID NO: 4757783 - DNA, 13 bp, Homo sapiens
ggaagcacatgcc

SEQ ID NO: 4757784 - DNA, 16 bp, Homo sapiens
ggaagccagcaggctc

SEQ ID NO: 4757785 - DNA, 22 bp, Homo sapiens
ggaagccagcaggctctcaggc

SEQ ID NO: 4757786 - DNA, 12 bp, Homo sapiens
ggaagcccaccc

SEQ ID NO: 4757787 - DNA, 15 bp, Homo sapiens
ggaagcccacccgcc

SEQ ID NO: 4757788 - DNA, 16 bp, Homo sapiens
ggaagctgcagcttgg

SEQ ID NO: 4757789 - DNA, 15 bp, Homo sapiens
ggaaggacacagtca

SEQ ID NO: 4757790 - DNA, 17 bp, Homo sapiens
ggaaggcagggaggagg

SEQ ID NO: 4757791 - DNA, 13 bp, Homo sapiens
ggaaggcctgagg

SEQ ID NO: 4757792 - DNA, 15 bp, Homo sapiens
ggaaggcctgaggga

SEQ ID NO: 4757793 - DNA, 22 bp, Homo sapiens
ggaaggcctgagggaagcccac

SEQ ID NO: 4757794 - DNA, 13 bp, Homo sapiens
ggaaggcctgggt

SEQ ID NO: 4757795 - DNA, 12 bp, Homo sapiens
ggaagggacccc

SEQ ID NO: 4757796 - DNA, 13 bp, Homo sapiens
ggaagggcaggag

SEQ ID NO: 4757797 - DNA, 14 bp, Homo sapiens
ggaagggcaggagc

SEQ ID NO: 4757798 - DNA, 19 bp, Homo sapiens
ggaagggcaggagctcaca

SEQ ID NO: 4757799 - DNA, 13 bp, Homo sapiens
ggaaggggacagg

SEQ ID NO: 4757800 - DNA, 17 bp, Homo sapiens
gctgtcaaatccatgtg

SEQ ID NO: 4757801 - DNA, 19 bp, Homo sapiens
gctgtcaattacaggaagt

SEQ ID NO: 4757802 - DNA, 17 bp, Homo sapiens
gctgtcagccattcctg

SEQ ID NO: 4757803 - DNA, 19 bp, Homo sapiens
gctgtcatgcccagcttgg

SEQ ID NO: 4757804 - DNA, 21 bp, Homo sapiens
gctgtcatgcccagcttggag

SEQ ID NO: 4757805 - DNA, 15 bp, Homo sapiens
gctgtccctgtgggc

SEQ ID NO: 4757806 - DNA, 19 bp, Homo sapiens
gctgtcccttacgtgagtc

SEQ ID NO: 4757807 - DNA, 15 bp, Homo sapiens
gctgtccgtcctgct

SEQ ID NO: 4757808 - DNA, 19 bp, Homo sapiens
gctgtcctctcgagcccag

SEQ ID NO: 4757809 - DNA, 20 bp, Homo sapiens
gctgtcctgagccccctgca

SEQ ID NO: 4757810 - DNA, 18 bp, Homo sapiens
gctgtcgccccaggccct

SEQ ID NO: 4757811 - DNA, 19 bp, Homo sapiens
gctgtcgccccaggccctc

SEQ ID NO: 4757812 - DNA, 21 bp, Homo sapiens
gctgtcttactaataggtctg

SEQ ID NO: 4757813 - DNA, 15 bp, Homo sapiens
gctgtgaaacagtgt

SEQ ID NO: 4757814 - DNA, 20 bp, Homo sapiens
gctgtgaaacagtgtggatg

SEQ ID NO: 4757815 - DNA, 20 bp, Homo sapiens
gctgtgaaatgactgcatca

SEQ ID NO: 4757816 - DNA, 11 bp, Homo sapiens
gctgtgaggac

SEQ ID NO: 4757817 - DNA, 14 bp, Homo sapiens
gctgtgaggacagg

SEQ ID NO: 4757818 - DNA, 14 bp, Homo sapiens
gctgtgatgcatga

SEQ ID NO: 4757819 - DNA, 13 bp, Homo sapiens
gctgtgcgggcgc

SEQ ID NO: 4757820 - DNA, 19 bp, Homo sapiens
gctgtgcgggcgcccggac

SEQ ID NO: 4757821 - DNA, 22 bp, Homo sapiens
gctgtggcccctccttctcccc

SEQ ID NO: 4757822 - DNA, 14 bp, Homo sapiens
gctgtgggcagcac

SEQ ID NO: 4757823 - DNA, 16 bp, Homo sapiens
gctgtgggcagcaccc

SEQ ID NO: 4757824 - DNA, 18 bp, Homo sapiens
gctgtgggcagcaccctc

SEQ ID NO: 4757825 - DNA, 20 bp, Homo sapiens
gctgtgggcagcaccctccc

SEQ ID NO: 4757826 - DNA, 19 bp, Homo sapiens
gctgtgtggggagggtggg

SEQ ID NO: 4757827 - DNA, 17 bp, Homo sapiens
gctgttatctgtcttta

SEQ ID NO: 4757828 - DNA, 16 bp, Homo sapiens
gctgttcattgatgac

SEQ ID NO: 4757829 - DNA, 13 bp, Homo sapiens
gctgttctgcact

SEQ ID NO: 4757830 - DNA, 16 bp, Homo sapiens
gctgttctgcactgaa

SEQ ID NO: 4757831 - DNA, 16 bp, Homo sapiens
gctgtttaccgcccac

SEQ ID NO: 4757832 - DNA, 22 bp, Homo sapiens
gctgtttacttgaatagtattg

SEQ ID NO: 4757833 - DNA, 16 bp, Homo sapiens
gctgttttggggtctt

SEQ ID NO: 4757834 - DNA, 14 bp, Homo sapiens
gcttaaaatgcaag

SEQ ID NO: 4757835 - DNA, 22 bp, Homo sapiens
gcttaacataaacttgtactta

SEQ ID NO: 4757836 - DNA, 14 bp, Homo sapiens
gcttaatctagagc

SEQ ID NO: 4757837 - DNA, 20 bp, Homo sapiens
gcttactagtatcactgctt

SEQ ID NO: 4757838 - DNA, 15 bp, Homo sapiens
gcttagaggagctct

SEQ ID NO: 4757839 - DNA, 21 bp, Homo sapiens
gcttagctgaaacctaaggca

SEQ ID NO: 4757840 - DNA, 23 bp, Homo sapiens
gcttagtatctcatcaacaaaga

SEQ ID NO: 4757841 - DNA, 14 bp, Homo sapiens
gcttattagcagct

SEQ ID NO: 4757842 - DNA, 22 bp, Homo sapiens
gcttatttatattcagagatgt

SEQ ID NO: 4757843 - DNA, 15 bp, Homo sapiens
gcttattttgtggct

SEQ ID NO: 4757844 - DNA, 19 bp, Homo sapiens
gcttcaccgcattccaggg

SEQ ID NO: 4757845 - DNA, 15 bp, Homo sapiens
gcttcataggcagag

SEQ ID NO: 4757846 - DNA, 12 bp, Homo sapiens
gcttcatcctcc

SEQ ID NO: 4757847 - DNA, 14 bp, Homo sapiens
gcttcatctggagt

SEQ ID NO: 4757848 - DNA, 15 bp, Homo sapiens
gcttcatctggagtc

SEQ ID NO: 4757849 - DNA, 16 bp, Homo sapiens
gcttcattaaaacaag

SEQ ID NO: 4757850 - DNA, 14 bp, Homo sapiens
gcggaaaccgggtg

SEQ ID NO: 4757851 - DNA, 20 bp, Homo sapiens
gcggaaaccgggtggcagcg

SEQ ID NO: 4757852 - DNA, 20 bp, Homo sapiens
gcggaccggagcggctgagg

SEQ ID NO: 4757853 - DNA, 21 bp, Homo sapiens
gcggaccggagcggctgagga

SEQ ID NO: 4757854 - DNA, 16 bp, Homo sapiens
gcggagcccccgcccc

SEQ ID NO: 4757855 - DNA, 20 bp, Homo sapiens
gcggaggggcttggagcaga

SEQ ID NO: 4757856 - DNA, 21 bp, Homo sapiens
gcggaggggcttggagcagag

SEQ ID NO: 4757857 - DNA, 18 bp, Homo sapiens
gcggcatccgagcccctg

SEQ ID NO: 4757858 - DNA, 13 bp, Homo sapiens
gcggcccggccca

SEQ ID NO: 4757859 - DNA, 20 bp, Homo sapiens
gcggcccgtgcgcagccgcg

SEQ ID NO: 4757860 - DNA, 17 bp, Homo sapiens
gcggccgctctccgccc

SEQ ID NO: 4757861 - DNA, 18 bp, Homo sapiens
gcggcctgcagaccctgc

SEQ ID NO: 4757862 - DNA, 21 bp, Homo sapiens
gcggcctgcagaccctgccag

SEQ ID NO: 4757863 - DNA, 13 bp, Homo sapiens
gcggcttccctgc

SEQ ID NO: 4757864 - DNA, 14 bp, Homo sapiens
gcgggacaggactt

SEQ ID NO: 4757865 - DNA, 15 bp, Homo sapiens
gcgggacaggacttg

SEQ ID NO: 4757866 - DNA, 17 bp, Homo sapiens
gcgggagtctcctcact

SEQ ID NO: 4757867 - DNA, 21 bp, Homo sapiens
gcgggagtctcctcactgcca

SEQ ID NO: 4757868 - DNA, 22 bp, Homo sapiens
gcgggagtctcctcactgccac

SEQ ID NO: 4757869 - DNA, 12 bp, Homo sapiens
gcgggcagcccc

SEQ ID NO: 4757870 - DNA, 13 bp, Homo sapiens
gcgggccaggaga

SEQ ID NO: 4757871 - DNA, 21 bp, Homo sapiens
gcggggcctgggtccccctcc

SEQ ID NO: 4757872 - DNA, 17 bp, Homo sapiens
gcggggtctgctcctgg

SEQ ID NO: 4757873 - DNA, 16 bp, Homo sapiens
gcgggtggctggagcc

SEQ ID NO: 4757874 - DNA, 23 bp, Homo sapiens
gcggtcactgcccacctgccagg

SEQ ID NO: 4757875 - DNA, 16 bp, Homo sapiens
gcggtggggagagatg

SEQ ID NO: 4757876 - DNA, 12 bp, Homo sapiens
gcgtaggagaga

SEQ ID NO: 4757877 - DNA, 19 bp, Homo sapiens
gcgtccacatacactgcat

SEQ ID NO: 4757878 - DNA, 19 bp, Homo sapiens
gcgtccaggtgatccccca

SEQ ID NO: 4757879 - DNA, 16 bp, Homo sapiens
gcgtccctagcagtga

SEQ ID NO: 4757880 - DNA, 16 bp, Homo sapiens
gcgtccttgtccccgc

SEQ ID NO: 4757881 - DNA, 15 bp, Homo sapiens
gcgtcctttcctctc

SEQ ID NO: 4757882 - DNA, 24 bp, Homo sapiens
gcgtcctttcctctcctctctgga

SEQ ID NO: 4757883 - DNA, 16 bp, Homo sapiens
gcgtgggatccagaga

SEQ ID NO: 4757884 - DNA, 17 bp, Homo sapiens
gcgtgtctcatttgcca

SEQ ID NO: 4757885 - DNA, 15 bp, Homo sapiens
gcgtgtggccctgtg

SEQ ID NO: 4757886 - DNA, 21 bp, Homo sapiens
gcgttgttttgtggataagaa

SEQ ID NO: 4757887 - DNA, 12 bp, Homo sapiens
gcgttttagagt

SEQ ID NO: 4757888 - DNA, 20 bp, Homo sapiens
gcgtttttttacaacattca

SEQ ID NO: 4757889 - DNA, 14 bp, Homo sapiens
gctaaacctatctg

SEQ ID NO: 4757890 - DNA, 16 bp, Homo sapiens
gctaaacctatctgta

SEQ ID NO: 4757891 - DNA, 22 bp, Homo sapiens
gctaaacctatctgtattggca

SEQ ID NO: 4757892 - DNA, 23 bp, Homo sapiens
gctaaagtgattccttcttgctc

SEQ ID NO: 4757893 - DNA, 12 bp, Homo sapiens
gctaaatgcaaa

SEQ ID NO: 4757894 - DNA, 13 bp, Homo sapiens
gctaacaagtagc

SEQ ID NO: 4757895 - DNA, 14 bp, Homo sapiens
gctaacagagactg

SEQ ID NO: 4757896 - DNA, 13 bp, Homo sapiens
gctaactggcccc

SEQ ID NO: 4757897 - DNA, 15 bp, Homo sapiens
gctaactggccccag

SEQ ID NO: 4757898 - DNA, 18 bp, Homo sapiens
gctaagaaagaaatgcta

SEQ ID NO: 4757899 - DNA, 16 bp, Homo sapiens
gctaagcctgatgatg

SEQ ID NO: 4757900 - DNA, 21 bp, Homo sapiens
gctaagtggaagacagagatg

SEQ ID NO: 4757901 - DNA, 12 bp, Homo sapiens
gctaatgaattt

SEQ ID NO: 4757902 - DNA, 18 bp, Homo sapiens
gctaatgaattttaaaag

SEQ ID NO: 4757903 - DNA, 20 bp, Homo sapiens
gctaatgaattttaaaagca

SEQ ID NO: 4757904 - DNA, 22 bp, Homo sapiens
gctaatgaattttaaaagcata

SEQ ID NO: 4757905 - DNA, 15 bp, Homo sapiens
gctaattaaaaagtt

SEQ ID NO: 4757906 - DNA, 15 bp, Homo sapiens
gctaatttgtgaaag

SEQ ID NO: 4757907 - DNA, 16 bp, Homo sapiens
gctacaggggaggctg

SEQ ID NO: 4757908 - DNA, 18 bp, Homo sapiens
gctaccaattgtttcttg

SEQ ID NO: 4757909 - DNA, 15 bp, Homo sapiens
gctaccaggaagagg

SEQ ID NO: 4757910 - DNA, 21 bp, Homo sapiens
gctagaaagagaaaaagccct

SEQ ID NO: 4757911 - DNA, 22 bp, Homo sapiens
gctagacgagcaggcttcttcc

SEQ ID NO: 4757912 - DNA, 17 bp, Homo sapiens
gctagagcattctgggg

SEQ ID NO: 4757913 - DNA, 19 bp, Homo sapiens
gctagagcattctggggtg

SEQ ID NO: 4757914 - DNA, 18 bp, Homo sapiens
gctaggttaataggagga

SEQ ID NO: 4757915 - DNA, 20 bp, Homo sapiens
gctagtccggacccacctca

SEQ ID NO: 4757916 - DNA, 22 bp, Homo sapiens
gctagtccggacccacctcacc

SEQ ID NO: 4757917 - DNA, 14 bp, Homo sapiens
gctagtctgtgcct

SEQ ID NO: 4757918 - DNA, 15 bp, Homo sapiens
gctagtctgtgcctc

SEQ ID NO: 4757919 - DNA, 18 bp, Homo sapiens
gctagtctgtgcctcagt

SEQ ID NO: 4757920 - DNA, 13 bp, Homo sapiens
gctagtgagctgg

SEQ ID NO: 4757921 - DNA, 14 bp, Homo sapiens
gctagtttaaaatt

SEQ ID NO: 4757922 - DNA, 14 bp, Homo sapiens
gctataaaagccca

SEQ ID NO: 4757923 - DNA, 16 bp, Homo sapiens
gctataaatagtgaaa

SEQ ID NO: 4757924 - DNA, 12 bp, Homo sapiens
gctatccagccg

SEQ ID NO: 4757925 - DNA, 18 bp, Homo sapiens
gctatgatatgtgcttgt

SEQ ID NO: 4757926 - DNA, 17 bp, Homo sapiens
gctatgcacaccaaatt

SEQ ID NO: 4757927 - DNA, 22 bp, Homo sapiens
gctatgcacaccaaattgctga

SEQ ID NO: 4757928 - DNA, 18 bp, Homo sapiens
gctatgcgcaatgtggca

SEQ ID NO: 4757929 - DNA, 15 bp, Homo sapiens
gctatggactgcaca

SEQ ID NO: 4757930 - DNA, 21 bp, Homo sapiens
gctatgtctcatgttttatat

SEQ ID NO: 4757931 - DNA, 15 bp, Homo sapiens
gctatgtctgtgatg

SEQ ID NO: 4757932 - DNA, 15 bp, Homo sapiens
gctgagtcggctggg

SEQ ID NO: 4757933 - DNA, 23 bp, Homo sapiens
gctgagtcggctgggcagggccg

SEQ ID NO: 4757934 - DNA, 17 bp, Homo sapiens
gctgagtgcgaccacca

SEQ ID NO: 4757935 - DNA, 19 bp, Homo sapiens
gctgatagtgtttcgttaa

SEQ ID NO: 4757936 - DNA, 22 bp, Homo sapiens
gctgatagtgtttcgttaagca

SEQ ID NO: 4757937 - DNA, 23 bp, Homo sapiens
gctgatagtgtttcgttaagcag

SEQ ID NO: 4757938 - DNA, 19 bp, Homo sapiens
gctgattggaaaataataa

SEQ ID NO: 4757939 - DNA, 21 bp, Homo sapiens
gctgattggaaaataataaaa

SEQ ID NO: 4757940 - DNA, 19 bp, Homo sapiens
gctgatttactaacagtaa

SEQ ID NO: 4757941 - DNA, 15 bp, Homo sapiens
gctgcaaaatgaaga

SEQ ID NO: 4757942 - DNA, 18 bp, Homo sapiens
gctgcacagtagtgttgg

SEQ ID NO: 4757943 - DNA, 22 bp, Homo sapiens
gctgcagctaatttgtgaaagt

SEQ ID NO: 4757944 - DNA, 12 bp, Homo sapiens
gctgcagcttgg

SEQ ID NO: 4757945 - DNA, 14 bp, Homo sapiens
gctgcagcttggga

SEQ ID NO: 4757946 - DNA, 16 bp, Homo sapiens
gctgcaggaatcaaaa

SEQ ID NO: 4757947 - DNA, 22 bp, Homo sapiens
gctgcaggaatcaaaaattgaa

SEQ ID NO: 4757948 - DNA, 20 bp, Homo sapiens
gctgcatcctcagccccagg

SEQ ID NO: 4757949 - DNA, 14 bp, Homo sapiens
gctgcatttcaagt

SEQ ID NO: 4757950 - DNA, 15 bp, Homo sapiens
gctgccaatgggagc

SEQ ID NO: 4757951 - DNA, 13 bp, Homo sapiens
gctgccacccacc

SEQ ID NO: 4757952 - DNA, 22 bp, Homo sapiens
gctgccacccaccccaagctgc

SEQ ID NO: 4757953 - DNA, 12 bp, Homo sapiens
gctgccacctgc

SEQ ID NO: 4757954 - DNA, 13 bp, Homo sapiens
gctgccacctgcc

SEQ ID NO: 4757955 - DNA, 15 bp, Homo sapiens
gctgcccctggcagc

SEQ ID NO: 4757956 - DNA, 18 bp, Homo sapiens
gctgcccctggcagcccc

SEQ ID NO: 4757957 - DNA, 19 bp, Homo sapiens
gctgcccctggcagcccct

SEQ ID NO: 4757958 - DNA, 20 bp, Homo sapiens
gctgccgcctcaccttcctt

SEQ ID NO: 4757959 - DNA, 13 bp, Homo sapiens
gctgccgctgcac

SEQ ID NO: 4757960 - DNA, 14 bp, Homo sapiens
gctgccgctgcacc

SEQ ID NO: 4757961 - DNA, 17 bp, Homo sapiens
gctgccgctgccgctgc

SEQ ID NO: 4757962 - DNA, 14 bp, Homo sapiens
gctgccgctgctct

SEQ ID NO: 4757963 - DNA, 12 bp, Homo sapiens
gctgcctccaag

SEQ ID NO: 4757964 - DNA, 14 bp, Homo sapiens
gctgcctccaagtc

SEQ ID NO: 4757965 - DNA, 23 bp, Homo sapiens
gctgcctccaagtcatgggagaa

SEQ ID NO: 4757966 - DNA, 19 bp, Homo sapiens
gctgcctccgggcctcggc

SEQ ID NO: 4757967 - DNA, 20 bp, Homo sapiens
gctgcctccgggcctcggcc

SEQ ID NO: 4757968 - DNA, 14 bp, Homo sapiens
gctgcctgccatgt

SEQ ID NO: 4757969 - DNA, 18 bp, Homo sapiens
gctgcctgccatgtgtga

SEQ ID NO: 4757970 - DNA, 22 bp, Homo sapiens
gctgcctgccatgtgtgagtca

SEQ ID NO: 4757971 - DNA, 20 bp, Homo sapiens
gctgcctgcccgcacagcag

SEQ ID NO: 4757972 - DNA, 13 bp, Homo sapiens
gctgcctgcctcc

SEQ ID NO: 4757973 - DNA, 15 bp, Homo sapiens
gctgcctgcctccgg

SEQ ID NO: 4757974 - DNA, 17 bp, Homo sapiens
gctgcctgcctccggcc

SEQ ID NO: 4757975 - DNA, 19 bp, Homo sapiens
gctgcctgcctccggccct

SEQ ID NO: 4757976 - DNA, 20 bp, Homo sapiens
gctgcctggcgggcagcccc

SEQ ID NO: 4757977 - DNA, 20 bp, Homo sapiens
gctgccttctgacggccctg

SEQ ID NO: 4757978 - DNA, 21 bp, Homo sapiens
gctgccttctgacggccctgc

SEQ ID NO: 4757979 - DNA, 22 bp, Homo sapiens
gcctgcgccccccagtggactc

SEQ ID NO: 4757980 - DNA, 18 bp, Homo sapiens
gcctgcgcctcctcctgc

SEQ ID NO: 4757981 - DNA, 20 bp, Homo sapiens
gcctgcgcctcctcctgcat

SEQ ID NO: 4757982 - DNA, 20 bp, Homo sapiens
gcctgcgctcctctgcagcc

SEQ ID NO: 4757983 - DNA, 21 bp, Homo sapiens
gcctgcgctcctctgcagcct

SEQ ID NO: 4757984 - DNA, 22 bp, Homo sapiens
gcctgcgctcctctgcagcctg

SEQ ID NO: 4757985 - DNA, 17 bp, Homo sapiens
gcctgcggggttccctg

SEQ ID NO: 4757986 - DNA, 19 bp, Homo sapiens
gcctgcggggttccctgcg

SEQ ID NO: 4757987 - DNA, 20 bp, Homo sapiens
gcctgcggggttccctgcgc

SEQ ID NO: 4757988 - DNA, 20 bp, Homo sapiens
gcctgctgctctctaagaat

SEQ ID NO: 4757989 - DNA, 13 bp, Homo sapiens
gcctgcttcccac

SEQ ID NO: 4757990 - DNA, 16 bp, Homo sapiens
gcctggacaaaccctt

SEQ ID NO: 4757991 - DNA, 13 bp, Homo sapiens
gcctggaggagaa

SEQ ID NO: 4757992 - DNA, 13 bp, Homo sapiens
gcctggcacagga

SEQ ID NO: 4757993 - DNA, 12 bp, Homo sapiens
gcctggcccagc

SEQ ID NO: 4757994 - DNA, 15 bp, Homo sapiens
gcctggccccaagca

SEQ ID NO: 4757995 - DNA, 19 bp, Homo sapiens
gcctggccctgccctgagg

SEQ ID NO: 4757996 - DNA, 17 bp, Homo sapiens
gcctggcctggccctgc

SEQ ID NO: 4757997 - DNA, 17 bp, Homo sapiens
gcctggcgggcagcccc

SEQ ID NO: 4757998 - DNA, 21 bp, Homo sapiens
gcctggcgggcagcccctgct

SEQ ID NO: 4757999 - DNA, 22 bp, Homo sapiens
gcctggcgggcagcccctgctg

SEQ ID NO: 4758000 - DNA, 12 bp, Homo sapiens
gcctggctctgg

SEQ ID NO: 4758001 - DNA, 14 bp, Homo sapiens
gcctggctctggag

SEQ ID NO: 4758002 - DNA, 22 bp, Homo sapiens
gcctgggaaattgctccattcc

SEQ ID NO: 4758003 - DNA, 16 bp, Homo sapiens
gcctgggacgcccctt

SEQ ID NO: 4758004 - DNA, 22 bp, Homo sapiens
gcctgggacgcccctttctctt

SEQ ID NO: 4758005 - DNA, 16 bp, Homo sapiens
gcctgggagatgcagc

SEQ ID NO: 4758006 - DNA, 20 bp, Homo sapiens
gcctgggagatgcagctgga

SEQ ID NO: 4758007 - DNA, 11 bp, Homo sapiens
gcctgggcaga

SEQ ID NO: 4758008 - DNA, 17 bp, Homo sapiens
gcctgggcagaaggaag

SEQ ID NO: 4758009 - DNA, 22 bp, Homo sapiens
gcctgggggctgggcagaggaa

SEQ ID NO: 4758010 - DNA, 16 bp, Homo sapiens
gcctgggtccccctcc

SEQ ID NO: 4758011 - DNA, 18 bp, Homo sapiens
gcctgggtccccctcctg

SEQ ID NO: 4758012 - DNA, 19 bp, Homo sapiens
gcctgggtggatcggcctc

SEQ ID NO: 4758013 - DNA, 16 bp, Homo sapiens
gcctggtaggtctgga

SEQ ID NO: 4758014 - DNA, 12 bp, Homo sapiens
gcctggtctgga

SEQ ID NO: 4758015 - DNA, 13 bp, Homo sapiens
gcctggtctggag

SEQ ID NO: 4758016 - DNA, 19 bp, Homo sapiens
gcctggtctgtgcattgtg

SEQ ID NO: 4758017 - DNA, 19 bp, Homo sapiens
gcctgtggtgaggtcctgt

SEQ ID NO: 4758018 - DNA, 13 bp, Homo sapiens
gcctgtgtttcat

SEQ ID NO: 4758019 - DNA, 19 bp, Homo sapiens
gcctgtgtttcatgttctg

SEQ ID NO: 4758020 - DNA, 20 bp, Homo sapiens
gcctgtgtttcatgttctgt

SEQ ID NO: 4758021 - DNA, 23 bp, Homo sapiens
gcctgtgtttcatgttctgtgtc

SEQ ID NO: 4758022 - DNA, 15 bp, Homo sapiens
gcctgttaggtctgt

SEQ ID NO: 4758023 - DNA, 16 bp, Homo sapiens
gcctgttgatctatgg

SEQ ID NO: 4758024 - DNA, 15 bp, Homo sapiens
gcctgttgggccagg

SEQ ID NO: 4758025 - DNA, 18 bp, Homo sapiens
gcctgttgggccaggagc

SEQ ID NO: 4758026 - DNA, 20 bp, Homo sapiens
gcctgttgggccaggagcct

SEQ ID NO: 4758027 - DNA, 21 bp, Homo sapiens
gccttacacaatggttttctt

SEQ ID NO: 4758028 - DNA, 13 bp, Homo sapiens
gccttagaggagc

SEQ ID NO: 4758029 - DNA, 23 bp, Homo sapiens
gccttccaccctgccctggccta

SEQ ID NO: 4758030 - DNA, 15 bp, Homo sapiens
gccttccccgtgcgg

SEQ ID NO: 4758031 - DNA, 20 bp, Homo sapiens
gccttccctttacagctctc

SEQ ID NO: 4758032 - DNA, 19 bp, Homo sapiens
gccttctgacggccctgca

SEQ ID NO: 4758033 - DNA, 16 bp, Homo sapiens
gccttctgatgaaatg

SEQ ID NO: 4758034 - DNA, 13 bp, Homo sapiens
gccttgcctccag

SEQ ID NO: 4758035 - DNA, 17 bp, Homo sapiens
gccttggttcctccagc

SEQ ID NO: 4758036 - DNA, 16 bp, Homo sapiens
gccttgttgtattcct

SEQ ID NO: 4758037 - DNA, 18 bp, Homo sapiens
gccttgttgtattcctgc

SEQ ID NO: 4758038 - DNA, 14 bp, Homo sapiens
gcctttaggcagga

SEQ ID NO: 4758039 - DNA, 15 bp, Homo sapiens
gcctttaggcaggaa

SEQ ID NO: 4758040 - DNA, 19 bp, Homo sapiens
gcctttgcgctctgggttt

SEQ ID NO: 4758041 - DNA, 11 bp, Homo sapiens
gcctttgtaac

SEQ ID NO: 4758042 - DNA, 13 bp, Homo sapiens
gccttttgacagc

SEQ ID NO: 4758043 - DNA, 21 bp, Homo sapiens
gcgaagtccgaggcctggctc

SEQ ID NO: 4758044 - DNA, 14 bp, Homo sapiens
gcgaccacccctgt

SEQ ID NO: 4758045 - DNA, 17 bp, Homo sapiens
gcgaccacccctgtgcg

SEQ ID NO: 4758046 - DNA, 14 bp, Homo sapiens
gcgagaagggcgca

SEQ ID NO: 4758047 - DNA, 14 bp, Homo sapiens
gcgaggcagaatgg

SEQ ID NO: 4758048 - DNA, 13 bp, Homo sapiens
gcgagtccagaca

SEQ ID NO: 4758049 - DNA, 14 bp, Homo sapiens
gcgatctcagctca

SEQ ID NO: 4758050 - DNA, 22 bp, Homo sapiens
gcgatgtgttctttgtacctgt

SEQ ID NO: 4758051 - DNA, 15 bp, Homo sapiens
gcgcagatcaacaga

SEQ ID NO: 4758052 - DNA, 13 bp, Homo sapiens
gcgcagcccccac

SEQ ID NO: 4758053 - DNA, 17 bp, Homo sapiens
gcgcaggaaccgaggac

SEQ ID NO: 4758054 - DNA, 20 bp, Homo sapiens
gcgcatagtgtgctcggaca

SEQ ID NO: 4758055 - DNA, 15 bp, Homo sapiens
gcgcatggcgccccg

SEQ ID NO: 4758056 - DNA, 17 bp, Homo sapiens
gcgcatggcgccccggg

SEQ ID NO: 4758057 - DNA, 16 bp, Homo sapiens
gcgccaccgtgggaga

SEQ ID NO: 4758058 - DNA, 18 bp, Homo sapiens
gcgcccagcctggcccca

SEQ ID NO: 4758059 - DNA, 15 bp, Homo sapiens
gcgcccccaggaccc

SEQ ID NO: 4758060 - DNA, 18 bp, Homo sapiens
gcgccccccagtggactc

SEQ ID NO: 4758061 - DNA, 20 bp, Homo sapiens
gcgccccccagtggactcgc

SEQ ID NO: 4758062 - DNA, 14 bp, Homo sapiens
gcgccccgccccca

SEQ ID NO: 4758063 - DNA, 18 bp, Homo sapiens
gcgccccgcccccacccc

SEQ ID NO: 4758064 - DNA, 19 bp, Homo sapiens
gccccgtgctcctctgccc

SEQ ID NO: 4758065 - DNA, 18 bp, Homo sapiens
gcccctatcctgcaccct

SEQ ID NO: 4758066 - DNA, 16 bp, Homo sapiens
gcccctccacgcctcc

SEQ ID NO: 4758067 - DNA, 16 bp, Homo sapiens
gcccctccgggcagag

SEQ ID NO: 4758068 - DNA, 18 bp, Homo sapiens
gcccctccgggcagagac

SEQ ID NO: 4758069 - DNA, 13 bp, Homo sapiens
gcccctccgtccc

SEQ ID NO: 4758070 - DNA, 14 bp, Homo sapiens
gcccctccgtcccc

SEQ ID NO: 4758071 - DNA, 17 bp, Homo sapiens
gcccctccgtccccagg

SEQ ID NO: 4758072 - DNA, 19 bp, Homo sapiens
gcccctcctccagagcctg

SEQ ID NO: 4758073 - DNA, 22 bp, Homo sapiens
gcccctcctccagagcctgggc

SEQ ID NO: 4758074 - DNA, 12 bp, Homo sapiens
gcccctcctcgg

SEQ ID NO: 4758075 - DNA, 19 bp, Homo sapiens
gcccctcctctcctcgtcc

SEQ ID NO: 4758076 - DNA, 15 bp, Homo sapiens
gcccctccttctccc

SEQ ID NO: 4758077 - DNA, 16 bp, Homo sapiens
gcccctccttctcccc

SEQ ID NO: 4758078 - DNA, 19 bp, Homo sapiens
gcccctccttctcccctcc

SEQ ID NO: 4758079 - DNA, 20 bp, Homo sapiens
gcccctccttctcccctcca

SEQ ID NO: 4758080 - DNA, 18 bp, Homo sapiens
gcccctctgcgccccagc

SEQ ID NO: 4758081 - DNA, 20 bp, Homo sapiens
gcccctgagggacgagcaga

SEQ ID NO: 4758082 - DNA, 21 bp, Homo sapiens
gcccctgagggacgagcagag

SEQ ID NO: 4758083 - DNA, 22 bp, Homo sapiens
gcccctgagggacgagcagagc

SEQ ID NO: 4758084 - DNA, 14 bp, Homo sapiens
gcccctgcccagca

SEQ ID NO: 4758085 - DNA, 15 bp, Homo sapiens
gcccctgcccagcac

SEQ ID NO: 4758086 - DNA, 19 bp, Homo sapiens
gcccctgcccagcacctcc

SEQ ID NO: 4758087 - DNA, 16 bp, Homo sapiens
gcccctggcagcccct

SEQ ID NO: 4758088 - DNA, 17 bp, Homo sapiens
gcccctggcagcccctg

SEQ ID NO: 4758089 - DNA, 15 bp, Homo sapiens
gcccctgtccatccg

SEQ ID NO: 4758090 - DNA, 16 bp, Homo sapiens
gcccctgtttctcctc

SEQ ID NO: 4758091 - DNA, 19 bp, Homo sapiens
gcccctgtttctcctccat

SEQ ID NO: 4758092 - DNA, 13 bp, Homo sapiens
gccccttcccacg

SEQ ID NO: 4758093 - DNA, 17 bp, Homo sapiens
gccccttcccacgtccc

SEQ ID NO: 4758094 - DNA, 16 bp, Homo sapiens
gccccttggggagcag

SEQ ID NO: 4758095 - DNA, 14 bp, Homo sapiens
gcccctttctcttg

SEQ ID NO: 4758096 - DNA, 20 bp, Homo sapiens
gcccgagccccttggggagc

SEQ ID NO: 4758097 - DNA, 21 bp, Homo sapiens
gcccgagcgcgtgccttcccc

SEQ ID NO: 4758098 - DNA, 15 bp, Homo sapiens
gcccgaggccagggc

SEQ ID NO: 4758099 - DNA, 18 bp, Homo sapiens
gcccgaggccagggccgc

SEQ ID NO: 4758100 - DNA, 24 bp, Homo sapiens
gcccgcacaccctcactctgccag

SEQ ID NO: 4758101 - DNA, 15 bp, Homo sapiens
gcccgcacagcagcc

SEQ ID NO: 4758102 - DNA, 17 bp, Homo sapiens
gcccgcacagcagcctg

SEQ ID NO: 4758103 - DNA, 18 bp, Homo sapiens
gcccgcacagcagcctgc

SEQ ID NO: 4758104 - DNA, 12 bp, Homo sapiens
gcccgccacctt

SEQ ID NO: 4758105 - DNA, 21 bp, Homo sapiens
gcccgcccaccccgctgcctg

SEQ ID NO: 4758106 - DNA, 18 bp, Homo sapiens
gcccgcccacctgggccc

SEQ ID NO: 4758107 - DNA, 13 bp, Homo sapiens
gcccgccccaggc

SEQ ID NO: 4758108 - DNA, 21 bp, Homo sapiens
gcccgccccaggccccagcag

SEQ ID NO: 4758109 - DNA, 21 bp, Homo sapiens
gcccgcccccgccctcgctcc

SEQ ID NO: 4758110 - DNA, 13 bp, Homo sapiens
gcccgccctcctc

SEQ ID NO: 4758111 - DNA, 14 bp, Homo sapiens
gcccgccctcctct

SEQ ID NO: 4758112 - DNA, 18 bp, Homo sapiens
gcccgccctcctctgccc

SEQ ID NO: 4758113 - DNA, 20 bp, Homo sapiens
gcccgccgcctccctcaccc

SEQ ID NO: 4758114 - DNA, 18 bp, Homo sapiens
gcccgccggttggccggc

SEQ ID NO: 4758115 - DNA, 20 bp, Homo sapiens
gcccgccggttggccggctg

SEQ ID NO: 4758116 - DNA, 15 bp, Homo sapiens
gcccgcgcccgccgc

SEQ ID NO: 4758117 - DNA, 22 bp, Homo sapiens
gcccgcgggtggctggagcccc

SEQ ID NO: 4758118 - DNA, 17 bp, Homo sapiens
gcccgctcaacctctca

SEQ ID NO: 4758119 - DNA, 20 bp, Homo sapiens
gcccggactgaccgaaggga

SEQ ID NO: 4758120 - DNA, 14 bp, Homo sapiens
gcccggccaaggac

SEQ ID NO: 4758121 - DNA, 17 bp, Homo sapiens
gcccggccaaggacact

SEQ ID NO: 4758122 - DNA, 22 bp, Homo sapiens
gcccggccaaggacactgatgg

SEQ ID NO: 4758123 - DNA, 21 bp, Homo sapiens
gcccggcccaccagggactgc

SEQ ID NO: 4758124 - DNA, 13 bp, Homo sapiens
gcccggcccacgc

SEQ ID NO: 4758125 - DNA, 19 bp, Homo sapiens
gcccggcccacgcagagcc

SEQ ID NO: 4758126 - DNA, 16 bp, Homo sapiens
gcccggcctcctagcc

SEQ ID NO: 4758127 - DNA, 16 bp, Homo sapiens
gcccgtgcgcagccgc

SEQ ID NO: 4758128 - DNA, 22 bp, Homo sapiens
gcccgtggtgaggttgtgctgc

SEQ ID NO: 4758129 - DNA, 13 bp, Homo sapiens
gcccgtgtggcct

SEQ ID NO: 4758130 - DNA, 19 bp, Homo sapiens
gcccgtgtggcctgggtcc

SEQ ID NO: 4758131 - DNA, 20 bp, Homo sapiens
gccctattataattgtcatg

SEQ ID NO: 4758132 - DNA, 18 bp, Homo sapiens
gccctcactccactcccc

SEQ ID NO: 4758133 - DNA, 12 bp, Homo sapiens
gccctcagaaca

SEQ ID NO: 4758134 - DNA, 23 bp, Homo sapiens
gccctcatcttgaagggcccagg

SEQ ID NO: 4758135 - DNA, 10 bp, Homo sapiens
gccctccccc

SEQ ID NO: 4758136 - DNA, 15 bp, Homo sapiens
gccctcccccttccc

SEQ ID NO: 4758137 - DNA, 14 bp, Homo sapiens
gccctccctccctc

SEQ ID NO: 4758138 - DNA, 17 bp, Homo sapiens
gccctccctccctccac

SEQ ID NO: 4758139 - DNA, 22 bp, Homo sapiens
gccctccctgactccctgtggg

SEQ ID NO: 4758140 - DNA, 18 bp, Homo sapiens
gccctccctgctgccagg

SEQ ID NO: 4758141 - DNA, 18 bp, Homo sapiens
gccctccgccagccctgt

SEQ ID NO: 4758142 - DNA, 14 bp, Homo sapiens
gccctccgcccttc

SEQ ID NO: 4758143 - DNA, 12 bp, Homo sapiens
gccctcctctgc

SEQ ID NO: 4758144 - DNA, 18 bp, Homo sapiens
gccctcctctgccccctc

SEQ ID NO: 4758145 - DNA, 23 bp, Homo sapiens
gccctcctctgccccctcccccg

SEQ ID NO: 4758146 - DNA, 15 bp, Homo sapiens
gccctcgggccctct

SEQ ID NO: 4758147 - DNA, 14 bp, Homo sapiens
gccctctctgcagt

SEQ ID NO: 4758148 - DNA, 13 bp, Homo sapiens
gccctctgccact

SEQ ID NO: 4758149 - DNA, 15 bp, Homo sapiens
gccctcttcaatccc

SEQ ID NO: 4758150 - DNA, 16 bp, Homo sapiens
gccctctttctctctg

SEQ ID NO: 4758151 - DNA, 17 bp, Homo sapiens
gccctctttctctctgt

SEQ ID NO: 4758152 - DNA, 22 bp, Homo sapiens
gccctctttctctctgtgtggc

SEQ ID NO: 4758153 - DNA, 21 bp, Homo sapiens
gccctgaaatggcctgtccct

SEQ ID NO: 4758154 - DNA, 15 bp, Homo sapiens
gccctgacaggcctt

SEQ ID NO: 4758155 - DNA, 18 bp, Homo sapiens
gccctgacaggccttcct

SEQ ID NO: 4758156 - DNA, 19 bp, Homo sapiens
gcatgggaatgaatgtcag

SEQ ID NO: 4758157 - DNA, 18 bp, Homo sapiens
gcatggtaccagccctgg

SEQ ID NO: 4758158 - DNA, 23 bp, Homo sapiens
gcatggtaccagccctggggctg

SEQ ID NO: 4758159 - DNA, 16 bp, Homo sapiens
gcatgtcacatgacat

SEQ ID NO: 4758160 - DNA, 18 bp, Homo sapiens
gcatgtcctatccctgga

SEQ ID NO: 4758161 - DNA, 18 bp, Homo sapiens
gcatgtcggggcccctgc

SEQ ID NO: 4758162 - DNA, 14 bp, Homo sapiens
gcattgaacttctt

SEQ ID NO: 4758163 - DNA, 20 bp, Homo sapiens
gcattgcactaaaagtgatg

SEQ ID NO: 4758164 - DNA, 21 bp, Homo sapiens
gcattgcactaaaagtgatgt

SEQ ID NO: 4758165 - DNA, 18 bp, Homo sapiens
gcattggggggccgggca

SEQ ID NO: 4758166 - DNA, 12 bp, Homo sapiens
gcattgtggctg

SEQ ID NO: 4758167 - DNA, 15 bp, Homo sapiens
gcattgtggctgtca

SEQ ID NO: 4758168 - DNA, 13 bp, Homo sapiens
gcatttatgcatg

SEQ ID NO: 4758169 - DNA, 23 bp, Homo sapiens
gcatttgcaggtgaccagaatga

SEQ ID NO: 4758170 - DNA, 15 bp, Homo sapiens
gcatttgctgaataa

SEQ ID NO: 4758171 - DNA, 20 bp, Homo sapiens
gcatttgctgaataacaaca

SEQ ID NO: 4758172 - DNA, 15 bp, Homo sapiens
gcatttgtgagccaa

SEQ ID NO: 4758173 - DNA, 13 bp, Homo sapiens
gcattttactatg

SEQ ID NO: 4758174 - DNA, 22 bp, Homo sapiens
gcattttactatgcctgttgat

SEQ ID NO: 4758175 - DNA, 22 bp, Homo sapiens
gcattttgggggtttttaatct

SEQ ID NO: 4758176 - DNA, 17 bp, Homo sapiens
gccaaaaggccccttcc

SEQ ID NO: 4758177 - DNA, 19 bp, Homo sapiens
gccaaaaggccccttccca

SEQ ID NO: 4758178 - DNA, 14 bp, Homo sapiens
gccaaactcacctg

SEQ ID NO: 4758179 - DNA, 15 bp, Homo sapiens
gccaaagatagcaga

SEQ ID NO: 4758180 - DNA, 20 bp, Homo sapiens
gccaaagatagcagaagagt

SEQ ID NO: 4758181 - DNA, 14 bp, Homo sapiens
gccaaaggaagcac

SEQ ID NO: 4758182 - DNA, 20 bp, Homo sapiens
gccaaaggaagcacatgcct

SEQ ID NO: 4758183 - DNA, 20 bp, Homo sapiens
gccaaatgagttcccttgat

SEQ ID NO: 4758184 - DNA, 15 bp, Homo sapiens
gccaaccagcttgtc

SEQ ID NO: 4758185 - DNA, 18 bp, Homo sapiens
gccaaccccatcctcaca

SEQ ID NO: 4758186 - DNA, 22 bp, Homo sapiens
gccaacttaaacctgtgctttc

SEQ ID NO: 4758187 - DNA, 15 bp, Homo sapiens
gccaagaattagatt

SEQ ID NO: 4758188 - DNA, 21 bp, Homo sapiens
gccaagccagggttccagaca

SEQ ID NO: 4758189 - DNA, 14 bp, Homo sapiens
gccaaggacactga

SEQ ID NO: 4758190 - DNA, 20 bp, Homo sapiens
gccaaggacactgatgggtc

SEQ ID NO: 4758191 - DNA, 21 bp, Homo sapiens
gccaaggcatccccagtgcca

SEQ ID NO: 4758192 - DNA, 14 bp, Homo sapiens
gccaatgtccaggt

SEQ ID NO: 4758193 - DNA, 15 bp, Homo sapiens
gccaatgtccaggtc

SEQ ID NO: 4758194 - DNA, 13 bp, Homo sapiens
gccacaatcacta

SEQ ID NO: 4758195 - DNA, 17 bp, Homo sapiens
gccacaatcactaaata

SEQ ID NO: 4758196 - DNA, 13 bp, Homo sapiens
gccacaatgtgat

SEQ ID NO: 4758197 - DNA, 21 bp, Homo sapiens
gccacactggccggcccacgt

SEQ ID NO: 4758198 - DNA, 16 bp, Homo sapiens
gccacagcagcctctg

SEQ ID NO: 4758199 - DNA, 16 bp, Homo sapiens
gccacatcgcagcccc

SEQ ID NO: 4758200 - DNA, 15 bp, Homo sapiens
gccacatggccgctg

SEQ ID NO: 4758201 - DNA, 14 bp, Homo sapiens
gccaccacccaccc

SEQ ID NO: 4758202 - DNA, 15 bp, Homo sapiens
gccaccacccacccc

SEQ ID NO: 4758203 - DNA, 13 bp, Homo sapiens
gccaccacctgga

SEQ ID NO: 4758204 - DNA, 16 bp, Homo sapiens
gccacccatgaggctt

SEQ ID NO: 4758205 - DNA, 12 bp, Homo sapiens
gccacccgcccg

SEQ ID NO: 4758206 - DNA, 18 bp, Homo sapiens
gccacccggatctccagg

SEQ ID NO: 4758207 - DNA, 20 bp, Homo sapiens
gccacccggatctccaggcc

SEQ ID NO: 4758208 - DNA, 22 bp, Homo sapiens
gccacccggatctccaggccca

SEQ ID NO: 4758209 - DNA, 18 bp, Homo sapiens
gccaccctctgctgcaca

SEQ ID NO: 4758210 - DNA, 19 bp, Homo sapiens
gccaccttgtacagaacca

SEQ ID NO: 4758211 - DNA, 19 bp, Homo sapiens
gccacgtggccgctgccca

SEQ ID NO: 4758212 - DNA, 17 bp, Homo sapiens
gccacgttgcagaaaaa

SEQ ID NO: 4758213 - DNA, 14 bp, Homo sapiens
gccactaaaatcca

SEQ ID NO: 4758214 - DNA, 23 bp, Homo sapiens
gccactaaaatccacccagccca

SEQ ID NO: 4758215 - DNA, 14 bp, Homo sapiens
gccactaaggtcag

SEQ ID NO: 4758216 - DNA, 17 bp, Homo sapiens
gccactgcaacccatga

SEQ ID NO: 4758217 - DNA, 23 bp, Homo sapiens
gccactgccataacttgtttgta

SEQ ID NO: 4758218 - DNA, 18 bp, Homo sapiens
gccagacgctgccgctgc

SEQ ID NO: 4758219 - DNA, 19 bp, Homo sapiens
gccagacgctgccgctgcc

SEQ ID NO: 4758220 - DNA, 12 bp, Homo sapiens
gccagagacaca

SEQ ID NO: 4758221 - DNA, 16 bp, Homo sapiens
gccagagacacaagcc

SEQ ID NO: 4758222 - DNA, 21 bp, Homo sapiens
gccagagacacaagccttcgg

SEQ ID NO: 4758223 - DNA, 10 bp, Homo sapiens
gccagaggag

SEQ ID NO: 4758224 - DNA, 17 bp, Homo sapiens
gccagaggagagaggac

SEQ ID NO: 4758225 - DNA, 21 bp, Homo sapiens
gccagagtgtcctgctacctt

SEQ ID NO: 4758226 - DNA, 17 bp, Homo sapiens
gccagatgacagggagc

SEQ ID NO: 4758227 - DNA, 12 bp, Homo sapiens
gccagcaccctc

SEQ ID NO: 4758228 - DNA, 13 bp, Homo sapiens
gccagcaccctct

SEQ ID NO: 4758229 - DNA, 14 bp, Homo sapiens
gccagcaccctctc

SEQ ID NO: 4758230 - DNA, 20 bp, Homo sapiens
gccagcacgttctccagact

SEQ ID NO: 4758231 - DNA, 13 bp, Homo sapiens
gccagcaggctct

SEQ ID NO: 4758232 - DNA, 17 bp, Homo sapiens
gccagcaggctctcagg

SEQ ID NO: 4758233 - DNA, 18 bp, Homo sapiens
gccagcaggctctcaggc

SEQ ID NO: 4758234 - DNA, 19 bp, Homo sapiens
gccagcaggctctcaggcc

SEQ ID NO: 4758235 - DNA, 23 bp, Homo sapiens
gccagcaggctctcaggccagct

SEQ ID NO: 4758236 - DNA, 13 bp, Homo sapiens
gccagcagggcgg

SEQ ID NO: 4758237 - DNA, 14 bp, Homo sapiens
gccagcagggcggg

SEQ ID NO: 4758238 - DNA, 20 bp, Homo sapiens
gccagcagggcgggccagga

SEQ ID NO: 4758239 - DNA, 22 bp, Homo sapiens
gccagcagggcgggccaggaga

SEQ ID NO: 4758240 - DNA, 23 bp, Homo sapiens
gccagcagggcgggccaggagaa

SEQ ID NO: 4758241 - DNA, 18 bp, Homo sapiens
gccagcaggttctctcct

SEQ ID NO: 4758242 - DNA, 12 bp, Homo sapiens
gccagccctgtt

SEQ ID NO: 4758243 - DNA, 16 bp, Homo sapiens
gccagccgccctgggc

SEQ ID NO: 4758244 - DNA, 19 bp, Homo sapiens
gccagcctggggcctggca

SEQ ID NO: 4758245 - DNA, 22 bp, Homo sapiens
gccagcgctgaacagaccgggg

SEQ ID NO: 4758246 - DNA, 18 bp, Homo sapiens
gccagctgcttgggcttc

SEQ ID NO: 4758247 - DNA, 14 bp, Homo sapiens
gccagctggtgaat

SEQ ID NO: 4758248 - DNA, 13 bp, Homo sapiens
gccaggaagccag

SEQ ID NO: 4758249 - DNA, 18 bp, Homo sapiens
gccaggaaggggacagga

SEQ ID NO: 4758250 - DNA, 14 bp, Homo sapiens
gccaggagaccctg

SEQ ID NO: 4758251 - DNA, 20 bp, Homo sapiens
gccaggccctctctgcagtc

SEQ ID NO: 4758252 - DNA, 18 bp, Homo sapiens
gccaggcctcagggacca

SEQ ID NO: 4758253 - DNA, 14 bp, Homo sapiens
gccaggcctcccgc

SEQ ID NO: 4758254 - DNA, 16 bp, Homo sapiens
gccaggctggagtgca

SEQ ID NO: 4758255 - DNA, 18 bp, Homo sapiens
gccagggacattttcaag

SEQ ID NO: 4758256 - DNA, 16 bp, Homo sapiens
gacatctctgactttc

SEQ ID NO: 4758257 - DNA, 16 bp, Homo sapiens
gacatgagagtagggc

SEQ ID NO: 4758258 - DNA, 15 bp, Homo sapiens
gacatgcactgaccc

SEQ ID NO: 4758259 - DNA, 16 bp, Homo sapiens
gacatgcactgaccct

SEQ ID NO: 4758260 - DNA, 19 bp, Homo sapiens
gacatgctaacctctctga

SEQ ID NO: 4758261 - DNA, 16 bp, Homo sapiens
gacattgtcagaatgt

SEQ ID NO: 4758262 - DNA, 17 bp, Homo sapiens
gacattttgtagctagt

SEQ ID NO: 4758263 - DNA, 18 bp, Homo sapiens
gacattttgtagctagtt

SEQ ID NO: 4758264 - DNA, 15 bp, Homo sapiens
gaccaaatgtaaaat

SEQ ID NO: 4758265 - DNA, 17 bp, Homo sapiens
gaccaaatgtaaaatat

SEQ ID NO: 4758266 - DNA, 21 bp, Homo sapiens
gaccaacgatcctatgagaga

SEQ ID NO: 4758267 - DNA, 21 bp, Homo sapiens
gaccaaggtgcggaccggagc

SEQ ID NO: 4758268 - DNA, 12 bp, Homo sapiens
gaccaagtctct

SEQ ID NO: 4758269 - DNA, 12 bp, Homo sapiens
gggcagcccctc

SEQ ID NO: 4758270 - DNA, 14 bp, Homo sapiens
gggcagcccctccc

SEQ ID NO: 4758271 - DNA, 14 bp, Homo sapiens
gggcaggagctcac

SEQ ID NO: 4758272 - DNA, 14 bp, Homo sapiens
gggcagggccgcag

SEQ ID NO: 4758273 - DNA, 15 bp, Homo sapiens
gggcagggccgcagg

SEQ ID NO: 4758274 - DNA, 11 bp, Homo sapiens
gggcagggtgg

SEQ ID NO: 4758275 - DNA, 16 bp, Homo sapiens
gggcaggtcctgccca

SEQ ID NO: 4758276 - DNA, 17 bp, Homo sapiens
gggcaggtcctgcccat

SEQ ID NO: 4758277 - DNA, 16 bp, Homo sapiens
gggcagtggagagggg

SEQ ID NO: 4758278 - DNA, 19 bp, Homo sapiens
gggcatggtaccagccctg

SEQ ID NO: 4758279 - DNA, 20 bp, Homo sapiens
gggccaagccagggttccag

SEQ ID NO: 4758280 - DNA, 23 bp, Homo sapiens
gggccaagccagggttccagaca

SEQ ID NO: 4758281 - DNA, 24 bp, Homo sapiens
gggccaagccagggttccagacag

SEQ ID NO: 4758282 - DNA, 18 bp, Homo sapiens
gggccaggaaggggacag

SEQ ID NO: 4758283 - DNA, 18 bp, Homo sapiens
gggccatgttcccagaac

SEQ ID NO: 4758284 - DNA, 19 bp, Homo sapiens
gggccatttcacattcctg

SEQ ID NO: 4758285 - DNA, 21 bp, Homo sapiens
gggcccatggccccagctggc

SEQ ID NO: 4758286 - DNA, 15 bp, Homo sapiens
gggccccccagctca

SEQ ID NO: 4758287 - DNA, 12 bp, Homo sapiens
gggcccctccac

SEQ ID NO: 4758288 - DNA, 16 bp, Homo sapiens
gggcccctcctccaga

SEQ ID NO: 4758289 - DNA, 13 bp, Homo sapiens
gggcccctgcgtg

SEQ ID NO: 4758290 - DNA, 14 bp, Homo sapiens
gggcccctgggatg

SEQ ID NO: 4758291 - DNA, 15 bp, Homo sapiens
gggcccgcactcagg

SEQ ID NO: 4758292 - DNA, 15 bp, Homo sapiens
gggcccgccccaggc

SEQ ID NO: 4758293 - DNA, 18 bp, Homo sapiens
gggcccgccccaggcccc

SEQ ID NO: 4758294 - DNA, 17 bp, Homo sapiens
gggcccgctcaacctct

SEQ ID NO: 4758295 - DNA, 21 bp, Homo sapiens
gggcccgctcaacctctcaga

SEQ ID NO: 4758296 - DNA, 22 bp, Homo sapiens
gggccctaggcatactctccag

SEQ ID NO: 4758297 - DNA, 18 bp, Homo sapiens
gggccctgaaatggcctg

SEQ ID NO: 4758298 - DNA, 10 bp, Homo sapiens
gggccctgct

SEQ ID NO: 4758299 - DNA, 12 bp, Homo sapiens
gggccctgggcc

SEQ ID NO: 4758300 - DNA, 18 bp, Homo sapiens
gggccctgggcctcagtt

SEQ ID NO: 4758301 - DNA, 19 bp, Homo sapiens
gggccctggggtctctgag

SEQ ID NO: 4758302 - DNA, 22 bp, Homo sapiens
gggccctggggtctctgagcag

SEQ ID NO: 4758303 - DNA, 23 bp, Homo sapiens
gggccctggggtctctgagcagt

SEQ ID NO: 4758304 - DNA, 13 bp, Homo sapiens
gggccctgtcact

SEQ ID NO: 4758305 - DNA, 22 bp, Homo sapiens
gggccctgtcactgtccagagt

SEQ ID NO: 4758306 - DNA, 22 bp, Homo sapiens
gggccgaacctgatacctgcct

SEQ ID NO: 4758307 - DNA, 16 bp, Homo sapiens
gggccgcagggcgctc

SEQ ID NO: 4758308 - DNA, 23 bp, Homo sapiens
gggccgccgaagggcagccccgc

SEQ ID NO: 4758309 - DNA, 20 bp, Homo sapiens
gggccgcctcctccagactc

SEQ ID NO: 4758310 - DNA, 19 bp, Homo sapiens
gggccgcttctcctgcagt

SEQ ID NO: 4758311 - DNA, 23 bp, Homo sapiens
gggccgggcaggtcctgcccatg

SEQ ID NO: 4758312 - DNA, 16 bp, Homo sapiens
gggcctcgctttccca

SEQ ID NO: 4758313 - DNA, 14 bp, Homo sapiens
gggcctctctggaa

SEQ ID NO: 4758314 - DNA, 22 bp, Homo sapiens
gggcctctctggaagagggagg

SEQ ID NO: 4758315 - DNA, 22 bp, Homo sapiens
gggcctgcggggttccctgcgc

SEQ ID NO: 4758316 - DNA, 15 bp, Homo sapiens
ggcctggccccctcg

SEQ ID NO: 4758317 - DNA, 18 bp, Homo sapiens
ggcctggccctgccctga

SEQ ID NO: 4758318 - DNA, 18 bp, Homo sapiens
ggcctgggagatgcagct

SEQ ID NO: 4758319 - DNA, 18 bp, Homo sapiens
ggcctgggctgtgaggac

SEQ ID NO: 4758320 - DNA, 20 bp, Homo sapiens
ggcctgggctgtgaggacag

SEQ ID NO: 4758321 - DNA, 22 bp, Homo sapiens
ggcctgggggctgggcagagga

SEQ ID NO: 4758322 - DNA, 16 bp, Homo sapiens
ggcctgggtcctcggc

SEQ ID NO: 4758323 - DNA, 20 bp, Homo sapiens
ggcctgggtcctcggccctg

SEQ ID NO: 4758324 - DNA, 23 bp, Homo sapiens
ggcctgggtggatcggcctcctc

SEQ ID NO: 4758325 - DNA, 17 bp, Homo sapiens
ggcctggtaggtctgga

SEQ ID NO: 4758326 - DNA, 19 bp, Homo sapiens
ggcctgtccctagggctct

SEQ ID NO: 4758327 - DNA, 20 bp, Homo sapiens
ggcctgtccctagggctctc

SEQ ID NO: 4758328 - DNA, 15 bp, Homo sapiens
ggccttgcctccagg

SEQ ID NO: 4758329 - DNA, 19 bp, Homo sapiens
ggccttggttcctccagca

SEQ ID NO: 4758330 - DNA, 12 bp, Homo sapiens
ggcctttcctct

SEQ ID NO: 4758331 - DNA, 14 bp, Homo sapiens
ggcctttcctctct

SEQ ID NO: 4758332 - DNA, 12 bp, Homo sapiens
ggcgactgtgaa

SEQ ID NO: 4758333 - DNA, 19 bp, Homo sapiens
ggcgcaagcgacacaggct

SEQ ID NO: 4758334 - DNA, 14 bp, Homo sapiens
ggcgcccacctgcc

SEQ ID NO: 4758335 - DNA, 17 bp, Homo sapiens
ggcgcccacctgcccag

SEQ ID NO: 4758336 - DNA, 13 bp, Homo sapiens
ggcgccccggacg

SEQ ID NO: 4758337 - DNA, 20 bp, Homo sapiens
ggcgcctgcgctcctctgca

SEQ ID NO: 4758338 - DNA, 23 bp, Homo sapiens
ggcgcctgcgctcctctgcagcc

SEQ ID NO: 4758339 - DNA, 24 bp, Homo sapiens
ggcgcctgcgctcctctgcagcct

SEQ ID NO: 4758340 - DNA, 12 bp, Homo sapiens
ggcgcctgggtc

SEQ ID NO: 4758341 - DNA, 18 bp, Homo sapiens
ggcgcctgtcgggcccgc

SEQ ID NO: 4758342 - DNA, 22 bp, Homo sapiens
ggcgcgcgcccccaggaccccc

SEQ ID NO: 4758343 - DNA, 18 bp, Homo sapiens
ggcgcgggacaggacttg

SEQ ID NO: 4758344 - DNA, 16 bp, Homo sapiens
ggcgctccggcagagg

SEQ ID NO: 4758345 - DNA, 15 bp, Homo sapiens
ggcgctcctcccagc

SEQ ID NO: 4758346 - DNA, 15 bp, Homo sapiens
ggcgctgagggcagg

SEQ ID NO: 4758347 - DNA, 11 bp, Homo sapiens
ggcgctgcccc

SEQ ID NO: 4758348 - DNA, 16 bp, Homo sapiens
ggcggagctctggctt

SEQ ID NO: 4758349 - DNA, 19 bp, Homo sapiens
ggcggaggggcttggagca

SEQ ID NO: 4758350 - DNA, 15 bp, Homo sapiens
ggcgggcagcccctg

SEQ ID NO: 4758351 - DNA, 23 bp, Homo sapiens
ggcgggcagcccctgctggacca

SEQ ID NO: 4758352 - DNA, 22 bp, Homo sapiens
ggcgtcagtcgatattcccagg

SEQ ID NO: 4758353 - DNA, 21 bp, Homo sapiens
ggcgtccctgagggcccttcc

SEQ ID NO: 4758354 - DNA, 11 bp, Homo sapiens
ggcgtcctctc

SEQ ID NO: 4758355 - DNA, 23 bp, Homo sapiens
ggcgtgatctcagctcactgcaa

SEQ ID NO: 4758356 - DNA, 16 bp, Homo sapiens
ggcgtgggatccagag

SEQ ID NO: 4758357 - DNA, 19 bp, Homo sapiens
ggcgtgggatccagagaga

SEQ ID NO: 4758358 - DNA, 22 bp, Homo sapiens
ggctaaaaaagctgaatcagac

SEQ ID NO: 4758359 - DNA, 16 bp, Homo sapiens
ggctaactggccccag

SEQ ID NO: 4758360 - DNA, 14 bp, Homo sapiens
ggctaagaggctgc

SEQ ID NO: 4758361 - DNA, 13 bp, Homo sapiens
ggctactgccact

SEQ ID NO: 4758362 - DNA, 17 bp, Homo sapiens
ggctagactagtctcaa

SEQ ID NO: 4758363 - DNA, 13 bp, Homo sapiens
ggctagtctgtgc

SEQ ID NO: 4758364 - DNA, 20 bp, Homo sapiens
ggctattgtccttgtgtatc

SEQ ID NO: 4758365 - DNA, 23 bp, Homo sapiens
ggctcacaccggcactgtgcact

SEQ ID NO: 4758366 - DNA, 15 bp, Homo sapiens
ggctcacagccacca

SEQ ID NO: 4758367 - DNA, 22 bp, Homo sapiens
ggctcacctttgggcaaaggcc

SEQ ID NO: 4758368 - DNA, 19 bp, Homo sapiens
ggctcccactgcccctgca

SEQ ID NO: 4758369 - DNA, 14 bp, Homo sapiens
ggctcccagcagag

SEQ ID NO: 4758370 - DNA, 16 bp, Homo sapiens
ggctcccagcagaggc

SEQ ID NO: 4758371 - DNA, 18 bp, Homo sapiens
ggctccgggctgtgtcct

SEQ ID NO: 4758372 - DNA, 13 bp, Homo sapiens
ggctcctcaccac

SEQ ID NO: 4758373 - DNA, 13 bp, Homo sapiens
ggctcctttcccc

SEQ ID NO: 4758374 - DNA, 13 bp, Homo sapiens
ggctctaatttcc

SEQ ID NO: 4758375 - DNA, 20 bp, Homo sapiens
ggctctcaggccagctgctt

SEQ ID NO: 4758376 - DNA, 19 bp, Homo sapiens
ggctctctcacccagcctg

SEQ ID NO: 4758377 - DNA, 10 bp, Homo sapiens
ggctctggct

SEQ ID NO: 4758378 - DNA, 13 bp, Homo sapiens
ggctgaaattatg

SEQ ID NO: 4758379 - DNA, 11 bp, Homo sapiens
ggctgaagaaa

SEQ ID NO: 4758380 - DNA, 16 bp, Homo sapiens
ggctgaatgtatgtaa

SEQ ID NO: 4758381 - DNA, 20 bp, Homo sapiens
ggctgagacacagcccagag

SEQ ID NO: 4758382 - DNA, 20 bp, Homo sapiens
ggctgagagggtgtgggtgc

SEQ ID NO: 4758383 - DNA, 13 bp, Homo sapiens
ggctgagcccctc

SEQ ID NO: 4758384 - DNA, 14 bp, Homo sapiens
ggctgagcccctcc

SEQ ID NO: 4758385 - DNA, 19 bp, Homo sapiens
ggggctgtcctgagccccc

SEQ ID NO: 4758386 - DNA, 21 bp, Homo sapiens
ggggctgtgcgggcgcccgga

SEQ ID NO: 4758387 - DNA, 17 bp, Homo sapiens
ggggcttggaagggcgc

SEQ ID NO: 4758388 - DNA, 23 bp, Homo sapiens
ggggcttggggtagagaggacag

SEQ ID NO: 4758389 - DNA, 22 bp, Homo sapiens
gggggcaagagctcaggagaag

SEQ ID NO: 4758390 - DNA, 14 bp, Homo sapiens
gggggcacagccag

SEQ ID NO: 4758391 - DNA, 16 bp, Homo sapiens
gggggcacagccagaa

SEQ ID NO: 4758392 - DNA, 14 bp, Homo sapiens
gggggcaggcctcc

SEQ ID NO: 4758393 - DNA, 14 bp, Homo sapiens
gggggccgggcagg

SEQ ID NO: 4758394 - DNA, 23 bp, Homo sapiens
gggggccgggcaggtcctgccca

SEQ ID NO: 4758395 - DNA, 19 bp, Homo sapiens
gggggctaactggccccag

SEQ ID NO: 4758396 - DNA, 16 bp, Homo sapiens
gggggctgcttctcca

SEQ ID NO: 4758397 - DNA, 23 bp, Homo sapiens
gggggctgttagctcagaggaga

SEQ ID NO: 4758398 - DNA, 20 bp, Homo sapiens
gggggcttggggtagagagg

SEQ ID NO: 4758399 - DNA, 21 bp, Homo sapiens
gggggcttggggtagagagga

SEQ ID NO: 4758400 - DNA, 15 bp, Homo sapiens
gggggttgggttcca

SEQ ID NO: 4758401 - DNA, 23 bp, Homo sapiens
gggggtttgaggaccctcccagg

SEQ ID NO: 4758402 - DNA, 16 bp, Homo sapiens
ggggtagagaggacag

SEQ ID NO: 4758403 - DNA, 17 bp, Homo sapiens
ggggtcagttgggcccc

SEQ ID NO: 4758404 - DNA, 22 bp, Homo sapiens
ggggtcgggggaggagcacccc

SEQ ID NO: 4758405 - DNA, 20 bp, Homo sapiens
ggggtctctgagcagtgggg

SEQ ID NO: 4758406 - DNA, 23 bp, Homo sapiens
ggggtctttcagaacacgacaga

SEQ ID NO: 4758407 - DNA, 12 bp, Homo sapiens
ggggtgcccgtg

SEQ ID NO: 4758408 - DNA, 19 bp, Homo sapiens
ggggtgcccgtgtggcctg

SEQ ID NO: 4758409 - DNA, 21 bp, Homo sapiens
ggggtgcccgtgtggcctggg

SEQ ID NO: 4758410 - DNA, 24 bp, Homo sapiens
ggggtgcccgtgtggcctgggtcc

SEQ ID NO: 4758411 - DNA, 13 bp, Homo sapiens
gggtaaataaatg

SEQ ID NO: 4758412 - DNA, 14 bp, Homo sapiens
gggtaaataaatgc

SEQ ID NO: 4758413 - DNA, 15 bp, Homo sapiens
gggtaaataaatgct

SEQ ID NO: 4758414 - DNA, 23 bp, Homo sapiens
gggtaaataaatgctgctttggg

SEQ ID NO: 4758415 - DNA, 22 bp, Homo sapiens
gggtaagggactccagaagcag

SEQ ID NO: 4758416 - DNA, 17 bp, Homo sapiens
gggtaagtgagagaggg

SEQ ID NO: 4758417 - DNA, 16 bp, Homo sapiens
gggtacagcccaggcg

SEQ ID NO: 4758418 - DNA, 23 bp, Homo sapiens
gggtagagcggagaaaggaaggg

SEQ ID NO: 4758419 - DNA, 15 bp, Homo sapiens
gggtcaactccaagg

SEQ ID NO: 4758420 - DNA, 16 bp, Homo sapiens
gggtcaactccaaggc

SEQ ID NO: 4758421 - DNA, 17 bp, Homo sapiens
gggtcaactccaaggca

SEQ ID NO: 4758422 - DNA, 17 bp, Homo sapiens
gggtcaccttcctgggc

SEQ ID NO: 4758423 - DNA, 16 bp, Homo sapiens
gggtcagttgggcccc

SEQ ID NO: 4758424 - DNA, 21 bp, Homo sapiens
gggtcatattcataccttctg

SEQ ID NO: 4758425 - DNA, 23 bp, Homo sapiens
gggtccctgcgtctcctgcccac

SEQ ID NO: 4758426 - DNA, 15 bp, Homo sapiens
gggtcgcctgccctg

SEQ ID NO: 4758427 - DNA, 19 bp, Homo sapiens
ggtgctgtcatgcccagct

SEQ ID NO: 4758428 - DNA, 17 bp, Homo sapiens
ggtggaagggcaggagc

SEQ ID NO: 4758429 - DNA, 23 bp, Homo sapiens
ggtggaattattagcaccagctt

SEQ ID NO: 4758430 - DNA, 21 bp, Homo sapiens
ggtggatactggggggcaggc

SEQ ID NO: 4758431 - DNA, 13 bp, Homo sapiens
ggtggcaataaat

SEQ ID NO: 4758432 - DNA, 21 bp, Homo sapiens
ggtggcacccaccactctcag

SEQ ID NO: 4758433 - DNA, 18 bp, Homo sapiens
ggtggcagcgcccagcct

SEQ ID NO: 4758434 - DNA, 22 bp, Homo sapiens
ggtggcaggcacacagcagccc

SEQ ID NO: 4758435 - DNA, 22 bp, Homo sapiens
ggtggcatttgcaggtgaccag

SEQ ID NO: 4758436 - DNA, 16 bp, Homo sapiens
ggtggcatttgctgaa

SEQ ID NO: 4758437 - DNA, 16 bp, Homo sapiens
ggtggccgtcacgctt

SEQ ID NO: 4758438 - DNA, 20 bp, Homo sapiens
ggtggccttgagtctctgaa

SEQ ID NO: 4758439 - DNA, 14 bp, Homo sapiens
ggtggctggagccc

SEQ ID NO: 4758440 - DNA, 17 bp, Homo sapiens
ggtggctggagccccat

SEQ ID NO: 4758441 - DNA, 13 bp, Homo sapiens
ggtgggccccaca

SEQ ID NO: 4758442 - DNA, 18 bp, Homo sapiens
ggtgggccccacagtggt

SEQ ID NO: 4758443 - DNA, 13 bp, Homo sapiens
ggtggggagggcc

SEQ ID NO: 4758444 - DNA, 15 bp, Homo sapiens
ggtggggccagcgct

SEQ ID NO: 4758445 - DNA, 20 bp, Homo sapiens
ggtggggcttagaatggggc

SEQ ID NO: 4758446 - DNA, 20 bp, Homo sapiens
ggtggggtgctggggctgca

SEQ ID NO: 4758447 - DNA, 20 bp, Homo sapiens
ggtgggtcaactccaaggca

SEQ ID NO: 4758448 - DNA, 14 bp, Homo sapiens
ggtggtcttggaga

SEQ ID NO: 4758449 - DNA, 16 bp, Homo sapiens
ggtggtcttggagagg

SEQ ID NO: 4758450 - DNA, 20 bp, Homo sapiens
ggtggtgaaggggctggtgg

SEQ ID NO: 4758451 - DNA, 15 bp, Homo sapiens
ggtggtggtgaaggg

SEQ ID NO: 4758452 - DNA, 18 bp, Homo sapiens
ggtgtagctgtcctctca

SEQ ID NO: 4758453 - DNA, 19 bp, Homo sapiens
ggtgtcccctggtgcccct

SEQ ID NO: 4758454 - DNA, 19 bp, Homo sapiens
ggtgtgacctgacacctgc

SEQ ID NO: 4758455 - DNA, 14 bp, Homo sapiens
ggtgtgagatggtg

SEQ ID NO: 4758456 - DNA, 19 bp, Homo sapiens
ggtgtgaggacataaatct

SEQ ID NO: 4758457 - DNA, 11 bp, Homo sapiens
ggtgtggcttg

SEQ ID NO: 4758458 - DNA, 17 bp, Homo sapiens
ggtgtgggtgccctgtt

SEQ ID NO: 4758459 - DNA, 14 bp, Homo sapiens
ggtgttttcatgta

SEQ ID NO: 4758460 - DNA, 22 bp, Homo sapiens
ggtgttttccttcacaatggtt

SEQ ID NO: 4758461 - DNA, 21 bp, Homo sapiens
ggttaacagtaaatatacact

SEQ ID NO: 4758462 - DNA, 17 bp, Homo sapiens
ggttagtgcatgtcaca

SEQ ID NO: 4758463 - DNA, 13 bp, Homo sapiens
ggttccagacaga

SEQ ID NO: 4758464 - DNA, 19 bp, Homo sapiens
ggttccagacagagtggat

SEQ ID NO: 4758465 - DNA, 13 bp, Homo sapiens
ggttcctcatggc

SEQ ID NO: 4758466 - DNA, 22 bp, Homo sapiens
ggttctcccatgatttggggtg

SEQ ID NO: 4758467 - DNA, 23 bp, Homo sapiens
ggttctcccatgatttggggtga

SEQ ID NO: 4758468 - DNA, 23 bp, Homo sapiens
ggttctttgagggactgcctctg

SEQ ID NO: 4758469 - DNA, 23 bp, Homo sapiens
ggttgggttccagacagagtgga

SEQ ID NO: 4758470 - DNA, 22 bp, Homo sapiens
ggttgtacatagtggtcatttg

SEQ ID NO: 4758471 - DNA, 14 bp, Homo sapiens
ggttgtctctcttc

SEQ ID NO: 4758472 - DNA, 21 bp, Homo sapiens
ggttgtctctcttcggtggcc

SEQ ID NO: 4758473 - DNA, 15 bp, Homo sapiens
ggtttacccagtggg

SEQ ID NO: 4758474 - DNA, 12 bp, Homo sapiens
ggtttactctgt

SEQ ID NO: 4758475 - DNA, 17 bp, Homo sapiens
ggtttcagtagctcctt

SEQ ID NO: 4758476 - DNA, 14 bp, Homo sapiens
ggtttccacatgct

SEQ ID NO: 4758477 - DNA, 18 bp, Homo sapiens
ggtttccatcaaagccct

SEQ ID NO: 4758478 - DNA, 20 bp, Homo sapiens
ggtttccatcaaagccctcc

SEQ ID NO: 4758479 - DNA, 14 bp, Homo sapiens
ggtttctgtttgaa

SEQ ID NO: 4758480 - DNA, 16 bp, Homo sapiens
ggtttgggcagtggag

SEQ ID NO: 4758481 - DNA, 21 bp, Homo sapiens
ggtttgggggacgcccagccc

SEQ ID NO: 4758482 - DNA, 14 bp, Homo sapiens
ggtttgtttgctgc

SEQ ID NO: 4758483 - DNA, 19 bp, Homo sapiens
ggttttagaaattctataa

SEQ ID NO: 4758484 - DNA, 16 bp, Homo sapiens
ggttttctccttccca

SEQ ID NO: 4758485 - DNA, 20 bp, Homo sapiens
ggttttgacttgccactgcc

SEQ ID NO: 4758486 - DNA, 17 bp, Homo sapiens
ggttttgttaggggtgg

SEQ ID NO: 4758487 - DNA, 19 bp, Homo sapiens
ggtttttaatctcttgtca

SEQ ID NO: 4758488 - DNA, 16 bp, Homo sapiens
ggtttttatttctcgg

SEQ ID NO: 4758489 - DNA, 13 bp, Homo sapiens
gtaaaacagtggt

SEQ ID NO: 4758490 - DNA, 13 bp, Homo sapiens
gtaaaaccaaagg

SEQ ID NO: 4758491 - DNA, 11 bp, Homo sapiens
gtaaaactgtg

SEQ ID NO: 4758492 - DNA, 18 bp, Homo sapiens
gtaaaactttattttata

SEQ ID NO: 4758493 - DNA, 13 bp, Homo sapiens
gtaaaagagctgt

SEQ ID NO: 4758494 - DNA, 18 bp, Homo sapiens
gtaaaatactattggaca

SEQ ID NO: 4758495 - DNA, 20 bp, Homo sapiens
gtaaaatagtctcattgcca

SEQ ID NO: 4758496 - DNA, 20 bp, Homo sapiens
gtaaaatatttataaatgaa

SEQ ID NO: 4758497 - DNA, 17 bp, Homo sapiens
gtaaaattatctgttct

SEQ ID NO: 4758498 - DNA, 21 bp, Homo sapiens
gtaaaattatctgttctatgg

SEQ ID NO: 4758499 - DNA, 22 bp, Homo sapiens
gtaaaattatctgttctatgga

SEQ ID NO: 4758500 - DNA, 15 bp, Homo sapiens
gtaaagatattgtat

SEQ ID NO: 4758501 - DNA, 16 bp, Homo sapiens
gtaaagatattgtatc

SEQ ID NO: 4758502 - DNA, 15 bp, Homo sapiens
gtaaaggtaggtgca

SEQ ID NO: 4758503 - DNA, 17 bp, Homo sapiens
gtaaaggtgatgaattt

SEQ ID NO: 4758504 - DNA, 14 bp, Homo sapiens
gtaaataaaaatag

SEQ ID NO: 4758505 - DNA, 13 bp, Homo sapiens
gtaaataaatgct

SEQ ID NO: 4758506 - DNA, 14 bp, Homo sapiens
gtaaataactgtga

SEQ ID NO: 4758507 - DNA, 18 bp, Homo sapiens
gtaaatatacactttaca

SEQ ID NO: 4758508 - DNA, 21 bp, Homo sapiens
gtaaatctaacattattactt

SEQ ID NO: 4758509 - DNA, 19 bp, Homo sapiens
gtaaatctatctctatata

SEQ ID NO: 4758510 - DNA, 18 bp, Homo sapiens
gtaaattcctaattctat

SEQ ID NO: 4758511 - DNA, 21 bp, Homo sapiens
gtaacagcaggagcatggccg

SEQ ID NO: 4758512 - DNA, 15 bp, Homo sapiens
gtcaaatccatgtgt

SEQ ID NO: 4758513 - DNA, 19 bp, Homo sapiens
gtcaaatccatgtgtcccc

SEQ ID NO: 4758514 - DNA, 14 bp, Homo sapiens
gtcaactccaaggc

SEQ ID NO: 4758515 - DNA, 22 bp, Homo sapiens
gtcaactccaaggcaaatgtcc

SEQ ID NO: 4758516 - DNA, 15 bp, Homo sapiens
gtcaagtgtgcctgc

SEQ ID NO: 4758517 - DNA, 17 bp, Homo sapiens
gtcaagtgtgcctgcta

SEQ ID NO: 4758518 - DNA, 13 bp, Homo sapiens
gtcaatgaaaagc

SEQ ID NO: 4758519 - DNA, 17 bp, Homo sapiens
gtcaatgaaatatttgc

SEQ ID NO: 4758520 - DNA, 12 bp, Homo sapiens
gtcaatgtgaaa

SEQ ID NO: 4758521 - DNA, 14 bp, Homo sapiens
gtcaatgtgtgcac

SEQ ID NO: 4758522 - DNA, 16 bp, Homo sapiens
gtcaattgcttgagca

SEQ ID NO: 4758523 - DNA, 19 bp, Homo sapiens
gtcacaaagctatttaagt

SEQ ID NO: 4758524 - DNA, 14 bp, Homo sapiens
gtcacagacccctg

SEQ ID NO: 4758525 - DNA, 15 bp, Homo sapiens
gtcacagacccctgg

SEQ ID NO: 4758526 - DNA, 20 bp, Homo sapiens
gtcacagacccctgggggag

SEQ ID NO: 4758527 - DNA, 13 bp, Homo sapiens
gtcacatgacatc

SEQ ID NO: 4758528 - DNA, 18 bp, Homo sapiens
gtcaccagctatctgtca

SEQ ID NO: 4758529 - DNA, 18 bp, Homo sapiens
gtcacccaacctggcata

SEQ ID NO: 4758530 - DNA, 14 bp, Homo sapiens
gtcaccttcctggg

SEQ ID NO: 4758531 - DNA, 14 bp, Homo sapiens
gtcacgtgaccctg

SEQ ID NO: 4758532 - DNA, 15 bp, Homo sapiens
gtcacgtgaccctgt

SEQ ID NO: 4758533 - DNA, 16 bp, Homo sapiens
gtcactacgcctggct

SEQ ID NO: 4758534 - DNA, 19 bp, Homo sapiens
gtcactgacatcagcactg

SEQ ID NO: 4758535 - DNA, 20 bp, Homo sapiens
gtcactgcccacctgccagg

SEQ ID NO: 4758536 - DNA, 13 bp, Homo sapiens
gtcactgtccaga

SEQ ID NO: 4758537 - DNA, 19 bp, Homo sapiens
gtcactgtccagagtctct

SEQ ID NO: 4758538 - DNA, 20 bp, Homo sapiens
gtcacttttttcctgtcaat

SEQ ID NO: 4758539 - DNA, 15 bp, Homo sapiens
gtcagaaactaaaac

SEQ ID NO: 4758540 - DNA, 20 bp, Homo sapiens
gtcagaagcccattaaaata

SEQ ID NO: 4758541 - DNA, 21 bp, Homo sapiens
gtcagaagtttctgccgcagc

SEQ ID NO: 4758542 - DNA, 15 bp, Homo sapiens
gtcagagatgttttc

SEQ ID NO: 4758543 - DNA, 13 bp, Homo sapiens
gtcagagcccagg

SEQ ID NO: 4758544 - DNA, 18 bp, Homo sapiens
gtcagccagccgccctgg

SEQ ID NO: 4758545 - DNA, 15 bp, Homo sapiens
gtcagccagcttggt

SEQ ID NO: 4758546 - DNA, 13 bp, Homo sapiens
gtcagcccagtgg

SEQ ID NO: 4758547 - DNA, 14 bp, Homo sapiens
gtcagcccagtggg

SEQ ID NO: 4758548 - DNA, 15 bp, Homo sapiens
gtcagcggagaggac

SEQ ID NO: 4758549 - DNA, 20 bp, Homo sapiens
gtcaggagagccctctgctg

SEQ ID NO: 4758550 - DNA, 12 bp, Homo sapiens
gtcaggatgacg

SEQ ID NO: 4758551 - DNA, 20 bp, Homo sapiens
gtcaggccattcagtctatg

SEQ ID NO: 4758552 - DNA, 12 bp, Homo sapiens
gtcaggccctgg

SEQ ID NO: 4758553 - DNA, 13 bp, Homo sapiens
gtcaggccctgga

SEQ ID NO: 4758554 - DNA, 17 bp, Homo sapiens
gtcagtcgatattccca

SEQ ID NO: 4758555 - DNA, 19 bp, Homo sapiens
gtcagtgaagcccaggagg

SEQ ID NO: 4758556 - DNA, 19 bp, Homo sapiens
gtcagtgtactctgagtcc

SEQ ID NO: 4758557 - DNA, 16 bp, Homo sapiens
gtcagtgtagatcaac

SEQ ID NO: 4758558 - DNA, 18 bp, Homo sapiens
gtcagttgggcccccatc

SEQ ID NO: 4758559 - DNA, 14 bp, Homo sapiens
gtcagtttgtgaag

SEQ ID NO: 4758560 - DNA, 14 bp, Homo sapiens
gtcatcaacaaaag

SEQ ID NO: 4758561 - DNA, 15 bp, Homo sapiens
gtcatcaagtagtag

SEQ ID NO: 4758562 - DNA, 20 bp, Homo sapiens
gtcatcaagtagtagtactt

SEQ ID NO: 4758563 - DNA, 22 bp, Homo sapiens
gtcatctctctggggccctggg

SEQ ID NO: 4758564 - DNA, 15 bp, Homo sapiens
gtcatctgtaaaata

SEQ ID NO: 4758565 - DNA, 12 bp, Homo sapiens
gtcatctgtcag

SEQ ID NO: 4758566 - DNA, 22 bp, Homo sapiens
gtcatgcccagcttggagtgcc

SEQ ID NO: 4758567 - DNA, 12 bp, Homo sapiens
gtcatgtggcta

SEQ ID NO: 4758568 - DNA, 11 bp, Homo sapiens
gtcattctcat

SEQ ID NO: 4758569 - DNA, 12 bp, Homo sapiens
gtcattctcatc

SEQ ID NO: 4758570 - DNA, 16 bp, Homo sapiens
gtcattctcatccaaa

SEQ ID NO: 4758571 - DNA, 21 bp, Homo sapiens
gtcatttcttctctctgtgct

SEQ ID NO: 4758572 - DNA, 17 bp, Homo sapiens
gtcatttggtggctcta

SEQ ID NO: 4758573 - DNA, 20 bp, Homo sapiens
gtccaacaactccaggaaaa

SEQ ID NO: 4758574 - DNA, 16 bp, Homo sapiens
gtccaatccagccttc

SEQ ID NO: 4758575 - DNA, 13 bp, Homo sapiens
gtccaattttcct

SEQ ID NO: 4758576 - DNA, 20 bp, Homo sapiens
gtccacaaatgtcctcagag

SEQ ID NO: 4758577 - DNA, 16 bp, Homo sapiens
gtccacatacactgca

SEQ ID NO: 4758578 - DNA, 18 bp, Homo sapiens
gtccaccccgtcccggcc

SEQ ID NO: 4758579 - DNA, 22 bp, Homo sapiens
gtccaccccgttgttgtccctg

SEQ ID NO: 4758580 - DNA, 15 bp, Homo sapiens
gtccaccttctgcca

SEQ ID NO: 4758581 - DNA, 19 bp, Homo sapiens
gtccaccttctgccaaggc

SEQ ID NO: 4758582 - DNA, 17 bp, Homo sapiens
gtccagacaagccctgc

SEQ ID NO: 4758583 - DNA, 13 bp, Homo sapiens
gtccagagtctct

SEQ ID NO: 4758584 - DNA, 21 bp, Homo sapiens
gtccaggagatgaggctggat

SEQ ID NO: 4758585 - DNA, 16 bp, Homo sapiens
gtccagggtccagccc

SEQ ID NO: 4758586 - DNA, 12 bp, Homo sapiens
gtccaggtgatc

SEQ ID NO: 4758587 - DNA, 16 bp, Homo sapiens
gtccatccgtctctgt

SEQ ID NO: 4758588 - DNA, 17 bp, Homo sapiens
gtccatccgtctctgtc

SEQ ID NO: 4758589 - DNA, 18 bp, Homo sapiens
gtccatccgtctctgtcc

SEQ ID NO: 4758590 - DNA, 19 bp, Homo sapiens
gtccatccgtctctgtccg

SEQ ID NO: 4758591 - DNA, 20 bp, Homo sapiens
gtccatgtgataattgtaaa

SEQ ID NO: 4758592 - DNA, 16 bp, Homo sapiens
gtccatttttacaagt

SEQ ID NO: 4758593 - DNA, 23 bp, Homo sapiens
gtccatttttacaagttatagta

SEQ ID NO: 4758594 - DNA, 12 bp, Homo sapiens
gtcccacagccc

SEQ ID NO: 4758595 - DNA, 21 bp, Homo sapiens
gtcccacagccccttgcttct

SEQ ID NO: 4758596 - DNA, 18 bp, Homo sapiens
gtcccaccgggagcctcc

SEQ ID NO: 4758597 - DNA, 18 bp, Homo sapiens
gtcccagtccggtgcctt

SEQ ID NO: 4758598 - DNA, 19 bp, Homo sapiens
gtcccagtccggtgccttc

SEQ ID NO: 4758599 - DNA, 22 bp, Homo sapiens
gtcccagtccggtgccttccac

SEQ ID NO: 4758600 - DNA, 23 bp, Homo sapiens
gtcccagtccggtgccttccacc

SEQ ID NO: 4758601 - DNA, 21 bp, Homo sapiens
gtcccagtgtctggcccagcc

SEQ ID NO: 4758602 - DNA, 22 bp, Homo sapiens
gtcccagtgtctggcccagcca

SEQ ID NO: 4758603 - DNA, 16 bp, Homo sapiens
gtccccaatgaatata

SEQ ID NO: 4758604 - DNA, 12 bp, Homo sapiens
gtccccagggtg

SEQ ID NO: 4758605 - DNA, 20 bp, Homo sapiens
gtcccccctgtggtctgtgt

SEQ ID NO: 4758606 - DNA, 17 bp, Homo sapiens
gtacagattgctgcttc

SEQ ID NO: 4758607 - DNA, 19 bp, Homo sapiens
gtacaggatatcacctgaa

SEQ ID NO: 4758608 - DNA, 18 bp, Homo sapiens
gtacaggctgagacacag

SEQ ID NO: 4758609 - DNA, 19 bp, Homo sapiens
gtacagtttgtttacacac

SEQ ID NO: 4758610 - DNA, 20 bp, Homo sapiens
gtacataaagtaataactgt

SEQ ID NO: 4758611 - DNA, 16 bp, Homo sapiens
gtacatatggaaatcc

SEQ ID NO: 4758612 - DNA, 21 bp, Homo sapiens
gtacatatggaaatcctgtta

SEQ ID NO: 4758613 - DNA, 19 bp, Homo sapiens
gtacatcttgtgcatgcaa

SEQ ID NO: 4758614 - DNA, 21 bp, Homo sapiens
gtacatgtggaaaactcacag

SEQ ID NO: 4758615 - DNA, 15 bp, Homo sapiens
gtacatttatgtgtg

SEQ ID NO: 4758616 - DNA, 22 bp, Homo sapiens
gtacatttgatttgatatacag

SEQ ID NO: 4758617 - DNA, 23 bp, Homo sapiens
gtacatttgatttgatatacaga

SEQ ID NO: 4758618 - DNA, 19 bp, Homo sapiens
gtaccatcccactgatatc

SEQ ID NO: 4758619 - DNA, 16 bp, Homo sapiens
gtaccatgttaaagag

SEQ ID NO: 4758620 - DNA, 18 bp, Homo sapiens
gtacccttcttgtctctc

SEQ ID NO: 4758621 - DNA, 12 bp, Homo sapiens
gtaccggatgca

SEQ ID NO: 4758622 - DNA, 15 bp, Homo sapiens
gtaccggccactgca

SEQ ID NO: 4758623 - DNA, 16 bp, Homo sapiens
gtaccggccactgcaa

SEQ ID NO: 4758624 - DNA, 14 bp, Homo sapiens
gtactacatttgca

SEQ ID NO: 4758625 - DNA, 15 bp, Homo sapiens
gtactacatttgcat

SEQ ID NO: 4758626 - DNA, 22 bp, Homo sapiens
gtactaccccagaacgcatgca

SEQ ID NO: 4758627 - DNA, 14 bp, Homo sapiens
gtactagagatatt

SEQ ID NO: 4758628 - DNA, 21 bp, Homo sapiens
gtactagagatattttgtaaa

SEQ ID NO: 4758629 - DNA, 16 bp, Homo sapiens
gtactatctagtgtct

SEQ ID NO: 4758630 - DNA, 19 bp, Homo sapiens
gtactatggctgtattttt

SEQ ID NO: 4758631 - DNA, 21 bp, Homo sapiens
gtactcagtcagcccagtggg

SEQ ID NO: 4758632 - DNA, 18 bp, Homo sapiens
gtactctgagtcctcatt

SEQ ID NO: 4758633 - DNA, 19 bp, Homo sapiens
gtactggtaagattgttat

SEQ ID NO: 4758634 - DNA, 20 bp, Homo sapiens
gtactgtactttcccaggtt

SEQ ID NO: 4758635 - DNA, 22 bp, Homo sapiens
gtactgtactttcccaggttga

SEQ ID NO: 4758636 - DNA, 11 bp, Homo sapiens
gtactgtattg

SEQ ID NO: 4758637 - DNA, 16 bp, Homo sapiens
gtacttacactgaaat

SEQ ID NO: 4758638 - DNA, 17 bp, Homo sapiens
gtacttcagttctcatc

SEQ ID NO: 4758639 - DNA, 15 bp, Homo sapiens
gtacttcttctgtaa

SEQ ID NO: 4758640 - DNA, 16 bp, Homo sapiens
gtagaaactttggaag

SEQ ID NO: 4758641 - DNA, 20 bp, Homo sapiens
gtagaaactttggaagtttt

SEQ ID NO: 4758642 - DNA, 20 bp, Homo sapiens
gtagaaattttatctcttct

SEQ ID NO: 4758643 - DNA, 15 bp, Homo sapiens
gtagaatctcagcac

SEQ ID NO: 4758644 - DNA, 11 bp, Homo sapiens
gtagagaggac

SEQ ID NO: 4758645 - DNA, 15 bp, Homo sapiens
gtagataaagcactg

SEQ ID NO: 4758646 - DNA, 16 bp, Homo sapiens
gtagatagtatgcact

SEQ ID NO: 4758647 - DNA, 20 bp, Homo sapiens
gtagcatactgatgagacaa

SEQ ID NO: 4758648 - DNA, 14 bp, Homo sapiens
gtagcatataaatg

SEQ ID NO: 4758649 - DNA, 11 bp, Homo sapiens
gtagccctggc

SEQ ID NO: 4758650 - DNA, 21 bp, Homo sapiens
gtagccctggcccggtcccag

SEQ ID NO: 4758651 - DNA, 14 bp, Homo sapiens
gtagcctggtctgt

SEQ ID NO: 4758652 - DNA, 18 bp, Homo sapiens
gtagcctggtctgtgcat

SEQ ID NO: 4758653 - DNA, 21 bp, Homo sapiens
gtagctccgcgtgtctcattt

SEQ ID NO: 4758654 - DNA, 18 bp, Homo sapiens
gtagctccttggttttgc

SEQ ID NO: 4758655 - DNA, 12 bp, Homo sapiens
gtagctgtcctc

SEQ ID NO: 4758656 - DNA, 18 bp, Homo sapiens
gtagcttacctgacacaa

SEQ ID NO: 4758657 - DNA, 14 bp, Homo sapiens
gtagcttcagtcat

SEQ ID NO: 4758658 - DNA, 16 bp, Homo sapiens
gtagcttcagtcatta

SEQ ID NO: 4758659 - DNA, 21 bp, Homo sapiens
gtagggccctgacaggccttc

SEQ ID NO: 4758660 - DNA, 16 bp, Homo sapiens
gtagggtgaggcgtgg

SEQ ID NO: 4758661 - DNA, 19 bp, Homo sapiens
gtagtacttcttctgtaat

SEQ ID NO: 4758662 - DNA, 19 bp, Homo sapiens
gtagtagttgatgaccaat

SEQ ID NO: 4758663 - DNA, 23 bp, Homo sapiens
gtagtagttgatgaccaatctct

SEQ ID NO: 4758664 - DNA, 14 bp, Homo sapiens
gtagtcaggtgcct

SEQ ID NO: 4758665 - DNA, 17 bp, Homo sapiens
gtagtgttgggtggagg

SEQ ID NO: 4758666 - DNA, 18 bp, Homo sapiens
gtagttgatgaccaatct

SEQ ID NO: 4758667 - DNA, 20 bp, Homo sapiens
gtagttgatgaccaatctct

SEQ ID NO: 4758668 - DNA, 24 bp, Homo sapiens
gtagttgatgaccaatctctgtga

SEQ ID NO: 4758669 - DNA, 13 bp, Homo sapiens
gtataaaacagtg

SEQ ID NO: 4758670 - DNA, 19 bp, Homo sapiens
gtataaaacagtgtttcca

SEQ ID NO: 4758671 - DNA, 17 bp, Homo sapiens
gtataaaatgtaaaaac

SEQ ID NO: 4758672 - DNA, 22 bp, Homo sapiens
gtataatactttgtatacaagt

SEQ ID NO: 4758673 - DNA, 20 bp, Homo sapiens
gtataatattaaggcttact

SEQ ID NO: 4758674 - DNA, 11 bp, Homo sapiens
gtatacaaaca

SEQ ID NO: 4758675 - DNA, 17 bp, Homo sapiens
gtatacaaacaggtgct

SEQ ID NO: 4758676 - DNA, 18 bp, Homo sapiens
gtatacaaacaggtgcta

SEQ ID NO: 4758677 - DNA, 15 bp, Homo sapiens
gtatacaagtgtttc

SEQ ID NO: 4758678 - DNA, 15 bp, Homo sapiens
gtatacacacacaca

SEQ ID NO: 4758679 - DNA, 18 bp, Homo sapiens
gtatacatatgtatgtgt

SEQ ID NO: 4758680 - DNA, 20 bp, Homo sapiens
gtatacatatgtatgtgtga

SEQ ID NO: 4758681 - DNA, 21 bp, Homo sapiens
gtatatacagagcctgtttta

SEQ ID NO: 4758682 - DNA, 19 bp, Homo sapiens
gtatatagatgtctgtgta

SEQ ID NO: 4758683 - DNA, 23 bp, Homo sapiens
gtatatagatgtctgtgtataca

SEQ ID NO: 4758684 - DNA, 21 bp, Homo sapiens
gtatatattatatatacatta

SEQ ID NO: 4758685 - DNA, 24 bp, Homo sapiens
gtatattcaaaaattatattttga

SEQ ID NO: 4758686 - DNA, 15 bp, Homo sapiens
gtatattttatttca

SEQ ID NO: 4758687 - DNA, 14 bp, Homo sapiens
gtatcagtgtttat

SEQ ID NO: 4758688 - DNA, 19 bp, Homo sapiens
gtatcagtgtttatgtgct

SEQ ID NO: 4758689 - DNA, 13 bp, Homo sapiens
gtatcccttctca

SEQ ID NO: 4758690 - DNA, 18 bp, Homo sapiens
gtatcccttctcacagca

SEQ ID NO: 4758691 - DNA, 23 bp, Homo sapiens
gtatctgatatctgtttgcttct

SEQ ID NO: 4758692 - DNA, 14 bp, Homo sapiens
gtatcttatttata

SEQ ID NO: 4758693 - DNA, 20 bp, Homo sapiens
gtatgaaatatatgtgaaag

SEQ ID NO: 4758694 - DNA, 20 bp, Homo sapiens
gtatgcactaatcaatactt

SEQ ID NO: 4758695 - DNA, 20 bp, Homo sapiens
tcaccttcctgggcagccca

SEQ ID NO: 4758696 - DNA, 14 bp, Homo sapiens
tcaccttccttgaa

SEQ ID NO: 4758697 - DNA, 15 bp, Homo sapiens
tcacgctgaatgaga

SEQ ID NO: 4758698 - DNA, 12 bp, Homo sapiens
tcacgctttcat

SEQ ID NO: 4758699 - DNA, 14 bp, Homo sapiens
tcacgtgaccctgt

SEQ ID NO: 4758700 - DNA, 15 bp, Homo sapiens
tcacgtgaccctgtg

SEQ ID NO: 4758701 - DNA, 16 bp, Homo sapiens
tcacgtgaccctgtgc

SEQ ID NO: 4758702 - DNA, 21 bp, Homo sapiens
tcacgtgaccctgtgccccgc

SEQ ID NO: 4758703 - DNA, 19 bp, Homo sapiens
tcactaaaaggaagacagt

SEQ ID NO: 4758704 - DNA, 22 bp, Homo sapiens
tcactacccatcggtgtccatt

SEQ ID NO: 4758705 - DNA, 14 bp, Homo sapiens
tcactatccatgca

SEQ ID NO: 4758706 - DNA, 14 bp, Homo sapiens
tcactcattaatta

SEQ ID NO: 4758707 - DNA, 14 bp, Homo sapiens
tcactccactcccc

SEQ ID NO: 4758708 - DNA, 16 bp, Homo sapiens
tcactctgacagtatt

SEQ ID NO: 4758709 - DNA, 20 bp, Homo sapiens
tcactctgacagtattaaca

SEQ ID NO: 4758710 - DNA, 18 bp, Homo sapiens
tcactctgtcagccagcc

SEQ ID NO: 4758711 - DNA, 18 bp, Homo sapiens
tcactgagaaggccccag

SEQ ID NO: 4758712 - DNA, 20 bp, Homo sapiens
tcactgagaaggccccaggg

SEQ ID NO: 4758713 - DNA, 22 bp, Homo sapiens
tcactgagaaggccccagggca

SEQ ID NO: 4758714 - DNA, 23 bp, Homo sapiens
tcactgagaaggccccagggcag

SEQ ID NO: 4758715 - DNA, 24 bp, Homo sapiens
tcactgagaaggccccagggcagc

SEQ ID NO: 4758716 - DNA, 11 bp, Homo sapiens
tcactgcccac

SEQ ID NO: 4758717 - DNA, 18 bp, Homo sapiens
tcactgcccacctgccag

SEQ ID NO: 4758718 - DNA, 20 bp, Homo sapiens
tcactgcccacctgccaggc

SEQ ID NO: 4758719 - DNA, 21 bp, Homo sapiens
tcactgcccacctgccaggct

SEQ ID NO: 4758720 - DNA, 22 bp, Homo sapiens
tcactgcccacctgccaggctg

SEQ ID NO: 4758721 - DNA, 22 bp, Homo sapiens
tcactgcccgcacaccctcact

SEQ ID NO: 4758722 - DNA, 14 bp, Homo sapiens
tcactgctttgtag

SEQ ID NO: 4758723 - DNA, 19 bp, Homo sapiens
tcactgctttttccttagc

SEQ ID NO: 4758724 - DNA, 20 bp, Homo sapiens
tcactggagtagttgctact

SEQ ID NO: 4758725 - DNA, 23 bp, Homo sapiens
tcacttaaaatcaaatttttctg

SEQ ID NO: 4758726 - DNA, 17 bp, Homo sapiens
tcacttaaactttgtca

SEQ ID NO: 4758727 - DNA, 14 bp, Homo sapiens
tcacttctgctgta

SEQ ID NO: 4758728 - DNA, 12 bp, Homo sapiens
tcacttcttaag

SEQ ID NO: 4758729 - DNA, 15 bp, Homo sapiens
tcacttcttaaggac

SEQ ID NO: 4758730 - DNA, 21 bp, Homo sapiens
tcacttcttaaggacagtgtt

SEQ ID NO: 4758731 - DNA, 16 bp, Homo sapiens
tcacttttattgtata

SEQ ID NO: 4758732 - DNA, 13 bp, Homo sapiens
tcacttttttcct

SEQ ID NO: 4758733 - DNA, 14 bp, Homo sapiens
tcagaaaagcacct

SEQ ID NO: 4758734 - DNA, 22 bp, Homo sapiens
tcagaaacaaagcatttgactt

SEQ ID NO: 4758735 - DNA, 24 bp, Homo sapiens
tcagaaacaaagcatttgactttc

SEQ ID NO: 4758736 - DNA, 19 bp, Homo sapiens
tcagaaagggcagcccctc

SEQ ID NO: 4758737 - DNA, 22 bp, Homo sapiens
tcagaaagggcagcccctcccc

SEQ ID NO: 4758738 - DNA, 16 bp, Homo sapiens
tcagaacaatccgatt

SEQ ID NO: 4758739 - DNA, 18 bp, Homo sapiens
tcagaagatctttcttaa

SEQ ID NO: 4758740 - DNA, 19 bp, Homo sapiens
tcagaagcccattaaaata

SEQ ID NO: 4758741 - DNA, 18 bp, Homo sapiens
tcagaagtgaaaaagact

SEQ ID NO: 4758742 - DNA, 22 bp, Homo sapiens
tcagaagtttctgccgcagccc

SEQ ID NO: 4758743 - DNA, 23 bp, Homo sapiens
tcagaagtttctgccgcagccct

SEQ ID NO: 4758744 - DNA, 17 bp, Homo sapiens
tcagaatattaagcaca

SEQ ID NO: 4758745 - DNA, 21 bp, Homo sapiens
tcagaatgttgtgttggtatt

SEQ ID NO: 4758746 - DNA, 17 bp, Homo sapiens
tcagaattgtttttaga

SEQ ID NO: 4758747 - DNA, 22 bp, Homo sapiens
tcagaattgtttttagaaattt

SEQ ID NO: 4758748 - DNA, 19 bp, Homo sapiens
tcagacacctagactctaa

SEQ ID NO: 4758749 - DNA, 15 bp, Homo sapiens
tcagactctctcctc

SEQ ID NO: 4758750 - DNA, 12 bp, Homo sapiens
tcagagatgttt

SEQ ID NO: 4758751 - DNA, 14 bp, Homo sapiens
tcagaggagaggag

SEQ ID NO: 4758752 - DNA, 15 bp, Homo sapiens
tcagagggtccctag

SEQ ID NO: 4758753 - DNA, 14 bp, Homo sapiens
tcagaggtatctta

SEQ ID NO: 4758754 - DNA, 20 bp, Homo sapiens
tcagagttcccaagaaagga

SEQ ID NO: 4758755 - DNA, 15 bp, Homo sapiens
tcagataaatcatgg

SEQ ID NO: 4758756 - DNA, 16 bp, Homo sapiens
tcagatccttccaaac

SEQ ID NO: 4758757 - DNA, 19 bp, Homo sapiens
tcagatccttccaaactct

SEQ ID NO: 4758758 - DNA, 21 bp, Homo sapiens
tcagatctgcactcctgtctc

SEQ ID NO: 4758759 - DNA, 13 bp, Homo sapiens
tcagatcttctgt

SEQ ID NO: 4758760 - DNA, 17 bp, Homo sapiens
tcagatgatctctccac

SEQ ID NO: 4758761 - DNA, 12 bp, Homo sapiens
tcagattgtaaa

SEQ ID NO: 4758762 - DNA, 24 bp, Homo sapiens
tcagattgtaaaggtaggtgcatg

SEQ ID NO: 4758763 - DNA, 15 bp, Homo sapiens
tcagattgtatctga

SEQ ID NO: 4758764 - DNA, 17 bp, Homo sapiens
tcagcactaattagtgt

SEQ ID NO: 4758765 - DNA, 14 bp, Homo sapiens
tcagcagacactcc

SEQ ID NO: 4758766 - DNA, 19 bp, Homo sapiens
tcagcatagagctatatat

SEQ ID NO: 4758767 - DNA, 14 bp, Homo sapiens
tcagcatcccacga

SEQ ID NO: 4758768 - DNA, 22 bp, Homo sapiens
tcagcatcccacgatcggcctt

SEQ ID NO: 4758769 - DNA, 15 bp, Homo sapiens
tcagcatcctggaaa

SEQ ID NO: 4758770 - DNA, 14 bp, Homo sapiens
tcagcattcccaat

SEQ ID NO: 4758771 - DNA, 18 bp, Homo sapiens
tcagccagccgccctggg

SEQ ID NO: 4758772 - DNA, 19 bp, Homo sapiens
tcagccagccgccctgggc

SEQ ID NO: 4758773 - DNA, 16 bp, Homo sapiens
tcagccccagacctgc

SEQ ID NO: 4758774 - DNA, 17 bp, Homo sapiens
tcagccccagacctgcc

SEQ ID NO: 4758775 - DNA, 16 bp, Homo sapiens
tcagccttggttcctg

SEQ ID NO: 4758776 - DNA, 18 bp, Homo sapiens
tcagcgattcctgccaag

SEQ ID NO: 4758777 - DNA, 14 bp, Homo sapiens
tcagcggagaggac

SEQ ID NO: 4758778 - DNA, 18 bp, Homo sapiens
tcagcgggagtctcctca

SEQ ID NO: 4758779 - DNA, 12 bp, Homo sapiens
tcagctccactc

SEQ ID NO: 4758780 - DNA, 15 bp, Homo sapiens
tcagctccactctga

SEQ ID NO: 4758781 - DNA, 15 bp, Homo sapiens
tcagctctaaagcag

SEQ ID NO: 4758782 - DNA, 14 bp, Homo sapiens
tcagctctgcataa

SEQ ID NO: 4758783 - DNA, 17 bp, Homo sapiens
tcagctgtctgtggctt

SEQ ID NO: 4758784 - DNA, 16 bp, Homo sapiens
tcagcttcccaacaat

SEQ ID NO: 4758785 - DNA, 22 bp, Homo sapiens
tattctccttctgtcaaagtca

SEQ ID NO: 4758786 - DNA, 19 bp, Homo sapiens
tattctgcagaaaattaat

SEQ ID NO: 4758787 - DNA, 19 bp, Homo sapiens
tattctgtagccaacttaa

SEQ ID NO: 4758788 - DNA, 17 bp, Homo sapiens
tattgacaataagaaac

SEQ ID NO: 4758789 - DNA, 17 bp, Homo sapiens
tattgagacactgtcaa

SEQ ID NO: 4758790 - DNA, 17 bp, Homo sapiens
tattgagcagaattcat

SEQ ID NO: 4758791 - DNA, 20 bp, Homo sapiens
tattgagggaaatgttttca

SEQ ID NO: 4758792 - DNA, 14 bp, Homo sapiens
tattgataataaaa

SEQ ID NO: 4758793 - DNA, 15 bp, Homo sapiens
tattgatctgtatta

SEQ ID NO: 4758794 - DNA, 20 bp, Homo sapiens
tattgcccatgatataactt

SEQ ID NO: 4758795 - DNA, 21 bp, Homo sapiens
tattgcccatgatataacttt

SEQ ID NO: 4758796 - DNA, 22 bp, Homo sapiens
tattgcttggactacctataaa

SEQ ID NO: 4758797 - DNA, 16 bp, Homo sapiens
tattgctttataaata

SEQ ID NO: 4758798 - DNA, 17 bp, Homo sapiens
tattggacagacacaga

SEQ ID NO: 4758799 - DNA, 19 bp, Homo sapiens
tattggacttccatttgga

SEQ ID NO: 4758800 - DNA, 15 bp, Homo sapiens
tattggcagcacagc

SEQ ID NO: 4758801 - DNA, 11 bp, Homo sapiens
tattgtaatat

SEQ ID NO: 4758802 - DNA, 23 bp, Homo sapiens
tattgtaatatagaaaaaaacat

SEQ ID NO: 4758803 - DNA, 15 bp, Homo sapiens
tattgtatctccttt

SEQ ID NO: 4758804 - DNA, 15 bp, Homo sapiens
tattgtattatcata

SEQ ID NO: 4758805 - DNA, 22 bp, Homo sapiens
tattgtattatcatatatgctt

SEQ ID NO: 4758806 - DNA, 23 bp, Homo sapiens
tattgtattatcatatatgcttt

SEQ ID NO: 4758807 - DNA, 16 bp, Homo sapiens
tattgtattgttagat

SEQ ID NO: 4758808 - DNA, 18 bp, Homo sapiens
tattgtattgttagatgt

SEQ ID NO: 4758809 - DNA, 20 bp, Homo sapiens
tattgtccattccaatacat

SEQ ID NO: 4758810 - DNA, 15 bp, Homo sapiens
tattgtccttgtgta

SEQ ID NO: 4758811 - DNA, 13 bp, Homo sapiens
tattgtctgtaaa

SEQ ID NO: 4758812 - DNA, 15 bp, Homo sapiens
tattgtgagatcctg

SEQ ID NO: 4758813 - DNA, 18 bp, Homo sapiens
tattgtgtaggaaatctg

SEQ ID NO: 4758814 - DNA, 20 bp, Homo sapiens
tattgttaaaaccttactta

SEQ ID NO: 4758815 - DNA, 15 bp, Homo sapiens
tattgttcttgtaaa

SEQ ID NO: 4758816 - DNA, 16 bp, Homo sapiens
tattgttcttgtaaaa

SEQ ID NO: 4758817 - DNA, 20 bp, Homo sapiens
tattgttcttgtaaaactgt

SEQ ID NO: 4758818 - DNA, 22 bp, Homo sapiens
tattgttcttgtaaaactgtga

SEQ ID NO: 4758819 - DNA, 22 bp, Homo sapiens
tatttaaaaaatgaatagtaca

SEQ ID NO: 4758820 - DNA, 15 bp, Homo sapiens
tatttaaaatgtaaa

SEQ ID NO: 4758821 - DNA, 15 bp, Homo sapiens
tatttaacattcttg

SEQ ID NO: 4758822 - DNA, 20 bp, Homo sapiens
tatttaactaattaaaaaat

SEQ ID NO: 4758823 - DNA, 19 bp, Homo sapiens
tatttaagtggactgtatt

SEQ ID NO: 4758824 - DNA, 16 bp, Homo sapiens
tatttaatgtttgtaa

SEQ ID NO: 4758825 - DNA, 11 bp, Homo sapiens
tatttacaaga

SEQ ID NO: 4758826 - DNA, 15 bp, Homo sapiens
tatttacaagaagaa

SEQ ID NO: 4758827 - DNA, 19 bp, Homo sapiens
tatttaccagaagtttaaa

SEQ ID NO: 4758828 - DNA, 14 bp, Homo sapiens
tatttactgcaatg

SEQ ID NO: 4758829 - DNA, 15 bp, Homo sapiens
tatttactgcaatgt

SEQ ID NO: 4758830 - DNA, 18 bp, Homo sapiens
tatttactgcaatgtctg

SEQ ID NO: 4758831 - DNA, 19 bp, Homo sapiens
tatttactgcaatgtctgt

SEQ ID NO: 4758832 - DNA, 23 bp, Homo sapiens
tatttagtaaaattatctgttct

SEQ ID NO: 4758833 - DNA, 13 bp, Homo sapiens
tatttagtatctg

SEQ ID NO: 4758834 - DNA, 16 bp, Homo sapiens
tatttataagaaaaat

SEQ ID NO: 4758835 - DNA, 15 bp, Homo sapiens
tatttatattagagt

SEQ ID NO: 4758836 - DNA, 20 bp, Homo sapiens
tatttatgatgttattttgt

SEQ ID NO: 4758837 - DNA, 14 bp, Homo sapiens
tatttattaaactt

SEQ ID NO: 4758838 - DNA, 16 bp, Homo sapiens
tatttattaaacttca

SEQ ID NO: 4758839 - DNA, 18 bp, Homo sapiens
tatttattaaacttcagc

SEQ ID NO: 4758840 - DNA, 13 bp, Homo sapiens
tatttattgcttt

SEQ ID NO: 4758841 - DNA, 14 bp, Homo sapiens
tatttattgcttta

SEQ ID NO: 4758842 - DNA, 21 bp, Homo sapiens
tatttattgtatatatggata

SEQ ID NO: 4758843 - DNA, 22 bp, Homo sapiens
tatttattgtatatatggatat

SEQ ID NO: 4758844 - DNA, 22 bp, Homo sapiens
tatttcacttaaactttgtcac

SEQ ID NO: 4758845 - DNA, 20 bp, Homo sapiens
tatttcactttagtttttga

SEQ ID NO: 4758846 - DNA, 20 bp, Homo sapiens
tatttcatgaatacattgta

SEQ ID NO: 4758847 - DNA, 23 bp, Homo sapiens
tatttccatacgtgcccatttca

SEQ ID NO: 4758848 - DNA, 14 bp, Homo sapiens
tatttccatattaa

SEQ ID NO: 4758849 - DNA, 18 bp, Homo sapiens
tatttccatattaaaatc

SEQ ID NO: 4758850 - DNA, 11 bp, Homo sapiens
tatttccatgg

SEQ ID NO: 4758851 - DNA, 19 bp, Homo sapiens
tatttctcgggtgcatttg

SEQ ID NO: 4758852 - DNA, 17 bp, Homo sapiens
tatttctgtatatagat

SEQ ID NO: 4758853 - DNA, 21 bp, Homo sapiens
tatttctgtatatagatgtct

SEQ ID NO: 4758854 - DNA, 15 bp, Homo sapiens
tatttctttcatcag

SEQ ID NO: 4758855 - DNA, 20 bp, Homo sapiens
tatttgctcataagtaaatg

SEQ ID NO: 4758856 - DNA, 21 bp, Homo sapiens
tatttgctcataagtaaatgt

SEQ ID NO: 4758857 - DNA, 19 bp, Homo sapiens
tatttgtttagttcagcaa

SEQ ID NO: 4758858 - DNA, 12 bp, Homo sapiens
tattttaacata

SEQ ID NO: 4758859 - DNA, 15 bp, Homo sapiens
tattttaacatagca

SEQ ID NO: 4758860 - DNA, 22 bp, Homo sapiens
tattttagcagttctgcaaata

SEQ ID NO: 4758861 - DNA, 15 bp, Homo sapiens
tattttatataataa

SEQ ID NO: 4758862 - DNA, 15 bp, Homo sapiens
tattttatctgtgtt

SEQ ID NO: 4758863 - DNA, 20 bp, Homo sapiens
tattttcgtgcatttgtgag

SEQ ID NO: 4758864 - DNA, 18 bp, Homo sapiens
tattttctactttaaatt

SEQ ID NO: 4758865 - DNA, 22 bp, Homo sapiens
tattttctgagtagcatatata

SEQ ID NO: 4758866 - DNA, 19 bp, Homo sapiens
tattttcttcccatttgta

SEQ ID NO: 4758867 - DNA, 21 bp, Homo sapiens
tattttgaagtgagaaaatga

SEQ ID NO: 4758868 - DNA, 22 bp, Homo sapiens
tattttgtaaaatgtattatgt

SEQ ID NO: 4758869 - DNA, 23 bp, Homo sapiens
tatttttagagattaatttgtgt

SEQ ID NO: 4758870 - DNA, 17 bp, Homo sapiens
tatttttgctctccctc

SEQ ID NO: 4758871 - DNA, 12 bp, Homo sapiens
tatttttgtaat

SEQ ID NO: 4758872 - DNA, 18 bp, Homo sapiens
tattttttgtaactcttt

SEQ ID NO: 4758873 - DNA, 22 bp, Homo sapiens
tcaaaaaacagaaaaacaaaaa

SEQ ID NO: 4758874 - DNA, 17 bp, Homo sapiens
tcaaaaatcatcaaagt

SEQ ID NO: 4758875 - DNA, 18 bp, Homo sapiens
tcaaaaattgaagagaga

SEQ ID NO: 4758876 - DNA, 22 bp, Homo sapiens
tcaaaagggccccatggccaaa

SEQ ID NO: 4758877 - DNA, 18 bp, Homo sapiens
tcaaaataatctgaaatg

SEQ ID NO: 4758878 - DNA, 21 bp, Homo sapiens
tcaaaataatctgaaatgaca

SEQ ID NO: 4758879 - DNA, 17 bp, Homo sapiens
tcaaaataggtttttat

SEQ ID NO: 4758880 - DNA, 13 bp, Homo sapiens
tcaaaatattgag

SEQ ID NO: 4758881 - DNA, 22 bp, Homo sapiens
tcaaaatattgagcagaattca

SEQ ID NO: 4758882 - DNA, 21 bp, Homo sapiens
tcacatatcaagtcccgaggc

SEQ ID NO: 4758883 - DNA, 21 bp, Homo sapiens
tcacatgtggcacgtaaggtc

SEQ ID NO: 4758884 - DNA, 13 bp, Homo sapiens
tcacattcctgac

SEQ ID NO: 4758885 - DNA, 14 bp, Homo sapiens
tcacattcctgacc

SEQ ID NO: 4758886 - DNA, 16 bp, Homo sapiens
tcacattcctgaccct

SEQ ID NO: 4758887 - DNA, 21 bp, Homo sapiens
tcacattcctgaccctcactt

SEQ ID NO: 4758888 - DNA, 16 bp, Homo sapiens
tcaccaaaagacgagg

SEQ ID NO: 4758889 - DNA, 19 bp, Homo sapiens
tcaccaacaacagtcagcc

SEQ ID NO: 4758890 - DNA, 20 bp, Homo sapiens
tcaccaacaacagtcagcca

SEQ ID NO: 4758891 - DNA, 20 bp, Homo sapiens
tcaccacaaccctgttgcta

SEQ ID NO: 4758892 - DNA, 16 bp, Homo sapiens
tcaccagccctggcaa

SEQ ID NO: 4758893 - DNA, 17 bp, Homo sapiens
tcaccagctatctgtca

SEQ ID NO: 4758894 - DNA, 19 bp, Homo sapiens
tcaccagctatctgtcatc

SEQ ID NO: 4758895 - DNA, 20 bp, Homo sapiens
tcaccagctgccaaaatcgt

SEQ ID NO: 4758896 - DNA, 14 bp, Homo sapiens
tcaccccccgacct

SEQ ID NO: 4758897 - DNA, 17 bp, Homo sapiens
tcaccccggcaggccct

SEQ ID NO: 4758898 - DNA, 18 bp, Homo sapiens
tcaccccggcaggccctg

SEQ ID NO: 4758899 - DNA, 15 bp, Homo sapiens
tcaccctctgtcctt

SEQ ID NO: 4758900 - DNA, 16 bp, Homo sapiens
tcaccctgccaccctc

SEQ ID NO: 4758901 - DNA, 21 bp, Homo sapiens
tcacccttgaaaactctcagt

SEQ ID NO: 4758902 - DNA, 20 bp, Homo sapiens
tcaccgacccgacactctca

SEQ ID NO: 4758903 - DNA, 21 bp, Homo sapiens
tcaccgacccgacactctcac

SEQ ID NO: 4758904 - DNA, 14 bp, Homo sapiens
tcaccgattcttcc

SEQ ID NO: 4758905 - DNA, 15 bp, Homo sapiens
tcaccgattcttcct

SEQ ID NO: 4758906 - DNA, 16 bp, Homo sapiens
tcaccgattcttcctt

SEQ ID NO: 4758907 - DNA, 21 bp, Homo sapiens
tcaccgcattccaggggctgc

SEQ ID NO: 4758908 - DNA, 12 bp, Homo sapiens
tcacctccttct

SEQ ID NO: 4758909 - DNA, 19 bp, Homo sapiens
tcacctgaataagggactt

SEQ ID NO: 4758910 - DNA, 13 bp, Homo sapiens
tcacctgcccctc

SEQ ID NO: 4758911 - DNA, 15 bp, Homo sapiens
tcacctgcccctcaa

SEQ ID NO: 4758912 - DNA, 18 bp, Homo sapiens
tcacctggcttcccagga

SEQ ID NO: 4758913 - DNA, 20 bp, Homo sapiens
tcatttggatataaatctta

SEQ ID NO: 4758914 - DNA, 15 bp, Homo sapiens
tcatttggtggctct

SEQ ID NO: 4758915 - DNA, 13 bp, Homo sapiens
tcattttcagatc

SEQ ID NO: 4758916 - DNA, 21 bp, Homo sapiens
tcattttctagccctctccct

SEQ ID NO: 4758917 - DNA, 22 bp, Homo sapiens
tcatttttgaaactgcatttgt

SEQ ID NO: 4758918 - DNA, 13 bp, Homo sapiens
tcattttttttaa

SEQ ID NO: 4758919 - DNA, 23 bp, Homo sapiens
tccaaaactgtattgaaaaaata

SEQ ID NO: 4758920 - DNA, 20 bp, Homo sapiens
tccaaaagtgaccagcatac

SEQ ID NO: 4758921 - DNA, 21 bp, Homo sapiens
tccaaaatagtcatgtttctg

SEQ ID NO: 4758922 - DNA, 17 bp, Homo sapiens
tccaaatacattccagt

SEQ ID NO: 4758923 - DNA, 23 bp, Homo sapiens
tccaaatgctgtcgggcaagata

SEQ ID NO: 4758924 - DNA, 19 bp, Homo sapiens
tccaacaactccaggaaaa

SEQ ID NO: 4758925 - DNA, 15 bp, Homo sapiens
tccaacatgtgatgt

SEQ ID NO: 4758926 - DNA, 18 bp, Homo sapiens
tccaacccaggtctgctt

SEQ ID NO: 4758927 - DNA, 13 bp, Homo sapiens
tccaacccatgca

SEQ ID NO: 4758928 - DNA, 17 bp, Homo sapiens
tccaacccatgcatggc

SEQ ID NO: 4758929 - DNA, 22 bp, Homo sapiens
tccaacccatgcatggcctccc

SEQ ID NO: 4758930 - DNA, 12 bp, Homo sapiens
tccaacctggag

SEQ ID NO: 4758931 - DNA, 14 bp, Homo sapiens
tccaacctggaggc

SEQ ID NO: 4758932 - DNA, 20 bp, Homo sapiens
tccaacctggaggctggacc

SEQ ID NO: 4758933 - DNA, 15 bp, Homo sapiens
tccaacttttcatcc

SEQ ID NO: 4758934 - DNA, 12 bp, Homo sapiens
tccaagagaatt

SEQ ID NO: 4758935 - DNA, 15 bp, Homo sapiens
tccaagagggactcc

SEQ ID NO: 4758936 - DNA, 14 bp, Homo sapiens
tccaagcatcagca

SEQ ID NO: 4758937 - DNA, 16 bp, Homo sapiens
tccaagccctggggca

SEQ ID NO: 4758938 - DNA, 19 bp, Homo sapiens
tccaagccctggggcaggg

SEQ ID NO: 4758939 - DNA, 17 bp, Homo sapiens
tccaaggaacttcatgc

SEQ ID NO: 4758940 - DNA, 14 bp, Homo sapiens
tccaaggcaaatgt

SEQ ID NO: 4758941 - DNA, 15 bp, Homo sapiens
tccaaggcaaatgtc

SEQ ID NO: 4758942 - DNA, 21 bp, Homo sapiens
tccaagtattttatctgtgtt

SEQ ID NO: 4758943 - DNA, 12 bp, Homo sapiens
tccaagtgtgtg

SEQ ID NO: 4758944 - DNA, 20 bp, Homo sapiens
tccaagtgtgtgtgcaatgt

SEQ ID NO: 4758945 - DNA, 16 bp, Homo sapiens
tccaagttcattcata

SEQ ID NO: 4758946 - DNA, 18 bp, Homo sapiens
tccaagttcattcatact

SEQ ID NO: 4758947 - DNA, 13 bp, Homo sapiens
tccaatccagcct

SEQ ID NO: 4758948 - DNA, 14 bp, Homo sapiens
tccaatccagcctt

SEQ ID NO: 4758949 - DNA, 16 bp, Homo sapiens
tccaatccagccttct

SEQ ID NO: 4758950 - DNA, 15 bp, Homo sapiens
tccaatgtttcaagc

SEQ ID NO: 4758951 - DNA, 13 bp, Homo sapiens
tccacaaatgtcc

SEQ ID NO: 4758952 - DNA, 14 bp, Homo sapiens
tccacaaatgtcct

SEQ ID NO: 4758953 - DNA, 19 bp, Homo sapiens
tccacaaatgtcctcagag

SEQ ID NO: 4758954 - DNA, 17 bp, Homo sapiens
tccacaacctcctcctc

SEQ ID NO: 4758955 - DNA, 15 bp, Homo sapiens
tccacaagagcccag

SEQ ID NO: 4758956 - DNA, 18 bp, Homo sapiens
tccacaagagcccaggcc

SEQ ID NO: 4758957 - DNA, 21 bp, Homo sapiens
tccacaagagcccaggcctcc

SEQ ID NO: 4758958 - DNA, 22 bp, Homo sapiens
tccacacacagcagctccaacc

SEQ ID NO: 4758959 - DNA, 15 bp, Homo sapiens
tccacacctccaccc

SEQ ID NO: 4758960 - DNA, 19 bp, Homo sapiens
tccacacctccacccgtcc

SEQ ID NO: 4758961 - DNA, 21 bp, Homo sapiens
tccacacctccacccgtcctg

SEQ ID NO: 4758962 - DNA, 12 bp, Homo sapiens
tccacaggagcc

SEQ ID NO: 4758963 - DNA, 13 bp, Homo sapiens
tccacagtattgt

SEQ ID NO: 4758964 - DNA, 21 bp, Homo sapiens
tccacagtattgttcttgtaa

SEQ ID NO: 4758965 - DNA, 22 bp, Homo sapiens
tccacagtattgttcttgtaaa

SEQ ID NO: 4758966 - DNA, 23 bp, Homo sapiens
tccacagtattgttcttgtaaaa

SEQ ID NO: 4758967 - DNA, 12 bp, Homo sapiens
tccacatacact

SEQ ID NO: 4758968 - DNA, 14 bp, Homo sapiens
tccacatacactgc

SEQ ID NO: 4758969 - DNA, 16 bp, Homo sapiens
tccacatacactgcat

SEQ ID NO: 4758970 - DNA, 17 bp, Homo sapiens
tccacatacactgcatt

SEQ ID NO: 4758971 - DNA, 20 bp, Homo sapiens
tccacatgcacatgtattct

SEQ ID NO: 4758972 - DNA, 13 bp, Homo sapiens
tccacatgctctg

SEQ ID NO: 4758973 - DNA, 14 bp, Homo sapiens
tccacatgctctga

SEQ ID NO: 4758974 - DNA, 18 bp, Homo sapiens
tccacattgtagcctaat

SEQ ID NO: 4758975 - DNA, 14 bp, Homo sapiens
tccacccagcccac

SEQ ID NO: 4758976 - DNA, 21 bp, Homo sapiens
tccacccctcaagccaggaga

SEQ ID NO: 4758977 - DNA, 15 bp, Homo sapiens
tccaccctgaggagt

SEQ ID NO: 4758978 - DNA, 15 bp, Homo sapiens
tccaccctgccctgg

SEQ ID NO: 4758979 - DNA, 19 bp, Homo sapiens
tccaccctgccctggccta

SEQ ID NO: 4758980 - DNA, 20 bp, Homo sapiens
tccaccctgccctggcctac

SEQ ID NO: 4758981 - DNA, 15 bp, Homo sapiens
tccaccgcagaagga

SEQ ID NO: 4758982 - DNA, 16 bp, Homo sapiens
tccacctggtggccct

SEQ ID NO: 4758983 - DNA, 20 bp, Homo sapiens
tccacctggtggccctgcgg

SEQ ID NO: 4758984 - DNA, 18 bp, Homo sapiens
tccaccttaaattaaaca

SEQ ID NO: 4758985 - DNA, 22 bp, Homo sapiens
tccaccttaaattaaacaattt

SEQ ID NO: 4758986 - DNA, 14 bp, Homo sapiens
tccacgcctcctgg

SEQ ID NO: 4758987 - DNA, 15 bp, Homo sapiens
tccacgcctcctggc

SEQ ID NO: 4758988 - DNA, 18 bp, Homo sapiens
tccacgcttagggtctgt

SEQ ID NO: 4758989 - DNA, 17 bp, Homo sapiens
tccactaggtgcccagt

SEQ ID NO: 4758990 - DNA, 14 bp, Homo sapiens
tccactcccctcat

SEQ ID NO: 4758991 - DNA, 9 bp, Homo sapiens
tccactcct

SEQ ID NO: 4758992 - DNA, 16 bp, Homo sapiens
tccactgcctctgcct

SEQ ID NO: 4758993 - DNA, 14 bp, Homo sapiens
tccacttctctaga

SEQ ID NO: 4758994 - DNA, 16 bp, Homo sapiens
tccactttcctctctc

SEQ ID NO: 4758995 - DNA, 19 bp, Homo sapiens
tccagaaaaatcaatcatt

SEQ ID NO: 4758996 - DNA, 13 bp, Homo sapiens
tccagaactgtct

SEQ ID NO: 4758997 - DNA, 13 bp, Homo sapiens
tccagaattgaga

SEQ ID NO: 4758998 - DNA, 19 bp, Homo sapiens
tcagtgagatcagtcagct

SEQ ID NO: 4758999 - DNA, 15 bp, Homo sapiens
tcagtgagtcagagg

SEQ ID NO: 4759000 - DNA, 15 bp, Homo sapiens
tcagtggacatttgt

SEQ ID NO: 4759001 - DNA, 23 bp, Homo sapiens
tcagtggttggcaattgtttcaa

SEQ ID NO: 4759002 - DNA, 20 bp, Homo sapiens
tcagtgtactctgagtcctc

SEQ ID NO: 4759003 - DNA, 14 bp, Homo sapiens
tcagtgtttatgtg

SEQ ID NO: 4759004 - DNA, 14 bp, Homo sapiens
tcagttacagtggc

SEQ ID NO: 4759005 - DNA, 20 bp, Homo sapiens
tcagttacagtggcagtatt

SEQ ID NO: 4759006 - DNA, 19 bp, Homo sapiens
tcagttatgacatccacaa

SEQ ID NO: 4759007 - DNA, 15 bp, Homo sapiens
tcagttctcatcttg

SEQ ID NO: 4759008 - DNA, 17 bp, Homo sapiens
tcagttgttagtgtgtc

SEQ ID NO: 4759009 - DNA, 18 bp, Homo sapiens
tcataaaggagcatataa

SEQ ID NO: 4759010 - DNA, 14 bp, Homo sapiens
tcatacctctgacc

SEQ ID NO: 4759011 - DNA, 13 bp, Homo sapiens
tcatactcaaaga

SEQ ID NO: 4759012 - DNA, 21 bp, Homo sapiens
tcatacttgctccttgaataa

SEQ ID NO: 4759013 - DNA, 14 bp, Homo sapiens
tcatagataccatt

SEQ ID NO: 4759014 - DNA, 15 bp, Homo sapiens
tcataggcagagccc

SEQ ID NO: 4759015 - DNA, 18 bp, Homo sapiens
tcatagtcaatcaaacag

SEQ ID NO: 4759016 - DNA, 14 bp, Homo sapiens
tcatatatgctttt

SEQ ID NO: 4759017 - DNA, 19 bp, Homo sapiens
tcatatatgcttttttgca

SEQ ID NO: 4759018 - DNA, 16 bp, Homo sapiens
tcatatattttatgaa

SEQ ID NO: 4759019 - DNA, 12 bp, Homo sapiens
tcatatcatttc

SEQ ID NO: 4759020 - DNA, 23 bp, Homo sapiens
tcatatctgtatgcctcatttta

SEQ ID NO: 4759021 - DNA, 19 bp, Homo sapiens
tcatatcttctttgttttg

SEQ ID NO: 4759022 - DNA, 22 bp, Homo sapiens
tcatattcataccttctgatga

SEQ ID NO: 4759023 - DNA, 13 bp, Homo sapiens
tcatattctcaga

SEQ ID NO: 4759024 - DNA, 15 bp, Homo sapiens
tcatatttacctgtg

SEQ ID NO: 4759025 - DNA, 17 bp, Homo sapiens
tcatatttacctgtgaa

SEQ ID NO: 4759026 - DNA, 20 bp, Homo sapiens
tcatatttggtgatgagact

SEQ ID NO: 4759027 - DNA, 21 bp, Homo sapiens
tcatatttggtgatgagactt

SEQ ID NO: 4759028 - DNA, 18 bp, Homo sapiens
tcatcaacaaagaaatat

SEQ ID NO: 4759029 - DNA, 15 bp, Homo sapiens
tcatcaatcattgta

SEQ ID NO: 4759030 - DNA, 19 bp, Homo sapiens
tcatcaatcattgtacagt

SEQ ID NO: 4759031 - DNA, 19 bp, Homo sapiens
tcatcaccgattcttcctt

SEQ ID NO: 4759032 - DNA, 20 bp, Homo sapiens
tcatcaccgattcttccttg

SEQ ID NO: 4759033 - DNA, 13 bp, Homo sapiens
tcatcagaagtgg

SEQ ID NO: 4759034 - DNA, 22 bp, Homo sapiens
tcatccaaaagtgaccagcata

SEQ ID NO: 4759035 - DNA, 19 bp, Homo sapiens
tcatccagaactgtcttag

SEQ ID NO: 4759036 - DNA, 12 bp, Homo sapiens
tcatccctttcc

SEQ ID NO: 4759037 - DNA, 13 bp, Homo sapiens
tcatccctttcca

SEQ ID NO: 4759038 - DNA, 14 bp, Homo sapiens
tcatccctttccag

SEQ ID NO: 4759039 - DNA, 11 bp, Homo sapiens
tcatcctcagc

SEQ ID NO: 4759040 - DNA, 14 bp, Homo sapiens
tcatcctcagcaag

SEQ ID NO: 4759041 - DNA, 14 bp, Homo sapiens
tcatcggaggctgg

SEQ ID NO: 4759042 - DNA, 16 bp, Homo sapiens
tcatcggaggctgggc

SEQ ID NO: 4759043 - DNA, 13 bp, Homo sapiens
tcatctacacata

SEQ ID NO: 4759044 - DNA, 17 bp, Homo sapiens
tcatctcaaacactgct

SEQ ID NO: 4759045 - DNA, 18 bp, Homo sapiens
tcatctcaaacactgctt

SEQ ID NO: 4759046 - DNA, 20 bp, Homo sapiens
tcatctcaaacactgcttaa

SEQ ID NO: 4759047 - DNA, 15 bp, Homo sapiens
tcatctcagcaatca

SEQ ID NO: 4759048 - DNA, 18 bp, Homo sapiens
tcatctccaaatcttgcc

SEQ ID NO: 4759049 - DNA, 21 bp, Homo sapiens
tcatctccaaatcttgccatt

SEQ ID NO: 4759050 - DNA, 16 bp, Homo sapiens
tcatctctctggggcc

SEQ ID NO: 4759051 - DNA, 15 bp, Homo sapiens
tcatctcttgatgaa

SEQ ID NO: 4759052 - DNA, 18 bp, Homo sapiens
tcatctgaggagtccaaa

SEQ ID NO: 4759053 - DNA, 15 bp, Homo sapiens
tcatctggagtccct

SEQ ID NO: 4759054 - DNA, 23 bp, Homo sapiens
tcatctgtaaaatagtctcattg

SEQ ID NO: 4759055 - DNA, 11 bp, Homo sapiens
tcatctgtcag

SEQ ID NO: 4759056 - DNA, 20 bp, Homo sapiens
tcatcttgcctcattttgct

SEQ ID NO: 4759057 - DNA, 21 bp, Homo sapiens
tcatgaatcactgcacctctt

SEQ ID NO: 4759058 - DNA, 13 bp, Homo sapiens
tcatgaccactgg

SEQ ID NO: 4759059 - DNA, 19 bp, Homo sapiens
tcatgaccactgggcctgc

SEQ ID NO: 4759060 - DNA, 20 bp, Homo sapiens
tcatgaccactgggcctgct

SEQ ID NO: 4759061 - DNA, 21 bp, Homo sapiens
tcatgactttcagattgtatc

SEQ ID NO: 4759062 - DNA, 17 bp, Homo sapiens
tcatgatgctagttctt

SEQ ID NO: 4759063 - DNA, 18 bp, Homo sapiens
tcatgatgctagttctta

SEQ ID NO: 4759064 - DNA, 15 bp, Homo sapiens
tcatgattagacaat

SEQ ID NO: 4759065 - DNA, 16 bp, Homo sapiens
tcatgattagacaatg

SEQ ID NO: 4759066 - DNA, 19 bp, Homo sapiens
tcatgattagacaatgtgg

SEQ ID NO: 4759067 - DNA, 14 bp, Homo sapiens
tcatgcatagacaa

SEQ ID NO: 4759068 - DNA, 19 bp, Homo sapiens
tcatgcatagacaagtgtt

SEQ ID NO: 4759069 - DNA, 15 bp, Homo sapiens
tcatgcccagcttgg

SEQ ID NO: 4759070 - DNA, 15 bp, Homo sapiens
tcatgctgcctgcca

SEQ ID NO: 4759071 - DNA, 18 bp, Homo sapiens
tcatgctgcctgccatgt

SEQ ID NO: 4759072 - DNA, 22 bp, Homo sapiens
tcatgctgcctgccatgtgtga

SEQ ID NO: 4759073 - DNA, 17 bp, Homo sapiens
tcatgcttctactccat

SEQ ID NO: 4759074 - DNA, 18 bp, Homo sapiens
tcatgcttttctcatggt

SEQ ID NO: 4759075 - DNA, 20 bp, Homo sapiens
tcatggatttattttttgta

SEQ ID NO: 4759076 - DNA, 18 bp, Homo sapiens
tcatggctgtcccctgca

SEQ ID NO: 4759077 - DNA, 15 bp, Homo sapiens
tcatggctgttatct

SEQ ID NO: 4759078 - DNA, 17 bp, Homo sapiens
tcatgggagaagagggg

SEQ ID NO: 4759079 - DNA, 20 bp, Homo sapiens
tcatgggcattgctggactg

SEQ ID NO: 4759080 - DNA, 23 bp, Homo sapiens
tcatggtcccacttccccatctg

SEQ ID NO: 4759081 - DNA, 13 bp, Homo sapiens
tcatgtctattgt

SEQ ID NO: 4759082 - DNA, 18 bp, Homo sapiens
tcatgttaattgatagaa

SEQ ID NO: 4759083 - DNA, 17 bp, Homo sapiens
tcatgttggtaccctgg

SEQ ID NO: 4759084 - DNA, 18 bp, Homo sapiens
tcatgttggtaccctgga

SEQ ID NO: 4759085 - DNA, 15 bp, Homo sapiens
tcatgtttaagaaat

SEQ ID NO: 4759086 - DNA, 16 bp, Homo sapiens
tccagtatcttgaaga

SEQ ID NO: 4759087 - DNA, 18 bp, Homo sapiens
tccagtatcttgaagact

SEQ ID NO: 4759088 - DNA, 21 bp, Homo sapiens
tccagtccccctatccttggc

SEQ ID NO: 4759089 - DNA, 22 bp, Homo sapiens
tccagtgacacaactcatccag

SEQ ID NO: 4759090 - DNA, 16 bp, Homo sapiens
tccagtgctttatcca

SEQ ID NO: 4759091 - DNA, 19 bp, Homo sapiens
tccagtgtattttctgtgt

SEQ ID NO: 4759092 - DNA, 15 bp, Homo sapiens
tccagttctgatgag

SEQ ID NO: 4759093 - DNA, 17 bp, Homo sapiens
tccagttctgatgaggc

SEQ ID NO: 4759094 - DNA, 21 bp, Homo sapiens
tccagtttgcccaccacaact

SEQ ID NO: 4759095 - DNA, 18 bp, Homo sapiens
tccagtttgttctccggg

SEQ ID NO: 4759096 - DNA, 13 bp, Homo sapiens
tccataccccctg

SEQ ID NO: 4759097 - DNA, 20 bp, Homo sapiens
tccataccccctgccccaga

SEQ ID NO: 4759098 - DNA, 22 bp, Homo sapiens
tccatacgtgcccatttcacac

SEQ ID NO: 4759099 - DNA, 23 bp, Homo sapiens
tccatacgtgcccatttcacaca

SEQ ID NO: 4759100 - DNA, 19 bp, Homo sapiens
tccatatcagctctgcata

SEQ ID NO: 4759101 - DNA, 19 bp, Homo sapiens
tccatcaaagccctccctg

SEQ ID NO: 4759102 - DNA, 18 bp, Homo sapiens
tccatccaaacctacctt

SEQ ID NO: 4759103 - DNA, 18 bp, Homo sapiens
tccatccacacacagcag

SEQ ID NO: 4759104 - DNA, 14 bp, Homo sapiens
tccatccaccacct

SEQ ID NO: 4759105 - DNA, 22 bp, Homo sapiens
tccatccttttgcttcatctgg

SEQ ID NO: 4759106 - DNA, 18 bp, Homo sapiens
tccatctcaacctacctc

SEQ ID NO: 4759107 - DNA, 17 bp, Homo sapiens
tccatgactgcatttta

SEQ ID NO: 4759108 - DNA, 17 bp, Homo sapiens
tccatgatcaaaatgca

SEQ ID NO: 4759109 - DNA, 20 bp, Homo sapiens
tccatgatcaaaatgcatac

SEQ ID NO: 4759110 - DNA, 13 bp, Homo sapiens
tccatgcacagga

SEQ ID NO: 4759111 - DNA, 22 bp, Homo sapiens
tccatgcagatctagccaggcc

SEQ ID NO: 4759112 - DNA, 23 bp, Homo sapiens
tccatgcagatctagccaggcct

SEQ ID NO: 4759113 - DNA, 13 bp, Homo sapiens
tccatgctcctca

SEQ ID NO: 4759114 - DNA, 22 bp, Homo sapiens
tccatgctcctcactgcccgca

SEQ ID NO: 4759115 - DNA, 12 bp, Homo sapiens
tccatgctcttt

SEQ ID NO: 4759116 - DNA, 16 bp, Homo sapiens
tccatggatcttgctg

SEQ ID NO: 4759117 - DNA, 13 bp, Homo sapiens
tccattaaacttc

SEQ ID NO: 4759118 - DNA, 14 bp, Homo sapiens
tccattaaacttct

SEQ ID NO: 4759119 - DNA, 18 bp, Homo sapiens
tccattaaacttctactg

SEQ ID NO: 4759120 - DNA, 20 bp, Homo sapiens
tccattaaacttctactgag

SEQ ID NO: 4759121 - DNA, 21 bp, Homo sapiens
tccattaaacttctactgagc

SEQ ID NO: 4759122 - DNA, 13 bp, Homo sapiens
tccattaatttaa

SEQ ID NO: 4759123 - DNA, 16 bp, Homo sapiens
tccattactaaagaca

SEQ ID NO: 4759124 - DNA, 16 bp, Homo sapiens
tccattccaatacatt

SEQ ID NO: 4759125 - DNA, 12 bp, Homo sapiens
tccattcctgag

SEQ ID NO: 4759126 - DNA, 13 bp, Homo sapiens
tccatttgctgat

SEQ ID NO: 4759127 - DNA, 19 bp, Homo sapiens
tccatttgctgattgtctg

SEQ ID NO: 4759128 - DNA, 21 bp, Homo sapiens
tccatttggaatcatatggga

SEQ ID NO: 4759129 - DNA, 19 bp, Homo sapiens
tccatttggattttaaaca

SEQ ID NO: 4759130 - DNA, 13 bp, Homo sapiens
tccattttggaaa

SEQ ID NO: 4759131 - DNA, 24 bp, Homo sapiens
tccatttttacaagttatagtact

SEQ ID NO: 4759132 - DNA, 17 bp, Homo sapiens
tccatttttgagtaaaa

SEQ ID NO: 4759133 - DNA, 16 bp, Homo sapiens
tcccaaagcagtgcat

SEQ ID NO: 4759134 - DNA, 17 bp, Homo sapiens
tcccaaagcagtgcatg

SEQ ID NO: 4759135 - DNA, 21 bp, Homo sapiens
tcccaaagcagtgcatgctgt

SEQ ID NO: 4759136 - DNA, 13 bp, Homo sapiens
tcccaaataaatt

SEQ ID NO: 4759137 - DNA, 21 bp, Homo sapiens
tcccaaataaatttataacaa

SEQ ID NO: 4759138 - DNA, 15 bp, Homo sapiens
tcccaaatctcaaaa

SEQ ID NO: 4759139 - DNA, 15 bp, Homo sapiens
tcccaacctcccctg

SEQ ID NO: 4759140 - DNA, 16 bp, Homo sapiens
tcccaacctcccctgg

SEQ ID NO: 4759141 - DNA, 20 bp, Homo sapiens
tcccaacctcccctggtcct

SEQ ID NO: 4759142 - DNA, 20 bp, Homo sapiens
tcccaagaaaggaaaccttt

SEQ ID NO: 4759143 - DNA, 22 bp, Homo sapiens
tcccaagctgatggacatgaga

SEQ ID NO: 4759144 - DNA, 13 bp, Homo sapiens
tcccaaggcagct

SEQ ID NO: 4759145 - DNA, 14 bp, Homo sapiens
tcccaagtcaaaca

SEQ ID NO: 4759146 - DNA, 18 bp, Homo sapiens
tcccaagtcaaacagtgt

SEQ ID NO: 4759147 - DNA, 14 bp, Homo sapiens
tcccaatcagcact

SEQ ID NO: 4759148 - DNA, 17 bp, Homo sapiens
tcccaatcagcactgaa

SEQ ID NO: 4759149 - DNA, 18 bp, Homo sapiens
tcccaatcagcactgaaa

SEQ ID NO: 4759150 - DNA, 22 bp, Homo sapiens
tcccacaagactggtattctct

SEQ ID NO: 4759151 - DNA, 16 bp, Homo sapiens
tcccacagccccttgc

SEQ ID NO: 4759152 - DNA, 20 bp, Homo sapiens
tcccacccactagccctctt

SEQ ID NO: 4759153 - DNA, 13 bp, Homo sapiens
tcccacccccagc

SEQ ID NO: 4759154 - DNA, 22 bp, Homo sapiens
tcccacccctataccctaggtc

SEQ ID NO: 4759155 - DNA, 18 bp, Homo sapiens
tcccaccgggagcctccc

SEQ ID NO: 4759156 - DNA, 21 bp, Homo sapiens
tcccaccgggagcctccccct

SEQ ID NO: 4759157 - DNA, 18 bp, Homo sapiens
tcccacctccctgcccag

SEQ ID NO: 4759158 - DNA, 16 bp, Homo sapiens
tcccacctctttcttc

SEQ ID NO: 4759159 - DNA, 16 bp, Homo sapiens
tcccacctgtcaacct

SEQ ID NO: 4759160 - DNA, 19 bp, Homo sapiens
tcccactgatatcacgggc

SEQ ID NO: 4759161 - DNA, 19 bp, Homo sapiens
tctctctttcttttgtgca

SEQ ID NO: 4759162 - DNA, 16 bp, Homo sapiens
tctctgagcagtgggg

SEQ ID NO: 4759163 - DNA, 15 bp, Homo sapiens
tctctgatggcactt

SEQ ID NO: 4759164 - DNA, 22 bp, Homo sapiens
tctctgatggcacttttgagct

SEQ ID NO: 4759165 - DNA, 24 bp, Homo sapiens
tctctgccggtggggccagcgctg

SEQ ID NO: 4759166 - DNA, 20 bp, Homo sapiens
tctctggaagagggaggggc

SEQ ID NO: 4759167 - DNA, 16 bp, Homo sapiens
tctctggacctgacca

SEQ ID NO: 4759168 - DNA, 17 bp, Homo sapiens
tctctggacctgaccag

SEQ ID NO: 4759169 - DNA, 20 bp, Homo sapiens
tctctggcaatcttgccctt

SEQ ID NO: 4759170 - DNA, 20 bp, Homo sapiens
tctctggggccctgggcctc

SEQ ID NO: 4759171 - DNA, 22 bp, Homo sapiens
tctctggggccctgggcctcag

SEQ ID NO: 4759172 - DNA, 22 bp, Homo sapiens
tctctggttgccaaatactcat

SEQ ID NO: 4759173 - DNA, 15 bp, Homo sapiens
tctctgtgtggcaaa

SEQ ID NO: 4759174 - DNA, 22 bp, Homo sapiens
tctctgttctttcatactacat

SEQ ID NO: 4759175 - DNA, 14 bp, Homo sapiens
tctcttaagctgcc

SEQ ID NO: 4759176 - DNA, 17 bp, Homo sapiens
tctcttaagctgcccaa

SEQ ID NO: 4759177 - DNA, 18 bp, Homo sapiens
tctcttaagctgcccaat

SEQ ID NO: 4759178 - DNA, 20 bp, Homo sapiens
tctcttaccccgtccctttc

SEQ ID NO: 4759179 - DNA, 19 bp, Homo sapiens
tctcttacgctctctgtct

SEQ ID NO: 4759180 - DNA, 13 bp, Homo sapiens
tctcttcgctgtg

SEQ ID NO: 4759181 - DNA, 16 bp, Homo sapiens
tctcttcggtggcctt

SEQ ID NO: 4759182 - DNA, 17 bp, Homo sapiens
tctcttggtctctttct

SEQ ID NO: 4759183 - DNA, 17 bp, Homo sapiens
tctcttgtaccagccca

SEQ ID NO: 4759184 - DNA, 16 bp, Homo sapiens
tctcttgtcattctca

SEQ ID NO: 4759185 - DNA, 21 bp, Homo sapiens
tctcttgtcattctcatccaa

SEQ ID NO: 4759186 - DNA, 15 bp, Homo sapiens
tctctttacattttg

SEQ ID NO: 4759187 - DNA, 15 bp, Homo sapiens
tctctttctttccaa

SEQ ID NO: 4759188 - DNA, 18 bp, Homo sapiens
tctctttcttttgtgcat

SEQ ID NO: 4759189 - DNA, 16 bp, Homo sapiens
tctctttgtggggctt

SEQ ID NO: 4759190 - DNA, 20 bp, Homo sapiens
tctctttgtggggcttggcg

SEQ ID NO: 4759191 - DNA, 21 bp, Homo sapiens
tctctttgtggggcttggcgt

SEQ ID NO: 4759192 - DNA, 21 bp, Homo sapiens
tctctttgttcttcaatgtga

SEQ ID NO: 4759193 - DNA, 11 bp, Homo sapiens
tctctttttat

SEQ ID NO: 4759194 - DNA, 12 bp, Homo sapiens
tctgaaaactgg

SEQ ID NO: 4759195 - DNA, 16 bp, Homo sapiens
tctgaaagttttgata

SEQ ID NO: 4759196 - DNA, 16 bp, Homo sapiens
tctgaaattttctaga

SEQ ID NO: 4759197 - DNA, 18 bp, Homo sapiens
tctgaaattttctagaat

SEQ ID NO: 4759198 - DNA, 22 bp, Homo sapiens
tctgaaattttctagaatacta

SEQ ID NO: 4759199 - DNA, 19 bp, Homo sapiens
tctgaactgcaacactgga

SEQ ID NO: 4759200 - DNA, 19 bp, Homo sapiens
tctgaagccttttcctgag

SEQ ID NO: 4759201 - DNA, 13 bp, Homo sapiens
tctgaaggagagg

SEQ ID NO: 4759202 - DNA, 14 bp, Homo sapiens
tctgaaggagagga

SEQ ID NO: 4759203 - DNA, 16 bp, Homo sapiens
tctgaaggagaggagt

SEQ ID NO: 4759204 - DNA, 16 bp, Homo sapiens
tctgaagggaggggaa

SEQ ID NO: 4759205 - DNA, 19 bp, Homo sapiens
tctgaagggaggggaagag

SEQ ID NO: 4759206 - DNA, 22 bp, Homo sapiens
tctgaagtcccttcctgtcctg

SEQ ID NO: 4759207 - DNA, 18 bp, Homo sapiens
tctgaatctctcaaaatg

SEQ ID NO: 4759208 - DNA, 19 bp, Homo sapiens
tctgaatctctcaaaatgt

SEQ ID NO: 4759209 - DNA, 12 bp, Homo sapiens
tctgacaagggc

SEQ ID NO: 4759210 - DNA, 22 bp, Homo sapiens
tctgacagcatttcagctgtga

SEQ ID NO: 4759211 - DNA, 19 bp, Homo sapiens
tctgacagtattaacatca

SEQ ID NO: 4759212 - DNA, 16 bp, Homo sapiens
tctgagaagaggagcc

SEQ ID NO: 4759213 - DNA, 13 bp, Homo sapiens
tctgttccctgct

SEQ ID NO: 4759214 - DNA, 10 bp, Homo sapiens
tctgttctat

SEQ ID NO: 4759215 - DNA, 12 bp, Homo sapiens
tctgttctcaaa

SEQ ID NO: 4759216 - DNA, 21 bp, Homo sapiens
tctgttctcaaatgctaaatg

SEQ ID NO: 4759217 - DNA, 22 bp, Homo sapiens
tctgttgaccaatctctattca

SEQ ID NO: 4759218 - DNA, 23 bp, Homo sapiens
tctgttggccagcacgttctcca

SEQ ID NO: 4759219 - DNA, 11 bp, Homo sapiens
tctgttgtaat

SEQ ID NO: 4759220 - DNA, 16 bp, Homo sapiens
tctgtttaccctccct

SEQ ID NO: 4759221 - DNA, 18 bp, Homo sapiens
tctgtttaccctccctgt

SEQ ID NO: 4759222 - DNA, 21 bp, Homo sapiens
tcttaaaattggttaatgaaa

SEQ ID NO: 4759223 - DNA, 22 bp, Homo sapiens
tcttaaatatgtggagttcatc

SEQ ID NO: 4759224 - DNA, 21 bp, Homo sapiens
tcttaagacagcatgtgttaa

SEQ ID NO: 4759225 - DNA, 24 bp, Homo sapiens
tcttaagacagcatgtgttaatct

SEQ ID NO: 4759226 - DNA, 14 bp, Homo sapiens
tcttaagctgccca

SEQ ID NO: 4759227 - DNA, 16 bp, Homo sapiens
tcttaaggacagtgtt

SEQ ID NO: 4759228 - DNA, 19 bp, Homo sapiens
tcttaaggacagtgttcaa

SEQ ID NO: 4759229 - DNA, 22 bp, Homo sapiens
tcttaaggacagtgttcaaatt

SEQ ID NO: 4759230 - DNA, 18 bp, Homo sapiens
tcttaatgtctcaaaata

SEQ ID NO: 4759231 - DNA, 13 bp, Homo sapiens
tcttaattatggt

SEQ ID NO: 4759232 - DNA, 14 bp, Homo sapiens
tcttaccctttctt

SEQ ID NO: 4759233 - DNA, 16 bp, Homo sapiens
tcttaccgaaatgaaa

SEQ ID NO: 4759234 - DNA, 19 bp, Homo sapiens
tcttaccgaaatgaaaatg

SEQ ID NO: 4759235 - DNA, 16 bp, Homo sapiens
tcttacctcatttgca

SEQ ID NO: 4759236 - DNA, 17 bp, Homo sapiens
tcttacctcatttgcat

SEQ ID NO: 4759237 - DNA, 18 bp, Homo sapiens
tcttactaataggtctgg

SEQ ID NO: 4759238 - DNA, 21 bp, Homo sapiens
tcttactcaagatactggact

SEQ ID NO: 4759239 - DNA, 17 bp, Homo sapiens
tcttactgttttgtgcg

SEQ ID NO: 4759240 - DNA, 20 bp, Homo sapiens
tcttatacagataaaacatg

SEQ ID NO: 4759241 - DNA, 14 bp, Homo sapiens
tcttattaaaacac

SEQ ID NO: 4759242 - DNA, 12 bp, Homo sapiens
tcttattcctaa

SEQ ID NO: 4759243 - DNA, 23 bp, Homo sapiens
tcttcaaacagttccataccaag

SEQ ID NO: 4759244 - DNA, 15 bp, Homo sapiens
tcttcaaccctgccc

SEQ ID NO: 4759245 - DNA, 17 bp, Homo sapiens
tcttcaaccctgccctg

SEQ ID NO: 4759246 - DNA, 20 bp, Homo sapiens
tcttcaaccctgccctgcac

SEQ ID NO: 4759247 - DNA, 14 bp, Homo sapiens
tcttcaatgtgaaa

SEQ ID NO: 4759248 - DNA, 19 bp, Homo sapiens
tcttcaatgtgaaactgag

SEQ ID NO: 4759249 - DNA, 24 bp, Homo sapiens
tcttcaatgtgaaactgagaccaa

SEQ ID NO: 4759250 - DNA, 22 bp, Homo sapiens
tcttcaattaatggaaaactgt

SEQ ID NO: 4759251 - DNA, 20 bp, Homo sapiens
tcttcaatttgtataaaatg

SEQ ID NO: 4759252 - DNA, 14 bp, Homo sapiens
tcttcaccaggaag

SEQ ID NO: 4759253 - DNA, 22 bp, Homo sapiens
tcttcactgtcttactcaagat

SEQ ID NO: 4759254 - DNA, 17 bp, Homo sapiens
tcttcagcacaaaagga

SEQ ID NO: 4759255 - DNA, 15 bp, Homo sapiens
tcttcatccatagac

SEQ ID NO: 4759256 - DNA, 16 bp, Homo sapiens
tcttcatccatagaca

SEQ ID NO: 4759257 - DNA, 19 bp, Homo sapiens
tcttcatccatagacacag

SEQ ID NO: 4759258 - DNA, 20 bp, Homo sapiens
tcttcatgtaaattgactgt

SEQ ID NO: 4759259 - DNA, 22 bp, Homo sapiens
tcttcccaagtcctcgcccccc

SEQ ID NO: 4759260 - DNA, 13 bp, Homo sapiens
tcttcccccttcc

SEQ ID NO: 4759261 - DNA, 14 bp, Homo sapiens
tcttcccccttccc

SEQ ID NO: 4759262 - DNA, 24 bp, Homo sapiens
tcttcccccttcccctgcgccctc

SEQ ID NO: 4759263 - DNA, 17 bp, Homo sapiens
tcttcctaccaaatata

SEQ ID NO: 4759264 - DNA, 18 bp, Homo sapiens
tcttcctggacagtgaga

SEQ ID NO: 4759265 - DNA, 10 bp, Homo sapiens
tcttccttcc

SEQ ID NO: 4759266 - DNA, 11 bp, Homo sapiens
tcttccttcct

SEQ ID NO: 4759267 - DNA, 12 bp, Homo sapiens
tcttccttcctt

SEQ ID NO: 4759268 - DNA, 15 bp, Homo sapiens
tcttccttgccacaa

SEQ ID NO: 4759269 - DNA, 20 bp, Homo sapiens
tcttcgctgtgatgcatgag

SEQ ID NO: 4759270 - DNA, 22 bp, Homo sapiens
tcttcgtggattgttttttctg

SEQ ID NO: 4759271 - DNA, 19 bp, Homo sapiens
tcttctaaaactactgcct

SEQ ID NO: 4759272 - DNA, 21 bp, Homo sapiens
tcttctaaaactactgccttt

SEQ ID NO: 4759273 - DNA, 15 bp, Homo sapiens
tcttctcattttttc

SEQ ID NO: 4759274 - DNA, 19 bp, Homo sapiens
tcttctccactttctagcc

SEQ ID NO: 4759275 - DNA, 21 bp, Homo sapiens
tcttctgaacttggcgctgcc

SEQ ID NO: 4759276 - DNA, 21 bp, Homo sapiens
tcttctgagtggctaaaactt

SEQ ID NO: 4759277 - DNA, 15 bp, Homo sapiens
tcttctgtaatattt

SEQ ID NO: 4759278 - DNA, 17 bp, Homo sapiens
tcttctttaatttttct

SEQ ID NO: 4759279 - DNA, 15 bp, Homo sapiens
tcttcttttcccatt

SEQ ID NO: 4759280 - DNA, 16 bp, Homo sapiens
tcttgaagaatattgt

SEQ ID NO: 4759281 - DNA, 16 bp, Homo sapiens
tcttgaagggcccagg

SEQ ID NO: 4759282 - DNA, 11 bp, Homo sapiens
tcttgaataaa

SEQ ID NO: 4759283 - DNA, 18 bp, Homo sapiens
tcttgaatgcttaaatga

SEQ ID NO: 4759284 - DNA, 22 bp, Homo sapiens
tcttgaatgttgaagaactcat

SEQ ID NO: 4759285 - DNA, 14 bp, Homo sapiens
tcttgagagcccca

SEQ ID NO: 4759286 - DNA, 23 bp, Homo sapiens
tcttgagcagctgaattggctgc

SEQ ID NO: 4759287 - DNA, 17 bp, Homo sapiens
tcttgagtgggccccct

SEQ ID NO: 4759288 - DNA, 18 bp, Homo sapiens
tcttgagtgggccccctc

SEQ ID NO: 4759289 - DNA, 15 bp, Homo sapiens
tcttgcagcagagag

SEQ ID NO: 4759290 - DNA, 23 bp, Homo sapiens
tcttgcctcattttgcttcccat

SEQ ID NO: 4759291 - DNA, 20 bp, Homo sapiens
tcttgcggcaccgcccaccc

SEQ ID NO: 4759292 - DNA, 21 bp, Homo sapiens
tcttgcggcaccgcccaccca

SEQ ID NO: 4759293 - DNA, 20 bp, Homo sapiens
tcttgctcagtccctctggg

SEQ ID NO: 4759294 - DNA, 12 bp, Homo sapiens
tcttgctgctta

SEQ ID NO: 4759295 - DNA, 21 bp, Homo sapiens
tcttggattggtaccagagcc

SEQ ID NO: 4759296 - DNA, 18 bp, Homo sapiens
tcttggccctattcatta

SEQ ID NO: 4759297 - DNA, 16 bp, Homo sapiens
tcttgggaagcagttt

SEQ ID NO: 4759298 - DNA, 15 bp, Homo sapiens
tcttggtatgatcat

SEQ ID NO: 4759299 - DNA, 16 bp, Homo sapiens
tcttgtaaaactgtga

SEQ ID NO: 4759300 - DNA, 18 bp, Homo sapiens
tcttgtaaaactgtgaca

SEQ ID NO: 4759301 - DNA, 19 bp, Homo sapiens
tcttgtaaaactgtgacat

SEQ ID NO: 4759302 - DNA, 20 bp, Homo sapiens
tcttgtattttcttcccatt

SEQ ID NO: 4759303 - DNA, 15 bp, Homo sapiens
tcttgtgcatgcaaa

SEQ ID NO: 4759304 - DNA, 16 bp, Homo sapiens
tcttgtgcatgcaaaa

SEQ ID NO: 4759305 - DNA, 13 bp, Homo sapiens
tcttgtgtgttta

SEQ ID NO: 4759306 - DNA, 17 bp, Homo sapiens
tcttgtgtttgaaacac

SEQ ID NO: 4759307 - DNA, 16 bp, Homo sapiens
tcttgttaaatgagct

SEQ ID NO: 4759308 - DNA, 22 bp, Homo sapiens
tcttgttaatttcattccaaac

SEQ ID NO: 4759309 - DNA, 21 bp, Homo sapiens
tcttgttcatgttttgctaat

SEQ ID NO: 4759310 - DNA, 16 bp, Homo sapiens
tcttgttgataaaaat

SEQ ID NO: 4759311 - DNA, 13 bp, Homo sapiens
tctttaaattatg

SEQ ID NO: 4759312 - DNA, 18 bp, Homo sapiens
tctttactaacactggct

SEQ ID NO: 4759313 - DNA, 18 bp, Homo sapiens
tctttagtattatattaa

SEQ ID NO: 4759314 - DNA, 13 bp, Homo sapiens
tctttatgatttc

SEQ ID NO: 4759315 - DNA, 16 bp, Homo sapiens
tctttatgatttcatg

SEQ ID NO: 4759316 - DNA, 17 bp, Homo sapiens
tctttatgatttcatga

SEQ ID NO: 4759317 - DNA, 14 bp, Homo sapiens
tctttattagtgaa

SEQ ID NO: 4759318 - DNA, 13 bp, Homo sapiens
tctttattgtctg

SEQ ID NO: 4759319 - DNA, 20 bp, Homo sapiens
tctttcaatccacagtattg

SEQ ID NO: 4759320 - DNA, 14 bp, Homo sapiens
tctttcatactaca

SEQ ID NO: 4759321 - DNA, 20 bp, Homo sapiens
tctttccaaaggttgtacat

SEQ ID NO: 4759322 - DNA, 14 bp, Homo sapiens
tctttccccactga

SEQ ID NO: 4759323 - DNA, 13 bp, Homo sapiens
tctttccttcctt

SEQ ID NO: 4759324 - DNA, 15 bp, Homo sapiens
tctttcggtctcctt

SEQ ID NO: 4759325 - DNA, 12 bp, Homo sapiens
tctttctctctg

SEQ ID NO: 4759326 - DNA, 15 bp, Homo sapiens
tctttctctctgtgt

SEQ ID NO: 4759327 - DNA, 17 bp, Homo sapiens
tctttctctctgtgtgg

SEQ ID NO: 4759328 - DNA, 19 bp, Homo sapiens
tctttctctctgtgtggca

SEQ ID NO: 4759329 - DNA, 20 bp, Homo sapiens
tctttctctctttccatctc

SEQ ID NO: 4759330 - DNA, 16 bp, Homo sapiens
tctttcttcaattaat

SEQ ID NO: 4759331 - DNA, 20 bp, Homo sapiens
tctttcttcaattaatggaa

SEQ ID NO: 4759332 - DNA, 14 bp, Homo sapiens
tctttctttccaaa

SEQ ID NO: 4759333 - DNA, 22 bp, Homo sapiens
tctttgagggactgcctctgcc

SEQ ID NO: 4759334 - DNA, 23 bp, Homo sapiens
tctttgagtgaagctgggagaac

SEQ ID NO: 4759335 - DNA, 20 bp, Homo sapiens
tgaccttggagagacacagc

SEQ ID NO: 4759336 - DNA, 18 bp, Homo sapiens
tgacctttatttattaaa

SEQ ID NO: 4759337 - DNA, 20 bp, Homo sapiens
tgacctttttaatccaggcc

SEQ ID NO: 4759338 - DNA, 19 bp, Homo sapiens
tgacgacctacatctgaaa

SEQ ID NO: 4759339 - DNA, 23 bp, Homo sapiens
tgacggcagtaaatccacagtga

SEQ ID NO: 4759340 - DNA, 13 bp, Homo sapiens
tgacggccctgca

SEQ ID NO: 4759341 - DNA, 19 bp, Homo sapiens
tgacggtattatgcttctt

SEQ ID NO: 4759342 - DNA, 21 bp, Homo sapiens
tgacgtgcacaaaccttcttt

SEQ ID NO: 4759343 - DNA, 23 bp, Homo sapiens
tgactaagaaatgccagtggtgg

SEQ ID NO: 4759344 - DNA, 23 bp, Homo sapiens
tgactaatccttaataactatgg

SEQ ID NO: 4759345 - DNA, 20 bp, Homo sapiens
tgactacagacattaaataa

SEQ ID NO: 4759346 - DNA, 16 bp, Homo sapiens
tgactccaaccattca

SEQ ID NO: 4759347 - DNA, 20 bp, Homo sapiens
tgactccagaatttcccaaa

SEQ ID NO: 4759348 - DNA, 13 bp, Homo sapiens
tgactccctgtgg

SEQ ID NO: 4759349 - DNA, 16 bp, Homo sapiens
tgactccctgtggggg

SEQ ID NO: 4759350 - DNA, 23 bp, Homo sapiens
tgactccctgtgggggtggccat

SEQ ID NO: 4759351 - DNA, 23 bp, Homo sapiens
tgactcttactaaccaccatttc

SEQ ID NO: 4759352 - DNA, 20 bp, Homo sapiens
tgactctttattgtctgtaa

SEQ ID NO: 4759353 - DNA, 21 bp, Homo sapiens
tgactctttattgtctgtaaa

SEQ ID NO: 4759354 - DNA, 15 bp, Homo sapiens
tgacttattgattaa

SEQ ID NO: 4759355 - DNA, 22 bp, Homo sapiens
tgacttcagactctctcctctc

SEQ ID NO: 4759356 - DNA, 14 bp, Homo sapiens
tgacttcccagctg

SEQ ID NO: 4759357 - DNA, 22 bp, Homo sapiens
tgacttcccagctggcagcgcc

SEQ ID NO: 4759358 - DNA, 15 bp, Homo sapiens
tgacttcctgaactc

SEQ ID NO: 4759359 - DNA, 15 bp, Homo sapiens
tgacttgccactgcc

SEQ ID NO: 4759360 - DNA, 15 bp, Homo sapiens
tgactttcagattgt

SEQ ID NO: 4759361 - DNA, 14 bp, Homo sapiens
tgagaaaacaggct

SEQ ID NO: 4759362 - DNA, 18 bp, Homo sapiens
tgagaaatataaaaataa

SEQ ID NO: 4759363 - DNA, 22 bp, Homo sapiens
tgagaaattgtgccaaagatag

SEQ ID NO: 4759364 - DNA, 13 bp, Homo sapiens
tgagaactaaata

SEQ ID NO: 4759365 - DNA, 16 bp, Homo sapiens
tgagaactaaatagat

SEQ ID NO: 4759366 - DNA, 16 bp, Homo sapiens
tgagaactgtgaatat

SEQ ID NO: 4759367 - DNA, 20 bp, Homo sapiens
tgagaatctgtgcagtcatc

SEQ ID NO: 4759368 - DNA, 21 bp, Homo sapiens
tgagaatctgtgcagtcatca

SEQ ID NO: 4759369 - DNA, 13 bp, Homo sapiens
tgagaatgtgcct

SEQ ID NO: 4759370 - DNA, 18 bp, Homo sapiens
tgagaattactgtttgaa

SEQ ID NO: 4759371 - DNA, 21 bp, Homo sapiens
tgagaattgaggggaggtggc

SEQ ID NO: 4759372 - DNA, 23 bp, Homo sapiens
tgagacacacaacggcagtgaag

SEQ ID NO: 4759373 - DNA, 22 bp, Homo sapiens
tgagacactgtcaagattaagt

SEQ ID NO: 4759374 - DNA, 13 bp, Homo sapiens
tgagactctgagg

SEQ ID NO: 4759375 - DNA, 16 bp, Homo sapiens
tgagagaagagagtat

SEQ ID NO: 4759376 - DNA, 23 bp, Homo sapiens
tgagagatgctgtagacatctgt

SEQ ID NO: 4759377 - DNA, 14 bp, Homo sapiens
tgagagcagcctct

SEQ ID NO: 4759378 - DNA, 15 bp, Homo sapiens
tgagagtcatctcaa

SEQ ID NO: 4759379 - DNA, 15 bp, Homo sapiens
tgagatactttgcat

SEQ ID NO: 4759380 - DNA, 22 bp, Homo sapiens
tgagatactttgcattgtctgt

SEQ ID NO: 4759381 - DNA, 15 bp, Homo sapiens
tgagatcctgtgatt

SEQ ID NO: 4759382 - DNA, 17 bp, Homo sapiens
tgagatcctgtgattcc

SEQ ID NO: 4759383 - DNA, 19 bp, Homo sapiens
tgagatggtgccccctggg

SEQ ID NO: 4759384 - DNA, 17 bp, Homo sapiens
tgagatgtgtatcagtg

SEQ ID NO: 4759385 - DNA, 20 bp, Homo sapiens
tgagatgtgtatcagtgttt

SEQ ID NO: 4759386 - DNA, 19 bp, Homo sapiens
tgagatgtttagtagctga

SEQ ID NO: 4759387 - DNA, 14 bp, Homo sapiens
tgagatttgtattt

SEQ ID NO: 4759388 - DNA, 20 bp, Homo sapiens
tgagatttgtatttatatta

SEQ ID NO: 4759389 - DNA, 21 bp, Homo sapiens
tgagcaaactgaagcccacag

SEQ ID NO: 4759390 - DNA, 13 bp, Homo sapiens
tgagcaaggcaag

SEQ ID NO: 4759391 - DNA, 16 bp, Homo sapiens
tgagcaaggcaagaag

SEQ ID NO: 4759392 - DNA, 20 bp, Homo sapiens
tgagcaaggcaagaagtggg

SEQ ID NO: 4759393 - DNA, 22 bp, Homo sapiens
tgagcagacagggcgtcctctc

SEQ ID NO: 4759394 - DNA, 13 bp, Homo sapiens
tgagcagctgaat

SEQ ID NO: 4759395 - DNA, 16 bp, Homo sapiens
tgagcaggaaggcctg

SEQ ID NO: 4759396 - DNA, 18 bp, Homo sapiens
tgagcaggaaggcctggg

SEQ ID NO: 4759397 - DNA, 12 bp, Homo sapiens
tgagcagtgggg

SEQ ID NO: 4759398 - DNA, 13 bp, Homo sapiens
tgagcagtgggga

SEQ ID NO: 4759399 - DNA, 15 bp, Homo sapiens
tgagcagtggggagc

SEQ ID NO: 4759400 - DNA, 21 bp, Homo sapiens
tgagcatgcccaaatataaca

SEQ ID NO: 4759401 - DNA, 20 bp, Homo sapiens
tgagccaataaagctcacac

SEQ ID NO: 4759402 - DNA, 21 bp, Homo sapiens
tgagccaataaagctcacact

SEQ ID NO: 4759403 - DNA, 22 bp, Homo sapiens
tgagccaataaagctcacactt

SEQ ID NO: 4759404 - DNA, 23 bp, Homo sapiens
tgagcccagaagctcaaggctgc

SEQ ID NO: 4759405 - DNA, 15 bp, Homo sapiens
tgagccccctgcacc

SEQ ID NO: 4759406 - DNA, 18 bp, Homo sapiens
tgagccccctgcacccac

SEQ ID NO: 4759407 - DNA, 19 bp, Homo sapiens
tgagccccctgcacccacc

SEQ ID NO: 4759408 - DNA, 23 bp, Homo sapiens
tgagccccctgcacccacccctg

SEQ ID NO: 4759409 - DNA, 11 bp, Homo sapiens
tgagcctgtct

SEQ ID NO: 4759410 - DNA, 12 bp, Homo sapiens
tgagcctgtctc

SEQ ID NO: 4759411 - DNA, 17 bp, Homo sapiens
tgagccttattaaaata

SEQ ID NO: 4759412 - DNA, 18 bp, Homo sapiens
tgagcgccccgcccccac

SEQ ID NO: 4759413 - DNA, 15 bp, Homo sapiens
tgagcgtccaggtga

SEQ ID NO: 4759414 - DNA, 18 bp, Homo sapiens
tgagctatgatatgtgct

SEQ ID NO: 4759415 - DNA, 13 bp, Homo sapiens
tgagctccaccct

SEQ ID NO: 4759416 - DNA, 14 bp, Homo sapiens
tgagctccaccctc

SEQ ID NO: 4759417 - DNA, 15 bp, Homo sapiens
tgagctggttttctc

SEQ ID NO: 4759418 - DNA, 24 bp, Homo sapiens
tgagctggttttctctgatggcac

SEQ ID NO: 4759419 - DNA, 18 bp, Homo sapiens
tgaggaacctcaaactgg

SEQ ID NO: 4759420 - DNA, 22 bp, Homo sapiens
tgaggaagcaaaagcatctatg

SEQ ID NO: 4759421 - DNA, 14 bp, Homo sapiens
tgaggacagggccc

SEQ ID NO: 4759422 - DNA, 15 bp, Homo sapiens
tgaggacctttctga

SEQ ID NO: 4759423 - DNA, 18 bp, Homo sapiens
tgaggagctagtgttaat

SEQ ID NO: 4759424 - DNA, 16 bp, Homo sapiens
tgaggaggggagcaag

SEQ ID NO: 4759425 - DNA, 21 bp, Homo sapiens
tgaggaggggagcaaggctgc

SEQ ID NO: 4759426 - DNA, 22 bp, Homo sapiens
tgaggatgaaaaaataacactg

SEQ ID NO: 4759427 - DNA, 23 bp, Homo sapiens
tgaggcattttactatgcctgtt

SEQ ID NO: 4759428 - DNA, 17 bp, Homo sapiens
tgaggccaaatattgat

SEQ ID NO: 4759429 - DNA, 12 bp, Homo sapiens
tgaggccagaga

SEQ ID NO: 4759430 - DNA, 16 bp, Homo sapiens
tgaggccagagacaca

SEQ ID NO: 4759431 - DNA, 12 bp, Homo sapiens
tgaggcccccgg

SEQ ID NO: 4759432 - DNA, 23 bp, Homo sapiens
tgaggcccccggaggcgcccacc

SEQ ID NO: 4759433 - DNA, 22 bp, Homo sapiens
tgaggctggataggagaggaaa

SEQ ID NO: 4759434 - DNA, 12 bp, Homo sapiens
tgagggaagccc

SEQ ID NO: 4759435 - DNA, 18 bp, Homo sapiens
tgagggaagcccacccgc

SEQ ID NO: 4759436 - DNA, 22 bp, Homo sapiens
tgagggaagcccacccgcccca

SEQ ID NO: 4759437 - DNA, 15 bp, Homo sapiens
tgagggacgagcaga

SEQ ID NO: 4759438 - DNA, 23 bp, Homo sapiens
tgagggacgagcagagcgcagcc

SEQ ID NO: 4759439 - DNA, 19 bp, Homo sapiens
tgagggactgcctctgcca

SEQ ID NO: 4759440 - DNA, 17 bp, Homo sapiens
tgagggcaaaccaggct

SEQ ID NO: 4759441 - DNA, 17 bp, Homo sapiens
tgaggggaggtggccag

SEQ ID NO: 4759442 - DNA, 19 bp, Homo sapiens
tgaggggaggtggccagcc

SEQ ID NO: 4759443 - DNA, 15 bp, Homo sapiens
tgaggtcatctgtaa

SEQ ID NO: 4759444 - DNA, 15 bp, Homo sapiens
tgaggtctttgcatt

SEQ ID NO: 4759445 - DNA, 14 bp, Homo sapiens
tgaggtttcagtag

SEQ ID NO: 4759446 - DNA, 14 bp, Homo sapiens
tgagtagttatgaa

SEQ ID NO: 4759447 - DNA, 18 bp, Homo sapiens
tgagtatttgcgtccgca

SEQ ID NO: 4759448 - DNA, 23 bp, Homo sapiens
tgagtcagaggcagaacctagtc

SEQ ID NO: 4759449 - DNA, 15 bp, Homo sapiens
tgagtcagggcccag

SEQ ID NO: 4759450 - DNA, 17 bp, Homo sapiens
tgagtcagggcccagag

SEQ ID NO: 4759451 - DNA, 22 bp, Homo sapiens
tgagtcagggcccagaggctga

SEQ ID NO: 4759452 - DNA, 21 bp, Homo sapiens
tgagtcggctgggcagggccg

SEQ ID NO: 4759453 - DNA, 18 bp, Homo sapiens
tgagtctgtcctttccca

SEQ ID NO: 4759454 - DNA, 18 bp, Homo sapiens
tgagtgagaagataaaaa

SEQ ID NO: 4759455 - DNA, 17 bp, Homo sapiens
tgagtgcagctctggag

SEQ ID NO: 4759456 - DNA, 13 bp, Homo sapiens
tgagtgccttaca

SEQ ID NO: 4759457 - DNA, 17 bp, Homo sapiens
tgagtgccttacacaat

SEQ ID NO: 4759458 - DNA, 15 bp, Homo sapiens
tgagtgcgaccacca

SEQ ID NO: 4759459 - DNA, 15 bp, Homo sapiens
tcgtagaacctgcgc

SEQ ID NO: 4759460 - DNA, 16 bp, Homo sapiens
tcgtagaacctgcgca

SEQ ID NO: 4759461 - DNA, 20 bp, Homo sapiens
tcgtccggcctgcagcccag

SEQ ID NO: 4759462 - DNA, 22 bp, Homo sapiens
tcgtccggcctgcagcccagaa

SEQ ID NO: 4759463 - DNA, 16 bp, Homo sapiens
tcgtgattgataagaa

SEQ ID NO: 4759464 - DNA, 18 bp, Homo sapiens
tcgtgccatgatctgtat

SEQ ID NO: 4759465 - DNA, 16 bp, Homo sapiens
tcgtgtgcttagaaac

SEQ ID NO: 4759466 - DNA, 15 bp, Homo sapiens
tcgtgtttcacagtg

SEQ ID NO: 4759467 - DNA, 21 bp, Homo sapiens
tcgttaagcagtacatcttgt

SEQ ID NO: 4759468 - DNA, 15 bp, Homo sapiens
tctaaaaagtcagat

SEQ ID NO: 4759469 - DNA, 19 bp, Homo sapiens
tctaaaacactattctcca

SEQ ID NO: 4759470 - DNA, 17 bp, Homo sapiens
tctaaaactactgcctt

SEQ ID NO: 4759471 - DNA, 19 bp, Homo sapiens
tctaaaatgctgttctcaa

SEQ ID NO: 4759472 - DNA, 22 bp, Homo sapiens
tctaaaattgagttcttcctgt

SEQ ID NO: 4759473 - DNA, 16 bp, Homo sapiens
tctaaaccatgaaaag

SEQ ID NO: 4759474 - DNA, 20 bp, Homo sapiens
tctaaagcagagatgtatta

SEQ ID NO: 4759475 - DNA, 13 bp, Homo sapiens
tctaaagctgcca

SEQ ID NO: 4759476 - DNA, 17 bp, Homo sapiens
tctaaagctgccagccg

SEQ ID NO: 4759477 - DNA, 22 bp, Homo sapiens
tctaaaggtttcactgttcatg

SEQ ID NO: 4759478 - DNA, 13 bp, Homo sapiens
tctaaatcataat

SEQ ID NO: 4759479 - DNA, 16 bp, Homo sapiens
tctaaatcataatcat

SEQ ID NO: 4759480 - DNA, 14 bp, Homo sapiens
tctaacctttctaa

SEQ ID NO: 4759481 - DNA, 23 bp, Homo sapiens
tctaagaaatggctttccacatc

SEQ ID NO: 4759482 - DNA, 15 bp, Homo sapiens
tctaaggcaggatgt

SEQ ID NO: 4759483 - DNA, 17 bp, Homo sapiens
tctaagggatccagaga

SEQ ID NO: 4759484 - DNA, 21 bp, Homo sapiens
tctaagggatccagagacctg

SEQ ID NO: 4759485 - DNA, 21 bp, Homo sapiens
tctaatggattataatcagaa

SEQ ID NO: 4759486 - DNA, 19 bp, Homo sapiens
tctaattgtacccttcttg

SEQ ID NO: 4759487 - DNA, 20 bp, Homo sapiens
tctacaaaaaaaatcaaaaa

SEQ ID NO: 4759488 - DNA, 21 bp, Homo sapiens
tctacaaacttttataaatgt

SEQ ID NO: 4759489 - DNA, 22 bp, Homo sapiens
tctacaaacttttataaatgtt

SEQ ID NO: 4759490 - DNA, 16 bp, Homo sapiens
tctacaatacaacaca

SEQ ID NO: 4759491 - DNA, 23 bp, Homo sapiens
tctacacagtgggaactctgaca

SEQ ID NO: 4759492 - DNA, 19 bp, Homo sapiens
tctacacatataaacacag

SEQ ID NO: 4759493 - DNA, 11 bp, Homo sapiens
tctacaggcat

SEQ ID NO: 4759494 - DNA, 20 bp, Homo sapiens
tctactagcaccatcaccct

SEQ ID NO: 4759495 - DNA, 20 bp, Homo sapiens
tctactcgagttacagacaa

SEQ ID NO: 4759496 - DNA, 16 bp, Homo sapiens
tctactttaaattgtg

SEQ ID NO: 4759497 - DNA, 20 bp, Homo sapiens
tctagaagagtctattgtct

SEQ ID NO: 4759498 - DNA, 13 bp, Homo sapiens
tctagaaggggcg

SEQ ID NO: 4759499 - DNA, 14 bp, Homo sapiens
tctagaatactaat

SEQ ID NO: 4759500 - DNA, 20 bp, Homo sapiens
tctagagctatgcacaccaa

SEQ ID NO: 4759501 - DNA, 15 bp, Homo sapiens
tctagatatgagaaa

SEQ ID NO: 4759502 - DNA, 17 bp, Homo sapiens
tctagatatgagaaata

SEQ ID NO: 4759503 - DNA, 21 bp, Homo sapiens
tctagcaactgttggataata

SEQ ID NO: 4759504 - DNA, 18 bp, Homo sapiens
tctagcatggctgccaat

SEQ ID NO: 4759505 - DNA, 14 bp, Homo sapiens
tctagccaggcctc

SEQ ID NO: 4759506 - DNA, 15 bp, Homo sapiens
tctagccaggcctcc

SEQ ID NO: 4759507 - DNA, 21 bp, Homo sapiens
tctaggcagttcaaagcagga

SEQ ID NO: 4759508 - DNA, 16 bp, Homo sapiens
tctaggggcaggtgaa

SEQ ID NO: 4759509 - DNA, 18 bp, Homo sapiens
tctagggttgctggagcc

SEQ ID NO: 4759510 - DNA, 22 bp, Homo sapiens
tctagggttgctggagcctgag

SEQ ID NO: 4759511 - DNA, 17 bp, Homo sapiens
tctagtaacagtatttc

SEQ ID NO: 4759512 - DNA, 23 bp, Homo sapiens
tctagtgctaaacctatctgtat

SEQ ID NO: 4759513 - DNA, 18 bp, Homo sapiens
tctagttagcaggaaata

SEQ ID NO: 4759514 - DNA, 21 bp, Homo sapiens
tctataggacttaatttagca

SEQ ID NO: 4759515 - DNA, 15 bp, Homo sapiens
tctatatttactgtt

SEQ ID NO: 4759516 - DNA, 18 bp, Homo sapiens
tctatatttactgtttat

SEQ ID NO: 4759517 - DNA, 15 bp, Homo sapiens
tctatctgggcctgg

SEQ ID NO: 4759518 - DNA, 15 bp, Homo sapiens
tctatgattaaactg

SEQ ID NO: 4759519 - DNA, 14 bp, Homo sapiens
tctatggattcact

SEQ ID NO: 4759520 - DNA, 21 bp, Homo sapiens
tctatggcatattgataataa

SEQ ID NO: 4759521 - DNA, 23 bp, Homo sapiens
tctatgggagattaaaaccagag

SEQ ID NO: 4759522 - DNA, 19 bp, Homo sapiens
tctatggggagaggaactc

SEQ ID NO: 4759523 - DNA, 13 bp, Homo sapiens
tctatgtgtatat

SEQ ID NO: 4759524 - DNA, 13 bp, Homo sapiens
tgttaatatcact

SEQ ID NO: 4759525 - DNA, 17 bp, Homo sapiens
tgttaatatcactcatt

SEQ ID NO: 4759526 - DNA, 19 bp, Homo sapiens
tgttaatatcactcattaa

SEQ ID NO: 4759527 - DNA, 19 bp, Homo sapiens
tgttaatcttaatgtatat

SEQ ID NO: 4759528 - DNA, 22 bp, Homo sapiens
tgttaatcttaatgtatatcgt

SEQ ID NO: 4759529 - DNA, 16 bp, Homo sapiens
tgttaatgattcttgt

SEQ ID NO: 4759530 - DNA, 18 bp, Homo sapiens
tgttacaggtgtactatg

SEQ ID NO: 4759531 - DNA, 15 bp, Homo sapiens
tgttacttaaatagc

SEQ ID NO: 4759532 - DNA, 17 bp, Homo sapiens
tgttagaaaaaactgga

SEQ ID NO: 4759533 - DNA, 14 bp, Homo sapiens
tgttagctgggaag

SEQ ID NO: 4759534 - DNA, 17 bp, Homo sapiens
tgttatacacagttcca

SEQ ID NO: 4759535 - DNA, 20 bp, Homo sapiens
tgttatctgtctttatgatt

SEQ ID NO: 4759536 - DNA, 23 bp, Homo sapiens
tgttatctgtctttatgatttca

SEQ ID NO: 4759537 - DNA, 13 bp, Homo sapiens
tgttatgactcca

SEQ ID NO: 4759538 - DNA, 13 bp, Homo sapiens
tgttattaaatgt

SEQ ID NO: 4759539 - DNA, 22 bp, Homo sapiens
tgttcaaagaacccccctcccc

SEQ ID NO: 4759540 - DNA, 21 bp, Homo sapiens
tgttcaaaggagcaagaactt

SEQ ID NO: 4759541 - DNA, 19 bp, Homo sapiens
tgttcaaattctgattatt

SEQ ID NO: 4759542 - DNA, 12 bp, Homo sapiens
tgttcacacaca

SEQ ID NO: 4759543 - DNA, 17 bp, Homo sapiens
tgttcaccttctgtgca

SEQ ID NO: 4759544 - DNA, 18 bp, Homo sapiens
tgttcactgaataaataa

SEQ ID NO: 4759545 - DNA, 22 bp, Homo sapiens
tgttcatataggggcaaaaatt

SEQ ID NO: 4759546 - DNA, 14 bp, Homo sapiens
tgttccaagtgtgt

SEQ ID NO: 4759547 - DNA, 21 bp, Homo sapiens
tgttccaagtgtgtgtgcaat

SEQ ID NO: 4759548 - DNA, 18 bp, Homo sapiens
tgttcccagaaccttgat

SEQ ID NO: 4759549 - DNA, 21 bp, Homo sapiens
tgttccctgctgggtgggaat

SEQ ID NO: 4759550 - DNA, 21 bp, Homo sapiens
tgttccgttcatctgaggagt

SEQ ID NO: 4759551 - DNA, 24 bp, Homo sapiens
tgttccgttcatctgaggagtcca

SEQ ID NO: 4759552 - DNA, 14 bp, Homo sapiens
tgttcctgactgtt

SEQ ID NO: 4759553 - DNA, 18 bp, Homo sapiens
tgttcctgactgttctct

SEQ ID NO: 4759554 - DNA, 20 bp, Homo sapiens
tgttctaactagtaatcttg

SEQ ID NO: 4759555 - DNA, 19 bp, Homo sapiens
tgttctatggaccaaatgt

SEQ ID NO: 4759556 - DNA, 19 bp, Homo sapiens
tgttctcaacacacagtat

SEQ ID NO: 4759557 - DNA, 14 bp, Homo sapiens
tgttctcaatcatt

SEQ ID NO: 4759558 - DNA, 22 bp, Homo sapiens
tgttctcaatcattgtcagaga

SEQ ID NO: 4759559 - DNA, 22 bp, Homo sapiens
tgttctccgggtgtggcctcag

SEQ ID NO: 4759560 - DNA, 11 bp, Homo sapiens
tgttctcctcc

SEQ ID NO: 4759561 - DNA, 16 bp, Homo sapiens
tgttctcctccaaatg

SEQ ID NO: 4759562 - DNA, 20 bp, Homo sapiens
tgttctgtgtcacgtgaccc

SEQ ID NO: 4759563 - DNA, 23 bp, Homo sapiens
tgttcttcaatgtgaaactgaga

SEQ ID NO: 4759564 - DNA, 21 bp, Homo sapiens
tgttcttgggggtggggctgc

SEQ ID NO: 4759565 - DNA, 17 bp, Homo sapiens
tgttctttcatactaca

SEQ ID NO: 4759566 - DNA, 19 bp, Homo sapiens
tgttctttttaaaaagttg

SEQ ID NO: 4759567 - DNA, 21 bp, Homo sapiens
tgttctttttgactgattgtt

SEQ ID NO: 4759568 - DNA, 16 bp, Homo sapiens
tgttgaaggactacag

SEQ ID NO: 4759569 - DNA, 18 bp, Homo sapiens
tgttgaagtgcatgttaa

SEQ ID NO: 4759570 - DNA, 21 bp, Homo sapiens
tgttgaagtgcatgttaaaat

SEQ ID NO: 4759571 - DNA, 22 bp, Homo sapiens
tgttgaagtgcatgttaaaata

SEQ ID NO: 4759572 - DNA, 21 bp, Homo sapiens
tgttgagctggtaacatcgtt

SEQ ID NO: 4759573 - DNA, 12 bp, Homo sapiens
tgttgaggaggg

SEQ ID NO: 4759574 - DNA, 21 bp, Homo sapiens
tgttgctacatcagagtgtat

SEQ ID NO: 4759575 - DNA, 19 bp, Homo sapiens
tgttgcttaatctagagct

SEQ ID NO: 4759576 - DNA, 20 bp, Homo sapiens
tgttgcttaatctagagcta

SEQ ID NO: 4759577 - DNA, 13 bp, Homo sapiens
tgttgggccagga

SEQ ID NO: 4759578 - DNA, 15 bp, Homo sapiens
tgttggtatttactg

SEQ ID NO: 4759579 - DNA, 21 bp, Homo sapiens
tgttggtatttactgcaatgt

SEQ ID NO: 4759580 - DNA, 21 bp, Homo sapiens
tgttgtacaattactgtgaga

SEQ ID NO: 4759581 - DNA, 12 bp, Homo sapiens
tgttgtccctgc

SEQ ID NO: 4759582 - DNA, 13 bp, Homo sapiens
tgttgtccctgca

SEQ ID NO: 4759583 - DNA, 15 bp, Homo sapiens
tgttgtccctgcagg

SEQ ID NO: 4759584 - DNA, 13 bp, Homo sapiens
tgttgtcttattc

SEQ ID NO: 4759585 - DNA, 23 bp, Homo sapiens
tgttgttcaaatgcattttgggg

SEQ ID NO: 4759586 - DNA, 23 bp, Homo sapiens
tgttgttcgatcgtttcacatct

SEQ ID NO: 4759587 - DNA, 20 bp, Homo sapiens
tgtttaaaatggcatttagc

SEQ ID NO: 4759588 - DNA, 19 bp, Homo sapiens
tgtttaagaaatgagaaat

SEQ ID NO: 4759589 - DNA, 16 bp, Homo sapiens
tgtttaaggttcttgc

SEQ ID NO: 4759590 - DNA, 21 bp, Homo sapiens
tgtttaagtgaattgacttat

SEQ ID NO: 4759591 - DNA, 13 bp, Homo sapiens
tgtttaatgcaaa

SEQ ID NO: 4759592 - DNA, 16 bp, Homo sapiens
tgtttacacacgtgca

SEQ ID NO: 4759593 - DNA, 13 bp, Homo sapiens
tgtttaccctccc

SEQ ID NO: 4759594 - DNA, 15 bp, Homo sapiens
tgtttaccctccctg

SEQ ID NO: 4759595 - DNA, 19 bp, Homo sapiens
tgtttaccctccctgtccc

SEQ ID NO: 4759596 - DNA, 22 bp, Homo sapiens
tgtttaccctccctgtcccctg

SEQ ID NO: 4759597 - DNA, 15 bp, Homo sapiens
tgtttaggaaccgct

SEQ ID NO: 4759598 - DNA, 14 bp, Homo sapiens
tgtttagtaataca

SEQ ID NO: 4759599 - DNA, 12 bp, Homo sapiens
tgtttagtagct

SEQ ID NO: 4759600 - DNA, 16 bp, Homo sapiens
tgtttagtagctgata

SEQ ID NO: 4759601 - DNA, 22 bp, Homo sapiens
tgtttagtagctgataaagaaa

SEQ ID NO: 4759602 - DNA, 22 bp, Homo sapiens
tgtttagtcagtgtactctgag

SEQ ID NO: 4759603 - DNA, 16 bp, Homo sapiens
tgtttagttcagcaaa

SEQ ID NO: 4759604 - DNA, 22 bp, Homo sapiens
tgtttataggaaataaatctaa

SEQ ID NO: 4759605 - DNA, 22 bp, Homo sapiens
tgtttatattgtttttatatat

SEQ ID NO: 4759606 - DNA, 14 bp, Homo sapiens
tgtttcatgttctg

SEQ ID NO: 4759607 - DNA, 19 bp, Homo sapiens
tgtttcatgttctgtgtca

SEQ ID NO: 4759608 - DNA, 20 bp, Homo sapiens
tgtttcccgctccaagagaa

SEQ ID NO: 4759609 - DNA, 16 bp, Homo sapiens
tgtttcgttaagcagt

SEQ ID NO: 4759610 - DNA, 19 bp, Homo sapiens
tgtttctgcagtattctgt

SEQ ID NO: 4759611 - DNA, 20 bp, Homo sapiens
tgtttctgtcctgtaactgt

SEQ ID NO: 4759612 - DNA, 22 bp, Homo sapiens
tgtttctgtcctgtaactgtta

SEQ ID NO: 4759613 - DNA, 18 bp, Homo sapiens
tgtttgcctttaggcagg

SEQ ID NO: 4759614 - DNA, 21 bp, Homo sapiens
tgtttgcctttaggcaggaag

SEQ ID NO: 4759615 - DNA, 15 bp, Homo sapiens
tgtttgctgcttttg

SEQ ID NO: 4759616 - DNA, 14 bp, Homo sapiens
tgtttgtaaaagag

SEQ ID NO: 4759617 - DNA, 19 bp, Homo sapiens
tgtttgtaaaagagctgtt

SEQ ID NO: 4759618 - DNA, 17 bp, Homo sapiens
tgttttacaaagaaaca

SEQ ID NO: 4759619 - DNA, 17 bp, Homo sapiens
tgttttacaatggctgg

SEQ ID NO: 4759620 - DNA, 12 bp, Homo sapiens
tgttttataaat

SEQ ID NO: 4759621 - DNA, 19 bp, Homo sapiens
tgttttatgactaatcctt

SEQ ID NO: 4759622 - DNA, 15 bp, Homo sapiens
tgttttcaagttgca

SEQ ID NO: 4759623 - DNA, 20 bp, Homo sapiens
tgttttcatgtaaataaata

SEQ ID NO: 4759624 - DNA, 21 bp, Homo sapiens
tgttttccccaattatcctcc

SEQ ID NO: 4759625 - DNA, 14 bp, Homo sapiens
tgttttccttcaca

SEQ ID NO: 4759626 - DNA, 15 bp, Homo sapiens
tgttttgatctctgt

SEQ ID NO: 4759627 - DNA, 15 bp, Homo sapiens
tgttttgctaatgct

SEQ ID NO: 4759628 - DNA, 15 bp, Homo sapiens
tgttttggatgaatg

SEQ ID NO: 4759629 - DNA, 12 bp, Homo sapiens
tgttttgggttt

SEQ ID NO: 4759630 - DNA, 22 bp, Homo sapiens
tgttttgtgcggtgtgtctcca

SEQ ID NO: 4759631 - DNA, 17 bp, Homo sapiens
tgtttttggatggctta

SEQ ID NO: 4759632 - DNA, 16 bp, Homo sapiens
tgttttttctttataa

SEQ ID NO: 4759633 - DNA, 18 bp, Homo sapiens
ttaaaaaaaatattctgt

SEQ ID NO: 4759634 - DNA, 19 bp, Homo sapiens
ttaaaaaaaatattctgtc

SEQ ID NO: 4759635 - DNA, 15 bp, Homo sapiens
ttaaaaaaataatat

SEQ ID NO: 4759636 - DNA, 21 bp, Homo sapiens
ttaaaaaaataatataaatga

SEQ ID NO: 4759637 - DNA, 20 bp, Homo sapiens
ttacagtggcagtattgaca

SEQ ID NO: 4759638 - DNA, 12 bp, Homo sapiens
ttacataacagg

SEQ ID NO: 4759639 - DNA, 17 bp, Homo sapiens
ttacataacaggcattg

SEQ ID NO: 4759640 - DNA, 22 bp, Homo sapiens
ttacataacaggcattgcacta

SEQ ID NO: 4759641 - DNA, 22 bp, Homo sapiens
ttacatagctttagagaagcca

SEQ ID NO: 4759642 - DNA, 12 bp, Homo sapiens
ttacatgcatga

SEQ ID NO: 4759643 - DNA, 13 bp, Homo sapiens
ttacatgcatgag

SEQ ID NO: 4759644 - DNA, 22 bp, Homo sapiens
ttaccaaagaagagtttacaga

SEQ ID NO: 4759645 - DNA, 15 bp, Homo sapiens
ttaccacttagaaga

SEQ ID NO: 4759646 - DNA, 16 bp, Homo sapiens
ttaccctccacacact

SEQ ID NO: 4759647 - DNA, 13 bp, Homo sapiens
ttaccctccctgt

SEQ ID NO: 4759648 - DNA, 15 bp, Homo sapiens
ttaccctccctgtcc

SEQ ID NO: 4759649 - DNA, 16 bp, Homo sapiens
ttaccctttcttttga

SEQ ID NO: 4759650 - DNA, 13 bp, Homo sapiens
ttaccgaaatgaa

SEQ ID NO: 4759651 - DNA, 22 bp, Homo sapiens
tgcttaacataaacttgtactt

SEQ ID NO: 4759652 - DNA, 13 bp, Homo sapiens
tgcttaaggaaaa

SEQ ID NO: 4759653 - DNA, 19 bp, Homo sapiens
tgcttaaggaaaagagaaa

SEQ ID NO: 4759654 - DNA, 20 bp, Homo sapiens
tgcttatttatattcagaga

SEQ ID NO: 4759655 - DNA, 14 bp, Homo sapiens
tgcttcacacaaag

SEQ ID NO: 4759656 - DNA, 16 bp, Homo sapiens
tgcttcacacaaagtg

SEQ ID NO: 4759657 - DNA, 18 bp, Homo sapiens
tgcttcacacaaagtgaa

SEQ ID NO: 4759658 - DNA, 21 bp, Homo sapiens
tgcttcacacaaagtgaaatt

SEQ ID NO: 4759659 - DNA, 15 bp, Homo sapiens
tgcttcatctggagt

SEQ ID NO: 4759660 - DNA, 15 bp, Homo sapiens
tgcttcattaaaaca

SEQ ID NO: 4759661 - DNA, 23 bp, Homo sapiens
tgcttcattaaaacaagagacca

SEQ ID NO: 4759662 - DNA, 21 bp, Homo sapiens
tgcttcccacctccctgccca

SEQ ID NO: 4759663 - DNA, 19 bp, Homo sapiens
tgcttcccatctgaagagt

SEQ ID NO: 4759664 - DNA, 19 bp, Homo sapiens
tgcttctcccgccattggc

SEQ ID NO: 4759665 - DNA, 15 bp, Homo sapiens
tgcttctccctgggg

SEQ ID NO: 4759666 - DNA, 15 bp, Homo sapiens
tgcttctctttcaca

SEQ ID NO: 4759667 - DNA, 17 bp, Homo sapiens
tgcttctgctgccctga

SEQ ID NO: 4759668 - DNA, 18 bp, Homo sapiens
tgcttgaccctgaaatat

SEQ ID NO: 4759669 - DNA, 18 bp, Homo sapiens
tgcttgaggccaaatgag

SEQ ID NO: 4759670 - DNA, 16 bp, Homo sapiens
tgcttgagtggacagc

SEQ ID NO: 4759671 - DNA, 19 bp, Homo sapiens
tgcttgagtggacagcagc

SEQ ID NO: 4759672 - DNA, 20 bp, Homo sapiens
tgcttgagtggacagcagct

SEQ ID NO: 4759673 - DNA, 21 bp, Homo sapiens
tgcttgagtggacagcagctg

SEQ ID NO: 4759674 - DNA, 17 bp, Homo sapiens
tgcttgatttgaccact

SEQ ID NO: 4759675 - DNA, 12 bp, Homo sapiens
tgcttgggcttc

SEQ ID NO: 4759676 - DNA, 19 bp, Homo sapiens
tgcttgggcttcatcctcc

SEQ ID NO: 4759677 - DNA, 15 bp, Homo sapiens
tgctttatccacatt

SEQ ID NO: 4759678 - DNA, 12 bp, Homo sapiens
tgctttcatcca

SEQ ID NO: 4759679 - DNA, 18 bp, Homo sapiens
tgctttcatgtttaagaa

SEQ ID NO: 4759680 - DNA, 12 bp, Homo sapiens
tgctttctcatg

SEQ ID NO: 4759681 - DNA, 17 bp, Homo sapiens
tgctttgcccacatgcc

SEQ ID NO: 4759682 - DNA, 14 bp, Homo sapiens
tgcttttcatcctt

SEQ ID NO: 4759683 - DNA, 15 bp, Homo sapiens
tgcttttctcatggt

SEQ ID NO: 4759684 - DNA, 16 bp, Homo sapiens
tgcttttgatggctat

SEQ ID NO: 4759685 - DNA, 16 bp, Homo sapiens
tgctttttccttagct

SEQ ID NO: 4759686 - DNA, 17 bp, Homo sapiens
tggaaaaaaaaaaatat

SEQ ID NO: 4759687 - DNA, 13 bp, Homo sapiens
tggaaaactgtta

SEQ ID NO: 4759688 - DNA, 14 bp, Homo sapiens
tggaaaataataaa

SEQ ID NO: 4759689 - DNA, 15 bp, Homo sapiens
tggaaaataataaaa

SEQ ID NO: 4759690 - DNA, 16 bp, Homo sapiens
tggaaaataataaaag

SEQ ID NO: 4759691 - DNA, 13 bp, Homo sapiens
tggaaacatctga

SEQ ID NO: 4759692 - DNA, 15 bp, Homo sapiens
tggaaacatctgatt

SEQ ID NO: 4759693 - DNA, 20 bp, Homo sapiens
tggaaacatctgatttctga

SEQ ID NO: 4759694 - DNA, 22 bp, Homo sapiens
tggaaagacgtttttgtgctgt

SEQ ID NO: 4759695 - DNA, 21 bp, Homo sapiens
tggaaagagctgttttggatg

SEQ ID NO: 4759696 - DNA, 12 bp, Homo sapiens
tggaaagccagg

SEQ ID NO: 4759697 - DNA, 13 bp, Homo sapiens
tggaaagggtgtg

SEQ ID NO: 4759698 - DNA, 16 bp, Homo sapiens
tggaaagggtgtggct

SEQ ID NO: 4759699 - DNA, 18 bp, Homo sapiens
tggaaagggtgtggcttg

SEQ ID NO: 4759700 - DNA, 22 bp, Homo sapiens
tggaaagggtgtggcttggaac

SEQ ID NO: 4759701 - DNA, 14 bp, Homo sapiens
tggaaaggtcctgc

SEQ ID NO: 4759702 - DNA, 16 bp, Homo sapiens
tggaaaggtcctgctg

SEQ ID NO: 4759703 - DNA, 14 bp, Homo sapiens
tggaaccttccctc

SEQ ID NO: 4759704 - DNA, 17 bp, Homo sapiens
tggaacgttctctacct

SEQ ID NO: 4759705 - DNA, 23 bp, Homo sapiens
tggaactcagctgtctgtggctt

SEQ ID NO: 4759706 - DNA, 15 bp, Homo sapiens
tggaactctatctgg

SEQ ID NO: 4759707 - DNA, 20 bp, Homo sapiens
tggaactctatctgggcctg

SEQ ID NO: 4759708 - DNA, 23 bp, Homo sapiens
tggaactctatctgggcctgggc

SEQ ID NO: 4759709 - DNA, 16 bp, Homo sapiens
tggaagaaagggagaa

SEQ ID NO: 4759710 - DNA, 16 bp, Homo sapiens
tggaagaattcatgat

SEQ ID NO: 4759711 - DNA, 17 bp, Homo sapiens
tggaagaattcatgatg

SEQ ID NO: 4759712 - DNA, 22 bp, Homo sapiens
tggaagacagagatggcagagc

SEQ ID NO: 4759713 - DNA, 12 bp, Homo sapiens
tggaagacagct

SEQ ID NO: 4759714 - DNA, 14 bp, Homo sapiens
tggaagacagctct

SEQ ID NO: 4759715 - DNA, 16 bp, Homo sapiens
tggaagacagctctta

SEQ ID NO: 4759716 - DNA, 16 bp, Homo sapiens
tggaagagagaaagca

SEQ ID NO: 4759717 - DNA, 17 bp, Homo sapiens
tggaagagggaggggcc

SEQ ID NO: 4759718 - DNA, 13 bp, Homo sapiens
tggaaggaaaaca

SEQ ID NO: 4759719 - DNA, 23 bp, Homo sapiens
tggaaggcacccgccctttcctt

SEQ ID NO: 4759720 - DNA, 20 bp, Homo sapiens
tggaagggcaggagctcaca

SEQ ID NO: 4759721 - DNA, 20 bp, Homo sapiens
tggaagttgtcctttctgat

SEQ ID NO: 4759722 - DNA, 21 bp, Homo sapiens
tggaagttttacttgattaag

SEQ ID NO: 4759723 - DNA, 18 bp, Homo sapiens
tggaattacataacaggc

SEQ ID NO: 4759724 - DNA, 19 bp, Homo sapiens
tggaattacataacaggca

SEQ ID NO: 4759725 - DNA, 20 bp, Homo sapiens
tggaattacataacaggcat

SEQ ID NO: 4759726 - DNA, 14 bp, Homo sapiens
tggacagacacaga

SEQ ID NO: 4759727 - DNA, 22 bp, Homo sapiens
tggacagatgggtgtcccctgg

SEQ ID NO: 4759728 - DNA, 15 bp, Homo sapiens
tggacagcaaaacca

SEQ ID NO: 4759729 - DNA, 20 bp, Homo sapiens
tggacagcaaaaccattgct

SEQ ID NO: 4759730 - DNA, 21 bp, Homo sapiens
tggacagcaaaaccattgctt

SEQ ID NO: 4759731 - DNA, 21 bp, Homo sapiens
tggacagtgagagcagggctg

SEQ ID NO: 4759732 - DNA, 16 bp, Homo sapiens
tggacagtgcctaact

SEQ ID NO: 4759733 - DNA, 18 bp, Homo sapiens
tggacagttcacaccctg

SEQ ID NO: 4759734 - DNA, 21 bp, Homo sapiens
tggacagttcacaccctgcaa

SEQ ID NO: 4759735 - DNA, 18 bp, Homo sapiens
tggacatgagagtagggc

SEQ ID NO: 4759736 - DNA, 22 bp, Homo sapiens
tggacatgagagtagggccctg

SEQ ID NO: 4759737 - DNA, 13 bp, Homo sapiens
tggacatgcacag

SEQ ID NO: 4759738 - DNA, 13 bp, Homo sapiens
tggaccaaatgta

SEQ ID NO: 4759739 - DNA, 14 bp, Homo sapiens
tggaccaaatgtaa

SEQ ID NO: 4759740 - DNA, 17 bp, Homo sapiens
tggaccaaatgtaaaat

SEQ ID NO: 4759741 - DNA, 16 bp, Homo sapiens
tggaccaactgctttg

SEQ ID NO: 4759742 - DNA, 13 bp, Homo sapiens
tggaccccagaga

SEQ ID NO: 4759743 - DNA, 13 bp, Homo sapiens
tggacctgaccag

SEQ ID NO: 4759744 - DNA, 17 bp, Homo sapiens
tggacctgaccagactg

SEQ ID NO: 4759745 - DNA, 21 bp, Homo sapiens
tggacgagtgagctaccagga

SEQ ID NO: 4759746 - DNA, 17 bp, Homo sapiens
tggactacctataaatg

SEQ ID NO: 4759747 - DNA, 18 bp, Homo sapiens
tggactgatggttgcttt

SEQ ID NO: 4759748 - DNA, 19 bp, Homo sapiens
tggactgatggttgctttg

SEQ ID NO: 4759749 - DNA, 15 bp, Homo sapiens
tggactgcgctggac

SEQ ID NO: 4759750 - DNA, 16 bp, Homo sapiens
tggactgcgctggacg

SEQ ID NO: 4759751 - DNA, 14 bp, Homo sapiens
tggagaaaatggac

SEQ ID NO: 4759752 - DNA, 12 bp, Homo sapiens
tggagaaggaag

SEQ ID NO: 4759753 - DNA, 13 bp, Homo sapiens
tggagaagtgtgt

SEQ ID NO: 4759754 - DNA, 16 bp, Homo sapiens
tggagaagtgtgttct

SEQ ID NO: 4759755 - DNA, 18 bp, Homo sapiens
tggagaccctgcgcccct

SEQ ID NO: 4759756 - DNA, 20 bp, Homo sapiens
tggagaggaggtgtggagtg

SEQ ID NO: 4759757 - DNA, 13 bp, Homo sapiens
tggagaggcggcc

SEQ ID NO: 4759758 - DNA, 15 bp, Homo sapiens
tggagatgtaggaac

SEQ ID NO: 4759759 - DNA, 14 bp, Homo sapiens
ttcgtcttccctgc

SEQ ID NO: 4759760 - DNA, 14 bp, Homo sapiens
ttcgtgcatttgtg

SEQ ID NO: 4759761 - DNA, 15 bp, Homo sapiens
ttcgtgcatttgtga

SEQ ID NO: 4759762 - DNA, 21 bp, Homo sapiens
ttcgtgtttttggttttctcc

SEQ ID NO: 4759763 - DNA, 23 bp, Homo sapiens
ttcgtgtttttggttttctcctt

SEQ ID NO: 4759764 - DNA, 13 bp, Homo sapiens
ttcgttaagcagt

SEQ ID NO: 4759765 - DNA, 14 bp, Homo sapiens
ttcgttaagcagta

SEQ ID NO: 4759766 - DNA, 20 bp, Homo sapiens
ttcgttagtaatctgtataa

SEQ ID NO: 4759767 - DNA, 22 bp, Homo sapiens
ttctaaaacccttggtctgtgt

SEQ ID NO: 4759768 - DNA, 18 bp, Homo sapiens
ttctaaaactactgcctt

SEQ ID NO: 4759769 - DNA, 16 bp, Homo sapiens
ttctaaaataaatgtt

SEQ ID NO: 4759770 - DNA, 15 bp, Homo sapiens
ttctaaaccatgaaa

SEQ ID NO: 4759771 - DNA, 19 bp, Homo sapiens
ttctaaaccatgaaaagtt

SEQ ID NO: 4759772 - DNA, 14 bp, Homo sapiens
ttctaacttcataa

SEQ ID NO: 4759773 - DNA, 18 bp, Homo sapiens
ttctaagaaatatctgtg

SEQ ID NO: 4759774 - DNA, 17 bp, Homo sapiens
ttctaagattgtacata

SEQ ID NO: 4759775 - DNA, 22 bp, Homo sapiens
ttctaagggatccagagacctg

SEQ ID NO: 4759776 - DNA, 15 bp, Homo sapiens
ttctaagtgagatgt

SEQ ID NO: 4759777 - DNA, 19 bp, Homo sapiens
ttctaagtgagatgtttgg

SEQ ID NO: 4759778 - DNA, 16 bp, Homo sapiens
ttctaattagattaac

SEQ ID NO: 4759779 - DNA, 22 bp, Homo sapiens
ttctacacagtgggaactctga

SEQ ID NO: 4759780 - DNA, 17 bp, Homo sapiens
ttctacagaaaaacaat

SEQ ID NO: 4759781 - DNA, 21 bp, Homo sapiens
ttctagaaggggcgaggcttt

SEQ ID NO: 4759782 - DNA, 19 bp, Homo sapiens
ttctagaatactaataaaa

SEQ ID NO: 4759783 - DNA, 14 bp, Homo sapiens
ttctagcaattgct

SEQ ID NO: 4759784 - DNA, 16 bp, Homo sapiens
ttctagccctctccct

SEQ ID NO: 4759785 - DNA, 17 bp, Homo sapiens
ttctagccctctccctc

SEQ ID NO: 4759786 - DNA, 17 bp, Homo sapiens
ttctaggggcaggtgaa

SEQ ID NO: 4759787 - DNA, 15 bp, Homo sapiens
ttctagtaacagtat

SEQ ID NO: 4759788 - DNA, 21 bp, Homo sapiens
ttctagtgggtttaatgttta

SEQ ID NO: 4759789 - DNA, 15 bp, Homo sapiens
ttctagtgtagaatt

SEQ ID NO: 4759790 - DNA, 19 bp, Homo sapiens
ttctagttagcaggaaata

SEQ ID NO: 4759791 - DNA, 13 bp, Homo sapiens
ttctatatttact

SEQ ID NO: 4759792 - DNA, 15 bp, Homo sapiens
ttctatatttactgt

SEQ ID NO: 4759793 - DNA, 22 bp, Homo sapiens
ttctatgagacctcccccaggg

SEQ ID NO: 4759794 - DNA, 15 bp, Homo sapiens
ttctatggaccaaat

SEQ ID NO: 4759795 - DNA, 19 bp, Homo sapiens
ttctatggaccaaatgtaa

SEQ ID NO: 4759796 - DNA, 23 bp, Homo sapiens
ttctatggaccaaatgtaaaata

SEQ ID NO: 4759797 - DNA, 18 bp, Homo sapiens
ttctatggattcacttct

SEQ ID NO: 4759798 - DNA, 13 bp, Homo sapiens
ttctatggcatat

SEQ ID NO: 4759799 - DNA, 19 bp, Homo sapiens
ttctattggcatggatttc

SEQ ID NO: 4759800 - DNA, 21 bp, Homo sapiens
ttctcacactctaactgtata

SEQ ID NO: 4759801 - DNA, 21 bp, Homo sapiens
ttctcacagcacatgctggcc

SEQ ID NO: 4759802 - DNA, 21 bp, Homo sapiens
ttctcagaacaccaagtaaat

SEQ ID NO: 4759803 - DNA, 21 bp, Homo sapiens
ttctcagctccactctgaagt

SEQ ID NO: 4759804 - DNA, 20 bp, Homo sapiens
ttctcatctgtaaaaccagg

SEQ ID NO: 4759805 - DNA, 14 bp, Homo sapiens
ttctcattcttcta

SEQ ID NO: 4759806 - DNA, 21 bp, Homo sapiens
ttctcatttatgttatttatg

SEQ ID NO: 4759807 - DNA, 17 bp, Homo sapiens
ttctcattttttcctga

SEQ ID NO: 4759808 - DNA, 24 bp, Homo sapiens
ttctccattaaacttctactgagc

SEQ ID NO: 4759809 - DNA, 15 bp, Homo sapiens
ttctccccctcagct

SEQ ID NO: 4759810 - DNA, 20 bp, Homo sapiens
ttctcccgccattggcctta

SEQ ID NO: 4759811 - DNA, 22 bp, Homo sapiens
ttctcctccattcatgtttaat

SEQ ID NO: 4759812 - DNA, 12 bp, Homo sapiens
ttctcctctccc

SEQ ID NO: 4759813 - DNA, 13 bp, Homo sapiens
ttctccttcccaa

SEQ ID NO: 4759814 - DNA, 16 bp, Homo sapiens
ttctccttcccaaggc

SEQ ID NO: 4759815 - DNA, 16 bp, Homo sapiens
ttctcctttgtcaaat

SEQ ID NO: 4759816 - DNA, 12 bp, Homo sapiens
ttctctaaaaca

SEQ ID NO: 4759817 - DNA, 21 bp, Homo sapiens
ttctctaacccctagtgtctt

SEQ ID NO: 4759818 - DNA, 15 bp, Homo sapiens
ttctctcctgtgagc

SEQ ID NO: 4759819 - DNA, 14 bp, Homo sapiens
ttctctctgtgctg

SEQ ID NO: 4759820 - DNA, 16 bp, Homo sapiens
ttctctctgtgtggca

SEQ ID NO: 4759821 - DNA, 16 bp, Homo sapiens
ttctctgatggcactt

SEQ ID NO: 4759822 - DNA, 16 bp, Homo sapiens
ttctcttaagctgccc

SEQ ID NO: 4759823 - DNA, 18 bp, Homo sapiens
ttctcttacgctctctgt

SEQ ID NO: 4759824 - DNA, 14 bp, Homo sapiens
ttctcttcgctgtg

SEQ ID NO: 4759825 - DNA, 19 bp, Homo sapiens
ttctctttcaattctgtga

SEQ ID NO: 4759826 - DNA, 17 bp, Homo sapiens
ttctctttggggctcct

SEQ ID NO: 4759827 - DNA, 21 bp, Homo sapiens
ttctctttgttcttcaatgtg

SEQ ID NO: 4759828 - DNA, 14 bp, Homo sapiens
ttctgaaaactgtt

SEQ ID NO: 4759829 - DNA, 23 bp, Homo sapiens
ttctgaactatcagggcaagctc

SEQ ID NO: 4759830 - DNA, 14 bp, Homo sapiens
ttctgaaggggaaa

SEQ ID NO: 4759831 - DNA, 17 bp, Homo sapiens
ttctgacggccctgcaa

SEQ ID NO: 4759832 - DNA, 21 bp, Homo sapiens
ttctgagcaccgaatattgag

SEQ ID NO: 4759833 - DNA, 16 bp, Homo sapiens
ttctgatcctctcttc

SEQ ID NO: 4759834 - DNA, 17 bp, Homo sapiens
ttctgatgaggcatttt

SEQ ID NO: 4759835 - DNA, 18 bp, Homo sapiens
ttctgcaataacagtttt

SEQ ID NO: 4759836 - DNA, 22 bp, Homo sapiens
ttctgcaataacagttttaaga

SEQ ID NO: 4759837 - DNA, 12 bp, Homo sapiens
ttctgcactgaa

SEQ ID NO: 4759838 - DNA, 14 bp, Homo sapiens
ttctgcactgaaaa

SEQ ID NO: 4759839 - DNA, 15 bp, Homo sapiens
ttctgcactgaaaag

SEQ ID NO: 4759840 - DNA, 13 bp, Homo sapiens
ttctgcagaaaat

SEQ ID NO: 4759841 - DNA, 22 bp, Homo sapiens
ttctgcagcccgatgtccctgt

SEQ ID NO: 4759842 - DNA, 13 bp, Homo sapiens
ttctgcattacta

SEQ ID NO: 4759843 - DNA, 23 bp, Homo sapiens
ttctgcattactattaactctgc

SEQ ID NO: 4759844 - DNA, 16 bp, Homo sapiens
ttctgccatttcatgt

SEQ ID NO: 4759845 - DNA, 13 bp, Homo sapiens
ttctgccgcagcc

SEQ ID NO: 4759846 - DNA, 15 bp, Homo sapiens
ttctgccgcagccct

SEQ ID NO: 4759847 - DNA, 13 bp, Homo sapiens
ttctgctttctga

SEQ ID NO: 4759848 - DNA, 20 bp, Homo sapiens
ttctggactatagctgttct

SEQ ID NO: 4759849 - DNA, 16 bp, Homo sapiens
ttctggaggtggggag

SEQ ID NO: 4759850 - DNA, 18 bp, Homo sapiens
ttctggaggtggggaggg

SEQ ID NO: 4759851 - DNA, 17 bp, Homo sapiens
ttctggcctttcctctc

SEQ ID NO: 4759852 - DNA, 22 bp, Homo sapiens
ttctggggtggggcttggaagg

SEQ ID NO: 4759853 - DNA, 18 bp, Homo sapiens
ttctgggttaacagtaaa

SEQ ID NO: 4759854 - DNA, 19 bp, Homo sapiens
ttctgtaattcttctcctt

SEQ ID NO: 4759855 - DNA, 21 bp, Homo sapiens
ttctgtcctcaggtgaataac

SEQ ID NO: 4759856 - DNA, 17 bp, Homo sapiens
ttctgtgcatctggcct

SEQ ID NO: 4759857 - DNA, 23 bp, Homo sapiens
ttctgtggctgatttactaacag

SEQ ID NO: 4759858 - DNA, 12 bp, Homo sapiens
ttcataggcaga

SEQ ID NO: 4759859 - DNA, 13 bp, Homo sapiens
ttcatcaagtagc

SEQ ID NO: 4759860 - DNA, 16 bp, Homo sapiens
ttcatccaactggaag

SEQ ID NO: 4759861 - DNA, 16 bp, Homo sapiens
ttcatccatagacaca

SEQ ID NO: 4759862 - DNA, 18 bp, Homo sapiens
ttcatccatagacacagt

SEQ ID NO: 4759863 - DNA, 15 bp, Homo sapiens
ttcatcctcacatgt

SEQ ID NO: 4759864 - DNA, 17 bp, Homo sapiens
ttcatcctcacatgtgg

SEQ ID NO: 4759865 - DNA, 12 bp, Homo sapiens
ttcatcctctta

SEQ ID NO: 4759866 - DNA, 17 bp, Homo sapiens
ttcatcttgaattgtaa

SEQ ID NO: 4759867 - DNA, 15 bp, Homo sapiens
ttcatgaccttacat

SEQ ID NO: 4759868 - DNA, 15 bp, Homo sapiens
ttcatgatgctagtt

SEQ ID NO: 4759869 - DNA, 23 bp, Homo sapiens
ttcatgctgcctgccatgtgtga

SEQ ID NO: 4759870 - DNA, 22 bp, Homo sapiens
ttcatgcttgatttgaccactg

SEQ ID NO: 4759871 - DNA, 23 bp, Homo sapiens
ttcatgcttgatttgaccactga

SEQ ID NO: 4759872 - DNA, 13 bp, Homo sapiens
ttcatgcttttct

SEQ ID NO: 4759873 - DNA, 16 bp, Homo sapiens
ttcatgtttaagaaat

SEQ ID NO: 4759874 - DNA, 14 bp, Homo sapiens
ttcatgttttgcta

SEQ ID NO: 4759875 - DNA, 15 bp, Homo sapiens
ttcatgttttgctaa

SEQ ID NO: 4759876 - DNA, 17 bp, Homo sapiens
ttcattaaacaaacaga

SEQ ID NO: 4759877 - DNA, 19 bp, Homo sapiens
ttcattacatcctctgctt

SEQ ID NO: 4759878 - DNA, 16 bp, Homo sapiens
ttcattcatacttaaa

SEQ ID NO: 4759879 - DNA, 17 bp, Homo sapiens
tgaactaactgccatgt

SEQ ID NO: 4759880 - DNA, 18 bp, Homo sapiens
tgaactaactgccatgta

SEQ ID NO: 4759881 - DNA, 17 bp, Homo sapiens
tgaactatttctacaca

SEQ ID NO: 4759882 - DNA, 14 bp, Homo sapiens
tgaactgaagcaga

SEQ ID NO: 4759883 - DNA, 14 bp, Homo sapiens
tgaactgcaacact

SEQ ID NO: 4759884 - DNA, 15 bp, Homo sapiens
tgaactgcaacactg

SEQ ID NO: 4759885 - DNA, 17 bp, Homo sapiens
tgaactgcaacactgga

SEQ ID NO: 4759886 - DNA, 17 bp, Homo sapiens
tgaagaaaatccttcag

SEQ ID NO: 4759887 - DNA, 19 bp, Homo sapiens
tgaagaaaatccttcagca

SEQ ID NO: 4759888 - DNA, 18 bp, Homo sapiens
tgaagaaacacagcatgc

SEQ ID NO: 4759889 - DNA, 22 bp, Homo sapiens
tgaagaaacacagcatgcattt

SEQ ID NO: 4759890 - DNA, 20 bp, Homo sapiens
tgaagaattaatgacaacaa

SEQ ID NO: 4759891 - DNA, 14 bp, Homo sapiens
tgaagacagagcta

SEQ ID NO: 4759892 - DNA, 17 bp, Homo sapiens
tgaagaccctatctccc

SEQ ID NO: 4759893 - DNA, 15 bp, Homo sapiens
tgaagagctagagaa

SEQ ID NO: 4759894 - DNA, 11 bp, Homo sapiens
tgaagatctca

SEQ ID NO: 4759895 - DNA, 17 bp, Homo sapiens
tgaagatctcagataaa

SEQ ID NO: 4759896 - DNA, 19 bp, Homo sapiens
tgaagatgcattttaaatg

SEQ ID NO: 4759897 - DNA, 23 bp, Homo sapiens
tgaagatgcattttaaatgtcta

SEQ ID NO: 4759898 - DNA, 11 bp, Homo sapiens
tgaagatggcc

SEQ ID NO: 4759899 - DNA, 23 bp, Homo sapiens
tgaagcaaacacacagactctgt

SEQ ID NO: 4759900 - DNA, 13 bp, Homo sapiens
tgaagcagagtca

SEQ ID NO: 4759901 - DNA, 14 bp, Homo sapiens
tgaagcccaggagg

SEQ ID NO: 4759902 - DNA, 17 bp, Homo sapiens
tgaagccttttcctgag

SEQ ID NO: 4759903 - DNA, 24 bp, Homo sapiens
tgaagggaggggaagagagaggcc

SEQ ID NO: 4759904 - DNA, 11 bp, Homo sapiens
tgaaggggctg

SEQ ID NO: 4759905 - DNA, 17 bp, Homo sapiens
tgaagtaagttctgaaa

SEQ ID NO: 4759906 - DNA, 18 bp, Homo sapiens
tgaagtcccttcctgtcc

SEQ ID NO: 4759907 - DNA, 20 bp, Homo sapiens
tgaagtcccttcctgtcctg

SEQ ID NO: 4759908 - DNA, 20 bp, Homo sapiens
tgaagtctttgtacagacaa

SEQ ID NO: 4759909 - DNA, 15 bp, Homo sapiens
tgaagtgattgacat

SEQ ID NO: 4759910 - DNA, 16 bp, Homo sapiens
tgaagtgattgacatt

SEQ ID NO: 4759911 - DNA, 13 bp, Homo sapiens
tgaataaaatgtt

SEQ ID NO: 4759912 - DNA, 16 bp, Homo sapiens
tgaataaataagtaaa

SEQ ID NO: 4759913 - DNA, 21 bp, Homo sapiens
tgaatataaatgtactacatt

SEQ ID NO: 4759914 - DNA, 14 bp, Homo sapiens
tgaatataaatgtg

SEQ ID NO: 4759915 - DNA, 17 bp, Homo sapiens
tgaatataaatgtgtgt

SEQ ID NO: 4759916 - DNA, 19 bp, Homo sapiens
tgaatatactcattagaat

SEQ ID NO: 4759917 - DNA, 22 bp, Homo sapiens
tgaatcaatctggcttctgcat

SEQ ID NO: 4759918 - DNA, 17 bp, Homo sapiens
tgaatcagacagtggat

SEQ ID NO: 4759919 - DNA, 16 bp, Homo sapiens
tgaatcagaggcagag

SEQ ID NO: 4759920 - DNA, 23 bp, Homo sapiens
tgaatccatgatcaaaatgcata

SEQ ID NO: 4759921 - DNA, 19 bp, Homo sapiens
ttttgggggtttttaatct

SEQ ID NO: 4759922 - DNA, 22 bp, Homo sapiens
ttttgtaaaattccatggatct

SEQ ID NO: 4759923 - DNA, 13 bp, Homo sapiens
ttttgtaactctt

SEQ ID NO: 4759924 - DNA, 17 bp, Homo sapiens
ttttgtaattcctctag

SEQ ID NO: 4759925 - DNA, 23 bp, Homo sapiens
ttttgtatgaaatatatgtgaaa

SEQ ID NO: 4759926 - DNA, 24 bp, Homo sapiens
ttttgtgaatggttgcaaagtgtt

SEQ ID NO: 4759927 - DNA, 14 bp, Homo sapiens
ttttgttgattaaa

SEQ ID NO: 4759928 - DNA, 19 bp, Homo sapiens
tttttaaaaagttgcacat

SEQ ID NO: 4759929 - DNA, 17 bp, Homo sapiens
tttttaactttaccatg

SEQ ID NO: 4759930 - DNA, 15 bp, Homo sapiens
tttttaagtgttctg

SEQ ID NO: 4759931 - DNA, 16 bp, Homo sapiens
tttttaatttcctgtg

SEQ ID NO: 4759932 - DNA, 19 bp, Homo sapiens
tttttaatttcctgtgagg

SEQ ID NO: 4759933 - DNA, 20 bp, Homo sapiens
tttttacaagttatagtact

SEQ ID NO: 4759934 - DNA, 14 bp, Homo sapiens
tttttagattccta

SEQ ID NO: 4759935 - DNA, 21 bp, Homo sapiens
tttttataaattataatgcat

SEQ ID NO: 4759936 - DNA, 13 bp, Homo sapiens
tttttatatatta

SEQ ID NO: 4759937 - DNA, 13 bp, Homo sapiens
tttttcattgtgt

SEQ ID NO: 4759938 - DNA, 14 bp, Homo sapiens
tttttcattgtgtt

SEQ ID NO: 4759939 - DNA, 15 bp, Homo sapiens
tttttcattttctct

SEQ ID NO: 4759940 - DNA, 12 bp, Homo sapiens
tttttcctacca

SEQ ID NO: 4759941 - DNA, 22 bp, Homo sapiens
tttttcctatgaccataaaatt

SEQ ID NO: 4759942 - DNA, 13 bp, Homo sapiens
tttttgaattgtg

SEQ ID NO: 4759943 - DNA, 16 bp, Homo sapiens
tttttgagtaaaactt

SEQ ID NO: 4759944 - DNA, 14 bp, Homo sapiens
tttttgctctccct

SEQ ID NO: 4759945 - DNA, 15 bp, Homo sapiens
tttttggcattatct

SEQ ID NO: 4759946 - DNA, 16 bp, Homo sapiens
tttttggttgcaattg

SEQ ID NO: 4759947 - DNA, 15 bp, Homo sapiens
tttttgtaactcttt

SEQ ID NO: 4759948 - DNA, 18 bp, Homo sapiens
tttttgtaatataagaca

SEQ ID NO: 4759949 - DNA, 11 bp, Homo sapiens
tttttgtgaat

SEQ ID NO: 4759950 - DNA, 17 bp, Homo sapiens
ttttttaagtgttctgt

SEQ ID NO: 4759951 - DNA, 13 bp, Homo sapiens
ttttttgcaataa

SEQ ID NO: 4759952 - DNA, 12 bp, Homo sapiens
ttttttgtaact

SEQ ID NO: 4759953 - DNA, 17 bp, Homo sapiens
ttcttgcaagctccagt

SEQ ID NO: 4759954 - DNA, 12 bp, Homo sapiens
ttcttgcaataa

SEQ ID NO: 4759955 - DNA, 18 bp, Homo sapiens
ttcttgctctgctcatct

SEQ ID NO: 4759956 - DNA, 21 bp, Homo sapiens
ttcttgttcatgttttgctaa

SEQ ID NO: 4759957 - DNA, 14 bp, Homo sapiens
ttcttgtttaccaa

SEQ ID NO: 4759958 - DNA, 14 bp, Homo sapiens
ttctttaacatatc

SEQ ID NO: 4759959 - DNA, 17 bp, Homo sapiens
ttctttaatttttctgt

SEQ ID NO: 4759960 - DNA, 12 bp, Homo sapiens
ttctttagtctt

SEQ ID NO: 4759961 - DNA, 13 bp, Homo sapiens
ttctttataatgg

SEQ ID NO: 4759962 - DNA, 12 bp, Homo sapiens
ttctttcagcca

SEQ ID NO: 4759963 - DNA, 13 bp, Homo sapiens
ttctttcctctta

SEQ ID NO: 4759964 - DNA, 12 bp, Homo sapiens
ttctttccttcc

SEQ ID NO: 4759965 - DNA, 15 bp, Homo sapiens
ttctttccttccttt

SEQ ID NO: 4759966 - DNA, 21 bp, Homo sapiens
ttctttccttccttttttcct

SEQ ID NO: 4759967 - DNA, 21 bp, Homo sapiens
ttctttgagggactgcctctg

SEQ ID NO: 4759968 - DNA, 15 bp, Homo sapiens
ttctttgttgcttaa

SEQ ID NO: 4759969 - DNA, 13 bp, Homo sapiens
ttcttttaatttt

SEQ ID NO: 4759970 - DNA, 15 bp, Homo sapiens
ttcttttcaatgcaa

SEQ ID NO: 4759971 - DNA, 18 bp, Homo sapiens
ttcttttcaatgcaatgc

SEQ ID NO: 4759972 - DNA, 14 bp, Homo sapiens
ttcttttcccattt

SEQ ID NO: 4759973 - DNA, 23 bp, Homo sapiens
ttcttttgaatcaatctggcttc

SEQ ID NO: 4759974 - DNA, 16 bp, Homo sapiens
ttcttttgtgcatatg

SEQ ID NO: 4759975 - DNA, 22 bp, Homo sapiens
ttctttttaaaaagttgcacat

SEQ ID NO: 4759976 - DNA, 18 bp, Homo sapiens
ttctttttggcattatct

SEQ ID NO: 4759977 - DNA, 14 bp, Homo sapiens
ttgaaaaaatattg

SEQ ID NO: 4759978 - DNA, 16 bp, Homo sapiens
ttgaaaacttctcatt

SEQ ID NO: 4759979 - DNA, 16 bp, Homo sapiens
ttgaaactgcatttgt

SEQ ID NO: 4759980 - DNA, 17 bp, Homo sapiens
ttgaaactgtatttact

SEQ ID NO: 4759981 - DNA, 21 bp, Homo sapiens
ttgaaactgtatttacttgtt

SEQ ID NO: 4759982 - DNA, 23 bp, Homo sapiens
ttgaaaggagaaaaaaaaagcca

SEQ ID NO: 4759983 - DNA, 22 bp, Homo sapiens
ttgaaataacagccttaaatcc

SEQ ID NO: 4759984 - DNA, 18 bp, Homo sapiens
ttgaaatacttgaaaact

SEQ ID NO: 4759985 - DNA, 15 bp, Homo sapiens
ttgaacaactcgaat

SEQ ID NO: 4759986 - DNA, 18 bp, Homo sapiens
ttgaacacatttccttta

SEQ ID NO: 4759987 - DNA, 23 bp, Homo sapiens
ttgaaccgtcaatgtgaaataaa

SEQ ID NO: 4759988 - DNA, 18 bp, Homo sapiens
ttgaagaagggaaattca

SEQ ID NO: 4759989 - DNA, 17 bp, Homo sapiens
ttgaagacagagctaca

SEQ ID NO: 4759990 - DNA, 16 bp, Homo sapiens
ttgaagacttcaaaat

SEQ ID NO: 4759991 - DNA, 20 bp, Homo sapiens
ttgaagagagatatatctga

SEQ ID NO: 4759992 - DNA, 16 bp, Homo sapiens
ttgaagggggatgcag

SEQ ID NO: 4759993 - DNA, 20 bp, Homo sapiens
ttgaagtgagaaaatgaaca

SEQ ID NO: 4759994 - DNA, 14 bp, Homo sapiens
ttgaagtgcatgtt

SEQ ID NO: 4759995 - DNA, 19 bp, Homo sapiens
ttgaagtgcatgttaaaat

SEQ ID NO: 4759996 - DNA, 16 bp, Homo sapiens
ttgaatagtattgtgt

SEQ ID NO: 4759997 - DNA, 18 bp, Homo sapiens
ttgaatctctaaaatgct

SEQ ID NO: 4759998 - DNA, 23 bp, Homo sapiens
ttgaatctctaaaatgctgttct

SEQ ID NO: 4759999 - DNA, 12 bp, Homo sapiens
ttgaatgatgcc

SEQ ID NO: 4760000 - DNA, 18 bp, Homo sapiens
ttgaatgcttaaatgatc

SEQ ID NO: 4760001 - DNA, 18 bp, Homo sapiens
ttgaattttcaaaggctt

SEQ ID NO: 4760002 - DNA, 15 bp, Homo sapiens
ttgacaataagaaac

SEQ ID NO: 4760003 - DNA, 20 bp, Homo sapiens
ttgacaataagaaacagttt

SEQ ID NO: 4760004 - DNA, 17 bp, Homo sapiens
ttgacacactcaccatt

SEQ ID NO: 4760005 - DNA, 21 bp, Homo sapiens
ttgacacactcaccatttaat

SEQ ID NO: 4760006 - DNA, 20 bp, Homo sapiens
ttgacacattgcacacacag

SEQ ID NO: 4760007 - DNA, 19 bp, Homo sapiens
ttgacacttttcatatcat

SEQ ID NO: 4760008 - DNA, 19 bp, Homo sapiens
ttgacattgtcagaatgtt

SEQ ID NO: 4760009 - DNA, 20 bp, Homo sapiens
ttgacattgtcagaatgttg

SEQ ID NO: 4760010 - DNA, 20 bp, Homo sapiens
ttgaccctgaaatattttct

SEQ ID NO: 4760011 - DNA, 20 bp, Homo sapiens
ttgaccgtgaggccagagac

SEQ ID NO: 4760012 - DNA, 21 bp, Homo sapiens
ttgacgacctacatctgaaat

SEQ ID NO: 4760013 - DNA, 21 bp, Homo sapiens
ttgagacactgtcaagattaa

SEQ ID NO: 4760014 - DNA, 15 bp, Homo sapiens
ttgagagcagcctct

SEQ ID NO: 4760015 - DNA, 22 bp, Homo sapiens
ttgagcagtggcctacaaatca

SEQ ID NO: 4760016 - DNA, 15 bp, Homo sapiens
ttgagcatgcccaaa

SEQ ID NO: 4760017 - DNA, 19 bp, Homo sapiens
ttgagccttattaaaatat

SEQ ID NO: 4760018 - DNA, 15 bp, Homo sapiens
ttgagctatgatatg

SEQ ID NO: 4760019 - DNA, 17 bp, Homo sapiens
ttgagctatgatatgtg

SEQ ID NO: 4760020 - DNA, 16 bp, Homo sapiens
ttgagctggttttctc

SEQ ID NO: 4760021 - DNA, 17 bp, Homo sapiens
ttgaggaccctcccagg

SEQ ID NO: 4760022 - DNA, 21 bp, Homo sapiens
ttgagggacgactttctttaa

SEQ ID NO: 4760023 - DNA, 17 bp, Homo sapiens
ttgagggactgcctctg

SEQ ID NO: 4760024 - DNA, 16 bp, Homo sapiens
ttgaggggaggtggcc

SEQ ID NO: 4760025 - DNA, 17 bp, Homo sapiens
ttgagtctctgaatttg

SEQ ID NO: 4760026 - DNA, 11 bp, Homo sapiens
ttgagtgcctt

SEQ ID NO: 4760027 - DNA, 17 bp, Homo sapiens
ttgagtgggccccctct

SEQ ID NO: 4760028 - DNA, 16 bp, Homo sapiens
ttgagtgtcaggctct

SEQ ID NO: 4760029 - DNA, 20 bp, Homo sapiens
ttgagttaagtctatctggt

SEQ ID NO: 4760030 - DNA, 15 bp, Homo sapiens
ttgagtttgctgtat

SEQ ID NO: 4760031 - DNA, 15 bp, Homo sapiens
ttgataaaaatactg

SEQ ID NO: 4760032 - DNA, 17 bp, Homo sapiens
ttgataataaaattcat

SEQ ID NO: 4760033 - DNA, 18 bp, Homo sapiens
ttgataataaaattcatt

SEQ ID NO: 4760034 - DNA, 13 bp, Homo sapiens
ttgatatacagac

SEQ ID NO: 4760035 - DNA, 15 bp, Homo sapiens
ttgatattctaagaa

SEQ ID NO: 4760036 - DNA, 18 bp, Homo sapiens
ttgatattctaagaaata

SEQ ID NO: 4760037 - DNA, 22 bp, Homo sapiens
ttgatattctaagaaatatctg

SEQ ID NO: 4760038 - DNA, 15 bp, Homo sapiens
ttgatatttaaaaga

SEQ ID NO: 4760039 - DNA, 12 bp, Homo sapiens
ttgatctggtgc

SEQ ID NO: 4760040 - DNA, 19 bp, Homo sapiens
ttgatgaataaaatgttta

SEQ ID NO: 4760041 - DNA, 22 bp, Homo sapiens
ttgatgaccaatctctgtgact

SEQ ID NO: 4760042 - DNA, 22 bp, Homo sapiens
ttgatggagatccaactatttc

SEQ ID NO: 4760043 - DNA, 19 bp, Homo sapiens
ttgatggtagaaattttat

SEQ ID NO: 4760044 - DNA, 13 bp, Homo sapiens
ttgattaaaagca

SEQ ID NO: 4760045 - DNA, 12 bp, Homo sapiens
ttgattctttca

SEQ ID NO: 4760046 - DNA, 17 bp, Homo sapiens
ttgattgtttgatgaat

SEQ ID NO: 4760047 - DNA, 15 bp, Homo sapiens
ttgcaacactgccaa

SEQ ID NO: 4760048 - DNA, 21 bp, Homo sapiens
ttgcaagagtgatgggaaaga

SEQ ID NO: 4760049 - DNA, 23 bp, Homo sapiens
ttgctctccctcccttctttcct

SEQ ID NO: 4760050 - DNA, 21 bp, Homo sapiens
ttgctctgctcatctacacat

SEQ ID NO: 4760051 - DNA, 12 bp, Homo sapiens
ttgctgaaacac

SEQ ID NO: 4760052 - DNA, 20 bp, Homo sapiens
ttgctgaataacaacaattt

SEQ ID NO: 4760053 - DNA, 16 bp, Homo sapiens
ttgctgagatgtttag

SEQ ID NO: 4760054 - DNA, 17 bp, Homo sapiens
ttgctgcactcttgcac

SEQ ID NO: 4760055 - DNA, 23 bp, Homo sapiens
ttgctgtaaataaaaatagctat

SEQ ID NO: 4760056 - DNA, 20 bp, Homo sapiens
ttgctgtctgaaaaagtgtt

SEQ ID NO: 4760057 - DNA, 12 bp, Homo sapiens
ttgcttcattaa

SEQ ID NO: 4760058 - DNA, 17 bp, Homo sapiens
ttgcttcattaaaacaa

SEQ ID NO: 4760059 - DNA, 14 bp, Homo sapiens
ttgcttccttctca

SEQ ID NO: 4760060 - DNA, 23 bp, Homo sapiens
ttgcttctaagggatccagagac

SEQ ID NO: 4760061 - DNA, 14 bp, Homo sapiens
ttgcttcttgtgtt

SEQ ID NO: 4760062 - DNA, 18 bp, Homo sapiens
ttgcttggactacctata

SEQ ID NO: 4760063 - DNA, 19 bp, Homo sapiens
ttggaaaataataaaagaa

SEQ ID NO: 4760064 - DNA, 21 bp, Homo sapiens
ttggaaaataataaaagaatc

SEQ ID NO: 4760065 - DNA, 22 bp, Homo sapiens
ttggaaaatgttctgacagcat

SEQ ID NO: 4760066 - DNA, 19 bp, Homo sapiens
ttggaacagtaatcagttt

SEQ ID NO: 4760067 - DNA, 20 bp, Homo sapiens
ttggaacagtaatcagtttg

SEQ ID NO: 4760068 - DNA, 18 bp, Homo sapiens
ttggaagaattcatgatg

SEQ ID NO: 4760069 - DNA, 13 bp, Homo sapiens
ttggacagcaaaa

SEQ ID NO: 4760070 - DNA, 22 bp, Homo sapiens
ttggacagcaaaaccattgctt

SEQ ID NO: 4760071 - DNA, 15 bp, Homo sapiens
ttggagagacacagc

SEQ ID NO: 4760072 - DNA, 21 bp, Homo sapiens
ttggagagagcaatcttgctg

SEQ ID NO: 4760073 - DNA, 19 bp, Homo sapiens
ttggagcagagacggcagc

SEQ ID NO: 4760074 - DNA, 15 bp, Homo sapiens
ttggagtgcagtggc

SEQ ID NO: 4760075 - DNA, 15 bp, Homo sapiens
ttggatataaatctt

SEQ ID NO: 4760076 - DNA, 23 bp, Homo sapiens
ttggatgaatgcagtataaaatg

SEQ ID NO: 4760077 - DNA, 12 bp, Homo sapiens
ttggcaccaaag

SEQ ID NO: 4760078 - DNA, 18 bp, Homo sapiens
ttggcaccaaagatgcag

SEQ ID NO: 4760079 - DNA, 22 bp, Homo sapiens
ttggcaggagtgggctctgagc

SEQ ID NO: 4760080 - DNA, 18 bp, Homo sapiens
ttggcattatctctttct

SEQ ID NO: 4760081 - DNA, 11 bp, Homo sapiens
ttggcccctct

SEQ ID NO: 4760082 - DNA, 13 bp, Homo sapiens
ttggccggctggc

SEQ ID NO: 4760083 - DNA, 15 bp, Homo sapiens
ttggccggctggccg

SEQ ID NO: 4760084 - DNA, 20 bp, Homo sapiens
ttggctattgtccttgtgta

SEQ ID NO: 4760085 - DNA, 19 bp, Homo sapiens
ttggctgccaagagtccaa

SEQ ID NO: 4760086 - DNA, 13 bp, Homo sapiens
ttgggaagcagtt

SEQ ID NO: 4760087 - DNA, 18 bp, Homo sapiens
ttgggaagcagtttcaga

SEQ ID NO: 4760088 - DNA, 22 bp, Homo sapiens
ttgggacctgcttcattcaagc

SEQ ID NO: 4760089 - DNA, 17 bp, Homo sapiens
ttgggcagtggagaggg

SEQ ID NO: 4760090 - DNA, 19 bp, Homo sapiens
ttgggcccccatccctccc

SEQ ID NO: 4760091 - DNA, 20 bp, Homo sapiens
ttggggggccgggcaggtcc

SEQ ID NO: 4760092 - DNA, 19 bp, Homo sapiens
ttgggtaagggactccaga

SEQ ID NO: 4760093 - DNA, 14 bp, Homo sapiens
ttgggttccagaca

SEQ ID NO: 4760094 - DNA, 15 bp, Homo sapiens
ttgggttccagacag

SEQ ID NO: 4760095 - DNA, 23 bp, Homo sapiens
ttggtaatgatgattcaatcatt

SEQ ID NO: 4760096 - DNA, 21 bp, Homo sapiens
ttggtaccctggacagtgcct

SEQ ID NO: 4760097 - DNA, 17 bp, Homo sapiens
ttggtagatattcagga

SEQ ID NO: 4760098 - DNA, 22 bp, Homo sapiens
ttggtatggagttggcagacag

SEQ ID NO: 4760099 - DNA, 12 bp, Homo sapiens
ttggtatttact

SEQ ID NO: 4760100 - DNA, 13 bp, Homo sapiens
ttggtatttactg

SEQ ID NO: 4760101 - DNA, 19 bp, Homo sapiens
ttggtctctttctttccaa

SEQ ID NO: 4760102 - DNA, 21 bp, Homo sapiens
ttggttaatgaaaaatctgaa

SEQ ID NO: 4760103 - DNA, 15 bp, Homo sapiens
ttggttcctccagca

SEQ ID NO: 4760104 - DNA, 14 bp, Homo sapiens
ttggttttctcctt

SEQ ID NO: 4760105 - DNA, 14 bp, Homo sapiens
ttgtaaaactgtga

SEQ ID NO: 4760106 - DNA, 17 bp, Homo sapiens
ttgtaaaactgtgacat

SEQ ID NO: 4760107 - DNA, 16 bp, Homo sapiens
ttgtaaaattccatgg

SEQ ID NO: 4760108 - DNA, 18 bp, Homo sapiens
ttgtaaaggtaggtgcat

SEQ ID NO: 4760109 - DNA, 14 bp, Homo sapiens
ttgtaaggaatgat

SEQ ID NO: 4760110 - DNA, 20 bp, Homo sapiens
ttgtaaggaatgattaatta

SEQ ID NO: 4760111 - DNA, 16 bp, Homo sapiens
ttgtaatataagacaa

SEQ ID NO: 4760112 - DNA, 21 bp, Homo sapiens
ttgtaatatagaaaaaaacat

SEQ ID NO: 4760113 - DNA, 18 bp, Homo sapiens
ttgtaatattttgctgct

SEQ ID NO: 4760114 - DNA, 16 bp, Homo sapiens
ttgtaatcataaatac

SEQ ID NO: 4760115 - DNA, 19 bp, Homo sapiens
ttgtacagaatcattgctt

SEQ ID NO: 4760116 - DNA, 18 bp, Homo sapiens
ttgtacagtttgtttaca

SEQ ID NO: 4760117 - DNA, 17 bp, Homo sapiens
ttgtacatatggaaatc

SEQ ID NO: 4760118 - DNA, 19 bp, Homo sapiens
ttgtacccttcttgtctct

SEQ ID NO: 4760119 - DNA, 18 bp, Homo sapiens
ttgtacgttaattaaaca

SEQ ID NO: 4760120 - DNA, 17 bp, Homo sapiens
ttgtacgttcttctatt

SEQ ID NO: 4760121 - DNA, 18 bp, Homo sapiens
ttgtacttacactgaaat

SEQ ID NO: 4760122 - DNA, 20 bp, Homo sapiens
ttgtagcctaatattcatgc

SEQ ID NO: 4760123 - DNA, 15 bp, Homo sapiens
ttgtagctagtttaa

SEQ ID NO: 4760124 - DNA, 21 bp, Homo sapiens
ttgtaggggaaatcaaggtga

SEQ ID NO: 4760125 - DNA, 14 bp, Homo sapiens
ttgtataaaacagt

SEQ ID NO: 4760126 - DNA, 16 bp, Homo sapiens
ttgtataaaacagtgt

SEQ ID NO: 4760127 - DNA, 15 bp, Homo sapiens
ttgtataattatgaa

SEQ ID NO: 4760128 - DNA, 13 bp, Homo sapiens
ttgtatacaagta

SEQ ID NO: 4760129 - DNA, 17 bp, Homo sapiens
ttgtatctgaactcaca

SEQ ID NO: 4760130 - DNA, 22 bp, Homo sapiens
ttgtatgaaatatatgtgaaag

SEQ ID NO: 4760131 - DNA, 19 bp, Homo sapiens
ttgtatgttttattgtaat

SEQ ID NO: 4760132 - DNA, 21 bp, Homo sapiens
ttgtattatcatatatgcttt

SEQ ID NO: 4760133 - DNA, 17 bp, Homo sapiens
ttgtattttaataaaga

SEQ ID NO: 4760134 - DNA, 23 bp, Homo sapiens
ttgtcaaatggtattttttgtga

SEQ ID NO: 4760135 - DNA, 18 bp, Homo sapiens
ttgtcaatgctctaacaa

SEQ ID NO: 4760136 - DNA, 21 bp, Homo sapiens
ttgtcacttctgctgtacaga

SEQ ID NO: 4760137 - DNA, 12 bp, Homo sapiens
ttgtcagaatgt

SEQ ID NO: 4760138 - DNA, 15 bp, Homo sapiens
ttgtcagaatgttgt

SEQ ID NO: 4760139 - DNA, 13 bp, Homo sapiens
ttgtcattctcat

SEQ ID NO: 4760140 - DNA, 14 bp, Homo sapiens
ttgtcattctcatc

SEQ ID NO: 4760141 - DNA, 17 bp, Homo sapiens
tttgaggaccctcccag

SEQ ID NO: 4760142 - DNA, 18 bp, Homo sapiens
tttgagggactgcctctg

SEQ ID NO: 4760143 - DNA, 20 bp, Homo sapiens
tttgagggactgcctctgcc

SEQ ID NO: 4760144 - DNA, 15 bp, Homo sapiens
tttgagggttccatg

SEQ ID NO: 4760145 - DNA, 13 bp, Homo sapiens
tttgatctggtgc

SEQ ID NO: 4760146 - DNA, 18 bp, Homo sapiens
tttgatgaataaaatgtt

SEQ ID NO: 4760147 - DNA, 22 bp, Homo sapiens
tttgatgttctttcaccctttt

SEQ ID NO: 4760148 - DNA, 18 bp, Homo sapiens
tttgattgtttgatgaat

SEQ ID NO: 4760149 - DNA, 18 bp, Homo sapiens
tttgatttgatatacaga

SEQ ID NO: 4760150 - DNA, 21 bp, Homo sapiens
tttgcaacactgccaaacatc

SEQ ID NO: 4760151 - DNA, 13 bp, Homo sapiens
tttgcaataagga

SEQ ID NO: 4760152 - DNA, 14 bp, Homo sapiens
tttgcaataaggat

SEQ ID NO: 4760153 - DNA, 22 bp, Homo sapiens
tttgcagacatattttcttaca

SEQ ID NO: 4760154 - DNA, 19 bp, Homo sapiens
tttgccctgcgtcccttct

SEQ ID NO: 4760155 - DNA, 16 bp, Homo sapiens
tttgccttaattctta

SEQ ID NO: 4760156 - DNA, 14 bp, Homo sapiens
tttgctaatgaatt

SEQ ID NO: 4760157 - DNA, 13 bp, Homo sapiens
tttgctaattaaa

SEQ ID NO: 4760158 - DNA, 20 bp, Homo sapiens
tttgctctccctcccttctt

SEQ ID NO: 4760159 - DNA, 22 bp, Homo sapiens
tttgctctccctcccttctttc

SEQ ID NO: 4760160 - DNA, 21 bp, Homo sapiens
tttgctgtatacaaacaggtg

SEQ ID NO: 4760161 - DNA, 18 bp, Homo sapiens
tttgcttatttatattca

SEQ ID NO: 4760162 - DNA, 16 bp, Homo sapiens
tttgcttcccatctga

SEQ ID NO: 4760163 - DNA, 21 bp, Homo sapiens
tttggaaaacgatttaattta

SEQ ID NO: 4760164 - DNA, 17 bp, Homo sapiens
tttggaagaattcatga

SEQ ID NO: 4760165 - DNA, 22 bp, Homo sapiens
tttggatgaatgcagtataaaa

SEQ ID NO: 4760166 - DNA, 19 bp, Homo sapiens
tttggccgttttgtgaaga

SEQ ID NO: 4760167 - DNA, 12 bp, Homo sapiens
tttggctgctct

SEQ ID NO: 4760168 - DNA, 15 bp, Homo sapiens
tttggggggagaaac

SEQ ID NO: 4760169 - DNA, 15 bp, Homo sapiens
tttggttcctcatgg

SEQ ID NO: 4760170 - DNA, 14 bp, Homo sapiens
tttgtaaaagagct

SEQ ID NO: 4760171 - DNA, 21 bp, Homo sapiens
tttgtaaaagagctgttcttt

SEQ ID NO: 4760172 - DNA, 15 bp, Homo sapiens
tttgtaaaatgtatt

SEQ ID NO: 4760173 - DNA, 16 bp, Homo sapiens
tttgtaaaatgtatta

SEQ ID NO: 4760174 - DNA, 12 bp, Homo sapiens
tttgtaactctt

SEQ ID NO: 4760175 - DNA, 17 bp, Homo sapiens
tttgtaactctttggct

SEQ ID NO: 4760176 - DNA, 19 bp, Homo sapiens
tttgtaatataagacaagt

SEQ ID NO: 4760177 - DNA, 18 bp, Homo sapiens
tttgtaatgtatcttatt

SEQ ID NO: 4760178 - DNA, 14 bp, Homo sapiens
tttgtaattcctct

SEQ ID NO: 4760179 - DNA, 21 bp, Homo sapiens
tttgtacaatggggacttccc

SEQ ID NO: 4760180 - DNA, 20 bp, Homo sapiens
tttgtacatgccattgaaaa

SEQ ID NO: 4760181 - DNA, 13 bp, Homo sapiens
aaaaaaaagaata

SEQ ID NO: 4760182 - DNA, 13 bp, Homo sapiens
aaaaaaaatgata

SEQ ID NO: 4760183 - DNA, 11 bp, Homo sapiens
aaaaaagtaat

SEQ ID NO: 4760184 - DNA, 12 bp, Homo sapiens
aaaaaataatat

SEQ ID NO: 4760185 - DNA, 14 bp, Homo sapiens
aaaaaatatatgta

SEQ ID NO: 4760186 - DNA, 13 bp, Homo sapiens
aaaaaatatgaga

SEQ ID NO: 4760187 - DNA, 12 bp, Homo sapiens
aaaaactggaaa

SEQ ID NO: 4760188 - DNA, 13 bp, Homo sapiens
aaaaactttccat

SEQ ID NO: 4760189 - DNA, 17 bp, Homo sapiens
aaaaactttccatgaca

SEQ ID NO: 4760190 - DNA, 23 bp, Homo sapiens
aaaaactttccatgacagtagca

SEQ ID NO: 4760191 - DNA, 24 bp, Homo sapiens
aaaaactttccatgacagtagcat

SEQ ID NO: 4760192 - DNA, 14 bp, Homo sapiens
aaaaagatattgta

SEQ ID NO: 4760193 - DNA, 15 bp, Homo sapiens
aaaaagatattgtat

SEQ ID NO: 4760194 - DNA, 21 bp, Homo sapiens
aaaaagatggatttgacacac

SEQ ID NO: 4760195 - DNA, 22 bp, Homo sapiens
aaaaagcaggaaagatcccaag

SEQ ID NO: 4760196 - DNA, 12 bp, Homo sapiens
aaaaagggaaaa

SEQ ID NO: 4760197 - DNA, 15 bp, Homo sapiens
aaaaagtcaaacttt

SEQ ID NO: 4760198 - DNA, 17 bp, Homo sapiens
aaaaagtgtttttacat

SEQ ID NO: 4760199 - DNA, 16 bp, Homo sapiens
aaaaatacagtattat

SEQ ID NO: 4760200 - DNA, 17 bp, Homo sapiens
aaaaatacagtattatt

SEQ ID NO: 4760201 - DNA, 19 bp, Homo sapiens
aaaaatatatgtaatatat

SEQ ID NO: 4760202 - DNA, 12 bp, Homo sapiens
aaaaatatgtgt

SEQ ID NO: 4760203 - DNA, 13 bp, Homo sapiens
aaaaatatgtgta

SEQ ID NO: 4760204 - DNA, 23 bp, Homo sapiens
aaaaatccctcttcctccaaagc

SEQ ID NO: 4760205 - DNA, 14 bp, Homo sapiens
aaaaatctgaattt

SEQ ID NO: 4760206 - DNA, 17 bp, Homo sapiens
aaaaatgaaatttaagc

SEQ ID NO: 4760207 - DNA, 16 bp, Homo sapiens
aaaaatgcttgaccct

SEQ ID NO: 4760208 - DNA, 12 bp, Homo sapiens
aaaaatgttcat

SEQ ID NO: 4760209 - DNA, 13 bp, Homo sapiens
aaaaattgaagag

SEQ ID NO: 4760210 - DNA, 11 bp, Homo sapiens
aaaaatttcac

SEQ ID NO: 4760211 - DNA, 18 bp, Homo sapiens
aaaacaaaaaaacccagg

SEQ ID NO: 4760212 - DNA, 23 bp, Homo sapiens
aaaacaaaatccttgccttcaaa

SEQ ID NO: 4760213 - DNA, 18 bp, Homo sapiens
aaaacaaatatttcactt

SEQ ID NO: 4760214 - DNA, 20 bp, Homo sapiens
aaaacaagagaccacttcct

SEQ ID NO: 4760215 - DNA, 17 bp, Homo sapiens
aaaacataaaatataca

SEQ ID NO: 4760216 - DNA, 13 bp, Homo sapiens
aaaacatctcatc

SEQ ID NO: 4760217 - DNA, 19 bp, Homo sapiens
aaaacattctatctactga

SEQ ID NO: 4760218 - DNA, 22 bp, Homo sapiens
aaaacattgtccccaatgaata

SEQ ID NO: 4760219 - DNA, 18 bp, Homo sapiens
aaaaccatctggcctggc

SEQ ID NO: 4760220 - DNA, 16 bp, Homo sapiens
aaaaccattgcttcac

SEQ ID NO: 4760221 - DNA, 20 bp, Homo sapiens
aaaacctcagttggcctctg

SEQ ID NO: 4760222 - DNA, 15 bp, Homo sapiens
aaaacgatttaattt

SEQ ID NO: 4760223 - DNA, 13 bp, Homo sapiens
aaaactactgcct

SEQ ID NO: 4760224 - DNA, 16 bp, Homo sapiens
aaaactatcagcagcg

SEQ ID NO: 4760225 - DNA, 11 bp, Homo sapiens
aaaactgccac

SEQ ID NO: 4760226 - DNA, 18 bp, Homo sapiens
aaaactgccacaagcaca

SEQ ID NO: 4760227 - DNA, 20 bp, Homo sapiens
aaaactggaaacatctgatt

SEQ ID NO: 4760228 - DNA, 21 bp, Homo sapiens
aaaactggaataagaagcaaa

SEQ ID NO: 4760229 - DNA, 15 bp, Homo sapiens
aaaactgtgacattc

SEQ ID NO: 4760230 - DNA, 17 bp, Homo sapiens
aaaactgtgacattcca

SEQ ID NO: 4760231 - DNA, 13 bp, Homo sapiens
aaaacttctcatt

SEQ ID NO: 4760232 - DNA, 19 bp, Homo sapiens
aaaactttattttatataa

SEQ ID NO: 4760233 - DNA, 23 bp, Homo sapiens
aaaactttattttatataataaa

SEQ ID NO: 4760234 - DNA, 18 bp, Homo sapiens
aaaactttccatgacagt

SEQ ID NO: 4760235 - DNA, 21 bp, Homo sapiens
aaaactttccatgacagtagc

SEQ ID NO: 4760236 - DNA, 14 bp, Homo sapiens
aaaagaaaaactgt

SEQ ID NO: 4760237 - DNA, 17 bp, Homo sapiens
aaaagaaagaaaaaagt

SEQ ID NO: 4760238 - DNA, 14 bp, Homo sapiens
aaaagacatccaca

SEQ ID NO: 4760239 - DNA, 20 bp, Homo sapiens
aaaagaccatgcattcagat

SEQ ID NO: 4760240 - DNA, 21 bp, Homo sapiens
aaaagaccatgcattcagatc

SEQ ID NO: 4760241 - DNA, 22 bp, Homo sapiens
aaaagagaccacccatatcatg

SEQ ID NO: 4760242 - DNA, 13 bp, Homo sapiens
aaaagagcttccc

SEQ ID NO: 4760243 - DNA, 21 bp, Homo sapiens
aaaagatattgtattatcata

SEQ ID NO: 4760244 - DNA, 14 bp, Homo sapiens
aaaagcacctcttg

SEQ ID NO: 4760245 - DNA, 15 bp, Homo sapiens
aaaagcccatgctta

SEQ ID NO: 4760246 - DNA, 12 bp, Homo sapiens
aaaaggcccctt

SEQ ID NO: 4760247 - DNA, 22 bp, Homo sapiens
aaaaggtagcttacctgacaca

SEQ ID NO: 4760248 - DNA, 23 bp, Homo sapiens
aaaagtaaaacagatttgttcat

SEQ ID NO: 4760249 - DNA, 15 bp, Homo sapiens
aaaagtcaaactttc

SEQ ID NO: 4760250 - DNA, 12 bp, Homo sapiens
aaaagtgatgtg

SEQ ID NO: 4760251 - DNA, 22 bp, Homo sapiens
aaaagtgatgtgatttatgcat

SEQ ID NO: 4760252 - DNA, 16 bp, Homo sapiens
aaaagtgtttttacat

SEQ ID NO: 4760253 - DNA, 22 bp, Homo sapiens
aaaagttttcaagcattgctaa

SEQ ID NO: 4760254 - DNA, 18 bp, Homo sapiens
aaaataataaaagaatca

SEQ ID NO: 4760255 - DNA, 13 bp, Homo sapiens
aaaatacagtatt

SEQ ID NO: 4760256 - DNA, 13 bp, Homo sapiens
aaaatagtctcat

SEQ ID NO: 4760257 - DNA, 17 bp, Homo sapiens
aaaatagtctcattgcc

SEQ ID NO: 4760258 - DNA, 22 bp, Homo sapiens
aaaatatatgtaatatatacat

SEQ ID NO: 4760259 - DNA, 23 bp, Homo sapiens
aaaatatatgtaatatatacata

SEQ ID NO: 4760260 - DNA, 12 bp, Homo sapiens
aaaatatgtgta

SEQ ID NO: 4760261 - DNA, 14 bp, Homo sapiens
aaaatattctccat

SEQ ID NO: 4760262 - DNA, 14 bp, Homo sapiens
aaaatattctgtca

SEQ ID NO: 4760263 - DNA, 21 bp, Homo sapiens
aaaatattgtttaatgcaaat

SEQ ID NO: 4760264 - DNA, 15 bp, Homo sapiens
aaaatattttcttaa

SEQ ID NO: 4760265 - DNA, 18 bp, Homo sapiens
aaaatattttcttaatta

SEQ ID NO: 4760266 - DNA, 13 bp, Homo sapiens
aaaatcaatcatt

SEQ ID NO: 4760267 - DNA, 12 bp, Homo sapiens
aaaatcatcaaa

SEQ ID NO: 4760268 - DNA, 14 bp, Homo sapiens
aaaatcatcaaagt

SEQ ID NO: 4760269 - DNA, 22 bp, Homo sapiens
aaaatccaagctgctcatttca

SEQ ID NO: 4760270 - DNA, 13 bp, Homo sapiens
aaaatctgaattt

SEQ ID NO: 4760271 - DNA, 20 bp, Homo sapiens
aaaatgagaatctgtgcagt

SEQ ID NO: 4760272 - DNA, 15 bp, Homo sapiens
aaaatgctttctcat

SEQ ID NO: 4760273 - DNA, 21 bp, Homo sapiens
aaaatggacgtgttatgactc

SEQ ID NO: 4760274 - DNA, 21 bp, Homo sapiens
aaaatggatgacaaagaaaat

SEQ ID NO: 4760275 - DNA, 17 bp, Homo sapiens
aaaatggcatttagcac

SEQ ID NO: 4760276 - DNA, 20 bp, Homo sapiens
aaaatggctgaagaaacaca

SEQ ID NO: 4760277 - DNA, 22 bp, Homo sapiens
aaaatgttcattctatgacaat

SEQ ID NO: 4760278 - DNA, 14 bp, Homo sapiens
aaaattattaaaaa

SEQ ID NO: 4760279 - DNA, 23 bp, Homo sapiens
aaaatttgacattgtcagaatgt

SEQ ID NO: 4760280 - DNA, 19 bp, Homo sapiens
aaaattttattgaatataa

SEQ ID NO: 4760281 - DNA, 17 bp, Homo sapiens
aaaattttcttctttaa

SEQ ID NO: 4760282 - DNA, 20 bp, Homo sapiens
aaacaaaatttatgtcattt

SEQ ID NO: 4760283 - DNA, 15 bp, Homo sapiens
aaacaaatatactca

SEQ ID NO: 4760284 - DNA, 18 bp, Homo sapiens
aaacaaatatactcattt

SEQ ID NO: 4760285 - DNA, 19 bp, Homo sapiens
aaacaaatcattttgatgt

SEQ ID NO: 4760286 - DNA, 20 bp, Homo sapiens
aaacaaattcaagaatgcag

SEQ ID NO: 4760287 - DNA, 14 bp, Homo sapiens
aaacaacagcaaca

SEQ ID NO: 4760288 - DNA, 21 bp, Homo sapiens
aaacaagagaccacttcctta

SEQ ID NO: 4760289 - DNA, 22 bp, Homo sapiens
aaacaagagaccacttccttaa

SEQ ID NO: 4760290 - DNA, 13 bp, Homo sapiens
aaacaagcgccac

SEQ ID NO: 4760291 - DNA, 13 bp, Homo sapiens
aaacaattcaaag

SEQ ID NO: 4760292 - DNA, 12 bp, Homo sapiens
aaacaatttatt

SEQ ID NO: 4760293 - DNA, 22 bp, Homo sapiens
aaacacaaaccacaactgacac

SEQ ID NO: 4760294 - DNA, 17 bp, Homo sapiens
aaacacagcatgcattt

SEQ ID NO: 4760295 - DNA, 21 bp, Homo sapiens
aaacacagcatgcatttagca

SEQ ID NO: 4760296 - DNA, 22 bp, Homo sapiens
aaacacatagattcacctgtaa

SEQ ID NO: 4760297 - DNA, 20 bp, Homo sapiens
aaacaccaccaaatgacaag

SEQ ID NO: 4760298 - DNA, 16 bp, Homo sapiens
aaacactcgtgtgcat

SEQ ID NO: 4760299 - DNA, 12 bp, Homo sapiens
aaacactgtgta

SEQ ID NO: 4760300 - DNA, 17 bp, Homo sapiens
aaacacttctccttaac

SEQ ID NO: 4760301 - DNA, 13 bp, Homo sapiens
aaacagctgcttt

SEQ ID NO: 4760302 - DNA, 18 bp, Homo sapiens
aaacaggaaaaaaacttt

SEQ ID NO: 4760303 - DNA, 20 bp, Homo sapiens
aaacaggaaaaaaactttta

SEQ ID NO: 4760304 - DNA, 15 bp, Homo sapiens
aaacaggggggccct

SEQ ID NO: 4760305 - DNA, 18 bp, Homo sapiens
aaacaggtgctaacactg

SEQ ID NO: 4760306 - DNA, 19 bp, Homo sapiens
aaacagtgtggcttaaaca

SEQ ID NO: 4760307 - DNA, 22 bp, Homo sapiens
aaacagtgtggcttaaacattt

SEQ ID NO: 4760308 - DNA, 12 bp, Homo sapiens
aaacagtgtttc

SEQ ID NO: 4760309 - DNA, 22 bp, Homo sapiens
aaacagttaagacaacaggcat

SEQ ID NO: 4760310 - DNA, 20 bp, Homo sapiens
aaacataatatcttgaagaa

SEQ ID NO: 4760311 - DNA, 16 bp, Homo sapiens
aaacatagtggtattt

SEQ ID NO: 4760312 - DNA, 14 bp, Homo sapiens
aaacatctgatttc

SEQ ID NO: 4760313 - DNA, 17 bp, Homo sapiens
aaacatgacactgacct

SEQ ID NO: 4760314 - DNA, 19 bp, Homo sapiens
aaacatgactctttattgt

SEQ ID NO: 4760315 - DNA, 20 bp, Homo sapiens
aaacatgactctttattgtc

SEQ ID NO: 4760316 - DNA, 19 bp, Homo sapiens
aaacattctatctactgat

SEQ ID NO: 4760317 - DNA, 21 bp, Homo sapiens
aaacattctatctactgattt

SEQ ID NO: 4760318 - DNA, 17 bp, Homo sapiens
aaacatttccctgctga

SEQ ID NO: 4760319 - DNA, 20 bp, Homo sapiens
aaaccacctgtccccagtta

SEQ ID NO: 4760320 - DNA, 21 bp, Homo sapiens
aaaccataaaataaataatct

SEQ ID NO: 4760321 - DNA, 12 bp, Homo sapiens
aaaccatgaaaa

SEQ ID NO: 4760322 - DNA, 16 bp, Homo sapiens
aaaccattgcttcact

SEQ ID NO: 4760323 - DNA, 17 bp, Homo sapiens
aaacccacataaacact

SEQ ID NO: 4760324 - DNA, 20 bp, Homo sapiens
aaacccacataaacacttct

SEQ ID NO: 4760325 - DNA, 16 bp, Homo sapiens
aaacccggctgactca

SEQ ID NO: 4760326 - DNA, 21 bp, Homo sapiens
aaacccgttttatgatttact

SEQ ID NO: 4760327 - DNA, 13 bp, Homo sapiens
aaaccctgcttct

SEQ ID NO: 4760328 - DNA, 20 bp, Homo sapiens
aaacctaaggcaacatttcc

SEQ ID NO: 4760329 - DNA, 11 bp, Homo sapiens
aaacctcagtt

SEQ ID NO: 4760330 - DNA, 18 bp, Homo sapiens
aaacctcagttggcctct

SEQ ID NO: 4760331 - DNA, 15 bp, Homo sapiens
aaacctgaggccaaa

SEQ ID NO: 4760332 - DNA, 20 bp, Homo sapiens
aaacctgtgctttcatgttt

SEQ ID NO: 4760333 - DNA, 22 bp, Homo sapiens
aaacctgtgtctctgagagtag

SEQ ID NO: 4760334 - DNA, 13 bp, Homo sapiens
aaacctgttcctg

SEQ ID NO: 4760335 - DNA, 15 bp, Homo sapiens
aaaccttaatatttc

SEQ ID NO: 4760336 - DNA, 23 bp, Homo sapiens
aaaccttaatatttcttcaaata

SEQ ID NO: 4760337 - DNA, 23 bp, Homo sapiens
aaaccttcttttcaatgcaatgc

SEQ ID NO: 4760338 - DNA, 19 bp, Homo sapiens
aaaccttgctgctatgctg

SEQ ID NO: 4760339 - DNA, 14 bp, Homo sapiens
aaaccttttaaaaa

SEQ ID NO: 4760340 - DNA, 17 bp, Homo sapiens
aaacgtaatttgttata

SEQ ID NO: 4760341 - DNA, 13 bp, Homo sapiens
aaactaccaccct

SEQ ID NO: 4760342 - DNA, 17 bp, Homo sapiens
aaactaccaccctcgct

SEQ ID NO: 4760343 - DNA, 17 bp, Homo sapiens
aaactactgcctttcaa

SEQ ID NO: 4760344 - DNA, 19 bp, Homo sapiens
aaactactgcctttcaaag

SEQ ID NO: 4760345 - DNA, 16 bp, Homo sapiens
aaactatagaataaag

SEQ ID NO: 4760346 - DNA, 13 bp, Homo sapiens
aaactcatacagt

SEQ ID NO: 4760347 - DNA, 17 bp, Homo sapiens
aaactgatgctttcaga

SEQ ID NO: 4760348 - DNA, 19 bp, Homo sapiens
aaactggaaacatctgatt

SEQ ID NO: 4760349 - DNA, 13 bp, Homo sapiens
aaactgggaaatg

SEQ ID NO: 4760350 - DNA, 21 bp, Homo sapiens
aaactgtgacattccacagag

SEQ ID NO: 4760351 - DNA, 10 bp, Homo sapiens
aaactgtgag

SEQ ID NO: 4760352 - DNA, 15 bp, Homo sapiens
aaacttaacagatca

SEQ ID NO: 4760353 - DNA, 22 bp, Homo sapiens
aaacttactatggtatatattt

SEQ ID NO: 4760354 - DNA, 23 bp, Homo sapiens
aaacttactatggtatatatttt

SEQ ID NO: 4760355 - DNA, 13 bp, Homo sapiens
aaacttctactga

SEQ ID NO: 4760356 - DNA, 17 bp, Homo sapiens
aaacttctactgagcaa

SEQ ID NO: 4760357 - DNA, 23 bp, Homo sapiens
aaactttattttatataataaag

SEQ ID NO: 4760358 - DNA, 14 bp, Homo sapiens
aaactttccatgac

SEQ ID NO: 4760359 - DNA, 15 bp, Homo sapiens
aaactttccatgaca

SEQ ID NO: 4760360 - DNA, 14 bp, Homo sapiens
aaactttggaagtt

SEQ ID NO: 4760361 - DNA, 16 bp, Homo sapiens
aaactttggaagtttt

SEQ ID NO: 4760362 - DNA, 20 bp, Homo sapiens
aaactttggaagttttactt

SEQ ID NO: 4760363 - DNA, 14 bp, Homo sapiens
aaacttttataaat

SEQ ID NO: 4760364 - DNA, 16 bp, Homo sapiens
aaacttttataaatta

SEQ ID NO: 4760365 - DNA, 21 bp, Homo sapiens
aaacttttataaattaaatat

SEQ ID NO: 4760366 - DNA, 15 bp, Homo sapiens
aaagaaaggcagaga

SEQ ID NO: 4760367 - DNA, 13 bp, Homo sapiens
aaagaatcatttg

SEQ ID NO: 4760368 - DNA, 14 bp, Homo sapiens
aaagacatgaaatt

SEQ ID NO: 4760369 - DNA, 21 bp, Homo sapiens
aaagagaaaatgctttctcat

SEQ ID NO: 4760370 - DNA, 24 bp, Homo sapiens
aaagagaaaatgctttctcatgca

SEQ ID NO: 4760371 - DNA, 14 bp, Homo sapiens
aaagagaaacacta

SEQ ID NO: 4760372 - DNA, 20 bp, Homo sapiens
aaagagaccacccatatcat

SEQ ID NO: 4760373 - DNA, 15 bp, Homo sapiens
aaagagctgttcttt

SEQ ID NO: 4760374 - DNA, 12 bp, Homo sapiens
aaagagcttccc

SEQ ID NO: 4760375 - DNA, 22 bp, Homo sapiens
aaagaggcgtcttgtattttct

SEQ ID NO: 4760376 - DNA, 18 bp, Homo sapiens
aaagagtaaaaccaaagg

SEQ ID NO: 4760377 - DNA, 23 bp, Homo sapiens
aaagagtagaactttaaaagaag

SEQ ID NO: 4760378 - DNA, 19 bp, Homo sapiens
aaagatagcagaagagtag

SEQ ID NO: 4760379 - DNA, 16 bp, Homo sapiens
aaagataggtatggaa

SEQ ID NO: 4760380 - DNA, 12 bp, Homo sapiens
aaagatattgta

SEQ ID NO: 4760381 - DNA, 20 bp, Homo sapiens
aaagatattgtatctccttt

SEQ ID NO: 4760382 - DNA, 16 bp, Homo sapiens
aaagatctttttttaa

SEQ ID NO: 4760383 - DNA, 20 bp, Homo sapiens
aaagatctttttttaagtgt

SEQ ID NO: 4760384 - DNA, 21 bp, Homo sapiens
aaagatggatttgacacactc

SEQ ID NO: 4760385 - DNA, 22 bp, Homo sapiens
aaagatggatttgacacactca

SEQ ID NO: 4760386 - DNA, 21 bp, Homo sapiens
aaagattgttggcagtttcct

SEQ ID NO: 4760387 - DNA, 21 bp, Homo sapiens
aaagcaaaccttaatttgaaa

SEQ ID NO: 4760388 - DNA, 23 bp, Homo sapiens
aaagcaaaccttaatttgaaata

SEQ ID NO: 4760389 - DNA, 13 bp, Homo sapiens
aaagcaaaggaga

SEQ ID NO: 4760390 - DNA, 21 bp, Homo sapiens
aaagcactggccttgcctcca

SEQ ID NO: 4760391 - DNA, 19 bp, Homo sapiens
aaagcagagatgtattatg

SEQ ID NO: 4760392 - DNA, 20 bp, Homo sapiens
aaagcagagatgtattatgg

SEQ ID NO: 4760393 - DNA, 21 bp, Homo sapiens
aaagcagcacacattgtgtta

SEQ ID NO: 4760394 - DNA, 21 bp, Homo sapiens
aaagcaggaaagatcccaagt

SEQ ID NO: 4760395 - DNA, 17 bp, Homo sapiens
aaagcagtgcatgctgt

SEQ ID NO: 4760396 - DNA, 21 bp, Homo sapiens
aaagcagtgcatgctgtccct

SEQ ID NO: 4760397 - DNA, 22 bp, Homo sapiens
aaagcatatataaaacaaaaca

SEQ ID NO: 4760398 - DNA, 19 bp, Homo sapiens
aaagcatgctcagtattga

SEQ ID NO: 4760399 - DNA, 22 bp, Homo sapiens
aaagcatgctcagtattgagac

SEQ ID NO: 4760400 - DNA, 20 bp, Homo sapiens
aaagcctgggcagaaatgtg

SEQ ID NO: 4760401 - DNA, 16 bp, Homo sapiens
aaagcctgttgtttaa

SEQ ID NO: 4760402 - DNA, 21 bp, Homo sapiens
aaagcctgttgtttaagtgac

SEQ ID NO: 4760403 - DNA, 18 bp, Homo sapiens
aaagctatcttcatgtaa

SEQ ID NO: 4760404 - DNA, 14 bp, Homo sapiens
aaagctatttaagt

SEQ ID NO: 4760405 - DNA, 13 bp, Homo sapiens
aaaggaaaccttt

SEQ ID NO: 4760406 - DNA, 16 bp, Homo sapiens
aaaggaagacagttct

SEQ ID NO: 4760407 - DNA, 16 bp, Homo sapiens
aaaggagcaagaactt

SEQ ID NO: 4760408 - DNA, 13 bp, Homo sapiens
aaaggcagggccc

SEQ ID NO: 4760409 - DNA, 17 bp, Homo sapiens
aaaggccttaacaaacg

SEQ ID NO: 4760410 - DNA, 21 bp, Homo sapiens
aaaggctgcagctaatttgtg

SEQ ID NO: 4760411 - DNA, 18 bp, Homo sapiens
aaaggctggatgtgcttt

SEQ ID NO: 4760412 - DNA, 21 bp, Homo sapiens
aaaggtttatttttctgttac

SEQ ID NO: 4760413 - DNA, 22 bp, Homo sapiens
aaaggtttcactgttcatgaat

SEQ ID NO: 4760414 - DNA, 15 bp, Homo sapiens
aaagtatatacagag

SEQ ID NO: 4760415 - DNA, 16 bp, Homo sapiens
aaagtattccacctta

SEQ ID NO: 4760416 - DNA, 21 bp, Homo sapiens
aaagtattccaccttaaatta

SEQ ID NO: 4760417 - DNA, 14 bp, Homo sapiens
aaagtctcctgtat

SEQ ID NO: 4760418 - DNA, 19 bp, Homo sapiens
aaagtgagaaaactgtgac

SEQ ID NO: 4760419 - DNA, 13 bp, Homo sapiens
aaagtgcacacac

SEQ ID NO: 4760420 - DNA, 14 bp, Homo sapiens
aaagtgcacacaca

SEQ ID NO: 4760421 - DNA, 13 bp, Homo sapiens
aaagtggcaagct

SEQ ID NO: 4760422 - DNA, 12 bp, Homo sapiens
aaagtggtgaga

SEQ ID NO: 4760423 - DNA, 15 bp, Homo sapiens
aaagtgttgtcttat

SEQ ID NO: 4760424 - DNA, 10 bp, Homo sapiens
aaagtgtttt

SEQ ID NO: 4760425 - DNA, 15 bp, Homo sapiens
aaagtgtttttacat

SEQ ID NO: 4760426 - DNA, 16 bp, Homo sapiens
aaagttaatcttcatg

SEQ ID NO: 4760427 - DNA, 13 bp, Homo sapiens
aaagttctattat

SEQ ID NO: 4760428 - DNA, 18 bp, Homo sapiens
aaagttggttttgtaaaa

SEQ ID NO: 4760429 - DNA, 24 bp, Homo sapiens
aaagttggttttgtaaaattccat

SEQ ID NO: 4760430 - DNA, 22 bp, Homo sapiens
aaagttttgatacttgtaactt

SEQ ID NO: 4760431 - DNA, 18 bp, Homo sapiens
aaataaaaatattctcca

SEQ ID NO: 4760432 - DNA, 13 bp, Homo sapiens
aaataaaataacc

SEQ ID NO: 4760433 - DNA, 19 bp, Homo sapiens
aaataaataatctcatccc

SEQ ID NO: 4760434 - DNA, 17 bp, Homo sapiens
aaataaatctactgttt

SEQ ID NO: 4760435 - DNA, 12 bp, Homo sapiens
aaataactgtga

SEQ ID NO: 4760436 - DNA, 14 bp, Homo sapiens
aaataactgtgact

SEQ ID NO: 4760437 - DNA, 13 bp, Homo sapiens
aaataataaaaga

SEQ ID NO: 4760438 - DNA, 16 bp, Homo sapiens
aaataataaaagaatc

SEQ ID NO: 4760439 - DNA, 20 bp, Homo sapiens
aaataataaaggttctatga

SEQ ID NO: 4760440 - DNA, 18 bp, Homo sapiens
aaataatataaatgaatg

SEQ ID NO: 4760441 - DNA, 23 bp, Homo sapiens
aaataatctcatccccaaactgt

SEQ ID NO: 4760442 - DNA, 15 bp, Homo sapiens
aaataattaaaacaa

SEQ ID NO: 4760443 - DNA, 14 bp, Homo sapiens
aaatacagtattat

SEQ ID NO: 4760444 - DNA, 17 bp, Homo sapiens
aaatagatttttagatt

SEQ ID NO: 4760445 - DNA, 14 bp, Homo sapiens
aaatagctataaat

SEQ ID NO: 4760446 - DNA, 18 bp, Homo sapiens
aaataggagggaaacctt

SEQ ID NO: 4760447 - DNA, 19 bp, Homo sapiens
aaataggagggaaaccttt

SEQ ID NO: 4760448 - DNA, 19 bp, Homo sapiens
aaatagtcatgtttctgca

SEQ ID NO: 4760449 - DNA, 13 bp, Homo sapiens
aaatagtctcatt

SEQ ID NO: 4760450 - DNA, 17 bp, Homo sapiens
aaatagtctcattgcca

SEQ ID NO: 4760451 - DNA, 13 bp, Homo sapiens
aaatagtgaaaat

SEQ ID NO: 4760452 - DNA, 18 bp, Homo sapiens
aaatagttgtaggggaaa

SEQ ID NO: 4760453 - DNA, 12 bp, Homo sapiens
aaatataaaaat

SEQ ID NO: 4760454 - DNA, 11 bp, Homo sapiens
aaatataaact

SEQ ID NO: 4760455 - DNA, 15 bp, Homo sapiens
aaatataaactgtga

SEQ ID NO: 4760456 - DNA, 13 bp, Homo sapiens
aaatataaacttg

SEQ ID NO: 4760457 - DNA, 15 bp, Homo sapiens
aaatataaatcacag

SEQ ID NO: 4760458 - DNA, 19 bp, Homo sapiens
aaatataaatcacagattt

SEQ ID NO: 4760459 - DNA, 15 bp, Homo sapiens
aaatataacatgaaa

SEQ ID NO: 4760460 - DNA, 22 bp, Homo sapiens
aaatatagtgttgtgttacaat

SEQ ID NO: 4760461 - DNA, 16 bp, Homo sapiens
aaatatatatttatca

SEQ ID NO: 4760462 - DNA, 14 bp, Homo sapiens
aaatatatgtaata

SEQ ID NO: 4760463 - DNA, 17 bp, Homo sapiens
aaatatatgtaatatat

SEQ ID NO: 4760464 - DNA, 14 bp, Homo sapiens
aaatatatgtatgt

SEQ ID NO: 4760465 - DNA, 20 bp, Homo sapiens
aaatatatgtatgtaaaaat

SEQ ID NO: 4760466 - DNA, 19 bp, Homo sapiens
aaatatcattatagcatgt

SEQ ID NO: 4760467 - DNA, 16 bp, Homo sapiens
aaatatctagtgctaa

SEQ ID NO: 4760468 - DNA, 12 bp, Homo sapiens
aaatatctgtga

SEQ ID NO: 4760469 - DNA, 21 bp, Homo sapiens
aaatatctgtgaaatatcatc

SEQ ID NO: 4760470 - DNA, 19 bp, Homo sapiens
aaatatgattctcctctcc

SEQ ID NO: 4760471 - DNA, 23 bp, Homo sapiens
aaatatgctctcccctccctttt

SEQ ID NO: 4760472 - DNA, 21 bp, Homo sapiens
aaatattgagcagaattcatt

SEQ ID NO: 4760473 - DNA, 18 bp, Homo sapiens
aaatattgatctgtatta

SEQ ID NO: 4760474 - DNA, 14 bp, Homo sapiens
aaatattgctgtct

SEQ ID NO: 4760475 - DNA, 20 bp, Homo sapiens
aaatattgctgtctgaaaaa

SEQ ID NO: 4760476 - DNA, 22 bp, Homo sapiens
aaatattgctgtctgaaaaagt

SEQ ID NO: 4760477 - DNA, 22 bp, Homo sapiens
aaatattgcttggactacctat

SEQ ID NO: 4760478 - DNA, 13 bp, Homo sapiens
aaatcaaggtgaa

SEQ ID NO: 4760479 - DNA, 14 bp, Homo sapiens
aaatcaatttaaag

SEQ ID NO: 4760480 - DNA, 15 bp, Homo sapiens
aaatcacagatttcc

SEQ ID NO: 4760481 - DNA, 11 bp, Homo sapiens
aaatcatcaaa

SEQ ID NO: 4760482 - DNA, 12 bp, Homo sapiens
aaatcattttga

SEQ ID NO: 4760483 - DNA, 13 bp, Homo sapiens
aaatcattttgat

SEQ ID NO: 4760484 - DNA, 19 bp, Homo sapiens
aaatcattttgatgtatta

SEQ ID NO: 4760485 - DNA, 20 bp, Homo sapiens
aaatctacaacataatgata

SEQ ID NO: 4760486 - DNA, 21 bp, Homo sapiens
aaatctactcttaaatataca

SEQ ID NO: 4760487 - DNA, 23 bp, Homo sapiens
aaatctatctctatataaaaaat

SEQ ID NO: 4760488 - DNA, 13 bp, Homo sapiens
aaatctgaatttc

SEQ ID NO: 4760489 - DNA, 14 bp, Homo sapiens
aaatctgaatttct

SEQ ID NO: 4760490 - DNA, 19 bp, Homo sapiens
aaatcttacccttcaatgt

SEQ ID NO: 4760491 - DNA, 21 bp, Homo sapiens
aaatcttacccttcaatgtta

SEQ ID NO: 4760492 - DNA, 23 bp, Homo sapiens
aaatcttacccttcaatgttaaa

SEQ ID NO: 4760493 - DNA, 13 bp, Homo sapiens
aaatctttgttaa

SEQ ID NO: 4760494 - DNA, 16 bp, Homo sapiens
aaatctttgttaaaat

SEQ ID NO: 4760495 - DNA, 18 bp, Homo sapiens
aaatctttgttaaaatat

SEQ ID NO: 4760496 - DNA, 20 bp, Homo sapiens
aaatctttgttaaaatatag

SEQ ID NO: 4760497 - DNA, 16 bp, Homo sapiens
aaatgaaatttaagca

SEQ ID NO: 4760498 - DNA, 20 bp, Homo sapiens
aaatgaactaactgccatgt

SEQ ID NO: 4760499 - DNA, 22 bp, Homo sapiens
aaatgaagacaccagagtgtat

SEQ ID NO: 4760500 - DNA, 23 bp, Homo sapiens
aaatgaagacaccagagtgtatg

SEQ ID NO: 4760501 - DNA, 17 bp, Homo sapiens
aaatgaatgaaatataa

SEQ ID NO: 4760502 - DNA, 14 bp, Homo sapiens
aaatgacatgcact

SEQ ID NO: 4760503 - DNA, 17 bp, Homo sapiens
aaatgacatgcactgac

SEQ ID NO: 4760504 - DNA, 16 bp, Homo sapiens
aaatgacttattgatt

SEQ ID NO: 4760505 - DNA, 21 bp, Homo sapiens
aaatgagaaattgtgccaaag

SEQ ID NO: 4760506 - DNA, 13 bp, Homo sapiens
aaatgattcactt

SEQ ID NO: 4760507 - DNA, 21 bp, Homo sapiens
aaatgatttaaatttaagtaa

SEQ ID NO: 4760508 - DNA, 16 bp, Homo sapiens
aaatgcaaacactgtg

SEQ ID NO: 4760509 - DNA, 15 bp, Homo sapiens
aaatgcagtgtattt

SEQ ID NO: 4760510 - DNA, 20 bp, Homo sapiens
aaatgccaagactctatgct

SEQ ID NO: 4760511 - DNA, 15 bp, Homo sapiens
aaatgctaaatgcaa

SEQ ID NO: 4760512 - DNA, 14 bp, Homo sapiens
aaatgctgctttgg

SEQ ID NO: 4760513 - DNA, 19 bp, Homo sapiens
aaatgctgttggtgagaat

SEQ ID NO: 4760514 - DNA, 20 bp, Homo sapiens
aaatgctgttggtgagaatc

SEQ ID NO: 4760515 - DNA, 19 bp, Homo sapiens
aaatgcttgaccctgaaat

SEQ ID NO: 4760516 - DNA, 15 bp, Homo sapiens
aaatgctttctcatg

SEQ ID NO: 4760517 - DNA, 18 bp, Homo sapiens
aaatggaagacagctctt

SEQ ID NO: 4760518 - DNA, 14 bp, Homo sapiens
aaatggacgtgtta

SEQ ID NO: 4760519 - DNA, 15 bp, Homo sapiens
aaatggacgtgttat

SEQ ID NO: 4760520 - DNA, 22 bp, Homo sapiens
aaatggacgtgttatgactcca

SEQ ID NO: 4760521 - DNA, 14 bp, Homo sapiens
aaatggacttgctt

SEQ ID NO: 4760522 - DNA, 19 bp, Homo sapiens
aaatggacttgcttcttgt

SEQ ID NO: 4760523 - DNA, 14 bp, Homo sapiens
aaatggatgacaaa

SEQ ID NO: 4760524 - DNA, 17 bp, Homo sapiens
aaatggatgacaaagaa

SEQ ID NO: 4760525 - DNA, 18 bp, Homo sapiens
agggccctgacaggcctt

SEQ ID NO: 4760526 - DNA, 13 bp, Homo sapiens
agggccctgctca

SEQ ID NO: 4760527 - DNA, 16 bp, Homo sapiens
agggccctgctcaggc

SEQ ID NO: 4760528 - DNA, 17 bp, Homo sapiens
agggccctgctcaggcc

SEQ ID NO: 4760529 - DNA, 19 bp, Homo sapiens
agggccctgctcaggcctc

SEQ ID NO: 4760530 - DNA, 20 bp, Homo sapiens
agggccctgctcaggcctca

SEQ ID NO: 4760531 - DNA, 20 bp, Homo sapiens
agggccctggggtctctgag

SEQ ID NO: 4760532 - DNA, 18 bp, Homo sapiens
agggcccttcccaacctc

SEQ ID NO: 4760533 - DNA, 14 bp, Homo sapiens
agggccgcagggcg

SEQ ID NO: 4760534 - DNA, 18 bp, Homo sapiens
agggccgcagggcgctcc

SEQ ID NO: 4760535 - DNA, 11 bp, Homo sapiens
agggccgccga

SEQ ID NO: 4760536 - DNA, 13 bp, Homo sapiens
agggccgcttctc

SEQ ID NO: 4760537 - DNA, 20 bp, Homo sapiens
agggcgcctgggtcctccca

SEQ ID NO: 4760538 - DNA, 23 bp, Homo sapiens
agggcgcctgggtcctcccagct

SEQ ID NO: 4760539 - DNA, 20 bp, Homo sapiens
agggcgctccggcagaggca

SEQ ID NO: 4760540 - DNA, 18 bp, Homo sapiens
agggcgctgagggcaggg

SEQ ID NO: 4760541 - DNA, 14 bp, Homo sapiens
agggcgggccagga

SEQ ID NO: 4760542 - DNA, 15 bp, Homo sapiens
agggctccctgccct

SEQ ID NO: 4760543 - DNA, 23 bp, Homo sapiens
agggctgacctgcctctcacaca

SEQ ID NO: 4760544 - DNA, 13 bp, Homo sapiens
agggctgagcccc

SEQ ID NO: 4760545 - DNA, 14 bp, Homo sapiens
agggctgagcccct

SEQ ID NO: 4760546 - DNA, 16 bp, Homo sapiens
agggctgagcccctcc

SEQ ID NO: 4760547 - DNA, 20 bp, Homo sapiens
agggctgagcccctcctctc

SEQ ID NO: 4760548 - DNA, 20 bp, Homo sapiens
agggctgggcgcctctgtcc

SEQ ID NO: 4760549 - DNA, 15 bp, Homo sapiens
aggggaaaacctcag

SEQ ID NO: 4760550 - DNA, 16 bp, Homo sapiens
aggggaaaacctcagt

SEQ ID NO: 4760551 - DNA, 15 bp, Homo sapiens
aggggaagagagagg

SEQ ID NO: 4760552 - DNA, 18 bp, Homo sapiens
aggggaagagagaggcct

SEQ ID NO: 4760553 - DNA, 20 bp, Homo sapiens
aggggaagctgcagcttggg

SEQ ID NO: 4760554 - DNA, 14 bp, Homo sapiens
aggggaggtggcca

SEQ ID NO: 4760555 - DNA, 20 bp, Homo sapiens
aggggaggtggccagcccgc

SEQ ID NO: 4760556 - DNA, 23 bp, Homo sapiens
aggggaggtggccagcccgcaga

SEQ ID NO: 4760557 - DNA, 16 bp, Homo sapiens
aggggatctaaaagga

SEQ ID NO: 4760558 - DNA, 24 bp, Homo sapiens
aggggatctaaaaggaggacaggg

SEQ ID NO: 4760559 - DNA, 14 bp, Homo sapiens
aggggccagaccac

SEQ ID NO: 4760560 - DNA, 14 bp, Homo sapiens
aggggccaggaagg

SEQ ID NO: 4760561 - DNA, 18 bp, Homo sapiens
aggggccaggaaggggac

SEQ ID NO: 4760562 - DNA, 21 bp, Homo sapiens
aggggccaggaaggggacagg

SEQ ID NO: 4760563 - DNA, 16 bp, Homo sapiens
aggggcctcaggtcct

SEQ ID NO: 4760564 - DNA, 20 bp, Homo sapiens
aggggcctcaggtcctactg

SEQ ID NO: 4760565 - DNA, 17 bp, Homo sapiens
aggggcctgggctgtga

SEQ ID NO: 4760566 - DNA, 21 bp, Homo sapiens
aggggcctgggctgtgaggac

SEQ ID NO: 4760567 - DNA, 20 bp, Homo sapiens
aggggcgcgcgcccccagga

SEQ ID NO: 4760568 - DNA, 22 bp, Homo sapiens
aggggcgctcctcccagctgta

SEQ ID NO: 4760569 - DNA, 22 bp, Homo sapiens
aggggcgctgcccccacagatc

SEQ ID NO: 4760570 - DNA, 18 bp, Homo sapiens
aggggctgcagccccctg

SEQ ID NO: 4760571 - DNA, 18 bp, Homo sapiens
aggggctgcatcctcagc

SEQ ID NO: 4760572 - DNA, 17 bp, Homo sapiens
aggggctggggacttcg

SEQ ID NO: 4760573 - DNA, 14 bp, Homo sapiens
aggggctggtggag

SEQ ID NO: 4760574 - DNA, 16 bp, Homo sapiens
aggggcttggagcaga

SEQ ID NO: 4760575 - DNA, 18 bp, Homo sapiens
agggggtcagttgggccc

SEQ ID NO: 4760576 - DNA, 14 bp, Homo sapiens
aggggtataggaca

SEQ ID NO: 4760577 - DNA, 15 bp, Homo sapiens
aggggtcagcagggg

SEQ ID NO: 4760578 - DNA, 16 bp, Homo sapiens
aggggtggaagggcag

SEQ ID NO: 4760579 - DNA, 18 bp, Homo sapiens
aggggtggaagggcagga

SEQ ID NO: 4760580 - DNA, 21 bp, Homo sapiens
aggggtggaagggcaggagct

SEQ ID NO: 4760581 - DNA, 17 bp, Homo sapiens
agggtacagcccaggcg

SEQ ID NO: 4760582 - DNA, 15 bp, Homo sapiens
agggtccagccctcc

SEQ ID NO: 4760583 - DNA, 16 bp, Homo sapiens
agggtccagccctccg

SEQ ID NO: 4760584 - DNA, 23 bp, Homo sapiens
agggtcctgggggctgctgcact

SEQ ID NO: 4760585 - DNA, 23 bp, Homo sapiens
agggtggcacccaccactctcag

SEQ ID NO: 4760586 - DNA, 15 bp, Homo sapiens
agggtggggcttaga

SEQ ID NO: 4760587 - DNA, 13 bp, Homo sapiens
agggtgtggcttg

SEQ ID NO: 4760588 - DNA, 21 bp, Homo sapiens
agggttaaagaaaggcagaga

SEQ ID NO: 4760589 - DNA, 12 bp, Homo sapiens
agggttccagac

SEQ ID NO: 4760590 - DNA, 13 bp, Homo sapiens
agggttccagaca

SEQ ID NO: 4760591 - DNA, 15 bp, Homo sapiens
agggttccagacagg

SEQ ID NO: 4760592 - DNA, 13 bp, Homo sapiens
agggttctagaag

SEQ ID NO: 4760593 - DNA, 14 bp, Homo sapiens
agggttctagaagg

SEQ ID NO: 4760594 - DNA, 16 bp, Homo sapiens
agggttgctggagcct

SEQ ID NO: 4760595 - DNA, 17 bp, Homo sapiens
agggttgctggagcctg

SEQ ID NO: 4760596 - DNA, 19 bp, Homo sapiens
agggttgggaaaatccaaa

SEQ ID NO: 4760597 - DNA, 22 bp, Homo sapiens
agggttgtgattttgtctgctt

SEQ ID NO: 4760598 - DNA, 16 bp, Homo sapiens
aggtaaactgatgctt

SEQ ID NO: 4760599 - DNA, 22 bp, Homo sapiens
aggtaatggatatgaaagagaa

SEQ ID NO: 4760600 - DNA, 17 bp, Homo sapiens
aggtacggtgagactct

SEQ ID NO: 4760601 - DNA, 19 bp, Homo sapiens
aggtagacttttatgagaa

SEQ ID NO: 4760602 - DNA, 20 bp, Homo sapiens
aggtagacttttatgagaac

SEQ ID NO: 4760603 - DNA, 15 bp, Homo sapiens
aggtcagagcccagg

SEQ ID NO: 4760604 - DNA, 20 bp, Homo sapiens
aggtcagtgttataaaatct

SEQ ID NO: 4760605 - DNA, 21 bp, Homo sapiens
aggtcagtgttataaaatctg

SEQ ID NO: 4760606 - DNA, 15 bp, Homo sapiens
aggtcatctgtaaaa

SEQ ID NO: 4760607 - DNA, 17 bp, Homo sapiens
aggtcatctgtaaaata

SEQ ID NO: 4760608 - DNA, 23 bp, Homo sapiens
aggtcatctgtaaaatagtctca

SEQ ID NO: 4760609 - DNA, 16 bp, Homo sapiens
aggtcccctggccctt

SEQ ID NO: 4760610 - DNA, 19 bp, Homo sapiens
aggtcccctggcccttcct

SEQ ID NO: 4760611 - DNA, 17 bp, Homo sapiens
aggtcctgcccatgtgt

SEQ ID NO: 4760612 - DNA, 20 bp, Homo sapiens
aggtcctgcccatgtgtccc

SEQ ID NO: 4760613 - DNA, 16 bp, Homo sapiens
aggtcctgctgtggaa

SEQ ID NO: 4760614 - DNA, 22 bp, Homo sapiens
aggtctacctgaaaattcaaca

SEQ ID NO: 4760615 - DNA, 12 bp, Homo sapiens
aggtctccaccc

SEQ ID NO: 4760616 - DNA, 14 bp, Homo sapiens
aggtctccacccct

SEQ ID NO: 4760617 - DNA, 15 bp, Homo sapiens
aggtctccacccctc

SEQ ID NO: 4760618 - DNA, 17 bp, Homo sapiens
aggtctccacccctcaa

SEQ ID NO: 4760619 - DNA, 16 bp, Homo sapiens
aggtctggattttcaa

SEQ ID NO: 4760620 - DNA, 22 bp, Homo sapiens
aggtctgttgaagtgcatgtta

SEQ ID NO: 4760621 - DNA, 14 bp, Homo sapiens
aggtgaaatggagg

SEQ ID NO: 4760622 - DNA, 16 bp, Homo sapiens
aggtgaacaatcaact

SEQ ID NO: 4760623 - DNA, 23 bp, Homo sapiens
aggtgaacaccactttgtctctg

SEQ ID NO: 4760624 - DNA, 23 bp, Homo sapiens
aggtgatcccccaaacagcatgt

SEQ ID NO: 4760625 - DNA, 18 bp, Homo sapiens
aggtgatgaatttaccat

SEQ ID NO: 4760626 - DNA, 15 bp, Homo sapiens
aggtgcacctgcccc

SEQ ID NO: 4760627 - DNA, 18 bp, Homo sapiens
aggtgcacctgccccagg

SEQ ID NO: 4760628 - DNA, 21 bp, Homo sapiens
aggtgcacctgccccaggctc

SEQ ID NO: 4760629 - DNA, 22 bp, Homo sapiens
aggtgcggaccggagcggctga

SEQ ID NO: 4760630 - DNA, 16 bp, Homo sapiens
aggtgctcaaaatgca

SEQ ID NO: 4760631 - DNA, 17 bp, Homo sapiens
aggtgctcaaaatgcaa

SEQ ID NO: 4760632 - DNA, 21 bp, Homo sapiens
aggtgctcataactagagtat

SEQ ID NO: 4760633 - DNA, 16 bp, Homo sapiens
aggtggggagggcctc

SEQ ID NO: 4760634 - DNA, 17 bp, Homo sapiens
aggtggggtgctggggc

SEQ ID NO: 4760635 - DNA, 15 bp, Homo sapiens
aggtggtcttggaga

SEQ ID NO: 4760636 - DNA, 18 bp, Homo sapiens
aggtggtcttggagagga

SEQ ID NO: 4760637 - DNA, 19 bp, Homo sapiens
aggtggtcttggagaggag

SEQ ID NO: 4760638 - DNA, 21 bp, Homo sapiens
aggtggtggtggtggtgaagg

SEQ ID NO: 4760639 - DNA, 15 bp, Homo sapiens
aggtgtcctgactgt

SEQ ID NO: 4760640 - DNA, 13 bp, Homo sapiens
aggtgtgccaaac

SEQ ID NO: 4760641 - DNA, 13 bp, Homo sapiens
aggtgtggagtgg

SEQ ID NO: 4760642 - DNA, 14 bp, Homo sapiens
aggtgtggagtgga

SEQ ID NO: 4760643 - DNA, 15 bp, Homo sapiens
aggtgtggagtggag

SEQ ID NO: 4760644 - DNA, 16 bp, Homo sapiens
aggtgtggagtggagg

SEQ ID NO: 4760645 - DNA, 17 bp, Homo sapiens
aggtgtggagtggaggg

SEQ ID NO: 4760646 - DNA, 12 bp, Homo sapiens
aggtgtgggccg

SEQ ID NO: 4760647 - DNA, 13 bp, Homo sapiens
aggttaagtctca

SEQ ID NO: 4760648 - DNA, 23 bp, Homo sapiens
aggttaataggaggacagaacca

SEQ ID NO: 4760649 - DNA, 13 bp, Homo sapiens
aggttactgtttt

SEQ ID NO: 4760650 - DNA, 11 bp, Homo sapiens
aggttctatga

SEQ ID NO: 4760651 - DNA, 12 bp, Homo sapiens
aggttctatgat

SEQ ID NO: 4760652 - DNA, 17 bp, Homo sapiens
aggttctgctttctgat

SEQ ID NO: 4760653 - DNA, 18 bp, Homo sapiens
aggttctgctttctgata

SEQ ID NO: 4760654 - DNA, 19 bp, Homo sapiens
aggttcttgatttttacat

SEQ ID NO: 4760655 - DNA, 16 bp, Homo sapiens
aggttggaccccagag

SEQ ID NO: 4760656 - DNA, 17 bp, Homo sapiens
aggttggaccccagaga

SEQ ID NO: 4760657 - DNA, 17 bp, Homo sapiens
aggttggagtgcattca

SEQ ID NO: 4760658 - DNA, 15 bp, Homo sapiens
aggttgtgctgcctg

SEQ ID NO: 4760659 - DNA, 20 bp, Homo sapiens
aggttgttttatagaggttc

SEQ ID NO: 4760660 - DNA, 17 bp, Homo sapiens
aggtttatttttctgtt

SEQ ID NO: 4760661 - DNA, 16 bp, Homo sapiens
aggtttcactgttcat

SEQ ID NO: 4760662 - DNA, 19 bp, Homo sapiens
aggtttcactgttcatgaa

SEQ ID NO: 4760663 - DNA, 19 bp, Homo sapiens
aggtttcagtagctccttg

SEQ ID NO: 4760664 - DNA, 21 bp, Homo sapiens
aggtttgggggacgcccagcc

SEQ ID NO: 4760665 - DNA, 18 bp, Homo sapiens
agtaaaacttgtattgga

SEQ ID NO: 4760666 - DNA, 16 bp, Homo sapiens
agtaaaattatactgt

SEQ ID NO: 4760667 - DNA, 18 bp, Homo sapiens
agtaaaattatctgttct

SEQ ID NO: 4760668 - DNA, 20 bp, Homo sapiens
agtaaataatgattcaatgt

SEQ ID NO: 4760669 - DNA, 21 bp, Homo sapiens
agtaaataatgattcaatgtg

SEQ ID NO: 4760670 - DNA, 14 bp, Homo sapiens
agtaaatacattat

SEQ ID NO: 4760671 - DNA, 18 bp, Homo sapiens
agtaaatatacactttac

SEQ ID NO: 4760672 - DNA, 21 bp, Homo sapiens
agtaaatatacactttacatt

SEQ ID NO: 4760673 - DNA, 17 bp, Homo sapiens
agtaaatcccacgacat

SEQ ID NO: 4760674 - DNA, 13 bp, Homo sapiens
agtaaatctatct

SEQ ID NO: 4760675 - DNA, 17 bp, Homo sapiens
agtaaattcctaattct

SEQ ID NO: 4760676 - DNA, 20 bp, Homo sapiens
agtaaattcctaattctatg

SEQ ID NO: 4760677 - DNA, 18 bp, Homo sapiens
agtaacacagtgcagtgc

SEQ ID NO: 4760678 - DNA, 14 bp, Homo sapiens
agtaacagtatttc

SEQ ID NO: 4760679 - DNA, 16 bp, Homo sapiens
agtaacagtatttcca

SEQ ID NO: 4760680 - DNA, 15 bp, Homo sapiens
agtaagcatttcaaa

SEQ ID NO: 4760681 - DNA, 18 bp, Homo sapiens
agtaaggaatgatattgc

SEQ ID NO: 4760682 - DNA, 13 bp, Homo sapiens
agtaatctgtata

SEQ ID NO: 4760683 - DNA, 23 bp, Homo sapiens
agtaatgtcataaagtgagaaaa

SEQ ID NO: 4760684 - DNA, 19 bp, Homo sapiens
agtaatttacaaacctctc

SEQ ID NO: 4760685 - DNA, 19 bp, Homo sapiens
agtaattttcttctcattc

SEQ ID NO: 4760686 - DNA, 15 bp, Homo sapiens
agtacaataaataaa

SEQ ID NO: 4760687 - DNA, 14 bp, Homo sapiens
agtacaattctttg

SEQ ID NO: 4760688 - DNA, 19 bp, Homo sapiens
agtacaattctttgttgct

SEQ ID NO: 4760689 - DNA, 22 bp, Homo sapiens
agtacaattctttgttgcttaa

SEQ ID NO: 4760690 - DNA, 14 bp, Homo sapiens
agtacagggcagaa

SEQ ID NO: 4760691 - DNA, 16 bp, Homo sapiens
agtacataaagtaata

SEQ ID NO: 4760692 - DNA, 20 bp, Homo sapiens
agtacataaagtaataactg

SEQ ID NO: 4760693 - DNA, 16 bp, Homo sapiens
agtacatcttgtgcat

SEQ ID NO: 4760694 - DNA, 21 bp, Homo sapiens
agtacatcttgtgcatgcaaa

SEQ ID NO: 4760695 - DNA, 22 bp, Homo sapiens
agtaccagaagccggcggagct

SEQ ID NO: 4760696 - DNA, 21 bp, Homo sapiens
agtacccaacctggtaattat

SEQ ID NO: 4760697 - DNA, 16 bp, Homo sapiens
agtacttcttctgtaa

SEQ ID NO: 4760698 - DNA, 17 bp, Homo sapiens
agtacttcttctgtaat

SEQ ID NO: 4760699 - DNA, 18 bp, Homo sapiens
agtacttcttctgtaata

SEQ ID NO: 4760700 - DNA, 15 bp, Homo sapiens
agtagaatctcagca

SEQ ID NO: 4760701 - DNA, 17 bp, Homo sapiens
agtagagtcaggagaaa

SEQ ID NO: 4760702 - DNA, 13 bp, Homo sapiens
agtagatttcatg

SEQ ID NO: 4760703 - DNA, 18 bp, Homo sapiens
agtagcattttaatagtt

SEQ ID NO: 4760704 - DNA, 20 bp, Homo sapiens
agtagcattttaatagtttc

SEQ ID NO: 4760705 - DNA, 13 bp, Homo sapiens
agtagggccctga

SEQ ID NO: 4760706 - DNA, 17 bp, Homo sapiens
agtaggtctgcacacat

SEQ ID NO: 4760707 - DNA, 16 bp, Homo sapiens
agtaggtgggtcttgg

SEQ ID NO: 4760708 - DNA, 20 bp, Homo sapiens
agtagtacttcttctgtaat

SEQ ID NO: 4760709 - DNA, 23 bp, Homo sapiens
agtagtacttcttctgtaatatt

SEQ ID NO: 4760710 - DNA, 14 bp, Homo sapiens
agtagtgcctgtga

SEQ ID NO: 4760711 - DNA, 16 bp, Homo sapiens
agtagtgcctgtgatc

SEQ ID NO: 4760712 - DNA, 19 bp, Homo sapiens
agtagtgcctgtgatcgtg

SEQ ID NO: 4760713 - DNA, 12 bp, Homo sapiens
agtagtgctatc

SEQ ID NO: 4760714 - DNA, 21 bp, Homo sapiens
agtagtgtgagtgttagaaaa

SEQ ID NO: 4760715 - DNA, 22 bp, Homo sapiens
agtagtgtgagtgttagaaaaa

SEQ ID NO: 4760716 - DNA, 20 bp, Homo sapiens
agtagtgttgggtggaggat

SEQ ID NO: 4760717 - DNA, 12 bp, Homo sapiens
agtataaattac

SEQ ID NO: 4760718 - DNA, 18 bp, Homo sapiens
agtataaattacatgcat

SEQ ID NO: 4760719 - DNA, 19 bp, Homo sapiens
agtataaattacatgcatg

SEQ ID NO: 4760720 - DNA, 17 bp, Homo sapiens
agtatacaagtgtttct

SEQ ID NO: 4760721 - DNA, 20 bp, Homo sapiens
agtatagatggtagaaactt

SEQ ID NO: 4760722 - DNA, 14 bp, Homo sapiens
agtatataagcttt

SEQ ID NO: 4760723 - DNA, 15 bp, Homo sapiens
agtatataagctttt

SEQ ID NO: 4760724 - DNA, 15 bp, Homo sapiens
agtatatatgtacag

SEQ ID NO: 4760725 - DNA, 16 bp, Homo sapiens
agtatatatgtacagt

SEQ ID NO: 4760726 - DNA, 15 bp, Homo sapiens
agtatattcaaaaat

SEQ ID NO: 4760727 - DNA, 10 bp, Homo sapiens
agtatctcat

SEQ ID NO: 4760728 - DNA, 14 bp, Homo sapiens
agtatcttaaaatt

SEQ ID NO: 4760729 - DNA, 23 bp, Homo sapiens
agtatgatttgttcctttctgga

SEQ ID NO: 4760730 - DNA, 23 bp, Homo sapiens
agtatgcactaatcaatactttg

SEQ ID NO: 4760731 - DNA, 15 bp, Homo sapiens
agtatgtcagttata

SEQ ID NO: 4760732 - DNA, 21 bp, Homo sapiens
agtatgtgtatgtacttacat

SEQ ID NO: 4760733 - DNA, 17 bp, Homo sapiens
agtattaacatcaaaga

SEQ ID NO: 4760734 - DNA, 17 bp, Homo sapiens
agtattatattaatata

SEQ ID NO: 4760735 - DNA, 17 bp, Homo sapiens
agtattatttagtaaaa

SEQ ID NO: 4760736 - DNA, 23 bp, Homo sapiens
agtattccaccttaaattaaaca

SEQ ID NO: 4760737 - DNA, 13 bp, Homo sapiens
agtattgacaata

SEQ ID NO: 4760738 - DNA, 17 bp, Homo sapiens
agtattgagacactgtc

SEQ ID NO: 4760739 - DNA, 20 bp, Homo sapiens
agtattgagacactgtcaag

SEQ ID NO: 4760740 - DNA, 21 bp, Homo sapiens
agtattgagacactgtcaaga

SEQ ID NO: 4760741 - DNA, 22 bp, Homo sapiens
agtattgttcttgtaaaactgt

SEQ ID NO: 4760742 - DNA, 12 bp, Homo sapiens
agtatttaacat

SEQ ID NO: 4760743 - DNA, 17 bp, Homo sapiens
agtatttaacattcttg

SEQ ID NO: 4760744 - DNA, 19 bp, Homo sapiens
agtatttcagatgctttag

SEQ ID NO: 4760745 - DNA, 20 bp, Homo sapiens
agtcaagacggatccacagt

SEQ ID NO: 4760746 - DNA, 17 bp, Homo sapiens
agtcaagtgtgcctgct

SEQ ID NO: 4760747 - DNA, 23 bp, Homo sapiens
agtcacatatcaagtcccgaggc

SEQ ID NO: 4760748 - DNA, 14 bp, Homo sapiens
agtcagaagatctt

SEQ ID NO: 4760749 - DNA, 22 bp, Homo sapiens
agtcagaagtttctgccgcagc

SEQ ID NO: 4760750 - DNA, 13 bp, Homo sapiens
agtcagactgaaa

SEQ ID NO: 4760751 - DNA, 14 bp, Homo sapiens
agtcagcccagtgg

SEQ ID NO: 4760752 - DNA, 15 bp, Homo sapiens
agtcagcggagagga

SEQ ID NO: 4760753 - DNA, 17 bp, Homo sapiens
agtcaggagccagcagg

SEQ ID NO: 4760754 - DNA, 16 bp, Homo sapiens
agtcagggcccagagg

SEQ ID NO: 4760755 - DNA, 15 bp, Homo sapiens
agtcagtgtactctg

SEQ ID NO: 4760756 - DNA, 14 bp, Homo sapiens
agtcatcaacaaaa

SEQ ID NO: 4760757 - DNA, 17 bp, Homo sapiens
agtcatggctgtcccct

SEQ ID NO: 4760758 - DNA, 18 bp, Homo sapiens
agtcatggctgtcccctg

SEQ ID NO: 4760759 - DNA, 22 bp, Homo sapiens
agtcatggctgtcccctgcaag

SEQ ID NO: 4760760 - DNA, 16 bp, Homo sapiens
agtcatgggagaagag

SEQ ID NO: 4760761 - DNA, 17 bp, Homo sapiens
agtcatgggagaagagg

SEQ ID NO: 4760762 - DNA, 16 bp, Homo sapiens
agtcattaaattacta

SEQ ID NO: 4760763 - DNA, 17 bp, Homo sapiens
agtcattaaattactat

SEQ ID NO: 4760764 - DNA, 21 bp, Homo sapiens
agtccacccccattgtgaatg

SEQ ID NO: 4760765 - DNA, 14 bp, Homo sapiens
agtccactttcctc

SEQ ID NO: 4760766 - DNA, 16 bp, Homo sapiens
agtccactttcctctc

SEQ ID NO: 4760767 - DNA, 18 bp, Homo sapiens
agtccactttcctctctc

SEQ ID NO: 4760768 - DNA, 19 bp, Homo sapiens
agtccactttcctctctct

SEQ ID NO: 4760769 - DNA, 15 bp, Homo sapiens
agcacccccagcctc

SEQ ID NO: 4760770 - DNA, 22 bp, Homo sapiens
agcacccccagcctcccccagg

SEQ ID NO: 4760771 - DNA, 15 bp, Homo sapiens
agcaccctctcctgg

SEQ ID NO: 4760772 - DNA, 22 bp, Homo sapiens
agcaccgtggtgtgaggccccc

SEQ ID NO: 4760773 - DNA, 13 bp, Homo sapiens
agcacctttagaa

SEQ ID NO: 4760774 - DNA, 20 bp, Homo sapiens
agcacctttctggcttttaa

SEQ ID NO: 4760775 - DNA, 17 bp, Homo sapiens
agcacgttctccagact

SEQ ID NO: 4760776 - DNA, 17 bp, Homo sapiens
agcactagaatgagaaa

SEQ ID NO: 4760777 - DNA, 18 bp, Homo sapiens
agcactagaatgagaaat

SEQ ID NO: 4760778 - DNA, 19 bp, Homo sapiens
agcactagaatgagaaatc

SEQ ID NO: 4760779 - DNA, 20 bp, Homo sapiens
agcactatcgaggtatttgg

SEQ ID NO: 4760780 - DNA, 16 bp, Homo sapiens
agcactcccagggccc

SEQ ID NO: 4760781 - DNA, 22 bp, Homo sapiens
agcactgaaaataccatcaggc

SEQ ID NO: 4760782 - DNA, 23 bp, Homo sapiens
agcacttgaccttttcgacgctt

SEQ ID NO: 4760783 - DNA, 19 bp, Homo sapiens
agcagaatgagatgattta

SEQ ID NO: 4760784 - DNA, 15 bp, Homo sapiens
agcagaattcattca

SEQ ID NO: 4760785 - DNA, 22 bp, Homo sapiens
agcagacactccagtttgccca

SEQ ID NO: 4760786 - DNA, 13 bp, Homo sapiens
agcagacagggcg

SEQ ID NO: 4760787 - DNA, 18 bp, Homo sapiens
agcagagacggcagcccc

SEQ ID NO: 4760788 - DNA, 23 bp, Homo sapiens
agcagagctgatggagaaggaag

SEQ ID NO: 4760789 - DNA, 22 bp, Homo sapiens
agcagagtcaagctgatgaagt

SEQ ID NO: 4760790 - DNA, 20 bp, Homo sapiens
agcagatcagtctttgtcaa

SEQ ID NO: 4760791 - DNA, 15 bp, Homo sapiens
agcagcggcccagat

SEQ ID NO: 4760792 - DNA, 17 bp, Homo sapiens
agcagcggcccagattg

SEQ ID NO: 4760793 - DNA, 17 bp, Homo sapiens
agcagctccaacctgga

SEQ ID NO: 4760794 - DNA, 17 bp, Homo sapiens
agcaggaaagatcccaa

SEQ ID NO: 4760795 - DNA, 16 bp, Homo sapiens
agcaggaaggcctggg

SEQ ID NO: 4760796 - DNA, 17 bp, Homo sapiens
agcaggctcgggctccc

SEQ ID NO: 4760797 - DNA, 13 bp, Homo sapiens
agcaggctctcag

SEQ ID NO: 4760798 - DNA, 14 bp, Homo sapiens
agcaggctctcagg

SEQ ID NO: 4760799 - DNA, 15 bp, Homo sapiens
agcaggctctcaggc

SEQ ID NO: 4760800 - DNA, 18 bp, Homo sapiens
agcaggctctcaggccag

SEQ ID NO: 4760801 - DNA, 23 bp, Homo sapiens
agcaggctctcaggccagctgct

SEQ ID NO: 4760802 - DNA, 17 bp, Homo sapiens
agcagggcgggccagga

SEQ ID NO: 4760803 - DNA, 18 bp, Homo sapiens
agcagggcgggccaggag

SEQ ID NO: 4760804 - DNA, 22 bp, Homo sapiens
agcaggggggttgggttccaga

SEQ ID NO: 4760805 - DNA, 16 bp, Homo sapiens
agcagtaaatgtatat

SEQ ID NO: 4760806 - DNA, 21 bp, Homo sapiens
agcagtaaatgtatattgatg

SEQ ID NO: 4760807 - DNA, 14 bp, Homo sapiens
agcagtacatcttg

SEQ ID NO: 4760808 - DNA, 20 bp, Homo sapiens
agcagtacatcttgtgcatg

SEQ ID NO: 4760809 - DNA, 15 bp, Homo sapiens
agcagtaccatccca

SEQ ID NO: 4760810 - DNA, 18 bp, Homo sapiens
agcagtcagcggagagga

SEQ ID NO: 4760811 - DNA, 19 bp, Homo sapiens
agcagtctccgctcccgca

SEQ ID NO: 4760812 - DNA, 16 bp, Homo sapiens
agcagttctgcaaata

SEQ ID NO: 4760813 - DNA, 21 bp, Homo sapiens
agcagttgctagcaacaactt

SEQ ID NO: 4760814 - DNA, 23 bp, Homo sapiens
agcagttgctagcaacaacttac

SEQ ID NO: 4760815 - DNA, 18 bp, Homo sapiens
agcagttgttatattcat

SEQ ID NO: 4760816 - DNA, 22 bp, Homo sapiens
agcagttgttatattcattctt

SEQ ID NO: 4760817 - DNA, 21 bp, Homo sapiens
agcagtttcagataaatcatg

SEQ ID NO: 4760818 - DNA, 23 bp, Homo sapiens
agcagtttcagataaatcatggg

SEQ ID NO: 4760819 - DNA, 18 bp, Homo sapiens
agcataccagttcttgca

SEQ ID NO: 4760820 - DNA, 20 bp, Homo sapiens
agcatagttctgcaataaca

SEQ ID NO: 4760821 - DNA, 14 bp, Homo sapiens
agcatataaatgtt

SEQ ID NO: 4760822 - DNA, 13 bp, Homo sapiens
agcatatataaaa

SEQ ID NO: 4760823 - DNA, 20 bp, Homo sapiens
agcatccaaggaacttcatg

SEQ ID NO: 4760824 - DNA, 24 bp, Homo sapiens
agcatccaaggaacttcatgcttg

SEQ ID NO: 4760825 - DNA, 13 bp, Homo sapiens
agcatcctggaaa

SEQ ID NO: 4760826 - DNA, 16 bp, Homo sapiens
agcatcctggaaattt

SEQ ID NO: 4760827 - DNA, 20 bp, Homo sapiens
agcatcctggaaatttgtgt

SEQ ID NO: 4760828 - DNA, 18 bp, Homo sapiens
agcatcgtgtgggtccct

SEQ ID NO: 4760829 - DNA, 18 bp, Homo sapiens
agcatctgctcttctctt

SEQ ID NO: 4760830 - DNA, 16 bp, Homo sapiens
agcatgcatttagcat

SEQ ID NO: 4760831 - DNA, 17 bp, Homo sapiens
agcatgcccaaatataa

SEQ ID NO: 4760832 - DNA, 20 bp, Homo sapiens
agcatgcccaaatataacat

SEQ ID NO: 4760833 - DNA, 19 bp, Homo sapiens
agcatgtaagaaataagtt

SEQ ID NO: 4760834 - DNA, 14 bp, Homo sapiens
agcatgtcctatcc

SEQ ID NO: 4760835 - DNA, 20 bp, Homo sapiens
agcatgtgctcagccccaga

SEQ ID NO: 4760836 - DNA, 22 bp, Homo sapiens
agcatgtgttaatcttaatgta

SEQ ID NO: 4760837 - DNA, 19 bp, Homo sapiens
agcattcccaattatcaaa

SEQ ID NO: 4760838 - DNA, 16 bp, Homo sapiens
agcattctggggtggg

SEQ ID NO: 4760839 - DNA, 12 bp, Homo sapiens
agcattgctaaa

SEQ ID NO: 4760840 - DNA, 23 bp, Homo sapiens
agcattttactgtctgtaagaga

SEQ ID NO: 4760841 - DNA, 16 bp, Homo sapiens
agccaaggaagttggt

SEQ ID NO: 4760842 - DNA, 14 bp, Homo sapiens
agccaagtgtcctg

SEQ ID NO: 4760843 - DNA, 19 bp, Homo sapiens
agccaataaagctcacact

SEQ ID NO: 4760844 - DNA, 18 bp, Homo sapiens
agccaatgaagcaaacac

SEQ ID NO: 4760845 - DNA, 14 bp, Homo sapiens
agccaccacctgga

SEQ ID NO: 4760846 - DNA, 18 bp, Homo sapiens
agccacccggatctccag

SEQ ID NO: 4760847 - DNA, 18 bp, Homo sapiens
agccacgctgtcctctcg

SEQ ID NO: 4760848 - DNA, 20 bp, Homo sapiens
agccacgctgtcctctcgag

SEQ ID NO: 4760849 - DNA, 23 bp, Homo sapiens
agccacgctgtcctctcgagccc

SEQ ID NO: 4760850 - DNA, 19 bp, Homo sapiens
agccacggggactcagccc

SEQ ID NO: 4760851 - DNA, 18 bp, Homo sapiens
agccacgttgcagaaaaa

SEQ ID NO: 4760852 - DNA, 17 bp, Homo sapiens
agccagaaactgaactg

SEQ ID NO: 4760853 - DNA, 14 bp, Homo sapiens
agccagagcctctg

SEQ ID NO: 4760854 - DNA, 15 bp, Homo sapiens
agccagaggagagag

SEQ ID NO: 4760855 - DNA, 17 bp, Homo sapiens
agccagatgacagggag

SEQ ID NO: 4760856 - DNA, 20 bp, Homo sapiens
agccagatgacagggagctg

SEQ ID NO: 4760857 - DNA, 17 bp, Homo sapiens
agccagcaggctctcag

SEQ ID NO: 4760858 - DNA, 21 bp, Homo sapiens
agccagcaggctctcaggcca

SEQ ID NO: 4760859 - DNA, 13 bp, Homo sapiens
agccagcagggcg

SEQ ID NO: 4760860 - DNA, 17 bp, Homo sapiens
agccagctctgagcaga

SEQ ID NO: 4760861 - DNA, 12 bp, Homo sapiens
agccaggagacc

SEQ ID NO: 4760862 - DNA, 13 bp, Homo sapiens
agccagggttcca

SEQ ID NO: 4760863 - DNA, 15 bp, Homo sapiens
agccagggttccaga

SEQ ID NO: 4760864 - DNA, 16 bp, Homo sapiens
agccagggttccagac

SEQ ID NO: 4760865 - DNA, 18 bp, Homo sapiens
agccaggtgtcctgactg

SEQ ID NO: 4760866 - DNA, 23 bp, Homo sapiens
agccaggttgttttatagaggtt

SEQ ID NO: 4760867 - DNA, 14 bp, Homo sapiens
agccatagccccag

SEQ ID NO: 4760868 - DNA, 16 bp, Homo sapiens
agccatagccccaggc

SEQ ID NO: 4760869 - DNA, 15 bp, Homo sapiens
agccatcagatgagg

SEQ ID NO: 4760870 - DNA, 16 bp, Homo sapiens
agccatggctggatgt

SEQ ID NO: 4760871 - DNA, 19 bp, Homo sapiens
agccatggctggatgtgca

SEQ ID NO: 4760872 - DNA, 18 bp, Homo sapiens
agccattgcttctccctc

SEQ ID NO: 4760873 - DNA, 22 bp, Homo sapiens
agccattgcttctccctcactt

SEQ ID NO: 4760874 - DNA, 22 bp, Homo sapiens
agcccaacatggggcccctctc

SEQ ID NO: 4760875 - DNA, 13 bp, Homo sapiens
agcccaaccggga

SEQ ID NO: 4760876 - DNA, 19 bp, Homo sapiens
agcccacagtatattttat

SEQ ID NO: 4760877 - DNA, 13 bp, Homo sapiens
agcccaccctgct

SEQ ID NO: 4760878 - DNA, 15 bp, Homo sapiens
agcccagagactgaa

SEQ ID NO: 4760879 - DNA, 19 bp, Homo sapiens
agcccagagactgaacggc

SEQ ID NO: 4760880 - DNA, 11 bp, Homo sapiens
agcccagagag

SEQ ID NO: 4760881 - DNA, 18 bp, Homo sapiens
agcccagagagaccctgc

SEQ ID NO: 4760882 - DNA, 20 bp, Homo sapiens
agcccagagagaccctgcca

SEQ ID NO: 4760883 - DNA, 20 bp, Homo sapiens
agcccagatggaaagacgtt

SEQ ID NO: 4760884 - DNA, 20 bp, Homo sapiens
agcccaggaattctcacagg

SEQ ID NO: 4760885 - DNA, 20 bp, Homo sapiens
agcccaggcaatagtgttga

SEQ ID NO: 4760886 - DNA, 16 bp, Homo sapiens
agcccatgtcaatcaa

SEQ ID NO: 4760887 - DNA, 19 bp, Homo sapiens
agcccatgtggctaaaaaa

SEQ ID NO: 4760888 - DNA, 16 bp, Homo sapiens
agccccaggcccgccc

SEQ ID NO: 4760889 - DNA, 20 bp, Homo sapiens
agccccaggcccgccctgcc

SEQ ID NO: 4760890 - DNA, 19 bp, Homo sapiens
agctaccaggaagaggggc

SEQ ID NO: 4760891 - DNA, 15 bp, Homo sapiens
agctagagaaattct

SEQ ID NO: 4760892 - DNA, 22 bp, Homo sapiens
agctagaggagattgctctggg

SEQ ID NO: 4760893 - DNA, 20 bp, Homo sapiens
agctagtgttaatccagaga

SEQ ID NO: 4760894 - DNA, 22 bp, Homo sapiens
agctagtgttaatccagagaac

SEQ ID NO: 4760895 - DNA, 16 bp, Homo sapiens
agctagttagctcaca

SEQ ID NO: 4760896 - DNA, 17 bp, Homo sapiens
agctagtttaaaattat

SEQ ID NO: 4760897 - DNA, 18 bp, Homo sapiens
agctagtttaaaattatt

SEQ ID NO: 4760898 - DNA, 21 bp, Homo sapiens
agctataaaagcccatgctta

SEQ ID NO: 4760899 - DNA, 17 bp, Homo sapiens
agctatcttcatgtaaa

SEQ ID NO: 4760900 - DNA, 20 bp, Homo sapiens
agctatcttcatgtaaattg

SEQ ID NO: 4760901 - DNA, 21 bp, Homo sapiens
agctatgaagagctagagaaa

SEQ ID NO: 4760902 - DNA, 16 bp, Homo sapiens
agctatgatatgtgct

SEQ ID NO: 4760903 - DNA, 18 bp, Homo sapiens
agctatgatatgtgcttg

SEQ ID NO: 4760904 - DNA, 17 bp, Homo sapiens
agctatgcgcaatgtgg

SEQ ID NO: 4760905 - DNA, 20 bp, Homo sapiens
agctatgctgtatctgtgct

SEQ ID NO: 4760906 - DNA, 15 bp, Homo sapiens
agctattcacacaca

SEQ ID NO: 4760907 - DNA, 22 bp, Homo sapiens
agctatttaagtggactgtatt

SEQ ID NO: 4760908 - DNA, 23 bp, Homo sapiens
agctatttaagtggactgtattt

SEQ ID NO: 4760909 - DNA, 21 bp, Homo sapiens
agctcacaagccgtgttttat

SEQ ID NO: 4760910 - DNA, 13 bp, Homo sapiens
agctcacagcaca

SEQ ID NO: 4760911 - DNA, 16 bp, Homo sapiens
agctcacagcacattt

SEQ ID NO: 4760912 - DNA, 19 bp, Homo sapiens
agctcacagcacatttgtt

SEQ ID NO: 4760913 - DNA, 21 bp, Homo sapiens
agctcaggagaaggcctgccc

SEQ ID NO: 4760914 - DNA, 22 bp, Homo sapiens
agctcaggagaaggcctgcccc

SEQ ID NO: 4760915 - DNA, 14 bp, Homo sapiens
agctcaggggcagc

SEQ ID NO: 4760916 - DNA, 20 bp, Homo sapiens
agctcagtcccacagcccct

SEQ ID NO: 4760917 - DNA, 20 bp, Homo sapiens
agctcatagagtcccccctc

SEQ ID NO: 4760918 - DNA, 16 bp, Homo sapiens
agctcatagcacatgt

SEQ ID NO: 4760919 - DNA, 22 bp, Homo sapiens
agctcatagcacatgttttaca

SEQ ID NO: 4760920 - DNA, 17 bp, Homo sapiens
agctccaacctggaggc

SEQ ID NO: 4760921 - DNA, 18 bp, Homo sapiens
agctccaacctggaggct

SEQ ID NO: 4760922 - DNA, 19 bp, Homo sapiens
agctccaacctggaggctg

SEQ ID NO: 4760923 - DNA, 16 bp, Homo sapiens
agctccctttttgaat

SEQ ID NO: 4760924 - DNA, 21 bp, Homo sapiens
agctccctttttgaattgtgt

SEQ ID NO: 4760925 - DNA, 21 bp, Homo sapiens
agctccgagtggctcccgtgt

SEQ ID NO: 4760926 - DNA, 20 bp, Homo sapiens
agctccttggttttgcctct

SEQ ID NO: 4760927 - DNA, 14 bp, Homo sapiens
agctcgtgtgctta

SEQ ID NO: 4760928 - DNA, 15 bp, Homo sapiens
agctctaaagcagag

SEQ ID NO: 4760929 - DNA, 18 bp, Homo sapiens
agctctaaagcagagatg

SEQ ID NO: 4760930 - DNA, 14 bp, Homo sapiens
agctctccctcaca

SEQ ID NO: 4760931 - DNA, 15 bp, Homo sapiens
agctctcctccagcc

SEQ ID NO: 4760932 - DNA, 14 bp, Homo sapiens
agctctgcataaga

SEQ ID NO: 4760933 - DNA, 22 bp, Homo sapiens
agctctgcataagattatatac

SEQ ID NO: 4760934 - DNA, 17 bp, Homo sapiens
agctctgtagcctggtc

SEQ ID NO: 4760935 - DNA, 21 bp, Homo sapiens
agctctgtagcctggtctgtg

SEQ ID NO: 4760936 - DNA, 22 bp, Homo sapiens
agctctgtagcctggtctgtgc

SEQ ID NO: 4760937 - DNA, 19 bp, Homo sapiens
agctgagtcggctgggcag

SEQ ID NO: 4760938 - DNA, 23 bp, Homo sapiens
agctgagtcggctgggcagggcc

SEQ ID NO: 4760939 - DNA, 19 bp, Homo sapiens
agctgataaagaaaccttt

SEQ ID NO: 4760940 - DNA, 21 bp, Homo sapiens
agctgatagaagaaggactga

SEQ ID NO: 4760941 - DNA, 20 bp, Homo sapiens
agctgatagtgtttcgttaa

SEQ ID NO: 4760942 - DNA, 17 bp, Homo sapiens
agctgatggagaaggaa

SEQ ID NO: 4760943 - DNA, 18 bp, Homo sapiens
agctgcaccagcaggtgc

SEQ ID NO: 4760944 - DNA, 14 bp, Homo sapiens
agctgcagcttggg

SEQ ID NO: 4760945 - DNA, 16 bp, Homo sapiens
agctgcaggaatcaaa

SEQ ID NO: 4760946 - DNA, 13 bp, Homo sapiens
agctgccacctgc

SEQ ID NO: 4760947 - DNA, 19 bp, Homo sapiens
agctgccagccttcccttc

SEQ ID NO: 4760948 - DNA, 13 bp, Homo sapiens
agctgctcctaga

SEQ ID NO: 4760949 - DNA, 17 bp, Homo sapiens
agctgctcctagagggg

SEQ ID NO: 4760950 - DNA, 14 bp, Homo sapiens
agctgctgccgcct

SEQ ID NO: 4760951 - DNA, 19 bp, Homo sapiens
agctgctgccgcctcacct

SEQ ID NO: 4760952 - DNA, 22 bp, Homo sapiens
agctgctgtatttgaggaaact

SEQ ID NO: 4760953 - DNA, 16 bp, Homo sapiens
agctgcttgggcttca

SEQ ID NO: 4760954 - DNA, 15 bp, Homo sapiens
agctggactgggtgg

SEQ ID NO: 4760955 - DNA, 15 bp, Homo sapiens
agctggagtgcagtg

SEQ ID NO: 4760956 - DNA, 18 bp, Homo sapiens
agctggcaaactgtgaat

SEQ ID NO: 4760957 - DNA, 12 bp, Homo sapiens
agctggcagcgc

SEQ ID NO: 4760958 - DNA, 15 bp, Homo sapiens
agctggggggctgtc

SEQ ID NO: 4760959 - DNA, 17 bp, Homo sapiens
agctggggggctgtcct

SEQ ID NO: 4760960 - DNA, 22 bp, Homo sapiens
agctggggtggggacctcaggc

SEQ ID NO: 4760961 - DNA, 21 bp, Homo sapiens
agctgggttggtatggagttg

SEQ ID NO: 4760962 - DNA, 14 bp, Homo sapiens
agctggtgaatcca

SEQ ID NO: 4760963 - DNA, 11 bp, Homo sapiens
agctgtatcaa

SEQ ID NO: 4760964 - DNA, 21 bp, Homo sapiens
agctgtattatcttaaaccca

SEQ ID NO: 4760965 - DNA, 21 bp, Homo sapiens
agctgtcctctcagaactcct

SEQ ID NO: 4760966 - DNA, 19 bp, Homo sapiens
agctgttccacttctctag

SEQ ID NO: 4760967 - DNA, 15 bp, Homo sapiens
agctgttctttttga

SEQ ID NO: 4760968 - DNA, 18 bp, Homo sapiens
agctgttttggatgaatg

SEQ ID NO: 4760969 - DNA, 12 bp, Homo sapiens
agcttaatgtct

SEQ ID NO: 4760970 - DNA, 13 bp, Homo sapiens
agcttacctgaca

SEQ ID NO: 4760971 - DNA, 15 bp, Homo sapiens
agcttacctgacaca

SEQ ID NO: 4760972 - DNA, 11 bp, Homo sapiens
agcttccagat

SEQ ID NO: 4760973 - DNA, 16 bp, Homo sapiens
agcttgcttctctgcc

SEQ ID NO: 4760974 - DNA, 15 bp, Homo sapiens
agcttggagtgccac

SEQ ID NO: 4760975 - DNA, 18 bp, Homo sapiens
agcttgggagagcccctg

SEQ ID NO: 4760976 - DNA, 24 bp, Homo sapiens
agcttgggagagcccctggggcct

SEQ ID NO: 4760977 - DNA, 17 bp, Homo sapiens
agcttggtggttatgtc

SEQ ID NO: 4760978 - DNA, 20 bp, Homo sapiens
agctttataataaactgttt

SEQ ID NO: 4760979 - DNA, 15 bp, Homo sapiens
agctttcctgggtct

SEQ ID NO: 4760980 - DNA, 19 bp, Homo sapiens
agctttctctttgttcttc

SEQ ID NO: 4760981 - DNA, 16 bp, Homo sapiens
agctttctgatactta

SEQ ID NO: 4760982 - DNA, 23 bp, Homo sapiens
agctttgcaaccttgtactttac

SEQ ID NO: 4760983 - DNA, 13 bp, Homo sapiens
aggaaaaaaactt

SEQ ID NO: 4760984 - DNA, 17 bp, Homo sapiens
aggaaaaaaacttttat

SEQ ID NO: 4760985 - DNA, 12 bp, Homo sapiens
aggaaaactgtt

SEQ ID NO: 4760986 - DNA, 21 bp, Homo sapiens
aggaaaaggcttgagtctgga

SEQ ID NO: 4760987 - DNA, 20 bp, Homo sapiens
aggaaaagggcattttgtac

SEQ ID NO: 4760988 - DNA, 16 bp, Homo sapiens
aggaaagaggctctgg

SEQ ID NO: 4760989 - DNA, 17 bp, Homo sapiens
aggaaagatcccaagtc

SEQ ID NO: 4760990 - DNA, 20 bp, Homo sapiens
aggaaagatcccaagtcaaa

SEQ ID NO: 4760991 - DNA, 17 bp, Homo sapiens
aggaaagcaaaggagat

SEQ ID NO: 4760992 - DNA, 13 bp, Homo sapiens
aggaaagccctcc

SEQ ID NO: 4760993 - DNA, 17 bp, Homo sapiens
aggaaagccctccccct

SEQ ID NO: 4760994 - DNA, 16 bp, Homo sapiens
aggaaagcctcactga

SEQ ID NO: 4760995 - DNA, 13 bp, Homo sapiens
aggaaagttctat

SEQ ID NO: 4760996 - DNA, 14 bp, Homo sapiens
aggaaataaatcta

SEQ ID NO: 4760997 - DNA, 16 bp, Homo sapiens
aggaaatagtgttctt

SEQ ID NO: 4760998 - DNA, 18 bp, Homo sapiens
aggaaatagtgttctttt

SEQ ID NO: 4760999 - DNA, 13 bp, Homo sapiens
aggaaatatctgt

SEQ ID NO: 4761000 - DNA, 22 bp, Homo sapiens
aggaaatatctgtgaaggactt

SEQ ID NO: 4761001 - DNA, 18 bp, Homo sapiens
aggaaatctgaagccttt

SEQ ID NO: 4761002 - DNA, 19 bp, Homo sapiens
aggaacagagtatatatgt

SEQ ID NO: 4761003 - DNA, 18 bp, Homo sapiens
aggaacccatcactgtgt

SEQ ID NO: 4761004 - DNA, 21 bp, Homo sapiens
aggaacctctgatttattttg

SEQ ID NO: 4761005 - DNA, 17 bp, Homo sapiens
aggaagacagttctaca

SEQ ID NO: 4761006 - DNA, 17 bp, Homo sapiens
aggaagcacatgcctct

SEQ ID NO: 4761007 - DNA, 24 bp, Homo sapiens
aggaagcacatgcctctctcaggc

SEQ ID NO: 4761008 - DNA, 21 bp, Homo sapiens
aggaagccagcaggctctcag

SEQ ID NO: 4761009 - DNA, 14 bp, Homo sapiens
aggaaggacatttc

SEQ ID NO: 4761010 - DNA, 18 bp, Homo sapiens
aggaaggggacaggattg

SEQ ID NO: 4761011 - DNA, 20 bp, Homo sapiens
aggccaaaggaagcacatgc

SEQ ID NO: 4761012 - DNA, 15 bp, Homo sapiens
aggccaaatattgat

SEQ ID NO: 4761013 - DNA, 16 bp, Homo sapiens
aggccacccccacctc

SEQ ID NO: 4761014 - DNA, 14 bp, Homo sapiens
aggccagctgcttg

SEQ ID NO: 4761015 - DNA, 16 bp, Homo sapiens
aggccagctgcttggg

SEQ ID NO: 4761016 - DNA, 23 bp, Homo sapiens
aggccagctgcttgggcttcatc

SEQ ID NO: 4761017 - DNA, 13 bp, Homo sapiens
aggcccagcctgg

SEQ ID NO: 4761018 - DNA, 18 bp, Homo sapiens
aggcccagcctggcccca

SEQ ID NO: 4761019 - DNA, 21 bp, Homo sapiens
aggcccccggaggcgcccacc

SEQ ID NO: 4761020 - DNA, 12 bp, Homo sapiens
aggcccctgagg

SEQ ID NO: 4761021 - DNA, 22 bp, Homo sapiens
aggcccctgagggacgagcaga

SEQ ID NO: 4761022 - DNA, 15 bp, Homo sapiens
aggccctctctgcag

SEQ ID NO: 4761023 - DNA, 16 bp, Homo sapiens
aggccctctctgcagt

SEQ ID NO: 4761024 - DNA, 18 bp, Homo sapiens
aggccctctctgcagtcc

SEQ ID NO: 4761025 - DNA, 13 bp, Homo sapiens
aggccggccagcc

SEQ ID NO: 4761026 - DNA, 22 bp, Homo sapiens
aggcctaatctcatacctctga

SEQ ID NO: 4761027 - DNA, 13 bp, Homo sapiens
aggcctcacctgg

SEQ ID NO: 4761028 - DNA, 17 bp, Homo sapiens
aggcctcacctggcttc

SEQ ID NO: 4761029 - DNA, 16 bp, Homo sapiens
aggcctcagggaccaa

SEQ ID NO: 4761030 - DNA, 21 bp, Homo sapiens
aggcctcagggaccaaggaga

SEQ ID NO: 4761031 - DNA, 22 bp, Homo sapiens
aggcctcagggaccaaggagat

SEQ ID NO: 4761032 - DNA, 21 bp, Homo sapiens
aggcctcccgcatgctgcctg

SEQ ID NO: 4761033 - DNA, 17 bp, Homo sapiens
aggcctgagggaagccc

SEQ ID NO: 4761034 - DNA, 18 bp, Homo sapiens
aggcctgccccccttccc

SEQ ID NO: 4761035 - DNA, 10 bp, Homo sapiens
aggcctggcc

SEQ ID NO: 4761036 - DNA, 13 bp, Homo sapiens
aggcctggcccag

SEQ ID NO: 4761037 - DNA, 15 bp, Homo sapiens
aggcctggcccagcc

SEQ ID NO: 4761038 - DNA, 18 bp, Homo sapiens
aggcctggcccagccagc

SEQ ID NO: 4761039 - DNA, 19 bp, Homo sapiens
aggcctggcccagccagca

SEQ ID NO: 4761040 - DNA, 16 bp, Homo sapiens
aggcctggctctggag

SEQ ID NO: 4761041 - DNA, 13 bp, Homo sapiens
aggcctgggtgtg

SEQ ID NO: 4761042 - DNA, 19 bp, Homo sapiens
aggcctgggtgtgacctga

SEQ ID NO: 4761043 - DNA, 15 bp, Homo sapiens
aggcctggtctggag

SEQ ID NO: 4761044 - DNA, 21 bp, Homo sapiens
aggcctggtctggagccccta

SEQ ID NO: 4761045 - DNA, 24 bp, Homo sapiens
aggcctggtctggagcccctatcc

SEQ ID NO: 4761046 - DNA, 14 bp, Homo sapiens
aggcgcccacctgc

SEQ ID NO: 4761047 - DNA, 15 bp, Homo sapiens
aggcgcccacctgcc

SEQ ID NO: 4761048 - DNA, 16 bp, Homo sapiens
aggcgcccacctgccc

SEQ ID NO: 4761049 - DNA, 21 bp, Homo sapiens
aggcgcccacctgcccagtta

SEQ ID NO: 4761050 - DNA, 16 bp, Homo sapiens
aggcgccgcctcgccc

SEQ ID NO: 4761051 - DNA, 14 bp, Homo sapiens
aggcgcgcaccgcc

SEQ ID NO: 4761052 - DNA, 16 bp, Homo sapiens
aggcgcgcaccgccca

SEQ ID NO: 4761053 - DNA, 21 bp, Homo sapiens
aggcgcgcaccgcccaacccc

SEQ ID NO: 4761054 - DNA, 23 bp, Homo sapiens
aggcggaggggcttggagcagag

SEQ ID NO: 4761055 - DNA, 17 bp, Homo sapiens
aggcggtcactgcccac

SEQ ID NO: 4761056 - DNA, 23 bp, Homo sapiens
aggcggtcactgcccacctgcca

SEQ ID NO: 4761057 - DNA, 17 bp, Homo sapiens
aggcgtcttgtattttc

SEQ ID NO: 4761058 - DNA, 13 bp, Homo sapiens
aggcgtgggatcc

SEQ ID NO: 4761059 - DNA, 22 bp, Homo sapiens
aggcgtgggatccagagagaag

SEQ ID NO: 4761060 - DNA, 18 bp, Homo sapiens
aggctagtccggacccac

SEQ ID NO: 4761061 - DNA, 15 bp, Homo sapiens
aggctcaggctgccc

SEQ ID NO: 4761062 - DNA, 23 bp, Homo sapiens
aggctctgagactaaatgagagg

SEQ ID NO: 4761063 - DNA, 23 bp, Homo sapiens
aggctgatgccgtgcgggctaat

SEQ ID NO: 4761064 - DNA, 20 bp, Homo sapiens
aggctgcagctaatttgtga

SEQ ID NO: 4761065 - DNA, 22 bp, Homo sapiens
aggctgcagctaatttgtgaaa

SEQ ID NO: 4761066 - DNA, 17 bp, Homo sapiens
aggctgccccaggggca

SEQ ID NO: 4761067 - DNA, 21 bp, Homo sapiens
aggctgccgctgctctcccag

SEQ ID NO: 4761068 - DNA, 16 bp, Homo sapiens
aggctgcgcctgcccg

SEQ ID NO: 4761069 - DNA, 15 bp, Homo sapiens
aggctggaccaactg

SEQ ID NO: 4761070 - DNA, 18 bp, Homo sapiens
aggctggataggagagga

SEQ ID NO: 4761071 - DNA, 16 bp, Homo sapiens
aggctggatgtgcttt

SEQ ID NO: 4761072 - DNA, 20 bp, Homo sapiens
aggctggatgtgctttcatc

SEQ ID NO: 4761073 - DNA, 12 bp, Homo sapiens
aggctgggcccc

SEQ ID NO: 4761074 - DNA, 15 bp, Homo sapiens
aggctgggcccctgg

SEQ ID NO: 4761075 - DNA, 13 bp, Homo sapiens
aggctggggacac

SEQ ID NO: 4761076 - DNA, 20 bp, Homo sapiens
aggctgtcaattacaggaag

SEQ ID NO: 4761077 - DNA, 21 bp, Homo sapiens
aggctgtcaattacaggaagt

SEQ ID NO: 4761078 - DNA, 16 bp, Homo sapiens
aggctgttctgcactg

SEQ ID NO: 4761079 - DNA, 15 bp, Homo sapiens
aggcttccaatgtgg

SEQ ID NO: 4761080 - DNA, 13 bp, Homo sapiens
aggcttccagctc

SEQ ID NO: 4761081 - DNA, 16 bp, Homo sapiens
aggcttccagctcagt

SEQ ID NO: 4761082 - DNA, 20 bp, Homo sapiens
aggcttcgtttgcctccaga

SEQ ID NO: 4761083 - DNA, 12 bp, Homo sapiens
aggcttctccac

SEQ ID NO: 4761084 - DNA, 21 bp, Homo sapiens
aggcttgtgtaatttcctgct

SEQ ID NO: 4761085 - DNA, 20 bp, Homo sapiens
aggctttcggaattcctgca

SEQ ID NO: 4761086 - DNA, 17 bp, Homo sapiens
aggctttctattggcat

SEQ ID NO: 4761087 - DNA, 20 bp, Homo sapiens
agggaaaacataatatcttg

SEQ ID NO: 4761088 - DNA, 20 bp, Homo sapiens
agggaaacccggggaactgg

SEQ ID NO: 4761089 - DNA, 22 bp, Homo sapiens
agggaaatcaatttaaaggaaa

SEQ ID NO: 4761090 - DNA, 16 bp, Homo sapiens
agggaaatccaactcc

SEQ ID NO: 4761091 - DNA, 13 bp, Homo sapiens
agggaaatgctgt

SEQ ID NO: 4761092 - DNA, 15 bp, Homo sapiens
agggaaccagagcga

SEQ ID NO: 4761093 - DNA, 16 bp, Homo sapiens
agggaagcccacccgc

SEQ ID NO: 4761094 - DNA, 21 bp, Homo sapiens
agggaagcccacccgccccag

SEQ ID NO: 4761095 - DNA, 13 bp, Homo sapiens
agggaagccctga

SEQ ID NO: 4761096 - DNA, 21 bp, Homo sapiens
agggaagctgatacagagaga

SEQ ID NO: 4761097 - DNA, 18 bp, Homo sapiens
agggacacagaggacagc

SEQ ID NO: 4761098 - DNA, 17 bp, Homo sapiens
agggacactacaaacat

SEQ ID NO: 4761099 - DNA, 20 bp, Homo sapiens
agggacagttgggtgtgaga

SEQ ID NO: 4761100 - DNA, 20 bp, Homo sapiens
agggaccccagatacctgtg

SEQ ID NO: 4761101 - DNA, 22 bp, Homo sapiens
agggaccccagatacctgtgag

SEQ ID NO: 4761102 - DNA, 21 bp, Homo sapiens
agggacggggcccgccccagg

SEQ ID NO: 4761103 - DNA, 14 bp, Homo sapiens
agggactccaagcc

SEQ ID NO: 4761104 - DNA, 21 bp, Homo sapiens
agggactccagaagcagcagc

SEQ ID NO: 4761105 - DNA, 16 bp, Homo sapiens
agggactgcctctgcc

SEQ ID NO: 4761106 - DNA, 23 bp, Homo sapiens
agggactttggaattctgcttct

SEQ ID NO: 4761107 - DNA, 20 bp, Homo sapiens
agggaggaggcagagaagaa

SEQ ID NO: 4761108 - DNA, 13 bp, Homo sapiens
agggaggggaaga

SEQ ID NO: 4761109 - DNA, 14 bp, Homo sapiens
agggaggggccctg

SEQ ID NO: 4761110 - DNA, 18 bp, Homo sapiens
agggaggtcaggccctgg

SEQ ID NO: 4761111 - DNA, 16 bp, Homo sapiens
agggatacccatccca

SEQ ID NO: 4761112 - DNA, 17 bp, Homo sapiens
agggatccagagacctg

SEQ ID NO: 4761113 - DNA, 14 bp, Homo sapiens
agaccacttcctta

SEQ ID NO: 4761114 - DNA, 15 bp, Homo sapiens
agaccacttccttaa

SEQ ID NO: 4761115 - DNA, 17 bp, Homo sapiens
agaccacttccttaaca

SEQ ID NO: 4761116 - DNA, 20 bp, Homo sapiens
agaccacttccttaacagct

SEQ ID NO: 4761117 - DNA, 18 bp, Homo sapiens
agaccagcatagttctgc

SEQ ID NO: 4761118 - DNA, 21 bp, Homo sapiens
agaccatgcattcagatctga

SEQ ID NO: 4761119 - DNA, 17 bp, Homo sapiens
agacccctaccctttcc

SEQ ID NO: 4761120 - DNA, 13 bp, Homo sapiens
agacccctgggtg

SEQ ID NO: 4761121 - DNA, 23 bp, Homo sapiens
agacccctgggtgggccctgccg

SEQ ID NO: 4761122 - DNA, 18 bp, Homo sapiens
agaccctaggtgctcata

SEQ ID NO: 4761123 - DNA, 18 bp, Homo sapiens
agaccctatctcccacaa

SEQ ID NO: 4761124 - DNA, 12 bp, Homo sapiens
agaccctgccag

SEQ ID NO: 4761125 - DNA, 18 bp, Homo sapiens
agaccctgcgcccctgcc

SEQ ID NO: 4761126 - DNA, 13 bp, Homo sapiens
agaccctgtcttt

SEQ ID NO: 4761127 - DNA, 16 bp, Homo sapiens
agaccctgtctttgct

SEQ ID NO: 4761128 - DNA, 21 bp, Homo sapiens
agaccctgtctttgctgttta

SEQ ID NO: 4761129 - DNA, 14 bp, Homo sapiens
agaccgatccttcc

SEQ ID NO: 4761130 - DNA, 16 bp, Homo sapiens
agaccgatccttccca

SEQ ID NO: 4761131 - DNA, 23 bp, Homo sapiens
agacctccagattattttctata

SEQ ID NO: 4761132 - DNA, 17 bp, Homo sapiens
agacctcccccagggag

SEQ ID NO: 4761133 - DNA, 19 bp, Homo sapiens
agacctcccccagggaggg

SEQ ID NO: 4761134 - DNA, 14 bp, Homo sapiens
agacctcctgatgt

SEQ ID NO: 4761135 - DNA, 12 bp, Homo sapiens
agacctgctcca

SEQ ID NO: 4761136 - DNA, 15 bp, Homo sapiens
agacctgctccagat

SEQ ID NO: 4761137 - DNA, 18 bp, Homo sapiens
agaccttctgaagatctc

SEQ ID NO: 4761138 - DNA, 19 bp, Homo sapiens
agaccttctgaagatctca

SEQ ID NO: 4761139 - DNA, 14 bp, Homo sapiens
agacggcagcccca

SEQ ID NO: 4761140 - DNA, 17 bp, Homo sapiens
agacgttaccaattatg

SEQ ID NO: 4761141 - DNA, 22 bp, Homo sapiens
agacgtttttgtgctgtgggca

SEQ ID NO: 4761142 - DNA, 14 bp, Homo sapiens
agactaaatgagag

SEQ ID NO: 4761143 - DNA, 23 bp, Homo sapiens
agactaacttattttgattgttt

SEQ ID NO: 4761144 - DNA, 15 bp, Homo sapiens
agactactggcctct

SEQ ID NO: 4761145 - DNA, 12 bp, Homo sapiens
agactatgtgtc

SEQ ID NO: 4761146 - DNA, 16 bp, Homo sapiens
agactctatgctctgg

SEQ ID NO: 4761147 - DNA, 19 bp, Homo sapiens
agactctatgctctggaaa

SEQ ID NO: 4761148 - DNA, 17 bp, Homo sapiens
agactctctcctctctc

SEQ ID NO: 4761149 - DNA, 21 bp, Homo sapiens
agactctctcctctctctccc

SEQ ID NO: 4761150 - DNA, 17 bp, Homo sapiens
agactctgtaacatcac

SEQ ID NO: 4761151 - DNA, 21 bp, Homo sapiens
agactgagcttgattctaaag

SEQ ID NO: 4761152 - DNA, 19 bp, Homo sapiens
agactgcccaccctgggcc

SEQ ID NO: 4761153 - DNA, 23 bp, Homo sapiens
agactgccttatattattttctg

SEQ ID NO: 4761154 - DNA, 20 bp, Homo sapiens
agactggaggcatttctttt

SEQ ID NO: 4761155 - DNA, 22 bp, Homo sapiens
agactggaggcatttcttttta

SEQ ID NO: 4761156 - DNA, 21 bp, Homo sapiens
agactgtgggtccctgcgtct

SEQ ID NO: 4761157 - DNA, 20 bp, Homo sapiens
agacttcaaaatattgagca

SEQ ID NO: 4761158 - DNA, 18 bp, Homo sapiens
agacttccagctttctct

SEQ ID NO: 4761159 - DNA, 17 bp, Homo sapiens
agacttcctattaattt

SEQ ID NO: 4761160 - DNA, 22 bp, Homo sapiens
agacttcctattaatttattaa

SEQ ID NO: 4761161 - DNA, 19 bp, Homo sapiens
agacttcgctattcccagg

SEQ ID NO: 4761162 - DNA, 18 bp, Homo sapiens
agacttctaaaataaatg

SEQ ID NO: 4761163 - DNA, 20 bp, Homo sapiens
agacttctaaaataaatgtt

SEQ ID NO: 4761164 - DNA, 21 bp, Homo sapiens
agacttctaaaataaatgttt

SEQ ID NO: 4761165 - DNA, 16 bp, Homo sapiens
agacttctaaatcata

SEQ ID NO: 4761166 - DNA, 21 bp, Homo sapiens
agacttgcagttagactcaaa

SEQ ID NO: 4761167 - DNA, 20 bp, Homo sapiens
agactttaattcttctcttt

SEQ ID NO: 4761168 - DNA, 19 bp, Homo sapiens
agacttttctttcagccaa

SEQ ID NO: 4761169 - DNA, 16 bp, Homo sapiens
agagaaaaaaaaatat

SEQ ID NO: 4761170 - DNA, 18 bp, Homo sapiens
agagaaaaaaaaatatgt

SEQ ID NO: 4761171 - DNA, 19 bp, Homo sapiens
agagaaaagattaaaatta

SEQ ID NO: 4761172 - DNA, 16 bp, Homo sapiens
agagaaaatgctttct

SEQ ID NO: 4761173 - DNA, 12 bp, Homo sapiens
agagaaatgaaa

SEQ ID NO: 4761174 - DNA, 13 bp, Homo sapiens
agagaagaaagaa

SEQ ID NO: 4761175 - DNA, 15 bp, Homo sapiens
agagaagccacgctg

SEQ ID NO: 4761176 - DNA, 19 bp, Homo sapiens
agagacaacttgctccttt

SEQ ID NO: 4761177 - DNA, 15 bp, Homo sapiens
agagacacaagcctt

SEQ ID NO: 4761178 - DNA, 16 bp, Homo sapiens
agagacacaagccttc

SEQ ID NO: 4761179 - DNA, 20 bp, Homo sapiens
agagaccaccgcgcccctct

SEQ ID NO: 4761180 - DNA, 17 bp, Homo sapiens
agagaccacttccttaa

SEQ ID NO: 4761181 - DNA, 13 bp, Homo sapiens
agagaccctgcca

SEQ ID NO: 4761182 - DNA, 14 bp, Homo sapiens
agagaccctgccaa

SEQ ID NO: 4761183 - DNA, 22 bp, Homo sapiens
agagacgaggtgtcttccttcc

SEQ ID NO: 4761184 - DNA, 14 bp, Homo sapiens
agagacggcagccc

SEQ ID NO: 4761185 - DNA, 20 bp, Homo sapiens
agagacggcagccccatcct

SEQ ID NO: 4761186 - DNA, 18 bp, Homo sapiens
agagactatggagcctgg

SEQ ID NO: 4761187 - DNA, 19 bp, Homo sapiens
agagactgcccaccctggg

SEQ ID NO: 4761188 - DNA, 19 bp, Homo sapiens
agagacttgcagttagact

SEQ ID NO: 4761189 - DNA, 15 bp, Homo sapiens
agagagaccctgcca

SEQ ID NO: 4761190 - DNA, 11 bp, Homo sapiens
agagagaggcc

SEQ ID NO: 4761191 - DNA, 14 bp, Homo sapiens
agagagaggcctgg

SEQ ID NO: 4761192 - DNA, 20 bp, Homo sapiens
agagagcaaagatggcttcc

SEQ ID NO: 4761193 - DNA, 17 bp, Homo sapiens
agagagcggcttcccca

SEQ ID NO: 4761194 - DNA, 23 bp, Homo sapiens
agagagcggcttccccatcgcct

SEQ ID NO: 4761195 - DNA, 11 bp, Homo sapiens
agagaggcctg

SEQ ID NO: 4761196 - DNA, 16 bp, Homo sapiens
agagagtatggtgctg

SEQ ID NO: 4761197 - DNA, 22 bp, Homo sapiens
agagagtatggtgctgggtcct

SEQ ID NO: 4761198 - DNA, 14 bp, Homo sapiens
agagatatatctga

SEQ ID NO: 4761199 - DNA, 16 bp, Homo sapiens
agagatatatctgaaa

SEQ ID NO: 4761200 - DNA, 16 bp, Homo sapiens
agagatattttgtaaa

SEQ ID NO: 4761201 - DNA, 14 bp, Homo sapiens
agagatgttttcaa

SEQ ID NO: 4761202 - DNA, 17 bp, Homo sapiens
agagattaatttgtgta

SEQ ID NO: 4761203 - DNA, 19 bp, Homo sapiens
agagattaatttgtgtaga

SEQ ID NO: 4761204 - DNA, 19 bp, Homo sapiens
agagattgggggggcttgg

SEQ ID NO: 4761205 - DNA, 14 bp, Homo sapiens
agagattttatgtt

SEQ ID NO: 4761206 - DNA, 18 bp, Homo sapiens
agagcaagaccccatctc

SEQ ID NO: 4761207 - DNA, 15 bp, Homo sapiens
agagcacaatattaa

SEQ ID NO: 4761208 - DNA, 16 bp, Homo sapiens
agagcagcctcttgaa

SEQ ID NO: 4761209 - DNA, 14 bp, Homo sapiens
agagcattctgggg

SEQ ID NO: 4761210 - DNA, 10 bp, Homo sapiens
agagccacaa

SEQ ID NO: 4761211 - DNA, 22 bp, Homo sapiens
agagccacagaaaatggaggat

SEQ ID NO: 4761212 - DNA, 17 bp, Homo sapiens
agagccatccaccctga

SEQ ID NO: 4761213 - DNA, 15 bp, Homo sapiens
agagcccaggcctcc

SEQ ID NO: 4761214 - DNA, 12 bp, Homo sapiens
agagccccggag

SEQ ID NO: 4761215 - DNA, 22 bp, Homo sapiens
agagccccggagcaccacgggg

SEQ ID NO: 4761216 - DNA, 15 bp, Homo sapiens
agagcccctggggcc

SEQ ID NO: 4761217 - DNA, 16 bp, Homo sapiens
agagcccgcccacctg

SEQ ID NO: 4761218 - DNA, 16 bp, Homo sapiens
agagcctatggaaagg

SEQ ID NO: 4761219 - DNA, 17 bp, Homo sapiens
agagcctatggaaaggg

SEQ ID NO: 4761220 - DNA, 20 bp, Homo sapiens
agagcctatggaaagggtgt

SEQ ID NO: 4761221 - DNA, 13 bp, Homo sapiens
agagcctgggcgc

SEQ ID NO: 4761222 - DNA, 17 bp, Homo sapiens
agagcgccacccgcccg

SEQ ID NO: 4761223 - DNA, 14 bp, Homo sapiens
agagctagagaaat

SEQ ID NO: 4761224 - DNA, 23 bp, Homo sapiens
agagctatatatatatatatatg

SEQ ID NO: 4761225 - DNA, 14 bp, Homo sapiens
agagctatgcacac

SEQ ID NO: 4761226 - DNA, 17 bp, Homo sapiens
agagctatgcacaccaa

SEQ ID NO: 4761227 - DNA, 17 bp, Homo sapiens
agagctgagtcggctgg

SEQ ID NO: 4761228 - DNA, 18 bp, Homo sapiens
agagctgagtcggctggg

SEQ ID NO: 4761229 - DNA, 20 bp, Homo sapiens
agagctgagtcggctgggca

SEQ ID NO: 4761230 - DNA, 19 bp, Homo sapiens
agagctgatggagaaggaa

SEQ ID NO: 4761231 - DNA, 12 bp, Homo sapiens
agagctgctgta

SEQ ID NO: 4761232 - DNA, 15 bp, Homo sapiens
agagctgctgtattt

SEQ ID NO: 4761233 - DNA, 22 bp, Homo sapiens
agagctgttttggatgaatgca

SEQ ID NO: 4761234 - DNA, 23 bp, Homo sapiens
agaggaaaaggcttgagtctgga

SEQ ID NO: 4761235 - DNA, 12 bp, Homo sapiens
agaggaaagcaa

SEQ ID NO: 4761236 - DNA, 16 bp, Homo sapiens
agaggaaagcaaagga

SEQ ID NO: 4761237 - DNA, 18 bp, Homo sapiens
agaggaaagcaaaggaga

SEQ ID NO: 4761238 - DNA, 20 bp, Homo sapiens
agaggaacctctgatttatt

SEQ ID NO: 4761239 - DNA, 23 bp, Homo sapiens
agaggacggcttccccatcgcct

SEQ ID NO: 4761240 - DNA, 14 bp, Homo sapiens
agaggagaggctgc

SEQ ID NO: 4761241 - DNA, 13 bp, Homo sapiens
agaggaggtgtgg

SEQ ID NO: 4761242 - DNA, 18 bp, Homo sapiens
agaggaggtgtggagtgg

SEQ ID NO: 4761243 - DNA, 20 bp, Homo sapiens
agaggaggtgtggagtggag

SEQ ID NO: 4761244 - DNA, 22 bp, Homo sapiens
agaggaggtgtggagtggaggg

SEQ ID NO: 4761245 - DNA, 21 bp, Homo sapiens
agaggataaataataaaggtt

SEQ ID NO: 4761246 - DNA, 20 bp, Homo sapiens
agaggattgtccaccttctg

SEQ ID NO: 4761247 - DNA, 12 bp, Homo sapiens
agaggcagggcc

SEQ ID NO: 4761248 - DNA, 14 bp, Homo sapiens
agaggcagggccct

SEQ ID NO: 4761249 - DNA, 20 bp, Homo sapiens
agaggccctggacttcccaa

SEQ ID NO: 4761250 - DNA, 19 bp, Homo sapiens
agaggcctgggtgtgacct

SEQ ID NO: 4761251 - DNA, 23 bp, Homo sapiens
agaggcctgggtgtgacctgaca

SEQ ID NO: 4761252 - DNA, 17 bp, Homo sapiens
agaggctatgtgagcac

SEQ ID NO: 4761253 - DNA, 15 bp, Homo sapiens
agaggctgctgtcac

SEQ ID NO: 4761254 - DNA, 16 bp, Homo sapiens
agagggactccaagcc

SEQ ID NO: 4761255 - DNA, 17 bp, Homo sapiens
agagggatgaaatgcca

SEQ ID NO: 4761256 - DNA, 12 bp, Homo sapiens
agagggcacaga

SEQ ID NO: 4761257 - DNA, 13 bp, Homo sapiens
agagggctgagcc

SEQ ID NO: 4761258 - DNA, 16 bp, Homo sapiens
agaggggaagagactt

SEQ ID NO: 4761259 - DNA, 19 bp, Homo sapiens
agagggtgtgggtgccctg

SEQ ID NO: 4761260 - DNA, 15 bp, Homo sapiens
agaggtggggtgctg

SEQ ID NO: 4761261 - DNA, 15 bp, Homo sapiens
agaggttaaggtggg

SEQ ID NO: 4761262 - DNA, 18 bp, Homo sapiens
agaggtttcagcattccc

SEQ ID NO: 4761263 - DNA, 21 bp, Homo sapiens
agagtaagcacctttagaata

SEQ ID NO: 4761264 - DNA, 23 bp, Homo sapiens
agagtaagcacctttagaatatt

SEQ ID NO: 4761265 - DNA, 19 bp, Homo sapiens
agagtactttggtttctga

SEQ ID NO: 4761266 - DNA, 14 bp, Homo sapiens
agagtagggccctg

SEQ ID NO: 4761267 - DNA, 22 bp, Homo sapiens
agagtagggccctgacaggcct

SEQ ID NO: 4761268 - DNA, 19 bp, Homo sapiens
agagtatacaagtgtttct

SEQ ID NO: 4761269 - DNA, 13 bp, Homo sapiens
agagtatatatgt

SEQ ID NO: 4761270 - DNA, 18 bp, Homo sapiens
agagtatgcaagaagaat

SEQ ID NO: 4761271 - DNA, 15 bp, Homo sapiens
agagtcattgttaca

SEQ ID NO: 4761272 - DNA, 22 bp, Homo sapiens
agagtcccccctcccacctcca

SEQ ID NO: 4761273 - DNA, 17 bp, Homo sapiens
agagtctattgtctcct

SEQ ID NO: 4761274 - DNA, 18 bp, Homo sapiens
agagtgatttgtaaaaca

SEQ ID NO: 4761275 - DNA, 12 bp, Homo sapiens
agagtgtatgca

SEQ ID NO: 4761276 - DNA, 22 bp, Homo sapiens
agagttactgccacggtccttt

SEQ ID NO: 4761277 - DNA, 21 bp, Homo sapiens
agagttctccttgtacttgaa

SEQ ID NO: 4761278 - DNA, 15 bp, Homo sapiens
agataaatatcatta

SEQ ID NO: 4761279 - DNA, 16 bp, Homo sapiens
agataaatccaatagt

SEQ ID NO: 4761280 - DNA, 18 bp, Homo sapiens
agataaatccaatagtct

SEQ ID NO: 4761281 - DNA, 20 bp, Homo sapiens
agataagtgctcagtattga

SEQ ID NO: 4761282 - DNA, 18 bp, Homo sapiens
agataccattttgaaata

SEQ ID NO: 4761283 - DNA, 15 bp, Homo sapiens
agatacctgtgagga

SEQ ID NO: 4761284 - DNA, 17 bp, Homo sapiens
agatacctgtgaggact

SEQ ID NO: 4761285 - DNA, 15 bp, Homo sapiens
agatagaggatgggc

SEQ ID NO: 4761286 - DNA, 13 bp, Homo sapiens
agatagccaaggc

SEQ ID NO: 4761287 - DNA, 20 bp, Homo sapiens
agatagccaaggccaaagga

SEQ ID NO: 4761288 - DNA, 21 bp, Homo sapiens
agatagtatgcactatataca

SEQ ID NO: 4761289 - DNA, 21 bp, Homo sapiens
agatatatctgaaaactggaa

SEQ ID NO: 4761290 - DNA, 19 bp, Homo sapiens
agatatcgagagtttctat

SEQ ID NO: 4761291 - DNA, 21 bp, Homo sapiens
agatatgagaaatataaaaat

SEQ ID NO: 4761292 - DNA, 13 bp, Homo sapiens
agatattatttat

SEQ ID NO: 4761293 - DNA, 16 bp, Homo sapiens
agatattgtattatca

SEQ ID NO: 4761294 - DNA, 17 bp, Homo sapiens
agatattgtattatcat

SEQ ID NO: 4761295 - DNA, 22 bp, Homo sapiens
agatattgtattatcatatatg

SEQ ID NO: 4761296 - DNA, 17 bp, Homo sapiens
agatcaggaagagaagg

SEQ ID NO: 4761297 - DNA, 21 bp, Homo sapiens
agatcatctccaaatcttgcc

SEQ ID NO: 4761298 - DNA, 19 bp, Homo sapiens
agatcattctccttgtaaa

SEQ ID NO: 4761299 - DNA, 16 bp, Homo sapiens
agatccatccttttgc

SEQ ID NO: 4761300 - DNA, 20 bp, Homo sapiens
agatcccaagtcaaacagtg

SEQ ID NO: 4761301 - DNA, 15 bp, Homo sapiens
agatccctcggtcag

SEQ ID NO: 4761302 - DNA, 20 bp, Homo sapiens
agatccctcggtcagcaccg

SEQ ID NO: 4761303 - DNA, 20 bp, Homo sapiens
agatcctccgcggaggcccc

SEQ ID NO: 4761304 - DNA, 21 bp, Homo sapiens
agatcctctttccccactgaa

SEQ ID NO: 4761305 - DNA, 22 bp, Homo sapiens
agatcctctttccccactgaag

SEQ ID NO: 4761306 - DNA, 11 bp, Homo sapiens
agatccttcca

SEQ ID NO: 4761307 - DNA, 15 bp, Homo sapiens
agatctagccaggcc

SEQ ID NO: 4761308 - DNA, 16 bp, Homo sapiens
agatcttgagcaaggc

SEQ ID NO: 4761309 - DNA, 18 bp, Homo sapiens
agatcttgcctctttcct

SEQ ID NO: 4761310 - DNA, 17 bp, Homo sapiens
agatgacagggagctgg

SEQ ID NO: 4761311 - DNA, 18 bp, Homo sapiens
agatgactgaatttctat

SEQ ID NO: 4761312 - DNA, 13 bp, Homo sapiens
agatgactggaaa

SEQ ID NO: 4761313 - DNA, 13 bp, Homo sapiens
agatgagaattag

SEQ ID NO: 4761314 - DNA, 13 bp, Homo sapiens
agatgaggctgga

SEQ ID NO: 4761315 - DNA, 22 bp, Homo sapiens
agatgaggctggataggagagg

SEQ ID NO: 4761316 - DNA, 22 bp, Homo sapiens
agatgataatcccatactctca

SEQ ID NO: 4761317 - DNA, 14 bp, Homo sapiens
agatgatctctcca

SEQ ID NO: 4761318 - DNA, 17 bp, Homo sapiens
agatgatttaattctta

SEQ ID NO: 4761319 - DNA, 14 bp, Homo sapiens
agatgcaacctcac

SEQ ID NO: 4761320 - DNA, 16 bp, Homo sapiens
agatgcaacctcacta

SEQ ID NO: 4761321 - DNA, 19 bp, Homo sapiens
agatgcaacctcactatgg

SEQ ID NO: 4761322 - DNA, 18 bp, Homo sapiens
agatgcatctgtggcctg

SEQ ID NO: 4761323 - DNA, 18 bp, Homo sapiens
agatgcattttaaatgtc

SEQ ID NO: 4761324 - DNA, 21 bp, Homo sapiens
agatgcattttaaatgtctat

SEQ ID NO: 4761325 - DNA, 19 bp, Homo sapiens
agatgctgctgagcacatc

SEQ ID NO: 4761326 - DNA, 23 bp, Homo sapiens
agatggagaaacaacaaataagt

SEQ ID NO: 4761327 - DNA, 14 bp, Homo sapiens
agatggcagagcca

SEQ ID NO: 4761328 - DNA, 21 bp, Homo sapiens
agatggcttccgtgagacaca

SEQ ID NO: 4761329 - DNA, 19 bp, Homo sapiens
agatgggggcctctctgga

SEQ ID NO: 4761330 - DNA, 17 bp, Homo sapiens
agatgggtgattatgaa

SEQ ID NO: 4761331 - DNA, 19 bp, Homo sapiens
agatgggtgattatgaaat

SEQ ID NO: 4761332 - DNA, 21 bp, Homo sapiens
agatgggtgattatgaaatgc

SEQ ID NO: 4761333 - DNA, 22 bp, Homo sapiens
agatgggttttgttaggggtgg

SEQ ID NO: 4761334 - DNA, 14 bp, Homo sapiens
agatggtagaaact

SEQ ID NO: 4761335 - DNA, 22 bp, Homo sapiens
agatggtagaaactttggaagt

SEQ ID NO: 4761336 - DNA, 22 bp, Homo sapiens
agatggtcatatttaaacagaa

SEQ ID NO: 4761337 - DNA, 14 bp, Homo sapiens
agatgtaccatgtt

SEQ ID NO: 4761338 - DNA, 20 bp, Homo sapiens
agatgtaccatgttaaagag

SEQ ID NO: 4761339 - DNA, 12 bp, Homo sapiens
agatgtttggca

SEQ ID NO: 4761340 - DNA, 15 bp, Homo sapiens
agatgtttggcaaga

SEQ ID NO: 4761341 - DNA, 19 bp, Homo sapiens
agatgtttggcaagaaatc

SEQ ID NO: 4761342 - DNA, 21 bp, Homo sapiens
agattaaaaccagagagaaag

SEQ ID NO: 4761343 - DNA, 15 bp, Homo sapiens
agattaatggcactg

SEQ ID NO: 4761344 - DNA, 19 bp, Homo sapiens
agattaatttgtgtagatt

SEQ ID NO: 4761345 - DNA, 16 bp, Homo sapiens
agattagaaagaatta

SEQ ID NO: 4761346 - DNA, 18 bp, Homo sapiens
agattatatacaaagctg

SEQ ID NO: 4761347 - DNA, 16 bp, Homo sapiens
agattattttctatat

SEQ ID NO: 4761348 - DNA, 23 bp, Homo sapiens
agattcactttgacacttttcat

SEQ ID NO: 4761349 - DNA, 14 bp, Homo sapiens
agattcctacttaa

SEQ ID NO: 4761350 - DNA, 15 bp, Homo sapiens
agattcctacttaaa

SEQ ID NO: 4761351 - DNA, 16 bp, Homo sapiens
agattcctacttaaac

SEQ ID NO: 4761352 - DNA, 17 bp, Homo sapiens
agattcctacttaaaca

SEQ ID NO: 4761353 - DNA, 19 bp, Homo sapiens
agattgtacatatggaaat

SEQ ID NO: 4761354 - DNA, 16 bp, Homo sapiens
agattgttattaaatg

SEQ ID NO: 4761355 - DNA, 18 bp, Homo sapiens
agatttgtatttatatta

SEQ ID NO: 4761356 - DNA, 17 bp, Homo sapiens
agcaaaaccattgcttc

SEQ ID NO: 4761357 - DNA, 12 bp, Homo sapiens
agcaaaatatat

SEQ ID NO: 4761358 - DNA, 12 bp, Homo sapiens
agcaaacacaca

SEQ ID NO: 4761359 - DNA, 16 bp, Homo sapiens
agcaaagacagtttct

SEQ ID NO: 4761360 - DNA, 17 bp, Homo sapiens
agcaaagacagtttctt

SEQ ID NO: 4761361 - DNA, 20 bp, Homo sapiens
agcaaagcatgccaatttct

SEQ ID NO: 4761362 - DNA, 18 bp, Homo sapiens
acccacttccctgcaagg

SEQ ID NO: 4761363 - DNA, 11 bp, Homo sapiens
acccagcagcg

SEQ ID NO: 4761364 - DNA, 19 bp, Homo sapiens
acccagcagcgcccgaggc

SEQ ID NO: 4761365 - DNA, 15 bp, Homo sapiens
acccaggtgttgtcc

SEQ ID NO: 4761366 - DNA, 16 bp, Homo sapiens
acccagtgttcagcat

SEQ ID NO: 4761367 - DNA, 13 bp, Homo sapiens
acccatcactgtg

SEQ ID NO: 4761368 - DNA, 14 bp, Homo sapiens
acccatcactgtgt

SEQ ID NO: 4761369 - DNA, 21 bp, Homo sapiens
acccatcggtgtccatttata

SEQ ID NO: 4761370 - DNA, 21 bp, Homo sapiens
acccatgagcgtccaggtgat

SEQ ID NO: 4761371 - DNA, 16 bp, Homo sapiens
acccatgcatggcctc

SEQ ID NO: 4761372 - DNA, 22 bp, Homo sapiens
acccattagcagtccctccaca

SEQ ID NO: 4761373 - DNA, 15 bp, Homo sapiens
accccaaacttccag

SEQ ID NO: 4761374 - DNA, 15 bp, Homo sapiens
accccacacgccggg

SEQ ID NO: 4761375 - DNA, 20 bp, Homo sapiens
accccaccctgtctgcaggc

SEQ ID NO: 4761376 - DNA, 17 bp, Homo sapiens
accccagagattcccaa

SEQ ID NO: 4761377 - DNA, 21 bp, Homo sapiens
accccagatacctgtgaggac

SEQ ID NO: 4761378 - DNA, 21 bp, Homo sapiens
accccaggaagtcatcctgca

SEQ ID NO: 4761379 - DNA, 17 bp, Homo sapiens
accccatcctcacacag

SEQ ID NO: 4761380 - DNA, 17 bp, Homo sapiens
accccattctgggactg

SEQ ID NO: 4761381 - DNA, 18 bp, Homo sapiens
acccccacctccctgcag

SEQ ID NO: 4761382 - DNA, 12 bp, Homo sapiens
acccccagcctc

SEQ ID NO: 4761383 - DNA, 18 bp, Homo sapiens
acccccagcctcccccag

SEQ ID NO: 4761384 - DNA, 19 bp, Homo sapiens
accccctgccccagagaag

SEQ ID NO: 4761385 - DNA, 17 bp, Homo sapiens
accccgatgtggacctc

SEQ ID NO: 4761386 - DNA, 15 bp, Homo sapiens
accccgctcttccca

SEQ ID NO: 4761387 - DNA, 22 bp, Homo sapiens
accccgctcttcccaagtcctc

SEQ ID NO: 4761388 - DNA, 16 bp, Homo sapiens
accccggcaggccctg

SEQ ID NO: 4761389 - DNA, 19 bp, Homo sapiens
accccgtcccggccccgcg

SEQ ID NO: 4761390 - DNA, 18 bp, Homo sapiens
accccgtccctttccctg

SEQ ID NO: 4761391 - DNA, 14 bp, Homo sapiens
accccgtctgcccc

SEQ ID NO: 4761392 - DNA, 14 bp, Homo sapiens
accccgttcccagc

SEQ ID NO: 4761393 - DNA, 18 bp, Homo sapiens
acccctacagcctgcaca

SEQ ID NO: 4761394 - DNA, 19 bp, Homo sapiens
acccctacagcctgcacac

SEQ ID NO: 4761395 - DNA, 23 bp, Homo sapiens
acccctcaagccaggagaccctg

SEQ ID NO: 4761396 - DNA, 20 bp, Homo sapiens
acccctcccacctctttctt

SEQ ID NO: 4761397 - DNA, 21 bp, Homo sapiens
acccctcccacctctttcttc

SEQ ID NO: 4761398 - DNA, 14 bp, Homo sapiens
acccctcttccccc

SEQ ID NO: 4761399 - DNA, 22 bp, Homo sapiens
acccctcttcccccttcccctg

SEQ ID NO: 4761400 - DNA, 18 bp, Homo sapiens
acccctgaactggcccca

SEQ ID NO: 4761401 - DNA, 12 bp, Homo sapiens
acccctgcccag

SEQ ID NO: 4761402 - DNA, 13 bp, Homo sapiens
acccctgccctcg

SEQ ID NO: 4761403 - DNA, 15 bp, Homo sapiens
acccctgggggaggc

SEQ ID NO: 4761404 - DNA, 19 bp, Homo sapiens
acccctgggggaggcttcc

SEQ ID NO: 4761405 - DNA, 21 bp, Homo sapiens
acccctgggtgggccctgccg

SEQ ID NO: 4761406 - DNA, 14 bp, Homo sapiens
acccgccccagaga

SEQ ID NO: 4761407 - DNA, 23 bp, Homo sapiens
acccgccccagagactgcccacc

SEQ ID NO: 4761408 - DNA, 19 bp, Homo sapiens
acccgccctttccttgcct

SEQ ID NO: 4761409 - DNA, 16 bp, Homo sapiens
acccggatctccaggc

SEQ ID NO: 4761410 - DNA, 19 bp, Homo sapiens
acccggatctccaggccca

SEQ ID NO: 4761411 - DNA, 20 bp, Homo sapiens
acccggatctccaggcccag

SEQ ID NO: 4761412 - DNA, 14 bp, Homo sapiens
acccgttttatgat

SEQ ID NO: 4761413 - DNA, 22 bp, Homo sapiens
accctacagtatataagctttt

SEQ ID NO: 4761414 - DNA, 24 bp, Homo sapiens
accctaggtctccacccctcaagc

SEQ ID NO: 4761415 - DNA, 15 bp, Homo sapiens
accctaggtgctcat

SEQ ID NO: 4761416 - DNA, 15 bp, Homo sapiens
accctcactctgcca

SEQ ID NO: 4761417 - DNA, 16 bp, Homo sapiens
accctcactctgccag

SEQ ID NO: 4761418 - DNA, 17 bp, Homo sapiens
accctcactctgccagg

SEQ ID NO: 4761419 - DNA, 21 bp, Homo sapiens
accctcagaatattaagcaca

SEQ ID NO: 4761420 - DNA, 21 bp, Homo sapiens
accctccacacacttcttcca

SEQ ID NO: 4761421 - DNA, 17 bp, Homo sapiens
accctccacaggagccg

SEQ ID NO: 4761422 - DNA, 22 bp, Homo sapiens
accctcccaggtttcccactgc

SEQ ID NO: 4761423 - DNA, 14 bp, Homo sapiens
accctcccccgcag

SEQ ID NO: 4761424 - DNA, 13 bp, Homo sapiens
accctcccctctc

SEQ ID NO: 4761425 - DNA, 14 bp, Homo sapiens
accctccctgtccc

SEQ ID NO: 4761426 - DNA, 15 bp, Homo sapiens
accctccctgtcccc

SEQ ID NO: 4761427 - DNA, 13 bp, Homo sapiens
accctcgctgcca

SEQ ID NO: 4761428 - DNA, 14 bp, Homo sapiens
accctcgctgccac

SEQ ID NO: 4761429 - DNA, 22 bp, Homo sapiens
accctctcctgggggtggcagg

SEQ ID NO: 4761430 - DNA, 20 bp, Homo sapiens
accctctgctatgtctgtga

SEQ ID NO: 4761431 - DNA, 16 bp, Homo sapiens
accctctgctgcacag

SEQ ID NO: 4761432 - DNA, 19 bp, Homo sapiens
accctctgtccttccccca

SEQ ID NO: 4761433 - DNA, 20 bp, Homo sapiens
accctgaatcagaggcagag

SEQ ID NO: 4761434 - DNA, 18 bp, Homo sapiens
accctgcaaggcccacag

SEQ ID NO: 4761435 - DNA, 19 bp, Homo sapiens
accctgccaactttccaga

SEQ ID NO: 4761436 - DNA, 14 bp, Homo sapiens
actttcctatgaca

SEQ ID NO: 4761437 - DNA, 15 bp, Homo sapiens
actttcctctctctc

SEQ ID NO: 4761438 - DNA, 17 bp, Homo sapiens
actttcgttaatcttgc

SEQ ID NO: 4761439 - DNA, 20 bp, Homo sapiens
actttcgttaatcttgctgc

SEQ ID NO: 4761440 - DNA, 17 bp, Homo sapiens
actttctagccagagga

SEQ ID NO: 4761441 - DNA, 19 bp, Homo sapiens
actttctgaaattcacaaa

SEQ ID NO: 4761442 - DNA, 17 bp, Homo sapiens
actttcttcaaaatata

SEQ ID NO: 4761443 - DNA, 23 bp, Homo sapiens
actttgacgagtcaccttccagg

SEQ ID NO: 4761444 - DNA, 12 bp, Homo sapiens
actttgcaggag

SEQ ID NO: 4761445 - DNA, 17 bp, Homo sapiens
actttgcaggagttcct

SEQ ID NO: 4761446 - DNA, 14 bp, Homo sapiens
actttggtttctga

SEQ ID NO: 4761447 - DNA, 20 bp, Homo sapiens
actttgtcacttctgctgta

SEQ ID NO: 4761448 - DNA, 21 bp, Homo sapiens
actttgtgtcttttgttctct

SEQ ID NO: 4761449 - DNA, 17 bp, Homo sapiens
acttttataaatgtttt

SEQ ID NO: 4761450 - DNA, 15 bp, Homo sapiens
acttttataaattaa

SEQ ID NO: 4761451 - DNA, 18 bp, Homo sapiens
acttttcatatcatttct

SEQ ID NO: 4761452 - DNA, 19 bp, Homo sapiens
acttttcatttttgctttt

SEQ ID NO: 4761453 - DNA, 16 bp, Homo sapiens
acttttctttcagcca

SEQ ID NO: 4761454 - DNA, 18 bp, Homo sapiens
acttttgcaagagtgatg

SEQ ID NO: 4761455 - DNA, 15 bp, Homo sapiens
agaaaaaactggaaa

SEQ ID NO: 4761456 - DNA, 11 bp, Homo sapiens
agaaaaacaaa

SEQ ID NO: 4761457 - DNA, 22 bp, Homo sapiens
agaaaaacaatggtaacatttt

SEQ ID NO: 4761458 - DNA, 13 bp, Homo sapiens
agaaaaagccctc

SEQ ID NO: 4761459 - DNA, 17 bp, Homo sapiens
agaaaaatcaatcattt

SEQ ID NO: 4761460 - DNA, 18 bp, Homo sapiens
agaaaaatgaaatttaag

SEQ ID NO: 4761461 - DNA, 23 bp, Homo sapiens
agaaaaatgcttgaccctgaaat

SEQ ID NO: 4761462 - DNA, 16 bp, Homo sapiens
agaaaaatgtgaattt

SEQ ID NO: 4761463 - DNA, 16 bp, Homo sapiens
agaaaaatttcacgat

SEQ ID NO: 4761464 - DNA, 22 bp, Homo sapiens
agaaaacaggaaaaaaactttt

SEQ ID NO: 4761465 - DNA, 13 bp, Homo sapiens
agaaaagcacctc

SEQ ID NO: 4761466 - DNA, 11 bp, Homo sapiens
agaaaagccag

SEQ ID NO: 4761467 - DNA, 18 bp, Homo sapiens
agaaaatgagatgggttg

SEQ ID NO: 4761468 - DNA, 15 bp, Homo sapiens
agaaaatgctttctc

SEQ ID NO: 4761469 - DNA, 16 bp, Homo sapiens
agaaaatgctttctca

SEQ ID NO: 4761470 - DNA, 19 bp, Homo sapiens
agaaaatgctttctcatgc

SEQ ID NO: 4761471 - DNA, 23 bp, Homo sapiens
agaaaatgctttctcatgcatag

SEQ ID NO: 4761472 - DNA, 23 bp, Homo sapiens
agaaaatggatgacaaagaaaat

SEQ ID NO: 4761473 - DNA, 15 bp, Homo sapiens
agaaacaaaatataa

SEQ ID NO: 4761474 - DNA, 12 bp, Homo sapiens
agaaacaaaccc

SEQ ID NO: 4761475 - DNA, 16 bp, Homo sapiens
agaaacaacaaataag

SEQ ID NO: 4761476 - DNA, 14 bp, Homo sapiens
agaaacaatttctg

SEQ ID NO: 4761477 - DNA, 14 bp, Homo sapiens
agaaacacagcatg

SEQ ID NO: 4761478 - DNA, 16 bp, Homo sapiens
agaaacacggagtttc

SEQ ID NO: 4761479 - DNA, 20 bp, Homo sapiens
agaaacacggagtttccatt

SEQ ID NO: 4761480 - DNA, 17 bp, Homo sapiens
agaaacatttatctttg

SEQ ID NO: 4761481 - DNA, 13 bp, Homo sapiens
agaaaccctgcac

SEQ ID NO: 4761482 - DNA, 22 bp, Homo sapiens
agaaaccttttaaaaaaataat

SEQ ID NO: 4761483 - DNA, 23 bp, Homo sapiens
agaaaccttttaaaaaaataata

SEQ ID NO: 4761484 - DNA, 14 bp, Homo sapiens
agaaacttaaagaa

SEQ ID NO: 4761485 - DNA, 22 bp, Homo sapiens
agaaacttcctttgagaattgt

SEQ ID NO: 4761486 - DNA, 23 bp, Homo sapiens
agaaactttggaagttttacttg

SEQ ID NO: 4761487 - DNA, 24 bp, Homo sapiens
agaaactttggaagttttacttga

SEQ ID NO: 4761488 - DNA, 14 bp, Homo sapiens
agaaagaattagcc

SEQ ID NO: 4761489 - DNA, 13 bp, Homo sapiens
agaaagaggccct

SEQ ID NO: 4761490 - DNA, 15 bp, Homo sapiens
agaaaggaaaccttt

SEQ ID NO: 4761491 - DNA, 21 bp, Homo sapiens
agaaaggaaaccttttcttgt

SEQ ID NO: 4761492 - DNA, 18 bp, Homo sapiens
agaaagggcagcccctcc

SEQ ID NO: 4761493 - DNA, 20 bp, Homo sapiens
agaaagggcagcccctcccc

SEQ ID NO: 4761494 - DNA, 16 bp, Homo sapiens
agaaatataaaaataa

SEQ ID NO: 4761495 - DNA, 14 bp, Homo sapiens
agaaatatctgtga

SEQ ID NO: 4761496 - DNA, 21 bp, Homo sapiens
agaaatcctaacattatattc

SEQ ID NO: 4761497 - DNA, 15 bp, Homo sapiens
agaaatggctttcca

SEQ ID NO: 4761498 - DNA, 23 bp, Homo sapiens
agaaattagggctctaatttcct

SEQ ID NO: 4761499 - DNA, 12 bp, Homo sapiens
agaaattctata

SEQ ID NO: 4761500 - DNA, 14 bp, Homo sapiens
acagcccagagact

SEQ ID NO: 4761501 - DNA, 12 bp, Homo sapiens
acagcccaggcg

SEQ ID NO: 4761502 - DNA, 15 bp, Homo sapiens
acagcccgagcccct

SEQ ID NO: 4761503 - DNA, 21 bp, Homo sapiens
acagcccgagccccttgggga

SEQ ID NO: 4761504 - DNA, 13 bp, Homo sapiens
acagccctgcacg

SEQ ID NO: 4761505 - DNA, 14 bp, Homo sapiens
acagcctccacctt

SEQ ID NO: 4761506 - DNA, 23 bp, Homo sapiens
acagcctccaccttgagcactat

SEQ ID NO: 4761507 - DNA, 12 bp, Homo sapiens
acagcctgcaca

SEQ ID NO: 4761508 - DNA, 13 bp, Homo sapiens
acagcctgcacac

SEQ ID NO: 4761509 - DNA, 15 bp, Homo sapiens
acagcggccccgcgg

SEQ ID NO: 4761510 - DNA, 23 bp, Homo sapiens
acagcggccccgcggagcccccg

SEQ ID NO: 4761511 - DNA, 16 bp, Homo sapiens
acagcggcccggccca

SEQ ID NO: 4761512 - DNA, 21 bp, Homo sapiens
acagcggcccggcccacgcag

SEQ ID NO: 4761513 - DNA, 19 bp, Homo sapiens
acagcgtccctagcagtga

SEQ ID NO: 4761514 - DNA, 15 bp, Homo sapiens
acagctaacaataaa

SEQ ID NO: 4761515 - DNA, 22 bp, Homo sapiens
acagctactcagatctgcactc

SEQ ID NO: 4761516 - DNA, 15 bp, Homo sapiens
acagctctcctccag

SEQ ID NO: 4761517 - DNA, 16 bp, Homo sapiens
acagctctcctccagc

SEQ ID NO: 4761518 - DNA, 12 bp, Homo sapiens
acagctgcctcc

SEQ ID NO: 4761519 - DNA, 17 bp, Homo sapiens
acagctgcctccgggcc

SEQ ID NO: 4761520 - DNA, 13 bp, Homo sapiens
acagctgctttct

SEQ ID NO: 4761521 - DNA, 21 bp, Homo sapiens
acagctgtgctgtaacacaag

SEQ ID NO: 4761522 - DNA, 17 bp, Homo sapiens
acagcttcacttaaaat

SEQ ID NO: 4761523 - DNA, 22 bp, Homo sapiens
acagcttgaccgtgaggccaga

SEQ ID NO: 4761524 - DNA, 18 bp, Homo sapiens
acagcttgaggaaagagc

SEQ ID NO: 4761525 - DNA, 14 bp, Homo sapiens
acaggaaaaaaact

SEQ ID NO: 4761526 - DNA, 16 bp, Homo sapiens
acaggaaaaaaacttt

SEQ ID NO: 4761527 - DNA, 19 bp, Homo sapiens
acaggaaaagcatgtctta

SEQ ID NO: 4761528 - DNA, 18 bp, Homo sapiens
acaggaaagccctccccc

SEQ ID NO: 4761529 - DNA, 21 bp, Homo sapiens
acaggaacccatcactgtgtc

SEQ ID NO: 4761530 - DNA, 16 bp, Homo sapiens
acaggaccaggagcca

SEQ ID NO: 4761531 - DNA, 16 bp, Homo sapiens
acaggagcgtgtacta

SEQ ID NO: 4761532 - DNA, 19 bp, Homo sapiens
acaggaggcaagcaagctc

SEQ ID NO: 4761533 - DNA, 16 bp, Homo sapiens
acaggatatcacctga

SEQ ID NO: 4761534 - DNA, 20 bp, Homo sapiens
acaggatcctggcctgagaa

SEQ ID NO: 4761535 - DNA, 17 bp, Homo sapiens
acaggattgtctgctgc

SEQ ID NO: 4761536 - DNA, 18 bp, Homo sapiens
acaggattgtctgctgcc

SEQ ID NO: 4761537 - DNA, 22 bp, Homo sapiens
acaggattgtctgctgcctcca

SEQ ID NO: 4761538 - DNA, 18 bp, Homo sapiens
acaggcaccatgctgggc

SEQ ID NO: 4761539 - DNA, 20 bp, Homo sapiens
acaggcaccatgctgggccg

SEQ ID NO: 4761540 - DNA, 22 bp, Homo sapiens
acaggcattgcactaaaagtga

SEQ ID NO: 4761541 - DNA, 15 bp, Homo sapiens
acaggccatttcatt

SEQ ID NO: 4761542 - DNA, 13 bp, Homo sapiens
acaggcctggccc

SEQ ID NO: 4761543 - DNA, 16 bp, Homo sapiens
acaggcctggcccagc

SEQ ID NO: 4761544 - DNA, 17 bp, Homo sapiens
acaggcctggcccagcc

SEQ ID NO: 4761545 - DNA, 23 bp, Homo sapiens
acaggcctggcccagccagcagg

SEQ ID NO: 4761546 - DNA, 16 bp, Homo sapiens
acaggccttcctcctc

SEQ ID NO: 4761547 - DNA, 20 bp, Homo sapiens
acaggccttcctcctctcaa

SEQ ID NO: 4761548 - DNA, 19 bp, Homo sapiens
acaggctgttctgcactga

SEQ ID NO: 4761549 - DNA, 20 bp, Homo sapiens
acaggctgttctgcactgaa

SEQ ID NO: 4761550 - DNA, 21 bp, Homo sapiens
acaggctgttctgcactgaaa

SEQ ID NO: 4761551 - DNA, 17 bp, Homo sapiens
acagggacacagtctgg

SEQ ID NO: 4761552 - DNA, 23 bp, Homo sapiens
acagggcaaaatgaactaactgc

SEQ ID NO: 4761553 - DNA, 14 bp, Homo sapiens
acagggtggcaccc

SEQ ID NO: 4761554 - DNA, 13 bp, Homo sapiens
acagggtggggct

SEQ ID NO: 4761555 - DNA, 21 bp, Homo sapiens
acagggtggggcttagaatgg

SEQ ID NO: 4761556 - DNA, 24 bp, Homo sapiens
acaggtgtactatggctgtatttt

SEQ ID NO: 4761557 - DNA, 18 bp, Homo sapiens
acagtaaatatacacttt

SEQ ID NO: 4761558 - DNA, 16 bp, Homo sapiens
acagtaactgccattt

SEQ ID NO: 4761559 - DNA, 18 bp, Homo sapiens
acagtagcatactgatga

SEQ ID NO: 4761560 - DNA, 20 bp, Homo sapiens
acagtagcatactgatgaga

SEQ ID NO: 4761561 - DNA, 19 bp, Homo sapiens
acagtagtgttgggtggag

SEQ ID NO: 4761562 - DNA, 17 bp, Homo sapiens
acagtatagataaatcc

SEQ ID NO: 4761563 - DNA, 15 bp, Homo sapiens
acagtatataagctt

SEQ ID NO: 4761564 - DNA, 19 bp, Homo sapiens
acagtattaacatcaaaga

SEQ ID NO: 4761565 - DNA, 19 bp, Homo sapiens
acagtattatttagtaaaa

SEQ ID NO: 4761566 - DNA, 21 bp, Homo sapiens
acagtattatttagtaaaatt

SEQ ID NO: 4761567 - DNA, 16 bp, Homo sapiens
acagtattgttcttgt

SEQ ID NO: 4761568 - DNA, 15 bp, Homo sapiens
acagtatttaacatt

SEQ ID NO: 4761569 - DNA, 22 bp, Homo sapiens
acagtcaagacggatccacagt

SEQ ID NO: 4761570 - DNA, 11 bp, Homo sapiens
acagtcagcca

SEQ ID NO: 4761571 - DNA, 20 bp, Homo sapiens
acagtcagccagcttggtgg

SEQ ID NO: 4761572 - DNA, 12 bp, Homo sapiens
acagtctctatt

SEQ ID NO: 4761573 - DNA, 16 bp, Homo sapiens
acagtctctatttgat

SEQ ID NO: 4761574 - DNA, 22 bp, Homo sapiens
acagtctctatttgatttgcaa

SEQ ID NO: 4761575 - DNA, 13 bp, Homo sapiens
acagtgaacagct

SEQ ID NO: 4761576 - DNA, 13 bp, Homo sapiens
acagtgaccaagg

SEQ ID NO: 4761577 - DNA, 16 bp, Homo sapiens
acagtgacccttccca

SEQ ID NO: 4761578 - DNA, 15 bp, Homo sapiens
acagtggcagtattg

SEQ ID NO: 4761579 - DNA, 16 bp, Homo sapiens
acagtggggcccatgg

SEQ ID NO: 4761580 - DNA, 18 bp, Homo sapiens
acagtggggcccatggcc

SEQ ID NO: 4761581 - DNA, 21 bp, Homo sapiens
acagtggggcccatggcccca

SEQ ID NO: 4761582 - DNA, 23 bp, Homo sapiens
acagtggtcagcgattcctgcca

SEQ ID NO: 4761583 - DNA, 16 bp, Homo sapiens
acagtggtccagggtc

SEQ ID NO: 4761584 - DNA, 23 bp, Homo sapiens
acagtggttgttttttcattgtg

SEQ ID NO: 4761585 - DNA, 21 bp, Homo sapiens
acagtgtggcttaaacatttt

SEQ ID NO: 4761586 - DNA, 19 bp, Homo sapiens
acagtgttcaaattctgat

SEQ ID NO: 4761587 - DNA, 16 bp, Homo sapiens
acagtgtttccagtga

SEQ ID NO: 4761588 - DNA, 16 bp, Homo sapiens
acagttacttacacac

SEQ ID NO: 4761589 - DNA, 13 bp, Homo sapiens
acagttatacata

SEQ ID NO: 4761590 - DNA, 20 bp, Homo sapiens
acagttccacaattttgtct

SEQ ID NO: 4761591 - DNA, 16 bp, Homo sapiens
acagttctctccttct

SEQ ID NO: 4761592 - DNA, 16 bp, Homo sapiens
acagttgatatttaaa

SEQ ID NO: 4761593 - DNA, 14 bp, Homo sapiens
acagttggccgatt

SEQ ID NO: 4761594 - DNA, 23 bp, Homo sapiens
acagttggttttgcatgtctgca

SEQ ID NO: 4761595 - DNA, 15 bp, Homo sapiens
acagtttcttgcaag

SEQ ID NO: 4761596 - DNA, 14 bp, Homo sapiens
acagtttgtttaca

SEQ ID NO: 4761597 - DNA, 15 bp, Homo sapiens
acataaaccctccaa

SEQ ID NO: 4761598 - DNA, 18 bp, Homo sapiens
acataaagtaataactgt

SEQ ID NO: 4761599 - DNA, 12 bp, Homo sapiens
acataacacaca

SEQ ID NO: 4761600 - DNA, 14 bp, Homo sapiens
acataacaggcatt

SEQ ID NO: 4761601 - DNA, 18 bp, Homo sapiens
acataacaggcattgcac

SEQ ID NO: 4761602 - DNA, 14 bp, Homo sapiens
acataaccagcggg

SEQ ID NO: 4761603 - DNA, 13 bp, Homo sapiens
acataagttttct

SEQ ID NO: 4761604 - DNA, 18 bp, Homo sapiens
acataattgccaataatg

SEQ ID NO: 4761605 - DNA, 14 bp, Homo sapiens
acatacactgcatt

SEQ ID NO: 4761606 - DNA, 17 bp, Homo sapiens
acatacgaaacacaaac

SEQ ID NO: 4761607 - DNA, 18 bp, Homo sapiens
acatagattaatggcact

SEQ ID NO: 4761608 - DNA, 20 bp, Homo sapiens
acatagattcacctgtaaaa

SEQ ID NO: 4761609 - DNA, 21 bp, Homo sapiens
acatagctttagagaagccat

SEQ ID NO: 4761610 - DNA, 23 bp, Homo sapiens
acatagctttagagaagccataa

SEQ ID NO: 4761611 - DNA, 22 bp, Homo sapiens
acatagtggtattttaacatag

SEQ ID NO: 4761612 - DNA, 15 bp, Homo sapiens
acatatacacaaaga

SEQ ID NO: 4761613 - DNA, 13 bp, Homo sapiens
acatatacattat

SEQ ID NO: 4761614 - DNA, 22 bp, Homo sapiens
acatatacattatttctgtata

SEQ ID NO: 4761615 - DNA, 17 bp, Homo sapiens
acatatcattcagaatg

SEQ ID NO: 4761616 - DNA, 16 bp, Homo sapiens
acatatgaacgcacaa

SEQ ID NO: 4761617 - DNA, 23 bp, Homo sapiens
acatatgaacgcacaacatgcac

SEQ ID NO: 4761618 - DNA, 22 bp, Homo sapiens
acatatgtaggaaaattttctt

SEQ ID NO: 4761619 - DNA, 15 bp, Homo sapiens
acatatgtatgtgtg

SEQ ID NO: 4761620 - DNA, 23 bp, Homo sapiens
acatatgtatgtgtgagtgtatg

SEQ ID NO: 4761621 - DNA, 22 bp, Homo sapiens
acatattcaaagtatatacaga

SEQ ID NO: 4761622 - DNA, 17 bp, Homo sapiens
accagccctggggctgg

SEQ ID NO: 4761623 - DNA, 18 bp, Homo sapiens
accagccctggggctggg

SEQ ID NO: 4761624 - DNA, 12 bp, Homo sapiens
accagcctgagc

SEQ ID NO: 4761625 - DNA, 15 bp, Homo sapiens
accagcctgagccac

SEQ ID NO: 4761626 - DNA, 17 bp, Homo sapiens
accagctatctgtcatc

SEQ ID NO: 4761627 - DNA, 21 bp, Homo sapiens
accagctatctgtcatctctc

SEQ ID NO: 4761628 - DNA, 23 bp, Homo sapiens
accagctatctgtcatctctctg

SEQ ID NO: 4761629 - DNA, 22 bp, Homo sapiens
accaggaaattctgtttatgtt

SEQ ID NO: 4761630 - DNA, 13 bp, Homo sapiens
accaggagccagg

SEQ ID NO: 4761631 - DNA, 14 bp, Homo sapiens
accaggagccaggt

SEQ ID NO: 4761632 - DNA, 15 bp, Homo sapiens
accaggaggcctggg

SEQ ID NO: 4761633 - DNA, 17 bp, Homo sapiens
accaggctgatgccgtg

SEQ ID NO: 4761634 - DNA, 12 bp, Homo sapiens
accaggctgcag

SEQ ID NO: 4761635 - DNA, 14 bp, Homo sapiens
accagggactgcag

SEQ ID NO: 4761636 - DNA, 17 bp, Homo sapiens
accagggactgcagctg

SEQ ID NO: 4761637 - DNA, 14 bp, Homo sapiens
accagtctgaagtt

SEQ ID NO: 4761638 - DNA, 23 bp, Homo sapiens
accagtctgaagtttcatttatg

SEQ ID NO: 4761639 - DNA, 17 bp, Homo sapiens
accagttccctcagccc

SEQ ID NO: 4761640 - DNA, 20 bp, Homo sapiens
accagttccctcagccctca

SEQ ID NO: 4761641 - DNA, 17 bp, Homo sapiens
accagttcttgcaataa

SEQ ID NO: 4761642 - DNA, 18 bp, Homo sapiens
accagttcttgcaataag

SEQ ID NO: 4761643 - DNA, 18 bp, Homo sapiens
accataaaataaataatc

SEQ ID NO: 4761644 - DNA, 18 bp, Homo sapiens
accatcaccacgcagaga

SEQ ID NO: 4761645 - DNA, 14 bp, Homo sapiens
accatcccactgat

SEQ ID NO: 4761646 - DNA, 13 bp, Homo sapiens
accatctggcctg

SEQ ID NO: 4761647 - DNA, 15 bp, Homo sapiens
accatctggcctggc

SEQ ID NO: 4761648 - DNA, 16 bp, Homo sapiens
accatctggcctggcc

SEQ ID NO: 4761649 - DNA, 17 bp, Homo sapiens
accatgaagaacataaa

SEQ ID NO: 4761650 - DNA, 19 bp, Homo sapiens
accatgctgggccggggtg

SEQ ID NO: 4761651 - DNA, 12 bp, Homo sapiens
accatggaggag

SEQ ID NO: 4761652 - DNA, 23 bp, Homo sapiens
accatgttcttgagcagctgaat

SEQ ID NO: 4761653 - DNA, 11 bp, Homo sapiens
accattgcttc

SEQ ID NO: 4761654 - DNA, 15 bp, Homo sapiens
accattgcttcacta

SEQ ID NO: 4761655 - DNA, 19 bp, Homo sapiens
accatttagtcctcacctt

SEQ ID NO: 4761656 - DNA, 15 bp, Homo sapiens
accattttgaaatat

SEQ ID NO: 4761657 - DNA, 18 bp, Homo sapiens
acccaaggtggtcttgga

SEQ ID NO: 4761658 - DNA, 19 bp, Homo sapiens
acccaaggtggtcttggag

SEQ ID NO: 4761659 - DNA, 19 bp, Homo sapiens
acccaagttggagtgcagt

SEQ ID NO: 4761660 - DNA, 14 bp, Homo sapiens
acccacataaacac

SEQ ID NO: 4761661 - DNA, 20 bp, Homo sapiens
acccaccacccccatcatca

SEQ ID NO: 4761662 - DNA, 20 bp, Homo sapiens
acccaccactctcaggacca

SEQ ID NO: 4761663 - DNA, 15 bp, Homo sapiens
acccacccctgccca

SEQ ID NO: 4761664 - DNA, 21 bp, Homo sapiens
acccactagccctctttctct

SEQ ID NO: 4761665 - DNA, 17 bp, Homo sapiens
acccacttccctgcaag

SEQ ID NO: 4761666 - DNA, 22 bp, Homo sapiens
aatgaaatacttgacaacattt

SEQ ID NO: 4761667 - DNA, 19 bp, Homo sapiens
aatgaaataggagggaaac

SEQ ID NO: 4761668 - DNA, 23 bp, Homo sapiens
aatgaaataggagggaaaccttt

SEQ ID NO: 4761669 - DNA, 12 bp, Homo sapiens
aatgaaatataa

SEQ ID NO: 4761670 - DNA, 22 bp, Homo sapiens
aatgaaatataaactgtgagat

SEQ ID NO: 4761671 - DNA, 15 bp, Homo sapiens
aatgaaatatttgct

SEQ ID NO: 4761672 - DNA, 16 bp, Homo sapiens
aatgaaatttaagcac

SEQ ID NO: 4761673 - DNA, 17 bp, Homo sapiens
aatgaaatttaagcaca

SEQ ID NO: 4761674 - DNA, 16 bp, Homo sapiens
aatgaactaactgcca

SEQ ID NO: 4761675 - DNA, 22 bp, Homo sapiens
aatgaagatgcattttaaatgt

SEQ ID NO: 4761676 - DNA, 15 bp, Homo sapiens
aatgaagcaaacaca

SEQ ID NO: 4761677 - DNA, 22 bp, Homo sapiens
aatgaatgaaatataaactgtg

SEQ ID NO: 4761678 - DNA, 13 bp, Homo sapiens
aatgaatgtcagt

SEQ ID NO: 4761679 - DNA, 22 bp, Homo sapiens
aatgaatgtcagtgtgactgat

SEQ ID NO: 4761680 - DNA, 15 bp, Homo sapiens
aatgaattcacccct

SEQ ID NO: 4761681 - DNA, 13 bp, Homo sapiens
aatgaattttaaa

SEQ ID NO: 4761682 - DNA, 19 bp, Homo sapiens
aatgaattttaaaagcata

SEQ ID NO: 4761683 - DNA, 21 bp, Homo sapiens
aatgaattttaaaagcatata

SEQ ID NO: 4761684 - DNA, 19 bp, Homo sapiens
aatgacatgcactgaccct

SEQ ID NO: 4761685 - DNA, 12 bp, Homo sapiens
aatgagaaatca

SEQ ID NO: 4761686 - DNA, 15 bp, Homo sapiens
aatgagaaattgtgc

SEQ ID NO: 4761687 - DNA, 20 bp, Homo sapiens
aatgagaaattgtgccaaag

SEQ ID NO: 4761688 - DNA, 22 bp, Homo sapiens
aatgagaaattgtgccaaagat

SEQ ID NO: 4761689 - DNA, 17 bp, Homo sapiens
aatgagaagtaaattat

SEQ ID NO: 4761690 - DNA, 18 bp, Homo sapiens
aatgagaagtaaattatt

SEQ ID NO: 4761691 - DNA, 13 bp, Homo sapiens
aatgagaggaaaa

SEQ ID NO: 4761692 - DNA, 18 bp, Homo sapiens
aatgagaggaaaagaaaa

SEQ ID NO: 4761693 - DNA, 17 bp, Homo sapiens
aatgagcttaatgtctt

SEQ ID NO: 4761694 - DNA, 14 bp, Homo sapiens
aatgatattgctga

SEQ ID NO: 4761695 - DNA, 16 bp, Homo sapiens
aatgatgattcaatca

SEQ ID NO: 4761696 - DNA, 20 bp, Homo sapiens
aatgatgattcaatcatttt

SEQ ID NO: 4761697 - DNA, 12 bp, Homo sapiens
aatgattaatta

SEQ ID NO: 4761698 - DNA, 16 bp, Homo sapiens
aatgattaattaaaac

SEQ ID NO: 4761699 - DNA, 20 bp, Homo sapiens
aatgattcaatgtgaatttt

SEQ ID NO: 4761700 - DNA, 17 bp, Homo sapiens
aatgattcttgtgtcat

SEQ ID NO: 4761701 - DNA, 20 bp, Homo sapiens
aatgcaaaacacaaaacaaa

SEQ ID NO: 4761702 - DNA, 16 bp, Homo sapiens
aatgcaatgcatctga

SEQ ID NO: 4761703 - DNA, 18 bp, Homo sapiens
aatgcacaaacagaggcc

SEQ ID NO: 4761704 - DNA, 20 bp, Homo sapiens
aatgcacaaacagaggccgc

SEQ ID NO: 4761705 - DNA, 15 bp, Homo sapiens
aatgcagtataaaat

SEQ ID NO: 4761706 - DNA, 23 bp, Homo sapiens
aatgcagtatccgcgagcctgct

SEQ ID NO: 4761707 - DNA, 14 bp, Homo sapiens
aatgcatctgaaag

SEQ ID NO: 4761708 - DNA, 20 bp, Homo sapiens
aatgcatctgaaagttttga

SEQ ID NO: 4761709 - DNA, 16 bp, Homo sapiens
aatgccaagactctat

SEQ ID NO: 4761710 - DNA, 20 bp, Homo sapiens
aatgccaagactctatgctc

SEQ ID NO: 4761711 - DNA, 16 bp, Homo sapiens
aatgccaattcatctc

SEQ ID NO: 4761712 - DNA, 21 bp, Homo sapiens
aatgccagtggtggaggtggg

SEQ ID NO: 4761713 - DNA, 15 bp, Homo sapiens
aatgccatcaaatga

SEQ ID NO: 4761714 - DNA, 22 bp, Homo sapiens
aatgcccaggaagtaattttct

SEQ ID NO: 4761715 - DNA, 15 bp, Homo sapiens
aatgcctaataaaca

SEQ ID NO: 4761716 - DNA, 17 bp, Homo sapiens
aatgccttgttgtattc

SEQ ID NO: 4761717 - DNA, 13 bp, Homo sapiens
aatgctatggact

SEQ ID NO: 4761718 - DNA, 11 bp, Homo sapiens
aatgctatttg

SEQ ID NO: 4761719 - DNA, 20 bp, Homo sapiens
aatgctatttgtgtaactga

SEQ ID NO: 4761720 - DNA, 14 bp, Homo sapiens
aatgctcaatgtgc

SEQ ID NO: 4761721 - DNA, 14 bp, Homo sapiens
aatgcttaaatgat

SEQ ID NO: 4761722 - DNA, 19 bp, Homo sapiens
aatgcttctttcctcttaa

SEQ ID NO: 4761723 - DNA, 18 bp, Homo sapiens
aatgcttgaccctgaaat

SEQ ID NO: 4761724 - DNA, 13 bp, Homo sapiens
aatgctttctcat

SEQ ID NO: 4761725 - DNA, 13 bp, Homo sapiens
aatggaagacagc

SEQ ID NO: 4761726 - DNA, 16 bp, Homo sapiens
aatggaagacagctct

SEQ ID NO: 4761727 - DNA, 16 bp, Homo sapiens
aatggaggtacaggat

SEQ ID NO: 4761728 - DNA, 17 bp, Homo sapiens
aatggaggtacaggata

SEQ ID NO: 4761729 - DNA, 16 bp, Homo sapiens
aatggatgacaaagaa

SEQ ID NO: 4761730 - DNA, 14 bp, Homo sapiens
aatggatgtaatat

SEQ ID NO: 4761731 - DNA, 12 bp, Homo sapiens
aatggcactgat

SEQ ID NO: 4761732 - DNA, 21 bp, Homo sapiens
aatggcatttagcacagtatt

SEQ ID NO: 4761733 - DNA, 18 bp, Homo sapiens
aatggccaagtgtacatt

SEQ ID NO: 4761734 - DNA, 19 bp, Homo sapiens
aatggccaagtgtacattt

SEQ ID NO: 4761735 - DNA, 15 bp, Homo sapiens
aatggcctcttaaaa

SEQ ID NO: 4761736 - DNA, 13 bp, Homo sapiens
aatggctgaagaa

SEQ ID NO: 4761737 - DNA, 18 bp, Homo sapiens
aatggctgaagaaacaca

SEQ ID NO: 4761738 - DNA, 15 bp, Homo sapiens
aatggctgggtttgg

SEQ ID NO: 4761739 - DNA, 14 bp, Homo sapiens
aatgggagctcatg

SEQ ID NO: 4761740 - DNA, 19 bp, Homo sapiens
aatgggctgcaaaatgaag

SEQ ID NO: 4761741 - DNA, 18 bp, Homo sapiens
aatggggaactcccccag

SEQ ID NO: 4761742 - DNA, 18 bp, Homo sapiens
aatgggtaaataaatgct

SEQ ID NO: 4761743 - DNA, 20 bp, Homo sapiens
aatggtaacatttttcaata

SEQ ID NO: 4761744 - DNA, 19 bp, Homo sapiens
aatggtagctctgaaggga

SEQ ID NO: 4761745 - DNA, 21 bp, Homo sapiens
aatggtagctctgaagggagg

SEQ ID NO: 4761746 - DNA, 18 bp, Homo sapiens
aatggtattttttgtgaa

SEQ ID NO: 4761747 - DNA, 18 bp, Homo sapiens
aatggtgggctccagagt

SEQ ID NO: 4761748 - DNA, 19 bp, Homo sapiens
aatggtgggctccagagta

SEQ ID NO: 4761749 - DNA, 17 bp, Homo sapiens
aatggtgtagctgtcct

SEQ ID NO: 4761750 - DNA, 18 bp, Homo sapiens
aatggtgtagctgtcctc

SEQ ID NO: 4761751 - DNA, 22 bp, Homo sapiens
aatggtgtcataactagagcac

SEQ ID NO: 4761752 - DNA, 18 bp, Homo sapiens
aatggttttcttgtgtgt

SEQ ID NO: 4761753 - DNA, 23 bp, Homo sapiens
aatgtaaaaaggaatatgaaagt

SEQ ID NO: 4761754 - DNA, 14 bp, Homo sapiens
aatgtaaaacacaa

SEQ ID NO: 4761755 - DNA, 20 bp, Homo sapiens
aatgtaaaacacaagactgt

SEQ ID NO: 4761756 - DNA, 23 bp, Homo sapiens
aatgtagggcagaatagctgata

SEQ ID NO: 4761757 - DNA, 21 bp, Homo sapiens
aatgtatcccttctcacagca

SEQ ID NO: 4761758 - DNA, 14 bp, Homo sapiens
aatgtatcttattt

SEQ ID NO: 4761759 - DNA, 15 bp, Homo sapiens
aatgtatcttattta

SEQ ID NO: 4761760 - DNA, 20 bp, Homo sapiens
aatgtatcttatttatatat

SEQ ID NO: 4761761 - DNA, 21 bp, Homo sapiens
aatgtatcttatttatatatg

SEQ ID NO: 4761762 - DNA, 22 bp, Homo sapiens
aatgtatcttatttatatatga

SEQ ID NO: 4761763 - DNA, 14 bp, Homo sapiens
aatgtatgtaaata

SEQ ID NO: 4761764 - DNA, 22 bp, Homo sapiens
aatgtattatgtcctgtgagat

SEQ ID NO: 4761765 - DNA, 21 bp, Homo sapiens
aatgtattctatctctcttta

SEQ ID NO: 4761766 - DNA, 17 bp, Homo sapiens
aatgtcaatttttaact

SEQ ID NO: 4761767 - DNA, 13 bp, Homo sapiens
aatgtcagtgtga

SEQ ID NO: 4761768 - DNA, 12 bp, Homo sapiens
aatgtcatctct

SEQ ID NO: 4761769 - DNA, 15 bp, Homo sapiens
aatgtcatttgctaa

SEQ ID NO: 4761770 - DNA, 21 bp, Homo sapiens
aatgtcatttgctaatgaatt

SEQ ID NO: 4761771 - DNA, 21 bp, Homo sapiens
aatgtccaagcatcagcaaga

SEQ ID NO: 4761772 - DNA, 17 bp, Homo sapiens
aatgtccaggtcacagg

SEQ ID NO: 4761773 - DNA, 19 bp, Homo sapiens
aatgtccaggtcacaggca

SEQ ID NO: 4761774 - DNA, 21 bp, Homo sapiens
aatgtcccaaataaatttata

SEQ ID NO: 4761775 - DNA, 14 bp, Homo sapiens
aatgtcttcatgtt

SEQ ID NO: 4761776 - DNA, 15 bp, Homo sapiens
aatgtctttgtgttt

SEQ ID NO: 4761777 - DNA, 20 bp, Homo sapiens
aatgtgaaataaagagttct

SEQ ID NO: 4761778 - DNA, 19 bp, Homo sapiens
aatgtgatatgtgtaatat

SEQ ID NO: 4761779 - DNA, 11 bp, Homo sapiens
aatgtgccaaa

SEQ ID NO: 4761780 - DNA, 18 bp, Homo sapiens
aatgtgccaaaatgtcaa

SEQ ID NO: 4761781 - DNA, 22 bp, Homo sapiens
aatgtgctgcaaagagttatat

SEQ ID NO: 4761782 - DNA, 15 bp, Homo sapiens
aatgtgcttccgaga

SEQ ID NO: 4761783 - DNA, 20 bp, Homo sapiens
aatgtggtggcaataaatgt

SEQ ID NO: 4761784 - DNA, 12 bp, Homo sapiens
aatgtgtaaatg

SEQ ID NO: 4761785 - DNA, 13 bp, Homo sapiens
aatgtgtaaatgt

SEQ ID NO: 4761786 - DNA, 16 bp, Homo sapiens
aatgtgtgcttggaaa

SEQ ID NO: 4761787 - DNA, 17 bp, Homo sapiens
aatgtgtgggcccaagg

SEQ ID NO: 4761788 - DNA, 19 bp, Homo sapiens
aatgttcactgaataaata

SEQ ID NO: 4761789 - DNA, 12 bp, Homo sapiens
aatgttcattct

SEQ ID NO: 4761790 - DNA, 20 bp, Homo sapiens
aatgttcattctatgacaat

SEQ ID NO: 4761791 - DNA, 15 bp, Homo sapiens
aatgttccattcagt

SEQ ID NO: 4761792 - DNA, 23 bp, Homo sapiens
aatgttgtgttggtatttactgc

SEQ ID NO: 4761793 - DNA, 18 bp, Homo sapiens
aatgtttatttttgctct

SEQ ID NO: 4761794 - DNA, 15 bp, Homo sapiens
aatgtttgtaagcaa

SEQ ID NO: 4761795 - DNA, 20 bp, Homo sapiens
aatgtttgtaagcaattcta

SEQ ID NO: 4761796 - DNA, 23 bp, Homo sapiens
aattaaaaagacacttttaccga

SEQ ID NO: 4761797 - DNA, 17 bp, Homo sapiens
aattaaaacaaaatcct

SEQ ID NO: 4761798 - DNA, 18 bp, Homo sapiens
aattaaaacacaacatct

SEQ ID NO: 4761799 - DNA, 18 bp, Homo sapiens
aattaaagtctacactgc

SEQ ID NO: 4761800 - DNA, 21 bp, Homo sapiens
aattaaagtctacactgcctt

SEQ ID NO: 4761801 - DNA, 22 bp, Homo sapiens
aattaaagtctacactgccttt

SEQ ID NO: 4761802 - DNA, 14 bp, Homo sapiens
aattaaatatatgt

SEQ ID NO: 4761803 - DNA, 16 bp, Homo sapiens
aattaaatatatgtat

SEQ ID NO: 4761804 - DNA, 16 bp, Homo sapiens
aattaaatgaaatact

SEQ ID NO: 4761805 - DNA, 19 bp, Homo sapiens
aattaactccgtttccaaa

SEQ ID NO: 4761806 - DNA, 12 bp, Homo sapiens
aattaatggaaa

SEQ ID NO: 4761807 - DNA, 17 bp, Homo sapiens
aattaatggaaaactgt

SEQ ID NO: 4761808 - DNA, 12 bp, Homo sapiens
aattaattatca

SEQ ID NO: 4761809 - DNA, 14 bp, Homo sapiens
aattaattctttat

SEQ ID NO: 4761810 - DNA, 23 bp, Homo sapiens
aattaattctttatcacatgttg

SEQ ID NO: 4761811 - DNA, 12 bp, Homo sapiens
aattaatttcag

SEQ ID NO: 4761812 - DNA, 11 bp, Homo sapiens
aattacaggaa

SEQ ID NO: 4761813 - DNA, 20 bp, Homo sapiens
aattacaggaagtactggag

SEQ ID NO: 4761814 - DNA, 14 bp, Homo sapiens
aattacataacagg

SEQ ID NO: 4761815 - DNA, 16 bp, Homo sapiens
aattacataacaggca

SEQ ID NO: 4761816 - DNA, 15 bp, Homo sapiens
aattacatgcatgag

SEQ ID NO: 4761817 - DNA, 15 bp, Homo sapiens
aattaccatttgtta

SEQ ID NO: 4761818 - DNA, 18 bp, Homo sapiens
aattaccatttgttaata

SEQ ID NO: 4761819 - DNA, 22 bp, Homo sapiens
aattacgattatagtaccactg

SEQ ID NO: 4761820 - DNA, 18 bp, Homo sapiens
aattactgtgagaactgt

SEQ ID NO: 4761821 - DNA, 21 bp, Homo sapiens
aattactgtgagaactgtgaa

SEQ ID NO: 4761822 - DNA, 15 bp, Homo sapiens
aattactgtttgaaa

SEQ ID NO: 4761823 - DNA, 16 bp, Homo sapiens
aattagaagccatcct

SEQ ID NO: 4761824 - DNA, 17 bp, Homo sapiens
aattagatccattaatt

SEQ ID NO: 4761825 - DNA, 13 bp, Homo sapiens
aattagattttaa

SEQ ID NO: 4761826 - DNA, 14 bp, Homo sapiens
aattagtattttga

SEQ ID NO: 4761827 - DNA, 17 bp, Homo sapiens
aattagtgagatttgta

SEQ ID NO: 4761828 - DNA, 16 bp, Homo sapiens
aattatatgatatgca

SEQ ID NO: 4761829 - DNA, 20 bp, Homo sapiens
aattatatgatatgcatgta

SEQ ID NO: 4761830 - DNA, 23 bp, Homo sapiens
aattatattttgaacaactcgaa

SEQ ID NO: 4761831 - DNA, 21 bp, Homo sapiens
aattatcaaaaaacagaaaaa

SEQ ID NO: 4761832 - DNA, 15 bp, Homo sapiens
aattatcattgtttg

SEQ ID NO: 4761833 - DNA, 14 bp, Homo sapiens
aattatctgttcta

SEQ ID NO: 4761834 - DNA, 15 bp, Homo sapiens
aattatctgttctat

SEQ ID NO: 4761835 - DNA, 16 bp, Homo sapiens
aattatctgttctatg

SEQ ID NO: 4761836 - DNA, 16 bp, Homo sapiens
aattatctttaaaact

SEQ ID NO: 4761837 - DNA, 13 bp, Homo sapiens
aattattaaaaat

SEQ ID NO: 4761838 - DNA, 16 bp, Homo sapiens
aattattaatgaatgc

SEQ ID NO: 4761839 - DNA, 16 bp, Homo sapiens
aattattactttaaat

SEQ ID NO: 4761840 - DNA, 22 bp, Homo sapiens
aattattactttaaattatatg

SEQ ID NO: 4761841 - DNA, 18 bp, Homo sapiens
aattattagcaccagctt

SEQ ID NO: 4761842 - DNA, 17 bp, Homo sapiens
aattatttaactaatta

SEQ ID NO: 4761843 - DNA, 23 bp, Homo sapiens
aattatttaactaattaaaaaat

SEQ ID NO: 4761844 - DNA, 16 bp, Homo sapiens
aattcaaacctaagtt

SEQ ID NO: 4761845 - DNA, 13 bp, Homo sapiens
aattcacccctcc

SEQ ID NO: 4761846 - DNA, 16 bp, Homo sapiens
aattcagtggacattt

SEQ ID NO: 4761847 - DNA, 18 bp, Homo sapiens
aattcagtggacatttgt

SEQ ID NO: 4761848 - DNA, 21 bp, Homo sapiens
aattcattccatttgctgatt

SEQ ID NO: 4761849 - DNA, 17 bp, Homo sapiens
aattccaatacattatt

SEQ ID NO: 4761850 - DNA, 21 bp, Homo sapiens
aattccacctggaaagccagg

SEQ ID NO: 4761851 - DNA, 23 bp, Homo sapiens
aattccacctggaaagccaggtt

SEQ ID NO: 4761852 - DNA, 14 bp, Homo sapiens
aattcctaattcta

SEQ ID NO: 4761853 - DNA, 16 bp, Homo sapiens
aattcctaattctatg

SEQ ID NO: 4761854 - DNA, 18 bp, Homo sapiens
aattcctcctgtctcctc

SEQ ID NO: 4761855 - DNA, 19 bp, Homo sapiens
aattctaagattgtacata

SEQ ID NO: 4761856 - DNA, 20 bp, Homo sapiens
aattctgaaggggaaaacct

SEQ ID NO: 4761857 - DNA, 14 bp, Homo sapiens
aattcttacctcat

SEQ ID NO: 4761858 - DNA, 19 bp, Homo sapiens
aattcttacctcatttgca

SEQ ID NO: 4761859 - DNA, 15 bp, Homo sapiens
aattcttctcctttg

SEQ ID NO: 4761860 - DNA, 20 bp, Homo sapiens
aattcttctcctttgtcaaa

SEQ ID NO: 4761861 - DNA, 14 bp, Homo sapiens
aattcttgaataaa

SEQ ID NO: 4761862 - DNA, 13 bp, Homo sapiens
aattcttgcactg

SEQ ID NO: 4761863 - DNA, 22 bp, Homo sapiens
aattcttgcactgtatccaagt

SEQ ID NO: 4761864 - DNA, 16 bp, Homo sapiens
aattcttgccaagcaa

SEQ ID NO: 4761865 - DNA, 15 bp, Homo sapiens
aattcttttcccaga

SEQ ID NO: 4761866 - DNA, 16 bp, Homo sapiens
aattgaaaagaagtag

SEQ ID NO: 4761867 - DNA, 21 bp, Homo sapiens
aattgaaccgtcaatgtgaaa

SEQ ID NO: 4761868 - DNA, 22 bp, Homo sapiens
aattgaaccgtcaatgtgaaat

SEQ ID NO: 4761869 - DNA, 23 bp, Homo sapiens
aattgaagagagatatatctgaa

SEQ ID NO: 4761870 - DNA, 17 bp, Homo sapiens
aattgaggcttacagta

SEQ ID NO: 4761871 - DNA, 18 bp, Homo sapiens
aattgcatttttaccttt

SEQ ID NO: 4761872 - DNA, 15 bp, Homo sapiens
aattgctccattcct

SEQ ID NO: 4761873 - DNA, 15 bp, Homo sapiens
aattgcttctctaaa

SEQ ID NO: 4761874 - DNA, 14 bp, Homo sapiens
aattgcttgagcat

SEQ ID NO: 4761875 - DNA, 18 bp, Homo sapiens
aattggaagtctaagaac

SEQ ID NO: 4761876 - DNA, 14 bp, Homo sapiens
aattggttaatgaa

SEQ ID NO: 4761877 - DNA, 19 bp, Homo sapiens
aattgtaaaggtgatgaat

SEQ ID NO: 4761878 - DNA, 12 bp, Homo sapiens
aattgtaaggaa

SEQ ID NO: 4761879 - DNA, 16 bp, Homo sapiens
aattgtaaggaatgat

SEQ ID NO: 4761880 - DNA, 12 bp, Homo sapiens
aattgtataaaa

SEQ ID NO: 4761881 - DNA, 17 bp, Homo sapiens
aattgtataaaacagtg

SEQ ID NO: 4761882 - DNA, 18 bp, Homo sapiens
aattgtataaaacagtgt

SEQ ID NO: 4761883 - DNA, 15 bp, Homo sapiens
aattgtgtggagaag

SEQ ID NO: 4761884 - DNA, 18 bp, Homo sapiens
aattgtgtggagaagtgt

SEQ ID NO: 4761885 - DNA, 20 bp, Homo sapiens
aattgtgtggagaagtgtgt

SEQ ID NO: 4761886 - DNA, 14 bp, Homo sapiens
aattgtttaaaagc

SEQ ID NO: 4761887 - DNA, 17 bp, Homo sapiens
aattgtttaagaatcat

SEQ ID NO: 4761888 - DNA, 22 bp, Homo sapiens
aattgtttttagaaatttattc

SEQ ID NO: 4761889 - DNA, 17 bp, Homo sapiens
aatttagaggataaata

SEQ ID NO: 4761890 - DNA, 17 bp, Homo sapiens
aatttagcagtccattt

SEQ ID NO: 4761891 - DNA, 16 bp, Homo sapiens
aatttaggaatgctca

SEQ ID NO: 4761892 - DNA, 17 bp, Homo sapiens
aatttaggaatgctcaa

SEQ ID NO: 4761893 - DNA, 22 bp, Homo sapiens
aatttatcttccatatgctctt

SEQ ID NO: 4761894 - DNA, 15 bp, Homo sapiens
aatttattaaattta

SEQ ID NO: 4761895 - DNA, 16 bp, Homo sapiens
aatttattaaatttat

SEQ ID NO: 4761896 - DNA, 20 bp, Homo sapiens
aatttattagccctgcattt

SEQ ID NO: 4761897 - DNA, 13 bp, Homo sapiens
aatttattcttat

SEQ ID NO: 4761898 - DNA, 16 bp, Homo sapiens
aatttatttcatccag

SEQ ID NO: 4761899 - DNA, 20 bp, Homo sapiens
aatttattttattttagcag

SEQ ID NO: 4761900 - DNA, 18 bp, Homo sapiens
aatttcacgattcatttt

SEQ ID NO: 4761901 - DNA, 16 bp, Homo sapiens
aatttcctgtgaggat

SEQ ID NO: 4761902 - DNA, 12 bp, Homo sapiens
aatttctatggc

SEQ ID NO: 4761903 - DNA, 17 bp, Homo sapiens
aatttctgccatttcat

SEQ ID NO: 4761904 - DNA, 18 bp, Homo sapiens
aatttctgccatttcatg

SEQ ID NO: 4761905 - DNA, 17 bp, Homo sapiens
aatttgaagaattaatg

SEQ ID NO: 4761906 - DNA, 21 bp, Homo sapiens
aatttgacattgtcagaatgt

SEQ ID NO: 4761907 - DNA, 12 bp, Homo sapiens
aatttgttctgt

SEQ ID NO: 4761908 - DNA, 18 bp, Homo sapiens
aatttgtttgtgcttcta

SEQ ID NO: 4761909 - DNA, 15 bp, Homo sapiens
aattttcttctcatt

SEQ ID NO: 4761910 - DNA, 16 bp, Homo sapiens
aattttcttctcattc

SEQ ID NO: 4761911 - DNA, 17 bp, Homo sapiens
aattttggaagaattca

SEQ ID NO: 4761912 - DNA, 13 bp, Homo sapiens
acaaaaactaaaa

SEQ ID NO: 4761913 - DNA, 23 bp, Homo sapiens
acaaaacaaacaacctgccacaa

SEQ ID NO: 4761914 - DNA, 15 bp, Homo sapiens
acaaaacaaatcctg

SEQ ID NO: 4761915 - DNA, 13 bp, Homo sapiens
acaaaacaacagc

SEQ ID NO: 4761916 - DNA, 12 bp, Homo sapiens
acaaaaggctgg

SEQ ID NO: 4761917 - DNA, 21 bp, Homo sapiens
acaaaaggctggatgtgcttt

SEQ ID NO: 4761918 - DNA, 14 bp, Homo sapiens
acaaaatataaatc

SEQ ID NO: 4761919 - DNA, 21 bp, Homo sapiens
acaaaatgtgtgcttggaaaa

SEQ ID NO: 4761920 - DNA, 22 bp, Homo sapiens
acaaaatgtgtgcttggaaaat

SEQ ID NO: 4761921 - DNA, 23 bp, Homo sapiens
acaaaatgtgtgcttggaaaatg

SEQ ID NO: 4761922 - DNA, 12 bp, Homo sapiens
acaaaatttatg

SEQ ID NO: 4761923 - DNA, 23 bp, Homo sapiens
acaaaatttatgtcattttcaga

SEQ ID NO: 4761924 - DNA, 21 bp, Homo sapiens
acaaaccacaactgacacagg

SEQ ID NO: 4761925 - DNA, 13 bp, Homo sapiens
acaaacctctcag

SEQ ID NO: 4761926 - DNA, 21 bp, Homo sapiens
acaaacctgtttctgcagcca

SEQ ID NO: 4761927 - DNA, 23 bp, Homo sapiens
acaaaccttcttttcaatgcaat

SEQ ID NO: 4761928 - DNA, 13 bp, Homo sapiens
acaaactcatcca

SEQ ID NO: 4761929 - DNA, 12 bp, Homo sapiens
acaaacttttat

SEQ ID NO: 4761930 - DNA, 16 bp, Homo sapiens
acaaagaaaatgagaa

SEQ ID NO: 4761931 - DNA, 12 bp, Homo sapiens
acaaagaaatat

SEQ ID NO: 4761932 - DNA, 14 bp, Homo sapiens
acaaagatattatt

SEQ ID NO: 4761933 - DNA, 17 bp, Homo sapiens
acaaagcactggccttg

SEQ ID NO: 4761934 - DNA, 14 bp, Homo sapiens
acaaagcatgctca

SEQ ID NO: 4761935 - DNA, 20 bp, Homo sapiens
acaaagcatgctcagtattg

SEQ ID NO: 4761936 - DNA, 18 bp, Homo sapiens
acaaagccagctctgagc

SEQ ID NO: 4761937 - DNA, 15 bp, Homo sapiens
acaaagctatttaag

SEQ ID NO: 4761938 - DNA, 20 bp, Homo sapiens
acaaagctgtcactcacaaa

SEQ ID NO: 4761939 - DNA, 14 bp, Homo sapiens
acaaagtgaaatta

SEQ ID NO: 4761940 - DNA, 21 bp, Homo sapiens
acaaataagtcaaaataatct

SEQ ID NO: 4761941 - DNA, 20 bp, Homo sapiens
acaaatcaccttaactccct

SEQ ID NO: 4761942 - DNA, 13 bp, Homo sapiens
acaaatcagtaat

SEQ ID NO: 4761943 - DNA, 14 bp, Homo sapiens
acaaatcattttga

SEQ ID NO: 4761944 - DNA, 16 bp, Homo sapiens
acaaatcattttgatg

SEQ ID NO: 4761945 - DNA, 15 bp, Homo sapiens
acaaatctcactgta

SEQ ID NO: 4761946 - DNA, 17 bp, Homo sapiens
acaaatctcactgtatt

SEQ ID NO: 4761947 - DNA, 16 bp, Homo sapiens
acaaatgtcctcagag

SEQ ID NO: 4761948 - DNA, 17 bp, Homo sapiens
acaaatgtcctcagagg

SEQ ID NO: 4761949 - DNA, 15 bp, Homo sapiens
acaaattttcacaat

SEQ ID NO: 4761950 - DNA, 15 bp, Homo sapiens
acaaatttttactca

SEQ ID NO: 4761951 - DNA, 23 bp, Homo sapiens
acaacaaagcatgctcagtattg

SEQ ID NO: 4761952 - DNA, 14 bp, Homo sapiens
acaacaacaaagca

SEQ ID NO: 4761953 - DNA, 16 bp, Homo sapiens
acaacacattgaaact

SEQ ID NO: 4761954 - DNA, 18 bp, Homo sapiens
acaacacattgaaactgt

SEQ ID NO: 4761955 - DNA, 12 bp, Homo sapiens
acaacaggcatt

SEQ ID NO: 4761956 - DNA, 17 bp, Homo sapiens
acaacagtcagccagct

SEQ ID NO: 4761957 - DNA, 12 bp, Homo sapiens
acaacatgcaca

SEQ ID NO: 4761958 - DNA, 15 bp, Homo sapiens
acaaccatgttcttg

SEQ ID NO: 4761959 - DNA, 23 bp, Homo sapiens
acaaccatgttcttgagcagctg

SEQ ID NO: 4761960 - DNA, 20 bp, Homo sapiens
acaaccctgttgctacatca

SEQ ID NO: 4761961 - DNA, 21 bp, Homo sapiens
acaaccctgttgctacatcag

SEQ ID NO: 4761962 - DNA, 23 bp, Homo sapiens
acaaccttcatttaaaaaggttt

SEQ ID NO: 4761963 - DNA, 15 bp, Homo sapiens
acaacgatttctcca

SEQ ID NO: 4761964 - DNA, 23 bp, Homo sapiens
acaactcatccagaactgtctta

SEQ ID NO: 4761965 - DNA, 16 bp, Homo sapiens
acaactgacacaggaa

SEQ ID NO: 4761966 - DNA, 22 bp, Homo sapiens
acaactgtggataaattttgga

SEQ ID NO: 4761967 - DNA, 17 bp, Homo sapiens
acaactgtttttgaaga

SEQ ID NO: 4761968 - DNA, 19 bp, Homo sapiens
acaactgtttttgaagaag

SEQ ID NO: 4761969 - DNA, 19 bp, Homo sapiens
acaagaagaatttgaagac

SEQ ID NO: 4761970 - DNA, 18 bp, Homo sapiens
acaagagcccaggcctcc

SEQ ID NO: 4761971 - DNA, 17 bp, Homo sapiens
acaagcaaactgaaatt

SEQ ID NO: 4761972 - DNA, 22 bp, Homo sapiens
acaagcacaattgatctctttt

SEQ ID NO: 4761973 - DNA, 15 bp, Homo sapiens
acaagccgtgtttta

SEQ ID NO: 4761974 - DNA, 14 bp, Homo sapiens
acaagctacatatg

SEQ ID NO: 4761975 - DNA, 17 bp, Homo sapiens
acaaggcaaggctgtca

SEQ ID NO: 4761976 - DNA, 20 bp, Homo sapiens
acaaggcaaggctgtcaatt

SEQ ID NO: 4761977 - DNA, 18 bp, Homo sapiens
acaagtactggtaagatt

SEQ ID NO: 4761978 - DNA, 21 bp, Homo sapiens
acaagtctgagtagttatgaa

SEQ ID NO: 4761979 - DNA, 17 bp, Homo sapiens
acaataagaaacagttt

SEQ ID NO: 4761980 - DNA, 14 bp, Homo sapiens
acaataagccactg

SEQ ID NO: 4761981 - DNA, 15 bp, Homo sapiens
acaataatgaataat

SEQ ID NO: 4761982 - DNA, 19 bp, Homo sapiens
acaatattaagtgttgtac

SEQ ID NO: 4761983 - DNA, 23 bp, Homo sapiens
acaatattaagtgttgtacaatt

SEQ ID NO: 4761984 - DNA, 22 bp, Homo sapiens
acaatggcaagcatagtcgcct

SEQ ID NO: 4761985 - DNA, 18 bp, Homo sapiens
acaatggctgggtttggg

SEQ ID NO: 4761986 - DNA, 18 bp, Homo sapiens
acaatggtagctctgaag

SEQ ID NO: 4761987 - DNA, 21 bp, Homo sapiens
acaatggttttcttgtgtgtt

SEQ ID NO: 4761988 - DNA, 11 bp, Homo sapiens
acaatgtgata

SEQ ID NO: 4761989 - DNA, 14 bp, Homo sapiens
acaatgtggaatta

SEQ ID NO: 4761990 - DNA, 17 bp, Homo sapiens
acaatgtggaattacat

SEQ ID NO: 4761991 - DNA, 18 bp, Homo sapiens
acaatgtggaattacata

SEQ ID NO: 4761992 - DNA, 14 bp, Homo sapiens
acaattagatttct

SEQ ID NO: 4761993 - DNA, 19 bp, Homo sapiens
acaattcaaagaatcacct

SEQ ID NO: 4761994 - DNA, 12 bp, Homo sapiens
acaattctttgt

SEQ ID NO: 4761995 - DNA, 20 bp, Homo sapiens
acaattctttgttgcttaat

SEQ ID NO: 4761996 - DNA, 15 bp, Homo sapiens
acaattgatctcttt

SEQ ID NO: 4761997 - DNA, 15 bp, Homo sapiens
acaatttattttatt

SEQ ID NO: 4761998 - DNA, 13 bp, Homo sapiens
acacaaaacaaca

SEQ ID NO: 4761999 - DNA, 17 bp, Homo sapiens
acacaaaacaacagcaa

SEQ ID NO: 4762000 - DNA, 20 bp, Homo sapiens
acacaaaacaacagcaacaa

SEQ ID NO: 4762001 - DNA, 17 bp, Homo sapiens
acacaaagcctgtgtta

SEQ ID NO: 4762002 - DNA, 18 bp, Homo sapiens
acacaaagtgaaattagt

SEQ ID NO: 4762003 - DNA, 14 bp, Homo sapiens
acacaactcatcca

SEQ ID NO: 4762004 - DNA, 17 bp, Homo sapiens
acacaattggaagtcta

SEQ ID NO: 4762005 - DNA, 21 bp, Homo sapiens
acacacaaaacaacagcaaca

SEQ ID NO: 4762006 - DNA, 9 bp, Homo sapiens
acacacaca

SEQ ID NO: 4762007 - DNA, 14 bp, Homo sapiens
acacacacaaatat

SEQ ID NO: 4762008 - DNA, 12 bp, Homo sapiens
acacacacacac

SEQ ID NO: 4762009 - DNA, 21 bp, Homo sapiens
acacacacgcgtccacataca

SEQ ID NO: 4762010 - DNA, 12 bp, Homo sapiens
acacacatagat

SEQ ID NO: 4762011 - DNA, 14 bp, Homo sapiens
acacacatatacat

SEQ ID NO: 4762012 - DNA, 15 bp, Homo sapiens
acacacatatacatt

SEQ ID NO: 4762013 - DNA, 13 bp, Homo sapiens
acacacccttccc

SEQ ID NO: 4762014 - DNA, 20 bp, Homo sapiens
acacacccttccccactccc

SEQ ID NO: 4762015 - DNA, 16 bp, Homo sapiens
acacacgcgtccacat

SEQ ID NO: 4762016 - DNA, 18 bp, Homo sapiens
acacacggggcacccagc

SEQ ID NO: 4762017 - DNA, 19 bp, Homo sapiens
acacacgtgcaatttgttt

SEQ ID NO: 4762018 - DNA, 14 bp, Homo sapiens
acacacttcttcca

SEQ ID NO: 4762019 - DNA, 12 bp, Homo sapiens
acacagactctg

SEQ ID NO: 4762020 - DNA, 13 bp, Homo sapiens
acacagcagcccc

SEQ ID NO: 4762021 - DNA, 13 bp, Homo sapiens
acacagcatgcat

SEQ ID NO: 4762022 - DNA, 16 bp, Homo sapiens
acacagcccagagact

SEQ ID NO: 4762023 - DNA, 18 bp, Homo sapiens
acacagcccagagactga

SEQ ID NO: 4762024 - DNA, 19 bp, Homo sapiens
acacagcccagagactgaa

SEQ ID NO: 4762025 - DNA, 23 bp, Homo sapiens
acacagcccgagccccttgggga

SEQ ID NO: 4762026 - DNA, 17 bp, Homo sapiens
acacagcgtccctagca

SEQ ID NO: 4762027 - DNA, 21 bp, Homo sapiens
acacagctgagctggcctatt

SEQ ID NO: 4762028 - DNA, 19 bp, Homo sapiens
acacaggatcctggcctga

SEQ ID NO: 4762029 - DNA, 19 bp, Homo sapiens
acacaggcctggcccagcc

SEQ ID NO: 4762030 - DNA, 20 bp, Homo sapiens
acacaggcctggcccagcca

SEQ ID NO: 4762031 - DNA, 21 bp, Homo sapiens
acacaggcctggcccagccag

SEQ ID NO: 4762032 - DNA, 14 bp, Homo sapiens
acacaggctgccgc

SEQ ID NO: 4762033 - DNA, 17 bp, Homo sapiens
acacagtattgacttct

SEQ ID NO: 4762034 - DNA, 14 bp, Homo sapiens
acacagtctggtgc

SEQ ID NO: 4762035 - DNA, 19 bp, Homo sapiens
acacagtgggaactctgac

SEQ ID NO: 4762036 - DNA, 19 bp, Homo sapiens
acacatagattcacctgta

SEQ ID NO: 4762037 - DNA, 17 bp, Homo sapiens
acacatatgaacgcaca

SEQ ID NO: 4762038 - DNA, 16 bp, Homo sapiens
acacattgaaactgta

SEQ ID NO: 4762039 - DNA, 13 bp, Homo sapiens
acacattgtgtta

SEQ ID NO: 4762040 - DNA, 22 bp, Homo sapiens
acaccaaatagcttttcacttc

SEQ ID NO: 4762041 - DNA, 21 bp, Homo sapiens
aagataaaaactgcccattgt

SEQ ID NO: 4762042 - DNA, 20 bp, Homo sapiens
aagataaatccaactctgac

SEQ ID NO: 4762043 - DNA, 19 bp, Homo sapiens
aagataattaaatgaaata

SEQ ID NO: 4762044 - DNA, 21 bp, Homo sapiens
aagataattaaatgaaatact

SEQ ID NO: 4762045 - DNA, 12 bp, Homo sapiens
aagatactgttt

SEQ ID NO: 4762046 - DNA, 20 bp, Homo sapiens
aagatagcagaagagtagat

SEQ ID NO: 4762047 - DNA, 13 bp, Homo sapiens
aagatagttgtaa

SEQ ID NO: 4762048 - DNA, 23 bp, Homo sapiens
aagatagttgtaaagatattgta

SEQ ID NO: 4762049 - DNA, 15 bp, Homo sapiens
aagatagtttattat

SEQ ID NO: 4762050 - DNA, 17 bp, Homo sapiens
aagatattaccctcaga

SEQ ID NO: 4762051 - DNA, 21 bp, Homo sapiens
aagatattaccctcagaatat

SEQ ID NO: 4762052 - DNA, 17 bp, Homo sapiens
aagatattgtatctcct

SEQ ID NO: 4762053 - DNA, 18 bp, Homo sapiens
aagatattgtattatcat

SEQ ID NO: 4762054 - DNA, 19 bp, Homo sapiens
aagatctcagataaagtga

SEQ ID NO: 4762055 - DNA, 16 bp, Homo sapiens
aagatctttttttaag

SEQ ID NO: 4762056 - DNA, 17 bp, Homo sapiens
aagatgaaaatggaagt

SEQ ID NO: 4762057 - DNA, 20 bp, Homo sapiens
aagatgctgctgagcacatc

SEQ ID NO: 4762058 - DNA, 23 bp, Homo sapiens
aagatgctgctgagcacatctct

SEQ ID NO: 4762059 - DNA, 20 bp, Homo sapiens
aagatggagaaacaacaaat

SEQ ID NO: 4762060 - DNA, 19 bp, Homo sapiens
aagatggatttgacacact

SEQ ID NO: 4762061 - DNA, 21 bp, Homo sapiens
aagatggatttgacacactca

SEQ ID NO: 4762062 - DNA, 22 bp, Homo sapiens
aagatggcctaggatcttcact

SEQ ID NO: 4762063 - DNA, 18 bp, Homo sapiens
aagatgggtgattatgaa

SEQ ID NO: 4762064 - DNA, 14 bp, Homo sapiens
aagatgtgacatgt

SEQ ID NO: 4762065 - DNA, 18 bp, Homo sapiens
aagatgtgacatgtttta

SEQ ID NO: 4762066 - DNA, 16 bp, Homo sapiens
aagattaaaattagtg

SEQ ID NO: 4762067 - DNA, 20 bp, Homo sapiens
aagattaagttataccagca

SEQ ID NO: 4762068 - DNA, 21 bp, Homo sapiens
aagattagaaagaattagcca

SEQ ID NO: 4762069 - DNA, 21 bp, Homo sapiens
aagattatatacaaagctgtc

SEQ ID NO: 4762070 - DNA, 16 bp, Homo sapiens
aagattccattttgga

SEQ ID NO: 4762071 - DNA, 20 bp, Homo sapiens
aagattgttattaaatgtag

SEQ ID NO: 4762072 - DNA, 22 bp, Homo sapiens
aagattgttggcagtttcctcc

SEQ ID NO: 4762073 - DNA, 23 bp, Homo sapiens
aagcaaacacacagactctgtga

SEQ ID NO: 4762074 - DNA, 21 bp, Homo sapiens
aagcaaagacagtttcttgca

SEQ ID NO: 4762075 - DNA, 14 bp, Homo sapiens
aagcaaataaatat

SEQ ID NO: 4762076 - DNA, 12 bp, Homo sapiens
aagcaagctctc

SEQ ID NO: 4762077 - DNA, 14 bp, Homo sapiens
aagcaattagaagc

SEQ ID NO: 4762078 - DNA, 19 bp, Homo sapiens
aagcacaaaaaatttaaga

SEQ ID NO: 4762079 - DNA, 20 bp, Homo sapiens
aagcacaataaaagacatcc

SEQ ID NO: 4762080 - DNA, 16 bp, Homo sapiens
aagcacacttgacatc

SEQ ID NO: 4762081 - DNA, 19 bp, Homo sapiens
aagcacatgcctctctcag

SEQ ID NO: 4762082 - DNA, 21 bp, Homo sapiens
aagcacctcttgaagaactga

SEQ ID NO: 4762083 - DNA, 12 bp, Homo sapiens
aagcagaatgag

SEQ ID NO: 4762084 - DNA, 22 bp, Homo sapiens
aagcagagtcaagctgatgaag

SEQ ID NO: 4762085 - DNA, 19 bp, Homo sapiens
aagcagcagctagaaagag

SEQ ID NO: 4762086 - DNA, 20 bp, Homo sapiens
aagcagtacatcttgtgcat

SEQ ID NO: 4762087 - DNA, 12 bp, Homo sapiens
aagcagtgcatg

SEQ ID NO: 4762088 - DNA, 20 bp, Homo sapiens
aagcagtgcatgctgtccct

SEQ ID NO: 4762089 - DNA, 15 bp, Homo sapiens
aagcagtttcagata

SEQ ID NO: 4762090 - DNA, 17 bp, Homo sapiens
aagcagtttcagataaa

SEQ ID NO: 4762091 - DNA, 15 bp, Homo sapiens
aagcatgaagataaa

SEQ ID NO: 4762092 - DNA, 23 bp, Homo sapiens
aagcatgaggtgagagaaagcca

SEQ ID NO: 4762093 - DNA, 15 bp, Homo sapiens
aagcatgctcagtat

SEQ ID NO: 4762094 - DNA, 13 bp, Homo sapiens
aagcattgctaaa

SEQ ID NO: 4762095 - DNA, 13 bp, Homo sapiens
aagcatttcaaag

SEQ ID NO: 4762096 - DNA, 22 bp, Homo sapiens
aagcattttactgtctgtaaga

SEQ ID NO: 4762097 - DNA, 17 bp, Homo sapiens
aagccaaaaaccttagc

SEQ ID NO: 4762098 - DNA, 20 bp, Homo sapiens
aagccagcaggctctcaggc

SEQ ID NO: 4762099 - DNA, 19 bp, Homo sapiens
aagccagggttccagacag

SEQ ID NO: 4762100 - DNA, 15 bp, Homo sapiens
aagccaggttgtttt

SEQ ID NO: 4762101 - DNA, 21 bp, Homo sapiens
aagccatagccccaggcccgc

SEQ ID NO: 4762102 - DNA, 18 bp, Homo sapiens
aagcccacccgccccaga

SEQ ID NO: 4762103 - DNA, 23 bp, Homo sapiens
aagcccacccgccccagagactg

SEQ ID NO: 4762104 - DNA, 15 bp, Homo sapiens
aagcccaggaggacc

SEQ ID NO: 4762105 - DNA, 17 bp, Homo sapiens
aagccctccctgtctgt

SEQ ID NO: 4762106 - DNA, 15 bp, Homo sapiens
aagccctgcttgctg

SEQ ID NO: 4762107 - DNA, 15 bp, Homo sapiens
aagcctgttgtttaa

SEQ ID NO: 4762108 - DNA, 18 bp, Homo sapiens
aagcgacacaggctgccg

SEQ ID NO: 4762109 - DNA, 23 bp, Homo sapiens
aagcgacctaaacagctgcttta

SEQ ID NO: 4762110 - DNA, 14 bp, Homo sapiens
aagcgggaaacatg

SEQ ID NO: 4762111 - DNA, 15 bp, Homo sapiens
aagctcaaggctgca

SEQ ID NO: 4762112 - DNA, 15 bp, Homo sapiens
aagctcatagcacat

SEQ ID NO: 4762113 - DNA, 18 bp, Homo sapiens
aagctcatagcacatgtt

SEQ ID NO: 4762114 - DNA, 22 bp, Homo sapiens
aagctccagtgctttatccaca

SEQ ID NO: 4762115 - DNA, 23 bp, Homo sapiens
aagctctcttgccgaggagccag

SEQ ID NO: 4762116 - DNA, 23 bp, Homo sapiens
aagctgatgaagttaagcacaac

SEQ ID NO: 4762117 - DNA, 20 bp, Homo sapiens
aagctggagtgcagtggcat

SEQ ID NO: 4762118 - DNA, 18 bp, Homo sapiens
aagctgtttgaaggaaag

SEQ ID NO: 4762119 - DNA, 23 bp, Homo sapiens
aagcttgtattatcagtgaatat

SEQ ID NO: 4762120 - DNA, 14 bp, Homo sapiens
aaggaaaagagaaa

SEQ ID NO: 4762121 - DNA, 19 bp, Homo sapiens
aaggaaaccttttcttgta

SEQ ID NO: 4762122 - DNA, 13 bp, Homo sapiens
aaggaacttcatg

SEQ ID NO: 4762123 - DNA, 16 bp, Homo sapiens
aaggaagacagttcta

SEQ ID NO: 4762124 - DNA, 15 bp, Homo sapiens
aaggaagacttcatc

SEQ ID NO: 4762125 - DNA, 20 bp, Homo sapiens
aaggaatagatctatgattg

SEQ ID NO: 4762126 - DNA, 21 bp, Homo sapiens
aaggacaagcaattagaagcc

SEQ ID NO: 4762127 - DNA, 12 bp, Homo sapiens
aaggacagtgtt

SEQ ID NO: 4762128 - DNA, 13 bp, Homo sapiens
aaggactgaagaa

SEQ ID NO: 4762129 - DNA, 23 bp, Homo sapiens
aaggactgaagaaaatccttcag

SEQ ID NO: 4762130 - DNA, 16 bp, Homo sapiens
aaggacttctgcagct

SEQ ID NO: 4762131 - DNA, 12 bp, Homo sapiens
aaggagaaaaaa

SEQ ID NO: 4762132 - DNA, 13 bp, Homo sapiens
aaggagaggagtg

SEQ ID NO: 4762133 - DNA, 18 bp, Homo sapiens
aaggagatggggagggcg

SEQ ID NO: 4762134 - DNA, 23 bp, Homo sapiens
aaggagcagagctgatggagaag

SEQ ID NO: 4762135 - DNA, 18 bp, Homo sapiens
aaggaggcatgcctctga

SEQ ID NO: 4762136 - DNA, 15 bp, Homo sapiens
aaggaggggaagctg

SEQ ID NO: 4762137 - DNA, 18 bp, Homo sapiens
aaggaggggaagctgcag

SEQ ID NO: 4762138 - DNA, 20 bp, Homo sapiens
aaggattcttttttcaatgt

SEQ ID NO: 4762139 - DNA, 21 bp, Homo sapiens
aaggattcttttttcaatgta

SEQ ID NO: 4762140 - DNA, 15 bp, Homo sapiens
aaggatttattctca

SEQ ID NO: 4762141 - DNA, 22 bp, Homo sapiens
aaggatttattctcagaacacc

SEQ ID NO: 4762142 - DNA, 18 bp, Homo sapiens
aaggcaacatttccgaag

SEQ ID NO: 4762143 - DNA, 16 bp, Homo sapiens
aaggcaagaagtggga

SEQ ID NO: 4762144 - DNA, 13 bp, Homo sapiens
aaggcaaggctgt

SEQ ID NO: 4762145 - DNA, 16 bp, Homo sapiens
aaggcaaggctgtcaa

SEQ ID NO: 4762146 - DNA, 18 bp, Homo sapiens
aaggcaaggctgtcaatt

SEQ ID NO: 4762147 - DNA, 12 bp, Homo sapiens
aaggcactgagc

SEQ ID NO: 4762148 - DNA, 14 bp, Homo sapiens
aaggcagggaggag

SEQ ID NO: 4762149 - DNA, 15 bp, Homo sapiens
aaggcagggccctga

SEQ ID NO: 4762150 - DNA, 21 bp, Homo sapiens
aaggcatgcctggacaaaccc

SEQ ID NO: 4762151 - DNA, 18 bp, Homo sapiens
aaggccccaaggtttaca

SEQ ID NO: 4762152 - DNA, 14 bp, Homo sapiens
aaggccccagggca

SEQ ID NO: 4762153 - DNA, 17 bp, Homo sapiens
aaggcccccacctctgt

SEQ ID NO: 4762154 - DNA, 12 bp, Homo sapiens
aaggccccttcc

SEQ ID NO: 4762155 - DNA, 14 bp, Homo sapiens
aaggccgttaggga

SEQ ID NO: 4762156 - DNA, 22 bp, Homo sapiens
aaggcctgagggaagcccaccc

SEQ ID NO: 4762157 - DNA, 18 bp, Homo sapiens
aaggcctgccccccttcc

SEQ ID NO: 4762158 - DNA, 19 bp, Homo sapiens
aaggccttgccagcaacac

SEQ ID NO: 4762159 - DNA, 17 bp, Homo sapiens
aaggctgactcttacta

SEQ ID NO: 4762160 - DNA, 19 bp, Homo sapiens
aaggctgcagctaatttgt

SEQ ID NO: 4762161 - DNA, 22 bp, Homo sapiens
aaggctgcagctaatttgtgaa

SEQ ID NO: 4762162 - DNA, 17 bp, Homo sapiens
aaggctggatgtgcttt

SEQ ID NO: 4762163 - DNA, 20 bp, Homo sapiens
aaggctgtcaattacaggaa

SEQ ID NO: 4762164 - DNA, 22 bp, Homo sapiens
aaggcttccaatgtggtggcaa

SEQ ID NO: 4762165 - DNA, 18 bp, Homo sapiens
aagggactccagaagcag

SEQ ID NO: 4762166 - DNA, 16 bp, Homo sapiens
aagggaggggaagaga

SEQ ID NO: 4762167 - DNA, 15 bp, Homo sapiens
aagggatccagagac

SEQ ID NO: 4762168 - DNA, 23 bp, Homo sapiens
aagggatccagagacctgctcca

SEQ ID NO: 4762169 - DNA, 12 bp, Homo sapiens
aagggcagcccc

SEQ ID NO: 4762170 - DNA, 15 bp, Homo sapiens
aagggcagccccgcg

SEQ ID NO: 4762171 - DNA, 14 bp, Homo sapiens
aagggcagcccctc

SEQ ID NO: 4762172 - DNA, 11 bp, Homo sapiens
aagggcccagg

SEQ ID NO: 4762173 - DNA, 18 bp, Homo sapiens
aagggctgacctgcctct

SEQ ID NO: 4762174 - DNA, 13 bp, Homo sapiens
aaggggagagtaa

SEQ ID NO: 4762175 - DNA, 16 bp, Homo sapiens
aaggggccaggaaggg

SEQ ID NO: 4762176 - DNA, 21 bp, Homo sapiens
aaggggccaggaaggggacag

SEQ ID NO: 4762177 - DNA, 15 bp, Homo sapiens
aaggggcctgggctg

SEQ ID NO: 4762178 - DNA, 20 bp, Homo sapiens
aaggggcgctcctcccagct

SEQ ID NO: 4762179 - DNA, 15 bp, Homo sapiens
aaggggtggaagggc

SEQ ID NO: 4762180 - DNA, 21 bp, Homo sapiens
aaggtacggtgagactctgag

SEQ ID NO: 4762181 - DNA, 22 bp, Homo sapiens
aaggtacggtgagactctgagg

SEQ ID NO: 4762182 - DNA, 18 bp, Homo sapiens
aaggtagcttacctgaca

SEQ ID NO: 4762183 - DNA, 18 bp, Homo sapiens
aaggtaggtgcatgcctt

SEQ ID NO: 4762184 - DNA, 12 bp, Homo sapiens
aaggtcatctca

SEQ ID NO: 4762185 - DNA, 15 bp, Homo sapiens
aaggtcctgctgtgg

SEQ ID NO: 4762186 - DNA, 18 bp, Homo sapiens
aaggtgcacctgccccag

SEQ ID NO: 4762187 - DNA, 17 bp, Homo sapiens
aaggtgctcttctcatt

SEQ ID NO: 4762188 - DNA, 12 bp, Homo sapiens
aaggttctatga

SEQ ID NO: 4762189 - DNA, 19 bp, Homo sapiens
aaggttcttcatccctttc

SEQ ID NO: 4762190 - DNA, 16 bp, Homo sapiens
aaggttgtacatagtg

SEQ ID NO: 4762191 - DNA, 16 bp, Homo sapiens
aaggtttcactgttca

SEQ ID NO: 4762192 - DNA, 15 bp, Homo sapiens
aagtaaatctatctc

SEQ ID NO: 4762193 - DNA, 21 bp, Homo sapiens
aagtaaatgtcttcatgttga

SEQ ID NO: 4762194 - DNA, 16 bp, Homo sapiens
aagtaaattattttat

SEQ ID NO: 4762195 - DNA, 15 bp, Homo sapiens
aagtaattttcttct

SEQ ID NO: 4762196 - DNA, 15 bp, Homo sapiens
aagtacataaagtaa

SEQ ID NO: 4762197 - DNA, 22 bp, Homo sapiens
aagtactagcaataagttgaat

SEQ ID NO: 4762198 - DNA, 13 bp, Homo sapiens
aagtagatttcat

SEQ ID NO: 4762199 - DNA, 19 bp, Homo sapiens
aagtagtacttcttctgta

SEQ ID NO: 4762200 - DNA, 19 bp, Homo sapiens
aagtatattcaaaaattat

SEQ ID NO: 4762201 - DNA, 16 bp, Homo sapiens
aagtatgcactaatca

SEQ ID NO: 4762202 - DNA, 18 bp, Homo sapiens
aagtatgcactaatcaat

SEQ ID NO: 4762203 - DNA, 22 bp, Homo sapiens
aagtatgcactaatcaatactt

SEQ ID NO: 4762204 - DNA, 18 bp, Homo sapiens
aagtattccaccttaaat

SEQ ID NO: 4762205 - DNA, 20 bp, Homo sapiens
aagtattccaccttaaatta

SEQ ID NO: 4762206 - DNA, 18 bp, Homo sapiens
aagtattccttggcccag

SEQ ID NO: 4762207 - DNA, 20 bp, Homo sapiens
aagtcagaaactaaaacaaa

SEQ ID NO: 4762208 - DNA, 19 bp, Homo sapiens
aagtcctcgccccccgccc

SEQ ID NO: 4762209 - DNA, 22 bp, Homo sapiens
aagtctacctgccttgcctgtt

SEQ ID NO: 4762210 - DNA, 20 bp, Homo sapiens
aagtctcgtgagaatatact

SEQ ID NO: 4762211 - DNA, 19 bp, Homo sapiens
aagtctctctaagacaaat

SEQ ID NO: 4762212 - DNA, 23 bp, Homo sapiens
aagtctctctaagacaaatgcag

SEQ ID NO: 4762213 - DNA, 12 bp, Homo sapiens
aagtgaaaaaga

SEQ ID NO: 4762214 - DNA, 21 bp, Homo sapiens
aagtgaaattagtattttgag

SEQ ID NO: 4762215 - DNA, 10 bp, Homo sapiens
aagtgaccaa

SEQ ID NO: 4762216 - DNA, 14 bp, Homo sapiens
aagtgatgtgattt

SEQ ID NO: 4762217 - DNA, 17 bp, Homo sapiens
aagtgatgtgatttatg

SEQ ID NO: 4762218 - DNA, 11 bp, Homo sapiens
aagtgcatgtt

SEQ ID NO: 4762219 - DNA, 13 bp, Homo sapiens
aagtgcatgttaa

SEQ ID NO: 4762220 - DNA, 20 bp, Homo sapiens
aagtgcatgttaaaataatt

SEQ ID NO: 4762221 - DNA, 17 bp, Homo sapiens
aagtggaagacagagat

SEQ ID NO: 4762222 - DNA, 14 bp, Homo sapiens
aagtggactgtatt

SEQ ID NO: 4762223 - DNA, 15 bp, Homo sapiens
aagtggcaagctctt

SEQ ID NO: 4762224 - DNA, 19 bp, Homo sapiens
aagtggcaagctcttcatt

SEQ ID NO: 4762225 - DNA, 21 bp, Homo sapiens
aagtgtgcctgctatccagcc

SEQ ID NO: 4762226 - DNA, 13 bp, Homo sapiens
aagtgtgttctga

SEQ ID NO: 4762227 - DNA, 15 bp, Homo sapiens
aagtgtgttctgatg

SEQ ID NO: 4762228 - DNA, 19 bp, Homo sapiens
aagtgtttaattgtataaa

SEQ ID NO: 4762229 - DNA, 23 bp, Homo sapiens
aagtgtttaattgtataaaacag

SEQ ID NO: 4762230 - DNA, 15 bp, Homo sapiens
aagtgtttttacata

SEQ ID NO: 4762231 - DNA, 18 bp, Homo sapiens
aagttataccagcaaaag

SEQ ID NO: 4762232 - DNA, 17 bp, Homo sapiens
aagttatttgatctggt

SEQ ID NO: 4762233 - DNA, 19 bp, Homo sapiens
aagttatttgatctggtgc

SEQ ID NO: 4762234 - DNA, 19 bp, Homo sapiens
aagttcattcatactcaaa

SEQ ID NO: 4762235 - DNA, 22 bp, Homo sapiens
aagttcattcatactcaaagag

SEQ ID NO: 4762236 - DNA, 13 bp, Homo sapiens
aagttgaatgata

SEQ ID NO: 4762237 - DNA, 20 bp, Homo sapiens
aagttgacctttatttatta

SEQ ID NO: 4762238 - DNA, 18 bp, Homo sapiens
aagttgcagtcagaagat

SEQ ID NO: 4762239 - DNA, 22 bp, Homo sapiens
aagttgtgatctgttgtaatat

SEQ ID NO: 4762240 - DNA, 23 bp, Homo sapiens
aagtttaaatctttgttaaaata

SEQ ID NO: 4762241 - DNA, 21 bp, Homo sapiens
aagtttctgccgcagccctgc

SEQ ID NO: 4762242 - DNA, 16 bp, Homo sapiens
aagtttctttgagggt

SEQ ID NO: 4762243 - DNA, 11 bp, Homo sapiens
aataaaaatag

SEQ ID NO: 4762244 - DNA, 13 bp, Homo sapiens
aataaaaatagct

SEQ ID NO: 4762245 - DNA, 12 bp, Homo sapiens
aataaaataacc

SEQ ID NO: 4762246 - DNA, 22 bp, Homo sapiens
aataaaattcattccatttgct

SEQ ID NO: 4762247 - DNA, 22 bp, Homo sapiens
aataaacacatagattcacctg

SEQ ID NO: 4762248 - DNA, 12 bp, Homo sapiens
aataaaccagac

SEQ ID NO: 4762249 - DNA, 20 bp, Homo sapiens
aataaaccggatcctgttgc

SEQ ID NO: 4762250 - DNA, 14 bp, Homo sapiens
aataaactccttaa

SEQ ID NO: 4762251 - DNA, 11 bp, Homo sapiens
aataaactgtt

SEQ ID NO: 4762252 - DNA, 11 bp, Homo sapiens
aataaagccac

SEQ ID NO: 4762253 - DNA, 21 bp, Homo sapiens
aataaagccttgtgatcactt

SEQ ID NO: 4762254 - DNA, 12 bp, Homo sapiens
aataaaggttct

SEQ ID NO: 4762255 - DNA, 19 bp, Homo sapiens
aataaagtattccacctta

SEQ ID NO: 4762256 - DNA, 12 bp, Homo sapiens
aataaatgctgc

SEQ ID NO: 4762257 - DNA, 16 bp, Homo sapiens
aataaatgctgctttg

SEQ ID NO: 4762258 - DNA, 17 bp, Homo sapiens
aataaatgctgctttgg

SEQ ID NO: 4762259 - DNA, 14 bp, Homo sapiens
aataaatgtgtaaa

SEQ ID NO: 4762260 - DNA, 17 bp, Homo sapiens
aataaatttataacaat

SEQ ID NO: 4762261 - DNA, 19 bp, Homo sapiens
aataaatttataacaattg

SEQ ID NO: 4762262 - DNA, 13 bp, Homo sapiens
aataactattgct

SEQ ID NO: 4762263 - DNA, 18 bp, Homo sapiens
aataactgtgactgtggg

SEQ ID NO: 4762264 - DNA, 17 bp, Homo sapiens
aataagaaacagtttaa

SEQ ID NO: 4762265 - DNA, 19 bp, Homo sapiens
aataagaaacagtttaaca

SEQ ID NO: 4762266 - DNA, 21 bp, Homo sapiens
aataaggatttattctcagaa

SEQ ID NO: 4762267 - DNA, 23 bp, Homo sapiens
aataaggatttattctcagaaca

SEQ ID NO: 4762268 - DNA, 20 bp, Homo sapiens
aataagtcaaaataatctga

SEQ ID NO: 4762269 - DNA, 15 bp, Homo sapiens
aataagttcccattt

SEQ ID NO: 4762270 - DNA, 13 bp, Homo sapiens
aataataaaagaa

SEQ ID NO: 4762271 - DNA, 19 bp, Homo sapiens
aataataaaggttctatga

SEQ ID NO: 4762272 - DNA, 18 bp, Homo sapiens
aataatgcctttgtaacc

SEQ ID NO: 4762273 - DNA, 22 bp, Homo sapiens
aataatgcctttgtaaccacaa

SEQ ID NO: 4762274 - DNA, 21 bp, Homo sapiens
aataatgtgggaagaaacaaa

SEQ ID NO: 4762275 - DNA, 21 bp, Homo sapiens
aatacagctaaggccttgcca

SEQ ID NO: 4762276 - DNA, 13 bp, Homo sapiens
aatacagtattat

SEQ ID NO: 4762277 - DNA, 15 bp, Homo sapiens
aatacagtattattt

SEQ ID NO: 4762278 - DNA, 22 bp, Homo sapiens
aatacattattgaaaagcaaat

SEQ ID NO: 4762279 - DNA, 22 bp, Homo sapiens
aatacattattggacttccatt

SEQ ID NO: 4762280 - DNA, 12 bp, Homo sapiens
aatacattcttg

SEQ ID NO: 4762281 - DNA, 13 bp, Homo sapiens
aatacgcttgagc

SEQ ID NO: 4762282 - DNA, 13 bp, Homo sapiens
aatactaataaaa

SEQ ID NO: 4762283 - DNA, 18 bp, Homo sapiens
aatactaataaaatacat

SEQ ID NO: 4762284 - DNA, 14 bp, Homo sapiens
aatacttcttttta

SEQ ID NO: 4762285 - DNA, 15 bp, Homo sapiens
aatacttgacaacat

SEQ ID NO: 4762286 - DNA, 15 bp, Homo sapiens
aatactttgtgtctt

SEQ ID NO: 4762287 - DNA, 17 bp, Homo sapiens
aatagaaaacaggaaaa

SEQ ID NO: 4762288 - DNA, 21 bp, Homo sapiens
aatagccccatctctcctgct

SEQ ID NO: 4762289 - DNA, 16 bp, Homo sapiens
aatagctgatagaaga

SEQ ID NO: 4762290 - DNA, 17 bp, Homo sapiens
aataggagggaaacctt

SEQ ID NO: 4762291 - DNA, 19 bp, Homo sapiens
aataggagggaaacctttg

SEQ ID NO: 4762292 - DNA, 13 bp, Homo sapiens
aatagtcatgttt

SEQ ID NO: 4762293 - DNA, 16 bp, Homo sapiens
aatagtcatgtttctg

SEQ ID NO: 4762294 - DNA, 19 bp, Homo sapiens
aatagtgaaaattttattg

SEQ ID NO: 4762295 - DNA, 23 bp, Homo sapiens
aatagttgtaggggaaatcaagg

SEQ ID NO: 4762296 - DNA, 13 bp, Homo sapiens
aatataaaaacat

SEQ ID NO: 4762297 - DNA, 13 bp, Homo sapiens
aatataaactgtg

SEQ ID NO: 4762298 - DNA, 16 bp, Homo sapiens
aatataaatcacagat

SEQ ID NO: 4762299 - DNA, 18 bp, Homo sapiens
aatataaatcacagattt

SEQ ID NO: 4762300 - DNA, 17 bp, Homo sapiens
aatataaatgtactaca

SEQ ID NO: 4762301 - DNA, 18 bp, Homo sapiens
aatataagacaagtctga

SEQ ID NO: 4762302 - DNA, 22 bp, Homo sapiens
aatataatgggctgcaaaatga

SEQ ID NO: 4762303 - DNA, 14 bp, Homo sapiens
aatatacaaacatg

SEQ ID NO: 4762304 - DNA, 20 bp, Homo sapiens
aatatacaaacatgtggcaa

SEQ ID NO: 4762305 - DNA, 21 bp, Homo sapiens
aatatacaactttggaatttg

SEQ ID NO: 4762306 - DNA, 18 bp, Homo sapiens
aatatacaatttcttgaa

SEQ ID NO: 4762307 - DNA, 15 bp, Homo sapiens
aatatactcatttgg

SEQ ID NO: 4762308 - DNA, 15 bp, Homo sapiens
aatatactccttaaa

SEQ ID NO: 4762309 - DNA, 22 bp, Homo sapiens
aatatactccttaaaaatgtat

SEQ ID NO: 4762310 - DNA, 13 bp, Homo sapiens
aatatagaaaaaa

SEQ ID NO: 4762311 - DNA, 22 bp, Homo sapiens
aatatagaaaaaaacattctat

SEQ ID NO: 4762312 - DNA, 20 bp, Homo sapiens
aatatatacatattcaaagt

SEQ ID NO: 4762313 - DNA, 21 bp, Homo sapiens
aatatatacatattcaaagta

SEQ ID NO: 4762314 - DNA, 15 bp, Homo sapiens
aatatatatttatca

SEQ ID NO: 4762315 - DNA, 15 bp, Homo sapiens
aatatatgtaatata

SEQ ID NO: 4762316 - DNA, 21 bp, Homo sapiens
aatatatgtaatatatacata

SEQ ID NO: 4762317 - DNA, 14 bp, Homo sapiens
aatatatgtatgta

SEQ ID NO: 4762318 - DNA, 14 bp, Homo sapiens
aatatatgtgaaag

SEQ ID NO: 4762319 - DNA, 14 bp, Homo sapiens
aatatatgtttggc

SEQ ID NO: 4762320 - DNA, 22 bp, Homo sapiens
aatatatgtttggctgaaatta

SEQ ID NO: 4762321 - DNA, 21 bp, Homo sapiens
aatatattagtaagatactgt

SEQ ID NO: 4762322 - DNA, 15 bp, Homo sapiens
aatatcactcattaa

SEQ ID NO: 4762323 - DNA, 17 bp, Homo sapiens
aatatcagttacagtgg

SEQ ID NO: 4762324 - DNA, 22 bp, Homo sapiens
aatatcagttacagtggcagta

SEQ ID NO: 4762325 - DNA, 22 bp, Homo sapiens
aatatcattatagcatgtaata

SEQ ID NO: 4762326 - DNA, 17 bp, Homo sapiens
aatatcatttcataaaa

SEQ ID NO: 4762327 - DNA, 19 bp, Homo sapiens
aatatctatttatctgtct

SEQ ID NO: 4762328 - DNA, 18 bp, Homo sapiens
aatatcttcgttagtaat

SEQ ID NO: 4762329 - DNA, 13 bp, Homo sapiens
aatatcttgaaga

SEQ ID NO: 4762330 - DNA, 15 bp, Homo sapiens
aatatgagattggaa

SEQ ID NO: 4762331 - DNA, 21 bp, Homo sapiens
aatatggaaccttccctccaa

SEQ ID NO: 4762332 - DNA, 17 bp, Homo sapiens
aatatgtgtacacatat

SEQ ID NO: 4762333 - DNA, 15 bp, Homo sapiens
aatattaaaaattaa

SEQ ID NO: 4762334 - DNA, 18 bp, Homo sapiens
aatattatacttctttat

SEQ ID NO: 4762335 - DNA, 15 bp, Homo sapiens
aatattcatgctgcc

SEQ ID NO: 4762336 - DNA, 22 bp, Homo sapiens
aatattcatgctgcctgccatg

SEQ ID NO: 4762337 - DNA, 19 bp, Homo sapiens
aatattgagcagaattcat

SEQ ID NO: 4762338 - DNA, 22 bp, Homo sapiens
aatattgctattgtttatagga

SEQ ID NO: 4762339 - DNA, 22 bp, Homo sapiens
aatattgttaaaaccttactta

SEQ ID NO: 4762340 - DNA, 23 bp, Homo sapiens
aatatttataaatgaagatgcat

SEQ ID NO: 4762341 - DNA, 16 bp, Homo sapiens
aatatttattgcttta

SEQ ID NO: 4762342 - DNA, 21 bp, Homo sapiens
aatatttattgctttataaat

SEQ ID NO: 4762343 - DNA, 14 bp, Homo sapiens
aatatttcttcaaa

SEQ ID NO: 4762344 - DNA, 15 bp, Homo sapiens
aatatttgcttattt

SEQ ID NO: 4762345 - DNA, 21 bp, Homo sapiens
aatattttctactttaaattg

SEQ ID NO: 4762346 - DNA, 16 bp, Homo sapiens
aatcaaaaaattatct

SEQ ID NO: 4762347 - DNA, 22 bp, Homo sapiens
aatcaaataaaaattctagatt

SEQ ID NO: 4762348 - DNA, 22 bp, Homo sapiens
aatcaagatgggtgattatgaa

SEQ ID NO: 4762349 - DNA, 12 bp, Homo sapiens
aatcaatacttt

SEQ ID NO: 4762350 - DNA, 14 bp, Homo sapiens
aatcaatactttga

SEQ ID NO: 4762351 - DNA, 14 bp, Homo sapiens
aatcaattaaaagt

SEQ ID NO: 4762352 - DNA, 16 bp, Homo sapiens
aatcaatttaaaggaa

SEQ ID NO: 4762353 - DNA, 22 bp, Homo sapiens
aatcaatttaaaggaaagttct

SEQ ID NO: 4762354 - DNA, 19 bp, Homo sapiens
aatcacaaactcatccatt

SEQ ID NO: 4762355 - DNA, 11 bp, Homo sapiens
aatcacagcca

SEQ ID NO: 4762356 - DNA, 19 bp, Homo sapiens
aatcacctaattaatttca

SEQ ID NO: 4762357 - DNA, 20 bp, Homo sapiens
aatcacctaattaatttcag

SEQ ID NO: 4762358 - DNA, 15 bp, Homo sapiens
aatcactaaatatct

SEQ ID NO: 4762359 - DNA, 18 bp, Homo sapiens
aatcactaaatatctagt

SEQ ID NO: 4762360 - DNA, 20 bp, Homo sapiens
aatcactcatttatttccat

SEQ ID NO: 4762361 - DNA, 14 bp, Homo sapiens
aatcagaatggaag

SEQ ID NO: 4762362 - DNA, 12 bp, Homo sapiens
aatcagactctt

SEQ ID NO: 4762363 - DNA, 17 bp, Homo sapiens
aatcagcactgaaaata

SEQ ID NO: 4762364 - DNA, 17 bp, Homo sapiens
aatcaggattccttctt

SEQ ID NO: 4762365 - DNA, 11 bp, Homo sapiens
aatcagtaatt

SEQ ID NO: 4762366 - DNA, 22 bp, Homo sapiens
aatcataaatactgctgtataa

SEQ ID NO: 4762367 - DNA, 14 bp, Homo sapiens
aatcatacacagaa

SEQ ID NO: 4762368 - DNA, 13 bp, Homo sapiens
aatcatatataat

SEQ ID NO: 4762369 - DNA, 16 bp, Homo sapiens
aatcatcaaagtgttt

SEQ ID NO: 4762370 - DNA, 19 bp, Homo sapiens
aatcatcaaagtgtttaat

SEQ ID NO: 4762371 - DNA, 19 bp, Homo sapiens
aatcatccttttttaaaaa

SEQ ID NO: 4762372 - DNA, 13 bp, Homo sapiens
aatcatggattta

SEQ ID NO: 4762373 - DNA, 21 bp, Homo sapiens
aatcatggatttattttttgt

SEQ ID NO: 4762374 - DNA, 23 bp, Homo sapiens
aatcatggatttattttttgtaa

SEQ ID NO: 4762375 - DNA, 23 bp, Homo sapiens
aatcatgggcattgctggactga

SEQ ID NO: 4762376 - DNA, 17 bp, Homo sapiens
aatcattgtacagtttg

SEQ ID NO: 4762377 - DNA, 22 bp, Homo sapiens
aatcattgtacagtttgtttac

SEQ ID NO: 4762378 - DNA, 21 bp, Homo sapiens
aatcattgtcagagatgtttt

SEQ ID NO: 4762379 - DNA, 12 bp, Homo sapiens
aatcattttgat

SEQ ID NO: 4762380 - DNA, 14 bp, Homo sapiens
aatcattttgatgt

SEQ ID NO: 4762381 - DNA, 14 bp, Homo sapiens
aatccacagtattg

SEQ ID NO: 4762382 - DNA, 21 bp, Homo sapiens
aatccacctggtggccctgcg

SEQ ID NO: 4762383 - DNA, 13 bp, Homo sapiens
aatccatgatcaa

SEQ ID NO: 4762384 - DNA, 20 bp, Homo sapiens
aatccatgatcaaaatgcat

SEQ ID NO: 4762385 - DNA, 22 bp, Homo sapiens
aatccatgtgtcccccctgtgg

SEQ ID NO: 4762386 - DNA, 14 bp, Homo sapiens
aatctaaattaact

SEQ ID NO: 4762387 - DNA, 18 bp, Homo sapiens
aatctacaaacttttata

SEQ ID NO: 4762388 - DNA, 19 bp, Homo sapiens
aatctacaaacttttataa

SEQ ID NO: 4762389 - DNA, 17 bp, Homo sapiens
aatctactcttaaatat

SEQ ID NO: 4762390 - DNA, 18 bp, Homo sapiens
aatctactcttaaatata

SEQ ID NO: 4762391 - DNA, 20 bp, Homo sapiens
aatctactcttaaatataca

SEQ ID NO: 4762392 - DNA, 15 bp, Homo sapiens
aatctagagctatgc

SEQ ID NO: 4762393 - DNA, 13 bp, Homo sapiens
aatctcactgtat

SEQ ID NO: 4762394 - DNA, 20 bp, Homo sapiens
aatctcgcactacatctgat

SEQ ID NO: 4762395 - DNA, 11 bp, Homo sapiens
aatctctgtga

SEQ ID NO: 4762396 - DNA, 13 bp, Homo sapiens
aatctctgtgact

SEQ ID NO: 4762397 - DNA, 13 bp, Homo sapiens
aatctcttgtcat

SEQ ID NO: 4762398 - DNA, 21 bp, Homo sapiens
aatctcttgtcattctcatcc

SEQ ID NO: 4762399 - DNA, 15 bp, Homo sapiens
aatctgaatttctaa

SEQ ID NO: 4762400 - DNA, 21 bp, Homo sapiens
aatctgtataatactttgtat

SEQ ID NO: 4762401 - DNA, 14 bp, Homo sapiens
aatctgtccagaca

SEQ ID NO: 4762402 - DNA, 21 bp, Homo sapiens
aatctgtcgcatttcatcaag

SEQ ID NO: 4762403 - DNA, 19 bp, Homo sapiens
aatcttacccttcaatgtt

SEQ ID NO: 4762404 - DNA, 20 bp, Homo sapiens
aatcttacccttcaatgtta

SEQ ID NO: 4762405 - DNA, 23 bp, Homo sapiens
aatcttacccttcaatgttaaat

SEQ ID NO: 4762406 - DNA, 13 bp, Homo sapiens
aatcttctgaact

SEQ ID NO: 4762407 - DNA, 13 bp, Homo sapiens
aatctttgttaaa

SEQ ID NO: 4762408 - DNA, 17 bp, Homo sapiens
aatctttgttaaaatat

SEQ ID NO: 4762409 - DNA, 18 bp, Homo sapiens
aatctttgttaaaatata

SEQ ID NO: 4762410 - DNA, 20 bp, Homo sapiens
aatcttttggggtcatcttt

SEQ ID NO: 4762411 - DNA, 15 bp, Homo sapiens
aatgaaaaatctgaa

SEQ ID NO: 4762412 - DNA, 19 bp, Homo sapiens
aatgaaaatggctgaagaa

SEQ ID NO: 4762413 - DNA, 12 bp, Homo sapiens
aatgaaatactt

SEQ ID NO: 4762414 - DNA, 14 bp, Homo sapiens
aaatggctgaagaa

SEQ ID NO: 4762415 - DNA, 19 bp, Homo sapiens
aaatggggaactcccccag

SEQ ID NO: 4762416 - DNA, 15 bp, Homo sapiens
aaatggtattttttg

SEQ ID NO: 4762417 - DNA, 21 bp, Homo sapiens
aaatggtattttttgtgaatg

SEQ ID NO: 4762418 - DNA, 14 bp, Homo sapiens
aaatggtgtcataa

SEQ ID NO: 4762419 - DNA, 18 bp, Homo sapiens
aaatggtgttttcatgta

SEQ ID NO: 4762420 - DNA, 22 bp, Homo sapiens
aaatggtgttttcatgtaaata

SEQ ID NO: 4762421 - DNA, 19 bp, Homo sapiens
aaatgtactacatttgcat

SEQ ID NO: 4762422 - DNA, 20 bp, Homo sapiens
aaatgtactacatttgcatg

SEQ ID NO: 4762423 - DNA, 22 bp, Homo sapiens
aaatgtactacatttgcatgcc

SEQ ID NO: 4762424 - DNA, 17 bp, Homo sapiens
aaatgtagcttcagtca

SEQ ID NO: 4762425 - DNA, 13 bp, Homo sapiens
aaatgtattatgt

SEQ ID NO: 4762426 - DNA, 13 bp, Homo sapiens
aaatgtcctcaga

SEQ ID NO: 4762427 - DNA, 12 bp, Homo sapiens
aaatgtctataa

SEQ ID NO: 4762428 - DNA, 19 bp, Homo sapiens
aaatgtgtaaatgtggaca

SEQ ID NO: 4762429 - DNA, 13 bp, Homo sapiens
aaatgttaacaat

SEQ ID NO: 4762430 - DNA, 23 bp, Homo sapiens
aaatgttaacaatgcctattgta

SEQ ID NO: 4762431 - DNA, 11 bp, Homo sapiens
aaatgttcatt

SEQ ID NO: 4762432 - DNA, 17 bp, Homo sapiens
aaatgttcattctatga

SEQ ID NO: 4762433 - DNA, 17 bp, Homo sapiens
aaatgttttaaagaagt

SEQ ID NO: 4762434 - DNA, 12 bp, Homo sapiens
aaattaaacaat

SEQ ID NO: 4762435 - DNA, 16 bp, Homo sapiens
aaattaaatatatgta

SEQ ID NO: 4762436 - DNA, 20 bp, Homo sapiens
aaattaaatatatgtatgta

SEQ ID NO: 4762437 - DNA, 16 bp, Homo sapiens
aaattaacaaattcag

SEQ ID NO: 4762438 - DNA, 21 bp, Homo sapiens
aaattaattctttatcacatg

SEQ ID NO: 4762439 - DNA, 15 bp, Homo sapiens
aaattacatgcatga

SEQ ID NO: 4762440 - DNA, 15 bp, Homo sapiens
aaattactatagcaa

SEQ ID NO: 4762441 - DNA, 19 bp, Homo sapiens
aaattactatagcaaagta

SEQ ID NO: 4762442 - DNA, 18 bp, Homo sapiens
aaattagggctctaattt

SEQ ID NO: 4762443 - DNA, 21 bp, Homo sapiens
aaattagggctctaatttcct

SEQ ID NO: 4762444 - DNA, 18 bp, Homo sapiens
aaattagtgagatttgta

SEQ ID NO: 4762445 - DNA, 12 bp, Homo sapiens
aaattagtgttt

SEQ ID NO: 4762446 - DNA, 13 bp, Homo sapiens
aaattagtgtttt

SEQ ID NO: 4762447 - DNA, 21 bp, Homo sapiens
aaattagtgttttcattctgg

SEQ ID NO: 4762448 - DNA, 22 bp, Homo sapiens
aaattagtgttttcattctggt

SEQ ID NO: 4762449 - DNA, 18 bp, Homo sapiens
aaattataatgcatctaa

SEQ ID NO: 4762450 - DNA, 14 bp, Homo sapiens
aaattatatgatat

SEQ ID NO: 4762451 - DNA, 18 bp, Homo sapiens
aaattatatgatatgcat

SEQ ID NO: 4762452 - DNA, 20 bp, Homo sapiens
aaattatcattgtttgtcct

SEQ ID NO: 4762453 - DNA, 23 bp, Homo sapiens
aaattatctgttctatggaccaa

SEQ ID NO: 4762454 - DNA, 19 bp, Homo sapiens
aaattatgacgtgcacaaa

SEQ ID NO: 4762455 - DNA, 24 bp, Homo sapiens
aaattattactttaaattatatga

SEQ ID NO: 4762456 - DNA, 13 bp, Homo sapiens
aaattcacactgt

SEQ ID NO: 4762457 - DNA, 15 bp, Homo sapiens
aaattcattccattt

SEQ ID NO: 4762458 - DNA, 16 bp, Homo sapiens
aaattcattccatttg

SEQ ID NO: 4762459 - DNA, 14 bp, Homo sapiens
aaattcctaattct

SEQ ID NO: 4762460 - DNA, 15 bp, Homo sapiens
aaattcctaattcta

SEQ ID NO: 4762461 - DNA, 18 bp, Homo sapiens
aaattctgattattacaa

SEQ ID NO: 4762462 - DNA, 15 bp, Homo sapiens
aaattcttgaataaa

SEQ ID NO: 4762463 - DNA, 14 bp, Homo sapiens
aaattcttgcactg

SEQ ID NO: 4762464 - DNA, 21 bp, Homo sapiens
aaattcttgcactgtatccaa

SEQ ID NO: 4762465 - DNA, 23 bp, Homo sapiens
aaattcttgcactgtatccaagt

SEQ ID NO: 4762466 - DNA, 13 bp, Homo sapiens
aaattgctgagat

SEQ ID NO: 4762467 - DNA, 16 bp, Homo sapiens
aaattgctgagatgtt

SEQ ID NO: 4762468 - DNA, 15 bp, Homo sapiens
aaatttaagcacaaa

SEQ ID NO: 4762469 - DNA, 22 bp, Homo sapiens
aaatttatgtcattttcagatc

SEQ ID NO: 4762470 - DNA, 21 bp, Homo sapiens
aaatttattagccctgcattt

SEQ ID NO: 4762471 - DNA, 17 bp, Homo sapiens
aaatttcacgattcatt

SEQ ID NO: 4762472 - DNA, 21 bp, Homo sapiens
aaatttcacgattcatttttg

SEQ ID NO: 4762473 - DNA, 20 bp, Homo sapiens
aaatttctagatatgagaaa

SEQ ID NO: 4762474 - DNA, 12 bp, Homo sapiens
aaatttgtgtgc

SEQ ID NO: 4762475 - DNA, 17 bp, Homo sapiens
aaattttggaagaattc

SEQ ID NO: 4762476 - DNA, 18 bp, Homo sapiens
aaattttggaagaattca

SEQ ID NO: 4762477 - DNA, 22 bp, Homo sapiens
aaattttggaagaattcatgat

SEQ ID NO: 4762478 - DNA, 15 bp, Homo sapiens
aaatttttactcagg

SEQ ID NO: 4762479 - DNA, 21 bp, Homo sapiens
aaatttttactcaggctttct

SEQ ID NO: 4762480 - DNA, 23 bp, Homo sapiens
aaatttttactcaggctttctat

SEQ ID NO: 4762481 - DNA, 21 bp, Homo sapiens
aacaaacctctatatgttgct

SEQ ID NO: 4762482 - DNA, 18 bp, Homo sapiens
aacaaacgtaatttgtta

SEQ ID NO: 4762483 - DNA, 22 bp, Homo sapiens
aacaaagcatgctcagtattga

SEQ ID NO: 4762484 - DNA, 14 bp, Homo sapiens
aacaaatatactca

SEQ ID NO: 4762485 - DNA, 15 bp, Homo sapiens
aacaaatcattttga

SEQ ID NO: 4762486 - DNA, 22 bp, Homo sapiens
aacaacaaagcatgctcagtat

SEQ ID NO: 4762487 - DNA, 14 bp, Homo sapiens
aacaacaacaaagc

SEQ ID NO: 4762488 - DNA, 15 bp, Homo sapiens
aacaacaacagaaca

SEQ ID NO: 4762489 - DNA, 15 bp, Homo sapiens
aacaacagcaacaac

SEQ ID NO: 4762490 - DNA, 12 bp, Homo sapiens
aacaacctgcca

SEQ ID NO: 4762491 - DNA, 20 bp, Homo sapiens
aacaacctgccacaatgtga

SEQ ID NO: 4762492 - DNA, 20 bp, Homo sapiens
aacaactcgaatcactcatt

SEQ ID NO: 4762493 - DNA, 20 bp, Homo sapiens
aacaagccacgttgcagaaa

SEQ ID NO: 4762494 - DNA, 18 bp, Homo sapiens
aacaatgcctattgtaat

SEQ ID NO: 4762495 - DNA, 19 bp, Homo sapiens
aacaatgccttgttgtatt

SEQ ID NO: 4762496 - DNA, 23 bp, Homo sapiens
aacaatgccttgttgtattcctg

SEQ ID NO: 4762497 - DNA, 20 bp, Homo sapiens
aacaatttaggaatgctcaa

SEQ ID NO: 4762498 - DNA, 14 bp, Homo sapiens
aacaattttctgca

SEQ ID NO: 4762499 - DNA, 19 bp, Homo sapiens
aacacacagtatagataaa

SEQ ID NO: 4762500 - DNA, 23 bp, Homo sapiens
aacacacagtatagataaatcca

SEQ ID NO: 4762501 - DNA, 20 bp, Homo sapiens
aacacagcatgcatttagca

SEQ ID NO: 4762502 - DNA, 18 bp, Homo sapiens
aacacatagattcacctg

SEQ ID NO: 4762503 - DNA, 18 bp, Homo sapiens
aacacattgaaactgtat

SEQ ID NO: 4762504 - DNA, 19 bp, Homo sapiens
aacacattgaaactgtatt

SEQ ID NO: 4762505 - DNA, 22 bp, Homo sapiens
aacacattgaaactgtatttac

SEQ ID NO: 4762506 - DNA, 18 bp, Homo sapiens
aacaccactttgtctctg

SEQ ID NO: 4762507 - DNA, 21 bp, Homo sapiens
aacactattctccagaaaaat

SEQ ID NO: 4762508 - DNA, 16 bp, Homo sapiens
aacactcgtgtgcatg

SEQ ID NO: 4762509 - DNA, 17 bp, Homo sapiens
aacactcgtgtgcatga

SEQ ID NO: 4762510 - DNA, 19 bp, Homo sapiens
aacactcgtgtgcatgaga

SEQ ID NO: 4762511 - DNA, 23 bp, Homo sapiens
aacactcgtgtgcatgagaatgt

SEQ ID NO: 4762512 - DNA, 14 bp, Homo sapiens
aacactgcttaagg

SEQ ID NO: 4762513 - DNA, 16 bp, Homo sapiens
aacactgcttaaggaa

SEQ ID NO: 4762514 - DNA, 14 bp, Homo sapiens
aacactgtgtattt

SEQ ID NO: 4762515 - DNA, 16 bp, Homo sapiens
aacactgtgtatttat

SEQ ID NO: 4762516 - DNA, 14 bp, Homo sapiens
aacacttctcctta

SEQ ID NO: 4762517 - DNA, 16 bp, Homo sapiens
aacacttctccttaac

SEQ ID NO: 4762518 - DNA, 14 bp, Homo sapiens
aacagaaaaacaaa

SEQ ID NO: 4762519 - DNA, 20 bp, Homo sapiens
aacagaaaaatgaaatttaa

SEQ ID NO: 4762520 - DNA, 13 bp, Homo sapiens
aacagaccagcat

SEQ ID NO: 4762521 - DNA, 18 bp, Homo sapiens
aacagacctcggctgtgt

SEQ ID NO: 4762522 - DNA, 11 bp, Homo sapiens
aacagcaacaa

SEQ ID NO: 4762523 - DNA, 16 bp, Homo sapiens
aacagcacagtctttt

SEQ ID NO: 4762524 - DNA, 23 bp, Homo sapiens
aacagctaggttaataggaggac

SEQ ID NO: 4762525 - DNA, 24 bp, Homo sapiens
aacagctaggttaataggaggaca

SEQ ID NO: 4762526 - DNA, 16 bp, Homo sapiens
aacaggaaaaaaactt

SEQ ID NO: 4762527 - DNA, 20 bp, Homo sapiens
aacaggaccaggagccaggt

SEQ ID NO: 4762528 - DNA, 15 bp, Homo sapiens
aacaggagtgactct

SEQ ID NO: 4762529 - DNA, 20 bp, Homo sapiens
aacaggagtgactctggctg

SEQ ID NO: 4762530 - DNA, 22 bp, Homo sapiens
aacaggcattgcactaaaagtg

SEQ ID NO: 4762531 - DNA, 19 bp, Homo sapiens
aacaggttttcctgaagaa

SEQ ID NO: 4762532 - DNA, 14 bp, Homo sapiens
aacagtaaatatac

SEQ ID NO: 4762533 - DNA, 17 bp, Homo sapiens
aacagtaaatatacact

SEQ ID NO: 4762534 - DNA, 17 bp, Homo sapiens
aacagtaactgccattt

SEQ ID NO: 4762535 - DNA, 12 bp, Homo sapiens
aacagtcagcca

SEQ ID NO: 4762536 - DNA, 21 bp, Homo sapiens
aacagtgtggatgtaaatttt

SEQ ID NO: 4762537 - DNA, 13 bp, Homo sapiens
aacagtgtttcca

SEQ ID NO: 4762538 - DNA, 13 bp, Homo sapiens
aacagtttcaaaa

SEQ ID NO: 4762539 - DNA, 15 bp, Homo sapiens
aacataaaatataca

SEQ ID NO: 4762540 - DNA, 17 bp, Homo sapiens
aacataagctagaaaaa

SEQ ID NO: 4762541 - DNA, 13 bp, Homo sapiens
aacatagtggtat

SEQ ID NO: 4762542 - DNA, 18 bp, Homo sapiens
aacatagtggtattttaa

SEQ ID NO: 4762543 - DNA, 19 bp, Homo sapiens
aacatagtggtattttaac

SEQ ID NO: 4762544 - DNA, 21 bp, Homo sapiens
aacatagtggtattttaacat

SEQ ID NO: 4762545 - DNA, 20 bp, Homo sapiens
aacatcaattgggttttgat

SEQ ID NO: 4762546 - DNA, 18 bp, Homo sapiens
aacatcactatccatgca

SEQ ID NO: 4762547 - DNA, 20 bp, Homo sapiens
aacatcagtcaattgcttga

SEQ ID NO: 4762548 - DNA, 12 bp, Homo sapiens
aacatctgattt

SEQ ID NO: 4762549 - DNA, 20 bp, Homo sapiens
aacatgactctttattgtct

SEQ ID NO: 4762550 - DNA, 14 bp, Homo sapiens
aacatgagtttatg

SEQ ID NO: 4762551 - DNA, 17 bp, Homo sapiens
aacatgagtttatggga

SEQ ID NO: 4762552 - DNA, 17 bp, Homo sapiens
aacatgcacattcatcc

SEQ ID NO: 4762553 - DNA, 15 bp, Homo sapiens
aacatggcatgtgaa

SEQ ID NO: 4762554 - DNA, 17 bp, Homo sapiens
aacatggcatgtgaaaa

SEQ ID NO: 4762555 - DNA, 12 bp, Homo sapiens
aacatggccaat

SEQ ID NO: 4762556 - DNA, 15 bp, Homo sapiens
aacatggggcccctc

SEQ ID NO: 4762557 - DNA, 14 bp, Homo sapiens
aacatgtgatgtgt

SEQ ID NO: 4762558 - DNA, 21 bp, Homo sapiens
aacattatagattttcatgtt

SEQ ID NO: 4762559 - DNA, 20 bp, Homo sapiens
aacattattacttttcctct

SEQ ID NO: 4762560 - DNA, 14 bp, Homo sapiens
aacattctatttca

SEQ ID NO: 4762561 - DNA, 15 bp, Homo sapiens
aacattctatttcaa

SEQ ID NO: 4762562 - DNA, 18 bp, Homo sapiens
aacattgccttatattgg

SEQ ID NO: 4762563 - DNA, 15 bp, Homo sapiens
aacatttccctgctg

SEQ ID NO: 4762564 - DNA, 18 bp, Homo sapiens
aacattttttgtttcttg

SEQ ID NO: 4762565 - DNA, 21 bp, Homo sapiens
aacattttttgtttcttggtg

SEQ ID NO: 4762566 - DNA, 19 bp, Homo sapiens
aaccaagctataaaagccc

SEQ ID NO: 4762567 - DNA, 20 bp, Homo sapiens
aaccacaactgacacaggaa

SEQ ID NO: 4762568 - DNA, 15 bp, Homo sapiens
aaccacacctaaatt

SEQ ID NO: 4762569 - DNA, 19 bp, Homo sapiens
aaccactgcaatatcttcg

SEQ ID NO: 4762570 - DNA, 13 bp, Homo sapiens
aaccactttcctt

SEQ ID NO: 4762571 - DNA, 20 bp, Homo sapiens
aaccagcagcaggggaaaga

SEQ ID NO: 4762572 - DNA, 14 bp, Homo sapiens
aaccagtctgaagt

SEQ ID NO: 4762573 - DNA, 23 bp, Homo sapiens
aaccagtctgaagtttcatttat

SEQ ID NO: 4762574 - DNA, 17 bp, Homo sapiens
aaccataaaataaataa

SEQ ID NO: 4762575 - DNA, 18 bp, Homo sapiens
aaccataaaataaataat

SEQ ID NO: 4762576 - DNA, 15 bp, Homo sapiens
aaccatctggcctgg

SEQ ID NO: 4762577 - DNA, 17 bp, Homo sapiens
aaccatctggcctggcc

SEQ ID NO: 4762578 - DNA, 14 bp, Homo sapiens
aaccatgttcttga

SEQ ID NO: 4762579 - DNA, 14 bp, Homo sapiens
aaccattgcttcac

SEQ ID NO: 4762580 - DNA, 16 bp, Homo sapiens
aaccattgcttcacta

SEQ ID NO: 4762581 - DNA, 23 bp, Homo sapiens
aaccattgcttcactacccatcg

SEQ ID NO: 4762582 - DNA, 23 bp, Homo sapiens
aaccattttgctgtcccttttcc

SEQ ID NO: 4762583 - DNA, 22 bp, Homo sapiens
aacccaaataaatgtgtaaatg

SEQ ID NO: 4762584 - DNA, 16 bp, Homo sapiens
aacccacataaacact

SEQ ID NO: 4762585 - DNA, 16 bp, Homo sapiens
aacccaggattcaaca

SEQ ID NO: 4762586 - DNA, 15 bp, Homo sapiens
aacccaggtgttgtc

SEQ ID NO: 4762587 - DNA, 19 bp, Homo sapiens
aacccaggtgttgtccgtg

SEQ ID NO: 4762588 - DNA, 15 bp, Homo sapiens
aacccatcactgtgt

SEQ ID NO: 4762589 - DNA, 23 bp, Homo sapiens
aacccatgcatggcctcccagcc

SEQ ID NO: 4762590 - DNA, 17 bp, Homo sapiens
aaccccaacgcacagga

SEQ ID NO: 4762591 - DNA, 19 bp, Homo sapiens
aaccccaacgcacaggaaa

SEQ ID NO: 4762592 - DNA, 18 bp, Homo sapiens
aacccccacctcccggtg

SEQ ID NO: 4762593 - DNA, 21 bp, Homo sapiens
aacccctaatcgccctgagct

SEQ ID NO: 4762594 - DNA, 16 bp, Homo sapiens
aaccctacagtatata

SEQ ID NO: 4762595 - DNA, 19 bp, Homo sapiens
aaccctacagtatataagc

SEQ ID NO: 4762596 - DNA, 12 bp, Homo sapiens
aaccctgcttct

SEQ ID NO: 4762597 - DNA, 15 bp, Homo sapiens
aaccctgcttctgct

SEQ ID NO: 4762598 - DNA, 21 bp, Homo sapiens
aaccctgcttctgctgccctg

SEQ ID NO: 4762599 - DNA, 11 bp, Homo sapiens
aacccttacag

SEQ ID NO: 4762600 - DNA, 13 bp, Homo sapiens
aacccttcagtgc

SEQ ID NO: 4762601 - DNA, 17 bp, Homo sapiens
aaccgtcaatgtgaaat

SEQ ID NO: 4762602 - DNA, 18 bp, Homo sapiens
aacctaaggcaacatttc

SEQ ID NO: 4762603 - DNA, 18 bp, Homo sapiens
aacctaccttatagagca

SEQ ID NO: 4762604 - DNA, 20 bp, Homo sapiens
aacctaccttatagagcaca

SEQ ID NO: 4762605 - DNA, 22 bp, Homo sapiens
aacctaccttatagagcacaat

SEQ ID NO: 4762606 - DNA, 13 bp, Homo sapiens
aacctcaaactgg

SEQ ID NO: 4762607 - DNA, 20 bp, Homo sapiens
aacctcagttggcctctgcc

SEQ ID NO: 4762608 - DNA, 21 bp, Homo sapiens
aacctcagttggcctctgccc

SEQ ID NO: 4762609 - DNA, 14 bp, Homo sapiens
aacctcccctggtc

SEQ ID NO: 4762610 - DNA, 18 bp, Homo sapiens
aacctcccctggtcctgc

SEQ ID NO: 4762611 - DNA, 17 bp, Homo sapiens
aacctctactgaaaaca

SEQ ID NO: 4762612 - DNA, 13 bp, Homo sapiens
aacctctcagcac

SEQ ID NO: 4762613 - DNA, 17 bp, Homo sapiens
aacctgaattaaagtct

SEQ ID NO: 4762614 - DNA, 20 bp, Homo sapiens
aacctgaattaaagtctaca

SEQ ID NO: 4762615 - DNA, 20 bp, Homo sapiens
aacctgaggccaaatattga

SEQ ID NO: 4762616 - DNA, 19 bp, Homo sapiens
aacctgccacaatgtgata

SEQ ID NO: 4762617 - DNA, 14 bp, Homo sapiens
aacctgcgcacccc

SEQ ID NO: 4762618 - DNA, 21 bp, Homo sapiens
aacctggtggcaccagatgca

SEQ ID NO: 4762619 - DNA, 16 bp, Homo sapiens
aacctgtgctttcatg

SEQ ID NO: 4762620 - DNA, 19 bp, Homo sapiens
aacctgttcctgactgttc

SEQ ID NO: 4762621 - DNA, 20 bp, Homo sapiens
aacctgttcttcctaccaaa

SEQ ID NO: 4762622 - DNA, 14 bp, Homo sapiens
aaccttccctccaa

SEQ ID NO: 4762623 - DNA, 23 bp, Homo sapiens
aaccttcttttcaatgcaatgca

SEQ ID NO: 4762624 - DNA, 17 bp, Homo sapiens
aaccttgtactttacaa

SEQ ID NO: 4762625 - DNA, 22 bp, Homo sapiens
aacctttccgctgtcgccccag

SEQ ID NO: 4762626 - DNA, 23 bp, Homo sapiens
aacctttccgctgtcgccccagg

SEQ ID NO: 4762627 - DNA, 12 bp, Homo sapiens
aacctttgtcaa

SEQ ID NO: 4762628 - DNA, 22 bp, Homo sapiens
aaccttttaaaaaaataatata

SEQ ID NO: 4762629 - DNA, 23 bp, Homo sapiens
aaccttttgagtgccttacacaa

SEQ ID NO: 4762630 - DNA, 18 bp, Homo sapiens
aacgaccgacgcccctcc

SEQ ID NO: 4762631 - DNA, 15 bp, Homo sapiens
aacgatccttcaaag

SEQ ID NO: 4762632 - DNA, 16 bp, Homo sapiens
aacgcacaacatgcac

SEQ ID NO: 4762633 - DNA, 16 bp, Homo sapiens
aacgctgacttgcaga

SEQ ID NO: 4762634 - DNA, 19 bp, Homo sapiens
aacgctgctccatgcacag

SEQ ID NO: 4762635 - DNA, 14 bp, Homo sapiens
aacgggcctccccg

SEQ ID NO: 4762636 - DNA, 17 bp, Homo sapiens
aacgttagactgcaata

SEQ ID NO: 4762637 - DNA, 15 bp, Homo sapiens
aacgttcatgttcat

SEQ ID NO: 4762638 - DNA, 16 bp, Homo sapiens
aacgttcatgttcatc

SEQ ID NO: 4762639 - DNA, 15 bp, Homo sapiens
aacgttctctacctt

SEQ ID NO: 4762640 - DNA, 22 bp, Homo sapiens
aactaaaggaaacaaagcaata

SEQ ID NO: 4762641 - DNA, 16 bp, Homo sapiens
aactaacaatgccttg

SEQ ID NO: 4762642 - DNA, 16 bp, Homo sapiens
aactaatgtaaatatt

SEQ ID NO: 4762643 - DNA, 17 bp, Homo sapiens
aactaatgtaaatattg

SEQ ID NO: 4762644 - DNA, 16 bp, Homo sapiens
aactaattaaactgat

SEQ ID NO: 4762645 - DNA, 20 bp, Homo sapiens
aactaccaccctcgctgcca

SEQ ID NO: 4762646 - DNA, 12 bp, Homo sapiens
aactactgcctt

SEQ ID NO: 4762647 - DNA, 22 bp, Homo sapiens
aactagatctcctgtaattttg

SEQ ID NO: 4762648 - DNA, 20 bp, Homo sapiens
aactatcagggcaagctcat

SEQ ID NO: 4762649 - DNA, 21 bp, Homo sapiens
aactatcctgcgggttttaat

SEQ ID NO: 4762650 - DNA, 15 bp, Homo sapiens
aactatttctttcat

SEQ ID NO: 4762651 - DNA, 21 bp, Homo sapiens
aactcatacagtctctatttg

SEQ ID NO: 4762652 - DNA, 19 bp, Homo sapiens
aactcatccagaactgtct

SEQ ID NO: 4762653 - DNA, 20 bp, Homo sapiens
aactcccttctcccctcagc

SEQ ID NO: 4762654 - DNA, 19 bp, Homo sapiens
aactcctgttttcacacct

SEQ ID NO: 4762655 - DNA, 13 bp, Homo sapiens
aactccttggcct

SEQ ID NO: 4762656 - DNA, 14 bp, Homo sapiens
aactctatctgggc

SEQ ID NO: 4762657 - DNA, 15 bp, Homo sapiens
aactctcctccagag

SEQ ID NO: 4762658 - DNA, 19 bp, Homo sapiens
aactctgacaagggctgac

SEQ ID NO: 4762659 - DNA, 21 bp, Homo sapiens
aactctgacaagggctgacct

SEQ ID NO: 4762660 - DNA, 22 bp, Homo sapiens
aactctgacaagggctgacctg

SEQ ID NO: 4762661 - DNA, 11 bp, Homo sapiens
aactctgcata

SEQ ID NO: 4762662 - DNA, 10 bp, Homo sapiens
aactctggcc

SEQ ID NO: 4762663 - DNA, 18 bp, Homo sapiens
aactctttggctattgtc

SEQ ID NO: 4762664 - DNA, 12 bp, Homo sapiens
aactgacacagg

SEQ ID NO: 4762665 - DNA, 13 bp, Homo sapiens
aactgaggagcta

SEQ ID NO: 4762666 - DNA, 12 bp, Homo sapiens
aactgatttcca

SEQ ID NO: 4762667 - DNA, 16 bp, Homo sapiens
aactgatttccatcca

SEQ ID NO: 4762668 - DNA, 10 bp, Homo sapiens
aactgccaca

SEQ ID NO: 4762669 - DNA, 17 bp, Homo sapiens
aactgccacaagcacaa

SEQ ID NO: 4762670 - DNA, 20 bp, Homo sapiens
aactgccaggcagctgcagt

SEQ ID NO: 4762671 - DNA, 22 bp, Homo sapiens
aactgccatgtaggctaagaaa

SEQ ID NO: 4762672 - DNA, 22 bp, Homo sapiens
aactgctttgttttggctgctc

SEQ ID NO: 4762673 - DNA, 19 bp, Homo sapiens
aactggaaacatctgattt

SEQ ID NO: 4762674 - DNA, 15 bp, Homo sapiens
aactggaataagaag

SEQ ID NO: 4762675 - DNA, 21 bp, Homo sapiens
aactggaataagaagcaaata

SEQ ID NO: 4762676 - DNA, 13 bp, Homo sapiens
aactggccccagg

SEQ ID NO: 4762677 - DNA, 22 bp, Homo sapiens
aactggccccaggcggaggggc

SEQ ID NO: 4762678 - DNA, 16 bp, Homo sapiens
aactggccctcgggcc

SEQ ID NO: 4762679 - DNA, 13 bp, Homo sapiens
aactgggaaatga

SEQ ID NO: 4762680 - DNA, 14 bp, Homo sapiens
aactgtagtaattg

SEQ ID NO: 4762681 - DNA, 22 bp, Homo sapiens
aactgtagtaattgttacaatt

SEQ ID NO: 4762682 - DNA, 14 bp, Homo sapiens
aactgtatatttgt

SEQ ID NO: 4762683 - DNA, 16 bp, Homo sapiens
aactgtatttacttgt

SEQ ID NO: 4762684 - DNA, 15 bp, Homo sapiens
aactgtgaatatgtg

SEQ ID NO: 4762685 - DNA, 18 bp, Homo sapiens
aactgtgaatatgtgtaa

SEQ ID NO: 4762686 - DNA, 13 bp, Homo sapiens
aactgtgacattc

SEQ ID NO: 4762687 - DNA, 17 bp, Homo sapiens
aactgtgagataaatat

SEQ ID NO: 4762688 - DNA, 15 bp, Homo sapiens
aactgttaacttatt

SEQ ID NO: 4762689 - DNA, 15 bp, Homo sapiens
aactgttaagggaag

SEQ ID NO: 4762690 - DNA, 15 bp, Homo sapiens
aactgttacagtaat

SEQ ID NO: 4762691 - DNA, 10 bp, Homo sapiens
aactgtttat

SEQ ID NO: 4762692 - DNA, 14 bp, Homo sapiens
aactgtttttgaag

SEQ ID NO: 4762693 - DNA, 15 bp, Homo sapiens
aactgtttttgaaga

SEQ ID NO: 4762694 - DNA, 13 bp, Homo sapiens
aacttaatgaaga

SEQ ID NO: 4762695 - DNA, 14 bp, Homo sapiens
aacttattcaaaga

SEQ ID NO: 4762696 - DNA, 22 bp, Homo sapiens
aacttattcaaagagaaaacat

SEQ ID NO: 4762697 - DNA, 22 bp, Homo sapiens
aacttcagcaaccctacagtat

SEQ ID NO: 4762698 - DNA, 16 bp, Homo sapiens
aacttcatctgtctgt

SEQ ID NO: 4762699 - DNA, 14 bp, Homo sapiens
aacttcatgcttga

SEQ ID NO: 4762700 - DNA, 18 bp, Homo sapiens
aacttccagtatcatttt

SEQ ID NO: 4762701 - DNA, 16 bp, Homo sapiens
aacttctactcttcaa

SEQ ID NO: 4762702 - DNA, 18 bp, Homo sapiens
aacttctgaactttggaa

SEQ ID NO: 4762703 - DNA, 14 bp, Homo sapiens
aacttgctcctttc

SEQ ID NO: 4762704 - DNA, 14 bp, Homo sapiens
aacttggcgctgcc

SEQ ID NO: 4762705 - DNA, 23 bp, Homo sapiens
aacttggggaaggggcctgggct

SEQ ID NO: 4762706 - DNA, 12 bp, Homo sapiens
aacttgtactta

SEQ ID NO: 4762707 - DNA, 18 bp, Homo sapiens
aacttgtattggaagtat

SEQ ID NO: 4762708 - DNA, 13 bp, Homo sapiens
aacttgtttgtaa

SEQ ID NO: 4762709 - DNA, 12 bp, Homo sapiens
aactttaccatg

SEQ ID NO: 4762710 - DNA, 21 bp, Homo sapiens
aactttcacctcagattttct

SEQ ID NO: 4762711 - DNA, 21 bp, Homo sapiens
aactttggaagttttacttga

SEQ ID NO: 4762712 - DNA, 10 bp, Homo sapiens
aactttgtca

SEQ ID NO: 4762713 - DNA, 17 bp, Homo sapiens
aacttttataaattaaa

SEQ ID NO: 4762714 - DNA, 20 bp, Homo sapiens
aacttttataaattaaatat

SEQ ID NO: 4762715 - DNA, 20 bp, Homo sapiens
aacttttcaaggcacattga

SEQ ID NO: 4762716 - DNA, 14 bp, Homo sapiens
aacttttttttagt

SEQ ID NO: 4762717 - DNA, 19 bp, Homo sapiens
aacttttttttagtatttg

SEQ ID NO: 4762718 - DNA, 20 bp, Homo sapiens
aagaaaaaagtgcaacttga

SEQ ID NO: 4762719 - DNA, 12 bp, Homo sapiens
aagaaacacagc

SEQ ID NO: 4762720 - DNA, 14 bp, Homo sapiens
aagaaacacagcat

SEQ ID NO: 4762721 - DNA, 17 bp, Homo sapiens
aagaaacacagcatgca

SEQ ID NO: 4762722 - DNA, 24 bp, Homo sapiens
aagaaacacagcatgcatttagca

SEQ ID NO: 4762723 - DNA, 17 bp, Homo sapiens
aagaaacagtttaacag

SEQ ID NO: 4762724 - DNA, 17 bp, Homo sapiens
aagaaaccttttaaaaa

SEQ ID NO: 4762725 - DNA, 13 bp, Homo sapiens
aagaaagaaatgc

SEQ ID NO: 4762726 - DNA, 14 bp, Homo sapiens
aagaaagaacggaa

SEQ ID NO: 4762727 - DNA, 18 bp, Homo sapiens
aagaaatatctgtgaaat

SEQ ID NO: 4762728 - DNA, 22 bp, Homo sapiens
aagaaatgagaaattgtgccaa

SEQ ID NO: 4762729 - DNA, 17 bp, Homo sapiens
aagaaatggctttccac

SEQ ID NO: 4762730 - DNA, 22 bp, Homo sapiens
aagaacccatggaaaaatgcca

SEQ ID NO: 4762731 - DNA, 18 bp, Homo sapiens
aagaacccccctccccaa

SEQ ID NO: 4762732 - DNA, 21 bp, Homo sapiens
aagaacccccctccccaagga

SEQ ID NO: 4762733 - DNA, 18 bp, Homo sapiens
aagaactcaccagggttt

SEQ ID NO: 4762734 - DNA, 15 bp, Homo sapiens
aagaagagtttacag

SEQ ID NO: 4762735 - DNA, 19 bp, Homo sapiens
aagaagctaaaatgaaaaa

SEQ ID NO: 4762736 - DNA, 15 bp, Homo sapiens
aagaaggactgaaga

SEQ ID NO: 4762737 - DNA, 15 bp, Homo sapiens
aagaaggcccgggag

SEQ ID NO: 4762738 - DNA, 20 bp, Homo sapiens
aagaaggcccgggaggagga

SEQ ID NO: 4762739 - DNA, 14 bp, Homo sapiens
aagaagggaaattc

SEQ ID NO: 4762740 - DNA, 17 bp, Homo sapiens
aagaagtccatgtgata

SEQ ID NO: 4762741 - DNA, 12 bp, Homo sapiens
aagaatattgta

SEQ ID NO: 4762742 - DNA, 16 bp, Homo sapiens
aagaatcatggattta

SEQ ID NO: 4762743 - DNA, 21 bp, Homo sapiens
aagaatccctgttcattgtaa

SEQ ID NO: 4762744 - DNA, 13 bp, Homo sapiens
aagaatctactta

SEQ ID NO: 4762745 - DNA, 16 bp, Homo sapiens
aagaattcatgatgct

SEQ ID NO: 4762746 - DNA, 22 bp, Homo sapiens
aagaattcatgatgctagttct

SEQ ID NO: 4762747 - DNA, 22 bp, Homo sapiens
aagacaccagagtgtatgcata

SEQ ID NO: 4762748 - DNA, 20 bp, Homo sapiens
aagacagagatggcagagcc

SEQ ID NO: 4762749 - DNA, 21 bp, Homo sapiens
aagacagagatggcagagcca

SEQ ID NO: 4762750 - DNA, 19 bp, Homo sapiens
aagacaggagagattattt

SEQ ID NO: 4762751 - DNA, 13 bp, Homo sapiens
aagacagtttctt

SEQ ID NO: 4762752 - DNA, 20 bp, Homo sapiens
aagacattcaccaacaacag

SEQ ID NO: 4762753 - DNA, 16 bp, Homo sapiens
aagaccctaggtgctc

SEQ ID NO: 4762754 - DNA, 17 bp, Homo sapiens
aagaccctaggtgctca

SEQ ID NO: 4762755 - DNA, 15 bp, Homo sapiens
aagaccctcagttat

SEQ ID NO: 4762756 - DNA, 14 bp, Homo sapiens
aagaccttctgaag

SEQ ID NO: 4762757 - DNA, 21 bp, Homo sapiens
aagacgtttttgtgctgtggg

SEQ ID NO: 4762758 - DNA, 18 bp, Homo sapiens
aagactactggcctctgt

SEQ ID NO: 4762759 - DNA, 18 bp, Homo sapiens
aagactctatgctctgga

SEQ ID NO: 4762760 - DNA, 22 bp, Homo sapiens
aagactggcatggacatcagca

SEQ ID NO: 4762761 - DNA, 22 bp, Homo sapiens
aagacttcaaatgttattcaat

SEQ ID NO: 4762762 - DNA, 23 bp, Homo sapiens
aagacttccagctttctctttgt

SEQ ID NO: 4762763 - DNA, 12 bp, Homo sapiens
aagacttttctt

SEQ ID NO: 4762764 - DNA, 15 bp, Homo sapiens
aagagaaaaagccct

SEQ ID NO: 4762765 - DNA, 16 bp, Homo sapiens
aagagaaaaagccctc

SEQ ID NO: 4762766 - DNA, 18 bp, Homo sapiens
aagagaaaaagccctctt

SEQ ID NO: 4762767 - DNA, 18 bp, Homo sapiens
aagagaaaatgctttctc

SEQ ID NO: 4762768 - DNA, 13 bp, Homo sapiens
aagagaaggagca

SEQ ID NO: 4762769 - DNA, 19 bp, Homo sapiens
aagagaccacttccttaac

SEQ ID NO: 4762770 - DNA, 20 bp, Homo sapiens
aagagagatatatctgaaaa

SEQ ID NO: 4762771 - DNA, 16 bp, Homo sapiens
aagagatatgctcatt

SEQ ID NO: 4762772 - DNA, 18 bp, Homo sapiens
aagagatatgctcattat

SEQ ID NO: 4762773 - DNA, 19 bp, Homo sapiens
aagagattctattaaaagc

SEQ ID NO: 4762774 - DNA, 19 bp, Homo sapiens
aagagattttatgtttaaa

SEQ ID NO: 4762775 - DNA, 23 bp, Homo sapiens
aagagattttatgtttaaaatgg

SEQ ID NO: 4762776 - DNA, 14 bp, Homo sapiens
aagagcccaggcct

SEQ ID NO: 4762777 - DNA, 14 bp, Homo sapiens
aagagctcaggaga

SEQ ID NO: 4762778 - DNA, 17 bp, Homo sapiens
aagagctcaggagaagg

SEQ ID NO: 4762779 - DNA, 13 bp, Homo sapiens
aagagctgttctt

SEQ ID NO: 4762780 - DNA, 22 bp, Homo sapiens
aagagcttcccctaacctgggt

SEQ ID NO: 4762781 - DNA, 16 bp, Homo sapiens
aagagggactccaagc

SEQ ID NO: 4762782 - DNA, 23 bp, Homo sapiens
aagagggactccaagccctgggg

SEQ ID NO: 4762783 - DNA, 13 bp, Homo sapiens
aagaggggcgctg

SEQ ID NO: 4762784 - DNA, 15 bp, Homo sapiens
aagaggggcgctgcc

SEQ ID NO: 4762785 - DNA, 22 bp, Homo sapiens
aagaggggcgctgcccccacag

SEQ ID NO: 4762786 - DNA, 15 bp, Homo sapiens
aagaggtttcagcat

SEQ ID NO: 4762787 - DNA, 22 bp, Homo sapiens
aagagttctccttgtacttgaa

SEQ ID NO: 4762788 - DNA, 18 bp, Homo sapiens
cctagggctctccaagca

SEQ ID NO: 4762789 - DNA, 17 bp, Homo sapiens
cctaggtctccacccct

SEQ ID NO: 4762790 - DNA, 14 bp, Homo sapiens
cctaggtgctcata

SEQ ID NO: 4762791 - DNA, 22 bp, Homo sapiens
cctaggtgggtcaactccaagg

SEQ ID NO: 4762792 - DNA, 18 bp, Homo sapiens
cctagtcttgttgttcat

SEQ ID NO: 4762793 - DNA, 15 bp, Homo sapiens
cctagtgatttttgg

SEQ ID NO: 4762794 - DNA, 17 bp, Homo sapiens
cctagtttgacctcaca

SEQ ID NO: 4762795 - DNA, 20 bp, Homo sapiens
cctataccctaggtctccac

SEQ ID NO: 4762796 - DNA, 21 bp, Homo sapiens
cctatatttataaaccagcag

SEQ ID NO: 4762797 - DNA, 13 bp, Homo sapiens
cctatccttggca

SEQ ID NO: 4762798 - DNA, 17 bp, Homo sapiens
cctatccttggcaccaa

SEQ ID NO: 4762799 - DNA, 16 bp, Homo sapiens
cctatctgtattggca

SEQ ID NO: 4762800 - DNA, 19 bp, Homo sapiens
cctatctgtattggcagca

SEQ ID NO: 4762801 - DNA, 21 bp, Homo sapiens
cctatctgtattggcagcaca

SEQ ID NO: 4762802 - DNA, 21 bp, Homo sapiens
cctatggaaagggtgtggctt

SEQ ID NO: 4762803 - DNA, 23 bp, Homo sapiens
cctattgctgtaaataaaaatag

SEQ ID NO: 4762804 - DNA, 13 bp, Homo sapiens
cctattgtaatat

SEQ ID NO: 4762805 - DNA, 23 bp, Homo sapiens
cctcaactctcctccagagtcag

SEQ ID NO: 4762806 - DNA, 16 bp, Homo sapiens
cctcaagccaggagac

SEQ ID NO: 4762807 - DNA, 22 bp, Homo sapiens
cctcaagccaggagaccctgtc

SEQ ID NO: 4762808 - DNA, 23 bp, Homo sapiens
cctcaagccaggagaccctgtct

SEQ ID NO: 4762809 - DNA, 16 bp, Homo sapiens
cctcaagttgtgtgct

SEQ ID NO: 4762810 - DNA, 17 bp, Homo sapiens
cctcacacctcccttca

SEQ ID NO: 4762811 - DNA, 13 bp, Homo sapiens
cctcacagtgacc

SEQ ID NO: 4762812 - DNA, 18 bp, Homo sapiens
cctcacagtgacccttcc

SEQ ID NO: 4762813 - DNA, 24 bp, Homo sapiens
cctcacagtgacccttcccaatca

SEQ ID NO: 4762814 - DNA, 13 bp, Homo sapiens
cctcacccttgcg

SEQ ID NO: 4762815 - DNA, 15 bp, Homo sapiens
cctcacctggcttcc

SEQ ID NO: 4762816 - DNA, 23 bp, Homo sapiens
cctcacctggcttcccaggaccc

SEQ ID NO: 4762817 - DNA, 14 bp, Homo sapiens
cctcaccttccttg

SEQ ID NO: 4762818 - DNA, 18 bp, Homo sapiens
cctcaccttccttgaaat

SEQ ID NO: 4762819 - DNA, 24 bp, Homo sapiens
cctcactatggtatgctggccagc

SEQ ID NO: 4762820 - DNA, 22 bp, Homo sapiens
cctcactccactcccctcatcc

SEQ ID NO: 4762821 - DNA, 19 bp, Homo sapiens
cctcactctgccagggcag

SEQ ID NO: 4762822 - DNA, 22 bp, Homo sapiens
cctcactctgccagggcagtgc

SEQ ID NO: 4762823 - DNA, 14 bp, Homo sapiens
cctcactctgtcag

SEQ ID NO: 4762824 - DNA, 15 bp, Homo sapiens
cctcactctgtcagc

SEQ ID NO: 4762825 - DNA, 14 bp, Homo sapiens
cctcactgagaagg

SEQ ID NO: 4762826 - DNA, 20 bp, Homo sapiens
cctcactgagaaggccccag

SEQ ID NO: 4762827 - DNA, 11 bp, Homo sapiens
cctcactgcca

SEQ ID NO: 4762828 - DNA, 18 bp, Homo sapiens
cctcactgcccgcacacc

SEQ ID NO: 4762829 - DNA, 20 bp, Homo sapiens
cctcactgcccgcacaccct

SEQ ID NO: 4762830 - DNA, 16 bp, Homo sapiens
cctcactgggtgtggc

SEQ ID NO: 4762831 - DNA, 21 bp, Homo sapiens
cctcactgggtgtggcctggc

SEQ ID NO: 4762832 - DNA, 19 bp, Homo sapiens
cctcacttgtggcagcttc

SEQ ID NO: 4762833 - DNA, 16 bp, Homo sapiens
cctcagaaaatgagta

SEQ ID NO: 4762834 - DNA, 17 bp, Homo sapiens
cctcagaatattaagca

SEQ ID NO: 4762835 - DNA, 20 bp, Homo sapiens
cctcagaatattaagcacat

SEQ ID NO: 4762836 - DNA, 20 bp, Homo sapiens
cctcagccccagggccctgc

SEQ ID NO: 4762837 - DNA, 14 bp, Homo sapiens
cctcaggcctgggg

SEQ ID NO: 4762838 - DNA, 23 bp, Homo sapiens
cctcaggcctgggggctgggcag

SEQ ID NO: 4762839 - DNA, 21 bp, Homo sapiens
cctcagtccctccctcctggc

SEQ ID NO: 4762840 - DNA, 13 bp, Homo sapiens
cctcagtccttta

SEQ ID NO: 4762841 - DNA, 20 bp, Homo sapiens
cctcagtcctttattgtcca

SEQ ID NO: 4762842 - DNA, 19 bp, Homo sapiens
cctcagtgagatcagtcag

SEQ ID NO: 4762843 - DNA, 23 bp, Homo sapiens
cctcagtgagatcagtcagctcc

SEQ ID NO: 4762844 - DNA, 15 bp, Homo sapiens
cctcagttattttgt

SEQ ID NO: 4762845 - DNA, 14 bp, Homo sapiens
cctcatcagtgtca

SEQ ID NO: 4762846 - DNA, 20 bp, Homo sapiens
cctcatcttgaagggcccag

SEQ ID NO: 4762847 - DNA, 22 bp, Homo sapiens
cctcatcttgaagggcccagga

SEQ ID NO: 4762848 - DNA, 15 bp, Homo sapiens
cctcattttgcttcc

SEQ ID NO: 4762849 - DNA, 17 bp, Homo sapiens
cctcattttgcttccca

SEQ ID NO: 4762850 - DNA, 20 bp, Homo sapiens
cctcattttgcttcccatct

SEQ ID NO: 4762851 - DNA, 21 bp, Homo sapiens
cctcattttgcttcccatctg

SEQ ID NO: 4762852 - DNA, 17 bp, Homo sapiens
cctccaaagcctgggca

SEQ ID NO: 4762853 - DNA, 14 bp, Homo sapiens
cctccaagggatct

SEQ ID NO: 4762854 - DNA, 13 bp, Homo sapiens
cctccacacctcc

SEQ ID NO: 4762855 - DNA, 14 bp, Homo sapiens
cctccacaggagcc

SEQ ID NO: 4762856 - DNA, 15 bp, Homo sapiens
cctccaccccagtcc

SEQ ID NO: 4762857 - DNA, 16 bp, Homo sapiens
cctccaccccagtccc

SEQ ID NO: 4762858 - DNA, 20 bp, Homo sapiens
cctccaccccagtccccggg

SEQ ID NO: 4762859 - DNA, 18 bp, Homo sapiens
cctccaccgcagaaggaa

SEQ ID NO: 4762860 - DNA, 14 bp, Homo sapiens
cctccacgcctcct

SEQ ID NO: 4762861 - DNA, 16 bp, Homo sapiens
cctccactcctcccaa

SEQ ID NO: 4762862 - DNA, 10 bp, Homo sapiens
cctccagacc

SEQ ID NO: 4762863 - DNA, 22 bp, Homo sapiens
cctccagacccctaccctttcc

SEQ ID NO: 4762864 - DNA, 17 bp, Homo sapiens
cctccagattattttct

SEQ ID NO: 4762865 - DNA, 17 bp, Homo sapiens
cctccagcaatgcctgc

SEQ ID NO: 4762866 - DNA, 13 bp, Homo sapiens
cctccagccctgg

SEQ ID NO: 4762867 - DNA, 15 bp, Homo sapiens
cctccaggaccttgc

SEQ ID NO: 4762868 - DNA, 13 bp, Homo sapiens
cctccaggttcct

SEQ ID NO: 4762869 - DNA, 14 bp, Homo sapiens
cctccaggttcctc

SEQ ID NO: 4762870 - DNA, 20 bp, Homo sapiens
cctccatcaaacgcagacac

SEQ ID NO: 4762871 - DNA, 12 bp, Homo sapiens
cctccatccaca

SEQ ID NO: 4762872 - DNA, 18 bp, Homo sapiens
cctccatccacacacagc

SEQ ID NO: 4762873 - DNA, 11 bp, Homo sapiens
cctcccaagct

SEQ ID NO: 4762874 - DNA, 18 bp, Homo sapiens
cctcccagccctgcccag

SEQ ID NO: 4762875 - DNA, 21 bp, Homo sapiens
cctcccccaaaccctgcttct

SEQ ID NO: 4762876 - DNA, 13 bp, Homo sapiens
cctcccccaggct

SEQ ID NO: 4762877 - DNA, 14 bp, Homo sapiens
cctcccccaggctg

SEQ ID NO: 4762878 - DNA, 14 bp, Homo sapiens
cctcccccagggag

SEQ ID NO: 4762879 - DNA, 12 bp, Homo sapiens
cctccccctaca

SEQ ID NO: 4762880 - DNA, 12 bp, Homo sapiens
cctccccctcct

SEQ ID NO: 4762881 - DNA, 15 bp, Homo sapiens
cctcccctctcctga

SEQ ID NO: 4762882 - DNA, 14 bp, Homo sapiens
cctcccctggtcct

SEQ ID NO: 4762883 - DNA, 18 bp, Homo sapiens
cctcccctggtcctgcac

SEQ ID NO: 4762884 - DNA, 20 bp, Homo sapiens
cctcccgcatgctgcctgcc

SEQ ID NO: 4762885 - DNA, 23 bp, Homo sapiens
cctcccgccgcctcgggccgcct

SEQ ID NO: 4762886 - DNA, 21 bp, Homo sapiens
cctcccggggtgcccgtgtgg

SEQ ID NO: 4762887 - DNA, 17 bp, Homo sapiens
cctccctcacccggcaa

SEQ ID NO: 4762888 - DNA, 16 bp, Homo sapiens
cctccctccctgctcc

SEQ ID NO: 4762889 - DNA, 14 bp, Homo sapiens
cctccctcctggct

SEQ ID NO: 4762890 - DNA, 18 bp, Homo sapiens
cctccctcctggctcaca

SEQ ID NO: 4762891 - DNA, 21 bp, Homo sapiens
cctccctcctggctcacagcc

SEQ ID NO: 4762892 - DNA, 11 bp, Homo sapiens
cctccctgcag

SEQ ID NO: 4762893 - DNA, 14 bp, Homo sapiens
cctccctgcagctt

SEQ ID NO: 4762894 - DNA, 19 bp, Homo sapiens
cctccctgcagctttgagg

SEQ ID NO: 4762895 - DNA, 14 bp, Homo sapiens
cctccctgctgcca

SEQ ID NO: 4762896 - DNA, 12 bp, Homo sapiens
cctccctgtccc

SEQ ID NO: 4762897 - DNA, 15 bp, Homo sapiens
cctccctgtcccctg

SEQ ID NO: 4762898 - DNA, 20 bp, Homo sapiens
cctccctgtcccctgaggtt

SEQ ID NO: 4762899 - DNA, 21 bp, Homo sapiens
cctcccttctttccttccttt

SEQ ID NO: 4762900 - DNA, 24 bp, Homo sapiens
cctccgaacgctgctccatgcaca

SEQ ID NO: 4762901 - DNA, 17 bp, Homo sapiens
cctccgccagccctgtt

SEQ ID NO: 4762902 - DNA, 13 bp, Homo sapiens
cctccggccctgc

SEQ ID NO: 4762903 - DNA, 17 bp, Homo sapiens
cctccgggcagagacca

SEQ ID NO: 4762904 - DNA, 22 bp, Homo sapiens
cctccgggcagagaccaccgcg

SEQ ID NO: 4762905 - DNA, 22 bp, Homo sapiens
cctccgggcctcggcctggctt

SEQ ID NO: 4762906 - DNA, 13 bp, Homo sapiens
cctcctagcctct

SEQ ID NO: 4762907 - DNA, 21 bp, Homo sapiens
cctcctagcctctccgcccac

SEQ ID NO: 4762908 - DNA, 22 bp, Homo sapiens
cctcctagcctctccgcccacg

SEQ ID NO: 4762909 - DNA, 19 bp, Homo sapiens
cctcctccagagcctgggc

SEQ ID NO: 4762910 - DNA, 14 bp, Homo sapiens
cctcctccatgctg

SEQ ID NO: 4762911 - DNA, 18 bp, Homo sapiens
cctcctccatgctgtccc

SEQ ID NO: 4762912 - DNA, 19 bp, Homo sapiens
cctcctcccaacagtttta

SEQ ID NO: 4762913 - DNA, 14 bp, Homo sapiens
cctcctcccccacg

SEQ ID NO: 4762914 - DNA, 11 bp, Homo sapiens
cctcctcctgc

SEQ ID NO: 4762915 - DNA, 19 bp, Homo sapiens
cctcctctcaaacctggca

SEQ ID NO: 4762916 - DNA, 12 bp, Homo sapiens
cctcctctgccc

SEQ ID NO: 4762917 - DNA, 13 bp, Homo sapiens
cctcctctgcccc

SEQ ID NO: 4762918 - DNA, 16 bp, Homo sapiens
cctcctcttcaccccg

SEQ ID NO: 4762919 - DNA, 15 bp, Homo sapiens
cctcctgatgtcttg

SEQ ID NO: 4762920 - DNA, 12 bp, Homo sapiens
cctcctggccag

SEQ ID NO: 4762921 - DNA, 16 bp, Homo sapiens
cctcctggccagacgc

SEQ ID NO: 4762922 - DNA, 12 bp, Homo sapiens
cctcctggctca

SEQ ID NO: 4762923 - DNA, 18 bp, Homo sapiens
cctcctggctcacagcca

SEQ ID NO: 4762924 - DNA, 19 bp, Homo sapiens
cctcctggctcacagccac

SEQ ID NO: 4762925 - DNA, 20 bp, Homo sapiens
cctcctggctcacagccacc

SEQ ID NO: 4762926 - DNA, 20 bp, Homo sapiens
cctcctgtctcctctgtcag

SEQ ID NO: 4762927 - DNA, 13 bp, Homo sapiens
cctccttctcccc

SEQ ID NO: 4762928 - DNA, 20 bp, Homo sapiens
cctccttctcccctccagac

SEQ ID NO: 4762929 - DNA, 12 bp, Homo sapiens
cctccttctgca

SEQ ID NO: 4762930 - DNA, 21 bp, Homo sapiens
cctcgaatgtgtgggcccaag

SEQ ID NO: 4762931 - DNA, 17 bp, Homo sapiens
cctcgagctctgtagcc

SEQ ID NO: 4762932 - DNA, 21 bp, Homo sapiens
cctcgagctctgtagcctggt

SEQ ID NO: 4762933 - DNA, 22 bp, Homo sapiens
cctcgagtggcgagtccagaca

SEQ ID NO: 4762934 - DNA, 17 bp, Homo sapiens
cctcgccccccgcccgg

SEQ ID NO: 4762935 - DNA, 14 bp, Homo sapiens
cctcgcgcccctgt

SEQ ID NO: 4762936 - DNA, 17 bp, Homo sapiens
cctcgcgcccctgtcca

SEQ ID NO: 4762937 - DNA, 13 bp, Homo sapiens
cctcgctgccacc

SEQ ID NO: 4762938 - DNA, 14 bp, Homo sapiens
cctcgctgccaccc

SEQ ID NO: 4762939 - DNA, 18 bp, Homo sapiens
cctcgctgccacccaccc

SEQ ID NO: 4762940 - DNA, 18 bp, Homo sapiens
cctcgcttcataggcaga

SEQ ID NO: 4762941 - DNA, 13 bp, Homo sapiens
cctcggcagctcc

SEQ ID NO: 4762942 - DNA, 12 bp, Homo sapiens
cctcggccctgt

SEQ ID NO: 4762943 - DNA, 14 bp, Homo sapiens
cctcggcctggctt

SEQ ID NO: 4762944 - DNA, 16 bp, Homo sapiens
cctcggcctggcttca

SEQ ID NO: 4762945 - DNA, 13 bp, Homo sapiens
cctcggctgtgtg

SEQ ID NO: 4762946 - DNA, 16 bp, Homo sapiens
cctcgggcgcctgcgc

SEQ ID NO: 4762947 - DNA, 15 bp, Homo sapiens
cctctagctaccatt

SEQ ID NO: 4762948 - DNA, 16 bp, Homo sapiens
cctctaggaggtctct

SEQ ID NO: 4762949 - DNA, 21 bp, Homo sapiens
cctctaggccttgccccacct

SEQ ID NO: 4762950 - DNA, 18 bp, Homo sapiens
cctctaggtaaactagca

SEQ ID NO: 4762951 - DNA, 18 bp, Homo sapiens
cctctcagatccctcggt

SEQ ID NO: 4762952 - DNA, 19 bp, Homo sapiens
cctctcagatccctcggtc

SEQ ID NO: 4762953 - DNA, 23 bp, Homo sapiens
cctctcccaaataaactccttaa

SEQ ID NO: 4762954 - DNA, 12 bp, Homo sapiens
cctctcctcgtc

SEQ ID NO: 4762955 - DNA, 16 bp, Homo sapiens
cctctcctcgtccggc

SEQ ID NO: 4762956 - DNA, 15 bp, Homo sapiens
cctctcctgcatccc

SEQ ID NO: 4762957 - DNA, 22 bp, Homo sapiens
cctctcctgggggtggcaggca

SEQ ID NO: 4762958 - DNA, 12 bp, Homo sapiens
cctctctcaggc

SEQ ID NO: 4762959 - DNA, 14 bp, Homo sapiens
cctctctcatggct

SEQ ID NO: 4762960 - DNA, 20 bp, Homo sapiens
cctctctctccctccactcc

SEQ ID NO: 4762961 - DNA, 13 bp, Homo sapiens
cctctctctctct

SEQ ID NO: 4762962 - DNA, 21 bp, Homo sapiens
cctctctgaactgcaacactg

SEQ ID NO: 4762963 - DNA, 15 bp, Homo sapiens
cctctctgcagtcct

SEQ ID NO: 4762964 - DNA, 22 bp, Homo sapiens
cctctctggaagagggaggggc

SEQ ID NO: 4762965 - DNA, 20 bp, Homo sapiens
cctctcttttttggggggag

SEQ ID NO: 4762966 - DNA, 21 bp, Homo sapiens
cctctgacagctgtcctgagc

SEQ ID NO: 4762967 - DNA, 13 bp, Homo sapiens
cctctgaccaaca

SEQ ID NO: 4762968 - DNA, 17 bp, Homo sapiens
cctctgaccaacaggct

SEQ ID NO: 4762969 - DNA, 15 bp, Homo sapiens
cctctgcagcctgag

SEQ ID NO: 4762970 - DNA, 17 bp, Homo sapiens
cctctgcagcctgagct

SEQ ID NO: 4762971 - DNA, 23 bp, Homo sapiens
cctctgcagcctgagctccaccc

SEQ ID NO: 4762972 - DNA, 16 bp, Homo sapiens
cctctgcataaatatt

SEQ ID NO: 4762973 - DNA, 19 bp, Homo sapiens
cctctgccactgacaggaa

SEQ ID NO: 4762974 - DNA, 16 bp, Homo sapiens
cctctgccccctcccc

SEQ ID NO: 4762975 - DNA, 21 bp, Homo sapiens
cctctgcccctcttccctggc

SEQ ID NO: 4762976 - DNA, 18 bp, Homo sapiens
cctctgccggtcccccat

SEQ ID NO: 4762977 - DNA, 12 bp, Homo sapiens
cctctgcgcccc

SEQ ID NO: 4762978 - DNA, 17 bp, Homo sapiens
cctctgctatgtctgtg

SEQ ID NO: 4762979 - DNA, 14 bp, Homo sapiens
cctctgctgcacag

SEQ ID NO: 4762980 - DNA, 22 bp, Homo sapiens
cctctgcttgtcattctgctaa

SEQ ID NO: 4762981 - DNA, 23 bp, Homo sapiens
cctctgcttgtcattctgctaat

SEQ ID NO: 4762982 - DNA, 11 bp, Homo sapiens
cctctggacag

SEQ ID NO: 4762983 - DNA, 12 bp, Homo sapiens
cctctggacaga

SEQ ID NO: 4762984 - DNA, 17 bp, Homo sapiens
cctctggggctctaggg

SEQ ID NO: 4762985 - DNA, 22 bp, Homo sapiens
cctctgtcagtttgtgaagtga

SEQ ID NO: 4762986 - DNA, 21 bp, Homo sapiens
cctctgtccgtctgtcctgcg

SEQ ID NO: 4762987 - DNA, 19 bp, Homo sapiens
cctctgtccttcccccagc

SEQ ID NO: 4762988 - DNA, 19 bp, Homo sapiens
cctctgttatttgtcctca

SEQ ID NO: 4762989 - DNA, 14 bp, Homo sapiens
cctcttcaatcccc

SEQ ID NO: 4762990 - DNA, 21 bp, Homo sapiens
cctcttcaccccggcaggccc

SEQ ID NO: 4762991 - DNA, 23 bp, Homo sapiens
cctcttcaccccggcaggccctg

SEQ ID NO: 4762992 - DNA, 12 bp, Homo sapiens
cctcttccccct

SEQ ID NO: 4762993 - DNA, 15 bp, Homo sapiens
cctcttcccccttcc

SEQ ID NO: 4762994 - DNA, 21 bp, Homo sapiens
cctcttcccccttcccctgcg

SEQ ID NO: 4762995 - DNA, 13 bp, Homo sapiens
cctcttctcagct

SEQ ID NO: 4762996 - DNA, 18 bp, Homo sapiens
cctcttctcagctccact

SEQ ID NO: 4762997 - DNA, 21 bp, Homo sapiens
cctcttgaatgcttaaatgat

SEQ ID NO: 4762998 - DNA, 14 bp, Homo sapiens
cctctttctctctg

SEQ ID NO: 4762999 - DNA, 17 bp, Homo sapiens
cctctttctctctgtgt

SEQ ID NO: 4763000 - DNA, 21 bp, Homo sapiens
cctctttctctctgtgtggca

SEQ ID NO: 4763001 - DNA, 12 bp, Homo sapiens
cctctttcttca

SEQ ID NO: 4763002 - DNA, 21 bp, Homo sapiens
cctcttttcccttgtgtgagg

SEQ ID NO: 4763003 - DNA, 20 bp, Homo sapiens
cctgaactcccagtcatgtt

SEQ ID NO: 4763004 - DNA, 22 bp, Homo sapiens
cctgaagtctttgtacagacaa

SEQ ID NO: 4763005 - DNA, 18 bp, Homo sapiens
cctgaattaaagtctaca

SEQ ID NO: 4763006 - DNA, 12 bp, Homo sapiens
cctgaattatta

SEQ ID NO: 4763007 - DNA, 13 bp, Homo sapiens
cctgaattattaa

SEQ ID NO: 4763008 - DNA, 18 bp, Homo sapiens
cctgacacctgccgctgc

SEQ ID NO: 4763009 - DNA, 20 bp, Homo sapiens
cctgacacctgccgctgctt

SEQ ID NO: 4763010 - DNA, 21 bp, Homo sapiens
cctgacagcgccatgtgtgtc

SEQ ID NO: 4763011 - DNA, 13 bp, Homo sapiens
cctgaccctcact

SEQ ID NO: 4763012 - DNA, 14 bp, Homo sapiens
cctgaccctcactt

SEQ ID NO: 4763013 - DNA, 13 bp, Homo sapiens
cctgactgttctc

SEQ ID NO: 4763014 - DNA, 13 bp, Homo sapiens
cctgacttcccag

SEQ ID NO: 4763015 - DNA, 14 bp, Homo sapiens
cctgacttcccagc

SEQ ID NO: 4763016 - DNA, 20 bp, Homo sapiens
cctgacttcccagctggcag

SEQ ID NO: 4763017 - DNA, 23 bp, Homo sapiens
cctgagaattgaggggaggtggc

SEQ ID NO: 4763018 - DNA, 20 bp, Homo sapiens
cctgagccccctgcacccac

SEQ ID NO: 4763019 - DNA, 12 bp, Homo sapiens
cctgagcctgtc

SEQ ID NO: 4763020 - DNA, 16 bp, Homo sapiens
cctgagcctgtctctc

SEQ ID NO: 4763021 - DNA, 19 bp, Homo sapiens
cctgagctccaccctcccc

SEQ ID NO: 4763022 - DNA, 20 bp, Homo sapiens
cctgaggacctttctgagga

SEQ ID NO: 4763023 - DNA, 12 bp, Homo sapiens
cctgagggaagc

SEQ ID NO: 4763024 - DNA, 17 bp, Homo sapiens
cctgagggaagcccacc

SEQ ID NO: 4763025 - DNA, 21 bp, Homo sapiens
cctgagggacgagcagagcgc

SEQ ID NO: 4763026 - DNA, 17 bp, Homo sapiens
cctgaggtcatctgtaa

SEQ ID NO: 4763027 - DNA, 19 bp, Homo sapiens
cctgaggtcatctgtaaaa

SEQ ID NO: 4763028 - DNA, 21 bp, Homo sapiens
cctgagtcagggcccagaggc

SEQ ID NO: 4763029 - DNA, 22 bp, Homo sapiens
cctgatcaaggtgctcttctca

SEQ ID NO: 4763030 - DNA, 15 bp, Homo sapiens
cctgatggccaggcc

SEQ ID NO: 4763031 - DNA, 14 bp, Homo sapiens
cctgcaaggcccac

SEQ ID NO: 4763032 - DNA, 23 bp, Homo sapiens
cctgcaaggtgcacctgccccag

SEQ ID NO: 4763033 - DNA, 15 bp, Homo sapiens
cctgcacacacctgc

SEQ ID NO: 4763034 - DNA, 16 bp, Homo sapiens
cctgcacacacctgcc

SEQ ID NO: 4763035 - DNA, 19 bp, Homo sapiens
cctgcacacacctgcctgc

SEQ ID NO: 4763036 - DNA, 13 bp, Homo sapiens
cctgcaccctctg

SEQ ID NO: 4763037 - DNA, 17 bp, Homo sapiens
cctgcacctgcttctca

SEQ ID NO: 4763038 - DNA, 20 bp, Homo sapiens
cctgcactgtcccggagctc

SEQ ID NO: 4763039 - DNA, 15 bp, Homo sapiens
cctgcagcccagaac

SEQ ID NO: 4763040 - DNA, 22 bp, Homo sapiens
cctgcaggaaagaaatcagctt

SEQ ID NO: 4763041 - DNA, 15 bp, Homo sapiens
cctgcagtctgtgga

SEQ ID NO: 4763042 - DNA, 12 bp, Homo sapiens
cctgcagtgttc

SEQ ID NO: 4763043 - DNA, 19 bp, Homo sapiens
cctgcagtgttcgcttggc

SEQ ID NO: 4763044 - DNA, 20 bp, Homo sapiens
cctgcagtgttcgcttggct

SEQ ID NO: 4763045 - DNA, 14 bp, Homo sapiens
cctgcatccctcca

SEQ ID NO: 4763046 - DNA, 15 bp, Homo sapiens
cctgcatccctccac

SEQ ID NO: 4763047 - DNA, 23 bp, Homo sapiens
cctgcatgtcggggcccctgcgt

SEQ ID NO: 4763048 - DNA, 18 bp, Homo sapiens
cctgccaactttccagac

SEQ ID NO: 4763049 - DNA, 14 bp, Homo sapiens
cctgccaccctctg

SEQ ID NO: 4763050 - DNA, 14 bp, Homo sapiens
cctgccaggaagcc

SEQ ID NO: 4763051 - DNA, 15 bp, Homo sapiens
cctgccaggaagcca

SEQ ID NO: 4763052 - DNA, 17 bp, Homo sapiens
cctgccaggaagccagc

SEQ ID NO: 4763053 - DNA, 21 bp, Homo sapiens
cctgccaggaagccagcaggc

SEQ ID NO: 4763054 - DNA, 22 bp, Homo sapiens
cctgccaggaagccagcaggct

SEQ ID NO: 4763055 - DNA, 18 bp, Homo sapiens
cctgcccagcacctcctc

SEQ ID NO: 4763056 - DNA, 21 bp, Homo sapiens
cctgcccagcacctcctccgt

SEQ ID NO: 4763057 - DNA, 15 bp, Homo sapiens
cctgcccaggccggc

SEQ ID NO: 4763058 - DNA, 18 bp, Homo sapiens
cctgcccaggccggccag

SEQ ID NO: 4763059 - DNA, 18 bp, Homo sapiens
cctgcccagttagcccgg

SEQ ID NO: 4763060 - DNA, 19 bp, Homo sapiens
cctgcccatgtgtcccctc

SEQ ID NO: 4763061 - DNA, 20 bp, Homo sapiens
cctgccccacacaggcctgg

SEQ ID NO: 4763062 - DNA, 11 bp, Homo sapiens
cctgccccaga

SEQ ID NO: 4763063 - DNA, 12 bp, Homo sapiens
cctgccccagag

SEQ ID NO: 4763064 - DNA, 13 bp, Homo sapiens
cctgccccaggct

SEQ ID NO: 4763065 - DNA, 15 bp, Homo sapiens
cctgccccaggctca

SEQ ID NO: 4763066 - DNA, 13 bp, Homo sapiens
cctgccccccttc

SEQ ID NO: 4763067 - DNA, 16 bp, Homo sapiens
cctgccctcactccac

SEQ ID NO: 4763068 - DNA, 20 bp, Homo sapiens
cctgccctcactccactccc

SEQ ID NO: 4763069 - DNA, 13 bp, Homo sapiens
cctgccctccccc

SEQ ID NO: 4763070 - DNA, 14 bp, Homo sapiens
cctgccctccccca

SEQ ID NO: 4763071 - DNA, 13 bp, Homo sapiens
cctgccctgagga

SEQ ID NO: 4763072 - DNA, 13 bp, Homo sapiens
cctgccctgcacc

SEQ ID NO: 4763073 - DNA, 11 bp, Homo sapiens
cctgccctggc

SEQ ID NO: 4763074 - DNA, 12 bp, Homo sapiens
cctgccctggcc

SEQ ID NO: 4763075 - DNA, 22 bp, Homo sapiens
cctgccctggcctaccacagct

SEQ ID NO: 4763076 - DNA, 21 bp, Homo sapiens
cctgcccttacctgccaggaa

SEQ ID NO: 4763077 - DNA, 21 bp, Homo sapiens
cctgcctcatcttccttctca

SEQ ID NO: 4763078 - DNA, 15 bp, Homo sapiens
cctgcctccggccct

SEQ ID NO: 4763079 - DNA, 18 bp, Homo sapiens
cctgcctccggccctgcc

SEQ ID NO: 4763080 - DNA, 17 bp, Homo sapiens
cctgcctctcacacaca

SEQ ID NO: 4763081 - DNA, 21 bp, Homo sapiens
cctgcctgagaccacggtcca

SEQ ID NO: 4763082 - DNA, 14 bp, Homo sapiens
cctgcctgttgggc

SEQ ID NO: 4763083 - DNA, 21 bp, Homo sapiens
cctgcgacggaggcaggacca

SEQ ID NO: 4763084 - DNA, 16 bp, Homo sapiens
cctgcgccccccagtg

SEQ ID NO: 4763085 - DNA, 14 bp, Homo sapiens
cctgcgcccctgcc

SEQ ID NO: 4763086 - DNA, 15 bp, Homo sapiens
cctgcgcccctgccc

SEQ ID NO: 4763087 - DNA, 17 bp, Homo sapiens
cctgcgcccctgcccag

SEQ ID NO: 4763088 - DNA, 20 bp, Homo sapiens
cctgcgcccctgcccagcac

SEQ ID NO: 4763089 - DNA, 17 bp, Homo sapiens
cctgcgccctccctccc

SEQ ID NO: 4763090 - DNA, 22 bp, Homo sapiens
cctgcgccctccctccctccac

SEQ ID NO: 4763091 - DNA, 13 bp, Homo sapiens
cctgcgcctcctc

SEQ ID NO: 4763092 - DNA, 17 bp, Homo sapiens
cctgcgcctcctcctgc

SEQ ID NO: 4763093 - DNA, 17 bp, Homo sapiens
cctgcgcctgcgcctcc

SEQ ID NO: 4763094 - DNA, 16 bp, Homo sapiens
cctgcgcgcagctggc

SEQ ID NO: 4763095 - DNA, 12 bp, Homo sapiens
cctgcgctcctc

SEQ ID NO: 4763096 - DNA, 13 bp, Homo sapiens
cctgcgctcctct

SEQ ID NO: 4763097 - DNA, 14 bp, Homo sapiens
cctgcgctcctctg

SEQ ID NO: 4763098 - DNA, 16 bp, Homo sapiens
cctgcgctcctctgca

SEQ ID NO: 4763099 - DNA, 21 bp, Homo sapiens
cctgcgctcctctgcagcctg

SEQ ID NO: 4763100 - DNA, 18 bp, Homo sapiens
cctgcggggttccctgcg

SEQ ID NO: 4763101 - DNA, 14 bp, Homo sapiens
cctgcgtctcctgc

SEQ ID NO: 4763102 - DNA, 17 bp, Homo sapiens
cctgcgtgtgttctctc

SEQ ID NO: 4763103 - DNA, 18 bp, Homo sapiens
cctgctaaatgacttatt

SEQ ID NO: 4763104 - DNA, 16 bp, Homo sapiens
cctgctacctttgtct

SEQ ID NO: 4763105 - DNA, 21 bp, Homo sapiens
cctgctacctttgtctcacga

SEQ ID NO: 4763106 - DNA, 13 bp, Homo sapiens
cctgctatccagc

SEQ ID NO: 4763107 - DNA, 15 bp, Homo sapiens
cctgctatccagccg

SEQ ID NO: 4763108 - DNA, 17 bp, Homo sapiens
cctgctatccagccgca

SEQ ID NO: 4763109 - DNA, 19 bp, Homo sapiens
cctgctcacgtctgtgagt

SEQ ID NO: 4763110 - DNA, 21 bp, Homo sapiens
cctgctcccggctctgaggct

SEQ ID NO: 4763111 - DNA, 13 bp, Homo sapiens
cctgctccctgct

SEQ ID NO: 4763112 - DNA, 11 bp, Homo sapiens
cctgctcctcc

SEQ ID NO: 4763113 - DNA, 23 bp, Homo sapiens
cctgctgagaatccccgtgctca

SEQ ID NO: 4763114 - DNA, 20 bp, Homo sapiens
cctgctgagtggctcgtgtt

SEQ ID NO: 4763115 - DNA, 20 bp, Homo sapiens
cctgctgccaggctcccact

SEQ ID NO: 4763116 - DNA, 17 bp, Homo sapiens
cctgctgctctctaaga

SEQ ID NO: 4763117 - DNA, 16 bp, Homo sapiens
cctgcttacctgccag

SEQ ID NO: 4763118 - DNA, 13 bp, Homo sapiens
cctgcttcattca

SEQ ID NO: 4763119 - DNA, 14 bp, Homo sapiens
cctgcttcccacct

SEQ ID NO: 4763120 - DNA, 21 bp, Homo sapiens
cctgcttcccacctccctgcc

SEQ ID NO: 4763121 - DNA, 23 bp, Homo sapiens
cctgcttcccacctccctgccca

SEQ ID NO: 4763122 - DNA, 24 bp, Homo sapiens
cctgcttcccacctccctgcccag

SEQ ID NO: 4763123 - DNA, 20 bp, Homo sapiens
cctgcttctcccgccattgg

SEQ ID NO: 4763124 - DNA, 22 bp, Homo sapiens
cctgcttctcccgccattggcc

SEQ ID NO: 4763125 - DNA, 17 bp, Homo sapiens
cctgcttctgctgccct

SEQ ID NO: 4763126 - DNA, 22 bp, Homo sapiens
cctgcttgctggaaaactgcca

SEQ ID NO: 4763127 - DNA, 13 bp, Homo sapiens
cctggaaagccag

SEQ ID NO: 4763128 - DNA, 15 bp, Homo sapiens
cctggaaagccaggt

SEQ ID NO: 4763129 - DNA, 18 bp, Homo sapiens
cctggaaatttgtgtgct

SEQ ID NO: 4763130 - DNA, 22 bp, Homo sapiens
cctggaactctatctgggcctg

SEQ ID NO: 4763131 - DNA, 13 bp, Homo sapiens
cctggacaaaccc

SEQ ID NO: 4763132 - DNA, 14 bp, Homo sapiens
cctggacagtgaga

SEQ ID NO: 4763133 - DNA, 15 bp, Homo sapiens
cctggacagtgagag

SEQ ID NO: 4763134 - DNA, 23 bp, Homo sapiens
cctggacagtgagagcagggctg

SEQ ID NO: 4763135 - DNA, 20 bp, Homo sapiens
cctggacgcatgcagggccc

SEQ ID NO: 4763136 - DNA, 20 bp, Homo sapiens
cctggagaagggttcagccc

SEQ ID NO: 4763137 - DNA, 15 bp, Homo sapiens
cctggaggagaagga

SEQ ID NO: 4763138 - DNA, 18 bp, Homo sapiens
cctggaggctggaccaac

SEQ ID NO: 4763139 - DNA, 20 bp, Homo sapiens
cctggaggctggaccaactg

SEQ ID NO: 4763140 - DNA, 13 bp, Homo sapiens
cctggatgttata

SEQ ID NO: 4763141 - DNA, 18 bp, Homo sapiens
cctggcacaggactgatt

SEQ ID NO: 4763142 - DNA, 24 bp, Homo sapiens
cctggcacaggactgattctggga

SEQ ID NO: 4763143 - DNA, 15 bp, Homo sapiens
cctggcagatggggg

SEQ ID NO: 4763144 - DNA, 17 bp, Homo sapiens
cctggcagatgggggcc

SEQ ID NO: 4763145 - DNA, 17 bp, Homo sapiens
cctggcatgggaatgaa

SEQ ID NO: 4763146 - DNA, 18 bp, Homo sapiens
cctggcatgggaatgaat

SEQ ID NO: 4763147 - DNA, 17 bp, Homo sapiens
cctggcccagccagcag

SEQ ID NO: 4763148 - DNA, 13 bp, Homo sapiens
cctggcccataga

SEQ ID NO: 4763149 - DNA, 16 bp, Homo sapiens
cctggccccaaatgtt

SEQ ID NO: 4763150 - DNA, 14 bp, Homo sapiens
cctggccccagtga

SEQ ID NO: 4763151 - DNA, 19 bp, Homo sapiens
cctggccccagtgaccggg

SEQ ID NO: 4763152 - DNA, 17 bp, Homo sapiens
cctggcccggtcccagt

SEQ ID NO: 4763153 - DNA, 19 bp, Homo sapiens
cctggcctaccacagctgc

SEQ ID NO: 4763154 - DNA, 13 bp, Homo sapiens
cctggcctggccc

SEQ ID NO: 4763155 - DNA, 22 bp, Homo sapiens
cctggcctggccctgccctgag

SEQ ID NO: 4763156 - DNA, 14 bp, Homo sapiens
cctggcgggcagcc

SEQ ID NO: 4763157 - DNA, 18 bp, Homo sapiens
cctggctcacagccacca

SEQ ID NO: 4763158 - DNA, 20 bp, Homo sapiens
cctggctcacagccaccacc

SEQ ID NO: 4763159 - DNA, 16 bp, Homo sapiens
cctggctcccagggtc

SEQ ID NO: 4763160 - DNA, 18 bp, Homo sapiens
cctggctgagtgcgacca

SEQ ID NO: 4763161 - DNA, 23 bp, Homo sapiens
cctggctgagtgcgaccaccact

SEQ ID NO: 4763162 - DNA, 15 bp, Homo sapiens
cctggcttctgggac

SEQ ID NO: 4763163 - DNA, 13 bp, Homo sapiens
cctgggacagcca

SEQ ID NO: 4763164 - DNA, 15 bp, Homo sapiens
cccacaccccgtctg

SEQ ID NO: 4763165 - DNA, 16 bp, Homo sapiens
cccacacgccggggct

SEQ ID NO: 4763166 - DNA, 17 bp, Homo sapiens
cccacaggagcatgtcc

SEQ ID NO: 4763167 - DNA, 15 bp, Homo sapiens
cccacataaacactt

SEQ ID NO: 4763168 - DNA, 22 bp, Homo sapiens
cccacataaacacttctcctta

SEQ ID NO: 4763169 - DNA, 20 bp, Homo sapiens
cccaccacaactaacaatgc

SEQ ID NO: 4763170 - DNA, 15 bp, Homo sapiens
cccaccacacacacc

SEQ ID NO: 4763171 - DNA, 17 bp, Homo sapiens
cccaccactctcaggac

SEQ ID NO: 4763172 - DNA, 13 bp, Homo sapiens
cccacccacaccc

SEQ ID NO: 4763173 - DNA, 18 bp, Homo sapiens
cccacccccagcagctca

SEQ ID NO: 4763174 - DNA, 16 bp, Homo sapiens
cccaccccgctgcctg

SEQ ID NO: 4763175 - DNA, 22 bp, Homo sapiens
cccaccccgctgcctggcgggc

SEQ ID NO: 4763176 - DNA, 21 bp, Homo sapiens
cccacccctacagcctgcaca

SEQ ID NO: 4763177 - DNA, 15 bp, Homo sapiens
cccacccctcttccc

SEQ ID NO: 4763178 - DNA, 17 bp, Homo sapiens
cccacccgccccagaga

SEQ ID NO: 4763179 - DNA, 18 bp, Homo sapiens
cccacccgccccagagac

SEQ ID NO: 4763180 - DNA, 20 bp, Homo sapiens
cccacccgtgttctcctcca

SEQ ID NO: 4763181 - DNA, 20 bp, Homo sapiens
cccaccctcccctctcctga

SEQ ID NO: 4763182 - DNA, 14 bp, Homo sapiens
cccaccctgggcct

SEQ ID NO: 4763183 - DNA, 19 bp, Homo sapiens
cccaccctgggcctcccgt

SEQ ID NO: 4763184 - DNA, 21 bp, Homo sapiens
cccaccgggagcctccccctc

SEQ ID NO: 4763185 - DNA, 22 bp, Homo sapiens
cccacctaaagggaagccctga

SEQ ID NO: 4763186 - DNA, 17 bp, Homo sapiens
cccacctccctgcagct

SEQ ID NO: 4763187 - DNA, 17 bp, Homo sapiens
cccacctccctgcccag

SEQ ID NO: 4763188 - DNA, 16 bp, Homo sapiens
cccacctctttcttca

SEQ ID NO: 4763189 - DNA, 13 bp, Homo sapiens
cccacctgccagg

SEQ ID NO: 4763190 - DNA, 22 bp, Homo sapiens
cccacctgggccctaggcatac

SEQ ID NO: 4763191 - DNA, 15 bp, Homo sapiens
cccacctgtcaacct

SEQ ID NO: 4763192 - DNA, 13 bp, Homo sapiens
cccacgcagagcc

SEQ ID NO: 4763193 - DNA, 20 bp, Homo sapiens
ccgctgggagaaaagccaga

SEQ ID NO: 4763194 - DNA, 16 bp, Homo sapiens
ccgctgtcgccccagg

SEQ ID NO: 4763195 - DNA, 20 bp, Homo sapiens
ccgctgtcgccccaggccct

SEQ ID NO: 4763196 - DNA, 18 bp, Homo sapiens
ccggaaggacacagtcag

SEQ ID NO: 4763197 - DNA, 21 bp, Homo sapiens
ccggaaggggcgctcctccca

SEQ ID NO: 4763198 - DNA, 18 bp, Homo sapiens
ccggacgcatgcagggcc

SEQ ID NO: 4763199 - DNA, 19 bp, Homo sapiens
ccggacgcatgcagggccc

SEQ ID NO: 4763200 - DNA, 12 bp, Homo sapiens
ccggacgctgga

SEQ ID NO: 4763201 - DNA, 18 bp, Homo sapiens
ccggacgctggagaccct

SEQ ID NO: 4763202 - DNA, 18 bp, Homo sapiens
ccggactgaccgaaggga

SEQ ID NO: 4763203 - DNA, 12 bp, Homo sapiens
ccggagcaccac

SEQ ID NO: 4763204 - DNA, 15 bp, Homo sapiens
ccggagcggctgagg

SEQ ID NO: 4763205 - DNA, 16 bp, Homo sapiens
ccggagcggctgagga

SEQ ID NO: 4763206 - DNA, 15 bp, Homo sapiens
ccggaggcgcccacc

SEQ ID NO: 4763207 - DNA, 16 bp, Homo sapiens
ccggaggcgcccacct

SEQ ID NO: 4763208 - DNA, 19 bp, Homo sapiens
ccggaggcgcccacctgcc

SEQ ID NO: 4763209 - DNA, 21 bp, Homo sapiens
ccggaggcgcccacctgccca

SEQ ID NO: 4763210 - DNA, 13 bp, Homo sapiens
ccggatcctgttg

SEQ ID NO: 4763211 - DNA, 14 bp, Homo sapiens
ccggatctccaggc

SEQ ID NO: 4763212 - DNA, 14 bp, Homo sapiens
ccggcactgtgcac

SEQ ID NO: 4763213 - DNA, 12 bp, Homo sapiens
ccggcagaggca

SEQ ID NO: 4763214 - DNA, 15 bp, Homo sapiens
ccggcagaggcaggg

SEQ ID NO: 4763215 - DNA, 17 bp, Homo sapiens
ccggcagaggcagggcc

SEQ ID NO: 4763216 - DNA, 23 bp, Homo sapiens
ccggcagaggcagggccctgggg

SEQ ID NO: 4763217 - DNA, 11 bp, Homo sapiens
ccggcaggccc

SEQ ID NO: 4763218 - DNA, 12 bp, Homo sapiens
ccggcaggccct

SEQ ID NO: 4763219 - DNA, 15 bp, Homo sapiens
ccggcaggccctgca

SEQ ID NO: 4763220 - DNA, 18 bp, Homo sapiens
ccggcaggccctgcagtg

SEQ ID NO: 4763221 - DNA, 18 bp, Homo sapiens
ccggcccacgcagagccc

SEQ ID NO: 4763222 - DNA, 19 bp, Homo sapiens
ccggcccacgcagagcccc

SEQ ID NO: 4763223 - DNA, 15 bp, Homo sapiens
ccggcccacgtcctg

SEQ ID NO: 4763224 - DNA, 19 bp, Homo sapiens
ccggcccccctctcgggct

SEQ ID NO: 4763225 - DNA, 20 bp, Homo sapiens
ccggcccccctctcgggctc

SEQ ID NO: 4763226 - DNA, 15 bp, Homo sapiens
ccggcccgccacctt

SEQ ID NO: 4763227 - DNA, 16 bp, Homo sapiens
ccggccctgccccaca

SEQ ID NO: 4763228 - DNA, 20 bp, Homo sapiens
ccggcctgatggccaggcct

SEQ ID NO: 4763229 - DNA, 17 bp, Homo sapiens
ccggcctggccccctcg

SEQ ID NO: 4763230 - DNA, 13 bp, Homo sapiens
ccggcttggctag

SEQ ID NO: 4763231 - DNA, 17 bp, Homo sapiens
ccgggaacgcttgctct

SEQ ID NO: 4763232 - DNA, 15 bp, Homo sapiens
ccgggagcctccccc

SEQ ID NO: 4763233 - DNA, 13 bp, Homo sapiens
ccgggaggaggat

SEQ ID NO: 4763234 - DNA, 21 bp, Homo sapiens
ccgggcactgtcatgcccagc

SEQ ID NO: 4763235 - DNA, 16 bp, Homo sapiens
ccgggcagagaccacc

SEQ ID NO: 4763236 - DNA, 22 bp, Homo sapiens
ccgggccccatggtcacagacc

SEQ ID NO: 4763237 - DNA, 14 bp, Homo sapiens
ccgggcctcggcct

SEQ ID NO: 4763238 - DNA, 18 bp, Homo sapiens
ccgggcctcggcctggct

SEQ ID NO: 4763239 - DNA, 18 bp, Homo sapiens
ccgggctggcctgacaca

SEQ ID NO: 4763240 - DNA, 23 bp, Homo sapiens
ccgggctggcctgacacaatggt

SEQ ID NO: 4763241 - DNA, 14 bp, Homo sapiens
ccggggctggccct

SEQ ID NO: 4763242 - DNA, 21 bp, Homo sapiens
ccggggtgcccgtgtggcctg

SEQ ID NO: 4763243 - DNA, 23 bp, Homo sapiens
ccggggtgcccgtgtggcctggg

SEQ ID NO: 4763244 - DNA, 20 bp, Homo sapiens
ccgggtactcagtcagccca

SEQ ID NO: 4763245 - DNA, 21 bp, Homo sapiens
ccgggtgccccccatgccctc

SEQ ID NO: 4763246 - DNA, 19 bp, Homo sapiens
ccgggtgcgtgaccggccc

SEQ ID NO: 4763247 - DNA, 17 bp, Homo sapiens
ccgggtggcagcgccca

SEQ ID NO: 4763248 - DNA, 21 bp, Homo sapiens
ccgggtgtggcctcagccctc

SEQ ID NO: 4763249 - DNA, 20 bp, Homo sapiens
ccggtgccttccaccctgcc

SEQ ID NO: 4763250 - DNA, 21 bp, Homo sapiens
ccggtgccttccaccctgccc

SEQ ID NO: 4763251 - DNA, 23 bp, Homo sapiens
ccggtgccttccaccctgccctg

SEQ ID NO: 4763252 - DNA, 14 bp, Homo sapiens
ccggtggcttctgg

SEQ ID NO: 4763253 - DNA, 13 bp, Homo sapiens
ccggttccacgtg

SEQ ID NO: 4763254 - DNA, 14 bp, Homo sapiens
ccggttccacgtgg

SEQ ID NO: 4763255 - DNA, 18 bp, Homo sapiens
ccggttccacgtggggtg

SEQ ID NO: 4763256 - DNA, 19 bp, Homo sapiens
ccgtaccatcggtcagcag

SEQ ID NO: 4763257 - DNA, 13 bp, Homo sapiens
ccgtcagcctgtg

SEQ ID NO: 4763258 - DNA, 14 bp, Homo sapiens
ccgtcccggccccg

SEQ ID NO: 4763259 - DNA, 15 bp, Homo sapiens
ccgtcccggccccgc

SEQ ID NO: 4763260 - DNA, 22 bp, Homo sapiens
ccgtccctgacttcccagctgg

SEQ ID NO: 4763261 - DNA, 13 bp, Homo sapiens
ccgtccgcccgcc

SEQ ID NO: 4763262 - DNA, 13 bp, Homo sapiens
ccgtctgattgtt

SEQ ID NO: 4763263 - DNA, 14 bp, Homo sapiens
ccgtgagacacaag

SEQ ID NO: 4763264 - DNA, 20 bp, Homo sapiens
ccgtgagcaggaaggcctgg

SEQ ID NO: 4763265 - DNA, 22 bp, Homo sapiens
ccgtgagcaggaaggcctgggt

SEQ ID NO: 4763266 - DNA, 12 bp, Homo sapiens
ccgtgaggccag

SEQ ID NO: 4763267 - DNA, 14 bp, Homo sapiens
ccgtgaggccagag

SEQ ID NO: 4763268 - DNA, 16 bp, Homo sapiens
ccgtgaggccagagac

SEQ ID NO: 4763269 - DNA, 19 bp, Homo sapiens
ccgtgcgcagccgcgctct

SEQ ID NO: 4763270 - DNA, 15 bp, Homo sapiens
ccgtgctcacagtag

SEQ ID NO: 4763271 - DNA, 14 bp, Homo sapiens
ccgtgctcctctgc

SEQ ID NO: 4763272 - DNA, 17 bp, Homo sapiens
ccgtgctcctctgcccg

SEQ ID NO: 4763273 - DNA, 21 bp, Homo sapiens
ccgtggtgaggttgtgctgcc

SEQ ID NO: 4763274 - DNA, 14 bp, Homo sapiens
ccgtggtgtcctct

SEQ ID NO: 4763275 - DNA, 16 bp, Homo sapiens
ccgtgtctctgaggac

SEQ ID NO: 4763276 - DNA, 12 bp, Homo sapiens
ccgtgtggcctg

SEQ ID NO: 4763277 - DNA, 13 bp, Homo sapiens
ccgtgtggcctgg

SEQ ID NO: 4763278 - DNA, 11 bp, Homo sapiens
ccgtgttcaca

SEQ ID NO: 4763279 - DNA, 15 bp, Homo sapiens
ccgtgttcacacaca

SEQ ID NO: 4763280 - DNA, 19 bp, Homo sapiens
ccgttagggaaatccaact

SEQ ID NO: 4763281 - DNA, 23 bp, Homo sapiens
ccgttagggaaatccaactccag

SEQ ID NO: 4763282 - DNA, 20 bp, Homo sapiens
ccgttcatctgaggagtcca

SEQ ID NO: 4763283 - DNA, 14 bp, Homo sapiens
ccgttcccagcgca

SEQ ID NO: 4763284 - DNA, 15 bp, Homo sapiens
ccgttcccagcgcat

SEQ ID NO: 4763285 - DNA, 16 bp, Homo sapiens
ccgttgttgtccctgc

SEQ ID NO: 4763286 - DNA, 14 bp, Homo sapiens
cctaaacagctgct

SEQ ID NO: 4763287 - DNA, 16 bp, Homo sapiens
cctaaagaaaaagata

SEQ ID NO: 4763288 - DNA, 22 bp, Homo sapiens
cctaaataatatcctgaataac

SEQ ID NO: 4763289 - DNA, 21 bp, Homo sapiens
cctaaatccactctgcaggaa

SEQ ID NO: 4763290 - DNA, 12 bp, Homo sapiens
cctaacagtcag

SEQ ID NO: 4763291 - DNA, 23 bp, Homo sapiens
cctaactgatttccatccaaacc

SEQ ID NO: 4763292 - DNA, 19 bp, Homo sapiens
cctaagctggagtgcagtg

SEQ ID NO: 4763293 - DNA, 12 bp, Homo sapiens
cctaagtttctt

SEQ ID NO: 4763294 - DNA, 20 bp, Homo sapiens
cctaatattcatgctgcctg

SEQ ID NO: 4763295 - DNA, 14 bp, Homo sapiens
cctaatccacctgg

SEQ ID NO: 4763296 - DNA, 15 bp, Homo sapiens
cctaatccacctggt

SEQ ID NO: 4763297 - DNA, 17 bp, Homo sapiens
cctaatcgccctgagct

SEQ ID NO: 4763298 - DNA, 14 bp, Homo sapiens
cctaattaatttca

SEQ ID NO: 4763299 - DNA, 22 bp, Homo sapiens
cctacaatatcattttcctggg

SEQ ID NO: 4763300 - DNA, 23 bp, Homo sapiens
cctacaatatcattttcctggga

SEQ ID NO: 4763301 - DNA, 13 bp, Homo sapiens
cctacagatcctc

SEQ ID NO: 4763302 - DNA, 20 bp, Homo sapiens
cctacagcctgcacacacct

SEQ ID NO: 4763303 - DNA, 21 bp, Homo sapiens
cctacagcctgcacacacctg

SEQ ID NO: 4763304 - DNA, 13 bp, Homo sapiens
cctacagtatata

SEQ ID NO: 4763305 - DNA, 16 bp, Homo sapiens
cctaccacagctgcct

SEQ ID NO: 4763306 - DNA, 16 bp, Homo sapiens
cctaccctcttctcag

SEQ ID NO: 4763307 - DNA, 15 bp, Homo sapiens
cctacggtacaagct

SEQ ID NO: 4763308 - DNA, 20 bp, Homo sapiens
cctactcctccccctcctcc

SEQ ID NO: 4763309 - DNA, 14 bp, Homo sapiens
cctacttaaacaaa

SEQ ID NO: 4763310 - DNA, 16 bp, Homo sapiens
cctacttaaacaaaaa

SEQ ID NO: 4763311 - DNA, 19 bp, Homo sapiens
cctagaatgtttcatttgc

SEQ ID NO: 4763312 - DNA, 23 bp, Homo sapiens
cctagaggattgtccaccttctg

SEQ ID NO: 4763313 - DNA, 23 bp, Homo sapiens
cctagaggggacaagccaggccc

SEQ ID NO: 4763314 - DNA, 15 bp, Homo sapiens
cctagcccaccctgc

SEQ ID NO: 4763315 - DNA, 16 bp, Homo sapiens
cctagcccaccctgct

SEQ ID NO: 4763316 - DNA, 17 bp, Homo sapiens
cctagcccaccctgctg

SEQ ID NO: 4763317 - DNA, 21 bp, Homo sapiens
cctagcctctccgcccacgcg

SEQ ID NO: 4763318 - DNA, 20 bp, Homo sapiens
ccctgttgctacatcagagt

SEQ ID NO: 4763319 - DNA, 20 bp, Homo sapiens
cccttacctgccaggaagcc

SEQ ID NO: 4763320 - DNA, 15 bp, Homo sapiens
cccttacgtgagtcc

SEQ ID NO: 4763321 - DNA, 12 bp, Homo sapiens
cccttcatccca

SEQ ID NO: 4763322 - DNA, 14 bp, Homo sapiens
cccttccactgcct

SEQ ID NO: 4763323 - DNA, 20 bp, Homo sapiens
cccttccactgcctctgcct

SEQ ID NO: 4763324 - DNA, 12 bp, Homo sapiens
cccttccagaca

SEQ ID NO: 4763325 - DNA, 21 bp, Homo sapiens
cccttcccaatcagcactgaa

SEQ ID NO: 4763326 - DNA, 15 bp, Homo sapiens
cccttccccactccc

SEQ ID NO: 4763327 - DNA, 18 bp, Homo sapiens
cccttccccactcccgtg

SEQ ID NO: 4763328 - DNA, 18 bp, Homo sapiens
cccttcccctgcgccctc

SEQ ID NO: 4763329 - DNA, 21 bp, Homo sapiens
cccttcccctgcgccctccct

SEQ ID NO: 4763330 - DNA, 22 bp, Homo sapiens
cccttcccctgcgccctccctc

SEQ ID NO: 4763331 - DNA, 13 bp, Homo sapiens
cccttcctgtcct

SEQ ID NO: 4763332 - DNA, 14 bp, Homo sapiens
cccttcctgtcctg

SEQ ID NO: 4763333 - DNA, 22 bp, Homo sapiens
cccttcggtattgttcaaagaa

SEQ ID NO: 4763334 - DNA, 20 bp, Homo sapiens
cccttctaggggcaggtgaa

SEQ ID NO: 4763335 - DNA, 17 bp, Homo sapiens
cccttctttccttcctt

SEQ ID NO: 4763336 - DNA, 23 bp, Homo sapiens
cccttcttttcctgggtgctcag

SEQ ID NO: 4763337 - DNA, 14 bp, Homo sapiens
cccttgaccccaca

SEQ ID NO: 4763338 - DNA, 15 bp, Homo sapiens
cccttgaccccacac

SEQ ID NO: 4763339 - DNA, 12 bp, Homo sapiens
cccttgactgtt

SEQ ID NO: 4763340 - DNA, 14 bp, Homo sapiens
cccttggcccctct

SEQ ID NO: 4763341 - DNA, 14 bp, Homo sapiens
cccttggctcctgt

SEQ ID NO: 4763342 - DNA, 18 bp, Homo sapiens
cccttggggagcaggctc

SEQ ID NO: 4763343 - DNA, 19 bp, Homo sapiens
cccttggggagcagtggcc

SEQ ID NO: 4763344 - DNA, 18 bp, Homo sapiens
ccctttcccaaacccttc

SEQ ID NO: 4763345 - DNA, 18 bp, Homo sapiens
ccctttccttgccttctt

SEQ ID NO: 4763346 - DNA, 14 bp, Homo sapiens
ccctttcgtccaca

SEQ ID NO: 4763347 - DNA, 23 bp, Homo sapiens
ccgaagaccttctgaagatctca

SEQ ID NO: 4763348 - DNA, 16 bp, Homo sapiens
ccgaagggcagccccg

SEQ ID NO: 4763349 - DNA, 14 bp, Homo sapiens
ccgacagtcaagac

SEQ ID NO: 4763350 - DNA, 12 bp, Homo sapiens
ccgacgcccctc

SEQ ID NO: 4763351 - DNA, 18 bp, Homo sapiens
ccgagatagccaaggcca

SEQ ID NO: 4763352 - DNA, 22 bp, Homo sapiens
ccgagatagccaaggccaaagg

SEQ ID NO: 4763353 - DNA, 13 bp, Homo sapiens
ccgagcccctgtt

SEQ ID NO: 4763354 - DNA, 18 bp, Homo sapiens
ccgagcgcgtgccttccc

SEQ ID NO: 4763355 - DNA, 19 bp, Homo sapiens
ccgagcgcgtgccttcccc

SEQ ID NO: 4763356 - DNA, 16 bp, Homo sapiens
ccgaggagccaggcaa

SEQ ID NO: 4763357 - DNA, 23 bp, Homo sapiens
ccgaggcagcaacaggaccagga

SEQ ID NO: 4763358 - DNA, 15 bp, Homo sapiens
ccgaggcctgcgccc

SEQ ID NO: 4763359 - DNA, 16 bp, Homo sapiens
ccgaggcctggctctg

SEQ ID NO: 4763360 - DNA, 22 bp, Homo sapiens
ccgaggcctggctctggagccc

SEQ ID NO: 4763361 - DNA, 12 bp, Homo sapiens
ccgagggaaatg

SEQ ID NO: 4763362 - DNA, 16 bp, Homo sapiens
ccgagggcgcctgggt

SEQ ID NO: 4763363 - DNA, 16 bp, Homo sapiens
ccgatataagccatag

SEQ ID NO: 4763364 - DNA, 16 bp, Homo sapiens
ccgatgtccctgtccc

SEQ ID NO: 4763365 - DNA, 18 bp, Homo sapiens
ccgatgtccctgtcccct

SEQ ID NO: 4763366 - DNA, 12 bp, Homo sapiens
ccgattagaagg

SEQ ID NO: 4763367 - DNA, 23 bp, Homo sapiens
ccgcacaccctcactctgccagg

SEQ ID NO: 4763368 - DNA, 12 bp, Homo sapiens
ccgcacagcagc

SEQ ID NO: 4763369 - DNA, 13 bp, Homo sapiens
ccgcacagcagcc

SEQ ID NO: 4763370 - DNA, 15 bp, Homo sapiens
ccgcacagcagcctg

SEQ ID NO: 4763371 - DNA, 16 bp, Homo sapiens
ccgcacagcagcctgc

SEQ ID NO: 4763372 - DNA, 20 bp, Homo sapiens
ccgcaccccgatgtggacct

SEQ ID NO: 4763373 - DNA, 21 bp, Homo sapiens
ccgcacgcggccgctctccgc

SEQ ID NO: 4763374 - DNA, 19 bp, Homo sapiens
ccgcactcaggagcacagc

SEQ ID NO: 4763375 - DNA, 21 bp, Homo sapiens
ccgcactcaggagcacagcca

SEQ ID NO: 4763376 - DNA, 22 bp, Homo sapiens
ccgcactcaggagcacagccat

SEQ ID NO: 4763377 - DNA, 21 bp, Homo sapiens
ccgcagaggtggggtgctggg

SEQ ID NO: 4763378 - DNA, 12 bp, Homo sapiens
ccgcagcaccag

SEQ ID NO: 4763379 - DNA, 18 bp, Homo sapiens
ccgcagcaccagcctgag

SEQ ID NO: 4763380 - DNA, 21 bp, Homo sapiens
ccgcagcaccagcctgagcca

SEQ ID NO: 4763381 - DNA, 20 bp, Homo sapiens
ccgcagcgggcgcgggacag

SEQ ID NO: 4763382 - DNA, 21 bp, Homo sapiens
ccgcagcgggcgcgggacagg

SEQ ID NO: 4763383 - DNA, 22 bp, Homo sapiens
ccgcagcgggcgcgggacagga

SEQ ID NO: 4763384 - DNA, 22 bp, Homo sapiens
ccgcaggcttcgtttgcctcca

SEQ ID NO: 4763385 - DNA, 13 bp, Homo sapiens
ccgcattccaggg

SEQ ID NO: 4763386 - DNA, 17 bp, Homo sapiens
ccgccagagtgtcctgc

SEQ ID NO: 4763387 - DNA, 13 bp, Homo sapiens
ccgccattggcct

SEQ ID NO: 4763388 - DNA, 15 bp, Homo sapiens
ccgccattggcctta

SEQ ID NO: 4763389 - DNA, 15 bp, Homo sapiens
ccgcccacccacacc

SEQ ID NO: 4763390 - DNA, 14 bp, Homo sapiens
ccgcccacccagca

SEQ ID NO: 4763391 - DNA, 17 bp, Homo sapiens
ccgcccacccagcagcg

SEQ ID NO: 4763392 - DNA, 12 bp, Homo sapiens
ccgcccacctgg

SEQ ID NO: 4763393 - DNA, 10 bp, Homo sapiens
ccgccccaga

SEQ ID NO: 4763394 - DNA, 20 bp, Homo sapiens
ccgccccagagactgcccac

SEQ ID NO: 4763395 - DNA, 21 bp, Homo sapiens
ccgccccagagactgcccacc

SEQ ID NO: 4763396 - DNA, 22 bp, Homo sapiens
ccgccccagagactgcccaccc

SEQ ID NO: 4763397 - DNA, 12 bp, Homo sapiens
ccgccccaggca

SEQ ID NO: 4763398 - DNA, 13 bp, Homo sapiens
ccgccccaggcac

SEQ ID NO: 4763399 - DNA, 18 bp, Homo sapiens
ccgccccaggcaccgcca

SEQ ID NO: 4763400 - DNA, 13 bp, Homo sapiens
ccgcccccacccc

SEQ ID NO: 4763401 - DNA, 17 bp, Homo sapiens
ccgcccccacccctaca

SEQ ID NO: 4763402 - DNA, 20 bp, Homo sapiens
ccgccccgtgctcctctgcc

SEQ ID NO: 4763403 - DNA, 12 bp, Homo sapiens
ccgcccgccccc

SEQ ID NO: 4763404 - DNA, 15 bp, Homo sapiens
ccgcccgccctcctc

SEQ ID NO: 4763405 - DNA, 14 bp, Homo sapiens
ccgccctcctctgc

SEQ ID NO: 4763406 - DNA, 15 bp, Homo sapiens
ccgccctcctctgcc

SEQ ID NO: 4763407 - DNA, 13 bp, Homo sapiens
ccgccctcgctcc

SEQ ID NO: 4763408 - DNA, 18 bp, Homo sapiens
ccgcccttccctgacact

SEQ ID NO: 4763409 - DNA, 16 bp, Homo sapiens
ccgccgaagggcagcc

SEQ ID NO: 4763410 - DNA, 14 bp, Homo sapiens
ccgccgcctccctc

SEQ ID NO: 4763411 - DNA, 22 bp, Homo sapiens
ccgccggaatgaatgagcattc

SEQ ID NO: 4763412 - DNA, 22 bp, Homo sapiens
ccgccggttggccggctggccg

SEQ ID NO: 4763413 - DNA, 13 bp, Homo sapiens
ccgcctcactggg

SEQ ID NO: 4763414 - DNA, 18 bp, Homo sapiens
ccgcctcagcctcccaaa

SEQ ID NO: 4763415 - DNA, 21 bp, Homo sapiens
ccgcctcccggggtgcccgtg

SEQ ID NO: 4763416 - DNA, 11 bp, Homo sapiens
ccgcctcctcc

SEQ ID NO: 4763417 - DNA, 14 bp, Homo sapiens
ccgcctcctccaga

SEQ ID NO: 4763418 - DNA, 15 bp, Homo sapiens
ccgcctcctccagac

SEQ ID NO: 4763419 - DNA, 13 bp, Homo sapiens
ccgcctgcgcccc

SEQ ID NO: 4763420 - DNA, 12 bp, Homo sapiens
ccgccttccttg

SEQ ID NO: 4763421 - DNA, 22 bp, Homo sapiens
ccgccttccttgaccttcctct

SEQ ID NO: 4763422 - DNA, 14 bp, Homo sapiens
ccgcgaccacccct

SEQ ID NO: 4763423 - DNA, 14 bp, Homo sapiens
ccgcgcccctctgc

SEQ ID NO: 4763424 - DNA, 15 bp, Homo sapiens
ccgcgcccctctgcg

SEQ ID NO: 4763425 - DNA, 16 bp, Homo sapiens
ccgcgcccctctgcgc

SEQ ID NO: 4763426 - DNA, 12 bp, Homo sapiens
ccgcgcccgccg

SEQ ID NO: 4763427 - DNA, 16 bp, Homo sapiens
ccgcgcccgccgcctc

SEQ ID NO: 4763428 - DNA, 14 bp, Homo sapiens
ccgcgctctgcccc

SEQ ID NO: 4763429 - DNA, 15 bp, Homo sapiens
ccgcgctctgcccct

SEQ ID NO: 4763430 - DNA, 16 bp, Homo sapiens
ccgcggagcccccgcc

SEQ ID NO: 4763431 - DNA, 18 bp, Homo sapiens
ccgcggaggcccctgagg

SEQ ID NO: 4763432 - DNA, 19 bp, Homo sapiens
ccgcgggcgagaagggcgc

SEQ ID NO: 4763433 - DNA, 19 bp, Homo sapiens
ccgcgggtggctggagccc

SEQ ID NO: 4763434 - DNA, 20 bp, Homo sapiens
ccgcgggtggctggagcccc

SEQ ID NO: 4763435 - DNA, 14 bp, Homo sapiens
ccgcgtcctttcct

SEQ ID NO: 4763436 - DNA, 13 bp, Homo sapiens
ccgctgcaccacg

SEQ ID NO: 4763437 - DNA, 21 bp, Homo sapiens
ccgctgcagtcagcacagaga

SEQ ID NO: 4763438 - DNA, 15 bp, Homo sapiens
ccgctgccgctgcac

SEQ ID NO: 4763439 - DNA, 13 bp, Homo sapiens
ccgctgcctggcg

SEQ ID NO: 4763440 - DNA, 19 bp, Homo sapiens
ccgctgcctggcgggcagc

SEQ ID NO: 4763441 - DNA, 22 bp, Homo sapiens
ccgctgcctggcgggcagcccc

SEQ ID NO: 4763442 - DNA, 23 bp, Homo sapiens
ccgctgcctggcgggcagcccct

SEQ ID NO: 4763443 - DNA, 16 bp, Homo sapiens
ccgctgctctcccagg

SEQ ID NO: 4763444 - DNA, 21 bp, Homo sapiens
ccctcatctttcatcaatcat

SEQ ID NO: 4763445 - DNA, 16 bp, Homo sapiens
ccctccaagggatctg

SEQ ID NO: 4763446 - DNA, 13 bp, Homo sapiens
ccctccacacctc

SEQ ID NO: 4763447 - DNA, 15 bp, Homo sapiens
ccctccacaggagcc

SEQ ID NO: 4763448 - DNA, 13 bp, Homo sapiens
ccctcccccgcag

SEQ ID NO: 4763449 - DNA, 14 bp, Homo sapiens
ccctccctcctggc

SEQ ID NO: 4763450 - DNA, 16 bp, Homo sapiens
ccctccctcctgtgtt

SEQ ID NO: 4763451 - DNA, 13 bp, Homo sapiens
ccctccctgactc

SEQ ID NO: 4763452 - DNA, 12 bp, Homo sapiens
ccctccctgtcc

SEQ ID NO: 4763453 - DNA, 13 bp, Homo sapiens
ccctccctgtccc

SEQ ID NO: 4763454 - DNA, 21 bp, Homo sapiens
ccctccgaacgctgctccatg

SEQ ID NO: 4763455 - DNA, 15 bp, Homo sapiens
ccctccgccagccct

SEQ ID NO: 4763456 - DNA, 18 bp, Homo sapiens
ccctccgccagccctgtt

SEQ ID NO: 4763457 - DNA, 14 bp, Homo sapiens
ccctccgtccccag

SEQ ID NO: 4763458 - DNA, 13 bp, Homo sapiens
ccctcctctgccc

SEQ ID NO: 4763459 - DNA, 14 bp, Homo sapiens
ccctcctctgcccc

SEQ ID NO: 4763460 - DNA, 18 bp, Homo sapiens
ccctcctctgccccctcc

SEQ ID NO: 4763461 - DNA, 11 bp, Homo sapiens
ccctcctgcac

SEQ ID NO: 4763462 - DNA, 15 bp, Homo sapiens
ccctcctggctcaca

SEQ ID NO: 4763463 - DNA, 15 bp, Homo sapiens
ccctccttctcccct

SEQ ID NO: 4763464 - DNA, 19 bp, Homo sapiens
ccctccttctcccctccag

SEQ ID NO: 4763465 - DNA, 21 bp, Homo sapiens
ccctccttctcccctccagac

SEQ ID NO: 4763466 - DNA, 20 bp, Homo sapiens
ccctcgagctctgtagcctg

SEQ ID NO: 4763467 - DNA, 21 bp, Homo sapiens
ccctcgagctctgtagcctgg

SEQ ID NO: 4763468 - DNA, 23 bp, Homo sapiens
ccctcgagctctgtagcctggtc

SEQ ID NO: 4763469 - DNA, 13 bp, Homo sapiens
ccctcgcgcccct

SEQ ID NO: 4763470 - DNA, 17 bp, Homo sapiens
ccctcgcgcccctgtcc

SEQ ID NO: 4763471 - DNA, 14 bp, Homo sapiens
ccctcgctgccacc

SEQ ID NO: 4763472 - DNA, 17 bp, Homo sapiens
ccctcgctgccacccac

SEQ ID NO: 4763473 - DNA, 20 bp, Homo sapiens
ccctcggtcagcaccgtggt

SEQ ID NO: 4763474 - DNA, 20 bp, Homo sapiens
ccctctcctgagcctgtctc

SEQ ID NO: 4763475 - DNA, 21 bp, Homo sapiens
ccctctcctgagcctgtctct

SEQ ID NO: 4763476 - DNA, 18 bp, Homo sapiens
ccctctcctgcatccctc

SEQ ID NO: 4763477 - DNA, 12 bp, Homo sapiens
ccctctctgcag

SEQ ID NO: 4763478 - DNA, 22 bp, Homo sapiens
ccctctctgtttaccctccctg

SEQ ID NO: 4763479 - DNA, 12 bp, Homo sapiens
ccctctgccact

SEQ ID NO: 4763480 - DNA, 15 bp, Homo sapiens
ccctctgcgccccag

SEQ ID NO: 4763481 - DNA, 17 bp, Homo sapiens
ccctctgcgccccagcg

SEQ ID NO: 4763482 - DNA, 13 bp, Homo sapiens
ccctctgctgctt

SEQ ID NO: 4763483 - DNA, 12 bp, Homo sapiens
ccctctggggct

SEQ ID NO: 4763484 - DNA, 16 bp, Homo sapiens
ccctctggggctgttc

SEQ ID NO: 4763485 - DNA, 23 bp, Homo sapiens
ccctctgtccttcccccagcaca

SEQ ID NO: 4763486 - DNA, 11 bp, Homo sapiens
ccctcttcaat

SEQ ID NO: 4763487 - DNA, 15 bp, Homo sapiens
ccctctttctctctg

SEQ ID NO: 4763488 - DNA, 17 bp, Homo sapiens
ccctctttctctctgtg

SEQ ID NO: 4763489 - DNA, 21 bp, Homo sapiens
ccctgaaatattttctacttt

SEQ ID NO: 4763490 - DNA, 17 bp, Homo sapiens
ccctgaatcagaggcag

SEQ ID NO: 4763491 - DNA, 13 bp, Homo sapiens
ccctgacactgtc

SEQ ID NO: 4763492 - DNA, 23 bp, Homo sapiens
ccctgacaggccttcctcctctc

SEQ ID NO: 4763493 - DNA, 13 bp, Homo sapiens
ccctgacttccca

SEQ ID NO: 4763494 - DNA, 17 bp, Homo sapiens
ccctgacttcccagctg

SEQ ID NO: 4763495 - DNA, 21 bp, Homo sapiens
ccctgacttcccagctggcag

SEQ ID NO: 4763496 - DNA, 16 bp, Homo sapiens
ccctgaggagtgatgg

SEQ ID NO: 4763497 - DNA, 15 bp, Homo sapiens
ccctgcaaggcccac

SEQ ID NO: 4763498 - DNA, 23 bp, Homo sapiens
ccctgcaatgtatcccttctcac

SEQ ID NO: 4763499 - DNA, 13 bp, Homo sapiens
ccctgcacccacc

SEQ ID NO: 4763500 - DNA, 15 bp, Homo sapiens
ccctgcacccacccc

SEQ ID NO: 4763501 - DNA, 17 bp, Homo sapiens
ccctgcacccacccctg

SEQ ID NO: 4763502 - DNA, 20 bp, Homo sapiens
ccctgcacccacccctgccc

SEQ ID NO: 4763503 - DNA, 16 bp, Homo sapiens
ccctgcacctgcttct

SEQ ID NO: 4763504 - DNA, 19 bp, Homo sapiens
ccctgcaccttgggcacgg

SEQ ID NO: 4763505 - DNA, 13 bp, Homo sapiens
ccctgcagtgttc

SEQ ID NO: 4763506 - DNA, 21 bp, Homo sapiens
ccctgcagtgttcgcttggct

SEQ ID NO: 4763507 - DNA, 17 bp, Homo sapiens
ccctgcatcccttggcc

SEQ ID NO: 4763508 - DNA, 20 bp, Homo sapiens
ccctgcatggctgagagggt

SEQ ID NO: 4763509 - DNA, 12 bp, Homo sapiens
ccctgccaccct

SEQ ID NO: 4763510 - DNA, 17 bp, Homo sapiens
ccctgccaccctctgct

SEQ ID NO: 4763511 - DNA, 15 bp, Homo sapiens
ccctgcccagcacct

SEQ ID NO: 4763512 - DNA, 21 bp, Homo sapiens
ccctgcccagcacctcctccg

SEQ ID NO: 4763513 - DNA, 20 bp, Homo sapiens
ccctgcccaggcagtctttg

SEQ ID NO: 4763514 - DNA, 15 bp, Homo sapiens
ccctgcccaggccgg

SEQ ID NO: 4763515 - DNA, 12 bp, Homo sapiens
ccctgccctccc

SEQ ID NO: 4763516 - DNA, 17 bp, Homo sapiens
ccctgccctcccccacg

SEQ ID NO: 4763517 - DNA, 11 bp, Homo sapiens
ccctgccctcg

SEQ ID NO: 4763518 - DNA, 14 bp, Homo sapiens
ccctgccctcggcc

SEQ ID NO: 4763519 - DNA, 13 bp, Homo sapiens
ccctgccctggcc

SEQ ID NO: 4763520 - DNA, 17 bp, Homo sapiens
ccctgccctggcctacc

SEQ ID NO: 4763521 - DNA, 16 bp, Homo sapiens
ccctgcgcccctgccc

SEQ ID NO: 4763522 - DNA, 22 bp, Homo sapiens
ccctgcggggcggcatccgagc

SEQ ID NO: 4763523 - DNA, 16 bp, Homo sapiens
ccctgcgtctcctgcc

SEQ ID NO: 4763524 - DNA, 15 bp, Homo sapiens
ccctgctcaggcctc

SEQ ID NO: 4763525 - DNA, 17 bp, Homo sapiens
ccctgctcccggctctg

SEQ ID NO: 4763526 - DNA, 23 bp, Homo sapiens
ccctgctgggtgggaatgcgctc

SEQ ID NO: 4763527 - DNA, 20 bp, Homo sapiens
ccctggaactctatctgggc

SEQ ID NO: 4763528 - DNA, 22 bp, Homo sapiens
ccctggaactctatctgggcct

SEQ ID NO: 4763529 - DNA, 18 bp, Homo sapiens
ccctggaagttgtccttt

SEQ ID NO: 4763530 - DNA, 23 bp, Homo sapiens
ccctggaagttgtcctttctgat

SEQ ID NO: 4763531 - DNA, 16 bp, Homo sapiens
ccctggcagcccctgt

SEQ ID NO: 4763532 - DNA, 12 bp, Homo sapiens
ccctggccccag

SEQ ID NO: 4763533 - DNA, 17 bp, Homo sapiens
ccctggcccggtcccag

SEQ ID NO: 4763534 - DNA, 15 bp, Homo sapiens
ccctggcccttcctt

SEQ ID NO: 4763535 - DNA, 21 bp, Homo sapiens
ccctggcccttccttcaccca

SEQ ID NO: 4763536 - DNA, 19 bp, Homo sapiens
ccctggcctaccacagctg

SEQ ID NO: 4763537 - DNA, 19 bp, Homo sapiens
ccctgggatgggaccaggg

SEQ ID NO: 4763538 - DNA, 13 bp, Homo sapiens
ccctgggcctcag

SEQ ID NO: 4763539 - DNA, 13 bp, Homo sapiens
ccctgggcctccc

SEQ ID NO: 4763540 - DNA, 19 bp, Homo sapiens
ccctggggaggacccctgc

SEQ ID NO: 4763541 - DNA, 15 bp, Homo sapiens
ccctggggcctagac

SEQ ID NO: 4763542 - DNA, 17 bp, Homo sapiens
ccctgggggaggcttcc

SEQ ID NO: 4763543 - DNA, 19 bp, Homo sapiens
ccctgggggaggcttccag

SEQ ID NO: 4763544 - DNA, 21 bp, Homo sapiens
ccctgggggaggcttccagct

SEQ ID NO: 4763545 - DNA, 23 bp, Homo sapiens
ccctgggggaggcttccagctca

SEQ ID NO: 4763546 - DNA, 19 bp, Homo sapiens
ccctggggggcacagccag

SEQ ID NO: 4763547 - DNA, 20 bp, Homo sapiens
ccctggggggcacagccaga

SEQ ID NO: 4763548 - DNA, 23 bp, Homo sapiens
ccctggggtctctgagcagtggg

SEQ ID NO: 4763549 - DNA, 15 bp, Homo sapiens
ccctgggtgggccct

SEQ ID NO: 4763550 - DNA, 14 bp, Homo sapiens
ccctggtcctgcac

SEQ ID NO: 4763551 - DNA, 14 bp, Homo sapiens
ccctgtagccctgg

SEQ ID NO: 4763552 - DNA, 13 bp, Homo sapiens
ccctgtagctcct

SEQ ID NO: 4763553 - DNA, 20 bp, Homo sapiens
ccctgtccatccgtctctgt

SEQ ID NO: 4763554 - DNA, 22 bp, Homo sapiens
ccctgtccatccgtctctgtcc

SEQ ID NO: 4763555 - DNA, 15 bp, Homo sapiens
ccctgtctgcaggcc

SEQ ID NO: 4763556 - DNA, 19 bp, Homo sapiens
ccctgtctgtctgtctctc

SEQ ID NO: 4763557 - DNA, 14 bp, Homo sapiens
ccctgtgccctctc

SEQ ID NO: 4763558 - DNA, 15 bp, Homo sapiens
ccctgtgccctctca

SEQ ID NO: 4763559 - DNA, 16 bp, Homo sapiens
ccctgtgccctctcac

SEQ ID NO: 4763560 - DNA, 15 bp, Homo sapiens
ccctgtgggagtcca

SEQ ID NO: 4763561 - DNA, 19 bp, Homo sapiens
ccctgtgggggtggccatc

SEQ ID NO: 4763562 - DNA, 23 bp, Homo sapiens
ccctgtgggggtggccatccctg

SEQ ID NO: 4763563 - DNA, 24 bp, Homo sapiens
ccctgtgggggtggccatccctgg

SEQ ID NO: 4763564 - DNA, 12 bp, Homo sapiens
ccctgtggtctg

SEQ ID NO: 4763565 - DNA, 15 bp, Homo sapiens
ccctgtggtctgtgt

SEQ ID NO: 4763566 - DNA, 20 bp, Homo sapiens
ccctgtggtctgtgtgtgac

SEQ ID NO: 4763567 - DNA, 13 bp, Homo sapiens
ccctgttctggca

SEQ ID NO: 4763568 - DNA, 17 bp, Homo sapiens
ccctgttgacctaccct

SEQ ID NO: 4763569 - DNA, 22 bp, Homo sapiens
ccctgttgacctaccctggacc

SEQ ID NO: 4763570 - DNA, 14 bp, Homo sapiens
cccctgcatggctg

SEQ ID NO: 4763571 - DNA, 13 bp, Homo sapiens
cccctgcccagca

SEQ ID NO: 4763572 - DNA, 17 bp, Homo sapiens
cccctgcccagcacctc

SEQ ID NO: 4763573 - DNA, 12 bp, Homo sapiens
cccctgccccag

SEQ ID NO: 4763574 - DNA, 15 bp, Homo sapiens
cccctgccccagaga

SEQ ID NO: 4763575 - DNA, 13 bp, Homo sapiens
cccctgcctgaga

SEQ ID NO: 4763576 - DNA, 14 bp, Homo sapiens
cccctgcgccctcc

SEQ ID NO: 4763577 - DNA, 17 bp, Homo sapiens
cccctgcgccctccctc

SEQ ID NO: 4763578 - DNA, 22 bp, Homo sapiens
cccctgcttctcccgccattgg

SEQ ID NO: 4763579 - DNA, 16 bp, Homo sapiens
cccctggcatgtttca

SEQ ID NO: 4763580 - DNA, 16 bp, Homo sapiens
cccctggcccttcctt

SEQ ID NO: 4763581 - DNA, 17 bp, Homo sapiens
cccctggcccttccttc

SEQ ID NO: 4763582 - DNA, 21 bp, Homo sapiens
cccctggcccttccttcaccc

SEQ ID NO: 4763583 - DNA, 15 bp, Homo sapiens
cccctggggcctaga

SEQ ID NO: 4763584 - DNA, 19 bp, Homo sapiens
cccctgggggaggcttcca

SEQ ID NO: 4763585 - DNA, 22 bp, Homo sapiens
cccctgggggaggcttccagct

SEQ ID NO: 4763586 - DNA, 15 bp, Homo sapiens
cccctggggggcaca

SEQ ID NO: 4763587 - DNA, 18 bp, Homo sapiens
cccctggggggcacagcc

SEQ ID NO: 4763588 - DNA, 19 bp, Homo sapiens
cccctggggggcacagcca

SEQ ID NO: 4763589 - DNA, 14 bp, Homo sapiens
cccctgtggtctgt

SEQ ID NO: 4763590 - DNA, 20 bp, Homo sapiens
cccctgttctggcagagttg

SEQ ID NO: 4763591 - DNA, 17 bp, Homo sapiens
cccctgtttctcctcca

SEQ ID NO: 4763592 - DNA, 13 bp, Homo sapiens
ccccttcccaccc

SEQ ID NO: 4763593 - DNA, 16 bp, Homo sapiens
ccccttgaccccacac

SEQ ID NO: 4763594 - DNA, 22 bp, Homo sapiens
ccccttgccacatcgcagcccc

SEQ ID NO: 4763595 - DNA, 18 bp, Homo sapiens
ccccttggggagcagtgg

SEQ ID NO: 4763596 - DNA, 14 bp, Homo sapiens
cccgacactctcac

SEQ ID NO: 4763597 - DNA, 19 bp, Homo sapiens
cccgaggcagcaacaggac

SEQ ID NO: 4763598 - DNA, 12 bp, Homo sapiens
cccgaggccagg

SEQ ID NO: 4763599 - DNA, 13 bp, Homo sapiens
cccgaggccaggg

SEQ ID NO: 4763600 - DNA, 14 bp, Homo sapiens
cccgaggccagggc

SEQ ID NO: 4763601 - DNA, 21 bp, Homo sapiens
cccgatgcgtggctcccagca

SEQ ID NO: 4763602 - DNA, 13 bp, Homo sapiens
cccgcacagcagc

SEQ ID NO: 4763603 - DNA, 21 bp, Homo sapiens
cccgcactcaggagcacagcc

SEQ ID NO: 4763604 - DNA, 16 bp, Homo sapiens
cccgcagacagacaga

SEQ ID NO: 4763605 - DNA, 17 bp, Homo sapiens
cccgcagaggtggggtg

SEQ ID NO: 4763606 - DNA, 13 bp, Homo sapiens
cccgcagcaccag

SEQ ID NO: 4763607 - DNA, 17 bp, Homo sapiens
cccgcagcaccagcctg

SEQ ID NO: 4763608 - DNA, 17 bp, Homo sapiens
cccgcatgctgcctgcc

SEQ ID NO: 4763609 - DNA, 19 bp, Homo sapiens
cccgcatgctgcctgcctc

SEQ ID NO: 4763610 - DNA, 17 bp, Homo sapiens
cccgcccaccccgctgc

SEQ ID NO: 4763611 - DNA, 12 bp, Homo sapiens
cccgcccacctg

SEQ ID NO: 4763612 - DNA, 13 bp, Homo sapiens
cccgcccacctgg

SEQ ID NO: 4763613 - DNA, 12 bp, Homo sapiens
cccgccccagag

SEQ ID NO: 4763614 - DNA, 13 bp, Homo sapiens
cccgccccagaga

SEQ ID NO: 4763615 - DNA, 21 bp, Homo sapiens
cccgccccagagactgcccac

SEQ ID NO: 4763616 - DNA, 12 bp, Homo sapiens
cccgccccaggc

SEQ ID NO: 4763617 - DNA, 21 bp, Homo sapiens
cccgccccgctgctcccggtg

SEQ ID NO: 4763618 - DNA, 12 bp, Homo sapiens
cccgcccctccc

SEQ ID NO: 4763619 - DNA, 14 bp, Homo sapiens
cccgccctcctctg

SEQ ID NO: 4763620 - DNA, 15 bp, Homo sapiens
cccgccctcctctgc

SEQ ID NO: 4763621 - DNA, 16 bp, Homo sapiens
cccgccctcctctgcc

SEQ ID NO: 4763622 - DNA, 17 bp, Homo sapiens
cccgccctcctctgccc

SEQ ID NO: 4763623 - DNA, 21 bp, Homo sapiens
cccgccggttggccggctggc

SEQ ID NO: 4763624 - DNA, 13 bp, Homo sapiens
cccgcctcagcct

SEQ ID NO: 4763625 - DNA, 20 bp, Homo sapiens
cccgcctcccggggtgcccg

SEQ ID NO: 4763626 - DNA, 14 bp, Homo sapiens
cccgcgaccacccc

SEQ ID NO: 4763627 - DNA, 17 bp, Homo sapiens
cccgcgaccacccctgt

SEQ ID NO: 4763628 - DNA, 19 bp, Homo sapiens
cccgcgaccacccctgtgc

SEQ ID NO: 4763629 - DNA, 17 bp, Homo sapiens
cccgcgcgtgcccccag

SEQ ID NO: 4763630 - DNA, 19 bp, Homo sapiens
cccgcgcgtgcccccagcg

SEQ ID NO: 4763631 - DNA, 16 bp, Homo sapiens
cccgcggagcccccgc

SEQ ID NO: 4763632 - DNA, 22 bp, Homo sapiens
cccgcggagcccccgcccctcc

SEQ ID NO: 4763633 - DNA, 22 bp, Homo sapiens
cccgcggggacgtcgctgtccg

SEQ ID NO: 4763634 - DNA, 23 bp, Homo sapiens
cccgctcttcccaagtcctcgcc

SEQ ID NO: 4763635 - DNA, 20 bp, Homo sapiens
cccgctgtcagccattcctg

SEQ ID NO: 4763636 - DNA, 23 bp, Homo sapiens
cccggactgaccgaagggacggg

SEQ ID NO: 4763637 - DNA, 17 bp, Homo sapiens
cccggagctcaggccct

SEQ ID NO: 4763638 - DNA, 16 bp, Homo sapiens
cccggaggcgcccacc

SEQ ID NO: 4763639 - DNA, 18 bp, Homo sapiens
cccggaggcgcccacctg

SEQ ID NO: 4763640 - DNA, 22 bp, Homo sapiens
cccggatctccaggcccagcct

SEQ ID NO: 4763641 - DNA, 14 bp, Homo sapiens
cccggcaggccctg

SEQ ID NO: 4763642 - DNA, 16 bp, Homo sapiens
cccggcaggccctgca

SEQ ID NO: 4763643 - DNA, 17 bp, Homo sapiens
cccggcaggccctgcag

SEQ ID NO: 4763644 - DNA, 17 bp, Homo sapiens
cccggcccacgcagagc

SEQ ID NO: 4763645 - DNA, 18 bp, Homo sapiens
cccggcccacgcagagcc

SEQ ID NO: 4763646 - DNA, 13 bp, Homo sapiens
cccggccccgcgc

SEQ ID NO: 4763647 - DNA, 14 bp, Homo sapiens
cccggcctggcccc

SEQ ID NO: 4763648 - DNA, 20 bp, Homo sapiens
cccggctcggcctcttgaga

SEQ ID NO: 4763649 - DNA, 15 bp, Homo sapiens
cccgggaaaggccgg

SEQ ID NO: 4763650 - DNA, 18 bp, Homo sapiens
cccgggcactgtcatgcc

SEQ ID NO: 4763651 - DNA, 19 bp, Homo sapiens
cccgggcactgtcatgccc

SEQ ID NO: 4763652 - DNA, 22 bp, Homo sapiens
cccgggcactgtcatgcccagc

SEQ ID NO: 4763653 - DNA, 17 bp, Homo sapiens
cccgggggtccccggac

SEQ ID NO: 4763654 - DNA, 13 bp, Homo sapiens
cccggggtgcccg

SEQ ID NO: 4763655 - DNA, 23 bp, Homo sapiens
cccgggtactcagtcagcccagt

SEQ ID NO: 4763656 - DNA, 17 bp, Homo sapiens
cccggtgtatgcagtgg

SEQ ID NO: 4763657 - DNA, 17 bp, Homo sapiens
cccgtccgtccgcccgc

SEQ ID NO: 4763658 - DNA, 14 bp, Homo sapiens
cccgtctgattgtt

SEQ ID NO: 4763659 - DNA, 21 bp, Homo sapiens
cccgtctgattgttcctcccc

SEQ ID NO: 4763660 - DNA, 12 bp, Homo sapiens
cccgtctgcccc

SEQ ID NO: 4763661 - DNA, 13 bp, Homo sapiens
cccgtctgcccct

SEQ ID NO: 4763662 - DNA, 16 bp, Homo sapiens
cccgtgcgcagccgcg

SEQ ID NO: 4763663 - DNA, 20 bp, Homo sapiens
cccgtgcggcccgtgcgcag

SEQ ID NO: 4763664 - DNA, 17 bp, Homo sapiens
cccgtgctcctctgccc

SEQ ID NO: 4763665 - DNA, 17 bp, Homo sapiens
cccgtgtggcctgggtc

SEQ ID NO: 4763666 - DNA, 23 bp, Homo sapiens
cccgttgtgtgggtttactctgt

SEQ ID NO: 4763667 - DNA, 16 bp, Homo sapiens
cccgttgttgtccctg

SEQ ID NO: 4763668 - DNA, 20 bp, Homo sapiens
ccctaattctcttcgctgtg

SEQ ID NO: 4763669 - DNA, 14 bp, Homo sapiens
ccctacagcctgca

SEQ ID NO: 4763670 - DNA, 19 bp, Homo sapiens
ccctacagcctgcacacac

SEQ ID NO: 4763671 - DNA, 20 bp, Homo sapiens
ccctacagcctgcacacacc

SEQ ID NO: 4763672 - DNA, 21 bp, Homo sapiens
ccctacagcctgcacacacct

SEQ ID NO: 4763673 - DNA, 19 bp, Homo sapiens
ccctacagtatataagctt

SEQ ID NO: 4763674 - DNA, 14 bp, Homo sapiens
ccctaccctcttct

SEQ ID NO: 4763675 - DNA, 19 bp, Homo sapiens
ccctaggcatactctccag

SEQ ID NO: 4763676 - DNA, 16 bp, Homo sapiens
ccctaggtctccaccc

SEQ ID NO: 4763677 - DNA, 20 bp, Homo sapiens
ccctaggtctccacccctca

SEQ ID NO: 4763678 - DNA, 21 bp, Homo sapiens
ccctaggtctccacccctcaa

SEQ ID NO: 4763679 - DNA, 16 bp, Homo sapiens
ccctagtgatttttgg

SEQ ID NO: 4763680 - DNA, 13 bp, Homo sapiens
ccctagttctttg

SEQ ID NO: 4763681 - DNA, 21 bp, Homo sapiens
ccctataccctaggtctccac

SEQ ID NO: 4763682 - DNA, 17 bp, Homo sapiens
ccctatcctgcaccctc

SEQ ID NO: 4763683 - DNA, 19 bp, Homo sapiens
ccctatccttggcaccaaa

SEQ ID NO: 4763684 - DNA, 17 bp, Homo sapiens
ccctatctcttcctgtc

SEQ ID NO: 4763685 - DNA, 22 bp, Homo sapiens
ccctcaagccaggagaccctgt

SEQ ID NO: 4763686 - DNA, 23 bp, Homo sapiens
ccctcaagccaggagaccctgtc

SEQ ID NO: 4763687 - DNA, 16 bp, Homo sapiens
ccctcactctgccagg

SEQ ID NO: 4763688 - DNA, 17 bp, Homo sapiens
ccctcactctgccaggg

SEQ ID NO: 4763689 - DNA, 21 bp, Homo sapiens
ccctcactctgccagggcagt

SEQ ID NO: 4763690 - DNA, 17 bp, Homo sapiens
ccctcactctgtcagcc

SEQ ID NO: 4763691 - DNA, 20 bp, Homo sapiens
ccctcagaatattaagcaca

SEQ ID NO: 4763692 - DNA, 13 bp, Homo sapiens
ccctcagccctca

SEQ ID NO: 4763693 - DNA, 15 bp, Homo sapiens
ccctcagctctccct

SEQ ID NO: 4763694 - DNA, 21 bp, Homo sapiens
ccctcatcttgaagggcccag

SEQ ID NO: 4763695 - DNA, 20 bp, Homo sapiens
ccccacacgccggggctggc

SEQ ID NO: 4763696 - DNA, 22 bp, Homo sapiens
ccccacacgccggggctggccc

SEQ ID NO: 4763697 - DNA, 13 bp, Homo sapiens
ccccacagatcca

SEQ ID NO: 4763698 - DNA, 20 bp, Homo sapiens
ccccacaggagcgtgtccta

SEQ ID NO: 4763699 - DNA, 20 bp, Homo sapiens
ccccacccctacagcctgca

SEQ ID NO: 4763700 - DNA, 19 bp, Homo sapiens
ccccacctccctgcagctt

SEQ ID NO: 4763701 - DNA, 15 bp, Homo sapiens
ccccacgcttctgga

SEQ ID NO: 4763702 - DNA, 16 bp, Homo sapiens
ccccacggccgtccct

SEQ ID NO: 4763703 - DNA, 18 bp, Homo sapiens
ccccacggccgtccctga

SEQ ID NO: 4763704 - DNA, 13 bp, Homo sapiens
ccccactgaagaa

SEQ ID NO: 4763705 - DNA, 11 bp, Homo sapiens
ccccactggaa

SEQ ID NO: 4763706 - DNA, 21 bp, Homo sapiens
ccccagagactgcccaccctg

SEQ ID NO: 4763707 - DNA, 22 bp, Homo sapiens
ccccagagactgcccaccctgg

SEQ ID NO: 4763708 - DNA, 21 bp, Homo sapiens
ccccagaggtggatactgggg

SEQ ID NO: 4763709 - DNA, 17 bp, Homo sapiens
ccccagatacctgtgag

SEQ ID NO: 4763710 - DNA, 19 bp, Homo sapiens
ccccagatacctgtgagga

SEQ ID NO: 4763711 - DNA, 20 bp, Homo sapiens
ccccagatacctgtgaggac

SEQ ID NO: 4763712 - DNA, 17 bp, Homo sapiens
ccccagccccctggcat

SEQ ID NO: 4763713 - DNA, 10 bp, Homo sapiens
ccccagcctc

SEQ ID NO: 4763714 - DNA, 12 bp, Homo sapiens
ccccagcctccc

SEQ ID NO: 4763715 - DNA, 23 bp, Homo sapiens
ccccagcctcccccaggctgcgc

SEQ ID NO: 4763716 - DNA, 16 bp, Homo sapiens
ccccagctggctgggt

SEQ ID NO: 4763717 - DNA, 12 bp, Homo sapiens
ccccaggacccc

SEQ ID NO: 4763718 - DNA, 19 bp, Homo sapiens
ccccaggacccccccagtc

SEQ ID NO: 4763719 - DNA, 19 bp, Homo sapiens
ccccaggatgcatgcaggg

SEQ ID NO: 4763720 - DNA, 15 bp, Homo sapiens
ccccaggccctccct

SEQ ID NO: 4763721 - DNA, 21 bp, Homo sapiens
ccccaggcggaggggcttgga

SEQ ID NO: 4763722 - DNA, 14 bp, Homo sapiens
ccccaggctgcgcc

SEQ ID NO: 4763723 - DNA, 17 bp, Homo sapiens
ccccagggagggggtca

SEQ ID NO: 4763724 - DNA, 13 bp, Homo sapiens
ccccagggccctg

SEQ ID NO: 4763725 - DNA, 16 bp, Homo sapiens
ccccagggccctgctc

SEQ ID NO: 4763726 - DNA, 17 bp, Homo sapiens
ccccagggccctgctca

SEQ ID NO: 4763727 - DNA, 18 bp, Homo sapiens
ccccagggccctgctcag

SEQ ID NO: 4763728 - DNA, 20 bp, Homo sapiens
ccccaggggcactgtgttct

SEQ ID NO: 4763729 - DNA, 22 bp, Homo sapiens
ccccagggtgcaggcgcgcacc

SEQ ID NO: 4763730 - DNA, 14 bp, Homo sapiens
ccccagtccccggg

SEQ ID NO: 4763731 - DNA, 12 bp, Homo sapiens
ccccagtccgcc

SEQ ID NO: 4763732 - DNA, 17 bp, Homo sapiens
ccccagtccgccccgtg

SEQ ID NO: 4763733 - DNA, 16 bp, Homo sapiens
ccccagtgccagctgg

SEQ ID NO: 4763734 - DNA, 20 bp, Homo sapiens
ccccagttaatgtgccaaaa

SEQ ID NO: 4763735 - DNA, 14 bp, Homo sapiens
ccccatcgcctggg

SEQ ID NO: 4763736 - DNA, 19 bp, Homo sapiens
ccccatcgcctgggacgcc

SEQ ID NO: 4763737 - DNA, 21 bp, Homo sapiens
ccccatcgcctgggacgcccc

SEQ ID NO: 4763738 - DNA, 21 bp, Homo sapiens
ccccatcgccttctggctgct

SEQ ID NO: 4763739 - DNA, 19 bp, Homo sapiens
ccccatcgccttctgggga

SEQ ID NO: 4763740 - DNA, 14 bp, Homo sapiens
ccccatgccaccac

SEQ ID NO: 4763741 - DNA, 15 bp, Homo sapiens
ccccatgccctccct

SEQ ID NO: 4763742 - DNA, 18 bp, Homo sapiens
ccccatggaacagccctg

SEQ ID NO: 4763743 - DNA, 19 bp, Homo sapiens
ccccatggtgcagtgaaga

SEQ ID NO: 4763744 - DNA, 15 bp, Homo sapiens
ccccatgtccttgga

SEQ ID NO: 4763745 - DNA, 17 bp, Homo sapiens
ccccattgccttctggg

SEQ ID NO: 4763746 - DNA, 14 bp, Homo sapiens
cccccacagatcca

SEQ ID NO: 4763747 - DNA, 19 bp, Homo sapiens
cccccagcacaaagcactg

SEQ ID NO: 4763748 - DNA, 23 bp, Homo sapiens
cccccagcactaaggccgtgtct

SEQ ID NO: 4763749 - DNA, 22 bp, Homo sapiens
cccccagcctcccccaggctgc

SEQ ID NO: 4763750 - DNA, 21 bp, Homo sapiens
cccccagctcaggggcagctc

SEQ ID NO: 4763751 - DNA, 13 bp, Homo sapiens
cccccaggacccc

SEQ ID NO: 4763752 - DNA, 14 bp, Homo sapiens
cccccaggctgcgc

SEQ ID NO: 4763753 - DNA, 20 bp, Homo sapiens
cccccatgccaccacccacc

SEQ ID NO: 4763754 - DNA, 18 bp, Homo sapiens
cccccatgccctccctgc

SEQ ID NO: 4763755 - DNA, 19 bp, Homo sapiens
cccccatgccctccctgct

SEQ ID NO: 4763756 - DNA, 13 bp, Homo sapiens
cccccatgggctg

SEQ ID NO: 4763757 - DNA, 20 bp, Homo sapiens
cccccattgtgaatgttgtc

SEQ ID NO: 4763758 - DNA, 12 bp, Homo sapiens
ccccccagcact

SEQ ID NO: 4763759 - DNA, 12 bp, Homo sapiens
ccccccagctca

SEQ ID NO: 4763760 - DNA, 13 bp, Homo sapiens
ccccccagtccgc

SEQ ID NO: 4763761 - DNA, 11 bp, Homo sapiens
cccccctgtgg

SEQ ID NO: 4763762 - DNA, 18 bp, Homo sapiens
cccccgcccaggccatca

SEQ ID NO: 4763763 - DNA, 18 bp, Homo sapiens
cccccgccctcgctccgg

SEQ ID NO: 4763764 - DNA, 14 bp, Homo sapiens
cccccggaggcgcc

SEQ ID NO: 4763765 - DNA, 15 bp, Homo sapiens
cccccggaggcgccc

SEQ ID NO: 4763766 - DNA, 21 bp, Homo sapiens
cccccggaggcgcccacctgc

SEQ ID NO: 4763767 - DNA, 22 bp, Homo sapiens
cccccggcctggccccctcgcg

SEQ ID NO: 4763768 - DNA, 17 bp, Homo sapiens
ccccctacagatcctcc

SEQ ID NO: 4763769 - DNA, 11 bp, Homo sapiens
ccccctcagct

SEQ ID NO: 4763770 - DNA, 14 bp, Homo sapiens
ccccctcccccgca

SEQ ID NO: 4763771 - DNA, 13 bp, Homo sapiens
ccccctgcaccca

SEQ ID NO: 4763772 - DNA, 18 bp, Homo sapiens
ccccctgcttctcccgcc

SEQ ID NO: 4763773 - DNA, 23 bp, Homo sapiens
ccccctggggggcacagccagaa

SEQ ID NO: 4763774 - DNA, 18 bp, Homo sapiens
ccccctgtggtctgtgtg

SEQ ID NO: 4763775 - DNA, 21 bp, Homo sapiens
ccccgcccccacccctacagc

SEQ ID NO: 4763776 - DNA, 17 bp, Homo sapiens
ccccgccccgctgctcc

SEQ ID NO: 4763777 - DNA, 19 bp, Homo sapiens
ccccgcgcgtgcccccagc

SEQ ID NO: 4763778 - DNA, 13 bp, Homo sapiens
ccccgcggagccc

SEQ ID NO: 4763779 - DNA, 19 bp, Homo sapiens
ccccgcggagcccccgccc

SEQ ID NO: 4763780 - DNA, 23 bp, Homo sapiens
ccccgcggagcccccgcccctcc

SEQ ID NO: 4763781 - DNA, 18 bp, Homo sapiens
ccccgctcttcccaagtc

SEQ ID NO: 4763782 - DNA, 20 bp, Homo sapiens
ccccggagcaccacggggtc

SEQ ID NO: 4763783 - DNA, 16 bp, Homo sapiens
ccccggccgggagacc

SEQ ID NO: 4763784 - DNA, 17 bp, Homo sapiens
ccccggcctgatggcca

SEQ ID NO: 4763785 - DNA, 16 bp, Homo sapiens
ccccgggaaaggccgg

SEQ ID NO: 4763786 - DNA, 14 bp, Homo sapiens
ccccgtcaccccgc

SEQ ID NO: 4763787 - DNA, 18 bp, Homo sapiens
ccccgtcccggccccgcg

SEQ ID NO: 4763788 - DNA, 16 bp, Homo sapiens
ccccgtccctttccct

SEQ ID NO: 4763789 - DNA, 13 bp, Homo sapiens
ccccgtctgcccc

SEQ ID NO: 4763790 - DNA, 14 bp, Homo sapiens
ccccgtgcggcccg

SEQ ID NO: 4763791 - DNA, 13 bp, Homo sapiens
ccccgtgctcctc

SEQ ID NO: 4763792 - DNA, 17 bp, Homo sapiens
ccccgtgctcctctgcc

SEQ ID NO: 4763793 - DNA, 14 bp, Homo sapiens
ccccgttcccagcg

SEQ ID NO: 4763794 - DNA, 16 bp, Homo sapiens
ccccgttgttgtccct

SEQ ID NO: 4763795 - DNA, 15 bp, Homo sapiens
cccctacagatcctc

SEQ ID NO: 4763796 - DNA, 15 bp, Homo sapiens
cccctacagcctgca

SEQ ID NO: 4763797 - DNA, 14 bp, Homo sapiens
cccctaccctttcc

SEQ ID NO: 4763798 - DNA, 13 bp, Homo sapiens
cccctatcctgca

SEQ ID NO: 4763799 - DNA, 15 bp, Homo sapiens
cccctatcctgcacc

SEQ ID NO: 4763800 - DNA, 16 bp, Homo sapiens
cccctcagctctccct

SEQ ID NO: 4763801 - DNA, 19 bp, Homo sapiens
cccctcagctctccctcac

SEQ ID NO: 4763802 - DNA, 21 bp, Homo sapiens
cccctcagctctccctcacac

SEQ ID NO: 4763803 - DNA, 13 bp, Homo sapiens
cccctccagaccc

SEQ ID NO: 4763804 - DNA, 12 bp, Homo sapiens
cccctccccaag

SEQ ID NO: 4763805 - DNA, 12 bp, Homo sapiens
cccctccccatg

SEQ ID NO: 4763806 - DNA, 15 bp, Homo sapiens
cccctcccccgcaga

SEQ ID NO: 4763807 - DNA, 18 bp, Homo sapiens
cccctccgtccccagggt

SEQ ID NO: 4763808 - DNA, 13 bp, Homo sapiens
cccctccttctcc

SEQ ID NO: 4763809 - DNA, 16 bp, Homo sapiens
cccctccttctcccct

SEQ ID NO: 4763810 - DNA, 22 bp, Homo sapiens
cccctccttctcccctccagac

SEQ ID NO: 4763811 - DNA, 17 bp, Homo sapiens
cccctcgcgcccctgtc

SEQ ID NO: 4763812 - DNA, 13 bp, Homo sapiens
cccctctcatcac

SEQ ID NO: 4763813 - DNA, 22 bp, Homo sapiens
cccctctcctgagcctgtctct

SEQ ID NO: 4763814 - DNA, 13 bp, Homo sapiens
cccctctgcgccc

SEQ ID NO: 4763815 - DNA, 18 bp, Homo sapiens
cccctgaggacctttctg

SEQ ID NO: 4763816 - DNA, 23 bp, Homo sapiens
cccctgagggacgagcagagcgc

SEQ ID NO: 4763817 - DNA, 24 bp, Homo sapiens
cccctgagggacgagcagagcgca

SEQ ID NO: 4763818 - DNA, 12 bp, Homo sapiens
cccctgcaccca

SEQ ID NO: 4763819 - DNA, 16 bp, Homo sapiens
cccctgcacccacccc

SEQ ID NO: 4763820 - DNA, 22 bp, Homo sapiens
cccctgcacccacccctgccca

SEQ ID NO: 4763821 - DNA, 18 bp, Homo sapiens
cccacgcagagccccgga

SEQ ID NO: 4763822 - DNA, 19 bp, Homo sapiens
cccacgcagagccccggag

SEQ ID NO: 4763823 - DNA, 20 bp, Homo sapiens
cccacgcagagccccggagc

SEQ ID NO: 4763824 - DNA, 22 bp, Homo sapiens
cccacgcagagccccggagcac

SEQ ID NO: 4763825 - DNA, 15 bp, Homo sapiens
cccacgcttctggag

SEQ ID NO: 4763826 - DNA, 16 bp, Homo sapiens
cccacgcttctggagg

SEQ ID NO: 4763827 - DNA, 19 bp, Homo sapiens
cccacgcttctggaggtgg

SEQ ID NO: 4763828 - DNA, 13 bp, Homo sapiens
cccacggccgtcc

SEQ ID NO: 4763829 - DNA, 23 bp, Homo sapiens
cccacggccgtccctgacttccc

SEQ ID NO: 4763830 - DNA, 15 bp, Homo sapiens
cccacggctaagagg

SEQ ID NO: 4763831 - DNA, 19 bp, Homo sapiens
cccacggctaagaggctgc

SEQ ID NO: 4763832 - DNA, 18 bp, Homo sapiens
cccacgtcccgggcactg

SEQ ID NO: 4763833 - DNA, 15 bp, Homo sapiens
cccacgtcctgggtg

SEQ ID NO: 4763834 - DNA, 19 bp, Homo sapiens
cccactagccctctttctc

SEQ ID NO: 4763835 - DNA, 12 bp, Homo sapiens
cccactcccgtg

SEQ ID NO: 4763836 - DNA, 21 bp, Homo sapiens
cccactcgtgataagtcaaca

SEQ ID NO: 4763837 - DNA, 20 bp, Homo sapiens
cccactgatatcacgggccc

SEQ ID NO: 4763838 - DNA, 18 bp, Homo sapiens
cccacttccccatctgtg

SEQ ID NO: 4763839 - DNA, 21 bp, Homo sapiens
cccacttccccatctgtgtgt

SEQ ID NO: 4763840 - DNA, 21 bp, Homo sapiens
cccagaaccttgatggggtga

SEQ ID NO: 4763841 - DNA, 17 bp, Homo sapiens
cccagaacgcatgcagg

SEQ ID NO: 4763842 - DNA, 15 bp, Homo sapiens
cccagaacgggcctc

SEQ ID NO: 4763843 - DNA, 18 bp, Homo sapiens
cccagaacgggcctcccc

SEQ ID NO: 4763844 - DNA, 20 bp, Homo sapiens
cccagaagctcaaggctgca

SEQ ID NO: 4763845 - DNA, 17 bp, Homo sapiens
cccagagaagcctcagt

SEQ ID NO: 4763846 - DNA, 15 bp, Homo sapiens
cccagagagaccctg

SEQ ID NO: 4763847 - DNA, 15 bp, Homo sapiens
cccagaggctgagtt

SEQ ID NO: 4763848 - DNA, 18 bp, Homo sapiens
cccagaggtggatactgg

SEQ ID NO: 4763849 - DNA, 20 bp, Homo sapiens
cccagaggtggatactgggg

SEQ ID NO: 4763850 - DNA, 22 bp, Homo sapiens
cccagatacctgtgaggactgg

SEQ ID NO: 4763851 - DNA, 22 bp, Homo sapiens
cccagcacctcctccgtgggca

SEQ ID NO: 4763852 - DNA, 21 bp, Homo sapiens
cccagcactaaggccgtgtct

SEQ ID NO: 4763853 - DNA, 12 bp, Homo sapiens
cccagccagcag

SEQ ID NO: 4763854 - DNA, 12 bp, Homo sapiens
cccagccatggc

SEQ ID NO: 4763855 - DNA, 13 bp, Homo sapiens
cccagccatggct

SEQ ID NO: 4763856 - DNA, 20 bp, Homo sapiens
cccagccatggctggatgtg

SEQ ID NO: 4763857 - DNA, 20 bp, Homo sapiens
cccagcccccacccccgtca

SEQ ID NO: 4763858 - DNA, 15 bp, Homo sapiens
cccagccctgcccag

SEQ ID NO: 4763859 - DNA, 16 bp, Homo sapiens
cccagccctgcccaga

SEQ ID NO: 4763860 - DNA, 16 bp, Homo sapiens
cccagcctatctctct

SEQ ID NO: 4763861 - DNA, 19 bp, Homo sapiens
cccagcctcccccaggctg

SEQ ID NO: 4763862 - DNA, 20 bp, Homo sapiens
cccagcctcccccaggctgc

SEQ ID NO: 4763863 - DNA, 13 bp, Homo sapiens
cccagcctggccc

SEQ ID NO: 4763864 - DNA, 14 bp, Homo sapiens
cccagcctggcccc

SEQ ID NO: 4763865 - DNA, 15 bp, Homo sapiens
cccagcctggcccca

SEQ ID NO: 4763866 - DNA, 20 bp, Homo sapiens
cccagcgacgcggcccgcgg

SEQ ID NO: 4763867 - DNA, 17 bp, Homo sapiens
cccagctcaggggcagc

SEQ ID NO: 4763868 - DNA, 12 bp, Homo sapiens
cccagctggcag

SEQ ID NO: 4763869 - DNA, 16 bp, Homo sapiens
cccagctggcagcgcc

SEQ ID NO: 4763870 - DNA, 19 bp, Homo sapiens
cccagctggcagcgcctcc

SEQ ID NO: 4763871 - DNA, 12 bp, Homo sapiens
cccagctggctg

SEQ ID NO: 4763872 - DNA, 15 bp, Homo sapiens
cccagctggctgggt

SEQ ID NO: 4763873 - DNA, 16 bp, Homo sapiens
cccagctggctgggtc

SEQ ID NO: 4763874 - DNA, 23 bp, Homo sapiens
cccagctggctgggtcgcccctc

SEQ ID NO: 4763875 - DNA, 15 bp, Homo sapiens
cccaggaagtaattt

SEQ ID NO: 4763876 - DNA, 17 bp, Homo sapiens
cccaggaccctgggtca

SEQ ID NO: 4763877 - DNA, 13 bp, Homo sapiens
cccaggaggacct

SEQ ID NO: 4763878 - DNA, 19 bp, Homo sapiens
cccaggaggacctgggggg

SEQ ID NO: 4763879 - DNA, 14 bp, Homo sapiens
cccaggcaatagtg

SEQ ID NO: 4763880 - DNA, 22 bp, Homo sapiens
cccaggcaatagtgttgaggag

SEQ ID NO: 4763881 - DNA, 11 bp, Homo sapiens
cccaggcaggg

SEQ ID NO: 4763882 - DNA, 14 bp, Homo sapiens
cccaggcagtcttt

SEQ ID NO: 4763883 - DNA, 12 bp, Homo sapiens
cccaggcccgcc

SEQ ID NO: 4763884 - DNA, 16 bp, Homo sapiens
cccaggcccgccctgc

SEQ ID NO: 4763885 - DNA, 22 bp, Homo sapiens
cccaggccgaggaagggccccc

SEQ ID NO: 4763886 - DNA, 21 bp, Homo sapiens
cccaggccggccagcctcacc

SEQ ID NO: 4763887 - DNA, 15 bp, Homo sapiens
cccaggcggaggggc

SEQ ID NO: 4763888 - DNA, 18 bp, Homo sapiens
cccaggcggaggggcttg

SEQ ID NO: 4763889 - DNA, 19 bp, Homo sapiens
cccaggctcaggctgccca

SEQ ID NO: 4763890 - DNA, 13 bp, Homo sapiens
cccaggctgcgcc

SEQ ID NO: 4763891 - DNA, 16 bp, Homo sapiens
cccaggctgcgcctgc

SEQ ID NO: 4763892 - DNA, 19 bp, Homo sapiens
cccaggctgcgcctgcccg

SEQ ID NO: 4763893 - DNA, 21 bp, Homo sapiens
cccaggctgcgcctgcccgcc

SEQ ID NO: 4763894 - DNA, 15 bp, Homo sapiens
cccagggagggggtc

SEQ ID NO: 4763895 - DNA, 13 bp, Homo sapiens
cccagggcccgag

SEQ ID NO: 4763896 - DNA, 20 bp, Homo sapiens
cccagggccgcttctcctgc

SEQ ID NO: 4763897 - DNA, 18 bp, Homo sapiens
cccaggggcactgtgttc

SEQ ID NO: 4763898 - DNA, 15 bp, Homo sapiens
cccagggtcccctgc

SEQ ID NO: 4763899 - DNA, 17 bp, Homo sapiens
cccagtccggtgccttc

SEQ ID NO: 4763900 - DNA, 21 bp, Homo sapiens
cccagtccggtgccttccacc

SEQ ID NO: 4763901 - DNA, 16 bp, Homo sapiens
cccagtcttgagtggg

SEQ ID NO: 4763902 - DNA, 18 bp, Homo sapiens
cccagtgcaatctgtcca

SEQ ID NO: 4763903 - DNA, 21 bp, Homo sapiens
cccagtgcaatctgtccagac

SEQ ID NO: 4763904 - DNA, 22 bp, Homo sapiens
cccagtgcaatctgtccagaca

SEQ ID NO: 4763905 - DNA, 14 bp, Homo sapiens
cccagtgccagctg

SEQ ID NO: 4763906 - DNA, 15 bp, Homo sapiens
cccagtgccagctgg

SEQ ID NO: 4763907 - DNA, 17 bp, Homo sapiens
cccagtgccagctggtg

SEQ ID NO: 4763908 - DNA, 14 bp, Homo sapiens
cccagtgggacaga

SEQ ID NO: 4763909 - DNA, 16 bp, Homo sapiens
cccagtgtctggccca

SEQ ID NO: 4763910 - DNA, 20 bp, Homo sapiens
cccagtgtctggcccagcca

SEQ ID NO: 4763911 - DNA, 23 bp, Homo sapiens
cccagtgtctggcccagccatgg

SEQ ID NO: 4763912 - DNA, 14 bp, Homo sapiens
cccagttagcccgg

SEQ ID NO: 4763913 - DNA, 21 bp, Homo sapiens
cccataatgcttctttcctct

SEQ ID NO: 4763914 - DNA, 23 bp, Homo sapiens
cccatagaaacatgacactgacc

SEQ ID NO: 4763915 - DNA, 12 bp, Homo sapiens
cccatatataaa

SEQ ID NO: 4763916 - DNA, 18 bp, Homo sapiens
cccatatataaattatta

SEQ ID NO: 4763917 - DNA, 19 bp, Homo sapiens
cccatatataaattattac

SEQ ID NO: 4763918 - DNA, 22 bp, Homo sapiens
cccatccctccccttgccacat

SEQ ID NO: 4763919 - DNA, 16 bp, Homo sapiens
cccatcctcacacaga

SEQ ID NO: 4763920 - DNA, 22 bp, Homo sapiens
cccatcgcctgggacgcccctt

SEQ ID NO: 4763921 - DNA, 19 bp, Homo sapiens
cccatcggtgtccatttat

SEQ ID NO: 4763922 - DNA, 20 bp, Homo sapiens
cccatcggtgtccatttata

SEQ ID NO: 4763923 - DNA, 14 bp, Homo sapiens
cccatctctcctgc

SEQ ID NO: 4763924 - DNA, 20 bp, Homo sapiens
cccatgagcgtccaggtgat

SEQ ID NO: 4763925 - DNA, 21 bp, Homo sapiens
cccatgaggcttgtggccaca

SEQ ID NO: 4763926 - DNA, 18 bp, Homo sapiens
cccatgcaggcagcctgc

SEQ ID NO: 4763927 - DNA, 16 bp, Homo sapiens
cccatgcatggcctcc

SEQ ID NO: 4763928 - DNA, 19 bp, Homo sapiens
cccatgcatggcctcccag

SEQ ID NO: 4763929 - DNA, 20 bp, Homo sapiens
cccatgcatggcctcccagc

SEQ ID NO: 4763930 - DNA, 16 bp, Homo sapiens
cccatgccaatgtcca

SEQ ID NO: 4763931 - DNA, 17 bp, Homo sapiens
cccatgccaccacccac

SEQ ID NO: 4763932 - DNA, 16 bp, Homo sapiens
cccatggccccagctg

SEQ ID NO: 4763933 - DNA, 14 bp, Homo sapiens
cccatgggctgctg

SEQ ID NO: 4763934 - DNA, 17 bp, Homo sapiens
cccatggtaatgtaact

SEQ ID NO: 4763935 - DNA, 17 bp, Homo sapiens
cccatggtagactgtga

SEQ ID NO: 4763936 - DNA, 18 bp, Homo sapiens
cccatggtcacagacccc

SEQ ID NO: 4763937 - DNA, 14 bp, Homo sapiens
cccatgtcaatcaa

SEQ ID NO: 4763938 - DNA, 14 bp, Homo sapiens
cccattgccttctg

SEQ ID NO: 4763939 - DNA, 18 bp, Homo sapiens
cccattgtgaatgttgtc

SEQ ID NO: 4763940 - DNA, 18 bp, Homo sapiens
cccatttgtaatgtatct

SEQ ID NO: 4763941 - DNA, 16 bp, Homo sapiens
cccatttttgtaatat

SEQ ID NO: 4763942 - DNA, 13 bp, Homo sapiens
ccccaaggaagaa

SEQ ID NO: 4763943 - DNA, 13 bp, Homo sapiens
ccccaaggcactg

SEQ ID NO: 4763944 - DNA, 13 bp, Homo sapiens
ccccacacaggcc

SEQ ID NO: 4763945 - DNA, 14 bp, Homo sapiens
ccccacacaggcct

SEQ ID NO: 4763946 - DNA, 21 bp, Homo sapiens
catgaatacgtaaactgcgta

SEQ ID NO: 4763947 - DNA, 12 bp, Homo sapiens
catgacactgac

SEQ ID NO: 4763948 - DNA, 15 bp, Homo sapiens
catgacagtagcata

SEQ ID NO: 4763949 - DNA, 13 bp, Homo sapiens
catgacatccaca

SEQ ID NO: 4763950 - DNA, 18 bp, Homo sapiens
catgacatccacatgcac

SEQ ID NO: 4763951 - DNA, 13 bp, Homo sapiens
catgaccttacat

SEQ ID NO: 4763952 - DNA, 23 bp, Homo sapiens
catgaccttgacgtgtgtggtcc

SEQ ID NO: 4763953 - DNA, 13 bp, Homo sapiens
catgactgcattt

SEQ ID NO: 4763954 - DNA, 16 bp, Homo sapiens
catgactgcattttac

SEQ ID NO: 4763955 - DNA, 22 bp, Homo sapiens
catgactttcagattgtatctg

SEQ ID NO: 4763956 - DNA, 18 bp, Homo sapiens
catgagaactaaatagat

SEQ ID NO: 4763957 - DNA, 21 bp, Homo sapiens
catgagaatgtcatttgctaa

SEQ ID NO: 4763958 - DNA, 23 bp, Homo sapiens
catgagaatgtcatttgctaatg

SEQ ID NO: 4763959 - DNA, 18 bp, Homo sapiens
catgagcgtccaggtgat

SEQ ID NO: 4763960 - DNA, 16 bp, Homo sapiens
catgagctccctcgct

SEQ ID NO: 4763961 - DNA, 18 bp, Homo sapiens
catgagctccctcgctgt

SEQ ID NO: 4763962 - DNA, 22 bp, Homo sapiens
catgagctccctcgctgtatga

SEQ ID NO: 4763963 - DNA, 23 bp, Homo sapiens
catgaggaacaaggcaaggctgt

SEQ ID NO: 4763964 - DNA, 17 bp, Homo sapiens
catgaggcttgtggcca

SEQ ID NO: 4763965 - DNA, 18 bp, Homo sapiens
catgatataactttagaa

SEQ ID NO: 4763966 - DNA, 23 bp, Homo sapiens
catgatctgtatttaatggtttt

SEQ ID NO: 4763967 - DNA, 15 bp, Homo sapiens
catgatgctagttct

SEQ ID NO: 4763968 - DNA, 19 bp, Homo sapiens
catgatgctagttcttacg

SEQ ID NO: 4763969 - DNA, 18 bp, Homo sapiens
catgatgctcatgactta

SEQ ID NO: 4763970 - DNA, 16 bp, Homo sapiens
catgattagacaatgt

SEQ ID NO: 4763971 - DNA, 18 bp, Homo sapiens
catgattagacaatgtgg

SEQ ID NO: 4763972 - DNA, 20 bp, Homo sapiens
catgattagacaatgtggaa

SEQ ID NO: 4763973 - DNA, 21 bp, Homo sapiens
catgattggtttctaggcagt

SEQ ID NO: 4763974 - DNA, 17 bp, Homo sapiens
catgatttttgccctgc

SEQ ID NO: 4763975 - DNA, 16 bp, Homo sapiens
catgcaaagtcctttc

SEQ ID NO: 4763976 - DNA, 12 bp, Homo sapiens
catgcacatgta

SEQ ID NO: 4763977 - DNA, 16 bp, Homo sapiens
catgcacattcatcct

SEQ ID NO: 4763978 - DNA, 12 bp, Homo sapiens
catgcactgacc

SEQ ID NO: 4763979 - DNA, 14 bp, Homo sapiens
catgcactgaccct

SEQ ID NO: 4763980 - DNA, 19 bp, Homo sapiens
catgcactgacccttccag

SEQ ID NO: 4763981 - DNA, 22 bp, Homo sapiens
catgcactgacccttccagaca

SEQ ID NO: 4763982 - DNA, 23 bp, Homo sapiens
catgcagatctagccaggcctcc

SEQ ID NO: 4763983 - DNA, 18 bp, Homo sapiens
catgcaggcagcctgcag

SEQ ID NO: 4763984 - DNA, 19 bp, Homo sapiens
catgcagggcccccatgca

SEQ ID NO: 4763985 - DNA, 14 bp, Homo sapiens
catgcatggcctcc

SEQ ID NO: 4763986 - DNA, 17 bp, Homo sapiens
catgcatggcctcccag

SEQ ID NO: 4763987 - DNA, 20 bp, Homo sapiens
catgcatggcctcccagcca

SEQ ID NO: 4763988 - DNA, 14 bp, Homo sapiens
catgcattcagatc

SEQ ID NO: 4763989 - DNA, 17 bp, Homo sapiens
catgcattcagatctga

SEQ ID NO: 4763990 - DNA, 23 bp, Homo sapiens
catgcatttagcatgagttctgc

SEQ ID NO: 4763991 - DNA, 18 bp, Homo sapiens
catgccaatgtccaggtc

SEQ ID NO: 4763992 - DNA, 19 bp, Homo sapiens
catgccaccacccacccca

SEQ ID NO: 4763993 - DNA, 12 bp, Homo sapiens
catgcccagctt

SEQ ID NO: 4763994 - DNA, 19 bp, Homo sapiens
catgcccctcttagaagaa

SEQ ID NO: 4763995 - DNA, 11 bp, Homo sapiens
catgccctccc

SEQ ID NO: 4763996 - DNA, 19 bp, Homo sapiens
catgcctacattagtgaga

SEQ ID NO: 4763997 - DNA, 15 bp, Homo sapiens
catgcctctctcagg

SEQ ID NO: 4763998 - DNA, 22 bp, Homo sapiens
catgcctctgatatgggactga

SEQ ID NO: 4763999 - DNA, 23 bp, Homo sapiens
catgcctctgatatgggactgag

SEQ ID NO: 4764000 - DNA, 16 bp, Homo sapiens
catgcgctcctggctt

SEQ ID NO: 4764001 - DNA, 17 bp, Homo sapiens
catgcgggcttcctcct

SEQ ID NO: 4764002 - DNA, 14 bp, Homo sapiens
catgctcaatgaaa

SEQ ID NO: 4764003 - DNA, 20 bp, Homo sapiens
catgctcctcactgcccgca

SEQ ID NO: 4764004 - DNA, 19 bp, Homo sapiens
catgctctttcaccctgcc

SEQ ID NO: 4764005 - DNA, 21 bp, Homo sapiens
catgctctttcaccctgccac

SEQ ID NO: 4764006 - DNA, 16 bp, Homo sapiens
catgctgcctgccatg

SEQ ID NO: 4764007 - DNA, 14 bp, Homo sapiens
catgctgcctgcct

SEQ ID NO: 4764008 - DNA, 15 bp, Homo sapiens
catgctgcctgcctc

SEQ ID NO: 4764009 - DNA, 19 bp, Homo sapiens
catgctgcctgcctccggc

SEQ ID NO: 4764010 - DNA, 23 bp, Homo sapiens
catgctgcctgcctccggccctg

SEQ ID NO: 4764011 - DNA, 16 bp, Homo sapiens
catgctggccagcctg

SEQ ID NO: 4764012 - DNA, 15 bp, Homo sapiens
catgctgtcccttac

SEQ ID NO: 4764013 - DNA, 17 bp, Homo sapiens
catgctgtcccttacgt

SEQ ID NO: 4764014 - DNA, 20 bp, Homo sapiens
catgctgtcttagatcagga

SEQ ID NO: 4764015 - DNA, 15 bp, Homo sapiens
catgcttagagcatg

SEQ ID NO: 4764016 - DNA, 21 bp, Homo sapiens
catgcttattagcagctgggt

SEQ ID NO: 4764017 - DNA, 22 bp, Homo sapiens
catgcttattagcagctgggtt

SEQ ID NO: 4764018 - DNA, 15 bp, Homo sapiens
catggaaaaatgcca

SEQ ID NO: 4764019 - DNA, 16 bp, Homo sapiens
catggaaaaatgccat

SEQ ID NO: 4764020 - DNA, 21 bp, Homo sapiens
catggaaaaatgccatcaaat

SEQ ID NO: 4764021 - DNA, 15 bp, Homo sapiens
catggaacagccctg

SEQ ID NO: 4764022 - DNA, 17 bp, Homo sapiens
catggaacagccctgca

SEQ ID NO: 4764023 - DNA, 20 bp, Homo sapiens
catggaagtactataattta

SEQ ID NO: 4764024 - DNA, 20 bp, Homo sapiens
catggatgattcttttccca

SEQ ID NO: 4764025 - DNA, 14 bp, Homo sapiens
catggattgattaa

SEQ ID NO: 4764026 - DNA, 20 bp, Homo sapiens
catggatttattttttgtaa

SEQ ID NO: 4764027 - DNA, 23 bp, Homo sapiens
catggatttattttttgtaactc

SEQ ID NO: 4764028 - DNA, 19 bp, Homo sapiens
catggatttcctttgacct

SEQ ID NO: 4764029 - DNA, 13 bp, Homo sapiens
catggccaggagt

SEQ ID NO: 4764030 - DNA, 13 bp, Homo sapiens
catggccccagct

SEQ ID NO: 4764031 - DNA, 21 bp, Homo sapiens
catggccgcaacttcccaggc

SEQ ID NO: 4764032 - DNA, 18 bp, Homo sapiens
catggcctcccagccacc

SEQ ID NO: 4764033 - DNA, 17 bp, Homo sapiens
catggctgccaatggga

SEQ ID NO: 4764034 - DNA, 19 bp, Homo sapiens
catggctggatgtgcatct

SEQ ID NO: 4764035 - DNA, 23 bp, Homo sapiens
catggctggatgtgcatctggcc

SEQ ID NO: 4764036 - DNA, 17 bp, Homo sapiens
catggctgtcccctgca

SEQ ID NO: 4764037 - DNA, 21 bp, Homo sapiens
catgggaaaggaggcatgcct

SEQ ID NO: 4764038 - DNA, 14 bp, Homo sapiens
catgggaatgaatg

SEQ ID NO: 4764039 - DNA, 16 bp, Homo sapiens
catgggaatgaatgtc

SEQ ID NO: 4764040 - DNA, 18 bp, Homo sapiens
catgggaatgaatgtcag

SEQ ID NO: 4764041 - DNA, 15 bp, Homo sapiens
catgggagcaaatat

SEQ ID NO: 4764042 - DNA, 19 bp, Homo sapiens
catgggcattgctggactg

SEQ ID NO: 4764043 - DNA, 22 bp, Homo sapiens
catgggcattgctggactgatg

SEQ ID NO: 4764044 - DNA, 12 bp, Homo sapiens
catgggtggagg

SEQ ID NO: 4764045 - DNA, 17 bp, Homo sapiens
catggtagactgtgaca

SEQ ID NO: 4764046 - DNA, 16 bp, Homo sapiens
catggtcacagacccc

SEQ ID NO: 4764047 - DNA, 16 bp, Homo sapiens
catggtcccacttccc

SEQ ID NO: 4764048 - DNA, 20 bp, Homo sapiens
catggtgaactgaagcagag

SEQ ID NO: 4764049 - DNA, 17 bp, Homo sapiens
catggtgttcatgacaa

SEQ ID NO: 4764050 - DNA, 22 bp, Homo sapiens
catgtaaataccagactgcagg

SEQ ID NO: 4764051 - DNA, 23 bp, Homo sapiens
catgtaaataccagactgcaggt

SEQ ID NO: 4764052 - DNA, 14 bp, Homo sapiens
catgtaagaaataa

SEQ ID NO: 4764053 - DNA, 15 bp, Homo sapiens
catgtaagaaataag

SEQ ID NO: 4764054 - DNA, 15 bp, Homo sapiens
catgtaatattaaat

SEQ ID NO: 4764055 - DNA, 16 bp, Homo sapiens
catgtaatattaaatt

SEQ ID NO: 4764056 - DNA, 19 bp, Homo sapiens
catgtagcatataaatgtt

SEQ ID NO: 4764057 - DNA, 21 bp, Homo sapiens
catgtatagtgagtgtggctt

SEQ ID NO: 4764058 - DNA, 13 bp, Homo sapiens
catgtatgccatg

SEQ ID NO: 4764059 - DNA, 14 bp, Homo sapiens
catgtattctgttg

SEQ ID NO: 4764060 - DNA, 12 bp, Homo sapiens
catgtcaatcaa

SEQ ID NO: 4764061 - DNA, 21 bp, Homo sapiens
catgtcacatgacatccacat

SEQ ID NO: 4764062 - DNA, 15 bp, Homo sapiens
catgtcctatccctg

SEQ ID NO: 4764063 - DNA, 19 bp, Homo sapiens
catgtcggggcccctgcgt

SEQ ID NO: 4764064 - DNA, 13 bp, Homo sapiens
catgtctattgtc

SEQ ID NO: 4764065 - DNA, 21 bp, Homo sapiens
catgtctttctccaaagttat

SEQ ID NO: 4764066 - DNA, 22 bp, Homo sapiens
catgtctttggcttcagaattg

SEQ ID NO: 4764067 - DNA, 22 bp, Homo sapiens
catttttgagtaaaacttgtat

SEQ ID NO: 4764068 - DNA, 17 bp, Homo sapiens
ccaaaactgtattgaaa

SEQ ID NO: 4764069 - DNA, 13 bp, Homo sapiens
ccaaaaggcccct

SEQ ID NO: 4764070 - DNA, 14 bp, Homo sapiens
ccaaaaggcccctt

SEQ ID NO: 4764071 - DNA, 14 bp, Homo sapiens
ccaaaccaccttcc

SEQ ID NO: 4764072 - DNA, 20 bp, Homo sapiens
ccaaactcacctgcccctca

SEQ ID NO: 4764073 - DNA, 16 bp, Homo sapiens
ccaaagatgcagccgc

SEQ ID NO: 4764074 - DNA, 19 bp, Homo sapiens
ccaaagcagtgcatgctgt

SEQ ID NO: 4764075 - DNA, 23 bp, Homo sapiens
ccaaagcagtgcatgctgtccct

SEQ ID NO: 4764076 - DNA, 21 bp, Homo sapiens
cagctgtaccggccactgcaa

SEQ ID NO: 4764077 - DNA, 23 bp, Homo sapiens
cagctgtaccggccactgcaacc

SEQ ID NO: 4764078 - DNA, 18 bp, Homo sapiens
cagctgtattatcttaaa

SEQ ID NO: 4764079 - DNA, 15 bp, Homo sapiens
cagctgtcctgagct

SEQ ID NO: 4764080 - DNA, 21 bp, Homo sapiens
cagctgtcctgagctaacact

SEQ ID NO: 4764081 - DNA, 16 bp, Homo sapiens
cagctgtctgtggctt

SEQ ID NO: 4764082 - DNA, 17 bp, Homo sapiens
cagcttcccaacaatac

SEQ ID NO: 4764083 - DNA, 13 bp, Homo sapiens
cagcttccctgaa

SEQ ID NO: 4764084 - DNA, 15 bp, Homo sapiens
cagcttccctgaaca

SEQ ID NO: 4764085 - DNA, 19 bp, Homo sapiens
cagcttgaccgtgaggcca

SEQ ID NO: 4764086 - DNA, 20 bp, Homo sapiens
cagcttgaccgtgaggccag

SEQ ID NO: 4764087 - DNA, 18 bp, Homo sapiens
cagcttgatgctgtttct

SEQ ID NO: 4764088 - DNA, 14 bp, Homo sapiens
cagcttggagtgcc

SEQ ID NO: 4764089 - DNA, 18 bp, Homo sapiens
cagctttataataaactg

SEQ ID NO: 4764090 - DNA, 19 bp, Homo sapiens
cagctttataataaactgt

SEQ ID NO: 4764091 - DNA, 21 bp, Homo sapiens
cagctttataataaactgttt

SEQ ID NO: 4764092 - DNA, 21 bp, Homo sapiens
caggcttcgtttgcctccaga

SEQ ID NO: 4764093 - DNA, 11 bp, Homo sapiens
caggctttcta

SEQ ID NO: 4764094 - DNA, 14 bp, Homo sapiens
cagggaaccagagc

SEQ ID NO: 4764095 - DNA, 18 bp, Homo sapiens
cagggacagcctgcacag

SEQ ID NO: 4764096 - DNA, 19 bp, Homo sapiens
cagggacagcctgcacagt

SEQ ID NO: 4764097 - DNA, 15 bp, Homo sapiens
cagggacagttgggt

SEQ ID NO: 4764098 - DNA, 14 bp, Homo sapiens
cagggaccaaggag

SEQ ID NO: 4764099 - DNA, 15 bp, Homo sapiens
cagggaccaaggaga

SEQ ID NO: 4764100 - DNA, 19 bp, Homo sapiens
cagggaccaaggagatggg

SEQ ID NO: 4764101 - DNA, 18 bp, Homo sapiens
cagggagggaaacccggg

SEQ ID NO: 4764102 - DNA, 20 bp, Homo sapiens
cagggagggaaacccgggga

SEQ ID NO: 4764103 - DNA, 12 bp, Homo sapiens
cagggagggaac

SEQ ID NO: 4764104 - DNA, 14 bp, Homo sapiens
cagggaggtcaggc

SEQ ID NO: 4764105 - DNA, 20 bp, Homo sapiens
cagggagtgtgatgcaggaa

SEQ ID NO: 4764106 - DNA, 22 bp, Homo sapiens
cagggatgggggatgggccagg

SEQ ID NO: 4764107 - DNA, 11 bp, Homo sapiens
cagggcaagct

SEQ ID NO: 4764108 - DNA, 18 bp, Homo sapiens
cagggcagcggtcttctc

SEQ ID NO: 4764109 - DNA, 17 bp, Homo sapiens
cagggcccaaataacag

SEQ ID NO: 4764110 - DNA, 12 bp, Homo sapiens
cagggcccagag

SEQ ID NO: 4764111 - DNA, 17 bp, Homo sapiens
cagggcccccacaggag

SEQ ID NO: 4764112 - DNA, 21 bp, Homo sapiens
cagggcccccacaggggatgg

SEQ ID NO: 4764113 - DNA, 21 bp, Homo sapiens
cagggccctgaaatggcctgt

SEQ ID NO: 4764114 - DNA, 19 bp, Homo sapiens
cagggccctgctcaggcct

SEQ ID NO: 4764115 - DNA, 21 bp, Homo sapiens
cagggccctgctcaggcctca

SEQ ID NO: 4764116 - DNA, 22 bp, Homo sapiens
cagggccctggggtctctgagc

SEQ ID NO: 4764117 - DNA, 17 bp, Homo sapiens
cagggccgcagggcgct

SEQ ID NO: 4764118 - DNA, 20 bp, Homo sapiens
cagggccgcttctcctgcag

SEQ ID NO: 4764119 - DNA, 17 bp, Homo sapiens
cagggcgctccggcaga

SEQ ID NO: 4764120 - DNA, 19 bp, Homo sapiens
cagggcgctccggcagagg

SEQ ID NO: 4764121 - DNA, 17 bp, Homo sapiens
cagggcgggccaggaga

SEQ ID NO: 4764122 - DNA, 13 bp, Homo sapiens
cagggcgtcctct

SEQ ID NO: 4764123 - DNA, 14 bp, Homo sapiens
cagggcgtcctctc

SEQ ID NO: 4764124 - DNA, 14 bp, Homo sapiens
cagggctgggcgcc

SEQ ID NO: 4764125 - DNA, 21 bp, Homo sapiens
cagggctgggcgcctctgtcc

SEQ ID NO: 4764126 - DNA, 19 bp, Homo sapiens
caggggaggctgagacgca

SEQ ID NO: 4764127 - DNA, 12 bp, Homo sapiens
caggggcagctc

SEQ ID NO: 4764128 - DNA, 15 bp, Homo sapiens
caggggcccctcctc

SEQ ID NO: 4764129 - DNA, 16 bp, Homo sapiens
caggggctgcatcctc

SEQ ID NO: 4764130 - DNA, 20 bp, Homo sapiens
caggggctgcatcctcagcc

SEQ ID NO: 4764131 - DNA, 22 bp, Homo sapiens
caggggctgcatcctcagcccc

SEQ ID NO: 4764132 - DNA, 23 bp, Homo sapiens
caggggctgcatcctcagcccca

SEQ ID NO: 4764133 - DNA, 13 bp, Homo sapiens
caggggctgggga

SEQ ID NO: 4764134 - DNA, 15 bp, Homo sapiens
caggggcttctcccc

SEQ ID NO: 4764135 - DNA, 15 bp, Homo sapiens
cagggtccagccctc

SEQ ID NO: 4764136 - DNA, 16 bp, Homo sapiens
cagggtccagccctcc

SEQ ID NO: 4764137 - DNA, 22 bp, Homo sapiens
cagggtcctgggggctgctgca

SEQ ID NO: 4764138 - DNA, 16 bp, Homo sapiens
cagggtggggcttaga

SEQ ID NO: 4764139 - DNA, 13 bp, Homo sapiens
cagggtggggggc

SEQ ID NO: 4764140 - DNA, 15 bp, Homo sapiens
cagggtggggggcca

SEQ ID NO: 4764141 - DNA, 16 bp, Homo sapiens
cagggtggggggccat

SEQ ID NO: 4764142 - DNA, 18 bp, Homo sapiens
cagggttccagacagggt

SEQ ID NO: 4764143 - DNA, 20 bp, Homo sapiens
cagggttccagacagggtgg

SEQ ID NO: 4764144 - DNA, 23 bp, Homo sapiens
cagggttccagacagggtggggc

SEQ ID NO: 4764145 - DNA, 22 bp, Homo sapiens
cagggtttacccagtgggacag

SEQ ID NO: 4764146 - DNA, 16 bp, Homo sapiens
caggtcagagcccagg

SEQ ID NO: 4764147 - DNA, 18 bp, Homo sapiens
caggtcagagcccaggaa

SEQ ID NO: 4764148 - DNA, 21 bp, Homo sapiens
caggtcccctggcccttcctt

SEQ ID NO: 4764149 - DNA, 23 bp, Homo sapiens
caggtcccctggcccttccttca

SEQ ID NO: 4764150 - DNA, 13 bp, Homo sapiens
caggtcctgccca

SEQ ID NO: 4764151 - DNA, 12 bp, Homo sapiens
caggtgaataac

SEQ ID NO: 4764152 - DNA, 19 bp, Homo sapiens
caggtgcctcccagccctg

SEQ ID NO: 4764153 - DNA, 12 bp, Homo sapiens
caggtggcattt

SEQ ID NO: 4764154 - DNA, 20 bp, Homo sapiens
caggtggggttttcacttcc

SEQ ID NO: 4764155 - DNA, 21 bp, Homo sapiens
caggtgtactatggctgtatt

SEQ ID NO: 4764156 - DNA, 14 bp, Homo sapiens
caggtgtcctgact

SEQ ID NO: 4764157 - DNA, 18 bp, Homo sapiens
caggttccatccaccacc

SEQ ID NO: 4764158 - DNA, 23 bp, Homo sapiens
caggttccatccaccaccttgcc

SEQ ID NO: 4764159 - DNA, 14 bp, Homo sapiens
caggttggacccca

SEQ ID NO: 4764160 - DNA, 21 bp, Homo sapiens
caggttgttttatagaggttc

SEQ ID NO: 4764161 - DNA, 15 bp, Homo sapiens
cagtaaatatacact

SEQ ID NO: 4764162 - DNA, 14 bp, Homo sapiens
cagtaaatccacag

SEQ ID NO: 4764163 - DNA, 18 bp, Homo sapiens
cagtaatgtcataaagtg

SEQ ID NO: 4764164 - DNA, 22 bp, Homo sapiens
cagtacaataaataaaagaaag

SEQ ID NO: 4764165 - DNA, 22 bp, Homo sapiens
cagtacatcttgtgcatgcaaa

SEQ ID NO: 4764166 - DNA, 14 bp, Homo sapiens
cagtacatgggaaa

SEQ ID NO: 4764167 - DNA, 20 bp, Homo sapiens
cagtagcattttaatagttt

SEQ ID NO: 4764168 - DNA, 20 bp, Homo sapiens
cagtagctccgcgtgtctca

SEQ ID NO: 4764169 - DNA, 23 bp, Homo sapiens
cagtagctccgcgtgtctcattt

SEQ ID NO: 4764170 - DNA, 17 bp, Homo sapiens
cagtagctccttggttt

SEQ ID NO: 4764171 - DNA, 23 bp, Homo sapiens
cagtagtgccaaaaggccccttc

SEQ ID NO: 4764172 - DNA, 18 bp, Homo sapiens
cagtagtgcctgtgatcg

SEQ ID NO: 4764173 - DNA, 12 bp, Homo sapiens
cagtataaatta

SEQ ID NO: 4764174 - DNA, 19 bp, Homo sapiens
cagtataaattacatgcat

SEQ ID NO: 4764175 - DNA, 12 bp, Homo sapiens
cagtatataagc

SEQ ID NO: 4764176 - DNA, 14 bp, Homo sapiens
cagtatataagctt

SEQ ID NO: 4764177 - DNA, 17 bp, Homo sapiens
cagtatattttatttca

SEQ ID NO: 4764178 - DNA, 20 bp, Homo sapiens
cagtatattttatttcaatg

SEQ ID NO: 4764179 - DNA, 23 bp, Homo sapiens
cagtattatttagtaaaattatc

SEQ ID NO: 4764180 - DNA, 18 bp, Homo sapiens
cagtattctgtagccaac

SEQ ID NO: 4764181 - DNA, 20 bp, Homo sapiens
cagtattgagacactgtcaa

SEQ ID NO: 4764182 - DNA, 18 bp, Homo sapiens
cagtattgttcttgtaaa

SEQ ID NO: 4764183 - DNA, 12 bp, Homo sapiens
cagtatttaaca

SEQ ID NO: 4764184 - DNA, 20 bp, Homo sapiens
cagtcaagacggatccacag

SEQ ID NO: 4764185 - DNA, 20 bp, Homo sapiens
cagtcaattgcttgagcatg

SEQ ID NO: 4764186 - DNA, 16 bp, Homo sapiens
cagtcagaagatcttt

SEQ ID NO: 4764187 - DNA, 15 bp, Homo sapiens
cagtcagcacagaga

SEQ ID NO: 4764188 - DNA, 21 bp, Homo sapiens
cagtcagcggagaggacccca

SEQ ID NO: 4764189 - DNA, 12 bp, Homo sapiens
cagtcaggggcc

SEQ ID NO: 4764190 - DNA, 20 bp, Homo sapiens
cagtcatggctgtcccctgc

SEQ ID NO: 4764191 - DNA, 14 bp, Homo sapiens
cagtccaataaatt

SEQ ID NO: 4764192 - DNA, 22 bp, Homo sapiens
cagtccacccccattgtgaatg

SEQ ID NO: 4764193 - DNA, 20 bp, Homo sapiens
cagtccatttttgagtaaaa

SEQ ID NO: 4764194 - DNA, 22 bp, Homo sapiens
cagtccccctatccttggcacc

SEQ ID NO: 4764195 - DNA, 23 bp, Homo sapiens
cagtccgccccgtgctcctctgc

SEQ ID NO: 4764196 - DNA, 13 bp, Homo sapiens
cagtccggtgcct

SEQ ID NO: 4764197 - DNA, 17 bp, Homo sapiens
cagtccggtgccttcca

SEQ ID NO: 4764198 - DNA, 22 bp, Homo sapiens
cagtccggtgccttccaccctg

SEQ ID NO: 4764199 - DNA, 18 bp, Homo sapiens
cagtcctagaatgtttca

SEQ ID NO: 4764200 - DNA, 17 bp, Homo sapiens
cagtcgatattcccagg

SEQ ID NO: 4764201 - DNA, 13 bp, Homo sapiens
cagtctatgctgt

SEQ ID NO: 4764202 - DNA, 21 bp, Homo sapiens
cagtctccgctcccgcagcgg

SEQ ID NO: 4764203 - DNA, 13 bp, Homo sapiens
cagtctctatttg

SEQ ID NO: 4764204 - DNA, 23 bp, Homo sapiens
cagtctctatttgatttgcaaca

SEQ ID NO: 4764205 - DNA, 19 bp, Homo sapiens
cagtctgcagctattcaca

SEQ ID NO: 4764206 - DNA, 15 bp, Homo sapiens
cagtctgttcagagg

SEQ ID NO: 4764207 - DNA, 17 bp, Homo sapiens
cagtctgttcagaggca

SEQ ID NO: 4764208 - DNA, 18 bp, Homo sapiens
cagtcttgagtgggcccc

SEQ ID NO: 4764209 - DNA, 23 bp, Homo sapiens
cagtcttgagtgggccccctctc

SEQ ID NO: 4764210 - DNA, 20 bp, Homo sapiens
cagtctttgctcagtggatc

SEQ ID NO: 4764211 - DNA, 12 bp, Homo sapiens
cagtcttttgtc

SEQ ID NO: 4764212 - DNA, 16 bp, Homo sapiens
cagtgaacagcttcac

SEQ ID NO: 4764213 - DNA, 17 bp, Homo sapiens
cagtgaatataaatgta

SEQ ID NO: 4764214 - DNA, 20 bp, Homo sapiens
cagtgagagcagggctgggc

SEQ ID NO: 4764215 - DNA, 22 bp, Homo sapiens
cagtgagagcagggctgggcgc

SEQ ID NO: 4764216 - DNA, 18 bp, Homo sapiens
cagtgcaatctgtccaga

SEQ ID NO: 4764217 - DNA, 20 bp, Homo sapiens
cagtgcaatctgtccagaca

SEQ ID NO: 4764218 - DNA, 18 bp, Homo sapiens
cagtgcagggacagcctg

SEQ ID NO: 4764219 - DNA, 23 bp, Homo sapiens
cagtgcatgctgtcccttacgtg

SEQ ID NO: 4764220 - DNA, 15 bp, Homo sapiens
cagtgccaaaaacaa

SEQ ID NO: 4764221 - DNA, 17 bp, Homo sapiens
cagtgccagctggtgaa

SEQ ID NO: 4764222 - DNA, 21 bp, Homo sapiens
cagtgccagctggtgaatcca

SEQ ID NO: 4764223 - DNA, 19 bp, Homo sapiens
cagtgctagtgagctgggc

SEQ ID NO: 4764224 - DNA, 21 bp, Homo sapiens
cagtgctagtgagctgggcat

SEQ ID NO: 4764225 - DNA, 16 bp, Homo sapiens
cagtgcttagcaaaaa

SEQ ID NO: 4764226 - DNA, 19 bp, Homo sapiens
cagtgctttatccacattg

SEQ ID NO: 4764227 - DNA, 10 bp, Homo sapiens
cagtggaaga

SEQ ID NO: 4764228 - DNA, 21 bp, Homo sapiens
cagtggaagagctgctgtatt

SEQ ID NO: 4764229 - DNA, 14 bp, Homo sapiens
cagtggaagtgatt

SEQ ID NO: 4764230 - DNA, 13 bp, Homo sapiens
cagtggagagggg

SEQ ID NO: 4764231 - DNA, 15 bp, Homo sapiens
cagtggcagtattga

SEQ ID NO: 4764232 - DNA, 18 bp, Homo sapiens
cagtggccgggctgggga

SEQ ID NO: 4764233 - DNA, 14 bp, Homo sapiens
cagtggcctacaaa

SEQ ID NO: 4764234 - DNA, 22 bp, Homo sapiens
cagtggcctacaaatcagtaat

SEQ ID NO: 4764235 - DNA, 23 bp, Homo sapiens
cagtggcctacaaatcagtaatt

SEQ ID NO: 4764236 - DNA, 21 bp, Homo sapiens
cagtggcgcgatctcagctca

SEQ ID NO: 4764237 - DNA, 13 bp, Homo sapiens
cagtgggacagag

SEQ ID NO: 4764238 - DNA, 12 bp, Homo sapiens
cagtgggatctt

SEQ ID NO: 4764239 - DNA, 17 bp, Homo sapiens
cagtggggcccatggcc

SEQ ID NO: 4764240 - DNA, 20 bp, Homo sapiens
cagtggggcccatggcccca

SEQ ID NO: 4764241 - DNA, 21 bp, Homo sapiens
cagtggggcccatggccccag

SEQ ID NO: 4764242 - DNA, 19 bp, Homo sapiens
cagtggtccagggtccagc

SEQ ID NO: 4764243 - DNA, 23 bp, Homo sapiens
cagtggtccagggtccagccctc

SEQ ID NO: 4764244 - DNA, 14 bp, Homo sapiens
cagtggtgatgcct

SEQ ID NO: 4764245 - DNA, 13 bp, Homo sapiens
cagtgtagatttt

SEQ ID NO: 4764246 - DNA, 20 bp, Homo sapiens
cagtgtatttaatgtttgta

SEQ ID NO: 4764247 - DNA, 21 bp, Homo sapiens
cagtgtcctgtgctttctgca

SEQ ID NO: 4764248 - DNA, 14 bp, Homo sapiens
cagtgtctggccca

SEQ ID NO: 4764249 - DNA, 18 bp, Homo sapiens
cagtgtctggcccagcca

SEQ ID NO: 4764250 - DNA, 23 bp, Homo sapiens
cagtgtctggcccagccatggct

SEQ ID NO: 4764251 - DNA, 17 bp, Homo sapiens
cagtgtggcttaaacat

SEQ ID NO: 4764252 - DNA, 19 bp, Homo sapiens
cagtgtggcttaaacattt

SEQ ID NO: 4764253 - DNA, 18 bp, Homo sapiens
cagtgttcaaattctgat

SEQ ID NO: 4764254 - DNA, 21 bp, Homo sapiens
cagtgttcccttctggctgtc

SEQ ID NO: 4764255 - DNA, 14 bp, Homo sapiens
cagtgttcgcttgg

SEQ ID NO: 4764256 - DNA, 16 bp, Homo sapiens
cagtgttcgcttggct

SEQ ID NO: 4764257 - DNA, 20 bp, Homo sapiens
cagttaaggaccgtggccct

SEQ ID NO: 4764258 - DNA, 15 bp, Homo sapiens
cagttagcacagagg

SEQ ID NO: 4764259 - DNA, 13 bp, Homo sapiens
cagttcacaccct

SEQ ID NO: 4764260 - DNA, 15 bp, Homo sapiens
cagttcacaccctgc

SEQ ID NO: 4764261 - DNA, 17 bp, Homo sapiens
cagttccctcagccctc

SEQ ID NO: 4764262 - DNA, 19 bp, Homo sapiens
cagttccctcagccctcat

SEQ ID NO: 4764263 - DNA, 21 bp, Homo sapiens
cagttccctcagccctcatta

SEQ ID NO: 4764264 - DNA, 14 bp, Homo sapiens
cagttctcatcttg

SEQ ID NO: 4764265 - DNA, 16 bp, Homo sapiens
cagttctcatcttgta

SEQ ID NO: 4764266 - DNA, 13 bp, Homo sapiens
cagttctctcctt

SEQ ID NO: 4764267 - DNA, 14 bp, Homo sapiens
cagttctctccttc

SEQ ID NO: 4764268 - DNA, 13 bp, Homo sapiens
cagttctgatgag

SEQ ID NO: 4764269 - DNA, 11 bp, Homo sapiens
cagttctgcaa

SEQ ID NO: 4764270 - DNA, 12 bp, Homo sapiens
cagttctgcaaa

SEQ ID NO: 4764271 - DNA, 13 bp, Homo sapiens
cagttctgcaaat

SEQ ID NO: 4764272 - DNA, 20 bp, Homo sapiens
cagttctgcaaatagaaaac

SEQ ID NO: 4764273 - DNA, 22 bp, Homo sapiens
cagttgacacattgcacacaca

SEQ ID NO: 4764274 - DNA, 20 bp, Homo sapiens
cagttgatatttaaaagatc

SEQ ID NO: 4764275 - DNA, 11 bp, Homo sapiens
cagttgattaa

SEQ ID NO: 4764276 - DNA, 20 bp, Homo sapiens
cagttgcaataaactcagtc

SEQ ID NO: 4764277 - DNA, 23 bp, Homo sapiens
cagttggcctctgcccctcttcc

SEQ ID NO: 4764278 - DNA, 12 bp, Homo sapiens
cagttgggcccc

SEQ ID NO: 4764279 - DNA, 15 bp, Homo sapiens
cagttgggcccccat

SEQ ID NO: 4764280 - DNA, 21 bp, Homo sapiens
cagttggttttgcatgtctgc

SEQ ID NO: 4764281 - DNA, 17 bp, Homo sapiens
cagttgttagtgtgtct

SEQ ID NO: 4764282 - DNA, 19 bp, Homo sapiens
cagttgttatattcattct

SEQ ID NO: 4764283 - DNA, 21 bp, Homo sapiens
cagttgttatattcattcttt

SEQ ID NO: 4764284 - DNA, 13 bp, Homo sapiens
cagtttaacagaa

SEQ ID NO: 4764285 - DNA, 17 bp, Homo sapiens
cagtttaggacccaagg

SEQ ID NO: 4764286 - DNA, 17 bp, Homo sapiens
cagtttcagataaatca

SEQ ID NO: 4764287 - DNA, 20 bp, Homo sapiens
cagtttctcttaagctgccc

SEQ ID NO: 4764288 - DNA, 22 bp, Homo sapiens
cagtttggtatgaaacaaatat

SEQ ID NO: 4764289 - DNA, 23 bp, Homo sapiens
cagtttgtgaagtgattgacatt

SEQ ID NO: 4764290 - DNA, 18 bp, Homo sapiens
cagtttgtttacacacgt

SEQ ID NO: 4764291 - DNA, 16 bp, Homo sapiens
cagttttgtcttcgta

SEQ ID NO: 4764292 - DNA, 14 bp, Homo sapiens
cataaaataaataa

SEQ ID NO: 4764293 - DNA, 17 bp, Homo sapiens
cataaaataaataatct

SEQ ID NO: 4764294 - DNA, 12 bp, Homo sapiens
cataaaatatac

SEQ ID NO: 4764295 - DNA, 14 bp, Homo sapiens
cataaagtgagaaa

SEQ ID NO: 4764296 - DNA, 15 bp, Homo sapiens
cataaatagtaaata

SEQ ID NO: 4764297 - DNA, 21 bp, Homo sapiens
cataaattatttctaaaacat

SEQ ID NO: 4764298 - DNA, 17 bp, Homo sapiens
cataacaggcattgcac

SEQ ID NO: 4764299 - DNA, 17 bp, Homo sapiens
cataaccgcacagacat

SEQ ID NO: 4764300 - DNA, 19 bp, Homo sapiens
cataactagagtatgtgta

SEQ ID NO: 4764301 - DNA, 15 bp, Homo sapiens
cataagctagaaaaa

SEQ ID NO: 4764302 - DNA, 21 bp, Homo sapiens
cataagggacatgtctttggc

SEQ ID NO: 4764303 - DNA, 13 bp, Homo sapiens
cataagtaaatgt

SEQ ID NO: 4764304 - DNA, 23 bp, Homo sapiens
cataagtaaatgtcttcatgttg

SEQ ID NO: 4764305 - DNA, 13 bp, Homo sapiens
cataagttttctc

SEQ ID NO: 4764306 - DNA, 22 bp, Homo sapiens
cataatcatccttttttaaaaa

SEQ ID NO: 4764307 - DNA, 15 bp, Homo sapiens
cataatggtaaatct

SEQ ID NO: 4764308 - DNA, 18 bp, Homo sapiens
cataatgttagtagcact

SEQ ID NO: 4764309 - DNA, 19 bp, Homo sapiens
catacaaatctcactgtat

SEQ ID NO: 4764310 - DNA, 20 bp, Homo sapiens
catacacagaaatcctaaca

SEQ ID NO: 4764311 - DNA, 17 bp, Homo sapiens
catacagtctctatttg

SEQ ID NO: 4764312 - DNA, 19 bp, Homo sapiens
catacagtctctatttgat

SEQ ID NO: 4764313 - DNA, 17 bp, Homo sapiens
cataccagttcttgcaa

SEQ ID NO: 4764314 - DNA, 17 bp, Homo sapiens
cataccccctgccccag

SEQ ID NO: 4764315 - DNA, 21 bp, Homo sapiens
cataccccctgccccagagaa

SEQ ID NO: 4764316 - DNA, 23 bp, Homo sapiens
catacctctctctatatatacat

SEQ ID NO: 4764317 - DNA, 16 bp, Homo sapiens
catacgaaacacaaac

SEQ ID NO: 4764318 - DNA, 15 bp, Homo sapiens
catacgcactgggca

SEQ ID NO: 4764319 - DNA, 22 bp, Homo sapiens
catacgtgcccatttcacacaa

SEQ ID NO: 4764320 - DNA, 18 bp, Homo sapiens
catactacatttgaacag

SEQ ID NO: 4764321 - DNA, 23 bp, Homo sapiens
catactcaaagaggccagtactt

SEQ ID NO: 4764322 - DNA, 14 bp, Homo sapiens
catactctccagga

SEQ ID NO: 4764323 - DNA, 23 bp, Homo sapiens
catactctccaggattgtccaca

SEQ ID NO: 4764324 - DNA, 24 bp, Homo sapiens
catactctccaggattgtccacaa

SEQ ID NO: 4764325 - DNA, 20 bp, Homo sapiens
catactgatgagacaacaca

SEQ ID NO: 4764326 - DNA, 16 bp, Homo sapiens
catagaaacatgacac

SEQ ID NO: 4764327 - DNA, 18 bp, Homo sapiens
catagaaacatgacactg

SEQ ID NO: 4764328 - DNA, 15 bp, Homo sapiens
catagacacagtatt

SEQ ID NO: 4764329 - DNA, 15 bp, Homo sapiens
catagagctatatat

SEQ ID NO: 4764330 - DNA, 21 bp, Homo sapiens
cagcatagttctgcaataaca

SEQ ID NO: 4764331 - DNA, 23 bp, Homo sapiens
cagcatagttctgcaataacagt

SEQ ID NO: 4764332 - DNA, 21 bp, Homo sapiens
cagcatatgtgccataaacag

SEQ ID NO: 4764333 - DNA, 21 bp, Homo sapiens
cagcatcctggaaatttgtgt

SEQ ID NO: 4764334 - DNA, 17 bp, Homo sapiens
cagcatcgtgtgggtcc

SEQ ID NO: 4764335 - DNA, 12 bp, Homo sapiens
cagcatgcattt

SEQ ID NO: 4764336 - DNA, 21 bp, Homo sapiens
cagcatgtgctcagccccaga

SEQ ID NO: 4764337 - DNA, 20 bp, Homo sapiens
cagcatgtgttaatcttaat

SEQ ID NO: 4764338 - DNA, 23 bp, Homo sapiens
cagcatgtgttaatcttaatgta

SEQ ID NO: 4764339 - DNA, 22 bp, Homo sapiens
cagcattcccaattatcaaaaa

SEQ ID NO: 4764340 - DNA, 19 bp, Homo sapiens
cagccaataaacaccagtg

SEQ ID NO: 4764341 - DNA, 14 bp, Homo sapiens
cagccaatttcaaa

SEQ ID NO: 4764342 - DNA, 21 bp, Homo sapiens
cagccacccggatctccaggc

SEQ ID NO: 4764343 - DNA, 12 bp, Homo sapiens
cagccagcaggt

SEQ ID NO: 4764344 - DNA, 23 bp, Homo sapiens
cagccagcaggttctctcctgtg

SEQ ID NO: 4764345 - DNA, 12 bp, Homo sapiens
cagccatggctg

SEQ ID NO: 4764346 - DNA, 19 bp, Homo sapiens
cagcccagaacgggcctcc

SEQ ID NO: 4764347 - DNA, 14 bp, Homo sapiens
cagcccagagactg

SEQ ID NO: 4764348 - DNA, 20 bp, Homo sapiens
cagcccagagagaccctgcc

SEQ ID NO: 4764349 - DNA, 17 bp, Homo sapiens
cagccccagacctgccg

SEQ ID NO: 4764350 - DNA, 17 bp, Homo sapiens
cagccccagggccctgc

SEQ ID NO: 4764351 - DNA, 19 bp, Homo sapiens
cagccccagggccctgctc

SEQ ID NO: 4764352 - DNA, 22 bp, Homo sapiens
cagagctgatggagaaggaagg

SEQ ID NO: 4764353 - DNA, 20 bp, Homo sapiens
cagaggagagaggaccccct

SEQ ID NO: 4764354 - DNA, 14 bp, Homo sapiens
cagaggatggcttc

SEQ ID NO: 4764355 - DNA, 12 bp, Homo sapiens
cagaggcagggc

SEQ ID NO: 4764356 - DNA, 13 bp, Homo sapiens
cagaggcagggcc

SEQ ID NO: 4764357 - DNA, 15 bp, Homo sapiens
cagaggcagggccct

SEQ ID NO: 4764358 - DNA, 17 bp, Homo sapiens
cagaggcagggccctgg

SEQ ID NO: 4764359 - DNA, 19 bp, Homo sapiens
cagaggcagggccctgggg

SEQ ID NO: 4764360 - DNA, 21 bp, Homo sapiens
cagaggcagggccctggggtc

SEQ ID NO: 4764361 - DNA, 20 bp, Homo sapiens
cagaggcattggaggatggg

SEQ ID NO: 4764362 - DNA, 21 bp, Homo sapiens
cagagggatgaaatgccaaga

SEQ ID NO: 4764363 - DNA, 16 bp, Homo sapiens
cagaggtggggtgctg

SEQ ID NO: 4764364 - DNA, 22 bp, Homo sapiens
cagaggtggggtgctggggctg

SEQ ID NO: 4764365 - DNA, 21 bp, Homo sapiens
cagagtatgtcagtccaataa

SEQ ID NO: 4764366 - DNA, 20 bp, Homo sapiens
cagagtcagaagtttctgcc

SEQ ID NO: 4764367 - DNA, 19 bp, Homo sapiens
cagagtgtatttttgtaat

SEQ ID NO: 4764368 - DNA, 15 bp, Homo sapiens
cagatacctgtgagg

SEQ ID NO: 4764369 - DNA, 16 bp, Homo sapiens
cagatacctgtgagga

SEQ ID NO: 4764370 - DNA, 22 bp, Homo sapiens
cagatagtatacacatcataaa

SEQ ID NO: 4764371 - DNA, 23 bp, Homo sapiens
cagatcacatgcccctcttagaa

SEQ ID NO: 4764372 - DNA, 21 bp, Homo sapiens
cagatccatccttttgcttca

SEQ ID NO: 4764373 - DNA, 22 bp, Homo sapiens
cagatccatccttttgcttcat

SEQ ID NO: 4764374 - DNA, 13 bp, Homo sapiens
cagatccatcggt

SEQ ID NO: 4764375 - DNA, 21 bp, Homo sapiens
cagatccctcggtcagcaccg

SEQ ID NO: 4764376 - DNA, 19 bp, Homo sapiens
cagatcctccgcggaggcc

SEQ ID NO: 4764377 - DNA, 21 bp, Homo sapiens
cagatcctccgcggaggcccc

SEQ ID NO: 4764378 - DNA, 22 bp, Homo sapiens
cagatcctccgcggaggcccct

SEQ ID NO: 4764379 - DNA, 21 bp, Homo sapiens
cagatcctctttccccactga

SEQ ID NO: 4764380 - DNA, 12 bp, Homo sapiens
cagatctagcca

SEQ ID NO: 4764381 - DNA, 16 bp, Homo sapiens
cagatctagccaggcc

SEQ ID NO: 4764382 - DNA, 17 bp, Homo sapiens
cagatctagccaggcct

SEQ ID NO: 4764383 - DNA, 20 bp, Homo sapiens
cagatctagccaggcctccc

SEQ ID NO: 4764384 - DNA, 22 bp, Homo sapiens
cagatctgaagtagtgtgagtg

SEQ ID NO: 4764385 - DNA, 13 bp, Homo sapiens
cagatctgcactc

SEQ ID NO: 4764386 - DNA, 21 bp, Homo sapiens
cagatctgcactcctgtctct

SEQ ID NO: 4764387 - DNA, 15 bp, Homo sapiens
cagatgatctctcca

SEQ ID NO: 4764388 - DNA, 24 bp, Homo sapiens
cagatgggtgtcccctggtgcccc

SEQ ID NO: 4764389 - DNA, 19 bp, Homo sapiens
cagatggtgtcctgcatgt

SEQ ID NO: 4764390 - DNA, 20 bp, Homo sapiens
cagatggtgtcctgcatgta

SEQ ID NO: 4764391 - DNA, 15 bp, Homo sapiens
cagattgctgcttct

SEQ ID NO: 4764392 - DNA, 17 bp, Homo sapiens
cagcaaaaccattgctt

SEQ ID NO: 4764393 - DNA, 19 bp, Homo sapiens
cagcaaattcttgaataaa

SEQ ID NO: 4764394 - DNA, 13 bp, Homo sapiens
cagcaacaacaac

SEQ ID NO: 4764395 - DNA, 18 bp, Homo sapiens
cagcaacaggaccaggag

SEQ ID NO: 4764396 - DNA, 19 bp, Homo sapiens
cagcaacaggaccaggagc

SEQ ID NO: 4764397 - DNA, 20 bp, Homo sapiens
cagcaaccctacagtatata

SEQ ID NO: 4764398 - DNA, 15 bp, Homo sapiens
cagcaagataaacac

SEQ ID NO: 4764399 - DNA, 23 bp, Homo sapiens
cagcaaggtattggtaggttact

SEQ ID NO: 4764400 - DNA, 17 bp, Homo sapiens
cagcacacattgtgtta

SEQ ID NO: 4764401 - DNA, 15 bp, Homo sapiens
cagcacagagagcgg

SEQ ID NO: 4764402 - DNA, 18 bp, Homo sapiens
cagcacagctactcagat

SEQ ID NO: 4764403 - DNA, 20 bp, Homo sapiens
cagcacagctactcagatct

SEQ ID NO: 4764404 - DNA, 16 bp, Homo sapiens
cagcacatgctggcca

SEQ ID NO: 4764405 - DNA, 18 bp, Homo sapiens
cagcacatgctggccagc

SEQ ID NO: 4764406 - DNA, 20 bp, Homo sapiens
cagcacatgctggccagcct

SEQ ID NO: 4764407 - DNA, 16 bp, Homo sapiens
cagcacatttgttaat

SEQ ID NO: 4764408 - DNA, 17 bp, Homo sapiens
cagcacatttgttaatg

SEQ ID NO: 4764409 - DNA, 23 bp, Homo sapiens
cagcacatttgttaatgattctt

SEQ ID NO: 4764410 - DNA, 16 bp, Homo sapiens
cagcaccagcctgagc

SEQ ID NO: 4764411 - DNA, 17 bp, Homo sapiens
cagcaccagcctgagcc

SEQ ID NO: 4764412 - DNA, 11 bp, Homo sapiens
cagcaccctcc

SEQ ID NO: 4764413 - DNA, 19 bp, Homo sapiens
cagcaccctcccccgcagc

SEQ ID NO: 4764414 - DNA, 16 bp, Homo sapiens
cagcaccctctcctgg

SEQ ID NO: 4764415 - DNA, 14 bp, Homo sapiens
cagcacctttgtaa

SEQ ID NO: 4764416 - DNA, 17 bp, Homo sapiens
cagcacgttctccagac

SEQ ID NO: 4764417 - DNA, 18 bp, Homo sapiens
cagcacgttctccagact

SEQ ID NO: 4764418 - DNA, 20 bp, Homo sapiens
cagcactcccagggcccgag

SEQ ID NO: 4764419 - DNA, 21 bp, Homo sapiens
cagcactcccagggcccgagc

SEQ ID NO: 4764420 - DNA, 14 bp, Homo sapiens
cagcagcagcagca

SEQ ID NO: 4764421 - DNA, 14 bp, Homo sapiens
cagcagccccccag

SEQ ID NO: 4764422 - DNA, 22 bp, Homo sapiens
cagcagcctgcttcccacctcc

SEQ ID NO: 4764423 - DNA, 17 bp, Homo sapiens
cagcagcgcccgaggcc

SEQ ID NO: 4764424 - DNA, 16 bp, Homo sapiens
cagcagcggcccagat

SEQ ID NO: 4764425 - DNA, 13 bp, Homo sapiens
cagcagctccaac

SEQ ID NO: 4764426 - DNA, 16 bp, Homo sapiens
cagcagctccaacctg

SEQ ID NO: 4764427 - DNA, 19 bp, Homo sapiens
cagcagctccaacctggag

SEQ ID NO: 4764428 - DNA, 14 bp, Homo sapiens
cagcaggctctcag

SEQ ID NO: 4764429 - DNA, 16 bp, Homo sapiens
cagcaggctctcaggc

SEQ ID NO: 4764430 - DNA, 22 bp, Homo sapiens
cagcaggctctcaggccagctg

SEQ ID NO: 4764431 - DNA, 21 bp, Homo sapiens
cagcagggcgggccaggagaa

SEQ ID NO: 4764432 - DNA, 21 bp, Homo sapiens
cagcaggggaaagattatatt

SEQ ID NO: 4764433 - DNA, 16 bp, Homo sapiens
cagcaggggggttggg

SEQ ID NO: 4764434 - DNA, 19 bp, Homo sapiens
cagcaggggggttgggttc

SEQ ID NO: 4764435 - DNA, 21 bp, Homo sapiens
cagcaggtgccatcacgcttg

SEQ ID NO: 4764436 - DNA, 16 bp, Homo sapiens
cagcagtaccatccca

SEQ ID NO: 4764437 - DNA, 20 bp, Homo sapiens
cagcagtaccatcccactga

SEQ ID NO: 4764438 - DNA, 19 bp, Homo sapiens
cagcagtctccgctcccgc

SEQ ID NO: 4764439 - DNA, 21 bp, Homo sapiens
cagcagttttcttttaatttt

SEQ ID NO: 4764440 - DNA, 17 bp, Homo sapiens
cagcatagttctgcaat

SEQ ID NO: 4764441 - DNA, 19 bp, Homo sapiens
cagcatagttctgcaataa

SEQ ID NO: 4764442 - DNA, 14 bp, Homo sapiens
cacttaaactttgt

SEQ ID NO: 4764443 - DNA, 17 bp, Homo sapiens
cacttaaactttgtcac

SEQ ID NO: 4764444 - DNA, 21 bp, Homo sapiens
cacttaaactttgtcacttct

SEQ ID NO: 4764445 - DNA, 14 bp, Homo sapiens
cacttcaagcaaag

SEQ ID NO: 4764446 - DNA, 21 bp, Homo sapiens
cacttcaagcaaagacagttt

SEQ ID NO: 4764447 - DNA, 13 bp, Homo sapiens
cacttccctgcaa

SEQ ID NO: 4764448 - DNA, 13 bp, Homo sapiens
cacttccttaaca

SEQ ID NO: 4764449 - DNA, 19 bp, Homo sapiens
cacttctacgcataaacta

SEQ ID NO: 4764450 - DNA, 18 bp, Homo sapiens
cacttctccttaaccccc

SEQ ID NO: 4764451 - DNA, 21 bp, Homo sapiens
cacttctccttaacccccatt

SEQ ID NO: 4764452 - DNA, 20 bp, Homo sapiens
cacttgctgcactcttgcac

SEQ ID NO: 4764453 - DNA, 20 bp, Homo sapiens
cacttgggctggcacccact

SEQ ID NO: 4764454 - DNA, 16 bp, Homo sapiens
cactttcctctctctc

SEQ ID NO: 4764455 - DNA, 13 bp, Homo sapiens
cactttctagcca

SEQ ID NO: 4764456 - DNA, 15 bp, Homo sapiens
cacttttctcatctg

SEQ ID NO: 4764457 - DNA, 14 bp, Homo sapiens
cagaaaaacaaaaa

SEQ ID NO: 4764458 - DNA, 19 bp, Homo sapiens
cagaaaaacaaaaaaaaga

SEQ ID NO: 4764459 - DNA, 17 bp, Homo sapiens
cagaaaaagagcttccc

SEQ ID NO: 4764460 - DNA, 21 bp, Homo sapiens
cagaaaaatgaaatttaagca

SEQ ID NO: 4764461 - DNA, 11 bp, Homo sapiens
cagaaaatgag

SEQ ID NO: 4764462 - DNA, 21 bp, Homo sapiens
cagaaaatggaagacagctct

SEQ ID NO: 4764463 - DNA, 23 bp, Homo sapiens
cagaaaatggaagacagctctta

SEQ ID NO: 4764464 - DNA, 21 bp, Homo sapiens
cagaaagaggaataaaatgat

SEQ ID NO: 4764465 - DNA, 11 bp, Homo sapiens
cagaaatgtgc

SEQ ID NO: 4764466 - DNA, 20 bp, Homo sapiens
cagaacaaacctctatatgt

SEQ ID NO: 4764467 - DNA, 17 bp, Homo sapiens
cagaacaccaagtaaat

SEQ ID NO: 4764468 - DNA, 22 bp, Homo sapiens
cagaacaccaagtaaatctatc

SEQ ID NO: 4764469 - DNA, 16 bp, Homo sapiens
cagaaccaacgggtct

SEQ ID NO: 4764470 - DNA, 23 bp, Homo sapiens
cagaaccagcactcccagggccc

SEQ ID NO: 4764471 - DNA, 21 bp, Homo sapiens
cagaaccttcccgtctgattg

SEQ ID NO: 4764472 - DNA, 15 bp, Homo sapiens
cagaacctttgtcaa

SEQ ID NO: 4764473 - DNA, 19 bp, Homo sapiens
cagaacgcatgcagggccc

SEQ ID NO: 4764474 - DNA, 14 bp, Homo sapiens
cagaacgggcctcc

SEQ ID NO: 4764475 - DNA, 17 bp, Homo sapiens
cagaacgggcctccccg

SEQ ID NO: 4764476 - DNA, 20 bp, Homo sapiens
cagaactcctgtgtgtggaa

SEQ ID NO: 4764477 - DNA, 17 bp, Homo sapiens
cagaactcctttctaag

SEQ ID NO: 4764478 - DNA, 16 bp, Homo sapiens
cagaactgtcttagtc

SEQ ID NO: 4764479 - DNA, 14 bp, Homo sapiens
cagaagcagcagct

SEQ ID NO: 4764480 - DNA, 16 bp, Homo sapiens
cagaagcagttgcaat

SEQ ID NO: 4764481 - DNA, 18 bp, Homo sapiens
cagaagctcaaggctgca

SEQ ID NO: 4764482 - DNA, 19 bp, Homo sapiens
cagaaggaagacttcatcc

SEQ ID NO: 4764483 - DNA, 15 bp, Homo sapiens
cagaaggaaggcagg

SEQ ID NO: 4764484 - DNA, 23 bp, Homo sapiens
cagaagtcagttgcaaattttag

SEQ ID NO: 4764485 - DNA, 17 bp, Homo sapiens
cagaagtgaaaaagact

SEQ ID NO: 4764486 - DNA, 14 bp, Homo sapiens
cagaagtggaagga

SEQ ID NO: 4764487 - DNA, 22 bp, Homo sapiens
cagaagtttaaatctttgttaa

SEQ ID NO: 4764488 - DNA, 14 bp, Homo sapiens
cagaagtttctgcc

SEQ ID NO: 4764489 - DNA, 23 bp, Homo sapiens
cagaagtttctgccgcagccctg

SEQ ID NO: 4764490 - DNA, 20 bp, Homo sapiens
cagaataaaccggatcctgt

SEQ ID NO: 4764491 - DNA, 22 bp, Homo sapiens
cagaatatggacaaagaaggca

SEQ ID NO: 4764492 - DNA, 17 bp, Homo sapiens
cagaatattaagcacat

SEQ ID NO: 4764493 - DNA, 14 bp, Homo sapiens
cagaatcattgctt

SEQ ID NO: 4764494 - DNA, 21 bp, Homo sapiens
cagaatgttgtgttggtattt

SEQ ID NO: 4764495 - DNA, 22 bp, Homo sapiens
cagaattgaaccgtcaatgtga

SEQ ID NO: 4764496 - DNA, 22 bp, Homo sapiens
cagaattgggcccttagaatgt

SEQ ID NO: 4764497 - DNA, 24 bp, Homo sapiens
cagaatttcccaaagcagtgcatg

SEQ ID NO: 4764498 - DNA, 16 bp, Homo sapiens
cagacaacaaacctgt

SEQ ID NO: 4764499 - DNA, 21 bp, Homo sapiens
cagacaagccctgcttgctgg

SEQ ID NO: 4764500 - DNA, 16 bp, Homo sapiens
cagacaccatcaccac

SEQ ID NO: 4764501 - DNA, 20 bp, Homo sapiens
cagacactccagtttgccca

SEQ ID NO: 4764502 - DNA, 15 bp, Homo sapiens
cagacagggtggggc

SEQ ID NO: 4764503 - DNA, 16 bp, Homo sapiens
cagacagggtggggct

SEQ ID NO: 4764504 - DNA, 20 bp, Homo sapiens
cagacagttaagagaaatga

SEQ ID NO: 4764505 - DNA, 18 bp, Homo sapiens
cagacatacgaaacacaa

SEQ ID NO: 4764506 - DNA, 19 bp, Homo sapiens
cagacatacgaaacacaaa

SEQ ID NO: 4764507 - DNA, 16 bp, Homo sapiens
cagacattaaataatc

SEQ ID NO: 4764508 - DNA, 20 bp, Homo sapiens
cagacattgacaagcacgca

SEQ ID NO: 4764509 - DNA, 18 bp, Homo sapiens
cagaccacgcccctgcct

SEQ ID NO: 4764510 - DNA, 22 bp, Homo sapiens
cagaccccaccctgtctgcagg

SEQ ID NO: 4764511 - DNA, 23 bp, Homo sapiens
cagaccccaccctgtctgcaggc

SEQ ID NO: 4764512 - DNA, 13 bp, Homo sapiens
cagaccctgccag

SEQ ID NO: 4764513 - DNA, 22 bp, Homo sapiens
cagacctccagattattttcta

SEQ ID NO: 4764514 - DNA, 22 bp, Homo sapiens
cagacgcaagaggtttcagcat

SEQ ID NO: 4764515 - DNA, 17 bp, Homo sapiens
cagacgctgccgctgcc

SEQ ID NO: 4764516 - DNA, 12 bp, Homo sapiens
cagacggacggg

SEQ ID NO: 4764517 - DNA, 19 bp, Homo sapiens
cagactcgagagggctgag

SEQ ID NO: 4764518 - DNA, 22 bp, Homo sapiens
cagactcgagagggctgagccc

SEQ ID NO: 4764519 - DNA, 22 bp, Homo sapiens
cagactctgtgagattctaaat

SEQ ID NO: 4764520 - DNA, 21 bp, Homo sapiens
cagactgcaggttggacccca

SEQ ID NO: 4764521 - DNA, 21 bp, Homo sapiens
cagactgtgggtccctgcgtc

SEQ ID NO: 4764522 - DNA, 18 bp, Homo sapiens
cagacttcgctattccca

SEQ ID NO: 4764523 - DNA, 20 bp, Homo sapiens
cagacttctaaaataaatgt

SEQ ID NO: 4764524 - DNA, 15 bp, Homo sapiens
cagagaactcataaa

SEQ ID NO: 4764525 - DNA, 18 bp, Homo sapiens
cagagaagaaagaacgga

SEQ ID NO: 4764526 - DNA, 18 bp, Homo sapiens
caactctgactgtaaaat

SEQ ID NO: 4764527 - DNA, 11 bp, Homo sapiens
caactgacaca

SEQ ID NO: 4764528 - DNA, 13 bp, Homo sapiens
caactgacacagg

SEQ ID NO: 4764529 - DNA, 21 bp, Homo sapiens
caactgtggataaattttgga

SEQ ID NO: 4764530 - DNA, 18 bp, Homo sapiens
caactgttagctgggaag

SEQ ID NO: 4764531 - DNA, 14 bp, Homo sapiens
caacttcccaggcc

SEQ ID NO: 4764532 - DNA, 17 bp, Homo sapiens
caacttgctcctttcca

SEQ ID NO: 4764533 - DNA, 21 bp, Homo sapiens
caacttgctcctttccatcag

SEQ ID NO: 4764534 - DNA, 24 bp, Homo sapiens
caactttcactataatgtgaaatg

SEQ ID NO: 4764535 - DNA, 13 bp, Homo sapiens
caagacaatgaca

SEQ ID NO: 4764536 - DNA, 23 bp, Homo sapiens
caagaccttacaaccacatttct

SEQ ID NO: 4764537 - DNA, 21 bp, Homo sapiens
caagactctatgctctggaaa

SEQ ID NO: 4764538 - DNA, 15 bp, Homo sapiens
caagacttttctttg

SEQ ID NO: 4764539 - DNA, 15 bp, Homo sapiens
caagagaattcactt

SEQ ID NO: 4764540 - DNA, 18 bp, Homo sapiens
caagagaccacttcctta

SEQ ID NO: 4764541 - DNA, 23 bp, Homo sapiens
caagagaccacttccttaacagc

SEQ ID NO: 4764542 - DNA, 13 bp, Homo sapiens
caagagcccaggc

SEQ ID NO: 4764543 - DNA, 14 bp, Homo sapiens
caagagcccaggcc

SEQ ID NO: 4764544 - DNA, 15 bp, Homo sapiens
caagagctcaggaga

SEQ ID NO: 4764545 - DNA, 22 bp, Homo sapiens
caagagctcaggagaaggcctg

SEQ ID NO: 4764546 - DNA, 18 bp, Homo sapiens
caagagggactccaagcc

SEQ ID NO: 4764547 - DNA, 15 bp, Homo sapiens
caagatactggacta

SEQ ID NO: 4764548 - DNA, 18 bp, Homo sapiens
caagatactggactaagt

SEQ ID NO: 4764549 - DNA, 16 bp, Homo sapiens
caagattaattaaaat

SEQ ID NO: 4764550 - DNA, 20 bp, Homo sapiens
caagcaaagacagtttcttg

SEQ ID NO: 4764551 - DNA, 21 bp, Homo sapiens
caagcaaagacagtttcttgc

SEQ ID NO: 4764552 - DNA, 17 bp, Homo sapiens
caagcactagccttccc

SEQ ID NO: 4764553 - DNA, 15 bp, Homo sapiens
caagcatcacttttt

SEQ ID NO: 4764554 - DNA, 18 bp, Homo sapiens
caagcatcagcaagacaa

SEQ ID NO: 4764555 - DNA, 16 bp, Homo sapiens
caagccacgttgcaga

SEQ ID NO: 4764556 - DNA, 12 bp, Homo sapiens
caagccaggaga

SEQ ID NO: 4764557 - DNA, 19 bp, Homo sapiens
caagccaggagaccctgtc

SEQ ID NO: 4764558 - DNA, 20 bp, Homo sapiens
caagccaggagaccctgtct

SEQ ID NO: 4764559 - DNA, 12 bp, Homo sapiens
caagccaggccc

SEQ ID NO: 4764560 - DNA, 23 bp, Homo sapiens
caagcgacctaaacagctgcttt

SEQ ID NO: 4764561 - DNA, 14 bp, Homo sapiens
caagctcacttgct

SEQ ID NO: 4764562 - DNA, 16 bp, Homo sapiens
caagctcatagcacat

SEQ ID NO: 4764563 - DNA, 12 bp, Homo sapiens
caagctctcttg

SEQ ID NO: 4764564 - DNA, 19 bp, Homo sapiens
caagctcttcattgcactg

SEQ ID NO: 4764565 - DNA, 15 bp, Homo sapiens
caagctgatagtgtt

SEQ ID NO: 4764566 - DNA, 22 bp, Homo sapiens
caagctgctgccgcctcacctt

SEQ ID NO: 4764567 - DNA, 13 bp, Homo sapiens
caaggaaggacat

SEQ ID NO: 4764568 - DNA, 20 bp, Homo sapiens
caaggaagggatgtatttgt

SEQ ID NO: 4764569 - DNA, 14 bp, Homo sapiens
caaggcaaatgtcc

SEQ ID NO: 4764570 - DNA, 14 bp, Homo sapiens
caaggcaagaagtg

SEQ ID NO: 4764571 - DNA, 14 bp, Homo sapiens
caaggcaaggctgt

SEQ ID NO: 4764572 - DNA, 17 bp, Homo sapiens
caaggcacattgaaata

SEQ ID NO: 4764573 - DNA, 18 bp, Homo sapiens
caaggcatccccagtgcc

SEQ ID NO: 4764574 - DNA, 16 bp, Homo sapiens
caaggccaaaggaagc

SEQ ID NO: 4764575 - DNA, 17 bp, Homo sapiens
caaggccaaaggaagca

SEQ ID NO: 4764576 - DNA, 19 bp, Homo sapiens
caaggccaaaggaagcaca

SEQ ID NO: 4764577 - DNA, 14 bp, Homo sapiens
caaggccagcccac

SEQ ID NO: 4764578 - DNA, 15 bp, Homo sapiens
caaggcccacaggag

SEQ ID NO: 4764579 - DNA, 17 bp, Homo sapiens
caaggcccccacctctg

SEQ ID NO: 4764580 - DNA, 20 bp, Homo sapiens
caaggcccccacctctgtga

SEQ ID NO: 4764581 - DNA, 16 bp, Homo sapiens
caaggcctccagccac

SEQ ID NO: 4764582 - DNA, 14 bp, Homo sapiens
caaggggtggaagg

SEQ ID NO: 4764583 - DNA, 15 bp, Homo sapiens
caaggggtggaaggg

SEQ ID NO: 4764584 - DNA, 15 bp, Homo sapiens
cacaaagtgaaatta

SEQ ID NO: 4764585 - DNA, 17 bp, Homo sapiens
cacaaagtgaaattagt

SEQ ID NO: 4764586 - DNA, 13 bp, Homo sapiens
cacaacatgcaca

SEQ ID NO: 4764587 - DNA, 15 bp, Homo sapiens
cacaactaacaatgc

SEQ ID NO: 4764588 - DNA, 18 bp, Homo sapiens
cacaactaacaatgcctt

SEQ ID NO: 4764589 - DNA, 14 bp, Homo sapiens
cacaactgtggata

SEQ ID NO: 4764590 - DNA, 14 bp, Homo sapiens
cacaagagcccagg

SEQ ID NO: 4764591 - DNA, 14 bp, Homo sapiens
cacaagccttcggc

SEQ ID NO: 4764592 - DNA, 19 bp, Homo sapiens
cacaatattaagtgttgta

SEQ ID NO: 4764593 - DNA, 23 bp, Homo sapiens
cacaatattaagtgttgtacaat

SEQ ID NO: 4764594 - DNA, 16 bp, Homo sapiens
cacaattagatttctc

SEQ ID NO: 4764595 - DNA, 17 bp, Homo sapiens
cacaattagatttctca

SEQ ID NO: 4764596 - DNA, 19 bp, Homo sapiens
cacaatttgttgaatctca

SEQ ID NO: 4764597 - DNA, 22 bp, Homo sapiens
cacaatttgttgaatctcaggt

SEQ ID NO: 4764598 - DNA, 10 bp, Homo sapiens
cacacacaaa

SEQ ID NO: 4764599 - DNA, 14 bp, Homo sapiens
cacacacaaaacaa

SEQ ID NO: 4764600 - DNA, 10 bp, Homo sapiens
cacacacaca

SEQ ID NO: 4764601 - DNA, 12 bp, Homo sapiens
cacacacacaaa

SEQ ID NO: 4764602 - DNA, 12 bp, Homo sapiens
cacacacacaca

SEQ ID NO: 4764603 - DNA, 13 bp, Homo sapiens
cacacacacacac

SEQ ID NO: 4764604 - DNA, 16 bp, Homo sapiens
cacacacacacacaaa

SEQ ID NO: 4764605 - DNA, 14 bp, Homo sapiens
cacacacacccttc

SEQ ID NO: 4764606 - DNA, 18 bp, Homo sapiens
cacacacagcagctccaa

SEQ ID NO: 4764607 - DNA, 14 bp, Homo sapiens
cacacagcagcccc

SEQ ID NO: 4764608 - DNA, 20 bp, Homo sapiens
cacacagcagccccccagca

SEQ ID NO: 4764609 - DNA, 14 bp, Homo sapiens
cacacagcagctcc

SEQ ID NO: 4764610 - DNA, 15 bp, Homo sapiens
cacacagcagctcca

SEQ ID NO: 4764611 - DNA, 14 bp, Homo sapiens
cacacaggcctggc

SEQ ID NO: 4764612 - DNA, 17 bp, Homo sapiens
cacacaggcctggccca

SEQ ID NO: 4764613 - DNA, 18 bp, Homo sapiens
cacacaggcctggcccag

SEQ ID NO: 4764614 - DNA, 21 bp, Homo sapiens
cacacaggcctggcccagcca

SEQ ID NO: 4764615 - DNA, 15 bp, Homo sapiens
cacacagtgaccaag

SEQ ID NO: 4764616 - DNA, 13 bp, Homo sapiens
cacacataacaca

SEQ ID NO: 4764617 - DNA, 18 bp, Homo sapiens
cacacataacacacatca

SEQ ID NO: 4764618 - DNA, 14 bp, Homo sapiens
cacacatatacatt

SEQ ID NO: 4764619 - DNA, 14 bp, Homo sapiens
cacacatggaaggt

SEQ ID NO: 4764620 - DNA, 16 bp, Homo sapiens
cacaccccgtctgccc

SEQ ID NO: 4764621 - DNA, 19 bp, Homo sapiens
cacaccctcactctgccag

SEQ ID NO: 4764622 - DNA, 11 bp, Homo sapiens
cacaccctgca

SEQ ID NO: 4764623 - DNA, 12 bp, Homo sapiens
cacaccctgcaa

SEQ ID NO: 4764624 - DNA, 12 bp, Homo sapiens
cacacccttccc

SEQ ID NO: 4764625 - DNA, 15 bp, Homo sapiens
cacacccttccccac

SEQ ID NO: 4764626 - DNA, 16 bp, Homo sapiens
cacacccttccccact

SEQ ID NO: 4764627 - DNA, 18 bp, Homo sapiens
cacaccgcaccgggctgg

SEQ ID NO: 4764628 - DNA, 13 bp, Homo sapiens
cacaccggcactg

SEQ ID NO: 4764629 - DNA, 14 bp, Homo sapiens
cacacctccacccg

SEQ ID NO: 4764630 - DNA, 15 bp, Homo sapiens
cacacctcccttcat

SEQ ID NO: 4764631 - DNA, 16 bp, Homo sapiens
cacacctgagaatgtg

SEQ ID NO: 4764632 - DNA, 15 bp, Homo sapiens
cacaccttacaaagc

SEQ ID NO: 4764633 - DNA, 18 bp, Homo sapiens
cacaccttacaaagccag

SEQ ID NO: 4764634 - DNA, 22 bp, Homo sapiens
cacaccttacaaagccagctct

SEQ ID NO: 4764635 - DNA, 18 bp, Homo sapiens
cacacgccggggctggcc

SEQ ID NO: 4764636 - DNA, 20 bp, Homo sapiens
cacacgccggggctggccct

SEQ ID NO: 4764637 - DNA, 21 bp, Homo sapiens
cacacgccggggctggccctg

SEQ ID NO: 4764638 - DNA, 23 bp, Homo sapiens
cacacgccggggctggccctgcc

SEQ ID NO: 4764639 - DNA, 16 bp, Homo sapiens
cacacgcgtccacata

SEQ ID NO: 4764640 - DNA, 19 bp, Homo sapiens
cacacggggcacccagccc

SEQ ID NO: 4764641 - DNA, 16 bp, Homo sapiens
cacacgtgcaatttgt

SEQ ID NO: 4764642 - DNA, 14 bp, Homo sapiens
cacactcaccattt

SEQ ID NO: 4764643 - DNA, 14 bp, Homo sapiens
cacactctcttctt

SEQ ID NO: 4764644 - DNA, 12 bp, Homo sapiens
cacactctgacg

SEQ ID NO: 4764645 - DNA, 14 bp, Homo sapiens
cacactgccctctg

SEQ ID NO: 4764646 - DNA, 12 bp, Homo sapiens
cacactggagga

SEQ ID NO: 4764647 - DNA, 14 bp, Homo sapiens
cacacttgggctgg

SEQ ID NO: 4764648 - DNA, 15 bp, Homo sapiens
cacacttgggctggc

SEQ ID NO: 4764649 - DNA, 20 bp, Homo sapiens
cacagaaaatggaagacagc

SEQ ID NO: 4764650 - DNA, 19 bp, Homo sapiens
cacagaaaattcttctcca

SEQ ID NO: 4764651 - DNA, 15 bp, Homo sapiens
cacagacccctgggg

SEQ ID NO: 4764652 - DNA, 16 bp, Homo sapiens
cacagacccctggggg

SEQ ID NO: 4764653 - DNA, 18 bp, Homo sapiens
cacagacccctgggggag

SEQ ID NO: 4764654 - DNA, 20 bp, Homo sapiens
cacagactctgtgagattct

SEQ ID NO: 4764655 - DNA, 13 bp, Homo sapiens
cacagactgctgt

SEQ ID NO: 4764656 - DNA, 19 bp, Homo sapiens
cacagaggacggcttcccc

SEQ ID NO: 4764657 - DNA, 19 bp, Homo sapiens
cacagaggatggcttcccc

SEQ ID NO: 4764658 - DNA, 10 bp, Homo sapiens
cacagatcca

SEQ ID NO: 4764659 - DNA, 14 bp, Homo sapiens
cacagattatttgt

SEQ ID NO: 4764660 - DNA, 13 bp, Homo sapiens
cacagcacatgct

SEQ ID NO: 4764661 - DNA, 19 bp, Homo sapiens
cacagcacatgctggccag

SEQ ID NO: 4764662 - DNA, 23 bp, Homo sapiens
cacagcacatgctggccagcctg

SEQ ID NO: 4764663 - DNA, 15 bp, Homo sapiens
cacagcacatttgtt

SEQ ID NO: 4764664 - DNA, 18 bp, Homo sapiens
cacagcagccccccagca

SEQ ID NO: 4764665 - DNA, 12 bp, Homo sapiens
cacagcagcctg

SEQ ID NO: 4764666 - DNA, 13 bp, Homo sapiens
cacagcatgcatt

SEQ ID NO: 4764667 - DNA, 15 bp, Homo sapiens
cacagcatgcattta

SEQ ID NO: 4764668 - DNA, 19 bp, Homo sapiens
cacagccaataaacaccag

SEQ ID NO: 4764669 - DNA, 15 bp, Homo sapiens
cacagccaccacctg

SEQ ID NO: 4764670 - DNA, 23 bp, Homo sapiens
cacagccagaaactgaactggcc

SEQ ID NO: 4764671 - DNA, 15 bp, Homo sapiens
cacagccatagcaga

SEQ ID NO: 4764672 - DNA, 17 bp, Homo sapiens
cacagcccagagactga

SEQ ID NO: 4764673 - DNA, 14 bp, Homo sapiens
cacagccccttgct

SEQ ID NO: 4764674 - DNA, 20 bp, Homo sapiens
cacagcctttgcgctctggg

SEQ ID NO: 4764675 - DNA, 23 bp, Homo sapiens
cacagcctttgcgctctgggttt

SEQ ID NO: 4764676 - DNA, 15 bp, Homo sapiens
cacagctaacatgga

SEQ ID NO: 4764677 - DNA, 12 bp, Homo sapiens
cacaggagccgc

SEQ ID NO: 4764678 - DNA, 14 bp, Homo sapiens
cacaggagccgcag

SEQ ID NO: 4764679 - DNA, 17 bp, Homo sapiens
cacaggagccgcagagg

SEQ ID NO: 4764680 - DNA, 20 bp, Homo sapiens
cacaggagccgcagaggccc

SEQ ID NO: 4764681 - DNA, 21 bp, Homo sapiens
cacaggagccgcagaggcccg

SEQ ID NO: 4764682 - DNA, 17 bp, Homo sapiens
cacaggagcgtgtccta

SEQ ID NO: 4764683 - DNA, 22 bp, Homo sapiens
cacaggagctccctttttgaat

SEQ ID NO: 4764684 - DNA, 15 bp, Homo sapiens
cacaggaggcaagca

SEQ ID NO: 4764685 - DNA, 15 bp, Homo sapiens
cacaggatcctggcc

SEQ ID NO: 4764686 - DNA, 18 bp, Homo sapiens
cacaggatcctggcctga

SEQ ID NO: 4764687 - DNA, 14 bp, Homo sapiens
cacaggcctggccc

SEQ ID NO: 4764688 - DNA, 19 bp, Homo sapiens
cacaggcctggcccagcca

SEQ ID NO: 4764689 - DNA, 17 bp, Homo sapiens
cacaggggaaaagagga

SEQ ID NO: 4764690 - DNA, 15 bp, Homo sapiens
cacagggtgttggaa

SEQ ID NO: 4764691 - DNA, 16 bp, Homo sapiens
cacaggtgtaaatata

SEQ ID NO: 4764692 - DNA, 20 bp, Homo sapiens
cacagtaatctttcggtctc

SEQ ID NO: 4764693 - DNA, 23 bp, Homo sapiens
cacagtagtgttgggtggaggat

SEQ ID NO: 4764694 - DNA, 15 bp, Homo sapiens
cacagtatttaacat

SEQ ID NO: 4764695 - DNA, 15 bp, Homo sapiens
cacagtcttttccta

SEQ ID NO: 4764696 - DNA, 14 bp, Homo sapiens
cacagtggggccca

SEQ ID NO: 4764697 - DNA, 20 bp, Homo sapiens
cacagttctggctataaact

SEQ ID NO: 4764698 - DNA, 18 bp, Homo sapiens
cacagttcttggtgactg

SEQ ID NO: 4764699 - DNA, 22 bp, Homo sapiens
cacagttcttggtgactgtccc

SEQ ID NO: 4764700 - DNA, 13 bp, Homo sapiens
cacagttttgtct

SEQ ID NO: 4764701 - DNA, 23 bp, Homo sapiens
cacataaacacttctccttaacc

SEQ ID NO: 4764702 - DNA, 13 bp, Homo sapiens
cacataacacaca

SEQ ID NO: 4764703 - DNA, 18 bp, Homo sapiens
cacatagattaatggcac

SEQ ID NO: 4764704 - DNA, 23 bp, Homo sapiens
cacctgtaaaactttattttata

SEQ ID NO: 4764705 - DNA, 18 bp, Homo sapiens
caccttacaaagccagct

SEQ ID NO: 4764706 - DNA, 14 bp, Homo sapiens
caccttcccagctg

SEQ ID NO: 4764707 - DNA, 14 bp, Homo sapiens
caccttcctgggca

SEQ ID NO: 4764708 - DNA, 15 bp, Homo sapiens
caccttcctgggcag

SEQ ID NO: 4764709 - DNA, 21 bp, Homo sapiens
caccttcctgggcagcccaga

SEQ ID NO: 4764710 - DNA, 15 bp, Homo sapiens
caccttctgtgcatc

SEQ ID NO: 4764711 - DNA, 21 bp, Homo sapiens
caccttctgtgcatctggcct

SEQ ID NO: 4764712 - DNA, 17 bp, Homo sapiens
caccttgaatctgcctg

SEQ ID NO: 4764713 - DNA, 18 bp, Homo sapiens
caccttgccaatggtgta

SEQ ID NO: 4764714 - DNA, 18 bp, Homo sapiens
caccttgtacagaaccag

SEQ ID NO: 4764715 - DNA, 22 bp, Homo sapiens
cacctttagaatattaaaaatt

SEQ ID NO: 4764716 - DNA, 14 bp, Homo sapiens
cacctttccgtgcc

SEQ ID NO: 4764717 - DNA, 20 bp, Homo sapiens
cacctttgggcaaaggcccc

SEQ ID NO: 4764718 - DNA, 22 bp, Homo sapiens
cacctttgtaaatacacaattc

SEQ ID NO: 4764719 - DNA, 13 bp, Homo sapiens
cacgatcggcctt

SEQ ID NO: 4764720 - DNA, 19 bp, Homo sapiens
cacgatcggccttggtaac

SEQ ID NO: 4764721 - DNA, 13 bp, Homo sapiens
cacgattccagtg

SEQ ID NO: 4764722 - DNA, 15 bp, Homo sapiens
cacgattccagtgca

SEQ ID NO: 4764723 - DNA, 13 bp, Homo sapiens
cacgcaacttgaa

SEQ ID NO: 4764724 - DNA, 15 bp, Homo sapiens
cacgcaacttgaaat

SEQ ID NO: 4764725 - DNA, 21 bp, Homo sapiens
cacgcagagccccggagcacc

SEQ ID NO: 4764726 - DNA, 23 bp, Homo sapiens
cacgcagagccccggagcaccac

SEQ ID NO: 4764727 - DNA, 20 bp, Homo sapiens
cacgccggggctggccctgc

SEQ ID NO: 4764728 - DNA, 21 bp, Homo sapiens
cacgccggggctggccctgcc

SEQ ID NO: 4764729 - DNA, 22 bp, Homo sapiens
cacgccggggctggccctgccc

SEQ ID NO: 4764730 - DNA, 17 bp, Homo sapiens
cacgcctcctggccaga

SEQ ID NO: 4764731 - DNA, 20 bp, Homo sapiens
cacgcttagggtctgtcccg

SEQ ID NO: 4764732 - DNA, 20 bp, Homo sapiens
cacggagggtgacgggggtg

SEQ ID NO: 4764733 - DNA, 16 bp, Homo sapiens
cacggctaagaggctg

SEQ ID NO: 4764734 - DNA, 16 bp, Homo sapiens
cacgggagagcgccac

SEQ ID NO: 4764735 - DNA, 22 bp, Homo sapiens
cacgggagagcgccacccgccc

SEQ ID NO: 4764736 - DNA, 12 bp, Homo sapiens
cacgggcccgct

SEQ ID NO: 4764737 - DNA, 18 bp, Homo sapiens
cacgggcccgctcaacct

SEQ ID NO: 4764738 - DNA, 23 bp, Homo sapiens
cacgggcccgctcaacctctcag

SEQ ID NO: 4764739 - DNA, 22 bp, Homo sapiens
cacgggcgttatgtaagtttct

SEQ ID NO: 4764740 - DNA, 16 bp, Homo sapiens
cacggggcacccagcc

SEQ ID NO: 4764741 - DNA, 19 bp, Homo sapiens
cacggggtcgggggaggag

SEQ ID NO: 4764742 - DNA, 23 bp, Homo sapiens
cacggggtcgggggaggagcacc

SEQ ID NO: 4764743 - DNA, 20 bp, Homo sapiens
cacgtccctcgagctctgta

SEQ ID NO: 4764744 - DNA, 16 bp, Homo sapiens
cacgtctccctggccc

SEQ ID NO: 4764745 - DNA, 18 bp, Homo sapiens
cacgtctccctggcccca

SEQ ID NO: 4764746 - DNA, 16 bp, Homo sapiens
cacgtgaccctgtgcc

SEQ ID NO: 4764747 - DNA, 23 bp, Homo sapiens
cacgtgaccctgtgccccgcctc

SEQ ID NO: 4764748 - DNA, 19 bp, Homo sapiens
cacgtgactcctcaattcc

SEQ ID NO: 4764749 - DNA, 15 bp, Homo sapiens
cacgtggggtggaat

SEQ ID NO: 4764750 - DNA, 20 bp, Homo sapiens
cacgtgtttcgggccagggc

SEQ ID NO: 4764751 - DNA, 19 bp, Homo sapiens
cactaaaagtgatgtgatt

SEQ ID NO: 4764752 - DNA, 21 bp, Homo sapiens
cactaaaagtgatgtgattta

SEQ ID NO: 4764753 - DNA, 21 bp, Homo sapiens
cactaaacttggtgcttattg

SEQ ID NO: 4764754 - DNA, 23 bp, Homo sapiens
cactaaggccgtgtctctgagga

SEQ ID NO: 4764755 - DNA, 22 bp, Homo sapiens
cactaatggccaagtgtacatt

SEQ ID NO: 4764756 - DNA, 23 bp, Homo sapiens
cactacgcctggctgatttttgt

SEQ ID NO: 4764757 - DNA, 16 bp, Homo sapiens
cactagaatgagaaat

SEQ ID NO: 4764758 - DNA, 15 bp, Homo sapiens
cactagccctctttc

SEQ ID NO: 4764759 - DNA, 14 bp, Homo sapiens
cactagccttccca

SEQ ID NO: 4764760 - DNA, 15 bp, Homo sapiens
cactagccttcccag

SEQ ID NO: 4764761 - DNA, 20 bp, Homo sapiens
cactaggtgcccagtcttga

SEQ ID NO: 4764762 - DNA, 17 bp, Homo sapiens
cactagtggggtcctga

SEQ ID NO: 4764763 - DNA, 16 bp, Homo sapiens
cactatccatgcacca

SEQ ID NO: 4764764 - DNA, 21 bp, Homo sapiens
cactatggtatgctggccagc

SEQ ID NO: 4764765 - DNA, 22 bp, Homo sapiens
cactatggtatgctggccagca

SEQ ID NO: 4764766 - DNA, 13 bp, Homo sapiens
cactcaggagcac

SEQ ID NO: 4764767 - DNA, 16 bp, Homo sapiens
cactcaggagcacagc

SEQ ID NO: 4764768 - DNA, 17 bp, Homo sapiens
cactcaggagcacagcc

SEQ ID NO: 4764769 - DNA, 19 bp, Homo sapiens
cactcaggagcacagccat

SEQ ID NO: 4764770 - DNA, 21 bp, Homo sapiens
cactcaggagcacagccatag

SEQ ID NO: 4764771 - DNA, 15 bp, Homo sapiens
cactcccagggcccg

SEQ ID NO: 4764772 - DNA, 12 bp, Homo sapiens
cactcccctcat

SEQ ID NO: 4764773 - DNA, 14 bp, Homo sapiens
cactcctcccaact

SEQ ID NO: 4764774 - DNA, 22 bp, Homo sapiens
cactcgtgtgcatgagaatgtc

SEQ ID NO: 4764775 - DNA, 18 bp, Homo sapiens
cactctaactgtatattt

SEQ ID NO: 4764776 - DNA, 22 bp, Homo sapiens
cactctagttgtggacttttcc

SEQ ID NO: 4764777 - DNA, 13 bp, Homo sapiens
cactctcaccccc

SEQ ID NO: 4764778 - DNA, 14 bp, Homo sapiens
cactctcacccccc

SEQ ID NO: 4764779 - DNA, 21 bp, Homo sapiens
cactctgaagtcccttcctgt

SEQ ID NO: 4764780 - DNA, 15 bp, Homo sapiens
cactctgaccgggct

SEQ ID NO: 4764781 - DNA, 12 bp, Homo sapiens
cactctgccagg

SEQ ID NO: 4764782 - DNA, 13 bp, Homo sapiens
attgtcagaatgt

SEQ ID NO: 4764783 - DNA, 22 bp, Homo sapiens
attgtccacaaatgtcctcaga

SEQ ID NO: 4764784 - DNA, 18 bp, Homo sapiens
attgtctaaccaattgtg

SEQ ID NO: 4764785 - DNA, 18 bp, Homo sapiens
attgtctgaaattttcta

SEQ ID NO: 4764786 - DNA, 12 bp, Homo sapiens
attgtctgctgc

SEQ ID NO: 4764787 - DNA, 13 bp, Homo sapiens
attgtctgctgcc

SEQ ID NO: 4764788 - DNA, 14 bp, Homo sapiens
attgtctgtaaatc

SEQ ID NO: 4764789 - DNA, 20 bp, Homo sapiens
attgtgagaattactgtttg

SEQ ID NO: 4764790 - DNA, 19 bp, Homo sapiens
attgtgagatcctgtgatt

SEQ ID NO: 4764791 - DNA, 24 bp, Homo sapiens
attgtgtaaattcctgttgtctga

SEQ ID NO: 4764792 - DNA, 19 bp, Homo sapiens
attgttaaaaccttactta

SEQ ID NO: 4764793 - DNA, 16 bp, Homo sapiens
attgttaaatgataag

SEQ ID NO: 4764794 - DNA, 19 bp, Homo sapiens
attgttacaggtgtactat

SEQ ID NO: 4764795 - DNA, 16 bp, Homo sapiens
attgttagatgtttgt

SEQ ID NO: 4764796 - DNA, 12 bp, Homo sapiens
attgttatgtaa

SEQ ID NO: 4764797 - DNA, 16 bp, Homo sapiens
attgttcagaaaagca

SEQ ID NO: 4764798 - DNA, 15 bp, Homo sapiens
attgttcctccccag

SEQ ID NO: 4764799 - DNA, 12 bp, Homo sapiens
attgttggcagt

SEQ ID NO: 4764800 - DNA, 17 bp, Homo sapiens
attgttggcagtttcct

SEQ ID NO: 4764801 - DNA, 15 bp, Homo sapiens
attgtttaatgcaaa

SEQ ID NO: 4764802 - DNA, 20 bp, Homo sapiens
attgtttgatgaataaaatg

SEQ ID NO: 4764803 - DNA, 18 bp, Homo sapiens
attgtttggcttcctcct

SEQ ID NO: 4764804 - DNA, 14 bp, Homo sapiens
attgtttttatata

SEQ ID NO: 4764805 - DNA, 17 bp, Homo sapiens
attgtttttatatatta

SEQ ID NO: 4764806 - DNA, 23 bp, Homo sapiens
attgtttttatatattataagtt

SEQ ID NO: 4764807 - DNA, 20 bp, Homo sapiens
atttaaaacaagctgatagt

SEQ ID NO: 4764808 - DNA, 16 bp, Homo sapiens
atttaaaggaaagttc

SEQ ID NO: 4764809 - DNA, 16 bp, Homo sapiens
atttaaatttaagtaa

SEQ ID NO: 4764810 - DNA, 20 bp, Homo sapiens
atttaacattcttggtcaca

SEQ ID NO: 4764811 - DNA, 15 bp, Homo sapiens
atttaactagcactt

SEQ ID NO: 4764812 - DNA, 22 bp, Homo sapiens
atttaagaattgccagtctttt

SEQ ID NO: 4764813 - DNA, 12 bp, Homo sapiens
atttaagcacaa

SEQ ID NO: 4764814 - DNA, 17 bp, Homo sapiens
atttaagtggactgtat

SEQ ID NO: 4764815 - DNA, 19 bp, Homo sapiens
atttaagtggactgtattt

SEQ ID NO: 4764816 - DNA, 22 bp, Homo sapiens
atttaatcatttccagcaaaat

SEQ ID NO: 4764817 - DNA, 19 bp, Homo sapiens
atttaatgtttgtaagcaa

SEQ ID NO: 4764818 - DNA, 23 bp, Homo sapiens
atttaattcttaccgaaatgaaa

SEQ ID NO: 4764819 - DNA, 16 bp, Homo sapiens
atttacaacttccaga

SEQ ID NO: 4764820 - DNA, 21 bp, Homo sapiens
atttacaacttccagatttga

SEQ ID NO: 4764821 - DNA, 13 bp, Homo sapiens
atttaccagaagt

SEQ ID NO: 4764822 - DNA, 21 bp, Homo sapiens
atttaccatcaaacaaatcat

SEQ ID NO: 4764823 - DNA, 18 bp, Homo sapiens
atttactaacagtaactg

SEQ ID NO: 4764824 - DNA, 19 bp, Homo sapiens
atttagaggataaataata

SEQ ID NO: 4764825 - DNA, 22 bp, Homo sapiens
atttagaggataaataataaag

SEQ ID NO: 4764826 - DNA, 13 bp, Homo sapiens
atttagcacagta

SEQ ID NO: 4764827 - DNA, 16 bp, Homo sapiens
atttagcacagtattt

SEQ ID NO: 4764828 - DNA, 20 bp, Homo sapiens
atttagcacagtatttaaca

SEQ ID NO: 4764829 - DNA, 21 bp, Homo sapiens
atttagcacagtatttaacat

SEQ ID NO: 4764830 - DNA, 15 bp, Homo sapiens
atttagctgtatcaa

SEQ ID NO: 4764831 - DNA, 18 bp, Homo sapiens
atttaggcatgagctctt

SEQ ID NO: 4764832 - DNA, 19 bp, Homo sapiens
atttagggttctatattta

SEQ ID NO: 4764833 - DNA, 16 bp, Homo sapiens
atttagtatctgtaat

SEQ ID NO: 4764834 - DNA, 16 bp, Homo sapiens
atttagtcctcacctt

SEQ ID NO: 4764835 - DNA, 13 bp, Homo sapiens
atttataaatgaa

SEQ ID NO: 4764836 - DNA, 17 bp, Homo sapiens
atttataaatgaagatg

SEQ ID NO: 4764837 - DNA, 14 bp, Homo sapiens
atttatattagagt

SEQ ID NO: 4764838 - DNA, 15 bp, Homo sapiens
atttatattcagaga

SEQ ID NO: 4764839 - DNA, 17 bp, Homo sapiens
atttatctgtctgagcc

SEQ ID NO: 4764840 - DNA, 14 bp, Homo sapiens
atttatctgtgaat

SEQ ID NO: 4764841 - DNA, 21 bp, Homo sapiens
atttatcttccatatgctctt

SEQ ID NO: 4764842 - DNA, 13 bp, Homo sapiens
atttatgcatgag

SEQ ID NO: 4764843 - DNA, 15 bp, Homo sapiens
atttatgcatgagaa

SEQ ID NO: 4764844 - DNA, 16 bp, Homo sapiens
atttatgcatgagaac

SEQ ID NO: 4764845 - DNA, 18 bp, Homo sapiens
atttatgcatttatgcat

SEQ ID NO: 4764846 - DNA, 21 bp, Homo sapiens
atttatgttatttatgatgtt

SEQ ID NO: 4764847 - DNA, 13 bp, Homo sapiens
atttattaaatgt

SEQ ID NO: 4764848 - DNA, 14 bp, Homo sapiens
atttattaaatgtt

SEQ ID NO: 4764849 - DNA, 23 bp, Homo sapiens
atttattaaatttattaaatgtt

SEQ ID NO: 4764850 - DNA, 23 bp, Homo sapiens
atttattagttaggtgtgccaaa

SEQ ID NO: 4764851 - DNA, 14 bp, Homo sapiens
atttattattttca

SEQ ID NO: 4764852 - DNA, 15 bp, Homo sapiens
atttattctcagaac

SEQ ID NO: 4764853 - DNA, 21 bp, Homo sapiens
atttattctcagaacaccaag

SEQ ID NO: 4764854 - DNA, 12 bp, Homo sapiens
atttattgcttt

SEQ ID NO: 4764855 - DNA, 20 bp, Homo sapiens
atttattgtatatatggata

SEQ ID NO: 4764856 - DNA, 16 bp, Homo sapiens
atttatttcatccagt

SEQ ID NO: 4764857 - DNA, 15 bp, Homo sapiens
atttattttgtatga

SEQ ID NO: 4764858 - DNA, 16 bp, Homo sapiens
atttcaaagaaaacag

SEQ ID NO: 4764859 - DNA, 21 bp, Homo sapiens
atttcaaccacacctaaatta

SEQ ID NO: 4764860 - DNA, 23 bp, Homo sapiens
atttcaatgattgtttaattgta

SEQ ID NO: 4764861 - DNA, 14 bp, Homo sapiens
atttcacattcctg

SEQ ID NO: 4764862 - DNA, 23 bp, Homo sapiens
atttcaccccatccctccttaag

SEQ ID NO: 4764863 - DNA, 14 bp, Homo sapiens
atttcagatgcttt

SEQ ID NO: 4764864 - DNA, 14 bp, Homo sapiens
atttcatcaagatt

SEQ ID NO: 4764865 - DNA, 13 bp, Homo sapiens
atttcatgtccat

SEQ ID NO: 4764866 - DNA, 19 bp, Homo sapiens
atttcattgagggaaaaca

SEQ ID NO: 4764867 - DNA, 16 bp, Homo sapiens
atttccatattaaaat

SEQ ID NO: 4764868 - DNA, 18 bp, Homo sapiens
atttccatattaaaatca

SEQ ID NO: 4764869 - DNA, 16 bp, Homo sapiens
atttcccaaagcagtg

SEQ ID NO: 4764870 - DNA, 21 bp, Homo sapiens
atttccgaagaccttctgaag

SEQ ID NO: 4764871 - DNA, 14 bp, Homo sapiens
atttcctgtgagga

SEQ ID NO: 4764872 - DNA, 12 bp, Homo sapiens
atttccttgtct

SEQ ID NO: 4764873 - DNA, 13 bp, Homo sapiens
atttctaaaacat

SEQ ID NO: 4764874 - DNA, 17 bp, Homo sapiens
atttctaaaacattaat

SEQ ID NO: 4764875 - DNA, 16 bp, Homo sapiens
atttctatggcatatt

SEQ ID NO: 4764876 - DNA, 14 bp, Homo sapiens
atttctccattaaa

SEQ ID NO: 4764877 - DNA, 15 bp, Homo sapiens
atttctcctctttct

SEQ ID NO: 4764878 - DNA, 18 bp, Homo sapiens
atttctcgggtgcatttg

SEQ ID NO: 4764879 - DNA, 15 bp, Homo sapiens
atttctgccatttca

SEQ ID NO: 4764880 - DNA, 14 bp, Homo sapiens
atttctgtatatag

SEQ ID NO: 4764881 - DNA, 17 bp, Homo sapiens
atttctgtatatagatg

SEQ ID NO: 4764882 - DNA, 16 bp, Homo sapiens
atttcttccacaagag

SEQ ID NO: 4764883 - DNA, 13 bp, Homo sapiens
atttctttcatca

SEQ ID NO: 4764884 - DNA, 19 bp, Homo sapiens
atttgaaaagcccacataa

SEQ ID NO: 4764885 - DNA, 22 bp, Homo sapiens
atttgaacagggcaaaatgaac

SEQ ID NO: 4764886 - DNA, 13 bp, Homo sapiens
atttgacacactc

SEQ ID NO: 4764887 - DNA, 20 bp, Homo sapiens
atttgacacactcaccattt

SEQ ID NO: 4764888 - DNA, 21 bp, Homo sapiens
atttgacattgtcagaatgtt

SEQ ID NO: 4764889 - DNA, 22 bp, Homo sapiens
atttgatatacagacctccaga

SEQ ID NO: 4764890 - DNA, 22 bp, Homo sapiens
atttgatattgtgtaggaaatc

SEQ ID NO: 4764891 - DNA, 19 bp, Homo sapiens
atttgatttgatatacaga

SEQ ID NO: 4764892 - DNA, 18 bp, Homo sapiens
atttgatttgcaacactg

SEQ ID NO: 4764893 - DNA, 22 bp, Homo sapiens
atttgcaacactgccaaacatc

SEQ ID NO: 4764894 - DNA, 22 bp, Homo sapiens
atttgcaacaggaagacactgg

SEQ ID NO: 4764895 - DNA, 18 bp, Homo sapiens
atttgccagacagagatc

SEQ ID NO: 4764896 - DNA, 19 bp, Homo sapiens
atttgccagacagagatca

SEQ ID NO: 4764897 - DNA, 14 bp, Homo sapiens
atttgctaatgaat

SEQ ID NO: 4764898 - DNA, 19 bp, Homo sapiens
atttgctaatgaattttaa

SEQ ID NO: 4764899 - DNA, 15 bp, Homo sapiens
atttgctcataagta

SEQ ID NO: 4764900 - DNA, 20 bp, Homo sapiens
atttgctcataagtaaatgt

SEQ ID NO: 4764901 - DNA, 10 bp, Homo sapiens
atttgctgaa

SEQ ID NO: 4764902 - DNA, 18 bp, Homo sapiens
atttgcttatttatattc

SEQ ID NO: 4764903 - DNA, 19 bp, Homo sapiens
atttggaatcatatgggat

SEQ ID NO: 4764904 - DNA, 13 bp, Homo sapiens
atttggattttaa

SEQ ID NO: 4764905 - DNA, 19 bp, Homo sapiens
atttgggctgaatgtatgt

SEQ ID NO: 4764906 - DNA, 22 bp, Homo sapiens
atttgggctgaatgtatgtaaa

SEQ ID NO: 4764907 - DNA, 13 bp, Homo sapiens
atttgtattaatg

SEQ ID NO: 4764908 - DNA, 14 bp, Homo sapiens
atttgtatttatat

SEQ ID NO: 4764909 - DNA, 20 bp, Homo sapiens
atttgtatttatattagagt

SEQ ID NO: 4764910 - DNA, 22 bp, Homo sapiens
atttgtcagtgtagatcaactc

SEQ ID NO: 4764911 - DNA, 19 bp, Homo sapiens
atttgtcgggttctcccat

SEQ ID NO: 4764912 - DNA, 21 bp, Homo sapiens
atttgtcgggttctcccatga

SEQ ID NO: 4764913 - DNA, 14 bp, Homo sapiens
atttgtgtaactga

SEQ ID NO: 4764914 - DNA, 18 bp, Homo sapiens
atttgttaatgattcttg

SEQ ID NO: 4764915 - DNA, 11 bp, Homo sapiens
atttgttcatt

SEQ ID NO: 4764916 - DNA, 21 bp, Homo sapiens
atttgttctgggttaacagta

SEQ ID NO: 4764917 - DNA, 16 bp, Homo sapiens
atttgtttgtgcttct

SEQ ID NO: 4764918 - DNA, 13 bp, Homo sapiens
attttaaaagcat

SEQ ID NO: 4764919 - DNA, 20 bp, Homo sapiens
attttaaaatctcctaaatg

SEQ ID NO: 4764920 - DNA, 19 bp, Homo sapiens
attttaaaatgcaaatatt

SEQ ID NO: 4764921 - DNA, 15 bp, Homo sapiens
attttaaacaaaatt

SEQ ID NO: 4764922 - DNA, 20 bp, Homo sapiens
attttaaacaaaatttatgt

SEQ ID NO: 4764923 - DNA, 12 bp, Homo sapiens
attttaaatgtc

SEQ ID NO: 4764924 - DNA, 15 bp, Homo sapiens
attttaaatgtctat

SEQ ID NO: 4764925 - DNA, 21 bp, Homo sapiens
attttaacatagcagctggtt

SEQ ID NO: 4764926 - DNA, 13 bp, Homo sapiens
attttaataaaga

SEQ ID NO: 4764927 - DNA, 19 bp, Homo sapiens
attttagcagttctgcaaa

SEQ ID NO: 4764928 - DNA, 20 bp, Homo sapiens
attttagcagttctgcaaat

SEQ ID NO: 4764929 - DNA, 21 bp, Homo sapiens
attttagcagttctgcaaata

SEQ ID NO: 4764930 - DNA, 15 bp, Homo sapiens
attttagctaattta

SEQ ID NO: 4764931 - DNA, 16 bp, Homo sapiens
attttagctaatttag

SEQ ID NO: 4764932 - DNA, 14 bp, Homo sapiens
attttagttaacta

SEQ ID NO: 4764933 - DNA, 18 bp, Homo sapiens
attttatagtgtgttgtg

SEQ ID NO: 4764934 - DNA, 14 bp, Homo sapiens
attttatctcttct

SEQ ID NO: 4764935 - DNA, 14 bp, Homo sapiens
attttatgtttaaa

SEQ ID NO: 4764936 - DNA, 21 bp, Homo sapiens
attttatgtttaaaatggcat

SEQ ID NO: 4764937 - DNA, 14 bp, Homo sapiens
attttcatcaagta

SEQ ID NO: 4764938 - DNA, 22 bp, Homo sapiens
attttccctcagaaaatgagta

SEQ ID NO: 4764939 - DNA, 14 bp, Homo sapiens
attttcctgggagt

SEQ ID NO: 4764940 - DNA, 15 bp, Homo sapiens
attttcgcccaccta

SEQ ID NO: 4764941 - DNA, 13 bp, Homo sapiens
attttcgtgcatt

SEQ ID NO: 4764942 - DNA, 16 bp, Homo sapiens
attttcgtgcatttgt

SEQ ID NO: 4764943 - DNA, 17 bp, Homo sapiens
attttcgtgcatttgtg

SEQ ID NO: 4764944 - DNA, 22 bp, Homo sapiens
attttctagaatactaataaaa

SEQ ID NO: 4764945 - DNA, 18 bp, Homo sapiens
attttctctcctcggtgg

SEQ ID NO: 4764946 - DNA, 15 bp, Homo sapiens
attttctgtaattct

SEQ ID NO: 4764947 - DNA, 18 bp, Homo sapiens
attttctgttatacacag

SEQ ID NO: 4764948 - DNA, 17 bp, Homo sapiens
attttcttcccatttgt

SEQ ID NO: 4764949 - DNA, 20 bp, Homo sapiens
attttcttctttaatttttc

SEQ ID NO: 4764950 - DNA, 12 bp, Homo sapiens
attttgaaatat

SEQ ID NO: 4764951 - DNA, 18 bp, Homo sapiens
attttgacactgaaataa

SEQ ID NO: 4764952 - DNA, 21 bp, Homo sapiens
attttgagccttattaaaata

SEQ ID NO: 4764953 - DNA, 15 bp, Homo sapiens
attttgatgtattat

SEQ ID NO: 4764954 - DNA, 20 bp, Homo sapiens
attttgattgtttgatgaat

SEQ ID NO: 4764955 - DNA, 19 bp, Homo sapiens
attttggaaaatgattagg

SEQ ID NO: 4764956 - DNA, 20 bp, Homo sapiens
attttggaagaattcatgat

SEQ ID NO: 4764957 - DNA, 22 bp, Homo sapiens
attttgggggtttttaatcttt

SEQ ID NO: 4764958 - DNA, 18 bp, Homo sapiens
attttgtaaaatgtatta

SEQ ID NO: 4764959 - DNA, 12 bp, Homo sapiens
attttgtagcta

SEQ ID NO: 4764960 - DNA, 16 bp, Homo sapiens
attttgtatgaaatat

SEQ ID NO: 4764961 - DNA, 12 bp, Homo sapiens
attttgtctcta

SEQ ID NO: 4764962 - DNA, 20 bp, Homo sapiens
attttgtctctagttgactt

SEQ ID NO: 4764963 - DNA, 12 bp, Homo sapiens
attttgtctggc

SEQ ID NO: 4764964 - DNA, 15 bp, Homo sapiens
attttgtctggctgt

SEQ ID NO: 4764965 - DNA, 20 bp, Homo sapiens
attttgtggcttttaaagaa

SEQ ID NO: 4764966 - DNA, 19 bp, Homo sapiens
atttttaacttatctccag

SEQ ID NO: 4764967 - DNA, 14 bp, Homo sapiens
atttttactcaggc

SEQ ID NO: 4764968 - DNA, 15 bp, Homo sapiens
atttttactcaggct

SEQ ID NO: 4764969 - DNA, 18 bp, Homo sapiens
atttttactcaggctttc

SEQ ID NO: 4764970 - DNA, 20 bp, Homo sapiens
atttttactcaggctttcta

SEQ ID NO: 4764971 - DNA, 20 bp, Homo sapiens
atttttagagattaatttgt

SEQ ID NO: 4764972 - DNA, 18 bp, Homo sapiens
atttttctactgctcttt

SEQ ID NO: 4764973 - DNA, 19 bp, Homo sapiens
atttttctgggaagaaaat

SEQ ID NO: 4764974 - DNA, 18 bp, Homo sapiens
atttttctgttggtctta

SEQ ID NO: 4764975 - DNA, 22 bp, Homo sapiens
atttttctgttggtcttaacta

SEQ ID NO: 4764976 - DNA, 18 bp, Homo sapiens
atttttgaaactgcattt

SEQ ID NO: 4764977 - DNA, 20 bp, Homo sapiens
atttttgaaactgcatttgt

SEQ ID NO: 4764978 - DNA, 12 bp, Homo sapiens
atttttgccctg

SEQ ID NO: 4764979 - DNA, 23 bp, Homo sapiens
attatgtcaaatggatgtaatat

SEQ ID NO: 4764980 - DNA, 22 bp, Homo sapiens
attatgtcctgtgagatgtgta

SEQ ID NO: 4764981 - DNA, 15 bp, Homo sapiens
attattaaaaattat

SEQ ID NO: 4764982 - DNA, 14 bp, Homo sapiens
attattaagctgtt

SEQ ID NO: 4764983 - DNA, 14 bp, Homo sapiens
attattaatgaatg

SEQ ID NO: 4764984 - DNA, 15 bp, Homo sapiens
attattaatgaatgc

SEQ ID NO: 4764985 - DNA, 22 bp, Homo sapiens
attattacttttcctcttagaa

SEQ ID NO: 4764986 - DNA, 13 bp, Homo sapiens
attattattatat

SEQ ID NO: 4764987 - DNA, 16 bp, Homo sapiens
attattattatattgt

SEQ ID NO: 4764988 - DNA, 17 bp, Homo sapiens
attattattttaaaaat

SEQ ID NO: 4764989 - DNA, 15 bp, Homo sapiens
attattgaaaagcaa

SEQ ID NO: 4764990 - DNA, 18 bp, Homo sapiens
attattggacttccattt

SEQ ID NO: 4764991 - DNA, 15 bp, Homo sapiens
attattgtagagaaa

SEQ ID NO: 4764992 - DNA, 14 bp, Homo sapiens
attatttacaagaa

SEQ ID NO: 4764993 - DNA, 17 bp, Homo sapiens
attatttagtaaaatta

SEQ ID NO: 4764994 - DNA, 21 bp, Homo sapiens
attatttagtaaaattatctg

SEQ ID NO: 4764995 - DNA, 13 bp, Homo sapiens
attattttctata

SEQ ID NO: 4764996 - DNA, 14 bp, Homo sapiens
attcaaagaatcac

SEQ ID NO: 4764997 - DNA, 21 bp, Homo sapiens
attcaaatttatttccaatgt

SEQ ID NO: 4764998 - DNA, 13 bp, Homo sapiens
attcaacatcaat

SEQ ID NO: 4764999 - DNA, 14 bp, Homo sapiens
attcaacatcaatt

SEQ ID NO: 4765000 - DNA, 20 bp, Homo sapiens
attcaagcttcatatatgct

SEQ ID NO: 4765001 - DNA, 18 bp, Homo sapiens
attcaatcattttgggaa

SEQ ID NO: 4765002 - DNA, 23 bp, Homo sapiens
attcaatgggtaaataaatgctg

SEQ ID NO: 4765003 - DNA, 12 bp, Homo sapiens
attcacacacac

SEQ ID NO: 4765004 - DNA, 13 bp, Homo sapiens
attcacacacaca

SEQ ID NO: 4765005 - DNA, 21 bp, Homo sapiens
attcacccctcccacctcttt

SEQ ID NO: 4765006 - DNA, 13 bp, Homo sapiens
attcacctgtaaa

SEQ ID NO: 4765007 - DNA, 15 bp, Homo sapiens
attcacctgtaaaac

SEQ ID NO: 4765008 - DNA, 16 bp, Homo sapiens
attcacctgtaaaact

SEQ ID NO: 4765009 - DNA, 20 bp, Homo sapiens
attcactttgacacttttca

SEQ ID NO: 4765010 - DNA, 14 bp, Homo sapiens
attcacttttattg

SEQ ID NO: 4765011 - DNA, 18 bp, Homo sapiens
attcacttttattgtata

SEQ ID NO: 4765012 - DNA, 15 bp, Homo sapiens
attcagactgcttca

SEQ ID NO: 4765013 - DNA, 15 bp, Homo sapiens
attcaggaaatgttc

SEQ ID NO: 4765014 - DNA, 21 bp, Homo sapiens
attcagtagcattttaatagt

SEQ ID NO: 4765015 - DNA, 22 bp, Homo sapiens
attcagtagcattttaatagtt

SEQ ID NO: 4765016 - DNA, 13 bp, Homo sapiens
attcagtctgcag

SEQ ID NO: 4765017 - DNA, 14 bp, Homo sapiens
attcataatgactt

SEQ ID NO: 4765018 - DNA, 19 bp, Homo sapiens
attcataatgacttaagca

SEQ ID NO: 4765019 - DNA, 18 bp, Homo sapiens
attcataccttctgatga

SEQ ID NO: 4765020 - DNA, 13 bp, Homo sapiens
attcatacttaaa

SEQ ID NO: 4765021 - DNA, 20 bp, Homo sapiens
attcatacttaaaaatttat

SEQ ID NO: 4765022 - DNA, 15 bp, Homo sapiens
attcatgatgctagt

SEQ ID NO: 4765023 - DNA, 20 bp, Homo sapiens
attcatgatgctagttctta

SEQ ID NO: 4765024 - DNA, 12 bp, Homo sapiens
attcatgctgcc

SEQ ID NO: 4765025 - DNA, 22 bp, Homo sapiens
attcatgctgcctgccatgtgt

SEQ ID NO: 4765026 - DNA, 14 bp, Homo sapiens
attcatgtccagag

SEQ ID NO: 4765027 - DNA, 15 bp, Homo sapiens
attcatttacaactt

SEQ ID NO: 4765028 - DNA, 20 bp, Homo sapiens
attccaacccaggtctgctt

SEQ ID NO: 4765029 - DNA, 22 bp, Homo sapiens
attccatgggttgaacaagcca

SEQ ID NO: 4765030 - DNA, 18 bp, Homo sapiens
attcccttcaatgcaaaa

SEQ ID NO: 4765031 - DNA, 21 bp, Homo sapiens
attccgaaaaaaaaatgttca

SEQ ID NO: 4765032 - DNA, 22 bp, Homo sapiens
attccgaaaaaaaaatgttcat

SEQ ID NO: 4765033 - DNA, 15 bp, Homo sapiens
attcctaattcctgt

SEQ ID NO: 4765034 - DNA, 16 bp, Homo sapiens
attcctaattcctgta

SEQ ID NO: 4765035 - DNA, 14 bp, Homo sapiens
attcctaattctat

SEQ ID NO: 4765036 - DNA, 20 bp, Homo sapiens
attcctaattctatgattaa

SEQ ID NO: 4765037 - DNA, 13 bp, Homo sapiens
attcctcctgtct

SEQ ID NO: 4765038 - DNA, 13 bp, Homo sapiens
attcctgaccctc

SEQ ID NO: 4765039 - DNA, 16 bp, Homo sapiens
attcctgaccctcact

SEQ ID NO: 4765040 - DNA, 16 bp, Homo sapiens
attccttctggccttt

SEQ ID NO: 4765041 - DNA, 13 bp, Homo sapiens
attccttcttgct

SEQ ID NO: 4765042 - DNA, 15 bp, Homo sapiens
attcgtaagttctgt

SEQ ID NO: 4765043 - DNA, 24 bp, Homo sapiens
attctaagaaatatctgtgaaata

SEQ ID NO: 4765044 - DNA, 18 bp, Homo sapiens
attctaagattgtacata

SEQ ID NO: 4765045 - DNA, 20 bp, Homo sapiens
attctaagtgagatgtttgg

SEQ ID NO: 4765046 - DNA, 15 bp, Homo sapiens
attctatctactgat

SEQ ID NO: 4765047 - DNA, 16 bp, Homo sapiens
attctatctctcttta

SEQ ID NO: 4765048 - DNA, 21 bp, Homo sapiens
attctatgacaataaatttta

SEQ ID NO: 4765049 - DNA, 12 bp, Homo sapiens
attctatttcaa

SEQ ID NO: 4765050 - DNA, 21 bp, Homo sapiens
attctatttcaacttcaggaa

SEQ ID NO: 4765051 - DNA, 19 bp, Homo sapiens
attctcagaagtgaaaaag

SEQ ID NO: 4765052 - DNA, 17 bp, Homo sapiens
attctcattttgctttt

SEQ ID NO: 4765053 - DNA, 22 bp, Homo sapiens
attctccagaaaaatcaatcat

SEQ ID NO: 4765054 - DNA, 11 bp, Homo sapiens
attctcctctc

SEQ ID NO: 4765055 - DNA, 14 bp, Homo sapiens
attctcctctccca

SEQ ID NO: 4765056 - DNA, 12 bp, Homo sapiens
attctcttcgct

SEQ ID NO: 4765057 - DNA, 19 bp, Homo sapiens
attctctttgcctgaagaa

SEQ ID NO: 4765058 - DNA, 14 bp, Homo sapiens
attctgaaggggaa

SEQ ID NO: 4765059 - DNA, 15 bp, Homo sapiens
attctgaaggggaaa

SEQ ID NO: 4765060 - DNA, 15 bp, Homo sapiens
attctgattattaca

SEQ ID NO: 4765061 - DNA, 23 bp, Homo sapiens
attctgcagaaaattaattgaaa

SEQ ID NO: 4765062 - DNA, 21 bp, Homo sapiens
attctgcagcccgatgtccct

SEQ ID NO: 4765063 - DNA, 21 bp, Homo sapiens
attctgctaatttatgaagat

SEQ ID NO: 4765064 - DNA, 13 bp, Homo sapiens
attctgcttctct

SEQ ID NO: 4765065 - DNA, 18 bp, Homo sapiens
attcttaccgaaatgaaa

SEQ ID NO: 4765066 - DNA, 21 bp, Homo sapiens
attcttactcggcatcctcca

SEQ ID NO: 4765067 - DNA, 20 bp, Homo sapiens
attcttattttataatttta

SEQ ID NO: 4765068 - DNA, 15 bp, Homo sapiens
attcttccttgccac

SEQ ID NO: 4765069 - DNA, 16 bp, Homo sapiens
attcttccttgccaca

SEQ ID NO: 4765070 - DNA, 20 bp, Homo sapiens
attcttctaaaactactgcc

SEQ ID NO: 4765071 - DNA, 13 bp, Homo sapiens
attcttctccact

SEQ ID NO: 4765072 - DNA, 20 bp, Homo sapiens
attcttctcctttgtcaaat

SEQ ID NO: 4765073 - DNA, 20 bp, Homo sapiens
attcttgcactgtatccaag

SEQ ID NO: 4765074 - DNA, 18 bp, Homo sapiens
attctttcaatccacagt

SEQ ID NO: 4765075 - DNA, 23 bp, Homo sapiens
attctttcaatccacagtattgt

SEQ ID NO: 4765076 - DNA, 20 bp, Homo sapiens
attcttttcccatcaccaga

SEQ ID NO: 4765077 - DNA, 16 bp, Homo sapiens
attcttttttcaatgt

SEQ ID NO: 4765078 - DNA, 17 bp, Homo sapiens
attcttttttcaatgta

SEQ ID NO: 4765079 - DNA, 21 bp, Homo sapiens
attcttttttcaatgtactgt

SEQ ID NO: 4765080 - DNA, 12 bp, Homo sapiens
attgaaaaaaca

SEQ ID NO: 4765081 - DNA, 14 bp, Homo sapiens
attgaaactgtatt

SEQ ID NO: 4765082 - DNA, 16 bp, Homo sapiens
attgaacactgcaccc

SEQ ID NO: 4765083 - DNA, 17 bp, Homo sapiens
attgaaccgtcaatgtg

SEQ ID NO: 4765084 - DNA, 19 bp, Homo sapiens
attgaaccgtcaatgtgaa

SEQ ID NO: 4765085 - DNA, 20 bp, Homo sapiens
attgaaccgtcaatgtgaaa

SEQ ID NO: 4765086 - DNA, 19 bp, Homo sapiens
attgaagagagatatatct

SEQ ID NO: 4765087 - DNA, 23 bp, Homo sapiens
attgaagagagatatatctgaaa

SEQ ID NO: 4765088 - DNA, 14 bp, Homo sapiens
attgaatctctaaa

SEQ ID NO: 4765089 - DNA, 19 bp, Homo sapiens
attgacgacctacatctga

SEQ ID NO: 4765090 - DNA, 22 bp, Homo sapiens
attgacgacctacatctgaaat

SEQ ID NO: 4765091 - DNA, 16 bp, Homo sapiens
attgactggtccccca

SEQ ID NO: 4765092 - DNA, 16 bp, Homo sapiens
attgagacactgtcaa

SEQ ID NO: 4765093 - DNA, 22 bp, Homo sapiens
attgagagatgttttgttgata

SEQ ID NO: 4765094 - DNA, 21 bp, Homo sapiens
attgagcagaattcattcata

SEQ ID NO: 4765095 - DNA, 17 bp, Homo sapiens
attgagggaaaacataa

SEQ ID NO: 4765096 - DNA, 20 bp, Homo sapiens
attgagttcttcctgtaatc

SEQ ID NO: 4765097 - DNA, 22 bp, Homo sapiens
attgagttcttcctgtaatctt

SEQ ID NO: 4765098 - DNA, 12 bp, Homo sapiens
attgatctgtat

SEQ ID NO: 4765099 - DNA, 15 bp, Homo sapiens
attgatctgtattaa

SEQ ID NO: 4765100 - DNA, 16 bp, Homo sapiens
attgcactaaaagtga

SEQ ID NO: 4765101 - DNA, 20 bp, Homo sapiens
atggctgttatctgtcttta

SEQ ID NO: 4765102 - DNA, 15 bp, Homo sapiens
atgggaatgaatgtc

SEQ ID NO: 4765103 - DNA, 13 bp, Homo sapiens
atgggaccaggga

SEQ ID NO: 4765104 - DNA, 22 bp, Homo sapiens
atgggagaagaggggtatagga

SEQ ID NO: 4765105 - DNA, 15 bp, Homo sapiens
atgggagagaagaga

SEQ ID NO: 4765106 - DNA, 18 bp, Homo sapiens
atgggcaaggggccagga

SEQ ID NO: 4765107 - DNA, 20 bp, Homo sapiens
atgggcagctggggggctgt

SEQ ID NO: 4765108 - DNA, 11 bp, Homo sapiens
atgggccaggg

SEQ ID NO: 4765109 - DNA, 19 bp, Homo sapiens
atggggaactcccccagag

SEQ ID NO: 4765110 - DNA, 16 bp, Homo sapiens
atgggggatgcttcat

SEQ ID NO: 4765111 - DNA, 16 bp, Homo sapiens
atgggggatgggccag

SEQ ID NO: 4765112 - DNA, 14 bp, Homo sapiens
atgggtaaataaat

SEQ ID NO: 4765113 - DNA, 18 bp, Homo sapiens
atgggtaaataaatgctg

SEQ ID NO: 4765114 - DNA, 23 bp, Homo sapiens
atgggtaaataaatgctgctttg

SEQ ID NO: 4765115 - DNA, 14 bp, Homo sapiens
atgggtcctgctgc

SEQ ID NO: 4765116 - DNA, 14 bp, Homo sapiens
atgggtgattatga

SEQ ID NO: 4765117 - DNA, 17 bp, Homo sapiens
atgggtgattatgaaat

SEQ ID NO: 4765118 - DNA, 19 bp, Homo sapiens
atgggtgattatgaaatgc

SEQ ID NO: 4765119 - DNA, 15 bp, Homo sapiens
atgggtgtcccctgg

SEQ ID NO: 4765120 - DNA, 18 bp, Homo sapiens
atgggttgaacaagccac

SEQ ID NO: 4765121 - DNA, 17 bp, Homo sapiens
atggtaaataactgtga

SEQ ID NO: 4765122 - DNA, 15 bp, Homo sapiens
atggtaccagccctg

SEQ ID NO: 4765123 - DNA, 16 bp, Homo sapiens
atggtagctctgaagg

SEQ ID NO: 4765124 - DNA, 17 bp, Homo sapiens
atggtagctctgaaggg

SEQ ID NO: 4765125 - DNA, 17 bp, Homo sapiens
atggtatatattttgaa

SEQ ID NO: 4765126 - DNA, 16 bp, Homo sapiens
atggtatgctggccag

SEQ ID NO: 4765127 - DNA, 15 bp, Homo sapiens
atggtcatatttaaa

SEQ ID NO: 4765128 - DNA, 13 bp, Homo sapiens
atggtgcagtgaa

SEQ ID NO: 4765129 - DNA, 16 bp, Homo sapiens
atggtgccccctgggg

SEQ ID NO: 4765130 - DNA, 19 bp, Homo sapiens
atggtgggctccagagtag

SEQ ID NO: 4765131 - DNA, 14 bp, Homo sapiens
atggtggtttcaga

SEQ ID NO: 4765132 - DNA, 13 bp, Homo sapiens
atgaataaaatgt

SEQ ID NO: 4765133 - DNA, 19 bp, Homo sapiens
atgaataatgcctttgtaa

SEQ ID NO: 4765134 - DNA, 22 bp, Homo sapiens
atgaatcgcagacgcaagaggt

SEQ ID NO: 4765135 - DNA, 12 bp, Homo sapiens
atgaatgaaata

SEQ ID NO: 4765136 - DNA, 14 bp, Homo sapiens
atgaatgaaatata

SEQ ID NO: 4765137 - DNA, 22 bp, Homo sapiens
atgaatgaaatataaactgtga

SEQ ID NO: 4765138 - DNA, 13 bp, Homo sapiens
atgaatgcagtat

SEQ ID NO: 4765139 - DNA, 19 bp, Homo sapiens
atgaatgcagtataaaatg

SEQ ID NO: 4765140 - DNA, 18 bp, Homo sapiens
atgaattttaaaagcata

SEQ ID NO: 4765141 - DNA, 20 bp, Homo sapiens
atgaatttttttatttctgt

SEQ ID NO: 4765142 - DNA, 22 bp, Homo sapiens
atgacactggaagggtccggct

SEQ ID NO: 4765143 - DNA, 19 bp, Homo sapiens
atgacaggaacccatcact

SEQ ID NO: 4765144 - DNA, 16 bp, Homo sapiens
atgacatccacatgca

SEQ ID NO: 4765145 - DNA, 22 bp, Homo sapiens
atgacatccacatgcacatgta

SEQ ID NO: 4765146 - DNA, 14 bp, Homo sapiens
atgacatgcactga

SEQ ID NO: 4765147 - DNA, 17 bp, Homo sapiens
atgacatgcactgaccc

SEQ ID NO: 4765148 - DNA, 18 bp, Homo sapiens
atgacatgcactgaccct

SEQ ID NO: 4765149 - DNA, 22 bp, Homo sapiens
atgacatgcactgacccttcca

SEQ ID NO: 4765150 - DNA, 15 bp, Homo sapiens
atgaccaatctctgt

SEQ ID NO: 4765151 - DNA, 16 bp, Homo sapiens
atgaccactgggcctg

SEQ ID NO: 4765152 - DNA, 12 bp, Homo sapiens
atgacccagtgg

SEQ ID NO: 4765153 - DNA, 13 bp, Homo sapiens
atgaccctgtgcc

SEQ ID NO: 4765154 - DNA, 17 bp, Homo sapiens
atgaccctgtgcctgtg

SEQ ID NO: 4765155 - DNA, 18 bp, Homo sapiens
atgaccctgtgcctgtgt

SEQ ID NO: 4765156 - DNA, 13 bp, Homo sapiens
atgacgtgcacaa

SEQ ID NO: 4765157 - DNA, 18 bp, Homo sapiens
atgacgtgcacaaacctt

SEQ ID NO: 4765158 - DNA, 19 bp, Homo sapiens
atgacgtgcacaaaccttc

SEQ ID NO: 4765159 - DNA, 13 bp, Homo sapiens
atgactaatcctt

SEQ ID NO: 4765160 - DNA, 21 bp, Homo sapiens
atgactaatccttaataacta

SEQ ID NO: 4765161 - DNA, 17 bp, Homo sapiens
atgactccagaatttcc

SEQ ID NO: 4765162 - DNA, 16 bp, Homo sapiens
atgactgaatttctat

SEQ ID NO: 4765163 - DNA, 13 bp, Homo sapiens
atgactgcatttt

SEQ ID NO: 4765164 - DNA, 14 bp, Homo sapiens
atgactggaaacaa

SEQ ID NO: 4765165 - DNA, 21 bp, Homo sapiens
atgactttcagattgtatctg

SEQ ID NO: 4765166 - DNA, 14 bp, Homo sapiens
atgagaaatcatgt

SEQ ID NO: 4765167 - DNA, 13 bp, Homo sapiens
atgagaactaaat

SEQ ID NO: 4765168 - DNA, 19 bp, Homo sapiens
atgagaatctgtgcagtca

SEQ ID NO: 4765169 - DNA, 20 bp, Homo sapiens
atgagaatgtcatttgctaa

SEQ ID NO: 4765170 - DNA, 16 bp, Homo sapiens
atgagacaacacacac

SEQ ID NO: 4765171 - DNA, 19 bp, Homo sapiens
atgagacctcccccaggga

SEQ ID NO: 4765172 - DNA, 23 bp, Homo sapiens
atgagacttcctattaatttatt

SEQ ID NO: 4765173 - DNA, 16 bp, Homo sapiens
atgagatactttgcat

SEQ ID NO: 4765174 - DNA, 20 bp, Homo sapiens
atgagatgatttaattctta

SEQ ID NO: 4765175 - DNA, 21 bp, Homo sapiens
atgagatgggttgagtttgct

SEQ ID NO: 4765176 - DNA, 17 bp, Homo sapiens
atgagcatgctccctca

SEQ ID NO: 4765177 - DNA, 18 bp, Homo sapiens
atgagcatgctccctcat

SEQ ID NO: 4765178 - DNA, 16 bp, Homo sapiens
atgagcgtccaggtga

SEQ ID NO: 4765179 - DNA, 13 bp, Homo sapiens
atgagctccctcg

SEQ ID NO: 4765180 - DNA, 19 bp, Homo sapiens
atgaggaacctcaaactgg

SEQ ID NO: 4765181 - DNA, 22 bp, Homo sapiens
atgaggcattttactatgcctg

SEQ ID NO: 4765182 - DNA, 14 bp, Homo sapiens
atgaggctggatag

SEQ ID NO: 4765183 - DNA, 20 bp, Homo sapiens
atgataatagctcacagcac

SEQ ID NO: 4765184 - DNA, 15 bp, Homo sapiens
atgatactgaattgt

SEQ ID NO: 4765185 - DNA, 19 bp, Homo sapiens
atgatagcgtgcagtagag

SEQ ID NO: 4765186 - DNA, 18 bp, Homo sapiens
atgatataataaatatat

SEQ ID NO: 4765187 - DNA, 12 bp, Homo sapiens
atgatatgcatg

SEQ ID NO: 4765188 - DNA, 19 bp, Homo sapiens
atgatatgcatgtagcata

SEQ ID NO: 4765189 - DNA, 16 bp, Homo sapiens
atgatatgtctttaaa

SEQ ID NO: 4765190 - DNA, 20 bp, Homo sapiens
atgatatgtctttaaaatga

SEQ ID NO: 4765191 - DNA, 20 bp, Homo sapiens
atgatatgtgcttgtgtgta

SEQ ID NO: 4765192 - DNA, 21 bp, Homo sapiens
atgatatgtgcttgtgtgtat

SEQ ID NO: 4765193 - DNA, 18 bp, Homo sapiens
atgatcaaggagggagaa

SEQ ID NO: 4765194 - DNA, 23 bp, Homo sapiens
atgatcaaggagggagaaaggca

SEQ ID NO: 4765195 - DNA, 17 bp, Homo sapiens
atgatgccatgaggaac

SEQ ID NO: 4765196 - DNA, 16 bp, Homo sapiens
atgatgttattttgta

SEQ ID NO: 4765197 - DNA, 22 bp, Homo sapiens
atgatgttattttgtacgtgtt

SEQ ID NO: 4765198 - DNA, 19 bp, Homo sapiens
atgattaaattatcattgt

SEQ ID NO: 4765199 - DNA, 22 bp, Homo sapiens
atgattaagtgcttgaggccaa

SEQ ID NO: 4765200 - DNA, 21 bp, Homo sapiens
atgattagacaatgtggaatt

SEQ ID NO: 4765201 - DNA, 16 bp, Homo sapiens
atgattcaatgtgaat

SEQ ID NO: 4765202 - DNA, 21 bp, Homo sapiens
atgattcaatgtgaattttaa

SEQ ID NO: 4765203 - DNA, 15 bp, Homo sapiens
atgattctcctctcc

SEQ ID NO: 4765204 - DNA, 21 bp, Homo sapiens
atgattcttgtgtcatcaagt

SEQ ID NO: 4765205 - DNA, 12 bp, Homo sapiens
atgatttaacat

SEQ ID NO: 4765206 - DNA, 16 bp, Homo sapiens
atgatttaagcatttt

SEQ ID NO: 4765207 - DNA, 16 bp, Homo sapiens
atgatttaattcttac

SEQ ID NO: 4765208 - DNA, 15 bp, Homo sapiens
atgatttcagaaaca

SEQ ID NO: 4765209 - DNA, 16 bp, Homo sapiens
atgatttcagaaacaa

SEQ ID NO: 4765210 - DNA, 19 bp, Homo sapiens
atgatttcatgattagaca

SEQ ID NO: 4765211 - DNA, 17 bp, Homo sapiens
atgatttttgccctgcg

SEQ ID NO: 4765212 - DNA, 14 bp, Homo sapiens
atgcaaaaatgaat

SEQ ID NO: 4765213 - DNA, 13 bp, Homo sapiens
atgcaaacactgt

SEQ ID NO: 4765214 - DNA, 15 bp, Homo sapiens
atgcaaatctggctt

SEQ ID NO: 4765215 - DNA, 22 bp, Homo sapiens
atgcaaatctggcttagtaaat

SEQ ID NO: 4765216 - DNA, 15 bp, Homo sapiens
atgcaaatgaaggaa

SEQ ID NO: 4765217 - DNA, 21 bp, Homo sapiens
atgcaaatgaaggaatgcaat

SEQ ID NO: 4765218 - DNA, 16 bp, Homo sapiens
atgcaataaagagtaa

SEQ ID NO: 4765219 - DNA, 23 bp, Homo sapiens
atgcaataaagagtaaatatact

SEQ ID NO: 4765220 - DNA, 14 bp, Homo sapiens
atgcaatgcatctg

SEQ ID NO: 4765221 - DNA, 17 bp, Homo sapiens
atgcaatttacttggaa

SEQ ID NO: 4765222 - DNA, 16 bp, Homo sapiens
atgcacaaacagaggc

SEQ ID NO: 4765223 - DNA, 18 bp, Homo sapiens
atgcacaaacagaggccg

SEQ ID NO: 4765224 - DNA, 17 bp, Homo sapiens
atgcacaccaaattgct

SEQ ID NO: 4765225 - DNA, 19 bp, Homo sapiens
atgcacaccaaattgctga

SEQ ID NO: 4765226 - DNA, 16 bp, Homo sapiens
atgcacattcatcctc

SEQ ID NO: 4765227 - DNA, 20 bp, Homo sapiens
atgcacattcatcctcacat

SEQ ID NO: 4765228 - DNA, 22 bp, Homo sapiens
atgcacattcatcctcacatgt

SEQ ID NO: 4765229 - DNA, 22 bp, Homo sapiens
atgcagaaatgtggatgctctt

SEQ ID NO: 4765230 - DNA, 16 bp, Homo sapiens
atgcagatctagccag

SEQ ID NO: 4765231 - DNA, 18 bp, Homo sapiens
atgcagatctagccaggc

SEQ ID NO: 4765232 - DNA, 18 bp, Homo sapiens
atgcagccgccttccttg

SEQ ID NO: 4765233 - DNA, 16 bp, Homo sapiens
atgcaggaagaccaca

SEQ ID NO: 4765234 - DNA, 18 bp, Homo sapiens
atgcaggaagaccacatg

SEQ ID NO: 4765235 - DNA, 22 bp, Homo sapiens
atgcaggttagaaataatgtca

SEQ ID NO: 4765236 - DNA, 13 bp, Homo sapiens
atgcaggttttct

SEQ ID NO: 4765237 - DNA, 13 bp, Homo sapiens
atgcagtataaaa

SEQ ID NO: 4765238 - DNA, 14 bp, Homo sapiens
atgcagtataaaat

SEQ ID NO: 4765239 - DNA, 19 bp, Homo sapiens
atgcagtgtagattttata

SEQ ID NO: 4765240 - DNA, 23 bp, Homo sapiens
atgcagtgtagattttatagtgt

SEQ ID NO: 4765241 - DNA, 14 bp, Homo sapiens
atgcataacacact

SEQ ID NO: 4765242 - DNA, 18 bp, Homo sapiens
atgcatacaaatctcact

SEQ ID NO: 4765243 - DNA, 22 bp, Homo sapiens
atgcatctgaaagttttgatac

SEQ ID NO: 4765244 - DNA, 19 bp, Homo sapiens
atgcatctgtggcctgggg

SEQ ID NO: 4765245 - DNA, 15 bp, Homo sapiens
atgcatgagaactaa

SEQ ID NO: 4765246 - DNA, 21 bp, Homo sapiens
atgcatgagaactaaatagat

SEQ ID NO: 4765247 - DNA, 18 bp, Homo sapiens
atgcatgcactcttttga

SEQ ID NO: 4765248 - DNA, 20 bp, Homo sapiens
atgcatgtagcatataaatg

SEQ ID NO: 4765249 - DNA, 13 bp, Homo sapiens
atgcattcagatc

SEQ ID NO: 4765250 - DNA, 19 bp, Homo sapiens
atgcatttagcatgagttc

SEQ ID NO: 4765251 - DNA, 20 bp, Homo sapiens
atgcatttatgcatgagaac

SEQ ID NO: 4765252 - DNA, 22 bp, Homo sapiens
atgcattttaaagttaaacatt

SEQ ID NO: 4765253 - DNA, 17 bp, Homo sapiens
atgccaatgtccaggtc

SEQ ID NO: 4765254 - DNA, 23 bp, Homo sapiens
atgccaatgtccaggtcacaggc

SEQ ID NO: 4765255 - DNA, 19 bp, Homo sapiens
atgccagacttctaaaata

SEQ ID NO: 4765256 - DNA, 16 bp, Homo sapiens
agtgtggatgtaaatt

SEQ ID NO: 4765257 - DNA, 21 bp, Homo sapiens
agtgtggatgtaaattttata

SEQ ID NO: 4765258 - DNA, 15 bp, Homo sapiens
agtgtggcttaaaca

SEQ ID NO: 4765259 - DNA, 17 bp, Homo sapiens
agtgtggcttaaacatt

SEQ ID NO: 4765260 - DNA, 19 bp, Homo sapiens
agtgtggcttaaacatttt

SEQ ID NO: 4765261 - DNA, 14 bp, Homo sapiens
agaatataaataaa

SEQ ID NO: 4765262 - DNA, 15 bp, Homo sapiens
agaatattaaaaatt

SEQ ID NO: 4765263 - DNA, 18 bp, Homo sapiens
agaatattgtattgttag

SEQ ID NO: 4765264 - DNA, 15 bp, Homo sapiens
agaatattgttaaaa

SEQ ID NO: 4765265 - DNA, 16 bp, Homo sapiens
agaatcaagtctgtga

SEQ ID NO: 4765266 - DNA, 22 bp, Homo sapiens
agaatcacctaattaatttcag

SEQ ID NO: 4765267 - DNA, 17 bp, Homo sapiens
agaatcatggatttatt

SEQ ID NO: 4765268 - DNA, 20 bp, Homo sapiens
agaatcgacctcactgtcag

SEQ ID NO: 4765269 - DNA, 19 bp, Homo sapiens
agaatcttgttaatttcat

SEQ ID NO: 4765270 - DNA, 13 bp, Homo sapiens
agaatgagaaatc

SEQ ID NO: 4765271 - DNA, 14 bp, Homo sapiens
agaatgagaaatca

SEQ ID NO: 4765272 - DNA, 17 bp, Homo sapiens
agaatgagatgatttaa

SEQ ID NO: 4765273 - DNA, 22 bp, Homo sapiens
agaatgcacaaacagaggccgc

SEQ ID NO: 4765274 - DNA, 18 bp, Homo sapiens
agaatggaagagagaaag

SEQ ID NO: 4765275 - DNA, 14 bp, Homo sapiens
agaatggagggcct

SEQ ID NO: 4765276 - DNA, 13 bp, Homo sapiens
agaatggctctgg

SEQ ID NO: 4765277 - DNA, 14 bp, Homo sapiens
agaatggctctggc

SEQ ID NO: 4765278 - DNA, 15 bp, Homo sapiens
agaatggctctggct

SEQ ID NO: 4765279 - DNA, 20 bp, Homo sapiens
agaatggtgggctccagagt

SEQ ID NO: 4765280 - DNA, 11 bp, Homo sapiens
agaatgtcatt

SEQ ID NO: 4765281 - DNA, 20 bp, Homo sapiens
agaatgtcatttgctaatga

SEQ ID NO: 4765282 - DNA, 21 bp, Homo sapiens
agaatgtcatttgctaatgaa

SEQ ID NO: 4765283 - DNA, 20 bp, Homo sapiens
agaatgtgaaaaaaaaaagt

SEQ ID NO: 4765284 - DNA, 13 bp, Homo sapiens
agaattactgttt

SEQ ID NO: 4765285 - DNA, 19 bp, Homo sapiens
agaattaggtaatggatat

SEQ ID NO: 4765286 - DNA, 12 bp, Homo sapiens
agaattcacttt

SEQ ID NO: 4765287 - DNA, 15 bp, Homo sapiens
agaattcagtagcat

SEQ ID NO: 4765288 - DNA, 15 bp, Homo sapiens
agaattcatgatgct

SEQ ID NO: 4765289 - DNA, 17 bp, Homo sapiens
agaattcatgatgctag

SEQ ID NO: 4765290 - DNA, 21 bp, Homo sapiens
agaattcattcatacttaaaa

SEQ ID NO: 4765291 - DNA, 19 bp, Homo sapiens
agaattctccaaaacaatt

SEQ ID NO: 4765292 - DNA, 22 bp, Homo sapiens
agaattgaaccgtcaatgtgaa

SEQ ID NO: 4765293 - DNA, 10 bp, Homo sapiens
agaattgaga

SEQ ID NO: 4765294 - DNA, 21 bp, Homo sapiens
agaattgaggggaggtggcca

SEQ ID NO: 4765295 - DNA, 21 bp, Homo sapiens
agaattgtgcgacttcacaaa

SEQ ID NO: 4765296 - DNA, 22 bp, Homo sapiens
agaattgtgcgacttcacaaaa

SEQ ID NO: 4765297 - DNA, 21 bp, Homo sapiens
agaattgtttttagaaattta

SEQ ID NO: 4765298 - DNA, 20 bp, Homo sapiens
agaatttagaggataaataa

SEQ ID NO: 4765299 - DNA, 21 bp, Homo sapiens
agaatttagaggataaataat

SEQ ID NO: 4765300 - DNA, 20 bp, Homo sapiens
agaatttatcctttatttta

SEQ ID NO: 4765301 - DNA, 18 bp, Homo sapiens
agaatttcccaaagcagt

SEQ ID NO: 4765302 - DNA, 23 bp, Homo sapiens
agaatttcccaaagcagtgcatg

SEQ ID NO: 4765303 - DNA, 13 bp, Homo sapiens
agacaaaggcctt

SEQ ID NO: 4765304 - DNA, 21 bp, Homo sapiens
agacaaagtttggaagtacat

SEQ ID NO: 4765305 - DNA, 17 bp, Homo sapiens
agacaaatgcagtgtat

SEQ ID NO: 4765306 - DNA, 14 bp, Homo sapiens
agacaacaggcatt

SEQ ID NO: 4765307 - DNA, 18 bp, Homo sapiens
agacaacttgctcctttc

SEQ ID NO: 4765308 - DNA, 20 bp, Homo sapiens
agacaacttgctcctttcca

SEQ ID NO: 4765309 - DNA, 14 bp, Homo sapiens
agacaatgtggaat

SEQ ID NO: 4765310 - DNA, 20 bp, Homo sapiens
agacaatgtggaattacata

SEQ ID NO: 4765311 - DNA, 13 bp, Homo sapiens
agacacaagcctt

SEQ ID NO: 4765312 - DNA, 16 bp, Homo sapiens
agacacagcccagaga

SEQ ID NO: 4765313 - DNA, 16 bp, Homo sapiens
agacaccagagtgtat

SEQ ID NO: 4765314 - DNA, 22 bp, Homo sapiens
agacaccatcaccacgcagaga

SEQ ID NO: 4765315 - DNA, 17 bp, Homo sapiens
agacagaaaaaaataaa

SEQ ID NO: 4765316 - DNA, 21 bp, Homo sapiens
agacagaaaaaaataaaaaca

SEQ ID NO: 4765317 - DNA, 24 bp, Homo sapiens
agacagacggacgggacagcggcc

SEQ ID NO: 4765318 - DNA, 11 bp, Homo sapiens
agacagagatc

SEQ ID NO: 4765319 - DNA, 20 bp, Homo sapiens
agacagagatggcagagcca

SEQ ID NO: 4765320 - DNA, 20 bp, Homo sapiens
agacagagtcttactctgtt

SEQ ID NO: 4765321 - DNA, 20 bp, Homo sapiens
agacagagtggatctggagt

SEQ ID NO: 4765322 - DNA, 11 bp, Homo sapiens
agacagctctt

SEQ ID NO: 4765323 - DNA, 16 bp, Homo sapiens
agacagggcgtcctct

SEQ ID NO: 4765324 - DNA, 23 bp, Homo sapiens
agacagggtggggcttagaatgg

SEQ ID NO: 4765325 - DNA, 14 bp, Homo sapiens
agacagtttcttgc

SEQ ID NO: 4765326 - DNA, 16 bp, Homo sapiens
agaccaagtctctcta

SEQ ID NO: 4765327 - DNA, 18 bp, Homo sapiens
agaccaccgcgcccctct

SEQ ID NO: 4765328 - DNA, 20 bp, Homo sapiens
agaccaccgcgcccctctgc

SEQ ID NO: 4765329 - DNA, 22 bp, Homo sapiens
agaccaccgcgcccctctgcgc

SEQ ID NO: 4765330 - DNA, 22 bp, Homo sapiens
agaccacggtccaatccagcct

SEQ ID NO: 4765331 - DNA, 23 bp, Homo sapiens
tctttggctattgtccttgtgta

SEQ ID NO: 4765332 - DNA, 22 bp, Homo sapiens
tctttggggctcctttcccctc

SEQ ID NO: 4765333 - DNA, 20 bp, Homo sapiens
tctttgtacagacaacaaac

SEQ ID NO: 4765334 - DNA, 16 bp, Homo sapiens
tctttgtgacaggaaa

SEQ ID NO: 4765335 - DNA, 13 bp, Homo sapiens
tctttgtggggct

SEQ ID NO: 4765336 - DNA, 18 bp, Homo sapiens
tctttgtggggcttggcg

SEQ ID NO: 4765337 - DNA, 13 bp, Homo sapiens
tctttgttaaaat

SEQ ID NO: 4765338 - DNA, 14 bp, Homo sapiens
tctttgttaaaata

SEQ ID NO: 4765339 - DNA, 19 bp, Homo sapiens
tctttgttcttcaatgtga

SEQ ID NO: 4765340 - DNA, 15 bp, Homo sapiens
tcttttcaatgcaat

SEQ ID NO: 4765341 - DNA, 21 bp, Homo sapiens
tcttttcccatttacaaatga

SEQ ID NO: 4765342 - DNA, 16 bp, Homo sapiens
tcttttgaatcaatct

SEQ ID NO: 4765343 - DNA, 12 bp, Homo sapiens
tcttttgttctc

SEQ ID NO: 4765344 - DNA, 14 bp, Homo sapiens
tcttttgttctctc

SEQ ID NO: 4765345 - DNA, 21 bp, Homo sapiens
tctttttaaaaagttgcacat

SEQ ID NO: 4765346 - DNA, 12 bp, Homo sapiens
tctttttgactg

SEQ ID NO: 4765347 - DNA, 14 bp, Homo sapiens
tctttttgactgat

SEQ ID NO: 4765348 - DNA, 23 bp, Homo sapiens
tctttttttaagtgttctgtggc

SEQ ID NO: 4765349 - DNA, 20 bp, Homo sapiens
tgaaaaatagtgtgtccatg

SEQ ID NO: 4765350 - DNA, 16 bp, Homo sapiens
tgaaaaatctgaattt

SEQ ID NO: 4765351 - DNA, 21 bp, Homo sapiens
tgaaaaccatctggcctggcc

SEQ ID NO: 4765352 - DNA, 21 bp, Homo sapiens
tgaaaactggaataagaagca

SEQ ID NO: 4765353 - DNA, 23 bp, Homo sapiens
tgaaaactggaataagaagcaaa

SEQ ID NO: 4765354 - DNA, 23 bp, Homo sapiens
tgaaaactgtttatggtattttc

SEQ ID NO: 4765355 - DNA, 15 bp, Homo sapiens
tgaaaacttctcatt

SEQ ID NO: 4765356 - DNA, 15 bp, Homo sapiens
tgaaaagaagtagtg

SEQ ID NO: 4765357 - DNA, 14 bp, Homo sapiens
tgaaaagttttcaa

SEQ ID NO: 4765358 - DNA, 18 bp, Homo sapiens
tgaaaataccatcaggcc

SEQ ID NO: 4765359 - DNA, 20 bp, Homo sapiens
tgaaaatggaagtggcaata

SEQ ID NO: 4765360 - DNA, 17 bp, Homo sapiens
tgaaaatggctgaagaa

SEQ ID NO: 4765361 - DNA, 18 bp, Homo sapiens
tgaaaatggctgaagaaa

SEQ ID NO: 4765362 - DNA, 13 bp, Homo sapiens
tgaaaattcaaca

SEQ ID NO: 4765363 - DNA, 16 bp, Homo sapiens
tgaaacacacagtgac

SEQ ID NO: 4765364 - DNA, 16 bp, Homo sapiens
tgaaacctaaggcaac

SEQ ID NO: 4765365 - DNA, 17 bp, Homo sapiens
tgaaactatagaataaa

SEQ ID NO: 4765366 - DNA, 17 bp, Homo sapiens
tgaaactgacttgctgt

SEQ ID NO: 4765367 - DNA, 14 bp, Homo sapiens
tgaaactgtattta

SEQ ID NO: 4765368 - DNA, 15 bp, Homo sapiens
tgaaactgtatttac

SEQ ID NO: 4765369 - DNA, 20 bp, Homo sapiens
tgaaactgtatttacttgtt

SEQ ID NO: 4765370 - DNA, 14 bp, Homo sapiens
tgaaagagaaaatg

SEQ ID NO: 4765371 - DNA, 17 bp, Homo sapiens
tgaaagagtaaaaccaa

SEQ ID NO: 4765372 - DNA, 14 bp, Homo sapiens
tgaaagtcagttta

SEQ ID NO: 4765373 - DNA, 15 bp, Homo sapiens
tgaaagttgtgatct

SEQ ID NO: 4765374 - DNA, 22 bp, Homo sapiens
tgaaagttgtgatctgttgtaa

SEQ ID NO: 4765375 - DNA, 15 bp, Homo sapiens
tgaaataaagagttc

SEQ ID NO: 4765376 - DNA, 14 bp, Homo sapiens
tgaaataataatat

SEQ ID NO: 4765377 - DNA, 13 bp, Homo sapiens
tgaaatacttgaa

SEQ ID NO: 4765378 - DNA, 17 bp, Homo sapiens
tgaaatacttgaaaact

SEQ ID NO: 4765379 - DNA, 22 bp, Homo sapiens
tgaaataggagggaaacctttg

SEQ ID NO: 4765380 - DNA, 16 bp, Homo sapiens
tgaaatatatgtgaaa

SEQ ID NO: 4765381 - DNA, 17 bp, Homo sapiens
tgaaatatttgcttatt

SEQ ID NO: 4765382 - DNA, 14 bp, Homo sapiens
tgaaatccaaaata

SEQ ID NO: 4765383 - DNA, 21 bp, Homo sapiens
tgaaatccaaaatagtcatgt

SEQ ID NO: 4765384 - DNA, 14 bp, Homo sapiens
tgaaatgccaagac

SEQ ID NO: 4765385 - DNA, 23 bp, Homo sapiens
tgaaatgccaagactctatgctc

SEQ ID NO: 4765386 - DNA, 20 bp, Homo sapiens
tgaaatggcctgtccctagg

SEQ ID NO: 4765387 - DNA, 14 bp, Homo sapiens
tgaaattagtattt

SEQ ID NO: 4765388 - DNA, 17 bp, Homo sapiens
tgaaattagtgttttca

SEQ ID NO: 4765389 - DNA, 21 bp, Homo sapiens
tgaaattagtgttttcattct

SEQ ID NO: 4765390 - DNA, 22 bp, Homo sapiens
tgaaattagtgttttcattctg

SEQ ID NO: 4765391 - DNA, 15 bp, Homo sapiens
tgaaattatgtcaaa

SEQ ID NO: 4765392 - DNA, 13 bp, Homo sapiens
tgaaatttaagca

SEQ ID NO: 4765393 - DNA, 17 bp, Homo sapiens
tgaaatttaagcacaaa

SEQ ID NO: 4765394 - DNA, 14 bp, Homo sapiens
tgaaatttctcagc

SEQ ID NO: 4765395 - DNA, 12 bp, Homo sapiens
tgaaattttcta

SEQ ID NO: 4765396 - DNA, 22 bp, Homo sapiens
tgaaattttctagaatactaat

SEQ ID NO: 4765397 - DNA, 18 bp, Homo sapiens
tgaacaactcgaatcact

SEQ ID NO: 4765398 - DNA, 17 bp, Homo sapiens
tgaacacagatcattct

SEQ ID NO: 4765399 - DNA, 23 bp, Homo sapiens
tgaacactgcaccctccacagga

SEQ ID NO: 4765400 - DNA, 12 bp, Homo sapiens
tgaaccaccgcg

SEQ ID NO: 4765401 - DNA, 19 bp, Homo sapiens
tgaaccgtcaatgtgaaat

SEQ ID NO: 4765402 - DNA, 22 bp, Homo sapiens
tgaaccgtcaatgtgaaataaa

SEQ ID NO: 4765403 - DNA, 15 bp, Homo sapiens
tgaactaactgccat

SEQ ID NO: 4765404 - DNA, 20 bp, Homo sapiens
tgaactatcagggcaagctc

SEQ ID NO: 4765405 - DNA, 20 bp, Homo sapiens
tgaactatttctacacagtg

SEQ ID NO: 4765406 - DNA, 19 bp, Homo sapiens
tgaactggccgctgggaga

SEQ ID NO: 4765407 - DNA, 12 bp, Homo sapiens
tgaacttggttc

SEQ ID NO: 4765408 - DNA, 14 bp, Homo sapiens
tgaagaaaatcctt

SEQ ID NO: 4765409 - DNA, 15 bp, Homo sapiens
tgaagaaacaaggca

SEQ ID NO: 4765410 - DNA, 17 bp, Homo sapiens
tgaagaaacacagcatg

SEQ ID NO: 4765411 - DNA, 19 bp, Homo sapiens
tgaagaaacacagcatgca

SEQ ID NO: 4765412 - DNA, 20 bp, Homo sapiens
tgaagaaacacagcatgcat

SEQ ID NO: 4765413 - DNA, 20 bp, Homo sapiens
tgaagaatctacttaaccct

SEQ ID NO: 4765414 - DNA, 17 bp, Homo sapiens
tgaagacaccagagtgt

SEQ ID NO: 4765415 - DNA, 22 bp, Homo sapiens
tgaagacaccagagtgtatgca

SEQ ID NO: 4765416 - DNA, 13 bp, Homo sapiens
tgaagacagagct

SEQ ID NO: 4765417 - DNA, 21 bp, Homo sapiens
tgaagaccctatctcccacaa

SEQ ID NO: 4765418 - DNA, 17 bp, Homo sapiens
tgaagacttttctttca

SEQ ID NO: 4765419 - DNA, 15 bp, Homo sapiens
tgaagagagatatat

SEQ ID NO: 4765420 - DNA, 22 bp, Homo sapiens
tgaagagagatatatctgaaaa

SEQ ID NO: 4765421 - DNA, 21 bp, Homo sapiens
tgaagagtggaaatggggaac

SEQ ID NO: 4765422 - DNA, 23 bp, Homo sapiens
tgaagataaatccaactctgact

SEQ ID NO: 4765423 - DNA, 20 bp, Homo sapiens
tgaagatgcattttaaatgt

SEQ ID NO: 4765424 - DNA, 14 bp, Homo sapiens
tgaagcaaacacac

SEQ ID NO: 4765425 - DNA, 16 bp, Homo sapiens
tgaagcagagtcaagc

SEQ ID NO: 4765426 - DNA, 21 bp, Homo sapiens
tgaagcagagtcaagctgatg

SEQ ID NO: 4765427 - DNA, 23 bp, Homo sapiens
tgaagcagagtcaagctgatgaa

SEQ ID NO: 4765428 - DNA, 15 bp, Homo sapiens
tgaagcccaggagga

SEQ ID NO: 4765429 - DNA, 16 bp, Homo sapiens
tgaagcccaggaggac

SEQ ID NO: 4765430 - DNA, 15 bp, Homo sapiens
tgaagccctaagtaa

SEQ ID NO: 4765431 - DNA, 20 bp, Homo sapiens
tgaaggaatgcaataaagag

SEQ ID NO: 4765432 - DNA, 17 bp, Homo sapiens
tgaagggaaatcaattt

SEQ ID NO: 4765433 - DNA, 13 bp, Homo sapiens
tgaagggcccagg

SEQ ID NO: 4765434 - DNA, 9 bp, Homo sapiens
tgaaggggc

SEQ ID NO: 4765435 - DNA, 23 bp, Homo sapiens
tgaagtaagttctgaaaactgtt

SEQ ID NO: 4765436 - DNA, 18 bp, Homo sapiens
tgaagtagtgtgagtgtt

SEQ ID NO: 4765437 - DNA, 14 bp, Homo sapiens
tgaagtatgcacta

SEQ ID NO: 4765438 - DNA, 14 bp, Homo sapiens
tgaagtcccttcct

SEQ ID NO: 4765439 - DNA, 13 bp, Homo sapiens
tgaagtgcatgtt

SEQ ID NO: 4765440 - DNA, 15 bp, Homo sapiens
tgaagtgcatgttaa

SEQ ID NO: 4765441 - DNA, 16 bp, Homo sapiens
tgaagtgcatgttaaa

SEQ ID NO: 4765442 - DNA, 13 bp, Homo sapiens
tgaataaagccac

SEQ ID NO: 4765443 - DNA, 12 bp, Homo sapiens
tgaataacaaca

SEQ ID NO: 4765444 - DNA, 14 bp, Homo sapiens
tgaataacaacaat

SEQ ID NO: 4765445 - DNA, 14 bp, Homo sapiens
tgaataataaccac

SEQ ID NO: 4765446 - DNA, 15 bp, Homo sapiens
tgaatagtattgtgt

SEQ ID NO: 4765447 - DNA, 23 bp, Homo sapiens
tgaatataaatgtactacatttg

SEQ ID NO: 4765448 - DNA, 18 bp, Homo sapiens
tgaatataaatgtgtgta

SEQ ID NO: 4765449 - DNA, 19 bp, Homo sapiens
tgaatataaatgtgtgtat

SEQ ID NO: 4765450 - DNA, 22 bp, Homo sapiens
tgaatataaatgtgtgtatgtg

SEQ ID NO: 4765451 - DNA, 15 bp, Homo sapiens
tgaatatactcatta

SEQ ID NO: 4765452 - DNA, 15 bp, Homo sapiens
tgaatatgtgtaact

SEQ ID NO: 4765453 - DNA, 17 bp, Homo sapiens
tgaatcaatctggcttc

SEQ ID NO: 4765454 - DNA, 18 bp, Homo sapiens
tgaatccatcgatttgta

SEQ ID NO: 4765455 - DNA, 22 bp, Homo sapiens
tgaatccatgatcaaaatgcat

SEQ ID NO: 4765456 - DNA, 22 bp, Homo sapiens
tgaatctctaaaatgctgttct

SEQ ID NO: 4765457 - DNA, 18 bp, Homo sapiens
tgaatctctcaaaatgtg

SEQ ID NO: 4765458 - DNA, 21 bp, Homo sapiens
tgaatctctcaaaatgtgccg

SEQ ID NO: 4765459 - DNA, 20 bp, Homo sapiens
tgaatgaaatataaactgtg

SEQ ID NO: 4765460 - DNA, 16 bp, Homo sapiens
tgaatgagaagtaaat

SEQ ID NO: 4765461 - DNA, 22 bp, Homo sapiens
tgaatgagtttccagctaagcc

SEQ ID NO: 4765462 - DNA, 16 bp, Homo sapiens
tgaatgcaaaaagata

SEQ ID NO: 4765463 - DNA, 14 bp, Homo sapiens
tgaatgcagtataa

SEQ ID NO: 4765464 - DNA, 17 bp, Homo sapiens
tgaatgcccaggaagta

SEQ ID NO: 4765465 - DNA, 20 bp, Homo sapiens
tgaatgctatttgtgtaact

SEQ ID NO: 4765466 - DNA, 17 bp, Homo sapiens
tgaatgcttaaatgatc

SEQ ID NO: 4765467 - DNA, 15 bp, Homo sapiens
tgaatggttgcaaag

SEQ ID NO: 4765468 - DNA, 19 bp, Homo sapiens
tgaatggttgcaaagtgtt

SEQ ID NO: 4765469 - DNA, 13 bp, Homo sapiens
tgaatgtatgtaa

SEQ ID NO: 4765470 - DNA, 14 bp, Homo sapiens
tgaattaaagtcta

SEQ ID NO: 4765471 - DNA, 17 bp, Homo sapiens
tgaattattaatgaatg

SEQ ID NO: 4765472 - DNA, 21 bp, Homo sapiens
tgaattattgggcttaatata

SEQ ID NO: 4765473 - DNA, 17 bp, Homo sapiens
tgaattcacccctccca

SEQ ID NO: 4765474 - DNA, 17 bp, Homo sapiens
tgaattgacttatttca

SEQ ID NO: 4765475 - DNA, 13 bp, Homo sapiens
tgaattgtaagga

SEQ ID NO: 4765476 - DNA, 21 bp, Homo sapiens
tgaattgtaaggaatgattaa

SEQ ID NO: 4765477 - DNA, 19 bp, Homo sapiens
tgaattgtgtggagaagtg

SEQ ID NO: 4765478 - DNA, 20 bp, Homo sapiens
tgaattgttatgtaaacatc

SEQ ID NO: 4765479 - DNA, 12 bp, Homo sapiens
tgaatttctatg

SEQ ID NO: 4765480 - DNA, 19 bp, Homo sapiens
tgaatttggggctacttat

SEQ ID NO: 4765481 - DNA, 12 bp, Homo sapiens
tgacaacatttt

SEQ ID NO: 4765482 - DNA, 21 bp, Homo sapiens
tgacaagggctgacctgcctc

SEQ ID NO: 4765483 - DNA, 22 bp, Homo sapiens
tgacaagggctgacctgcctct

SEQ ID NO: 4765484 - DNA, 21 bp, Homo sapiens
tgacaagtggggtctttcaga

SEQ ID NO: 4765485 - DNA, 18 bp, Homo sapiens
tgacacaatggtagctct

SEQ ID NO: 4765486 - DNA, 20 bp, Homo sapiens
tgacacaatggtagctctga

SEQ ID NO: 4765487 - DNA, 17 bp, Homo sapiens
tgacacactcaccattt

SEQ ID NO: 4765488 - DNA, 16 bp, Homo sapiens
tgacacattgcacaca

SEQ ID NO: 4765489 - DNA, 18 bp, Homo sapiens
tgacaccaccactgtgtc

SEQ ID NO: 4765490 - DNA, 19 bp, Homo sapiens
tgacacttttcatatcatt

SEQ ID NO: 4765491 - DNA, 22 bp, Homo sapiens
tgacagcactaaacttggtgct

SEQ ID NO: 4765492 - DNA, 17 bp, Homo sapiens
tgacagcctccaccttg

SEQ ID NO: 4765493 - DNA, 21 bp, Homo sapiens
tgacagcctccaccttgagca

SEQ ID NO: 4765494 - DNA, 23 bp, Homo sapiens
tgacagcctccaccttgagcact

SEQ ID NO: 4765495 - DNA, 20 bp, Homo sapiens
tgacagcgccatgtgtgtca

SEQ ID NO: 4765496 - DNA, 16 bp, Homo sapiens
tgacagctgtgctgta

SEQ ID NO: 4765497 - DNA, 21 bp, Homo sapiens
tgacaggaaagccctccccct

SEQ ID NO: 4765498 - DNA, 22 bp, Homo sapiens
tgacaggaacccatcactgtgt

SEQ ID NO: 4765499 - DNA, 23 bp, Homo sapiens
tgacaggaacccatcactgtgtc

SEQ ID NO: 4765500 - DNA, 20 bp, Homo sapiens
tgacaggcgccgcctcgccc

SEQ ID NO: 4765501 - DNA, 19 bp, Homo sapiens
tgacagtggttatatttca

SEQ ID NO: 4765502 - DNA, 15 bp, Homo sapiens
tgacatccacatgca

SEQ ID NO: 4765503 - DNA, 20 bp, Homo sapiens
tgacatccacatgcacatgt

SEQ ID NO: 4765504 - DNA, 19 bp, Homo sapiens
tgacatgcactgacccttc

SEQ ID NO: 4765505 - DNA, 13 bp, Homo sapiens
tgacattgtcaga

SEQ ID NO: 4765506 - DNA, 17 bp, Homo sapiens
tgacattgtcagaatgt

SEQ ID NO: 4765507 - DNA, 22 bp, Homo sapiens
tgacattgtcagaatgttgtgt

SEQ ID NO: 4765508 - DNA, 16 bp, Homo sapiens
tgacattttgtagcta

SEQ ID NO: 4765509 - DNA, 21 bp, Homo sapiens
tgaccaaggtgaagatggcct

SEQ ID NO: 4765510 - DNA, 13 bp, Homo sapiens
tgaccaatctctg

SEQ ID NO: 4765511 - DNA, 14 bp, Homo sapiens
tgaccaatctctgt

SEQ ID NO: 4765512 - DNA, 16 bp, Homo sapiens
tgaccaatctctgtga

SEQ ID NO: 4765513 - DNA, 15 bp, Homo sapiens
tgaccactgggcctg

SEQ ID NO: 4765514 - DNA, 17 bp, Homo sapiens
tgaccactgggcctgct

SEQ ID NO: 4765515 - DNA, 23 bp, Homo sapiens
tgaccagaatgaggcacatgaca

SEQ ID NO: 4765516 - DNA, 21 bp, Homo sapiens
tgaccagactgtgggtccctg

SEQ ID NO: 4765517 - DNA, 20 bp, Homo sapiens
tgaccagcataccagttctt

SEQ ID NO: 4765518 - DNA, 23 bp, Homo sapiens
tgaccagcataccagttcttgca

SEQ ID NO: 4765519 - DNA, 20 bp, Homo sapiens
tgaccaggctcacaactgtt

SEQ ID NO: 4765520 - DNA, 21 bp, Homo sapiens
tgaccaggctcacaactgttt

SEQ ID NO: 4765521 - DNA, 14 bp, Homo sapiens
tgacccaattaagt

SEQ ID NO: 4765522 - DNA, 13 bp, Homo sapiens
tgaccccacacgc

SEQ ID NO: 4765523 - DNA, 12 bp, Homo sapiens
tgaccctcacct

SEQ ID NO: 4765524 - DNA, 15 bp, Homo sapiens
tgaccctgtgcctgt

SEQ ID NO: 4765525 - DNA, 21 bp, Homo sapiens
tgacccttccagacatacgaa

SEQ ID NO: 4765526 - DNA, 19 bp, Homo sapiens
tgacccttcccaatcagca

SEQ ID NO: 4765527 - DNA, 14 bp, Homo sapiens
tgaccgaagggacg

SEQ ID NO: 4765528 - DNA, 20 bp, Homo sapiens
tgaccgtgaggccagagaca

SEQ ID NO: 4765529 - DNA, 14 bp, Homo sapiens
tgacctaccctgga

SEQ ID NO: 4765530 - DNA, 21 bp, Homo sapiens
tgacctctcacttttttataa

SEQ ID NO: 4765531 - DNA, 12 bp, Homo sapiens
tgacctgacacc

SEQ ID NO: 4765532 - DNA, 14 bp, Homo sapiens
tgacctgacacctg

SEQ ID NO: 4765533 - DNA, 16 bp, Homo sapiens
tgaccttacatagctt

SEQ ID NO: 4765534 - DNA, 16 bp, Homo sapiens
tgaccttcctctgggg

SEQ ID NO: 4765535 - DNA, 17 bp, Homo sapiens
tgaccttcctctggggc

SEQ ID NO: 4765536 - DNA, 21 bp, Homo sapiens
tgaccttcctctggggctcta

SEQ ID NO: 4765537 - DNA, 17 bp, Homo sapiens
tgaccttggagagacac

SEQ ID NO: 4765538 - DNA, 19 bp, Homo sapiens
tgaccttggagagacacag

SEQ ID NO: 4765539 - DNA, 15 bp, Homo sapiens
tgacctttaggtatt

SEQ ID NO: 4765540 - DNA, 16 bp, Homo sapiens
tgacctttaggtatta

SEQ ID NO: 4765541 - DNA, 16 bp, Homo sapiens
tgacctttatttatta

SEQ ID NO: 4765542 - DNA, 23 bp, Homo sapiens
tgacctttatttattaaacttca

SEQ ID NO: 4765543 - DNA, 18 bp, Homo sapiens
tgacctttttaatccagg

SEQ ID NO: 4765544 - DNA, 21 bp, Homo sapiens
tgacgacctacatctgaaatc

SEQ ID NO: 4765545 - DNA, 15 bp, Homo sapiens
tgacgcagcccccca

SEQ ID NO: 4765546 - DNA, 14 bp, Homo sapiens
tgacggccctgcaa

SEQ ID NO: 4765547 - DNA, 19 bp, Homo sapiens
tgacgtctagctatgctgt

SEQ ID NO: 4765548 - DNA, 16 bp, Homo sapiens
tgacgtgcacaaacct

SEQ ID NO: 4765549 - DNA, 19 bp, Homo sapiens
tgacgtgcacaaaccttct

SEQ ID NO: 4765550 - DNA, 15 bp, Homo sapiens
tgactcagtgcaggg

SEQ ID NO: 4765551 - DNA, 16 bp, Homo sapiens
tgactctttattgtct

SEQ ID NO: 4765552 - DNA, 21 bp, Homo sapiens
tgactctttctattgtttctt

SEQ ID NO: 4765553 - DNA, 21 bp, Homo sapiens
tgactgaacgatccttcaaag

SEQ ID NO: 4765554 - DNA, 13 bp, Homo sapiens
tgactgaatttct

SEQ ID NO: 4765555 - DNA, 15 bp, Homo sapiens
tgactgctgcctccc

SEQ ID NO: 4765556 - DNA, 17 bp, Homo sapiens
tgactggtcccccatgg

SEQ ID NO: 4765557 - DNA, 16 bp, Homo sapiens
tgactgtagtttttgt

SEQ ID NO: 4765558 - DNA, 23 bp, Homo sapiens
tgactgtagtttttgttcacctt

SEQ ID NO: 4765559 - DNA, 18 bp, Homo sapiens
tgactgtggggtttttaa

SEQ ID NO: 4765560 - DNA, 18 bp, Homo sapiens
tgactgttatctcggact

SEQ ID NO: 4765561 - DNA, 13 bp, Homo sapiens
tgactgttctctt

SEQ ID NO: 4765562 - DNA, 19 bp, Homo sapiens
tgacttattgattaagtat

SEQ ID NO: 4765563 - DNA, 16 bp, Homo sapiens
tgacttatttgctcat

SEQ ID NO: 4765564 - DNA, 19 bp, Homo sapiens
tgacttcagactctctcct

SEQ ID NO: 4765565 - DNA, 17 bp, Homo sapiens
tgacttcccagctggca

SEQ ID NO: 4765566 - DNA, 18 bp, Homo sapiens
tgacttcccagctggcag

SEQ ID NO: 4765567 - DNA, 14 bp, Homo sapiens
tgacttctcccggg

SEQ ID NO: 4765568 - DNA, 20 bp, Homo sapiens
tgacttctttactaacactg

SEQ ID NO: 4765569 - DNA, 16 bp, Homo sapiens
tgacttgccactgcca

SEQ ID NO: 4765570 - DNA, 14 bp, Homo sapiens
tgagaaaactgtga

SEQ ID NO: 4765571 - DNA, 22 bp, Homo sapiens
tgagaaaactgtgaccaagtat

SEQ ID NO: 4765572 - DNA, 18 bp, Homo sapiens
tgagaaattgtgccaaag

SEQ ID NO: 4765573 - DNA, 19 bp, Homo sapiens
tgagaaatttttttccaga

SEQ ID NO: 4765574 - DNA, 20 bp, Homo sapiens
tgagaaatttttttccagaa

SEQ ID NO: 4765575 - DNA, 13 bp, Homo sapiens
tgagaactgtgaa

SEQ ID NO: 4765576 - DNA, 15 bp, Homo sapiens
tgagaactgtgaata

SEQ ID NO: 4765577 - DNA, 20 bp, Homo sapiens
tgagaactgtgaatatgtgt

SEQ ID NO: 4765578 - DNA, 15 bp, Homo sapiens
tgagaagaggagccc

SEQ ID NO: 4765579 - DNA, 13 bp, Homo sapiens
tgagaagataaaa

SEQ ID NO: 4765580 - DNA, 15 bp, Homo sapiens
tcaaatgctaaatgc

SEQ ID NO: 4765581 - DNA, 17 bp, Homo sapiens
tcaaatgctaaatgcaa

SEQ ID NO: 4765582 - DNA, 16 bp, Homo sapiens
tcaaatggatgtaata

SEQ ID NO: 4765583 - DNA, 20 bp, Homo sapiens
tcaaatggtattttttgtga

SEQ ID NO: 4765584 - DNA, 23 bp, Homo sapiens
tcaaatggtattttttgtgaatg

SEQ ID NO: 4765585 - DNA, 12 bp, Homo sapiens
tcaaatgtgtaa

SEQ ID NO: 4765586 - DNA, 22 bp, Homo sapiens
tcaaattctgattattacaaca

SEQ ID NO: 4765587 - DNA, 23 bp, Homo sapiens
tcaaattctgattattacaacaa

SEQ ID NO: 4765588 - DNA, 20 bp, Homo sapiens
tcaacaaaagggagaacatg

SEQ ID NO: 4765589 - DNA, 15 bp, Homo sapiens
tcaacaaagaaatat

SEQ ID NO: 4765590 - DNA, 15 bp, Homo sapiens
tcaacaagaagaatt

SEQ ID NO: 4765591 - DNA, 18 bp, Homo sapiens
tcaacataacataagcta

SEQ ID NO: 4765592 - DNA, 15 bp, Homo sapiens
tcaactaaatccaaa

SEQ ID NO: 4765593 - DNA, 13 bp, Homo sapiens
tcaactccaaggc

SEQ ID NO: 4765594 - DNA, 13 bp, Homo sapiens
tcaacttaatgaa

SEQ ID NO: 4765595 - DNA, 16 bp, Homo sapiens
tcaacttaatgaagaa

SEQ ID NO: 4765596 - DNA, 23 bp, Homo sapiens
tcaagaagatagttgtaaagata

SEQ ID NO: 4765597 - DNA, 19 bp, Homo sapiens
tcaagacggatccacagta

SEQ ID NO: 4765598 - DNA, 21 bp, Homo sapiens
tcaagacggatccacagtaat

SEQ ID NO: 4765599 - DNA, 18 bp, Homo sapiens
tcaagagcataatggtaa

SEQ ID NO: 4765600 - DNA, 20 bp, Homo sapiens
tcaagatgggtgattatgaa

SEQ ID NO: 4765601 - DNA, 13 bp, Homo sapiens
tcaagattaatta

SEQ ID NO: 4765602 - DNA, 14 bp, Homo sapiens
tcaagattaattaa

SEQ ID NO: 4765603 - DNA, 20 bp, Homo sapiens
tcaagcaaagacagtttctt

SEQ ID NO: 4765604 - DNA, 23 bp, Homo sapiens
tcaagcaaagacagtttcttgca

SEQ ID NO: 4765605 - DNA, 13 bp, Homo sapiens
tcaagccaggaga

SEQ ID NO: 4765606 - DNA, 19 bp, Homo sapiens
tcaagcgctatccacagaa

SEQ ID NO: 4765607 - DNA, 18 bp, Homo sapiens
tcaagctccatcttattt

SEQ ID NO: 4765608 - DNA, 14 bp, Homo sapiens
tcaagcttcatata

SEQ ID NO: 4765609 - DNA, 20 bp, Homo sapiens
tcaaggagggagaaaggcaa

SEQ ID NO: 4765610 - DNA, 13 bp, Homo sapiens
tcaaggctgcagt

SEQ ID NO: 4765611 - DNA, 19 bp, Homo sapiens
tcaaggtgctcttctcatt

SEQ ID NO: 4765612 - DNA, 11 bp, Homo sapiens
tcaagtctgtg

SEQ ID NO: 4765613 - DNA, 16 bp, Homo sapiens
tcaagttgtgtgctat

SEQ ID NO: 4765614 - DNA, 16 bp, Homo sapiens
tcaataactattgctg

SEQ ID NO: 4765615 - DNA, 17 bp, Homo sapiens
tcaatactttgaacaca

SEQ ID NO: 4765616 - DNA, 21 bp, Homo sapiens
tcaatatatagagacttctaa

SEQ ID NO: 4765617 - DNA, 14 bp, Homo sapiens
tcaatcattgtaca

SEQ ID NO: 4765618 - DNA, 16 bp, Homo sapiens
tcaatccacagtattg

SEQ ID NO: 4765619 - DNA, 18 bp, Homo sapiens
tcaatccacagtattgtt

SEQ ID NO: 4765620 - DNA, 20 bp, Homo sapiens
tcaatctggcttctgcatta

SEQ ID NO: 4765621 - DNA, 22 bp, Homo sapiens
tcaatctgtgaagcctttatct

SEQ ID NO: 4765622 - DNA, 17 bp, Homo sapiens
tcaatgaaatatttgct

SEQ ID NO: 4765623 - DNA, 13 bp, Homo sapiens
tcaatgcaatgca

SEQ ID NO: 4765624 - DNA, 22 bp, Homo sapiens
tcaatgcaatgcatctgaaagt

SEQ ID NO: 4765625 - DNA, 16 bp, Homo sapiens
tcaatgctacaaaatg

SEQ ID NO: 4765626 - DNA, 19 bp, Homo sapiens
tcaatgcttttctagcaac

SEQ ID NO: 4765627 - DNA, 18 bp, Homo sapiens
tcaatgggtaaataaatg

SEQ ID NO: 4765628 - DNA, 19 bp, Homo sapiens
tcaatgggtaaataaatgc

SEQ ID NO: 4765629 - DNA, 12 bp, Homo sapiens
tcaatgtactgt

SEQ ID NO: 4765630 - DNA, 13 bp, Homo sapiens
tcaatgtactgta

SEQ ID NO: 4765631 - DNA, 14 bp, Homo sapiens
tcaatgtactgtat

SEQ ID NO: 4765632 - DNA, 16 bp, Homo sapiens
tcaatgtactgtattg

SEQ ID NO: 4765633 - DNA, 21 bp, Homo sapiens
tcaatgtactgtattgggacg

SEQ ID NO: 4765634 - DNA, 10 bp, Homo sapiens
tcaatgtgaa

SEQ ID NO: 4765635 - DNA, 13 bp, Homo sapiens
tcaatgtgaaact

SEQ ID NO: 4765636 - DNA, 17 bp, Homo sapiens
tcaatgtgaaactgaga

SEQ ID NO: 4765637 - DNA, 19 bp, Homo sapiens
tcaatgtgctgttgattct

SEQ ID NO: 4765638 - DNA, 20 bp, Homo sapiens
tcaatgtgctgttgattctt

SEQ ID NO: 4765639 - DNA, 20 bp, Homo sapiens
tcaatgttcacgcaacttga

SEQ ID NO: 4765640 - DNA, 21 bp, Homo sapiens
tcaatgttcacgcaacttgaa

SEQ ID NO: 4765641 - DNA, 15 bp, Homo sapiens
tcaattaatggaaaa

SEQ ID NO: 4765642 - DNA, 19 bp, Homo sapiens
tcaattaatggaaaactgt

SEQ ID NO: 4765643 - DNA, 23 bp, Homo sapiens
tcaattacaggaagtactggaga

SEQ ID NO: 4765644 - DNA, 13 bp, Homo sapiens
tcaattccttagt

SEQ ID NO: 4765645 - DNA, 22 bp, Homo sapiens
tcaattgagttaaatcagtaat

SEQ ID NO: 4765646 - DNA, 17 bp, Homo sapiens
tcaattgcttgagcatg

SEQ ID NO: 4765647 - DNA, 24 bp, Homo sapiens
tcaattgcttgagcatgcccaaat

SEQ ID NO: 4765648 - DNA, 19 bp, Homo sapiens
tcacaactgtttttgaaga

SEQ ID NO: 4765649 - DNA, 12 bp, Homo sapiens
tcacaactttgc

SEQ ID NO: 4765650 - DNA, 16 bp, Homo sapiens
tcacaatttgaaaagc

SEQ ID NO: 4765651 - DNA, 12 bp, Homo sapiens
tcacacaaagtg

SEQ ID NO: 4765652 - DNA, 14 bp, Homo sapiens
tcacacaactgtgg

SEQ ID NO: 4765653 - DNA, 15 bp, Homo sapiens
tcacacacacacaca

SEQ ID NO: 4765654 - DNA, 17 bp, Homo sapiens
tcacaccactgccattt

SEQ ID NO: 4765655 - DNA, 15 bp, Homo sapiens
tcacaccctgcaagg

SEQ ID NO: 4765656 - DNA, 21 bp, Homo sapiens
tcacaccctgcaaggcccaca

SEQ ID NO: 4765657 - DNA, 23 bp, Homo sapiens
tcacaccttacaaagccagctct

SEQ ID NO: 4765658 - DNA, 16 bp, Homo sapiens
tcacactctaactgta

SEQ ID NO: 4765659 - DNA, 14 bp, Homo sapiens
tcacacttgggctg

SEQ ID NO: 4765660 - DNA, 16 bp, Homo sapiens
tcacagacccctgggg

SEQ ID NO: 4765661 - DNA, 20 bp, Homo sapiens
tcacagagtacaaaatagtt

SEQ ID NO: 4765662 - DNA, 20 bp, Homo sapiens
tcacagcacatgctggccag

SEQ ID NO: 4765663 - DNA, 18 bp, Homo sapiens
tcacagtgacccttccca

SEQ ID NO: 4765664 - DNA, 22 bp, Homo sapiens
tcacagtgggcggcttccctgc

SEQ ID NO: 4765665 - DNA, 22 bp, Homo sapiens
tcacatatcaagtcccgaggca

SEQ ID NO: 4765666 - DNA, 12 bp, Homo sapiens
tcacatctgtat

SEQ ID NO: 4765667 - DNA, 22 bp, Homo sapiens
tcacatctgtatatcagctcta

SEQ ID NO: 4765668 - DNA, 16 bp, Homo sapiens
tcacatgacatccaca

SEQ ID NO: 4765669 - DNA, 23 bp, Homo sapiens
tcacatgacatccacatgcacat

SEQ ID NO: 4765670 - DNA, 19 bp, Homo sapiens
tcaccacaaccctgttgct

SEQ ID NO: 4765671 - DNA, 12 bp, Homo sapiens
tcaccacagctg

SEQ ID NO: 4765672 - DNA, 15 bp, Homo sapiens
tcaccacgcagagag

SEQ ID NO: 4765673 - DNA, 12 bp, Homo sapiens
tcaccaggaaga

SEQ ID NO: 4765674 - DNA, 17 bp, Homo sapiens
tcaccaggaagaaggcc

SEQ ID NO: 4765675 - DNA, 22 bp, Homo sapiens
tcaccaggaagaaggcccggga

SEQ ID NO: 4765676 - DNA, 23 bp, Homo sapiens
tcaccaggaagaaggcccgggag

SEQ ID NO: 4765677 - DNA, 23 bp, Homo sapiens
tcaccatttaatcatttccagca

SEQ ID NO: 4765678 - DNA, 13 bp, Homo sapiens
tcacccagcctgg

SEQ ID NO: 4765679 - DNA, 13 bp, Homo sapiens
tcaccccacactt

SEQ ID NO: 4765680 - DNA, 18 bp, Homo sapiens
tcaccccccgacctggct

SEQ ID NO: 4765681 - DNA, 15 bp, Homo sapiens
tcaccccggcaggcc

SEQ ID NO: 4765682 - DNA, 16 bp, Homo sapiens
tcaccccggcaggccc

SEQ ID NO: 4765683 - DNA, 19 bp, Homo sapiens
tcaccccggcaggccctgc

SEQ ID NO: 4765684 - DNA, 20 bp, Homo sapiens
tcaccccggcaggccctgca

SEQ ID NO: 4765685 - DNA, 22 bp, Homo sapiens
tcaccccggcaggccctgcagt

SEQ ID NO: 4765686 - DNA, 23 bp, Homo sapiens
tcaccctgccaccctctgctgca

SEQ ID NO: 4765687 - DNA, 22 bp, Homo sapiens
tcaccgacccgacactctcacc

SEQ ID NO: 4765688 - DNA, 17 bp, Homo sapiens
tcaccgattcttccttg

SEQ ID NO: 4765689 - DNA, 14 bp, Homo sapiens
tcaccgcattccag

SEQ ID NO: 4765690 - DNA, 15 bp, Homo sapiens
tcaccgcattccagg

SEQ ID NO: 4765691 - DNA, 23 bp, Homo sapiens
tcacctccattaaccaagaaaac

SEQ ID NO: 4765692 - DNA, 21 bp, Homo sapiens
tcacctccttctgcagtcaga

SEQ ID NO: 4765693 - DNA, 20 bp, Homo sapiens
tcacctgaattattaatgaa

SEQ ID NO: 4765694 - DNA, 13 bp, Homo sapiens
tcacctggcttcc

SEQ ID NO: 4765695 - DNA, 15 bp, Homo sapiens
tcacctggcttccca

SEQ ID NO: 4765696 - DNA, 17 bp, Homo sapiens
tcacctggcttcccagg

SEQ ID NO: 4765697 - DNA, 15 bp, Homo sapiens
tcaccttcctgggca

SEQ ID NO: 4765698 - DNA, 21 bp, Homo sapiens
tcaccttcctgggcagcccag

SEQ ID NO: 4765699 - DNA, 22 bp, Homo sapiens
tcaccttcctgggcagcccaga

SEQ ID NO: 4765700 - DNA, 15 bp, Homo sapiens
tcaccttctgtgcat

SEQ ID NO: 4765701 - DNA, 20 bp, Homo sapiens
tcaccttctgttttagagtt

SEQ ID NO: 4765702 - DNA, 19 bp, Homo sapiens
tcagtattgagacactgtc

SEQ ID NO: 4765703 - DNA, 20 bp, Homo sapiens
tcagtcactaaaaggaagac

SEQ ID NO: 4765704 - DNA, 14 bp, Homo sapiens
tcagtcagcccagt

SEQ ID NO: 4765705 - DNA, 13 bp, Homo sapiens
tcagtcagctccg

SEQ ID NO: 4765706 - DNA, 13 bp, Homo sapiens
tcagtcattaaat

SEQ ID NO: 4765707 - DNA, 13 bp, Homo sapiens
tcagtcccacagc

SEQ ID NO: 4765708 - DNA, 20 bp, Homo sapiens
tcagtccctccctcctggct

SEQ ID NO: 4765709 - DNA, 18 bp, Homo sapiens
tcagtcgatattcccagg

SEQ ID NO: 4765710 - DNA, 21 bp, Homo sapiens
tcagtctttgtcaatgctcta

SEQ ID NO: 4765711 - DNA, 16 bp, Homo sapiens
tcagtgccaaaaacaa

SEQ ID NO: 4765712 - DNA, 15 bp, Homo sapiens
tcagtggatcacaca

SEQ ID NO: 4765713 - DNA, 16 bp, Homo sapiens
tcagtgtcattttctg

SEQ ID NO: 4765714 - DNA, 19 bp, Homo sapiens
tcagtgtcattttctgtta

SEQ ID NO: 4765715 - DNA, 13 bp, Homo sapiens
tcagtgtgactga

SEQ ID NO: 4765716 - DNA, 18 bp, Homo sapiens
tcagtgtgactgatctct

SEQ ID NO: 4765717 - DNA, 19 bp, Homo sapiens
tcagtgtgataaggacttt

SEQ ID NO: 4765718 - DNA, 13 bp, Homo sapiens
tcagtgttataaa

SEQ ID NO: 4765719 - DNA, 13 bp, Homo sapiens
tcagttacagtgg

SEQ ID NO: 4765720 - DNA, 21 bp, Homo sapiens
tcagttacagtggcagtattg

SEQ ID NO: 4765721 - DNA, 17 bp, Homo sapiens
tcagttcaacctggtgg

SEQ ID NO: 4765722 - DNA, 14 bp, Homo sapiens
tcagttctcatctt

SEQ ID NO: 4765723 - DNA, 19 bp, Homo sapiens
tcagttgttagtgtgtctt

SEQ ID NO: 4765724 - DNA, 13 bp, Homo sapiens
tcagtttctctgg

SEQ ID NO: 4765725 - DNA, 12 bp, Homo sapiens
tcagtttgtgaa

SEQ ID NO: 4765726 - DNA, 13 bp, Homo sapiens
tcagtttgtgaag

SEQ ID NO: 4765727 - DNA, 14 bp, Homo sapiens
tcagtttgtgaagt

SEQ ID NO: 4765728 - DNA, 13 bp, Homo sapiens
tcataaagtgaga

SEQ ID NO: 4765729 - DNA, 18 bp, Homo sapiens
tcataaattatttctaaa

SEQ ID NO: 4765730 - DNA, 13 bp, Homo sapiens
tcataaattcaaa

SEQ ID NO: 4765731 - DNA, 15 bp, Homo sapiens
tcataactagagcac

SEQ ID NO: 4765732 - DNA, 13 bp, Homo sapiens
tcataatgactta

SEQ ID NO: 4765733 - DNA, 11 bp, Homo sapiens
tcatacacaga

SEQ ID NO: 4765734 - DNA, 14 bp, Homo sapiens
tcatacacagaaat

SEQ ID NO: 4765735 - DNA, 20 bp, Homo sapiens
tcatacacagaaatcctaac

SEQ ID NO: 4765736 - DNA, 22 bp, Homo sapiens
tcatacacagaaatcctaacat

SEQ ID NO: 4765737 - DNA, 20 bp, Homo sapiens
tcatacagtctctatttgat

SEQ ID NO: 4765738 - DNA, 12 bp, Homo sapiens
tcatacataaaa

SEQ ID NO: 4765739 - DNA, 15 bp, Homo sapiens
tcataccatccatcc

SEQ ID NO: 4765740 - DNA, 14 bp, Homo sapiens
tcatactcaaagag

SEQ ID NO: 4765741 - DNA, 14 bp, Homo sapiens
tcatacttaaaaat

SEQ ID NO: 4765742 - DNA, 16 bp, Homo sapiens
tcatacttaaaaattt

SEQ ID NO: 4765743 - DNA, 19 bp, Homo sapiens
tcatacttaaaaatttatt

SEQ ID NO: 4765744 - DNA, 20 bp, Homo sapiens
tcatagataccattttgaaa

SEQ ID NO: 4765745 - DNA, 15 bp, Homo sapiens
tcatagcacatgttt

SEQ ID NO: 4765746 - DNA, 20 bp, Homo sapiens
tcatagcacatgttttacaa

SEQ ID NO: 4765747 - DNA, 18 bp, Homo sapiens
tcataggcagagcccgcc

SEQ ID NO: 4765748 - DNA, 15 bp, Homo sapiens
tcatagtcaatcaaa

SEQ ID NO: 4765749 - DNA, 13 bp, Homo sapiens
tcatatcatttct

SEQ ID NO: 4765750 - DNA, 19 bp, Homo sapiens
tcatatgtgaagacagagc

SEQ ID NO: 4765751 - DNA, 18 bp, Homo sapiens
tcatcaacaaaagggaga

SEQ ID NO: 4765752 - DNA, 23 bp, Homo sapiens
tcatcaacaaaagggagaacatg

SEQ ID NO: 4765753 - DNA, 23 bp, Homo sapiens
tcatcaagtagtagtacttaata

SEQ ID NO: 4765754 - DNA, 16 bp, Homo sapiens
tcatcaatcattgtac

SEQ ID NO: 4765755 - DNA, 18 bp, Homo sapiens
tcatcaccgattcttcct

SEQ ID NO: 4765756 - DNA, 23 bp, Homo sapiens
tcatcaccgattcttccttgcca

SEQ ID NO: 4765757 - DNA, 15 bp, Homo sapiens
tcatcagaaaaagtc

SEQ ID NO: 4765758 - DNA, 22 bp, Homo sapiens
tcatcagaagtggtaggaaagc

SEQ ID NO: 4765759 - DNA, 14 bp, Homo sapiens
tcatccaaaagtga

SEQ ID NO: 4765760 - DNA, 17 bp, Homo sapiens
tcatccaaaagtgacca

SEQ ID NO: 4765761 - DNA, 19 bp, Homo sapiens
tcatccaactggaaggctt

SEQ ID NO: 4765762 - DNA, 21 bp, Homo sapiens
tcatccactaggtgcccagtc

SEQ ID NO: 4765763 - DNA, 16 bp, Homo sapiens
tcatccagaactgtct

SEQ ID NO: 4765764 - DNA, 22 bp, Homo sapiens
tcatccagtttgttctccgggt

SEQ ID NO: 4765765 - DNA, 16 bp, Homo sapiens
tcatcctcacatgtgg

SEQ ID NO: 4765766 - DNA, 12 bp, Homo sapiens
tcatcctcagca

SEQ ID NO: 4765767 - DNA, 15 bp, Homo sapiens
tcatcctgccttcat

SEQ ID NO: 4765768 - DNA, 17 bp, Homo sapiens
tcatcctgccttcatgg

SEQ ID NO: 4765769 - DNA, 23 bp, Homo sapiens
tcatcctgccttcatggaactca

SEQ ID NO: 4765770 - DNA, 14 bp, Homo sapiens
tcatccttctggaa

SEQ ID NO: 4765771 - DNA, 23 bp, Homo sapiens
tcatcggaggctgggcccctggg

SEQ ID NO: 4765772 - DNA, 13 bp, Homo sapiens
tcatctcagctca

SEQ ID NO: 4765773 - DNA, 19 bp, Homo sapiens
tcatctcagctcactgcaa

SEQ ID NO: 4765774 - DNA, 17 bp, Homo sapiens
tcatctccatgctcttt

SEQ ID NO: 4765775 - DNA, 13 bp, Homo sapiens
tcatctctctggg

SEQ ID NO: 4765776 - DNA, 14 bp, Homo sapiens
tcatctctctgggg

SEQ ID NO: 4765777 - DNA, 20 bp, Homo sapiens
tcatctctctggggccctgg

SEQ ID NO: 4765778 - DNA, 15 bp, Homo sapiens
tcatctgtaaaacca

SEQ ID NO: 4765779 - DNA, 18 bp, Homo sapiens
tcatctgtaaaaccaggc

SEQ ID NO: 4765780 - DNA, 22 bp, Homo sapiens
tcatctgtaaaatagtctcatt

SEQ ID NO: 4765781 - DNA, 12 bp, Homo sapiens
tcatctgtcagc

SEQ ID NO: 4765782 - DNA, 21 bp, Homo sapiens
tcatcttgtaaataatgctta

SEQ ID NO: 4765783 - DNA, 13 bp, Homo sapiens
tcatctttgattt

SEQ ID NO: 4765784 - DNA, 15 bp, Homo sapiens
tcatgaccttacata

SEQ ID NO: 4765785 - DNA, 23 bp, Homo sapiens
tcatgactttcagattgtatctg

SEQ ID NO: 4765786 - DNA, 13 bp, Homo sapiens
tcatgatgctagt

SEQ ID NO: 4765787 - DNA, 13 bp, Homo sapiens
tcatgatgctcat

SEQ ID NO: 4765788 - DNA, 21 bp, Homo sapiens
tcatgcacacaattagatttc

SEQ ID NO: 4765789 - DNA, 16 bp, Homo sapiens
tcatgcaggttagaaa

SEQ ID NO: 4765790 - DNA, 15 bp, Homo sapiens
tcatgcatagacaag

SEQ ID NO: 4765791 - DNA, 19 bp, Homo sapiens
tcatggctgttatctgtct

SEQ ID NO: 4765792 - DNA, 13 bp, Homo sapiens
tcatgtaaattga

SEQ ID NO: 4765793 - DNA, 20 bp, Homo sapiens
tcatgtctattgtccaaagt

SEQ ID NO: 4765794 - DNA, 12 bp, Homo sapiens
tcatgttgatgt

SEQ ID NO: 4765795 - DNA, 22 bp, Homo sapiens
tcatgtttaagaaatgagaaat

SEQ ID NO: 4765796 - DNA, 18 bp, Homo sapiens
tcatgtttaatttgcatc

SEQ ID NO: 4765797 - DNA, 15 bp, Homo sapiens
tcatgtttctgcagt

SEQ ID NO: 4765798 - DNA, 15 bp, Homo sapiens
tcatgttttatatga

SEQ ID NO: 4765799 - DNA, 13 bp, Homo sapiens
tcattaaaacaag

SEQ ID NO: 4765800 - DNA, 15 bp, Homo sapiens
tcattaaaacaagag

SEQ ID NO: 4765801 - DNA, 19 bp, Homo sapiens
tcattaaaacaagagacca

SEQ ID NO: 4765802 - DNA, 15 bp, Homo sapiens
tcattaaattactat

SEQ ID NO: 4765803 - DNA, 14 bp, Homo sapiens
tcattagaattgaa

SEQ ID NO: 4765804 - DNA, 15 bp, Homo sapiens
tcattcaagcttcat

SEQ ID NO: 4765805 - DNA, 20 bp, Homo sapiens
tcattctggtccttagtaaa

SEQ ID NO: 4765806 - DNA, 18 bp, Homo sapiens
tcattgagggaaaacata

SEQ ID NO: 4765807 - DNA, 16 bp, Homo sapiens
tcattgcttatgacat

SEQ ID NO: 4765808 - DNA, 17 bp, Homo sapiens
tcattgtacagtttgtt

SEQ ID NO: 4765809 - DNA, 19 bp, Homo sapiens
tcattgtacagtttgttta

SEQ ID NO: 4765810 - DNA, 22 bp, Homo sapiens
tcattgttacaggtgtactatg

SEQ ID NO: 4765811 - DNA, 17 bp, Homo sapiens
tcatttacaacttccag

SEQ ID NO: 4765812 - DNA, 17 bp, Homo sapiens
tcatttatgatacaaaa

SEQ ID NO: 4765813 - DNA, 15 bp, Homo sapiens
tcatttatgttattt

SEQ ID NO: 4765814 - DNA, 21 bp, Homo sapiens
tcatttatgttatttatgatg

SEQ ID NO: 4765815 - DNA, 22 bp, Homo sapiens
tcatttatgttatttatgatgt

SEQ ID NO: 4765816 - DNA, 14 bp, Homo sapiens
tcatttatttccat

SEQ ID NO: 4765817 - DNA, 19 bp, Homo sapiens
tcatttatttccatattaa

SEQ ID NO: 4765818 - DNA, 20 bp, Homo sapiens
tcatttatttccatattaaa

SEQ ID NO: 4765819 - DNA, 15 bp, Homo sapiens
tcatttccagcaaaa

SEQ ID NO: 4765820 - DNA, 20 bp, Homo sapiens
tcatttccagcaaaatatat

SEQ ID NO: 4765821 - DNA, 17 bp, Homo sapiens
tcatttgatattgtgta

SEQ ID NO: 4765822 - DNA, 17 bp, Homo sapiens
tcatttgccaggaagat

SEQ ID NO: 4765823 - DNA, 13 bp, Homo sapiens
tcatttgctaatg

SEQ ID NO: 4765824 - DNA, 16 bp, Homo sapiens
tcatttgctaatgaat

SEQ ID NO: 4765825 - DNA, 17 bp, Homo sapiens
tcatttggatataaatc

SEQ ID NO: 4765826 - DNA, 14 bp, Homo sapiens
tcattttccaatta

SEQ ID NO: 4765827 - DNA, 13 bp, Homo sapiens
tcattttcctggg

SEQ ID NO: 4765828 - DNA, 13 bp, Homo sapiens
tcattttctctcc

SEQ ID NO: 4765829 - DNA, 15 bp, Homo sapiens
tcattttctctcctc

SEQ ID NO: 4765830 - DNA, 20 bp, Homo sapiens
tcattttctgttatacacag

SEQ ID NO: 4765831 - DNA, 12 bp, Homo sapiens
tcattttgatgt

SEQ ID NO: 4765832 - DNA, 13 bp, Homo sapiens
tcattttgatgta

SEQ ID NO: 4765833 - DNA, 13 bp, Homo sapiens
tcattttgcacgt

SEQ ID NO: 4765834 - DNA, 20 bp, Homo sapiens
tcattttgggaaattcttgc

SEQ ID NO: 4765835 - DNA, 18 bp, Homo sapiens
tcatttttcattttctct

SEQ ID NO: 4765836 - DNA, 21 bp, Homo sapiens
tcatttttgaaactgcatttg

SEQ ID NO: 4765837 - DNA, 17 bp, Homo sapiens
tcattttttttaattga

SEQ ID NO: 4765838 - DNA, 22 bp, Homo sapiens
tccaaacctaccttatagagca

SEQ ID NO: 4765839 - DNA, 24 bp, Homo sapiens
tccaaacctaccttatagagcaca

SEQ ID NO: 4765840 - DNA, 12 bp, Homo sapiens
tccaaagcctgg

SEQ ID NO: 4765841 - DNA, 16 bp, Homo sapiens
tccaaaggttgtacat

SEQ ID NO: 4765842 - DNA, 16 bp, Homo sapiens
tccaaaggtttcaact

SEQ ID NO: 4765843 - DNA, 14 bp, Homo sapiens
tccaaattctctga

SEQ ID NO: 4765844 - DNA, 17 bp, Homo sapiens
tccaacatgtgatgtgt

SEQ ID NO: 4765845 - DNA, 18 bp, Homo sapiens
tccaaccattcaaaaatt

SEQ ID NO: 4765846 - DNA, 15 bp, Homo sapiens
tccaacccatgcatg

SEQ ID NO: 4765847 - DNA, 18 bp, Homo sapiens
tccaacccatgcatggcc

SEQ ID NO: 4765848 - DNA, 20 bp, Homo sapiens
tccaagaccttacaaccaca

SEQ ID NO: 4765849 - DNA, 12 bp, Homo sapiens
tccaagagggac

SEQ ID NO: 4765850 - DNA, 22 bp, Homo sapiens
tccaagcactagccttcccagc

SEQ ID NO: 4765851 - DNA, 16 bp, Homo sapiens
tccaagcatcagcaag

SEQ ID NO: 4765852 - DNA, 13 bp, Homo sapiens
tccaagccctggg

SEQ ID NO: 4765853 - DNA, 23 bp, Homo sapiens
tccaagcctctctggcactttga

SEQ ID NO: 4765854 - DNA, 23 bp, Homo sapiens
tccaaggaagggatgtatttgta

SEQ ID NO: 4765855 - DNA, 16 bp, Homo sapiens
tccaaggcaaatgtcc

SEQ ID NO: 4765856 - DNA, 18 bp, Homo sapiens
tccaaggcaaatgtccaa

SEQ ID NO: 4765857 - DNA, 13 bp, Homo sapiens
tccaagtatttta

SEQ ID NO: 4765858 - DNA, 22 bp, Homo sapiens
tccaagtattttatctgtgttg

SEQ ID NO: 4765859 - DNA, 16 bp, Homo sapiens
tccaagtcatgggaga

SEQ ID NO: 4765860 - DNA, 17 bp, Homo sapiens
tccaagtgtgtgtgcaa

SEQ ID NO: 4765861 - DNA, 22 bp, Homo sapiens
tccaagttatttgatctggtgc

SEQ ID NO: 4765862 - DNA, 15 bp, Homo sapiens
tccaatccagccttc

SEQ ID NO: 4765863 - DNA, 17 bp, Homo sapiens
tccaatgccaattcatc

SEQ ID NO: 4765864 - DNA, 23 bp, Homo sapiens
tccaattactactttgttattgt

SEQ ID NO: 4765865 - DNA, 12 bp, Homo sapiens
tccaattttcct

SEQ ID NO: 4765866 - DNA, 19 bp, Homo sapiens
tccaattttcctaagtttc

SEQ ID NO: 4765867 - DNA, 12 bp, Homo sapiens
tccacaaatgtc

SEQ ID NO: 4765868 - DNA, 16 bp, Homo sapiens
tccacaagagcccagg

SEQ ID NO: 4765869 - DNA, 18 bp, Homo sapiens
tccacaatcatctattga

SEQ ID NO: 4765870 - DNA, 18 bp, Homo sapiens
tccacaattttgtctcta

SEQ ID NO: 4765871 - DNA, 15 bp, Homo sapiens
tccacacacagcagc

SEQ ID NO: 4765872 - DNA, 10 bp, Homo sapiens
tccacacacc

SEQ ID NO: 4765873 - DNA, 16 bp, Homo sapiens
tccacacctccacccg

SEQ ID NO: 4765874 - DNA, 15 bp, Homo sapiens
tccacaggagccgca

SEQ ID NO: 4765875 - DNA, 21 bp, Homo sapiens
tccacagggacacagtctggt

SEQ ID NO: 4765876 - DNA, 18 bp, Homo sapiens
tccacagtaatctttcgg

SEQ ID NO: 4765877 - DNA, 11 bp, Homo sapiens
tccacatgcac

SEQ ID NO: 4765878 - DNA, 13 bp, Homo sapiens
tccaccaccttgc

SEQ ID NO: 4765879 - DNA, 14 bp, Homo sapiens
tccaccaccttgcc

SEQ ID NO: 4765880 - DNA, 15 bp, Homo sapiens
tccaccaccttgcca

SEQ ID NO: 4765881 - DNA, 15 bp, Homo sapiens
tccaccccagtcccc

SEQ ID NO: 4765882 - DNA, 17 bp, Homo sapiens
tccacccccattgtgaa

SEQ ID NO: 4765883 - DNA, 18 bp, Homo sapiens
tccacccccattgtgaat

SEQ ID NO: 4765884 - DNA, 20 bp, Homo sapiens
tccacccctcaagccaggag

SEQ ID NO: 4765885 - DNA, 12 bp, Homo sapiens
tccaccctgagg

SEQ ID NO: 4765886 - DNA, 12 bp, Homo sapiens
tccaccctgccc

SEQ ID NO: 4765887 - DNA, 17 bp, Homo sapiens
tccaccctgccctggcc

SEQ ID NO: 4765888 - DNA, 18 bp, Homo sapiens
tccaccctgccctggcct

SEQ ID NO: 4765889 - DNA, 17 bp, Homo sapiens
tccaccgcagaaggaag

SEQ ID NO: 4765890 - DNA, 21 bp, Homo sapiens
tccacctcccccaaaccctgc

SEQ ID NO: 4765891 - DNA, 18 bp, Homo sapiens
tccacctggaaagccagg

SEQ ID NO: 4765892 - DNA, 19 bp, Homo sapiens
tccacctggaaagccaggt

SEQ ID NO: 4765893 - DNA, 18 bp, Homo sapiens
tccacctggtggccctgc

SEQ ID NO: 4765894 - DNA, 15 bp, Homo sapiens
tccaccttctgccaa

SEQ ID NO: 4765895 - DNA, 15 bp, Homo sapiens
tccaccttgagcact

SEQ ID NO: 4765896 - DNA, 18 bp, Homo sapiens
tccacgcctcctggccag

SEQ ID NO: 4765897 - DNA, 22 bp, Homo sapiens
tccacgcttagggtctgtcccg

SEQ ID NO: 4765898 - DNA, 22 bp, Homo sapiens
tccacgtgtttcgggccagggc

SEQ ID NO: 4765899 - DNA, 16 bp, Homo sapiens
tccactcccctcatcc

SEQ ID NO: 4765900 - DNA, 19 bp, Homo sapiens
tccactcccctcatccact

SEQ ID NO: 4765901 - DNA, 18 bp, Homo sapiens
tccactcctcccaactct

SEQ ID NO: 4765902 - DNA, 23 bp, Homo sapiens
tccactcctcccaactctggcct

SEQ ID NO: 4765903 - DNA, 13 bp, Homo sapiens
tccactgcctctg

SEQ ID NO: 4765904 - DNA, 15 bp, Homo sapiens
tccactttcctctct

SEQ ID NO: 4765905 - DNA, 16 bp, Homo sapiens
tccagaaaaatcaatc

SEQ ID NO: 4765906 - DNA, 16 bp, Homo sapiens
tccagaacaaaagata

SEQ ID NO: 4765907 - DNA, 15 bp, Homo sapiens
tccagaagcagcagc

SEQ ID NO: 4765908 - DNA, 16 bp, Homo sapiens
tccagaatttcccaaa

SEQ ID NO: 4765909 - DNA, 22 bp, Homo sapiens
tccagaatttcccaaagcagtg

SEQ ID NO: 4765910 - DNA, 21 bp, Homo sapiens
tccagacaagccctgcttgct

SEQ ID NO: 4765911 - DNA, 22 bp, Homo sapiens
tccagacaagccctgcttgctg

SEQ ID NO: 4765912 - DNA, 23 bp, Homo sapiens
tccagacaagccctgcttgctgg

SEQ ID NO: 4765913 - DNA, 13 bp, Homo sapiens
tccagacaccatc

SEQ ID NO: 4765914 - DNA, 10 bp, Homo sapiens
tccagacaga

SEQ ID NO: 4765915 - DNA, 22 bp, Homo sapiens
tccagacagagtggatctggag

SEQ ID NO: 4765916 - DNA, 23 bp, Homo sapiens
tccagacagagtggatctggagt

SEQ ID NO: 4765917 - DNA, 22 bp, Homo sapiens
tccagacccctaccctttccca

SEQ ID NO: 4765918 - DNA, 23 bp, Homo sapiens
tccagacttcgctattcccaggc

SEQ ID NO: 4765919 - DNA, 18 bp, Homo sapiens
tccagagacctgctccag

SEQ ID NO: 4765920 - DNA, 19 bp, Homo sapiens
tccagagacctgctccaga

SEQ ID NO: 4765921 - DNA, 15 bp, Homo sapiens
tccagagctcatttc

SEQ ID NO: 4765922 - DNA, 23 bp, Homo sapiens
tccagagtaggtgggtcttggat

SEQ ID NO: 4765923 - DNA, 18 bp, Homo sapiens
tccagattattttctata

SEQ ID NO: 4765924 - DNA, 19 bp, Homo sapiens
tccagattattttctatat

SEQ ID NO: 4765925 - DNA, 14 bp, Homo sapiens
tccagcaatgcctg

SEQ ID NO: 4765926 - DNA, 16 bp, Homo sapiens
tccagcacctttgtaa

SEQ ID NO: 4765927 - DNA, 22 bp, Homo sapiens
tgctgtctgaaaaagtgttttt

SEQ ID NO: 4765928 - DNA, 21 bp, Homo sapiens
tgctgtctgtgtgaggctccc

SEQ ID NO: 4765929 - DNA, 17 bp, Homo sapiens
tgctgtgaaacagtgtg

SEQ ID NO: 4765930 - DNA, 13 bp, Homo sapiens
tgctgtgacaggc

SEQ ID NO: 4765931 - DNA, 22 bp, Homo sapiens
tgctgtgacaggcagtgttctt

SEQ ID NO: 4765932 - DNA, 11 bp, Homo sapiens
tgctgtgggca

SEQ ID NO: 4765933 - DNA, 13 bp, Homo sapiens
tgctgtgggcagc

SEQ ID NO: 4765934 - DNA, 16 bp, Homo sapiens
tgctgtgggcagcacc

SEQ ID NO: 4765935 - DNA, 17 bp, Homo sapiens
tgctgtgggcagcaccc

SEQ ID NO: 4765936 - DNA, 19 bp, Homo sapiens
tgctgtgggcagcaccctc

SEQ ID NO: 4765937 - DNA, 13 bp, Homo sapiens
tgctgtgtgcaga

SEQ ID NO: 4765938 - DNA, 15 bp, Homo sapiens
tgctgtgtgcagagt

SEQ ID NO: 4765939 - DNA, 20 bp, Homo sapiens
tgctgtgtgcagagtataca

SEQ ID NO: 4765940 - DNA, 16 bp, Homo sapiens
tgctgtttaccgccca

SEQ ID NO: 4765941 - DNA, 15 bp, Homo sapiens
tgctgtttatatata

SEQ ID NO: 4765942 - DNA, 20 bp, Homo sapiens
tgcttaaggaaaagagaaac

SEQ ID NO: 4765943 - DNA, 16 bp, Homo sapiens
tgcttaatctagagct

SEQ ID NO: 4765944 - DNA, 17 bp, Homo sapiens
tgcttaatctagagcta

SEQ ID NO: 4765945 - DNA, 15 bp, Homo sapiens
tgcttacctcacacg

SEQ ID NO: 4765946 - DNA, 21 bp, Homo sapiens
tgcttagtatctcatcaacaa

SEQ ID NO: 4765947 - DNA, 15 bp, Homo sapiens
tgcttagtgtccctt

SEQ ID NO: 4765948 - DNA, 13 bp, Homo sapiens
tgcttattgatat

SEQ ID NO: 4765949 - DNA, 14 bp, Homo sapiens
tgcttatttatatt

SEQ ID NO: 4765950 - DNA, 11 bp, Homo sapiens
tgcttcacaca

SEQ ID NO: 4765951 - DNA, 14 bp, Homo sapiens
tgcttcccacctcc

SEQ ID NO: 4765952 - DNA, 17 bp, Homo sapiens
tgcttcccacctccctg

SEQ ID NO: 4765953 - DNA, 20 bp, Homo sapiens
tgcttcccacctccctgccc

SEQ ID NO: 4765954 - DNA, 23 bp, Homo sapiens
tgcttcccacctccctgcccagg

SEQ ID NO: 4765955 - DNA, 13 bp, Homo sapiens
tgcttccttctca

SEQ ID NO: 4765956 - DNA, 20 bp, Homo sapiens
tgcttctaagggatccagag

SEQ ID NO: 4765957 - DNA, 21 bp, Homo sapiens
tgcttctaagggatccagaga

SEQ ID NO: 4765958 - DNA, 15 bp, Homo sapiens
tgcttctactccatg

SEQ ID NO: 4765959 - DNA, 16 bp, Homo sapiens
tgcttctactccatgg

SEQ ID NO: 4765960 - DNA, 16 bp, Homo sapiens
tgcttctccacctccc

SEQ ID NO: 4765961 - DNA, 13 bp, Homo sapiens
tgcttctccagcc

SEQ ID NO: 4765962 - DNA, 13 bp, Homo sapiens
tgcttctccctca

SEQ ID NO: 4765963 - DNA, 12 bp, Homo sapiens
tgcttctgctgc

SEQ ID NO: 4765964 - DNA, 14 bp, Homo sapiens
tgcttcttggagtc

SEQ ID NO: 4765965 - DNA, 13 bp, Homo sapiens
tgcttcttgtgtt

SEQ ID NO: 4765966 - DNA, 21 bp, Homo sapiens
tgcttgctggaaaactgccac

SEQ ID NO: 4765967 - DNA, 13 bp, Homo sapiens
tgcttgtgtgtat

SEQ ID NO: 4765968 - DNA, 14 bp, Homo sapiens
tgcttgttcttcct

SEQ ID NO: 4765969 - DNA, 15 bp, Homo sapiens
tgctttctgatacat

SEQ ID NO: 4765970 - DNA, 19 bp, Homo sapiens
tgctttctgatacatctgt

SEQ ID NO: 4765971 - DNA, 13 bp, Homo sapiens
tgctttggggata

SEQ ID NO: 4765972 - DNA, 19 bp, Homo sapiens
tgctttgttttggctgctc

SEQ ID NO: 4765973 - DNA, 20 bp, Homo sapiens
tgcttttgatggctatgttt

SEQ ID NO: 4765974 - DNA, 18 bp, Homo sapiens
tgcttttttgcaataagg

SEQ ID NO: 4765975 - DNA, 15 bp, Homo sapiens
tggaaaactgccaca

SEQ ID NO: 4765976 - DNA, 17 bp, Homo sapiens
tggaaaataataaaaga

SEQ ID NO: 4765977 - DNA, 20 bp, Homo sapiens
tggaaaataataaaagaatc

SEQ ID NO: 4765978 - DNA, 22 bp, Homo sapiens
tggaaacaaggaaggacatttc

SEQ ID NO: 4765979 - DNA, 16 bp, Homo sapiens
tggaaacatctgattt

SEQ ID NO: 4765980 - DNA, 20 bp, Homo sapiens
tggaaagagctgttttggat

SEQ ID NO: 4765981 - DNA, 14 bp, Homo sapiens
tggaaagccaggtt

SEQ ID NO: 4765982 - DNA, 22 bp, Homo sapiens
tggaaaggtcctgctgtggaaa

SEQ ID NO: 4765983 - DNA, 22 bp, Homo sapiens
tggaaatggggaactcccccag

SEQ ID NO: 4765984 - DNA, 16 bp, Homo sapiens
tggaaatttgtgtgct

SEQ ID NO: 4765985 - DNA, 14 bp, Homo sapiens
tggaacagccctgc

SEQ ID NO: 4765986 - DNA, 15 bp, Homo sapiens
tggaacagccctgca

SEQ ID NO: 4765987 - DNA, 17 bp, Homo sapiens
tggaaccatggaggagg

SEQ ID NO: 4765988 - DNA, 17 bp, Homo sapiens
tggaaccttccctccaa

SEQ ID NO: 4765989 - DNA, 12 bp, Homo sapiens
tggaagaattca

SEQ ID NO: 4765990 - DNA, 14 bp, Homo sapiens
tggaagaattcatg

SEQ ID NO: 4765991 - DNA, 13 bp, Homo sapiens
tggaagacagaga

SEQ ID NO: 4765992 - DNA, 23 bp, Homo sapiens
tggaagacagagatggcagagcc

SEQ ID NO: 4765993 - DNA, 19 bp, Homo sapiens
tggaagagctgctgtattt

SEQ ID NO: 4765994 - DNA, 16 bp, Homo sapiens
tggaaggcacccgccc

SEQ ID NO: 4765995 - DNA, 16 bp, Homo sapiens
tggaagggaccccaga

SEQ ID NO: 4765996 - DNA, 15 bp, Homo sapiens
tggaagggcaggagc

SEQ ID NO: 4765997 - DNA, 20 bp, Homo sapiens
tggaaggtcacgctgaatga

SEQ ID NO: 4765998 - DNA, 14 bp, Homo sapiens
tggaatcacagcca

SEQ ID NO: 4765999 - DNA, 21 bp, Homo sapiens
tggaattacataacaggcatt

SEQ ID NO: 4766000 - DNA, 20 bp, Homo sapiens
tggaattattagcaccagct

SEQ ID NO: 4766001 - DNA, 21 bp, Homo sapiens
tggaattcaatgggtaaataa

SEQ ID NO: 4766002 - DNA, 14 bp, Homo sapiens
tggaattctgcttc

SEQ ID NO: 4766003 - DNA, 19 bp, Homo sapiens
tggacaaacccttctttta

SEQ ID NO: 4766004 - DNA, 22 bp, Homo sapiens
tggacactacacgtttcaacct

SEQ ID NO: 4766005 - DNA, 18 bp, Homo sapiens
tggacagatgggtgtccc

SEQ ID NO: 4766006 - DNA, 18 bp, Homo sapiens
tgcctctttcctcctcat

SEQ ID NO: 4766007 - DNA, 21 bp, Homo sapiens
tgcctctttcctcctcatgaa

SEQ ID NO: 4766008 - DNA, 14 bp, Homo sapiens
tgcctgcagagcag

SEQ ID NO: 4766009 - DNA, 11 bp, Homo sapiens
tgcctgccatg

SEQ ID NO: 4766010 - DNA, 13 bp, Homo sapiens
tgcctgccatgtg

SEQ ID NO: 4766011 - DNA, 15 bp, Homo sapiens
tgcctgccatgtgtg

SEQ ID NO: 4766012 - DNA, 17 bp, Homo sapiens
tgcctgccatgtgtgag

SEQ ID NO: 4766013 - DNA, 20 bp, Homo sapiens
tgcctgcccgcacagcagcc

SEQ ID NO: 4766014 - DNA, 22 bp, Homo sapiens
tgcctgcccgcacagcagcctg

SEQ ID NO: 4766015 - DNA, 15 bp, Homo sapiens
tgcctgctatccagc

SEQ ID NO: 4766016 - DNA, 19 bp, Homo sapiens
tgcctgctatccagccgca

SEQ ID NO: 4766017 - DNA, 21 bp, Homo sapiens
tgcctggcgggcagcccctgc

SEQ ID NO: 4766018 - DNA, 22 bp, Homo sapiens
tgcctggcgggcagcccctgct

SEQ ID NO: 4766019 - DNA, 12 bp, Homo sapiens
tgcctgggacag

SEQ ID NO: 4766020 - DNA, 14 bp, Homo sapiens
tgcctgggacagcc

SEQ ID NO: 4766021 - DNA, 18 bp, Homo sapiens
tgcctgggcagaaggaag

SEQ ID NO: 4766022 - DNA, 22 bp, Homo sapiens
tgcctgtgtttcatgttctgtg

SEQ ID NO: 4766023 - DNA, 14 bp, Homo sapiens
tgcctgttgatcta

SEQ ID NO: 4766024 - DNA, 20 bp, Homo sapiens
tgcctgttgatctatgggaa

SEQ ID NO: 4766025 - DNA, 19 bp, Homo sapiens
tgcctgttgggccaggagc

SEQ ID NO: 4766026 - DNA, 16 bp, Homo sapiens
tgccttagaggagccc

SEQ ID NO: 4766027 - DNA, 18 bp, Homo sapiens
tgccttagaggagcccac

SEQ ID NO: 4766028 - DNA, 16 bp, Homo sapiens
tgccttcataaattat

SEQ ID NO: 4766029 - DNA, 21 bp, Homo sapiens
tgccttcataaattatttcta

SEQ ID NO: 4766030 - DNA, 14 bp, Homo sapiens
tgccttccaccctg

SEQ ID NO: 4766031 - DNA, 16 bp, Homo sapiens
tgccttccaccctgcc

SEQ ID NO: 4766032 - DNA, 18 bp, Homo sapiens
tgccttccaccctgccct

SEQ ID NO: 4766033 - DNA, 19 bp, Homo sapiens
tgccttccaccctgccctg

SEQ ID NO: 4766034 - DNA, 21 bp, Homo sapiens
tgccttccaccctgccctggc

SEQ ID NO: 4766035 - DNA, 23 bp, Homo sapiens
tgccttccaccctgccctggcct

SEQ ID NO: 4766036 - DNA, 19 bp, Homo sapiens
tgccttctgacggccctgc

SEQ ID NO: 4766037 - DNA, 12 bp, Homo sapiens
tgccttctgggg

SEQ ID NO: 4766038 - DNA, 14 bp, Homo sapiens
tgccttctggggag

SEQ ID NO: 4766039 - DNA, 20 bp, Homo sapiens
tgccttctggggagggacac

SEQ ID NO: 4766040 - DNA, 22 bp, Homo sapiens
tgccttctggggagggacacag

SEQ ID NO: 4766041 - DNA, 13 bp, Homo sapiens
tgccttctttact

SEQ ID NO: 4766042 - DNA, 16 bp, Homo sapiens
tgccttgggcgggcca

SEQ ID NO: 4766043 - DNA, 16 bp, Homo sapiens
tgccttggggacaaga

SEQ ID NO: 4766044 - DNA, 19 bp, Homo sapiens
tgccttgttgtattcctgc

SEQ ID NO: 4766045 - DNA, 22 bp, Homo sapiens
tgcctttcaaagtgcacacaca

SEQ ID NO: 4766046 - DNA, 23 bp, Homo sapiens
tgcctttcaaagtgcacacacac

SEQ ID NO: 4766047 - DNA, 22 bp, Homo sapiens
tgcctttgacccaggaaccgat

SEQ ID NO: 4766048 - DNA, 15 bp, Homo sapiens
tgccttttccctctg

SEQ ID NO: 4766049 - DNA, 17 bp, Homo sapiens
tgcgacgatccccatgg

SEQ ID NO: 4766050 - DNA, 23 bp, Homo sapiens
tgcgacggaggcaggaccaggca

SEQ ID NO: 4766051 - DNA, 23 bp, Homo sapiens
tgcgcaccccgttcccagcgcat

SEQ ID NO: 4766052 - DNA, 19 bp, Homo sapiens
tgcgcagccgcgctctgcc

SEQ ID NO: 4766053 - DNA, 12 bp, Homo sapiens
tgcgccccagcg

SEQ ID NO: 4766054 - DNA, 12 bp, Homo sapiens
tgcgcccctgcc

SEQ ID NO: 4766055 - DNA, 21 bp, Homo sapiens
tgcgcccctgcccagcacctc

SEQ ID NO: 4766056 - DNA, 13 bp, Homo sapiens
tgcgccctccctc

SEQ ID NO: 4766057 - DNA, 19 bp, Homo sapiens
tgcgccctccctccctcca

SEQ ID NO: 4766058 - DNA, 20 bp, Homo sapiens
tgcgccctccctccctccac

SEQ ID NO: 4766059 - DNA, 21 bp, Homo sapiens
tgcgccctccctccctccaca

SEQ ID NO: 4766060 - DNA, 17 bp, Homo sapiens
tgcgccctgacatgcta

SEQ ID NO: 4766061 - DNA, 12 bp, Homo sapiens
tgcgcctcctcc

SEQ ID NO: 4766062 - DNA, 15 bp, Homo sapiens
tgcgcctcctcctgc

SEQ ID NO: 4766063 - DNA, 16 bp, Homo sapiens
tgcgcctcctcctgca

SEQ ID NO: 4766064 - DNA, 17 bp, Homo sapiens
tgcgcctcctcctgcat

SEQ ID NO: 4766065 - DNA, 18 bp, Homo sapiens
tgcgcctcctcctgcatg

SEQ ID NO: 4766066 - DNA, 12 bp, Homo sapiens
tgcgcctgcccg

SEQ ID NO: 4766067 - DNA, 19 bp, Homo sapiens
tgcgcctgcgcctcctcct

SEQ ID NO: 4766068 - DNA, 22 bp, Homo sapiens
tgcgctagagcattctggggtg

SEQ ID NO: 4766069 - DNA, 23 bp, Homo sapiens
tgcgctcctctgcagcctgagct

SEQ ID NO: 4766070 - DNA, 18 bp, Homo sapiens
tgcggaccggagcggctg

SEQ ID NO: 4766071 - DNA, 18 bp, Homo sapiens
tgcggcaccgcccaccca

SEQ ID NO: 4766072 - DNA, 19 bp, Homo sapiens
tgcggcccgtgcgcagccg

SEQ ID NO: 4766073 - DNA, 23 bp, Homo sapiens
tgcggcccgtgcgcagccgcgct

SEQ ID NO: 4766074 - DNA, 21 bp, Homo sapiens
tgcggggcggcatccgagccc

SEQ ID NO: 4766075 - DNA, 23 bp, Homo sapiens
tgcgtcccttctctttggggctc

SEQ ID NO: 4766076 - DNA, 15 bp, Homo sapiens
tgcgtctacccagac

SEQ ID NO: 4766077 - DNA, 22 bp, Homo sapiens
tgcgtgccacatcaataacaac

SEQ ID NO: 4766078 - DNA, 13 bp, Homo sapiens
tgcgttttagagt

SEQ ID NO: 4766079 - DNA, 20 bp, Homo sapiens
tgcgttttagagtatgcaag

SEQ ID NO: 4766080 - DNA, 19 bp, Homo sapiens
tgctaaacctatctgtatt

SEQ ID NO: 4766081 - DNA, 22 bp, Homo sapiens
tgctaaagtcaggccattcagt

SEQ ID NO: 4766082 - DNA, 19 bp, Homo sapiens
tgctaaatgacttattgat

SEQ ID NO: 4766083 - DNA, 12 bp, Homo sapiens
tgctaagtggaa

SEQ ID NO: 4766084 - DNA, 22 bp, Homo sapiens
tgctaatgaattttaaaagcat

SEQ ID NO: 4766085 - DNA, 17 bp, Homo sapiens
tgctaattaaaaagtta

SEQ ID NO: 4766086 - DNA, 15 bp, Homo sapiens
tgctaatttatgaag

SEQ ID NO: 4766087 - DNA, 15 bp, Homo sapiens
tgctacatcagagtg

SEQ ID NO: 4766088 - DNA, 19 bp, Homo sapiens
tgctacatcagagtgtatt

SEQ ID NO: 4766089 - DNA, 13 bp, Homo sapiens
tgctactcagtat

SEQ ID NO: 4766090 - DNA, 12 bp, Homo sapiens
tgctatccagcc

SEQ ID NO: 4766091 - DNA, 13 bp, Homo sapiens
tgctatccagccg

SEQ ID NO: 4766092 - DNA, 16 bp, Homo sapiens
tgctatccagccgcaa

SEQ ID NO: 4766093 - DNA, 18 bp, Homo sapiens
tgctatgctgttcattga

SEQ ID NO: 4766094 - DNA, 14 bp, Homo sapiens
tgctatgtctgtga

SEQ ID NO: 4766095 - DNA, 21 bp, Homo sapiens
tgctattcgtaagttctgtgc

SEQ ID NO: 4766096 - DNA, 22 bp, Homo sapiens
tgctattgtttataggaaataa

SEQ ID NO: 4766097 - DNA, 18 bp, Homo sapiens
tgctatttgtgtaactga

SEQ ID NO: 4766098 - DNA, 19 bp, Homo sapiens
tgctatttgtgtaactgaa

SEQ ID NO: 4766099 - DNA, 23 bp, Homo sapiens
tgctatttttaatttcctgtgag

SEQ ID NO: 4766100 - DNA, 16 bp, Homo sapiens
tgctcaatgtgctgtt

SEQ ID NO: 4766101 - DNA, 17 bp, Homo sapiens
tgctcaatgtgctgttg

SEQ ID NO: 4766102 - DNA, 18 bp, Homo sapiens
tgctcaatgtgctgttga

SEQ ID NO: 4766103 - DNA, 16 bp, Homo sapiens
tgctcacgtctgtgag

SEQ ID NO: 4766104 - DNA, 17 bp, Homo sapiens
tgctcacgtctgtgagt

SEQ ID NO: 4766105 - DNA, 22 bp, Homo sapiens
tgctcacgtctgtgagtctgtc

SEQ ID NO: 4766106 - DNA, 14 bp, Homo sapiens
tgctcaggcctcac

SEQ ID NO: 4766107 - DNA, 19 bp, Homo sapiens
tgctcaggcctcacctggc

SEQ ID NO: 4766108 - DNA, 21 bp, Homo sapiens
tgctcaggcctcacctggctt

SEQ ID NO: 4766109 - DNA, 23 bp, Homo sapiens
tgctcaggcctcacctggcttcc

SEQ ID NO: 4766110 - DNA, 18 bp, Homo sapiens
tgctcaggctccccaaga

SEQ ID NO: 4766111 - DNA, 17 bp, Homo sapiens
tgctcagggcatgctta

SEQ ID NO: 4766112 - DNA, 18 bp, Homo sapiens
tgctcagtggatcacaca

SEQ ID NO: 4766113 - DNA, 14 bp, Homo sapiens
tgctcataactaga

SEQ ID NO: 4766114 - DNA, 17 bp, Homo sapiens
tgctcataagtaaatgt

SEQ ID NO: 4766115 - DNA, 20 bp, Homo sapiens
tgctcatctacacatataaa

SEQ ID NO: 4766116 - DNA, 22 bp, Homo sapiens
tgctcattttttttttatcaga

SEQ ID NO: 4766117 - DNA, 20 bp, Homo sapiens
tgctccagatcctctttccc

SEQ ID NO: 4766118 - DNA, 23 bp, Homo sapiens
tgctccagtataaattacatgca

SEQ ID NO: 4766119 - DNA, 13 bp, Homo sapiens
tgctccatgcaca

SEQ ID NO: 4766120 - DNA, 14 bp, Homo sapiens
tgctccattcctga

SEQ ID NO: 4766121 - DNA, 16 bp, Homo sapiens
tgctccattcctgagt

SEQ ID NO: 4766122 - DNA, 21 bp, Homo sapiens
tgctcctccagtacaataaat

SEQ ID NO: 4766123 - DNA, 15 bp, Homo sapiens
tgctccttgaataag

SEQ ID NO: 4766124 - DNA, 19 bp, Homo sapiens
tgctcctttccatcagctt

SEQ ID NO: 4766125 - DNA, 16 bp, Homo sapiens
tgctcgctctgcatga

SEQ ID NO: 4766126 - DNA, 16 bp, Homo sapiens
tgctcggacacagttt

SEQ ID NO: 4766127 - DNA, 14 bp, Homo sapiens
tgctctccatctct

SEQ ID NO: 4766128 - DNA, 15 bp, Homo sapiens
tgctctccatctctt

SEQ ID NO: 4766129 - DNA, 15 bp, Homo sapiens
tgctctccttcactc

SEQ ID NO: 4766130 - DNA, 21 bp, Homo sapiens
tgctctccttcactctgacag

SEQ ID NO: 4766131 - DNA, 15 bp, Homo sapiens
tgctctctcattccc

SEQ ID NO: 4766132 - DNA, 16 bp, Homo sapiens
tgctctctcattccca

SEQ ID NO: 4766133 - DNA, 20 bp, Homo sapiens
tgctctgagaagaggagccc

SEQ ID NO: 4766134 - DNA, 17 bp, Homo sapiens
tgctctgtggtaagaga

SEQ ID NO: 4766135 - DNA, 19 bp, Homo sapiens
tgctcttaagtaccagaag

SEQ ID NO: 4766136 - DNA, 13 bp, Homo sapiens
tgctcttctcatt

SEQ ID NO: 4766137 - DNA, 15 bp, Homo sapiens
tgctctttcaccctg

SEQ ID NO: 4766138 - DNA, 14 bp, Homo sapiens
tgctcttttcccag

SEQ ID NO: 4766139 - DNA, 21 bp, Homo sapiens
tgctgaaaaccatctggcctg

SEQ ID NO: 4766140 - DNA, 20 bp, Homo sapiens
tgctgagatgtttagtagct

SEQ ID NO: 4766141 - DNA, 17 bp, Homo sapiens
tgctgagtggctcgtgt

SEQ ID NO: 4766142 - DNA, 23 bp, Homo sapiens
tgctgattgtctgaaattttcta

SEQ ID NO: 4766143 - DNA, 15 bp, Homo sapiens
tgctgcacagtagtg

SEQ ID NO: 4766144 - DNA, 14 bp, Homo sapiens
tgctgcactgccct

SEQ ID NO: 4766145 - DNA, 17 bp, Homo sapiens
tgctgcactgccctccg

SEQ ID NO: 4766146 - DNA, 24 bp, Homo sapiens
tgctgccccacaacacaccttgcc

SEQ ID NO: 4766147 - DNA, 13 bp, Homo sapiens
tgctgcctcagga

SEQ ID NO: 4766148 - DNA, 15 bp, Homo sapiens
tgctgcctcaggaat

SEQ ID NO: 4766149 - DNA, 14 bp, Homo sapiens
tgctgcctgccatg

SEQ ID NO: 4766150 - DNA, 21 bp, Homo sapiens
tgctgcctgcccgcacagcag

SEQ ID NO: 4766151 - DNA, 22 bp, Homo sapiens
tgctgcctgcctccggccctgc

SEQ ID NO: 4766152 - DNA, 17 bp, Homo sapiens
tgctgctcgggaaggcc

SEQ ID NO: 4766153 - DNA, 13 bp, Homo sapiens
tgctgctgtggca

SEQ ID NO: 4766154 - DNA, 14 bp, Homo sapiens
tgctggaaaactgc

SEQ ID NO: 4766155 - DNA, 22 bp, Homo sapiens
tgctggaaaggcccggagatgc

SEQ ID NO: 4766156 - DNA, 20 bp, Homo sapiens
tgctggactgatggttgctt

SEQ ID NO: 4766157 - DNA, 12 bp, Homo sapiens
tgctggccagca

SEQ ID NO: 4766158 - DNA, 16 bp, Homo sapiens
tgctggccagcaccct

SEQ ID NO: 4766159 - DNA, 17 bp, Homo sapiens
tgctggccagcaccctc

SEQ ID NO: 4766160 - DNA, 18 bp, Homo sapiens
tgctggccagcaccctct

SEQ ID NO: 4766161 - DNA, 15 bp, Homo sapiens
tgctggccagcctgg

SEQ ID NO: 4766162 - DNA, 16 bp, Homo sapiens
tgctggccagcctggg

SEQ ID NO: 4766163 - DNA, 22 bp, Homo sapiens
tgctggccagcctggggcctgg

SEQ ID NO: 4766164 - DNA, 13 bp, Homo sapiens
tgctggcttgcac

SEQ ID NO: 4766165 - DNA, 16 bp, Homo sapiens
tgctgggtccttaaaa

SEQ ID NO: 4766166 - DNA, 14 bp, Homo sapiens
tgctgtcatgccca

SEQ ID NO: 4766167 - DNA, 17 bp, Homo sapiens
tgctgtcccttacgtga

SEQ ID NO: 4766168 - DNA, 18 bp, Homo sapiens
tgctgtctgaaaaagtgt

SEQ ID NO: 4766169 - DNA, 14 bp, Homo sapiens
tgatatattttcca

SEQ ID NO: 4766170 - DNA, 13 bp, Homo sapiens
tgatatcccaagt

SEQ ID NO: 4766171 - DNA, 13 bp, Homo sapiens
tgatatgcatgta

SEQ ID NO: 4766172 - DNA, 14 bp, Homo sapiens
tgatatgtctttaa

SEQ ID NO: 4766173 - DNA, 14 bp, Homo sapiens
tgatatgtgtaata

SEQ ID NO: 4766174 - DNA, 16 bp, Homo sapiens
tgatattgctgaagaa

SEQ ID NO: 4766175 - DNA, 13 bp, Homo sapiens
tgatattgtgtag

SEQ ID NO: 4766176 - DNA, 23 bp, Homo sapiens
tgatattgtgtaggaaatctgaa

SEQ ID NO: 4766177 - DNA, 14 bp, Homo sapiens
tgatcaaaatgcat

SEQ ID NO: 4766178 - DNA, 16 bp, Homo sapiens
tgatcaaggagggaga

SEQ ID NO: 4766179 - DNA, 16 bp, Homo sapiens
tgatcaaggtgctctt

SEQ ID NO: 4766180 - DNA, 16 bp, Homo sapiens
tgatcacttatcagtt

SEQ ID NO: 4766181 - DNA, 21 bp, Homo sapiens
tgatcccccaaacagcatgtg

SEQ ID NO: 4766182 - DNA, 22 bp, Homo sapiens
tgatctcagcatcctggaaatt

SEQ ID NO: 4766183 - DNA, 19 bp, Homo sapiens
tgatctcagctcactgcaa

SEQ ID NO: 4766184 - DNA, 12 bp, Homo sapiens
tgatctctccac

SEQ ID NO: 4766185 - DNA, 22 bp, Homo sapiens
tgatctggtgcgtgtggccctg

SEQ ID NO: 4766186 - DNA, 12 bp, Homo sapiens
tgatctgtatta

SEQ ID NO: 4766187 - DNA, 22 bp, Homo sapiens
tgatctgtattaagctccagtg

SEQ ID NO: 4766188 - DNA, 15 bp, Homo sapiens
tgatctgtatttaat

SEQ ID NO: 4766189 - DNA, 18 bp, Homo sapiens
tgatctgttgtaatatca

SEQ ID NO: 4766190 - DNA, 20 bp, Homo sapiens
tgatctgttgtaatatcagt

SEQ ID NO: 4766191 - DNA, 21 bp, Homo sapiens
tgatctgttgtaatatcagtt

SEQ ID NO: 4766192 - DNA, 19 bp, Homo sapiens
tgatgaccaatctctgtga

SEQ ID NO: 4766193 - DNA, 19 bp, Homo sapiens
tgatgagacaacacacaca

SEQ ID NO: 4766194 - DNA, 14 bp, Homo sapiens
tgatgaggcatttt

SEQ ID NO: 4766195 - DNA, 11 bp, Homo sapiens
tgatgcaggaa

SEQ ID NO: 4766196 - DNA, 18 bp, Homo sapiens
tgatgcaggaagaccaca

SEQ ID NO: 4766197 - DNA, 17 bp, Homo sapiens
tgatgcatgagctccct

SEQ ID NO: 4766198 - DNA, 12 bp, Homo sapiens
tgatggagaagg

SEQ ID NO: 4766199 - DNA, 15 bp, Homo sapiens
tgatggccaggcctc

SEQ ID NO: 4766200 - DNA, 14 bp, Homo sapiens
tgatggctatgttt

SEQ ID NO: 4766201 - DNA, 16 bp, Homo sapiens
tgatgggtcctgctgc

SEQ ID NO: 4766202 - DNA, 13 bp, Homo sapiens
tgatggttgcttt

SEQ ID NO: 4766203 - DNA, 14 bp, Homo sapiens
tgatgtccaaactt

SEQ ID NO: 4766204 - DNA, 15 bp, Homo sapiens
tgatgtccaaactta

SEQ ID NO: 4766205 - DNA, 16 bp, Homo sapiens
tgatgtccaaacttaa

SEQ ID NO: 4766206 - DNA, 20 bp, Homo sapiens
tgatgtctgaggataccttc

SEQ ID NO: 4766207 - DNA, 16 bp, Homo sapiens
tgatgtgatttatgca

SEQ ID NO: 4766208 - DNA, 19 bp, Homo sapiens
tgatgtgatttatgcattt

SEQ ID NO: 4766209 - DNA, 19 bp, Homo sapiens
tgatgtgctcatcagaaac

SEQ ID NO: 4766210 - DNA, 13 bp, Homo sapiens
tgatgtggatgaa

SEQ ID NO: 4766211 - DNA, 10 bp, Homo sapiens
tgatgttata

SEQ ID NO: 4766212 - DNA, 19 bp, Homo sapiens
tgatgttattttgtacgtg

SEQ ID NO: 4766213 - DNA, 20 bp, Homo sapiens
tgatgttctttcaccctttt

SEQ ID NO: 4766214 - DNA, 19 bp, Homo sapiens
tgattaaactgggaaatga

SEQ ID NO: 4766215 - DNA, 21 bp, Homo sapiens
tgattaaattatcattgtttg

SEQ ID NO: 4766216 - DNA, 22 bp, Homo sapiens
tgattaatttctgccatttcat

SEQ ID NO: 4766217 - DNA, 13 bp, Homo sapiens
tgattatgaaatg

SEQ ID NO: 4766218 - DNA, 22 bp, Homo sapiens
tgattcaaataaccctgaatca

SEQ ID NO: 4766219 - DNA, 12 bp, Homo sapiens
tgattcaatgtg

SEQ ID NO: 4766220 - DNA, 14 bp, Homo sapiens
tgattcaatgtgaa

SEQ ID NO: 4766221 - DNA, 21 bp, Homo sapiens
tgattcataatgacttaagca

SEQ ID NO: 4766222 - DNA, 23 bp, Homo sapiens
tgattcctggtggccagtatcct

SEQ ID NO: 4766223 - DNA, 16 bp, Homo sapiens
tgattctaaaggggac

SEQ ID NO: 4766224 - DNA, 11 bp, Homo sapiens
tgattctcctc

SEQ ID NO: 4766225 - DNA, 13 bp, Homo sapiens
tgattctcctctc

SEQ ID NO: 4766226 - DNA, 14 bp, Homo sapiens
tgattcttgtgtca

SEQ ID NO: 4766227 - DNA, 15 bp, Homo sapiens
tgattcttgtgtcat

SEQ ID NO: 4766228 - DNA, 21 bp, Homo sapiens
tgattcttgtgtcatcaagta

SEQ ID NO: 4766229 - DNA, 12 bp, Homo sapiens
tgattgacattt

SEQ ID NO: 4766230 - DNA, 22 bp, Homo sapiens
tgattgacattttgtagctagt

SEQ ID NO: 4766231 - DNA, 17 bp, Homo sapiens
tgattggaaaataataa

SEQ ID NO: 4766232 - DNA, 14 bp, Homo sapiens
tgattgttcctccc

SEQ ID NO: 4766233 - DNA, 16 bp, Homo sapiens
tgattgtttaattgta

SEQ ID NO: 4766234 - DNA, 16 bp, Homo sapiens
tgatttactaacagta

SEQ ID NO: 4766235 - DNA, 20 bp, Homo sapiens
tgatttactaacagtaactg

SEQ ID NO: 4766236 - DNA, 21 bp, Homo sapiens
tgatttactaacagtaactgc

SEQ ID NO: 4766237 - DNA, 20 bp, Homo sapiens
tgatttagagatgataatcc

SEQ ID NO: 4766238 - DNA, 15 bp, Homo sapiens
tgatttatgcattta

SEQ ID NO: 4766239 - DNA, 12 bp, Homo sapiens
tgatttattctg

SEQ ID NO: 4766240 - DNA, 18 bp, Homo sapiens
tgatttattctggtgtct

SEQ ID NO: 4766241 - DNA, 17 bp, Homo sapiens
tgatttcaatgattgtt

SEQ ID NO: 4766242 - DNA, 14 bp, Homo sapiens
tgatttccatccaa

SEQ ID NO: 4766243 - DNA, 14 bp, Homo sapiens
tgatttctgaacta

SEQ ID NO: 4766244 - DNA, 14 bp, Homo sapiens
tgatttgatataca

SEQ ID NO: 4766245 - DNA, 22 bp, Homo sapiens
tgatttggccgttttgtgaaga

SEQ ID NO: 4766246 - DNA, 21 bp, Homo sapiens
tgatttgggctgaatgtatgt

SEQ ID NO: 4766247 - DNA, 14 bp, Homo sapiens
tgatttttgttgat

SEQ ID NO: 4766248 - DNA, 21 bp, Homo sapiens
tgcaaaaatgaattcacccct

SEQ ID NO: 4766249 - DNA, 23 bp, Homo sapiens
tgcaaaatacatgatgatttcag

SEQ ID NO: 4766250 - DNA, 19 bp, Homo sapiens
tgcaaacactgtgtattta

SEQ ID NO: 4766251 - DNA, 14 bp, Homo sapiens
tgcaaacatttctt

SEQ ID NO: 4766252 - DNA, 18 bp, Homo sapiens
tgcaaatctggcttagta

SEQ ID NO: 4766253 - DNA, 13 bp, Homo sapiens
tgcaaatgaagga

SEQ ID NO: 4766254 - DNA, 18 bp, Homo sapiens
tgcaacagactgccttat

SEQ ID NO: 4766255 - DNA, 21 bp, Homo sapiens
tgcaacccatgagcgtccagg

SEQ ID NO: 4766256 - DNA, 22 bp, Homo sapiens
tgcaacccatgagcgtccaggt

SEQ ID NO: 4766257 - DNA, 13 bp, Homo sapiens
tgcaacctcacta

SEQ ID NO: 4766258 - DNA, 15 bp, Homo sapiens
tgcaacctccacctc

SEQ ID NO: 4766259 - DNA, 17 bp, Homo sapiens
tgcaaccttgtacttta

SEQ ID NO: 4766260 - DNA, 15 bp, Homo sapiens
tgcaacttgagggac

SEQ ID NO: 4766261 - DNA, 14 bp, Homo sapiens
tgcaagagtgatgg

SEQ ID NO: 4766262 - DNA, 19 bp, Homo sapiens
tgcaagctccagtagctcc

SEQ ID NO: 4766263 - DNA, 22 bp, Homo sapiens
tgcatttgtgcgtatgcagtgt

SEQ ID NO: 4766264 - DNA, 21 bp, Homo sapiens
tgcattttaaagttaaacatt

SEQ ID NO: 4766265 - DNA, 14 bp, Homo sapiens
tgcattttaaatgt

SEQ ID NO: 4766266 - DNA, 15 bp, Homo sapiens
tgccaaaaggcccct

SEQ ID NO: 4766267 - DNA, 20 bp, Homo sapiens
tgccaaaaggccccttccca

SEQ ID NO: 4766268 - DNA, 23 bp, Homo sapiens
tgccaaacatcagtcaattgctt

SEQ ID NO: 4766269 - DNA, 13 bp, Homo sapiens
tgccaaagatagc

SEQ ID NO: 4766270 - DNA, 21 bp, Homo sapiens
tgccaaagatagcagaagagt

SEQ ID NO: 4766271 - DNA, 14 bp, Homo sapiens
tgccaactttccag

SEQ ID NO: 4766272 - DNA, 21 bp, Homo sapiens
tgccaagactctatgctctgg

SEQ ID NO: 4766273 - DNA, 16 bp, Homo sapiens
tgccaagagtccaagc

SEQ ID NO: 4766274 - DNA, 16 bp, Homo sapiens
tgccaaggcatcccca

SEQ ID NO: 4766275 - DNA, 18 bp, Homo sapiens
tgccaatgggagctcatg

SEQ ID NO: 4766276 - DNA, 19 bp, Homo sapiens
tgccaatggtgtagctgtc

SEQ ID NO: 4766277 - DNA, 15 bp, Homo sapiens
tgccaatgtccaggt

SEQ ID NO: 4766278 - DNA, 14 bp, Homo sapiens
tgccacaagcacaa

SEQ ID NO: 4766279 - DNA, 16 bp, Homo sapiens
tgccacaagcacaatt

SEQ ID NO: 4766280 - DNA, 20 bp, Homo sapiens
tgccacaatcactaaatatc

SEQ ID NO: 4766281 - DNA, 15 bp, Homo sapiens
tgccacaatgtgata

SEQ ID NO: 4766282 - DNA, 17 bp, Homo sapiens
tgccaccacccacccca

SEQ ID NO: 4766283 - DNA, 14 bp, Homo sapiens
tgccacccacccca

SEQ ID NO: 4766284 - DNA, 17 bp, Homo sapiens
tgccaccctctgctgca

SEQ ID NO: 4766285 - DNA, 24 bp, Homo sapiens
tgccaccctctgctgcacagtagt

SEQ ID NO: 4766286 - DNA, 21 bp, Homo sapiens
tgccacgtggccgctgcccac

SEQ ID NO: 4766287 - DNA, 19 bp, Homo sapiens
tgccactaaaatccaccca

SEQ ID NO: 4766288 - DNA, 20 bp, Homo sapiens
tgccactaaaatccacccag

SEQ ID NO: 4766289 - DNA, 23 bp, Homo sapiens
tgccactaaaatccacccagccc

SEQ ID NO: 4766290 - DNA, 18 bp, Homo sapiens
tgccactcaggcagcctg

SEQ ID NO: 4766291 - DNA, 22 bp, Homo sapiens
tgccactgacaggaaagtggat

SEQ ID NO: 4766292 - DNA, 12 bp, Homo sapiens
tgccactgccat

SEQ ID NO: 4766293 - DNA, 15 bp, Homo sapiens
tgccactgccataac

SEQ ID NO: 4766294 - DNA, 16 bp, Homo sapiens
tgccactgccataact

SEQ ID NO: 4766295 - DNA, 13 bp, Homo sapiens
tgccagacttcta

SEQ ID NO: 4766296 - DNA, 23 bp, Homo sapiens
tgccagacttctaaaataaatgt

SEQ ID NO: 4766297 - DNA, 19 bp, Homo sapiens
tccccatatataaattatt

SEQ ID NO: 4766298 - DNA, 20 bp, Homo sapiens
tccccatggctcctcaccac

SEQ ID NO: 4766299 - DNA, 15 bp, Homo sapiens
tccccattagtatcc

SEQ ID NO: 4766300 - DNA, 18 bp, Homo sapiens
tccccattgccttctggg

SEQ ID NO: 4766301 - DNA, 19 bp, Homo sapiens
tcccccaaacagcatgtgc

SEQ ID NO: 4766302 - DNA, 15 bp, Homo sapiens
tcccccaaaccctgc

SEQ ID NO: 4766303 - DNA, 16 bp, Homo sapiens
tcccccaaaccctgct

SEQ ID NO: 4766304 - DNA, 20 bp, Homo sapiens
tcccccaaaccctgcttctg

SEQ ID NO: 4766305 - DNA, 15 bp, Homo sapiens
tcccccacgcctcca

SEQ ID NO: 4766306 - DNA, 16 bp, Homo sapiens
tcccccagcacaaagc

SEQ ID NO: 4766307 - DNA, 18 bp, Homo sapiens
tcccccaggctgcgcctg

SEQ ID NO: 4766308 - DNA, 19 bp, Homo sapiens
tcccccaggctgcgcctgc

SEQ ID NO: 4766309 - DNA, 17 bp, Homo sapiens
tccggcagaggcagggc

SEQ ID NO: 4766310 - DNA, 18 bp, Homo sapiens
tccggcagaggcagggcc

SEQ ID NO: 4766311 - DNA, 21 bp, Homo sapiens
tccggcagaggcagggccctg

SEQ ID NO: 4766312 - DNA, 13 bp, Homo sapiens
tccggccctgccc

SEQ ID NO: 4766313 - DNA, 15 bp, Homo sapiens
tccggcctgcagccc

SEQ ID NO: 4766314 - DNA, 16 bp, Homo sapiens
tccggcctgcagccca

SEQ ID NO: 4766315 - DNA, 19 bp, Homo sapiens
tccgggcctcggcctggct

SEQ ID NO: 4766316 - DNA, 20 bp, Homo sapiens
tccgggcctcggcctggctt

SEQ ID NO: 4766317 - DNA, 15 bp, Homo sapiens
tccgggtgtggcctc

SEQ ID NO: 4766318 - DNA, 17 bp, Homo sapiens
tccgggtgtggcctcag

SEQ ID NO: 4766319 - DNA, 19 bp, Homo sapiens
tccgggtgtggcctcagcc

SEQ ID NO: 4766320 - DNA, 21 bp, Homo sapiens
tccgtccccagggtgcaggcg

SEQ ID NO: 4766321 - DNA, 13 bp, Homo sapiens
tccgtccgcccgc

SEQ ID NO: 4766322 - DNA, 18 bp, Homo sapiens
tccgtccgcccgcccacc

SEQ ID NO: 4766323 - DNA, 16 bp, Homo sapiens
tccgtctgtcctgcgc

SEQ ID NO: 4766324 - DNA, 18 bp, Homo sapiens
tccgtctgtcctgcgcct

SEQ ID NO: 4766325 - DNA, 13 bp, Homo sapiens
tccgtgaaagttg

SEQ ID NO: 4766326 - DNA, 14 bp, Homo sapiens
tccgtgagacacaa

SEQ ID NO: 4766327 - DNA, 15 bp, Homo sapiens
tccgtgggcagctcc

SEQ ID NO: 4766328 - DNA, 15 bp, Homo sapiens
tcctaagctgccagc

SEQ ID NO: 4766329 - DNA, 23 bp, Homo sapiens
tcctaaggtgcttacctcacacg

SEQ ID NO: 4766330 - DNA, 12 bp, Homo sapiens
tcctaagtttct

SEQ ID NO: 4766331 - DNA, 18 bp, Homo sapiens
tcctaagtttctttgagg

SEQ ID NO: 4766332 - DNA, 18 bp, Homo sapiens
tcctaattcctgtatgtt

SEQ ID NO: 4766333 - DNA, 19 bp, Homo sapiens
tcctaattcctgtatgtta

SEQ ID NO: 4766334 - DNA, 16 bp, Homo sapiens
tcctacccgcttccca

SEQ ID NO: 4766335 - DNA, 15 bp, Homo sapiens
tcctacttaaacaaa

SEQ ID NO: 4766336 - DNA, 21 bp, Homo sapiens
tcctagaggggacaagccagg

SEQ ID NO: 4766337 - DNA, 14 bp, Homo sapiens
tcctagcctctccg

SEQ ID NO: 4766338 - DNA, 19 bp, Homo sapiens
tcctaggacatctctgtaa

SEQ ID NO: 4766339 - DNA, 21 bp, Homo sapiens
tcctatgagagaagagagtat

SEQ ID NO: 4766340 - DNA, 17 bp, Homo sapiens
tcctattaatttattaa

SEQ ID NO: 4766341 - DNA, 18 bp, Homo sapiens
tcctcaaaaatcatcaaa

SEQ ID NO: 4766342 - DNA, 18 bp, Homo sapiens
tcctcaagttgtgtgcta

SEQ ID NO: 4766343 - DNA, 17 bp, Homo sapiens
tcctcaattccagggaa

SEQ ID NO: 4766344 - DNA, 15 bp, Homo sapiens
tcctcacatgtggca

SEQ ID NO: 4766345 - DNA, 13 bp, Homo sapiens
tcctcactgccac

SEQ ID NO: 4766346 - DNA, 20 bp, Homo sapiens
tcctcagatcttctgtgggt

SEQ ID NO: 4766347 - DNA, 22 bp, Homo sapiens
tcctcagccccagggccctgct

SEQ ID NO: 4766348 - DNA, 15 bp, Homo sapiens
tcctcatgaaagcag

SEQ ID NO: 4766349 - DNA, 14 bp, Homo sapiens
tcctccagagcctg

SEQ ID NO: 4766350 - DNA, 18 bp, Homo sapiens
tcctccagccctgggcac

SEQ ID NO: 4766351 - DNA, 18 bp, Homo sapiens
tcctccatgctgtccctg

SEQ ID NO: 4766352 - DNA, 21 bp, Homo sapiens
tcctcccagctgtaccggcca

SEQ ID NO: 4766353 - DNA, 20 bp, Homo sapiens
tcctccccagccccctggca

SEQ ID NO: 4766354 - DNA, 15 bp, Homo sapiens
tcctcccccacgcct

SEQ ID NO: 4766355 - DNA, 23 bp, Homo sapiens
tcctcccccacgcctccatccac

SEQ ID NO: 4766356 - DNA, 13 bp, Homo sapiens
tcctccccctcct

SEQ ID NO: 4766357 - DNA, 15 bp, Homo sapiens
tcctcccctggaagt

SEQ ID NO: 4766358 - DNA, 13 bp, Homo sapiens
tcctccgtgggca

SEQ ID NO: 4766359 - DNA, 21 bp, Homo sapiens
tcctccgtgggcagctcctcg

SEQ ID NO: 4766360 - DNA, 16 bp, Homo sapiens
tcctcctctcaaacct

SEQ ID NO: 4766361 - DNA, 11 bp, Homo sapiens
tcctcctgcat

SEQ ID NO: 4766362 - DNA, 14 bp, Homo sapiens
tcctcggccctgta

SEQ ID NO: 4766363 - DNA, 22 bp, Homo sapiens
tcctcgggcgcctgcgctcctc

SEQ ID NO: 4766364 - DNA, 18 bp, Homo sapiens
tcctcgggtggggcctgc

SEQ ID NO: 4766365 - DNA, 22 bp, Homo sapiens
tcctcggtggcatttgctgaat

SEQ ID NO: 4766366 - DNA, 17 bp, Homo sapiens
tcctcgtccggcctgca

SEQ ID NO: 4766367 - DNA, 21 bp, Homo sapiens
tcctcgtccggcctgcagccc

SEQ ID NO: 4766368 - DNA, 23 bp, Homo sapiens
tcctcgtccggcctgcagcccag

SEQ ID NO: 4766369 - DNA, 14 bp, Homo sapiens
tcctctaggaggtc

SEQ ID NO: 4766370 - DNA, 17 bp, Homo sapiens
tcctctaggaggtctct

SEQ ID NO: 4766371 - DNA, 21 bp, Homo sapiens
tcctctaggaggtctctaaga

SEQ ID NO: 4766372 - DNA, 16 bp, Homo sapiens
tcctctcagaactcct

SEQ ID NO: 4766373 - DNA, 19 bp, Homo sapiens
tcctctcagaactcctgtg

SEQ ID NO: 4766374 - DNA, 18 bp, Homo sapiens
tcctctcgagcccagatg

SEQ ID NO: 4766375 - DNA, 22 bp, Homo sapiens
tcctctcgtagaacctgcgcac

SEQ ID NO: 4766376 - DNA, 15 bp, Homo sapiens
tcctctctctccctc

SEQ ID NO: 4766377 - DNA, 22 bp, Homo sapiens
tcctctctctctctctctctgt

SEQ ID NO: 4766378 - DNA, 20 bp, Homo sapiens
tcctctcttttttgggggga

SEQ ID NO: 4766379 - DNA, 15 bp, Homo sapiens
tcctctgcagcctga

SEQ ID NO: 4766380 - DNA, 17 bp, Homo sapiens
tcctctgcagcctgagc

SEQ ID NO: 4766381 - DNA, 22 bp, Homo sapiens
tcctctgccccctcccccgcag

SEQ ID NO: 4766382 - DNA, 23 bp, Homo sapiens
tcctctgccccctcccccgcaga

SEQ ID NO: 4766383 - DNA, 17 bp, Homo sapiens
tcctctgcttgtcattc

SEQ ID NO: 4766384 - DNA, 22 bp, Homo sapiens
tcctctgtcagtttgtgaagtg

SEQ ID NO: 4766385 - DNA, 22 bp, Homo sapiens
tcctctgtccgtctgtcctgcg

SEQ ID NO: 4766386 - DNA, 18 bp, Homo sapiens
tcctcttaatgtctcaaa

SEQ ID NO: 4766387 - DNA, 21 bp, Homo sapiens
tcctcttaatgtctcaaaata

SEQ ID NO: 4766388 - DNA, 14 bp, Homo sapiens
tcctcttacctgta

SEQ ID NO: 4766389 - DNA, 20 bp, Homo sapiens
tcctcttcctgcctctctca

SEQ ID NO: 4766390 - DNA, 13 bp, Homo sapiens
tcctctttcccca

SEQ ID NO: 4766391 - DNA, 16 bp, Homo sapiens
tcctctttccccactg

SEQ ID NO: 4766392 - DNA, 11 bp, Homo sapiens
tcctgaataac

SEQ ID NO: 4766393 - DNA, 21 bp, Homo sapiens
tcctgacagcgccatgtgtgt

SEQ ID NO: 4766394 - DNA, 14 bp, Homo sapiens
tcctgaccctcact

SEQ ID NO: 4766395 - DNA, 15 bp, Homo sapiens
tcctgaccctcactt

SEQ ID NO: 4766396 - DNA, 14 bp, Homo sapiens
tcctgactgttctc

SEQ ID NO: 4766397 - DNA, 22 bp, Homo sapiens
tcctgactgttctcttactgcc

SEQ ID NO: 4766398 - DNA, 18 bp, Homo sapiens
tcctgagccccctgcacc

SEQ ID NO: 4766399 - DNA, 17 bp, Homo sapiens
tcctgagcctgtctctc

SEQ ID NO: 4766400 - DNA, 18 bp, Homo sapiens
tcctgagcctgtctctcc

SEQ ID NO: 4766401 - DNA, 18 bp, Homo sapiens
tcctgaggtcatctgtaa

SEQ ID NO: 4766402 - DNA, 21 bp, Homo sapiens
tcctgaggtcatctgtaaaat

SEQ ID NO: 4766403 - DNA, 17 bp, Homo sapiens
tcctgatcaaggtgctc

SEQ ID NO: 4766404 - DNA, 20 bp, Homo sapiens
tcctgatcaaggtgctcttc

SEQ ID NO: 4766405 - DNA, 15 bp, Homo sapiens
tcctgcaccctctgc

SEQ ID NO: 4766406 - DNA, 21 bp, Homo sapiens
tcctgcaccctctgctatgtc

SEQ ID NO: 4766407 - DNA, 16 bp, Homo sapiens
tcctgcatccctccac

SEQ ID NO: 4766408 - DNA, 14 bp, Homo sapiens
tcctgcatgtatgc

SEQ ID NO: 4766409 - DNA, 15 bp, Homo sapiens
tcctgcatgtatgcc

SEQ ID NO: 4766410 - DNA, 22 bp, Homo sapiens
tcctgcatgtcggggcccctgc

SEQ ID NO: 4766411 - DNA, 14 bp, Homo sapiens
tcctgcccactctg

SEQ ID NO: 4766412 - DNA, 18 bp, Homo sapiens
tcctgcccatgtgtcccc

SEQ ID NO: 4766413 - DNA, 20 bp, Homo sapiens
tcctgcccttacctgccagg

SEQ ID NO: 4766414 - DNA, 20 bp, Homo sapiens
tcctgcgcctgcgcctcctc

SEQ ID NO: 4766415 - DNA, 24 bp, Homo sapiens
tcctgcgcctgcgcctcctcctgc

SEQ ID NO: 4766416 - DNA, 13 bp, Homo sapiens
tcctgctcgccct

SEQ ID NO: 4766417 - DNA, 14 bp, Homo sapiens
tcctgctcgccctg

SEQ ID NO: 4766418 - DNA, 22 bp, Homo sapiens
tcctgctcgccctgtgccctct

SEQ ID NO: 4766419 - DNA, 12 bp, Homo sapiens
tcctgctgctcg

SEQ ID NO: 4766420 - DNA, 19 bp, Homo sapiens
tcctgctgctcgggaaggc

SEQ ID NO: 4766421 - DNA, 22 bp, Homo sapiens
tcctgctgctcgggaaggcctg

SEQ ID NO: 4766422 - DNA, 18 bp, Homo sapiens
tcctggccagacgctgcc

SEQ ID NO: 4766423 - DNA, 18 bp, Homo sapiens
tcctggcccgggagccgc

SEQ ID NO: 4766424 - DNA, 21 bp, Homo sapiens
tagtgttgggtggaggatgga

SEQ ID NO: 4766425 - DNA, 22 bp, Homo sapiens
tagtgttttcattctggtcctt

SEQ ID NO: 4766426 - DNA, 15 bp, Homo sapiens
tagttaaattggctt

SEQ ID NO: 4766427 - DNA, 16 bp, Homo sapiens
tagttagcaggaaata

SEQ ID NO: 4766428 - DNA, 16 bp, Homo sapiens
tagttaggtgtgccaa

SEQ ID NO: 4766429 - DNA, 17 bp, Homo sapiens
tagttaggtgtgccaaa

SEQ ID NO: 4766430 - DNA, 11 bp, Homo sapiens
tagttctgcaa

SEQ ID NO: 4766431 - DNA, 14 bp, Homo sapiens
tagttgtaaagata

SEQ ID NO: 4766432 - DNA, 20 bp, Homo sapiens
tagtttaaaattattaaaaa

SEQ ID NO: 4766433 - DNA, 20 bp, Homo sapiens
tagtttgacctcacagtgac

SEQ ID NO: 4766434 - DNA, 17 bp, Homo sapiens
tagtttgcatttaagaa

SEQ ID NO: 4766435 - DNA, 21 bp, Homo sapiens
tagtttgcatttaagaattgc

SEQ ID NO: 4766436 - DNA, 16 bp, Homo sapiens
tataaaaaagaaaact

SEQ ID NO: 4766437 - DNA, 14 bp, Homo sapiens
tataaaaacatttt

SEQ ID NO: 4766438 - DNA, 19 bp, Homo sapiens
tataaaacaaaacaaacaa

SEQ ID NO: 4766439 - DNA, 14 bp, Homo sapiens
tataaaatctgtat

SEQ ID NO: 4766440 - DNA, 11 bp, Homo sapiens
tataaacacag

SEQ ID NO: 4766441 - DNA, 13 bp, Homo sapiens
tataaacacagta

SEQ ID NO: 4766442 - DNA, 22 bp, Homo sapiens
tataaaccagcagcaggggaaa

SEQ ID NO: 4766443 - DNA, 13 bp, Homo sapiens
tataaactgtgag

SEQ ID NO: 4766444 - DNA, 14 bp, Homo sapiens
tataaactgtgaga

SEQ ID NO: 4766445 - DNA, 18 bp, Homo sapiens
tataaactgtgagataaa

SEQ ID NO: 4766446 - DNA, 14 bp, Homo sapiens
tataaacttgtgta

SEQ ID NO: 4766447 - DNA, 12 bp, Homo sapiens
tataaactttta

SEQ ID NO: 4766448 - DNA, 14 bp, Homo sapiens
tataaatgaatgaa

SEQ ID NO: 4766449 - DNA, 12 bp, Homo sapiens
tataaatggact

SEQ ID NO: 4766450 - DNA, 16 bp, Homo sapiens
tataaatggacttgct

SEQ ID NO: 4766451 - DNA, 23 bp, Homo sapiens
tataaatggtgtcataactagag

SEQ ID NO: 4766452 - DNA, 12 bp, Homo sapiens
tataaatgtgtg

SEQ ID NO: 4766453 - DNA, 13 bp, Homo sapiens
tataaatgtgtgt

SEQ ID NO: 4766454 - DNA, 11 bp, Homo sapiens
tataaattaaa

SEQ ID NO: 4766455 - DNA, 12 bp, Homo sapiens
tataaattaaat

SEQ ID NO: 4766456 - DNA, 19 bp, Homo sapiens
tataaattaaatatatgta

SEQ ID NO: 4766457 - DNA, 23 bp, Homo sapiens
tataaattaaatatatgtatgta

SEQ ID NO: 4766458 - DNA, 16 bp, Homo sapiens
tataaattacatgcat

SEQ ID NO: 4766459 - DNA, 18 bp, Homo sapiens
tataaattacatgcatga

SEQ ID NO: 4766460 - DNA, 14 bp, Homo sapiens
tataaattataatg

SEQ ID NO: 4766461 - DNA, 22 bp, Homo sapiens
tataagagacaaagtttggaag

SEQ ID NO: 4766462 - DNA, 13 bp, Homo sapiens
tataataaactgt

SEQ ID NO: 4766463 - DNA, 22 bp, Homo sapiens
tataatactttgtatacaagta

SEQ ID NO: 4766464 - DNA, 14 bp, Homo sapiens
tataatcagaatgg

SEQ ID NO: 4766465 - DNA, 22 bp, Homo sapiens
tataatggcctcttaaaaatta

SEQ ID NO: 4766466 - DNA, 13 bp, Homo sapiens
tataattgtcatg

SEQ ID NO: 4766467 - DNA, 14 bp, Homo sapiens
tataattgtcatga

SEQ ID NO: 4766468 - DNA, 23 bp, Homo sapiens
tataatttgccagacagagatca

SEQ ID NO: 4766469 - DNA, 20 bp, Homo sapiens
tatctgtctttatgatttca

SEQ ID NO: 4766470 - DNA, 21 bp, Homo sapiens
tatctgtctttatgatttcat

SEQ ID NO: 4766471 - DNA, 16 bp, Homo sapiens
tatctgtgaaggactt

SEQ ID NO: 4766472 - DNA, 21 bp, Homo sapiens
tatctgtgtaagacacgtgca

SEQ ID NO: 4766473 - DNA, 11 bp, Homo sapiens
tatctgttcta

SEQ ID NO: 4766474 - DNA, 22 bp, Homo sapiens
tatctgttctatggaccaaatg

SEQ ID NO: 4766475 - DNA, 21 bp, Homo sapiens
tatcttaaaattggttaatga

SEQ ID NO: 4766476 - DNA, 14 bp, Homo sapiens
tatcttactttcct

SEQ ID NO: 4766477 - DNA, 12 bp, Homo sapiens
tatcttatttat

SEQ ID NO: 4766478 - DNA, 17 bp, Homo sapiens
tatcttatttatatatg

SEQ ID NO: 4766479 - DNA, 21 bp, Homo sapiens
tatcttcgttagtaatctgta

SEQ ID NO: 4766480 - DNA, 15 bp, Homo sapiens
tatcttctggactat

SEQ ID NO: 4766481 - DNA, 12 bp, Homo sapiens
tatcttgaagaa

SEQ ID NO: 4766482 - DNA, 18 bp, Homo sapiens
tatcttgaagaatattgt

SEQ ID NO: 4766483 - DNA, 15 bp, Homo sapiens
tatcttgaagacttt

SEQ ID NO: 4766484 - DNA, 15 bp, Homo sapiens
tatcttttcttctcc

SEQ ID NO: 4766485 - DNA, 12 bp, Homo sapiens
tatgaaagagaa

SEQ ID NO: 4766486 - DNA, 22 bp, Homo sapiens
tatgaaagagaaaatgctttct

SEQ ID NO: 4766487 - DNA, 23 bp, Homo sapiens
tatgaaagagaaaatgctttctc

SEQ ID NO: 4766488 - DNA, 15 bp, Homo sapiens
tatgaaatatatgtg

SEQ ID NO: 4766489 - DNA, 21 bp, Homo sapiens
tatgaacgcacaacatgcaca

SEQ ID NO: 4766490 - DNA, 15 bp, Homo sapiens
tatgaagcagaatga

SEQ ID NO: 4766491 - DNA, 14 bp, Homo sapiens
tatgaccctgtgcc

SEQ ID NO: 4766492 - DNA, 14 bp, Homo sapiens
tatgacgtgcacaa

SEQ ID NO: 4766493 - DNA, 20 bp, Homo sapiens
tatgacgtgcacaaaccttc

SEQ ID NO: 4766494 - DNA, 22 bp, Homo sapiens
tatgacgtgcacaaaccttctt

SEQ ID NO: 4766495 - DNA, 14 bp, Homo sapiens
tatgactaatcctt

SEQ ID NO: 4766496 - DNA, 20 bp, Homo sapiens
tatgactaatccttaataac

SEQ ID NO: 4766497 - DNA, 21 bp, Homo sapiens
tatgactaatccttaataact

SEQ ID NO: 4766498 - DNA, 24 bp, Homo sapiens
tatgactaatccttaataactatg

SEQ ID NO: 4766499 - DNA, 23 bp, Homo sapiens
tatgactccagaatttcccaaag

SEQ ID NO: 4766500 - DNA, 18 bp, Homo sapiens
tatgagaaatataaaaat

SEQ ID NO: 4766501 - DNA, 20 bp, Homo sapiens
tatgagaaatataaaaataa

SEQ ID NO: 4766502 - DNA, 16 bp, Homo sapiens
tatgagatactttgca

SEQ ID NO: 4766503 - DNA, 20 bp, Homo sapiens
tatgagattggaaaaaatta

SEQ ID NO: 4766504 - DNA, 22 bp, Homo sapiens
tatgatatgcatgtagcatata

SEQ ID NO: 4766505 - DNA, 22 bp, Homo sapiens
tatgatatgtgcttgtgtgtat

SEQ ID NO: 4766506 - DNA, 15 bp, Homo sapiens
tatgattaaactggg

SEQ ID NO: 4766507 - DNA, 16 bp, Homo sapiens
tatgattaaattatca

SEQ ID NO: 4766508 - DNA, 13 bp, Homo sapiens
tatgattccaatt

SEQ ID NO: 4766509 - DNA, 15 bp, Homo sapiens
tatgattctcctctc

SEQ ID NO: 4766510 - DNA, 18 bp, Homo sapiens
tatgattctcctctccca

SEQ ID NO: 4766511 - DNA, 17 bp, Homo sapiens
tatgatttgttcctttc

SEQ ID NO: 4766512 - DNA, 17 bp, Homo sapiens
tatgcaagaagaatata

SEQ ID NO: 4766513 - DNA, 18 bp, Homo sapiens
tatgcagtgtagatttta

SEQ ID NO: 4766514 - DNA, 15 bp, Homo sapiens
tatgcatgagaacta

SEQ ID NO: 4766515 - DNA, 19 bp, Homo sapiens
tatgcatgagaactaaata

SEQ ID NO: 4766516 - DNA, 21 bp, Homo sapiens
tatgcatgagaactaaataga

SEQ ID NO: 4766517 - DNA, 13 bp, Homo sapiens
tatgcatgtagca

SEQ ID NO: 4766518 - DNA, 14 bp, Homo sapiens
tatgcatgtagcat

SEQ ID NO: 4766519 - DNA, 20 bp, Homo sapiens
tatgcatgtagcatataaat

SEQ ID NO: 4766520 - DNA, 21 bp, Homo sapiens
tatgcatgtagcatataaatg

SEQ ID NO: 4766521 - DNA, 12 bp, Homo sapiens
tatgcatttatg

SEQ ID NO: 4766522 - DNA, 13 bp, Homo sapiens
tatgcatttatgc

SEQ ID NO: 4766523 - DNA, 15 bp, Homo sapiens
tatgcatttatgcat

SEQ ID NO: 4766524 - DNA, 16 bp, Homo sapiens
tatgcatttatgcatg

SEQ ID NO: 4766525 - DNA, 19 bp, Homo sapiens
tatgcatttatgcatgaga

SEQ ID NO: 4766526 - DNA, 22 bp, Homo sapiens
tatgcatttatgcatgagaact

SEQ ID NO: 4766527 - DNA, 15 bp, Homo sapiens
tatgcctatatttat

SEQ ID NO: 4766528 - DNA, 13 bp, Homo sapiens
tatgctggccagc

SEQ ID NO: 4766529 - DNA, 18 bp, Homo sapiens
tatgctggccagcaccct

SEQ ID NO: 4766530 - DNA, 15 bp, Homo sapiens
tatgctgtatctgtg

SEQ ID NO: 4766531 - DNA, 14 bp, Homo sapiens
tatgctgtgtgcag

SEQ ID NO: 4766532 - DNA, 15 bp, Homo sapiens
tatgctgtgtgcaga

SEQ ID NO: 4766533 - DNA, 22 bp, Homo sapiens
tatgctgtgtgcagagtataca

SEQ ID NO: 4766534 - DNA, 15 bp, Homo sapiens
tatgctgttcattga

SEQ ID NO: 4766535 - DNA, 19 bp, Homo sapiens
tatgcttttttgcaataag

SEQ ID NO: 4766536 - DNA, 16 bp, Homo sapiens
tatggaaagggtgtgg

SEQ ID NO: 4766537 - DNA, 23 bp, Homo sapiens
tatggaaagggtgtggcttggaa

SEQ ID NO: 4766538 - DNA, 20 bp, Homo sapiens
tatggaaccttccctccaaa

SEQ ID NO: 4766539 - DNA, 16 bp, Homo sapiens
tatggaccaaatgtaa

SEQ ID NO: 4766540 - DNA, 17 bp, Homo sapiens
tatggaccaaatgtaaa

SEQ ID NO: 4766541 - DNA, 21 bp, Homo sapiens
tatggaccaaatgtaaaatat

SEQ ID NO: 4766542 - DNA, 21 bp, Homo sapiens
tatggagtgtgcctctctctc

SEQ ID NO: 4766543 - DNA, 14 bp, Homo sapiens
tatggattcacttc

SEQ ID NO: 4766544 - DNA, 21 bp, Homo sapiens
tatggcaacgttcatgttcat

SEQ ID NO: 4766545 - DNA, 19 bp, Homo sapiens
tatggcatattgataataa

SEQ ID NO: 4766546 - DNA, 14 bp, Homo sapiens
tatggctttgtgct

SEQ ID NO: 4766547 - DNA, 22 bp, Homo sapiens
tatggctttgtgcttgttcttc

SEQ ID NO: 4766548 - DNA, 18 bp, Homo sapiens
tatggtaaataactgtga

SEQ ID NO: 4766549 - DNA, 14 bp, Homo sapiens
tatggtagaaaaat

SEQ ID NO: 4766550 - DNA, 14 bp, Homo sapiens
tatggtatatattt

SEQ ID NO: 4766551 - DNA, 22 bp, Homo sapiens
gtgcctgtgtttcatgttctgt

SEQ ID NO: 4766552 - DNA, 17 bp, Homo sapiens
gtgccttccaccctgcc

SEQ ID NO: 4766553 - DNA, 18 bp, Homo sapiens
gtgccttccaccctgccc

SEQ ID NO: 4766554 - DNA, 20 bp, Homo sapiens
gtgccttccaccctgccctg

SEQ ID NO: 4766555 - DNA, 21 bp, Homo sapiens
gtgccttccaccctgccctgg

SEQ ID NO: 4766556 - DNA, 22 bp, Homo sapiens
gtgccttccaccctgccctggc

SEQ ID NO: 4766557 - DNA, 23 bp, Homo sapiens
gtgccttccaccctgccctggcc

SEQ ID NO: 4766558 - DNA, 21 bp, Homo sapiens
gtgccttccccgtgcggcccg

SEQ ID NO: 4766559 - DNA, 22 bp, Homo sapiens
gtgcgcagccgcgctctgcccc

SEQ ID NO: 4766560 - DNA, 18 bp, Homo sapiens
gtgcggcccgtgcgcagc

SEQ ID NO: 4766561 - DNA, 21 bp, Homo sapiens
gtgcggcccgtgcgcagccgc

SEQ ID NO: 4766562 - DNA, 22 bp, Homo sapiens
gtgctaaacctatctgtattgg

SEQ ID NO: 4766563 - DNA, 14 bp, Homo sapiens
gtgctagtgagctg

SEQ ID NO: 4766564 - DNA, 13 bp, Homo sapiens
gtgctattaatat

SEQ ID NO: 4766565 - DNA, 18 bp, Homo sapiens
gtgctcagggcatgctta

SEQ ID NO: 4766566 - DNA, 22 bp, Homo sapiens
gtgctcagtattgacgacctac

SEQ ID NO: 4766567 - DNA, 23 bp, Homo sapiens
gtgctcataactagagtatgtgt

SEQ ID NO: 4766568 - DNA, 13 bp, Homo sapiens
gtgctcctctgcc

SEQ ID NO: 4766569 - DNA, 16 bp, Homo sapiens
gtgctccttttctctt

SEQ ID NO: 4766570 - DNA, 18 bp, Homo sapiens
gtgctcttctgttctcaa

SEQ ID NO: 4766571 - DNA, 17 bp, Homo sapiens
gtgctgctgtggcatca

SEQ ID NO: 4766572 - DNA, 14 bp, Homo sapiens
gtgctggggctgca

SEQ ID NO: 4766573 - DNA, 12 bp, Homo sapiens
gtgctgtgggca

SEQ ID NO: 4766574 - DNA, 15 bp, Homo sapiens
gtgctgtgggcagca

SEQ ID NO: 4766575 - DNA, 18 bp, Homo sapiens
gtgctgtgggcagcaccc

SEQ ID NO: 4766576 - DNA, 17 bp, Homo sapiens
gtgctgttgattctttc

SEQ ID NO: 4766577 - DNA, 17 bp, Homo sapiens
gtgcttagaaacctcac

SEQ ID NO: 4766578 - DNA, 20 bp, Homo sapiens
gtgcttcacacaaagtgaaa

SEQ ID NO: 4766579 - DNA, 23 bp, Homo sapiens
gtgcttcacacaaagtgaaatta

SEQ ID NO: 4766580 - DNA, 23 bp, Homo sapiens
gtgcttccgagattcagactgct

SEQ ID NO: 4766581 - DNA, 20 bp, Homo sapiens
gtgcttgaggccaaatgagt

SEQ ID NO: 4766582 - DNA, 20 bp, Homo sapiens
gtgcttgtgtgtatgtctat

SEQ ID NO: 4766583 - DNA, 15 bp, Homo sapiens
gtgctttatccacat

SEQ ID NO: 4766584 - DNA, 16 bp, Homo sapiens
gtgctttatccacatt

SEQ ID NO: 4766585 - DNA, 19 bp, Homo sapiens
gtgctttatccacattgta

SEQ ID NO: 4766586 - DNA, 19 bp, Homo sapiens
gtgctttctatctaatttt

SEQ ID NO: 4766587 - DNA, 12 bp, Homo sapiens
gtgctttctgca

SEQ ID NO: 4766588 - DNA, 13 bp, Homo sapiens
gtgctttctgcat

SEQ ID NO: 4766589 - DNA, 16 bp, Homo sapiens
gtggaaatggggaact

SEQ ID NO: 4766590 - DNA, 21 bp, Homo sapiens
gtggaagacagagatggcaga

SEQ ID NO: 4766591 - DNA, 14 bp, Homo sapiens
gtggaagggcagga

SEQ ID NO: 4766592 - DNA, 15 bp, Homo sapiens
gtggaagggcaggag

SEQ ID NO: 4766593 - DNA, 20 bp, Homo sapiens
gtggaattattagcaccagc

SEQ ID NO: 4766594 - DNA, 17 bp, Homo sapiens
gtggactcgcgagaggg

SEQ ID NO: 4766595 - DNA, 14 bp, Homo sapiens
gtggactcttccct

SEQ ID NO: 4766596 - DNA, 13 bp, Homo sapiens
gtggaggggtcag

SEQ ID NO: 4766597 - DNA, 17 bp, Homo sapiens
gtggagttcatcttgaa

SEQ ID NO: 4766598 - DNA, 17 bp, Homo sapiens
gtggataaattttggaa

SEQ ID NO: 4766599 - DNA, 18 bp, Homo sapiens
gtggataaattttggaag

SEQ ID NO: 4766600 - DNA, 13 bp, Homo sapiens
gtggataagaaaa

SEQ ID NO: 4766601 - DNA, 19 bp, Homo sapiens
gtggatgtcccttccccac

SEQ ID NO: 4766602 - DNA, 12 bp, Homo sapiens
gtggattgtttt

SEQ ID NO: 4766603 - DNA, 13 bp, Homo sapiens
gtggcaaacattt

SEQ ID NO: 4766604 - DNA, 17 bp, Homo sapiens
gtggcacccaccactct

SEQ ID NO: 4766605 - DNA, 20 bp, Homo sapiens
gtggcacccaccactctcag

SEQ ID NO: 4766606 - DNA, 22 bp, Homo sapiens
gtggcacttgggtgtggctcct

SEQ ID NO: 4766607 - DNA, 15 bp, Homo sapiens
gtggcagcgcccagc

SEQ ID NO: 4766608 - DNA, 23 bp, Homo sapiens
gtggcaggcacacagcagccccc

SEQ ID NO: 4766609 - DNA, 16 bp, Homo sapiens
gtggcatttgcaggtg

SEQ ID NO: 4766610 - DNA, 16 bp, Homo sapiens
gtggcatttgctgaat

SEQ ID NO: 4766611 - DNA, 13 bp, Homo sapiens
gtggccagcccgc

SEQ ID NO: 4766612 - DNA, 21 bp, Homo sapiens
gtggccagcccgcagaggtgg

SEQ ID NO: 4766613 - DNA, 14 bp, Homo sapiens
gtggccatccctgg

SEQ ID NO: 4766614 - DNA, 16 bp, Homo sapiens
gtggccatccctgggc

SEQ ID NO: 4766615 - DNA, 17 bp, Homo sapiens
gtggccatccctgggcc

SEQ ID NO: 4766616 - DNA, 19 bp, Homo sapiens
gtggccatccctgggcccc

SEQ ID NO: 4766617 - DNA, 23 bp, Homo sapiens
gtggccctgccctctccttcctt

SEQ ID NO: 4766618 - DNA, 13 bp, Homo sapiens
gtggccgctgccc

SEQ ID NO: 4766619 - DNA, 15 bp, Homo sapiens
gtggccgctgcccac

SEQ ID NO: 4766620 - DNA, 18 bp, Homo sapiens
gtggcctcagccctcaga

SEQ ID NO: 4766621 - DNA, 14 bp, Homo sapiens
gtggcctgagaaga

SEQ ID NO: 4766622 - DNA, 18 bp, Homo sapiens
gtggcctgggtcctcggc

SEQ ID NO: 4766623 - DNA, 19 bp, Homo sapiens
gtggcctgggtcctcggcc

SEQ ID NO: 4766624 - DNA, 16 bp, Homo sapiens
gtggccttgagtctct

SEQ ID NO: 4766625 - DNA, 19 bp, Homo sapiens
gttgtattcctgcctttga

SEQ ID NO: 4766626 - DNA, 23 bp, Homo sapiens
gttgtctctcttcggtggccttg

SEQ ID NO: 4766627 - DNA, 14 bp, Homo sapiens
gttgttatattcat

SEQ ID NO: 4766628 - DNA, 20 bp, Homo sapiens
gttgttcgatcgtttcacat

SEQ ID NO: 4766629 - DNA, 19 bp, Homo sapiens
gttgttttttctttataat

SEQ ID NO: 4766630 - DNA, 15 bp, Homo sapiens
gtttaaatctttgtt

SEQ ID NO: 4766631 - DNA, 21 bp, Homo sapiens
gtttaacagaaaaatgaaatt

SEQ ID NO: 4766632 - DNA, 14 bp, Homo sapiens
gtttaagaatcatg

SEQ ID NO: 4766633 - DNA, 19 bp, Homo sapiens
gtttaagaatcatggattt

SEQ ID NO: 4766634 - DNA, 12 bp, Homo sapiens
gtttaatgcaaa

SEQ ID NO: 4766635 - DNA, 18 bp, Homo sapiens
gtttaccctccctgtccc

SEQ ID NO: 4766636 - DNA, 13 bp, Homo sapiens
gtttactctgtgc

SEQ ID NO: 4766637 - DNA, 14 bp, Homo sapiens
gtttagctgtgaaa

SEQ ID NO: 4766638 - DNA, 15 bp, Homo sapiens
gtttagtttgcattt

SEQ ID NO: 4766639 - DNA, 17 bp, Homo sapiens
gtttcaccacaaccctg

SEQ ID NO: 4766640 - DNA, 13 bp, Homo sapiens
gtttcagaaaggg

SEQ ID NO: 4766641 - DNA, 21 bp, Homo sapiens
gtttcagaaagggcagcccct

SEQ ID NO: 4766642 - DNA, 22 bp, Homo sapiens
gtttcagaaagggcagcccctc

SEQ ID NO: 4766643 - DNA, 21 bp, Homo sapiens
gtttcagataaatcatgggca

SEQ ID NO: 4766644 - DNA, 22 bp, Homo sapiens
gtttcagataaatcatgggcat

SEQ ID NO: 4766645 - DNA, 14 bp, Homo sapiens
gtttcagcattccc

SEQ ID NO: 4766646 - DNA, 15 bp, Homo sapiens
gtttcagcattccca

SEQ ID NO: 4766647 - DNA, 13 bp, Homo sapiens
gtttccatttgga

SEQ ID NO: 4766648 - DNA, 20 bp, Homo sapiens
gtttcctcctcccaacagtt

SEQ ID NO: 4766649 - DNA, 16 bp, Homo sapiens
gtttctgtttgaattt

SEQ ID NO: 4766650 - DNA, 17 bp, Homo sapiens
gtttgaaacttttcaag

SEQ ID NO: 4766651 - DNA, 16 bp, Homo sapiens
gtttgaaccaagaact

SEQ ID NO: 4766652 - DNA, 21 bp, Homo sapiens
gtttgacctcacagtgaccct

SEQ ID NO: 4766653 - DNA, 19 bp, Homo sapiens
gtttgaggaccctcccagg

SEQ ID NO: 4766654 - DNA, 22 bp, Homo sapiens
gtttgatgaataaaatgtttat

SEQ ID NO: 4766655 - DNA, 17 bp, Homo sapiens
gtttgctgcttttgatg

SEQ ID NO: 4766656 - DNA, 17 bp, Homo sapiens
gtttgggaaaggcaggg

SEQ ID NO: 4766657 - DNA, 14 bp, Homo sapiens
gtttgggcagtgga

SEQ ID NO: 4766658 - DNA, 16 bp, Homo sapiens
gtttgggcagtggaga

SEQ ID NO: 4766659 - DNA, 18 bp, Homo sapiens
gtttgggcagtggagagg

SEQ ID NO: 4766660 - DNA, 22 bp, Homo sapiens
gtttgggggacgcccagccccc

SEQ ID NO: 4766661 - DNA, 15 bp, Homo sapiens
gtttgtaaaaatgta

SEQ ID NO: 4766662 - DNA, 20 bp, Homo sapiens
gtttgtaagcaattctaagt

SEQ ID NO: 4766663 - DNA, 20 bp, Homo sapiens
gtttgtgaggacctttgcac

SEQ ID NO: 4766664 - DNA, 13 bp, Homo sapiens
gtttgtttgctgc

SEQ ID NO: 4766665 - DNA, 17 bp, Homo sapiens
gttttacaaagaaacaa

SEQ ID NO: 4766666 - DNA, 19 bp, Homo sapiens
gttttagaaacaatatgga

SEQ ID NO: 4766667 - DNA, 13 bp, Homo sapiens
gttttataaatgg

SEQ ID NO: 4766668 - DNA, 17 bp, Homo sapiens
gttttatgactaatcct

SEQ ID NO: 4766669 - DNA, 16 bp, Homo sapiens
gttttatttgtttact

SEQ ID NO: 4766670 - DNA, 23 bp, Homo sapiens
gttttcagattgtaaaggtaggt

SEQ ID NO: 4766671 - DNA, 22 bp, Homo sapiens
gttttcaggtgctcaaaatgca

SEQ ID NO: 4766672 - DNA, 10 bp, Homo sapiens
gttttctcct

SEQ ID NO: 4766673 - DNA, 11 bp, Homo sapiens
gttttctcctt

SEQ ID NO: 4766674 - DNA, 19 bp, Homo sapiens
gttttgacttgccactgcc

SEQ ID NO: 4766675 - DNA, 16 bp, Homo sapiens
gttttgcatgtctgca

SEQ ID NO: 4766676 - DNA, 13 bp, Homo sapiens
gttttgcctcttt

SEQ ID NO: 4766677 - DNA, 23 bp, Homo sapiens
gttttgcctctttaaattatgac

SEQ ID NO: 4766678 - DNA, 14 bp, Homo sapiens
gttttggctgctct

SEQ ID NO: 4766679 - DNA, 18 bp, Homo sapiens
gttttgggttttcttccc

SEQ ID NO: 4766680 - DNA, 19 bp, Homo sapiens
gttttgtaaaattccatgg

SEQ ID NO: 4766681 - DNA, 16 bp, Homo sapiens
taacatggaagtacta

SEQ ID NO: 4766682 - DNA, 15 bp, Homo sapiens
taacattcttggtca

SEQ ID NO: 4766683 - DNA, 20 bp, Homo sapiens
taacattcttggtcacaaag

SEQ ID NO: 4766684 - DNA, 15 bp, Homo sapiens
taacattgtaaatga

SEQ ID NO: 4766685 - DNA, 20 bp, Homo sapiens
taaccaccatttcccctgtg

SEQ ID NO: 4766686 - DNA, 14 bp, Homo sapiens
taacccaaaagatt

SEQ ID NO: 4766687 - DNA, 14 bp, Homo sapiens
taaccgccgcggta

SEQ ID NO: 4766688 - DNA, 19 bp, Homo sapiens
taaccgggactacagaagt

SEQ ID NO: 4766689 - DNA, 22 bp, Homo sapiens
taacctatgaagtttattttct

SEQ ID NO: 4766690 - DNA, 22 bp, Homo sapiens
taacctgggttgttgcagagta

SEQ ID NO: 4766691 - DNA, 12 bp, Homo sapiens
taacctgtgaat

SEQ ID NO: 4766692 - DNA, 20 bp, Homo sapiens
taacgaccgacgcccctccg

SEQ ID NO: 4766693 - DNA, 17 bp, Homo sapiens
taactaatgtaaatatt

SEQ ID NO: 4766694 - DNA, 13 bp, Homo sapiens
taactaatttgct

SEQ ID NO: 4766695 - DNA, 16 bp, Homo sapiens
taactagagtatgtgt

SEQ ID NO: 4766696 - DNA, 13 bp, Homo sapiens
taactagatctcc

SEQ ID NO: 4766697 - DNA, 15 bp, Homo sapiens
taactatggtaaata

SEQ ID NO: 4766698 - DNA, 13 bp, Homo sapiens
taactctgcatag

SEQ ID NO: 4766699 - DNA, 19 bp, Homo sapiens
taactctttggctattgtc

SEQ ID NO: 4766700 - DNA, 23 bp, Homo sapiens
taactctttggctattgtccttg

SEQ ID NO: 4766701 - DNA, 15 bp, Homo sapiens
taactgaggagctag

SEQ ID NO: 4766702 - DNA, 12 bp, Homo sapiens
taactgccatgt

SEQ ID NO: 4766703 - DNA, 22 bp, Homo sapiens
taactgccatgtaggctaagaa

SEQ ID NO: 4766704 - DNA, 14 bp, Homo sapiens
taactggccccagg

SEQ ID NO: 4766705 - DNA, 16 bp, Homo sapiens
taactggccccaggcg

SEQ ID NO: 4766706 - DNA, 21 bp, Homo sapiens
taactggccctcgggccctct

SEQ ID NO: 4766707 - DNA, 16 bp, Homo sapiens
taactgtatatttgta

SEQ ID NO: 4766708 - DNA, 19 bp, Homo sapiens
taactgtatatttgtatga

SEQ ID NO: 4766709 - DNA, 23 bp, Homo sapiens
taactgtccgtagtatcagagat

SEQ ID NO: 4766710 - DNA, 14 bp, Homo sapiens
taactgtgactgtg

SEQ ID NO: 4766711 - DNA, 18 bp, Homo sapiens
taactgttaacccagtgt

SEQ ID NO: 4766712 - DNA, 14 bp, Homo sapiens
taactgttacagta

SEQ ID NO: 4766713 - DNA, 17 bp, Homo sapiens
taactgttacagtaatg

SEQ ID NO: 4766714 - DNA, 14 bp, Homo sapiens
taacttatctccag

SEQ ID NO: 4766715 - DNA, 14 bp, Homo sapiens
taacttattttgat

SEQ ID NO: 4766716 - DNA, 21 bp, Homo sapiens
taacttattttgattgtttga

SEQ ID NO: 4766717 - DNA, 14 bp, Homo sapiens
taacttgatcttgt

SEQ ID NO: 4766718 - DNA, 13 bp, Homo sapiens
taacttgctgtga

SEQ ID NO: 4766719 - DNA, 18 bp, Homo sapiens
taacttgctgtgaaatga

SEQ ID NO: 4766720 - DNA, 19 bp, Homo sapiens
taacttgctgtgaaatgac

SEQ ID NO: 4766721 - DNA, 14 bp, Homo sapiens
taacttgtttgtaa

SEQ ID NO: 4766722 - DNA, 21 bp, Homo sapiens
taactttagaaataaacctta

SEQ ID NO: 4766723 - DNA, 15 bp, Homo sapiens
taacttttattatct

SEQ ID NO: 4766724 - DNA, 17 bp, Homo sapiens
taagaaacagtttaaca

SEQ ID NO: 4766725 - DNA, 15 bp, Homo sapiens
taagaaagaaatgct

SEQ ID NO: 4766726 - DNA, 22 bp, Homo sapiens
taagaaatgagaaattgtgcca

SEQ ID NO: 4766727 - DNA, 17 bp, Homo sapiens
taagaaatggctttcca

SEQ ID NO: 4766728 - DNA, 22 bp, Homo sapiens
taagaaccttttgagtgcctta

SEQ ID NO: 4766729 - DNA, 10 bp, Homo sapiens
taagaattca

SEQ ID NO: 4766730 - DNA, 12 bp, Homo sapiens
taagaattcagt

SEQ ID NO: 4766731 - DNA, 19 bp, Homo sapiens
taagaattcagtagcattt

SEQ ID NO: 4766732 - DNA, 14 bp, Homo sapiens
taagacaagtctga

SEQ ID NO: 4766733 - DNA, 12 bp, Homo sapiens
taagagacaaag

SEQ ID NO: 4766734 - DNA, 19 bp, Homo sapiens
taagagacaaagtttggaa

SEQ ID NO: 4766735 - DNA, 20 bp, Homo sapiens
taagagatatgctcattatt

SEQ ID NO: 4766736 - DNA, 22 bp, Homo sapiens
taagagattggatcaagtatta

SEQ ID NO: 4766737 - DNA, 22 bp, Homo sapiens
taagataggttctgctttctga

SEQ ID NO: 4766738 - DNA, 16 bp, Homo sapiens
taagatgtgtcttcaa

SEQ ID NO: 4766739 - DNA, 21 bp, Homo sapiens
taagattccattttggaaaat

SEQ ID NO: 4766740 - DNA, 12 bp, Homo sapiens
taagattgtaca

SEQ ID NO: 4766741 - DNA, 20 bp, Homo sapiens
taagattgttattaaatgta

SEQ ID NO: 4766742 - DNA, 21 bp, Homo sapiens
taagcacaaccatgttcttga

SEQ ID NO: 4766743 - DNA, 19 bp, Homo sapiens
taagcagtacatcttgtgc

SEQ ID NO: 4766744 - DNA, 21 bp, Homo sapiens
taagcagtacatcttgtgcat

SEQ ID NO: 4766745 - DNA, 15 bp, Homo sapiens
taagcattttactgt

SEQ ID NO: 4766746 - DNA, 17 bp, Homo sapiens
taagccaatataatggg

SEQ ID NO: 4766747 - DNA, 20 bp, Homo sapiens
taagccaatgaagcaaacac

SEQ ID NO: 4766748 - DNA, 21 bp, Homo sapiens
taagctgcccaatttcacaga

SEQ ID NO: 4766749 - DNA, 15 bp, Homo sapiens
taaggacagtgttca

SEQ ID NO: 4766750 - DNA, 19 bp, Homo sapiens
taaggacagtgttcaaatt

SEQ ID NO: 4766751 - DNA, 21 bp, Homo sapiens
taaggaccgtggccctgccct

SEQ ID NO: 4766752 - DNA, 17 bp, Homo sapiens
taaggacttctgcagct

SEQ ID NO: 4766753 - DNA, 19 bp, Homo sapiens
taagggactccagaagcag

SEQ ID NO: 4766754 - DNA, 22 bp, Homo sapiens
taagggactccagaagcagcag

SEQ ID NO: 4766755 - DNA, 15 bp, Homo sapiens
taagggcaggaagac

SEQ ID NO: 4766756 - DNA, 19 bp, Homo sapiens
taaggtcagtgttataaaa

SEQ ID NO: 4766757 - DNA, 13 bp, Homo sapiens
taaggttcttgct

SEQ ID NO: 4766758 - DNA, 21 bp, Homo sapiens
taagtaaatgtcttcatgttg

SEQ ID NO: 4766759 - DNA, 21 bp, Homo sapiens
taagtagactttaattcttct

SEQ ID NO: 4766760 - DNA, 22 bp, Homo sapiens
taagtattccttggcccagcag

SEQ ID NO: 4766761 - DNA, 23 bp, Homo sapiens
taagtattccttggcccagcagc

SEQ ID NO: 4766762 - DNA, 21 bp, Homo sapiens
taagtatttcagatgctttag

SEQ ID NO: 4766763 - DNA, 21 bp, Homo sapiens
taagtctatctggtattaaat

SEQ ID NO: 4766764 - DNA, 23 bp, Homo sapiens
taagtctcaattctgaaggggaa

SEQ ID NO: 4766765 - DNA, 16 bp, Homo sapiens
taagtcttactgtttt

SEQ ID NO: 4766766 - DNA, 12 bp, Homo sapiens
taagtgagagag

SEQ ID NO: 4766767 - DNA, 17 bp, Homo sapiens
taagtgcttgaggccaa

SEQ ID NO: 4766768 - DNA, 20 bp, Homo sapiens
taagtggaagacagagatgg

SEQ ID NO: 4766769 - DNA, 15 bp, Homo sapiens
taagtggactgtatt

SEQ ID NO: 4766770 - DNA, 15 bp, Homo sapiens
taagtgttctgtggc

SEQ ID NO: 4766771 - DNA, 21 bp, Homo sapiens
taagtgttctgtggctgattt

SEQ ID NO: 4766772 - DNA, 14 bp, Homo sapiens
taagtgttggccat

SEQ ID NO: 4766773 - DNA, 15 bp, Homo sapiens
taagttataccagca

SEQ ID NO: 4766774 - DNA, 13 bp, Homo sapiens
taagttctgtgca

SEQ ID NO: 4766775 - DNA, 16 bp, Homo sapiens
taagttctgtgcagtt

SEQ ID NO: 4766776 - DNA, 19 bp, Homo sapiens
taagttctgtgcagtttgg

SEQ ID NO: 4766777 - DNA, 23 bp, Homo sapiens
taagttctgtgcagtttggtatg

SEQ ID NO: 4766778 - DNA, 17 bp, Homo sapiens
taagttgaagggaaatc

SEQ ID NO: 4766779 - DNA, 13 bp, Homo sapiens
taagttgaccttt

SEQ ID NO: 4766780 - DNA, 15 bp, Homo sapiens
taagttgtcttacac

SEQ ID NO: 4766781 - DNA, 15 bp, Homo sapiens
taagtttctaagaat

SEQ ID NO: 4766782 - DNA, 11 bp, Homo sapiens
taagttttctc

SEQ ID NO: 4766783 - DNA, 13 bp, Homo sapiens
taagttttctctt

SEQ ID NO: 4766784 - DNA, 16 bp, Homo sapiens
taataaaactctgcac

SEQ ID NO: 4766785 - DNA, 12 bp, Homo sapiens
taataaaagaat

SEQ ID NO: 4766786 - DNA, 13 bp, Homo sapiens
taataaaatacat

SEQ ID NO: 4766787 - DNA, 19 bp, Homo sapiens
taataaaattcattccatt

SEQ ID NO: 4766788 - DNA, 14 bp, Homo sapiens
taataaagattcca

SEQ ID NO: 4766789 - DNA, 15 bp, Homo sapiens
taataactagatctc

SEQ ID NO: 4766790 - DNA, 19 bp, Homo sapiens
taatacaccaaatagcttt

SEQ ID NO: 4766791 - DNA, 20 bp, Homo sapiens
taatagaaagtcagatgact

SEQ ID NO: 4766792 - DNA, 21 bp, Homo sapiens
taatagaaagtcagatgacta

SEQ ID NO: 4766793 - DNA, 16 bp, Homo sapiens
taatagctcacagcac

SEQ ID NO: 4766794 - DNA, 18 bp, Homo sapiens
taatagctcacagcacat

SEQ ID NO: 4766795 - DNA, 23 bp, Homo sapiens
taatagtacccaacctggtaatt

SEQ ID NO: 4766796 - DNA, 15 bp, Homo sapiens
taatataaatcgtaa

SEQ ID NO: 4766797 - DNA, 16 bp, Homo sapiens
taatataaatgaatga

SEQ ID NO: 4766798 - DNA, 12 bp, Homo sapiens
taatatactcct

SEQ ID NO: 4766799 - DNA, 14 bp, Homo sapiens
taatatagggtttg

SEQ ID NO: 4766800 - DNA, 22 bp, Homo sapiens
taatatatacatattcaaagta

SEQ ID NO: 4766801 - DNA, 16 bp, Homo sapiens
taatatcactcattaa

SEQ ID NO: 4766802 - DNA, 15 bp, Homo sapiens
taatatcatttcata

SEQ ID NO: 4766803 - DNA, 15 bp, Homo sapiens
tacaggaagtactgg

SEQ ID NO: 4766804 - DNA, 22 bp, Homo sapiens
tacaggaagtactggagaaaat

SEQ ID NO: 4766805 - DNA, 21 bp, Homo sapiens
tacaggatatcacctgaatta

SEQ ID NO: 4766806 - DNA, 16 bp, Homo sapiens
tacagtatataagctt

SEQ ID NO: 4766807 - DNA, 20 bp, Homo sapiens
tacagtctctatttgatttg

SEQ ID NO: 4766808 - DNA, 14 bp, Homo sapiens
tacagttatacata

SEQ ID NO: 4766809 - DNA, 19 bp, Homo sapiens
tacagttgatatttaaaag

SEQ ID NO: 4766810 - DNA, 20 bp, Homo sapiens
tacagtttgtgaggaccttt

SEQ ID NO: 4766811 - DNA, 17 bp, Homo sapiens
tacagtttgtttacaca

SEQ ID NO: 4766812 - DNA, 20 bp, Homo sapiens
tacataaagtaataactgtt

SEQ ID NO: 4766813 - DNA, 15 bp, Homo sapiens
tacataacaggcatt

SEQ ID NO: 4766814 - DNA, 20 bp, Homo sapiens
tacataatgttagtagcact

SEQ ID NO: 4766815 - DNA, 17 bp, Homo sapiens
tacataattgccaataa

SEQ ID NO: 4766816 - DNA, 19 bp, Homo sapiens
tacatacctctctctatat

SEQ ID NO: 4766817 - DNA, 23 bp, Homo sapiens
tacatacctctctctatatatac

SEQ ID NO: 4766818 - DNA, 16 bp, Homo sapiens
tacatagtggtcattt

SEQ ID NO: 4766819 - DNA, 14 bp, Homo sapiens
tacatatacacaaa

SEQ ID NO: 4766820 - DNA, 15 bp, Homo sapiens
tacatatgataaatt

SEQ ID NO: 4766821 - DNA, 14 bp, Homo sapiens
tacatatgctttaa

SEQ ID NO: 4766822 - DNA, 21 bp, Homo sapiens
tacatatgctttaagaatcga

SEQ ID NO: 4766823 - DNA, 13 bp, Homo sapiens
tacatatgtatgt

SEQ ID NO: 4766824 - DNA, 14 bp, Homo sapiens
tacatatgtatgtg

SEQ ID NO: 4766825 - DNA, 14 bp, Homo sapiens
tacatattcaaagt

SEQ ID NO: 4766826 - DNA, 21 bp, Homo sapiens
tacatattcaaagtatataca

SEQ ID NO: 4766827 - DNA, 23 bp, Homo sapiens
tacatcagagtgtatttttgtaa

SEQ ID NO: 4766828 - DNA, 13 bp, Homo sapiens
tacatcctctgct

SEQ ID NO: 4766829 - DNA, 12 bp, Homo sapiens
tacatctgaaat

SEQ ID NO: 4766830 - DNA, 15 bp, Homo sapiens
tacatctgaaatcta

SEQ ID NO: 4766831 - DNA, 12 bp, Homo sapiens
tacatcttgtgc

SEQ ID NO: 4766832 - DNA, 17 bp, Homo sapiens
tacatcttgtgcatgca

SEQ ID NO: 4766833 - DNA, 21 bp, Homo sapiens
tacatcttgtgcatgcaaaaa

SEQ ID NO: 4766834 - DNA, 15 bp, Homo sapiens
tacatgatgatttca

SEQ ID NO: 4766835 - DNA, 17 bp, Homo sapiens
tacatgatgatttcaga

SEQ ID NO: 4766836 - DNA, 22 bp, Homo sapiens
tacatgatgatttcagaaacaa

SEQ ID NO: 4766837 - DNA, 16 bp, Homo sapiens
tacatgccattgaaaa

SEQ ID NO: 4766838 - DNA, 22 bp, Homo sapiens
tacatgcctttccagtgctgct

SEQ ID NO: 4766839 - DNA, 23 bp, Homo sapiens
tacattagacacacatatacatt

SEQ ID NO: 4766840 - DNA, 19 bp, Homo sapiens
tacattatttctgtatata

SEQ ID NO: 4766841 - DNA, 17 bp, Homo sapiens
tacattcttgctctgct

SEQ ID NO: 4766842 - DNA, 13 bp, Homo sapiens
tacatttgttcct

SEQ ID NO: 4766843 - DNA, 14 bp, Homo sapiens
taccaaatataaac

SEQ ID NO: 4766844 - DNA, 18 bp, Homo sapiens
taccaaatataaacttgt

SEQ ID NO: 4766845 - DNA, 21 bp, Homo sapiens
taccaatgctcttttcacagc

SEQ ID NO: 4766846 - DNA, 13 bp, Homo sapiens
taccacagctgcc

SEQ ID NO: 4766847 - DNA, 20 bp, Homo sapiens
taccacagctgcctccgggc

SEQ ID NO: 4766848 - DNA, 22 bp, Homo sapiens
taccacagctgcctccgggcct

SEQ ID NO: 4766849 - DNA, 21 bp, Homo sapiens
taccaccctcgctgccaccca

SEQ ID NO: 4766850 - DNA, 22 bp, Homo sapiens
taccaccctcgctgccacccac

SEQ ID NO: 4766851 - DNA, 14 bp, Homo sapiens
taccacttagaaga

SEQ ID NO: 4766852 - DNA, 23 bp, Homo sapiens
taccagactgcaggttggacccc

SEQ ID NO: 4766853 - DNA, 14 bp, Homo sapiens
taccagagactctg

SEQ ID NO: 4766854 - DNA, 18 bp, Homo sapiens
taccagcaaaagtgcagt

SEQ ID NO: 4766855 - DNA, 17 bp, Homo sapiens
taccagccctggggctg

SEQ ID NO: 4766856 - DNA, 14 bp, Homo sapiens
taccagttcttgca

SEQ ID NO: 4766857 - DNA, 17 bp, Homo sapiens
taccagttcttgcaata

SEQ ID NO: 4766858 - DNA, 18 bp, Homo sapiens
taccagttcttgcaataa

SEQ ID NO: 4766859 - DNA, 19 bp, Homo sapiens
taccagttcttgcaataag

SEQ ID NO: 4766860 - DNA, 23 bp, Homo sapiens
taccagttcttgcaataagatat

SEQ ID NO: 4766861 - DNA, 15 bp, Homo sapiens
taccatcaaacaaat

SEQ ID NO: 4766862 - DNA, 20 bp, Homo sapiens
tacccatcggtgtccattta

SEQ ID NO: 4766863 - DNA, 21 bp, Homo sapiens
tacccatcggtgtccatttat

SEQ ID NO: 4766864 - DNA, 16 bp, Homo sapiens
taccccctgccccaga

SEQ ID NO: 4766865 - DNA, 15 bp, Homo sapiens
taccccgtccctttc

SEQ ID NO: 4766866 - DNA, 16 bp, Homo sapiens
tacccggtggcttctg

SEQ ID NO: 4766867 - DNA, 21 bp, Homo sapiens
tacccggtggcttctggcacc

SEQ ID NO: 4766868 - DNA, 23 bp, Homo sapiens
taccctaggtctccacccctcaa

SEQ ID NO: 4766869 - DNA, 11 bp, Homo sapiens
taccctccctg

SEQ ID NO: 4766870 - DNA, 13 bp, Homo sapiens
taccctccctgtc

SEQ ID NO: 4766871 - DNA, 17 bp, Homo sapiens
taccctcctgtaaaata

SEQ ID NO: 4766872 - DNA, 19 bp, Homo sapiens
taccctcttctcagctcca

SEQ ID NO: 4766873 - DNA, 22 bp, Homo sapiens
taccctcttctcagctccactc

SEQ ID NO: 4766874 - DNA, 14 bp, Homo sapiens
taccggccactgca

SEQ ID NO: 4766875 - DNA, 15 bp, Homo sapiens
taccggccactgcaa

SEQ ID NO: 4766876 - DNA, 12 bp, Homo sapiens
tacctaagtaaa

SEQ ID NO: 4766877 - DNA, 13 bp, Homo sapiens
tacctataaatgg

SEQ ID NO: 4766878 - DNA, 16 bp, Homo sapiens
tacctataaatggact

SEQ ID NO: 4766879 - DNA, 17 bp, Homo sapiens
tacctataaatggactt

SEQ ID NO: 4766880 - DNA, 13 bp, Homo sapiens
tacctcatttgca

SEQ ID NO: 4766881 - DNA, 22 bp, Homo sapiens
tacctcgagtggcgagtccaga

SEQ ID NO: 4766882 - DNA, 20 bp, Homo sapiens
tacctctctctatatataca

SEQ ID NO: 4766883 - DNA, 17 bp, Homo sapiens
tacctctgaccaacagg

SEQ ID NO: 4766884 - DNA, 18 bp, Homo sapiens
tacctctgcataaatatt

SEQ ID NO: 4766885 - DNA, 16 bp, Homo sapiens
tacctgccaggaagcc

SEQ ID NO: 4766886 - DNA, 20 bp, Homo sapiens
tacctgccaggaagccagca

SEQ ID NO: 4766887 - DNA, 22 bp, Homo sapiens
tacctggcttagcgttctgttt

SEQ ID NO: 4766888 - DNA, 12 bp, Homo sapiens
tacctgtgagga

SEQ ID NO: 4766889 - DNA, 20 bp, Homo sapiens
taccttccagtcaggatgac

SEQ ID NO: 4766890 - DNA, 14 bp, Homo sapiens
taccttccatctca

SEQ ID NO: 4766891 - DNA, 13 bp, Homo sapiens
taccttcccatgc

SEQ ID NO: 4766892 - DNA, 13 bp, Homo sapiens
tacgctctctgtc

SEQ ID NO: 4766893 - DNA, 14 bp, Homo sapiens
tactaacactggct

SEQ ID NO: 4766894 - DNA, 16 bp, Homo sapiens
tactaaccaccatttc

SEQ ID NO: 4766895 - DNA, 15 bp, Homo sapiens
tactaataaaataca

SEQ ID NO: 4766896 - DNA, 14 bp, Homo sapiens
tactacatttgcat

SEQ ID NO: 4766897 - DNA, 16 bp, Homo sapiens
tactacatttgcatgc

SEQ ID NO: 4766898 - DNA, 23 bp, Homo sapiens
tactagagatattttgtaaaatg

SEQ ID NO: 4766899 - DNA, 16 bp, Homo sapiens
tactatagcaaagtag

SEQ ID NO: 4766900 - DNA, 23 bp, Homo sapiens
tactatctagtgtctaaaacact

SEQ ID NO: 4766901 - DNA, 18 bp, Homo sapiens
tactattaactctgcata

SEQ ID NO: 4766902 - DNA, 16 bp, Homo sapiens
tactcaaaatgcagga

SEQ ID NO: 4766903 - DNA, 18 bp, Homo sapiens
tactcaaaatgcaggaca

SEQ ID NO: 4766904 - DNA, 22 bp, Homo sapiens
tactcaagatactggactaagt

SEQ ID NO: 4766905 - DNA, 16 bp, Homo sapiens
tactcatggaagagat

SEQ ID NO: 4766906 - DNA, 19 bp, Homo sapiens
tactcatttggatataaat

SEQ ID NO: 4766907 - DNA, 14 bp, Homo sapiens
tactcctccccctc

SEQ ID NO: 4766908 - DNA, 16 bp, Homo sapiens
tactcctccccctcct

SEQ ID NO: 4766909 - DNA, 18 bp, Homo sapiens
tactcctccccctcctcc

SEQ ID NO: 4766910 - DNA, 18 bp, Homo sapiens
tactccttaaaaatgtat

SEQ ID NO: 4766911 - DNA, 18 bp, Homo sapiens
tactcgagttacagacaa

SEQ ID NO: 4766912 - DNA, 22 bp, Homo sapiens
tactcgagttacagacaaagcg

SEQ ID NO: 4766913 - DNA, 12 bp, Homo sapiens
tactctccagga

SEQ ID NO: 4766914 - DNA, 22 bp, Homo sapiens
tactcttcagaatatggacaaa

SEQ ID NO: 4766915 - DNA, 14 bp, Homo sapiens
tactgaattgttat

SEQ ID NO: 4766916 - DNA, 22 bp, Homo sapiens
tactgaattgttatgtaaacat

SEQ ID NO: 4766917 - DNA, 23 bp, Homo sapiens
tactgaattgttatgtaaacatc

SEQ ID NO: 4766918 - DNA, 21 bp, Homo sapiens
tactgatttgggctgaatgta

SEQ ID NO: 4766919 - DNA, 23 bp, Homo sapiens
tactgatttgggctgaatgtatg

SEQ ID NO: 4766920 - DNA, 16 bp, Homo sapiens
tactgcaatgtctgtc

SEQ ID NO: 4766921 - DNA, 22 bp, Homo sapiens
tactgccgaaacccttgactgt

SEQ ID NO: 4766922 - DNA, 15 bp, Homo sapiens
tactgcctttcaaag

SEQ ID NO: 4766923 - DNA, 15 bp, Homo sapiens
tactggaaataacct

SEQ ID NO: 4766924 - DNA, 21 bp, Homo sapiens
tactggctgagtgagggcata

SEQ ID NO: 4766925 - DNA, 23 bp, Homo sapiens
gtattacacaagaccagtgctta

SEQ ID NO: 4766926 - DNA, 17 bp, Homo sapiens
gtattagtaataaaaca

SEQ ID NO: 4766927 - DNA, 17 bp, Homo sapiens
gtattatcatatatgct

SEQ ID NO: 4766928 - DNA, 19 bp, Homo sapiens
gtattatttagtaaaatta

SEQ ID NO: 4766929 - DNA, 20 bp, Homo sapiens
gtattatttagtaaaattat

SEQ ID NO: 4766930 - DNA, 15 bp, Homo sapiens
gtattccaccttaaa

SEQ ID NO: 4766931 - DNA, 20 bp, Homo sapiens
gtattccaccttaaattaaa

SEQ ID NO: 4766932 - DNA, 17 bp, Homo sapiens
gtattcctgcctttgat

SEQ ID NO: 4766933 - DNA, 19 bp, Homo sapiens
gtattccttggcccagcag

SEQ ID NO: 4766934 - DNA, 17 bp, Homo sapiens
gtattctgttggccagc

SEQ ID NO: 4766935 - DNA, 23 bp, Homo sapiens
gtattgacaataagaaacagttt

SEQ ID NO: 4766936 - DNA, 23 bp, Homo sapiens
gtattgacgacctacatctgaaa

SEQ ID NO: 4766937 - DNA, 18 bp, Homo sapiens
gtattgagacactgtcaa

SEQ ID NO: 4766938 - DNA, 16 bp, Homo sapiens
gtattggcagcacagc

SEQ ID NO: 4766939 - DNA, 22 bp, Homo sapiens
gtattgttcttgtaaaactgtg

SEQ ID NO: 4766940 - DNA, 11 bp, Homo sapiens
gtatttaacat

SEQ ID NO: 4766941 - DNA, 16 bp, Homo sapiens
gtatttactgcaatgt

SEQ ID NO: 4766942 - DNA, 13 bp, Homo sapiens
gtatttacttgtt

SEQ ID NO: 4766943 - DNA, 13 bp, Homo sapiens
gtatttatattag

SEQ ID NO: 4766944 - DNA, 16 bp, Homo sapiens
gtatttatattagagt

SEQ ID NO: 4766945 - DNA, 16 bp, Homo sapiens
gtatttcggctatgtc

SEQ ID NO: 4766946 - DNA, 17 bp, Homo sapiens
gtatttcggctatgtct

SEQ ID NO: 4766947 - DNA, 20 bp, Homo sapiens
gtatttggtaacttgctgtg

SEQ ID NO: 4766948 - DNA, 15 bp, Homo sapiens
gtattttaacatagc

SEQ ID NO: 4766949 - DNA, 18 bp, Homo sapiens
gtattttcgtgcatttgt

SEQ ID NO: 4766950 - DNA, 19 bp, Homo sapiens
gtattttcgtgcatttgtg

SEQ ID NO: 4766951 - DNA, 21 bp, Homo sapiens
gtattttcttcccatttgtaa

SEQ ID NO: 4766952 - DNA, 13 bp, Homo sapiens
gtatttttagaga

SEQ ID NO: 4766953 - DNA, 16 bp, Homo sapiens
gtcaaacagtgtggct

SEQ ID NO: 4766954 - DNA, 22 bp, Homo sapiens
gtcaaacagtgtggcttaaaca

SEQ ID NO: 4766955 - DNA, 18 bp, Homo sapiens
gtcaaagtggtgagaggc

SEQ ID NO: 4766956 - DNA, 19 bp, Homo sapiens
gtcaaagtggtgagaggca

SEQ ID NO: 4766957 - DNA, 18 bp, Homo sapiens
gtcaaatccatgtgtccc

SEQ ID NO: 4766958 - DNA, 16 bp, Homo sapiens
gtcaaatggtattttt

SEQ ID NO: 4766959 - DNA, 17 bp, Homo sapiens
gtcaacctgaattaaag

SEQ ID NO: 4766960 - DNA, 15 bp, Homo sapiens
gtcaactccaaggca

SEQ ID NO: 4766961 - DNA, 16 bp, Homo sapiens
gtcaactccaaggcaa

SEQ ID NO: 4766962 - DNA, 17 bp, Homo sapiens
gtcaactccaaggcaaa

SEQ ID NO: 4766963 - DNA, 21 bp, Homo sapiens
gtcaactccaaggcaaatgtc

SEQ ID NO: 4766964 - DNA, 20 bp, Homo sapiens
gtcaagattaagttatacca

SEQ ID NO: 4766965 - DNA, 16 bp, Homo sapiens
gtcaatatatagagac

SEQ ID NO: 4766966 - DNA, 17 bp, Homo sapiens
gtcaatgctatggactg

SEQ ID NO: 4766967 - DNA, 13 bp, Homo sapiens
gtcaatgtgaaat

SEQ ID NO: 4766968 - DNA, 22 bp, Homo sapiens
gtcaattacaggaagtactgga

SEQ ID NO: 4766969 - DNA, 21 bp, Homo sapiens
gtcacaccctccccattagta

SEQ ID NO: 4766970 - DNA, 12 bp, Homo sapiens
gtcacagacccc

SEQ ID NO: 4766971 - DNA, 17 bp, Homo sapiens
gtcacagacccctgggg

SEQ ID NO: 4766972 - DNA, 22 bp, Homo sapiens
gtcacagttcttggtgactgtc

SEQ ID NO: 4766973 - DNA, 19 bp, Homo sapiens
gtcacatgacatccacatg

SEQ ID NO: 4766974 - DNA, 19 bp, Homo sapiens
gtcaccagctatctgtcat

SEQ ID NO: 4766975 - DNA, 19 bp, Homo sapiens
gtcaccttccaggacccct

SEQ ID NO: 4766976 - DNA, 15 bp, Homo sapiens
gtcaccttcctgggc

SEQ ID NO: 4766977 - DNA, 21 bp, Homo sapiens
gtcaccttcctgggcagccca

SEQ ID NO: 4766978 - DNA, 22 bp, Homo sapiens
gtcaccttcctgggcagcccag

SEQ ID NO: 4766979 - DNA, 24 bp, Homo sapiens
gtcaccttcctgggcagcccagag

SEQ ID NO: 4766980 - DNA, 13 bp, Homo sapiens
gtcacgctttcat

SEQ ID NO: 4766981 - DNA, 18 bp, Homo sapiens
gtcacgtgaccctgtgcc

SEQ ID NO: 4766982 - DNA, 19 bp, Homo sapiens
gtcactcacaaaaggctgg

SEQ ID NO: 4766983 - DNA, 12 bp, Homo sapiens
gtcactgcccac

SEQ ID NO: 4766984 - DNA, 15 bp, Homo sapiens
gtcactgcccacctg

SEQ ID NO: 4766985 - DNA, 14 bp, Homo sapiens
gtcagaatgttgtg

SEQ ID NO: 4766986 - DNA, 22 bp, Homo sapiens
gtcagcaccgtggtgtgaggcc

SEQ ID NO: 4766987 - DNA, 12 bp, Homo sapiens
gtcagccagccg

SEQ ID NO: 4766988 - DNA, 19 bp, Homo sapiens
gtcagcgattcctgccaag

SEQ ID NO: 4766989 - DNA, 22 bp, Homo sapiens
gtcagcggagaggaccccattc

SEQ ID NO: 4766990 - DNA, 15 bp, Homo sapiens
gtcaggagccagcag

SEQ ID NO: 4766991 - DNA, 17 bp, Homo sapiens
gtcaggagccagcaggg

SEQ ID NO: 4766992 - DNA, 11 bp, Homo sapiens
gtcaggccctg

SEQ ID NO: 4766993 - DNA, 15 bp, Homo sapiens
gtcagggctgtgctt

SEQ ID NO: 4766994 - DNA, 15 bp, Homo sapiens
gtcaggggccgggca

SEQ ID NO: 4766995 - DNA, 21 bp, Homo sapiens
gtcaggtgcctcccagccctg

SEQ ID NO: 4766996 - DNA, 22 bp, Homo sapiens
gtcagtgagtcagaggcagaac

SEQ ID NO: 4766997 - DNA, 15 bp, Homo sapiens
gtcagtgtgactgat

SEQ ID NO: 4766998 - DNA, 15 bp, Homo sapiens
gtcagttgggccccc

SEQ ID NO: 4766999 - DNA, 16 bp, Homo sapiens
gtcagttgggccccca

SEQ ID NO: 4767000 - DNA, 19 bp, Homo sapiens
gtcagtttgtgaagtgatt

SEQ ID NO: 4767001 - DNA, 21 bp, Homo sapiens
gtcataaagtgagaaaactgt

SEQ ID NO: 4767002 - DNA, 12 bp, Homo sapiens
gtcataccatcc

SEQ ID NO: 4767003 - DNA, 14 bp, Homo sapiens
gtcataccatccat

SEQ ID NO: 4767004 - DNA, 20 bp, Homo sapiens
gtcatattcataccttctga

SEQ ID NO: 4767005 - DNA, 14 bp, Homo sapiens
gtcatctgtaaaat

SEQ ID NO: 4767006 - DNA, 21 bp, Homo sapiens
gtcatctgtaaaatagtctca

SEQ ID NO: 4767007 - DNA, 11 bp, Homo sapiens
gtcatctgtca

SEQ ID NO: 4767008 - DNA, 14 bp, Homo sapiens
gtcatgatgaatca

SEQ ID NO: 4767009 - DNA, 16 bp, Homo sapiens
gtcatgcccagcttgg

SEQ ID NO: 4767010 - DNA, 20 bp, Homo sapiens
gtctatgtgtatatattata

SEQ ID NO: 4767011 - DNA, 21 bp, Homo sapiens
gtctatgtgtatatattatat

SEQ ID NO: 4767012 - DNA, 15 bp, Homo sapiens
gtctcaatgaaatag

SEQ ID NO: 4767013 - DNA, 20 bp, Homo sapiens
gtctcagcaaattcttgaat

SEQ ID NO: 4767014 - DNA, 14 bp, Homo sapiens
gtctccacccctca

SEQ ID NO: 4767015 - DNA, 15 bp, Homo sapiens
gtctccacccctcaa

SEQ ID NO: 4767016 - DNA, 16 bp, Homo sapiens
gtctccacccctcaag

SEQ ID NO: 4767017 - DNA, 20 bp, Homo sapiens
gtctccctacttagacccag

SEQ ID NO: 4767018 - DNA, 15 bp, Homo sapiens
gtctccctggcccca

SEQ ID NO: 4767019 - DNA, 15 bp, Homo sapiens
gtctcctcactgcca

SEQ ID NO: 4767020 - DNA, 18 bp, Homo sapiens
gtctcctcactgccacta

SEQ ID NO: 4767021 - DNA, 21 bp, Homo sapiens
gtctctctaagacaaatgcag

SEQ ID NO: 4767022 - DNA, 18 bp, Homo sapiens
gtctctcttcggtggcct

SEQ ID NO: 4767023 - DNA, 22 bp, Homo sapiens
gtctctcttcggtggccttgag

SEQ ID NO: 4767024 - DNA, 12 bp, Homo sapiens
gtctctgagaac

SEQ ID NO: 4767025 - DNA, 14 bp, Homo sapiens
gtctctgagcagtg

SEQ ID NO: 4767026 - DNA, 17 bp, Homo sapiens
gtctctttctttccaaa

SEQ ID NO: 4767027 - DNA, 10 bp, Homo sapiens
gtctgagccc

SEQ ID NO: 4767028 - DNA, 18 bp, Homo sapiens
gtctgagccctgccctca

SEQ ID NO: 4767029 - DNA, 24 bp, Homo sapiens
gtctgagccctgccctcactccac

SEQ ID NO: 4767030 - DNA, 20 bp, Homo sapiens
gtctgattgttcctccccag

SEQ ID NO: 4767031 - DNA, 20 bp, Homo sapiens
gtctgcacaccttgaatctg

SEQ ID NO: 4767032 - DNA, 21 bp, Homo sapiens
gtctgcagctattcacacaca

SEQ ID NO: 4767033 - DNA, 17 bp, Homo sapiens
gtctgccccttgacccc

SEQ ID NO: 4767034 - DNA, 19 bp, Homo sapiens
gtctgccccttgaccccac

SEQ ID NO: 4767035 - DNA, 15 bp, Homo sapiens
gtctgctcctgggaa

SEQ ID NO: 4767036 - DNA, 14 bp, Homo sapiens
gtctgctgcctcca

SEQ ID NO: 4767037 - DNA, 16 bp, Homo sapiens
gtctgctgcctccaag

SEQ ID NO: 4767038 - DNA, 16 bp, Homo sapiens
gtctggcccagccatg

SEQ ID NO: 4767039 - DNA, 18 bp, Homo sapiens
gtctggcccagccatggc

SEQ ID NO: 4767040 - DNA, 21 bp, Homo sapiens
gtctggcccagccatggctgg

SEQ ID NO: 4767041 - DNA, 14 bp, Homo sapiens
gtctggctgtggcc

SEQ ID NO: 4767042 - DNA, 19 bp, Homo sapiens
gtctggctgtggcccctcc

SEQ ID NO: 4767043 - DNA, 19 bp, Homo sapiens
gtctgtaaatctaacatta

SEQ ID NO: 4767044 - DNA, 19 bp, Homo sapiens
gtctgtccctaaacatagt

SEQ ID NO: 4767045 - DNA, 17 bp, Homo sapiens
gtctgtcctgcgcctgc

SEQ ID NO: 4767046 - DNA, 11 bp, Homo sapiens
gtctgtctctc

SEQ ID NO: 4767047 - DNA, 24 bp, Homo sapiens
gtctgtctctcttttgctctctca

SEQ ID NO: 4767048 - DNA, 21 bp, Homo sapiens
gtctgtgaaagtctcctgtat

SEQ ID NO: 4767049 - DNA, 17 bp, Homo sapiens
gtctgtgaataaagcca

SEQ ID NO: 4767050 - DNA, 20 bp, Homo sapiens
gtctgtgcattgtggctgtc

SEQ ID NO: 4767051 - DNA, 16 bp, Homo sapiens
gtctgtggagcgtcct

SEQ ID NO: 4767052 - DNA, 21 bp, Homo sapiens
gtctgtgtatacatatgtatg

SEQ ID NO: 4767053 - DNA, 16 bp, Homo sapiens
gtctgtgtgtgacacc

SEQ ID NO: 4767054 - DNA, 22 bp, Homo sapiens
gtctgtgtgtgacaccaccact

SEQ ID NO: 4767055 - DNA, 15 bp, Homo sapiens
gtctgtgttctcaac

SEQ ID NO: 4767056 - DNA, 17 bp, Homo sapiens
gtcttaactaatgtaaa

SEQ ID NO: 4767057 - DNA, 18 bp, Homo sapiens
gtcttaactaatgtaaat

SEQ ID NO: 4767058 - DNA, 18 bp, Homo sapiens
gtcttactcaagatactg

SEQ ID NO: 4767059 - DNA, 20 bp, Homo sapiens
gtcttcaaattgtcttttgt

SEQ ID NO: 4767060 - DNA, 15 bp, Homo sapiens
gtcttcaaccctgcc

SEQ ID NO: 4767061 - DNA, 22 bp, Homo sapiens
gtcttgagtgggccccctctct

SEQ ID NO: 4767062 - DNA, 17 bp, Homo sapiens
gtcttgagtttcatttt

SEQ ID NO: 4767063 - DNA, 20 bp, Homo sapiens
gtcttgagtttcatttttca

SEQ ID NO: 4767064 - DNA, 15 bp, Homo sapiens
gtcttggagaggagg

SEQ ID NO: 4767065 - DNA, 14 bp, Homo sapiens
gtcttgtattttct

SEQ ID NO: 4767066 - DNA, 14 bp, Homo sapiens
gtcttgttgttcat

SEQ ID NO: 4767067 - DNA, 18 bp, Homo sapiens
gtcttgtttaatatttgt

SEQ ID NO: 4767068 - DNA, 13 bp, Homo sapiens
gtctttatgattt

SEQ ID NO: 4767069 - DNA, 19 bp, Homo sapiens
gtctttgctgtttatatat

SEQ ID NO: 4767070 - DNA, 17 bp, Homo sapiens
gtctttggttcctcatg

SEQ ID NO: 4767071 - DNA, 12 bp, Homo sapiens
gtctttgtgttt

SEQ ID NO: 4767072 - DNA, 14 bp, Homo sapiens
gtcttttgttctct

SEQ ID NO: 4767073 - DNA, 21 bp, Homo sapiens
gtcttttttttcttcacctca

SEQ ID NO: 4767074 - DNA, 15 bp, Homo sapiens
gtgaaaagtaaaaca

SEQ ID NO: 4767075 - DNA, 12 bp, Homo sapiens
gtgaaacagtgt

SEQ ID NO: 4767076 - DNA, 12 bp, Homo sapiens
gtgaaactgaga

SEQ ID NO: 4767077 - DNA, 18 bp, Homo sapiens
gtgaaagagtaaaaccaa

SEQ ID NO: 4767078 - DNA, 19 bp, Homo sapiens
gtgaaattagtattttgag

SEQ ID NO: 4767079 - DNA, 23 bp, Homo sapiens
gtgaaccaagctataaaagccca

SEQ ID NO: 4767080 - DNA, 15 bp, Homo sapiens
gtgaagcctttatct

SEQ ID NO: 4767081 - DNA, 20 bp, Homo sapiens
gtgaattttaaaatgcaaat

SEQ ID NO: 4767082 - DNA, 20 bp, Homo sapiens
gtgacacagctgagctggcc

SEQ ID NO: 4767083 - DNA, 15 bp, Homo sapiens
gtgacaccaccactg

SEQ ID NO: 4767084 - DNA, 16 bp, Homo sapiens
gtgacaccaccactgt

SEQ ID NO: 4767085 - DNA, 18 bp, Homo sapiens
gtgacaccaccactgtgt

SEQ ID NO: 4767086 - DNA, 17 bp, Homo sapiens
gtgacaggaaagccctc

SEQ ID NO: 4767087 - DNA, 13 bp, Homo sapiens
gtgacaggcagtg

SEQ ID NO: 4767088 - DNA, 23 bp, Homo sapiens
gtgacccttcccaatcagcactg

SEQ ID NO: 4767089 - DNA, 15 bp, Homo sapiens
gtgaccggcccgcca

SEQ ID NO: 4767090 - DNA, 19 bp, Homo sapiens
gtgaccggcccgccacctt

SEQ ID NO: 4767091 - DNA, 15 bp, Homo sapiens
gtgacctgacacctg

SEQ ID NO: 4767092 - DNA, 19 bp, Homo sapiens
gtgacctttttaatccagg

SEQ ID NO: 4767093 - DNA, 17 bp, Homo sapiens
gtgactctggctgccaa

SEQ ID NO: 4767094 - DNA, 17 bp, Homo sapiens
gtgactgatctctcgtg

SEQ ID NO: 4767095 - DNA, 12 bp, Homo sapiens
gtgactgtccca

SEQ ID NO: 4767096 - DNA, 21 bp, Homo sapiens
gtgactgtcccaccgggagcc

SEQ ID NO: 4767097 - DNA, 22 bp, Homo sapiens
gtgactgtcccaccgggagcct

SEQ ID NO: 4767098 - DNA, 15 bp, Homo sapiens
gtgagaactgtgaat

SEQ ID NO: 4767099 - DNA, 22 bp, Homo sapiens
gtgagaatcgacctcactgtca

SEQ ID NO: 4767100 - DNA, 21 bp, Homo sapiens
gtgagaattactgtttgaaac

SEQ ID NO: 4767101 - DNA, 16 bp, Homo sapiens
gtgagataaatatcat

SEQ ID NO: 4767102 - DNA, 21 bp, Homo sapiens
gtgagatggtgccccctgggg

SEQ ID NO: 4767103 - DNA, 13 bp, Homo sapiens
gtgagattctaaa

SEQ ID NO: 4767104 - DNA, 23 bp, Homo sapiens
gtgagatttagggttctatattt

SEQ ID NO: 4767105 - DNA, 17 bp, Homo sapiens
gtgagcgccccgccccc

SEQ ID NO: 4767106 - DNA, 12 bp, Homo sapiens
gtgagctgggca

SEQ ID NO: 4767107 - DNA, 14 bp, Homo sapiens
gtgaggacagggcc

SEQ ID NO: 4767108 - DNA, 17 bp, Homo sapiens
gtgaggccagagacaca

SEQ ID NO: 4767109 - DNA, 15 bp, Homo sapiens
gtgaggcccccggag

SEQ ID NO: 4767110 - DNA, 20 bp, Homo sapiens
gtgaggcccccggaggcgcc

SEQ ID NO: 4767111 - DNA, 19 bp, Homo sapiens
gtgaggcgtgggatccaga

SEQ ID NO: 4767112 - DNA, 21 bp, Homo sapiens
gtgaggcgtgggatccagaga

SEQ ID NO: 4767113 - DNA, 17 bp, Homo sapiens
gtgaggtgggcctttga

SEQ ID NO: 4767114 - DNA, 20 bp, Homo sapiens
gtgagtcctggcatgggaat

SEQ ID NO: 4767115 - DNA, 18 bp, Homo sapiens
gtgagtctgtcctttccc

SEQ ID NO: 4767116 - DNA, 14 bp, Homo sapiens
gtgagtgtatgtat

SEQ ID NO: 4767117 - DNA, 15 bp, Homo sapiens
gtgagtgtatgtata

SEQ ID NO: 4767118 - DNA, 17 bp, Homo sapiens
gtgagtgtatgtataca

SEQ ID NO: 4767119 - DNA, 17 bp, Homo sapiens
gtgataattgtaaaggt

SEQ ID NO: 4767120 - DNA, 22 bp, Homo sapiens
gtgatcccccaaacagcatgtg

SEQ ID NO: 4767121 - DNA, 14 bp, Homo sapiens
gtgatctgttgtaa

SEQ ID NO: 4767122 - DNA, 23 bp, Homo sapiens
gtgatctgttgtaatatcagtta

SEQ ID NO: 4767123 - DNA, 23 bp, Homo sapiens
gtgatgaatttaccatcaaacaa

SEQ ID NO: 4767124 - DNA, 20 bp, Homo sapiens
gtgatgggcaaggggccagg

SEQ ID NO: 4767125 - DNA, 22 bp, Homo sapiens
gtgatgggggcatgggtggagg

SEQ ID NO: 4767126 - DNA, 14 bp, Homo sapiens
gtgatgtgatttat

SEQ ID NO: 4767127 - DNA, 20 bp, Homo sapiens
gtgatgtgatttatgcattt

SEQ ID NO: 4767128 - DNA, 21 bp, Homo sapiens
gtgattatgaaatgccagact

SEQ ID NO: 4767129 - DNA, 22 bp, Homo sapiens
gtgattccttcttgctcagtcc

SEQ ID NO: 4767130 - DNA, 20 bp, Homo sapiens
gtgattgacattttgtagct

SEQ ID NO: 4767131 - DNA, 18 bp, Homo sapiens
ggcctcctagcctctccg

SEQ ID NO: 4767132 - DNA, 21 bp, Homo sapiens
ggcctcctcttcaccccggca

SEQ ID NO: 4767133 - DNA, 12 bp, Homo sapiens
ggcctcggcctg

SEQ ID NO: 4767134 - DNA, 16 bp, Homo sapiens
ggcctcggcctggctt

SEQ ID NO: 4767135 - DNA, 22 bp, Homo sapiens
ggcctctctggaagagggaggg

SEQ ID NO: 4767136 - DNA, 14 bp, Homo sapiens
ggcctctgcccctc

SEQ ID NO: 4767137 - DNA, 12 bp, Homo sapiens
ggcctctgtgcc

SEQ ID NO: 4767138 - DNA, 20 bp, Homo sapiens
ggcctgagggaagcccaccc

SEQ ID NO: 4767139 - DNA, 21 bp, Homo sapiens
ggcctgagggaagcccacccg

SEQ ID NO: 4767140 - DNA, 23 bp, Homo sapiens
ggcctgagggaagcccacccgcc

SEQ ID NO: 4767141 - DNA, 19 bp, Homo sapiens
ggcctgcagaccctgccag

SEQ ID NO: 4767142 - DNA, 22 bp, Homo sapiens
ggcctgcagaccctgccagggg

SEQ ID NO: 4767143 - DNA, 13 bp, Homo sapiens
ggcctgcagccca

SEQ ID NO: 4767144 - DNA, 12 bp, Homo sapiens
ggcctgcccccc

SEQ ID NO: 4767145 - DNA, 18 bp, Homo sapiens
ggcctgccccccttccca

SEQ ID NO: 4767146 - DNA, 21 bp, Homo sapiens
ggcctgccccccttcccaccc

SEQ ID NO: 4767147 - DNA, 23 bp, Homo sapiens
ggcctgccccccttcccacccct

SEQ ID NO: 4767148 - DNA, 15 bp, Homo sapiens
ggcctggcagggagg

SEQ ID NO: 4767149 - DNA, 13 bp, Homo sapiens
ggcctggcccagc

SEQ ID NO: 4767150 - DNA, 11 bp, Homo sapiens
ggcctggcccc

SEQ ID NO: 4767151 - DNA, 23 bp, Homo sapiens
ggcctggccccctcgcgcccctg

SEQ ID NO: 4767152 - DNA, 14 bp, Homo sapiens
ggcctggccctgcc

SEQ ID NO: 4767153 - DNA, 13 bp, Homo sapiens
ggcctggcctggc

SEQ ID NO: 4767154 - DNA, 14 bp, Homo sapiens
ggcctggcctggcc

SEQ ID NO: 4767155 - DNA, 16 bp, Homo sapiens
ggcctggcctggccct

SEQ ID NO: 4767156 - DNA, 17 bp, Homo sapiens
ggcctggcctggccctg

SEQ ID NO: 4767157 - DNA, 17 bp, Homo sapiens
ggcctggctctggagcc

SEQ ID NO: 4767158 - DNA, 18 bp, Homo sapiens
ggcctggctctggagccc

SEQ ID NO: 4767159 - DNA, 22 bp, Homo sapiens
ggcctgggagatgcagctggat

SEQ ID NO: 4767160 - DNA, 15 bp, Homo sapiens
ggcctgggctgtgag

SEQ ID NO: 4767161 - DNA, 21 bp, Homo sapiens
ggcctgggctgtgaggacagg

SEQ ID NO: 4767162 - DNA, 16 bp, Homo sapiens
ggcctgggtccccctc

SEQ ID NO: 4767163 - DNA, 21 bp, Homo sapiens
ggcctgggtccccctcctgca

SEQ ID NO: 4767164 - DNA, 22 bp, Homo sapiens
ggcctgggtccccctcctgcac

SEQ ID NO: 4767165 - DNA, 24 bp, Homo sapiens
ggcctgggtcctcggccctgtagc

SEQ ID NO: 4767166 - DNA, 15 bp, Homo sapiens
ggcctggtaggtctg

SEQ ID NO: 4767167 - DNA, 23 bp, Homo sapiens
ggccttccctttacagctctcct

SEQ ID NO: 4767168 - DNA, 22 bp, Homo sapiens
ggccttcctcctctcaaacctg

SEQ ID NO: 4767169 - DNA, 15 bp, Homo sapiens
ggccttgagtctctg

SEQ ID NO: 4767170 - DNA, 12 bp, Homo sapiens
ggcgagtccaga

SEQ ID NO: 4767171 - DNA, 22 bp, Homo sapiens
ggcgcaggaaccgaggactcca

SEQ ID NO: 4767172 - DNA, 12 bp, Homo sapiens
ggcgcccacctg

SEQ ID NO: 4767173 - DNA, 16 bp, Homo sapiens
ggcgcccacctgccca

SEQ ID NO: 4767174 - DNA, 15 bp, Homo sapiens
ggcgccccggacgcc

SEQ ID NO: 4767175 - DNA, 14 bp, Homo sapiens
ggcgccgcctcgcc

SEQ ID NO: 4767176 - DNA, 17 bp, Homo sapiens
ggcgcctgcgctcctct

SEQ ID NO: 4767177 - DNA, 15 bp, Homo sapiens
ggcgcctgtcgggcc

SEQ ID NO: 4767178 - DNA, 21 bp, Homo sapiens
ggcgcgcgcccccaggacccc

SEQ ID NO: 4767179 - DNA, 21 bp, Homo sapiens
ggcgctccggcagaggcaggg

SEQ ID NO: 4767180 - DNA, 17 bp, Homo sapiens
ggcgctcctcccagctg

SEQ ID NO: 4767181 - DNA, 13 bp, Homo sapiens
ggcgctgccccca

SEQ ID NO: 4767182 - DNA, 16 bp, Homo sapiens
ggcgctgcccccacag

SEQ ID NO: 4767183 - DNA, 23 bp, Homo sapiens
ggcgctgcccctggcagcccctg

SEQ ID NO: 4767184 - DNA, 21 bp, Homo sapiens
ggcggaggggcttggagcaga

SEQ ID NO: 4767185 - DNA, 16 bp, Homo sapiens
ggcggcatccgagccc

SEQ ID NO: 4767186 - DNA, 22 bp, Homo sapiens
ggcggcggggcctgggtccccc

SEQ ID NO: 4767187 - DNA, 12 bp, Homo sapiens
ggcggctctggg

SEQ ID NO: 4767188 - DNA, 13 bp, Homo sapiens
ggcggctctggga

SEQ ID NO: 4767189 - DNA, 12 bp, Homo sapiens
ggcgggcagccc

SEQ ID NO: 4767190 - DNA, 21 bp, Homo sapiens
ggcggggctgtgcgggcgccc

SEQ ID NO: 4767191 - DNA, 23 bp, Homo sapiens
ggcgtccctgagggcccttccca

SEQ ID NO: 4767192 - DNA, 17 bp, Homo sapiens
ggcgtgggatccagaga

SEQ ID NO: 4767193 - DNA, 18 bp, Homo sapiens
ggcgtgggatccagagag

SEQ ID NO: 4767194 - DNA, 13 bp, Homo sapiens
ggctaactggccc

SEQ ID NO: 4767195 - DNA, 15 bp, Homo sapiens
ggctaactggcccca

SEQ ID NO: 4767196 - DNA, 21 bp, Homo sapiens
ggctacagttgatatttaaaa

SEQ ID NO: 4767197 - DNA, 15 bp, Homo sapiens
ggctagtctgtgcct

SEQ ID NO: 4767198 - DNA, 21 bp, Homo sapiens
ggctatgtctcatgttttata

SEQ ID NO: 4767199 - DNA, 20 bp, Homo sapiens
ggctcacaccggcactgtgc

SEQ ID NO: 4767200 - DNA, 19 bp, Homo sapiens
ggctcacagccaccacctg

SEQ ID NO: 4767201 - DNA, 21 bp, Homo sapiens
ggctcacagccaccacctgga

SEQ ID NO: 4767202 - DNA, 11 bp, Homo sapiens
ggctccatgct

SEQ ID NO: 4767203 - DNA, 15 bp, Homo sapiens
ggctcccagcagagg

SEQ ID NO: 4767204 - DNA, 19 bp, Homo sapiens
ggctccccaagacttgacg

SEQ ID NO: 4767205 - DNA, 19 bp, Homo sapiens
ggctccctccctccctgct

SEQ ID NO: 4767206 - DNA, 23 bp, Homo sapiens
ggctcctgtgtctggtccacaca

SEQ ID NO: 4767207 - DNA, 17 bp, Homo sapiens
ggctctcaggccagctg

SEQ ID NO: 4767208 - DNA, 19 bp, Homo sapiens
ggctctcaggccagctgct

SEQ ID NO: 4767209 - DNA, 21 bp, Homo sapiens
ggctctgaatctctcaaaatg

SEQ ID NO: 4767210 - DNA, 13 bp, Homo sapiens
ggctcttcctgga

SEQ ID NO: 4767211 - DNA, 23 bp, Homo sapiens
ggctgacctgcctctcacacaca

SEQ ID NO: 4767212 - DNA, 12 bp, Homo sapiens
ggctgagacaca

SEQ ID NO: 4767213 - DNA, 12 bp, Homo sapiens
ggctgagcccct

SEQ ID NO: 4767214 - DNA, 19 bp, Homo sapiens
ggctgaggacggggcagag

SEQ ID NO: 4767215 - DNA, 21 bp, Homo sapiens
ggctgaggacggggcagagct

SEQ ID NO: 4767216 - DNA, 17 bp, Homo sapiens
ggctgagtgagggcata

SEQ ID NO: 4767217 - DNA, 20 bp, Homo sapiens
ggctgatgtcttcttggggg

SEQ ID NO: 4767218 - DNA, 19 bp, Homo sapiens
ggctgattggaaaataata

SEQ ID NO: 4767219 - DNA, 23 bp, Homo sapiens
ggctgattggaaaataataaaag

SEQ ID NO: 4767220 - DNA, 14 bp, Homo sapiens
ggctgcaaaatgaa

SEQ ID NO: 4767221 - DNA, 18 bp, Homo sapiens
ggctgcagccccctgctt

SEQ ID NO: 4767222 - DNA, 21 bp, Homo sapiens
ggctgcagccccctgcttctc

SEQ ID NO: 4767223 - DNA, 12 bp, Homo sapiens
ggctgcagggac

SEQ ID NO: 4767224 - DNA, 16 bp, Homo sapiens
ggctgcatcctcagcc

SEQ ID NO: 4767225 - DNA, 23 bp, Homo sapiens
ggctgcatcctcagccccagggc

SEQ ID NO: 4767226 - DNA, 20 bp, Homo sapiens
ggctgcatgatttttgccct

SEQ ID NO: 4767227 - DNA, 22 bp, Homo sapiens
ggctgcatgatttttgccctgc

SEQ ID NO: 4767228 - DNA, 20 bp, Homo sapiens
ggctgccgctgctctcccag

SEQ ID NO: 4767229 - DNA, 17 bp, Homo sapiens
ggctgcgcctgcccgcc

SEQ ID NO: 4767230 - DNA, 16 bp, Homo sapiens
ggctgctaagtggaag

SEQ ID NO: 4767231 - DNA, 22 bp, Homo sapiens
ggctgctaagtggaagacagag

SEQ ID NO: 4767232 - DNA, 15 bp, Homo sapiens
ggctgctctccatct

SEQ ID NO: 4767233 - DNA, 19 bp, Homo sapiens
ggctgctgaaaaccatctg

SEQ ID NO: 4767234 - DNA, 19 bp, Homo sapiens
ggctgctgcactgccctcc

SEQ ID NO: 4767235 - DNA, 17 bp, Homo sapiens
ggctgctgcagtcagca

SEQ ID NO: 4767236 - DNA, 13 bp, Homo sapiens
ggggcagagctga

SEQ ID NO: 4767237 - DNA, 19 bp, Homo sapiens
ggggcaggcctcccaagct

SEQ ID NO: 4767238 - DNA, 20 bp, Homo sapiens
ggggcaggcctcccaagctg

SEQ ID NO: 4767239 - DNA, 19 bp, Homo sapiens
ggggccagaccacgcccct

SEQ ID NO: 4767240 - DNA, 17 bp, Homo sapiens
ggggcccatggccccag

SEQ ID NO: 4767241 - DNA, 11 bp, Homo sapiens
ggggccctggg

SEQ ID NO: 4767242 - DNA, 23 bp, Homo sapiens
ggggcctgcggggttccctgcgc

SEQ ID NO: 4767243 - DNA, 11 bp, Homo sapiens
ggggcctggca

SEQ ID NO: 4767244 - DNA, 12 bp, Homo sapiens
ggggcctgggct

SEQ ID NO: 4767245 - DNA, 15 bp, Homo sapiens
ggggcctgggctgtg

SEQ ID NO: 4767246 - DNA, 17 bp, Homo sapiens
ggggcctgggtccccct

SEQ ID NO: 4767247 - DNA, 21 bp, Homo sapiens
ggggcgcgcgcccccaggacc

SEQ ID NO: 4767248 - DNA, 16 bp, Homo sapiens
ggggcgctcctcccag

SEQ ID NO: 4767249 - DNA, 21 bp, Homo sapiens
ggggcggcatccgagcccctg

SEQ ID NO: 4767250 - DNA, 17 bp, Homo sapiens
ggggctaacgggcgcct

SEQ ID NO: 4767251 - DNA, 17 bp, Homo sapiens
ggggctaactggcccca

SEQ ID NO: 4767252 - DNA, 23 bp, Homo sapiens
ggggctctagggttgctggagcc

SEQ ID NO: 4767253 - DNA, 19 bp, Homo sapiens
ggggctgcagccccctgct

SEQ ID NO: 4767254 - DNA, 11 bp, Homo sapiens
ggggctggccc

SEQ ID NO: 4767255 - DNA, 14 bp, Homo sapiens
ggggctggccctgc

SEQ ID NO: 4767256 - DNA, 19 bp, Homo sapiens
ggggctggccctgccctcc

SEQ ID NO: 4767257 - DNA, 20 bp, Homo sapiens
ggggctggccctgccctccc

SEQ ID NO: 4767258 - DNA, 21 bp, Homo sapiens
ggggctggccctgccctcccc

SEQ ID NO: 4767259 - DNA, 17 bp, Homo sapiens
ggggctgggcagaggaa

SEQ ID NO: 4767260 - DNA, 13 bp, Homo sapiens
ggggcttggaagg

SEQ ID NO: 4767261 - DNA, 19 bp, Homo sapiens
gggggacgcccagccccca

SEQ ID NO: 4767262 - DNA, 19 bp, Homo sapiens
ggaggtggagcttgcagtg

SEQ ID NO: 4767263 - DNA, 20 bp, Homo sapiens
ggaggtggagcttgcagtga

SEQ ID NO: 4767264 - DNA, 22 bp, Homo sapiens
ggaggtggggagggcctctgga

SEQ ID NO: 4767265 - DNA, 22 bp, Homo sapiens
ggaggtgtggagtggaggggtc

SEQ ID NO: 4767266 - DNA, 15 bp, Homo sapiens
ggagtagagtcagga

SEQ ID NO: 4767267 - DNA, 17 bp, Homo sapiens
ggagtcaagtgtgcctg

SEQ ID NO: 4767268 - DNA, 19 bp, Homo sapiens
ggagtcaagtgtgcctgct

SEQ ID NO: 4767269 - DNA, 14 bp, Homo sapiens
ggagtccactttcc

SEQ ID NO: 4767270 - DNA, 15 bp, Homo sapiens
ggagtccactttcct

SEQ ID NO: 4767271 - DNA, 18 bp, Homo sapiens
ggagtccactttcctctc

SEQ ID NO: 4767272 - DNA, 11 bp, Homo sapiens
ggagtccctcc

SEQ ID NO: 4767273 - DNA, 16 bp, Homo sapiens
ggagtctgaaggagag

SEQ ID NO: 4767274 - DNA, 18 bp, Homo sapiens
ggagtctgaaggagagga

SEQ ID NO: 4767275 - DNA, 20 bp, Homo sapiens
ggagtctgaaggagaggagt

SEQ ID NO: 4767276 - DNA, 18 bp, Homo sapiens
ggagtctgattgcaggaa

SEQ ID NO: 4767277 - DNA, 17 bp, Homo sapiens
ggagtggaggggtcagc

SEQ ID NO: 4767278 - DNA, 13 bp, Homo sapiens
ggagtgggctctc

SEQ ID NO: 4767279 - DNA, 17 bp, Homo sapiens
ggagtgggctctctgga

SEQ ID NO: 4767280 - DNA, 23 bp, Homo sapiens
ggagtgggctctctggacctgac

SEQ ID NO: 4767281 - DNA, 21 bp, Homo sapiens
ggagtgtgcctctctctccca

SEQ ID NO: 4767282 - DNA, 23 bp, Homo sapiens
ggataaataataaaggttctatg

SEQ ID NO: 4767283 - DNA, 21 bp, Homo sapiens
ggataccttccatctcaacct

SEQ ID NO: 4767284 - DNA, 17 bp, Homo sapiens
ggataggagcttccaga

SEQ ID NO: 4767285 - DNA, 18 bp, Homo sapiens
ggatcaagtattactaaa

SEQ ID NO: 4767286 - DNA, 17 bp, Homo sapiens
ggatcacttgagcccag

SEQ ID NO: 4767287 - DNA, 14 bp, Homo sapiens
ggatccagagacct

SEQ ID NO: 4767288 - DNA, 16 bp, Homo sapiens
ggatcctggcctgaga

SEQ ID NO: 4767289 - DNA, 17 bp, Homo sapiens
ggatcctggcctgagaa

SEQ ID NO: 4767290 - DNA, 15 bp, Homo sapiens
ggatcggcctcctct

SEQ ID NO: 4767291 - DNA, 13 bp, Homo sapiens
ggatctccaggcc

SEQ ID NO: 4767292 - DNA, 17 bp, Homo sapiens
ggatctgctccatgcag

SEQ ID NO: 4767293 - DNA, 19 bp, Homo sapiens
ggatctgctccatgcagat

SEQ ID NO: 4767294 - DNA, 11 bp, Homo sapiens
ggatctgtccg

SEQ ID NO: 4767295 - DNA, 15 bp, Homo sapiens
ggatgattcttttcc

SEQ ID NO: 4767296 - DNA, 14 bp, Homo sapiens
ggatgatttaacat

SEQ ID NO: 4767297 - DNA, 16 bp, Homo sapiens
ggatgcatgcagggcc

SEQ ID NO: 4767298 - DNA, 16 bp, Homo sapiens
ggatggagaggcggcc

SEQ ID NO: 4767299 - DNA, 18 bp, Homo sapiens
ggatggagaggcggcctc

SEQ ID NO: 4767300 - DNA, 17 bp, Homo sapiens
ggatggggcggcctgca

SEQ ID NO: 4767301 - DNA, 17 bp, Homo sapiens
ggatgggggatgggcca

SEQ ID NO: 4767302 - DNA, 19 bp, Homo sapiens
ggatgggggatgggccagg

SEQ ID NO: 4767303 - DNA, 18 bp, Homo sapiens
ggatgtgcatctggccta

SEQ ID NO: 4767304 - DNA, 21 bp, Homo sapiens
ggatgttcaacttaatgaaga

SEQ ID NO: 4767305 - DNA, 11 bp, Homo sapiens
ggattcaaatt

SEQ ID NO: 4767306 - DNA, 15 bp, Homo sapiens
ggattcatgtccaga

SEQ ID NO: 4767307 - DNA, 19 bp, Homo sapiens
ggattcttttttcaatgta

SEQ ID NO: 4767308 - DNA, 18 bp, Homo sapiens
ggattggtaccagagcct

SEQ ID NO: 4767309 - DNA, 15 bp, Homo sapiens
ggatttattctcaga

SEQ ID NO: 4767310 - DNA, 21 bp, Homo sapiens
ggcaaaaatttgacattgtca

SEQ ID NO: 4767311 - DNA, 23 bp, Homo sapiens
ggcaaaatgaactaactgccatg

SEQ ID NO: 4767312 - DNA, 17 bp, Homo sapiens
ggcaaaccaggctgcag

SEQ ID NO: 4767313 - DNA, 19 bp, Homo sapiens
ggcaaaccaggctgcaggt

SEQ ID NO: 4767314 - DNA, 12 bp, Homo sapiens
ggcaaaggcccc

SEQ ID NO: 4767315 - DNA, 18 bp, Homo sapiens
ggcaaatgacatgcactg

SEQ ID NO: 4767316 - DNA, 21 bp, Homo sapiens
ggcaaatgacatgcactgacc

SEQ ID NO: 4767317 - DNA, 20 bp, Homo sapiens
ggcaacaaaggatggctctg

SEQ ID NO: 4767318 - DNA, 15 bp, Homo sapiens
ggcaacgttcatgtt

SEQ ID NO: 4767319 - DNA, 14 bp, Homo sapiens
ggcaactgtggaag

SEQ ID NO: 4767320 - DNA, 17 bp, Homo sapiens
ggcaagacttttctttg

SEQ ID NO: 4767321 - DNA, 18 bp, Homo sapiens
ggcaagagctcaggagaa

SEQ ID NO: 4767322 - DNA, 17 bp, Homo sapiens
ggcaagatagctccttc

SEQ ID NO: 4767323 - DNA, 17 bp, Homo sapiens
ggcaagctcatagcaca

SEQ ID NO: 4767324 - DNA, 18 bp, Homo sapiens
ggcaagctcatagcacat

SEQ ID NO: 4767325 - DNA, 14 bp, Homo sapiens
ggcaaggggccagg

SEQ ID NO: 4767326 - DNA, 15 bp, Homo sapiens
ggcaaggggccagga

SEQ ID NO: 4767327 - DNA, 22 bp, Homo sapiens
ggcaaggggcgcgcgcccccag

SEQ ID NO: 4767328 - DNA, 13 bp, Homo sapiens
ggcacacagcagc

SEQ ID NO: 4767329 - DNA, 14 bp, Homo sapiens
ggcacacagcagcc

SEQ ID NO: 4767330 - DNA, 18 bp, Homo sapiens
ggcacacagcagcccccc

SEQ ID NO: 4767331 - DNA, 24 bp, Homo sapiens
ggcacagaaaatggaagacagctc

SEQ ID NO: 4767332 - DNA, 13 bp, Homo sapiens
ggcacagccagaa

SEQ ID NO: 4767333 - DNA, 16 bp, Homo sapiens
ggcacatagcataggc

SEQ ID NO: 4767334 - DNA, 15 bp, Homo sapiens
ggcaccaaagatgca

SEQ ID NO: 4767335 - DNA, 18 bp, Homo sapiens
ggcaccaaagatgcagcc

SEQ ID NO: 4767336 - DNA, 17 bp, Homo sapiens
ggcaccatgctgggccg

SEQ ID NO: 4767337 - DNA, 12 bp, Homo sapiens
ggcacccactgg

SEQ ID NO: 4767338 - DNA, 17 bp, Homo sapiens
ggcaccggacgctggag

SEQ ID NO: 4767339 - DNA, 24 bp, Homo sapiens
ggcaccggacgctggagaccctgc

SEQ ID NO: 4767340 - DNA, 13 bp, Homo sapiens
ggcacggaggctc

SEQ ID NO: 4767341 - DNA, 18 bp, Homo sapiens
ggcacgggagagcgccac

SEQ ID NO: 4767342 - DNA, 16 bp, Homo sapiens
ggcacgtaaggtctca

SEQ ID NO: 4767343 - DNA, 21 bp, Homo sapiens
ggcactgtcatgcccagcttg

SEQ ID NO: 4767344 - DNA, 12 bp, Homo sapiens
ggcagaaggaag

SEQ ID NO: 4767345 - DNA, 15 bp, Homo sapiens
ggcagaatggtgggc

SEQ ID NO: 4767346 - DNA, 16 bp, Homo sapiens
ggcagaatggtgggct

SEQ ID NO: 4767347 - DNA, 20 bp, Homo sapiens
ggcagagaagaaagaacgga

SEQ ID NO: 4767348 - DNA, 19 bp, Homo sapiens
ggcagagattgggggggct

SEQ ID NO: 4767349 - DNA, 24 bp, Homo sapiens
ggcagagccatccaccctgaggag

SEQ ID NO: 4767350 - DNA, 22 bp, Homo sapiens
ggcagagcccgcccacctgggc

SEQ ID NO: 4767351 - DNA, 22 bp, Homo sapiens
ggcagagctgagtcggctgggc

SEQ ID NO: 4767352 - DNA, 12 bp, Homo sapiens
ggcagaggcagg

SEQ ID NO: 4767353 - DNA, 22 bp, Homo sapiens
ggcagagggatgaaatgccaag

SEQ ID NO: 4767354 - DNA, 21 bp, Homo sapiens
ggcagagttgaagacagagct

SEQ ID NO: 4767355 - DNA, 16 bp, Homo sapiens
ggcagcaacaggacca

SEQ ID NO: 4767356 - DNA, 22 bp, Homo sapiens
ggcagcaacaggaccaggagcc

SEQ ID NO: 4767357 - DNA, 23 bp, Homo sapiens
ggcagcaacaggaccaggagcca

SEQ ID NO: 4767358 - DNA, 22 bp, Homo sapiens
ggcagcacagctactcagatct

SEQ ID NO: 4767359 - DNA, 12 bp, Homo sapiens
ggcagcaccctc

SEQ ID NO: 4767360 - DNA, 14 bp, Homo sapiens
ggcagcagcagcag

SEQ ID NO: 4767361 - DNA, 23 bp, Homo sapiens
ggcagcccagagagaccctgcca

SEQ ID NO: 4767362 - DNA, 11 bp, Homo sapiens
ggcagcccctg

SEQ ID NO: 4767363 - DNA, 18 bp, Homo sapiens
ggcagcccctgctggacc

SEQ ID NO: 4767364 - DNA, 22 bp, Homo sapiens
ggcagcccctgttctggcagag

SEQ ID NO: 4767365 - DNA, 11 bp, Homo sapiens
ggcagcctgtg

SEQ ID NO: 4767366 - DNA, 22 bp, Homo sapiens
ggcagcgcccagcctggcccca

SEQ ID NO: 4767367 - DNA, 16 bp, Homo sapiens
ggcagctggggggctg

SEQ ID NO: 4767368 - DNA, 21 bp, Homo sapiens
ggcagctggggggctgtcctg

SEQ ID NO: 4767369 - DNA, 10 bp, Homo sapiens
ggcaggaagt

SEQ ID NO: 4767370 - DNA, 15 bp, Homo sapiens
ggcaggaagtcagga

SEQ ID NO: 4767371 - DNA, 12 bp, Homo sapiens
ggcaggagctca

SEQ ID NO: 4767372 - DNA, 14 bp, Homo sapiens
ggcaggagctcaca

SEQ ID NO: 4767373 - DNA, 20 bp, Homo sapiens
ggcaggagtgggctctgagc

SEQ ID NO: 4767374 - DNA, 18 bp, Homo sapiens
ggcaggcacacagcagcc

SEQ ID NO: 4767375 - DNA, 20 bp, Homo sapiens
ggcaggcacacagcagcccc

SEQ ID NO: 4767376 - DNA, 17 bp, Homo sapiens
gcggccccgcggagccc

SEQ ID NO: 4767377 - DNA, 21 bp, Homo sapiens
gcggcccggcccacgcagagc

SEQ ID NO: 4767378 - DNA, 15 bp, Homo sapiens
gcggcccgtgcgcag

SEQ ID NO: 4767379 - DNA, 13 bp, Homo sapiens
gcggccgctctcc

SEQ ID NO: 4767380 - DNA, 22 bp, Homo sapiens
gcggcctcgtgccatgatctgt

SEQ ID NO: 4767381 - DNA, 13 bp, Homo sapiens
gcggcctgcagac

SEQ ID NO: 4767382 - DNA, 14 bp, Homo sapiens
gcggcctgcagacc

SEQ ID NO: 4767383 - DNA, 17 bp, Homo sapiens
gcggcggggcctgggtc

SEQ ID NO: 4767384 - DNA, 14 bp, Homo sapiens
gcggctgaggacgg

SEQ ID NO: 4767385 - DNA, 22 bp, Homo sapiens
gcggctgaggacggggcagagc

SEQ ID NO: 4767386 - DNA, 23 bp, Homo sapiens
gcggctgaggacggggcagagct

SEQ ID NO: 4767387 - DNA, 15 bp, Homo sapiens
gcgggacagcggccc

SEQ ID NO: 4767388 - DNA, 16 bp, Homo sapiens
gcgggacagcggcccc

SEQ ID NO: 4767389 - DNA, 23 bp, Homo sapiens
gcgggagtctcctcactgccact

SEQ ID NO: 4767390 - DNA, 16 bp, Homo sapiens
gcctggaggagaagga

SEQ ID NO: 4767391 - DNA, 21 bp, Homo sapiens
gcctggaggagaaggaggaac

SEQ ID NO: 4767392 - DNA, 20 bp, Homo sapiens
gcctggcagggaggtcaggc

SEQ ID NO: 4767393 - DNA, 13 bp, Homo sapiens
gcctggcccagcc

SEQ ID NO: 4767394 - DNA, 14 bp, Homo sapiens
gcctggcccagcca

SEQ ID NO: 4767395 - DNA, 15 bp, Homo sapiens
gcctggcccagccag

SEQ ID NO: 4767396 - DNA, 16 bp, Homo sapiens
gcctggcccagccagc

SEQ ID NO: 4767397 - DNA, 17 bp, Homo sapiens
gcctggcccagccagca

SEQ ID NO: 4767398 - DNA, 13 bp, Homo sapiens
gcctggccccctc

SEQ ID NO: 4767399 - DNA, 14 bp, Homo sapiens
gcctggccccctcg

SEQ ID NO: 4767400 - DNA, 16 bp, Homo sapiens
gcctggccctgccctg

SEQ ID NO: 4767401 - DNA, 15 bp, Homo sapiens
gcctggcctggccct

SEQ ID NO: 4767402 - DNA, 13 bp, Homo sapiens
gcctggcgggcag

SEQ ID NO: 4767403 - DNA, 14 bp, Homo sapiens
gcctggcgggcagc

SEQ ID NO: 4767404 - DNA, 16 bp, Homo sapiens
gcctggcgggcagccc

SEQ ID NO: 4767405 - DNA, 13 bp, Homo sapiens
gcctggctctgga

SEQ ID NO: 4767406 - DNA, 17 bp, Homo sapiens
gcctggcttcaccgcat

SEQ ID NO: 4767407 - DNA, 17 bp, Homo sapiens
gcctgggacagccactg

SEQ ID NO: 4767408 - DNA, 15 bp, Homo sapiens
gcctgggacgcccct

SEQ ID NO: 4767409 - DNA, 18 bp, Homo sapiens
gccgctgctgtgacaggc

SEQ ID NO: 4767410 - DNA, 20 bp, Homo sapiens
gccgctgcttgagtggacag

SEQ ID NO: 4767411 - DNA, 20 bp, Homo sapiens
gccgctgggagaaaagccag

SEQ ID NO: 4767412 - DNA, 22 bp, Homo sapiens
gccgctgggagaaaagccagat

SEQ ID NO: 4767413 - DNA, 13 bp, Homo sapiens
gccgcttctcctg

SEQ ID NO: 4767414 - DNA, 19 bp, Homo sapiens
gccggcccacgtcctgggt

SEQ ID NO: 4767415 - DNA, 14 bp, Homo sapiens
gccggcgccccgga

SEQ ID NO: 4767416 - DNA, 14 bp, Homo sapiens
gccgggcaggtcct

SEQ ID NO: 4767417 - DNA, 18 bp, Homo sapiens
gccgggcaggtcctgccc

SEQ ID NO: 4767418 - DNA, 14 bp, Homo sapiens
gccgggccccatgg

SEQ ID NO: 4767419 - DNA, 19 bp, Homo sapiens
gccggggctggccctgccc

SEQ ID NO: 4767420 - DNA, 21 bp, Homo sapiens
gccggggctggccctgccctc

SEQ ID NO: 4767421 - DNA, 13 bp, Homo sapiens
gccggtcccccat

SEQ ID NO: 4767422 - DNA, 20 bp, Homo sapiens
gccggtcccccatgccacca

SEQ ID NO: 4767423 - DNA, 17 bp, Homo sapiens
gccgtccctgacttccc

SEQ ID NO: 4767424 - DNA, 19 bp, Homo sapiens
gccgtctttggttcctcat

SEQ ID NO: 4767425 - DNA, 21 bp, Homo sapiens
gccgtctttggttcctcatgg

SEQ ID NO: 4767426 - DNA, 15 bp, Homo sapiens
gccgtgtctctgagg

SEQ ID NO: 4767427 - DNA, 13 bp, Homo sapiens
gcctaatattcat

SEQ ID NO: 4767428 - DNA, 16 bp, Homo sapiens
gcctaatattcatgct

SEQ ID NO: 4767429 - DNA, 19 bp, Homo sapiens
gcctaatattcatgctgcc

SEQ ID NO: 4767430 - DNA, 14 bp, Homo sapiens
gcctaatccacctg

SEQ ID NO: 4767431 - DNA, 16 bp, Homo sapiens
gcctacaaatcagtaa

SEQ ID NO: 4767432 - DNA, 17 bp, Homo sapiens
gcctacaaatcagtaat

SEQ ID NO: 4767433 - DNA, 14 bp, Homo sapiens
gcctagcccaccct

SEQ ID NO: 4767434 - DNA, 16 bp, Homo sapiens
gcctagcccaccctgc

SEQ ID NO: 4767435 - DNA, 18 bp, Homo sapiens
gcctagcccaccctgctg

SEQ ID NO: 4767436 - DNA, 22 bp, Homo sapiens
gcctagcccaccctgctgcctt

SEQ ID NO: 4767437 - DNA, 23 bp, Homo sapiens
gcctagcccaccctgctgccttc

SEQ ID NO: 4767438 - DNA, 16 bp, Homo sapiens
gcctatcctaagagct

SEQ ID NO: 4767439 - DNA, 16 bp, Homo sapiens
gcctatgaccctgtgc

SEQ ID NO: 4767440 - DNA, 17 bp, Homo sapiens
gcctatgaccctgtgcc

SEQ ID NO: 4767441 - DNA, 18 bp, Homo sapiens
gcctatgaccctgtgcct

SEQ ID NO: 4767442 - DNA, 21 bp, Homo sapiens
gcctatgaccctgtgcctgtg

SEQ ID NO: 4767443 - DNA, 20 bp, Homo sapiens
gcctatggaaagggtgtggc

SEQ ID NO: 4767444 - DNA, 12 bp, Homo sapiens
gcctcacctggc

SEQ ID NO: 4767445 - DNA, 15 bp, Homo sapiens
gcctcacctggcttc

SEQ ID NO: 4767446 - DNA, 16 bp, Homo sapiens
gcctcacctggcttcc

SEQ ID NO: 4767447 - DNA, 19 bp, Homo sapiens
gcctcacctggcttcccag

SEQ ID NO: 4767448 - DNA, 22 bp, Homo sapiens
gcctcacctggcttcccaggac

SEQ ID NO: 4767449 - DNA, 13 bp, Homo sapiens
gcctcaccttcct

SEQ ID NO: 4767450 - DNA, 14 bp, Homo sapiens
gcctcagccctcag

SEQ ID NO: 4767451 - DNA, 15 bp, Homo sapiens
gcctcagggaccaag

SEQ ID NO: 4767452 - DNA, 23 bp, Homo sapiens
gcctcagtccctccctcctggct

SEQ ID NO: 4767453 - DNA, 22 bp, Homo sapiens
gcctcagttcaacctggtggca

SEQ ID NO: 4767454 - DNA, 23 bp, Homo sapiens
gcctcatcttccttctcagcctt

SEQ ID NO: 4767455 - DNA, 22 bp, Homo sapiens
gcctcattttgcttcccatctg

SEQ ID NO: 4767456 - DNA, 21 bp, Homo sapiens
gcctccaagtcatgggagaag

SEQ ID NO: 4767457 - DNA, 21 bp, Homo sapiens
gcctccaggaccttgcttcct

SEQ ID NO: 4767458 - DNA, 19 bp, Homo sapiens
gcctccatccacacacagc

SEQ ID NO: 4767459 - DNA, 16 bp, Homo sapiens
gcctcccaagctgatg

SEQ ID NO: 4767460 - DNA, 19 bp, Homo sapiens
gcctcccaagctgatggac

SEQ ID NO: 4767461 - DNA, 14 bp, Homo sapiens
gcctcccagccctg

SEQ ID NO: 4767462 - DNA, 20 bp, Homo sapiens
gcctcccagccctgcccaga

SEQ ID NO: 4767463 - DNA, 14 bp, Homo sapiens
gcctcccatgttca

SEQ ID NO: 4767464 - DNA, 20 bp, Homo sapiens
gcctcccccaggctgcgcct

SEQ ID NO: 4767465 - DNA, 23 bp, Homo sapiens
gcctcccccaggctgcgcctgcc

SEQ ID NO: 4767466 - DNA, 19 bp, Homo sapiens
gcctccccccacaagaact

SEQ ID NO: 4767467 - DNA, 13 bp, Homo sapiens
gcctccccctcag

SEQ ID NO: 4767468 - DNA, 14 bp, Homo sapiens
gcctccccctcaga

SEQ ID NO: 4767469 - DNA, 22 bp, Homo sapiens
gcctccccgggggtccccggac

SEQ ID NO: 4767470 - DNA, 19 bp, Homo sapiens
gcctcccgcatgctgcctg

SEQ ID NO: 4767471 - DNA, 20 bp, Homo sapiens
gcctcccgcatgctgcctgc

SEQ ID NO: 4767472 - DNA, 15 bp, Homo sapiens
gcctcccgccgcctc

SEQ ID NO: 4767473 - DNA, 17 bp, Homo sapiens
gcctcccggggtgcccg

SEQ ID NO: 4767474 - DNA, 21 bp, Homo sapiens
gcctcccggggtgcccgtgtg

SEQ ID NO: 4767475 - DNA, 23 bp, Homo sapiens
gcctcccggggtgcccgtgtggc

SEQ ID NO: 4767476 - DNA, 17 bp, Homo sapiens
gcctccgggcctcggcc

SEQ ID NO: 4767477 - DNA, 17 bp, Homo sapiens
gcctcctagcctctccg

SEQ ID NO: 4767478 - DNA, 14 bp, Homo sapiens
gcctcctccagact

SEQ ID NO: 4767479 - DNA, 16 bp, Homo sapiens
gcctcctccagactcg

SEQ ID NO: 4767480 - DNA, 11 bp, Homo sapiens
gcctcctggcc

SEQ ID NO: 4767481 - DNA, 14 bp, Homo sapiens
gcctcctggccaga

SEQ ID NO: 4767482 - DNA, 16 bp, Homo sapiens
gcctcctggccagacg

SEQ ID NO: 4767483 - DNA, 17 bp, Homo sapiens
gcctcgcccccgggccc

SEQ ID NO: 4767484 - DNA, 15 bp, Homo sapiens
gcctcggcctggctt

SEQ ID NO: 4767485 - DNA, 15 bp, Homo sapiens
gcctcgggccgcctc

SEQ ID NO: 4767486 - DNA, 19 bp, Homo sapiens
gcctcgggccgcctcctcc

SEQ ID NO: 4767487 - DNA, 14 bp, Homo sapiens
gcctcgtgccatga

SEQ ID NO: 4767488 - DNA, 22 bp, Homo sapiens
gcctctctcatggcttgggctg

SEQ ID NO: 4767489 - DNA, 14 bp, Homo sapiens
gcctctctctccca

SEQ ID NO: 4767490 - DNA, 18 bp, Homo sapiens
gcctctctggaagaggga

SEQ ID NO: 4767491 - DNA, 13 bp, Homo sapiens
gcctctgatatgg

SEQ ID NO: 4767492 - DNA, 14 bp, Homo sapiens
gcctctgcccctct

SEQ ID NO: 4767493 - DNA, 15 bp, Homo sapiens
gcctctgccttagag

SEQ ID NO: 4767494 - DNA, 18 bp, Homo sapiens
gcctctgccttagaggag

SEQ ID NO: 4767495 - DNA, 15 bp, Homo sapiens
gcctctgtcctggcc

SEQ ID NO: 4767496 - DNA, 13 bp, Homo sapiens
gcctcttaaaaat

SEQ ID NO: 4767497 - DNA, 14 bp, Homo sapiens
gcctcttaaaaatt

SEQ ID NO: 4767498 - DNA, 14 bp, Homo sapiens
gcctctttaaatta

SEQ ID NO: 4767499 - DNA, 23 bp, Homo sapiens
gcctgacacaatggtagctctga

SEQ ID NO: 4767500 - DNA, 14 bp, Homo sapiens
gcctgagccacagt

SEQ ID NO: 4767501 - DNA, 21 bp, Homo sapiens
gcctgagccacagtggggccc

SEQ ID NO: 4767502 - DNA, 17 bp, Homo sapiens
gcctgagctccaccctc

SEQ ID NO: 4767503 - DNA, 18 bp, Homo sapiens
gcctgagctccaccctcc

SEQ ID NO: 4767504 - DNA, 20 bp, Homo sapiens
gcctgagctccaccctcccc

SEQ ID NO: 4767505 - DNA, 21 bp, Homo sapiens
gcctgagctccaccctcccct

SEQ ID NO: 4767506 - DNA, 18 bp, Homo sapiens
gcctgagggaagcccacc

SEQ ID NO: 4767507 - DNA, 22 bp, Homo sapiens
gcctgagggaagcccacccgcc

SEQ ID NO: 4767508 - DNA, 14 bp, Homo sapiens
gcctgatggccagg

SEQ ID NO: 4767509 - DNA, 20 bp, Homo sapiens
gcctgcacacacctgcctgc

SEQ ID NO: 4767510 - DNA, 19 bp, Homo sapiens
gcctgcagaccctgccagg

SEQ ID NO: 4767511 - DNA, 13 bp, Homo sapiens
gcctgcagcccag

SEQ ID NO: 4767512 - DNA, 14 bp, Homo sapiens
gcctgcagcccaga

SEQ ID NO: 4767513 - DNA, 15 bp, Homo sapiens
gcctgcagcccagaa

SEQ ID NO: 4767514 - DNA, 12 bp, Homo sapiens
gcctgcccccct

SEQ ID NO: 4767515 - DNA, 15 bp, Homo sapiens
gcctgccccccttcc

SEQ ID NO: 4767516 - DNA, 15 bp, Homo sapiens
gcctgcccgcacagc

SEQ ID NO: 4767517 - DNA, 19 bp, Homo sapiens
gcctgcccgcacagcagcc

SEQ ID NO: 4767518 - DNA, 16 bp, Homo sapiens
gcctgcccgcccgccg

SEQ ID NO: 4767519 - DNA, 17 bp, Homo sapiens
gcctgcccgcccgccgg

SEQ ID NO: 4767520 - DNA, 14 bp, Homo sapiens
gcctgcctccggcc

SEQ ID NO: 4767521 - DNA, 19 bp, Homo sapiens
gcctgcctccggccctgcc

SEQ ID NO: 4767522 - DNA, 14 bp, Homo sapiens
gcctgcgcccccca

SEQ ID NO: 4767523 - DNA, 16 bp, Homo sapiens
gcctgcgccccccagt

SEQ ID NO: 4767524 - DNA, 19 bp, Homo sapiens
gcctgcgccccccagtgga

SEQ ID NO: 4767525 - DNA, 15 bp, Homo sapiens
gcctgcgcctcctcc

SEQ ID NO: 4767526 - DNA, 14 bp, Homo sapiens
gcctgcgcgtgcgg

SEQ ID NO: 4767527 - DNA, 23 bp, Homo sapiens
gcctgcgctcctctgcagcctga

SEQ ID NO: 4767528 - DNA, 15 bp, Homo sapiens
gcctgctatccagcc

SEQ ID NO: 4767529 - DNA, 16 bp, Homo sapiens
gcctgctatccagccg

SEQ ID NO: 4767530 - DNA, 17 bp, Homo sapiens
gcctgctatccagccgc

SEQ ID NO: 4767531 - DNA, 18 bp, Homo sapiens
gcctgctatccagccgca

SEQ ID NO: 4767532 - DNA, 21 bp, Homo sapiens
gcctgcttcccacctccctgc

SEQ ID NO: 4767533 - DNA, 23 bp, Homo sapiens
gcctggagaagggttcagcccaa

SEQ ID NO: 4767534 - DNA, 13 bp, Homo sapiens
gcatttcatcaag

SEQ ID NO: 4767535 - DNA, 15 bp, Homo sapiens
gcattttaaatgtct

SEQ ID NO: 4767536 - DNA, 23 bp, Homo sapiens
gcattttaaatgtctataaatgg

SEQ ID NO: 4767537 - DNA, 17 bp, Homo sapiens
gcattttactatgcctg

SEQ ID NO: 4767538 - DNA, 20 bp, Homo sapiens
gcattttactatgcctgttg

SEQ ID NO: 4767539 - DNA, 17 bp, Homo sapiens
gcattttactgtacaga

SEQ ID NO: 4767540 - DNA, 23 bp, Homo sapiens
gccaaaaggccccttcccacgtc

SEQ ID NO: 4767541 - DNA, 15 bp, Homo sapiens
gccaaaatgtcaatt

SEQ ID NO: 4767542 - DNA, 16 bp, Homo sapiens
gccaaatattgatctg

SEQ ID NO: 4767543 - DNA, 19 bp, Homo sapiens
gccaaatattgatctgtat

SEQ ID NO: 4767544 - DNA, 18 bp, Homo sapiens
gccaaccaggctacagtt

SEQ ID NO: 4767545 - DNA, 14 bp, Homo sapiens
gccaagaattctta

SEQ ID NO: 4767546 - DNA, 20 bp, Homo sapiens
gccaagactctatgctctgg

SEQ ID NO: 4767547 - DNA, 22 bp, Homo sapiens
gccaaggcatccccagtgccag

SEQ ID NO: 4767548 - DNA, 11 bp, Homo sapiens
gccaaggccaa

SEQ ID NO: 4767549 - DNA, 17 bp, Homo sapiens
gccaaggccaaaggaag

SEQ ID NO: 4767550 - DNA, 19 bp, Homo sapiens
gccaaggccaaaggaagca

SEQ ID NO: 4767551 - DNA, 20 bp, Homo sapiens
gccaaggccaaaggaagcac

SEQ ID NO: 4767552 - DNA, 16 bp, Homo sapiens
gccaataaagctcaca

SEQ ID NO: 4767553 - DNA, 17 bp, Homo sapiens
gccaataaagctcacac

SEQ ID NO: 4767554 - DNA, 18 bp, Homo sapiens
gccaataaagctcacact

SEQ ID NO: 4767555 - DNA, 21 bp, Homo sapiens
gccaatgaagcaaacacacag

SEQ ID NO: 4767556 - DNA, 13 bp, Homo sapiens
gccacaagcacaa

SEQ ID NO: 4767557 - DNA, 14 bp, Homo sapiens
gccacaatcactaa

SEQ ID NO: 4767558 - DNA, 24 bp, Homo sapiens
gccacaatcactaaatatctagtg

SEQ ID NO: 4767559 - DNA, 14 bp, Homo sapiens
gccacactggccgg

SEQ ID NO: 4767560 - DNA, 17 bp, Homo sapiens
gccacagcagcctctga

SEQ ID NO: 4767561 - DNA, 13 bp, Homo sapiens
gccacagccccaa

SEQ ID NO: 4767562 - DNA, 15 bp, Homo sapiens
gccacagtggcactt

SEQ ID NO: 4767563 - DNA, 18 bp, Homo sapiens
gccacagtggggcccatg

SEQ ID NO: 4767564 - DNA, 18 bp, Homo sapiens
gccacatggccgctgccc

SEQ ID NO: 4767565 - DNA, 16 bp, Homo sapiens
gccaccaagctgctct

SEQ ID NO: 4767566 - DNA, 16 bp, Homo sapiens
gccaccacccacccca

SEQ ID NO: 4767567 - DNA, 23 bp, Homo sapiens
gccacccccacctccctgcagct

SEQ ID NO: 4767568 - DNA, 15 bp, Homo sapiens
gccacccgcccgccc

SEQ ID NO: 4767569 - DNA, 17 bp, Homo sapiens
gccacccgcccgccccc

SEQ ID NO: 4767570 - DNA, 19 bp, Homo sapiens
gcccgctcaacctctcaga

SEQ ID NO: 4767571 - DNA, 18 bp, Homo sapiens
gcccggcccacgcagagc

SEQ ID NO: 4767572 - DNA, 20 bp, Homo sapiens
gcccggcccacgcagagccc

SEQ ID NO: 4767573 - DNA, 22 bp, Homo sapiens
gcccggcccacgcagagccccg

SEQ ID NO: 4767574 - DNA, 21 bp, Homo sapiens
gcccgggaggaggatccgggc

SEQ ID NO: 4767575 - DNA, 23 bp, Homo sapiens
gcccggtcccagtccggtgcctt

SEQ ID NO: 4767576 - DNA, 14 bp, Homo sapiens
gcccgtgtggcctg

SEQ ID NO: 4767577 - DNA, 16 bp, Homo sapiens
gcccgtgtggcctggg

SEQ ID NO: 4767578 - DNA, 18 bp, Homo sapiens
gcccgtgtggcctgggtc

SEQ ID NO: 4767579 - DNA, 20 bp, Homo sapiens
gcccgtgtggcctgggtcct

SEQ ID NO: 4767580 - DNA, 24 bp, Homo sapiens
gcccgtgtggcctgggtcctcggc

SEQ ID NO: 4767581 - DNA, 19 bp, Homo sapiens
gccctaggcatactctcca

SEQ ID NO: 4767582 - DNA, 22 bp, Homo sapiens
gccctaggcatactctccagga

SEQ ID NO: 4767583 - DNA, 14 bp, Homo sapiens
gccctcactccact

SEQ ID NO: 4767584 - DNA, 20 bp, Homo sapiens
gccctcactccactcccctc

SEQ ID NO: 4767585 - DNA, 21 bp, Homo sapiens
gccctcactccactcccctca

SEQ ID NO: 4767586 - DNA, 20 bp, Homo sapiens
gccctcccccttccccttct

SEQ ID NO: 4767587 - DNA, 20 bp, Homo sapiens
gccctccctccctccacacc

SEQ ID NO: 4767588 - DNA, 17 bp, Homo sapiens
gccctccctgactccct

SEQ ID NO: 4767589 - DNA, 21 bp, Homo sapiens
gccctccctgactccctgtgg

SEQ ID NO: 4767590 - DNA, 14 bp, Homo sapiens
gccctccgccagcc

SEQ ID NO: 4767591 - DNA, 19 bp, Homo sapiens
gccctccgccagccctgtt

SEQ ID NO: 4767592 - DNA, 16 bp, Homo sapiens
gccctcctctgccccc

SEQ ID NO: 4767593 - DNA, 12 bp, Homo sapiens
gccctcgggccc

SEQ ID NO: 4767594 - DNA, 15 bp, Homo sapiens
gccctctccctcagt

SEQ ID NO: 4767595 - DNA, 19 bp, Homo sapiens
gccctctctccgccccgga

SEQ ID NO: 4767596 - DNA, 21 bp, Homo sapiens
gccctctctgcagtcctcggc

SEQ ID NO: 4767597 - DNA, 15 bp, Homo sapiens
gccctctgctgcttt

SEQ ID NO: 4767598 - DNA, 15 bp, Homo sapiens
gccctctttctctct

SEQ ID NO: 4767599 - DNA, 18 bp, Homo sapiens
gccctctttctctctgtg

SEQ ID NO: 4767600 - DNA, 19 bp, Homo sapiens
gccctctttctctctgtgt

SEQ ID NO: 4767601 - DNA, 16 bp, Homo sapiens
gccctgacatgctaac

SEQ ID NO: 4767602 - DNA, 19 bp, Homo sapiens
gccctgatgcgtctaccca

SEQ ID NO: 4767603 - DNA, 23 bp, Homo sapiens
gccctgcaatgtatcccttctca

SEQ ID NO: 4767604 - DNA, 16 bp, Homo sapiens
gccctgcaccttgggc

SEQ ID NO: 4767605 - DNA, 22 bp, Homo sapiens
gccctgcaccttgggcacggga

SEQ ID NO: 4767606 - DNA, 13 bp, Homo sapiens
gccctgcagaggg

SEQ ID NO: 4767607 - DNA, 14 bp, Homo sapiens
gccctgcagagggc

SEQ ID NO: 4767608 - DNA, 18 bp, Homo sapiens
gccctgcagagggcacag

SEQ ID NO: 4767609 - DNA, 22 bp, Homo sapiens
gccctgcagtgttcgcttggct

SEQ ID NO: 4767610 - DNA, 15 bp, Homo sapiens
gccctgcccgcgccc

SEQ ID NO: 4767611 - DNA, 10 bp, Homo sapiens
gccctgccct

SEQ ID NO: 4767612 - DNA, 13 bp, Homo sapiens
gccctgccctcac

SEQ ID NO: 4767613 - DNA, 14 bp, Homo sapiens
gccctgccctcact

SEQ ID NO: 4767614 - DNA, 15 bp, Homo sapiens
gccctgccctcactc

SEQ ID NO: 4767615 - DNA, 19 bp, Homo sapiens
gccctgccctcccccacgg

SEQ ID NO: 4767616 - DNA, 20 bp, Homo sapiens
gccctgccctctccttcctt

SEQ ID NO: 4767617 - DNA, 13 bp, Homo sapiens
gccctgccctgag

SEQ ID NO: 4767618 - DNA, 14 bp, Homo sapiens
gccctgccgtgggc

SEQ ID NO: 4767619 - DNA, 18 bp, Homo sapiens
gccctgcgtcccttctct

SEQ ID NO: 4767620 - DNA, 15 bp, Homo sapiens
gccctgctcaggcct

SEQ ID NO: 4767621 - DNA, 16 bp, Homo sapiens
gccctgctcaggcctc

SEQ ID NO: 4767622 - DNA, 17 bp, Homo sapiens
gccctgctcaggcctca

SEQ ID NO: 4767623 - DNA, 19 bp, Homo sapiens
gccctgctcaggcctcacc

SEQ ID NO: 4767624 - DNA, 15 bp, Homo sapiens
gccctggcccggtcc

SEQ ID NO: 4767625 - DNA, 14 bp, Homo sapiens
gccctggcctacca

SEQ ID NO: 4767626 - DNA, 21 bp, Homo sapiens
gccctggcctaccacagctgc

SEQ ID NO: 4767627 - DNA, 22 bp, Homo sapiens
gccctggcctaccacagctgcc

SEQ ID NO: 4767628 - DNA, 20 bp, Homo sapiens
gccctgggctgtctgtcacc

SEQ ID NO: 4767629 - DNA, 15 bp, Homo sapiens
gccctggggctgggc

SEQ ID NO: 4767630 - DNA, 16 bp, Homo sapiens
gccctggggctgggcc

SEQ ID NO: 4767631 - DNA, 15 bp, Homo sapiens
gccctggggtctctg

SEQ ID NO: 4767632 - DNA, 17 bp, Homo sapiens
gccctggggtctctgag

SEQ ID NO: 4767633 - DNA, 19 bp, Homo sapiens
gccctggggtctctgagca

SEQ ID NO: 4767634 - DNA, 22 bp, Homo sapiens
gccctggggtctctgagcagtg

SEQ ID NO: 4767635 - DNA, 23 bp, Homo sapiens
gccctggggtctctgagcagtgg

SEQ ID NO: 4767636 - DNA, 13 bp, Homo sapiens
gccctgtagccct

SEQ ID NO: 4767637 - DNA, 20 bp, Homo sapiens
gccctgtagccctggcccgg

SEQ ID NO: 4767638 - DNA, 15 bp, Homo sapiens
gccctgtagctcctt

SEQ ID NO: 4767639 - DNA, 18 bp, Homo sapiens
gccctgtagctccttagc

SEQ ID NO: 4767640 - DNA, 16 bp, Homo sapiens
gccctgtgggagtcca

SEQ ID NO: 4767641 - DNA, 19 bp, Homo sapiens
gccctgttccgcctcactg

SEQ ID NO: 4767642 - DNA, 20 bp, Homo sapiens
gcccttaaaataatgattta

SEQ ID NO: 4767643 - DNA, 14 bp, Homo sapiens
gcccttagaatgtg

SEQ ID NO: 4767644 - DNA, 20 bp, Homo sapiens
gcccttcccaacctcccctg

SEQ ID NO: 4767645 - DNA, 18 bp, Homo sapiens
gccctttccttgccttct

SEQ ID NO: 4767646 - DNA, 16 bp, Homo sapiens
gccgaagggcagcccc

SEQ ID NO: 4767647 - DNA, 17 bp, Homo sapiens
gccgaagggcagccccg

SEQ ID NO: 4767648 - DNA, 19 bp, Homo sapiens
gccgagatagccaaggcca

SEQ ID NO: 4767649 - DNA, 19 bp, Homo sapiens
gccgagggaaatgctgttg

SEQ ID NO: 4767650 - DNA, 21 bp, Homo sapiens
gccgcaaatccataccccctg

SEQ ID NO: 4767651 - DNA, 22 bp, Homo sapiens
gccgcaaatccataccccctgc

SEQ ID NO: 4767652 - DNA, 14 bp, Homo sapiens
gccgcagaggcccg

SEQ ID NO: 4767653 - DNA, 12 bp, Homo sapiens
gccgcagccctg

SEQ ID NO: 4767654 - DNA, 18 bp, Homo sapiens
gccgcagggcgctccggc

SEQ ID NO: 4767655 - DNA, 19 bp, Homo sapiens
gccgcagggcgctccggca

SEQ ID NO: 4767656 - DNA, 21 bp, Homo sapiens
gccgcagggcgctccggcaga

SEQ ID NO: 4767657 - DNA, 15 bp, Homo sapiens
gccgccctgggctgt

SEQ ID NO: 4767658 - DNA, 13 bp, Homo sapiens
gccgcctcacctt

SEQ ID NO: 4767659 - DNA, 14 bp, Homo sapiens
gccgcctcctccag

SEQ ID NO: 4767660 - DNA, 18 bp, Homo sapiens
gccgcgggcgagaagggc

SEQ ID NO: 4767661 - DNA, 24 bp, Homo sapiens
gccgcgggcgagaagggcgcagga

SEQ ID NO: 4767662 - DNA, 22 bp, Homo sapiens
gccgctgcagtcagcacagaga

SEQ ID NO: 4767663 - DNA, 23 bp, Homo sapiens
gccgctgcagtcagcacagagag

SEQ ID NO: 4767664 - DNA, 14 bp, Homo sapiens
gccgctgcccacgt

SEQ ID NO: 4767665 - DNA, 23 bp, Homo sapiens
cttgttatgttgtaatattttgc

SEQ ID NO: 4767666 - DNA, 19 bp, Homo sapiens
cttgttcatgttttgctaa

SEQ ID NO: 4767667 - DNA, 13 bp, Homo sapiens
cttgttgtattcc

SEQ ID NO: 4767668 - DNA, 16 bp, Homo sapiens
cttgtttaccaaagaa

SEQ ID NO: 4767669 - DNA, 16 bp, Homo sapiens
ctttaaaaaaatccca

SEQ ID NO: 4767670 - DNA, 16 bp, Homo sapiens
ctttaaaacttactat

SEQ ID NO: 4767671 - DNA, 22 bp, Homo sapiens
ctttaaattatatgatatgcat

SEQ ID NO: 4767672 - DNA, 14 bp, Homo sapiens
ctttaaattatgac

SEQ ID NO: 4767673 - DNA, 16 bp, Homo sapiens
ctttaaattgtggatg

SEQ ID NO: 4767674 - DNA, 17 bp, Homo sapiens
ctttaaccagtctgaag

SEQ ID NO: 4767675 - DNA, 20 bp, Homo sapiens
ctttaagcgaggcagaatgg

SEQ ID NO: 4767676 - DNA, 17 bp, Homo sapiens
ctttacatatgctttaa

SEQ ID NO: 4767677 - DNA, 22 bp, Homo sapiens
ctttagaaataaaccttaatat

SEQ ID NO: 4767678 - DNA, 22 bp, Homo sapiens
ctttagaatagttaaattggct

SEQ ID NO: 4767679 - DNA, 16 bp, Homo sapiens
ctttagagaagccata

SEQ ID NO: 4767680 - DNA, 15 bp, Homo sapiens
ctttaggcaggaagt

SEQ ID NO: 4767681 - DNA, 21 bp, Homo sapiens
ctttagtattatattaatata

SEQ ID NO: 4767682 - DNA, 11 bp, Homo sapiens
ctttataaata

SEQ ID NO: 4767683 - DNA, 19 bp, Homo sapiens
ctttataataaactgttta

SEQ ID NO: 4767684 - DNA, 15 bp, Homo sapiens
ctttataatggctct

SEQ ID NO: 4767685 - DNA, 17 bp, Homo sapiens
ctttataatggctctgg

SEQ ID NO: 4767686 - DNA, 17 bp, Homo sapiens
ctttatcatgtgtttct

SEQ ID NO: 4767687 - DNA, 13 bp, Homo sapiens
ctttatccacatt

SEQ ID NO: 4767688 - DNA, 23 bp, Homo sapiens
ctttatgaaatatccttacttta

SEQ ID NO: 4767689 - DNA, 15 bp, Homo sapiens
ctttattgtctgtaa

SEQ ID NO: 4767690 - DNA, 19 bp, Homo sapiens
ctttatttattaaacttca

SEQ ID NO: 4767691 - DNA, 16 bp, Homo sapiens
ctttattttaaatgat

SEQ ID NO: 4767692 - DNA, 23 bp, Homo sapiens
ctttattttatataataaagtat

SEQ ID NO: 4767693 - DNA, 17 bp, Homo sapiens
ctttcaagatctaaatc

SEQ ID NO: 4767694 - DNA, 15 bp, Homo sapiens
ctttcaatccacagt

SEQ ID NO: 4767695 - DNA, 20 bp, Homo sapiens
ctttcaatccacagtattgt

SEQ ID NO: 4767696 - DNA, 15 bp, Homo sapiens
ctttcacccttttct

SEQ ID NO: 4767697 - DNA, 21 bp, Homo sapiens
ctttcagattgtatctgaact

SEQ ID NO: 4767698 - DNA, 18 bp, Homo sapiens
ctttcatcaatcattgta

SEQ ID NO: 4767699 - DNA, 21 bp, Homo sapiens
ctttcatcaatcattgtacag

SEQ ID NO: 4767700 - DNA, 19 bp, Homo sapiens
ctttcatgtttaagaaatg

SEQ ID NO: 4767701 - DNA, 20 bp, Homo sapiens
ctttcatgtttaagaaatga

SEQ ID NO: 4767702 - DNA, 15 bp, Homo sapiens
ctttccaaaggttgt

SEQ ID NO: 4767703 - DNA, 19 bp, Homo sapiens
ctttccatcagctttataa

SEQ ID NO: 4767704 - DNA, 12 bp, Homo sapiens
ctttccatgaca

SEQ ID NO: 4767705 - DNA, 14 bp, Homo sapiens
ctttcccacactgt

SEQ ID NO: 4767706 - DNA, 23 bp, Homo sapiens
ctttcccgatgcgtggctcccag

SEQ ID NO: 4767707 - DNA, 19 bp, Homo sapiens
ctttccgctgtcgccccag

SEQ ID NO: 4767708 - DNA, 16 bp, Homo sapiens
ctttcctcctcatgaa

SEQ ID NO: 4767709 - DNA, 21 bp, Homo sapiens
ctttcctgatcaaggtgctct

SEQ ID NO: 4767710 - DNA, 21 bp, Homo sapiens
ctttccttccttttttccttt

SEQ ID NO: 4767711 - DNA, 20 bp, Homo sapiens
ctttcctttcatcctcagca

SEQ ID NO: 4767712 - DNA, 23 bp, Homo sapiens
ctttcgtgtttttggttttctcc

SEQ ID NO: 4767713 - DNA, 22 bp, Homo sapiens
ctttcgttaatcttgctgctta

SEQ ID NO: 4767714 - DNA, 17 bp, Homo sapiens
ctttctacatgcaaatc

SEQ ID NO: 4767715 - DNA, 16 bp, Homo sapiens
ctttctagccagagga

SEQ ID NO: 4767716 - DNA, 13 bp, Homo sapiens
ctttctattggca

SEQ ID NO: 4767717 - DNA, 15 bp, Homo sapiens
ctttctccaaagtta

SEQ ID NO: 4767718 - DNA, 18 bp, Homo sapiens
ctttctctctgtgtggca

SEQ ID NO: 4767719 - DNA, 14 bp, Homo sapiens
ctttctcttctaat

SEQ ID NO: 4767720 - DNA, 15 bp, Homo sapiens
ctttctcttgctgtt

SEQ ID NO: 4767721 - DNA, 15 bp, Homo sapiens
ctttctggcttttaa

SEQ ID NO: 4767722 - DNA, 15 bp, Homo sapiens
ctttcttcaattaat

SEQ ID NO: 4767723 - DNA, 18 bp, Homo sapiens
ctttcttcaattaatgga

SEQ ID NO: 4767724 - DNA, 13 bp, Homo sapiens
ctttcttccttcc

SEQ ID NO: 4767725 - DNA, 11 bp, Homo sapiens
ctttctttcca

SEQ ID NO: 4767726 - DNA, 13 bp, Homo sapiens
ctttctttccaaa

SEQ ID NO: 4767727 - DNA, 14 bp, Homo sapiens
ctttctttccaaag

SEQ ID NO: 4767728 - DNA, 11 bp, Homo sapiens
ctttcttttct

SEQ ID NO: 4767729 - DNA, 12 bp, Homo sapiens
ctttcttttctt

SEQ ID NO: 4767730 - DNA, 22 bp, Homo sapiens
ctttgacacttttcatatcatt

SEQ ID NO: 4767731 - DNA, 14 bp, Homo sapiens
ctttgagggactgc

SEQ ID NO: 4767732 - DNA, 19 bp, Homo sapiens
ctttgagggactgcctctg

SEQ ID NO: 4767733 - DNA, 17 bp, Homo sapiens
ctttgagtgtcaggctc

SEQ ID NO: 4767734 - DNA, 19 bp, Homo sapiens
ctttgagttaagtctatct

SEQ ID NO: 4767735 - DNA, 14 bp, Homo sapiens
ctttgcctgaagaa

SEQ ID NO: 4767736 - DNA, 13 bp, Homo sapiens
ctttgctgtttat

SEQ ID NO: 4767737 - DNA, 15 bp, Homo sapiens
ctttggaatttgaag

SEQ ID NO: 4767738 - DNA, 12 bp, Homo sapiens
ctttggccacag

SEQ ID NO: 4767739 - DNA, 13 bp, Homo sapiens
ctttgggaggctg

SEQ ID NO: 4767740 - DNA, 14 bp, Homo sapiens
ctttgggaggctga

SEQ ID NO: 4767741 - DNA, 17 bp, Homo sapiens
ctttgggcctggctccc

SEQ ID NO: 4767742 - DNA, 21 bp, Homo sapiens
ctttgggtagtgccatggcca

SEQ ID NO: 4767743 - DNA, 21 bp, Homo sapiens
ctttggtcctacccgcttccc

SEQ ID NO: 4767744 - DNA, 18 bp, Homo sapiens
ctttgtaaccacaacttt

SEQ ID NO: 4767745 - DNA, 17 bp, Homo sapiens
ctttgtatacaagtact

SEQ ID NO: 4767746 - DNA, 15 bp, Homo sapiens
ctttgtcacttctgc

SEQ ID NO: 4767747 - DNA, 21 bp, Homo sapiens
ctttgtctcacgattccagtg

SEQ ID NO: 4767748 - DNA, 17 bp, Homo sapiens
ctttgtcttgatcctca

SEQ ID NO: 4767749 - DNA, 14 bp, Homo sapiens
ctttgtgcttgttc

SEQ ID NO: 4767750 - DNA, 15 bp, Homo sapiens
ctttgtgcttgttct

SEQ ID NO: 4767751 - DNA, 12 bp, Homo sapiens
ctttgtggggct

SEQ ID NO: 4767752 - DNA, 15 bp, Homo sapiens
ctttgtggtgagaat

SEQ ID NO: 4767753 - DNA, 13 bp, Homo sapiens
ctttgtgtctttt

SEQ ID NO: 4767754 - DNA, 19 bp, Homo sapiens
ctttgtgtcttttgttctc

SEQ ID NO: 4767755 - DNA, 20 bp, Homo sapiens
ctttgtgtcttttgttctct

SEQ ID NO: 4767756 - DNA, 12 bp, Homo sapiens
ctttgttaaaat

SEQ ID NO: 4767757 - DNA, 14 bp, Homo sapiens
ctttgttaaaatat

SEQ ID NO: 4767758 - DNA, 16 bp, Homo sapiens
ctttgttcttcaatgt

SEQ ID NO: 4767759 - DNA, 22 bp, Homo sapiens
ctttgttcttcaatgtgaaact

SEQ ID NO: 4767760 - DNA, 18 bp, Homo sapiens
cttttaaaaaaataatat

SEQ ID NO: 4767761 - DNA, 18 bp, Homo sapiens
cttttaaaaactcctgtt

SEQ ID NO: 4767762 - DNA, 21 bp, Homo sapiens
cttttataaatgttttaaaga

SEQ ID NO: 4767763 - DNA, 17 bp, Homo sapiens
cttttattgtataatta

SEQ ID NO: 4767764 - DNA, 16 bp, Homo sapiens
cttttcaatgcaatgc

SEQ ID NO: 4767765 - DNA, 14 bp, Homo sapiens
cttttcatatcatt

SEQ ID NO: 4767766 - DNA, 16 bp, Homo sapiens
cttttcatatcatttc

SEQ ID NO: 4767767 - DNA, 20 bp, Homo sapiens
cttttcatggagtagagtca

SEQ ID NO: 4767768 - DNA, 20 bp, Homo sapiens
cttttcctgaggtcatctgt

SEQ ID NO: 4767769 - DNA, 21 bp, Homo sapiens
cttttcctgaggtcatctgta

SEQ ID NO: 4767770 - DNA, 22 bp, Homo sapiens
cttttcctgaggtcatctgtaa

SEQ ID NO: 4767771 - DNA, 15 bp, Homo sapiens
cttttctgtttgcta

SEQ ID NO: 4767772 - DNA, 17 bp, Homo sapiens
cttttgaatcaatctgg

SEQ ID NO: 4767773 - DNA, 18 bp, Homo sapiens
cttttgagctcctaagct

SEQ ID NO: 4767774 - DNA, 20 bp, Homo sapiens
cttttgctctctcattccca

SEQ ID NO: 4767775 - DNA, 19 bp, Homo sapiens
cttttggagcaaagtggtt

SEQ ID NO: 4767776 - DNA, 15 bp, Homo sapiens
cttttgggaaatgct

SEQ ID NO: 4767777 - DNA, 21 bp, Homo sapiens
cttttggtgtttgagtgttca

SEQ ID NO: 4767778 - DNA, 22 bp, Homo sapiens
cttttggtttgtgggtccagga

SEQ ID NO: 4767779 - DNA, 22 bp, Homo sapiens
cttttgtacgttaattaaacaa

SEQ ID NO: 4767780 - DNA, 17 bp, Homo sapiens
cttttgtcatgtggcta

SEQ ID NO: 4767781 - DNA, 13 bp, Homo sapiens
ctttttgaattgt

SEQ ID NO: 4767782 - DNA, 19 bp, Homo sapiens
cttttttcaatgtactgta

SEQ ID NO: 4767783 - DNA, 22 bp, Homo sapiens
cttttttcaatgtactgtattg

SEQ ID NO: 4767784 - DNA, 12 bp, Homo sapiens
cttttttcctgt

SEQ ID NO: 4767785 - DNA, 16 bp, Homo sapiens
cttttttcctgtcaat

SEQ ID NO: 4767786 - DNA, 17 bp, Homo sapiens
cttttttgcaataagga

SEQ ID NO: 4767787 - DNA, 21 bp, Homo sapiens
gaacccatcactgtgtctcat

SEQ ID NO: 4767788 - DNA, 21 bp, Homo sapiens
gaacccccctccccaaggaag

SEQ ID NO: 4767789 - DNA, 13 bp, Homo sapiens
gaaccgaggactc

SEQ ID NO: 4767790 - DNA, 19 bp, Homo sapiens
gaacctgatacctgcctgg

SEQ ID NO: 4767791 - DNA, 10 bp, Homo sapiens
gaaccttccc

SEQ ID NO: 4767792 - DNA, 12 bp, Homo sapiens
gaacctttgtca

SEQ ID NO: 4767793 - DNA, 18 bp, Homo sapiens
gaacgatccttcaaagtc

SEQ ID NO: 4767794 - DNA, 18 bp, Homo sapiens
gaacgcacaacatgcaca

SEQ ID NO: 4767795 - DNA, 13 bp, Homo sapiens
gaacgcatgcagg

SEQ ID NO: 4767796 - DNA, 12 bp, Homo sapiens
gaacgcttgctc

SEQ ID NO: 4767797 - DNA, 23 bp, Homo sapiens
gaacgtgggagttcagctgcttc

SEQ ID NO: 4767798 - DNA, 16 bp, Homo sapiens
gaactcacagactgct

SEQ ID NO: 4767799 - DNA, 14 bp, Homo sapiens
gaactcccccagag

SEQ ID NO: 4767800 - DNA, 14 bp, Homo sapiens
gaactcccttctcc

SEQ ID NO: 4767801 - DNA, 13 bp, Homo sapiens
gaactccttggcc

SEQ ID NO: 4767802 - DNA, 15 bp, Homo sapiens
gaactcgccacctgc

SEQ ID NO: 4767803 - DNA, 17 bp, Homo sapiens
gaactgaagcagagtca

SEQ ID NO: 4767804 - DNA, 12 bp, Homo sapiens
gaactggcccca

SEQ ID NO: 4767805 - DNA, 14 bp, Homo sapiens
gaactggccccagc

SEQ ID NO: 4767806 - DNA, 23 bp, Homo sapiens
gaactgtcttagtcataccatcc

SEQ ID NO: 4767807 - DNA, 19 bp, Homo sapiens
gaactgtgaatatgtgtaa

SEQ ID NO: 4767808 - DNA, 12 bp, Homo sapiens
gaacttcatgct

SEQ ID NO: 4767809 - DNA, 16 bp, Homo sapiens
gaacttggcgctgccc

SEQ ID NO: 4767810 - DNA, 18 bp, Homo sapiens
gaacttggcgctgcccct

SEQ ID NO: 4767811 - DNA, 23 bp, Homo sapiens
gaacttggttcccatttgctcct

SEQ ID NO: 4767812 - DNA, 14 bp, Homo sapiens
gaactttaaaagaa

SEQ ID NO: 4767813 - DNA, 22 bp, Homo sapiens
gaagaaaatggatgacaaagaa

SEQ ID NO: 4767814 - DNA, 15 bp, Homo sapiens
gaagaaacacagcat

SEQ ID NO: 4767815 - DNA, 19 bp, Homo sapiens
gaagaaagaacggaagaag

SEQ ID NO: 4767816 - DNA, 17 bp, Homo sapiens
gaagaactcatgtgatt

SEQ ID NO: 4767817 - DNA, 16 bp, Homo sapiens
gaagaactgacttcct

SEQ ID NO: 4767818 - DNA, 22 bp, Homo sapiens
gaagaagggaaattcacactgt

SEQ ID NO: 4767819 - DNA, 14 bp, Homo sapiens
gaagaatattgtat

SEQ ID NO: 4767820 - DNA, 15 bp, Homo sapiens
gaagaatattgtatt

SEQ ID NO: 4767821 - DNA, 14 bp, Homo sapiens
gaagaattggcaga

SEQ ID NO: 4767822 - DNA, 21 bp, Homo sapiens
gaagacaccagagtgtatgca

SEQ ID NO: 4767823 - DNA, 15 bp, Homo sapiens
gaagacagagatggc

SEQ ID NO: 4767824 - DNA, 21 bp, Homo sapiens
gaagacagagatggcagagcc

SEQ ID NO: 4767825 - DNA, 15 bp, Homo sapiens
gaagacagagctaca

SEQ ID NO: 4767826 - DNA, 13 bp, Homo sapiens
gaagacagctctt

SEQ ID NO: 4767827 - DNA, 21 bp, Homo sapiens
gaagaccacatgcgctcctgg

SEQ ID NO: 4767828 - DNA, 15 bp, Homo sapiens
gaagaccctcagtta

SEQ ID NO: 4767829 - DNA, 16 bp, Homo sapiens
gaagaccttctgaaga

SEQ ID NO: 4767830 - DNA, 13 bp, Homo sapiens
gaagagaaggagc

SEQ ID NO: 4767831 - DNA, 15 bp, Homo sapiens
gaagagaaggagcag

SEQ ID NO: 4767832 - DNA, 14 bp, Homo sapiens
gaagagagaggcct

SEQ ID NO: 4767833 - DNA, 19 bp, Homo sapiens
gaagagagaggcctgggtg

SEQ ID NO: 4767834 - DNA, 19 bp, Homo sapiens
gaagagagtatggtgctgg

SEQ ID NO: 4767835 - DNA, 17 bp, Homo sapiens
gaagagatcaggaagag

SEQ ID NO: 4767836 - DNA, 18 bp, Homo sapiens
gaagagggaactaagcat

SEQ ID NO: 4767837 - DNA, 17 bp, Homo sapiens
gaagagggaggggccct

SEQ ID NO: 4767838 - DNA, 20 bp, Homo sapiens
gaagaggggcgctgccccca

SEQ ID NO: 4767839 - DNA, 15 bp, Homo sapiens
gatgtttagtagctg

SEQ ID NO: 4767840 - DNA, 16 bp, Homo sapiens
gatgtttgagcagtgg

SEQ ID NO: 4767841 - DNA, 16 bp, Homo sapiens
gattaaactgggaaat

SEQ ID NO: 4767842 - DNA, 20 bp, Homo sapiens
gattaaactgggaaatgaga

SEQ ID NO: 4767843 - DNA, 21 bp, Homo sapiens
gattaacaggtatgaaccacc

SEQ ID NO: 4767844 - DNA, 20 bp, Homo sapiens
gattaagttataccagcaaa

SEQ ID NO: 4767845 - DNA, 22 bp, Homo sapiens
gattaagttataccagcaaaag

SEQ ID NO: 4767846 - DNA, 14 bp, Homo sapiens
gattaatttgtgta

SEQ ID NO: 4767847 - DNA, 13 bp, Homo sapiens
gattacagaaaca

SEQ ID NO: 4767848 - DNA, 22 bp, Homo sapiens
gattacaggtgtgagccaccac

SEQ ID NO: 4767849 - DNA, 14 bp, Homo sapiens
gattataatcagaa

SEQ ID NO: 4767850 - DNA, 14 bp, Homo sapiens
gattatgaaatgcc

SEQ ID NO: 4767851 - DNA, 15 bp, Homo sapiens
gattatgaaatgcca

SEQ ID NO: 4767852 - DNA, 15 bp, Homo sapiens
gattattttctatat

SEQ ID NO: 4767853 - DNA, 21 bp, Homo sapiens
gattcaaataaccctgaatca

SEQ ID NO: 4767854 - DNA, 10 bp, Homo sapiens
gattcaaatt

SEQ ID NO: 4767855 - DNA, 13 bp, Homo sapiens
gattcaacatcaa

SEQ ID NO: 4767856 - DNA, 11 bp, Homo sapiens
gattcaatgtg

SEQ ID NO: 4767857 - DNA, 20 bp, Homo sapiens
gattcacctgtaaaacttta

SEQ ID NO: 4767858 - DNA, 22 bp, Homo sapiens
gattcacctgtaaaactttatt

SEQ ID NO: 4767859 - DNA, 19 bp, Homo sapiens
gattcccgtggctttgtgc

SEQ ID NO: 4767860 - DNA, 20 bp, Homo sapiens
gattcccgtggctttgtgct

SEQ ID NO: 4767861 - DNA, 17 bp, Homo sapiens
gattcctacttaaacaa

SEQ ID NO: 4767862 - DNA, 14 bp, Homo sapiens
gattccttcttccc

SEQ ID NO: 4767863 - DNA, 15 bp, Homo sapiens
gattctaaaggggac

SEQ ID NO: 4767864 - DNA, 17 bp, Homo sapiens
gattctaaaggggacag

SEQ ID NO: 4767865 - DNA, 19 bp, Homo sapiens
gattctaaaggggacagat

SEQ ID NO: 4767866 - DNA, 17 bp, Homo sapiens
gattcttaccctttctt

SEQ ID NO: 4767867 - DNA, 22 bp, Homo sapiens
gattcttccttgccacaatcac

SEQ ID NO: 4767868 - DNA, 23 bp, Homo sapiens
gattctttcaatccacagtattg

SEQ ID NO: 4767869 - DNA, 16 bp, Homo sapiens
gattcttttttcaatg

SEQ ID NO: 4767870 - DNA, 17 bp, Homo sapiens
gattcttttttcaatgt

SEQ ID NO: 4767871 - DNA, 18 bp, Homo sapiens
gattcttttttcaatgta

SEQ ID NO: 4767872 - DNA, 21 bp, Homo sapiens
gattgacattttgtagctagt

SEQ ID NO: 4767873 - DNA, 19 bp, Homo sapiens
gattgtaaaggtaggtgca

SEQ ID NO: 4767874 - DNA, 21 bp, Homo sapiens
gattgtcaccatgatcactta

SEQ ID NO: 4767875 - DNA, 18 bp, Homo sapiens
gattgtccacaaatgtcc

SEQ ID NO: 4767876 - DNA, 19 bp, Homo sapiens
gattgtccacaaatgtcct

SEQ ID NO: 4767877 - DNA, 18 bp, Homo sapiens
gattgtgctctgcagcga

SEQ ID NO: 4767878 - DNA, 17 bp, Homo sapiens
gattgttcctccccagc

SEQ ID NO: 4767879 - DNA, 15 bp, Homo sapiens
gatttaattcttacc

SEQ ID NO: 4767880 - DNA, 17 bp, Homo sapiens
gatttattctcagaaca

SEQ ID NO: 4767881 - DNA, 20 bp, Homo sapiens
gatttattctcagaacacca

SEQ ID NO: 4767882 - DNA, 22 bp, Homo sapiens
gatttattttttgtaactcttt

SEQ ID NO: 4767883 - DNA, 20 bp, Homo sapiens
gatttcaatgattgtttaat

SEQ ID NO: 4767884 - DNA, 12 bp, Homo sapiens
gatttcagaaac

SEQ ID NO: 4767885 - DNA, 23 bp, Homo sapiens
gatttccatccaaacctacctta

SEQ ID NO: 4767886 - DNA, 20 bp, Homo sapiens
gatttgatatacagacctcc

SEQ ID NO: 4767887 - DNA, 18 bp, Homo sapiens
gcactgagcgcctgcaga

SEQ ID NO: 4767888 - DNA, 13 bp, Homo sapiens
gcactgccctccg

SEQ ID NO: 4767889 - DNA, 12 bp, Homo sapiens
gcactggccttg

SEQ ID NO: 4767890 - DNA, 19 bp, Homo sapiens
gcactggccttgcctccag

SEQ ID NO: 4767891 - DNA, 16 bp, Homo sapiens
gcactgtcatgcccag

SEQ ID NO: 4767892 - DNA, 21 bp, Homo sapiens
gcacttcaagcaaagacagtt

SEQ ID NO: 4767893 - DNA, 18 bp, Homo sapiens
gcagaaggaagacttcat

SEQ ID NO: 4767894 - DNA, 16 bp, Homo sapiens
gcagaatgagatgatt

SEQ ID NO: 4767895 - DNA, 17 bp, Homo sapiens
gcagaatgagatgattt

SEQ ID NO: 4767896 - DNA, 23 bp, Homo sapiens
gcagaatgagatgatttaattct

SEQ ID NO: 4767897 - DNA, 19 bp, Homo sapiens
gcagaatggtgggctccag

SEQ ID NO: 4767898 - DNA, 13 bp, Homo sapiens
gcagaattcattc

SEQ ID NO: 4767899 - DNA, 17 bp, Homo sapiens
gcagacagacagacaga

SEQ ID NO: 4767900 - DNA, 17 bp, Homo sapiens
gcagacagggcgtcctc

SEQ ID NO: 4767901 - DNA, 17 bp, Homo sapiens
gcagacagttaagagaa

SEQ ID NO: 4767902 - DNA, 17 bp, Homo sapiens
gcagaccagagagctca

SEQ ID NO: 4767903 - DNA, 22 bp, Homo sapiens
gcagaccccaccctgtctgcag

SEQ ID NO: 4767904 - DNA, 23 bp, Homo sapiens
gcagaccccaccctgtctgcagg

SEQ ID NO: 4767905 - DNA, 22 bp, Homo sapiens
gcagacgcaagaggtttcagca

SEQ ID NO: 4767906 - DNA, 20 bp, Homo sapiens
gcagacggggggctgcgggc

SEQ ID NO: 4767907 - DNA, 21 bp, Homo sapiens
gcagacggggggctgcgggcg

SEQ ID NO: 4767908 - DNA, 17 bp, Homo sapiens
gcagagaactcataaag

SEQ ID NO: 4767909 - DNA, 15 bp, Homo sapiens
gcagagaccaccgcg

SEQ ID NO: 4767910 - DNA, 20 bp, Homo sapiens
gcagagaccaccgcgcccct

SEQ ID NO: 4767911 - DNA, 17 bp, Homo sapiens
gcagagacggcagcccc

SEQ ID NO: 4767912 - DNA, 18 bp, Homo sapiens
gcagagacggcagcccca

SEQ ID NO: 4767913 - DNA, 17 bp, Homo sapiens
gcagagccatccaccct

SEQ ID NO: 4767914 - DNA, 23 bp, Homo sapiens
gcagagccatccaccctgaggag

SEQ ID NO: 4767915 - DNA, 16 bp, Homo sapiens
gcagagccccggagca

SEQ ID NO: 4767916 - DNA, 20 bp, Homo sapiens
gcagagccccggagcaccac

SEQ ID NO: 4767917 - DNA, 16 bp, Homo sapiens
gcagagcgcagccccc

SEQ ID NO: 4767918 - DNA, 20 bp, Homo sapiens
gcagagctgagtcggctggg

SEQ ID NO: 4767919 - DNA, 21 bp, Homo sapiens
gcagagctgatggagaaggaa

SEQ ID NO: 4767920 - DNA, 15 bp, Homo sapiens
gcagaggcagggccc

SEQ ID NO: 4767921 - DNA, 20 bp, Homo sapiens
gcagaggcagggccctgggg

SEQ ID NO: 4767922 - DNA, 18 bp, Homo sapiens
gcagagggatgaaatgcc

SEQ ID NO: 4767923 - DNA, 20 bp, Homo sapiens
gcagaggtggggtgctgggg

SEQ ID NO: 4767924 - DNA, 22 bp, Homo sapiens
gcagagtatacaagtgtttcta

SEQ ID NO: 4767925 - DNA, 22 bp, Homo sapiens
gcagagtcaagctgatgaagtt

SEQ ID NO: 4767926 - DNA, 19 bp, Homo sapiens
gcagagttgaagacagagc

SEQ ID NO: 4767927 - DNA, 15 bp, Homo sapiens
gcagatctagccagg

SEQ ID NO: 4767928 - DNA, 18 bp, Homo sapiens
gcagatctagccaggcct

SEQ ID NO: 4767929 - DNA, 16 bp, Homo sapiens
gcagcaacaggaccag

SEQ ID NO: 4767930 - DNA, 20 bp, Homo sapiens
gcagcacagctactcagatc

SEQ ID NO: 4767931 - DNA, 14 bp, Homo sapiens
gcagcaccagcctg

SEQ ID NO: 4767932 - DNA, 21 bp, Homo sapiens
gcagcaccagcctgagccaca

SEQ ID NO: 4767933 - DNA, 22 bp, Homo sapiens
gcagcaccagcctgagccacag

SEQ ID NO: 4767934 - DNA, 23 bp, Homo sapiens
gcagcaccagcctgagccacagt

SEQ ID NO: 4767935 - DNA, 19 bp, Homo sapiens
gcagcaccctcccccgcag

SEQ ID NO: 4767936 - DNA, 20 bp, Homo sapiens
gcagcagagagaaataaaac

SEQ ID NO: 4767937 - DNA, 15 bp, Homo sapiens
gcagcagcagcagca

SEQ ID NO: 4767938 - DNA, 15 bp, Homo sapiens
gcagcaggggaaaga

SEQ ID NO: 4767939 - DNA, 21 bp, Homo sapiens
gcagcaggggaaagattatat

SEQ ID NO: 4767940 - DNA, 16 bp, Homo sapiens
gcagcagtaccatccc

SEQ ID NO: 4767941 - DNA, 17 bp, Homo sapiens
gcagcagtaccatccca

SEQ ID NO: 4767942 - DNA, 11 bp, Homo sapiens
gcagcccagag

SEQ ID NO: 4767943 - DNA, 14 bp, Homo sapiens
gcagcccagagaga

SEQ ID NO: 4767944 - DNA, 13 bp, Homo sapiens
gcagcccccacgc

SEQ ID NO: 4767945 - DNA, 13 bp, Homo sapiens
gcagccccccacg

SEQ ID NO: 4767946 - DNA, 14 bp, Homo sapiens
gcagccccccagca

SEQ ID NO: 4767947 - DNA, 15 bp, Homo sapiens
gcagccccccagcac

SEQ ID NO: 4767948 - DNA, 13 bp, Homo sapiens
gcagccccctgct

SEQ ID NO: 4767949 - DNA, 17 bp, Homo sapiens
gcagccccctgcttctc

SEQ ID NO: 4767950 - DNA, 23 bp, Homo sapiens
gcagccccctgcttctcccgcca

SEQ ID NO: 4767951 - DNA, 22 bp, Homo sapiens
gcagccccgcgaccacccctgt

SEQ ID NO: 4767952 - DNA, 20 bp, Homo sapiens
gcagcccctgttctggcaga

SEQ ID NO: 4767953 - DNA, 17 bp, Homo sapiens
gcagcccgatgtccctg

SEQ ID NO: 4767954 - DNA, 16 bp, Homo sapiens
gcagccctgcagaggg

SEQ ID NO: 4767955 - DNA, 14 bp, Homo sapiens
gcagccgccttcct

SEQ ID NO: 4767956 - DNA, 16 bp, Homo sapiens
gcagccgccttccttg

SEQ ID NO: 4767957 - DNA, 20 bp, Homo sapiens
gcagccgccttccttgacct

SEQ ID NO: 4767958 - DNA, 19 bp, Homo sapiens
gcagccgcgctctgcccct

SEQ ID NO: 4767959 - DNA, 21 bp, Homo sapiens
gcagccgcgctctgcccctcc

SEQ ID NO: 4767960 - DNA, 13 bp, Homo sapiens
gcagcctcttgaa

SEQ ID NO: 4767961 - DNA, 14 bp, Homo sapiens
gcagcctcttgaat

SEQ ID NO: 4767962 - DNA, 11 bp, Homo sapiens
gcagcctgagc

SEQ ID NO: 4767963 - DNA, 13 bp, Homo sapiens
gcagcctgagctc

SEQ ID NO: 4767964 - DNA, 17 bp, Homo sapiens
gcagcctgagctccacc

SEQ ID NO: 4767965 - DNA, 18 bp, Homo sapiens
gcagcctgagctccaccc

SEQ ID NO: 4767966 - DNA, 20 bp, Homo sapiens
gcagcctgagctccaccctc

SEQ ID NO: 4767967 - DNA, 15 bp, Homo sapiens
gcagcgcccagcctg

SEQ ID NO: 4767968 - DNA, 17 bp, Homo sapiens
gcagcgcccagcctggc

SEQ ID NO: 4767969 - DNA, 12 bp, Homo sapiens
gcagcgcctccc

SEQ ID NO: 4767970 - DNA, 13 bp, Homo sapiens
gcagcgcctcccg

SEQ ID NO: 4767971 - DNA, 17 bp, Homo sapiens
gcagcggcagcagcagc

SEQ ID NO: 4767972 - DNA, 18 bp, Homo sapiens
gcagctaatttgtgaaag

SEQ ID NO: 4767973 - DNA, 18 bp, Homo sapiens
gcagctccaacctggagg

SEQ ID NO: 4767974 - DNA, 18 bp, Homo sapiens
gcagctgcaccagcaggt

SEQ ID NO: 4767975 - DNA, 16 bp, Homo sapiens
gcagctggactgggtg

SEQ ID NO: 4767976 - DNA, 20 bp, Homo sapiens
gcagctggatggggcggcct

SEQ ID NO: 4767977 - DNA, 21 bp, Homo sapiens
gcagctggggggctgtcctga

SEQ ID NO: 4767978 - DNA, 21 bp, Homo sapiens
gcagcttgggagagcccctgg

SEQ ID NO: 4767979 - DNA, 18 bp, Homo sapiens
gcaggaaaaggctgcagc

SEQ ID NO: 4767980 - DNA, 18 bp, Homo sapiens
gcaggaaccgaggactcc

SEQ ID NO: 4767981 - DNA, 16 bp, Homo sapiens
gcaggaagacttccag

SEQ ID NO: 4767982 - DNA, 18 bp, Homo sapiens
gcaggaagagatgctcta

SEQ ID NO: 4767983 - DNA, 19 bp, Homo sapiens
gcaggaagtcaggagccag

SEQ ID NO: 4767984 - DNA, 20 bp, Homo sapiens
gcaggaagtcaggagccagc

SEQ ID NO: 4767985 - DNA, 19 bp, Homo sapiens
gcaggaatcaaaaattgaa

SEQ ID NO: 4767986 - DNA, 13 bp, Homo sapiens
gcaggaccaggca

SEQ ID NO: 4767987 - DNA, 11 bp, Homo sapiens
gcaggagctca

SEQ ID NO: 4767988 - DNA, 15 bp, Homo sapiens
gcaggagttcctttc

SEQ ID NO: 4767989 - DNA, 16 bp, Homo sapiens
gcaggagttcctttcc

SEQ ID NO: 4767990 - DNA, 18 bp, Homo sapiens
gcaggatgattgtacaga

SEQ ID NO: 4767991 - DNA, 13 bp, Homo sapiens
gcaggcaaaggcc

SEQ ID NO: 4767992 - DNA, 20 bp, Homo sapiens
gcaggcaagacaccttccca

SEQ ID NO: 4767993 - DNA, 18 bp, Homo sapiens
gcaggcacacagcagccc

SEQ ID NO: 4767994 - DNA, 19 bp, Homo sapiens
gcaggcacacagcagcccc

SEQ ID NO: 4767995 - DNA, 15 bp, Homo sapiens
gcaggcagcctgcag

SEQ ID NO: 4767996 - DNA, 12 bp, Homo sapiens
gcaggctctcag

SEQ ID NO: 4767997 - DNA, 20 bp, Homo sapiens
gcaggctctcaggccagctg

SEQ ID NO: 4767998 - DNA, 21 bp, Homo sapiens
gcaggcttcgtttgcctccag

SEQ ID NO: 4767999 - DNA, 15 bp, Homo sapiens
gcagggacagttggg

SEQ ID NO: 4768000 - DNA, 20 bp, Homo sapiens
gcagggaggtcaggccctgg

SEQ ID NO: 4768001 - DNA, 17 bp, Homo sapiens
gcagggcccccactgga

SEQ ID NO: 4768002 - DNA, 23 bp, Homo sapiens
gcagggccctggggtctctgagc

SEQ ID NO: 4768003 - DNA, 18 bp, Homo sapiens
gcagggccgcagggcgct

SEQ ID NO: 4768004 - DNA, 17 bp, Homo sapiens
gcagggcgggccaggag

SEQ ID NO: 4768005 - DNA, 14 bp, Homo sapiens
gcagggctgggcgc

SEQ ID NO: 4768006 - DNA, 23 bp, Homo sapiens
gcagggctgggcgcctctgtcct

SEQ ID NO: 4768007 - DNA, 22 bp, Homo sapiens
gcaggggagggtagagcggaga

SEQ ID NO: 4768008 - DNA, 20 bp, Homo sapiens
gcaggggcccctcctccaga

SEQ ID NO: 4768009 - DNA, 14 bp, Homo sapiens
gcaggggggttggg

SEQ ID NO: 4768010 - DNA, 22 bp, Homo sapiens
gcaggggggttgggttccagac

SEQ ID NO: 4768011 - DNA, 23 bp, Homo sapiens
gcaggggggttgggttccagaca

SEQ ID NO: 4768012 - DNA, 18 bp, Homo sapiens
gcagggttctagaagggg

SEQ ID NO: 4768013 - DNA, 21 bp, Homo sapiens
gcaggtcctgcccatgtgtcc

SEQ ID NO: 4768014 - DNA, 18 bp, Homo sapiens
gcaggtgaccagaatgag

SEQ ID NO: 4768015 - DNA, 15 bp, Homo sapiens
gcaggttctctcctg

SEQ ID NO: 4768016 - DNA, 17 bp, Homo sapiens
gcaggttctctcctgtg

SEQ ID NO: 4768017 - DNA, 18 bp, Homo sapiens
gcaggttctctcctgtga

SEQ ID NO: 4768018 - DNA, 20 bp, Homo sapiens
gcagtaccatcccactgata

SEQ ID NO: 4768019 - DNA, 14 bp, Homo sapiens
gcagtagtgccaaa

SEQ ID NO: 4768020 - DNA, 22 bp, Homo sapiens
gcagtagtgccaaaaggcccct

SEQ ID NO: 4768021 - DNA, 23 bp, Homo sapiens
gcagtagtgccaaaaggcccctt

SEQ ID NO: 4768022 - DNA, 18 bp, Homo sapiens
gcagtcagcacagagagc

SEQ ID NO: 4768023 - DNA, 22 bp, Homo sapiens
gcagtcagcacagagagcggct

SEQ ID NO: 4768024 - DNA, 15 bp, Homo sapiens
gcagtcagcggagag

SEQ ID NO: 4768025 - DNA, 20 bp, Homo sapiens
gcagtctgtggagcgtcctt

SEQ ID NO: 4768026 - DNA, 15 bp, Homo sapiens
gcagtggagagggga

SEQ ID NO: 4768027 - DNA, 15 bp, Homo sapiens
gcagtggtgatgcct

SEQ ID NO: 4768028 - DNA, 21 bp, Homo sapiens
gcagtggtgatgcctaaagga

SEQ ID NO: 4768029 - DNA, 20 bp, Homo sapiens
gcagtgtatttaatgtttgt

SEQ ID NO: 4768030 - DNA, 16 bp, Homo sapiens
gcagtgttcgcttggc

SEQ ID NO: 4768031 - DNA, 16 bp, Homo sapiens
gcagttatttaccaga

SEQ ID NO: 4768032 - DNA, 18 bp, Homo sapiens
gcagtttcagataaatca

SEQ ID NO: 4768033 - DNA, 12 bp, Homo sapiens
gcataacacagc

SEQ ID NO: 4768034 - DNA, 20 bp, Homo sapiens
gcatacaaatctcactgtat

SEQ ID NO: 4768035 - DNA, 18 bp, Homo sapiens
gcataccagttcttgcaa

SEQ ID NO: 4768036 - DNA, 21 bp, Homo sapiens
gcataccagttcttgcaataa

SEQ ID NO: 4768037 - DNA, 18 bp, Homo sapiens
gcatacgtattgttaaat

SEQ ID NO: 4768038 - DNA, 14 bp, Homo sapiens
gcatagacaagtgt

SEQ ID NO: 4768039 - DNA, 16 bp, Homo sapiens
gcatagccattcattt

SEQ ID NO: 4768040 - DNA, 14 bp, Homo sapiens
gcataggctgggga

SEQ ID NO: 4768041 - DNA, 20 bp, Homo sapiens
gcatagggtttggaagaaag

SEQ ID NO: 4768042 - DNA, 21 bp, Homo sapiens
gcatagggtttggaagaaagg

SEQ ID NO: 4768043 - DNA, 14 bp, Homo sapiens
gcatataaatgttt

SEQ ID NO: 4768044 - DNA, 21 bp, Homo sapiens
gcatattagcatcatgtcttt

SEQ ID NO: 4768045 - DNA, 18 bp, Homo sapiens
gcatattgataataaaat

SEQ ID NO: 4768046 - DNA, 21 bp, Homo sapiens
gcatcaagatgtgacatgttt

SEQ ID NO: 4768047 - DNA, 19 bp, Homo sapiens
gcatcatcttgaacattaa

SEQ ID NO: 4768048 - DNA, 16 bp, Homo sapiens
gcatccccagtgccag

SEQ ID NO: 4768049 - DNA, 16 bp, Homo sapiens
gcatcccttggcccct

SEQ ID NO: 4768050 - DNA, 20 bp, Homo sapiens
gcatcccttggcccctctct

SEQ ID NO: 4768051 - DNA, 18 bp, Homo sapiens
gcatccgctgcgctccca

SEQ ID NO: 4768052 - DNA, 17 bp, Homo sapiens
gcatcctcagccccagg

SEQ ID NO: 4768053 - DNA, 22 bp, Homo sapiens
gcatcctggaaatttgtgtgct

SEQ ID NO: 4768054 - DNA, 18 bp, Homo sapiens
gcatcgtgtgggtcccta

SEQ ID NO: 4768055 - DNA, 21 bp, Homo sapiens
gcatctctccccatatataaa

SEQ ID NO: 4768056 - DNA, 16 bp, Homo sapiens
gcatctgaaagttttg

SEQ ID NO: 4768057 - DNA, 13 bp, Homo sapiens
gcatctggcctat

SEQ ID NO: 4768058 - DNA, 16 bp, Homo sapiens
gcatctgtggcctggg

SEQ ID NO: 4768059 - DNA, 15 bp, Homo sapiens
gcatgagaactaaat

SEQ ID NO: 4768060 - DNA, 15 bp, Homo sapiens
gcatgagaatgtcat

SEQ ID NO: 4768061 - DNA, 22 bp, Homo sapiens
gcatgagaatgtcatttgctaa

SEQ ID NO: 4768062 - DNA, 13 bp, Homo sapiens
gcatgagttctgc

SEQ ID NO: 4768063 - DNA, 23 bp, Homo sapiens
gcatgagttctgcacatacagat

SEQ ID NO: 4768064 - DNA, 13 bp, Homo sapiens
gcatgcagggccc

SEQ ID NO: 4768065 - DNA, 11 bp, Homo sapiens
gcatgcctctg

SEQ ID NO: 4768066 - DNA, 21 bp, Homo sapiens
gcatgctgcctgcctccggcc

SEQ ID NO: 4768067 - DNA, 20 bp, Homo sapiens
gcatggccgcaacttcccag

SEQ ID NO: 4768068 - DNA, 17 bp, Homo sapiens
gcatggcctcccagcca

SEQ ID NO: 4768069 - DNA, 19 bp, Homo sapiens
gcatggcctcccagccacc

SEQ ID NO: 4768070 - DNA, 17 bp, Homo sapiens
gcatggtaccagccctg

SEQ ID NO: 4768071 - DNA, 22 bp, Homo sapiens
gcatggtaccagccctggggct

SEQ ID NO: 4768072 - DNA, 13 bp, Homo sapiens
gcatgtatgccat

SEQ ID NO: 4768073 - DNA, 22 bp, Homo sapiens
gcatgtgttaatcttaatgtat

SEQ ID NO: 4768074 - DNA, 13 bp, Homo sapiens
gcatgttaaaata

SEQ ID NO: 4768075 - DNA, 23 bp, Homo sapiens
gcatgtttcccgctccaagagaa

SEQ ID NO: 4768076 - DNA, 15 bp, Homo sapiens
gcattactattaact

SEQ ID NO: 4768077 - DNA, 22 bp, Homo sapiens
gcattccaggggctgcagcccc

SEQ ID NO: 4768078 - DNA, 12 bp, Homo sapiens
gcattcccaatt

SEQ ID NO: 4768079 - DNA, 15 bp, Homo sapiens
gcattctgcagcccg

SEQ ID NO: 4768080 - DNA, 23 bp, Homo sapiens
gcattgcactaaaagtgatgtga

SEQ ID NO: 4768081 - DNA, 18 bp, Homo sapiens
gcattgctggactgatgg

SEQ ID NO: 4768082 - DNA, 16 bp, Homo sapiens
gcattggggggccggg

SEQ ID NO: 4768083 - DNA, 13 bp, Homo sapiens
gcatttagcacag

SEQ ID NO: 4768084 - DNA, 16 bp, Homo sapiens
gcatttagcatgagtt

SEQ ID NO: 4768085 - DNA, 17 bp, Homo sapiens
gcatttagcatgagttc

SEQ ID NO: 4768086 - DNA, 19 bp, Homo sapiens
gcatttagcatgagttctg

SEQ ID NO: 4768087 - DNA, 10 bp, Homo sapiens
gcatttatgc

SEQ ID NO: 4768088 - DNA, 16 bp, Homo sapiens
gcatttatgcatgaga

SEQ ID NO: 4768089 - DNA, 24 bp, Homo sapiens
gcatttatgcatgagaactaaata

SEQ ID NO: 4768090 - DNA, 13 bp, Homo sapiens
gagaggcggcctc

SEQ ID NO: 4768091 - DNA, 15 bp, Homo sapiens
gagagggctgagccc

SEQ ID NO: 4768092 - DNA, 16 bp, Homo sapiens
gagagggctgagcccc

SEQ ID NO: 4768093 - DNA, 19 bp, Homo sapiens
gagagggctgagcccctcc

SEQ ID NO: 4768094 - DNA, 22 bp, Homo sapiens
gagagggtgtgggtgccctgtt

SEQ ID NO: 4768095 - DNA, 21 bp, Homo sapiens
gagatagccaaggccaaagga

SEQ ID NO: 4768096 - DNA, 14 bp, Homo sapiens
gagatattttgtaa

SEQ ID NO: 4768097 - DNA, 22 bp, Homo sapiens
gagatattttgtaaaatgtatt

SEQ ID NO: 4768098 - DNA, 13 bp, Homo sapiens
gagatcaggaaga

SEQ ID NO: 4768099 - DNA, 22 bp, Homo sapiens
gagatcctcaaaaatcatcaaa

SEQ ID NO: 4768100 - DNA, 15 bp, Homo sapiens
gagatgaggctggat

SEQ ID NO: 4768101 - DNA, 21 bp, Homo sapiens
gagatgatgccatgggccctc

SEQ ID NO: 4768102 - DNA, 23 bp, Homo sapiens
gagatgcatctgtggcctggggc

SEQ ID NO: 4768103 - DNA, 22 bp, Homo sapiens
gagatggacagttcacaccctg

SEQ ID NO: 4768104 - DNA, 15 bp, Homo sapiens
gagatggcagagcca

SEQ ID NO: 4768105 - DNA, 21 bp, Homo sapiens
gagatggggagggcgcttttg

SEQ ID NO: 4768106 - DNA, 17 bp, Homo sapiens
gagatggtgccccctgg

SEQ ID NO: 4768107 - DNA, 18 bp, Homo sapiens
gagatgtaccatgttaaa

SEQ ID NO: 4768108 - DNA, 17 bp, Homo sapiens
gagattggaaaaaatta

SEQ ID NO: 4768109 - DNA, 14 bp, Homo sapiens
gagattggaaggaa

SEQ ID NO: 4768110 - DNA, 19 bp, Homo sapiens
gagattggatcaagtatta

SEQ ID NO: 4768111 - DNA, 15 bp, Homo sapiens
gagatttgtatttat

SEQ ID NO: 4768112 - DNA, 17 bp, Homo sapiens
gagatttgtatttatat

SEQ ID NO: 4768113 - DNA, 17 bp, Homo sapiens
gagcaaagatggcttcc

SEQ ID NO: 4768114 - DNA, 17 bp, Homo sapiens
gagcaaggcaagaagtg

SEQ ID NO: 4768115 - DNA, 20 bp, Homo sapiens
gagcaaggcaagaagtggga

SEQ ID NO: 4768116 - DNA, 12 bp, Homo sapiens
gagcaaggctgc

SEQ ID NO: 4768117 - DNA, 22 bp, Homo sapiens
gagcaaggctgctaagtggaag

SEQ ID NO: 4768118 - DNA, 20 bp, Homo sapiens
gagcaatcttgctgtgaaac

SEQ ID NO: 4768119 - DNA, 12 bp, Homo sapiens
gagcacagccat

SEQ ID NO: 4768120 - DNA, 18 bp, Homo sapiens
gagcacagccatagcaga

SEQ ID NO: 4768121 - DNA, 20 bp, Homo sapiens
gagcacagctttcctgggtc

SEQ ID NO: 4768122 - DNA, 22 bp, Homo sapiens
gagcaccacggggtcgggggag

SEQ ID NO: 4768123 - DNA, 13 bp, Homo sapiens
gagcacccccagc

SEQ ID NO: 4768124 - DNA, 19 bp, Homo sapiens
gagcacccccagcctcccc

SEQ ID NO: 4768125 - DNA, 18 bp, Homo sapiens
gagcactagaatgagaaa

SEQ ID NO: 4768126 - DNA, 17 bp, Homo sapiens
gagcagagcgcagcccc

SEQ ID NO: 4768127 - DNA, 19 bp, Homo sapiens
gagcagagcgcagccccca

SEQ ID NO: 4768128 - DNA, 21 bp, Homo sapiens
gagcagagcgcagcccccacg

SEQ ID NO: 4768129 - DNA, 20 bp, Homo sapiens
gagcagagctgatggagaag

SEQ ID NO: 4768130 - DNA, 18 bp, Homo sapiens
gagcaggcggtggggaga

SEQ ID NO: 4768131 - DNA, 20 bp, Homo sapiens
gagcagtggccgggctgggg

SEQ ID NO: 4768132 - DNA, 11 bp, Homo sapiens
gagcagtgggg

SEQ ID NO: 4768133 - DNA, 18 bp, Homo sapiens
gagcatgcccaaatataa

SEQ ID NO: 4768134 - DNA, 21 bp, Homo sapiens
gagcatgcccaaatataacat

SEQ ID NO: 4768135 - DNA, 23 bp, Homo sapiens
gagcatgcccaaatataacatga

SEQ ID NO: 4768136 - DNA, 16 bp, Homo sapiens
gagcattctggggtgg

SEQ ID NO: 4768137 - DNA, 21 bp, Homo sapiens
gagccaataaagctcacactt

SEQ ID NO: 4768138 - DNA, 14 bp, Homo sapiens
gagccacagggacg

SEQ ID NO: 4768139 - DNA, 19 bp, Homo sapiens
gagccacagtggggcccat

SEQ ID NO: 4768140 - DNA, 20 bp, Homo sapiens
gagccacagtggggcccatg

SEQ ID NO: 4768141 - DNA, 15 bp, Homo sapiens
gagccagcagggcgg

SEQ ID NO: 4768142 - DNA, 20 bp, Homo sapiens
gagccagcagggcgggccag

SEQ ID NO: 4768143 - DNA, 23 bp, Homo sapiens
gagccagcagggcgggccaggag

SEQ ID NO: 4768144 - DNA, 13 bp, Homo sapiens
gagccatccaccc

SEQ ID NO: 4768145 - DNA, 15 bp, Homo sapiens
gagccatccaccctg

SEQ ID NO: 4768146 - DNA, 17 bp, Homo sapiens
gagccatccaccctgag

SEQ ID NO: 4768147 - DNA, 19 bp, Homo sapiens
gagccatccaccctgagga

SEQ ID NO: 4768148 - DNA, 22 bp, Homo sapiens
gagccatccaccctgaggagtg

SEQ ID NO: 4768149 - DNA, 13 bp, Homo sapiens
gagccatgctctt

SEQ ID NO: 4768150 - DNA, 14 bp, Homo sapiens
gagccatgctctta

SEQ ID NO: 4768151 - DNA, 22 bp, Homo sapiens
gagcccacggctaagaggctgc

SEQ ID NO: 4768152 - DNA, 21 bp, Homo sapiens
gagcccagaagctcaaggctg

SEQ ID NO: 4768153 - DNA, 12 bp, Homo sapiens
gagcccaggcct

SEQ ID NO: 4768154 - DNA, 17 bp, Homo sapiens
gagccccatcgcctggg

SEQ ID NO: 4768155 - DNA, 15 bp, Homo sapiens
gagcccccgcccctc

SEQ ID NO: 4768156 - DNA, 16 bp, Homo sapiens
gagcccccgcccctcc

SEQ ID NO: 4768157 - DNA, 17 bp, Homo sapiens
gagcccccgcccctccc

SEQ ID NO: 4768158 - DNA, 20 bp, Homo sapiens
gagcccccgcccctccccct

SEQ ID NO: 4768159 - DNA, 13 bp, Homo sapiens
gagccccctgcac

SEQ ID NO: 4768160 - DNA, 19 bp, Homo sapiens
gagcccctgtttctcctcc

SEQ ID NO: 4768161 - DNA, 21 bp, Homo sapiens
gagcccgcctgcgccccccag

SEQ ID NO: 4768162 - DNA, 23 bp, Homo sapiens
gagccctgccctcactccactcc

SEQ ID NO: 4768163 - DNA, 16 bp, Homo sapiens
gagccgcagaggcccg

SEQ ID NO: 4768164 - DNA, 18 bp, Homo sapiens
gagcctccaggttcctca

SEQ ID NO: 4768165 - DNA, 14 bp, Homo sapiens
gagcctccccctca

SEQ ID NO: 4768166 - DNA, 16 bp, Homo sapiens
gagcctgcttgctgat

SEQ ID NO: 4768167 - DNA, 19 bp, Homo sapiens
gagcctggcacaggactga

SEQ ID NO: 4768168 - DNA, 17 bp, Homo sapiens
gagccttattaaaatat

SEQ ID NO: 4768169 - DNA, 16 bp, Homo sapiens
gagcgatgtgttcttt

SEQ ID NO: 4768170 - DNA, 15 bp, Homo sapiens
gagcgcgtgccttcc

SEQ ID NO: 4768171 - DNA, 17 bp, Homo sapiens
gagcgcgtgccttcccc

SEQ ID NO: 4768172 - DNA, 21 bp, Homo sapiens
gagcggagaaaggaagggctg

SEQ ID NO: 4768173 - DNA, 23 bp, Homo sapiens
gagcggcttccccattgccttct

SEQ ID NO: 4768174 - DNA, 21 bp, Homo sapiens
gagcgggggctaactggcccc

SEQ ID NO: 4768175 - DNA, 14 bp, Homo sapiens
gagcgtccaggtga

SEQ ID NO: 4768176 - DNA, 17 bp, Homo sapiens
gagcgtccttgtccccg

SEQ ID NO: 4768177 - DNA, 18 bp, Homo sapiens
gagcgtgtactaccccag

SEQ ID NO: 4768178 - DNA, 12 bp, Homo sapiens
gagcgtgtccta

SEQ ID NO: 4768179 - DNA, 16 bp, Homo sapiens
gagcgtgtcctatccc

SEQ ID NO: 4768180 - DNA, 19 bp, Homo sapiens
gagctagtgttaatccaga

SEQ ID NO: 4768181 - DNA, 19 bp, Homo sapiens
gagctatgatatgtgcttg

SEQ ID NO: 4768182 - DNA, 14 bp, Homo sapiens
gagctatgcacacc

SEQ ID NO: 4768183 - DNA, 15 bp, Homo sapiens
gagctatgcacacca

SEQ ID NO: 4768184 - DNA, 21 bp, Homo sapiens
gagctatgcacaccaaattgc

SEQ ID NO: 4768185 - DNA, 23 bp, Homo sapiens
gagctatgcacaccaaattgctg

SEQ ID NO: 4768186 - DNA, 13 bp, Homo sapiens
gagctcaggagaa

SEQ ID NO: 4768187 - DNA, 15 bp, Homo sapiens
gagctcaggagaagg

SEQ ID NO: 4768188 - DNA, 17 bp, Homo sapiens
gagctcaggagaaggcc

SEQ ID NO: 4768189 - DNA, 19 bp, Homo sapiens
gagctccccaatccaaccc

SEQ ID NO: 4768190 - DNA, 23 bp, Homo sapiens
gagctccccaatccaacccatgc

SEQ ID NO: 4768191 - DNA, 15 bp, Homo sapiens
gagctctgtagcctg

SEQ ID NO: 4768192 - DNA, 17 bp, Homo sapiens
gagctctgtagcctggt

SEQ ID NO: 4768193 - DNA, 19 bp, Homo sapiens
gagctctgtagcctggtct

SEQ ID NO: 4768194 - DNA, 22 bp, Homo sapiens
gagctctgtagcctggtctgtg

SEQ ID NO: 4768195 - DNA, 18 bp, Homo sapiens
gagctgagtcggctgggc

SEQ ID NO: 4768196 - DNA, 20 bp, Homo sapiens
gagctgagtcggctgggcag

SEQ ID NO: 4768197 - DNA, 21 bp, Homo sapiens
gagctgagtcggctgggcagg

SEQ ID NO: 4768198 - DNA, 23 bp, Homo sapiens
gagctgagtcggctgggcagggc

SEQ ID NO: 4768199 - DNA, 15 bp, Homo sapiens
gagctgccacctgcc

SEQ ID NO: 4768200 - DNA, 16 bp, Homo sapiens
gagctgccacctgcct

SEQ ID NO: 4768201 - DNA, 21 bp, Homo sapiens
gagctggcctattttggacgt

SEQ ID NO: 4768202 - DNA, 14 bp, Homo sapiens
gagcttaatgtctt

SEQ ID NO: 4768203 - DNA, 10 bp, Homo sapiens
gagcttcccc

SEQ ID NO: 4768204 - DNA, 22 bp, Homo sapiens
gagcttcccctaacctgggttg

SEQ ID NO: 4768205 - DNA, 17 bp, Homo sapiens
gaggaacctcaaactgg

SEQ ID NO: 4768206 - DNA, 23 bp, Homo sapiens
gaggaactccttggcctagccca

SEQ ID NO: 4768207 - DNA, 15 bp, Homo sapiens
gaggaagggcccccg

SEQ ID NO: 4768208 - DNA, 19 bp, Homo sapiens
gaggaccccattctgggac

SEQ ID NO: 4768209 - DNA, 20 bp, Homo sapiens
gaggaccccattctgggact

SEQ ID NO: 4768210 - DNA, 21 bp, Homo sapiens
gaggaccccattctgggactg

SEQ ID NO: 4768211 - DNA, 15 bp, Homo sapiens
gaggaccctcccagg

SEQ ID NO: 4768212 - DNA, 12 bp, Homo sapiens
gaggacctttct

SEQ ID NO: 4768213 - DNA, 14 bp, Homo sapiens
gaggacggcttccc

SEQ ID NO: 4768214 - DNA, 14 bp, Homo sapiens
gaggactccagggg

SEQ ID NO: 4768215 - DNA, 14 bp, Homo sapiens
gaggagaaggagga

SEQ ID NO: 4768216 - DNA, 12 bp, Homo sapiens
gaggagagagga

SEQ ID NO: 4768217 - DNA, 17 bp, Homo sapiens
gaggagattgctctggg

SEQ ID NO: 4768218 - DNA, 10 bp, Homo sapiens
gaggagcacc

SEQ ID NO: 4768219 - DNA, 16 bp, Homo sapiens
gaggagcacccccagc

SEQ ID NO: 4768220 - DNA, 22 bp, Homo sapiens
gaggagcacccccagcctcccc

SEQ ID NO: 4768221 - DNA, 23 bp, Homo sapiens
gaggagcacccccagcctccccc

SEQ ID NO: 4768222 - DNA, 20 bp, Homo sapiens
gaggaggcagagaagaaaga

SEQ ID NO: 4768223 - DNA, 17 bp, Homo sapiens
gaggagtgatgggcaag

SEQ ID NO: 4768224 - DNA, 23 bp, Homo sapiens
gaggagtgatgggcaaggggcca

SEQ ID NO: 4768225 - DNA, 23 bp, Homo sapiens
gaggagtttggggtatgggagag

SEQ ID NO: 4768226 - DNA, 20 bp, Homo sapiens
gaggataaataataaaggtt

SEQ ID NO: 4768227 - DNA, 21 bp, Homo sapiens
gaggataccttccatctcaac

SEQ ID NO: 4768228 - DNA, 16 bp, Homo sapiens
gaggatagagacttgc

SEQ ID NO: 4768229 - DNA, 21 bp, Homo sapiens
gaggatggcttccccattgcc

SEQ ID NO: 4768230 - DNA, 19 bp, Homo sapiens
gaggatgggcagctggggg

SEQ ID NO: 4768231 - DNA, 15 bp, Homo sapiens
gaggcaagcaagctc

SEQ ID NO: 4768232 - DNA, 13 bp, Homo sapiens
gaggcacatgaca

SEQ ID NO: 4768233 - DNA, 19 bp, Homo sapiens
gaggcagcaacaggaccag

SEQ ID NO: 4768234 - DNA, 22 bp, Homo sapiens
gaggcagcaacaggaccaggag

SEQ ID NO: 4768235 - DNA, 17 bp, Homo sapiens
gaggcagggccctgggg

SEQ ID NO: 4768236 - DNA, 20 bp, Homo sapiens
gaggcattttactatgcctg

SEQ ID NO: 4768237 - DNA, 20 bp, Homo sapiens
gaggccaaatattgatctgt

SEQ ID NO: 4768238 - DNA, 14 bp, Homo sapiens
gaggccaaatgagt

SEQ ID NO: 4768239 - DNA, 12 bp, Homo sapiens
gaggccagggcc

SEQ ID NO: 4768240 - DNA, 13 bp, Homo sapiens
gaggcctgggaga

SEQ ID NO: 4768241 - DNA, 13 bp, Homo sapiens
gaggcctgggtgt

SEQ ID NO: 4768242 - DNA, 22 bp, Homo sapiens
gaggcctgggtgtgacctgaca

SEQ ID NO: 4768243 - DNA, 12 bp, Homo sapiens
gaggcgcccacc

SEQ ID NO: 4768244 - DNA, 14 bp, Homo sapiens
gaggcgcccacctg

SEQ ID NO: 4768245 - DNA, 15 bp, Homo sapiens
gaggcgcccacctgc

SEQ ID NO: 4768246 - DNA, 18 bp, Homo sapiens
gaggcgcccacctgccca

SEQ ID NO: 4768247 - DNA, 19 bp, Homo sapiens
gaggcgcccacctgcccag

SEQ ID NO: 4768248 - DNA, 13 bp, Homo sapiens
gaggcgtcttgta

SEQ ID NO: 4768249 - DNA, 22 bp, Homo sapiens
gaggcgtgggatccagagagaa

SEQ ID NO: 4768250 - DNA, 14 bp, Homo sapiens
gaggctgctgtcac

SEQ ID NO: 4768251 - DNA, 12 bp, Homo sapiens
gaggctggacca

SEQ ID NO: 4768252 - DNA, 17 bp, Homo sapiens
gaggctggcggggtctg

SEQ ID NO: 4768253 - DNA, 16 bp, Homo sapiens
gaggctgggcccctgg

SEQ ID NO: 4768254 - DNA, 15 bp, Homo sapiens
gaggcttccagctca

SEQ ID NO: 4768255 - DNA, 17 bp, Homo sapiens
gaggcttccagctcagt

SEQ ID NO: 4768256 - DNA, 20 bp, Homo sapiens
gaggcttccagctcagtccc

SEQ ID NO: 4768257 - DNA, 17 bp, Homo sapiens
gagggaagcccacccgc

SEQ ID NO: 4768258 - DNA, 18 bp, Homo sapiens
gagggaagcccacccgcc

SEQ ID NO: 4768259 - DNA, 23 bp, Homo sapiens
gagggaagcccacccgccccaga

SEQ ID NO: 4768260 - DNA, 24 bp, Homo sapiens
gagggactccaagccctggggcag

SEQ ID NO: 4768261 - DNA, 16 bp, Homo sapiens
gagggactgcctctgc

SEQ ID NO: 4768262 - DNA, 19 bp, Homo sapiens
gagggatgaaatgccaaga

SEQ ID NO: 4768263 - DNA, 21 bp, Homo sapiens
gagggatggagaggcggcctc

SEQ ID NO: 4768264 - DNA, 12 bp, Homo sapiens
gagggcaaacca

SEQ ID NO: 4768265 - DNA, 21 bp, Homo sapiens
gagggcaaaccaggctgcagg

SEQ ID NO: 4768266 - DNA, 23 bp, Homo sapiens
gagggcacagaaaatggaagaca

SEQ ID NO: 4768267 - DNA, 14 bp, Homo sapiens
gagggcctctggac

SEQ ID NO: 4768268 - DNA, 13 bp, Homo sapiens
gagggcgcctggg

SEQ ID NO: 4768269 - DNA, 15 bp, Homo sapiens
gagggcgcctgggtc

SEQ ID NO: 4768270 - DNA, 22 bp, Homo sapiens
gagggcgcctgggtcctcccag

SEQ ID NO: 4768271 - DNA, 15 bp, Homo sapiens
gagggctgagcccct

SEQ ID NO: 4768272 - DNA, 16 bp, Homo sapiens
gaggggaagagagagg

SEQ ID NO: 4768273 - DNA, 13 bp, Homo sapiens
gaggggagcaagg

SEQ ID NO: 4768274 - DNA, 14 bp, Homo sapiens
gaggggagcaaggc

SEQ ID NO: 4768275 - DNA, 13 bp, Homo sapiens
gaggggaggtggc

SEQ ID NO: 4768276 - DNA, 14 bp, Homo sapiens
gaggggtgctctgc

SEQ ID NO: 4768277 - DNA, 13 bp, Homo sapiens
gagggtccctaat

SEQ ID NO: 4768278 - DNA, 18 bp, Homo sapiens
gagggtccctaattctct

SEQ ID NO: 4768279 - DNA, 19 bp, Homo sapiens
gagggtccctaattctctt

SEQ ID NO: 4768280 - DNA, 14 bp, Homo sapiens
gagggtccctaggt

SEQ ID NO: 4768281 - DNA, 24 bp, Homo sapiens
gagggtgccgcgggcgagaagggc

SEQ ID NO: 4768282 - DNA, 15 bp, Homo sapiens
gaggtcaggccctgg

SEQ ID NO: 4768283 - DNA, 14 bp, Homo sapiens
gaggtcatctgtaa

SEQ ID NO: 4768284 - DNA, 15 bp, Homo sapiens
gaggtcatctgtaaa

SEQ ID NO: 4768285 - DNA, 24 bp, Homo sapiens
gaggtcatctgtaaaatagtctca

SEQ ID NO: 4768286 - DNA, 20 bp, Homo sapiens
gaggtggggagggcctctgg

SEQ ID NO: 4768287 - DNA, 17 bp, Homo sapiens
gaggtgtggagtggagg

SEQ ID NO: 4768288 - DNA, 15 bp, Homo sapiens
gaggttgggaggcca

SEQ ID NO: 4768289 - DNA, 20 bp, Homo sapiens
gaggtttcagtagctccttg

SEQ ID NO: 4768290 - DNA, 16 bp, Homo sapiens
gagtaaaaccaaaggt

SEQ ID NO: 4768291 - DNA, 16 bp, Homo sapiens
gagtagggccctgaca

SEQ ID NO: 4768292 - DNA, 17 bp, Homo sapiens
gagtagggccctgacag

SEQ ID NO: 4768293 - DNA, 11 bp, Homo sapiens
gagtatatatg

SEQ ID NO: 4768294 - DNA, 19 bp, Homo sapiens
gagtatgcaagaagaatat

SEQ ID NO: 4768295 - DNA, 21 bp, Homo sapiens
gagtatggtgctgggtcctta

SEQ ID NO: 4768296 - DNA, 16 bp, Homo sapiens
gagtatgtgtatgtac

SEQ ID NO: 4768297 - DNA, 18 bp, Homo sapiens
gagtcaagtgtgcctgct

SEQ ID NO: 4768298 - DNA, 19 bp, Homo sapiens
gagtcaagtgtgcctgcta

SEQ ID NO: 4768299 - DNA, 23 bp, Homo sapiens
gagtcaccttccaggacccctgg

SEQ ID NO: 4768300 - DNA, 14 bp, Homo sapiens
gagtcactggaaca

SEQ ID NO: 4768301 - DNA, 18 bp, Homo sapiens
gagtcagaagtttctgcc

SEQ ID NO: 4768302 - DNA, 22 bp, Homo sapiens
gagtcagaagtttctgccgcag

SEQ ID NO: 4768303 - DNA, 22 bp, Homo sapiens
gagtcagggcccagaggctgag

SEQ ID NO: 4768304 - DNA, 13 bp, Homo sapiens
gagtcatctcaaa

SEQ ID NO: 4768305 - DNA, 14 bp, Homo sapiens
gagtccactttcct

SEQ ID NO: 4768306 - DNA, 17 bp, Homo sapiens
gagtccactttcctctc

SEQ ID NO: 4768307 - DNA, 15 bp, Homo sapiens
gagtcggctgggcag

SEQ ID NO: 4768308 - DNA, 17 bp, Homo sapiens
gagtctgaaggagagga

SEQ ID NO: 4768309 - DNA, 17 bp, Homo sapiens
gagtctgtcctttccca

SEQ ID NO: 4768310 - DNA, 14 bp, Homo sapiens
gagtgactctggct

SEQ ID NO: 4768311 - DNA, 14 bp, Homo sapiens
gagtgatgggcaag

SEQ ID NO: 4768312 - DNA, 21 bp, Homo sapiens
gagtgatgggcaaggggccag

SEQ ID NO: 4768313 - DNA, 20 bp, Homo sapiens
gagtgatttgtaaaacagtg

SEQ ID NO: 4768314 - DNA, 15 bp, Homo sapiens
gagtgccacgtggcc

SEQ ID NO: 4768315 - DNA, 23 bp, Homo sapiens
gagtgccacgtggccgctgccca

SEQ ID NO: 4768316 - DNA, 18 bp, Homo sapiens
gagtgccttacacaatgg

SEQ ID NO: 4768317 - DNA, 14 bp, Homo sapiens
gagtggacagcagc

SEQ ID NO: 4768318 - DNA, 17 bp, Homo sapiens
gagtggacagcagctgg

SEQ ID NO: 4768319 - DNA, 22 bp, Homo sapiens
gagtggaccacgacctcgtcca

SEQ ID NO: 4768320 - DNA, 13 bp, Homo sapiens
gagtggactcttc

SEQ ID NO: 4768321 - DNA, 20 bp, Homo sapiens
gagtggaggggtcagcaggg

SEQ ID NO: 4768322 - DNA, 19 bp, Homo sapiens
gagtggcgagtccagacac

SEQ ID NO: 4768323 - DNA, 13 bp, Homo sapiens
gagtgtagtcccg

SEQ ID NO: 4768324 - DNA, 13 bp, Homo sapiens
gagtgtatgcata

SEQ ID NO: 4768325 - DNA, 15 bp, Homo sapiens
gagtgtatgtataca

SEQ ID NO: 4768326 - DNA, 20 bp, Homo sapiens
gagtgtatgtatacacacac

SEQ ID NO: 4768327 - DNA, 21 bp, Homo sapiens
gagtgtatgtatacacacaca

SEQ ID NO: 4768328 - DNA, 23 bp, Homo sapiens
gagtgtatttttgtaattcctct

SEQ ID NO: 4768329 - DNA, 13 bp, Homo sapiens
gagtgtcaggctc

SEQ ID NO: 4768330 - DNA, 14 bp, Homo sapiens
gagtgtcaggctct

SEQ ID NO: 4768331 - DNA, 14 bp, Homo sapiens
gagtgtcctgctac

SEQ ID NO: 4768332 - DNA, 20 bp, Homo sapiens
gagtgtgaatataaatgtgt

SEQ ID NO: 4768333 - DNA, 16 bp, Homo sapiens
gagtgtgcctctctct

SEQ ID NO: 4768334 - DNA, 12 bp, Homo sapiens
gagttacagaca

SEQ ID NO: 4768335 - DNA, 13 bp, Homo sapiens
gagttacagacaa

SEQ ID NO: 4768336 - DNA, 15 bp, Homo sapiens
gagttatatgacttc

SEQ ID NO: 4768337 - DNA, 19 bp, Homo sapiens
gagttcatcttgaattgta

SEQ ID NO: 4768338 - DNA, 20 bp, Homo sapiens
gagttcatcttgaattgtaa

SEQ ID NO: 4768339 - DNA, 23 bp, Homo sapiens
gagttcatcttgaattgtaagga

SEQ ID NO: 4768340 - DNA, 15 bp, Homo sapiens
gagttcctttccctc

SEQ ID NO: 4768341 - DNA, 19 bp, Homo sapiens
gagttctccttgtacttga

SEQ ID NO: 4768342 - DNA, 20 bp, Homo sapiens
gagttctgcacatacagatg

SEQ ID NO: 4768343 - DNA, 13 bp, Homo sapiens
gagttctggttcc

SEQ ID NO: 4768344 - DNA, 15 bp, Homo sapiens
gagttcttcctgtaa

SEQ ID NO: 4768345 - DNA, 21 bp, Homo sapiens
gagtttccatttggattttaa

SEQ ID NO: 4768346 - DNA, 20 bp, Homo sapiens
gataaagaaaccttttaaaa

SEQ ID NO: 4768347 - DNA, 21 bp, Homo sapiens
gataaataataaaggttctat

SEQ ID NO: 4768348 - DNA, 23 bp, Homo sapiens
gataaataataaaggttctatga

SEQ ID NO: 4768349 - DNA, 12 bp, Homo sapiens
gataaatcatgg

SEQ ID NO: 4768350 - DNA, 13 bp, Homo sapiens
gataaatcatggg

SEQ ID NO: 4768351 - DNA, 17 bp, Homo sapiens
gataaatcatgggcatt

SEQ ID NO: 4768352 - DNA, 16 bp, Homo sapiens
gataaattttggaaga

SEQ ID NO: 4768353 - DNA, 22 bp, Homo sapiens
gataagaaccttttgagtgcct

SEQ ID NO: 4768354 - DNA, 22 bp, Homo sapiens
gataataaaattcattccattt

SEQ ID NO: 4768355 - DNA, 16 bp, Homo sapiens
gataatgagatgtaat

SEQ ID NO: 4768356 - DNA, 19 bp, Homo sapiens
gataattaaatgaaatact

SEQ ID NO: 4768357 - DNA, 17 bp, Homo sapiens
gataattgtaaaggtga

SEQ ID NO: 4768358 - DNA, 18 bp, Homo sapiens
gatacactcaagcatgaa

SEQ ID NO: 4768359 - DNA, 16 bp, Homo sapiens
gataccattttgaaat

SEQ ID NO: 4768360 - DNA, 13 bp, Homo sapiens
gatacccatccca

SEQ ID NO: 4768361 - DNA, 18 bp, Homo sapiens
gatacccggtggcttctg

SEQ ID NO: 4768362 - DNA, 15 bp, Homo sapiens
gatacctgtgaggac

SEQ ID NO: 4768363 - DNA, 16 bp, Homo sapiens
gataccttccatctca

SEQ ID NO: 4768364 - DNA, 18 bp, Homo sapiens
gataccttccatctcaac

SEQ ID NO: 4768365 - DNA, 20 bp, Homo sapiens
gatactggggggcaggcctc

SEQ ID NO: 4768366 - DNA, 14 bp, Homo sapiens
gatacttgtaactt

SEQ ID NO: 4768367 - DNA, 17 bp, Homo sapiens
gatagcgtgcagtagag

SEQ ID NO: 4768368 - DNA, 13 bp, Homo sapiens
gataggagaggaa

SEQ ID NO: 4768369 - DNA, 14 bp, Homo sapiens
gataggagaggaaa

SEQ ID NO: 4768370 - DNA, 13 bp, Homo sapiens
gatagtttattat

SEQ ID NO: 4768371 - DNA, 14 bp, Homo sapiens
gatataagccatag

SEQ ID NO: 4768372 - DNA, 15 bp, Homo sapiens
gatataagccatagc

SEQ ID NO: 4768373 - DNA, 21 bp, Homo sapiens
gatataagccatagccccagg

SEQ ID NO: 4768374 - DNA, 16 bp, Homo sapiens
gatatatctgaaaact

SEQ ID NO: 4768375 - DNA, 21 bp, Homo sapiens
gatatcaggaaatatctgtga

SEQ ID NO: 4768376 - DNA, 17 bp, Homo sapiens
gatatgaaagagaaaat

SEQ ID NO: 4768377 - DNA, 22 bp, Homo sapiens
gatatgggactgagcctggccc

SEQ ID NO: 4768378 - DNA, 13 bp, Homo sapiens
gatatgtctttaa

SEQ ID NO: 4768379 - DNA, 21 bp, Homo sapiens
gatatgtgcttgtgtgtatgt

SEQ ID NO: 4768380 - DNA, 13 bp, Homo sapiens
gatatgtgtaata

SEQ ID NO: 4768381 - DNA, 13 bp, Homo sapiens
gatattaccctca

SEQ ID NO: 4768382 - DNA, 15 bp, Homo sapiens
gatattgtatctcct

SEQ ID NO: 4768383 - DNA, 14 bp, Homo sapiens
gatattgtattatc

SEQ ID NO: 4768384 - DNA, 18 bp, Homo sapiens
gatattttgtaaaatgta

SEQ ID NO: 4768385 - DNA, 15 bp, Homo sapiens
gatcaaaatgcatac

SEQ ID NO: 4768386 - DNA, 15 bp, Homo sapiens
gatcaaggagggaga

SEQ ID NO: 4768387 - DNA, 14 bp, Homo sapiens
gatcaaggtgctct

SEQ ID NO: 4768388 - DNA, 19 bp, Homo sapiens
gatcaaggtgctcttctca

SEQ ID NO: 4768389 - DNA, 20 bp, Homo sapiens
gatcaaggtgctcttctcat

SEQ ID NO: 4768390 - DNA, 15 bp, Homo sapiens
gatcacatgcccctc

SEQ ID NO: 4768391 - DNA, 14 bp, Homo sapiens
gatcactttctgaa

SEQ ID NO: 4768392 - DNA, 18 bp, Homo sapiens
gatccagagacctgctcc

SEQ ID NO: 4768393 - DNA, 12 bp, Homo sapiens
gatccagagaga

SEQ ID NO: 4768394 - DNA, 23 bp, Homo sapiens
gatccatttaaaacaagctgata

SEQ ID NO: 4768395 - DNA, 21 bp, Homo sapiens
gatcccccaaacagcatgtgc

SEQ ID NO: 4768396 - DNA, 20 bp, Homo sapiens
gatccctcggtcagcaccgt

SEQ ID NO: 4768397 - DNA, 21 bp, Homo sapiens
gatcctccgcggaggcccctg

SEQ ID NO: 4768398 - DNA, 22 bp, Homo sapiens
gatcctccgcggaggcccctga

SEQ ID NO: 4768399 - DNA, 21 bp, Homo sapiens
gatccttcaaagtctcaatga

SEQ ID NO: 4768400 - DNA, 20 bp, Homo sapiens
gatctaaaaggaggacaggg

SEQ ID NO: 4768401 - DNA, 16 bp, Homo sapiens
gatctagccaggcctc

SEQ ID NO: 4768402 - DNA, 13 bp, Homo sapiens
gatctatgggaaa

SEQ ID NO: 4768403 - DNA, 19 bp, Homo sapiens
gatctcagctcactgcaac

SEQ ID NO: 4768404 - DNA, 11 bp, Homo sapiens
gatctccaggc

SEQ ID NO: 4768405 - DNA, 18 bp, Homo sapiens
gatctccaggcccagcct

SEQ ID NO: 4768406 - DNA, 23 bp, Homo sapiens
gatctccaggcccagcctggccc

SEQ ID NO: 4768407 - DNA, 14 bp, Homo sapiens
gatctcctgtgcac

SEQ ID NO: 4768408 - DNA, 21 bp, Homo sapiens
gatctgcactcctgtctcttg

SEQ ID NO: 4768409 - DNA, 16 bp, Homo sapiens
gatctgctccatgcag

SEQ ID NO: 4768410 - DNA, 17 bp, Homo sapiens
gatctgctccatgcaga

SEQ ID NO: 4768411 - DNA, 14 bp, Homo sapiens
gatctggagtctga

SEQ ID NO: 4768412 - DNA, 19 bp, Homo sapiens
gatctggagtctgaaggag

SEQ ID NO: 4768413 - DNA, 21 bp, Homo sapiens
gatctggtgcgtgtggccctg

SEQ ID NO: 4768414 - DNA, 23 bp, Homo sapiens
gatctggtgcgtgtggccctgtg

SEQ ID NO: 4768415 - DNA, 13 bp, Homo sapiens
gatctgttgtaat

SEQ ID NO: 4768416 - DNA, 22 bp, Homo sapiens
gatcttgagcaaggcaagaagt

SEQ ID NO: 4768417 - DNA, 16 bp, Homo sapiens
gatctttttttaagtg

SEQ ID NO: 4768418 - DNA, 22 bp, Homo sapiens
gatgaaaaaaagggaaaacaaa

SEQ ID NO: 4768419 - DNA, 20 bp, Homo sapiens
gatgaaatgccaagactcta

SEQ ID NO: 4768420 - DNA, 15 bp, Homo sapiens
gatgacagggagctg

SEQ ID NO: 4768421 - DNA, 20 bp, Homo sapiens
gatgaccttgaatgatgcca

SEQ ID NO: 4768422 - DNA, 21 bp, Homo sapiens
gatgacggtattatgcttctt

SEQ ID NO: 4768423 - DNA, 14 bp, Homo sapiens
gatgactgaatttc

SEQ ID NO: 4768424 - DNA, 13 bp, Homo sapiens
gatgactggaaac

SEQ ID NO: 4768425 - DNA, 16 bp, Homo sapiens
gatgagacaacacaca

SEQ ID NO: 4768426 - DNA, 14 bp, Homo sapiens
gatgaggcatttta

SEQ ID NO: 4768427 - DNA, 21 bp, Homo sapiens
gatgaggctggataggagagg

SEQ ID NO: 4768428 - DNA, 13 bp, Homo sapiens
gatgatgttctga

SEQ ID NO: 4768429 - DNA, 22 bp, Homo sapiens
gatgattcaatcattttgggaa

SEQ ID NO: 4768430 - DNA, 17 bp, Homo sapiens
gatgatttaattcttac

SEQ ID NO: 4768431 - DNA, 12 bp, Homo sapiens
gatgatttcaga

SEQ ID NO: 4768432 - DNA, 20 bp, Homo sapiens
gatgcatctgtggcctgggg

SEQ ID NO: 4768433 - DNA, 19 bp, Homo sapiens
gatgcattttaaatgtcta

SEQ ID NO: 4768434 - DNA, 20 bp, Homo sapiens
gatgcccaaagatgcagccg

SEQ ID NO: 4768435 - DNA, 14 bp, Homo sapiens
gatgcctgaacttg

SEQ ID NO: 4768436 - DNA, 18 bp, Homo sapiens
gatgcgtggctcccagca

SEQ ID NO: 4768437 - DNA, 16 bp, Homo sapiens
gatggaatcacagcca

SEQ ID NO: 4768438 - DNA, 17 bp, Homo sapiens
gatggaatcacagccaa

SEQ ID NO: 4768439 - DNA, 20 bp, Homo sapiens
gatggacagttcacaccctg

SEQ ID NO: 4768440 - DNA, 14 bp, Homo sapiens
gatggagaaggaag

SEQ ID NO: 4768441 - DNA, 16 bp, Homo sapiens
gatggagaaggaaggc

SEQ ID NO: 4768442 - DNA, 22 bp, Homo sapiens
gatggatctgctccatgcagat

SEQ ID NO: 4768443 - DNA, 19 bp, Homo sapiens
gatggatttgacacactca

SEQ ID NO: 4768444 - DNA, 17 bp, Homo sapiens
gatggcacttttgagct

SEQ ID NO: 4768445 - DNA, 12 bp, Homo sapiens
gatggcagagcc

SEQ ID NO: 4768446 - DNA, 21 bp, Homo sapiens
gatggcttccgtgagacacaa

SEQ ID NO: 4768447 - DNA, 22 bp, Homo sapiens
gatgggaaagaccctaggtgct

SEQ ID NO: 4768448 - DNA, 16 bp, Homo sapiens
gatgggcaaggggcca

SEQ ID NO: 4768449 - DNA, 20 bp, Homo sapiens
gatgggcaaggggccaggaa

SEQ ID NO: 4768450 - DNA, 19 bp, Homo sapiens
gatggggcggcctgcagac

SEQ ID NO: 4768451 - DNA, 16 bp, Homo sapiens
gatgggggatgggcca

SEQ ID NO: 4768452 - DNA, 13 bp, Homo sapiens
gatgggggcctct

SEQ ID NO: 4768453 - DNA, 15 bp, Homo sapiens
gatgggtcctgctgc

SEQ ID NO: 4768454 - DNA, 15 bp, Homo sapiens
gatgggtgattatga

SEQ ID NO: 4768455 - DNA, 21 bp, Homo sapiens
gatgggtgattatgaaatgcc

SEQ ID NO: 4768456 - DNA, 13 bp, Homo sapiens
gatgtaatacacc

SEQ ID NO: 4768457 - DNA, 20 bp, Homo sapiens
gatgtcaatgctatggactg

SEQ ID NO: 4768458 - DNA, 14 bp, Homo sapiens
gatgtctgtgtata

SEQ ID NO: 4768459 - DNA, 16 bp, Homo sapiens
gatgtctgtgtataca

SEQ ID NO: 4768460 - DNA, 18 bp, Homo sapiens
gatgtctgtgtatacata

SEQ ID NO: 4768461 - DNA, 15 bp, Homo sapiens
gatgtgcatctggcc

SEQ ID NO: 4768462 - DNA, 17 bp, Homo sapiens
gatgtgcatctggccta

SEQ ID NO: 4768463 - DNA, 18 bp, Homo sapiens
gatgtgcatctggcctat

SEQ ID NO: 4768464 - DNA, 12 bp, Homo sapiens
gaatatgtgtaa

SEQ ID NO: 4768465 - DNA, 23 bp, Homo sapiens
gaatattaaaaattaattcttta

SEQ ID NO: 4768466 - DNA, 20 bp, Homo sapiens
gaatattgagcaatatgtca

SEQ ID NO: 4768467 - DNA, 19 bp, Homo sapiens
gaatcaatgtgctccttca

SEQ ID NO: 4768468 - DNA, 23 bp, Homo sapiens
gaatcacctaattaatttcagta

SEQ ID NO: 4768469 - DNA, 16 bp, Homo sapiens
gaatcagaggcagaga

SEQ ID NO: 4768470 - DNA, 18 bp, Homo sapiens
gaatcagtcctagaatgt

SEQ ID NO: 4768471 - DNA, 16 bp, Homo sapiens
gaatcatggatttatt

SEQ ID NO: 4768472 - DNA, 17 bp, Homo sapiens
gaatccatatcagctct

SEQ ID NO: 4768473 - DNA, 17 bp, Homo sapiens
gaatccccgtgctcaca

SEQ ID NO: 4768474 - DNA, 13 bp, Homo sapiens
gaatcccctcgct

SEQ ID NO: 4768475 - DNA, 22 bp, Homo sapiens
gaatcccctcgcttcataggca

SEQ ID NO: 4768476 - DNA, 21 bp, Homo sapiens
gaatcgatgggggatgcttca

SEQ ID NO: 4768477 - DNA, 14 bp, Homo sapiens
gaatctacttaacc

SEQ ID NO: 4768478 - DNA, 22 bp, Homo sapiens
gaatctcaatgacctgttgatt

SEQ ID NO: 4768479 - DNA, 16 bp, Homo sapiens
gaatctctcaaaatgt

SEQ ID NO: 4768480 - DNA, 19 bp, Homo sapiens
gaatctgtgcagtcatcaa

SEQ ID NO: 4768481 - DNA, 19 bp, Homo sapiens
gaatgaaatataaactgtg

SEQ ID NO: 4768482 - DNA, 23 bp, Homo sapiens
gaatgaaatataaactgtgagat

SEQ ID NO: 4768483 - DNA, 19 bp, Homo sapiens
gaatgagaagtaaattatt

SEQ ID NO: 4768484 - DNA, 20 bp, Homo sapiens
gaatgagaagtaaattattt

SEQ ID NO: 4768485 - DNA, 16 bp, Homo sapiens
gaatgagatgatttaa

SEQ ID NO: 4768486 - DNA, 14 bp, Homo sapiens
gaatgattaattaa

SEQ ID NO: 4768487 - DNA, 12 bp, Homo sapiens
gaatgcaataaa

SEQ ID NO: 4768488 - DNA, 15 bp, Homo sapiens
gaatgctcaatgtgc

SEQ ID NO: 4768489 - DNA, 16 bp, Homo sapiens
gaatgctcaatgtgct

SEQ ID NO: 4768490 - DNA, 11 bp, Homo sapiens
gaatggagcag

SEQ ID NO: 4768491 - DNA, 14 bp, Homo sapiens
gaatggatgctgct

SEQ ID NO: 4768492 - DNA, 19 bp, Homo sapiens
gaatggggtgggagccaca

SEQ ID NO: 4768493 - DNA, 15 bp, Homo sapiens
gaatggtgggctcca

SEQ ID NO: 4768494 - DNA, 20 bp, Homo sapiens
gaatgtcagtgtgactgatc

SEQ ID NO: 4768495 - DNA, 15 bp, Homo sapiens
gaatgtcatttgcta

SEQ ID NO: 4768496 - DNA, 16 bp, Homo sapiens
gaatgtcatttgctaa

SEQ ID NO: 4768497 - DNA, 22 bp, Homo sapiens
gaatgtcatttgctaatgaatt

SEQ ID NO: 4768498 - DNA, 18 bp, Homo sapiens
gaatgtgcaaagcagtat

SEQ ID NO: 4768499 - DNA, 23 bp, Homo sapiens
gaatgtgcaaagcagtatgtaca

SEQ ID NO: 4768500 - DNA, 15 bp, Homo sapiens
gaatgtgtcccatgc

SEQ ID NO: 4768501 - DNA, 18 bp, Homo sapiens
gaatgttgtcctgtgtca

SEQ ID NO: 4768502 - DNA, 19 bp, Homo sapiens
gaatgttgtcctgtgtcat

SEQ ID NO: 4768503 - DNA, 23 bp, Homo sapiens
gaatgttgtgttggtatttactg

SEQ ID NO: 4768504 - DNA, 11 bp, Homo sapiens
gaattaaagtc

SEQ ID NO: 4768505 - DNA, 13 bp, Homo sapiens
gaattaaagtcta

SEQ ID NO: 4768506 - DNA, 14 bp, Homo sapiens
gaattaaagtctac

SEQ ID NO: 4768507 - DNA, 16 bp, Homo sapiens
gaattaagaggataca

SEQ ID NO: 4768508 - DNA, 17 bp, Homo sapiens
gaattacataacaggca

SEQ ID NO: 4768509 - DNA, 14 bp, Homo sapiens
gaattaccatttgt

SEQ ID NO: 4768510 - DNA, 15 bp, Homo sapiens
gaattagaagaaaat

SEQ ID NO: 4768511 - DNA, 15 bp, Homo sapiens
gaattaggtaatgga

SEQ ID NO: 4768512 - DNA, 18 bp, Homo sapiens
gaattattaatgaatgcc

SEQ ID NO: 4768513 - DNA, 19 bp, Homo sapiens
gaattattagcaccagctt

SEQ ID NO: 4768514 - DNA, 20 bp, Homo sapiens
gaattattgggcttaatata

SEQ ID NO: 4768515 - DNA, 22 bp, Homo sapiens
gaattcatgatgctagttctta

SEQ ID NO: 4768516 - DNA, 17 bp, Homo sapiens
gaattcatgcctcaagt

SEQ ID NO: 4768517 - DNA, 19 bp, Homo sapiens
gaattgaggggaggtggcc

SEQ ID NO: 4768518 - DNA, 18 bp, Homo sapiens
gaattggctgccaagagt

SEQ ID NO: 4768519 - DNA, 15 bp, Homo sapiens
gaattgtaaggaatg

SEQ ID NO: 4768520 - DNA, 20 bp, Homo sapiens
gaattgtgtggagaagtgtg

SEQ ID NO: 4768521 - DNA, 15 bp, Homo sapiens
gaatttaccatcaaa

SEQ ID NO: 4768522 - DNA, 19 bp, Homo sapiens
gaatttaccatcaaacaaa

SEQ ID NO: 4768523 - DNA, 16 bp, Homo sapiens
gaatttcccaaagcag

SEQ ID NO: 4768524 - DNA, 15 bp, Homo sapiens
gaatttgaagacttc

SEQ ID NO: 4768525 - DNA, 13 bp, Homo sapiens
gaattttaaaatg

SEQ ID NO: 4768526 - DNA, 13 bp, Homo sapiens
gaattttcaaagg

SEQ ID NO: 4768527 - DNA, 22 bp, Homo sapiens
gacaacttgctcctttccatca

SEQ ID NO: 4768528 - DNA, 21 bp, Homo sapiens
gacaaggggtggaagggcagg

SEQ ID NO: 4768529 - DNA, 24 bp, Homo sapiens
gacaaggggtggaagggcaggagc

SEQ ID NO: 4768530 - DNA, 23 bp, Homo sapiens
gacaagtctgagtagttatgaat

SEQ ID NO: 4768531 - DNA, 21 bp, Homo sapiens
gacaagtgacttatttgctca

SEQ ID NO: 4768532 - DNA, 18 bp, Homo sapiens
gacaataagaaacagttt

SEQ ID NO: 4768533 - DNA, 16 bp, Homo sapiens
gacacaagccttcggc

SEQ ID NO: 4768534 - DNA, 9 bp, Homo sapiens
gacacacat

SEQ ID NO: 4768535 - DNA, 21 bp, Homo sapiens
gacacacggggcacccagccc

SEQ ID NO: 4768536 - DNA, 22 bp, Homo sapiens
gacacactcaccatttaatcat

SEQ ID NO: 4768537 - DNA, 13 bp, Homo sapiens
gacacagcgtccc

SEQ ID NO: 4768538 - DNA, 22 bp, Homo sapiens
gacacagcgtccctagcagtga

SEQ ID NO: 4768539 - DNA, 20 bp, Homo sapiens
gacacaggatcctggcctga

SEQ ID NO: 4768540 - DNA, 21 bp, Homo sapiens
gacaccaccactgtgtcccag

SEQ ID NO: 4768541 - DNA, 19 bp, Homo sapiens
gacaccagagtgtatgcat

SEQ ID NO: 4768542 - DNA, 21 bp, Homo sapiens
gacaccagagtgtatgcatac

SEQ ID NO: 4768543 - DNA, 19 bp, Homo sapiens
gacacctgccgctgcttga

SEQ ID NO: 4768544 - DNA, 21 bp, Homo sapiens
gacacgtgcaacagactgcct

SEQ ID NO: 4768545 - DNA, 21 bp, Homo sapiens
gacactctcaccccccgacct

SEQ ID NO: 4768546 - DNA, 14 bp, Homo sapiens
gacagaaaaaaata

SEQ ID NO: 4768547 - DNA, 20 bp, Homo sapiens
gacagaaaaaaataaaaaca

SEQ ID NO: 4768548 - DNA, 22 bp, Homo sapiens
gacagaaccaacgggtctgtgg

SEQ ID NO: 4768549 - DNA, 23 bp, Homo sapiens
gacagacggacgggacagcggcc

SEQ ID NO: 4768550 - DNA, 19 bp, Homo sapiens
gacagagatggcagagcca

SEQ ID NO: 4768551 - DNA, 12 bp, Homo sapiens
gacagagtggat

SEQ ID NO: 4768552 - DNA, 18 bp, Homo sapiens
gacagatcttgagcaagg

SEQ ID NO: 4768553 - DNA, 17 bp, Homo sapiens
gacagatgggtgtcccc

SEQ ID NO: 4768554 - DNA, 19 bp, Homo sapiens
gacagcaaaaccattgctt

SEQ ID NO: 4768555 - DNA, 22 bp, Homo sapiens
gacagcagctggactgggtggg

SEQ ID NO: 4768556 - DNA, 17 bp, Homo sapiens
gacagcgccatgtgtgt

SEQ ID NO: 4768557 - DNA, 12 bp, Homo sapiens
gacagcttcccc

SEQ ID NO: 4768558 - DNA, 16 bp, Homo sapiens
gacaggaaagccctcc

SEQ ID NO: 4768559 - DNA, 21 bp, Homo sapiens
gacaggaacccatcactgtgt

SEQ ID NO: 4768560 - DNA, 18 bp, Homo sapiens
gacaggacttgtgcgccg

SEQ ID NO: 4768561 - DNA, 21 bp, Homo sapiens
gacaggattgtctgctgcctc

SEQ ID NO: 4768562 - DNA, 22 bp, Homo sapiens
gacaggccttcctcctctcaaa

SEQ ID NO: 4768563 - DNA, 19 bp, Homo sapiens
gacaggcgccgcctcgccc

SEQ ID NO: 4768564 - DNA, 10 bp, Homo sapiens
gacagtgcct

SEQ ID NO: 4768565 - DNA, 17 bp, Homo sapiens
gacagtggttatatttc

SEQ ID NO: 4768566 - DNA, 19 bp, Homo sapiens
gacagtgttcaaattctga

SEQ ID NO: 4768567 - DNA, 22 bp, Homo sapiens
gacagttaagagaaatgagctt

SEQ ID NO: 4768568 - DNA, 17 bp, Homo sapiens
gacagttgggtgtgaga

SEQ ID NO: 4768569 - DNA, 16 bp, Homo sapiens
gacagtttcttgcaag

SEQ ID NO: 4768570 - DNA, 23 bp, Homo sapiens
gacagtttcttgcaagctccagt

SEQ ID NO: 4768571 - DNA, 23 bp, Homo sapiens
gacataagctggtatcagtggtt

SEQ ID NO: 4768572 - DNA, 14 bp, Homo sapiens
gacatacacaaatg

SEQ ID NO: 4768573 - DNA, 12 bp, Homo sapiens
gacatccacatg

SEQ ID NO: 4768574 - DNA, 14 bp, Homo sapiens
gacatgagattcca

SEQ ID NO: 4768575 - DNA, 14 bp, Homo sapiens
gacatgcactgacc

SEQ ID NO: 4768576 - DNA, 16 bp, Homo sapiens
gacatggcaacaaagg

SEQ ID NO: 4768577 - DNA, 19 bp, Homo sapiens
gacatggcaacaaaggatg

SEQ ID NO: 4768578 - DNA, 15 bp, Homo sapiens
gacattgtcagaatg

SEQ ID NO: 4768579 - DNA, 22 bp, Homo sapiens
gacattgtcagaatgttgtgtt

SEQ ID NO: 4768580 - DNA, 17 bp, Homo sapiens
gaccaagtataaacttt

SEQ ID NO: 4768581 - DNA, 13 bp, Homo sapiens
gaccaatctctgt

SEQ ID NO: 4768582 - DNA, 15 bp, Homo sapiens
gaccaatctctgtga

SEQ ID NO: 4768583 - DNA, 20 bp, Homo sapiens
gaccacactctgcctggcct

SEQ ID NO: 4768584 - DNA, 20 bp, Homo sapiens
gaccaccacttgatgtctga

SEQ ID NO: 4768585 - DNA, 17 bp, Homo sapiens
gaccaccgcgcccctct

SEQ ID NO: 4768586 - DNA, 20 bp, Homo sapiens
gaccacggtccaatccagcc

SEQ ID NO: 4768587 - DNA, 17 bp, Homo sapiens
gaccacgtctccctggc

SEQ ID NO: 4768588 - DNA, 18 bp, Homo sapiens
gaccactgagagccacag

SEQ ID NO: 4768589 - DNA, 16 bp, Homo sapiens
gaccacttccttaaca

SEQ ID NO: 4768590 - DNA, 15 bp, Homo sapiens
gaccagagctgccac

SEQ ID NO: 4768591 - DNA, 17 bp, Homo sapiens
gaccagagctgccacct

SEQ ID NO: 4768592 - DNA, 19 bp, Homo sapiens
gaccagagctgccacctgc

SEQ ID NO: 4768593 - DNA, 21 bp, Homo sapiens
gaccagagctgccacctgcct

SEQ ID NO: 4768594 - DNA, 20 bp, Homo sapiens
gaccagcaccatctctcctc

SEQ ID NO: 4768595 - DNA, 17 bp, Homo sapiens
gaccagcatagttctgc

SEQ ID NO: 4768596 - DNA, 13 bp, Homo sapiens
gaccaggagccag

SEQ ID NO: 4768597 - DNA, 20 bp, Homo sapiens
gaccaggctcacaactgttt

SEQ ID NO: 4768598 - DNA, 16 bp, Homo sapiens
gacccacctcaccccg

SEQ ID NO: 4768599 - DNA, 22 bp, Homo sapiens
gacccatgtaaataccagactg

SEQ ID NO: 4768600 - DNA, 10 bp, Homo sapiens
gaccccacac

SEQ ID NO: 4768601 - DNA, 18 bp, Homo sapiens
gaccccaccctgtctgca

SEQ ID NO: 4768602 - DNA, 18 bp, Homo sapiens
gaccccagatacctgtga

SEQ ID NO: 4768603 - DNA, 21 bp, Homo sapiens
gacccccatggtaatgtaact

SEQ ID NO: 4768604 - DNA, 12 bp, Homo sapiens
gacccctgccct

SEQ ID NO: 4768605 - DNA, 15 bp, Homo sapiens
gacccctgccctcgg

SEQ ID NO: 4768606 - DNA, 18 bp, Homo sapiens
gacccctgccctcggcca

SEQ ID NO: 4768607 - DNA, 22 bp, Homo sapiens
gacccctgggggaggcttccag

SEQ ID NO: 4768608 - DNA, 17 bp, Homo sapiens
gaccctaggtgctcata

SEQ ID NO: 4768609 - DNA, 21 bp, Homo sapiens
gaccctccaccgcagaaggaa

SEQ ID NO: 4768610 - DNA, 18 bp, Homo sapiens
gaccctgccaactttcca

SEQ ID NO: 4768611 - DNA, 20 bp, Homo sapiens
gaccctgccaactttccaga

SEQ ID NO: 4768612 - DNA, 13 bp, Homo sapiens
gaccctgccaggg

SEQ ID NO: 4768613 - DNA, 22 bp, Homo sapiens
gaccctgcgcccctgcccagca

SEQ ID NO: 4768614 - DNA, 20 bp, Homo sapiens
gaccctgggtcaccttcctg

SEQ ID NO: 4768615 - DNA, 18 bp, Homo sapiens
gaccctgtgccccgcctc

SEQ ID NO: 4768616 - DNA, 20 bp, Homo sapiens
gaccctgtgccccgcctccc

SEQ ID NO: 4768617 - DNA, 16 bp, Homo sapiens
gaccctgtgcctgtgt

SEQ ID NO: 4768618 - DNA, 15 bp, Homo sapiens
gacccttccagacat

SEQ ID NO: 4768619 - DNA, 16 bp, Homo sapiens
gaccgccccaggcacc

SEQ ID NO: 4768620 - DNA, 15 bp, Homo sapiens
gaccggacgcatgca

SEQ ID NO: 4768621 - DNA, 15 bp, Homo sapiens
gaccggcccgccacc

SEQ ID NO: 4768622 - DNA, 15 bp, Homo sapiens
gaccgtgaggccaga

SEQ ID NO: 4768623 - DNA, 20 bp, Homo sapiens
gaccgtggtgtcctctgtcc

SEQ ID NO: 4768624 - DNA, 15 bp, Homo sapiens
gacctacatctgaaa

SEQ ID NO: 4768625 - DNA, 22 bp, Homo sapiens
gacctacatctgaaatctacaa

SEQ ID NO: 4768626 - DNA, 20 bp, Homo sapiens
gacctcacagtgacccttcc

SEQ ID NO: 4768627 - DNA, 23 bp, Homo sapiens
gacctccagattattttctatat

SEQ ID NO: 4768628 - DNA, 14 bp, Homo sapiens
gacctcccccaggg

SEQ ID NO: 4768629 - DNA, 20 bp, Homo sapiens
gacctctcacttttttataa

SEQ ID NO: 4768630 - DNA, 18 bp, Homo sapiens
gacctgaccagactgtgg

SEQ ID NO: 4768631 - DNA, 22 bp, Homo sapiens
gacctgcctctcacacacatag

SEQ ID NO: 4768632 - DNA, 11 bp, Homo sapiens
gacctgctcca

SEQ ID NO: 4768633 - DNA, 14 bp, Homo sapiens
gaccttacaaccac

SEQ ID NO: 4768634 - DNA, 13 bp, Homo sapiens
gaccttctgaaga

SEQ ID NO: 4768635 - DNA, 22 bp, Homo sapiens
gaccttctgcggctccgggctg

SEQ ID NO: 4768636 - DNA, 12 bp, Homo sapiens
gaccttgcttcc

SEQ ID NO: 4768637 - DNA, 18 bp, Homo sapiens
gaccttggagagacacag

SEQ ID NO: 4768638 - DNA, 22 bp, Homo sapiens
gacctttaagagaaatgagctg

SEQ ID NO: 4768639 - DNA, 19 bp, Homo sapiens
gacctttatttattaaact

SEQ ID NO: 4768640 - DNA, 23 bp, Homo sapiens
gacctttatttattaaacttcag

SEQ ID NO: 4768641 - DNA, 15 bp, Homo sapiens
gacctttttaatcca

SEQ ID NO: 4768642 - DNA, 17 bp, Homo sapiens
gacctttttaatccagg

SEQ ID NO: 4768643 - DNA, 19 bp, Homo sapiens
gacctttttaatccaggcc

SEQ ID NO: 4768644 - DNA, 20 bp, Homo sapiens
gacgacctacatctgaaatc

SEQ ID NO: 4768645 - DNA, 23 bp, Homo sapiens
gacgatccccatggaacagccct

SEQ ID NO: 4768646 - DNA, 19 bp, Homo sapiens
gacgcaagaggtttcagca

SEQ ID NO: 4768647 - DNA, 14 bp, Homo sapiens
gacgcccagccccc

SEQ ID NO: 4768648 - DNA, 13 bp, Homo sapiens
gacgcccctccgg

SEQ ID NO: 4768649 - DNA, 21 bp, Homo sapiens
gacgctgccgctgccgctgca

SEQ ID NO: 4768650 - DNA, 16 bp, Homo sapiens
gacgctggagaccctg

SEQ ID NO: 4768651 - DNA, 21 bp, Homo sapiens
gacgctggagaccctgcgccc

SEQ ID NO: 4768652 - DNA, 19 bp, Homo sapiens
gacgcttaacctttccgct

SEQ ID NO: 4768653 - DNA, 14 bp, Homo sapiens
gacggaagtggcct

SEQ ID NO: 4768654 - DNA, 21 bp, Homo sapiens
gacggaagtggcctgagaaga

SEQ ID NO: 4768655 - DNA, 18 bp, Homo sapiens
gacggaggcaggaccagg

SEQ ID NO: 4768656 - DNA, 12 bp, Homo sapiens
gacggcagcccc

SEQ ID NO: 4768657 - DNA, 18 bp, Homo sapiens
gacggcagccccatcctt

SEQ ID NO: 4768658 - DNA, 13 bp, Homo sapiens
gacggccctgcaa

SEQ ID NO: 4768659 - DNA, 19 bp, Homo sapiens
gacgggacagcggcccggc

SEQ ID NO: 4768660 - DNA, 23 bp, Homo sapiens
gacgtcatcggaggctgggcccc

SEQ ID NO: 4768661 - DNA, 22 bp, Homo sapiens
gactaaccccaacgcacaggaa

SEQ ID NO: 4768662 - DNA, 11 bp, Homo sapiens
gactacagaag

SEQ ID NO: 4768663 - DNA, 14 bp, Homo sapiens
gactacagaagtgg

SEQ ID NO: 4768664 - DNA, 17 bp, Homo sapiens
gactacagaagtggaag

SEQ ID NO: 4768665 - DNA, 13 bp, Homo sapiens
gactacagaattg

SEQ ID NO: 4768666 - DNA, 17 bp, Homo sapiens
gactacaggtattttca

SEQ ID NO: 4768667 - DNA, 16 bp, Homo sapiens
gactatggagcctggc

SEQ ID NO: 4768668 - DNA, 19 bp, Homo sapiens
gactcagtgcagggacagc

SEQ ID NO: 4768669 - DNA, 22 bp, Homo sapiens
gactcagtgcagggacagcctg

SEQ ID NO: 4768670 - DNA, 21 bp, Homo sapiens
gactccaagccctggggcagg

SEQ ID NO: 4768671 - DNA, 16 bp, Homo sapiens
gactccccgcccgccc

SEQ ID NO: 4768672 - DNA, 23 bp, Homo sapiens
gactccccgcccgccctcctctg

SEQ ID NO: 4768673 - DNA, 23 bp, Homo sapiens
gactccctgtgggggtggccatc

SEQ ID NO: 4768674 - DNA, 17 bp, Homo sapiens
gactcgcgagagggtgc

SEQ ID NO: 4768675 - DNA, 19 bp, Homo sapiens
gactcgcttagctgaaacc

SEQ ID NO: 4768676 - DNA, 21 bp, Homo sapiens
gactctaaaactatcagcagc

SEQ ID NO: 4768677 - DNA, 12 bp, Homo sapiens
gactctatgctc

SEQ ID NO: 4768678 - DNA, 13 bp, Homo sapiens
gactctatgctct

SEQ ID NO: 4768679 - DNA, 14 bp, Homo sapiens
gactctatgctctg

SEQ ID NO: 4768680 - DNA, 15 bp, Homo sapiens
gactctctcctctct

SEQ ID NO: 4768681 - DNA, 13 bp, Homo sapiens
gactctgaggtgt

SEQ ID NO: 4768682 - DNA, 15 bp, Homo sapiens
gactctggctgccaa

SEQ ID NO: 4768683 - DNA, 17 bp, Homo sapiens
gactctggctgccaaga

SEQ ID NO: 4768684 - DNA, 23 bp, Homo sapiens
gactctttattgtctgtaaatct

SEQ ID NO: 4768685 - DNA, 14 bp, Homo sapiens
gactgaatttctat

SEQ ID NO: 4768686 - DNA, 15 bp, Homo sapiens
gactgacttagcagg

SEQ ID NO: 4768687 - DNA, 23 bp, Homo sapiens
gactgagcctggcccatagaaac

SEQ ID NO: 4768688 - DNA, 13 bp, Homo sapiens
gactgatggttgc

SEQ ID NO: 4768689 - DNA, 18 bp, Homo sapiens
gactgatggttgctttga

SEQ ID NO: 4768690 - DNA, 16 bp, Homo sapiens
gactgattctgggatg

SEQ ID NO: 4768691 - DNA, 11 bp, Homo sapiens
gactgattgtt

SEQ ID NO: 4768692 - DNA, 21 bp, Homo sapiens
gactgcaggttggaccccaga

SEQ ID NO: 4768693 - DNA, 12 bp, Homo sapiens
gactgcccaccc

SEQ ID NO: 4768694 - DNA, 14 bp, Homo sapiens
gactgcccaccctg

SEQ ID NO: 4768695 - DNA, 18 bp, Homo sapiens
gactgcccaccctgggcc

SEQ ID NO: 4768696 - DNA, 22 bp, Homo sapiens
gactgcccaccctgggcctccc

SEQ ID NO: 4768697 - DNA, 21 bp, Homo sapiens
gactgcctctgccacactctg

SEQ ID NO: 4768698 - DNA, 21 bp, Homo sapiens
gactgctttcccaaaggccct

SEQ ID NO: 4768699 - DNA, 23 bp, Homo sapiens
gactggccaaggtttggggaaga

SEQ ID NO: 4768700 - DNA, 15 bp, Homo sapiens
gactggcccacccct

SEQ ID NO: 4768701 - DNA, 22 bp, Homo sapiens
gactggcccacccctcttcccc

SEQ ID NO: 4768702 - DNA, 15 bp, Homo sapiens
gactggttgtctctc

SEQ ID NO: 4768703 - DNA, 17 bp, Homo sapiens
gactgtcttcaaccctg

SEQ ID NO: 4768704 - DNA, 19 bp, Homo sapiens
gactgtcttcaaccctgcc

SEQ ID NO: 4768705 - DNA, 22 bp, Homo sapiens
gactgtcttcaaccctgccctg

SEQ ID NO: 4768706 - DNA, 19 bp, Homo sapiens
gactgtgggtccctgcgtc

SEQ ID NO: 4768707 - DNA, 16 bp, Homo sapiens
gactgttatctcggac

SEQ ID NO: 4768708 - DNA, 15 bp, Homo sapiens
gactgttctcttact

SEQ ID NO: 4768709 - DNA, 19 bp, Homo sapiens
gacttaagcacacttgaca

SEQ ID NO: 4768710 - DNA, 23 bp, Homo sapiens
gacttcaaatgtgtaactttatt

SEQ ID NO: 4768711 - DNA, 12 bp, Homo sapiens
gacttcacaaaa

SEQ ID NO: 4768712 - DNA, 15 bp, Homo sapiens
gacttcagactctct

SEQ ID NO: 4768713 - DNA, 23 bp, Homo sapiens
gacttcagactctctcctctctc

SEQ ID NO: 4768714 - DNA, 15 bp, Homo sapiens
gacttccatttggaa

SEQ ID NO: 4768715 - DNA, 14 bp, Homo sapiens
gacttcccagctgg

SEQ ID NO: 4768716 - DNA, 22 bp, Homo sapiens
gacttcccagctggcagcgcct

SEQ ID NO: 4768717 - DNA, 17 bp, Homo sapiens
gacttcccgggaacgct

SEQ ID NO: 4768718 - DNA, 18 bp, Homo sapiens
gacttcctattaatttat

SEQ ID NO: 4768719 - DNA, 21 bp, Homo sapiens
gacttcgctattcccaggcag

SEQ ID NO: 4768720 - DNA, 13 bp, Homo sapiens
gacttctgcagct

SEQ ID NO: 4768721 - DNA, 22 bp, Homo sapiens
gacttctttactaacactggct

SEQ ID NO: 4768722 - DNA, 15 bp, Homo sapiens
gacttgcagttagac

SEQ ID NO: 4768723 - DNA, 13 bp, Homo sapiens
gacttgccactgc

SEQ ID NO: 4768724 - DNA, 23 bp, Homo sapiens
gacttggataggagcttccagat

SEQ ID NO: 4768725 - DNA, 20 bp, Homo sapiens
gacttggatgtcatatcttc

SEQ ID NO: 4768726 - DNA, 19 bp, Homo sapiens
gacttgtgcgccggcgccc

SEQ ID NO: 4768727 - DNA, 23 bp, Homo sapiens
gacttgtgcgccggcgccccgga

SEQ ID NO: 4768728 - DNA, 20 bp, Homo sapiens
gagaaaacatctcatcatgt

SEQ ID NO: 4768729 - DNA, 12 bp, Homo sapiens
gagaaaagccag

SEQ ID NO: 4768730 - DNA, 21 bp, Homo sapiens
gagaaactcgggcactcccta

SEQ ID NO: 4768731 - DNA, 14 bp, Homo sapiens
gagaaatgagcttg

SEQ ID NO: 4768732 - DNA, 21 bp, Homo sapiens
gagaaccccccgcaatgtgct

SEQ ID NO: 4768733 - DNA, 21 bp, Homo sapiens
gagaagaaagaacggaagaag

SEQ ID NO: 4768734 - DNA, 16 bp, Homo sapiens
gagaagagaatgcaca

SEQ ID NO: 4768735 - DNA, 12 bp, Homo sapiens
gagaagaggagc

SEQ ID NO: 4768736 - DNA, 12 bp, Homo sapiens
gagaaggaggaa

SEQ ID NO: 4768737 - DNA, 17 bp, Homo sapiens
gagaaggccccagggca

SEQ ID NO: 4768738 - DNA, 14 bp, Homo sapiens
gagaagtgtgttct

SEQ ID NO: 4768739 - DNA, 23 bp, Homo sapiens
gagacaaagtttggaagtacata

SEQ ID NO: 4768740 - DNA, 16 bp, Homo sapiens
gagaccaagtctctct

SEQ ID NO: 4768741 - DNA, 23 bp, Homo sapiens
gagaccaccgcgcccctctgcgc

SEQ ID NO: 4768742 - DNA, 16 bp, Homo sapiens
gagaccacttccttaa

SEQ ID NO: 4768743 - DNA, 18 bp, Homo sapiens
gagaccacttccttaaca

SEQ ID NO: 4768744 - DNA, 21 bp, Homo sapiens
gagaccacttccttaacagct

SEQ ID NO: 4768745 - DNA, 15 bp, Homo sapiens
gagaccctgcgcccc

SEQ ID NO: 4768746 - DNA, 17 bp, Homo sapiens
gagaccctgcgcccctg

SEQ ID NO: 4768747 - DNA, 17 bp, Homo sapiens
gagacctcccccaggga

SEQ ID NO: 4768748 - DNA, 15 bp, Homo sapiens
gagacggcagcccca

SEQ ID NO: 4768749 - DNA, 19 bp, Homo sapiens
gagactaacttattttgat

SEQ ID NO: 4768750 - DNA, 22 bp, Homo sapiens
gagactaacttattttgattgt

SEQ ID NO: 4768751 - DNA, 14 bp, Homo sapiens
gagactatgtgtca

SEQ ID NO: 4768752 - DNA, 14 bp, Homo sapiens
gagactcgcctggg

SEQ ID NO: 4768753 - DNA, 14 bp, Homo sapiens
gagactgcccaccc

SEQ ID NO: 4768754 - DNA, 15 bp, Homo sapiens
gagactgcccaccct

SEQ ID NO: 4768755 - DNA, 19 bp, Homo sapiens
gagactggaggcatttctt

SEQ ID NO: 4768756 - DNA, 18 bp, Homo sapiens
gagacttctaaatcataa

SEQ ID NO: 4768757 - DNA, 15 bp, Homo sapiens
gagagaaaggagggc

SEQ ID NO: 4768758 - DNA, 20 bp, Homo sapiens
gagagacaacttgctccttt

SEQ ID NO: 4768759 - DNA, 19 bp, Homo sapiens
gagagagcaatcttgctgt

SEQ ID NO: 4768760 - DNA, 22 bp, Homo sapiens
gagagagcaatcttgctgtgaa

SEQ ID NO: 4768761 - DNA, 13 bp, Homo sapiens
gagagaggcctgg

SEQ ID NO: 4768762 - DNA, 15 bp, Homo sapiens
gagagcccctggggc

SEQ ID NO: 4768763 - DNA, 14 bp, Homo sapiens
gagagcgccacccg

SEQ ID NO: 4768764 - DNA, 19 bp, Homo sapiens
gagagctcaagtttcagag

SEQ ID NO: 4768765 - DNA, 15 bp, Homo sapiens
gagaggaccccctga

SEQ ID NO: 4768766 - DNA, 19 bp, Homo sapiens
gagaggaggtgtggagtgg

SEQ ID NO: 4768767 - DNA, 14 bp, Homo sapiens
gagaggcctgggtg

SEQ ID NO: 4768768 - DNA, 17 bp, Homo sapiens
ctgtatacaaacaggtg

SEQ ID NO: 4768769 - DNA, 19 bp, Homo sapiens
ctgtatatagatgtctgtg

SEQ ID NO: 4768770 - DNA, 21 bp, Homo sapiens
ctgtatatagatgtctgtgta

SEQ ID NO: 4768771 - DNA, 22 bp, Homo sapiens
ctgtatatagatgtctgtgtat

SEQ ID NO: 4768772 - DNA, 12 bp, Homo sapiens
ctgtatatttgt

SEQ ID NO: 4768773 - DNA, 15 bp, Homo sapiens
ctgtatatttgtatg

SEQ ID NO: 4768774 - DNA, 16 bp, Homo sapiens
ctgtatatttgtatga

SEQ ID NO: 4768775 - DNA, 19 bp, Homo sapiens
ctgtatgatttaggcttct

SEQ ID NO: 4768776 - DNA, 17 bp, Homo sapiens
ctgtattacataaataa

SEQ ID NO: 4768777 - DNA, 19 bp, Homo sapiens
ctgtattgaaaaaatattg

SEQ ID NO: 4768778 - DNA, 22 bp, Homo sapiens
ctgtattggcagcacagctact

SEQ ID NO: 4768779 - DNA, 19 bp, Homo sapiens
ctgtattgttacagctgaa

SEQ ID NO: 4768780 - DNA, 20 bp, Homo sapiens
ctgtatttgaggaaactcat

SEQ ID NO: 4768781 - DNA, 19 bp, Homo sapiens
ctgtcaaatccatgtgtcc

SEQ ID NO: 4768782 - DNA, 20 bp, Homo sapiens
ctgtcaaatccatgtgtccc

SEQ ID NO: 4768783 - DNA, 17 bp, Homo sapiens
ctgtcaacctgaattaa

SEQ ID NO: 4768784 - DNA, 18 bp, Homo sapiens
ctgtcaacctgaattaaa

SEQ ID NO: 4768785 - DNA, 19 bp, Homo sapiens
ctgtcaacctgaattaaag

SEQ ID NO: 4768786 - DNA, 11 bp, Homo sapiens
ctgtcactgtc

SEQ ID NO: 4768787 - DNA, 16 bp, Homo sapiens
ctgtcagccagccgcc

SEQ ID NO: 4768788 - DNA, 19 bp, Homo sapiens
ctgtcagccagccgccctg

SEQ ID NO: 4768789 - DNA, 23 bp, Homo sapiens
ctgtcagccagccgccctgggct

SEQ ID NO: 4768790 - DNA, 16 bp, Homo sapiens
ctgtcagcttcccaac

SEQ ID NO: 4768791 - DNA, 19 bp, Homo sapiens
ctgtcagcttcccaacaat

SEQ ID NO: 4768792 - DNA, 20 bp, Homo sapiens
ctgtcagcttcccaacaata

SEQ ID NO: 4768793 - DNA, 14 bp, Homo sapiens
ctgtcagggccttg

SEQ ID NO: 4768794 - DNA, 22 bp, Homo sapiens
ctgtcagttatgacatccacaa

SEQ ID NO: 4768795 - DNA, 16 bp, Homo sapiens
ctgtcagtttgtgaag

SEQ ID NO: 4768796 - DNA, 17 bp, Homo sapiens
ctgtcagtttgtgaagt

SEQ ID NO: 4768797 - DNA, 14 bp, Homo sapiens
ctgtcatctctctg

SEQ ID NO: 4768798 - DNA, 17 bp, Homo sapiens
ctgtcattagaattgaa

SEQ ID NO: 4768799 - DNA, 22 bp, Homo sapiens
ctgtcattggttacaaattttt

SEQ ID NO: 4768800 - DNA, 19 bp, Homo sapiens
ctgtcccaccgggagcctc

SEQ ID NO: 4768801 - DNA, 16 bp, Homo sapiens
ctgtcccctcctcgcc

SEQ ID NO: 4768802 - DNA, 17 bp, Homo sapiens
ctgtcccctgcaagtgg

SEQ ID NO: 4768803 - DNA, 21 bp, Homo sapiens
ctgtcccggagctcaggccct

SEQ ID NO: 4768804 - DNA, 14 bp, Homo sapiens
ctgtccctaaacat

SEQ ID NO: 4768805 - DNA, 17 bp, Homo sapiens
ctgtccctaaacatagt

SEQ ID NO: 4768806 - DNA, 22 bp, Homo sapiens
ctgtccctaaacatagtggtat

SEQ ID NO: 4768807 - DNA, 23 bp, Homo sapiens
ctgtccctagggctctccaagca

SEQ ID NO: 4768808 - DNA, 12 bp, Homo sapiens
ctgtccctgtgg

SEQ ID NO: 4768809 - DNA, 18 bp, Homo sapiens
ctgtccctgtgggctcac

SEQ ID NO: 4768810 - DNA, 21 bp, Homo sapiens
ctgtccctgtgggctcacacc

SEQ ID NO: 4768811 - DNA, 20 bp, Homo sapiens
ctgtccgcgtcctttcctct

SEQ ID NO: 4768812 - DNA, 19 bp, Homo sapiens
ctgtccgtctgtcctgcgc

SEQ ID NO: 4768813 - DNA, 22 bp, Homo sapiens
ctgtcctctcagaactcctgtg

SEQ ID NO: 4768814 - DNA, 13 bp, Homo sapiens
ctgtcctctcgag

SEQ ID NO: 4768815 - DNA, 18 bp, Homo sapiens
ctgtcctctcgagcccag

SEQ ID NO: 4768816 - DNA, 13 bp, Homo sapiens
ctgtcctgagccc

SEQ ID NO: 4768817 - DNA, 18 bp, Homo sapiens
ctgtcctgagccccctgc

SEQ ID NO: 4768818 - DNA, 19 bp, Homo sapiens
ctgtcctgagccccctgca

SEQ ID NO: 4768819 - DNA, 20 bp, Homo sapiens
ctgtcctgagccccctgcac

SEQ ID NO: 4768820 - DNA, 21 bp, Homo sapiens
ctgtcctgagccccctgcacc

SEQ ID NO: 4768821 - DNA, 22 bp, Homo sapiens
ctgtcctgagccccctgcaccc

SEQ ID NO: 4768822 - DNA, 13 bp, Homo sapiens
ctgtcctggcccg

SEQ ID NO: 4768823 - DNA, 23 bp, Homo sapiens
ctgtcctggcccgggagccgcag

SEQ ID NO: 4768824 - DNA, 14 bp, Homo sapiens
ctgtcctggctccc

SEQ ID NO: 4768825 - DNA, 16 bp, Homo sapiens
ctgtcctggctcccag

SEQ ID NO: 4768826 - DNA, 17 bp, Homo sapiens
ctgtcctgtaactgtta

SEQ ID NO: 4768827 - DNA, 20 bp, Homo sapiens
ctgtcctgttgattaatttc

SEQ ID NO: 4768828 - DNA, 15 bp, Homo sapiens
ctgtccttcccccag

SEQ ID NO: 4768829 - DNA, 17 bp, Homo sapiens
ctgtccttcccccagca

SEQ ID NO: 4768830 - DNA, 17 bp, Homo sapiens
ctgtcgcatttcatcaa

SEQ ID NO: 4768831 - DNA, 13 bp, Homo sapiens
ctgtcgccccagg

SEQ ID NO: 4768832 - DNA, 22 bp, Homo sapiens
ctgtcgccccaggccctccctg

SEQ ID NO: 4768833 - DNA, 16 bp, Homo sapiens
ctgtctaacttgggga

SEQ ID NO: 4768834 - DNA, 22 bp, Homo sapiens
ctgtctctacaaaaaaaatcaa

SEQ ID NO: 4768835 - DNA, 17 bp, Homo sapiens
ctgtctctccctaccct

SEQ ID NO: 4768836 - DNA, 18 bp, Homo sapiens
ctgtctcttgggaagcag

SEQ ID NO: 4768837 - DNA, 20 bp, Homo sapiens
ctgtctcttgggaagcagtt

SEQ ID NO: 4768838 - DNA, 20 bp, Homo sapiens
ctgtctgagccctgccctca

SEQ ID NO: 4768839 - DNA, 22 bp, Homo sapiens
ctgtctgagccctgccctcact

SEQ ID NO: 4768840 - DNA, 20 bp, Homo sapiens
ctgtctgcaggccaccccca

SEQ ID NO: 4768841 - DNA, 16 bp, Homo sapiens
ctgtctggctgtacgt

SEQ ID NO: 4768842 - DNA, 16 bp, Homo sapiens
ctgtctgtctctcttt

SEQ ID NO: 4768843 - DNA, 19 bp, Homo sapiens
ctgtctgtgtgaggctccc

SEQ ID NO: 4768844 - DNA, 22 bp, Homo sapiens
ctgtcttactaataggtctgga

SEQ ID NO: 4768845 - DNA, 18 bp, Homo sapiens
ctgtcttcaaccctgccc

SEQ ID NO: 4768846 - DNA, 22 bp, Homo sapiens
ctgtgaaagtctcctgtatcat

SEQ ID NO: 4768847 - DNA, 14 bp, Homo sapiens
ctgtgaaatatcat

SEQ ID NO: 4768848 - DNA, 23 bp, Homo sapiens
ctgtgaaatatcatcacgtatgt

SEQ ID NO: 4768849 - DNA, 16 bp, Homo sapiens
ctgtgaaatgactgca

SEQ ID NO: 4768850 - DNA, 15 bp, Homo sapiens
ctgtgaactgccagg

SEQ ID NO: 4768851 - DNA, 18 bp, Homo sapiens
ctgtgaagcctttatcta

SEQ ID NO: 4768852 - DNA, 17 bp, Homo sapiens
ctgtgacacagctgagc

SEQ ID NO: 4768853 - DNA, 18 bp, Homo sapiens
ctgtgacacagctgagct

SEQ ID NO: 4768854 - DNA, 20 bp, Homo sapiens
ctgtgactcgcttagctgaa

SEQ ID NO: 4768855 - DNA, 17 bp, Homo sapiens
ctgtgaggacagggccc

SEQ ID NO: 4768856 - DNA, 13 bp, Homo sapiens
ctgtgaggactgg

SEQ ID NO: 4768857 - DNA, 16 bp, Homo sapiens
ctgtgagtctgtcctt

SEQ ID NO: 4768858 - DNA, 13 bp, Homo sapiens
ctgtgataacaga

SEQ ID NO: 4768859 - DNA, 20 bp, Homo sapiens
ctgtgatcgtgtgttgccat

SEQ ID NO: 4768860 - DNA, 14 bp, Homo sapiens
ctgtgatgcatgag

SEQ ID NO: 4768861 - DNA, 16 bp, Homo sapiens
ctgtgatgcatgagct

SEQ ID NO: 4768862 - DNA, 21 bp, Homo sapiens
ctgtgatgcatgagctccctc

SEQ ID NO: 4768863 - DNA, 16 bp, Homo sapiens
cttaattataagctat

SEQ ID NO: 4768864 - DNA, 18 bp, Homo sapiens
cttaattcttacctcatt

SEQ ID NO: 4768865 - DNA, 22 bp, Homo sapiens
cttaattcttacctcatttgca

SEQ ID NO: 4768866 - DNA, 21 bp, Homo sapiens
cttacaaagccagctctgagc

SEQ ID NO: 4768867 - DNA, 16 bp, Homo sapiens
cttacacacctgagaa

SEQ ID NO: 4768868 - DNA, 17 bp, Homo sapiens
cttacagacagaatata

SEQ ID NO: 4768869 - DNA, 21 bp, Homo sapiens
cttacagtattttctatgtaa

SEQ ID NO: 4768870 - DNA, 22 bp, Homo sapiens
cttacccaaactgttcaagaaa

SEQ ID NO: 4768871 - DNA, 14 bp, Homo sapiens
cttacccacttccc

SEQ ID NO: 4768872 - DNA, 18 bp, Homo sapiens
cttaccgaaatgaaaatg

SEQ ID NO: 4768873 - DNA, 13 bp, Homo sapiens
cttacctcacacg

SEQ ID NO: 4768874 - DNA, 13 bp, Homo sapiens
cttacctgacaca

SEQ ID NO: 4768875 - DNA, 15 bp, Homo sapiens
cttacgtgagtcctg

SEQ ID NO: 4768876 - DNA, 17 bp, Homo sapiens
cttactaataggtctgg

SEQ ID NO: 4768877 - DNA, 19 bp, Homo sapiens
cttacttagaatttatcct

SEQ ID NO: 4768878 - DNA, 16 bp, Homo sapiens
cttagaagaatattgt

SEQ ID NO: 4768879 - DNA, 15 bp, Homo sapiens
cttagaagatgttgt

SEQ ID NO: 4768880 - DNA, 16 bp, Homo sapiens
cttagaatgtgaaaaa

SEQ ID NO: 4768881 - DNA, 14 bp, Homo sapiens
cttagacccagtca

SEQ ID NO: 4768882 - DNA, 16 bp, Homo sapiens
cttagcctccagcacc

SEQ ID NO: 4768883 - DNA, 19 bp, Homo sapiens
cttagcctttaataggctt

SEQ ID NO: 4768884 - DNA, 21 bp, Homo sapiens
cttagctccctcccgcacccc

SEQ ID NO: 4768885 - DNA, 17 bp, Homo sapiens
cttagctcccttgagct

SEQ ID NO: 4768886 - DNA, 17 bp, Homo sapiens
cttagcttagaccgtgg

SEQ ID NO: 4768887 - DNA, 19 bp, Homo sapiens
cttagcttagaccgtggtg

SEQ ID NO: 4768888 - DNA, 13 bp, Homo sapiens
cttagcttttctg

SEQ ID NO: 4768889 - DNA, 16 bp, Homo sapiens
cttaggatttaccaaa

SEQ ID NO: 4768890 - DNA, 13 bp, Homo sapiens
cttagtaaattcc

SEQ ID NO: 4768891 - DNA, 14 bp, Homo sapiens
cttagtaaattcct

SEQ ID NO: 4768892 - DNA, 14 bp, Homo sapiens
cttatagagcacaa

SEQ ID NO: 4768893 - DNA, 16 bp, Homo sapiens
cttatggagtgtgcct

SEQ ID NO: 4768894 - DNA, 23 bp, Homo sapiens
cttatgtcatttcttctctctgt

SEQ ID NO: 4768895 - DNA, 18 bp, Homo sapiens
cttattaaaacacttcat

SEQ ID NO: 4768896 - DNA, 13 bp, Homo sapiens
cttattagcagct

SEQ ID NO: 4768897 - DNA, 16 bp, Homo sapiens
cttattcaaagagaaa

SEQ ID NO: 4768898 - DNA, 22 bp, Homo sapiens
cttattgtttttggatggctta

SEQ ID NO: 4768899 - DNA, 23 bp, Homo sapiens
cttatttcactttagtttttgaa

SEQ ID NO: 4768900 - DNA, 18 bp, Homo sapiens
cttatttgtatttttcct

SEQ ID NO: 4768901 - DNA, 22 bp, Homo sapiens
cttattttgattgtttgatgaa

SEQ ID NO: 4768902 - DNA, 22 bp, Homo sapiens
cttcaaaatattgagcagaatt

SEQ ID NO: 4768903 - DNA, 17 bp, Homo sapiens
cttcaaattgtcttttg

SEQ ID NO: 4768904 - DNA, 15 bp, Homo sapiens
cttcaaccctgccct

SEQ ID NO: 4768905 - DNA, 19 bp, Homo sapiens
cttcaaccctgccctgcac

SEQ ID NO: 4768906 - DNA, 14 bp, Homo sapiens
cttcaatgtgaaac

SEQ ID NO: 4768907 - DNA, 14 bp, Homo sapiens
cttcaatgttaaat

SEQ ID NO: 4768908 - DNA, 15 bp, Homo sapiens
cttcaattaatggaa

SEQ ID NO: 4768909 - DNA, 21 bp, Homo sapiens
cttcaattaatggaaaactgt

SEQ ID NO: 4768910 - DNA, 10 bp, Homo sapiens
cttcaatttg

SEQ ID NO: 4768911 - DNA, 19 bp, Homo sapiens
cttcaatttgtataaaatg

SEQ ID NO: 4768912 - DNA, 13 bp, Homo sapiens
cttcacacaaagt

SEQ ID NO: 4768913 - DNA, 14 bp, Homo sapiens
cttcacacaaagtg

SEQ ID NO: 4768914 - DNA, 12 bp, Homo sapiens
cttcaccaggaa

SEQ ID NO: 4768915 - DNA, 22 bp, Homo sapiens
cttcaccaggaagaaggcccgg

SEQ ID NO: 4768916 - DNA, 14 bp, Homo sapiens
cttcaccccggcag

SEQ ID NO: 4768917 - DNA, 17 bp, Homo sapiens
cttcaccccggcaggcc

SEQ ID NO: 4768918 - DNA, 18 bp, Homo sapiens
cttcaccccggcaggccc

SEQ ID NO: 4768919 - DNA, 23 bp, Homo sapiens
cttcaccccggcaggccctgcag

SEQ ID NO: 4768920 - DNA, 20 bp, Homo sapiens
cttcaccgtgacattccagc

SEQ ID NO: 4768921 - DNA, 16 bp, Homo sapiens
cttcacctccttctgc

SEQ ID NO: 4768922 - DNA, 14 bp, Homo sapiens
cttcacgattctta

SEQ ID NO: 4768923 - DNA, 19 bp, Homo sapiens
cttcactgtcttactcaag

SEQ ID NO: 4768924 - DNA, 20 bp, Homo sapiens
cttcacttaaaatcaaattt

SEQ ID NO: 4768925 - DNA, 21 bp, Homo sapiens
cttcagaatatggacaaagaa

SEQ ID NO: 4768926 - DNA, 23 bp, Homo sapiens
cttcagaattgtttttagaaatt

SEQ ID NO: 4768927 - DNA, 19 bp, Homo sapiens
cttcagacacacggggcac

SEQ ID NO: 4768928 - DNA, 16 bp, Homo sapiens
cttcagactctctcct

SEQ ID NO: 4768929 - DNA, 11 bp, Homo sapiens
cttcagcaacc

SEQ ID NO: 4768930 - DNA, 13 bp, Homo sapiens
cttcagcaaccct

SEQ ID NO: 4768931 - DNA, 23 bp, Homo sapiens
cttcagcaaccctacagtatata

SEQ ID NO: 4768932 - DNA, 17 bp, Homo sapiens
cttcagcaatccttaaa

SEQ ID NO: 4768933 - DNA, 17 bp, Homo sapiens
cttcaggtcccctggcc

SEQ ID NO: 4768934 - DNA, 19 bp, Homo sapiens
cttcaggtcccctggccct

SEQ ID NO: 4768935 - DNA, 13 bp, Homo sapiens
cttcagtcattaa

SEQ ID NO: 4768936 - DNA, 15 bp, Homo sapiens
cttcagtcctgggag

SEQ ID NO: 4768937 - DNA, 18 bp, Homo sapiens
cttcagtcctgggagacc

SEQ ID NO: 4768938 - DNA, 14 bp, Homo sapiens
cttcagttctcatc

SEQ ID NO: 4768939 - DNA, 17 bp, Homo sapiens
cttcagttctcatcttg

SEQ ID NO: 4768940 - DNA, 18 bp, Homo sapiens
cttcataaattatttcta

SEQ ID NO: 4768941 - DNA, 23 bp, Homo sapiens
cttcatacaaaggacagtacaca

SEQ ID NO: 4768942 - DNA, 16 bp, Homo sapiens
cttcataggcagagcc

SEQ ID NO: 4768943 - DNA, 21 bp, Homo sapiens
cttcatccatagacacagtat

SEQ ID NO: 4768944 - DNA, 16 bp, Homo sapiens
cttcatccctttccag

SEQ ID NO: 4768945 - DNA, 16 bp, Homo sapiens
cttcatcctcctcaga

SEQ ID NO: 4768946 - DNA, 13 bp, Homo sapiens
cttcatctggagt

SEQ ID NO: 4768947 - DNA, 17 bp, Homo sapiens
cttcatgaccttacata

SEQ ID NO: 4768948 - DNA, 17 bp, Homo sapiens
cttcatgcgcagtcccc

SEQ ID NO: 4768949 - DNA, 22 bp, Homo sapiens
cttcatgcgcagtccccaggta

SEQ ID NO: 4768950 - DNA, 16 bp, Homo sapiens
cttcatgctgtctgtg

SEQ ID NO: 4768951 - DNA, 12 bp, Homo sapiens
cttcatgcttga

SEQ ID NO: 4768952 - DNA, 18 bp, Homo sapiens
cttcatgcttttctcatg

SEQ ID NO: 4768953 - DNA, 13 bp, Homo sapiens
cttcatgtaaatt

SEQ ID NO: 4768954 - DNA, 22 bp, Homo sapiens
cttcatgtaaattgactgtact

SEQ ID NO: 4768955 - DNA, 23 bp, Homo sapiens
cttcattaaaacaagagaccact

SEQ ID NO: 4768956 - DNA, 19 bp, Homo sapiens
cttcattgggaagtatgat

SEQ ID NO: 4768957 - DNA, 13 bp, Homo sapiens
cttccacaagagc

SEQ ID NO: 4768958 - DNA, 15 bp, Homo sapiens
cttccacaagagccc

SEQ ID NO: 4768959 - DNA, 22 bp, Homo sapiens
cttccacaagagcccaggcctc

SEQ ID NO: 4768960 - DNA, 12 bp, Homo sapiens
cttccaccctgc

SEQ ID NO: 4768961 - DNA, 13 bp, Homo sapiens
cttccaccctgcc

SEQ ID NO: 4768962 - DNA, 14 bp, Homo sapiens
cttccaccctgccc

SEQ ID NO: 4768963 - DNA, 18 bp, Homo sapiens
cttccaccctgccctggc

SEQ ID NO: 4768964 - DNA, 19 bp, Homo sapiens
cttccaccctgccctggcc

SEQ ID NO: 4768965 - DNA, 20 bp, Homo sapiens
cttccaccctgccctggcct

SEQ ID NO: 4768966 - DNA, 21 bp, Homo sapiens
cttccaccctgccctggccta

SEQ ID NO: 4768967 - DNA, 13 bp, Homo sapiens
cttccactgcctc

SEQ ID NO: 4768968 - DNA, 16 bp, Homo sapiens
cttccactgcctctgc

SEQ ID NO: 4768969 - DNA, 18 bp, Homo sapiens
cttccactgcctctgcct

SEQ ID NO: 4768970 - DNA, 12 bp, Homo sapiens
cttccagacata

SEQ ID NO: 4768971 - DNA, 13 bp, Homo sapiens
cttccagctttct

SEQ ID NO: 4768972 - DNA, 19 bp, Homo sapiens
cttccagctttctctttgt

SEQ ID NO: 4768973 - DNA, 15 bp, Homo sapiens
cttccaggacccctg

SEQ ID NO: 4768974 - DNA, 17 bp, Homo sapiens
cttccaggacccctggg

SEQ ID NO: 4768975 - DNA, 15 bp, Homo sapiens
cttccatatgctctt

SEQ ID NO: 4768976 - DNA, 14 bp, Homo sapiens
cttccatttggaat

SEQ ID NO: 4768977 - DNA, 23 bp, Homo sapiens
cttcccaaagtcctgggattaca

SEQ ID NO: 4768978 - DNA, 21 bp, Homo sapiens
cttcccaacgtactcctcaga

SEQ ID NO: 4768979 - DNA, 22 bp, Homo sapiens
cttcccaagtcctcgccccccg

SEQ ID NO: 4768980 - DNA, 15 bp, Homo sapiens
cttcccacctccctg

SEQ ID NO: 4768981 - DNA, 16 bp, Homo sapiens
cttcccacctccctgc

SEQ ID NO: 4768982 - DNA, 19 bp, Homo sapiens
cttcccacctccctgccca

SEQ ID NO: 4768983 - DNA, 21 bp, Homo sapiens
cttcccacctccctgcccagg

SEQ ID NO: 4768984 - DNA, 22 bp, Homo sapiens
cttcccacgtccctcgagctct

SEQ ID NO: 4768985 - DNA, 13 bp, Homo sapiens
cttctttccttcc

SEQ ID NO: 4768986 - DNA, 15 bp, Homo sapiens
cttcttttcaatgca

SEQ ID NO: 4768987 - DNA, 17 bp, Homo sapiens
cttcttttcaatgcaat

SEQ ID NO: 4768988 - DNA, 18 bp, Homo sapiens
cttcttttcaatgcaatg

SEQ ID NO: 4768989 - DNA, 19 bp, Homo sapiens
cttcttttcaatgcaatgc

SEQ ID NO: 4768990 - DNA, 14 bp, Homo sapiens
cttcttttcccatt

SEQ ID NO: 4768991 - DNA, 12 bp, Homo sapiens
cttctttttggt

SEQ ID NO: 4768992 - DNA, 17 bp, Homo sapiens
cttgaaaactctcagtc

SEQ ID NO: 4768993 - DNA, 17 bp, Homo sapiens
cttgaaaccagctcagg

SEQ ID NO: 4768994 - DNA, 17 bp, Homo sapiens
cttgaaattatatctgt

SEQ ID NO: 4768995 - DNA, 17 bp, Homo sapiens
cttgaaatttctcagcg

SEQ ID NO: 4768996 - DNA, 13 bp, Homo sapiens
cttgaagaactga

SEQ ID NO: 4768997 - DNA, 13 bp, Homo sapiens
cttgaagaatatt

SEQ ID NO: 4768998 - DNA, 16 bp, Homo sapiens
cttgaagacttttctt

SEQ ID NO: 4768999 - DNA, 15 bp, Homo sapiens
cttgaatagtattgt

SEQ ID NO: 4769000 - DNA, 19 bp, Homo sapiens
cttgaattgtaaggaatga

SEQ ID NO: 4769001 - DNA, 17 bp, Homo sapiens
cttgacaggcgccgcct

SEQ ID NO: 4769002 - DNA, 22 bp, Homo sapiens
cttgacagttacttacacacct

SEQ ID NO: 4769003 - DNA, 14 bp, Homo sapiens
cttgaccccacacg

SEQ ID NO: 4769004 - DNA, 14 bp, Homo sapiens
cttgaccctgaaat

SEQ ID NO: 4769005 - DNA, 17 bp, Homo sapiens
cttgaccgtgaggccag

SEQ ID NO: 4769006 - DNA, 18 bp, Homo sapiens
cttgaccgtgaggccaga

SEQ ID NO: 4769007 - DNA, 18 bp, Homo sapiens
cttgaccttcctctgggg

SEQ ID NO: 4769008 - DNA, 21 bp, Homo sapiens
cttgaccttcctctggggctc

SEQ ID NO: 4769009 - DNA, 18 bp, Homo sapiens
cttgaccttttcgacgct

SEQ ID NO: 4769010 - DNA, 11 bp, Homo sapiens
cttgactgtta

SEQ ID NO: 4769011 - DNA, 21 bp, Homo sapiens
cttgagcaaggcaagaagtgg

SEQ ID NO: 4769012 - DNA, 23 bp, Homo sapiens
cttgagcactattctaaggagca

SEQ ID NO: 4769013 - DNA, 14 bp, Homo sapiens
cttgagcagctgaa

SEQ ID NO: 4769014 - DNA, 20 bp, Homo sapiens
cttgagcatgcccaaatata

SEQ ID NO: 4769015 - DNA, 17 bp, Homo sapiens
cttgaggccaaatgagt

SEQ ID NO: 4769016 - DNA, 14 bp, Homo sapiens
cttgagtttcattt

SEQ ID NO: 4769017 - DNA, 19 bp, Homo sapiens
cttgagtttcatttttcat

SEQ ID NO: 4769018 - DNA, 15 bp, Homo sapiens
cttgatatcccaagt

SEQ ID NO: 4769019 - DNA, 17 bp, Homo sapiens
cttgatgtctgaggata

SEQ ID NO: 4769020 - DNA, 22 bp, Homo sapiens
cttgattaaggactacagaatt

SEQ ID NO: 4769021 - DNA, 14 bp, Homo sapiens
cttgattacataat

SEQ ID NO: 4769022 - DNA, 12 bp, Homo sapiens
cttgattcataa

SEQ ID NO: 4769023 - DNA, 14 bp, Homo sapiens
cttgcactgtatcc

SEQ ID NO: 4769024 - DNA, 15 bp, Homo sapiens
cttgcacttctgtta

SEQ ID NO: 4769025 - DNA, 13 bp, Homo sapiens
cttgcagcagaga

SEQ ID NO: 4769026 - DNA, 11 bp, Homo sapiens
ctggcctggcc

SEQ ID NO: 4769027 - DNA, 21 bp, Homo sapiens
ctggcctggccctgccctgag

SEQ ID NO: 4769028 - DNA, 13 bp, Homo sapiens
ctggcctggcctg

SEQ ID NO: 4769029 - DNA, 17 bp, Homo sapiens
ctggcctggcctggccc

SEQ ID NO: 4769030 - DNA, 14 bp, Homo sapiens
ctggcctgggggct

SEQ ID NO: 4769031 - DNA, 18 bp, Homo sapiens
ctggccttggttcctcca

SEQ ID NO: 4769032 - DNA, 21 bp, Homo sapiens
ctggccttggttcctccagca

SEQ ID NO: 4769033 - DNA, 22 bp, Homo sapiens
ctggcgggcagcccctgctgga

SEQ ID NO: 4769034 - DNA, 20 bp, Homo sapiens
ctggcggggtctgctcctgg

SEQ ID NO: 4769035 - DNA, 20 bp, Homo sapiens
ctggctacgacttgggacgg

SEQ ID NO: 4769036 - DNA, 13 bp, Homo sapiens
ctggctcacagcc

SEQ ID NO: 4769037 - DNA, 15 bp, Homo sapiens
ctggctcccagggtc

SEQ ID NO: 4769038 - DNA, 17 bp, Homo sapiens
ctggctcccagggtcct

SEQ ID NO: 4769039 - DNA, 20 bp, Homo sapiens
ctggctgagtgcgaccacca

SEQ ID NO: 4769040 - DNA, 21 bp, Homo sapiens
ctggctgagtgcgaccaccac

SEQ ID NO: 4769041 - DNA, 18 bp, Homo sapiens
ctggctgggtcgcccctc

SEQ ID NO: 4769042 - DNA, 21 bp, Homo sapiens
ctggctgtggcccctccttct

SEQ ID NO: 4769043 - DNA, 19 bp, Homo sapiens
ctggcttagcgttctgttt

SEQ ID NO: 4769044 - DNA, 18 bp, Homo sapiens
ctggcttcaccgcattcc

SEQ ID NO: 4769045 - DNA, 13 bp, Homo sapiens
ctggcttgcactt

SEQ ID NO: 4769046 - DNA, 20 bp, Homo sapiens
ctggcttttaaacctgttcc

SEQ ID NO: 4769047 - DNA, 24 bp, Homo sapiens
ctgggaatggggtgggagccacag

SEQ ID NO: 4769048 - DNA, 19 bp, Homo sapiens
ctgggacaggcaccatgct

SEQ ID NO: 4769049 - DNA, 23 bp, Homo sapiens
ctgggactataggcatgcgccac

SEQ ID NO: 4769050 - DNA, 16 bp, Homo sapiens
ctgggagatgcagctg

SEQ ID NO: 4769051 - DNA, 13 bp, Homo sapiens
ctgggagtgggag

SEQ ID NO: 4769052 - DNA, 17 bp, Homo sapiens
ctgggcagaaggaagac

SEQ ID NO: 4769053 - DNA, 13 bp, Homo sapiens
ctgggcagaggaa

SEQ ID NO: 4769054 - DNA, 20 bp, Homo sapiens
ctgggcagaggaaagcaaag

SEQ ID NO: 4769055 - DNA, 17 bp, Homo sapiens
ctgggcagcccagagag

SEQ ID NO: 4769056 - DNA, 13 bp, Homo sapiens
ctgggcagggccg

SEQ ID NO: 4769057 - DNA, 22 bp, Homo sapiens
ctgggcagggccgcagggcgct

SEQ ID NO: 4769058 - DNA, 21 bp, Homo sapiens
ctgggcatggtaccagccctg

SEQ ID NO: 4769059 - DNA, 14 bp, Homo sapiens
ctgggcccctccac

SEQ ID NO: 4769060 - DNA, 16 bp, Homo sapiens
ctgggcccctccacgc

SEQ ID NO: 4769061 - DNA, 17 bp, Homo sapiens
ctgggcccctccacgcc

SEQ ID NO: 4769062 - DNA, 17 bp, Homo sapiens
ctgggcccctgggatgg

SEQ ID NO: 4769063 - DNA, 21 bp, Homo sapiens
ctgggccggggtgtggaatca

SEQ ID NO: 4769064 - DNA, 12 bp, Homo sapiens
ctgggcctcccg

SEQ ID NO: 4769065 - DNA, 21 bp, Homo sapiens
ctgggcctcccgtccgtccgc

SEQ ID NO: 4769066 - DNA, 11 bp, Homo sapiens
ctgggcctggg

SEQ ID NO: 4769067 - DNA, 18 bp, Homo sapiens
ctgggctgtctgtcacca

SEQ ID NO: 4769068 - DNA, 21 bp, Homo sapiens
ctgggctgtctgtcaccagct

SEQ ID NO: 4769069 - DNA, 16 bp, Homo sapiens
ctgggctgtgaggaca

SEQ ID NO: 4769070 - DNA, 13 bp, Homo sapiens
ctgggcttgggga

SEQ ID NO: 4769071 - DNA, 21 bp, Homo sapiens
ctgggcttggggaccagagct

SEQ ID NO: 4769072 - DNA, 22 bp, Homo sapiens
ctgggcttggggaccagagctg

SEQ ID NO: 4769073 - DNA, 16 bp, Homo sapiens
ctggggaaacttccta

SEQ ID NO: 4769074 - DNA, 17 bp, Homo sapiens
ctggggaggacccctgc

SEQ ID NO: 4769075 - DNA, 19 bp, Homo sapiens
ctggggaggacccctgccc

SEQ ID NO: 4769076 - DNA, 12 bp, Homo sapiens
ctggggcagggt

SEQ ID NO: 4769077 - DNA, 14 bp, Homo sapiens
ctggggccctgggc

SEQ ID NO: 4769078 - DNA, 15 bp, Homo sapiens
ctggggccctgggcc

SEQ ID NO: 4769079 - DNA, 17 bp, Homo sapiens
ctggggccctgggcctc

SEQ ID NO: 4769080 - DNA, 20 bp, Homo sapiens
ctggggccctgggcctcagt

SEQ ID NO: 4769081 - DNA, 13 bp, Homo sapiens
ctggggcttgcta

SEQ ID NO: 4769082 - DNA, 14 bp, Homo sapiens
ctggggggcacagc

SEQ ID NO: 4769083 - DNA, 18 bp, Homo sapiens
ctggggggcacagccaga

SEQ ID NO: 4769084 - DNA, 19 bp, Homo sapiens
ctggggggcacagccagaa

SEQ ID NO: 4769085 - DNA, 12 bp, Homo sapiens
ctggggggcagg

SEQ ID NO: 4769086 - DNA, 13 bp, Homo sapiens
ctggggggcaggc

SEQ ID NO: 4769087 - DNA, 18 bp, Homo sapiens
ctggggggcaggcctccc

SEQ ID NO: 4769088 - DNA, 20 bp, Homo sapiens
ctggggggcaggcctcccaa

SEQ ID NO: 4769089 - DNA, 12 bp, Homo sapiens
ctggggggctgt

SEQ ID NO: 4769090 - DNA, 17 bp, Homo sapiens
ctggggggctgtcctga

SEQ ID NO: 4769091 - DNA, 21 bp, Homo sapiens
ctggggggctgtcctgagccc

SEQ ID NO: 4769092 - DNA, 14 bp, Homo sapiens
ctgggggtggcagg

SEQ ID NO: 4769093 - DNA, 16 bp, Homo sapiens
ctgggggtggcaggca

SEQ ID NO: 4769094 - DNA, 17 bp, Homo sapiens
ctgggggtggcaggcac

SEQ ID NO: 4769095 - DNA, 16 bp, Homo sapiens
ctggggtctctgagca

SEQ ID NO: 4769096 - DNA, 19 bp, Homo sapiens
ctggggtctctgagcagtg

SEQ ID NO: 4769097 - DNA, 18 bp, Homo sapiens
ctggggtggggacctcag

SEQ ID NO: 4769098 - DNA, 19 bp, Homo sapiens
ctggggtggggacctcagg

SEQ ID NO: 4769099 - DNA, 16 bp, Homo sapiens
ctgggtcaccttcctg

SEQ ID NO: 4769100 - DNA, 17 bp, Homo sapiens
ctgggtcaccttcctgg

SEQ ID NO: 4769101 - DNA, 19 bp, Homo sapiens
ctgggtcaccttcctgggc

SEQ ID NO: 4769102 - DNA, 14 bp, Homo sapiens
ctgggtccccctcc

SEQ ID NO: 4769103 - DNA, 15 bp, Homo sapiens
ctgggtccccctcct

SEQ ID NO: 4769104 - DNA, 23 bp, Homo sapiens
ctgggtcctcggccctgtagccc

SEQ ID NO: 4769105 - DNA, 15 bp, Homo sapiens
ctgggtcgcccctcc

SEQ ID NO: 4769106 - DNA, 17 bp, Homo sapiens
ctgggtgctcagggcat

SEQ ID NO: 4769107 - DNA, 17 bp, Homo sapiens
ctgggtgggccccacag

SEQ ID NO: 4769108 - DNA, 21 bp, Homo sapiens
ctgggtgggccccacagtggt

SEQ ID NO: 4769109 - DNA, 21 bp, Homo sapiens
ctgggtgtgacctgacacctg

SEQ ID NO: 4769110 - DNA, 22 bp, Homo sapiens
ctgggtgtgacctgacacctgc

SEQ ID NO: 4769111 - DNA, 22 bp, Homo sapiens
ctgggtgtggcctggcttctgg

SEQ ID NO: 4769112 - DNA, 20 bp, Homo sapiens
ctgggttaacagtaaatata

SEQ ID NO: 4769113 - DNA, 21 bp, Homo sapiens
ctgggttaacagtaaatatac

SEQ ID NO: 4769114 - DNA, 22 bp, Homo sapiens
ctgggttgttgcagagtaaatc

SEQ ID NO: 4769115 - DNA, 14 bp, Homo sapiens
ctgggtttgggcag

SEQ ID NO: 4769116 - DNA, 23 bp, Homo sapiens
ctgggtttgggcagtggagaggg

SEQ ID NO: 4769117 - DNA, 15 bp, Homo sapiens
ctgggttttagaaat

SEQ ID NO: 4769118 - DNA, 15 bp, Homo sapiens
ctggtaagattgtta

SEQ ID NO: 4769119 - DNA, 17 bp, Homo sapiens
ctggtaagattgttatt

SEQ ID NO: 4769120 - DNA, 23 bp, Homo sapiens
ctggtaattatcctcaagttgtg

SEQ ID NO: 4769121 - DNA, 13 bp, Homo sapiens
ctggtaggtctgg

SEQ ID NO: 4769122 - DNA, 17 bp, Homo sapiens
ctggtaggtctggattt

SEQ ID NO: 4769123 - DNA, 23 bp, Homo sapiens
ctggtaggtctggattttcaaag

SEQ ID NO: 4769124 - DNA, 16 bp, Homo sapiens
ctggtattaaatgcca

SEQ ID NO: 4769125 - DNA, 15 bp, Homo sapiens
ctggtcccccatggg

SEQ ID NO: 4769126 - DNA, 12 bp, Homo sapiens
ctggtctggagc

SEQ ID NO: 4769127 - DNA, 11 bp, Homo sapiens
ctgctccagat

SEQ ID NO: 4769128 - DNA, 21 bp, Homo sapiens
ctgctccatgcagatctagcc

SEQ ID NO: 4769129 - DNA, 20 bp, Homo sapiens
ctgctcccggctctgaggct

SEQ ID NO: 4769130 - DNA, 21 bp, Homo sapiens
ctgctcccggtgtgcagcggg

SEQ ID NO: 4769131 - DNA, 22 bp, Homo sapiens
ctgctcccggtgtgcagcgggt

SEQ ID NO: 4769132 - DNA, 19 bp, Homo sapiens
ctgctcgccctgtgccctc

SEQ ID NO: 4769133 - DNA, 14 bp, Homo sapiens
ctgctcgggaaggc

SEQ ID NO: 4769134 - DNA, 11 bp, Homo sapiens
ctgctctccat

SEQ ID NO: 4769135 - DNA, 13 bp, Homo sapiens
ctgctctccatct

SEQ ID NO: 4769136 - DNA, 15 bp, Homo sapiens
ctgctctccttcact

SEQ ID NO: 4769137 - DNA, 20 bp, Homo sapiens
ctgctgaaaaccatctggcc

SEQ ID NO: 4769138 - DNA, 22 bp, Homo sapiens
ctgctgaaaaccatctggcctg

SEQ ID NO: 4769139 - DNA, 17 bp, Homo sapiens
ctgctgcagtcagcaca

SEQ ID NO: 4769140 - DNA, 19 bp, Homo sapiens
ctgctgcagtcagcacaga

SEQ ID NO: 4769141 - DNA, 22 bp, Homo sapiens
ctgctgccaggctcccactgcc

SEQ ID NO: 4769142 - DNA, 14 bp, Homo sapiens
ctgctgccgcctca

SEQ ID NO: 4769143 - DNA, 24 bp, Homo sapiens
ctgctgccgcctcaccttccttga

SEQ ID NO: 4769144 - DNA, 16 bp, Homo sapiens
ctgctgcctcaggaat

SEQ ID NO: 4769145 - DNA, 17 bp, Homo sapiens
ctgctgcctccaagtca

SEQ ID NO: 4769146 - DNA, 17 bp, Homo sapiens
ctgctgctcgggaaggc

SEQ ID NO: 4769147 - DNA, 18 bp, Homo sapiens
ctgctgctcgggaaggcc

SEQ ID NO: 4769148 - DNA, 22 bp, Homo sapiens
ctgctgctcgggaaggcctgag

SEQ ID NO: 4769149 - DNA, 17 bp, Homo sapiens
ctgctgcttctccctgg

SEQ ID NO: 4769150 - DNA, 20 bp, Homo sapiens
ctgctggaaaggcccggaga

SEQ ID NO: 4769151 - DNA, 22 bp, Homo sapiens
ctgctggaccaaggtgcggacc

SEQ ID NO: 4769152 - DNA, 17 bp, Homo sapiens
ctgctggtcttatcctg

SEQ ID NO: 4769153 - DNA, 22 bp, Homo sapiens
ctgctgtataaggtaataaaac

SEQ ID NO: 4769154 - DNA, 14 bp, Homo sapiens
ctgctgtatttgag

SEQ ID NO: 4769155 - DNA, 23 bp, Homo sapiens
ctgctgtcttactaataggtctg

SEQ ID NO: 4769156 - DNA, 15 bp, Homo sapiens
ctgcttaaaatgcaa

SEQ ID NO: 4769157 - DNA, 19 bp, Homo sapiens
ctgcttaaaatgcaaggac

SEQ ID NO: 4769158 - DNA, 12 bp, Homo sapiens
ctgcttagtgtc

SEQ ID NO: 4769159 - DNA, 16 bp, Homo sapiens
ctgcttagtgtccctt

SEQ ID NO: 4769160 - DNA, 12 bp, Homo sapiens
ctgcttcattca

SEQ ID NO: 4769161 - DNA, 19 bp, Homo sapiens
ctgcttcccacctccctgc

SEQ ID NO: 4769162 - DNA, 21 bp, Homo sapiens
ctgcttcccacctccctgccc

SEQ ID NO: 4769163 - DNA, 24 bp, Homo sapiens
ctgcttcccacctccctgcccagg

SEQ ID NO: 4769164 - DNA, 19 bp, Homo sapiens
ctgcttctccacctccccc

SEQ ID NO: 4769165 - DNA, 22 bp, Homo sapiens
ctgcttctcccgccattggcct

SEQ ID NO: 4769166 - DNA, 11 bp, Homo sapiens
ctgcttctgct

SEQ ID NO: 4769167 - DNA, 13 bp, Homo sapiens
ctgcttctgctgc

SEQ ID NO: 4769168 - DNA, 15 bp, Homo sapiens
ctgcttctgctgccc

SEQ ID NO: 4769169 - DNA, 16 bp, Homo sapiens
ctgcttgagtggacag

SEQ ID NO: 4769170 - DNA, 23 bp, Homo sapiens
ctgcttgagtggacagcagctgg

SEQ ID NO: 4769171 - DNA, 17 bp, Homo sapiens
ctgcttgatatcccaag

SEQ ID NO: 4769172 - DNA, 13 bp, Homo sapiens
ctgcttgggcttc

SEQ ID NO: 4769173 - DNA, 19 bp, Homo sapiens
ctgcttgggcttcatcctc

SEQ ID NO: 4769174 - DNA, 17 bp, Homo sapiens
ctgctttctgatacatc

SEQ ID NO: 4769175 - DNA, 21 bp, Homo sapiens
ctgctttctgatacatctgtc

SEQ ID NO: 4769176 - DNA, 21 bp, Homo sapiens
ctgctttgttttggctgctct

SEQ ID NO: 4769177 - DNA, 13 bp, Homo sapiens
ctgcttttgatgg

SEQ ID NO: 4769178 - DNA, 21 bp, Homo sapiens
ctgcttttgatggctatgttt

SEQ ID NO: 4769179 - DNA, 16 bp, Homo sapiens
ctggaaaactgccaca

SEQ ID NO: 4769180 - DNA, 22 bp, Homo sapiens
ctggaaaactgccacaagcaca

SEQ ID NO: 4769181 - DNA, 24 bp, Homo sapiens
ctggaaaactgccacaagcacaat

SEQ ID NO: 4769182 - DNA, 23 bp, Homo sapiens
ctggaaagagctgttttggatga

SEQ ID NO: 4769183 - DNA, 12 bp, Homo sapiens
ctggaaagccag

SEQ ID NO: 4769184 - DNA, 14 bp, Homo sapiens
ctggaaagccaggt

SEQ ID NO: 4769185 - DNA, 14 bp, Homo sapiens
ctggaaatttgtgt

SEQ ID NO: 4769186 - DNA, 22 bp, Homo sapiens
ctggaactctatctgggcctgg

SEQ ID NO: 4769187 - DNA, 23 bp, Homo sapiens
ctggaactctatctgggcctggg

SEQ ID NO: 4769188 - DNA, 12 bp, Homo sapiens
ctggaagaggga

SEQ ID NO: 4769189 - DNA, 18 bp, Homo sapiens
ctggaagagggaggggcc

SEQ ID NO: 4769190 - DNA, 17 bp, Homo sapiens
ctggaaggttttgcttc

SEQ ID NO: 4769191 - DNA, 16 bp, Homo sapiens
ctggaattgggctccg

SEQ ID NO: 4769192 - DNA, 20 bp, Homo sapiens
ctggaccaaggtgcggaccg

SEQ ID NO: 4769193 - DNA, 15 bp, Homo sapiens
ctggacctgaccaga

SEQ ID NO: 4769194 - DNA, 16 bp, Homo sapiens
ctggacgcatgcaggg

SEQ ID NO: 4769195 - DNA, 19 bp, Homo sapiens
ctggactgatggttgcttt

SEQ ID NO: 4769196 - DNA, 21 bp, Homo sapiens
ctggagaaaatggacgtgtta

SEQ ID NO: 4769197 - DNA, 18 bp, Homo sapiens
ctggagaccctgcgcccc

SEQ ID NO: 4769198 - DNA, 23 bp, Homo sapiens
ctggagaccctgcgcccctgccc

SEQ ID NO: 4769199 - DNA, 23 bp, Homo sapiens
ctggagcccctatcctgcaccct

SEQ ID NO: 4769200 - DNA, 22 bp, Homo sapiens
ctggagcccgcctgcgcccccc

SEQ ID NO: 4769201 - DNA, 19 bp, Homo sapiens
ctggagcctgagtcagggc

SEQ ID NO: 4769202 - DNA, 23 bp, Homo sapiens
ctggagcctgagtcagggcccag

SEQ ID NO: 4769203 - DNA, 18 bp, Homo sapiens
ctggaggagaaggaggaa

SEQ ID NO: 4769204 - DNA, 14 bp, Homo sapiens
ctggaggagcacac

SEQ ID NO: 4769205 - DNA, 23 bp, Homo sapiens
ctggaggcatttctttttaggct

SEQ ID NO: 4769206 - DNA, 22 bp, Homo sapiens
ctggaggtacgaaaagagggga

SEQ ID NO: 4769207 - DNA, 21 bp, Homo sapiens
ctggaggtggggagggcctct

SEQ ID NO: 4769208 - DNA, 23 bp, Homo sapiens
ctggaggtggggagggcctctgg

SEQ ID NO: 4769209 - DNA, 14 bp, Homo sapiens
ctggagtccctcct

SEQ ID NO: 4769210 - DNA, 21 bp, Homo sapiens
ctggagtctgaaggagaggag

SEQ ID NO: 4769211 - DNA, 17 bp, Homo sapiens
ctggagtgggctctctg

SEQ ID NO: 4769212 - DNA, 13 bp, Homo sapiens
ctggagttcctca

SEQ ID NO: 4769213 - DNA, 17 bp, Homo sapiens
ctggagttctggttcct

SEQ ID NO: 4769214 - DNA, 16 bp, Homo sapiens
ctggatattcatgaaa

SEQ ID NO: 4769215 - DNA, 17 bp, Homo sapiens
ctggatggatctgctcc

SEQ ID NO: 4769216 - DNA, 23 bp, Homo sapiens
ctggatggatctgctccatgcag

SEQ ID NO: 4769217 - DNA, 17 bp, Homo sapiens
ctggatgtgcatctggc

SEQ ID NO: 4769218 - DNA, 15 bp, Homo sapiens
ctggatgtgctttca

SEQ ID NO: 4769219 - DNA, 13 bp, Homo sapiens
ctggattccagag

SEQ ID NO: 4769220 - DNA, 14 bp, Homo sapiens
ctggcaatcttgcc

SEQ ID NO: 4769221 - DNA, 22 bp, Homo sapiens
ctggcacaggactgattctggg

SEQ ID NO: 4769222 - DNA, 21 bp, Homo sapiens
ctggcagatgggggcctctct

SEQ ID NO: 4769223 - DNA, 15 bp, Homo sapiens
ctggcagcgcctccc

SEQ ID NO: 4769224 - DNA, 22 bp, Homo sapiens
ctggcagggaggtcaggccctg

SEQ ID NO: 4769225 - DNA, 23 bp, Homo sapiens
ctggcagggaggtcaggccctgg

SEQ ID NO: 4769226 - DNA, 18 bp, Homo sapiens
ctggcataggactctttg

SEQ ID NO: 4769227 - DNA, 16 bp, Homo sapiens
ctggccagcaccctct

SEQ ID NO: 4769228 - DNA, 12 bp, Homo sapiens
ctggccagcctg

SEQ ID NO: 4769229 - DNA, 15 bp, Homo sapiens
ctggccagcctgggg

SEQ ID NO: 4769230 - DNA, 19 bp, Homo sapiens
ctggccagcctggggcctg

SEQ ID NO: 4769231 - DNA, 22 bp, Homo sapiens
ctggccagcctggggcctggca

SEQ ID NO: 4769232 - DNA, 11 bp, Homo sapiens
ctggcccagcc

SEQ ID NO: 4769233 - DNA, 13 bp, Homo sapiens
ctggcccagccag

SEQ ID NO: 4769234 - DNA, 13 bp, Homo sapiens
ctggcccagccat

SEQ ID NO: 4769235 - DNA, 17 bp, Homo sapiens
ctggcccagccatggct

SEQ ID NO: 4769236 - DNA, 18 bp, Homo sapiens
ctggcccagccatggctg

SEQ ID NO: 4769237 - DNA, 20 bp, Homo sapiens
ctggcccagccatggctgga

SEQ ID NO: 4769238 - DNA, 12 bp, Homo sapiens
ctggcccagtgc

SEQ ID NO: 4769239 - DNA, 19 bp, Homo sapiens
ctggccccaggcggagggg

SEQ ID NO: 4769240 - DNA, 14 bp, Homo sapiens
ctggcccggtccca

SEQ ID NO: 4769241 - DNA, 17 bp, Homo sapiens
ctggcccggtcccagtc

SEQ ID NO: 4769242 - DNA, 16 bp, Homo sapiens
ctggccctcgggccct

SEQ ID NO: 4769243 - DNA, 15 bp, Homo sapiens
ctggccctgccctcc

SEQ ID NO: 4769244 - DNA, 16 bp, Homo sapiens
ctggcccttccttcac

SEQ ID NO: 4769245 - DNA, 17 bp, Homo sapiens
ctggccggtccaccccg

SEQ ID NO: 4769246 - DNA, 15 bp, Homo sapiens
ctggcctaccacagc

SEQ ID NO: 4769247 - DNA, 19 bp, Homo sapiens
ctggcctaccacagctgcc

SEQ ID NO: 4769248 - DNA, 16 bp, Homo sapiens
ctggcctatgaccctg

SEQ ID NO: 4769249 - DNA, 22 bp, Homo sapiens
ctggcctatgaccctgtgcctg

SEQ ID NO: 4769250 - DNA, 23 bp, Homo sapiens
ctggcctatgaccctgtgcctgt

SEQ ID NO: 4769251 - DNA, 13 bp, Homo sapiens
ctgacttcccagc

SEQ ID NO: 4769252 - DNA, 16 bp, Homo sapiens
ctgacttcccagctgg

SEQ ID NO: 4769253 - DNA, 22 bp, Homo sapiens
ctgacttcccagctggcagcgc

SEQ ID NO: 4769254 - DNA, 19 bp, Homo sapiens
ctgagaaagtatgccccac

SEQ ID NO: 4769255 - DNA, 18 bp, Homo sapiens
ctgagaagaggagccctc

SEQ ID NO: 4769256 - DNA, 22 bp, Homo sapiens
ctgagaagaggagccctcatct

SEQ ID NO: 4769257 - DNA, 22 bp, Homo sapiens
ctgagaatccccgtgctcacag

SEQ ID NO: 4769258 - DNA, 11 bp, Homo sapiens
ctgagaatgtg

SEQ ID NO: 4769259 - DNA, 12 bp, Homo sapiens
ctgagaatgtgc

SEQ ID NO: 4769260 - DNA, 17 bp, Homo sapiens
ctgagaattgaggggag

SEQ ID NO: 4769261 - DNA, 15 bp, Homo sapiens
ctgagacaatgcctt

SEQ ID NO: 4769262 - DNA, 11 bp, Homo sapiens
ctgagaccacg

SEQ ID NO: 4769263 - DNA, 23 bp, Homo sapiens
ctgagaccacggtccaatccagc

SEQ ID NO: 4769264 - DNA, 19 bp, Homo sapiens
ctgagaggagcgtgtccta

SEQ ID NO: 4769265 - DNA, 21 bp, Homo sapiens
ctgagagggtgtgggtgccct

SEQ ID NO: 4769266 - DNA, 18 bp, Homo sapiens
ctgagcacatctcttcat

SEQ ID NO: 4769267 - DNA, 16 bp, Homo sapiens
ctgagccacagtgggg

SEQ ID NO: 4769268 - DNA, 21 bp, Homo sapiens
ctgagccacagtggggcccat

SEQ ID NO: 4769269 - DNA, 15 bp, Homo sapiens
ctgagcccctcctct

SEQ ID NO: 4769270 - DNA, 12 bp, Homo sapiens
ctgagccctgcc

SEQ ID NO: 4769271 - DNA, 22 bp, Homo sapiens
ctgagcctggcccatagaaaca

SEQ ID NO: 4769272 - DNA, 19 bp, Homo sapiens
ctgagctccaccctcccct

SEQ ID NO: 4769273 - DNA, 20 bp, Homo sapiens
ctgagctccaccctcccctc

SEQ ID NO: 4769274 - DNA, 21 bp, Homo sapiens
ctgagcttgattctaaagggg

SEQ ID NO: 4769275 - DNA, 22 bp, Homo sapiens
ctgagcttgattctaaagggga

SEQ ID NO: 4769276 - DNA, 21 bp, Homo sapiens
ctgaggaaggaggggaagctg

SEQ ID NO: 4769277 - DNA, 20 bp, Homo sapiens
ctgaggaagtcccagtccaa

SEQ ID NO: 4769278 - DNA, 15 bp, Homo sapiens
ctgaggacggggcag

SEQ ID NO: 4769279 - DNA, 21 bp, Homo sapiens
ctgaggacggggcagagctga

SEQ ID NO: 4769280 - DNA, 14 bp, Homo sapiens
ctgaggagctagtg

SEQ ID NO: 4769281 - DNA, 13 bp, Homo sapiens
ctgaggagtccaa

SEQ ID NO: 4769282 - DNA, 13 bp, Homo sapiens
ctgaggagtgatg

SEQ ID NO: 4769283 - DNA, 16 bp, Homo sapiens
ctgaggagtgatgggc

SEQ ID NO: 4769284 - DNA, 18 bp, Homo sapiens
ctgaggagtgatgggcaa

SEQ ID NO: 4769285 - DNA, 19 bp, Homo sapiens
ctgaggagtgatgggcaag

SEQ ID NO: 4769286 - DNA, 18 bp, Homo sapiens
ctgaggccaaatattgat

SEQ ID NO: 4769287 - DNA, 16 bp, Homo sapiens
ctgagtcagggcccag

SEQ ID NO: 4769288 - DNA, 22 bp, Homo sapiens
ctgagtcctcattgttcagaaa

SEQ ID NO: 4769289 - DNA, 14 bp, Homo sapiens
ctgagtcggctggg

SEQ ID NO: 4769290 - DNA, 15 bp, Homo sapiens
ctgagtcggctgggc

SEQ ID NO: 4769291 - DNA, 21 bp, Homo sapiens
ctgagtcggctgggcagggcc

SEQ ID NO: 4769292 - DNA, 23 bp, Homo sapiens
ctgagtcggctgggcagggccgc

SEQ ID NO: 4769293 - DNA, 23 bp, Homo sapiens
ctgagtctgtgaataaagccaca

SEQ ID NO: 4769294 - DNA, 15 bp, Homo sapiens
ctgagtgcgaccacc

SEQ ID NO: 4769295 - DNA, 21 bp, Homo sapiens
ctgagtgcgaccaccacttga

SEQ ID NO: 4769296 - DNA, 21 bp, Homo sapiens
ctgagtggctcgtgtttcaca

SEQ ID NO: 4769297 - DNA, 17 bp, Homo sapiens
ctgataaagaaaccttt

SEQ ID NO: 4769298 - DNA, 13 bp, Homo sapiens
ctgatacatctgt

SEQ ID NO: 4769299 - DNA, 13 bp, Homo sapiens
ctgatagtgtttc

SEQ ID NO: 4769300 - DNA, 21 bp, Homo sapiens
ctgatagtgtttcgttaagca

SEQ ID NO: 4769301 - DNA, 15 bp, Homo sapiens
ctgatatcacgggcc

SEQ ID NO: 4769302 - DNA, 21 bp, Homo sapiens
ctgatatcacgggcccgctca

SEQ ID NO: 4769303 - DNA, 22 bp, Homo sapiens
ctgatatctgtttgcttctaaa

SEQ ID NO: 4769304 - DNA, 16 bp, Homo sapiens
ctgatcaaggtgctct

SEQ ID NO: 4769305 - DNA, 14 bp, Homo sapiens
ctgatctctcgtga

SEQ ID NO: 4769306 - DNA, 18 bp, Homo sapiens
ctgatctctcgtgattga

SEQ ID NO: 4769307 - DNA, 13 bp, Homo sapiens
ctgatgagacaac

SEQ ID NO: 4769308 - DNA, 16 bp, Homo sapiens
ctgatgatataaacaa

SEQ ID NO: 4769309 - DNA, 15 bp, Homo sapiens
ctgatgatgttctga

SEQ ID NO: 4769310 - DNA, 17 bp, Homo sapiens
ctgatggagaaggaagg

SEQ ID NO: 4769311 - DNA, 14 bp, Homo sapiens
ctgatgggtcctgc

SEQ ID NO: 4769312 - DNA, 15 bp, Homo sapiens
ctgatgggtcctgct

SEQ ID NO: 4769313 - DNA, 16 bp, Homo sapiens
ctgatgggtcctgctg

SEQ ID NO: 4769314 - DNA, 16 bp, Homo sapiens
ctgatggttgctttga

SEQ ID NO: 4769315 - DNA, 23 bp, Homo sapiens
ctgatgtcttcttgggggcagac

SEQ ID NO: 4769316 - DNA, 13 bp, Homo sapiens
ctgattctgggat

SEQ ID NO: 4769317 - DNA, 16 bp, Homo sapiens
ctgattctgggatgct

SEQ ID NO: 4769318 - DNA, 19 bp, Homo sapiens
ctgattctgggatgctcct

SEQ ID NO: 4769319 - DNA, 19 bp, Homo sapiens
ctgattggacctggcccag

SEQ ID NO: 4769320 - DNA, 23 bp, Homo sapiens
ctgattggacctggcccagtgca

SEQ ID NO: 4769321 - DNA, 14 bp, Homo sapiens
ctgatttattctgg

SEQ ID NO: 4769322 - DNA, 14 bp, Homo sapiens
ctgatttattttgt

SEQ ID NO: 4769323 - DNA, 23 bp, Homo sapiens
ctgatttccatccaaacctacct

SEQ ID NO: 4769324 - DNA, 20 bp, Homo sapiens
ctgatttggccgttttgtga

SEQ ID NO: 4769325 - DNA, 21 bp, Homo sapiens
ctgatttggccgttttgtgaa

SEQ ID NO: 4769326 - DNA, 19 bp, Homo sapiens
ctgatttgggctgaatgta

SEQ ID NO: 4769327 - DNA, 23 bp, Homo sapiens
ctgatttgggctgaatgtatgta

SEQ ID NO: 4769328 - DNA, 14 bp, Homo sapiens
ctgcaaaatgaaga

SEQ ID NO: 4769329 - DNA, 16 bp, Homo sapiens
ctgcaaaatgaagaca

SEQ ID NO: 4769330 - DNA, 15 bp, Homo sapiens
ctgcaacccatgagc

SEQ ID NO: 4769331 - DNA, 22 bp, Homo sapiens
ctgcaacccatgagcgtccagg

SEQ ID NO: 4769332 - DNA, 16 bp, Homo sapiens
ctgcaacctccacctc

SEQ ID NO: 4769333 - DNA, 16 bp, Homo sapiens
ctgcaaggcccacagg

SEQ ID NO: 4769334 - DNA, 16 bp, Homo sapiens
ctgcaataacagtttt

SEQ ID NO: 4769335 - DNA, 14 bp, Homo sapiens
ctgcacacacctgc

SEQ ID NO: 4769336 - DNA, 15 bp, Homo sapiens
ctgcacacacctgcc

SEQ ID NO: 4769337 - DNA, 21 bp, Homo sapiens
ctgcacaccttgaatctgcct

SEQ ID NO: 4769338 - DNA, 13 bp, Homo sapiens
ctgcacatacaga

SEQ ID NO: 4769339 - DNA, 15 bp, Homo sapiens
ctgcacatacagatg

SEQ ID NO: 4769340 - DNA, 19 bp, Homo sapiens
ctgcacatacagatggtgt

SEQ ID NO: 4769341 - DNA, 13 bp, Homo sapiens
ctgcaccagcagg

SEQ ID NO: 4769342 - DNA, 14 bp, Homo sapiens
ctgcacccacccct

SEQ ID NO: 4769343 - DNA, 22 bp, Homo sapiens
ctgcacccacccctgcccaggc

SEQ ID NO: 4769344 - DNA, 12 bp, Homo sapiens
ctgcaccctcca

SEQ ID NO: 4769345 - DNA, 14 bp, Homo sapiens
ctgcaccctctgct

SEQ ID NO: 4769346 - DNA, 14 bp, Homo sapiens
ctgcacctgcttct

SEQ ID NO: 4769347 - DNA, 14 bp, Homo sapiens
ctgcaccttgggca

SEQ ID NO: 4769348 - DNA, 15 bp, Homo sapiens
ctgcacgcccaggat

SEQ ID NO: 4769349 - DNA, 22 bp, Homo sapiens
ctgcacgcggactccggggttc

SEQ ID NO: 4769350 - DNA, 14 bp, Homo sapiens
ctgcactcctgtct

SEQ ID NO: 4769351 - DNA, 11 bp, Homo sapiens
ctgcactgaaa

SEQ ID NO: 4769352 - DNA, 14 bp, Homo sapiens
ctgcactgaaaagg

SEQ ID NO: 4769353 - DNA, 18 bp, Homo sapiens
ctgcagaccacactctgc

SEQ ID NO: 4769354 - DNA, 12 bp, Homo sapiens
ctgcagaccctg

SEQ ID NO: 4769355 - DNA, 16 bp, Homo sapiens
ctgcagccaaccccat

SEQ ID NO: 4769356 - DNA, 15 bp, Homo sapiens
ctgcagcctgagctc

SEQ ID NO: 4769357 - DNA, 19 bp, Homo sapiens
ctgcagctattcacacaca

SEQ ID NO: 4769358 - DNA, 20 bp, Homo sapiens
ctgcagctattcacacacac

SEQ ID NO: 4769359 - DNA, 12 bp, Homo sapiens
ctgcagcttggg

SEQ ID NO: 4769360 - DNA, 22 bp, Homo sapiens
ctgcagcttgggagagcccctg

SEQ ID NO: 4769361 - DNA, 19 bp, Homo sapiens
ctgcagctttgaggctggc

SEQ ID NO: 4769362 - DNA, 15 bp, Homo sapiens
ctgcaggaatcaaaa

SEQ ID NO: 4769363 - DNA, 20 bp, Homo sapiens
ctgcaggatgattgtacaga

SEQ ID NO: 4769364 - DNA, 14 bp, Homo sapiens
ctgcaggccacccc

SEQ ID NO: 4769365 - DNA, 16 bp, Homo sapiens
ctgcaggttggacccc

SEQ ID NO: 4769366 - DNA, 21 bp, Homo sapiens
ctgcagtcctcggcagctccg

SEQ ID NO: 4769367 - DNA, 20 bp, Homo sapiens
ctgcagtgttcgcttggctc

SEQ ID NO: 4769368 - DNA, 22 bp, Homo sapiens
ctgcagtgttcgcttggctcca

SEQ ID NO: 4769369 - DNA, 16 bp, Homo sapiens
ctgcagttagcacaga

SEQ ID NO: 4769370 - DNA, 17 bp, Homo sapiens
ctgcagttagcacagag

SEQ ID NO: 4769371 - DNA, 20 bp, Homo sapiens
ctgcagttagcacagaggat

SEQ ID NO: 4769372 - DNA, 21 bp, Homo sapiens
ctgcagttatttaccagaagt

SEQ ID NO: 4769373 - DNA, 21 bp, Homo sapiens
ctgcatcctcagccccagggc

SEQ ID NO: 4769374 - DNA, 21 bp, Homo sapiens
ctgcatgattagtgcaataaa

SEQ ID NO: 4769375 - DNA, 17 bp, Homo sapiens
ctgcatgcttagagcat

SEQ ID NO: 4769376 - DNA, 21 bp, Homo sapiens
ctgcatgtatgccatgtatgt

SEQ ID NO: 4769377 - DNA, 15 bp, Homo sapiens
ctgcatgtcggggcc

SEQ ID NO: 4769378 - DNA, 23 bp, Homo sapiens
ctgcattactattaactctgcat

SEQ ID NO: 4769379 - DNA, 18 bp, Homo sapiens
ctgcattcgttgctccag

SEQ ID NO: 4769380 - DNA, 15 bp, Homo sapiens
ctgccaactttccag

SEQ ID NO: 4769381 - DNA, 18 bp, Homo sapiens
ctgccaactttccagact

SEQ ID NO: 4769382 - DNA, 15 bp, Homo sapiens
ctgccaagagtccaa

SEQ ID NO: 4769383 - DNA, 18 bp, Homo sapiens
ctgccaagagtccaagcc

SEQ ID NO: 4769384 - DNA, 18 bp, Homo sapiens
ctgccacaatgtgatatg

SEQ ID NO: 4769385 - DNA, 16 bp, Homo sapiens
ctgccacactctgacg

SEQ ID NO: 4769386 - DNA, 14 bp, Homo sapiens
ctgccaccctctgc

SEQ ID NO: 4769387 - DNA, 17 bp, Homo sapiens
ctgccaccctctgctgc

SEQ ID NO: 4769388 - DNA, 20 bp, Homo sapiens
ctgccaccctctgctgcaca

SEQ ID NO: 4769389 - DNA, 21 bp, Homo sapiens
ctgccactaaaatccacccag

SEQ ID NO: 4769390 - DNA, 15 bp, Homo sapiens
ctgccaggaagccag

SEQ ID NO: 4769391 - DNA, 13 bp, Homo sapiens
ctgccaggctgca

SEQ ID NO: 4769392 - DNA, 19 bp, Homo sapiens
ctgccaggctgcagggaca

SEQ ID NO: 4769393 - DNA, 17 bp, Homo sapiens
ctgccagggcagtgcta

SEQ ID NO: 4769394 - DNA, 23 bp, Homo sapiens
ctgccagggggtttgaggaccct

SEQ ID NO: 4769395 - DNA, 21 bp, Homo sapiens
ctgccataacttgtttgtaaa

SEQ ID NO: 4769396 - DNA, 14 bp, Homo sapiens
ctgccatgtaggct

SEQ ID NO: 4769397 - DNA, 19 bp, Homo sapiens
ctgccatgtgtgagtcact

SEQ ID NO: 4769398 - DNA, 13 bp, Homo sapiens
ctgcccaccctgg

SEQ ID NO: 4769399 - DNA, 20 bp, Homo sapiens
ctgcccaccctgggcctccc

SEQ ID NO: 4769400 - DNA, 21 bp, Homo sapiens
ctgcccaccctgggcctcccg

SEQ ID NO: 4769401 - DNA, 23 bp, Homo sapiens
ctgcccaccctgggcctcccgtc

SEQ ID NO: 4769402 - DNA, 17 bp, Homo sapiens
ctgcccacctgccaggc

SEQ ID NO: 4769403 - DNA, 18 bp, Homo sapiens
ctgcccacctgccaggct

SEQ ID NO: 4769404 - DNA, 19 bp, Homo sapiens
ctgcccacctgccaggctg

SEQ ID NO: 4769405 - DNA, 17 bp, Homo sapiens
ctgcccacgtcccgggc

SEQ ID NO: 4769406 - DNA, 23 bp, Homo sapiens
ctgcccacgtcccgggcactgtc

SEQ ID NO: 4769407 - DNA, 18 bp, Homo sapiens
ctgcccagcacctcctcc

SEQ ID NO: 4769408 - DNA, 20 bp, Homo sapiens
ctgcccagcggctcttcctg

SEQ ID NO: 4769409 - DNA, 18 bp, Homo sapiens
ctgcccaggcagtctttg

SEQ ID NO: 4769410 - DNA, 21 bp, Homo sapiens
ctgcccaggcagtctttgctc

SEQ ID NO: 4769411 - DNA, 14 bp, Homo sapiens
ctgcccagttagcc

SEQ ID NO: 4769412 - DNA, 20 bp, Homo sapiens
ctgcccatgtgtcccctcac

SEQ ID NO: 4769413 - DNA, 22 bp, Homo sapiens
ctgcccatgtgtcccctcactc

SEQ ID NO: 4769414 - DNA, 15 bp, Homo sapiens
ctgccccacaacaca

SEQ ID NO: 4769415 - DNA, 16 bp, Homo sapiens
ctgccccacacaggcc

SEQ ID NO: 4769416 - DNA, 22 bp, Homo sapiens
ctgccccacacaggcctggccc

SEQ ID NO: 4769417 - DNA, 13 bp, Homo sapiens
ctgccccagagaa

SEQ ID NO: 4769418 - DNA, 21 bp, Homo sapiens
ctgccccagagaagcctcagt

SEQ ID NO: 4769419 - DNA, 23 bp, Homo sapiens
ctgccccagagaagcctcagtcc

SEQ ID NO: 4769420 - DNA, 12 bp, Homo sapiens
ctgccccaggct

SEQ ID NO: 4769421 - DNA, 15 bp, Homo sapiens
ctgcccccacagatc

SEQ ID NO: 4769422 - DNA, 14 bp, Homo sapiens
ctgccccccttccc

SEQ ID NO: 4769423 - DNA, 15 bp, Homo sapiens
ctgccccccttccca

SEQ ID NO: 4769424 - DNA, 20 bp, Homo sapiens
ctgccccccttcccacccct

SEQ ID NO: 4769425 - DNA, 16 bp, Homo sapiens
ctgccccctcccccgc

SEQ ID NO: 4769426 - DNA, 18 bp, Homo sapiens
ctgccccctcccccgcag

SEQ ID NO: 4769427 - DNA, 14 bp, Homo sapiens
ctgcccctcaactc

SEQ ID NO: 4769428 - DNA, 22 bp, Homo sapiens
ctgcccctcaactctcctccag

SEQ ID NO: 4769429 - DNA, 17 bp, Homo sapiens
ctgcccctcttccctgg

SEQ ID NO: 4769430 - DNA, 13 bp, Homo sapiens
ctgcccctgcacc

SEQ ID NO: 4769431 - DNA, 15 bp, Homo sapiens
ctgcccctggcagcc

SEQ ID NO: 4769432 - DNA, 16 bp, Homo sapiens
ctgcccctggcagccc

SEQ ID NO: 4769433 - DNA, 17 bp, Homo sapiens
ctgcccgcacagcagcc

SEQ ID NO: 4769434 - DNA, 20 bp, Homo sapiens
ctgcccgcacagcagcctgc

SEQ ID NO: 4769435 - DNA, 16 bp, Homo sapiens
ctgcccgcgggtggct

SEQ ID NO: 4769436 - DNA, 18 bp, Homo sapiens
ctgccctcactccactcc

SEQ ID NO: 4769437 - DNA, 12 bp, Homo sapiens
ctgccctccccc

SEQ ID NO: 4769438 - DNA, 14 bp, Homo sapiens
ctgccctcccccac

SEQ ID NO: 4769439 - DNA, 15 bp, Homo sapiens
ctgccctcccccacg

SEQ ID NO: 4769440 - DNA, 16 bp, Homo sapiens
ctgccctcccccacgg

SEQ ID NO: 4769441 - DNA, 17 bp, Homo sapiens
ctgccctcccccacggc

SEQ ID NO: 4769442 - DNA, 21 bp, Homo sapiens
ctgccctcccccacggccgtc

SEQ ID NO: 4769443 - DNA, 17 bp, Homo sapiens
ctgccctctccttcctt

SEQ ID NO: 4769444 - DNA, 18 bp, Homo sapiens
ctgccctctgccactgac

SEQ ID NO: 4769445 - DNA, 18 bp, Homo sapiens
ctgccgaaacccttgact

SEQ ID NO: 4769446 - DNA, 19 bp, Homo sapiens
ctgccgaaacccttgactg

SEQ ID NO: 4769447 - DNA, 13 bp, Homo sapiens
ctgccgcagccct

SEQ ID NO: 4769448 - DNA, 15 bp, Homo sapiens
ctgccgcagccctgc

SEQ ID NO: 4769449 - DNA, 17 bp, Homo sapiens
ctgccgcagccctgcag

SEQ ID NO: 4769450 - DNA, 18 bp, Homo sapiens
ctgccgcagccctgcaga

SEQ ID NO: 4769451 - DNA, 13 bp, Homo sapiens
ctgccgctgcacc

SEQ ID NO: 4769452 - DNA, 14 bp, Homo sapiens
ctgccgctgcacca

SEQ ID NO: 4769453 - DNA, 15 bp, Homo sapiens
ctgccgctgcaccac

SEQ ID NO: 4769454 - DNA, 14 bp, Homo sapiens
ctgccgctgcttga

SEQ ID NO: 4769455 - DNA, 17 bp, Homo sapiens
ctgccggtcccccatgc

SEQ ID NO: 4769456 - DNA, 23 bp, Homo sapiens
ctgccggtcccccatgccaccac

SEQ ID NO: 4769457 - DNA, 13 bp, Homo sapiens
ctgccgtgggcaa

SEQ ID NO: 4769458 - DNA, 17 bp, Homo sapiens
ctgcctacgtgctgccc

SEQ ID NO: 4769459 - DNA, 21 bp, Homo sapiens
ctgcctcatcttccttctcag

SEQ ID NO: 4769460 - DNA, 12 bp, Homo sapiens
ctgcctccaagt

SEQ ID NO: 4769461 - DNA, 20 bp, Homo sapiens
ctgcctccaagtcatgggag

SEQ ID NO: 4769462 - DNA, 21 bp, Homo sapiens
ctgcctccggccctgccccac

SEQ ID NO: 4769463 - DNA, 23 bp, Homo sapiens
ctgcctccgggcctcggcctggc

SEQ ID NO: 4769464 - DNA, 21 bp, Homo sapiens
ctgcctctcacacacatagat

SEQ ID NO: 4769465 - DNA, 16 bp, Homo sapiens
ctgcctctgccacact

SEQ ID NO: 4769466 - DNA, 20 bp, Homo sapiens
ctgcctctgccacactctga

SEQ ID NO: 4769467 - DNA, 12 bp, Homo sapiens
ctgcctctgcct

SEQ ID NO: 4769468 - DNA, 17 bp, Homo sapiens
ctgcctgcctccggccc

SEQ ID NO: 4769469 - DNA, 13 bp, Homo sapiens
ctgcctggccttg

SEQ ID NO: 4769470 - DNA, 17 bp, Homo sapiens
ctgcctggcgggcagcc

SEQ ID NO: 4769471 - DNA, 16 bp, Homo sapiens
ctgcctgggacagcca

SEQ ID NO: 4769472 - DNA, 23 bp, Homo sapiens
ctgccttagaggagcccacggct

SEQ ID NO: 4769473 - DNA, 16 bp, Homo sapiens
ctgccttatattattt

SEQ ID NO: 4769474 - DNA, 19 bp, Homo sapiens
ctgccttctcccctccaag

SEQ ID NO: 4769475 - DNA, 19 bp, Homo sapiens
ctgccttctgacggccctg

SEQ ID NO: 4769476 - DNA, 22 bp, Homo sapiens
ctgccttctgacggccctgcaa

SEQ ID NO: 4769477 - DNA, 18 bp, Homo sapiens
ctgcgcccctgcccagca

SEQ ID NO: 4769478 - DNA, 14 bp, Homo sapiens
ctgcgccctccctc

SEQ ID NO: 4769479 - DNA, 23 bp, Homo sapiens
ctgcgccctccctccctccacac

SEQ ID NO: 4769480 - DNA, 12 bp, Homo sapiens
ctgcgcctcctc

SEQ ID NO: 4769481 - DNA, 13 bp, Homo sapiens
ctgcgcctcctcc

SEQ ID NO: 4769482 - DNA, 13 bp, Homo sapiens
ctgcgcctgcccg

SEQ ID NO: 4769483 - DNA, 20 bp, Homo sapiens
caaactgttcaagaaataat

SEQ ID NO: 4769484 - DNA, 14 bp, Homo sapiens
caaacttttataaa

SEQ ID NO: 4769485 - DNA, 21 bp, Homo sapiens
caaacttttataaatgtttta

SEQ ID NO: 4769486 - DNA, 16 bp, Homo sapiens
caaagaaaatgagaat

SEQ ID NO: 4769487 - DNA, 18 bp, Homo sapiens
caaagaaacaaaatataa

SEQ ID NO: 4769488 - DNA, 17 bp, Homo sapiens
caaagaacccccctccc

SEQ ID NO: 4769489 - DNA, 19 bp, Homo sapiens
caaagaacccccctcccca

SEQ ID NO: 4769490 - DNA, 23 bp, Homo sapiens
caaagaaggcacaggtgtaaata

SEQ ID NO: 4769491 - DNA, 16 bp, Homo sapiens
caaagaatcaacagtg

SEQ ID NO: 4769492 - DNA, 19 bp, Homo sapiens
caaagacagtttcttgcaa

SEQ ID NO: 4769493 - DNA, 16 bp, Homo sapiens
caaagactccgagaag

SEQ ID NO: 4769494 - DNA, 23 bp, Homo sapiens
caaagagaaaagattaaaattag

SEQ ID NO: 4769495 - DNA, 18 bp, Homo sapiens
caaagaggccagtacttt

SEQ ID NO: 4769496 - DNA, 20 bp, Homo sapiens
caaagaggccagtactttgc

SEQ ID NO: 4769497 - DNA, 13 bp, Homo sapiens
caaagagtagaac

SEQ ID NO: 4769498 - DNA, 13 bp, Homo sapiens
caaagatagcaga

SEQ ID NO: 4769499 - DNA, 19 bp, Homo sapiens
caaagatccagcggggctt

SEQ ID NO: 4769500 - DNA, 14 bp, Homo sapiens
caaagatgcagccg

SEQ ID NO: 4769501 - DNA, 15 bp, Homo sapiens
caaagatgcagccgc

SEQ ID NO: 4769502 - DNA, 19 bp, Homo sapiens
caaagcactggccttgcct

SEQ ID NO: 4769503 - DNA, 22 bp, Homo sapiens
caaagcactggccttgcctcca

SEQ ID NO: 4769504 - DNA, 22 bp, Homo sapiens
caaagcagtatgtacaggctga

SEQ ID NO: 4769505 - DNA, 15 bp, Homo sapiens
caaagcagtgcatgc

SEQ ID NO: 4769506 - DNA, 11 bp, Homo sapiens
caaagccctcc

SEQ ID NO: 4769507 - DNA, 23 bp, Homo sapiens
caaagccctccctgtctgtctgt

SEQ ID NO: 4769508 - DNA, 13 bp, Homo sapiens
caaagcctgggca

SEQ ID NO: 4769509 - DNA, 12 bp, Homo sapiens
caaagctattta

SEQ ID NO: 4769510 - DNA, 17 bp, Homo sapiens
caaagctttctttgttt

SEQ ID NO: 4769511 - DNA, 16 bp, Homo sapiens
caaagtatatacagag

SEQ ID NO: 4769512 - DNA, 19 bp, Homo sapiens
caaagtcctgggattacag

SEQ ID NO: 4769513 - DNA, 19 bp, Homo sapiens
caaagtctcaatgaaatag

SEQ ID NO: 4769514 - DNA, 20 bp, Homo sapiens
caaagtgaaattagtatttt

SEQ ID NO: 4769515 - DNA, 21 bp, Homo sapiens
caaagtgaaattagtattttg

SEQ ID NO: 4769516 - DNA, 14 bp, Homo sapiens
caaagtgcacacac

SEQ ID NO: 4769517 - DNA, 16 bp, Homo sapiens
caaagtggtgagaggc

SEQ ID NO: 4769518 - DNA, 19 bp, Homo sapiens
caaagtggtgagaggcatc

SEQ ID NO: 4769519 - DNA, 19 bp, Homo sapiens
caaagtgtttaattgtata

SEQ ID NO: 4769520 - DNA, 13 bp, Homo sapiens
caaagttatccag

SEQ ID NO: 4769521 - DNA, 13 bp, Homo sapiens
caaagtttggaag

SEQ ID NO: 4769522 - DNA, 14 bp, Homo sapiens
caaagtttggaagt

SEQ ID NO: 4769523 - DNA, 13 bp, Homo sapiens
caaataaccctga

SEQ ID NO: 4769524 - DNA, 12 bp, Homo sapiens
caaataagtcaa

SEQ ID NO: 4769525 - DNA, 18 bp, Homo sapiens
caaatactgaaatattag

SEQ ID NO: 4769526 - DNA, 13 bp, Homo sapiens
caaatataaactt

SEQ ID NO: 4769527 - DNA, 15 bp, Homo sapiens
caaatataaacttgt

SEQ ID NO: 4769528 - DNA, 17 bp, Homo sapiens
caaatatgattctcctc

SEQ ID NO: 4769529 - DNA, 19 bp, Homo sapiens
caaatatgattctcctctc

SEQ ID NO: 4769530 - DNA, 21 bp, Homo sapiens
caaatatgattctcctctccc

SEQ ID NO: 4769531 - DNA, 16 bp, Homo sapiens
caaatattcattttga

SEQ ID NO: 4769532 - DNA, 17 bp, Homo sapiens
caaatattgatctgtat

SEQ ID NO: 4769533 - DNA, 21 bp, Homo sapiens
caaatattgctattgtttata

SEQ ID NO: 4769534 - DNA, 18 bp, Homo sapiens
caaatattgcttggacta

SEQ ID NO: 4769535 - DNA, 20 bp, Homo sapiens
caaatccataccccctgccc

SEQ ID NO: 4769536 - DNA, 13 bp, Homo sapiens
caaatccatgtgt

SEQ ID NO: 4769537 - DNA, 18 bp, Homo sapiens
caaatccatgtgtccccc

SEQ ID NO: 4769538 - DNA, 22 bp, Homo sapiens
caaatctcaaaagatctcctgt

SEQ ID NO: 4769539 - DNA, 20 bp, Homo sapiens
caaatctgtataaatgtgaa

SEQ ID NO: 4769540 - DNA, 19 bp, Homo sapiens
caaatgaaggaatgcaata

SEQ ID NO: 4769541 - DNA, 18 bp, Homo sapiens
caaatgaataatgccttt

SEQ ID NO: 4769542 - DNA, 22 bp, Homo sapiens
caaatgaataatgcctttgtaa

SEQ ID NO: 4769543 - DNA, 23 bp, Homo sapiens
caaatgaataatgcctttgtaac

SEQ ID NO: 4769544 - DNA, 10 bp, Homo sapiens
caaatgacat

SEQ ID NO: 4769545 - DNA, 16 bp, Homo sapiens
caaatgacatgcactg

SEQ ID NO: 4769546 - DNA, 16 bp, Homo sapiens
caaatgctaaatgcaa

SEQ ID NO: 4769547 - DNA, 17 bp, Homo sapiens
caaatgctaaatgcaaa

SEQ ID NO: 4769548 - DNA, 14 bp, Homo sapiens
tttcgtgcatttgt

SEQ ID NO: 4769549 - DNA, 15 bp, Homo sapiens
tttcgtgcatttgtg

SEQ ID NO: 4769550 - DNA, 21 bp, Homo sapiens
tttcgttaagcagtacatctt

SEQ ID NO: 4769551 - DNA, 14 bp, Homo sapiens
tttctaaaaagtca

SEQ ID NO: 4769552 - DNA, 12 bp, Homo sapiens
tttctaaaacat

SEQ ID NO: 4769553 - DNA, 14 bp, Homo sapiens
tttctaagaattta

SEQ ID NO: 4769554 - DNA, 20 bp, Homo sapiens
tttctacactgtattacata

SEQ ID NO: 4769555 - DNA, 11 bp, Homo sapiens
tttctacatgc

SEQ ID NO: 4769556 - DNA, 21 bp, Homo sapiens
tttctactttaaattgtggat

SEQ ID NO: 4769557 - DNA, 22 bp, Homo sapiens
tttctagaatactaataaaata

SEQ ID NO: 4769558 - DNA, 17 bp, Homo sapiens
tttctagccctctccct

SEQ ID NO: 4769559 - DNA, 20 bp, Homo sapiens
tttctatggattcacttcta

SEQ ID NO: 4769560 - DNA, 19 bp, Homo sapiens
tttctattccttctggcct

SEQ ID NO: 4769561 - DNA, 15 bp, Homo sapiens
tttctcaccctctgt

SEQ ID NO: 4769562 - DNA, 14 bp, Homo sapiens
tttctccgttgtgg

SEQ ID NO: 4769563 - DNA, 11 bp, Homo sapiens
tttctctctgt

SEQ ID NO: 4769564 - DNA, 17 bp, Homo sapiens
tttctctctgtgtggca

SEQ ID NO: 4769565 - DNA, 11 bp, Homo sapiens
tttctctgtgg

SEQ ID NO: 4769566 - DNA, 18 bp, Homo sapiens
tttctcttaagctgccca

SEQ ID NO: 4769567 - DNA, 21 bp, Homo sapiens
tttctctttgggtttcttgtt

SEQ ID NO: 4769568 - DNA, 20 bp, Homo sapiens
tttctgatacatctgtcagt

SEQ ID NO: 4769569 - DNA, 18 bp, Homo sapiens
tttctgcagtattctgta

SEQ ID NO: 4769570 - DNA, 19 bp, Homo sapiens
tttctgcagtattctgtag

SEQ ID NO: 4769571 - DNA, 14 bp, Homo sapiens
tttctgtatataga

SEQ ID NO: 4769572 - DNA, 22 bp, Homo sapiens
tttctgtcctcaggtgaataac

SEQ ID NO: 4769573 - DNA, 14 bp, Homo sapiens
tttctgtcctgtaa

SEQ ID NO: 4769574 - DNA, 18 bp, Homo sapiens
tttctgtcctgtaactgt

SEQ ID NO: 4769575 - DNA, 11 bp, Homo sapiens
tttcttcaaaa

SEQ ID NO: 4769576 - DNA, 22 bp, Homo sapiens
tttcttcaaaatataaaatgcc

SEQ ID NO: 4769577 - DNA, 12 bp, Homo sapiens
tttcttcccatt

SEQ ID NO: 4769578 - DNA, 21 bp, Homo sapiens
tttcttccttcctttctctct

SEQ ID NO: 4769579 - DNA, 23 bp, Homo sapiens
tttcttctttaatttttctgttg

SEQ ID NO: 4769580 - DNA, 16 bp, Homo sapiens
tttcttgcaagctcca

SEQ ID NO: 4769581 - DNA, 14 bp, Homo sapiens
tttcttgtatctgg

SEQ ID NO: 4769582 - DNA, 17 bp, Homo sapiens
tttgaaataacagcctt

SEQ ID NO: 4769583 - DNA, 15 bp, Homo sapiens
tttgaacagggcaaa

SEQ ID NO: 4769584 - DNA, 15 bp, Homo sapiens
tttgaagaattaatg

SEQ ID NO: 4769585 - DNA, 13 bp, Homo sapiens
tttgaattgtgtg

SEQ ID NO: 4769586 - DNA, 20 bp, Homo sapiens
tttgaattgtgtggagaagt

SEQ ID NO: 4769587 - DNA, 12 bp, Homo sapiens
tttgacattgtc

SEQ ID NO: 4769588 - DNA, 20 bp, Homo sapiens
tttgacattgtcagaatgtt

SEQ ID NO: 4769589 - DNA, 14 bp, Homo sapiens
tttgaccactgaca

SEQ ID NO: 4769590 - DNA, 15 bp, Homo sapiens
tttgaccactgacag

SEQ ID NO: 4769591 - DNA, 21 bp, Homo sapiens
tttgaccactgacagcctcca

SEQ ID NO: 4769592 - DNA, 18 bp, Homo sapiens
tttgacctcacagtgacc

SEQ ID NO: 4769593 - DNA, 19 bp, Homo sapiens
tttgacttgccactgccat

SEQ ID NO: 4769594 - DNA, 19 bp, Homo sapiens
tttgagaccaacctgggta

SEQ ID NO: 4769595 - DNA, 12 bp, Homo sapiens
tttgaggaaact

SEQ ID NO: 4769596 - DNA, 21 bp, Homo sapiens
tttgaggctggcggggtctgc

SEQ ID NO: 4769597 - DNA, 21 bp, Homo sapiens
tttgagtgccttacacaatgg

SEQ ID NO: 4769598 - DNA, 18 bp, Homo sapiens
tttgagtgtcaggctctg

SEQ ID NO: 4769599 - DNA, 19 bp, Homo sapiens
tttgagtgtcaggctctga

SEQ ID NO: 4769600 - DNA, 21 bp, Homo sapiens
tttgatatacagacctccaga

SEQ ID NO: 4769601 - DNA, 12 bp, Homo sapiens
tttgatttgcaa

SEQ ID NO: 4769602 - DNA, 20 bp, Homo sapiens
tttgatttgcaacactgcca

SEQ ID NO: 4769603 - DNA, 23 bp, Homo sapiens
tttgcaacactgccaaacatcag

SEQ ID NO: 4769604 - DNA, 17 bp, Homo sapiens
tttgcaaccttgtactt

SEQ ID NO: 4769605 - DNA, 22 bp, Homo sapiens
tttgcaaccttgtactttacaa

SEQ ID NO: 4769606 - DNA, 17 bp, Homo sapiens
tttgcactttgccatct

SEQ ID NO: 4769607 - DNA, 15 bp, Homo sapiens
tttgcatgtctgcat

SEQ ID NO: 4769608 - DNA, 13 bp, Homo sapiens
tttgcattgtctg

SEQ ID NO: 4769609 - DNA, 14 bp, Homo sapiens
tttgcattgtctgt

SEQ ID NO: 4769610 - DNA, 13 bp, Homo sapiens
tttgcatttaaga

SEQ ID NO: 4769611 - DNA, 21 bp, Homo sapiens
tttgcatttaagaattgccag

SEQ ID NO: 4769612 - DNA, 19 bp, Homo sapiens
tttgcctttaggcaggaag

SEQ ID NO: 4769613 - DNA, 12 bp, Homo sapiens
tttgcctttggt

SEQ ID NO: 4769614 - DNA, 16 bp, Homo sapiens
tttgcgctctgggttt

SEQ ID NO: 4769615 - DNA, 13 bp, Homo sapiens
tttgctaatgaat

SEQ ID NO: 4769616 - DNA, 14 bp, Homo sapiens
tttgctaattaaaa

SEQ ID NO: 4769617 - DNA, 15 bp, Homo sapiens
tttgctcataagtaa

SEQ ID NO: 4769618 - DNA, 19 bp, Homo sapiens
tttgctcataagtaaatgt

SEQ ID NO: 4769619 - DNA, 21 bp, Homo sapiens
tttgctcataagtaaatgtct

SEQ ID NO: 4769620 - DNA, 20 bp, Homo sapiens
tttgctctgtggtaagagat

SEQ ID NO: 4769621 - DNA, 20 bp, Homo sapiens
tttgctgaataacaacaatt

SEQ ID NO: 4769622 - DNA, 17 bp, Homo sapiens
tttgcttatttatattc

SEQ ID NO: 4769623 - DNA, 14 bp, Homo sapiens
tttgctttttgctt

SEQ ID NO: 4769624 - DNA, 13 bp, Homo sapiens
tttggaagaaagg

SEQ ID NO: 4769625 - DNA, 13 bp, Homo sapiens
tttggaatttgaa

SEQ ID NO: 4769626 - DNA, 18 bp, Homo sapiens
tttggatgaatgcagtat

SEQ ID NO: 4769627 - DNA, 22 bp, Homo sapiens
tttggcattatctctttctctc

SEQ ID NO: 4769628 - DNA, 21 bp, Homo sapiens
tttggccgttttgtgaagaaa

SEQ ID NO: 4769629 - DNA, 14 bp, Homo sapiens
tttggctgaaatta

SEQ ID NO: 4769630 - DNA, 19 bp, Homo sapiens
tttggctgctctccatctc

SEQ ID NO: 4769631 - DNA, 14 bp, Homo sapiens
tttgggctgaatgt

SEQ ID NO: 4769632 - DNA, 18 bp, Homo sapiens
tttgggggacgcccagcc

SEQ ID NO: 4769633 - DNA, 20 bp, Homo sapiens
tttggtatgaaacaaatata

SEQ ID NO: 4769634 - DNA, 13 bp, Homo sapiens
tttggtggctcta

SEQ ID NO: 4769635 - DNA, 19 bp, Homo sapiens
tttggttcctcatggctgt

SEQ ID NO: 4769636 - DNA, 15 bp, Homo sapiens
tttggttgcaattgt

SEQ ID NO: 4769637 - DNA, 16 bp, Homo sapiens
tttgtaaaacagtggt

SEQ ID NO: 4769638 - DNA, 17 bp, Homo sapiens
tttgtaaaagagctgtt

SEQ ID NO: 4769639 - DNA, 20 bp, Homo sapiens
tttgtaaaagagctgttctt

SEQ ID NO: 4769640 - DNA, 16 bp, Homo sapiens
tttgtaaaattccatg

SEQ ID NO: 4769641 - DNA, 22 bp, Homo sapiens
tttgtaaatatcttttcttctc

SEQ ID NO: 4769642 - DNA, 18 bp, Homo sapiens
tttgtaatataagacaag

SEQ ID NO: 4769643 - DNA, 15 bp, Homo sapiens
tttgtaatgtatctt

SEQ ID NO: 4769644 - DNA, 21 bp, Homo sapiens
tttgtaatgtatcttatttat

SEQ ID NO: 4769645 - DNA, 23 bp, Homo sapiens
tttgtagctagtttaaaattatt

SEQ ID NO: 4769646 - DNA, 17 bp, Homo sapiens
tttgtagtagttgatga

SEQ ID NO: 4769647 - DNA, 22 bp, Homo sapiens
tttgtatcctccattgtatctt

SEQ ID NO: 4769648 - DNA, 16 bp, Homo sapiens
tttgtattagtaataa

SEQ ID NO: 4769649 - DNA, 10 bp, Homo sapiens
tttgtattta

SEQ ID NO: 4769650 - DNA, 18 bp, Homo sapiens
tttgtctctgagaacaga

SEQ ID NO: 4769651 - DNA, 16 bp, Homo sapiens
tttgtctggctgtggc

SEQ ID NO: 4769652 - DNA, 22 bp, Homo sapiens
tttgtctggctgtggcccctcc

SEQ ID NO: 4769653 - DNA, 13 bp, Homo sapiens
tttgtcttcaact

SEQ ID NO: 4769654 - DNA, 20 bp, Homo sapiens
tttgtgaaagtggcaagctc

SEQ ID NO: 4769655 - DNA, 15 bp, Homo sapiens
tttgtgaagaaacat

SEQ ID NO: 4769656 - DNA, 14 bp, Homo sapiens
tttgtgaagtgatt

SEQ ID NO: 4769657 - DNA, 20 bp, Homo sapiens
tttgtgaagtgattgacatt

SEQ ID NO: 4769658 - DNA, 21 bp, Homo sapiens
tttgtgaagtgattgacattt

SEQ ID NO: 4769659 - DNA, 18 bp, Homo sapiens
tttgtgagccaaagagaa

SEQ ID NO: 4769660 - DNA, 13 bp, Homo sapiens
tttgtgctgtggg

SEQ ID NO: 4769661 - DNA, 18 bp, Homo sapiens
tttgtgcttgttcttcct

SEQ ID NO: 4769662 - DNA, 15 bp, Homo sapiens
tttgtgtcctttaaa

SEQ ID NO: 4769663 - DNA, 12 bp, Homo sapiens
tttgtgtctttt

SEQ ID NO: 4769664 - DNA, 18 bp, Homo sapiens
tttgttaaaatatagtgt

SEQ ID NO: 4769665 - DNA, 21 bp, Homo sapiens
tttgttctccgggtgtggcct

SEQ ID NO: 4769666 - DNA, 15 bp, Homo sapiens
tttgttctctcttgg

SEQ ID NO: 4769667 - DNA, 23 bp, Homo sapiens
tttgttctgggttaacagtaaat

SEQ ID NO: 4769668 - DNA, 23 bp, Homo sapiens
tttgttgagctggtaacatcgtt

SEQ ID NO: 4769669 - DNA, 12 bp, Homo sapiens
tttgtttacaca

SEQ ID NO: 4769670 - DNA, 13 bp, Homo sapiens
tttgtttgctgct

SEQ ID NO: 4769671 - DNA, 16 bp, Homo sapiens
tttgtttgtgcttcta

SEQ ID NO: 4769672 - DNA, 16 bp, Homo sapiens
tttgttttggctgctc

SEQ ID NO: 4769673 - DNA, 19 bp, Homo sapiens
ttttaaaaaaaatattctg

SEQ ID NO: 4769674 - DNA, 20 bp, Homo sapiens
ttttaaaaaaaatattctgt

SEQ ID NO: 4769675 - DNA, 21 bp, Homo sapiens
ttttaaacaaaatttatgtca

SEQ ID NO: 4769676 - DNA, 17 bp, Homo sapiens
ttttaaagaagtccatg

SEQ ID NO: 4769677 - DNA, 15 bp, Homo sapiens
ttttaatttcctgtg

SEQ ID NO: 4769678 - DNA, 21 bp, Homo sapiens
ttttacataattgccaataat

SEQ ID NO: 4769679 - DNA, 19 bp, Homo sapiens
ttttactcaggctttctat

SEQ ID NO: 4769680 - DNA, 20 bp, Homo sapiens
ttttactcaggctttctatt

SEQ ID NO: 4769681 - DNA, 21 bp, Homo sapiens
ttttagagattaatttgtgta

SEQ ID NO: 4769682 - DNA, 18 bp, Homo sapiens
ttttagattcctacttaa

SEQ ID NO: 4769683 - DNA, 16 bp, Homo sapiens
ttttataaatggaggt

SEQ ID NO: 4769684 - DNA, 17 bp, Homo sapiens
ttttataaatgttttaa

SEQ ID NO: 4769685 - DNA, 19 bp, Homo sapiens
ttttatctgaaatcaatta

SEQ ID NO: 4769686 - DNA, 14 bp, Homo sapiens
ttttatgaagaaaa

SEQ ID NO: 4769687 - DNA, 20 bp, Homo sapiens
ttttatgagacttcctatta

SEQ ID NO: 4769688 - DNA, 16 bp, Homo sapiens
ttttattatcttctat

SEQ ID NO: 4769689 - DNA, 13 bp, Homo sapiens
ttttattgctgga

SEQ ID NO: 4769690 - DNA, 13 bp, Homo sapiens
ttttatttctcgg

SEQ ID NO: 4769691 - DNA, 18 bp, Homo sapiens
ttttcaagttgcagtcag

SEQ ID NO: 4769692 - DNA, 21 bp, Homo sapiens
ttttcaatgcaatgcatctga

SEQ ID NO: 4769693 - DNA, 17 bp, Homo sapiens
ttttcaatgtactgtat

SEQ ID NO: 4769694 - DNA, 18 bp, Homo sapiens
ttttcacttcttaaggac

SEQ ID NO: 4769695 - DNA, 12 bp, Homo sapiens
ttttcagattgt

SEQ ID NO: 4769696 - DNA, 16 bp, Homo sapiens
ttttcataggaagaca

SEQ ID NO: 4769697 - DNA, 12 bp, Homo sapiens
ttttcattctgg

SEQ ID NO: 4769698 - DNA, 22 bp, Homo sapiens
ttttcattctggtccttagtaa

SEQ ID NO: 4769699 - DNA, 15 bp, Homo sapiens
ttttcattttctctc

SEQ ID NO: 4769700 - DNA, 16 bp, Homo sapiens
ttttcattttctctcc

SEQ ID NO: 4769701 - DNA, 20 bp, Homo sapiens
ttttccagggcaatcaatgt

SEQ ID NO: 4769702 - DNA, 22 bp, Homo sapiens
ttttccccattgaccctcacct

SEQ ID NO: 4769703 - DNA, 14 bp, Homo sapiens
ttttccccctaatt

SEQ ID NO: 4769704 - DNA, 18 bp, Homo sapiens
ttttccccctaattctta

SEQ ID NO: 4769705 - DNA, 14 bp, Homo sapiens
ttttcgtcttccct

SEQ ID NO: 4769706 - DNA, 15 bp, Homo sapiens
ttttctaattgtacc

SEQ ID NO: 4769707 - DNA, 13 bp, Homo sapiens
ttttctactcgag

SEQ ID NO: 4769708 - DNA, 22 bp, Homo sapiens
ttttctactcgagttacagaca

SEQ ID NO: 4769709 - DNA, 13 bp, Homo sapiens
ttttctagaatac

SEQ ID NO: 4769710 - DNA, 23 bp, Homo sapiens
ttttctagaatactaataaaata

SEQ ID NO: 4769711 - DNA, 15 bp, Homo sapiens
ttttctatatttgga

SEQ ID NO: 4769712 - DNA, 16 bp, Homo sapiens
ttttctgtaattcttc

SEQ ID NO: 4769713 - DNA, 19 bp, Homo sapiens
ttttcttccaacatgtgat

SEQ ID NO: 4769714 - DNA, 22 bp, Homo sapiens
ttttcttcccatttgtaatgta

SEQ ID NO: 4769715 - DNA, 16 bp, Homo sapiens
ttttgacactgaaata

SEQ ID NO: 4769716 - DNA, 19 bp, Homo sapiens
ttttgagcgacatctctga

SEQ ID NO: 4769717 - DNA, 19 bp, Homo sapiens
ttttgatacttgtaacttt

SEQ ID NO: 4769718 - DNA, 17 bp, Homo sapiens
ttttgatctctgttctt

SEQ ID NO: 4769719 - DNA, 14 bp, Homo sapiens
ttttgatggctatg

SEQ ID NO: 4769720 - DNA, 13 bp, Homo sapiens
ttttgatgtatta

SEQ ID NO: 4769721 - DNA, 22 bp, Homo sapiens
ttttgcaataaggatttattct

SEQ ID NO: 4769722 - DNA, 15 bp, Homo sapiens
ttttgcatgtctgca

SEQ ID NO: 4769723 - DNA, 21 bp, Homo sapiens
ttttgctggcttgcactttct

SEQ ID NO: 4769724 - DNA, 11 bp, Homo sapiens
ttttgtaactc

SEQ ID NO: 4769725 - DNA, 18 bp, Homo sapiens
ttttgtaactctttggct

SEQ ID NO: 4769726 - DNA, 17 bp, Homo sapiens
ttttgtaatataagaca

SEQ ID NO: 4769727 - DNA, 19 bp, Homo sapiens
ttttgtaattcctctagct

SEQ ID NO: 4769728 - DNA, 12 bp, Homo sapiens
ttttgtagctag

SEQ ID NO: 4769729 - DNA, 13 bp, Homo sapiens
ttttgtatcctcc

SEQ ID NO: 4769730 - DNA, 14 bp, Homo sapiens
ttttgtgaatggtt

SEQ ID NO: 4769731 - DNA, 21 bp, Homo sapiens
ttttgttcaccttctgtgcat

SEQ ID NO: 4769732 - DNA, 15 bp, Homo sapiens
ttttgttgattaaaa

SEQ ID NO: 4769733 - DNA, 14 bp, Homo sapiens
tttttaaattttct

SEQ ID NO: 4769734 - DNA, 21 bp, Homo sapiens
tttttaactttaccatgctca

SEQ ID NO: 4769735 - DNA, 22 bp, Homo sapiens
tttttatttctgtcagttatga

SEQ ID NO: 4769736 - DNA, 21 bp, Homo sapiens
tttttcaaaacgccatgtcct

SEQ ID NO: 4769737 - DNA, 16 bp, Homo sapiens
tttttcaatgtactgt

SEQ ID NO: 4769738 - DNA, 13 bp, Homo sapiens
tttttcctgtcaa

SEQ ID NO: 4769739 - DNA, 13 bp, Homo sapiens
tttttgactgatt

SEQ ID NO: 4769740 - DNA, 16 bp, Homo sapiens
tttttgtaatataaga

SEQ ID NO: 4769741 - DNA, 22 bp, Homo sapiens
tttttgttcaccttctgtgcat

SEQ ID NO: 4769742 - DNA, 13 bp, Homo sapiens
ttttttgtctgtg

SEQ ID NO: 4769743 - DNA, 14 bp, Homo sapiens
ttttttgtctgtga

SEQ ID NO: 4769744 - DNA, 12 bp, Homo sapiens
tttttttaagtg

SEQ ID NO: 4769745 - DNA, 22 bp, Homo sapiens
tggatcaggaacccttacagta

SEQ ID NO: 4769746 - DNA, 15 bp, Homo sapiens
tggatctgctccatg

SEQ ID NO: 4769747 - DNA, 16 bp, Homo sapiens
tggatctgctccatgc

SEQ ID NO: 4769748 - DNA, 18 bp, Homo sapiens
tggatctgctccatgcag

SEQ ID NO: 4769749 - DNA, 12 bp, Homo sapiens
tggatctggagt

SEQ ID NO: 4769750 - DNA, 17 bp, Homo sapiens
tggatcttgctggagaa

SEQ ID NO: 4769751 - DNA, 17 bp, Homo sapiens
tggatgaatgcagtata

SEQ ID NO: 4769752 - DNA, 16 bp, Homo sapiens
tggatgattcttttcc

SEQ ID NO: 4769753 - DNA, 17 bp, Homo sapiens
tggatggggcggcctgc

SEQ ID NO: 4769754 - DNA, 20 bp, Homo sapiens
tggatggggcggcctgcaga

SEQ ID NO: 4769755 - DNA, 18 bp, Homo sapiens
tggatgtgcatctggcct

SEQ ID NO: 4769756 - DNA, 16 bp, Homo sapiens
tggattataatcagaa

SEQ ID NO: 4769757 - DNA, 12 bp, Homo sapiens
tggattcacttc

SEQ ID NO: 4769758 - DNA, 13 bp, Homo sapiens
tggattcacttct

SEQ ID NO: 4769759 - DNA, 11 bp, Homo sapiens
tggattgtttt

SEQ ID NO: 4769760 - DNA, 14 bp, Homo sapiens
tggatttcctttga

SEQ ID NO: 4769761 - DNA, 16 bp, Homo sapiens
tggattttaaacaaaa

SEQ ID NO: 4769762 - DNA, 22 bp, Homo sapiens
tggattttaaacaaaatttatg

SEQ ID NO: 4769763 - DNA, 19 bp, Homo sapiens
tggcaacgttcatgttcat

SEQ ID NO: 4769764 - DNA, 20 bp, Homo sapiens
tggcaacgttcatgttcatc

SEQ ID NO: 4769765 - DNA, 15 bp, Homo sapiens
tggcaagcatagtcg

SEQ ID NO: 4769766 - DNA, 20 bp, Homo sapiens
tggcaagctcttcattgcac

SEQ ID NO: 4769767 - DNA, 21 bp, Homo sapiens
tggcaagctcttcattgcact

SEQ ID NO: 4769768 - DNA, 13 bp, Homo sapiens
tggcaagtttttg

SEQ ID NO: 4769769 - DNA, 11 bp, Homo sapiens
tggcaccaaag

SEQ ID NO: 4769770 - DNA, 17 bp, Homo sapiens
tggcaccaaagatgcag

SEQ ID NO: 4769771 - DNA, 14 bp, Homo sapiens
tggcaccagatgca

SEQ ID NO: 4769772 - DNA, 20 bp, Homo sapiens
tggcaccagatgcaacctca

SEQ ID NO: 4769773 - DNA, 16 bp, Homo sapiens
tggcacccaccactct

SEQ ID NO: 4769774 - DNA, 17 bp, Homo sapiens
tggcagagccatccacc

SEQ ID NO: 4769775 - DNA, 21 bp, Homo sapiens
tggcagagccatccaccctga

SEQ ID NO: 4769776 - DNA, 15 bp, Homo sapiens
tggcagagttgaaga

SEQ ID NO: 4769777 - DNA, 18 bp, Homo sapiens
tggcagatgggggcctct

SEQ ID NO: 4769778 - DNA, 18 bp, Homo sapiens
tggcagcgcccagcctgg

SEQ ID NO: 4769779 - DNA, 17 bp, Homo sapiens
tggcagcgcctcccgcc

SEQ ID NO: 4769780 - DNA, 20 bp, Homo sapiens
tggcaggcacacagcagccc

SEQ ID NO: 4769781 - DNA, 20 bp, Homo sapiens
tggcagggaggtcaggccct

SEQ ID NO: 4769782 - DNA, 14 bp, Homo sapiens
tggcagtattgaca

SEQ ID NO: 4769783 - DNA, 18 bp, Homo sapiens
tggcatagccattcattt

SEQ ID NO: 4769784 - DNA, 17 bp, Homo sapiens
tggcataggactctttg

SEQ ID NO: 4769785 - DNA, 21 bp, Homo sapiens
tggcatctctccccatatata

SEQ ID NO: 4769786 - DNA, 23 bp, Homo sapiens
tggcatctctccccatatataaa

SEQ ID NO: 4769787 - DNA, 18 bp, Homo sapiens
tggcatcttaaaagctat

SEQ ID NO: 4769788 - DNA, 15 bp, Homo sapiens
tggcatgggaatgaa

SEQ ID NO: 4769789 - DNA, 19 bp, Homo sapiens
tggcattatctctttctct

SEQ ID NO: 4769790 - DNA, 14 bp, Homo sapiens
tggcatttgctgaa

SEQ ID NO: 4769791 - DNA, 15 bp, Homo sapiens
tggcatttgctgaat

SEQ ID NO: 4769792 - DNA, 20 bp, Homo sapiens
tggccacactggaatccagt

SEQ ID NO: 4769793 - DNA, 14 bp, Homo sapiens
tggccacagtggca

SEQ ID NO: 4769794 - DNA, 14 bp, Homo sapiens
tggccagcaccctc

SEQ ID NO: 4769795 - DNA, 15 bp, Homo sapiens
tggccagcaccctct

SEQ ID NO: 4769796 - DNA, 18 bp, Homo sapiens
tggccagcaccctctcct

SEQ ID NO: 4769797 - DNA, 18 bp, Homo sapiens
tggccagcccgcagaggt

SEQ ID NO: 4769798 - DNA, 21 bp, Homo sapiens
tggccagcccgcagaggtggg

SEQ ID NO: 4769799 - DNA, 23 bp, Homo sapiens
tggccagcccgcagaggtggggt

SEQ ID NO: 4769800 - DNA, 19 bp, Homo sapiens
tggccagcctggggcctgg

SEQ ID NO: 4769801 - DNA, 14 bp, Homo sapiens
tggccaggagtggg

SEQ ID NO: 4769802 - DNA, 17 bp, Homo sapiens
tggccagtatcctggat

SEQ ID NO: 4769803 - DNA, 12 bp, Homo sapiens
tggccatccctg

SEQ ID NO: 4769804 - DNA, 14 bp, Homo sapiens
tggccatccctggg

SEQ ID NO: 4769805 - DNA, 16 bp, Homo sapiens
tggccatccctgggcc

SEQ ID NO: 4769806 - DNA, 20 bp, Homo sapiens
tggccatccctgggcccctc

SEQ ID NO: 4769807 - DNA, 23 bp, Homo sapiens
tggccatccctgggcccctccac

SEQ ID NO: 4769808 - DNA, 14 bp, Homo sapiens
tggcccacccctct

SEQ ID NO: 4769809 - DNA, 23 bp, Homo sapiens
tggcccacccctcttcccccttc

SEQ ID NO: 4769810 - DNA, 11 bp, Homo sapiens
tggcccagcag

SEQ ID NO: 4769811 - DNA, 18 bp, Homo sapiens
tggcccagcagcggccca

SEQ ID NO: 4769812 - DNA, 12 bp, Homo sapiens
tggcccagccag

SEQ ID NO: 4769813 - DNA, 20 bp, Homo sapiens
tggcccagtgcaatctgtcc

SEQ ID NO: 4769814 - DNA, 14 bp, Homo sapiens
tggccccaaatgtt

SEQ ID NO: 4769815 - DNA, 22 bp, Homo sapiens
tggccccagctcctcttcctgc

SEQ ID NO: 4769816 - DNA, 14 bp, Homo sapiens
tggccccagctggc

SEQ ID NO: 4769817 - DNA, 16 bp, Homo sapiens
tggccccagctggctg

SEQ ID NO: 4769818 - DNA, 18 bp, Homo sapiens
ttgtaaaactgtgacatt

SEQ ID NO: 4769819 - DNA, 16 bp, Homo sapiens
ttgtaaaagagctgtt

SEQ ID NO: 4769820 - DNA, 15 bp, Homo sapiens
ttgtaaaatgtatta

SEQ ID NO: 4769821 - DNA, 21 bp, Homo sapiens
ttgtaaaattccatggatctt

SEQ ID NO: 4769822 - DNA, 21 bp, Homo sapiens
ttgtaaagatattgtatctcc

SEQ ID NO: 4769823 - DNA, 20 bp, Homo sapiens
ttgtaagcaattctaagtga

SEQ ID NO: 4769824 - DNA, 14 bp, Homo sapiens
ttgtaatatcagtt

SEQ ID NO: 4769825 - DNA, 15 bp, Homo sapiens
ttgtaatgtatctta

SEQ ID NO: 4769826 - DNA, 18 bp, Homo sapiens
ttgtaatgtatcttattt

SEQ ID NO: 4769827 - DNA, 21 bp, Homo sapiens
ttgtaattcctctagctacca

SEQ ID NO: 4769828 - DNA, 13 bp, Homo sapiens
ttgtacataaaca

SEQ ID NO: 4769829 - DNA, 15 bp, Homo sapiens
ttgtacatatggaaa

SEQ ID NO: 4769830 - DNA, 13 bp, Homo sapiens
ttgtacatgaaca

SEQ ID NO: 4769831 - DNA, 15 bp, Homo sapiens
ttgtacctaagtaaa

SEQ ID NO: 4769832 - DNA, 18 bp, Homo sapiens
ttgtacgtgttattatta

SEQ ID NO: 4769833 - DNA, 13 bp, Homo sapiens
ttgtacttacact

SEQ ID NO: 4769834 - DNA, 14 bp, Homo sapiens
ttgtactttacaat

SEQ ID NO: 4769835 - DNA, 15 bp, Homo sapiens
ttgtagggtgaggcg

SEQ ID NO: 4769836 - DNA, 20 bp, Homo sapiens
ttgtattagtaataaaacat

SEQ ID NO: 4769837 - DNA, 20 bp, Homo sapiens
ttgtattatcagtgaatata

SEQ ID NO: 4769838 - DNA, 20 bp, Homo sapiens
ttgtattgttagatgtttgt

SEQ ID NO: 4769839 - DNA, 16 bp, Homo sapiens
ttgtcaacttcagttg

SEQ ID NO: 4769840 - DNA, 13 bp, Homo sapiens
ttgtcacttctgc

SEQ ID NO: 4769841 - DNA, 20 bp, Homo sapiens
ttgtcacttctgctgtacag

SEQ ID NO: 4769842 - DNA, 19 bp, Homo sapiens
ttgtcagagatgttttcaa

SEQ ID NO: 4769843 - DNA, 19 bp, Homo sapiens
ttgtcatcagccaaaacgt

SEQ ID NO: 4769844 - DNA, 13 bp, Homo sapiens
ttgtcatgtggct

SEQ ID NO: 4769845 - DNA, 15 bp, Homo sapiens
ttgtcattctgctaa

SEQ ID NO: 4769846 - DNA, 21 bp, Homo sapiens
ttgtccaaagttacctggaat

SEQ ID NO: 4769847 - DNA, 15 bp, Homo sapiens
ttgtccacaaatgtc

SEQ ID NO: 4769848 - DNA, 23 bp, Homo sapiens
ttgtccacaaatgtcctcagagg

SEQ ID NO: 4769849 - DNA, 22 bp, Homo sapiens
ttgtccaccttctgccaaggcc

SEQ ID NO: 4769850 - DNA, 18 bp, Homo sapiens
ttgtccccaatgaatata

SEQ ID NO: 4769851 - DNA, 12 bp, Homo sapiens
ttgtccctgcag

SEQ ID NO: 4769852 - DNA, 13 bp, Homo sapiens
ttgtcctgtgtca

SEQ ID NO: 4769853 - DNA, 13 bp, Homo sapiens
ttgtctaaagatc

SEQ ID NO: 4769854 - DNA, 20 bp, Homo sapiens
ttgtctcacgattccagtgc

SEQ ID NO: 4769855 - DNA, 11 bp, Homo sapiens
ttgtctgctgc

SEQ ID NO: 4769856 - DNA, 16 bp, Homo sapiens
ttgtctgtgataacag

SEQ ID NO: 4769857 - DNA, 13 bp, Homo sapiens
ttgtcttattcct

SEQ ID NO: 4769858 - DNA, 17 bp, Homo sapiens
ttgtcttgatcctcact

SEQ ID NO: 4769859 - DNA, 13 bp, Homo sapiens
ttgtgaagtgatt

SEQ ID NO: 4769860 - DNA, 17 bp, Homo sapiens
ttgtgaatggttgcaaa

SEQ ID NO: 4769861 - DNA, 13 bp, Homo sapiens
ttgtgaggacctt

SEQ ID NO: 4769862 - DNA, 13 bp, Homo sapiens
ttgtgatctgttg

SEQ ID NO: 4769863 - DNA, 14 bp, Homo sapiens
ttgtgcatgcaaaa

SEQ ID NO: 4769864 - DNA, 15 bp, Homo sapiens
ttgtgccctgtagct

SEQ ID NO: 4769865 - DNA, 15 bp, Homo sapiens
ttgtgctgtgggcag

SEQ ID NO: 4769866 - DNA, 19 bp, Homo sapiens
ttgtgctgtgggcagcacc

SEQ ID NO: 4769867 - DNA, 19 bp, Homo sapiens
ttgtgcttatgtcatttct

SEQ ID NO: 4769868 - DNA, 15 bp, Homo sapiens
ttgtgctttctatct

SEQ ID NO: 4769869 - DNA, 17 bp, Homo sapiens
ttgtggacactacacgt

SEQ ID NO: 4769870 - DNA, 17 bp, Homo sapiens
ttgtggacttttcccca

SEQ ID NO: 4769871 - DNA, 19 bp, Homo sapiens
ttgtggcagcttccctgaa

SEQ ID NO: 4769872 - DNA, 14 bp, Homo sapiens
ttgtgtagattgtg

SEQ ID NO: 4769873 - DNA, 15 bp, Homo sapiens
ttgtgtatgatccaa

SEQ ID NO: 4769874 - DNA, 20 bp, Homo sapiens
ttgttaatatcactcattaa

SEQ ID NO: 4769875 - DNA, 21 bp, Homo sapiens
ttgttaatgattcttgtgtca

SEQ ID NO: 4769876 - DNA, 12 bp, Homo sapiens
ttgttagatgtt

SEQ ID NO: 4769877 - DNA, 18 bp, Homo sapiens
ttgttatatcagcagaca

SEQ ID NO: 4769878 - DNA, 16 bp, Homo sapiens
ttgttatcagtacaat

SEQ ID NO: 4769879 - DNA, 22 bp, Homo sapiens
ttgttatgtaaacatcataaat

SEQ ID NO: 4769880 - DNA, 20 bp, Homo sapiens
ttgttcaaagaacccccctc

SEQ ID NO: 4769881 - DNA, 18 bp, Homo sapiens
ttgttcaccttctgtgca

SEQ ID NO: 4769882 - DNA, 19 bp, Homo sapiens
ttgttcccattttccttca

SEQ ID NO: 4769883 - DNA, 14 bp, Homo sapiens
ttgttcctttttct

SEQ ID NO: 4769884 - DNA, 20 bp, Homo sapiens
ttgttctagttagcaggaaa

SEQ ID NO: 4769885 - DNA, 22 bp, Homo sapiens
ttgttctagttagcaggaaata

SEQ ID NO: 4769886 - DNA, 23 bp, Homo sapiens
ttgttctccgggtgtggcctcag

SEQ ID NO: 4769887 - DNA, 12 bp, Homo sapiens
ttgttctgtgca

SEQ ID NO: 4769888 - DNA, 17 bp, Homo sapiens
ttgttcttcaatgtgaa

SEQ ID NO: 4769889 - DNA, 14 bp, Homo sapiens
ttgtttgctgcttt

SEQ ID NO: 4769890 - DNA, 20 bp, Homo sapiens
ttgtttgtaaaagagctgtt

SEQ ID NO: 4769891 - DNA, 17 bp, Homo sapiens
ttgttttatagaggttc

SEQ ID NO: 4769892 - DNA, 13 bp, Homo sapiens
ttgttttgtggat

SEQ ID NO: 4769893 - DNA, 16 bp, Homo sapiens
ttgtttttatatatta

SEQ ID NO: 4769894 - DNA, 18 bp, Homo sapiens
tttaaaaaagatggattt

SEQ ID NO: 4769895 - DNA, 19 bp, Homo sapiens
tttaaaaaatagcagcttt

SEQ ID NO: 4769896 - DNA, 17 bp, Homo sapiens
tttaaaacaagctgata

SEQ ID NO: 4769897 - DNA, 18 bp, Homo sapiens
tttaaaacaagctgatag

SEQ ID NO: 4769898 - DNA, 19 bp, Homo sapiens
tttaaaagatccatttaaa

SEQ ID NO: 4769899 - DNA, 18 bp, Homo sapiens
tttaaaagcatatataaa

SEQ ID NO: 4769900 - DNA, 20 bp, Homo sapiens
tttaaaagccctttccaaag

SEQ ID NO: 4769901 - DNA, 20 bp, Homo sapiens
tttaaaatctcctaaatgct

SEQ ID NO: 4769902 - DNA, 23 bp, Homo sapiens
tttaaaattattaaaaattatag

SEQ ID NO: 4769903 - DNA, 18 bp, Homo sapiens
tttaaacaaaatttatgt

SEQ ID NO: 4769904 - DNA, 13 bp, Homo sapiens
tttaaacaaatgg

SEQ ID NO: 4769905 - DNA, 18 bp, Homo sapiens
tttaaacaacgatttctc

SEQ ID NO: 4769906 - DNA, 18 bp, Homo sapiens
tttaaacttcttaactgg

SEQ ID NO: 4769907 - DNA, 21 bp, Homo sapiens
tttaaagggagccatgctctt

SEQ ID NO: 4769908 - DNA, 17 bp, Homo sapiens
tttaaatctttgttaaa

SEQ ID NO: 4769909 - DNA, 20 bp, Homo sapiens
tttaaatctttgttaaaata

SEQ ID NO: 4769910 - DNA, 12 bp, Homo sapiens
tttaaattatat

SEQ ID NO: 4769911 - DNA, 14 bp, Homo sapiens
tttaaattatatga

SEQ ID NO: 4769912 - DNA, 16 bp, Homo sapiens
tttaaattatatgata

SEQ ID NO: 4769913 - DNA, 15 bp, Homo sapiens
tttaaattgtggatg

SEQ ID NO: 4769914 - DNA, 18 bp, Homo sapiens
tttaacagaaaaatgaaa

SEQ ID NO: 4769915 - DNA, 22 bp, Homo sapiens
tttaacagaaaaatgaaattta

SEQ ID NO: 4769916 - DNA, 11 bp, Homo sapiens
tttaacatagc

SEQ ID NO: 4769917 - DNA, 23 bp, Homo sapiens
tttaacattcttggtcacaaagc

SEQ ID NO: 4769918 - DNA, 16 bp, Homo sapiens
tttaacccaaaagatt

SEQ ID NO: 4769919 - DNA, 15 bp, Homo sapiens
tttaacgtgaggttt

SEQ ID NO: 4769920 - DNA, 21 bp, Homo sapiens
tttaccgcccacccagcagcg

SEQ ID NO: 4769921 - DNA, 13 bp, Homo sapiens
tttactaacagta

SEQ ID NO: 4769922 - DNA, 16 bp, Homo sapiens
tttactaacagtaact

SEQ ID NO: 4769923 - DNA, 16 bp, Homo sapiens
tttactatgcctgttg

SEQ ID NO: 4769924 - DNA, 20 bp, Homo sapiens
tttactatgcctgttgatct

SEQ ID NO: 4769925 - DNA, 14 bp, Homo sapiens
tttactcaggcttt

SEQ ID NO: 4769926 - DNA, 18 bp, Homo sapiens
tttacttgattaaggact

SEQ ID NO: 4769927 - DNA, 17 bp, Homo sapiens
tttagaaataaacctta

SEQ ID NO: 4769928 - DNA, 15 bp, Homo sapiens
tttagaaattctata

SEQ ID NO: 4769929 - DNA, 19 bp, Homo sapiens
tttagaatattaaaaatta

SEQ ID NO: 4769930 - DNA, 18 bp, Homo sapiens
tttagaatgacaggaacc

SEQ ID NO: 4769931 - DNA, 23 bp, Homo sapiens
tttagagtatgcaagaagaatat

SEQ ID NO: 4769932 - DNA, 15 bp, Homo sapiens
tttagcacagtattt

SEQ ID NO: 4769933 - DNA, 15 bp, Homo sapiens
tttaggaatgctcaa

SEQ ID NO: 4769934 - DNA, 21 bp, Homo sapiens
tttaggcttctatgtccaaca

SEQ ID NO: 4769935 - DNA, 19 bp, Homo sapiens
tttagtaaaattatctgtt

SEQ ID NO: 4769936 - DNA, 21 bp, Homo sapiens
tttagtaaaattatctgttct

SEQ ID NO: 4769937 - DNA, 17 bp, Homo sapiens
tttagtctttagctatt

SEQ ID NO: 4769938 - DNA, 14 bp, Homo sapiens
tttataaatggagg

SEQ ID NO: 4769939 - DNA, 20 bp, Homo sapiens
tttataaatggaggtacagg

SEQ ID NO: 4769940 - DNA, 13 bp, Homo sapiens
tttataaattaaa

SEQ ID NO: 4769941 - DNA, 16 bp, Homo sapiens
tttataaattaaatat

SEQ ID NO: 4769942 - DNA, 15 bp, Homo sapiens
tttataacattgtaa

SEQ ID NO: 4769943 - DNA, 13 bp, Homo sapiens
tttataaggtctg

SEQ ID NO: 4769944 - DNA, 12 bp, Homo sapiens
tttataatggct

SEQ ID NO: 4769945 - DNA, 17 bp, Homo sapiens
tttatagtgtgttgtgc

SEQ ID NO: 4769946 - DNA, 15 bp, Homo sapiens
tttatataataaagt

SEQ ID NO: 4769947 - DNA, 14 bp, Homo sapiens
tttatatgattaaa

SEQ ID NO: 4769948 - DNA, 15 bp, Homo sapiens
tttatcatgtgtttc

SEQ ID NO: 4769949 - DNA, 20 bp, Homo sapiens
tttatcttccatatgctctt

SEQ ID NO: 4769950 - DNA, 17 bp, Homo sapiens
tttatgactaatcctta

SEQ ID NO: 4769951 - DNA, 18 bp, Homo sapiens
tttatgactaatccttaa

SEQ ID NO: 4769952 - DNA, 20 bp, Homo sapiens
tttatgactaatccttaata

SEQ ID NO: 4769953 - DNA, 23 bp, Homo sapiens
tttatgatgttattttgtacgtg

SEQ ID NO: 4769954 - DNA, 19 bp, Homo sapiens
tttatgatttactcattat

SEQ ID NO: 4769955 - DNA, 12 bp, Homo sapiens
tttatgatttca

SEQ ID NO: 4769956 - DNA, 21 bp, Homo sapiens
tttatgcatgagaactaaata

SEQ ID NO: 4769957 - DNA, 19 bp, Homo sapiens
tttatggtattttcgtgca

SEQ ID NO: 4769958 - DNA, 18 bp, Homo sapiens
tttattaaacttcagcaa

SEQ ID NO: 4769959 - DNA, 12 bp, Homo sapiens
tttattaaatgt

SEQ ID NO: 4769960 - DNA, 16 bp, Homo sapiens
tttattcattagctgt

SEQ ID NO: 4769961 - DNA, 14 bp, Homo sapiens
tttattgctttata

SEQ ID NO: 4769962 - DNA, 14 bp, Homo sapiens
tttattgtcaaagt

SEQ ID NO: 4769963 - DNA, 14 bp, Homo sapiens
tttatttcaatgta

SEQ ID NO: 4769964 - DNA, 15 bp, Homo sapiens
tttatttcaatgtaa

SEQ ID NO: 4769965 - DNA, 13 bp, Homo sapiens
tttatttccatat

SEQ ID NO: 4769966 - DNA, 11 bp, Homo sapiens
tttattttata

SEQ ID NO: 4769967 - DNA, 16 bp, Homo sapiens
tttatttttgctctcc

SEQ ID NO: 4769968 - DNA, 18 bp, Homo sapiens
tttcaaaataaaatatca

SEQ ID NO: 4769969 - DNA, 16 bp, Homo sapiens
tttcaaagaaaacaga

SEQ ID NO: 4769970 - DNA, 20 bp, Homo sapiens
tttcaaagaaaacagaccag

SEQ ID NO: 4769971 - DNA, 16 bp, Homo sapiens
tttcaaagtgcacaca

SEQ ID NO: 4769972 - DNA, 18 bp, Homo sapiens
tttcaaagtgcacacaca

SEQ ID NO: 4769973 - DNA, 14 bp, Homo sapiens
tttcaaccacacct

SEQ ID NO: 4769974 - DNA, 12 bp, Homo sapiens
tttcaatgattg

SEQ ID NO: 4769975 - DNA, 13 bp, Homo sapiens
tttcaatgcaatg

SEQ ID NO: 4769976 - DNA, 17 bp, Homo sapiens
tttcaatgcaatgcatc

SEQ ID NO: 4769977 - DNA, 18 bp, Homo sapiens
tttcaatgcaatgcatct

SEQ ID NO: 4769978 - DNA, 15 bp, Homo sapiens
tttcaatgtaattaa

SEQ ID NO: 4769979 - DNA, 20 bp, Homo sapiens
tttcaatgtaattaaactgt

SEQ ID NO: 4769980 - DNA, 14 bp, Homo sapiens
tttcacacaactgt

SEQ ID NO: 4769981 - DNA, 15 bp, Homo sapiens
tttcacatctgtata

SEQ ID NO: 4769982 - DNA, 18 bp, Homo sapiens
tttcacattcctgaccct

SEQ ID NO: 4769983 - DNA, 21 bp, Homo sapiens
tttcaccctgccaccctctgc

SEQ ID NO: 4769984 - DNA, 20 bp, Homo sapiens
tttcactataatgtgaaatg

SEQ ID NO: 4769985 - DNA, 11 bp, Homo sapiens
tttcacttcct

SEQ ID NO: 4769986 - DNA, 19 bp, Homo sapiens
tttcagaaagggcagcccc

SEQ ID NO: 4769987 - DNA, 18 bp, Homo sapiens
tttcagcattcccaatta

SEQ ID NO: 4769988 - DNA, 22 bp, Homo sapiens
tttcagcattcccaattatcaa

SEQ ID NO: 4769989 - DNA, 16 bp, Homo sapiens
tttcagccaagaattc

SEQ ID NO: 4769990 - DNA, 20 bp, Homo sapiens
tttcaggtgctcaaaatgca

SEQ ID NO: 4769991 - DNA, 15 bp, Homo sapiens
tttcagtagctcctt

SEQ ID NO: 4769992 - DNA, 17 bp, Homo sapiens
tttcatactacatttga

SEQ ID NO: 4769993 - DNA, 20 bp, Homo sapiens
tttcatagataccattttga

SEQ ID NO: 4769994 - DNA, 15 bp, Homo sapiens
tttcatatcatttct

SEQ ID NO: 4769995 - DNA, 18 bp, Homo sapiens
tttcatcaagattaatta

SEQ ID NO: 4769996 - DNA, 21 bp, Homo sapiens
tttcatcaatcattgtacagt

SEQ ID NO: 4769997 - DNA, 21 bp, Homo sapiens
tttcatccagtttgttctccg

SEQ ID NO: 4769998 - DNA, 13 bp, Homo sapiens
tttcatcctcagc

SEQ ID NO: 4769999 - DNA, 23 bp, Homo sapiens
tttcatgaccactgggcctgcta

SEQ ID NO: 4770000 - DNA, 15 bp, Homo sapiens
tttcatgattagaca

SEQ ID NO: 4770001 - DNA, 21 bp, Homo sapiens
tttcatgattagacaatgtgg

SEQ ID NO: 4770002 - DNA, 14 bp, Homo sapiens
tttcatgttctgtg

SEQ ID NO: 4770003 - DNA, 24 bp, Homo sapiens
tttcattcgtgggcctgctgctct

SEQ ID NO: 4770004 - DNA, 22 bp, Homo sapiens
tttcattgagggaaaacataat

SEQ ID NO: 4770005 - DNA, 23 bp, Homo sapiens
tttcattgagggaaaacataata

SEQ ID NO: 4770006 - DNA, 12 bp, Homo sapiens
tttcattgtgtt

SEQ ID NO: 4770007 - DNA, 19 bp, Homo sapiens
tttcatttatgatacaaaa

SEQ ID NO: 4770008 - DNA, 18 bp, Homo sapiens
tttcattttctctcctcg

SEQ ID NO: 4770009 - DNA, 13 bp, Homo sapiens
tttccaaatacat

SEQ ID NO: 4770010 - DNA, 15 bp, Homo sapiens
tttccacatgctctg

SEQ ID NO: 4770011 - DNA, 21 bp, Homo sapiens
tttccagaattgagagatgtt

SEQ ID NO: 4770012 - DNA, 17 bp, Homo sapiens
tttccagcaaaatatat

SEQ ID NO: 4770013 - DNA, 21 bp, Homo sapiens
tttccagtaaggaatgatatt

SEQ ID NO: 4770014 - DNA, 16 bp, Homo sapiens
tttccagttaaggacc

SEQ ID NO: 4770015 - DNA, 21 bp, Homo sapiens
tttccatacgtgcccatttca

SEQ ID NO: 4770016 - DNA, 22 bp, Homo sapiens
tttccatacgtgcccatttcac

SEQ ID NO: 4770017 - DNA, 15 bp, Homo sapiens
tttccatccaaacct

SEQ ID NO: 4770018 - DNA, 19 bp, Homo sapiens
tttccatgactgcatttta

SEQ ID NO: 4770019 - DNA, 20 bp, Homo sapiens
tttccatgactgcattttac

SEQ ID NO: 4770020 - DNA, 17 bp, Homo sapiens
tttccatttggatttta

SEQ ID NO: 4770021 - DNA, 20 bp, Homo sapiens
tttcccacactgtgaactaa

SEQ ID NO: 4770022 - DNA, 23 bp, Homo sapiens
tttccccagaccgatccttccca

SEQ ID NO: 4770023 - DNA, 13 bp, Homo sapiens
tttcccctctcat

SEQ ID NO: 4770024 - DNA, 14 bp, Homo sapiens
tttccctgcatccc

SEQ ID NO: 4770025 - DNA, 16 bp, Homo sapiens
tttcccttcccttcca

SEQ ID NO: 4770026 - DNA, 18 bp, Homo sapiens
tttcccttgtgtgagggc

SEQ ID NO: 4770027 - DNA, 22 bp, Homo sapiens
tccaggggctgcagccccctgc

SEQ ID NO: 4770028 - DNA, 23 bp, Homo sapiens
tccaggggctgcagccccctgct

SEQ ID NO: 4770029 - DNA, 23 bp, Homo sapiens
tccaggggctggggacttcgggg

SEQ ID NO: 4770030 - DNA, 14 bp, Homo sapiens
tccaggggtttaca

SEQ ID NO: 4770031 - DNA, 16 bp, Homo sapiens
tccagggtccagccct

SEQ ID NO: 4770032 - DNA, 15 bp, Homo sapiens
tccaggtcacaggca

SEQ ID NO: 4770033 - DNA, 22 bp, Homo sapiens
tccaggtcacaggcatccgctg

SEQ ID NO: 4770034 - DNA, 13 bp, Homo sapiens
tccagtataaatt

SEQ ID NO: 4770035 - DNA, 19 bp, Homo sapiens
tccagtataaattacatgc

SEQ ID NO: 4770036 - DNA, 20 bp, Homo sapiens
tccagtataaattacatgca

SEQ ID NO: 4770037 - DNA, 17 bp, Homo sapiens
tccagtccccctatcct

SEQ ID NO: 4770038 - DNA, 16 bp, Homo sapiens
tccagtgctgctccct

SEQ ID NO: 4770039 - DNA, 22 bp, Homo sapiens
tccagtgctttatccacattgt

SEQ ID NO: 4770040 - DNA, 22 bp, Homo sapiens
tccagtgtggtcttgtttaata

SEQ ID NO: 4770041 - DNA, 21 bp, Homo sapiens
tccagtgttcccttctggctg

SEQ ID NO: 4770042 - DNA, 22 bp, Homo sapiens
tccagttaaggaccgtggccct

SEQ ID NO: 4770043 - DNA, 14 bp, Homo sapiens
tccagtttgttctc

SEQ ID NO: 4770044 - DNA, 17 bp, Homo sapiens
tccagtttgttctccgg

SEQ ID NO: 4770045 - DNA, 19 bp, Homo sapiens
tccagtttgttctccgggt

SEQ ID NO: 4770046 - DNA, 15 bp, Homo sapiens
tccataccccctgcc

SEQ ID NO: 4770047 - DNA, 16 bp, Homo sapiens
tccataccccctgccc

SEQ ID NO: 4770048 - DNA, 17 bp, Homo sapiens
tccataccccctgcccc

SEQ ID NO: 4770049 - DNA, 19 bp, Homo sapiens
tccataccccctgccccag

SEQ ID NO: 4770050 - DNA, 21 bp, Homo sapiens
tccataccccctgccccagag

SEQ ID NO: 4770051 - DNA, 13 bp, Homo sapiens
tccatagacacag

SEQ ID NO: 4770052 - DNA, 15 bp, Homo sapiens
tccatagacacagta

SEQ ID NO: 4770053 - DNA, 16 bp, Homo sapiens
tccatagacacagtat

SEQ ID NO: 4770054 - DNA, 17 bp, Homo sapiens
tccatagacacagtatt

SEQ ID NO: 4770055 - DNA, 14 bp, Homo sapiens
tccatatcagctct

SEQ ID NO: 4770056 - DNA, 20 bp, Homo sapiens
tccatatcagctctgcataa

SEQ ID NO: 4770057 - DNA, 13 bp, Homo sapiens
tccatcagcttta

SEQ ID NO: 4770058 - DNA, 18 bp, Homo sapiens
tccatccttttgcttcat

SEQ ID NO: 4770059 - DNA, 20 bp, Homo sapiens
tccatccttttgcttcatct

SEQ ID NO: 4770060 - DNA, 17 bp, Homo sapiens
tccatctgtttgataca

SEQ ID NO: 4770061 - DNA, 19 bp, Homo sapiens
tccatgacagtagcatact

SEQ ID NO: 4770062 - DNA, 18 bp, Homo sapiens
tccatgatcaaaatgcat

SEQ ID NO: 4770063 - DNA, 14 bp, Homo sapiens
tccatgcaccaaac

SEQ ID NO: 4770064 - DNA, 12 bp, Homo sapiens
tccatgctgtcc

SEQ ID NO: 4770065 - DNA, 14 bp, Homo sapiens
tccatgctgtccct

SEQ ID NO: 4770066 - DNA, 15 bp, Homo sapiens
tccatgctgtccctg

SEQ ID NO: 4770067 - DNA, 20 bp, Homo sapiens
tccatggaaccatggaggag

SEQ ID NO: 4770068 - DNA, 15 bp, Homo sapiens
tccatggatcttgct

SEQ ID NO: 4770069 - DNA, 16 bp, Homo sapiens
tccatggtgaactgaa

SEQ ID NO: 4770070 - DNA, 17 bp, Homo sapiens
tccatggtgaactgaag

SEQ ID NO: 4770071 - DNA, 22 bp, Homo sapiens
tccatggtgaactgaagcagag

SEQ ID NO: 4770072 - DNA, 23 bp, Homo sapiens
tccatggtgaactgaagcagagt

SEQ ID NO: 4770073 - DNA, 17 bp, Homo sapiens
tccatgtgctgctgtgg

SEQ ID NO: 4770074 - DNA, 13 bp, Homo sapiens
tccatgtgtcccc

SEQ ID NO: 4770075 - DNA, 20 bp, Homo sapiens
tccatgtgtcccccctgtgg

SEQ ID NO: 4770076 - DNA, 15 bp, Homo sapiens
tccattaaacttcta

SEQ ID NO: 4770077 - DNA, 15 bp, Homo sapiens
tccattaatttaaat

SEQ ID NO: 4770078 - DNA, 15 bp, Homo sapiens
tccattcagtctgca

SEQ ID NO: 4770079 - DNA, 14 bp, Homo sapiens
tccattcctgagta

SEQ ID NO: 4770080 - DNA, 20 bp, Homo sapiens
tccatttggattttaaacaa

SEQ ID NO: 4770081 - DNA, 14 bp, Homo sapiens
tccattttggaaaa

SEQ ID NO: 4770082 - DNA, 22 bp, Homo sapiens
tccatttttacaagttatagta

SEQ ID NO: 4770083 - DNA, 16 bp, Homo sapiens
tccatttttgagtaaa

SEQ ID NO: 4770084 - DNA, 21 bp, Homo sapiens
tcccaaaagagggacaacgaa

SEQ ID NO: 4770085 - DNA, 16 bp, Homo sapiens
tcccaaataaactcct

SEQ ID NO: 4770086 - DNA, 17 bp, Homo sapiens
tcccaaataaactcctt

SEQ ID NO: 4770087 - DNA, 14 bp, Homo sapiens
tcccaaatctcaaa

SEQ ID NO: 4770088 - DNA, 22 bp, Homo sapiens
tcccaaattggtgtttctgaat

SEQ ID NO: 4770089 - DNA, 21 bp, Homo sapiens
tcccaacccaggattcaacat

SEQ ID NO: 4770090 - DNA, 14 bp, Homo sapiens
tcccaacctcccct

SEQ ID NO: 4770091 - DNA, 14 bp, Homo sapiens
tcccaactctggcc

SEQ ID NO: 4770092 - DNA, 15 bp, Homo sapiens
tcccaactctggcct

SEQ ID NO: 4770093 - DNA, 21 bp, Homo sapiens
tcccaagcacctgggattaca

SEQ ID NO: 4770094 - DNA, 14 bp, Homo sapiens
tcccaaggcagctg

SEQ ID NO: 4770095 - DNA, 13 bp, Homo sapiens
tcccaatcagcac

SEQ ID NO: 4770096 - DNA, 19 bp, Homo sapiens
tcccaatcagcactgaaaa

SEQ ID NO: 4770097 - DNA, 18 bp, Homo sapiens
tcccaattatcaaaaaac

SEQ ID NO: 4770098 - DNA, 20 bp, Homo sapiens
tcccacccccagcagctcac

SEQ ID NO: 4770099 - DNA, 12 bp, Homo sapiens
tcccacccctat

SEQ ID NO: 4770100 - DNA, 12 bp, Homo sapiens
tcccaccgggag

SEQ ID NO: 4770101 - DNA, 13 bp, Homo sapiens
tcccacctccagt

SEQ ID NO: 4770102 - DNA, 14 bp, Homo sapiens
tcccacctccagtc

SEQ ID NO: 4770103 - DNA, 16 bp, Homo sapiens
tcccacctccctgccc

SEQ ID NO: 4770104 - DNA, 17 bp, Homo sapiens
tcccacctccctgccca

SEQ ID NO: 4770105 - DNA, 19 bp, Homo sapiens
tcccacctccctgcccagg

SEQ ID NO: 4770106 - DNA, 12 bp, Homo sapiens
tcccacctcttt

SEQ ID NO: 4770107 - DNA, 19 bp, Homo sapiens
tcccactgcccctgcacct

SEQ ID NO: 4770108 - DNA, 15 bp, Homo sapiens
tcccacttccccatc

SEQ ID NO: 4770109 - DNA, 21 bp, Homo sapiens
tcccacttccccatctgtgtg

SEQ ID NO: 4770110 - DNA, 17 bp, Homo sapiens
tcccagagttatttccc

SEQ ID NO: 4770111 - DNA, 22 bp, Homo sapiens
tcccagccacccggatctccag

SEQ ID NO: 4770112 - DNA, 18 bp, Homo sapiens
tcccagccctgcccagag

SEQ ID NO: 4770113 - DNA, 17 bp, Homo sapiens
tcccagctgctcctaga

SEQ ID NO: 4770114 - DNA, 21 bp, Homo sapiens
tcccagctggcagcgcctccc

SEQ ID NO: 4770115 - DNA, 22 bp, Homo sapiens
tcccagctgtaccggccactgc

SEQ ID NO: 4770116 - DNA, 23 bp, Homo sapiens
tcccagctgtaccggccactgca

SEQ ID NO: 4770117 - DNA, 20 bp, Homo sapiens
tcccaggaccctgggtcacc

SEQ ID NO: 4770118 - DNA, 21 bp, Homo sapiens
tcccaggaccctgggtcacct

SEQ ID NO: 4770119 - DNA, 22 bp, Homo sapiens
tcccagggcccgagcgcgtgcc

SEQ ID NO: 4770120 - DNA, 23 bp, Homo sapiens
tcccagggcccgagcgcgtgcct

SEQ ID NO: 4770121 - DNA, 14 bp, Homo sapiens
tcccagtgtctggc

SEQ ID NO: 4770122 - DNA, 17 bp, Homo sapiens
tcccagtgtctggccca

SEQ ID NO: 4770123 - DNA, 21 bp, Homo sapiens
tcccagtgtctggcccagcca

SEQ ID NO: 4770124 - DNA, 18 bp, Homo sapiens
tcccatgatttggggtga

SEQ ID NO: 4770125 - DNA, 13 bp, Homo sapiens
tcccatgcaggct

SEQ ID NO: 4770126 - DNA, 18 bp, Homo sapiens
tcccatgcataacacact

SEQ ID NO: 4770127 - DNA, 18 bp, Homo sapiens
tcccatttccttgtctaa

SEQ ID NO: 4770128 - DNA, 17 bp, Homo sapiens
tcccatttgtaatgtat

SEQ ID NO: 4770129 - DNA, 15 bp, Homo sapiens
tccccaccctcccct

SEQ ID NO: 4770130 - DNA, 22 bp, Homo sapiens
tccccaccctcccctctcctga

SEQ ID NO: 4770131 - DNA, 13 bp, Homo sapiens
tccccactcccgt

SEQ ID NO: 4770132 - DNA, 14 bp, Homo sapiens
tccccactgaagaa

SEQ ID NO: 4770133 - DNA, 21 bp, Homo sapiens
tccccagttaatgtgccaaaa

SEQ ID NO: 4770134 - DNA, 16 bp, Homo sapiens
aaaagcacctcttgaa

SEQ ID NO: 4770135 - DNA, 19 bp, Homo sapiens
aaaagcatatataaaacaa

SEQ ID NO: 4770136 - DNA, 17 bp, Homo sapiens
aaaagccaagtgtcctg

SEQ ID NO: 4770137 - DNA, 14 bp, Homo sapiens
aaaagccctcttca

SEQ ID NO: 4770138 - DNA, 19 bp, Homo sapiens
aaaagcggggttcaatgct

SEQ ID NO: 4770139 - DNA, 19 bp, Homo sapiens
aaaagctatcttcatgtaa

SEQ ID NO: 4770140 - DNA, 20 bp, Homo sapiens
aaaaggctgcagctaatttg

SEQ ID NO: 4770141 - DNA, 16 bp, Homo sapiens
aaaagggcattttgta

SEQ ID NO: 4770142 - DNA, 20 bp, Homo sapiens
aaaaggttcttcatcccttt

SEQ ID NO: 4770143 - DNA, 19 bp, Homo sapiens
aaaagtctcaatgttccat

SEQ ID NO: 4770144 - DNA, 15 bp, Homo sapiens
aaaagtgatgtgatt

SEQ ID NO: 4770145 - DNA, 16 bp, Homo sapiens
aaaagtgcagtagtgt

SEQ ID NO: 4770146 - DNA, 18 bp, Homo sapiens
aaaataaaaacataaaat

SEQ ID NO: 4770147 - DNA, 22 bp, Homo sapiens
aaaataataaaagaatcatttg

SEQ ID NO: 4770148 - DNA, 15 bp, Homo sapiens
aaaataatataaatg

SEQ ID NO: 4770149 - DNA, 16 bp, Homo sapiens
aaaatacagtattatt

SEQ ID NO: 4770150 - DNA, 20 bp, Homo sapiens
aaaatacagtattatttagt

SEQ ID NO: 4770151 - DNA, 14 bp, Homo sapiens
aaaatacatactat

SEQ ID NO: 4770152 - DNA, 22 bp, Homo sapiens
aaaatactgactccaaccattc

SEQ ID NO: 4770153 - DNA, 15 bp, Homo sapiens
aaaatagctataaat

SEQ ID NO: 4770154 - DNA, 21 bp, Homo sapiens
aaaatagtcatgtttctgcag

SEQ ID NO: 4770155 - DNA, 11 bp, Homo sapiens
aaaatatatgt

SEQ ID NO: 4770156 - DNA, 21 bp, Homo sapiens
aaaatatccaagcccagccta

SEQ ID NO: 4770157 - DNA, 13 bp, Homo sapiens
aaaatatgtgtac

SEQ ID NO: 4770158 - DNA, 21 bp, Homo sapiens
aaaatattgagcagaattcat

SEQ ID NO: 4770159 - DNA, 18 bp, Homo sapiens
aaaatattgtttaatgca

SEQ ID NO: 4770160 - DNA, 16 bp, Homo sapiens
aaaatattttcttaat

SEQ ID NO: 4770161 - DNA, 15 bp, Homo sapiens
aaaatcacaaactca

SEQ ID NO: 4770162 - DNA, 20 bp, Homo sapiens
aaaatcatcaaagtgtttaa

SEQ ID NO: 4770163 - DNA, 19 bp, Homo sapiens
aaaatcccatttatgcaat

SEQ ID NO: 4770164 - DNA, 14 bp, Homo sapiens
aaaatccttcagca

SEQ ID NO: 4770165 - DNA, 15 bp, Homo sapiens
aaaatccttcagcaa

SEQ ID NO: 4770166 - DNA, 18 bp, Homo sapiens
aaaatccttgccttcaaa

SEQ ID NO: 4770167 - DNA, 14 bp, Homo sapiens
aaaatctcctaaat

SEQ ID NO: 4770168 - DNA, 14 bp, Homo sapiens
aaaatctgaatttc

SEQ ID NO: 4770169 - DNA, 20 bp, Homo sapiens
aaaatgaaatttaagcacaa

SEQ ID NO: 4770170 - DNA, 12 bp, Homo sapiens
aaaatgaagaca

SEQ ID NO: 4770171 - DNA, 23 bp, Homo sapiens
aaaatgaagacaccagagtgtat

SEQ ID NO: 4770172 - DNA, 17 bp, Homo sapiens
aaaatgagaatctgtgc

SEQ ID NO: 4770173 - DNA, 12 bp, Homo sapiens
aaaatgcaaata

SEQ ID NO: 4770174 - DNA, 15 bp, Homo sapiens
aaaatgcttgaccct

SEQ ID NO: 4770175 - DNA, 12 bp, Homo sapiens
aaaatgctttct

SEQ ID NO: 4770176 - DNA, 17 bp, Homo sapiens
aaaatgctttctcatgc

SEQ ID NO: 4770177 - DNA, 19 bp, Homo sapiens
aaaatgctttctcatgcat

SEQ ID NO: 4770178 - DNA, 18 bp, Homo sapiens
aaaatggatgacaaagaa

SEQ ID NO: 4770179 - DNA, 15 bp, Homo sapiens
aaaatggcatttagc

SEQ ID NO: 4770180 - DNA, 18 bp, Homo sapiens
aaaatggcatttagcaca

SEQ ID NO: 4770181 - DNA, 19 bp, Homo sapiens
aaaatggcatttagcacag

SEQ ID NO: 4770182 - DNA, 14 bp, Homo sapiens
aaaatggctgaaga

SEQ ID NO: 4770183 - DNA, 21 bp, Homo sapiens
aaaatggctgaagaaacacag

SEQ ID NO: 4770184 - DNA, 17 bp, Homo sapiens
aaaatggtgttttcatg

SEQ ID NO: 4770185 - DNA, 12 bp, Homo sapiens
aaaatgtatgtt

SEQ ID NO: 4770186 - DNA, 12 bp, Homo sapiens
aaaatgttcatt

SEQ ID NO: 4770187 - DNA, 19 bp, Homo sapiens
aaaatgttcattctatgac

SEQ ID NO: 4770188 - DNA, 22 bp, Homo sapiens
aaaattagtgagatttgtattt

SEQ ID NO: 4770189 - DNA, 13 bp, Homo sapiens
aaaattatactgt

SEQ ID NO: 4770190 - DNA, 15 bp, Homo sapiens
aaaattatactgtgt

SEQ ID NO: 4770191 - DNA, 18 bp, Homo sapiens
aaaattatactgtgtgtg

SEQ ID NO: 4770192 - DNA, 22 bp, Homo sapiens
aaaattatctttaaaacttact

SEQ ID NO: 4770193 - DNA, 20 bp, Homo sapiens
aaaattattaaaaattatag

SEQ ID NO: 4770194 - DNA, 21 bp, Homo sapiens
aaaattattaaaaattataga

SEQ ID NO: 4770195 - DNA, 18 bp, Homo sapiens
aaaattcattccatttgc

SEQ ID NO: 4770196 - DNA, 11 bp, Homo sapiens
aaaattcttgt

SEQ ID NO: 4770197 - DNA, 22 bp, Homo sapiens
aaaattgaagagagatatatct

SEQ ID NO: 4770198 - DNA, 15 bp, Homo sapiens
aaaatttatgtcatt

SEQ ID NO: 4770199 - DNA, 13 bp, Homo sapiens
aaaatttgacatt

SEQ ID NO: 4770200 - DNA, 15 bp, Homo sapiens
aaaattttcttcttt

SEQ ID NO: 4770201 - DNA, 17 bp, Homo sapiens
aaacaaaaactttccat

SEQ ID NO: 4770202 - DNA, 21 bp, Homo sapiens
aaacaaaaactttccatgaca

SEQ ID NO: 4770203 - DNA, 15 bp, Homo sapiens
aaacaaaatataaat

SEQ ID NO: 4770204 - DNA, 13 bp, Homo sapiens
aaacaaaatttat

SEQ ID NO: 4770205 - DNA, 14 bp, Homo sapiens
aaacaaacaacctg

SEQ ID NO: 4770206 - DNA, 13 bp, Homo sapiens
aaacaaatatact

SEQ ID NO: 4770207 - DNA, 14 bp, Homo sapiens
aaacaaatcatttt

SEQ ID NO: 4770208 - DNA, 18 bp, Homo sapiens
aaacaaatcattttgatg

SEQ ID NO: 4770209 - DNA, 12 bp, Homo sapiens
aaacaacagcaa

SEQ ID NO: 4770210 - DNA, 19 bp, Homo sapiens
aaacaacagtcttcatttt

SEQ ID NO: 4770211 - DNA, 23 bp, Homo sapiens
aaacaagagaccacttccttaac

SEQ ID NO: 4770212 - DNA, 13 bp, Homo sapiens
aaacaagctgata

SEQ ID NO: 4770213 - DNA, 17 bp, Homo sapiens
aaacaatttattttatt

SEQ ID NO: 4770214 - DNA, 19 bp, Homo sapiens
aaacacacaggccatttca

SEQ ID NO: 4770215 - DNA, 14 bp, Homo sapiens
aaacacatagattc

SEQ ID NO: 4770216 - DNA, 19 bp, Homo sapiens
aaacacatagattcacctg

SEQ ID NO: 4770217 - DNA, 21 bp, Homo sapiens
aaacacggagtttccatttgg

SEQ ID NO: 4770218 - DNA, 23 bp, Homo sapiens
aaacacggagtttccatttggat

SEQ ID NO: 4770219 - DNA, 23 bp, Homo sapiens
aaacactaatggccaagtgtaca

SEQ ID NO: 4770220 - DNA, 13 bp, Homo sapiens
aaacactattctc

SEQ ID NO: 4770221 - DNA, 17 bp, Homo sapiens
aaacactcgtgtgcatg

SEQ ID NO: 4770222 - DNA, 19 bp, Homo sapiens
aaacactcgtgtgcatgag

SEQ ID NO: 4770223 - DNA, 22 bp, Homo sapiens
aaacactcgtgtgcatgagaat

SEQ ID NO: 4770224 - DNA, 19 bp, Homo sapiens
aaacactgcttaaggaaaa

SEQ ID NO: 4770225 - DNA, 18 bp, Homo sapiens
aaacacttctccttaacc

SEQ ID NO: 4770226 - DNA, 21 bp, Homo sapiens
aaacactttgaggacatttat

SEQ ID NO: 4770227 - DNA, 15 bp, Homo sapiens
aaacaggaaaaaaac

SEQ ID NO: 4770228 - DNA, 20 bp, Homo sapiens
aaacagggacactacaaaca

SEQ ID NO: 4770229 - DNA, 14 bp, Homo sapiens
aaacagtttaacag

SEQ ID NO: 4770230 - DNA, 21 bp, Homo sapiens
aaacatagtggtattttaaca

SEQ ID NO: 4770231 - DNA, 17 bp, Homo sapiens
aaacatctgatttctga

SEQ ID NO: 4770232 - DNA, 18 bp, Homo sapiens
aaacatctgatttctgaa

SEQ ID NO: 4770233 - DNA, 16 bp, Homo sapiens
aaacatgtgaaagata

SEQ ID NO: 4770234 - DNA, 20 bp, Homo sapiens
aaacattatagattttcatg

SEQ ID NO: 4770235 - DNA, 20 bp, Homo sapiens
aaacatttctttttccttct

SEQ ID NO: 4770236 - DNA, 18 bp, Homo sapiens
aaacattttttgtttctt

SEQ ID NO: 4770237 - DNA, 17 bp, Homo sapiens
aaaccagaaagaggaat

SEQ ID NO: 4770238 - DNA, 20 bp, Homo sapiens
aaaccagaaagaggaataaa

SEQ ID NO: 4770239 - DNA, 14 bp, Homo sapiens
aaaccatctggcct

SEQ ID NO: 4770240 - DNA, 15 bp, Homo sapiens
aaaccatctggcctg

SEQ ID NO: 4770241 - DNA, 21 bp, Homo sapiens
aaaccatgaaaagttttcaag

SEQ ID NO: 4770242 - DNA, 12 bp, Homo sapiens
aaaccattgctt

SEQ ID NO: 4770243 - DNA, 15 bp, Homo sapiens
aaaccattgcttcac

SEQ ID NO: 4770244 - DNA, 23 bp, Homo sapiens
aaacccaaataaatgtgtaaatg

SEQ ID NO: 4770245 - DNA, 16 bp, Homo sapiens
aaacccacataaacac

SEQ ID NO: 4770246 - DNA, 19 bp, Homo sapiens
aaacccacataaacacttc

SEQ ID NO: 4770247 - DNA, 12 bp, Homo sapiens
aaacccctgaca

SEQ ID NO: 4770248 - DNA, 22 bp, Homo sapiens
aaaccctgctaaatgacttatt

SEQ ID NO: 4770249 - DNA, 16 bp, Homo sapiens
aaacccttgactgtta

SEQ ID NO: 4770250 - DNA, 21 bp, Homo sapiens
aaacccttgactgttatctcg

SEQ ID NO: 4770251 - DNA, 15 bp, Homo sapiens
aaacctatctgtatt

SEQ ID NO: 4770252 - DNA, 17 bp, Homo sapiens
aaacctatctgtattgg

SEQ ID NO: 4770253 - DNA, 20 bp, Homo sapiens
aaacctatctgtattggcag

SEQ ID NO: 4770254 - DNA, 19 bp, Homo sapiens
aaacctcagttggcctctg

SEQ ID NO: 4770255 - DNA, 20 bp, Homo sapiens
aaacctcagttggcctctgc

SEQ ID NO: 4770256 - DNA, 16 bp, Homo sapiens
aaattaacttctattt

SEQ ID NO: 4770257 - DNA, 17 bp, Homo sapiens
aaattaacttctatttt

SEQ ID NO: 4770258 - DNA, 20 bp, Homo sapiens
aaattaacttctattttcaa

SEQ ID NO: 4770259 - DNA, 13 bp, Homo sapiens
aaattaattcttt

SEQ ID NO: 4770260 - DNA, 22 bp, Homo sapiens
aaattaattctttatcacatgt

SEQ ID NO: 4770261 - DNA, 13 bp, Homo sapiens
aaattacatgcat

SEQ ID NO: 4770262 - DNA, 23 bp, Homo sapiens
aaattagggctctaatttcctta

SEQ ID NO: 4770263 - DNA, 20 bp, Homo sapiens
aaattagtattttgagcctt

SEQ ID NO: 4770264 - DNA, 13 bp, Homo sapiens
aaattagtgagat

SEQ ID NO: 4770265 - DNA, 16 bp, Homo sapiens
aaattagtgttttcat

SEQ ID NO: 4770266 - DNA, 17 bp, Homo sapiens
aaattagtgttttcatt

SEQ ID NO: 4770267 - DNA, 20 bp, Homo sapiens
aaattatatgatatgcatgt

SEQ ID NO: 4770268 - DNA, 17 bp, Homo sapiens
aaattatctttaaaact

SEQ ID NO: 4770269 - DNA, 18 bp, Homo sapiens
aaattatgtcaaatggat

SEQ ID NO: 4770270 - DNA, 19 bp, Homo sapiens
aaattattaaaaattatag

SEQ ID NO: 4770271 - DNA, 18 bp, Homo sapiens
aaattattactttaaatt

SEQ ID NO: 4770272 - DNA, 16 bp, Homo sapiens
aaattcacaaagttaa

SEQ ID NO: 4770273 - DNA, 14 bp, Homo sapiens
aaattcacactgtg

SEQ ID NO: 4770274 - DNA, 22 bp, Homo sapiens
aaattcagtggacatttgttct

SEQ ID NO: 4770275 - DNA, 14 bp, Homo sapiens
aaattcatgctgct

SEQ ID NO: 4770276 - DNA, 19 bp, Homo sapiens
aaattcccaacctgctcat

SEQ ID NO: 4770277 - DNA, 13 bp, Homo sapiens
aaattcctgttgt

SEQ ID NO: 4770278 - DNA, 17 bp, Homo sapiens
aaattctataagagaca

SEQ ID NO: 4770279 - DNA, 12 bp, Homo sapiens
aaattctgatta

SEQ ID NO: 4770280 - DNA, 15 bp, Homo sapiens
aaattcttgcactgt

SEQ ID NO: 4770281 - DNA, 21 bp, Homo sapiens
aaattgaagagagatatatct

SEQ ID NO: 4770282 - DNA, 17 bp, Homo sapiens
aaattgcagcagttgct

SEQ ID NO: 4770283 - DNA, 22 bp, Homo sapiens
aaattggttaatgaaaaatctg

SEQ ID NO: 4770284 - DNA, 18 bp, Homo sapiens
aaattgtcttttgtcatg

SEQ ID NO: 4770285 - DNA, 13 bp, Homo sapiens
aaattgtgccaaa

SEQ ID NO: 4770286 - DNA, 14 bp, Homo sapiens
aaattgtgccaaag

SEQ ID NO: 4770287 - DNA, 13 bp, Homo sapiens
aaattgtggatga

SEQ ID NO: 4770288 - DNA, 19 bp, Homo sapiens
aaattgtttggcttcctcc

SEQ ID NO: 4770289 - DNA, 12 bp, Homo sapiens
aaatttaagcac

SEQ ID NO: 4770290 - DNA, 13 bp, Homo sapiens
aaatttaagcaca

SEQ ID NO: 4770291 - DNA, 18 bp, Homo sapiens
aaatttatgtcattttca

SEQ ID NO: 4770292 - DNA, 16 bp, Homo sapiens
aaatttattaaatgtt

SEQ ID NO: 4770293 - DNA, 21 bp, Homo sapiens
aaatttattcttatcttagga

SEQ ID NO: 4770294 - DNA, 19 bp, Homo sapiens
aaatttatttccaatgttt

SEQ ID NO: 4770295 - DNA, 23 bp, Homo sapiens
aaatttgacattgtcagaatgtt

SEQ ID NO: 4770296 - DNA, 19 bp, Homo sapiens
aaattttattgaatataat

SEQ ID NO: 4770297 - DNA, 22 bp, Homo sapiens
aaattttctagaatactaataa

SEQ ID NO: 4770298 - DNA, 22 bp, Homo sapiens
aaattttctgtacagtttgtga

SEQ ID NO: 4770299 - DNA, 23 bp, Homo sapiens
aaattttcttctttaatttttct

SEQ ID NO: 4770300 - DNA, 14 bp, Homo sapiens
aaatttttactcag

SEQ ID NO: 4770301 - DNA, 20 bp, Homo sapiens
aaatttttctgggaagaaaa

SEQ ID NO: 4770302 - DNA, 19 bp, Homo sapiens
aaatttttttccagaattg

SEQ ID NO: 4770303 - DNA, 22 bp, Homo sapiens
aacaaaaaaaagaaagaaaaaa

SEQ ID NO: 4770304 - DNA, 18 bp, Homo sapiens
aacaaaaactttccatga

SEQ ID NO: 4770305 - DNA, 14 bp, Homo sapiens
aacaaagaaatatt

SEQ ID NO: 4770306 - DNA, 14 bp, Homo sapiens
aacaaagcatgctc

SEQ ID NO: 4770307 - DNA, 16 bp, Homo sapiens
aacaaatatactcatt

SEQ ID NO: 4770308 - DNA, 23 bp, Homo sapiens
aacaaatatgattctcctctccc

SEQ ID NO: 4770309 - DNA, 14 bp, Homo sapiens
aacaaatggcttgt

SEQ ID NO: 4770310 - DNA, 18 bp, Homo sapiens
aacaacaaagcatgctca

SEQ ID NO: 4770311 - DNA, 19 bp, Homo sapiens
aacaacagtcagccagctt

SEQ ID NO: 4770312 - DNA, 24 bp, Homo sapiens
aacaacctgccacaatgtgatatg

SEQ ID NO: 4770313 - DNA, 14 bp, Homo sapiens
aacaacttactaaa

SEQ ID NO: 4770314 - DNA, 18 bp, Homo sapiens
aacaaggcaaggctgtca

SEQ ID NO: 4770315 - DNA, 14 bp, Homo sapiens
aacaagtacatctg

SEQ ID NO: 4770316 - DNA, 17 bp, Homo sapiens
aacaatgcctattgtaa

SEQ ID NO: 4770317 - DNA, 23 bp, Homo sapiens
aacaatgcctattgtaatataga

SEQ ID NO: 4770318 - DNA, 17 bp, Homo sapiens
aacaatgccttgttgta

SEQ ID NO: 4770319 - DNA, 20 bp, Homo sapiens
aacaatggtaacatttttca

SEQ ID NO: 4770320 - DNA, 19 bp, Homo sapiens
aacacaagactgtcattag

SEQ ID NO: 4770321 - DNA, 17 bp, Homo sapiens
aacacacagactctgtg

SEQ ID NO: 4770322 - DNA, 18 bp, Homo sapiens
aacacacagtgaccaagg

SEQ ID NO: 4770323 - DNA, 21 bp, Homo sapiens
aacacacagtgaccaagggaa

SEQ ID NO: 4770324 - DNA, 20 bp, Homo sapiens
aacacagtaagataggttct

SEQ ID NO: 4770325 - DNA, 20 bp, Homo sapiens
aacacatagattcacctgta

SEQ ID NO: 4770326 - DNA, 23 bp, Homo sapiens
aacaccaagtaaatctatctcta

SEQ ID NO: 4770327 - DNA, 22 bp, Homo sapiens
aacacggagtttccatttggat

SEQ ID NO: 4770328 - DNA, 16 bp, Homo sapiens
aacactaatggccaag

SEQ ID NO: 4770329 - DNA, 12 bp, Homo sapiens
aacactgccaaa

SEQ ID NO: 4770330 - DNA, 22 bp, Homo sapiens
aacagacctcactgctttgtag

SEQ ID NO: 4770331 - DNA, 19 bp, Homo sapiens
aacagactgccttatatta

SEQ ID NO: 4770332 - DNA, 16 bp, Homo sapiens
aacagagactggaggc

SEQ ID NO: 4770333 - DNA, 14 bp, Homo sapiens
aacagagtatatat

SEQ ID NO: 4770334 - DNA, 15 bp, Homo sapiens
aacagagtatatatg

SEQ ID NO: 4770335 - DNA, 21 bp, Homo sapiens
aacagagtatatatgtacagt

SEQ ID NO: 4770336 - DNA, 21 bp, Homo sapiens
aacagatcacatgcccctctt

SEQ ID NO: 4770337 - DNA, 15 bp, Homo sapiens
aacagatttgttcat

SEQ ID NO: 4770338 - DNA, 16 bp, Homo sapiens
aacagatttgttcatt

SEQ ID NO: 4770339 - DNA, 22 bp, Homo sapiens
aacagcacagtcttttcctacg

SEQ ID NO: 4770340 - DNA, 15 bp, Homo sapiens
aacagcaggttgtgt

SEQ ID NO: 4770341 - DNA, 13 bp, Homo sapiens
aacagctgtatta

SEQ ID NO: 4770342 - DNA, 14 bp, Homo sapiens
aacaggaccaggag

SEQ ID NO: 4770343 - DNA, 21 bp, Homo sapiens
aacaggctgttctgcactgaa

SEQ ID NO: 4770344 - DNA, 23 bp, Homo sapiens
aacaggctgttctgcactgaaaa

SEQ ID NO: 4770345 - DNA, 10 bp, Homo sapiens
aacagtaaat

SEQ ID NO: 4770346 - DNA, 13 bp, Homo sapiens
aacagtaaatata

SEQ ID NO: 4770347 - DNA, 12 bp, Homo sapiens
aacagtaactgc

SEQ ID NO: 4770348 - DNA, 14 bp, Homo sapiens
aacagtaatcagtt

SEQ ID NO: 4770349 - DNA, 12 bp, Homo sapiens
aacagtatttcc

SEQ ID NO: 4770350 - DNA, 13 bp, Homo sapiens
aacagtatttcca

SEQ ID NO: 4770351 - DNA, 22 bp, Homo sapiens
aacagtgtggcttaaacatttt

SEQ ID NO: 4770352 - DNA, 14 bp, Homo sapiens
aacagtgtttccag

SEQ ID NO: 4770353 - DNA, 21 bp, Homo sapiens
aacagttaagacaacaggcat

SEQ ID NO: 4770354 - DNA, 17 bp, Homo sapiens
aacataaacttgtactt

SEQ ID NO: 4770355 - DNA, 16 bp, Homo sapiens
aacataagctagaaaa

SEQ ID NO: 4770356 - DNA, 21 bp, Homo sapiens
aacataatgatactgaattgt

SEQ ID NO: 4770357 - DNA, 15 bp, Homo sapiens
aacatactttctaaa

SEQ ID NO: 4770358 - DNA, 18 bp, Homo sapiens
aacatctcatcatgtcta

SEQ ID NO: 4770359 - DNA, 14 bp, Homo sapiens
aacatctgatttct

SEQ ID NO: 4770360 - DNA, 21 bp, Homo sapiens
aacatctgatttctgaactat

SEQ ID NO: 4770361 - DNA, 21 bp, Homo sapiens
aacatggccaatagtcatatg

SEQ ID NO: 4770362 - DNA, 20 bp, Homo sapiens
aacatggggcccctctcatc

SEQ ID NO: 4770363 - DNA, 15 bp, Homo sapiens
aacatgtgatgtgtt

SEQ ID NO: 4770364 - DNA, 21 bp, Homo sapiens
aacattaggcaggttgcttaa

SEQ ID NO: 4770365 - DNA, 23 bp, Homo sapiens
aacatttgggacctggataatta

SEQ ID NO: 4770366 - DNA, 13 bp, Homo sapiens
aaccaacacccaa

SEQ ID NO: 4770367 - DNA, 21 bp, Homo sapiens
aaccactgggatcagctggtg

SEQ ID NO: 4770368 - DNA, 15 bp, Homo sapiens
aaccagcactcccag

SEQ ID NO: 4770369 - DNA, 16 bp, Homo sapiens
aaccagcactcccagg

SEQ ID NO: 4770370 - DNA, 13 bp, Homo sapiens
aaccatctggcct

SEQ ID NO: 4770371 - DNA, 12 bp, Homo sapiens
aaccatgaaaag

SEQ ID NO: 4770372 - DNA, 17 bp, Homo sapiens
aaccattcaaaaatttc

SEQ ID NO: 4770373 - DNA, 12 bp, Homo sapiens
aaccattgcttc

SEQ ID NO: 4770374 - DNA, 15 bp, Homo sapiens
aacccacataaacac

SEQ ID NO: 4770375 - DNA, 13 bp, Homo sapiens
aacccagtgttca

SEQ ID NO: 4770376 - DNA, 18 bp, Homo sapiens
aacccagtgttcagcata

SEQ ID NO: 4770377 - DNA, 14 bp, Homo sapiens
aacccatcactgtg

SEQ ID NO: 4770378 - DNA, 20 bp, Homo sapiens
aagcttgtattatcagtgaa

SEQ ID NO: 4770379 - DNA, 17 bp, Homo sapiens
aaggaaacaaagcaata

SEQ ID NO: 4770380 - DNA, 23 bp, Homo sapiens
aaggaaagttctattatctgggt

SEQ ID NO: 4770381 - DNA, 16 bp, Homo sapiens
aaggaagcacatgcct

SEQ ID NO: 4770382 - DNA, 16 bp, Homo sapiens
aaggaaggacatttcc

SEQ ID NO: 4770383 - DNA, 17 bp, Homo sapiens
aaggaaggcagggagga

SEQ ID NO: 4770384 - DNA, 17 bp, Homo sapiens
aaggaaggctccatctc

SEQ ID NO: 4770385 - DNA, 20 bp, Homo sapiens
aaggacactgatgggtcctg

SEQ ID NO: 4770386 - DNA, 13 bp, Homo sapiens
aaggacagtgttc

SEQ ID NO: 4770387 - DNA, 16 bp, Homo sapiens
aaggacagtgttcaaa

SEQ ID NO: 4770388 - DNA, 18 bp, Homo sapiens
aaggacagtgttcaaatt

SEQ ID NO: 4770389 - DNA, 15 bp, Homo sapiens
aaggactacagaatt

SEQ ID NO: 4770390 - DNA, 16 bp, Homo sapiens
aaggactacagaattg

SEQ ID NO: 4770391 - DNA, 13 bp, Homo sapiens
aaggacttctgca

SEQ ID NO: 4770392 - DNA, 21 bp, Homo sapiens
aaggagcactagaatgagaaa

SEQ ID NO: 4770393 - DNA, 20 bp, Homo sapiens
aaggaggcatgcctctgata

SEQ ID NO: 4770394 - DNA, 13 bp, Homo sapiens
aaggagggagaaa

SEQ ID NO: 4770395 - DNA, 19 bp, Homo sapiens
aaggatgcccaaagatgca

SEQ ID NO: 4770396 - DNA, 15 bp, Homo sapiens
aaggattcttttttc

SEQ ID NO: 4770397 - DNA, 17 bp, Homo sapiens
aaggattcttttttcaa

SEQ ID NO: 4770398 - DNA, 13 bp, Homo sapiens
aaggatttattct

SEQ ID NO: 4770399 - DNA, 17 bp, Homo sapiens
aaggatttattctcaga

SEQ ID NO: 4770400 - DNA, 20 bp, Homo sapiens
aaggatttattctcagaaca

SEQ ID NO: 4770401 - DNA, 13 bp, Homo sapiens
aaggcaaatgtcc

SEQ ID NO: 4770402 - DNA, 14 bp, Homo sapiens
aaggcaaatgtcca

SEQ ID NO: 4770403 - DNA, 15 bp, Homo sapiens
aaggcaagaagtggg

SEQ ID NO: 4770404 - DNA, 15 bp, Homo sapiens
aaggcaaggctgtca

SEQ ID NO: 4770405 - DNA, 17 bp, Homo sapiens
aaggcaaggctgtcaat

SEQ ID NO: 4770406 - DNA, 17 bp, Homo sapiens
aaggcacaggtgtaaat

SEQ ID NO: 4770407 - DNA, 23 bp, Homo sapiens
aaggcacccgccctttccttgcc

SEQ ID NO: 4770408 - DNA, 23 bp, Homo sapiens
aaggcagactttctacatgcaaa

SEQ ID NO: 4770409 - DNA, 19 bp, Homo sapiens
aaggcagggaggaggcaga

SEQ ID NO: 4770410 - DNA, 14 bp, Homo sapiens
aaggcagggccctg

SEQ ID NO: 4770411 - DNA, 20 bp, Homo sapiens
aaggcagggccctgaaatgg

SEQ ID NO: 4770412 - DNA, 22 bp, Homo sapiens
aaggcatccccagtgccagctg

SEQ ID NO: 4770413 - DNA, 15 bp, Homo sapiens
aaggcccacaggagg

SEQ ID NO: 4770414 - DNA, 16 bp, Homo sapiens
aaggcccggagatgca

SEQ ID NO: 4770415 - DNA, 15 bp, Homo sapiens
aaggccggtgggaag

SEQ ID NO: 4770416 - DNA, 16 bp, Homo sapiens
aaggccgtgtctctga

SEQ ID NO: 4770417 - DNA, 17 bp, Homo sapiens
aaggccgtgtctctgag

SEQ ID NO: 4770418 - DNA, 16 bp, Homo sapiens
aaggcctgcccccctt

SEQ ID NO: 4770419 - DNA, 19 bp, Homo sapiens
aaggcctgccccccttccc

SEQ ID NO: 4770420 - DNA, 23 bp, Homo sapiens
aaggctgctaagtggaagacaga

SEQ ID NO: 4770421 - DNA, 15 bp, Homo sapiens
aagggacatgtcttt

SEQ ID NO: 4770422 - DNA, 23 bp, Homo sapiens
aagggaccccagatacctgtgag

SEQ ID NO: 4770423 - DNA, 15 bp, Homo sapiens
aagggaggggaagag

SEQ ID NO: 4770424 - DNA, 16 bp, Homo sapiens
aagggagtgaaaacct

SEQ ID NO: 4770425 - DNA, 17 bp, Homo sapiens
aagggatccagagacct

SEQ ID NO: 4770426 - DNA, 21 bp, Homo sapiens
aagggatccagagacctgctc

SEQ ID NO: 4770427 - DNA, 17 bp, Homo sapiens
aagggcagcccctcccc

SEQ ID NO: 4770428 - DNA, 17 bp, Homo sapiens
aagggcaggagctcaca

SEQ ID NO: 4770429 - DNA, 20 bp, Homo sapiens
aaggggccaggaaggggaca

SEQ ID NO: 4770430 - DNA, 22 bp, Homo sapiens
aaggggccaggaaggggacagg

SEQ ID NO: 4770431 - DNA, 18 bp, Homo sapiens
aaggggctggtggagatg

SEQ ID NO: 4770432 - DNA, 14 bp, Homo sapiens
aaggggtggaaggg

SEQ ID NO: 4770433 - DNA, 17 bp, Homo sapiens
aaggggtggaagggcag

SEQ ID NO: 4770434 - DNA, 14 bp, Homo sapiens
aagggtgtggcttg

SEQ ID NO: 4770435 - DNA, 14 bp, Homo sapiens
aaggtagactttta

SEQ ID NO: 4770436 - DNA, 20 bp, Homo sapiens
aaggtagcttacctgacaca

SEQ ID NO: 4770437 - DNA, 18 bp, Homo sapiens
aaggtctcatttgatatt

SEQ ID NO: 4770438 - DNA, 22 bp, Homo sapiens
aaggtgaaggatctgtccgaca

SEQ ID NO: 4770439 - DNA, 15 bp, Homo sapiens
aaggtggtggtggtg

SEQ ID NO: 4770440 - DNA, 16 bp, Homo sapiens
aaggttctatgatata

SEQ ID NO: 4770441 - DNA, 17 bp, Homo sapiens
aaggttctatgatatac

SEQ ID NO: 4770442 - DNA, 20 bp, Homo sapiens
aaggttcttcatccctttcc

SEQ ID NO: 4770443 - DNA, 12 bp, Homo sapiens
aaggttgtacat

SEQ ID NO: 4770444 - DNA, 22 bp, Homo sapiens
aaggttttgaaattttctgtac

SEQ ID NO: 4770445 - DNA, 22 bp, Homo sapiens
aagtaaatctatctctatataa

SEQ ID NO: 4770446 - DNA, 17 bp, Homo sapiens
aagtaaattattttatg

SEQ ID NO: 4770447 - DNA, 19 bp, Homo sapiens
aagtaacctctacaggcat

SEQ ID NO: 4770448 - DNA, 19 bp, Homo sapiens
aagtaattttcttctcatt

SEQ ID NO: 4770449 - DNA, 14 bp, Homo sapiens
aagtacatctgtac

SEQ ID NO: 4770450 - DNA, 20 bp, Homo sapiens
aagtactggtaagattgtta

SEQ ID NO: 4770451 - DNA, 23 bp, Homo sapiens
aagtactggtaagattgttatta

SEQ ID NO: 4770452 - DNA, 21 bp, Homo sapiens
aagtactgtactttcccaggt

SEQ ID NO: 4770453 - DNA, 22 bp, Homo sapiens
aagtagtacttcttctgtaata

SEQ ID NO: 4770454 - DNA, 22 bp, Homo sapiens
aagtagtgtctggatcagtaaa

SEQ ID NO: 4770455 - DNA, 15 bp, Homo sapiens
aagtataaactttta

SEQ ID NO: 4770456 - DNA, 22 bp, Homo sapiens
aagtatatacagagcctgtttt

SEQ ID NO: 4770457 - DNA, 22 bp, Homo sapiens
aagtatccctgatttattctgg

SEQ ID NO: 4770458 - DNA, 16 bp, Homo sapiens
aagtattactaaattg

SEQ ID NO: 4770459 - DNA, 17 bp, Homo sapiens
aagtattactaaattga

SEQ ID NO: 4770460 - DNA, 17 bp, Homo sapiens
aagtattccaccttaaa

SEQ ID NO: 4770461 - DNA, 19 bp, Homo sapiens
aagtattccttggcccagc

SEQ ID NO: 4770462 - DNA, 20 bp, Homo sapiens
aagtattccttggcccagca

SEQ ID NO: 4770463 - DNA, 22 bp, Homo sapiens
aagtattccttggcccagcagc

SEQ ID NO: 4770464 - DNA, 21 bp, Homo sapiens
aagtcaaaataatctgaaatg

SEQ ID NO: 4770465 - DNA, 21 bp, Homo sapiens
aagtcactgacatcagcactg

SEQ ID NO: 4770466 - DNA, 22 bp, Homo sapiens
aagtcactgacatcagcactgc

SEQ ID NO: 4770467 - DNA, 12 bp, Homo sapiens
aagtcagatgac

SEQ ID NO: 4770468 - DNA, 18 bp, Homo sapiens
aagtcagatgtttgagca

SEQ ID NO: 4770469 - DNA, 14 bp, Homo sapiens
aagtcatgggagaa

SEQ ID NO: 4770470 - DNA, 18 bp, Homo sapiens
aagtcatgggagaagagg

SEQ ID NO: 4770471 - DNA, 14 bp, Homo sapiens
aagtcccgaggcag

SEQ ID NO: 4770472 - DNA, 18 bp, Homo sapiens
aagtcccttcctgtcctg

SEQ ID NO: 4770473 - DNA, 22 bp, Homo sapiens
aagtccgaggcctggctctgga

SEQ ID NO: 4770474 - DNA, 23 bp, Homo sapiens
aagtccgaggcctggctctggag

SEQ ID NO: 4770475 - DNA, 16 bp, Homo sapiens
aagtctacactgcctt

SEQ ID NO: 4770476 - DNA, 22 bp, Homo sapiens
aagtctcaattctgaaggggaa

SEQ ID NO: 4770477 - DNA, 14 bp, Homo sapiens
aagtctctctaaga

SEQ ID NO: 4770478 - DNA, 22 bp, Homo sapiens
aagtctctctaagacaaatgca

SEQ ID NO: 4770479 - DNA, 16 bp, Homo sapiens
aagtctgagtagttat

SEQ ID NO: 4770480 - DNA, 20 bp, Homo sapiens
aagtgaaaaagacttcaaat

SEQ ID NO: 4770481 - DNA, 12 bp, Homo sapiens
aagtgagagagg

SEQ ID NO: 4770482 - DNA, 23 bp, Homo sapiens
aagtgatgtgatttatgcattta

SEQ ID NO: 4770483 - DNA, 22 bp, Homo sapiens
aagtgattgacattttgtagct

SEQ ID NO: 4770484 - DNA, 14 bp, Homo sapiens
aagtgcacacacac

SEQ ID NO: 4770485 - DNA, 14 bp, Homo sapiens
aagtgctcagtatt

SEQ ID NO: 4770486 - DNA, 19 bp, Homo sapiens
aagtggaagacagagatgg

SEQ ID NO: 4770487 - DNA, 20 bp, Homo sapiens
aagtggaagacagagatggc

SEQ ID NO: 4770488 - DNA, 12 bp, Homo sapiens
aagtggcaagct

SEQ ID NO: 4770489 - DNA, 22 bp, Homo sapiens
aagtggcaagctcttcattgca

SEQ ID NO: 4770490 - DNA, 12 bp, Homo sapiens
aagtgtacattt

SEQ ID NO: 4770491 - DNA, 15 bp, Homo sapiens
aagtgtactggattt

SEQ ID NO: 4770492 - DNA, 13 bp, Homo sapiens
aagtgtgcctgct

SEQ ID NO: 4770493 - DNA, 14 bp, Homo sapiens
aagtgtgcctgcta

SEQ ID NO: 4770494 - DNA, 17 bp, Homo sapiens
aagtgtgtgtgcaatgt

SEQ ID NO: 4770495 - DNA, 21 bp, Homo sapiens
aagtgtgttctgatgaggcat

SEQ ID NO: 4770496 - DNA, 17 bp, Homo sapiens
aagtgttctgtggctga

SEQ ID NO: 4770497 - DNA, 21 bp, Homo sapiens
aagtgttggccatcatttcat

SEQ ID NO: 4770498 - DNA, 19 bp, Homo sapiens
aagttaaaggttactgttt

SEQ ID NO: 4770499 - DNA, 13 bp, Homo sapiens
aatggcctcttaa

SEQ ID NO: 4770500 - DNA, 14 bp, Homo sapiens
aatggcctcttaaa

SEQ ID NO: 4770501 - DNA, 16 bp, Homo sapiens
aatggcctcttaaaaa

SEQ ID NO: 4770502 - DNA, 20 bp, Homo sapiens
aatggcctcttaaaaattat

SEQ ID NO: 4770503 - DNA, 18 bp, Homo sapiens
aatggcctggtaggtctg

SEQ ID NO: 4770504 - DNA, 17 bp, Homo sapiens
aatgggtaaataaatgc

SEQ ID NO: 4770505 - DNA, 22 bp, Homo sapiens
aatgggtaaataaatgctgctt

SEQ ID NO: 4770506 - DNA, 16 bp, Homo sapiens
aatggtgggctccaga

SEQ ID NO: 4770507 - DNA, 17 bp, Homo sapiens
aatggtgggctccagag

SEQ ID NO: 4770508 - DNA, 16 bp, Homo sapiens
aatggttttcttgtgt

SEQ ID NO: 4770509 - DNA, 17 bp, Homo sapiens
aatgtaaatattgctgt

SEQ ID NO: 4770510 - DNA, 14 bp, Homo sapiens
aatgtaacttaatt

SEQ ID NO: 4770511 - DNA, 21 bp, Homo sapiens
aatgtaattgattgtatatag

SEQ ID NO: 4770512 - DNA, 17 bp, Homo sapiens
aatgtactacatttgca

SEQ ID NO: 4770513 - DNA, 13 bp, Homo sapiens
aatgtactgtatt

SEQ ID NO: 4770514 - DNA, 17 bp, Homo sapiens
aatgtatattgatgtaa

SEQ ID NO: 4770515 - DNA, 11 bp, Homo sapiens
aatgtatctta

SEQ ID NO: 4770516 - DNA, 19 bp, Homo sapiens
aatgtatcttatttatata

SEQ ID NO: 4770517 - DNA, 15 bp, Homo sapiens
aatgtatgtaaatag

SEQ ID NO: 4770518 - DNA, 16 bp, Homo sapiens
aatgtattctatctct

SEQ ID NO: 4770519 - DNA, 18 bp, Homo sapiens
aatgtcaaaaatatttag

SEQ ID NO: 4770520 - DNA, 16 bp, Homo sapiens
aatgtcagtgtgactg

SEQ ID NO: 4770521 - DNA, 21 bp, Homo sapiens
aatgtcagtgtgactgatctc

SEQ ID NO: 4770522 - DNA, 21 bp, Homo sapiens
aatgtcataaagtgagaaaac

SEQ ID NO: 4770523 - DNA, 12 bp, Homo sapiens
aatgtcatttgc

SEQ ID NO: 4770524 - DNA, 16 bp, Homo sapiens
aatgtctataaatggt

SEQ ID NO: 4770525 - DNA, 15 bp, Homo sapiens
aatgtctcaaaataa

SEQ ID NO: 4770526 - DNA, 23 bp, Homo sapiens
aatgtctgtccctaaacatagtg

SEQ ID NO: 4770527 - DNA, 22 bp, Homo sapiens
aatgtgaaaaaaaaaagtaatt

SEQ ID NO: 4770528 - DNA, 16 bp, Homo sapiens
aatgtgaaactgagac

SEQ ID NO: 4770529 - DNA, 23 bp, Homo sapiens
aatgtgaattttaaaatgcaaat

SEQ ID NO: 4770530 - DNA, 12 bp, Homo sapiens
aatgtgccaaaa

SEQ ID NO: 4770531 - DNA, 17 bp, Homo sapiens
aatgtgccaaaatgtca

SEQ ID NO: 4770532 - DNA, 11 bp, Homo sapiens
aatgtgctgca

SEQ ID NO: 4770533 - DNA, 14 bp, Homo sapiens
aatgtgctgttgat

SEQ ID NO: 4770534 - DNA, 23 bp, Homo sapiens
aatgtgcttccgagattcagact

SEQ ID NO: 4770535 - DNA, 21 bp, Homo sapiens
aatgtgggaagaaacaaaccc

SEQ ID NO: 4770536 - DNA, 17 bp, Homo sapiens
aatgtggtggcaataaa

SEQ ID NO: 4770537 - DNA, 13 bp, Homo sapiens
aatgtgtgggccc

SEQ ID NO: 4770538 - DNA, 15 bp, Homo sapiens
aatgtgtgtatgtgt

SEQ ID NO: 4770539 - DNA, 16 bp, Homo sapiens
aatgtgtgtatgtgtg

SEQ ID NO: 4770540 - DNA, 13 bp, Homo sapiens
aatgttaaatcta

SEQ ID NO: 4770541 - DNA, 15 bp, Homo sapiens
aatgttaaatctaca

SEQ ID NO: 4770542 - DNA, 23 bp, Homo sapiens
aatgttctttcctttcatcctca

SEQ ID NO: 4770543 - DNA, 23 bp, Homo sapiens
aatgttgaagaactcatgtgatt

SEQ ID NO: 4770544 - DNA, 12 bp, Homo sapiens
aatgttgtcctg

SEQ ID NO: 4770545 - DNA, 23 bp, Homo sapiens
aatgtttgtaagcaattctaagt

SEQ ID NO: 4770546 - DNA, 23 bp, Homo sapiens
aatgttttaaagaagtccatgtg

SEQ ID NO: 4770547 - DNA, 14 bp, Homo sapiens
aattaaacaattta

SEQ ID NO: 4770548 - DNA, 19 bp, Homo sapiens
aattaaacaatttatttta

SEQ ID NO: 4770549 - DNA, 13 bp, Homo sapiens
aattaaagtctac

SEQ ID NO: 4770550 - DNA, 14 bp, Homo sapiens
aattaaataaaata

SEQ ID NO: 4770551 - DNA, 23 bp, Homo sapiens
aattaaatatatgtatgtaaaaa

SEQ ID NO: 4770552 - DNA, 15 bp, Homo sapiens
aattaaatgaaatac

SEQ ID NO: 4770553 - DNA, 17 bp, Homo sapiens
aattaaatgaaatactt

SEQ ID NO: 4770554 - DNA, 20 bp, Homo sapiens
aattaaccccataattagat

SEQ ID NO: 4770555 - DNA, 22 bp, Homo sapiens
aattaatgagttttatccaaga

SEQ ID NO: 4770556 - DNA, 13 bp, Homo sapiens
aattaattcttta

SEQ ID NO: 4770557 - DNA, 13 bp, Homo sapiens
aattaatttcagt

SEQ ID NO: 4770558 - DNA, 19 bp, Homo sapiens
aattacaggaagtactgga

SEQ ID NO: 4770559 - DNA, 19 bp, Homo sapiens
aattacctaagagccacaa

SEQ ID NO: 4770560 - DNA, 15 bp, Homo sapiens
aattactactttgtt

SEQ ID NO: 4770561 - DNA, 12 bp, Homo sapiens
aattactgtgag

SEQ ID NO: 4770562 - DNA, 16 bp, Homo sapiens
aattactgtgagaact

SEQ ID NO: 4770563 - DNA, 20 bp, Homo sapiens
aattagaagaaaatggatga

SEQ ID NO: 4770564 - DNA, 22 bp, Homo sapiens
aattagaagccatcctaaggtg

SEQ ID NO: 4770565 - DNA, 16 bp, Homo sapiens
aattagatgactgaat

SEQ ID NO: 4770566 - DNA, 14 bp, Homo sapiens
aattagtgagattt

SEQ ID NO: 4770567 - DNA, 20 bp, Homo sapiens
aattataagctatgtcacta

SEQ ID NO: 4770568 - DNA, 17 bp, Homo sapiens
aattataatgcatctaa

SEQ ID NO: 4770569 - DNA, 21 bp, Homo sapiens
aattatatctgtggtcttcaa

SEQ ID NO: 4770570 - DNA, 14 bp, Homo sapiens
aattatattttgaa

SEQ ID NO: 4770571 - DNA, 22 bp, Homo sapiens
aattatcctcaagttgtgtgct

SEQ ID NO: 4770572 - DNA, 13 bp, Homo sapiens
aattatctttaaa

SEQ ID NO: 4770573 - DNA, 20 bp, Homo sapiens
aattatgaagccctaagtaa

SEQ ID NO: 4770574 - DNA, 16 bp, Homo sapiens
aattatgacgtgcaca

SEQ ID NO: 4770575 - DNA, 17 bp, Homo sapiens
aattatgacgtgcacaa

SEQ ID NO: 4770576 - DNA, 14 bp, Homo sapiens
aattatgtcaaatg

SEQ ID NO: 4770577 - DNA, 19 bp, Homo sapiens
aattatgtcaaatggatgt

SEQ ID NO: 4770578 - DNA, 15 bp, Homo sapiens
aattattaaaaatta

SEQ ID NO: 4770579 - DNA, 17 bp, Homo sapiens
aattattaaaaattata

SEQ ID NO: 4770580 - DNA, 13 bp, Homo sapiens
aattattaatgaa

SEQ ID NO: 4770581 - DNA, 15 bp, Homo sapiens
aattattaatgaatg

SEQ ID NO: 4770582 - DNA, 17 bp, Homo sapiens
aattattagcaccagct

SEQ ID NO: 4770583 - DNA, 14 bp, Homo sapiens
aattcaaagaatca

SEQ ID NO: 4770584 - DNA, 12 bp, Homo sapiens
aattcacccctc

SEQ ID NO: 4770585 - DNA, 21 bp, Homo sapiens
aattcatgatgctagttctta

SEQ ID NO: 4770586 - DNA, 14 bp, Homo sapiens
aattcattccattt

SEQ ID NO: 4770587 - DNA, 13 bp, Homo sapiens
aattccaatacat

SEQ ID NO: 4770588 - DNA, 22 bp, Homo sapiens
aattccacctggaaagccaggt

SEQ ID NO: 4770589 - DNA, 17 bp, Homo sapiens
aattctcagaagtgaaa

SEQ ID NO: 4770590 - DNA, 14 bp, Homo sapiens
aattctgattatta

SEQ ID NO: 4770591 - DNA, 18 bp, Homo sapiens
aattctgcttctctttca

SEQ ID NO: 4770592 - DNA, 15 bp, Homo sapiens
aattctgtttatgtt

SEQ ID NO: 4770593 - DNA, 19 bp, Homo sapiens
aattcttaccgaaatgaaa

SEQ ID NO: 4770594 - DNA, 20 bp, Homo sapiens
aattcttaccgaaatgaaaa

SEQ ID NO: 4770595 - DNA, 21 bp, Homo sapiens
aattcttaccgaaatgaaaat

SEQ ID NO: 4770596 - DNA, 19 bp, Homo sapiens
aattcttatgccatataat

SEQ ID NO: 4770597 - DNA, 23 bp, Homo sapiens
aattcttattttataattttaaa

SEQ ID NO: 4770598 - DNA, 22 bp, Homo sapiens
aattcttctccactttctagcc

SEQ ID NO: 4770599 - DNA, 22 bp, Homo sapiens
aattcttctcctttgtcaaatg

SEQ ID NO: 4770600 - DNA, 14 bp, Homo sapiens
aattcttgcactgt

SEQ ID NO: 4770601 - DNA, 17 bp, Homo sapiens
aattctttatcacatgt

SEQ ID NO: 4770602 - DNA, 23 bp, Homo sapiens
aattctttgttgcttaatctaga

SEQ ID NO: 4770603 - DNA, 19 bp, Homo sapiens
aattgaaccgtcaatgtga

SEQ ID NO: 4770604 - DNA, 19 bp, Homo sapiens
aattgacctgatttccatt

SEQ ID NO: 4770605 - DNA, 20 bp, Homo sapiens
aattgacctgatttccattt

SEQ ID NO: 4770606 - DNA, 15 bp, Homo sapiens
aattgagttaaatca

SEQ ID NO: 4770607 - DNA, 17 bp, Homo sapiens
aattgagttaaatcagt

SEQ ID NO: 4770608 - DNA, 20 bp, Homo sapiens
aattgctgagatgtttagta

SEQ ID NO: 4770609 - DNA, 21 bp, Homo sapiens
aattgcttctctaaaacagca

SEQ ID NO: 4770610 - DNA, 21 bp, Homo sapiens
aattgcttgagcatgcccaaa

SEQ ID NO: 4770611 - DNA, 13 bp, Homo sapiens
aattggcttgttt

SEQ ID NO: 4770612 - DNA, 23 bp, Homo sapiens
aattggcttgtttaaggttcttg

SEQ ID NO: 4770613 - DNA, 19 bp, Homo sapiens
aattgggcccttagaatgt

SEQ ID NO: 4770614 - DNA, 22 bp, Homo sapiens
aattgggcccttagaatgtgaa

SEQ ID NO: 4770615 - DNA, 23 bp, Homo sapiens
aattgggcccttagaatgtgaaa

SEQ ID NO: 4770616 - DNA, 17 bp, Homo sapiens
aattggttaatgaaaaa

SEQ ID NO: 4770617 - DNA, 22 bp, Homo sapiens
aattgtaaggaatgattaatta

SEQ ID NO: 4770618 - DNA, 18 bp, Homo sapiens
aattgtgagaattactgt

SEQ ID NO: 4770619 - DNA, 17 bp, Homo sapiens
aattgtgccaaagatag

SEQ ID NO: 4770620 - DNA, 16 bp, Homo sapiens
aattgttacaattttc

SEQ ID NO: 4770621 - DNA, 19 bp, Homo sapiens
acagatcacatgcccctct

SEQ ID NO: 4770622 - DNA, 21 bp, Homo sapiens
acagatcacatgcccctctta

SEQ ID NO: 4770623 - DNA, 22 bp, Homo sapiens
acagatcctccgcggaggcccc

SEQ ID NO: 4770624 - DNA, 12 bp, Homo sapiens
acagatcttgag

SEQ ID NO: 4770625 - DNA, 14 bp, Homo sapiens
acagatcttgagca

SEQ ID NO: 4770626 - DNA, 17 bp, Homo sapiens
acagatcttgagcaagg

SEQ ID NO: 4770627 - DNA, 13 bp, Homo sapiens
acagattatttgt

SEQ ID NO: 4770628 - DNA, 16 bp, Homo sapiens
acagattgctgcttct

SEQ ID NO: 4770629 - DNA, 16 bp, Homo sapiens
acagatttccaaaagt

SEQ ID NO: 4770630 - DNA, 15 bp, Homo sapiens
acagcacatttgtta

SEQ ID NO: 4770631 - DNA, 18 bp, Homo sapiens
acagcacatttgttaatg

SEQ ID NO: 4770632 - DNA, 19 bp, Homo sapiens
acagcagccccccagcact

SEQ ID NO: 4770633 - DNA, 20 bp, Homo sapiens
acagcagccccccagcacta

SEQ ID NO: 4770634 - DNA, 10 bp, Homo sapiens
acagcagctc

SEQ ID NO: 4770635 - DNA, 12 bp, Homo sapiens
acagcagctcca

SEQ ID NO: 4770636 - DNA, 13 bp, Homo sapiens
acagcagctccaa

SEQ ID NO: 4770637 - DNA, 14 bp, Homo sapiens
acagcagctccaac

SEQ ID NO: 4770638 - DNA, 20 bp, Homo sapiens
acagcagctccaacctggag

SEQ ID NO: 4770639 - DNA, 22 bp, Homo sapiens
acagcagctccaacctggaggc

SEQ ID NO: 4770640 - DNA, 23 bp, Homo sapiens
acagcagctccaacctggaggct

SEQ ID NO: 4770641 - DNA, 15 bp, Homo sapiens
acagcagctggactg

SEQ ID NO: 4770642 - DNA, 16 bp, Homo sapiens
acagcaggagcatggc

SEQ ID NO: 4770643 - DNA, 14 bp, Homo sapiens
acagcatgcattta

SEQ ID NO: 4770644 - DNA, 18 bp, Homo sapiens
acagcatgcatttagcat

SEQ ID NO: 4770645 - DNA, 21 bp, Homo sapiens
acagcatgcatttagcatgag

SEQ ID NO: 4770646 - DNA, 21 bp, Homo sapiens
acagccccaaacaagcgccac

SEQ ID NO: 4770647 - DNA, 15 bp, Homo sapiens
acagccccttgcttc

SEQ ID NO: 4770648 - DNA, 17 bp, Homo sapiens
acagccccttgcttcta

SEQ ID NO: 4770649 - DNA, 16 bp, Homo sapiens
acagcccgagcccctt

SEQ ID NO: 4770650 - DNA, 19 bp, Homo sapiens
acagcctgcacacacctgc

SEQ ID NO: 4770651 - DNA, 23 bp, Homo sapiens
acagcctgcacacacctgcctgc

SEQ ID NO: 4770652 - DNA, 16 bp, Homo sapiens
acagcctgcacagtgg

SEQ ID NO: 4770653 - DNA, 22 bp, Homo sapiens
acagcctttgcgctctgggttt

SEQ ID NO: 4770654 - DNA, 20 bp, Homo sapiens
acagcggccccgcggagccc

SEQ ID NO: 4770655 - DNA, 13 bp, Homo sapiens
acagcggcccggc

SEQ ID NO: 4770656 - DNA, 15 bp, Homo sapiens
acagcggcccggccc

SEQ ID NO: 4770657 - DNA, 18 bp, Homo sapiens
acagcggcccggcccacg

SEQ ID NO: 4770658 - DNA, 15 bp, Homo sapiens
acagctaacatggaa

SEQ ID NO: 4770659 - DNA, 17 bp, Homo sapiens
acagctaacatggaagt

SEQ ID NO: 4770660 - DNA, 20 bp, Homo sapiens
acagctctcctccagccctg

SEQ ID NO: 4770661 - DNA, 19 bp, Homo sapiens
acagcttcacttaaaatca

SEQ ID NO: 4770662 - DNA, 21 bp, Homo sapiens
acagcttcacttaaaatcaaa

SEQ ID NO: 4770663 - DNA, 22 bp, Homo sapiens
acagcttccccatcgccttctg

SEQ ID NO: 4770664 - DNA, 17 bp, Homo sapiens
acagcttgaccgtgagg

SEQ ID NO: 4770665 - DNA, 21 bp, Homo sapiens
acagcttgaccgtgaggccag

SEQ ID NO: 4770666 - DNA, 18 bp, Homo sapiens
acagcttgatgctgtttc

SEQ ID NO: 4770667 - DNA, 17 bp, Homo sapiens
acaggaaaaaaactttt

SEQ ID NO: 4770668 - DNA, 21 bp, Homo sapiens
acaggaaaagcatgtcttatt

SEQ ID NO: 4770669 - DNA, 17 bp, Homo sapiens
acaggaaagccctcccc

SEQ ID NO: 4770670 - DNA, 13 bp, Homo sapiens
acaggaacccatc

SEQ ID NO: 4770671 - DNA, 12 bp, Homo sapiens
acaggaccagga

SEQ ID NO: 4770672 - DNA, 13 bp, Homo sapiens
acaggaccaggag

SEQ ID NO: 4770673 - DNA, 17 bp, Homo sapiens
acaggaccaggagccag

SEQ ID NO: 4770674 - DNA, 23 bp, Homo sapiens
acaggagtgactctggctgccaa

SEQ ID NO: 4770675 - DNA, 18 bp, Homo sapiens
acaggcattgcactaaaa

SEQ ID NO: 4770676 - DNA, 19 bp, Homo sapiens
acaggcattgcactaaaag

SEQ ID NO: 4770677 - DNA, 20 bp, Homo sapiens
acaggcctggcccagccagc

SEQ ID NO: 4770678 - DNA, 22 bp, Homo sapiens
acaggcctggcccagccagcag

SEQ ID NO: 4770679 - DNA, 22 bp, Homo sapiens
acaggctgttctgcactgaaaa

SEQ ID NO: 4770680 - DNA, 14 bp, Homo sapiens
acagggcaaaatga

SEQ ID NO: 4770681 - DNA, 15 bp, Homo sapiens
acagggcaaaatgaa

SEQ ID NO: 4770682 - DNA, 17 bp, Homo sapiens
acagggtggcacccacc

SEQ ID NO: 4770683 - DNA, 21 bp, Homo sapiens
acagggtggcacccaccactc

SEQ ID NO: 4770684 - DNA, 17 bp, Homo sapiens
acagggtggggcttaga

SEQ ID NO: 4770685 - DNA, 16 bp, Homo sapiens
acaggtgtaaatatag

SEQ ID NO: 4770686 - DNA, 17 bp, Homo sapiens
acaggttttatgagact

SEQ ID NO: 4770687 - DNA, 22 bp, Homo sapiens
acaggttttcctgaagaattga

SEQ ID NO: 4770688 - DNA, 16 bp, Homo sapiens
acagtaatgtcataaa

SEQ ID NO: 4770689 - DNA, 18 bp, Homo sapiens
acagtatataagcttttt

SEQ ID NO: 4770690 - DNA, 17 bp, Homo sapiens
acagtatattttatttc

SEQ ID NO: 4770691 - DNA, 21 bp, Homo sapiens
acagtattaacatcaaagact

SEQ ID NO: 4770692 - DNA, 22 bp, Homo sapiens
acagtattatagatataaatat

SEQ ID NO: 4770693 - DNA, 22 bp, Homo sapiens
acagtattatttagtaaaatta

SEQ ID NO: 4770694 - DNA, 22 bp, Homo sapiens
acagtattgttcttgtaaaact

SEQ ID NO: 4770695 - DNA, 23 bp, Homo sapiens
acagtcttcattttttttaattg

SEQ ID NO: 4770696 - DNA, 15 bp, Homo sapiens
acagtggcaagctac

SEQ ID NO: 4770697 - DNA, 16 bp, Homo sapiens
acagtgggaactctga

SEQ ID NO: 4770698 - DNA, 18 bp, Homo sapiens
acagtgggaactctgaca

SEQ ID NO: 4770699 - DNA, 14 bp, Homo sapiens
acagtggggcccat

SEQ ID NO: 4770700 - DNA, 19 bp, Homo sapiens
acagtggtcagcgattcct

SEQ ID NO: 4770701 - DNA, 23 bp, Homo sapiens
acagtggtccagggtccagccct

SEQ ID NO: 4770702 - DNA, 18 bp, Homo sapiens
acagtgtggatgtaaatt

SEQ ID NO: 4770703 - DNA, 16 bp, Homo sapiens
acagtgttcaaattct

SEQ ID NO: 4770704 - DNA, 14 bp, Homo sapiens
acagttcacaccct

SEQ ID NO: 4770705 - DNA, 18 bp, Homo sapiens
acagttcacaccctgcaa

SEQ ID NO: 4770706 - DNA, 16 bp, Homo sapiens
acagttccacaatttt

SEQ ID NO: 4770707 - DNA, 18 bp, Homo sapiens
acagttccacaattttgt

SEQ ID NO: 4770708 - DNA, 22 bp, Homo sapiens
acagttccacaattttgtctct

SEQ ID NO: 4770709 - DNA, 22 bp, Homo sapiens
acagttcttggtgactgtccca

SEQ ID NO: 4770710 - DNA, 18 bp, Homo sapiens
acagttgatatttaaaag

SEQ ID NO: 4770711 - DNA, 20 bp, Homo sapiens
acagttgatatttaaaagat

SEQ ID NO: 4770712 - DNA, 12 bp, Homo sapiens
acagtttaacag

SEQ ID NO: 4770713 - DNA, 21 bp, Homo sapiens
acagtttaacagaaaaatgaa

SEQ ID NO: 4770714 - DNA, 14 bp, Homo sapiens
acagtttcttgcaa

SEQ ID NO: 4770715 - DNA, 13 bp, Homo sapiens
acataaacacttc

SEQ ID NO: 4770716 - DNA, 22 bp, Homo sapiens
acataaacacttctccttaacc

SEQ ID NO: 4770717 - DNA, 16 bp, Homo sapiens
acataaacttgtactt

SEQ ID NO: 4770718 - DNA, 23 bp, Homo sapiens
acataaacttgtacttacactga

SEQ ID NO: 4770719 - DNA, 23 bp, Homo sapiens
acataaataaattaaataaaata

SEQ ID NO: 4770720 - DNA, 13 bp, Homo sapiens
acataacaggcat

SEQ ID NO: 4770721 - DNA, 17 bp, Homo sapiens
acataacaggcattgca

SEQ ID NO: 4770722 - DNA, 22 bp, Homo sapiens
acataacaggcattgcactaaa

SEQ ID NO: 4770723 - DNA, 19 bp, Homo sapiens
acataatatcttgaagaat

SEQ ID NO: 4770724 - DNA, 22 bp, Homo sapiens
acataatatcttgaagaatatt

SEQ ID NO: 4770725 - DNA, 23 bp, Homo sapiens
acataatgttagtagcactgaga

SEQ ID NO: 4770726 - DNA, 12 bp, Homo sapiens
acatacagatgg

SEQ ID NO: 4770727 - DNA, 22 bp, Homo sapiens
acatacctctctctatatatac

SEQ ID NO: 4770728 - DNA, 14 bp, Homo sapiens
acatacgaaacaca

SEQ ID NO: 4770729 - DNA, 19 bp, Homo sapiens
acatagattaatggcactg

SEQ ID NO: 4770730 - DNA, 20 bp, Homo sapiens
acatagattaatggcactga

SEQ ID NO: 4770731 - DNA, 19 bp, Homo sapiens
acatagattcacctgtaaa

SEQ ID NO: 4770732 - DNA, 22 bp, Homo sapiens
acatagattcacctgtaaaact

SEQ ID NO: 4770733 - DNA, 17 bp, Homo sapiens
acatagcataggctggg

SEQ ID NO: 4770734 - DNA, 18 bp, Homo sapiens
acatagtctgaagtgaag

SEQ ID NO: 4770735 - DNA, 14 bp, Homo sapiens
acatagtggtattt

SEQ ID NO: 4770736 - DNA, 20 bp, Homo sapiens
acatagtggtattttaacat

SEQ ID NO: 4770737 - DNA, 21 bp, Homo sapiens
acatagtggtattttaacata

SEQ ID NO: 4770738 - DNA, 19 bp, Homo sapiens
acatataaacacagtaaga

SEQ ID NO: 4770739 - DNA, 14 bp, Homo sapiens
acatatacattatt

SEQ ID NO: 4770740 - DNA, 16 bp, Homo sapiens
acatatagctttgcaa

SEQ ID NO: 4770741 - DNA, 15 bp, Homo sapiens
acatatcattcagaa

SEQ ID NO: 4770742 - DNA, 17 bp, Homo sapiens
accctgcaaggcccaca

SEQ ID NO: 4770743 - DNA, 18 bp, Homo sapiens
accctgccaactttccag

SEQ ID NO: 4770744 - DNA, 17 bp, Homo sapiens
accctgccaccctctgc

SEQ ID NO: 4770745 - DNA, 23 bp, Homo sapiens
accctgccaccctctgctgcaca

SEQ ID NO: 4770746 - DNA, 16 bp, Homo sapiens
accctgccctgcacct

SEQ ID NO: 4770747 - DNA, 19 bp, Homo sapiens
accctgccctgcaccttgg

SEQ ID NO: 4770748 - DNA, 21 bp, Homo sapiens
accctgccctggcctaccaca

SEQ ID NO: 4770749 - DNA, 18 bp, Homo sapiens
accctgcgcccctgccca

SEQ ID NO: 4770750 - DNA, 14 bp, Homo sapiens
accctgctaaatga

SEQ ID NO: 4770751 - DNA, 14 bp, Homo sapiens
accctgggcctccc

SEQ ID NO: 4770752 - DNA, 17 bp, Homo sapiens
accctgtctgcaggcca

SEQ ID NO: 4770753 - DNA, 23 bp, Homo sapiens
accctgtctgcaggccaccccca

SEQ ID NO: 4770754 - DNA, 11 bp, Homo sapiens
accctgtgccc

SEQ ID NO: 4770755 - DNA, 14 bp, Homo sapiens
accctgtgccccgc

SEQ ID NO: 4770756 - DNA, 15 bp, Homo sapiens
accctgtgccccgcc

SEQ ID NO: 4770757 - DNA, 22 bp, Homo sapiens
accctgtgccccgcctcccggg

SEQ ID NO: 4770758 - DNA, 11 bp, Homo sapiens
accctgtgcct

SEQ ID NO: 4770759 - DNA, 13 bp, Homo sapiens
accctgtgcctgt

SEQ ID NO: 4770760 - DNA, 14 bp, Homo sapiens
accctgtgcctgtg

SEQ ID NO: 4770761 - DNA, 23 bp, Homo sapiens
accctgttgctacatcagagtgt

SEQ ID NO: 4770762 - DNA, 12 bp, Homo sapiens
acccttcaatgt

SEQ ID NO: 4770763 - DNA, 13 bp, Homo sapiens
acccttcaatgtt

SEQ ID NO: 4770764 - DNA, 16 bp, Homo sapiens
acccttcaatgttaaa

SEQ ID NO: 4770765 - DNA, 13 bp, Homo sapiens
acccttccccact

SEQ ID NO: 4770766 - DNA, 15 bp, Homo sapiens
acccttccccactcc

SEQ ID NO: 4770767 - DNA, 17 bp, Homo sapiens
acccttgaaaactctca

SEQ ID NO: 4770768 - DNA, 20 bp, Homo sapiens
acccttgaaaactctcagtc

SEQ ID NO: 4770769 - DNA, 22 bp, Homo sapiens
acccttgactgttatctcggac

SEQ ID NO: 4770770 - DNA, 17 bp, Homo sapiens
acccttggtctgtgttc

SEQ ID NO: 4770771 - DNA, 23 bp, Homo sapiens
acccttggtctgtgttctcaaca

SEQ ID NO: 4770772 - DNA, 21 bp, Homo sapiens
accgaactcgggattacagaa

SEQ ID NO: 4770773 - DNA, 12 bp, Homo sapiens
accgaatattga

SEQ ID NO: 4770774 - DNA, 11 bp, Homo sapiens
accgaggactc

SEQ ID NO: 4770775 - DNA, 19 bp, Homo sapiens
accgaggactccaggggct

SEQ ID NO: 4770776 - DNA, 13 bp, Homo sapiens
accgattcttcct

SEQ ID NO: 4770777 - DNA, 17 bp, Homo sapiens
accgattcttccttgcc

SEQ ID NO: 4770778 - DNA, 12 bp, Homo sapiens
accgcagaagga

SEQ ID NO: 4770779 - DNA, 15 bp, Homo sapiens
accgcagaaggaagg

SEQ ID NO: 4770780 - DNA, 13 bp, Homo sapiens
accgcattccagg

SEQ ID NO: 4770781 - DNA, 16 bp, Homo sapiens
accgcccaacccccac

SEQ ID NO: 4770782 - DNA, 19 bp, Homo sapiens
accgcccaacccccacctc

SEQ ID NO: 4770783 - DNA, 14 bp, Homo sapiens
accgcccacccaca

SEQ ID NO: 4770784 - DNA, 18 bp, Homo sapiens
accgcccacccacacccc

SEQ ID NO: 4770785 - DNA, 14 bp, Homo sapiens
accgcccacccagc

SEQ ID NO: 4770786 - DNA, 15 bp, Homo sapiens
accgcccacccagca

SEQ ID NO: 4770787 - DNA, 16 bp, Homo sapiens
accgcccacccagcag

SEQ ID NO: 4770788 - DNA, 22 bp, Homo sapiens
accgcccacccagcagcgcccg

SEQ ID NO: 4770789 - DNA, 14 bp, Homo sapiens
accgcgcccctctg

SEQ ID NO: 4770790 - DNA, 17 bp, Homo sapiens
accggagcggctgagga

SEQ ID NO: 4770791 - DNA, 18 bp, Homo sapiens
accggagctccagtttct

SEQ ID NO: 4770792 - DNA, 21 bp, Homo sapiens
accgggaaaggcatctaagac

SEQ ID NO: 4770793 - DNA, 14 bp, Homo sapiens
accgggactacaga

SEQ ID NO: 4770794 - DNA, 16 bp, Homo sapiens
accgggactacagaag

SEQ ID NO: 4770795 - DNA, 20 bp, Homo sapiens
accggggtggagtcagggct

SEQ ID NO: 4770796 - DNA, 21 bp, Homo sapiens
accggggtggagtcagggctg

SEQ ID NO: 4770797 - DNA, 16 bp, Homo sapiens
accgtaaaggtttatt

SEQ ID NO: 4770798 - DNA, 22 bp, Homo sapiens
accgtaaaggtttatttttctg

SEQ ID NO: 4770799 - DNA, 18 bp, Homo sapiens
accgtgaggccagagaca

SEQ ID NO: 4770800 - DNA, 19 bp, Homo sapiens
accgtggccctgccctctc

SEQ ID NO: 4770801 - DNA, 20 bp, Homo sapiens
accgtggccctgccctctcc

SEQ ID NO: 4770802 - DNA, 21 bp, Homo sapiens
accgtggccctgccctctcct

SEQ ID NO: 4770803 - DNA, 16 bp, Homo sapiens
accgtggtgtcctctg

SEQ ID NO: 4770804 - DNA, 17 bp, Homo sapiens
accgtggtgtcctctgt

SEQ ID NO: 4770805 - DNA, 18 bp, Homo sapiens
acctaaacagctgcttta

SEQ ID NO: 4770806 - DNA, 21 bp, Homo sapiens
acctaaacagctgctttatga

SEQ ID NO: 4770807 - DNA, 18 bp, Homo sapiens
acctaaattaacaaattc

SEQ ID NO: 4770808 - DNA, 15 bp, Homo sapiens
acctaattaatttca

SEQ ID NO: 4770809 - DNA, 14 bp, Homo sapiens
acctaccctggacc

SEQ ID NO: 4770810 - DNA, 18 bp, Homo sapiens
acctaccttatagagcac

SEQ ID NO: 4770811 - DNA, 16 bp, Homo sapiens
acctatctgtattggc

SEQ ID NO: 4770812 - DNA, 22 bp, Homo sapiens
acctatctgtattggcagcaca

SEQ ID NO: 4770813 - DNA, 20 bp, Homo sapiens
acctcacagtgacccttccc

SEQ ID NO: 4770814 - DNA, 22 bp, Homo sapiens
acctcaccccgttacagctccc

SEQ ID NO: 4770815 - DNA, 24 bp, Homo sapiens
acctcactatggtatgctggccag

SEQ ID NO: 4770816 - DNA, 17 bp, Homo sapiens
acctcactgctttgtag

SEQ ID NO: 4770817 - DNA, 12 bp, Homo sapiens
acctcacttgtg

SEQ ID NO: 4770818 - DNA, 13 bp, Homo sapiens
acctcaggcctgg

SEQ ID NO: 4770819 - DNA, 17 bp, Homo sapiens
acctcagttggcctctg

SEQ ID NO: 4770820 - DNA, 13 bp, Homo sapiens
acctcatttgcat

SEQ ID NO: 4770821 - DNA, 11 bp, Homo sapiens
acctccacccg

SEQ ID NO: 4770822 - DNA, 14 bp, Homo sapiens
acctccacccgtcc

SEQ ID NO: 4770823 - DNA, 20 bp, Homo sapiens
acctccagattattttctat

SEQ ID NO: 4770824 - DNA, 23 bp, Homo sapiens
acctccaggaagggaccccactg

SEQ ID NO: 4770825 - DNA, 18 bp, Homo sapiens
acctcccccaaaccctgc

SEQ ID NO: 4770826 - DNA, 18 bp, Homo sapiens
acctcccctggtcctgca

SEQ ID NO: 4770827 - DNA, 14 bp, Homo sapiens
acctccctgcagct

SEQ ID NO: 4770828 - DNA, 15 bp, Homo sapiens
acctccctgcagctt

SEQ ID NO: 4770829 - DNA, 14 bp, Homo sapiens
acctccctgcccag

SEQ ID NO: 4770830 - DNA, 15 bp, Homo sapiens
acctccctgcccagg

SEQ ID NO: 4770831 - DNA, 20 bp, Homo sapiens
acctcggctgtgtggggagg

SEQ ID NO: 4770832 - DNA, 15 bp, Homo sapiens
acctctactttccag

SEQ ID NO: 4770833 - DNA, 22 bp, Homo sapiens
acctctatatgttgctgaaaca

SEQ ID NO: 4770834 - DNA, 17 bp, Homo sapiens
acctctcacttttttat

SEQ ID NO: 4770835 - DNA, 14 bp, Homo sapiens
acctctcagatccc

SEQ ID NO: 4770836 - DNA, 17 bp, Homo sapiens
acctctctctatatata

SEQ ID NO: 4770837 - DNA, 15 bp, Homo sapiens
acctctgtgaccccc

SEQ ID NO: 4770838 - DNA, 12 bp, Homo sapiens
acctcttgtttt

SEQ ID NO: 4770839 - DNA, 17 bp, Homo sapiens
acctctttcggaaatga

SEQ ID NO: 4770840 - DNA, 13 bp, Homo sapiens
acctctttcttca

SEQ ID NO: 4770841 - DNA, 13 bp, Homo sapiens
acctgaaagccct

SEQ ID NO: 4770842 - DNA, 14 bp, Homo sapiens
acctgaaagccctt

SEQ ID NO: 4770843 - DNA, 22 bp, Homo sapiens
acctgaaagcccttctcaagac

SEQ ID NO: 4770844 - DNA, 17 bp, Homo sapiens
acctgaattaaagtcta

SEQ ID NO: 4770845 - DNA, 20 bp, Homo sapiens
acctgacacctgccgctgct

SEQ ID NO: 4770846 - DNA, 14 bp, Homo sapiens
acctgaggccaaat

SEQ ID NO: 4770847 - DNA, 17 bp, Homo sapiens
acctgatacctgcctgg

SEQ ID NO: 4770848 - DNA, 21 bp, Homo sapiens
acctgatttccatttgcaaca

SEQ ID NO: 4770849 - DNA, 16 bp, Homo sapiens
acctgccaggaagcca

SEQ ID NO: 4770850 - DNA, 17 bp, Homo sapiens
acctgccaggaagccag

SEQ ID NO: 4770851 - DNA, 18 bp, Homo sapiens
acctgccaggaagccagc

SEQ ID NO: 4770852 - DNA, 21 bp, Homo sapiens
acctgccaggaagccagcagg

SEQ ID NO: 4770853 - DNA, 22 bp, Homo sapiens
acctgccaggaagccagcaggc

SEQ ID NO: 4770854 - DNA, 15 bp, Homo sapiens
acctgcctctcacac

SEQ ID NO: 4770855 - DNA, 16 bp, Homo sapiens
acctgcctgggacagc

SEQ ID NO: 4770856 - DNA, 21 bp, Homo sapiens
acctgcctgggacagccactg

SEQ ID NO: 4770857 - DNA, 12 bp, Homo sapiens
acctgctccaga

SEQ ID NO: 4770858 - DNA, 13 bp, Homo sapiens
acctgctccagat

SEQ ID NO: 4770859 - DNA, 22 bp, Homo sapiens
acctgcttctcagcgcaacagc

SEQ ID NO: 4770860 - DNA, 15 bp, Homo sapiens
acctggaaagccagg

SEQ ID NO: 4770861 - DNA, 16 bp, Homo sapiens
acctggaaagccaggt

SEQ ID NO: 4770862 - DNA, 12 bp, Homo sapiens
acctggaggctg

SEQ ID NO: 4770863 - DNA, 15 bp, Homo sapiens
acctggaggctggac

SEQ ID NO: 4770864 - DNA, 22 bp, Homo sapiens
acctggatggatctgctccatg

SEQ ID NO: 4770865 - DNA, 22 bp, Homo sapiens
actgcatcaagatgtgacatgt

SEQ ID NO: 4770866 - DNA, 16 bp, Homo sapiens
actgccacaagcacaa

SEQ ID NO: 4770867 - DNA, 22 bp, Homo sapiens
actgccactaaaatccacccag

SEQ ID NO: 4770868 - DNA, 12 bp, Homo sapiens
actgcccaccct

SEQ ID NO: 4770869 - DNA, 14 bp, Homo sapiens
actgcccaccctgg

SEQ ID NO: 4770870 - DNA, 18 bp, Homo sapiens
actgcccaccctgggcct

SEQ ID NO: 4770871 - DNA, 21 bp, Homo sapiens
actgcccaccctgggcctccc

SEQ ID NO: 4770872 - DNA, 15 bp, Homo sapiens
actgcccacctgcca

SEQ ID NO: 4770873 - DNA, 18 bp, Homo sapiens
actgcccacctgccaggc

SEQ ID NO: 4770874 - DNA, 16 bp, Homo sapiens
actgcccgcacaccct

SEQ ID NO: 4770875 - DNA, 19 bp, Homo sapiens
actgcccgcacaccctcac

SEQ ID NO: 4770876 - DNA, 15 bp, Homo sapiens
actgccctctgccac

SEQ ID NO: 4770877 - DNA, 11 bp, Homo sapiens
actgcctctgc

SEQ ID NO: 4770878 - DNA, 12 bp, Homo sapiens
actgcctctgcc

SEQ ID NO: 4770879 - DNA, 13 bp, Homo sapiens
actgcctctgcca

SEQ ID NO: 4770880 - DNA, 14 bp, Homo sapiens
actgcctctgccac

SEQ ID NO: 4770881 - DNA, 15 bp, Homo sapiens
actgcctctgccaca

SEQ ID NO: 4770882 - DNA, 22 bp, Homo sapiens
actgcctctgccttagaggagc

SEQ ID NO: 4770883 - DNA, 14 bp, Homo sapiens
actgcctggaaagc

SEQ ID NO: 4770884 - DNA, 22 bp, Homo sapiens
actgccttatattattttctgt

SEQ ID NO: 4770885 - DNA, 23 bp, Homo sapiens
actgcctttcaaagtgcacacac

SEQ ID NO: 4770886 - DNA, 21 bp, Homo sapiens
actgctcaggctccccaagac

SEQ ID NO: 4770887 - DNA, 20 bp, Homo sapiens
actgctgcttaaaatgcaag

SEQ ID NO: 4770888 - DNA, 14 bp, Homo sapiens
actgcttaaggaaa

SEQ ID NO: 4770889 - DNA, 14 bp, Homo sapiens
actgctttttcctt

SEQ ID NO: 4770890 - DNA, 17 bp, Homo sapiens
actggaaacatctgatt

SEQ ID NO: 4770891 - DNA, 21 bp, Homo sapiens
actggaaacatctgatttctg

SEQ ID NO: 4770892 - DNA, 17 bp, Homo sapiens
actggaagggtccggct

SEQ ID NO: 4770893 - DNA, 17 bp, Homo sapiens
actggaggcatttcttt

SEQ ID NO: 4770894 - DNA, 16 bp, Homo sapiens
actggagtagttgcta

SEQ ID NO: 4770895 - DNA, 20 bp, Homo sapiens
actggcccacccctcttccc

SEQ ID NO: 4770896 - DNA, 10 bp, Homo sapiens
actggcccca

SEQ ID NO: 4770897 - DNA, 15 bp, Homo sapiens
actggccccagctcc

SEQ ID NO: 4770898 - DNA, 19 bp, Homo sapiens
actggccctcgggccctct

SEQ ID NO: 4770899 - DNA, 17 bp, Homo sapiens
actggccttgcctccag

SEQ ID NO: 4770900 - DNA, 16 bp, Homo sapiens
actggggaaacttcct

SEQ ID NO: 4770901 - DNA, 22 bp, Homo sapiens
actggggggcaggcctcccaag

SEQ ID NO: 4770902 - DNA, 17 bp, Homo sapiens
actgggtgttcaaggcc

SEQ ID NO: 4770903 - DNA, 18 bp, Homo sapiens
actggtaagattgttatt

SEQ ID NO: 4770904 - DNA, 13 bp, Homo sapiens
actggtggaagga

SEQ ID NO: 4770905 - DNA, 14 bp, Homo sapiens
actggttatttaaa

SEQ ID NO: 4770906 - DNA, 22 bp, Homo sapiens
actggtttttctgttccctgct

SEQ ID NO: 4770907 - DNA, 23 bp, Homo sapiens
actggtttttctgttccctgctg

SEQ ID NO: 4770908 - DNA, 21 bp, Homo sapiens
actgtacagattgctgcttct

SEQ ID NO: 4770909 - DNA, 14 bp, Homo sapiens
actgtagtaattgt

SEQ ID NO: 4770910 - DNA, 13 bp, Homo sapiens
actgtatatttgt

SEQ ID NO: 4770911 - DNA, 15 bp, Homo sapiens
actgtatatttgtat

SEQ ID NO: 4770912 - DNA, 17 bp, Homo sapiens
actgtccagagtctctt

SEQ ID NO: 4770913 - DNA, 17 bp, Homo sapiens
actgtcctgttgattaa

SEQ ID NO: 4770914 - DNA, 17 bp, Homo sapiens
actgtctgtaagagaat

SEQ ID NO: 4770915 - DNA, 17 bp, Homo sapiens
actgtcttactcaagat

SEQ ID NO: 4770916 - DNA, 19 bp, Homo sapiens
actgtcttagtcataccat

SEQ ID NO: 4770917 - DNA, 14 bp, Homo sapiens
actgtgaatatgtg

SEQ ID NO: 4770918 - DNA, 19 bp, Homo sapiens
actgtgaatatgtgtaact

SEQ ID NO: 4770919 - DNA, 12 bp, Homo sapiens
actgtgacattc

SEQ ID NO: 4770920 - DNA, 19 bp, Homo sapiens
actgtgacattccacagag

SEQ ID NO: 4770921 - DNA, 21 bp, Homo sapiens
actgtgacattccacagagtt

SEQ ID NO: 4770922 - DNA, 18 bp, Homo sapiens
actgtgagaactgtgaat

SEQ ID NO: 4770923 - DNA, 21 bp, Homo sapiens
actgtgagaactgtgaatatg

SEQ ID NO: 4770924 - DNA, 17 bp, Homo sapiens
actgtgagataaatatc

SEQ ID NO: 4770925 - DNA, 19 bp, Homo sapiens
actgtgagataaatatcat

SEQ ID NO: 4770926 - DNA, 23 bp, Homo sapiens
actgtggggtttttaatctcttg

SEQ ID NO: 4770927 - DNA, 21 bp, Homo sapiens
actgtggtcccagctacaggg

SEQ ID NO: 4770928 - DNA, 19 bp, Homo sapiens
actgtgtctcatggtccca

SEQ ID NO: 4770929 - DNA, 16 bp, Homo sapiens
actgttaacttattca

SEQ ID NO: 4770930 - DNA, 19 bp, Homo sapiens
actgttaagggaagctgat

SEQ ID NO: 4770931 - DNA, 18 bp, Homo sapiens
actgttatctcggacttt

SEQ ID NO: 4770932 - DNA, 20 bp, Homo sapiens
actgttcatgaatacgtaaa

SEQ ID NO: 4770933 - DNA, 20 bp, Homo sapiens
actgttcccagcaaagtttt

SEQ ID NO: 4770934 - DNA, 22 bp, Homo sapiens
actgttctaactagtaatcttg

SEQ ID NO: 4770935 - DNA, 18 bp, Homo sapiens
actgttggctgattggaa

SEQ ID NO: 4770936 - DNA, 22 bp, Homo sapiens
actgttggctgattggaaaata

SEQ ID NO: 4770937 - DNA, 23 bp, Homo sapiens
actgttggctgattggaaaataa

SEQ ID NO: 4770938 - DNA, 23 bp, Homo sapiens
actgtttataataggtggagact

SEQ ID NO: 4770939 - DNA, 18 bp, Homo sapiens
actgtttatggtattttc

SEQ ID NO: 4770940 - DNA, 14 bp, Homo sapiens
actgtttcttctca

SEQ ID NO: 4770941 - DNA, 14 bp, Homo sapiens
actgtttttgaaga

SEQ ID NO: 4770942 - DNA, 16 bp, Homo sapiens
acttaaaaatttatta

SEQ ID NO: 4770943 - DNA, 13 bp, Homo sapiens
acttaaaatcaaa

SEQ ID NO: 4770944 - DNA, 15 bp, Homo sapiens
acttaaacaaaaact

SEQ ID NO: 4770945 - DNA, 21 bp, Homo sapiens
acttaaacaaaaactttccat

SEQ ID NO: 4770946 - DNA, 23 bp, Homo sapiens
acttaaacaaaaactttccatga

SEQ ID NO: 4770947 - DNA, 21 bp, Homo sapiens
acttaaactttgtcacttctg

SEQ ID NO: 4770948 - DNA, 15 bp, Homo sapiens
acttaaagcttgttt

SEQ ID NO: 4770949 - DNA, 16 bp, Homo sapiens
acttaaagcttgtttg

SEQ ID NO: 4770950 - DNA, 11 bp, Homo sapiens
acttaatttag

SEQ ID NO: 4770951 - DNA, 20 bp, Homo sapiens
acttacacacctgagaatgt

SEQ ID NO: 4770952 - DNA, 14 bp, Homo sapiens
acttacactgaaat

SEQ ID NO: 4770953 - DNA, 18 bp, Homo sapiens
acttacactgaaatccaa

SEQ ID NO: 4770954 - DNA, 15 bp, Homo sapiens
acttagggagtgtgc

SEQ ID NO: 4770955 - DNA, 16 bp, Homo sapiens
acttagggagtgtgcc

SEQ ID NO: 4770956 - DNA, 13 bp, Homo sapiens
acttatctccagc

SEQ ID NO: 4770957 - DNA, 17 bp, Homo sapiens
acttatttataacattg

SEQ ID NO: 4770958 - DNA, 23 bp, Homo sapiens
acttatttataacattgtaaatg

SEQ ID NO: 4770959 - DNA, 23 bp, Homo sapiens
acttatttgctcataagtaaatg

SEQ ID NO: 4770960 - DNA, 12 bp, Homo sapiens
acttattttgat

SEQ ID NO: 4770961 - DNA, 15 bp, Homo sapiens
acttcaaaatattga

SEQ ID NO: 4770962 - DNA, 13 bp, Homo sapiens
acttcaaatgtgt

SEQ ID NO: 4770963 - DNA, 14 bp, Homo sapiens
acttcaaatgtgta

SEQ ID NO: 4770964 - DNA, 22 bp, Homo sapiens
acttcaaatgtgtaactttatt

SEQ ID NO: 4770965 - DNA, 16 bp, Homo sapiens
acttcagtcctgggag

SEQ ID NO: 4770966 - DNA, 20 bp, Homo sapiens
acttcagttctcatcttgta

SEQ ID NO: 4770967 - DNA, 18 bp, Homo sapiens
acttcatgctgtctgtgt

SEQ ID NO: 4770968 - DNA, 14 bp, Homo sapiens
acttcattgaaaat

SEQ ID NO: 4770969 - DNA, 21 bp, Homo sapiens
acttccaggttccatccacca

SEQ ID NO: 4770970 - DNA, 22 bp, Homo sapiens
acttccatttggaatcatatgg

SEQ ID NO: 4770971 - DNA, 12 bp, Homo sapiens
acttcccagctg

SEQ ID NO: 4770972 - DNA, 23 bp, Homo sapiens
acttcccagctggcagcgcctcc

SEQ ID NO: 4770973 - DNA, 14 bp, Homo sapiens
acttcccaggccga

SEQ ID NO: 4770974 - DNA, 14 bp, Homo sapiens
acttccccatctgt

SEQ ID NO: 4770975 - DNA, 16 bp, Homo sapiens
acttccccatctgtgt

SEQ ID NO: 4770976 - DNA, 20 bp, Homo sapiens
acttcccgggaacgcttgct

SEQ ID NO: 4770977 - DNA, 22 bp, Homo sapiens
acttcctataccggagctccag

SEQ ID NO: 4770978 - DNA, 17 bp, Homo sapiens
acttcgctattcccagg

SEQ ID NO: 4770979 - DNA, 18 bp, Homo sapiens
acttcgctattcccaggc

SEQ ID NO: 4770980 - DNA, 20 bp, Homo sapiens
acttcgctattcccaggcag

SEQ ID NO: 4770981 - DNA, 21 bp, Homo sapiens
acttcgggggcggctctggga

SEQ ID NO: 4770982 - DNA, 16 bp, Homo sapiens
acttctaaaataaatg

SEQ ID NO: 4770983 - DNA, 20 bp, Homo sapiens
acttctaaaataaatgtttt

SEQ ID NO: 4770984 - DNA, 22 bp, Homo sapiens
acttctaaaataaatgttttgg

SEQ ID NO: 4770985 - DNA, 14 bp, Homo sapiens
acttctactgagca

SEQ ID NO: 4770986 - DNA, 15 bp, Homo sapiens
acttctactgagcaa

SEQ ID NO: 4770987 - DNA, 23 bp, Homo sapiens
agactcgagagggctgagcccct

SEQ ID NO: 4770988 - DNA, 15 bp, Homo sapiens
agactcgcctgggaa

SEQ ID NO: 4770989 - DNA, 14 bp, Homo sapiens
agactctagatgtt

SEQ ID NO: 4770990 - DNA, 12 bp, Homo sapiens
agactgcccacc

SEQ ID NO: 4770991 - DNA, 13 bp, Homo sapiens
agactgcccaccc

SEQ ID NO: 4770992 - DNA, 21 bp, Homo sapiens
agactgcccaccctgggcctc

SEQ ID NO: 4770993 - DNA, 17 bp, Homo sapiens
agactgccttatattat

SEQ ID NO: 4770994 - DNA, 18 bp, Homo sapiens
agacttcaaaatattgag

SEQ ID NO: 4770995 - DNA, 17 bp, Homo sapiens
agacttcatccctctgg

SEQ ID NO: 4770996 - DNA, 22 bp, Homo sapiens
agacttcgctattcccaggcag

SEQ ID NO: 4770997 - DNA, 15 bp, Homo sapiens
agacttctaaaataa

SEQ ID NO: 4770998 - DNA, 19 bp, Homo sapiens
agacttctaaaataaatgt

SEQ ID NO: 4770999 - DNA, 22 bp, Homo sapiens
agacttctaaaataaatgtttt

SEQ ID NO: 4771000 - DNA, 17 bp, Homo sapiens
agacttctaaatcataa

SEQ ID NO: 4771001 - DNA, 19 bp, Homo sapiens
agactttctacatgcaaat

SEQ ID NO: 4771002 - DNA, 21 bp, Homo sapiens
agactttctacatgcaaatct

SEQ ID NO: 4771003 - DNA, 22 bp, Homo sapiens
agagaaaaaaaaatatgtgtac

SEQ ID NO: 4771004 - DNA, 23 bp, Homo sapiens
agagaaaaaaaaatatgtgtaca

SEQ ID NO: 4771005 - DNA, 19 bp, Homo sapiens
agagaaaatgctttctcat

SEQ ID NO: 4771006 - DNA, 17 bp, Homo sapiens
agagaagaaagaacgga

SEQ ID NO: 4771007 - DNA, 20 bp, Homo sapiens
agagaagccacgctgtcctc

SEQ ID NO: 4771008 - DNA, 13 bp, Homo sapiens
agagaagccataa

SEQ ID NO: 4771009 - DNA, 22 bp, Homo sapiens
agagaattctaagattgtacat

SEQ ID NO: 4771010 - DNA, 17 bp, Homo sapiens
agagacaaagtttggaa

SEQ ID NO: 4771011 - DNA, 23 bp, Homo sapiens
agagacaatttaaggcctgcact

SEQ ID NO: 4771012 - DNA, 19 bp, Homo sapiens
agagacacaagccttcggc

SEQ ID NO: 4771013 - DNA, 19 bp, Homo sapiens
agagaccacccatatcatg

SEQ ID NO: 4771014 - DNA, 18 bp, Homo sapiens
agagaccacttccttaac

SEQ ID NO: 4771015 - DNA, 19 bp, Homo sapiens
agagaccacttccttaaca

SEQ ID NO: 4771016 - DNA, 23 bp, Homo sapiens
agagaccacttccttaacagctg

SEQ ID NO: 4771017 - DNA, 23 bp, Homo sapiens
agagaccctgccaactttccaga

SEQ ID NO: 4771018 - DNA, 15 bp, Homo sapiens
agagacctgctccag

SEQ ID NO: 4771019 - DNA, 16 bp, Homo sapiens
agagacctgctccaga

SEQ ID NO: 4771020 - DNA, 20 bp, Homo sapiens
agagacctgctccagatcct

SEQ ID NO: 4771021 - DNA, 15 bp, Homo sapiens
agagacggcagcccc

SEQ ID NO: 4771022 - DNA, 19 bp, Homo sapiens
agagacggcagccccatcc

SEQ ID NO: 4771023 - DNA, 13 bp, Homo sapiens
agagactgcccac

SEQ ID NO: 4771024 - DNA, 14 bp, Homo sapiens
agagactgcccacc

SEQ ID NO: 4771025 - DNA, 16 bp, Homo sapiens
agagactgcccaccct

SEQ ID NO: 4771026 - DNA, 21 bp, Homo sapiens
agagactgcccaccctgggcc

SEQ ID NO: 4771027 - DNA, 22 bp, Homo sapiens
agagactgcccaccctgggcct

SEQ ID NO: 4771028 - DNA, 17 bp, Homo sapiens
agagacttctaaatcat

SEQ ID NO: 4771029 - DNA, 18 bp, Homo sapiens
agagacttgcagttagac

SEQ ID NO: 4771030 - DNA, 23 bp, Homo sapiens
agagacttgcagttagactcaaa

SEQ ID NO: 4771031 - DNA, 21 bp, Homo sapiens
agagagcaatcttgctgtgaa

SEQ ID NO: 4771032 - DNA, 22 bp, Homo sapiens
agagagcaatcttgctgtgaaa

SEQ ID NO: 4771033 - DNA, 24 bp, Homo sapiens
agagaggcctgggtgtgacctgac

SEQ ID NO: 4771034 - DNA, 19 bp, Homo sapiens
agagatatatctgaaaact

SEQ ID NO: 4771035 - DNA, 13 bp, Homo sapiens
agagatattttgt

SEQ ID NO: 4771036 - DNA, 15 bp, Homo sapiens
agagatattttgtaa

SEQ ID NO: 4771037 - DNA, 15 bp, Homo sapiens
agagatcaggaagag

SEQ ID NO: 4771038 - DNA, 15 bp, Homo sapiens
agagatggcagagcc

SEQ ID NO: 4771039 - DNA, 17 bp, Homo sapiens
agagatggcagagccat

SEQ ID NO: 4771040 - DNA, 23 bp, Homo sapiens
agagatgtccatttttacaagtt

SEQ ID NO: 4771041 - DNA, 17 bp, Homo sapiens
agagattggatcaagta

SEQ ID NO: 4771042 - DNA, 18 bp, Homo sapiens
agagattttatgtttaaa

SEQ ID NO: 4771043 - DNA, 18 bp, Homo sapiens
agagcaaagatggcttcc

SEQ ID NO: 4771044 - DNA, 19 bp, Homo sapiens
agagcaatcttgctgtgaa

SEQ ID NO: 4771045 - DNA, 20 bp, Homo sapiens
agagcaatcttgctgtgaaa

SEQ ID NO: 4771046 - DNA, 16 bp, Homo sapiens
agagcactgctccagt

SEQ ID NO: 4771047 - DNA, 14 bp, Homo sapiens
agagccacaataag

SEQ ID NO: 4771048 - DNA, 15 bp, Homo sapiens
agagccatccaccct

SEQ ID NO: 4771049 - DNA, 16 bp, Homo sapiens
agagccatccaccctg

SEQ ID NO: 4771050 - DNA, 24 bp, Homo sapiens
agagcccgcccacctgggccctag

SEQ ID NO: 4771051 - DNA, 22 bp, Homo sapiens
agagccctctgctgctttccaa

SEQ ID NO: 4771052 - DNA, 19 bp, Homo sapiens
agagcctccaggttcctca

SEQ ID NO: 4771053 - DNA, 21 bp, Homo sapiens
agagcctgttttaaaaaatac

SEQ ID NO: 4771054 - DNA, 16 bp, Homo sapiens
agagcgccacccgccc

SEQ ID NO: 4771055 - DNA, 13 bp, Homo sapiens
agagctatgcaca

SEQ ID NO: 4771056 - DNA, 16 bp, Homo sapiens
agagctcaggagaagg

SEQ ID NO: 4771057 - DNA, 18 bp, Homo sapiens
agagctcaggagaaggcc

SEQ ID NO: 4771058 - DNA, 14 bp, Homo sapiens
agagctgccacctg

SEQ ID NO: 4771059 - DNA, 19 bp, Homo sapiens
agagctgttctttttgact

SEQ ID NO: 4771060 - DNA, 21 bp, Homo sapiens
agagctgttctttttgactga

SEQ ID NO: 4771061 - DNA, 15 bp, Homo sapiens
agagctgttttggat

SEQ ID NO: 4771062 - DNA, 16 bp, Homo sapiens
agagcttcagaggtgg

SEQ ID NO: 4771063 - DNA, 22 bp, Homo sapiens
agagcttcccctaacctgggtt

SEQ ID NO: 4771064 - DNA, 17 bp, Homo sapiens
agaggaactccttggcc

SEQ ID NO: 4771065 - DNA, 21 bp, Homo sapiens
agaggaactccttggcctagc

SEQ ID NO: 4771066 - DNA, 16 bp, Homo sapiens
agaggaataaaatgat

SEQ ID NO: 4771067 - DNA, 21 bp, Homo sapiens
agaggaataaaatgattaagt

SEQ ID NO: 4771068 - DNA, 23 bp, Homo sapiens
agaggacagtttaggacccaagg

SEQ ID NO: 4771069 - DNA, 23 bp, Homo sapiens
agaggaccccattctgggactgc

SEQ ID NO: 4771070 - DNA, 15 bp, Homo sapiens
agaggagagaggacc

SEQ ID NO: 4771071 - DNA, 15 bp, Homo sapiens
agaggagaggctgct

SEQ ID NO: 4771072 - DNA, 14 bp, Homo sapiens
agaggaggtgtgga

SEQ ID NO: 4771073 - DNA, 19 bp, Homo sapiens
agaggattagtaagatctc

SEQ ID NO: 4771074 - DNA, 13 bp, Homo sapiens
agaggcagagacc

SEQ ID NO: 4771075 - DNA, 11 bp, Homo sapiens
agaggcagggc

SEQ ID NO: 4771076 - DNA, 13 bp, Homo sapiens
agaggcagggccc

SEQ ID NO: 4771077 - DNA, 16 bp, Homo sapiens
agaggcagggccctgg

SEQ ID NO: 4771078 - DNA, 17 bp, Homo sapiens
agaggcagggccctggg

SEQ ID NO: 4771079 - DNA, 12 bp, Homo sapiens
agaggcggcctc

SEQ ID NO: 4771080 - DNA, 14 bp, Homo sapiens
agagggaggggccc

SEQ ID NO: 4771081 - DNA, 23 bp, Homo sapiens
agagggatccaccgccacactgg

SEQ ID NO: 4771082 - DNA, 12 bp, Homo sapiens
agagggctgagc

SEQ ID NO: 4771083 - DNA, 15 bp, Homo sapiens
agagggctgagcccc

SEQ ID NO: 4771084 - DNA, 20 bp, Homo sapiens
agagggctgagcccctcctc

SEQ ID NO: 4771085 - DNA, 21 bp, Homo sapiens
agagggtgtgggtgccctgtt

SEQ ID NO: 4771086 - DNA, 15 bp, Homo sapiens
agaggtggatactgg

SEQ ID NO: 4771087 - DNA, 18 bp, Homo sapiens
agaggtggggtgctgggg

SEQ ID NO: 4771088 - DNA, 21 bp, Homo sapiens
agaggtggggtgctggggctg

SEQ ID NO: 4771089 - DNA, 15 bp, Homo sapiens
agaggtttcagcatt

SEQ ID NO: 4771090 - DNA, 16 bp, Homo sapiens
agagtaaaaccaaagg

SEQ ID NO: 4771091 - DNA, 12 bp, Homo sapiens
agagtactttgg

SEQ ID NO: 4771092 - DNA, 16 bp, Homo sapiens
agagtagggccctgac

SEQ ID NO: 4771093 - DNA, 18 bp, Homo sapiens
agagtagggccctgacag

SEQ ID NO: 4771094 - DNA, 17 bp, Homo sapiens
agagtatacaagtgttt

SEQ ID NO: 4771095 - DNA, 15 bp, Homo sapiens
agagtatatatgtac

SEQ ID NO: 4771096 - DNA, 17 bp, Homo sapiens
agagtatatatgtacag

SEQ ID NO: 4771097 - DNA, 14 bp, Homo sapiens
agagtatgtgtatg

SEQ ID NO: 4771098 - DNA, 15 bp, Homo sapiens
agagtatgtgtatgt

SEQ ID NO: 4771099 - DNA, 22 bp, Homo sapiens
agagtcgagtgatatggcttgt

SEQ ID NO: 4771100 - DNA, 19 bp, Homo sapiens
agagtgcccttaaaataat

SEQ ID NO: 4771101 - DNA, 17 bp, Homo sapiens
agagtggaaatggggaa

SEQ ID NO: 4771102 - DNA, 19 bp, Homo sapiens
agagtgtatgcatacaaat

SEQ ID NO: 4771103 - DNA, 16 bp, Homo sapiens
agagttatatgacttc

SEQ ID NO: 4771104 - DNA, 18 bp, Homo sapiens
agagttctccttgtactt

SEQ ID NO: 4771105 - DNA, 13 bp, Homo sapiens
agagttgaagaca

SEQ ID NO: 4771106 - DNA, 15 bp, Homo sapiens
agagttgaagacaga

SEQ ID NO: 4771107 - DNA, 12 bp, Homo sapiens
agataaatcatg

SEQ ID NO: 4771108 - DNA, 19 bp, Homo sapiens
agccaggagaccctgtctt

SEQ ID NO: 4771109 - DNA, 22 bp, Homo sapiens
agccaggcaacttcagtcctgg

SEQ ID NO: 4771110 - DNA, 14 bp, Homo sapiens
agccaggcctcccg

SEQ ID NO: 4771111 - DNA, 18 bp, Homo sapiens
agccaggcctcccgcatg

SEQ ID NO: 4771112 - DNA, 14 bp, Homo sapiens
agccagggttccag

SEQ ID NO: 4771113 - DNA, 17 bp, Homo sapiens
agccaggtgtcctgact

SEQ ID NO: 4771114 - DNA, 22 bp, Homo sapiens
agccaggtgtcctgactgtcct

SEQ ID NO: 4771115 - DNA, 23 bp, Homo sapiens
agccaggtgtcctgactgtccta

SEQ ID NO: 4771116 - DNA, 15 bp, Homo sapiens
agccatagccccagg

SEQ ID NO: 4771117 - DNA, 18 bp, Homo sapiens
agccatagccccaggccc

SEQ ID NO: 4771118 - DNA, 20 bp, Homo sapiens
agccatatattttctgagta

SEQ ID NO: 4771119 - DNA, 16 bp, Homo sapiens
agccatcagatgaggc

SEQ ID NO: 4771120 - DNA, 12 bp, Homo sapiens
agccatgctctt

SEQ ID NO: 4771121 - DNA, 13 bp, Homo sapiens
agccatggctgga

SEQ ID NO: 4771122 - DNA, 21 bp, Homo sapiens
agcccacggctaagaggctgc

SEQ ID NO: 4771123 - DNA, 22 bp, Homo sapiens
agcccacggctaagaggctgct

SEQ ID NO: 4771124 - DNA, 17 bp, Homo sapiens
agcccagaacgggcctc

SEQ ID NO: 4771125 - DNA, 21 bp, Homo sapiens
agcccagaacgggcctccccg

SEQ ID NO: 4771126 - DNA, 21 bp, Homo sapiens
agcccagagagaccctgccaa

SEQ ID NO: 4771127 - DNA, 17 bp, Homo sapiens
agcccatgtcaatcaag

SEQ ID NO: 4771128 - DNA, 12 bp, Homo sapiens
agccccaggccc

SEQ ID NO: 4771129 - DNA, 21 bp, Homo sapiens
agccccaggcccgccctgccc

SEQ ID NO: 4771130 - DNA, 14 bp, Homo sapiens
agccccagggccct

SEQ ID NO: 4771131 - DNA, 16 bp, Homo sapiens
agccccagggccctgc

SEQ ID NO: 4771132 - DNA, 20 bp, Homo sapiens
agccccatcccaaacccttc

SEQ ID NO: 4771133 - DNA, 19 bp, Homo sapiens
agccccatccttcccgcag

SEQ ID NO: 4771134 - DNA, 18 bp, Homo sapiens
agccccatctctcctgct

SEQ ID NO: 4771135 - DNA, 20 bp, Homo sapiens
agcccccacccccgtcaccc

SEQ ID NO: 4771136 - DNA, 21 bp, Homo sapiens
agcccccacccccgtcacccc

SEQ ID NO: 4771137 - DNA, 15 bp, Homo sapiens
agcccccgcccctcc

SEQ ID NO: 4771138 - DNA, 22 bp, Homo sapiens
agcccccgcccctccccctaca

SEQ ID NO: 4771139 - DNA, 23 bp, Homo sapiens
agccccgcgaccacccctgtgcg

SEQ ID NO: 4771140 - DNA, 22 bp, Homo sapiens
agcccctccccatggtgcagtg

SEQ ID NO: 4771141 - DNA, 11 bp, Homo sapiens
agcccctcctc

SEQ ID NO: 4771142 - DNA, 12 bp, Homo sapiens
agcccctcctct

SEQ ID NO: 4771143 - DNA, 13 bp, Homo sapiens
agcccctcctctc

SEQ ID NO: 4771144 - DNA, 15 bp, Homo sapiens
agcccctgtttctcc

SEQ ID NO: 4771145 - DNA, 13 bp, Homo sapiens
agcccgagcccct

SEQ ID NO: 4771146 - DNA, 16 bp, Homo sapiens
agcccgcccacctggg

SEQ ID NO: 4771147 - DNA, 18 bp, Homo sapiens
agcccgcccacctgggcc

SEQ ID NO: 4771148 - DNA, 22 bp, Homo sapiens
agcccgcctgcgccccccagtg

SEQ ID NO: 4771149 - DNA, 20 bp, Homo sapiens
agcccggccaaggacactga

SEQ ID NO: 4771150 - DNA, 22 bp, Homo sapiens
agcccggccaaggacactgatg

SEQ ID NO: 4771151 - DNA, 23 bp, Homo sapiens
agccctcatcttgaagggcccag

SEQ ID NO: 4771152 - DNA, 18 bp, Homo sapiens
agccctccgccagccctg

SEQ ID NO: 4771153 - DNA, 20 bp, Homo sapiens
agccctccgccagccctgtt

SEQ ID NO: 4771154 - DNA, 15 bp, Homo sapiens
agccctctttctctc

SEQ ID NO: 4771155 - DNA, 19 bp, Homo sapiens
agccctctttctctctgtg

SEQ ID NO: 4771156 - DNA, 24 bp, Homo sapiens
agccctctttctctctgtgtggca

SEQ ID NO: 4771157 - DNA, 15 bp, Homo sapiens
agccctgcagagggc

SEQ ID NO: 4771158 - DNA, 16 bp, Homo sapiens
agccctgcagagggca

SEQ ID NO: 4771159 - DNA, 12 bp, Homo sapiens
agccctgcccag

SEQ ID NO: 4771160 - DNA, 14 bp, Homo sapiens
agccctgcccagag

SEQ ID NO: 4771161 - DNA, 23 bp, Homo sapiens
agccctgccctcactccactccc

SEQ ID NO: 4771162 - DNA, 11 bp, Homo sapiens
agccctggccc

SEQ ID NO: 4771163 - DNA, 15 bp, Homo sapiens
agccctggcccggtc

SEQ ID NO: 4771164 - DNA, 13 bp, Homo sapiens
agccctggggctg

SEQ ID NO: 4771165 - DNA, 18 bp, Homo sapiens
agccctgttccgcctcac

SEQ ID NO: 4771166 - DNA, 23 bp, Homo sapiens
agcccttctaccttcctgcaaca

SEQ ID NO: 4771167 - DNA, 21 bp, Homo sapiens
agccgagatagccaaggccaa

SEQ ID NO: 4771168 - DNA, 15 bp, Homo sapiens
agccgcagaggcccg

SEQ ID NO: 4771169 - DNA, 20 bp, Homo sapiens
agccgcaggggcccctcctc

SEQ ID NO: 4771170 - DNA, 15 bp, Homo sapiens
agccgccttccttga

SEQ ID NO: 4771171 - DNA, 16 bp, Homo sapiens
agccgccttccttgac

SEQ ID NO: 4771172 - DNA, 17 bp, Homo sapiens
agccgccttccttgacc

SEQ ID NO: 4771173 - DNA, 14 bp, Homo sapiens
agccgcgctctgcc

SEQ ID NO: 4771174 - DNA, 17 bp, Homo sapiens
agccgcgctctgcccct

SEQ ID NO: 4771175 - DNA, 15 bp, Homo sapiens
agccgtcagcctgtg

SEQ ID NO: 4771176 - DNA, 14 bp, Homo sapiens
agcctaatattcat

SEQ ID NO: 4771177 - DNA, 16 bp, Homo sapiens
agcctaatattcatgc

SEQ ID NO: 4771178 - DNA, 15 bp, Homo sapiens
agcctatctctcttc

SEQ ID NO: 4771179 - DNA, 14 bp, Homo sapiens
agcctcacccttgc

SEQ ID NO: 4771180 - DNA, 13 bp, Homo sapiens
agcctcactgata

SEQ ID NO: 4771181 - DNA, 18 bp, Homo sapiens
agcctccaccttgagcac

SEQ ID NO: 4771182 - DNA, 11 bp, Homo sapiens
agcctccccca

SEQ ID NO: 4771183 - DNA, 15 bp, Homo sapiens
agcctcccccaggct

SEQ ID NO: 4771184 - DNA, 13 bp, Homo sapiens
agcctccccctca

SEQ ID NO: 4771185 - DNA, 23 bp, Homo sapiens
agcctccccctcagatgatctct

SEQ ID NO: 4771186 - DNA, 18 bp, Homo sapiens
agcctcctgcccttacct

SEQ ID NO: 4771187 - DNA, 20 bp, Homo sapiens
agcctctgaagttggacagc

SEQ ID NO: 4771188 - DNA, 14 bp, Homo sapiens
agcctgagctccac

SEQ ID NO: 4771189 - DNA, 18 bp, Homo sapiens
agcctgagtcagggccca

SEQ ID NO: 4771190 - DNA, 20 bp, Homo sapiens
agcctgagtcagggcccaga

SEQ ID NO: 4771191 - DNA, 21 bp, Homo sapiens
agcctgagtcagggcccagag

SEQ ID NO: 4771192 - DNA, 18 bp, Homo sapiens
agcctgcacacacctgcc

SEQ ID NO: 4771193 - DNA, 22 bp, Homo sapiens
agcctgcttcccacctccctgc

SEQ ID NO: 4771194 - DNA, 12 bp, Homo sapiens
agcctggcccca

SEQ ID NO: 4771195 - DNA, 15 bp, Homo sapiens
agcctggggcctggc

SEQ ID NO: 4771196 - DNA, 19 bp, Homo sapiens
agcctggggcctggcaggg

SEQ ID NO: 4771197 - DNA, 15 bp, Homo sapiens
agcctggtctgtgca

SEQ ID NO: 4771198 - DNA, 15 bp, Homo sapiens
agcctgtgggtcctt

SEQ ID NO: 4771199 - DNA, 21 bp, Homo sapiens
agcctgttgaaggactacagg

SEQ ID NO: 4771200 - DNA, 16 bp, Homo sapiens
agcctgttgtttaagt

SEQ ID NO: 4771201 - DNA, 17 bp, Homo sapiens
agcctgttttaaaaaat

SEQ ID NO: 4771202 - DNA, 17 bp, Homo sapiens
agccttaagtcttactg

SEQ ID NO: 4771203 - DNA, 12 bp, Homo sapiens
agccttattaaa

SEQ ID NO: 4771204 - DNA, 13 bp, Homo sapiens
agccttattaaaa

SEQ ID NO: 4771205 - DNA, 14 bp, Homo sapiens
agccttattaaaat

SEQ ID NO: 4771206 - DNA, 16 bp, Homo sapiens
agccttattaaaatat

SEQ ID NO: 4771207 - DNA, 23 bp, Homo sapiens
agccttattaaaatattttctta

SEQ ID NO: 4771208 - DNA, 17 bp, Homo sapiens
agcctttggtgaataac

SEQ ID NO: 4771209 - DNA, 13 bp, Homo sapiens
agcgacacaggct

SEQ ID NO: 4771210 - DNA, 19 bp, Homo sapiens
agcgacacaggctgccgct

SEQ ID NO: 4771211 - DNA, 17 bp, Homo sapiens
agcgacatctctgactt

SEQ ID NO: 4771212 - DNA, 20 bp, Homo sapiens
agcgacatctctgactttct

SEQ ID NO: 4771213 - DNA, 18 bp, Homo sapiens
agcgacctaaacagctgc

SEQ ID NO: 4771214 - DNA, 14 bp, Homo sapiens
agcgatgtgttctt

SEQ ID NO: 4771215 - DNA, 17 bp, Homo sapiens
agcgattcctgccaagt

SEQ ID NO: 4771216 - DNA, 19 bp, Homo sapiens
agcgattcctgccaagtag

SEQ ID NO: 4771217 - DNA, 20 bp, Homo sapiens
agcgcacctcgccgtgtctt

SEQ ID NO: 4771218 - DNA, 17 bp, Homo sapiens
agcgcagcccccacgcc

SEQ ID NO: 4771219 - DNA, 17 bp, Homo sapiens
agcgccccgcccccacc

SEQ ID NO: 4771220 - DNA, 20 bp, Homo sapiens
agcgccccgcccccacccct

SEQ ID NO: 4771221 - DNA, 19 bp, Homo sapiens
agcgcccgaggccagggcc

SEQ ID NO: 4771222 - DNA, 20 bp, Homo sapiens
agcgcctcccgccgcctcgg

SEQ ID NO: 4771223 - DNA, 15 bp, Homo sapiens
agcgcgtgccttccc

SEQ ID NO: 4771224 - DNA, 16 bp, Homo sapiens
agcgcgtgccttcccc

SEQ ID NO: 4771225 - DNA, 20 bp, Homo sapiens
agcggccccgcggagccccc

SEQ ID NO: 4771226 - DNA, 18 bp, Homo sapiens
agcggcccggcccacgca

SEQ ID NO: 4771227 - DNA, 21 bp, Homo sapiens
agcggcccggcccacgcagag

SEQ ID NO: 4771228 - DNA, 20 bp, Homo sapiens
agcggctgaggacggggcag

SEQ ID NO: 4771229 - DNA, 19 bp, Homo sapiens
agcgggagtctcctcactg

SEQ ID NO: 4771230 - DNA, 16 bp, Homo sapiens
aggaaaccttttcttg

SEQ ID NO: 4771231 - DNA, 16 bp, Homo sapiens
aggaaagcagtgcagt

SEQ ID NO: 4771232 - DNA, 23 bp, Homo sapiens
aggaaagccctcccccttcccct

SEQ ID NO: 4771233 - DNA, 16 bp, Homo sapiens
aggaaagtggatgcca

SEQ ID NO: 4771234 - DNA, 23 bp, Homo sapiens
aggaaatagtgttctttttaaaa

SEQ ID NO: 4771235 - DNA, 16 bp, Homo sapiens
aggaaatatctgtgaa

SEQ ID NO: 4771236 - DNA, 21 bp, Homo sapiens
aggaaatatctgtgaaggact

SEQ ID NO: 4771237 - DNA, 16 bp, Homo sapiens
aggaacaaggcaaggc

SEQ ID NO: 4771238 - DNA, 19 bp, Homo sapiens
aggaacaaggcaaggctgt

SEQ ID NO: 4771239 - DNA, 20 bp, Homo sapiens
aggaacaaggcaaggctgtc

SEQ ID NO: 4771240 - DNA, 16 bp, Homo sapiens
aggaacagagtatata

SEQ ID NO: 4771241 - DNA, 19 bp, Homo sapiens
aggaacccatcactgtgtc

SEQ ID NO: 4771242 - DNA, 20 bp, Homo sapiens
aggaacccatcactgtgtct

SEQ ID NO: 4771243 - DNA, 21 bp, Homo sapiens
aggaacccatcactgtgtctc

SEQ ID NO: 4771244 - DNA, 14 bp, Homo sapiens
aggaacctctgatt

SEQ ID NO: 4771245 - DNA, 22 bp, Homo sapiens
aggaacctctgatttattttgt

SEQ ID NO: 4771246 - DNA, 14 bp, Homo sapiens
aggaactccttggc

SEQ ID NO: 4771247 - DNA, 18 bp, Homo sapiens
aggaagaaggcccgggag

SEQ ID NO: 4771248 - DNA, 19 bp, Homo sapiens
aggaagacttcatccctct

SEQ ID NO: 4771249 - DNA, 14 bp, Homo sapiens
aggaagagaaggag

SEQ ID NO: 4771250 - DNA, 16 bp, Homo sapiens
aggaagagaaggagca

SEQ ID NO: 4771251 - DNA, 22 bp, Homo sapiens
aggaagaggggcgctgccccca

SEQ ID NO: 4771252 - DNA, 11 bp, Homo sapiens
aggaagcacat

SEQ ID NO: 4771253 - DNA, 16 bp, Homo sapiens
aggaagcacatgcctc

SEQ ID NO: 4771254 - DNA, 13 bp, Homo sapiens
aggaagccagcag

SEQ ID NO: 4771255 - DNA, 15 bp, Homo sapiens
aggaagccagcaggc

SEQ ID NO: 4771256 - DNA, 18 bp, Homo sapiens
aggaagccagcaggctct

SEQ ID NO: 4771257 - DNA, 23 bp, Homo sapiens
aggaagccagcaggctctcaggc

SEQ ID NO: 4771258 - DNA, 16 bp, Homo sapiens
aggaaggcagggagga

SEQ ID NO: 4771259 - DNA, 20 bp, Homo sapiens
aggaaggcagggaggaggca

SEQ ID NO: 4771260 - DNA, 14 bp, Homo sapiens
aggaaggcctgggt

SEQ ID NO: 4771261 - DNA, 23 bp, Homo sapiens
aggaagggcccccggctcggcct

SEQ ID NO: 4771262 - DNA, 15 bp, Homo sapiens
aggaatgatattgct

SEQ ID NO: 4771263 - DNA, 15 bp, Homo sapiens
aggaatgctcaatgt

SEQ ID NO: 4771264 - DNA, 20 bp, Homo sapiens
aggaatgggccaagccaggg

SEQ ID NO: 4771265 - DNA, 18 bp, Homo sapiens
aggacaaggggtggaagg

SEQ ID NO: 4771266 - DNA, 18 bp, Homo sapiens
aggacactgatgggtcct

SEQ ID NO: 4771267 - DNA, 23 bp, Homo sapiens
aggacactgatgggtcctgctgc

SEQ ID NO: 4771268 - DNA, 23 bp, Homo sapiens
aggacagaaccaacgggtctgtg

SEQ ID NO: 4771269 - DNA, 21 bp, Homo sapiens
aggacagtgttcaaattctga

SEQ ID NO: 4771270 - DNA, 18 bp, Homo sapiens
aggacagtttaggaccca

SEQ ID NO: 4771271 - DNA, 16 bp, Homo sapiens
aggaccaccctgccaa

SEQ ID NO: 4771272 - DNA, 12 bp, Homo sapiens
aggaccaggagc

SEQ ID NO: 4771273 - DNA, 13 bp, Homo sapiens
aggacccaaggtg

SEQ ID NO: 4771274 - DNA, 21 bp, Homo sapiens
aggacccaaggtggtcttgga

SEQ ID NO: 4771275 - DNA, 19 bp, Homo sapiens
aggaccccattctgggact

SEQ ID NO: 4771276 - DNA, 14 bp, Homo sapiens
aggacccctgccct

SEQ ID NO: 4771277 - DNA, 15 bp, Homo sapiens
aggaccctcccaggt

SEQ ID NO: 4771278 - DNA, 11 bp, Homo sapiens
aggaccctggg

SEQ ID NO: 4771279 - DNA, 12 bp, Homo sapiens
aggaccctgggt

SEQ ID NO: 4771280 - DNA, 19 bp, Homo sapiens
aggaccgtggccctgccct

SEQ ID NO: 4771281 - DNA, 12 bp, Homo sapiens
aggacgcatgca

SEQ ID NO: 4771282 - DNA, 13 bp, Homo sapiens
aggacgcatgcag

SEQ ID NO: 4771283 - DNA, 14 bp, Homo sapiens
aggactacaggtat

SEQ ID NO: 4771284 - DNA, 16 bp, Homo sapiens
aggactccaggggctg

SEQ ID NO: 4771285 - DNA, 21 bp, Homo sapiens
aggactccaggggctggggac

SEQ ID NO: 4771286 - DNA, 21 bp, Homo sapiens
aggactctcacgatatgcaag

SEQ ID NO: 4771287 - DNA, 13 bp, Homo sapiens
aggactgaagaaa

SEQ ID NO: 4771288 - DNA, 14 bp, Homo sapiens
aggactgttctaac

SEQ ID NO: 4771289 - DNA, 18 bp, Homo sapiens
aggactgttggctgattg

SEQ ID NO: 4771290 - DNA, 14 bp, Homo sapiens
aggacttaatttag

SEQ ID NO: 4771291 - DNA, 13 bp, Homo sapiens
aggacttctgcag

SEQ ID NO: 4771292 - DNA, 15 bp, Homo sapiens
aggacttctgcagct

SEQ ID NO: 4771293 - DNA, 16 bp, Homo sapiens
aggagaaggcctgccc

SEQ ID NO: 4771294 - DNA, 22 bp, Homo sapiens
aggagaaggcctgccccccttc

SEQ ID NO: 4771295 - DNA, 17 bp, Homo sapiens
aggagagattatttaca

SEQ ID NO: 4771296 - DNA, 21 bp, Homo sapiens
aggagagccctctgctgcttt

SEQ ID NO: 4771297 - DNA, 17 bp, Homo sapiens
aggagatgaggctggat

SEQ ID NO: 4771298 - DNA, 15 bp, Homo sapiens
aggagattgctctgg

SEQ ID NO: 4771299 - DNA, 13 bp, Homo sapiens
aggagcaaacagg

SEQ ID NO: 4771300 - DNA, 20 bp, Homo sapiens
aggagcacacatccaagagg

SEQ ID NO: 4771301 - DNA, 22 bp, Homo sapiens
aggagcacacatccaagaggga

SEQ ID NO: 4771302 - DNA, 14 bp, Homo sapiens
aggagcacagccat

SEQ ID NO: 4771303 - DNA, 16 bp, Homo sapiens
aggagcacagccatag

SEQ ID NO: 4771304 - DNA, 13 bp, Homo sapiens
aggagcaccccca

SEQ ID NO: 4771305 - DNA, 17 bp, Homo sapiens
aggagcacccccagcct

SEQ ID NO: 4771306 - DNA, 23 bp, Homo sapiens
aggagcacccccagcctccccca

SEQ ID NO: 4771307 - DNA, 13 bp, Homo sapiens
aggagcactagaa

SEQ ID NO: 4771308 - DNA, 20 bp, Homo sapiens
aggagcatgtcctatccctg

SEQ ID NO: 4771309 - DNA, 22 bp, Homo sapiens
aggagcatgtcctatccctgga

SEQ ID NO: 4771310 - DNA, 15 bp, Homo sapiens
aggagccagcagggc

SEQ ID NO: 4771311 - DNA, 21 bp, Homo sapiens
aggagccagcagggcgggcca

SEQ ID NO: 4771312 - DNA, 24 bp, Homo sapiens
aggagcccacggctaagaggctgc

SEQ ID NO: 4771313 - DNA, 22 bp, Homo sapiens
aggagctagtgttaatccagag

SEQ ID NO: 4771314 - DNA, 18 bp, Homo sapiens
aggagctcacaccgcacc

SEQ ID NO: 4771315 - DNA, 13 bp, Homo sapiens
aggagctcccttt

SEQ ID NO: 4771316 - DNA, 22 bp, Homo sapiens
aggagctccctttttgaattgt

SEQ ID NO: 4771317 - DNA, 16 bp, Homo sapiens
aggagcttccagatgg

SEQ ID NO: 4771318 - DNA, 12 bp, Homo sapiens
aggaggacaggg

SEQ ID NO: 4771319 - DNA, 23 bp, Homo sapiens
aggaggacctggggggggcaaga

SEQ ID NO: 4771320 - DNA, 14 bp, Homo sapiens
aggaggcctgggag

SEQ ID NO: 4771321 - DNA, 15 bp, Homo sapiens
aggaggcctgggaga

SEQ ID NO: 4771322 - DNA, 15 bp, Homo sapiens
aggagggaaaccttt

SEQ ID NO: 4771323 - DNA, 14 bp, Homo sapiens
aggaggggagcaag

SEQ ID NO: 4771324 - DNA, 16 bp, Homo sapiens
aggagtctgattgcag

SEQ ID NO: 4771325 - DNA, 22 bp, Homo sapiens
aggagtgactctggctgccaag

SEQ ID NO: 4771326 - DNA, 14 bp, Homo sapiens
aggagtgggctctg

SEQ ID NO: 4771327 - DNA, 23 bp, Homo sapiens
aggagttattaaagtaatttaca

SEQ ID NO: 4771328 - DNA, 21 bp, Homo sapiens
aggataaataataaaggttct

SEQ ID NO: 4771329 - DNA, 20 bp, Homo sapiens
aggatacccggtggcttctg

SEQ ID NO: 4771330 - DNA, 23 bp, Homo sapiens
aggatacccggtggcttctggca

SEQ ID NO: 4771331 - DNA, 15 bp, Homo sapiens
aggatcctggcctga

SEQ ID NO: 4771332 - DNA, 17 bp, Homo sapiens
aggatcctggcctgaga

SEQ ID NO: 4771333 - DNA, 15 bp, Homo sapiens
aggatctgtccgaca

SEQ ID NO: 4771334 - DNA, 16 bp, Homo sapiens
aggatcttcactgtct

SEQ ID NO: 4771335 - DNA, 20 bp, Homo sapiens
aggatgacggtattatgctt

SEQ ID NO: 4771336 - DNA, 23 bp, Homo sapiens
aggatgaggaacctcaaactggg

SEQ ID NO: 4771337 - DNA, 23 bp, Homo sapiens
aggatgggcagctggggggctgt

SEQ ID NO: 4771338 - DNA, 20 bp, Homo sapiens
aggattcttttttcaatgta

SEQ ID NO: 4771339 - DNA, 19 bp, Homo sapiens
aggattgtccacaaatgtc

SEQ ID NO: 4771340 - DNA, 21 bp, Homo sapiens
aggattgtctgctgcctccaa

SEQ ID NO: 4771341 - DNA, 14 bp, Homo sapiens
aggatttattctca

SEQ ID NO: 4771342 - DNA, 12 bp, Homo sapiens
aggatttctgct

SEQ ID NO: 4771343 - DNA, 14 bp, Homo sapiens
aggcaaatgtccaa

SEQ ID NO: 4771344 - DNA, 17 bp, Homo sapiens
aggcaacttcagtcctg

SEQ ID NO: 4771345 - DNA, 19 bp, Homo sapiens
aggcaacttcagtcctggg

SEQ ID NO: 4771346 - DNA, 13 bp, Homo sapiens
aggcaagaagtgg

SEQ ID NO: 4771347 - DNA, 15 bp, Homo sapiens
aggcaagaagtggga

SEQ ID NO: 4771348 - DNA, 17 bp, Homo sapiens
aggcaagaagtgggatt

SEQ ID NO: 4771349 - DNA, 14 bp, Homo sapiens
aggcacacagcagc

SEQ ID NO: 4771350 - DNA, 17 bp, Homo sapiens
aggcacacagcagcccc

SEQ ID NO: 4771351 - DNA, 17 bp, Homo sapiens
aggcacaggtgtaaata

SEQ ID NO: 4771352 - DNA, 22 bp, Homo sapiens
aggtttgggggacgcccagccc

SEQ ID NO: 4771353 - DNA, 20 bp, Homo sapiens
agtaaaacagatttgttcat

SEQ ID NO: 4771354 - DNA, 15 bp, Homo sapiens
agtaaaaccaaaggt

SEQ ID NO: 4771355 - DNA, 19 bp, Homo sapiens
agtaaaacttgtattggaa

SEQ ID NO: 4771356 - DNA, 12 bp, Homo sapiens
agtaaaattatc

SEQ ID NO: 4771357 - DNA, 14 bp, Homo sapiens
agtaaaattatctg

SEQ ID NO: 4771358 - DNA, 20 bp, Homo sapiens
agtaaaattatctgttctat

SEQ ID NO: 4771359 - DNA, 20 bp, Homo sapiens
agtaaatatacactttacat

SEQ ID NO: 4771360 - DNA, 18 bp, Homo sapiens
agtaaatccacagtgagt

SEQ ID NO: 4771361 - DNA, 20 bp, Homo sapiens
agtaaatctatctctatata

SEQ ID NO: 4771362 - DNA, 18 bp, Homo sapiens
agtaagatctctttctaa

SEQ ID NO: 4771363 - DNA, 14 bp, Homo sapiens
agtaagttctgaaa

SEQ ID NO: 4771364 - DNA, 14 bp, Homo sapiens
agtaatctgtataa

SEQ ID NO: 4771365 - DNA, 19 bp, Homo sapiens
agtaatctgtataatactt

SEQ ID NO: 4771366 - DNA, 16 bp, Homo sapiens
agtaatctttcggtct

SEQ ID NO: 4771367 - DNA, 18 bp, Homo sapiens
agtaattttcttctcatt

SEQ ID NO: 4771368 - DNA, 20 bp, Homo sapiens
agtaattttcttctcattct

SEQ ID NO: 4771369 - DNA, 14 bp, Homo sapiens
agtacaataaataa

SEQ ID NO: 4771370 - DNA, 20 bp, Homo sapiens
agtacagggcagaaccaaga

SEQ ID NO: 4771371 - DNA, 15 bp, Homo sapiens
agtacatcttgtgca

SEQ ID NO: 4771372 - DNA, 17 bp, Homo sapiens
agtacatcttgtgcatg

SEQ ID NO: 4771373 - DNA, 19 bp, Homo sapiens
agtacatcttgtgcatgca

SEQ ID NO: 4771374 - DNA, 22 bp, Homo sapiens
agtacatcttgtgcatgcaaaa

SEQ ID NO: 4771375 - DNA, 14 bp, Homo sapiens
agtaccatcccact

SEQ ID NO: 4771376 - DNA, 16 bp, Homo sapiens
agtaccatcccactga

SEQ ID NO: 4771377 - DNA, 17 bp, Homo sapiens
agtaccatcccactgat

SEQ ID NO: 4771378 - DNA, 15 bp, Homo sapiens
agtactagcaataag

SEQ ID NO: 4771379 - DNA, 21 bp, Homo sapiens
agtactggtaagattgttatt

SEQ ID NO: 4771380 - DNA, 20 bp, Homo sapiens
agtactgtactttcccaggt

SEQ ID NO: 4771381 - DNA, 13 bp, Homo sapiens
agtacttaatagt

SEQ ID NO: 4771382 - DNA, 16 bp, Homo sapiens
agtagagtcaggagaa

SEQ ID NO: 4771383 - DNA, 20 bp, Homo sapiens
agtagcatactgatgagaca

SEQ ID NO: 4771384 - DNA, 22 bp, Homo sapiens
agtagcattttaatagtttcta

SEQ ID NO: 4771385 - DNA, 18 bp, Homo sapiens
agtagctccgcgtgtctc

SEQ ID NO: 4771386 - DNA, 23 bp, Homo sapiens
agtagctccttggttttgcctct

SEQ ID NO: 4771387 - DNA, 20 bp, Homo sapiens
agtagggccctgacaggcct

SEQ ID NO: 4771388 - DNA, 14 bp, Homo sapiens
agtaggtctgcaca

SEQ ID NO: 4771389 - DNA, 23 bp, Homo sapiens
agtaggtctgcacacataacaca

SEQ ID NO: 4771390 - DNA, 20 bp, Homo sapiens
agtaggtgggtcttggattg

SEQ ID NO: 4771391 - DNA, 14 bp, Homo sapiens
agtagtgtctggat

SEQ ID NO: 4771392 - DNA, 21 bp, Homo sapiens
agtagttgatgaccaatctct

SEQ ID NO: 4771393 - DNA, 22 bp, Homo sapiens
agtagttgatgaccaatctctg

SEQ ID NO: 4771394 - DNA, 17 bp, Homo sapiens
agtataaattacatgca

SEQ ID NO: 4771395 - DNA, 16 bp, Homo sapiens
agtatacaagtgtttc

SEQ ID NO: 4771396 - DNA, 20 bp, Homo sapiens
agtatacacatcataaacaa

SEQ ID NO: 4771397 - DNA, 21 bp, Homo sapiens
agtatacacatcataaacaaa

SEQ ID NO: 4771398 - DNA, 15 bp, Homo sapiens
agtatagataaatcc

SEQ ID NO: 4771399 - DNA, 12 bp, Homo sapiens
agtatagatggt

SEQ ID NO: 4771400 - DNA, 17 bp, Homo sapiens
agtatagatggtagaaa

SEQ ID NO: 4771401 - DNA, 19 bp, Homo sapiens
agtatatacagagcctgtt

SEQ ID NO: 4771402 - DNA, 23 bp, Homo sapiens
agtatatacagagcctgttttaa

SEQ ID NO: 4771403 - DNA, 14 bp, Homo sapiens
agtatattcaaaaa

SEQ ID NO: 4771404 - DNA, 18 bp, Homo sapiens
agtatattcaaaaattat

SEQ ID NO: 4771405 - DNA, 13 bp, Homo sapiens
agtatattttatt

SEQ ID NO: 4771406 - DNA, 19 bp, Homo sapiens
agtatattttatttcaatg

SEQ ID NO: 4771407 - DNA, 13 bp, Homo sapiens
agtatcctggatt

SEQ ID NO: 4771408 - DNA, 11 bp, Homo sapiens
agtatcttgaa

SEQ ID NO: 4771409 - DNA, 12 bp, Homo sapiens
agtatcttgaag

SEQ ID NO: 4771410 - DNA, 22 bp, Homo sapiens
agtatgcactaatcaatacttt

SEQ ID NO: 4771411 - DNA, 13 bp, Homo sapiens
agtatgtgtatgt

SEQ ID NO: 4771412 - DNA, 14 bp, Homo sapiens
agtatgtgtatgta

SEQ ID NO: 4771413 - DNA, 22 bp, Homo sapiens
agtatgtgtatgtacttacatg

SEQ ID NO: 4771414 - DNA, 14 bp, Homo sapiens
agtattatagatat

SEQ ID NO: 4771415 - DNA, 15 bp, Homo sapiens
agtattatttagtaa

SEQ ID NO: 4771416 - DNA, 14 bp, Homo sapiens
agtattccacctta

SEQ ID NO: 4771417 - DNA, 14 bp, Homo sapiens
agtattccttggcc

SEQ ID NO: 4771418 - DNA, 22 bp, Homo sapiens
agtattctgtagccaacttaaa

SEQ ID NO: 4771419 - DNA, 21 bp, Homo sapiens
agtattgacaataagaaacag

SEQ ID NO: 4771420 - DNA, 14 bp, Homo sapiens
agtattgagacact

SEQ ID NO: 4771421 - DNA, 18 bp, Homo sapiens
agtattgagacactgtca

SEQ ID NO: 4771422 - DNA, 13 bp, Homo sapiens
agtatttaacatt

SEQ ID NO: 4771423 - DNA, 15 bp, Homo sapiens
agtatttaacattct

SEQ ID NO: 4771424 - DNA, 12 bp, Homo sapiens
agtattttgagc

SEQ ID NO: 4771425 - DNA, 21 bp, Homo sapiens
agtattttgagccttattaaa

SEQ ID NO: 4771426 - DNA, 23 bp, Homo sapiens
agtattttgagccttattaaaat

SEQ ID NO: 4771427 - DNA, 21 bp, Homo sapiens
agtcaaaataatctgaaatga

SEQ ID NO: 4771428 - DNA, 17 bp, Homo sapiens
agtcaaacagtgtggct

SEQ ID NO: 4771429 - DNA, 16 bp, Homo sapiens
agtcaagctgatgaag

SEQ ID NO: 4771430 - DNA, 16 bp, Homo sapiens
agtcaagtgtgcctgc

SEQ ID NO: 4771431 - DNA, 16 bp, Homo sapiens
agtcaatcaaacaggg

SEQ ID NO: 4771432 - DNA, 23 bp, Homo sapiens
agtcaattgcttgagcatgccca

SEQ ID NO: 4771433 - DNA, 14 bp, Homo sapiens
agtcaccttccagg

SEQ ID NO: 4771434 - DNA, 16 bp, Homo sapiens
agtcactaaaaggaag

SEQ ID NO: 4771435 - DNA, 21 bp, Homo sapiens
agtcactaaaaggaagacagt

SEQ ID NO: 4771436 - DNA, 16 bp, Homo sapiens
agtcagcccagtggga

SEQ ID NO: 4771437 - DNA, 18 bp, Homo sapiens
agtcagcggagaggaccc

SEQ ID NO: 4771438 - DNA, 22 bp, Homo sapiens
agtcagctccgagtggctcccg

SEQ ID NO: 4771439 - DNA, 13 bp, Homo sapiens
agtcaggagccag

SEQ ID NO: 4771440 - DNA, 15 bp, Homo sapiens
agtcaggagccagca

SEQ ID NO: 4771441 - DNA, 16 bp, Homo sapiens
agtcagggctgtgctt

SEQ ID NO: 4771442 - DNA, 21 bp, Homo sapiens
agtcagtgtactctgagtcct

SEQ ID NO: 4771443 - DNA, 16 bp, Homo sapiens
agtcatatgtgaagac

SEQ ID NO: 4771444 - DNA, 15 bp, Homo sapiens
agtcatgatgaatca

SEQ ID NO: 4771445 - DNA, 17 bp, Homo sapiens
agtcattctagagggat

SEQ ID NO: 4771446 - DNA, 19 bp, Homo sapiens
agtccacccccattgtgaa

SEQ ID NO: 4771447 - DNA, 22 bp, Homo sapiens
agtccacgccgggtcgcctgcc

SEQ ID NO: 4771448 - DNA, 13 bp, Homo sapiens
agtccactttcct

SEQ ID NO: 4771449 - DNA, 20 bp, Homo sapiens
agtccactttcctctctctc

SEQ ID NO: 4771450 - DNA, 12 bp, Homo sapiens
agtccagacacc

SEQ ID NO: 4771451 - DNA, 20 bp, Homo sapiens
agtccatgtgataattgtaa

SEQ ID NO: 4771452 - DNA, 13 bp, Homo sapiens
agtccatttttga

SEQ ID NO: 4771453 - DNA, 18 bp, Homo sapiens
agtccatttttgagtaaa

SEQ ID NO: 4771454 - DNA, 21 bp, Homo sapiens
agtccatttttgagtaaaact

SEQ ID NO: 4771455 - DNA, 15 bp, Homo sapiens
agtcccacagcccct

SEQ ID NO: 4771456 - DNA, 20 bp, Homo sapiens
agtcccgtgccctgtttcca

SEQ ID NO: 4771457 - DNA, 15 bp, Homo sapiens
agtccctccctcctg

SEQ ID NO: 4771458 - DNA, 16 bp, Homo sapiens
agtccctccctcctgg

SEQ ID NO: 4771459 - DNA, 19 bp, Homo sapiens
agtccctccctcctggctc

SEQ ID NO: 4771460 - DNA, 18 bp, Homo sapiens
agtccctcctcccccacg

SEQ ID NO: 4771461 - DNA, 22 bp, Homo sapiens
agtccgccccgtgctcctctgc

SEQ ID NO: 4771462 - DNA, 19 bp, Homo sapiens
agtcctagaatgtttcatt

SEQ ID NO: 4771463 - DNA, 19 bp, Homo sapiens
agtcctcaccttctgtttt

SEQ ID NO: 4771464 - DNA, 16 bp, Homo sapiens
agtcctcgccccccgc

SEQ ID NO: 4771465 - DNA, 22 bp, Homo sapiens
agtcctggcatgggaatgaatg

SEQ ID NO: 4771466 - DNA, 16 bp, Homo sapiens
agtcgatattcccagg

SEQ ID NO: 4771467 - DNA, 19 bp, Homo sapiens
agtcggctgggcagggccg

SEQ ID NO: 4771468 - DNA, 20 bp, Homo sapiens
agtctaaatttattatttaa

SEQ ID NO: 4771469 - DNA, 21 bp, Homo sapiens
agtctaagaacccatggaaaa

SEQ ID NO: 4771470 - DNA, 19 bp, Homo sapiens
agtctatgctgtgtgcaga

SEQ ID NO: 4771471 - DNA, 16 bp, Homo sapiens
agtctcaatgaaatag

SEQ ID NO: 4771472 - DNA, 16 bp, Homo sapiens
agtctcaatgttccat

SEQ ID NO: 4771473 - DNA, 15 bp, Homo sapiens
agtctcctcactgcc

SEQ ID NO: 4771474 - DNA, 19 bp, Homo sapiens
ataaggatttattctcaga

SEQ ID NO: 4771475 - DNA, 15 bp, Homo sapiens
ataagtaaatgtctt

SEQ ID NO: 4771476 - DNA, 23 bp, Homo sapiens
ataagtcaaaataatctgaaatg

SEQ ID NO: 4771477 - DNA, 15 bp, Homo sapiens
ataagtgctcagtat

SEQ ID NO: 4771478 - DNA, 17 bp, Homo sapiens
ataagttgaatgataat

SEQ ID NO: 4771479 - DNA, 12 bp, Homo sapiens
ataataaaattc

SEQ ID NO: 4771480 - DNA, 22 bp, Homo sapiens
ataataaagtattccaccttaa

SEQ ID NO: 4771481 - DNA, 16 bp, Homo sapiens
ataataaatatatatt

SEQ ID NO: 4771482 - DNA, 16 bp, Homo sapiens
ataataactagatctc

SEQ ID NO: 4771483 - DNA, 21 bp, Homo sapiens
ataataactagatctcctgta

SEQ ID NO: 4771484 - DNA, 14 bp, Homo sapiens
ataatactttgtat

SEQ ID NO: 4771485 - DNA, 18 bp, Homo sapiens
ataatactttgtatacaa

SEQ ID NO: 4771486 - DNA, 21 bp, Homo sapiens
ataatactttgtatacaagta

SEQ ID NO: 4771487 - DNA, 18 bp, Homo sapiens
ataatataaatgaatgaa

SEQ ID NO: 4771488 - DNA, 18 bp, Homo sapiens
ataatatcctgaataact

SEQ ID NO: 4771489 - DNA, 20 bp, Homo sapiens
ataatatttaggcatgagct

SEQ ID NO: 4771490 - DNA, 21 bp, Homo sapiens
ataatcatccttttttaaaaa

SEQ ID NO: 4771491 - DNA, 22 bp, Homo sapiens
ataatctgaaatgacaggatat

SEQ ID NO: 4771492 - DNA, 14 bp, Homo sapiens
ataatgagatgtaa

SEQ ID NO: 4771493 - DNA, 14 bp, Homo sapiens
ataatgcatctaaa

SEQ ID NO: 4771494 - DNA, 15 bp, Homo sapiens
ataatgcctttgtaa

SEQ ID NO: 4771495 - DNA, 16 bp, Homo sapiens
ataatgcctttgtaac

SEQ ID NO: 4771496 - DNA, 14 bp, Homo sapiens
ataatggccctgta

SEQ ID NO: 4771497 - DNA, 17 bp, Homo sapiens
ataatggccctgtagct

SEQ ID NO: 4771498 - DNA, 17 bp, Homo sapiens
ataatggcctcttaaaa

SEQ ID NO: 4771499 - DNA, 22 bp, Homo sapiens
ataatggcctggtaggtctgga

SEQ ID NO: 4771500 - DNA, 12 bp, Homo sapiens
ataatggctctg

SEQ ID NO: 4771501 - DNA, 20 bp, Homo sapiens
ataatgggctgcaaaatgaa

SEQ ID NO: 4771502 - DNA, 12 bp, Homo sapiens
ataattgtaaag

SEQ ID NO: 4771503 - DNA, 16 bp, Homo sapiens
ataattgtcatgactt

SEQ ID NO: 4771504 - DNA, 18 bp, Homo sapiens
ataatttacctgaagtct

SEQ ID NO: 4771505 - DNA, 11 bp, Homo sapiens
atacaaacagg

SEQ ID NO: 4771506 - DNA, 16 bp, Homo sapiens
atacaaccttcattta

SEQ ID NO: 4771507 - DNA, 21 bp, Homo sapiens
atacaactttggaatttgaag

SEQ ID NO: 4771508 - DNA, 13 bp, Homo sapiens
atacaagtgtttc

SEQ ID NO: 4771509 - DNA, 10 bp, Homo sapiens
atacacacac

SEQ ID NO: 4771510 - DNA, 18 bp, Homo sapiens
atacagagcctgttttaa

SEQ ID NO: 4771511 - DNA, 23 bp, Homo sapiens
atacagatggtgtcctgcatgta

SEQ ID NO: 4771512 - DNA, 14 bp, Homo sapiens
atacatatacacaa

SEQ ID NO: 4771513 - DNA, 12 bp, Homo sapiens
atacatatgtat

SEQ ID NO: 4771514 - DNA, 18 bp, Homo sapiens
atacatatgtatgtgtga

SEQ ID NO: 4771515 - DNA, 19 bp, Homo sapiens
atacatattcaaagtatat

SEQ ID NO: 4771516 - DNA, 14 bp, Homo sapiens
atacattagacaca

SEQ ID NO: 4771517 - DNA, 15 bp, Homo sapiens
atacattagacacac

SEQ ID NO: 4771518 - DNA, 21 bp, Homo sapiens
atacattagacacacatatac

SEQ ID NO: 4771519 - DNA, 20 bp, Homo sapiens
atacattatttctgtatata

SEQ ID NO: 4771520 - DNA, 23 bp, Homo sapiens
atacattatttctgtatatagat

SEQ ID NO: 4771521 - DNA, 23 bp, Homo sapiens
atacattccagtgtattttctgt

SEQ ID NO: 4771522 - DNA, 19 bp, Homo sapiens
ataccaggttacctcactt

SEQ ID NO: 4771523 - DNA, 15 bp, Homo sapiens
ataccagttcttgca

SEQ ID NO: 4771524 - DNA, 18 bp, Homo sapiens
ataccagttcttgcaata

SEQ ID NO: 4771525 - DNA, 15 bp, Homo sapiens
ataccattttgaaat

SEQ ID NO: 4771526 - DNA, 17 bp, Homo sapiens
ataccccctgccccaga

SEQ ID NO: 4771527 - DNA, 23 bp, Homo sapiens
atacccggtggcttctggcacct

SEQ ID NO: 4771528 - DNA, 22 bp, Homo sapiens
ataccggagctccagtttctct

SEQ ID NO: 4771529 - DNA, 16 bp, Homo sapiens
atacctctaataacct

SEQ ID NO: 4771530 - DNA, 14 bp, Homo sapiens
atacctctctctat

SEQ ID NO: 4771531 - DNA, 13 bp, Homo sapiens
atacctctgacca

SEQ ID NO: 4771532 - DNA, 14 bp, Homo sapiens
ataccttctgatga

SEQ ID NO: 4771533 - DNA, 24 bp, Homo sapiens
atacgtgcccatttcacacaactg

SEQ ID NO: 4771534 - DNA, 12 bp, Homo sapiens
atactaataaaa

SEQ ID NO: 4771535 - DNA, 22 bp, Homo sapiens
atactaataaaatacatactat

SEQ ID NO: 4771536 - DNA, 22 bp, Homo sapiens
atactacatttgaacagggcaa

SEQ ID NO: 4771537 - DNA, 18 bp, Homo sapiens
atactatagattctttat

SEQ ID NO: 4771538 - DNA, 22 bp, Homo sapiens
atactattggacagacacagag

SEQ ID NO: 4771539 - DNA, 22 bp, Homo sapiens
atactcaaagaggccagtactt

SEQ ID NO: 4771540 - DNA, 22 bp, Homo sapiens
atactcatttggatataaatct

SEQ ID NO: 4771541 - DNA, 17 bp, Homo sapiens
atactccttaaaaatgt

SEQ ID NO: 4771542 - DNA, 22 bp, Homo sapiens
atactccttaaaaatgtatgtt

SEQ ID NO: 4771543 - DNA, 18 bp, Homo sapiens
atactgaattgttatgta

SEQ ID NO: 4771544 - DNA, 22 bp, Homo sapiens
atactgactccaaccattcaaa

SEQ ID NO: 4771545 - DNA, 17 bp, Homo sapiens
atactgatgagacaaca

SEQ ID NO: 4771546 - DNA, 20 bp, Homo sapiens
atactgatgagacaacacac

SEQ ID NO: 4771547 - DNA, 22 bp, Homo sapiens
atactggaaataacctgtgaat

SEQ ID NO: 4771548 - DNA, 13 bp, Homo sapiens
atactgtgtgtga

SEQ ID NO: 4771549 - DNA, 21 bp, Homo sapiens
atactgtgtgtgagtgtgaat

SEQ ID NO: 4771550 - DNA, 16 bp, Homo sapiens
atacttaaaaatttat

SEQ ID NO: 4771551 - DNA, 17 bp, Homo sapiens
atacttggtccttaaaa

SEQ ID NO: 4771552 - DNA, 12 bp, Homo sapiens
atacttgtaact

SEQ ID NO: 4771553 - DNA, 15 bp, Homo sapiens
atacttgtaactttt

SEQ ID NO: 4771554 - DNA, 16 bp, Homo sapiens
atactttgcattgtct

SEQ ID NO: 4771555 - DNA, 23 bp, Homo sapiens
atactttgtgtcttttgttctct

SEQ ID NO: 4771556 - DNA, 23 bp, Homo sapiens
atagaaaacaggaaaaaaacttt

SEQ ID NO: 4771557 - DNA, 14 bp, Homo sapiens
atagaaacatgaca

SEQ ID NO: 4771558 - DNA, 17 bp, Homo sapiens
atagaaagtcagatgac

SEQ ID NO: 4771559 - DNA, 21 bp, Homo sapiens
atagacaaaggccttaacaaa

SEQ ID NO: 4771560 - DNA, 14 bp, Homo sapiens
atagagcacaatat

SEQ ID NO: 4771561 - DNA, 14 bp, Homo sapiens
atagatggtagaaa

SEQ ID NO: 4771562 - DNA, 21 bp, Homo sapiens
atagatggtagaaactttgga

SEQ ID NO: 4771563 - DNA, 17 bp, Homo sapiens
atagatgtctgtgtata

SEQ ID NO: 4771564 - DNA, 20 bp, Homo sapiens
atagatgtctgtgtatacat

SEQ ID NO: 4771565 - DNA, 21 bp, Homo sapiens
atagatgtctgtgtatacata

SEQ ID NO: 4771566 - DNA, 19 bp, Homo sapiens
atagattcacctgtaaaac

SEQ ID NO: 4771567 - DNA, 23 bp, Homo sapiens
atagattcacctgtaaaacttta

SEQ ID NO: 4771568 - DNA, 14 bp, Homo sapiens
atagattctttatt

SEQ ID NO: 4771569 - DNA, 15 bp, Homo sapiens
atagattctttatta

SEQ ID NO: 4771570 - DNA, 14 bp, Homo sapiens
atagatttttagat

SEQ ID NO: 4771571 - DNA, 15 bp, Homo sapiens
atagcataggctggg

SEQ ID NO: 4771572 - DNA, 20 bp, Homo sapiens
atagcatgtaatattaaatt

SEQ ID NO: 4771573 - DNA, 15 bp, Homo sapiens
atagccaaggccaaa

SEQ ID NO: 4771574 - DNA, 21 bp, Homo sapiens
atagccaaggccaaaggaagc

SEQ ID NO: 4771575 - DNA, 14 bp, Homo sapiens
atagctataaatag

SEQ ID NO: 4771576 - DNA, 17 bp, Homo sapiens
atagctataaatagtga

SEQ ID NO: 4771577 - DNA, 18 bp, Homo sapiens
atagctataaatagtgaa

SEQ ID NO: 4771578 - DNA, 17 bp, Homo sapiens
atagctcacagcacatt

SEQ ID NO: 4771579 - DNA, 18 bp, Homo sapiens
atagctgttctaatggat

SEQ ID NO: 4771580 - DNA, 20 bp, Homo sapiens
atagcttttcacttcttaag

SEQ ID NO: 4771581 - DNA, 23 bp, Homo sapiens
atagcttttcacttcttaaggac

SEQ ID NO: 4771582 - DNA, 15 bp, Homo sapiens
ataggaaataaatct

SEQ ID NO: 4771583 - DNA, 15 bp, Homo sapiens
ataggagcttccaga

SEQ ID NO: 4771584 - DNA, 12 bp, Homo sapiens
ataggctgggga

SEQ ID NO: 4771585 - DNA, 15 bp, Homo sapiens
atagggtttggaaga

SEQ ID NO: 4771586 - DNA, 19 bp, Homo sapiens
atagggtttggaagaaagg

SEQ ID NO: 4771587 - DNA, 21 bp, Homo sapiens
ataggttacataaaaggaagg

SEQ ID NO: 4771588 - DNA, 20 bp, Homo sapiens
ataggttctgctttctgata

SEQ ID NO: 4771589 - DNA, 12 bp, Homo sapiens
ataggtttctaa

SEQ ID NO: 4771590 - DNA, 23 bp, Homo sapiens
atagtactagagatattttgtaa

SEQ ID NO: 4771591 - DNA, 16 bp, Homo sapiens
atagtcaatcaaacag

SEQ ID NO: 4771592 - DNA, 19 bp, Homo sapiens
atagtcatgtttctgcagt

SEQ ID NO: 4771593 - DNA, 20 bp, Homo sapiens
atagtctcattgccaaggca

SEQ ID NO: 4771594 - DNA, 12 bp, Homo sapiens
atagtgaaaatt

SEQ ID NO: 4771595 - DNA, 14 bp, Homo sapiens
atctgtggcctggg

SEQ ID NO: 4771596 - DNA, 16 bp, Homo sapiens
atctgtggcctggggc

SEQ ID NO: 4771597 - DNA, 20 bp, Homo sapiens
atctgtgtgtgaattccttt

SEQ ID NO: 4771598 - DNA, 19 bp, Homo sapiens
atctgtgttgtctctctaa

SEQ ID NO: 4771599 - DNA, 13 bp, Homo sapiens
atctgttctatgg

SEQ ID NO: 4771600 - DNA, 13 bp, Homo sapiens
atctgttgtaata

SEQ ID NO: 4771601 - DNA, 18 bp, Homo sapiens
atctgttgtaatatcagt

SEQ ID NO: 4771602 - DNA, 15 bp, Homo sapiens
atctgtttgcttcta

SEQ ID NO: 4771603 - DNA, 17 bp, Homo sapiens
atctgtttgcttctaaa

SEQ ID NO: 4771604 - DNA, 20 bp, Homo sapiens
atcttaaaagctatcttcat

SEQ ID NO: 4771605 - DNA, 13 bp, Homo sapiens
atcttaaaattgg

SEQ ID NO: 4771606 - DNA, 15 bp, Homo sapiens
atcttaaatttctaa

SEQ ID NO: 4771607 - DNA, 16 bp, Homo sapiens
atcttaggatttacca

SEQ ID NO: 4771608 - DNA, 17 bp, Homo sapiens
atcttatttatatatga

SEQ ID NO: 4771609 - DNA, 15 bp, Homo sapiens
atcttcgttagtaat

SEQ ID NO: 4771610 - DNA, 19 bp, Homo sapiens
atcttctggactatagctg

SEQ ID NO: 4771611 - DNA, 17 bp, Homo sapiens
atcttgaagaatattgt

SEQ ID NO: 4771612 - DNA, 17 bp, Homo sapiens
atcttgaagacttttct

SEQ ID NO: 4771613 - DNA, 18 bp, Homo sapiens
atcttgaagacttttctt

SEQ ID NO: 4771614 - DNA, 15 bp, Homo sapiens
atcttgaagggccca

SEQ ID NO: 4771615 - DNA, 17 bp, Homo sapiens
atcttgaattgtaagga

SEQ ID NO: 4771616 - DNA, 17 bp, Homo sapiens
atcttgacaggcgccgc

SEQ ID NO: 4771617 - DNA, 21 bp, Homo sapiens
atcttgctggagaagcatcca

SEQ ID NO: 4771618 - DNA, 19 bp, Homo sapiens
atcttggccctgttaaggc

SEQ ID NO: 4771619 - DNA, 17 bp, Homo sapiens
atctttcggtctcctta

SEQ ID NO: 4771620 - DNA, 15 bp, Homo sapiens
atctttgttaaaata

SEQ ID NO: 4771621 - DNA, 21 bp, Homo sapiens
atgaaaaatagtgtgtccatg

SEQ ID NO: 4771622 - DNA, 14 bp, Homo sapiens
atgaaaaatctgaa

SEQ ID NO: 4771623 - DNA, 16 bp, Homo sapiens
atgaaaaatctgaatt

SEQ ID NO: 4771624 - DNA, 19 bp, Homo sapiens
atgaaaaccaccctatcat

SEQ ID NO: 4771625 - DNA, 18 bp, Homo sapiens
atgaaaaggtgattgtca

SEQ ID NO: 4771626 - DNA, 14 bp, Homo sapiens
atgaaaagttttca

SEQ ID NO: 4771627 - DNA, 19 bp, Homo sapiens
atgaaaatggctgaagaaa

SEQ ID NO: 4771628 - DNA, 13 bp, Homo sapiens
atgaaacaaatat

SEQ ID NO: 4771629 - DNA, 14 bp, Homo sapiens
atgaaacaaatata

SEQ ID NO: 4771630 - DNA, 15 bp, Homo sapiens
atgaaaggtatgtag

SEQ ID NO: 4771631 - DNA, 19 bp, Homo sapiens
atgaaagtcaagtctacct

SEQ ID NO: 4771632 - DNA, 19 bp, Homo sapiens
atgaaatacttgacaacat

SEQ ID NO: 4771633 - DNA, 17 bp, Homo sapiens
atgaaatataaactgtg

SEQ ID NO: 4771634 - DNA, 15 bp, Homo sapiens
atgaaatatatgtga

SEQ ID NO: 4771635 - DNA, 15 bp, Homo sapiens
atgaaatgccaagac

SEQ ID NO: 4771636 - DNA, 20 bp, Homo sapiens
atgaactaactgccatgtag

SEQ ID NO: 4771637 - DNA, 15 bp, Homo sapiens
atgaagcagaatgag

SEQ ID NO: 4771638 - DNA, 22 bp, Homo sapiens
atgaagcagaatgagatgattt

SEQ ID NO: 4771639 - DNA, 14 bp, Homo sapiens
atgaagtaagttct

SEQ ID NO: 4771640 - DNA, 19 bp, Homo sapiens
atgaagttaagcacaacca

SEQ ID NO: 4771641 - DNA, 16 bp, Homo sapiens
atgaagtttattttct

SEQ ID NO: 4771642 - DNA, 14 bp, Homo sapiens
atgaataaaatgtt

SEQ ID NO: 4771643 - DNA, 16 bp, Homo sapiens
atgaataaaatgttta

SEQ ID NO: 4771644 - DNA, 20 bp, Homo sapiens
atgaataatgcctttgtaac

SEQ ID NO: 4771645 - DNA, 15 bp, Homo sapiens
atgaatgaaatataa

SEQ ID NO: 4771646 - DNA, 16 bp, Homo sapiens
atgaatgaaatataaa

SEQ ID NO: 4771647 - DNA, 22 bp, Homo sapiens
atgaatgagcattctgcagccc

SEQ ID NO: 4771648 - DNA, 18 bp, Homo sapiens
atgaatgcagtataaaat

SEQ ID NO: 4771649 - DNA, 19 bp, Homo sapiens
atgaatgcccaggaagtaa

SEQ ID NO: 4771650 - DNA, 22 bp, Homo sapiens
atgaatgcccaggaagtaattt

SEQ ID NO: 4771651 - DNA, 16 bp, Homo sapiens
atgaatgtcagtgtga

SEQ ID NO: 4771652 - DNA, 20 bp, Homo sapiens
atgaatgtcagtgtgactga

SEQ ID NO: 4771653 - DNA, 20 bp, Homo sapiens
atgaattagaagaaaatgga

SEQ ID NO: 4771654 - DNA, 23 bp, Homo sapiens
atgaattagaagaaaatggatga

SEQ ID NO: 4771655 - DNA, 20 bp, Homo sapiens
atgaatttaccatcaaacaa

SEQ ID NO: 4771656 - DNA, 15 bp, Homo sapiens
atgaattttaaaagc

SEQ ID NO: 4771657 - DNA, 14 bp, Homo sapiens
atgacaaagaaaat

SEQ ID NO: 4771658 - DNA, 13 bp, Homo sapiens
atgacaataaatt

SEQ ID NO: 4771659 - DNA, 18 bp, Homo sapiens
atgacaggaacccatcac

SEQ ID NO: 4771660 - DNA, 22 bp, Homo sapiens
atgacaggaacccatcactgtg

SEQ ID NO: 4771661 - DNA, 23 bp, Homo sapiens
atgacaggaacccatcactgtgt

SEQ ID NO: 4771662 - DNA, 17 bp, Homo sapiens
atgacagtagcatactg

SEQ ID NO: 4771663 - DNA, 21 bp, Homo sapiens
atgacagtagcatactgatga

SEQ ID NO: 4771664 - DNA, 13 bp, Homo sapiens
atgacatccacat

SEQ ID NO: 4771665 - DNA, 17 bp, Homo sapiens
atgacatccacatgcac

SEQ ID NO: 4771666 - DNA, 23 bp, Homo sapiens
atgacatccacatgcacatgtat

SEQ ID NO: 4771667 - DNA, 16 bp, Homo sapiens
atgacatgcactgacc

SEQ ID NO: 4771668 - DNA, 23 bp, Homo sapiens
atgacatgcactgacccttccag

SEQ ID NO: 4771669 - DNA, 17 bp, Homo sapiens
atgaccactgggcctgc

SEQ ID NO: 4771670 - DNA, 20 bp, Homo sapiens
atgaccataaaattagacat

SEQ ID NO: 4771671 - DNA, 12 bp, Homo sapiens
atgaccctgtgc

SEQ ID NO: 4771672 - DNA, 14 bp, Homo sapiens
atgaccctgtgcct

SEQ ID NO: 4771673 - DNA, 15 bp, Homo sapiens
atgaccctgtgcctg

SEQ ID NO: 4771674 - DNA, 21 bp, Homo sapiens
atgaccctgtgcctgtgtttc

SEQ ID NO: 4771675 - DNA, 20 bp, Homo sapiens
atgacggtattatgcttctt

SEQ ID NO: 4771676 - DNA, 23 bp, Homo sapiens
atgacgtgcacaaaccttctttt

SEQ ID NO: 4771677 - DNA, 22 bp, Homo sapiens
atgactaatccttaataactat

SEQ ID NO: 4771678 - DNA, 16 bp, Homo sapiens
atgactccagaatttc

SEQ ID NO: 4771679 - DNA, 15 bp, Homo sapiens
atgactctttattgt

SEQ ID NO: 4771680 - DNA, 15 bp, Homo sapiens
atgactgaatttcta

SEQ ID NO: 4771681 - DNA, 12 bp, Homo sapiens
atgacttcttgt

SEQ ID NO: 4771682 - DNA, 17 bp, Homo sapiens
atgacttcttgttcatg

SEQ ID NO: 4771683 - DNA, 23 bp, Homo sapiens
atgacttctttactaacactggc

SEQ ID NO: 4771684 - DNA, 23 bp, Homo sapiens
atgactttcagattgtatctgaa

SEQ ID NO: 4771685 - DNA, 19 bp, Homo sapiens
atgagaaatataaaaataa

SEQ ID NO: 4771686 - DNA, 17 bp, Homo sapiens
atgagaaattgtgccaa

SEQ ID NO: 4771687 - DNA, 22 bp, Homo sapiens
atgagaaattgtgccaaagata

SEQ ID NO: 4771688 - DNA, 16 bp, Homo sapiens
atgagaactaaataga

SEQ ID NO: 4771689 - DNA, 14 bp, Homo sapiens
atgagaatgtcatt

SEQ ID NO: 4771690 - DNA, 19 bp, Homo sapiens
atgagaatgtcatttgcta

SEQ ID NO: 4771691 - DNA, 17 bp, Homo sapiens
atgagacaacacacaca

SEQ ID NO: 4771692 - DNA, 20 bp, Homo sapiens
atgagacctcccccagggag

SEQ ID NO: 4771693 - DNA, 22 bp, Homo sapiens
atgagacttcctattaatttat

SEQ ID NO: 4771694 - DNA, 15 bp, Homo sapiens
atgagaggaaaagaa

SEQ ID NO: 4771695 - DNA, 19 bp, Homo sapiens
atgagaggaaaagaaaaga

SEQ ID NO: 4771696 - DNA, 15 bp, Homo sapiens
atgagatactttgca

SEQ ID NO: 4771697 - DNA, 19 bp, Homo sapiens
atgagatcccagagttatt

SEQ ID NO: 4771698 - DNA, 21 bp, Homo sapiens
atgagatgatttaattcttac

SEQ ID NO: 4771699 - DNA, 15 bp, Homo sapiens
atgagatgtaataca

SEQ ID NO: 4771700 - DNA, 22 bp, Homo sapiens
atgagattggaaaaaattagac

SEQ ID NO: 4771701 - DNA, 20 bp, Homo sapiens
atgagcacctttctggcttt

SEQ ID NO: 4771702 - DNA, 17 bp, Homo sapiens
atgagcgtccaggtgat

SEQ ID NO: 4771703 - DNA, 15 bp, Homo sapiens
atgaggaacctcaaa

SEQ ID NO: 4771704 - DNA, 20 bp, Homo sapiens
atgaggctggataggagagg

SEQ ID NO: 4771705 - DNA, 20 bp, Homo sapiens
atgagttctgcacatacaga

SEQ ID NO: 4771706 - DNA, 13 bp, Homo sapiens
atgataaggttta

SEQ ID NO: 4771707 - DNA, 22 bp, Homo sapiens
atgataaggtttagaatgacag

SEQ ID NO: 4771708 - DNA, 15 bp, Homo sapiens
atgataatagctcac

SEQ ID NO: 4771709 - DNA, 15 bp, Homo sapiens
atgatacttggtcct

SEQ ID NO: 4771710 - DNA, 17 bp, Homo sapiens
atgatataactttagaa

SEQ ID NO: 4771711 - DNA, 18 bp, Homo sapiens
atgatatgcatgtagcat

SEQ ID NO: 4771712 - DNA, 15 bp, Homo sapiens
atgatatgtctttaa

SEQ ID NO: 4771713 - DNA, 22 bp, Homo sapiens
atgatatgtgcttgtgtgtatg

SEQ ID NO: 4771714 - DNA, 23 bp, Homo sapiens
atgatattgctgaagaatctact

SEQ ID NO: 4771715 - DNA, 15 bp, Homo sapiens
atgatcaaaatgcat

SEQ ID NO: 4771716 - DNA, 22 bp, Homo sapiens
atgtctcaccaggaaattctgt

SEQ ID NO: 4771717 - DNA, 15 bp, Homo sapiens
atgtctcatgtttta

SEQ ID NO: 4771718 - DNA, 19 bp, Homo sapiens
atgtctgtccctaaacata

SEQ ID NO: 4771719 - DNA, 11 bp, Homo sapiens
atgtctgtgat

SEQ ID NO: 4771720 - DNA, 14 bp, Homo sapiens
atgtctgtgtatac

SEQ ID NO: 4771721 - DNA, 17 bp, Homo sapiens
atgtctgtgtatacata

SEQ ID NO: 4771722 - DNA, 22 bp, Homo sapiens
atgtctgtgtatacatatgtat

SEQ ID NO: 4771723 - DNA, 23 bp, Homo sapiens
atgtctgtgtatacatatgtatg

SEQ ID NO: 4771724 - DNA, 14 bp, Homo sapiens
atgtcttcatgttg

SEQ ID NO: 4771725 - DNA, 22 bp, Homo sapiens
atgtcttcttgggggcagacca

SEQ ID NO: 4771726 - DNA, 22 bp, Homo sapiens
atgtctttctccaaagttatcc

SEQ ID NO: 4771727 - DNA, 22 bp, Homo sapiens
atgtctttggcttcagaattgt

SEQ ID NO: 4771728 - DNA, 22 bp, Homo sapiens
atgtgaaaaaaaaaagtaatta

SEQ ID NO: 4771729 - DNA, 14 bp, Homo sapiens
atgtgaaactgaga

SEQ ID NO: 4771730 - DNA, 18 bp, Homo sapiens
atgtgaaaggatatgaat

SEQ ID NO: 4771731 - DNA, 14 bp, Homo sapiens
atgtgaaataaaga

SEQ ID NO: 4771732 - DNA, 19 bp, Homo sapiens
atgtgaaatttttatttgt

SEQ ID NO: 4771733 - DNA, 15 bp, Homo sapiens
atgtgataattgtaa

SEQ ID NO: 4771734 - DNA, 16 bp, Homo sapiens
atgtgataattgtaaa

SEQ ID NO: 4771735 - DNA, 19 bp, Homo sapiens
atgtgatatgtgtaatatc

SEQ ID NO: 4771736 - DNA, 23 bp, Homo sapiens
atgtgatatgtgtaatatcattt

SEQ ID NO: 4771737 - DNA, 17 bp, Homo sapiens
atgtgcatctggcctat

SEQ ID NO: 4771738 - DNA, 18 bp, Homo sapiens
atgtgctattaatatttg

SEQ ID NO: 4771739 - DNA, 16 bp, Homo sapiens
atgtgctcatcagaaa

SEQ ID NO: 4771740 - DNA, 17 bp, Homo sapiens
atgtgctcatcagaaac

SEQ ID NO: 4771741 - DNA, 21 bp, Homo sapiens
atgtgctgttgattctttcaa

SEQ ID NO: 4771742 - DNA, 22 bp, Homo sapiens
atgtgctgttgattctttcaat

SEQ ID NO: 4771743 - DNA, 16 bp, Homo sapiens
atgtgcttgtgtgtat

SEQ ID NO: 4771744 - DNA, 17 bp, Homo sapiens
atgtgcttgtgtgtatg

SEQ ID NO: 4771745 - DNA, 18 bp, Homo sapiens
atgtgcttgtgtgtatgt

SEQ ID NO: 4771746 - DNA, 19 bp, Homo sapiens
atgtgcttgtgtgtatgtc

SEQ ID NO: 4771747 - DNA, 22 bp, Homo sapiens
atgtgcttgtgtgtatgtctat

SEQ ID NO: 4771748 - DNA, 23 bp, Homo sapiens
atgtgcttgtgtgtatgtctatg

SEQ ID NO: 4771749 - DNA, 17 bp, Homo sapiens
atgtggaaaactcacag

SEQ ID NO: 4771750 - DNA, 15 bp, Homo sapiens
atgtggaattacata

SEQ ID NO: 4771751 - DNA, 14 bp, Homo sapiens
atgtgtaacttttt

SEQ ID NO: 4771752 - DNA, 15 bp, Homo sapiens
atgtgtacacatatg

SEQ ID NO: 4771753 - DNA, 11 bp, Homo sapiens
atgtgtatata

SEQ ID NO: 4771754 - DNA, 13 bp, Homo sapiens
atgtgtcccctca

SEQ ID NO: 4771755 - DNA, 14 bp, Homo sapiens
atgtgtcccctcac

SEQ ID NO: 4771756 - DNA, 13 bp, Homo sapiens
atgtgtgagtgta

SEQ ID NO: 4771757 - DNA, 16 bp, Homo sapiens
atgtgtgagtgtatgt

SEQ ID NO: 4771758 - DNA, 20 bp, Homo sapiens
atgtgtgagtgtatgtatac

SEQ ID NO: 4771759 - DNA, 13 bp, Homo sapiens
atgtgtgtatgtg

SEQ ID NO: 4771760 - DNA, 16 bp, Homo sapiens
atgtgtgtatgtgtgt

SEQ ID NO: 4771761 - DNA, 13 bp, Homo sapiens
atgtgtgtcagcc

SEQ ID NO: 4771762 - DNA, 14 bp, Homo sapiens
atgtgtgtttctgt

SEQ ID NO: 4771763 - DNA, 15 bp, Homo sapiens
atgtgttgctctcca

SEQ ID NO: 4771764 - DNA, 22 bp, Homo sapiens
atgtgttgctctccattctttt

SEQ ID NO: 4771765 - DNA, 11 bp, Homo sapiens
atgttaaatct

SEQ ID NO: 4771766 - DNA, 12 bp, Homo sapiens
atgttaaatcta

SEQ ID NO: 4771767 - DNA, 13 bp, Homo sapiens
atgttaaatctac

SEQ ID NO: 4771768 - DNA, 21 bp, Homo sapiens
atgttaacaatgcctattgta

SEQ ID NO: 4771769 - DNA, 22 bp, Homo sapiens
atgttaacaatgcctattgtaa

SEQ ID NO: 4771770 - DNA, 19 bp, Homo sapiens
atgttaattgatagaataa

SEQ ID NO: 4771771 - DNA, 22 bp, Homo sapiens
atgttatacaaccttcatttaa

SEQ ID NO: 4771772 - DNA, 18 bp, Homo sapiens
atgttcaacttaatgaag

SEQ ID NO: 4771773 - DNA, 21 bp, Homo sapiens
atgttcaacttaatgaagaaa

SEQ ID NO: 4771774 - DNA, 19 bp, Homo sapiens
atgttcacgcaacttgaaa

SEQ ID NO: 4771775 - DNA, 20 bp, Homo sapiens
atgttcatgtgtaacttcta

SEQ ID NO: 4771776 - DNA, 22 bp, Homo sapiens
atgttccgttcatctgaggagt

SEQ ID NO: 4771777 - DNA, 12 bp, Homo sapiens
atgttctgtgtc

SEQ ID NO: 4771778 - DNA, 20 bp, Homo sapiens
atgttctttcacccttttct

SEQ ID NO: 4771779 - DNA, 14 bp, Homo sapiens
atgttgcatgaatc

SEQ ID NO: 4771780 - DNA, 21 bp, Homo sapiens
atgttgtgttggtatttactg

SEQ ID NO: 4771781 - DNA, 22 bp, Homo sapiens
atgttgtgttggtatttactgc

SEQ ID NO: 4771782 - DNA, 17 bp, Homo sapiens
atgttgttaaaaacatg

SEQ ID NO: 4771783 - DNA, 15 bp, Homo sapiens
atgttgttcaaatgc

SEQ ID NO: 4771784 - DNA, 16 bp, Homo sapiens
atgtttaaaatggcat

SEQ ID NO: 4771785 - DNA, 23 bp, Homo sapiens
atgtttaaaatggcatttagcac

SEQ ID NO: 4771786 - DNA, 24 bp, Homo sapiens
atgtttagatgaggttgagctatg

SEQ ID NO: 4771787 - DNA, 14 bp, Homo sapiens
atgtttagtagctg

SEQ ID NO: 4771788 - DNA, 19 bp, Homo sapiens
atgtttagtagctgataaa

SEQ ID NO: 4771789 - DNA, 13 bp, Homo sapiens
atgtttatattgt

SEQ ID NO: 4771790 - DNA, 17 bp, Homo sapiens
atgtttatttttgctct

SEQ ID NO: 4771791 - DNA, 22 bp, Homo sapiens
atgtttctgcagtattctgtag

SEQ ID NO: 4771792 - DNA, 16 bp, Homo sapiens
atgtttggcaagaaat

SEQ ID NO: 4771793 - DNA, 16 bp, Homo sapiens
atgtttggctgaaatt

SEQ ID NO: 4771794 - DNA, 19 bp, Homo sapiens
atgtttggctgaaattatg

SEQ ID NO: 4771795 - DNA, 20 bp, Homo sapiens
atgtttgtaagcaattctaa

SEQ ID NO: 4771796 - DNA, 23 bp, Homo sapiens
atgttttacaaagaaacaaaata

SEQ ID NO: 4771797 - DNA, 16 bp, Homo sapiens
atgttttatatgatta

SEQ ID NO: 4771798 - DNA, 14 bp, Homo sapiens
atgttttgaatgat

SEQ ID NO: 4771799 - DNA, 15 bp, Homo sapiens
atgttttggaattca

SEQ ID NO: 4771800 - DNA, 19 bp, Homo sapiens
atgttttggagagagcaat

SEQ ID NO: 4771801 - DNA, 21 bp, Homo sapiens
atgtttttttttttaagacaa

SEQ ID NO: 4771802 - DNA, 18 bp, Homo sapiens
attaaaaagacactttta

SEQ ID NO: 4771803 - DNA, 13 bp, Homo sapiens
attaaaaattata

SEQ ID NO: 4771804 - DNA, 16 bp, Homo sapiens
attaaaacaaaatcct

SEQ ID NO: 4771805 - DNA, 23 bp, Homo sapiens
attaaaacacaacatctttttct

SEQ ID NO: 4771806 - DNA, 11 bp, Homo sapiens
attaaaatatt

SEQ ID NO: 4771807 - DNA, 18 bp, Homo sapiens
attaaaatattttcttaa

SEQ ID NO: 4771808 - DNA, 21 bp, Homo sapiens
attaaaatattttcttaatta

SEQ ID NO: 4771809 - DNA, 18 bp, Homo sapiens
attaaaatcacaaactca

SEQ ID NO: 4771810 - DNA, 19 bp, Homo sapiens
attaaactgggaaatgaga

SEQ ID NO: 4771811 - DNA, 17 bp, Homo sapiens
attaaactgttaactta

SEQ ID NO: 4771812 - DNA, 16 bp, Homo sapiens
attaaacttcagcaac

SEQ ID NO: 4771813 - DNA, 14 bp, Homo sapiens
attaaagatgcagg

SEQ ID NO: 4771814 - DNA, 16 bp, Homo sapiens
attaaagtctacactg

SEQ ID NO: 4771815 - DNA, 16 bp, Homo sapiens
attaaatatatgtatg

SEQ ID NO: 4771816 - DNA, 14 bp, Homo sapiens
attaaatgaaatac

SEQ ID NO: 4771817 - DNA, 21 bp, Homo sapiens
attaaatgtagcttcagtcat

SEQ ID NO: 4771818 - DNA, 24 bp, Homo sapiens
attaaatgtagcttcagtcattaa

SEQ ID NO: 4771819 - DNA, 11 bp, Homo sapiens
attaaatgttg

SEQ ID NO: 4771820 - DNA, 22 bp, Homo sapiens
attaaattactatagcaaagta

SEQ ID NO: 4771821 - DNA, 18 bp, Homo sapiens
attaaattatcattgttt

SEQ ID NO: 4771822 - DNA, 12 bp, Homo sapiens
attaacaaattc

SEQ ID NO: 4771823 - DNA, 16 bp, Homo sapiens
attaacaaattcagtg

SEQ ID NO: 4771824 - DNA, 18 bp, Homo sapiens
attaactccgtttccaaa

SEQ ID NO: 4771825 - DNA, 15 bp, Homo sapiens
attaactctgcatag

SEQ ID NO: 4771826 - DNA, 21 bp, Homo sapiens
attaactctgcatagacaaag

SEQ ID NO: 4771827 - DNA, 22 bp, Homo sapiens
attaagcacattattgtagaga

SEQ ID NO: 4771828 - DNA, 15 bp, Homo sapiens
attaaggactacaga

SEQ ID NO: 4771829 - DNA, 19 bp, Homo sapiens
attaaggactacagaattg

SEQ ID NO: 4771830 - DNA, 14 bp, Homo sapiens
attaagtgttgtac

SEQ ID NO: 4771831 - DNA, 19 bp, Homo sapiens
attaatataaaaacatttt

SEQ ID NO: 4771832 - DNA, 16 bp, Homo sapiens
attaatgaatgcccag

SEQ ID NO: 4771833 - DNA, 12 bp, Homo sapiens
attaatgagttt

SEQ ID NO: 4771834 - DNA, 14 bp, Homo sapiens
attaatggcactga

SEQ ID NO: 4771835 - DNA, 13 bp, Homo sapiens
attaatgtagata

SEQ ID NO: 4771836 - DNA, 23 bp, Homo sapiens
attaatgtagggcagaatagctg

SEQ ID NO: 4771837 - DNA, 15 bp, Homo sapiens
attaattaaaatttg

SEQ ID NO: 4771838 - DNA, 13 bp, Homo sapiens
attgttttataaa

SEQ ID NO: 4771839 - DNA, 14 bp, Homo sapiens
attgttttataaat

SEQ ID NO: 4771840 - DNA, 15 bp, Homo sapiens
attgttttataaatg

SEQ ID NO: 4771841 - DNA, 16 bp, Homo sapiens
attgtttttagaaatt

SEQ ID NO: 4771842 - DNA, 19 bp, Homo sapiens
attgtttttatatattata

SEQ ID NO: 4771843 - DNA, 21 bp, Homo sapiens
atttaaaaaggtttaaaacta

SEQ ID NO: 4771844 - DNA, 16 bp, Homo sapiens
atttaaaacaagctga

SEQ ID NO: 4771845 - DNA, 22 bp, Homo sapiens
atttaaaacaagctgatagtgt

SEQ ID NO: 4771846 - DNA, 17 bp, Homo sapiens
atttaaaactgtaattt

SEQ ID NO: 4771847 - DNA, 12 bp, Homo sapiens
atttaaaatgta

SEQ ID NO: 4771848 - DNA, 22 bp, Homo sapiens
atttaagagattttatgtttaa

SEQ ID NO: 4771849 - DNA, 19 bp, Homo sapiens
atttaagcacaaaaaattt

SEQ ID NO: 4771850 - DNA, 21 bp, Homo sapiens
atttaagtggactgtatttcg

SEQ ID NO: 4771851 - DNA, 21 bp, Homo sapiens
atttaatcatttccagcaaaa

SEQ ID NO: 4771852 - DNA, 16 bp, Homo sapiens
atttaatgtttgtaag

SEQ ID NO: 4771853 - DNA, 18 bp, Homo sapiens
atttaatgtttgtaagca

SEQ ID NO: 4771854 - DNA, 21 bp, Homo sapiens
atttaatgtttgtaagcaatt

SEQ ID NO: 4771855 - DNA, 22 bp, Homo sapiens
atttaattttgacactgaaata

SEQ ID NO: 4771856 - DNA, 18 bp, Homo sapiens
atttacaacttccagatt

SEQ ID NO: 4771857 - DNA, 14 bp, Homo sapiens
atttacaagaagaa

SEQ ID NO: 4771858 - DNA, 15 bp, Homo sapiens
atttacaatgtatta

SEQ ID NO: 4771859 - DNA, 17 bp, Homo sapiens
atttacaatgtattaag

SEQ ID NO: 4771860 - DNA, 14 bp, Homo sapiens
atttaccagaagtt

SEQ ID NO: 4771861 - DNA, 13 bp, Homo sapiens
atttactaacagt

SEQ ID NO: 4771862 - DNA, 22 bp, Homo sapiens
atttactaacagtaactgccat

SEQ ID NO: 4771863 - DNA, 23 bp, Homo sapiens
atttactaacagtaactgccatt

SEQ ID NO: 4771864 - DNA, 18 bp, Homo sapiens
atttactgcaatgtctgt

SEQ ID NO: 4771865 - DNA, 12 bp, Homo sapiens
atttactgttta

SEQ ID NO: 4771866 - DNA, 12 bp, Homo sapiens
atttagcacagt

SEQ ID NO: 4771867 - DNA, 15 bp, Homo sapiens
atttagcacagtatt

SEQ ID NO: 4771868 - DNA, 17 bp, Homo sapiens
atttagcacagtattta

SEQ ID NO: 4771869 - DNA, 14 bp, Homo sapiens
atttagcatgagtt

SEQ ID NO: 4771870 - DNA, 18 bp, Homo sapiens
atttagtaaaattatctg

SEQ ID NO: 4771871 - DNA, 19 bp, Homo sapiens
atttagtaaaattatctgt

SEQ ID NO: 4771872 - DNA, 14 bp, Homo sapiens
atttataaatgaag

SEQ ID NO: 4771873 - DNA, 15 bp, Homo sapiens
atttataacattgta

SEQ ID NO: 4771874 - DNA, 17 bp, Homo sapiens
atttataacattgtaaa

SEQ ID NO: 4771875 - DNA, 19 bp, Homo sapiens
atttataagaaaaatgtga

SEQ ID NO: 4771876 - DNA, 16 bp, Homo sapiens
atttatatatgaagta

SEQ ID NO: 4771877 - DNA, 16 bp, Homo sapiens
atttatattagagtgc

SEQ ID NO: 4771878 - DNA, 22 bp, Homo sapiens
atttatcgaaagtaaaaaagat

SEQ ID NO: 4771879 - DNA, 14 bp, Homo sapiens
atttatctgtctga

SEQ ID NO: 4771880 - DNA, 20 bp, Homo sapiens
atttatgatataataaatat

SEQ ID NO: 4771881 - DNA, 19 bp, Homo sapiens
atttatgatgttattttgt

SEQ ID NO: 4771882 - DNA, 14 bp, Homo sapiens
atttatgcatgaga

SEQ ID NO: 4771883 - DNA, 16 bp, Homo sapiens
atttatgcatttatgc

SEQ ID NO: 4771884 - DNA, 12 bp, Homo sapiens
atttatgtgtga

SEQ ID NO: 4771885 - DNA, 20 bp, Homo sapiens
atttatgttatttatgatgt

SEQ ID NO: 4771886 - DNA, 13 bp, Homo sapiens
atttattaaactt

SEQ ID NO: 4771887 - DNA, 14 bp, Homo sapiens
atttattaaacttc

SEQ ID NO: 4771888 - DNA, 15 bp, Homo sapiens
atttattaaacttca

SEQ ID NO: 4771889 - DNA, 16 bp, Homo sapiens
atttattaaacttcag

SEQ ID NO: 4771890 - DNA, 15 bp, Homo sapiens
atttattaaatttat

SEQ ID NO: 4771891 - DNA, 21 bp, Homo sapiens
atttattaaatttattaaatg

SEQ ID NO: 4771892 - DNA, 22 bp, Homo sapiens
atttattagccctgcattttca

SEQ ID NO: 4771893 - DNA, 11 bp, Homo sapiens
atttattctgg

SEQ ID NO: 4771894 - DNA, 12 bp, Homo sapiens
atttatttccat

SEQ ID NO: 4771895 - DNA, 22 bp, Homo sapiens
atttattttgtatgaaatatat

SEQ ID NO: 4771896 - DNA, 18 bp, Homo sapiens
atttattttttgtaactc

SEQ ID NO: 4771897 - DNA, 20 bp, Homo sapiens
atttattttttgtaactctt

SEQ ID NO: 4771898 - DNA, 22 bp, Homo sapiens
atttcaaccacacctaaattaa

SEQ ID NO: 4771899 - DNA, 20 bp, Homo sapiens
atttcaatgtaattaaactg

SEQ ID NO: 4771900 - DNA, 22 bp, Homo sapiens
atttcaatgtaattaaactgtt

SEQ ID NO: 4771901 - DNA, 19 bp, Homo sapiens
atttcacacaactgtggat

SEQ ID NO: 4771902 - DNA, 17 bp, Homo sapiens
atttcacagagtacaaa

SEQ ID NO: 4771903 - DNA, 23 bp, Homo sapiens
atttcacagagtacaaaatagtt

SEQ ID NO: 4771904 - DNA, 15 bp, Homo sapiens
atttcatcaagatta

SEQ ID NO: 4771905 - DNA, 14 bp, Homo sapiens
atttcatccagaag

SEQ ID NO: 4771906 - DNA, 12 bp, Homo sapiens
atttcattcgtg

SEQ ID NO: 4771907 - DNA, 18 bp, Homo sapiens
atttccagcaaaatatat

SEQ ID NO: 4771908 - DNA, 22 bp, Homo sapiens
atttccagcaaaatatatgttt

SEQ ID NO: 4771909 - DNA, 20 bp, Homo sapiens
atttccatccaaacctacct

SEQ ID NO: 4771910 - DNA, 16 bp, Homo sapiens
atttcccctgtggttt

SEQ ID NO: 4771911 - DNA, 23 bp, Homo sapiens
atttccgtgagagtcatctcaaa

SEQ ID NO: 4771912 - DNA, 12 bp, Homo sapiens
atttcctgtgag

SEQ ID NO: 4771913 - DNA, 13 bp, Homo sapiens
atttcctgtgagg

SEQ ID NO: 4771914 - DNA, 16 bp, Homo sapiens
atttcctgtgaggata

SEQ ID NO: 4771915 - DNA, 19 bp, Homo sapiens
atttcctttaccctccaca

SEQ ID NO: 4771916 - DNA, 20 bp, Homo sapiens
atttcctttaccctccacac

SEQ ID NO: 4771917 - DNA, 23 bp, Homo sapiens
atttctagatatgagaaatataa

SEQ ID NO: 4771918 - DNA, 15 bp, Homo sapiens
atttctatggcatat

SEQ ID NO: 4771919 - DNA, 19 bp, Homo sapiens
atttctatggcatattgat

SEQ ID NO: 4771920 - DNA, 18 bp, Homo sapiens
atttctattttgcagcag

SEQ ID NO: 4771921 - DNA, 17 bp, Homo sapiens
atttctgccatttcatg

SEQ ID NO: 4771922 - DNA, 18 bp, Homo sapiens
atttctgccatttcatgt

SEQ ID NO: 4771923 - DNA, 19 bp, Homo sapiens
atttctgccatttcatgtc

SEQ ID NO: 4771924 - DNA, 20 bp, Homo sapiens
atttctgtatatagatgtct

SEQ ID NO: 4771925 - DNA, 23 bp, Homo sapiens
atttctgtatatagatgtctgtg

SEQ ID NO: 4771926 - DNA, 20 bp, Homo sapiens
atttcttccacaagagccca

SEQ ID NO: 4771927 - DNA, 23 bp, Homo sapiens
atttcttccacaagagcccaggc

SEQ ID NO: 4771928 - DNA, 18 bp, Homo sapiens
atttcttctctctgtgct

SEQ ID NO: 4771929 - DNA, 19 bp, Homo sapiens
atttcttggtatgatcatt

SEQ ID NO: 4771930 - DNA, 18 bp, Homo sapiens
atttgaaaatgataaaag

SEQ ID NO: 4771931 - DNA, 16 bp, Homo sapiens
atttgaagacttcaaa

SEQ ID NO: 4771932 - DNA, 22 bp, Homo sapiens
atttgacattgtcagaatgttg

SEQ ID NO: 4771933 - DNA, 18 bp, Homo sapiens
atttgagctgcctggagg

SEQ ID NO: 4771934 - DNA, 17 bp, Homo sapiens
atttgatatacagacct

SEQ ID NO: 4771935 - DNA, 14 bp, Homo sapiens
atttgcaacactgc

SEQ ID NO: 4771936 - DNA, 19 bp, Homo sapiens
atttgcaacactgccaaac

SEQ ID NO: 4771937 - DNA, 17 bp, Homo sapiens
atttgccagacagagat

SEQ ID NO: 4771938 - DNA, 13 bp, Homo sapiens
atttgctcctttc

SEQ ID NO: 4771939 - DNA, 21 bp, Homo sapiens
atttgctctgtggtaagagat

SEQ ID NO: 4771940 - DNA, 13 bp, Homo sapiens
atttgctgaataa

SEQ ID NO: 4771941 - DNA, 16 bp, Homo sapiens
atttgctgaataacaa

SEQ ID NO: 4771942 - DNA, 18 bp, Homo sapiens
atttgctgattgtctgaa

SEQ ID NO: 4771943 - DNA, 15 bp, Homo sapiens
atttgctgcatttca

SEQ ID NO: 4771944 - DNA, 14 bp, Homo sapiens
atttgcttatttat

SEQ ID NO: 4771945 - DNA, 16 bp, Homo sapiens
atttggatataaatct

SEQ ID NO: 4771946 - DNA, 21 bp, Homo sapiens
atttggattttaaacaaaatt

SEQ ID NO: 4771947 - DNA, 17 bp, Homo sapiens
atttgggctgaatgtat

SEQ ID NO: 4771948 - DNA, 20 bp, Homo sapiens
atttgggctgaatgtatgta

SEQ ID NO: 4771949 - DNA, 21 bp, Homo sapiens
atttgggctgaatgtatgtaa

SEQ ID NO: 4771950 - DNA, 21 bp, Homo sapiens
atttggttaaaggtctcccac

SEQ ID NO: 4771951 - DNA, 23 bp, Homo sapiens
atttggtttagaatgctgcgctt

SEQ ID NO: 4771952 - DNA, 17 bp, Homo sapiens
atttgtaaaacagtggt

SEQ ID NO: 4771953 - DNA, 23 bp, Homo sapiens
atttgtaatgtatcttatttata

SEQ ID NO: 4771954 - DNA, 23 bp, Homo sapiens
atttgtattagtaataaaacatt

SEQ ID NO: 4771955 - DNA, 13 bp, Homo sapiens
atttgtatttata

SEQ ID NO: 4771956 - DNA, 15 bp, Homo sapiens
atttgtatttatatt

SEQ ID NO: 4771957 - DNA, 14 bp, Homo sapiens
atttgtcctcatgt

SEQ ID NO: 4771958 - DNA, 18 bp, Homo sapiens
atttgtgagccaaagaga

SEQ ID NO: 4771959 - DNA, 15 bp, Homo sapiens
caacttgctcctttc

SEQ ID NO: 4771960 - DNA, 19 bp, Homo sapiens
caactttagtatttttact

SEQ ID NO: 4771961 - DNA, 16 bp, Homo sapiens
caactttccaactttt

SEQ ID NO: 4771962 - DNA, 13 bp, Homo sapiens
caactttgctttt

SEQ ID NO: 4771963 - DNA, 18 bp, Homo sapiens
caactttggaatttgaag

SEQ ID NO: 4771964 - DNA, 15 bp, Homo sapiens
caacttttcatccag

SEQ ID NO: 4771965 - DNA, 17 bp, Homo sapiens
caacttttcatttttgc

SEQ ID NO: 4771966 - DNA, 21 bp, Homo sapiens
caagaacataaaccctccaag

SEQ ID NO: 4771967 - DNA, 21 bp, Homo sapiens
caagaactcccttctcccctc

SEQ ID NO: 4771968 - DNA, 20 bp, Homo sapiens
caagaactttccaggaaggc

SEQ ID NO: 4771969 - DNA, 17 bp, Homo sapiens
caagaagaatataaata

SEQ ID NO: 4771970 - DNA, 18 bp, Homo sapiens
caagaagaatataaataa

SEQ ID NO: 4771971 - DNA, 20 bp, Homo sapiens
caagacaccttcccagctgc

SEQ ID NO: 4771972 - DNA, 14 bp, Homo sapiens
caagactctatgct

SEQ ID NO: 4771973 - DNA, 17 bp, Homo sapiens
caagactctatgctctg

SEQ ID NO: 4771974 - DNA, 18 bp, Homo sapiens
caagactctatgctctgg

SEQ ID NO: 4771975 - DNA, 19 bp, Homo sapiens
caagactctatgctctgga

SEQ ID NO: 4771976 - DNA, 14 bp, Homo sapiens
caagagaccacttc

SEQ ID NO: 4771977 - DNA, 20 bp, Homo sapiens
caagagaccacttccttaac

SEQ ID NO: 4771978 - DNA, 16 bp, Homo sapiens
caagagcccaggcctc

SEQ ID NO: 4771979 - DNA, 14 bp, Homo sapiens
caagagctcaggag

SEQ ID NO: 4771980 - DNA, 17 bp, Homo sapiens
caagaggtttcagcatt

SEQ ID NO: 4771981 - DNA, 19 bp, Homo sapiens
caagagtccaagccatctg

SEQ ID NO: 4771982 - DNA, 23 bp, Homo sapiens
caagataaacacaatttcttcat

SEQ ID NO: 4771983 - DNA, 14 bp, Homo sapiens
caagatactggact

SEQ ID NO: 4771984 - DNA, 19 bp, Homo sapiens
caagatgggtgattatgaa

SEQ ID NO: 4771985 - DNA, 22 bp, Homo sapiens
caagattaagttataccagcaa

SEQ ID NO: 4771986 - DNA, 15 bp, Homo sapiens
caagcaaactgaaat

SEQ ID NO: 4771987 - DNA, 18 bp, Homo sapiens
caagcaaagacagtttct

SEQ ID NO: 4771988 - DNA, 20 bp, Homo sapiens
caagcaattagaagccatcc

SEQ ID NO: 4771989 - DNA, 18 bp, Homo sapiens
caagcacaattgatctct

SEQ ID NO: 4771990 - DNA, 18 bp, Homo sapiens
caagcaggctcaacataa

SEQ ID NO: 4771991 - DNA, 15 bp, Homo sapiens
caagcatcagcaaga

SEQ ID NO: 4771992 - DNA, 16 bp, Homo sapiens
caagccagggttccag

SEQ ID NO: 4771993 - DNA, 21 bp, Homo sapiens
caagcccagcctatctctctt

SEQ ID NO: 4771994 - DNA, 16 bp, Homo sapiens
caagccctggggcagg

SEQ ID NO: 4771995 - DNA, 18 bp, Homo sapiens
caagcgacacaggctgcc

SEQ ID NO: 4771996 - DNA, 20 bp, Homo sapiens
caagcgacacaggctgccgc

SEQ ID NO: 4771997 - DNA, 13 bp, Homo sapiens
caagctacatatg

SEQ ID NO: 4771998 - DNA, 14 bp, Homo sapiens
caagctcatagcac

SEQ ID NO: 4771999 - DNA, 17 bp, Homo sapiens
caagctcatagcacatg

SEQ ID NO: 4772000 - DNA, 17 bp, Homo sapiens
caagctccagtagctcc

SEQ ID NO: 4772001 - DNA, 15 bp, Homo sapiens
caagctgctgccgcc

SEQ ID NO: 4772002 - DNA, 13 bp, Homo sapiens
caagctgttccac

SEQ ID NO: 4772003 - DNA, 15 bp, Homo sapiens
caaggaaggacattt

SEQ ID NO: 4772004 - DNA, 17 bp, Homo sapiens
caaggaagggatgtatt

SEQ ID NO: 4772005 - DNA, 13 bp, Homo sapiens
caaggacaagcaa

SEQ ID NO: 4772006 - DNA, 12 bp, Homo sapiens
caaggacactga

SEQ ID NO: 4772007 - DNA, 17 bp, Homo sapiens
caaggcaaggctgtcaa

SEQ ID NO: 4772008 - DNA, 21 bp, Homo sapiens
caaggcacattgaaatacttg

SEQ ID NO: 4772009 - DNA, 15 bp, Homo sapiens
caaggcatccccagt

SEQ ID NO: 4772010 - DNA, 20 bp, Homo sapiens
caaggcatccccagtgccag

SEQ ID NO: 4772011 - DNA, 20 bp, Homo sapiens
caaggccaaaggaagcacat

SEQ ID NO: 4772012 - DNA, 21 bp, Homo sapiens
caaggccagcccacacagccc

SEQ ID NO: 4772013 - DNA, 22 bp, Homo sapiens
caaggccagcccacacagcccg

SEQ ID NO: 4772014 - DNA, 19 bp, Homo sapiens
caaggctgctaagtggaag

SEQ ID NO: 4772015 - DNA, 21 bp, Homo sapiens
caaggctgctaagtggaagac

SEQ ID NO: 4772016 - DNA, 14 bp, Homo sapiens
caaggctgtcaatt

SEQ ID NO: 4772017 - DNA, 21 bp, Homo sapiens
caaggctgtcaattacaggaa

SEQ ID NO: 4772018 - DNA, 23 bp, Homo sapiens
caaggctgtcaattacaggaagt

SEQ ID NO: 4772019 - DNA, 16 bp, Homo sapiens
caagggcagtggaaga

SEQ ID NO: 4772020 - DNA, 13 bp, Homo sapiens
caaggggccagga

SEQ ID NO: 4772021 - DNA, 19 bp, Homo sapiens
caaggggtggaagggcagg

SEQ ID NO: 4772022 - DNA, 21 bp, Homo sapiens
caaggtgcggaccggagcggc

SEQ ID NO: 4772023 - DNA, 18 bp, Homo sapiens
caaggtgctcttctcatt

SEQ ID NO: 4772024 - DNA, 19 bp, Homo sapiens
caaggtgctcttctcattt

SEQ ID NO: 4772025 - DNA, 19 bp, Homo sapiens
caaggtggtcttggagagg

SEQ ID NO: 4772026 - DNA, 22 bp, Homo sapiens
caaggtggtcttggagaggagg

SEQ ID NO: 4772027 - DNA, 17 bp, Homo sapiens
caagtaaatctatctct

SEQ ID NO: 4772028 - DNA, 20 bp, Homo sapiens
caagtagatgcctgaacttg

SEQ ID NO: 4772029 - DNA, 21 bp, Homo sapiens
caagtagggtttagccgggcc

SEQ ID NO: 4772030 - DNA, 16 bp, Homo sapiens
caagtagtagtactta

SEQ ID NO: 4772031 - DNA, 14 bp, Homo sapiens
caagtataaacttt

SEQ ID NO: 4772032 - DNA, 23 bp, Homo sapiens
caagtattactaaattgaccttt

SEQ ID NO: 4772033 - DNA, 24 bp, Homo sapiens
caagtattactaaattgaccttta

SEQ ID NO: 4772034 - DNA, 18 bp, Homo sapiens
caagtattttatctgtgt

SEQ ID NO: 4772035 - DNA, 14 bp, Homo sapiens
caagtcatgggaga

SEQ ID NO: 4772036 - DNA, 16 bp, Homo sapiens
caagtcatgggagaag

SEQ ID NO: 4772037 - DNA, 17 bp, Homo sapiens
caagtcccgaggcagca

SEQ ID NO: 4772038 - DNA, 14 bp, Homo sapiens
caagtcctcgcccc

SEQ ID NO: 4772039 - DNA, 18 bp, Homo sapiens
caagtcctcgccccccgc

SEQ ID NO: 4772040 - DNA, 15 bp, Homo sapiens
caagtctagtggaac

SEQ ID NO: 4772041 - DNA, 20 bp, Homo sapiens
caagtgggtcaattccttag

SEQ ID NO: 4772042 - DNA, 19 bp, Homo sapiens
caagtggtttccacatgct

SEQ ID NO: 4772043 - DNA, 22 bp, Homo sapiens
caagtggtttccacatgctctg

SEQ ID NO: 4772044 - DNA, 23 bp, Homo sapiens
caagtgtgcctgctatccagccg

SEQ ID NO: 4772045 - DNA, 17 bp, Homo sapiens
caagtgtgtgtgcaatg

SEQ ID NO: 4772046 - DNA, 19 bp, Homo sapiens
caagttgcagtcagaagat

SEQ ID NO: 4772047 - DNA, 13 bp, Homo sapiens
caagttgtgtgct

SEQ ID NO: 4772048 - DNA, 15 bp, Homo sapiens
caagttgtgtgctat

SEQ ID NO: 4772049 - DNA, 16 bp, Homo sapiens
caataaactcagtcaa

SEQ ID NO: 4772050 - DNA, 20 bp, Homo sapiens
caataaactcagtcaaatgt

SEQ ID NO: 4772051 - DNA, 16 bp, Homo sapiens
caataaagagtaaata

SEQ ID NO: 4772052 - DNA, 17 bp, Homo sapiens
caataacagttttaaga

SEQ ID NO: 4772053 - DNA, 15 bp, Homo sapiens
caataagaaacagtt

SEQ ID NO: 4772054 - DNA, 22 bp, Homo sapiens
caataagaaacagtttaacaga

SEQ ID NO: 4772055 - DNA, 17 bp, Homo sapiens
caataaggatttattct

SEQ ID NO: 4772056 - DNA, 23 bp, Homo sapiens
caatacattgaacacatttcctt

SEQ ID NO: 4772057 - DNA, 20 bp, Homo sapiens
caatatcattttcctgggag

SEQ ID NO: 4772058 - DNA, 21 bp, Homo sapiens
caatatcattttcctgggagt

SEQ ID NO: 4772059 - DNA, 13 bp, Homo sapiens
caatatgggagga

SEQ ID NO: 4772060 - DNA, 19 bp, Homo sapiens
caatcactaaatatctagt

SEQ ID NO: 4772061 - DNA, 20 bp, Homo sapiens
caatcactaaatatctagtg

SEQ ID NO: 4772062 - DNA, 16 bp, Homo sapiens
caatcagcactgaaaa

SEQ ID NO: 4772063 - DNA, 13 bp, Homo sapiens
caatcattgtaca

SEQ ID NO: 4772064 - DNA, 15 bp, Homo sapiens
caatcattgtacagt

SEQ ID NO: 4772065 - DNA, 20 bp, Homo sapiens
caatcattgtacagtttgtt

SEQ ID NO: 4772066 - DNA, 23 bp, Homo sapiens
caatcattgtacagtttgtttac

SEQ ID NO: 4772067 - DNA, 22 bp, Homo sapiens
caatcattttgggaaattcttg

SEQ ID NO: 4772068 - DNA, 15 bp, Homo sapiens
caatccacagtattg

SEQ ID NO: 4772069 - DNA, 16 bp, Homo sapiens
caatccacagtattgt

SEQ ID NO: 4772070 - DNA, 17 bp, Homo sapiens
caatccacagtattgtt

SEQ ID NO: 4772071 - DNA, 19 bp, Homo sapiens
caatccccataatgcttct

SEQ ID NO: 4772072 - DNA, 18 bp, Homo sapiens
caatcctcccacttcagc

SEQ ID NO: 4772073 - DNA, 22 bp, Homo sapiens
caatcctcccacttcagcctcc

SEQ ID NO: 4772074 - DNA, 14 bp, Homo sapiens
caatctctgtgact

SEQ ID NO: 4772075 - DNA, 16 bp, Homo sapiens
caatcttgctgtgaaa

SEQ ID NO: 4772076 - DNA, 19 bp, Homo sapiens
caatgaaaaggtgattgtc

SEQ ID NO: 4772077 - DNA, 20 bp, Homo sapiens
caatgaaatatttgcttatt

SEQ ID NO: 4772078 - DNA, 22 bp, Homo sapiens
caatgaaatatttgcttattta

SEQ ID NO: 4772079 - DNA, 23 bp, Homo sapiens
caatgaaatatttgcttatttat

SEQ ID NO: 4772080 - DNA, 14 bp, Homo sapiens
caccctcccctctt

SEQ ID NO: 4772081 - DNA, 14 bp, Homo sapiens
caccctcgctgcca

SEQ ID NO: 4772082 - DNA, 16 bp, Homo sapiens
caccctcgctgccacc

SEQ ID NO: 4772083 - DNA, 18 bp, Homo sapiens
caccctcgctgccaccca

SEQ ID NO: 4772084 - DNA, 21 bp, Homo sapiens
caccctctgctatgtctgtga

SEQ ID NO: 4772085 - DNA, 14 bp, Homo sapiens
caccctctgctgca

SEQ ID NO: 4772086 - DNA, 21 bp, Homo sapiens
caccctctgtccttcccccag

SEQ ID NO: 4772087 - DNA, 15 bp, Homo sapiens
caccctgaggagtga

SEQ ID NO: 4772088 - DNA, 18 bp, Homo sapiens
caccctgaggagtgatgg

SEQ ID NO: 4772089 - DNA, 11 bp, Homo sapiens
caccctgcaag

SEQ ID NO: 4772090 - DNA, 17 bp, Homo sapiens
caccctgcaaggcccac

SEQ ID NO: 4772091 - DNA, 15 bp, Homo sapiens
caccctgccctggcc

SEQ ID NO: 4772092 - DNA, 14 bp, Homo sapiens
caccctgggcctcc

SEQ ID NO: 4772093 - DNA, 18 bp, Homo sapiens
caccctgggcctcccgtc

SEQ ID NO: 4772094 - DNA, 16 bp, Homo sapiens
caccctgtctgcaggc

SEQ ID NO: 4772095 - DNA, 11 bp, Homo sapiens
cacccttcccc

SEQ ID NO: 4772096 - DNA, 21 bp, Homo sapiens
cacccttccccactcccgtga

SEQ ID NO: 4772097 - DNA, 20 bp, Homo sapiens
caccgacccgacactctcac

SEQ ID NO: 4772098 - DNA, 23 bp, Homo sapiens
caccgacccgacactctcacccc

SEQ ID NO: 4772099 - DNA, 18 bp, Homo sapiens
caccgattcttccttgcc

SEQ ID NO: 4772100 - DNA, 20 bp, Homo sapiens
caccgattcttccttgccac

SEQ ID NO: 4772101 - DNA, 22 bp, Homo sapiens
caccgcaccgggctggcctgac

SEQ ID NO: 4772102 - DNA, 13 bp, Homo sapiens
caccgcagaagga

SEQ ID NO: 4772103 - DNA, 15 bp, Homo sapiens
caccgcattccaggg

SEQ ID NO: 4772104 - DNA, 17 bp, Homo sapiens
caccgcattccaggggc

SEQ ID NO: 4772105 - DNA, 22 bp, Homo sapiens
caccgcccaacccccacctccc

SEQ ID NO: 4772106 - DNA, 12 bp, Homo sapiens
caccgcccaccc

SEQ ID NO: 4772107 - DNA, 16 bp, Homo sapiens
caccgcgcccctctgc

SEQ ID NO: 4772108 - DNA, 17 bp, Homo sapiens
caccgcgcccctctgcg

SEQ ID NO: 4772109 - DNA, 18 bp, Homo sapiens
caccgcgcccctctgcgc

SEQ ID NO: 4772110 - DNA, 23 bp, Homo sapiens
caccgcgcccctctgcgccccag

SEQ ID NO: 4772111 - DNA, 12 bp, Homo sapiens
caccggaggagc

SEQ ID NO: 4772112 - DNA, 16 bp, Homo sapiens
caccggcactgtgcac

SEQ ID NO: 4772113 - DNA, 17 bp, Homo sapiens
caccgtggtgtgaggcc

SEQ ID NO: 4772114 - DNA, 20 bp, Homo sapiens
caccgtggtgtgaggccccc

SEQ ID NO: 4772115 - DNA, 16 bp, Homo sapiens
cacctcccccaaaccc

SEQ ID NO: 4772116 - DNA, 13 bp, Homo sapiens
cacctccctgcag

SEQ ID NO: 4772117 - DNA, 15 bp, Homo sapiens
cacctccctgcagct

SEQ ID NO: 4772118 - DNA, 15 bp, Homo sapiens
cacctccctgcccag

SEQ ID NO: 4772119 - DNA, 17 bp, Homo sapiens
cacctccctgcccaggc

SEQ ID NO: 4772120 - DNA, 13 bp, Homo sapiens
cacctccttctgc

SEQ ID NO: 4772121 - DNA, 23 bp, Homo sapiens
cacctccttctgcagtcagactg

SEQ ID NO: 4772122 - DNA, 12 bp, Homo sapiens
cacctgccaggc

SEQ ID NO: 4772123 - DNA, 18 bp, Homo sapiens
cacctgcccagttagccc

SEQ ID NO: 4772124 - DNA, 15 bp, Homo sapiens
cacctgccccaggct

SEQ ID NO: 4772125 - DNA, 22 bp, Homo sapiens
cacctgccccaggctcaggctg

SEQ ID NO: 4772126 - DNA, 14 bp, Homo sapiens
cacctgcccctcaa

SEQ ID NO: 4772127 - DNA, 18 bp, Homo sapiens
cacctgcccctcaactct

SEQ ID NO: 4772128 - DNA, 19 bp, Homo sapiens
cacctgccgtaagttactg

SEQ ID NO: 4772129 - DNA, 23 bp, Homo sapiens
cacctgcctgcagagcaggaaat

SEQ ID NO: 4772130 - DNA, 19 bp, Homo sapiens
cacctgcctgttgggccag

SEQ ID NO: 4772131 - DNA, 13 bp, Homo sapiens
cacctgcttctca

SEQ ID NO: 4772132 - DNA, 14 bp, Homo sapiens
cacctgcttctcag

SEQ ID NO: 4772133 - DNA, 18 bp, Homo sapiens
cacctggaaagccaggtt

SEQ ID NO: 4772134 - DNA, 16 bp, Homo sapiens
cacctggcttcccagg

SEQ ID NO: 4772135 - DNA, 20 bp, Homo sapiens
cacctgggattacaagcatg

SEQ ID NO: 4772136 - DNA, 16 bp, Homo sapiens
caccttaaattaaaca

SEQ ID NO: 4772137 - DNA, 22 bp, Homo sapiens
caccttaaattaaacaatttat

SEQ ID NO: 4772138 - DNA, 16 bp, Homo sapiens
caccttacaaagccag

SEQ ID NO: 4772139 - DNA, 17 bp, Homo sapiens
caccttacaaagccagc

SEQ ID NO: 4772140 - DNA, 14 bp, Homo sapiens
caccttccttgaaa

SEQ ID NO: 4772141 - DNA, 19 bp, Homo sapiens
caccttctgtgcatctggc

SEQ ID NO: 4772142 - DNA, 13 bp, Homo sapiens
caccttgagcact

SEQ ID NO: 4772143 - DNA, 14 bp, Homo sapiens
caccttgagcacta

SEQ ID NO: 4772144 - DNA, 20 bp, Homo sapiens
caccttgggcacgggagagc

SEQ ID NO: 4772145 - DNA, 17 bp, Homo sapiens
caccttgtacagaacca

SEQ ID NO: 4772146 - DNA, 23 bp, Homo sapiens
caccttgtacagaaccagcactc

SEQ ID NO: 4772147 - DNA, 17 bp, Homo sapiens
cacctttagaatattaa

SEQ ID NO: 4772148 - DNA, 17 bp, Homo sapiens
cacgacataagctggta

SEQ ID NO: 4772149 - DNA, 15 bp, Homo sapiens
cacgattcatttttg

SEQ ID NO: 4772150 - DNA, 12 bp, Homo sapiens
cacgattccagt

SEQ ID NO: 4772151 - DNA, 12 bp, Homo sapiens
cacgcagagagg

SEQ ID NO: 4772152 - DNA, 12 bp, Homo sapiens
cacgcagagccc

SEQ ID NO: 4772153 - DNA, 14 bp, Homo sapiens
cacgcagagccccg

SEQ ID NO: 4772154 - DNA, 15 bp, Homo sapiens
cacgcagagccccgg

SEQ ID NO: 4772155 - DNA, 16 bp, Homo sapiens
cacgccggggctggcc

SEQ ID NO: 4772156 - DNA, 13 bp, Homo sapiens
cacgcctccatcc

SEQ ID NO: 4772157 - DNA, 18 bp, Homo sapiens
cacgcctccatccacaca

SEQ ID NO: 4772158 - DNA, 15 bp, Homo sapiens
cacgcctcctggcca

SEQ ID NO: 4772159 - DNA, 16 bp, Homo sapiens
cacgcctggctaattt

SEQ ID NO: 4772160 - DNA, 14 bp, Homo sapiens
cacgcggctgctgc

SEQ ID NO: 4772161 - DNA, 23 bp, Homo sapiens
cacgctgaatgagaagtaaatta

SEQ ID NO: 4772162 - DNA, 13 bp, Homo sapiens
cacgctgtcctct

SEQ ID NO: 4772163 - DNA, 23 bp, Homo sapiens
cacgctgtcctctcgagcccaga

SEQ ID NO: 4772164 - DNA, 15 bp, Homo sapiens
cacgcttctggaggt

SEQ ID NO: 4772165 - DNA, 22 bp, Homo sapiens
cacgcttctggaggtggggagg

SEQ ID NO: 4772166 - DNA, 23 bp, Homo sapiens
cacgcttctggaggtggggaggg

SEQ ID NO: 4772167 - DNA, 19 bp, Homo sapiens
cacggagtttccatttgga

SEQ ID NO: 4772168 - DNA, 20 bp, Homo sapiens
cacggagtttccatttggat

SEQ ID NO: 4772169 - DNA, 13 bp, Homo sapiens
cacggccgtccct

SEQ ID NO: 4772170 - DNA, 21 bp, Homo sapiens
cacggccgtccctgacttccc

SEQ ID NO: 4772171 - DNA, 17 bp, Homo sapiens
cacggcgtttttttaca

SEQ ID NO: 4772172 - DNA, 13 bp, Homo sapiens
cacgggagagcgc

SEQ ID NO: 4772173 - DNA, 15 bp, Homo sapiens
cacgggagagcgcca

SEQ ID NO: 4772174 - DNA, 20 bp, Homo sapiens
cacgggcccgctcaacctct

SEQ ID NO: 4772175 - DNA, 13 bp, Homo sapiens
cacggggcaccca

SEQ ID NO: 4772176 - DNA, 18 bp, Homo sapiens
cacggtccaatccagcct

SEQ ID NO: 4772177 - DNA, 16 bp, Homo sapiens
cacgtcccgggcactg

SEQ ID NO: 4772178 - DNA, 19 bp, Homo sapiens
cacgtcccgggcactgtca

SEQ ID NO: 4772179 - DNA, 15 bp, Homo sapiens
cacgtgaccctgtgc

SEQ ID NO: 4772180 - DNA, 17 bp, Homo sapiens
cacgtgaccctgtgccc

SEQ ID NO: 4772181 - DNA, 14 bp, Homo sapiens
cacgttgcagaaaa

SEQ ID NO: 4772182 - DNA, 18 bp, Homo sapiens
cacgtttcaacctctcta

SEQ ID NO: 4772183 - DNA, 14 bp, Homo sapiens
cactaaaagtgatg

SEQ ID NO: 4772184 - DNA, 18 bp, Homo sapiens
cactaaaatccacccagc

SEQ ID NO: 4772185 - DNA, 19 bp, Homo sapiens
cactaaaatccacccagcc

SEQ ID NO: 4772186 - DNA, 22 bp, Homo sapiens
cactaaaatccacccagcccac

SEQ ID NO: 4772187 - DNA, 15 bp, Homo sapiens
cactaaatatctagt

SEQ ID NO: 4772188 - DNA, 14 bp, Homo sapiens
cactaatcaatact

SEQ ID NO: 4772189 - DNA, 16 bp, Homo sapiens
cactagccctctttct

SEQ ID NO: 4772190 - DNA, 23 bp, Homo sapiens
cactagccctctttctctctgtg

SEQ ID NO: 4772191 - DNA, 18 bp, Homo sapiens
cactagccttcccagctt

SEQ ID NO: 4772192 - DNA, 16 bp, Homo sapiens
cactaggtgcccagtc

SEQ ID NO: 4772193 - DNA, 21 bp, Homo sapiens
cactaggtgcccagtcttgag

SEQ ID NO: 4772194 - DNA, 16 bp, Homo sapiens
cactataatgtgaaat

SEQ ID NO: 4772195 - DNA, 19 bp, Homo sapiens
cactatccatgcaccaaac

SEQ ID NO: 4772196 - DNA, 14 bp, Homo sapiens
cactatgcatttta

SEQ ID NO: 4772197 - DNA, 19 bp, Homo sapiens
cactatggtatgctggcca

SEQ ID NO: 4772198 - DNA, 12 bp, Homo sapiens
cactcaggagca

SEQ ID NO: 4772199 - DNA, 18 bp, Homo sapiens
cactcaggagcacagcca

SEQ ID NO: 4772200 - DNA, 20 bp, Homo sapiens
cactcaggagcacagccata

SEQ ID NO: 4772201 - DNA, 22 bp, Homo sapiens
cactcatttatttccatattaa

SEQ ID NO: 4772202 - DNA, 13 bp, Homo sapiens
cactccactcccc

SEQ ID NO: 4772203 - DNA, 15 bp, Homo sapiens
cagcagcctgcttcc

SEQ ID NO: 4772204 - DNA, 20 bp, Homo sapiens
cagcagcctgcttcccacct

SEQ ID NO: 4772205 - DNA, 21 bp, Homo sapiens
cagcagcctgcttcccacctc

SEQ ID NO: 4772206 - DNA, 15 bp, Homo sapiens
cagcagcgcccgagg

SEQ ID NO: 4772207 - DNA, 16 bp, Homo sapiens
cagcagcgcccgaggc

SEQ ID NO: 4772208 - DNA, 18 bp, Homo sapiens
cagcagcggcagcagcag

SEQ ID NO: 4772209 - DNA, 15 bp, Homo sapiens
cagcagcggcccaga

SEQ ID NO: 4772210 - DNA, 17 bp, Homo sapiens
cagcagcggcccagatt

SEQ ID NO: 4772211 - DNA, 11 bp, Homo sapiens
cagcagctcca

SEQ ID NO: 4772212 - DNA, 15 bp, Homo sapiens
cagcaggctctcagg

SEQ ID NO: 4772213 - DNA, 16 bp, Homo sapiens
cagcagggcgggccag

SEQ ID NO: 4772214 - DNA, 20 bp, Homo sapiens
cagcagggcgggccaggaga

SEQ ID NO: 4772215 - DNA, 15 bp, Homo sapiens
cagcaggggaaagat

SEQ ID NO: 4772216 - DNA, 16 bp, Homo sapiens
cagcaggggaaagatt

SEQ ID NO: 4772217 - DNA, 22 bp, Homo sapiens
cagcaggggaaagattatattt

SEQ ID NO: 4772218 - DNA, 15 bp, Homo sapiens
cagcaggggggttgg

SEQ ID NO: 4772219 - DNA, 22 bp, Homo sapiens
cagcaggggggttgggttccag

SEQ ID NO: 4772220 - DNA, 18 bp, Homo sapiens
cagcaggttctctcctgt

SEQ ID NO: 4772221 - DNA, 24 bp, Homo sapiens
cagcaggttgtgtgtgtgtgcagt

SEQ ID NO: 4772222 - DNA, 16 bp, Homo sapiens
cagcataccagttctt

SEQ ID NO: 4772223 - DNA, 17 bp, Homo sapiens
cagcataccagttcttg

SEQ ID NO: 4772224 - DNA, 18 bp, Homo sapiens
cagcataccagttcttgc

SEQ ID NO: 4772225 - DNA, 13 bp, Homo sapiens
cagcatgcattta

SEQ ID NO: 4772226 - DNA, 14 bp, Homo sapiens
cagcatgcatttag

SEQ ID NO: 4772227 - DNA, 21 bp, Homo sapiens
cagcatgcatttagcatgagt

SEQ ID NO: 4772228 - DNA, 15 bp, Homo sapiens
cagccaccacctgga

SEQ ID NO: 4772229 - DNA, 19 bp, Homo sapiens
cagccacccggatctccag

SEQ ID NO: 4772230 - DNA, 23 bp, Homo sapiens
cagccacccggatctccaggccc

SEQ ID NO: 4772231 - DNA, 15 bp, Homo sapiens
cagccagaaactgaa

SEQ ID NO: 4772232 - DNA, 13 bp, Homo sapiens
cagcccaaccggg

SEQ ID NO: 4772233 - DNA, 21 bp, Homo sapiens
cagcccaaccgggaaaggcat

SEQ ID NO: 4772234 - DNA, 22 bp, Homo sapiens
cagcccaaccgggaaaggcatc

SEQ ID NO: 4772235 - DNA, 18 bp, Homo sapiens
cagcccacacagcccgag

SEQ ID NO: 4772236 - DNA, 17 bp, Homo sapiens
cagcccagaacgggcct

SEQ ID NO: 4772237 - DNA, 20 bp, Homo sapiens
cagcccagaacgggcctccc

SEQ ID NO: 4772238 - DNA, 21 bp, Homo sapiens
cagcccagaacgggcctcccc

SEQ ID NO: 4772239 - DNA, 11 bp, Homo sapiens
cagcccagaga

SEQ ID NO: 4772240 - DNA, 12 bp, Homo sapiens
cagcccagagag

SEQ ID NO: 4772241 - DNA, 21 bp, Homo sapiens
cagcccagagagaccctgcca

SEQ ID NO: 4772242 - DNA, 23 bp, Homo sapiens
cagcccagagagaccctgccaac

SEQ ID NO: 4772243 - DNA, 17 bp, Homo sapiens
cagcccatgtcaatcaa

SEQ ID NO: 4772244 - DNA, 16 bp, Homo sapiens
cagcccccacccccgt

SEQ ID NO: 4772245 - DNA, 13 bp, Homo sapiens
cagcccccacgcc

SEQ ID NO: 4772246 - DNA, 20 bp, Homo sapiens
cagccccccacgcttctgga

SEQ ID NO: 4772247 - DNA, 14 bp, Homo sapiens
cagccccccagcac

SEQ ID NO: 4772248 - DNA, 16 bp, Homo sapiens
cagccccccagcacta

SEQ ID NO: 4772249 - DNA, 21 bp, Homo sapiens
cagccccctgcttctcccgcc

SEQ ID NO: 4772250 - DNA, 16 bp, Homo sapiens
cagccccttgcttcta

SEQ ID NO: 4772251 - DNA, 14 bp, Homo sapiens
cagcccgagcccct

SEQ ID NO: 4772252 - DNA, 18 bp, Homo sapiens
cagcccgatgtccctgtc

SEQ ID NO: 4772253 - DNA, 17 bp, Homo sapiens
cagcccgcagaggtggg

SEQ ID NO: 4772254 - DNA, 18 bp, Homo sapiens
cagccctccgccagccct

SEQ ID NO: 4772255 - DNA, 23 bp, Homo sapiens
cagccctccgccagccctgttcc

SEQ ID NO: 4772256 - DNA, 12 bp, Homo sapiens
cagccctgccca

SEQ ID NO: 4772257 - DNA, 11 bp, Homo sapiens
cagccctgggc

SEQ ID NO: 4772258 - DNA, 15 bp, Homo sapiens
cagccctgggcacat

SEQ ID NO: 4772259 - DNA, 13 bp, Homo sapiens
cagccctggggct

SEQ ID NO: 4772260 - DNA, 22 bp, Homo sapiens
cagccctgttccgcctcactgg

SEQ ID NO: 4772261 - DNA, 22 bp, Homo sapiens
cagccgcaaatccataccccct

SEQ ID NO: 4772262 - DNA, 16 bp, Homo sapiens
cagccgccctgggctg

SEQ ID NO: 4772263 - DNA, 23 bp, Homo sapiens
cagccgccttccttgaccttcct

SEQ ID NO: 4772264 - DNA, 21 bp, Homo sapiens
cagccgcgctctgcccctccg

SEQ ID NO: 4772265 - DNA, 15 bp, Homo sapiens
cagcctcacccttgc

SEQ ID NO: 4772266 - DNA, 16 bp, Homo sapiens
cagcctcacccttgcg

SEQ ID NO: 4772267 - DNA, 11 bp, Homo sapiens
cagcctccccc

SEQ ID NO: 4772268 - DNA, 13 bp, Homo sapiens
cagcctcccccag

SEQ ID NO: 4772269 - DNA, 14 bp, Homo sapiens
cagcctcccccagg

SEQ ID NO: 4772270 - DNA, 12 bp, Homo sapiens
cagcctctgaag

SEQ ID NO: 4772271 - DNA, 18 bp, Homo sapiens
cagcctgagccacagtgg

SEQ ID NO: 4772272 - DNA, 18 bp, Homo sapiens
cagcctgagctccaccct

SEQ ID NO: 4772273 - DNA, 20 bp, Homo sapiens
cagcctgagctccaccctcc

SEQ ID NO: 4772274 - DNA, 21 bp, Homo sapiens
cagcctgagctccaccctccc

SEQ ID NO: 4772275 - DNA, 17 bp, Homo sapiens
cagcctgcacacacctg

SEQ ID NO: 4772276 - DNA, 12 bp, Homo sapiens
cagcctgcacag

SEQ ID NO: 4772277 - DNA, 14 bp, Homo sapiens
cagcctgcacagtg

SEQ ID NO: 4772278 - DNA, 18 bp, Homo sapiens
cagcctgtgaactgccag

SEQ ID NO: 4772279 - DNA, 19 bp, Homo sapiens
cagcctgtgaactgccagg

SEQ ID NO: 4772280 - DNA, 16 bp, Homo sapiens
cagcctttgcgctctg

SEQ ID NO: 4772281 - DNA, 19 bp, Homo sapiens
cagcctttgcgctctgggt

SEQ ID NO: 4772282 - DNA, 23 bp, Homo sapiens
cagcgcaacagctgtgtgtgccc

SEQ ID NO: 4772283 - DNA, 17 bp, Homo sapiens
cagcgcatggcgccccg

SEQ ID NO: 4772284 - DNA, 23 bp, Homo sapiens
cagcgccctctacctcctagcaa

SEQ ID NO: 4772285 - DNA, 21 bp, Homo sapiens
cagcgcctcccgccgcctcgg

SEQ ID NO: 4772286 - DNA, 14 bp, Homo sapiens
cagcgctgaacaga

SEQ ID NO: 4772287 - DNA, 16 bp, Homo sapiens
cagcggagaggacccc

SEQ ID NO: 4772288 - DNA, 13 bp, Homo sapiens
cagcggcccggcc

SEQ ID NO: 4772289 - DNA, 15 bp, Homo sapiens
cagcggcccggccca

SEQ ID NO: 4772290 - DNA, 23 bp, Homo sapiens
cagcggcccggcccacgcagagc

SEQ ID NO: 4772291 - DNA, 15 bp, Homo sapiens
cagctaacatggaag

SEQ ID NO: 4772292 - DNA, 14 bp, Homo sapiens
cagctaatttgtga

SEQ ID NO: 4772293 - DNA, 18 bp, Homo sapiens
cagctaatttgtgaaagt

SEQ ID NO: 4772294 - DNA, 19 bp, Homo sapiens
cagctaatttgtgaaagtg

SEQ ID NO: 4772295 - DNA, 20 bp, Homo sapiens
cagctacaggggaggctgag

SEQ ID NO: 4772296 - DNA, 13 bp, Homo sapiens
cagctactcagat

SEQ ID NO: 4772297 - DNA, 15 bp, Homo sapiens
cagctactcagatct

SEQ ID NO: 4772298 - DNA, 14 bp, Homo sapiens
cagctattcacaca

SEQ ID NO: 4772299 - DNA, 17 bp, Homo sapiens
cagctattcacacacac

SEQ ID NO: 4772300 - DNA, 15 bp, Homo sapiens
cagctcactgcaacc

SEQ ID NO: 4772301 - DNA, 18 bp, Homo sapiens
cagctcaggggcagctca

SEQ ID NO: 4772302 - DNA, 18 bp, Homo sapiens
cagctcagtcccacagcc

SEQ ID NO: 4772303 - DNA, 19 bp, Homo sapiens
cagctcagtcccacagccc

SEQ ID NO: 4772304 - DNA, 16 bp, Homo sapiens
cagctccaacctggag

SEQ ID NO: 4772305 - DNA, 18 bp, Homo sapiens
cagctccaacctggaggc

SEQ ID NO: 4772306 - DNA, 14 bp, Homo sapiens
cagctccactctga

SEQ ID NO: 4772307 - DNA, 23 bp, Homo sapiens
cagctccactctgaagtcccttc

SEQ ID NO: 4772308 - DNA, 21 bp, Homo sapiens
cagctccggaaggacacagtc

SEQ ID NO: 4772309 - DNA, 21 bp, Homo sapiens
cagctcctcgggtggggcctg

SEQ ID NO: 4772310 - DNA, 21 bp, Homo sapiens
cagctcctcttcctgcctctc

SEQ ID NO: 4772311 - DNA, 19 bp, Homo sapiens
cagctctaaagcagagatg

SEQ ID NO: 4772312 - DNA, 10 bp, Homo sapiens
cagctcttat

SEQ ID NO: 4772313 - DNA, 14 bp, Homo sapiens
cagctgacggcagt

SEQ ID NO: 4772314 - DNA, 20 bp, Homo sapiens
cagctgcagttagcacagag

SEQ ID NO: 4772315 - DNA, 23 bp, Homo sapiens
cagctgcagttagcacagaggat

SEQ ID NO: 4772316 - DNA, 14 bp, Homo sapiens
cagctgcttgggct

SEQ ID NO: 4772317 - DNA, 19 bp, Homo sapiens
cagctgcttgggcttcatc

SEQ ID NO: 4772318 - DNA, 22 bp, Homo sapiens
cagctggatggggcggcctgca

SEQ ID NO: 4772319 - DNA, 16 bp, Homo sapiens
cagctggcagcgcctc

SEQ ID NO: 4772320 - DNA, 19 bp, Homo sapiens
cagctggcagcgcctcccg

SEQ ID NO: 4772321 - DNA, 14 bp, Homo sapiens
cagctggctgggtc

SEQ ID NO: 4772322 - DNA, 23 bp, Homo sapiens
cagctggctgggtcgcccctcct

SEQ ID NO: 4772323 - DNA, 18 bp, Homo sapiens
cagctggggggctgtcct

SEQ ID NO: 4772324 - DNA, 20 bp, Homo sapiens
cagctggggggctgtcctga

SEQ ID NO: 4772325 - DNA, 16 bp, Homo sapiens
cagtccacgccgggtc

SEQ ID NO: 4772326 - DNA, 21 bp, Homo sapiens
cagtccccctatccttggcac

SEQ ID NO: 4772327 - DNA, 23 bp, Homo sapiens
cagtccccctatccttggcacca

SEQ ID NO: 4772328 - DNA, 16 bp, Homo sapiens
cagtccccgggaaagg

SEQ ID NO: 4772329 - DNA, 15 bp, Homo sapiens
cagtccctccctcct

SEQ ID NO: 4772330 - DNA, 18 bp, Homo sapiens
cagtccctccctcctggc

SEQ ID NO: 4772331 - DNA, 17 bp, Homo sapiens
cagtcctagaatgtttc

SEQ ID NO: 4772332 - DNA, 18 bp, Homo sapiens
cagtcctcggcagctccg

SEQ ID NO: 4772333 - DNA, 12 bp, Homo sapiens
cagtcctgggag

SEQ ID NO: 4772334 - DNA, 13 bp, Homo sapiens
cagtcgatattcc

SEQ ID NO: 4772335 - DNA, 16 bp, Homo sapiens
cagtcgatattcccag

SEQ ID NO: 4772336 - DNA, 18 bp, Homo sapiens
cagtcgatattcccaggg

SEQ ID NO: 4772337 - DNA, 17 bp, Homo sapiens
cagtcggagcctcactc

SEQ ID NO: 4772338 - DNA, 21 bp, Homo sapiens
cagtctatgctgtgtgcagag

SEQ ID NO: 4772339 - DNA, 17 bp, Homo sapiens
cagtctccgctcccgca

SEQ ID NO: 4772340 - DNA, 15 bp, Homo sapiens
cagtctctatttgat

SEQ ID NO: 4772341 - DNA, 21 bp, Homo sapiens
cagtctctatttgatttgcaa

SEQ ID NO: 4772342 - DNA, 22 bp, Homo sapiens
cagtcttgagtgggccccctct

SEQ ID NO: 4772343 - DNA, 15 bp, Homo sapiens
cagtcttttcctacg

SEQ ID NO: 4772344 - DNA, 18 bp, Homo sapiens
cagtgaagcccaggagga

SEQ ID NO: 4772345 - DNA, 24 bp, Homo sapiens
cagtgacccttcccaatcagcact

SEQ ID NO: 4772346 - DNA, 19 bp, Homo sapiens
cagtgcagggacagcctgc

SEQ ID NO: 4772347 - DNA, 21 bp, Homo sapiens
cagtgcagggacagcctgcac

SEQ ID NO: 4772348 - DNA, 19 bp, Homo sapiens
cagtgcatgctgtccctta

SEQ ID NO: 4772349 - DNA, 22 bp, Homo sapiens
cagtgcatgctgtcccttacgt

SEQ ID NO: 4772350 - DNA, 19 bp, Homo sapiens
cagtgcctaactccttaca

SEQ ID NO: 4772351 - DNA, 16 bp, Homo sapiens
cagtgctagtgagctg

SEQ ID NO: 4772352 - DNA, 17 bp, Homo sapiens
cagtgctttatccacat

SEQ ID NO: 4772353 - DNA, 18 bp, Homo sapiens
cagtgctttatccacatt

SEQ ID NO: 4772354 - DNA, 23 bp, Homo sapiens
cagtggacatttgttctgggtta

SEQ ID NO: 4772355 - DNA, 21 bp, Homo sapiens
cagtggatcacacacatggaa

SEQ ID NO: 4772356 - DNA, 18 bp, Homo sapiens
cagtggcctacaaatcag

SEQ ID NO: 4772357 - DNA, 21 bp, Homo sapiens
cagtggcgtgatctcagctca

SEQ ID NO: 4772358 - DNA, 19 bp, Homo sapiens
cagtgggcggcttccctgc

SEQ ID NO: 4772359 - DNA, 13 bp, Homo sapiens
cagtggggcccat

SEQ ID NO: 4772360 - DNA, 19 bp, Homo sapiens
cagtggggcccatggcccc

SEQ ID NO: 4772361 - DNA, 20 bp, Homo sapiens
cagtggtccagggtccagcc

SEQ ID NO: 4772362 - DNA, 14 bp, Homo sapiens
cagtggtggaggtg

SEQ ID NO: 4772363 - DNA, 22 bp, Homo sapiens
cagtggttcctaatcctctagg

SEQ ID NO: 4772364 - DNA, 18 bp, Homo sapiens
cagtggttcgggggaaat

SEQ ID NO: 4772365 - DNA, 23 bp, Homo sapiens
cagtggttgttttttcattgtgt

SEQ ID NO: 4772366 - DNA, 20 bp, Homo sapiens
cagtgtagattttatagtgt

SEQ ID NO: 4772367 - DNA, 15 bp, Homo sapiens
cagtgtatttaatgt

SEQ ID NO: 4772368 - DNA, 17 bp, Homo sapiens
cagtgtattttctgtgt

SEQ ID NO: 4772369 - DNA, 18 bp, Homo sapiens
cagtgtcctgtgctttct

SEQ ID NO: 4772370 - DNA, 15 bp, Homo sapiens
cagtgtctggcccag

SEQ ID NO: 4772371 - DNA, 16 bp, Homo sapiens
cagtgtggatgtaaat

SEQ ID NO: 4772372 - DNA, 15 bp, Homo sapiens
cagtgttcgcttggc

SEQ ID NO: 4772373 - DNA, 15 bp, Homo sapiens
cagtgtttccagtga

SEQ ID NO: 4772374 - DNA, 19 bp, Homo sapiens
cagttaagacaacaggcat

SEQ ID NO: 4772375 - DNA, 14 bp, Homo sapiens
cagttaagagaaat

SEQ ID NO: 4772376 - DNA, 17 bp, Homo sapiens
cagttaatgtgccaaaa

SEQ ID NO: 4772377 - DNA, 13 bp, Homo sapiens
cagttaattcttg

SEQ ID NO: 4772378 - DNA, 13 bp, Homo sapiens
cagttacagtggc

SEQ ID NO: 4772379 - DNA, 14 bp, Homo sapiens
cagttacagtggca

SEQ ID NO: 4772380 - DNA, 19 bp, Homo sapiens
cagttacagtggcagtatt

SEQ ID NO: 4772381 - DNA, 20 bp, Homo sapiens
cagttacagtggcagtattg

SEQ ID NO: 4772382 - DNA, 16 bp, Homo sapiens
cagttacttacacacc

SEQ ID NO: 4772383 - DNA, 15 bp, Homo sapiens
cagttagactcaaag

SEQ ID NO: 4772384 - DNA, 17 bp, Homo sapiens
cagttagcccggccaag

SEQ ID NO: 4772385 - DNA, 19 bp, Homo sapiens
cagttagcccggccaagga

SEQ ID NO: 4772386 - DNA, 19 bp, Homo sapiens
cagttatttaccagaagtt

SEQ ID NO: 4772387 - DNA, 15 bp, Homo sapiens
cagttcaaagcagga

SEQ ID NO: 4772388 - DNA, 16 bp, Homo sapiens
cagttcaacctggtgg

SEQ ID NO: 4772389 - DNA, 21 bp, Homo sapiens
cagttcaacctggtggcacca

SEQ ID NO: 4772390 - DNA, 16 bp, Homo sapiens
cagttcacaccctgca

SEQ ID NO: 4772391 - DNA, 19 bp, Homo sapiens
cagttcacaccctgcaagg

SEQ ID NO: 4772392 - DNA, 20 bp, Homo sapiens
cagttcacaccctgcaaggc

SEQ ID NO: 4772393 - DNA, 16 bp, Homo sapiens
cagttccacaattttg

SEQ ID NO: 4772394 - DNA, 22 bp, Homo sapiens
cagttccacaattttgtctcta

SEQ ID NO: 4772395 - DNA, 14 bp, Homo sapiens
cagttccctcagcc

SEQ ID NO: 4772396 - DNA, 13 bp, Homo sapiens
cagttctcatctt

SEQ ID NO: 4772397 - DNA, 15 bp, Homo sapiens
cagttctctccttct

SEQ ID NO: 4772398 - DNA, 18 bp, Homo sapiens
cagttctgcaaatagaaa

SEQ ID NO: 4772399 - DNA, 14 bp, Homo sapiens
cagttcttgcaata

SEQ ID NO: 4772400 - DNA, 23 bp, Homo sapiens
cagttcttggtgactgtcccacc

SEQ ID NO: 4772401 - DNA, 22 bp, Homo sapiens
cagttgcaataaactcagtcaa

SEQ ID NO: 4772402 - DNA, 14 bp, Homo sapiens
cagttggcctctgc

SEQ ID NO: 4772403 - DNA, 16 bp, Homo sapiens
cagttggcctctgccc

SEQ ID NO: 4772404 - DNA, 19 bp, Homo sapiens
cagttggcctctgcccctc

SEQ ID NO: 4772405 - DNA, 18 bp, Homo sapiens
cagttggttttgcatgtc

SEQ ID NO: 4772406 - DNA, 22 bp, Homo sapiens
cagttgtaacattctatttcaa

SEQ ID NO: 4772407 - DNA, 11 bp, Homo sapiens
cagtttaacag

SEQ ID NO: 4772408 - DNA, 12 bp, Homo sapiens
cagtttaacaga

SEQ ID NO: 4772409 - DNA, 14 bp, Homo sapiens
cagtttctaaaatt

SEQ ID NO: 4772410 - DNA, 20 bp, Homo sapiens
cagtttcttgcaagctccag

SEQ ID NO: 4772411 - DNA, 13 bp, Homo sapiens
cagtttgtgaagt

SEQ ID NO: 4772412 - DNA, 18 bp, Homo sapiens
cagtttgtgaagtgattg

SEQ ID NO: 4772413 - DNA, 22 bp, Homo sapiens
cagtttgtgaagtgattgacat

SEQ ID NO: 4772414 - DNA, 12 bp, Homo sapiens
cagtttgtgatc

SEQ ID NO: 4772415 - DNA, 16 bp, Homo sapiens
cagtttgttctccggg

SEQ ID NO: 4772416 - DNA, 17 bp, Homo sapiens
cataaaatatacaaaca

SEQ ID NO: 4772417 - DNA, 17 bp, Homo sapiens
cataaaatcgctttcaa

SEQ ID NO: 4772418 - DNA, 18 bp, Homo sapiens
cataaacacttctcctta

SEQ ID NO: 4772419 - DNA, 21 bp, Homo sapiens
cataaactagatatagctttt

SEQ ID NO: 4772420 - DNA, 23 bp, Homo sapiens
cataaatagtaaataatgattca

SEQ ID NO: 4772421 - DNA, 16 bp, Homo sapiens
cataaatcttccaaag

SEQ ID NO: 4772422 - DNA, 14 bp, Homo sapiens
cataaattatttct

SEQ ID NO: 4772423 - DNA, 18 bp, Homo sapiens
cataaattatttctaaaa

SEQ ID NO: 4772424 - DNA, 12 bp, Homo sapiens
cataacacacat

SEQ ID NO: 4772425 - DNA, 13 bp, Homo sapiens
cataacaggcatt

SEQ ID NO: 4772426 - DNA, 16 bp, Homo sapiens
cataacaggcattgca

SEQ ID NO: 4772427 - DNA, 14 bp, Homo sapiens
cataactagagcac

SEQ ID NO: 4772428 - DNA, 18 bp, Homo sapiens
cataactagagtatgtgt

SEQ ID NO: 4772429 - DNA, 21 bp, Homo sapiens
cataactagagtatgtgtatg

SEQ ID NO: 4772430 - DNA, 23 bp, Homo sapiens
cataactagagtatgtgtatgta

SEQ ID NO: 4772431 - DNA, 20 bp, Homo sapiens
cataacttccagtatcattt

SEQ ID NO: 4772432 - DNA, 22 bp, Homo sapiens
cataagattatatacaaagctg

SEQ ID NO: 4772433 - DNA, 23 bp, Homo sapiens
cataagattatatacaaagctgt

SEQ ID NO: 4772434 - DNA, 19 bp, Homo sapiens
cataatatcttgaagaata

SEQ ID NO: 4772435 - DNA, 19 bp, Homo sapiens
cataatgatactgaattgt

SEQ ID NO: 4772436 - DNA, 13 bp, Homo sapiens
cataatgcttctt

SEQ ID NO: 4772437 - DNA, 23 bp, Homo sapiens
cataatgttagtagcactgagac

SEQ ID NO: 4772438 - DNA, 16 bp, Homo sapiens
cataattagatccatt

SEQ ID NO: 4772439 - DNA, 15 bp, Homo sapiens
catacaaatctcact

SEQ ID NO: 4772440 - DNA, 14 bp, Homo sapiens
catacactgcattc

SEQ ID NO: 4772441 - DNA, 13 bp, Homo sapiens
catacattcctaa

SEQ ID NO: 4772442 - DNA, 20 bp, Homo sapiens
cataccaactcaactttttt

SEQ ID NO: 4772443 - DNA, 18 bp, Homo sapiens
cataccagttcttgcaat

SEQ ID NO: 4772444 - DNA, 14 bp, Homo sapiens
cataccccctgccc

SEQ ID NO: 4772445 - DNA, 19 bp, Homo sapiens
cataccccctgccccagag

SEQ ID NO: 4772446 - DNA, 20 bp, Homo sapiens
cataccccctgccccagaga

SEQ ID NO: 4772447 - DNA, 23 bp, Homo sapiens
catgtgctcagccccagacctgc

SEQ ID NO: 4772448 - DNA, 11 bp, Homo sapiens
catgtgctgca

SEQ ID NO: 4772449 - DNA, 19 bp, Homo sapiens
catgtggcacgtaaggtct

SEQ ID NO: 4772450 - DNA, 17 bp, Homo sapiens
catgtgtaacttctaga

SEQ ID NO: 4772451 - DNA, 18 bp, Homo sapiens
catgtgtcccccctgtgg

SEQ ID NO: 4772452 - DNA, 23 bp, Homo sapiens
catgtgtcccccctgtggtctgt

SEQ ID NO: 4772453 - DNA, 16 bp, Homo sapiens
catgtgtcccctcact

SEQ ID NO: 4772454 - DNA, 17 bp, Homo sapiens
catgtgtcccctcactc

SEQ ID NO: 4772455 - DNA, 20 bp, Homo sapiens
catgtgtgagtcacttctac

SEQ ID NO: 4772456 - DNA, 15 bp, Homo sapiens
catgtgttaatctta

SEQ ID NO: 4772457 - DNA, 12 bp, Homo sapiens
catgttaaaata

SEQ ID NO: 4772458 - DNA, 18 bp, Homo sapiens
catgttaaaataattata

SEQ ID NO: 4772459 - DNA, 21 bp, Homo sapiens
catgttaaaataattatatga

SEQ ID NO: 4772460 - DNA, 13 bp, Homo sapiens
catgttaaagagg

SEQ ID NO: 4772461 - DNA, 13 bp, Homo sapiens
catgttctgtgtc

SEQ ID NO: 4772462 - DNA, 21 bp, Homo sapiens
catgttctgtgtcacgtgacc

SEQ ID NO: 4772463 - DNA, 23 bp, Homo sapiens
catgttctgtgtcacgtgaccct

SEQ ID NO: 4772464 - DNA, 12 bp, Homo sapiens
catgtttaagaa

SEQ ID NO: 4772465 - DNA, 16 bp, Homo sapiens
catgtttaagaaatga

SEQ ID NO: 4772466 - DNA, 16 bp, Homo sapiens
cattaaaacaagagac

SEQ ID NO: 4772467 - DNA, 16 bp, Homo sapiens
cattaaaatagttaca

SEQ ID NO: 4772468 - DNA, 23 bp, Homo sapiens
cattaagtattccttggcccagc

SEQ ID NO: 4772469 - DNA, 17 bp, Homo sapiens
cattaatccacatgttt

SEQ ID NO: 4772470 - DNA, 21 bp, Homo sapiens
cattaatccacatgtttcaga

SEQ ID NO: 4772471 - DNA, 22 bp, Homo sapiens
cattaatccacatgtttcagag

SEQ ID NO: 4772472 - DNA, 21 bp, Homo sapiens
cattaatgtagataaagcact

SEQ ID NO: 4772473 - DNA, 21 bp, Homo sapiens
cattactcaaaatgcaggaca

SEQ ID NO: 4772474 - DNA, 18 bp, Homo sapiens
cattagaattaccatttg

SEQ ID NO: 4772475 - DNA, 14 bp, Homo sapiens
cattagacacacat

SEQ ID NO: 4772476 - DNA, 23 bp, Homo sapiens
cattaggaacagagtatatatgt

SEQ ID NO: 4772477 - DNA, 17 bp, Homo sapiens
cattatagcatgtaata

SEQ ID NO: 4772478 - DNA, 22 bp, Homo sapiens
cattatagcatgtaatattaaa

SEQ ID NO: 4772479 - DNA, 16 bp, Homo sapiens
cattatggctttgtgc

SEQ ID NO: 4772480 - DNA, 17 bp, Homo sapiens
cattatggctttgtgct

SEQ ID NO: 4772481 - DNA, 19 bp, Homo sapiens
cattattggacttccattt

SEQ ID NO: 4772482 - DNA, 12 bp, Homo sapiens
cattatttctgt

SEQ ID NO: 4772483 - DNA, 18 bp, Homo sapiens
cattatttctgtatatag

SEQ ID NO: 4772484 - DNA, 21 bp, Homo sapiens
cattatttctgtatatagatg

SEQ ID NO: 4772485 - DNA, 23 bp, Homo sapiens
cattcaactttagtatttttact

SEQ ID NO: 4772486 - DNA, 15 bp, Homo sapiens
cattcatactcaaag

SEQ ID NO: 4772487 - DNA, 15 bp, Homo sapiens
cattcatacttaaaa

SEQ ID NO: 4772488 - DNA, 18 bp, Homo sapiens
cattcatacttaaaaatt

SEQ ID NO: 4772489 - DNA, 22 bp, Homo sapiens
cattcatacttaaaaatttatt

SEQ ID NO: 4772490 - DNA, 14 bp, Homo sapiens
cattcatttacaac

SEQ ID NO: 4772491 - DNA, 20 bp, Homo sapiens
cattccaggggctgcagccc

SEQ ID NO: 4772492 - DNA, 22 bp, Homo sapiens
cattccaggggctgcagccccc

SEQ ID NO: 4772493 - DNA, 15 bp, Homo sapiens
cattccagtccaatt

SEQ ID NO: 4772494 - DNA, 19 bp, Homo sapiens
cattccagtccaattttcc

SEQ ID NO: 4772495 - DNA, 12 bp, Homo sapiens
cattccatttgc

SEQ ID NO: 4772496 - DNA, 18 bp, Homo sapiens
cattcctgaccctcactt

SEQ ID NO: 4772497 - DNA, 14 bp, Homo sapiens
cattctatctactg

SEQ ID NO: 4772498 - DNA, 23 bp, Homo sapiens
cattctatgactcttgtctcctc

SEQ ID NO: 4772499 - DNA, 23 bp, Homo sapiens
cattctcatccaaaagtgaccag

SEQ ID NO: 4772500 - DNA, 18 bp, Homo sapiens
cattctggggtggggctt

SEQ ID NO: 4772501 - DNA, 22 bp, Homo sapiens
cattctggtccttagtaaattc

SEQ ID NO: 4772502 - DNA, 19 bp, Homo sapiens
cattctttataaaccataa

SEQ ID NO: 4772503 - DNA, 14 bp, Homo sapiens
cattgaaactgtat

SEQ ID NO: 4772504 - DNA, 13 bp, Homo sapiens
cattgaaataata

SEQ ID NO: 4772505 - DNA, 18 bp, Homo sapiens
cattgaacactgcaccct

SEQ ID NO: 4772506 - DNA, 20 bp, Homo sapiens
cattgaagggggatgcaggc

SEQ ID NO: 4772507 - DNA, 13 bp, Homo sapiens
cattgaccttcat

SEQ ID NO: 4772508 - DNA, 14 bp, Homo sapiens
cattgcactaaaag

SEQ ID NO: 4772509 - DNA, 17 bp, Homo sapiens
cattgcactaaaagtga

SEQ ID NO: 4772510 - DNA, 21 bp, Homo sapiens
cattgcactaaaagtgatgtg

SEQ ID NO: 4772511 - DNA, 23 bp, Homo sapiens
cattgcactaaaagtgatgtgat

SEQ ID NO: 4772512 - DNA, 15 bp, Homo sapiens
cattgcactgcagtt

SEQ ID NO: 4772513 - DNA, 13 bp, Homo sapiens
cattgctggactg

SEQ ID NO: 4772514 - DNA, 17 bp, Homo sapiens
cattgcttcactaccca

SEQ ID NO: 4772515 - DNA, 21 bp, Homo sapiens
cattgcttcattaaaacaaga

SEQ ID NO: 4772516 - DNA, 23 bp, Homo sapiens
cattggccttaactggccctcgg

SEQ ID NO: 4772517 - DNA, 21 bp, Homo sapiens
cattggttacaaatttttact

SEQ ID NO: 4772518 - DNA, 13 bp, Homo sapiens
cattgtacagttt

SEQ ID NO: 4772519 - DNA, 19 bp, Homo sapiens
cattgtacagtttgtttac

SEQ ID NO: 4772520 - DNA, 20 bp, Homo sapiens
cattgtacagtttgtttaca

SEQ ID NO: 4772521 - DNA, 21 bp, Homo sapiens
cattgtacagtttgtttacac

SEQ ID NO: 4772522 - DNA, 19 bp, Homo sapiens
cattgtagcctaatattca

SEQ ID NO: 4772523 - DNA, 15 bp, Homo sapiens
cattgtcagaatgtt

SEQ ID NO: 4772524 - DNA, 14 bp, Homo sapiens
cattgtggctgtca

SEQ ID NO: 4772525 - DNA, 14 bp, Homo sapiens
cattgtgttttctt

SEQ ID NO: 4772526 - DNA, 20 bp, Homo sapiens
cattgtgttttcttcgtgga

SEQ ID NO: 4772527 - DNA, 15 bp, Homo sapiens
cattgttcagaaaag

SEQ ID NO: 4772528 - DNA, 19 bp, Homo sapiens
catttaactagcactttat

SEQ ID NO: 4772529 - DNA, 18 bp, Homo sapiens
catttaagaattgccagt

SEQ ID NO: 4772530 - DNA, 13 bp, Homo sapiens
catttagcacagt

SEQ ID NO: 4772531 - DNA, 18 bp, Homo sapiens
catttaggtgaggaagca

SEQ ID NO: 4772532 - DNA, 16 bp, Homo sapiens
catttagtcctcacct

SEQ ID NO: 4772533 - DNA, 23 bp, Homo sapiens
catttagtcctcaccttctgttt

SEQ ID NO: 4772534 - DNA, 14 bp, Homo sapiens
catttatctttgta

SEQ ID NO: 4772535 - DNA, 14 bp, Homo sapiens
catttatgcatgag

SEQ ID NO: 4772536 - DNA, 17 bp, Homo sapiens
catttatgcatgagaac

SEQ ID NO: 4772537 - DNA, 21 bp, Homo sapiens
catttatgcatgagaactaaa

SEQ ID NO: 4772538 - DNA, 22 bp, Homo sapiens
catttatgcatgagaactaaat

SEQ ID NO: 4772539 - DNA, 23 bp, Homo sapiens
catttatgcatgagaactaaata

SEQ ID NO: 4772540 - DNA, 13 bp, Homo sapiens
catttatgtgtga

SEQ ID NO: 4772541 - DNA, 22 bp, Homo sapiens
catttatgtgtgaagcaaattt

SEQ ID NO: 4772542 - DNA, 17 bp, Homo sapiens
catttatgttatttatg

SEQ ID NO: 4772543 - DNA, 18 bp, Homo sapiens
catttatttccatattaa

SEQ ID NO: 4772544 - DNA, 20 bp, Homo sapiens
catttatttccatattaaaa

SEQ ID NO: 4772545 - DNA, 21 bp, Homo sapiens
catttatttccatattaaaat

SEQ ID NO: 4772546 - DNA, 15 bp, Homo sapiens
catttcacattcctg

SEQ ID NO: 4772547 - DNA, 14 bp, Homo sapiens
catttcataaaaat

SEQ ID NO: 4772548 - DNA, 15 bp, Homo sapiens
catttcataaaaatc

SEQ ID NO: 4772549 - DNA, 18 bp, Homo sapiens
catttcatgtccataaaa

SEQ ID NO: 4772550 - DNA, 15 bp, Homo sapiens
catttccagcaaaat

SEQ ID NO: 4772551 - DNA, 18 bp, Homo sapiens
catttcccctgtggtttg

SEQ ID NO: 4772552 - DNA, 13 bp, Homo sapiens
catttccctgctg

SEQ ID NO: 4772553 - DNA, 17 bp, Homo sapiens
catttcttggtatgatc

SEQ ID NO: 4772554 - DNA, 14 bp, Homo sapiens
catttgatattgtg

SEQ ID NO: 4772555 - DNA, 13 bp, Homo sapiens
catttgctaatga

SEQ ID NO: 4772556 - DNA, 21 bp, Homo sapiens
catttgctgcatttcaagtta

SEQ ID NO: 4772557 - DNA, 18 bp, Homo sapiens
catttgctttttgcttgt

SEQ ID NO: 4772558 - DNA, 19 bp, Homo sapiens
catttggattttaaacaaa

SEQ ID NO: 4772559 - DNA, 22 bp, Homo sapiens
catttggattttaaacaaaatt

SEQ ID NO: 4772560 - DNA, 23 bp, Homo sapiens
catttggattttaaacaaaattt

SEQ ID NO: 4772561 - DNA, 22 bp, Homo sapiens
catttgtaatgtatcttattta

SEQ ID NO: 4772562 - DNA, 13 bp, Homo sapiens
catttgttaatat

SEQ ID NO: 4772563 - DNA, 20 bp, Homo sapiens
catttgttaatgattcttgt

SEQ ID NO: 4772564 - DNA, 23 bp, Homo sapiens
catttgttctgggttaacagtaa

SEQ ID NO: 4772565 - DNA, 14 bp, Homo sapiens
cattttaaatgtct

SEQ ID NO: 4772566 - DNA, 16 bp, Homo sapiens
cattttactgtacaga

SEQ ID NO: 4772567 - DNA, 16 bp, Homo sapiens
cattttactgtctgta

SEQ ID NO: 4772568 - DNA, 15 bp, Homo sapiens
ccagatacctgtgag

SEQ ID NO: 4772569 - DNA, 17 bp, Homo sapiens
ccagatacctgtgagga

SEQ ID NO: 4772570 - DNA, 21 bp, Homo sapiens
ccagatcctctttccccactg

SEQ ID NO: 4772571 - DNA, 16 bp, Homo sapiens
ccagatgacagggagc

SEQ ID NO: 4772572 - DNA, 17 bp, Homo sapiens
ccagattattttctata

SEQ ID NO: 4772573 - DNA, 23 bp, Homo sapiens
ccagattattttctatatttgga

SEQ ID NO: 4772574 - DNA, 10 bp, Homo sapiens
ccagcaaaat

SEQ ID NO: 4772575 - DNA, 17 bp, Homo sapiens
ccagcaaagttttcaga

SEQ ID NO: 4772576 - DNA, 16 bp, Homo sapiens
ccagcaacacctgccg

SEQ ID NO: 4772577 - DNA, 21 bp, Homo sapiens
ccagcacaaagcactggcctt

SEQ ID NO: 4772578 - DNA, 15 bp, Homo sapiens
ccagcacatctctga

SEQ ID NO: 4772579 - DNA, 18 bp, Homo sapiens
ccagcaccctctcctggg

SEQ ID NO: 4772580 - DNA, 16 bp, Homo sapiens
ccagcacctcctccgt

SEQ ID NO: 4772581 - DNA, 15 bp, Homo sapiens
ccagcacctttgtaa

SEQ ID NO: 4772582 - DNA, 20 bp, Homo sapiens
ccagcactaaggccgtgtct

SEQ ID NO: 4772583 - DNA, 16 bp, Homo sapiens
ccagcactcccagggc

SEQ ID NO: 4772584 - DNA, 18 bp, Homo sapiens
ccagcactcccagggccc

SEQ ID NO: 4772585 - DNA, 19 bp, Homo sapiens
ccagcactcccagggcccg

SEQ ID NO: 4772586 - DNA, 18 bp, Homo sapiens
ccagcagcgcccgaggcc

SEQ ID NO: 4772587 - DNA, 14 bp, Homo sapiens
ccagcagcggccca

SEQ ID NO: 4772588 - DNA, 13 bp, Homo sapiens
ccagcaggctctc

SEQ ID NO: 4772589 - DNA, 18 bp, Homo sapiens
ccagcaggctctcaggcc

SEQ ID NO: 4772590 - DNA, 21 bp, Homo sapiens
ccagcagggcgggccaggaga

SEQ ID NO: 4772591 - DNA, 21 bp, Homo sapiens
ccagcaggttctctcctgtga

SEQ ID NO: 4772592 - DNA, 18 bp, Homo sapiens
ccagcatagttctgcaat

SEQ ID NO: 4772593 - DNA, 19 bp, Homo sapiens
ccagccacccggatctcca

SEQ ID NO: 4772594 - DNA, 22 bp, Homo sapiens
ccagccacccggatctccaggc

SEQ ID NO: 4772595 - DNA, 12 bp, Homo sapiens
ccagccagcagg

SEQ ID NO: 4772596 - DNA, 18 bp, Homo sapiens
ccagccatggctggatgt

SEQ ID NO: 4772597 - DNA, 15 bp, Homo sapiens
ccagcccgcagaggt

SEQ ID NO: 4772598 - DNA, 13 bp, Homo sapiens
ccagccctccgcc

SEQ ID NO: 4772599 - DNA, 13 bp, Homo sapiens
ccagccctgccca

SEQ ID NO: 4772600 - DNA, 16 bp, Homo sapiens
ccagccctgcccagag

SEQ ID NO: 4772601 - DNA, 24 bp, Homo sapiens
ccagccctgttccgcctcactggg

SEQ ID NO: 4772602 - DNA, 20 bp, Homo sapiens
ccagccgagatagccaaggc

SEQ ID NO: 4772603 - DNA, 16 bp, Homo sapiens
ccagccgccctgggct

SEQ ID NO: 4772604 - DNA, 19 bp, Homo sapiens
ccagcctatctctcttctg

SEQ ID NO: 4772605 - DNA, 20 bp, Homo sapiens
ccagcctatctctcttctgc

SEQ ID NO: 4772606 - DNA, 23 bp, Homo sapiens
ccagcctcccccaggctgcgcct

SEQ ID NO: 4772607 - DNA, 12 bp, Homo sapiens
ccagcctgagcc

SEQ ID NO: 4772608 - DNA, 14 bp, Homo sapiens
ccagcctgagccac

SEQ ID NO: 4772609 - DNA, 16 bp, Homo sapiens
ccagcctgagccacag

SEQ ID NO: 4772610 - DNA, 14 bp, Homo sapiens
ccagcctggcccca

SEQ ID NO: 4772611 - DNA, 17 bp, Homo sapiens
ccagcctggggcctggc

SEQ ID NO: 4772612 - DNA, 16 bp, Homo sapiens
ccagcggggcttctgg

SEQ ID NO: 4772613 - DNA, 15 bp, Homo sapiens
ccagctaatttttgt

SEQ ID NO: 4772614 - DNA, 20 bp, Homo sapiens
ccagctacaggggaggctga

SEQ ID NO: 4772615 - DNA, 21 bp, Homo sapiens
ccagctatctgtcatctctct

SEQ ID NO: 4772616 - DNA, 15 bp, Homo sapiens
ccagctcaggggcag

SEQ ID NO: 4772617 - DNA, 17 bp, Homo sapiens
ccagctcctcttcctgc

SEQ ID NO: 4772618 - DNA, 19 bp, Homo sapiens
ccagctgcaggaatcaaaa

SEQ ID NO: 4772619 - DNA, 16 bp, Homo sapiens
ccagctgcttgggctt

SEQ ID NO: 4772620 - DNA, 12 bp, Homo sapiens
ccagctggcagc

SEQ ID NO: 4772621 - DNA, 19 bp, Homo sapiens
ccagctggcagcgcctccc

SEQ ID NO: 4772622 - DNA, 14 bp, Homo sapiens
ccagctggctgggt

SEQ ID NO: 4772623 - DNA, 20 bp, Homo sapiens
ccagctggctgggtcgcccc

SEQ ID NO: 4772624 - DNA, 22 bp, Homo sapiens
ccagctggctgggtcgcccctc

SEQ ID NO: 4772625 - DNA, 21 bp, Homo sapiens
ccagctgtaccggccactgca

SEQ ID NO: 4772626 - DNA, 14 bp, Homo sapiens
ccagcttgcttctc

SEQ ID NO: 4772627 - DNA, 15 bp, Homo sapiens
ccagcttgcttctct

SEQ ID NO: 4772628 - DNA, 19 bp, Homo sapiens
ccagcttggagtgccacat

SEQ ID NO: 4772629 - DNA, 19 bp, Homo sapiens
ccagcttggagtgccacgt

SEQ ID NO: 4772630 - DNA, 23 bp, Homo sapiens
ccagcttggagtgccacgtggcc

SEQ ID NO: 4772631 - DNA, 21 bp, Homo sapiens
ccagcttggtggttatgtccc

SEQ ID NO: 4772632 - DNA, 21 bp, Homo sapiens
ccaggaagaaggcccgggagg

SEQ ID NO: 4772633 - DNA, 23 bp, Homo sapiens
ccaggaagaggggcgctgccccc

SEQ ID NO: 4772634 - DNA, 17 bp, Homo sapiens
ccaggaagccagcaggc

SEQ ID NO: 4772635 - DNA, 13 bp, Homo sapiens
ccaggaaggggac

SEQ ID NO: 4772636 - DNA, 18 bp, Homo sapiens
ccaggaagtcatcctgca

SEQ ID NO: 4772637 - DNA, 17 bp, Homo sapiens
ccaggacccccccagtc

SEQ ID NO: 4772638 - DNA, 22 bp, Homo sapiens
ccaggaccctgggtcaccttcc

SEQ ID NO: 4772639 - DNA, 16 bp, Homo sapiens
ccaggaccttgcttcc

SEQ ID NO: 4772640 - DNA, 23 bp, Homo sapiens
ccaggaccttgcttccttctcat

SEQ ID NO: 4772641 - DNA, 16 bp, Homo sapiens
ccaggacgcatgcagg

SEQ ID NO: 4772642 - DNA, 22 bp, Homo sapiens
ccaggagaaagaaggcttaaca

SEQ ID NO: 4772643 - DNA, 13 bp, Homo sapiens
ccaggagaccctg

SEQ ID NO: 4772644 - DNA, 19 bp, Homo sapiens
ccaggagatgaggctggat

SEQ ID NO: 4772645 - DNA, 11 bp, Homo sapiens
ccaggagccag

SEQ ID NO: 4772646 - DNA, 14 bp, Homo sapiens
ccaggagccaggtg

SEQ ID NO: 4772647 - DNA, 16 bp, Homo sapiens
ccaggagccaggtgtc

SEQ ID NO: 4772648 - DNA, 13 bp, Homo sapiens
ccaggagcctcct

SEQ ID NO: 4772649 - DNA, 15 bp, Homo sapiens
ccaggaggcctggga

SEQ ID NO: 4772650 - DNA, 14 bp, Homo sapiens
ccaggatgcatgca

SEQ ID NO: 4772651 - DNA, 13 bp, Homo sapiens
ccaggattgtcca

SEQ ID NO: 4772652 - DNA, 16 bp, Homo sapiens
ccaggattgtccacaa

SEQ ID NO: 4772653 - DNA, 20 bp, Homo sapiens
ccaggattgtccacaaatgt

SEQ ID NO: 4772654 - DNA, 14 bp, Homo sapiens
ccaggcaccgccag

SEQ ID NO: 4772655 - DNA, 18 bp, Homo sapiens
ccaggcacggaggctcgt

SEQ ID NO: 4772656 - DNA, 14 bp, Homo sapiens
ccaggcccagcctg

SEQ ID NO: 4772657 - DNA, 19 bp, Homo sapiens
ccaggcccagcctggcccc

SEQ ID NO: 4772658 - DNA, 13 bp, Homo sapiens
ccaggcccgccct

SEQ ID NO: 4772659 - DNA, 14 bp, Homo sapiens
ccaggccctccctg

SEQ ID NO: 4772660 - DNA, 17 bp, Homo sapiens
ccaggccctccctgact

SEQ ID NO: 4772661 - DNA, 12 bp, Homo sapiens
ccaggccctctc

SEQ ID NO: 4772662 - DNA, 15 bp, Homo sapiens
ccaggccggccagcc

SEQ ID NO: 4772663 - DNA, 13 bp, Homo sapiens
ccaggcctcccgc

SEQ ID NO: 4772664 - DNA, 14 bp, Homo sapiens
ccaggcctcccgca

SEQ ID NO: 4772665 - DNA, 16 bp, Homo sapiens
ccaggcctcccgcatg

SEQ ID NO: 4772666 - DNA, 18 bp, Homo sapiens
ccaggcctcccgcatgct

SEQ ID NO: 4772667 - DNA, 21 bp, Homo sapiens
ccaggcctcccgcatgctgcc

SEQ ID NO: 4772668 - DNA, 23 bp, Homo sapiens
ccaggcggaggggcttggagcag

SEQ ID NO: 4772669 - DNA, 17 bp, Homo sapiens
ccaggcggtcactgccc

SEQ ID NO: 4772670 - DNA, 19 bp, Homo sapiens
ccaggcggtcactgcccac

SEQ ID NO: 4772671 - DNA, 19 bp, Homo sapiens
ccaggctagtccggaccca

SEQ ID NO: 4772672 - DNA, 17 bp, Homo sapiens
ccaggctcacaactgtt

SEQ ID NO: 4772673 - DNA, 16 bp, Homo sapiens
ccaggctcaggctgcc

SEQ ID NO: 4772674 - DNA, 18 bp, Homo sapiens
ccaggctcccactgcccc

SEQ ID NO: 4772675 - DNA, 11 bp, Homo sapiens
ccaggctgcag

SEQ ID NO: 4772676 - DNA, 15 bp, Homo sapiens
ccaggctgcagggac

SEQ ID NO: 4772677 - DNA, 13 bp, Homo sapiens
ccaggctgcaggt

SEQ ID NO: 4772678 - DNA, 17 bp, Homo sapiens
ccaggctggagtgcagt

SEQ ID NO: 4772679 - DNA, 17 bp, Homo sapiens
ccagggatgggggatgg

SEQ ID NO: 4772680 - DNA, 23 bp, Homo sapiens
ccagggcccgagcgcgtgccttc

SEQ ID NO: 4772681 - DNA, 14 bp, Homo sapiens
ccagggccctgctc

SEQ ID NO: 4772682 - DNA, 22 bp, Homo sapiens
ccagggccctgctcaggcctca

SEQ ID NO: 4772683 - DNA, 14 bp, Homo sapiens
ccagggccgcttct

SEQ ID NO: 4772684 - DNA, 17 bp, Homo sapiens
ccagggccgcttctcct

SEQ ID NO: 4772685 - DNA, 13 bp, Homo sapiens
ccaggggcttctc

SEQ ID NO: 4772686 - DNA, 23 bp, Homo sapiens
ccaggggcttctccccctcagct

SEQ ID NO: 4772687 - DNA, 15 bp, Homo sapiens
ccagggtgcaggcgc

SEQ ID NO: 4772688 - DNA, 16 bp, Homo sapiens
ccagggtgcaggcgcg

SEQ ID NO: 4772689 - DNA, 22 bp, Homo sapiens
ccagggttaaagaaaggcagag

SEQ ID NO: 4772690 - DNA, 23 bp, Homo sapiens
cccaggccggccagcctcaccct

SEQ ID NO: 4772691 - DNA, 23 bp, Homo sapiens
cccaggcggaggggcttggagca

SEQ ID NO: 4772692 - DNA, 12 bp, Homo sapiens
cccagggagggg

SEQ ID NO: 4772693 - DNA, 16 bp, Homo sapiens
cccagggagggggtca

SEQ ID NO: 4772694 - DNA, 12 bp, Homo sapiens
cccagggcagcg

SEQ ID NO: 4772695 - DNA, 16 bp, Homo sapiens
cccagggccctgctca

SEQ ID NO: 4772696 - DNA, 18 bp, Homo sapiens
cccagggccctgctcagg

SEQ ID NO: 4772697 - DNA, 23 bp, Homo sapiens
cccagggccctgctcaggcctca

SEQ ID NO: 4772698 - DNA, 18 bp, Homo sapiens
cccagggccgcttctcct

SEQ ID NO: 4772699 - DNA, 19 bp, Homo sapiens
cccagggccgcttctcctg

SEQ ID NO: 4772700 - DNA, 15 bp, Homo sapiens
cccaggggtcagcag

SEQ ID NO: 4772701 - DNA, 14 bp, Homo sapiens
cccagggtcccctg

SEQ ID NO: 4772702 - DNA, 13 bp, Homo sapiens
cccagggtgcagg

SEQ ID NO: 4772703 - DNA, 14 bp, Homo sapiens
cccaggtgttgtcc

SEQ ID NO: 4772704 - DNA, 18 bp, Homo sapiens
cccaggttggagtgcagt

SEQ ID NO: 4772705 - DNA, 15 bp, Homo sapiens
cccagtccccgggaa

SEQ ID NO: 4772706 - DNA, 16 bp, Homo sapiens
cccagtccgccccgtg

SEQ ID NO: 4772707 - DNA, 21 bp, Homo sapiens
cccagtgaccgggggaagctg

SEQ ID NO: 4772708 - DNA, 19 bp, Homo sapiens
cccagtgcaatctgtccag

SEQ ID NO: 4772709 - DNA, 18 bp, Homo sapiens
cccagtgggacagaggag

SEQ ID NO: 4772710 - DNA, 20 bp, Homo sapiens
cccagtggttcctaatcctc

SEQ ID NO: 4772711 - DNA, 15 bp, Homo sapiens
cccagtgtctggccc

SEQ ID NO: 4772712 - DNA, 17 bp, Homo sapiens
cccagtgtctggcccag

SEQ ID NO: 4772713 - DNA, 17 bp, Homo sapiens
cccagttagcccggcca

SEQ ID NO: 4772714 - DNA, 17 bp, Homo sapiens
cccatagaaacatgaca

SEQ ID NO: 4772715 - DNA, 22 bp, Homo sapiens
cccatagaaacatgacactgac

SEQ ID NO: 4772716 - DNA, 11 bp, Homo sapiens
cccatatcatg

SEQ ID NO: 4772717 - DNA, 13 bp, Homo sapiens
cccatcactgtgt

SEQ ID NO: 4772718 - DNA, 16 bp, Homo sapiens
cccatcagcatcccac

SEQ ID NO: 4772719 - DNA, 18 bp, Homo sapiens
cccatcgccttctggctg

SEQ ID NO: 4772720 - DNA, 16 bp, Homo sapiens
cccatcgccttctggg

SEQ ID NO: 4772721 - DNA, 16 bp, Homo sapiens
cccatgaccttgacgt

SEQ ID NO: 4772722 - DNA, 19 bp, Homo sapiens
cccatgagcgtccaggtga

SEQ ID NO: 4772723 - DNA, 15 bp, Homo sapiens
cccatgcatggcctc

SEQ ID NO: 4772724 - DNA, 14 bp, Homo sapiens
cccatgccaatgtc

SEQ ID NO: 4772725 - DNA, 15 bp, Homo sapiens
cccatgccaatgtcc

SEQ ID NO: 4772726 - DNA, 17 bp, Homo sapiens
cccatggaacagccctg

SEQ ID NO: 4772727 - DNA, 18 bp, Homo sapiens
cccatggaacagccctgc

SEQ ID NO: 4772728 - DNA, 22 bp, Homo sapiens
cccatggaacagccctgcacgc

SEQ ID NO: 4772729 - DNA, 17 bp, Homo sapiens
cccatggccccagctgg

SEQ ID NO: 4772730 - DNA, 15 bp, Homo sapiens
cccatggtcacagac

SEQ ID NO: 4772731 - DNA, 16 bp, Homo sapiens
cccatggtcacagacc

SEQ ID NO: 4772732 - DNA, 21 bp, Homo sapiens
cccatggtcacagacccctgg

SEQ ID NO: 4772733 - DNA, 15 bp, Homo sapiens
cccatgtaaatacca

SEQ ID NO: 4772734 - DNA, 21 bp, Homo sapiens
cccattactcaaaatgcagga

SEQ ID NO: 4772735 - DNA, 19 bp, Homo sapiens
cccattgtgaatgttgtcc

SEQ ID NO: 4772736 - DNA, 13 bp, Homo sapiens
cccatttcacaca

SEQ ID NO: 4772737 - DNA, 18 bp, Homo sapiens
cccatttccttgtctaaa

SEQ ID NO: 4772738 - DNA, 18 bp, Homo sapiens
ccccaaactgtagtaatt

SEQ ID NO: 4772739 - DNA, 17 bp, Homo sapiens
ccccaaggaagaacaaa

SEQ ID NO: 4772740 - DNA, 14 bp, Homo sapiens
ccccaaggcactga

SEQ ID NO: 4772741 - DNA, 17 bp, Homo sapiens
ccccacacaggcctggc

SEQ ID NO: 4772742 - DNA, 19 bp, Homo sapiens
ccccacacgccggggctgg

SEQ ID NO: 4772743 - DNA, 21 bp, Homo sapiens
ccccacacgccggggctggcc

SEQ ID NO: 4772744 - DNA, 13 bp, Homo sapiens
ccccacccccgtc

SEQ ID NO: 4772745 - DNA, 18 bp, Homo sapiens
ccccacccccgtcacccc

SEQ ID NO: 4772746 - DNA, 19 bp, Homo sapiens
ccccaccctgtctgcaggc

SEQ ID NO: 4772747 - DNA, 17 bp, Homo sapiens
ccccacctccctgcagc

SEQ ID NO: 4772748 - DNA, 11 bp, Homo sapiens
ccccacctctg

SEQ ID NO: 4772749 - DNA, 19 bp, Homo sapiens
ccccactggagcgtgtact

SEQ ID NO: 4772750 - DNA, 16 bp, Homo sapiens
ccccagagactgccca

SEQ ID NO: 4772751 - DNA, 18 bp, Homo sapiens
ccccagagactgcccacc

SEQ ID NO: 4772752 - DNA, 18 bp, Homo sapiens
ccccagatacctgtgagg

SEQ ID NO: 4772753 - DNA, 22 bp, Homo sapiens
ccccagcactaaggccgtgtct

SEQ ID NO: 4772754 - DNA, 23 bp, Homo sapiens
ccccagccccctggcatgtttca

SEQ ID NO: 4772755 - DNA, 11 bp, Homo sapiens
ccccagcctcc

SEQ ID NO: 4772756 - DNA, 13 bp, Homo sapiens
ccccagcctcccc

SEQ ID NO: 4772757 - DNA, 22 bp, Homo sapiens
ccccagcgtggggctaacgggc

SEQ ID NO: 4772758 - DNA, 16 bp, Homo sapiens
ccccagctcaggggca

SEQ ID NO: 4772759 - DNA, 22 bp, Homo sapiens
ccccagctggctgggtcgcccc

SEQ ID NO: 4772760 - DNA, 20 bp, Homo sapiens
ccccaggaagtcatcctgca

SEQ ID NO: 4772761 - DNA, 16 bp, Homo sapiens
ccccaggaccccccca

SEQ ID NO: 4772762 - DNA, 19 bp, Homo sapiens
ccccaggacgcatgcaggg

SEQ ID NO: 4772763 - DNA, 19 bp, Homo sapiens
ccccaggcccgccctgccc

SEQ ID NO: 4772764 - DNA, 14 bp, Homo sapiens
ccccaggccctccc

SEQ ID NO: 4772765 - DNA, 16 bp, Homo sapiens
ccccaggccctccctg

SEQ ID NO: 4772766 - DNA, 15 bp, Homo sapiens
ccccaggctgcgcct

SEQ ID NO: 4772767 - DNA, 19 bp, Homo sapiens
ccccaggctgcgcctgccc

SEQ ID NO: 4772768 - DNA, 13 bp, Homo sapiens
ccccagggagggg

SEQ ID NO: 4772769 - DNA, 15 bp, Homo sapiens
ccccagggccctgct

SEQ ID NO: 4772770 - DNA, 20 bp, Homo sapiens
ccccagggccctgctcaggc

SEQ ID NO: 4772771 - DNA, 21 bp, Homo sapiens
ccccagggtcccctgcatggc

SEQ ID NO: 4772772 - DNA, 16 bp, Homo sapiens
ccccagggtgcaggcg

SEQ ID NO: 4772773 - DNA, 13 bp, Homo sapiens
ccccagtccccgg

SEQ ID NO: 4772774 - DNA, 16 bp, Homo sapiens
ccccatatataaatta

SEQ ID NO: 4772775 - DNA, 20 bp, Homo sapiens
ccccatgccaatgtccaggt

SEQ ID NO: 4772776 - DNA, 13 bp, Homo sapiens
ccccatgggctgc

SEQ ID NO: 4772777 - DNA, 22 bp, Homo sapiens
ccccattccagtccaattttcc

SEQ ID NO: 4772778 - DNA, 19 bp, Homo sapiens
cccccaaaccctgcttctg

SEQ ID NO: 4772779 - DNA, 15 bp, Homo sapiens
cccccacctctgtga

SEQ ID NO: 4772780 - DNA, 12 bp, Homo sapiens
cccccacggccg

SEQ ID NO: 4772781 - DNA, 15 bp, Homo sapiens
cccccacggccgtcc

SEQ ID NO: 4772782 - DNA, 15 bp, Homo sapiens
cccccagcagctcac

SEQ ID NO: 4772783 - DNA, 18 bp, Homo sapiens
cccccaggctgcgcctgc

SEQ ID NO: 4772784 - DNA, 15 bp, Homo sapiens
cccccatgccaccac

SEQ ID NO: 4772785 - DNA, 21 bp, Homo sapiens
cccccatgccaccacccaccc

SEQ ID NO: 4772786 - DNA, 13 bp, Homo sapiens
ccccccagcacta

SEQ ID NO: 4772787 - DNA, 18 bp, Homo sapiens
cccccggaggcgcccacc

SEQ ID NO: 4772788 - DNA, 20 bp, Homo sapiens
cccccggaggcgcccacctg

SEQ ID NO: 4772789 - DNA, 21 bp, Homo sapiens
ccccctatctcttcctgtcta

SEQ ID NO: 4772790 - DNA, 12 bp, Homo sapiens
ccccctccccaa

SEQ ID NO: 4772791 - DNA, 13 bp, Homo sapiens
ccccctctcgggc

SEQ ID NO: 4772792 - DNA, 11 bp, Homo sapiens
ccccctgcacc

SEQ ID NO: 4772793 - DNA, 12 bp, Homo sapiens
ccccctgcaccc

SEQ ID NO: 4772794 - DNA, 13 bp, Homo sapiens
ccccctgtggtct

SEQ ID NO: 4772795 - DNA, 15 bp, Homo sapiens
ccccctgtggtctgt

SEQ ID NO: 4772796 - DNA, 13 bp, Homo sapiens
cccccttcccctg

SEQ ID NO: 4772797 - DNA, 19 bp, Homo sapiens
cccccttcccctgcgccct

SEQ ID NO: 4772798 - DNA, 16 bp, Homo sapiens
ccccgcagacagacag

SEQ ID NO: 4772799 - DNA, 16 bp, Homo sapiens
ccccgcccccacccct

SEQ ID NO: 4772800 - DNA, 22 bp, Homo sapiens
ccccgcccccacccctacagcc

SEQ ID NO: 4772801 - DNA, 13 bp, Homo sapiens
ccccgcccctccc

SEQ ID NO: 4772802 - DNA, 15 bp, Homo sapiens
ccccgccctcgctcc

SEQ ID NO: 4772803 - DNA, 15 bp, Homo sapiens
ccccgcgaccacccc

SEQ ID NO: 4772804 - DNA, 18 bp, Homo sapiens
ccccgcgaccacccctgt

SEQ ID NO: 4772805 - DNA, 22 bp, Homo sapiens
ccccgcgcgtgcccccagcgtg

SEQ ID NO: 4772806 - DNA, 13 bp, Homo sapiens
ccccggacgccgc

SEQ ID NO: 4772807 - DNA, 16 bp, Homo sapiens
ccccggacgctggctc

SEQ ID NO: 4772808 - DNA, 22 bp, Homo sapiens
ccccggaggcgcccacctgccc

SEQ ID NO: 4772809 - DNA, 17 bp, Homo sapiens
ccccggcaggccctgca

SEQ ID NO: 4772810 - DNA, 18 bp, Homo sapiens
ccccggcaggccctgcag

SEQ ID NO: 4772811 - DNA, 21 bp, Homo sapiens
ccccggcaggccctgcagtgt

SEQ ID NO: 4772812 - DNA, 21 bp, Homo sapiens
ccccggcctgatggccaggcc

SEQ ID NO: 4772813 - DNA, 17 bp, Homo sapiens
ccctgccctgaggaagg

SEQ ID NO: 4772814 - DNA, 14 bp, Homo sapiens
ccctgccctgcacc

SEQ ID NO: 4772815 - DNA, 15 bp, Homo sapiens
ccctgccctgcacct

SEQ ID NO: 4772816 - DNA, 14 bp, Homo sapiens
ccctgccctggcct

SEQ ID NO: 4772817 - DNA, 16 bp, Homo sapiens
ccctgccctggcctac

SEQ ID NO: 4772818 - DNA, 18 bp, Homo sapiens
ccctgccctggcctacca

SEQ ID NO: 4772819 - DNA, 20 bp, Homo sapiens
ccctgccctggcctaccaca

SEQ ID NO: 4772820 - DNA, 13 bp, Homo sapiens
ccctgcctgagac

SEQ ID NO: 4772821 - DNA, 14 bp, Homo sapiens
ccctgcgcccctgc

SEQ ID NO: 4772822 - DNA, 18 bp, Homo sapiens
ccctgcgcccctgcccag

SEQ ID NO: 4772823 - DNA, 13 bp, Homo sapiens
ccctgcgccctcc

SEQ ID NO: 4772824 - DNA, 16 bp, Homo sapiens
ccctgcgccctccctc

SEQ ID NO: 4772825 - DNA, 16 bp, Homo sapiens
ccctgctcaggcctca

SEQ ID NO: 4772826 - DNA, 17 bp, Homo sapiens
ccctgctccctgctccc

SEQ ID NO: 4772827 - DNA, 15 bp, Homo sapiens
ccctgcttctgctgc

SEQ ID NO: 4772828 - DNA, 18 bp, Homo sapiens
ccctgcttctgctgccct

SEQ ID NO: 4772829 - DNA, 16 bp, Homo sapiens
ccctgcttgctggaaa

SEQ ID NO: 4772830 - DNA, 23 bp, Homo sapiens
ccctgcttgctggaaaactgcca

SEQ ID NO: 4772831 - DNA, 23 bp, Homo sapiens
ccctggaactctatctgggcctg

SEQ ID NO: 4772832 - DNA, 19 bp, Homo sapiens
ccctggaccgagtggacca

SEQ ID NO: 4772833 - DNA, 20 bp, Homo sapiens
ccctggaccgagtggaccac

SEQ ID NO: 4772834 - DNA, 13 bp, Homo sapiens
ccctggcagcccc

SEQ ID NO: 4772835 - DNA, 12 bp, Homo sapiens
ccctggcatgtt

SEQ ID NO: 4772836 - DNA, 14 bp, Homo sapiens
ccctggcccggtcc

SEQ ID NO: 4772837 - DNA, 16 bp, Homo sapiens
ccctggcccttccttc

SEQ ID NO: 4772838 - DNA, 15 bp, Homo sapiens
ccctggcctaccaca

SEQ ID NO: 4772839 - DNA, 22 bp, Homo sapiens
ccctggcctaccacagctgcct

SEQ ID NO: 4772840 - DNA, 14 bp, Homo sapiens
ccctgggcccctcc

SEQ ID NO: 4772841 - DNA, 16 bp, Homo sapiens
ccctgggcccctccac

SEQ ID NO: 4772842 - DNA, 16 bp, Homo sapiens
ccctgggctgtctgtc

SEQ ID NO: 4772843 - DNA, 19 bp, Homo sapiens
ccctgggctgtctgtcacc

SEQ ID NO: 4772844 - DNA, 20 bp, Homo sapiens
ccctggggcagggtgggggg

SEQ ID NO: 4772845 - DNA, 22 bp, Homo sapiens
ccctggggcagggtggggggcc

SEQ ID NO: 4772846 - DNA, 22 bp, Homo sapiens
ccctggggctgggccccccagc

SEQ ID NO: 4772847 - DNA, 18 bp, Homo sapiens
ccctgggggaggcttcca

SEQ ID NO: 4772848 - DNA, 22 bp, Homo sapiens
ccctgggggaggcttccagctc

SEQ ID NO: 4772849 - DNA, 16 bp, Homo sapiens
ccctggggggcacagc

SEQ ID NO: 4772850 - DNA, 18 bp, Homo sapiens
ccctggggggcacagcca

SEQ ID NO: 4772851 - DNA, 15 bp, Homo sapiens
ccctggggtctctga

SEQ ID NO: 4772852 - DNA, 18 bp, Homo sapiens
ccctggggtctctgagca

SEQ ID NO: 4772853 - DNA, 21 bp, Homo sapiens
ccctggggtctctgagcagtg

SEQ ID NO: 4772854 - DNA, 20 bp, Homo sapiens
ccctgggtcaccttcctggg

SEQ ID NO: 4772855 - DNA, 23 bp, Homo sapiens
ccctgggtcaccttcctgggcag

SEQ ID NO: 4772856 - DNA, 21 bp, Homo sapiens
ccctgggtgggccctgccgtg

SEQ ID NO: 4772857 - DNA, 12 bp, Homo sapiens
ccctggtcctgc

SEQ ID NO: 4772858 - DNA, 13 bp, Homo sapiens
ccctggtgcccct

SEQ ID NO: 4772859 - DNA, 12 bp, Homo sapiens
ccctgtagctcc

SEQ ID NO: 4772860 - DNA, 21 bp, Homo sapiens
ccctgtagctccttagctagt

SEQ ID NO: 4772861 - DNA, 15 bp, Homo sapiens
ccctgtcactgtcca

SEQ ID NO: 4772862 - DNA, 16 bp, Homo sapiens
ccctgtcactgtccag

SEQ ID NO: 4772863 - DNA, 12 bp, Homo sapiens
ccctgtcccctg

SEQ ID NO: 4772864 - DNA, 13 bp, Homo sapiens
ccctgtctaatga

SEQ ID NO: 4772865 - DNA, 13 bp, Homo sapiens
ccctgtctgcagg

SEQ ID NO: 4772866 - DNA, 14 bp, Homo sapiens
ccctgtctgcaggc

SEQ ID NO: 4772867 - DNA, 16 bp, Homo sapiens
ccctgtctgcaggcca

SEQ ID NO: 4772868 - DNA, 11 bp, Homo sapiens
ccctgtgcccc

SEQ ID NO: 4772869 - DNA, 13 bp, Homo sapiens
ccctgtgccctct

SEQ ID NO: 4772870 - DNA, 13 bp, Homo sapiens
ccctgtgcctgtg

SEQ ID NO: 4772871 - DNA, 14 bp, Homo sapiens
ccctgtgggagtcc

SEQ ID NO: 4772872 - DNA, 13 bp, Homo sapiens
ccctgtgggctca

SEQ ID NO: 4772873 - DNA, 17 bp, Homo sapiens
ccctgtggtctgtgtgt

SEQ ID NO: 4772874 - DNA, 12 bp, Homo sapiens
ccctgttcattg

SEQ ID NO: 4772875 - DNA, 21 bp, Homo sapiens
ccctgttccgcctcactgggt

SEQ ID NO: 4772876 - DNA, 19 bp, Homo sapiens
ccctgttgacctaccctgg

SEQ ID NO: 4772877 - DNA, 22 bp, Homo sapiens
ccctgttgctacatcagagtgt

SEQ ID NO: 4772878 - DNA, 17 bp, Homo sapiens
ccctgtttctcctccat

SEQ ID NO: 4772879 - DNA, 13 bp, Homo sapiens
cccttacctggct

SEQ ID NO: 4772880 - DNA, 17 bp, Homo sapiens
cccttacgtgagtcctg

SEQ ID NO: 4772881 - DNA, 13 bp, Homo sapiens
cccttcaatgtta

SEQ ID NO: 4772882 - DNA, 18 bp, Homo sapiens
cccttccactgcctctgc

SEQ ID NO: 4772883 - DNA, 18 bp, Homo sapiens
cccttcccaatcagcact

SEQ ID NO: 4772884 - DNA, 14 bp, Homo sapiens
cccttcccacccct

SEQ ID NO: 4772885 - DNA, 14 bp, Homo sapiens
cccttcccctgcgc

SEQ ID NO: 4772886 - DNA, 20 bp, Homo sapiens
cccttcccctgcgccctccc

SEQ ID NO: 4772887 - DNA, 17 bp, Homo sapiens
cccttcccttccactgc

SEQ ID NO: 4772888 - DNA, 16 bp, Homo sapiens
cccttcctgtcctgct

SEQ ID NO: 4772889 - DNA, 21 bp, Homo sapiens
cccttcctgtcctgctcacgt

SEQ ID NO: 4772890 - DNA, 13 bp, Homo sapiens
cccttctcacagc

SEQ ID NO: 4772891 - DNA, 19 bp, Homo sapiens
cccttctcacagcacatgc

SEQ ID NO: 4772892 - DNA, 15 bp, Homo sapiens
cccttctcccctcag

SEQ ID NO: 4772893 - DNA, 16 bp, Homo sapiens
cccttctcccctcagc

SEQ ID NO: 4772894 - DNA, 12 bp, Homo sapiens
cccttctgtgtc

SEQ ID NO: 4772895 - DNA, 15 bp, Homo sapiens
cccttcttgtctctc

SEQ ID NO: 4772896 - DNA, 16 bp, Homo sapiens
cccttctttccttcct

SEQ ID NO: 4772897 - DNA, 14 bp, Homo sapiens
cccttgaaaactct

SEQ ID NO: 4772898 - DNA, 23 bp, Homo sapiens
cccttgagctggttttctctgat

SEQ ID NO: 4772899 - DNA, 18 bp, Homo sapiens
cccttgccacatcgcagc

SEQ ID NO: 4772900 - DNA, 12 bp, Homo sapiens
cccttgcttcta

SEQ ID NO: 4772901 - DNA, 23 bp, Homo sapiens
cccttgcttctaagggatccaga

SEQ ID NO: 4772902 - DNA, 14 bp, Homo sapiens
ccctttccctgcat

SEQ ID NO: 4772903 - DNA, 14 bp, Homo sapiens
ccctttccttgcct

SEQ ID NO: 4772904 - DNA, 13 bp, Homo sapiens
ccctttctcttgc

SEQ ID NO: 4772905 - DNA, 20 bp, Homo sapiens
ccgaaacccttgactgttat

SEQ ID NO: 4772906 - DNA, 20 bp, Homo sapiens
ccgaacctgatacctgcctg

SEQ ID NO: 4772907 - DNA, 13 bp, Homo sapiens
ccgaagggcagcc

SEQ ID NO: 4772908 - DNA, 15 bp, Homo sapiens
ccgaagggcagcccc

SEQ ID NO: 4772909 - DNA, 17 bp, Homo sapiens
ccgacactctcaccccc

SEQ ID NO: 4772910 - DNA, 13 bp, Homo sapiens
ccgacctggctga

SEQ ID NO: 4772911 - DNA, 15 bp, Homo sapiens
ccgacgcccctccgg

SEQ ID NO: 4772912 - DNA, 16 bp, Homo sapiens
ccgacgcccctccggg

SEQ ID NO: 4772913 - DNA, 17 bp, Homo sapiens
ccgacgcccctccgggc

SEQ ID NO: 4772914 - DNA, 12 bp, Homo sapiens
ccgagcccctgt

SEQ ID NO: 4772915 - DNA, 17 bp, Homo sapiens
ccgagcgcgtgccttcc

SEQ ID NO: 4772916 - DNA, 20 bp, Homo sapiens
ccgaggcagcaacaggacca

SEQ ID NO: 4772917 - DNA, 22 bp, Homo sapiens
ccgaggcagcaacaggaccagg

SEQ ID NO: 4772918 - DNA, 19 bp, Homo sapiens
ccgaggcctggctctggag

SEQ ID NO: 4772919 - DNA, 15 bp, Homo sapiens
ccgagggcgcctggg

SEQ ID NO: 4772920 - DNA, 23 bp, Homo sapiens
ccgagtggaccacgacctcgtcc

SEQ ID NO: 4772921 - DNA, 19 bp, Homo sapiens
ccgatataagccatagccc

SEQ ID NO: 4772922 - DNA, 13 bp, Homo sapiens
ccgatgtccctgt

SEQ ID NO: 4772923 - DNA, 13 bp, Homo sapiens
ccgattcttcctt

SEQ ID NO: 4772924 - DNA, 15 bp, Homo sapiens
ccgcaaatccatacc

SEQ ID NO: 4772925 - DNA, 17 bp, Homo sapiens
ccgcaacttcccaggcc

SEQ ID NO: 4772926 - DNA, 22 bp, Homo sapiens
ccgcaaggggaccgccccaggc

SEQ ID NO: 4772927 - DNA, 20 bp, Homo sapiens
ccgcacaccctcactctgcc

SEQ ID NO: 4772928 - DNA, 21 bp, Homo sapiens
ccgcacaccctcactctgcca

SEQ ID NO: 4772929 - DNA, 19 bp, Homo sapiens
ccgcactgggcttggggac

SEQ ID NO: 4772930 - DNA, 15 bp, Homo sapiens
ccgcagaaggaaggc

SEQ ID NO: 4772931 - DNA, 18 bp, Homo sapiens
ccgcagaaggaaggcagg

SEQ ID NO: 4772932 - DNA, 20 bp, Homo sapiens
ccgcagaggtggggtgctgg

SEQ ID NO: 4772933 - DNA, 23 bp, Homo sapiens
ccgcagaggtggggtgctggggc

SEQ ID NO: 4772934 - DNA, 16 bp, Homo sapiens
ccgcagcaccagcctg

SEQ ID NO: 4772935 - DNA, 23 bp, Homo sapiens
ccgcagccctgcagagggcacag

SEQ ID NO: 4772936 - DNA, 20 bp, Homo sapiens
ccgtcctgctcgccctgtgc

SEQ ID NO: 4772937 - DNA, 24 bp, Homo sapiens
ccgtcctggggtggttggaggcct

SEQ ID NO: 4772938 - DNA, 13 bp, Homo sapiens
ccgtctctgtccg

SEQ ID NO: 4772939 - DNA, 20 bp, Homo sapiens
ccgtctgattgttcctcccc

SEQ ID NO: 4772940 - DNA, 14 bp, Homo sapiens
ccgtctgtcctgcg

SEQ ID NO: 4772941 - DNA, 14 bp, Homo sapiens
ccgtgaaagttgtg

SEQ ID NO: 4772942 - DNA, 19 bp, Homo sapiens
ccgtgagcgccccgccccc

SEQ ID NO: 4772943 - DNA, 21 bp, Homo sapiens
ccgtgagcgccccgcccccac

SEQ ID NO: 4772944 - DNA, 15 bp, Homo sapiens
ccgtgccctgtttcc

SEQ ID NO: 4772945 - DNA, 13 bp, Homo sapiens
ccgtgcgcagccg

SEQ ID NO: 4772946 - DNA, 14 bp, Homo sapiens
ccgtgcggcccgtg

SEQ ID NO: 4772947 - DNA, 15 bp, Homo sapiens
ccgtgcggcccgtgc

SEQ ID NO: 4772948 - DNA, 20 bp, Homo sapiens
ccgtgcggcccgtgcgcagc

SEQ ID NO: 4772949 - DNA, 15 bp, Homo sapiens
ccgtgctcctctgcc

SEQ ID NO: 4772950 - DNA, 18 bp, Homo sapiens
ccgtgctcctctgcccgc

SEQ ID NO: 4772951 - DNA, 15 bp, Homo sapiens
ccgtggccctgccct

SEQ ID NO: 4772952 - DNA, 21 bp, Homo sapiens
ccgtgggagaggagaggctgc

SEQ ID NO: 4772953 - DNA, 17 bp, Homo sapiens
ccgtggtgtcctctgtc

SEQ ID NO: 4772954 - DNA, 14 bp, Homo sapiens
ccgtggtgtgaggc

SEQ ID NO: 4772955 - DNA, 14 bp, Homo sapiens
ccgtgtggcctggg

SEQ ID NO: 4772956 - DNA, 15 bp, Homo sapiens
ccgtgtggcctgggt

SEQ ID NO: 4772957 - DNA, 21 bp, Homo sapiens
ccgtgttttatgactaatcct

SEQ ID NO: 4772958 - DNA, 23 bp, Homo sapiens
ccgtgttttatgactaatcctta

SEQ ID NO: 4772959 - DNA, 14 bp, Homo sapiens
ccgttcatctgagg

SEQ ID NO: 4772960 - DNA, 15 bp, Homo sapiens
ccgttcatctgagga

SEQ ID NO: 4772961 - DNA, 17 bp, Homo sapiens
ccgttcatctgaggagt

SEQ ID NO: 4772962 - DNA, 18 bp, Homo sapiens
cctaaaagaaaccctgca

SEQ ID NO: 4772963 - DNA, 19 bp, Homo sapiens
cctaaacagctgctttatg

SEQ ID NO: 4772964 - DNA, 17 bp, Homo sapiens
cctaaacatagtggtat

SEQ ID NO: 4772965 - DNA, 22 bp, Homo sapiens
cctaaacatagtggtattttaa

SEQ ID NO: 4772966 - DNA, 17 bp, Homo sapiens
cctaaagggaagccctg

SEQ ID NO: 4772967 - DNA, 19 bp, Homo sapiens
cctaaataaacacatagat

SEQ ID NO: 4772968 - DNA, 12 bp, Homo sapiens
cctaaatgcaaa

SEQ ID NO: 4772969 - DNA, 14 bp, Homo sapiens
cctaaatgcaaagc

SEQ ID NO: 4772970 - DNA, 22 bp, Homo sapiens
cctaaattaacaaattcagtgg

SEQ ID NO: 4772971 - DNA, 14 bp, Homo sapiens
cctaacctgggttg

SEQ ID NO: 4772972 - DNA, 21 bp, Homo sapiens
cctaactgatttccatccaaa

SEQ ID NO: 4772973 - DNA, 22 bp, Homo sapiens
cctaaggcaacatttccgaaga

SEQ ID NO: 4772974 - DNA, 18 bp, Homo sapiens
cctaatattcatgctgcc

SEQ ID NO: 4772975 - DNA, 19 bp, Homo sapiens
cctaatctcatacctctga

SEQ ID NO: 4772976 - DNA, 14 bp, Homo sapiens
cctaatcttctgaa

SEQ ID NO: 4772977 - DNA, 17 bp, Homo sapiens
cctaattaatttcagta

SEQ ID NO: 4772978 - DNA, 19 bp, Homo sapiens
cctaattctcttcgctgtg

SEQ ID NO: 4772979 - DNA, 22 bp, Homo sapiens
cctacagtatataagctttttt

SEQ ID NO: 4772980 - DNA, 13 bp, Homo sapiens
cctacatctgaaa

SEQ ID NO: 4772981 - DNA, 23 bp, Homo sapiens
cctacatctgaaatctacaacat

SEQ ID NO: 4772982 - DNA, 13 bp, Homo sapiens
cctaccacagctg

SEQ ID NO: 4772983 - DNA, 18 bp, Homo sapiens
cctaccacagctgcctcc

SEQ ID NO: 4772984 - DNA, 13 bp, Homo sapiens
cctaccctggacc

SEQ ID NO: 4772985 - DNA, 13 bp, Homo sapiens
cctacgtgctgcc

SEQ ID NO: 4772986 - DNA, 15 bp, Homo sapiens
cctactccacctgtt

SEQ ID NO: 4772987 - DNA, 16 bp, Homo sapiens
cctactcctccccctc

SEQ ID NO: 4772988 - DNA, 18 bp, Homo sapiens
cctacttaaacaaaaact

SEQ ID NO: 4772989 - DNA, 18 bp, Homo sapiens
cctagaatgtttcatttg

SEQ ID NO: 4772990 - DNA, 21 bp, Homo sapiens
cctagactctgtaacatcact

SEQ ID NO: 4772991 - DNA, 20 bp, Homo sapiens
cctagaggattgtccacctt

SEQ ID NO: 4772992 - DNA, 22 bp, Homo sapiens
cctagaggattgtccaccttct

SEQ ID NO: 4772993 - DNA, 16 bp, Homo sapiens
cctagcagtgaactat

SEQ ID NO: 4772994 - DNA, 13 bp, Homo sapiens
cctagcccaccct

SEQ ID NO: 4772995 - DNA, 14 bp, Homo sapiens
cctagcccaccctg

SEQ ID NO: 4772996 - DNA, 19 bp, Homo sapiens
cctaggcatactctccagg

SEQ ID NO: 4772997 - DNA, 12 bp, Homo sapiens
cctagggctctc

SEQ ID NO: 4772998 - DNA, 16 bp, Homo sapiens
cctaggtctccacccc

SEQ ID NO: 4772999 - DNA, 11 bp, Homo sapiens
cctaggtgctc

SEQ ID NO: 4773000 - DNA, 22 bp, Homo sapiens
cctagttctttgcattcgtcct

SEQ ID NO: 4773001 - DNA, 20 bp, Homo sapiens
cctataaatggacttgcttc

SEQ ID NO: 4773002 - DNA, 22 bp, Homo sapiens
cctataccctaggtctccaccc

SEQ ID NO: 4773003 - DNA, 17 bp, Homo sapiens
cctatcctgcaccctct

SEQ ID NO: 4773004 - DNA, 18 bp, Homo sapiens
cctatcctgcaccctctg

SEQ ID NO: 4773005 - DNA, 23 bp, Homo sapiens
cctatctggaaaaaaaaaaatat

SEQ ID NO: 4773006 - DNA, 13 bp, Homo sapiens
cctatctgtattg

SEQ ID NO: 4773007 - DNA, 16 bp, Homo sapiens
cctatgaccataaaat

SEQ ID NO: 4773008 - DNA, 14 bp, Homo sapiens
cctatgaccctgtg

SEQ ID NO: 4773009 - DNA, 10 bp, Homo sapiens
cctattataa

SEQ ID NO: 4773010 - DNA, 11 bp, Homo sapiens
cctcaaactgg

SEQ ID NO: 4773011 - DNA, 15 bp, Homo sapiens
cctcaactctcctcc

SEQ ID NO: 4773012 - DNA, 19 bp, Homo sapiens
cctcaactctcctccagag

SEQ ID NO: 4773013 - DNA, 15 bp, Homo sapiens
cctcaagagaaggca

SEQ ID NO: 4773014 - DNA, 19 bp, Homo sapiens
cctcacagtgacccttccc

SEQ ID NO: 4773015 - DNA, 18 bp, Homo sapiens
cctcaccagccctggcaa

SEQ ID NO: 4773016 - DNA, 16 bp, Homo sapiens
cctcacctggcttccc

SEQ ID NO: 4773017 - DNA, 18 bp, Homo sapiens
cctcactccactcccctc

SEQ ID NO: 4773018 - DNA, 19 bp, Homo sapiens
cctcactccactcccctca

SEQ ID NO: 4773019 - DNA, 13 bp, Homo sapiens
cctcactctgcca

SEQ ID NO: 4773020 - DNA, 17 bp, Homo sapiens
cctcactctgtcagcca

SEQ ID NO: 4773021 - DNA, 13 bp, Homo sapiens
cctcactgccact

SEQ ID NO: 4773022 - DNA, 14 bp, Homo sapiens
cctcactgcccgca

SEQ ID NO: 4773023 - DNA, 14 bp, Homo sapiens
cctcagagggtccc

SEQ ID NO: 4773024 - DNA, 14 bp, Homo sapiens
cctcagatgatctc

SEQ ID NO: 4773025 - DNA, 19 bp, Homo sapiens
cctcagatgatctctccac

SEQ ID NO: 4773026 - DNA, 22 bp, Homo sapiens
cctcagcaagtgctgagtctgt

SEQ ID NO: 4773027 - DNA, 14 bp, Homo sapiens
cctcagccccaggg

SEQ ID NO: 4773028 - DNA, 17 bp, Homo sapiens
cctcagccccagggccc

SEQ ID NO: 4773029 - DNA, 19 bp, Homo sapiens
cctcagccccagggccctg

SEQ ID NO: 4773030 - DNA, 12 bp, Homo sapiens
cctcagccctca

SEQ ID NO: 4773031 - DNA, 16 bp, Homo sapiens
cctcagccctcagaac

SEQ ID NO: 4773032 - DNA, 14 bp, Homo sapiens
cctcagctctccct

SEQ ID NO: 4773033 - DNA, 17 bp, Homo sapiens
cctcagctctccctcac

SEQ ID NO: 4773034 - DNA, 17 bp, Homo sapiens
cctcagggaccaaggag

SEQ ID NO: 4773035 - DNA, 20 bp, Homo sapiens
cctcaggtcctactggggaa

SEQ ID NO: 4773036 - DNA, 14 bp, Homo sapiens
cctcagtccctccc

SEQ ID NO: 4773037 - DNA, 19 bp, Homo sapiens
cctcagtccctccctcctg

SEQ ID NO: 4773038 - DNA, 23 bp, Homo sapiens
cctcagtccctccctcctggctc

SEQ ID NO: 4773039 - DNA, 22 bp, Homo sapiens
cctcagttcaacctggtggcac

SEQ ID NO: 4773040 - DNA, 16 bp, Homo sapiens
cctcagttggcctctg

SEQ ID NO: 4773041 - DNA, 19 bp, Homo sapiens
cctcagttggcctctgccc

SEQ ID NO: 4773042 - DNA, 21 bp, Homo sapiens
cctcatcttccttctcagcct

SEQ ID NO: 4773043 - DNA, 16 bp, Homo sapiens
cctcatcttgaagggc

SEQ ID NO: 4773044 - DNA, 21 bp, Homo sapiens
cctcatcttgaagggcccagg

SEQ ID NO: 4773045 - DNA, 12 bp, Homo sapiens
cctcatggctgt

SEQ ID NO: 4773046 - DNA, 16 bp, Homo sapiens
cctcattttgcttccc

SEQ ID NO: 4773047 - DNA, 18 bp, Homo sapiens
cctcattttgcttcccat

SEQ ID NO: 4773048 - DNA, 16 bp, Homo sapiens
cctccaaatgctgtcg

SEQ ID NO: 4773049 - DNA, 13 bp, Homo sapiens
cctccacaggagc

SEQ ID NO: 4773050 - DNA, 17 bp, Homo sapiens
cctccacaggagccgca

SEQ ID NO: 4773051 - DNA, 12 bp, Homo sapiens
cctccaccccag

SEQ ID NO: 4773052 - DNA, 13 bp, Homo sapiens
cctccacccgtcc

SEQ ID NO: 4773053 - DNA, 15 bp, Homo sapiens
cctccacccgtcctg

SEQ ID NO: 4773054 - DNA, 21 bp, Homo sapiens
cctccaccttgagcactattc

SEQ ID NO: 4773055 - DNA, 20 bp, Homo sapiens
cctccacgcctcctggccag

SEQ ID NO: 4773056 - DNA, 21 bp, Homo sapiens
cctccacgcctcctggccaga

SEQ ID NO: 4773057 - DNA, 12 bp, Homo sapiens
cctccactcctc

SEQ ID NO: 4773058 - DNA, 9 bp, Homo sapiens
cctccagac

SEQ ID NO: 4773059 - DNA, 15 bp, Homo sapiens
cctgccgctgcttga

SEQ ID NO: 4773060 - DNA, 17 bp, Homo sapiens
cctgcctacgtgctgcc

SEQ ID NO: 4773061 - DNA, 13 bp, Homo sapiens
cctgcctccggcc

SEQ ID NO: 4773062 - DNA, 16 bp, Homo sapiens
cctgcctccggccctg

SEQ ID NO: 4773063 - DNA, 17 bp, Homo sapiens
cctgcctctctcatggc

SEQ ID NO: 4773064 - DNA, 23 bp, Homo sapiens
cctgcctggaggagaaggaggaa

SEQ ID NO: 4773065 - DNA, 12 bp, Homo sapiens
cctgcctgggac

SEQ ID NO: 4773066 - DNA, 22 bp, Homo sapiens
cctgcctgggacagccactgga

SEQ ID NO: 4773067 - DNA, 22 bp, Homo sapiens
cctgcctgttgggccaggagcc

SEQ ID NO: 4773068 - DNA, 23 bp, Homo sapiens
cctgcctgttgggccaggagcct

SEQ ID NO: 4773069 - DNA, 13 bp, Homo sapiens
cctgcgcaccccg

SEQ ID NO: 4773070 - DNA, 21 bp, Homo sapiens
cctgcgcaccccgttcccagc

SEQ ID NO: 4773071 - DNA, 22 bp, Homo sapiens
cctgcgccccccagtggactcg

SEQ ID NO: 4773072 - DNA, 12 bp, Homo sapiens
cctgcgcccctg

SEQ ID NO: 4773073 - DNA, 21 bp, Homo sapiens
cctgcgccctccctccctcca

SEQ ID NO: 4773074 - DNA, 23 bp, Homo sapiens
cctgcgccctccctccctccaca

SEQ ID NO: 4773075 - DNA, 15 bp, Homo sapiens
cctgcgcctcctcct

SEQ ID NO: 4773076 - DNA, 18 bp, Homo sapiens
cctgcgcctcctcctgca

SEQ ID NO: 4773077 - DNA, 19 bp, Homo sapiens
cctgcgcctgcgcctcctc

SEQ ID NO: 4773078 - DNA, 17 bp, Homo sapiens
cctgcggggcggcatcc

SEQ ID NO: 4773079 - DNA, 22 bp, Homo sapiens
cctgcggggcggcatccgagcc

SEQ ID NO: 4773080 - DNA, 17 bp, Homo sapiens
cctgcggggttccctgc

SEQ ID NO: 4773081 - DNA, 19 bp, Homo sapiens
cctgcggggttccctgcgc

SEQ ID NO: 4773082 - DNA, 19 bp, Homo sapiens
cctgctcacccgcctcttg

SEQ ID NO: 4773083 - DNA, 14 bp, Homo sapiens
cctgctcaggcctc

SEQ ID NO: 4773084 - DNA, 18 bp, Homo sapiens
cctgctcaggcctcacct

SEQ ID NO: 4773085 - DNA, 19 bp, Homo sapiens
cctgctcaggcctcacctg

SEQ ID NO: 4773086 - DNA, 21 bp, Homo sapiens
cctgctcaggcctcacctggc

SEQ ID NO: 4773087 - DNA, 11 bp, Homo sapiens
cctgctccaga

SEQ ID NO: 4773088 - DNA, 16 bp, Homo sapiens
cctgctccagatcctc

SEQ ID NO: 4773089 - DNA, 18 bp, Homo sapiens
cctgctcccggctctgag

SEQ ID NO: 4773090 - DNA, 13 bp, Homo sapiens
cctgctcctccag

SEQ ID NO: 4773091 - DNA, 16 bp, Homo sapiens
cctgctcgccctgtgc

SEQ ID NO: 4773092 - DNA, 19 bp, Homo sapiens
cctgctcgccctgtgccct

SEQ ID NO: 4773093 - DNA, 12 bp, Homo sapiens
cctgctgccagg

SEQ ID NO: 4773094 - DNA, 17 bp, Homo sapiens
cctgctgctcgggaagg

SEQ ID NO: 4773095 - DNA, 19 bp, Homo sapiens
cctgctgctcgggaaggcc

SEQ ID NO: 4773096 - DNA, 20 bp, Homo sapiens
cctgctgctcgggaaggcct

SEQ ID NO: 4773097 - DNA, 23 bp, Homo sapiens
cctgctgctcgggaaggcctgag

SEQ ID NO: 4773098 - DNA, 22 bp, Homo sapiens
cctgctgctctctaagaattca

SEQ ID NO: 4773099 - DNA, 12 bp, Homo sapiens
cctgcttcccac

SEQ ID NO: 4773100 - DNA, 16 bp, Homo sapiens
cctgcttctcccgcca

SEQ ID NO: 4773101 - DNA, 14 bp, Homo sapiens
cctgcttctgctgc

SEQ ID NO: 4773102 - DNA, 15 bp, Homo sapiens
cctgcttctgctgcc

SEQ ID NO: 4773103 - DNA, 19 bp, Homo sapiens
cctgcttctgctgccctga

SEQ ID NO: 4773104 - DNA, 19 bp, Homo sapiens
cctggacgcatgcagggcc

SEQ ID NO: 4773105 - DNA, 20 bp, Homo sapiens
cctggacttcccaaggaaag

SEQ ID NO: 4773106 - DNA, 14 bp, Homo sapiens
cctggaggctggac

SEQ ID NO: 4773107 - DNA, 15 bp, Homo sapiens
cctggaggctggacc

SEQ ID NO: 4773108 - DNA, 22 bp, Homo sapiens
cctggaggctggaccaactgct

SEQ ID NO: 4773109 - DNA, 23 bp, Homo sapiens
cctggaggctggaccaactgctt

SEQ ID NO: 4773110 - DNA, 17 bp, Homo sapiens
cctggagttctggttcc

SEQ ID NO: 4773111 - DNA, 19 bp, Homo sapiens
cctggatggatctgctcca

SEQ ID NO: 4773112 - DNA, 20 bp, Homo sapiens
cctggatggatctgctccat

SEQ ID NO: 4773113 - DNA, 18 bp, Homo sapiens
cctggattcctctaagat

SEQ ID NO: 4773114 - DNA, 14 bp, Homo sapiens
cctggcacaggact

SEQ ID NO: 4773115 - DNA, 16 bp, Homo sapiens
cctggcacaggactga

SEQ ID NO: 4773116 - DNA, 20 bp, Homo sapiens
cctggcagatgggggcctct

SEQ ID NO: 4773117 - DNA, 21 bp, Homo sapiens
cctggcagatgggggcctctc

SEQ ID NO: 4773118 - DNA, 12 bp, Homo sapiens
cctggcagcccc

SEQ ID NO: 4773119 - DNA, 20 bp, Homo sapiens
cctggcagggaggtcaggcc

SEQ ID NO: 4773120 - DNA, 21 bp, Homo sapiens
cctggcagggaggtcaggccc

SEQ ID NO: 4773121 - DNA, 23 bp, Homo sapiens
cctggcagggaggtcaggccctg

SEQ ID NO: 4773122 - DNA, 16 bp, Homo sapiens
cctggcatgggaatga

SEQ ID NO: 4773123 - DNA, 23 bp, Homo sapiens
cctggcatgggaatgaatgtcag

SEQ ID NO: 4773124 - DNA, 12 bp, Homo sapiens
cctggcccagcc

SEQ ID NO: 4773125 - DNA, 14 bp, Homo sapiens
cctggcccagccag

SEQ ID NO: 4773126 - DNA, 18 bp, Homo sapiens
cctggcccagccagcagg

SEQ ID NO: 4773127 - DNA, 12 bp, Homo sapiens
cctggcccagtg

SEQ ID NO: 4773128 - DNA, 18 bp, Homo sapiens
cctggcccatagaaacat

SEQ ID NO: 4773129 - DNA, 24 bp, Homo sapiens
cctggcccatagaaacatgacact

SEQ ID NO: 4773130 - DNA, 21 bp, Homo sapiens
cctggccccctcgcgcccctg

SEQ ID NO: 4773131 - DNA, 18 bp, Homo sapiens
cctggcccggtcccagtc

SEQ ID NO: 4773132 - DNA, 13 bp, Homo sapiens
cctggccctgccc

SEQ ID NO: 4773133 - DNA, 17 bp, Homo sapiens
cctggccctgccctgag

SEQ ID NO: 4773134 - DNA, 21 bp, Homo sapiens
cctggcctaccacagctgcct

SEQ ID NO: 4773135 - DNA, 17 bp, Homo sapiens
cctggcctggccctgcc

SEQ ID NO: 4773136 - DNA, 12 bp, Homo sapiens
cctggcgggcag

SEQ ID NO: 4773137 - DNA, 15 bp, Homo sapiens
cctggcgggcagccc

SEQ ID NO: 4773138 - DNA, 18 bp, Homo sapiens
cctggcgggcagcccctg

SEQ ID NO: 4773139 - DNA, 21 bp, Homo sapiens
cctggcgggcagcccctgctg

SEQ ID NO: 4773140 - DNA, 23 bp, Homo sapiens
cctggcgggcagcccctgctgga

SEQ ID NO: 4773141 - DNA, 15 bp, Homo sapiens
cctggctcacagcca

SEQ ID NO: 4773142 - DNA, 16 bp, Homo sapiens
cctggctcacagccac

SEQ ID NO: 4773143 - DNA, 23 bp, Homo sapiens
cctggctcacagccaccacctgg

SEQ ID NO: 4773144 - DNA, 13 bp, Homo sapiens
cctggctctggag

SEQ ID NO: 4773145 - DNA, 21 bp, Homo sapiens
cctggctctttagaatggacc

SEQ ID NO: 4773146 - DNA, 14 bp, Homo sapiens
cctggcttcaccgc

SEQ ID NO: 4773147 - DNA, 20 bp, Homo sapiens
cctggcttcaccgcattcca

SEQ ID NO: 4773148 - DNA, 22 bp, Homo sapiens
cctggcttcaccgcattccagg

SEQ ID NO: 4773149 - DNA, 14 bp, Homo sapiens
cctggcttcccagg

SEQ ID NO: 4773150 - DNA, 18 bp, Homo sapiens
cctggcttcccaggaccc

SEQ ID NO: 4773151 - DNA, 20 bp, Homo sapiens
cctggcttcccaggaccctg

SEQ ID NO: 4773152 - DNA, 22 bp, Homo sapiens
cctggcttcccaggaccctggg

SEQ ID NO: 4773153 - DNA, 18 bp, Homo sapiens
cctggcttctgggacagg

SEQ ID NO: 4773154 - DNA, 23 bp, Homo sapiens
cctggcttctgggacaggcacca

SEQ ID NO: 4773155 - DNA, 17 bp, Homo sapiens
cctgggagatgcagctg

SEQ ID NO: 4773156 - DNA, 13 bp, Homo sapiens
cctgggattacag

SEQ ID NO: 4773157 - DNA, 15 bp, Homo sapiens
cctgggcagaaggaa

SEQ ID NO: 4773158 - DNA, 16 bp, Homo sapiens
cctgggcagaaggaag

SEQ ID NO: 4773159 - DNA, 12 bp, Homo sapiens
cctgggcccctc

SEQ ID NO: 4773160 - DNA, 21 bp, Homo sapiens
cctgggcccctccacgcctcc

SEQ ID NO: 4773161 - DNA, 14 bp, Homo sapiens
cctgggccctaggc

SEQ ID NO: 4773162 - DNA, 18 bp, Homo sapiens
cctgggccctaggcatac

SEQ ID NO: 4773163 - DNA, 14 bp, Homo sapiens
cctgggcctcagtt

SEQ ID NO: 4773164 - DNA, 14 bp, Homo sapiens
cctgggcctcccgt

SEQ ID NO: 4773165 - DNA, 15 bp, Homo sapiens
cctgggcctcccgtc

SEQ ID NO: 4773166 - DNA, 10 bp, Homo sapiens
cctgggctgt

SEQ ID NO: 4773167 - DNA, 16 bp, Homo sapiens
cctggggaggacccct

SEQ ID NO: 4773168 - DNA, 18 bp, Homo sapiens
cctggggaggacccctgc

SEQ ID NO: 4773169 - DNA, 19 bp, Homo sapiens
cctggggaggacccctgcc

SEQ ID NO: 4773170 - DNA, 15 bp, Homo sapiens
cctggggcctggcag

SEQ ID NO: 4773171 - DNA, 17 bp, Homo sapiens
cctggggctgggccccc

SEQ ID NO: 4773172 - DNA, 15 bp, Homo sapiens
cctgggggaggcttc

SEQ ID NO: 4773173 - DNA, 16 bp, Homo sapiens
cctgggggctgctgca

SEQ ID NO: 4773174 - DNA, 21 bp, Homo sapiens
cctgggggctgggcagaggaa

SEQ ID NO: 4773175 - DNA, 20 bp, Homo sapiens
cctgggggctgttagctcag

SEQ ID NO: 4773176 - DNA, 14 bp, Homo sapiens
cctggggggcacag

SEQ ID NO: 4773177 - DNA, 13 bp, Homo sapiens
cctggggggggca

SEQ ID NO: 4773178 - DNA, 15 bp, Homo sapiens
cctgggggtggcagg

SEQ ID NO: 4773179 - DNA, 17 bp, Homo sapiens
cctggggtctctgagca

SEQ ID NO: 4773180 - DNA, 20 bp, Homo sapiens
cctggggtctctgagcagtg

SEQ ID NO: 4773181 - DNA, 11 bp, Homo sapiens
cgccacccgcc

SEQ ID NO: 4773182 - DNA, 22 bp, Homo sapiens
cgccacccgcccgcccccgccc

SEQ ID NO: 4773183 - DNA, 20 bp, Homo sapiens
cgccaccttgtacagaacca

SEQ ID NO: 4773184 - DNA, 14 bp, Homo sapiens
cgccagagtgtcct

SEQ ID NO: 4773185 - DNA, 15 bp, Homo sapiens
cgccagagtgtcctg

SEQ ID NO: 4773186 - DNA, 11 bp, Homo sapiens
cgccattccag

SEQ ID NO: 4773187 - DNA, 15 bp, Homo sapiens
cgcccacccacaccc

SEQ ID NO: 4773188 - DNA, 19 bp, Homo sapiens
cgcccacccagcagcgccc

SEQ ID NO: 4773189 - DNA, 17 bp, Homo sapiens
cgcccacctgcccagtt

SEQ ID NO: 4773190 - DNA, 12 bp, Homo sapiens
cgcccagccccc

SEQ ID NO: 4773191 - DNA, 14 bp, Homo sapiens
cgcccagcccccac

SEQ ID NO: 4773192 - DNA, 21 bp, Homo sapiens
cgcccaggatgaaggggccag

SEQ ID NO: 4773193 - DNA, 11 bp, Homo sapiens
cgccccagaga

SEQ ID NO: 4773194 - DNA, 10 bp, Homo sapiens
cgccccaggc

SEQ ID NO: 4773195 - DNA, 18 bp, Homo sapiens
cgccccaggccccagcag

SEQ ID NO: 4773196 - DNA, 13 bp, Homo sapiens
cgcccccacccct

SEQ ID NO: 4773197 - DNA, 15 bp, Homo sapiens
cgccccccagtggac

SEQ ID NO: 4773198 - DNA, 18 bp, Homo sapiens
cgccccccggcctggccc

SEQ ID NO: 4773199 - DNA, 20 bp, Homo sapiens
cgccccgtgctcctctgccc

SEQ ID NO: 4773200 - DNA, 11 bp, Homo sapiens
cgcccctcctc

SEQ ID NO: 4773201 - DNA, 20 bp, Homo sapiens
cgcccctctgcgccccagcg

SEQ ID NO: 4773202 - DNA, 17 bp, Homo sapiens
cgcccctgcccagcacc

SEQ ID NO: 4773203 - DNA, 15 bp, Homo sapiens
cgcccctgcctgaga

SEQ ID NO: 4773204 - DNA, 22 bp, Homo sapiens
cgcccctgtccatccgtctctg

SEQ ID NO: 4773205 - DNA, 16 bp, Homo sapiens
cgcccctttctcttgc

SEQ ID NO: 4773206 - DNA, 21 bp, Homo sapiens
cgcccgaggccagggccgccg

SEQ ID NO: 4773207 - DNA, 23 bp, Homo sapiens
cgcccgcccaccccgctgcctgg

SEQ ID NO: 4773208 - DNA, 17 bp, Homo sapiens
cgcccgcccccgccctc

SEQ ID NO: 4773209 - DNA, 15 bp, Homo sapiens
cgcccgccctcctct

SEQ ID NO: 4773210 - DNA, 12 bp, Homo sapiens
cgcccgccgcct

SEQ ID NO: 4773211 - DNA, 13 bp, Homo sapiens
cgccctccctccc

SEQ ID NO: 4773212 - DNA, 16 bp, Homo sapiens
cgccctcctctgcccc

SEQ ID NO: 4773213 - DNA, 19 bp, Homo sapiens
cgccctcctctgccccctc

SEQ ID NO: 4773214 - DNA, 12 bp, Homo sapiens
cgccctgggctg

SEQ ID NO: 4773215 - DNA, 14 bp, Homo sapiens
cgccctgggctgtc

SEQ ID NO: 4773216 - DNA, 15 bp, Homo sapiens
cgccctgggctgtct

SEQ ID NO: 4773217 - DNA, 18 bp, Homo sapiens
cgccctgggctgtctgtc

SEQ ID NO: 4773218 - DNA, 19 bp, Homo sapiens
cgccctgggctgtctgtca

SEQ ID NO: 4773219 - DNA, 22 bp, Homo sapiens
cgccctgggctgtctgtcacca

SEQ ID NO: 4773220 - DNA, 22 bp, Homo sapiens
cgccctgtgccctctcactgac

SEQ ID NO: 4773221 - DNA, 13 bp, Homo sapiens
cgccctttccttg

SEQ ID NO: 4773222 - DNA, 15 bp, Homo sapiens
cgccctttccttgcc

SEQ ID NO: 4773223 - DNA, 20 bp, Homo sapiens
cgccggcgccccggacgccg

SEQ ID NO: 4773224 - DNA, 16 bp, Homo sapiens
cgccggggctggccct

SEQ ID NO: 4773225 - DNA, 21 bp, Homo sapiens
cgcctcccggggtgcccgtgt

SEQ ID NO: 4773226 - DNA, 13 bp, Homo sapiens
cgcctcctccaga

SEQ ID NO: 4773227 - DNA, 15 bp, Homo sapiens
cgcctcctccagact

SEQ ID NO: 4773228 - DNA, 22 bp, Homo sapiens
cgcctcctggccagacgctgcc

SEQ ID NO: 4773229 - DNA, 14 bp, Homo sapiens
cgcctcgcccccgg

SEQ ID NO: 4773230 - DNA, 19 bp, Homo sapiens
cgcctcgggccgcctcctc

SEQ ID NO: 4773231 - DNA, 19 bp, Homo sapiens
cgcctctgtcctggcccgg

SEQ ID NO: 4773232 - DNA, 12 bp, Homo sapiens
cgcctgcgcccc

SEQ ID NO: 4773233 - DNA, 17 bp, Homo sapiens
cgcctgcgcctcctcct

SEQ ID NO: 4773234 - DNA, 19 bp, Homo sapiens
cgcctgcgcctcctcctgc

SEQ ID NO: 4773235 - DNA, 14 bp, Homo sapiens
cgcctgcgctcctc

SEQ ID NO: 4773236 - DNA, 19 bp, Homo sapiens
cgcctgcgctcctctgcag

SEQ ID NO: 4773237 - DNA, 22 bp, Homo sapiens
cgcctgcgctcctctgcagcct

SEQ ID NO: 4773238 - DNA, 23 bp, Homo sapiens
cgcctgcgctcctctgcagcctg

SEQ ID NO: 4773239 - DNA, 17 bp, Homo sapiens
cgcctgggaatcaggat

SEQ ID NO: 4773240 - DNA, 13 bp, Homo sapiens
cgccttctgggga

SEQ ID NO: 4773241 - DNA, 14 bp, Homo sapiens
cgcgatctcagctc

SEQ ID NO: 4773242 - DNA, 16 bp, Homo sapiens
cgcgcccccaggaccc

SEQ ID NO: 4773243 - DNA, 16 bp, Homo sapiens
cgcgcccctctgcgcc

SEQ ID NO: 4773244 - DNA, 21 bp, Homo sapiens
cgcgcccctctgcgccccagc

SEQ ID NO: 4773245 - DNA, 12 bp, Homo sapiens
cgcgcccctgtc

SEQ ID NO: 4773246 - DNA, 17 bp, Homo sapiens
cgcgcgggacagcggcc

SEQ ID NO: 4773247 - DNA, 16 bp, Homo sapiens
cgcgcgtgcccccagc

SEQ ID NO: 4773248 - DNA, 16 bp, Homo sapiens
cgcgcgttcgcggcgg

SEQ ID NO: 4773249 - DNA, 22 bp, Homo sapiens
cgcgcgttcgcggcggtgggcg

SEQ ID NO: 4773250 - DNA, 12 bp, Homo sapiens
cgcggagccccc

SEQ ID NO: 4773251 - DNA, 14 bp, Homo sapiens
cgcggagcccccgc

SEQ ID NO: 4773252 - DNA, 14 bp, Homo sapiens
cgcggaggcccctg

SEQ ID NO: 4773253 - DNA, 15 bp, Homo sapiens
cgcggaggcccctga

SEQ ID NO: 4773254 - DNA, 16 bp, Homo sapiens
cgcggcggtgggcgcc

SEQ ID NO: 4773255 - DNA, 20 bp, Homo sapiens
cgcgggacagcggccccgcg

SEQ ID NO: 4773256 - DNA, 13 bp, Homo sapiens
cgcgtgcccccag

SEQ ID NO: 4773257 - DNA, 17 bp, Homo sapiens
cgcgtgcccccagcgtg

SEQ ID NO: 4773258 - DNA, 18 bp, Homo sapiens
cgcgtgcccccagcgtgg

SEQ ID NO: 4773259 - DNA, 13 bp, Homo sapiens
cgcgtgccttccc

SEQ ID NO: 4773260 - DNA, 21 bp, Homo sapiens
cgcgtgccttccccgtgcggc

SEQ ID NO: 4773261 - DNA, 20 bp, Homo sapiens
cgctatagttactgtcctgt

SEQ ID NO: 4773262 - DNA, 17 bp, Homo sapiens
cgctattcccaggcagg

SEQ ID NO: 4773263 - DNA, 14 bp, Homo sapiens
cgctccggcagagg

SEQ ID NO: 4773264 - DNA, 15 bp, Homo sapiens
cgctccggcagaggc

SEQ ID NO: 4773265 - DNA, 16 bp, Homo sapiens
cgctccggcagaggca

SEQ ID NO: 4773266 - DNA, 17 bp, Homo sapiens
cgctccggcagaggcag

SEQ ID NO: 4773267 - DNA, 20 bp, Homo sapiens
cgctccggcagaggcagggc

SEQ ID NO: 4773268 - DNA, 24 bp, Homo sapiens
cgctccggcagaggcagggccctg

SEQ ID NO: 4773269 - DNA, 12 bp, Homo sapiens
cgctcctctgca

SEQ ID NO: 4773270 - DNA, 18 bp, Homo sapiens
cgctctccgccccccggc

SEQ ID NO: 4773271 - DNA, 18 bp, Homo sapiens
cgctcttcaccaggaaga

SEQ ID NO: 4773272 - DNA, 18 bp, Homo sapiens
cgctgaatgagaagtaaa

SEQ ID NO: 4773273 - DNA, 14 bp, Homo sapiens
cgctgacttgcaga

SEQ ID NO: 4773274 - DNA, 14 bp, Homo sapiens
cgctgagggcaggg

SEQ ID NO: 4773275 - DNA, 15 bp, Homo sapiens
cgctgcagtcagcac

SEQ ID NO: 4773276 - DNA, 16 bp, Homo sapiens
cgctgcccctggcagc

SEQ ID NO: 4773277 - DNA, 18 bp, Homo sapiens
cgctgcccctggcagccc

SEQ ID NO: 4773278 - DNA, 15 bp, Homo sapiens
cgctgccgctgcacc

SEQ ID NO: 4773279 - DNA, 18 bp, Homo sapiens
cgctgccgctgcaccacg

SEQ ID NO: 4773280 - DNA, 17 bp, Homo sapiens
cgctgcctggcgggcag

SEQ ID NO: 4773281 - DNA, 14 bp, Homo sapiens
cgctgcgctcccac

SEQ ID NO: 4773282 - DNA, 13 bp, Homo sapiens
cgctgctctccca

SEQ ID NO: 4773283 - DNA, 18 bp, Homo sapiens
cgctgctgtgacaggcag

SEQ ID NO: 4773284 - DNA, 16 bp, Homo sapiens
cgctggagaccctgcg

SEQ ID NO: 4773285 - DNA, 18 bp, Homo sapiens
cgctggagaccctgcgcc

SEQ ID NO: 4773286 - DNA, 20 bp, Homo sapiens
cgctgggagaaaagccagat

SEQ ID NO: 4773287 - DNA, 14 bp, Homo sapiens
cgctggtaactgtt

SEQ ID NO: 4773288 - DNA, 16 bp, Homo sapiens
cgctgtccgtcctgct

SEQ ID NO: 4773289 - DNA, 16 bp, Homo sapiens
cgctgtcctctcgagc

SEQ ID NO: 4773290 - DNA, 19 bp, Homo sapiens
cgctgtcctctcgagccca

SEQ ID NO: 4773291 - DNA, 23 bp, Homo sapiens
cgctgtcctctcgagcccagatg

SEQ ID NO: 4773292 - DNA, 21 bp, Homo sapiens
cgcttagggtctgtcccgggt

SEQ ID NO: 4773293 - DNA, 21 bp, Homo sapiens
cgcttctcctgcagtctgtgg

SEQ ID NO: 4773294 - DNA, 22 bp, Homo sapiens
cgcttctcctgcagtctgtgga

SEQ ID NO: 4773295 - DNA, 10 bp, Homo sapiens
cgcttctgga

SEQ ID NO: 4773296 - DNA, 16 bp, Homo sapiens
cgcttggctccatgct

SEQ ID NO: 4773297 - DNA, 21 bp, Homo sapiens
cgcttggctccatgctcctca

SEQ ID NO: 4773298 - DNA, 17 bp, Homo sapiens
cgctttctacactgtat

SEQ ID NO: 4773299 - DNA, 23 bp, Homo sapiens
cgcttttgtacgttaattaaaca

SEQ ID NO: 4773300 - DNA, 20 bp, Homo sapiens
cggaaggacacagtcagggg

SEQ ID NO: 4773301 - DNA, 20 bp, Homo sapiens
cggacagggtggcacccacc

SEQ ID NO: 4773302 - DNA, 20 bp, Homo sapiens
cggaccggagcggctgagga

SEQ ID NO: 4773303 - DNA, 18 bp, Homo sapiens
cggacgctggagaccctg

SEQ ID NO: 4773304 - DNA, 15 bp, Homo sapiens
ctaagaatttagagg

SEQ ID NO: 4773305 - DNA, 14 bp, Homo sapiens
ctaagacaaatgca

SEQ ID NO: 4773306 - DNA, 17 bp, Homo sapiens
ctaagacaaatgcagtg

SEQ ID NO: 4773307 - DNA, 16 bp, Homo sapiens
ctaagagccacaataa

SEQ ID NO: 4773308 - DNA, 14 bp, Homo sapiens
ctaagaggctgctg

SEQ ID NO: 4773309 - DNA, 14 bp, Homo sapiens
ctaagcatttaaaa

SEQ ID NO: 4773310 - DNA, 18 bp, Homo sapiens
ctaaggccttgccagcaa

SEQ ID NO: 4773311 - DNA, 15 bp, Homo sapiens
ctaagggatccagag

SEQ ID NO: 4773312 - DNA, 16 bp, Homo sapiens
ctaagggatccagaga

SEQ ID NO: 4773313 - DNA, 20 bp, Homo sapiens
ctaagggatccagagacctg

SEQ ID NO: 4773314 - DNA, 21 bp, Homo sapiens
ctaaggtcagtgttataaaat

SEQ ID NO: 4773315 - DNA, 15 bp, Homo sapiens
ctaagtaaattttct

SEQ ID NO: 4773316 - DNA, 20 bp, Homo sapiens
ctaagtgagatgtttggcaa

SEQ ID NO: 4773317 - DNA, 17 bp, Homo sapiens
ctaagttgtattttaat

SEQ ID NO: 4773318 - DNA, 21 bp, Homo sapiens
ctaagttgtattttaataaag

SEQ ID NO: 4773319 - DNA, 14 bp, Homo sapiens
ctaataaaatacat

SEQ ID NO: 4773320 - DNA, 15 bp, Homo sapiens
ctaataaaatacata

SEQ ID NO: 4773321 - DNA, 15 bp, Homo sapiens
ctaatattcatgctg

SEQ ID NO: 4773322 - DNA, 13 bp, Homo sapiens
ctaatccacctgg

SEQ ID NO: 4773323 - DNA, 14 bp, Homo sapiens
ctaatccacctggt

SEQ ID NO: 4773324 - DNA, 23 bp, Homo sapiens
ctaatccacctggtggccctgcg

SEQ ID NO: 4773325 - DNA, 17 bp, Homo sapiens
ctaatcgccctgagcta

SEQ ID NO: 4773326 - DNA, 21 bp, Homo sapiens
ctaatctcatacctctgacca

SEQ ID NO: 4773327 - DNA, 12 bp, Homo sapiens
ctaatgaatttt

SEQ ID NO: 4773328 - DNA, 14 bp, Homo sapiens
ctaatgacaagtga

SEQ ID NO: 4773329 - DNA, 21 bp, Homo sapiens
ctaatggattataatcagaat

SEQ ID NO: 4773330 - DNA, 22 bp, Homo sapiens
ctaatggccaagtgtacatttg

SEQ ID NO: 4773331 - DNA, 17 bp, Homo sapiens
ctaattaatttcagtaa

SEQ ID NO: 4773332 - DNA, 12 bp, Homo sapiens
ctaattcctgta

SEQ ID NO: 4773333 - DNA, 22 bp, Homo sapiens
ctaattgtacccttcttgtctc

SEQ ID NO: 4773334 - DNA, 18 bp, Homo sapiens
ctaatttatgaagatagt

SEQ ID NO: 4773335 - DNA, 11 bp, Homo sapiens
ctaatttgtga

SEQ ID NO: 4773336 - DNA, 17 bp, Homo sapiens
ctacaaacttttataaa

SEQ ID NO: 4773337 - DNA, 22 bp, Homo sapiens
ctacaaacttttataaatgttt

SEQ ID NO: 4773338 - DNA, 14 bp, Homo sapiens
ctacaaatcagtaa

SEQ ID NO: 4773339 - DNA, 15 bp, Homo sapiens
ctacaaatcagtaat

SEQ ID NO: 4773340 - DNA, 19 bp, Homo sapiens
ctacaatacaacacattga

SEQ ID NO: 4773341 - DNA, 21 bp, Homo sapiens
ctacaatatcattttcctggg

SEQ ID NO: 4773342 - DNA, 22 bp, Homo sapiens
ctacaatatcattttcctggga

SEQ ID NO: 4773343 - DNA, 21 bp, Homo sapiens
ctacacaggggaaaagaggag

SEQ ID NO: 4773344 - DNA, 21 bp, Homo sapiens
ctacacagtgggaactctgac

SEQ ID NO: 4773345 - DNA, 23 bp, Homo sapiens
ctacacagtgggaactctgacaa

SEQ ID NO: 4773346 - DNA, 22 bp, Homo sapiens
ctacactgtattacataaataa

SEQ ID NO: 4773347 - DNA, 14 bp, Homo sapiens
ctacagacattaaa

SEQ ID NO: 4773348 - DNA, 14 bp, Homo sapiens
ctacagatcctccg

SEQ ID NO: 4773349 - DNA, 23 bp, Homo sapiens
ctacagcttgaccgtgaggccag

SEQ ID NO: 4773350 - DNA, 15 bp, Homo sapiens
ctacaggttttatga

SEQ ID NO: 4773351 - DNA, 12 bp, Homo sapiens
ctacagtatata

SEQ ID NO: 4773352 - DNA, 14 bp, Homo sapiens
ctacagtatataag

SEQ ID NO: 4773353 - DNA, 14 bp, Homo sapiens
ctacatcagagtgt

SEQ ID NO: 4773354 - DNA, 15 bp, Homo sapiens
ctacatcagagtgta

SEQ ID NO: 4773355 - DNA, 18 bp, Homo sapiens
ctacatgcaaatctggct

SEQ ID NO: 4773356 - DNA, 11 bp, Homo sapiens
ctacatttgca

SEQ ID NO: 4773357 - DNA, 16 bp, Homo sapiens
ctacatttttgtttaa

SEQ ID NO: 4773358 - DNA, 13 bp, Homo sapiens
ctaccaaatataa

SEQ ID NO: 4773359 - DNA, 18 bp, Homo sapiens
ctaccaaatataaacttg

SEQ ID NO: 4773360 - DNA, 22 bp, Homo sapiens
ctaccaccctcgctgccaccca

SEQ ID NO: 4773361 - DNA, 23 bp, Homo sapiens
ctacccatcggtgtccatttata

SEQ ID NO: 4773362 - DNA, 22 bp, Homo sapiens
ctaccctggaccgagtggacca

SEQ ID NO: 4773363 - DNA, 13 bp, Homo sapiens
ctaccctttccca

SEQ ID NO: 4773364 - DNA, 17 bp, Homo sapiens
ctacctataaatggact

SEQ ID NO: 4773365 - DNA, 22 bp, Homo sapiens
ctacctataaatggacttgctt

SEQ ID NO: 4773366 - DNA, 18 bp, Homo sapiens
ctacctgaaaattcaaca

SEQ ID NO: 4773367 - DNA, 15 bp, Homo sapiens
ctaccttatagagca

SEQ ID NO: 4773368 - DNA, 22 bp, Homo sapiens
ctacctttgtctcacgattcca

SEQ ID NO: 4773369 - DNA, 23 bp, Homo sapiens
ctacctttgtctcacgattccag

SEQ ID NO: 4773370 - DNA, 15 bp, Homo sapiens
ctactcgagttacag

SEQ ID NO: 4773371 - DNA, 22 bp, Homo sapiens
ctactctgcgacgatccccatg

SEQ ID NO: 4773372 - DNA, 14 bp, Homo sapiens
ctactgcctttcaa

SEQ ID NO: 4773373 - DNA, 14 bp, Homo sapiens
ctacttaaacaaaa

SEQ ID NO: 4773374 - DNA, 16 bp, Homo sapiens
ctacttaaacaaaaac

SEQ ID NO: 4773375 - DNA, 19 bp, Homo sapiens
ctacttaaacaaaaacttt

SEQ ID NO: 4773376 - DNA, 23 bp, Homo sapiens
ctacttaaacaaaaactttccat

SEQ ID NO: 4773377 - DNA, 21 bp, Homo sapiens
ctacttaggaaatactcagca

SEQ ID NO: 4773378 - DNA, 14 bp, Homo sapiens
ctacttatattctg

SEQ ID NO: 4773379 - DNA, 13 bp, Homo sapiens
ctacttatttcag

SEQ ID NO: 4773380 - DNA, 14 bp, Homo sapiens
ctactttaaattgt

SEQ ID NO: 4773381 - DNA, 15 bp, Homo sapiens
ctactttaaattgtg

SEQ ID NO: 4773382 - DNA, 22 bp, Homo sapiens
ctagaaagagaaaaagccctct

SEQ ID NO: 4773383 - DNA, 23 bp, Homo sapiens
ctagaaagagaaaaagccctctt

SEQ ID NO: 4773384 - DNA, 14 bp, Homo sapiens
ctagaaggggcgag

SEQ ID NO: 4773385 - DNA, 17 bp, Homo sapiens
ctagaatgagaaatcat

SEQ ID NO: 4773386 - DNA, 18 bp, Homo sapiens
ctagagatattttgtaaa

SEQ ID NO: 4773387 - DNA, 19 bp, Homo sapiens
ctagagatattttgtaaaa

SEQ ID NO: 4773388 - DNA, 17 bp, Homo sapiens
ctagagggatccaccgc

SEQ ID NO: 4773389 - DNA, 13 bp, Homo sapiens
ctagagtatgtgt

SEQ ID NO: 4773390 - DNA, 14 bp, Homo sapiens
ctagagtatgtgta

SEQ ID NO: 4773391 - DNA, 15 bp, Homo sapiens
ctagagtatgtgtat

SEQ ID NO: 4773392 - DNA, 16 bp, Homo sapiens
ctagagtatgtgtatg

SEQ ID NO: 4773393 - DNA, 17 bp, Homo sapiens
ctagagtatgtgtatgt

SEQ ID NO: 4773394 - DNA, 18 bp, Homo sapiens
ctagagtatgtgtatgta

SEQ ID NO: 4773395 - DNA, 22 bp, Homo sapiens
ctagatatagcttttggtgttt

SEQ ID NO: 4773396 - DNA, 16 bp, Homo sapiens
ctagatatgagaaata

SEQ ID NO: 4773397 - DNA, 14 bp, Homo sapiens
ctagatctcctgta

SEQ ID NO: 4773398 - DNA, 19 bp, Homo sapiens
ctagcaataagttgaatga

SEQ ID NO: 4773399 - DNA, 17 bp, Homo sapiens
ctagcagtgaactattt

SEQ ID NO: 4773400 - DNA, 12 bp, Homo sapiens
ctagccagagga

SEQ ID NO: 4773401 - DNA, 15 bp, Homo sapiens
ctagccagaggagag

SEQ ID NO: 4773402 - DNA, 19 bp, Homo sapiens
ctagccagaggagagagga

SEQ ID NO: 4773403 - DNA, 12 bp, Homo sapiens
ctagccaggcct

SEQ ID NO: 4773404 - DNA, 18 bp, Homo sapiens
ctagccaggcctcccgca

SEQ ID NO: 4773405 - DNA, 23 bp, Homo sapiens
ctagccaggcctcccgcatgctg

SEQ ID NO: 4773406 - DNA, 17 bp, Homo sapiens
ctagccatatattttct

SEQ ID NO: 4773407 - DNA, 12 bp, Homo sapiens
ctagcccaccct

SEQ ID NO: 4773408 - DNA, 20 bp, Homo sapiens
ctagcccaccctgctgcctt

SEQ ID NO: 4773409 - DNA, 21 bp, Homo sapiens
ctagcccaccctgctgccttc

SEQ ID NO: 4773410 - DNA, 23 bp, Homo sapiens
ctagccctctttctctctgtgtg

SEQ ID NO: 4773411 - DNA, 21 bp, Homo sapiens
ctagctatgctgtatctgtgc

SEQ ID NO: 4773412 - DNA, 22 bp, Homo sapiens
ctaggacatctctgtaaaaagc

SEQ ID NO: 4773413 - DNA, 20 bp, Homo sapiens
ctaggatcttcactgtctta

SEQ ID NO: 4773414 - DNA, 20 bp, Homo sapiens
ctaggcagttcaaagcagga

SEQ ID NO: 4773415 - DNA, 15 bp, Homo sapiens
ctaggcatactctcc

SEQ ID NO: 4773416 - DNA, 16 bp, Homo sapiens
ctaggcatactctcca

SEQ ID NO: 4773417 - DNA, 17 bp, Homo sapiens
ctaggcatactctccag

SEQ ID NO: 4773418 - DNA, 19 bp, Homo sapiens
ctaggcatactctccagga

SEQ ID NO: 4773419 - DNA, 20 bp, Homo sapiens
ctaggcatactctccaggat

SEQ ID NO: 4773420 - DNA, 15 bp, Homo sapiens
ctagggctctccaag

SEQ ID NO: 4773421 - DNA, 18 bp, Homo sapiens
ctagggctctccaagcac

SEQ ID NO: 4773422 - DNA, 20 bp, Homo sapiens
ctagggctctccaagcacta

SEQ ID NO: 4773423 - DNA, 23 bp, Homo sapiens
ctaggggccgagggaaatgctgt

SEQ ID NO: 4773424 - DNA, 13 bp, Homo sapiens
ctaggtctccacc

SEQ ID NO: 4773425 - DNA, 16 bp, Homo sapiens
ctaggtctccacccct

SEQ ID NO: 4773426 - DNA, 20 bp, Homo sapiens
ctcaatgtgctgttgattct

SEQ ID NO: 4773427 - DNA, 15 bp, Homo sapiens
ctcaattccagggaa

SEQ ID NO: 4773428 - DNA, 22 bp, Homo sapiens
ctcaattccagggaaccagagc

SEQ ID NO: 4773429 - DNA, 15 bp, Homo sapiens
ctcacaaaaggctgg

SEQ ID NO: 4773430 - DNA, 14 bp, Homo sapiens
ctcacaaaggatgc

SEQ ID NO: 4773431 - DNA, 13 bp, Homo sapiens
ctcacaactgttt

SEQ ID NO: 4773432 - DNA, 19 bp, Homo sapiens
ctcacaactgtttttgaag

SEQ ID NO: 4773433 - DNA, 18 bp, Homo sapiens
ctcacacctcccttcatc

SEQ ID NO: 4773434 - DNA, 14 bp, Homo sapiens
ctcacactggagga

SEQ ID NO: 4773435 - DNA, 14 bp, Homo sapiens
ctcacacttgggct

SEQ ID NO: 4773436 - DNA, 16 bp, Homo sapiens
ctcacagactgctgtc

SEQ ID NO: 4773437 - DNA, 20 bp, Homo sapiens
ctcacagcacatgctggcca

SEQ ID NO: 4773438 - DNA, 22 bp, Homo sapiens
ctcacagcacatgctggccagc

SEQ ID NO: 4773439 - DNA, 10 bp, Homo sapiens
ctcacagcca

SEQ ID NO: 4773440 - DNA, 19 bp, Homo sapiens
ctcacagtgacccttccca

SEQ ID NO: 4773441 - DNA, 17 bp, Homo sapiens
ctcaccatttaatcatt

SEQ ID NO: 4773442 - DNA, 20 bp, Homo sapiens
ctcaccccgttacagctccc

SEQ ID NO: 4773443 - DNA, 12 bp, Homo sapiens
ctcaccctctgt

SEQ ID NO: 4773444 - DNA, 13 bp, Homo sapiens
ctcacctgcccct

SEQ ID NO: 4773445 - DNA, 17 bp, Homo sapiens
ctcacctggcttcccag

SEQ ID NO: 4773446 - DNA, 19 bp, Homo sapiens
ctcacctggcttcccagga

SEQ ID NO: 4773447 - DNA, 14 bp, Homo sapiens
ctcacgtctgtgag

SEQ ID NO: 4773448 - DNA, 23 bp, Homo sapiens
ctcacgtctgtgagtctgtcctt

SEQ ID NO: 4773449 - DNA, 12 bp, Homo sapiens
ctcactctgcca

SEQ ID NO: 4773450 - DNA, 15 bp, Homo sapiens
ctcactctgccaggg

SEQ ID NO: 4773451 - DNA, 14 bp, Homo sapiens
ctcactctgtcagc

SEQ ID NO: 4773452 - DNA, 15 bp, Homo sapiens
ctcactctgtcagcc

SEQ ID NO: 4773453 - DNA, 17 bp, Homo sapiens
ctcactgacttctcccg

SEQ ID NO: 4773454 - DNA, 21 bp, Homo sapiens
ctcactgccactaaaatccac

SEQ ID NO: 4773455 - DNA, 18 bp, Homo sapiens
ctcactgcccgcacaccc

SEQ ID NO: 4773456 - DNA, 20 bp, Homo sapiens
ctcacttgtggcagcttccc

SEQ ID NO: 4773457 - DNA, 23 bp, Homo sapiens
ctcacttgtggcagcttccctga

SEQ ID NO: 4773458 - DNA, 17 bp, Homo sapiens
ctcacttttctcatctg

SEQ ID NO: 4773459 - DNA, 13 bp, Homo sapiens
ctcagaatattaa

SEQ ID NO: 4773460 - DNA, 19 bp, Homo sapiens
ctcagaatattaagcacat

SEQ ID NO: 4773461 - DNA, 21 bp, Homo sapiens
ctcagacccagacgtggtgct

SEQ ID NO: 4773462 - DNA, 19 bp, Homo sapiens
ctcagacgggctgagagga

SEQ ID NO: 4773463 - DNA, 22 bp, Homo sapiens
ctcagacggtggaatatttgga

SEQ ID NO: 4773464 - DNA, 15 bp, Homo sapiens
ctcagatccctcggt

SEQ ID NO: 4773465 - DNA, 23 bp, Homo sapiens
ctcagatccctcggtcagcaccg

SEQ ID NO: 4773466 - DNA, 15 bp, Homo sapiens
ctcagatctgcactc

SEQ ID NO: 4773467 - DNA, 19 bp, Homo sapiens
ctcagatctgcactcctgt

SEQ ID NO: 4773468 - DNA, 13 bp, Homo sapiens
ctcagatgatctc

SEQ ID NO: 4773469 - DNA, 15 bp, Homo sapiens
ctcagcaaattcttg

SEQ ID NO: 4773470 - DNA, 14 bp, Homo sapiens
ctcagcaagtgctg

SEQ ID NO: 4773471 - DNA, 16 bp, Homo sapiens
ctcagcaggggagggt

SEQ ID NO: 4773472 - DNA, 23 bp, Homo sapiens
ctcagcatcctggaaatttgtgt

SEQ ID NO: 4773473 - DNA, 17 bp, Homo sapiens
ctcagccccagacctgc

SEQ ID NO: 4773474 - DNA, 12 bp, Homo sapiens
ctcagccccagg

SEQ ID NO: 4773475 - DNA, 13 bp, Homo sapiens
ctcagccctcaga

SEQ ID NO: 4773476 - DNA, 16 bp, Homo sapiens
ctcagccctcattaaa

SEQ ID NO: 4773477 - DNA, 20 bp, Homo sapiens
ctcagccctcattaaactaa

SEQ ID NO: 4773478 - DNA, 17 bp, Homo sapiens
ctcagcgggagtctcct

SEQ ID NO: 4773479 - DNA, 20 bp, Homo sapiens
ctcagcgggagtctcctcac

SEQ ID NO: 4773480 - DNA, 16 bp, Homo sapiens
ctcagctccactctga

SEQ ID NO: 4773481 - DNA, 13 bp, Homo sapiens
ctcagctctccct

SEQ ID NO: 4773482 - DNA, 15 bp, Homo sapiens
ctcaggaccaccctg

SEQ ID NO: 4773483 - DNA, 23 bp, Homo sapiens
ctcaggaccaccctgccaaggca

SEQ ID NO: 4773484 - DNA, 19 bp, Homo sapiens
ctcaggagaaggcctgccc

SEQ ID NO: 4773485 - DNA, 13 bp, Homo sapiens
ctcaggagcacag

SEQ ID NO: 4773486 - DNA, 14 bp, Homo sapiens
ctcaggagcacagc

SEQ ID NO: 4773487 - DNA, 15 bp, Homo sapiens
ctcaggagcacagcc

SEQ ID NO: 4773488 - DNA, 13 bp, Homo sapiens
ctcaggcagcctg

SEQ ID NO: 4773489 - DNA, 15 bp, Homo sapiens
ctcaggcagcctgtg

SEQ ID NO: 4773490 - DNA, 19 bp, Homo sapiens
ctcaggccaaactcacctg

SEQ ID NO: 4773491 - DNA, 13 bp, Homo sapiens
ctcaggccagctg

SEQ ID NO: 4773492 - DNA, 14 bp, Homo sapiens
ctcaggccagctgc

SEQ ID NO: 4773493 - DNA, 16 bp, Homo sapiens
ctcaggccagctgctt

SEQ ID NO: 4773494 - DNA, 21 bp, Homo sapiens
ctcaggccagctgcttgggct

SEQ ID NO: 4773495 - DNA, 11 bp, Homo sapiens
ctcaggcctca

SEQ ID NO: 4773496 - DNA, 11 bp, Homo sapiens
ctcaggcctgg

SEQ ID NO: 4773497 - DNA, 13 bp, Homo sapiens
ctcaggcctgggg

SEQ ID NO: 4773498 - DNA, 14 bp, Homo sapiens
ctcaggcctggggg

SEQ ID NO: 4773499 - DNA, 13 bp, Homo sapiens
ctcaggctgccca

SEQ ID NO: 4773500 - DNA, 15 bp, Homo sapiens
ctcaggctgcccagc

SEQ ID NO: 4773501 - DNA, 18 bp, Homo sapiens
ctcaggtggcatttgcag

SEQ ID NO: 4773502 - DNA, 13 bp, Homo sapiens
ctcagtcaaatgt

SEQ ID NO: 4773503 - DNA, 14 bp, Homo sapiens
ctcagtcagtgtca

SEQ ID NO: 4773504 - DNA, 16 bp, Homo sapiens
ctcagtcagtgtcatg

SEQ ID NO: 4773505 - DNA, 14 bp, Homo sapiens
ctcagtcccacagc

SEQ ID NO: 4773506 - DNA, 16 bp, Homo sapiens
ctcagtcccacagccc

SEQ ID NO: 4773507 - DNA, 18 bp, Homo sapiens
ctcagtccctccctcctg

SEQ ID NO: 4773508 - DNA, 18 bp, Homo sapiens
ctcagtgagatcagtcag

SEQ ID NO: 4773509 - DNA, 21 bp, Homo sapiens
ctcagtgcagggacagcctgc

SEQ ID NO: 4773510 - DNA, 24 bp, Homo sapiens
ctcagtgcagggacagcctgcaca

SEQ ID NO: 4773511 - DNA, 18 bp, Homo sapiens
ctcagttcaacctggtgg

SEQ ID NO: 4773512 - DNA, 22 bp, Homo sapiens
ctcagttcaacctggtggcacc

SEQ ID NO: 4773513 - DNA, 16 bp, Homo sapiens
ctcagttggcctctgc

SEQ ID NO: 4773514 - DNA, 20 bp, Homo sapiens
ctcagttggcctctgcccct

SEQ ID NO: 4773515 - DNA, 14 bp, Homo sapiens
ctcagtttctctgg

SEQ ID NO: 4773516 - DNA, 19 bp, Homo sapiens
ctcataagtaaatgtcttc

SEQ ID NO: 4773517 - DNA, 18 bp, Homo sapiens
ctcatacagtctctattt

SEQ ID NO: 4773518 - DNA, 21 bp, Homo sapiens
ctcatacctctgaccaacagg

SEQ ID NO: 4773519 - DNA, 15 bp, Homo sapiens
ctcatcaacaaagaa

SEQ ID NO: 4773520 - DNA, 14 bp, Homo sapiens
ctcatcactgaaat

SEQ ID NO: 4773521 - DNA, 19 bp, Homo sapiens
ctcatcagtgtcattttct

SEQ ID NO: 4773522 - DNA, 21 bp, Homo sapiens
ctcatcagtgtcattttctgt

SEQ ID NO: 4773523 - DNA, 19 bp, Homo sapiens
ctcatccaaaagtgaccag

SEQ ID NO: 4773524 - DNA, 19 bp, Homo sapiens
ctcatccactaggtgccca

SEQ ID NO: 4773525 - DNA, 20 bp, Homo sapiens
ctcatccagaactgtcttag

SEQ ID NO: 4773526 - DNA, 23 bp, Homo sapiens
ctcatccattaatgtagataaag

SEQ ID NO: 4773527 - DNA, 14 bp, Homo sapiens
ctcatctccatgct

SEQ ID NO: 4773528 - DNA, 19 bp, Homo sapiens
ctcatctgtaaaaccaggc

SEQ ID NO: 4773529 - DNA, 22 bp, Homo sapiens
ctcatctgtaaaaccaggctga

SEQ ID NO: 4773530 - DNA, 17 bp, Homo sapiens
ctcatcttccttctcag

SEQ ID NO: 4773531 - DNA, 13 bp, Homo sapiens
ctcatcttgcctc

SEQ ID NO: 4773532 - DNA, 22 bp, Homo sapiens
ctcatggctgttatctgtcttt

SEQ ID NO: 4773533 - DNA, 17 bp, Homo sapiens
ctcatgttttatatgat

SEQ ID NO: 4773534 - DNA, 20 bp, Homo sapiens
ctcattgccaaggcatcccc

SEQ ID NO: 4773535 - DNA, 21 bp, Homo sapiens
ctcatttagcattgaaataat

SEQ ID NO: 4773536 - DNA, 21 bp, Homo sapiens
ctcatttatgttatttatgat

SEQ ID NO: 4773537 - DNA, 17 bp, Homo sapiens
ctcatttatttccatat

SEQ ID NO: 4773538 - DNA, 18 bp, Homo sapiens
ctcatttgatattgtgta

SEQ ID NO: 4773539 - DNA, 18 bp, Homo sapiens
ctcatttggatataaatc

SEQ ID NO: 4773540 - DNA, 20 bp, Homo sapiens
ctcatttggatataaatctt

SEQ ID NO: 4773541 - DNA, 17 bp, Homo sapiens
ctcattttgcttcccat

SEQ ID NO: 4773542 - DNA, 18 bp, Homo sapiens
ctccaaagcctgggcaga

SEQ ID NO: 4773543 - DNA, 13 bp, Homo sapiens
ctccaaatgctgt

SEQ ID NO: 4773544 - DNA, 16 bp, Homo sapiens
ctccaacctggaggct

SEQ ID NO: 4773545 - DNA, 18 bp, Homo sapiens
ctccaacctggaggctgg

SEQ ID NO: 4773546 - DNA, 23 bp, Homo sapiens
ctccaacctggaggctggaccaa

SEQ ID NO: 4773547 - DNA, 21 bp, Homo sapiens
ctccaagcactagccttccca

SEQ ID NO: 4773548 - DNA, 13 bp, Homo sapiens
ctctatatataca

SEQ ID NO: 4773549 - DNA, 15 bp, Homo sapiens
ctctatatatacatg

SEQ ID NO: 4773550 - DNA, 14 bp, Homo sapiens
ctctatctgggcct

SEQ ID NO: 4773551 - DNA, 16 bp, Homo sapiens
ctctatctgggcctgg

SEQ ID NO: 4773552 - DNA, 13 bp, Homo sapiens
ctctatgctctgg

SEQ ID NO: 4773553 - DNA, 16 bp, Homo sapiens
ctctatgctctggaaa

SEQ ID NO: 4773554 - DNA, 12 bp, Homo sapiens
ctctcacacaca

SEQ ID NO: 4773555 - DNA, 22 bp, Homo sapiens
ctctcaccccccgacctggctg

SEQ ID NO: 4773556 - DNA, 23 bp, Homo sapiens
ctctcacttttttataaattata

SEQ ID NO: 4773557 - DNA, 16 bp, Homo sapiens
ctctcagaactcctgt

SEQ ID NO: 4773558 - DNA, 20 bp, Homo sapiens
ctctcagaactcctgtgtgt

SEQ ID NO: 4773559 - DNA, 13 bp, Homo sapiens
ctctcagatccct

SEQ ID NO: 4773560 - DNA, 17 bp, Homo sapiens
ctctcaggaccaccctg

SEQ ID NO: 4773561 - DNA, 12 bp, Homo sapiens
ctctcaggccaa

SEQ ID NO: 4773562 - DNA, 21 bp, Homo sapiens
ctctcaggccaaactcacctg

SEQ ID NO: 4773563 - DNA, 13 bp, Homo sapiens
ctctcaggccagc

SEQ ID NO: 4773564 - DNA, 17 bp, Homo sapiens
ctctcaggccagctgct

SEQ ID NO: 4773565 - DNA, 21 bp, Homo sapiens
ctctcaggccagctgcttggg

SEQ ID NO: 4773566 - DNA, 19 bp, Homo sapiens
ctctcagtatcttaaaatt

SEQ ID NO: 4773567 - DNA, 24 bp, Homo sapiens
ctctccaggattgtccacaaatgt

SEQ ID NO: 4773568 - DNA, 18 bp, Homo sapiens
ctctccattcttttaaat

SEQ ID NO: 4773569 - DNA, 19 bp, Homo sapiens
ctctcccaactgctgctta

SEQ ID NO: 4773570 - DNA, 22 bp, Homo sapiens
ctctccccatatataaattatt

SEQ ID NO: 4773571 - DNA, 14 bp, Homo sapiens
ctctccctccactc

SEQ ID NO: 4773572 - DNA, 21 bp, Homo sapiens
ctctccgcccacgcggctgct

SEQ ID NO: 4773573 - DNA, 13 bp, Homo sapiens
ctctcctccagag

SEQ ID NO: 4773574 - DNA, 13 bp, Homo sapiens
ctctcctcctttt

SEQ ID NO: 4773575 - DNA, 17 bp, Homo sapiens
ctctcctcggtggcatt

SEQ ID NO: 4773576 - DNA, 17 bp, Homo sapiens
ctctcctcgtccggcct

SEQ ID NO: 4773577 - DNA, 20 bp, Homo sapiens
ctctcctcgtccggcctgca

SEQ ID NO: 4773578 - DNA, 15 bp, Homo sapiens
ctctcctctctctcc

SEQ ID NO: 4773579 - DNA, 16 bp, Homo sapiens
ctctcctctctctccc

SEQ ID NO: 4773580 - DNA, 18 bp, Homo sapiens
ctctcctctctctccctc

SEQ ID NO: 4773581 - DNA, 20 bp, Homo sapiens
ctctcctctctctccctcca

SEQ ID NO: 4773582 - DNA, 14 bp, Homo sapiens
ctctcctctctgga

SEQ ID NO: 4773583 - DNA, 18 bp, Homo sapiens
ctctcctgagcctgtctc

SEQ ID NO: 4773584 - DNA, 19 bp, Homo sapiens
ctctcctgagcctgtctct

SEQ ID NO: 4773585 - DNA, 13 bp, Homo sapiens
ctctcctgcatcc

SEQ ID NO: 4773586 - DNA, 18 bp, Homo sapiens
ctctcctgctcacccgcc

SEQ ID NO: 4773587 - DNA, 19 bp, Homo sapiens
ctctcctgggggtggcagg

SEQ ID NO: 4773588 - DNA, 19 bp, Homo sapiens
ctctcctgtgagctcccca

SEQ ID NO: 4773589 - DNA, 17 bp, Homo sapiens
ctctccttcactctgac

SEQ ID NO: 4773590 - DNA, 12 bp, Homo sapiens
ctctccttcctt

SEQ ID NO: 4773591 - DNA, 16 bp, Homo sapiens
ctctcgctcccctctg

SEQ ID NO: 4773592 - DNA, 21 bp, Homo sapiens
ctctcgtagaacctgcgcacc

SEQ ID NO: 4773593 - DNA, 21 bp, Homo sapiens
ctctctaagacaaatgcagtg

SEQ ID NO: 4773594 - DNA, 12 bp, Homo sapiens
ctctctcaggcc

SEQ ID NO: 4773595 - DNA, 13 bp, Homo sapiens
ctctctccctcca

SEQ ID NO: 4773596 - DNA, 16 bp, Homo sapiens
ctctctccgccccgga

SEQ ID NO: 4773597 - DNA, 13 bp, Homo sapiens
ctctctcctctct

SEQ ID NO: 4773598 - DNA, 17 bp, Homo sapiens
ctctctctatatataca

SEQ ID NO: 4773599 - DNA, 20 bp, Homo sapiens
ctctctctatatatacatgt

SEQ ID NO: 4773600 - DNA, 13 bp, Homo sapiens
ctctctctctctc

SEQ ID NO: 4773601 - DNA, 15 bp, Homo sapiens
ctctctctctctctg

SEQ ID NO: 4773602 - DNA, 13 bp, Homo sapiens
ctctctctctgtt

SEQ ID NO: 4773603 - DNA, 9 bp, Homo sapiens
ctctctctg

SEQ ID NO: 4773604 - DNA, 14 bp, Homo sapiens
ctctctctgttcca

SEQ ID NO: 4773605 - DNA, 15 bp, Homo sapiens
ctctctgaactgcaa

SEQ ID NO: 4773606 - DNA, 18 bp, Homo sapiens
ctctctgaactgcaacac

SEQ ID NO: 4773607 - DNA, 21 bp, Homo sapiens
ctctctgaactgcaacactgg

SEQ ID NO: 4773608 - DNA, 13 bp, Homo sapiens
ctctctgcagtcc

SEQ ID NO: 4773609 - DNA, 15 bp, Homo sapiens
ctctctggacctgac

SEQ ID NO: 4773610 - DNA, 18 bp, Homo sapiens
ctctctggggccctgggc

SEQ ID NO: 4773611 - DNA, 22 bp, Homo sapiens
ctctctggggccctgggcctca

SEQ ID NO: 4773612 - DNA, 23 bp, Homo sapiens
ctctctggggccctgggcctcag

SEQ ID NO: 4773613 - DNA, 16 bp, Homo sapiens
ctctctgtgtggcaaa

SEQ ID NO: 4773614 - DNA, 21 bp, Homo sapiens
ctctctgtgtggcaaacattt

SEQ ID NO: 4773615 - DNA, 22 bp, Homo sapiens
ctctctgtgtggcaaacattta

SEQ ID NO: 4773616 - DNA, 22 bp, Homo sapiens
ctctctgttccaagtgtgtgtg

SEQ ID NO: 4773617 - DNA, 13 bp, Homo sapiens
ctctcttggtctc

SEQ ID NO: 4773618 - DNA, 15 bp, Homo sapiens
ctctcttggtctctt

SEQ ID NO: 4773619 - DNA, 24 bp, Homo sapiens
ctctcttggtctctttctttccaa

SEQ ID NO: 4773620 - DNA, 12 bp, Homo sapiens
ctctctttcttt

SEQ ID NO: 4773621 - DNA, 20 bp, Homo sapiens
ctctgaactgcaacactgga

SEQ ID NO: 4773622 - DNA, 13 bp, Homo sapiens
ctctgaagggagg

SEQ ID NO: 4773623 - DNA, 20 bp, Homo sapiens
ctctgaagggaggggaagag

SEQ ID NO: 4773624 - DNA, 20 bp, Homo sapiens
ctctgaagtcccttcctgtc

SEQ ID NO: 4773625 - DNA, 19 bp, Homo sapiens
ctctgaatctctcaaaatg

SEQ ID NO: 4773626 - DNA, 18 bp, Homo sapiens
ctctgaatgctatttgtg

SEQ ID NO: 4773627 - DNA, 17 bp, Homo sapiens
ctctgacaagggctgac

SEQ ID NO: 4773628 - DNA, 18 bp, Homo sapiens
ctctgacaagggctgacc

SEQ ID NO: 4773629 - DNA, 12 bp, Homo sapiens
ctctgagaacag

SEQ ID NO: 4773630 - DNA, 23 bp, Homo sapiens
ctctgagcagacagggcgtcctc

SEQ ID NO: 4773631 - DNA, 14 bp, Homo sapiens
ctctgagcagtggg

SEQ ID NO: 4773632 - DNA, 15 bp, Homo sapiens
ctctgagcagtgggg

SEQ ID NO: 4773633 - DNA, 14 bp, Homo sapiens
ctctgagtcctcat

SEQ ID NO: 4773634 - DNA, 16 bp, Homo sapiens
ctctgatatgggactg

SEQ ID NO: 4773635 - DNA, 14 bp, Homo sapiens
ctctgatggcactt

SEQ ID NO: 4773636 - DNA, 16 bp, Homo sapiens
ctctgatggcactttt

SEQ ID NO: 4773637 - DNA, 18 bp, Homo sapiens
ctctgatttattttgtat

SEQ ID NO: 4773638 - DNA, 21 bp, Homo sapiens
ctctgcacctaatccccataa

SEQ ID NO: 4773639 - DNA, 15 bp, Homo sapiens
ctctgcagcctgagc

SEQ ID NO: 4773640 - DNA, 18 bp, Homo sapiens
ctctgccagggcagtgct

SEQ ID NO: 4773641 - DNA, 10 bp, Homo sapiens
ctctgccccc

SEQ ID NO: 4773642 - DNA, 16 bp, Homo sapiens
ctctgccccctccccc

SEQ ID NO: 4773643 - DNA, 20 bp, Homo sapiens
ctctgccccctcccccgcag

SEQ ID NO: 4773644 - DNA, 10 bp, Homo sapiens
ctctgcccct

SEQ ID NO: 4773645 - DNA, 18 bp, Homo sapiens
ctctgcccctccgtcccc

SEQ ID NO: 4773646 - DNA, 23 bp, Homo sapiens
ctctgcccctccgtccccagggt

SEQ ID NO: 4773647 - DNA, 19 bp, Homo sapiens
ctctgcccgcgggtggctg

SEQ ID NO: 4773648 - DNA, 14 bp, Homo sapiens
ctctgcgccccagc

SEQ ID NO: 4773649 - DNA, 17 bp, Homo sapiens
ctctgctatgtctgtga

SEQ ID NO: 4773650 - DNA, 20 bp, Homo sapiens
ctctgctatgtctgtgatgt

SEQ ID NO: 4773651 - DNA, 15 bp, Homo sapiens
ctctgctgcacagta

SEQ ID NO: 4773652 - DNA, 20 bp, Homo sapiens
ctctggacagatgggtgtcc

SEQ ID NO: 4773653 - DNA, 17 bp, Homo sapiens
ctctggacctgaccaga

SEQ ID NO: 4773654 - DNA, 21 bp, Homo sapiens
ctctggcactccagaacaaac

SEQ ID NO: 4773655 - DNA, 13 bp, Homo sapiens
ctctggctgccaa

SEQ ID NO: 4773656 - DNA, 19 bp, Homo sapiens
ctctgggctatatgcctat

SEQ ID NO: 4773657 - DNA, 18 bp, Homo sapiens
ctctggggccctgggcct

SEQ ID NO: 4773658 - DNA, 22 bp, Homo sapiens
ctctggggccctgggcctcagt

SEQ ID NO: 4773659 - DNA, 16 bp, Homo sapiens
ctctggggctctaggg

SEQ ID NO: 4773660 - DNA, 16 bp, Homo sapiens
ctctgggttttgggat

SEQ ID NO: 4773661 - DNA, 21 bp, Homo sapiens
ctctgggttttgggatttggg

SEQ ID NO: 4773662 - DNA, 19 bp, Homo sapiens
ctctgtacgaggcttctct

SEQ ID NO: 4773663 - DNA, 20 bp, Homo sapiens
ctctgtacgaggcttctcta

SEQ ID NO: 4773664 - DNA, 13 bp, Homo sapiens
ctctgtagcctgg

SEQ ID NO: 4773665 - DNA, 21 bp, Homo sapiens
ctctgtagcctggtctgtgca

SEQ ID NO: 4773666 - DNA, 15 bp, Homo sapiens
ctctgtcagccagcc

SEQ ID NO: 4773667 - DNA, 17 bp, Homo sapiens
ctctgtcagccagccgc

SEQ ID NO: 4773668 - DNA, 20 bp, Homo sapiens
ctctgtcagccagccgccct

SEQ ID NO: 4773669 - DNA, 23 bp, Homo sapiens
ctctgtccgcgtcctttcctctc

SEQ ID NO: 4773670 - DNA, 14 bp, Homo sapiens
ctgcccacctgcca

SEQ ID NO: 4773671 - DNA, 15 bp, Homo sapiens
ctgcccacctgccag

SEQ ID NO: 4773672 - DNA, 16 bp, Homo sapiens
ctgcccacctgccagg

SEQ ID NO: 4773673 - DNA, 13 bp, Homo sapiens
ctgcccagcacct

SEQ ID NO: 4773674 - DNA, 16 bp, Homo sapiens
ctgcccagcacctcct

SEQ ID NO: 4773675 - DNA, 21 bp, Homo sapiens
ctgcccagcacctcctccgtg

SEQ ID NO: 4773676 - DNA, 22 bp, Homo sapiens
ctgcccaggcagtctttgctca

SEQ ID NO: 4773677 - DNA, 18 bp, Homo sapiens
ctgcccaggccggccagc

SEQ ID NO: 4773678 - DNA, 22 bp, Homo sapiens
ctgcccaggccggccagcctca

SEQ ID NO: 4773679 - DNA, 20 bp, Homo sapiens
ctgcccagttagcccggcca

SEQ ID NO: 4773680 - DNA, 18 bp, Homo sapiens
ctgccccacacaggcctg

SEQ ID NO: 4773681 - DNA, 21 bp, Homo sapiens
ctgccccacacaggcctggcc

SEQ ID NO: 4773682 - DNA, 15 bp, Homo sapiens
ctgccccagagaagc

SEQ ID NO: 4773683 - DNA, 20 bp, Homo sapiens
ctgccccagagaagcctcag

SEQ ID NO: 4773684 - DNA, 22 bp, Homo sapiens
ctgccccaggctcaggctgccc

SEQ ID NO: 4773685 - DNA, 14 bp, Homo sapiens
ctgcccccacagat

SEQ ID NO: 4773686 - DNA, 12 bp, Homo sapiens
ctgccccctccc

SEQ ID NO: 4773687 - DNA, 17 bp, Homo sapiens
ctgccccctcccccgca

SEQ ID NO: 4773688 - DNA, 23 bp, Homo sapiens
ctgccccctcccccgcagacaga

SEQ ID NO: 4773689 - DNA, 18 bp, Homo sapiens
ctgcccctccgtccccag

SEQ ID NO: 4773690 - DNA, 14 bp, Homo sapiens
ctgcccctggcagc

SEQ ID NO: 4773691 - DNA, 19 bp, Homo sapiens
ctgcccctggcagcccctg

SEQ ID NO: 4773692 - DNA, 17 bp, Homo sapiens
ctgccccttgaccccac

SEQ ID NO: 4773693 - DNA, 19 bp, Homo sapiens
ctgccccttgaccccacac

SEQ ID NO: 4773694 - DNA, 22 bp, Homo sapiens
ctgcccgagggcaggggccgtg

SEQ ID NO: 4773695 - DNA, 18 bp, Homo sapiens
ctgcccgcacagcagcct

SEQ ID NO: 4773696 - DNA, 21 bp, Homo sapiens
ctgcccgcacagcagcctgct

SEQ ID NO: 4773697 - DNA, 13 bp, Homo sapiens
ctgcccgcgcccg

SEQ ID NO: 4773698 - DNA, 17 bp, Homo sapiens
ctgcccgcgcccgccgc

SEQ ID NO: 4773699 - DNA, 20 bp, Homo sapiens
ctgccctcactccactcccc

SEQ ID NO: 4773700 - DNA, 18 bp, Homo sapiens
ctgccctcccccacggcc

SEQ ID NO: 4773701 - DNA, 18 bp, Homo sapiens
ctgccctctccttcctta

SEQ ID NO: 4773702 - DNA, 21 bp, Homo sapiens
ctgccctgatgcgtctaccca

SEQ ID NO: 4773703 - DNA, 12 bp, Homo sapiens
ctgccctggcct

SEQ ID NO: 4773704 - DNA, 13 bp, Homo sapiens
ctgccctggccta

SEQ ID NO: 4773705 - DNA, 19 bp, Homo sapiens
ctgcccttacctgccagga

SEQ ID NO: 4773706 - DNA, 19 bp, Homo sapiens
ctgccgcagccctgcagag

SEQ ID NO: 4773707 - DNA, 23 bp, Homo sapiens
ctgccgcagccctgcagagggca

SEQ ID NO: 4773708 - DNA, 15 bp, Homo sapiens
ctgccgctgcttgag

SEQ ID NO: 4773709 - DNA, 20 bp, Homo sapiens
ctgccgctgcttgagtggac

SEQ ID NO: 4773710 - DNA, 14 bp, Homo sapiens
ctgccggtccccca

SEQ ID NO: 4773711 - DNA, 16 bp, Homo sapiens
ctgccggtggggccag

SEQ ID NO: 4773712 - DNA, 20 bp, Homo sapiens
ctgccggtggggccagcgct

SEQ ID NO: 4773713 - DNA, 21 bp, Homo sapiens
ctgccggtggggccagcgctg

SEQ ID NO: 4773714 - DNA, 16 bp, Homo sapiens
ctgcctccaagtcatg

SEQ ID NO: 4773715 - DNA, 22 bp, Homo sapiens
ctgcctccggccctgccccaca

SEQ ID NO: 4773716 - DNA, 13 bp, Homo sapiens
ctgcctctcacac

SEQ ID NO: 4773717 - DNA, 13 bp, Homo sapiens
ctgcctctgccac

SEQ ID NO: 4773718 - DNA, 13 bp, Homo sapiens
ctgcctctgcctt

SEQ ID NO: 4773719 - DNA, 15 bp, Homo sapiens
ctgcctgagaccacg

SEQ ID NO: 4773720 - DNA, 15 bp, Homo sapiens
ctgcctgcagagcag

SEQ ID NO: 4773721 - DNA, 14 bp, Homo sapiens
ctgcctgccatgtg

SEQ ID NO: 4773722 - DNA, 18 bp, Homo sapiens
ctgcctgccatgtgtgag

SEQ ID NO: 4773723 - DNA, 19 bp, Homo sapiens
ctgcctggaggagaaggag

SEQ ID NO: 4773724 - DNA, 22 bp, Homo sapiens
ctgcctggaggagaaggaggaa

SEQ ID NO: 4773725 - DNA, 15 bp, Homo sapiens
ctgcctggcgggcag

SEQ ID NO: 4773726 - DNA, 18 bp, Homo sapiens
ctgcctgggacagccact

SEQ ID NO: 4773727 - DNA, 19 bp, Homo sapiens
ctgcctgtggtgaggtcct

SEQ ID NO: 4773728 - DNA, 16 bp, Homo sapiens
ctgcctgttgggccag

SEQ ID NO: 4773729 - DNA, 19 bp, Homo sapiens
ctgcctgttgggccaggag

SEQ ID NO: 4773730 - DNA, 15 bp, Homo sapiens
ctgccttagaggagc

SEQ ID NO: 4773731 - DNA, 20 bp, Homo sapiens
ctgccttctgacggccctgc

SEQ ID NO: 4773732 - DNA, 21 bp, Homo sapiens
ctgccttctgacggccctgca

SEQ ID NO: 4773733 - DNA, 23 bp, Homo sapiens
ctgcgacggaggcaggaccaggc

SEQ ID NO: 4773734 - DNA, 13 bp, Homo sapiens
ctgcgccccagcg

SEQ ID NO: 4773735 - DNA, 12 bp, Homo sapiens
ctgcgcccctgc

SEQ ID NO: 4773736 - DNA, 14 bp, Homo sapiens
ctgcgcccctgccc

SEQ ID NO: 4773737 - DNA, 15 bp, Homo sapiens
ctgcgcccctgccca

SEQ ID NO: 4773738 - DNA, 19 bp, Homo sapiens
ctgcgcccctgcccagcac

SEQ ID NO: 4773739 - DNA, 20 bp, Homo sapiens
ctgcgcccctgcccagcacc

SEQ ID NO: 4773740 - DNA, 13 bp, Homo sapiens
ctgcgccctccct

SEQ ID NO: 4773741 - DNA, 15 bp, Homo sapiens
ctgcgcctcctcctg

SEQ ID NO: 4773742 - DNA, 18 bp, Homo sapiens
ctgcgcctcctcctgcat

SEQ ID NO: 4773743 - DNA, 19 bp, Homo sapiens
ctgcgcctcctcctgcatg

SEQ ID NO: 4773744 - DNA, 14 bp, Homo sapiens
ctgcgcctgcccgc

SEQ ID NO: 4773745 - DNA, 15 bp, Homo sapiens
ctgcgcctgcccgcc

SEQ ID NO: 4773746 - DNA, 15 bp, Homo sapiens
ctgcgcctgcgcctc

SEQ ID NO: 4773747 - DNA, 16 bp, Homo sapiens
ctgcgctcctctgcag

SEQ ID NO: 4773748 - DNA, 23 bp, Homo sapiens
ctgcgctcctctgcagcctgagc

SEQ ID NO: 4773749 - DNA, 15 bp, Homo sapiens
ctgcggggttccctg

SEQ ID NO: 4773750 - DNA, 14 bp, Homo sapiens
ctgcgggttttaat

SEQ ID NO: 4773751 - DNA, 13 bp, Homo sapiens
ctgcgtcccttct

SEQ ID NO: 4773752 - DNA, 16 bp, Homo sapiens
ctgcgtctcctcgtcc

SEQ ID NO: 4773753 - DNA, 17 bp, Homo sapiens
ctgcgtctcctgcccac

SEQ ID NO: 4773754 - DNA, 20 bp, Homo sapiens
ctgcgtgtgttctctccgga

SEQ ID NO: 4773755 - DNA, 14 bp, Homo sapiens
ctgctaaatgactt

SEQ ID NO: 4773756 - DNA, 15 bp, Homo sapiens
ctgctacagagcaga

SEQ ID NO: 4773757 - DNA, 13 bp, Homo sapiens
ctgctatccagcc

SEQ ID NO: 4773758 - DNA, 14 bp, Homo sapiens
ctgctatccagccg

SEQ ID NO: 4773759 - DNA, 16 bp, Homo sapiens
ctgctatccagccgca

SEQ ID NO: 4773760 - DNA, 14 bp, Homo sapiens
ctgctatgtctgtg

SEQ ID NO: 4773761 - DNA, 16 bp, Homo sapiens
ctgctcacgtctgtga

SEQ ID NO: 4773762 - DNA, 17 bp, Homo sapiens
ctgctcacgtctgtgag

SEQ ID NO: 4773763 - DNA, 16 bp, Homo sapiens
ctgctcaggcctcacc

SEQ ID NO: 4773764 - DNA, 23 bp, Homo sapiens
ctgctcaggcctcacctggcttc

SEQ ID NO: 4773765 - DNA, 15 bp, Homo sapiens
ctgctcaggctcccc

SEQ ID NO: 4773766 - DNA, 23 bp, Homo sapiens
ctgctcaggctccccaagacttg

SEQ ID NO: 4773767 - DNA, 12 bp, Homo sapiens
ctgctccatgca

SEQ ID NO: 4773768 - DNA, 14 bp, Homo sapiens
ctgctccatgcaca

SEQ ID NO: 4773769 - DNA, 15 bp, Homo sapiens
ctgctccatgcacag

SEQ ID NO: 4773770 - DNA, 16 bp, Homo sapiens
ctgctccatgcacagg

SEQ ID NO: 4773771 - DNA, 22 bp, Homo sapiens
ctgctccatgcagatctagcca

SEQ ID NO: 4773772 - DNA, 23 bp, Homo sapiens
ctgctccatgcagatctagccag

SEQ ID NO: 4773773 - DNA, 12 bp, Homo sapiens
ctgctcctggga

SEQ ID NO: 4773774 - DNA, 16 bp, Homo sapiens
ctgctcgccctgtgcc

SEQ ID NO: 4773775 - DNA, 17 bp, Homo sapiens
ctgctcgccctgtgccc

SEQ ID NO: 4773776 - DNA, 23 bp, Homo sapiens
ctgctcgccctgtgccctctcac

SEQ ID NO: 4773777 - DNA, 20 bp, Homo sapiens
ctgctcgggaaggcctgagg

SEQ ID NO: 4773778 - DNA, 18 bp, Homo sapiens
ctgctctccttcactctg

SEQ ID NO: 4773779 - DNA, 21 bp, Homo sapiens
ctgctctccttcactctgaca

SEQ ID NO: 4773780 - DNA, 18 bp, Homo sapiens
ctgctctctaagaattca

SEQ ID NO: 4773781 - DNA, 23 bp, Homo sapiens
ctgctgaaaaccatctggcctgg

SEQ ID NO: 4773782 - DNA, 17 bp, Homo sapiens
ctgctgcacagtagtgt

SEQ ID NO: 4773783 - DNA, 20 bp, Homo sapiens
ctgctgcacagtagtgttgg

SEQ ID NO: 4773784 - DNA, 21 bp, Homo sapiens
ctgctgcagtcagcacagaga

SEQ ID NO: 4773785 - DNA, 15 bp, Homo sapiens
ctgctgcctccaagt

SEQ ID NO: 4773786 - DNA, 21 bp, Homo sapiens
ctgctgcctgcccgcacagca

SEQ ID NO: 4773787 - DNA, 18 bp, Homo sapiens
ctgctgcttctccctggg

SEQ ID NO: 4773788 - DNA, 16 bp, Homo sapiens
ctgctgtatttgagga

SEQ ID NO: 4773789 - DNA, 17 bp, Homo sapiens
ctgcttagtgtccctta

SEQ ID NO: 4773790 - DNA, 13 bp, Homo sapiens
ctgcttcattcaa

SEQ ID NO: 4773791 - DNA, 17 bp, Homo sapiens
ctgcttctccacctccc

SEQ ID NO: 4773792 - DNA, 21 bp, Homo sapiens
ctgtatttacttgttatgttg

SEQ ID NO: 4773793 - DNA, 17 bp, Homo sapiens
ctgtatttgaggaaact

SEQ ID NO: 4773794 - DNA, 15 bp, Homo sapiens
ctgtcaaatccatgt

SEQ ID NO: 4773795 - DNA, 16 bp, Homo sapiens
ctgtcaaatccatgtg

SEQ ID NO: 4773796 - DNA, 21 bp, Homo sapiens
ctgtcaacctgaattaaagtc

SEQ ID NO: 4773797 - DNA, 13 bp, Homo sapiens
ctgtcaattacag

SEQ ID NO: 4773798 - DNA, 15 bp, Homo sapiens
ctgtcaattacagga

SEQ ID NO: 4773799 - DNA, 12 bp, Homo sapiens
ctgtcagccagc

SEQ ID NO: 4773800 - DNA, 18 bp, Homo sapiens
ctgtcagccagccgccct

SEQ ID NO: 4773801 - DNA, 20 bp, Homo sapiens
ctgtcagccagccgccctgg

SEQ ID NO: 4773802 - DNA, 22 bp, Homo sapiens
ctgtcagccagccgccctgggc

SEQ ID NO: 4773803 - DNA, 20 bp, Homo sapiens
ctgtcagggccttggcccag

SEQ ID NO: 4773804 - DNA, 22 bp, Homo sapiens
ctgtcagggccttggcccaggg

SEQ ID NO: 4773805 - DNA, 15 bp, Homo sapiens
ctgtccagagtctct

SEQ ID NO: 4773806 - DNA, 18 bp, Homo sapiens
ctgtccatccgtctctgt

SEQ ID NO: 4773807 - DNA, 20 bp, Homo sapiens
ctgtccatccgtctctgtcc

SEQ ID NO: 4773808 - DNA, 21 bp, Homo sapiens
ctgtcccaccgggagcctccc

SEQ ID NO: 4773809 - DNA, 17 bp, Homo sapiens
ctgtccccgcactgggc

SEQ ID NO: 4773810 - DNA, 18 bp, Homo sapiens
ctgtccccgcactgggct

SEQ ID NO: 4773811 - DNA, 24 bp, Homo sapiens
ctgtccctagggctctccaagcac

SEQ ID NO: 4773812 - DNA, 14 bp, Homo sapiens
ctgtccctgtgggc

SEQ ID NO: 4773813 - DNA, 20 bp, Homo sapiens
ctgtcccttacgtgagtcct

SEQ ID NO: 4773814 - DNA, 22 bp, Homo sapiens
ctgtccgtagtatcagagatgt

SEQ ID NO: 4773815 - DNA, 14 bp, Homo sapiens
ctgtccgtcctgct

SEQ ID NO: 4773816 - DNA, 16 bp, Homo sapiens
ctgtccgtcctgctcg

SEQ ID NO: 4773817 - DNA, 18 bp, Homo sapiens
ctgtccgtctgtcctgcg

SEQ ID NO: 4773818 - DNA, 21 bp, Homo sapiens
ctgtccgtctgtcctgcgcct

SEQ ID NO: 4773819 - DNA, 19 bp, Homo sapiens
ctgtcctcaggtgaataac

SEQ ID NO: 4773820 - DNA, 19 bp, Homo sapiens
ctgtcctctcgagcccaga

SEQ ID NO: 4773821 - DNA, 17 bp, Homo sapiens
ctgtcctgagccccctg

SEQ ID NO: 4773822 - DNA, 13 bp, Homo sapiens
ctgtcctgctcac

SEQ ID NO: 4773823 - DNA, 22 bp, Homo sapiens
ctgtcctgctcacgtctgtgag

SEQ ID NO: 4773824 - DNA, 16 bp, Homo sapiens
ctgtcctgttgattaa

SEQ ID NO: 4773825 - DNA, 13 bp, Homo sapiens
ctgtcctttccca

SEQ ID NO: 4773826 - DNA, 15 bp, Homo sapiens
ctgtcgccccaggcc

SEQ ID NO: 4773827 - DNA, 17 bp, Homo sapiens
ctgtcgccccaggccct

SEQ ID NO: 4773828 - DNA, 18 bp, Homo sapiens
ctgtcgccccaggccctc

SEQ ID NO: 4773829 - DNA, 21 bp, Homo sapiens
ctgtctcttgggaagcagttt

SEQ ID NO: 4773830 - DNA, 23 bp, Homo sapiens
ctgtctcttgggaagcagtttca

SEQ ID NO: 4773831 - DNA, 13 bp, Homo sapiens
ctgtctgaaaaag

SEQ ID NO: 4773832 - DNA, 19 bp, Homo sapiens
ctgtctgaaaaagtgtttt

SEQ ID NO: 4773833 - DNA, 16 bp, Homo sapiens
ctgtctgagccctgcc

SEQ ID NO: 4773834 - DNA, 21 bp, Homo sapiens
ctgtctgagccctgccctcac

SEQ ID NO: 4773835 - DNA, 13 bp, Homo sapiens
ctgtctgtcacca

SEQ ID NO: 4773836 - DNA, 16 bp, Homo sapiens
ctgtctgtcaccagct

SEQ ID NO: 4773837 - DNA, 19 bp, Homo sapiens
ctgtctgtcccagttaact

SEQ ID NO: 4773838 - DNA, 12 bp, Homo sapiens
ctgtctgtggct

SEQ ID NO: 4773839 - DNA, 15 bp, Homo sapiens
ctgtcttcaaccctg

SEQ ID NO: 4773840 - DNA, 19 bp, Homo sapiens
ctgtcttcaaccctgccct

SEQ ID NO: 4773841 - DNA, 21 bp, Homo sapiens
ctgtcttcaaccctgccctgc

SEQ ID NO: 4773842 - DNA, 23 bp, Homo sapiens
ctgtcttcaaccctgccctgcac

SEQ ID NO: 4773843 - DNA, 15 bp, Homo sapiens
ctgtctttatgattt

SEQ ID NO: 4773844 - DNA, 17 bp, Homo sapiens
ctgtctttatgatttca

SEQ ID NO: 4773845 - DNA, 16 bp, Homo sapiens
ctgtctttgctgttta

SEQ ID NO: 4773846 - DNA, 18 bp, Homo sapiens
ctgtgaaagtctcctgta

SEQ ID NO: 4773847 - DNA, 15 bp, Homo sapiens
ctgtgaaatatcatc

SEQ ID NO: 4773848 - DNA, 16 bp, Homo sapiens
ctgtgaactaatgaca

SEQ ID NO: 4773849 - DNA, 17 bp, Homo sapiens
ctgtgaagcctttatct

SEQ ID NO: 4773850 - DNA, 19 bp, Homo sapiens
ctgtgaatatgtgtaactt

SEQ ID NO: 4773851 - DNA, 16 bp, Homo sapiens
ctgtgacattccacag

SEQ ID NO: 4773852 - DNA, 17 bp, Homo sapiens
ctgtgactcgcttagct

SEQ ID NO: 4773853 - DNA, 16 bp, Homo sapiens
ctgtgagaactgtgaa

SEQ ID NO: 4773854 - DNA, 22 bp, Homo sapiens
ctgtgagaactgtgaatatgtg

SEQ ID NO: 4773855 - DNA, 21 bp, Homo sapiens
ctgtgagataaatatcattat

SEQ ID NO: 4773856 - DNA, 22 bp, Homo sapiens
ctgtgagataaatatcattata

SEQ ID NO: 4773857 - DNA, 22 bp, Homo sapiens
ctgtgagctccccaatccaacc

SEQ ID NO: 4773858 - DNA, 23 bp, Homo sapiens
ctgtgaggacagggcccccacag

SEQ ID NO: 4773859 - DNA, 12 bp, Homo sapiens
ctgtgataacag

SEQ ID NO: 4773860 - DNA, 17 bp, Homo sapiens
ctgtgataacagagtga

SEQ ID NO: 4773861 - DNA, 19 bp, Homo sapiens
ctgtgatcgtgtgttgcca

SEQ ID NO: 4773862 - DNA, 13 bp, Homo sapiens
ctgtgatgcatga

SEQ ID NO: 4773863 - DNA, 23 bp, Homo sapiens
ctgtgatgtcagtagtgcctgtg

SEQ ID NO: 4773864 - DNA, 14 bp, Homo sapiens
ctgtgcactctact

SEQ ID NO: 4773865 - DNA, 16 bp, Homo sapiens
ctgtgcagtttggtat

SEQ ID NO: 4773866 - DNA, 17 bp, Homo sapiens
ctgtgcattgtggctgt

SEQ ID NO: 4773867 - DNA, 19 bp, Homo sapiens
ctgtgcattgtggctgtca

SEQ ID NO: 4773868 - DNA, 20 bp, Homo sapiens
ctgtgccccgcctcccgggg

SEQ ID NO: 4773869 - DNA, 11 bp, Homo sapiens
ctgtgccctct

SEQ ID NO: 4773870 - DNA, 18 bp, Homo sapiens
ctgtgccctctcactgac

SEQ ID NO: 4773871 - DNA, 16 bp, Homo sapiens
ctgtgcctcagtgaga

SEQ ID NO: 4773872 - DNA, 17 bp, Homo sapiens
ctgtgcctgtgtttcat

SEQ ID NO: 4773873 - DNA, 20 bp, Homo sapiens
ctgtgcctgtgtttcatgtt

SEQ ID NO: 4773874 - DNA, 23 bp, Homo sapiens
ctgtgcctgtgtttcatgttctg

SEQ ID NO: 4773875 - DNA, 17 bp, Homo sapiens
ctgtgcgggcgcccgga

SEQ ID NO: 4773876 - DNA, 15 bp, Homo sapiens
ctgtgctaagttgtc

SEQ ID NO: 4773877 - DNA, 18 bp, Homo sapiens
ctgtgctaagttgtctta

SEQ ID NO: 4773878 - DNA, 22 bp, Homo sapiens
ctgtgctggtgggggcctcttt

SEQ ID NO: 4773879 - DNA, 14 bp, Homo sapiens
ctgtgctttctgca

SEQ ID NO: 4773880 - DNA, 18 bp, Homo sapiens
ctgtggagcgtccttgtc

SEQ ID NO: 4773881 - DNA, 14 bp, Homo sapiens
ctgtggcctggggc

SEQ ID NO: 4773882 - DNA, 12 bp, Homo sapiens
ctgtggctgatt

SEQ ID NO: 4773883 - DNA, 20 bp, Homo sapiens
ctgtggctgatttactaaca

SEQ ID NO: 4773884 - DNA, 21 bp, Homo sapiens
ctgtggctgatttactaacag

SEQ ID NO: 4773885 - DNA, 19 bp, Homo sapiens
ctgtgggactggcccaccc

SEQ ID NO: 4773886 - DNA, 13 bp, Homo sapiens
ctgtgggagtcca

SEQ ID NO: 4773887 - DNA, 14 bp, Homo sapiens
ctgtgggcagcacc

SEQ ID NO: 4773888 - DNA, 16 bp, Homo sapiens
ctgtgggggtggccat

SEQ ID NO: 4773889 - DNA, 17 bp, Homo sapiens
ctgtgggtccctgcgtc

SEQ ID NO: 4773890 - DNA, 22 bp, Homo sapiens
ctgtgggtccctgcgtctcctg

SEQ ID NO: 4773891 - DNA, 23 bp, Homo sapiens
ctgtggtgaggtcctgtcctggc

SEQ ID NO: 4773892 - DNA, 21 bp, Homo sapiens
ctgtgtatacatatgtatgtg

SEQ ID NO: 4773893 - DNA, 13 bp, Homo sapiens
ctgtgtcacgtga

SEQ ID NO: 4773894 - DNA, 15 bp, Homo sapiens
ctgtgtcacgtgacc

SEQ ID NO: 4773895 - DNA, 17 bp, Homo sapiens
ctgtgtcacgtgaccct

SEQ ID NO: 4773896 - DNA, 20 bp, Homo sapiens
ctgtgtcacgtgaccctgtg

SEQ ID NO: 4773897 - DNA, 21 bp, Homo sapiens
ctgtgtcacgtgaccctgtgc

SEQ ID NO: 4773898 - DNA, 15 bp, Homo sapiens
ctgtgtcatctgtca

SEQ ID NO: 4773899 - DNA, 22 bp, Homo sapiens
ctgtgtcccagtgtctggccca

SEQ ID NO: 4773900 - DNA, 22 bp, Homo sapiens
ctgtgtctcatggtcccacttc

SEQ ID NO: 4773901 - DNA, 21 bp, Homo sapiens
ctgtgtctggtccacacacca

SEQ ID NO: 4773902 - DNA, 17 bp, Homo sapiens
ctgtgtggcaaacattt

SEQ ID NO: 4773903 - DNA, 21 bp, Homo sapiens
ctgtgtggcaaacatttaaaa

SEQ ID NO: 4773904 - DNA, 13 bp, Homo sapiens
ctgtgtggggagg

SEQ ID NO: 4773905 - DNA, 12 bp, Homo sapiens
ctgtgtgtgaat

SEQ ID NO: 4773906 - DNA, 13 bp, Homo sapiens
ctgtgttactgat

SEQ ID NO: 4773907 - DNA, 18 bp, Homo sapiens
ctgttaagggaagctgat

SEQ ID NO: 4773908 - DNA, 19 bp, Homo sapiens
ctgttaagggaagctgata

SEQ ID NO: 4773909 - DNA, 14 bp, Homo sapiens
ctgttacagtaatg

SEQ ID NO: 4773910 - DNA, 15 bp, Homo sapiens
ctgttacagtaatgt

SEQ ID NO: 4773911 - DNA, 17 bp, Homo sapiens
ctgttagaattaggtaa

SEQ ID NO: 4773912 - DNA, 15 bp, Homo sapiens
ctgttatacacagtt

SEQ ID NO: 4773913 - DNA, 13 bp, Homo sapiens
cttcagtcctggg

SEQ ID NO: 4773914 - DNA, 13 bp, Homo sapiens
cttcagttctcat

SEQ ID NO: 4773915 - DNA, 16 bp, Homo sapiens
cttcagttctcatctt

SEQ ID NO: 4773916 - DNA, 16 bp, Homo sapiens
cttcataaattatttc

SEQ ID NO: 4773917 - DNA, 17 bp, Homo sapiens
cttcataggcagagccc

SEQ ID NO: 4773918 - DNA, 13 bp, Homo sapiens
cttcatccataga

SEQ ID NO: 4773919 - DNA, 20 bp, Homo sapiens
cttcatccatagacacagta

SEQ ID NO: 4773920 - DNA, 22 bp, Homo sapiens
cttcatccatagacacagtatt

SEQ ID NO: 4773921 - DNA, 13 bp, Homo sapiens
cttcatccctttc

SEQ ID NO: 4773922 - DNA, 17 bp, Homo sapiens
cttcatctggagtccct

SEQ ID NO: 4773923 - DNA, 23 bp, Homo sapiens
cttcatgcttgatttgaccactg

SEQ ID NO: 4773924 - DNA, 14 bp, Homo sapiens
cttcatggaactca

SEQ ID NO: 4773925 - DNA, 21 bp, Homo sapiens
cttcatggaactcagctgtct

SEQ ID NO: 4773926 - DNA, 12 bp, Homo sapiens
cttcatgtaaat

SEQ ID NO: 4773927 - DNA, 16 bp, Homo sapiens
cttcattaaaacaaga

SEQ ID NO: 4773928 - DNA, 19 bp, Homo sapiens
cttcattttttttaattga

SEQ ID NO: 4773929 - DNA, 17 bp, Homo sapiens
cttccaacatgtgatgt

SEQ ID NO: 4773930 - DNA, 18 bp, Homo sapiens
cttccaagttcattcata

SEQ ID NO: 4773931 - DNA, 21 bp, Homo sapiens
cttccacaagagcccaggcct

SEQ ID NO: 4773932 - DNA, 22 bp, Homo sapiens
cttccaccctgccctggcctac

SEQ ID NO: 4773933 - DNA, 17 bp, Homo sapiens
cttccactgcctctgcc

SEQ ID NO: 4773934 - DNA, 10 bp, Homo sapiens
cttccagatg

SEQ ID NO: 4773935 - DNA, 23 bp, Homo sapiens
cttccaggttccatccaccacct

SEQ ID NO: 4773936 - DNA, 13 bp, Homo sapiens
cttccagtcagga

SEQ ID NO: 4773937 - DNA, 19 bp, Homo sapiens
cttccatctcaacctacct

SEQ ID NO: 4773938 - DNA, 22 bp, Homo sapiens
cttccatggtggtttcagaaag

SEQ ID NO: 4773939 - DNA, 20 bp, Homo sapiens
cttccatttggaatcatatg

SEQ ID NO: 4773940 - DNA, 13 bp, Homo sapiens
cttcccaacaata

SEQ ID NO: 4773941 - DNA, 21 bp, Homo sapiens
cttcccaacaatactttgtgt

SEQ ID NO: 4773942 - DNA, 20 bp, Homo sapiens
cttcccaatcagcactgaaa

SEQ ID NO: 4773943 - DNA, 12 bp, Homo sapiens
cttcccacccct

SEQ ID NO: 4773944 - DNA, 15 bp, Homo sapiens
cttcccagctggcag

SEQ ID NO: 4773945 - DNA, 20 bp, Homo sapiens
cttcccagctggcagcgcct

SEQ ID NO: 4773946 - DNA, 22 bp, Homo sapiens
cttcccagctggcagcgcctcc

SEQ ID NO: 4773947 - DNA, 11 bp, Homo sapiens
cttcccaggcc

SEQ ID NO: 4773948 - DNA, 21 bp, Homo sapiens
cttcccatgtctttctccaaa

SEQ ID NO: 4773949 - DNA, 13 bp, Homo sapiens
cttcccatttgta

SEQ ID NO: 4773950 - DNA, 15 bp, Homo sapiens
cttcccatttgtaat

SEQ ID NO: 4773951 - DNA, 18 bp, Homo sapiens
cttccccaaggcactgag

SEQ ID NO: 4773952 - DNA, 20 bp, Homo sapiens
cttccccaaggcactgagcg

SEQ ID NO: 4773953 - DNA, 13 bp, Homo sapiens
cttccccactccc

SEQ ID NO: 4773954 - DNA, 15 bp, Homo sapiens
cttccccatctgtgt

SEQ ID NO: 4773955 - DNA, 13 bp, Homo sapiens
cttccccatgctc

SEQ ID NO: 4773956 - DNA, 20 bp, Homo sapiens
cttcccccagggtcccctgc

SEQ ID NO: 4773957 - DNA, 14 bp, Homo sapiens
cttcccccttcccc

SEQ ID NO: 4773958 - DNA, 15 bp, Homo sapiens
cttcccccttcccct

SEQ ID NO: 4773959 - DNA, 21 bp, Homo sapiens
cttcccctgaggacctttctg

SEQ ID NO: 4773960 - DNA, 17 bp, Homo sapiens
cttcccctgcgccctcc

SEQ ID NO: 4773961 - DNA, 21 bp, Homo sapiens
cttcccctgcgccctccctcc

SEQ ID NO: 4773962 - DNA, 13 bp, Homo sapiens
cttccccttctgt

SEQ ID NO: 4773963 - DNA, 14 bp, Homo sapiens
cttccccttctgtg

SEQ ID NO: 4773964 - DNA, 20 bp, Homo sapiens
cttcccgggaacgcttgctc

SEQ ID NO: 4773965 - DNA, 23 bp, Homo sapiens
cttcccgtctgattgttcctccc

SEQ ID NO: 4773966 - DNA, 15 bp, Homo sapiens
cttccctctcgctcc

SEQ ID NO: 4773967 - DNA, 23 bp, Homo sapiens
cttccctctcgctcccctctgcc

SEQ ID NO: 4773968 - DNA, 16 bp, Homo sapiens
cttccctgaacactca

SEQ ID NO: 4773969 - DNA, 14 bp, Homo sapiens
cttccctgcaaggt

SEQ ID NO: 4773970 - DNA, 20 bp, Homo sapiens
cttccctgcttcacgattct

SEQ ID NO: 4773971 - DNA, 15 bp, Homo sapiens
cttcccttccactgc

SEQ ID NO: 4773972 - DNA, 20 bp, Homo sapiens
cttcccttccactgcctctg

SEQ ID NO: 4773973 - DNA, 23 bp, Homo sapiens
cttcccttcttttcctgggtgct

SEQ ID NO: 4773974 - DNA, 18 bp, Homo sapiens
cttccgtgagacacaaga

SEQ ID NO: 4773975 - DNA, 17 bp, Homo sapiens
cttcctaccaaatataa

SEQ ID NO: 4773976 - DNA, 21 bp, Homo sapiens
cttcctataccggagctccag

SEQ ID NO: 4773977 - DNA, 22 bp, Homo sapiens
cttcctataccggagctccagt

SEQ ID NO: 4773978 - DNA, 20 bp, Homo sapiens
cttcctcatctccatgctct

SEQ ID NO: 4773979 - DNA, 16 bp, Homo sapiens
cttcctccaaagcctg

SEQ ID NO: 4773980 - DNA, 14 bp, Homo sapiens
cttcctcctctcaa

SEQ ID NO: 4773981 - DNA, 14 bp, Homo sapiens
cttcctctggggct

SEQ ID NO: 4773982 - DNA, 15 bp, Homo sapiens
cttcctctggggctc

SEQ ID NO: 4773983 - DNA, 13 bp, Homo sapiens
cttcctcttacct

SEQ ID NO: 4773984 - DNA, 22 bp, Homo sapiens
cttcctggacagtgagagcagg

SEQ ID NO: 4773985 - DNA, 16 bp, Homo sapiens
cttcctgggcagccca

SEQ ID NO: 4773986 - DNA, 10 bp, Homo sapiens
cttccttcct

SEQ ID NO: 4773987 - DNA, 11 bp, Homo sapiens
cttccttcctt

SEQ ID NO: 4773988 - DNA, 12 bp, Homo sapiens
cttccttccttt

SEQ ID NO: 4773989 - DNA, 17 bp, Homo sapiens
cttccttctcagccttg

SEQ ID NO: 4773990 - DNA, 20 bp, Homo sapiens
cttccttgaaatttctcagc

SEQ ID NO: 4773991 - DNA, 14 bp, Homo sapiens
cttccttgccacaa

SEQ ID NO: 4773992 - DNA, 19 bp, Homo sapiens
cttccttgccacaatcact

SEQ ID NO: 4773993 - DNA, 17 bp, Homo sapiens
cttcgctattcccaggc

SEQ ID NO: 4773994 - DNA, 12 bp, Homo sapiens
cttcggtggcct

SEQ ID NO: 4773995 - DNA, 13 bp, Homo sapiens
cttcggtggcctt

SEQ ID NO: 4773996 - DNA, 21 bp, Homo sapiens
cttcgtttgcctccagaacct

SEQ ID NO: 4773997 - DNA, 14 bp, Homo sapiens
cttctaaaataaat

SEQ ID NO: 4773998 - DNA, 21 bp, Homo sapiens
cttctaaaataaatgttttgg

SEQ ID NO: 4773999 - DNA, 23 bp, Homo sapiens
cttctaaaggtttcactgttcat

SEQ ID NO: 4774000 - DNA, 21 bp, Homo sapiens
cttctaatccatgtgctgctg

SEQ ID NO: 4774001 - DNA, 13 bp, Homo sapiens
cttctactgagca

SEQ ID NO: 4774002 - DNA, 17 bp, Homo sapiens
cttctatgtccaacaga

SEQ ID NO: 4774003 - DNA, 12 bp, Homo sapiens
cttctcacactg

SEQ ID NO: 4774004 - DNA, 20 bp, Homo sapiens
cttctcagccttggttcctg

SEQ ID NO: 4774005 - DNA, 15 bp, Homo sapiens
cttctcattcttcta

SEQ ID NO: 4774006 - DNA, 15 bp, Homo sapiens
cttctcattttttcc

SEQ ID NO: 4774007 - DNA, 11 bp, Homo sapiens
cttctccactt

SEQ ID NO: 4774008 - DNA, 15 bp, Homo sapiens
cttctccccctcagc

SEQ ID NO: 4774009 - DNA, 22 bp, Homo sapiens
cttctcccctcagccaatgaat

SEQ ID NO: 4774010 - DNA, 16 bp, Homo sapiens
cttctccctggggagg

SEQ ID NO: 4774011 - DNA, 19 bp, Homo sapiens
cttctcctgcagtctgtgg

SEQ ID NO: 4774012 - DNA, 22 bp, Homo sapiens
cttctcctttgtcaaatggtat

SEQ ID NO: 4774013 - DNA, 15 bp, Homo sapiens
cttctgaagatctca

SEQ ID NO: 4774014 - DNA, 19 bp, Homo sapiens
cttctgacggccctgcaat

SEQ ID NO: 4774015 - DNA, 13 bp, Homo sapiens
cttctgctgtaca

SEQ ID NO: 4774016 - DNA, 16 bp, Homo sapiens
cttctgctgtacagat

SEQ ID NO: 4774017 - DNA, 18 bp, Homo sapiens
cttctggccgctgcagtc

SEQ ID NO: 4774018 - DNA, 21 bp, Homo sapiens
cttctggcctttcctctctcc

SEQ ID NO: 4774019 - DNA, 22 bp, Homo sapiens
cttctggcctttcctctctcct

SEQ ID NO: 4774020 - DNA, 18 bp, Homo sapiens
cttctggctgctgcagtc

SEQ ID NO: 4774021 - DNA, 16 bp, Homo sapiens
cttctggggagggaca

SEQ ID NO: 4774022 - DNA, 18 bp, Homo sapiens
cttctggggagggacaca

SEQ ID NO: 4774023 - DNA, 21 bp, Homo sapiens
cttctggggagggacacagag

SEQ ID NO: 4774024 - DNA, 15 bp, Homo sapiens
cttctggggaggggc

SEQ ID NO: 4774025 - DNA, 12 bp, Homo sapiens
cttctgtgcatc

SEQ ID NO: 4774026 - DNA, 13 bp, Homo sapiens
cttctgtgtcaca

SEQ ID NO: 4774027 - DNA, 15 bp, Homo sapiens
cttctgttctcaaat

SEQ ID NO: 4774028 - DNA, 23 bp, Homo sapiens
cttcttaaggacagtgttcaaat

SEQ ID NO: 4774029 - DNA, 21 bp, Homo sapiens
cttcttacgaacgccacggcc

SEQ ID NO: 4774030 - DNA, 23 bp, Homo sapiens
cttcttcatccatagacacagta

SEQ ID NO: 4774031 - DNA, 23 bp, Homo sapiens
cttcttccccaaggcactgagcg

SEQ ID NO: 4774032 - DNA, 13 bp, Homo sapiens
cttcttcccccag

SEQ ID NO: 4774033 - DNA, 19 bp, Homo sapiens
cttcttgtgtttgaaacac

SEQ ID NO: 4774034 - DNA, 23 bp, Homo sapiens
cttcttgttcatgttttgctaat

SEQ ID NO: 4774035 - DNA, 19 bp, Homo sapiens
ctttgttcttcaatgtgaa

SEQ ID NO: 4774036 - DNA, 23 bp, Homo sapiens
ctttgttcttcaatgtgaaactg

SEQ ID NO: 4774037 - DNA, 21 bp, Homo sapiens
ctttgttgcttaatctagagc

SEQ ID NO: 4774038 - DNA, 22 bp, Homo sapiens
ctttgttgcttaatctagagct

SEQ ID NO: 4774039 - DNA, 20 bp, Homo sapiens
ctttgttttggctgctctcc

SEQ ID NO: 4774040 - DNA, 14 bp, Homo sapiens
cttttaaacctgtt

SEQ ID NO: 4774041 - DNA, 19 bp, Homo sapiens
cttttaagatgtgtcttca

SEQ ID NO: 4774042 - DNA, 11 bp, Homo sapiens
cttttataaat

SEQ ID NO: 4774043 - DNA, 17 bp, Homo sapiens
cttttataaatgtttta

SEQ ID NO: 4774044 - DNA, 14 bp, Homo sapiens
cttttataaattaa

SEQ ID NO: 4774045 - DNA, 16 bp, Homo sapiens
cttttataaattaaat

SEQ ID NO: 4774046 - DNA, 18 bp, Homo sapiens
cttttataaattaaatat

SEQ ID NO: 4774047 - DNA, 17 bp, Homo sapiens
cttttcaatgcaatgca

SEQ ID NO: 4774048 - DNA, 15 bp, Homo sapiens
cttttcacttcttaa

SEQ ID NO: 4774049 - DNA, 18 bp, Homo sapiens
cttttcccacctctttgg

SEQ ID NO: 4774050 - DNA, 14 bp, Homo sapiens
cttttcccttgtgt

SEQ ID NO: 4774051 - DNA, 15 bp, Homo sapiens
cttttcctcttagaa

SEQ ID NO: 4774052 - DNA, 18 bp, Homo sapiens
cttttcctgggtgctcag

SEQ ID NO: 4774053 - DNA, 23 bp, Homo sapiens
cttttcctgggtgctcagggcat

SEQ ID NO: 4774054 - DNA, 14 bp, Homo sapiens
cttttctcatctgt

SEQ ID NO: 4774055 - DNA, 13 bp, Homo sapiens
cttttctctttgg

SEQ ID NO: 4774056 - DNA, 21 bp, Homo sapiens
cttttctctttgggtttcttg

SEQ ID NO: 4774057 - DNA, 16 bp, Homo sapiens
cttttcttgtatctgg

SEQ ID NO: 4774058 - DNA, 13 bp, Homo sapiens
cttttctttttat

SEQ ID NO: 4774059 - DNA, 21 bp, Homo sapiens
cttttgagtgccttacacaat

SEQ ID NO: 4774060 - DNA, 17 bp, Homo sapiens
cttttgatggctatgtt

SEQ ID NO: 4774061 - DNA, 14 bp, Homo sapiens
cttttgctctctca

SEQ ID NO: 4774062 - DNA, 21 bp, Homo sapiens
cttttgtacgttaattaaaca

SEQ ID NO: 4774063 - DNA, 12 bp, Homo sapiens
cttttgttctct

SEQ ID NO: 4774064 - DNA, 14 bp, Homo sapiens
cttttgttctctct

SEQ ID NO: 4774065 - DNA, 16 bp, Homo sapiens
cttttgttctctcttg

SEQ ID NO: 4774066 - DNA, 17 bp, Homo sapiens
cttttgttctctcttgg

SEQ ID NO: 4774067 - DNA, 21 bp, Homo sapiens
ctttttaaaaagttgcacatt

SEQ ID NO: 4774068 - DNA, 19 bp, Homo sapiens
ctttttaaacaaatggctt

SEQ ID NO: 4774069 - DNA, 22 bp, Homo sapiens
ctttttacacttcacctccttc

SEQ ID NO: 4774070 - DNA, 20 bp, Homo sapiens
ctttttatcgccattccagg

SEQ ID NO: 4774071 - DNA, 17 bp, Homo sapiens
ctttttgactgattgtt

SEQ ID NO: 4774072 - DNA, 17 bp, Homo sapiens
cttttttattgaataac

SEQ ID NO: 4774073 - DNA, 12 bp, Homo sapiens
cttttttcaatg

SEQ ID NO: 4774074 - DNA, 16 bp, Homo sapiens
cttttttcctttcttc

SEQ ID NO: 4774075 - DNA, 14 bp, Homo sapiens
cttttttgcaataa

SEQ ID NO: 4774076 - DNA, 17 bp, Homo sapiens
cttttttttcttcacct

SEQ ID NO: 4774077 - DNA, 14 bp, Homo sapiens
gaaaaaaaaaatga

SEQ ID NO: 4774078 - DNA, 21 bp, Homo sapiens
gaaaaaaaaaatgattgtcta

SEQ ID NO: 4774079 - DNA, 14 bp, Homo sapiens
gaaaaaaactttta

SEQ ID NO: 4774080 - DNA, 23 bp, Homo sapiens
gaaaaaatattgtttaatgcaaa

SEQ ID NO: 4774081 - DNA, 22 bp, Homo sapiens
gaaaaagatattgtattatcat

SEQ ID NO: 4774082 - DNA, 18 bp, Homo sapiens
gaaaaatctgaatttcta

SEQ ID NO: 4774083 - DNA, 20 bp, Homo sapiens
gaaaaatctgaatttctaaa

SEQ ID NO: 4774084 - DNA, 18 bp, Homo sapiens
gaaaaatgaaatttaagc

SEQ ID NO: 4774085 - DNA, 14 bp, Homo sapiens
gaaaaatttcacga

SEQ ID NO: 4774086 - DNA, 18 bp, Homo sapiens
gaaaaatttgaaaatgat

SEQ ID NO: 4774087 - DNA, 21 bp, Homo sapiens
gaaaacataatatcttgaaga

SEQ ID NO: 4774088 - DNA, 23 bp, Homo sapiens
gaaaacatctcatcatgtctatt

SEQ ID NO: 4774089 - DNA, 18 bp, Homo sapiens
gaaaaccatctggcctgg

SEQ ID NO: 4774090 - DNA, 22 bp, Homo sapiens
gaaaacctcagttggcctctgc

SEQ ID NO: 4774091 - DNA, 17 bp, Homo sapiens
gaaaacctgaggccaaa

SEQ ID NO: 4774092 - DNA, 12 bp, Homo sapiens
gaaaactaagtt

SEQ ID NO: 4774093 - DNA, 19 bp, Homo sapiens
gaaaactgccacaagcaca

SEQ ID NO: 4774094 - DNA, 13 bp, Homo sapiens
gaaaacttctcat

SEQ ID NO: 4774095 - DNA, 14 bp, Homo sapiens
gaaaagaatttttt

SEQ ID NO: 4774096 - DNA, 12 bp, Homo sapiens
gaaaagccagat

SEQ ID NO: 4774097 - DNA, 15 bp, Homo sapiens
gaaaagcccacataa

SEQ ID NO: 4774098 - DNA, 23 bp, Homo sapiens
gaaaagcccacataagttttctc

SEQ ID NO: 4774099 - DNA, 20 bp, Homo sapiens
gaaaaggctgcagctaattt

SEQ ID NO: 4774100 - DNA, 18 bp, Homo sapiens
gaaaagttttcaagcatt

SEQ ID NO: 4774101 - DNA, 16 bp, Homo sapiens
gaaaataataaaagaa

SEQ ID NO: 4774102 - DNA, 17 bp, Homo sapiens
gaaaataataaaagaat

SEQ ID NO: 4774103 - DNA, 20 bp, Homo sapiens
gaaaataataaaagaatcat

SEQ ID NO: 4774104 - DNA, 15 bp, Homo sapiens
gaaaatgagaatctg

SEQ ID NO: 4774105 - DNA, 19 bp, Homo sapiens
gaaaatggatgacaaagaa

SEQ ID NO: 4774106 - DNA, 22 bp, Homo sapiens
gaaaatggatgacaaagaaaat

SEQ ID NO: 4774107 - DNA, 16 bp, Homo sapiens
gaaaatggctgaagaa

SEQ ID NO: 4774108 - DNA, 22 bp, Homo sapiens
gaaaatggctgaagaaacacag

SEQ ID NO: 4774109 - DNA, 19 bp, Homo sapiens
gaaaattttattgaatata

SEQ ID NO: 4774110 - DNA, 23 bp, Homo sapiens
gaaacaaaatataaatcacagat

SEQ ID NO: 4774111 - DNA, 16 bp, Homo sapiens
gaaacaaggaaggaca

SEQ ID NO: 4774112 - DNA, 18 bp, Homo sapiens
gaaacacacagtgaccaa

SEQ ID NO: 4774113 - DNA, 21 bp, Homo sapiens
gaaacacacagtgaccaaggg

SEQ ID NO: 4774114 - DNA, 20 bp, Homo sapiens
gaaacactcgtgtgcatgag

SEQ ID NO: 4774115 - DNA, 24 bp, Homo sapiens
gaaacactcgtgtgcatgagaatg

SEQ ID NO: 4774116 - DNA, 22 bp, Homo sapiens
gaaacagcttgatgctgtttct

SEQ ID NO: 4774117 - DNA, 20 bp, Homo sapiens
gaaacagtgtggatgtaaat

SEQ ID NO: 4774118 - DNA, 17 bp, Homo sapiens
gaaacccctgacacctt

SEQ ID NO: 4774119 - DNA, 17 bp, Homo sapiens
gaaactcatacagtctc

SEQ ID NO: 4774120 - DNA, 18 bp, Homo sapiens
gaaactttggaagtttta

SEQ ID NO: 4774121 - DNA, 20 bp, Homo sapiens
gaaactttggaagttttact

SEQ ID NO: 4774122 - DNA, 19 bp, Homo sapiens
gaaagagaaaatgctttct

SEQ ID NO: 4774123 - DNA, 20 bp, Homo sapiens
gaaagagctgttttggatga

SEQ ID NO: 4774124 - DNA, 22 bp, Homo sapiens
gaaagaggaataaaatgattaa

SEQ ID NO: 4774125 - DNA, 14 bp, Homo sapiens
gaaagatcccaagt

SEQ ID NO: 4774126 - DNA, 20 bp, Homo sapiens
gaaagattatattttataag

SEQ ID NO: 4774127 - DNA, 16 bp, Homo sapiens
gaaagcagatcatctc

SEQ ID NO: 4774128 - DNA, 18 bp, Homo sapiens
gaaagcatattgactttt

SEQ ID NO: 4774129 - DNA, 14 bp, Homo sapiens
gaaagccctccccc

SEQ ID NO: 4774130 - DNA, 13 bp, Homo sapiens
gaaaggaaacctt

SEQ ID NO: 4774131 - DNA, 16 bp, Homo sapiens
gaaaggaaagaggctc

SEQ ID NO: 4774132 - DNA, 21 bp, Homo sapiens
gaaaggaagatgtaagaagct

SEQ ID NO: 4774133 - DNA, 19 bp, Homo sapiens
gaaaggaggcatgcctctg

SEQ ID NO: 4774134 - DNA, 18 bp, Homo sapiens
gaaaggagttattaaagt

SEQ ID NO: 4774135 - DNA, 12 bp, Homo sapiens
gaaaggcagggc

SEQ ID NO: 4774136 - DNA, 13 bp, Homo sapiens
gaaaggcatctaa

SEQ ID NO: 4774137 - DNA, 15 bp, Homo sapiens
gaaagggcagcccct

SEQ ID NO: 4774138 - DNA, 18 bp, Homo sapiens
gaaagggcagcccctccc

SEQ ID NO: 4774139 - DNA, 20 bp, Homo sapiens
gaaagggcagcccctcccca

SEQ ID NO: 4774140 - DNA, 18 bp, Homo sapiens
gaaagggtgtggcttgga

SEQ ID NO: 4774141 - DNA, 14 bp, Homo sapiens
gaaagttggttttg

SEQ ID NO: 4774142 - DNA, 14 bp, Homo sapiens
gaaataaatctaaa

SEQ ID NO: 4774143 - DNA, 15 bp, Homo sapiens
gaaataataatattt

SEQ ID NO: 4774144 - DNA, 23 bp, Homo sapiens
gaaatacttgaaaacttctcatt

SEQ ID NO: 4774145 - DNA, 22 bp, Homo sapiens
gaaatataaactgtgagataaa

SEQ ID NO: 4774146 - DNA, 13 bp, Homo sapiens
gaaatatatgtga

SEQ ID NO: 4774147 - DNA, 22 bp, Homo sapiens
gaaatatcatcacgtatgttat

SEQ ID NO: 4774148 - DNA, 21 bp, Homo sapiens
gaaatatctgtgaaatatcat

SEQ ID NO: 4774149 - DNA, 21 bp, Homo sapiens
gaaatatttgcttatttatat

SEQ ID NO: 4774150 - DNA, 20 bp, Homo sapiens
gaaatcaaggtgaaggatct

SEQ ID NO: 4774151 - DNA, 15 bp, Homo sapiens
gaaatcaatttaaag

SEQ ID NO: 4774152 - DNA, 14 bp, Homo sapiens
gaaatccaaaatag

SEQ ID NO: 4774153 - DNA, 16 bp, Homo sapiens
gaaatcccctaactga

SEQ ID NO: 4774154 - DNA, 22 bp, Homo sapiens
gaaatcccctaactgatttcca

SEQ ID NO: 4774155 - DNA, 16 bp, Homo sapiens
gaaatgagatcccaga

SEQ ID NO: 4774156 - DNA, 15 bp, Homo sapiens
gacagagatcagaat

SEQ ID NO: 4774157 - DNA, 15 bp, Homo sapiens
gacagagatggcaga

SEQ ID NO: 4774158 - DNA, 20 bp, Homo sapiens
gacagagctacacaggggaa

SEQ ID NO: 4774159 - DNA, 21 bp, Homo sapiens
gacagatgggtgtcccctggt

SEQ ID NO: 4774160 - DNA, 16 bp, Homo sapiens
gacagcaaaaccattg

SEQ ID NO: 4774161 - DNA, 21 bp, Homo sapiens
gacagcaaaaccattgcttca

SEQ ID NO: 4774162 - DNA, 22 bp, Homo sapiens
gacagcaaaaccattgcttcac

SEQ ID NO: 4774163 - DNA, 13 bp, Homo sapiens
gacagcagctgga

SEQ ID NO: 4774164 - DNA, 21 bp, Homo sapiens
gacagcagctggactgggtgg

SEQ ID NO: 4774165 - DNA, 15 bp, Homo sapiens
gacagcctccacctt

SEQ ID NO: 4774166 - DNA, 14 bp, Homo sapiens
gacagcctgcacag

SEQ ID NO: 4774167 - DNA, 16 bp, Homo sapiens
gacagcgccatgtgtg

SEQ ID NO: 4774168 - DNA, 13 bp, Homo sapiens
gacagcggcccgg

SEQ ID NO: 4774169 - DNA, 21 bp, Homo sapiens
gacagcggcccggcccacgca

SEQ ID NO: 4774170 - DNA, 11 bp, Homo sapiens
gacagctctta

SEQ ID NO: 4774171 - DNA, 19 bp, Homo sapiens
gacagctgtcctgagctaa

SEQ ID NO: 4774172 - DNA, 23 bp, Homo sapiens
gacaggacttgtgcgccggcgcc

SEQ ID NO: 4774173 - DNA, 22 bp, Homo sapiens
gacaggagagattatttacaag

SEQ ID NO: 4774174 - DNA, 20 bp, Homo sapiens
gacaggattgtctgctgcct

SEQ ID NO: 4774175 - DNA, 23 bp, Homo sapiens
gacaggattgtctgctgcctcca

SEQ ID NO: 4774176 - DNA, 15 bp, Homo sapiens
gacaggcaccatgct

SEQ ID NO: 4774177 - DNA, 21 bp, Homo sapiens
gacaggccttcctcctctcaa

SEQ ID NO: 4774178 - DNA, 20 bp, Homo sapiens
gacaggcgccgcctcgcccc

SEQ ID NO: 4774179 - DNA, 23 bp, Homo sapiens
gacagggcccccacaggggatgg

SEQ ID NO: 4774180 - DNA, 14 bp, Homo sapiens
gacagtagcatact

SEQ ID NO: 4774181 - DNA, 13 bp, Homo sapiens
gacagtgcagtgc

SEQ ID NO: 4774182 - DNA, 13 bp, Homo sapiens
gacagttacttac

SEQ ID NO: 4774183 - DNA, 15 bp, Homo sapiens
gacagttcacaccct

SEQ ID NO: 4774184 - DNA, 17 bp, Homo sapiens
gacagttcacaccctgc

SEQ ID NO: 4774185 - DNA, 18 bp, Homo sapiens
gacagttcacaccctgca

SEQ ID NO: 4774186 - DNA, 19 bp, Homo sapiens
gacagttcacaccctgcaa

SEQ ID NO: 4774187 - DNA, 14 bp, Homo sapiens
gacagtttcttgca

SEQ ID NO: 4774188 - DNA, 16 bp, Homo sapiens
gacatcaactgcatca

SEQ ID NO: 4774189 - DNA, 23 bp, Homo sapiens
gacatcaactgcatcaagatgtg

SEQ ID NO: 4774190 - DNA, 19 bp, Homo sapiens
gacatgaacgttttctctt

SEQ ID NO: 4774191 - DNA, 20 bp, Homo sapiens
gacatgagagtagggccctg

SEQ ID NO: 4774192 - DNA, 12 bp, Homo sapiens
gacatgcactga

SEQ ID NO: 4774193 - DNA, 13 bp, Homo sapiens
gacatgcactgac

SEQ ID NO: 4774194 - DNA, 20 bp, Homo sapiens
gacatgcactgacccttcca

SEQ ID NO: 4774195 - DNA, 21 bp, Homo sapiens
gacatgtctttggcttcagaa

SEQ ID NO: 4774196 - DNA, 23 bp, Homo sapiens
gacattcaccaacaacagtcagc

SEQ ID NO: 4774197 - DNA, 21 bp, Homo sapiens
gacatttatgatgcagcagat

SEQ ID NO: 4774198 - DNA, 14 bp, Homo sapiens
gacattttgtagct

SEQ ID NO: 4774199 - DNA, 16 bp, Homo sapiens
gaccaaatgtaaaata

SEQ ID NO: 4774200 - DNA, 22 bp, Homo sapiens
gaccaagtctctctaagacaaa

SEQ ID NO: 4774201 - DNA, 15 bp, Homo sapiens
gaccaccacttgatg

SEQ ID NO: 4774202 - DNA, 16 bp, Homo sapiens
gaccacccctgtgcgc

SEQ ID NO: 4774203 - DNA, 15 bp, Homo sapiens
gaccaccctgccaag

SEQ ID NO: 4774204 - DNA, 17 bp, Homo sapiens
gaccaccctgccaaggc

SEQ ID NO: 4774205 - DNA, 22 bp, Homo sapiens
gaccaccgcgcccctctgcgcc

SEQ ID NO: 4774206 - DNA, 17 bp, Homo sapiens
gaccacgacctcgtcca

SEQ ID NO: 4774207 - DNA, 19 bp, Homo sapiens
gaccacggtccaatccagc

SEQ ID NO: 4774208 - DNA, 17 bp, Homo sapiens
gaccactgacagcctcc

SEQ ID NO: 4774209 - DNA, 15 bp, Homo sapiens
gaccactgggcctgc

SEQ ID NO: 4774210 - DNA, 13 bp, Homo sapiens
gaccagagctgcc

SEQ ID NO: 4774211 - DNA, 14 bp, Homo sapiens
gaccagagctgcca

SEQ ID NO: 4774212 - DNA, 18 bp, Homo sapiens
gaccagagctgccacctg

SEQ ID NO: 4774213 - DNA, 21 bp, Homo sapiens
gaccagcaccatctctcctcc

SEQ ID NO: 4774214 - DNA, 14 bp, Homo sapiens
gaccagcataccag

SEQ ID NO: 4774215 - DNA, 14 bp, Homo sapiens
gaccaggagccagg

SEQ ID NO: 4774216 - DNA, 17 bp, Homo sapiens
gaccaggctcacaactg

SEQ ID NO: 4774217 - DNA, 18 bp, Homo sapiens
gaccaggctcacaactgt

SEQ ID NO: 4774218 - DNA, 22 bp, Homo sapiens
gaccagggatgggggatgggcc

SEQ ID NO: 4774219 - DNA, 20 bp, Homo sapiens
gaccatttagtcctcacctt

SEQ ID NO: 4774220 - DNA, 13 bp, Homo sapiens
gaccccacacgcc

SEQ ID NO: 4774221 - DNA, 19 bp, Homo sapiens
gaccccacacgccggggct

SEQ ID NO: 4774222 - DNA, 20 bp, Homo sapiens
gaccccacacgccggggctg

SEQ ID NO: 4774223 - DNA, 22 bp, Homo sapiens
gaccccacacgccggggctggc

SEQ ID NO: 4774224 - DNA, 21 bp, Homo sapiens
gaccccaccctgtctgcaggc

SEQ ID NO: 4774225 - DNA, 22 bp, Homo sapiens
gaccccagatacctgtgaggac

SEQ ID NO: 4774226 - DNA, 15 bp, Homo sapiens
gacccccccagtccg

SEQ ID NO: 4774227 - DNA, 12 bp, Homo sapiens
gacccctaccct

SEQ ID NO: 4774228 - DNA, 16 bp, Homo sapiens
gacccctaccctttcc

SEQ ID NO: 4774229 - DNA, 13 bp, Homo sapiens
gacccctgccctc

SEQ ID NO: 4774230 - DNA, 16 bp, Homo sapiens
gacccctgggggaggc

SEQ ID NO: 4774231 - DNA, 15 bp, Homo sapiens
gaccctaggtgctca

SEQ ID NO: 4774232 - DNA, 12 bp, Homo sapiens
gaccctcacttt

SEQ ID NO: 4774233 - DNA, 22 bp, Homo sapiens
gaccctccaccgcagaaggaag

SEQ ID NO: 4774234 - DNA, 12 bp, Homo sapiens
gaccctgccagg

SEQ ID NO: 4774235 - DNA, 15 bp, Homo sapiens
gaccctgcgcccctg

SEQ ID NO: 4774236 - DNA, 16 bp, Homo sapiens
gaccctgcgcccctgc

SEQ ID NO: 4774237 - DNA, 19 bp, Homo sapiens
gaccctgcgcccctgccca

SEQ ID NO: 4774238 - DNA, 16 bp, Homo sapiens
gaccctgggtcacctt

SEQ ID NO: 4774239 - DNA, 21 bp, Homo sapiens
gaccctgggtcaccttcctgg

SEQ ID NO: 4774240 - DNA, 22 bp, Homo sapiens
gaccctgggtcaccttcctggg

SEQ ID NO: 4774241 - DNA, 17 bp, Homo sapiens
gaccctgtctttgctgt

SEQ ID NO: 4774242 - DNA, 15 bp, Homo sapiens
gaccctgtgccccgc

SEQ ID NO: 4774243 - DNA, 15 bp, Homo sapiens
gaccctgtgcctgtg

SEQ ID NO: 4774244 - DNA, 17 bp, Homo sapiens
gaccctgtgcctgtgtt

SEQ ID NO: 4774245 - DNA, 17 bp, Homo sapiens
gacccttccagacatac

SEQ ID NO: 4774246 - DNA, 22 bp, Homo sapiens
gacccttcccaatcagcactga

SEQ ID NO: 4774247 - DNA, 23 bp, Homo sapiens
gacccttcccaatcagcactgaa

SEQ ID NO: 4774248 - DNA, 15 bp, Homo sapiens
gaccgacgcccctcc

SEQ ID NO: 4774249 - DNA, 18 bp, Homo sapiens
gaccggagcggctgagga

SEQ ID NO: 4774250 - DNA, 19 bp, Homo sapiens
gaccggagcggctgaggac

SEQ ID NO: 4774251 - DNA, 16 bp, Homo sapiens
gaccggcccgccacct

SEQ ID NO: 4774252 - DNA, 14 bp, Homo sapiens
gaccgtgaggccag

SEQ ID NO: 4774253 - DNA, 17 bp, Homo sapiens
gaccgtgaggccagaga

SEQ ID NO: 4774254 - DNA, 19 bp, Homo sapiens
gaccgtgaggccagagaca

SEQ ID NO: 4774255 - DNA, 18 bp, Homo sapiens
gaccgtggtgtcctctgt

SEQ ID NO: 4774256 - DNA, 15 bp, Homo sapiens
gacctaccctggacc

SEQ ID NO: 4774257 - DNA, 20 bp, Homo sapiens
gacctaccctggaccgagtg

SEQ ID NO: 4774258 - DNA, 23 bp, Homo sapiens
gacctactcctccccctcctcca

SEQ ID NO: 4774259 - DNA, 18 bp, Homo sapiens
gacctcacagtgaccctt

SEQ ID NO: 4774260 - DNA, 21 bp, Homo sapiens
gacctcacagtgacccttccc

SEQ ID NO: 4774261 - DNA, 22 bp, Homo sapiens
gacctcacagtgacccttccca

SEQ ID NO: 4774262 - DNA, 14 bp, Homo sapiens
gacctcaggcctgg

SEQ ID NO: 4774263 - DNA, 22 bp, Homo sapiens
gacctccagattattttctata

SEQ ID NO: 4774264 - DNA, 20 bp, Homo sapiens
gacctccctgtctctacaaa

SEQ ID NO: 4774265 - DNA, 22 bp, Homo sapiens
gacctgacacctgccgctgctt

SEQ ID NO: 4774266 - DNA, 18 bp, Homo sapiens
gacctgcctctcacacac

SEQ ID NO: 4774267 - DNA, 20 bp, Homo sapiens
gacctgcctctcacacacat

SEQ ID NO: 4774268 - DNA, 18 bp, Homo sapiens
gaccttctgaagatctca

SEQ ID NO: 4774269 - DNA, 16 bp, Homo sapiens
gaccttggtggtggga

SEQ ID NO: 4774270 - DNA, 15 bp, Homo sapiens
gacctttatttatta

SEQ ID NO: 4774271 - DNA, 21 bp, Homo sapiens
gacctttatttattaaacttc

SEQ ID NO: 4774272 - DNA, 22 bp, Homo sapiens
gacctttatttattaaacttca

SEQ ID NO: 4774273 - DNA, 18 bp, Homo sapiens
gacgagcagagcgcagcc

SEQ ID NO: 4774274 - DNA, 22 bp, Homo sapiens
gacgcagccccccacgcttctg

SEQ ID NO: 4774275 - DNA, 16 bp, Homo sapiens
gacgcccagcccccac

SEQ ID NO: 4774276 - DNA, 20 bp, Homo sapiens
gacgcccagcccccaccccc

SEQ ID NO: 4774277 - DNA, 18 bp, Homo sapiens
gaggcagagaagaaagaa

SEQ ID NO: 4774278 - DNA, 13 bp, Homo sapiens
gaggcagcaacag

SEQ ID NO: 4774279 - DNA, 23 bp, Homo sapiens
gaggcagggcaaatgacatgcac

SEQ ID NO: 4774280 - DNA, 13 bp, Homo sapiens
gaggcagggccct

SEQ ID NO: 4774281 - DNA, 15 bp, Homo sapiens
gaggcattttactat

SEQ ID NO: 4774282 - DNA, 13 bp, Homo sapiens
gaggccagagaca

SEQ ID NO: 4774283 - DNA, 14 bp, Homo sapiens
gaggccagagacac

SEQ ID NO: 4774284 - DNA, 19 bp, Homo sapiens
gaggccagagacacaagcc

SEQ ID NO: 4774285 - DNA, 20 bp, Homo sapiens
gaggccagagacacaagcct

SEQ ID NO: 4774286 - DNA, 14 bp, Homo sapiens
gaggccagggccgc

SEQ ID NO: 4774287 - DNA, 18 bp, Homo sapiens
gaggcccgaggcaccgga

SEQ ID NO: 4774288 - DNA, 14 bp, Homo sapiens
gaggcctggctctg

SEQ ID NO: 4774289 - DNA, 15 bp, Homo sapiens
gaggcctggctctgg

SEQ ID NO: 4774290 - DNA, 13 bp, Homo sapiens
gaggcctggtctg

SEQ ID NO: 4774291 - DNA, 20 bp, Homo sapiens
gaggcgtgggatccagagag

SEQ ID NO: 4774292 - DNA, 17 bp, Homo sapiens
gaggctggaccaactgc

SEQ ID NO: 4774293 - DNA, 20 bp, Homo sapiens
gaggctggataggagaggaa

SEQ ID NO: 4774294 - DNA, 17 bp, Homo sapiens
gaggctgggcccctggg

SEQ ID NO: 4774295 - DNA, 19 bp, Homo sapiens
gaggctgggcccctgggat

SEQ ID NO: 4774296 - DNA, 14 bp, Homo sapiens
gaggcttccagctc

SEQ ID NO: 4774297 - DNA, 20 bp, Homo sapiens
gaggctttaagcgaggcaga

SEQ ID NO: 4774298 - DNA, 12 bp, Homo sapiens
gagggaaacctt

SEQ ID NO: 4774299 - DNA, 13 bp, Homo sapiens
gagggaaaccttt

SEQ ID NO: 4774300 - DNA, 22 bp, Homo sapiens
gagggaatccatatcagctctg

SEQ ID NO: 4774301 - DNA, 16 bp, Homo sapiens
gagggacgagcagagc

SEQ ID NO: 4774302 - DNA, 18 bp, Homo sapiens
gagggacgagcagagcgc

SEQ ID NO: 4774303 - DNA, 16 bp, Homo sapiens
gagggactccaagccc

SEQ ID NO: 4774304 - DNA, 18 bp, Homo sapiens
gagggactccaagccctg

SEQ ID NO: 4774305 - DNA, 15 bp, Homo sapiens
gagggactgcctctg

SEQ ID NO: 4774306 - DNA, 15 bp, Homo sapiens
gagggaggggccctg

SEQ ID NO: 4774307 - DNA, 16 bp, Homo sapiens
gagggcaaaccaggct

SEQ ID NO: 4774308 - DNA, 22 bp, Homo sapiens
gagggcacagaaaatggaagac

SEQ ID NO: 4774309 - DNA, 23 bp, Homo sapiens
gagggcaggggctgcatcctcag

SEQ ID NO: 4774310 - DNA, 15 bp, Homo sapiens
gagggcctctggaca

SEQ ID NO: 4774311 - DNA, 15 bp, Homo sapiens
gagggcgcttttgta

SEQ ID NO: 4774312 - DNA, 18 bp, Homo sapiens
gagggcggcggggcctgg

SEQ ID NO: 4774313 - DNA, 14 bp, Homo sapiens
gagggctgacaagg

SEQ ID NO: 4774314 - DNA, 14 bp, Homo sapiens
gagggctgagcccc

SEQ ID NO: 4774315 - DNA, 13 bp, Homo sapiens
gaggggacttgga

SEQ ID NO: 4774316 - DNA, 16 bp, Homo sapiens
gaggggcttggagcag

SEQ ID NO: 4774317 - DNA, 17 bp, Homo sapiens
gaggggtataggacaag

SEQ ID NO: 4774318 - DNA, 14 bp, Homo sapiens
gaggtcaggccctg

SEQ ID NO: 4774319 - DNA, 19 bp, Homo sapiens
gaggtggagcttgcagtga

SEQ ID NO: 4774320 - DNA, 22 bp, Homo sapiens
gaggtggggagggcctctggac

SEQ ID NO: 4774321 - DNA, 21 bp, Homo sapiens
gaggtggggtgctggggctgc

SEQ ID NO: 4774322 - DNA, 20 bp, Homo sapiens
gagtaaaacttgtattggaa

SEQ ID NO: 4774323 - DNA, 13 bp, Homo sapiens
gagtagggccctg

SEQ ID NO: 4774324 - DNA, 12 bp, Homo sapiens
gagtatatatgt

SEQ ID NO: 4774325 - DNA, 15 bp, Homo sapiens
gagtatatatgtaca

SEQ ID NO: 4774326 - DNA, 15 bp, Homo sapiens
gagtatgtgtatgta

SEQ ID NO: 4774327 - DNA, 14 bp, Homo sapiens
gagtcaccttccag

SEQ ID NO: 4774328 - DNA, 16 bp, Homo sapiens
gagtcagggcccagag

SEQ ID NO: 4774329 - DNA, 17 bp, Homo sapiens
gagtcagggcccagagg

SEQ ID NO: 4774330 - DNA, 16 bp, Homo sapiens
gagtccactttcctct

SEQ ID NO: 4774331 - DNA, 18 bp, Homo sapiens
gagtccactttcctctct

SEQ ID NO: 4774332 - DNA, 22 bp, Homo sapiens
gagtcctcattgttcagaaaag

SEQ ID NO: 4774333 - DNA, 14 bp, Homo sapiens
gagtcggctgggca

SEQ ID NO: 4774334 - DNA, 16 bp, Homo sapiens
gagtcggctgggcagg

SEQ ID NO: 4774335 - DNA, 17 bp, Homo sapiens
gagtcggctgggcaggg

SEQ ID NO: 4774336 - DNA, 18 bp, Homo sapiens
gagtcggctgggcagggc

SEQ ID NO: 4774337 - DNA, 19 bp, Homo sapiens
gagtcggctgggcagggcc

SEQ ID NO: 4774338 - DNA, 20 bp, Homo sapiens
gagtcggctgggcagggccg

SEQ ID NO: 4774339 - DNA, 18 bp, Homo sapiens
gagtctcctcactgccac

SEQ ID NO: 4774340 - DNA, 16 bp, Homo sapiens
gagtctgattgcagga

SEQ ID NO: 4774341 - DNA, 22 bp, Homo sapiens
gagtgagaaatttttttccaga

SEQ ID NO: 4774342 - DNA, 15 bp, Homo sapiens
gagtgatgggcaagg

SEQ ID NO: 4774343 - DNA, 22 bp, Homo sapiens
gagtgatttgtaaaacagtggt

SEQ ID NO: 4774344 - DNA, 18 bp, Homo sapiens
gagtgccacatggccgct

SEQ ID NO: 4774345 - DNA, 19 bp, Homo sapiens
gagtgccacatggccgctg

SEQ ID NO: 4774346 - DNA, 23 bp, Homo sapiens
gagtgcccttaaaataatgattt

SEQ ID NO: 4774347 - DNA, 14 bp, Homo sapiens
gagtgcgctagagc

SEQ ID NO: 4774348 - DNA, 18 bp, Homo sapiens
gagtggactcttccctct

SEQ ID NO: 4774349 - DNA, 18 bp, Homo sapiens
gagtggatctggagtctg

SEQ ID NO: 4774350 - DNA, 14 bp, Homo sapiens
gagtggctcccgtg

SEQ ID NO: 4774351 - DNA, 17 bp, Homo sapiens
gagtgggctctctggac

SEQ ID NO: 4774352 - DNA, 23 bp, Homo sapiens
gagtgggctctctggacctgacc

SEQ ID NO: 4774353 - DNA, 15 bp, Homo sapiens
gagtgggctctgagc

SEQ ID NO: 4774354 - DNA, 18 bp, Homo sapiens
gagtgtatgcatacaaat

SEQ ID NO: 4774355 - DNA, 16 bp, Homo sapiens
gagtgtatgtatacac

SEQ ID NO: 4774356 - DNA, 18 bp, Homo sapiens
gagtgtgaatataaatgt

SEQ ID NO: 4774357 - DNA, 14 bp, Homo sapiens
gagtgtgatgcagg

SEQ ID NO: 4774358 - DNA, 13 bp, Homo sapiens
gagtgtgcctctc

SEQ ID NO: 4774359 - DNA, 18 bp, Homo sapiens
gagttaaatcagtaatct

SEQ ID NO: 4774360 - DNA, 20 bp, Homo sapiens
gagttcctttccctccgaac

SEQ ID NO: 4774361 - DNA, 15 bp, Homo sapiens
gagttgaagacagag

SEQ ID NO: 4774362 - DNA, 17 bp, Homo sapiens
gagttgaagacagagct

SEQ ID NO: 4774363 - DNA, 13 bp, Homo sapiens
gagtttctatgga

SEQ ID NO: 4774364 - DNA, 22 bp, Homo sapiens
gagtttgctgtatacaaacagg

SEQ ID NO: 4774365 - DNA, 16 bp, Homo sapiens
gataaatcatgggcat

SEQ ID NO: 4774366 - DNA, 21 bp, Homo sapiens
gataaattttggaagaattca

SEQ ID NO: 4774367 - DNA, 22 bp, Homo sapiens
gataacagagtgatttgtaaaa

SEQ ID NO: 4774368 - DNA, 18 bp, Homo sapiens
gataagtgctcagtattg

SEQ ID NO: 4774369 - DNA, 16 bp, Homo sapiens
gataataaaattcatt

SEQ ID NO: 4774370 - DNA, 18 bp, Homo sapiens
gataatgagatgtaatac

SEQ ID NO: 4774371 - DNA, 23 bp, Homo sapiens
gatacactcaagcatgaagataa

SEQ ID NO: 4774372 - DNA, 14 bp, Homo sapiens
gatacccatcccat

SEQ ID NO: 4774373 - DNA, 21 bp, Homo sapiens
gatacccggtggcttctggca

SEQ ID NO: 4774374 - DNA, 14 bp, Homo sapiens
gatacctgtgagga

SEQ ID NO: 4774375 - DNA, 16 bp, Homo sapiens
gatacctgtgaggact

SEQ ID NO: 4774376 - DNA, 15 bp, Homo sapiens
gatacgtgtcaatgt

SEQ ID NO: 4774377 - DNA, 17 bp, Homo sapiens
gatactggggggcaggc

SEQ ID NO: 4774378 - DNA, 12 bp, Homo sapiens
gatagccaaggc

SEQ ID NO: 4774379 - DNA, 13 bp, Homo sapiens
gatagccaaggcc

SEQ ID NO: 4774380 - DNA, 14 bp, Homo sapiens
gatagccaaggcca

SEQ ID NO: 4774381 - DNA, 13 bp, Homo sapiens
gatagctccttca

SEQ ID NO: 4774382 - DNA, 14 bp, Homo sapiens
gatagctccttcat

SEQ ID NO: 4774383 - DNA, 16 bp, Homo sapiens
gataggagcttccaga

SEQ ID NO: 4774384 - DNA, 19 bp, Homo sapiens
gataggttctgctttctga

SEQ ID NO: 4774385 - DNA, 13 bp, Homo sapiens
gatataagccata

SEQ ID NO: 4774386 - DNA, 14 bp, Homo sapiens
gatatatctgaaaa

SEQ ID NO: 4774387 - DNA, 21 bp, Homo sapiens
gatatctttgagggctgacaa

SEQ ID NO: 4774388 - DNA, 23 bp, Homo sapiens
gatatgaaagagaaaatgctttc

SEQ ID NO: 4774389 - DNA, 22 bp, Homo sapiens
gatatgagaaatataaaaataa

SEQ ID NO: 4774390 - DNA, 16 bp, Homo sapiens
gatatgagtacatact

SEQ ID NO: 4774391 - DNA, 18 bp, Homo sapiens
gatatgcatgtagcatat

SEQ ID NO: 4774392 - DNA, 21 bp, Homo sapiens
gatatgcatgtagcatataaa

SEQ ID NO: 4774393 - DNA, 23 bp, Homo sapiens
gatatgcatgtagcatataaatg

SEQ ID NO: 4774394 - DNA, 24 bp, Homo sapiens
gatattgctgaagaatctacttaa

SEQ ID NO: 4774395 - DNA, 19 bp, Homo sapiens
gatattgtatctcctttaa

SEQ ID NO: 4774396 - DNA, 15 bp, Homo sapiens
gatattgtgtaggaa

SEQ ID NO: 4774397 - DNA, 20 bp, Homo sapiens
gatattttgtaaaatgtatt

SEQ ID NO: 4774398 - DNA, 14 bp, Homo sapiens
gatcaaaatgcata

SEQ ID NO: 4774399 - DNA, 19 bp, Homo sapiens
gcacattgaaatacttgaa

SEQ ID NO: 4774400 - DNA, 23 bp, Homo sapiens
gcaccaaagatgcagccgccttc

SEQ ID NO: 4774401 - DNA, 20 bp, Homo sapiens
gcaccagatgcaacctcact

SEQ ID NO: 4774402 - DNA, 21 bp, Homo sapiens
gcaccagcaggtgccatcacg

SEQ ID NO: 4774403 - DNA, 14 bp, Homo sapiens
gcaccagcctgagc

SEQ ID NO: 4774404 - DNA, 19 bp, Homo sapiens
gcaccagcctgagccacag

SEQ ID NO: 4774405 - DNA, 17 bp, Homo sapiens
gcaccatctctcctcct

SEQ ID NO: 4774406 - DNA, 16 bp, Homo sapiens
gcaccccaccacacac

SEQ ID NO: 4774407 - DNA, 13 bp, Homo sapiens
gcacccccagcct

SEQ ID NO: 4774408 - DNA, 19 bp, Homo sapiens
gcacccccagcctccccca

SEQ ID NO: 4774409 - DNA, 22 bp, Homo sapiens
gcacccccagcctcccccaggc

SEQ ID NO: 4774410 - DNA, 18 bp, Homo sapiens
gcaccccgttcccagcgc

SEQ ID NO: 4774411 - DNA, 18 bp, Homo sapiens
gcaccctctcctgggggt

SEQ ID NO: 4774412 - DNA, 15 bp, Homo sapiens
gcaccgaatattgag

SEQ ID NO: 4774413 - DNA, 14 bp, Homo sapiens
gcaccgccagagtg

SEQ ID NO: 4774414 - DNA, 21 bp, Homo sapiens
gcaccgcccaacccccacctc

SEQ ID NO: 4774415 - DNA, 16 bp, Homo sapiens
gcaccgcccacccaca

SEQ ID NO: 4774416 - DNA, 19 bp, Homo sapiens
gcaccgcccacccacaccc

SEQ ID NO: 4774417 - DNA, 18 bp, Homo sapiens
gcaccgggctggcctgac

SEQ ID NO: 4774418 - DNA, 18 bp, Homo sapiens
gcaccgtggtgtgaggcc

SEQ ID NO: 4774419 - DNA, 17 bp, Homo sapiens
gcacctcgccgtgtctt

SEQ ID NO: 4774420 - DNA, 12 bp, Homo sapiens
gcacctcttgaa

SEQ ID NO: 4774421 - DNA, 12 bp, Homo sapiens
gcacctgcttct

SEQ ID NO: 4774422 - DNA, 18 bp, Homo sapiens
gcaccttcccctgaggac

SEQ ID NO: 4774423 - DNA, 23 bp, Homo sapiens
gcaccttgggcacgggagagcgc

SEQ ID NO: 4774424 - DNA, 15 bp, Homo sapiens
gcacctttagaatat

SEQ ID NO: 4774425 - DNA, 15 bp, Homo sapiens
gcacgcctgccttct

SEQ ID NO: 4774426 - DNA, 18 bp, Homo sapiens
gcacgcggccgctctccg

SEQ ID NO: 4774427 - DNA, 20 bp, Homo sapiens
gcacgcggccgctctccgcc

SEQ ID NO: 4774428 - DNA, 22 bp, Homo sapiens
gcactaaaagtgatgtgattta

SEQ ID NO: 4774429 - DNA, 23 bp, Homo sapiens
gcactaaggccgtgtctctgagg

SEQ ID NO: 4774430 - DNA, 17 bp, Homo sapiens
gcactaatcaatacttt

SEQ ID NO: 4774431 - DNA, 13 bp, Homo sapiens
gcactaattagtg

SEQ ID NO: 4774432 - DNA, 12 bp, Homo sapiens
gcactagccttc

SEQ ID NO: 4774433 - DNA, 19 bp, Homo sapiens
gcactcaggagcacagcca

SEQ ID NO: 4774434 - DNA, 22 bp, Homo sapiens
gcactcaggagcacagccatag

SEQ ID NO: 4774435 - DNA, 15 bp, Homo sapiens
gcactcccagggccc

SEQ ID NO: 4774436 - DNA, 20 bp, Homo sapiens
gcactgacccttccagacat

SEQ ID NO: 4774437 - DNA, 11 bp, Homo sapiens
gcactggcctt

SEQ ID NO: 4774438 - DNA, 16 bp, Homo sapiens
gcactggccttctgat

SEQ ID NO: 4774439 - DNA, 21 bp, Homo sapiens
gcactggccttctgatgaaat

SEQ ID NO: 4774440 - DNA, 15 bp, Homo sapiens
gcactggccttgcct

SEQ ID NO: 4774441 - DNA, 14 bp, Homo sapiens
gcactgggcttggg

SEQ ID NO: 4774442 - DNA, 23 bp, Homo sapiens
gcactgggcttggggaccagagc

SEQ ID NO: 4774443 - DNA, 15 bp, Homo sapiens
gcactggtttgtttc

SEQ ID NO: 4774444 - DNA, 18 bp, Homo sapiens
gcactgtcatgcccagct

SEQ ID NO: 4774445 - DNA, 20 bp, Homo sapiens
gcactgtcatgcccagcttg

SEQ ID NO: 4774446 - DNA, 22 bp, Homo sapiens
gcactgtcatgcccagcttgga

SEQ ID NO: 4774447 - DNA, 17 bp, Homo sapiens
gcacttctgttatcagg

SEQ ID NO: 4774448 - DNA, 17 bp, Homo sapiens
gcactttataagccaat

SEQ ID NO: 4774449 - DNA, 20 bp, Homo sapiens
gcagaaatgtggatgctctt

SEQ ID NO: 4774450 - DNA, 20 bp, Homo sapiens
gcagaaccaagaacataaac

SEQ ID NO: 4774451 - DNA, 15 bp, Homo sapiens
gcagaaggaaggcag

SEQ ID NO: 4774452 - DNA, 22 bp, Homo sapiens
gcagaccacactctgcctggcc

SEQ ID NO: 4774453 - DNA, 15 bp, Homo sapiens
gcagaccctgccagg

SEQ ID NO: 4774454 - DNA, 17 bp, Homo sapiens
gcagaccctgccagggg

SEQ ID NO: 4774455 - DNA, 22 bp, Homo sapiens
gcagagacggcagccccatcct

SEQ ID NO: 4774456 - DNA, 21 bp, Homo sapiens
gcagagattgggggggcttgg

SEQ ID NO: 4774457 - DNA, 22 bp, Homo sapiens
gcagagattgggggggcttggg

SEQ ID NO: 4774458 - DNA, 11 bp, Homo sapiens
gcagagccccg

SEQ ID NO: 4774459 - DNA, 13 bp, Homo sapiens
gcagagccccgga

SEQ ID NO: 4774460 - DNA, 18 bp, Homo sapiens
gcagagccccggagcacc

SEQ ID NO: 4774461 - DNA, 14 bp, Homo sapiens
gcagagcgcagccc

SEQ ID NO: 4774462 - DNA, 18 bp, Homo sapiens
gcagagcgcagcccccac

SEQ ID NO: 4774463 - DNA, 13 bp, Homo sapiens
gcagagctgagtc

SEQ ID NO: 4774464 - DNA, 19 bp, Homo sapiens
gcagagctgatggagaagg

SEQ ID NO: 4774465 - DNA, 13 bp, Homo sapiens
gcagaggaaagca

SEQ ID NO: 4774466 - DNA, 14 bp, Homo sapiens
gcagaggaaagcaa

SEQ ID NO: 4774467 - DNA, 20 bp, Homo sapiens
gcagaggaaagcaaaggaga

SEQ ID NO: 4774468 - DNA, 17 bp, Homo sapiens
gcagaggcagggccctg

SEQ ID NO: 4774469 - DNA, 18 bp, Homo sapiens
gcagaggcagggccctgg

SEQ ID NO: 4774470 - DNA, 15 bp, Homo sapiens
gcagaggcccgaggc

SEQ ID NO: 4774471 - DNA, 14 bp, Homo sapiens
gcagagggcacaga

SEQ ID NO: 4774472 - DNA, 13 bp, Homo sapiens
gcagaggtggggt

SEQ ID NO: 4774473 - DNA, 14 bp, Homo sapiens
gcagaggtggggtg

SEQ ID NO: 4774474 - DNA, 19 bp, Homo sapiens
gcagagtatacaagtgttt

SEQ ID NO: 4774475 - DNA, 15 bp, Homo sapiens
gcagagttgaagaca

SEQ ID NO: 4774476 - DNA, 17 bp, Homo sapiens
gcagatctagccaggcc

SEQ ID NO: 4774477 - DNA, 14 bp, Homo sapiens
gcagatgggggcct

SEQ ID NO: 4774478 - DNA, 16 bp, Homo sapiens
gcagatgggggcctct

SEQ ID NO: 4774479 - DNA, 21 bp, Homo sapiens
gcagcaacaggaccaggagcc

SEQ ID NO: 4774480 - DNA, 13 bp, Homo sapiens
gcagcaccagcct

SEQ ID NO: 4774481 - DNA, 12 bp, Homo sapiens
gcagcaccctcc

SEQ ID NO: 4774482 - DNA, 15 bp, Homo sapiens
gcagcaccctccccc

SEQ ID NO: 4774483 - DNA, 17 bp, Homo sapiens
gcagcagcagcagcagt

SEQ ID NO: 4774484 - DNA, 22 bp, Homo sapiens
gcagcaggggaaagattatatt

SEQ ID NO: 4774485 - DNA, 20 bp, Homo sapiens
gcagcagtaccatcccactg

SEQ ID NO: 4774486 - DNA, 20 bp, Homo sapiens
gcagcccagaacgggcctcc

SEQ ID NO: 4774487 - DNA, 15 bp, Homo sapiens
gcagcccagagagac

SEQ ID NO: 4774488 - DNA, 21 bp, Homo sapiens
gcagccccatccttcccgcag

SEQ ID NO: 4774489 - DNA, 15 bp, Homo sapiens
gcagcccccacgccg

SEQ ID NO: 4774490 - DNA, 15 bp, Homo sapiens
gcagccccctgcttc

SEQ ID NO: 4774491 - DNA, 20 bp, Homo sapiens
gcagccccgcgaccacccct

SEQ ID NO: 4774492 - DNA, 11 bp, Homo sapiens
gcagcccctgc

SEQ ID NO: 4774493 - DNA, 18 bp, Homo sapiens
gcagcccgatgtccctgt

SEQ ID NO: 4774494 - DNA, 21 bp, Homo sapiens
gcagcccgatgtccctgtccc

SEQ ID NO: 4774495 - DNA, 23 bp, Homo sapiens
gcagcccgatgtccctgtcccct

SEQ ID NO: 4774496 - DNA, 13 bp, Homo sapiens
gcagccctgcaga

SEQ ID NO: 4774497 - DNA, 14 bp, Homo sapiens
gcagccctgcagag

SEQ ID NO: 4774498 - DNA, 17 bp, Homo sapiens
gcagccctgcagagggc

SEQ ID NO: 4774499 - DNA, 15 bp, Homo sapiens
gcagccgcgctctgc

SEQ ID NO: 4774500 - DNA, 16 bp, Homo sapiens
gcagccgcgctctgcc

SEQ ID NO: 4774501 - DNA, 18 bp, Homo sapiens
gcagccgcgctctgcccc

SEQ ID NO: 4774502 - DNA, 22 bp, Homo sapiens
gcagcctctgaagttggacagc

SEQ ID NO: 4774503 - DNA, 16 bp, Homo sapiens
gcagcctgagctccac

SEQ ID NO: 4774504 - DNA, 19 bp, Homo sapiens
gcagcctgagctccaccct

SEQ ID NO: 4774505 - DNA, 23 bp, Homo sapiens
gcagcctgcagaccacactctgc

SEQ ID NO: 4774506 - DNA, 23 bp, Homo sapiens
gcagcctgcttcccacctccctg

SEQ ID NO: 4774507 - DNA, 14 bp, Homo sapiens
gcagcgcccgaggc

SEQ ID NO: 4774508 - DNA, 20 bp, Homo sapiens
gcagcgcccgaggccagggc

SEQ ID NO: 4774509 - DNA, 21 bp, Homo sapiens
gcagcgcccgaggccagggcc

SEQ ID NO: 4774510 - DNA, 15 bp, Homo sapiens
gcagcgcctcccgcc

SEQ ID NO: 4774511 - DNA, 17 bp, Homo sapiens
gcagcgcctcccgccgc

SEQ ID NO: 4774512 - DNA, 19 bp, Homo sapiens
gcagctatgcgcaatgtgg

SEQ ID NO: 4774513 - DNA, 21 bp, Homo sapiens
gcagctatgcgcaatgtggca

SEQ ID NO: 4774514 - DNA, 22 bp, Homo sapiens
gcagctatgcgcaatgtggcat

SEQ ID NO: 4774515 - DNA, 13 bp, Homo sapiens
gcagctccaacct

SEQ ID NO: 4774516 - DNA, 19 bp, Homo sapiens
gcagctccaacctggaggc

SEQ ID NO: 4774517 - DNA, 23 bp, Homo sapiens
gcagctccaacctggaggctgga

SEQ ID NO: 4774518 - DNA, 23 bp, Homo sapiens
gcagctcctcgggtggggcctgc

SEQ ID NO: 4774519 - DNA, 21 bp, Homo sapiens
gcagctggatggggcggcctg

SEQ ID NO: 4774520 - DNA, 21 bp, Homo sapiens
gcagctggcgcgtgtgtggcc

SEQ ID NO: 4774521 - DNA, 18 bp, Homo sapiens
gccattgcttctccctca

SEQ ID NO: 4774522 - DNA, 13 bp, Homo sapiens
gccattggcctta

SEQ ID NO: 4774523 - DNA, 21 bp, Homo sapiens
gccattggccttaactggccc

SEQ ID NO: 4774524 - DNA, 15 bp, Homo sapiens
gccatttcacattcc

SEQ ID NO: 4774525 - DNA, 16 bp, Homo sapiens
gccatttgtgtttata

SEQ ID NO: 4774526 - DNA, 18 bp, Homo sapiens
gccattttgtctggctgt

SEQ ID NO: 4774527 - DNA, 13 bp, Homo sapiens
gcccaacccccac

SEQ ID NO: 4774528 - DNA, 14 bp, Homo sapiens
gcccaacccccacc

SEQ ID NO: 4774529 - DNA, 18 bp, Homo sapiens
gcccaacccccacctccc

SEQ ID NO: 4774530 - DNA, 18 bp, Homo sapiens
gcccaaccgggaaaggca

SEQ ID NO: 4774531 - DNA, 22 bp, Homo sapiens
gcccaaggcccccacctctgtg

SEQ ID NO: 4774532 - DNA, 22 bp, Homo sapiens
gcccaatttcacagagtacaaa

SEQ ID NO: 4774533 - DNA, 19 bp, Homo sapiens
gcccacaataatgaataat

SEQ ID NO: 4774534 - DNA, 16 bp, Homo sapiens
gcccacaggaggcaag

SEQ ID NO: 4774535 - DNA, 17 bp, Homo sapiens
gcccacaggaggcaagc

SEQ ID NO: 4774536 - DNA, 22 bp, Homo sapiens
gcccacaggaggcaagcaagct

SEQ ID NO: 4774537 - DNA, 18 bp, Homo sapiens
gcccaccacaactaacaa

SEQ ID NO: 4774538 - DNA, 15 bp, Homo sapiens
gcccacccacacccc

SEQ ID NO: 4774539 - DNA, 17 bp, Homo sapiens
gcccacccacaccccgt

SEQ ID NO: 4774540 - DNA, 16 bp, Homo sapiens
gcccaccccgctgcct

SEQ ID NO: 4774541 - DNA, 19 bp, Homo sapiens
gcccaccccgctgcctggc

SEQ ID NO: 4774542 - DNA, 19 bp, Homo sapiens
gcccacccctcttccccct

SEQ ID NO: 4774543 - DNA, 12 bp, Homo sapiens
gcccacccgccc

SEQ ID NO: 4774544 - DNA, 19 bp, Homo sapiens
gcccacccgccccagagac

SEQ ID NO: 4774545 - DNA, 21 bp, Homo sapiens
gcccacccgccccagagactg

SEQ ID NO: 4774546 - DNA, 14 bp, Homo sapiens
gcccaccctgggcc

SEQ ID NO: 4774547 - DNA, 17 bp, Homo sapiens
gcccaccctgggcctcc

SEQ ID NO: 4774548 - DNA, 22 bp, Homo sapiens
gcccacctaaagggaagccctg

SEQ ID NO: 4774549 - DNA, 15 bp, Homo sapiens
gcccacctgccaggc

SEQ ID NO: 4774550 - DNA, 17 bp, Homo sapiens
gcccacctgccaggctg

SEQ ID NO: 4774551 - DNA, 14 bp, Homo sapiens
gcccacctgcccag

SEQ ID NO: 4774552 - DNA, 17 bp, Homo sapiens
gcccacctgggccctag

SEQ ID NO: 4774553 - DNA, 15 bp, Homo sapiens
gcccacgcagagccc

SEQ ID NO: 4774554 - DNA, 19 bp, Homo sapiens
gcccacgcagagccccgga

SEQ ID NO: 4774555 - DNA, 22 bp, Homo sapiens
gcccacgcagagccccggagca

SEQ ID NO: 4774556 - DNA, 15 bp, Homo sapiens
gcccacggctaagag

SEQ ID NO: 4774557 - DNA, 18 bp, Homo sapiens
gcccacggctaagaggct

SEQ ID NO: 4774558 - DNA, 20 bp, Homo sapiens
gcccacggctaagaggctgc

SEQ ID NO: 4774559 - DNA, 16 bp, Homo sapiens
gcccacgtcccgggca

SEQ ID NO: 4774560 - DNA, 16 bp, Homo sapiens
gcccacgtcctgggtg

SEQ ID NO: 4774561 - DNA, 19 bp, Homo sapiens
gcccagaacgggcctcccc

SEQ ID NO: 4774562 - DNA, 20 bp, Homo sapiens
gcccagaacgggcctccccg

SEQ ID NO: 4774563 - DNA, 22 bp, Homo sapiens
gcccagaacgggcctccccggg

SEQ ID NO: 4774564 - DNA, 13 bp, Homo sapiens
gcccagaggctga

SEQ ID NO: 4774565 - DNA, 21 bp, Homo sapiens
gcccagagtatgggcactcag

SEQ ID NO: 4774566 - DNA, 14 bp, Homo sapiens
gcccagcacctcct

SEQ ID NO: 4774567 - DNA, 15 bp, Homo sapiens
gcccagcacctcctc

SEQ ID NO: 4774568 - DNA, 16 bp, Homo sapiens
gcccagcagcggccca

SEQ ID NO: 4774569 - DNA, 15 bp, Homo sapiens
gcccagccatggctg

SEQ ID NO: 4774570 - DNA, 19 bp, Homo sapiens
gcccagcccccacccccgt

SEQ ID NO: 4774571 - DNA, 21 bp, Homo sapiens
gcccagcctggccccaaatgt

SEQ ID NO: 4774572 - DNA, 19 bp, Homo sapiens
gcccagcttggagtgccac

SEQ ID NO: 4774573 - DNA, 15 bp, Homo sapiens
gcccaggccggccag

SEQ ID NO: 4774574 - DNA, 20 bp, Homo sapiens
gcccaggccggccagcctca

SEQ ID NO: 4774575 - DNA, 22 bp, Homo sapiens
gcccagggggaagatgccaagg

SEQ ID NO: 4774576 - DNA, 14 bp, Homo sapiens
gcccaggggtcagc

SEQ ID NO: 4774577 - DNA, 13 bp, Homo sapiens
gcccagttagccc

SEQ ID NO: 4774578 - DNA, 15 bp, Homo sapiens
gcccagttagcccgg

SEQ ID NO: 4774579 - DNA, 21 bp, Homo sapiens
gcccagttagcccggccaagg

SEQ ID NO: 4774580 - DNA, 16 bp, Homo sapiens
gcccatggccccagct

SEQ ID NO: 4774581 - DNA, 19 bp, Homo sapiens
gcccatggccccagctggc

SEQ ID NO: 4774582 - DNA, 18 bp, Homo sapiens
gcccatgtgtcccctcac

SEQ ID NO: 4774583 - DNA, 18 bp, Homo sapiens
gccccacacaggcctggc

SEQ ID NO: 4774584 - DNA, 22 bp, Homo sapiens
gccccacacaggcctggcccag

SEQ ID NO: 4774585 - DNA, 14 bp, Homo sapiens
gccccacctgagcc

SEQ ID NO: 4774586 - DNA, 13 bp, Homo sapiens
gccccagagactg

SEQ ID NO: 4774587 - DNA, 16 bp, Homo sapiens
gccccagagactgccc

SEQ ID NO: 4774588 - DNA, 19 bp, Homo sapiens
gccccagagactgcccacc

SEQ ID NO: 4774589 - DNA, 15 bp, Homo sapiens
gccccagctggctgg

SEQ ID NO: 4774590 - DNA, 18 bp, Homo sapiens
gccccagctggctgggtc

SEQ ID NO: 4774591 - DNA, 22 bp, Homo sapiens
gccccagctggctgggtcgccc

SEQ ID NO: 4774592 - DNA, 12 bp, Homo sapiens
gccccaggcccc

SEQ ID NO: 4774593 - DNA, 15 bp, Homo sapiens
gccccaggccccagc

SEQ ID NO: 4774594 - DNA, 20 bp, Homo sapiens
gccccaggccccagcagtct

SEQ ID NO: 4774595 - DNA, 16 bp, Homo sapiens
gccccaggcccgccct

SEQ ID NO: 4774596 - DNA, 19 bp, Homo sapiens
gccccaggcccgccctgcc

SEQ ID NO: 4774597 - DNA, 13 bp, Homo sapiens
gccccaggccctc

SEQ ID NO: 4774598 - DNA, 16 bp, Homo sapiens
gccccaggccctccct

SEQ ID NO: 4774599 - DNA, 16 bp, Homo sapiens
gccccaggcggagggg

SEQ ID NO: 4774600 - DNA, 18 bp, Homo sapiens
gccccaggctcaggctgc

SEQ ID NO: 4774601 - DNA, 21 bp, Homo sapiens
gccccaggctcaggctgccca

SEQ ID NO: 4774602 - DNA, 23 bp, Homo sapiens
gccccaggctcaggctgcccagc

SEQ ID NO: 4774603 - DNA, 12 bp, Homo sapiens
gccccagggcag

SEQ ID NO: 4774604 - DNA, 18 bp, Homo sapiens
gccccagggccctgctca

SEQ ID NO: 4774605 - DNA, 17 bp, Homo sapiens
gccccatcagcatccca

SEQ ID NO: 4774606 - DNA, 18 bp, Homo sapiens
gccccatcccaaaccctt

SEQ ID NO: 4774607 - DNA, 13 bp, Homo sapiens
gccccatccttcc

SEQ ID NO: 4774608 - DNA, 22 bp, Homo sapiens
gccccatggtcacagacccctg

SEQ ID NO: 4774609 - DNA, 21 bp, Homo sapiens
gcccccacaggagcatgtcct

SEQ ID NO: 4774610 - DNA, 21 bp, Homo sapiens
gcccccacaggagcgtgtcct

SEQ ID NO: 4774611 - DNA, 12 bp, Homo sapiens
gcccccacccct

SEQ ID NO: 4774612 - DNA, 16 bp, Homo sapiens
gcccccaggacccccc

SEQ ID NO: 4774613 - DNA, 19 bp, Homo sapiens
gcccccatcacactcggcc

SEQ ID NO: 4774614 - DNA, 22 bp, Homo sapiens
gccccccctatctcttcctgtc

SEQ ID NO: 4774615 - DNA, 15 bp, Homo sapiens
gccccccttcccacc

SEQ ID NO: 4774616 - DNA, 14 bp, Homo sapiens
gcccccgccctcgc

SEQ ID NO: 4774617 - DNA, 22 bp, Homo sapiens
gcccccggaggcgcccacctgc

SEQ ID NO: 4774618 - DNA, 18 bp, Homo sapiens
gcccccggctcggcctct

SEQ ID NO: 4774619 - DNA, 16 bp, Homo sapiens
gcccccgggccctttc

SEQ ID NO: 4774620 - DNA, 15 bp, Homo sapiens
gccccctcccccgca

SEQ ID NO: 4774621 - DNA, 17 bp, Homo sapiens
gccccctcgcgcccctg

SEQ ID NO: 4774622 - DNA, 14 bp, Homo sapiens
gccccctctaggcc

SEQ ID NO: 4774623 - DNA, 18 bp, Homo sapiens
gccccctgcacccacccc

SEQ ID NO: 4774624 - DNA, 21 bp, Homo sapiens
gccccctgcacccacccctgc

SEQ ID NO: 4774625 - DNA, 14 bp, Homo sapiens
gccccctgcttctc

SEQ ID NO: 4774626 - DNA, 11 bp, Homo sapiens
gccccctgggg

SEQ ID NO: 4774627 - DNA, 21 bp, Homo sapiens
gccccctggggggcacagcca

SEQ ID NO: 4774628 - DNA, 13 bp, Homo sapiens
gccccgcccccac

SEQ ID NO: 4774629 - DNA, 20 bp, Homo sapiens
gccccgcccccacccctaca

SEQ ID NO: 4774630 - DNA, 17 bp, Homo sapiens
gccccgcgaccacccct

SEQ ID NO: 4774631 - DNA, 19 bp, Homo sapiens
gccccgcgaccacccctgt

SEQ ID NO: 4774632 - DNA, 18 bp, Homo sapiens
gccccgcggagcccccgc

SEQ ID NO: 4774633 - DNA, 14 bp, Homo sapiens
gccccgctgctccc

SEQ ID NO: 4774634 - DNA, 13 bp, Homo sapiens
gccccggagcacc

SEQ ID NO: 4774635 - DNA, 17 bp, Homo sapiens
gccccgtgctcctctgc

SEQ ID NO: 4774636 - DNA, 18 bp, Homo sapiens
gccccgtgctcctctgcc

SEQ ID NO: 4774637 - DNA, 15 bp, Homo sapiens
gcccctatcctgcac

SEQ ID NO: 4774638 - DNA, 17 bp, Homo sapiens
gcccctatcctgcaccc

SEQ ID NO: 4774639 - DNA, 20 bp, Homo sapiens
gcccctatcctgcaccctct

SEQ ID NO: 4774640 - DNA, 22 bp, Homo sapiens
gcccctatcctgcaccctctgc

SEQ ID NO: 4774641 - DNA, 23 bp, Homo sapiens
gcccctcaactctcctccagagt

SEQ ID NO: 4774642 - DNA, 13 bp, Homo sapiens
gcccctccccatg

SEQ ID NO: 4774643 - DNA, 13 bp, Homo sapiens
gcctgagggaagc

SEQ ID NO: 4774644 - DNA, 14 bp, Homo sapiens
gcctgagggaagcc

SEQ ID NO: 4774645 - DNA, 20 bp, Homo sapiens
gcctgagtcagggcccagag

SEQ ID NO: 4774646 - DNA, 22 bp, Homo sapiens
gcctgagtcagggcccagaggc

SEQ ID NO: 4774647 - DNA, 20 bp, Homo sapiens
gcctgagtgacagagcaaga

SEQ ID NO: 4774648 - DNA, 13 bp, Homo sapiens
gcctgatggccag

SEQ ID NO: 4774649 - DNA, 15 bp, Homo sapiens
gcctgcacacacctg

SEQ ID NO: 4774650 - DNA, 18 bp, Homo sapiens
gcctgcacacacctgcct

SEQ ID NO: 4774651 - DNA, 19 bp, Homo sapiens
gcctgcacacacctgcctg

SEQ ID NO: 4774652 - DNA, 22 bp, Homo sapiens
gcctgcacagtggtccagggtc

SEQ ID NO: 4774653 - DNA, 15 bp, Homo sapiens
gcctgcagaccctgc

SEQ ID NO: 4774654 - DNA, 18 bp, Homo sapiens
gcctgcagaccctgccag

SEQ ID NO: 4774655 - DNA, 20 bp, Homo sapiens
gcctgcagaccctgccaggg

SEQ ID NO: 4774656 - DNA, 14 bp, Homo sapiens
gcctgccccccttc

SEQ ID NO: 4774657 - DNA, 16 bp, Homo sapiens
gcctgccccccttccc

SEQ ID NO: 4774658 - DNA, 22 bp, Homo sapiens
gcctgccccccttcccacccct

SEQ ID NO: 4774659 - DNA, 21 bp, Homo sapiens
gcctgcccgcacagcagcctg

SEQ ID NO: 4774660 - DNA, 22 bp, Homo sapiens
gcctgcctcccctgcctcacca

SEQ ID NO: 4774661 - DNA, 15 bp, Homo sapiens
gcctgcctccggccc

SEQ ID NO: 4774662 - DNA, 22 bp, Homo sapiens
gcctgcctccggccctgcccca

SEQ ID NO: 4774663 - DNA, 11 bp, Homo sapiens
gcctgcctggt

SEQ ID NO: 4774664 - DNA, 13 bp, Homo sapiens
gcctgcgcctcct

SEQ ID NO: 4774665 - DNA, 17 bp, Homo sapiens
gcctgcgcctcctcctg

SEQ ID NO: 4774666 - DNA, 19 bp, Homo sapiens
gcctgcgcctcctcctgca

SEQ ID NO: 4774667 - DNA, 22 bp, Homo sapiens
gcctgctggctcccttacttta

SEQ ID NO: 4774668 - DNA, 23 bp, Homo sapiens
gcctgcttcccacctccctgccc

SEQ ID NO: 4774669 - DNA, 14 bp, Homo sapiens
gcctggacaaaccc

SEQ ID NO: 4774670 - DNA, 15 bp, Homo sapiens
gcctggcacaggact

SEQ ID NO: 4774671 - DNA, 16 bp, Homo sapiens
gcctggcacaggactg

SEQ ID NO: 4774672 - DNA, 17 bp, Homo sapiens
gcctggcacaggactga

SEQ ID NO: 4774673 - DNA, 18 bp, Homo sapiens
gcctggcccagccagcag

SEQ ID NO: 4774674 - DNA, 19 bp, Homo sapiens
gcctggcccagccagcagg

SEQ ID NO: 4774675 - DNA, 14 bp, Homo sapiens
gcctggcccataga

SEQ ID NO: 4774676 - DNA, 19 bp, Homo sapiens
gcctggcccatagaaacat

SEQ ID NO: 4774677 - DNA, 11 bp, Homo sapiens
gcctggcccca

SEQ ID NO: 4774678 - DNA, 16 bp, Homo sapiens
gcctggccccaaatgt

SEQ ID NO: 4774679 - DNA, 17 bp, Homo sapiens
gcctggccccaaatgtt

SEQ ID NO: 4774680 - DNA, 15 bp, Homo sapiens
gcctggccccctcgc

SEQ ID NO: 4774681 - DNA, 22 bp, Homo sapiens
gcctggccccctcgcgcccctg

SEQ ID NO: 4774682 - DNA, 23 bp, Homo sapiens
gcctggccccctcgcgcccctgt

SEQ ID NO: 4774683 - DNA, 12 bp, Homo sapiens
gcctggccctgc

SEQ ID NO: 4774684 - DNA, 17 bp, Homo sapiens
gcctggccctgccctga

SEQ ID NO: 4774685 - DNA, 23 bp, Homo sapiens
gcctggccttgagccgtgacctc

SEQ ID NO: 4774686 - DNA, 20 bp, Homo sapiens
gcctggcgggcagcccctgc

SEQ ID NO: 4774687 - DNA, 23 bp, Homo sapiens
gcctggcgggcagcccctgctgg

SEQ ID NO: 4774688 - DNA, 21 bp, Homo sapiens
gcctggcttcaccgcattcca

SEQ ID NO: 4774689 - DNA, 17 bp, Homo sapiens
gcctggcttctgggaca

SEQ ID NO: 4774690 - DNA, 19 bp, Homo sapiens
gcctgggagatgcagctgg

SEQ ID NO: 4774691 - DNA, 12 bp, Homo sapiens
gcctgggctagg

SEQ ID NO: 4774692 - DNA, 15 bp, Homo sapiens
gcctgggctgtgagg

SEQ ID NO: 4774693 - DNA, 16 bp, Homo sapiens
gcctgggctgtgagga

SEQ ID NO: 4774694 - DNA, 21 bp, Homo sapiens
gcctgggctgtgaggacaggg

SEQ ID NO: 4774695 - DNA, 14 bp, Homo sapiens
gcctggggcctggc

SEQ ID NO: 4774696 - DNA, 15 bp, Homo sapiens
gcctggggcctggca

SEQ ID NO: 4774697 - DNA, 21 bp, Homo sapiens
gcctgggggctgggcagagga

SEQ ID NO: 4774698 - DNA, 15 bp, Homo sapiens
gcctgggtccccctc

SEQ ID NO: 4774699 - DNA, 20 bp, Homo sapiens
gcctgggtccccctcctgca

SEQ ID NO: 4774700 - DNA, 17 bp, Homo sapiens
gcctgggtcctcccagc

SEQ ID NO: 4774701 - DNA, 18 bp, Homo sapiens
gcctgggtcctcccagct

SEQ ID NO: 4774702 - DNA, 15 bp, Homo sapiens
gcctgggtcctcggc

SEQ ID NO: 4774703 - DNA, 16 bp, Homo sapiens
gcctgggtcctcggcc

SEQ ID NO: 4774704 - DNA, 23 bp, Homo sapiens
gcctgggtggatcggcctcctct

SEQ ID NO: 4774705 - DNA, 15 bp, Homo sapiens
gcctggtaggtctgg

SEQ ID NO: 4774706 - DNA, 18 bp, Homo sapiens
gcctggtaggtctggatt

SEQ ID NO: 4774707 - DNA, 16 bp, Homo sapiens
gcctggtctgtgcatt

SEQ ID NO: 4774708 - DNA, 22 bp, Homo sapiens
gcctggtctgtgcattgtggct

SEQ ID NO: 4774709 - DNA, 17 bp, Homo sapiens
gcctgtccctagggctc

SEQ ID NO: 4774710 - DNA, 19 bp, Homo sapiens
gcctgtccctagggctctc

SEQ ID NO: 4774711 - DNA, 22 bp, Homo sapiens
gcctgtccctagggctctccaa

SEQ ID NO: 4774712 - DNA, 15 bp, Homo sapiens
gcctgtcgggcccgc

SEQ ID NO: 4774713 - DNA, 16 bp, Homo sapiens
gcctgtcgggcccgca

SEQ ID NO: 4774714 - DNA, 17 bp, Homo sapiens
gcctgtcgggcccgcac

SEQ ID NO: 4774715 - DNA, 14 bp, Homo sapiens
gcctgttgggccag

SEQ ID NO: 4774716 - DNA, 16 bp, Homo sapiens
gcctgttgggccagga

SEQ ID NO: 4774717 - DNA, 20 bp, Homo sapiens
gccttaactggccctcgggc

SEQ ID NO: 4774718 - DNA, 16 bp, Homo sapiens
gccttaagtcttactg

SEQ ID NO: 4774719 - DNA, 14 bp, Homo sapiens
gccttattaaaata

SEQ ID NO: 4774720 - DNA, 15 bp, Homo sapiens
gccttccaccctgcc

SEQ ID NO: 4774721 - DNA, 22 bp, Homo sapiens
gccttccaccctgccctggcct

SEQ ID NO: 4774722 - DNA, 23 bp, Homo sapiens
gccttcccttcttttcctgggtg

SEQ ID NO: 4774723 - DNA, 22 bp, Homo sapiens
gccttccctttacagctctcct

SEQ ID NO: 4774724 - DNA, 14 bp, Homo sapiens
gccttctcccctcc

SEQ ID NO: 4774725 - DNA, 17 bp, Homo sapiens
gccttctgacggccctg

SEQ ID NO: 4774726 - DNA, 20 bp, Homo sapiens
gccttctgacggccctgcaa

SEQ ID NO: 4774727 - DNA, 17 bp, Homo sapiens
gccttctgatgaaatgt

SEQ ID NO: 4774728 - DNA, 23 bp, Homo sapiens
gccttctggggagggacacagag

SEQ ID NO: 4774729 - DNA, 14 bp, Homo sapiens
gccttgccccacct

SEQ ID NO: 4774730 - DNA, 16 bp, Homo sapiens
gccttgccccacctcc

SEQ ID NO: 4774731 - DNA, 16 bp, Homo sapiens
gccttggttcctccag

SEQ ID NO: 4774732 - DNA, 18 bp, Homo sapiens
gccttggttcctccagca

SEQ ID NO: 4774733 - DNA, 17 bp, Homo sapiens
gcctttaggcaggaagt

SEQ ID NO: 4774734 - DNA, 17 bp, Homo sapiens
gcctttccagtgctgct

SEQ ID NO: 4774735 - DNA, 20 bp, Homo sapiens
gcgaagtccgaggcctggct

SEQ ID NO: 4774736 - DNA, 15 bp, Homo sapiens
gcgacacaggctgcc

SEQ ID NO: 4774737 - DNA, 17 bp, Homo sapiens
gcgacacaggctgccgc

SEQ ID NO: 4774738 - DNA, 15 bp, Homo sapiens
gcgaccacccctgtg

SEQ ID NO: 4774739 - DNA, 20 bp, Homo sapiens
gcgacctaaacagctgcttt

SEQ ID NO: 4774740 - DNA, 12 bp, Homo sapiens
gcgacgcggccc

SEQ ID NO: 4774741 - DNA, 15 bp, Homo sapiens
gcgagcctgcttgct

SEQ ID NO: 4774742 - DNA, 17 bp, Homo sapiens
gcgagtccagacaccat

SEQ ID NO: 4774743 - DNA, 21 bp, Homo sapiens
gcgagtccagacaccatcacc

SEQ ID NO: 4774744 - DNA, 22 bp, Homo sapiens
gcgagtccagacaccatcacca

SEQ ID NO: 4774745 - DNA, 14 bp, Homo sapiens
gcgattcctgccaa

SEQ ID NO: 4774746 - DNA, 22 bp, Homo sapiens
gcgcaagcgacacaggctgccg

SEQ ID NO: 4774747 - DNA, 17 bp, Homo sapiens
gcgcaccgcccaacccc

SEQ ID NO: 4774748 - DNA, 23 bp, Homo sapiens
gcgcaccgcccaacccccacctc

SEQ ID NO: 4774749 - DNA, 19 bp, Homo sapiens
gcgcagccgcgctctgccc

SEQ ID NO: 4774750 - DNA, 20 bp, Homo sapiens
gcgcagccgcgctctgcccc

SEQ ID NO: 4774751 - DNA, 18 bp, Homo sapiens
gcgcaggaaccgaggact

SEQ ID NO: 4774752 - DNA, 13 bp, Homo sapiens
gcgcatggcgccc

SEQ ID NO: 4774753 - DNA, 16 bp, Homo sapiens
gcgcatggcgccccgg

SEQ ID NO: 4774754 - DNA, 18 bp, Homo sapiens
gcgcatggcgccccgggc

SEQ ID NO: 4774755 - DNA, 14 bp, Homo sapiens
gcgccacccgcccg

SEQ ID NO: 4774756 - DNA, 13 bp, Homo sapiens
gcgcccacctgcc

SEQ ID NO: 4774757 - DNA, 14 bp, Homo sapiens
gcgcccacctgccc

SEQ ID NO: 4774758 - DNA, 16 bp, Homo sapiens
gcgcccacctgcccag

SEQ ID NO: 4774759 - DNA, 17 bp, Homo sapiens
gcgccccgcccccaccc

SEQ ID NO: 4774760 - DNA, 20 bp, Homo sapiens
gcgcccctctgcgccccagc

SEQ ID NO: 4774761 - DNA, 17 bp, Homo sapiens
gcgcccgaggccagggc

SEQ ID NO: 4774762 - DNA, 12 bp, Homo sapiens
gcgccctccctc

SEQ ID NO: 4774763 - DNA, 18 bp, Homo sapiens
gcgccctccctccctcca

SEQ ID NO: 4774764 - DNA, 16 bp, Homo sapiens
gcgccgcctcgccccc

SEQ ID NO: 4774765 - DNA, 16 bp, Homo sapiens
gctgcccctggcagcc

SEQ ID NO: 4774766 - DNA, 16 bp, Homo sapiens
gctgccgctgcaccac

SEQ ID NO: 4774767 - DNA, 22 bp, Homo sapiens
gctgcctaaatccactctgcag

SEQ ID NO: 4774768 - DNA, 20 bp, Homo sapiens
gctgcctccaagtcatggga

SEQ ID NO: 4774769 - DNA, 16 bp, Homo sapiens
gctgcctccgggcctc

SEQ ID NO: 4774770 - DNA, 22 bp, Homo sapiens
gctgcctgcccgcacagcagcc

SEQ ID NO: 4774771 - DNA, 23 bp, Homo sapiens
gctgcctgcctccggccctgccc

SEQ ID NO: 4774772 - DNA, 12 bp, Homo sapiens
gctgcctggagg

SEQ ID NO: 4774773 - DNA, 11 bp, Homo sapiens
gctgcctggcg

SEQ ID NO: 4774774 - DNA, 15 bp, Homo sapiens
gctgcctggcgggca

SEQ ID NO: 4774775 - DNA, 20 bp, Homo sapiens
gctgcctgtggtgaggtcct

SEQ ID NO: 4774776 - DNA, 19 bp, Homo sapiens
gctgccttctgacggccct

SEQ ID NO: 4774777 - DNA, 13 bp, Homo sapiens
gctgcgcctgccc

SEQ ID NO: 4774778 - DNA, 17 bp, Homo sapiens
gctgcgctcccacctcg

SEQ ID NO: 4774779 - DNA, 14 bp, Homo sapiens
gctgctaagtggaa

SEQ ID NO: 4774780 - DNA, 22 bp, Homo sapiens
gctgctcgggaaggcctgaggg

SEQ ID NO: 4774781 - DNA, 14 bp, Homo sapiens
gctgctctcccagg

SEQ ID NO: 4774782 - DNA, 18 bp, Homo sapiens
gctgctctctaagaattc

SEQ ID NO: 4774783 - DNA, 22 bp, Homo sapiens
gctgctgaaaaccatctggcct

SEQ ID NO: 4774784 - DNA, 16 bp, Homo sapiens
gctgctgcactgccct

SEQ ID NO: 4774785 - DNA, 22 bp, Homo sapiens
gctgctgcagtcagcacagaga

SEQ ID NO: 4774786 - DNA, 16 bp, Homo sapiens
gctgctgcttctccct

SEQ ID NO: 4774787 - DNA, 19 bp, Homo sapiens
gctgctgcttctccctggg

SEQ ID NO: 4774788 - DNA, 18 bp, Homo sapiens
gctgcttctccacctccc

SEQ ID NO: 4774789 - DNA, 15 bp, Homo sapiens
gctggaaaactgcca

SEQ ID NO: 4774790 - DNA, 18 bp, Homo sapiens
gctggaaaactgccacaa

SEQ ID NO: 4774791 - DNA, 14 bp, Homo sapiens
gctggaccaactgc

SEQ ID NO: 4774792 - DNA, 18 bp, Homo sapiens
gctggaccaactgctttg

SEQ ID NO: 4774793 - DNA, 14 bp, Homo sapiens
gctggactgggtgg

SEQ ID NO: 4774794 - DNA, 20 bp, Homo sapiens
gctggactgggtgggcccca

SEQ ID NO: 4774795 - DNA, 22 bp, Homo sapiens
gctggactgggtgggccccaca

SEQ ID NO: 4774796 - DNA, 21 bp, Homo sapiens
gctggagaccctgcgcccctg

SEQ ID NO: 4774797 - DNA, 23 bp, Homo sapiens
gctggagaccctgcgcccctgcc

SEQ ID NO: 4774798 - DNA, 14 bp, Homo sapiens
gctggaggaatcag

SEQ ID NO: 4774799 - DNA, 14 bp, Homo sapiens
gctggagtgcagtg

SEQ ID NO: 4774800 - DNA, 15 bp, Homo sapiens
gctggagtgcagtgg

SEQ ID NO: 4774801 - DNA, 14 bp, Homo sapiens
gctggataggagag

SEQ ID NO: 4774802 - DNA, 18 bp, Homo sapiens
gctggataggagaggaaa

SEQ ID NO: 4774803 - DNA, 22 bp, Homo sapiens
gctggatggggcggcctgcaga

SEQ ID NO: 4774804 - DNA, 17 bp, Homo sapiens
gctggatgtgcatctgg

SEQ ID NO: 4774805 - DNA, 16 bp, Homo sapiens
gctggatgtgctttca

SEQ ID NO: 4774806 - DNA, 14 bp, Homo sapiens
gctggcacccactg

SEQ ID NO: 4774807 - DNA, 13 bp, Homo sapiens
gctggcagcgcct

SEQ ID NO: 4774808 - DNA, 14 bp, Homo sapiens
gctggcagcgcctc

SEQ ID NO: 4774809 - DNA, 19 bp, Homo sapiens
gctggcagcgcctcccgcc

SEQ ID NO: 4774810 - DNA, 23 bp, Homo sapiens
gctggccagcaccctctcctggg

SEQ ID NO: 4774811 - DNA, 15 bp, Homo sapiens
gctggccctgccctc

SEQ ID NO: 4774812 - DNA, 16 bp, Homo sapiens
gctggccctgccctcc

SEQ ID NO: 4774813 - DNA, 19 bp, Homo sapiens
gctggccctgccctccccc

SEQ ID NO: 4774814 - DNA, 16 bp, Homo sapiens
gctgggagaaaagcca

SEQ ID NO: 4774815 - DNA, 17 bp, Homo sapiens
gctgggagaaaagccag

SEQ ID NO: 4774816 - DNA, 13 bp, Homo sapiens
gctgggcagagga

SEQ ID NO: 4774817 - DNA, 14 bp, Homo sapiens
gctgggcagaggaa

SEQ ID NO: 4774818 - DNA, 17 bp, Homo sapiens
gctgggcagaggaaagc

SEQ ID NO: 4774819 - DNA, 13 bp, Homo sapiens
gctgggcagggcc

SEQ ID NO: 4774820 - DNA, 14 bp, Homo sapiens
gctgggcagggccg

SEQ ID NO: 4774821 - DNA, 16 bp, Homo sapiens
gctgggcagggccgca

SEQ ID NO: 4774822 - DNA, 19 bp, Homo sapiens
gctgggcatggtaccagcc

SEQ ID NO: 4774823 - DNA, 23 bp, Homo sapiens
gctgggcatggtaccagccctgg

SEQ ID NO: 4774824 - DNA, 20 bp, Homo sapiens
gctgggccccccagctcagg

SEQ ID NO: 4774825 - DNA, 12 bp, Homo sapiens
gctgggcccctg

SEQ ID NO: 4774826 - DNA, 13 bp, Homo sapiens
gctgggcccctgg

SEQ ID NO: 4774827 - DNA, 18 bp, Homo sapiens
gctgggcccctgggatgg

SEQ ID NO: 4774828 - DNA, 23 bp, Homo sapiens
gctgggcccctgggatgggacca

SEQ ID NO: 4774829 - DNA, 20 bp, Homo sapiens
gctgggcgcctctgtcctgg

SEQ ID NO: 4774830 - DNA, 20 bp, Homo sapiens
gctggggacacaggatcctg

SEQ ID NO: 4774831 - DNA, 11 bp, Homo sapiens
gctggggctgc

SEQ ID NO: 4774832 - DNA, 15 bp, Homo sapiens
gctggggctgcatga

SEQ ID NO: 4774833 - DNA, 14 bp, Homo sapiens
gctgggtcccgggt

SEQ ID NO: 4774834 - DNA, 17 bp, Homo sapiens
gctgggtcgcccctcct

SEQ ID NO: 4774835 - DNA, 15 bp, Homo sapiens
gctgtatacaaacag

SEQ ID NO: 4774836 - DNA, 22 bp, Homo sapiens
gctgtattatcttaaacccaca

SEQ ID NO: 4774837 - DNA, 16 bp, Homo sapiens
gctgtatttttagaga

SEQ ID NO: 4774838 - DNA, 19 bp, Homo sapiens
gctgtatttttagagatta

SEQ ID NO: 4774839 - DNA, 22 bp, Homo sapiens
gctgtcaattacaggaagtact

SEQ ID NO: 4774840 - DNA, 23 bp, Homo sapiens
gctgtcccttacgtgagtcctgg

SEQ ID NO: 4774841 - DNA, 17 bp, Homo sapiens
gctgtcctctcgagccc

SEQ ID NO: 4774842 - DNA, 21 bp, Homo sapiens
gctgtcctgagccccctgcac

SEQ ID NO: 4774843 - DNA, 23 bp, Homo sapiens
gctgtcctgagccccctgcaccc

SEQ ID NO: 4774844 - DNA, 14 bp, Homo sapiens
gctgtcgccccagg

SEQ ID NO: 4774845 - DNA, 15 bp, Homo sapiens
gctgtcgccccaggc

SEQ ID NO: 4774846 - DNA, 17 bp, Homo sapiens
gctgtcgccccaggccc

SEQ ID NO: 4774847 - DNA, 20 bp, Homo sapiens
gctgtcgccccaggccctcc

SEQ ID NO: 4774848 - DNA, 21 bp, Homo sapiens
gctgtctgaaaaagtgttttt

SEQ ID NO: 4774849 - DNA, 12 bp, Homo sapiens
gctgtctgtcac

SEQ ID NO: 4774850 - DNA, 16 bp, Homo sapiens
gctgtctgtcaccagc

SEQ ID NO: 4774851 - DNA, 22 bp, Homo sapiens
gctgtcttactaataggtctgg

SEQ ID NO: 4774852 - DNA, 23 bp, Homo sapiens
gctgtcttactaataggtctgga

SEQ ID NO: 4774853 - DNA, 14 bp, Homo sapiens
gctgtgaaatgact

SEQ ID NO: 4774854 - DNA, 12 bp, Homo sapiens
gctgtgaggaca

SEQ ID NO: 4774855 - DNA, 15 bp, Homo sapiens
gctgtgatgcatgag

SEQ ID NO: 4774856 - DNA, 22 bp, Homo sapiens
gctgtgatttttgttgattaaa

SEQ ID NO: 4774857 - DNA, 15 bp, Homo sapiens
gctgtggcccctcct

SEQ ID NO: 4774858 - DNA, 21 bp, Homo sapiens
gctgtggcccctccttctccc

SEQ ID NO: 4774859 - DNA, 14 bp, Homo sapiens
gctgttagctcaga

SEQ ID NO: 4774860 - DNA, 12 bp, Homo sapiens
gctgttctcaat

SEQ ID NO: 4774861 - DNA, 14 bp, Homo sapiens
gctgttctgcactg

SEQ ID NO: 4774862 - DNA, 19 bp, Homo sapiens
gctgttttggatgaatgca

SEQ ID NO: 4774863 - DNA, 19 bp, Homo sapiens
gcttaaacatttccctgct

SEQ ID NO: 4774864 - DNA, 13 bp, Homo sapiens
gcttaagaagtat

SEQ ID NO: 4774865 - DNA, 21 bp, Homo sapiens
gcttaaggaaaagagaaacac

SEQ ID NO: 4774866 - DNA, 13 bp, Homo sapiens
gcttaatgtcttt

SEQ ID NO: 4774867 - DNA, 13 bp, Homo sapiens
gcttaattccaat

SEQ ID NO: 4774868 - DNA, 16 bp, Homo sapiens
gcttagaatggggctt

SEQ ID NO: 4774869 - DNA, 17 bp, Homo sapiens
gcttagcgttctgtttc

SEQ ID NO: 4774870 - DNA, 22 bp, Homo sapiens
gcttagtaatagatcacggcat

SEQ ID NO: 4774871 - DNA, 22 bp, Homo sapiens
gcttagtatctcatcaacaaag

SEQ ID NO: 4774872 - DNA, 16 bp, Homo sapiens
gcttcacacaaagtga

SEQ ID NO: 4774873 - DNA, 21 bp, Homo sapiens
gcttcacacaaagtgaaatta

SEQ ID NO: 4774874 - DNA, 13 bp, Homo sapiens
gcttcagaattgt

SEQ ID NO: 4774875 - DNA, 17 bp, Homo sapiens
gcttcataggcagagcc

SEQ ID NO: 4774876 - DNA, 18 bp, Homo sapiens
gcttcataggcagagccc

SEQ ID NO: 4774877 - DNA, 21 bp, Homo sapiens
gcttcataggcagagcccgcc

SEQ ID NO: 4774878 - DNA, 22 bp, Homo sapiens
gcttcattaaaacaagagacca

SEQ ID NO: 4774879 - DNA, 14 bp, Homo sapiens
gcttccagctcagt

SEQ ID NO: 4774880 - DNA, 13 bp, Homo sapiens
gcttcccacctcc

SEQ ID NO: 4774881 - DNA, 15 bp, Homo sapiens
gcttcccacctccct

SEQ ID NO: 4774882 - DNA, 18 bp, Homo sapiens
gcttcccacctccctgcc

SEQ ID NO: 4774883 - DNA, 12 bp, Homo sapiens
gcttcccaggac

SEQ ID NO: 4774884 - DNA, 13 bp, Homo sapiens
gcttcccaggacc

SEQ ID NO: 4774885 - DNA, 15 bp, Homo sapiens
gcttcccaggaccct

SEQ ID NO: 4774886 - DNA, 19 bp, Homo sapiens
gcttcccaggaccctgggt

SEQ ID NO: 4774887 - DNA, 22 bp, Homo sapiens
ggatcttacccacttccctgca

SEQ ID NO: 4774888 - DNA, 23 bp, Homo sapiens
ggatcttacccacttccctgcaa

SEQ ID NO: 4774889 - DNA, 15 bp, Homo sapiens
ggatgaagaccctat

SEQ ID NO: 4774890 - DNA, 21 bp, Homo sapiens
ggatgaatgcagtataaaatg

SEQ ID NO: 4774891 - DNA, 17 bp, Homo sapiens
ggatgacaaagaaaatg

SEQ ID NO: 4774892 - DNA, 22 bp, Homo sapiens
ggatgacggtattatgcttctt

SEQ ID NO: 4774893 - DNA, 18 bp, Homo sapiens
ggatgcccaaagatgcag

SEQ ID NO: 4774894 - DNA, 19 bp, Homo sapiens
ggatgcccaaagatgcagc

SEQ ID NO: 4774895 - DNA, 19 bp, Homo sapiens
ggatggggcggcctgcaga

SEQ ID NO: 4774896 - DNA, 14 bp, Homo sapiens
ggatgtaatatagg

SEQ ID NO: 4774897 - DNA, 12 bp, Homo sapiens
ggatgtcccttc

SEQ ID NO: 4774898 - DNA, 15 bp, Homo sapiens
ggattataatcagaa

SEQ ID NO: 4774899 - DNA, 12 bp, Homo sapiens
ggattcacttct

SEQ ID NO: 4774900 - DNA, 13 bp, Homo sapiens
ggattcacttcta

SEQ ID NO: 4774901 - DNA, 17 bp, Homo sapiens
ggattcacttctattta

SEQ ID NO: 4774902 - DNA, 12 bp, Homo sapiens
ggattcaggaat

SEQ ID NO: 4774903 - DNA, 14 bp, Homo sapiens
ggattcctcccctg

SEQ ID NO: 4774904 - DNA, 17 bp, Homo sapiens
ggattccttcttcccca

SEQ ID NO: 4774905 - DNA, 15 bp, Homo sapiens
ggattggtaccagag

SEQ ID NO: 4774906 - DNA, 20 bp, Homo sapiens
ggatttattttttgtaactc

SEQ ID NO: 4774907 - DNA, 22 bp, Homo sapiens
ggcaaacactttggccacagcc

SEQ ID NO: 4774908 - DNA, 12 bp, Homo sapiens
ggcaaacattta

SEQ ID NO: 4774909 - DNA, 21 bp, Homo sapiens
ggcaaaccaatttgttctgtg

SEQ ID NO: 4774910 - DNA, 19 bp, Homo sapiens
ggcaaatgacatgcactga

SEQ ID NO: 4774911 - DNA, 16 bp, Homo sapiens
ggcaacagagtgagac

SEQ ID NO: 4774912 - DNA, 21 bp, Homo sapiens
ggcaacttcagtcctgggaga

SEQ ID NO: 4774913 - DNA, 20 bp, Homo sapiens
ggcaagagctcaggagaagg

SEQ ID NO: 4774914 - DNA, 22 bp, Homo sapiens
ggcaagagctcaggagaaggcc

SEQ ID NO: 4774915 - DNA, 15 bp, Homo sapiens
ggcaagctcatagca

SEQ ID NO: 4774916 - DNA, 19 bp, Homo sapiens
ggcaagctcatagcacatg

SEQ ID NO: 4774917 - DNA, 21 bp, Homo sapiens
ggcaataaatgtcccaaataa

SEQ ID NO: 4774918 - DNA, 22 bp, Homo sapiens
ggcaatagtgttgaggagggga

SEQ ID NO: 4774919 - DNA, 16 bp, Homo sapiens
ggcacacagcagcccc

SEQ ID NO: 4774920 - DNA, 22 bp, Homo sapiens
ggcacacagcagccccccagca

SEQ ID NO: 4774921 - DNA, 14 bp, Homo sapiens
ggcacactgagcaa

SEQ ID NO: 4774922 - DNA, 21 bp, Homo sapiens
ggcacagaaaatggaagacag

SEQ ID NO: 4774923 - DNA, 22 bp, Homo sapiens
ggcacaggactgattctgggat

SEQ ID NO: 4774924 - DNA, 18 bp, Homo sapiens
ggcacaggtgtaaatata

SEQ ID NO: 4774925 - DNA, 22 bp, Homo sapiens
ggcacatagcataggctgggga

SEQ ID NO: 4774926 - DNA, 15 bp, Homo sapiens
ggcacattgaaatac

SEQ ID NO: 4774927 - DNA, 16 bp, Homo sapiens
ggcaccaaagatgcag

SEQ ID NO: 4774928 - DNA, 16 bp, Homo sapiens
ggcacccaccactctc

SEQ ID NO: 4774929 - DNA, 21 bp, Homo sapiens
ggcacccaccactctcaggac

SEQ ID NO: 4774930 - DNA, 13 bp, Homo sapiens
ggcaccgcccacc

SEQ ID NO: 4774931 - DNA, 14 bp, Homo sapiens
ggcaccgcccaccc

SEQ ID NO: 4774932 - DNA, 16 bp, Homo sapiens
ggcaccgcccacccac

SEQ ID NO: 4774933 - DNA, 22 bp, Homo sapiens
ggcaccgcccacccacaccccg

SEQ ID NO: 4774934 - DNA, 16 bp, Homo sapiens
ggcacgggagagcgcc

SEQ ID NO: 4774935 - DNA, 23 bp, Homo sapiens
ggcacgggagagcgccacccgcc

SEQ ID NO: 4774936 - DNA, 22 bp, Homo sapiens
ggcagaataaaccggatcctgt

SEQ ID NO: 4774937 - DNA, 18 bp, Homo sapiens
ggcagaccagagagctca

SEQ ID NO: 4774938 - DNA, 21 bp, Homo sapiens
ggcagagattgggggggcttg

SEQ ID NO: 4774939 - DNA, 15 bp, Homo sapiens
ggcagaggcagggcc

SEQ ID NO: 4774940 - DNA, 17 bp, Homo sapiens
ggcagaggcagggccct

SEQ ID NO: 4774941 - DNA, 19 bp, Homo sapiens
ggcagagggatgaaatgcc

SEQ ID NO: 4774942 - DNA, 17 bp, Homo sapiens
ggcagagttgaagacag

SEQ ID NO: 4774943 - DNA, 13 bp, Homo sapiens
ggcagcaccctcc

SEQ ID NO: 4774944 - DNA, 15 bp, Homo sapiens
ggcagcaccctcccc

SEQ ID NO: 4774945 - DNA, 20 bp, Homo sapiens
ggcagcaccctcccccgcag

SEQ ID NO: 4774946 - DNA, 14 bp, Homo sapiens
ggcagcccagagag

SEQ ID NO: 4774947 - DNA, 20 bp, Homo sapiens
ggcagcccagagagaccctg

SEQ ID NO: 4774948 - DNA, 11 bp, Homo sapiens
ggcagccccat

SEQ ID NO: 4774949 - DNA, 19 bp, Homo sapiens
ggcagccccatccttcccg

SEQ ID NO: 4774950 - DNA, 22 bp, Homo sapiens
ggcagccccatccttcccgcag

SEQ ID NO: 4774951 - DNA, 12 bp, Homo sapiens
ggcagcccctcc

SEQ ID NO: 4774952 - DNA, 15 bp, Homo sapiens
ggcagcccctgctgg

SEQ ID NO: 4774953 - DNA, 19 bp, Homo sapiens
ggcagcccctgctggacca

SEQ ID NO: 4774954 - DNA, 15 bp, Homo sapiens
ggcagcctgcagacc

SEQ ID NO: 4774955 - DNA, 18 bp, Homo sapiens
ggcagcgcccagcctggc

SEQ ID NO: 4774956 - DNA, 15 bp, Homo sapiens
ggcagcgcctcccgc

SEQ ID NO: 4774957 - DNA, 17 bp, Homo sapiens
ggcagcgcctcccgccg

SEQ ID NO: 4774958 - DNA, 22 bp, Homo sapiens
ggcagcgcctcccgccgcctcg

SEQ ID NO: 4774959 - DNA, 23 bp, Homo sapiens
ggcagctcatagagtcccccctc

SEQ ID NO: 4774960 - DNA, 21 bp, Homo sapiens
ggcagctgcagttagcacaga

SEQ ID NO: 4774961 - DNA, 21 bp, Homo sapiens
ggcagcttccctgaacactca

SEQ ID NO: 4774962 - DNA, 19 bp, Homo sapiens
ggcaggcacacagcagccc

SEQ ID NO: 4774963 - DNA, 16 bp, Homo sapiens
ggcaggccctgcagtg

SEQ ID NO: 4774964 - DNA, 15 bp, Homo sapiens
ggcagggagggaaac

SEQ ID NO: 4774965 - DNA, 22 bp, Homo sapiens
ggcagggagggaaacccgggga

SEQ ID NO: 4774966 - DNA, 11 bp, Homo sapiens
ggcagggccct

SEQ ID NO: 4774967 - DNA, 14 bp, Homo sapiens
ggcagggccctgaa

SEQ ID NO: 4774968 - DNA, 23 bp, Homo sapiens
ggcagggccctggggtctctgag

SEQ ID NO: 4774969 - DNA, 13 bp, Homo sapiens
ggcagggttctag

SEQ ID NO: 4774970 - DNA, 19 bp, Homo sapiens
ggcaggtcctgcccatgtg

SEQ ID NO: 4774971 - DNA, 11 bp, Homo sapiens
ggcagtggaga

SEQ ID NO: 4774972 - DNA, 15 bp, Homo sapiens
ggcatcaggaaagga

SEQ ID NO: 4774973 - DNA, 17 bp, Homo sapiens
ggcatcatctcagctca

SEQ ID NO: 4774974 - DNA, 18 bp, Homo sapiens
ggcatccagtatcttgaa

SEQ ID NO: 4774975 - DNA, 19 bp, Homo sapiens
ggcatccccagtgccagct

SEQ ID NO: 4774976 - DNA, 16 bp, Homo sapiens
ggcatccgagcccctg

SEQ ID NO: 4774977 - DNA, 13 bp, Homo sapiens
ggcatctaagaca

SEQ ID NO: 4774978 - DNA, 17 bp, Homo sapiens
ggcatgagctcttggca

SEQ ID NO: 4774979 - DNA, 17 bp, Homo sapiens
ggcatggtaccagccct

SEQ ID NO: 4774980 - DNA, 18 bp, Homo sapiens
ggcatggtaccagccctg

SEQ ID NO: 4774981 - DNA, 16 bp, Homo sapiens
ggcattgctggactga

SEQ ID NO: 4774982 - DNA, 23 bp, Homo sapiens
ggcattggaggatgggggtcctg

SEQ ID NO: 4774983 - DNA, 19 bp, Homo sapiens
ggcatttagcacagtattt

SEQ ID NO: 4774984 - DNA, 17 bp, Homo sapiens
ggccaaactcacctgcc

SEQ ID NO: 4774985 - DNA, 21 bp, Homo sapiens
ggccaaactcacctgcccctc

SEQ ID NO: 4774986 - DNA, 12 bp, Homo sapiens
ggccaaaggaag

SEQ ID NO: 4774987 - DNA, 18 bp, Homo sapiens
ggccaaatattgatctgt

SEQ ID NO: 4774988 - DNA, 20 bp, Homo sapiens
ggccaagaaagaaaccagac

SEQ ID NO: 4774989 - DNA, 17 bp, Homo sapiens
ggccagagacacaagcc

SEQ ID NO: 4774990 - DNA, 13 bp, Homo sapiens
ggccagcaccctc

SEQ ID NO: 4774991 - DNA, 12 bp, Homo sapiens
ggccagcccgca

SEQ ID NO: 4774992 - DNA, 15 bp, Homo sapiens
ggccagcctcaccct

SEQ ID NO: 4774993 - DNA, 17 bp, Homo sapiens
ggccagcctcacccttg

SEQ ID NO: 4774994 - DNA, 15 bp, Homo sapiens
ggccagcctggggcc

SEQ ID NO: 4774995 - DNA, 19 bp, Homo sapiens
ggccagcctggggcctggc

SEQ ID NO: 4774996 - DNA, 16 bp, Homo sapiens
ggccagggcgtggctt

SEQ ID NO: 4774997 - DNA, 23 bp, Homo sapiens
ggccaggggcttctccccctcag

SEQ ID NO: 4774998 - DNA, 19 bp, Homo sapiens
ggccatcaccacagctgca

SEQ ID NO: 4774999 - DNA, 17 bp, Homo sapiens
ggccatccctgggcccc

SEQ ID NO: 4775000 - DNA, 21 bp, Homo sapiens
ggccatccctgggcccctcca

SEQ ID NO: 4775001 - DNA, 23 bp, Homo sapiens
ggccattctgattggacctggcc

SEQ ID NO: 4775002 - DNA, 17 bp, Homo sapiens
ggccattgaacactgca

SEQ ID NO: 4775003 - DNA, 18 bp, Homo sapiens
ggccatttcacattcctg

SEQ ID NO: 4775004 - DNA, 14 bp, Homo sapiens
ggcccaaataacag

SEQ ID NO: 4775005 - DNA, 11 bp, Homo sapiens
ggcccaaggcc

SEQ ID NO: 4775006 - DNA, 17 bp, Homo sapiens
ggcccacgcagagcccc

SEQ ID NO: 4775007 - DNA, 17 bp, Homo sapiens
ggcccagcagcggccca

SEQ ID NO: 4775008 - DNA, 16 bp, Homo sapiens
ggcccagcctggcccc

SEQ ID NO: 4775009 - DNA, 14 bp, Homo sapiens
gggaaattcttgca

SEQ ID NO: 4775010 - DNA, 14 bp, Homo sapiens
gggaactcccccag

SEQ ID NO: 4775011 - DNA, 18 bp, Homo sapiens
gggaactcccccagaggt

SEQ ID NO: 4775012 - DNA, 21 bp, Homo sapiens
gggaactctgacaagggctga

SEQ ID NO: 4775013 - DNA, 13 bp, Homo sapiens
gggaagagacttg

SEQ ID NO: 4775014 - DNA, 14 bp, Homo sapiens
gggaagattagaaa

SEQ ID NO: 4775015 - DNA, 21 bp, Homo sapiens
gggaagattagaaagaattag

SEQ ID NO: 4775016 - DNA, 11 bp, Homo sapiens
gggaagcagtt

SEQ ID NO: 4775017 - DNA, 20 bp, Homo sapiens
gggaagcagtttcagataaa

SEQ ID NO: 4775018 - DNA, 15 bp, Homo sapiens
gggaagcccacccgc

SEQ ID NO: 4775019 - DNA, 21 bp, Homo sapiens
gggaagcccacccgccccaga

SEQ ID NO: 4775020 - DNA, 20 bp, Homo sapiens
gggaagctgagcccctccct

SEQ ID NO: 4775021 - DNA, 23 bp, Homo sapiens
gggaaggcctgagggaagcccac

SEQ ID NO: 4775022 - DNA, 16 bp, Homo sapiens
gggaatccatatcagc

SEQ ID NO: 4775023 - DNA, 23 bp, Homo sapiens
gggaatgcgctcttcaccaggaa

SEQ ID NO: 4775024 - DNA, 16 bp, Homo sapiens
gggacactacaaacat

SEQ ID NO: 4775025 - DNA, 12 bp, Homo sapiens
gggacagcggcc

SEQ ID NO: 4775026 - DNA, 23 bp, Homo sapiens
gggacagcggccccgcggagccc

SEQ ID NO: 4775027 - DNA, 16 bp, Homo sapiens
gggacagcggcccggc

SEQ ID NO: 4775028 - DNA, 21 bp, Homo sapiens
gggacaggattgtctgctgcc

SEQ ID NO: 4775029 - DNA, 22 bp, Homo sapiens
gggacaggattgtctgctgcct

SEQ ID NO: 4775030 - DNA, 14 bp, Homo sapiens
gggaccagagctgc

SEQ ID NO: 4775031 - DNA, 12 bp, Homo sapiens
gggaccccagat

SEQ ID NO: 4775032 - DNA, 13 bp, Homo sapiens
gggacctcaggcc

SEQ ID NO: 4775033 - DNA, 23 bp, Homo sapiens
gggacgagcagagcgcagccccc

SEQ ID NO: 4775034 - DNA, 13 bp, Homo sapiens
gggacgcccagcc

SEQ ID NO: 4775035 - DNA, 17 bp, Homo sapiens
gggacgggggctgcttc

SEQ ID NO: 4775036 - DNA, 12 bp, Homo sapiens
gggactcagccc

SEQ ID NO: 4775037 - DNA, 13 bp, Homo sapiens
gggactccaagcc

SEQ ID NO: 4775038 - DNA, 17 bp, Homo sapiens
gggactccaagccctgg

SEQ ID NO: 4775039 - DNA, 18 bp, Homo sapiens
gggactccaagccctggg

SEQ ID NO: 4775040 - DNA, 23 bp, Homo sapiens
gggactccaagccctggggcagg

SEQ ID NO: 4775041 - DNA, 14 bp, Homo sapiens
gggactgcctctgc

SEQ ID NO: 4775042 - DNA, 15 bp, Homo sapiens
gggactgcctctgcc

SEQ ID NO: 4775043 - DNA, 15 bp, Homo sapiens
gggactggcccaccc

SEQ ID NO: 4775044 - DNA, 22 bp, Homo sapiens
gggactggcccacccctcttcc

SEQ ID NO: 4775045 - DNA, 23 bp, Homo sapiens
gggactggcccacccctcttccc

SEQ ID NO: 4775046 - DNA, 21 bp, Homo sapiens
gggactgtcttcaaccctgcc

SEQ ID NO: 4775047 - DNA, 22 bp, Homo sapiens
gggactgtcttcaaccctgccc

SEQ ID NO: 4775048 - DNA, 23 bp, Homo sapiens
gggactgtcttcaaccctgccct

SEQ ID NO: 4775049 - DNA, 16 bp, Homo sapiens
gggagaaaagccagat

SEQ ID NO: 4775050 - DNA, 18 bp, Homo sapiens
gggagaatggctctggct

SEQ ID NO: 4775051 - DNA, 23 bp, Homo sapiens
gggagcaggctcgggctccccag

SEQ ID NO: 4775052 - DNA, 18 bp, Homo sapiens
gggagccagagcctctgt

SEQ ID NO: 4775053 - DNA, 13 bp, Homo sapiens
gggagcctccccc

SEQ ID NO: 4775054 - DNA, 20 bp, Homo sapiens
gggagcctccccctcagatg

SEQ ID NO: 4775055 - DNA, 18 bp, Homo sapiens
gggaggacccctgccctc

SEQ ID NO: 4775056 - DNA, 19 bp, Homo sapiens
gggaggagcacccccagcc

SEQ ID NO: 4775057 - DNA, 15 bp, Homo sapiens
gggaggaggcagaga

SEQ ID NO: 4775058 - DNA, 16 bp, Homo sapiens
gggaggtcaggccctg

SEQ ID NO: 4775059 - DNA, 16 bp, Homo sapiens
gggagtcaagtgtgcc

SEQ ID NO: 4775060 - DNA, 21 bp, Homo sapiens
gggagtcaagtgtgcctgcta

SEQ ID NO: 4775061 - DNA, 21 bp, Homo sapiens
gggagtccactttcctctctc

SEQ ID NO: 4775062 - DNA, 15 bp, Homo sapiens
gggagtgtgatgcag

SEQ ID NO: 4775063 - DNA, 13 bp, Homo sapiens
gggatccagagac

SEQ ID NO: 4775064 - DNA, 23 bp, Homo sapiens
gggatcctggagttctggttcct

SEQ ID NO: 4775065 - DNA, 19 bp, Homo sapiens
gggatggagaggcggcctc

SEQ ID NO: 4775066 - DNA, 20 bp, Homo sapiens
gggatgggggatgggccagg

SEQ ID NO: 4775067 - DNA, 13 bp, Homo sapiens
gggcaaaggcccc

SEQ ID NO: 4775068 - DNA, 21 bp, Homo sapiens
gggcacatagcataggctggg

SEQ ID NO: 4775069 - DNA, 12 bp, Homo sapiens
gggcacccagcc

SEQ ID NO: 4775070 - DNA, 23 bp, Homo sapiens
gggcacgggagagcgccacccgc

SEQ ID NO: 4775071 - DNA, 14 bp, Homo sapiens
gggcagaaggaaga

SEQ ID NO: 4775072 - DNA, 15 bp, Homo sapiens
gggcagagaccaccg

SEQ ID NO: 4775073 - DNA, 23 bp, Homo sapiens
gggcagagaccaccgcgcccctc

SEQ ID NO: 4775074 - DNA, 17 bp, Homo sapiens
gggcagcaccctccccc

SEQ ID NO: 4775075 - DNA, 12 bp, Homo sapiens
gggcagcccaga

SEQ ID NO: 4775076 - DNA, 14 bp, Homo sapiens
gggcagcccagaga

SEQ ID NO: 4775077 - DNA, 22 bp, Homo sapiens
gggcagccccgcgaccacccct

SEQ ID NO: 4775078 - DNA, 16 bp, Homo sapiens
gggcagcccctcccca

SEQ ID NO: 4775079 - DNA, 13 bp, Homo sapiens
gggcagcccctgc

SEQ ID NO: 4775080 - DNA, 19 bp, Homo sapiens
gggcagtgctagtgagctg

SEQ ID NO: 4775081 - DNA, 21 bp, Homo sapiens
gggcatagggtttggaagaaa

SEQ ID NO: 4775082 - DNA, 20 bp, Homo sapiens
gggcatggtaccagccctgg

SEQ ID NO: 4775083 - DNA, 13 bp, Homo sapiens
gggccaggagcct

SEQ ID NO: 4775084 - DNA, 11 bp, Homo sapiens
gggccagggcg

SEQ ID NO: 4775085 - DNA, 21 bp, Homo sapiens
gggccatttcacattcctgac

SEQ ID NO: 4775086 - DNA, 14 bp, Homo sapiens
gggcccagaggctg

SEQ ID NO: 4775087 - DNA, 14 bp, Homo sapiens
gggcccatggcccc

SEQ ID NO: 4775088 - DNA, 16 bp, Homo sapiens
gggccccacagtggtc

SEQ ID NO: 4775089 - DNA, 19 bp, Homo sapiens
gggccccatggtcacagac

SEQ ID NO: 4775090 - DNA, 21 bp, Homo sapiens
gggccccatggtcacagaccc

SEQ ID NO: 4775091 - DNA, 23 bp, Homo sapiens
gggccccatggtcacagacccct

SEQ ID NO: 4775092 - DNA, 14 bp, Homo sapiens
gggcccccatgcag

SEQ ID NO: 4775093 - DNA, 23 bp, Homo sapiens
gggccccccagctcaggggcagc

SEQ ID NO: 4775094 - DNA, 13 bp, Homo sapiens
gggccccctctct

SEQ ID NO: 4775095 - DNA, 18 bp, Homo sapiens
gggcccctccacgcctcc

SEQ ID NO: 4775096 - DNA, 15 bp, Homo sapiens
gggcccctcctccag

SEQ ID NO: 4775097 - DNA, 12 bp, Homo sapiens
gggcccctggga

SEQ ID NO: 4775098 - DNA, 23 bp, Homo sapiens
gggcccgagcgcgtgccttcccc

SEQ ID NO: 4775099 - DNA, 15 bp, Homo sapiens
gggccctgctcaggc

SEQ ID NO: 4775100 - DNA, 18 bp, Homo sapiens
gggccctgctcaggcctc

SEQ ID NO: 4775101 - DNA, 13 bp, Homo sapiens
gggccctgggcct

SEQ ID NO: 4775102 - DNA, 15 bp, Homo sapiens
gggccctgggcctca

SEQ ID NO: 4775103 - DNA, 15 bp, Homo sapiens
gggccgcagggcgct

SEQ ID NO: 4775104 - DNA, 23 bp, Homo sapiens
gggccgcagggcgctccggcaga

SEQ ID NO: 4775105 - DNA, 11 bp, Homo sapiens
gggccgcctcc

SEQ ID NO: 4775106 - DNA, 18 bp, Homo sapiens
gggccgcctcctccagac

SEQ ID NO: 4775107 - DNA, 20 bp, Homo sapiens
gggccgggcaggtcctgccc

SEQ ID NO: 4775108 - DNA, 21 bp, Homo sapiens
gggccgggcaggtcctgccca

SEQ ID NO: 4775109 - DNA, 14 bp, Homo sapiens
gggcctcaggtcct

SEQ ID NO: 4775110 - DNA, 15 bp, Homo sapiens
gggcctcaggtccta

SEQ ID NO: 4775111 - DNA, 13 bp, Homo sapiens
gggcctcccgtcc

SEQ ID NO: 4775112 - DNA, 20 bp, Homo sapiens
gggcctcccgtccgtccgcc

SEQ ID NO: 4775113 - DNA, 14 bp, Homo sapiens
gggcctcggcctgg

SEQ ID NO: 4775114 - DNA, 18 bp, Homo sapiens
gggcctctctggaagagg

SEQ ID NO: 4775115 - DNA, 20 bp, Homo sapiens
gggcctgctagtctgtcagg

SEQ ID NO: 4775116 - DNA, 14 bp, Homo sapiens
gggcctgggctgtg

SEQ ID NO: 4775117 - DNA, 19 bp, Homo sapiens
gggcctgggctgtgaggac

SEQ ID NO: 4775118 - DNA, 23 bp, Homo sapiens
gggcctgggctgtgaggacaggg

SEQ ID NO: 4775119 - DNA, 22 bp, Homo sapiens
gggcctgggtccccctcctgca

SEQ ID NO: 4775120 - DNA, 15 bp, Homo sapiens
gggcctttgagagcc

SEQ ID NO: 4775121 - DNA, 13 bp, Homo sapiens
gggcgactgtgaa

SEQ ID NO: 4775122 - DNA, 21 bp, Homo sapiens
gggcgcaagcgacacaggctg

SEQ ID NO: 4775123 - DNA, 22 bp, Homo sapiens
gggcgcaagcgacacaggctgc

SEQ ID NO: 4775124 - DNA, 21 bp, Homo sapiens
gggcgcaggaaccgaggactc

SEQ ID NO: 4775125 - DNA, 13 bp, Homo sapiens
gggcgcccggact

SEQ ID NO: 4775126 - DNA, 14 bp, Homo sapiens
gggcgcccggactg

SEQ ID NO: 4775127 - DNA, 13 bp, Homo sapiens
gggcgcctgggtc

SEQ ID NO: 4775128 - DNA, 18 bp, Homo sapiens
gggcgcgcgcccccagga

SEQ ID NO: 4775129 - DNA, 20 bp, Homo sapiens
gggcgcgcgcccccaggacc

SEQ ID NO: 4775130 - DNA, 23 bp, Homo sapiens
gggcgcgcgcccccaggaccccc

SEQ ID NO: 4775131 - DNA, 17 bp, Homo sapiens
ggtgtgggccagagatc

SEQ ID NO: 4775132 - DNA, 20 bp, Homo sapiens
ggtgtgttttgtcttcaact

SEQ ID NO: 4775133 - DNA, 20 bp, Homo sapiens
ggtgttcatgacaagtggaa

SEQ ID NO: 4775134 - DNA, 20 bp, Homo sapiens
ggttaacagtaaatatacac

SEQ ID NO: 4775135 - DNA, 18 bp, Homo sapiens
ggttaaggggatctaaaa

SEQ ID NO: 4775136 - DNA, 15 bp, Homo sapiens
ggttacctcactttt

SEQ ID NO: 4775137 - DNA, 13 bp, Homo sapiens
ggttagtgcatgt

SEQ ID NO: 4775138 - DNA, 11 bp, Homo sapiens
ggttccagaca

SEQ ID NO: 4775139 - DNA, 23 bp, Homo sapiens
ggttccagacagggtggggctta

SEQ ID NO: 4775140 - DNA, 18 bp, Homo sapiens
ggttccatccaccacctt

SEQ ID NO: 4775141 - DNA, 17 bp, Homo sapiens
ggttcccatttgctcct

SEQ ID NO: 4775142 - DNA, 11 bp, Homo sapiens
ggttctagaag

SEQ ID NO: 4775143 - DNA, 13 bp, Homo sapiens
ggttctagaaggg

SEQ ID NO: 4775144 - DNA, 19 bp, Homo sapiens
ggttgagctatgatatgtg

SEQ ID NO: 4775145 - DNA, 13 bp, Homo sapiens
ggttgctggagcc

SEQ ID NO: 4775146 - DNA, 14 bp, Homo sapiens
ggttggccggctgg

SEQ ID NO: 4775147 - DNA, 17 bp, Homo sapiens
ggttggccggctggccg

SEQ ID NO: 4775148 - DNA, 19 bp, Homo sapiens
ggttgttttatagaggttc

SEQ ID NO: 4775149 - DNA, 15 bp, Homo sapiens
ggtttagaatgacag

SEQ ID NO: 4775150 - DNA, 19 bp, Homo sapiens
ggtttccatcaaagccctc

SEQ ID NO: 4775151 - DNA, 16 bp, Homo sapiens
ggtttctaaagctgcc

SEQ ID NO: 4775152 - DNA, 21 bp, Homo sapiens
ggtttcttgtttaccaaagaa

SEQ ID NO: 4775153 - DNA, 18 bp, Homo sapiens
ggtttgggcagtggagag

SEQ ID NO: 4775154 - DNA, 19 bp, Homo sapiens
ggtttgggcagtggagagg

SEQ ID NO: 4775155 - DNA, 19 bp, Homo sapiens
ggtttgttatcagtacaat

SEQ ID NO: 4775156 - DNA, 13 bp, Homo sapiens
ggttttctccttc

SEQ ID NO: 4775157 - DNA, 17 bp, Homo sapiens
ggttttgcatgtctgca

SEQ ID NO: 4775158 - DNA, 22 bp, Homo sapiens
gtaaaaaccctgctaaatgact

SEQ ID NO: 4775159 - DNA, 23 bp, Homo sapiens
gtaaaaagactactggcctctgt

SEQ ID NO: 4775160 - DNA, 20 bp, Homo sapiens
gtaaaacagatttgttcatt

SEQ ID NO: 4775161 - DNA, 12 bp, Homo sapiens
gtaaaactgtga

SEQ ID NO: 4775162 - DNA, 13 bp, Homo sapiens
gtaaaactgtgac

SEQ ID NO: 4775163 - DNA, 19 bp, Homo sapiens
gtaaaatgtattatgtcct

SEQ ID NO: 4775164 - DNA, 15 bp, Homo sapiens
gtaaaattatctgtt

SEQ ID NO: 4775165 - DNA, 18 bp, Homo sapiens
gtaaaattatctgttcta

SEQ ID NO: 4775166 - DNA, 18 bp, Homo sapiens
gtaaacatcataaatagt

SEQ ID NO: 4775167 - DNA, 23 bp, Homo sapiens
gtaaacatcataaatagtaaata

SEQ ID NO: 4775168 - DNA, 22 bp, Homo sapiens
gtaaaggtgatgaatttaccat

SEQ ID NO: 4775169 - DNA, 23 bp, Homo sapiens
gtaaaggtttatttttctgttac

SEQ ID NO: 4775170 - DNA, 11 bp, Homo sapiens
gtaaataaatg

SEQ ID NO: 4775171 - DNA, 18 bp, Homo sapiens
gtaaataaatgctgcttt

SEQ ID NO: 4775172 - DNA, 12 bp, Homo sapiens
gtaaataactgt

SEQ ID NO: 4775173 - DNA, 15 bp, Homo sapiens
gtaaataactgtgac

SEQ ID NO: 4775174 - DNA, 20 bp, Homo sapiens
gtaaataactgtgactgtgg

SEQ ID NO: 4775175 - DNA, 19 bp, Homo sapiens
gtaaataatgattcaatgt

SEQ ID NO: 4775176 - DNA, 13 bp, Homo sapiens
gtaaatatacact

SEQ ID NO: 4775177 - DNA, 13 bp, Homo sapiens
gtaaatatagtag

SEQ ID NO: 4775178 - DNA, 14 bp, Homo sapiens
gtaaatctatctct

SEQ ID NO: 4775179 - DNA, 15 bp, Homo sapiens
gtaaatctatctcta

SEQ ID NO: 4775180 - DNA, 20 bp, Homo sapiens
gtaaatctatctctatataa

SEQ ID NO: 4775181 - DNA, 20 bp, Homo sapiens
gtaaatgaggtctttgcatt

SEQ ID NO: 4775182 - DNA, 14 bp, Homo sapiens
gtaaattcctgttg

SEQ ID NO: 4775183 - DNA, 15 bp, Homo sapiens
gtaacatttttcaat

SEQ ID NO: 4775184 - DNA, 10 bp, Homo sapiens
gtaactcttt

SEQ ID NO: 4775185 - DNA, 12 bp, Homo sapiens
gtaactctttgg

SEQ ID NO: 4775186 - DNA, 22 bp, Homo sapiens
gtaactgttaacccagtgttca

SEQ ID NO: 4775187 - DNA, 22 bp, Homo sapiens
gtaacttaattataagctatgt

SEQ ID NO: 4775188 - DNA, 23 bp, Homo sapiens
gtaacttaattataagctatgtc

SEQ ID NO: 4775189 - DNA, 21 bp, Homo sapiens
gtaactttattggtcttgccc

SEQ ID NO: 4775190 - DNA, 21 bp, Homo sapiens
gtaacttttttttttttttgg

SEQ ID NO: 4775191 - DNA, 21 bp, Homo sapiens
gtaagcaattctaagtgagat

SEQ ID NO: 4775192 - DNA, 13 bp, Homo sapiens
gtaaggaatgatt

SEQ ID NO: 4775193 - DNA, 21 bp, Homo sapiens
gtaagggactccagaagcagc

SEQ ID NO: 4775194 - DNA, 24 bp, Homo sapiens
gtaagggactccagaagcagcagc

SEQ ID NO: 4775195 - DNA, 22 bp, Homo sapiens
gtaagttctgaaaactgtttat

SEQ ID NO: 4775196 - DNA, 18 bp, Homo sapiens
gtaagttgaagggaaatc

SEQ ID NO: 4775197 - DNA, 15 bp, Homo sapiens
gtaagtttctaagaa

SEQ ID NO: 4775198 - DNA, 13 bp, Homo sapiens
gtaatataagaca

SEQ ID NO: 4775199 - DNA, 15 bp, Homo sapiens
gtaatatagaaaaaa

SEQ ID NO: 4775200 - DNA, 23 bp, Homo sapiens
gtaatattaaattcctcctgtct

SEQ ID NO: 4775201 - DNA, 21 bp, Homo sapiens
gtaatatttacaatgtattaa

SEQ ID NO: 4775202 - DNA, 20 bp, Homo sapiens
gtaatcacactctcttctta

SEQ ID NO: 4775203 - DNA, 19 bp, Homo sapiens
gtaatctttcggtctcctt

SEQ ID NO: 4775204 - DNA, 20 bp, Homo sapiens
gtaatctttcggtctcctta

SEQ ID NO: 4775205 - DNA, 12 bp, Homo sapiens
gtaatgtatctt

SEQ ID NO: 4775206 - DNA, 13 bp, Homo sapiens
gtaatgtatctta

SEQ ID NO: 4775207 - DNA, 14 bp, Homo sapiens
gtaatgtatcttat

SEQ ID NO: 4775208 - DNA, 19 bp, Homo sapiens
gtaatgtatcttatttata

SEQ ID NO: 4775209 - DNA, 16 bp, Homo sapiens
gtaattaaactgttaa

SEQ ID NO: 4775210 - DNA, 22 bp, Homo sapiens
gtaattcttctcctttgtcaaa

SEQ ID NO: 4775211 - DNA, 18 bp, Homo sapiens
gtacaataaataaaagaa

SEQ ID NO: 4775212 - DNA, 14 bp, Homo sapiens
gtacaattactgtg

SEQ ID NO: 4775213 - DNA, 20 bp, Homo sapiens
gtacaattactgtgagaact

SEQ ID NO: 4775214 - DNA, 14 bp, Homo sapiens
gtacaattctttgt

SEQ ID NO: 4775215 - DNA, 17 bp, Homo sapiens
gtacagaaccagcactc

SEQ ID NO: 4775216 - DNA, 21 bp, Homo sapiens
gtacagaatcattgcttatga

SEQ ID NO: 4775217 - DNA, 16 bp, Homo sapiens
gtacagacaacaaacc

SEQ ID NO: 4775218 - DNA, 19 bp, Homo sapiens
gtacagattgctgcttctg

SEQ ID NO: 4775219 - DNA, 14 bp, Homo sapiens
gtacagcccaggcg

SEQ ID NO: 4775220 - DNA, 13 bp, Homo sapiens
gtacagggcagaa

SEQ ID NO: 4775221 - DNA, 16 bp, Homo sapiens
gtacagtttgtttaca

SEQ ID NO: 4775222 - DNA, 18 bp, Homo sapiens
gtacagtttgtttacaca

SEQ ID NO: 4775223 - DNA, 22 bp, Homo sapiens
gtacataaagtaataactgtta

SEQ ID NO: 4775224 - DNA, 14 bp, Homo sapiens
gtacattgtgccct

SEQ ID NO: 4775225 - DNA, 16 bp, Homo sapiens
gtacattgtgccctgt

SEQ ID NO: 4775226 - DNA, 22 bp, Homo sapiens
gtacattgtgccctgtagctcc

SEQ ID NO: 4775227 - DNA, 21 bp, Homo sapiens
gtacatttatgtgtgaagcaa

SEQ ID NO: 4775228 - DNA, 21 bp, Homo sapiens
gtaccagagcctatggaaagg

SEQ ID NO: 4775229 - DNA, 13 bp, Homo sapiens
gtaccagcccagg

SEQ ID NO: 4775230 - DNA, 17 bp, Homo sapiens
gtaccagccctggggct

SEQ ID NO: 4775231 - DNA, 17 bp, Homo sapiens
gtaccatcccactgata

SEQ ID NO: 4775232 - DNA, 21 bp, Homo sapiens
gtaccctcgactggcaataat

SEQ ID NO: 4775233 - DNA, 16 bp, Homo sapiens
gtacgttaattaaaca

SEQ ID NO: 4775234 - DNA, 21 bp, Homo sapiens
gtactacatttgcatgccttt

SEQ ID NO: 4775235 - DNA, 22 bp, Homo sapiens
gtactaccccaggatgcatgca

SEQ ID NO: 4775236 - DNA, 18 bp, Homo sapiens
gtactcagtcagcccagt

SEQ ID NO: 4775237 - DNA, 15 bp, Homo sapiens
gtactctgagtcctc

SEQ ID NO: 4775238 - DNA, 20 bp, Homo sapiens
gtacttacactgaaatccaa

SEQ ID NO: 4775239 - DNA, 14 bp, Homo sapiens
gtactttcccaggt

SEQ ID NO: 4775240 - DNA, 18 bp, Homo sapiens
gtagaagcccttctacct

SEQ ID NO: 4775241 - DNA, 15 bp, Homo sapiens
gtagacatctgtcct

SEQ ID NO: 4775242 - DNA, 13 bp, Homo sapiens
gtagactgtgaca

SEQ ID NO: 4775243 - DNA, 12 bp, Homo sapiens
gtagacttttat

SEQ ID NO: 4775244 - DNA, 17 bp, Homo sapiens
gtagatattcaggaaat

SEQ ID NO: 4775245 - DNA, 22 bp, Homo sapiens
gtagatattcaggaaatgttca

SEQ ID NO: 4775246 - DNA, 17 bp, Homo sapiens
gtagattgtgtaaattc

SEQ ID NO: 4775247 - DNA, 22 bp, Homo sapiens
gtagcaggatgaggaacctcaa

SEQ ID NO: 4775248 - DNA, 13 bp, Homo sapiens
gtagcatataaat

SEQ ID NO: 4775249 - DNA, 16 bp, Homo sapiens
gtagcatataaatgtt

SEQ ID NO: 4775250 - DNA, 14 bp, Homo sapiens
gtagccctggcccg

SEQ ID NO: 4775251 - DNA, 16 bp, Homo sapiens
gtagccctggcccggt

SEQ ID NO: 4775252 - DNA, 21 bp, Homo sapiens
gtagcctaatattcatgctgc

SEQ ID NO: 4775253 - DNA, 15 bp, Homo sapiens
gtctacactgccttt

SEQ ID NO: 4775254 - DNA, 17 bp, Homo sapiens
gtctacctgccttgcct

SEQ ID NO: 4775255 - DNA, 19 bp, Homo sapiens
gtctatgctgtgtgcagag

SEQ ID NO: 4775256 - DNA, 15 bp, Homo sapiens
gtctatgtgtatata

SEQ ID NO: 4775257 - DNA, 14 bp, Homo sapiens
gtctcaatgaaata

SEQ ID NO: 4775258 - DNA, 14 bp, Homo sapiens
gtctcacgattcca

SEQ ID NO: 4775259 - DNA, 15 bp, Homo sapiens
gtctcacgattccag

SEQ ID NO: 4775260 - DNA, 17 bp, Homo sapiens
gtctcatggtcccactt

SEQ ID NO: 4775261 - DNA, 13 bp, Homo sapiens
gtctcatgtttta

SEQ ID NO: 4775262 - DNA, 23 bp, Homo sapiens
gtctcattgccaaggcatcccca

SEQ ID NO: 4775263 - DNA, 19 bp, Homo sapiens
gtctcatttgatattgtgt

SEQ ID NO: 4775264 - DNA, 13 bp, Homo sapiens
gtctccacccctc

SEQ ID NO: 4775265 - DNA, 13 bp, Homo sapiens
gtctccagctgat

SEQ ID NO: 4775266 - DNA, 15 bp, Homo sapiens
gtctccgctcccgca

SEQ ID NO: 4775267 - DNA, 21 bp, Homo sapiens
gtctccgctcccgcagcgggc

SEQ ID NO: 4775268 - DNA, 16 bp, Homo sapiens
gtctcctcactgccac

SEQ ID NO: 4775269 - DNA, 14 bp, Homo sapiens
gtctcctcctccag

SEQ ID NO: 4775270 - DNA, 15 bp, Homo sapiens
gtctcctgcccactc

SEQ ID NO: 4775271 - DNA, 23 bp, Homo sapiens
gtctcctgcccactctgaccggg

SEQ ID NO: 4775272 - DNA, 15 bp, Homo sapiens
gtctcctgtatcatt

SEQ ID NO: 4775273 - DNA, 18 bp, Homo sapiens
gtctcctgtatcatttct

SEQ ID NO: 4775274 - DNA, 19 bp, Homo sapiens
gtctctagttgacttcaaa

SEQ ID NO: 4775275 - DNA, 17 bp, Homo sapiens
gtctctcttttgctctc

SEQ ID NO: 4775276 - DNA, 17 bp, Homo sapiens
gtctctgagcagtgggg

SEQ ID NO: 4775277 - DNA, 18 bp, Homo sapiens
gtctcttgggaagcagtt

SEQ ID NO: 4775278 - DNA, 17 bp, Homo sapiens
gtctgaaaaagtgtttt

SEQ ID NO: 4775279 - DNA, 15 bp, Homo sapiens
gtctgaaggagagga

SEQ ID NO: 4775280 - DNA, 16 bp, Homo sapiens
gtctgaaggagaggag

SEQ ID NO: 4775281 - DNA, 12 bp, Homo sapiens
gtctgagccctg

SEQ ID NO: 4775282 - DNA, 16 bp, Homo sapiens
gtctgagccctgccct

SEQ ID NO: 4775283 - DNA, 20 bp, Homo sapiens
gtctgagccctgccctcact

SEQ ID NO: 4775284 - DNA, 16 bp, Homo sapiens
gtctgaggataccttc

SEQ ID NO: 4775285 - DNA, 15 bp, Homo sapiens
gtctgagtagttatg

SEQ ID NO: 4775286 - DNA, 22 bp, Homo sapiens
gtctgattgttcctccccagcc

SEQ ID NO: 4775287 - DNA, 9 bp, Homo sapiens
gtctgcccc

SEQ ID NO: 4775288 - DNA, 11 bp, Homo sapiens
gtctgcccctt

SEQ ID NO: 4775289 - DNA, 12 bp, Homo sapiens
gtctgctgcccc

SEQ ID NO: 4775290 - DNA, 15 bp, Homo sapiens
gtctggagcccctat

SEQ ID NO: 4775291 - DNA, 22 bp, Homo sapiens
gtctggagcccctatcctgcac

SEQ ID NO: 4775292 - DNA, 14 bp, Homo sapiens
gtctggatcagtaa

SEQ ID NO: 4775293 - DNA, 19 bp, Homo sapiens
gtctggatcagtaaaatta

SEQ ID NO: 4775294 - DNA, 15 bp, Homo sapiens
gtctggctgtggccc

SEQ ID NO: 4775295 - DNA, 14 bp, Homo sapiens
gtctgtaagagaat

SEQ ID NO: 4775296 - DNA, 14 bp, Homo sapiens
gtctgtcctgcgcc

SEQ ID NO: 4775297 - DNA, 15 bp, Homo sapiens
gtctgtcctgcgcct

SEQ ID NO: 4775298 - DNA, 21 bp, Homo sapiens
gtctgtctctcttttgctctc

SEQ ID NO: 4775299 - DNA, 17 bp, Homo sapiens
gtctgtgagtctgtcct

SEQ ID NO: 4775300 - DNA, 18 bp, Homo sapiens
gtctgtgagtctgtcctt

SEQ ID NO: 4775301 - DNA, 13 bp, Homo sapiens
gtctgtgataaca

SEQ ID NO: 4775302 - DNA, 17 bp, Homo sapiens
gtctgtgcattgtggct

SEQ ID NO: 4775303 - DNA, 19 bp, Homo sapiens
gtctgtgcattgtggctgt

SEQ ID NO: 4775304 - DNA, 14 bp, Homo sapiens
gtctgtgcctcagt

SEQ ID NO: 4775305 - DNA, 13 bp, Homo sapiens
gtctgtgtataca

SEQ ID NO: 4775306 - DNA, 15 bp, Homo sapiens
gtctgtgtatacata

SEQ ID NO: 4775307 - DNA, 22 bp, Homo sapiens
gtctgttgaagtgcatgttaaa

SEQ ID NO: 4775308 - DNA, 21 bp, Homo sapiens
gtcttacaactgactgactta

SEQ ID NO: 4775309 - DNA, 17 bp, Homo sapiens
gtcttattcctaattcc

SEQ ID NO: 4775310 - DNA, 15 bp, Homo sapiens
gtcttccctgcttca

SEQ ID NO: 4775311 - DNA, 13 bp, Homo sapiens
gtcttgagtgggc

SEQ ID NO: 4775312 - DNA, 17 bp, Homo sapiens
gtcttgccctattataa

SEQ ID NO: 4775313 - DNA, 23 bp, Homo sapiens
gtcttggtttccatcaaagccct

SEQ ID NO: 4775314 - DNA, 12 bp, Homo sapiens
gtcttgtatttt

SEQ ID NO: 4775315 - DNA, 13 bp, Homo sapiens
gtcttgtattttc

SEQ ID NO: 4775316 - DNA, 19 bp, Homo sapiens
gtctttatgatttcatgat

SEQ ID NO: 4775317 - DNA, 13 bp, Homo sapiens
gtctttgataaag

SEQ ID NO: 4775318 - DNA, 17 bp, Homo sapiens
gtctttgctcagtggat

SEQ ID NO: 4775319 - DNA, 18 bp, Homo sapiens
gtctttgctgtttatata

SEQ ID NO: 4775320 - DNA, 19 bp, Homo sapiens
gtctttggcttcagaattg

SEQ ID NO: 4775321 - DNA, 20 bp, Homo sapiens
gtctttggttcctcatggct

SEQ ID NO: 4775322 - DNA, 21 bp, Homo sapiens
gtctttggttcctcatggctg

SEQ ID NO: 4775323 - DNA, 23 bp, Homo sapiens
gtctttggttcctcatggctgtt

SEQ ID NO: 4775324 - DNA, 15 bp, Homo sapiens
gtctttgtacagaca

SEQ ID NO: 4775325 - DNA, 16 bp, Homo sapiens
gtctttgtacagacaa

SEQ ID NO: 4775326 - DNA, 19 bp, Homo sapiens
gtgaaaaaaaaaagtaatt

SEQ ID NO: 4775327 - DNA, 16 bp, Homo sapiens
gtgaaaagtaaaacag

SEQ ID NO: 4775328 - DNA, 15 bp, Homo sapiens
gtgaaactgagacca

SEQ ID NO: 4775329 - DNA, 19 bp, Homo sapiens
gtgaaaggatatgaatctg

SEQ ID NO: 4775330 - DNA, 16 bp, Homo sapiens
gtgaaagtggcaagct

SEQ ID NO: 4775331 - DNA, 20 bp, Homo sapiens
gtgaactatttctacacagt

SEQ ID NO: 4775332 - DNA, 21 bp, Homo sapiens
gtgaagcccaggaggacctgg

SEQ ID NO: 4775333 - DNA, 22 bp, Homo sapiens
gtgaagcctttatctatgggag

SEQ ID NO: 4775334 - DNA, 17 bp, Homo sapiens
gtgaagtatgcactaat

SEQ ID NO: 4775335 - DNA, 15 bp, Homo sapiens
gtgaagtgattgaca

SEQ ID NO: 4775336 - DNA, 16 bp, Homo sapiens
gtgaataaagccacat

SEQ ID NO: 4775337 - DNA, 16 bp, Homo sapiens
gtgaataacagactat

SEQ ID NO: 4775338 - DNA, 14 bp, Homo sapiens
gtgaatataaatgt

SEQ ID NO: 4775339 - DNA, 17 bp, Homo sapiens
gtgaatataaatgtgtg

SEQ ID NO: 4775340 - DNA, 12 bp, Homo sapiens
gtgaatatgtgt

SEQ ID NO: 4775341 - DNA, 22 bp, Homo sapiens
gtgaatccatgatcaaaatgca

SEQ ID NO: 4775342 - DNA, 17 bp, Homo sapiens
gtgaatgttgtcctgtg

SEQ ID NO: 4775343 - DNA, 17 bp, Homo sapiens
gtgacaccaccactgtg

SEQ ID NO: 4775344 - DNA, 20 bp, Homo sapiens
gtgacaccaccactgtgtcc

SEQ ID NO: 4775345 - DNA, 23 bp, Homo sapiens
gtgacaccaccactgtgtcccag

SEQ ID NO: 4775346 - DNA, 16 bp, Homo sapiens
gtgacaggaaagccct

SEQ ID NO: 4775347 - DNA, 19 bp, Homo sapiens
gtgaccagcataccagttc

SEQ ID NO: 4775348 - DNA, 20 bp, Homo sapiens
gtgaccaggctcacaactgt

SEQ ID NO: 4775349 - DNA, 20 bp, Homo sapiens
gtgacccccatgtccttgga

SEQ ID NO: 4775350 - DNA, 13 bp, Homo sapiens
gtgaccctgtgcc

SEQ ID NO: 4775351 - DNA, 16 bp, Homo sapiens
gtgaccctgtgccccg

SEQ ID NO: 4775352 - DNA, 12 bp, Homo sapiens
gtgacccttccc

SEQ ID NO: 4775353 - DNA, 16 bp, Homo sapiens
gtgaccggcccgccac

SEQ ID NO: 4775354 - DNA, 20 bp, Homo sapiens
gtgaccgggggaagctgagc

SEQ ID NO: 4775355 - DNA, 21 bp, Homo sapiens
gtgaccgggggaagctgagcc

SEQ ID NO: 4775356 - DNA, 21 bp, Homo sapiens
gtgacctgacacctgccgctg

SEQ ID NO: 4775357 - DNA, 22 bp, Homo sapiens
gtgacctttttaatccaggccc

SEQ ID NO: 4775358 - DNA, 13 bp, Homo sapiens
gtgactgtcccac

SEQ ID NO: 4775359 - DNA, 23 bp, Homo sapiens
gtgacttatttgctcataagtaa

SEQ ID NO: 4775360 - DNA, 20 bp, Homo sapiens
gtgacttcagactctctcct

SEQ ID NO: 4775361 - DNA, 14 bp, Homo sapiens
gtgagaaatttttt

SEQ ID NO: 4775362 - DNA, 17 bp, Homo sapiens
gtgagaactgtgaatat

SEQ ID NO: 4775363 - DNA, 19 bp, Homo sapiens
gtgagaagtacagggcaga

SEQ ID NO: 4775364 - DNA, 19 bp, Homo sapiens
gtgagaatcgacctcactg

SEQ ID NO: 4775365 - DNA, 16 bp, Homo sapiens
gtgagaattactgttt

SEQ ID NO: 4775366 - DNA, 16 bp, Homo sapiens
gtgagatttgtattta

SEQ ID NO: 4775367 - DNA, 23 bp, Homo sapiens
gtgagatttgtatttatattaga

SEQ ID NO: 4775368 - DNA, 15 bp, Homo sapiens
gtgagcaatcctgca

SEQ ID NO: 4775369 - DNA, 19 bp, Homo sapiens
gtgagcaggaaggcctggg

SEQ ID NO: 4775370 - DNA, 15 bp, Homo sapiens
gtgagccaaagagaa

SEQ ID NO: 4775371 - DNA, 20 bp, Homo sapiens
gtgagcgccccgcccccacc

SEQ ID NO: 4775372 - DNA, 15 bp, Homo sapiens
gtgagctaccaggaa

SEQ ID NO: 4775373 - DNA, 22 bp, Homo sapiens
gtgaggactgttggctgattgg

SEQ ID NO: 4775374 - DNA, 13 bp, Homo sapiens
gtgaggccagaga

SEQ ID NO: 4775375 - DNA, 19 bp, Homo sapiens
gtgagggcaaaccaggctg

SEQ ID NO: 4775376 - DNA, 12 bp, Homo sapiens
gttagatgtttg

SEQ ID NO: 4775377 - DNA, 14 bp, Homo sapiens
gttagcaggaaata

SEQ ID NO: 4775378 - DNA, 13 bp, Homo sapiens
gttagcccggcca

SEQ ID NO: 4775379 - DNA, 11 bp, Homo sapiens
gttagctcaga

SEQ ID NO: 4775380 - DNA, 13 bp, Homo sapiens
gttagctcagagg

SEQ ID NO: 4775381 - DNA, 21 bp, Homo sapiens
gttagctcagaggagaggagc

SEQ ID NO: 4775382 - DNA, 22 bp, Homo sapiens
gttaggattaggtttagaatca

SEQ ID NO: 4775383 - DNA, 13 bp, Homo sapiens
gttaggggtgggg

SEQ ID NO: 4775384 - DNA, 20 bp, Homo sapiens
gttagtaatctgtataatac

SEQ ID NO: 4775385 - DNA, 12 bp, Homo sapiens
gttagtgcatgt

SEQ ID NO: 4775386 - DNA, 17 bp, Homo sapiens
gttagtgcatgtcacat

SEQ ID NO: 4775387 - DNA, 20 bp, Homo sapiens
gttatacaaccttcatttaa

SEQ ID NO: 4775388 - DNA, 18 bp, Homo sapiens
gttatatcagcagacact

SEQ ID NO: 4775389 - DNA, 14 bp, Homo sapiens
gttatcactgtgca

SEQ ID NO: 4775390 - DNA, 23 bp, Homo sapiens
gttatcagggcccaaataacagt

SEQ ID NO: 4775391 - DNA, 21 bp, Homo sapiens
gttatgactccagaatttccc

SEQ ID NO: 4775392 - DNA, 21 bp, Homo sapiens
gttatggcaagtttttggtaa

SEQ ID NO: 4775393 - DNA, 20 bp, Homo sapiens
gttatggtagaaaaatttca

SEQ ID NO: 4775394 - DNA, 19 bp, Homo sapiens
gttatgtaagtttctaaga

SEQ ID NO: 4775395 - DNA, 21 bp, Homo sapiens
gttattcaataactattgctg

SEQ ID NO: 4775396 - DNA, 19 bp, Homo sapiens
gttcaaagaacccccctcc

SEQ ID NO: 4775397 - DNA, 22 bp, Homo sapiens
gttcaaagaacccccctcccca

SEQ ID NO: 4775398 - DNA, 13 bp, Homo sapiens
gttcaaattctga

SEQ ID NO: 4775399 - DNA, 18 bp, Homo sapiens
gttcaatgctacaaaatg

SEQ ID NO: 4775400 - DNA, 19 bp, Homo sapiens
gttcacaccctgcaaggcc

SEQ ID NO: 4775401 - DNA, 20 bp, Homo sapiens
gttcaccttctgtgcatctg

SEQ ID NO: 4775402 - DNA, 15 bp, Homo sapiens
gttcacgcaacttga

SEQ ID NO: 4775403 - DNA, 16 bp, Homo sapiens
gttcacgtgactcctc

SEQ ID NO: 4775404 - DNA, 15 bp, Homo sapiens
gttcagctgcttctc

SEQ ID NO: 4775405 - DNA, 19 bp, Homo sapiens
gttcatctgaggagtccaa

SEQ ID NO: 4775406 - DNA, 12 bp, Homo sapiens
gttcatgaatac

SEQ ID NO: 4775407 - DNA, 19 bp, Homo sapiens
gttcatgtgtaacttctag

SEQ ID NO: 4775408 - DNA, 19 bp, Homo sapiens
gttcatgttttgctaatgc

SEQ ID NO: 4775409 - DNA, 18 bp, Homo sapiens
gttcattcatactcaaag

SEQ ID NO: 4775410 - DNA, 20 bp, Homo sapiens
gttcattccgaaaaaaaaat

SEQ ID NO: 4775411 - DNA, 9 bp, Homo sapiens
gttccaagt

SEQ ID NO: 4775412 - DNA, 11 bp, Homo sapiens
gttccaagtgt

SEQ ID NO: 4775413 - DNA, 14 bp, Homo sapiens
gttccaagtgtgtg

SEQ ID NO: 4775414 - DNA, 17 bp, Homo sapiens
gttccaagtgtgtgtgc

SEQ ID NO: 4775415 - DNA, 19 bp, Homo sapiens
gttccaagtgtgtgtgcaa

SEQ ID NO: 4775416 - DNA, 16 bp, Homo sapiens
gttccatccaccacct

SEQ ID NO: 4775417 - DNA, 14 bp, Homo sapiens
gttccattctatga

SEQ ID NO: 4775418 - DNA, 20 bp, Homo sapiens
gttcccatttgctcctttct

SEQ ID NO: 4775419 - DNA, 19 bp, Homo sapiens
gttcccttgattcaaataa

SEQ ID NO: 4775420 - DNA, 12 bp, Homo sapiens
gttcctcatggc

SEQ ID NO: 4775421 - DNA, 16 bp, Homo sapiens
gttcctgactgttctc

SEQ ID NO: 4775422 - DNA, 12 bp, Homo sapiens
gttcctttccct

SEQ ID NO: 4775423 - DNA, 23 bp, Homo sapiens
gttcctttctggaattgggctcc

SEQ ID NO: 4775424 - DNA, 19 bp, Homo sapiens
gttcgcttggctccatgct

SEQ ID NO: 4775425 - DNA, 23 bp, Homo sapiens
gttcgggggaaatagttccattc

SEQ ID NO: 4775426 - DNA, 17 bp, Homo sapiens
gttctatttatttattg

SEQ ID NO: 4775427 - DNA, 14 bp, Homo sapiens
gttctcaaatgcta

SEQ ID NO: 4775428 - DNA, 16 bp, Homo sapiens
gttctcaacacacagt

SEQ ID NO: 4775429 - DNA, 16 bp, Homo sapiens
gttctcaatgcttttc

SEQ ID NO: 4775430 - DNA, 18 bp, Homo sapiens
gttctccgggtgtggcct

SEQ ID NO: 4775431 - DNA, 19 bp, Homo sapiens
gttctccgggtgtggcctc

SEQ ID NO: 4775432 - DNA, 19 bp, Homo sapiens
gttctctcttggtctcttt

SEQ ID NO: 4775433 - DNA, 18 bp, Homo sapiens
gttctgcaaatagaaaac

SEQ ID NO: 4775434 - DNA, 13 bp, Homo sapiens
gttctgcactgaa

SEQ ID NO: 4775435 - DNA, 13 bp, Homo sapiens
gttctgccactta

SEQ ID NO: 4775436 - DNA, 21 bp, Homo sapiens
gttctgctttctgatacatct

SEQ ID NO: 4775437 - DNA, 12 bp, Homo sapiens
gttctggtgtta

SEQ ID NO: 4775438 - DNA, 20 bp, Homo sapiens
gttctgtgtcacgtgaccct

SEQ ID NO: 4775439 - DNA, 22 bp, Homo sapiens
gttctgtgtcacgtgaccctgt

SEQ ID NO: 4775440 - DNA, 21 bp, Homo sapiens
gttcttcaatgtgaaactgag

SEQ ID NO: 4775441 - DNA, 16 bp, Homo sapiens
gttcttcctcttacct

SEQ ID NO: 4775442 - DNA, 17 bp, Homo sapiens
gttcttctattgtgctt

SEQ ID NO: 4775443 - DNA, 13 bp, Homo sapiens
gttcttgcaataa

SEQ ID NO: 4775444 - DNA, 21 bp, Homo sapiens
gttcttgcagtcatcagaagt

SEQ ID NO: 4775445 - DNA, 18 bp, Homo sapiens
gttctttcacccttttct

SEQ ID NO: 4775446 - DNA, 22 bp, Homo sapiens
gttctttcctttcatcctcagc

SEQ ID NO: 4775447 - DNA, 23 bp, Homo sapiens
gttctttcctttcatcctcagca

SEQ ID NO: 4775448 - DNA, 13 bp, Homo sapiens
gttctttgtacct

SEQ ID NO: 4775449 - DNA, 14 bp, Homo sapiens
gttctttttgactg

SEQ ID NO: 4775450 - DNA, 20 bp, Homo sapiens
gttctttttgactgattgtt

SEQ ID NO: 4775451 - DNA, 22 bp, Homo sapiens
gttgaacaagccacgttgcaga

SEQ ID NO: 4775452 - DNA, 21 bp, Homo sapiens
gttgaagtgcatgttaaaata

SEQ ID NO: 4775453 - DNA, 17 bp, Homo sapiens
gttgacctaccctggac

SEQ ID NO: 4775454 - DNA, 16 bp, Homo sapiens
gttgacttcaaatgtg

SEQ ID NO: 4775455 - DNA, 13 bp, Homo sapiens
gttgagtttgctg

SEQ ID NO: 4775456 - DNA, 15 bp, Homo sapiens
gttgataaaaatact

SEQ ID NO: 4775457 - DNA, 12 bp, Homo sapiens
gttgatgaccaa

SEQ ID NO: 4775458 - DNA, 13 bp, Homo sapiens
gttgattctttca

SEQ ID NO: 4775459 - DNA, 14 bp, Homo sapiens
gttgattctttcaa

SEQ ID NO: 4775460 - DNA, 15 bp, Homo sapiens
gttgcacaacacaga

SEQ ID NO: 4775461 - DNA, 13 bp, Homo sapiens
gttgctacatcag

SEQ ID NO: 4775462 - DNA, 19 bp, Homo sapiens
gttggacagcaaaaccatt

SEQ ID NO: 4775463 - DNA, 17 bp, Homo sapiens
gttggaccccagagatt

SEQ ID NO: 4775464 - DNA, 13 bp, Homo sapiens
gttggcagtttcc

SEQ ID NO: 4775465 - DNA, 16 bp, Homo sapiens
gttggccggctggccg

SEQ ID NO: 4775466 - DNA, 20 bp, Homo sapiens
gttggccggctggccggtcc

SEQ ID NO: 4775467 - DNA, 11 bp, Homo sapiens
gttggcctctg

SEQ ID NO: 4775468 - DNA, 14 bp, Homo sapiens
gttggcctctgccc

SEQ ID NO: 4775469 - DNA, 19 bp, Homo sapiens
gttggctagtctgtgcctc

SEQ ID NO: 4775470 - DNA, 20 bp, Homo sapiens
gttggctgattggaaaataa

SEQ ID NO: 4775471 - DNA, 13 bp, Homo sapiens
gttgggtggagga

SEQ ID NO: 4775472 - DNA, 15 bp, Homo sapiens
gttgggttccagaca

SEQ ID NO: 4775473 - DNA, 16 bp, Homo sapiens
gttgggttccagacag

SEQ ID NO: 4775474 - DNA, 19 bp, Homo sapiens
gttgggttccagacagagt

SEQ ID NO: 4775475 - DNA, 15 bp, Homo sapiens
gttggtatttactgc

SEQ ID NO: 4775476 - DNA, 23 bp, Homo sapiens
gttgtaatatcagttacagtggc

SEQ ID NO: 4775477 - DNA, 19 bp, Homo sapiens
gttgtaatattttgctgct

SEQ ID NO: 4775478 - DNA, 19 bp, Homo sapiens
gttgtacaattactgtgag

SEQ ID NO: 4775479 - DNA, 15 bp, Homo sapiens
gttgtcctgtgtcat

SEQ ID NO: 4775480 - DNA, 21 bp, Homo sapiens
gttgtcctgtgtcatctgtca

SEQ ID NO: 4775481 - DNA, 21 bp, Homo sapiens
gttgtctctcttcggtggcct

SEQ ID NO: 4775482 - DNA, 13 bp, Homo sapiens
gttgtgatctgtt

SEQ ID NO: 4775483 - DNA, 20 bp, Homo sapiens
gttgtgtgggtttactctgt

SEQ ID NO: 4775484 - DNA, 18 bp, Homo sapiens
gttgttatattcattctt

SEQ ID NO: 4775485 - DNA, 15 bp, Homo sapiens
gttgttgtccctgca

SEQ ID NO: 4775486 - DNA, 13 bp, Homo sapiens
gttgttttgtgga

SEQ ID NO: 4775487 - DNA, 18 bp, Homo sapiens
gttgttttttcattgtgt

SEQ ID NO: 4775488 - DNA, 17 bp, Homo sapiens
gtttaaaattattaaaa

SEQ ID NO: 4775489 - DNA, 21 bp, Homo sapiens
gtttaacgtgaggtttcagta

SEQ ID NO: 4775490 - DNA, 17 bp, Homo sapiens
gtttaagaatcatggat

SEQ ID NO: 4775491 - DNA, 18 bp, Homo sapiens
gtttaagaatcatggatt

SEQ ID NO: 4775492 - DNA, 15 bp, Homo sapiens
gtttaagtagatttc

SEQ ID NO: 4775493 - DNA, 17 bp, Homo sapiens
gtttaccctccctgtcc

SEQ ID NO: 4775494 - DNA, 17 bp, Homo sapiens
gtttaccgcccacccag

SEQ ID NO: 4775495 - DNA, 20 bp, Homo sapiens
gtttagtagctgataaagaa

SEQ ID NO: 4775496 - DNA, 21 bp, Homo sapiens
gtttatattgtttttatatat

SEQ ID NO: 4775497 - DNA, 21 bp, Homo sapiens
gtttattatagtctgtacttc

SEQ ID NO: 4775498 - DNA, 20 bp, Homo sapiens
taaccacgattccaacccag

SEQ ID NO: 4775499 - DNA, 23 bp, Homo sapiens
taaccagtctgaagtttcattta

SEQ ID NO: 4775500 - DNA, 19 bp, Homo sapiens
taaccctgaatcagaggca

SEQ ID NO: 4775501 - DNA, 20 bp, Homo sapiens
taaccctgaatcagaggcag

SEQ ID NO: 4775502 - DNA, 21 bp, Homo sapiens
taaccgggactacagaagtgg

SEQ ID NO: 4775503 - DNA, 18 bp, Homo sapiens
taacgaccgacgcccctc

SEQ ID NO: 4775504 - DNA, 12 bp, Homo sapiens
taactaatgtaa

SEQ ID NO: 4775505 - DNA, 14 bp, Homo sapiens
taactaatgtaaat

SEQ ID NO: 4775506 - DNA, 17 bp, Homo sapiens
taactacctttggctta

SEQ ID NO: 4775507 - DNA, 21 bp, Homo sapiens
taactacctttggcttaattc

SEQ ID NO: 4775508 - DNA, 17 bp, Homo sapiens
taactagatctcctgta

SEQ ID NO: 4775509 - DNA, 16 bp, Homo sapiens
taactatggtaaataa

SEQ ID NO: 4775510 - DNA, 20 bp, Homo sapiens
taactatggtaaataactgt

SEQ ID NO: 4775511 - DNA, 16 bp, Homo sapiens
taactctttggctatt

SEQ ID NO: 4775512 - DNA, 21 bp, Homo sapiens
taactgaggagctagtgttaa

SEQ ID NO: 4775513 - DNA, 21 bp, Homo sapiens
taactgatttccatccaaacc

SEQ ID NO: 4775514 - DNA, 16 bp, Homo sapiens
taactggatattcttt

SEQ ID NO: 4775515 - DNA, 11 bp, Homo sapiens
taactggcccc

SEQ ID NO: 4775516 - DNA, 12 bp, Homo sapiens
taactggcccca

SEQ ID NO: 4775517 - DNA, 17 bp, Homo sapiens
taactggccctcgggcc

SEQ ID NO: 4775518 - DNA, 20 bp, Homo sapiens
taactgtatatttgtatgat

SEQ ID NO: 4775519 - DNA, 15 bp, Homo sapiens
taactgttaacccag

SEQ ID NO: 4775520 - DNA, 20 bp, Homo sapiens
taactgttaacccagtgttc

SEQ ID NO: 4775521 - DNA, 21 bp, Homo sapiens
taactgttacagtaatgtcat

SEQ ID NO: 4775522 - DNA, 14 bp, Homo sapiens
taactgttagaatt

SEQ ID NO: 4775523 - DNA, 18 bp, Homo sapiens
taacttatctccagccaa

SEQ ID NO: 4775524 - DNA, 15 bp, Homo sapiens
taacttattcaaaga

SEQ ID NO: 4775525 - DNA, 13 bp, Homo sapiens
taacttattttga

SEQ ID NO: 4775526 - DNA, 15 bp, Homo sapiens
taacttgctgtgaaa

SEQ ID NO: 4775527 - DNA, 16 bp, Homo sapiens
taacttgctgtgaaat

SEQ ID NO: 4775528 - DNA, 20 bp, Homo sapiens
taacttggggaaggggcctg

SEQ ID NO: 4775529 - DNA, 16 bp, Homo sapiens
taactttattggtctt

SEQ ID NO: 4775530 - DNA, 16 bp, Homo sapiens
taacttttattatctt

SEQ ID NO: 4775531 - DNA, 22 bp, Homo sapiens
taacttttttttttttttggtt

SEQ ID NO: 4775532 - DNA, 12 bp, Homo sapiens
taagaaacagtt

SEQ ID NO: 4775533 - DNA, 15 bp, Homo sapiens
taagaaatatctgtg

SEQ ID NO: 4775534 - DNA, 18 bp, Homo sapiens
taagaaatggctttccac

SEQ ID NO: 4775535 - DNA, 14 bp, Homo sapiens
taagaagcaaataa

SEQ ID NO: 4775536 - DNA, 13 bp, Homo sapiens
taagaatcatgga

SEQ ID NO: 4775537 - DNA, 16 bp, Homo sapiens
taagaatcatggattt

SEQ ID NO: 4775538 - DNA, 21 bp, Homo sapiens
taagaattcagtagcatttta

SEQ ID NO: 4775539 - DNA, 14 bp, Homo sapiens
taagacaaatgcag

SEQ ID NO: 4775540 - DNA, 17 bp, Homo sapiens
taagacaacaggcattt

SEQ ID NO: 4775541 - DNA, 19 bp, Homo sapiens
taagacattcaccaacaac

SEQ ID NO: 4775542 - DNA, 15 bp, Homo sapiens
taagagattttatgt

SEQ ID NO: 4775543 - DNA, 16 bp, Homo sapiens
taagagattttatgtt

SEQ ID NO: 4775544 - DNA, 12 bp, Homo sapiens
taagagccacaa

SEQ ID NO: 4775545 - DNA, 18 bp, Homo sapiens
taagataggttctgcttt

SEQ ID NO: 4775546 - DNA, 18 bp, Homo sapiens
taagatgggcatagggtt

SEQ ID NO: 4775547 - DNA, 20 bp, Homo sapiens
taagatgtgtcttcaatttg

SEQ ID NO: 4775548 - DNA, 21 bp, Homo sapiens
taagattatatacaaagctgt

SEQ ID NO: 4775549 - DNA, 14 bp, Homo sapiens
taagattgtacata

SEQ ID NO: 4775550 - DNA, 15 bp, Homo sapiens
taagcaattctaagt

SEQ ID NO: 4775551 - DNA, 16 bp, Homo sapiens
taagcacaaaaaattt

SEQ ID NO: 4775552 - DNA, 18 bp, Homo sapiens
taagcacacttgacatca

SEQ ID NO: 4775553 - DNA, 15 bp, Homo sapiens
taagcagtacatctt

SEQ ID NO: 4775554 - DNA, 17 bp, Homo sapiens
taagcagtacatcttgt

SEQ ID NO: 4775555 - DNA, 18 bp, Homo sapiens
taagcccacagtatattt

SEQ ID NO: 4775556 - DNA, 17 bp, Homo sapiens
taagctagaaaaattag

SEQ ID NO: 4775557 - DNA, 15 bp, Homo sapiens
taagctatgtcacta

SEQ ID NO: 4775558 - DNA, 21 bp, Homo sapiens
taagctccagtgctttatcca

SEQ ID NO: 4775559 - DNA, 17 bp, Homo sapiens
taaggatttattctcag

SEQ ID NO: 4775560 - DNA, 18 bp, Homo sapiens
taaggatttattctcaga

SEQ ID NO: 4775561 - DNA, 19 bp, Homo sapiens
taaggatttattctcagaa

SEQ ID NO: 4775562 - DNA, 20 bp, Homo sapiens
taaggatttattctcagaac

SEQ ID NO: 4775563 - DNA, 21 bp, Homo sapiens
taaggatttattctcagaaca

SEQ ID NO: 4775564 - DNA, 20 bp, Homo sapiens
taaggcaacatttccgaaga

SEQ ID NO: 4775565 - DNA, 16 bp, Homo sapiens
taaggctaaatgtaaa

SEQ ID NO: 4775566 - DNA, 15 bp, Homo sapiens
taagggaagctgata

SEQ ID NO: 4775567 - DNA, 20 bp, Homo sapiens
taagggactccagaagcagc

SEQ ID NO: 4775568 - DNA, 15 bp, Homo sapiens
taagtaaatgtcttc

SEQ ID NO: 4775569 - DNA, 20 bp, Homo sapiens
taagtaacctctacaggcat

SEQ ID NO: 4775570 - DNA, 15 bp, Homo sapiens
taagtagatttcatg

SEQ ID NO: 4775571 - DNA, 20 bp, Homo sapiens
taagtattccttggcccagc

SEQ ID NO: 4775572 - DNA, 22 bp, Homo sapiens
taagtctatctggtattaaatg

SEQ ID NO: 4775573 - DNA, 11 bp, Homo sapiens
taagtcttact

SEQ ID NO: 4775574 - DNA, 16 bp, Homo sapiens
taagtgagatgtttgg

SEQ ID NO: 4775575 - DNA, 23 bp, Homo sapiens
taagtgaggatgaaaaaataaca

SEQ ID NO: 4775576 - DNA, 14 bp, Homo sapiens
taagtggaagacag

SEQ ID NO: 4775577 - DNA, 16 bp, Homo sapiens
taagtggactgtattt

SEQ ID NO: 4775578 - DNA, 13 bp, Homo sapiens
taagtgttctgtg

SEQ ID NO: 4775579 - DNA, 18 bp, Homo sapiens
taagttataccagcaaaa

SEQ ID NO: 4775580 - DNA, 18 bp, Homo sapiens
taagttctgaaaactgtt

SEQ ID NO: 4775581 - DNA, 12 bp, Homo sapiens
taagttgaatga

SEQ ID NO: 4775582 - DNA, 22 bp, Homo sapiens
taagttgtattttaataaagat

SEQ ID NO: 4775583 - DNA, 24 bp, Homo sapiens
taagttgtattttaataaagattc

SEQ ID NO: 4775584 - DNA, 15 bp, Homo sapiens
taataaaacattagt

SEQ ID NO: 4775585 - DNA, 14 bp, Homo sapiens
taataaaattcatt

SEQ ID NO: 4775586 - DNA, 20 bp, Homo sapiens
taataaaattcattccattt

SEQ ID NO: 4775587 - DNA, 15 bp, Homo sapiens
taataaactgtttaa

SEQ ID NO: 4775588 - DNA, 19 bp, Homo sapiens
taataaaggttctatgata

SEQ ID NO: 4775589 - DNA, 22 bp, Homo sapiens
taataaagtattccaccttaaa

SEQ ID NO: 4775590 - DNA, 19 bp, Homo sapiens
taataacctttaagtcaga

SEQ ID NO: 4775591 - DNA, 20 bp, Homo sapiens
taataactagatctcctgta

SEQ ID NO: 4775592 - DNA, 21 bp, Homo sapiens
taataactagatctcctgtaa

SEQ ID NO: 4775593 - DNA, 13 bp, Homo sapiens
taataactgttag

SEQ ID NO: 4775594 - DNA, 13 bp, Homo sapiens
taatactttgtat

SEQ ID NO: 4775595 - DNA, 15 bp, Homo sapiens
taatagctcacagca

SEQ ID NO: 4775596 - DNA, 14 bp, Homo sapiens
taatagtttctaaa

SEQ ID NO: 4775597 - DNA, 19 bp, Homo sapiens
taatagtttctaaaccatg

SEQ ID NO: 4775598 - DNA, 13 bp, Homo sapiens
taatataaatgaa

SEQ ID NO: 4775599 - DNA, 14 bp, Homo sapiens
taatataaatgaat

SEQ ID NO: 4775600 - DNA, 15 bp, Homo sapiens
taatataagacaagt

SEQ ID NO: 4775601 - DNA, 20 bp, Homo sapiens
taatatactccttaaaaatg

SEQ ID NO: 4775602 - DNA, 12 bp, Homo sapiens
taatatagaaaa

SEQ ID NO: 4775603 - DNA, 23 bp, Homo sapiens
taatatagggtttgtttgctgct

SEQ ID NO: 4775604 - DNA, 14 bp, Homo sapiens
taatatcactcatt

SEQ ID NO: 4775605 - DNA, 18 bp, Homo sapiens
taatatcactcattaatt

SEQ ID NO: 4775606 - DNA, 21 bp, Homo sapiens
taatatcactcattaattaac

SEQ ID NO: 4775607 - DNA, 12 bp, Homo sapiens
taatatcagtta

SEQ ID NO: 4775608 - DNA, 16 bp, Homo sapiens
taatatcagttacagt

SEQ ID NO: 4775609 - DNA, 21 bp, Homo sapiens
taatatccctggagttcctca

SEQ ID NO: 4775610 - DNA, 12 bp, Homo sapiens
taatatcttgaa

SEQ ID NO: 4775611 - DNA, 14 bp, Homo sapiens
taatatcttgaaga

SEQ ID NO: 4775612 - DNA, 18 bp, Homo sapiens
taatatcttgaagaatat

SEQ ID NO: 4775613 - DNA, 22 bp, Homo sapiens
taatatggaaccttccctccaa

SEQ ID NO: 4775614 - DNA, 12 bp, Homo sapiens
taatattaaatt

SEQ ID NO: 4775615 - DNA, 13 bp, Homo sapiens
taatatttacaat

SEQ ID NO: 4775616 - DNA, 21 bp, Homo sapiens
taatatttaggcatgagctct

SEQ ID NO: 4775617 - DNA, 16 bp, Homo sapiens
taatatttattgcttt

SEQ ID NO: 4775618 - DNA, 14 bp, Homo sapiens
taatcaatactttg

SEQ ID NO: 4775619 - DNA, 20 bp, Homo sapiens
taatcaatactttgaacaca

SEQ ID NO: 4775620 - DNA, 13 bp, Homo sapiens
tagaaccttctaa

SEQ ID NO: 4775621 - DNA, 19 bp, Homo sapiens
tagaagaaggactgaagaa

SEQ ID NO: 4775622 - DNA, 17 bp, Homo sapiens
tagaagaatattgtatt

SEQ ID NO: 4775623 - DNA, 21 bp, Homo sapiens
tagaaggcagactttctacat

SEQ ID NO: 4775624 - DNA, 23 bp, Homo sapiens
tagaataatgtgggaagaaacaa

SEQ ID NO: 4775625 - DNA, 19 bp, Homo sapiens
tagaatactaataaaatac

SEQ ID NO: 4775626 - DNA, 13 bp, Homo sapiens
tagaatattaaaa

SEQ ID NO: 4775627 - DNA, 18 bp, Homo sapiens
tagaatattaaaaattaa

SEQ ID NO: 4775628 - DNA, 15 bp, Homo sapiens
tagaatgagaaatca

SEQ ID NO: 4775629 - DNA, 13 bp, Homo sapiens
tagaatggggctt

SEQ ID NO: 4775630 - DNA, 18 bp, Homo sapiens
tagaattaggtaatggat

SEQ ID NO: 4775631 - DNA, 15 bp, Homo sapiens
tagacaaaggcctta

SEQ ID NO: 4775632 - DNA, 21 bp, Homo sapiens
tagacaatgtggaattacata

SEQ ID NO: 4775633 - DNA, 17 bp, Homo sapiens
tagacacacatatacat

SEQ ID NO: 4775634 - DNA, 19 bp, Homo sapiens
tagacacacatatacatta

SEQ ID NO: 4775635 - DNA, 17 bp, Homo sapiens
tagaccgtggtgtcctc

SEQ ID NO: 4775636 - DNA, 19 bp, Homo sapiens
tagactcaaagaagtactg

SEQ ID NO: 4775637 - DNA, 19 bp, Homo sapiens
tagactttaattcttctct

SEQ ID NO: 4775638 - DNA, 18 bp, Homo sapiens
tagagaaaaaaaaatatg

SEQ ID NO: 4775639 - DNA, 23 bp, Homo sapiens
tagagaaaaaaaaatatgtgtac

SEQ ID NO: 4775640 - DNA, 14 bp, Homo sapiens
tagagaagccataa

SEQ ID NO: 4775641 - DNA, 10 bp, Homo sapiens
tagagaggac

SEQ ID NO: 4775642 - DNA, 20 bp, Homo sapiens
tagagcattctggggtgggg

SEQ ID NO: 4775643 - DNA, 22 bp, Homo sapiens
tagagcggagaaaggaagggct

SEQ ID NO: 4775644 - DNA, 19 bp, Homo sapiens
tagaggataaataataaag

SEQ ID NO: 4775645 - DNA, 22 bp, Homo sapiens
tagaggatgggcagctgggggg

SEQ ID NO: 4775646 - DNA, 20 bp, Homo sapiens
tagaggattgtccaccttct

SEQ ID NO: 4775647 - DNA, 17 bp, Homo sapiens
tagaggggacaagccag

SEQ ID NO: 4775648 - DNA, 21 bp, Homo sapiens
tagaggggacaagccaggccc

SEQ ID NO: 4775649 - DNA, 19 bp, Homo sapiens
tagaggtcttgatctttgg

SEQ ID NO: 4775650 - DNA, 17 bp, Homo sapiens
tagagtatgcaagaaga

SEQ ID NO: 4775651 - DNA, 21 bp, Homo sapiens
tagatacacctcaactaaatc

SEQ ID NO: 4775652 - DNA, 19 bp, Homo sapiens
tagataccattttgaaata

SEQ ID NO: 4775653 - DNA, 20 bp, Homo sapiens
tagataccattttgaaatat

SEQ ID NO: 4775654 - DNA, 22 bp, Homo sapiens
tagatcaactcatgttaattga

SEQ ID NO: 4775655 - DNA, 20 bp, Homo sapiens
tagatcatttttatcccgcc

SEQ ID NO: 4775656 - DNA, 20 bp, Homo sapiens
tagatccattaatttaaatg

SEQ ID NO: 4775657 - DNA, 20 bp, Homo sapiens
tagatgactgaatttctatg

SEQ ID NO: 4775658 - DNA, 21 bp, Homo sapiens
tagatgaggttgagctatgat

SEQ ID NO: 4775659 - DNA, 12 bp, Homo sapiens
tagattcacctg

SEQ ID NO: 4775660 - DNA, 16 bp, Homo sapiens
tagattcctacttaaa

SEQ ID NO: 4775661 - DNA, 18 bp, Homo sapiens
tagattctttattagtga

SEQ ID NO: 4775662 - DNA, 18 bp, Homo sapiens
tagattgttttagagtta

SEQ ID NO: 4775663 - DNA, 15 bp, Homo sapiens
tagattttatagtgt

SEQ ID NO: 4775664 - DNA, 14 bp, Homo sapiens
tagatttttagatt

SEQ ID NO: 4775665 - DNA, 17 bp, Homo sapiens
tagatttttagattcct

SEQ ID NO: 4775666 - DNA, 18 bp, Homo sapiens
tagcaaattccaatacat

SEQ ID NO: 4775667 - DNA, 20 bp, Homo sapiens
tagcaaattccaatacatta

SEQ ID NO: 4775668 - DNA, 21 bp, Homo sapiens
tagcaattgcttctctaaaac

SEQ ID NO: 4775669 - DNA, 22 bp, Homo sapiens
tagcacagaggatggcttcccc

SEQ ID NO: 4775670 - DNA, 13 bp, Homo sapiens
tagcacagtattt

SEQ ID NO: 4775671 - DNA, 14 bp, Homo sapiens
tagcacagtattta

SEQ ID NO: 4775672 - DNA, 21 bp, Homo sapiens
tagcaccagcttgcttctctg

SEQ ID NO: 4775673 - DNA, 12 bp, Homo sapiens
tagcactttata

SEQ ID NO: 4775674 - DNA, 19 bp, Homo sapiens
tagcactttgggaggctga

SEQ ID NO: 4775675 - DNA, 17 bp, Homo sapiens
tagcagctgggttggta

SEQ ID NO: 4775676 - DNA, 22 bp, Homo sapiens
tagcagctgggttggtatggag

SEQ ID NO: 4775677 - DNA, 16 bp, Homo sapiens
tagcagttctgcaaat

SEQ ID NO: 4775678 - DNA, 13 bp, Homo sapiens
tagcataggctgg

SEQ ID NO: 4775679 - DNA, 18 bp, Homo sapiens
tagcatgagttctgcaca

SEQ ID NO: 4775680 - DNA, 19 bp, Homo sapiens
tagcatggctgccaatggg

SEQ ID NO: 4775681 - DNA, 18 bp, Homo sapiens
tagccaacttaaacctgt

SEQ ID NO: 4775682 - DNA, 22 bp, Homo sapiens
tagccaacttaaacctgtgctt

SEQ ID NO: 4775683 - DNA, 12 bp, Homo sapiens
tagccaggcctc

SEQ ID NO: 4775684 - DNA, 13 bp, Homo sapiens
tagccattcattt

SEQ ID NO: 4775685 - DNA, 16 bp, Homo sapiens
tagccattcatttaca

SEQ ID NO: 4775686 - DNA, 13 bp, Homo sapiens
tagccccaggccc

SEQ ID NO: 4775687 - DNA, 22 bp, Homo sapiens
tagccccaggcccgccctgccc

SEQ ID NO: 4775688 - DNA, 13 bp, Homo sapiens
tagccctctccct

SEQ ID NO: 4775689 - DNA, 15 bp, Homo sapiens
tagccctctttctct

SEQ ID NO: 4775690 - DNA, 18 bp, Homo sapiens
tagccctctttctctctg

SEQ ID NO: 4775691 - DNA, 20 bp, Homo sapiens
tagccctctttctctctgtg

SEQ ID NO: 4775692 - DNA, 14 bp, Homo sapiens
tagccctggcccgg

SEQ ID NO: 4775693 - DNA, 19 bp, Homo sapiens
tagccctggcccggtccca

SEQ ID NO: 4775694 - DNA, 16 bp, Homo sapiens
tagcctaatattcatg

SEQ ID NO: 4775695 - DNA, 17 bp, Homo sapiens
tagcctctccgcccacg

SEQ ID NO: 4775696 - DNA, 14 bp, Homo sapiens
tagcctggtctgtg

SEQ ID NO: 4775697 - DNA, 15 bp, Homo sapiens
tagcctggtctgtgc

SEQ ID NO: 4775698 - DNA, 14 bp, Homo sapiens
tagcgtgtgtagat

SEQ ID NO: 4775699 - DNA, 18 bp, Homo sapiens
tagcgtgtgtagatagta

SEQ ID NO: 4775700 - DNA, 18 bp, Homo sapiens
tagcgttgttttgtggat

SEQ ID NO: 4775701 - DNA, 19 bp, Homo sapiens
tagctcacaagccgtgttt

SEQ ID NO: 4775702 - DNA, 22 bp, Homo sapiens
tagctcacaagccgtgttttat

SEQ ID NO: 4775703 - DNA, 12 bp, Homo sapiens
tagctcacagca

SEQ ID NO: 4775704 - DNA, 13 bp, Homo sapiens
tagctcccttgag

SEQ ID NO: 4775705 - DNA, 17 bp, Homo sapiens
tagctcccttgagctgg

SEQ ID NO: 4775706 - DNA, 11 bp, Homo sapiens
tagctccttca

SEQ ID NO: 4775707 - DNA, 14 bp, Homo sapiens
tagctccttcatgc

SEQ ID NO: 4775708 - DNA, 13 bp, Homo sapiens
tagctccttggtt

SEQ ID NO: 4775709 - DNA, 19 bp, Homo sapiens
tagctctgaatgctatttg

SEQ ID NO: 4775710 - DNA, 14 bp, Homo sapiens
tagctgataaagaa

SEQ ID NO: 4775711 - DNA, 19 bp, Homo sapiens
tagcttacctgacacaaga

SEQ ID NO: 4775712 - DNA, 14 bp, Homo sapiens
tagcttcagtcatt

SEQ ID NO: 4775713 - DNA, 16 bp, Homo sapiens
tagcttcagtcattaa

SEQ ID NO: 4775714 - DNA, 21 bp, Homo sapiens
tagcttcagtcattaaattac

SEQ ID NO: 4775715 - DNA, 21 bp, Homo sapiens
tagctttgcaaccttgtactt

SEQ ID NO: 4775716 - DNA, 15 bp, Homo sapiens
taggaaaattttctt

SEQ ID NO: 4775717 - DNA, 18 bp, Homo sapiens
taggaacagagtatatat

SEQ ID NO: 4775718 - DNA, 19 bp, Homo sapiens
taggaacagagtatatatg

SEQ ID NO: 4775719 - DNA, 22 bp, Homo sapiens
taggaacagagtatatatgtac

SEQ ID NO: 4775720 - DNA, 16 bp, Homo sapiens
taggaatgctcaatgt

SEQ ID NO: 4775721 - DNA, 22 bp, Homo sapiens
taggaatgctcaatgtgctgtt

SEQ ID NO: 4775722 - DNA, 14 bp, Homo sapiens
taggacaaggggtg

SEQ ID NO: 4775723 - DNA, 22 bp, Homo sapiens
taggacatctctgtaaaaagca

SEQ ID NO: 4775724 - DNA, 22 bp, Homo sapiens
taggacccaaggtggtcttgga

SEQ ID NO: 4775725 - DNA, 17 bp, Homo sapiens
taggacttaatttagca

SEQ ID NO: 4775726 - DNA, 12 bp, Homo sapiens
taggagaggaaa

SEQ ID NO: 4775727 - DNA, 18 bp, Homo sapiens
taggagcttccagatggg

SEQ ID NO: 4775728 - DNA, 16 bp, Homo sapiens
taggatcttcactgtc

SEQ ID NO: 4775729 - DNA, 21 bp, Homo sapiens
taggcaggaagtcaggagcca

SEQ ID NO: 4775730 - DNA, 22 bp, Homo sapiens
taggcctactggggatcagagt

SEQ ID NO: 4775731 - DNA, 14 bp, Homo sapiens
taggcgaaagtaat

SEQ ID NO: 4775732 - DNA, 12 bp, Homo sapiens
taggctctgaga

SEQ ID NO: 4775733 - DNA, 13 bp, Homo sapiens
taggctggggaca

SEQ ID NO: 4775734 - DNA, 16 bp, Homo sapiens
taggctggggacacag

SEQ ID NO: 4775735 - DNA, 20 bp, Homo sapiens
tagggaaatccaactccagg

SEQ ID NO: 4775736 - DNA, 23 bp, Homo sapiens
taggggcaaaaatttgacattgt

SEQ ID NO: 4775737 - DNA, 18 bp, Homo sapiens
taggggccgagggaaatg

SEQ ID NO: 4775738 - DNA, 16 bp, Homo sapiens
tagggtctgtcccggg

SEQ ID NO: 4775739 - DNA, 14 bp, Homo sapiens
tagggtgaggcgtg

SEQ ID NO: 4775740 - DNA, 19 bp, Homo sapiens
tagggttctatatttactg

SEQ ID NO: 4775741 - DNA, 18 bp, Homo sapiens
tagggtttgtttgctgct

SEQ ID NO: 4775742 - DNA, 19 bp, Homo sapiens
tatgcttgcatatatttca

SEQ ID NO: 4775743 - DNA, 18 bp, Homo sapiens
tatgcttttttgcaataa

SEQ ID NO: 4775744 - DNA, 17 bp, Homo sapiens
tatggacaatgacccag

SEQ ID NO: 4775745 - DNA, 23 bp, Homo sapiens
tatggagttggcagacaggatgt

SEQ ID NO: 4775746 - DNA, 13 bp, Homo sapiens
tatggctgtattt

SEQ ID NO: 4775747 - DNA, 10 bp, Homo sapiens
tatgggagag

SEQ ID NO: 4775748 - DNA, 14 bp, Homo sapiens
tatgggaggaacaa

SEQ ID NO: 4775749 - DNA, 19 bp, Homo sapiens
tatggtaaataactgtgac

SEQ ID NO: 4775750 - DNA, 22 bp, Homo sapiens
tatggtatgctggccagcaccc

SEQ ID NO: 4775751 - DNA, 13 bp, Homo sapiens
tatggtattttcg

SEQ ID NO: 4775752 - DNA, 20 bp, Homo sapiens
tatggtattttcgtgcattt

SEQ ID NO: 4775753 - DNA, 17 bp, Homo sapiens
tatggtgatactccaag

SEQ ID NO: 4775754 - DNA, 20 bp, Homo sapiens
tatggtgctgggtccttaaa

SEQ ID NO: 4775755 - DNA, 13 bp, Homo sapiens
tatgtaagtttct

SEQ ID NO: 4775756 - DNA, 18 bp, Homo sapiens
tatgtaagtttctaagaa

SEQ ID NO: 4775757 - DNA, 18 bp, Homo sapiens
tatgtaatatatacatat

SEQ ID NO: 4775758 - DNA, 14 bp, Homo sapiens
tatgtacaggctga

SEQ ID NO: 4775759 - DNA, 17 bp, Homo sapiens
tatgtacagttatacat

SEQ ID NO: 4775760 - DNA, 14 bp, Homo sapiens
tatgtacttacatg

SEQ ID NO: 4775761 - DNA, 15 bp, Homo sapiens
tatgtaggaaaattt

SEQ ID NO: 4775762 - DNA, 23 bp, Homo sapiens
tatgtaggaaaattttcttcttt

SEQ ID NO: 4775763 - DNA, 16 bp, Homo sapiens
tatgtatatctgtgta

SEQ ID NO: 4775764 - DNA, 17 bp, Homo sapiens
tatgtatggtttgaaaa

SEQ ID NO: 4775765 - DNA, 18 bp, Homo sapiens
tatgtcctgtgagatgtg

SEQ ID NO: 4775766 - DNA, 21 bp, Homo sapiens
tatgtctatgtgtatatatta

SEQ ID NO: 4775767 - DNA, 14 bp, Homo sapiens
tatgtctcatgttt

SEQ ID NO: 4775768 - DNA, 15 bp, Homo sapiens
tatgtctcatgtttt

SEQ ID NO: 4775769 - DNA, 17 bp, Homo sapiens
tatgtctcatgttttat

SEQ ID NO: 4775770 - DNA, 13 bp, Homo sapiens
tatgtctcttgtt

SEQ ID NO: 4775771 - DNA, 12 bp, Homo sapiens
tatgtctgtgat

SEQ ID NO: 4775772 - DNA, 12 bp, Homo sapiens
tatgtctttaaa

SEQ ID NO: 4775773 - DNA, 16 bp, Homo sapiens
tatgtctttaaaatga

SEQ ID NO: 4775774 - DNA, 23 bp, Homo sapiens
tatgtgctattaatatttgttta

SEQ ID NO: 4775775 - DNA, 15 bp, Homo sapiens
tatgtgcttgtgtgt

SEQ ID NO: 4775776 - DNA, 20 bp, Homo sapiens
tatgtgcttgtgtgtatgtc

SEQ ID NO: 4775777 - DNA, 20 bp, Homo sapiens
tatgtggagttcatcttgaa

SEQ ID NO: 4775778 - DNA, 23 bp, Homo sapiens
tatgtgtatatattatatataca

SEQ ID NO: 4775779 - DNA, 12 bp, Homo sapiens
tatgtgtatgta

SEQ ID NO: 4775780 - DNA, 21 bp, Homo sapiens
tatgtgtgagtgtatgtatac

SEQ ID NO: 4775781 - DNA, 18 bp, Homo sapiens
tatgttatttatgatgtt

SEQ ID NO: 4775782 - DNA, 15 bp, Homo sapiens
tatgttgctgaaaca

SEQ ID NO: 4775783 - DNA, 18 bp, Homo sapiens
tatgtttggctgaaatta

SEQ ID NO: 4775784 - DNA, 16 bp, Homo sapiens
tattaaaaattaattc

SEQ ID NO: 4775785 - DNA, 17 bp, Homo sapiens
tattaaaaattatagac

SEQ ID NO: 4775786 - DNA, 15 bp, Homo sapiens
tattaaacttcagca

SEQ ID NO: 4775787 - DNA, 19 bp, Homo sapiens
tattaaatttattaaatgt

SEQ ID NO: 4775788 - DNA, 20 bp, Homo sapiens
tattaaatttattaaatgtt

SEQ ID NO: 4775789 - DNA, 19 bp, Homo sapiens
tattaacaattaattgtct

SEQ ID NO: 4775790 - DNA, 20 bp, Homo sapiens
tattaacaattaattgtctt

SEQ ID NO: 4775791 - DNA, 12 bp, Homo sapiens
tattaagcacat

SEQ ID NO: 4775792 - DNA, 14 bp, Homo sapiens
tattaagcacatta

SEQ ID NO: 4775793 - DNA, 21 bp, Homo sapiens
tattaagcccacagtatattt

SEQ ID NO: 4775794 - DNA, 19 bp, Homo sapiens
tattaagctccagtgcttt

SEQ ID NO: 4775795 - DNA, 18 bp, Homo sapiens
tattaatataaaaacatt

SEQ ID NO: 4775796 - DNA, 20 bp, Homo sapiens
tattacaacaagcaaactga

SEQ ID NO: 4775797 - DNA, 21 bp, Homo sapiens
tattacaacaagcaaactgaa

SEQ ID NO: 4775798 - DNA, 22 bp, Homo sapiens
tattacaacaagcaaactgaaa

SEQ ID NO: 4775799 - DNA, 24 bp, Homo sapiens
tattagagtgcccttaaaataatg

SEQ ID NO: 4775800 - DNA, 15 bp, Homo sapiens
tattagcagctgggt

SEQ ID NO: 4775801 - DNA, 16 bp, Homo sapiens
tattagccctgcattt

SEQ ID NO: 4775802 - DNA, 21 bp, Homo sapiens
tattataagttgacctttatt

SEQ ID NO: 4775803 - DNA, 15 bp, Homo sapiens
tattatagtctgtac

SEQ ID NO: 4775804 - DNA, 16 bp, Homo sapiens
tattatattaatataa

SEQ ID NO: 4775805 - DNA, 13 bp, Homo sapiens
tattatattgttt

SEQ ID NO: 4775806 - DNA, 14 bp, Homo sapiens
tattatgcttcttg

SEQ ID NO: 4775807 - DNA, 18 bp, Homo sapiens
tattatggtgatactcca

SEQ ID NO: 4775808 - DNA, 21 bp, Homo sapiens
tattatgtcctgtgagatgtg

SEQ ID NO: 4775809 - DNA, 14 bp, Homo sapiens
tattattatattgt

SEQ ID NO: 4775810 - DNA, 13 bp, Homo sapiens
tattattattata

SEQ ID NO: 4775811 - DNA, 18 bp, Homo sapiens
tattatttagtaaaatta

SEQ ID NO: 4775812 - DNA, 22 bp, Homo sapiens
tattatttagtaaaattatctg

SEQ ID NO: 4775813 - DNA, 20 bp, Homo sapiens
tattattttctgtaattctt

SEQ ID NO: 4775814 - DNA, 13 bp, Homo sapiens
tattcacacacac

SEQ ID NO: 4775815 - DNA, 17 bp, Homo sapiens
tattcagagatgtacca

SEQ ID NO: 4775816 - DNA, 17 bp, Homo sapiens
tattcaggaaatgttca

SEQ ID NO: 4775817 - DNA, 23 bp, Homo sapiens
tattcataccttctgatgaagtt

SEQ ID NO: 4775818 - DNA, 16 bp, Homo sapiens
tattcatgctgcctgc

SEQ ID NO: 4775819 - DNA, 20 bp, Homo sapiens
tattcatgctgcctgccatg

SEQ ID NO: 4775820 - DNA, 15 bp, Homo sapiens
tattccaccttaaat

SEQ ID NO: 4775821 - DNA, 18 bp, Homo sapiens
tattccaccttaaattaa

SEQ ID NO: 4775822 - DNA, 17 bp, Homo sapiens
tattcccagggccgctt

SEQ ID NO: 4775823 - DNA, 17 bp, Homo sapiens
tattcctaattcctgta

SEQ ID NO: 4775824 - DNA, 18 bp, Homo sapiens
tattcctaattcctgtat

SEQ ID NO: 4775825 - DNA, 13 bp, Homo sapiens
tattcctgccttt

SEQ ID NO: 4775826 - DNA, 19 bp, Homo sapiens
tattccttctggcctttcc

SEQ ID NO: 4775827 - DNA, 21 bp, Homo sapiens
tattccttctggcctttcctc

SEQ ID NO: 4775828 - DNA, 14 bp, Homo sapiens
tattccttggccca

SEQ ID NO: 4775829 - DNA, 19 bp, Homo sapiens
tattccttggcccagcagc

SEQ ID NO: 4775830 - DNA, 23 bp, Homo sapiens
tattctaaggagcaaatacctta

SEQ ID NO: 4775831 - DNA, 10 bp, Homo sapiens
tattctgtca

SEQ ID NO: 4775832 - DNA, 22 bp, Homo sapiens
tattgacaataagaaacagttt

SEQ ID NO: 4775833 - DNA, 16 bp, Homo sapiens
tattgagacactgtca

SEQ ID NO: 4775834 - DNA, 18 bp, Homo sapiens
tattgagacactgtcaag

SEQ ID NO: 4775835 - DNA, 19 bp, Homo sapiens
tattgagcaatatgtcagt

SEQ ID NO: 4775836 - DNA, 18 bp, Homo sapiens
tattgagcagaattcatt

SEQ ID NO: 4775837 - DNA, 11 bp, Homo sapiens
tattgatattc

SEQ ID NO: 4775838 - DNA, 13 bp, Homo sapiens
tattgatctgtat

SEQ ID NO: 4775839 - DNA, 20 bp, Homo sapiens
tattgctgaagaatctactt

SEQ ID NO: 4775840 - DNA, 21 bp, Homo sapiens
tattgctgtaaataaaaatag

SEQ ID NO: 4775841 - DNA, 22 bp, Homo sapiens
tattgctgtaaataaaaatagc

SEQ ID NO: 4775842 - DNA, 14 bp, Homo sapiens
tattggcagcacag

SEQ ID NO: 4775843 - DNA, 16 bp, Homo sapiens
tattggcagcacagct

SEQ ID NO: 4775844 - DNA, 13 bp, Homo sapiens
tattgggcttaat

SEQ ID NO: 4775845 - DNA, 16 bp, Homo sapiens
tattgggcttaatata

SEQ ID NO: 4775846 - DNA, 20 bp, Homo sapiens
tattggtcttgccctattat

SEQ ID NO: 4775847 - DNA, 21 bp, Homo sapiens
tattggtcttgccctattata

SEQ ID NO: 4775848 - DNA, 17 bp, Homo sapiens
tattggtttctgtttga

SEQ ID NO: 4775849 - DNA, 18 bp, Homo sapiens
tattgtatatatggatat

SEQ ID NO: 4775850 - DNA, 18 bp, Homo sapiens
tattgtattatcatatat

SEQ ID NO: 4775851 - DNA, 17 bp, Homo sapiens
tattgtattgttagatg

SEQ ID NO: 4775852 - DNA, 13 bp, Homo sapiens
tattgtcaaagtg

SEQ ID NO: 4775853 - DNA, 17 bp, Homo sapiens
tattgtcaaagtggtga

SEQ ID NO: 4775854 - DNA, 16 bp, Homo sapiens
tattgtctgtaaatct

SEQ ID NO: 4775855 - DNA, 19 bp, Homo sapiens
tattgtgctttctatctaa

SEQ ID NO: 4775856 - DNA, 15 bp, Homo sapiens
tattgtgtaggaaat

SEQ ID NO: 4775857 - DNA, 14 bp, Homo sapiens
tattgttagatgtt

SEQ ID NO: 4775858 - DNA, 16 bp, Homo sapiens
tattgttgctgctttg

SEQ ID NO: 4775859 - DNA, 16 bp, Homo sapiens
tattgtttataggaaa

SEQ ID NO: 4775860 - DNA, 13 bp, Homo sapiens
tatttaaaatgta

SEQ ID NO: 4775861 - DNA, 20 bp, Homo sapiens
tatttaagtggactgtattt

SEQ ID NO: 4775862 - DNA, 15 bp, Homo sapiens
tatttacacaattta

SEQ ID NO: 4775863 - DNA, 16 bp, Homo sapiens
tatttactgcaatgtc

SEQ ID NO: 4775864 - DNA, 13 bp, Homo sapiens
tcaatgcttttct

SEQ ID NO: 4775865 - DNA, 22 bp, Homo sapiens
tcaatgtgaaactgagaccaag

SEQ ID NO: 4775866 - DNA, 13 bp, Homo sapiens
tcaatgtgaaata

SEQ ID NO: 4775867 - DNA, 17 bp, Homo sapiens
tcaatgtgaaataaaga

SEQ ID NO: 4775868 - DNA, 19 bp, Homo sapiens
tcaatgtgaaataaagagt

SEQ ID NO: 4775869 - DNA, 12 bp, Homo sapiens
tcaatgtgtgca

SEQ ID NO: 4775870 - DNA, 14 bp, Homo sapiens
tcaatgttaaatct

SEQ ID NO: 4775871 - DNA, 22 bp, Homo sapiens
tcaatgttcacgcaacttgaaa

SEQ ID NO: 4775872 - DNA, 14 bp, Homo sapiens
tcaattaatggaaa

SEQ ID NO: 4775873 - DNA, 20 bp, Homo sapiens
tcaattaatggaaaactgtt

SEQ ID NO: 4775874 - DNA, 17 bp, Homo sapiens
tcaattggacaattatt

SEQ ID NO: 4775875 - DNA, 13 bp, Homo sapiens
tcaatttaaagga

SEQ ID NO: 4775876 - DNA, 17 bp, Homo sapiens
tcaatttaaaggaaagt

SEQ ID NO: 4775877 - DNA, 23 bp, Homo sapiens
tcaatttggtttagaatgctgcg

SEQ ID NO: 4775878 - DNA, 16 bp, Homo sapiens
tcacaaagctatttaa

SEQ ID NO: 4775879 - DNA, 12 bp, Homo sapiens
tcacaactgttt

SEQ ID NO: 4775880 - DNA, 22 bp, Homo sapiens
tcacacaactgtggataaattt

SEQ ID NO: 4775881 - DNA, 14 bp, Homo sapiens
tcacacacacacac

SEQ ID NO: 4775882 - DNA, 14 bp, Homo sapiens
tcacaccctgcaag

SEQ ID NO: 4775883 - DNA, 17 bp, Homo sapiens
tcacaccctgcaaggcc

SEQ ID NO: 4775884 - DNA, 23 bp, Homo sapiens
tcacaccctgcaaggcccacagg

SEQ ID NO: 4775885 - DNA, 16 bp, Homo sapiens
tcacacctcccttcat

SEQ ID NO: 4775886 - DNA, 16 bp, Homo sapiens
tcacaccttacaaagc

SEQ ID NO: 4775887 - DNA, 18 bp, Homo sapiens
tcacaccttacaaagcca

SEQ ID NO: 4775888 - DNA, 21 bp, Homo sapiens
tcacaccttacaaagccagct

SEQ ID NO: 4775889 - DNA, 18 bp, Homo sapiens
tcacactctaactgtata

SEQ ID NO: 4775890 - DNA, 18 bp, Homo sapiens
tcacactctcttcttact

SEQ ID NO: 4775891 - DNA, 21 bp, Homo sapiens
tcacactgtgcgttttagagt

SEQ ID NO: 4775892 - DNA, 19 bp, Homo sapiens
tcacagacccctgggggag

SEQ ID NO: 4775893 - DNA, 20 bp, Homo sapiens
tcacagatttccaaaagtac

SEQ ID NO: 4775894 - DNA, 21 bp, Homo sapiens
tcacagatttccaaaagtact

SEQ ID NO: 4775895 - DNA, 16 bp, Homo sapiens
tcacagcacatttgtt

SEQ ID NO: 4775896 - DNA, 18 bp, Homo sapiens
tcacagcacatttgttaa

SEQ ID NO: 4775897 - DNA, 17 bp, Homo sapiens
tcacagccaccacctgg

SEQ ID NO: 4775898 - DNA, 18 bp, Homo sapiens
tcacagggtgttggaaga

SEQ ID NO: 4775899 - DNA, 17 bp, Homo sapiens
tcacagtgacccttccc

SEQ ID NO: 4775900 - DNA, 16 bp, Homo sapiens
tcacagttctctcctt

SEQ ID NO: 4775901 - DNA, 20 bp, Homo sapiens
tcacatatcaagtcccgagg

SEQ ID NO: 4775902 - DNA, 14 bp, Homo sapiens
tcacatctgtatat

SEQ ID NO: 4775903 - DNA, 20 bp, Homo sapiens
tcacatgacatccacatgca

SEQ ID NO: 4775904 - DNA, 21 bp, Homo sapiens
tcacatgacatccacatgcac

SEQ ID NO: 4775905 - DNA, 18 bp, Homo sapiens
tcacatgcccctcttaga

SEQ ID NO: 4775906 - DNA, 20 bp, Homo sapiens
tcacatgcccctcttagaag

SEQ ID NO: 4775907 - DNA, 13 bp, Homo sapiens
tcacatgtggcac

SEQ ID NO: 4775908 - DNA, 16 bp, Homo sapiens
tcaccaacaacagtca

SEQ ID NO: 4775909 - DNA, 23 bp, Homo sapiens
tcaccaacaacagtcagccagct

SEQ ID NO: 4775910 - DNA, 23 bp, Homo sapiens
tcaccacaaccctgttgctacat

SEQ ID NO: 4775911 - DNA, 16 bp, Homo sapiens
tcaccacgcagagagg

SEQ ID NO: 4775912 - DNA, 23 bp, Homo sapiens
tcaccacgcagagaggggaggtg

SEQ ID NO: 4775913 - DNA, 17 bp, Homo sapiens
tcaccagaaatgatagc

SEQ ID NO: 4775914 - DNA, 20 bp, Homo sapiens
tcaccatttaatcatttcca

SEQ ID NO: 4775915 - DNA, 21 bp, Homo sapiens
tcaccatttaatcatttccag

SEQ ID NO: 4775916 - DNA, 15 bp, Homo sapiens
tcaccccccgacctg

SEQ ID NO: 4775917 - DNA, 16 bp, Homo sapiens
tcaccctctgtccttc

SEQ ID NO: 4775918 - DNA, 23 bp, Homo sapiens
tcacccttgaaaactctcagtca

SEQ ID NO: 4775919 - DNA, 12 bp, Homo sapiens
tcacccttttct

SEQ ID NO: 4775920 - DNA, 21 bp, Homo sapiens
tcaccgattcttccttgccac

SEQ ID NO: 4775921 - DNA, 16 bp, Homo sapiens
tcaccgcattccaggg

SEQ ID NO: 4775922 - DNA, 18 bp, Homo sapiens
tcaccgcattccaggggc

SEQ ID NO: 4775923 - DNA, 15 bp, Homo sapiens
tcaccgccgtggggt

SEQ ID NO: 4775924 - DNA, 16 bp, Homo sapiens
tcaccgccgtggggtg

SEQ ID NO: 4775925 - DNA, 13 bp, Homo sapiens
tcaccggaggagc

SEQ ID NO: 4775926 - DNA, 17 bp, Homo sapiens
tcaccgtcacaataaaa

SEQ ID NO: 4775927 - DNA, 16 bp, Homo sapiens
tcacctaattaatttc

SEQ ID NO: 4775928 - DNA, 17 bp, Homo sapiens
tcacctaattaatttca

SEQ ID NO: 4775929 - DNA, 22 bp, Homo sapiens
tcacctgaataagggactttgg

SEQ ID NO: 4775930 - DNA, 16 bp, Homo sapiens
tcacctgcccctcaac

SEQ ID NO: 4775931 - DNA, 23 bp, Homo sapiens
tcacctggcttcccaggaccctg

SEQ ID NO: 4775932 - DNA, 13 bp, Homo sapiens
tcacctgtaaaac

SEQ ID NO: 4775933 - DNA, 16 bp, Homo sapiens
tcacctgtaaaacttt

SEQ ID NO: 4775934 - DNA, 17 bp, Homo sapiens
tcacctgtaaaacttta

SEQ ID NO: 4775935 - DNA, 13 bp, Homo sapiens
tcaccttcctggg

SEQ ID NO: 4775936 - DNA, 23 bp, Homo sapiens
tcaccttcctgggcagcccagag

SEQ ID NO: 4775937 - DNA, 17 bp, Homo sapiens
tcaccttccttgaaatt

SEQ ID NO: 4775938 - DNA, 14 bp, Homo sapiens
tcaccttctgtgca

SEQ ID NO: 4775939 - DNA, 16 bp, Homo sapiens
tcaccttctgtgcatc

SEQ ID NO: 4775940 - DNA, 14 bp, Homo sapiens
tcaccttctgtttt

SEQ ID NO: 4775941 - DNA, 15 bp, Homo sapiens
tcaccttctgtttta

SEQ ID NO: 4775942 - DNA, 13 bp, Homo sapiens
tcacgattcattt

SEQ ID NO: 4775943 - DNA, 13 bp, Homo sapiens
tcacgattccagt

SEQ ID NO: 4775944 - DNA, 14 bp, Homo sapiens
tcacgattccagtg

SEQ ID NO: 4775945 - DNA, 16 bp, Homo sapiens
tcacgcaacttgaaat

SEQ ID NO: 4775946 - DNA, 13 bp, Homo sapiens
tcacgtgaccctg

SEQ ID NO: 4775947 - DNA, 17 bp, Homo sapiens
tcacgtgaccctgtgcc

SEQ ID NO: 4775948 - DNA, 20 bp, Homo sapiens
tcactaaatatctagtgcta

SEQ ID NO: 4775949 - DNA, 22 bp, Homo sapiens
tcactaaatatctagtgctaaa

SEQ ID NO: 4775950 - DNA, 18 bp, Homo sapiens
tcactacaggttaaaaga

SEQ ID NO: 4775951 - DNA, 21 bp, Homo sapiens
tcactaccctcctgtaaaata

SEQ ID NO: 4775952 - DNA, 22 bp, Homo sapiens
tcactaccctcctgtaaaatac

SEQ ID NO: 4775953 - DNA, 19 bp, Homo sapiens
tcactataatgtgaaatgt

SEQ ID NO: 4775954 - DNA, 13 bp, Homo sapiens
tcactatgcattt

SEQ ID NO: 4775955 - DNA, 17 bp, Homo sapiens
tcactatggtatgctgg

SEQ ID NO: 4775956 - DNA, 21 bp, Homo sapiens
tcactatggtatgctggccag

SEQ ID NO: 4775957 - DNA, 22 bp, Homo sapiens
tcactatggtatgctggccagc

SEQ ID NO: 4775958 - DNA, 23 bp, Homo sapiens
tcactatggtatgctggccagca

SEQ ID NO: 4775959 - DNA, 13 bp, Homo sapiens
tcactccactccc

SEQ ID NO: 4775960 - DNA, 12 bp, Homo sapiens
tcactctgacag

SEQ ID NO: 4775961 - DNA, 13 bp, Homo sapiens
tcactctgtcagc

SEQ ID NO: 4775962 - DNA, 18 bp, Homo sapiens
tcactgcaacctccacct

SEQ ID NO: 4775963 - DNA, 18 bp, Homo sapiens
tcactgcaacctctgcct

SEQ ID NO: 4775964 - DNA, 22 bp, Homo sapiens
tcactgccactaaaatccaccc

SEQ ID NO: 4775965 - DNA, 12 bp, Homo sapiens
tcactgcccgca

SEQ ID NO: 4775966 - DNA, 15 bp, Homo sapiens
tcactgctttttcct

SEQ ID NO: 4775967 - DNA, 20 bp, Homo sapiens
tcactgctttttccttagct

SEQ ID NO: 4775968 - DNA, 20 bp, Homo sapiens
tcactgtattaaagatgcag

SEQ ID NO: 4775969 - DNA, 23 bp, Homo sapiens
tcactgtcttactcaagatactg

SEQ ID NO: 4775970 - DNA, 14 bp, Homo sapiens
tcactgtgtctcat

SEQ ID NO: 4775971 - DNA, 18 bp, Homo sapiens
tcacttaaactttgtcac

SEQ ID NO: 4775972 - DNA, 22 bp, Homo sapiens
tcacttctacgcataaactaga

SEQ ID NO: 4775973 - DNA, 20 bp, Homo sapiens
tcacttcttaaggacagtgt

SEQ ID NO: 4775974 - DNA, 22 bp, Homo sapiens
tcacttgtggcagcttccctga

SEQ ID NO: 4775975 - DNA, 21 bp, Homo sapiens
tcactttagaggcttgatcat

SEQ ID NO: 4775976 - DNA, 19 bp, Homo sapiens
tcactttgacacttttcat

SEQ ID NO: 4775977 - DNA, 17 bp, Homo sapiens
tcacttttttcctgtca

SEQ ID NO: 4775978 - DNA, 18 bp, Homo sapiens
tcacttttttcctgtcaa

SEQ ID NO: 4775979 - DNA, 21 bp, Homo sapiens
tcacttttttcctgtcaatat

SEQ ID NO: 4775980 - DNA, 22 bp, Homo sapiens
tcacttttttcctgtcaatata

SEQ ID NO: 4775981 - DNA, 12 bp, Homo sapiens
tcagaaaagcac

SEQ ID NO: 4775982 - DNA, 14 bp, Homo sapiens
tcagaacaaattca

SEQ ID NO: 4775983 - DNA, 16 bp, Homo sapiens
tcagaacaaattcagg

SEQ ID NO: 4775984 - DNA, 18 bp, Homo sapiens
tcagaacaccaagtaaat

SEQ ID NO: 4775985 - DNA, 18 bp, Homo sapiens
tccacacacagcagctcc

SEQ ID NO: 4775986 - DNA, 19 bp, Homo sapiens
tccacacacagcagctcca

SEQ ID NO: 4775987 - DNA, 21 bp, Homo sapiens
tccacacacagcagctccaac

SEQ ID NO: 4775988 - DNA, 17 bp, Homo sapiens
tccacagaacctttgtc

SEQ ID NO: 4775989 - DNA, 18 bp, Homo sapiens
tccacagaacctttgtca

SEQ ID NO: 4775990 - DNA, 19 bp, Homo sapiens
tccacagaacctttgtcaa

SEQ ID NO: 4775991 - DNA, 16 bp, Homo sapiens
tccacagtattgttct

SEQ ID NO: 4775992 - DNA, 18 bp, Homo sapiens
tccacatttccccctagc

SEQ ID NO: 4775993 - DNA, 13 bp, Homo sapiens
tccacccagccca

SEQ ID NO: 4775994 - DNA, 15 bp, Homo sapiens
tccacccctcaagcc

SEQ ID NO: 4775995 - DNA, 13 bp, Homo sapiens
tccaccctcccct

SEQ ID NO: 4775996 - DNA, 16 bp, Homo sapiens
tccaccctgccctggc

SEQ ID NO: 4775997 - DNA, 18 bp, Homo sapiens
tccaccgcagaaggaagg

SEQ ID NO: 4775998 - DNA, 12 bp, Homo sapiens
tccacctccccc

SEQ ID NO: 4775999 - DNA, 14 bp, Homo sapiens
tccacctcccccaa

SEQ ID NO: 4776000 - DNA, 22 bp, Homo sapiens
tccacctcccccaaaccctgct

SEQ ID NO: 4776001 - DNA, 21 bp, Homo sapiens
tccacctggaaagccaggttg

SEQ ID NO: 4776002 - DNA, 23 bp, Homo sapiens
tccacctgttactacttcttttt

SEQ ID NO: 4776003 - DNA, 14 bp, Homo sapiens
tccaccttaaatta

SEQ ID NO: 4776004 - DNA, 17 bp, Homo sapiens
tccaccttaaattaaac

SEQ ID NO: 4776005 - DNA, 17 bp, Homo sapiens
tccacgcctcctggcca

SEQ ID NO: 4776006 - DNA, 19 bp, Homo sapiens
tccacgcctcctggccaga

SEQ ID NO: 4776007 - DNA, 20 bp, Homo sapiens
tccactacaggttttatgag

SEQ ID NO: 4776008 - DNA, 19 bp, Homo sapiens
tccactaggtgcccagtct

SEQ ID NO: 4776009 - DNA, 15 bp, Homo sapiens
tccactcccctcatc

SEQ ID NO: 4776010 - DNA, 12 bp, Homo sapiens
tccactcctccc

SEQ ID NO: 4776011 - DNA, 22 bp, Homo sapiens
tccactcctcccaactctggcc

SEQ ID NO: 4776012 - DNA, 20 bp, Homo sapiens
tccacttctctagagaacat

SEQ ID NO: 4776013 - DNA, 14 bp, Homo sapiens
tccactttcctctc

SEQ ID NO: 4776014 - DNA, 18 bp, Homo sapiens
tccactttcctctctctc

SEQ ID NO: 4776015 - DNA, 14 bp, Homo sapiens
tccactttctagcc

SEQ ID NO: 4776016 - DNA, 19 bp, Homo sapiens
tccactttctagccagagg

SEQ ID NO: 4776017 - DNA, 20 bp, Homo sapiens
tccactttctagccagagga

SEQ ID NO: 4776018 - DNA, 21 bp, Homo sapiens
tccactttctagccagaggag

SEQ ID NO: 4776019 - DNA, 15 bp, Homo sapiens
tccagaaaaatcaat

SEQ ID NO: 4776020 - DNA, 21 bp, Homo sapiens
tccagaacaaaagataaaact

SEQ ID NO: 4776021 - DNA, 20 bp, Homo sapiens
tccagaacaaacctctatat

SEQ ID NO: 4776022 - DNA, 16 bp, Homo sapiens
tccagaactgtcttag

SEQ ID NO: 4776023 - DNA, 12 bp, Homo sapiens
tccagaagcagc

SEQ ID NO: 4776024 - DNA, 14 bp, Homo sapiens
tccagaagcagcag

SEQ ID NO: 4776025 - DNA, 22 bp, Homo sapiens
tccagaatgtatagacaggaaa

SEQ ID NO: 4776026 - DNA, 15 bp, Homo sapiens
tccagaatttcccaa

SEQ ID NO: 4776027 - DNA, 16 bp, Homo sapiens
tccagacaagccctgc

SEQ ID NO: 4776028 - DNA, 14 bp, Homo sapiens
tccagacaccatca

SEQ ID NO: 4776029 - DNA, 18 bp, Homo sapiens
tccagacagggtggggct

SEQ ID NO: 4776030 - DNA, 20 bp, Homo sapiens
tccagacccctaccctttcc

SEQ ID NO: 4776031 - DNA, 21 bp, Homo sapiens
tccagacttcgctattcccag

SEQ ID NO: 4776032 - DNA, 15 bp, Homo sapiens
tccagagaacccccc

SEQ ID NO: 4776033 - DNA, 17 bp, Homo sapiens
tccagagacctgctcca

SEQ ID NO: 4776034 - DNA, 23 bp, Homo sapiens
tccagagacctgctccagatcct

SEQ ID NO: 4776035 - DNA, 18 bp, Homo sapiens
tccagagagaagcacccc

SEQ ID NO: 4776036 - DNA, 20 bp, Homo sapiens
tccagagggttgtgattttg

SEQ ID NO: 4776037 - DNA, 22 bp, Homo sapiens
tccagagtaggtgggtcttgga

SEQ ID NO: 4776038 - DNA, 17 bp, Homo sapiens
tccagcaatgcctgcct

SEQ ID NO: 4776039 - DNA, 17 bp, Homo sapiens
tccagccctgggcacat

SEQ ID NO: 4776040 - DNA, 19 bp, Homo sapiens
tccagccttcttcccccag

SEQ ID NO: 4776041 - DNA, 18 bp, Homo sapiens
tccagcggggcttctggg

SEQ ID NO: 4776042 - DNA, 19 bp, Homo sapiens
tccagcggggcttctgggc

SEQ ID NO: 4776043 - DNA, 22 bp, Homo sapiens
tccagctaagcctgatgatgga

SEQ ID NO: 4776044 - DNA, 11 bp, Homo sapiens
tccagctcagt

SEQ ID NO: 4776045 - DNA, 18 bp, Homo sapiens
tccagctcagtcccacag

SEQ ID NO: 4776046 - DNA, 20 bp, Homo sapiens
tccagctcagtcccacagcc

SEQ ID NO: 4776047 - DNA, 22 bp, Homo sapiens
tccagctcagtcccacagcccc

SEQ ID NO: 4776048 - DNA, 23 bp, Homo sapiens
tccagctcagtcccacagcccct

SEQ ID NO: 4776049 - DNA, 11 bp, Homo sapiens
tccagctgctc

SEQ ID NO: 4776050 - DNA, 21 bp, Homo sapiens
tccagctttctctttgttctt

SEQ ID NO: 4776051 - DNA, 22 bp, Homo sapiens
tccagctttctctttgttcttc

SEQ ID NO: 4776052 - DNA, 16 bp, Homo sapiens
tccaggaaaactgttt

SEQ ID NO: 4776053 - DNA, 23 bp, Homo sapiens
tccaggaccttgcttccttctca

SEQ ID NO: 4776054 - DNA, 16 bp, Homo sapiens
tccaggagatgaggct

SEQ ID NO: 4776055 - DNA, 21 bp, Homo sapiens
tccaggaggactgttctaact

SEQ ID NO: 4776056 - DNA, 21 bp, Homo sapiens
tccaggattgtccacaaatgt

SEQ ID NO: 4776057 - DNA, 23 bp, Homo sapiens
tccaggattgtccacaaatgtcc

SEQ ID NO: 4776058 - DNA, 15 bp, Homo sapiens
tccaggcccagcctg

SEQ ID NO: 4776059 - DNA, 13 bp, Homo sapiens
tccaggctagtcc

SEQ ID NO: 4776060 - DNA, 17 bp, Homo sapiens
tccaggggtttacagtg

SEQ ID NO: 4776061 - DNA, 13 bp, Homo sapiens
tccagggtccagc

SEQ ID NO: 4776062 - DNA, 22 bp, Homo sapiens
tccaggtgatcccccaaacagc

SEQ ID NO: 4776063 - DNA, 18 bp, Homo sapiens
tccaggttccatccacca

SEQ ID NO: 4776064 - DNA, 13 bp, Homo sapiens
tccaggttcctca

SEQ ID NO: 4776065 - DNA, 23 bp, Homo sapiens
tccagtataaattacatgcatga

SEQ ID NO: 4776066 - DNA, 16 bp, Homo sapiens
tccagtccaattttcc

SEQ ID NO: 4776067 - DNA, 18 bp, Homo sapiens
tccagtccaattttccta

SEQ ID NO: 4776068 - DNA, 22 bp, Homo sapiens
tccagtccccctatccttggca

SEQ ID NO: 4776069 - DNA, 23 bp, Homo sapiens
tccagtccccctatccttggcac

SEQ ID NO: 4776070 - DNA, 19 bp, Homo sapiens
tccagtgctgctcccttta

SEQ ID NO: 4776071 - DNA, 20 bp, Homo sapiens
tccagtgctttatccacatt

SEQ ID NO: 4776072 - DNA, 16 bp, Homo sapiens
tccagtgtattttctg

SEQ ID NO: 4776073 - DNA, 12 bp, Homo sapiens
tccagtttctct

SEQ ID NO: 4776074 - DNA, 18 bp, Homo sapiens
tccataccccctgcccca

SEQ ID NO: 4776075 - DNA, 23 bp, Homo sapiens
tccataccccctgccccagagaa

SEQ ID NO: 4776076 - DNA, 16 bp, Homo sapiens
tccatcaaagccctcc

SEQ ID NO: 4776077 - DNA, 16 bp, Homo sapiens
tccatcagctttataa

SEQ ID NO: 4776078 - DNA, 17 bp, Homo sapiens
tccatccaccaccttgc

SEQ ID NO: 4776079 - DNA, 19 bp, Homo sapiens
tccatccgtctctgtccgc

SEQ ID NO: 4776080 - DNA, 13 bp, Homo sapiens
tccatctcaacct

SEQ ID NO: 4776081 - DNA, 21 bp, Homo sapiens
tccatctcttgtaccagccca

SEQ ID NO: 4776082 - DNA, 23 bp, Homo sapiens
tccatgaattaaatctgtttcct

SEQ ID NO: 4776083 - DNA, 23 bp, Homo sapiens
tccatgacagtagcatactgatg

SEQ ID NO: 4776084 - DNA, 14 bp, Homo sapiens
tccatgatcaaaat

SEQ ID NO: 4776085 - DNA, 18 bp, Homo sapiens
tccatgcagatctagcca

SEQ ID NO: 4776086 - DNA, 20 bp, Homo sapiens
tccatgcagatctagccagg

SEQ ID NO: 4776087 - DNA, 19 bp, Homo sapiens
tccatgctctttcaccctg

SEQ ID NO: 4776088 - DNA, 16 bp, Homo sapiens
tccatgggagcaaata

SEQ ID NO: 4776089 - DNA, 13 bp, Homo sapiens
tccatggtggttt

SEQ ID NO: 4776090 - DNA, 23 bp, Homo sapiens
tccatgtgataattgtaaaggtg

SEQ ID NO: 4776091 - DNA, 12 bp, Homo sapiens
tccatgtgtccc

SEQ ID NO: 4776092 - DNA, 19 bp, Homo sapiens
tccattaaacttctactga

SEQ ID NO: 4776093 - DNA, 16 bp, Homo sapiens
tccattaatgtagata

SEQ ID NO: 4776094 - DNA, 17 bp, Homo sapiens
tccattaatttaaatga

SEQ ID NO: 4776095 - DNA, 14 bp, Homo sapiens
tccattcagtctgc

SEQ ID NO: 4776096 - DNA, 19 bp, Homo sapiens
tccattccaatacattgaa

SEQ ID NO: 4776097 - DNA, 12 bp, Homo sapiens
tccattctatga

SEQ ID NO: 4776098 - DNA, 23 bp, Homo sapiens
tccattctccaggggtttacagt

SEQ ID NO: 4776099 - DNA, 13 bp, Homo sapiens
tccattgtatctt

SEQ ID NO: 4776100 - DNA, 19 bp, Homo sapiens
tccatttaaaacaagctga

SEQ ID NO: 4776101 - DNA, 20 bp, Homo sapiens
tccatttaaaacaagctgat

SEQ ID NO: 4776102 - DNA, 11 bp, Homo sapiens
tccatttggat

SEQ ID NO: 4776103 - DNA, 18 bp, Homo sapiens
tccatttggattttaaac

SEQ ID NO: 4776104 - DNA, 18 bp, Homo sapiens
tcccaaacccttcagtgc

SEQ ID NO: 4776105 - DNA, 14 bp, Homo sapiens
tcccaaacccttcg

SEQ ID NO: 4776106 - DNA, 23 bp, Homo sapiens
tcctcggccctgtagccctggcc

SEQ ID NO: 4776107 - DNA, 15 bp, Homo sapiens
tcctcgggcgcctgc

SEQ ID NO: 4776108 - DNA, 19 bp, Homo sapiens
tcctcgtccggcctgcagc

SEQ ID NO: 4776109 - DNA, 21 bp, Homo sapiens
tcctctaagatcttgcctctt

SEQ ID NO: 4776110 - DNA, 17 bp, Homo sapiens
tcctctcaaacctggca

SEQ ID NO: 4776111 - DNA, 22 bp, Homo sapiens
tcctctcaaacctggcagatgg

SEQ ID NO: 4776112 - DNA, 13 bp, Homo sapiens
tcctctcctctct

SEQ ID NO: 4776113 - DNA, 13 bp, Homo sapiens
tcctctcgagccc

SEQ ID NO: 4776114 - DNA, 17 bp, Homo sapiens
tcctctcgagcccagat

SEQ ID NO: 4776115 - DNA, 20 bp, Homo sapiens
tcctctcgtagaacctgcgc

SEQ ID NO: 4776116 - DNA, 15 bp, Homo sapiens
tcctctctctctctc

SEQ ID NO: 4776117 - DNA, 21 bp, Homo sapiens
tcctctgaggatgatgtactt

SEQ ID NO: 4776118 - DNA, 14 bp, Homo sapiens
tcctctgcagcctg

SEQ ID NO: 4776119 - DNA, 18 bp, Homo sapiens
tcctctgcagcctgagct

SEQ ID NO: 4776120 - DNA, 19 bp, Homo sapiens
tcctctgcccgcgggtggc

SEQ ID NO: 4776121 - DNA, 19 bp, Homo sapiens
tcctctgtcagtttgtgaa

SEQ ID NO: 4776122 - DNA, 21 bp, Homo sapiens
tcctctgtccgtctgtcctgc

SEQ ID NO: 4776123 - DNA, 23 bp, Homo sapiens
tcctctgtccgtctgtcctgcgc

SEQ ID NO: 4776124 - DNA, 22 bp, Homo sapiens
tcctctgttatttgtcctcatg

SEQ ID NO: 4776125 - DNA, 12 bp, Homo sapiens
tcctcttacctg

SEQ ID NO: 4776126 - DNA, 13 bp, Homo sapiens
tcctcttacctgt

SEQ ID NO: 4776127 - DNA, 19 bp, Homo sapiens
tcctcttatatgtgcccct

SEQ ID NO: 4776128 - DNA, 17 bp, Homo sapiens
tcctcttcctgcctctc

SEQ ID NO: 4776129 - DNA, 14 bp, Homo sapiens
tcctctttccccac

SEQ ID NO: 4776130 - DNA, 15 bp, Homo sapiens
tcctgaagaattgaa

SEQ ID NO: 4776131 - DNA, 20 bp, Homo sapiens
tcctgacagcgccatgtgtg

SEQ ID NO: 4776132 - DNA, 14 bp, Homo sapiens
tcctgactgtccta

SEQ ID NO: 4776133 - DNA, 16 bp, Homo sapiens
tcctgactgttctctt

SEQ ID NO: 4776134 - DNA, 18 bp, Homo sapiens
tcctgactgttctcttac

SEQ ID NO: 4776135 - DNA, 15 bp, Homo sapiens
tcctgagccccctgc

SEQ ID NO: 4776136 - DNA, 16 bp, Homo sapiens
tcctgagccccctgca

SEQ ID NO: 4776137 - DNA, 19 bp, Homo sapiens
tcctgagccccctgcaccc

SEQ ID NO: 4776138 - DNA, 15 bp, Homo sapiens
tcctgagctaacact

SEQ ID NO: 4776139 - DNA, 16 bp, Homo sapiens
tcctgaggtcatctgt

SEQ ID NO: 4776140 - DNA, 19 bp, Homo sapiens
tcctgatcaaggtgctctt

SEQ ID NO: 4776141 - DNA, 15 bp, Homo sapiens
tcctgcaatgggaga

SEQ ID NO: 4776142 - DNA, 16 bp, Homo sapiens
tcctgcaccctctgct

SEQ ID NO: 4776143 - DNA, 17 bp, Homo sapiens
tcctgcactgtcccgga

SEQ ID NO: 4776144 - DNA, 16 bp, Homo sapiens
tcctgcagtctgtgga

SEQ ID NO: 4776145 - DNA, 18 bp, Homo sapiens
tcctgcatccctccaccc

SEQ ID NO: 4776146 - DNA, 21 bp, Homo sapiens
tcctgcatccctccaccccag

SEQ ID NO: 4776147 - DNA, 21 bp, Homo sapiens
tcctgcatgtcggggcccctg

SEQ ID NO: 4776148 - DNA, 20 bp, Homo sapiens
tcctgcccatgtgtcccctc

SEQ ID NO: 4776149 - DNA, 14 bp, Homo sapiens
tcctgcctcagcct

SEQ ID NO: 4776150 - DNA, 16 bp, Homo sapiens
tcctgctacctttgtc

SEQ ID NO: 4776151 - DNA, 15 bp, Homo sapiens
tcctgctcgccctgt

SEQ ID NO: 4776152 - DNA, 17 bp, Homo sapiens
tcctgctcgccctgtgc

SEQ ID NO: 4776153 - DNA, 16 bp, Homo sapiens
tcctgctgctcgggaa

SEQ ID NO: 4776154 - DNA, 23 bp, Homo sapiens
tcctgctgctcgggaaggcctga

SEQ ID NO: 4776155 - DNA, 13 bp, Homo sapiens
tcctgctgtggaa

SEQ ID NO: 4776156 - DNA, 16 bp, Homo sapiens
tcctggaaatttgtgt

SEQ ID NO: 4776157 - DNA, 22 bp, Homo sapiens
tcctggacagtgagagcagggc

SEQ ID NO: 4776158 - DNA, 21 bp, Homo sapiens
tcctggagggaagcactgcct

SEQ ID NO: 4776159 - DNA, 22 bp, Homo sapiens
tcctggcatgggaatgaatgtc

SEQ ID NO: 4776160 - DNA, 12 bp, Homo sapiens
tcctggctcaca

SEQ ID NO: 4776161 - DNA, 14 bp, Homo sapiens
tcctggctcccagg

SEQ ID NO: 4776162 - DNA, 15 bp, Homo sapiens
tcctggctcccaggg

SEQ ID NO: 4776163 - DNA, 20 bp, Homo sapiens
tcctggcttttaaacctgtt

SEQ ID NO: 4776164 - DNA, 21 bp, Homo sapiens
tcctgggcaacagagtgagac

SEQ ID NO: 4776165 - DNA, 14 bp, Homo sapiens
tcctgggcagccca

SEQ ID NO: 4776166 - DNA, 14 bp, Homo sapiens
tcctgggggctgct

SEQ ID NO: 4776167 - DNA, 13 bp, Homo sapiens
tcctgggggtggc

SEQ ID NO: 4776168 - DNA, 22 bp, Homo sapiens
tcctggggtggttggaggcctg

SEQ ID NO: 4776169 - DNA, 15 bp, Homo sapiens
tcctggtgtggaaga

SEQ ID NO: 4776170 - DNA, 21 bp, Homo sapiens
tcctgtaactgttacagtaat

SEQ ID NO: 4776171 - DNA, 16 bp, Homo sapiens
tcctgtaattttgtag

SEQ ID NO: 4776172 - DNA, 16 bp, Homo sapiens
tcctgtcctgctcacg

SEQ ID NO: 4776173 - DNA, 17 bp, Homo sapiens
tcctgtcctgctcacgt

SEQ ID NO: 4776174 - DNA, 19 bp, Homo sapiens
tcctgtcctggctcccagg

SEQ ID NO: 4776175 - DNA, 17 bp, Homo sapiens
tcctgtctcctctgtca

SEQ ID NO: 4776176 - DNA, 18 bp, Homo sapiens
tcctgtctcctctgtcag

SEQ ID NO: 4776177 - DNA, 20 bp, Homo sapiens
tcctgtctcctctgtcagtt

SEQ ID NO: 4776178 - DNA, 15 bp, Homo sapiens
tcctgtgagatgtgt

SEQ ID NO: 4776179 - DNA, 17 bp, Homo sapiens
tcctgtgagatgtgtat

SEQ ID NO: 4776180 - DNA, 22 bp, Homo sapiens
tcctgtgagatgtgtatcagtg

SEQ ID NO: 4776181 - DNA, 11 bp, Homo sapiens
tcctgtgagga

SEQ ID NO: 4776182 - DNA, 22 bp, Homo sapiens
tcctgtgtctggtccacacacc

SEQ ID NO: 4776183 - DNA, 19 bp, Homo sapiens
tcctgttcccatgagatga

SEQ ID NO: 4776184 - DNA, 21 bp, Homo sapiens
tcctgtttcccttcccttcca

SEQ ID NO: 4776185 - DNA, 16 bp, Homo sapiens
tcctgttttcacacct

SEQ ID NO: 4776186 - DNA, 20 bp, Homo sapiens
tcctgttttcacaccttaca

SEQ ID NO: 4776187 - DNA, 19 bp, Homo sapiens
tccttaaaaagaccatgca

SEQ ID NO: 4776188 - DNA, 17 bp, Homo sapiens
tccttaaaaatgtatgt

SEQ ID NO: 4776189 - DNA, 13 bp, Homo sapiens
tccttaagagatt

SEQ ID NO: 4776190 - DNA, 13 bp, Homo sapiens
tccttaataacta

SEQ ID NO: 4776191 - DNA, 12 bp, Homo sapiens
tccttagctagt

SEQ ID NO: 4776192 - DNA, 19 bp, Homo sapiens
tccttcacccaccaccccc

SEQ ID NO: 4776193 - DNA, 15 bp, Homo sapiens
tccttcatgcttttc

SEQ ID NO: 4776194 - DNA, 18 bp, Homo sapiens
tccttcatgcttttctca

SEQ ID NO: 4776195 - DNA, 16 bp, Homo sapiens
tccttcccaaggcagc

SEQ ID NO: 4776196 - DNA, 18 bp, Homo sapiens
tccttcccaaggcagctg

SEQ ID NO: 4776197 - DNA, 18 bp, Homo sapiens
tccttcccgcagcaccag

SEQ ID NO: 4776198 - DNA, 14 bp, Homo sapiens
tccttctcatcttg

SEQ ID NO: 4776199 - DNA, 12 bp, Homo sapiens
tccttctcccct

SEQ ID NO: 4776200 - DNA, 18 bp, Homo sapiens
tccttctcccctccagac

SEQ ID NO: 4776201 - DNA, 20 bp, Homo sapiens
tccttctgcagtcagactga

SEQ ID NO: 4776202 - DNA, 20 bp, Homo sapiens
tccttctggcctttcctctc

SEQ ID NO: 4776203 - DNA, 16 bp, Homo sapiens
tccttgaaatttctca

SEQ ID NO: 4776204 - DNA, 17 bp, Homo sapiens
tccttgaccttcctctg

SEQ ID NO: 4776205 - DNA, 19 bp, Homo sapiens
tccttgaccttcctctggg

SEQ ID NO: 4776206 - DNA, 21 bp, Homo sapiens
tccttgaccttcctctggggc

SEQ ID NO: 4776207 - DNA, 22 bp, Homo sapiens
tccttgaccttcctctggggct

SEQ ID NO: 4776208 - DNA, 16 bp, Homo sapiens
tccttggcaccaaaga

SEQ ID NO: 4776209 - DNA, 16 bp, Homo sapiens
tccttggcccagcagc

SEQ ID NO: 4776210 - DNA, 21 bp, Homo sapiens
tccttggttatatttttttaa

SEQ ID NO: 4776211 - DNA, 17 bp, Homo sapiens
tccttggttttgcctct

SEQ ID NO: 4776212 - DNA, 15 bp, Homo sapiens
tccttgtacttgaat

SEQ ID NO: 4776213 - DNA, 17 bp, Homo sapiens
tccttgtacttgaataa

SEQ ID NO: 4776214 - DNA, 21 bp, Homo sapiens
tccttgtgtatcctgacagcg

SEQ ID NO: 4776215 - DNA, 23 bp, Homo sapiens
tccttgtttgcctttaggcagga

SEQ ID NO: 4776216 - DNA, 13 bp, Homo sapiens
tcctttatgtatt

SEQ ID NO: 4776217 - DNA, 13 bp, Homo sapiens
tcctttccatcag

SEQ ID NO: 4776218 - DNA, 14 bp, Homo sapiens
tcctttcctctcct

SEQ ID NO: 4776219 - DNA, 21 bp, Homo sapiens
tcctttcctctcctctctgga

SEQ ID NO: 4776220 - DNA, 19 bp, Homo sapiens
tcctttctaaggagcacta

SEQ ID NO: 4776221 - DNA, 13 bp, Homo sapiens
tcctttctctctt

SEQ ID NO: 4776222 - DNA, 12 bp, Homo sapiens
tcctttctggaa

SEQ ID NO: 4776223 - DNA, 16 bp, Homo sapiens
tcctttgtcaaatggt

SEQ ID NO: 4776224 - DNA, 14 bp, Homo sapiens
tccttttttccttt

SEQ ID NO: 4776225 - DNA, 20 bp, Homo sapiens
tccttttttcctttcctgat

SEQ ID NO: 4776226 - DNA, 17 bp, Homo sapiens
tccttttttcctttctt

SEQ ID NO: 4776227 - DNA, 14 bp, Homo sapiens
tcgaatcactcatt

SEQ ID NO: 4776228 - DNA, 20 bp, Homo sapiens
tgccttctgacggccctgca

SEQ ID NO: 4776229 - DNA, 13 bp, Homo sapiens
tgccttctgggga

SEQ ID NO: 4776230 - DNA, 23 bp, Homo sapiens
tgccttgttgtattcctgccttt

SEQ ID NO: 4776231 - DNA, 14 bp, Homo sapiens
tgcctttaggcagg

SEQ ID NO: 4776232 - DNA, 20 bp, Homo sapiens
tgcctttccagtgctgctcc

SEQ ID NO: 4776233 - DNA, 15 bp, Homo sapiens
tgcctttctagcaat

SEQ ID NO: 4776234 - DNA, 13 bp, Homo sapiens
tgcctttgatgtg

SEQ ID NO: 4776235 - DNA, 23 bp, Homo sapiens
tgccttttgggtttgccttaatt

SEQ ID NO: 4776236 - DNA, 14 bp, Homo sapiens
tgcgaccaccactt

SEQ ID NO: 4776237 - DNA, 22 bp, Homo sapiens
tgcgacggaggcaggaccaggc

SEQ ID NO: 4776238 - DNA, 22 bp, Homo sapiens
tgcgcagccgcgctctgcccct

SEQ ID NO: 4776239 - DNA, 15 bp, Homo sapiens
tgcgcccctgcccag

SEQ ID NO: 4776240 - DNA, 16 bp, Homo sapiens
tgcgcccctgcccagc

SEQ ID NO: 4776241 - DNA, 17 bp, Homo sapiens
tgcgcccctgcccagca

SEQ ID NO: 4776242 - DNA, 11 bp, Homo sapiens
tgcgccctccc

SEQ ID NO: 4776243 - DNA, 17 bp, Homo sapiens
tgcgccctccctccctc

SEQ ID NO: 4776244 - DNA, 18 bp, Homo sapiens
tgcgcctgcgcctcctcc

SEQ ID NO: 4776245 - DNA, 19 bp, Homo sapiens
tgcgctcctctgcagcctg

SEQ ID NO: 4776246 - DNA, 14 bp, Homo sapiens
tgcgctctgggttt

SEQ ID NO: 4776247 - DNA, 17 bp, Homo sapiens
tgcgctcttcaccagga

SEQ ID NO: 4776248 - DNA, 19 bp, Homo sapiens
tgcgctcttcaccaggaag

SEQ ID NO: 4776249 - DNA, 19 bp, Homo sapiens
tgcggaccggagcggctga

SEQ ID NO: 4776250 - DNA, 23 bp, Homo sapiens
tgcggaccggagcggctgaggac

SEQ ID NO: 4776251 - DNA, 13 bp, Homo sapiens
tgcggcaccgccc

SEQ ID NO: 4776252 - DNA, 19 bp, Homo sapiens
tgcggcaccgcccacccac

SEQ ID NO: 4776253 - DNA, 20 bp, Homo sapiens
tgcggcaccgcccacccaca

SEQ ID NO: 4776254 - DNA, 17 bp, Homo sapiens
tgcgtgtggccctgtgg

SEQ ID NO: 4776255 - DNA, 21 bp, Homo sapiens
tgctaaagtcaggccattcag

SEQ ID NO: 4776256 - DNA, 16 bp, Homo sapiens
tgctaaatgacttatt

SEQ ID NO: 4776257 - DNA, 19 bp, Homo sapiens
tgctaaatgcaaacactgt

SEQ ID NO: 4776258 - DNA, 15 bp, Homo sapiens
tgctacaaaatgtgt

SEQ ID NO: 4776259 - DNA, 20 bp, Homo sapiens
tgctacactcgtccccctcc

SEQ ID NO: 4776260 - DNA, 12 bp, Homo sapiens
tgctactcagta

SEQ ID NO: 4776261 - DNA, 16 bp, Homo sapiens
tgctagtgagctgggc

SEQ ID NO: 4776262 - DNA, 19 bp, Homo sapiens
tgctagtgagctgggcatg

SEQ ID NO: 4776263 - DNA, 12 bp, Homo sapiens
tgctagttctta

SEQ ID NO: 4776264 - DNA, 16 bp, Homo sapiens
tgctatggactgcaca

SEQ ID NO: 4776265 - DNA, 15 bp, Homo sapiens
tgctatgtctgtgat

SEQ ID NO: 4776266 - DNA, 13 bp, Homo sapiens
tgctattaatatt

SEQ ID NO: 4776267 - DNA, 19 bp, Homo sapiens
tgctattgtttataggaaa

SEQ ID NO: 4776268 - DNA, 13 bp, Homo sapiens
tgctcaaaatgca

SEQ ID NO: 4776269 - DNA, 12 bp, Homo sapiens
tgctcaatgtgc

SEQ ID NO: 4776270 - DNA, 13 bp, Homo sapiens
tgctcaatgtgct

SEQ ID NO: 4776271 - DNA, 14 bp, Homo sapiens
tgctcagccccaga

SEQ ID NO: 4776272 - DNA, 20 bp, Homo sapiens
tgctcagccccagacctgcc

SEQ ID NO: 4776273 - DNA, 12 bp, Homo sapiens
tgctcagtattg

SEQ ID NO: 4776274 - DNA, 22 bp, Homo sapiens
tgctcagtattgagacactgtc

SEQ ID NO: 4776275 - DNA, 14 bp, Homo sapiens
tgctcatctacaca

SEQ ID NO: 4776276 - DNA, 16 bp, Homo sapiens
tgctcatctacacata

SEQ ID NO: 4776277 - DNA, 17 bp, Homo sapiens
tgctcatctacacatat

SEQ ID NO: 4776278 - DNA, 21 bp, Homo sapiens
tgctcatctacacatataaac

SEQ ID NO: 4776279 - DNA, 13 bp, Homo sapiens
tgctccatgcaga

SEQ ID NO: 4776280 - DNA, 21 bp, Homo sapiens
tgctccatgcagatctagcca

SEQ ID NO: 4776281 - DNA, 14 bp, Homo sapiens
tgctccctgctccc

SEQ ID NO: 4776282 - DNA, 18 bp, Homo sapiens
tgctcctagtttgacctc

SEQ ID NO: 4776283 - DNA, 19 bp, Homo sapiens
tgctcctcactgcccgcac

SEQ ID NO: 4776284 - DNA, 20 bp, Homo sapiens
tgctcctccagtacaataaa

SEQ ID NO: 4776285 - DNA, 16 bp, Homo sapiens
tgctcctttccatcag

SEQ ID NO: 4776286 - DNA, 17 bp, Homo sapiens
tgctcctttccatcagc

SEQ ID NO: 4776287 - DNA, 18 bp, Homo sapiens
tgctcctttcttgtttta

SEQ ID NO: 4776288 - DNA, 14 bp, Homo sapiens
tgctccttttctct

SEQ ID NO: 4776289 - DNA, 15 bp, Homo sapiens
tgctccttttctctt

SEQ ID NO: 4776290 - DNA, 12 bp, Homo sapiens
tgctcggacaca

SEQ ID NO: 4776291 - DNA, 14 bp, Homo sapiens
tgctcggacacagt

SEQ ID NO: 4776292 - DNA, 22 bp, Homo sapiens
tgctcggacacagttttgtctt

SEQ ID NO: 4776293 - DNA, 12 bp, Homo sapiens
tgctctcccagg

SEQ ID NO: 4776294 - DNA, 23 bp, Homo sapiens
tgctctcccctccctttttaaac

SEQ ID NO: 4776295 - DNA, 18 bp, Homo sapiens
tgctctgagaagaggagc

SEQ ID NO: 4776296 - DNA, 23 bp, Homo sapiens
tgctctgagaagaggagccctca

SEQ ID NO: 4776297 - DNA, 18 bp, Homo sapiens
tgctctggaaaacctgag

SEQ ID NO: 4776298 - DNA, 19 bp, Homo sapiens
tgctctgtggtaagagata

SEQ ID NO: 4776299 - DNA, 15 bp, Homo sapiens
tgctcttaagtacca

SEQ ID NO: 4776300 - DNA, 15 bp, Homo sapiens
tgctcttctgttctc

SEQ ID NO: 4776301 - DNA, 18 bp, Homo sapiens
tgctctttcaccctgcca

SEQ ID NO: 4776302 - DNA, 23 bp, Homo sapiens
tgctctttcaccctgccaccctc

SEQ ID NO: 4776303 - DNA, 16 bp, Homo sapiens
tgctgaagaatctact

SEQ ID NO: 4776304 - DNA, 16 bp, Homo sapiens
tgctgaataacaacaa

SEQ ID NO: 4776305 - DNA, 19 bp, Homo sapiens
tgctgaataacaacaattt

SEQ ID NO: 4776306 - DNA, 21 bp, Homo sapiens
tgctgagatgtttagtagctg

SEQ ID NO: 4776307 - DNA, 22 bp, Homo sapiens
tgctgcaaagagttatatgact

SEQ ID NO: 4776308 - DNA, 22 bp, Homo sapiens
tgctgcctccaagtcatgggag

SEQ ID NO: 4776309 - DNA, 15 bp, Homo sapiens
tgctgcctgccatgt

SEQ ID NO: 4776310 - DNA, 14 bp, Homo sapiens
tgctgcctgcctcc

SEQ ID NO: 4776311 - DNA, 20 bp, Homo sapiens
tgctgccttctgacggccct

SEQ ID NO: 4776312 - DNA, 19 bp, Homo sapiens
tgctgcgcttaccttccca

SEQ ID NO: 4776313 - DNA, 13 bp, Homo sapiens
tgctgcttctccc

SEQ ID NO: 4776314 - DNA, 16 bp, Homo sapiens
tgctgcttctccctgg

SEQ ID NO: 4776315 - DNA, 13 bp, Homo sapiens
tgctgctttgggg

SEQ ID NO: 4776316 - DNA, 13 bp, Homo sapiens
tgctgcttttgat

SEQ ID NO: 4776317 - DNA, 15 bp, Homo sapiens
tgctggaaaactgcc

SEQ ID NO: 4776318 - DNA, 14 bp, Homo sapiens
tgctggccagcacc

SEQ ID NO: 4776319 - DNA, 15 bp, Homo sapiens
tgctggccagcaccc

SEQ ID NO: 4776320 - DNA, 20 bp, Homo sapiens
tgctggccagcaccctctcc

SEQ ID NO: 4776321 - DNA, 23 bp, Homo sapiens
tgctggccagcctggggcctggc

SEQ ID NO: 4776322 - DNA, 23 bp, Homo sapiens
tgctgggccggggtgtggaatca

SEQ ID NO: 4776323 - DNA, 14 bp, Homo sapiens
tgctgggtgggaat

SEQ ID NO: 4776324 - DNA, 18 bp, Homo sapiens
tgctgtaaataaaaatag

SEQ ID NO: 4776325 - DNA, 16 bp, Homo sapiens
tgctgtagacatctgt

SEQ ID NO: 4776326 - DNA, 13 bp, Homo sapiens
tgctgtccctgtg

SEQ ID NO: 4776327 - DNA, 16 bp, Homo sapiens
tgctgtccctgtgggc

SEQ ID NO: 4776328 - DNA, 18 bp, Homo sapiens
tgctgtccctgtgggctc

SEQ ID NO: 4776329 - DNA, 20 bp, Homo sapiens
tgctgtccctgtgggctcac

SEQ ID NO: 4776330 - DNA, 14 bp, Homo sapiens
tgctgtgaaacagt

SEQ ID NO: 4776331 - DNA, 16 bp, Homo sapiens
tgctgtgaaatgactg

SEQ ID NO: 4776332 - DNA, 21 bp, Homo sapiens
tgctgtgggcagcaccctccc

SEQ ID NO: 4776333 - DNA, 13 bp, Homo sapiens
tgctgttcattga

SEQ ID NO: 4776334 - DNA, 21 bp, Homo sapiens
tgctgtttaccgcccacccag

SEQ ID NO: 4776335 - DNA, 15 bp, Homo sapiens
tgcttaaaatgcaag

SEQ ID NO: 4776336 - DNA, 18 bp, Homo sapiens
tgcttaaatgatcaagga

SEQ ID NO: 4776337 - DNA, 23 bp, Homo sapiens
tgcttaatctagagctatgcaca

SEQ ID NO: 4776338 - DNA, 13 bp, Homo sapiens
tgcttagcaaaaa

SEQ ID NO: 4776339 - DNA, 17 bp, Homo sapiens
tgcttatattgttttca

SEQ ID NO: 4776340 - DNA, 12 bp, Homo sapiens
tgcttcacacaa

SEQ ID NO: 4776341 - DNA, 15 bp, Homo sapiens
tgcttcacacaaagt

SEQ ID NO: 4776342 - DNA, 22 bp, Homo sapiens
tgcttcacacaaagtgaaatta

SEQ ID NO: 4776343 - DNA, 16 bp, Homo sapiens
tgcttcattaaaacaa

SEQ ID NO: 4776344 - DNA, 17 bp, Homo sapiens
tgcttcattaaaacaag

SEQ ID NO: 4776345 - DNA, 21 bp, Homo sapiens
tgcttcattcaagcttcatat

SEQ ID NO: 4776346 - DNA, 22 bp, Homo sapiens
tgcttccgagattcagactgct

SEQ ID NO: 4776347 - DNA, 24 bp, Homo sapiens
tgcttctaagggatccagagacct

SEQ ID NO: 4776348 - DNA, 22 bp, Homo sapiens
tgcttctcacactggaggagca

SEQ ID NO: 4776349 - DNA, 13 bp, Homo sapiens
tgcttctccacct

SEQ ID NO: 4776350 - DNA, 16 bp, Homo sapiens
tgggaatgaatgtcag

SEQ ID NO: 4776351 - DNA, 23 bp, Homo sapiens
tgggaatgcgctcttcaccagga

SEQ ID NO: 4776352 - DNA, 11 bp, Homo sapiens
tgggacagagg

SEQ ID NO: 4776353 - DNA, 18 bp, Homo sapiens
tgggacagaggagcaagg

SEQ ID NO: 4776354 - DNA, 16 bp, Homo sapiens
tgggacagccactgga

SEQ ID NO: 4776355 - DNA, 19 bp, Homo sapiens
tgggacgctggtaactgtt

SEQ ID NO: 4776356 - DNA, 21 bp, Homo sapiens
tgggactgctcaggctcccca

SEQ ID NO: 4776357 - DNA, 17 bp, Homo sapiens
tgggactggcccacccc

SEQ ID NO: 4776358 - DNA, 18 bp, Homo sapiens
tgggactggcccacccct

SEQ ID NO: 4776359 - DNA, 15 bp, Homo sapiens
tgggagaaaagccag

SEQ ID NO: 4776360 - DNA, 16 bp, Homo sapiens
tgggagactgagcttg

SEQ ID NO: 4776361 - DNA, 15 bp, Homo sapiens
tgggagagcccctgg

SEQ ID NO: 4776362 - DNA, 19 bp, Homo sapiens
tgggagaggagaggctgct

SEQ ID NO: 4776363 - DNA, 14 bp, Homo sapiens
tgggagatgcagct

SEQ ID NO: 4776364 - DNA, 13 bp, Homo sapiens
tgggagcaaaaga

SEQ ID NO: 4776365 - DNA, 16 bp, Homo sapiens
tgggagccacagggac

SEQ ID NO: 4776366 - DNA, 17 bp, Homo sapiens
tgggagccgtcagcctg

SEQ ID NO: 4776367 - DNA, 20 bp, Homo sapiens
tgggagtccactttcctctc

SEQ ID NO: 4776368 - DNA, 21 bp, Homo sapiens
tgggagtccactttcctctct

SEQ ID NO: 4776369 - DNA, 15 bp, Homo sapiens
tgggatccagagaga

SEQ ID NO: 4776370 - DNA, 16 bp, Homo sapiens
tgggatccagagagaa

SEQ ID NO: 4776371 - DNA, 13 bp, Homo sapiens
tgggatcctggag

SEQ ID NO: 4776372 - DNA, 15 bp, Homo sapiens
tgggatgggaccagg

SEQ ID NO: 4776373 - DNA, 14 bp, Homo sapiens
tgggattcaggaat

SEQ ID NO: 4776374 - DNA, 16 bp, Homo sapiens
tgggattcctcccctg

SEQ ID NO: 4776375 - DNA, 20 bp, Homo sapiens
tgggattcctcccctggaag

SEQ ID NO: 4776376 - DNA, 21 bp, Homo sapiens
tgggattcctcccctggaagt

SEQ ID NO: 4776377 - DNA, 18 bp, Homo sapiens
tgggcaaggggccaggaa

SEQ ID NO: 4776378 - DNA, 18 bp, Homo sapiens
tgggcacatagcataggc

SEQ ID NO: 4776379 - DNA, 21 bp, Homo sapiens
tgggcacgggagagcgccacc

SEQ ID NO: 4776380 - DNA, 12 bp, Homo sapiens
tgggcagaagga

SEQ ID NO: 4776381 - DNA, 13 bp, Homo sapiens
tgggcagaaggaa

SEQ ID NO: 4776382 - DNA, 23 bp, Homo sapiens
tgggcagaaggaagacttcatcc

SEQ ID NO: 4776383 - DNA, 14 bp, Homo sapiens
tgggcagcaccctc

SEQ ID NO: 4776384 - DNA, 16 bp, Homo sapiens
tgggcagcaccctccc

SEQ ID NO: 4776385 - DNA, 17 bp, Homo sapiens
tgggcagcaccctcccc

SEQ ID NO: 4776386 - DNA, 12 bp, Homo sapiens
tgggcagcccag

SEQ ID NO: 4776387 - DNA, 13 bp, Homo sapiens
tgggcagcccaga

SEQ ID NO: 4776388 - DNA, 14 bp, Homo sapiens
tgggcagcccagag

SEQ ID NO: 4776389 - DNA, 16 bp, Homo sapiens
tgggcagcccagagag

SEQ ID NO: 4776390 - DNA, 18 bp, Homo sapiens
tgggcagcccagagagac

SEQ ID NO: 4776391 - DNA, 13 bp, Homo sapiens
tgggcagctcctc

SEQ ID NO: 4776392 - DNA, 21 bp, Homo sapiens
tgggcagctggggggctgtcc

SEQ ID NO: 4776393 - DNA, 13 bp, Homo sapiens
tgggcagggccgc

SEQ ID NO: 4776394 - DNA, 20 bp, Homo sapiens
tgggcagggccgcagggcgc

SEQ ID NO: 4776395 - DNA, 14 bp, Homo sapiens
tgggcagtggagag

SEQ ID NO: 4776396 - DNA, 18 bp, Homo sapiens
tgggcagtggagagggga

SEQ ID NO: 4776397 - DNA, 15 bp, Homo sapiens
tgggccaagccaggg

SEQ ID NO: 4776398 - DNA, 10 bp, Homo sapiens
tgggccaggg

SEQ ID NO: 4776399 - DNA, 12 bp, Homo sapiens
tgggccccacag

SEQ ID NO: 4776400 - DNA, 13 bp, Homo sapiens
tgggccccacagt

SEQ ID NO: 4776401 - DNA, 20 bp, Homo sapiens
tgggccccacagtggtcagc

SEQ ID NO: 4776402 - DNA, 13 bp, Homo sapiens
tgggcccctccac

SEQ ID NO: 4776403 - DNA, 17 bp, Homo sapiens
tgggcccctccacgcct

SEQ ID NO: 4776404 - DNA, 22 bp, Homo sapiens
tgggcccctccacgcctcctgg

SEQ ID NO: 4776405 - DNA, 17 bp, Homo sapiens
tgggcccttagaatgtg

SEQ ID NO: 4776406 - DNA, 22 bp, Homo sapiens
tgggcccttagaatgtgaaaaa

SEQ ID NO: 4776407 - DNA, 20 bp, Homo sapiens
tgggcctcagttcaacctgg

SEQ ID NO: 4776408 - DNA, 16 bp, Homo sapiens
tgggcctgggctaggg

SEQ ID NO: 4776409 - DNA, 20 bp, Homo sapiens
tgggcgccggttccacgtgg

SEQ ID NO: 4776410 - DNA, 21 bp, Homo sapiens
tgggcgccggttccacgtggg

SEQ ID NO: 4776411 - DNA, 22 bp, Homo sapiens
tgggcgccggttccacgtgggg

SEQ ID NO: 4776412 - DNA, 11 bp, Homo sapiens
tgggctccaga

SEQ ID NO: 4776413 - DNA, 16 bp, Homo sapiens
tgggctccagagtagg

SEQ ID NO: 4776414 - DNA, 19 bp, Homo sapiens
tgggctctctggacctgac

SEQ ID NO: 4776415 - DNA, 22 bp, Homo sapiens
tgggctctctggacctgaccag

SEQ ID NO: 4776416 - DNA, 23 bp, Homo sapiens
tgggctctctggacctgaccaga

SEQ ID NO: 4776417 - DNA, 21 bp, Homo sapiens
tgggctgaatgtatgtaaata

SEQ ID NO: 4776418 - DNA, 18 bp, Homo sapiens
tgggctgcaaaatgaaga

SEQ ID NO: 4776419 - DNA, 20 bp, Homo sapiens
tgggctgcaaaatgaagaca

SEQ ID NO: 4776420 - DNA, 14 bp, Homo sapiens
tgggctggagtggg

SEQ ID NO: 4776421 - DNA, 15 bp, Homo sapiens
tgggctggcacccac

SEQ ID NO: 4776422 - DNA, 18 bp, Homo sapiens
tgggctggcacccactgg

SEQ ID NO: 4776423 - DNA, 19 bp, Homo sapiens
tgggctggcacccactgga

SEQ ID NO: 4776424 - DNA, 13 bp, Homo sapiens
tgggctgtgagga

SEQ ID NO: 4776425 - DNA, 21 bp, Homo sapiens
tgggctgtgaggacagggccc

SEQ ID NO: 4776426 - DNA, 15 bp, Homo sapiens
tgggcttcatcctcc

SEQ ID NO: 4776427 - DNA, 22 bp, Homo sapiens
tggggaactcccccagaggtgg

SEQ ID NO: 4776428 - DNA, 14 bp, Homo sapiens
tggggaagattaga

SEQ ID NO: 4776429 - DNA, 13 bp, Homo sapiens
tggggaaggggcc

SEQ ID NO: 4776430 - DNA, 16 bp, Homo sapiens
tggggaaggggcctgg

SEQ ID NO: 4776431 - DNA, 14 bp, Homo sapiens
tggggaccagagct

SEQ ID NO: 4776432 - DNA, 13 bp, Homo sapiens
tggggacctcagg

SEQ ID NO: 4776433 - DNA, 17 bp, Homo sapiens
tggggacctcaggcctg

SEQ ID NO: 4776434 - DNA, 20 bp, Homo sapiens
tggggacgggggctgcttct

SEQ ID NO: 4776435 - DNA, 22 bp, Homo sapiens
tggggacgggggctgcttctcc

SEQ ID NO: 4776436 - DNA, 14 bp, Homo sapiens
tggggaggacccct

SEQ ID NO: 4776437 - DNA, 18 bp, Homo sapiens
tggggaggacccctgccc

SEQ ID NO: 4776438 - DNA, 18 bp, Homo sapiens
tggggagggacacagagg

SEQ ID NO: 4776439 - DNA, 17 bp, Homo sapiens
tggggagggcctctgga

SEQ ID NO: 4776440 - DNA, 17 bp, Homo sapiens
tggggagggcgcttttg

SEQ ID NO: 4776441 - DNA, 15 bp, Homo sapiens
tggggagggtgggcg

SEQ ID NO: 4776442 - DNA, 21 bp, Homo sapiens
tggggccagcgctgaacagac

SEQ ID NO: 4776443 - DNA, 18 bp, Homo sapiens
tggggcccatggccccag

SEQ ID NO: 4776444 - DNA, 19 bp, Homo sapiens
tggggcccatggccccagc

SEQ ID NO: 4776445 - DNA, 12 bp, Homo sapiens
tggggccctggg

SEQ ID NO: 4776446 - DNA, 16 bp, Homo sapiens
tggggccctgggcctc

SEQ ID NO: 4776447 - DNA, 18 bp, Homo sapiens
tggggccctgggcctcag

SEQ ID NO: 4776448 - DNA, 19 bp, Homo sapiens
tggggccctgggcctcagt

SEQ ID NO: 4776449 - DNA, 16 bp, Homo sapiens
tggggcctagactctg

SEQ ID NO: 4776450 - DNA, 11 bp, Homo sapiens
tggggcctggc

SEQ ID NO: 4776451 - DNA, 13 bp, Homo sapiens
tggggcggcctgc

SEQ ID NO: 4776452 - DNA, 10 bp, Homo sapiens
tggggctcct

SEQ ID NO: 4776453 - DNA, 13 bp, Homo sapiens
tggggctgcatcc

SEQ ID NO: 4776454 - DNA, 13 bp, Homo sapiens
tggggctgggccc

SEQ ID NO: 4776455 - DNA, 20 bp, Homo sapiens
tggggcttagaatggggctt

SEQ ID NO: 4776456 - DNA, 16 bp, Homo sapiens
tgggggacgcccagcc

SEQ ID NO: 4776457 - DNA, 17 bp, Homo sapiens
tgggggacgcccagccc

SEQ ID NO: 4776458 - DNA, 18 bp, Homo sapiens
tgggggaggcttccagct

SEQ ID NO: 4776459 - DNA, 15 bp, Homo sapiens
tgggggatgcttcat

SEQ ID NO: 4776460 - DNA, 21 bp, Homo sapiens
tgggggatgggccagggttta

SEQ ID NO: 4776461 - DNA, 17 bp, Homo sapiens
tgggggctgggcagagg

SEQ ID NO: 4776462 - DNA, 18 bp, Homo sapiens
tgggggctgggcagagga

SEQ ID NO: 4776463 - DNA, 13 bp, Homo sapiens
tggggggagaaac

SEQ ID NO: 4776464 - DNA, 15 bp, Homo sapiens
tggggggcacagcca

SEQ ID NO: 4776465 - DNA, 17 bp, Homo sapiens
tggggggccgggcaggt

SEQ ID NO: 4776466 - DNA, 14 bp, Homo sapiens
tggggggctgtcct

SEQ ID NO: 4776467 - DNA, 15 bp, Homo sapiens
tggggggctgtcctg

SEQ ID NO: 4776468 - DNA, 20 bp, Homo sapiens
tgggggggcttggggtagag

SEQ ID NO: 4776469 - DNA, 14 bp, Homo sapiens
tgggggtggcaggc

SEQ ID NO: 4776470 - DNA, 16 bp, Homo sapiens
tgggggtggcaggcac

SEQ ID NO: 4776471 - DNA, 14 bp, Homo sapiens
tgggggtggccatc

SEQ ID NO: 4776472 - DNA, 21 bp, Homo sapiens
tgggggtggccatccctgggc

SEQ ID NO: 4776473 - DNA, 16 bp, Homo sapiens
tgtcagccagccgccc

SEQ ID NO: 4776474 - DNA, 16 bp, Homo sapiens
tgtcagccattcctgt

SEQ ID NO: 4776475 - DNA, 19 bp, Homo sapiens
tgtcagcccatgtcaatca

SEQ ID NO: 4776476 - DNA, 19 bp, Homo sapiens
tgtcagcgtttctccacct

SEQ ID NO: 4776477 - DNA, 19 bp, Homo sapiens
tgtcaggctctgaatctct

SEQ ID NO: 4776478 - DNA, 17 bp, Homo sapiens
tgtcagtagtgcctgtg

SEQ ID NO: 4776479 - DNA, 18 bp, Homo sapiens
tgtcagtttgtgaagtga

SEQ ID NO: 4776480 - DNA, 18 bp, Homo sapiens
tgtcataaagtgagaaaa

SEQ ID NO: 4776481 - DNA, 22 bp, Homo sapiens
tgtcataaagtgagaaaactgt

SEQ ID NO: 4776482 - DNA, 15 bp, Homo sapiens
tgtcatcaagtagta

SEQ ID NO: 4776483 - DNA, 14 bp, Homo sapiens
tgtcatctctctgg

SEQ ID NO: 4776484 - DNA, 22 bp, Homo sapiens
tgtcatctctctggggccctgg

SEQ ID NO: 4776485 - DNA, 18 bp, Homo sapiens
tgtcatgcccagcttgga

SEQ ID NO: 4776486 - DNA, 22 bp, Homo sapiens
tgtcatgcccagcttggagtgc

SEQ ID NO: 4776487 - DNA, 20 bp, Homo sapiens
tgtcattagaattgaattat

SEQ ID NO: 4776488 - DNA, 18 bp, Homo sapiens
tgtcattctcatccaaaa

SEQ ID NO: 4776489 - DNA, 22 bp, Homo sapiens
tgtcattctcatccaaaagtga

SEQ ID NO: 4776490 - DNA, 16 bp, Homo sapiens
tgtcattctgctaatt

SEQ ID NO: 4776491 - DNA, 13 bp, Homo sapiens
tgtcatttgctaa

SEQ ID NO: 4776492 - DNA, 14 bp, Homo sapiens
tgtcatttgctaat

SEQ ID NO: 4776493 - DNA, 15 bp, Homo sapiens
tgtcattttctgtta

SEQ ID NO: 4776494 - DNA, 18 bp, Homo sapiens
tgtccaaacttaacagat

SEQ ID NO: 4776495 - DNA, 11 bp, Homo sapiens
tgtccaagcat

SEQ ID NO: 4776496 - DNA, 12 bp, Homo sapiens
tgtccacaaatg

SEQ ID NO: 4776497 - DNA, 13 bp, Homo sapiens
tgtccacaaatgt

SEQ ID NO: 4776498 - DNA, 17 bp, Homo sapiens
tgtccacaaatgtcctc

SEQ ID NO: 4776499 - DNA, 17 bp, Homo sapiens
tgtccaccttctgccaa

SEQ ID NO: 4776500 - DNA, 21 bp, Homo sapiens
tgtccaccttctgccaaggcc

SEQ ID NO: 4776501 - DNA, 18 bp, Homo sapiens
tgtccagaacaaaagata

SEQ ID NO: 4776502 - DNA, 19 bp, Homo sapiens
tgtccagacaagccctgct

SEQ ID NO: 4776503 - DNA, 14 bp, Homo sapiens
tgtccagagtctct

SEQ ID NO: 4776504 - DNA, 12 bp, Homo sapiens
tgtccatttata

SEQ ID NO: 4776505 - DNA, 18 bp, Homo sapiens
tgtcccaccgggagcctc

SEQ ID NO: 4776506 - DNA, 22 bp, Homo sapiens
tgtccccagttaatgtgccaaa

SEQ ID NO: 4776507 - DNA, 22 bp, Homo sapiens
tgtcccccctgtggtctgtgtg

SEQ ID NO: 4776508 - DNA, 17 bp, Homo sapiens
tgtcccctggtgcccct

SEQ ID NO: 4776509 - DNA, 18 bp, Homo sapiens
tgtcccgggtactcagtc

SEQ ID NO: 4776510 - DNA, 15 bp, Homo sapiens
tgtccctagggctct

SEQ ID NO: 4776511 - DNA, 18 bp, Homo sapiens
tgtccctagggctctcca

SEQ ID NO: 4776512 - DNA, 13 bp, Homo sapiens
tgtccctgtcccc

SEQ ID NO: 4776513 - DNA, 15 bp, Homo sapiens
tgtccctgtcccctc

SEQ ID NO: 4776514 - DNA, 18 bp, Homo sapiens
tgtccctgtgggctcaca

SEQ ID NO: 4776515 - DNA, 19 bp, Homo sapiens
tgtccctgtgggctcacac

SEQ ID NO: 4776516 - DNA, 22 bp, Homo sapiens
tgtccctgtgggctcacaccgg

SEQ ID NO: 4776517 - DNA, 21 bp, Homo sapiens
tgtccgcgtcctttcctctcc

SEQ ID NO: 4776518 - DNA, 16 bp, Homo sapiens
tgtccgtagtatcaga

SEQ ID NO: 4776519 - DNA, 13 bp, Homo sapiens
tgtccgtcctgct

SEQ ID NO: 4776520 - DNA, 17 bp, Homo sapiens
tgtccgtctgtcctgcg

SEQ ID NO: 4776521 - DNA, 20 bp, Homo sapiens
tgtccgtctgtcctgcgcct

SEQ ID NO: 4776522 - DNA, 16 bp, Homo sapiens
tgtcctaaatgcaaag

SEQ ID NO: 4776523 - DNA, 21 bp, Homo sapiens
tgtcctaggggccgagggaaa

SEQ ID NO: 4776524 - DNA, 23 bp, Homo sapiens
tgtcctaggggccgagggaaatg

SEQ ID NO: 4776525 - DNA, 21 bp, Homo sapiens
tgtcctatccccggacgcatg

SEQ ID NO: 4776526 - DNA, 21 bp, Homo sapiens
tgtcctatccctggacgcatg

SEQ ID NO: 4776527 - DNA, 16 bp, Homo sapiens
tgtcctctcagaactc

SEQ ID NO: 4776528 - DNA, 18 bp, Homo sapiens
tgtcctctcagaactcct

SEQ ID NO: 4776529 - DNA, 20 bp, Homo sapiens
tgtcctctcgagcccagatg

SEQ ID NO: 4776530 - DNA, 13 bp, Homo sapiens
tgtcctctgtccg

SEQ ID NO: 4776531 - DNA, 16 bp, Homo sapiens
tgtcctgactgtccta

SEQ ID NO: 4776532 - DNA, 21 bp, Homo sapiens
tgtcctgagctaacactaaaa

SEQ ID NO: 4776533 - DNA, 20 bp, Homo sapiens
tgtcctgcatgtatgccatg

SEQ ID NO: 4776534 - DNA, 21 bp, Homo sapiens
tgtcctgctacctttgtctca

SEQ ID NO: 4776535 - DNA, 22 bp, Homo sapiens
tgtcctgctacctttgtctcac

SEQ ID NO: 4776536 - DNA, 18 bp, Homo sapiens
tgtcctgctcacgtctgt

SEQ ID NO: 4776537 - DNA, 14 bp, Homo sapiens
tgtcctggctccca

SEQ ID NO: 4776538 - DNA, 18 bp, Homo sapiens
tgtcctgtgagatgtgta

SEQ ID NO: 4776539 - DNA, 15 bp, Homo sapiens
tgtcctgtgctttct

SEQ ID NO: 4776540 - DNA, 19 bp, Homo sapiens
tgtcctgttgattaatttc

SEQ ID NO: 4776541 - DNA, 15 bp, Homo sapiens
tgtccttcccccagc

SEQ ID NO: 4776542 - DNA, 18 bp, Homo sapiens
tgtccttggacctagagg

SEQ ID NO: 4776543 - DNA, 22 bp, Homo sapiens
tgtccttgtgtatcctgacagc

SEQ ID NO: 4776544 - DNA, 19 bp, Homo sapiens
tgtcctttatgtattctct

SEQ ID NO: 4776545 - DNA, 17 bp, Homo sapiens
tgtcgccccaggccctc

SEQ ID NO: 4776546 - DNA, 19 bp, Homo sapiens
tgtcgccccaggccctccc

SEQ ID NO: 4776547 - DNA, 13 bp, Homo sapiens
tgtcggggcccct

SEQ ID NO: 4776548 - DNA, 16 bp, Homo sapiens
tgtcgggttctcccat

SEQ ID NO: 4776549 - DNA, 19 bp, Homo sapiens
tgtcgtaacagcaggagca

SEQ ID NO: 4776550 - DNA, 20 bp, Homo sapiens
tgtctatggatttgccttct

SEQ ID NO: 4776551 - DNA, 13 bp, Homo sapiens
tgtctatgtgtat

SEQ ID NO: 4776552 - DNA, 17 bp, Homo sapiens
tgtctatgtgtatatat

SEQ ID NO: 4776553 - DNA, 19 bp, Homo sapiens
tgtctatgtgtatatatta

SEQ ID NO: 4776554 - DNA, 15 bp, Homo sapiens
tgtctcaaaataaaa

SEQ ID NO: 4776555 - DNA, 17 bp, Homo sapiens
tgtctcacgattccagt

SEQ ID NO: 4776556 - DNA, 14 bp, Homo sapiens
tgtctcatggtccc

SEQ ID NO: 4776557 - DNA, 14 bp, Homo sapiens
tgtctcatttgcca

SEQ ID NO: 4776558 - DNA, 14 bp, Homo sapiens
tgtctccagctgat

SEQ ID NO: 4776559 - DNA, 14 bp, Homo sapiens
tgtctcctctgtca

SEQ ID NO: 4776560 - DNA, 16 bp, Homo sapiens
tgtctcctctgtcagt

SEQ ID NO: 4776561 - DNA, 16 bp, Homo sapiens
tgtctctccctaccct

SEQ ID NO: 4776562 - DNA, 19 bp, Homo sapiens
tgtctctccctaccctctt

SEQ ID NO: 4776563 - DNA, 14 bp, Homo sapiens
tgtctcttgggaag

SEQ ID NO: 4776564 - DNA, 19 bp, Homo sapiens
tgtctcttgggaagcagtt

SEQ ID NO: 4776565 - DNA, 20 bp, Homo sapiens
tgtctcttgggaagcagttt

SEQ ID NO: 4776566 - DNA, 22 bp, Homo sapiens
tgtctcttgggaagcagtttca

SEQ ID NO: 4776567 - DNA, 17 bp, Homo sapiens
tgtctcttgttaaatga

SEQ ID NO: 4776568 - DNA, 22 bp, Homo sapiens
tgtctgaaattttctagaatac

SEQ ID NO: 4776569 - DNA, 19 bp, Homo sapiens
tgtctgagccctgccctca

SEQ ID NO: 4776570 - DNA, 20 bp, Homo sapiens
tgtctgagccctgccctcac

SEQ ID NO: 4776571 - DNA, 21 bp, Homo sapiens
tgtctgagccctgccctcact

SEQ ID NO: 4776572 - DNA, 10 bp, Homo sapiens
tgtctgctgc

SEQ ID NO: 4776573 - DNA, 19 bp, Homo sapiens
tgtctgctgcctccaagtc

SEQ ID NO: 4776574 - DNA, 23 bp, Homo sapiens
tgtctgctgcctccaagtcatgg

SEQ ID NO: 4776575 - DNA, 23 bp, Homo sapiens
tgtctgcttagtatctcatcaac

SEQ ID NO: 4776576 - DNA, 21 bp, Homo sapiens
tgtctggatcagtaaaattat

SEQ ID NO: 4776577 - DNA, 12 bp, Homo sapiens
tgtctggcccag

SEQ ID NO: 4776578 - DNA, 15 bp, Homo sapiens
tgtctggcccagcca

SEQ ID NO: 4776579 - DNA, 15 bp, Homo sapiens
tgtctggctgtggcc

SEQ ID NO: 4776580 - DNA, 18 bp, Homo sapiens
tgtctggtccacacacca

SEQ ID NO: 4776581 - DNA, 18 bp, Homo sapiens
tgtctgtaaatctaacat

SEQ ID NO: 4776582 - DNA, 14 bp, Homo sapiens
tgtctgtaagagaa

SEQ ID NO: 4776583 - DNA, 17 bp, Homo sapiens
tgtctgtccctaaacat

SEQ ID NO: 4776584 - DNA, 21 bp, Homo sapiens
tgtctgtccctaaacatagtg

SEQ ID NO: 4776585 - DNA, 13 bp, Homo sapiens
tgtctgtgtatac

SEQ ID NO: 4776586 - DNA, 14 bp, Homo sapiens
tgtctgtgtataca

SEQ ID NO: 4776587 - DNA, 15 bp, Homo sapiens
tgtctgtgtatacat

SEQ ID NO: 4776588 - DNA, 15 bp, Homo sapiens
tgtcttactcaagat

SEQ ID NO: 4776589 - DNA, 17 bp, Homo sapiens
tgtcttagatcaggaga

SEQ ID NO: 4776590 - DNA, 12 bp, Homo sapiens
tgtcttattcct

SEQ ID NO: 4776591 - DNA, 22 bp, Homo sapiens
tgtcttattcctaattcctgta

SEQ ID NO: 4776592 - DNA, 20 bp, Homo sapiens
tgtcttcaaccctgccctgc

SEQ ID NO: 4776593 - DNA, 23 bp, Homo sapiens
tgtcttcaaccctgccctgcacc

SEQ ID NO: 4776594 - DNA, 17 bp, Homo sapiens
tgtcttcatgttgatgt

SEQ ID NO: 4776595 - DNA, 19 bp, Homo sapiens
tgtttgcctttaggcagga

SEQ ID NO: 4776596 - DNA, 22 bp, Homo sapiens
tgtttgcctttaggcaggaagt

SEQ ID NO: 4776597 - DNA, 17 bp, Homo sapiens
tgtttgtaaaagagctg

SEQ ID NO: 4776598 - DNA, 21 bp, Homo sapiens
tgtttgtcctttatgtattct

SEQ ID NO: 4776599 - DNA, 23 bp, Homo sapiens
tgtttgtcctttatgtattctct

SEQ ID NO: 4776600 - DNA, 14 bp, Homo sapiens
tgtttgtgcttcta

SEQ ID NO: 4776601 - DNA, 15 bp, Homo sapiens
tgtttgtgcttctaa

SEQ ID NO: 4776602 - DNA, 16 bp, Homo sapiens
tgttttatatgattaa

SEQ ID NO: 4776603 - DNA, 12 bp, Homo sapiens
tgttttcattct

SEQ ID NO: 4776604 - DNA, 14 bp, Homo sapiens
tgttttcattctgg

SEQ ID NO: 4776605 - DNA, 12 bp, Homo sapiens
tgttttgctaat

SEQ ID NO: 4776606 - DNA, 20 bp, Homo sapiens
tgttttggctgctctccatc

SEQ ID NO: 4776607 - DNA, 12 bp, Homo sapiens
tgttttgtggat

SEQ ID NO: 4776608 - DNA, 13 bp, Homo sapiens
tgttttgtggata

SEQ ID NO: 4776609 - DNA, 12 bp, Homo sapiens
tgtttttacata

SEQ ID NO: 4776610 - DNA, 17 bp, Homo sapiens
tgtttttcgtcattcca

SEQ ID NO: 4776611 - DNA, 20 bp, Homo sapiens
tgtttttggttttctccttc

SEQ ID NO: 4776612 - DNA, 22 bp, Homo sapiens
ttaaaaaaaatattctgtcatt

SEQ ID NO: 4776613 - DNA, 17 bp, Homo sapiens
ttaaaaaatacagtatt

SEQ ID NO: 4776614 - DNA, 22 bp, Homo sapiens
ttaaaaaatacagtattattta

SEQ ID NO: 4776615 - DNA, 17 bp, Homo sapiens
ttaaaaagacactttta

SEQ ID NO: 4776616 - DNA, 21 bp, Homo sapiens
ttaaaaagacacttttaccga

SEQ ID NO: 4776617 - DNA, 18 bp, Homo sapiens
ttaaaaagttgcacatta

SEQ ID NO: 4776618 - DNA, 15 bp, Homo sapiens
ttaaaaatgtatgtt

SEQ ID NO: 4776619 - DNA, 16 bp, Homo sapiens
ttaaaaattaattctt

SEQ ID NO: 4776620 - DNA, 14 bp, Homo sapiens
ttaaaacttcatct

SEQ ID NO: 4776621 - DNA, 21 bp, Homo sapiens
ttaaaagctatcttcatgtaa

SEQ ID NO: 4776622 - DNA, 18 bp, Homo sapiens
ttaaaagtgtatttgtta

SEQ ID NO: 4776623 - DNA, 22 bp, Homo sapiens
ttaaaataattatatgaagcag

SEQ ID NO: 4776624 - DNA, 14 bp, Homo sapiens
ttaaaatatagtgt

SEQ ID NO: 4776625 - DNA, 15 bp, Homo sapiens
ttaaaatatagtgtt

SEQ ID NO: 4776626 - DNA, 18 bp, Homo sapiens
ttaaaatggcatttagca

SEQ ID NO: 4776627 - DNA, 19 bp, Homo sapiens
ttaaacaaaaactttccat

SEQ ID NO: 4776628 - DNA, 23 bp, Homo sapiens
ttaaacaacgatttctccattaa

SEQ ID NO: 4776629 - DNA, 16 bp, Homo sapiens
ttaaacccacataaac

SEQ ID NO: 4776630 - DNA, 20 bp, Homo sapiens
ttaaacctgtgctttcatgt

SEQ ID NO: 4776631 - DNA, 13 bp, Homo sapiens
ttaaactcttaga

SEQ ID NO: 4776632 - DNA, 16 bp, Homo sapiens
ttaaactgggaaatga

SEQ ID NO: 4776633 - DNA, 13 bp, Homo sapiens
ttaaacttcagca

SEQ ID NO: 4776634 - DNA, 17 bp, Homo sapiens
ttaaacttctactgagc

SEQ ID NO: 4776635 - DNA, 16 bp, Homo sapiens
ttaaagaaaggcagag

SEQ ID NO: 4776636 - DNA, 23 bp, Homo sapiens
ttaaagaagtccatgtgataatt

SEQ ID NO: 4776637 - DNA, 24 bp, Homo sapiens
ttaaagaagtccatgtgataattg

SEQ ID NO: 4776638 - DNA, 15 bp, Homo sapiens
ttaaaggttactgtt

SEQ ID NO: 4776639 - DNA, 17 bp, Homo sapiens
ttaaaggttactgtttt

SEQ ID NO: 4776640 - DNA, 12 bp, Homo sapiens
ttaaagtctaca

SEQ ID NO: 4776641 - DNA, 16 bp, Homo sapiens
ttaaatatacaacttt

SEQ ID NO: 4776642 - DNA, 18 bp, Homo sapiens
ttaaatatatgtatgtaa

SEQ ID NO: 4776643 - DNA, 20 bp, Homo sapiens
ttaaatatatgtatgtaaaa

SEQ ID NO: 4776644 - DNA, 22 bp, Homo sapiens
ttaaatatatgtatgtaaaaat

SEQ ID NO: 4776645 - DNA, 12 bp, Homo sapiens
ttaaatctttgt

SEQ ID NO: 4776646 - DNA, 17 bp, Homo sapiens
ttaaatctttgttaaaa

SEQ ID NO: 4776647 - DNA, 15 bp, Homo sapiens
ttaaatgaaatactt

SEQ ID NO: 4776648 - DNA, 21 bp, Homo sapiens
ttaaatgtagcttcagtcatt

SEQ ID NO: 4776649 - DNA, 17 bp, Homo sapiens
ttaaatgtctataaatg

SEQ ID NO: 4776650 - DNA, 19 bp, Homo sapiens
ttaaattaaacaatttatt

SEQ ID NO: 4776651 - DNA, 12 bp, Homo sapiens
ttaaattatatg

SEQ ID NO: 4776652 - DNA, 22 bp, Homo sapiens
ttaaattatatgatatgcatgt

SEQ ID NO: 4776653 - DNA, 20 bp, Homo sapiens
ttaaattatcattgtttgtc

SEQ ID NO: 4776654 - DNA, 23 bp, Homo sapiens
ttaaattatcattgtttgtcctt

SEQ ID NO: 4776655 - DNA, 14 bp, Homo sapiens
ttaaatttattaaa

SEQ ID NO: 4776656 - DNA, 19 bp, Homo sapiens
ttaaatttattaaatgttg

SEQ ID NO: 4776657 - DNA, 19 bp, Homo sapiens
ttaacaatgcctattgtaa

SEQ ID NO: 4776658 - DNA, 21 bp, Homo sapiens
ttaacaatgcctattgtaata

SEQ ID NO: 4776659 - DNA, 20 bp, Homo sapiens
ttaacataaacttgtactta

SEQ ID NO: 4776660 - DNA, 21 bp, Homo sapiens
ttaaccagtctgaagtttcat

SEQ ID NO: 4776661 - DNA, 17 bp, Homo sapiens
ttaactaatgtaaatat

SEQ ID NO: 4776662 - DNA, 13 bp, Homo sapiens
ttaactttaccat

SEQ ID NO: 4776663 - DNA, 21 bp, Homo sapiens
ttaagaaacacggctgatatc

SEQ ID NO: 4776664 - DNA, 23 bp, Homo sapiens
ttaagaaatgagaaattgtgcca

SEQ ID NO: 4776665 - DNA, 16 bp, Homo sapiens
ttaagacaacaggcat

SEQ ID NO: 4776666 - DNA, 15 bp, Homo sapiens
ttaagattccatttt

SEQ ID NO: 4776667 - DNA, 21 bp, Homo sapiens
ttaagcacaaaaaatttaaga

SEQ ID NO: 4776668 - DNA, 21 bp, Homo sapiens
ttaagcacattattgtagaga

SEQ ID NO: 4776669 - DNA, 13 bp, Homo sapiens
ttaagcagtacat

SEQ ID NO: 4776670 - DNA, 16 bp, Homo sapiens
ttaagcagtacatctt

SEQ ID NO: 4776671 - DNA, 21 bp, Homo sapiens
ttaagcagtacatcttgtgca

SEQ ID NO: 4776672 - DNA, 13 bp, Homo sapiens
ttaaggacagtgt

SEQ ID NO: 4776673 - DNA, 19 bp, Homo sapiens
ttaaggactacagaattgg

SEQ ID NO: 4776674 - DNA, 21 bp, Homo sapiens
ttaagtattccttggcccagc

SEQ ID NO: 4776675 - DNA, 15 bp, Homo sapiens
ttaagtcttactgtt

SEQ ID NO: 4776676 - DNA, 22 bp, Homo sapiens
ttaagtgttctgtggctgattt

SEQ ID NO: 4776677 - DNA, 24 bp, Homo sapiens
ttaatagtacccaacctggtaatt

SEQ ID NO: 4776678 - DNA, 13 bp, Homo sapiens
ttaatataaatcg

SEQ ID NO: 4776679 - DNA, 14 bp, Homo sapiens
ttaatatttcttca

SEQ ID NO: 4776680 - DNA, 12 bp, Homo sapiens
ttaatatttgtt

SEQ ID NO: 4776681 - DNA, 16 bp, Homo sapiens
ttaatatttgtttagt

SEQ ID NO: 4776682 - DNA, 14 bp, Homo sapiens
ttaatcatttccag

SEQ ID NO: 4776683 - DNA, 20 bp, Homo sapiens
ttaatcatttccagcaaaat

SEQ ID NO: 4776684 - DNA, 22 bp, Homo sapiens
ttaatcatttccagcaaaatat

SEQ ID NO: 4776685 - DNA, 20 bp, Homo sapiens
ttaatctagagctatgcaca

SEQ ID NO: 4776686 - DNA, 11 bp, Homo sapiens
ttaatctcttg

SEQ ID NO: 4776687 - DNA, 14 bp, Homo sapiens
ttaatctcttgtca

SEQ ID NO: 4776688 - DNA, 18 bp, Homo sapiens
ttaatctttgtgacagga

SEQ ID NO: 4776689 - DNA, 16 bp, Homo sapiens
ttaatgaaaaatctga

SEQ ID NO: 4776690 - DNA, 13 bp, Homo sapiens
ttaatgaagaaat

SEQ ID NO: 4776691 - DNA, 19 bp, Homo sapiens
ttaatgaagaaatacagct

SEQ ID NO: 4776692 - DNA, 12 bp, Homo sapiens
ttaatgacaaca

SEQ ID NO: 4776693 - DNA, 18 bp, Homo sapiens
ttaatgattcttgtgtca

SEQ ID NO: 4776694 - DNA, 23 bp, Homo sapiens
ttaatgcaaatgaaggaatgcaa

SEQ ID NO: 4776695 - DNA, 18 bp, Homo sapiens
ttaatggaaaactgttaa

SEQ ID NO: 4776696 - DNA, 14 bp, Homo sapiens
ttaatggcactgat

SEQ ID NO: 4776697 - DNA, 16 bp, Homo sapiens
ttaatgtctttgtgtt

SEQ ID NO: 4776698 - DNA, 16 bp, Homo sapiens
ttaatgtgccaaaatg

SEQ ID NO: 4776699 - DNA, 22 bp, Homo sapiens
ttaattaaccccataattagat

SEQ ID NO: 4776700 - DNA, 17 bp, Homo sapiens
ttaattcttaccgaaat

SEQ ID NO: 4776701 - DNA, 15 bp, Homo sapiens
ttaattcttacctca

SEQ ID NO: 4776702 - DNA, 20 bp, Homo sapiens
ttaattcttacctcatttgc

SEQ ID NO: 4776703 - DNA, 23 bp, Homo sapiens
ttaattcttacctcatttgcatc

SEQ ID NO: 4776704 - DNA, 13 bp, Homo sapiens
ttaattcttctct

SEQ ID NO: 4776705 - DNA, 23 bp, Homo sapiens
ttaattctttatcacatgttgtc

SEQ ID NO: 4776706 - DNA, 17 bp, Homo sapiens
ttaattgatagaataaa

SEQ ID NO: 4776707 - DNA, 15 bp, Homo sapiens
ttaattgtcttgcac

SEQ ID NO: 4776708 - DNA, 13 bp, Homo sapiens
ttaatttaaatga

SEQ ID NO: 4776709 - DNA, 14 bp, Homo sapiens
ttaatttaaatgat

SEQ ID NO: 4776710 - DNA, 16 bp, Homo sapiens
ttaatttaaatgattt

SEQ ID NO: 4776711 - DNA, 14 bp, Homo sapiens
ttaatttcctgtga

SEQ ID NO: 4776712 - DNA, 16 bp, Homo sapiens
ttacaaagaaacaaaa

SEQ ID NO: 4776713 - DNA, 17 bp, Homo sapiens
ttacaaagaaacaaaat

SEQ ID NO: 4776714 - DNA, 18 bp, Homo sapiens
ttacaacaagcaaactga

SEQ ID NO: 4776715 - DNA, 23 bp, Homo sapiens
ttacaacaagcaaactgaaatta

SEQ ID NO: 4776716 - DNA, 13 bp, Homo sapiens
ttacaacttccag

SEQ ID NO: 4776717 - DNA, 17 bp, Homo sapiens
ttatcttgacaggcgcc

SEQ ID NO: 4776718 - DNA, 11 bp, Homo sapiens
ttatgaaatgc

SEQ ID NO: 4776719 - DNA, 12 bp, Homo sapiens
ttatgaaatgcc

SEQ ID NO: 4776720 - DNA, 12 bp, Homo sapiens
ttatgaagaaaa

SEQ ID NO: 4776721 - DNA, 21 bp, Homo sapiens
ttatgaagaaaaatttgaaaa

SEQ ID NO: 4776722 - DNA, 20 bp, Homo sapiens
ttatgagacttcctattaat

SEQ ID NO: 4776723 - DNA, 16 bp, Homo sapiens
ttatgatttcatgatt

SEQ ID NO: 4776724 - DNA, 23 bp, Homo sapiens
ttatgcatgagaactaaatagat

SEQ ID NO: 4776725 - DNA, 18 bp, Homo sapiens
ttatgcatttatgcatga

SEQ ID NO: 4776726 - DNA, 11 bp, Homo sapiens
ttatgcttctt

SEQ ID NO: 4776727 - DNA, 21 bp, Homo sapiens
ttatggacaatgacccagtgg

SEQ ID NO: 4776728 - DNA, 15 bp, Homo sapiens
ttatggctttgtgct

SEQ ID NO: 4776729 - DNA, 14 bp, Homo sapiens
ttatggtattttcg

SEQ ID NO: 4776730 - DNA, 21 bp, Homo sapiens
ttatggtattttcgtgcattt

SEQ ID NO: 4776731 - DNA, 19 bp, Homo sapiens
ttatgtaagtttctaagaa

SEQ ID NO: 4776732 - DNA, 16 bp, Homo sapiens
ttatgtcaaatggatg

SEQ ID NO: 4776733 - DNA, 13 bp, Homo sapiens
ttatgttgtaata

SEQ ID NO: 4776734 - DNA, 13 bp, Homo sapiens
ttattaaaatatt

SEQ ID NO: 4776735 - DNA, 17 bp, Homo sapiens
ttattaaacttcagcaa

SEQ ID NO: 4776736 - DNA, 18 bp, Homo sapiens
ttattaaatttattaaat

SEQ ID NO: 4776737 - DNA, 15 bp, Homo sapiens
ttattaatgaatgcc

SEQ ID NO: 4776738 - DNA, 12 bp, Homo sapiens
ttattactttaa

SEQ ID NO: 4776739 - DNA, 16 bp, Homo sapiens
ttattactttaaatta

SEQ ID NO: 4776740 - DNA, 15 bp, Homo sapiens
ttattagcaccagct

SEQ ID NO: 4776741 - DNA, 16 bp, Homo sapiens
ttattagcaccagctt

SEQ ID NO: 4776742 - DNA, 18 bp, Homo sapiens
ttattagccctgcatttt

SEQ ID NO: 4776743 - DNA, 14 bp, Homo sapiens
ttattatagtctgt

SEQ ID NO: 4776744 - DNA, 12 bp, Homo sapiens
ttattatattgt

SEQ ID NO: 4776745 - DNA, 16 bp, Homo sapiens
ttattattatattgtt

SEQ ID NO: 4776746 - DNA, 22 bp, Homo sapiens
ttattattttcatataatttgc

SEQ ID NO: 4776747 - DNA, 13 bp, Homo sapiens
ttattcaaagaga

SEQ ID NO: 4776748 - DNA, 19 bp, Homo sapiens
ttattcaaagagaaaacat

SEQ ID NO: 4776749 - DNA, 20 bp, Homo sapiens
ttattcaaagagaaaacatc

SEQ ID NO: 4776750 - DNA, 17 bp, Homo sapiens
ttattcattagctgtga

SEQ ID NO: 4776751 - DNA, 12 bp, Homo sapiens
ttattctaatta

SEQ ID NO: 4776752 - DNA, 21 bp, Homo sapiens
ttattgcccatgatataactt

SEQ ID NO: 4776753 - DNA, 16 bp, Homo sapiens
ttattggacttccatt

SEQ ID NO: 4776754 - DNA, 15 bp, Homo sapiens
ttattgtctgtaaat

SEQ ID NO: 4776755 - DNA, 11 bp, Homo sapiens
ttatttacaag

SEQ ID NO: 4776756 - DNA, 13 bp, Homo sapiens
ttatttagtaaaa

SEQ ID NO: 4776757 - DNA, 22 bp, Homo sapiens
ttatttagtaaaattatctgtt

SEQ ID NO: 4776758 - DNA, 14 bp, Homo sapiens
ttatttatatatga

SEQ ID NO: 4776759 - DNA, 13 bp, Homo sapiens
ttatttatgatgt

SEQ ID NO: 4776760 - DNA, 17 bp, Homo sapiens
ttatttattaaacttca

SEQ ID NO: 4776761 - DNA, 13 bp, Homo sapiens
ttatttattatta

SEQ ID NO: 4776762 - DNA, 15 bp, Homo sapiens
ttatttcaatgtaat

SEQ ID NO: 4776763 - DNA, 18 bp, Homo sapiens
ttatttcaatgtaattaa

SEQ ID NO: 4776764 - DNA, 22 bp, Homo sapiens
ttatttctaaaacattaattga

SEQ ID NO: 4776765 - DNA, 19 bp, Homo sapiens
ttatttctgtatatagatg

SEQ ID NO: 4776766 - DNA, 18 bp, Homo sapiens
ttatttgctcataagtaa

SEQ ID NO: 4776767 - DNA, 16 bp, Homo sapiens
ttattttagcagttct

SEQ ID NO: 4776768 - DNA, 13 bp, Homo sapiens
ttattttcatata

SEQ ID NO: 4776769 - DNA, 15 bp, Homo sapiens
ttattttgtacgtgt

SEQ ID NO: 4776770 - DNA, 13 bp, Homo sapiens
ttcaaaaatttca

SEQ ID NO: 4776771 - DNA, 18 bp, Homo sapiens
ttcaaagaaaacagacca

SEQ ID NO: 4776772 - DNA, 18 bp, Homo sapiens
ttcaaagaacccccctcc

SEQ ID NO: 4776773 - DNA, 13 bp, Homo sapiens
ttcaaagaatcac

SEQ ID NO: 4776774 - DNA, 15 bp, Homo sapiens
ttcaaagagaaaaca

SEQ ID NO: 4776775 - DNA, 14 bp, Homo sapiens
ttcaaagtatatac

SEQ ID NO: 4776776 - DNA, 19 bp, Homo sapiens
ttcaaagtctcaatgaaat

SEQ ID NO: 4776777 - DNA, 17 bp, Homo sapiens
ttcaaagtgcacacaca

SEQ ID NO: 4776778 - DNA, 13 bp, Homo sapiens
ttcaaatgcattt

SEQ ID NO: 4776779 - DNA, 14 bp, Homo sapiens
ttcaaatgtgtaac

SEQ ID NO: 4776780 - DNA, 16 bp, Homo sapiens
ttcaaattgtcttttg

SEQ ID NO: 4776781 - DNA, 17 bp, Homo sapiens
ttcaacagtttcaaaat

SEQ ID NO: 4776782 - DNA, 19 bp, Homo sapiens
ttcaaccacacctaaatta

SEQ ID NO: 4776783 - DNA, 17 bp, Homo sapiens
ttcaaccctgccctgca

SEQ ID NO: 4776784 - DNA, 23 bp, Homo sapiens
ttcaagatctaaatcatatataa

SEQ ID NO: 4776785 - DNA, 17 bp, Homo sapiens
ttcaaggtctgcttttc

SEQ ID NO: 4776786 - DNA, 19 bp, Homo sapiens
ttcaatagccccatctctc

SEQ ID NO: 4776787 - DNA, 16 bp, Homo sapiens
ttcaatccacagtatt

SEQ ID NO: 4776788 - DNA, 14 bp, Homo sapiens
ttcaatgcaatgca

SEQ ID NO: 4776789 - DNA, 16 bp, Homo sapiens
ttcaatgtactgtatt

SEQ ID NO: 4776790 - DNA, 17 bp, Homo sapiens
ttcaatgtactgtattg

SEQ ID NO: 4776791 - DNA, 11 bp, Homo sapiens
ttcaatgtgaa

SEQ ID NO: 4776792 - DNA, 16 bp, Homo sapiens
ttcaatgtgaaactga

SEQ ID NO: 4776793 - DNA, 17 bp, Homo sapiens
ttcaatgttaaatctac

SEQ ID NO: 4776794 - DNA, 15 bp, Homo sapiens
ttcaattaatggaaa

SEQ ID NO: 4776795 - DNA, 18 bp, Homo sapiens
ttcaattggacaattatt

SEQ ID NO: 4776796 - DNA, 21 bp, Homo sapiens
ttcacacaactgtggataaat

SEQ ID NO: 4776797 - DNA, 14 bp, Homo sapiens
ttcacaccctgcaa

SEQ ID NO: 4776798 - DNA, 14 bp, Homo sapiens
ttcacaccttacaa

SEQ ID NO: 4776799 - DNA, 19 bp, Homo sapiens
ttcacaccttacaaagcca

SEQ ID NO: 4776800 - DNA, 22 bp, Homo sapiens
ttcacaccttacaaagccagct

SEQ ID NO: 4776801 - DNA, 15 bp, Homo sapiens
ttcacagtgggcggc

SEQ ID NO: 4776802 - DNA, 13 bp, Homo sapiens
ttcacatctgtat

SEQ ID NO: 4776803 - DNA, 13 bp, Homo sapiens
ttcaccaacaaca

SEQ ID NO: 4776804 - DNA, 21 bp, Homo sapiens
ttcaccaacaacagtcagcca

SEQ ID NO: 4776805 - DNA, 24 bp, Homo sapiens
ttcaccaacaacagtcagccagct

SEQ ID NO: 4776806 - DNA, 12 bp, Homo sapiens
ttcaccaggaag

SEQ ID NO: 4776807 - DNA, 13 bp, Homo sapiens
ttcacccaccacc

SEQ ID NO: 4776808 - DNA, 20 bp, Homo sapiens
ttcaccccatccctccttaa

SEQ ID NO: 4776809 - DNA, 21 bp, Homo sapiens
ttcaccccggcaggccctgca

SEQ ID NO: 4776810 - DNA, 17 bp, Homo sapiens
ttcacccctcccacctc

SEQ ID NO: 4776811 - DNA, 13 bp, Homo sapiens
ttcaccgcattcc

SEQ ID NO: 4776812 - DNA, 16 bp, Homo sapiens
ttcaccttctgtgcat

SEQ ID NO: 4776813 - DNA, 15 bp, Homo sapiens
ttcacgattcatttt

SEQ ID NO: 4776814 - DNA, 14 bp, Homo sapiens
ttcacgcaacttga

SEQ ID NO: 4776815 - DNA, 16 bp, Homo sapiens
ttcacgcaacttgaaa

SEQ ID NO: 4776816 - DNA, 22 bp, Homo sapiens
ttcacgcaacttgaaattatat

SEQ ID NO: 4776817 - DNA, 16 bp, Homo sapiens
ttcacttaaaatcaaa

SEQ ID NO: 4776818 - DNA, 16 bp, Homo sapiens
ttcacttaaactttgt

SEQ ID NO: 4776819 - DNA, 13 bp, Homo sapiens
ttcacttcttaag

SEQ ID NO: 4776820 - DNA, 21 bp, Homo sapiens
ttcacttcttaaggacagtgt

SEQ ID NO: 4776821 - DNA, 16 bp, Homo sapiens
ttcacttttattgtat

SEQ ID NO: 4776822 - DNA, 23 bp, Homo sapiens
ttcagaattgtttttagaaattt

SEQ ID NO: 4776823 - DNA, 14 bp, Homo sapiens
ttcagactgcttca

SEQ ID NO: 4776824 - DNA, 15 bp, Homo sapiens
ttcagataaatcatg

SEQ ID NO: 4776825 - DNA, 16 bp, Homo sapiens
ttcagataaatcatgg

SEQ ID NO: 4776826 - DNA, 18 bp, Homo sapiens
ttcagataaatcatgggc

SEQ ID NO: 4776827 - DNA, 19 bp, Homo sapiens
ttcagatccttccaaactc

SEQ ID NO: 4776828 - DNA, 15 bp, Homo sapiens
ttcagatctgaagta

SEQ ID NO: 4776829 - DNA, 21 bp, Homo sapiens
ttcagcaaccctacagtatat

SEQ ID NO: 4776830 - DNA, 19 bp, Homo sapiens
ttcagccaagaattcttaa

SEQ ID NO: 4776831 - DNA, 16 bp, Homo sapiens
ttcagctgcttctctt

SEQ ID NO: 4776832 - DNA, 19 bp, Homo sapiens
ttcaggaaagcagcagttt

SEQ ID NO: 4776833 - DNA, 22 bp, Homo sapiens
ttcaggtcccctggcccttcct

SEQ ID NO: 4776834 - DNA, 23 bp, Homo sapiens
ttcaggtcccctggcccttcctt

SEQ ID NO: 4776835 - DNA, 24 bp, Homo sapiens
ttcaggtcccctggcccttccttc

SEQ ID NO: 4776836 - DNA, 22 bp, Homo sapiens
ttcagtcacttgtttgtgtttg

SEQ ID NO: 4776837 - DNA, 15 bp, Homo sapiens
ttcagtcattaaatt

SEQ ID NO: 4776838 - DNA, 13 bp, Homo sapiens
ttcagttctcatc

SEQ ID NO: 4776839 - DNA, 22 bp, Homo sapiens
ttcatagagccctattctctca

SEQ ID NO: 4776840 - DNA, 13 bp, Homo sapiens
ttcttccttgcca

SEQ ID NO: 4776841 - DNA, 20 bp, Homo sapiens
ttcttccttgccacaatcac

SEQ ID NO: 4776842 - DNA, 21 bp, Homo sapiens
ttcttccttgccacaatcact

SEQ ID NO: 4776843 - DNA, 20 bp, Homo sapiens
ttcttccttttgtatcctcc

SEQ ID NO: 4776844 - DNA, 16 bp, Homo sapiens
ttcttctaaaactact

SEQ ID NO: 4776845 - DNA, 19 bp, Homo sapiens
ttcttctcattcttctaaa

SEQ ID NO: 4776846 - DNA, 23 bp, Homo sapiens
ttcttctgtaatatttacaatgt

SEQ ID NO: 4776847 - DNA, 16 bp, Homo sapiens
ttcttctttaattttt

SEQ ID NO: 4776848 - DNA, 20 bp, Homo sapiens
ttcttgcactgtatccaagt

SEQ ID NO: 4776849 - DNA, 18 bp, Homo sapiens
ttcttgcagtcatcagaa

SEQ ID NO: 4776850 - DNA, 19 bp, Homo sapiens
ttcttgcggcaccgcccac

SEQ ID NO: 4776851 - DNA, 14 bp, Homo sapiens
ttcttgctctgctc

SEQ ID NO: 4776852 - DNA, 14 bp, Homo sapiens
ttcttggtatgatc

SEQ ID NO: 4776853 - DNA, 18 bp, Homo sapiens
ttcttggtgactgtccca

SEQ ID NO: 4776854 - DNA, 16 bp, Homo sapiens
ttcttgtaaaactgtg

SEQ ID NO: 4776855 - DNA, 22 bp, Homo sapiens
ttcttgtaaaactgtgacattc

SEQ ID NO: 4776856 - DNA, 16 bp, Homo sapiens
ttcttgtgtttgaaac

SEQ ID NO: 4776857 - DNA, 18 bp, Homo sapiens
ttctttactcggcgtgct

SEQ ID NO: 4776858 - DNA, 18 bp, Homo sapiens
ttctttataatggctctg

SEQ ID NO: 4776859 - DNA, 14 bp, Homo sapiens
ttctttccaaaggt

SEQ ID NO: 4776860 - DNA, 12 bp, Homo sapiens
ttctttgttgct

SEQ ID NO: 4776861 - DNA, 16 bp, Homo sapiens
ttcttttcaatgcaat

SEQ ID NO: 4776862 - DNA, 14 bp, Homo sapiens
ttcttttcctgggt

SEQ ID NO: 4776863 - DNA, 21 bp, Homo sapiens
ttcttttttcaatgtactgta

SEQ ID NO: 4776864 - DNA, 19 bp, Homo sapiens
ttgaaaaaatattgtttaa

SEQ ID NO: 4776865 - DNA, 20 bp, Homo sapiens
ttgaaaaaccattttgctgt

SEQ ID NO: 4776866 - DNA, 21 bp, Homo sapiens
ttgaaaacttctcatttatgt

SEQ ID NO: 4776867 - DNA, 20 bp, Homo sapiens
ttgaaacacacagtgaccaa

SEQ ID NO: 4776868 - DNA, 21 bp, Homo sapiens
ttgaaacacacagtgaccaag

SEQ ID NO: 4776869 - DNA, 12 bp, Homo sapiens
ttgaaactgtat

SEQ ID NO: 4776870 - DNA, 20 bp, Homo sapiens
ttgaaactgtatttacttgt

SEQ ID NO: 4776871 - DNA, 14 bp, Homo sapiens
ttgaaattatatct

SEQ ID NO: 4776872 - DNA, 15 bp, Homo sapiens
ttgaaattttctgta

SEQ ID NO: 4776873 - DNA, 13 bp, Homo sapiens
ttgaacttcttta

SEQ ID NO: 4776874 - DNA, 19 bp, Homo sapiens
ttgaagacttttctttcag

SEQ ID NO: 4776875 - DNA, 18 bp, Homo sapiens
ttgaagagagatatatct

SEQ ID NO: 4776876 - DNA, 21 bp, Homo sapiens
ttgaagagagatatatctgaa

SEQ ID NO: 4776877 - DNA, 14 bp, Homo sapiens
ttgaagggaaatca

SEQ ID NO: 4776878 - DNA, 17 bp, Homo sapiens
ttgaagtgcatgttaaa

SEQ ID NO: 4776879 - DNA, 15 bp, Homo sapiens
ttgaatagtattgtg

SEQ ID NO: 4776880 - DNA, 19 bp, Homo sapiens
ttgaatcaatctggcttct

SEQ ID NO: 4776881 - DNA, 17 bp, Homo sapiens
ttgaatgataatagctc

SEQ ID NO: 4776882 - DNA, 16 bp, Homo sapiens
ttgaatgatgccatga

SEQ ID NO: 4776883 - DNA, 16 bp, Homo sapiens
ttgaatgcttaaatga

SEQ ID NO: 4776884 - DNA, 14 bp, Homo sapiens
ttgacaataagaaa

SEQ ID NO: 4776885 - DNA, 21 bp, Homo sapiens
ttgacacattgcacacacagt

SEQ ID NO: 4776886 - DNA, 16 bp, Homo sapiens
ttgacatcaactgcat

SEQ ID NO: 4776887 - DNA, 18 bp, Homo sapiens
ttgacattgtcagaatgt

SEQ ID NO: 4776888 - DNA, 16 bp, Homo sapiens
ttgacattttgtagct

SEQ ID NO: 4776889 - DNA, 18 bp, Homo sapiens
ttgaccctgaaatatttt

SEQ ID NO: 4776890 - DNA, 17 bp, Homo sapiens
ttgaccgtgaggccaga

SEQ ID NO: 4776891 - DNA, 21 bp, Homo sapiens
ttgaccgtgaggccagagaca

SEQ ID NO: 4776892 - DNA, 23 bp, Homo sapiens
ttgacctcacagtgacccttccc

SEQ ID NO: 4776893 - DNA, 13 bp, Homo sapiens
ttgacctttattt

SEQ ID NO: 4776894 - DNA, 22 bp, Homo sapiens
ttgacgacctacatctgaaatc

SEQ ID NO: 4776895 - DNA, 18 bp, Homo sapiens
ttgacgagtcaccttcca

SEQ ID NO: 4776896 - DNA, 20 bp, Homo sapiens
ttgactgttatttgttgaga

SEQ ID NO: 4776897 - DNA, 17 bp, Homo sapiens
ttgacttcaaatgtgta

SEQ ID NO: 4776898 - DNA, 17 bp, Homo sapiens
ttgacttgccactgcca

SEQ ID NO: 4776899 - DNA, 18 bp, Homo sapiens
ttgacttgccactgccat

SEQ ID NO: 4776900 - DNA, 13 bp, Homo sapiens
ttgagacactgtc

SEQ ID NO: 4776901 - DNA, 15 bp, Homo sapiens
ttgagacactgtcaa

SEQ ID NO: 4776902 - DNA, 23 bp, Homo sapiens
ttgagacactgtcaagattaagt

SEQ ID NO: 4776903 - DNA, 15 bp, Homo sapiens
ttgagcaaggcaaga

SEQ ID NO: 4776904 - DNA, 12 bp, Homo sapiens
ttgagcagctga

SEQ ID NO: 4776905 - DNA, 21 bp, Homo sapiens
ttgagcagtggcctacaaatc

SEQ ID NO: 4776906 - DNA, 20 bp, Homo sapiens
ttgagcatgcccaaatataa

SEQ ID NO: 4776907 - DNA, 23 bp, Homo sapiens
ttgagcatgcccaaatataacat

SEQ ID NO: 4776908 - DNA, 17 bp, Homo sapiens
ttgagccttattaaaat

SEQ ID NO: 4776909 - DNA, 14 bp, Homo sapiens
ttgaggaaactcat

SEQ ID NO: 4776910 - DNA, 15 bp, Homo sapiens
ttgaggccaaatgag

SEQ ID NO: 4776911 - DNA, 18 bp, Homo sapiens
ttgagggactgcctctgc

SEQ ID NO: 4776912 - DNA, 15 bp, Homo sapiens
ttgaggggaggtggc

SEQ ID NO: 4776913 - DNA, 22 bp, Homo sapiens
ttgaggggaggtggccagcccg

SEQ ID NO: 4776914 - DNA, 13 bp, Homo sapiens
ttgagtcatttta

SEQ ID NO: 4776915 - DNA, 13 bp, Homo sapiens
ttgagtggacagc

SEQ ID NO: 4776916 - DNA, 17 bp, Homo sapiens
ttgagtggacagcagct

SEQ ID NO: 4776917 - DNA, 23 bp, Homo sapiens
ttgagttcttcctgtaatcttgt

SEQ ID NO: 4776918 - DNA, 14 bp, Homo sapiens
ttgataataaaatt

SEQ ID NO: 4776919 - DNA, 13 bp, Homo sapiens
ttgatatcccaag

SEQ ID NO: 4776920 - DNA, 23 bp, Homo sapiens
ttgatattctaagaaatatctgt

SEQ ID NO: 4776921 - DNA, 15 bp, Homo sapiens
ttgatctatgggaaa

SEQ ID NO: 4776922 - DNA, 19 bp, Homo sapiens
ttgatctatgggaaatcta

SEQ ID NO: 4776923 - DNA, 19 bp, Homo sapiens
ttgatctggtgcgtgtggc

SEQ ID NO: 4776924 - DNA, 20 bp, Homo sapiens
ttgatctggtgcgtgtggcc

SEQ ID NO: 4776925 - DNA, 19 bp, Homo sapiens
ttgatgaccaatctctgtg

SEQ ID NO: 4776926 - DNA, 20 bp, Homo sapiens
ttgatgaccaatctctgtga

SEQ ID NO: 4776927 - DNA, 19 bp, Homo sapiens
ttgatgctgtttctacatt

SEQ ID NO: 4776928 - DNA, 23 bp, Homo sapiens
ttgatgttctttcacccttttct

SEQ ID NO: 4776929 - DNA, 16 bp, Homo sapiens
ttgattaagtatatct

SEQ ID NO: 4776930 - DNA, 12 bp, Homo sapiens
ttgattacataa

SEQ ID NO: 4776931 - DNA, 16 bp, Homo sapiens
ttgattacataatgtt

SEQ ID NO: 4776932 - DNA, 13 bp, Homo sapiens
ttgattcataatg

SEQ ID NO: 4776933 - DNA, 20 bp, Homo sapiens
ttgattttccccctaattct

SEQ ID NO: 4776934 - DNA, 17 bp, Homo sapiens
ttgcaagctccagtagc

SEQ ID NO: 4776935 - DNA, 23 bp, Homo sapiens
ttgcaataaactcagtcaaatgt

SEQ ID NO: 4776936 - DNA, 17 bp, Homo sapiens
ttgcaattgtttaagaa

SEQ ID NO: 4776937 - DNA, 19 bp, Homo sapiens
ttgcaattgtttaagaatc

SEQ ID NO: 4776938 - DNA, 20 bp, Homo sapiens
ttgcacatggattgattaaa

SEQ ID NO: 4776939 - DNA, 20 bp, Homo sapiens
ttgcactaaaagtgatgtga

SEQ ID NO: 4776940 - DNA, 14 bp, Homo sapiens
ttgcagcagttgct

SEQ ID NO: 4776941 - DNA, 20 bp, Homo sapiens
ttgcaggtgaccagaatgag

SEQ ID NO: 4776942 - DNA, 13 bp, Homo sapiens
ttgcagtaaagtt

SEQ ID NO: 4776943 - DNA, 20 bp, Homo sapiens
ttgcatcacaatttgttgaa

SEQ ID NO: 4776944 - DNA, 13 bp, Homo sapiens
ttgcattgtctgt

SEQ ID NO: 4776945 - DNA, 17 bp, Homo sapiens
ttgccaaggcatcccca

SEQ ID NO: 4776946 - DNA, 20 bp, Homo sapiens
ttgccacattgcttcattaa

SEQ ID NO: 4776947 - DNA, 13 bp, Homo sapiens
ttgccactgccat

SEQ ID NO: 4776948 - DNA, 22 bp, Homo sapiens
ttgccaggaaaggagagtactt

SEQ ID NO: 4776949 - DNA, 21 bp, Homo sapiens
ttgccagtcttttgtcctgca

SEQ ID NO: 4776950 - DNA, 14 bp, Homo sapiens
ttgccatccttgca

SEQ ID NO: 4776951 - DNA, 22 bp, Homo sapiens
ttgccctattataattgtcatg

SEQ ID NO: 4776952 - DNA, 19 bp, Homo sapiens
ttgccctgcgtcccttctc

SEQ ID NO: 4776953 - DNA, 18 bp, Homo sapiens
ttgccgtggcatcttaaa

SEQ ID NO: 4776954 - DNA, 18 bp, Homo sapiens
ttgcctcattttgcttcc

SEQ ID NO: 4776955 - DNA, 19 bp, Homo sapiens
ttgcctctttaaattatga

SEQ ID NO: 4776956 - DNA, 15 bp, Homo sapiens
ttgccttaattctta

SEQ ID NO: 4776957 - DNA, 16 bp, Homo sapiens
ttgcctttggttcccc

SEQ ID NO: 4776958 - DNA, 19 bp, Homo sapiens
ttgctaagataattaaatg

SEQ ID NO: 4776959 - DNA, 23 bp, Homo sapiens
ttgctaagataattaaatgaaat

SEQ ID NO: 4776960 - DNA, 20 bp, Homo sapiens
ttgctacatcagagtgtatt

SEQ ID NO: 4776961 - DNA, 21 bp, Homo sapiens
ttttatctgaaatcaattaaa

SEQ ID NO: 4776962 - DNA, 14 bp, Homo sapiens
ttttattgaataac

SEQ ID NO: 4776963 - DNA, 21 bp, Homo sapiens
ttttatttctcgggtgcattt

SEQ ID NO: 4776964 - DNA, 12 bp, Homo sapiens
ttttcaatgcaa

SEQ ID NO: 4776965 - DNA, 17 bp, Homo sapiens
ttttcaatgcaatgcat

SEQ ID NO: 4776966 - DNA, 15 bp, Homo sapiens
ttttcacagttctct

SEQ ID NO: 4776967 - DNA, 13 bp, Homo sapiens
ttttcacttctta

SEQ ID NO: 4776968 - DNA, 18 bp, Homo sapiens
ttttcaggtgctcaaaat

SEQ ID NO: 4776969 - DNA, 21 bp, Homo sapiens
ttttcaggtgctcaaaatgca

SEQ ID NO: 4776970 - DNA, 13 bp, Homo sapiens
ttttcatatcatt

SEQ ID NO: 4776971 - DNA, 16 bp, Homo sapiens
ttttcatatcatttct

SEQ ID NO: 4776972 - DNA, 20 bp, Homo sapiens
ttttcatttaggtgaggaag

SEQ ID NO: 4776973 - DNA, 14 bp, Homo sapiens
ttttccctctggca

SEQ ID NO: 4776974 - DNA, 17 bp, Homo sapiens
ttttcctcttagaagaa

SEQ ID NO: 4776975 - DNA, 13 bp, Homo sapiens
ttttcctgtcaat

SEQ ID NO: 4776976 - DNA, 16 bp, Homo sapiens
ttttcgtgcatttgtg

SEQ ID NO: 4776977 - DNA, 17 bp, Homo sapiens
ttttcgtgcatttgtga

SEQ ID NO: 4776978 - DNA, 23 bp, Homo sapiens
ttttctactcgagttacagacaa

SEQ ID NO: 4776979 - DNA, 18 bp, Homo sapiens
ttttctatgtccagcctt

SEQ ID NO: 4776980 - DNA, 19 bp, Homo sapiens
ttttctattccttctggcc

SEQ ID NO: 4776981 - DNA, 16 bp, Homo sapiens
ttttctgttccctgct

SEQ ID NO: 4776982 - DNA, 22 bp, Homo sapiens
ttttcttccaacatgtgatgtg

SEQ ID NO: 4776983 - DNA, 11 bp, Homo sapiens
ttttcttgtat

SEQ ID NO: 4776984 - DNA, 13 bp, Homo sapiens
ttttctttataat

SEQ ID NO: 4776985 - DNA, 16 bp, Homo sapiens
ttttctttcagccaag

SEQ ID NO: 4776986 - DNA, 22 bp, Homo sapiens
ttttgaagaagggaaattcaca

SEQ ID NO: 4776987 - DNA, 13 bp, Homo sapiens
ttttgaattgtgt

SEQ ID NO: 4776988 - DNA, 17 bp, Homo sapiens
ttttgacttgccactgc

SEQ ID NO: 4776989 - DNA, 17 bp, Homo sapiens
ttttgagtgccttacac

SEQ ID NO: 4776990 - DNA, 18 bp, Homo sapiens
ttttgatacttgtaactt

SEQ ID NO: 4776991 - DNA, 17 bp, Homo sapiens
ttttgattgtttgatga

SEQ ID NO: 4776992 - DNA, 12 bp, Homo sapiens
ttttgcaataag

SEQ ID NO: 4776993 - DNA, 14 bp, Homo sapiens
ttttgcctctttaa

SEQ ID NO: 4776994 - DNA, 11 bp, Homo sapiens
ttttgctctcc

SEQ ID NO: 4776995 - DNA, 18 bp, Homo sapiens
ttttgggttttcttccct

SEQ ID NO: 4776996 - DNA, 16 bp, Homo sapiens
ttttgtaaaatgtatt

SEQ ID NO: 4776997 - DNA, 18 bp, Homo sapiens
ttttgtaaaatgtattat

SEQ ID NO: 4776998 - DNA, 18 bp, Homo sapiens
ttttgtaaaattccatgg

SEQ ID NO: 4776999 - DNA, 14 bp, Homo sapiens
ttttgtaactcttt

SEQ ID NO: 4777000 - DNA, 21 bp, Homo sapiens
ttttgtagtagttgatgacca

SEQ ID NO: 4777001 - DNA, 21 bp, Homo sapiens
ttttgtcacccaacctggcat

SEQ ID NO: 4777002 - DNA, 19 bp, Homo sapiens
ttttgtctgtgataacaga

SEQ ID NO: 4777003 - DNA, 13 bp, Homo sapiens
ttttgtcttcaac

SEQ ID NO: 4777004 - DNA, 21 bp, Homo sapiens
ttttgtgaagaaacatttatc

SEQ ID NO: 4777005 - DNA, 19 bp, Homo sapiens
ttttgttgattaaaacatt

SEQ ID NO: 4777006 - DNA, 15 bp, Homo sapiens
ttttgtttcttggtg

SEQ ID NO: 4777007 - DNA, 19 bp, Homo sapiens
tttttaacttatctccagc

SEQ ID NO: 4777008 - DNA, 18 bp, Homo sapiens
tttttaatctcttgtcat

SEQ ID NO: 4777009 - DNA, 19 bp, Homo sapiens
tttttaatctcttgtcatt

SEQ ID NO: 4777010 - DNA, 16 bp, Homo sapiens
tttttactcaggcttt

SEQ ID NO: 4777011 - DNA, 22 bp, Homo sapiens
tttttactcaggctttctattg

SEQ ID NO: 4777012 - DNA, 19 bp, Homo sapiens
tttttagagattaatttgt

SEQ ID NO: 4777013 - DNA, 21 bp, Homo sapiens
tttttattaggttaagtctca

SEQ ID NO: 4777014 - DNA, 11 bp, Homo sapiens
tttttgaagaa

SEQ ID NO: 4777015 - DNA, 21 bp, Homo sapiens
tttttgaagaagggaaattca

SEQ ID NO: 4777016 - DNA, 17 bp, Homo sapiens
tttttggttttctcctt

SEQ ID NO: 4777017 - DNA, 14 bp, Homo sapiens
tttttgtaactctt

SEQ ID NO: 4777018 - DNA, 23 bp, Homo sapiens
tttttgttcaccttctgtgcatc

SEQ ID NO: 4777019 - DNA, 12 bp, Homo sapiens
ttttttcaatgt

SEQ ID NO: 4777020 - DNA, 13 bp, Homo sapiens
ttttttcaatgta

SEQ ID NO: 4777021 - DNA, 14 bp, Homo sapiens
ttttttcctgtcaa

SEQ ID NO: 4777022 - DNA, 10 bp, Homo sapiens
ttttttgaga

SEQ ID NO: 4777023 - DNA, 16 bp, Homo sapiens
ttttttgctatggaag

SEQ ID NO: 4777024 - DNA, 13 bp, Homo sapiens
ttttttgtaactc

SEQ ID NO: 4777025 - DNA, 16 bp, Homo sapiens
tctggctgtggcccct

SEQ ID NO: 4777026 - DNA, 18 bp, Homo sapiens
tctggctgtggcccctcc

SEQ ID NO: 4777027 - DNA, 13 bp, Homo sapiens
tctggcttctgca

SEQ ID NO: 4777028 - DNA, 14 bp, Homo sapiens
tctgggaagaaaat

SEQ ID NO: 4777029 - DNA, 12 bp, Homo sapiens
tctgggactgct

SEQ ID NO: 4777030 - DNA, 12 bp, Homo sapiens
tctgggcctggg

SEQ ID NO: 4777031 - DNA, 14 bp, Homo sapiens
tctggggccctggg

SEQ ID NO: 4777032 - DNA, 11 bp, Homo sapiens
tctggggctgt

SEQ ID NO: 4777033 - DNA, 14 bp, Homo sapiens
tctgggttaacagt

SEQ ID NO: 4777034 - DNA, 14 bp, Homo sapiens
tctggtattaaatg

SEQ ID NO: 4777035 - DNA, 22 bp, Homo sapiens
tctggtccacacaccacagaag

SEQ ID NO: 4777036 - DNA, 21 bp, Homo sapiens
tctggtgcgtgtggccctgtg

SEQ ID NO: 4777037 - DNA, 20 bp, Homo sapiens
tctgtaatatttacaatgta

SEQ ID NO: 4777038 - DNA, 21 bp, Homo sapiens
tctgtacatgtggaaaactca

SEQ ID NO: 4777039 - DNA, 21 bp, Homo sapiens
tctgtacgaggcttctctaac

SEQ ID NO: 4777040 - DNA, 16 bp, Homo sapiens
tctgtagccaacttaa

SEQ ID NO: 4777041 - DNA, 14 bp, Homo sapiens
tctgtagcctggtc

SEQ ID NO: 4777042 - DNA, 17 bp, Homo sapiens
tctgtagcctggtctgt

SEQ ID NO: 4777043 - DNA, 20 bp, Homo sapiens
tctgtagcctggtctgtgca

SEQ ID NO: 4777044 - DNA, 22 bp, Homo sapiens
tctgtagcctggtctgtgcatt

SEQ ID NO: 4777045 - DNA, 13 bp, Homo sapiens
tctgtataaatgt

SEQ ID NO: 4777046 - DNA, 16 bp, Homo sapiens
tctgtataatactttg

SEQ ID NO: 4777047 - DNA, 19 bp, Homo sapiens
tctgtataatactttgtat

SEQ ID NO: 4777048 - DNA, 18 bp, Homo sapiens
tctgtatatagatgtctg

SEQ ID NO: 4777049 - DNA, 23 bp, Homo sapiens
tctgtatatagatgtctgtgtat

SEQ ID NO: 4777050 - DNA, 16 bp, Homo sapiens
tctgtatatcagctct

SEQ ID NO: 4777051 - DNA, 18 bp, Homo sapiens
tctgtatatcagctctaa

SEQ ID NO: 4777052 - DNA, 17 bp, Homo sapiens
tctgtattggcagcaca

SEQ ID NO: 4777053 - DNA, 19 bp, Homo sapiens
tctgtattggcagcacagc

SEQ ID NO: 4777054 - DNA, 15 bp, Homo sapiens
tctgtcaaagtcaga

SEQ ID NO: 4777055 - DNA, 14 bp, Homo sapiens
tctgtcaatgaaaa

SEQ ID NO: 4777056 - DNA, 21 bp, Homo sapiens
tctgtcagcttcccaacaata

SEQ ID NO: 4777057 - DNA, 21 bp, Homo sapiens
tctgtcatctctctggggccc

SEQ ID NO: 4777058 - DNA, 23 bp, Homo sapiens
tctgtcatctctctggggccctg

SEQ ID NO: 4777059 - DNA, 19 bp, Homo sapiens
tctgtcattggttacaaat

SEQ ID NO: 4777060 - DNA, 21 bp, Homo sapiens
tctgtcattggttacaaattt

SEQ ID NO: 4777061 - DNA, 12 bp, Homo sapiens
tctgtccagaca

SEQ ID NO: 4777062 - DNA, 12 bp, Homo sapiens
tctgtcctgcgc

SEQ ID NO: 4777063 - DNA, 15 bp, Homo sapiens
tctgtcctgcgcctg

SEQ ID NO: 4777064 - DNA, 21 bp, Homo sapiens
tctgtccttccaacctgttca

SEQ ID NO: 4777065 - DNA, 17 bp, Homo sapiens
tctgtccttcccccagc

SEQ ID NO: 4777066 - DNA, 22 bp, Homo sapiens
tctgtgaaagtctcctgtatca

SEQ ID NO: 4777067 - DNA, 16 bp, Homo sapiens
tctgtgaaatatcatc

SEQ ID NO: 4777068 - DNA, 18 bp, Homo sapiens
tctgtgaagcctttatct

SEQ ID NO: 4777069 - DNA, 17 bp, Homo sapiens
tctgtgaataaagccac

SEQ ID NO: 4777070 - DNA, 18 bp, Homo sapiens
tctgtgactcgcttagct

SEQ ID NO: 4777071 - DNA, 21 bp, Homo sapiens
tctgtgactcgcttagctgaa

SEQ ID NO: 4777072 - DNA, 14 bp, Homo sapiens
tctgtgagtctgtc

SEQ ID NO: 4777073 - DNA, 15 bp, Homo sapiens
tctgtgcatctggcc

SEQ ID NO: 4777074 - DNA, 19 bp, Homo sapiens
tctgtgcatctggcctggg

SEQ ID NO: 4777075 - DNA, 17 bp, Homo sapiens
tctgtgctaagttgtct

SEQ ID NO: 4777076 - DNA, 15 bp, Homo sapiens
tctgtggcctggggc

SEQ ID NO: 4777077 - DNA, 17 bp, Homo sapiens
tctgtggctgatttact

SEQ ID NO: 4777078 - DNA, 13 bp, Homo sapiens
tctgtgggactgg

SEQ ID NO: 4777079 - DNA, 23 bp, Homo sapiens
tctgtgggactggcccacccctc

SEQ ID NO: 4777080 - DNA, 22 bp, Homo sapiens
tctgtgggtttctaaagctgcc

SEQ ID NO: 4777081 - DNA, 23 bp, Homo sapiens
tctgtgggtttctaaagctgcca

SEQ ID NO: 4777082 - DNA, 18 bp, Homo sapiens
tctgtgtcacgtgaccct

SEQ ID NO: 4777083 - DNA, 20 bp, Homo sapiens
tctgtgtcacgtgaccctgt

SEQ ID NO: 4777084 - DNA, 23 bp, Homo sapiens
tctgtgtcacgtgaccctgtgcc

SEQ ID NO: 4777085 - DNA, 11 bp, Homo sapiens
tctgtgtggca

SEQ ID NO: 4777086 - DNA, 12 bp, Homo sapiens
tctgtgtggcaa

SEQ ID NO: 4777087 - DNA, 19 bp, Homo sapiens
tctgtgtgtgaattccttt

SEQ ID NO: 4777088 - DNA, 20 bp, Homo sapiens
tctgtgttctcaacacacag

SEQ ID NO: 4777089 - DNA, 23 bp, Homo sapiens
tctgttatacacagttccacaat

SEQ ID NO: 4777090 - DNA, 10 bp, Homo sapiens
tctgttccaa

SEQ ID NO: 4777091 - DNA, 12 bp, Homo sapiens
tctgttctatgg

SEQ ID NO: 4777092 - DNA, 19 bp, Homo sapiens
tctgttctttcatactaca

SEQ ID NO: 4777093 - DNA, 18 bp, Homo sapiens
tctgttgaagtgcatgtt

SEQ ID NO: 4777094 - DNA, 12 bp, Homo sapiens
tctgtttatgtt

SEQ ID NO: 4777095 - DNA, 21 bp, Homo sapiens
tctgtttatgttcttgcagca

SEQ ID NO: 4777096 - DNA, 13 bp, Homo sapiens
tcttaaaaattat

SEQ ID NO: 4777097 - DNA, 18 bp, Homo sapiens
tcttaaaaattatcttta

SEQ ID NO: 4777098 - DNA, 17 bp, Homo sapiens
tcttaaacccacataaa

SEQ ID NO: 4777099 - DNA, 21 bp, Homo sapiens
tcttaaacccacataaacact

SEQ ID NO: 4777100 - DNA, 13 bp, Homo sapiens
tcttaactaatgt

SEQ ID NO: 4777101 - DNA, 15 bp, Homo sapiens
tcttaactaatgtaa

SEQ ID NO: 4777102 - DNA, 23 bp, Homo sapiens
tcttaagctgcccaatttcacag

SEQ ID NO: 4777103 - DNA, 18 bp, Homo sapiens
tcttaaggacagtgttca

SEQ ID NO: 4777104 - DNA, 17 bp, Homo sapiens
tcttaatagaaagtcag

SEQ ID NO: 4777105 - DNA, 14 bp, Homo sapiens
tcttacccacttcc

SEQ ID NO: 4777106 - DNA, 22 bp, Homo sapiens
tcttacccacttccctgcaagg

SEQ ID NO: 4777107 - DNA, 22 bp, Homo sapiens
tcttaccccgtccctttccctg

SEQ ID NO: 4777108 - DNA, 17 bp, Homo sapiens
tcttacccttcaatgtt

SEQ ID NO: 4777109 - DNA, 14 bp, Homo sapiens
tcttaccgaaatga

SEQ ID NO: 4777110 - DNA, 15 bp, Homo sapiens
tcttacctcatttgc

SEQ ID NO: 4777111 - DNA, 23 bp, Homo sapiens
tcttactcaagatactggactaa

SEQ ID NO: 4777112 - DNA, 15 bp, Homo sapiens
tcttagaagaatatt

SEQ ID NO: 4777113 - DNA, 20 bp, Homo sapiens
tcttagaagaatattgtatt

SEQ ID NO: 4777114 - DNA, 13 bp, Homo sapiens
tcttagagaataa

SEQ ID NO: 4777115 - DNA, 14 bp, Homo sapiens
tcttagagaataag

SEQ ID NO: 4777116 - DNA, 22 bp, Homo sapiens
tcttagagaataagaataataa

SEQ ID NO: 4777117 - DNA, 18 bp, Homo sapiens
tcttagggtacagcccag

SEQ ID NO: 4777118 - DNA, 21 bp, Homo sapiens
tcttagggtacagcccaggcg

SEQ ID NO: 4777119 - DNA, 14 bp, Homo sapiens
tcttatttatatat

SEQ ID NO: 4777120 - DNA, 17 bp, Homo sapiens
tcttatttatatatgaa

SEQ ID NO: 4777121 - DNA, 19 bp, Homo sapiens
tcttatttatatatgaagt

SEQ ID NO: 4777122 - DNA, 15 bp, Homo sapiens
tcttcaaatatctct

SEQ ID NO: 4777123 - DNA, 14 bp, Homo sapiens
tcttcaaccctgcc

SEQ ID NO: 4777124 - DNA, 18 bp, Homo sapiens
tcttcaaccctgccctgc

SEQ ID NO: 4777125 - DNA, 19 bp, Homo sapiens
tcttcaaccctgccctgca

SEQ ID NO: 4777126 - DNA, 17 bp, Homo sapiens
tcttcaccccggcaggc

SEQ ID NO: 4777127 - DNA, 22 bp, Homo sapiens
tcttcaccccggcaggccctgc

SEQ ID NO: 4777128 - DNA, 20 bp, Homo sapiens
tcttcatccatagacacagt

SEQ ID NO: 4777129 - DNA, 23 bp, Homo sapiens
tcttcatgttgatgtgtccgtga

SEQ ID NO: 4777130 - DNA, 16 bp, Homo sapiens
tcttcattgcactgca

SEQ ID NO: 4777131 - DNA, 16 bp, Homo sapiens
tcttccaacatgtgat

SEQ ID NO: 4777132 - DNA, 18 bp, Homo sapiens
tcttccaacatgtgatgt

SEQ ID NO: 4777133 - DNA, 22 bp, Homo sapiens
tcttccaacatgtgatgtgttg

SEQ ID NO: 4777134 - DNA, 14 bp, Homo sapiens
tcttcccatttgta

SEQ ID NO: 4777135 - DNA, 18 bp, Homo sapiens
tcttcccatttgtaatgt

SEQ ID NO: 4777136 - DNA, 12 bp, Homo sapiens
tcttcccccttc

SEQ ID NO: 4777137 - DNA, 13 bp, Homo sapiens
tcttccctgcttc

SEQ ID NO: 4777138 - DNA, 23 bp, Homo sapiens
tcttccctggccaggggcttctc

SEQ ID NO: 4777139 - DNA, 22 bp, Homo sapiens
tcttcctccaaagcctgggcag

SEQ ID NO: 4777140 - DNA, 14 bp, Homo sapiens
tcttcctcttacct

SEQ ID NO: 4777141 - DNA, 15 bp, Homo sapiens
tcttcctgtaatctt

SEQ ID NO: 4777142 - DNA, 13 bp, Homo sapiens
tcttccttccttt

SEQ ID NO: 4777143 - DNA, 13 bp, Homo sapiens
tcttcgctgtgat

SEQ ID NO: 4777144 - DNA, 22 bp, Homo sapiens
tcttcgctgtgatgcatgagct

SEQ ID NO: 4777145 - DNA, 18 bp, Homo sapiens
tcttcggtggccttgagt

SEQ ID NO: 4777146 - DNA, 17 bp, Homo sapiens
tcttctaaaactactgc

SEQ ID NO: 4777147 - DNA, 17 bp, Homo sapiens
tgacttctttttggcat

SEQ ID NO: 4777148 - DNA, 14 bp, Homo sapiens
tgacttgccactgc

SEQ ID NO: 4777149 - DNA, 17 bp, Homo sapiens
tgacttgccactgccat

SEQ ID NO: 4777150 - DNA, 16 bp, Homo sapiens
tgactttcagattgta

SEQ ID NO: 4777151 - DNA, 16 bp, Homo sapiens
tgactttcctatgaca

SEQ ID NO: 4777152 - DNA, 20 bp, Homo sapiens
tgactttggagacgatgctt

SEQ ID NO: 4777153 - DNA, 17 bp, Homo sapiens
tgagaaattgtgccaaa

SEQ ID NO: 4777154 - DNA, 15 bp, Homo sapiens
tgagaactaaataga

SEQ ID NO: 4777155 - DNA, 12 bp, Homo sapiens
tgagaactgtga

SEQ ID NO: 4777156 - DNA, 18 bp, Homo sapiens
tgagaactgtgaatatgt

SEQ ID NO: 4777157 - DNA, 14 bp, Homo sapiens
tgagaaggccccag

SEQ ID NO: 4777158 - DNA, 16 bp, Homo sapiens
tgagaaggccccaggg

SEQ ID NO: 4777159 - DNA, 22 bp, Homo sapiens
tgagaagtaaattattttatgt

SEQ ID NO: 4777160 - DNA, 19 bp, Homo sapiens
tgagaagtacagggcagaa

SEQ ID NO: 4777161 - DNA, 20 bp, Homo sapiens
tgagaagtacagggcagaac

SEQ ID NO: 4777162 - DNA, 13 bp, Homo sapiens
tgagaatgtcatt

SEQ ID NO: 4777163 - DNA, 22 bp, Homo sapiens
tgagaattgaggggaggtggcc

SEQ ID NO: 4777164 - DNA, 15 bp, Homo sapiens
tgagacaacacacac

SEQ ID NO: 4777165 - DNA, 16 bp, Homo sapiens
tgagacaacacacaca

SEQ ID NO: 4777166 - DNA, 15 bp, Homo sapiens
tgagacaatgccttg

SEQ ID NO: 4777167 - DNA, 18 bp, Homo sapiens
tgagacacagcccagaga

SEQ ID NO: 4777168 - DNA, 13 bp, Homo sapiens
tgagacactgtca

SEQ ID NO: 4777169 - DNA, 16 bp, Homo sapiens
tgagacactgtcaaga

SEQ ID NO: 4777170 - DNA, 22 bp, Homo sapiens
tgagacttcctattaatttatt

SEQ ID NO: 4777171 - DNA, 19 bp, Homo sapiens
tgagagcctccaggttcct

SEQ ID NO: 4777172 - DNA, 22 bp, Homo sapiens
tgagaggcatccagtatcttga

SEQ ID NO: 4777173 - DNA, 15 bp, Homo sapiens
tgagagtagggccct

SEQ ID NO: 4777174 - DNA, 20 bp, Homo sapiens
tgagagtcatctcaaacact

SEQ ID NO: 4777175 - DNA, 19 bp, Homo sapiens
tgagatcctcaaaaatcat

SEQ ID NO: 4777176 - DNA, 21 bp, Homo sapiens
tgagatcctcaaaaatcatca

SEQ ID NO: 4777177 - DNA, 15 bp, Homo sapiens
tgagatgatttaatt

SEQ ID NO: 4777178 - DNA, 21 bp, Homo sapiens
tgagatgatttccaagcctct

SEQ ID NO: 4777179 - DNA, 22 bp, Homo sapiens
tgagatgtagcaaattccaata

SEQ ID NO: 4777180 - DNA, 13 bp, Homo sapiens
tgagatgtctgcg

SEQ ID NO: 4777181 - DNA, 15 bp, Homo sapiens
tgagatgtgtatcag

SEQ ID NO: 4777182 - DNA, 18 bp, Homo sapiens
tgagatgtgtatcagtgt

SEQ ID NO: 4777183 - DNA, 19 bp, Homo sapiens
tgagatgtgtatcagtgtt

SEQ ID NO: 4777184 - DNA, 21 bp, Homo sapiens
tgagatgtttagtagctgata

SEQ ID NO: 4777185 - DNA, 12 bp, Homo sapiens
tgagatgtttgg

SEQ ID NO: 4777186 - DNA, 14 bp, Homo sapiens
tgagatgtttggca

SEQ ID NO: 4777187 - DNA, 21 bp, Homo sapiens
tgagatgtttggcaagaaatc

SEQ ID NO: 4777188 - DNA, 13 bp, Homo sapiens
tgagattctaaat

SEQ ID NO: 4777189 - DNA, 19 bp, Homo sapiens
tgagattctaaatgttcat

SEQ ID NO: 4777190 - DNA, 19 bp, Homo sapiens
tgagcaaggcaagaagtgg

SEQ ID NO: 4777191 - DNA, 20 bp, Homo sapiens
tgagcacatctcttcatgcg

SEQ ID NO: 4777192 - DNA, 21 bp, Homo sapiens
tgagcagacagggcgtcctct

SEQ ID NO: 4777193 - DNA, 12 bp, Homo sapiens
tgagcagctgaa

SEQ ID NO: 4777194 - DNA, 21 bp, Homo sapiens
tgagcagtaaatgtatattga

SEQ ID NO: 4777195 - DNA, 17 bp, Homo sapiens
tgagcagtggggagcgg

SEQ ID NO: 4777196 - DNA, 15 bp, Homo sapiens
tgagcatgctccctc

SEQ ID NO: 4777197 - DNA, 23 bp, Homo sapiens
tgagcatgctccctcatgcagat

SEQ ID NO: 4777198 - DNA, 19 bp, Homo sapiens
tgagccacagtggggccca

SEQ ID NO: 4777199 - DNA, 23 bp, Homo sapiens
tgagccacagtggggcccatggc

SEQ ID NO: 4777200 - DNA, 22 bp, Homo sapiens
tgagcccacaggagctcccttt

SEQ ID NO: 4777201 - DNA, 11 bp, Homo sapiens
tgagcccctcc

SEQ ID NO: 4777202 - DNA, 22 bp, Homo sapiens
tgagcctggcccatagaaacat

SEQ ID NO: 4777203 - DNA, 19 bp, Homo sapiens
tgagcgccccgcccccacc

SEQ ID NO: 4777204 - DNA, 16 bp, Homo sapiens
tgagcgtccaggtgat

SEQ ID NO: 4777205 - DNA, 14 bp, Homo sapiens
tgagctaccaggaa

SEQ ID NO: 4777206 - DNA, 15 bp, Homo sapiens
tgagctaccaggaag

SEQ ID NO: 4777207 - DNA, 19 bp, Homo sapiens
tgagctaccaggaagaggg

SEQ ID NO: 4777208 - DNA, 17 bp, Homo sapiens
tgagctatgatatgtgc

SEQ ID NO: 4777209 - DNA, 15 bp, Homo sapiens
tgagctccaccctcc

SEQ ID NO: 4777210 - DNA, 16 bp, Homo sapiens
tgagctccaccctccc

SEQ ID NO: 4777211 - DNA, 17 bp, Homo sapiens
tgagctccaccctcccc

SEQ ID NO: 4777212 - DNA, 19 bp, Homo sapiens
tgagctccccaatccaacc

SEQ ID NO: 4777213 - DNA, 20 bp, Homo sapiens
tgagctccccaatccaaccc

SEQ ID NO: 4777214 - DNA, 18 bp, Homo sapiens
tgagctccctcgctgtat

SEQ ID NO: 4777215 - DNA, 15 bp, Homo sapiens
tgagctcttggcagg

SEQ ID NO: 4777216 - DNA, 13 bp, Homo sapiens
tgagctggttttc

SEQ ID NO: 4777217 - DNA, 22 bp, Homo sapiens
tgagcttgattctaaaggggac

SEQ ID NO: 4777218 - DNA, 17 bp, Homo sapiens
tgaggaaactcatacag

SEQ ID NO: 4777219 - DNA, 16 bp, Homo sapiens
tgaggaacctcaaact

SEQ ID NO: 4777220 - DNA, 15 bp, Homo sapiens
tgaggaagcaaaagc

SEQ ID NO: 4777221 - DNA, 14 bp, Homo sapiens
tgaggacctttctg

SEQ ID NO: 4777222 - DNA, 18 bp, Homo sapiens
tgaggacggggcagagct

SEQ ID NO: 4777223 - DNA, 18 bp, Homo sapiens
tgaggaggggagcaaggc

SEQ ID NO: 4777224 - DNA, 22 bp, Homo sapiens
tgaggaggggagcaaggctgct

SEQ ID NO: 4777225 - DNA, 18 bp, Homo sapiens
tgaggagtgatgggcaag

SEQ ID NO: 4777226 - DNA, 12 bp, Homo sapiens
tgaggcacatga

SEQ ID NO: 4777227 - DNA, 18 bp, Homo sapiens
tgaggcagggcaaatgac

SEQ ID NO: 4777228 - DNA, 22 bp, Homo sapiens
tgaggccaaatgagttcccttg

SEQ ID NO: 4777229 - DNA, 14 bp, Homo sapiens
tgaggcccccggag

SEQ ID NO: 4777230 - DNA, 16 bp, Homo sapiens
tgaggcccccggaggc

SEQ ID NO: 4777231 - DNA, 22 bp, Homo sapiens
tgaggcccccggaggcgcccac

SEQ ID NO: 4777232 - DNA, 15 bp, Homo sapiens
tgagggaagcccacc

SEQ ID NO: 4777233 - DNA, 20 bp, Homo sapiens
tgagggaagcccacccgccc

SEQ ID NO: 4777234 - DNA, 21 bp, Homo sapiens
tgagggaagcccacccgcccc

SEQ ID NO: 4777235 - DNA, 19 bp, Homo sapiens
tgagggatacccatcccat

SEQ ID NO: 4777236 - DNA, 18 bp, Homo sapiens
tgagggcaaaccaggctg

SEQ ID NO: 4777237 - DNA, 19 bp, Homo sapiens
tgagggcaaaccaggctgc

SEQ ID NO: 4777238 - DNA, 20 bp, Homo sapiens
tgagggcaaaccaggctgca

SEQ ID NO: 4777239 - DNA, 21 bp, Homo sapiens
tgaggggaggtggccagcccg

SEQ ID NO: 4777240 - DNA, 14 bp, Homo sapiens
tgagggttccatgg

SEQ ID NO: 4777241 - DNA, 17 bp, Homo sapiens
tgaggtgggcctttgag

SEQ ID NO: 4777242 - DNA, 18 bp, Homo sapiens
tgaggttaaggggatcta

SEQ ID NO: 4777243 - DNA, 14 bp, Homo sapiens
tgaggttgagctat

SEQ ID NO: 4777244 - DNA, 16 bp, Homo sapiens
tgaggtttcagtagct

SEQ ID NO: 4777245 - DNA, 16 bp, Homo sapiens
tgagtcagggcccaga

SEQ ID NO: 4777246 - DNA, 20 bp, Homo sapiens
tgagtcctcattgttcagaa

SEQ ID NO: 4777247 - DNA, 13 bp, Homo sapiens
tgagtctctgaat

SEQ ID NO: 4777248 - DNA, 13 bp, Homo sapiens
tgagtctgtcctt

SEQ ID NO: 4777249 - DNA, 21 bp, Homo sapiens
tgagtctgtgaataaagccac

SEQ ID NO: 4777250 - DNA, 22 bp, Homo sapiens
tgagtctgtgaataaagccaca

SEQ ID NO: 4777251 - DNA, 14 bp, Homo sapiens
tgagtgccttacac

SEQ ID NO: 4777252 - DNA, 16 bp, Homo sapiens
tgagtgccttacacaa

SEQ ID NO: 4777253 - DNA, 20 bp, Homo sapiens
tgagtgccttacacaatggt

SEQ ID NO: 4777254 - DNA, 13 bp, Homo sapiens
tgagtggacagca

SEQ ID NO: 4777255 - DNA, 14 bp, Homo sapiens
tgagtggacagcag

SEQ ID NO: 4777256 - DNA, 21 bp, Homo sapiens
tgagtggacagcagctggact

SEQ ID NO: 4777257 - DNA, 22 bp, Homo sapiens
tgagtggacagcagctggactg

SEQ ID NO: 4777258 - DNA, 16 bp, Homo sapiens
tgagtgggccccctct

SEQ ID NO: 4777259 - DNA, 19 bp, Homo sapiens
tgagtgtatgtatacacac

SEQ ID NO: 4777260 - DNA, 21 bp, Homo sapiens
tgagtgtatgtatacacacac

SEQ ID NO: 4777261 - DNA, 14 bp, Homo sapiens
tgagttaagtctat

SEQ ID NO: 4777262 - DNA, 19 bp, Homo sapiens
tgagttctgcacatacaga

SEQ ID NO: 4777263 - DNA, 12 bp, Homo sapiens
tgagtttatggg

SEQ ID NO: 4777264 - DNA, 16 bp, Homo sapiens
tgagtttcatttttca

SEQ ID NO: 4777265 - DNA, 17 bp, Homo sapiens
tgagttttatcttgaca

SEQ ID NO: 4777266 - DNA, 17 bp, Homo sapiens
tgataaagaaaagaatc

SEQ ID NO: 4777267 - DNA, 16 bp, Homo sapiens
tgataaagaaaccttt

SEQ ID NO: 4777268 - DNA, 20 bp, Homo sapiens
tgataagaaccttttgagtg

SEQ ID NO: 4777269 - DNA, 17 bp, Homo sapiens
tcctgggcagcccagag

SEQ ID NO: 4777270 - DNA, 19 bp, Homo sapiens
tcctgggcagcccagagag

SEQ ID NO: 4777271 - DNA, 19 bp, Homo sapiens
tcctgggggctgctgcact

SEQ ID NO: 4777272 - DNA, 20 bp, Homo sapiens
tcctgggggctgctgcactg

SEQ ID NO: 4777273 - DNA, 22 bp, Homo sapiens
tcctgggggctgctgcactgcc

SEQ ID NO: 4777274 - DNA, 15 bp, Homo sapiens
tcctgggggtggcag

SEQ ID NO: 4777275 - DNA, 19 bp, Homo sapiens
tcctgggggtggcaggcac

SEQ ID NO: 4777276 - DNA, 19 bp, Homo sapiens
tcctggggtggttggaggc

SEQ ID NO: 4777277 - DNA, 19 bp, Homo sapiens
tcctgggtgctcagggcat

SEQ ID NO: 4777278 - DNA, 17 bp, Homo sapiens
tcctgtaaaatactatt

SEQ ID NO: 4777279 - DNA, 18 bp, Homo sapiens
tcctgtaactgttacagt

SEQ ID NO: 4777280 - DNA, 16 bp, Homo sapiens
tcctgtcctggctccc

SEQ ID NO: 4777281 - DNA, 19 bp, Homo sapiens
tcctgtctaacttggggaa

SEQ ID NO: 4777282 - DNA, 16 bp, Homo sapiens
tcctgtctcttgggaa

SEQ ID NO: 4777283 - DNA, 22 bp, Homo sapiens
tcctgtgaggatagagacttgc

SEQ ID NO: 4777284 - DNA, 16 bp, Homo sapiens
tcctgtgtcatctgtc

SEQ ID NO: 4777285 - DNA, 19 bp, Homo sapiens
tcctgtgtcatctgtcagc

SEQ ID NO: 4777286 - DNA, 18 bp, Homo sapiens
tcctgtgtttgctcccat

SEQ ID NO: 4777287 - DNA, 22 bp, Homo sapiens
tcctgtttcccttcccttccac

SEQ ID NO: 4777288 - DNA, 18 bp, Homo sapiens
tccttaaaaatgtatgtt

SEQ ID NO: 4777289 - DNA, 13 bp, Homo sapiens
tccttagtaaatt

SEQ ID NO: 4777290 - DNA, 18 bp, Homo sapiens
tccttcaaagtctcaatg

SEQ ID NO: 4777291 - DNA, 19 bp, Homo sapiens
tccttcactctgacagtat

SEQ ID NO: 4777292 - DNA, 17 bp, Homo sapiens
tccttcagcaatcctta

SEQ ID NO: 4777293 - DNA, 14 bp, Homo sapiens
tccttccaaactct

SEQ ID NO: 4777294 - DNA, 19 bp, Homo sapiens
tccttcccaaggcagctgg

SEQ ID NO: 4777295 - DNA, 16 bp, Homo sapiens
tccttcccccagcaca

SEQ ID NO: 4777296 - DNA, 18 bp, Homo sapiens
tccttcccccagcacaaa

SEQ ID NO: 4777297 - DNA, 12 bp, Homo sapiens
tccttcccgcag

SEQ ID NO: 4777298 - DNA, 14 bp, Homo sapiens
tccttcccgcagca

SEQ ID NO: 4777299 - DNA, 22 bp, Homo sapiens
tccttctcagccttggttcctg

SEQ ID NO: 4777300 - DNA, 14 bp, Homo sapiens
tccttctcccctcc

SEQ ID NO: 4777301 - DNA, 19 bp, Homo sapiens
tccttctcccctccagacc

SEQ ID NO: 4777302 - DNA, 21 bp, Homo sapiens
tccttctcccctccagacccc

SEQ ID NO: 4777303 - DNA, 19 bp, Homo sapiens
tccttctgcagtcagactg

SEQ ID NO: 4777304 - DNA, 12 bp, Homo sapiens
tccttctggcct

SEQ ID NO: 4777305 - DNA, 13 bp, Homo sapiens
tccttctggcctt

SEQ ID NO: 4777306 - DNA, 17 bp, Homo sapiens
tccttcttccccaaggc

SEQ ID NO: 4777307 - DNA, 15 bp, Homo sapiens
tccttgccacaatca

SEQ ID NO: 4777308 - DNA, 16 bp, Homo sapiens
tccttgccacaatcac

SEQ ID NO: 4777309 - DNA, 15 bp, Homo sapiens
tccttgccttcaaac

SEQ ID NO: 4777310 - DNA, 14 bp, Homo sapiens
tccttgccttcttt

SEQ ID NO: 4777311 - DNA, 12 bp, Homo sapiens
tccttggcacca

SEQ ID NO: 4777312 - DNA, 12 bp, Homo sapiens
tccttggcccag

SEQ ID NO: 4777313 - DNA, 17 bp, Homo sapiens
tccttggcccagcagcg

SEQ ID NO: 4777314 - DNA, 10 bp, Homo sapiens
tccttggcct

SEQ ID NO: 4777315 - DNA, 13 bp, Homo sapiens
tccttggcctagc

SEQ ID NO: 4777316 - DNA, 22 bp, Homo sapiens
tccttggcctagcccaccctgc

SEQ ID NO: 4777317 - DNA, 15 bp, Homo sapiens
tccttggttttgcct

SEQ ID NO: 4777318 - DNA, 13 bp, Homo sapiens
tccttgtccccgc

SEQ ID NO: 4777319 - DNA, 14 bp, Homo sapiens
tcctttccatcagc

SEQ ID NO: 4777320 - DNA, 15 bp, Homo sapiens
tcctttccatcagct

SEQ ID NO: 4777321 - DNA, 16 bp, Homo sapiens
tcctttccatcagctt

SEQ ID NO: 4777322 - DNA, 23 bp, Homo sapiens
tcctttcctgatcaaggtgctct

SEQ ID NO: 4777323 - DNA, 14 bp, Homo sapiens
tcctttcttccttc

SEQ ID NO: 4777324 - DNA, 23 bp, Homo sapiens
tccttttcacagttctctccttc

SEQ ID NO: 4777325 - DNA, 15 bp, Homo sapiens
tccttttgtatcctc

SEQ ID NO: 4777326 - DNA, 18 bp, Homo sapiens
tcctttttctttttttaa

SEQ ID NO: 4777327 - DNA, 19 bp, Homo sapiens
tccttttttattgaataac

SEQ ID NO: 4777328 - DNA, 14 bp, Homo sapiens
tcgaaagtaaaaaa

SEQ ID NO: 4777329 - DNA, 16 bp, Homo sapiens
tcgaatcactcattta

SEQ ID NO: 4777330 - DNA, 15 bp, Homo sapiens
tcgagagggctgagc

SEQ ID NO: 4777331 - DNA, 21 bp, Homo sapiens
tcgagagggctgagcccctcc

SEQ ID NO: 4777332 - DNA, 13 bp, Homo sapiens
tcgagcccagatg

SEQ ID NO: 4777333 - DNA, 16 bp, Homo sapiens
tcgagcccagatggaa

SEQ ID NO: 4777334 - DNA, 20 bp, Homo sapiens
tcgagctctgtagcctggtc

SEQ ID NO: 4777335 - DNA, 22 bp, Homo sapiens
tcgagctctgtagcctggtctg

SEQ ID NO: 4777336 - DNA, 20 bp, Homo sapiens
tcgagtggcgagtccagaca

SEQ ID NO: 4777337 - DNA, 14 bp, Homo sapiens
tcgatattcccagg

SEQ ID NO: 4777338 - DNA, 17 bp, Homo sapiens
tcgatgggggatgcttc

SEQ ID NO: 4777339 - DNA, 19 bp, Homo sapiens
tcgatgggggatgcttcat

SEQ ID NO: 4777340 - DNA, 13 bp, Homo sapiens
tcgccattccagg

SEQ ID NO: 4777341 - DNA, 11 bp, Homo sapiens
tcgcccaccta

SEQ ID NO: 4777342 - DNA, 13 bp, Homo sapiens
tcgccccaggccc

SEQ ID NO: 4777343 - DNA, 15 bp, Homo sapiens
tcgcccccgggccct

SEQ ID NO: 4777344 - DNA, 18 bp, Homo sapiens
tcgcccccgggccctttc

SEQ ID NO: 4777345 - DNA, 12 bp, Homo sapiens
tcgccctgtgcc

SEQ ID NO: 4777346 - DNA, 14 bp, Homo sapiens
tcgcctgggacgcc

SEQ ID NO: 4777347 - DNA, 12 bp, Homo sapiens
tcgcgcccctgt

SEQ ID NO: 4777348 - DNA, 14 bp, Homo sapiens
tcgctattcccagg

SEQ ID NO: 4777349 - DNA, 16 bp, Homo sapiens
tcgctattcccaggca

SEQ ID NO: 4777350 - DNA, 15 bp, Homo sapiens
tcgctcccctctgcc

SEQ ID NO: 4777351 - DNA, 15 bp, Homo sapiens
tcgctgccacccacc

SEQ ID NO: 4777352 - DNA, 16 bp, Homo sapiens
tcgctgtccgtcctgc

SEQ ID NO: 4777353 - DNA, 20 bp, Homo sapiens
tcgcttcataggcagagccc

SEQ ID NO: 4777354 - DNA, 22 bp, Homo sapiens
tcgcttggctccatgctcctca

SEQ ID NO: 4777355 - DNA, 14 bp, Homo sapiens
tcggaattcctgca

SEQ ID NO: 4777356 - DNA, 19 bp, Homo sapiens
tcggacaccatcttgggat

SEQ ID NO: 4777357 - DNA, 15 bp, Homo sapiens
tcggactttgcagga

SEQ ID NO: 4777358 - DNA, 18 bp, Homo sapiens
tcggaggctgggcccctg

SEQ ID NO: 4777359 - DNA, 19 bp, Homo sapiens
tcggaggctgggcccctgg

SEQ ID NO: 4777360 - DNA, 21 bp, Homo sapiens
tcggcaccttcccctgaggac

SEQ ID NO: 4777361 - DNA, 18 bp, Homo sapiens
tcggccctgtagccctgg

SEQ ID NO: 4777362 - DNA, 19 bp, Homo sapiens
tcggccctgtagccctggc

SEQ ID NO: 4777363 - DNA, 14 bp, Homo sapiens
tcggccgaggcctg

SEQ ID NO: 4777364 - DNA, 17 bp, Homo sapiens
tcggctgggcagggccg

SEQ ID NO: 4777365 - DNA, 20 bp, Homo sapiens
tcgggaaggcctgagggaag

SEQ ID NO: 4777366 - DNA, 15 bp, Homo sapiens
tcgggatggttggtt

SEQ ID NO: 4777367 - DNA, 18 bp, Homo sapiens
tcgggattacagaaacac

SEQ ID NO: 4777368 - DNA, 16 bp, Homo sapiens
tcgggcactccctaag

SEQ ID NO: 4777369 - DNA, 20 bp, Homo sapiens
tcgggcccgcactcaggagc

SEQ ID NO: 4777370 - DNA, 13 bp, Homo sapiens
tcggggcccctgc

SEQ ID NO: 4777371 - DNA, 19 bp, Homo sapiens
tcgggggaggagcaccccc

SEQ ID NO: 4777372 - DNA, 21 bp, Homo sapiens
tcgggggaggagcacccccag

SEQ ID NO: 4777373 - DNA, 18 bp, Homo sapiens
tcgggggcggctctggga

SEQ ID NO: 4777374 - DNA, 15 bp, Homo sapiens
tcggtgtccatttat

SEQ ID NO: 4777375 - DNA, 23 bp, Homo sapiens
tcggtgttttgcaaacatttctt

SEQ ID NO: 4777376 - DNA, 16 bp, Homo sapiens
tcgtaacagcaggagc

SEQ ID NO: 4777377 - DNA, 12 bp, Homo sapiens
tcgtaagttctg

SEQ ID NO: 4777378 - DNA, 19 bp, Homo sapiens
tcgtccatttaaacccggc

SEQ ID NO: 4777379 - DNA, 16 bp, Homo sapiens
tcgtccggcctgcagc

SEQ ID NO: 4777380 - DNA, 14 bp, Homo sapiens
tcgtgcatttgtga

SEQ ID NO: 4777381 - DNA, 17 bp, Homo sapiens
tcgtgcatttgtgagcc

SEQ ID NO: 4777382 - DNA, 14 bp, Homo sapiens
tcgtggattgtttt

SEQ ID NO: 4777383 - DNA, 15 bp, Homo sapiens
tcgtgtgcatgagaa

SEQ ID NO: 4777384 - DNA, 23 bp, Homo sapiens
tcgtgtgcatgagaatgtcattt

SEQ ID NO: 4777385 - DNA, 18 bp, Homo sapiens
tcgttaatcttgctgctt

SEQ ID NO: 4777386 - DNA, 21 bp, Homo sapiens
tcgttgctccagtataaatta

SEQ ID NO: 4777387 - DNA, 16 bp, Homo sapiens
tcgtttcacatctgta

SEQ ID NO: 4777388 - DNA, 14 bp, Homo sapiens
tcgtttgcctccag

SEQ ID NO: 4777389 - DNA, 14 bp, Homo sapiens
tctaaaaagtcaga

SEQ ID NO: 4777390 - DNA, 15 bp, Homo sapiens
tctaaaataaatgtt

SEQ ID NO: 4777391 - DNA, 23 bp, Homo sapiens
tctaaaatgctgttctcaatcat

SEQ ID NO: 4777392 - DNA, 23 bp, Homo sapiens
tctaaaattgagttcttcctgta

SEQ ID NO: 4777393 - DNA, 14 bp, Homo sapiens
tctaaagctgccag

SEQ ID NO: 4777394 - DNA, 14 bp, Homo sapiens
tctaaataatggcc

SEQ ID NO: 4777395 - DNA, 17 bp, Homo sapiens
tctaaatcatatataat

SEQ ID NO: 4777396 - DNA, 16 bp, Homo sapiens
tctaaatgcctttgac

SEQ ID NO: 4777397 - DNA, 15 bp, Homo sapiens
tctaaccaattgtga

SEQ ID NO: 4777398 - DNA, 16 bp, Homo sapiens
tctaactagtaatctt

SEQ ID NO: 4777399 - DNA, 19 bp, Homo sapiens
tctaactccttgaggtctt

SEQ ID NO: 4777400 - DNA, 17 bp, Homo sapiens
tctaactgtatatttgt

SEQ ID NO: 4777401 - DNA, 21 bp, Homo sapiens
tctaagaaatatctgtgaaat

SEQ ID NO: 4777402 - DNA, 14 bp, Homo sapiens
tctaagaatttaga

SEQ ID NO: 4777403 - DNA, 16 bp, Homo sapiens
tctaagattgtacata

SEQ ID NO: 4777404 - DNA, 18 bp, Homo sapiens
tctaaggagcaaatacct

SEQ ID NO: 4777405 - DNA, 15 bp, Homo sapiens
tctaatttttattaa

SEQ ID NO: 4777406 - DNA, 15 bp, Homo sapiens
tctacaaacttttat

SEQ ID NO: 4777407 - DNA, 21 bp, Homo sapiens
tctacacatataaacacagta

SEQ ID NO: 4777408 - DNA, 12 bp, Homo sapiens
tctacagaaaaa

SEQ ID NO: 4777409 - DNA, 12 bp, Homo sapiens
tctacccagact

SEQ ID NO: 4777410 - DNA, 17 bp, Homo sapiens
tctacccagactcagag

SEQ ID NO: 4777411 - DNA, 21 bp, Homo sapiens
tctaccttccagtcaggatga

SEQ ID NO: 4777412 - DNA, 21 bp, Homo sapiens
tctactcgagttacagacaaa

SEQ ID NO: 4777413 - DNA, 19 bp, Homo sapiens
tctactttaaattgtggat

SEQ ID NO: 4777414 - DNA, 20 bp, Homo sapiens
tctactttaaattgtggatg

SEQ ID NO: 4777415 - DNA, 18 bp, Homo sapiens
tctagaagagtctattgt

SEQ ID NO: 4777416 - DNA, 19 bp, Homo sapiens
tctagaagagtctattgtc

SEQ ID NO: 4777417 - DNA, 22 bp, Homo sapiens
tctagaatactaataaaataca

SEQ ID NO: 4777418 - DNA, 19 bp, Homo sapiens
tctagagctatgcacacca

SEQ ID NO: 4777419 - DNA, 20 bp, Homo sapiens
tctagagggatccaccgcca

SEQ ID NO: 4777420 - DNA, 20 bp, Homo sapiens
tctagccaggcctcccgcat

SEQ ID NO: 4777421 - DNA, 15 bp, Homo sapiens
tctagccctctccct

SEQ ID NO: 4777422 - DNA, 18 bp, Homo sapiens
tctaggaggtctctaaga

SEQ ID NO: 4777423 - DNA, 15 bp, Homo sapiens
tctagtgcaggaaaa

SEQ ID NO: 4777424 - DNA, 20 bp, Homo sapiens
tctagtgcaggaaaaggctg

SEQ ID NO: 4777425 - DNA, 18 bp, Homo sapiens
tctagtgtctaaaacact

SEQ ID NO: 4777426 - DNA, 16 bp, Homo sapiens
tctagttgacttcaaa

SEQ ID NO: 4777427 - DNA, 21 bp, Homo sapiens
tctagttgacttcaaatgtgt

SEQ ID NO: 4777428 - DNA, 22 bp, Homo sapiens
tctagttgtggacttttcccca

SEQ ID NO: 4777429 - DNA, 21 bp, Homo sapiens
tctatataaaaaatatatgta

SEQ ID NO: 4777430 - DNA, 22 bp, Homo sapiens
tctatatatacatatacacaaa

SEQ ID NO: 4777431 - DNA, 18 bp, Homo sapiens
tctatatatacatgtata

SEQ ID NO: 4777432 - DNA, 18 bp, Homo sapiens
tctatatgttgctgaaac

SEQ ID NO: 4777433 - DNA, 14 bp, Homo sapiens
tctatctaattttt

SEQ ID NO: 4777434 - DNA, 16 bp, Homo sapiens
tctatctctatataaa

SEQ ID NO: 4777435 - DNA, 17 bp, Homo sapiens
tctatctgggcctgggc

SEQ ID NO: 4777436 - DNA, 22 bp, Homo sapiens
tctatgacaataaattttatct

SEQ ID NO: 4777437 - DNA, 14 bp, Homo sapiens
tctatgatatacaa

SEQ ID NO: 4777438 - DNA, 17 bp, Homo sapiens
tctatggaccaaatgta

SEQ ID NO: 4777439 - DNA, 19 bp, Homo sapiens
tctatggaccaaatgtaaa

SEQ ID NO: 4777440 - DNA, 15 bp, Homo sapiens
tctatgggaaatcta

SEQ ID NO: 4777441 - DNA, 14 bp, Homo sapiens
tctatgtgtatata

SEQ ID NO: 4777442 - DNA, 20 bp, Homo sapiens
tctattagcttactgattaa

SEQ ID NO: 4777443 - DNA, 20 bp, Homo sapiens
tctattatctgggttttaga

SEQ ID NO: 4777444 - DNA, 23 bp, Homo sapiens
tctattatctgggttttagaaat

SEQ ID NO: 4777445 - DNA, 21 bp, Homo sapiens
tctattcccatcgctggaaaa

SEQ ID NO: 4777446 - DNA, 16 bp, Homo sapiens
tctattccttctggcc

SEQ ID NO: 4777447 - DNA, 16 bp, Homo sapiens
tctattgtttctttca

SEQ ID NO: 4777448 - DNA, 15 bp, Homo sapiens
tctatttaaaaaatg

SEQ ID NO: 4777449 - DNA, 19 bp, Homo sapiens
tctatttatctgtctgagc

SEQ ID NO: 4777450 - DNA, 14 bp, Homo sapiens
tctcaacctacctc

SEQ ID NO: 4777451 - DNA, 20 bp, Homo sapiens
tctcaagcgctatccacaga

SEQ ID NO: 4777452 - DNA, 20 bp, Homo sapiens
tctcaatcattgtcagagat

SEQ ID NO: 4777453 - DNA, 14 bp, Homo sapiens
tctcaatgaaatag

SEQ ID NO: 4777454 - DNA, 21 bp, Homo sapiens
tctcaattgagttaaatcagt

SEQ ID NO: 4777455 - DNA, 15 bp, Homo sapiens
tctcacacacataga

SEQ ID NO: 4777456 - DNA, 11 bp, Homo sapiens
tctcacagcac

SEQ ID NO: 4777457 - DNA, 16 bp, Homo sapiens
tctcacagcacatgct

SEQ ID NO: 4777458 - DNA, 23 bp, Homo sapiens
tctcacagcacatgctggccagc

SEQ ID NO: 4777459 - DNA, 16 bp, Homo sapiens
tctcaccccccgacct

SEQ ID NO: 4777460 - DNA, 20 bp, Homo sapiens
tctcaccccccgacctggct

SEQ ID NO: 4777461 - DNA, 22 bp, Homo sapiens
tctcactgtattaaagatgcag

SEQ ID NO: 4777462 - DNA, 15 bp, Homo sapiens
tctcacttttttata

SEQ ID NO: 4777463 - DNA, 19 bp, Homo sapiens
tctcagaacaccaagtaaa

SEQ ID NO: 4777464 - DNA, 20 bp, Homo sapiens
tctcagaacaccaagtaaat

SEQ ID NO: 4777465 - DNA, 20 bp, Homo sapiens
tctcagaagtgaaaaagact

SEQ ID NO: 4777466 - DNA, 17 bp, Homo sapiens
tctcagcaaattcttga

SEQ ID NO: 4777467 - DNA, 13 bp, Homo sapiens
tctcagctccact

SEQ ID NO: 4777468 - DNA, 22 bp, Homo sapiens
tctcaggaccaccctgccaagg

SEQ ID NO: 4777469 - DNA, 12 bp, Homo sapiens
tctcaggccaaa

SEQ ID NO: 4777470 - DNA, 15 bp, Homo sapiens
tctcagtctgtcacc

SEQ ID NO: 4777471 - DNA, 21 bp, Homo sapiens
tctcatgcatagacaagtgtt

SEQ ID NO: 4777472 - DNA, 15 bp, Homo sapiens
tctcatgctccttaa

SEQ ID NO: 4777473 - DNA, 15 bp, Homo sapiens
tctcatggtcccact

SEQ ID NO: 4777474 - DNA, 23 bp, Homo sapiens
tctcatggtcccacttccccatc

SEQ ID NO: 4777475 - DNA, 11 bp, Homo sapiens
tctcattccca

SEQ ID NO: 4777476 - DNA, 12 bp, Homo sapiens
tctcattcttgc

SEQ ID NO: 4777477 - DNA, 22 bp, Homo sapiens
tctcattgccaaggcatcccca

SEQ ID NO: 4777478 - DNA, 17 bp, Homo sapiens
tctcatttatgttattt

SEQ ID NO: 4777479 - DNA, 22 bp, Homo sapiens
tctcatttatgttatttatgat

SEQ ID NO: 4777480 - DNA, 17 bp, Homo sapiens
tctcatttgccaggaag

SEQ ID NO: 4777481 - DNA, 20 bp, Homo sapiens
tctcattttgcttttctcta

SEQ ID NO: 4777482 - DNA, 19 bp, Homo sapiens
tctccaagcactagccttc

SEQ ID NO: 4777483 - DNA, 22 bp, Homo sapiens
tctccacagggacacagtctgg

SEQ ID NO: 4777484 - DNA, 17 bp, Homo sapiens
tctccacccctcaagcc

SEQ ID NO: 4777485 - DNA, 20 bp, Homo sapiens
tctccacccctcaagccagg

SEQ ID NO: 4777486 - DNA, 22 bp, Homo sapiens
tctccacccctcaagccaggag

SEQ ID NO: 4777487 - DNA, 23 bp, Homo sapiens
tctccacctcccccaaaccctgc

SEQ ID NO: 4777488 - DNA, 16 bp, Homo sapiens
tctccagccaatttca

SEQ ID NO: 4777489 - DNA, 16 bp, Homo sapiens
tctccagcctcagcct

SEQ ID NO: 4777490 - DNA, 12 bp, Homo sapiens
tctccagctgat

SEQ ID NO: 4777491 - DNA, 12 bp, Homo sapiens
tctccaggccca

SEQ ID NO: 4777492 - DNA, 17 bp, Homo sapiens
tctccaggcccagcctg

SEQ ID NO: 4777493 - DNA, 16 bp, Homo sapiens
tctccaggggtttaca

SEQ ID NO: 4777494 - DNA, 21 bp, Homo sapiens
tctccatgctctttcaccctg

SEQ ID NO: 4777495 - DNA, 18 bp, Homo sapiens
tctccccatatataaatt

SEQ ID NO: 4777496 - DNA, 13 bp, Homo sapiens
tctccccctcagc

SEQ ID NO: 4777497 - DNA, 19 bp, Homo sapiens
tctcccctccagaccccta

SEQ ID NO: 4777498 - DNA, 15 bp, Homo sapiens
tctcccgccattggc

SEQ ID NO: 4777499 - DNA, 21 bp, Homo sapiens
tctccctacttagacccagtc

SEQ ID NO: 4777500 - DNA, 11 bp, Homo sapiens
tctccctccac

SEQ ID NO: 4777501 - DNA, 15 bp, Homo sapiens
tctccctccactcct

SEQ ID NO: 4777502 - DNA, 20 bp, Homo sapiens
tctccctcccttctttcctt

SEQ ID NO: 4777503 - DNA, 14 bp, Homo sapiens
tctccctggcccca

SEQ ID NO: 4777504 - DNA, 15 bp, Homo sapiens
tctccctggccccag

SEQ ID NO: 4777505 - DNA, 23 bp, Homo sapiens
tctccctggggaggacccctgcc

SEQ ID NO: 4777506 - DNA, 23 bp, Homo sapiens
tctccgcccacgcggctgctgct

SEQ ID NO: 4777507 - DNA, 22 bp, Homo sapiens
tctccgccccccggcctggccc

SEQ ID NO: 4777508 - DNA, 19 bp, Homo sapiens
tctcctaagctggagtgca

SEQ ID NO: 4777509 - DNA, 14 bp, Homo sapiens
tctcctcactgcca

SEQ ID NO: 4777510 - DNA, 17 bp, Homo sapiens
tctcctcactgccacta

SEQ ID NO: 4777511 - DNA, 18 bp, Homo sapiens
tctcctccaaatgctgtc

SEQ ID NO: 4777512 - DNA, 19 bp, Homo sapiens
tctcctccagccctgggca

SEQ ID NO: 4777513 - DNA, 23 bp, Homo sapiens
tctcctcggtggcatttgctgaa

SEQ ID NO: 4777514 - DNA, 18 bp, Homo sapiens
tctcctctcccaaataaa

SEQ ID NO: 4777515 - DNA, 17 bp, Homo sapiens
tctcctgagcctgtctc

SEQ ID NO: 4777516 - DNA, 19 bp, Homo sapiens
tctcctgagcctgtctctc

SEQ ID NO: 4777517 - DNA, 16 bp, Homo sapiens
tctcctgcagtctgtg

SEQ ID NO: 4777518 - DNA, 18 bp, Homo sapiens
tctcctgggggtggcagg

SEQ ID NO: 4777519 - DNA, 20 bp, Homo sapiens
tctcctgggggtggcaggca

SEQ ID NO: 4777520 - DNA, 16 bp, Homo sapiens
tctcctgtaattttgt

SEQ ID NO: 4777521 - DNA, 16 bp, Homo sapiens
tctcctgtgagctccc

SEQ ID NO: 4777522 - DNA, 18 bp, Homo sapiens
tctcctgtgagctcccca

SEQ ID NO: 4777523 - DNA, 17 bp, Homo sapiens
tctccttaaactaccac

SEQ ID NO: 4777524 - DNA, 13 bp, Homo sapiens
tctccttcccaag

SEQ ID NO: 4777525 - DNA, 18 bp, Homo sapiens
tctccttcccaaggcagc

SEQ ID NO: 4777526 - DNA, 21 bp, Homo sapiens
tctccttcccaaggcagctgg

SEQ ID NO: 4777527 - DNA, 11 bp, Homo sapiens
tctccttcctt

SEQ ID NO: 4777528 - DNA, 18 bp, Homo sapiens
tctccttgattacataat

SEQ ID NO: 4777529 - DNA, 17 bp, Homo sapiens
tctcctttgtcaaatgg

SEQ ID NO: 4777530 - DNA, 22 bp, Homo sapiens
tctcgtagaacctgcgcacccc

SEQ ID NO: 4777531 - DNA, 23 bp, Homo sapiens
tctcgtagaacctgcgcaccccg

SEQ ID NO: 4777532 - DNA, 22 bp, Homo sapiens
tctcgtgattgataagaacctt

SEQ ID NO: 4777533 - DNA, 14 bp, Homo sapiens
tctctaacccctag

SEQ ID NO: 4777534 - DNA, 17 bp, Homo sapiens
tctctaagacaaatgca

SEQ ID NO: 4777535 - DNA, 13 bp, Homo sapiens
tctctagagaaca

SEQ ID NO: 4777536 - DNA, 23 bp, Homo sapiens
tctctagtgcaggaaaaggctgc

SEQ ID NO: 4777537 - DNA, 20 bp, Homo sapiens
tctctagttgacttcaaatg

SEQ ID NO: 4777538 - DNA, 21 bp, Homo sapiens
tctctatataaaaaatatatg

SEQ ID NO: 4777539 - DNA, 15 bp, Homo sapiens
tctctatatatacat

SEQ ID NO: 4777540 - DNA, 21 bp, Homo sapiens
tctctatatatacatgtatag

SEQ ID NO: 4777541 - DNA, 13 bp, Homo sapiens
tctctcaaaatgt

SEQ ID NO: 4777542 - DNA, 12 bp, Homo sapiens
tctctcacccag

SEQ ID NO: 4777543 - DNA, 17 bp, Homo sapiens
tctctcacccagcctgg

SEQ ID NO: 4777544 - DNA, 12 bp, Homo sapiens
tctctcaggcca

SEQ ID NO: 4777545 - DNA, 11 bp, Homo sapiens
tctctccctcc

SEQ ID NO: 4777546 - DNA, 21 bp, Homo sapiens
tctctccctccactcctccca

SEQ ID NO: 4777547 - DNA, 24 bp, Homo sapiens
tctctccgccccggacagggtggc

SEQ ID NO: 4777548 - DNA, 17 bp, Homo sapiens
tctctcctctctctccc

SEQ ID NO: 4777549 - DNA, 19 bp, Homo sapiens
tctctctaagacaaatgca

SEQ ID NO: 4777550 - DNA, 22 bp, Homo sapiens
tctctctaagacaaatgcagtg

SEQ ID NO: 4777551 - DNA, 19 bp, Homo sapiens
tctctctatatatacatgt

SEQ ID NO: 4777552 - DNA, 16 bp, Homo sapiens
tctctctccctccact

SEQ ID NO: 4777553 - DNA, 15 bp, Homo sapiens
tctctctctctctgt

SEQ ID NO: 4777554 - DNA, 14 bp, Homo sapiens
tctctctctgttcc

SEQ ID NO: 4777555 - DNA, 15 bp, Homo sapiens
tctctctctgttcca

SEQ ID NO: 4777556 - DNA, 13 bp, Homo sapiens
tctctctgtgtgg

SEQ ID NO: 4777557 - DNA, 18 bp, Homo sapiens
tctctctgtgtggcaaac

SEQ ID NO: 4777558 - DNA, 20 bp, Homo sapiens
tctctctgtgtggcaaacat

SEQ ID NO: 4777559 - DNA, 12 bp, Homo sapiens
tctctctgttcc

SEQ ID NO: 4777560 - DNA, 16 bp, Homo sapiens
tctctctgttccaagt

SEQ ID NO: 4777561 - DNA, 17 bp, Homo sapiens
tctctcttggtctcttt

SEQ ID NO: 4777562 - DNA, 21 bp, Homo sapiens
tctctctttccatctcccttg

SEQ ID NO: 4777563 - DNA, 13 bp, Homo sapiens
tctctgaatttgt

SEQ ID NO: 4777564 - DNA, 14 bp, Homo sapiens
tctctgagaacaga

SEQ ID NO: 4777565 - DNA, 18 bp, Homo sapiens
tctctggcaatcttgccc

SEQ ID NO: 4777566 - DNA, 20 bp, Homo sapiens
tctctgtaaaaagcaggtga

SEQ ID NO: 4777567 - DNA, 20 bp, Homo sapiens
tctctgtgtggcaaacattt

SEQ ID NO: 4777568 - DNA, 21 bp, Homo sapiens
tctctgtgtggcaaacattta

SEQ ID NO: 4777569 - DNA, 12 bp, Homo sapiens
tctctgttccaa

SEQ ID NO: 4777570 - DNA, 14 bp, Homo sapiens
tctctgttccaagt

SEQ ID NO: 4777571 - DNA, 16 bp, Homo sapiens
tctctgttccaagtgt

SEQ ID NO: 4777572 - DNA, 22 bp, Homo sapiens
tctctgttccaagtgtgtgtgc

SEQ ID NO: 4777573 - DNA, 13 bp, Homo sapiens
tctcttaagctgc

SEQ ID NO: 4777574 - DNA, 21 bp, Homo sapiens
tctcttaccccgtccctttcc

SEQ ID NO: 4777575 - DNA, 19 bp, Homo sapiens
tctcttcatgcgcagtccc

SEQ ID NO: 4777576 - DNA, 20 bp, Homo sapiens
tctcttcccacctgtcaacc

SEQ ID NO: 4777577 - DNA, 15 bp, Homo sapiens
tctcttcgctgtgat

SEQ ID NO: 4777578 - DNA, 18 bp, Homo sapiens
tctcttcggtggccttga

SEQ ID NO: 4777579 - DNA, 22 bp, Homo sapiens
tctcttgctgtttaccgcccac

SEQ ID NO: 4777580 - DNA, 14 bp, Homo sapiens
tctcttgggaagca

SEQ ID NO: 4777581 - DNA, 15 bp, Homo sapiens
tctcttgggaagcag

SEQ ID NO: 4777582 - DNA, 18 bp, Homo sapiens
tctcttgggaagcagttt

SEQ ID NO: 4777583 - DNA, 20 bp, Homo sapiens
tctcttgggaagcagtttca

SEQ ID NO: 4777584 - DNA, 23 bp, Homo sapiens
tctcttgggaagcagtttcagat

SEQ ID NO: 4777585 - DNA, 13 bp, Homo sapiens
tctcttggtctct

SEQ ID NO: 4777586 - DNA, 16 bp, Homo sapiens
tctcttggtctctttc

SEQ ID NO: 4777587 - DNA, 15 bp, Homo sapiens
tctcttgtaccagcc

SEQ ID NO: 4777588 - DNA, 14 bp, Homo sapiens
tctcttgttaaatg

SEQ ID NO: 4777589 - DNA, 13 bp, Homo sapiens
tctctttctttcc

SEQ ID NO: 4777590 - DNA, 17 bp, Homo sapiens
tctctttcttttgtgca

SEQ ID NO: 4777591 - DNA, 19 bp, Homo sapiens
tctctttcttttgtgcata

SEQ ID NO: 4777592 - DNA, 18 bp, Homo sapiens
tctctttgcctgaagaaa

SEQ ID NO: 4777593 - DNA, 19 bp, Homo sapiens
tctctttgttcttcaatgt

SEQ ID NO: 4777594 - DNA, 14 bp, Homo sapiens
tctgaaaactggaa

SEQ ID NO: 4777595 - DNA, 14 bp, Homo sapiens
tctgaaaactgttt

SEQ ID NO: 4777596 - DNA, 19 bp, Homo sapiens
tctgaaagttttgatactt

SEQ ID NO: 4777597 - DNA, 17 bp, Homo sapiens
tctgaacccttccacca

SEQ ID NO: 4777598 - DNA, 22 bp, Homo sapiens
tctgaactcacagactgctgtc

SEQ ID NO: 4777599 - DNA, 15 bp, Homo sapiens
tctgaactttggaag

SEQ ID NO: 4777600 - DNA, 13 bp, Homo sapiens
tctgaagcctttt

SEQ ID NO: 4777601 - DNA, 15 bp, Homo sapiens
tctgaaggagaggag

SEQ ID NO: 4777602 - DNA, 23 bp, Homo sapiens
tctgaaggggaaaacctcagttg

SEQ ID NO: 4777603 - DNA, 20 bp, Homo sapiens
tctgaagtagtgtgagtgtt

SEQ ID NO: 4777604 - DNA, 15 bp, Homo sapiens
tctgaagttggacag

SEQ ID NO: 4777605 - DNA, 16 bp, Homo sapiens
tctgaagtttcattta

SEQ ID NO: 4777606 - DNA, 18 bp, Homo sapiens
tctgaagtttcatttatg

SEQ ID NO: 4777607 - DNA, 15 bp, Homo sapiens
tctgaatctctcaaa

SEQ ID NO: 4777608 - DNA, 16 bp, Homo sapiens
tctgacaagggctgac

SEQ ID NO: 4777609 - DNA, 13 bp, Homo sapiens
tctgacggccctg

SEQ ID NO: 4777610 - DNA, 15 bp, Homo sapiens
tctgacggccctgca

SEQ ID NO: 4777611 - DNA, 16 bp, Homo sapiens
tctgacggccctgcaa

SEQ ID NO: 4777612 - DNA, 21 bp, Homo sapiens
tctgagaacagacgttaccaa

SEQ ID NO: 4777613 - DNA, 19 bp, Homo sapiens
tctgagaagaggagccctc

SEQ ID NO: 4777614 - DNA, 16 bp, Homo sapiens
tctgagactaaatgag

SEQ ID NO: 4777615 - DNA, 19 bp, Homo sapiens
tctgagcaccgaatattga

SEQ ID NO: 4777616 - DNA, 22 bp, Homo sapiens
tctgagcaccgaatattgagca

SEQ ID NO: 4777617 - DNA, 16 bp, Homo sapiens
tctgagcagacagggc

SEQ ID NO: 4777618 - DNA, 13 bp, Homo sapiens
tctgagcagtggg

SEQ ID NO: 4777619 - DNA, 14 bp, Homo sapiens
tctgagcagtgggg

SEQ ID NO: 4777620 - DNA, 15 bp, Homo sapiens
tctgagcagtgggga

SEQ ID NO: 4777621 - DNA, 16 bp, Homo sapiens
tctgagccctgccctc

SEQ ID NO: 4777622 - DNA, 17 bp, Homo sapiens
tctgagccctgccctca

SEQ ID NO: 4777623 - DNA, 18 bp, Homo sapiens
tctgagccctgccctcac

SEQ ID NO: 4777624 - DNA, 16 bp, Homo sapiens
tctgaggagtaaaaag

SEQ ID NO: 4777625 - DNA, 23 bp, Homo sapiens
tctgaggagtaaaaagactactg

SEQ ID NO: 4777626 - DNA, 19 bp, Homo sapiens
tctgaggagtccaaaatat

SEQ ID NO: 4777627 - DNA, 12 bp, Homo sapiens
tctgagtcctca

SEQ ID NO: 4777628 - DNA, 14 bp, Homo sapiens
tctgatatgggact

SEQ ID NO: 4777629 - DNA, 16 bp, Homo sapiens
tctgatgaggcatttt

SEQ ID NO: 4777630 - DNA, 18 bp, Homo sapiens
tctgatgatgttctgaaa

SEQ ID NO: 4777631 - DNA, 19 bp, Homo sapiens
tctgatggcacttttgagc

SEQ ID NO: 4777632 - DNA, 23 bp, Homo sapiens
tctgatggcacttttgagctcct

SEQ ID NO: 4777633 - DNA, 16 bp, Homo sapiens
tctgattgttcctccc

SEQ ID NO: 4777634 - DNA, 19 bp, Homo sapiens
tctgattgttcctccccag

SEQ ID NO: 4777635 - DNA, 16 bp, Homo sapiens
tctgatttctgaacta

SEQ ID NO: 4777636 - DNA, 14 bp, Homo sapiens
tctgcaaatagaaa

SEQ ID NO: 4777637 - DNA, 14 bp, Homo sapiens
tctgcaataacagt

SEQ ID NO: 4777638 - DNA, 15 bp, Homo sapiens
tctgcacacataaca

SEQ ID NO: 4777639 - DNA, 23 bp, Homo sapiens
tctgcacaccttgaatctgcctg

SEQ ID NO: 4777640 - DNA, 15 bp, Homo sapiens
tctgtctgagccctg

SEQ ID NO: 4777641 - DNA, 22 bp, Homo sapiens
tctgtctgagccctgccctcac

SEQ ID NO: 4777642 - DNA, 19 bp, Homo sapiens
tctgtctttatgatttcat

SEQ ID NO: 4777643 - DNA, 23 bp, Homo sapiens
tctgtctttatgatttcatgatt

SEQ ID NO: 4777644 - DNA, 20 bp, Homo sapiens
tctgtgaaggacttggtgat

SEQ ID NO: 4777645 - DNA, 12 bp, Homo sapiens
tctgtgagattc

SEQ ID NO: 4777646 - DNA, 22 bp, Homo sapiens
tctgtgagtctgtcctttccca

SEQ ID NO: 4777647 - DNA, 14 bp, Homo sapiens
tctgtgataacaga

SEQ ID NO: 4777648 - DNA, 17 bp, Homo sapiens
tctgtgcatctggcctg

SEQ ID NO: 4777649 - DNA, 13 bp, Homo sapiens
tctgtgcctcagt

SEQ ID NO: 4777650 - DNA, 14 bp, Homo sapiens
tctgtgcctcagtg

SEQ ID NO: 4777651 - DNA, 12 bp, Homo sapiens
tctgtgtataca

SEQ ID NO: 4777652 - DNA, 15 bp, Homo sapiens
tctgtgtatacatat

SEQ ID NO: 4777653 - DNA, 17 bp, Homo sapiens
tctgtgtatacatatgt

SEQ ID NO: 4777654 - DNA, 22 bp, Homo sapiens
tctgtgtatacatatgtatgtg

SEQ ID NO: 4777655 - DNA, 22 bp, Homo sapiens
tctgtgtcacgtgaccctgtgc

SEQ ID NO: 4777656 - DNA, 16 bp, Homo sapiens
tctgtgtggcaaacat

SEQ ID NO: 4777657 - DNA, 17 bp, Homo sapiens
tctgtgtggcaaacatt

SEQ ID NO: 4777658 - DNA, 18 bp, Homo sapiens
tctgtgtggcaaacattt

SEQ ID NO: 4777659 - DNA, 22 bp, Homo sapiens
tctgtgttctcaacacacagta

SEQ ID NO: 4777660 - DNA, 12 bp, Homo sapiens
tctgttccaagt

SEQ ID NO: 4777661 - DNA, 21 bp, Homo sapiens
tctgttccaagtgtgtgtgca

SEQ ID NO: 4777662 - DNA, 22 bp, Homo sapiens
tctgttctatggaccaaatgta

SEQ ID NO: 4777663 - DNA, 15 bp, Homo sapiens
tctgttctttcatac

SEQ ID NO: 4777664 - DNA, 20 bp, Homo sapiens
tctgttctttcatactacat

SEQ ID NO: 4777665 - DNA, 23 bp, Homo sapiens
tctgtttaccctccctgtcccct

SEQ ID NO: 4777666 - DNA, 24 bp, Homo sapiens
tctgtttaccctccctgtcccctg

SEQ ID NO: 4777667 - DNA, 24 bp, Homo sapiens
tcttaaaagctatcttcatgtaaa

SEQ ID NO: 4777668 - DNA, 16 bp, Homo sapiens
tcttaaaattggttaa

SEQ ID NO: 4777669 - DNA, 14 bp, Homo sapiens
tcttaactaatgta

SEQ ID NO: 4777670 - DNA, 16 bp, Homo sapiens
tcttaactaatgtaaa

SEQ ID NO: 4777671 - DNA, 18 bp, Homo sapiens
tcttaactaatgtaaata

SEQ ID NO: 4777672 - DNA, 16 bp, Homo sapiens
tcttaagacagcatgt

SEQ ID NO: 4777673 - DNA, 19 bp, Homo sapiens
tcttaatagaaagtcagat

SEQ ID NO: 4777674 - DNA, 20 bp, Homo sapiens
tcttacccttcaatgttaaa

SEQ ID NO: 4777675 - DNA, 15 bp, Homo sapiens
tcttaccgaaatgaa

SEQ ID NO: 4777676 - DNA, 17 bp, Homo sapiens
tcttactaataggtctg

SEQ ID NO: 4777677 - DNA, 19 bp, Homo sapiens
tcttactagtgtttggctc

SEQ ID NO: 4777678 - DNA, 14 bp, Homo sapiens
tcttactgtatttg

SEQ ID NO: 4777679 - DNA, 16 bp, Homo sapiens
tcttactgttttgtgc

SEQ ID NO: 4777680 - DNA, 13 bp, Homo sapiens
tcttagaagaata

SEQ ID NO: 4777681 - DNA, 17 bp, Homo sapiens
tcttagaagaatattgt

SEQ ID NO: 4777682 - DNA, 19 bp, Homo sapiens
tcttagaagaatattgtat

SEQ ID NO: 4777683 - DNA, 14 bp, Homo sapiens
tcttagggtacagc

SEQ ID NO: 4777684 - DNA, 19 bp, Homo sapiens
tcttagggtacagcccagg

SEQ ID NO: 4777685 - DNA, 14 bp, Homo sapiens
tcttagtgtgtgca

SEQ ID NO: 4777686 - DNA, 17 bp, Homo sapiens
tcttattcctaattcct

SEQ ID NO: 4777687 - DNA, 19 bp, Homo sapiens
tcttattcctaattcctgt

SEQ ID NO: 4777688 - DNA, 22 bp, Homo sapiens
tcttcaaaatataaaatgccaa

SEQ ID NO: 4777689 - DNA, 16 bp, Homo sapiens
tcttcaaccctgccct

SEQ ID NO: 4777690 - DNA, 20 bp, Homo sapiens
tcttcaatgtgaaactgaga

SEQ ID NO: 4777691 - DNA, 23 bp, Homo sapiens
tcttcaattaatggaaaactgtt

SEQ ID NO: 4777692 - DNA, 18 bp, Homo sapiens
tcttcaatttgtataaaa

SEQ ID NO: 4777693 - DNA, 13 bp, Homo sapiens
tcttcaccaggaa

SEQ ID NO: 4777694 - DNA, 18 bp, Homo sapiens
tcttcaccccggcaggcc

SEQ ID NO: 4777695 - DNA, 17 bp, Homo sapiens
tcttccaagttcattca

SEQ ID NO: 4777696 - DNA, 20 bp, Homo sapiens
tcttccaagttcattcatac

SEQ ID NO: 4777697 - DNA, 20 bp, Homo sapiens
tcttcccaagtcctcgcccc

SEQ ID NO: 4777698 - DNA, 15 bp, Homo sapiens
tcttcccatttgtaa

SEQ ID NO: 4777699 - DNA, 19 bp, Homo sapiens
tcttcccatttgtaatgta

SEQ ID NO: 4777700 - DNA, 21 bp, Homo sapiens
tcttccccaaggcactgagcg

SEQ ID NO: 4777701 - DNA, 15 bp, Homo sapiens
tcttccctctcgctc

SEQ ID NO: 4777702 - DNA, 12 bp, Homo sapiens
tcttccctgctt

SEQ ID NO: 4777703 - DNA, 17 bp, Homo sapiens
tcttcctccaaagcctg

SEQ ID NO: 4777704 - DNA, 23 bp, Homo sapiens
tcttcctggacagtgagagcagg

SEQ ID NO: 4777705 - DNA, 14 bp, Homo sapiens
tcttcctgtaatct

SEQ ID NO: 4777706 - DNA, 23 bp, Homo sapiens
tcttccttctcagccttggttcc

SEQ ID NO: 4777707 - DNA, 19 bp, Homo sapiens
tcttccttttgtatcctcc

SEQ ID NO: 4777708 - DNA, 15 bp, Homo sapiens
tcttcggtggccttg

SEQ ID NO: 4777709 - DNA, 15 bp, Homo sapiens
tcttctacttcttgt

SEQ ID NO: 4777710 - DNA, 13 bp, Homo sapiens
tcttctatattaa

SEQ ID NO: 4777711 - DNA, 15 bp, Homo sapiens
tcttctattgtgctt

SEQ ID NO: 4777712 - DNA, 15 bp, Homo sapiens
tcttctcagctccac

SEQ ID NO: 4777713 - DNA, 20 bp, Homo sapiens
tcttctcagctccactctga

SEQ ID NO: 4777714 - DNA, 19 bp, Homo sapiens
tcttctcattcttctaaaa

SEQ ID NO: 4777715 - DNA, 21 bp, Homo sapiens
tcttctccactttctagccag

SEQ ID NO: 4777716 - DNA, 13 bp, Homo sapiens
tcttctcctttgt

SEQ ID NO: 4777717 - DNA, 18 bp, Homo sapiens
tcttctcctttgtcaaat

SEQ ID NO: 4777718 - DNA, 16 bp, Homo sapiens
tcttctctctgtgctg

SEQ ID NO: 4777719 - DNA, 20 bp, Homo sapiens
tcttctgagtggctaaaact

SEQ ID NO: 4777720 - DNA, 14 bp, Homo sapiens
tcttctgttctcaa

SEQ ID NO: 4777721 - DNA, 19 bp, Homo sapiens
tcttcttgggggcagacca

SEQ ID NO: 4777722 - DNA, 18 bp, Homo sapiens
tcttcttttcccatttac

SEQ ID NO: 4777723 - DNA, 13 bp, Homo sapiens
tcttgaagaatat

SEQ ID NO: 4777724 - DNA, 14 bp, Homo sapiens
tcttgaagaatatt

SEQ ID NO: 4777725 - DNA, 13 bp, Homo sapiens
tcttgaagacttt

SEQ ID NO: 4777726 - DNA, 15 bp, Homo sapiens
tcttgaagggcccag

SEQ ID NO: 4777727 - DNA, 23 bp, Homo sapiens
tcttgacaggcgccgcctcgccc

SEQ ID NO: 4777728 - DNA, 22 bp, Homo sapiens
tcttgagcaaggcaagaagtgg

SEQ ID NO: 4777729 - DNA, 13 bp, Homo sapiens
tcttgattcataa

SEQ ID NO: 4777730 - DNA, 15 bp, Homo sapiens
tcttgatttttacat

SEQ ID NO: 4777731 - DNA, 19 bp, Homo sapiens
tcttgcactgtatccaagt

SEQ ID NO: 4777732 - DNA, 20 bp, Homo sapiens
tcttgccctattataattgt

SEQ ID NO: 4777733 - DNA, 22 bp, Homo sapiens
tcttgccctattataattgtca

SEQ ID NO: 4777734 - DNA, 19 bp, Homo sapiens
tcttgccgaggagccaggc

SEQ ID NO: 4777735 - DNA, 14 bp, Homo sapiens
tcttgctctgctca

SEQ ID NO: 4777736 - DNA, 11 bp, Homo sapiens
tcttgctgtga

SEQ ID NO: 4777737 - DNA, 12 bp, Homo sapiens
tcttgctgtgaa

SEQ ID NO: 4777738 - DNA, 13 bp, Homo sapiens
tcttgctgtgaaa

SEQ ID NO: 4777739 - DNA, 20 bp, Homo sapiens
tcttgctgtttaccgcccac

SEQ ID NO: 4777740 - DNA, 22 bp, Homo sapiens
tcttgggggtggggctgcatcc

SEQ ID NO: 4777741 - DNA, 20 bp, Homo sapiens
tcttggtctctttctttcca

SEQ ID NO: 4777742 - DNA, 21 bp, Homo sapiens
tcttggtctctttctttccaa

SEQ ID NO: 4777743 - DNA, 16 bp, Homo sapiens
tcttggtgactgtccc

SEQ ID NO: 4777744 - DNA, 22 bp, Homo sapiens
tcttgtaaataatgcttaacat

SEQ ID NO: 4777745 - DNA, 16 bp, Homo sapiens
tcttgtaccagcccag

SEQ ID NO: 4777746 - DNA, 18 bp, Homo sapiens
tcttgtaccagcccaggc

SEQ ID NO: 4777747 - DNA, 23 bp, Homo sapiens
tcttgtcattctcatccaaaagt

SEQ ID NO: 4777748 - DNA, 22 bp, Homo sapiens
tcttgtgcatgcaaaaatgaat

SEQ ID NO: 4777749 - DNA, 21 bp, Homo sapiens
tcttgtgtcatcaagtagtag

SEQ ID NO: 4777750 - DNA, 16 bp, Homo sapiens
tcttgtgtgtttattg

SEQ ID NO: 4777751 - DNA, 14 bp, Homo sapiens
tcttgttaatttca

SEQ ID NO: 4777752 - DNA, 16 bp, Homo sapiens
tcttgttaatttcatt

SEQ ID NO: 4777753 - DNA, 17 bp, Homo sapiens
tcttgttaatttcattc

SEQ ID NO: 4777754 - DNA, 19 bp, Homo sapiens
tcttgttcatgttttgcta

SEQ ID NO: 4777755 - DNA, 20 bp, Homo sapiens
tcttgttcatgttttgctaa

SEQ ID NO: 4777756 - DNA, 23 bp, Homo sapiens
tctttaaaatgattcacttttat

SEQ ID NO: 4777757 - DNA, 14 bp, Homo sapiens
tctttaaattatga

SEQ ID NO: 4777758 - DNA, 14 bp, Homo sapiens
tctttaacatatca

SEQ ID NO: 4777759 - DNA, 14 bp, Homo sapiens
tctttactaacact

SEQ ID NO: 4777760 - DNA, 21 bp, Homo sapiens
tctttagtgatgcaataaaca

SEQ ID NO: 4777761 - DNA, 16 bp, Homo sapiens
actaatcaatactttg

SEQ ID NO: 4777762 - DNA, 19 bp, Homo sapiens
actaatccttaataactat

SEQ ID NO: 4777763 - DNA, 17 bp, Homo sapiens
actaatgacaagtgact

SEQ ID NO: 4777764 - DNA, 13 bp, Homo sapiens
actaatgtaaata

SEQ ID NO: 4777765 - DNA, 14 bp, Homo sapiens
actaattaaaaaat

SEQ ID NO: 4777766 - DNA, 15 bp, Homo sapiens
actaattagtgtcca

SEQ ID NO: 4777767 - DNA, 18 bp, Homo sapiens
actaattagtgtccaact

SEQ ID NO: 4777768 - DNA, 18 bp, Homo sapiens
actacagaagtggaagga

SEQ ID NO: 4777769 - DNA, 12 bp, Homo sapiens
actacagaattg

SEQ ID NO: 4777770 - DNA, 14 bp, Homo sapiens
actacatctgatat

SEQ ID NO: 4777771 - DNA, 18 bp, Homo sapiens
actacatctgatatcagg

SEQ ID NO: 4777772 - DNA, 15 bp, Homo sapiens
actaccaccctcgct

SEQ ID NO: 4777773 - DNA, 19 bp, Homo sapiens
actaccaccctcgctgcca

SEQ ID NO: 4777774 - DNA, 21 bp, Homo sapiens
actaccaccctcgctgccacc

SEQ ID NO: 4777775 - DNA, 22 bp, Homo sapiens
actaccaccctcgctgccaccc

SEQ ID NO: 4777776 - DNA, 21 bp, Homo sapiens
actaccccagaacgcatgcag

SEQ ID NO: 4777777 - DNA, 21 bp, Homo sapiens
actaccccaggacgcatgcag

SEQ ID NO: 4777778 - DNA, 21 bp, Homo sapiens
actaccccaggatgcatgcag

SEQ ID NO: 4777779 - DNA, 18 bp, Homo sapiens
actacctataaatggact

SEQ ID NO: 4777780 - DNA, 19 bp, Homo sapiens
actacctttggcttaattc

SEQ ID NO: 4777781 - DNA, 12 bp, Homo sapiens
actactgccttt

SEQ ID NO: 4777782 - DNA, 16 bp, Homo sapiens
actactgcctttcaaa

SEQ ID NO: 4777783 - DNA, 21 bp, Homo sapiens
actagagatattttgtaaaat

SEQ ID NO: 4777784 - DNA, 21 bp, Homo sapiens
actagagcacgggcgttatgt

SEQ ID NO: 4777785 - DNA, 13 bp, Homo sapiens
actagagtatgtg

SEQ ID NO: 4777786 - DNA, 11 bp, Homo sapiens
actagatctcc

SEQ ID NO: 4777787 - DNA, 14 bp, Homo sapiens
actagatctcctgt

SEQ ID NO: 4777788 - DNA, 15 bp, Homo sapiens
actagatctcctgta

SEQ ID NO: 4777789 - DNA, 16 bp, Homo sapiens
actagatctcctgtaa

SEQ ID NO: 4777790 - DNA, 18 bp, Homo sapiens
actagatctcctgtaatt

SEQ ID NO: 4777791 - DNA, 15 bp, Homo sapiens
actagccctctttct

SEQ ID NO: 4777792 - DNA, 18 bp, Homo sapiens
actagccctctttctctc

SEQ ID NO: 4777793 - DNA, 19 bp, Homo sapiens
actaggtgcccagtcttga

SEQ ID NO: 4777794 - DNA, 13 bp, Homo sapiens
actagtatcactg

SEQ ID NO: 4777795 - DNA, 15 bp, Homo sapiens
actataatgtgaaat

SEQ ID NO: 4777796 - DNA, 20 bp, Homo sapiens
actataggcatgcgccacca

SEQ ID NO: 4777797 - DNA, 22 bp, Homo sapiens
actataggcatgcgccaccatg

SEQ ID NO: 4777798 - DNA, 22 bp, Homo sapiens
actatatacatcacgttaaagt

SEQ ID NO: 4777799 - DNA, 16 bp, Homo sapiens
actatcagcagcggca

SEQ ID NO: 4777800 - DNA, 18 bp, Homo sapiens
actatccatgcaccaaac

SEQ ID NO: 4777801 - DNA, 23 bp, Homo sapiens
actatccttttttattgaataac

SEQ ID NO: 4777802 - DNA, 21 bp, Homo sapiens
actatgcctgttgatctatgg

SEQ ID NO: 4777803 - DNA, 23 bp, Homo sapiens
actatggagcctggcacaggact

SEQ ID NO: 4777804 - DNA, 22 bp, Homo sapiens
actatggctgtatttttagaga

SEQ ID NO: 4777805 - DNA, 19 bp, Homo sapiens
actatggtaaataactgtg

SEQ ID NO: 4777806 - DNA, 20 bp, Homo sapiens
actatggtaaataactgtga

SEQ ID NO: 4777807 - DNA, 21 bp, Homo sapiens
actatggtaaataactgtgac

SEQ ID NO: 4777808 - DNA, 18 bp, Homo sapiens
actatggtatatattttg

SEQ ID NO: 4777809 - DNA, 18 bp, Homo sapiens
actatgtgtcatgatttc

SEQ ID NO: 4777810 - DNA, 13 bp, Homo sapiens
actattggacaga

SEQ ID NO: 4777811 - DNA, 14 bp, Homo sapiens
actatttctttcat

SEQ ID NO: 4777812 - DNA, 17 bp, Homo sapiens
actatttctttcatcag

SEQ ID NO: 4777813 - DNA, 12 bp, Homo sapiens
actcaaggaatg

SEQ ID NO: 4777814 - DNA, 13 bp, Homo sapiens
actcaaggcctcc

SEQ ID NO: 4777815 - DNA, 22 bp, Homo sapiens
actcaccatttaatcatttcca

SEQ ID NO: 4777816 - DNA, 18 bp, Homo sapiens
actcagatctgcactcct

SEQ ID NO: 4777817 - DNA, 13 bp, Homo sapiens
actcaggagcaca

SEQ ID NO: 4777818 - DNA, 15 bp, Homo sapiens
actcaggagcacagc

SEQ ID NO: 4777819 - DNA, 18 bp, Homo sapiens
actcaggagcacagccat

SEQ ID NO: 4777820 - DNA, 19 bp, Homo sapiens
actcaggagcacagccata

SEQ ID NO: 4777821 - DNA, 17 bp, Homo sapiens
actcaggcagcctgtgg

SEQ ID NO: 4777822 - DNA, 22 bp, Homo sapiens
actcaggcagcctgtgggtcct

SEQ ID NO: 4777823 - DNA, 15 bp, Homo sapiens
actcaggctttctat

SEQ ID NO: 4777824 - DNA, 16 bp, Homo sapiens
actcaggctttctatt

SEQ ID NO: 4777825 - DNA, 20 bp, Homo sapiens
actcagtaaggcagtgcagt

SEQ ID NO: 4777826 - DNA, 14 bp, Homo sapiens
actcagtcaaatgt

SEQ ID NO: 4777827 - DNA, 14 bp, Homo sapiens
actcagtcagccca

SEQ ID NO: 4777828 - DNA, 13 bp, Homo sapiens
actcatccattaa

SEQ ID NO: 4777829 - DNA, 12 bp, Homo sapiens
actcattaatta

SEQ ID NO: 4777830 - DNA, 17 bp, Homo sapiens
actcattagaattacca

SEQ ID NO: 4777831 - DNA, 23 bp, Homo sapiens
actcattagaattaccatttgtt

SEQ ID NO: 4777832 - DNA, 19 bp, Homo sapiens
actcatttatttccatatt

SEQ ID NO: 4777833 - DNA, 21 bp, Homo sapiens
actcatttggatataaatctt

SEQ ID NO: 4777834 - DNA, 17 bp, Homo sapiens
actccaagccctggggc

SEQ ID NO: 4777835 - DNA, 16 bp, Homo sapiens
actccaaggcaaatgt

SEQ ID NO: 4777836 - DNA, 18 bp, Homo sapiens
actccaaggcaaatgtcc

SEQ ID NO: 4777837 - DNA, 19 bp, Homo sapiens
actccaaggcaaatgtcca

SEQ ID NO: 4777838 - DNA, 23 bp, Homo sapiens
actccaaggcaaatgtccaagca

SEQ ID NO: 4777839 - DNA, 20 bp, Homo sapiens
actccaaggtggcatagcca

SEQ ID NO: 4777840 - DNA, 22 bp, Homo sapiens
actccaaggtggcatagccatt

SEQ ID NO: 4777841 - DNA, 17 bp, Homo sapiens
actccacctcttccttt

SEQ ID NO: 4777842 - DNA, 13 bp, Homo sapiens
actccagaagcag

SEQ ID NO: 4777843 - DNA, 23 bp, Homo sapiens
actccagaatttcccaaagcagt

SEQ ID NO: 4777844 - DNA, 23 bp, Homo sapiens
actccatggtgaactgaagcaga

SEQ ID NO: 4777845 - DNA, 16 bp, Homo sapiens
actcccagggcccgag

SEQ ID NO: 4777846 - DNA, 17 bp, Homo sapiens
actcccagggcccgagc

SEQ ID NO: 4777847 - DNA, 19 bp, Homo sapiens
actcccagggcccgagcgc

SEQ ID NO: 4777848 - DNA, 22 bp, Homo sapiens
actccctgtgggggtggccatc

SEQ ID NO: 4777849 - DNA, 19 bp, Homo sapiens
actcctcaattccagggaa

SEQ ID NO: 4777850 - DNA, 12 bp, Homo sapiens
actcctcagacg

SEQ ID NO: 4777851 - DNA, 21 bp, Homo sapiens
actcctcagacgggctgagag

SEQ ID NO: 4777852 - DNA, 20 bp, Homo sapiens
actcctcccaactctggcct

SEQ ID NO: 4777853 - DNA, 15 bp, Homo sapiens
actcctccccctcct

SEQ ID NO: 4777854 - DNA, 22 bp, Homo sapiens
actcctccccctcctccatgct

SEQ ID NO: 4777855 - DNA, 16 bp, Homo sapiens
actcctgtgtgtggaa

SEQ ID NO: 4777856 - DNA, 20 bp, Homo sapiens
actccttaaaaatgtatgtt

SEQ ID NO: 4777857 - DNA, 24 bp, Homo sapiens
actcctttctaaggagcactagaa

SEQ ID NO: 4777858 - DNA, 18 bp, Homo sapiens
actcgagagggctgagcc

SEQ ID NO: 4777859 - DNA, 16 bp, Homo sapiens
actcgagttacagaca

SEQ ID NO: 4777860 - DNA, 19 bp, Homo sapiens
actcgtccccctcctgcct

SEQ ID NO: 4777861 - DNA, 12 bp, Homo sapiens
actctagatgtt

SEQ ID NO: 4777862 - DNA, 21 bp, Homo sapiens
actctagatgtttagatgagg

SEQ ID NO: 4777863 - DNA, 15 bp, Homo sapiens
actctatctgggcct

SEQ ID NO: 4777864 - DNA, 16 bp, Homo sapiens
actctatctgggcctg

SEQ ID NO: 4777865 - DNA, 18 bp, Homo sapiens
actctatctgggcctggg

SEQ ID NO: 4777866 - DNA, 17 bp, Homo sapiens
actctcaggaccaccct

SEQ ID NO: 4777867 - DNA, 20 bp, Homo sapiens
actctcaggaccaccctgcc

SEQ ID NO: 4777868 - DNA, 21 bp, Homo sapiens
actctcaggaccaccctgcca

SEQ ID NO: 4777869 - DNA, 18 bp, Homo sapiens
actctccaggattgtcca

SEQ ID NO: 4777870 - DNA, 14 bp, Homo sapiens
actctctcctctct

SEQ ID NO: 4777871 - DNA, 19 bp, Homo sapiens
actctctcctctctctccc

SEQ ID NO: 4777872 - DNA, 23 bp, Homo sapiens
actctctcctctctctccctcca

SEQ ID NO: 4777873 - DNA, 21 bp, Homo sapiens
actctgaagtcccttcctgtc

SEQ ID NO: 4777874 - DNA, 22 bp, Homo sapiens
actctgaagtcccttcctgtcc

SEQ ID NO: 4777875 - DNA, 23 bp, Homo sapiens
actctgaagtcccttcctgtcct

SEQ ID NO: 4777876 - DNA, 21 bp, Homo sapiens
actctgacaagggctgacctg

SEQ ID NO: 4777877 - DNA, 19 bp, Homo sapiens
actctgacgcaaaaccact

SEQ ID NO: 4777878 - DNA, 14 bp, Homo sapiens
actctgagtcctca

SEQ ID NO: 4777879 - DNA, 18 bp, Homo sapiens
actctgccagggcagtgc

SEQ ID NO: 4777880 - DNA, 21 bp, Homo sapiens
actctggccttggttcctcca

SEQ ID NO: 4777881 - DNA, 13 bp, Homo sapiens
aaaaaaacattct

SEQ ID NO: 4777882 - DNA, 13 bp, Homo sapiens
aaaaaatacagta

SEQ ID NO: 4777883 - DNA, 13 bp, Homo sapiens
aaaaaatatgtgt

SEQ ID NO: 4777884 - DNA, 17 bp, Homo sapiens
aaaaaatgaatagtaca

SEQ ID NO: 4777885 - DNA, 14 bp, Homo sapiens
aaaaaatgttcatt

SEQ ID NO: 4777886 - DNA, 19 bp, Homo sapiens
aaaaacattctatctactg

SEQ ID NO: 4777887 - DNA, 23 bp, Homo sapiens
aaaaacattctatctactgattt

SEQ ID NO: 4777888 - DNA, 22 bp, Homo sapiens
aaaaactcctgttttcacacct

SEQ ID NO: 4777889 - DNA, 15 bp, Homo sapiens
aaaaactggaaacat

SEQ ID NO: 4777890 - DNA, 22 bp, Homo sapiens
aaaaactggaaacatctgattt

SEQ ID NO: 4777891 - DNA, 22 bp, Homo sapiens
aaaaactttccatgacagtagc

SEQ ID NO: 4777892 - DNA, 12 bp, Homo sapiens
aaaaacttttat

SEQ ID NO: 4777893 - DNA, 17 bp, Homo sapiens
aaaaacttttataaatt

SEQ ID NO: 4777894 - DNA, 12 bp, Homo sapiens
aaaaagaggcta

SEQ ID NO: 4777895 - DNA, 20 bp, Homo sapiens
aaaaagatattgtattatca

SEQ ID NO: 4777896 - DNA, 20 bp, Homo sapiens
aaaaagcttaaacattgcct

SEQ ID NO: 4777897 - DNA, 16 bp, Homo sapiens
aaaaagtgcaacttga

SEQ ID NO: 4777898 - DNA, 18 bp, Homo sapiens
aaaaagtgtttttacata

SEQ ID NO: 4777899 - DNA, 15 bp, Homo sapiens
aaaaagttgcacatt

SEQ ID NO: 4777900 - DNA, 15 bp, Homo sapiens
aaaaatacagtatta

SEQ ID NO: 4777901 - DNA, 21 bp, Homo sapiens
aaaaatacagtattatttagt

SEQ ID NO: 4777902 - DNA, 18 bp, Homo sapiens
aaaaatagctataaatag

SEQ ID NO: 4777903 - DNA, 11 bp, Homo sapiens
aaaaatatatg

SEQ ID NO: 4777904 - DNA, 12 bp, Homo sapiens
aaaaatatatgt

SEQ ID NO: 4777905 - DNA, 15 bp, Homo sapiens
aaaaatatatgtaat

SEQ ID NO: 4777906 - DNA, 11 bp, Homo sapiens
aaaaatatgtg

SEQ ID NO: 4777907 - DNA, 19 bp, Homo sapiens
aaaaatctgaatttctaaa

SEQ ID NO: 4777908 - DNA, 15 bp, Homo sapiens
aaaaattaattcttt

SEQ ID NO: 4777909 - DNA, 16 bp, Homo sapiens
aaaaattatagactcc

SEQ ID NO: 4777910 - DNA, 15 bp, Homo sapiens
aaaaattatctttaa

SEQ ID NO: 4777911 - DNA, 16 bp, Homo sapiens
aaaaattatctttaaa

SEQ ID NO: 4777912 - DNA, 20 bp, Homo sapiens
aaaaattatctttaaaactt

SEQ ID NO: 4777913 - DNA, 14 bp, Homo sapiens
aaaaatttgacatt

SEQ ID NO: 4777914 - DNA, 24 bp, Homo sapiens
aaaaatttgacattgtcagaatgt

SEQ ID NO: 4777915 - DNA, 15 bp, Homo sapiens
aaaacaacagcaaca

SEQ ID NO: 4777916 - DNA, 22 bp, Homo sapiens
aaaacaacagcaacaacaacag

SEQ ID NO: 4777917 - DNA, 16 bp, Homo sapiens
aaaacaagctgatagt

SEQ ID NO: 4777918 - DNA, 19 bp, Homo sapiens
aaaacaatggtaacatttt

SEQ ID NO: 4777919 - DNA, 16 bp, Homo sapiens
aaaacagaaaaacaaa

SEQ ID NO: 4777920 - DNA, 19 bp, Homo sapiens
aaaacaggaaaaaaacttt

SEQ ID NO: 4777921 - DNA, 11 bp, Homo sapiens
aaaacagtggt

SEQ ID NO: 4777922 - DNA, 16 bp, Homo sapiens
aaaacattctatctac

SEQ ID NO: 4777923 - DNA, 17 bp, Homo sapiens
aaaaccattctgcttgg

SEQ ID NO: 4777924 - DNA, 23 bp, Homo sapiens
aaaaccttagctccctcccgcac

SEQ ID NO: 4777925 - DNA, 13 bp, Homo sapiens
aaaactaagttct

SEQ ID NO: 4777926 - DNA, 12 bp, Homo sapiens
aaaactgccaca

SEQ ID NO: 4777927 - DNA, 23 bp, Homo sapiens
aaaactgtattgaaaaaatattg

SEQ ID NO: 4777928 - DNA, 10 bp, Homo sapiens
aaaactgtga

SEQ ID NO: 4777929 - DNA, 22 bp, Homo sapiens
aaaactgtgacattccacagag

SEQ ID NO: 4777930 - DNA, 17 bp, Homo sapiens
aaaactgtgaccaagta

SEQ ID NO: 4777931 - DNA, 21 bp, Homo sapiens
aaaactgtgaccaagtataaa

SEQ ID NO: 4777932 - DNA, 12 bp, Homo sapiens
aaaactgtttat

SEQ ID NO: 4777933 - DNA, 12 bp, Homo sapiens
aaaactttattt

SEQ ID NO: 4777934 - DNA, 16 bp, Homo sapiens
aaaactttattttata

SEQ ID NO: 4777935 - DNA, 24 bp, Homo sapiens
aaaactttgacgagtcaccttcca

SEQ ID NO: 4777936 - DNA, 17 bp, Homo sapiens
aaaacttttataaatta

SEQ ID NO: 4777937 - DNA, 14 bp, Homo sapiens
aaaagaaagaaaaa

SEQ ID NO: 4777938 - DNA, 14 bp, Homo sapiens
aaaagaagtagtgt

SEQ ID NO: 4777939 - DNA, 19 bp, Homo sapiens
aaaagaatccctgttcatt

SEQ ID NO: 4777940 - DNA, 16 bp, Homo sapiens
aaaagacacttttacc

SEQ ID NO: 4777941 - DNA, 13 bp, Homo sapiens
aaaagacttcaaa

SEQ ID NO: 4777942 - DNA, 13 bp, Homo sapiens
aaaagatattgta

SEQ ID NO: 4777943 - DNA, 22 bp, Homo sapiens
aaaagatggatttgacacactc

SEQ ID NO: 4777944 - DNA, 18 bp, Homo sapiens
aaaagattaaaattagtg

SEQ ID NO: 4777945 - DNA, 18 bp, Homo sapiens
aaataataaaagaatcat

SEQ ID NO: 4777946 - DNA, 13 bp, Homo sapiens
aaataataaaggt

SEQ ID NO: 4777947 - DNA, 14 bp, Homo sapiens
aaataataaaggtt

SEQ ID NO: 4777948 - DNA, 16 bp, Homo sapiens
aaataataaaggttct

SEQ ID NO: 4777949 - DNA, 15 bp, Homo sapiens
aaataataatattta

SEQ ID NO: 4777950 - DNA, 14 bp, Homo sapiens
aaataatataaatg

SEQ ID NO: 4777951 - DNA, 22 bp, Homo sapiens
aaataatgatttaagcatttta

SEQ ID NO: 4777952 - DNA, 22 bp, Homo sapiens
aaataatgcttaacataaactt

SEQ ID NO: 4777953 - DNA, 23 bp, Homo sapiens
aaataatgcttaacataaacttg

SEQ ID NO: 4777954 - DNA, 15 bp, Homo sapiens
aaatacattccagtg

SEQ ID NO: 4777955 - DNA, 22 bp, Homo sapiens
aaatactattggacagacacag

SEQ ID NO: 4777956 - DNA, 18 bp, Homo sapiens
aaatagaaaacaggaaaa

SEQ ID NO: 4777957 - DNA, 13 bp, Homo sapiens
aaatagctataaa

SEQ ID NO: 4777958 - DNA, 21 bp, Homo sapiens
aaatagctataaatagtgaaa

SEQ ID NO: 4777959 - DNA, 15 bp, Homo sapiens
aaatagcttttcact

SEQ ID NO: 4777960 - DNA, 15 bp, Homo sapiens
aaatagtgttctttt

SEQ ID NO: 4777961 - DNA, 22 bp, Homo sapiens
aaatagttgtaggggaaatcaa

SEQ ID NO: 4777962 - DNA, 15 bp, Homo sapiens
aaatataaaaataat

SEQ ID NO: 4777963 - DNA, 16 bp, Homo sapiens
aaatataaactgtgag

SEQ ID NO: 4777964 - DNA, 16 bp, Homo sapiens
aaatatacactttaca

SEQ ID NO: 4777965 - DNA, 13 bp, Homo sapiens
aaatatagtagca

SEQ ID NO: 4777966 - DNA, 16 bp, Homo sapiens
aaatatagtgttgtgt

SEQ ID NO: 4777967 - DNA, 12 bp, Homo sapiens
aaatatatgtaa

SEQ ID NO: 4777968 - DNA, 12 bp, Homo sapiens
aaatatatgtat

SEQ ID NO: 4777969 - DNA, 19 bp, Homo sapiens
aaatatatgtttggctgaa

SEQ ID NO: 4777970 - DNA, 23 bp, Homo sapiens
aaatatatgtttggctgaaatta

SEQ ID NO: 4777971 - DNA, 21 bp, Homo sapiens
aaatatcatataaatattgag

SEQ ID NO: 4777972 - DNA, 13 bp, Homo sapiens
aaatatctagtgc

SEQ ID NO: 4777973 - DNA, 22 bp, Homo sapiens
aaatatctagtgctaaacctat

SEQ ID NO: 4777974 - DNA, 21 bp, Homo sapiens
aaatatctatttatctgtctg

SEQ ID NO: 4777975 - DNA, 16 bp, Homo sapiens
aaatatctctatttaa

SEQ ID NO: 4777976 - DNA, 15 bp, Homo sapiens
aaatatctgtgaaat

SEQ ID NO: 4777977 - DNA, 21 bp, Homo sapiens
aaatatgattctcctctccca

SEQ ID NO: 4777978 - DNA, 14 bp, Homo sapiens
aaatattagcaaag

SEQ ID NO: 4777979 - DNA, 14 bp, Homo sapiens
aaatattctgtcat

SEQ ID NO: 4777980 - DNA, 16 bp, Homo sapiens
aaatattgatctgtat

SEQ ID NO: 4777981 - DNA, 19 bp, Homo sapiens
aaatattgatctgtattaa

SEQ ID NO: 4777982 - DNA, 21 bp, Homo sapiens
aaatattgctgtctgaaaaag

SEQ ID NO: 4777983 - DNA, 15 bp, Homo sapiens
aaatattgcttggac

SEQ ID NO: 4777984 - DNA, 17 bp, Homo sapiens
aaatattgcttggacta

SEQ ID NO: 4777985 - DNA, 17 bp, Homo sapiens
aaatatttataaatgaa

SEQ ID NO: 4777986 - DNA, 13 bp, Homo sapiens
aaatatttcactt

SEQ ID NO: 4777987 - DNA, 14 bp, Homo sapiens
aaatattttcttaa

SEQ ID NO: 4777988 - DNA, 17 bp, Homo sapiens
aaatcaaggtgaaggat

SEQ ID NO: 4777989 - DNA, 13 bp, Homo sapiens
aaatcaatcattt

SEQ ID NO: 4777990 - DNA, 15 bp, Homo sapiens
aaatcacaaactcat

SEQ ID NO: 4777991 - DNA, 19 bp, Homo sapiens
aaatcacagatttccaaaa

SEQ ID NO: 4777992 - DNA, 15 bp, Homo sapiens
aaatcataatcatcc

SEQ ID NO: 4777993 - DNA, 17 bp, Homo sapiens
aaatcatcaaagtgttt

SEQ ID NO: 4777994 - DNA, 20 bp, Homo sapiens
aaatcatgggcattgctgga

SEQ ID NO: 4777995 - DNA, 17 bp, Homo sapiens
aaatccacccagcccac

SEQ ID NO: 4777996 - DNA, 15 bp, Homo sapiens
aaatccatgtgtccc

SEQ ID NO: 4777997 - DNA, 15 bp, Homo sapiens
aaatctaaattaact

SEQ ID NO: 4777998 - DNA, 21 bp, Homo sapiens
aaatctacaaacttttataaa

SEQ ID NO: 4777999 - DNA, 18 bp, Homo sapiens
aaatctagaagagtctat

SEQ ID NO: 4778000 - DNA, 16 bp, Homo sapiens
aaatctcactgtatta

SEQ ID NO: 4778001 - DNA, 14 bp, Homo sapiens
aaatctcatcccta

SEQ ID NO: 4778002 - DNA, 16 bp, Homo sapiens
aaatctgaagcctttt

SEQ ID NO: 4778003 - DNA, 12 bp, Homo sapiens
aaatctgaattt

SEQ ID NO: 4778004 - DNA, 18 bp, Homo sapiens
aaatctgtataaatgtga

SEQ ID NO: 4778005 - DNA, 19 bp, Homo sapiens
aaatctttgttaaaatata

SEQ ID NO: 4778006 - DNA, 21 bp, Homo sapiens
aaatctttgttaaaatatagt

SEQ ID NO: 4778007 - DNA, 13 bp, Homo sapiens
aaatgaaatactt

SEQ ID NO: 4778008 - DNA, 17 bp, Homo sapiens
aaatgaaatacttgaca

SEQ ID NO: 4778009 - DNA, 18 bp, Homo sapiens
aaatgaaatttaagcaca

SEQ ID NO: 4778010 - DNA, 17 bp, Homo sapiens
aaatgaactaactgcca

SEQ ID NO: 4778011 - DNA, 13 bp, Homo sapiens
aaatgaatgaaat

SEQ ID NO: 4778012 - DNA, 14 bp, Homo sapiens
aaatgaatgaaata

SEQ ID NO: 4778013 - DNA, 18 bp, Homo sapiens
aaatgacaggatatgagt

SEQ ID NO: 4778014 - DNA, 19 bp, Homo sapiens
aaatgacatgcactgaccc

SEQ ID NO: 4778015 - DNA, 14 bp, Homo sapiens
aaatgacttattga

SEQ ID NO: 4778016 - DNA, 20 bp, Homo sapiens
aaatgagttcccttgattca

SEQ ID NO: 4778017 - DNA, 19 bp, Homo sapiens
aaatgatacttggtcctta

SEQ ID NO: 4778018 - DNA, 18 bp, Homo sapiens
aaatgatatgtctttaaa

SEQ ID NO: 4778019 - DNA, 20 bp, Homo sapiens
aaatgatatgtctttaaaat

SEQ ID NO: 4778020 - DNA, 21 bp, Homo sapiens
aaatgatcaaggagggagaaa

SEQ ID NO: 4778021 - DNA, 21 bp, Homo sapiens
aaatgattcacttttattgta

SEQ ID NO: 4778022 - DNA, 20 bp, Homo sapiens
aaatgcaaacactgtgtatt

SEQ ID NO: 4778023 - DNA, 21 bp, Homo sapiens
aaatgcaaacactgtgtattt

SEQ ID NO: 4778024 - DNA, 22 bp, Homo sapiens
aaatgccaagactctatgctct

SEQ ID NO: 4778025 - DNA, 23 bp, Homo sapiens
aaatgccagacttctaaaataaa

SEQ ID NO: 4778026 - DNA, 15 bp, Homo sapiens
aaatgcctaataaac

SEQ ID NO: 4778027 - DNA, 15 bp, Homo sapiens
aaatgctactcagta

SEQ ID NO: 4778028 - DNA, 14 bp, Homo sapiens
aaatgctgatttaa

SEQ ID NO: 4778029 - DNA, 21 bp, Homo sapiens
aaatgctgatttaaacttctt

SEQ ID NO: 4778030 - DNA, 14 bp, Homo sapiens
aaatgctgttctca

SEQ ID NO: 4778031 - DNA, 16 bp, Homo sapiens
aaatgctgttctcaat

SEQ ID NO: 4778032 - DNA, 22 bp, Homo sapiens
aaatgctgttctcaatcattgt

SEQ ID NO: 4778033 - DNA, 13 bp, Homo sapiens
aaatgctttctca

SEQ ID NO: 4778034 - DNA, 14 bp, Homo sapiens
aaatgctttctcat

SEQ ID NO: 4778035 - DNA, 18 bp, Homo sapiens
aaatggaaaggtcctgct

SEQ ID NO: 4778036 - DNA, 21 bp, Homo sapiens
aaatggacgtgttatgactcc

SEQ ID NO: 4778037 - DNA, 19 bp, Homo sapiens
aaatggaggaaaccacaaa

SEQ ID NO: 4778038 - DNA, 18 bp, Homo sapiens
aaatggatgacaaagaaa

SEQ ID NO: 4778039 - DNA, 18 bp, Homo sapiens
aaatggatgtaatatagg

SEQ ID NO: 4778040 - DNA, 16 bp, Homo sapiens
aaatggcatttagcac

SEQ ID NO: 4778041 - DNA, 21 bp, Homo sapiens
aaatggcatttagcacagtat

SEQ ID NO: 4778042 - DNA, 17 bp, Homo sapiens
aaatggctgaagaaaca

SEQ ID NO: 4778043 - DNA, 20 bp, Homo sapiens
aaatggcttgttcagtcact

SEQ ID NO: 4778044 - DNA, 22 bp, Homo sapiens
aaatggggaactcccccagagg

SEQ ID NO: 4778045 - DNA, 17 bp, Homo sapiens
aaatggtattttttgtg

SEQ ID NO: 4778046 - DNA, 19 bp, Homo sapiens
aaatggtattttttgtgaa

SEQ ID NO: 4778047 - DNA, 19 bp, Homo sapiens
aaatggtgttttcatgtaa

SEQ ID NO: 4778048 - DNA, 13 bp, Homo sapiens
aaatgtaaaatat

SEQ ID NO: 4778049 - DNA, 14 bp, Homo sapiens
aaatgtaaaatatt

SEQ ID NO: 4778050 - DNA, 15 bp, Homo sapiens
aaatgtaaaatattt

SEQ ID NO: 4778051 - DNA, 21 bp, Homo sapiens
aaatgtagcttcagtcattaa

SEQ ID NO: 4778052 - DNA, 22 bp, Homo sapiens
aaatgtagcttcagtcattaaa

SEQ ID NO: 4778053 - DNA, 21 bp, Homo sapiens
aaatgtatgttggtttagcgt

SEQ ID NO: 4778054 - DNA, 11 bp, Homo sapiens
aaatgtattat

SEQ ID NO: 4778055 - DNA, 14 bp, Homo sapiens
aaatgtattatgtc

SEQ ID NO: 4778056 - DNA, 23 bp, Homo sapiens
aaatgtattatgtcctgtgagat

SEQ ID NO: 4778057 - DNA, 16 bp, Homo sapiens
aaatgtcccaaataaa

SEQ ID NO: 4778058 - DNA, 17 bp, Homo sapiens
aaatgtctataaatggt

SEQ ID NO: 4778059 - DNA, 17 bp, Homo sapiens
aaatgtgtgcttggaaa

SEQ ID NO: 4778060 - DNA, 18 bp, Homo sapiens
aaatgttattcaataact

SEQ ID NO: 4778061 - DNA, 22 bp, Homo sapiens
aaatgttttcatatttttcaaa

SEQ ID NO: 4778062 - DNA, 12 bp, Homo sapiens
aaatgttttgga

SEQ ID NO: 4778063 - DNA, 15 bp, Homo sapiens
aaattaaataaaata

SEQ ID NO: 4778064 - DNA, 19 bp, Homo sapiens
aaattaaatatatgtatgt

SEQ ID NO: 4778065 - DNA, 23 bp, Homo sapiens
aaattaaatatatgtatgtaaaa

SEQ ID NO: 4778066 - DNA, 23 bp, Homo sapiens
aaattaacaaattcagtggacat

SEQ ID NO: 4778067 - DNA, 21 bp, Homo sapiens
aagaagatagttgtaaagata

SEQ ID NO: 4778068 - DNA, 17 bp, Homo sapiens
aagaagggaaattcaca

SEQ ID NO: 4778069 - DNA, 19 bp, Homo sapiens
aagaagggaaattcacact

SEQ ID NO: 4778070 - DNA, 13 bp, Homo sapiens
aagaatattgtat

SEQ ID NO: 4778071 - DNA, 18 bp, Homo sapiens
aagaatattgtattgtta

SEQ ID NO: 4778072 - DNA, 11 bp, Homo sapiens
aagaatcatgg

SEQ ID NO: 4778073 - DNA, 12 bp, Homo sapiens
aagaatcatgga

SEQ ID NO: 4778074 - DNA, 23 bp, Homo sapiens
aagaatcgatgggggatgcttca

SEQ ID NO: 4778075 - DNA, 16 bp, Homo sapiens
aagaatggagcagtac

SEQ ID NO: 4778076 - DNA, 20 bp, Homo sapiens
aagaattcagtagcatttta

SEQ ID NO: 4778077 - DNA, 17 bp, Homo sapiens
aagaattgccagtcttt

SEQ ID NO: 4778078 - DNA, 20 bp, Homo sapiens
aagaattgccagtcttttgt

SEQ ID NO: 4778079 - DNA, 23 bp, Homo sapiens
aagaatttagaggataaataata

SEQ ID NO: 4778080 - DNA, 20 bp, Homo sapiens
aagaatttgaagacttcaaa

SEQ ID NO: 4778081 - DNA, 14 bp, Homo sapiens
aagaattttaaaaa

SEQ ID NO: 4778082 - DNA, 13 bp, Homo sapiens
aagacaaatgcag

SEQ ID NO: 4778083 - DNA, 21 bp, Homo sapiens
aagacaccagagtgtatgcat

SEQ ID NO: 4778084 - DNA, 19 bp, Homo sapiens
aagacacgtgcaacagact

SEQ ID NO: 4778085 - DNA, 21 bp, Homo sapiens
aagacagtttcttgcaagctc

SEQ ID NO: 4778086 - DNA, 14 bp, Homo sapiens
aagacattcaccaa

SEQ ID NO: 4778087 - DNA, 17 bp, Homo sapiens
aagaccatgcattcaga

SEQ ID NO: 4778088 - DNA, 19 bp, Homo sapiens
aagaccttctgaagatctc

SEQ ID NO: 4778089 - DNA, 22 bp, Homo sapiens
aagacgtttttgtgctgtgggc

SEQ ID NO: 4778090 - DNA, 15 bp, Homo sapiens
aagactctatgctct

SEQ ID NO: 4778091 - DNA, 16 bp, Homo sapiens
aagactgtcattagaa

SEQ ID NO: 4778092 - DNA, 12 bp, Homo sapiens
aagacttcaaaa

SEQ ID NO: 4778093 - DNA, 22 bp, Homo sapiens
aagacttccagctttctctttg

SEQ ID NO: 4778094 - DNA, 21 bp, Homo sapiens
aagacttgacgcagcccccca

SEQ ID NO: 4778095 - DNA, 17 bp, Homo sapiens
aagagaaaaagccctct

SEQ ID NO: 4778096 - DNA, 11 bp, Homo sapiens
aagagaattct

SEQ ID NO: 4778097 - DNA, 18 bp, Homo sapiens
aagagaccacttccttaa

SEQ ID NO: 4778098 - DNA, 20 bp, Homo sapiens
aagagagaaagcatattgac

SEQ ID NO: 4778099 - DNA, 17 bp, Homo sapiens
aagagagatatatctga

SEQ ID NO: 4778100 - DNA, 13 bp, Homo sapiens
aagagatgctcta

SEQ ID NO: 4778101 - DNA, 18 bp, Homo sapiens
aagagattttatgtttaa

SEQ ID NO: 4778102 - DNA, 21 bp, Homo sapiens
aagagctcaggagaaggcctg

SEQ ID NO: 4778103 - DNA, 15 bp, Homo sapiens
aagagctgctgtatt

SEQ ID NO: 4778104 - DNA, 16 bp, Homo sapiens
aagagctgctgtattt

SEQ ID NO: 4778105 - DNA, 22 bp, Homo sapiens
aagagctgttctttttgactga

SEQ ID NO: 4778106 - DNA, 18 bp, Homo sapiens
aagagctgttttggatga

SEQ ID NO: 4778107 - DNA, 16 bp, Homo sapiens
aagaggccagtacttt

SEQ ID NO: 4778108 - DNA, 14 bp, Homo sapiens
aagaggtggattca

SEQ ID NO: 4778109 - DNA, 18 bp, Homo sapiens
aagagtaaaaccaaaggt

SEQ ID NO: 4778110 - DNA, 16 bp, Homo sapiens
aagagtaaatatactt

SEQ ID NO: 4778111 - DNA, 22 bp, Homo sapiens
aagagttatatgacttcttgtt

SEQ ID NO: 4778112 - DNA, 22 bp, Homo sapiens
aagataattaaatgaaatactt

SEQ ID NO: 4778113 - DNA, 21 bp, Homo sapiens
aagatacactcaagcatgaag

SEQ ID NO: 4778114 - DNA, 15 bp, Homo sapiens
aagatagcagaagag

SEQ ID NO: 4778115 - DNA, 21 bp, Homo sapiens
aagatagctccttcatgcttt

SEQ ID NO: 4778116 - DNA, 22 bp, Homo sapiens
aagataggttctgctttctgat

SEQ ID NO: 4778117 - DNA, 16 bp, Homo sapiens
aagatagttgtaaaga

SEQ ID NO: 4778118 - DNA, 22 bp, Homo sapiens
aagatattgtatctcctttaat

SEQ ID NO: 4778119 - DNA, 19 bp, Homo sapiens
aagatattgtattatcata

SEQ ID NO: 4778120 - DNA, 22 bp, Homo sapiens
aagatattgtattatcatatat

SEQ ID NO: 4778121 - DNA, 12 bp, Homo sapiens
aagatctaaatc

SEQ ID NO: 4778122 - DNA, 19 bp, Homo sapiens
aagatctctttctaaagac

SEQ ID NO: 4778123 - DNA, 13 bp, Homo sapiens
aagatctttctta

SEQ ID NO: 4778124 - DNA, 14 bp, Homo sapiens
aagatctttcttaa

SEQ ID NO: 4778125 - DNA, 18 bp, Homo sapiens
aagatctttttttaagtg

SEQ ID NO: 4778126 - DNA, 20 bp, Homo sapiens
aagatgcattttaaatgtct

SEQ ID NO: 4778127 - DNA, 11 bp, Homo sapiens
aagatgccaag

SEQ ID NO: 4778128 - DNA, 12 bp, Homo sapiens
aagatgccaagg

SEQ ID NO: 4778129 - DNA, 18 bp, Homo sapiens
aagatgctgctgagcaca

SEQ ID NO: 4778130 - DNA, 22 bp, Homo sapiens
aagatgctgctgagcacatctc

SEQ ID NO: 4778131 - DNA, 20 bp, Homo sapiens
aagatggatttgacacactc

SEQ ID NO: 4778132 - DNA, 21 bp, Homo sapiens
aagatgggtgattatgaaatg

SEQ ID NO: 4778133 - DNA, 18 bp, Homo sapiens
aagattagaaagaattag

SEQ ID NO: 4778134 - DNA, 22 bp, Homo sapiens
aagattagaaagaattagccaa

SEQ ID NO: 4778135 - DNA, 20 bp, Homo sapiens
aagattatatacaaagctgt

SEQ ID NO: 4778136 - DNA, 18 bp, Homo sapiens
aagattccattttggaaa

SEQ ID NO: 4778137 - DNA, 13 bp, Homo sapiens
aagattgtacata

SEQ ID NO: 4778138 - DNA, 14 bp, Homo sapiens
aagcaaactgaaat

SEQ ID NO: 4778139 - DNA, 22 bp, Homo sapiens
aagcaaactggttatttaaaat

SEQ ID NO: 4778140 - DNA, 20 bp, Homo sapiens
aagcaaagacagtttcttgc

SEQ ID NO: 4778141 - DNA, 12 bp, Homo sapiens
aagcaaaggaga

SEQ ID NO: 4778142 - DNA, 13 bp, Homo sapiens
aagcaaaggagat

SEQ ID NO: 4778143 - DNA, 16 bp, Homo sapiens
aagcaaataaatatca

SEQ ID NO: 4778144 - DNA, 22 bp, Homo sapiens
aagcaaatctgtataaatgtga

SEQ ID NO: 4778145 - DNA, 20 bp, Homo sapiens
aagcaaatttctagatatga

SEQ ID NO: 4778146 - DNA, 13 bp, Homo sapiens
aagcaatcttggc

SEQ ID NO: 4778147 - DNA, 14 bp, Homo sapiens
aagcaatcttggca

SEQ ID NO: 4778148 - DNA, 16 bp, Homo sapiens
aagcacatgcctctct

SEQ ID NO: 4778149 - DNA, 16 bp, Homo sapiens
aagcagaatgagatga

SEQ ID NO: 4778150 - DNA, 12 bp, Homo sapiens
aagcagatcatc

SEQ ID NO: 4778151 - DNA, 18 bp, Homo sapiens
aagcagcagctagaaaga

SEQ ID NO: 4778152 - DNA, 20 bp, Homo sapiens
aagcaggaaagatcccaagt

SEQ ID NO: 4778153 - DNA, 17 bp, Homo sapiens
aagcagtacatcttgtg

SEQ ID NO: 4778154 - DNA, 23 bp, Homo sapiens
aagcagtacatcttgtgcatgca

SEQ ID NO: 4778155 - DNA, 20 bp, Homo sapiens
aagcagtatgtacaggctga

SEQ ID NO: 4778156 - DNA, 17 bp, Homo sapiens
aagcagtggatacgtgt

SEQ ID NO: 4778157 - DNA, 20 bp, Homo sapiens
aagcagtttcagataaatca

SEQ ID NO: 4778158 - DNA, 23 bp, Homo sapiens
aagcagtttcagataaatcatgg

SEQ ID NO: 4778159 - DNA, 15 bp, Homo sapiens
aagcatatataaaac

SEQ ID NO: 4778160 - DNA, 15 bp, Homo sapiens
aagcatcagcaagac

SEQ ID NO: 4778161 - DNA, 16 bp, Homo sapiens
aagcatcagcaagaca

SEQ ID NO: 4778162 - DNA, 16 bp, Homo sapiens
aagcatgccaatttct

SEQ ID NO: 4778163 - DNA, 19 bp, Homo sapiens
aagcatgccaatttctctt

SEQ ID NO: 4778164 - DNA, 19 bp, Homo sapiens
aagccacgttgcagaaaaa

SEQ ID NO: 4778165 - DNA, 13 bp, Homo sapiens
aagccaggagacc

SEQ ID NO: 4778166 - DNA, 14 bp, Homo sapiens
aagccaggagaccc

SEQ ID NO: 4778167 - DNA, 19 bp, Homo sapiens
aagccaggagaccctgtct

SEQ ID NO: 4778168 - DNA, 19 bp, Homo sapiens
aagcccacccgccccagag

SEQ ID NO: 4778169 - DNA, 21 bp, Homo sapiens
aagcccacccgccccagagac

SEQ ID NO: 4778170 - DNA, 22 bp, Homo sapiens
aagcccacccgccccagagact

SEQ ID NO: 4778171 - DNA, 13 bp, Homo sapiens
aagcccaggagga

SEQ ID NO: 4778172 - DNA, 21 bp, Homo sapiens
aagccctccctgtctgtctgt

SEQ ID NO: 4778173 - DNA, 16 bp, Homo sapiens
aagccctggggcaggg

SEQ ID NO: 4778174 - DNA, 21 bp, Homo sapiens
aagcccttctcaagaccgagt

SEQ ID NO: 4778175 - DNA, 22 bp, Homo sapiens
aagccggcggagctctggcttt

SEQ ID NO: 4778176 - DNA, 23 bp, Homo sapiens
aagcctcagtccctccctcctgg

SEQ ID NO: 4778177 - DNA, 17 bp, Homo sapiens
aagctaaaatgaaaaat

SEQ ID NO: 4778178 - DNA, 22 bp, Homo sapiens
aagctacatatgtaggaaaatt

SEQ ID NO: 4778179 - DNA, 16 bp, Homo sapiens
aagctataaaagccca

SEQ ID NO: 4778180 - DNA, 15 bp, Homo sapiens
aagctatcttcatgt

SEQ ID NO: 4778181 - DNA, 20 bp, Homo sapiens
aagctatttaagtggactgt

SEQ ID NO: 4778182 - DNA, 22 bp, Homo sapiens
aagctcacacttgggctggcac

SEQ ID NO: 4778183 - DNA, 20 bp, Homo sapiens
aagctcatagcacatgtttt

SEQ ID NO: 4778184 - DNA, 12 bp, Homo sapiens
aagctgatggac

SEQ ID NO: 4778185 - DNA, 13 bp, Homo sapiens
aagctgcagcttg

SEQ ID NO: 4778186 - DNA, 23 bp, Homo sapiens
aagctgcccaatttcacagagta

SEQ ID NO: 4778187 - DNA, 20 bp, Homo sapiens
aagctgctgccgcctcacct

SEQ ID NO: 4778188 - DNA, 14 bp, Homo sapiens
aatcaaaaaattat

SEQ ID NO: 4778189 - DNA, 19 bp, Homo sapiens
aatcaacagtgaacagctt

SEQ ID NO: 4778190 - DNA, 13 bp, Homo sapiens
aatcaatactttg

SEQ ID NO: 4778191 - DNA, 21 bp, Homo sapiens
aatcaatactttgaacacaaa

SEQ ID NO: 4778192 - DNA, 15 bp, Homo sapiens
aatcaatctggcttc

SEQ ID NO: 4778193 - DNA, 16 bp, Homo sapiens
aatcacagatttccaa

SEQ ID NO: 4778194 - DNA, 23 bp, Homo sapiens
aatcactaaatatctagtgctaa

SEQ ID NO: 4778195 - DNA, 15 bp, Homo sapiens
aatcactcatttatt

SEQ ID NO: 4778196 - DNA, 22 bp, Homo sapiens
aatcactcatttatttccatat

SEQ ID NO: 4778197 - DNA, 15 bp, Homo sapiens
aatcagaggcagaga

SEQ ID NO: 4778198 - DNA, 12 bp, Homo sapiens
aatcagcactga

SEQ ID NO: 4778199 - DNA, 16 bp, Homo sapiens
aatcagcactgaaaat

SEQ ID NO: 4778200 - DNA, 20 bp, Homo sapiens
aatcaggattccttcttccc

SEQ ID NO: 4778201 - DNA, 12 bp, Homo sapiens
aatcataatcat

SEQ ID NO: 4778202 - DNA, 17 bp, Homo sapiens
aatcatatataataaat

SEQ ID NO: 4778203 - DNA, 12 bp, Homo sapiens
aatcatctattg

SEQ ID NO: 4778204 - DNA, 22 bp, Homo sapiens
aatcatggatttattttttgta

SEQ ID NO: 4778205 - DNA, 12 bp, Homo sapiens
aatcattgtaca

SEQ ID NO: 4778206 - DNA, 16 bp, Homo sapiens
aatcattgtacagttt

SEQ ID NO: 4778207 - DNA, 16 bp, Homo sapiens
aatcattgtcagagat

SEQ ID NO: 4778208 - DNA, 19 bp, Homo sapiens
aatcattgtcagagatgtt

SEQ ID NO: 4778209 - DNA, 21 bp, Homo sapiens
aatcatttccagcaaaatata

SEQ ID NO: 4778210 - DNA, 22 bp, Homo sapiens
aatcatttccagcaaaatatat

SEQ ID NO: 4778211 - DNA, 23 bp, Homo sapiens
aatcattttctagccctctccct

SEQ ID NO: 4778212 - DNA, 12 bp, Homo sapiens
aatccaactcca

SEQ ID NO: 4778213 - DNA, 14 bp, Homo sapiens
aatccaactccagg

SEQ ID NO: 4778214 - DNA, 19 bp, Homo sapiens
aatccacagtattgttctt

SEQ ID NO: 4778215 - DNA, 18 bp, Homo sapiens
aatccacatgtttcagag

SEQ ID NO: 4778216 - DNA, 23 bp, Homo sapiens
aatccacccagcccactaactga

SEQ ID NO: 4778217 - DNA, 13 bp, Homo sapiens
aatccatatcagc

SEQ ID NO: 4778218 - DNA, 17 bp, Homo sapiens
aatccatatcagctctg

SEQ ID NO: 4778219 - DNA, 15 bp, Homo sapiens
aatccatgtgctgct

SEQ ID NO: 4778220 - DNA, 13 bp, Homo sapiens
aatccatgtgtcc

SEQ ID NO: 4778221 - DNA, 20 bp, Homo sapiens
aatccctcttcctccaaagc

SEQ ID NO: 4778222 - DNA, 12 bp, Homo sapiens
aatccctgttca

SEQ ID NO: 4778223 - DNA, 14 bp, Homo sapiens
aatccctgttcatt

SEQ ID NO: 4778224 - DNA, 15 bp, Homo sapiens
aatccttaataacta

SEQ ID NO: 4778225 - DNA, 12 bp, Homo sapiens
aatctaaattaa

SEQ ID NO: 4778226 - DNA, 15 bp, Homo sapiens
aatctaacattatta

SEQ ID NO: 4778227 - DNA, 13 bp, Homo sapiens
aatctacaaactt

SEQ ID NO: 4778228 - DNA, 17 bp, Homo sapiens
aatctacaaacttttat

SEQ ID NO: 4778229 - DNA, 21 bp, Homo sapiens
aatctacaaacttttataaat

SEQ ID NO: 4778230 - DNA, 23 bp, Homo sapiens
aatctacaaacttttataaatgt

SEQ ID NO: 4778231 - DNA, 16 bp, Homo sapiens
aatctatctctatata

SEQ ID NO: 4778232 - DNA, 22 bp, Homo sapiens
aatctcactgtattaaagatgc

SEQ ID NO: 4778233 - DNA, 20 bp, Homo sapiens
aatctcagcactttgtttca

SEQ ID NO: 4778234 - DNA, 16 bp, Homo sapiens
aatctcatacctctga

SEQ ID NO: 4778235 - DNA, 18 bp, Homo sapiens
aatctcatacctctgacc

SEQ ID NO: 4778236 - DNA, 22 bp, Homo sapiens
aatctcatacctctgaccaaca

SEQ ID NO: 4778237 - DNA, 19 bp, Homo sapiens
aatctctaaaatgctgttc

SEQ ID NO: 4778238 - DNA, 22 bp, Homo sapiens
aatctcttgtcattctcatcca

SEQ ID NO: 4778239 - DNA, 20 bp, Homo sapiens
aatctgaagccttttcctga

SEQ ID NO: 4778240 - DNA, 17 bp, Homo sapiens
aatctggcttctgcatt

SEQ ID NO: 4778241 - DNA, 17 bp, Homo sapiens
aatctgtataaatgtga

SEQ ID NO: 4778242 - DNA, 18 bp, Homo sapiens
aatctgtataaatgtgaa

SEQ ID NO: 4778243 - DNA, 17 bp, Homo sapiens
aatctgtcgcatttcat

SEQ ID NO: 4778244 - DNA, 21 bp, Homo sapiens
aatctgtgaagcctttatcta

SEQ ID NO: 4778245 - DNA, 23 bp, Homo sapiens
aatctgtgaagcctttatctatg

SEQ ID NO: 4778246 - DNA, 20 bp, Homo sapiens
aatcttctgaacttggcgct

SEQ ID NO: 4778247 - DNA, 23 bp, Homo sapiens
aatcttctgaacttggcgctgcc

SEQ ID NO: 4778248 - DNA, 16 bp, Homo sapiens
aatcttgctgcttatg

SEQ ID NO: 4778249 - DNA, 16 bp, Homo sapiens
aatcttgctgtgaaac

SEQ ID NO: 4778250 - DNA, 18 bp, Homo sapiens
aatcttggccctattcat

SEQ ID NO: 4778251 - DNA, 16 bp, Homo sapiens
aatctttgttaaaata

SEQ ID NO: 4778252 - DNA, 14 bp, Homo sapiens
aatgaaaaatctga

SEQ ID NO: 4778253 - DNA, 19 bp, Homo sapiens
aatgaaatataaactgtga

SEQ ID NO: 4778254 - DNA, 15 bp, Homo sapiens
aatgaactaactgcc

SEQ ID NO: 4778255 - DNA, 18 bp, Homo sapiens
aatgaactaactgccatg

SEQ ID NO: 4778256 - DNA, 17 bp, Homo sapiens
aatgaagcaaacacaca

SEQ ID NO: 4778257 - DNA, 13 bp, Homo sapiens
aatgaatgaaata

SEQ ID NO: 4778258 - DNA, 19 bp, Homo sapiens
aatgaatgcccaggaagta

SEQ ID NO: 4778259 - DNA, 20 bp, Homo sapiens
aatgaatgtcagtgtgactg

SEQ ID NO: 4778260 - DNA, 16 bp, Homo sapiens
aatgaattttaaaagc

SEQ ID NO: 4778261 - DNA, 22 bp, Homo sapiens
aatgacaggaacccatcactgt

SEQ ID NO: 4778262 - DNA, 13 bp, Homo sapiens
aatgacaggatat

SEQ ID NO: 4778263 - DNA, 22 bp, Homo sapiens
aatgacatgcactgacccttcc

SEQ ID NO: 4778264 - DNA, 16 bp, Homo sapiens
aatgacttattgatta

SEQ ID NO: 4778265 - DNA, 21 bp, Homo sapiens
aatgacttattgattaagtat

SEQ ID NO: 4778266 - DNA, 15 bp, Homo sapiens
aatgagaaatcatgt

SEQ ID NO: 4778267 - DNA, 22 bp, Homo sapiens
aatgagccaataaagctcacac

SEQ ID NO: 4778268 - DNA, 14 bp, Homo sapiens
aatgagttcccttg

SEQ ID NO: 4778269 - DNA, 17 bp, Homo sapiens
aatgatactgaattgtt

SEQ ID NO: 4778270 - DNA, 17 bp, Homo sapiens
aatgatatgtctttaaa

SEQ ID NO: 4778271 - DNA, 22 bp, Homo sapiens
aatgatattgctgaagaatcta

SEQ ID NO: 4778272 - DNA, 13 bp, Homo sapiens
aatgattaattaa

SEQ ID NO: 4778273 - DNA, 14 bp, Homo sapiens
aatgattcaatgtg

SEQ ID NO: 4778274 - DNA, 16 bp, Homo sapiens
aatgattcaatgtgaa

SEQ ID NO: 4778275 - DNA, 16 bp, Homo sapiens
aatgattcttgtgtca

SEQ ID NO: 4778276 - DNA, 21 bp, Homo sapiens
aatgattgtctaaccaattgt

SEQ ID NO: 4778277 - DNA, 12 bp, Homo sapiens
aatgattgttta

SEQ ID NO: 4778278 - DNA, 18 bp, Homo sapiens
aatgatttaagcatttta

SEQ ID NO: 4778279 - DNA, 18 bp, Homo sapiens
aatgcaaacactgtgtat

SEQ ID NO: 4778280 - DNA, 20 bp, Homo sapiens
aatgcaaatattgctattgt

SEQ ID NO: 4778281 - DNA, 15 bp, Homo sapiens
aatgcaataaagagt

SEQ ID NO: 4778282 - DNA, 14 bp, Homo sapiens
aatgcagtataaaa

SEQ ID NO: 4778283 - DNA, 18 bp, Homo sapiens
aatgcagtataaaatgta

SEQ ID NO: 4778284 - DNA, 17 bp, Homo sapiens
aatgcatctgaaagttt

SEQ ID NO: 4778285 - DNA, 21 bp, Homo sapiens
aatgcatctgaaagttttgat

SEQ ID NO: 4778286 - DNA, 22 bp, Homo sapiens
aatgcatctgaaagttttgata

SEQ ID NO: 4778287 - DNA, 22 bp, Homo sapiens
aatgccagacttctaaaataaa

SEQ ID NO: 4778288 - DNA, 16 bp, Homo sapiens
aatgcctaataaacaa

SEQ ID NO: 4778289 - DNA, 15 bp, Homo sapiens
aatgccttgttgtat

SEQ ID NO: 4778290 - DNA, 21 bp, Homo sapiens
aatgcctttctagcaattgct

SEQ ID NO: 4778291 - DNA, 19 bp, Homo sapiens
aatgcgctcttcaccagga

SEQ ID NO: 4778292 - DNA, 20 bp, Homo sapiens
aatgcgctcttcaccaggaa

SEQ ID NO: 4778293 - DNA, 21 bp, Homo sapiens
aatgcgctcttcaccaggaag

SEQ ID NO: 4778294 - DNA, 12 bp, Homo sapiens
aatgctaaatgc

SEQ ID NO: 4778295 - DNA, 14 bp, Homo sapiens
aatgctatggactg

SEQ ID NO: 4778296 - DNA, 16 bp, Homo sapiens
aatgctatttgtgtaa

SEQ ID NO: 4778297 - DNA, 21 bp, Homo sapiens
aatgctatttgtgtaactgaa

SEQ ID NO: 4778298 - DNA, 15 bp, Homo sapiens
aatgctcaatgtgct

SEQ ID NO: 4778299 - DNA, 19 bp, Homo sapiens
aatgctcgtatctccttga

SEQ ID NO: 4778300 - DNA, 16 bp, Homo sapiens
aatgctgttctcaatc

SEQ ID NO: 4778301 - DNA, 22 bp, Homo sapiens
aatgctgttctcaatcattgtc

SEQ ID NO: 4778302 - DNA, 18 bp, Homo sapiens
aatgcttctttcctctta

SEQ ID NO: 4778303 - DNA, 23 bp, Homo sapiens
aatgcttttctagcaactgttgg

SEQ ID NO: 4778304 - DNA, 14 bp, Homo sapiens
aatggaaaactgtt

SEQ ID NO: 4778305 - DNA, 16 bp, Homo sapiens
aatggacgtgttatga

SEQ ID NO: 4778306 - DNA, 15 bp, Homo sapiens
aatggaggtacagga

SEQ ID NO: 4778307 - DNA, 15 bp, Homo sapiens
aatggatgacaaaga

SEQ ID NO: 4778308 - DNA, 17 bp, Homo sapiens
aatggcatttagcacag

SEQ ID NO: 4778309 - DNA, 23 bp, Homo sapiens
aatggcatttagcacagtattta

SEQ ID NO: 4778310 - DNA, 22 bp, Homo sapiens
acacaaaccacaactgacacag

SEQ ID NO: 4778311 - DNA, 22 bp, Homo sapiens
acacaaagcctgtgttactgat

SEQ ID NO: 4778312 - DNA, 14 bp, Homo sapiens
acacaaagtgaaat

SEQ ID NO: 4778313 - DNA, 16 bp, Homo sapiens
acacaaagtgaaatta

SEQ ID NO: 4778314 - DNA, 19 bp, Homo sapiens
acacaaatattgcttggac

SEQ ID NO: 4778315 - DNA, 17 bp, Homo sapiens
acacaactcatccagaa

SEQ ID NO: 4778316 - DNA, 19 bp, Homo sapiens
acacaactgtggataaatt

SEQ ID NO: 4778317 - DNA, 15 bp, Homo sapiens
acacaattagatttc

SEQ ID NO: 4778318 - DNA, 15 bp, Homo sapiens
acacacaatggcaag

SEQ ID NO: 4778319 - DNA, 10 bp, Homo sapiens
acacacacac

SEQ ID NO: 4778320 - DNA, 11 bp, Homo sapiens
acacacacaca

SEQ ID NO: 4778321 - DNA, 14 bp, Homo sapiens
acacacacacacaa

SEQ ID NO: 4778322 - DNA, 14 bp, Homo sapiens
acacacacacacac

SEQ ID NO: 4778323 - DNA, 16 bp, Homo sapiens
acacacacacacacac

SEQ ID NO: 4778324 - DNA, 14 bp, Homo sapiens
acacacacacactt

SEQ ID NO: 4778325 - DNA, 11 bp, Homo sapiens
acacacacact

SEQ ID NO: 4778326 - DNA, 15 bp, Homo sapiens
acacacacccttccc

SEQ ID NO: 4778327 - DNA, 13 bp, Homo sapiens
acacacagcagct

SEQ ID NO: 4778328 - DNA, 23 bp, Homo sapiens
acacacatatacattatttctgt

SEQ ID NO: 4778329 - DNA, 15 bp, Homo sapiens
acacacatggaaggt

SEQ ID NO: 4778330 - DNA, 14 bp, Homo sapiens
acacaccacagaag

SEQ ID NO: 4778331 - DNA, 17 bp, Homo sapiens
acacaccaccacgcctg

SEQ ID NO: 4778332 - DNA, 20 bp, Homo sapiens
acacaccaccacgcctggct

SEQ ID NO: 4778333 - DNA, 12 bp, Homo sapiens
acacacccttcc

SEQ ID NO: 4778334 - DNA, 16 bp, Homo sapiens
acacacctgagaatgt

SEQ ID NO: 4778335 - DNA, 18 bp, Homo sapiens
acacacctgcctgcagag

SEQ ID NO: 4778336 - DNA, 21 bp, Homo sapiens
acacacgcgtccacatacact

SEQ ID NO: 4778337 - DNA, 19 bp, Homo sapiens
acacactactggatagtga

SEQ ID NO: 4778338 - DNA, 15 bp, Homo sapiens
acacactcaccattt

SEQ ID NO: 4778339 - DNA, 19 bp, Homo sapiens
acacagactctgtgagatt

SEQ ID NO: 4778340 - DNA, 20 bp, Homo sapiens
acacagaggacggcttcccc

SEQ ID NO: 4778341 - DNA, 14 bp, Homo sapiens
acacagattatttg

SEQ ID NO: 4778342 - DNA, 11 bp, Homo sapiens
acacagcagct

SEQ ID NO: 4778343 - DNA, 16 bp, Homo sapiens
acacagcagctccaac

SEQ ID NO: 4778344 - DNA, 16 bp, Homo sapiens
acacagcatgcattta

SEQ ID NO: 4778345 - DNA, 22 bp, Homo sapiens
acacagcatgcatttagcatga

SEQ ID NO: 4778346 - DNA, 13 bp, Homo sapiens
acacagctgcttt

SEQ ID NO: 4778347 - DNA, 18 bp, Homo sapiens
acacaggatcctggcctg

SEQ ID NO: 4778348 - DNA, 12 bp, Homo sapiens
acacaggcctgg

SEQ ID NO: 4778349 - DNA, 17 bp, Homo sapiens
acacaggcctggcccag

SEQ ID NO: 4778350 - DNA, 24 bp, Homo sapiens
acacaggcctggcccagccagcag

SEQ ID NO: 4778351 - DNA, 13 bp, Homo sapiens
acacaggctgccg

SEQ ID NO: 4778352 - DNA, 20 bp, Homo sapiens
acacagtatagataaatcca

SEQ ID NO: 4778353 - DNA, 20 bp, Homo sapiens
acacagtgggaactctgaca

SEQ ID NO: 4778354 - DNA, 12 bp, Homo sapiens
acacataaatat

SEQ ID NO: 4778355 - DNA, 18 bp, Homo sapiens
acacatagattaatggca

SEQ ID NO: 4778356 - DNA, 22 bp, Homo sapiens
acacatagattaatggcactga

SEQ ID NO: 4778357 - DNA, 13 bp, Homo sapiens
acacatagattca

SEQ ID NO: 4778358 - DNA, 17 bp, Homo sapiens
acacatagattcacctg

SEQ ID NO: 4778359 - DNA, 22 bp, Homo sapiens
acacatagattcacctgtaaaa

SEQ ID NO: 4778360 - DNA, 15 bp, Homo sapiens
acacatataaacaca

SEQ ID NO: 4778361 - DNA, 12 bp, Homo sapiens
acacatatacat

SEQ ID NO: 4778362 - DNA, 21 bp, Homo sapiens
acacatatacattatttctgt

SEQ ID NO: 4778363 - DNA, 20 bp, Homo sapiens
acacatatgaacgcacaaca

SEQ ID NO: 4778364 - DNA, 20 bp, Homo sapiens
acacatcataaacaaagagt

SEQ ID NO: 4778365 - DNA, 13 bp, Homo sapiens
acacattatcttc

SEQ ID NO: 4778366 - DNA, 18 bp, Homo sapiens
acacattgaaactgtatt

SEQ ID NO: 4778367 - DNA, 22 bp, Homo sapiens
acacattgaaactgtatttact

SEQ ID NO: 4778368 - DNA, 21 bp, Homo sapiens
acacatttcctttaccctcca

SEQ ID NO: 4778369 - DNA, 19 bp, Homo sapiens
acaccaaatagcttttcac

SEQ ID NO: 4778370 - DNA, 16 bp, Homo sapiens
acaccaaattgctgag

SEQ ID NO: 4778371 - DNA, 13 bp, Homo sapiens
acaccaagtaaat

SEQ ID NO: 4778372 - DNA, 22 bp, Homo sapiens
acaccaagtaaatctatctcta

SEQ ID NO: 4778373 - DNA, 16 bp, Homo sapiens
acaccaccactgtgtc

SEQ ID NO: 4778374 - DNA, 19 bp, Homo sapiens
acaccagagtgtatgcata

SEQ ID NO: 4778375 - DNA, 18 bp, Homo sapiens
acaccccgtctgcccctt

SEQ ID NO: 4778376 - DNA, 17 bp, Homo sapiens
acacccttccccactcc

SEQ ID NO: 4778377 - DNA, 17 bp, Homo sapiens
acaccgcaccgggctgg

SEQ ID NO: 4778378 - DNA, 18 bp, Homo sapiens
acaccgcaccgggctggc

SEQ ID NO: 4778379 - DNA, 15 bp, Homo sapiens
acacctaaattaaca

SEQ ID NO: 4778380 - DNA, 21 bp, Homo sapiens
acacctagactctaaaactat

SEQ ID NO: 4778381 - DNA, 12 bp, Homo sapiens
acacctccaccc

SEQ ID NO: 4778382 - DNA, 15 bp, Homo sapiens
acacctcccttcatc

SEQ ID NO: 4778383 - DNA, 13 bp, Homo sapiens
acacctgagaatg

SEQ ID NO: 4778384 - DNA, 17 bp, Homo sapiens
acacctgccgctgcttg

SEQ ID NO: 4778385 - DNA, 19 bp, Homo sapiens
acacctgccgctgcttgag

SEQ ID NO: 4778386 - DNA, 17 bp, Homo sapiens
acaccttacaaagccag

SEQ ID NO: 4778387 - DNA, 18 bp, Homo sapiens
acaccttacaaagccagc

SEQ ID NO: 4778388 - DNA, 17 bp, Homo sapiens
acacgccggggctggcc

SEQ ID NO: 4778389 - DNA, 20 bp, Homo sapiens
acacgccggggctggccctg

SEQ ID NO: 4778390 - DNA, 17 bp, Homo sapiens
acacgcgtccacataca

SEQ ID NO: 4778391 - DNA, 23 bp, Homo sapiens
acacgtgcaatttgtttgtgctt

SEQ ID NO: 4778392 - DNA, 17 bp, Homo sapiens
acacgtttcaacctctc

SEQ ID NO: 4778393 - DNA, 15 bp, Homo sapiens
acactagccaaggaa

SEQ ID NO: 4778394 - DNA, 16 bp, Homo sapiens
acactcatcaggtaaa

SEQ ID NO: 4778395 - DNA, 14 bp, Homo sapiens
acactcgtgtgcat

SEQ ID NO: 4778396 - DNA, 16 bp, Homo sapiens
acactcgtgtgcatga

SEQ ID NO: 4778397 - DNA, 16 bp, Homo sapiens
acactctaactgtata

SEQ ID NO: 4778398 - DNA, 22 bp, Homo sapiens
acactctcttcttactgtattt

SEQ ID NO: 4778399 - DNA, 14 bp, Homo sapiens
acactgaaatccaa

SEQ ID NO: 4778400 - DNA, 23 bp, Homo sapiens
acactgaccttggagagacacag

SEQ ID NO: 4778401 - DNA, 23 bp, Homo sapiens
acactgatgggtcctgctgctcg

SEQ ID NO: 4778402 - DNA, 14 bp, Homo sapiens
acactggaatccag

SEQ ID NO: 4778403 - DNA, 15 bp, Homo sapiens
acactggccggccca

SEQ ID NO: 4778404 - DNA, 22 bp, Homo sapiens
acactggctttgggtagtgcca

SEQ ID NO: 4778405 - DNA, 13 bp, Homo sapiens
acactgtcaagat

SEQ ID NO: 4778406 - DNA, 16 bp, Homo sapiens
acactgtctgctgccc

SEQ ID NO: 4778407 - DNA, 14 bp, Homo sapiens
acacttctccttaa

SEQ ID NO: 4778408 - DNA, 21 bp, Homo sapiens
acacttgcagagctgctggag

SEQ ID NO: 4778409 - DNA, 18 bp, Homo sapiens
acacttttcatatcattt

SEQ ID NO: 4778410 - DNA, 18 bp, Homo sapiens
acagaaaaaaataaaaac

SEQ ID NO: 4778411 - DNA, 21 bp, Homo sapiens
acagaaaaatgaaatttaagc

SEQ ID NO: 4778412 - DNA, 23 bp, Homo sapiens
acagaaacacggagtttccattt

SEQ ID NO: 4778413 - DNA, 17 bp, Homo sapiens
acagacccctgggggag

SEQ ID NO: 4778414 - DNA, 19 bp, Homo sapiens
acagacccctgggggaggc

SEQ ID NO: 4778415 - DNA, 16 bp, Homo sapiens
acagacctaagaaata

SEQ ID NO: 4778416 - DNA, 21 bp, Homo sapiens
acagacctcactgctttgtag

SEQ ID NO: 4778417 - DNA, 20 bp, Homo sapiens
acagacggacgggacagcgg

SEQ ID NO: 4778418 - DNA, 22 bp, Homo sapiens
acagacggacgggacagcggcc

SEQ ID NO: 4778419 - DNA, 19 bp, Homo sapiens
acagactctgtgagattct

SEQ ID NO: 4778420 - DNA, 19 bp, Homo sapiens
acagactgccttatattat

SEQ ID NO: 4778421 - DNA, 18 bp, Homo sapiens
acagactgctgtcttact

SEQ ID NO: 4778422 - DNA, 14 bp, Homo sapiens
acagagcctgtttt

SEQ ID NO: 4778423 - DNA, 15 bp, Homo sapiens
acagagcctgtttta

SEQ ID NO: 4778424 - DNA, 14 bp, Homo sapiens
acagagtatatatg

SEQ ID NO: 4778425 - DNA, 17 bp, Homo sapiens
acagagtatatatgtac

SEQ ID NO: 4778426 - DNA, 16 bp, Homo sapiens
acagagtggactcttc

SEQ ID NO: 4778427 - DNA, 15 bp, Homo sapiens
acagagtggatctgg

SEQ ID NO: 4778428 - DNA, 18 bp, Homo sapiens
acagagtggatctggagt

SEQ ID NO: 4778429 - DNA, 20 bp, Homo sapiens
acagagtggatctggagtct

SEQ ID NO: 4778430 - DNA, 13 bp, Homo sapiens
acagatatcgaga

SEQ ID NO: 4778431 - DNA, 19 bp, Homo sapiens
acagatattttcgcccacc

SEQ ID NO: 4778432 - DNA, 18 bp, Homo sapiens
acatatggaaatcctgtt

SEQ ID NO: 4778433 - DNA, 13 bp, Homo sapiens
acatatgtatgtg

SEQ ID NO: 4778434 - DNA, 14 bp, Homo sapiens
acatatgtatgtgt

SEQ ID NO: 4778435 - DNA, 22 bp, Homo sapiens
acatatgtatgtgtgagtgtat

SEQ ID NO: 4778436 - DNA, 18 bp, Homo sapiens
acatattcaaagtatata

SEQ ID NO: 4778437 - DNA, 22 bp, Homo sapiens
acatattcccatggtagactgt

SEQ ID NO: 4778438 - DNA, 14 bp, Homo sapiens
acatcaaagactcc

SEQ ID NO: 4778439 - DNA, 19 bp, Homo sapiens
acatcaattgggttttgat

SEQ ID NO: 4778440 - DNA, 14 bp, Homo sapiens
acatcagcactgcc

SEQ ID NO: 4778441 - DNA, 21 bp, Homo sapiens
acatccacatgcacatgtatt

SEQ ID NO: 4778442 - DNA, 23 bp, Homo sapiens
acatccccaccctcccctctcct

SEQ ID NO: 4778443 - DNA, 18 bp, Homo sapiens
acatctctgtaaaaagca

SEQ ID NO: 4778444 - DNA, 23 bp, Homo sapiens
acatctctgtaaaaagcaggtga

SEQ ID NO: 4778445 - DNA, 14 bp, Homo sapiens
acatctgatttctg

SEQ ID NO: 4778446 - DNA, 12 bp, Homo sapiens
acatctgtatat

SEQ ID NO: 4778447 - DNA, 13 bp, Homo sapiens
acatctgtcagtg

SEQ ID NO: 4778448 - DNA, 16 bp, Homo sapiens
acatctgtcagtgagt

SEQ ID NO: 4778449 - DNA, 12 bp, Homo sapiens
acatcttgtgca

SEQ ID NO: 4778450 - DNA, 18 bp, Homo sapiens
acatcttgtgcatgcaaa

SEQ ID NO: 4778451 - DNA, 22 bp, Homo sapiens
acatcttgtgcatgcaaaaatg

SEQ ID NO: 4778452 - DNA, 13 bp, Homo sapiens
acatgacactgac

SEQ ID NO: 4778453 - DNA, 14 bp, Homo sapiens
acatgacactgacc

SEQ ID NO: 4778454 - DNA, 22 bp, Homo sapiens
acatgacagtggttatatttca

SEQ ID NO: 4778455 - DNA, 15 bp, Homo sapiens
acatgacatccacat

SEQ ID NO: 4778456 - DNA, 21 bp, Homo sapiens
acatgacatccacatgcacat

SEQ ID NO: 4778457 - DNA, 19 bp, Homo sapiens
acatgagagtagggccctg

SEQ ID NO: 4778458 - DNA, 19 bp, Homo sapiens
acatgcactgacccttcca

SEQ ID NO: 4778459 - DNA, 16 bp, Homo sapiens
acatgcatgagcacct

SEQ ID NO: 4778460 - DNA, 14 bp, Homo sapiens
acatgcctttccag

SEQ ID NO: 4778461 - DNA, 15 bp, Homo sapiens
acatgcgctcctggc

SEQ ID NO: 4778462 - DNA, 18 bp, Homo sapiens
acatgcgctcctggcttt

SEQ ID NO: 4778463 - DNA, 16 bp, Homo sapiens
acatgctggccagcct

SEQ ID NO: 4778464 - DNA, 19 bp, Homo sapiens
acatggattcagtttctaa

SEQ ID NO: 4778465 - DNA, 16 bp, Homo sapiens
acatggccgctgccca

SEQ ID NO: 4778466 - DNA, 20 bp, Homo sapiens
acatggttacctctgcataa

SEQ ID NO: 4778467 - DNA, 15 bp, Homo sapiens
acatgtatagtgagt

SEQ ID NO: 4778468 - DNA, 19 bp, Homo sapiens
acatgtattctgttggcca

SEQ ID NO: 4778469 - DNA, 23 bp, Homo sapiens
acatgtgctcgctctgcatgatt

SEQ ID NO: 4778470 - DNA, 12 bp, Homo sapiens
acatgtttcaga

SEQ ID NO: 4778471 - DNA, 14 bp, Homo sapiens
acatgttttacaaa

SEQ ID NO: 4778472 - DNA, 15 bp, Homo sapiens
acatgttttacaaag

SEQ ID NO: 4778473 - DNA, 20 bp, Homo sapiens
acatgttttacaaagaaaca

SEQ ID NO: 4778474 - DNA, 22 bp, Homo sapiens
acattaatccacatgtttcaga

SEQ ID NO: 4778475 - DNA, 15 bp, Homo sapiens
acattagacacacat

SEQ ID NO: 4778476 - DNA, 20 bp, Homo sapiens
acattagacacacatataca

SEQ ID NO: 4778477 - DNA, 18 bp, Homo sapiens
acattaggaacagagtat

SEQ ID NO: 4778478 - DNA, 19 bp, Homo sapiens
acattaggcattgagactt

SEQ ID NO: 4778479 - DNA, 14 bp, Homo sapiens
acattatcttctgg

SEQ ID NO: 4778480 - DNA, 21 bp, Homo sapiens
acattattggacttccatttg

SEQ ID NO: 4778481 - DNA, 12 bp, Homo sapiens
acattatttctg

SEQ ID NO: 4778482 - DNA, 15 bp, Homo sapiens
acattatttctgtat

SEQ ID NO: 4778483 - DNA, 16 bp, Homo sapiens
acattatttctgtata

SEQ ID NO: 4778484 - DNA, 21 bp, Homo sapiens
acattatttctgtatatagat

SEQ ID NO: 4778485 - DNA, 14 bp, Homo sapiens
acattcatcctcac

SEQ ID NO: 4778486 - DNA, 18 bp, Homo sapiens
acattcatcctcacatgt

SEQ ID NO: 4778487 - DNA, 11 bp, Homo sapiens
acattcctgac

SEQ ID NO: 4778488 - DNA, 16 bp, Homo sapiens
acattgaaactgtatt

SEQ ID NO: 4778489 - DNA, 16 bp, Homo sapiens
acattgaaatacttga

SEQ ID NO: 4778490 - DNA, 18 bp, Homo sapiens
acattgaaatacttgaaa

SEQ ID NO: 4778491 - DNA, 14 bp, Homo sapiens
acattgccttatat

SEQ ID NO: 4778492 - DNA, 15 bp, Homo sapiens
acattgcttcattaa

SEQ ID NO: 4778493 - DNA, 14 bp, Homo sapiens
acattgtagcctaa

SEQ ID NO: 4778494 - DNA, 22 bp, Homo sapiens
acattgtagcctaatattcatg

SEQ ID NO: 4778495 - DNA, 13 bp, Homo sapiens
acattgtcagaat

SEQ ID NO: 4778496 - DNA, 14 bp, Homo sapiens
acattgtcagaatg

SEQ ID NO: 4778497 - DNA, 15 bp, Homo sapiens
acattgtcagaatgt

SEQ ID NO: 4778498 - DNA, 18 bp, Homo sapiens
acattgtcagaatgttgt

SEQ ID NO: 4778499 - DNA, 23 bp, Homo sapiens
acattgtccccaatgaatatact

SEQ ID NO: 4778500 - DNA, 22 bp, Homo sapiens
acattgtgttaacttatgtctc

SEQ ID NO: 4778501 - DNA, 21 bp, Homo sapiens
acatttcctttaccctccaca

SEQ ID NO: 4778502 - DNA, 20 bp, Homo sapiens
acatttctggccatttaact

SEQ ID NO: 4778503 - DNA, 22 bp, Homo sapiens
acatttgggagactgagcttga

SEQ ID NO: 4778504 - DNA, 22 bp, Homo sapiens
acatttgttctgggttaacagt

SEQ ID NO: 4778505 - DNA, 14 bp, Homo sapiens
acattttcaagaca

SEQ ID NO: 4778506 - DNA, 16 bp, Homo sapiens
acattttgtagctagt

SEQ ID NO: 4778507 - DNA, 13 bp, Homo sapiens
accaaagatgcag

SEQ ID NO: 4778508 - DNA, 13 bp, Homo sapiens
accaaatgtaaaa

SEQ ID NO: 4778509 - DNA, 20 bp, Homo sapiens
accaaatgtaaaatatttat

SEQ ID NO: 4778510 - DNA, 23 bp, Homo sapiens
accaaatgtaaaatatttataaa

SEQ ID NO: 4778511 - DNA, 16 bp, Homo sapiens
accaacaacagtcagc

SEQ ID NO: 4778512 - DNA, 23 bp, Homo sapiens
accaacgggtctgtgggactggc

SEQ ID NO: 4778513 - DNA, 15 bp, Homo sapiens
accaactaagttgta

SEQ ID NO: 4778514 - DNA, 17 bp, Homo sapiens
accaagaaaaccagtgg

SEQ ID NO: 4778515 - DNA, 20 bp, Homo sapiens
accaaggtgcggaccggagc

SEQ ID NO: 4778516 - DNA, 23 bp, Homo sapiens
accaagtaaatctatctctatat

SEQ ID NO: 4778517 - DNA, 13 bp, Homo sapiens
accaatctctgtg

SEQ ID NO: 4778518 - DNA, 14 bp, Homo sapiens
accaatctctgtga

SEQ ID NO: 4778519 - DNA, 16 bp, Homo sapiens
accaatctctgtgact

SEQ ID NO: 4778520 - DNA, 20 bp, Homo sapiens
accaattgtgagaattactg

SEQ ID NO: 4778521 - DNA, 15 bp, Homo sapiens
accaattgtttcttg

SEQ ID NO: 4778522 - DNA, 15 bp, Homo sapiens
accaatttgttctgt

SEQ ID NO: 4778523 - DNA, 20 bp, Homo sapiens
accacaactaacaatgcctt

SEQ ID NO: 4778524 - DNA, 19 bp, Homo sapiens
accacaactgacacaggaa

SEQ ID NO: 4778525 - DNA, 13 bp, Homo sapiens
accacacacaccc

SEQ ID NO: 4778526 - DNA, 18 bp, Homo sapiens
accacacacacccttccc

SEQ ID NO: 4778527 - DNA, 19 bp, Homo sapiens
accacacacacccttcccc

SEQ ID NO: 4778528 - DNA, 15 bp, Homo sapiens
accacacctaaatta

SEQ ID NO: 4778529 - DNA, 22 bp, Homo sapiens
accacagaagcttgtattatca

SEQ ID NO: 4778530 - DNA, 12 bp, Homo sapiens
accacagctgcc

SEQ ID NO: 4778531 - DNA, 19 bp, Homo sapiens
accacagctgcctccgggc

SEQ ID NO: 4778532 - DNA, 17 bp, Homo sapiens
accaccactgtgtccca

SEQ ID NO: 4778533 - DNA, 13 bp, Homo sapiens
accaccatttccc

SEQ ID NO: 4778534 - DNA, 21 bp, Homo sapiens
accaccctcgctgccacccac

SEQ ID NO: 4778535 - DNA, 13 bp, Homo sapiens
accaccctgccaa

SEQ ID NO: 4778536 - DNA, 15 bp, Homo sapiens
accaccgcgcccctc

SEQ ID NO: 4778537 - DNA, 23 bp, Homo sapiens
accaccgcgcccctctgcgcccc

SEQ ID NO: 4778538 - DNA, 16 bp, Homo sapiens
accacgacctcgtcca

SEQ ID NO: 4778539 - DNA, 13 bp, Homo sapiens
accacgcccctgc

SEQ ID NO: 4778540 - DNA, 20 bp, Homo sapiens
accacgcctggctaattttt

SEQ ID NO: 4778541 - DNA, 15 bp, Homo sapiens
accactctcaggacc

SEQ ID NO: 4778542 - DNA, 17 bp, Homo sapiens
accactctcaggaccac

SEQ ID NO: 4778543 - DNA, 17 bp, Homo sapiens
accactgacagcctcca

SEQ ID NO: 4778544 - DNA, 17 bp, Homo sapiens
accactgggatcagctg

SEQ ID NO: 4778545 - DNA, 16 bp, Homo sapiens
accactgggcctgcta

SEQ ID NO: 4778546 - DNA, 12 bp, Homo sapiens
accactgtgtcc

SEQ ID NO: 4778547 - DNA, 13 bp, Homo sapiens
accacttccttaa

SEQ ID NO: 4778548 - DNA, 14 bp, Homo sapiens
accacttccttaac

SEQ ID NO: 4778549 - DNA, 15 bp, Homo sapiens
accacttccttaaca

SEQ ID NO: 4778550 - DNA, 17 bp, Homo sapiens
accacttccttaacagc

SEQ ID NO: 4778551 - DNA, 13 bp, Homo sapiens
accacttgctgca

SEQ ID NO: 4778552 - DNA, 17 bp, Homo sapiens
accagaatgaggcacat

SEQ ID NO: 4778553 - DNA, 13 bp, Homo sapiens
accagactgcagg

SEQ ID NO: 4778554 - DNA, 13 bp, Homo sapiens
accagagagaaag

SEQ ID NO: 4778555 - DNA, 20 bp, Homo sapiens
acctggcagatgggggcctc

SEQ ID NO: 4778556 - DNA, 16 bp, Homo sapiens
acctggcttcccagga

SEQ ID NO: 4778557 - DNA, 19 bp, Homo sapiens
acctggcttcccaggaccc

SEQ ID NO: 4778558 - DNA, 14 bp, Homo sapiens
acctggtggccctg

SEQ ID NO: 4778559 - DNA, 14 bp, Homo sapiens
acctgtaaaacttt

SEQ ID NO: 4778560 - DNA, 22 bp, Homo sapiens
acctgtaaaactttattttata

SEQ ID NO: 4778561 - DNA, 12 bp, Homo sapiens
acctgtgctttc

SEQ ID NO: 4778562 - DNA, 22 bp, Homo sapiens
acctgtgctttcatgtttaaga

SEQ ID NO: 4778563 - DNA, 11 bp, Homo sapiens
acctgtgtctc

SEQ ID NO: 4778564 - DNA, 16 bp, Homo sapiens
acctgttcctgactgt

SEQ ID NO: 4778565 - DNA, 19 bp, Homo sapiens
acctgttcctgactgttct

SEQ ID NO: 4778566 - DNA, 20 bp, Homo sapiens
acctgttcctgactgttctc

SEQ ID NO: 4778567 - DNA, 19 bp, Homo sapiens
accttaaattaaacaattt

SEQ ID NO: 4778568 - DNA, 14 bp, Homo sapiens
accttatagagcac

SEQ ID NO: 4778569 - DNA, 21 bp, Homo sapiens
accttcaacatgtgctcgctc

SEQ ID NO: 4778570 - DNA, 14 bp, Homo sapiens
accttcccagctgc

SEQ ID NO: 4778571 - DNA, 17 bp, Homo sapiens
accttcccatgcaggct

SEQ ID NO: 4778572 - DNA, 22 bp, Homo sapiens
accttcctgggcagcccagaga

SEQ ID NO: 4778573 - DNA, 13 bp, Homo sapiens
accttccttgaaa

SEQ ID NO: 4778574 - DNA, 17 bp, Homo sapiens
accttctgaagatctca

SEQ ID NO: 4778575 - DNA, 13 bp, Homo sapiens
accttctgccaag

SEQ ID NO: 4778576 - DNA, 16 bp, Homo sapiens
accttctgccaaggcc

SEQ ID NO: 4778577 - DNA, 21 bp, Homo sapiens
accttcttttcaatgcaatgc

SEQ ID NO: 4778578 - DNA, 13 bp, Homo sapiens
accttgagcacta

SEQ ID NO: 4778579 - DNA, 14 bp, Homo sapiens
accttgatggggtg

SEQ ID NO: 4778580 - DNA, 12 bp, Homo sapiens
accttgcttcct

SEQ ID NO: 4778581 - DNA, 13 bp, Homo sapiens
accttgcttcctt

SEQ ID NO: 4778582 - DNA, 14 bp, Homo sapiens
accttgcttccttc

SEQ ID NO: 4778583 - DNA, 17 bp, Homo sapiens
acctttagaatattaaa

SEQ ID NO: 4778584 - DNA, 20 bp, Homo sapiens
acctttatttattaaacttc

SEQ ID NO: 4778585 - DNA, 18 bp, Homo sapiens
acctttcatgtgcctgaa

SEQ ID NO: 4778586 - DNA, 19 bp, Homo sapiens
accttttaaaaaaataata

SEQ ID NO: 4778587 - DNA, 14 bp, Homo sapiens
accttttgagtgcc

SEQ ID NO: 4778588 - DNA, 20 bp, Homo sapiens
accttttgagtgccttacac

SEQ ID NO: 4778589 - DNA, 16 bp, Homo sapiens
acctttttaatccagg

SEQ ID NO: 4778590 - DNA, 16 bp, Homo sapiens
acctttttatttcaaa

SEQ ID NO: 4778591 - DNA, 14 bp, Homo sapiens
acgaacatggcatg

SEQ ID NO: 4778592 - DNA, 15 bp, Homo sapiens
acgacataagctggt

SEQ ID NO: 4778593 - DNA, 15 bp, Homo sapiens
acgaccgacgcccct

SEQ ID NO: 4778594 - DNA, 16 bp, Homo sapiens
acgactttctttaaca

SEQ ID NO: 4778595 - DNA, 17 bp, Homo sapiens
acgagcagagcgcagcc

SEQ ID NO: 4778596 - DNA, 22 bp, Homo sapiens
acgagcagagcgcagcccccac

SEQ ID NO: 4778597 - DNA, 18 bp, Homo sapiens
acgagtgagctaccagga

SEQ ID NO: 4778598 - DNA, 14 bp, Homo sapiens
acgatccttcaaag

SEQ ID NO: 4778599 - DNA, 16 bp, Homo sapiens
acgatccttcaaagtc

SEQ ID NO: 4778600 - DNA, 12 bp, Homo sapiens
acgattccagtg

SEQ ID NO: 4778601 - DNA, 22 bp, Homo sapiens
acgattcttaccctttcttttg

SEQ ID NO: 4778602 - DNA, 13 bp, Homo sapiens
acgatttaattta

SEQ ID NO: 4778603 - DNA, 18 bp, Homo sapiens
acgcaaaaccactttcct

SEQ ID NO: 4778604 - DNA, 21 bp, Homo sapiens
acgcacacacacgcaaataca

SEQ ID NO: 4778605 - DNA, 19 bp, Homo sapiens
acgcagagccccggagcac

SEQ ID NO: 4778606 - DNA, 20 bp, Homo sapiens
acgcagagccccggagcacc

SEQ ID NO: 4778607 - DNA, 15 bp, Homo sapiens
acgcatgcagggccc

SEQ ID NO: 4778608 - DNA, 16 bp, Homo sapiens
acgcatgcagggcccc

SEQ ID NO: 4778609 - DNA, 18 bp, Homo sapiens
acgcccagcccccacccc

SEQ ID NO: 4778610 - DNA, 21 bp, Homo sapiens
acgcccctccgggcagagacc

SEQ ID NO: 4778611 - DNA, 18 bp, Homo sapiens
acgccgatataagccata

SEQ ID NO: 4778612 - DNA, 23 bp, Homo sapiens
acgccgatataagccatagcccc

SEQ ID NO: 4778613 - DNA, 17 bp, Homo sapiens
acgccggggctggccct

SEQ ID NO: 4778614 - DNA, 21 bp, Homo sapiens
acgccggggctggccctgccc

SEQ ID NO: 4778615 - DNA, 12 bp, Homo sapiens
acgcctcctggc

SEQ ID NO: 4778616 - DNA, 13 bp, Homo sapiens
acgcctcctggcc

SEQ ID NO: 4778617 - DNA, 16 bp, Homo sapiens
acgcctcctggccaga

SEQ ID NO: 4778618 - DNA, 19 bp, Homo sapiens
acgcggccgctctccgccc

SEQ ID NO: 4778619 - DNA, 13 bp, Homo sapiens
acgcgtccacata

SEQ ID NO: 4778620 - DNA, 16 bp, Homo sapiens
acgcgtccacatacac

SEQ ID NO: 4778621 - DNA, 13 bp, Homo sapiens
acgctgaatgaga

SEQ ID NO: 4778622 - DNA, 11 bp, Homo sapiens
acgctgctcca

SEQ ID NO: 4778623 - DNA, 19 bp, Homo sapiens
acgctggagaccctgcgcc

SEQ ID NO: 4778624 - DNA, 12 bp, Homo sapiens
acgctttcatga

SEQ ID NO: 4778625 - DNA, 13 bp, Homo sapiens
acgctttcatgac

SEQ ID NO: 4778626 - DNA, 14 bp, Homo sapiens
acggacgggacagc

SEQ ID NO: 4778627 - DNA, 23 bp, Homo sapiens
acggcagtaaatccacagtgagt

SEQ ID NO: 4778628 - DNA, 13 bp, Homo sapiens
acggccctgcaat

SEQ ID NO: 4778629 - DNA, 18 bp, Homo sapiens
acggctaagaggctgctg

SEQ ID NO: 4778630 - DNA, 21 bp, Homo sapiens
acgggacagcggcccggccca

SEQ ID NO: 4778631 - DNA, 12 bp, Homo sapiens
acgggagagcgc

SEQ ID NO: 4778632 - DNA, 13 bp, Homo sapiens
acgggagagcgcc

SEQ ID NO: 4778633 - DNA, 19 bp, Homo sapiens
acgggagagcgccacccgc

SEQ ID NO: 4778634 - DNA, 20 bp, Homo sapiens
acgggagggtaaggctgtgg

SEQ ID NO: 4778635 - DNA, 15 bp, Homo sapiens
acggggactcagccc

SEQ ID NO: 4778636 - DNA, 13 bp, Homo sapiens
acggggggctgcg

SEQ ID NO: 4778637 - DNA, 14 bp, Homo sapiens
acggtattatgctt

SEQ ID NO: 4778638 - DNA, 17 bp, Homo sapiens
acggtattatgcttctt

SEQ ID NO: 4778639 - DNA, 20 bp, Homo sapiens
acggtattatgcttcttgga

SEQ ID NO: 4778640 - DNA, 17 bp, Homo sapiens
acggtccaatccagcct

SEQ ID NO: 4778641 - DNA, 16 bp, Homo sapiens
acggtgagactctgag

SEQ ID NO: 4778642 - DNA, 22 bp, Homo sapiens
acgtagcaaatcgtacattgtg

SEQ ID NO: 4778643 - DNA, 18 bp, Homo sapiens
acgtcatcggaggctggg

SEQ ID NO: 4778644 - DNA, 21 bp, Homo sapiens
acgtcatcggaggctgggccc

SEQ ID NO: 4778645 - DNA, 19 bp, Homo sapiens
acgtctaacttcatgctgt

SEQ ID NO: 4778646 - DNA, 16 bp, Homo sapiens
acgtctgtgagtctgt

SEQ ID NO: 4778647 - DNA, 17 bp, Homo sapiens
acgtgaccctgtgcccc

SEQ ID NO: 4778648 - DNA, 11 bp, Homo sapiens
acgtgagtcct

SEQ ID NO: 4778649 - DNA, 15 bp, Homo sapiens
acgtgcaacagactg

SEQ ID NO: 4778650 - DNA, 14 bp, Homo sapiens
acgtgcaatttgtt

SEQ ID NO: 4778651 - DNA, 20 bp, Homo sapiens
acgtgcaatttgtttgtgct

SEQ ID NO: 4778652 - DNA, 17 bp, Homo sapiens
acgtgcccatttcacac

SEQ ID NO: 4778653 - DNA, 18 bp, Homo sapiens
acgtgcccatttcacaca

SEQ ID NO: 4778654 - DNA, 16 bp, Homo sapiens
acgtggccgctgccca

SEQ ID NO: 4778655 - DNA, 22 bp, Homo sapiens
acgtggccgctgctgtgacagg

SEQ ID NO: 4778656 - DNA, 15 bp, Homo sapiens
acgtggtgcttctca

SEQ ID NO: 4778657 - DNA, 13 bp, Homo sapiens
acgttaattaaac

SEQ ID NO: 4778658 - DNA, 12 bp, Homo sapiens
acgttcatgttc

SEQ ID NO: 4778659 - DNA, 17 bp, Homo sapiens
acgttcatgttcatctc

SEQ ID NO: 4778660 - DNA, 19 bp, Homo sapiens
acgtttttgtgctgtgggc

SEQ ID NO: 4778661 - DNA, 19 bp, Homo sapiens
actaaacttggtgcttatt

SEQ ID NO: 4778662 - DNA, 21 bp, Homo sapiens
actaaaggaaacaaagcaata

SEQ ID NO: 4778663 - DNA, 15 bp, Homo sapiens
actaacaatgccttg

SEQ ID NO: 4778664 - DNA, 21 bp, Homo sapiens
actaacaatgccttgttgtat

SEQ ID NO: 4778665 - DNA, 12 bp, Homo sapiens
actaacactggc

SEQ ID NO: 4778666 - DNA, 14 bp, Homo sapiens
actaacagtaactg

SEQ ID NO: 4778667 - DNA, 14 bp, Homo sapiens
actaactgccatgt

SEQ ID NO: 4778668 - DNA, 12 bp, Homo sapiens
actaacttattt

SEQ ID NO: 4778669 - DNA, 18 bp, Homo sapiens
actaacttattttgattg

SEQ ID NO: 4778670 - DNA, 13 bp, Homo sapiens
actaataaaatac

SEQ ID NO: 4778671 - DNA, 14 bp, Homo sapiens
actaataggtctgg

SEQ ID NO: 4778672 - DNA, 14 bp, Homo sapiens
actaatcaatactt

SEQ ID NO: 4778673 - DNA, 22 bp, Homo sapiens
actaatccttaataactatggt

SEQ ID NO: 4778674 - DNA, 24 bp, Homo sapiens
actaatggccaagtgtacatttga

SEQ ID NO: 4778675 - DNA, 15 bp, Homo sapiens
actaatgtaaatatt

SEQ ID NO: 4778676 - DNA, 15 bp, Homo sapiens
actaattaaactgat

SEQ ID NO: 4778677 - DNA, 22 bp, Homo sapiens
actacacgtttcaacctctcta

SEQ ID NO: 4778678 - DNA, 20 bp, Homo sapiens
acttctatttatttattatt

SEQ ID NO: 4778679 - DNA, 15 bp, Homo sapiens
acttctcaaatgcta

SEQ ID NO: 4778680 - DNA, 21 bp, Homo sapiens
acttctcaaatgctactcagt

SEQ ID NO: 4778681 - DNA, 14 bp, Homo sapiens
acttctccttaacc

SEQ ID NO: 4778682 - DNA, 11 bp, Homo sapiens
acttctctaga

SEQ ID NO: 4778683 - DNA, 12 bp, Homo sapiens
acttctgcagct

SEQ ID NO: 4778684 - DNA, 16 bp, Homo sapiens
acttctgctgtacaga

SEQ ID NO: 4778685 - DNA, 13 bp, Homo sapiens
acttcttctgtaa

SEQ ID NO: 4778686 - DNA, 16 bp, Homo sapiens
acttcttctgtaatat

SEQ ID NO: 4778687 - DNA, 16 bp, Homo sapiens
acttcttgtgctttac

SEQ ID NO: 4778688 - DNA, 21 bp, Homo sapiens
acttctttagtattatattaa

SEQ ID NO: 4778689 - DNA, 19 bp, Homo sapiens
acttctttttggcattatc

SEQ ID NO: 4778690 - DNA, 17 bp, Homo sapiens
acttgaaaacttctcat

SEQ ID NO: 4778691 - DNA, 23 bp, Homo sapiens
acttgagggacgactttctttaa

SEQ ID NO: 4778692 - DNA, 13 bp, Homo sapiens
acttgccactgcc

SEQ ID NO: 4778693 - DNA, 15 bp, Homo sapiens
acttgccactgccat

SEQ ID NO: 4778694 - DNA, 18 bp, Homo sapiens
acttgccactgccataac

SEQ ID NO: 4778695 - DNA, 18 bp, Homo sapiens
acttgctcctttccatca

SEQ ID NO: 4778696 - DNA, 12 bp, Homo sapiens
acttgctgtgaa

SEQ ID NO: 4778697 - DNA, 17 bp, Homo sapiens
acttgcttcttgtgttt

SEQ ID NO: 4778698 - DNA, 22 bp, Homo sapiens
acttggataggagcttccagat

SEQ ID NO: 4778699 - DNA, 15 bp, Homo sapiens
acttgggctggcacc

SEQ ID NO: 4778700 - DNA, 16 bp, Homo sapiens
acttggggaaggggcc

SEQ ID NO: 4778701 - DNA, 22 bp, Homo sapiens
acttggtgcttattgatattct

SEQ ID NO: 4778702 - DNA, 16 bp, Homo sapiens
acttgtggacactaca

SEQ ID NO: 4778703 - DNA, 23 bp, Homo sapiens
acttgtgtatgatccaagtattt

SEQ ID NO: 4778704 - DNA, 18 bp, Homo sapiens
acttgttatgttgtaata

SEQ ID NO: 4778705 - DNA, 13 bp, Homo sapiens
acttgtttgtaaa

SEQ ID NO: 4778706 - DNA, 21 bp, Homo sapiens
acttgtttgtaaaagagctgt

SEQ ID NO: 4778707 - DNA, 13 bp, Homo sapiens
actttaaattata

SEQ ID NO: 4778708 - DNA, 15 bp, Homo sapiens
actttaaattgtgga

SEQ ID NO: 4778709 - DNA, 17 bp, Homo sapiens
actttacattcttgctc

SEQ ID NO: 4778710 - DNA, 15 bp, Homo sapiens
actttacctctctgt

SEQ ID NO: 4778711 - DNA, 22 bp, Homo sapiens
actttacctctctgtcatgtgc

SEQ ID NO: 4778712 - DNA, 14 bp, Homo sapiens
actttattggtctt

SEQ ID NO: 4778713 - DNA, 23 bp, Homo sapiens
actttattttatataataaagta

SEQ ID NO: 4778714 - DNA, 16 bp, Homo sapiens
actttcactataatgt

SEQ ID NO: 4778715 - DNA, 20 bp, Homo sapiens
actttcactataatgtgaaa

SEQ ID NO: 4778716 - DNA, 22 bp, Homo sapiens
actttcagattgtatctgaact

SEQ ID NO: 4778717 - DNA, 15 bp, Homo sapiens
actttccatgacagt

SEQ ID NO: 4778718 - DNA, 12 bp, Homo sapiens
actttcctctct

SEQ ID NO: 4778719 - DNA, 23 bp, Homo sapiens
actttcgttaatcttgctgctta

SEQ ID NO: 4778720 - DNA, 14 bp, Homo sapiens
actttctacatgca

SEQ ID NO: 4778721 - DNA, 16 bp, Homo sapiens
actttctacatgcaaa

SEQ ID NO: 4778722 - DNA, 15 bp, Homo sapiens
actttctttaacata

SEQ ID NO: 4778723 - DNA, 16 bp, Homo sapiens
actttctttagtcttt

SEQ ID NO: 4778724 - DNA, 17 bp, Homo sapiens
actttgacacttttcat

SEQ ID NO: 4778725 - DNA, 22 bp, Homo sapiens
actttgacgagtcaccttccag

SEQ ID NO: 4778726 - DNA, 17 bp, Homo sapiens
actttgaggacatttat

SEQ ID NO: 4778727 - DNA, 17 bp, Homo sapiens
actttgagttaagtcta

SEQ ID NO: 4778728 - DNA, 13 bp, Homo sapiens
actttgcaggagt

SEQ ID NO: 4778729 - DNA, 13 bp, Homo sapiens
actttgcattgtc

SEQ ID NO: 4778730 - DNA, 18 bp, Homo sapiens
actttggaattctgcttc

SEQ ID NO: 4778731 - DNA, 14 bp, Homo sapiens
actttgtcacttct

SEQ ID NO: 4778732 - DNA, 13 bp, Homo sapiens
actttgtctctga

SEQ ID NO: 4778733 - DNA, 14 bp, Homo sapiens
actttgtgtctttt

SEQ ID NO: 4778734 - DNA, 19 bp, Homo sapiens
actttgtgtcttttgttct

SEQ ID NO: 4778735 - DNA, 20 bp, Homo sapiens
actttgtgtcttttgttctc

SEQ ID NO: 4778736 - DNA, 16 bp, Homo sapiens
acttttataaatgttt

SEQ ID NO: 4778737 - DNA, 15 bp, Homo sapiens
acttttattgtataa

SEQ ID NO: 4778738 - DNA, 17 bp, Homo sapiens
acttttcatatcatttc

SEQ ID NO: 4778739 - DNA, 15 bp, Homo sapiens
acttttttcctgtca

SEQ ID NO: 4778740 - DNA, 16 bp, Homo sapiens
agaaaaaaaaaatgat

SEQ ID NO: 4778741 - DNA, 17 bp, Homo sapiens
agaaaaaaaaaatgatt

SEQ ID NO: 4778742 - DNA, 16 bp, Homo sapiens
agaaaaaaaaatatgt

SEQ ID NO: 4778743 - DNA, 20 bp, Homo sapiens
agaaaaaagtgcaacttgag

SEQ ID NO: 4778744 - DNA, 19 bp, Homo sapiens
agaaaaacaatggtaacat

SEQ ID NO: 4778745 - DNA, 15 bp, Homo sapiens
agaaaaatcccagcc

SEQ ID NO: 4778746 - DNA, 19 bp, Homo sapiens
agaaaaattagatgactga

SEQ ID NO: 4778747 - DNA, 19 bp, Homo sapiens
agaaaacagaccagcatag

SEQ ID NO: 4778748 - DNA, 23 bp, Homo sapiens
agaaaacaggaaaaaaactttta

SEQ ID NO: 4778749 - DNA, 14 bp, Homo sapiens
agaaaatgctttct

SEQ ID NO: 4778750 - DNA, 15 bp, Homo sapiens
agaaaatggacgtgt

SEQ ID NO: 4778751 - DNA, 20 bp, Homo sapiens
agaaaatggacgtgttatga

SEQ ID NO: 4778752 - DNA, 23 bp, Homo sapiens
agaaaatggacgtgttatgactc

SEQ ID NO: 4778753 - DNA, 13 bp, Homo sapiens
agaaacacagcat

SEQ ID NO: 4778754 - DNA, 20 bp, Homo sapiens
agaaacacagcatgcattta

SEQ ID NO: 4778755 - DNA, 17 bp, Homo sapiens
agaaacatgacactgac

SEQ ID NO: 4778756 - DNA, 12 bp, Homo sapiens
agaaagaaaaaa

SEQ ID NO: 4778757 - DNA, 13 bp, Homo sapiens
agaaagaaaaaag

SEQ ID NO: 4778758 - DNA, 15 bp, Homo sapiens
agaaagaattagcca

SEQ ID NO: 4778759 - DNA, 15 bp, Homo sapiens
agaaagaggaataaa

SEQ ID NO: 4778760 - DNA, 17 bp, Homo sapiens
agaaaggcagagattgg

SEQ ID NO: 4778761 - DNA, 19 bp, Homo sapiens
agaaagggagaaggattct

SEQ ID NO: 4778762 - DNA, 21 bp, Homo sapiens
agaaagggcagcccctcccca

SEQ ID NO: 4778763 - DNA, 15 bp, Homo sapiens
agaaagtcatccttt

SEQ ID NO: 4778764 - DNA, 17 bp, Homo sapiens
agaaataaaccttaata

SEQ ID NO: 4778765 - DNA, 17 bp, Homo sapiens
agaaatataaaaataat

SEQ ID NO: 4778766 - DNA, 23 bp, Homo sapiens
agaaatatctgtgaaatatcatc

SEQ ID NO: 4778767 - DNA, 12 bp, Homo sapiens
agaaatcatgtt

SEQ ID NO: 4778768 - DNA, 16 bp, Homo sapiens
agaaatcccctaactg

SEQ ID NO: 4778769 - DNA, 12 bp, Homo sapiens
agaaatgagaaa

SEQ ID NO: 4778770 - DNA, 18 bp, Homo sapiens
agaaatgccagtggtgga

SEQ ID NO: 4778771 - DNA, 13 bp, Homo sapiens
agaaattctataa

SEQ ID NO: 4778772 - DNA, 22 bp, Homo sapiens
agaaattctataagagacaaag

SEQ ID NO: 4778773 - DNA, 18 bp, Homo sapiens
agaaattcttgttatggt

SEQ ID NO: 4778774 - DNA, 15 bp, Homo sapiens
agaaattgtgccaaa

SEQ ID NO: 4778775 - DNA, 18 bp, Homo sapiens
agaaattgtgccaaagat

SEQ ID NO: 4778776 - DNA, 20 bp, Homo sapiens
agaaattgtgccaaagatag

SEQ ID NO: 4778777 - DNA, 15 bp, Homo sapiens
agaaattttatctct

SEQ ID NO: 4778778 - DNA, 16 bp, Homo sapiens
agaaatttttttccag

SEQ ID NO: 4778779 - DNA, 17 bp, Homo sapiens
agaaatttttttccaga

SEQ ID NO: 4778780 - DNA, 18 bp, Homo sapiens
agaaatttttttccagaa

SEQ ID NO: 4778781 - DNA, 22 bp, Homo sapiens
agaaatttttttccagaattga

SEQ ID NO: 4778782 - DNA, 13 bp, Homo sapiens
agaacaccaagta

SEQ ID NO: 4778783 - DNA, 15 bp, Homo sapiens
agaacaccaagtaaa

SEQ ID NO: 4778784 - DNA, 16 bp, Homo sapiens
agaacaccaagtaaat

SEQ ID NO: 4778785 - DNA, 20 bp, Homo sapiens
agaacaccaagtaaatctat

SEQ ID NO: 4778786 - DNA, 20 bp, Homo sapiens
agaacagctaacaataaagt

SEQ ID NO: 4778787 - DNA, 13 bp, Homo sapiens
agaacagggatgc

SEQ ID NO: 4778788 - DNA, 21 bp, Homo sapiens
agaacatgagtttatgggaat

SEQ ID NO: 4778789 - DNA, 18 bp, Homo sapiens
agaaccaaaaagaggcta

SEQ ID NO: 4778790 - DNA, 21 bp, Homo sapiens
agaaccaaaaagaggctatgt

SEQ ID NO: 4778791 - DNA, 19 bp, Homo sapiens
agaaccagcactcccaggg

SEQ ID NO: 4778792 - DNA, 16 bp, Homo sapiens
agaacccccctcccca

SEQ ID NO: 4778793 - DNA, 22 bp, Homo sapiens
agaacctagtcttgttgttcat

SEQ ID NO: 4778794 - DNA, 19 bp, Homo sapiens
agaaccttttgagtgcctt

SEQ ID NO: 4778795 - DNA, 23 bp, Homo sapiens
agaaccttttgagtgccttacac

SEQ ID NO: 4778796 - DNA, 13 bp, Homo sapiens
agaacgggcctcc

SEQ ID NO: 4778797 - DNA, 15 bp, Homo sapiens
agaacgggcctcccc

SEQ ID NO: 4778798 - DNA, 18 bp, Homo sapiens
agaactcatgtgatttac

SEQ ID NO: 4778799 - DNA, 22 bp, Homo sapiens
agaactcctgtgtgtggaaggc

SEQ ID NO: 4778800 - DNA, 12 bp, Homo sapiens
agataagtgctc

SEQ ID NO: 4778801 - DNA, 15 bp, Homo sapiens
agataccattttgaa

SEQ ID NO: 4778802 - DNA, 19 bp, Homo sapiens
agatactttgcattgtctg

SEQ ID NO: 4778803 - DNA, 15 bp, Homo sapiens
agatagccaaggcca

SEQ ID NO: 4778804 - DNA, 14 bp, Homo sapiens
agatagctccttca

SEQ ID NO: 4778805 - DNA, 17 bp, Homo sapiens
agatatatctgaaaact

SEQ ID NO: 4778806 - DNA, 18 bp, Homo sapiens
agatatatctgaaaactg

SEQ ID NO: 4778807 - DNA, 14 bp, Homo sapiens
agatatctatggca

SEQ ID NO: 4778808 - DNA, 23 bp, Homo sapiens
agatatgagaaatataaaaataa

SEQ ID NO: 4778809 - DNA, 12 bp, Homo sapiens
agatatggtgga

SEQ ID NO: 4778810 - DNA, 21 bp, Homo sapiens
agatattaccctcagaatatt

SEQ ID NO: 4778811 - DNA, 22 bp, Homo sapiens
agatattatttatcgaaagtaa

SEQ ID NO: 4778812 - DNA, 15 bp, Homo sapiens
agatattgtattatc

SEQ ID NO: 4778813 - DNA, 23 bp, Homo sapiens
agatattgtattatcatatatgc

SEQ ID NO: 4778814 - DNA, 13 bp, Homo sapiens
agatattttgtaa

SEQ ID NO: 4778815 - DNA, 20 bp, Homo sapiens
agatattttgtaaaatgtat

SEQ ID NO: 4778816 - DNA, 15 bp, Homo sapiens
agatcaactcatgtt

SEQ ID NO: 4778817 - DNA, 19 bp, Homo sapiens
agatcaggagaaactcggg

SEQ ID NO: 4778818 - DNA, 20 bp, Homo sapiens
agatcatttttatcccgcca

SEQ ID NO: 4778819 - DNA, 14 bp, Homo sapiens
agatccatcctttt

SEQ ID NO: 4778820 - DNA, 19 bp, Homo sapiens
agatccatccttttgcttc

SEQ ID NO: 4778821 - DNA, 23 bp, Homo sapiens
agatccatcggtttatactattt

SEQ ID NO: 4778822 - DNA, 19 bp, Homo sapiens
agatccatttaaaacaagc

SEQ ID NO: 4778823 - DNA, 22 bp, Homo sapiens
agatccctcggtcagcaccgtg

SEQ ID NO: 4778824 - DNA, 20 bp, Homo sapiens
agatcctctttccccactga

SEQ ID NO: 4778825 - DNA, 12 bp, Homo sapiens
agatcctgtgat

SEQ ID NO: 4778826 - DNA, 13 bp, Homo sapiens
agatctagccagg

SEQ ID NO: 4778827 - DNA, 18 bp, Homo sapiens
agatctagccaggcctcc

SEQ ID NO: 4778828 - DNA, 17 bp, Homo sapiens
agatctcctgtgcacct

SEQ ID NO: 4778829 - DNA, 14 bp, Homo sapiens
agatctctttctaa

SEQ ID NO: 4778830 - DNA, 21 bp, Homo sapiens
agatctgaagtagtgtgagtg

SEQ ID NO: 4778831 - DNA, 21 bp, Homo sapiens
agatctgcactcctgtctctt

SEQ ID NO: 4778832 - DNA, 12 bp, Homo sapiens
agatcttgagca

SEQ ID NO: 4778833 - DNA, 20 bp, Homo sapiens
agatcttgagcaaggcaaga

SEQ ID NO: 4778834 - DNA, 17 bp, Homo sapiens
agatgactgaatttcta

SEQ ID NO: 4778835 - DNA, 24 bp, Homo sapiens
agatgactgaatttctatggcata

SEQ ID NO: 4778836 - DNA, 16 bp, Homo sapiens
agatgactggaaacaa

SEQ ID NO: 4778837 - DNA, 15 bp, Homo sapiens
agatgaggctggata

SEQ ID NO: 4778838 - DNA, 21 bp, Homo sapiens
agatgaggttgagctatgata

SEQ ID NO: 4778839 - DNA, 18 bp, Homo sapiens
agatgatttaattcttac

SEQ ID NO: 4778840 - DNA, 15 bp, Homo sapiens
agatgcatctgtggc

SEQ ID NO: 4778841 - DNA, 19 bp, Homo sapiens
agatgcattttaaatgtct

SEQ ID NO: 4778842 - DNA, 11 bp, Homo sapiens
agatgccaagg

SEQ ID NO: 4778843 - DNA, 13 bp, Homo sapiens
agatggcagagcc

SEQ ID NO: 4778844 - DNA, 15 bp, Homo sapiens
agatggcagagccat

SEQ ID NO: 4778845 - DNA, 22 bp, Homo sapiens
agatggcagagccatccaccct

SEQ ID NO: 4778846 - DNA, 19 bp, Homo sapiens
agatggcgcatagtgtgct

SEQ ID NO: 4778847 - DNA, 18 bp, Homo sapiens
agatgggcagtaaacagg

SEQ ID NO: 4778848 - DNA, 14 bp, Homo sapiens
agatggggagggcg

SEQ ID NO: 4778849 - DNA, 18 bp, Homo sapiens
agatggggagggcgcttt

SEQ ID NO: 4778850 - DNA, 23 bp, Homo sapiens
agatgggtgattatgaaatgcca

SEQ ID NO: 4778851 - DNA, 14 bp, Homo sapiens
agatgtaatacacc

SEQ ID NO: 4778852 - DNA, 16 bp, Homo sapiens
agatgtctgtgtatac

SEQ ID NO: 4778853 - DNA, 18 bp, Homo sapiens
agatgtctgtgtatacat

SEQ ID NO: 4778854 - DNA, 20 bp, Homo sapiens
agatgtctgtgtatacatat

SEQ ID NO: 4778855 - DNA, 21 bp, Homo sapiens
agatgtctgtgtatacatatg

SEQ ID NO: 4778856 - DNA, 22 bp, Homo sapiens
agatgtctgtgtatacatatgt

SEQ ID NO: 4778857 - DNA, 17 bp, Homo sapiens
agatgtttaaagaccaa

SEQ ID NO: 4778858 - DNA, 16 bp, Homo sapiens
agatgtttagtagctg

SEQ ID NO: 4778859 - DNA, 16 bp, Homo sapiens
agatgtttggcaagaa

SEQ ID NO: 4778860 - DNA, 21 bp, Homo sapiens
agatgtttggcaagaaatccc

SEQ ID NO: 4778861 - DNA, 20 bp, Homo sapiens
agattaaaattagtgagatt

SEQ ID NO: 4778862 - DNA, 20 bp, Homo sapiens
agattaagttataccagcaa

SEQ ID NO: 4778863 - DNA, 22 bp, Homo sapiens
agattaagttataccagcaaaa

SEQ ID NO: 4778864 - DNA, 23 bp, Homo sapiens
agattaagttataccagcaaaag

SEQ ID NO: 4778865 - DNA, 14 bp, Homo sapiens
agattaatggcact

SEQ ID NO: 4778866 - DNA, 15 bp, Homo sapiens
agattaattaaaatt

SEQ ID NO: 4778867 - DNA, 18 bp, Homo sapiens
agattaatttgtgtagat

SEQ ID NO: 4778868 - DNA, 12 bp, Homo sapiens
agattatttaca

SEQ ID NO: 4778869 - DNA, 14 bp, Homo sapiens
agattattttctat

SEQ ID NO: 4778870 - DNA, 15 bp, Homo sapiens
agattattttctata

SEQ ID NO: 4778871 - DNA, 17 bp, Homo sapiens
agattcaattttcttta

SEQ ID NO: 4778872 - DNA, 14 bp, Homo sapiens
agattcacctgtaa

SEQ ID NO: 4778873 - DNA, 17 bp, Homo sapiens
agattcacctgtaaaac

SEQ ID NO: 4778874 - DNA, 19 bp, Homo sapiens
agattcacctgtaaaactt

SEQ ID NO: 4778875 - DNA, 15 bp, Homo sapiens
agattcactttgaca

SEQ ID NO: 4778876 - DNA, 17 bp, Homo sapiens
agattcagactgcttca

SEQ ID NO: 4778877 - DNA, 21 bp, Homo sapiens
agattcctacttaaacaaaaa

SEQ ID NO: 4778878 - DNA, 14 bp, Homo sapiens
agattctttattag

SEQ ID NO: 4778879 - DNA, 13 bp, Homo sapiens
agattgctctggg

SEQ ID NO: 4778880 - DNA, 14 bp, Homo sapiens
agattgctgcttct

SEQ ID NO: 4778881 - DNA, 15 bp, Homo sapiens
agattggatcaagta

SEQ ID NO: 4778882 - DNA, 16 bp, Homo sapiens
agattgggggggcttg

SEQ ID NO: 4778883 - DNA, 14 bp, Homo sapiens
agattgtatctgaa

SEQ ID NO: 4778884 - DNA, 20 bp, Homo sapiens
agattgtgtaaattcctgtt

SEQ ID NO: 4778885 - DNA, 22 bp, Homo sapiens
agatttagggttctatatttac

SEQ ID NO: 4778886 - DNA, 13 bp, Homo sapiens
agatttattatga

SEQ ID NO: 4778887 - DNA, 22 bp, Homo sapiens
agatttcatccagaagtcaaca

SEQ ID NO: 4778888 - DNA, 15 bp, Homo sapiens
agatttgagctgcct

SEQ ID NO: 4778889 - DNA, 12 bp, Homo sapiens
agatttgtattt

SEQ ID NO: 4778890 - DNA, 12 bp, Homo sapiens
agatttgttcat

SEQ ID NO: 4778891 - DNA, 14 bp, Homo sapiens
agatttgttcattc

SEQ ID NO: 4778892 - DNA, 20 bp, Homo sapiens
agattttaaaacttcatctg

SEQ ID NO: 4778893 - DNA, 16 bp, Homo sapiens
agattttatgtttaaa

SEQ ID NO: 4778894 - DNA, 18 bp, Homo sapiens
agcaaaaccattgcttca

SEQ ID NO: 4778895 - DNA, 19 bp, Homo sapiens
agcaaaaccattgcttcac

SEQ ID NO: 4778896 - DNA, 15 bp, Homo sapiens
agcaaactgaaatta

SEQ ID NO: 4778897 - DNA, 22 bp, Homo sapiens
agcaaactgaaattagtgtttt

SEQ ID NO: 4778898 - DNA, 18 bp, Homo sapiens
agcaaactggttatttaa

SEQ ID NO: 4778899 - DNA, 15 bp, Homo sapiens
agcaaagttttcaga

SEQ ID NO: 4778900 - DNA, 16 bp, Homo sapiens
agcaaatatctaaata

SEQ ID NO: 4778901 - DNA, 19 bp, Homo sapiens
agcaaatctgtataaatgt

SEQ ID NO: 4778902 - DNA, 18 bp, Homo sapiens
agcaaattcttgaataaa

SEQ ID NO: 4778903 - DNA, 12 bp, Homo sapiens
agcaacaactta

SEQ ID NO: 4778904 - DNA, 13 bp, Homo sapiens
agcaacaacttac

SEQ ID NO: 4778905 - DNA, 16 bp, Homo sapiens
agcaacaacttactaa

SEQ ID NO: 4778906 - DNA, 15 bp, Homo sapiens
agcaacacctgccgt

SEQ ID NO: 4778907 - DNA, 17 bp, Homo sapiens
agcaacaggaccaggag

SEQ ID NO: 4778908 - DNA, 22 bp, Homo sapiens
agcaacccaggtgttgtccgtg

SEQ ID NO: 4778909 - DNA, 20 bp, Homo sapiens
agcaaccctacagtatataa

SEQ ID NO: 4778910 - DNA, 20 bp, Homo sapiens
agcaactgttggataataac

SEQ ID NO: 4778911 - DNA, 19 bp, Homo sapiens
agcaactttccaacttttc

SEQ ID NO: 4778912 - DNA, 18 bp, Homo sapiens
agcaaggcaagaagtggg

SEQ ID NO: 4778913 - DNA, 11 bp, Homo sapiens
agcaaggctgc

SEQ ID NO: 4778914 - DNA, 16 bp, Homo sapiens
agcaaggctgctaagt

SEQ ID NO: 4778915 - DNA, 19 bp, Homo sapiens
agcaaggctgctaagtgga

SEQ ID NO: 4778916 - DNA, 20 bp, Homo sapiens
agcaaggctgctaagtggaa

SEQ ID NO: 4778917 - DNA, 21 bp, Homo sapiens
agcaaggtttaaatttgttat

SEQ ID NO: 4778918 - DNA, 16 bp, Homo sapiens
agcaagtactttgtct

SEQ ID NO: 4778919 - DNA, 17 bp, Homo sapiens
agcaatccttaaaaaga

SEQ ID NO: 4778920 - DNA, 14 bp, Homo sapiens
agcaatcttgctgt

SEQ ID NO: 4778921 - DNA, 18 bp, Homo sapiens
agcaatcttgctgtgaaa

SEQ ID NO: 4778922 - DNA, 23 bp, Homo sapiens
agcgggagtctcctcactgccac

SEQ ID NO: 4778923 - DNA, 20 bp, Homo sapiens
agcgggcgcgggacaggact

SEQ ID NO: 4778924 - DNA, 22 bp, Homo sapiens
agcgggcgcgggacaggacttg

SEQ ID NO: 4778925 - DNA, 19 bp, Homo sapiens
agcgggggctaactggccc

SEQ ID NO: 4778926 - DNA, 20 bp, Homo sapiens
agcgggggctaactggcccc

SEQ ID NO: 4778927 - DNA, 14 bp, Homo sapiens
agcgtccttgtccc

SEQ ID NO: 4778928 - DNA, 17 bp, Homo sapiens
agcgtccttgtccccgc

SEQ ID NO: 4778929 - DNA, 12 bp, Homo sapiens
agcgtgtcctat

SEQ ID NO: 4778930 - DNA, 15 bp, Homo sapiens
agcgtgtcctatccc

SEQ ID NO: 4778931 - DNA, 17 bp, Homo sapiens
agcgttgttttgtggat

SEQ ID NO: 4778932 - DNA, 19 bp, Homo sapiens
agctaacatggaagtacta

SEQ ID NO: 4778933 - DNA, 20 bp, Homo sapiens
agctaacatggaagtactat

SEQ ID NO: 4778934 - DNA, 16 bp, Homo sapiens
agctaatttgtgaaag

SEQ ID NO: 4778935 - DNA, 17 bp, Homo sapiens
agctacaggggaggctg

SEQ ID NO: 4778936 - DNA, 16 bp, Homo sapiens
agctacatctacttaa

SEQ ID NO: 4778937 - DNA, 18 bp, Homo sapiens
agctaccaactaagttgt

SEQ ID NO: 4778938 - DNA, 16 bp, Homo sapiens
agctaccaggaagagg

SEQ ID NO: 4778939 - DNA, 13 bp, Homo sapiens
agctaccatttca

SEQ ID NO: 4778940 - DNA, 20 bp, Homo sapiens
agctaggttaataggaggac

SEQ ID NO: 4778941 - DNA, 23 bp, Homo sapiens
agctagttagagactcgcctggg

SEQ ID NO: 4778942 - DNA, 21 bp, Homo sapiens
agctagtttaaaattattaaa

SEQ ID NO: 4778943 - DNA, 22 bp, Homo sapiens
agctataaaagcccatgcttaa

SEQ ID NO: 4778944 - DNA, 12 bp, Homo sapiens
agctataaatag

SEQ ID NO: 4778945 - DNA, 16 bp, Homo sapiens
agctatcttcatgtaa

SEQ ID NO: 4778946 - DNA, 17 bp, Homo sapiens
agctatgatatgtgctt

SEQ ID NO: 4778947 - DNA, 16 bp, Homo sapiens
agctatgcacaccaaa

SEQ ID NO: 4778948 - DNA, 17 bp, Homo sapiens
agctatgctgtatctgt

SEQ ID NO: 4778949 - DNA, 22 bp, Homo sapiens
agctatgctgtatctgtgcttt

SEQ ID NO: 4778950 - DNA, 20 bp, Homo sapiens
agctattactggatctctta

SEQ ID NO: 4778951 - DNA, 15 bp, Homo sapiens
agctcaaggctgcag

SEQ ID NO: 4778952 - DNA, 17 bp, Homo sapiens
agctcacacttgggctg

SEQ ID NO: 4778953 - DNA, 22 bp, Homo sapiens
agctcacacttgggctggcacc

SEQ ID NO: 4778954 - DNA, 12 bp, Homo sapiens
agctcacagcac

SEQ ID NO: 4778955 - DNA, 19 bp, Homo sapiens
agctcaggagaaggcctgc

SEQ ID NO: 4778956 - DNA, 16 bp, Homo sapiens
agctcaggggcagctc

SEQ ID NO: 4778957 - DNA, 17 bp, Homo sapiens
agctcaggggcagctca

SEQ ID NO: 4778958 - DNA, 15 bp, Homo sapiens
agctcagtcccacag

SEQ ID NO: 4778959 - DNA, 17 bp, Homo sapiens
agctcagtcccacagcc

SEQ ID NO: 4778960 - DNA, 15 bp, Homo sapiens
agctcatagcacatg

SEQ ID NO: 4778961 - DNA, 19 bp, Homo sapiens
agctcatagcacatgtttt

SEQ ID NO: 4778962 - DNA, 23 bp, Homo sapiens
agctcatagcacatgttttacaa

SEQ ID NO: 4778963 - DNA, 22 bp, Homo sapiens
agctccaacctggaggctggac

SEQ ID NO: 4778964 - DNA, 14 bp, Homo sapiens
agctccaccctccc

SEQ ID NO: 4778965 - DNA, 15 bp, Homo sapiens
agctccaccctcccc

SEQ ID NO: 4778966 - DNA, 22 bp, Homo sapiens
agctccagtgctttatccacat

SEQ ID NO: 4778967 - DNA, 14 bp, Homo sapiens
agctccagtttctc

SEQ ID NO: 4778968 - DNA, 22 bp, Homo sapiens
agctccagtttctcttaagctg

SEQ ID NO: 4778969 - DNA, 14 bp, Homo sapiens
agctccctcccgca

SEQ ID NO: 4778970 - DNA, 13 bp, Homo sapiens
agctccctcgctg

SEQ ID NO: 4778971 - DNA, 15 bp, Homo sapiens
agctcccttgagctg

SEQ ID NO: 4778972 - DNA, 13 bp, Homo sapiens
agctccctttttg

SEQ ID NO: 4778973 - DNA, 16 bp, Homo sapiens
agctcctaagctgcca

SEQ ID NO: 4778974 - DNA, 20 bp, Homo sapiens
agctcctcgggtggggcctg

SEQ ID NO: 4778975 - DNA, 13 bp, Homo sapiens
agctccttcatgc

SEQ ID NO: 4778976 - DNA, 23 bp, Homo sapiens
agctccttggttttgcctcttta

SEQ ID NO: 4778977 - DNA, 13 bp, Homo sapiens
agctcgtgtgctt

SEQ ID NO: 4778978 - DNA, 13 bp, Homo sapiens
agctctaaagcag

SEQ ID NO: 4778979 - DNA, 13 bp, Homo sapiens
agctctccctcac

SEQ ID NO: 4778980 - DNA, 13 bp, Homo sapiens
agctctcctccag

SEQ ID NO: 4778981 - DNA, 14 bp, Homo sapiens
agctctcctccagc

SEQ ID NO: 4778982 - DNA, 19 bp, Homo sapiens
agctctcctccagccctgg

SEQ ID NO: 4778983 - DNA, 20 bp, Homo sapiens
agctctcctccagccctggg

SEQ ID NO: 4778984 - DNA, 22 bp, Homo sapiens
agctctcctccagccctgggca

SEQ ID NO: 4778985 - DNA, 21 bp, Homo sapiens
agctctcttgccgaggagcca

SEQ ID NO: 4778986 - DNA, 19 bp, Homo sapiens
agctctgaagggaggggaa

SEQ ID NO: 4778987 - DNA, 19 bp, Homo sapiens
agctctgaatgctatttgt

SEQ ID NO: 4778988 - DNA, 14 bp, Homo sapiens
agctctgagcagac

SEQ ID NO: 4778989 - DNA, 18 bp, Homo sapiens
agctctgcataagattat

SEQ ID NO: 4778990 - DNA, 21 bp, Homo sapiens
agctctggctttcgtgttttt

SEQ ID NO: 4778991 - DNA, 16 bp, Homo sapiens
agctctgtagcctggt

SEQ ID NO: 4778992 - DNA, 13 bp, Homo sapiens
agctgagctggcc

SEQ ID NO: 4778993 - DNA, 18 bp, Homo sapiens
agctgagtcggctgggca

SEQ ID NO: 4778994 - DNA, 15 bp, Homo sapiens
agctgatagtgtttc

SEQ ID NO: 4778995 - DNA, 14 bp, Homo sapiens
agctgatggagaag

SEQ ID NO: 4778996 - DNA, 19 bp, Homo sapiens
agctgatggagaaggaagg

SEQ ID NO: 4778997 - DNA, 17 bp, Homo sapiens
agctgccaaaatcgtag

SEQ ID NO: 4778998 - DNA, 14 bp, Homo sapiens
agctgccagccgag

SEQ ID NO: 4778999 - DNA, 19 bp, Homo sapiens
agctgcccaatttcacaga

SEQ ID NO: 4779000 - DNA, 20 bp, Homo sapiens
agctgcccaatttcacagag

SEQ ID NO: 4779001 - DNA, 21 bp, Homo sapiens
agctgcccaatttcacagagt

SEQ ID NO: 4779002 - DNA, 16 bp, Homo sapiens
agctgcctccgggcct

SEQ ID NO: 4779003 - DNA, 19 bp, Homo sapiens
agctgcctccgggcctcgg

SEQ ID NO: 4779004 - DNA, 20 bp, Homo sapiens
agctgcctccgggcctcggc

SEQ ID NO: 4779005 - DNA, 14 bp, Homo sapiens
agctgctctccttc

SEQ ID NO: 4779006 - DNA, 22 bp, Homo sapiens
agctgctgccgcctcaccttcc

SEQ ID NO: 4779007 - DNA, 23 bp, Homo sapiens
agctgctgccgcctcaccttcct

SEQ ID NO: 4779008 - DNA, 14 bp, Homo sapiens
agctgctgtatttg

SEQ ID NO: 4779009 - DNA, 14 bp, Homo sapiens
agctggagtgcagt

SEQ ID NO: 4779010 - DNA, 14 bp, Homo sapiens
agctggcagcgcct

SEQ ID NO: 4779011 - DNA, 19 bp, Homo sapiens
agctggcagcgcctcccgc

SEQ ID NO: 4779012 - DNA, 13 bp, Homo sapiens
agctggctgggtc

SEQ ID NO: 4779013 - DNA, 19 bp, Homo sapiens
agctggctgggtcgcccct

SEQ ID NO: 4779014 - DNA, 22 bp, Homo sapiens
agctggctgggtcgcccctcct

SEQ ID NO: 4779015 - DNA, 17 bp, Homo sapiens
agctgggcatggtacca

SEQ ID NO: 4779016 - DNA, 23 bp, Homo sapiens
agctggttttctctgatggcact

SEQ ID NO: 4779017 - DNA, 16 bp, Homo sapiens
agctgtcctctcagaa

SEQ ID NO: 4779018 - DNA, 16 bp, Homo sapiens
agctgtctgtggcttc

SEQ ID NO: 4779019 - DNA, 13 bp, Homo sapiens
agctgttcttttt

SEQ ID NO: 4779020 - DNA, 23 bp, Homo sapiens
agcttagaccgtggtgtcctctg

SEQ ID NO: 4779021 - DNA, 13 bp, Homo sapiens
agcttagtgtctc

SEQ ID NO: 4779022 - DNA, 13 bp, Homo sapiens
agcttccagatgg

SEQ ID NO: 4779023 - DNA, 15 bp, Homo sapiens
agcttcccaacaata

SEQ ID NO: 4779024 - DNA, 19 bp, Homo sapiens
agcttgaccgtgaggccag

SEQ ID NO: 4779025 - DNA, 20 bp, Homo sapiens
agcttgaccgtgaggccaga

SEQ ID NO: 4779026 - DNA, 23 bp, Homo sapiens
agcttgaccgtgaggccagagac

SEQ ID NO: 4779027 - DNA, 15 bp, Homo sapiens
agcttgggagagccc

SEQ ID NO: 4779028 - DNA, 19 bp, Homo sapiens
agcttgggagagcccctgg

SEQ ID NO: 4779029 - DNA, 22 bp, Homo sapiens
agcttgggagagcccctggggc

SEQ ID NO: 4779030 - DNA, 13 bp, Homo sapiens
agcttggtggtta

SEQ ID NO: 4779031 - DNA, 17 bp, Homo sapiens
agcttgtattatcagtg

SEQ ID NO: 4779032 - DNA, 17 bp, Homo sapiens
agcttgtttgttctagt

SEQ ID NO: 4779033 - DNA, 18 bp, Homo sapiens
agctttagagaagccata

SEQ ID NO: 4779034 - DNA, 14 bp, Homo sapiens
agctttataataaa

SEQ ID NO: 4779035 - DNA, 16 bp, Homo sapiens
agctttataataaact

SEQ ID NO: 4779036 - DNA, 19 bp, Homo sapiens
agctttcctgggtctggat

SEQ ID NO: 4779037 - DNA, 23 bp, Homo sapiens
agctttctaagctttcttacaat

SEQ ID NO: 4779038 - DNA, 14 bp, Homo sapiens
aggaaaaaaacttt

SEQ ID NO: 4779039 - DNA, 15 bp, Homo sapiens
aggaaaaaaactttt

SEQ ID NO: 4779040 - DNA, 12 bp, Homo sapiens
aggaaaagagaa

SEQ ID NO: 4779041 - DNA, 16 bp, Homo sapiens
aggaaaaggctgcagc

SEQ ID NO: 4779042 - DNA, 17 bp, Homo sapiens
aggaaaaggctgcagct

SEQ ID NO: 4779043 - DNA, 14 bp, Homo sapiens
aggaaaaggcttga

SEQ ID NO: 4779044 - DNA, 17 bp, Homo sapiens
agggaggtcaggccctg

SEQ ID NO: 4779045 - DNA, 22 bp, Homo sapiens
agggaggtcaggccctggaact

SEQ ID NO: 4779046 - DNA, 14 bp, Homo sapiens
agggatctgcttga

SEQ ID NO: 4779047 - DNA, 19 bp, Homo sapiens
agggcaaaccaggctgcag

SEQ ID NO: 4779048 - DNA, 21 bp, Homo sapiens
agggcaaatgacatgcactga

SEQ ID NO: 4779049 - DNA, 22 bp, Homo sapiens
agggcaaatgacatgcactgac

SEQ ID NO: 4779050 - DNA, 15 bp, Homo sapiens
agggcagccccgcga

SEQ ID NO: 4779051 - DNA, 21 bp, Homo sapiens
agggcagccccgcgaccaccc

SEQ ID NO: 4779052 - DNA, 14 bp, Homo sapiens
agggcagcccctcc

SEQ ID NO: 4779053 - DNA, 17 bp, Homo sapiens
agggcagcccctcccca

SEQ ID NO: 4779054 - DNA, 21 bp, Homo sapiens
agggcaggaagacttccagct

SEQ ID NO: 4779055 - DNA, 23 bp, Homo sapiens
agggcaggaagacttccagcttt

SEQ ID NO: 4779056 - DNA, 20 bp, Homo sapiens
agggcaggagctcacaccgc

SEQ ID NO: 4779057 - DNA, 20 bp, Homo sapiens
agggcagggttctagaaggg

SEQ ID NO: 4779058 - DNA, 17 bp, Homo sapiens
agggcccaaataacagt

SEQ ID NO: 4779059 - DNA, 13 bp, Homo sapiens
agggcccccactg

SEQ ID NO: 4779060 - DNA, 21 bp, Homo sapiens
agggcccccggctcggcctct

SEQ ID NO: 4779061 - DNA, 11 bp, Homo sapiens
agggccctgct

SEQ ID NO: 4779062 - DNA, 15 bp, Homo sapiens
agggccctgctcagg

SEQ ID NO: 4779063 - DNA, 22 bp, Homo sapiens
agggccctgctcaggcctcacc

SEQ ID NO: 4779064 - DNA, 15 bp, Homo sapiens
agggccctggggtct

SEQ ID NO: 4779065 - DNA, 14 bp, Homo sapiens
agggcccttcccaa

SEQ ID NO: 4779066 - DNA, 12 bp, Homo sapiens
agggcctctgga

SEQ ID NO: 4779067 - DNA, 13 bp, Homo sapiens
agggcctctggac

SEQ ID NO: 4779068 - DNA, 20 bp, Homo sapiens
agggcgcaggaaccgaggac

SEQ ID NO: 4779069 - DNA, 12 bp, Homo sapiens
agggcgcctggg

SEQ ID NO: 4779070 - DNA, 14 bp, Homo sapiens
agggcgcctgggtc

SEQ ID NO: 4779071 - DNA, 15 bp, Homo sapiens
agggcgctccggcag

SEQ ID NO: 4779072 - DNA, 18 bp, Homo sapiens
agggcgctccggcagagg

SEQ ID NO: 4779073 - DNA, 15 bp, Homo sapiens
agggcgctgagggca

SEQ ID NO: 4779074 - DNA, 18 bp, Homo sapiens
agggcggcggggcctggg

SEQ ID NO: 4779075 - DNA, 13 bp, Homo sapiens
agggctctccaag

SEQ ID NO: 4779076 - DNA, 14 bp, Homo sapiens
agggctctccaagc

SEQ ID NO: 4779077 - DNA, 18 bp, Homo sapiens
agggctctccaagcacta

SEQ ID NO: 4779078 - DNA, 16 bp, Homo sapiens
agggctgacctgcctc

SEQ ID NO: 4779079 - DNA, 12 bp, Homo sapiens
agggctgagccc

SEQ ID NO: 4779080 - DNA, 15 bp, Homo sapiens
agggctgagcccctc

SEQ ID NO: 4779081 - DNA, 22 bp, Homo sapiens
agggctgggcgcctctgtcctg

SEQ ID NO: 4779082 - DNA, 17 bp, Homo sapiens
agggcttctaccagaga

SEQ ID NO: 4779083 - DNA, 17 bp, Homo sapiens
aggggaaaacctcagtt

SEQ ID NO: 4779084 - DNA, 14 bp, Homo sapiens
aggggaaaatagta

SEQ ID NO: 4779085 - DNA, 14 bp, Homo sapiens
aggggaaagattat

SEQ ID NO: 4779086 - DNA, 13 bp, Homo sapiens
aggggaagctgca

SEQ ID NO: 4779087 - DNA, 18 bp, Homo sapiens
aggggagcaaggctgcta

SEQ ID NO: 4779088 - DNA, 11 bp, Homo sapiens
aggggaggctg

SEQ ID NO: 4779089 - DNA, 12 bp, Homo sapiens
aggggaggctga

SEQ ID NO: 4779090 - DNA, 12 bp, Homo sapiens
aggggaggtggc

SEQ ID NO: 4779091 - DNA, 16 bp, Homo sapiens
aggggaggtggccagc

SEQ ID NO: 4779092 - DNA, 22 bp, Homo sapiens
aggggatctaaaaggaggacag

SEQ ID NO: 4779093 - DNA, 15 bp, Homo sapiens
aggggcaaaaatttg

SEQ ID NO: 4779094 - DNA, 13 bp, Homo sapiens
aggggccaggaag

SEQ ID NO: 4779095 - DNA, 17 bp, Homo sapiens
aggggccaggaagggga

SEQ ID NO: 4779096 - DNA, 16 bp, Homo sapiens
aggggccctgtcactg

SEQ ID NO: 4779097 - DNA, 22 bp, Homo sapiens
aggggcgcgcgcccccaggacc

SEQ ID NO: 4779098 - DNA, 16 bp, Homo sapiens
aggggcgctcctccca

SEQ ID NO: 4779099 - DNA, 17 bp, Homo sapiens
aggggcgctcctcccag

SEQ ID NO: 4779100 - DNA, 18 bp, Homo sapiens
aggggcgctcctcccagc

SEQ ID NO: 4779101 - DNA, 23 bp, Homo sapiens
aggggcgctgcccccacagatcc

SEQ ID NO: 4779102 - DNA, 16 bp, Homo sapiens
aggggctgcatcctca

SEQ ID NO: 4779103 - DNA, 22 bp, Homo sapiens
aggggctgcatcctcagcccca

SEQ ID NO: 4779104 - DNA, 13 bp, Homo sapiens
aggggctggggac

SEQ ID NO: 4779105 - DNA, 19 bp, Homo sapiens
aggggcttggagcagagac

SEQ ID NO: 4779106 - DNA, 17 bp, Homo sapiens
agggggaagatgccaag

SEQ ID NO: 4779107 - DNA, 16 bp, Homo sapiens
agggggagactatgtg

SEQ ID NO: 4779108 - DNA, 20 bp, Homo sapiens
aggggtcagcagagcttcag

SEQ ID NO: 4779109 - DNA, 19 bp, Homo sapiens
aggggtggaagggcaggag

SEQ ID NO: 4779110 - DNA, 11 bp, Homo sapiens
aggggtttaca

SEQ ID NO: 4779111 - DNA, 15 bp, Homo sapiens
aggggtttacagtga

SEQ ID NO: 4779112 - DNA, 14 bp, Homo sapiens
agggtacagcccag

SEQ ID NO: 4779113 - DNA, 15 bp, Homo sapiens
agggtacagcccagg

SEQ ID NO: 4779114 - DNA, 13 bp, Homo sapiens
agggtccagccct

SEQ ID NO: 4779115 - DNA, 17 bp, Homo sapiens
agggtccagccctccgc

SEQ ID NO: 4779116 - DNA, 13 bp, Homo sapiens
agggtcccctgca

SEQ ID NO: 4779117 - DNA, 22 bp, Homo sapiens
agggtccctaggtgggtcaact

SEQ ID NO: 4779118 - DNA, 15 bp, Homo sapiens
agggtctatggggag

SEQ ID NO: 4779119 - DNA, 23 bp, Homo sapiens
agggtgaggcgtgggatccagag

SEQ ID NO: 4779120 - DNA, 14 bp, Homo sapiens
agggtggggggcca

SEQ ID NO: 4779121 - DNA, 19 bp, Homo sapiens
agggttaaagaaaggcaga

SEQ ID NO: 4779122 - DNA, 14 bp, Homo sapiens
agggttccagacag

SEQ ID NO: 4779123 - DNA, 16 bp, Homo sapiens
agggttctaacctttc

SEQ ID NO: 4779124 - DNA, 19 bp, Homo sapiens
agggttctaacctttctaa

SEQ ID NO: 4779125 - DNA, 19 bp, Homo sapiens
agggttctatatttactgt

SEQ ID NO: 4779126 - DNA, 15 bp, Homo sapiens
agggttgctggagcc

SEQ ID NO: 4779127 - DNA, 14 bp, Homo sapiens
agggttgtgatttt

SEQ ID NO: 4779128 - DNA, 19 bp, Homo sapiens
agggttgtgattttgtctg

SEQ ID NO: 4779129 - DNA, 18 bp, Homo sapiens
aggtagcttacctgacac

SEQ ID NO: 4779130 - DNA, 19 bp, Homo sapiens
aggtagcttacctgacaca

SEQ ID NO: 4779131 - DNA, 19 bp, Homo sapiens
aggtattggtaggttactc

SEQ ID NO: 4779132 - DNA, 15 bp, Homo sapiens
aggtcaatgaaatat

SEQ ID NO: 4779133 - DNA, 18 bp, Homo sapiens
aggtcaatgaaatatttg

SEQ ID NO: 4779134 - DNA, 19 bp, Homo sapiens
aggtcaatgaaatatttgc

SEQ ID NO: 4779135 - DNA, 13 bp, Homo sapiens
aggtcaggccctg

SEQ ID NO: 4779136 - DNA, 16 bp, Homo sapiens
aggtcaggccctggaa

SEQ ID NO: 4779137 - DNA, 20 bp, Homo sapiens
aggtccaccccgttgttgtc

SEQ ID NO: 4779138 - DNA, 15 bp, Homo sapiens
aggtcccctggccct

SEQ ID NO: 4779139 - DNA, 13 bp, Homo sapiens
aggtcctgcccat

SEQ ID NO: 4779140 - DNA, 14 bp, Homo sapiens
aggtcctgctgtgg

SEQ ID NO: 4779141 - DNA, 23 bp, Homo sapiens
aggtctccacccctcaagccagg

SEQ ID NO: 4779142 - DNA, 16 bp, Homo sapiens
aggtctgcacacataa

SEQ ID NO: 4779143 - DNA, 23 bp, Homo sapiens
aggtctgcacacataacacacat

SEQ ID NO: 4779144 - DNA, 22 bp, Homo sapiens
aggtctggaaggtcacgctgaa

SEQ ID NO: 4779145 - DNA, 24 bp, Homo sapiens
aggtctggattttcaaagattgtt

SEQ ID NO: 4779146 - DNA, 14 bp, Homo sapiens
aggtgaccagaatg

SEQ ID NO: 4779147 - DNA, 15 bp, Homo sapiens
aggtgaccagaatga

SEQ ID NO: 4779148 - DNA, 17 bp, Homo sapiens
aggtgcacctgccccag

SEQ ID NO: 4779149 - DNA, 13 bp, Homo sapiens
aggtgcccagtct

SEQ ID NO: 4779150 - DNA, 22 bp, Homo sapiens
aggtgcccagtcttgagtgggc

SEQ ID NO: 4779151 - DNA, 22 bp, Homo sapiens
aggtgcctcccagccctgccca

SEQ ID NO: 4779152 - DNA, 16 bp, Homo sapiens
aggtgctcttctcatt

SEQ ID NO: 4779153 - DNA, 16 bp, Homo sapiens
aggtgcttacctcaca

SEQ ID NO: 4779154 - DNA, 20 bp, Homo sapiens
aggtggagcttgcagtgagc

SEQ ID NO: 4779155 - DNA, 20 bp, Homo sapiens
aggtggatactggggggcag

SEQ ID NO: 4779156 - DNA, 14 bp, Homo sapiens
aggtggcatttgca

SEQ ID NO: 4779157 - DNA, 19 bp, Homo sapiens
aggtggccagcccgcagag

SEQ ID NO: 4779158 - DNA, 20 bp, Homo sapiens
aggtgggaggacagttagac

SEQ ID NO: 4779159 - DNA, 14 bp, Homo sapiens
aggtggggtgctgg

SEQ ID NO: 4779160 - DNA, 19 bp, Homo sapiens
aggtgggtcaactccaagg

SEQ ID NO: 4779161 - DNA, 19 bp, Homo sapiens
aggttactgtttttatcct

SEQ ID NO: 4779162 - DNA, 17 bp, Homo sapiens
aggttccatccaccacc

SEQ ID NO: 4779163 - DNA, 15 bp, Homo sapiens
aggttctatgatata

SEQ ID NO: 4779164 - DNA, 18 bp, Homo sapiens
aggttctatgatatacaa

SEQ ID NO: 4779165 - DNA, 14 bp, Homo sapiens
aggttgactaagaa

SEQ ID NO: 4779166 - DNA, 12 bp, Homo sapiens
aggtttcagtag

SEQ ID NO: 4779167 - DNA, 23 bp, Homo sapiens
agttatttcccaacccaggattc

SEQ ID NO: 4779168 - DNA, 20 bp, Homo sapiens
agttcaacctggtggcacca

SEQ ID NO: 4779169 - DNA, 19 bp, Homo sapiens
agttcatcttgaattgtaa

SEQ ID NO: 4779170 - DNA, 23 bp, Homo sapiens
agttcattcatactcaaagaggc

SEQ ID NO: 4779171 - DNA, 16 bp, Homo sapiens
agttccattctatgac

SEQ ID NO: 4779172 - DNA, 23 bp, Homo sapiens
agttcccaagaaaggaaaccttt

SEQ ID NO: 4779173 - DNA, 19 bp, Homo sapiens
agttcccatttccttgtct

SEQ ID NO: 4779174 - DNA, 17 bp, Homo sapiens
agttccctcagccctca

SEQ ID NO: 4779175 - DNA, 19 bp, Homo sapiens
agttcccttgattcaaata

SEQ ID NO: 4779176 - DNA, 17 bp, Homo sapiens
agttcctagagaactgt

SEQ ID NO: 4779177 - DNA, 12 bp, Homo sapiens
agttctcatctt

SEQ ID NO: 4779178 - DNA, 17 bp, Homo sapiens
agttctccttgtacttg

SEQ ID NO: 4779179 - DNA, 13 bp, Homo sapiens
agttctctccttc

SEQ ID NO: 4779180 - DNA, 12 bp, Homo sapiens
agttctgaaaac

SEQ ID NO: 4779181 - DNA, 13 bp, Homo sapiens
agttctgaaaact

SEQ ID NO: 4779182 - DNA, 16 bp, Homo sapiens
agttctgaaaactgtt

SEQ ID NO: 4779183 - DNA, 16 bp, Homo sapiens
agttctgcaaatagaa

SEQ ID NO: 4779184 - DNA, 14 bp, Homo sapiens
agttctgtgcagtt

SEQ ID NO: 4779185 - DNA, 13 bp, Homo sapiens
agttcttgcaata

SEQ ID NO: 4779186 - DNA, 16 bp, Homo sapiens
agttcttgcaataaga

SEQ ID NO: 4779187 - DNA, 16 bp, Homo sapiens
agttgaagacagagct

SEQ ID NO: 4779188 - DNA, 12 bp, Homo sapiens
agttgaccttta

SEQ ID NO: 4779189 - DNA, 14 bp, Homo sapiens
agttgatgaccaat

SEQ ID NO: 4779190 - DNA, 22 bp, Homo sapiens
agttgatgaccaatctctgtga

SEQ ID NO: 4779191 - DNA, 15 bp, Homo sapiens
agttgcaaagcattt

SEQ ID NO: 4779192 - DNA, 21 bp, Homo sapiens
agttgcaataaactcagtcaa

SEQ ID NO: 4779193 - DNA, 13 bp, Homo sapiens
agttgcagtaaag

SEQ ID NO: 4779194 - DNA, 22 bp, Homo sapiens
agttgccgcatattatatcaga

SEQ ID NO: 4779195 - DNA, 16 bp, Homo sapiens
agttggcctctgcccc

SEQ ID NO: 4779196 - DNA, 19 bp, Homo sapiens
agttggttacctattgctg

SEQ ID NO: 4779197 - DNA, 13 bp, Homo sapiens
agttgtaaagata

SEQ ID NO: 4779198 - DNA, 20 bp, Homo sapiens
agttgtattttaataaagat

SEQ ID NO: 4779199 - DNA, 22 bp, Homo sapiens
agttgttagtgtgtcttagtgt

SEQ ID NO: 4779200 - DNA, 21 bp, Homo sapiens
agtttattatagtctgtactt

SEQ ID NO: 4779201 - DNA, 21 bp, Homo sapiens
agtttcagataaatcatgggc

SEQ ID NO: 4779202 - DNA, 17 bp, Homo sapiens
agtttccatttggattt

SEQ ID NO: 4779203 - DNA, 20 bp, Homo sapiens
agtttctaaaattgagttct

SEQ ID NO: 4779204 - DNA, 19 bp, Homo sapiens
agtttctaaaccatgaaaa

SEQ ID NO: 4779205 - DNA, 20 bp, Homo sapiens
agtttctcttaagctgccca

SEQ ID NO: 4779206 - DNA, 15 bp, Homo sapiens
agtttctgccgcagc

SEQ ID NO: 4779207 - DNA, 16 bp, Homo sapiens
agtttctttgagggtt

SEQ ID NO: 4779208 - DNA, 20 bp, Homo sapiens
agtttgctgtatacaaacag

SEQ ID NO: 4779209 - DNA, 20 bp, Homo sapiens
agtttggaagtacataaagt

SEQ ID NO: 4779210 - DNA, 16 bp, Homo sapiens
agtttggtatgaaaca

SEQ ID NO: 4779211 - DNA, 23 bp, Homo sapiens
agtttggtatgaaacaaatatac

SEQ ID NO: 4779212 - DNA, 12 bp, Homo sapiens
agtttgtgaagt

SEQ ID NO: 4779213 - DNA, 21 bp, Homo sapiens
agtttgtgaagtgattgacat

SEQ ID NO: 4779214 - DNA, 22 bp, Homo sapiens
agtttgtgaagtgattgacatt

SEQ ID NO: 4779215 - DNA, 14 bp, Homo sapiens
agtttgtttacaca

SEQ ID NO: 4779216 - DNA, 15 bp, Homo sapiens
agttttatcttgaca

SEQ ID NO: 4779217 - DNA, 17 bp, Homo sapiens
agttttcaagcattgct

SEQ ID NO: 4779218 - DNA, 12 bp, Homo sapiens
agttttcagatt

SEQ ID NO: 4779219 - DNA, 15 bp, Homo sapiens
ataaaaaatatatgt

SEQ ID NO: 4779220 - DNA, 18 bp, Homo sapiens
ataaaaaatatatgtaat

SEQ ID NO: 4779221 - DNA, 19 bp, Homo sapiens
ataaaaaatatatgtaata

SEQ ID NO: 4779222 - DNA, 16 bp, Homo sapiens
ataaaaataattaaaa

SEQ ID NO: 4779223 - DNA, 18 bp, Homo sapiens
ataaaaattctagattac

SEQ ID NO: 4779224 - DNA, 14 bp, Homo sapiens
ataaaacagtgttt

SEQ ID NO: 4779225 - DNA, 15 bp, Homo sapiens
ataaaaccagaaaga

SEQ ID NO: 4779226 - DNA, 20 bp, Homo sapiens
ataaaactccttgaaaccag

SEQ ID NO: 4779227 - DNA, 11 bp, Homo sapiens
ataaaagccca

SEQ ID NO: 4779228 - DNA, 19 bp, Homo sapiens
ataaaagtgatattcctat

SEQ ID NO: 4779229 - DNA, 19 bp, Homo sapiens
ataaaatatacaaacatgt

SEQ ID NO: 4779230 - DNA, 14 bp, Homo sapiens
ataaaatcttcaac

SEQ ID NO: 4779231 - DNA, 22 bp, Homo sapiens
ataaaatggtgttttcatgtaa

SEQ ID NO: 4779232 - DNA, 14 bp, Homo sapiens
ataaacacatagat

SEQ ID NO: 4779233 - DNA, 21 bp, Homo sapiens
ataaaccctccaagggatctg

SEQ ID NO: 4779234 - DNA, 16 bp, Homo sapiens
ataaaccggatcctgt

SEQ ID NO: 4779235 - DNA, 14 bp, Homo sapiens
ataaactcagtcaa

SEQ ID NO: 4779236 - DNA, 14 bp, Homo sapiens
ataaactgtgagat

SEQ ID NO: 4779237 - DNA, 13 bp, Homo sapiens
ataaacttgtgta

SEQ ID NO: 4779238 - DNA, 12 bp, Homo sapiens
ataaagccacat

SEQ ID NO: 4779239 - DNA, 20 bp, Homo sapiens
ataaagccacataaccagcg

SEQ ID NO: 4779240 - DNA, 20 bp, Homo sapiens
ataaagtattccaccttaaa

SEQ ID NO: 4779241 - DNA, 21 bp, Homo sapiens
ataaataataaaggttctatg

SEQ ID NO: 4779242 - DNA, 22 bp, Homo sapiens
ataaatagtgaaaattttattg

SEQ ID NO: 4779243 - DNA, 16 bp, Homo sapiens
ataaatatcattatag

SEQ ID NO: 4779244 - DNA, 13 bp, Homo sapiens
ataaatatctatt

SEQ ID NO: 4779245 - DNA, 21 bp, Homo sapiens
ataaatcttacccttcaatgt

SEQ ID NO: 4779246 - DNA, 15 bp, Homo sapiens
ataaatgctgctttg

SEQ ID NO: 4779247 - DNA, 13 bp, Homo sapiens
ataaatggacttg

SEQ ID NO: 4779248 - DNA, 15 bp, Homo sapiens
ataaatggacttgct

SEQ ID NO: 4779249 - DNA, 12 bp, Homo sapiens
ataaatggaggt

SEQ ID NO: 4779250 - DNA, 20 bp, Homo sapiens
ataaatgtactacatttgca

SEQ ID NO: 4779251 - DNA, 13 bp, Homo sapiens
ataaatgtgtaaa

SEQ ID NO: 4779252 - DNA, 16 bp, Homo sapiens
ataaatgtgtaaatgt

SEQ ID NO: 4779253 - DNA, 15 bp, Homo sapiens
ataaatgtttatatt

SEQ ID NO: 4779254 - DNA, 18 bp, Homo sapiens
ataaatgtttatattgtt

SEQ ID NO: 4779255 - DNA, 14 bp, Homo sapiens
ataaattacatgca

SEQ ID NO: 4779256 - DNA, 21 bp, Homo sapiens
ataaattataatgcatctaaa

SEQ ID NO: 4779257 - DNA, 12 bp, Homo sapiens
ataaattattac

SEQ ID NO: 4779258 - DNA, 18 bp, Homo sapiens
ataaattattactttaaa

SEQ ID NO: 4779259 - DNA, 12 bp, Homo sapiens
ataaattttgga

SEQ ID NO: 4779260 - DNA, 17 bp, Homo sapiens
ataaattttggaagaat

SEQ ID NO: 4779261 - DNA, 19 bp, Homo sapiens
ataaattttggaagaattc

SEQ ID NO: 4779262 - DNA, 21 bp, Homo sapiens
ataaattttggaagaattcat

SEQ ID NO: 4779263 - DNA, 14 bp, Homo sapiens
ataacaacaattta

SEQ ID NO: 4779264 - DNA, 12 bp, Homo sapiens
ataacacacatc

SEQ ID NO: 4779265 - DNA, 22 bp, Homo sapiens
ataacagagaatcttgattaaa

SEQ ID NO: 4779266 - DNA, 12 bp, Homo sapiens
ataaccagcggg

SEQ ID NO: 4779267 - DNA, 20 bp, Homo sapiens
ataaccctgaatcagaggca

SEQ ID NO: 4779268 - DNA, 13 bp, Homo sapiens
ataactagagcac

SEQ ID NO: 4779269 - DNA, 18 bp, Homo sapiens
ataactagagtatgtgta

SEQ ID NO: 4779270 - DNA, 19 bp, Homo sapiens
ataactagagtatgtgtat

SEQ ID NO: 4779271 - DNA, 13 bp, Homo sapiens
ataactagatctc

SEQ ID NO: 4779272 - DNA, 20 bp, Homo sapiens
ataactagatctcctgtaat

SEQ ID NO: 4779273 - DNA, 21 bp, Homo sapiens
ataactagatctcctgtaatt

SEQ ID NO: 4779274 - DNA, 16 bp, Homo sapiens
ataactatggtaaata

SEQ ID NO: 4779275 - DNA, 19 bp, Homo sapiens
ataactatggtaaataact

SEQ ID NO: 4779276 - DNA, 23 bp, Homo sapiens
ataactatggtaaataactgtga

SEQ ID NO: 4779277 - DNA, 23 bp, Homo sapiens
ataactctgtacgaggcttctct

SEQ ID NO: 4779278 - DNA, 15 bp, Homo sapiens
ataacttgtttgtaa

SEQ ID NO: 4779279 - DNA, 16 bp, Homo sapiens
ataactttagaaataa

SEQ ID NO: 4779280 - DNA, 19 bp, Homo sapiens
ataagaaacagtttaacag

SEQ ID NO: 4779281 - DNA, 22 bp, Homo sapiens
ataagaaccttttgagtgcctt

SEQ ID NO: 4779282 - DNA, 17 bp, Homo sapiens
ataagagacaaagtttg

SEQ ID NO: 4779283 - DNA, 22 bp, Homo sapiens
ataagagacaaagtttggaagt

SEQ ID NO: 4779284 - DNA, 19 bp, Homo sapiens
ataagatattaccctcaga

SEQ ID NO: 4779285 - DNA, 17 bp, Homo sapiens
ataagccatagccccag

SEQ ID NO: 4779286 - DNA, 22 bp, Homo sapiens
ataagccattgcttctccctca

SEQ ID NO: 4779287 - DNA, 16 bp, Homo sapiens
ataagctggtatcagt

SEQ ID NO: 4779288 - DNA, 18 bp, Homo sapiens
ataaggatttattctcag

SEQ ID NO: 4779289 - DNA, 19 bp, Homo sapiens
atagtgaaaattttattga

SEQ ID NO: 4779290 - DNA, 20 bp, Homo sapiens
atagtgtgctcggacacagt

SEQ ID NO: 4779291 - DNA, 14 bp, Homo sapiens
atagtgttgaggag

SEQ ID NO: 4779292 - DNA, 20 bp, Homo sapiens
atagtgttgtgttacaataa

SEQ ID NO: 4779293 - DNA, 18 bp, Homo sapiens
atagtgtttcgttaagca

SEQ ID NO: 4779294 - DNA, 19 bp, Homo sapiens
atagtgtttcgttaagcag

SEQ ID NO: 4779295 - DNA, 16 bp, Homo sapiens
atagttacaagcattg

SEQ ID NO: 4779296 - DNA, 19 bp, Homo sapiens
atagttaccgatggtgtcc

SEQ ID NO: 4779297 - DNA, 18 bp, Homo sapiens
atagttccattctatgac

SEQ ID NO: 4779298 - DNA, 17 bp, Homo sapiens
atagtttattatagtct

SEQ ID NO: 4779299 - DNA, 16 bp, Homo sapiens
atagtttgaattcatg

SEQ ID NO: 4779300 - DNA, 20 bp, Homo sapiens
atataaaaaatatatgtaat

SEQ ID NO: 4779301 - DNA, 22 bp, Homo sapiens
atataaaaaatatatgtaatat

SEQ ID NO: 4779302 - DNA, 14 bp, Homo sapiens
atataaaaacattt

SEQ ID NO: 4779303 - DNA, 12 bp, Homo sapiens
atataaaaataa

SEQ ID NO: 4779304 - DNA, 20 bp, Homo sapiens
atataaaaataattaaaaca

SEQ ID NO: 4779305 - DNA, 12 bp, Homo sapiens
atataaaatgcc

SEQ ID NO: 4779306 - DNA, 13 bp, Homo sapiens
atataaaatgcca

SEQ ID NO: 4779307 - DNA, 15 bp, Homo sapiens
atataaaatgccaag

SEQ ID NO: 4779308 - DNA, 12 bp, Homo sapiens
atataaacacag

SEQ ID NO: 4779309 - DNA, 12 bp, Homo sapiens
atataaactgtg

SEQ ID NO: 4779310 - DNA, 13 bp, Homo sapiens
atataaactgtga

SEQ ID NO: 4779311 - DNA, 13 bp, Homo sapiens
atataaacttgtg

SEQ ID NO: 4779312 - DNA, 15 bp, Homo sapiens
atataaatcacagat

SEQ ID NO: 4779313 - DNA, 13 bp, Homo sapiens
atataaatcttac

SEQ ID NO: 4779314 - DNA, 13 bp, Homo sapiens
atataagccatag

SEQ ID NO: 4779315 - DNA, 14 bp, Homo sapiens
atataagccatagc

SEQ ID NO: 4779316 - DNA, 16 bp, Homo sapiens
atataagccatagccc

SEQ ID NO: 4779317 - DNA, 22 bp, Homo sapiens
atataataaatatatatttatc

SEQ ID NO: 4779318 - DNA, 23 bp, Homo sapiens
atataataaatatatatttatca

SEQ ID NO: 4779319 - DNA, 18 bp, Homo sapiens
atataatggcctcttaaa

SEQ ID NO: 4779320 - DNA, 21 bp, Homo sapiens
atataatgggctgcaaaatga

SEQ ID NO: 4779321 - DNA, 20 bp, Homo sapiens
atataatttgccagacagag

SEQ ID NO: 4779322 - DNA, 14 bp, Homo sapiens
atatacaaacatgt

SEQ ID NO: 4779323 - DNA, 16 bp, Homo sapiens
atatacacaaagatat

SEQ ID NO: 4779324 - DNA, 15 bp, Homo sapiens
atatacactttacat

SEQ ID NO: 4779325 - DNA, 17 bp, Homo sapiens
atatacagacctccaga

SEQ ID NO: 4779326 - DNA, 16 bp, Homo sapiens
atatacagagcctgtt

SEQ ID NO: 4779327 - DNA, 17 bp, Homo sapiens
atatacatatacacaaa

SEQ ID NO: 4779328 - DNA, 16 bp, Homo sapiens
atatacattagacaca

SEQ ID NO: 4779329 - DNA, 19 bp, Homo sapiens
atatacattatttctgtat

SEQ ID NO: 4779330 - DNA, 20 bp, Homo sapiens
atatacattatttctgtata

SEQ ID NO: 4779331 - DNA, 19 bp, Homo sapiens
atatactcattagaattac

SEQ ID NO: 4779332 - DNA, 13 bp, Homo sapiens
atatagatgtctg

SEQ ID NO: 4779333 - DNA, 23 bp, Homo sapiens
atatagatgtctgtgtatacata

SEQ ID NO: 4779334 - DNA, 14 bp, Homo sapiens
atatagctttgcaa

SEQ ID NO: 4779335 - DNA, 14 bp, Homo sapiens
atatagggtttgtt

SEQ ID NO: 4779336 - DNA, 18 bp, Homo sapiens
atatataaattattactt

SEQ ID NO: 4779337 - DNA, 18 bp, Homo sapiens
atatatacatattcaaag

SEQ ID NO: 4779338 - DNA, 19 bp, Homo sapiens
atatatacatgtatagtga

SEQ ID NO: 4779339 - DNA, 17 bp, Homo sapiens
atatatacattagacac

SEQ ID NO: 4779340 - DNA, 12 bp, Homo sapiens
atatatatgtat

SEQ ID NO: 4779341 - DNA, 13 bp, Homo sapiens
atatatatgtata

SEQ ID NO: 4779342 - DNA, 15 bp, Homo sapiens
atatatatttatcat

SEQ ID NO: 4779343 - DNA, 12 bp, Homo sapiens
atatatctgaaa

SEQ ID NO: 4779344 - DNA, 18 bp, Homo sapiens
atatatctgaaaactgga

SEQ ID NO: 4779345 - DNA, 17 bp, Homo sapiens
atatatgaagtaagttc

SEQ ID NO: 4779346 - DNA, 13 bp, Homo sapiens
atatatgtaatat

SEQ ID NO: 4779347 - DNA, 17 bp, Homo sapiens
atatatgtaatatatac

SEQ ID NO: 4779348 - DNA, 13 bp, Homo sapiens
atatatgtacagt

SEQ ID NO: 4779349 - DNA, 16 bp, Homo sapiens
atatatgtatgtaaaa

SEQ ID NO: 4779350 - DNA, 13 bp, Homo sapiens
atatatgtgaaag

SEQ ID NO: 4779351 - DNA, 15 bp, Homo sapiens
atatatgtttggctg

SEQ ID NO: 4779352 - DNA, 15 bp, Homo sapiens
atatattatatatac

SEQ ID NO: 4779353 - DNA, 16 bp, Homo sapiens
atatattatatataca

SEQ ID NO: 4779354 - DNA, 18 bp, Homo sapiens
atatcaagtcccgaggca

SEQ ID NO: 4779355 - DNA, 14 bp, Homo sapiens
atatcactcattaa

SEQ ID NO: 4779356 - DNA, 22 bp, Homo sapiens
atatcagctctaaagcagagat

SEQ ID NO: 4779357 - DNA, 14 bp, Homo sapiens
atatcagctctgca

SEQ ID NO: 4779358 - DNA, 21 bp, Homo sapiens
atatcaggaaatatctgtgaa

SEQ ID NO: 4779359 - DNA, 17 bp, Homo sapiens
atatcagttacagtggc

SEQ ID NO: 4779360 - DNA, 18 bp, Homo sapiens
atatcatcacgtatgtta

SEQ ID NO: 4779361 - DNA, 18 bp, Homo sapiens
atatcattatagcatgta

SEQ ID NO: 4779362 - DNA, 11 bp, Homo sapiens
atatcccaagt

SEQ ID NO: 4779363 - DNA, 17 bp, Homo sapiens
atatcgagagtttctat

SEQ ID NO: 4779364 - DNA, 14 bp, Homo sapiens
atatctagtgctaa

SEQ ID NO: 4779365 - DNA, 15 bp, Homo sapiens
atatctagtgctaaa

SEQ ID NO: 4779366 - DNA, 18 bp, Homo sapiens
atatctagtgctaaacct

SEQ ID NO: 4779367 - DNA, 20 bp, Homo sapiens
atatctagtgctaaacctat

SEQ ID NO: 4779368 - DNA, 13 bp, Homo sapiens
atatctatttatc

SEQ ID NO: 4779369 - DNA, 20 bp, Homo sapiens
atatctatttatctgtctga

SEQ ID NO: 4779370 - DNA, 17 bp, Homo sapiens
atatctgtgaaatatca

SEQ ID NO: 4779371 - DNA, 14 bp, Homo sapiens
atatcttgaagaat

SEQ ID NO: 4779372 - DNA, 20 bp, Homo sapiens
atatgaaagtcttattaaaa

SEQ ID NO: 4779373 - DNA, 17 bp, Homo sapiens
atatgaagcagaatgag

SEQ ID NO: 4779374 - DNA, 19 bp, Homo sapiens
atatgaagtaagttctgaa

SEQ ID NO: 4779375 - DNA, 19 bp, Homo sapiens
atatgaatgcttgtaatag

SEQ ID NO: 4779376 - DNA, 16 bp, Homo sapiens
atatgattaaattatc

SEQ ID NO: 4779377 - DNA, 16 bp, Homo sapiens
atatgattctcctctc

SEQ ID NO: 4779378 - DNA, 11 bp, Homo sapiens
atatgcatgta

SEQ ID NO: 4779379 - DNA, 15 bp, Homo sapiens
atatgcatgtagcat

SEQ ID NO: 4779380 - DNA, 19 bp, Homo sapiens
atatgcttttttgcaataa

SEQ ID NO: 4779381 - DNA, 12 bp, Homo sapiens
atatggatattt

SEQ ID NO: 4779382 - DNA, 18 bp, Homo sapiens
atatggcaacgttcatgt

SEQ ID NO: 4779383 - DNA, 12 bp, Homo sapiens
atatgtacagtt

SEQ ID NO: 4779384 - DNA, 19 bp, Homo sapiens
atatgtacagttatacata

SEQ ID NO: 4779385 - DNA, 12 bp, Homo sapiens
atatgtatgtgt

SEQ ID NO: 4779386 - DNA, 13 bp, Homo sapiens
atatgtatgtgtg

SEQ ID NO: 4779387 - DNA, 23 bp, Homo sapiens
atatgtatgtgtgagtgtatgta

SEQ ID NO: 4779388 - DNA, 24 bp, Homo sapiens
atatgtatgtgtgagtgtatgtat

SEQ ID NO: 4779389 - DNA, 14 bp, Homo sapiens
atatgtgcttgtgt

SEQ ID NO: 4779390 - DNA, 23 bp, Homo sapiens
atatgtgcttgtgtgtatgtcta

SEQ ID NO: 4779391 - DNA, 16 bp, Homo sapiens
atatgtgtaatatcat

SEQ ID NO: 4779392 - DNA, 21 bp, Homo sapiens
atatgtgtaatatcatttcat

SEQ ID NO: 4779393 - DNA, 13 bp, Homo sapiens
atatgtgtacaca

SEQ ID NO: 4779394 - DNA, 15 bp, Homo sapiens
atatgttatttttgg

SEQ ID NO: 4779395 - DNA, 16 bp, Homo sapiens
atattaaaaatataca

SEQ ID NO: 4779396 - DNA, 22 bp, Homo sapiens
atattaaaaattaattctttat

SEQ ID NO: 4779397 - DNA, 15 bp, Homo sapiens
atattaaaatcacaa

SEQ ID NO: 4779398 - DNA, 18 bp, Homo sapiens
atattaaaatcacaaact

SEQ ID NO: 4779399 - DNA, 13 bp, Homo sapiens
atattaagcacat

SEQ ID NO: 4779400 - DNA, 16 bp, Homo sapiens
atattagagtgccctt

SEQ ID NO: 4779401 - DNA, 10 bp, Homo sapiens
atattataag

SEQ ID NO: 4779402 - DNA, 20 bp, Homo sapiens
atattataagttgaccttta

SEQ ID NO: 4779403 - DNA, 11 bp, Homo sapiens
atattatatat

SEQ ID NO: 4779404 - DNA, 16 bp, Homo sapiens
atattatatatacatt

SEQ ID NO: 4779405 - DNA, 23 bp, Homo sapiens
atattatttgctaattaaaaagt

SEQ ID NO: 4779406 - DNA, 21 bp, Homo sapiens
atattcaaaaattatattttg

SEQ ID NO: 4779407 - DNA, 15 bp, Homo sapiens
atattcaaagtatat

SEQ ID NO: 4779408 - DNA, 23 bp, Homo sapiens
atattcaaagtatatacagagcc

SEQ ID NO: 4779409 - DNA, 17 bp, Homo sapiens
atattcattctttataa

SEQ ID NO: 4779410 - DNA, 22 bp, Homo sapiens
atattcattctttataaaccat

SEQ ID NO: 4779411 - DNA, 22 bp, Homo sapiens
atattctaagaaatatctgtga

SEQ ID NO: 4779412 - DNA, 17 bp, Homo sapiens
atgatcaaaatgcatac

SEQ ID NO: 4779413 - DNA, 20 bp, Homo sapiens
atgatcaaaatgcatacgta

SEQ ID NO: 4779414 - DNA, 15 bp, Homo sapiens
atgatcaaggaggga

SEQ ID NO: 4779415 - DNA, 19 bp, Homo sapiens
atgatcacttatcagtttg

SEQ ID NO: 4779416 - DNA, 14 bp, Homo sapiens
atgatgatttcaga

SEQ ID NO: 4779417 - DNA, 16 bp, Homo sapiens
atgatgccatgaggaa

SEQ ID NO: 4779418 - DNA, 13 bp, Homo sapiens
atgatgttctgaa

SEQ ID NO: 4779419 - DNA, 13 bp, Homo sapiens
atgattagacaat

SEQ ID NO: 4779420 - DNA, 17 bp, Homo sapiens
atgattagacaatgtgg

SEQ ID NO: 4779421 - DNA, 21 bp, Homo sapiens
atgattcaacaggttttcctg

SEQ ID NO: 4779422 - DNA, 13 bp, Homo sapiens
atgattctcctct

SEQ ID NO: 4779423 - DNA, 17 bp, Homo sapiens
atgattctcctctccca

SEQ ID NO: 4779424 - DNA, 15 bp, Homo sapiens
atgattcttgtgtca

SEQ ID NO: 4779425 - DNA, 14 bp, Homo sapiens
atgattgagagcag

SEQ ID NO: 4779426 - DNA, 17 bp, Homo sapiens
atgattgtttaattgta

SEQ ID NO: 4779427 - DNA, 20 bp, Homo sapiens
atgattgtttaattgtaggt

SEQ ID NO: 4779428 - DNA, 21 bp, Homo sapiens
atgatttaagcattttactgt

SEQ ID NO: 4779429 - DNA, 14 bp, Homo sapiens
atgatttactcatt

SEQ ID NO: 4779430 - DNA, 13 bp, Homo sapiens
atgatttcagaaa

SEQ ID NO: 4779431 - DNA, 14 bp, Homo sapiens
atgatttggggtga

SEQ ID NO: 4779432 - DNA, 15 bp, Homo sapiens
atgatttgttccttt

SEQ ID NO: 4779433 - DNA, 18 bp, Homo sapiens
atgatttgttcctttctg

SEQ ID NO: 4779434 - DNA, 15 bp, Homo sapiens
atgatttttgccctg

SEQ ID NO: 4779435 - DNA, 22 bp, Homo sapiens
atgcaagaagaatataaataaa

SEQ ID NO: 4779436 - DNA, 22 bp, Homo sapiens
atgcaataaagagtaaatatac

SEQ ID NO: 4779437 - DNA, 12 bp, Homo sapiens
atgcaatgcatc

SEQ ID NO: 4779438 - DNA, 17 bp, Homo sapiens
atgcaatgcatctgaaa

SEQ ID NO: 4779439 - DNA, 15 bp, Homo sapiens
atgcacaaacagagg

SEQ ID NO: 4779440 - DNA, 17 bp, Homo sapiens
atgcacaaacagaggcc

SEQ ID NO: 4779441 - DNA, 18 bp, Homo sapiens
atgcacaccaaattgctg

SEQ ID NO: 4779442 - DNA, 14 bp, Homo sapiens
atgcacagctaaca

SEQ ID NO: 4779443 - DNA, 21 bp, Homo sapiens
atgcacagctaacatggaagt

SEQ ID NO: 4779444 - DNA, 18 bp, Homo sapiens
atgcacattcatcctcac

SEQ ID NO: 4779445 - DNA, 17 bp, Homo sapiens
atgcactcttttgagca

SEQ ID NO: 4779446 - DNA, 23 bp, Homo sapiens
atgcactgacccttccagacata

SEQ ID NO: 4779447 - DNA, 19 bp, Homo sapiens
atgcagatctagccaggcc

SEQ ID NO: 4779448 - DNA, 20 bp, Homo sapiens
atgcagatctagccaggcct

SEQ ID NO: 4779449 - DNA, 19 bp, Homo sapiens
atgcagccgccttccttga

SEQ ID NO: 4779450 - DNA, 17 bp, Homo sapiens
atgcaggcagcctgcag

SEQ ID NO: 4779451 - DNA, 21 bp, Homo sapiens
atgcagggcccccacaggagc

SEQ ID NO: 4779452 - DNA, 15 bp, Homo sapiens
atgcaggttttctaa

SEQ ID NO: 4779453 - DNA, 14 bp, Homo sapiens
atgcatactgagat

SEQ ID NO: 4779454 - DNA, 18 bp, Homo sapiens
atgcatagacaagtgttt

SEQ ID NO: 4779455 - DNA, 21 bp, Homo sapiens
atgcatctgaaagttttgata

SEQ ID NO: 4779456 - DNA, 14 bp, Homo sapiens
atgcatggcctccc

SEQ ID NO: 4779457 - DNA, 15 bp, Homo sapiens
atgcatggcctccca

SEQ ID NO: 4779458 - DNA, 17 bp, Homo sapiens
atgcatggcctcccagc

SEQ ID NO: 4779459 - DNA, 16 bp, Homo sapiens
atgcatgtagcatata

SEQ ID NO: 4779460 - DNA, 19 bp, Homo sapiens
atgcatgtagcatataaat

SEQ ID NO: 4779461 - DNA, 23 bp, Homo sapiens
atgcatgtagcatataaatgttt

SEQ ID NO: 4779462 - DNA, 16 bp, Homo sapiens
atgcatttagcatgag

SEQ ID NO: 4779463 - DNA, 15 bp, Homo sapiens
atgcatttatgcatg

SEQ ID NO: 4779464 - DNA, 20 bp, Homo sapiens
atgcattttaaatgtctata

SEQ ID NO: 4779465 - DNA, 20 bp, Homo sapiens
atgccaagactctatgctct

SEQ ID NO: 4779466 - DNA, 21 bp, Homo sapiens
atgccaagactctatgctctg

SEQ ID NO: 4779467 - DNA, 12 bp, Homo sapiens
atgccaccaccc

SEQ ID NO: 4779468 - DNA, 20 bp, Homo sapiens
atgccagacttctaaaataa

SEQ ID NO: 4779469 - DNA, 14 bp, Homo sapiens
atgccatgtatgtt

SEQ ID NO: 4779470 - DNA, 21 bp, Homo sapiens
atgccatgtatgttgcatgaa

SEQ ID NO: 4779471 - DNA, 21 bp, Homo sapiens
atgcccaggaagtaattttct

SEQ ID NO: 4779472 - DNA, 16 bp, Homo sapiens
atgccctccctgctgc

SEQ ID NO: 4779473 - DNA, 19 bp, Homo sapiens
atgccctccctgctgccag

SEQ ID NO: 4779474 - DNA, 15 bp, Homo sapiens
atgcctacattagtg

SEQ ID NO: 4779475 - DNA, 19 bp, Homo sapiens
atgcctacattagtgagat

SEQ ID NO: 4779476 - DNA, 22 bp, Homo sapiens
atgcctctgatatgggactgag

SEQ ID NO: 4779477 - DNA, 15 bp, Homo sapiens
atgcctgaacttgaa

SEQ ID NO: 4779478 - DNA, 12 bp, Homo sapiens
atgcctgcctga

SEQ ID NO: 4779479 - DNA, 17 bp, Homo sapiens
atgcctgggcagaagga

SEQ ID NO: 4779480 - DNA, 18 bp, Homo sapiens
atgcctgttgatctatgg

SEQ ID NO: 4779481 - DNA, 13 bp, Homo sapiens
atgcctttgtaac

SEQ ID NO: 4779482 - DNA, 15 bp, Homo sapiens
atgctagttcttacg

SEQ ID NO: 4779483 - DNA, 18 bp, Homo sapiens
atgctatctcgctagcca

SEQ ID NO: 4779484 - DNA, 19 bp, Homo sapiens
atgctatctcgctagccat

SEQ ID NO: 4779485 - DNA, 13 bp, Homo sapiens
atgctatggactg

SEQ ID NO: 4779486 - DNA, 18 bp, Homo sapiens
atgctatggactgcacaa

SEQ ID NO: 4779487 - DNA, 17 bp, Homo sapiens
atgctcaatgtgctgtt

SEQ ID NO: 4779488 - DNA, 16 bp, Homo sapiens
atgctcagctcagcat

SEQ ID NO: 4779489 - DNA, 13 bp, Homo sapiens
atgctcagtattg

SEQ ID NO: 4779490 - DNA, 22 bp, Homo sapiens
atgctcctagtttgacctcaca

SEQ ID NO: 4779491 - DNA, 12 bp, Homo sapiens
atgctctaacaa

SEQ ID NO: 4779492 - DNA, 16 bp, Homo sapiens
atgctcttaaaggcag

SEQ ID NO: 4779493 - DNA, 15 bp, Homo sapiens
atgctctttcaccct

SEQ ID NO: 4779494 - DNA, 12 bp, Homo sapiens
atgctgcctgcc

SEQ ID NO: 4779495 - DNA, 16 bp, Homo sapiens
atgctgcctgccatgt

SEQ ID NO: 4779496 - DNA, 17 bp, Homo sapiens
atgctgcctgccatgtg

SEQ ID NO: 4779497 - DNA, 19 bp, Homo sapiens
atgctgcctgccatgtgtg

SEQ ID NO: 4779498 - DNA, 14 bp, Homo sapiens
atgctgcctgcctc

SEQ ID NO: 4779499 - DNA, 14 bp, Homo sapiens
atgctgctgagcac

SEQ ID NO: 4779500 - DNA, 19 bp, Homo sapiens
atgctgctggaggaatcag

SEQ ID NO: 4779501 - DNA, 15 bp, Homo sapiens
atgctggccagcacc

SEQ ID NO: 4779502 - DNA, 16 bp, Homo sapiens
atgctggccagcaccc

SEQ ID NO: 4779503 - DNA, 14 bp, Homo sapiens
atgctggccagcct

SEQ ID NO: 4779504 - DNA, 22 bp, Homo sapiens
atgctggccagcctggggcctg

SEQ ID NO: 4779505 - DNA, 20 bp, Homo sapiens
atgctgtagacatctgtcct

SEQ ID NO: 4779506 - DNA, 15 bp, Homo sapiens
atgctgtatctgtgc

SEQ ID NO: 4779507 - DNA, 12 bp, Homo sapiens
atgctgtccctg

SEQ ID NO: 4779508 - DNA, 20 bp, Homo sapiens
atgctgtccctgtgggctca

SEQ ID NO: 4779509 - DNA, 23 bp, Homo sapiens
atgctgtcccttacgtgagtcct

SEQ ID NO: 4779510 - DNA, 12 bp, Homo sapiens
atgctgtgtgca

SEQ ID NO: 4779511 - DNA, 21 bp, Homo sapiens
atgctgtgtgcagagtataca

SEQ ID NO: 4779512 - DNA, 15 bp, Homo sapiens
atgcttagagcatgt

SEQ ID NO: 4779513 - DNA, 18 bp, Homo sapiens
atgcttgatttgaccact

SEQ ID NO: 4779514 - DNA, 20 bp, Homo sapiens
atgctttctcatgcatagac

SEQ ID NO: 4779515 - DNA, 13 bp, Homo sapiens
atgcttttttgca

SEQ ID NO: 4779516 - DNA, 16 bp, Homo sapiens
atgcttttttgcaata

SEQ ID NO: 4779517 - DNA, 14 bp, Homo sapiens
atggaaaactgtta

SEQ ID NO: 4779518 - DNA, 22 bp, Homo sapiens
atggaaacacgagatcagtagt

SEQ ID NO: 4779519 - DNA, 13 bp, Homo sapiens
atggaaccttccc

SEQ ID NO: 4779520 - DNA, 18 bp, Homo sapiens
atggaaccttccctccaa

SEQ ID NO: 4779521 - DNA, 21 bp, Homo sapiens
atggaaccttccctccaaatt

SEQ ID NO: 4779522 - DNA, 22 bp, Homo sapiens
atggaactcagctgtctgtggc

SEQ ID NO: 4779523 - DNA, 17 bp, Homo sapiens
atggaactcgctcagaa

SEQ ID NO: 4779524 - DNA, 16 bp, Homo sapiens
atggaagacagctctt

SEQ ID NO: 4779525 - DNA, 14 bp, Homo sapiens
atggaagagagaaa

SEQ ID NO: 4779526 - DNA, 21 bp, Homo sapiens
atggaagtactataatttacc

SEQ ID NO: 4779527 - DNA, 19 bp, Homo sapiens
atggacagttcacaccctg

SEQ ID NO: 4779528 - DNA, 23 bp, Homo sapiens
atggacagttcacaccctgcaag

SEQ ID NO: 4779529 - DNA, 14 bp, Homo sapiens
atggaccaaatgta

SEQ ID NO: 4779530 - DNA, 20 bp, Homo sapiens
atggacgtgttatgactcca

SEQ ID NO: 4779531 - DNA, 23 bp, Homo sapiens
atggacgtgttatgactccagaa

SEQ ID NO: 4779532 - DNA, 17 bp, Homo sapiens
atggactgcacaaaagt

SEQ ID NO: 4779533 - DNA, 13 bp, Homo sapiens
atggagaaggaag

SEQ ID NO: 4779534 - DNA, 12 bp, Homo sapiens
attaattcttta

SEQ ID NO: 4779535 - DNA, 17 bp, Homo sapiens
attacaacaagcaaact

SEQ ID NO: 4779536 - DNA, 21 bp, Homo sapiens
attacaacaagcaaactgaaa

SEQ ID NO: 4779537 - DNA, 11 bp, Homo sapiens
attacagaaac

SEQ ID NO: 4779538 - DNA, 15 bp, Homo sapiens
attacataatgttag

SEQ ID NO: 4779539 - DNA, 17 bp, Homo sapiens
attacatgcatgagcac

SEQ ID NO: 4779540 - DNA, 22 bp, Homo sapiens
attacctgaaagcccttctcaa

SEQ ID NO: 4779541 - DNA, 14 bp, Homo sapiens
attactgtgagaac

SEQ ID NO: 4779542 - DNA, 23 bp, Homo sapiens
attactgtgagaactgtgaatat

SEQ ID NO: 4779543 - DNA, 16 bp, Homo sapiens
attactttaaattata

SEQ ID NO: 4779544 - DNA, 19 bp, Homo sapiens
attactttaaattatatga

SEQ ID NO: 4779545 - DNA, 15 bp, Homo sapiens
attagaattaccatt

SEQ ID NO: 4779546 - DNA, 13 bp, Homo sapiens
attagacacacat

SEQ ID NO: 4779547 - DNA, 15 bp, Homo sapiens
attagacacacatat

SEQ ID NO: 4779548 - DNA, 15 bp, Homo sapiens
attagccctgcattt

SEQ ID NO: 4779549 - DNA, 17 bp, Homo sapiens
attagccctgcattttc

SEQ ID NO: 4779550 - DNA, 18 bp, Homo sapiens
attagtgaagtatgcact

SEQ ID NO: 4779551 - DNA, 21 bp, Homo sapiens
attagtgaagtatgcactaat

SEQ ID NO: 4779552 - DNA, 19 bp, Homo sapiens
attagtgagatttgtattt

SEQ ID NO: 4779553 - DNA, 13 bp, Homo sapiens
attagtgcaataa

SEQ ID NO: 4779554 - DNA, 13 bp, Homo sapiens
attagtgttttca

SEQ ID NO: 4779555 - DNA, 13 bp, Homo sapiens
attataagttgac

SEQ ID NO: 4779556 - DNA, 13 bp, Homo sapiens
attataattgtca

SEQ ID NO: 4779557 - DNA, 16 bp, Homo sapiens
attataattgtcatga

SEQ ID NO: 4779558 - DNA, 20 bp, Homo sapiens
attataattgtcatgacttt

SEQ ID NO: 4779559 - DNA, 15 bp, Homo sapiens
attatactgtgtgtg

SEQ ID NO: 4779560 - DNA, 15 bp, Homo sapiens
attatacttctttat

SEQ ID NO: 4779561 - DNA, 15 bp, Homo sapiens
attatagcatgtaat

SEQ ID NO: 4779562 - DNA, 15 bp, Homo sapiens
attatagtctgtact

SEQ ID NO: 4779563 - DNA, 14 bp, Homo sapiens
attatatacaaagc

SEQ ID NO: 4779564 - DNA, 15 bp, Homo sapiens
attatatatacatta

SEQ ID NO: 4779565 - DNA, 15 bp, Homo sapiens
attatatgatatgca

SEQ ID NO: 4779566 - DNA, 16 bp, Homo sapiens
attatatgatatgcat

SEQ ID NO: 4779567 - DNA, 14 bp, Homo sapiens
attatattaatata

SEQ ID NO: 4779568 - DNA, 16 bp, Homo sapiens
attatcaaaaaacaga

SEQ ID NO: 4779569 - DNA, 18 bp, Homo sapiens
attatcaaaaaacagaaa

SEQ ID NO: 4779570 - DNA, 22 bp, Homo sapiens
attatcagtgaatataaatgta

SEQ ID NO: 4779571 - DNA, 14 bp, Homo sapiens
attatcatatatgc

SEQ ID NO: 4779572 - DNA, 16 bp, Homo sapiens
attatcattgtttgtc

SEQ ID NO: 4779573 - DNA, 18 bp, Homo sapiens
attatcgccttttgacag

SEQ ID NO: 4779574 - DNA, 15 bp, Homo sapiens
attatctgatccttg

SEQ ID NO: 4779575 - DNA, 13 bp, Homo sapiens
attatctgttcta

SEQ ID NO: 4779576 - DNA, 16 bp, Homo sapiens
attatctgttctatgg

SEQ ID NO: 4779577 - DNA, 12 bp, Homo sapiens
attatgaaatgc

SEQ ID NO: 4779578 - DNA, 14 bp, Homo sapiens
attatgaaatgcca

SEQ ID NO: 4779579 - DNA, 15 bp, Homo sapiens
attatgaaatgccag

SEQ ID NO: 4779580 - DNA, 21 bp, Homo sapiens
attatggctttgtgcttgttc

SEQ ID NO: 4779581 - DNA, 18 bp, Homo sapiens
attatggtgatactccaa

SEQ ID NO: 4779582 - DNA, 17 bp, Homo sapiens
attattggacttccatt

SEQ ID NO: 4779583 - DNA, 16 bp, Homo sapiens
attattgtagagaaaa

SEQ ID NO: 4779584 - DNA, 19 bp, Homo sapiens
attatttagtaaaattatc

SEQ ID NO: 4779585 - DNA, 14 bp, Homo sapiens
attatttctgtata

SEQ ID NO: 4779586 - DNA, 18 bp, Homo sapiens
attcaaaaattatatttt

SEQ ID NO: 4779587 - DNA, 20 bp, Homo sapiens
attcaaaaattatattttga

SEQ ID NO: 4779588 - DNA, 22 bp, Homo sapiens
attcaaaaattatattttgaac

SEQ ID NO: 4779589 - DNA, 21 bp, Homo sapiens
attcaaagaatcacctaatta

SEQ ID NO: 4779590 - DNA, 19 bp, Homo sapiens
attcaaagtatatacagag

SEQ ID NO: 4779591 - DNA, 16 bp, Homo sapiens
attcaactttccaaat

SEQ ID NO: 4779592 - DNA, 19 bp, Homo sapiens
attcaatgggtaaataaat

SEQ ID NO: 4779593 - DNA, 18 bp, Homo sapiens
attcacactgtgcgtttt

SEQ ID NO: 4779594 - DNA, 23 bp, Homo sapiens
attcacactgtgcgttttagagt

SEQ ID NO: 4779595 - DNA, 11 bp, Homo sapiens
attcacccctc

SEQ ID NO: 4779596 - DNA, 12 bp, Homo sapiens
attcacctgtaa

SEQ ID NO: 4779597 - DNA, 19 bp, Homo sapiens
attcacctgtaaaacttta

SEQ ID NO: 4779598 - DNA, 16 bp, Homo sapiens
attcacttctatttat

SEQ ID NO: 4779599 - DNA, 21 bp, Homo sapiens
attcagcatcgtgtgggtccc

SEQ ID NO: 4779600 - DNA, 22 bp, Homo sapiens
attcaggaaatgttcactgaat

SEQ ID NO: 4779601 - DNA, 17 bp, Homo sapiens
attcagtctatgctgtg

SEQ ID NO: 4779602 - DNA, 16 bp, Homo sapiens
attcagttgttagtgt

SEQ ID NO: 4779603 - DNA, 15 bp, Homo sapiens
attcataatgactta

SEQ ID NO: 4779604 - DNA, 13 bp, Homo sapiens
attcatactcaaa

SEQ ID NO: 4779605 - DNA, 15 bp, Homo sapiens
attcatactcaaaga

SEQ ID NO: 4779606 - DNA, 21 bp, Homo sapiens
attcatacttaaaaatttatt

SEQ ID NO: 4779607 - DNA, 16 bp, Homo sapiens
attcatagtagaactt

SEQ ID NO: 4779608 - DNA, 12 bp, Homo sapiens
attcatgatgct

SEQ ID NO: 4779609 - DNA, 15 bp, Homo sapiens
attcatgcctcaagt

SEQ ID NO: 4779610 - DNA, 14 bp, Homo sapiens
attcatgctgcctg

SEQ ID NO: 4779611 - DNA, 15 bp, Homo sapiens
attcatgctgcctgc

SEQ ID NO: 4779612 - DNA, 16 bp, Homo sapiens
attcatgctgcctgcc

SEQ ID NO: 4779613 - DNA, 16 bp, Homo sapiens
attcattcatacttaa

SEQ ID NO: 4779614 - DNA, 13 bp, Homo sapiens
attcattccattt

SEQ ID NO: 4779615 - DNA, 14 bp, Homo sapiens
attcatttacaact

SEQ ID NO: 4779616 - DNA, 20 bp, Homo sapiens
attcatttacaacttccaga

SEQ ID NO: 4779617 - DNA, 22 bp, Homo sapiens
attccaaacatcggggctaaca

SEQ ID NO: 4779618 - DNA, 22 bp, Homo sapiens
attccaacccaggtctgctttg

SEQ ID NO: 4779619 - DNA, 13 bp, Homo sapiens
attccaatacatt

SEQ ID NO: 4779620 - DNA, 20 bp, Homo sapiens
attccacctggaaagccagg

SEQ ID NO: 4779621 - DNA, 21 bp, Homo sapiens
attccacctggaaagccaggt

SEQ ID NO: 4779622 - DNA, 16 bp, Homo sapiens
attccaccttaaatta

SEQ ID NO: 4779623 - DNA, 17 bp, Homo sapiens
attccaccttaaattaa

SEQ ID NO: 4779624 - DNA, 18 bp, Homo sapiens
attccaccttaaattaaa

SEQ ID NO: 4779625 - DNA, 23 bp, Homo sapiens
attccaccttaaattaaacaatt

SEQ ID NO: 4779626 - DNA, 22 bp, Homo sapiens
attccaggggctgcagccccct

SEQ ID NO: 4779627 - DNA, 19 bp, Homo sapiens
attccagtgcagtagtgcc

SEQ ID NO: 4779628 - DNA, 19 bp, Homo sapiens
attccagtgtattttctgt

SEQ ID NO: 4779629 - DNA, 18 bp, Homo sapiens
attccatggatcttgctg

SEQ ID NO: 4779630 - DNA, 14 bp, Homo sapiens
attccattttggaa

SEQ ID NO: 4779631 - DNA, 16 bp, Homo sapiens
attcccaggcactctc

SEQ ID NO: 4779632 - DNA, 14 bp, Homo sapiens
attcccaggcaggg

SEQ ID NO: 4779633 - DNA, 23 bp, Homo sapiens
attccgaaaaaaaaatgttcatt

SEQ ID NO: 4779634 - DNA, 15 bp, Homo sapiens
attcctaattctatg

SEQ ID NO: 4779635 - DNA, 15 bp, Homo sapiens
attcctacttaaaca

SEQ ID NO: 4779636 - DNA, 17 bp, Homo sapiens
attcctacttaaacaaa

SEQ ID NO: 4779637 - DNA, 13 bp, Homo sapiens
attcctcccctgg

SEQ ID NO: 4779638 - DNA, 17 bp, Homo sapiens
attcctcccctggaagt

SEQ ID NO: 4779639 - DNA, 19 bp, Homo sapiens
attcctctaagatcttgcc

SEQ ID NO: 4779640 - DNA, 15 bp, Homo sapiens
attcctgaccctcac

SEQ ID NO: 4779641 - DNA, 12 bp, Homo sapiens
attcctgccttt

SEQ ID NO: 4779642 - DNA, 13 bp, Homo sapiens
attcctgtatgtt

SEQ ID NO: 4779643 - DNA, 13 bp, Homo sapiens
attccttggccca

SEQ ID NO: 4779644 - DNA, 15 bp, Homo sapiens
attccttggcccagc

SEQ ID NO: 4779645 - DNA, 17 bp, Homo sapiens
attccttggcccagcag

SEQ ID NO: 4779646 - DNA, 19 bp, Homo sapiens
attcgtgggcctgctgctc

SEQ ID NO: 4779647 - DNA, 18 bp, Homo sapiens
attctaagaaatatctgt

SEQ ID NO: 4779648 - DNA, 23 bp, Homo sapiens
attctaagaaatatctgtgaaat

SEQ ID NO: 4779649 - DNA, 23 bp, Homo sapiens
attctaagattgtacatatggaa

SEQ ID NO: 4779650 - DNA, 16 bp, Homo sapiens
attctagattaccatg

SEQ ID NO: 4779651 - DNA, 16 bp, Homo sapiens
attctatgacaataaa

SEQ ID NO: 4779652 - DNA, 17 bp, Homo sapiens
attctatgattaaactg

SEQ ID NO: 4779653 - DNA, 15 bp, Homo sapiens
attctattaaaagcc

SEQ ID NO: 4779654 - DNA, 19 bp, Homo sapiens
attctcagaacaccaagta

SEQ ID NO: 4779655 - DNA, 22 bp, Homo sapiens
attctcagaacaccaagtaaat

SEQ ID NO: 4779656 - DNA, 19 bp, Homo sapiens
attctccagaaaaatcaat

SEQ ID NO: 4779657 - DNA, 19 bp, Homo sapiens
atttgtgagccaaagagaa

SEQ ID NO: 4779658 - DNA, 15 bp, Homo sapiens
atttgtgtaactgaa

SEQ ID NO: 4779659 - DNA, 18 bp, Homo sapiens
atttgtgtagattgtgta

SEQ ID NO: 4779660 - DNA, 18 bp, Homo sapiens
atttgttatatcagcaga

SEQ ID NO: 4779661 - DNA, 22 bp, Homo sapiens
atttgttatatcagcagacact

SEQ ID NO: 4779662 - DNA, 23 bp, Homo sapiens
atttgttatatcagcagacactc

SEQ ID NO: 4779663 - DNA, 15 bp, Homo sapiens
atttgtttgtgcttc

SEQ ID NO: 4779664 - DNA, 17 bp, Homo sapiens
atttgtttgtgcttcta

SEQ ID NO: 4779665 - DNA, 20 bp, Homo sapiens
attttaaaaaagatggattt

SEQ ID NO: 4779666 - DNA, 24 bp, Homo sapiens
attttaaaaaagatggatttgaca

SEQ ID NO: 4779667 - DNA, 14 bp, Homo sapiens
attttaaaagcata

SEQ ID NO: 4779668 - DNA, 15 bp, Homo sapiens
attttaaaagcatat

SEQ ID NO: 4779669 - DNA, 22 bp, Homo sapiens
attttaaaagcatatataaaac

SEQ ID NO: 4779670 - DNA, 14 bp, Homo sapiens
attttaaaatgcaa

SEQ ID NO: 4779671 - DNA, 16 bp, Homo sapiens
attttaaatgatctgt

SEQ ID NO: 4779672 - DNA, 20 bp, Homo sapiens
attttaaatgtctataaatg

SEQ ID NO: 4779673 - DNA, 12 bp, Homo sapiens
attttaacatag

SEQ ID NO: 4779674 - DNA, 14 bp, Homo sapiens
attttaataaagat

SEQ ID NO: 4779675 - DNA, 21 bp, Homo sapiens
attttaccatcacacatgttc

SEQ ID NO: 4779676 - DNA, 18 bp, Homo sapiens
attttactgtctgtaaga

SEQ ID NO: 4779677 - DNA, 23 bp, Homo sapiens
attttactgtctgtaagagaatt

SEQ ID NO: 4779678 - DNA, 14 bp, Homo sapiens
attttatataataa

SEQ ID NO: 4779679 - DNA, 19 bp, Homo sapiens
attttatataataaagtat

SEQ ID NO: 4779680 - DNA, 13 bp, Homo sapiens
attttatctcttc

SEQ ID NO: 4779681 - DNA, 14 bp, Homo sapiens
attttatctgtgtt

SEQ ID NO: 4779682 - DNA, 22 bp, Homo sapiens
attttatgtttaaaatggcatt

SEQ ID NO: 4779683 - DNA, 17 bp, Homo sapiens
attttatttcaatgtaa

SEQ ID NO: 4779684 - DNA, 21 bp, Homo sapiens
attttatttcaatgtaattaa

SEQ ID NO: 4779685 - DNA, 16 bp, Homo sapiens
attttatttctctcag

SEQ ID NO: 4779686 - DNA, 11 bp, Homo sapiens
attttcaaaga

SEQ ID NO: 4779687 - DNA, 14 bp, Homo sapiens
attttcagatcctt

SEQ ID NO: 4779688 - DNA, 16 bp, Homo sapiens
attttcagatccttcc

SEQ ID NO: 4779689 - DNA, 16 bp, Homo sapiens
attttcatcaagtagc

SEQ ID NO: 4779690 - DNA, 19 bp, Homo sapiens
attttccccctaattctta

SEQ ID NO: 4779691 - DNA, 12 bp, Homo sapiens
attttcctggga

SEQ ID NO: 4779692 - DNA, 15 bp, Homo sapiens
attttcgtgcatttg

SEQ ID NO: 4779693 - DNA, 22 bp, Homo sapiens
attttctactccacctcttcct

SEQ ID NO: 4779694 - DNA, 14 bp, Homo sapiens
attttctactttaa

SEQ ID NO: 4779695 - DNA, 18 bp, Homo sapiens
attttctagaatactaat

SEQ ID NO: 4779696 - DNA, 15 bp, Homo sapiens
attttctatttaaaa

SEQ ID NO: 4779697 - DNA, 12 bp, Homo sapiens
attttctgtaat

SEQ ID NO: 4779698 - DNA, 13 bp, Homo sapiens
attttctgtaatt

SEQ ID NO: 4779699 - DNA, 18 bp, Homo sapiens
attttctgtgttgttcat

SEQ ID NO: 4779700 - DNA, 19 bp, Homo sapiens
attttctgtgttgttcata

SEQ ID NO: 4779701 - DNA, 17 bp, Homo sapiens
attttctgttatacaca

SEQ ID NO: 4779702 - DNA, 14 bp, Homo sapiens
attttcttaattat

SEQ ID NO: 4779703 - DNA, 23 bp, Homo sapiens
attttcttctttaatttttctgt

SEQ ID NO: 4779704 - DNA, 19 bp, Homo sapiens
attttgaaaggagaaaaaa

SEQ ID NO: 4779705 - DNA, 20 bp, Homo sapiens
attttgaacaactcgaatca

SEQ ID NO: 4779706 - DNA, 16 bp, Homo sapiens
attttgacactgaaat

SEQ ID NO: 4779707 - DNA, 20 bp, Homo sapiens
attttgagccttattaaaat

SEQ ID NO: 4779708 - DNA, 12 bp, Homo sapiens
attttgatgtat

SEQ ID NO: 4779709 - DNA, 16 bp, Homo sapiens
attttgatgtattatt

SEQ ID NO: 4779710 - DNA, 21 bp, Homo sapiens
attttgattgtttgatgaata

SEQ ID NO: 4779711 - DNA, 21 bp, Homo sapiens
attttggaagaattcatgatg

SEQ ID NO: 4779712 - DNA, 16 bp, Homo sapiens
attttggacgtgtgag

SEQ ID NO: 4779713 - DNA, 18 bp, Homo sapiens
attttggacgtgtgagga

SEQ ID NO: 4779714 - DNA, 17 bp, Homo sapiens
attttgtctggctgtgg

SEQ ID NO: 4779715 - DNA, 16 bp, Homo sapiens
atttttacaagttata

SEQ ID NO: 4779716 - DNA, 21 bp, Homo sapiens
atttttactcaggctttctat

SEQ ID NO: 4779717 - DNA, 16 bp, Homo sapiens
atttttagagattaat

SEQ ID NO: 4779718 - DNA, 13 bp, Homo sapiens
atttttatttcta

SEQ ID NO: 4779719 - DNA, 12 bp, Homo sapiens
atttttcaatag

SEQ ID NO: 4779720 - DNA, 15 bp, Homo sapiens
atttttcattttctc

SEQ ID NO: 4779721 - DNA, 16 bp, Homo sapiens
atttttgagtaaaact

SEQ ID NO: 4779722 - DNA, 20 bp, Homo sapiens
atttttgagtaaaacttgta

SEQ ID NO: 4779723 - DNA, 18 bp, Homo sapiens
atttttgtaattcctcta

SEQ ID NO: 4779724 - DNA, 14 bp, Homo sapiens
attttttcctacca

SEQ ID NO: 4779725 - DNA, 11 bp, Homo sapiens
attttttcctg

SEQ ID NO: 4779726 - DNA, 23 bp, Homo sapiens
attttttgtctgtgataacagag

SEQ ID NO: 4779727 - DNA, 13 bp, Homo sapiens
attttttgtgaat

SEQ ID NO: 4779728 - DNA, 18 bp, Homo sapiens
atttttttccagaattga

SEQ ID NO: 4779729 - DNA, 16 bp, Homo sapiens
caaaaaaaagaaagaa

SEQ ID NO: 4779730 - DNA, 19 bp, Homo sapiens
caaaaaaaagaaagaaaaa

SEQ ID NO: 4779731 - DNA, 14 bp, Homo sapiens
caaaaaacagaaaa

SEQ ID NO: 4779732 - DNA, 16 bp, Homo sapiens
caaaaaacagaaaaac

SEQ ID NO: 4779733 - DNA, 14 bp, Homo sapiens
caaaaactttccat

SEQ ID NO: 4779734 - DNA, 16 bp, Homo sapiens
caaaaactttccatga

SEQ ID NO: 4779735 - DNA, 23 bp, Homo sapiens
caaaaactttccatgacagtagc

SEQ ID NO: 4779736 - DNA, 15 bp, Homo sapiens
caaaaatcatcaaag

SEQ ID NO: 4779737 - DNA, 12 bp, Homo sapiens
caaaacaacagc

SEQ ID NO: 4779738 - DNA, 20 bp, Homo sapiens
caaaacaacagcaacaacaa

SEQ ID NO: 4779739 - DNA, 15 bp, Homo sapiens
caaaaccattgcttc

SEQ ID NO: 4779740 - DNA, 17 bp, Homo sapiens
caaaaccattgcttcac

SEQ ID NO: 4779741 - DNA, 12 bp, Homo sapiens
caaaaccccaga

SEQ ID NO: 4779742 - DNA, 19 bp, Homo sapiens
caaaagcatctatgtgaga

SEQ ID NO: 4779743 - DNA, 18 bp, Homo sapiens
caaaagctagaggagatt

SEQ ID NO: 4779744 - DNA, 22 bp, Homo sapiens
caaaagtatattcaaaaattat

SEQ ID NO: 4779745 - DNA, 19 bp, Homo sapiens
caaaagtgcagtagtgtca

SEQ ID NO: 4779746 - DNA, 15 bp, Homo sapiens
caaaataaaaccaga

SEQ ID NO: 4779747 - DNA, 20 bp, Homo sapiens
caaaataaaaccagaaagag

SEQ ID NO: 4779748 - DNA, 18 bp, Homo sapiens
caaaatagtcatgtttct

SEQ ID NO: 4779749 - DNA, 19 bp, Homo sapiens
caaaatagtcatgtttctg

SEQ ID NO: 4779750 - DNA, 18 bp, Homo sapiens
caaaatatatgtttggct

SEQ ID NO: 4779751 - DNA, 21 bp, Homo sapiens
caaaatatatgtttggctgaa

SEQ ID NO: 4779752 - DNA, 23 bp, Homo sapiens
caaaatatatgtttggctgaaat

SEQ ID NO: 4779753 - DNA, 11 bp, Homo sapiens
caaaatgcaag

SEQ ID NO: 4779754 - DNA, 16 bp, Homo sapiens
caaaatgcatacgtat

SEQ ID NO: 4779755 - DNA, 20 bp, Homo sapiens
caaaatgcatacgtattgtt

SEQ ID NO: 4779756 - DNA, 18 bp, Homo sapiens
caaaatgtcaatttttaa

SEQ ID NO: 4779757 - DNA, 11 bp, Homo sapiens
caaaatgtgcc

SEQ ID NO: 4779758 - DNA, 14 bp, Homo sapiens
caaacactgtgtat

SEQ ID NO: 4779759 - DNA, 15 bp, Homo sapiens
caaacactgtgtatt

SEQ ID NO: 4779760 - DNA, 13 bp, Homo sapiens
caaacagaggccg

SEQ ID NO: 4779761 - DNA, 12 bp, Homo sapiens
caaacaggtgct

SEQ ID NO: 4779762 - DNA, 13 bp, Homo sapiens
caaacaggtgcta

SEQ ID NO: 4779763 - DNA, 15 bp, Homo sapiens
caaacatcagtcaat

SEQ ID NO: 4779764 - DNA, 10 bp, Homo sapiens
caaacattta

SEQ ID NO: 4779765 - DNA, 15 bp, Homo sapiens
caaaccaatttgttc

SEQ ID NO: 4779766 - DNA, 20 bp, Homo sapiens
caaaccaatttgttctgtgc

SEQ ID NO: 4779767 - DNA, 21 bp, Homo sapiens
caaaccacaactgacacagga

SEQ ID NO: 4779768 - DNA, 23 bp, Homo sapiens
caaaccctgcttctgctgccctg

SEQ ID NO: 4779769 - DNA, 20 bp, Homo sapiens
caaacccttcagtgccaaaa

SEQ ID NO: 4779770 - DNA, 22 bp, Homo sapiens
caaacctaccttatagagcaca

SEQ ID NO: 4779771 - DNA, 16 bp, Homo sapiens
caaacctctatatgtt

SEQ ID NO: 4779772 - DNA, 14 bp, Homo sapiens
caaaccttcttttc

SEQ ID NO: 4779773 - DNA, 20 bp, Homo sapiens
caaaccttcttttcaatgca

SEQ ID NO: 4779774 - DNA, 23 bp, Homo sapiens
caaaccttcttttcaatgcaatg

SEQ ID NO: 4779775 - DNA, 14 bp, Homo sapiens
caaacgaaatggct

SEQ ID NO: 4779776 - DNA, 16 bp, Homo sapiens
caaacgtaatttgtta

SEQ ID NO: 4779777 - DNA, 18 bp, Homo sapiens
caaacgtaatttgttata

SEQ ID NO: 4779778 - DNA, 17 bp, Homo sapiens
caaactcacctgcccct

SEQ ID NO: 4779779 - DNA, 19 bp, Homo sapiens
caaactctctagtgcagga

SEQ ID NO: 4779780 - DNA, 20 bp, Homo sapiens
caatgaagcaaacacacaga

SEQ ID NO: 4779781 - DNA, 17 bp, Homo sapiens
caatgcatctgaaagtt

SEQ ID NO: 4779782 - DNA, 23 bp, Homo sapiens
caatgcatctgaaagttttgata

SEQ ID NO: 4779783 - DNA, 20 bp, Homo sapiens
caatgcctattgtaatatag

SEQ ID NO: 4779784 - DNA, 14 bp, Homo sapiens
caatgctatggact

SEQ ID NO: 4779785 - DNA, 19 bp, Homo sapiens
caatgctatggactgcaca

SEQ ID NO: 4779786 - DNA, 20 bp, Homo sapiens
caatgctcttttcacagcta

SEQ ID NO: 4779787 - DNA, 22 bp, Homo sapiens
caatggctgggtttgggcagtg

SEQ ID NO: 4779788 - DNA, 18 bp, Homo sapiens
caatgggtaaataaatgc

SEQ ID NO: 4779789 - DNA, 23 bp, Homo sapiens
caatggtgaactgtcattacaga

SEQ ID NO: 4779790 - DNA, 18 bp, Homo sapiens
caatggtgtagctgtcct

SEQ ID NO: 4779791 - DNA, 14 bp, Homo sapiens
caatgtactgtatt

SEQ ID NO: 4779792 - DNA, 17 bp, Homo sapiens
caatgtatcccttctca

SEQ ID NO: 4779793 - DNA, 16 bp, Homo sapiens
caatgtgaaactgaga

SEQ ID NO: 4779794 - DNA, 21 bp, Homo sapiens
caatgtgaattttaaaatgca

SEQ ID NO: 4779795 - DNA, 22 bp, Homo sapiens
caatgtgctgttgattctttca

SEQ ID NO: 4779796 - DNA, 22 bp, Homo sapiens
caatgtgcttccgagattcaga

SEQ ID NO: 4779797 - DNA, 16 bp, Homo sapiens
caatgtggaattacat

SEQ ID NO: 4779798 - DNA, 13 bp, Homo sapiens
caatgttaaatct

SEQ ID NO: 4779799 - DNA, 20 bp, Homo sapiens
caatgttaaattaattataa

SEQ ID NO: 4779800 - DNA, 19 bp, Homo sapiens
caatgttccgttcatctga

SEQ ID NO: 4779801 - DNA, 21 bp, Homo sapiens
caatgttggctagtctgtgcc

SEQ ID NO: 4779802 - DNA, 21 bp, Homo sapiens
caattaagttattaacatttg

SEQ ID NO: 4779803 - DNA, 18 bp, Homo sapiens
caattaatggaaaactgt

SEQ ID NO: 4779804 - DNA, 13 bp, Homo sapiens
caattactgtgag

SEQ ID NO: 4779805 - DNA, 15 bp, Homo sapiens
caattactgtgagaa

SEQ ID NO: 4779806 - DNA, 16 bp, Homo sapiens
caattactgtgagaac

SEQ ID NO: 4779807 - DNA, 19 bp, Homo sapiens
caattactgtgagaactgt

SEQ ID NO: 4779808 - DNA, 21 bp, Homo sapiens
caattactgtgagaactgtga

SEQ ID NO: 4779809 - DNA, 17 bp, Homo sapiens
caattatcaaaaaacag

SEQ ID NO: 4779810 - DNA, 15 bp, Homo sapiens
caattctaagtgaga

SEQ ID NO: 4779811 - DNA, 17 bp, Homo sapiens
caattctttgttgctta

SEQ ID NO: 4779812 - DNA, 14 bp, Homo sapiens
caattgatctcttt

SEQ ID NO: 4779813 - DNA, 14 bp, Homo sapiens
caattgcttgagca

SEQ ID NO: 4779814 - DNA, 23 bp, Homo sapiens
caattgggttttgatctcagcat

SEQ ID NO: 4779815 - DNA, 17 bp, Homo sapiens
caatttaaaatatagat

SEQ ID NO: 4779816 - DNA, 18 bp, Homo sapiens
caatttaggaatgctcaa

SEQ ID NO: 4779817 - DNA, 19 bp, Homo sapiens
caatttattttattttagc

SEQ ID NO: 4779818 - DNA, 17 bp, Homo sapiens
caatttcaaagaaaaca

SEQ ID NO: 4779819 - DNA, 13 bp, Homo sapiens
caatttcacagag

SEQ ID NO: 4779820 - DNA, 24 bp, Homo sapiens
caatttggtttagaatgctgcgct

SEQ ID NO: 4779821 - DNA, 18 bp, Homo sapiens
caatttgtttgtgcttct

SEQ ID NO: 4779822 - DNA, 19 bp, Homo sapiens
caatttttaacttatctcc

SEQ ID NO: 4779823 - DNA, 22 bp, Homo sapiens
cacaaaacaacagcaacaacaa

SEQ ID NO: 4779824 - DNA, 20 bp, Homo sapiens
cacaaaagtatattcaaaaa

SEQ ID NO: 4779825 - DNA, 14 bp, Homo sapiens
cacaaacagaggcc

SEQ ID NO: 4779826 - DNA, 19 bp, Homo sapiens
cacaaaccacaactgacac

SEQ ID NO: 4779827 - DNA, 20 bp, Homo sapiens
cacaaaccacaactgacaca

SEQ ID NO: 4779828 - DNA, 15 bp, Homo sapiens
cacaaaccttctttt

SEQ ID NO: 4779829 - DNA, 15 bp, Homo sapiens
cacaaagatattatt

SEQ ID NO: 4779830 - DNA, 17 bp, Homo sapiens
cacaaagcactggcctt

SEQ ID NO: 4779831 - DNA, 22 bp, Homo sapiens
cacaaagctatttaagtggact

SEQ ID NO: 4779832 - DNA, 16 bp, Homo sapiens
cacaaatgtcctcaga

SEQ ID NO: 4779833 - DNA, 14 bp, Homo sapiens
cacaacatgcacat

SEQ ID NO: 4779834 - DNA, 22 bp, Homo sapiens
cacaacatgcacattcatcctc

SEQ ID NO: 4779835 - DNA, 14 bp, Homo sapiens
cacaactaacaatg

SEQ ID NO: 4779836 - DNA, 23 bp, Homo sapiens
cacaactaacaatgccttgttgt

SEQ ID NO: 4779837 - DNA, 13 bp, Homo sapiens
cacaactgacaca

SEQ ID NO: 4779838 - DNA, 16 bp, Homo sapiens
cacaactgacacagga

SEQ ID NO: 4779839 - DNA, 18 bp, Homo sapiens
cacaactgtggataaatt

SEQ ID NO: 4779840 - DNA, 18 bp, Homo sapiens
cacaactgtttttgaaga

SEQ ID NO: 4779841 - DNA, 20 bp, Homo sapiens
cacaagagcccaggcctcct

SEQ ID NO: 4779842 - DNA, 12 bp, Homo sapiens
cacaagcacaat

SEQ ID NO: 4779843 - DNA, 13 bp, Homo sapiens
cacaagcacaatt

SEQ ID NO: 4779844 - DNA, 18 bp, Homo sapiens
cacaagccgtgttttatg

SEQ ID NO: 4779845 - DNA, 21 bp, Homo sapiens
cacaagtagatgcctgaactt

SEQ ID NO: 4779846 - DNA, 19 bp, Homo sapiens
cacaataaaagacatccac

SEQ ID NO: 4779847 - DNA, 15 bp, Homo sapiens
cacaatggtagctct

SEQ ID NO: 4779848 - DNA, 22 bp, Homo sapiens
cacaatgtgatatgtgtaatat

SEQ ID NO: 4779849 - DNA, 17 bp, Homo sapiens
cacacaaaacaacagca

SEQ ID NO: 4779850 - DNA, 16 bp, Homo sapiens
cacacaaagtgaaatt

SEQ ID NO: 4779851 - DNA, 16 bp, Homo sapiens
cacacaaatattgctt

SEQ ID NO: 4779852 - DNA, 13 bp, Homo sapiens
cacacacaaaaca

SEQ ID NO: 4779853 - DNA, 15 bp, Homo sapiens
cacacacaaaacaac

SEQ ID NO: 4779854 - DNA, 9 bp, Homo sapiens
cacacacac

SEQ ID NO: 4779855 - DNA, 15 bp, Homo sapiens
cacacacacacacaa

SEQ ID NO: 4779856 - DNA, 16 bp, Homo sapiens
cacacacacacacaca

SEQ ID NO: 4779857 - DNA, 17 bp, Homo sapiens
cacacacagcagctcca

SEQ ID NO: 4779858 - DNA, 15 bp, Homo sapiens
cacacaccacagaag

SEQ ID NO: 4779859 - DNA, 18 bp, Homo sapiens
cacacacgcgtccacata

SEQ ID NO: 4779860 - DNA, 13 bp, Homo sapiens
cacacagcccgag

SEQ ID NO: 4779861 - DNA, 16 bp, Homo sapiens
cacacaggcctggccc

SEQ ID NO: 4779862 - DNA, 20 bp, Homo sapiens
cacacaggcctggcccagcc

SEQ ID NO: 4779863 - DNA, 22 bp, Homo sapiens
cacacaggcctggcccagccag

SEQ ID NO: 4779864 - DNA, 15 bp, Homo sapiens
cacacagtatagata

SEQ ID NO: 4779865 - DNA, 15 bp, Homo sapiens
cacaccaaattgctg

SEQ ID NO: 4779866 - DNA, 14 bp, Homo sapiens
cacaccccgtctgc

SEQ ID NO: 4779867 - DNA, 13 bp, Homo sapiens
cacaccctgcaag

SEQ ID NO: 4779868 - DNA, 18 bp, Homo sapiens
cacacccttccccactcc

SEQ ID NO: 4779869 - DNA, 14 bp, Homo sapiens
cacacctaaattaa

SEQ ID NO: 4779870 - DNA, 18 bp, Homo sapiens
cacacctccacccgtcct

SEQ ID NO: 4779871 - DNA, 12 bp, Homo sapiens
cacacctgcctg

SEQ ID NO: 4779872 - DNA, 20 bp, Homo sapiens
cacaccttacaaagccagct

SEQ ID NO: 4779873 - DNA, 22 bp, Homo sapiens
cacacgccggggctggccctgc

SEQ ID NO: 4779874 - DNA, 19 bp, Homo sapiens
cacactggaggagcacaca

SEQ ID NO: 4779875 - DNA, 20 bp, Homo sapiens
cacactgtgcgttttagagt

SEQ ID NO: 4779876 - DNA, 16 bp, Homo sapiens
cacacttttgcaagag

SEQ ID NO: 4779877 - DNA, 23 bp, Homo sapiens
cacagaaaatggaagacagctct

SEQ ID NO: 4779878 - DNA, 17 bp, Homo sapiens
cacagaacctttgtcaa

SEQ ID NO: 4779879 - DNA, 19 bp, Homo sapiens
cacagacccctgggggagg

SEQ ID NO: 4779880 - DNA, 11 bp, Homo sapiens
cacagactctg

SEQ ID NO: 4779881 - DNA, 17 bp, Homo sapiens
cacagactgctgtctta

SEQ ID NO: 4779882 - DNA, 19 bp, Homo sapiens
cacagagagcggcttcccc

SEQ ID NO: 4779883 - DNA, 19 bp, Homo sapiens
cacagaggacagcttcccc

SEQ ID NO: 4779884 - DNA, 16 bp, Homo sapiens
cacagaggacggcttc

SEQ ID NO: 4779885 - DNA, 14 bp, Homo sapiens
cacagatttccaaa

SEQ ID NO: 4779886 - DNA, 20 bp, Homo sapiens
cacagcacatgctggccagc

SEQ ID NO: 4779887 - DNA, 15 bp, Homo sapiens
cacagcagcccccca

SEQ ID NO: 4779888 - DNA, 19 bp, Homo sapiens
cacagcagcctgcttccca

SEQ ID NO: 4779889 - DNA, 19 bp, Homo sapiens
cacagccaccacctggatg

SEQ ID NO: 4779890 - DNA, 17 bp, Homo sapiens
cacagccatagcagacg

SEQ ID NO: 4779891 - DNA, 16 bp, Homo sapiens
cacagcccagagactg

SEQ ID NO: 4779892 - DNA, 22 bp, Homo sapiens
cacagcgtccctagcagtgaac

SEQ ID NO: 4779893 - DNA, 22 bp, Homo sapiens
cacagctaacatggaagtacta

SEQ ID NO: 4779894 - DNA, 16 bp, Homo sapiens
cacagctactcagatc

SEQ ID NO: 4779895 - DNA, 18 bp, Homo sapiens
cacagctactcagatctg

SEQ ID NO: 4779896 - DNA, 17 bp, Homo sapiens
cacagctgagctggcct

SEQ ID NO: 4779897 - DNA, 18 bp, Homo sapiens
cacagctgagctggccta

SEQ ID NO: 4779898 - DNA, 12 bp, Homo sapiens
cacagctgcctc

SEQ ID NO: 4779899 - DNA, 15 bp, Homo sapiens
cacagctgcctccgg

SEQ ID NO: 4779900 - DNA, 17 bp, Homo sapiens
cacagctgcctccgggc

SEQ ID NO: 4779901 - DNA, 23 bp, Homo sapiens
cacagctggggtggggacctcag

SEQ ID NO: 4779902 - DNA, 14 bp, Homo sapiens
cactccactcccct

SEQ ID NO: 4779903 - DNA, 15 bp, Homo sapiens
cactccactcccctc

SEQ ID NO: 4779904 - DNA, 14 bp, Homo sapiens
cactcccagggccc

SEQ ID NO: 4779905 - DNA, 18 bp, Homo sapiens
cactcctgtctcttggga

SEQ ID NO: 4779906 - DNA, 11 bp, Homo sapiens
cactctgaagt

SEQ ID NO: 4779907 - DNA, 18 bp, Homo sapiens
cactctgaagtcccttcc

SEQ ID NO: 4779908 - DNA, 20 bp, Homo sapiens
cactctgacgcaaaaccact

SEQ ID NO: 4779909 - DNA, 15 bp, Homo sapiens
cactctgcaggaaat

SEQ ID NO: 4779910 - DNA, 13 bp, Homo sapiens
cactctgccaggg

SEQ ID NO: 4779911 - DNA, 14 bp, Homo sapiens
cactctgccagggc

SEQ ID NO: 4779912 - DNA, 19 bp, Homo sapiens
cactctgccagggcagtgc

SEQ ID NO: 4779913 - DNA, 17 bp, Homo sapiens
cactctgcctggccttg

SEQ ID NO: 4779914 - DNA, 14 bp, Homo sapiens
cactctgtcagcca

SEQ ID NO: 4779915 - DNA, 18 bp, Homo sapiens
cactctgtcagccagccg

SEQ ID NO: 4779916 - DNA, 21 bp, Homo sapiens
cactctgtcagccagccgccc

SEQ ID NO: 4779917 - DNA, 22 bp, Homo sapiens
cactgaaaaggttcttcatccc

SEQ ID NO: 4779918 - DNA, 15 bp, Homo sapiens
cactgacagcctcca

SEQ ID NO: 4779919 - DNA, 15 bp, Homo sapiens
cactgacccttccag

SEQ ID NO: 4779920 - DNA, 16 bp, Homo sapiens
cactgacccttccaga

SEQ ID NO: 4779921 - DNA, 18 bp, Homo sapiens
cactgacccttccagaca

SEQ ID NO: 4779922 - DNA, 19 bp, Homo sapiens
cactgacccttccagacat

SEQ ID NO: 4779923 - DNA, 20 bp, Homo sapiens
cactgaccttggagagacac

SEQ ID NO: 4779924 - DNA, 18 bp, Homo sapiens
cactgatatcacgggccc

SEQ ID NO: 4779925 - DNA, 17 bp, Homo sapiens
cactgatgggtcctgct

SEQ ID NO: 4779926 - DNA, 14 bp, Homo sapiens
cactgcaacctctg

SEQ ID NO: 4779927 - DNA, 15 bp, Homo sapiens
cactgcaatatcttc

SEQ ID NO: 4779928 - DNA, 13 bp, Homo sapiens
cactgcaccctcc

SEQ ID NO: 4779929 - DNA, 15 bp, Homo sapiens
cactgcagttattta

SEQ ID NO: 4779930 - DNA, 14 bp, Homo sapiens
cactgccaaacatc

SEQ ID NO: 4779931 - DNA, 20 bp, Homo sapiens
cactgccatttcctcctggg

SEQ ID NO: 4779932 - DNA, 20 bp, Homo sapiens
cactgcccacctgccaggct

SEQ ID NO: 4779933 - DNA, 19 bp, Homo sapiens
cactgcccgcacaccctca

SEQ ID NO: 4779934 - DNA, 23 bp, Homo sapiens
cactgccctctgccactgacagg

SEQ ID NO: 4779935 - DNA, 13 bp, Homo sapiens
cactgcctctgcc

SEQ ID NO: 4779936 - DNA, 14 bp, Homo sapiens
cactgcctctgcct

SEQ ID NO: 4779937 - DNA, 16 bp, Homo sapiens
cactgcctctgcctta

SEQ ID NO: 4779938 - DNA, 17 bp, Homo sapiens
cactggaacactaatga

SEQ ID NO: 4779939 - DNA, 14 bp, Homo sapiens
cactggaatccagt

SEQ ID NO: 4779940 - DNA, 23 bp, Homo sapiens
cactggccggcccacgtcctggg

SEQ ID NO: 4779941 - DNA, 11 bp, Homo sapiens
cactggccttg

SEQ ID NO: 4779942 - DNA, 19 bp, Homo sapiens
cactggccttgcctccagg

SEQ ID NO: 4779943 - DNA, 19 bp, Homo sapiens
cactgggtgtggcctggct

SEQ ID NO: 4779944 - DNA, 23 bp, Homo sapiens
cactgtattacataaataaatta

SEQ ID NO: 4779945 - DNA, 22 bp, Homo sapiens
cactgtcatgcccagcttggag

SEQ ID NO: 4779946 - DNA, 15 bp, Homo sapiens
cactgtccagagtct

SEQ ID NO: 4779947 - DNA, 19 bp, Homo sapiens
cactgtcccggagctcagg

SEQ ID NO: 4779948 - DNA, 14 bp, Homo sapiens
cactgtctgctgcc

SEQ ID NO: 4779949 - DNA, 14 bp, Homo sapiens
cactgtgtcccagt

SEQ ID NO: 4779950 - DNA, 16 bp, Homo sapiens
cactgtgtcccagtgt

SEQ ID NO: 4779951 - DNA, 18 bp, Homo sapiens
cactgtgtcccagtgtct

SEQ ID NO: 4779952 - DNA, 23 bp, Homo sapiens
cactgttcccagcaaagttttca

SEQ ID NO: 4779953 - DNA, 22 bp, Homo sapiens
cacttaaaatcaaatttttctg

SEQ ID NO: 4779954 - DNA, 13 bp, Homo sapiens
cacttatttccat

SEQ ID NO: 4779955 - DNA, 14 bp, Homo sapiens
cacttatttccatg

SEQ ID NO: 4779956 - DNA, 13 bp, Homo sapiens
cacttcaagcaaa

SEQ ID NO: 4779957 - DNA, 15 bp, Homo sapiens
cacttcacctccttc

SEQ ID NO: 4779958 - DNA, 18 bp, Homo sapiens
cacttccccatctgtgtg

SEQ ID NO: 4779959 - DNA, 19 bp, Homo sapiens
cacttccccatctgtgtgt

SEQ ID NO: 4779960 - DNA, 16 bp, Homo sapiens
cacttccttaacagct

SEQ ID NO: 4779961 - DNA, 20 bp, Homo sapiens
cacttccttaacagctgtat

SEQ ID NO: 4779962 - DNA, 22 bp, Homo sapiens
cacttccttaacagctgtatta

SEQ ID NO: 4779963 - DNA, 13 bp, Homo sapiens
cacttctccttaa

SEQ ID NO: 4779964 - DNA, 14 bp, Homo sapiens
cacttctccttaac

SEQ ID NO: 4779965 - DNA, 17 bp, Homo sapiens
cacttctccttaacccc

SEQ ID NO: 4779966 - DNA, 12 bp, Homo sapiens
cacttctgctgt

SEQ ID NO: 4779967 - DNA, 16 bp, Homo sapiens
cacttctttcctcaaa

SEQ ID NO: 4779968 - DNA, 23 bp, Homo sapiens
cacttggagcgtttttgctggct

SEQ ID NO: 4779969 - DNA, 22 bp, Homo sapiens
cacttgggctggcacccactgg

SEQ ID NO: 4779970 - DNA, 15 bp, Homo sapiens
cacttgggtgtggct

SEQ ID NO: 4779971 - DNA, 17 bp, Homo sapiens
cacttgtggcagcttcc

SEQ ID NO: 4779972 - DNA, 17 bp, Homo sapiens
cactttcccacactgtg

SEQ ID NO: 4779973 - DNA, 18 bp, Homo sapiens
cactttcccacactgtga

SEQ ID NO: 4779974 - DNA, 12 bp, Homo sapiens
cactttcctctc

SEQ ID NO: 4779975 - DNA, 14 bp, Homo sapiens
cactttcctctctc

SEQ ID NO: 4779976 - DNA, 15 bp, Homo sapiens
cactttcctctctct

SEQ ID NO: 4779977 - DNA, 16 bp, Homo sapiens
cactttctagccagag

SEQ ID NO: 4779978 - DNA, 17 bp, Homo sapiens
cactttctagccagagg

SEQ ID NO: 4779979 - DNA, 19 bp, Homo sapiens
cactttctagccagaggag

SEQ ID NO: 4779980 - DNA, 22 bp, Homo sapiens
cactttctagccagaggagaga

SEQ ID NO: 4779981 - DNA, 15 bp, Homo sapiens
cacttttcatatcat

SEQ ID NO: 4779982 - DNA, 13 bp, Homo sapiens
cacttttttataa

SEQ ID NO: 4779983 - DNA, 14 bp, Homo sapiens
cacttttttataaa

SEQ ID NO: 4779984 - DNA, 12 bp, Homo sapiens
cagaaaaacaaa

SEQ ID NO: 4779985 - DNA, 18 bp, Homo sapiens
cagaaaaatcaatcattt

SEQ ID NO: 4779986 - DNA, 16 bp, Homo sapiens
cagaaaatggaagaca

SEQ ID NO: 4779987 - DNA, 13 bp, Homo sapiens
cagaaagaggaat

SEQ ID NO: 4779988 - DNA, 17 bp, Homo sapiens
cagaaagggcagcccct

SEQ ID NO: 4779989 - DNA, 19 bp, Homo sapiens
cagaaagggcagcccctcc

SEQ ID NO: 4779990 - DNA, 22 bp, Homo sapiens
cagaaagggcagcccctcccca

SEQ ID NO: 4779991 - DNA, 14 bp, Homo sapiens
cagaacaaaagata

SEQ ID NO: 4779992 - DNA, 19 bp, Homo sapiens
cagaacaaaagataaaact

SEQ ID NO: 4779993 - DNA, 15 bp, Homo sapiens
cagaacaacaacaaa

SEQ ID NO: 4779994 - DNA, 13 bp, Homo sapiens
cagaacatgagtt

SEQ ID NO: 4779995 - DNA, 17 bp, Homo sapiens
cagaaccagcactccca

SEQ ID NO: 4779996 - DNA, 13 bp, Homo sapiens
cagaaccttcccg

SEQ ID NO: 4779997 - DNA, 14 bp, Homo sapiens
cagaacctttgtca

SEQ ID NO: 4779998 - DNA, 16 bp, Homo sapiens
cagaacgcatgcaggg

SEQ ID NO: 4779999 - DNA, 15 bp, Homo sapiens
cagaacgggcctccc

SEQ ID NO: 4780000 - DNA, 12 bp, Homo sapiens
cagaactcctgt

SEQ ID NO: 4780001 - DNA, 16 bp, Homo sapiens
cagaactcctgtgtgt

SEQ ID NO: 4780002 - DNA, 16 bp, Homo sapiens
cagaactcctttctaa

SEQ ID NO: 4780003 - DNA, 15 bp, Homo sapiens
cagaactgtcttagt

SEQ ID NO: 4780004 - DNA, 17 bp, Homo sapiens
cagaagcccattaaaat

SEQ ID NO: 4780005 - DNA, 19 bp, Homo sapiens
cagaagctcaaggctgcag

SEQ ID NO: 4780006 - DNA, 15 bp, Homo sapiens
cagaagcttgtatta

SEQ ID NO: 4780007 - DNA, 17 bp, Homo sapiens
cagaaggaagacttcat

SEQ ID NO: 4780008 - DNA, 18 bp, Homo sapiens
cagaaggaagacttcatc

SEQ ID NO: 4780009 - DNA, 22 bp, Homo sapiens
cagaaggaaggcagggaggagg

SEQ ID NO: 4780010 - DNA, 16 bp, Homo sapiens
cagaagtttctgccgc

SEQ ID NO: 4780011 - DNA, 19 bp, Homo sapiens
cagaagtttctgccgcagc

SEQ ID NO: 4780012 - DNA, 20 bp, Homo sapiens
cagaagtttctgccgcagcc

SEQ ID NO: 4780013 - DNA, 16 bp, Homo sapiens
cagaatattaagcaca

SEQ ID NO: 4780014 - DNA, 19 bp, Homo sapiens
cagaatattaagcacatta

SEQ ID NO: 4780015 - DNA, 20 bp, Homo sapiens
cagaatcattgcttatgaca

SEQ ID NO: 4780016 - DNA, 14 bp, Homo sapiens
cagaatgagatgat

SEQ ID NO: 4780017 - DNA, 20 bp, Homo sapiens
cagaatgagatgatttaatt

SEQ ID NO: 4780018 - DNA, 19 bp, Homo sapiens
cagaatggaagagagaaag

SEQ ID NO: 4780019 - DNA, 14 bp, Homo sapiens
cagaattcattcat

SEQ ID NO: 4780020 - DNA, 14 bp, Homo sapiens
cagaatttcccaaa

SEQ ID NO: 4780021 - DNA, 19 bp, Homo sapiens
cagaatttcccaaagcagt

SEQ ID NO: 4780022 - DNA, 12 bp, Homo sapiens
cagacaaagcgt

SEQ ID NO: 4780023 - DNA, 20 bp, Homo sapiens
cagacaacaaacctgtttct

SEQ ID NO: 4780024 - DNA, 15 bp, Homo sapiens
cagacaagccctgct

SEQ ID NO: 4780025 - DNA, 21 bp, Homo sapiens
cagctggggtggggacctcag

SEQ ID NO: 4780026 - DNA, 22 bp, Homo sapiens
cagctggggtggggacctcagg

SEQ ID NO: 4780027 - DNA, 17 bp, Homo sapiens
cagctggtgaatccatg

SEQ ID NO: 4780028 - DNA, 20 bp, Homo sapiens
cagctgtaccggccactgca

SEQ ID NO: 4780029 - DNA, 22 bp, Homo sapiens
cagctgtattatcttaaaccca

SEQ ID NO: 4780030 - DNA, 21 bp, Homo sapiens
cagcttccccatcgccttctg

SEQ ID NO: 4780031 - DNA, 21 bp, Homo sapiens
cagcttgaccgtgaggccaga

SEQ ID NO: 4780032 - DNA, 22 bp, Homo sapiens
cagcttggagtgccacgtggcc

SEQ ID NO: 4780033 - DNA, 18 bp, Homo sapiens
cagcttgggagagcccct

SEQ ID NO: 4780034 - DNA, 13 bp, Homo sapiens
cagcttgtccaac

SEQ ID NO: 4780035 - DNA, 23 bp, Homo sapiens
cagctttataataaactgtttaa

SEQ ID NO: 4780036 - DNA, 16 bp, Homo sapiens
cagctttgaggctggc

SEQ ID NO: 4780037 - DNA, 18 bp, Homo sapiens
caggaaaaaaacttttat

SEQ ID NO: 4780038 - DNA, 23 bp, Homo sapiens
caggaaaagggcattttgtacaa

SEQ ID NO: 4780039 - DNA, 14 bp, Homo sapiens
caggaaagatccca

SEQ ID NO: 4780040 - DNA, 14 bp, Homo sapiens
caggaaagccctcc

SEQ ID NO: 4780041 - DNA, 17 bp, Homo sapiens
caggaaagccctccccc

SEQ ID NO: 4780042 - DNA, 15 bp, Homo sapiens
caggaaaggaagatg

SEQ ID NO: 4780043 - DNA, 21 bp, Homo sapiens
caggaaattctgtttatgttc

SEQ ID NO: 4780044 - DNA, 14 bp, Homo sapiens
caggaacccatcac

SEQ ID NO: 4780045 - DNA, 21 bp, Homo sapiens
caggaacccatcactgtgtct

SEQ ID NO: 4780046 - DNA, 20 bp, Homo sapiens
caggaagaaggcccgggagg

SEQ ID NO: 4780047 - DNA, 16 bp, Homo sapiens
caggaagaccacatgc

SEQ ID NO: 4780048 - DNA, 16 bp, Homo sapiens
caggaagacttccagc

SEQ ID NO: 4780049 - DNA, 14 bp, Homo sapiens
caggaagagaagga

SEQ ID NO: 4780050 - DNA, 17 bp, Homo sapiens
caggaagagatgctcta

SEQ ID NO: 4780051 - DNA, 13 bp, Homo sapiens
caggaagaggggc

SEQ ID NO: 4780052 - DNA, 21 bp, Homo sapiens
caggaagccagcaggctctca

SEQ ID NO: 4780053 - DNA, 22 bp, Homo sapiens
caggaagccagcaggctctcag

SEQ ID NO: 4780054 - DNA, 12 bp, Homo sapiens
caggaaggcctg

SEQ ID NO: 4780055 - DNA, 14 bp, Homo sapiens
caggaaggcctggg

SEQ ID NO: 4780056 - DNA, 15 bp, Homo sapiens
caggaaggggacagg

SEQ ID NO: 4780057 - DNA, 19 bp, Homo sapiens
caggaaggggacaggattg

SEQ ID NO: 4780058 - DNA, 16 bp, Homo sapiens
caggaagtaattttct

SEQ ID NO: 4780059 - DNA, 22 bp, Homo sapiens
caggaagtaattttcttctcat

SEQ ID NO: 4780060 - DNA, 12 bp, Homo sapiens
caggaagtactg

SEQ ID NO: 4780061 - DNA, 16 bp, Homo sapiens
caggaagtactggaga

SEQ ID NO: 4780062 - DNA, 17 bp, Homo sapiens
caggaagtactggagaa

SEQ ID NO: 4780063 - DNA, 13 bp, Homo sapiens
caggaagtcagga

SEQ ID NO: 4780064 - DNA, 15 bp, Homo sapiens
caggaagtcaggagc

SEQ ID NO: 4780065 - DNA, 17 bp, Homo sapiens
caggaagtcaggagcca

SEQ ID NO: 4780066 - DNA, 19 bp, Homo sapiens
caggaagtcaggagccagc

SEQ ID NO: 4780067 - DNA, 21 bp, Homo sapiens
caggaagtcaggagccagcag

SEQ ID NO: 4780068 - DNA, 22 bp, Homo sapiens
caggaagtcaggagccagcagg

SEQ ID NO: 4780069 - DNA, 20 bp, Homo sapiens
caggaattctcacaggttca

SEQ ID NO: 4780070 - DNA, 13 bp, Homo sapiens
caggaccaggagc

SEQ ID NO: 4780071 - DNA, 15 bp, Homo sapiens
caggaccaggagcca

SEQ ID NO: 4780072 - DNA, 16 bp, Homo sapiens
caggaccaggagccag

SEQ ID NO: 4780073 - DNA, 17 bp, Homo sapiens
caggaccaggagccagg

SEQ ID NO: 4780074 - DNA, 18 bp, Homo sapiens
caggaccaggagccaggt

SEQ ID NO: 4780075 - DNA, 18 bp, Homo sapiens
caggacccccccagtccg

SEQ ID NO: 4780076 - DNA, 21 bp, Homo sapiens
caggacccccccagtccgccc

SEQ ID NO: 4780077 - DNA, 13 bp, Homo sapiens
caggaccctgggt

SEQ ID NO: 4780078 - DNA, 17 bp, Homo sapiens
caggacgcatgcagggc

SEQ ID NO: 4780079 - DNA, 15 bp, Homo sapiens
caggacttgtgcgcc

SEQ ID NO: 4780080 - DNA, 15 bp, Homo sapiens
caggagaccctgtct

SEQ ID NO: 4780081 - DNA, 19 bp, Homo sapiens
caggagagccctctgctgc

SEQ ID NO: 4780082 - DNA, 22 bp, Homo sapiens
caggagagccctctgctgcttt

SEQ ID NO: 4780083 - DNA, 14 bp, Homo sapiens
caggagcacagcca

SEQ ID NO: 4780084 - DNA, 21 bp, Homo sapiens
caggagcacagccatagcaga

SEQ ID NO: 4780085 - DNA, 13 bp, Homo sapiens
caggagccagcag

SEQ ID NO: 4780086 - DNA, 17 bp, Homo sapiens
caggagcctcctgccct

SEQ ID NO: 4780087 - DNA, 16 bp, Homo sapiens
caggagcgtgtcctat

SEQ ID NO: 4780088 - DNA, 19 bp, Homo sapiens
caggagctccctttttgaa

SEQ ID NO: 4780089 - DNA, 23 bp, Homo sapiens
caggaggacctggggggggcaag

SEQ ID NO: 4780090 - DNA, 17 bp, Homo sapiens
caggaggactgttctaa

SEQ ID NO: 4780091 - DNA, 20 bp, Homo sapiens
caggagggtctatggggaga

SEQ ID NO: 4780092 - DNA, 18 bp, Homo sapiens
caggagtgggctctgagc

SEQ ID NO: 4780093 - DNA, 21 bp, Homo sapiens
caggatgacggtattatgctt

SEQ ID NO: 4780094 - DNA, 23 bp, Homo sapiens
caggatgaggaacctcaaactgg

SEQ ID NO: 4780095 - DNA, 16 bp, Homo sapiens
caggatgcatgcaggg

SEQ ID NO: 4780096 - DNA, 22 bp, Homo sapiens
caggatgcatgcagggccccca

SEQ ID NO: 4780097 - DNA, 21 bp, Homo sapiens
caggatgtggcttatgagata

SEQ ID NO: 4780098 - DNA, 22 bp, Homo sapiens
caggatgttcaacttaatgaag

SEQ ID NO: 4780099 - DNA, 13 bp, Homo sapiens
caggattccttct

SEQ ID NO: 4780100 - DNA, 20 bp, Homo sapiens
caggattgtctgctgcctcc

SEQ ID NO: 4780101 - DNA, 22 bp, Homo sapiens
caggattgtctgctgcctccaa

SEQ ID NO: 4780102 - DNA, 22 bp, Homo sapiens
caggcaacttcagtcctgggag

SEQ ID NO: 4780103 - DNA, 17 bp, Homo sapiens
caggcaagacaccttcc

SEQ ID NO: 4780104 - DNA, 16 bp, Homo sapiens
caggcacacaccacca

SEQ ID NO: 4780105 - DNA, 21 bp, Homo sapiens
caggcacacagcagcccccca

SEQ ID NO: 4780106 - DNA, 18 bp, Homo sapiens
caggcaccatgctgggcc

SEQ ID NO: 4780107 - DNA, 15 bp, Homo sapiens
caggcacggaggctc

SEQ ID NO: 4780108 - DNA, 11 bp, Homo sapiens
caggcactctc

SEQ ID NO: 4780109 - DNA, 14 bp, Homo sapiens
caggcagcctgcag

SEQ ID NO: 4780110 - DNA, 23 bp, Homo sapiens
caggccaaactcacctgcccctc

SEQ ID NO: 4780111 - DNA, 13 bp, Homo sapiens
caggccagctgct

SEQ ID NO: 4780112 - DNA, 20 bp, Homo sapiens
caggccatcaccacagctgc

SEQ ID NO: 4780113 - DNA, 15 bp, Homo sapiens
caggcccagcctggc

SEQ ID NO: 4780114 - DNA, 16 bp, Homo sapiens
caggcccagcctggcc

SEQ ID NO: 4780115 - DNA, 23 bp, Homo sapiens
caggccccatcagcatcccacga

SEQ ID NO: 4780116 - DNA, 16 bp, Homo sapiens
caggcccgccctgccc

SEQ ID NO: 4780117 - DNA, 21 bp, Homo sapiens
caggcccgccctgcccgcgcc

SEQ ID NO: 4780118 - DNA, 19 bp, Homo sapiens
caggccctccctgactccc

SEQ ID NO: 4780119 - DNA, 20 bp, Homo sapiens
caggccctccctgactccct

SEQ ID NO: 4780120 - DNA, 17 bp, Homo sapiens
caggccctctctgcagt

SEQ ID NO: 4780121 - DNA, 13 bp, Homo sapiens
caggccctgcagt

SEQ ID NO: 4780122 - DNA, 17 bp, Homo sapiens
caggccctgcagtgttc

SEQ ID NO: 4780123 - DNA, 19 bp, Homo sapiens
caggccgaggaagggcccc

SEQ ID NO: 4780124 - DNA, 16 bp, Homo sapiens
caggcctcacctggct

SEQ ID NO: 4780125 - DNA, 16 bp, Homo sapiens
caggcctcagggacca

SEQ ID NO: 4780126 - DNA, 23 bp, Homo sapiens
caggcctcagggaccaaggagat

SEQ ID NO: 4780127 - DNA, 16 bp, Homo sapiens
caggcctcccaagctg

SEQ ID NO: 4780128 - DNA, 17 bp, Homo sapiens
caggcctcccaagctga

SEQ ID NO: 4780129 - DNA, 20 bp, Homo sapiens
caggcctcccgcatgctgcc

SEQ ID NO: 4780130 - DNA, 22 bp, Homo sapiens
caggcctcccgcatgctgcctg

SEQ ID NO: 4780131 - DNA, 15 bp, Homo sapiens
caggcctggcccagc

SEQ ID NO: 4780132 - DNA, 19 bp, Homo sapiens
caggccttcctcctctcaa

SEQ ID NO: 4780133 - DNA, 17 bp, Homo sapiens
caggcgccgcctcgccc

SEQ ID NO: 4780134 - DNA, 14 bp, Homo sapiens
caggcgcgcaccgc

SEQ ID NO: 4780135 - DNA, 22 bp, Homo sapiens
caggcgcgcaccgcccaacccc

SEQ ID NO: 4780136 - DNA, 23 bp, Homo sapiens
caggcgcgcaccgcccaaccccc

SEQ ID NO: 4780137 - DNA, 13 bp, Homo sapiens
caggcggaggggc

SEQ ID NO: 4780138 - DNA, 15 bp, Homo sapiens
caggcggaggggctt

SEQ ID NO: 4780139 - DNA, 23 bp, Homo sapiens
caggcggaggggcttggagcaga

SEQ ID NO: 4780140 - DNA, 17 bp, Homo sapiens
caggctcaacataacat

SEQ ID NO: 4780141 - DNA, 21 bp, Homo sapiens
caggctcccactgcccctgca

SEQ ID NO: 4780142 - DNA, 13 bp, Homo sapiens
caggctctcaggc

SEQ ID NO: 4780143 - DNA, 15 bp, Homo sapiens
caggctctcaggcca

SEQ ID NO: 4780144 - DNA, 18 bp, Homo sapiens
caggctctcaggccagct

SEQ ID NO: 4780145 - DNA, 22 bp, Homo sapiens
caggctgagacacagcccagag

SEQ ID NO: 4780146 - DNA, 16 bp, Homo sapiens
catctcaacctacctc

SEQ ID NO: 4780147 - DNA, 18 bp, Homo sapiens
catctcatcatgtctatt

SEQ ID NO: 4780148 - DNA, 15 bp, Homo sapiens
catctctcctccttt

SEQ ID NO: 4780149 - DNA, 14 bp, Homo sapiens
catctctctggggc

SEQ ID NO: 4780150 - DNA, 12 bp, Homo sapiens
catctctgtaaa

SEQ ID NO: 4780151 - DNA, 12 bp, Homo sapiens
catctgaaatct

SEQ ID NO: 4780152 - DNA, 21 bp, Homo sapiens
catctgaaatctacaacataa

SEQ ID NO: 4780153 - DNA, 11 bp, Homo sapiens
catctgaagag

SEQ ID NO: 4780154 - DNA, 14 bp, Homo sapiens
catctgctcttctc

SEQ ID NO: 4780155 - DNA, 17 bp, Homo sapiens
catctgctcttctctta

SEQ ID NO: 4780156 - DNA, 12 bp, Homo sapiens
catctggagtcc

SEQ ID NO: 4780157 - DNA, 14 bp, Homo sapiens
catctggcctggcc

SEQ ID NO: 4780158 - DNA, 16 bp, Homo sapiens
catctggcctgggggc

SEQ ID NO: 4780159 - DNA, 18 bp, Homo sapiens
catctgtaaaaccaggct

SEQ ID NO: 4780160 - DNA, 13 bp, Homo sapiens
catctgtaaaata

SEQ ID NO: 4780161 - DNA, 13 bp, Homo sapiens
catctgtacatga

SEQ ID NO: 4780162 - DNA, 15 bp, Homo sapiens
catctgtttgataca

SEQ ID NO: 4780163 - DNA, 21 bp, Homo sapiens
catcttgaattgtaaggaatg

SEQ ID NO: 4780164 - DNA, 21 bp, Homo sapiens
catcttgggattcctcccctg

SEQ ID NO: 4780165 - DNA, 16 bp, Homo sapiens
catgaaaagttttcaa

SEQ ID NO: 4780166 - DNA, 21 bp, Homo sapiens
catgaaaagttttcaagcatt

SEQ ID NO: 4780167 - DNA, 23 bp, Homo sapiens
catgaaagtcaagtctacctgcc

SEQ ID NO: 4780168 - DNA, 18 bp, Homo sapiens
catgaatccatcgatttg

SEQ ID NO: 4780169 - DNA, 21 bp, Homo sapiens
catgaatccatcgatttgtat

SEQ ID NO: 4780170 - DNA, 14 bp, Homo sapiens
catgacatccacat

SEQ ID NO: 4780171 - DNA, 21 bp, Homo sapiens
catgaccactgggcctgctag

SEQ ID NO: 4780172 - DNA, 22 bp, Homo sapiens
catgaccactgggcctgctagt

SEQ ID NO: 4780173 - DNA, 19 bp, Homo sapiens
catgaccttgacgtgtgtg

SEQ ID NO: 4780174 - DNA, 22 bp, Homo sapiens
catgagagtagggccctgacag

SEQ ID NO: 4780175 - DNA, 19 bp, Homo sapiens
catgagcacctttctggct

SEQ ID NO: 4780176 - DNA, 21 bp, Homo sapiens
catgagcacctttctggcttt

SEQ ID NO: 4780177 - DNA, 15 bp, Homo sapiens
catgagttctgcaca

SEQ ID NO: 4780178 - DNA, 17 bp, Homo sapiens
catgagttctgcacata

SEQ ID NO: 4780179 - DNA, 20 bp, Homo sapiens
catgagttctgcacatacag

SEQ ID NO: 4780180 - DNA, 22 bp, Homo sapiens
catgagttctgcacatacagat

SEQ ID NO: 4780181 - DNA, 18 bp, Homo sapiens
catgatcaaaatgcatac

SEQ ID NO: 4780182 - DNA, 16 bp, Homo sapiens
catgatgatttcagaa

SEQ ID NO: 4780183 - DNA, 18 bp, Homo sapiens
catgatgctagttcttac

SEQ ID NO: 4780184 - DNA, 14 bp, Homo sapiens
catgattagacaat

SEQ ID NO: 4780185 - DNA, 17 bp, Homo sapiens
catgatttcaatgattg

SEQ ID NO: 4780186 - DNA, 18 bp, Homo sapiens
catgatttcaatgattgt

SEQ ID NO: 4780187 - DNA, 15 bp, Homo sapiens
catgcaaaaatgaat

SEQ ID NO: 4780188 - DNA, 16 bp, Homo sapiens
catgcaaaaatgaatt

SEQ ID NO: 4780189 - DNA, 18 bp, Homo sapiens
catgcacattcatcctca

SEQ ID NO: 4780190 - DNA, 24 bp, Homo sapiens
catgcacattcatcctcacatgtg

SEQ ID NO: 4780191 - DNA, 17 bp, Homo sapiens
catgcactgacccttcc

SEQ ID NO: 4780192 - DNA, 16 bp, Homo sapiens
catgcagatctagcca

SEQ ID NO: 4780193 - DNA, 19 bp, Homo sapiens
catgcagatctagccaggc

SEQ ID NO: 4780194 - DNA, 21 bp, Homo sapiens
catgcagatctagccaggcct

SEQ ID NO: 4780195 - DNA, 12 bp, Homo sapiens
catgcagggccc

SEQ ID NO: 4780196 - DNA, 22 bp, Homo sapiens
catgcagggcccccacaggagc

SEQ ID NO: 4780197 - DNA, 15 bp, Homo sapiens
catgcatagacaagt

SEQ ID NO: 4780198 - DNA, 13 bp, Homo sapiens
catgcatgagcac

SEQ ID NO: 4780199 - DNA, 18 bp, Homo sapiens
catgcatggcctcccagc

SEQ ID NO: 4780200 - DNA, 16 bp, Homo sapiens
catgccaccacccacc

SEQ ID NO: 4780201 - DNA, 15 bp, Homo sapiens
catgcccaaatataa

SEQ ID NO: 4780202 - DNA, 22 bp, Homo sapiens
catgcccagcttggagtgccac

SEQ ID NO: 4780203 - DNA, 17 bp, Homo sapiens
catgcccctcttagaag

SEQ ID NO: 4780204 - DNA, 21 bp, Homo sapiens
catgccctccctgctgccagg

SEQ ID NO: 4780205 - DNA, 16 bp, Homo sapiens
catgcctctctcaggc

SEQ ID NO: 4780206 - DNA, 17 bp, Homo sapiens
catgcctctctcaggcc

SEQ ID NO: 4780207 - DNA, 19 bp, Homo sapiens
catgcctggacaaaccctt

SEQ ID NO: 4780208 - DNA, 17 bp, Homo sapiens
catgccttcataaatta

SEQ ID NO: 4780209 - DNA, 22 bp, Homo sapiens
catgccttttgggtttgcctta

SEQ ID NO: 4780210 - DNA, 15 bp, Homo sapiens
catgcgctcctggct

SEQ ID NO: 4780211 - DNA, 15 bp, Homo sapiens
catgctcagtattga

SEQ ID NO: 4780212 - DNA, 14 bp, Homo sapiens
catgctcctcactg

SEQ ID NO: 4780213 - DNA, 17 bp, Homo sapiens
catgctcctcactgccc

SEQ ID NO: 4780214 - DNA, 19 bp, Homo sapiens
catgctcctcactgcccgc

SEQ ID NO: 4780215 - DNA, 22 bp, Homo sapiens
catgctccttaatggcgccatg

SEQ ID NO: 4780216 - DNA, 20 bp, Homo sapiens
catgctgcctgcctccggcc

SEQ ID NO: 4780217 - DNA, 17 bp, Homo sapiens
catgctggccagcctgg

SEQ ID NO: 4780218 - DNA, 12 bp, Homo sapiens
catgctgggccg

SEQ ID NO: 4780219 - DNA, 19 bp, Homo sapiens
catgctgtccctgtgggct

SEQ ID NO: 4780220 - DNA, 22 bp, Homo sapiens
catgctgtccctgtgggctcac

SEQ ID NO: 4780221 - DNA, 23 bp, Homo sapiens
catgctgtccctgtgggctcaca

SEQ ID NO: 4780222 - DNA, 13 bp, Homo sapiens
catgctgtccctt

SEQ ID NO: 4780223 - DNA, 22 bp, Homo sapiens
catgctgtcccttacgtgagtc

SEQ ID NO: 4780224 - DNA, 22 bp, Homo sapiens
catgctgtctgtgtgaggctcc

SEQ ID NO: 4780225 - DNA, 21 bp, Homo sapiens
catgcttaaataaaaattatg

SEQ ID NO: 4780226 - DNA, 22 bp, Homo sapiens
catggaaaaatgccatcaaatg

SEQ ID NO: 4780227 - DNA, 22 bp, Homo sapiens
catggaagtactataatttacc

SEQ ID NO: 4780228 - DNA, 17 bp, Homo sapiens
catggaggaggaagacc

SEQ ID NO: 4780229 - DNA, 16 bp, Homo sapiens
catggatgattctttt

SEQ ID NO: 4780230 - DNA, 19 bp, Homo sapiens
catggattgattaaaagca

SEQ ID NO: 4780231 - DNA, 22 bp, Homo sapiens
catggatttattttttgtaact

SEQ ID NO: 4780232 - DNA, 16 bp, Homo sapiens
catggatttcctttga

SEQ ID NO: 4780233 - DNA, 17 bp, Homo sapiens
catggccaggagtgggt

SEQ ID NO: 4780234 - DNA, 17 bp, Homo sapiens
catggccccagctggct

SEQ ID NO: 4780235 - DNA, 18 bp, Homo sapiens
catggccccagctggctg

SEQ ID NO: 4780236 - DNA, 14 bp, Homo sapiens
catggccgctgccc

SEQ ID NO: 4780237 - DNA, 16 bp, Homo sapiens
catggctggatgtgca

SEQ ID NO: 4780238 - DNA, 18 bp, Homo sapiens
catggctgtcccctgcaa

SEQ ID NO: 4780239 - DNA, 13 bp, Homo sapiens
catgggaaaggag

SEQ ID NO: 4780240 - DNA, 17 bp, Homo sapiens
catgggagaagaggggt

SEQ ID NO: 4780241 - DNA, 14 bp, Homo sapiens
catggtaccagccc

SEQ ID NO: 4780242 - DNA, 15 bp, Homo sapiens
catggtaccagccct

SEQ ID NO: 4780243 - DNA, 17 bp, Homo sapiens
catggtaccagccctgg

SEQ ID NO: 4780244 - DNA, 17 bp, Homo sapiens
catggtcacagacccct

SEQ ID NO: 4780245 - DNA, 22 bp, Homo sapiens
catggtcacagacccctggggg

SEQ ID NO: 4780246 - DNA, 17 bp, Homo sapiens
catggtcccacttcccc

SEQ ID NO: 4780247 - DNA, 18 bp, Homo sapiens
catggtcccacttcccca

SEQ ID NO: 4780248 - DNA, 15 bp, Homo sapiens
catggtgaactgaag

SEQ ID NO: 4780249 - DNA, 17 bp, Homo sapiens
catggtgaactgaagca

SEQ ID NO: 4780250 - DNA, 17 bp, Homo sapiens
catgtaaattgactgta

SEQ ID NO: 4780251 - DNA, 19 bp, Homo sapiens
catgtaatattaaattcct

SEQ ID NO: 4780252 - DNA, 10 bp, Homo sapiens
catgtagcat

SEQ ID NO: 4780253 - DNA, 17 bp, Homo sapiens
catgtagcatataaatg

SEQ ID NO: 4780254 - DNA, 17 bp, Homo sapiens
catgtatgccatgtatg

SEQ ID NO: 4780255 - DNA, 15 bp, Homo sapiens
catgtatgttgcatg

SEQ ID NO: 4780256 - DNA, 16 bp, Homo sapiens
catgtatgttgcatga

SEQ ID NO: 4780257 - DNA, 17 bp, Homo sapiens
catgtatgttgcatgaa

SEQ ID NO: 4780258 - DNA, 22 bp, Homo sapiens
catgtattctgttggccagcac

SEQ ID NO: 4780259 - DNA, 15 bp, Homo sapiens
catgtcacatgacat

SEQ ID NO: 4780260 - DNA, 16 bp, Homo sapiens
catgtcacatgacatc

SEQ ID NO: 4780261 - DNA, 14 bp, Homo sapiens
catgtctattgtcc

SEQ ID NO: 4780262 - DNA, 14 bp, Homo sapiens
catgtcttatttaa

SEQ ID NO: 4780263 - DNA, 15 bp, Homo sapiens
catgtcttatttaaa

SEQ ID NO: 4780264 - DNA, 20 bp, Homo sapiens
catgtctttctccaaagtta

SEQ ID NO: 4780265 - DNA, 17 bp, Homo sapiens
catgtgaaaagtaaaac

SEQ ID NO: 4780266 - DNA, 20 bp, Homo sapiens
catgtgataattgtaaaggt

SEQ ID NO: 4780267 - DNA, 23 bp, Homo sapiens
catgtgatgtgttgctctccatt

SEQ ID NO: 4780268 - DNA, 15 bp, Homo sapiens
ccaccctctgctgca

SEQ ID NO: 4780269 - DNA, 16 bp, Homo sapiens
ccaccctgccaaggca

SEQ ID NO: 4780270 - DNA, 13 bp, Homo sapiens
ccaccctgccctg

SEQ ID NO: 4780271 - DNA, 15 bp, Homo sapiens
ccaccctgccctggc

SEQ ID NO: 4780272 - DNA, 15 bp, Homo sapiens
ccaccctgctgcctt

SEQ ID NO: 4780273 - DNA, 16 bp, Homo sapiens
ccaccctgctgccttc

SEQ ID NO: 4780274 - DNA, 16 bp, Homo sapiens
ccaccctgggcctccc

SEQ ID NO: 4780275 - DNA, 17 bp, Homo sapiens
ccaccctgggcctcccg

SEQ ID NO: 4780276 - DNA, 16 bp, Homo sapiens
ccaccgcagaaggaag

SEQ ID NO: 4780277 - DNA, 18 bp, Homo sapiens
ccaccgcgcccctctgcg

SEQ ID NO: 4780278 - DNA, 14 bp, Homo sapiens
ccaccgggagcctc

SEQ ID NO: 4780279 - DNA, 16 bp, Homo sapiens
ccaccgggagcctccc

SEQ ID NO: 4780280 - DNA, 20 bp, Homo sapiens
ccaccgggagcctccccctc

SEQ ID NO: 4780281 - DNA, 19 bp, Homo sapiens
ccacctaaagggaagccct

SEQ ID NO: 4780282 - DNA, 20 bp, Homo sapiens
ccacctaaagggaagccctg

SEQ ID NO: 4780283 - DNA, 20 bp, Homo sapiens
ccacctcccccaaaccctgc

SEQ ID NO: 4780284 - DNA, 21 bp, Homo sapiens
ccacctcccccaaaccctgct

SEQ ID NO: 4780285 - DNA, 15 bp, Homo sapiens
ccacctccctgcagc

SEQ ID NO: 4780286 - DNA, 17 bp, Homo sapiens
ccacctccctgcagctt

SEQ ID NO: 4780287 - DNA, 22 bp, Homo sapiens
ccacctctttcttcaattaatg

SEQ ID NO: 4780288 - DNA, 17 bp, Homo sapiens
ccacctgccaggctgca

SEQ ID NO: 4780289 - DNA, 21 bp, Homo sapiens
ccacctgcccagttagcccgg

SEQ ID NO: 4780290 - DNA, 16 bp, Homo sapiens
ccacctggaaagccag

SEQ ID NO: 4780291 - DNA, 22 bp, Homo sapiens
ccacctggatggatctgctcca

SEQ ID NO: 4780292 - DNA, 13 bp, Homo sapiens
ccacctgggccct

SEQ ID NO: 4780293 - DNA, 16 bp, Homo sapiens
ccacctgggccctagg

SEQ ID NO: 4780294 - DNA, 18 bp, Homo sapiens
ccacctgggccctaggca

SEQ ID NO: 4780295 - DNA, 15 bp, Homo sapiens
ccacctggtggccct

SEQ ID NO: 4780296 - DNA, 18 bp, Homo sapiens
ccacctggtggccctgcg

SEQ ID NO: 4780297 - DNA, 17 bp, Homo sapiens
ccacctgtcaacctgaa

SEQ ID NO: 4780298 - DNA, 15 bp, Homo sapiens
ccaccttaaattaaa

SEQ ID NO: 4780299 - DNA, 22 bp, Homo sapiens
ccaccttaaattaaacaattta

SEQ ID NO: 4780300 - DNA, 18 bp, Homo sapiens
ccaccttctgccaaggcc

SEQ ID NO: 4780301 - DNA, 15 bp, Homo sapiens
ccaccttgagcacta

SEQ ID NO: 4780302 - DNA, 14 bp, Homo sapiens
ccacgcagagaggg

SEQ ID NO: 4780303 - DNA, 13 bp, Homo sapiens
ccacgcagagccc

SEQ ID NO: 4780304 - DNA, 19 bp, Homo sapiens
ccacgcagagccccggagc

SEQ ID NO: 4780305 - DNA, 19 bp, Homo sapiens
ccacgccgatataagccat

SEQ ID NO: 4780306 - DNA, 15 bp, Homo sapiens
ccacgcctcctggcc

SEQ ID NO: 4780307 - DNA, 18 bp, Homo sapiens
ccacgcctcctggccaga

SEQ ID NO: 4780308 - DNA, 19 bp, Homo sapiens
ccacgcctcctggccagac

SEQ ID NO: 4780309 - DNA, 13 bp, Homo sapiens
ccacgcttctgga

SEQ ID NO: 4780310 - DNA, 17 bp, Homo sapiens
ccacggggactcagccc

SEQ ID NO: 4780311 - DNA, 23 bp, Homo sapiens
ccacggggtcgggggaggagcac

SEQ ID NO: 4780312 - DNA, 19 bp, Homo sapiens
ccacggtccaatccagcct

SEQ ID NO: 4780313 - DNA, 16 bp, Homo sapiens
ccacgtccctcgagct

SEQ ID NO: 4780314 - DNA, 14 bp, Homo sapiens
ccacgtctccctgg

SEQ ID NO: 4780315 - DNA, 19 bp, Homo sapiens
ccacgtggccgctgctgtg

SEQ ID NO: 4780316 - DNA, 17 bp, Homo sapiens
ccactaaaatccaccca

SEQ ID NO: 4780317 - DNA, 22 bp, Homo sapiens
ccactaaaatccacccagccca

SEQ ID NO: 4780318 - DNA, 21 bp, Homo sapiens
ccactagccctctttctctct

SEQ ID NO: 4780319 - DNA, 16 bp, Homo sapiens
ccactcaggcagcctg

SEQ ID NO: 4780320 - DNA, 12 bp, Homo sapiens
ccactcccctca

SEQ ID NO: 4780321 - DNA, 13 bp, Homo sapiens
ccactcccctcat

SEQ ID NO: 4780322 - DNA, 18 bp, Homo sapiens
ccactcccctcatccact

SEQ ID NO: 4780323 - DNA, 16 bp, Homo sapiens
ccactctcaggaccac

SEQ ID NO: 4780324 - DNA, 22 bp, Homo sapiens
ccactgatatcacgggcccgct

SEQ ID NO: 4780325 - DNA, 18 bp, Homo sapiens
ccactgcaacccatgagc

SEQ ID NO: 4780326 - DNA, 23 bp, Homo sapiens
ccactgcaacccatgagcgtcca

SEQ ID NO: 4780327 - DNA, 16 bp, Homo sapiens
ccactgccataacttg

SEQ ID NO: 4780328 - DNA, 14 bp, Homo sapiens
ccactgcctctgcc

SEQ ID NO: 4780329 - DNA, 15 bp, Homo sapiens
ccactgcctctgcct

SEQ ID NO: 4780330 - DNA, 18 bp, Homo sapiens
ccactgcctctgccttag

SEQ ID NO: 4780331 - DNA, 21 bp, Homo sapiens
ccactgcctctgccttagagg

SEQ ID NO: 4780332 - DNA, 17 bp, Homo sapiens
ccactggagcgtgtact

SEQ ID NO: 4780333 - DNA, 15 bp, Homo sapiens
ccactgtgtcccagt

SEQ ID NO: 4780334 - DNA, 16 bp, Homo sapiens
ccactgtgtcccagtg

SEQ ID NO: 4780335 - DNA, 17 bp, Homo sapiens
ccacttagaagatgttg

SEQ ID NO: 4780336 - DNA, 16 bp, Homo sapiens
ccacttccctgcaagg

SEQ ID NO: 4780337 - DNA, 17 bp, Homo sapiens
ccacttccctgcaaggt

SEQ ID NO: 4780338 - DNA, 12 bp, Homo sapiens
ccacttccttaa

SEQ ID NO: 4780339 - DNA, 18 bp, Homo sapiens
ccacttccttaacagctg

SEQ ID NO: 4780340 - DNA, 20 bp, Homo sapiens
ccacttccttaacagctgta

SEQ ID NO: 4780341 - DNA, 16 bp, Homo sapiens
ccacttgatgtctgag

SEQ ID NO: 4780342 - DNA, 17 bp, Homo sapiens
ccactttcctctctctc

SEQ ID NO: 4780343 - DNA, 23 bp, Homo sapiens
ccactttccttttctattccttc

SEQ ID NO: 4780344 - DNA, 17 bp, Homo sapiens
ccagaaaaatcaatcat

SEQ ID NO: 4780345 - DNA, 11 bp, Homo sapiens
ccagaaagagg

SEQ ID NO: 4780346 - DNA, 13 bp, Homo sapiens
ccagaaagaggaa

SEQ ID NO: 4780347 - DNA, 14 bp, Homo sapiens
ccagaaagaggaat

SEQ ID NO: 4780348 - DNA, 19 bp, Homo sapiens
ccagaacgcatgcagggcc

SEQ ID NO: 4780349 - DNA, 17 bp, Homo sapiens
ccagaacgggcctcccc

SEQ ID NO: 4780350 - DNA, 18 bp, Homo sapiens
ccagaacgggcctccccg

SEQ ID NO: 4780351 - DNA, 13 bp, Homo sapiens
ccagaagcagcag

SEQ ID NO: 4780352 - DNA, 19 bp, Homo sapiens
ccagaagctcaaggctgca

SEQ ID NO: 4780353 - DNA, 12 bp, Homo sapiens
ccagaattgaga

SEQ ID NO: 4780354 - DNA, 12 bp, Homo sapiens
ccagaatttccc

SEQ ID NO: 4780355 - DNA, 13 bp, Homo sapiens
ccagacaccatca

SEQ ID NO: 4780356 - DNA, 14 bp, Homo sapiens
ccagacagagatca

SEQ ID NO: 4780357 - DNA, 15 bp, Homo sapiens
ccagacagagatcag

SEQ ID NO: 4780358 - DNA, 17 bp, Homo sapiens
ccagacagggtggggct

SEQ ID NO: 4780359 - DNA, 9 bp, Homo sapiens
ccagacccc

SEQ ID NO: 4780360 - DNA, 20 bp, Homo sapiens
ccagacccctaccctttccc

SEQ ID NO: 4780361 - DNA, 21 bp, Homo sapiens
ccagacccctaccctttccca

SEQ ID NO: 4780362 - DNA, 15 bp, Homo sapiens
ccagactcagagacc

SEQ ID NO: 4780363 - DNA, 20 bp, Homo sapiens
ccagactcagagaccgtgag

SEQ ID NO: 4780364 - DNA, 18 bp, Homo sapiens
ccagactcgagagggctg

SEQ ID NO: 4780365 - DNA, 19 bp, Homo sapiens
ccagacttcgctattccca

SEQ ID NO: 4780366 - DNA, 20 bp, Homo sapiens
ccagacttcgctattcccag

SEQ ID NO: 4780367 - DNA, 22 bp, Homo sapiens
ccagacttcgctattcccaggc

SEQ ID NO: 4780368 - DNA, 24 bp, Homo sapiens
ccagacttcgctattcccaggcag

SEQ ID NO: 4780369 - DNA, 14 bp, Homo sapiens
ccagacttctaaaa

SEQ ID NO: 4780370 - DNA, 20 bp, Homo sapiens
ccagacttctaaaataaatg

SEQ ID NO: 4780371 - DNA, 22 bp, Homo sapiens
ccagacttctaaaataaatgtt

SEQ ID NO: 4780372 - DNA, 23 bp, Homo sapiens
ccagacttctaaaataaatgttt

SEQ ID NO: 4780373 - DNA, 22 bp, Homo sapiens
ccagagaaatgaaagtcagttt

SEQ ID NO: 4780374 - DNA, 17 bp, Homo sapiens
ccagagacctgctccag

SEQ ID NO: 4780375 - DNA, 19 bp, Homo sapiens
ccagagacctgctccagat

SEQ ID NO: 4780376 - DNA, 20 bp, Homo sapiens
ccagagacctgctccagatc

SEQ ID NO: 4780377 - DNA, 22 bp, Homo sapiens
ccagagactgcccaccctgggc

SEQ ID NO: 4780378 - DNA, 18 bp, Homo sapiens
ccagagagaccctgccaa

SEQ ID NO: 4780379 - DNA, 16 bp, Homo sapiens
ccagagcactgctcca

SEQ ID NO: 4780380 - DNA, 15 bp, Homo sapiens
ccagagcctgggcgc

SEQ ID NO: 4780381 - DNA, 21 bp, Homo sapiens
ccagagcgatgtgttctttgt

SEQ ID NO: 4780382 - DNA, 11 bp, Homo sapiens
ccagagctgcc

SEQ ID NO: 4780383 - DNA, 13 bp, Homo sapiens
ccagagctgccac

SEQ ID NO: 4780384 - DNA, 15 bp, Homo sapiens
ccagagctgccacct

SEQ ID NO: 4780385 - DNA, 16 bp, Homo sapiens
ccagagctgccacctg

SEQ ID NO: 4780386 - DNA, 13 bp, Homo sapiens
ccagaggctgagt

SEQ ID NO: 4780387 - DNA, 18 bp, Homo sapiens
ccagagtaggtgggtctt

SEQ ID NO: 4780388 - DNA, 12 bp, Homo sapiens
ccagagtctctt

SEQ ID NO: 4780389 - DNA, 20 bp, Homo sapiens
ccagagtgtcctgctacctt

SEQ ID NO: 4780390 - DNA, 22 bp, Homo sapiens
ccattggccttaactggccctc

SEQ ID NO: 4780391 - DNA, 21 bp, Homo sapiens
ccattgtgaatgttgtcctgt

SEQ ID NO: 4780392 - DNA, 22 bp, Homo sapiens
ccattgtgaatgttgtcctgtg

SEQ ID NO: 4780393 - DNA, 17 bp, Homo sapiens
ccatttcaatagcccca

SEQ ID NO: 4780394 - DNA, 12 bp, Homo sapiens
ccatttcacaca

SEQ ID NO: 4780395 - DNA, 17 bp, Homo sapiens
ccatttggattttaaac

SEQ ID NO: 4780396 - DNA, 22 bp, Homo sapiens
ccatttggattttaaacaaaat

SEQ ID NO: 4780397 - DNA, 14 bp, Homo sapiens
ccatttgtaatgta

SEQ ID NO: 4780398 - DNA, 14 bp, Homo sapiens
ccattttgaaatat

SEQ ID NO: 4780399 - DNA, 18 bp, Homo sapiens
ccattttgtctggctgtg

SEQ ID NO: 4780400 - DNA, 19 bp, Homo sapiens
cccaaacagcatgtgctca

SEQ ID NO: 4780401 - DNA, 22 bp, Homo sapiens
cccaaacagcatgtgctcagcc

SEQ ID NO: 4780402 - DNA, 12 bp, Homo sapiens
cccaaacccttc

SEQ ID NO: 4780403 - DNA, 23 bp, Homo sapiens
cccaaactgtagtaattgttaca

SEQ ID NO: 4780404 - DNA, 22 bp, Homo sapiens
cccaaactgttcaagaaataat

SEQ ID NO: 4780405 - DNA, 12 bp, Homo sapiens
cccaaagatgca

SEQ ID NO: 4780406 - DNA, 14 bp, Homo sapiens
cccaaataaatgtg

SEQ ID NO: 4780407 - DNA, 18 bp, Homo sapiens
cccaaataaatttataac

SEQ ID NO: 4780408 - DNA, 21 bp, Homo sapiens
cccaacaatactttgtgtctt

SEQ ID NO: 4780409 - DNA, 18 bp, Homo sapiens
cccaacccccacctcccg

SEQ ID NO: 4780410 - DNA, 17 bp, Homo sapiens
cccaaccgggaaaggca

SEQ ID NO: 4780411 - DNA, 21 bp, Homo sapiens
cccaacctggcataggactct

SEQ ID NO: 4780412 - DNA, 17 bp, Homo sapiens
cccaagacttgacgcag

SEQ ID NO: 4780413 - DNA, 16 bp, Homo sapiens
cccaagccaaaaacct

SEQ ID NO: 4780414 - DNA, 16 bp, Homo sapiens
cccaagctgctgccgc

SEQ ID NO: 4780415 - DNA, 16 bp, Homo sapiens
cccaaggcactgagcg

SEQ ID NO: 4780416 - DNA, 13 bp, Homo sapiens
cccaaggcagctg

SEQ ID NO: 4780417 - DNA, 15 bp, Homo sapiens
cccaaggcccccacc

SEQ ID NO: 4780418 - DNA, 21 bp, Homo sapiens
cccaaggtggtcttggagagg

SEQ ID NO: 4780419 - DNA, 20 bp, Homo sapiens
cccaagtggtttccacatgc

SEQ ID NO: 4780420 - DNA, 21 bp, Homo sapiens
cccaagttggaagggacccca

SEQ ID NO: 4780421 - DNA, 23 bp, Homo sapiens
cccaagttggaagggaccccaga

SEQ ID NO: 4780422 - DNA, 19 bp, Homo sapiens
cccacaccccgtctgcccc

SEQ ID NO: 4780423 - DNA, 17 bp, Homo sapiens
cccacacgccggggctg

SEQ ID NO: 4780424 - DNA, 19 bp, Homo sapiens
cccacacgccggggctggc

SEQ ID NO: 4780425 - DNA, 20 bp, Homo sapiens
cccacacgccggggctggcc

SEQ ID NO: 4780426 - DNA, 21 bp, Homo sapiens
cccacacgccggggctggccc

SEQ ID NO: 4780427 - DNA, 14 bp, Homo sapiens
cccacagatccatc

SEQ ID NO: 4780428 - DNA, 19 bp, Homo sapiens
cccacaggagcgtgtccta

SEQ ID NO: 4780429 - DNA, 22 bp, Homo sapiens
cccacaggaggcaagcaagctc

SEQ ID NO: 4780430 - DNA, 15 bp, Homo sapiens
cccacaggggatggt

SEQ ID NO: 4780431 - DNA, 23 bp, Homo sapiens
cccacagtatattttatttcaat

SEQ ID NO: 4780432 - DNA, 14 bp, Homo sapiens
cccacataaacact

SEQ ID NO: 4780433 - DNA, 17 bp, Homo sapiens
cccacataaacacttct

SEQ ID NO: 4780434 - DNA, 21 bp, Homo sapiens
cccaccacaactaacaatgcc

SEQ ID NO: 4780435 - DNA, 23 bp, Homo sapiens
cccaccaggaatgccgtttcctt

SEQ ID NO: 4780436 - DNA, 13 bp, Homo sapiens
cccacccagcagc

SEQ ID NO: 4780437 - DNA, 17 bp, Homo sapiens
cccacccagcagcgccc

SEQ ID NO: 4780438 - DNA, 21 bp, Homo sapiens
cccacccagcagcgcccgagg

SEQ ID NO: 4780439 - DNA, 14 bp, Homo sapiens
cccacccctgccca

SEQ ID NO: 4780440 - DNA, 15 bp, Homo sapiens
cccacccgccccaga

SEQ ID NO: 4780441 - DNA, 23 bp, Homo sapiens
cccacccgccccagagactgccc

SEQ ID NO: 4780442 - DNA, 12 bp, Homo sapiens
cccaccctgctg

SEQ ID NO: 4780443 - DNA, 12 bp, Homo sapiens
cccaccctgggc

SEQ ID NO: 4780444 - DNA, 18 bp, Homo sapiens
cccaccctgggcctcccg

SEQ ID NO: 4780445 - DNA, 18 bp, Homo sapiens
cccacctccctgcccagg

SEQ ID NO: 4780446 - DNA, 23 bp, Homo sapiens
cccacctctttcttcaattaatg

SEQ ID NO: 4780447 - DNA, 14 bp, Homo sapiens
cccacctgccaggc

SEQ ID NO: 4780448 - DNA, 15 bp, Homo sapiens
cccacctgccaggct

SEQ ID NO: 4780449 - DNA, 16 bp, Homo sapiens
cccacctgcccagtta

SEQ ID NO: 4780450 - DNA, 13 bp, Homo sapiens
cccacctgggccc

SEQ ID NO: 4780451 - DNA, 18 bp, Homo sapiens
cccacgatcggccttggt

SEQ ID NO: 4780452 - DNA, 12 bp, Homo sapiens
cccacgcagagc

SEQ ID NO: 4780453 - DNA, 14 bp, Homo sapiens
cccacgcagagccc

SEQ ID NO: 4780454 - DNA, 17 bp, Homo sapiens
cccacgcagagccccgg

SEQ ID NO: 4780455 - DNA, 21 bp, Homo sapiens
cccacgccgatataagccata

SEQ ID NO: 4780456 - DNA, 22 bp, Homo sapiens
cccacgccgatataagccatag

SEQ ID NO: 4780457 - DNA, 23 bp, Homo sapiens
cccacgccgatataagccatagc

SEQ ID NO: 4780458 - DNA, 13 bp, Homo sapiens
cccacgcctccat

SEQ ID NO: 4780459 - DNA, 14 bp, Homo sapiens
cccacgcctccatc

SEQ ID NO: 4780460 - DNA, 19 bp, Homo sapiens
cccacggccgtccctgact

SEQ ID NO: 4780461 - DNA, 16 bp, Homo sapiens
cccacgtcctgggtgc

SEQ ID NO: 4780462 - DNA, 23 bp, Homo sapiens
cccactaactgaggagctagtgt

SEQ ID NO: 4780463 - DNA, 18 bp, Homo sapiens
cccactagccctctttct

SEQ ID NO: 4780464 - DNA, 21 bp, Homo sapiens
cccactgatatcacgggcccg

SEQ ID NO: 4780465 - DNA, 16 bp, Homo sapiens
cccactgcccctgcac

SEQ ID NO: 4780466 - DNA, 13 bp, Homo sapiens
cccacttcagcct

SEQ ID NO: 4780467 - DNA, 15 bp, Homo sapiens
cccacttcagcctcc

SEQ ID NO: 4780468 - DNA, 18 bp, Homo sapiens
cccagaaccttgatgggg

SEQ ID NO: 4780469 - DNA, 16 bp, Homo sapiens
cccagaacgggcctcc

SEQ ID NO: 4780470 - DNA, 20 bp, Homo sapiens
cccagaacgggcctccccgg

SEQ ID NO: 4780471 - DNA, 20 bp, Homo sapiens
cccagacgtggtgcttctca

SEQ ID NO: 4780472 - DNA, 16 bp, Homo sapiens
cccagagactgcccac

SEQ ID NO: 4780473 - DNA, 19 bp, Homo sapiens
cccagagactgcccaccct

SEQ ID NO: 4780474 - DNA, 20 bp, Homo sapiens
cccagagactgcccaccctg

SEQ ID NO: 4780475 - DNA, 21 bp, Homo sapiens
cccagagactgcccaccctgg

SEQ ID NO: 4780476 - DNA, 14 bp, Homo sapiens
cccagagagaccct

SEQ ID NO: 4780477 - DNA, 12 bp, Homo sapiens
cccagaggtgga

SEQ ID NO: 4780478 - DNA, 22 bp, Homo sapiens
cccagaggtggatactgggggg

SEQ ID NO: 4780479 - DNA, 16 bp, Homo sapiens
cccagagtatgggcac

SEQ ID NO: 4780480 - DNA, 21 bp, Homo sapiens
cccagagtatgggcactcagg

SEQ ID NO: 4780481 - DNA, 17 bp, Homo sapiens
cccagatacctgtgagg

SEQ ID NO: 4780482 - DNA, 14 bp, Homo sapiens
cccagcacctcctc

SEQ ID NO: 4780483 - DNA, 20 bp, Homo sapiens
cccagcactaaggccgtgtc

SEQ ID NO: 4780484 - DNA, 17 bp, Homo sapiens
cccagcagcgcccgagg

SEQ ID NO: 4780485 - DNA, 13 bp, Homo sapiens
cccagccagcagg

SEQ ID NO: 4780486 - DNA, 24 bp, Homo sapiens
cccagccaggggaactcgccacct

SEQ ID NO: 4780487 - DNA, 19 bp, Homo sapiens
cccagccatggctggatgt

SEQ ID NO: 4780488 - DNA, 17 bp, Homo sapiens
cccagccccctggcatg

SEQ ID NO: 4780489 - DNA, 19 bp, Homo sapiens
cccagccccctggcatgtt

SEQ ID NO: 4780490 - DNA, 17 bp, Homo sapiens
cccagcctatctctctt

SEQ ID NO: 4780491 - DNA, 11 bp, Homo sapiens
cccagcctccc

SEQ ID NO: 4780492 - DNA, 12 bp, Homo sapiens
cccagcctcccc

SEQ ID NO: 4780493 - DNA, 15 bp, Homo sapiens
cccagcctcccccag

SEQ ID NO: 4780494 - DNA, 16 bp, Homo sapiens
cccagcctcccccagg

SEQ ID NO: 4780495 - DNA, 14 bp, Homo sapiens
cccagcgccctcta

SEQ ID NO: 4780496 - DNA, 21 bp, Homo sapiens
cccagctacaggggaggctga

SEQ ID NO: 4780497 - DNA, 18 bp, Homo sapiens
cccagctcctcttcctgc

SEQ ID NO: 4780498 - DNA, 17 bp, Homo sapiens
cccagctggcagcgcct

SEQ ID NO: 4780499 - DNA, 19 bp, Homo sapiens
cccagctggctgggtcgcc

SEQ ID NO: 4780500 - DNA, 12 bp, Homo sapiens
cccagcttcccg

SEQ ID NO: 4780501 - DNA, 11 bp, Homo sapiens
cccaggaaccg

SEQ ID NO: 4780502 - DNA, 18 bp, Homo sapiens
cccaggacccccccagtc

SEQ ID NO: 4780503 - DNA, 20 bp, Homo sapiens
cccaggacccccccagtccg

SEQ ID NO: 4780504 - DNA, 23 bp, Homo sapiens
cccaggacgcatgcagggccccc

SEQ ID NO: 4780505 - DNA, 15 bp, Homo sapiens
cccaggatgcatgca

SEQ ID NO: 4780506 - DNA, 23 bp, Homo sapiens
cccaggatgcatgcagggccccc

SEQ ID NO: 4780507 - DNA, 14 bp, Homo sapiens
cccaggcaccgcca

SEQ ID NO: 4780508 - DNA, 13 bp, Homo sapiens
cccaggcagggag

SEQ ID NO: 4780509 - DNA, 13 bp, Homo sapiens
cccaggcagtctt

SEQ ID NO: 4780510 - DNA, 13 bp, Homo sapiens
cccaggcccgccc

SEQ ID NO: 4780511 - DNA, 13 bp, Homo sapiens
cccaggccggcca

SEQ ID NO: 4780512 - DNA, 15 bp, Homo sapiens
ccccggcctggcccc

SEQ ID NO: 4780513 - DNA, 17 bp, Homo sapiens
ccccgggaaaggccggt

SEQ ID NO: 4780514 - DNA, 13 bp, Homo sapiens
ccccgggcccttt

SEQ ID NO: 4780515 - DNA, 14 bp, Homo sapiens
ccccgtctgcccct

SEQ ID NO: 4780516 - DNA, 23 bp, Homo sapiens
ccccgtctgccccttgaccccac

SEQ ID NO: 4780517 - DNA, 22 bp, Homo sapiens
ccccgtgcggcccgtgcgcagc

SEQ ID NO: 4780518 - DNA, 13 bp, Homo sapiens
ccccgtgctcaca

SEQ ID NO: 4780519 - DNA, 14 bp, Homo sapiens
ccccgtgctcctct

SEQ ID NO: 4780520 - DNA, 19 bp, Homo sapiens
ccccgtgctcctctgcccg

SEQ ID NO: 4780521 - DNA, 20 bp, Homo sapiens
cccctaaaagaaaccctgca

SEQ ID NO: 4780522 - DNA, 14 bp, Homo sapiens
cccctacagatcct

SEQ ID NO: 4780523 - DNA, 14 bp, Homo sapiens
cccctacagcctgc

SEQ ID NO: 4780524 - DNA, 18 bp, Homo sapiens
cccctacagcctgcacac

SEQ ID NO: 4780525 - DNA, 16 bp, Homo sapiens
cccctataccctaggt

SEQ ID NO: 4780526 - DNA, 16 bp, Homo sapiens
cccctatcctgcaccc

SEQ ID NO: 4780527 - DNA, 14 bp, Homo sapiens
cccctatccttggc

SEQ ID NO: 4780528 - DNA, 15 bp, Homo sapiens
cccctatccttggca

SEQ ID NO: 4780529 - DNA, 18 bp, Homo sapiens
cccctatctcttcctgtc

SEQ ID NO: 4780530 - DNA, 21 bp, Homo sapiens
cccctcaagccaggagaccct

SEQ ID NO: 4780531 - DNA, 21 bp, Homo sapiens
cccctcagatgatctctccac

SEQ ID NO: 4780532 - DNA, 23 bp, Homo sapiens
cccctcagatgatctctccacgg

SEQ ID NO: 4780533 - DNA, 19 bp, Homo sapiens
cccctcagccaatgaatca

SEQ ID NO: 4780534 - DNA, 20 bp, Homo sapiens
cccctccagacccctaccct

SEQ ID NO: 4780535 - DNA, 14 bp, Homo sapiens
cccctcccacctcc

SEQ ID NO: 4780536 - DNA, 11 bp, Homo sapiens
cccctcccccg

SEQ ID NO: 4780537 - DNA, 21 bp, Homo sapiens
cccctccgggcagagaccacc

SEQ ID NO: 4780538 - DNA, 21 bp, Homo sapiens
cccctcctccagagcctgggc

SEQ ID NO: 4780539 - DNA, 13 bp, Homo sapiens
cccctcctccatg

SEQ ID NO: 4780540 - DNA, 15 bp, Homo sapiens
cccctcctccatgct

SEQ ID NO: 4780541 - DNA, 20 bp, Homo sapiens
cccctcctccatgctgtccc

SEQ ID NO: 4780542 - DNA, 19 bp, Homo sapiens
cccctcctcgggcgcctgc

SEQ ID NO: 4780543 - DNA, 11 bp, Homo sapiens
cccctcctctc

SEQ ID NO: 4780544 - DNA, 21 bp, Homo sapiens
cccctccttctcccctccaga

SEQ ID NO: 4780545 - DNA, 16 bp, Homo sapiens
cccctcgcgcccctgt

SEQ ID NO: 4780546 - DNA, 18 bp, Homo sapiens
cccctcgcgcccctgtcc

SEQ ID NO: 4780547 - DNA, 19 bp, Homo sapiens
cccctcgcgcccctgtcca

SEQ ID NO: 4780548 - DNA, 16 bp, Homo sapiens
cccctctcctgcatcc

SEQ ID NO: 4780549 - DNA, 19 bp, Homo sapiens
cccctctgcgccccagcga

SEQ ID NO: 4780550 - DNA, 16 bp, Homo sapiens
cccctcttagaagaaa

SEQ ID NO: 4780551 - DNA, 18 bp, Homo sapiens
cccctgaactggccccag

SEQ ID NO: 4780552 - DNA, 21 bp, Homo sapiens
cccctgagggacgagcagagc

SEQ ID NO: 4780553 - DNA, 15 bp, Homo sapiens
cccctgcacccaccc

SEQ ID NO: 4780554 - DNA, 18 bp, Homo sapiens
cccctgcacccacccctg

SEQ ID NO: 4780555 - DNA, 19 bp, Homo sapiens
cccctgcacccacccctgc

SEQ ID NO: 4780556 - DNA, 15 bp, Homo sapiens
cccctgcccagcacc

SEQ ID NO: 4780557 - DNA, 21 bp, Homo sapiens
cccctgcccagcacctcctcc

SEQ ID NO: 4780558 - DNA, 13 bp, Homo sapiens
cccctgccccaga

SEQ ID NO: 4780559 - DNA, 14 bp, Homo sapiens
cccctgccctcggc

SEQ ID NO: 4780560 - DNA, 23 bp, Homo sapiens
cccctgcgccctccctccctcca

SEQ ID NO: 4780561 - DNA, 14 bp, Homo sapiens
cccctgcttctccc

SEQ ID NO: 4780562 - DNA, 24 bp, Homo sapiens
cccctgcttctcccgccattggcc

SEQ ID NO: 4780563 - DNA, 18 bp, Homo sapiens
cccctggaagttgtcctt

SEQ ID NO: 4780564 - DNA, 12 bp, Homo sapiens
cccctggggcct

SEQ ID NO: 4780565 - DNA, 23 bp, Homo sapiens
cccctggggcctagactctgtaa

SEQ ID NO: 4780566 - DNA, 13 bp, Homo sapiens
cccctggtcctgc

SEQ ID NO: 4780567 - DNA, 12 bp, Homo sapiens
cccctgtggtct

SEQ ID NO: 4780568 - DNA, 18 bp, Homo sapiens
cccctgtttctcctccat

SEQ ID NO: 4780569 - DNA, 19 bp, Homo sapiens
cccctgtttctcctccatt

SEQ ID NO: 4780570 - DNA, 21 bp, Homo sapiens
ccccttctaggggcaggtgaa

SEQ ID NO: 4780571 - DNA, 15 bp, Homo sapiens
ccccttgaccccaca

SEQ ID NO: 4780572 - DNA, 12 bp, Homo sapiens
ccccttgcttct

SEQ ID NO: 4780573 - DNA, 13 bp, Homo sapiens
ccccttgcttcta

SEQ ID NO: 4780574 - DNA, 17 bp, Homo sapiens
cccgacctggctgagtg

SEQ ID NO: 4780575 - DNA, 15 bp, Homo sapiens
cccgagccccttggg

SEQ ID NO: 4780576 - DNA, 18 bp, Homo sapiens
cccgagcgcgtgccttcc

SEQ ID NO: 4780577 - DNA, 19 bp, Homo sapiens
cccgagcgcgtgccttccc

SEQ ID NO: 4780578 - DNA, 12 bp, Homo sapiens
cccgaggcagca

SEQ ID NO: 4780579 - DNA, 16 bp, Homo sapiens
cccgaggcagcaacag

SEQ ID NO: 4780580 - DNA, 21 bp, Homo sapiens
cccgaggcagcaacaggacca

SEQ ID NO: 4780581 - DNA, 17 bp, Homo sapiens
cccgagggcgcctgggt

SEQ ID NO: 4780582 - DNA, 16 bp, Homo sapiens
cccgatgtggacctct

SEQ ID NO: 4780583 - DNA, 20 bp, Homo sapiens
cccgcaatgtgcttccgaga

SEQ ID NO: 4780584 - DNA, 11 bp, Homo sapiens
cccgcacagca

SEQ ID NO: 4780585 - DNA, 22 bp, Homo sapiens
cccgcagaggtggggtgctggg

SEQ ID NO: 4780586 - DNA, 14 bp, Homo sapiens
cccgcagcaccagc

SEQ ID NO: 4780587 - DNA, 16 bp, Homo sapiens
cccgcagcaccagcct

SEQ ID NO: 4780588 - DNA, 23 bp, Homo sapiens
cccgcaggcttcgtttgcctcca

SEQ ID NO: 4780589 - DNA, 16 bp, Homo sapiens
cccgcatgctgcctgc

SEQ ID NO: 4780590 - DNA, 22 bp, Homo sapiens
cccgcatgctgcctgcctccgg

SEQ ID NO: 4780591 - DNA, 15 bp, Homo sapiens
cccgccattggcctt

SEQ ID NO: 4780592 - DNA, 16 bp, Homo sapiens
cccgcccaccccgctg

SEQ ID NO: 4780593 - DNA, 19 bp, Homo sapiens
cccgcccaccccgctgcct

SEQ ID NO: 4780594 - DNA, 17 bp, Homo sapiens
cccgcccccacccctac

SEQ ID NO: 4780595 - DNA, 15 bp, Homo sapiens
cccgcccccgccctc

SEQ ID NO: 4780596 - DNA, 16 bp, Homo sapiens
cccgccccgctgctcc

SEQ ID NO: 4780597 - DNA, 16 bp, Homo sapiens
cccgcccctcccccta

SEQ ID NO: 4780598 - DNA, 11 bp, Homo sapiens
cccgccctcgc

SEQ ID NO: 4780599 - DNA, 17 bp, Homo sapiens
cccgccctttccttgcc

SEQ ID NO: 4780600 - DNA, 23 bp, Homo sapiens
cccgccggttggccggctggccg

SEQ ID NO: 4780601 - DNA, 15 bp, Homo sapiens
cccgcctgcgccccc

SEQ ID NO: 4780602 - DNA, 19 bp, Homo sapiens
cccgcgaagtccgaggcct

SEQ ID NO: 4780603 - DNA, 21 bp, Homo sapiens
cccgcgcccgccgcctccctc

SEQ ID NO: 4780604 - DNA, 15 bp, Homo sapiens
cccgcgcgtgccccc

SEQ ID NO: 4780605 - DNA, 18 bp, Homo sapiens
cccgcgcgtgcccccagc

SEQ ID NO: 4780606 - DNA, 14 bp, Homo sapiens
cccgcggagccccc

SEQ ID NO: 4780607 - DNA, 23 bp, Homo sapiens
cccgcggggacgtcgctgtccgt

SEQ ID NO: 4780608 - DNA, 22 bp, Homo sapiens
cccgcgggtggctggagcccca

SEQ ID NO: 4780609 - DNA, 14 bp, Homo sapiens
cccgctgcctggcg

SEQ ID NO: 4780610 - DNA, 19 bp, Homo sapiens
cccggacgcatgcagggcc

SEQ ID NO: 4780611 - DNA, 14 bp, Homo sapiens
cccggaggccttcc

SEQ ID NO: 4780612 - DNA, 15 bp, Homo sapiens
cccggaggcgcccac

SEQ ID NO: 4780613 - DNA, 17 bp, Homo sapiens
cccggaggcgcccacct

SEQ ID NO: 4780614 - DNA, 19 bp, Homo sapiens
cccggaggcgcccacctgc

SEQ ID NO: 4780615 - DNA, 22 bp, Homo sapiens
cccggaggcgcccacctgccca

SEQ ID NO: 4780616 - DNA, 15 bp, Homo sapiens
cccggcaggccctgc

SEQ ID NO: 4780617 - DNA, 19 bp, Homo sapiens
cccggcaggccctgcagtg

SEQ ID NO: 4780618 - DNA, 14 bp, Homo sapiens
cccggcccacgcag

SEQ ID NO: 4780619 - DNA, 15 bp, Homo sapiens
cccggcccacgcaga

SEQ ID NO: 4780620 - DNA, 19 bp, Homo sapiens
cccggcccccctctcgggc

SEQ ID NO: 4780621 - DNA, 13 bp, Homo sapiens
cccggcctcctag

SEQ ID NO: 4780622 - DNA, 12 bp, Homo sapiens
cccggcctgatg

SEQ ID NO: 4780623 - DNA, 19 bp, Homo sapiens
cccggcctgatggccaggc

SEQ ID NO: 4780624 - DNA, 13 bp, Homo sapiens
cccggcctggccc

SEQ ID NO: 4780625 - DNA, 20 bp, Homo sapiens
cccggctgactcagtgcagg

SEQ ID NO: 4780626 - DNA, 18 bp, Homo sapiens
cccgtccctttccctgca

SEQ ID NO: 4780627 - DNA, 19 bp, Homo sapiens
cccgtccctttccctgcat

SEQ ID NO: 4780628 - DNA, 20 bp, Homo sapiens
cccgtctgattgttcctccc

SEQ ID NO: 4780629 - DNA, 12 bp, Homo sapiens
cccgtgctcaca

SEQ ID NO: 4780630 - DNA, 14 bp, Homo sapiens
cccgtgtggcctgg

SEQ ID NO: 4780631 - DNA, 22 bp, Homo sapiens
cccgtgtggcctgggtcctcgg

SEQ ID NO: 4780632 - DNA, 17 bp, Homo sapiens
cccgttcccagcgcatg

SEQ ID NO: 4780633 - DNA, 18 bp, Homo sapiens
cccgttgttgtccctgca

SEQ ID NO: 4780634 - DNA, 17 bp, Homo sapiens
ccgcagggcgctccggc

SEQ ID NO: 4780635 - DNA, 20 bp, Homo sapiens
ccgcagggcgctccggcaga

SEQ ID NO: 4780636 - DNA, 18 bp, Homo sapiens
ccgcatgctgcctgcctc

SEQ ID NO: 4780637 - DNA, 19 bp, Homo sapiens
ccgcatgctgcctgcctcc

SEQ ID NO: 4780638 - DNA, 22 bp, Homo sapiens
ccgcatgctgcctgcctccggc

SEQ ID NO: 4780639 - DNA, 15 bp, Homo sapiens
ccgccagagtgtcct

SEQ ID NO: 4780640 - DNA, 12 bp, Homo sapiens
ccgccagccctg

SEQ ID NO: 4780641 - DNA, 12 bp, Homo sapiens
ccgcccacccag

SEQ ID NO: 4780642 - DNA, 11 bp, Homo sapiens
ccgcccacctg

SEQ ID NO: 4780643 - DNA, 14 bp, Homo sapiens
ccgcccacctgggc

SEQ ID NO: 4780644 - DNA, 19 bp, Homo sapiens
ccgcccacgcggctgctgc

SEQ ID NO: 4780645 - DNA, 15 bp, Homo sapiens
ccgccccagagactg

SEQ ID NO: 4780646 - DNA, 14 bp, Homo sapiens
ccgcccccacccct

SEQ ID NO: 4780647 - DNA, 17 bp, Homo sapiens
ccgcccccgccctcgct

SEQ ID NO: 4780648 - DNA, 17 bp, Homo sapiens
ccgccccggacagggtg

SEQ ID NO: 4780649 - DNA, 16 bp, Homo sapiens
ccgccccgtgctcctc

SEQ ID NO: 4780650 - DNA, 14 bp, Homo sapiens
ccgcccctccccct

SEQ ID NO: 4780651 - DNA, 14 bp, Homo sapiens
ccgcccgcccaccc

SEQ ID NO: 4780652 - DNA, 14 bp, Homo sapiens
ccgcccgcccccgc

SEQ ID NO: 4780653 - DNA, 15 bp, Homo sapiens
ccgcccgcccccgcc

SEQ ID NO: 4780654 - DNA, 13 bp, Homo sapiens
ccgcccggcctcc

SEQ ID NO: 4780655 - DNA, 16 bp, Homo sapiens
ccgcccggcctcctag

SEQ ID NO: 4780656 - DNA, 16 bp, Homo sapiens
ccgccctcctctgccc

SEQ ID NO: 4780657 - DNA, 23 bp, Homo sapiens
ccgccctgcccgcgcccgccgcc

SEQ ID NO: 4780658 - DNA, 15 bp, Homo sapiens
ccgccgaagggcagc

SEQ ID NO: 4780659 - DNA, 20 bp, Homo sapiens
ccgccgaagggcagccccgc

SEQ ID NO: 4780660 - DNA, 22 bp, Homo sapiens
ccgccgaagggcagccccgcga

SEQ ID NO: 4780661 - DNA, 17 bp, Homo sapiens
ccgccgcctccctcacc

SEQ ID NO: 4780662 - DNA, 17 bp, Homo sapiens
ccgcctcccggggtgcc

SEQ ID NO: 4780663 - DNA, 13 bp, Homo sapiens
ccgcctcctccag

SEQ ID NO: 4780664 - DNA, 20 bp, Homo sapiens
ccgcctcgacctctctcaaa

SEQ ID NO: 4780665 - DNA, 16 bp, Homo sapiens
ccgcctcgggccgcct

SEQ ID NO: 4780666 - DNA, 12 bp, Homo sapiens
ccgcgaccaccc

SEQ ID NO: 4780667 - DNA, 16 bp, Homo sapiens
ccgcgaccacccctgt

SEQ ID NO: 4780668 - DNA, 17 bp, Homo sapiens
ccgcgaccacccctgtg

SEQ ID NO: 4780669 - DNA, 22 bp, Homo sapiens
ccgcgcgcgggacagcggcccc

SEQ ID NO: 4780670 - DNA, 23 bp, Homo sapiens
ccgcgcgcgggacagcggccccg

SEQ ID NO: 4780671 - DNA, 15 bp, Homo sapiens
ccgcgcgtgccccca

SEQ ID NO: 4780672 - DNA, 20 bp, Homo sapiens
ccgcgctctgcccctccgtc

SEQ ID NO: 4780673 - DNA, 14 bp, Homo sapiens
ccgcggagcccccg

SEQ ID NO: 4780674 - DNA, 17 bp, Homo sapiens
ccgcgtggttctgccac

SEQ ID NO: 4780675 - DNA, 16 bp, Homo sapiens
ccgctcaacctctcag

SEQ ID NO: 4780676 - DNA, 19 bp, Homo sapiens
ccgctcttcccaagtcctc

SEQ ID NO: 4780677 - DNA, 17 bp, Homo sapiens
ccgctgccgctgcacca

SEQ ID NO: 4780678 - DNA, 21 bp, Homo sapiens
ccgctgcctggcgggcagccc

SEQ ID NO: 4780679 - DNA, 18 bp, Homo sapiens
ccgctgctctcccaggtg

SEQ ID NO: 4780680 - DNA, 14 bp, Homo sapiens
ccgctgctgtgaca

SEQ ID NO: 4780681 - DNA, 17 bp, Homo sapiens
ccgctgctgtgacaggc

SEQ ID NO: 4780682 - DNA, 23 bp, Homo sapiens
ccgctgcttgagtggacagcagc

SEQ ID NO: 4780683 - DNA, 19 bp, Homo sapiens
ccgctgggagaaaagccag

SEQ ID NO: 4780684 - DNA, 21 bp, Homo sapiens
ccgctgggagaaaagccagat

SEQ ID NO: 4780685 - DNA, 22 bp, Homo sapiens
ccgctgggagaaaagccagatg

SEQ ID NO: 4780686 - DNA, 23 bp, Homo sapiens
ccgctgggagaaaagccagatga

SEQ ID NO: 4780687 - DNA, 22 bp, Homo sapiens
ccgctgtcgccccaggccctcc

SEQ ID NO: 4780688 - DNA, 17 bp, Homo sapiens
ccgctgttttggggtct

SEQ ID NO: 4780689 - DNA, 23 bp, Homo sapiens
ccggaaggggcgctcctcccagc

SEQ ID NO: 4780690 - DNA, 14 bp, Homo sapiens
ccggacagggtggc

SEQ ID NO: 4780691 - DNA, 14 bp, Homo sapiens
ccggacccacctca

SEQ ID NO: 4780692 - DNA, 14 bp, Homo sapiens
ccggacgctggctc

SEQ ID NO: 4780693 - DNA, 21 bp, Homo sapiens
ccggagatgcatctgtggcct

SEQ ID NO: 4780694 - DNA, 20 bp, Homo sapiens
ccggagcggctgaggacggg

SEQ ID NO: 4780695 - DNA, 12 bp, Homo sapiens
ccggagctccag

SEQ ID NO: 4780696 - DNA, 22 bp, Homo sapiens
ccggaggcgcccacctgcccag

SEQ ID NO: 4780697 - DNA, 14 bp, Homo sapiens
ccggatcctgttgc

SEQ ID NO: 4780698 - DNA, 15 bp, Homo sapiens
ccggatctccaggcc

SEQ ID NO: 4780699 - DNA, 16 bp, Homo sapiens
ccggatctccaggccc

SEQ ID NO: 4780700 - DNA, 17 bp, Homo sapiens
ccggatctccaggccca

SEQ ID NO: 4780701 - DNA, 18 bp, Homo sapiens
ccggatctccaggcccag

SEQ ID NO: 4780702 - DNA, 19 bp, Homo sapiens
ccggatggaatcacagcca

SEQ ID NO: 4780703 - DNA, 15 bp, Homo sapiens
ccggcaaggggcgcg

SEQ ID NO: 4780704 - DNA, 20 bp, Homo sapiens
ccggcactgtgcactctact

SEQ ID NO: 4780705 - DNA, 14 bp, Homo sapiens
ccggcagaggcagg

SEQ ID NO: 4780706 - DNA, 18 bp, Homo sapiens
ccggcagaggcagggccc

SEQ ID NO: 4780707 - DNA, 19 bp, Homo sapiens
ccggcagaggcagggccct

SEQ ID NO: 4780708 - DNA, 17 bp, Homo sapiens
ccggcaggccctgcagt

SEQ ID NO: 4780709 - DNA, 20 bp, Homo sapiens
ccggcaggccctgcagtgtt

SEQ ID NO: 4780710 - DNA, 18 bp, Homo sapiens
ccggccaaggacactgat

SEQ ID NO: 4780711 - DNA, 14 bp, Homo sapiens
ccggcccacgcaga

SEQ ID NO: 4780712 - DNA, 16 bp, Homo sapiens
ccggcccacgcagagc

SEQ ID NO: 4780713 - DNA, 22 bp, Homo sapiens
ccggcccacgcagagccccgga

SEQ ID NO: 4780714 - DNA, 19 bp, Homo sapiens
ccggcccacgtcctgggtg

SEQ ID NO: 4780715 - DNA, 20 bp, Homo sapiens
ccggcccacgtcctgggtgc

SEQ ID NO: 4780716 - DNA, 16 bp, Homo sapiens
ccggcccccctctcgg

SEQ ID NO: 4780717 - DNA, 11 bp, Homo sapiens
ccggccctgcc

SEQ ID NO: 4780718 - DNA, 22 bp, Homo sapiens
ccggccctgccccacacaggcc

SEQ ID NO: 4780719 - DNA, 15 bp, Homo sapiens
ccggcctggccccct

SEQ ID NO: 4780720 - DNA, 16 bp, Homo sapiens
ccggcctggccccctc

SEQ ID NO: 4780721 - DNA, 14 bp, Homo sapiens
ccggctgactcagt

SEQ ID NO: 4780722 - DNA, 19 bp, Homo sapiens
ccggctggaccacgtctcc

SEQ ID NO: 4780723 - DNA, 18 bp, Homo sapiens
ccggctggccggtccacc

SEQ ID NO: 4780724 - DNA, 13 bp, Homo sapiens
ccgggaaaggccg

SEQ ID NO: 4780725 - DNA, 18 bp, Homo sapiens
ccgggagcctccccctca

SEQ ID NO: 4780726 - DNA, 20 bp, Homo sapiens
ccgggagcctccccctcaga

SEQ ID NO: 4780727 - DNA, 22 bp, Homo sapiens
ccgggagcgcacctcgccgtgt

SEQ ID NO: 4780728 - DNA, 19 bp, Homo sapiens
ccgggcactgtcatgccca

SEQ ID NO: 4780729 - DNA, 13 bp, Homo sapiens
ccgggcagagacc

SEQ ID NO: 4780730 - DNA, 17 bp, Homo sapiens
ccgggcagagaccaccg

SEQ ID NO: 4780731 - DNA, 19 bp, Homo sapiens
ccgggcagagaccaccgcg

SEQ ID NO: 4780732 - DNA, 16 bp, Homo sapiens
ccgggcaggtcctgcc

SEQ ID NO: 4780733 - DNA, 19 bp, Homo sapiens
ccgggcaggtcctgcccat

SEQ ID NO: 4780734 - DNA, 12 bp, Homo sapiens
ccgggcctcggc

SEQ ID NO: 4780735 - DNA, 16 bp, Homo sapiens
ccgggcctcggcctgg

SEQ ID NO: 4780736 - DNA, 12 bp, Homo sapiens
ccgggctggcct

SEQ ID NO: 4780737 - DNA, 13 bp, Homo sapiens
ccgggctggcctg

SEQ ID NO: 4780738 - DNA, 12 bp, Homo sapiens
ccggggctggcc

SEQ ID NO: 4780739 - DNA, 17 bp, Homo sapiens
ccggggctggccctgcc

SEQ ID NO: 4780740 - DNA, 20 bp, Homo sapiens
ccggggtgcccgtgtggcct

SEQ ID NO: 4780741 - DNA, 20 bp, Homo sapiens
ccggggtggagtcagggctg

SEQ ID NO: 4780742 - DNA, 23 bp, Homo sapiens
ccgggtgccccccatgccctccc

SEQ ID NO: 4780743 - DNA, 21 bp, Homo sapiens
ccgggtgcgtgaccggcccgc

SEQ ID NO: 4780744 - DNA, 14 bp, Homo sapiens
ccgggtgtggcctc

SEQ ID NO: 4780745 - DNA, 17 bp, Homo sapiens
ccgggtgtggcctcagc

SEQ ID NO: 4780746 - DNA, 19 bp, Homo sapiens
ccggtcccagtccggtgcc

SEQ ID NO: 4780747 - DNA, 18 bp, Homo sapiens
ccggtgccttccaccctg

SEQ ID NO: 4780748 - DNA, 22 bp, Homo sapiens
ccggtgccttccaccctgccct

SEQ ID NO: 4780749 - DNA, 20 bp, Homo sapiens
ccggttgctctcaaaaccct

SEQ ID NO: 4780750 - DNA, 22 bp, Homo sapiens
ccgtagtatcagagatgtccat

SEQ ID NO: 4780751 - DNA, 20 bp, Homo sapiens
ccgtcaccccgctcttccca

SEQ ID NO: 4780752 - DNA, 15 bp, Homo sapiens
ccgtcagcctgtgaa

SEQ ID NO: 4780753 - DNA, 13 bp, Homo sapiens
ccgtcccggcccc

SEQ ID NO: 4780754 - DNA, 16 bp, Homo sapiens
ccgtccctttccctgc

SEQ ID NO: 4780755 - DNA, 15 bp, Homo sapiens
ccgtccgcccgccca

SEQ ID NO: 4780756 - DNA, 18 bp, Homo sapiens
cctctgaccaacaggctg

SEQ ID NO: 4780757 - DNA, 18 bp, Homo sapiens
cctctgatatgggactga

SEQ ID NO: 4780758 - DNA, 13 bp, Homo sapiens
cctctgccacact

SEQ ID NO: 4780759 - DNA, 11 bp, Homo sapiens
cctctgccccc

SEQ ID NO: 4780760 - DNA, 13 bp, Homo sapiens
cctctgccccctc

SEQ ID NO: 4780761 - DNA, 16 bp, Homo sapiens
cctctgcccctcttcc

SEQ ID NO: 4780762 - DNA, 22 bp, Homo sapiens
cctctgccggtcccccatgcca

SEQ ID NO: 4780763 - DNA, 20 bp, Homo sapiens
cctctgccttagaggagccc

SEQ ID NO: 4780764 - DNA, 17 bp, Homo sapiens
cctctgctgcacagtag

SEQ ID NO: 4780765 - DNA, 17 bp, Homo sapiens
cctctgcttgtcattct

SEQ ID NO: 4780766 - DNA, 21 bp, Homo sapiens
cctctgcttgtcattctgcta

SEQ ID NO: 4780767 - DNA, 18 bp, Homo sapiens
cctctgtccttcccccag

SEQ ID NO: 4780768 - DNA, 20 bp, Homo sapiens
cctctgtccttcccccagca

SEQ ID NO: 4780769 - DNA, 21 bp, Homo sapiens
cctctgtccttcccccagcac

SEQ ID NO: 4780770 - DNA, 18 bp, Homo sapiens
cctcttagcttttctgca

SEQ ID NO: 4780771 - DNA, 17 bp, Homo sapiens
cctcttcaccccggcag

SEQ ID NO: 4780772 - DNA, 14 bp, Homo sapiens
cctcttcccccttc

SEQ ID NO: 4780773 - DNA, 22 bp, Homo sapiens
cctcttctcagctccactctga

SEQ ID NO: 4780774 - DNA, 21 bp, Homo sapiens
cctcttgagagccccacccct

SEQ ID NO: 4780775 - DNA, 15 bp, Homo sapiens
cctctttccccactg

SEQ ID NO: 4780776 - DNA, 17 bp, Homo sapiens
cctctttcctcctcatg

SEQ ID NO: 4780777 - DNA, 15 bp, Homo sapiens
cctctttctctctgt

SEQ ID NO: 4780778 - DNA, 19 bp, Homo sapiens
cctctttctctctgtgtgg

SEQ ID NO: 4780779 - DNA, 15 bp, Homo sapiens
cctctttgagtgaag

SEQ ID NO: 4780780 - DNA, 12 bp, Homo sapiens
cctgaaagccct

SEQ ID NO: 4780781 - DNA, 20 bp, Homo sapiens
cctgaaatattttctacttt

SEQ ID NO: 4780782 - DNA, 22 bp, Homo sapiens
cctgaaatggcctgtccctagg

SEQ ID NO: 4780783 - DNA, 13 bp, Homo sapiens
cctgaacactcat

SEQ ID NO: 4780784 - DNA, 14 bp, Homo sapiens
cctgaactggcccc

SEQ ID NO: 4780785 - DNA, 19 bp, Homo sapiens
cctgaagaaacaaggcatt

SEQ ID NO: 4780786 - DNA, 10 bp, Homo sapiens
cctgaataac

SEQ ID NO: 4780787 - DNA, 12 bp, Homo sapiens
cctgaatcagag

SEQ ID NO: 4780788 - DNA, 14 bp, Homo sapiens
cctgaattaaagtc

SEQ ID NO: 4780789 - DNA, 20 bp, Homo sapiens
cctgaattaaagtctacact

SEQ ID NO: 4780790 - DNA, 23 bp, Homo sapiens
cctgacacaatggtagctctgaa

SEQ ID NO: 4780791 - DNA, 12 bp, Homo sapiens
cctgacacctgc

SEQ ID NO: 4780792 - DNA, 22 bp, Homo sapiens
cctgacacctgccgctgcttga

SEQ ID NO: 4780793 - DNA, 20 bp, Homo sapiens
cctgacactgtctgctgccc

SEQ ID NO: 4780794 - DNA, 22 bp, Homo sapiens
cctgacatgctaacctctctga

SEQ ID NO: 4780795 - DNA, 23 bp, Homo sapiens
cctgaccccaagttatccacctg

SEQ ID NO: 4780796 - DNA, 17 bp, Homo sapiens
cctgactccctgtgggg

SEQ ID NO: 4780797 - DNA, 21 bp, Homo sapiens
cctgactccctgtgggggtgg

SEQ ID NO: 4780798 - DNA, 21 bp, Homo sapiens
cctgactgttctcttactgcc

SEQ ID NO: 4780799 - DNA, 22 bp, Homo sapiens
cctgactgttctcttactgccg

SEQ ID NO: 4780800 - DNA, 15 bp, Homo sapiens
cctgacttcccagct

SEQ ID NO: 4780801 - DNA, 19 bp, Homo sapiens
cctgacttcccagctggca

SEQ ID NO: 4780802 - DNA, 21 bp, Homo sapiens
cctgacttcccagctggcagc

SEQ ID NO: 4780803 - DNA, 21 bp, Homo sapiens
cctgagaaccttagccatcag

SEQ ID NO: 4780804 - DNA, 13 bp, Homo sapiens
cctgagaattgag

SEQ ID NO: 4780805 - DNA, 16 bp, Homo sapiens
cctgagccacagtggg

SEQ ID NO: 4780806 - DNA, 23 bp, Homo sapiens
cctgagccacagtggggcccatg

SEQ ID NO: 4780807 - DNA, 15 bp, Homo sapiens
cctgagcctgtctct

SEQ ID NO: 4780808 - DNA, 16 bp, Homo sapiens
cctgaggacctttctg

SEQ ID NO: 4780809 - DNA, 15 bp, Homo sapiens
cctgaggccaaatat

SEQ ID NO: 4780810 - DNA, 13 bp, Homo sapiens
cctgagggaagcc

SEQ ID NO: 4780811 - DNA, 16 bp, Homo sapiens
cctgagggaagcccac

SEQ ID NO: 4780812 - DNA, 20 bp, Homo sapiens
cctgagggaagcccacccgc

SEQ ID NO: 4780813 - DNA, 20 bp, Homo sapiens
cctgagggacgagcagagcg

SEQ ID NO: 4780814 - DNA, 16 bp, Homo sapiens
cctgaggtcatctgta

SEQ ID NO: 4780815 - DNA, 21 bp, Homo sapiens
cctgaggtcatctgtaaaata

SEQ ID NO: 4780816 - DNA, 20 bp, Homo sapiens
cctgagtcagggcccagagg

SEQ ID NO: 4780817 - DNA, 20 bp, Homo sapiens
cctgatgcgtctacccagac

SEQ ID NO: 4780818 - DNA, 23 bp, Homo sapiens
cctgatgcgtctacccagactca

SEQ ID NO: 4780819 - DNA, 16 bp, Homo sapiens
cctgatggccaggcct

SEQ ID NO: 4780820 - DNA, 18 bp, Homo sapiens
cctgattttaattgtgaa

SEQ ID NO: 4780821 - DNA, 14 bp, Homo sapiens
cctgcaagaacaag

SEQ ID NO: 4780822 - DNA, 21 bp, Homo sapiens
cctgcaaggcccacaggaggc

SEQ ID NO: 4780823 - DNA, 22 bp, Homo sapiens
cctgcaagtggacgtgggctcc

SEQ ID NO: 4780824 - DNA, 19 bp, Homo sapiens
cctgcaatgtatcccttct

SEQ ID NO: 4780825 - DNA, 14 bp, Homo sapiens
cctgcacacacctg

SEQ ID NO: 4780826 - DNA, 18 bp, Homo sapiens
cctgcacacacctgcctg

SEQ ID NO: 4780827 - DNA, 21 bp, Homo sapiens
cctgcacagtggtccagggtc

SEQ ID NO: 4780828 - DNA, 14 bp, Homo sapiens
cctgcacccacccc

SEQ ID NO: 4780829 - DNA, 16 bp, Homo sapiens
cctgcacccacccctg

SEQ ID NO: 4780830 - DNA, 19 bp, Homo sapiens
cctgcacccacccctgccc

SEQ ID NO: 4780831 - DNA, 23 bp, Homo sapiens
cctgcacccacccctgcccaggc

SEQ ID NO: 4780832 - DNA, 17 bp, Homo sapiens
cctgcaccctctgctat

SEQ ID NO: 4780833 - DNA, 19 bp, Homo sapiens
cctgcagaccctgccaggg

SEQ ID NO: 4780834 - DNA, 14 bp, Homo sapiens
cctgcagagcagga

SEQ ID NO: 4780835 - DNA, 14 bp, Homo sapiens
cctgcagagggcac

SEQ ID NO: 4780836 - DNA, 13 bp, Homo sapiens
cctgcagcccaga

SEQ ID NO: 4780837 - DNA, 18 bp, Homo sapiens
cctgcagtctgtggagcg

SEQ ID NO: 4780838 - DNA, 16 bp, Homo sapiens
cctgcatccctccacc

SEQ ID NO: 4780839 - DNA, 16 bp, Homo sapiens
cctgcatcccttggcc

SEQ ID NO: 4780840 - DNA, 21 bp, Homo sapiens
cctgcatcccttggcccctct

SEQ ID NO: 4780841 - DNA, 21 bp, Homo sapiens
cctgcatgtcggggcccctgc

SEQ ID NO: 4780842 - DNA, 14 bp, Homo sapiens
cctgccaactttcc

SEQ ID NO: 4780843 - DNA, 17 bp, Homo sapiens
cctgccacaatgtgata

SEQ ID NO: 4780844 - DNA, 12 bp, Homo sapiens
cctgccaccctc

SEQ ID NO: 4780845 - DNA, 18 bp, Homo sapiens
cctgccaccctctgctgc

SEQ ID NO: 4780846 - DNA, 13 bp, Homo sapiens
cctgccaggaagc

SEQ ID NO: 4780847 - DNA, 23 bp, Homo sapiens
cctgccaggaagccagcaggctc

SEQ ID NO: 4780848 - DNA, 14 bp, Homo sapiens
cctgccaggctgca

SEQ ID NO: 4780849 - DNA, 21 bp, Homo sapiens
cctgccaggctgcagggacag

SEQ ID NO: 4780850 - DNA, 14 bp, Homo sapiens
cctgccatgtgtga

SEQ ID NO: 4780851 - DNA, 16 bp, Homo sapiens
cctgcccactctgacc

SEQ ID NO: 4780852 - DNA, 20 bp, Homo sapiens
cctgcccagagtatgggcac

SEQ ID NO: 4780853 - DNA, 14 bp, Homo sapiens
cctgcccagcacct

SEQ ID NO: 4780854 - DNA, 15 bp, Homo sapiens
cctgcccagcacctc

SEQ ID NO: 4780855 - DNA, 12 bp, Homo sapiens
cctgcccaggca

SEQ ID NO: 4780856 - DNA, 13 bp, Homo sapiens
cctgcccaggccg

SEQ ID NO: 4780857 - DNA, 16 bp, Homo sapiens
cctgcccaggccggcc

SEQ ID NO: 4780858 - DNA, 23 bp, Homo sapiens
cctgccccacacaggcctggccc

SEQ ID NO: 4780859 - DNA, 14 bp, Homo sapiens
cctgccccagagaa

SEQ ID NO: 4780860 - DNA, 17 bp, Homo sapiens
cctgccccagagaagcc

SEQ ID NO: 4780861 - DNA, 21 bp, Homo sapiens
cctgccccagagaagcctcag

SEQ ID NO: 4780862 - DNA, 12 bp, Homo sapiens
cctgccccaggc

SEQ ID NO: 4780863 - DNA, 14 bp, Homo sapiens
cctgccccccttcc

SEQ ID NO: 4780864 - DNA, 20 bp, Homo sapiens
cctgccccccttcccacccc

SEQ ID NO: 4780865 - DNA, 13 bp, Homo sapiens
cctgcccgcacag

SEQ ID NO: 4780866 - DNA, 16 bp, Homo sapiens
cctgcccgcacagcag

SEQ ID NO: 4780867 - DNA, 17 bp, Homo sapiens
cctgcccgcacagcagc

SEQ ID NO: 4780868 - DNA, 15 bp, Homo sapiens
cctgcccgcccgccg

SEQ ID NO: 4780869 - DNA, 21 bp, Homo sapiens
cctgcccgcgcccgccgcctc

SEQ ID NO: 4780870 - DNA, 12 bp, Homo sapiens
cctgccctcact

SEQ ID NO: 4780871 - DNA, 13 bp, Homo sapiens
cctgccctcactc

SEQ ID NO: 4780872 - DNA, 15 bp, Homo sapiens
cctgccctcactcca

SEQ ID NO: 4780873 - DNA, 18 bp, Homo sapiens
cctgccctcactccactc

SEQ ID NO: 4780874 - DNA, 14 bp, Homo sapiens
cctgccctgcacct

SEQ ID NO: 4780875 - DNA, 13 bp, Homo sapiens
cctgccctggcct

SEQ ID NO: 4780876 - DNA, 14 bp, Homo sapiens
cctgccctggccta

SEQ ID NO: 4780877 - DNA, 20 bp, Homo sapiens
cctgccctggcctaccacag

SEQ ID NO: 4780878 - DNA, 13 bp, Homo sapiens
ccttctggccttt

SEQ ID NO: 4780879 - DNA, 24 bp, Homo sapiens
ccttctggggagggacacagagga

SEQ ID NO: 4780880 - DNA, 20 bp, Homo sapiens
ccttctggggaggggctccg

SEQ ID NO: 4780881 - DNA, 13 bp, Homo sapiens
ccttctgtgcatc

SEQ ID NO: 4780882 - DNA, 17 bp, Homo sapiens
ccttctgtgcatctggc

SEQ ID NO: 4780883 - DNA, 20 bp, Homo sapiens
ccttctgtgcatctggcctg

SEQ ID NO: 4780884 - DNA, 22 bp, Homo sapiens
ccttctgtgcatctggcctggg

SEQ ID NO: 4780885 - DNA, 22 bp, Homo sapiens
ccttcttccccaaggcactgag

SEQ ID NO: 4780886 - DNA, 18 bp, Homo sapiens
ccttctttccttcctttt

SEQ ID NO: 4780887 - DNA, 14 bp, Homo sapiens
ccttgaccccacac

SEQ ID NO: 4780888 - DNA, 13 bp, Homo sapiens
ccttgagtctctg

SEQ ID NO: 4780889 - DNA, 14 bp, Homo sapiens
ccttgatggggtga

SEQ ID NO: 4780890 - DNA, 22 bp, Homo sapiens
ccttgccacaatcactaaatat

SEQ ID NO: 4780891 - DNA, 22 bp, Homo sapiens
ccttgccacatcgcagcccctg

SEQ ID NO: 4780892 - DNA, 17 bp, Homo sapiens
ccttgcctgttaggtct

SEQ ID NO: 4780893 - DNA, 14 bp, Homo sapiens
ccttgcttcacttt

SEQ ID NO: 4780894 - DNA, 22 bp, Homo sapiens
ccttgcttccttctcatcttgc

SEQ ID NO: 4780895 - DNA, 16 bp, Homo sapiens
ccttggagagacacag

SEQ ID NO: 4780896 - DNA, 19 bp, Homo sapiens
ccttggagagacacagcgt

SEQ ID NO: 4780897 - DNA, 13 bp, Homo sapiens
ccttggcccagca

SEQ ID NO: 4780898 - DNA, 15 bp, Homo sapiens
ccttggcccagcagc

SEQ ID NO: 4780899 - DNA, 15 bp, Homo sapiens
ccttggcccctctct

SEQ ID NO: 4780900 - DNA, 18 bp, Homo sapiens
ccttggttcctccagcaa

SEQ ID NO: 4780901 - DNA, 11 bp, Homo sapiens
ccttgtacttg

SEQ ID NO: 4780902 - DNA, 16 bp, Homo sapiens
ccttgtactttacaat

SEQ ID NO: 4780903 - DNA, 22 bp, Homo sapiens
ccttgtagacgcacctgctgag

SEQ ID NO: 4780904 - DNA, 18 bp, Homo sapiens
ccttgtgatcactttctg

SEQ ID NO: 4780905 - DNA, 17 bp, Homo sapiens
cctttaataatgttata

SEQ ID NO: 4780906 - DNA, 20 bp, Homo sapiens
cctttacagctctcctccag

SEQ ID NO: 4780907 - DNA, 14 bp, Homo sapiens
cctttaggcaggaa

SEQ ID NO: 4780908 - DNA, 20 bp, Homo sapiens
cctttatcatgtgtttctgt

SEQ ID NO: 4780909 - DNA, 13 bp, Homo sapiens
cctttatgtattc

SEQ ID NO: 4780910 - DNA, 11 bp, Homo sapiens
cctttatttat

SEQ ID NO: 4780911 - DNA, 16 bp, Homo sapiens
cctttcatcctcagca

SEQ ID NO: 4780912 - DNA, 12 bp, Homo sapiens
cctttccatcag

SEQ ID NO: 4780913 - DNA, 14 bp, Homo sapiens
cctttccatcagct

SEQ ID NO: 4780914 - DNA, 15 bp, Homo sapiens
cctttccatcagctt

SEQ ID NO: 4780915 - DNA, 15 bp, Homo sapiens
cctttcccctctcat

SEQ ID NO: 4780916 - DNA, 19 bp, Homo sapiens
cctttcctctcctctctgg

SEQ ID NO: 4780917 - DNA, 22 bp, Homo sapiens
cctttcctgatcaaggtgctct

SEQ ID NO: 4780918 - DNA, 13 bp, Homo sapiens
cctttcttccttc

SEQ ID NO: 4780919 - DNA, 15 bp, Homo sapiens
cctttcttccttcct

SEQ ID NO: 4780920 - DNA, 16 bp, Homo sapiens
cctttcttccttcctt

SEQ ID NO: 4780921 - DNA, 16 bp, Homo sapiens
cctttgcgctctgggt

SEQ ID NO: 4780922 - DNA, 15 bp, Homo sapiens
cctttggtgaataac

SEQ ID NO: 4780923 - DNA, 15 bp, Homo sapiens
cctttgtcaacttca

SEQ ID NO: 4780924 - DNA, 17 bp, Homo sapiens
cctttgtcaacttcagt

SEQ ID NO: 4780925 - DNA, 20 bp, Homo sapiens
cctttgtctcacgattccag

SEQ ID NO: 4780926 - DNA, 17 bp, Homo sapiens
ccttttgtatcctccat

SEQ ID NO: 4780927 - DNA, 15 bp, Homo sapiens
cctttttgaattgtg

SEQ ID NO: 4780928 - DNA, 20 bp, Homo sapiens
ccttttttcctttcttcctt

SEQ ID NO: 4780929 - DNA, 14 bp, Homo sapiens
cgaacatggcatgt

SEQ ID NO: 4780930 - DNA, 13 bp, Homo sapiens
cgaagggcagccc

SEQ ID NO: 4780931 - DNA, 15 bp, Homo sapiens
cgacacaggctgccg

SEQ ID NO: 4780932 - DNA, 11 bp, Homo sapiens
cgaccacccct

SEQ ID NO: 4780933 - DNA, 15 bp, Homo sapiens
cgaccacccctgtgc

SEQ ID NO: 4780934 - DNA, 17 bp, Homo sapiens
cgacccggggcgggctg

SEQ ID NO: 4780935 - DNA, 13 bp, Homo sapiens
cgacctggctgag

SEQ ID NO: 4780936 - DNA, 22 bp, Homo sapiens
cgacgacaaatcttttggcaga

SEQ ID NO: 4780937 - DNA, 21 bp, Homo sapiens
cgacggaggcaggaccaggca

SEQ ID NO: 4780938 - DNA, 20 bp, Homo sapiens
cgacttgggacggaagtggc

SEQ ID NO: 4780939 - DNA, 15 bp, Homo sapiens
cgagagggctgagcc

SEQ ID NO: 4780940 - DNA, 17 bp, Homo sapiens
cgagagggctgagcccc

SEQ ID NO: 4780941 - DNA, 19 bp, Homo sapiens
cgagagggctgagcccctc

SEQ ID NO: 4780942 - DNA, 20 bp, Homo sapiens
cgagagggctgagcccctcc

SEQ ID NO: 4780943 - DNA, 19 bp, Homo sapiens
cgagcagagcgcagccccc

SEQ ID NO: 4780944 - DNA, 20 bp, Homo sapiens
cgagcagagcgcagccccca

SEQ ID NO: 4780945 - DNA, 12 bp, Homo sapiens
cgagcccagatg

SEQ ID NO: 4780946 - DNA, 12 bp, Homo sapiens
cgagcccctgtt

SEQ ID NO: 4780947 - DNA, 17 bp, Homo sapiens
cgagccccttggggagc

SEQ ID NO: 4780948 - DNA, 14 bp, Homo sapiens
cgagctctgtagcc

SEQ ID NO: 4780949 - DNA, 18 bp, Homo sapiens
cgagctctgtagcctggt

SEQ ID NO: 4780950 - DNA, 19 bp, Homo sapiens
cgagctctgtagcctggtc

SEQ ID NO: 4780951 - DNA, 19 bp, Homo sapiens
cgaggcagaatggtgggct

SEQ ID NO: 4780952 - DNA, 17 bp, Homo sapiens
cgaggcctggctctgga

SEQ ID NO: 4780953 - DNA, 13 bp, Homo sapiens
cgaggcttctcta

SEQ ID NO: 4780954 - DNA, 16 bp, Homo sapiens
cgagtcaccttccagg

SEQ ID NO: 4780955 - DNA, 17 bp, Homo sapiens
cgagtcatccagaatgt

SEQ ID NO: 4780956 - DNA, 12 bp, Homo sapiens
cgagtccagaca

SEQ ID NO: 4780957 - DNA, 16 bp, Homo sapiens
cgagtgagctaccagg

SEQ ID NO: 4780958 - DNA, 20 bp, Homo sapiens
cgagtgagctaccaggaaga

SEQ ID NO: 4780959 - DNA, 14 bp, Homo sapiens
cgatataagccata

SEQ ID NO: 4780960 - DNA, 13 bp, Homo sapiens
cgatctcagctca

SEQ ID NO: 4780961 - DNA, 16 bp, Homo sapiens
cgatgtccctgtcccc

SEQ ID NO: 4780962 - DNA, 17 bp, Homo sapiens
cgatgtccctgtcccct

SEQ ID NO: 4780963 - DNA, 21 bp, Homo sapiens
cgatgtccctgtcccctcctc

SEQ ID NO: 4780964 - DNA, 13 bp, Homo sapiens
cgattccagtgca

SEQ ID NO: 4780965 - DNA, 18 bp, Homo sapiens
cgcaagaggtttcagcat

SEQ ID NO: 4780966 - DNA, 22 bp, Homo sapiens
cgcaagcgacacaggctgccgc

SEQ ID NO: 4780967 - DNA, 20 bp, Homo sapiens
cgcacaccctcactctgcca

SEQ ID NO: 4780968 - DNA, 10 bp, Homo sapiens
cgcacagcag

SEQ ID NO: 4780969 - DNA, 14 bp, Homo sapiens
cgcaccgggctggc

SEQ ID NO: 4780970 - DNA, 20 bp, Homo sapiens
cgcaccgggctggcctgaca

SEQ ID NO: 4780971 - DNA, 14 bp, Homo sapiens
cgcacgcggccgct

SEQ ID NO: 4780972 - DNA, 19 bp, Homo sapiens
cgcactcaggagcacagcc

SEQ ID NO: 4780973 - DNA, 13 bp, Homo sapiens
cgcactgggcttg

SEQ ID NO: 4780974 - DNA, 17 bp, Homo sapiens
cgcactgggcttgggga

SEQ ID NO: 4780975 - DNA, 16 bp, Homo sapiens
cgcagacagacagaca

SEQ ID NO: 4780976 - DNA, 16 bp, Homo sapiens
cgcagagccccggagc

SEQ ID NO: 4780977 - DNA, 12 bp, Homo sapiens
cgcagaggtggg

SEQ ID NO: 4780978 - DNA, 14 bp, Homo sapiens
cgcagaggtggggt

SEQ ID NO: 4780979 - DNA, 16 bp, Homo sapiens
cgcagaggtggggtgc

SEQ ID NO: 4780980 - DNA, 17 bp, Homo sapiens
cgcagcaccagcctgag

SEQ ID NO: 4780981 - DNA, 19 bp, Homo sapiens
cgcagcaccagcctgagcc

SEQ ID NO: 4780982 - DNA, 20 bp, Homo sapiens
cgcagcaccagcctgagcca

SEQ ID NO: 4780983 - DNA, 11 bp, Homo sapiens
cgcagccccca

SEQ ID NO: 4780984 - DNA, 16 bp, Homo sapiens
cgcagccccccacgct

SEQ ID NO: 4780985 - DNA, 14 bp, Homo sapiens
cgcagccctgcaga

SEQ ID NO: 4780986 - DNA, 17 bp, Homo sapiens
cgcagccctgcagaggg

SEQ ID NO: 4780987 - DNA, 18 bp, Homo sapiens
cgcagccctgcagagggc

SEQ ID NO: 4780988 - DNA, 18 bp, Homo sapiens
cgcagccgcgctctgccc

SEQ ID NO: 4780989 - DNA, 19 bp, Homo sapiens
cgcagccgcgctctgcccc

SEQ ID NO: 4780990 - DNA, 22 bp, Homo sapiens
cgcagctggcgcgtgtgtggcc

SEQ ID NO: 4780991 - DNA, 16 bp, Homo sapiens
cgcaggaaccgaggac

SEQ ID NO: 4780992 - DNA, 19 bp, Homo sapiens
cgcaggaaccgaggactcc

SEQ ID NO: 4780993 - DNA, 21 bp, Homo sapiens
cgcaggaaccgaggactccag

SEQ ID NO: 4780994 - DNA, 23 bp, Homo sapiens
cgcaggcttcgtttgcctccaga

SEQ ID NO: 4780995 - DNA, 13 bp, Homo sapiens
cgcagggcgctcc

SEQ ID NO: 4780996 - DNA, 21 bp, Homo sapiens
cgcagggcgctccggcagagg

SEQ ID NO: 4780997 - DNA, 23 bp, Homo sapiens
cgcatgcagggcccccactggag

SEQ ID NO: 4780998 - DNA, 16 bp, Homo sapiens
cgcatggcgccccggg

SEQ ID NO: 4780999 - DNA, 12 bp, Homo sapiens
cgcattccaggg

SEQ ID NO: 4781000 - DNA, 16 bp, Homo sapiens
cgccacactggccggc

SEQ ID NO: 4781001 - DNA, 22 bp, Homo sapiens
cggacgctggagaccctgcgcc

SEQ ID NO: 4781002 - DNA, 13 bp, Homo sapiens
cggacgggacagc

SEQ ID NO: 4781003 - DNA, 15 bp, Homo sapiens
cggagaaaggaaggg

SEQ ID NO: 4781004 - DNA, 21 bp, Homo sapiens
cggagaggaccccattctggg

SEQ ID NO: 4781005 - DNA, 16 bp, Homo sapiens
cggagcccccgcccct

SEQ ID NO: 4781006 - DNA, 16 bp, Homo sapiens
cggagcggctgaggac

SEQ ID NO: 4781007 - DNA, 13 bp, Homo sapiens
cggaggcccctga

SEQ ID NO: 4781008 - DNA, 15 bp, Homo sapiens
cggaggcccctgagg

SEQ ID NO: 4781009 - DNA, 16 bp, Homo sapiens
cggaggcgcccacctg

SEQ ID NO: 4781010 - DNA, 19 bp, Homo sapiens
cggaggcgcccacctgccc

SEQ ID NO: 4781011 - DNA, 21 bp, Homo sapiens
cggaggcgcccacctgcccag

SEQ ID NO: 4781012 - DNA, 14 bp, Homo sapiens
cggaggctgggccc

SEQ ID NO: 4781013 - DNA, 16 bp, Homo sapiens
cggagtttccatttgg

SEQ ID NO: 4781014 - DNA, 13 bp, Homo sapiens
cggatctccaggc

SEQ ID NO: 4781015 - DNA, 14 bp, Homo sapiens
cggatctccaggcc

SEQ ID NO: 4781016 - DNA, 19 bp, Homo sapiens
cggatggaatcacagccaa

SEQ ID NO: 4781017 - DNA, 15 bp, Homo sapiens
cggcaaagatccagc

SEQ ID NO: 4781018 - DNA, 12 bp, Homo sapiens
cggcaccgccca

SEQ ID NO: 4781019 - DNA, 13 bp, Homo sapiens
cggcaccgcccac

SEQ ID NO: 4781020 - DNA, 16 bp, Homo sapiens
cggcaccgcccaccca

SEQ ID NO: 4781021 - DNA, 21 bp, Homo sapiens
cggcaccgcccacccacaccc

SEQ ID NO: 4781022 - DNA, 15 bp, Homo sapiens
cggcactgtgcactc

SEQ ID NO: 4781023 - DNA, 16 bp, Homo sapiens
cggcacttcaagcaaa

SEQ ID NO: 4781024 - DNA, 15 bp, Homo sapiens
cggcagaggcagggc

SEQ ID NO: 4781025 - DNA, 17 bp, Homo sapiens
cggcagaggcagggccc

SEQ ID NO: 4781026 - DNA, 15 bp, Homo sapiens
cggcagccccatcct

SEQ ID NO: 4781027 - DNA, 15 bp, Homo sapiens
cggcaggccctgcag

SEQ ID NO: 4781028 - DNA, 15 bp, Homo sapiens
cggcatccgagcccc

SEQ ID NO: 4781029 - DNA, 12 bp, Homo sapiens
cggcatgtttcc

SEQ ID NO: 4781030 - DNA, 19 bp, Homo sapiens
cggccactgcaacccatga

SEQ ID NO: 4781031 - DNA, 17 bp, Homo sapiens
cggcccacaattaattt

SEQ ID NO: 4781032 - DNA, 17 bp, Homo sapiens
cggcccacgcagagccc

SEQ ID NO: 4781033 - DNA, 23 bp, Homo sapiens
cggcccacgcagagccccggagc

SEQ ID NO: 4781034 - DNA, 15 bp, Homo sapiens
cggcccacgtcctgg

SEQ ID NO: 4781035 - DNA, 23 bp, Homo sapiens
cggcccagggggaagatgccaag

SEQ ID NO: 4781036 - DNA, 19 bp, Homo sapiens
cggccccgcgcgtgccccc

SEQ ID NO: 4781037 - DNA, 22 bp, Homo sapiens
cggccccgcgcgtgcccccagc

SEQ ID NO: 4781038 - DNA, 16 bp, Homo sapiens
cggcccggcccacgca

SEQ ID NO: 4781039 - DNA, 17 bp, Homo sapiens
cggcccgtgcgcagccg

SEQ ID NO: 4781040 - DNA, 11 bp, Homo sapiens
cggccctgccc

SEQ ID NO: 4781041 - DNA, 20 bp, Homo sapiens
cggccctgccccacacaggc

SEQ ID NO: 4781042 - DNA, 15 bp, Homo sapiens
cggccctgtagccct

SEQ ID NO: 4781043 - DNA, 17 bp, Homo sapiens
cggccctgtagccctgg

SEQ ID NO: 4781044 - DNA, 19 bp, Homo sapiens
cggccctgtagccctggcc

SEQ ID NO: 4781045 - DNA, 17 bp, Homo sapiens
cggccgctctccgcccc

SEQ ID NO: 4781046 - DNA, 18 bp, Homo sapiens
cggccgctctccgccccc

SEQ ID NO: 4781047 - DNA, 13 bp, Homo sapiens
cggcctcctagcc

SEQ ID NO: 4781048 - DNA, 19 bp, Homo sapiens
cggcctgatggccaggcct

SEQ ID NO: 4781049 - DNA, 19 bp, Homo sapiens
cggcctgcagaccctgcca

SEQ ID NO: 4781050 - DNA, 20 bp, Homo sapiens
cggcctgcagaccctgccag

SEQ ID NO: 4781051 - DNA, 12 bp, Homo sapiens
cggcctgcagcc

SEQ ID NO: 4781052 - DNA, 13 bp, Homo sapiens
cggcctgcagccc

SEQ ID NO: 4781053 - DNA, 16 bp, Homo sapiens
cggcctggccccctcg

SEQ ID NO: 4781054 - DNA, 18 bp, Homo sapiens
cggcgccccggacgccgc

SEQ ID NO: 4781055 - DNA, 21 bp, Homo sapiens
cggctgaggacggggcagagc

SEQ ID NO: 4781056 - DNA, 22 bp, Homo sapiens
cggctggccggtccaccccgtc

SEQ ID NO: 4781057 - DNA, 13 bp, Homo sapiens
cggctgggcaggg

SEQ ID NO: 4781058 - DNA, 17 bp, Homo sapiens
cggctgggcagggccgc

SEQ ID NO: 4781059 - DNA, 19 bp, Homo sapiens
cggctgtgtggggagggtg

SEQ ID NO: 4781060 - DNA, 20 bp, Homo sapiens
cgggaaaggccggtgggaag

SEQ ID NO: 4781061 - DNA, 13 bp, Homo sapiens
cgggaacgccccc

SEQ ID NO: 4781062 - DNA, 18 bp, Homo sapiens
cgggaacgcttgctctta

SEQ ID NO: 4781063 - DNA, 14 bp, Homo sapiens
cgggaaggcctgag

SEQ ID NO: 4781064 - DNA, 20 bp, Homo sapiens
cgggaaggcctgagggaagc

SEQ ID NO: 4781065 - DNA, 16 bp, Homo sapiens
cgggacagcggcccgg

SEQ ID NO: 4781066 - DNA, 18 bp, Homo sapiens
cgggacagcggcccggcc

SEQ ID NO: 4781067 - DNA, 14 bp, Homo sapiens
cgggacaggacttg

SEQ ID NO: 4781068 - DNA, 23 bp, Homo sapiens
cgggactgtcttcaaccctgccc

SEQ ID NO: 4781069 - DNA, 20 bp, Homo sapiens
cgggagagcgccacccgccc

SEQ ID NO: 4781070 - DNA, 14 bp, Homo sapiens
cgggattacagaaa

SEQ ID NO: 4781071 - DNA, 12 bp, Homo sapiens
cgggcagcccct

SEQ ID NO: 4781072 - DNA, 17 bp, Homo sapiens
cgggcagcccctgctgg

SEQ ID NO: 4781073 - DNA, 22 bp, Homo sapiens
cgggccatttcacattcctgac

SEQ ID NO: 4781074 - DNA, 19 bp, Homo sapiens
cgggccccatggtcacaga

SEQ ID NO: 4781075 - DNA, 19 bp, Homo sapiens
cgggcccgcactcaggagc

SEQ ID NO: 4781076 - DNA, 20 bp, Homo sapiens
cgggcccgcactcaggagca

SEQ ID NO: 4781077 - DNA, 17 bp, Homo sapiens
cgggcccgctcaacctc

SEQ ID NO: 4781078 - DNA, 22 bp, Homo sapiens
cgggccctctctccgccccgga

SEQ ID NO: 4781079 - DNA, 17 bp, Homo sapiens
cgggccgcctcctccag

SEQ ID NO: 4781080 - DNA, 23 bp, Homo sapiens
cgggcctccccgggggtccccgg

SEQ ID NO: 4781081 - DNA, 17 bp, Homo sapiens
cgggcctcggcctggct

SEQ ID NO: 4781082 - DNA, 20 bp, Homo sapiens
cgggcctcggcctggcttca

SEQ ID NO: 4781083 - DNA, 18 bp, Homo sapiens
cgggcgcctgcgctcctc

SEQ ID NO: 4781084 - DNA, 22 bp, Homo sapiens
cgggcgcctgcgctcctctgca

SEQ ID NO: 4781085 - DNA, 23 bp, Homo sapiens
cgggcgcctgcgctcctctgcag

SEQ ID NO: 4781086 - DNA, 21 bp, Homo sapiens
cgggctctctcacccagcctg

SEQ ID NO: 4781087 - DNA, 15 bp, Homo sapiens
cgggctggcctgaca

SEQ ID NO: 4781088 - DNA, 13 bp, Homo sapiens
cggggcagagctg

SEQ ID NO: 4781089 - DNA, 12 bp, Homo sapiens
cggggcccctgc

SEQ ID NO: 4781090 - DNA, 19 bp, Homo sapiens
cggggcccgccccaggccc

SEQ ID NO: 4781091 - DNA, 22 bp, Homo sapiens
cggggcggcatccgagcccctg

SEQ ID NO: 4781092 - DNA, 13 bp, Homo sapiens
cggggctggccct

SEQ ID NO: 4781093 - DNA, 17 bp, Homo sapiens
cgggggaagctgagccc

SEQ ID NO: 4781094 - DNA, 22 bp, Homo sapiens
cgggggaggagcacccccagcc

SEQ ID NO: 4781095 - DNA, 15 bp, Homo sapiens
cgggggcggctctgg

SEQ ID NO: 4781096 - DNA, 18 bp, Homo sapiens
cgggggctaactggcccc

SEQ ID NO: 4781097 - DNA, 20 bp, Homo sapiens
cgggggctaactggccccag

SEQ ID NO: 4781098 - DNA, 23 bp, Homo sapiens
cgggggctaactggccccaggcg

SEQ ID NO: 4781099 - DNA, 15 bp, Homo sapiens
cggggtcgggggagg

SEQ ID NO: 4781100 - DNA, 16 bp, Homo sapiens
cggggtgcccgtgtgg

SEQ ID NO: 4781101 - DNA, 20 bp, Homo sapiens
cggggtgcccgtgtggcctg

SEQ ID NO: 4781102 - DNA, 11 bp, Homo sapiens
cgggtctgtgg

SEQ ID NO: 4781103 - DNA, 22 bp, Homo sapiens
cgggtgcatttgagagaagcca

SEQ ID NO: 4781104 - DNA, 17 bp, Homo sapiens
cgggtgccccccatgcc

SEQ ID NO: 4781105 - DNA, 21 bp, Homo sapiens
cgggtgccccccatgccctcc

SEQ ID NO: 4781106 - DNA, 15 bp, Homo sapiens
cgggtggctggagcc

SEQ ID NO: 4781107 - DNA, 20 bp, Homo sapiens
cgggtggctggagccccatc

SEQ ID NO: 4781108 - DNA, 14 bp, Homo sapiens
cgggtggggcctgc

SEQ ID NO: 4781109 - DNA, 22 bp, Homo sapiens
cgggtgtggcctcagccctcag

SEQ ID NO: 4781110 - DNA, 15 bp, Homo sapiens
cgggttctcccatga

SEQ ID NO: 4781111 - DNA, 14 bp, Homo sapiens
cggtattatgcttc

SEQ ID NO: 4781112 - DNA, 16 bp, Homo sapiens
cggtattatgcttctt

SEQ ID NO: 4781113 - DNA, 20 bp, Homo sapiens
cggtcactgcccacctgcca

SEQ ID NO: 4781114 - DNA, 22 bp, Homo sapiens
cggtcactgcccacctgccagg

SEQ ID NO: 4781115 - DNA, 16 bp, Homo sapiens
cggtcccagtccggtg

SEQ ID NO: 4781116 - DNA, 21 bp, Homo sapiens
cggtcccagtccggtgccttc

SEQ ID NO: 4781117 - DNA, 16 bp, Homo sapiens
cggtgccttccaccct

SEQ ID NO: 4781118 - DNA, 13 bp, Homo sapiens
cggtggccttgag

SEQ ID NO: 4781119 - DNA, 16 bp, Homo sapiens
cggtgggcgcctgtcg

SEQ ID NO: 4781120 - DNA, 17 bp, Homo sapiens
cggtgtgagatggtgcc

SEQ ID NO: 4781121 - DNA, 23 bp, Homo sapiens
cgtaaaggtttatttttctgtta

SEQ ID NO: 4781122 - DNA, 16 bp, Homo sapiens
cgtacattgtgccctg

SEQ ID NO: 4781123 - DNA, 11 bp, Homo sapiens
ctaggtgctca

SEQ ID NO: 4781124 - DNA, 22 bp, Homo sapiens
ctaggtgggtcaactccaaggc

SEQ ID NO: 4781125 - DNA, 23 bp, Homo sapiens
ctaggtgggtcaactccaaggca

SEQ ID NO: 4781126 - DNA, 17 bp, Homo sapiens
ctaggttaataggagga

SEQ ID NO: 4781127 - DNA, 22 bp, Homo sapiens
ctagtatcactgctttttcctt

SEQ ID NO: 4781128 - DNA, 16 bp, Homo sapiens
ctagtctgtcagggcc

SEQ ID NO: 4781129 - DNA, 15 bp, Homo sapiens
ctagtctgtgcctca

SEQ ID NO: 4781130 - DNA, 14 bp, Homo sapiens
ctagtgctaaacct

SEQ ID NO: 4781131 - DNA, 16 bp, Homo sapiens
ctagtgttaatccaga

SEQ ID NO: 4781132 - DNA, 18 bp, Homo sapiens
ctagtgttaatccagaga

SEQ ID NO: 4781133 - DNA, 16 bp, Homo sapiens
ctagttagagactcgc

SEQ ID NO: 4781134 - DNA, 18 bp, Homo sapiens
ctagttctttgcattcgt

SEQ ID NO: 4781135 - DNA, 14 bp, Homo sapiens
ctagttgacttcaa

SEQ ID NO: 4781136 - DNA, 22 bp, Homo sapiens
ctataaaagcccatgcttaaat

SEQ ID NO: 4781137 - DNA, 19 bp, Homo sapiens
ctataaatagtgaaaattt

SEQ ID NO: 4781138 - DNA, 14 bp, Homo sapiens
ctataaatggactt

SEQ ID NO: 4781139 - DNA, 16 bp, Homo sapiens
ctataagagacaaagt

SEQ ID NO: 4781140 - DNA, 14 bp, Homo sapiens
ctataatgtgaaat

SEQ ID NO: 4781141 - DNA, 22 bp, Homo sapiens
ctataatttacctgaagtcttt

SEQ ID NO: 4781142 - DNA, 21 bp, Homo sapiens
ctataccctaggtctccaccc

SEQ ID NO: 4781143 - DNA, 17 bp, Homo sapiens
ctataccggagctccag

SEQ ID NO: 4781144 - DNA, 22 bp, Homo sapiens
ctataccggagctccagtttct

SEQ ID NO: 4781145 - DNA, 14 bp, Homo sapiens
ctatagattcttta

SEQ ID NO: 4781146 - DNA, 21 bp, Homo sapiens
ctatataaaaaatatatgtaa

SEQ ID NO: 4781147 - DNA, 22 bp, Homo sapiens
ctatatacatcacgttaaagta

SEQ ID NO: 4781148 - DNA, 22 bp, Homo sapiens
ctatatatacatatacacaaag

SEQ ID NO: 4781149 - DNA, 15 bp, Homo sapiens
ctatatatacatgta

SEQ ID NO: 4781150 - DNA, 18 bp, Homo sapiens
ctatatatacatgtatag

SEQ ID NO: 4781151 - DNA, 20 bp, Homo sapiens
ctatatatatatatatatgt

SEQ ID NO: 4781152 - DNA, 22 bp, Homo sapiens
ctatatatatatatatatgtat

SEQ ID NO: 4781153 - DNA, 22 bp, Homo sapiens
ctatattccaggtttaagtaga

SEQ ID NO: 4781154 - DNA, 11 bp, Homo sapiens
ctatatttact

SEQ ID NO: 4781155 - DNA, 22 bp, Homo sapiens
ctatatttggattcacagcctt

SEQ ID NO: 4781156 - DNA, 15 bp, Homo sapiens
ctatcagggcaagct

SEQ ID NO: 4781157 - DNA, 22 bp, Homo sapiens
ctatccacagaacctttgtcaa

SEQ ID NO: 4781158 - DNA, 17 bp, Homo sapiens
ctatccagccgcaaatc

SEQ ID NO: 4781159 - DNA, 16 bp, Homo sapiens
ctatccatgcaccaaa

SEQ ID NO: 4781160 - DNA, 20 bp, Homo sapiens
ctatccccggacgcatgcag

SEQ ID NO: 4781161 - DNA, 22 bp, Homo sapiens
ctatccccggacgcatgcaggg

SEQ ID NO: 4781162 - DNA, 20 bp, Homo sapiens
ctatccctggacgcatgcag

SEQ ID NO: 4781163 - DNA, 15 bp, Homo sapiens
ctatcctgcaccctc

SEQ ID NO: 4781164 - DNA, 21 bp, Homo sapiens
ctatcctgcaccctctgctat

SEQ ID NO: 4781165 - DNA, 12 bp, Homo sapiens
ctatccttggca

SEQ ID NO: 4781166 - DNA, 18 bp, Homo sapiens
ctatccttggcaccaaag

SEQ ID NO: 4781167 - DNA, 22 bp, Homo sapiens
ctatccttttttattgaataac

SEQ ID NO: 4781168 - DNA, 19 bp, Homo sapiens
ctatccttttttcctttcc

SEQ ID NO: 4781169 - DNA, 22 bp, Homo sapiens
ctatccttttttcctttcctga

SEQ ID NO: 4781170 - DNA, 17 bp, Homo sapiens
ctatcgatctggaaaga

SEQ ID NO: 4781171 - DNA, 13 bp, Homo sapiens
ctatctagtgtct

SEQ ID NO: 4781172 - DNA, 15 bp, Homo sapiens
ctatctcttcctgtc

SEQ ID NO: 4781173 - DNA, 20 bp, Homo sapiens
ctatctggaaaaaaaaaaat

SEQ ID NO: 4781174 - DNA, 12 bp, Homo sapiens
ctatctgggcct

SEQ ID NO: 4781175 - DNA, 13 bp, Homo sapiens
ctatctgggcctg

SEQ ID NO: 4781176 - DNA, 19 bp, Homo sapiens
ctatctgtattggcagcac

SEQ ID NO: 4781177 - DNA, 23 bp, Homo sapiens
ctatgaagtttattttctatttt

SEQ ID NO: 4781178 - DNA, 14 bp, Homo sapiens
ctatgaccctgtgc

SEQ ID NO: 4781179 - DNA, 19 bp, Homo sapiens
ctatgaccctgtgcctgtg

SEQ ID NO: 4781180 - DNA, 21 bp, Homo sapiens
ctatgatatgtgcttgtgtgt

SEQ ID NO: 4781181 - DNA, 19 bp, Homo sapiens
ctatgatgtccaaacttaa

SEQ ID NO: 4781182 - DNA, 23 bp, Homo sapiens
ctatgattccaattactactttg

SEQ ID NO: 4781183 - DNA, 15 bp, Homo sapiens
ctatgcacaccaaat

SEQ ID NO: 4781184 - DNA, 19 bp, Homo sapiens
ctatgcattttaaagttaa

SEQ ID NO: 4781185 - DNA, 19 bp, Homo sapiens
ctatgctctggaaaacctg

SEQ ID NO: 4781186 - DNA, 14 bp, Homo sapiens
ctatgctgtatctg

SEQ ID NO: 4781187 - DNA, 21 bp, Homo sapiens
ctatggaaagggtgtggcttg

SEQ ID NO: 4781188 - DNA, 16 bp, Homo sapiens
ctatggaccaaatgta

SEQ ID NO: 4781189 - DNA, 18 bp, Homo sapiens
ctatggactgcacaaaag

SEQ ID NO: 4781190 - DNA, 20 bp, Homo sapiens
ctatggattcacttctattt

SEQ ID NO: 4781191 - DNA, 17 bp, Homo sapiens
ctatggtatgctggcca

SEQ ID NO: 4781192 - DNA, 20 bp, Homo sapiens
ctatggtatgctggccagca

SEQ ID NO: 4781193 - DNA, 20 bp, Homo sapiens
ctatgtcactaccctcctgt

SEQ ID NO: 4781194 - DNA, 13 bp, Homo sapiens
ctatgtctgtgat

SEQ ID NO: 4781195 - DNA, 14 bp, Homo sapiens
ctatgtgagaccat

SEQ ID NO: 4781196 - DNA, 11 bp, Homo sapiens
ctatgtgtata

SEQ ID NO: 4781197 - DNA, 19 bp, Homo sapiens
ctatgtgtatatattatat

SEQ ID NO: 4781198 - DNA, 12 bp, Homo sapiens
ctattaactctg

SEQ ID NO: 4781199 - DNA, 13 bp, Homo sapiens
ctattaagaaact

SEQ ID NO: 4781200 - DNA, 13 bp, Homo sapiens
ctattaatttatt

SEQ ID NO: 4781201 - DNA, 14 bp, Homo sapiens
ctattaatttatta

SEQ ID NO: 4781202 - DNA, 16 bp, Homo sapiens
ctattaatttattaaa

SEQ ID NO: 4781203 - DNA, 19 bp, Homo sapiens
ctattaatttattaaattt

SEQ ID NO: 4781204 - DNA, 17 bp, Homo sapiens
ctattataattgtcatg

SEQ ID NO: 4781205 - DNA, 21 bp, Homo sapiens
ctattcaagaagatagttgta

SEQ ID NO: 4781206 - DNA, 15 bp, Homo sapiens
ctattcacacacaca

SEQ ID NO: 4781207 - DNA, 18 bp, Homo sapiens
ctattcattacatcctct

SEQ ID NO: 4781208 - DNA, 12 bp, Homo sapiens
ctattcccaggc

SEQ ID NO: 4781209 - DNA, 15 bp, Homo sapiens
ctattcccaggcagg

SEQ ID NO: 4781210 - DNA, 16 bp, Homo sapiens
ctattcccaggcaggg

SEQ ID NO: 4781211 - DNA, 18 bp, Homo sapiens
ctattcccaggcagggag

SEQ ID NO: 4781212 - DNA, 17 bp, Homo sapiens
ctattccttctggcctt

SEQ ID NO: 4781213 - DNA, 17 bp, Homo sapiens
ctattcgtaagttctgt

SEQ ID NO: 4781214 - DNA, 15 bp, Homo sapiens
ctattggacagacac

SEQ ID NO: 4781215 - DNA, 20 bp, Homo sapiens
ctattgtaatatagaaaaaa

SEQ ID NO: 4781216 - DNA, 16 bp, Homo sapiens
ctattgtccttgtgta

SEQ ID NO: 4781217 - DNA, 11 bp, Homo sapiens
ctatttaagtg

SEQ ID NO: 4781218 - DNA, 19 bp, Homo sapiens
ctatttaagtggactgtat

SEQ ID NO: 4781219 - DNA, 20 bp, Homo sapiens
ctatttaagtggactgtatt

SEQ ID NO: 4781220 - DNA, 16 bp, Homo sapiens
ctatttatctgtctga

SEQ ID NO: 4781221 - DNA, 16 bp, Homo sapiens
ctatttctttcatcag

SEQ ID NO: 4781222 - DNA, 12 bp, Homo sapiens
ctatttgatttg

SEQ ID NO: 4781223 - DNA, 16 bp, Homo sapiens
ctatttgtgtaactga

SEQ ID NO: 4781224 - DNA, 17 bp, Homo sapiens
ctcaaaataaaaccaga

SEQ ID NO: 4781225 - DNA, 23 bp, Homo sapiens
ctcaaaataaaaccagaaagagg

SEQ ID NO: 4781226 - DNA, 13 bp, Homo sapiens
ctcaaagaagtac

SEQ ID NO: 4781227 - DNA, 14 bp, Homo sapiens
ctcaacacacagta

SEQ ID NO: 4781228 - DNA, 13 bp, Homo sapiens
ctcaacctacctc

SEQ ID NO: 4781229 - DNA, 14 bp, Homo sapiens
ctcaactctcctcc

SEQ ID NO: 4781230 - DNA, 20 bp, Homo sapiens
ctcaactctcctccagagtc

SEQ ID NO: 4781231 - DNA, 16 bp, Homo sapiens
ctcaagatactggact

SEQ ID NO: 4781232 - DNA, 18 bp, Homo sapiens
ctcaagatactggactaa

SEQ ID NO: 4781233 - DNA, 16 bp, Homo sapiens
ctcaagccaggagacc

SEQ ID NO: 4781234 - DNA, 19 bp, Homo sapiens
ctcaagccaggagaccctg

SEQ ID NO: 4781235 - DNA, 23 bp, Homo sapiens
ctcaagccaggagaccctgtctt

SEQ ID NO: 4781236 - DNA, 20 bp, Homo sapiens
ctcaagcgctatccacagaa

SEQ ID NO: 4781237 - DNA, 12 bp, Homo sapiens
ctcaaggctgca

SEQ ID NO: 4781238 - DNA, 18 bp, Homo sapiens
ctcaagttgtgtgctatt

SEQ ID NO: 4781239 - DNA, 16 bp, Homo sapiens
ctcaatcatgacttct

SEQ ID NO: 4781240 - DNA, 13 bp, Homo sapiens
ctcaatcattgtc

SEQ ID NO: 4781241 - DNA, 19 bp, Homo sapiens
ctcaatcattgtcagagat

SEQ ID NO: 4781242 - DNA, 23 bp, Homo sapiens
ctcaatcattgtcagagatgttt

SEQ ID NO: 4781243 - DNA, 17 bp, Homo sapiens
ctcaatgcttttctagc

SEQ ID NO: 4781244 - DNA, 11 bp, Homo sapiens
ctcaatgtgct

SEQ ID NO: 4781245 - DNA, 14 bp, Homo sapiens
ctccgcggaggccc

SEQ ID NO: 4781246 - DNA, 15 bp, Homo sapiens
ctccgcggaggcccc

SEQ ID NO: 4781247 - DNA, 16 bp, Homo sapiens
ctccgcgtgtctcatt

SEQ ID NO: 4781248 - DNA, 16 bp, Homo sapiens
ctccggaaggacacag

SEQ ID NO: 4781249 - DNA, 15 bp, Homo sapiens
ctccggcagaggcag

SEQ ID NO: 4781250 - DNA, 17 bp, Homo sapiens
ctccggcagaggcaggg

SEQ ID NO: 4781251 - DNA, 18 bp, Homo sapiens
ctccggcagaggcagggc

SEQ ID NO: 4781252 - DNA, 19 bp, Homo sapiens
ctccggcagaggcagggcc

SEQ ID NO: 4781253 - DNA, 16 bp, Homo sapiens
ctccgggcctcggcct

SEQ ID NO: 4781254 - DNA, 22 bp, Homo sapiens
ctccgggtgcgtgaccggcccg

SEQ ID NO: 4781255 - DNA, 15 bp, Homo sapiens
ctccgtccccagggt

SEQ ID NO: 4781256 - DNA, 18 bp, Homo sapiens
ctccgtttccaaatacat

SEQ ID NO: 4781257 - DNA, 23 bp, Homo sapiens
ctcctagaggggacaagccaggc

SEQ ID NO: 4781258 - DNA, 13 bp, Homo sapiens
ctcctcactgcca

SEQ ID NO: 4781259 - DNA, 15 bp, Homo sapiens
ctcctcactgccact

SEQ ID NO: 4781260 - DNA, 16 bp, Homo sapiens
ctcctcactgcccgca

SEQ ID NO: 4781261 - DNA, 15 bp, Homo sapiens
ctcctccagagcctg

SEQ ID NO: 4781262 - DNA, 15 bp, Homo sapiens
ctcctccagagtcag

SEQ ID NO: 4781263 - DNA, 16 bp, Homo sapiens
ctcctccagccctggg

SEQ ID NO: 4781264 - DNA, 17 bp, Homo sapiens
ctcctccagccctgggc

SEQ ID NO: 4781265 - DNA, 18 bp, Homo sapiens
ctcctccagccctgggca

SEQ ID NO: 4781266 - DNA, 17 bp, Homo sapiens
ctcctccagtacaataa

SEQ ID NO: 4781267 - DNA, 16 bp, Homo sapiens
ctcctccatgctgtcc

SEQ ID NO: 4781268 - DNA, 13 bp, Homo sapiens
ctcctcccaactc

SEQ ID NO: 4781269 - DNA, 18 bp, Homo sapiens
ctcctcccaactctggcc

SEQ ID NO: 4781270 - DNA, 11 bp, Homo sapiens
ctcctcccagc

SEQ ID NO: 4781271 - DNA, 15 bp, Homo sapiens
ctcctcccccacgcc

SEQ ID NO: 4781272 - DNA, 19 bp, Homo sapiens
ctcctcccccacgcctcca

SEQ ID NO: 4781273 - DNA, 15 bp, Homo sapiens
ctcctccccctcctc

SEQ ID NO: 4781274 - DNA, 18 bp, Homo sapiens
ctcctccccctcctccat

SEQ ID NO: 4781275 - DNA, 12 bp, Homo sapiens
ctcctcctgcat

SEQ ID NO: 4781276 - DNA, 23 bp, Homo sapiens
ctcctcgaatgtgtgggcccaag

SEQ ID NO: 4781277 - DNA, 20 bp, Homo sapiens
ctcctcgggtggggcctgcg

SEQ ID NO: 4781278 - DNA, 16 bp, Homo sapiens
ctcctcggtggcattt

SEQ ID NO: 4781279 - DNA, 21 bp, Homo sapiens
ctcctcgtccggcctgcagcc

SEQ ID NO: 4781280 - DNA, 20 bp, Homo sapiens
ctcctctcaaacctggcaga

SEQ ID NO: 4781281 - DNA, 21 bp, Homo sapiens
ctcctctcaaacctggcagat

SEQ ID NO: 4781282 - DNA, 13 bp, Homo sapiens
ctcctctcccaaa

SEQ ID NO: 4781283 - DNA, 21 bp, Homo sapiens
ctcctctcctcgtccggcctg

SEQ ID NO: 4781284 - DNA, 18 bp, Homo sapiens
ctcctctgcagcctgagc

SEQ ID NO: 4781285 - DNA, 20 bp, Homo sapiens
ctcctctgcagcctgagctc

SEQ ID NO: 4781286 - DNA, 21 bp, Homo sapiens
ctcctctgcagcctgagctcc

SEQ ID NO: 4781287 - DNA, 14 bp, Homo sapiens
ctcctctgccccct

SEQ ID NO: 4781288 - DNA, 13 bp, Homo sapiens
ctcctctgcccgc

SEQ ID NO: 4781289 - DNA, 12 bp, Homo sapiens
ctcctctgtcag

SEQ ID NO: 4781290 - DNA, 18 bp, Homo sapiens
ctcctcttcaccccggca

SEQ ID NO: 4781291 - DNA, 22 bp, Homo sapiens
ctcctcttcaccccggcaggcc

SEQ ID NO: 4781292 - DNA, 14 bp, Homo sapiens
ctcctgagcctgtc

SEQ ID NO: 4781293 - DNA, 17 bp, Homo sapiens
ctcctgagcctgtctct

SEQ ID NO: 4781294 - DNA, 18 bp, Homo sapiens
ctcctgagcctgtctctc

SEQ ID NO: 4781295 - DNA, 21 bp, Homo sapiens
ctcctgcacgcggactccggg

SEQ ID NO: 4781296 - DNA, 18 bp, Homo sapiens
ctcctgcatccctccacc

SEQ ID NO: 4781297 - DNA, 21 bp, Homo sapiens
ctcctgcatgtcggggcccct

SEQ ID NO: 4781298 - DNA, 11 bp, Homo sapiens
ctcctgccctt

SEQ ID NO: 4781299 - DNA, 17 bp, Homo sapiens
ctcctgcctcagcctcc

SEQ ID NO: 4781300 - DNA, 23 bp, Homo sapiens
ctcctggccagacgctgccgctg

SEQ ID NO: 4781301 - DNA, 13 bp, Homo sapiens
ctcctggctcaca

SEQ ID NO: 4781302 - DNA, 16 bp, Homo sapiens
ctcctggctcacagcc

SEQ ID NO: 4781303 - DNA, 20 bp, Homo sapiens
ctcctggctcacagccacca

SEQ ID NO: 4781304 - DNA, 21 bp, Homo sapiens
ctcctggcttttaaacctgtt

SEQ ID NO: 4781305 - DNA, 23 bp, Homo sapiens
ctcctgggaatggggtgggagcc

SEQ ID NO: 4781306 - DNA, 17 bp, Homo sapiens
ctcctgggggtggcagg

SEQ ID NO: 4781307 - DNA, 18 bp, Homo sapiens
ctcctgggggtggcaggc

SEQ ID NO: 4781308 - DNA, 20 bp, Homo sapiens
ctcctgggggtggcaggcac

SEQ ID NO: 4781309 - DNA, 13 bp, Homo sapiens
ctcctgtaaaata

SEQ ID NO: 4781310 - DNA, 17 bp, Homo sapiens
ctcctgtctcttgggaa

SEQ ID NO: 4781311 - DNA, 21 bp, Homo sapiens
ctcctgttttcacaccttaca

SEQ ID NO: 4781312 - DNA, 22 bp, Homo sapiens
ctcctgttttcacaccttacaa

SEQ ID NO: 4781313 - DNA, 22 bp, Homo sapiens
ctccttaaaaatgtatgttggt

SEQ ID NO: 4781314 - DNA, 15 bp, Homo sapiens
ctccttaaactacca

SEQ ID NO: 4781315 - DNA, 16 bp, Homo sapiens
ctccttaaactaccac

SEQ ID NO: 4781316 - DNA, 18 bp, Homo sapiens
ctccttaaactaccaccc

SEQ ID NO: 4781317 - DNA, 13 bp, Homo sapiens
ctccttctcccct

SEQ ID NO: 4781318 - DNA, 19 bp, Homo sapiens
ctccttgaaaccagctcag

SEQ ID NO: 4781319 - DNA, 13 bp, Homo sapiens
ctccttgaataag

SEQ ID NO: 4781320 - DNA, 11 bp, Homo sapiens
ctccttggcct

SEQ ID NO: 4781321 - DNA, 17 bp, Homo sapiens
ctccttggcctagccca

SEQ ID NO: 4781322 - DNA, 20 bp, Homo sapiens
ctccttggttttgcctcttt

SEQ ID NO: 4781323 - DNA, 23 bp, Homo sapiens
ctccttggttttgcctctttaaa

SEQ ID NO: 4781324 - DNA, 14 bp, Homo sapiens
ctccttgtacttga

SEQ ID NO: 4781325 - DNA, 17 bp, Homo sapiens
ctcctttccatcagctt

SEQ ID NO: 4781326 - DNA, 16 bp, Homo sapiens
ctcctttgtcaaatgg

SEQ ID NO: 4781327 - DNA, 15 bp, Homo sapiens
ctccttttctctttg

SEQ ID NO: 4781328 - DNA, 17 bp, Homo sapiens
ctcgagcccagatggaa

SEQ ID NO: 4781329 - DNA, 16 bp, Homo sapiens
ctcgagttacagacaa

SEQ ID NO: 4781330 - DNA, 20 bp, Homo sapiens
ctcgagttacagacaaagcg

SEQ ID NO: 4781331 - DNA, 19 bp, Homo sapiens
ctcgccctgtgccctctca

SEQ ID NO: 4781332 - DNA, 17 bp, Homo sapiens
ctcgcgcccctgtccat

SEQ ID NO: 4781333 - DNA, 15 bp, Homo sapiens
ctcgctgccacccac

SEQ ID NO: 4781334 - DNA, 17 bp, Homo sapiens
ctcgctgccacccaccc

SEQ ID NO: 4781335 - DNA, 14 bp, Homo sapiens
ctcgcttagctgaa

SEQ ID NO: 4781336 - DNA, 12 bp, Homo sapiens
ctcggacacagt

SEQ ID NO: 4781337 - DNA, 13 bp, Homo sapiens
ctcggacaccatc

SEQ ID NO: 4781338 - DNA, 17 bp, Homo sapiens
ctcggccctgtagccct

SEQ ID NO: 4781339 - DNA, 23 bp, Homo sapiens
ctcggccctgtagccctggcccg

SEQ ID NO: 4781340 - DNA, 14 bp, Homo sapiens
ctcggcctggcttc

SEQ ID NO: 4781341 - DNA, 21 bp, Homo sapiens
ctcggctgcaattgtggacct

SEQ ID NO: 4781342 - DNA, 22 bp, Homo sapiens
ctcggctgtgtggggagggtgg

SEQ ID NO: 4781343 - DNA, 17 bp, Homo sapiens
ctcgggaaggcctgagg

SEQ ID NO: 4781344 - DNA, 23 bp, Homo sapiens
ctcgggaaggcctgagggaagcc

SEQ ID NO: 4781345 - DNA, 14 bp, Homo sapiens
ctcgggcgcctgcg

SEQ ID NO: 4781346 - DNA, 22 bp, Homo sapiens
ctcgggcgcctgcgctcctctg

SEQ ID NO: 4781347 - DNA, 16 bp, Homo sapiens
ctcgggtggggcctgc

SEQ ID NO: 4781348 - DNA, 17 bp, Homo sapiens
ctcgtagaacctgcgca

SEQ ID NO: 4781349 - DNA, 15 bp, Homo sapiens
ctcgtccggcctgca

SEQ ID NO: 4781350 - DNA, 17 bp, Homo sapiens
ctcgtccggcctgcagc

SEQ ID NO: 4781351 - DNA, 22 bp, Homo sapiens
ctcgtccggcctgcagcccaga

SEQ ID NO: 4781352 - DNA, 14 bp, Homo sapiens
ctcgtgcatgtaat

SEQ ID NO: 4781353 - DNA, 17 bp, Homo sapiens
ctcgtgccatgatctgt

SEQ ID NO: 4781354 - DNA, 21 bp, Homo sapiens
ctcgtgtgcatgagaatgtca

SEQ ID NO: 4781355 - DNA, 16 bp, Homo sapiens
ctcgtgtttcacagtg

SEQ ID NO: 4781356 - DNA, 13 bp, Homo sapiens
ctctaaaactatc

SEQ ID NO: 4781357 - DNA, 14 bp, Homo sapiens
ctctaaaatgctgt

SEQ ID NO: 4781358 - DNA, 20 bp, Homo sapiens
ctctaagaaatggctttcca

SEQ ID NO: 4781359 - DNA, 21 bp, Homo sapiens
ctctaagaaatggctttccac

SEQ ID NO: 4781360 - DNA, 16 bp, Homo sapiens
ctctaaggcaggatgt

SEQ ID NO: 4781361 - DNA, 11 bp, Homo sapiens
ctctaatttcc

SEQ ID NO: 4781362 - DNA, 15 bp, Homo sapiens
ctctacaaaaaaaat

SEQ ID NO: 4781363 - DNA, 13 bp, Homo sapiens
ctctagagaacat

SEQ ID NO: 4781364 - DNA, 15 bp, Homo sapiens
ctctagttgacttca

SEQ ID NO: 4781365 - DNA, 16 bp, Homo sapiens
ctctagttgacttcaa

SEQ ID NO: 4781366 - DNA, 13 bp, Homo sapiens
ctctatataaaaa

SEQ ID NO: 4781367 - DNA, 19 bp, Homo sapiens
ctgagcctgtctctcccta

SEQ ID NO: 4781368 - DNA, 23 bp, Homo sapiens
ctgagcgtgctttccaaaaccca

SEQ ID NO: 4781369 - DNA, 23 bp, Homo sapiens
ctgagctactgcttctaacacct

SEQ ID NO: 4781370 - DNA, 15 bp, Homo sapiens
ctgagctccaccctc

SEQ ID NO: 4781371 - DNA, 13 bp, Homo sapiens
ctgagctggccta

SEQ ID NO: 4781372 - DNA, 17 bp, Homo sapiens
ctgaggacggggcagag

SEQ ID NO: 4781373 - DNA, 16 bp, Homo sapiens
ctgaggagtaaaaaga

SEQ ID NO: 4781374 - DNA, 14 bp, Homo sapiens
ctgaggagtccaaa

SEQ ID NO: 4781375 - DNA, 16 bp, Homo sapiens
ctgaggataccttcca

SEQ ID NO: 4781376 - DNA, 20 bp, Homo sapiens
ctgaggataccttccatctc

SEQ ID NO: 4781377 - DNA, 14 bp, Homo sapiens
ctgagggaagccca

SEQ ID NO: 4781378 - DNA, 18 bp, Homo sapiens
ctgagggaagcccacccg

SEQ ID NO: 4781379 - DNA, 23 bp, Homo sapiens
ctgagggaagcccacccgcccca

SEQ ID NO: 4781380 - DNA, 13 bp, Homo sapiens
ctgagggcagggt

SEQ ID NO: 4781381 - DNA, 21 bp, Homo sapiens
ctgagggcagggttctagaag

SEQ ID NO: 4781382 - DNA, 12 bp, Homo sapiens
ctgagggccctt

SEQ ID NO: 4781383 - DNA, 18 bp, Homo sapiens
ctgagggcccttcccaac

SEQ ID NO: 4781384 - DNA, 12 bp, Homo sapiens
ctgaggtcatct

SEQ ID NO: 4781385 - DNA, 20 bp, Homo sapiens
ctgaggtcatctgtaaaata

SEQ ID NO: 4781386 - DNA, 15 bp, Homo sapiens
ctgaggttaagggga

SEQ ID NO: 4781387 - DNA, 20 bp, Homo sapiens
ctgagtcagggcccagaggc

SEQ ID NO: 4781388 - DNA, 22 bp, Homo sapiens
ctgagtcagggcccagaggctg

SEQ ID NO: 4781389 - DNA, 17 bp, Homo sapiens
ctgagtcggctgggcag

SEQ ID NO: 4781390 - DNA, 16 bp, Homo sapiens
ctgagtgcgaccacca

SEQ ID NO: 4781391 - DNA, 20 bp, Homo sapiens
ctgagtggctcgtgtttcac

SEQ ID NO: 4781392 - DNA, 16 bp, Homo sapiens
ctgatatattttccag

SEQ ID NO: 4781393 - DNA, 15 bp, Homo sapiens
ctgatatgggactga

SEQ ID NO: 4781394 - DNA, 16 bp, Homo sapiens
ctgatatgggactgag

SEQ ID NO: 4781395 - DNA, 14 bp, Homo sapiens
ctgatcaaggtgct

SEQ ID NO: 4781396 - DNA, 17 bp, Homo sapiens
ctgatcaaggtgctctt

SEQ ID NO: 4781397 - DNA, 20 bp, Homo sapiens
ctgatcactatgcattttaa

SEQ ID NO: 4781398 - DNA, 16 bp, Homo sapiens
ctgatgaagttgtaca

SEQ ID NO: 4781399 - DNA, 13 bp, Homo sapiens
ctgatgatataaa

SEQ ID NO: 4781400 - DNA, 14 bp, Homo sapiens
ctgatggacatgag

SEQ ID NO: 4781401 - DNA, 13 bp, Homo sapiens
ctgatggagaagg

SEQ ID NO: 4781402 - DNA, 14 bp, Homo sapiens
ctgatggagaagga

SEQ ID NO: 4781403 - DNA, 14 bp, Homo sapiens
ctgatggttgcttt

SEQ ID NO: 4781404 - DNA, 18 bp, Homo sapiens
ctgatggttgctttgagc

SEQ ID NO: 4781405 - DNA, 22 bp, Homo sapiens
ctgatggttgctttgagcccac

SEQ ID NO: 4781406 - DNA, 13 bp, Homo sapiens
ctgattggaaaat

SEQ ID NO: 4781407 - DNA, 16 bp, Homo sapiens
ctgattggaaaataat

SEQ ID NO: 4781408 - DNA, 18 bp, Homo sapiens
ctgattggacctggccca

SEQ ID NO: 4781409 - DNA, 21 bp, Homo sapiens
ctgattggacctggcccagtg

SEQ ID NO: 4781410 - DNA, 15 bp, Homo sapiens
ctgatttactaacag

SEQ ID NO: 4781411 - DNA, 18 bp, Homo sapiens
ctgatttattttgtatga

SEQ ID NO: 4781412 - DNA, 17 bp, Homo sapiens
ctgcaaatagaaaacag

SEQ ID NO: 4781413 - DNA, 20 bp, Homo sapiens
ctgcaaatagaaaacaggaa

SEQ ID NO: 4781414 - DNA, 14 bp, Homo sapiens
ctgcaacctccacc

SEQ ID NO: 4781415 - DNA, 14 bp, Homo sapiens
ctgcaaggcccaca

SEQ ID NO: 4781416 - DNA, 18 bp, Homo sapiens
ctgcaaggcccacaggag

SEQ ID NO: 4781417 - DNA, 13 bp, Homo sapiens
ctgcaataacagt

SEQ ID NO: 4781418 - DNA, 18 bp, Homo sapiens
ctgcaataaggggagagt

SEQ ID NO: 4781419 - DNA, 13 bp, Homo sapiens
ctgcaatgtctgt

SEQ ID NO: 4781420 - DNA, 18 bp, Homo sapiens
ctgcacagtagtgttggg

SEQ ID NO: 4781421 - DNA, 14 bp, Homo sapiens
ctgcaccagcaggt

SEQ ID NO: 4781422 - DNA, 12 bp, Homo sapiens
ctgcacccaccc

SEQ ID NO: 4781423 - DNA, 16 bp, Homo sapiens
ctgcacccacccctgc

SEQ ID NO: 4781424 - DNA, 18 bp, Homo sapiens
ctgcacccacccctgccc

SEQ ID NO: 4781425 - DNA, 19 bp, Homo sapiens
ctgcacccacccctgccca

SEQ ID NO: 4781426 - DNA, 14 bp, Homo sapiens
ctgcaccctccaca

SEQ ID NO: 4781427 - DNA, 11 bp, Homo sapiens
ctgcaccttgg

SEQ ID NO: 4781428 - DNA, 23 bp, Homo sapiens
ctgcaccttgggcacgggagagc

SEQ ID NO: 4781429 - DNA, 14 bp, Homo sapiens
ctgcacgcccagga

SEQ ID NO: 4781430 - DNA, 14 bp, Homo sapiens
ctgcactgccctcc

SEQ ID NO: 4781431 - DNA, 15 bp, Homo sapiens
ctgcagaccctgcca

SEQ ID NO: 4781432 - DNA, 17 bp, Homo sapiens
ctgcagaccctgccagg

SEQ ID NO: 4781433 - DNA, 10 bp, Homo sapiens
ctgcagaggg

SEQ ID NO: 4781434 - DNA, 13 bp, Homo sapiens
ctgcagagggcac

SEQ ID NO: 4781435 - DNA, 15 bp, Homo sapiens
ctgcagcccagaacg

SEQ ID NO: 4781436 - DNA, 22 bp, Homo sapiens
ctgcagcccagaacgggcctcc

SEQ ID NO: 4781437 - DNA, 23 bp, Homo sapiens
ctgcagcccagaacgggcctccc

SEQ ID NO: 4781438 - DNA, 19 bp, Homo sapiens
ctgcagccccctgcttctc

SEQ ID NO: 4781439 - DNA, 19 bp, Homo sapiens
ctgcagcccgatgtccctg

SEQ ID NO: 4781440 - DNA, 20 bp, Homo sapiens
ctgcagcccgatgtccctgt

SEQ ID NO: 4781441 - DNA, 15 bp, Homo sapiens
ctgcagctaatttgt

SEQ ID NO: 4781442 - DNA, 19 bp, Homo sapiens
ctgcagctaatttgtgaaa

SEQ ID NO: 4781443 - DNA, 23 bp, Homo sapiens
ctgcagctaatttgtgaaagtgg

SEQ ID NO: 4781444 - DNA, 21 bp, Homo sapiens
ctgcagctatgcgcaatgtgg

SEQ ID NO: 4781445 - DNA, 20 bp, Homo sapiens
ctgcagctgcaccagcaggt

SEQ ID NO: 4781446 - DNA, 13 bp, Homo sapiens
ctgcagcttggga

SEQ ID NO: 4781447 - DNA, 17 bp, Homo sapiens
ctgcagctttgaggctg

SEQ ID NO: 4781448 - DNA, 19 bp, Homo sapiens
ctgcaggatgattgtacag

SEQ ID NO: 4781449 - DNA, 18 bp, Homo sapiens
ctgcaggttggaccccag

SEQ ID NO: 4781450 - DNA, 14 bp, Homo sapiens
ctgcagtattctgt

SEQ ID NO: 4781451 - DNA, 15 bp, Homo sapiens
ctgcagtattctgta

SEQ ID NO: 4781452 - DNA, 18 bp, Homo sapiens
ctgcagtcagcacagaga

SEQ ID NO: 4781453 - DNA, 20 bp, Homo sapiens
ctgcagtctgtggagcgtcc

SEQ ID NO: 4781454 - DNA, 21 bp, Homo sapiens
ctgcagtctgtggagcgtcct

SEQ ID NO: 4781455 - DNA, 18 bp, Homo sapiens
ctgcagtgttcgcttggc

SEQ ID NO: 4781456 - DNA, 23 bp, Homo sapiens
ctgcagttatttaccagaagttt

SEQ ID NO: 4781457 - DNA, 15 bp, Homo sapiens
ctgcataagattata

SEQ ID NO: 4781458 - DNA, 19 bp, Homo sapiens
ctgcatagacaaaggcctt

SEQ ID NO: 4781459 - DNA, 20 bp, Homo sapiens
ctgcatcaagatgtgacatg

SEQ ID NO: 4781460 - DNA, 12 bp, Homo sapiens
ctgcatcatctt

SEQ ID NO: 4781461 - DNA, 19 bp, Homo sapiens
ctgcatccctccaccccag

SEQ ID NO: 4781462 - DNA, 22 bp, Homo sapiens
ctgcatccctccaccccagtcc

SEQ ID NO: 4781463 - DNA, 21 bp, Homo sapiens
ctgcatcccttggcccctctc

SEQ ID NO: 4781464 - DNA, 13 bp, Homo sapiens
ctgcatcctcagc

SEQ ID NO: 4781465 - DNA, 15 bp, Homo sapiens
ctgcatcctcagccc

SEQ ID NO: 4781466 - DNA, 17 bp, Homo sapiens
ctgcatcctcagcccca

SEQ ID NO: 4781467 - DNA, 19 bp, Homo sapiens
ctgcatgatttttgccctg

SEQ ID NO: 4781468 - DNA, 20 bp, Homo sapiens
ctgcatgatttttgccctgc

SEQ ID NO: 4781469 - DNA, 18 bp, Homo sapiens
ctgcatgcgggcttcctc

SEQ ID NO: 4781470 - DNA, 20 bp, Homo sapiens
ctgcatgtatgccatgtatg

SEQ ID NO: 4781471 - DNA, 20 bp, Homo sapiens
ctgcatgtcggggcccctgc

SEQ ID NO: 4781472 - DNA, 23 bp, Homo sapiens
ctgcatgtcggggcccctgcgtg

SEQ ID NO: 4781473 - DNA, 22 bp, Homo sapiens
ctgccaagataccttcatggtg

SEQ ID NO: 4781474 - DNA, 17 bp, Homo sapiens
ctgccaatgggagctca

SEQ ID NO: 4781475 - DNA, 18 bp, Homo sapiens
ctgccaatgggagctcat

SEQ ID NO: 4781476 - DNA, 19 bp, Homo sapiens
ctgccaatgggagctcatg

SEQ ID NO: 4781477 - DNA, 13 bp, Homo sapiens
ctgccacaagcac

SEQ ID NO: 4781478 - DNA, 15 bp, Homo sapiens
ctgccacaatgtgat

SEQ ID NO: 4781479 - DNA, 16 bp, Homo sapiens
ctgccaccctctgctg

SEQ ID NO: 4781480 - DNA, 21 bp, Homo sapiens
ctgccactgacaggaaagtgg

SEQ ID NO: 4781481 - DNA, 14 bp, Homo sapiens
ctgccagccttccc

SEQ ID NO: 4781482 - DNA, 17 bp, Homo sapiens
ctgccaggctcccactg

SEQ ID NO: 4781483 - DNA, 12 bp, Homo sapiens
ctgccagggcag

SEQ ID NO: 4781484 - DNA, 13 bp, Homo sapiens
ctgccagggcagt

SEQ ID NO: 4781485 - DNA, 15 bp, Homo sapiens
ctgccataacttgtt

SEQ ID NO: 4781486 - DNA, 13 bp, Homo sapiens
ctgccatgtgtga

SEQ ID NO: 4781487 - DNA, 19 bp, Homo sapiens
ctgccattttttgtctgtg

SEQ ID NO: 4781488 - DNA, 12 bp, Homo sapiens
ctgcccaccctg

SEQ ID NO: 4781489 - DNA, 15 bp, Homo sapiens
ctgcccaccctgggc

SEQ ID NO: 4781490 - DNA, 20 bp, Homo sapiens
ctgcttctccacctccccca

SEQ ID NO: 4781491 - DNA, 14 bp, Homo sapiens
ctgcttctcccgcc

SEQ ID NO: 4781492 - DNA, 19 bp, Homo sapiens
ctgcttctcccgccattgg

SEQ ID NO: 4781493 - DNA, 21 bp, Homo sapiens
ctgcttctcccgccattggcc

SEQ ID NO: 4781494 - DNA, 14 bp, Homo sapiens
ctgcttctccctgg

SEQ ID NO: 4781495 - DNA, 15 bp, Homo sapiens
ctgcttctccctggg

SEQ ID NO: 4781496 - DNA, 16 bp, Homo sapiens
ctgcttctccctgggg

SEQ ID NO: 4781497 - DNA, 14 bp, Homo sapiens
ctgcttctctttca

SEQ ID NO: 4781498 - DNA, 23 bp, Homo sapiens
ctgcttgctggaaaactgccaca

SEQ ID NO: 4781499 - DNA, 18 bp, Homo sapiens
ctgcttggtttagctgtg

SEQ ID NO: 4781500 - DNA, 18 bp, Homo sapiens
ctgcttgtcattctgcta

SEQ ID NO: 4781501 - DNA, 19 bp, Homo sapiens
ctgcttgtgaaaggaaaga

SEQ ID NO: 4781502 - DNA, 23 bp, Homo sapiens
ctgctttgttttggctgctctcc

SEQ ID NO: 4781503 - DNA, 19 bp, Homo sapiens
ctggaaaacctgaggccaa

SEQ ID NO: 4781504 - DNA, 20 bp, Homo sapiens
ctggaaaacctgaggccaaa

SEQ ID NO: 4781505 - DNA, 15 bp, Homo sapiens
ctggaaaactgccac

SEQ ID NO: 4781506 - DNA, 17 bp, Homo sapiens
ctggaaacatctgattt

SEQ ID NO: 4781507 - DNA, 15 bp, Homo sapiens
ctggaaagagctgtt

SEQ ID NO: 4781508 - DNA, 21 bp, Homo sapiens
ctggaaagcacgccggcctgc

SEQ ID NO: 4781509 - DNA, 15 bp, Homo sapiens
ctggaaaggcccgga

SEQ ID NO: 4781510 - DNA, 17 bp, Homo sapiens
ctggaacactaatgagg

SEQ ID NO: 4781511 - DNA, 13 bp, Homo sapiens
ctggaagagggag

SEQ ID NO: 4781512 - DNA, 24 bp, Homo sapiens
ctggaagagggaggggccctgtca

SEQ ID NO: 4781513 - DNA, 16 bp, Homo sapiens
ctggaaggctttattc

SEQ ID NO: 4781514 - DNA, 20 bp, Homo sapiens
ctggaagggtccggcttggc

SEQ ID NO: 4781515 - DNA, 16 bp, Homo sapiens
ctggaatctactagaa

SEQ ID NO: 4781516 - DNA, 18 bp, Homo sapiens
ctggaattgggctccgtg

SEQ ID NO: 4781517 - DNA, 22 bp, Homo sapiens
ctggacagatgggtgtcccctg

SEQ ID NO: 4781518 - DNA, 23 bp, Homo sapiens
ctggacagatgggtgtcccctgg

SEQ ID NO: 4781519 - DNA, 15 bp, Homo sapiens
ctggacagtgcctaa

SEQ ID NO: 4781520 - DNA, 21 bp, Homo sapiens
ctggaccacgtctccctggcc

SEQ ID NO: 4781521 - DNA, 15 bp, Homo sapiens
ctggactatagctgt

SEQ ID NO: 4781522 - DNA, 19 bp, Homo sapiens
ctggactgggtgggcccca

SEQ ID NO: 4781523 - DNA, 14 bp, Homo sapiens
ctggagaaaatgga

SEQ ID NO: 4781524 - DNA, 13 bp, Homo sapiens
ctggagaccctgc

SEQ ID NO: 4781525 - DNA, 21 bp, Homo sapiens
ctggagaccctgcgcccctgc

SEQ ID NO: 4781526 - DNA, 23 bp, Homo sapiens
ctggagattgtgctctgcagcga

SEQ ID NO: 4781527 - DNA, 22 bp, Homo sapiens
ctggagcccctatcctgcaccc

SEQ ID NO: 4781528 - DNA, 12 bp, Homo sapiens
ctggagcccgcc

SEQ ID NO: 4781529 - DNA, 18 bp, Homo sapiens
ctggagcctgagtcaggg

SEQ ID NO: 4781530 - DNA, 22 bp, Homo sapiens
ctggagcctgagtcagggccca

SEQ ID NO: 4781531 - DNA, 15 bp, Homo sapiens
ctggaggagaaggag

SEQ ID NO: 4781532 - DNA, 17 bp, Homo sapiens
ctggaggagaaggagga

SEQ ID NO: 4781533 - DNA, 19 bp, Homo sapiens
ctggaggagaaggaggaac

SEQ ID NO: 4781534 - DNA, 20 bp, Homo sapiens
ctggaggccaccaagctgct

SEQ ID NO: 4781535 - DNA, 17 bp, Homo sapiens
ctggaggtacgaaaaga

SEQ ID NO: 4781536 - DNA, 18 bp, Homo sapiens
ctggaggtggggagggcc

SEQ ID NO: 4781537 - DNA, 22 bp, Homo sapiens
ctggaggtggggagggcctctg

SEQ ID NO: 4781538 - DNA, 23 bp, Homo sapiens
ctggagtccctcctcccccacgc

SEQ ID NO: 4781539 - DNA, 16 bp, Homo sapiens
ctggagtctgaaggag

SEQ ID NO: 4781540 - DNA, 14 bp, Homo sapiens
ctggagtgcagtgg

SEQ ID NO: 4781541 - DNA, 16 bp, Homo sapiens
ctggagtgggctctct

SEQ ID NO: 4781542 - DNA, 22 bp, Homo sapiens
ctggagtgggctctctggacct

SEQ ID NO: 4781543 - DNA, 23 bp, Homo sapiens
ctggagtgggctctctggacctg

SEQ ID NO: 4781544 - DNA, 17 bp, Homo sapiens
ctggataggagaggaaa

SEQ ID NO: 4781545 - DNA, 13 bp, Homo sapiens
ctggatcagtaaa

SEQ ID NO: 4781546 - DNA, 14 bp, Homo sapiens
ctggatcagtaaaa

SEQ ID NO: 4781547 - DNA, 20 bp, Homo sapiens
ctggatggggcggcctgcag

SEQ ID NO: 4781548 - DNA, 15 bp, Homo sapiens
ctggatgtgcatctg

SEQ ID NO: 4781549 - DNA, 17 bp, Homo sapiens
ctggattttcaaagatt

SEQ ID NO: 4781550 - DNA, 14 bp, Homo sapiens
ctggcacaggactg

SEQ ID NO: 4781551 - DNA, 13 bp, Homo sapiens
ctggcagcccctg

SEQ ID NO: 4781552 - DNA, 23 bp, Homo sapiens
ctggcagcccctgttctggcaga

SEQ ID NO: 4781553 - DNA, 14 bp, Homo sapiens
ctggcagcgcctcc

SEQ ID NO: 4781554 - DNA, 16 bp, Homo sapiens
ctggcagcgcctcccg

SEQ ID NO: 4781555 - DNA, 21 bp, Homo sapiens
ctggcagcgcctcccgccgcc

SEQ ID NO: 4781556 - DNA, 16 bp, Homo sapiens
ctggcataggactctt

SEQ ID NO: 4781557 - DNA, 24 bp, Homo sapiens
ctggcatgggaatgaatgtcagtg

SEQ ID NO: 4781558 - DNA, 13 bp, Homo sapiens
ctggccagacgct

SEQ ID NO: 4781559 - DNA, 14 bp, Homo sapiens
ctggccagacgctg

SEQ ID NO: 4781560 - DNA, 16 bp, Homo sapiens
ctggccagacgctgcc

SEQ ID NO: 4781561 - DNA, 12 bp, Homo sapiens
ctggccagcacc

SEQ ID NO: 4781562 - DNA, 14 bp, Homo sapiens
ctggccagcaccct

SEQ ID NO: 4781563 - DNA, 20 bp, Homo sapiens
ctggccagcaccctctcctg

SEQ ID NO: 4781564 - DNA, 13 bp, Homo sapiens
ctggccagcctgg

SEQ ID NO: 4781565 - DNA, 17 bp, Homo sapiens
ctggccagcctggggcc

SEQ ID NO: 4781566 - DNA, 21 bp, Homo sapiens
ctggccagcctggggcctggc

SEQ ID NO: 4781567 - DNA, 23 bp, Homo sapiens
ctggccagcctggggcctggcag

SEQ ID NO: 4781568 - DNA, 19 bp, Homo sapiens
ctggcccagccatggctgg

SEQ ID NO: 4781569 - DNA, 21 bp, Homo sapiens
ctggcccagtgcaatctgtcc

SEQ ID NO: 4781570 - DNA, 17 bp, Homo sapiens
ctggcccatagaaacat

SEQ ID NO: 4781571 - DNA, 21 bp, Homo sapiens
ctggcccatagaaacatgaca

SEQ ID NO: 4781572 - DNA, 23 bp, Homo sapiens
ctggccccagctcctcttcctgc

SEQ ID NO: 4781573 - DNA, 12 bp, Homo sapiens
ctggccccaggc

SEQ ID NO: 4781574 - DNA, 14 bp, Homo sapiens
ctggccccaggcgg

SEQ ID NO: 4781575 - DNA, 13 bp, Homo sapiens
ctggccccagtga

SEQ ID NO: 4781576 - DNA, 14 bp, Homo sapiens
ctggccccagtgac

SEQ ID NO: 4781577 - DNA, 18 bp, Homo sapiens
ctggccccagtgaccggg

SEQ ID NO: 4781578 - DNA, 12 bp, Homo sapiens
ctggccccctcg

SEQ ID NO: 4781579 - DNA, 19 bp, Homo sapiens
ctggccccctcgcgcccct

SEQ ID NO: 4781580 - DNA, 21 bp, Homo sapiens
ctggccccctcgcgcccctgt

SEQ ID NO: 4781581 - DNA, 15 bp, Homo sapiens
ctggccctgccctga

SEQ ID NO: 4781582 - DNA, 16 bp, Homo sapiens
ctggcctaccacagct

SEQ ID NO: 4781583 - DNA, 20 bp, Homo sapiens
ctggcctaccacagctgcct

SEQ ID NO: 4781584 - DNA, 23 bp, Homo sapiens
ctggcctaccacagctgcctccg

SEQ ID NO: 4781585 - DNA, 15 bp, Homo sapiens
ctggcctctgtgcca

SEQ ID NO: 4781586 - DNA, 13 bp, Homo sapiens
ctggcctgacaca

SEQ ID NO: 4781587 - DNA, 15 bp, Homo sapiens
ctggcctggccctgc

SEQ ID NO: 4781588 - DNA, 19 bp, Homo sapiens
ctggcctggccctgccctg

SEQ ID NO: 4781589 - DNA, 14 bp, Homo sapiens
ctggcctggcctgg

SEQ ID NO: 4781590 - DNA, 17 bp, Homo sapiens
ctggccttgcctccagg

SEQ ID NO: 4781591 - DNA, 17 bp, Homo sapiens
ctggccttggttcctcc

SEQ ID NO: 4781592 - DNA, 20 bp, Homo sapiens
ctggccttggttcctccagc

SEQ ID NO: 4781593 - DNA, 22 bp, Homo sapiens
ctggccttggttcctccagcaa

SEQ ID NO: 4781594 - DNA, 16 bp, Homo sapiens
ctggcgggcagcccct

SEQ ID NO: 4781595 - DNA, 20 bp, Homo sapiens
ctggcgggcagcccctgctg

SEQ ID NO: 4781596 - DNA, 21 bp, Homo sapiens
ctggcgggcagcccctgctgg

SEQ ID NO: 4781597 - DNA, 14 bp, Homo sapiens
ctggctctggagcc

SEQ ID NO: 4781598 - DNA, 11 bp, Homo sapiens
ctggctgagtg

SEQ ID NO: 4781599 - DNA, 14 bp, Homo sapiens
ctggctgtggcccc

SEQ ID NO: 4781600 - DNA, 15 bp, Homo sapiens
ctggctgtggcccct

SEQ ID NO: 4781601 - DNA, 17 bp, Homo sapiens
ctggctgtggcccctcc

SEQ ID NO: 4781602 - DNA, 18 bp, Homo sapiens
ctggctgtggcccctcct

SEQ ID NO: 4781603 - DNA, 21 bp, Homo sapiens
ctggcttcaccgcattccagg

SEQ ID NO: 4781604 - DNA, 22 bp, Homo sapiens
ctggcttcaccgcattccaggg

SEQ ID NO: 4781605 - DNA, 23 bp, Homo sapiens
ctggcttcaccgcattccagggg

SEQ ID NO: 4781606 - DNA, 13 bp, Homo sapiens
ctggcttcccagg

SEQ ID NO: 4781607 - DNA, 14 bp, Homo sapiens
ctggcttcccagga

SEQ ID NO: 4781608 - DNA, 15 bp, Homo sapiens
ctggcttcccaggac

SEQ ID NO: 4781609 - DNA, 16 bp, Homo sapiens
ctggcttcccaggacc

SEQ ID NO: 4781610 - DNA, 18 bp, Homo sapiens
ctggcttcccaggaccct

SEQ ID NO: 4781611 - DNA, 20 bp, Homo sapiens
ctgggaaatgagatcccaga

SEQ ID NO: 4781612 - DNA, 22 bp, Homo sapiens
ctgttatctgtctttatgattt

SEQ ID NO: 4781613 - DNA, 14 bp, Homo sapiens
ctgttatttgtcct

SEQ ID NO: 4781614 - DNA, 18 bp, Homo sapiens
ctgttatttgtcctcatg

SEQ ID NO: 4781615 - DNA, 13 bp, Homo sapiens
ctgttccaagtgt

SEQ ID NO: 4781616 - DNA, 16 bp, Homo sapiens
ctgttccaagtgtgtg

SEQ ID NO: 4781617 - DNA, 20 bp, Homo sapiens
ctgttccaagtgtgtgtgca

SEQ ID NO: 4781618 - DNA, 14 bp, Homo sapiens
ctgttccacttctc

SEQ ID NO: 4781619 - DNA, 23 bp, Homo sapiens
ctgttcccagcaaagttttcaga

SEQ ID NO: 4781620 - DNA, 16 bp, Homo sapiens
ctgttccgcctcactg

SEQ ID NO: 4781621 - DNA, 15 bp, Homo sapiens
ctgttctaactagta

SEQ ID NO: 4781622 - DNA, 20 bp, Homo sapiens
ctgttctatggaccaaatgt

SEQ ID NO: 4781623 - DNA, 22 bp, Homo sapiens
ctgttctatggaccaaatgtaa

SEQ ID NO: 4781624 - DNA, 12 bp, Homo sapiens
ctgttctcaaat

SEQ ID NO: 4781625 - DNA, 16 bp, Homo sapiens
ctgttctcaatcattg

SEQ ID NO: 4781626 - DNA, 20 bp, Homo sapiens
ctgttctttttgactgattg

SEQ ID NO: 4781627 - DNA, 17 bp, Homo sapiens
ctgttgaagtgcatgtt

SEQ ID NO: 4781628 - DNA, 19 bp, Homo sapiens
ctgttgaagtgcatgttaa

SEQ ID NO: 4781629 - DNA, 20 bp, Homo sapiens
ctgttgaagtgcatgttaaa

SEQ ID NO: 4781630 - DNA, 19 bp, Homo sapiens
ctgttgacctaccctggac

SEQ ID NO: 4781631 - DNA, 18 bp, Homo sapiens
ctgttgatctatgggaaa

SEQ ID NO: 4781632 - DNA, 22 bp, Homo sapiens
ctgttgtaatatcagttacagt

SEQ ID NO: 4781633 - DNA, 18 bp, Homo sapiens
ctgtttaacgtgaggttt

SEQ ID NO: 4781634 - DNA, 19 bp, Homo sapiens
ctgtttaacgtgaggtttc

SEQ ID NO: 4781635 - DNA, 16 bp, Homo sapiens
ctgtttaccctccctg

SEQ ID NO: 4781636 - DNA, 19 bp, Homo sapiens
ctgtttacttgaatagtat

SEQ ID NO: 4781637 - DNA, 20 bp, Homo sapiens
ctgtttccaatgccaattca

SEQ ID NO: 4781638 - DNA, 23 bp, Homo sapiens
ctgtttccaatgccaattcatct

SEQ ID NO: 4781639 - DNA, 13 bp, Homo sapiens
ctgtttctcctcc

SEQ ID NO: 4781640 - DNA, 22 bp, Homo sapiens
ctgtttctcctccattcatgtt

SEQ ID NO: 4781641 - DNA, 16 bp, Homo sapiens
ctgtttgaattttcaa

SEQ ID NO: 4781642 - DNA, 17 bp, Homo sapiens
ctgtttgctaagtgagg

SEQ ID NO: 4781643 - DNA, 20 bp, Homo sapiens
ctgttttaaaaaatacagta

SEQ ID NO: 4781644 - DNA, 14 bp, Homo sapiens
ctgttttcacacct

SEQ ID NO: 4781645 - DNA, 13 bp, Homo sapiens
ctgttttggatga

SEQ ID NO: 4781646 - DNA, 16 bp, Homo sapiens
ctgttttggatgaatg

SEQ ID NO: 4781647 - DNA, 17 bp, Homo sapiens
cttaaaaaaaaaaatga

SEQ ID NO: 4781648 - DNA, 19 bp, Homo sapiens
cttaaaaagaccatgcatt

SEQ ID NO: 4781649 - DNA, 15 bp, Homo sapiens
cttaaaaatttatta

SEQ ID NO: 4781650 - DNA, 22 bp, Homo sapiens
cttaaaagctatcttcatgtaa

SEQ ID NO: 4781651 - DNA, 24 bp, Homo sapiens
cttaaaagctatcttcatgtaaat

SEQ ID NO: 4781652 - DNA, 17 bp, Homo sapiens
cttaaaataatgattta

SEQ ID NO: 4781653 - DNA, 20 bp, Homo sapiens
cttaaaattggttaatgaaa

SEQ ID NO: 4781654 - DNA, 22 bp, Homo sapiens
cttaaaattggttaatgaaaaa

SEQ ID NO: 4781655 - DNA, 12 bp, Homo sapiens
cttaaacaaaaa

SEQ ID NO: 4781656 - DNA, 21 bp, Homo sapiens
cttaaacaaaaactttccatg

SEQ ID NO: 4781657 - DNA, 16 bp, Homo sapiens
cttaaacattgcctta

SEQ ID NO: 4781658 - DNA, 11 bp, Homo sapiens
cttaaacattt

SEQ ID NO: 4781659 - DNA, 17 bp, Homo sapiens
cttaaacatttccctgc

SEQ ID NO: 4781660 - DNA, 23 bp, Homo sapiens
cttaaacattttttgtttcttgg

SEQ ID NO: 4781661 - DNA, 18 bp, Homo sapiens
cttaaacccacataaaca

SEQ ID NO: 4781662 - DNA, 19 bp, Homo sapiens
cttaaacccacataaacac

SEQ ID NO: 4781663 - DNA, 16 bp, Homo sapiens
cttaaacctgtgcttt

SEQ ID NO: 4781664 - DNA, 15 bp, Homo sapiens
cttaaactaccaccc

SEQ ID NO: 4781665 - DNA, 15 bp, Homo sapiens
cttaaactttgtcac

SEQ ID NO: 4781666 - DNA, 19 bp, Homo sapiens
cttaaactttgtcacttct

SEQ ID NO: 4781667 - DNA, 20 bp, Homo sapiens
cttaaactttgtcacttctg

SEQ ID NO: 4781668 - DNA, 14 bp, Homo sapiens
cttaaatagcatct

SEQ ID NO: 4781669 - DNA, 11 bp, Homo sapiens
cttaaattaaa

SEQ ID NO: 4781670 - DNA, 15 bp, Homo sapiens
cttaaattaaacaat

SEQ ID NO: 4781671 - DNA, 17 bp, Homo sapiens
cttaaattaaacaattt

SEQ ID NO: 4781672 - DNA, 19 bp, Homo sapiens
cttaaattaaacaatttat

SEQ ID NO: 4781673 - DNA, 14 bp, Homo sapiens
cttaacagctgtat

SEQ ID NO: 4781674 - DNA, 15 bp, Homo sapiens
cttaactaatgtaaa

SEQ ID NO: 4781675 - DNA, 17 bp, Homo sapiens
cttaactaatgtaaata

SEQ ID NO: 4781676 - DNA, 14 bp, Homo sapiens
cttaactggccctc

SEQ ID NO: 4781677 - DNA, 16 bp, Homo sapiens
cttaactggccctcgg

SEQ ID NO: 4781678 - DNA, 12 bp, Homo sapiens
cttaagaagtat

SEQ ID NO: 4781679 - DNA, 19 bp, Homo sapiens
cttaagacagcatgtgtta

SEQ ID NO: 4781680 - DNA, 21 bp, Homo sapiens
cttaagattccattttggaaa

SEQ ID NO: 4781681 - DNA, 14 bp, Homo sapiens
cttacaaagccagc

SEQ ID NO: 4781682 - DNA, 18 bp, Homo sapiens
cttacaaccacatttctg

SEQ ID NO: 4781683 - DNA, 19 bp, Homo sapiens
cttacacacctgagaatgt

SEQ ID NO: 4781684 - DNA, 18 bp, Homo sapiens
cttacactgaaatccaaa

SEQ ID NO: 4781685 - DNA, 15 bp, Homo sapiens
cttacagtaggagtg

SEQ ID NO: 4781686 - DNA, 23 bp, Homo sapiens
cttaccccgtccctttccctgca

SEQ ID NO: 4781687 - DNA, 16 bp, Homo sapiens
cttacctcatttgcat

SEQ ID NO: 4781688 - DNA, 17 bp, Homo sapiens
cttacctcatttgcatc

SEQ ID NO: 4781689 - DNA, 20 bp, Homo sapiens
cttactaaccaccatttccc

SEQ ID NO: 4781690 - DNA, 16 bp, Homo sapiens
cttactgttttgtgcg

SEQ ID NO: 4781691 - DNA, 19 bp, Homo sapiens
cttagaaaacatgggcttt

SEQ ID NO: 4781692 - DNA, 12 bp, Homo sapiens
cttagaatgggg

SEQ ID NO: 4781693 - DNA, 11 bp, Homo sapiens
cttagaatgtg

SEQ ID NO: 4781694 - DNA, 12 bp, Homo sapiens
cttagaatgtga

SEQ ID NO: 4781695 - DNA, 17 bp, Homo sapiens
cttagaatgtgaaaaaa

SEQ ID NO: 4781696 - DNA, 13 bp, Homo sapiens
cttagagaataag

SEQ ID NO: 4781697 - DNA, 18 bp, Homo sapiens
cttagccatcagatgagg

SEQ ID NO: 4781698 - DNA, 11 bp, Homo sapiens
cttagctccct

SEQ ID NO: 4781699 - DNA, 13 bp, Homo sapiens
cttagctccctcc

SEQ ID NO: 4781700 - DNA, 15 bp, Homo sapiens
cttagcttttctgca

SEQ ID NO: 4781701 - DNA, 17 bp, Homo sapiens
cttagtatctcatcaac

SEQ ID NO: 4781702 - DNA, 13 bp, Homo sapiens
cttagtcatacca

SEQ ID NO: 4781703 - DNA, 13 bp, Homo sapiens
cttagtttattgt

SEQ ID NO: 4781704 - DNA, 15 bp, Homo sapiens
cttagtttattgtgg

SEQ ID NO: 4781705 - DNA, 16 bp, Homo sapiens
cttatatgtgcccctt

SEQ ID NO: 4781706 - DNA, 14 bp, Homo sapiens
cttatgtcatttct

SEQ ID NO: 4781707 - DNA, 15 bp, Homo sapiens
cttattaaaatattt

SEQ ID NO: 4781708 - DNA, 19 bp, Homo sapiens
cttattcctaattcctgta

SEQ ID NO: 4781709 - DNA, 20 bp, Homo sapiens
cttattgattaagtatatct

SEQ ID NO: 4781710 - DNA, 13 bp, Homo sapiens
cttatttatatat

SEQ ID NO: 4781711 - DNA, 14 bp, Homo sapiens
cttatttatatatg

SEQ ID NO: 4781712 - DNA, 22 bp, Homo sapiens
cttatttatattcagagatgta

SEQ ID NO: 4781713 - DNA, 18 bp, Homo sapiens
cttatttgctcataagta

SEQ ID NO: 4781714 - DNA, 18 bp, Homo sapiens
cttattttataattttaa

SEQ ID NO: 4781715 - DNA, 19 bp, Homo sapiens
cttattttataattttaaa

SEQ ID NO: 4781716 - DNA, 14 bp, Homo sapiens
cttcaaaatattga

SEQ ID NO: 4781717 - DNA, 16 bp, Homo sapiens
cttcaaagtctcaatg

SEQ ID NO: 4781718 - DNA, 17 bp, Homo sapiens
cttcaaatgtgtaactt

SEQ ID NO: 4781719 - DNA, 14 bp, Homo sapiens
cttcaaccctgccc

SEQ ID NO: 4781720 - DNA, 22 bp, Homo sapiens
cttcaaccctgccctgcacctt

SEQ ID NO: 4781721 - DNA, 18 bp, Homo sapiens
cttcacacaaagtgaaat

SEQ ID NO: 4781722 - DNA, 19 bp, Homo sapiens
cttcacacaaagtgaaatt

SEQ ID NO: 4781723 - DNA, 13 bp, Homo sapiens
cttcaccaggaag

SEQ ID NO: 4781724 - DNA, 21 bp, Homo sapiens
cttcaccccggcaggccctgc

SEQ ID NO: 4781725 - DNA, 17 bp, Homo sapiens
cttcaccgcattccagg

SEQ ID NO: 4781726 - DNA, 22 bp, Homo sapiens
cttcaccgcattccaggggctg

SEQ ID NO: 4781727 - DNA, 17 bp, Homo sapiens
cttcaccgccgtggggt

SEQ ID NO: 4781728 - DNA, 17 bp, Homo sapiens
cttcacctccttctgca

SEQ ID NO: 4781729 - DNA, 19 bp, Homo sapiens
cttcacctccttctgcagt

SEQ ID NO: 4781730 - DNA, 23 bp, Homo sapiens
cttcagaagaaaggacagctcag

SEQ ID NO: 4781731 - DNA, 17 bp, Homo sapiens
cttcagactctctcctc

SEQ ID NO: 4781732 - DNA, 20 bp, Homo sapiens
cttcagactctctcctctct

SEQ ID NO: 4781733 - DNA, 15 bp, Homo sapiens
cttcagtcattaaat

SEQ ID NO: 4781734 - DNA, 13 bp, Homo sapiens
cttgtgcatgcaa

SEQ ID NO: 4781735 - DNA, 19 bp, Homo sapiens
cttgtgcatgcaaaaatga

SEQ ID NO: 4781736 - DNA, 23 bp, Homo sapiens
cttgtgcatgcaaaaatgaattc

SEQ ID NO: 4781737 - DNA, 15 bp, Homo sapiens
cttgtggcagcttcc

SEQ ID NO: 4781738 - DNA, 17 bp, Homo sapiens
cttgtggcagcttccct

SEQ ID NO: 4781739 - DNA, 19 bp, Homo sapiens
cttgtggcagcttccctga

SEQ ID NO: 4781740 - DNA, 21 bp, Homo sapiens
cttgtggcagcttccctgaac

SEQ ID NO: 4781741 - DNA, 18 bp, Homo sapiens
cttgtgtaatttcctgct

SEQ ID NO: 4781742 - DNA, 19 bp, Homo sapiens
cttgtgtaatttcctgctc

SEQ ID NO: 4781743 - DNA, 12 bp, Homo sapiens
cttgtgtgaggg

SEQ ID NO: 4781744 - DNA, 14 bp, Homo sapiens
cttgtgtgagggca

SEQ ID NO: 4781745 - DNA, 14 bp, Homo sapiens
cttgtgtgtatgtc

SEQ ID NO: 4781746 - DNA, 16 bp, Homo sapiens
cttgtgtgtatgtcta

SEQ ID NO: 4781747 - DNA, 21 bp, Homo sapiens
cttgtgtgtatgtctatgtgt

SEQ ID NO: 4781748 - DNA, 16 bp, Homo sapiens
cttgtgttcaatctgt

SEQ ID NO: 4781749 - DNA, 17 bp, Homo sapiens
cttgttaaatgagctta

SEQ ID NO: 4781750 - DNA, 14 bp, Homo sapiens
cttgttatgttgta

SEQ ID NO: 4781751 - DNA, 13 bp, Homo sapiens
cttgttcttcctc

SEQ ID NO: 4781752 - DNA, 14 bp, Homo sapiens
cttgttgtattcct

SEQ ID NO: 4781753 - DNA, 20 bp, Homo sapiens
cttgtttaaggttcttgctg

SEQ ID NO: 4781754 - DNA, 21 bp, Homo sapiens
ctttaaaagaaggtaaataat

SEQ ID NO: 4781755 - DNA, 13 bp, Homo sapiens
ctttaaattatat

SEQ ID NO: 4781756 - DNA, 23 bp, Homo sapiens
ctttaaattatatgatatgcatg

SEQ ID NO: 4781757 - DNA, 12 bp, Homo sapiens
ctttaaattatg

SEQ ID NO: 4781758 - DNA, 14 bp, Homo sapiens
ctttaaattgtgga

SEQ ID NO: 4781759 - DNA, 21 bp, Homo sapiens
ctttaacatatcattcagaat

SEQ ID NO: 4781760 - DNA, 18 bp, Homo sapiens
ctttaaccagtctgaagt

SEQ ID NO: 4781761 - DNA, 17 bp, Homo sapiens
ctttacagctctcctcc

SEQ ID NO: 4781762 - DNA, 16 bp, Homo sapiens
ctttaccctccacaca

SEQ ID NO: 4781763 - DNA, 19 bp, Homo sapiens
ctttactcggcgtgctcct

SEQ ID NO: 4781764 - DNA, 21 bp, Homo sapiens
ctttactcggcgtgctccttt

SEQ ID NO: 4781765 - DNA, 16 bp, Homo sapiens
ctttagaatattaaaa

SEQ ID NO: 4781766 - DNA, 18 bp, Homo sapiens
ctttagaatattaaaaat

SEQ ID NO: 4781767 - DNA, 19 bp, Homo sapiens
ctttagaatattaaaaatt

SEQ ID NO: 4781768 - DNA, 22 bp, Homo sapiens
ctttaggcaggaagtcaggagc

SEQ ID NO: 4781769 - DNA, 19 bp, Homo sapiens
ctttaggtaaaaagcttaa

SEQ ID NO: 4781770 - DNA, 23 bp, Homo sapiens
ctttaggtagtagaatctcagca

SEQ ID NO: 4781771 - DNA, 17 bp, Homo sapiens
ctttataagccaatgaa

SEQ ID NO: 4781772 - DNA, 20 bp, Homo sapiens
ctttataatggctctgggct

SEQ ID NO: 4781773 - DNA, 18 bp, Homo sapiens
ctttatcatgtgtttctg

SEQ ID NO: 4781774 - DNA, 12 bp, Homo sapiens
ctttatccacat

SEQ ID NO: 4781775 - DNA, 18 bp, Homo sapiens
ctttatccacattgtagc

SEQ ID NO: 4781776 - DNA, 13 bp, Homo sapiens
ctttatgatttca

SEQ ID NO: 4781777 - DNA, 15 bp, Homo sapiens
ctttatgatttcatg

SEQ ID NO: 4781778 - DNA, 12 bp, Homo sapiens
ctttatgtattc

SEQ ID NO: 4781779 - DNA, 13 bp, Homo sapiens
ctttattggtctt

SEQ ID NO: 4781780 - DNA, 13 bp, Homo sapiens
ctttattgtctgt

SEQ ID NO: 4781781 - DNA, 18 bp, Homo sapiens
ctttatttattaaacttc

SEQ ID NO: 4781782 - DNA, 21 bp, Homo sapiens
ctttatttattaaacttcagc

SEQ ID NO: 4781783 - DNA, 20 bp, Homo sapiens
ctttattttaaatgatctgt

SEQ ID NO: 4781784 - DNA, 16 bp, Homo sapiens
ctttattttatataat

SEQ ID NO: 4781785 - DNA, 17 bp, Homo sapiens
ctttcaaagtgcacaca

SEQ ID NO: 4781786 - DNA, 19 bp, Homo sapiens
ctttcaaagtgcacacaca

SEQ ID NO: 4781787 - DNA, 16 bp, Homo sapiens
ctttcaatccacagta

SEQ ID NO: 4781788 - DNA, 20 bp, Homo sapiens
ctttcacccttttctgtttg

SEQ ID NO: 4781789 - DNA, 20 bp, Homo sapiens
ctttcagccaagaattctta

SEQ ID NO: 4781790 - DNA, 16 bp, Homo sapiens
ctttcatactacattt

SEQ ID NO: 4781791 - DNA, 20 bp, Homo sapiens
ctttcatcaatcattgtaca

SEQ ID NO: 4781792 - DNA, 13 bp, Homo sapiens
ctttcatcctcag

SEQ ID NO: 4781793 - DNA, 14 bp, Homo sapiens
ctttcatcctcagc

SEQ ID NO: 4781794 - DNA, 21 bp, Homo sapiens
ctttcatgaccactgggcctg

SEQ ID NO: 4781795 - DNA, 15 bp, Homo sapiens
ctttccaacacacaa

SEQ ID NO: 4781796 - DNA, 14 bp, Homo sapiens
ctttccaggaaggc

SEQ ID NO: 4781797 - DNA, 15 bp, Homo sapiens
ctttccaggaaggct

SEQ ID NO: 4781798 - DNA, 15 bp, Homo sapiens
ctttccagtgctgct

SEQ ID NO: 4781799 - DNA, 16 bp, Homo sapiens
ctttccatcagcttta

SEQ ID NO: 4781800 - DNA, 20 bp, Homo sapiens
ctttccatcagctttataat

SEQ ID NO: 4781801 - DNA, 19 bp, Homo sapiens
ctttccatgacagtagcat

SEQ ID NO: 4781802 - DNA, 14 bp, Homo sapiens
ctttcccaaaccct

SEQ ID NO: 4781803 - DNA, 15 bp, Homo sapiens
ctttcccatcttaaa

SEQ ID NO: 4781804 - DNA, 16 bp, Homo sapiens
ctttccctgcatccct

SEQ ID NO: 4781805 - DNA, 17 bp, Homo sapiens
ctttccctgcatccctt

SEQ ID NO: 4781806 - DNA, 20 bp, Homo sapiens
ctttccgctgtcgccccagg

SEQ ID NO: 4781807 - DNA, 21 bp, Homo sapiens
ctttccgctgtcgccccaggc

SEQ ID NO: 4781808 - DNA, 14 bp, Homo sapiens
ctttcctcctcatg

SEQ ID NO: 4781809 - DNA, 18 bp, Homo sapiens
ctttcctctcctctctgg

SEQ ID NO: 4781810 - DNA, 11 bp, Homo sapiens
ctttccttcct

SEQ ID NO: 4781811 - DNA, 12 bp, Homo sapiens
ctttccttcctt

SEQ ID NO: 4781812 - DNA, 19 bp, Homo sapiens
ctttccttctgatctgaga

SEQ ID NO: 4781813 - DNA, 17 bp, Homo sapiens
ctttcctttcatcctca

SEQ ID NO: 4781814 - DNA, 18 bp, Homo sapiens
ctttcctttcatcctcag

SEQ ID NO: 4781815 - DNA, 23 bp, Homo sapiens
ctttcctttcatcctcagcaagt

SEQ ID NO: 4781816 - DNA, 14 bp, Homo sapiens
ctttcggaaatgat

SEQ ID NO: 4781817 - DNA, 15 bp, Homo sapiens
ctttctaaatgcctt

SEQ ID NO: 4781818 - DNA, 16 bp, Homo sapiens
ctttctaaatgccttt

SEQ ID NO: 4781819 - DNA, 18 bp, Homo sapiens
ctttctaagctttcttac

SEQ ID NO: 4781820 - DNA, 13 bp, Homo sapiens
ctttctatctaat

SEQ ID NO: 4781821 - DNA, 14 bp, Homo sapiens
ctttctatctaatt

SEQ ID NO: 4781822 - DNA, 18 bp, Homo sapiens
ctttctatctaattttta

SEQ ID NO: 4781823 - DNA, 14 bp, Homo sapiens
ctttctccaaagtt

SEQ ID NO: 4781824 - DNA, 20 bp, Homo sapiens
ctttctccaaagttatccag

SEQ ID NO: 4781825 - DNA, 14 bp, Homo sapiens
ctttctctctgtgt

SEQ ID NO: 4781826 - DNA, 16 bp, Homo sapiens
ctttctctctgtgtgg

SEQ ID NO: 4781827 - DNA, 20 bp, Homo sapiens
ctttctctctgtgtggcaaa

SEQ ID NO: 4781828 - DNA, 22 bp, Homo sapiens
ctttctgatacatctgtcagtg

SEQ ID NO: 4781829 - DNA, 23 bp, Homo sapiens
ctttctggaattgggctccgtgg

SEQ ID NO: 4781830 - DNA, 12 bp, Homo sapiens
ctttctggcttt

SEQ ID NO: 4781831 - DNA, 15 bp, Homo sapiens
ctttcttcaaaatat

SEQ ID NO: 4781832 - DNA, 16 bp, Homo sapiens
ctttcttcaattaatg

SEQ ID NO: 4781833 - DNA, 21 bp, Homo sapiens
ctttctttaacatatcattca

SEQ ID NO: 4781834 - DNA, 15 bp, Homo sapiens
ctttctttccaaagg

SEQ ID NO: 4781835 - DNA, 13 bp, Homo sapiens
ctttcttttgtgc

SEQ ID NO: 4781836 - DNA, 14 bp, Homo sapiens
ctttcttttgtgca

SEQ ID NO: 4781837 - DNA, 17 bp, Homo sapiens
ctttcttttttctctga

SEQ ID NO: 4781838 - DNA, 21 bp, Homo sapiens
ctttgacgagtcaccttccag

SEQ ID NO: 4781839 - DNA, 13 bp, Homo sapiens
ctttgagggactg

SEQ ID NO: 4781840 - DNA, 20 bp, Homo sapiens
ctttgagggactgcctctgc

SEQ ID NO: 4781841 - DNA, 22 bp, Homo sapiens
ctttgcaaccttgtactttaca

SEQ ID NO: 4781842 - DNA, 15 bp, Homo sapiens
ctttgctgtttatat

SEQ ID NO: 4781843 - DNA, 21 bp, Homo sapiens
ctttggcttaattccaatcat

SEQ ID NO: 4781844 - DNA, 16 bp, Homo sapiens
ctttggggctcctttc

SEQ ID NO: 4781845 - DNA, 17 bp, Homo sapiens
ctttggggcttatcaga

SEQ ID NO: 4781846 - DNA, 23 bp, Homo sapiens
ctttgggtagtgccatggccagg

SEQ ID NO: 4781847 - DNA, 21 bp, Homo sapiens
ctttgtcacttctgctgtaca

SEQ ID NO: 4781848 - DNA, 20 bp, Homo sapiens
ctttgtctcacgattccagt

SEQ ID NO: 4781849 - DNA, 14 bp, Homo sapiens
ctttgtgacaggaa

SEQ ID NO: 4781850 - DNA, 23 bp, Homo sapiens
ctttgtgacaggaaagccctccc

SEQ ID NO: 4781851 - DNA, 11 bp, Homo sapiens
ctttgtgctta

SEQ ID NO: 4781852 - DNA, 13 bp, Homo sapiens
ctttgtggggctt

SEQ ID NO: 4781853 - DNA, 15 bp, Homo sapiens
ctttgtgtcttttgt

SEQ ID NO: 4781854 - DNA, 22 bp, Homo sapiens
ctttgtgtcttttgttctctct

SEQ ID NO: 4781855 - DNA, 17 bp, Homo sapiens
ctttgttcttcaatgtg

SEQ ID NO: 4781856 - DNA, 14 bp, Homo sapiens
gaagggcaggagct

SEQ ID NO: 4781857 - DNA, 12 bp, Homo sapiens
gaaggggacagg

SEQ ID NO: 4781858 - DNA, 17 bp, Homo sapiens
gaaggggcctgggctgt

SEQ ID NO: 4781859 - DNA, 22 bp, Homo sapiens
gaaggggcctgggctgtgagga

SEQ ID NO: 4781860 - DNA, 20 bp, Homo sapiens
gaaggggcgctcctcccagc

SEQ ID NO: 4781861 - DNA, 11 bp, Homo sapiens
gaaggggctgg

SEQ ID NO: 4781862 - DNA, 13 bp, Homo sapiens
gaaggggctggtg

SEQ ID NO: 4781863 - DNA, 19 bp, Homo sapiens
gaaggggctggtggagatg

SEQ ID NO: 4781864 - DNA, 16 bp, Homo sapiens
gaagggggatgcaggc

SEQ ID NO: 4781865 - DNA, 23 bp, Homo sapiens
gaaggtcacgctgaatgagaagt

SEQ ID NO: 4781866 - DNA, 13 bp, Homo sapiens
gaagtatgcacta

SEQ ID NO: 4781867 - DNA, 15 bp, Homo sapiens
gaagtcaggagccag

SEQ ID NO: 4781868 - DNA, 19 bp, Homo sapiens
gaagtcaggagccagcagg

SEQ ID NO: 4781869 - DNA, 15 bp, Homo sapiens
gaagtcccttcctgt

SEQ ID NO: 4781870 - DNA, 18 bp, Homo sapiens
gaagtcccttcctgtcct

SEQ ID NO: 4781871 - DNA, 14 bp, Homo sapiens
gaagtccgaggcct

SEQ ID NO: 4781872 - DNA, 14 bp, Homo sapiens
gaagtctttgtaca

SEQ ID NO: 4781873 - DNA, 16 bp, Homo sapiens
gaagtctttgtacaga

SEQ ID NO: 4781874 - DNA, 13 bp, Homo sapiens
gaagtgaccaagg

SEQ ID NO: 4781875 - DNA, 13 bp, Homo sapiens
gaagtgcatgtta

SEQ ID NO: 4781876 - DNA, 14 bp, Homo sapiens
gaagtgtgttctga

SEQ ID NO: 4781877 - DNA, 20 bp, Homo sapiens
gaagttaaaggttactgttt

SEQ ID NO: 4781878 - DNA, 14 bp, Homo sapiens
gaagtttaaatctt

SEQ ID NO: 4781879 - DNA, 13 bp, Homo sapiens
gaagtttcattta

SEQ ID NO: 4781880 - DNA, 21 bp, Homo sapiens
gaagtttcatttatgatacaa

SEQ ID NO: 4781881 - DNA, 20 bp, Homo sapiens
gaagtttctgccgcagccct

SEQ ID NO: 4781882 - DNA, 15 bp, Homo sapiens
gaagttttacttgat

SEQ ID NO: 4781883 - DNA, 22 bp, Homo sapiens
gaagttttacttgattaaggac

SEQ ID NO: 4781884 - DNA, 23 bp, Homo sapiens
gaagttttacttgattaaggact

SEQ ID NO: 4781885 - DNA, 12 bp, Homo sapiens
gaataaagccac

SEQ ID NO: 4781886 - DNA, 20 bp, Homo sapiens
gaataaataagtaaatacat

SEQ ID NO: 4781887 - DNA, 16 bp, Homo sapiens
gaataacaacaattta

SEQ ID NO: 4781888 - DNA, 16 bp, Homo sapiens
gaataatgcctttgta

SEQ ID NO: 4781889 - DNA, 14 bp, Homo sapiens
gaatactaataaaa

SEQ ID NO: 4781890 - DNA, 18 bp, Homo sapiens
gaatactaataaaataca

SEQ ID NO: 4781891 - DNA, 13 bp, Homo sapiens
gaatataaatgtg

SEQ ID NO: 4781892 - DNA, 16 bp, Homo sapiens
gaatatacttagaaaa

SEQ ID NO: 4781893 - DNA, 20 bp, Homo sapiens
gaatatgaaagtcttattaa

SEQ ID NO: 4781894 - DNA, 16 bp, Homo sapiens
gaatatggacaaagaa

SEQ ID NO: 4781895 - DNA, 23 bp, Homo sapiens
gaatattaagcacattattgtag

SEQ ID NO: 4781896 - DNA, 12 bp, Homo sapiens
gaatattgagca

SEQ ID NO: 4781897 - DNA, 23 bp, Homo sapiens
gaatattgtattgttagatgttt

SEQ ID NO: 4781898 - DNA, 15 bp, Homo sapiens
gaatcaaaaattgaa

SEQ ID NO: 4781899 - DNA, 17 bp, Homo sapiens
gaatcaaataaaaattc

SEQ ID NO: 4781900 - DNA, 19 bp, Homo sapiens
gaatcaacagtgaacagct

SEQ ID NO: 4781901 - DNA, 13 bp, Homo sapiens
gaatcacagccaa

SEQ ID NO: 4781902 - DNA, 19 bp, Homo sapiens
gaatcacctaattaatttc

SEQ ID NO: 4781903 - DNA, 20 bp, Homo sapiens
gaatcacctaattaatttca

SEQ ID NO: 4781904 - DNA, 12 bp, Homo sapiens
gaatcattgctt

SEQ ID NO: 4781905 - DNA, 14 bp, Homo sapiens
gaatcattgcttat

SEQ ID NO: 4781906 - DNA, 15 bp, Homo sapiens
gaatccatatcagct

SEQ ID NO: 4781907 - DNA, 14 bp, Homo sapiens
gaatccctgttcat

SEQ ID NO: 4781908 - DNA, 18 bp, Homo sapiens
gaatctctaaaatgctgt

SEQ ID NO: 4781909 - DNA, 13 bp, Homo sapiens
gaatctgtgcagt

SEQ ID NO: 4781910 - DNA, 11 bp, Homo sapiens
gaatcttgatt

SEQ ID NO: 4781911 - DNA, 21 bp, Homo sapiens
gaatgaaatataaactgtgag

SEQ ID NO: 4781912 - DNA, 22 bp, Homo sapiens
gaatgaaatataaactgtgaga

SEQ ID NO: 4781913 - DNA, 22 bp, Homo sapiens
gaatgacaggaacccatcactg

SEQ ID NO: 4781914 - DNA, 17 bp, Homo sapiens
gaatgagcattctgcag

SEQ ID NO: 4781915 - DNA, 14 bp, Homo sapiens
gaatgatgccatga

SEQ ID NO: 4781916 - DNA, 20 bp, Homo sapiens
gaatgcgctcttcaccagga

SEQ ID NO: 4781917 - DNA, 17 bp, Homo sapiens
gaatgctcaatgtgctg

SEQ ID NO: 4781918 - DNA, 18 bp, Homo sapiens
gaatgctcaatgtgctgt

SEQ ID NO: 4781919 - DNA, 21 bp, Homo sapiens
gaatggagcagtacatgggaa

SEQ ID NO: 4781920 - DNA, 19 bp, Homo sapiens
gaatgggccaagccagggt

SEQ ID NO: 4781921 - DNA, 20 bp, Homo sapiens
gaatgggccaagccagggtt

SEQ ID NO: 4781922 - DNA, 17 bp, Homo sapiens
gaatggtgggctccaga

SEQ ID NO: 4781923 - DNA, 18 bp, Homo sapiens
gaatggtgggctccagag

SEQ ID NO: 4781924 - DNA, 22 bp, Homo sapiens
gaatggtgggctccagagtagg

SEQ ID NO: 4781925 - DNA, 21 bp, Homo sapiens
gaatgtcagtgtgactgatct

SEQ ID NO: 4781926 - DNA, 11 bp, Homo sapiens
gaatgtgaaaa

SEQ ID NO: 4781927 - DNA, 12 bp, Homo sapiens
gaatgtgaaaaa

SEQ ID NO: 4781928 - DNA, 19 bp, Homo sapiens
gaatgtgcaaagcagtatg

SEQ ID NO: 4781929 - DNA, 15 bp, Homo sapiens
gaattactgtttgaa

SEQ ID NO: 4781930 - DNA, 21 bp, Homo sapiens
gaattcaatgggtaaataaat

SEQ ID NO: 4781931 - DNA, 22 bp, Homo sapiens
gaattcaatgggtaaataaatg

SEQ ID NO: 4781932 - DNA, 22 bp, Homo sapiens
gaattcacccctcccacctctt

SEQ ID NO: 4781933 - DNA, 16 bp, Homo sapiens
gaattcagtagcattt

SEQ ID NO: 4781934 - DNA, 12 bp, Homo sapiens
gaattcattcat

SEQ ID NO: 4781935 - DNA, 21 bp, Homo sapiens
gaattccacctggaaagccag

SEQ ID NO: 4781936 - DNA, 19 bp, Homo sapiens
gaattgaaccgtcaatgtg

SEQ ID NO: 4781937 - DNA, 23 bp, Homo sapiens
gaattgaaccgtcaatgtgaaat

SEQ ID NO: 4781938 - DNA, 17 bp, Homo sapiens
gaattgagagatgtttt

SEQ ID NO: 4781939 - DNA, 20 bp, Homo sapiens
gaattgaggggaggtggcca

SEQ ID NO: 4781940 - DNA, 21 bp, Homo sapiens
gaattgaggggaggtggccag

SEQ ID NO: 4781941 - DNA, 12 bp, Homo sapiens
gaattgattttt

SEQ ID NO: 4781942 - DNA, 18 bp, Homo sapiens
gaattgccagtcttttgt

SEQ ID NO: 4781943 - DNA, 20 bp, Homo sapiens
gaattgggcccttagaatgt

SEQ ID NO: 4781944 - DNA, 22 bp, Homo sapiens
gaattgtgcgacttcacaaaat

SEQ ID NO: 4781945 - DNA, 18 bp, Homo sapiens
gaattgtgtggagaagtg

SEQ ID NO: 4781946 - DNA, 22 bp, Homo sapiens
gaattgttatgtaaacatcata

SEQ ID NO: 4781947 - DNA, 22 bp, Homo sapiens
gaattgtttttagaaatttatt

SEQ ID NO: 4781948 - DNA, 18 bp, Homo sapiens
gaatttcccaaagcagtg

SEQ ID NO: 4781949 - DNA, 22 bp, Homo sapiens
gaatttcccaaagcagtgcatg

SEQ ID NO: 4781950 - DNA, 21 bp, Homo sapiens
gaatttgaagacttcaaaata

SEQ ID NO: 4781951 - DNA, 17 bp, Homo sapiens
gaatttgtcgggttctc

SEQ ID NO: 4781952 - DNA, 20 bp, Homo sapiens
gaattttaaaaaagatggat

SEQ ID NO: 4781953 - DNA, 19 bp, Homo sapiens
gaattttaaaatgcaaata

SEQ ID NO: 4781954 - DNA, 23 bp, Homo sapiens
gaattttggctgtgtctcccttc

SEQ ID NO: 4781955 - DNA, 12 bp, Homo sapiens
gacaaacccttc

SEQ ID NO: 4781956 - DNA, 14 bp, Homo sapiens
gacaaaggccttaa

SEQ ID NO: 4781957 - DNA, 13 bp, Homo sapiens
gacaacacacaca

SEQ ID NO: 4781958 - DNA, 13 bp, Homo sapiens
gacaagggctgac

SEQ ID NO: 4781959 - DNA, 19 bp, Homo sapiens
gacaagggctgacctgcct

SEQ ID NO: 4781960 - DNA, 15 bp, Homo sapiens
gacaaggggtggaag

SEQ ID NO: 4781961 - DNA, 20 bp, Homo sapiens
gacaagtctgagtagttatg

SEQ ID NO: 4781962 - DNA, 13 bp, Homo sapiens
gacaataagaaac

SEQ ID NO: 4781963 - DNA, 11 bp, Homo sapiens
gacacaactca

SEQ ID NO: 4781964 - DNA, 19 bp, Homo sapiens
gacacaatggtagctctga

SEQ ID NO: 4781965 - DNA, 20 bp, Homo sapiens
gacacacggggcacccagcc

SEQ ID NO: 4781966 - DNA, 18 bp, Homo sapiens
gacacaggaaaccaacac

SEQ ID NO: 4781967 - DNA, 15 bp, Homo sapiens
gacacagttttgtct

SEQ ID NO: 4781968 - DNA, 14 bp, Homo sapiens
gacaccaccactgt

SEQ ID NO: 4781969 - DNA, 17 bp, Homo sapiens
gacaccaccactgtgtc

SEQ ID NO: 4781970 - DNA, 20 bp, Homo sapiens
gacaccagagtgtatgcata

SEQ ID NO: 4781971 - DNA, 18 bp, Homo sapiens
gacaccatcaccacgcag

SEQ ID NO: 4781972 - DNA, 15 bp, Homo sapiens
gacaccttcccagct

SEQ ID NO: 4781973 - DNA, 18 bp, Homo sapiens
gacaccttcccagctgct

SEQ ID NO: 4781974 - DNA, 16 bp, Homo sapiens
gacactctcacccccc

SEQ ID NO: 4781975 - DNA, 22 bp, Homo sapiens
gacactctcaccccccgacctg

SEQ ID NO: 4781976 - DNA, 20 bp, Homo sapiens
gacactgatgggtcctgctg

SEQ ID NO: 4781977 - DNA, 19 bp, Homo sapiens
gacagaaccaacgggtctg

SEQ ID NO: 4781978 - DNA, 23 bp, Homo sapiens
gacgcccagcccccacccccgtc

SEQ ID NO: 4781979 - DNA, 17 bp, Homo sapiens
gacgctggtaactgtta

SEQ ID NO: 4781980 - DNA, 19 bp, Homo sapiens
gacggacgggacagcggcc

SEQ ID NO: 4781981 - DNA, 14 bp, Homo sapiens
gacggatccacagt

SEQ ID NO: 4781982 - DNA, 20 bp, Homo sapiens
gacggcttccccatcgcctt

SEQ ID NO: 4781983 - DNA, 14 bp, Homo sapiens
gacggggcagagct

SEQ ID NO: 4781984 - DNA, 19 bp, Homo sapiens
gacggggcccgccccaggc

SEQ ID NO: 4781985 - DNA, 19 bp, Homo sapiens
gacggtattatgcttcttg

SEQ ID NO: 4781986 - DNA, 19 bp, Homo sapiens
gacgtcatcggaggctggg

SEQ ID NO: 4781987 - DNA, 21 bp, Homo sapiens
gacgtcatcggaggctgggcc

SEQ ID NO: 4781988 - DNA, 21 bp, Homo sapiens
gacgtcgctgtccgtcctgct

SEQ ID NO: 4781989 - DNA, 11 bp, Homo sapiens
gacgtgttatg

SEQ ID NO: 4781990 - DNA, 17 bp, Homo sapiens
gacgtttttgtgctgtg

SEQ ID NO: 4781991 - DNA, 20 bp, Homo sapiens
gacgtttttgtgctgtgggc

SEQ ID NO: 4781992 - DNA, 23 bp, Homo sapiens
gacgtttttgtgctgtgggcagc

SEQ ID NO: 4781993 - DNA, 22 bp, Homo sapiens
gactaaaacaagtacatctgta

SEQ ID NO: 4781994 - DNA, 16 bp, Homo sapiens
gactaacttattttga

SEQ ID NO: 4781995 - DNA, 21 bp, Homo sapiens
gactaacttattttgattgtt

SEQ ID NO: 4781996 - DNA, 17 bp, Homo sapiens
gactatagctgttctaa

SEQ ID NO: 4781997 - DNA, 12 bp, Homo sapiens
gactatggagcc

SEQ ID NO: 4781998 - DNA, 20 bp, Homo sapiens
gactatggagcctggcacag

SEQ ID NO: 4781999 - DNA, 23 bp, Homo sapiens
gactatttcaccatgttgccaat

SEQ ID NO: 4782000 - DNA, 23 bp, Homo sapiens
gactcagtgcagggacagcctgc

SEQ ID NO: 4782001 - DNA, 17 bp, Homo sapiens
gactccaagccctgggg

SEQ ID NO: 4782002 - DNA, 19 bp, Homo sapiens
gactccaagccctggggca

SEQ ID NO: 4782003 - DNA, 22 bp, Homo sapiens
gactccaagccctggggcaggg

SEQ ID NO: 4782004 - DNA, 23 bp, Homo sapiens
gactccaagccctggggcagggt

SEQ ID NO: 4782005 - DNA, 12 bp, Homo sapiens
gactccctgtgg

SEQ ID NO: 4782006 - DNA, 14 bp, Homo sapiens
gactccctgtgggg

SEQ ID NO: 4782007 - DNA, 24 bp, Homo sapiens
gactccctgtgggggtggccatcc

SEQ ID NO: 4782008 - DNA, 18 bp, Homo sapiens
gactccgagaagctctcg

SEQ ID NO: 4782009 - DNA, 24 bp, Homo sapiens
gactcgagagggctgagcccctcc

SEQ ID NO: 4782010 - DNA, 15 bp, Homo sapiens
gactcgcgagagggt

SEQ ID NO: 4782011 - DNA, 22 bp, Homo sapiens
gactctaaaactatcagcagcg

SEQ ID NO: 4782012 - DNA, 14 bp, Homo sapiens
gactctgtgagatt

SEQ ID NO: 4782013 - DNA, 16 bp, Homo sapiens
gactgatggttgcttt

SEQ ID NO: 4782014 - DNA, 12 bp, Homo sapiens
gactgattgttt

SEQ ID NO: 4782015 - DNA, 16 bp, Homo sapiens
gactgattgttttaaa

SEQ ID NO: 4782016 - DNA, 23 bp, Homo sapiens
gactgcaggttggaccccagaga

SEQ ID NO: 4782017 - DNA, 15 bp, Homo sapiens
gactgcccaccctgg

SEQ ID NO: 4782018 - DNA, 19 bp, Homo sapiens
gactgcccaccctgggcct

SEQ ID NO: 4782019 - DNA, 20 bp, Homo sapiens
gactgcccaccctgggcctc

SEQ ID NO: 4782020 - DNA, 21 bp, Homo sapiens
gactgcccaccctgggcctcc

SEQ ID NO: 4782021 - DNA, 12 bp, Homo sapiens
gactgcctctgc

SEQ ID NO: 4782022 - DNA, 17 bp, Homo sapiens
gactgctcaggctcccc

SEQ ID NO: 4782023 - DNA, 13 bp, Homo sapiens
gactggcccaccc

SEQ ID NO: 4782024 - DNA, 16 bp, Homo sapiens
gactggcccacccctc

SEQ ID NO: 4782025 - DNA, 17 bp, Homo sapiens
gactggcccacccctct

SEQ ID NO: 4782026 - DNA, 19 bp, Homo sapiens
gactggcccacccctcttc

SEQ ID NO: 4782027 - DNA, 18 bp, Homo sapiens
gactgggtgggccccaca

SEQ ID NO: 4782028 - DNA, 20 bp, Homo sapiens
gactggtcccccatgggctg

SEQ ID NO: 4782029 - DNA, 21 bp, Homo sapiens
gactgtcttcaaccctgccct

SEQ ID NO: 4782030 - DNA, 22 bp, Homo sapiens
gactgtggggtttttaatctct

SEQ ID NO: 4782031 - DNA, 17 bp, Homo sapiens
gactgttatctcggact

SEQ ID NO: 4782032 - DNA, 15 bp, Homo sapiens
gacttaatttagcag

SEQ ID NO: 4782033 - DNA, 15 bp, Homo sapiens
gacttccagctttct

SEQ ID NO: 4782034 - DNA, 13 bp, Homo sapiens
gacttccatttgg

SEQ ID NO: 4782035 - DNA, 24 bp, Homo sapiens
gacttccatttggaatcatatggg

SEQ ID NO: 4782036 - DNA, 16 bp, Homo sapiens
gacttcccagctggca

SEQ ID NO: 4782037 - DNA, 23 bp, Homo sapiens
gacttcgctattcccaggcaggg

SEQ ID NO: 4782038 - DNA, 21 bp, Homo sapiens
gacttcgggggcggctctggg

SEQ ID NO: 4782039 - DNA, 15 bp, Homo sapiens
gacttctaaaataaa

SEQ ID NO: 4782040 - DNA, 16 bp, Homo sapiens
gacttctaaaataaat

SEQ ID NO: 4782041 - DNA, 20 bp, Homo sapiens
gacttctaaaataaatgttt

SEQ ID NO: 4782042 - DNA, 14 bp, Homo sapiens
gacttctaaatcat

SEQ ID NO: 4782043 - DNA, 23 bp, Homo sapiens
gacttgacgcagccccccacgct

SEQ ID NO: 4782044 - DNA, 15 bp, Homo sapiens
gacttgccactgcca

SEQ ID NO: 4782045 - DNA, 20 bp, Homo sapiens
gacttgccactgccataact

SEQ ID NO: 4782046 - DNA, 12 bp, Homo sapiens
gacttttcccca

SEQ ID NO: 4782047 - DNA, 13 bp, Homo sapiens
gacttttccccat

SEQ ID NO: 4782048 - DNA, 15 bp, Homo sapiens
gagaaaaagccctct

SEQ ID NO: 4782049 - DNA, 14 bp, Homo sapiens
gagaaaagccagat

SEQ ID NO: 4782050 - DNA, 18 bp, Homo sapiens
gagaaaatgctttctcat

SEQ ID NO: 4782051 - DNA, 21 bp, Homo sapiens
gagaaacccaagtggaatcat

SEQ ID NO: 4782052 - DNA, 16 bp, Homo sapiens
gagaaagcatattgac

SEQ ID NO: 4782053 - DNA, 23 bp, Homo sapiens
gagaaatttttttccagaattga

SEQ ID NO: 4782054 - DNA, 19 bp, Homo sapiens
gagaactgtgaatatgtgt

SEQ ID NO: 4782055 - DNA, 20 bp, Homo sapiens
gagaactgtgaatatgtgta

SEQ ID NO: 4782056 - DNA, 16 bp, Homo sapiens
gagaagaaagaacgga

SEQ ID NO: 4782057 - DNA, 21 bp, Homo sapiens
gagaagcctcagtccctccct

SEQ ID NO: 4782058 - DNA, 20 bp, Homo sapiens
gagaagctctcgagggaagc

SEQ ID NO: 4782059 - DNA, 14 bp, Homo sapiens
gagaaggaggaacc

SEQ ID NO: 4782060 - DNA, 18 bp, Homo sapiens
gagaaggccccagggcag

SEQ ID NO: 4782061 - DNA, 20 bp, Homo sapiens
gagaaggccccagggcagcg

SEQ ID NO: 4782062 - DNA, 14 bp, Homo sapiens
gagaaggcctgccc

SEQ ID NO: 4782063 - DNA, 21 bp, Homo sapiens
gagaagggttcagcccaacat

SEQ ID NO: 4782064 - DNA, 15 bp, Homo sapiens
gagaagtaaattatt

SEQ ID NO: 4782065 - DNA, 19 bp, Homo sapiens
gagaagtaaattattttat

SEQ ID NO: 4782066 - DNA, 21 bp, Homo sapiens
gagaagtaaattattttatgt

SEQ ID NO: 4782067 - DNA, 15 bp, Homo sapiens
gagaagtgtgttctg

SEQ ID NO: 4782068 - DNA, 16 bp, Homo sapiens
gagaagtgtgttctga

SEQ ID NO: 4782069 - DNA, 18 bp, Homo sapiens
gagaatcgacctcactgt

SEQ ID NO: 4782070 - DNA, 20 bp, Homo sapiens
gagaatgcacaaacagaggc

SEQ ID NO: 4782071 - DNA, 21 bp, Homo sapiens
gagaatgcacaaacagaggcc

SEQ ID NO: 4782072 - DNA, 15 bp, Homo sapiens
gagaatgtcatttgc

SEQ ID NO: 4782073 - DNA, 19 bp, Homo sapiens
gagaatgtcatttgctaat

SEQ ID NO: 4782074 - DNA, 20 bp, Homo sapiens
gagaatgtcatttgctaatg

SEQ ID NO: 4782075 - DNA, 13 bp, Homo sapiens
gagaattactgtt

SEQ ID NO: 4782076 - DNA, 13 bp, Homo sapiens
gagaattctaaga

SEQ ID NO: 4782077 - DNA, 14 bp, Homo sapiens
gagacaacttgctc

SEQ ID NO: 4782078 - DNA, 15 bp, Homo sapiens
gagacacaagccttc

SEQ ID NO: 4782079 - DNA, 22 bp, Homo sapiens
gagaccaccgcgcccctctgcg

SEQ ID NO: 4782080 - DNA, 15 bp, Homo sapiens
gagaccacttcctta

SEQ ID NO: 4782081 - DNA, 18 bp, Homo sapiens
gagaccctgcgcccctgc

SEQ ID NO: 4782082 - DNA, 21 bp, Homo sapiens
gagaccctgcgcccctgccca

SEQ ID NO: 4782083 - DNA, 16 bp, Homo sapiens
gagaccgtgagcgccc

SEQ ID NO: 4782084 - DNA, 16 bp, Homo sapiens
gagacctcccccaggg

SEQ ID NO: 4782085 - DNA, 18 bp, Homo sapiens
gagacctcccccagggag

SEQ ID NO: 4782086 - DNA, 16 bp, Homo sapiens
gagacggcagccccat

SEQ ID NO: 4782087 - DNA, 12 bp, Homo sapiens
gagactaaatga

SEQ ID NO: 4782088 - DNA, 13 bp, Homo sapiens
gagactaaatgag

SEQ ID NO: 4782089 - DNA, 14 bp, Homo sapiens
gagactatggagcc

SEQ ID NO: 4782090 - DNA, 21 bp, Homo sapiens
gagactatggagcctggcaca

SEQ ID NO: 4782091 - DNA, 12 bp, Homo sapiens
gagactctgagg

SEQ ID NO: 4782092 - DNA, 16 bp, Homo sapiens
gagactgcccaccctg

SEQ ID NO: 4782093 - DNA, 20 bp, Homo sapiens
gagactgcccaccctgggcc

SEQ ID NO: 4782094 - DNA, 21 bp, Homo sapiens
gagacttcctattaatttatt

SEQ ID NO: 4782095 - DNA, 20 bp, Homo sapiens
gagagaagccacgctgtcct

SEQ ID NO: 4782096 - DNA, 18 bp, Homo sapiens
gagagacacagcgtccct

SEQ ID NO: 4782097 - DNA, 20 bp, Homo sapiens
gagagcccctggggcctaga

SEQ ID NO: 4782098 - DNA, 18 bp, Homo sapiens
gagagccctctgctgctt

SEQ ID NO: 4782099 - DNA, 16 bp, Homo sapiens
gatcaggaagagaagg

SEQ ID NO: 4782100 - DNA, 18 bp, Homo sapiens
gatcaggaagagaaggag

SEQ ID NO: 4782101 - DNA, 14 bp, Homo sapiens
gatcagtaaaatta

SEQ ID NO: 4782102 - DNA, 12 bp, Homo sapiens
gatccacccgcc

SEQ ID NO: 4782103 - DNA, 20 bp, Homo sapiens
gatccagagacctgctccag

SEQ ID NO: 4782104 - DNA, 21 bp, Homo sapiens
gatccagagacctgctccaga

SEQ ID NO: 4782105 - DNA, 23 bp, Homo sapiens
gatccagagagaagcaccccacc

SEQ ID NO: 4782106 - DNA, 17 bp, Homo sapiens
gatcccagagttatttc

SEQ ID NO: 4782107 - DNA, 19 bp, Homo sapiens
gatccccatggaacagccc

SEQ ID NO: 4782108 - DNA, 20 bp, Homo sapiens
gatccccatggaacagccct

SEQ ID NO: 4782109 - DNA, 22 bp, Homo sapiens
gatccccatggaacagccctgc

SEQ ID NO: 4782110 - DNA, 20 bp, Homo sapiens
gatcccccaaacagcatgtg

SEQ ID NO: 4782111 - DNA, 16 bp, Homo sapiens
gatcctcaaaaatcat

SEQ ID NO: 4782112 - DNA, 22 bp, Homo sapiens
gatcctcaaaaatcatcaaagt

SEQ ID NO: 4782113 - DNA, 21 bp, Homo sapiens
gatcctctcttcttttcccat

SEQ ID NO: 4782114 - DNA, 20 bp, Homo sapiens
gatcctctttccccactgaa

SEQ ID NO: 4782115 - DNA, 16 bp, Homo sapiens
gatcctggcctgagaa

SEQ ID NO: 4782116 - DNA, 13 bp, Homo sapiens
gatccttcaaagt

SEQ ID NO: 4782117 - DNA, 20 bp, Homo sapiens
gatcgtttcacatctgtata

SEQ ID NO: 4782118 - DNA, 22 bp, Homo sapiens
gatcgtttcacatctgtatatc

SEQ ID NO: 4782119 - DNA, 19 bp, Homo sapiens
gatctaaaaggaggacagg

SEQ ID NO: 4782120 - DNA, 13 bp, Homo sapiens
gatctagccaggc

SEQ ID NO: 4782121 - DNA, 14 bp, Homo sapiens
gatctagccaggcc

SEQ ID NO: 4782122 - DNA, 18 bp, Homo sapiens
gatctatgggaaatctag

SEQ ID NO: 4782123 - DNA, 20 bp, Homo sapiens
gatctcagataaagtgacca

SEQ ID NO: 4782124 - DNA, 21 bp, Homo sapiens
gatctcagcatcctggaaatt

SEQ ID NO: 4782125 - DNA, 12 bp, Homo sapiens
gatctcagctca

SEQ ID NO: 4782126 - DNA, 17 bp, Homo sapiens
gatctcagctcactgca

SEQ ID NO: 4782127 - DNA, 14 bp, Homo sapiens
gatctccaggccca

SEQ ID NO: 4782128 - DNA, 16 bp, Homo sapiens
gatctccaggcccagc

SEQ ID NO: 4782129 - DNA, 20 bp, Homo sapiens
gatctcctgtaattttgtag

SEQ ID NO: 4782130 - DNA, 12 bp, Homo sapiens
gatctcctgtgc

SEQ ID NO: 4782131 - DNA, 16 bp, Homo sapiens
gatctctgttctttca

SEQ ID NO: 4782132 - DNA, 20 bp, Homo sapiens
gatctgctatttttaatttc

SEQ ID NO: 4782133 - DNA, 17 bp, Homo sapiens
gatctggaaagagctgt

SEQ ID NO: 4782134 - DNA, 17 bp, Homo sapiens
gatctggagtctgaagg

SEQ ID NO: 4782135 - DNA, 12 bp, Homo sapiens
gatctgtattaa

SEQ ID NO: 4782136 - DNA, 20 bp, Homo sapiens
gatctgtatttaatggtttt

SEQ ID NO: 4782137 - DNA, 12 bp, Homo sapiens
gatctgtccttc

SEQ ID NO: 4782138 - DNA, 22 bp, Homo sapiens
gatctgtccttccaacctgttc

SEQ ID NO: 4782139 - DNA, 21 bp, Homo sapiens
gatctgtgcagcgaggtccac

SEQ ID NO: 4782140 - DNA, 12 bp, Homo sapiens
gatctgttgtaa

SEQ ID NO: 4782141 - DNA, 20 bp, Homo sapiens
gatcttgcctctttcctcct

SEQ ID NO: 4782142 - DNA, 19 bp, Homo sapiens
gatgaaaaaaagggaaaac

SEQ ID NO: 4782143 - DNA, 12 bp, Homo sapiens
gatgaagaccct

SEQ ID NO: 4782144 - DNA, 19 bp, Homo sapiens
gatgaagaccctatctccc

SEQ ID NO: 4782145 - DNA, 23 bp, Homo sapiens
gatgaagaccctatctcccacaa

SEQ ID NO: 4782146 - DNA, 14 bp, Homo sapiens
gatgaatgcagtat

SEQ ID NO: 4782147 - DNA, 12 bp, Homo sapiens
gatgacaaagaa

SEQ ID NO: 4782148 - DNA, 13 bp, Homo sapiens
gatgacagggagc

SEQ ID NO: 4782149 - DNA, 17 bp, Homo sapiens
gatgaccaatctctgtg

SEQ ID NO: 4782150 - DNA, 13 bp, Homo sapiens
gatgactgaattt

SEQ ID NO: 4782151 - DNA, 13 bp, Homo sapiens
gatgagaaaacag

SEQ ID NO: 4782152 - DNA, 17 bp, Homo sapiens
gatgagacaacacacac

SEQ ID NO: 4782153 - DNA, 21 bp, Homo sapiens
gatgagatcctcaaaaatcat

SEQ ID NO: 4782154 - DNA, 13 bp, Homo sapiens
gatgatctctcca

SEQ ID NO: 4782155 - DNA, 22 bp, Homo sapiens
gatgatctctccacggtagcac

SEQ ID NO: 4782156 - DNA, 16 bp, Homo sapiens
gatgatttaattctta

SEQ ID NO: 4782157 - DNA, 23 bp, Homo sapiens
gatgcagaaatgtggatgctctt

SEQ ID NO: 4782158 - DNA, 17 bp, Homo sapiens
gatgcatgagctccctc

SEQ ID NO: 4782159 - DNA, 12 bp, Homo sapiens
gatgcatgcagg

SEQ ID NO: 4782160 - DNA, 14 bp, Homo sapiens
gatgccgtgcgggc

SEQ ID NO: 4782161 - DNA, 15 bp, Homo sapiens
gatgcgtggctccca

SEQ ID NO: 4782162 - DNA, 20 bp, Homo sapiens
gatgctgctggaggaatcag

SEQ ID NO: 4782163 - DNA, 19 bp, Homo sapiens
gatgcttcatgtgaacgtg

SEQ ID NO: 4782164 - DNA, 18 bp, Homo sapiens
gatggaatcacagccaat

SEQ ID NO: 4782165 - DNA, 22 bp, Homo sapiens
gatggacagttcacaccctgca

SEQ ID NO: 4782166 - DNA, 20 bp, Homo sapiens
gatggacatgagagtagggc

SEQ ID NO: 4782167 - DNA, 12 bp, Homo sapiens
gatggagaagga

SEQ ID NO: 4782168 - DNA, 15 bp, Homo sapiens
gatggagaaggaagg

SEQ ID NO: 4782169 - DNA, 18 bp, Homo sapiens
gatggatctgctccatgc

SEQ ID NO: 4782170 - DNA, 14 bp, Homo sapiens
gatggatttgacac

SEQ ID NO: 4782171 - DNA, 15 bp, Homo sapiens
gatggatttgacaca

SEQ ID NO: 4782172 - DNA, 18 bp, Homo sapiens
gatggatttgacacactc

SEQ ID NO: 4782173 - DNA, 21 bp, Homo sapiens
gatggccaggcctcagggacc

SEQ ID NO: 4782174 - DNA, 15 bp, Homo sapiens
gatgggggatgcttc

SEQ ID NO: 4782175 - DNA, 17 bp, Homo sapiens
gatggggtgagaagtac

SEQ ID NO: 4782176 - DNA, 14 bp, Homo sapiens
gatgggtcctgctg

SEQ ID NO: 4782177 - DNA, 15 bp, Homo sapiens
gatgggtgtcccctg

SEQ ID NO: 4782178 - DNA, 20 bp, Homo sapiens
gatgggtgtcccctggtgcc

SEQ ID NO: 4782179 - DNA, 22 bp, Homo sapiens
gatgggttttgttaggggtggg

SEQ ID NO: 4782180 - DNA, 14 bp, Homo sapiens
gatggtgccccctg

SEQ ID NO: 4782181 - DNA, 15 bp, Homo sapiens
gatggtgccccctgg

SEQ ID NO: 4782182 - DNA, 20 bp, Homo sapiens
gatgtaatatagggtttgtt

SEQ ID NO: 4782183 - DNA, 19 bp, Homo sapiens
gatgtaccatgttaaagag

SEQ ID NO: 4782184 - DNA, 14 bp, Homo sapiens
gatgtattattata

SEQ ID NO: 4782185 - DNA, 22 bp, Homo sapiens
gatgtccaaacttaacagatca

SEQ ID NO: 4782186 - DNA, 11 bp, Homo sapiens
gatgtccctgt

SEQ ID NO: 4782187 - DNA, 13 bp, Homo sapiens
gatgtcccttccc

SEQ ID NO: 4782188 - DNA, 22 bp, Homo sapiens
gatgtctgaggataccttccat

SEQ ID NO: 4782189 - DNA, 17 bp, Homo sapiens
gatgtgatttatgcatt

SEQ ID NO: 4782190 - DNA, 13 bp, Homo sapiens
gatgtggatgaaa

SEQ ID NO: 4782191 - DNA, 19 bp, Homo sapiens
gatgtggatggaggtgatg

SEQ ID NO: 4782192 - DNA, 21 bp, Homo sapiens
gatgtgtccgtgaaagttgtg

SEQ ID NO: 4782193 - DNA, 20 bp, Homo sapiens
gatgtttagtagctgataaa

SEQ ID NO: 4782194 - DNA, 20 bp, Homo sapiens
gattaaattatcattgtttg

SEQ ID NO: 4782195 - DNA, 19 bp, Homo sapiens
gattaaggactacagaatt

SEQ ID NO: 4782196 - DNA, 18 bp, Homo sapiens
gattaagttataccagca

SEQ ID NO: 4782197 - DNA, 19 bp, Homo sapiens
gattaagttataccagcaa

SEQ ID NO: 4782198 - DNA, 14 bp, Homo sapiens
gattaatggcactg

SEQ ID NO: 4782199 - DNA, 16 bp, Homo sapiens
gattaatggcactgat

SEQ ID NO: 4782200 - DNA, 21 bp, Homo sapiens
gattaatttctgccatttcat

SEQ ID NO: 4782201 - DNA, 17 bp, Homo sapiens
gattacctgaaagccct

SEQ ID NO: 4782202 - DNA, 15 bp, Homo sapiens
gattagaaagaatta

SEQ ID NO: 4782203 - DNA, 16 bp, Homo sapiens
gattagaaagaattag

SEQ ID NO: 4782204 - DNA, 14 bp, Homo sapiens
gattagacaatgtg

SEQ ID NO: 4782205 - DNA, 16 bp, Homo sapiens
gattagacaatgtgga

SEQ ID NO: 4782206 - DNA, 13 bp, Homo sapiens
gattatgaaatgc

SEQ ID NO: 4782207 - DNA, 18 bp, Homo sapiens
gattatgaaatgccagac

SEQ ID NO: 4782208 - DNA, 18 bp, Homo sapiens
gattatttacaagaagaa

SEQ ID NO: 4782209 - DNA, 18 bp, Homo sapiens
gattcaaataaccctgaa

SEQ ID NO: 4782210 - DNA, 13 bp, Homo sapiens
gattcaatgtgaa

SEQ ID NO: 4782211 - DNA, 16 bp, Homo sapiens
gattcacctgtaaaac

SEQ ID NO: 4782212 - DNA, 18 bp, Homo sapiens
gattcacctgtaaaactt

SEQ ID NO: 4782213 - DNA, 19 bp, Homo sapiens
gattcacctgtaaaacttt

SEQ ID NO: 4782214 - DNA, 12 bp, Homo sapiens
gattccagtgca

SEQ ID NO: 4782215 - DNA, 21 bp, Homo sapiens
gattcccgtggctttgtgctt

SEQ ID NO: 4782216 - DNA, 18 bp, Homo sapiens
gattcctcccctggaagt

SEQ ID NO: 4782217 - DNA, 14 bp, Homo sapiens
gattcctctaagat

SEQ ID NO: 4782218 - DNA, 12 bp, Homo sapiens
gattctcctctc

SEQ ID NO: 4782219 - DNA, 15 bp, Homo sapiens
gattctcctctccca

SEQ ID NO: 4782220 - DNA, 18 bp, Homo sapiens
gattcttccttgccacaa

SEQ ID NO: 4782221 - DNA, 18 bp, Homo sapiens
gcaggaaagatcccaagt

SEQ ID NO: 4782222 - DNA, 11 bp, Homo sapiens
gcaggaaatag

SEQ ID NO: 4782223 - DNA, 21 bp, Homo sapiens
gcaggaaccgaggactccagg

SEQ ID NO: 4782224 - DNA, 15 bp, Homo sapiens
gcaggaagaccacat

SEQ ID NO: 4782225 - DNA, 17 bp, Homo sapiens
gcaggaagagatgctct

SEQ ID NO: 4782226 - DNA, 17 bp, Homo sapiens
gcaggaaggcctgggtg

SEQ ID NO: 4782227 - DNA, 18 bp, Homo sapiens
gcaggaagtcaggagcca

SEQ ID NO: 4782228 - DNA, 23 bp, Homo sapiens
gcaggaagtcaggagccagcagg

SEQ ID NO: 4782229 - DNA, 13 bp, Homo sapiens
gcaggagctcaca

SEQ ID NO: 4782230 - DNA, 18 bp, Homo sapiens
gcaggagctcacaccgca

SEQ ID NO: 4782231 - DNA, 22 bp, Homo sapiens
gcaggcaagacaccttcccagc

SEQ ID NO: 4782232 - DNA, 16 bp, Homo sapiens
gcaggcacacagcagc

SEQ ID NO: 4782233 - DNA, 17 bp, Homo sapiens
gcaggcacacagcagcc

SEQ ID NO: 4782234 - DNA, 23 bp, Homo sapiens
gcaggccacccccacctccctgc

SEQ ID NO: 4782235 - DNA, 13 bp, Homo sapiens
gcaggcctcccaa

SEQ ID NO: 4782236 - DNA, 14 bp, Homo sapiens
gcaggcctcccaag

SEQ ID NO: 4782237 - DNA, 21 bp, Homo sapiens
gcaggcgcgcaccgcccaacc

SEQ ID NO: 4782238 - DNA, 16 bp, Homo sapiens
gcaggcggtggggaga

SEQ ID NO: 4782239 - DNA, 15 bp, Homo sapiens
gcaggctaaagtgat

SEQ ID NO: 4782240 - DNA, 16 bp, Homo sapiens
gcagggacagttgggt

SEQ ID NO: 4782241 - DNA, 22 bp, Homo sapiens
gcagggagggaaacccggggaa

SEQ ID NO: 4782242 - DNA, 23 bp, Homo sapiens
gcagggcaaatgacatgcactga

SEQ ID NO: 4782243 - DNA, 23 bp, Homo sapiens
gcagggccagtcatggctgtccc

SEQ ID NO: 4782244 - DNA, 22 bp, Homo sapiens
gcagggccctgaaatggcctgt

SEQ ID NO: 4782245 - DNA, 14 bp, Homo sapiens
gcagggccctgggg

SEQ ID NO: 4782246 - DNA, 22 bp, Homo sapiens
gcagggccctggggtctctgag

SEQ ID NO: 4782247 - DNA, 14 bp, Homo sapiens
gcagggccgcaggg

SEQ ID NO: 4782248 - DNA, 19 bp, Homo sapiens
gcagggcgctccggcagag

SEQ ID NO: 4782249 - DNA, 20 bp, Homo sapiens
gcagggcgctccggcagagg

SEQ ID NO: 4782250 - DNA, 18 bp, Homo sapiens
gcagggcgggccaggaga

SEQ ID NO: 4782251 - DNA, 16 bp, Homo sapiens
gcagggctgggcgcct

SEQ ID NO: 4782252 - DNA, 15 bp, Homo sapiens
gcaggggctgcatcc

SEQ ID NO: 4782253 - DNA, 21 bp, Homo sapiens
gcaggggctgcatcctcagcc

SEQ ID NO: 4782254 - DNA, 16 bp, Homo sapiens
gcagggtggggggcca

SEQ ID NO: 4782255 - DNA, 14 bp, Homo sapiens
gcaggtcctgccca

SEQ ID NO: 4782256 - DNA, 20 bp, Homo sapiens
gcaggtgaccagaatgaggc

SEQ ID NO: 4782257 - DNA, 19 bp, Homo sapiens
gcaggttctctcctgtgag

SEQ ID NO: 4782258 - DNA, 22 bp, Homo sapiens
gcaggttgtgtgtgtgtgcagt

SEQ ID NO: 4782259 - DNA, 15 bp, Homo sapiens
gcagtaaatccacag

SEQ ID NO: 4782260 - DNA, 22 bp, Homo sapiens
gcagtacatcttgtgcatgcaa

SEQ ID NO: 4782261 - DNA, 14 bp, Homo sapiens
gcagtaccatccca

SEQ ID NO: 4782262 - DNA, 18 bp, Homo sapiens
gcagtaccatcccactga

SEQ ID NO: 4782263 - DNA, 21 bp, Homo sapiens
gcagtagtgccaaaaggcccc

SEQ ID NO: 4782264 - DNA, 17 bp, Homo sapiens
gcagtataaaatgtaaa

SEQ ID NO: 4782265 - DNA, 14 bp, Homo sapiens
gcagtcagactgaa

SEQ ID NO: 4782266 - DNA, 16 bp, Homo sapiens
gcagtcctcggcagct

SEQ ID NO: 4782267 - DNA, 19 bp, Homo sapiens
gcagtctttgctcagtgga

SEQ ID NO: 4782268 - DNA, 12 bp, Homo sapiens
gcagtgcagtgc

SEQ ID NO: 4782269 - DNA, 19 bp, Homo sapiens
gcagtgctagtgagctggg

SEQ ID NO: 4782270 - DNA, 13 bp, Homo sapiens
gcagtggagaggg

SEQ ID NO: 4782271 - DNA, 17 bp, Homo sapiens
gcagtggagaggggact

SEQ ID NO: 4782272 - DNA, 21 bp, Homo sapiens
gcagtggagaggggacttgga

SEQ ID NO: 4782273 - DNA, 22 bp, Homo sapiens
gcagtggcatcatctcagctca

SEQ ID NO: 4782274 - DNA, 14 bp, Homo sapiens
gcagtgtagatttt

SEQ ID NO: 4782275 - DNA, 22 bp, Homo sapiens
gcagtgtatttaatgtttgtaa

SEQ ID NO: 4782276 - DNA, 22 bp, Homo sapiens
gcagtgtcctgtgctttctgca

SEQ ID NO: 4782277 - DNA, 17 bp, Homo sapiens
gcagtgttcgcttggct

SEQ ID NO: 4782278 - DNA, 11 bp, Homo sapiens
gcagttctgca

SEQ ID NO: 4782279 - DNA, 18 bp, Homo sapiens
gcagttctgcaaatagaa

SEQ ID NO: 4782280 - DNA, 13 bp, Homo sapiens
gcagtttcagata

SEQ ID NO: 4782281 - DNA, 20 bp, Homo sapiens
gcataagattatatacaaag

SEQ ID NO: 4782282 - DNA, 16 bp, Homo sapiens
gcataccagttcttgc

SEQ ID NO: 4782283 - DNA, 14 bp, Homo sapiens
gcatactgatgaga

SEQ ID NO: 4782284 - DNA, 14 bp, Homo sapiens
gcatagagctatat

SEQ ID NO: 4782285 - DNA, 16 bp, Homo sapiens
gcatagggtttggaag

SEQ ID NO: 4782286 - DNA, 22 bp, Homo sapiens
gcatagtgtgctcggacacagt

SEQ ID NO: 4782287 - DNA, 11 bp, Homo sapiens
gcatataaatg

SEQ ID NO: 4782288 - DNA, 19 bp, Homo sapiens
gcatataaatgtttatatt

SEQ ID NO: 4782289 - DNA, 16 bp, Homo sapiens
gcatatataaaacaaa

SEQ ID NO: 4782290 - DNA, 14 bp, Homo sapiens
gcatattgactttt

SEQ ID NO: 4782291 - DNA, 14 bp, Homo sapiens
gcatcagcaagaca

SEQ ID NO: 4782292 - DNA, 21 bp, Homo sapiens
gcatcatcttgaacattaatc

SEQ ID NO: 4782293 - DNA, 21 bp, Homo sapiens
gcatccaaggaacttcatgct

SEQ ID NO: 4782294 - DNA, 14 bp, Homo sapiens
gcatccagtatctt

SEQ ID NO: 4782295 - DNA, 17 bp, Homo sapiens
gcatccagtatcttgaa

SEQ ID NO: 4782296 - DNA, 18 bp, Homo sapiens
gcatccagtatcttgaag

SEQ ID NO: 4782297 - DNA, 12 bp, Homo sapiens
gcatccccagtg

SEQ ID NO: 4782298 - DNA, 21 bp, Homo sapiens
gcatccctccaccccagtccc

SEQ ID NO: 4782299 - DNA, 13 bp, Homo sapiens
gcatcccttggcc

SEQ ID NO: 4782300 - DNA, 13 bp, Homo sapiens
gcatccgagcccc

SEQ ID NO: 4782301 - DNA, 15 bp, Homo sapiens
gcatccgagcccctg

SEQ ID NO: 4782302 - DNA, 17 bp, Homo sapiens
gcatccgagcccctgtt

SEQ ID NO: 4782303 - DNA, 22 bp, Homo sapiens
gcatccgagcccctgtttctcc

SEQ ID NO: 4782304 - DNA, 22 bp, Homo sapiens
gcatcctatcgatctggaaaga

SEQ ID NO: 4782305 - DNA, 13 bp, Homo sapiens
gcatcctcagccc

SEQ ID NO: 4782306 - DNA, 18 bp, Homo sapiens
gcatcctcagccccaggg

SEQ ID NO: 4782307 - DNA, 19 bp, Homo sapiens
gcatcctcagccccagggc

SEQ ID NO: 4782308 - DNA, 20 bp, Homo sapiens
gcatcctcagccccagggcc

SEQ ID NO: 4782309 - DNA, 22 bp, Homo sapiens
gcatcctcagccccagggccct

SEQ ID NO: 4782310 - DNA, 21 bp, Homo sapiens
gcatctaagacattcaccaac

SEQ ID NO: 4782311 - DNA, 18 bp, Homo sapiens
gcatctatctggtgattt

SEQ ID NO: 4782312 - DNA, 19 bp, Homo sapiens
gcatctctccccatatata

SEQ ID NO: 4782313 - DNA, 23 bp, Homo sapiens
gcatctctccccatatataaatt

SEQ ID NO: 4782314 - DNA, 12 bp, Homo sapiens
gcatctggccta

SEQ ID NO: 4782315 - DNA, 14 bp, Homo sapiens
gcatctggcctatg

SEQ ID NO: 4782316 - DNA, 20 bp, Homo sapiens
gcatctggcctatgaccctg

SEQ ID NO: 4782317 - DNA, 17 bp, Homo sapiens
gcatctggcctgggggc

SEQ ID NO: 4782318 - DNA, 18 bp, Homo sapiens
gcatgaatccatcgattt

SEQ ID NO: 4782319 - DNA, 23 bp, Homo sapiens
gcatgaatccatcgatttgtatt

SEQ ID NO: 4782320 - DNA, 17 bp, Homo sapiens
gcatgagaactaaatag

SEQ ID NO: 4782321 - DNA, 20 bp, Homo sapiens
gcatgagaatgtcatttgct

SEQ ID NO: 4782322 - DNA, 17 bp, Homo sapiens
gcatgagttctgcacat

SEQ ID NO: 4782323 - DNA, 17 bp, Homo sapiens
gcatgatttttgccctg

SEQ ID NO: 4782324 - DNA, 15 bp, Homo sapiens
gcatgcaaaaatgaa

SEQ ID NO: 4782325 - DNA, 17 bp, Homo sapiens
gcatgcaaaaatgaatt

SEQ ID NO: 4782326 - DNA, 21 bp, Homo sapiens
gcatgcagggcccccacagga

SEQ ID NO: 4782327 - DNA, 23 bp, Homo sapiens
gcatgcagggcccccacaggagc

SEQ ID NO: 4782328 - DNA, 19 bp, Homo sapiens
gcatgcatttagcatgagt

SEQ ID NO: 4782329 - DNA, 18 bp, Homo sapiens
gcatgcgggcttcctcct

SEQ ID NO: 4782330 - DNA, 14 bp, Homo sapiens
gcatgctcagtatt

SEQ ID NO: 4782331 - DNA, 12 bp, Homo sapiens
gcatgctgcctg

SEQ ID NO: 4782332 - DNA, 20 bp, Homo sapiens
gcatgctgcctgcctccggc

SEQ ID NO: 4782333 - DNA, 13 bp, Homo sapiens
gcatgcttagagc

SEQ ID NO: 4782334 - DNA, 15 bp, Homo sapiens
gcatgcttagagcat

SEQ ID NO: 4782335 - DNA, 17 bp, Homo sapiens
gcatgcttagagcatgt

SEQ ID NO: 4782336 - DNA, 23 bp, Homo sapiens
gcatgcttattagcagctgggtt

SEQ ID NO: 4782337 - DNA, 22 bp, Homo sapiens
gcatggccgcaacttcccaggc

SEQ ID NO: 4782338 - DNA, 16 bp, Homo sapiens
gcatgggaatgaatgt

SEQ ID NO: 4782339 - DNA, 20 bp, Homo sapiens
gcatggtaccagccctgggg

SEQ ID NO: 4782340 - DNA, 15 bp, Homo sapiens
gcatgtaagaaataa

SEQ ID NO: 4782341 - DNA, 17 bp, Homo sapiens
gcatgtagcatataaat

SEQ ID NO: 4782342 - DNA, 14 bp, Homo sapiens
gcccctccctcctg

SEQ ID NO: 4782343 - DNA, 20 bp, Homo sapiens
gcccctccgggcagagacca

SEQ ID NO: 4782344 - DNA, 18 bp, Homo sapiens
gcccctccgtccccaggg

SEQ ID NO: 4782345 - DNA, 14 bp, Homo sapiens
gcccctcctccaga

SEQ ID NO: 4782346 - DNA, 18 bp, Homo sapiens
gcccctcctccagagcct

SEQ ID NO: 4782347 - DNA, 11 bp, Homo sapiens
gcccctcctcg

SEQ ID NO: 4782348 - DNA, 15 bp, Homo sapiens
gcccctcctctcctc

SEQ ID NO: 4782349 - DNA, 23 bp, Homo sapiens
gcccctcctctcctcgtccggcc

SEQ ID NO: 4782350 - DNA, 13 bp, Homo sapiens
gcccctccttctc

SEQ ID NO: 4782351 - DNA, 14 bp, Homo sapiens
gcccctccttctcc

SEQ ID NO: 4782352 - DNA, 18 bp, Homo sapiens
gcccctccttctcccctc

SEQ ID NO: 4782353 - DNA, 22 bp, Homo sapiens
gcccctccttctcccctccaga

SEQ ID NO: 4782354 - DNA, 14 bp, Homo sapiens
gcccctctgcgccc

SEQ ID NO: 4782355 - DNA, 17 bp, Homo sapiens
gcccctcttccctggcc

SEQ ID NO: 4782356 - DNA, 19 bp, Homo sapiens
gcccctgcacctgcttctc

SEQ ID NO: 4782357 - DNA, 16 bp, Homo sapiens
gcccctgcctgagacc

SEQ ID NO: 4782358 - DNA, 21 bp, Homo sapiens
gcccctgcgtgtgttctctcc

SEQ ID NO: 4782359 - DNA, 15 bp, Homo sapiens
gcccctgctggacca

SEQ ID NO: 4782360 - DNA, 17 bp, Homo sapiens
gcccctgctggaccaag

SEQ ID NO: 4782361 - DNA, 15 bp, Homo sapiens
gcccctggcagcccc

SEQ ID NO: 4782362 - DNA, 22 bp, Homo sapiens
gcccctgggatgggaccaggga

SEQ ID NO: 4782363 - DNA, 16 bp, Homo sapiens
gcccctggggcctaga

SEQ ID NO: 4782364 - DNA, 22 bp, Homo sapiens
gcccctgtccatccgtctctgt

SEQ ID NO: 4782365 - DNA, 18 bp, Homo sapiens
gcccctgtttctcctcca

SEQ ID NO: 4782366 - DNA, 22 bp, Homo sapiens
gccccttctaggggcaggtgaa

SEQ ID NO: 4782367 - DNA, 17 bp, Homo sapiens
gccccttgaccccacac

SEQ ID NO: 4782368 - DNA, 19 bp, Homo sapiens
gccccttgaccccacacgc

SEQ ID NO: 4782369 - DNA, 13 bp, Homo sapiens
gcccgagcccctt

SEQ ID NO: 4782370 - DNA, 15 bp, Homo sapiens
gcccgagcgcgtgcc

SEQ ID NO: 4782371 - DNA, 23 bp, Homo sapiens
gcccgagcgcgtgccttccccgt

SEQ ID NO: 4782372 - DNA, 13 bp, Homo sapiens
gcccgaggcaccg

SEQ ID NO: 4782373 - DNA, 14 bp, Homo sapiens
gcccgaggccaggg

SEQ ID NO: 4782374 - DNA, 13 bp, Homo sapiens
gcccgcacaccct

SEQ ID NO: 4782375 - DNA, 23 bp, Homo sapiens
gcccgcacaccctcactctgcca

SEQ ID NO: 4782376 - DNA, 13 bp, Homo sapiens
gcccgcacagcag

SEQ ID NO: 4782377 - DNA, 16 bp, Homo sapiens
gcccgcactcaggagc

SEQ ID NO: 4782378 - DNA, 23 bp, Homo sapiens
gcccgcactcaggagcacagcca

SEQ ID NO: 4782379 - DNA, 22 bp, Homo sapiens
gcccgcagaggtggggtgctgg

SEQ ID NO: 4782380 - DNA, 23 bp, Homo sapiens
gcccgccaccttgtacagaacca

SEQ ID NO: 4782381 - DNA, 12 bp, Homo sapiens
gcccgcccaccc

SEQ ID NO: 4782382 - DNA, 17 bp, Homo sapiens
gcccgcccaccccgctg

SEQ ID NO: 4782383 - DNA, 22 bp, Homo sapiens
gcccgcccaccccgctgcctgg

SEQ ID NO: 4782384 - DNA, 23 bp, Homo sapiens
gcccgcccaccccgctgcctggc

SEQ ID NO: 4782385 - DNA, 16 bp, Homo sapiens
gcccgcccacctgggc

SEQ ID NO: 4782386 - DNA, 21 bp, Homo sapiens
gcccgcccacctgggccctag

SEQ ID NO: 4782387 - DNA, 12 bp, Homo sapiens
gcccgccccagg

SEQ ID NO: 4782388 - DNA, 12 bp, Homo sapiens
gcccgcccccgc

SEQ ID NO: 4782389 - DNA, 17 bp, Homo sapiens
gcccgcccccgccctcg

SEQ ID NO: 4782390 - DNA, 15 bp, Homo sapiens
gcccgccctcctctg

SEQ ID NO: 4782391 - DNA, 16 bp, Homo sapiens
gcccgccctcctctgc

SEQ ID NO: 4782392 - DNA, 19 bp, Homo sapiens
gcccgccctcctctgcccc

SEQ ID NO: 4782393 - DNA, 20 bp, Homo sapiens
gcccgccctcctctgccccc

SEQ ID NO: 4782394 - DNA, 21 bp, Homo sapiens
gcccgccctcctctgccccct

SEQ ID NO: 4782395 - DNA, 12 bp, Homo sapiens
gcccgccctgcc

SEQ ID NO: 4782396 - DNA, 14 bp, Homo sapiens
gcccgccctgcccg

SEQ ID NO: 4782397 - DNA, 16 bp, Homo sapiens
gcccgccgcctccctc

SEQ ID NO: 4782398 - DNA, 23 bp, Homo sapiens
gcccgccggttggccggctggcc

SEQ ID NO: 4782399 - DNA, 15 bp, Homo sapiens
gcccgcctgcgcccc

SEQ ID NO: 4782400 - DNA, 24 bp, Homo sapiens
gcccgcctgcgccccccagtggac

SEQ ID NO: 4782401 - DNA, 20 bp, Homo sapiens
gcccgcgggtggctggagcc

SEQ ID NO: 4782402 - DNA, 20 bp, Homo sapiens
gcccggagatgcatctgtgg

SEQ ID NO: 4782403 - DNA, 22 bp, Homo sapiens
gcccggagatgcatctgtggcc

SEQ ID NO: 4782404 - DNA, 21 bp, Homo sapiens
gcccggcccacgcagagcccc

SEQ ID NO: 4782405 - DNA, 23 bp, Homo sapiens
gcccggcccacgcagagccccgg

SEQ ID NO: 4782406 - DNA, 15 bp, Homo sapiens
gcccggcctcctagc

SEQ ID NO: 4782407 - DNA, 17 bp, Homo sapiens
gcccggcctcctagcct

SEQ ID NO: 4782408 - DNA, 19 bp, Homo sapiens
gcccggcctcctagcctct

SEQ ID NO: 4782409 - DNA, 14 bp, Homo sapiens
gcccgtgcgcagcc

SEQ ID NO: 4782410 - DNA, 15 bp, Homo sapiens
gcccgtgcgcagccg

SEQ ID NO: 4782411 - DNA, 21 bp, Homo sapiens
gcccgtgcgcagccgcgctct

SEQ ID NO: 4782412 - DNA, 23 bp, Homo sapiens
gcccgtgcgcagccgcgctctgc

SEQ ID NO: 4782413 - DNA, 15 bp, Homo sapiens
gcccgtgtggcctgg

SEQ ID NO: 4782414 - DNA, 20 bp, Homo sapiens
gccctaggcatactctccag

SEQ ID NO: 4782415 - DNA, 21 bp, Homo sapiens
gccctaggcatactctccagg

SEQ ID NO: 4782416 - DNA, 19 bp, Homo sapiens
gccctcactccactcccct

SEQ ID NO: 4782417 - DNA, 13 bp, Homo sapiens
gccctcccccacg

SEQ ID NO: 4782418 - DNA, 10 bp, Homo sapiens
gccctccctc

SEQ ID NO: 4782419 - DNA, 20 bp, Homo sapiens
gccctccctgactccctgtg

SEQ ID NO: 4782420 - DNA, 23 bp, Homo sapiens
gccctccctgactccctgtgggg

SEQ ID NO: 4782421 - DNA, 13 bp, Homo sapiens
gccctccctgctg

SEQ ID NO: 4782422 - DNA, 16 bp, Homo sapiens
gccctccctgctgcca

SEQ ID NO: 4782423 - DNA, 16 bp, Homo sapiens
gccctccgccagccct

SEQ ID NO: 4782424 - DNA, 17 bp, Homo sapiens
gccctccgccagccctg

SEQ ID NO: 4782425 - DNA, 15 bp, Homo sapiens
gccctccgcccttcc

SEQ ID NO: 4782426 - DNA, 11 bp, Homo sapiens
gccctcctctg

SEQ ID NO: 4782427 - DNA, 21 bp, Homo sapiens
gccctcctctgccccctcccc

SEQ ID NO: 4782428 - DNA, 22 bp, Homo sapiens
gccctcctctgccccctccccc

SEQ ID NO: 4782429 - DNA, 22 bp, Homo sapiens
gccctctcactgacttctcccg

SEQ ID NO: 4782430 - DNA, 16 bp, Homo sapiens
gccctctccttcctta

SEQ ID NO: 4782431 - DNA, 15 bp, Homo sapiens
gccctctctccgccc

SEQ ID NO: 4782432 - DNA, 13 bp, Homo sapiens
gccctctctgcag

SEQ ID NO: 4782433 - DNA, 22 bp, Homo sapiens
gccctctctgcagtcctcggca

SEQ ID NO: 4782434 - DNA, 18 bp, Homo sapiens
gccctctgccactgacag

SEQ ID NO: 4782435 - DNA, 11 bp, Homo sapiens
gccctcttcaa

SEQ ID NO: 4782436 - DNA, 21 bp, Homo sapiens
gccctctttctctctgtgtgg

SEQ ID NO: 4782437 - DNA, 23 bp, Homo sapiens
gccctctttctctctgtgtggca

SEQ ID NO: 4782438 - DNA, 16 bp, Homo sapiens
gccctgaaatggcctg

SEQ ID NO: 4782439 - DNA, 17 bp, Homo sapiens
gccctgaaatggcctgt

SEQ ID NO: 4782440 - DNA, 19 bp, Homo sapiens
gccctgaaatggcctgtcc

SEQ ID NO: 4782441 - DNA, 21 bp, Homo sapiens
gccctgacatgctaacctctc

SEQ ID NO: 4782442 - DNA, 16 bp, Homo sapiens
gccctgaggaaggagg

SEQ ID NO: 4782443 - DNA, 22 bp, Homo sapiens
gccctgaggaaggaggggaagc

SEQ ID NO: 4782444 - DNA, 22 bp, Homo sapiens
gccctgatgcgtctacccagac

SEQ ID NO: 4782445 - DNA, 13 bp, Homo sapiens
gccctgcagtgtt

SEQ ID NO: 4782446 - DNA, 17 bp, Homo sapiens
gccctgccctcactcca

SEQ ID NO: 4782447 - DNA, 18 bp, Homo sapiens
gccctgccctcactccac

SEQ ID NO: 4782448 - DNA, 19 bp, Homo sapiens
gccctgccctcactccact

SEQ ID NO: 4782449 - DNA, 17 bp, Homo sapiens
gccctgccgtgggcaag

SEQ ID NO: 4782450 - DNA, 14 bp, Homo sapiens
gccctgctcaggcc

SEQ ID NO: 4782451 - DNA, 19 bp, Homo sapiens
gccctggcccggtcccagt

SEQ ID NO: 4782452 - DNA, 21 bp, Homo sapiens
gccctggcccggtcccagtcc

SEQ ID NO: 4782453 - DNA, 11 bp, Homo sapiens
gccctggccta

SEQ ID NO: 4782454 - DNA, 12 bp, Homo sapiens
gccctggcctac

SEQ ID NO: 4782455 - DNA, 23 bp, Homo sapiens
gccctggcctaccacagctgcct

SEQ ID NO: 4782456 - DNA, 14 bp, Homo sapiens
gccctgggcctcag

SEQ ID NO: 4782457 - DNA, 23 bp, Homo sapiens
gccctgggcctcagttcaacctg

SEQ ID NO: 4782458 - DNA, 21 bp, Homo sapiens
gccctgggctgtctgtcacca

SEQ ID NO: 4782459 - DNA, 12 bp, Homo sapiens
gccctggggtct

SEQ ID NO: 4782460 - DNA, 14 bp, Homo sapiens
gccctgtagccctg

SEQ ID NO: 4782461 - DNA, 14 bp, Homo sapiens
gccctgtagctcct

SEQ ID NO: 4782462 - DNA, 11 bp, Homo sapiens
gccctgtcact

SEQ ID NO: 4782463 - DNA, 15 bp, Homo sapiens
gccctgtgccctctc

SEQ ID NO: 4782464 - DNA, 19 bp, Homo sapiens
gctcacaccggcactgtgc

SEQ ID NO: 4782465 - DNA, 17 bp, Homo sapiens
gctcacagcacatttgt

SEQ ID NO: 4782466 - DNA, 11 bp, Homo sapiens
gctcacagcca

SEQ ID NO: 4782467 - DNA, 13 bp, Homo sapiens
gctcacagccacc

SEQ ID NO: 4782468 - DNA, 17 bp, Homo sapiens
gctcacccgcctcttgc

SEQ ID NO: 4782469 - DNA, 14 bp, Homo sapiens
gctcagaggagagg

SEQ ID NO: 4782470 - DNA, 16 bp, Homo sapiens
gctcagccccagacct

SEQ ID NO: 4782471 - DNA, 13 bp, Homo sapiens
gctcaggcctcac

SEQ ID NO: 4782472 - DNA, 16 bp, Homo sapiens
gctcaggctccccaag

SEQ ID NO: 4782473 - DNA, 17 bp, Homo sapiens
gctcaggctccccaaga

SEQ ID NO: 4782474 - DNA, 12 bp, Homo sapiens
gctcaggctgcc

SEQ ID NO: 4782475 - DNA, 15 bp, Homo sapiens
gctcaggctgcccag

SEQ ID NO: 4782476 - DNA, 11 bp, Homo sapiens
gctcagtattg

SEQ ID NO: 4782477 - DNA, 22 bp, Homo sapiens
gctcagtcccacagccccttgc

SEQ ID NO: 4782478 - DNA, 15 bp, Homo sapiens
gctcatagcacatgt

SEQ ID NO: 4782479 - DNA, 16 bp, Homo sapiens
gctcatagcacatgtt

SEQ ID NO: 4782480 - DNA, 15 bp, Homo sapiens
gctcatctacacata

SEQ ID NO: 4782481 - DNA, 17 bp, Homo sapiens
gctccaccctcccctct

SEQ ID NO: 4782482 - DNA, 19 bp, Homo sapiens
gctccaccctcccctcttc

SEQ ID NO: 4782483 - DNA, 23 bp, Homo sapiens
gctccactctgaagtcccttcct

SEQ ID NO: 4782484 - DNA, 15 bp, Homo sapiens
gctccagtagctccg

SEQ ID NO: 4782485 - DNA, 20 bp, Homo sapiens
gctccagtttctcttaagct

SEQ ID NO: 4782486 - DNA, 14 bp, Homo sapiens
gctccatcttattt

SEQ ID NO: 4782487 - DNA, 13 bp, Homo sapiens
gctccatgcacag

SEQ ID NO: 4782488 - DNA, 14 bp, Homo sapiens
gctccatgcacagg

SEQ ID NO: 4782489 - DNA, 23 bp, Homo sapiens
gctccatgcagatctagccaggc

SEQ ID NO: 4782490 - DNA, 19 bp, Homo sapiens
gctccatgctcctcactgc

SEQ ID NO: 4782491 - DNA, 12 bp, Homo sapiens
gctccattcctg

SEQ ID NO: 4782492 - DNA, 18 bp, Homo sapiens
gctcccactgcccctgca

SEQ ID NO: 4782493 - DNA, 23 bp, Homo sapiens
gctcccagggtcctgggggctgc

SEQ ID NO: 4782494 - DNA, 17 bp, Homo sapiens
gctccccaatccaaccc

SEQ ID NO: 4782495 - DNA, 18 bp, Homo sapiens
gctccctccctccctgct

SEQ ID NO: 4782496 - DNA, 16 bp, Homo sapiens
gctccctcgctgtatg

SEQ ID NO: 4782497 - DNA, 21 bp, Homo sapiens
gctcccttgagctggttttct

SEQ ID NO: 4782498 - DNA, 21 bp, Homo sapiens
gctccctttttgaattgtgtg

SEQ ID NO: 4782499 - DNA, 17 bp, Homo sapiens
gctccgcgtgtctcatt

SEQ ID NO: 4782500 - DNA, 21 bp, Homo sapiens
gctccgcgtgtctcatttgcc

SEQ ID NO: 4782501 - DNA, 17 bp, Homo sapiens
gctccggcagaggcagg

SEQ ID NO: 4782502 - DNA, 14 bp, Homo sapiens
gctccgggtgcgtg

SEQ ID NO: 4782503 - DNA, 18 bp, Homo sapiens
gctcctcactgcccgcac

SEQ ID NO: 4782504 - DNA, 23 bp, Homo sapiens
gctcctcactgcccgcacaccct

SEQ ID NO: 4782505 - DNA, 12 bp, Homo sapiens
gctcctcccagc

SEQ ID NO: 4782506 - DNA, 15 bp, Homo sapiens
gctcctctgcagcct

SEQ ID NO: 4782507 - DNA, 17 bp, Homo sapiens
gctccttcatgcttttc

SEQ ID NO: 4782508 - DNA, 15 bp, Homo sapiens
gctcctttccatcag

SEQ ID NO: 4782509 - DNA, 22 bp, Homo sapiens
gctcctttccatcagctttata

SEQ ID NO: 4782510 - DNA, 13 bp, Homo sapiens
gctcctttcccct

SEQ ID NO: 4782511 - DNA, 16 bp, Homo sapiens
gctcctttcccctctc

SEQ ID NO: 4782512 - DNA, 14 bp, Homo sapiens
gctcggacacagtt

SEQ ID NO: 4782513 - DNA, 15 bp, Homo sapiens
gctcgggaaggcctg

SEQ ID NO: 4782514 - DNA, 17 bp, Homo sapiens
gctcgggaaggcctgag

SEQ ID NO: 4782515 - DNA, 21 bp, Homo sapiens
gctctagggttgctggagcct

SEQ ID NO: 4782516 - DNA, 14 bp, Homo sapiens
gctctcaggccagc

SEQ ID NO: 4782517 - DNA, 17 bp, Homo sapiens
gctctcaggccagctgc

SEQ ID NO: 4782518 - DNA, 14 bp, Homo sapiens
gctctccatctctt

SEQ ID NO: 4782519 - DNA, 13 bp, Homo sapiens
gctctccgccccc

SEQ ID NO: 4782520 - DNA, 17 bp, Homo sapiens
gctctccgccccccggc

SEQ ID NO: 4782521 - DNA, 11 bp, Homo sapiens
gctctcctcca

SEQ ID NO: 4782522 - DNA, 15 bp, Homo sapiens
gctctctaagaattc

SEQ ID NO: 4782523 - DNA, 12 bp, Homo sapiens
gctctctggacc

SEQ ID NO: 4782524 - DNA, 18 bp, Homo sapiens
gctctctggacctgacca

SEQ ID NO: 4782525 - DNA, 11 bp, Homo sapiens
gctctctgtct

SEQ ID NO: 4782526 - DNA, 23 bp, Homo sapiens
gctctcttgccgaggagccaggc

SEQ ID NO: 4782527 - DNA, 11 bp, Homo sapiens
gctctgaaggg

SEQ ID NO: 4782528 - DNA, 13 bp, Homo sapiens
gctctgaagggag

SEQ ID NO: 4782529 - DNA, 18 bp, Homo sapiens
gctctgaagggaggggaa

SEQ ID NO: 4782530 - DNA, 22 bp, Homo sapiens
gctctgaagggaggggaagaga

SEQ ID NO: 4782531 - DNA, 16 bp, Homo sapiens
gctctgaatctctcaa

SEQ ID NO: 4782532 - DNA, 21 bp, Homo sapiens
gctctgaatctctcaaaatgt

SEQ ID NO: 4782533 - DNA, 15 bp, Homo sapiens
gctctgagcagacag

SEQ ID NO: 4782534 - DNA, 18 bp, Homo sapiens
gctctgagcagttgttat

SEQ ID NO: 4782535 - DNA, 12 bp, Homo sapiens
gctctgcccctc

SEQ ID NO: 4782536 - DNA, 13 bp, Homo sapiens
gctctgcccctcc

SEQ ID NO: 4782537 - DNA, 17 bp, Homo sapiens
gctctggctttcgtgtt

SEQ ID NO: 4782538 - DNA, 20 bp, Homo sapiens
gctctgggctatatgcctat

SEQ ID NO: 4782539 - DNA, 16 bp, Homo sapiens
gctctgtagcctggtc

SEQ ID NO: 4782540 - DNA, 20 bp, Homo sapiens
gctctgtagcctggtctgtg

SEQ ID NO: 4782541 - DNA, 19 bp, Homo sapiens
gctctgtcttggtaggttt

SEQ ID NO: 4782542 - DNA, 19 bp, Homo sapiens
gctcttaagtaccagaagc

SEQ ID NO: 4782543 - DNA, 15 bp, Homo sapiens
gctcttcaccaggaa

SEQ ID NO: 4782544 - DNA, 16 bp, Homo sapiens
gctcttcaccaggaag

SEQ ID NO: 4782545 - DNA, 23 bp, Homo sapiens
gctcttctgttctcaaatgctaa

SEQ ID NO: 4782546 - DNA, 17 bp, Homo sapiens
gctcttggcaggagtgg

SEQ ID NO: 4782547 - DNA, 19 bp, Homo sapiens
gctgaaaaccatctggcct

SEQ ID NO: 4782548 - DNA, 16 bp, Homo sapiens
gctgaaattatgtcaa

SEQ ID NO: 4782549 - DNA, 18 bp, Homo sapiens
gctgaaattatgtcaaat

SEQ ID NO: 4782550 - DNA, 15 bp, Homo sapiens
gctgaataacaacaa

SEQ ID NO: 4782551 - DNA, 14 bp, Homo sapiens
gctgactcagtgca

SEQ ID NO: 4782552 - DNA, 14 bp, Homo sapiens
gctgactcttacta

SEQ ID NO: 4782553 - DNA, 15 bp, Homo sapiens
gctgacttgcagacg

SEQ ID NO: 4782554 - DNA, 21 bp, Homo sapiens
gctgagagggtgtgggtgccc

SEQ ID NO: 4782555 - DNA, 18 bp, Homo sapiens
gctgagatgtttagtagc

SEQ ID NO: 4782556 - DNA, 19 bp, Homo sapiens
gctgagcccctccctcctg

SEQ ID NO: 4782557 - DNA, 21 bp, Homo sapiens
gctgagcccctccctcctgtg

SEQ ID NO: 4782558 - DNA, 15 bp, Homo sapiens
gctgagcccctcctc

SEQ ID NO: 4782559 - DNA, 19 bp, Homo sapiens
gctgagcccctcctctcct

SEQ ID NO: 4782560 - DNA, 21 bp, Homo sapiens
gctgagcccctcctctcctcg

SEQ ID NO: 4782561 - DNA, 19 bp, Homo sapiens
gctgaggacggggcagagc

SEQ ID NO: 4782562 - DNA, 22 bp, Homo sapiens
gctgaggacggggcagagctga

SEQ ID NO: 4782563 - DNA, 18 bp, Homo sapiens
gctgagtcggctgggcag

SEQ ID NO: 4782564 - DNA, 19 bp, Homo sapiens
gctgagtcggctgggcagg

SEQ ID NO: 4782565 - DNA, 20 bp, Homo sapiens
gctgagtcggctgggcaggg

SEQ ID NO: 4782566 - DNA, 21 bp, Homo sapiens
gctgagtcggctgggcagggc

SEQ ID NO: 4782567 - DNA, 19 bp, Homo sapiens
gctgagtgcgaccaccact

SEQ ID NO: 4782568 - DNA, 14 bp, Homo sapiens
gctgattggaaaat

SEQ ID NO: 4782569 - DNA, 20 bp, Homo sapiens
gctgcaccacggcgtttttt

SEQ ID NO: 4782570 - DNA, 14 bp, Homo sapiens
gctgcactgccctc

SEQ ID NO: 4782571 - DNA, 15 bp, Homo sapiens
gctgcagccccctgc

SEQ ID NO: 4782572 - DNA, 16 bp, Homo sapiens
gctgcagccccctgct

SEQ ID NO: 4782573 - DNA, 21 bp, Homo sapiens
gctgcaggaatcaaaaattga

SEQ ID NO: 4782574 - DNA, 15 bp, Homo sapiens
gctgcatccaaggct

SEQ ID NO: 4782575 - DNA, 12 bp, Homo sapiens
gctgcatcctca

SEQ ID NO: 4782576 - DNA, 17 bp, Homo sapiens
gctgcatcctcagcccc

SEQ ID NO: 4782577 - DNA, 21 bp, Homo sapiens
gctgcatcctcagccccaggg

SEQ ID NO: 4782578 - DNA, 20 bp, Homo sapiens
gctgcatgatttttgccctg

SEQ ID NO: 4782579 - DNA, 22 bp, Homo sapiens
gctgcatgatttttgccctgcg

SEQ ID NO: 4782580 - DNA, 20 bp, Homo sapiens
gctgccaagataccttcatg

SEQ ID NO: 4782581 - DNA, 16 bp, Homo sapiens
gctgccaatgggagct

SEQ ID NO: 4782582 - DNA, 20 bp, Homo sapiens
gctgccaatgggagctcatg

SEQ ID NO: 4782583 - DNA, 19 bp, Homo sapiens
gctgccagccgagatagcc

SEQ ID NO: 4782584 - DNA, 19 bp, Homo sapiens
gctgcccacgtcccgggca

SEQ ID NO: 4782585 - DNA, 20 bp, Homo sapiens
gctgcccagcggctcttcct

SEQ ID NO: 4782586 - DNA, 13 bp, Homo sapiens
gctgcccccacag

SEQ ID NO: 4782587 - DNA, 17 bp, Homo sapiens
gcttcccatctgaagag

SEQ ID NO: 4782588 - DNA, 22 bp, Homo sapiens
gcttccgagattcagactgctt

SEQ ID NO: 4782589 - DNA, 23 bp, Homo sapiens
gcttctaagggatccagagacct

SEQ ID NO: 4782590 - DNA, 15 bp, Homo sapiens
gcttctaatatttat

SEQ ID NO: 4782591 - DNA, 19 bp, Homo sapiens
gcttctatgtccaacagag

SEQ ID NO: 4782592 - DNA, 21 bp, Homo sapiens
gcttctatgtccaacagagtg

SEQ ID NO: 4782593 - DNA, 23 bp, Homo sapiens
gcttctccacaacctcctcctcc

SEQ ID NO: 4782594 - DNA, 12 bp, Homo sapiens
gcttctccacct

SEQ ID NO: 4782595 - DNA, 22 bp, Homo sapiens
gcttctcccgccattggcctta

SEQ ID NO: 4782596 - DNA, 13 bp, Homo sapiens
gcttctccctggg

SEQ ID NO: 4782597 - DNA, 11 bp, Homo sapiens
gcttctgctgc

SEQ ID NO: 4782598 - DNA, 13 bp, Homo sapiens
gcttctgctgccc

SEQ ID NO: 4782599 - DNA, 15 bp, Homo sapiens
gcttctgctgccctg

SEQ ID NO: 4782600 - DNA, 12 bp, Homo sapiens
gcttctggcacc

SEQ ID NO: 4782601 - DNA, 23 bp, Homo sapiens
gcttctgggacaggcaccatgct

SEQ ID NO: 4782602 - DNA, 16 bp, Homo sapiens
gcttcttgtgtttgaa

SEQ ID NO: 4782603 - DNA, 15 bp, Homo sapiens
gcttgaccctgaaat

SEQ ID NO: 4782604 - DNA, 13 bp, Homo sapiens
gcttgagtggaca

SEQ ID NO: 4782605 - DNA, 14 bp, Homo sapiens
gcttgatgctgttt

SEQ ID NO: 4782606 - DNA, 19 bp, Homo sapiens
gcttgctggaaaactgcca

SEQ ID NO: 4782607 - DNA, 19 bp, Homo sapiens
gcttggcgtggagcaggcg

SEQ ID NO: 4782608 - DNA, 23 bp, Homo sapiens
gcttgggcttcatcctcctcaga

SEQ ID NO: 4782609 - DNA, 21 bp, Homo sapiens
gcttggggaccagagctgcca

SEQ ID NO: 4782610 - DNA, 18 bp, Homo sapiens
gcttggggtagagaggac

SEQ ID NO: 4782611 - DNA, 20 bp, Homo sapiens
gcttggtggttatgtcccat

SEQ ID NO: 4782612 - DNA, 14 bp, Homo sapiens
gcttgtagggtgag

SEQ ID NO: 4782613 - DNA, 21 bp, Homo sapiens
gcttgtattatcagtgaatat

SEQ ID NO: 4782614 - DNA, 17 bp, Homo sapiens
gcttgtgtgtatgtcta

SEQ ID NO: 4782615 - DNA, 19 bp, Homo sapiens
gcttgtgtgtatgtctatg

SEQ ID NO: 4782616 - DNA, 23 bp, Homo sapiens
gcttgtgtgtatgtctatgtgta

SEQ ID NO: 4782617 - DNA, 16 bp, Homo sapiens
gctttagagaagccat

SEQ ID NO: 4782618 - DNA, 18 bp, Homo sapiens
gctttagagaagccataa

SEQ ID NO: 4782619 - DNA, 20 bp, Homo sapiens
gctttatccacattgtagcc

SEQ ID NO: 4782620 - DNA, 19 bp, Homo sapiens
gctttcatccaactggaag

SEQ ID NO: 4782621 - DNA, 16 bp, Homo sapiens
gctttctctttgttct

SEQ ID NO: 4782622 - DNA, 20 bp, Homo sapiens
gctttctctttgttcttcaa

SEQ ID NO: 4782623 - DNA, 20 bp, Homo sapiens
gctttgagcccacaggagct

SEQ ID NO: 4782624 - DNA, 20 bp, Homo sapiens
gctttgggtagtgccatggc

SEQ ID NO: 4782625 - DNA, 21 bp, Homo sapiens
gctttgtttaacccaaaagat

SEQ ID NO: 4782626 - DNA, 22 bp, Homo sapiens
gctttgttttggctgctctcca

SEQ ID NO: 4782627 - DNA, 17 bp, Homo sapiens
gcttttcccacctcttt

SEQ ID NO: 4782628 - DNA, 13 bp, Homo sapiens
gcttttctcatgg

SEQ ID NO: 4782629 - DNA, 14 bp, Homo sapiens
gcttttttgcaata

SEQ ID NO: 4782630 - DNA, 15 bp, Homo sapiens
gcttttttgcaataa

SEQ ID NO: 4782631 - DNA, 13 bp, Homo sapiens
ggaaaaaaacttt

SEQ ID NO: 4782632 - DNA, 16 bp, Homo sapiens
ggaaaaaaatgcgtat

SEQ ID NO: 4782633 - DNA, 13 bp, Homo sapiens
ggaaaaaggcttc

SEQ ID NO: 4782634 - DNA, 19 bp, Homo sapiens
ggaaaaatgccatcaaatg

SEQ ID NO: 4782635 - DNA, 13 bp, Homo sapiens
ggaaaacctcagt

SEQ ID NO: 4782636 - DNA, 22 bp, Homo sapiens
ggaaaacctgaggccaaatatt

SEQ ID NO: 4782637 - DNA, 13 bp, Homo sapiens
ggaaaactgccac

SEQ ID NO: 4782638 - DNA, 23 bp, Homo sapiens
ggaaaagggcattttgtacaatg

SEQ ID NO: 4782639 - DNA, 17 bp, Homo sapiens
ggaaaataataaaagaa

SEQ ID NO: 4782640 - DNA, 23 bp, Homo sapiens
ggaaacactttgaggacatttat

SEQ ID NO: 4782641 - DNA, 23 bp, Homo sapiens
ggaaactcatacagtctctattt

SEQ ID NO: 4782642 - DNA, 19 bp, Homo sapiens
ggaaagcagtcagcggaga

SEQ ID NO: 4782643 - DNA, 12 bp, Homo sapiens
ggaaagccaggt

SEQ ID NO: 4782644 - DNA, 12 bp, Homo sapiens
ggaaaggcaggg

SEQ ID NO: 4782645 - DNA, 18 bp, Homo sapiens
ggaaaggcagggccctga

SEQ ID NO: 4782646 - DNA, 16 bp, Homo sapiens
ggaaaggcatctaaga

SEQ ID NO: 4782647 - DNA, 18 bp, Homo sapiens
ggaaattcttgcactgta

SEQ ID NO: 4782648 - DNA, 21 bp, Homo sapiens
ggaacaaggcaaggctgtcaa

SEQ ID NO: 4782649 - DNA, 18 bp, Homo sapiens
ggaacagagtatatatgt

SEQ ID NO: 4782650 - DNA, 12 bp, Homo sapiens
ggaacagccctg

SEQ ID NO: 4782651 - DNA, 17 bp, Homo sapiens
ggaacaggagtgactct

SEQ ID NO: 4782652 - DNA, 16 bp, Homo sapiens
ggaacccatcactgtg

SEQ ID NO: 4782653 - DNA, 14 bp, Homo sapiens
ggaaccgaggactc

SEQ ID NO: 4782654 - DNA, 13 bp, Homo sapiens
ggaacctcaaact

SEQ ID NO: 4782655 - DNA, 15 bp, Homo sapiens
ggaacctcaaactgg

SEQ ID NO: 4782656 - DNA, 17 bp, Homo sapiens
ggaactcccccagaggt

SEQ ID NO: 4782657 - DNA, 20 bp, Homo sapiens
ggaactcccccagaggtgga

SEQ ID NO: 4782658 - DNA, 17 bp, Homo sapiens
ggaactcgctcagaaga

SEQ ID NO: 4782659 - DNA, 18 bp, Homo sapiens
ggaactctatctgggcct

SEQ ID NO: 4782660 - DNA, 19 bp, Homo sapiens
ggaactctatctgggcctg

SEQ ID NO: 4782661 - DNA, 21 bp, Homo sapiens
ggaactctgacaagggctgac

SEQ ID NO: 4782662 - DNA, 12 bp, Homo sapiens
ggaagaaacaaa

SEQ ID NO: 4782663 - DNA, 17 bp, Homo sapiens
ggaagaaggcccgggag

SEQ ID NO: 4782664 - DNA, 19 bp, Homo sapiens
ggaagaaggcccgggagga

SEQ ID NO: 4782665 - DNA, 23 bp, Homo sapiens
ggaagacagttctacagaaaaac

SEQ ID NO: 4782666 - DNA, 13 bp, Homo sapiens
ggaagagagaggc

SEQ ID NO: 4782667 - DNA, 21 bp, Homo sapiens
ggaagagctgctgtatttgag

SEQ ID NO: 4782668 - DNA, 13 bp, Homo sapiens
ggaagatgccaag

SEQ ID NO: 4782669 - DNA, 22 bp, Homo sapiens
ggaagcacatgcctctctcagg

SEQ ID NO: 4782670 - DNA, 10 bp, Homo sapiens
ggaagcagtt

SEQ ID NO: 4782671 - DNA, 15 bp, Homo sapiens
ggaagcagtttcaga

SEQ ID NO: 4782672 - DNA, 17 bp, Homo sapiens
ggaagcagtttcagata

SEQ ID NO: 4782673 - DNA, 19 bp, Homo sapiens
ggaagcagtttcagataaa

SEQ ID NO: 4782674 - DNA, 14 bp, Homo sapiens
ggaagccagcaggc

SEQ ID NO: 4782675 - DNA, 15 bp, Homo sapiens
ggaagccagcaggct

SEQ ID NO: 4782676 - DNA, 20 bp, Homo sapiens
ggaagccagcaggctctcag

SEQ ID NO: 4782677 - DNA, 23 bp, Homo sapiens
ggaagccagcaggctctcaggcc

SEQ ID NO: 4782678 - DNA, 13 bp, Homo sapiens
ggaagcccacccg

SEQ ID NO: 4782679 - DNA, 11 bp, Homo sapiens
ggaagctgcag

SEQ ID NO: 4782680 - DNA, 21 bp, Homo sapiens
ggaaggacacagtcaggggcc

SEQ ID NO: 4782681 - DNA, 20 bp, Homo sapiens
ggaaggaggggaagctgcag

SEQ ID NO: 4782682 - DNA, 19 bp, Homo sapiens
ggaaggcatgcctggacaa

SEQ ID NO: 4782683 - DNA, 16 bp, Homo sapiens
ggaaggcctgagggaa

SEQ ID NO: 4782684 - DNA, 16 bp, Homo sapiens
ggaagggaccccagat

SEQ ID NO: 4782685 - DNA, 15 bp, Homo sapiens
ggaagggcaggagct

SEQ ID NO: 4782686 - DNA, 17 bp, Homo sapiens
ggaaggggcctgggctg

SEQ ID NO: 4782687 - DNA, 20 bp, Homo sapiens
ggaaggggcctgggctgtga

SEQ ID NO: 4782688 - DNA, 16 bp, Homo sapiens
ggaagtacataaagta

SEQ ID NO: 4782689 - DNA, 18 bp, Homo sapiens
ggaagtactggagaaaat

SEQ ID NO: 4782690 - DNA, 13 bp, Homo sapiens
ggaagtcaggagc

SEQ ID NO: 4782691 - DNA, 19 bp, Homo sapiens
ggaagtcatcctgcaatgg

SEQ ID NO: 4782692 - DNA, 12 bp, Homo sapiens
ggaagtgaccaa

SEQ ID NO: 4782693 - DNA, 14 bp, Homo sapiens
ggaatcaaaaattg

SEQ ID NO: 4782694 - DNA, 19 bp, Homo sapiens
ggaatgaatgagcattctg

SEQ ID NO: 4782695 - DNA, 12 bp, Homo sapiens
ggaatgctcaat

SEQ ID NO: 4782696 - DNA, 18 bp, Homo sapiens
ggaattttataagctgaa

SEQ ID NO: 4782697 - DNA, 13 bp, Homo sapiens
ggacaagcagtgg

SEQ ID NO: 4782698 - DNA, 15 bp, Homo sapiens
ggacaagccaggccc

SEQ ID NO: 4782699 - DNA, 18 bp, Homo sapiens
ggacaatgagtggaatac

SEQ ID NO: 4782700 - DNA, 11 bp, Homo sapiens
ggacacagagg

SEQ ID NO: 4782701 - DNA, 23 bp, Homo sapiens
ggacacagaggacggcttcccca

SEQ ID NO: 4782702 - DNA, 20 bp, Homo sapiens
ggacacaggatcctggcctg

SEQ ID NO: 4782703 - DNA, 21 bp, Homo sapiens
ggacacaggatcctggcctga

SEQ ID NO: 4782704 - DNA, 21 bp, Homo sapiens
ggacactgatgggtcctgctg

SEQ ID NO: 4782705 - DNA, 23 bp, Homo sapiens
ggacactgatgggtcctgctgct

SEQ ID NO: 4782706 - DNA, 20 bp, Homo sapiens
ggacagaaccaacgggtctg

SEQ ID NO: 4782707 - DNA, 15 bp, Homo sapiens
ggacagacacagagg

SEQ ID NO: 4782708 - DNA, 20 bp, Homo sapiens
ggacagaggagcaaggttta

SEQ ID NO: 4782709 - DNA, 22 bp, Homo sapiens
ggcccatagaaacatgacactg

SEQ ID NO: 4782710 - DNA, 23 bp, Homo sapiens
ggcccatagaaacatgacactga

SEQ ID NO: 4782711 - DNA, 15 bp, Homo sapiens
ggcccatggccccag

SEQ ID NO: 4782712 - DNA, 19 bp, Homo sapiens
ggcccatggccccagctgg

SEQ ID NO: 4782713 - DNA, 20 bp, Homo sapiens
ggcccatggccccagctggc

SEQ ID NO: 4782714 - DNA, 19 bp, Homo sapiens
ggccccagctggctgggtc

SEQ ID NO: 4782715 - DNA, 18 bp, Homo sapiens
ggccccatcagcatccca

SEQ ID NO: 4782716 - DNA, 13 bp, Homo sapiens
ggccccatggtca

SEQ ID NO: 4782717 - DNA, 12 bp, Homo sapiens
ggcccccacagg

SEQ ID NO: 4782718 - DNA, 21 bp, Homo sapiens
ggccccccagctcaggggcag

SEQ ID NO: 4782719 - DNA, 14 bp, Homo sapiens
ggcccccctctcgg

SEQ ID NO: 4782720 - DNA, 22 bp, Homo sapiens
ggcccccggaggcgcccacctg

SEQ ID NO: 4782721 - DNA, 19 bp, Homo sapiens
ggccccctcgcgcccctgt

SEQ ID NO: 4782722 - DNA, 21 bp, Homo sapiens
ggccccctcgcgcccctgtcc

SEQ ID NO: 4782723 - DNA, 22 bp, Homo sapiens
ggccccctcgcgcccctgtcca

SEQ ID NO: 4782724 - DNA, 19 bp, Homo sapiens
ggccccgcgcgtgccccca

SEQ ID NO: 4782725 - DNA, 20 bp, Homo sapiens
ggccccgcgcgtgcccccag

SEQ ID NO: 4782726 - DNA, 22 bp, Homo sapiens
ggccccgcgcgtgcccccagcg

SEQ ID NO: 4782727 - DNA, 14 bp, Homo sapiens
ggccccgcggagcc

SEQ ID NO: 4782728 - DNA, 13 bp, Homo sapiens
ggcccctgggatg

SEQ ID NO: 4782729 - DNA, 22 bp, Homo sapiens
ggcccctgggatgggaccaggg

SEQ ID NO: 4782730 - DNA, 22 bp, Homo sapiens
ggcccgagcgcgtgccttcccc

SEQ ID NO: 4782731 - DNA, 16 bp, Homo sapiens
ggcccgaggcaccgga

SEQ ID NO: 4782732 - DNA, 14 bp, Homo sapiens
ggcccgccaccttg

SEQ ID NO: 4782733 - DNA, 21 bp, Homo sapiens
ggcccgccccaggccccagca

SEQ ID NO: 4782734 - DNA, 13 bp, Homo sapiens
ggcccgccctgcc

SEQ ID NO: 4782735 - DNA, 14 bp, Homo sapiens
ggcccgccctgccc

SEQ ID NO: 4782736 - DNA, 24 bp, Homo sapiens
ggcccggagatgcatctgtggcct

SEQ ID NO: 4782737 - DNA, 13 bp, Homo sapiens
ggcccggcccacg

SEQ ID NO: 4782738 - DNA, 13 bp, Homo sapiens
ggcccgggaggag

SEQ ID NO: 4782739 - DNA, 15 bp, Homo sapiens
ggcccggtcccagtc

SEQ ID NO: 4782740 - DNA, 13 bp, Homo sapiens
ggccctccctgac

SEQ ID NO: 4782741 - DNA, 23 bp, Homo sapiens
ggccctccctgactccctgtggg

SEQ ID NO: 4782742 - DNA, 14 bp, Homo sapiens
ggccctcgggccct

SEQ ID NO: 4782743 - DNA, 15 bp, Homo sapiens
ggccctctctgcagt

SEQ ID NO: 4782744 - DNA, 20 bp, Homo sapiens
ggccctgaaatggcctgtcc

SEQ ID NO: 4782745 - DNA, 16 bp, Homo sapiens
ggccctgacaggcctt

SEQ ID NO: 4782746 - DNA, 18 bp, Homo sapiens
ggccctgacaggccttcc

SEQ ID NO: 4782747 - DNA, 15 bp, Homo sapiens
ggccctgcagtgttc

SEQ ID NO: 4782748 - DNA, 22 bp, Homo sapiens
ggccctgcagtgttcgcttggc

SEQ ID NO: 4782749 - DNA, 21 bp, Homo sapiens
ggccctgccccacacaggcct

SEQ ID NO: 4782750 - DNA, 15 bp, Homo sapiens
ggccctgccctcccc

SEQ ID NO: 4782751 - DNA, 21 bp, Homo sapiens
ggccctgccctctccttcctt

SEQ ID NO: 4782752 - DNA, 17 bp, Homo sapiens
ggccctgctcaggcctc

SEQ ID NO: 4782753 - DNA, 19 bp, Homo sapiens
ggccctggggtctctgagc

SEQ ID NO: 4782754 - DNA, 21 bp, Homo sapiens
ggccctggggtctctgagcag

SEQ ID NO: 4782755 - DNA, 19 bp, Homo sapiens
ggccctgtcactgtccaga

SEQ ID NO: 4782756 - DNA, 21 bp, Homo sapiens
ggccctgtcactgtccagagt

SEQ ID NO: 4782757 - DNA, 18 bp, Homo sapiens
ggcccttagaatgtgaaa

SEQ ID NO: 4782758 - DNA, 15 bp, Homo sapiens
ggccctttcgtccac

SEQ ID NO: 4782759 - DNA, 13 bp, Homo sapiens
ggccgaggcctgc

SEQ ID NO: 4782760 - DNA, 16 bp, Homo sapiens
ggccgcaacttcccag

SEQ ID NO: 4782761 - DNA, 19 bp, Homo sapiens
ggccgcaaggggaccgccc

SEQ ID NO: 4782762 - DNA, 22 bp, Homo sapiens
ggccgcaaggggaccgccccag

SEQ ID NO: 4782763 - DNA, 17 bp, Homo sapiens
ggccgcagggcgctccg

SEQ ID NO: 4782764 - DNA, 18 bp, Homo sapiens
ggccgcagggcgctccgg

SEQ ID NO: 4782765 - DNA, 22 bp, Homo sapiens
ggccgcagggcgctccggcaga

SEQ ID NO: 4782766 - DNA, 19 bp, Homo sapiens
ggccgccgaagggcagccc

SEQ ID NO: 4782767 - DNA, 15 bp, Homo sapiens
ggccgctctccgccc

SEQ ID NO: 4782768 - DNA, 20 bp, Homo sapiens
ggccgctctccgccccccgg

SEQ ID NO: 4782769 - DNA, 19 bp, Homo sapiens
ggccgctgctgtgacaggc

SEQ ID NO: 4782770 - DNA, 23 bp, Homo sapiens
ggccgctgggagaaaagccagat

SEQ ID NO: 4782771 - DNA, 14 bp, Homo sapiens
ggccgcttctcctg

SEQ ID NO: 4782772 - DNA, 15 bp, Homo sapiens
ggccgcttctcctgc

SEQ ID NO: 4782773 - DNA, 13 bp, Homo sapiens
ggccggccagcct

SEQ ID NO: 4782774 - DNA, 12 bp, Homo sapiens
ggccggctggcc

SEQ ID NO: 4782775 - DNA, 15 bp, Homo sapiens
ggccgggcaggtcct

SEQ ID NO: 4782776 - DNA, 19 bp, Homo sapiens
ggccgggcaggtcctgccc

SEQ ID NO: 4782777 - DNA, 12 bp, Homo sapiens
ggccgtccctga

SEQ ID NO: 4782778 - DNA, 23 bp, Homo sapiens
ggcctaatctcatacctctgacc

SEQ ID NO: 4782779 - DNA, 20 bp, Homo sapiens
ggcctaccacagctgcctcc

SEQ ID NO: 4782780 - DNA, 22 bp, Homo sapiens
ggcctagcccaccctgctgcct

SEQ ID NO: 4782781 - DNA, 15 bp, Homo sapiens
ggcctatgaccctgt

SEQ ID NO: 4782782 - DNA, 18 bp, Homo sapiens
ggcctatgaccctgtgcc

SEQ ID NO: 4782783 - DNA, 20 bp, Homo sapiens
ggcctcacctggcttcccag

SEQ ID NO: 4782784 - DNA, 22 bp, Homo sapiens
ggcctcacctggcttcccagga

SEQ ID NO: 4782785 - DNA, 14 bp, Homo sapiens
ggcctcagccctca

SEQ ID NO: 4782786 - DNA, 16 bp, Homo sapiens
ggcctcagggaccaag

SEQ ID NO: 4782787 - DNA, 17 bp, Homo sapiens
ggcctcaggtcctactg

SEQ ID NO: 4782788 - DNA, 12 bp, Homo sapiens
ggcctcccagcc

SEQ ID NO: 4782789 - DNA, 13 bp, Homo sapiens
ggcctcccagcca

SEQ ID NO: 4782790 - DNA, 19 bp, Homo sapiens
ggcctcccagccacccgga

SEQ ID NO: 4782791 - DNA, 12 bp, Homo sapiens
ggcctcctagcc

SEQ ID NO: 4782792 - DNA, 22 bp, Homo sapiens
ggcctcctcttcaccccggcag

SEQ ID NO: 4782793 - DNA, 17 bp, Homo sapiens
ggcctcggcctggcttc

SEQ ID NO: 4782794 - DNA, 14 bp, Homo sapiens
ggcctcgtgccatg

SEQ ID NO: 4782795 - DNA, 11 bp, Homo sapiens
ggcctctggac

SEQ ID NO: 4782796 - DNA, 12 bp, Homo sapiens
ggcctctggaca

SEQ ID NO: 4782797 - DNA, 18 bp, Homo sapiens
ggcctcttgagagcccca

SEQ ID NO: 4782798 - DNA, 21 bp, Homo sapiens
ggcctgagaattgaggggagg

SEQ ID NO: 4782799 - DNA, 23 bp, Homo sapiens
ggcctgagaattgaggggaggtg

SEQ ID NO: 4782800 - DNA, 16 bp, Homo sapiens
ggcctgagggaagccc

SEQ ID NO: 4782801 - DNA, 18 bp, Homo sapiens
ggcctgagggaagcccac

SEQ ID NO: 4782802 - DNA, 22 bp, Homo sapiens
ggcctgagggaagcccacccgc

SEQ ID NO: 4782803 - DNA, 12 bp, Homo sapiens
ggcctgcagccc

SEQ ID NO: 4782804 - DNA, 14 bp, Homo sapiens
ggcctgcagcccag

SEQ ID NO: 4782805 - DNA, 17 bp, Homo sapiens
ggcctgcagcccagaac

SEQ ID NO: 4782806 - DNA, 17 bp, Homo sapiens
ggcctgccccccttccc

SEQ ID NO: 4782807 - DNA, 20 bp, Homo sapiens
ggcctgcctacgtgctgccc

SEQ ID NO: 4782808 - DNA, 21 bp, Homo sapiens
ggcctggcagggaggtcaggc

SEQ ID NO: 4782809 - DNA, 11 bp, Homo sapiens
ggcctggccca

SEQ ID NO: 4782810 - DNA, 14 bp, Homo sapiens
ggcctggcccagcc

SEQ ID NO: 4782811 - DNA, 14 bp, Homo sapiens
ggcctggccccctc

SEQ ID NO: 4782812 - DNA, 12 bp, Homo sapiens
ggcctggccctg

SEQ ID NO: 4782813 - DNA, 19 bp, Homo sapiens
ggcctggccctgccctgag

SEQ ID NO: 4782814 - DNA, 15 bp, Homo sapiens
ggcctggctctggag

SEQ ID NO: 4782815 - DNA, 23 bp, Homo sapiens
ggcctggcttcaccgcattccag

SEQ ID NO: 4782816 - DNA, 14 bp, Homo sapiens
ggcctggcttctgg

SEQ ID NO: 4782817 - DNA, 20 bp, Homo sapiens
ggcctgggagatgcagctgg

SEQ ID NO: 4782818 - DNA, 13 bp, Homo sapiens
ggcctgggctagg

SEQ ID NO: 4782819 - DNA, 20 bp, Homo sapiens
ggcctgggggctgggcagag

SEQ ID NO: 4782820 - DNA, 23 bp, Homo sapiens
ggcctgggggctgttagctcaga

SEQ ID NO: 4782821 - DNA, 19 bp, Homo sapiens
ggcctgggtccccctcctg

SEQ ID NO: 4782822 - DNA, 17 bp, Homo sapiens
ggcctgggtcctcggcc

SEQ ID NO: 4782823 - DNA, 14 bp, Homo sapiens
ggcctggtctggag

SEQ ID NO: 4782824 - DNA, 18 bp, Homo sapiens
ggccttaactggccctcg

SEQ ID NO: 4782825 - DNA, 19 bp, Homo sapiens
ggccttaactggccctcgg

SEQ ID NO: 4782826 - DNA, 22 bp, Homo sapiens
ggccttaactggccctcgggcc

SEQ ID NO: 4782827 - DNA, 18 bp, Homo sapiens
ggccttgagtctctgaat

SEQ ID NO: 4782828 - DNA, 20 bp, Homo sapiens
ggcgagggcggcggggcctg

SEQ ID NO: 4782829 - DNA, 16 bp, Homo sapiens
ggcgagtccagacacc

SEQ ID NO: 4782830 - DNA, 22 bp, Homo sapiens
ggcgcaagcgacacaggctgcc

SEQ ID NO: 4782831 - DNA, 18 bp, Homo sapiens
gggcgctccggcagaggc

SEQ ID NO: 4782832 - DNA, 14 bp, Homo sapiens
gggcgctcctccca

SEQ ID NO: 4782833 - DNA, 15 bp, Homo sapiens
gggcgctcctcccag

SEQ ID NO: 4782834 - DNA, 19 bp, Homo sapiens
gggcggcatccgagcccct

SEQ ID NO: 4782835 - DNA, 19 bp, Homo sapiens
gggcgttatgtaagtttct

SEQ ID NO: 4782836 - DNA, 21 bp, Homo sapiens
gggcgttatgtaagtttctaa

SEQ ID NO: 4782837 - DNA, 14 bp, Homo sapiens
gggctaactggccc

SEQ ID NO: 4782838 - DNA, 16 bp, Homo sapiens
gggctaactggcccca

SEQ ID NO: 4782839 - DNA, 21 bp, Homo sapiens
gggctaactggccccaggcgg

SEQ ID NO: 4782840 - DNA, 11 bp, Homo sapiens
gggctgagccc

SEQ ID NO: 4782841 - DNA, 18 bp, Homo sapiens
gggctgagcccctcctct

SEQ ID NO: 4782842 - DNA, 19 bp, Homo sapiens
gggctgcagccccctgctt

SEQ ID NO: 4782843 - DNA, 13 bp, Homo sapiens
gggctgcatcctc

SEQ ID NO: 4782844 - DNA, 17 bp, Homo sapiens
gggctgcatcctcagcc

SEQ ID NO: 4782845 - DNA, 22 bp, Homo sapiens
gggctgcatgatttttgccctg

SEQ ID NO: 4782846 - DNA, 16 bp, Homo sapiens
gggctgctgcactgcc

SEQ ID NO: 4782847 - DNA, 13 bp, Homo sapiens
gggctggccctgc

SEQ ID NO: 4782848 - DNA, 16 bp, Homo sapiens
gggctggccctgccct

SEQ ID NO: 4782849 - DNA, 17 bp, Homo sapiens
gggctgggcgcctctgt

SEQ ID NO: 4782850 - DNA, 20 bp, Homo sapiens
gggctggtggagatgtagga

SEQ ID NO: 4782851 - DNA, 13 bp, Homo sapiens
gggctgtgaggac

SEQ ID NO: 4782852 - DNA, 16 bp, Homo sapiens
gggctgtgcgggcgcc

SEQ ID NO: 4782853 - DNA, 20 bp, Homo sapiens
gggctgttagctcagaggag

SEQ ID NO: 4782854 - DNA, 15 bp, Homo sapiens
gggcttagaatgggg

SEQ ID NO: 4782855 - DNA, 23 bp, Homo sapiens
gggcttatcagaactcctttcta

SEQ ID NO: 4782856 - DNA, 19 bp, Homo sapiens
gggcttctccccctcagct

SEQ ID NO: 4782857 - DNA, 13 bp, Homo sapiens
gggcttggagcag

SEQ ID NO: 4782858 - DNA, 17 bp, Homo sapiens
gggcttggagcagagac

SEQ ID NO: 4782859 - DNA, 16 bp, Homo sapiens
gggcttggggtagaga

SEQ ID NO: 4782860 - DNA, 21 bp, Homo sapiens
gggcttggggtagagaggaca

SEQ ID NO: 4782861 - DNA, 18 bp, Homo sapiens
ggggaactcccccagagg

SEQ ID NO: 4782862 - DNA, 21 bp, Homo sapiens
ggggaactcccccagaggtgg

SEQ ID NO: 4782863 - DNA, 23 bp, Homo sapiens
ggggacaggattgtctgctgcct

SEQ ID NO: 4782864 - DNA, 15 bp, Homo sapiens
ggggacgcccagccc

SEQ ID NO: 4782865 - DNA, 19 bp, Homo sapiens
ggggacgcccagcccccac

SEQ ID NO: 4782866 - DNA, 15 bp, Homo sapiens
ggggacttggatagg

SEQ ID NO: 4782867 - DNA, 17 bp, Homo sapiens
ggggaggacccctgccc

SEQ ID NO: 4782868 - DNA, 15 bp, Homo sapiens
ggggaggagcacccc

SEQ ID NO: 4782869 - DNA, 16 bp, Homo sapiens
ggggaggctgagacgc

SEQ ID NO: 4782870 - DNA, 14 bp, Homo sapiens
ggggaggcttccag

SEQ ID NO: 4782871 - DNA, 13 bp, Homo sapiens
ggggagtggccac

SEQ ID NO: 4782872 - DNA, 18 bp, Homo sapiens
ggggatctaaaaggagga

SEQ ID NO: 4782873 - DNA, 22 bp, Homo sapiens
ggggcaagagctcaggagaagg

SEQ ID NO: 4782874 - DNA, 13 bp, Homo sapiens
ggggcacagccag

SEQ ID NO: 4782875 - DNA, 13 bp, Homo sapiens
ggggcccatggcc

SEQ ID NO: 4782876 - DNA, 14 bp, Homo sapiens
ggggcccgccccag

SEQ ID NO: 4782877 - DNA, 13 bp, Homo sapiens
ggggccctgggcc

SEQ ID NO: 4782878 - DNA, 20 bp, Homo sapiens
ggggccctgtcactgtccag

SEQ ID NO: 4782879 - DNA, 23 bp, Homo sapiens
ggggccgggcaggtcctgcccat

SEQ ID NO: 4782880 - DNA, 16 bp, Homo sapiens
ggggccgtgcagggcc

SEQ ID NO: 4782881 - DNA, 14 bp, Homo sapiens
ggggcctgggctgt

SEQ ID NO: 4782882 - DNA, 16 bp, Homo sapiens
ggggcgcgcgccccca

SEQ ID NO: 4782883 - DNA, 17 bp, Homo sapiens
ggggcgcgcgcccccag

SEQ ID NO: 4782884 - DNA, 21 bp, Homo sapiens
ggggcgctcctcccagctgta

SEQ ID NO: 4782885 - DNA, 13 bp, Homo sapiens
ggggcgctgcccc

SEQ ID NO: 4782886 - DNA, 18 bp, Homo sapiens
ggggcggcatccgagccc

SEQ ID NO: 4782887 - DNA, 20 bp, Homo sapiens
ggggcggcatccgagcccct

SEQ ID NO: 4782888 - DNA, 13 bp, Homo sapiens
ggggcggctctgg

SEQ ID NO: 4782889 - DNA, 15 bp, Homo sapiens
ggggcggctctggga

SEQ ID NO: 4782890 - DNA, 15 bp, Homo sapiens
ggggctaactggccc

SEQ ID NO: 4782891 - DNA, 16 bp, Homo sapiens
ggggctaactggcccc

SEQ ID NO: 4782892 - DNA, 18 bp, Homo sapiens
ggggctaactggccccag

SEQ ID NO: 4782893 - DNA, 18 bp, Homo sapiens
ggggctgcagccccctgc

SEQ ID NO: 4782894 - DNA, 13 bp, Homo sapiens
ggggctggccctg

SEQ ID NO: 4782895 - DNA, 15 bp, Homo sapiens
ggggctggccctgcc

SEQ ID NO: 4782896 - DNA, 17 bp, Homo sapiens
ggggctggccctgccct

SEQ ID NO: 4782897 - DNA, 23 bp, Homo sapiens
ggggctggccctgccctccccca

SEQ ID NO: 4782898 - DNA, 18 bp, Homo sapiens
ggggctgtgcgggcgccc

SEQ ID NO: 4782899 - DNA, 22 bp, Homo sapiens
ggggctgttagctcagaggaga

SEQ ID NO: 4782900 - DNA, 18 bp, Homo sapiens
ggggcttggagcagagac

SEQ ID NO: 4782901 - DNA, 24 bp, Homo sapiens
ggggcttggagcagagacggcagc

SEQ ID NO: 4782902 - DNA, 11 bp, Homo sapiens
ggggcttggcg

SEQ ID NO: 4782903 - DNA, 19 bp, Homo sapiens
ggggcttggcgtggagcag

SEQ ID NO: 4782904 - DNA, 21 bp, Homo sapiens
ggggcttggggtagagaggac

SEQ ID NO: 4782905 - DNA, 18 bp, Homo sapiens
gggggacgcccagccccc

SEQ ID NO: 4782906 - DNA, 15 bp, Homo sapiens
gggggaggagcaccc

SEQ ID NO: 4782907 - DNA, 13 bp, Homo sapiens
gggggatgcaggc

SEQ ID NO: 4782908 - DNA, 21 bp, Homo sapiens
gggggcaagagctcaggagaa

SEQ ID NO: 4782909 - DNA, 13 bp, Homo sapiens
gggggcacagcca

SEQ ID NO: 4782910 - DNA, 16 bp, Homo sapiens
gggggcaggcctccca

SEQ ID NO: 4782911 - DNA, 20 bp, Homo sapiens
gggggccgggcaggtcctgc

SEQ ID NO: 4782912 - DNA, 13 bp, Homo sapiens
gggggcggctctg

SEQ ID NO: 4782913 - DNA, 17 bp, Homo sapiens
gggggctaactggcccc

SEQ ID NO: 4782914 - DNA, 10 bp, Homo sapiens
gggggtggca

SEQ ID NO: 4782915 - DNA, 12 bp, Homo sapiens
gggggtggcagg

SEQ ID NO: 4782916 - DNA, 12 bp, Homo sapiens
gggggtggccat

SEQ ID NO: 4782917 - DNA, 21 bp, Homo sapiens
ggggtaagttgaagggaaatc

SEQ ID NO: 4782918 - DNA, 15 bp, Homo sapiens
ggggtagagaggaca

SEQ ID NO: 4782919 - DNA, 15 bp, Homo sapiens
ggggtggggcttgga

SEQ ID NO: 4782920 - DNA, 22 bp, Homo sapiens
gggtaagttgaagggaaatcaa

SEQ ID NO: 4782921 - DNA, 14 bp, Homo sapiens
gggtcaactccaag

SEQ ID NO: 4782922 - DNA, 16 bp, Homo sapiens
gggtcaccttcctggg

SEQ ID NO: 4782923 - DNA, 20 bp, Homo sapiens
gggtcagcaggggggttggg

SEQ ID NO: 4782924 - DNA, 20 bp, Homo sapiens
gggtcaggttagggctcctg

SEQ ID NO: 4782925 - DNA, 14 bp, Homo sapiens
gggtccagccctcc

SEQ ID NO: 4782926 - DNA, 13 bp, Homo sapiens
gggtccccctcct

SEQ ID NO: 4782927 - DNA, 17 bp, Homo sapiens
gggtccccctcctgcac

SEQ ID NO: 4782928 - DNA, 18 bp, Homo sapiens
gggtccccctcctgcacg

SEQ ID NO: 4782929 - DNA, 12 bp, Homo sapiens
gggtccccggac

SEQ ID NO: 4782930 - DNA, 20 bp, Homo sapiens
gggtccccggacgctggctc

SEQ ID NO: 4782931 - DNA, 22 bp, Homo sapiens
gggtccctgcgtctcctgccca

SEQ ID NO: 4782932 - DNA, 12 bp, Homo sapiens
gggtcctcggcc

SEQ ID NO: 4782933 - DNA, 17 bp, Homo sapiens
gggtcctcggccctgta

SEQ ID NO: 4782934 - DNA, 18 bp, Homo sapiens
gggtcctcggccctgtag

SEQ ID NO: 4782935 - DNA, 21 bp, Homo sapiens
gggtcctcggccctgtagccc

SEQ ID NO: 4782936 - DNA, 22 bp, Homo sapiens
gggtgaggcgtgggatccagag

SEQ ID NO: 4782937 - DNA, 20 bp, Homo sapiens
gggtgcatttgagagaagcc

SEQ ID NO: 4782938 - DNA, 21 bp, Homo sapiens
gggtgcatttgagagaagcca

SEQ ID NO: 4782939 - DNA, 18 bp, Homo sapiens
gggtgcccgtgtggcctg

SEQ ID NO: 4782940 - DNA, 19 bp, Homo sapiens
gggtgcccgtgtggcctgg

SEQ ID NO: 4782941 - DNA, 21 bp, Homo sapiens
gggtgctcagggcatgcttat

SEQ ID NO: 4782942 - DNA, 18 bp, Homo sapiens
gggtggaagggcaggagc

SEQ ID NO: 4782943 - DNA, 23 bp, Homo sapiens
gggtggaattattagcaccagct

SEQ ID NO: 4782944 - DNA, 13 bp, Homo sapiens
gggtggaggatgg

SEQ ID NO: 4782945 - DNA, 21 bp, Homo sapiens
gggtggcagcgcccagcctgg

SEQ ID NO: 4782946 - DNA, 12 bp, Homo sapiens
gggtggcaggca

SEQ ID NO: 4782947 - DNA, 13 bp, Homo sapiens
gggtggctggagc

SEQ ID NO: 4782948 - DNA, 21 bp, Homo sapiens
gggtggctggagccccatcgc

SEQ ID NO: 4782949 - DNA, 15 bp, Homo sapiens
gggtgggagccacag

SEQ ID NO: 4782950 - DNA, 19 bp, Homo sapiens
gggtgggagccacagggac

SEQ ID NO: 4782951 - DNA, 14 bp, Homo sapiens
gggtgggccctgcc

SEQ ID NO: 4782952 - DNA, 20 bp, Homo sapiens
gggtggggacctcaggcctg

SEQ ID NO: 4782953 - DNA, 14 bp, Homo sapiens
gtcagggcccagag

SEQ ID NO: 4782954 - DNA, 19 bp, Homo sapiens
gtcagggcccagaggctga

SEQ ID NO: 4782955 - DNA, 21 bp, Homo sapiens
gtcagggcccagaggctgagt

SEQ ID NO: 4782956 - DNA, 21 bp, Homo sapiens
gtcagtgaagcccaggaggac

SEQ ID NO: 4782957 - DNA, 16 bp, Homo sapiens
gtcagtgtactctgag

SEQ ID NO: 4782958 - DNA, 22 bp, Homo sapiens
gtcagtgtactctgagtcctca

SEQ ID NO: 4782959 - DNA, 22 bp, Homo sapiens
gtcataaagtgagaaaactgtg

SEQ ID NO: 4782960 - DNA, 16 bp, Homo sapiens
gtcataactagagcac

SEQ ID NO: 4782961 - DNA, 18 bp, Homo sapiens
gtcatcatgttttgattt

SEQ ID NO: 4782962 - DNA, 18 bp, Homo sapiens
gtcatcggaggctgggcc

SEQ ID NO: 4782963 - DNA, 14 bp, Homo sapiens
gtcatctctctggg

SEQ ID NO: 4782964 - DNA, 23 bp, Homo sapiens
gtcatctctctggggccctgggc

SEQ ID NO: 4782965 - DNA, 20 bp, Homo sapiens
gtcatctgtcagcttcccaa

SEQ ID NO: 4782966 - DNA, 14 bp, Homo sapiens
gtcatctttgattt

SEQ ID NO: 4782967 - DNA, 20 bp, Homo sapiens
gtcatgactttcagattgta

SEQ ID NO: 4782968 - DNA, 15 bp, Homo sapiens
gtcatgcccagcttg

SEQ ID NO: 4782969 - DNA, 18 bp, Homo sapiens
gtcatgttggtaccctgg

SEQ ID NO: 4782970 - DNA, 19 bp, Homo sapiens
gtcatgttggtaccctgga

SEQ ID NO: 4782971 - DNA, 17 bp, Homo sapiens
gtcattaaattactata

SEQ ID NO: 4782972 - DNA, 24 bp, Homo sapiens
gtcattaaattactatagcaaagt

SEQ ID NO: 4782973 - DNA, 20 bp, Homo sapiens
gtcattttcagatccttcca

SEQ ID NO: 4782974 - DNA, 21 bp, Homo sapiens
gtcattttctgttatacacag

SEQ ID NO: 4782975 - DNA, 18 bp, Homo sapiens
gtccaagcatcagcaaga

SEQ ID NO: 4782976 - DNA, 21 bp, Homo sapiens
gtccaagttgccacattgctt

SEQ ID NO: 4782977 - DNA, 18 bp, Homo sapiens
gtccacaaatgtcctcag

SEQ ID NO: 4782978 - DNA, 15 bp, Homo sapiens
gtccacatacactgc

SEQ ID NO: 4782979 - DNA, 18 bp, Homo sapiens
gtccacatcaaaaatgca

SEQ ID NO: 4782980 - DNA, 18 bp, Homo sapiens
gtccacccccattgtgaa

SEQ ID NO: 4782981 - DNA, 17 bp, Homo sapiens
gtccaccccgtcccggc

SEQ ID NO: 4782982 - DNA, 22 bp, Homo sapiens
gtccacgccgggtcgcctgccc

SEQ ID NO: 4782983 - DNA, 18 bp, Homo sapiens
gtccactttcctctctct

SEQ ID NO: 4782984 - DNA, 18 bp, Homo sapiens
gtccagacaagccctgct

SEQ ID NO: 4782985 - DNA, 15 bp, Homo sapiens
gtccagccctccgcc

SEQ ID NO: 4782986 - DNA, 15 bp, Homo sapiens
gtccagggtccagcc

SEQ ID NO: 4782987 - DNA, 17 bp, Homo sapiens
gtccagggtccagccct

SEQ ID NO: 4782988 - DNA, 18 bp, Homo sapiens
gtccagggtccagccctc

SEQ ID NO: 4782989 - DNA, 23 bp, Homo sapiens
gtccatttaaacccggctgactc

SEQ ID NO: 4782990 - DNA, 14 bp, Homo sapiens
gtcccacagcccct

SEQ ID NO: 4782991 - DNA, 20 bp, Homo sapiens
gtcccacccccagcagctca

SEQ ID NO: 4782992 - DNA, 21 bp, Homo sapiens
gtcccacccccagcagctcac

SEQ ID NO: 4782993 - DNA, 19 bp, Homo sapiens
gtcccacttccccatctgt

SEQ ID NO: 4782994 - DNA, 14 bp, Homo sapiens
gtcccagtccggtg

SEQ ID NO: 4782995 - DNA, 13 bp, Homo sapiens
gtcccagtgtctg

SEQ ID NO: 4782996 - DNA, 18 bp, Homo sapiens
gtcccagtgtctggccca

SEQ ID NO: 4782997 - DNA, 19 bp, Homo sapiens
gtcccagtgtctggcccag

SEQ ID NO: 4782998 - DNA, 23 bp, Homo sapiens
gtcccatgaccttgacgtgtgtg

SEQ ID NO: 4782999 - DNA, 19 bp, Homo sapiens
gtccccagggtgcaggcgc

SEQ ID NO: 4783000 - DNA, 13 bp, Homo sapiens
gtcccccctgtgg

SEQ ID NO: 4783001 - DNA, 17 bp, Homo sapiens
gtcccccctgtggtctg

SEQ ID NO: 4783002 - DNA, 18 bp, Homo sapiens
gtcccccctgtggtctgt

SEQ ID NO: 4783003 - DNA, 18 bp, Homo sapiens
gtccccctatccttggca

SEQ ID NO: 4783004 - DNA, 14 bp, Homo sapiens
gtccccctcctgca

SEQ ID NO: 4783005 - DNA, 15 bp, Homo sapiens
gtccccctcctgcac

SEQ ID NO: 4783006 - DNA, 15 bp, Homo sapiens
gtccccgcactgggc

SEQ ID NO: 4783007 - DNA, 16 bp, Homo sapiens
gtcccctcactctgtc

SEQ ID NO: 4783008 - DNA, 20 bp, Homo sapiens
gtcccctcactctgtcagcc

SEQ ID NO: 4783009 - DNA, 23 bp, Homo sapiens
gtcccctcactctgtcagccagc

SEQ ID NO: 4783010 - DNA, 22 bp, Homo sapiens
gtcccctggcccttccttcacc

SEQ ID NO: 4783011 - DNA, 14 bp, Homo sapiens
gtcccgaggcagca

SEQ ID NO: 4783012 - DNA, 15 bp, Homo sapiens
gtcccggagctcagg

SEQ ID NO: 4783013 - DNA, 19 bp, Homo sapiens
gtcccgggtactcagtcag

SEQ ID NO: 4783014 - DNA, 15 bp, Homo sapiens
gtccctaattctctt

SEQ ID NO: 4783015 - DNA, 21 bp, Homo sapiens
gtccctaattctcttcgctgt

SEQ ID NO: 4783016 - DNA, 17 bp, Homo sapiens
gtccctagggctctcca

SEQ ID NO: 4783017 - DNA, 15 bp, Homo sapiens
gtccctcgagctctg

SEQ ID NO: 4783018 - DNA, 19 bp, Homo sapiens
gtccctcgagctctgtagc

SEQ ID NO: 4783019 - DNA, 23 bp, Homo sapiens
gtccctcgagctctgtagcctgg

SEQ ID NO: 4783020 - DNA, 16 bp, Homo sapiens
gtccctgacttcccag

SEQ ID NO: 4783021 - DNA, 18 bp, Homo sapiens
gtccctgacttcccagct

SEQ ID NO: 4783022 - DNA, 19 bp, Homo sapiens
gtccctgacttcccagctg

SEQ ID NO: 4783023 - DNA, 23 bp, Homo sapiens
gtccctgacttcccagctggcag

SEQ ID NO: 4783024 - DNA, 13 bp, Homo sapiens
gtccctgcagggc

SEQ ID NO: 4783025 - DNA, 17 bp, Homo sapiens
gtccctgtgggctcaca

SEQ ID NO: 4783026 - DNA, 18 bp, Homo sapiens
gtccctgtgggctcacac

SEQ ID NO: 4783027 - DNA, 21 bp, Homo sapiens
gtccctgtgggctcacaccgg

SEQ ID NO: 4783028 - DNA, 13 bp, Homo sapiens
gtcccttcctgtc

SEQ ID NO: 4783029 - DNA, 21 bp, Homo sapiens
gtccgccccgtgctcctctgc

SEQ ID NO: 4783030 - DNA, 22 bp, Homo sapiens
gtccgccccgtgctcctctgcc

SEQ ID NO: 4783031 - DNA, 14 bp, Homo sapiens
gtccggcctgcagc

SEQ ID NO: 4783032 - DNA, 17 bp, Homo sapiens
gtccggcctgcagccca

SEQ ID NO: 4783033 - DNA, 20 bp, Homo sapiens
gtccggtgccttccaccctg

SEQ ID NO: 4783034 - DNA, 19 bp, Homo sapiens
gtccgtccgcccgcccacc

SEQ ID NO: 4783035 - DNA, 21 bp, Homo sapiens
gtccgtccgcccgcccacccc

SEQ ID NO: 4783036 - DNA, 23 bp, Homo sapiens
gtccgtccgcccgcccaccccgc

SEQ ID NO: 4783037 - DNA, 12 bp, Homo sapiens
gtccgtcctgct

SEQ ID NO: 4783038 - DNA, 15 bp, Homo sapiens
gtcctaaatgcaaag

SEQ ID NO: 4783039 - DNA, 14 bp, Homo sapiens
gtcctatccccgga

SEQ ID NO: 4783040 - DNA, 22 bp, Homo sapiens
gtcctatccccggacgcatgca

SEQ ID NO: 4783041 - DNA, 16 bp, Homo sapiens
gtcctcattgttcaga

SEQ ID NO: 4783042 - DNA, 19 bp, Homo sapiens
gtcctcattgttcagaaaa

SEQ ID NO: 4783043 - DNA, 15 bp, Homo sapiens
gtcctcccagctgac

SEQ ID NO: 4783044 - DNA, 20 bp, Homo sapiens
gtcctctgtccgtctgtcct

SEQ ID NO: 4783045 - DNA, 23 bp, Homo sapiens
gtcctctgtccgtctgtcctgcg

SEQ ID NO: 4783046 - DNA, 17 bp, Homo sapiens
gtcctgcccatgtgtcc

SEQ ID NO: 4783047 - DNA, 16 bp, Homo sapiens
gtcctgcgcctgcgcc

SEQ ID NO: 4783048 - DNA, 14 bp, Homo sapiens
gtcctgctcgccct

SEQ ID NO: 4783049 - DNA, 17 bp, Homo sapiens
gtcctgctcgccctgtg

SEQ ID NO: 4783050 - DNA, 11 bp, Homo sapiens
gtcctgctgtg

SEQ ID NO: 4783051 - DNA, 14 bp, Homo sapiens
gtcctgggggctgc

SEQ ID NO: 4783052 - DNA, 23 bp, Homo sapiens
gtcctggggtggttggaggcctg

SEQ ID NO: 4783053 - DNA, 23 bp, Homo sapiens
gtcctgtgctttctgcatgctta

SEQ ID NO: 4783054 - DNA, 12 bp, Homo sapiens
gtcctgtgtcat

SEQ ID NO: 4783055 - DNA, 19 bp, Homo sapiens
gtcctgtgtcatctgtcag

SEQ ID NO: 4783056 - DNA, 13 bp, Homo sapiens
gtccttcccccag

SEQ ID NO: 4783057 - DNA, 15 bp, Homo sapiens
gtccttcccccagca

SEQ ID NO: 4783058 - DNA, 14 bp, Homo sapiens
gtcctttatgtatt

SEQ ID NO: 4783059 - DNA, 18 bp, Homo sapiens
gtcctttcctctcctctc

SEQ ID NO: 4783060 - DNA, 21 bp, Homo sapiens
gtcctttcctctcctctctgg

SEQ ID NO: 4783061 - DNA, 20 bp, Homo sapiens
gtcctttctgatcctctctt

SEQ ID NO: 4783062 - DNA, 23 bp, Homo sapiens
gtcgccccaggccctccctgact

SEQ ID NO: 4783063 - DNA, 14 bp, Homo sapiens
gtcgcccctcctcg

SEQ ID NO: 4783064 - DNA, 20 bp, Homo sapiens
gtcgcccctcctcgggcgcc

SEQ ID NO: 4783065 - DNA, 17 bp, Homo sapiens
gtcgctgtccgtcctgc

SEQ ID NO: 4783066 - DNA, 11 bp, Homo sapiens
gtcggctgggc

SEQ ID NO: 4783067 - DNA, 12 bp, Homo sapiens
gtcggctgggca

SEQ ID NO: 4783068 - DNA, 15 bp, Homo sapiens
gtcggctgggcaggg

SEQ ID NO: 4783069 - DNA, 17 bp, Homo sapiens
gtcggctgggcagggcc

SEQ ID NO: 4783070 - DNA, 21 bp, Homo sapiens
gtcgggcccgcactcaggagc

SEQ ID NO: 4783071 - DNA, 14 bp, Homo sapiens
gtcggggcccctgc

SEQ ID NO: 4783072 - DNA, 18 bp, Homo sapiens
gtcgggggaggagcaccc

SEQ ID NO: 4783073 - DNA, 14 bp, Homo sapiens
gtcgtaacagcagg

SEQ ID NO: 4783074 - DNA, 12 bp, Homo sapiens
gtgggccctgcc

SEQ ID NO: 4783075 - DNA, 13 bp, Homo sapiens
gtgggcctgccta

SEQ ID NO: 4783076 - DNA, 18 bp, Homo sapiens
gtggggacctcaggcctg

SEQ ID NO: 4783077 - DNA, 22 bp, Homo sapiens
gtggggacgggggctgcttctc

SEQ ID NO: 4783078 - DNA, 15 bp, Homo sapiens
gtggggccagcgctg

SEQ ID NO: 4783079 - DNA, 18 bp, Homo sapiens
gtggggcccatggcccca

SEQ ID NO: 4783080 - DNA, 20 bp, Homo sapiens
gtggggcccatggccccagc

SEQ ID NO: 4783081 - DNA, 23 bp, Homo sapiens
gtggggcccatggccccagctgg

SEQ ID NO: 4783082 - DNA, 12 bp, Homo sapiens
gtggggcttggc

SEQ ID NO: 4783083 - DNA, 19 bp, Homo sapiens
gtgggggagaatggctctg

SEQ ID NO: 4783084 - DNA, 21 bp, Homo sapiens
gtgggggagaatggctctggc

SEQ ID NO: 4783085 - DNA, 23 bp, Homo sapiens
gtggggggccatgttcccagaac

SEQ ID NO: 4783086 - DNA, 15 bp, Homo sapiens
gtggggtgctggggc

SEQ ID NO: 4783087 - DNA, 18 bp, Homo sapiens
gtggggttttcacttcct

SEQ ID NO: 4783088 - DNA, 16 bp, Homo sapiens
gtgggtcaactccaag

SEQ ID NO: 4783089 - DNA, 22 bp, Homo sapiens
gtggtattttaacatagcagct

SEQ ID NO: 4783090 - DNA, 13 bp, Homo sapiens
gtggtctgtgtgt

SEQ ID NO: 4783091 - DNA, 19 bp, Homo sapiens
gtggtcttcaaattgtctt

SEQ ID NO: 4783092 - DNA, 15 bp, Homo sapiens
gtggtcttggagagg

SEQ ID NO: 4783093 - DNA, 14 bp, Homo sapiens
gtggtgaggtcctg

SEQ ID NO: 4783094 - DNA, 20 bp, Homo sapiens
gtggtgaggttgtgctgcct

SEQ ID NO: 4783095 - DNA, 15 bp, Homo sapiens
gtggtggtggtgaag

SEQ ID NO: 4783096 - DNA, 16 bp, Homo sapiens
gtggtggtggtgaagg

SEQ ID NO: 4783097 - DNA, 14 bp, Homo sapiens
gtggtgtcctctgt

SEQ ID NO: 4783098 - DNA, 16 bp, Homo sapiens
gtggtgtcctctgtcc

SEQ ID NO: 4783099 - DNA, 14 bp, Homo sapiens
gtggtgtgaggccc

SEQ ID NO: 4783100 - DNA, 19 bp, Homo sapiens
gtggtgtgaggcccccgga

SEQ ID NO: 4783101 - DNA, 16 bp, Homo sapiens
gtggttatgtcccatg

SEQ ID NO: 4783102 - DNA, 16 bp, Homo sapiens
gtggttctgccactta

SEQ ID NO: 4783103 - DNA, 13 bp, Homo sapiens
gtggttggaggcc

SEQ ID NO: 4783104 - DNA, 17 bp, Homo sapiens
gtgtaaatgtggacaca

SEQ ID NO: 4783105 - DNA, 23 bp, Homo sapiens
gtgtaacttttttttagtatttg

SEQ ID NO: 4783106 - DNA, 16 bp, Homo sapiens
gtgtaatatcatttca

SEQ ID NO: 4783107 - DNA, 17 bp, Homo sapiens
gtgtaatatcatttcat

SEQ ID NO: 4783108 - DNA, 17 bp, Homo sapiens
gtgtaggaaatctgaag

SEQ ID NO: 4783109 - DNA, 19 bp, Homo sapiens
gtgtaggaaatctgaagcc

SEQ ID NO: 4783110 - DNA, 19 bp, Homo sapiens
gtgtagtcccggaggcctt

SEQ ID NO: 4783111 - DNA, 20 bp, Homo sapiens
gtgtagtcccggaggccttc

SEQ ID NO: 4783112 - DNA, 19 bp, Homo sapiens
gtgtatacatatgtatgtg

SEQ ID NO: 4783113 - DNA, 16 bp, Homo sapiens
gtgtatatattatata

SEQ ID NO: 4783114 - DNA, 23 bp, Homo sapiens
gtgtatgtacttacatgggtgtt

SEQ ID NO: 4783115 - DNA, 20 bp, Homo sapiens
gtgtatgtctatgtgtatat

SEQ ID NO: 4783116 - DNA, 18 bp, Homo sapiens
gtgtatttaatgtttgta

SEQ ID NO: 4783117 - DNA, 19 bp, Homo sapiens
gtgtatttaatgtttgtaa

SEQ ID NO: 4783118 - DNA, 21 bp, Homo sapiens
gtgtatttttgtaattcctct

SEQ ID NO: 4783119 - DNA, 20 bp, Homo sapiens
gtgtcacgtgaccctgtgcc

SEQ ID NO: 4783120 - DNA, 21 bp, Homo sapiens
gtgtcacgtgaccctgtgccc

SEQ ID NO: 4783121 - DNA, 16 bp, Homo sapiens
gtgtcacttttttcct

SEQ ID NO: 4783122 - DNA, 20 bp, Homo sapiens
gtgtcagcccatgtcaatca

SEQ ID NO: 4783123 - DNA, 22 bp, Homo sapiens
gtgtcattttctgttatacaca

SEQ ID NO: 4783124 - DNA, 23 bp, Homo sapiens
gtgtcattttctgttatacacag

SEQ ID NO: 4783125 - DNA, 17 bp, Homo sapiens
gtgtcccagtgtctggc

SEQ ID NO: 4783126 - DNA, 14 bp, Homo sapiens
gtgtcccccctgtg

SEQ ID NO: 4783127 - DNA, 22 bp, Homo sapiens
gtgtcccccctgtggtctgtgt

SEQ ID NO: 4783128 - DNA, 23 bp, Homo sapiens
gtgtcccccctgtggtctgtgtg

SEQ ID NO: 4783129 - DNA, 23 bp, Homo sapiens
gtgtcccctcactctgtcagcca

SEQ ID NO: 4783130 - DNA, 16 bp, Homo sapiens
gtgtcccctggtgccc

SEQ ID NO: 4783131 - DNA, 20 bp, Homo sapiens
gtgtcccctggtgcccctcc

SEQ ID NO: 4783132 - DNA, 13 bp, Homo sapiens
gtgtcctgcatgt

SEQ ID NO: 4783133 - DNA, 17 bp, Homo sapiens
gtgtcctgctacctttg

SEQ ID NO: 4783134 - DNA, 24 bp, Homo sapiens
gtgtcctgctacctttgtctcacg

SEQ ID NO: 4783135 - DNA, 22 bp, Homo sapiens
gtgtctaaaacactattctcca

SEQ ID NO: 4783136 - DNA, 20 bp, Homo sapiens
gtgtctggatcagtaaaatt

SEQ ID NO: 4783137 - DNA, 16 bp, Homo sapiens
gtgtctggtccacaca

SEQ ID NO: 4783138 - DNA, 21 bp, Homo sapiens
gtgtcttttaaaaactcctgt

SEQ ID NO: 4783139 - DNA, 13 bp, Homo sapiens
gtgtgacctgaca

SEQ ID NO: 4783140 - DNA, 20 bp, Homo sapiens
gtgtgacctgacacctgccg

SEQ ID NO: 4783141 - DNA, 12 bp, Homo sapiens
gtgtgaggcccc

SEQ ID NO: 4783142 - DNA, 13 bp, Homo sapiens
gtgtgagtgtatg

SEQ ID NO: 4783143 - DNA, 18 bp, Homo sapiens
gtgtgagtgttagaaaaa

SEQ ID NO: 4783144 - DNA, 13 bp, Homo sapiens
gtgtgatgcagga

SEQ ID NO: 4783145 - DNA, 13 bp, Homo sapiens
gtgtgcagagtat

SEQ ID NO: 4783146 - DNA, 19 bp, Homo sapiens
gtgtgcagagtatacaagt

SEQ ID NO: 4783147 - DNA, 14 bp, Homo sapiens
gtgtgcttcacaca

SEQ ID NO: 4783148 - DNA, 23 bp, Homo sapiens
gtgtggagaagtgtgttctgatg

SEQ ID NO: 4783149 - DNA, 17 bp, Homo sapiens
gtgtggagtggaggggt

SEQ ID NO: 4783150 - DNA, 15 bp, Homo sapiens
gtgtggcaaacattt

SEQ ID NO: 4783151 - DNA, 17 bp, Homo sapiens
gtgtggccctgtgggag

SEQ ID NO: 4783152 - DNA, 11 bp, Homo sapiens
gtgtggcctca

SEQ ID NO: 4783153 - DNA, 13 bp, Homo sapiens
gtgtggcctcagc

SEQ ID NO: 4783154 - DNA, 16 bp, Homo sapiens
gtgtggcctcagccct

SEQ ID NO: 4783155 - DNA, 12 bp, Homo sapiens
gtgtggcctggg

SEQ ID NO: 4783156 - DNA, 16 bp, Homo sapiens
gtgtgggccagagatc

SEQ ID NO: 4783157 - DNA, 18 bp, Homo sapiens
gtgtgggccagagatcct

SEQ ID NO: 4783158 - DNA, 20 bp, Homo sapiens
gtgtgtcagcccatgtcaat

SEQ ID NO: 4783159 - DNA, 18 bp, Homo sapiens
gtgtgtgacaccaccact

SEQ ID NO: 4783160 - DNA, 13 bp, Homo sapiens
gtgtgtgtgtgca

SEQ ID NO: 4783161 - DNA, 15 bp, Homo sapiens
gtgtgtttctgtcct

SEQ ID NO: 4783162 - DNA, 17 bp, Homo sapiens
gtgttattattattata

SEQ ID NO: 4783163 - DNA, 15 bp, Homo sapiens
gtgttcaaattctga

SEQ ID NO: 4783164 - DNA, 15 bp, Homo sapiens
gtgttcaatctgtga

SEQ ID NO: 4783165 - DNA, 17 bp, Homo sapiens
gtgttctcaatgctttt

SEQ ID NO: 4783166 - DNA, 18 bp, Homo sapiens
gtgttctgatgaggcatt

SEQ ID NO: 4783167 - DNA, 12 bp, Homo sapiens
gtgttgaggagg

SEQ ID NO: 4783168 - DNA, 15 bp, Homo sapiens
gtgttgggtggagga

SEQ ID NO: 4783169 - DNA, 16 bp, Homo sapiens
gtgttgtgctttcaag

SEQ ID NO: 4783170 - DNA, 18 bp, Homo sapiens
gtgtttaattgtataaaa

SEQ ID NO: 4783171 - DNA, 18 bp, Homo sapiens
gtgtttatgtgctattaa

SEQ ID NO: 4783172 - DNA, 17 bp, Homo sapiens
gtgtttcatgttctgtg

SEQ ID NO: 4783173 - DNA, 22 bp, Homo sapiens
gtgtttcatgttctgtgtcacg

SEQ ID NO: 4783174 - DNA, 21 bp, Homo sapiens
gtgtttctgtcctgtaactgt

SEQ ID NO: 4783175 - DNA, 14 bp, Homo sapiens
gtgttttcttcgtg

SEQ ID NO: 4783176 - DNA, 19 bp, Homo sapiens
gtgttttgggtttttaaaa

SEQ ID NO: 4783177 - DNA, 15 bp, Homo sapiens
gtgtttttacatata

SEQ ID NO: 4783178 - DNA, 20 bp, Homo sapiens
gtgtttttggttttctcctt

SEQ ID NO: 4783179 - DNA, 14 bp, Homo sapiens
gttaaatgagctta

SEQ ID NO: 4783180 - DNA, 23 bp, Homo sapiens
gttaacaatgcctattgtaatat

SEQ ID NO: 4783181 - DNA, 20 bp, Homo sapiens
gttaaccgggactacagaag

SEQ ID NO: 4783182 - DNA, 19 bp, Homo sapiens
gttaactatgattccaatt

SEQ ID NO: 4783183 - DNA, 18 bp, Homo sapiens
gttaacttatgtctcttg

SEQ ID NO: 4783184 - DNA, 21 bp, Homo sapiens
gttaacttattcaaagagaaa

SEQ ID NO: 4783185 - DNA, 17 bp, Homo sapiens
gttaagacaacaggcat

SEQ ID NO: 4783186 - DNA, 18 bp, Homo sapiens
gttaagagaaatgagctt

SEQ ID NO: 4783187 - DNA, 15 bp, Homo sapiens
gttaagcagtacatc

SEQ ID NO: 4783188 - DNA, 12 bp, Homo sapiens
gttaaggacttc

SEQ ID NO: 4783189 - DNA, 19 bp, Homo sapiens
gttaaggacttctgcagct

SEQ ID NO: 4783190 - DNA, 15 bp, Homo sapiens
gttaaggggatctaa

SEQ ID NO: 4783191 - DNA, 19 bp, Homo sapiens
gttaaggggatctaaaagg

SEQ ID NO: 4783192 - DNA, 17 bp, Homo sapiens
gttaattgatagaataa

SEQ ID NO: 4783193 - DNA, 18 bp, Homo sapiens
gttacagtggcagtattg

SEQ ID NO: 4783194 - DNA, 12 bp, Homo sapiens
gttacttacaca

SEQ ID NO: 4783195 - DNA, 11 bp, Homo sapiens
gttagatgttt

SEQ ID NO: 4783196 - DNA, 13 bp, Homo sapiens
gtttattgtcaaa

SEQ ID NO: 4783197 - DNA, 17 bp, Homo sapiens
gtttcatattctcagat

SEQ ID NO: 4783198 - DNA, 18 bp, Homo sapiens
gtttcatgttctgtgtca

SEQ ID NO: 4783199 - DNA, 18 bp, Homo sapiens
gtttcatttatgatacaa

SEQ ID NO: 4783200 - DNA, 21 bp, Homo sapiens
gtttccaatgccaattcatct

SEQ ID NO: 4783201 - DNA, 13 bp, Homo sapiens
gtttccacatgct

SEQ ID NO: 4783202 - DNA, 19 bp, Homo sapiens
gtttccagctaagcctgat

SEQ ID NO: 4783203 - DNA, 11 bp, Homo sapiens
gtttccagtga

SEQ ID NO: 4783204 - DNA, 18 bp, Homo sapiens
gtttccatcaaagccctc

SEQ ID NO: 4783205 - DNA, 23 bp, Homo sapiens
gtttccatttggattttaaacaa

SEQ ID NO: 4783206 - DNA, 18 bp, Homo sapiens
gtttcgttaagcagtaca

SEQ ID NO: 4783207 - DNA, 14 bp, Homo sapiens
gtttctaaagctgc

SEQ ID NO: 4783208 - DNA, 16 bp, Homo sapiens
gtttctaaagctgcca

SEQ ID NO: 4783209 - DNA, 20 bp, Homo sapiens
gtttctaaagctgccagccg

SEQ ID NO: 4783210 - DNA, 17 bp, Homo sapiens
gtttctaagaatttaga

SEQ ID NO: 4783211 - DNA, 18 bp, Homo sapiens
gtttctgcagtattctgt

SEQ ID NO: 4783212 - DNA, 19 bp, Homo sapiens
gtttctgtttgaattttca

SEQ ID NO: 4783213 - DNA, 20 bp, Homo sapiens
gtttctgtttgaattttcaa

SEQ ID NO: 4783214 - DNA, 21 bp, Homo sapiens
gtttctttgagggttccatgg

SEQ ID NO: 4783215 - DNA, 15 bp, Homo sapiens
gtttgaattttcaaa

SEQ ID NO: 4783216 - DNA, 13 bp, Homo sapiens
gtttgacctcaca

SEQ ID NO: 4783217 - DNA, 18 bp, Homo sapiens
gtttgaggaccctcccag

SEQ ID NO: 4783218 - DNA, 19 bp, Homo sapiens
gtttgatgaataaaatgtt

SEQ ID NO: 4783219 - DNA, 21 bp, Homo sapiens
gtttgcctttaggcaggaagt

SEQ ID NO: 4783220 - DNA, 13 bp, Homo sapiens
gtttgctaatgtt

SEQ ID NO: 4783221 - DNA, 13 bp, Homo sapiens
gtttgcttctaaa

SEQ ID NO: 4783222 - DNA, 19 bp, Homo sapiens
gtttgcttctaaaggtttc

SEQ ID NO: 4783223 - DNA, 17 bp, Homo sapiens
gtttggctgaaattatg

SEQ ID NO: 4783224 - DNA, 20 bp, Homo sapiens
gtttgggggacgcccagccc

SEQ ID NO: 4783225 - DNA, 15 bp, Homo sapiens
gtttggtatgaaaca

SEQ ID NO: 4783226 - DNA, 16 bp, Homo sapiens
gtttgtaaaagagctg

SEQ ID NO: 4783227 - DNA, 22 bp, Homo sapiens
gtttgtaaaagagctgttcttt

SEQ ID NO: 4783228 - DNA, 17 bp, Homo sapiens
gtttgtcctttatgtat

SEQ ID NO: 4783229 - DNA, 13 bp, Homo sapiens
gtttgtgcttcta

SEQ ID NO: 4783230 - DNA, 23 bp, Homo sapiens
gtttgttctccgggtgtggcctc

SEQ ID NO: 4783231 - DNA, 19 bp, Homo sapiens
gtttgttgagctggtaaca

SEQ ID NO: 4783232 - DNA, 18 bp, Homo sapiens
gttttaaaaaatacagta

SEQ ID NO: 4783233 - DNA, 23 bp, Homo sapiens
gttttaaagaagtccatgtgata

SEQ ID NO: 4783234 - DNA, 18 bp, Homo sapiens
gttttacaaagaaacaaa

SEQ ID NO: 4783235 - DNA, 18 bp, Homo sapiens
gttttatgagacttccta

SEQ ID NO: 4783236 - DNA, 24 bp, Homo sapiens
gttttattgtaatcataaatactg

SEQ ID NO: 4783237 - DNA, 13 bp, Homo sapiens
gttttctccttcc

SEQ ID NO: 4783238 - DNA, 14 bp, Homo sapiens
gttttcttcgtgga

SEQ ID NO: 4783239 - DNA, 16 bp, Homo sapiens
gttttcttttaatttt

SEQ ID NO: 4783240 - DNA, 20 bp, Homo sapiens
gttttgatacttgtaacttt

SEQ ID NO: 4783241 - DNA, 16 bp, Homo sapiens
gttttgatctcagcat

SEQ ID NO: 4783242 - DNA, 19 bp, Homo sapiens
gttttgatctctgttcttt

SEQ ID NO: 4783243 - DNA, 11 bp, Homo sapiens
gttttgctaat

SEQ ID NO: 4783244 - DNA, 18 bp, Homo sapiens
gttttgggaaacactttg

SEQ ID NO: 4783245 - DNA, 15 bp, Homo sapiens
gtttttaatctcttg

SEQ ID NO: 4783246 - DNA, 15 bp, Homo sapiens
gtttttatatattat

SEQ ID NO: 4783247 - DNA, 19 bp, Homo sapiens
gtttttctgttccctgctg

SEQ ID NO: 4783248 - DNA, 16 bp, Homo sapiens
gtttttggatggctta

SEQ ID NO: 4783249 - DNA, 14 bp, Homo sapiens
gttttttctttata

SEQ ID NO: 4783250 - DNA, 21 bp, Homo sapiens
taaaaaaaatattctgtcatt

SEQ ID NO: 4783251 - DNA, 18 bp, Homo sapiens
taaaaaaataatataaat

SEQ ID NO: 4783252 - DNA, 20 bp, Homo sapiens
taaaaaaataatataaatga

SEQ ID NO: 4783253 - DNA, 20 bp, Homo sapiens
taaaaaatacagtattattt

SEQ ID NO: 4783254 - DNA, 14 bp, Homo sapiens
taaaaaatatatgt

SEQ ID NO: 4783255 - DNA, 15 bp, Homo sapiens
taaaaacataaaata

SEQ ID NO: 4783256 - DNA, 17 bp, Homo sapiens
taaaaacataaaatata

SEQ ID NO: 4783257 - DNA, 15 bp, Homo sapiens
taaaaaccctgctaa

SEQ ID NO: 4783258 - DNA, 19 bp, Homo sapiens
taaaaagtcagatgtttga

SEQ ID NO: 4783259 - DNA, 22 bp, Homo sapiens
taaaaatccctcttcctccaaa

SEQ ID NO: 4783260 - DNA, 16 bp, Homo sapiens
taaaaattaattcttt

SEQ ID NO: 4783261 - DNA, 21 bp, Homo sapiens
taaaaattctagattaccatg

SEQ ID NO: 4783262 - DNA, 20 bp, Homo sapiens
taaaacaagagaccacttcc

SEQ ID NO: 4783263 - DNA, 14 bp, Homo sapiens
taaaacaagctgat

SEQ ID NO: 4783264 - DNA, 15 bp, Homo sapiens
taaaacaagctgata

SEQ ID NO: 4783265 - DNA, 20 bp, Homo sapiens
taaaacaagctgatagtgtt

SEQ ID NO: 4783266 - DNA, 19 bp, Homo sapiens
taaaacacttcattgaaaa

SEQ ID NO: 4783267 - DNA, 12 bp, Homo sapiens
taaaacagtggt

SEQ ID NO: 4783268 - DNA, 18 bp, Homo sapiens
taaaacatgactcctaca

SEQ ID NO: 4783269 - DNA, 13 bp, Homo sapiens
taaaaccaaaggt

SEQ ID NO: 4783270 - DNA, 16 bp, Homo sapiens
taaaaccagaaagagg

SEQ ID NO: 4783271 - DNA, 20 bp, Homo sapiens
taaaactactgcctttcaaa

SEQ ID NO: 4783272 - DNA, 20 bp, Homo sapiens
taaaactgtgacattccaca

SEQ ID NO: 4783273 - DNA, 18 bp, Homo sapiens
taaaacttactatggtat

SEQ ID NO: 4783274 - DNA, 17 bp, Homo sapiens
taaaagaaaccctgcac

SEQ ID NO: 4783275 - DNA, 17 bp, Homo sapiens
taaaagaaggtaaataa

SEQ ID NO: 4783276 - DNA, 13 bp, Homo sapiens
taaaagagctgtt

SEQ ID NO: 4783277 - DNA, 17 bp, Homo sapiens
taaaagagctgttcttt

SEQ ID NO: 4783278 - DNA, 23 bp, Homo sapiens
taaaagagctgttctttttgact

SEQ ID NO: 4783279 - DNA, 15 bp, Homo sapiens
taaaaggaggacagg

SEQ ID NO: 4783280 - DNA, 14 bp, Homo sapiens
taaaataaataatc

SEQ ID NO: 4783281 - DNA, 14 bp, Homo sapiens
taaaataaatgttt

SEQ ID NO: 4783282 - DNA, 17 bp, Homo sapiens
taaaataaatgttttgg

SEQ ID NO: 4783283 - DNA, 23 bp, Homo sapiens
taaaatacatactatagattctt

SEQ ID NO: 4783284 - DNA, 20 bp, Homo sapiens
taaaatacatggtatctctt

SEQ ID NO: 4783285 - DNA, 15 bp, Homo sapiens
taaaatatacaaaca

SEQ ID NO: 4783286 - DNA, 16 bp, Homo sapiens
taaaatatacaaacat

SEQ ID NO: 4783287 - DNA, 18 bp, Homo sapiens
taaaatatttataaatga

SEQ ID NO: 4783288 - DNA, 15 bp, Homo sapiens
taaaatcagactctt

SEQ ID NO: 4783289 - DNA, 21 bp, Homo sapiens
taaaatcagtgtgcttgcctt

SEQ ID NO: 4783290 - DNA, 14 bp, Homo sapiens
taaaatccacccag

SEQ ID NO: 4783291 - DNA, 20 bp, Homo sapiens
taaaatccacccagcccact

SEQ ID NO: 4783292 - DNA, 15 bp, Homo sapiens
taaaatctcctaaat

SEQ ID NO: 4783293 - DNA, 11 bp, Homo sapiens
taaaatgcaag

SEQ ID NO: 4783294 - DNA, 23 bp, Homo sapiens
taaaatgcaaggacaagcaatta

SEQ ID NO: 4783295 - DNA, 12 bp, Homo sapiens
taaaatgtatta

SEQ ID NO: 4783296 - DNA, 21 bp, Homo sapiens
taaaattagtgagatttgtat

SEQ ID NO: 4783297 - DNA, 14 bp, Homo sapiens
taaaattatactgt

SEQ ID NO: 4783298 - DNA, 19 bp, Homo sapiens
taaaattatctgttctatg

SEQ ID NO: 4783299 - DNA, 20 bp, Homo sapiens
taaaattatctgttctatgg

SEQ ID NO: 4783300 - DNA, 21 bp, Homo sapiens
taaaattatctgttctatgga

SEQ ID NO: 4783301 - DNA, 22 bp, Homo sapiens
taaaattatctgttctatggac

SEQ ID NO: 4783302 - DNA, 13 bp, Homo sapiens
taaaattattaaa

SEQ ID NO: 4783303 - DNA, 15 bp, Homo sapiens
taaaattattaaaaa

SEQ ID NO: 4783304 - DNA, 20 bp, Homo sapiens
taaaattattaaaaattata

SEQ ID NO: 4783305 - DNA, 19 bp, Homo sapiens
taaaattcattccatttgc

SEQ ID NO: 4783306 - DNA, 13 bp, Homo sapiens
taaacaaaattta

SEQ ID NO: 4783307 - DNA, 19 bp, Homo sapiens
taaacaaaatttatgtcat

SEQ ID NO: 4783308 - DNA, 21 bp, Homo sapiens
taaacaaaatttatgtcattt

SEQ ID NO: 4783309 - DNA, 18 bp, Homo sapiens
taaacacagattatttgt

SEQ ID NO: 4783310 - DNA, 15 bp, Homo sapiens
taaacacttctcctt

SEQ ID NO: 4783311 - DNA, 17 bp, Homo sapiens
taaacacttctccttaa

SEQ ID NO: 4783312 - DNA, 14 bp, Homo sapiens
taaacagctgcttt

SEQ ID NO: 4783313 - DNA, 22 bp, Homo sapiens
taaacatagtggtattttaaca

SEQ ID NO: 4783314 - DNA, 20 bp, Homo sapiens
taaaccataaaataaataat

SEQ ID NO: 4783315 - DNA, 17 bp, Homo sapiens
taaacccaaataaatgt

SEQ ID NO: 4783316 - DNA, 18 bp, Homo sapiens
taaacccacataaacact

SEQ ID NO: 4783317 - DNA, 13 bp, Homo sapiens
taaaccctccaag

SEQ ID NO: 4783318 - DNA, 20 bp, Homo sapiens
taatcatccttttttaaaaa

SEQ ID NO: 4783319 - DNA, 15 bp, Homo sapiens
taatcatttccagca

SEQ ID NO: 4783320 - DNA, 18 bp, Homo sapiens
taatccttaataactatg

SEQ ID NO: 4783321 - DNA, 19 bp, Homo sapiens
taatctagagctatgcaca

SEQ ID NO: 4783322 - DNA, 22 bp, Homo sapiens
taatctagagctatgcacacca

SEQ ID NO: 4783323 - DNA, 15 bp, Homo sapiens
taatctcttcttata

SEQ ID NO: 4783324 - DNA, 17 bp, Homo sapiens
taatctgtcgcatttca

SEQ ID NO: 4783325 - DNA, 16 bp, Homo sapiens
taatcttaatgtatat

SEQ ID NO: 4783326 - DNA, 15 bp, Homo sapiens
taatcttgctgctta

SEQ ID NO: 4783327 - DNA, 17 bp, Homo sapiens
taatcttgttgataaaa

SEQ ID NO: 4783328 - DNA, 16 bp, Homo sapiens
taatctttgtgacagg

SEQ ID NO: 4783329 - DNA, 19 bp, Homo sapiens
taatgaaaaatctgaattt

SEQ ID NO: 4783330 - DNA, 19 bp, Homo sapiens
taatgaatgcaaaaagata

SEQ ID NO: 4783331 - DNA, 18 bp, Homo sapiens
taatgaattttaaaagca

SEQ ID NO: 4783332 - DNA, 13 bp, Homo sapiens
taatgacaacaaa

SEQ ID NO: 4783333 - DNA, 16 bp, Homo sapiens
taatgacaagtgactt

SEQ ID NO: 4783334 - DNA, 13 bp, Homo sapiens
taatgaggaaact

SEQ ID NO: 4783335 - DNA, 17 bp, Homo sapiens
taatgattcttgtgtca

SEQ ID NO: 4783336 - DNA, 23 bp, Homo sapiens
taatgcttaacataaacttgtac

SEQ ID NO: 4783337 - DNA, 15 bp, Homo sapiens
taatggaaaactgtt

SEQ ID NO: 4783338 - DNA, 15 bp, Homo sapiens
taatggccaagtgta

SEQ ID NO: 4783339 - DNA, 13 bp, Homo sapiens
taatggctctggg

SEQ ID NO: 4783340 - DNA, 17 bp, Homo sapiens
taatggctctgggctat

SEQ ID NO: 4783341 - DNA, 23 bp, Homo sapiens
taatggctctgggctatatgcct

SEQ ID NO: 4783342 - DNA, 18 bp, Homo sapiens
taatgtaacttaattata

SEQ ID NO: 4783343 - DNA, 16 bp, Homo sapiens
taatgtagggcagaat

SEQ ID NO: 4783344 - DNA, 20 bp, Homo sapiens
taatgtcataaagtgagaaa

SEQ ID NO: 4783345 - DNA, 15 bp, Homo sapiens
taatgtctcaaaata

SEQ ID NO: 4783346 - DNA, 17 bp, Homo sapiens
taatgtctcaaaataaa

SEQ ID NO: 4783347 - DNA, 15 bp, Homo sapiens
taatgtctttgtgtt

SEQ ID NO: 4783348 - DNA, 19 bp, Homo sapiens
taatgtgaaatgtaactgt

SEQ ID NO: 4783349 - DNA, 17 bp, Homo sapiens
taatgtgggaagaaaca

SEQ ID NO: 4783350 - DNA, 16 bp, Homo sapiens
taatgtttagtcagtg

SEQ ID NO: 4783351 - DNA, 22 bp, Homo sapiens
taatgtttgtaagcaattctaa

SEQ ID NO: 4783352 - DNA, 14 bp, Homo sapiens
taattaaaaaatag

SEQ ID NO: 4783353 - DNA, 15 bp, Homo sapiens
taattaaaaagttaa

SEQ ID NO: 4783354 - DNA, 17 bp, Homo sapiens
taattaaaacacaacat

SEQ ID NO: 4783355 - DNA, 14 bp, Homo sapiens
taattaaaatttgg

SEQ ID NO: 4783356 - DNA, 15 bp, Homo sapiens
taattaaaatttggg

SEQ ID NO: 4783357 - DNA, 12 bp, Homo sapiens
taattaaatgaa

SEQ ID NO: 4783358 - DNA, 14 bp, Homo sapiens
taattaatttcagt

SEQ ID NO: 4783359 - DNA, 20 bp, Homo sapiens
taattatggtacctctgtct

SEQ ID NO: 4783360 - DNA, 16 bp, Homo sapiens
taattctatgattaaa

SEQ ID NO: 4783361 - DNA, 22 bp, Homo sapiens
taattcttaccgaaatgaaaat

SEQ ID NO: 4783362 - DNA, 23 bp, Homo sapiens
taattcttctcctttgtcaaatg

SEQ ID NO: 4783363 - DNA, 22 bp, Homo sapiens
taattgtaaaggtgatgaattt

SEQ ID NO: 4783364 - DNA, 18 bp, Homo sapiens
taattgtataaaacagtg

SEQ ID NO: 4783365 - DNA, 17 bp, Homo sapiens
taatttacctgaagtct

SEQ ID NO: 4783366 - DNA, 18 bp, Homo sapiens
taatttacctgaagtctt

SEQ ID NO: 4783367 - DNA, 18 bp, Homo sapiens
taatttagcagtccattt

SEQ ID NO: 4783368 - DNA, 23 bp, Homo sapiens
taatttagcagtccatttttgag

SEQ ID NO: 4783369 - DNA, 17 bp, Homo sapiens
taatttccttaaagcaa

SEQ ID NO: 4783370 - DNA, 19 bp, Homo sapiens
taatttctgccatttcatg

SEQ ID NO: 4783371 - DNA, 16 bp, Homo sapiens
taatttgctctgtggt

SEQ ID NO: 4783372 - DNA, 22 bp, Homo sapiens
taatttgctctgtggtaagaga

SEQ ID NO: 4783373 - DNA, 12 bp, Homo sapiens
taatttgtgaaa

SEQ ID NO: 4783374 - DNA, 19 bp, Homo sapiens
taattttaaaattgcagca

SEQ ID NO: 4783375 - DNA, 22 bp, Homo sapiens
tacaaaaaaaatcaaaaaatta

SEQ ID NO: 4783376 - DNA, 13 bp, Homo sapiens
tacaaacctctca

SEQ ID NO: 4783377 - DNA, 13 bp, Homo sapiens
tacaaagaaacaa

SEQ ID NO: 4783378 - DNA, 12 bp, Homo sapiens
tacaaagctgtc

SEQ ID NO: 4783379 - DNA, 14 bp, Homo sapiens
tacaaagctgtcac

SEQ ID NO: 4783380 - DNA, 15 bp, Homo sapiens
tacaaagctgtcact

SEQ ID NO: 4783381 - DNA, 17 bp, Homo sapiens
tacaaatctcactgtat

SEQ ID NO: 4783382 - DNA, 17 bp, Homo sapiens
tacaaatttttactcag

SEQ ID NO: 4783383 - DNA, 20 bp, Homo sapiens
tacaaatttttactcaggct

SEQ ID NO: 4783384 - DNA, 21 bp, Homo sapiens
tacaacaagcaaactgaaatt

SEQ ID NO: 4783385 - DNA, 15 bp, Homo sapiens
tacaacctccgcctc

SEQ ID NO: 4783386 - DNA, 14 bp, Homo sapiens
tacaagctacatat

SEQ ID NO: 4783387 - DNA, 21 bp, Homo sapiens
tacaaggccccaaggtttaca

SEQ ID NO: 4783388 - DNA, 22 bp, Homo sapiens
tacaaggccccaaggtttacat

SEQ ID NO: 4783389 - DNA, 13 bp, Homo sapiens
tacaatgtattaa

SEQ ID NO: 4783390 - DNA, 15 bp, Homo sapiens
tacaattactgtgag

SEQ ID NO: 4783391 - DNA, 21 bp, Homo sapiens
tacaattctttgttgcttaat

SEQ ID NO: 4783392 - DNA, 23 bp, Homo sapiens
tacacagtgggaactctgacaag

SEQ ID NO: 4783393 - DNA, 13 bp, Homo sapiens
tacacatataaac

SEQ ID NO: 4783394 - DNA, 17 bp, Homo sapiens
tacacatataaacacag

SEQ ID NO: 4783395 - DNA, 19 bp, Homo sapiens
tacactcaagcatgaagat

SEQ ID NO: 4783396 - DNA, 17 bp, Homo sapiens
tacacttcacctccttc

SEQ ID NO: 4783397 - DNA, 20 bp, Homo sapiens
tacacttcacctccttctgc

SEQ ID NO: 4783398 - DNA, 18 bp, Homo sapiens
tacagaaccagcactccc

SEQ ID NO: 4783399 - DNA, 21 bp, Homo sapiens
tacagaaccagcactcccagg

SEQ ID NO: 4783400 - DNA, 11 bp, Homo sapiens
tacagaatcat

SEQ ID NO: 4783401 - DNA, 13 bp, Homo sapiens
tacagacaaagcg

SEQ ID NO: 4783402 - DNA, 22 bp, Homo sapiens
tacagacaacaaacctgtttct

SEQ ID NO: 4783403 - DNA, 23 bp, Homo sapiens
tacagagcagacagttaagagaa

SEQ ID NO: 4783404 - DNA, 14 bp, Homo sapiens
tacagagcctgttt

SEQ ID NO: 4783405 - DNA, 15 bp, Homo sapiens
tacagcctgcacaca

SEQ ID NO: 4783406 - DNA, 21 bp, Homo sapiens
tacagcctggtttttaagtac

SEQ ID NO: 4783407 - DNA, 12 bp, Homo sapiens
tacagctaaggc

SEQ ID NO: 4783408 - DNA, 16 bp, Homo sapiens
tacagctaaggccttg

SEQ ID NO: 4783409 - DNA, 22 bp, Homo sapiens
tacagctctcctccagccctgg

SEQ ID NO: 4783410 - DNA, 21 bp, Homo sapiens
tacagcttgaccgtgaggcca

SEQ ID NO: 4783411 - DNA, 23 bp, Homo sapiens
tacagcttgaccgtgaggccaga

SEQ ID NO: 4783412 - DNA, 23 bp, Homo sapiens
tacaggatatcacctgaattatt

SEQ ID NO: 4783413 - DNA, 19 bp, Homo sapiens
tacaggctgagacacagcc

SEQ ID NO: 4783414 - DNA, 17 bp, Homo sapiens
tacaggtattttcatca

SEQ ID NO: 4783415 - DNA, 12 bp, Homo sapiens
tacaggttttat

SEQ ID NO: 4783416 - DNA, 18 bp, Homo sapiens
tacagtaatgtcataaag

SEQ ID NO: 4783417 - DNA, 21 bp, Homo sapiens
tacagtacatgtttattatgt

SEQ ID NO: 4783418 - DNA, 21 bp, Homo sapiens
tacagtattatttagtaaaat

SEQ ID NO: 4783419 - DNA, 22 bp, Homo sapiens
tacagtctctatttgatttgca

SEQ ID NO: 4783420 - DNA, 15 bp, Homo sapiens
tacagtggcagtatt

SEQ ID NO: 4783421 - DNA, 16 bp, Homo sapiens
tacagtggcagtattg

SEQ ID NO: 4783422 - DNA, 17 bp, Homo sapiens
tacagttatacatacct

SEQ ID NO: 4783423 - DNA, 16 bp, Homo sapiens
tacatactatagattc

SEQ ID NO: 4783424 - DNA, 18 bp, Homo sapiens
tacatactatagattctt

SEQ ID NO: 4783425 - DNA, 23 bp, Homo sapiens
tacatagctttagagaagccata

SEQ ID NO: 4783426 - DNA, 13 bp, Homo sapiens
tacatatgcttta

SEQ ID NO: 4783427 - DNA, 19 bp, Homo sapiens
tacatatggaaatcctgtt

SEQ ID NO: 4783428 - DNA, 22 bp, Homo sapiens
tacatatggaaatcctgttact

SEQ ID NO: 4783429 - DNA, 23 bp, Homo sapiens
tacatatggaaatcctgttactt

SEQ ID NO: 4783430 - DNA, 16 bp, Homo sapiens
tacatatgtatgtgtg

SEQ ID NO: 4783431 - DNA, 22 bp, Homo sapiens
tacatatgtatgtgtgagtgta

SEQ ID NO: 4783432 - DNA, 22 bp, Homo sapiens
tacatctgaaatctacaacata

SEQ ID NO: 4783433 - DNA, 14 bp, Homo sapiens
tacatcttgtgcat

SEQ ID NO: 4783434 - DNA, 15 bp, Homo sapiens
tacatcttgtgcatg

SEQ ID NO: 4783435 - DNA, 18 bp, Homo sapiens
tacatcttgtgcatgcaa

SEQ ID NO: 4783436 - DNA, 19 bp, Homo sapiens
tacatcttgtgcatgcaaa

SEQ ID NO: 4783437 - DNA, 20 bp, Homo sapiens
tacatcttgtgcatgcaaaa

SEQ ID NO: 4783438 - DNA, 16 bp, Homo sapiens
tacatgcatgagcacc

SEQ ID NO: 4783439 - DNA, 23 bp, Homo sapiens
tagggtttgtttgctgcttttga

SEQ ID NO: 4783440 - DNA, 19 bp, Homo sapiens
taggtctatgatgtccaaa

SEQ ID NO: 4783441 - DNA, 12 bp, Homo sapiens
taggtctccacc

SEQ ID NO: 4783442 - DNA, 13 bp, Homo sapiens
taggtctccaccc

SEQ ID NO: 4783443 - DNA, 19 bp, Homo sapiens
taggtctgcacacataaca

SEQ ID NO: 4783444 - DNA, 12 bp, Homo sapiens
taggttaagtct

SEQ ID NO: 4783445 - DNA, 16 bp, Homo sapiens
tagtaaaattatctgt

SEQ ID NO: 4783446 - DNA, 14 bp, Homo sapiens
tagtaatctgtata

SEQ ID NO: 4783447 - DNA, 16 bp, Homo sapiens
tagtacatgcagaaat

SEQ ID NO: 4783448 - DNA, 23 bp, Homo sapiens
tagtactagagatattttgtaaa

SEQ ID NO: 4783449 - DNA, 17 bp, Homo sapiens
tagtacttcttctgtaa

SEQ ID NO: 4783450 - DNA, 16 bp, Homo sapiens
tagtagctgataaaga

SEQ ID NO: 4783451 - DNA, 19 bp, Homo sapiens
tagtagctgataaagaaac

SEQ ID NO: 4783452 - DNA, 13 bp, Homo sapiens
tagtatcctgtta

SEQ ID NO: 4783453 - DNA, 22 bp, Homo sapiens
tagtattttgagccttattaaa

SEQ ID NO: 4783454 - DNA, 23 bp, Homo sapiens
tagtattttgagccttattaaaa

SEQ ID NO: 4783455 - DNA, 21 bp, Homo sapiens
tagtcaggtgcctcaagagaa

SEQ ID NO: 4783456 - DNA, 18 bp, Homo sapiens
tagtcccggaggccttcc

SEQ ID NO: 4783457 - DNA, 16 bp, Homo sapiens
tagtctgtgcctcagt

SEQ ID NO: 4783458 - DNA, 17 bp, Homo sapiens
tagtgagatttgtattt

SEQ ID NO: 4783459 - DNA, 22 bp, Homo sapiens
tagtgagtgtggcttagtaata

SEQ ID NO: 4783460 - DNA, 20 bp, Homo sapiens
tagtgcaataaaactccctt

SEQ ID NO: 4783461 - DNA, 11 bp, Homo sapiens
tagtgcatgtc

SEQ ID NO: 4783462 - DNA, 14 bp, Homo sapiens
tagtgcatgtcaca

SEQ ID NO: 4783463 - DNA, 23 bp, Homo sapiens
tagtgccaaaaggccccttccca

SEQ ID NO: 4783464 - DNA, 14 bp, Homo sapiens
tagtgccatggcca

SEQ ID NO: 4783465 - DNA, 16 bp, Homo sapiens
tagtgccatggccagg

SEQ ID NO: 4783466 - DNA, 16 bp, Homo sapiens
tagtgctaaacctatc

SEQ ID NO: 4783467 - DNA, 21 bp, Homo sapiens
tagtggtcatttggtggctct

SEQ ID NO: 4783468 - DNA, 19 bp, Homo sapiens
tagtgtctggatcagtaaa

SEQ ID NO: 4783469 - DNA, 17 bp, Homo sapiens
tagtgtgctcggacaca

SEQ ID NO: 4783470 - DNA, 16 bp, Homo sapiens
tagtgttaatccagag

SEQ ID NO: 4783471 - DNA, 20 bp, Homo sapiens
tagtgtttcgttaagcagta

SEQ ID NO: 4783472 - DNA, 12 bp, Homo sapiens
tagtgttttcat

SEQ ID NO: 4783473 - DNA, 17 bp, Homo sapiens
tagtgttttcattctgg

SEQ ID NO: 4783474 - DNA, 15 bp, Homo sapiens
tagttaggtgtgcca

SEQ ID NO: 4783475 - DNA, 17 bp, Homo sapiens
tagttgacttcaaatgt

SEQ ID NO: 4783476 - DNA, 23 bp, Homo sapiens
tagttgatgaccaatctctgtga

SEQ ID NO: 4783477 - DNA, 17 bp, Homo sapiens
tagttgtaggggaaatc

SEQ ID NO: 4783478 - DNA, 21 bp, Homo sapiens
tagtttgacctcacagtgacc

SEQ ID NO: 4783479 - DNA, 15 bp, Homo sapiens
tagtttgcatttaag

SEQ ID NO: 4783480 - DNA, 18 bp, Homo sapiens
tataaaaaaggtggtggt

SEQ ID NO: 4783481 - DNA, 21 bp, Homo sapiens
tataaaaaatatatgtaatat

SEQ ID NO: 4783482 - DNA, 23 bp, Homo sapiens
tataaaaaatatatgtaatatat

SEQ ID NO: 4783483 - DNA, 11 bp, Homo sapiens
tataaaaataa

SEQ ID NO: 4783484 - DNA, 14 bp, Homo sapiens
tataaaacagtgtt

SEQ ID NO: 4783485 - DNA, 17 bp, Homo sapiens
tataaaacagtgtttcc

SEQ ID NO: 4783486 - DNA, 22 bp, Homo sapiens
tataaaatggtgttttcatgta

SEQ ID NO: 4783487 - DNA, 12 bp, Homo sapiens
tataaactgtga

SEQ ID NO: 4783488 - DNA, 16 bp, Homo sapiens
tataaactgtgagata

SEQ ID NO: 4783489 - DNA, 15 bp, Homo sapiens
tataaatgaagatgc

SEQ ID NO: 4783490 - DNA, 17 bp, Homo sapiens
tataaatgaagatgcat

SEQ ID NO: 4783491 - DNA, 15 bp, Homo sapiens
tataaatgaatgaaa

SEQ ID NO: 4783492 - DNA, 20 bp, Homo sapiens
tataaatgaatgaaatataa

SEQ ID NO: 4783493 - DNA, 17 bp, Homo sapiens
tataaatggacttgctt

SEQ ID NO: 4783494 - DNA, 15 bp, Homo sapiens
tataaatgggaagaa

SEQ ID NO: 4783495 - DNA, 22 bp, Homo sapiens
tataaatgtactacatttgcat

SEQ ID NO: 4783496 - DNA, 14 bp, Homo sapiens
tataaatgtgtgta

SEQ ID NO: 4783497 - DNA, 14 bp, Homo sapiens
tataaattaaatat

SEQ ID NO: 4783498 - DNA, 20 bp, Homo sapiens
tataaattaaatatatgtat

SEQ ID NO: 4783499 - DNA, 15 bp, Homo sapiens
tataaattacatgca

SEQ ID NO: 4783500 - DNA, 15 bp, Homo sapiens
tataaattattactt

SEQ ID NO: 4783501 - DNA, 16 bp, Homo sapiens
tataaattattacttt

SEQ ID NO: 4783502 - DNA, 14 bp, Homo sapiens
tataacaattgatt

SEQ ID NO: 4783503 - DNA, 17 bp, Homo sapiens
tataacatgaaagtcaa

SEQ ID NO: 4783504 - DNA, 17 bp, Homo sapiens
tataacattgtaaatga

SEQ ID NO: 4783505 - DNA, 23 bp, Homo sapiens
tataactaatttgctctgtggta

SEQ ID NO: 4783506 - DNA, 13 bp, Homo sapiens
tataactttagaa

SEQ ID NO: 4783507 - DNA, 16 bp, Homo sapiens
tataactttagaaata

SEQ ID NO: 4783508 - DNA, 16 bp, Homo sapiens
tataagacaagtctga

SEQ ID NO: 4783509 - DNA, 18 bp, Homo sapiens
tataagagacaaagtttg

SEQ ID NO: 4783510 - DNA, 17 bp, Homo sapiens
tataagagggaacaaat

SEQ ID NO: 4783511 - DNA, 12 bp, Homo sapiens
tataagccatag

SEQ ID NO: 4783512 - DNA, 17 bp, Homo sapiens
tataaggctaaatgtaa

SEQ ID NO: 4783513 - DNA, 12 bp, Homo sapiens
tataagttgacc

SEQ ID NO: 4783514 - DNA, 14 bp, Homo sapiens
tataataaactgtt

SEQ ID NO: 4783515 - DNA, 15 bp, Homo sapiens
tataataaactgttt

SEQ ID NO: 4783516 - DNA, 13 bp, Homo sapiens
tataataaagtat

SEQ ID NO: 4783517 - DNA, 14 bp, Homo sapiens
tataatactttgta

SEQ ID NO: 4783518 - DNA, 21 bp, Homo sapiens
tataatactttgtatacaagt

SEQ ID NO: 4783519 - DNA, 14 bp, Homo sapiens
tataatatggaacc

SEQ ID NO: 4783520 - DNA, 17 bp, Homo sapiens
tataatggcctcttaaa

SEQ ID NO: 4783521 - DNA, 17 bp, Homo sapiens
tataatggctctgggct

SEQ ID NO: 4783522 - DNA, 16 bp, Homo sapiens
tataatgtgaaatgta

SEQ ID NO: 4783523 - DNA, 18 bp, Homo sapiens
tataatttacctgaagtc

SEQ ID NO: 4783524 - DNA, 21 bp, Homo sapiens
tataatttacctgaagtcttt

SEQ ID NO: 4783525 - DNA, 21 bp, Homo sapiens
tataatttgccagacagagat

SEQ ID NO: 4783526 - DNA, 13 bp, Homo sapiens
tatacaaacaggt

SEQ ID NO: 4783527 - DNA, 15 bp, Homo sapiens
tatacaaacatgtgg

SEQ ID NO: 4783528 - DNA, 17 bp, Homo sapiens
tatacaaccttcattta

SEQ ID NO: 4783529 - DNA, 16 bp, Homo sapiens
tatacaagtactggta

SEQ ID NO: 4783530 - DNA, 13 bp, Homo sapiens
tatacaagtgttt

SEQ ID NO: 4783531 - DNA, 15 bp, Homo sapiens
tatacaagtgtttct

SEQ ID NO: 4783532 - DNA, 15 bp, Homo sapiens
tatacacaaagatat

SEQ ID NO: 4783533 - DNA, 15 bp, Homo sapiens
tatacagagcctgtt

SEQ ID NO: 4783534 - DNA, 17 bp, Homo sapiens
tatacagagcctgtttt

SEQ ID NO: 4783535 - DNA, 23 bp, Homo sapiens
tatacagagcctgttttaaaaaa

SEQ ID NO: 4783536 - DNA, 17 bp, Homo sapiens
tatacatacctctctct

SEQ ID NO: 4783537 - DNA, 15 bp, Homo sapiens
tatacatatgtatgt

SEQ ID NO: 4783538 - DNA, 15 bp, Homo sapiens
tatacatgaaattca

SEQ ID NO: 4783539 - DNA, 15 bp, Homo sapiens
tatacattagacaca

SEQ ID NO: 4783540 - DNA, 20 bp, Homo sapiens
tatacattagacacacatat

SEQ ID NO: 4783541 - DNA, 23 bp, Homo sapiens
tatacattagacacacatataca

SEQ ID NO: 4783542 - DNA, 20 bp, Homo sapiens
tatacattatttctgtatat

SEQ ID NO: 4783543 - DNA, 13 bp, Homo sapiens
tataccagcaaaa

SEQ ID NO: 4783544 - DNA, 13 bp, Homo sapiens
tatactcatttgg

SEQ ID NO: 4783545 - DNA, 15 bp, Homo sapiens
tatactcatttggat

SEQ ID NO: 4783546 - DNA, 12 bp, Homo sapiens
tatactccttaa

SEQ ID NO: 4783547 - DNA, 20 bp, Homo sapiens
tatactccttaaaaatgtat

SEQ ID NO: 4783548 - DNA, 16 bp, Homo sapiens
tatagaaaaaaacatt

SEQ ID NO: 4783549 - DNA, 20 bp, Homo sapiens
tatagaaaaaaacattctat

SEQ ID NO: 4783550 - DNA, 20 bp, Homo sapiens
tatagataaatccaatagtc

SEQ ID NO: 4783551 - DNA, 23 bp, Homo sapiens
tatagattctttattagtgaagt

SEQ ID NO: 4783552 - DNA, 13 bp, Homo sapiens
tatagcatgtaat

SEQ ID NO: 4783553 - DNA, 18 bp, Homo sapiens
tataggaaataaatctaa

SEQ ID NO: 4783554 - DNA, 19 bp, Homo sapiens
tataggacttaatttagca

SEQ ID NO: 4783555 - DNA, 17 bp, Homo sapiens
tatagggtttgtttgct

SEQ ID NO: 4783556 - DNA, 17 bp, Homo sapiens
tatagtgttgtgttaca

SEQ ID NO: 4783557 - DNA, 19 bp, Homo sapiens
tatataaaaaatatatgta

SEQ ID NO: 4783558 - DNA, 19 bp, Homo sapiens
tatatacatattcaaagta

SEQ ID NO: 4783559 - DNA, 13 bp, Homo sapiens
tatatacatgtat

SEQ ID NO: 4783560 - DNA, 16 bp, Homo sapiens
tatatacatgtatagt

SEQ ID NO: 4783561 - DNA, 18 bp, Homo sapiens
tatatacatgtatagtga

SEQ ID NO: 4783562 - DNA, 12 bp, Homo sapiens
tatttactgttt

SEQ ID NO: 4783563 - DNA, 19 bp, Homo sapiens
tatttagtaaaattatctg

SEQ ID NO: 4783564 - DNA, 21 bp, Homo sapiens
tatttagtaaaattatctgtt

SEQ ID NO: 4783565 - DNA, 12 bp, Homo sapiens
tatttataaatg

SEQ ID NO: 4783566 - DNA, 23 bp, Homo sapiens
tatttatattcagagatgtacca

SEQ ID NO: 4783567 - DNA, 13 bp, Homo sapiens
tatttatcacata

SEQ ID NO: 4783568 - DNA, 17 bp, Homo sapiens
tatttatcatatttaat

SEQ ID NO: 4783569 - DNA, 17 bp, Homo sapiens
tatttatcgaaagtaaa

SEQ ID NO: 4783570 - DNA, 16 bp, Homo sapiens
tatttatctgttcaaa

SEQ ID NO: 4783571 - DNA, 12 bp, Homo sapiens
tatttatgatgt

SEQ ID NO: 4783572 - DNA, 17 bp, Homo sapiens
tatttatgggatcctgg

SEQ ID NO: 4783573 - DNA, 21 bp, Homo sapiens
tatttattaaacttcagcaac

SEQ ID NO: 4783574 - DNA, 14 bp, Homo sapiens
tatttcaaccacac

SEQ ID NO: 4783575 - DNA, 21 bp, Homo sapiens
tatttcaaccacacctaaatt

SEQ ID NO: 4783576 - DNA, 15 bp, Homo sapiens
tatttcaatgtaatt

SEQ ID NO: 4783577 - DNA, 11 bp, Homo sapiens
tatttcactta

SEQ ID NO: 4783578 - DNA, 15 bp, Homo sapiens
tatttccatattaaa

SEQ ID NO: 4783579 - DNA, 14 bp, Homo sapiens
tatttcggctatgt

SEQ ID NO: 4783580 - DNA, 14 bp, Homo sapiens
tatttctgtatata

SEQ ID NO: 4783581 - DNA, 23 bp, Homo sapiens
tatttcttcaaatatctctattt

SEQ ID NO: 4783582 - DNA, 13 bp, Homo sapiens
tatttgcttattt

SEQ ID NO: 4783583 - DNA, 18 bp, Homo sapiens
tatttggattcacagcct

SEQ ID NO: 4783584 - DNA, 20 bp, Homo sapiens
tatttggattcacagccttt

SEQ ID NO: 4783585 - DNA, 22 bp, Homo sapiens
tatttggtaacttgctgtgaaa

SEQ ID NO: 4783586 - DNA, 14 bp, Homo sapiens
tatttgtagtgtta

SEQ ID NO: 4783587 - DNA, 14 bp, Homo sapiens
tatttgtatgatat

SEQ ID NO: 4783588 - DNA, 20 bp, Homo sapiens
tatttgtcagtgtagatcaa

SEQ ID NO: 4783589 - DNA, 21 bp, Homo sapiens
tatttgtttagttcagcaaaa

SEQ ID NO: 4783590 - DNA, 13 bp, Homo sapiens
tattttaataaag

SEQ ID NO: 4783591 - DNA, 20 bp, Homo sapiens
tattttagcagttctgcaaa

SEQ ID NO: 4783592 - DNA, 15 bp, Homo sapiens
tattttagttaacta

SEQ ID NO: 4783593 - DNA, 20 bp, Homo sapiens
tattttatataataaagtat

SEQ ID NO: 4783594 - DNA, 21 bp, Homo sapiens
tattttatataataaagtatt

SEQ ID NO: 4783595 - DNA, 15 bp, Homo sapiens
tattttcgcccacct

SEQ ID NO: 4783596 - DNA, 18 bp, Homo sapiens
tattttcgtgcatttgtg

SEQ ID NO: 4783597 - DNA, 21 bp, Homo sapiens
tattttctactttaaattgtg

SEQ ID NO: 4783598 - DNA, 12 bp, Homo sapiens
tattttctatat

SEQ ID NO: 4783599 - DNA, 14 bp, Homo sapiens
tattttgattgttt

SEQ ID NO: 4783600 - DNA, 19 bp, Homo sapiens
tattttgattgtttgatga

SEQ ID NO: 4783601 - DNA, 14 bp, Homo sapiens
tattttgtaaaatg

SEQ ID NO: 4783602 - DNA, 23 bp, Homo sapiens
tattttgtcacccaacctggcat

SEQ ID NO: 4783603 - DNA, 15 bp, Homo sapiens
tattttgtgtccttt

SEQ ID NO: 4783604 - DNA, 12 bp, Homo sapiens
tatttttagaga

SEQ ID NO: 4783605 - DNA, 13 bp, Homo sapiens
tatttttagagat

SEQ ID NO: 4783606 - DNA, 13 bp, Homo sapiens
tatttttcaaaat

SEQ ID NO: 4783607 - DNA, 15 bp, Homo sapiens
tattttttgtaactc

SEQ ID NO: 4783608 - DNA, 16 bp, Homo sapiens
tattttttgtaactct

SEQ ID NO: 4783609 - DNA, 15 bp, Homo sapiens
tattttttgtgaatg

SEQ ID NO: 4783610 - DNA, 15 bp, Homo sapiens
tatttttttaacttt

SEQ ID NO: 4783611 - DNA, 21 bp, Homo sapiens
tatttttttaactttaccatg

SEQ ID NO: 4783612 - DNA, 20 bp, Homo sapiens
tcaaaaaacagaaaaacaaa

SEQ ID NO: 4783613 - DNA, 19 bp, Homo sapiens
tcaaaaatcatcaaagtgt

SEQ ID NO: 4783614 - DNA, 21 bp, Homo sapiens
tcaaaaatcatcaaagtgttt

SEQ ID NO: 4783615 - DNA, 16 bp, Homo sapiens
tcaaaagagatgaaag

SEQ ID NO: 4783616 - DNA, 15 bp, Homo sapiens
tcaaaataatctgaa

SEQ ID NO: 4783617 - DNA, 20 bp, Homo sapiens
tcaaaataatctgaaatgac

SEQ ID NO: 4783618 - DNA, 14 bp, Homo sapiens
tcaaaatattgagc

SEQ ID NO: 4783619 - DNA, 20 bp, Homo sapiens
tcaaaatattgagcagaatt

SEQ ID NO: 4783620 - DNA, 17 bp, Homo sapiens
tcaaaatgtggaccagt

SEQ ID NO: 4783621 - DNA, 19 bp, Homo sapiens
tcaaacactgcttaaggaa

SEQ ID NO: 4783622 - DNA, 22 bp, Homo sapiens
tcaaacagggacactacaaaca

SEQ ID NO: 4783623 - DNA, 17 bp, Homo sapiens
tcaaagaaaacagacca

SEQ ID NO: 4783624 - DNA, 15 bp, Homo sapiens
tcaaagaacccccct

SEQ ID NO: 4783625 - DNA, 17 bp, Homo sapiens
tcaaagaacccccctcc

SEQ ID NO: 4783626 - DNA, 20 bp, Homo sapiens
tcaaagaacccccctcccca

SEQ ID NO: 4783627 - DNA, 14 bp, Homo sapiens
tcaaagaagtactg

SEQ ID NO: 4783628 - DNA, 15 bp, Homo sapiens
tcaaagtcagaacaa

SEQ ID NO: 4783629 - DNA, 18 bp, Homo sapiens
tcaaagtctcaatgaaat

SEQ ID NO: 4783630 - DNA, 20 bp, Homo sapiens
tcaaagtctcaatgaaatag

SEQ ID NO: 4783631 - DNA, 17 bp, Homo sapiens
tcaaagtgcacacacac

SEQ ID NO: 4783632 - DNA, 16 bp, Homo sapiens
tcaaagtgtttaattg

SEQ ID NO: 4783633 - DNA, 16 bp, Homo sapiens
tcaaatagcctttctt

SEQ ID NO: 4783634 - DNA, 15 bp, Homo sapiens
tcaaatccatgtgtc

SEQ ID NO: 4783635 - DNA, 16 bp, Homo sapiens
tcaaatgctaaatgca

SEQ ID NO: 4783636 - DNA, 18 bp, Homo sapiens
tcaaatggatgtaatata

SEQ ID NO: 4783637 - DNA, 18 bp, Homo sapiens
tcaaatgtgtaactttat

SEQ ID NO: 4783638 - DNA, 13 bp, Homo sapiens
tcaaattctgatt

SEQ ID NO: 4783639 - DNA, 14 bp, Homo sapiens
tcaaattctgatta

SEQ ID NO: 4783640 - DNA, 22 bp, Homo sapiens
tcaaatttttctgggaagaaaa

SEQ ID NO: 4783641 - DNA, 14 bp, Homo sapiens
tcaacaaagaaata

SEQ ID NO: 4783642 - DNA, 16 bp, Homo sapiens
tcaacaaagaaatatt

SEQ ID NO: 4783643 - DNA, 18 bp, Homo sapiens
tcaacaaagaaatattat

SEQ ID NO: 4783644 - DNA, 21 bp, Homo sapiens
tcaacaaagaaatattatttg

SEQ ID NO: 4783645 - DNA, 17 bp, Homo sapiens
tcaacaagaagaatttg

SEQ ID NO: 4783646 - DNA, 11 bp, Homo sapiens
tcaacacacag

SEQ ID NO: 4783647 - DNA, 21 bp, Homo sapiens
tcaacacacagtatagataaa

SEQ ID NO: 4783648 - DNA, 16 bp, Homo sapiens
tcaacaggttttcctg

SEQ ID NO: 4783649 - DNA, 17 bp, Homo sapiens
tcaacagtgaacagctt

SEQ ID NO: 4783650 - DNA, 21 bp, Homo sapiens
tcaacatgtgctcgctctgca

SEQ ID NO: 4783651 - DNA, 15 bp, Homo sapiens
tcaaccacacctaaa

SEQ ID NO: 4783652 - DNA, 14 bp, Homo sapiens
tcaaccctgccctg

SEQ ID NO: 4783653 - DNA, 17 bp, Homo sapiens
tcaacctctcagatccc

SEQ ID NO: 4783654 - DNA, 16 bp, Homo sapiens
tcaacctgaattaaag

SEQ ID NO: 4783655 - DNA, 18 bp, Homo sapiens
tcaacctgaattaaagtc
